United States Patent 7,250,496 (BIOINFORMATICALLY DETECTABLE GROUP OF NOVEL REGULATORY GENES AND USES THEREOF) - sequence listing, part 14

SEQ ID NO: 560070 - RNA, 21 nt, Human
ccuuguuggccaggcuggucu

SEQ ID NO: 560071 - RNA, 24 nt, Human
cgccuuguuggccaggcuggucuu

SEQ ID NO: 560072 - RNA, 24 nt, Human
cgcucugucacccaggcuggagug

SEQ ID NO: 560073 - RNA, 21 nt, Human
cgugacugaugcucagagcaa

SEQ ID NO: 560074 - RNA, 23 nt, Human
cucaagugauccaccugccucag

SEQ ID NO: 560075 - RNA, 20 nt, Human
cucacacaucucugcagguc

SEQ ID NO: 560076 - RNA, 27 nt, Human
cucaccacaaccuccaccuccuggguu

SEQ ID NO: 560077 - RNA, 21 nt, Human
cucagccccccaaagugcugg

SEQ ID NO: 560078 - RNA, 24 nt, Human
cucagccuccugaguagcugggau

SEQ ID NO: 560079 - RNA, 19 nt, Human
cucagugcccuucucuucu

SEQ ID NO: 560080 - RNA, 20 nt, Human
cuccagcauccucccuggcc

SEQ ID NO: 560081 - RNA, 21 nt, Human
cucgcucugucacccaggcug

SEQ ID NO: 560082 - RNA, 24 nt, Human
cucgcucugucacccaggcuggag

SEQ ID NO: 560083 - RNA, 25 nt, Human
cucgugccucagccuccugaguagc

SEQ ID NO: 560084 - RNA, 27 nt, Human
cugaagcuguaaccagccucuccacuc

SEQ ID NO: 560085 - RNA, 22 nt, Human
cugaguagcugggauuacaggc

SEQ ID NO: 560086 - RNA, 24 nt, Human
cugaguagcugggauuacaggcgu

SEQ ID NO: 560087 - RNA, 18 nt, Human
cuggguccaacaguaucu

SEQ ID NO: 560088 - RNA, 24 nt, Human
cuucucuagggcuuggcuccgccg

SEQ ID NO: 560089 - RNA, 20 nt, Human
gacaggguuucgccuuguuc

SEQ ID NO: 560090 - RNA, 24 nt, Human
gaccucaagugauccaccugccuc

SEQ ID NO: 560091 - RNA, 21 nt, Human
gaggacauguaucgcaccuuc

SEQ ID NO: 560092 - RNA, 20 nt, Human
gaguagcugggauuacaggc

SEQ ID NO: 560093 - RNA, 24 nt, Human
gaguagcugggauuacaggcgugc

SEQ ID NO: 560094 - RNA, 24 nt, Human
gauuacaggcgugcacuaccaugc

SEQ ID NO: 560095 - RNA, 18 nt, Human
gauuacaggugugaggca

SEQ ID NO: 560096 - RNA, 22 nt, Human
gauuacaggugugaggcaccau

SEQ ID NO: 560097 - RNA, 25 nt, Human
gcucugucacccaggcuggagugca

SEQ ID NO: 560098 - RNA, 19 nt, Human
gcuggagugcaguggcgcg

SEQ ID NO: 560099 - RNA, 23 nt, Human
gcuggucuugaacuccugaccuc

SEQ ID NO: 560100 - RNA, 18 nt, Human
ggauggacagaugggugg

SEQ ID NO: 560101 - RNA, 27 nt, Human
ggauggacagauggguggauggaggaa

SEQ ID NO: 560102 - RNA, 19 nt, Human
ggauggaggaauggauggg

SEQ ID NO: 560103 - RNA, 20 nt, Human
ggccggggcucggggguccc

SEQ ID NO: 560104 - RNA, 21 nt, Human
ggcggauggacagaugggugg

SEQ ID NO: 560105 - RNA, 24 nt, Human
ggcuggucuugaacuccugaccuc

SEQ ID NO: 560106 - RNA, 19 nt, Human
ggucuugaacuccugaccu

SEQ ID NO: 560107 - RNA, 24 nt, Human
gguggccggccggggcucgggggu

SEQ ID NO: 560108 - RNA, 18 nt, Human
guagcugggauuacaggc

SEQ ID NO: 560109 - RNA, 18 nt, Human
guagcugggauuacaggc

SEQ ID NO: 560110 - RNA, 20 nt, Human
gucaaggacagccuggucca

SEQ ID NO: 560111 - RNA, 18 nt, Human
gugauccaccugccucag

SEQ ID NO: 560112 - RNA, 22 nt, Human
gugauccaccugccucagcccc

SEQ ID NO: 560113 - RNA, 22 nt, Human
gugccucagccuccugaguagc

SEQ ID NO: 560114 - RNA, 22 nt, Human
uaaccagccucuccacuccacc

SEQ ID NO: 560115 - RNA, 23 nt, Human
uaauuuuuuuauuuuuaguagag

SEQ ID NO: 560116 - RNA, 24 nt, Human
uaauuuuuuuauuuuuaguagaga

SEQ ID NO: 560117 - RNA, 22 nt, Human
uagagacaggguuucgccuugu

SEQ ID NO: 560118 - RNA, 20 nt, Human
uagggcuuggcuccgccggu

SEQ ID NO: 560119 - RNA, 19 nt, Human
uaguagagacaggguuucg

SEQ ID NO: 560120 - RNA, 26 nt, Human
uaguagagacaggguuucgccuuguu

SEQ ID NO: 560121 - RNA, 18 nt, Human
ucaaggacagccuggucc

SEQ ID NO: 560122 - RNA, 22 nt, Human
ucaagugauccaccugccucag

SEQ ID NO: 560123 - RNA, 24 nt, Human
ucaccacaaccuccaccuccuggg

SEQ ID NO: 560124 - RNA, 27 nt, Human
ucaccacaaccuccaccuccuggguuc

SEQ ID NO: 560125 - RNA, 24 nt, Human
ucacccaggcuggagugcaguggc

SEQ ID NO: 560126 - RNA, 18 nt, Human
ucagccccccaaagugcu

SEQ ID NO: 560127 - RNA, 20 nt, Human
ucagccccccaaagugcugg

SEQ ID NO: 560128 - RNA, 20 nt, Human
ucagccuccugaguagcugg

SEQ ID NO: 560129 - RNA, 18 nt, Human
uccaccugccucagcccc

SEQ ID NO: 560130 - RNA, 18 nt, Human
uccacugagcuggccccg

SEQ ID NO: 560131 - RNA, 24 nt, Human
uccacugagcuggccccgggggug

SEQ ID NO: 560132 - RNA, 18 nt, Human
uccagcauccucccuggc

SEQ ID NO: 560133 - RNA, 24 nt, Human
uccugaguagcugggauuacaggc

SEQ ID NO: 560134 - RNA, 21 nt, Human
uccuggguucaagcaagucuc

SEQ ID NO: 560135 - RNA, 24 nt, Human
uccuggguucaagcaagucucgug

SEQ ID NO: 560136 - RNA, 24 nt, Human
ucgcucugucacccaggcuggagu

SEQ ID NO: 560137 - RNA, 19 nt, Human
ucucgcucugucacccagg

SEQ ID NO: 560138 - RNA, 23 nt, Human
ucucgcucugucacccaggcugg

SEQ ID NO: 560139 - RNA, 24 nt, Human
ucucgcucugucacccaggcugga

SEQ ID NO: 560140 - RNA, 26 nt, Human
ucucgcucugucacccaggcuggagu

SEQ ID NO: 560141 - RNA, 27 nt, Human
ucucgcucugucacccaggcuggagug

SEQ ID NO: 560142 - RNA, 21 nt, Human
ucugaaacaucuguuccacuu

SEQ ID NO: 560143 - RNA, 21 nt, Human
ucugcaggucaaggacagccu

SEQ ID NO: 560144 - RNA, 24 nt, Human
ucugucacccaggcuggagugcag

SEQ ID NO: 560145 - RNA, 28 nt, Human
ucuucuggguccaacaguaucugaaaca

SEQ ID NO: 560146 - RNA, 21 nt, Human
ucuugaacuccugaccucaag

SEQ ID NO: 560147 - RNA, 24 nt, Human
ugaccucaagugauccaccugccu

SEQ ID NO: 560148 - RNA, 20 nt, Human
ugaggcaccauaaccuaccu

SEQ ID NO: 560149 - RNA, 21 nt, Human
ugaggcaccauaaccuaccua

SEQ ID NO: 560150 - RNA, 19 nt, Human
ugcaagagcugaaccccau

SEQ ID NO: 560151 - RNA, 22 nt, Human
ugcaguggcgcgaucucagcuc

SEQ ID NO: 560152 - RNA, 21 nt, Human
ugcccuucucuucugggucca

SEQ ID NO: 560153 - RNA, 24 nt, Human
ugccucagccccccaaagugcugg

SEQ ID NO: 560154 - RNA, 22 nt, Human
ugccucagccuccugaguagcu

SEQ ID NO: 560155 - RNA, 24 nt, Human
ugccucagccuccugaguagcugg

SEQ ID NO: 560156 - RNA, 24 nt, Human
ugcugggauuacaggugugaggca

SEQ ID NO: 560157 - RNA, 19 nt, Human
uggaccacucacagucauc

SEQ ID NO: 560158 - RNA, 23 nt, Human
uggagugcaguggcgcgaucuca

SEQ ID NO: 560159 - RNA, 24 nt, Human
uggagugcaguggcgcgaucucag

SEQ ID NO: 560160 - RNA, 24 nt, Human
uggccaggcuggucuugaacuccu

SEQ ID NO: 560161 - RNA, 24 nt, Human
uggcgcgaucucagcucaccacaa

SEQ ID NO: 560162 - RNA, 22 nt, Human
ugggauuacaggcgugcacuaa

SEQ ID NO: 560163 - RNA, 22 nt, Human
ugggauuacaggcgugcacuac

SEQ ID NO: 560164 - RNA, 24 nt, Human
ugggauuacaggcgugcacuacca

SEQ ID NO: 560165 - RNA, 25 nt, Human
ugggauuacaggcgugcacuaccau

SEQ ID NO: 560166 - RNA, 25 nt, Human
ugggauuacaggcgugcacuaccau

SEQ ID NO: 560167 - RNA, 18 nt, Human
ugggauuacaggugugag

SEQ ID NO: 560168 - RNA, 19 nt, Human
ugggauuacaggugugagg

SEQ ID NO: 560169 - RNA, 22 nt, Human
ugggauuacaggugugaggcac

SEQ ID NO: 560170 - RNA, 23 nt, Human
ugggauuacaggugugaggcacc

SEQ ID NO: 560171 - RNA, 24 nt, Human
ugggauuacaggugugaggcacca

SEQ ID NO: 560172 - RNA, 25 nt, Human
ugggauuacaggugugaggcaccau

SEQ ID NO: 560173 - RNA, 22 nt, Human
ugggcuccaagcucacacaucu

SEQ ID NO: 560174 - RNA, 18 nt, Human
uguacucugccuuuucuu

SEQ ID NO: 560175 - RNA, 21 nt, Human
ugucacccaggcuggagugca

SEQ ID NO: 560176 - RNA, 20 nt, Human
uuacaggugugaggcaccau

SEQ ID NO: 560177 - RNA, 24 nt, Human
uuaguagagacaggguuucgccuu

SEQ ID NO: 560178 - RNA, 25 nt, Human
uuaguagagacaggguuucgccuug

SEQ ID NO: 560179 - RNA, 18 nt, Human
uucucuagggcuuggcuc

SEQ ID NO: 560180 - RNA, 23 nt, Human
uuguuggccaggcuggucuugaa

SEQ ID NO: 560181 - RNA, 20 nt, Human
uuguuguuuuguuuuguuuu

SEQ ID NO: 560182 - RNA, 22 nt, Human
uuucgccuuguuggccaggcug

SEQ ID NO: 560183 - RNA, 24 nt, Human
uuucgccuuguuggccaggcuggu

SEQ ID NO: 560184 - RNA, 23 nt, Human
uuuuauuuuuaguagagacaggg

SEQ ID NO: 560185 - RNA, 23 nt, Human
uuuuuaguagagacaggguuucg

SEQ ID NO: 560186 - RNA, 24 nt, Human
uuuuuaguagagacaggguuucgc

SEQ ID NO: 560187 - RNA, 21 nt, Human
uuuuuuguuguuuuguuuugu

SEQ ID NO: 560188 - RNA, 26 nt, Human
uuuuuuuauuuuuaguagagacaggg

SEQ ID NO: 560189 - RNA, 18 nt, Human
aaacaaacaaacaccagg

SEQ ID NO: 560190 - RNA, 21 nt, Human
aacaggaagggagaaggcaau

SEQ ID NO: 560191 - RNA, 21 nt, Human
aagcauggacagcgggagggg

SEQ ID NO: 560192 - RNA, 20 nt, Human
acaaacaccaggucugcgcu

SEQ ID NO: 560193 - RNA, 18 nt, Human
acaccaggucugcgcugg

SEQ ID NO: 560194 - RNA, 19 nt, Human
acacugugccacugguuga

SEQ ID NO: 560195 - RNA, 23 nt, Human
acaggacagcaugagccacugag

SEQ ID NO: 560196 - RNA, 21 nt, Human
acuugcuggcucagugugggc

SEQ ID NO: 560197 - RNA, 19 nt, Human
agcccaacaaacaaacaaa

SEQ ID NO: 560198 - RNA, 19 nt, Human
aggaaagagaaagggaggg

SEQ ID NO: 560199 - RNA, 22 nt, Human
aggcagggaugagggaacagga

SEQ ID NO: 560200 - RNA, 23 nt, Human
agggaggguaagaugcggagggc

SEQ ID NO: 560201 - RNA, 21 nt, Human
agggcacagguggauggggac

SEQ ID NO: 560202 - RNA, 26 nt, Human
aggguaagaugcggagggcacaggug

SEQ ID NO: 560203 - RNA, 22 nt, Human
agguggauggggacgagggggc

SEQ ID NO: 560204 - RNA, 19 nt, Human
aucugcauggcccuggccc

SEQ ID NO: 560205 - RNA, 19 nt, Human
augagggaacaggaaggga

SEQ ID NO: 560206 - RNA, 23 nt, Human
caaggugggauuccaggaaggcc

SEQ ID NO: 560207 - RNA, 18 nt, Human
cacaccuccucugacgcc

SEQ ID NO: 560208 - RNA, 20 nt, Human
caccuccuccuggccccacc

SEQ ID NO: 560209 - RNA, 21 nt, Human
cagaagccacggccaaggaga

SEQ ID NO: 560210 - RNA, 20 nt, Human
cagcaugagccacugagccg

SEQ ID NO: 560211 - RNA, 26 nt, Human
cauggcccuggcccuguggcuccagc

SEQ ID NO: 560212 - RNA, 19 nt, Human
ccaacaaacaaacaaacac

SEQ ID NO: 560213 - RNA, 20 nt, Human
ccacaugcgcuuaguggggc

SEQ ID NO: 560214 - RNA, 24 nt, Human
ccacccaagggcucgacacaagcc

SEQ ID NO: 560215 - RNA, 22 nt, Human
ccagaggccuccaucugcaugg

SEQ ID NO: 560216 - RNA, 20 nt, Human
ccagcuccugccuccucaca

SEQ ID NO: 560217 - RNA, 23 nt, Human
ccaucugcauggcccuggcccug

SEQ ID NO: 560218 - RNA, 19 nt, Human
cccaacaaacaaacaaaca

SEQ ID NO: 560219 - RNA, 23 nt, Human
cccaaggucggggggagaggggc

SEQ ID NO: 560220 - RNA, 21 nt, Human
cccuggguugccgggguugcc

SEQ ID NO: 560221 - RNA, 20 nt, Human
cccuguggcuccagcaggcu

SEQ ID NO: 560222 - RNA, 25 nt, Human
ccuccucacagacagaagccacggc

SEQ ID NO: 560223 - RNA, 18 nt, Human
ccuccuggccccacccaa

SEQ ID NO: 560224 - RNA, 18 nt, Human
ccuuccgaaggauggagg

SEQ ID NO: 560225 - RNA, 22 nt, Human
ccuuccgaaggauggagguggg

SEQ ID NO: 560226 - RNA, 18 nt, Human
cggaggggccgagaggca

SEQ ID NO: 560227 - RNA, 20 nt, Human
cucacagacagaagccacgg

SEQ ID NO: 560228 - RNA, 21 nt, Human
cucacagacagaagccacggc

SEQ ID NO: 560229 - RNA, 22 nt, Human
cucacaggacagcaugagccac

SEQ ID NO: 560230 - RNA, 18 nt, Human
cucccagaggccuccauc

SEQ ID NO: 560231 - RNA, 22 nt, Human
cuccccagcuccugccuccuca

SEQ ID NO: 560232 - RNA, 20 nt, Human
cucccuggaggugggaacaa

SEQ ID NO: 560233 - RNA, 21 nt, Human
cuccucacagacagaagccac

SEQ ID NO: 560234 - RNA, 20 nt, Human
cuccuccuggccccacccaa

SEQ ID NO: 560235 - RNA, 23 nt, Human
cuccuggccccacccaagggcuc

SEQ ID NO: 560236 - RNA, 23 nt, Human
cuggaggugggaacaagucaccu

SEQ ID NO: 560237 - RNA, 23 nt, Human
cugucccuggaggucugugggcg

SEQ ID NO: 560238 - RNA, 22 nt, Human
gaacaagucaccucugaccaca

SEQ ID NO: 560239 - RNA, 23 nt, Human
gaggaaagagaaagggaggguaa

SEQ ID NO: 560240 - RNA, 18 nt, Human
gaggagagacauggggaa

SEQ ID NO: 560241 - RNA, 23 nt, Human
gccaaggagaggagagacauggg

SEQ ID NO: 560242 - RNA, 18 nt, Human
gccuggggagggccaggc

SEQ ID NO: 560243 - RNA, 26 nt, Human
ggacagcaggacuugcuggcucagug

SEQ ID NO: 560244 - RNA, 23 nt, Human
ggacagcgggaggggagaaggcg

SEQ ID NO: 560245 - RNA, 22 nt, Human
ggagcuguggugcaauuugcuc

SEQ ID NO: 560246 - RNA, 23 nt, Human
ggcaaugaggaaagagaaaggga

SEQ ID NO: 560247 - RNA, 19 nt, Human
ggcacagguggauggggac

SEQ ID NO: 560248 - RNA, 21 nt, Human
gggaacaggaagggagaaggc

SEQ ID NO: 560249 - RNA, 22 nt, Human
gggaugagggaacaggaaggga

SEQ ID NO: 560250 - RNA, 24 nt, Human
gggcggaagcugugggcacaggug

SEQ ID NO: 560251 - RNA, 20 nt, Human
gggcggaggccaagguggga

SEQ ID NO: 560252 - RNA, 22 nt, Human
ggguccugucccuccagguagc

SEQ ID NO: 560253 - RNA, 20 nt, Human
gguccugucccuccagguaa

SEQ ID NO: 560254 - RNA, 21 nt, Human
uaggcucccacuccccagcuc

SEQ ID NO: 560255 - RNA, 21 nt, Human
uccgaaggauggagguggguc

SEQ ID NO: 560256 - RNA, 22 nt, Human
uccucugacgccaucaccuccu

SEQ ID NO: 560257 - RNA, 21 nt, Human
ucugugggcggaagcuguggg

SEQ ID NO: 560258 - RNA, 27 nt, Human
ugagcccaacaaacaaacaaacaccag

SEQ ID NO: 560259 - RNA, 19 nt, Human
ugagccgccuggggagggc

SEQ ID NO: 560260 - RNA, 18 nt, Human
ugaggaaagagaaaggga

SEQ ID NO: 560261 - RNA, 21 nt, Human
ugaggaaagagaaagggaggg

SEQ ID NO: 560262 - RNA, 18 nt, Human
ugagggaacaggaaggga

SEQ ID NO: 560263 - RNA, 23 nt, Human
ugagggaacaggaagggagaagg

SEQ ID NO: 560264 - RNA, 24 nt, Human
uggacagcaggacuugcuggcuca

SEQ ID NO: 560265 - RNA, 18 nt, Human
uggacagcgggaggggag

SEQ ID NO: 560266 - RNA, 23 nt, Human
uggcccuguggcuccagcaggcu

SEQ ID NO: 560267 - RNA, 18 nt, Human
uggcuccagcaggcugcc

SEQ ID NO: 560268 - RNA, 19 nt, Human
ugggaacaagucaccucug

SEQ ID NO: 560269 - RNA, 21 nt, Human
uggggaaggcagggaugaggg

SEQ ID NO: 560270 - RNA, 19 nt, Human
uggguguggacagcaggac

SEQ ID NO: 560271 - RNA, 23 nt, Human
uguggacagcaggacuugcuggc

SEQ ID NO: 560272 - RNA, 22 nt, Human
uuccgaaggauggagguggguc

SEQ ID NO: 560273 - RNA, 20 nt, Human
cacuaccgcaaguuccucua

SEQ ID NO: 560274 - RNA, 24 nt, Human
cucaacauugacgucaccaucaac

SEQ ID NO: 560275 - RNA, 21 nt, Human
gggcuuauuuuucugaggcuu

SEQ ID NO: 560276 - RNA, 21 nt, Human
guuuuuucuuuuuuccuuuug

SEQ ID NO: 560277 - RNA, 23 nt, Human
uccuuuuggugguucaguuucau

SEQ ID NO: 560278 - RNA, 24 nt, Human
uuuuguuuuuucuuuuuuccuuuu

SEQ ID NO: 560279 - RNA, 24 nt, Human
acaaacacugaugauauguuacca

SEQ ID NO: 560280 - RNA, 21 nt, Human
agaagacagcacagaguucau

SEQ ID NO: 560281 - RNA, 23 nt, Human
agagggcauccagcuugcaagag

SEQ ID NO: 560282 - RNA, 23 nt, Human
agcuggucccuugccgugacaca

SEQ ID NO: 560283 - RNA, 20 nt, Human
aggagcaggagagucaucug

SEQ ID NO: 560284 - RNA, 20 nt, Human
aggcaggugagguggcugag

SEQ ID NO: 560285 - RNA, 18 nt, Human
auccaagaccacgcgagg

SEQ ID NO: 560286 - RNA, 21 nt, Human
auuuggggcugggggaacaau

SEQ ID NO: 560287 - RNA, 22 nt, Human
caaauaaaagggggaaaaaucc

SEQ ID NO: 560288 - RNA, 19 nt, Human
cacagaguucaugagcucu

SEQ ID NO: 560289 - RNA, 20 nt, Human
caccaugaauacaaacacug

SEQ ID NO: 560290 - RNA, 21 nt, Human
cacgauacacauuuaacaccc

SEQ ID NO: 560291 - RNA, 19 nt, Human
cagagucugcccaccuuuc

SEQ ID NO: 560292 - RNA, 25 nt, Human
cagcacgauacacauuuaacacccc

SEQ ID NO: 560293 - RNA, 24 nt, Human
cagccucacuguggagccugagau

SEQ ID NO: 560294 - RNA, 19 nt, Human
cccaaugccauggauccau

SEQ ID NO: 560295 - RNA, 21 nt, Human
ccccauguagacaaguuagac

SEQ ID NO: 560296 - RNA, 22 nt, Human
cgagggcuucccugcugccccg

SEQ ID NO: 560297 - RNA, 18 nt, Human
cuccaagauacaaggucc

SEQ ID NO: 560298 - RNA, 23 nt, Human
cuccuggaaucuuaggacaaaua

SEQ ID NO: 560299 - RNA, 19 nt, Human
cugaaacaaaacauuaccu

SEQ ID NO: 560300 - RNA, 22 nt, Human
gaagauucuccaaaugucacac

SEQ ID NO: 560301 - RNA, 18 nt, Human
gagcaggagagucaucug

SEQ ID NO: 560302 - RNA, 20 nt, Human
gagggugcaggaggcucugc

SEQ ID NO: 560303 - RNA, 18 nt, Human
gagucuuuuuaaaaugcu

SEQ ID NO: 560304 - RNA, 25 nt, Human
gauacacauuuaacaccccucaucc

SEQ ID NO: 560305 - RNA, 21 nt, Human
gccacaccaugaauacaaaca

SEQ ID NO: 560306 - RNA, 20 nt, Human
gcccccaggcucuauccuuc

SEQ ID NO: 560307 - RNA, 19 nt, Human
gggaaaaauccaaccucac

SEQ ID NO: 560308 - RNA, 21 nt, Human
gggucucaugcaugcagcuuc

SEQ ID NO: 560309 - RNA, 18 nt, Human
uaaaagggggaaaaaucc

SEQ ID NO: 560310 - RNA, 21 nt, Human
uacaagguccuuuccccgaag

SEQ ID NO: 560311 - RNA, 21 nt, Human
ucacuguggagccugagaugc

SEQ ID NO: 560312 - RNA, 19 nt, Human
uccacagagggcauccagc

SEQ ID NO: 560313 - RNA, 20 nt, Human
uccacagagggcauccagcu

SEQ ID NO: 560314 - RNA, 23 nt, Human
uccagaaagcagagucugcccac

SEQ ID NO: 560315 - RNA, 23 nt, Human
uccagagacaguuugaagcagau

SEQ ID NO: 560316 - RNA, 19 nt, Human
uccagcuugcaagagucug

SEQ ID NO: 560317 - RNA, 22 nt, Human
ucuccaaaugucacacaaggac

SEQ ID NO: 560318 - RNA, 24 nt, Human
ucuuaggaacaacacccagugggc

SEQ ID NO: 560319 - RNA, 18 nt, Human
ucuuaggacaaauaaaag

SEQ ID NO: 560320 - RNA, 20 nt, Human
ucuugcuucgaguagaguug

SEQ ID NO: 560321 - RNA, 18 nt, Human
ugaaacaaaacauuaccu

SEQ ID NO: 560322 - RNA, 23 nt, Human
ugacaugcuuucagagggggcgg

SEQ ID NO: 560323 - RNA, 19 nt, Human
ugaccucacuccaagauac

SEQ ID NO: 560324 - RNA, 20 nt, Human
ugagauaaauguuaagugga

SEQ ID NO: 560325 - RNA, 18 nt, Human
ugcaagagucuguggguc

SEQ ID NO: 560326 - RNA, 21 nt, Human
ugcaaugucgaugccugggcu

SEQ ID NO: 560327 - RNA, 22 nt, Human
ugccacaccaugaauacaaaca

SEQ ID NO: 560328 - RNA, 20 nt, Human
ugcugaaacaaaacauuacc

SEQ ID NO: 560329 - RNA, 20 nt, Human
uggaugccaccuccucugcc

SEQ ID NO: 560330 - RNA, 19 nt, Human
uggcugagcuaucugggcu

SEQ ID NO: 560331 - RNA, 19 nt, Human
uguggagccugagaugcau

SEQ ID NO: 560332 - RNA, 23 nt, Human
uguuaccagaagacagcacagag

SEQ ID NO: 560333 - RNA, 21 nt, Human
uucagagggggcggggaguac

SEQ ID NO: 560334 - RNA, 22 nt, Human
uugacccauauuagggaucuuc

SEQ ID NO: 560335 - RNA, 23 nt, Human
uugcaguuugucagccucacugu

SEQ ID NO: 560336 - RNA, 21 nt, Human
uugggagcuggucccuugcug

SEQ ID NO: 560337 - RNA, 22 nt, Human
acagccaaaaaagacuuugccu

SEQ ID NO: 560338 - RNA, 22 nt, Human
aggggggauguccugauuucug

SEQ ID NO: 560339 - RNA, 20 nt, Human
auugcacuccauucuuccgc

SEQ ID NO: 560340 - RNA, 21 nt, Human
cacagccaaaaaagacuuugc

SEQ ID NO: 560341 - RNA, 22 nt, Human
caccugauaggggggauguccu

SEQ ID NO: 560342 - RNA, 22 nt, Human
cccgcgcccauuggcaaccagg

SEQ ID NO: 560343 - RNA, 24 nt, Human
ccgccuuccuuguuuucuccaaaa

SEQ ID NO: 560344 - RNA, 18 nt, Human
ccgcgcccauuggcaacc

SEQ ID NO: 560345 - RNA, 20 nt, Human
ccugccccccuuucugcuca

SEQ ID NO: 560346 - RNA, 22 nt, Human
ccugugguuuaagcaguggagc

SEQ ID NO: 560347 - RNA, 19 nt, Human
cugugguuuaagcagugga

SEQ ID NO: 560348 - RNA, 18 nt, Human
gggauguccugauuucug

SEQ ID NO: 560349 - RNA, 19 nt, Human
ggggauguccugauuucug

SEQ ID NO: 560350 - RNA, 22 nt, Human
gugaggaguuaaccagguccug

SEQ ID NO: 560351 - RNA, 20 nt, Human
uaaaugauuuauuccagcca

SEQ ID NO: 560352 - RNA, 19 nt, Human
ugaggaguuaaccaggucc

SEQ ID NO: 560353 - RNA, 27 nt, Human
uggcuaaaagagucucucucuaaguau

SEQ ID NO: 560354 - RNA, 24 nt, Human
uuccagccacagccaaaaaagacu

SEQ ID NO: 560355 - RNA, 19 nt, Human
uuccuuguuuucuccaaaa

SEQ ID NO: 560356 - RNA, 23 nt, Human
uugaacguauuuuaaauagcaug

SEQ ID NO: 560357 - RNA, 18 nt, Human
aacacagaaacugcacca

SEQ ID NO: 560358 - RNA, 22 nt, Human
aaccugcuuuauuaacacagaa

SEQ ID NO: 560359 - RNA, 21 nt, Human
aacuucucccuccugcgcccc

SEQ ID NO: 560360 - RNA, 21 nt, Human
aagucacuuucugauaacuca

SEQ ID NO: 560361 - RNA, 18 nt, Human
acacagaaacugcaccac

SEQ ID NO: 560362 - RNA, 24 nt, Human
acagaaacugcaccaaccccgggg

SEQ ID NO: 560363 - RNA, 18 nt, Human
acgcuuugugugccucug

SEQ ID NO: 560364 - RNA, 25 nt, Human
acgcuuugugugccucugaucagua

SEQ ID NO: 560365 - RNA, 18 nt, Human
acucagguugccccuccu

SEQ ID NO: 560366 - RNA, 19 nt, Human
agaaaaagagggagcagag

SEQ ID NO: 560367 - RNA, 19 nt, Human
agagaagggagaaaaagag

SEQ ID NO: 560368 - RNA, 24 nt, Human
agggagaaaaagagggagcagagg

SEQ ID NO: 560369 - RNA, 21 nt, Human
agggguucccggugucugggc

SEQ ID NO: 560370 - RNA, 22 nt, Human
caacuucucccuccugcgcccc

SEQ ID NO: 560371 - RNA, 25 nt, Human
cacuuccagccuccugggucagggg

SEQ ID NO: 560372 - RNA, 26 nt, Human
cagaaacugcaccacacaaccuucag

SEQ ID NO: 560373 - RNA, 19 nt, Human
cagacccagcacuuagcaa

SEQ ID NO: 560374 - RNA, 22 nt, Human
cagcacuccgcuggcagggaga

SEQ ID NO: 560375 - RNA, 18 nt, Human
cagccuccugggucaggg

SEQ ID NO: 560376 - RNA, 19 nt, Human
cagcuacuucccaaacagc

SEQ ID NO: 560377 - RNA, 18 nt, Human
caguguccugccucggcc

SEQ ID NO: 560378 - RNA, 18 nt, Human
cccagcucucucccaaca

SEQ ID NO: 560379 - RNA, 24 nt, Human
cccagcucucucccaacaucuucc

SEQ ID NO: 560380 - RNA, 19 nt, Human
cccucugaaaagcuggcug

SEQ ID NO: 560381 - RNA, 23 nt, Human
cccuuggccuucuuuccuuccca

SEQ ID NO: 560382 - RNA, 22 nt, Human
ccuccugggucagggguucccg

SEQ ID NO: 560383 - RNA, 18 nt, Human
ccucggccaucugcugug

SEQ ID NO: 560384 - RNA, 18 nt, Human
ccucugcaguguccugcc

SEQ ID NO: 560385 - RNA, 24 nt, Human
cgccccagagaagggagaaaaaga

SEQ ID NO: 560386 - RNA, 23 nt, Human
cgcucugccccagcucucuccca

SEQ ID NO: 560387 - RNA, 18 nt, Human
cgcuuugugugccucuga

SEQ ID NO: 560388 - RNA, 22 nt, Human
cggcccagcacuccgcuggcag

SEQ ID NO: 560389 - RNA, 24 nt, Human
cuagagaucucuucauuaucuucc

SEQ ID NO: 560390 - RNA, 19 nt, Human
cuccccgcucugccccagc

SEQ ID NO: 560391 - RNA, 19 nt, Human
cucugccccagcucucucc

SEQ ID NO: 560392 - RNA, 20 nt, Human
cugcaguguccugccucggc

SEQ ID NO: 560393 - RNA, 19 nt, Human
cugccccagcucucuccca

SEQ ID NO: 560394 - RNA, 25 nt, Human
cuggaccccacugucaccccugccg

SEQ ID NO: 560395 - RNA, 25 nt, Human
cuguggauuuccugccuagagaucu

SEQ ID NO: 560396 - RNA, 22 nt, Human
cuucauuaucuuccucugcagu

SEQ ID NO: 560397 - RNA, 21 nt, Human
cuucuuuccuucccauucugg

SEQ ID NO: 560398 - RNA, 18 nt, Human
cuuggccuucuuuccuuc

SEQ ID NO: 560399 - RNA, 23 nt, Human
gaaucugaauucccuuggccuuc

SEQ ID NO: 560400 - RNA, 18 nt, Human
gcagcuccccgcucugcc

SEQ ID NO: 560401 - RNA, 20 nt, Human
gccccagcucucucccaaca

SEQ ID NO: 560402 - RNA, 20 nt, Human
gcgccccagagaagggagaa

SEQ ID NO: 560403 - RNA, 19 nt, Human
gcucuucuuucgcagauga

SEQ ID NO: 560404 - RNA, 18 nt, Human
gcugcagcuccccgcucu

SEQ ID NO: 560405 - RNA, 23 nt, Human
ggaccccacugucaccccugccg

SEQ ID NO: 560406 - RNA, 22 nt, Human
ggccuugcucuggggagcuuua

SEQ ID NO: 560407 - RNA, 25 nt, Human
gggagaaaaagagggagcagaggag

SEQ ID NO: 560408 - RNA, 25 nt, Human
ggggacacuuccagccuccuggguc

SEQ ID NO: 560409 - RNA, 20 nt, Human
gguccaggucacuggaggcu

SEQ ID NO: 560410 - RNA, 23 nt, Human
uaacaaauacugaaagcuuagga

SEQ ID NO: 560411 - RNA, 24 nt, Human
uagcaacuucucccuccugcgccc

SEQ ID NO: 560412 - RNA, 21 nt, Human
ucacuggaggcuucguccuca

SEQ ID NO: 560413 - RNA, 18 nt, Human
ucagggguucccgguguc

SEQ ID NO: 560414 - RNA, 24 nt, Human
ucccaaacagcgccacggggaagu

SEQ ID NO: 560415 - RNA, 20 nt, Human
ucccggugucugggcucuuc

SEQ ID NO: 560416 - RNA, 22 nt, Human
uccuggaccccacugucacccc

SEQ ID NO: 560417 - RNA, 21 nt, Human
ucuuucacaauaacaaauacu

SEQ ID NO: 560418 - RNA, 23 nt, Human
ugaaccucauagccaaugaacag

SEQ ID NO: 560419 - RNA, 23 nt, Human
ugcucuggggagcuuuaaauuuu

SEQ ID NO: 560420 - RNA, 20 nt, Human
uggaccccacugucaccccu

SEQ ID NO: 560421 - RNA, 27 nt, Human
ugggucagggguucccggugucugggc

SEQ ID NO: 560422 - RNA, 18 nt, Human
uucgcagaugaggggcag

SEQ ID NO: 560423 - RNA, 21 nt, Human
uucgcagaugaggggcaggcc

SEQ ID NO: 560424 - RNA, 19 nt, Human
uucuuuggcacuguucuaa

SEQ ID NO: 560425 - RNA, 18 nt, Human
uuuuuuuuuuuuuuuucg

SEQ ID NO: 560426 - RNA, 22 nt, Human
uuuuuuuuuuuuuuuuucgacu

SEQ ID NO: 560427 - RNA, 21 nt, Human
aaacaggagguugaagacaga

SEQ ID NO: 560428 - RNA, 19 nt, Human
aaacggaaagucugaaaac

SEQ ID NO: 560429 - RNA, 24 nt, Human
aaagugcugggauuacaggcauga

SEQ ID NO: 560430 - RNA, 21 nt, Human
aacaagcagauagcuaggucu

SEQ ID NO: 560431 - RNA, 24 nt, Human
aacucaaccuuccuuucuuccacc

SEQ ID NO: 560432 - RNA, 22 nt, Human
aagcguggcguugccagggaca

SEQ ID NO: 560433 - RNA, 24 nt, Human
aagggcuuugcacuguccaccuuu

SEQ ID NO: 560434 - RNA, 19 nt, Human
aaggggaccuuuagcugau

SEQ ID NO: 560435 - RNA, 20 nt, Human
aaguagcugggacuauaggu

SEQ ID NO: 560436 - RNA, 24 nt, Human
aaguagcugggacuauaggugugu

SEQ ID NO: 560437 - RNA, 24 nt, Human
aagugauccacuugccucagccuc

SEQ ID NO: 560438 - RNA, 19 nt, Human
aagugcugggauuacaggc

SEQ ID NO: 560439 - RNA, 21 nt, Human
aagugcugggauuacaggcau

SEQ ID NO: 560440 - RNA, 26 nt, Human
aagugcugggauuacaggcaugaacc

SEQ ID NO: 560441 - RNA, 24 nt, Human
accauguuggccaggcuggucuug

SEQ ID NO: 560442 - RNA, 22 nt, Human
acucugcugccaaggggccagg

SEQ ID NO: 560443 - RNA, 25 nt, Human
acuguguugcccaggcuggagugca

SEQ ID NO: 560444 - RNA, 18 nt, Human
agauuuucuuccagaccu

SEQ ID NO: 560445 - RNA, 24 nt, Human
agcgauucuccugccucagccucc

SEQ ID NO: 560446 - RNA, 19 nt, Human
aggcaugaaccacugcacc

SEQ ID NO: 560447 - RNA, 25 nt, Human
aggcuggagugcaguggugcgaucu

SEQ ID NO: 560448 - RNA, 24 nt, Human
agggaaauauugguucaugugaug

SEQ ID NO: 560449 - RNA, 19 nt, Human
agggauccagggcagucag

SEQ ID NO: 560450 - RNA, 20 nt, Human
aggugugugccaccaccacc

SEQ ID NO: 560451 - RNA, 19 nt, Human
agugacucaacacagacaa

SEQ ID NO: 560452 - RNA, 24 nt, Human
agugauccacuugccucagccucc

SEQ ID NO: 560453 - RNA, 21 nt, Human
agugcaguggugcgaucucag

SEQ ID NO: 560454 - RNA, 23 nt, Human
agugcaguggugcgaucucagcu

SEQ ID NO: 560455 - RNA, 24 nt, Human
agugcaguggugcgaucucagcuc

SEQ ID NO: 560456 - RNA, 18 nt, Human
agugcugggauuacaggc

SEQ ID NO: 560457 - RNA, 25 nt, Human
aguggugcgaucucagcucacuugc

SEQ ID NO: 560458 - RNA, 22 nt, Human
auaaggaaacaggagguugaag

SEQ ID NO: 560459 - RNA, 24 nt, Human
augagguuacaccauguuggccag

SEQ ID NO: 560460 - RNA, 19 nt, Human
augcacagaaagauuuugc

SEQ ID NO: 560461 - RNA, 24 nt, Human
auguggaccagcugacagaggcuu

SEQ ID NO: 560462 - RNA, 21 nt, Human
auucuccuuaagcuuucauua

SEQ ID NO: 560463 - RNA, 24 nt, Human
auuuuuguauuuuuaguagagaug

SEQ ID NO: 560464 - RNA, 20 nt, Human
caaaaugcucuaaaaaauaa

SEQ ID NO: 560465 - RNA, 22 nt, Human
caaaguaagaucauauccugcc

SEQ ID NO: 560466 - RNA, 24 nt, Human
caaagugcugggauuacaggcaug

SEQ ID NO: 560467 - RNA, 18 nt, Human
caaccuccaccuccuggg

SEQ ID NO: 560468 - RNA, 23 nt, Human
caaccuccaccuccuggguucaa

SEQ ID NO: 560469 - RNA, 22 nt, Human
caagcgauucuccugccucagc

SEQ ID NO: 560470 - RNA, 27 nt, Human
caagcgauucuccugccucagccuccc

SEQ ID NO: 560471 - RNA, 22 nt, Human
caagugauccacuugccucagc

SEQ ID NO: 560472 - RNA, 24 nt, Human
caccaccaccggcuaauuuuugua

SEQ ID NO: 560473 - RNA, 18 nt, Human
caccauguuggccaggcu

SEQ ID NO: 560474 - RNA, 21 nt, Human
caccauguuggccaggcuggu

SEQ ID NO: 560475 - RNA, 23 nt, Human
caccauguuggccaggcuggucu

SEQ ID NO: 560476 - RNA, 24 nt, Human
caccauguuggccaggcuggucuu

SEQ ID NO: 560477 - RNA, 27 nt, Human
caccauguuggccaggcuggucuugaa

SEQ ID NO: 560478 - RNA, 18 nt, Human
cacuguguugcccaggcu

SEQ ID NO: 560479 - RNA, 24 nt, Human
cacuguguugcccaggcuggagug

SEQ ID NO: 560480 - RNA, 24 nt, Human
cacuugcaaccuccaccuccuggg

SEQ ID NO: 560481 - RNA, 25 nt, Human
cagagccugggagagggauccaggg

SEQ ID NO: 560482 - RNA, 24 nt, Human
cagagucucacuguguugcccagg

SEQ ID NO: 560483 - RNA, 19 nt, Human
cagcagcuggaacuggcaa

SEQ ID NO: 560484 - RNA, 19 nt, Human
caucaccaaauagccuaga

SEQ ID NO: 560485 - RNA, 23 nt, Human
caugcacagaaagauuuugcaug

SEQ ID NO: 560486 - RNA, 24 nt, Human
cauguuggccaggcuggucuugaa

SEQ ID NO: 560487 - RNA, 23 nt, Human
ccaaagugcugggauuacaggca

SEQ ID NO: 560488 - RNA, 24 nt, Human
ccaaagugcugggauuacaggcau

SEQ ID NO: 560489 - RNA, 19 nt, Human
ccaccggcuaauuuuugua

SEQ ID NO: 560490 - RNA, 24 nt, Human
ccaccuccuggguucaagcgauuc

SEQ ID NO: 560491 - RNA, 22 nt, Human
ccauauccucacuauugcaaaa

SEQ ID NO: 560492 - RNA, 22 nt, Human
ccauguggacugagaaccagga

SEQ ID NO: 560493 - RNA, 24 nt, Human
cccaaagugcugggauuacaggca

SEQ ID NO: 560494 - RNA, 19 nt, Human
cccaaguagcugggacuau

SEQ ID NO: 560495 - RNA, 24 nt, Human
cccaaguagcugggacuauaggug

SEQ ID NO: 560496 - RNA, 19 nt, Human
ccuccaccuccuggguuca

SEQ ID NO: 560497 - RNA, 24 nt, Human
ccuccuggguucaagcgauucucc

SEQ ID NO: 560498 - RNA, 20 nt, Human
ccugaccucaagugauccac

SEQ ID NO: 560499 - RNA, 23 nt, Human
ccugaccucaagugauccacuug

SEQ ID NO: 560500 - RNA, 23 nt, Human
ccugaccucaagugauccacuug

SEQ ID NO: 560501 - RNA, 23 nt, Human
ccugccucagccucccaaguagc

SEQ ID NO: 560502 - RNA, 20 nt, Human
ccugccuuguuuucucuggg

SEQ ID NO: 560503 - RNA, 19 nt, Human
ccuggaagaaaugccuggu

SEQ ID NO: 560504 - RNA, 23 nt, Human
ccuggguucaagcgauucuccug

SEQ ID NO: 560505 - RNA, 23 nt, Human
cucaagugauccacuugccucag

SEQ ID NO: 560506 - RNA, 24 nt, Human
cucagccucccaaguagcugggac

SEQ ID NO: 560507 - RNA, 22 nt, Human
cucauagcagcccuaugaaguc

SEQ ID NO: 560508 - RNA, 23 nt, Human
cuccaucuuuagagauaaggaaa

SEQ ID NO: 560509 - RNA, 21 nt, Human
cuccuggguucaagcgauucu

SEQ ID NO: 560510 - RNA, 21 nt, Human
cucugugggaugucagaagac

SEQ ID NO: 560511 - RNA, 24 nt, Human
cucuuccuuucccuuugaacaucc

SEQ ID NO: 560512 - RNA, 23 nt, Human
cugccucagccucccaaguagcu

SEQ ID NO: 560513 - RNA, 23 nt, Human
cuuaaaaccugggcacaaaagac

SEQ ID NO: 560514 - RNA, 23 nt, Human
cuuccacccucauccauauccuc

SEQ ID NO: 560515 - RNA, 22 nt, Human
cuuccuuucccuuugaacaucc

SEQ ID NO: 560516 - RNA, 25 nt, Human
cuugcaugccuuugggcagucuguu

SEQ ID NO: 560517 - RNA, 22 nt, Human
cuuugccucuuccuuucccuuu

SEQ ID NO: 560518 - RNA, 22 nt, Human
gaaccucuucucguuggaaacg

SEQ ID NO: 560519 - RNA, 24 nt, Human
gaccucaagugauccacuugccuc

SEQ ID NO: 560520 - RNA, 22 nt, Human
gagguuacaccauguuggccag

SEQ ID NO: 560521 - RNA, 22 nt, Human
gaucauaagggcagcagcugga

SEQ ID NO: 560522 - RNA, 23 nt, Human
gauuacaggcaugaaccacugca

SEQ ID NO: 560523 - RNA, 24 nt, Human
gcgauucuccugccucagccuccc

SEQ ID NO: 560524 - RNA, 19 nt, Human
gcggaagcguggcguugcc

SEQ ID NO: 560525 - RNA, 23 nt, Human
gcuggucuugaacuccugaccuc

SEQ ID NO: 560526 - RNA, 21 nt, Human
ggaaacggaaagucugaaaac

SEQ ID NO: 560527 - RNA, 20 nt, Human
ggaaagucugaaaacuuaga

SEQ ID NO: 560528 - RNA, 24 nt, Human
ggcuggucuugaacuccugaccuc

SEQ ID NO: 560529 - RNA, 22 nt, Human
gggcagucuguugagauuauuc

SEQ ID NO: 560530 - RNA, 22 nt, Human
gggccagagccugggagaggga

SEQ ID NO: 560531 - RNA, 24 nt, Human
gguccuggaagaaaugccugguag

SEQ ID NO: 560532 - RNA, 19 nt, Human
ggucuugaacuccugaccu

SEQ ID NO: 560533 - RNA, 18 nt, Human
gguuacaccauguuggcc

SEQ ID NO: 560534 - RNA, 20 nt, Human
guccuggaagaaaugccugg

SEQ ID NO: 560535 - RNA, 18 nt, Human
gugaacaagcagauagcu

SEQ ID NO: 560536 - RNA, 18 nt, Human
gugauccacuugccucag

SEQ ID NO: 560537 - RNA, 24 nt, Human
gugauccacuugccucagccuccc

SEQ ID NO: 560538 - RNA, 18 nt, Human
uaagggaaauauugguuc

SEQ ID NO: 560539 - RNA, 18 nt, Human
uaagggaaauauugguuc

SEQ ID NO: 560540 - RNA, 24 nt, Human
uaauuuuuguauuuuuaguagaga

SEQ ID NO: 560541 - RNA, 22 nt, Human
uacaggcaugaaccacugcacc

SEQ ID NO: 560542 - RNA, 18 nt, Human
uacaggguuugguuuaaa

SEQ ID NO: 560543 - RNA, 20 nt, Human
uacccucucauggauauucu

SEQ ID NO: 560544 - RNA, 22 nt, Human
uagagaugagguuacaccaugu

SEQ ID NO: 560545 - RNA, 19 nt, Human
uagaguggugauauuaccu

SEQ ID NO: 560546 - RNA, 22 nt, Human
uagaguggugauauuaccuauu

SEQ ID NO: 560547 - RNA, 23 nt, Human
uagaguggugauauuaccuauuu

SEQ ID NO: 560548 - RNA, 19 nt, Human
uaggugaugcaugcacaga

SEQ ID NO: 560549 - RNA, 25 nt, Human
uaggugugugccaccaccaccggcu

SEQ ID NO: 560550 - RNA, 24 nt, Human
uaguagagaugagguuacaccaug

SEQ ID NO: 560551 - RNA, 18 nt, Human
uauccugccuuguuuucu

SEQ ID NO: 560552 - RNA, 20 nt, Human
uauucuuccauguggacuga

SEQ ID NO: 560553 - RNA, 21 nt, Human
ucaaauguggaccagcugaca

SEQ ID NO: 560554 - RNA, 20 nt, Human
ucaacacagacaacaaaaag

SEQ ID NO: 560555 - RNA, 19 nt, Human
ucaagcgauucuccugccu

SEQ ID NO: 560556 - RNA, 22 nt, Human
ucaagugauccacuugccucag

SEQ ID NO: 560557 - RNA, 20 nt, Human
ucagccucccaaguagcugg

SEQ ID NO: 560558 - RNA, 23 nt, Human
ucauggauauucuuccaugugga

SEQ ID NO: 560559 - RNA, 24 nt, Human
ucccaaagugcugggauuacaggc

SEQ ID NO: 560560 - RNA, 24 nt, Human
ucccaaguagcugggacuauaggu

SEQ ID NO: 560561 - RNA, 23 nt, Human
ucccuaugcccuggauuaacaaa

SEQ ID NO: 560562 - RNA, 22 nt, Human
uccucacuauugcaaaaugcuc

SEQ ID NO: 560563 - RNA, 21 nt, Human
uccuggguucaagcgauucuc

SEQ ID NO: 560564 - RNA, 24 nt, Human
uccuggguucaagcgauucuccug

SEQ ID NO: 560565 - RNA, 19 nt, Human
ucucacuguguugcccagg

SEQ ID NO: 560566 - RNA, 23 nt, Human
ucucacuguguugcccaggcugg

SEQ ID NO: 560567 - RNA, 24 nt, Human
ucucacuguguugcccaggcugga

SEQ ID NO: 560568 - RNA, 26 nt, Human
ucucacuguguugcccaggcuggagu

SEQ ID NO: 560569 - RNA, 26 nt, Human
ucuccugccucagccucccaaguagc

SEQ ID NO: 560570 - RNA, 19 nt, Human
ucugaaauauucucaccaa

SEQ ID NO: 560571 - RNA, 26 nt, Human
ucuguugagauuauucuccuuuaguu

SEQ ID NO: 560572 - RNA, 21 nt, Human
ucuugaacuccugaccucaag

SEQ ID NO: 560573 - RNA, 24 nt, Human
ugaaaacuuagauuuucuuccaga

SEQ ID NO: 560574 - RNA, 24 nt, Human
ugaaccacugcaccuggagagccc

SEQ ID NO: 560575 - RNA, 21 nt, Human
ugaagucaucaaguagguggg

SEQ ID NO: 560576 - RNA, 19 nt, Human
ugaauauuauucauuuguu

SEQ ID NO: 560577 - RNA, 19 nt, Human
ugaccucaagugauccacu

SEQ ID NO: 560578 - RNA, 20 nt, Human
ugaccucaagugauccacuu

SEQ ID NO: 560579 - RNA, 24 nt, Human
ugaccucaagugauccacuugccu

SEQ ID NO: 560580 - RNA, 20 nt, Human
ugacucaacacagacaacaa

SEQ ID NO: 560581 - RNA, 23 nt, Human
ugacucaacacagacaacaaaaa

SEQ ID NO: 560582 - RNA, 24 nt, Human
ugagguuacaccauguuggccagg

SEQ ID NO: 560583 - RNA, 22 nt, Human
ugcaguggugcgaucucagcuc

SEQ ID NO: 560584 - RNA, 18 nt, Human
ugcccaggcuggagugca

SEQ ID NO: 560585 - RNA, 21 nt, Human
ugcccaggcuggagugcagug

SEQ ID NO: 560586 - RNA, 24 nt, Human
ugcccaggcuggagugcaguggug

SEQ ID NO: 560587 - RNA, 22 nt, Human
ugccucagccucccaaagugcu

SEQ ID NO: 560588 - RNA, 24 nt, Human
ugccucagccucccaaagugcugg

SEQ ID NO: 560589 - RNA, 24 nt, Human
ugccucagccucccaaguagcugg

SEQ ID NO: 560590 - RNA, 22 nt, Human
ugccugguagaauacugagagg

SEQ ID NO: 560591 - RNA, 25 nt, Human
ugccugguagaauacugagagggcg

SEQ ID NO: 560592 - RNA, 22 nt, Human
ugcucuaaaaaauaauuuuagg

SEQ ID NO: 560593 - RNA, 23 nt, Human
ugcugggauuacaggcaugaacc

SEQ ID NO: 560594 - RNA, 21 nt, Human
uggagagcccacugcuucuug

SEQ ID NO: 560595 - RNA, 23 nt, Human
uggagugcaguggugcgaucuca

SEQ ID NO: 560596 - RNA, 24 nt, Human
uggagugcaguggugcgaucucag

SEQ ID NO: 560597 - RNA, 24 nt, Human
uggccaggcuggucuugaacuccu

SEQ ID NO: 560598 - RNA, 21 nt, Human
ugggacuauaggugugugcca

SEQ ID NO: 560599 - RNA, 22 nt, Human
ugggacuauaggugugugccac

SEQ ID NO: 560600 - RNA, 24 nt, Human
ugggacuauaggugugugccacca

SEQ ID NO: 560601 - RNA, 21 nt, Human
ugggauuacaggcaugaacca

SEQ ID NO: 560602 - RNA, 22 nt, Human
ugggauuacaggcaugaaccac

SEQ ID NO: 560603 - RNA, 24 nt, Human
ugggauuacaggcaugaaccacug

SEQ ID NO: 560604 - RNA, 24 nt, Human
ugggauuacaggcaugaaccacug

SEQ ID NO: 560605 - RNA, 23 nt, Human
uggguucaagcgauucuccugcc

SEQ ID NO: 560606 - RNA, 23 nt, Human
ugguccuggaagaaaugccuggu

SEQ ID NO: 560607 - RNA, 25 nt, Human
uggugcgaucucagcucacuugcaa

SEQ ID NO: 560608 - RNA, 24 nt, Human
ugugugccaccaccaccggcuaau

SEQ ID NO: 560609 - RNA, 18 nt, Human
uguguugcccaggcugga

SEQ ID NO: 560610 - RNA, 22 nt, Human
uguguugcccaggcuggagugc

SEQ ID NO: 560611 - RNA, 24 nt, Human
uguguugcccaggcuggagugcag

SEQ ID NO: 560612 - RNA, 24 nt, Human
uuaacaucaccaaauagccuagag

SEQ ID NO: 560613 - RNA, 24 nt, Human
uuaguagagaugagguuacaccau

SEQ ID NO: 560614 - RNA, 21 nt, Human
uucaagcgauucuccugccuc

SEQ ID NO: 560615 - RNA, 23 nt, Human
uucaagcgauucuccugccucag

SEQ ID NO: 560616 - RNA, 24 nt, Human
uucaagcgauucuccugccucagc

SEQ ID NO: 560617 - RNA, 18 nt, Human
uuccacucgaagcuggag

SEQ ID NO: 560618 - RNA, 18 nt, Human
uugcaaccuccaccuccu

SEQ ID NO: 560619 - RNA, 23 nt, Human
uugcaaccuccaccuccuggguu

SEQ ID NO: 560620 - RNA, 24 nt, Human
uugcaaccuccaccuccuggguuc

SEQ ID NO: 560621 - RNA, 23 nt, Human
uugcaugcuccucuuugccucuu

SEQ ID NO: 560622 - RNA, 24 nt, Human
uugcccaggcuggagugcaguggu

SEQ ID NO: 560623 - RNA, 24 nt, Human
uugccucagccucccaaagugcug

SEQ ID NO: 560624 - RNA, 21 nt, Human
uuguuaacaucaccaaauagc

SEQ ID NO: 560625 - RNA, 18 nt, Human
uuuacugagcaucuccua

SEQ ID NO: 560626 - RNA, 24 nt, Human
uuuguucuggcaacacucugcugc

SEQ ID NO: 560627 - RNA, 20 nt, Human
uuuuuaguagagaugagguu

SEQ ID NO: 560628 - RNA, 20 nt, Human
uuuuuguauuuuuaguagag

SEQ ID NO: 560629 - RNA, 21 nt, Human
aacacuuuauugcacaaaucc

SEQ ID NO: 560630 - RNA, 20 nt, Human
aacgucuucuguggagugug

SEQ ID NO: 560631 - RNA, 20 nt, Human
acaggcagaaagcuggcccg

SEQ ID NO: 560632 - RNA, 21 nt, Human
acccuggccucacaugccaac

SEQ ID NO: 560633 - RNA, 18 nt, Human
agcagugccggcaggcag

SEQ ID NO: 560634 - RNA, 24 nt, Human
agcccacagccccaaccugucccc

SEQ ID NO: 560635 - RNA, 20 nt, Human
agggcaaaggucacaggcag

SEQ ID NO: 560636 - RNA, 23 nt, Human
cacaaaucccacaaaggucucuu

SEQ ID NO: 560637 - RNA, 21 nt, Human
cacagccccaaccuguccccu

SEQ ID NO: 560638 - RNA, 19 nt, Human
cacccuggccucacaugcc

SEQ ID NO: 560639 - RNA, 21 nt, Human
cagcagugccggcaggcagac

SEQ ID NO: 560640 - RNA, 18 nt, Human
cagccccaaccugucccc

SEQ ID NO: 560641 - RNA, 27 nt, Human
caggcagguccuucccuagguaggucc

SEQ ID NO: 560642 - RNA, 20 nt, Human
caggcccuggguccaagccc

SEQ ID NO: 560643 - RNA, 25 nt, Human
ccacaaguagucaggcacuguggca

SEQ ID NO: 560644 - RNA, 25 nt, Human
ccacagccccaaccuguccccuggc

SEQ ID NO: 560645 - RNA, 20 nt, Human
ccagcagugccggcaggcag

SEQ ID NO: 560646 - RNA, 22 nt, Human
ccaggacagggcaaaggucaca

SEQ ID NO: 560647 - RNA, 23 nt, Human
cccaaagcuggacccuccaggac

SEQ ID NO: 560648 - RNA, 21 nt, Human
cccacagaggacccggggucc

SEQ ID NO: 560649 - RNA, 19 nt, Human
cccacccuggccucacaug

SEQ ID NO: 560650 - RNA, 20 nt, Human
ccccagaggagcaaagaggg

SEQ ID NO: 560651 - RNA, 22 nt, Human
cccgaggugcagcugccccaga

SEQ ID NO: 560652 - RNA, 22 nt, Human
cccuggguccaagcccacagcc

SEQ ID NO: 560653 - RNA, 23 nt, Human
cccuggguccaagcccacagccc

SEQ ID NO: 560654 - RNA, 21 nt, Human
ccucacaugccaacgucuucu

SEQ ID NO: 560655 - RNA, 21 nt, Human
ccuccaggacagggcaaaggu

SEQ ID NO: 560656 - RNA, 25 nt, Human
ccuguccccuggcucugggccuggu

SEQ ID NO: 560657 - RNA, 19 nt, Human
gcccacagccccaaccugu

SEQ ID NO: 560658 - RNA, 18 nt, Human
gccccagaggagcaaaga

SEQ ID NO: 560659 - RNA, 22 nt, Human
gcucugggccuggucuuuggug

SEQ ID NO: 560660 - RNA, 19 nt, Human
guggagugugcaggugucc

SEQ ID NO: 560661 - RNA, 25 nt, Human
uaaaaacacuuuauugcacaaaucc

SEQ ID NO: 560662 - RNA, 18 nt, Human
ucaaaacagcucagcacu

SEQ ID NO: 560663 - RNA, 19 nt, Human
ucagcccaaagcuggaccc

SEQ ID NO: 560664 - RNA, 18 nt, Human
uccaugagcguuccugug

SEQ ID NO: 560665 - RNA, 20 nt, Human
uccccuggcucugggccugg

SEQ ID NO: 560666 - RNA, 24 nt, Human
ugaagacaggugggguggaguugg

SEQ ID NO: 560667 - RNA, 26 nt, Human
ugaagacagguggggugggggaacac

SEQ ID NO: 560668 - RNA, 25 nt, Human
ugaagacagguggggugggggaacc

SEQ ID NO: 560669 - RNA, 24 nt, Human
ugccugggccacaaguagucaggc

SEQ ID NO: 560670 - RNA, 22 nt, Human
uggaguuggguccccaccugcc

SEQ ID NO: 560671 - RNA, 19 nt, Human
ugggccuggucuuuggugc

SEQ ID NO: 560672 - RNA, 19 nt, Human
uggguccccaccugcccag

SEQ ID NO: 560673 - RNA, 25 nt, Human
uguccccuggcucugggccuggucu

SEQ ID NO: 560674 - RNA, 18 nt, Human
uguguugggggaagccug

SEQ ID NO: 560675 - RNA, 18 nt, Human
uucuguggagugugcagg

SEQ ID NO: 560676 - RNA, 18 nt, Human
uugcacaaaucccacaaa

SEQ ID NO: 560677 - RNA, 22 nt, Human
uuuuccuacccacagaggaccc

SEQ ID NO: 560678 - RNA, 19 nt, Human
aaagacaaaaacugccacu

SEQ ID NO: 560679 - RNA, 19 nt, Human
aacgucggagcuagaagga

SEQ ID NO: 560680 - RNA, 24 nt, Human
aagacaaaaacugccacuuccucu

SEQ ID NO: 560681 - RNA, 21 nt, Human
agaaggaaagggguggggagg

SEQ ID NO: 560682 - RNA, 18 nt, Human
aggaggggcggugcuggg

SEQ ID NO: 560683 - RNA, 18 nt, Human
agggguggggaggggagg

SEQ ID NO: 560684 - RNA, 22 nt, Human
agggguggggaggggagggacc

SEQ ID NO: 560685 - RNA, 23 nt, Human
caaaaacugccacuuccucuucc

SEQ ID NO: 560686 - RNA, 23 nt, Human
caagcaaucccuggauucuucua

SEQ ID NO: 560687 - RNA, 20 nt, Human
cacuuccucuuccuucuucc

SEQ ID NO: 560688 - RNA, 25 nt, Human
ccacuuccucuuccuucuuccagga

SEQ ID NO: 560689 - RNA, 23 nt, Human
ccaggaggggcggugcuggggcu

SEQ ID NO: 560690 - RNA, 20 nt, Human
ccauauccuccgccgccccc

SEQ ID NO: 560691 - RNA, 23 nt, Human
ccauauuugguuucuacaucaua

SEQ ID NO: 560692 - RNA, 20 nt, Human
ccccccgccccccuaauaaa

SEQ ID NO: 560693 - RNA, 20 nt, Human
cccccuaauaaacgccuccc

SEQ ID NO: 560694 - RNA, 23 nt, Human
cccgcggccgcaaacgucggagc

SEQ ID NO: 560695 - RNA, 20 nt, Human
cggagcuagaaggaaagggg

SEQ ID NO: 560696 - RNA, 23 nt, Human
cggggacgaagaguaagggaggg

SEQ ID NO: 560697 - RNA, 19 nt, Human
cucuuuccccccgcccccc

SEQ ID NO: 560698 - RNA, 23 nt, Human
cugacucuggcuuuacuccauau

SEQ ID NO: 560699 - RNA, 22 nt, Human
cuucgugccuggccacugacuc

SEQ ID NO: 560700 - RNA, 21 nt, Human
gaaagggguggggaggggagg

SEQ ID NO: 560701 - RNA, 24 nt, Human
ggaccggggacgaagaguaaggga

SEQ ID NO: 560702 - RNA, 20 nt, Human
ggaggggagggaccggggac

SEQ ID NO: 560703 - RNA, 19 nt, Human
ggggaggggagggaccggg

SEQ ID NO: 560704 - RNA, 20 nt, Human
ggguggggaggggagggacc

SEQ ID NO: 560705 - RNA, 18 nt, Human
ggucugcuccaauguugu

SEQ ID NO: 560706 - RNA, 26 nt, Human
guggggaggggagggaccggggacga

SEQ ID NO: 560707 - RNA, 21 nt, Human
ucacacugcuaugcaagaaug

SEQ ID NO: 560708 - RNA, 22 nt, Human
ucacugccagucagaaggucug

SEQ ID NO: 560709 - RNA, 19 nt, Human
uccgccgcccccgcggccg

SEQ ID NO: 560710 - RNA, 21 nt, Human
uccgccgcccccgcggccgca

SEQ ID NO: 560711 - RNA, 20 nt, Human
uccuccgccgcccccgcggc

SEQ ID NO: 560712 - RNA, 22 nt, Human
ugccaagcaaucccuggauucu

SEQ ID NO: 560713 - RNA, 18 nt, Human
ugccuucgugccuggcca

SEQ ID NO: 560714 - RNA, 23 nt, Human
uggcaaaaacugguucuguacaa

SEQ ID NO: 560715 - RNA, 22 nt, Human
uggcuaaacuggcaaaaacugg

SEQ ID NO: 560716 - RNA, 20 nt, Human
uggggaggggagggaccggg

SEQ ID NO: 560717 - RNA, 27 nt, Human
uuccccccgccccccuaauaaacgccu

SEQ ID NO: 560718 - RNA, 18 nt, Human
aaaccuggaauuccggca

SEQ ID NO: 560719 - RNA, 20 nt, Human
aagaaaaagcaaccuuauua

SEQ ID NO: 560720 - RNA, 27 nt, Human
aagagcccagagugaauagugggcacc

SEQ ID NO: 560721 - RNA, 21 nt, Human
aagagccuggggggaaaggag

SEQ ID NO: 560722 - RNA, 21 nt, Human
aaggcuccagaagaggaacag

SEQ ID NO: 560723 - RNA, 20 nt, Human
aagggcaaggaaggcugcag

SEQ ID NO: 560724 - RNA, 25 nt, Human
aaugaaauggaaggaugucccuuaa

SEQ ID NO: 560725 - RNA, 20 nt, Human
acacggcaaccccaccagaa

SEQ ID NO: 560726 - RNA, 21 nt, Human
acacggcaaccccaccagaac

SEQ ID NO: 560727 - RNA, 22 nt, Human
acagaccagagaacguccaugc

SEQ ID NO: 560728 - RNA, 23 nt, Human
acagaggcggaaggaagagaagc

SEQ ID NO: 560729 - RNA, 19 nt, Human
acagcacagcagaacagga

SEQ ID NO: 560730 - RNA, 21 nt, Human
acagcacagcagaacaggaga

SEQ ID NO: 560731 - RNA, 24 nt, Human
acagcccgcaagguugaaaggccc

SEQ ID NO: 560732 - RNA, 19 nt, Human
accccggcuugcccugccu

SEQ ID NO: 560733 - RNA, 26 nt, Human
accugaucccuuccccucccuauucu

SEQ ID NO: 560734 - RNA, 22 nt, Human
agaaacaccagagaaggcagac

SEQ ID NO: 560735 - RNA, 21 nt, Human
agaacguccaugcgaugccuc

SEQ ID NO: 560736 - RNA, 19 nt, Human
agaaggcagacaccugagc

SEQ ID NO: 560737 - RNA, 19 nt, Human
agagaaggcagacaccuga

SEQ ID NO: 560738 - RNA, 25 nt, Human
agaugaagaaaauuauagggaggcu

SEQ ID NO: 560739 - RNA, 18 nt, Human
agcaagagaugaagaaaa

SEQ ID NO: 560740 - RNA, 20 nt, Human
agcacagcagaacaggagaa

SEQ ID NO: 560741 - RNA, 22 nt, Human
agcugccccucagggcugcauc

SEQ ID NO: 560742 - RNA, 19 nt, Human
aggaacagaggcggaagga

SEQ ID NO: 560743 - RNA, 22 nt, Human
aggaggagguggaagggcaagg

SEQ ID NO: 560744 - RNA, 22 nt, Human
aggcugaccugacaaagucaaa

SEQ ID NO: 560745 - RNA, 19 nt, Human
agggaaacaaagagccugg

SEQ ID NO: 560746 - RNA, 20 nt, Human
aguccaugauaucuaaguuu

SEQ ID NO: 560747 - RNA, 18 nt, Human
agugaggggugggaaggg

SEQ ID NO: 560748 - RNA, 20 nt, Human
agugaggggugggaagggaa

SEQ ID NO: 560749 - RNA, 24 nt, Human
auaugguuuuucccuuucaaacac

SEQ ID NO: 560750 - RNA, 21 nt, Human
auuugcacuuaaaaaaaguca

SEQ ID NO: 560751 - RNA, 19 nt, Human
caacacgccaaaggcuaga

SEQ ID NO: 560752 - RNA, 22 nt, Human
caacuaagaaagaaaaagcaac

SEQ ID NO: 560753 - RNA, 20 nt, Human
caagugaggcugaccugaca

SEQ ID NO: 560754 - RNA, 21 nt, Human
cacacggcaaccccaccagaa

SEQ ID NO: 560755 - RNA, 25 nt, Human
cacagcacagcagaacaggagaacc

SEQ ID NO: 560756 - RNA, 20 nt, Human
caccagagaaggcagacacc

SEQ ID NO: 560757 - RNA, 21 nt, Human
cagaccagagaacguccaugc

SEQ ID NO: 560758 - RNA, 19 nt, Human
cagcugucaccaucacuca

SEQ ID NO: 560759 - RNA, 27 nt, Human
caggacaacacaccugauccccugaag

SEQ ID NO: 560760 - RNA, 22 nt, Human
cagggcacuucugggcacccac

SEQ ID NO: 560761 - RNA, 18 nt, Human
ccuccugccaccacgaga

SEQ ID NO: 560762 - RNA, 22 nt, Human
cgccaaaggcuagaguuuuacu

SEQ ID NO: 560763 - RNA, 19 nt, Human
cggcugaacuuuggacagc

SEQ ID NO: 560764 - RNA, 18 nt, Human
cuagccuuaugcaacgua

SEQ ID NO: 560765 - RNA, 19 nt, Human
cuauucuaaagggagagaa

SEQ ID NO: 560766 - RNA, 21 nt, Human
cugcuccaagaaaauggaacc

SEQ ID NO: 560767 - RNA, 24 nt, Human
cuuaauacacuuauagaccuauca

SEQ ID NO: 560768 - RNA, 26 nt, Human
gaaaauuauagggaggcugcccuggc

SEQ ID NO: 560769 - RNA, 19 nt, Human
gaacacucagcaucacugg

SEQ ID NO: 560770 - RNA, 22 nt, Human
gaauuccggcagcucuccccgg

SEQ ID NO: 560771 - RNA, 18 nt, Human
gagaagcuccaaggugac

SEQ ID NO: 560772 - RNA, 19 nt, Human
gagaagcugagugaggggu

SEQ ID NO: 560773 - RNA, 21 nt, Human
gagaaggggaaggaggaacgg

SEQ ID NO: 560774 - RNA, 25 nt, Human
gcagggcacuucugggcacccacau

SEQ ID NO: 560775 - RNA, 21 nt, Human
gcccaggacaacacaccugau

SEQ ID NO: 560776 - RNA, 20 nt, Human
gcccugagaccugcaccacc

SEQ ID NO: 560777 - RNA, 23 nt, Human
gcugucaccaucacucaugucca

SEQ ID NO: 560778 - RNA, 19 nt, Human
ggacaagaugauggggagg

SEQ ID NO: 560779 - RNA, 19 nt, Human
gggaggcaaaggcuccaga

SEQ ID NO: 560780 - RNA, 23 nt, Human
gggaggcugcccuggcccaaagg

SEQ ID NO: 560781 - RNA, 20 nt, Human
gguggagggaaacaaagagc

SEQ ID NO: 560782 - RNA, 23 nt, Human
ggugggaagggaagaagagccca

SEQ ID NO: 560783 - RNA, 23 nt, Human
gguugaaaggcccaggacaacac

SEQ ID NO: 560784 - RNA, 26 nt, Human
guaggucaaguucaaaauuauaucaa

SEQ ID NO: 560785 - RNA, 19 nt, Human
uaagaaagaaaaagcaacc

SEQ ID NO: 560786 - RNA, 19 nt, Human
uagcaagagaugaagaaaa

SEQ ID NO: 560787 - RNA, 26 nt, Human
uagcaagagaugaagaaaagggaccc

SEQ ID NO: 560788 - RNA, 24 nt, Human
uagcaagagaugaagaaaauuaua

SEQ ID NO: 560789 - RNA, 23 nt, Human
uagggcaguugauaugcaagggg

SEQ ID NO: 560790 - RNA, 22 nt, Human
ucaacuaagaaagaaaaagcaa

SEQ ID NO: 560791 - RNA, 19 nt, Human
ucaaggagauaagagaugg

SEQ ID NO: 560792 - RNA, 18 nt, Human
ucagcacagcccgcaagg

SEQ ID NO: 560793 - RNA, 19 nt, Human
ucagugagguagauaauca

SEQ ID NO: 560794 - RNA, 22 nt, Human
uccaagaaaauggaacccaagg

SEQ ID NO: 560795 - RNA, 22 nt, Human
uccacaguggagcuugcuucug

SEQ ID NO: 560796 - RNA, 19 nt, Human
ucuaggacaagaugauggg

SEQ ID NO: 560797 - RNA, 19 nt, Human
ucuccacuacagaccagag

SEQ ID NO: 560798 - RNA, 22 nt, Human
ucuggaacucagcacagcccgc

SEQ ID NO: 560799 - RNA, 20 nt, Human
ugaacuuuggacagcugaga

SEQ ID NO: 560800 - RNA, 20 nt, Human
ugacugggaaaagcaacaca

SEQ ID NO: 560801 - RNA, 20 nt, Human
ugacugggaaaagcaacaca

SEQ ID NO: 560802 - RNA, 22 nt, Human
ugaggcugaccugacaaaguca

SEQ ID NO: 560803 - RNA, 21 nt, Human
ugagugaggggugggaaggga

SEQ ID NO: 560804 - RNA, 20 nt, Human
ugcccugagaccugcaccac

SEQ ID NO: 560805 - RNA, 23 nt, Human
uggaacccaagggagagggacuc

SEQ ID NO: 560806 - RNA, 23 nt, Human
uggaacucagcacagcccgcaag

SEQ ID NO: 560807 - RNA, 21 nt, Human
ugggaaaagcaacacacaagg

SEQ ID NO: 560808 - RNA, 24 nt, Human
ugggagaaggggaaggaggaacgg

SEQ ID NO: 560809 - RNA, 22 nt, Human
aaaccacagcuuaagcggggga

SEQ ID NO: 560810 - RNA, 24 nt, Human
aacagaaccaucacagccgcucag

SEQ ID NO: 560811 - RNA, 18 nt, Human
aacuuaagucaugaaugg

SEQ ID NO: 560812 - RNA, 23 nt, Human
aagcuucauauagcucauauagu

SEQ ID NO: 560813 - RNA, 22 nt, Human
aagguggacagaucacaccuca

SEQ ID NO: 560814 - RNA, 23 nt, Human
acagacuuccaaaaggaaacacc

SEQ ID NO: 560815 - RNA, 21 nt, Human
acccauccagcccaagacugu

SEQ ID NO: 560816 - RNA, 20 nt, Human
acccucuccuaucacacaca

SEQ ID NO: 560817 - RNA, 23 nt, Human
acccugugcaaguuguagaacaa

SEQ ID NO: 560818 - RNA, 27 nt, Human
accucagugaccucaaaacacaaggac

SEQ ID NO: 560819 - RNA, 18 nt, Human
acggccggaucccuaagc

SEQ ID NO: 560820 - RNA, 21 nt, Human
acucaguaucugacgugguuu

SEQ ID NO: 560821 - RNA, 22 nt, Human
acuggagacagaggauuuuccg

SEQ ID NO: 560822 - RNA, 24 nt, Human
agcacaaaccacagggcuuacuag

SEQ ID NO: 560823 - RNA, 19 nt, Human
agcauacacugagccaaca

SEQ ID NO: 560824 - RNA, 20 nt, Human
agcgcgugcgcguuaacgcc

SEQ ID NO: 560825 - RNA, 21 nt, Human
agcucauauagucuuauuguc

SEQ ID NO: 560826 - RNA, 24 nt, Human
agcuuauugucccugcuucaccuc

SEQ ID NO: 560827 - RNA, 22 nt, Human
aggacauaucacacagcaucuu

SEQ ID NO: 560828 - RNA, 22 nt, Human
aggcaacagugauguccaaaac

SEQ ID NO: 560829 - RNA, 18 nt, Human
agggagggaagguauggg

SEQ ID NO: 560830 - RNA, 18 nt, Human
agggagggaagguauggg

SEQ ID NO: 560831 - RNA, 23 nt, Human
agguggacagaucacaccucagg

SEQ ID NO: 560832 - RNA, 24 nt, Human
agucacacuuggguugccuaauuu

SEQ ID NO: 560833 - RNA, 22 nt, Human
agugacaaagagcaugcgggug

SEQ ID NO: 560834 - RNA, 21 nt, Human
agugaccucaaaacacaagga

SEQ ID NO: 560835 - RNA, 24 nt, Human
auggaugucuccucccaacuaggc

SEQ ID NO: 560836 - RNA, 24 nt, Human
caaaccccuggguccuggaugccu

SEQ ID NO: 560837 - RNA, 27 nt, Human
caaagagcaugcggguggggcgggcac

SEQ ID NO: 560838 - RNA, 21 nt, Human
caacagugauguccaaaacaa

SEQ ID NO: 560839 - RNA, 19 nt, Human
cacaccucaggaagucauc

SEQ ID NO: 560840 - RNA, 20 nt, Human
cacacuguacugugggccag

SEQ ID NO: 560841 - RNA, 24 nt, Human
cacugaaagcuggaagagcagcga

SEQ ID NO: 560842 - RNA, 20 nt, Human
cacuucuccagggacugcca

SEQ ID NO: 560843 - RNA, 21 nt, Human
cagacuuccaaaaggaaacac

SEQ ID NO: 560844 - RNA, 22 nt, Human
cagauccuggacgauggugcuu

SEQ ID NO: 560845 - RNA, 21 nt, Human
cagcaggaccacacaccuguc

SEQ ID NO: 560846 - RNA, 20 nt, Human
caggaaggcucccagauuga

SEQ ID NO: 560847 - RNA, 24 nt, Human
cagggcccaccaugaggcagccau

SEQ ID NO: 560848 - RNA, 18 nt, Human
caugaggcagccaucacc

SEQ ID NO: 560849 - RNA, 18 nt, Human
ccaaaucuaaaacuaucu

SEQ ID NO: 560850 - RNA, 23 nt, Human
ccaacuaggcgcagaggguagca

SEQ ID NO: 560851 - RNA, 19 nt, Human
ccacacaccuguccagggc

SEQ ID NO: 560852 - RNA, 19 nt, Human
ccacagggcuuacuagcac

SEQ ID NO: 560853 - RNA, 20 nt, Human
ccacagggcuuacuagcaca

SEQ ID NO: 560854 - RNA, 18 nt, Human
ccacaguacccugaccua

SEQ ID NO: 560855 - RNA, 20 nt, Human
ccaccaguuccuuggguagc

SEQ ID NO: 560856 - RNA, 20 nt, Human
ccacugcucuuuuggugugg

SEQ ID NO: 560857 - RNA, 21 nt, Human
cccacaguacccugaccuacc

SEQ ID NO: 560858 - RNA, 19 nt, Human
cccauccagcccaagacug

SEQ ID NO: 560859 - RNA, 21 nt, Human
ccccagcauacacugagccaa

SEQ ID NO: 560860 - RNA, 20 nt, Human
ccccuggguccuggaugccu

SEQ ID NO: 560861 - RNA, 19 nt, Human
cccgcggucuuacggccgc

SEQ ID NO: 560862 - RNA, 18 nt, Human
cccuggguccuggaugcc

SEQ ID NO: 560863 - RNA, 19 nt, Human
cccuggguccuggaugccu

SEQ ID NO: 560864 - RNA, 21 nt, Human
ccgcgcgcucggccacggccg

SEQ ID NO: 560865 - RNA, 23 nt, Human
ccuaccagcuaaugcaaaaacac

SEQ ID NO: 560866 - RNA, 18 nt, Human
cgcggucuuacggccgcg

SEQ ID NO: 560867 - RNA, 20 nt, Human
cggccgcgcgcucggccacg

SEQ ID NO: 560868 - RNA, 25 nt, Human
cuaagcacaaaccacagggcuuacu

SEQ ID NO: 560869 - RNA, 19 nt, Human
cuaccagcuaaugcaaaaa

SEQ ID NO: 560870 - RNA, 21 nt, Human
cuaugagcucccuucuggcug

SEQ ID NO: 560871 - RNA, 23 nt, Human
cucacagcuccccuucuucaguu

SEQ ID NO: 560872 - RNA, 21 nt, Human
cucaugaaauagaaacgaaaa

SEQ ID NO: 560873 - RNA, 24 nt, Human
cuccuaucacacacauccccccug

SEQ ID NO: 560874 - RNA, 20 nt, Human
cugaagacaguuggcggaga

SEQ ID NO: 560875 - RNA, 24 nt, Human
cuuucugaauuuaagaauuuugag

SEQ ID NO: 560876 - RNA, 21 nt, Human
gaaaaagacaaagggcccagg

SEQ ID NO: 560877 - RNA, 21 nt, Human
gaaaacgugacucuaggccuc

SEQ ID NO: 560878 - RNA, 19 nt, Human
gaaaaggacacuugagugg

SEQ ID NO: 560879 - RNA, 18 nt, Human
gaaccugcggacucucug

SEQ ID NO: 560880 - RNA, 18 nt, Human
gaagucccucuccccacc

SEQ ID NO: 560881 - RNA, 19 nt, Human
gauccuggacgauggugcu

SEQ ID NO: 560882 - RNA, 21 nt, Human
gcacuccaaggcuuggcauag

SEQ ID NO: 560883 - RNA, 19 nt, Human
gcgucgagcugaagucugg

SEQ ID NO: 560884 - RNA, 21 nt, Human
gcugaagucuggaagucccuc

SEQ ID NO: 560885 - RNA, 21 nt, Human
ggcaggccaggaugacuccag

SEQ ID NO: 560886 - RNA, 21 nt, Human
ggccaagauacuaccuuagcu

SEQ ID NO: 560887 - RNA, 19 nt, Human
ggguuucuucucugacuug

SEQ ID NO: 560888 - RNA, 24 nt, Human
guaagcaggggaucagagcuccau

SEQ ID NO: 560889 - RNA, 22 nt, Human
uaaaaacagaaccaucacagcc

SEQ ID NO: 560890 - RNA, 22 nt, Human
uaaaugauuccuaaaagcuuca

SEQ ID NO: 560891 - RNA, 22 nt, Human
uaacuagaaacauucuaaguau

SEQ ID NO: 560892 - RNA, 21 nt, Human
uaacucccgaaaucccagacc

SEQ ID NO: 560893 - RNA, 18 nt, Human
uaagcacaaaccacaggg

SEQ ID NO: 560894 - RNA, 22 nt, Human
uacccugugcaaguuguagaac

SEQ ID NO: 560895 - RNA, 18 nt, Human
uauaacccauccagccca

SEQ ID NO: 560896 - RNA, 22 nt, Human
ucaaaacacaaggacaucucca

SEQ ID NO: 560897 - RNA, 18 nt, Human
ucacugucaaucaucuuc

SEQ ID NO: 560898 - RNA, 22 nt, Human
ucagagcuccaucuucugugac

SEQ ID NO: 560899 - RNA, 25 nt, Human
ucagagcuccaucuucugugaccac

SEQ ID NO: 560900 - RNA, 23 nt, Human
ucagcuuaucugaaccugcggac

SEQ ID NO: 560901 - RNA, 19 nt, Human
ucagggagggaagguaugg

SEQ ID NO: 560902 - RNA, 22 nt, Human
ucaguuguggaguucuucaagg

SEQ ID NO: 560903 - RNA, 22 nt, Human
ucaugaaauagaaacgaaaaca

SEQ ID NO: 560904 - RNA, 23 nt, Human
uccagauuucauaccuuccucaa

SEQ ID NO: 560905 - RNA, 21 nt, Human
uccauguacagccagaucugc

SEQ ID NO: 560906 - RNA, 23 nt, Human
ucccagaccagauggaugucucc

SEQ ID NO: 560907 - RNA, 22 nt, Human
ucccugcuucaccuccagagac

SEQ ID NO: 560908 - RNA, 24 nt, Human
uccuggacgauggugcuucccuug

SEQ ID NO: 560909 - RNA, 22 nt, Human
uccuucaagccacuuccuuugc

SEQ ID NO: 560910 - RNA, 19 nt, Human
uccuuggguagcagagcag

SEQ ID NO: 560911 - RNA, 24 nt, Human
ucuauaacccauccagcccaagac

SEQ ID NO: 560912 - RNA, 26 nt, Human
ucucacagcuccccuucuucaguugu

SEQ ID NO: 560913 - RNA, 18 nt, Human
ucuccagggacugccacc

SEQ ID NO: 560914 - RNA, 19 nt, Human
ucucuggauacagaaacug

SEQ ID NO: 560915 - RNA, 18 nt, Human
ucugacgugguuucuaag

SEQ ID NO: 560916 - RNA, 24 nt, Human
ucugacgugguuucuaagguggag

SEQ ID NO: 560917 - RNA, 23 nt, Human
ucuggaagucccucuccccaccc

SEQ ID NO: 560918 - RNA, 22 nt, Human
ucugugaccacuucuccaggga

SEQ ID NO: 560919 - RNA, 22 nt, Human
ucuuacggccgcgcgcucggcc

SEQ ID NO: 560920 - RNA, 19 nt, Human
ugaccacuucuccagggac

SEQ ID NO: 560921 - RNA, 18 nt, Human
ugacucuaggccucagcc

SEQ ID NO: 560922 - RNA, 24 nt, Human
ugagccaacaacuuaagucaugaa

SEQ ID NO: 560923 - RNA, 20 nt, Human
ugaggagucugggguuccca

SEQ ID NO: 560924 - RNA, 25 nt, Human
ugauacuaacaaaaaccagaaguuu

SEQ ID NO: 560925 - RNA, 20 nt, Human
ugccugagacuccuagacac

SEQ ID NO: 560926 - RNA, 18 nt, Human
ugcggguggggcgggcac

SEQ ID NO: 560927 - RNA, 21 nt, Human
uggacagaucacaccucagga

SEQ ID NO: 560928 - RNA, 21 nt, Human
uggaugccuccuccagauuuc

SEQ ID NO: 560929 - RNA, 20 nt, Human
uggcaaccacugcucccaac

SEQ ID NO: 560930 - RNA, 23 nt, Human
uggcaggccaggaugacuccagu

SEQ ID NO: 560931 - RNA, 21 nt, Human
uggcugccacucagacuggcc

SEQ ID NO: 560932 - RNA, 21 nt, Human
ugggguuucuucucugacuug

SEQ ID NO: 560933 - RNA, 18 nt, Human
uggguccuggaugccucc

SEQ ID NO: 560934 - RNA, 19 nt, Human
uggguccuggaugccuccu

SEQ ID NO: 560935 - RNA, 22 nt, Human
ugggugggcacuccaaggcuug

SEQ ID NO: 560936 - RNA, 18 nt, Human
uguaaaaacagaaccauc

SEQ ID NO: 560937 - RNA, 21 nt, Human
uguaaaaacagaaccaucaca

SEQ ID NO: 560938 - RNA, 18 nt, Human
uucagcuuaucugaaccu

SEQ ID NO: 560939 - RNA, 21 nt, Human
uucaugcacugaaagcuggaa

SEQ ID NO: 560940 - RNA, 24 nt, Human
uuccgggguugggguuucuucucu

SEQ ID NO: 560941 - RNA, 21 nt, Human
uuccucuguuacccugugcaa

SEQ ID NO: 560942 - RNA, 21 nt, Human
uucuucuuuuuaucuccagcu

SEQ ID NO: 560943 - RNA, 22 nt, Human
uuugcagauccuggacgauggu

SEQ ID NO: 560944 - RNA, 20 nt, Human
acaguaugaagcuuuguuua

SEQ ID NO: 560945 - RNA, 20 nt, Human
acgccacagauauaacuaaa

SEQ ID NO: 560946 - RNA, 25 nt, Human
agauucucaaaacugccagcagcuc

SEQ ID NO: 560947 - RNA, 18 nt, Human
aucugucacaguaugaag

SEQ ID NO: 560948 - RNA, 24 nt, Human
augguucugacauaccagaggcuu

SEQ ID NO: 560949 - RNA, 22 nt, Human
caaccccacaccuccugcuucc

SEQ ID NO: 560950 - RNA, 21 nt, Human
caggaaaaugucauuuaauga

SEQ ID NO: 560951 - RNA, 24 nt, Human
ccagaggggcaggaacacuuugau

SEQ ID NO: 560952 - RNA, 23 nt, Human
ccccacaccuccugcuuccccgu

SEQ ID NO: 560953 - RNA, 21 nt, Human
cccgucgcaccgcccuggcca

SEQ ID NO: 560954 - RNA, 21 nt, Human
ccuagcaacaaucauugcuac

SEQ ID NO: 560955 - RNA, 19 nt, Human
ccuccugcuuccccgucgc

SEQ ID NO: 560956 - RNA, 22 nt, Human
ccugcuuccccgucgcaccgcc

SEQ ID NO: 560957 - RNA, 20 nt, Human
ccuggccagguucacauggu

SEQ ID NO: 560958 - RNA, 26 nt, Human
ccuggccagguucacaugguuucaac

SEQ ID NO: 560959 - RNA, 19 nt, Human
ccuuuaccugagcauggug

SEQ ID NO: 560960 - RNA, 22 nt, Human
cugagugcaggguccccucgga

SEQ ID NO: 560961 - RNA, 21 nt, Human
gagcauggugagcucucucuc

SEQ ID NO: 560962 - RNA, 21 nt, Human
gcucagaagacaaauguguuc

SEQ ID NO: 560963 - RNA, 22 nt, Human
ggaggucaucagauucucaaaa

SEQ ID NO: 560964 - RNA, 25 nt, Human
uaaaacagaaagacuuucaggaaaa

SEQ ID NO: 560965 - RNA, 24 nt, Human
uauacaacucuguagccuagcaac

SEQ ID NO: 560966 - RNA, 20 nt, Human
uauacauuacauauacaacu

SEQ ID NO: 560967 - RNA, 26 nt, Human
ucagaagacaaauguguucucugggg

SEQ ID NO: 560968 - RNA, 19 nt, Human
ucagauucucaaaacugcc

SEQ ID NO: 560969 - RNA, 19 nt, Human
ugaaaccauguauucauaa

SEQ ID NO: 560970 - RNA, 18 nt, Human
ugagcuauucucaaaugu

SEQ ID NO: 560971 - RNA, 21 nt, Human
ugccaucauuaugacugugga

SEQ ID NO: 560972 - RNA, 19 nt, Human
uggaagacagcaugguucu

SEQ ID NO: 560973 - RNA, 20 nt, Human
uggugagcucucucuccucc

SEQ ID NO: 560974 - RNA, 24 nt, Human
uguccagaggggcaggaacacuuu

SEQ ID NO: 560975 - RNA, 21 nt, Human
uuaaauggaugcucuucacaa

SEQ ID NO: 560976 - RNA, 19 nt, Human
uugcgugcgggaccaaccc

SEQ ID NO: 560977 - RNA, 26 nt, Human
uuuccacuuacaagagaacgccacag

SEQ ID NO: 560978 - RNA, 19 nt, Human
aaaaaaacugucaaagaca

SEQ ID NO: 560979 - RNA, 25 nt, Human
aaaaaguaaaucacaaaaauacaag

SEQ ID NO: 560980 - RNA, 24 nt, Human
aaaccccaaaaggcuuacagaaaa

SEQ ID NO: 560981 - RNA, 26 nt, Human
acaagaaaaaaacugucaaagacaac

SEQ ID NO: 560982 - RNA, 21 nt, Human
acacacacauauguauauagu

SEQ ID NO: 560983 - RNA, 23 nt, Human
accccaaaaggcuuacagaaaaa

SEQ ID NO: 560984 - RNA, 25 nt, Human
accccaaaaggcuuacagaaaaagu

SEQ ID NO: 560985 - RNA, 19 nt, Human
acucugaaaaacacuagaa

SEQ ID NO: 560986 - RNA, 23 nt, Human
acucugaaaaacacuagaacaua

SEQ ID NO: 560987 - RNA, 18 nt, Human
aggaaaaguaauacuuac

SEQ ID NO: 560988 - RNA, 21 nt, Human
agggacaagaaaaaaacuguc

SEQ ID NO: 560989 - RNA, 25 nt, Human
auauauauacacacacacacauaug

SEQ ID NO: 560990 - RNA, 22 nt, Human
auuuuuaaaugccccugccugc

SEQ ID NO: 560991 - RNA, 22 nt, Human
caaaaauaaggacuggaaugaa

SEQ ID NO: 560992 - RNA, 23 nt, Human
cacacacacacauauguauauag

SEQ ID NO: 560993 - RNA, 25 nt, Human
caccgggagcagguaccaccgccga

SEQ ID NO: 560994 - RNA, 23 nt, Human
cacucugaaaaacacuagaacau

SEQ ID NO: 560995 - RNA, 18 nt, Human
cauucuuuuuuggucagg

SEQ ID NO: 560996 - RNA, 24 nt, Human
cccaaaaggcuuacagaaaaagua

SEQ ID NO: 560997 - RNA, 18 nt, Human
cccacacguccucagggc

SEQ ID NO: 560998 - RNA, 19 nt, Human
ccccaaaaggcuuacagaa

SEQ ID NO: 560999 - RNA, 19 nt, Human
ccccacucugugagucugg

SEQ ID NO: 561000 - RNA, 19 nt, Human
cccccuccgcuuccuaauu

SEQ ID NO: 561001 - RNA, 22 nt, Human
cuccugcucccccuccgcuucc

SEQ ID NO: 561002 - RNA, 22 nt, Human
cuccugcucccccuccgcuucc

SEQ ID NO: 561003 - RNA, 18 nt, Human
gacaagaaaaaaacuguc

SEQ ID NO: 561004 - RNA, 21 nt, Human
ggagauucuggagccccacuc

SEQ ID NO: 561005 - RNA, 22 nt, Human
uaaaccccaaaaggcuuacaga

SEQ ID NO: 561006 - RNA, 24 nt, Human
uaaaccccaaaaggcuuacagaaa

SEQ ID NO: 561007 - RNA, 24 nt, Human
uaaaucacaaaaauacaagcuugu

SEQ ID NO: 561008 - RNA, 19 nt, Human
uaaaugccccugccugccc

SEQ ID NO: 561009 - RNA, 25 nt, Human
uaaccucagcgaaaacuuuuaggau

SEQ ID NO: 561010 - RNA, 24 nt, Human
uaacuuuuaggcugagacaaaaca

SEQ ID NO: 561011 - RNA, 24 nt, Human
uacacacacaccaauggcacugau

SEQ ID NO: 561012 - RNA, 24 nt, Human
uauacacacacacacauauguaua

SEQ ID NO: 561013 - RNA, 25 nt, Human
uauacacacacacacauauguauau

SEQ ID NO: 561014 - RNA, 25 nt, Human
uauauacacacacacacauauguag

SEQ ID NO: 561015 - RNA, 24 nt, Human
uaugacacauuauauauauacaca

SEQ ID NO: 561016 - RNA, 23 nt, Human
uccgcuuccuaauuucggggccg

SEQ ID NO: 561017 - RNA, 21 nt, Human
uccuacauuuuuaaaugcccc

SEQ ID NO: 561018 - RNA, 21 nt, Human
ugagacaaaacaauauucaau

SEQ ID NO: 561019 - RNA, 19 nt, Human
ugcuuuuugaacugcuuua

SEQ ID NO: 561020 - RNA, 23 nt, Human
uggaacgagccacgacggcucug

SEQ ID NO: 561021 - RNA, 19 nt, Human
uggaaugaaaaaggaagau

SEQ ID NO: 561022 - RNA, 20 nt, Human
uggagauucuggagccccac

SEQ ID NO: 561023 - RNA, 23 nt, Human
ugguaaguguaaaccccaaaagg

SEQ ID NO: 561024 - RNA, 21 nt, Human
uggucagggacaagaaaaaaa

SEQ ID NO: 561025 - RNA, 22 nt, Human
uuaaaugccccugccugccccc

SEQ ID NO: 561026 - RNA, 21 nt, Human
uuacguacacacacaccaaug

SEQ ID NO: 561027 - RNA, 25 nt, Human
aaaaaaacaaaaacaaaacaaaaaa

SEQ ID NO: 561028 - RNA, 23 nt, Human
aaaaacaaaacaaaaaaaacuua

SEQ ID NO: 561029 - RNA, 25 nt, Human
aaaacaaaaaaacaaaaacaaaaca

SEQ ID NO: 561030 - RNA, 21 nt, Human
aaaacaaaaacaaaacaaaaa

SEQ ID NO: 561031 - RNA, 27 nt, Human
aaacaaaaaacaaaaaaacaaaaacaa

SEQ ID NO: 561032 - RNA, 25 nt, Human
aaacaaaaacaaaacaaaaaaaacu

SEQ ID NO: 561033 - RNA, 23 nt, Human
aacaaaaaacaaaaaaacaaaaa

SEQ ID NO: 561034 - RNA, 23 nt, Human
aacaucgcaagauaauguauuca

SEQ ID NO: 561035 - RNA, 24 nt, Human
aaccaaacuucaaccccaucagcg

SEQ ID NO: 561036 - RNA, 19 nt, Human
aaucaguuacaggcacuug

SEQ ID NO: 561037 - RNA, 24 nt, Human
acaaaaaaacaaaaacaaaacaaa

SEQ ID NO: 561038 - RNA, 25 nt, Human
acaaaaaaacaaaaacaaaacaaaa

SEQ ID NO: 561039 - RNA, 20 nt, Human
acaaaacaaaaaaaacuuaa

SEQ ID NO: 561040 - RNA, 21 nt, Human
agccacagacacauaaaaucc

SEQ ID NO: 561041 - RNA, 22 nt, Human
aggaaaacaaaaaacaaaaaaa

SEQ ID NO: 561042 - RNA, 24 nt, Human
aggaaaacaaaaaacaaaaaaaca

SEQ ID NO: 561043 - RNA, 20 nt, Human
aggaauccuucucuagagac

SEQ ID NO: 561044 - RNA, 28 nt, Human
caaaaaaacaaaaacaaaacaaaaaaaa

SEQ ID NO: 561045 - RNA, 27 nt, Human
caaaaaacaaaaaaacaaaaacaaaac

SEQ ID NO: 561046 - RNA, 24 nt, Human
caaaaacaaaacaaaaaaaacuua

SEQ ID NO: 561047 - RNA, 21 nt, Human
caaccccaucagcgacgcaau

SEQ ID NO: 561048 - RNA, 23 nt, Human
caaguccaaggugggguugaagg

SEQ ID NO: 561049 - RNA, 18 nt, Human
caccccgccccggcgggc

SEQ ID NO: 561050 - RNA, 18 nt, Human
cagcuccaccccgccccg

SEQ ID NO: 561051 - RNA, 22 nt, Human
cagucucucucaaaaaacaagg

SEQ ID NO: 561052 - RNA, 22 nt, Human
caucuucuccccgcgccggggg

SEQ ID NO: 561053 - RNA, 19 nt, Human
ccaaaccaaacuucaaccc

SEQ ID NO: 561054 - RNA, 23 nt, Human
ccaaccgggcucccgccgccgcc

SEQ ID NO: 561055 - RNA, 21 nt, Human
ccaucagguagguccucaagu

SEQ ID NO: 561056 - RNA, 20 nt, Human
cccaggcuggguucagcagg

SEQ ID NO: 561057 - RNA, 19 nt, Human
ccccgggcccagccgggcc

SEQ ID NO: 561058 - RNA, 21 nt, Human
ccugcaagcaaaauggaggaa

SEQ ID NO: 561059 - RNA, 23 nt, Human
cgcaaugcuccugugaccuuggu

SEQ ID NO: 561060 - RNA, 26 nt, Human
cgccaaccgggcucccgccgccgccu

SEQ ID NO: 561061 - RNA, 20 nt, Human
cgcgaagaccagacgccaac

SEQ ID NO: 561062 - RNA, 21 nt, Human
cggcgcguggcgggcccgagg

SEQ ID NO: 561063 - RNA, 25 nt, Human
cuaggcaccaucuucuccccgcgcc

SEQ ID NO: 561064 - RNA, 18 nt, Human
cugaaacaagaaccaaac

SEQ ID NO: 561065 - RNA, 20 nt, Human
cugaaacaagaaccaaacca

SEQ ID NO: 561066 - RNA, 18 nt, Human
cuugaaaugucuuuggcu

SEQ ID NO: 561067 - RNA, 18 nt, Human
gaaaugcaauaccguauc

SEQ ID NO: 561068 - RNA, 24 nt, Human
gaaccaaaccaaacuucaacccca

SEQ ID NO: 561069 - RNA, 22 nt, Human
gacgcaaugcuccugugaccuu

SEQ ID NO: 561070 - RNA, 19 nt, Human
gccacagacacauaaaauc

SEQ ID NO: 561071 - RNA, 20 nt, Human
gccccgggcccagccgggcc

SEQ ID NO: 561072 - RNA, 22 nt, Human
gccccgggcccagccgggccag

SEQ ID NO: 561073 - RNA, 21 nt, Human
gcggcgcguggcgggcccgag

SEQ ID NO: 561074 - RNA, 18 nt, Human
gcgggcagcugcgcgccc

SEQ ID NO: 561075 - RNA, 19 nt, Human
gcuuuggaaaugcaauacc

SEQ ID NO: 561076 - RNA, 18 nt, Human
ggacgcccgcggucgcgc

SEQ ID NO: 561077 - RNA, 22 nt, Human
ggcccgaggccgcuaggcacca

SEQ ID NO: 561078 - RNA, 27 nt, Human
gggcagcgucuggcuccggcccggcgg

SEQ ID NO: 561079 - RNA, 21 nt, Human
gggcagcugcgcgccccgggc

SEQ ID NO: 561080 - RNA, 22 nt, Human
ggugcagacuguuucaaauguu

SEQ ID NO: 561081 - RNA, 19 nt, Human
guggcggcgcguggcgggc

SEQ ID NO: 561082 - RNA, 19 nt, Human
guggcggcgcguggcgggc

SEQ ID NO: 561083 - RNA, 21 nt, Human
uacauauugggcugaaacaag

SEQ ID NO: 561084 - RNA, 19 nt, Human
ucaaaggugcagacuguuu

SEQ ID NO: 561085 - RNA, 24 nt, Human
uccaccccgccccggcgggcagcu

SEQ ID NO: 561086 - RNA, 25 nt, Human
uccaggaauccuucucuagagacac

SEQ ID NO: 561087 - RNA, 21 nt, Human
uccccgcgccgggggcagcgu

SEQ ID NO: 561088 - RNA, 20 nt, Human
ugaaaugucuuuggcuggaa

SEQ ID NO: 561089 - RNA, 25 nt, Human
ugcaagcaaaauggaggaaaaggua

SEQ ID NO: 561090 - RNA, 24 nt, Human
ugcuccugugaccuuggugaaaac

SEQ ID NO: 561091 - RNA, 22 nt, Human
uguuucaaauguucucuacaua

SEQ ID NO: 561092 - RNA, 23 nt, Human
uuaugguucucucagucucucuc

SEQ ID NO: 561093 - RNA, 19 nt, Human
uucucucagucucucucaa

SEQ ID NO: 561094 - RNA, 20 nt, Human
aaaaacaaccaaaaacacug

SEQ ID NO: 561095 - RNA, 20 nt, Human
aaaaacacugggggaaacug

SEQ ID NO: 561096 - RNA, 21 nt, Human
aaacaaaaacaaccaaaaaca

SEQ ID NO: 561097 - RNA, 22 nt, Human
aaacaaaaacaaccaaaaacac

SEQ ID NO: 561098 - RNA, 25 nt, Human
aaacaaccaaaaacacugggggaaa

SEQ ID NO: 561099 - RNA, 22 nt, Human
aacaaaaacaaccaaaaacacu

SEQ ID NO: 561100 - RNA, 23 nt, Human
aacaaacaaaaacaaccaaaaac

SEQ ID NO: 561101 - RNA, 21 nt, Human
aagacucuguccagggucccg

SEQ ID NO: 561102 - RNA, 18 nt, Human
aagccucaucauuugcug

SEQ ID NO: 561103 - RNA, 19 nt, Human
aaucagggcagcccagggc

SEQ ID NO: 561104 - RNA, 19 nt, Human
acaaaaacaaccaaaaaca

SEQ ID NO: 561105 - RNA, 20 nt, Human
acaaacaaaaacaaccaaaa

SEQ ID NO: 561106 - RNA, 20 nt, Human
acacagcaagaccuuaucuc

SEQ ID NO: 561107 - RNA, 25 nt, Human
acacugggggaaacugagcaagggg

SEQ ID NO: 561108 - RNA, 18 nt, Human
acagcgcugucuugcccg

SEQ ID NO: 561109 - RNA, 22 nt, Human
acaggcgaggacaucagaucug

SEQ ID NO: 561110 - RNA, 19 nt, Human
acccaaacguccccagcag

SEQ ID NO: 561111 - RNA, 23 nt, Human
acccagugaugaggggacggcuc

SEQ ID NO: 561112 - RNA, 18 nt, Human
accucggugacucacgcc

SEQ ID NO: 561113 - RNA, 18 nt, Human
acugcacuccagccuggg

SEQ ID NO: 561114 - RNA, 18 nt, Human
agaaagaccaaggcugcu

SEQ ID NO: 561115 - RNA, 24 nt, Human
agacaggcgaggacaucagaucug

SEQ ID NO: 561116 - RNA, 22 nt, Human
agcacuuugggagacagguggg

SEQ ID NO: 561117 - RNA, 18 nt, Human
agcagccaaucuccgagc

SEQ ID NO: 561118 - RNA, 18 nt, Human
agcccagggcgaggaggu

SEQ ID NO: 561119 - RNA, 18 nt, Human
agcccagggcgaggaggu

SEQ ID NO: 561120 - RNA, 19 nt, Human
agcuggggcagcccagggc

SEQ ID NO: 561121 - RNA, 19 nt, Human
agcuggggcagcccagggc

SEQ ID NO: 561122 - RNA, 19 nt, Human
agcuggggcagcccagggc

SEQ ID NO: 561123 - RNA, 19 nt, Human
agcuggggcagcccagggc

SEQ ID NO: 561124 - RNA, 19 nt, Human
agcuggggcagcccagggc

SEQ ID NO: 561125 - RNA, 20 nt, Human
aggacccuguacccucugcc

SEQ ID NO: 561126 - RNA, 26 nt, Human
aggucccccagauccagcuggggcag

SEQ ID NO: 561127 - RNA, 19 nt, Human
agucagggcagcccagggc

SEQ ID NO: 561128 - RNA, 19 nt, Human
agucggggcagcccagggc

SEQ ID NO: 561129 - RNA, 19 nt, Human
agucggggcagcccagggc

SEQ ID NO: 561130 - RNA, 24 nt, Human
auugcgccacugcacuccagccug

SEQ ID NO: 561131 - RNA, 22 nt, Human
caaacaaaaacaaccaaaaaca

SEQ ID NO: 561132 - RNA, 23 nt, Human
caaccaaaaacacugggggaaac

SEQ ID NO: 561133 - RNA, 25 nt, Human
caaccaaaaacacugggggaaacug

SEQ ID NO: 561134 - RNA, 24 nt, Human
caacccaaacguccccagcagcag

SEQ ID NO: 561135 - RNA, 27 nt, Human
cacagcaagaccuuaucucaacaaaca

SEQ ID NO: 561136 - RNA, 21 nt, Human
cacagcucagcccuacgcuuc

SEQ ID NO: 561137 - RNA, 24 nt, Human
cacgccuggcaucccagcacuuug

SEQ ID NO: 561138 - RNA, 18 nt, Human
cacugcacuccagccugg

SEQ ID NO: 561139 - RNA, 19 nt, Human
cacugcacuccagccuggg

SEQ ID NO: 561140 - RNA, 20 nt, Human
cacugcacuccagccugggc

SEQ ID NO: 561141 - RNA, 25 nt, Human
cacugcacuccagccugggccacac

SEQ ID NO: 561142 - RNA, 19 nt, Human
cagcacuuugggagacagg

SEQ ID NO: 561143 - RNA, 21 nt, Human
cagcacuuugggagacaggug

SEQ ID NO: 561144 - RNA, 22 nt, Human
cagcacuuugggagacaggugg

SEQ ID NO: 561145 - RNA, 20 nt, Human
cagcccagggcgaggagguu

SEQ ID NO: 561146 - RNA, 20 nt, Human
cagcccagggcgaggagguu

SEQ ID NO: 561147 - RNA, 20 nt, Human
cagcccagggcgaggagguu

SEQ ID NO: 561148 - RNA, 20 nt, Human
cagcccagggcgaggagguu

SEQ ID NO: 561149 - RNA, 20 nt, Human
cagcccagggcgaggagguu

SEQ ID NO: 561150 - RNA, 20 nt, Human
cagcccagggcgaggagguu

SEQ ID NO: 561151 - RNA, 20 nt, Human
cagcccagggcgaggagguu

SEQ ID NO: 561152 - RNA, 20 nt, Human
cagcccagggcgaggagguu

SEQ ID NO: 561153 - RNA, 20 nt, Human
cagcccagggcgaggagguu

SEQ ID NO: 561154 - RNA, 18 nt, Human
cagcucagcccuacgcuu

SEQ ID NO: 561155 - RNA, 20 nt, Human
cagcugcagcugggccccag

SEQ ID NO: 561156 - RNA, 19 nt, Human
caggcggggcagcccaggc

SEQ ID NO: 561157 - RNA, 20 nt, Human
cagguccacagcuuucucag

SEQ ID NO: 561158 - RNA, 18 nt, Human
cagguccccagacccagc

SEQ ID NO: 561159 - RNA, 18 nt, Human
cagguccccagacccagc

SEQ ID NO: 561160 - RNA, 21 nt, Human
cagguccccagacccagcugg

SEQ ID NO: 561161 - RNA, 21 nt, Human
cagguccccagacccagcugg

SEQ ID NO: 561162 - RNA, 23 nt, Human
cagguccccagacccagcugggg

SEQ ID NO: 561163 - RNA, 23 nt, Human
cagguccccagacccagcugggg

SEQ ID NO: 561164 - RNA, 18 nt, Human
caggucccccagacccag

SEQ ID NO: 561165 - RNA, 19 nt, Human
caggucccccagacccagc

SEQ ID NO: 561166 - RNA, 19 nt, Human
caggucccccagacccagc

SEQ ID NO: 561167 - RNA, 19 nt, Human
caggucccccagacccagc

SEQ ID NO: 561168 - RNA, 22 nt, Human
caggucccccagacccagcugg

SEQ ID NO: 561169 - RNA, 22 nt, Human
caggucccccagacccagcugg

SEQ ID NO: 561170 - RNA, 23 nt, Human
caggucccccagacccagcuggg

SEQ ID NO: 561171 - RNA, 23 nt, Human
caggucccccagacccagcuggg

SEQ ID NO: 561172 - RNA, 23 nt, Human
caggucccccagauccagcuggg

SEQ ID NO: 561173 - RNA, 18 nt, Human
cagguuaaaaaaacaacu

SEQ ID NO: 561174 - RNA, 22 nt, Human
cagucggggcagcccagggcga

SEQ ID NO: 561175 - RNA, 22 nt, Human
cagucggggcagcccagggcga

SEQ ID NO: 561176 - RNA, 23 nt, Human
caucccagcacuuugggagacag

SEQ ID NO: 561177 - RNA, 24 nt, Human
caugauugcgccacugcacuccag

SEQ ID NO: 561178 - RNA, 23 nt, Human
caugcgguauuacauuagguacu

SEQ ID NO: 561179 - RNA, 20 nt, Human
ccaacccaaacguccccagc

SEQ ID NO: 561180 - RNA, 20 nt, Human
ccacugcacuccagccuggg

SEQ ID NO: 561181 - RNA, 20 nt, Human
ccacugcacuccagccuggg

SEQ ID NO: 561182 - RNA, 21 nt, Human
ccacugcacuccagccugggc

SEQ ID NO: 561183 - RNA, 24 nt, Human
ccacugcacuccagccugggccac

SEQ ID NO: 561184 - RNA, 24 nt, Human
ccagcagugccggcacaggacaag

SEQ ID NO: 561185 - RNA, 20 nt, Human
cccaaacguccccagcagca

SEQ ID NO: 561186 - RNA, 23 nt, Human
cccaaacguccccagcagcaguc

SEQ ID NO: 561187 - RNA, 22 nt, Human
cccaggcggggcagcccagggc

SEQ ID NO: 561188 - RNA, 22 nt, Human
cccaggcggggcagcccagggc

SEQ ID NO: 561189 - RNA, 22 nt, Human
cccaggcggggcagcccagggc

SEQ ID NO: 561190 - RNA, 22 nt, Human
cccaggcggggcagcccagggc

SEQ ID NO: 561191 - RNA, 22 nt, Human
cccaggcggggcagcccagggc

SEQ ID NO: 561192 - RNA, 18 nt, Human
cccaggucccccagaccc

SEQ ID NO: 561193 - RNA, 19 nt, Human
cccagugaugaggggacgg

SEQ ID NO: 561194 - RNA, 22 nt, Human
cccagugaugaggggacggcuc

SEQ ID NO: 561195 - RNA, 20 nt, Human
ccccagacccaaucagggca

SEQ ID NO: 561196 - RNA, 23 nt, Human
ccccagacccaggcggggcagcc

SEQ ID NO: 561197 - RNA, 23 nt, Human
ccccagacccaggcggggcagcc

SEQ ID NO: 561198 - RNA, 23 nt, Human
ccccagacccaggcggggcagcc

SEQ ID NO: 561199 - RNA, 23 nt, Human
ccccagacccaggcggggcagcc

SEQ ID NO: 561200 - RNA, 23 nt, Human
ccccagacccaggcggggcagcc

SEQ ID NO: 561201 - RNA, 23 nt, Human
ccccagacccaggcggggcagcc

SEQ ID NO: 561202 - RNA, 20 nt, Human
ccccagacccagucagggca

SEQ ID NO: 561203 - RNA, 20 nt, Human
ccccagacccagucggggca

SEQ ID NO: 561204 - RNA, 20 nt, Human
ccccagacccagucggggca

SEQ ID NO: 561205 - RNA, 27 nt, Human
cccccagacccagcuggggcagcccag

SEQ ID NO: 561206 - RNA, 27 nt, Human
cccccagacccagcuggggcagcccag

SEQ ID NO: 561207 - RNA, 27 nt, Human
cccccagacccagcuggggcagcccag

SEQ ID NO: 561208 - RNA, 27 nt, Human
cccccagacccagcuggggcagcccag

SEQ ID NO: 561209 - RNA, 27 nt, Human
cccccagauccagcuggggcagcccag

SEQ ID NO: 561210 - RNA, 24 nt, Human
cccgcugcugagacaggcgaggac

SEQ ID NO: 561211 - RNA, 25 nt, Human
cccggaguuugaggccgcagugagc

SEQ ID NO: 561212 - RNA, 18 nt, Human
ccguucucucccugggag

SEQ ID NO: 561213 - RNA, 23 nt, Human
ccucgcuuuuugcauuuuccuuu

SEQ ID NO: 561214 - RNA, 19 nt, Human
ccugucuccccggaucacu

SEQ ID NO: 561215 - RNA, 26 nt, Human
cgccacugcacuccagccugggccac

SEQ ID NO: 561216 - RNA, 19 nt, Human
cggcccugcaggcggugcc

SEQ ID NO: 561217 - RNA, 24 nt, Human
cucacgccuggcaucccagcacuu

SEQ ID NO: 561218 - RNA, 27 nt, Human
cucaggacccuguacccucugccaccc

SEQ ID NO: 561219 - RNA, 21 nt, Human
cuccaagaaaaaccuucugug

SEQ ID NO: 561220 - RNA, 19 nt, Human
cuccccagcagugccggcc

SEQ ID NO: 561221 - RNA, 22 nt, Human
cugacaccaggacgacagcacu

SEQ ID NO: 561222 - RNA, 22 nt, Human
cugcagcugcagcugggcccca

SEQ ID NO: 561223 - RNA, 21 nt, Human
cugcugcagcugcagcugggc

SEQ ID NO: 561224 - RNA, 18 nt, Human
cuuccaacccaaacgucc

SEQ ID NO: 561225 - RNA, 25 nt, Human
gaacagcgaccucggugacucacgc

SEQ ID NO: 561226 - RNA, 20 nt, Human
gacccuguacccucugccac

SEQ ID NO: 561227 - RNA, 25 nt, Human
gaccucggugacucacgccuggcau

SEQ ID NO: 561228 - RNA, 24 nt, Human
gacugccugagccccggaguuuga

SEQ ID NO: 561229 - RNA, 26 nt, Human
gagauucaggucccccagacccaguc

SEQ ID NO: 561230 - RNA, 18 nt, Human
gagccccggaguuugagg

SEQ ID NO: 561231 - RNA, 25 nt, Human
gagguucagguccccagacccagcu

SEQ ID NO: 561232 - RNA, 25 nt, Human
gagguucagguccccagacccagcu

SEQ ID NO: 561233 - RNA, 26 nt, Human
gagguucaggucccccagacccagcu

SEQ ID NO: 561234 - RNA, 26 nt, Human
gagguucaggucccccagacccagcu

SEQ ID NO: 561235 - RNA, 26 nt, Human
gagguucaggucccccagacccagcu

SEQ ID NO: 561236 - RNA, 26 nt, Human
gagguucaggucccccagacccaguc

SEQ ID NO: 561237 - RNA, 26 nt, Human
gagguucaggucccccagauccagcu

SEQ ID NO: 561238 - RNA, 19 nt, Human
gcaagacaaagaggaaaca

SEQ ID NO: 561239 - RNA, 23 nt, Human
gcaagacaaagaggaaacagggg

SEQ ID NO: 561240 - RNA, 21 nt, Human
gcagcccagggcgaggagguu

SEQ ID NO: 561241 - RNA, 21 nt, Human
gcagcccagggcgaggagguu

SEQ ID NO: 561242 - RNA, 21 nt, Human
gcagcccagggcgaggagguu

SEQ ID NO: 561243 - RNA, 21 nt, Human
gcagcccagggcgaggagguu

SEQ ID NO: 561244 - RNA, 21 nt, Human
gcagugagccaugauugcgcc

SEQ ID NO: 561245 - RNA, 22 nt, Human
gccacugcacuccagccugggc

SEQ ID NO: 561246 - RNA, 20 nt, Human
gccccaggucccccagaccc

SEQ ID NO: 561247 - RNA, 23 nt, Human
gcccucaggacccuguacccucu

SEQ ID NO: 561248 - RNA, 18 nt, Human
gccgccuuccuuccaacc

SEQ ID NO: 561249 - RNA, 19 nt, Human
gccgccuuccuuccaaccc

SEQ ID NO: 561250 - RNA, 19 nt, Human
ggagcagcugagcaguggg

SEQ ID NO: 561251 - RNA, 21 nt, Human
ggcaagacaaagaggaaacag

SEQ ID NO: 561252 - RNA, 21 nt, Human
ggcgaggagguacaggucccc

SEQ ID NO: 561253 - RNA, 26 nt, Human
gggccccaggucccccagacccaguc

SEQ ID NO: 561254 - RNA, 18 nt, Human
ggucagguuaaaaaaaca

SEQ ID NO: 561255 - RNA, 18 nt, Human
uaaagaaggccugaaauu

SEQ ID NO: 561256 - RNA, 19 nt, Human
uacccucugccacccagag

SEQ ID NO: 561257 - RNA, 23 nt, Human
uagcuccaguggaugcuggugac

SEQ ID NO: 561258 - RNA, 21 nt, Human
ucaacccagugaugaggggac

SEQ ID NO: 561259 - RNA, 22 nt, Human
ucacgccuggcaucccagcacu

SEQ ID NO: 561260 - RNA, 19 nt, Human
ucaggucccccagauccag

SEQ ID NO: 561261 - RNA, 22 nt, Human
uccagcuggggcagcccagggc

SEQ ID NO: 561262 - RNA, 22 nt, Human
uccauagcaaaaggauagucac

SEQ ID NO: 561263 - RNA, 18 nt, Human
uccccagacccaggcggg

SEQ ID NO: 561264 - RNA, 18 nt, Human
uccccagacccaggcggg

SEQ ID NO: 561265 - RNA, 18 nt, Human
uccccagacccaggcggg

SEQ ID NO: 561266 - RNA, 19 nt, Human
ucccccagacccaaucagg

SEQ ID NO: 561267 - RNA, 19 nt, Human
ucccccagacccaggcggg

SEQ ID NO: 561268 - RNA, 19 nt, Human
ucccccagacccaggcggg

SEQ ID NO: 561269 - RNA, 19 nt, Human
ucccccagacccaggcggg

SEQ ID NO: 561270 - RNA, 21 nt, Human
ucccccagacccaggcggggc

SEQ ID NO: 561271 - RNA, 21 nt, Human
ucccccagacccaggcggggc

SEQ ID NO: 561272 - RNA, 21 nt, Human
ucccccagacccaggcggggc

SEQ ID NO: 561273 - RNA, 19 nt, Human
ucccccagacccagucagg

SEQ ID NO: 561274 - RNA, 19 nt, Human
ucccccagacccagucggg

SEQ ID NO: 561275 - RNA, 19 nt, Human
ucccccagacccagucggg

SEQ ID NO: 561276 - RNA, 21 nt, Human
ucccugggaggcuuuggaagg

SEQ ID NO: 561277 - RNA, 23 nt, Human
uccuugguuuugacacaagcacc

SEQ ID NO: 561278 - RNA, 22 nt, Human
ucugacaccaggacgacagcac

SEQ ID NO: 561279 - RNA, 19 nt, Human
ucugcaggaaggaggggcc

SEQ ID NO: 561280 - RNA, 18 nt, Human
ucuuguagcuccagugga

SEQ ID NO: 561281 - RNA, 24 nt, Human
ugacaccaggacgacagcacagcc

SEQ ID NO: 561282 - RNA, 21 nt, Human
ugacauaaagaaggccugaaa

SEQ ID NO: 561283 - RNA, 22 nt, Human
ugacucacgccuggcaucccag

SEQ ID NO: 561284 - RNA, 24 nt, Human
ugacucacgccuggcaucccagca

SEQ ID NO: 561285 - RNA, 19 nt, Human
ugaggagauucaggucccc

SEQ ID NO: 561286 - RNA, 21 nt, Human
ugccggcacaggacaagucug

SEQ ID NO: 561287 - RNA, 18 nt, Human
ugcugggcuacuuugcag

SEQ ID NO: 561288 - RNA, 22 nt, Human
ugcuggugaccuggaucuccug

SEQ ID NO: 561289 - RNA, 19 nt, Human
uggagcagcugagcagugg

SEQ ID NO: 561290 - RNA, 25 nt, Human
ugggccccaggucccccagacccag

SEQ ID NO: 561291 - RNA, 21 nt, Human
ugggggaaacugagcaagggg

SEQ ID NO: 561292 - RNA, 18 nt, Human
uguggggauguacuccuc

SEQ ID NO: 561293 - RNA, 18 nt, Human
uuaguccguaggccaaag

SEQ ID NO: 561294 - RNA, 23 nt, Human
uugcgccacugcacuccagccug

SEQ ID NO: 561295 - RNA, 20 nt, Human
aaacaagauuuaacugcuuu

SEQ ID NO: 561296 - RNA, 20 nt, Human
aaacagcugacacagugagc

SEQ ID NO: 561297 - RNA, 18 nt, Human
aaaccauaaugccgaaga

SEQ ID NO: 561298 - RNA, 18 nt, Human
aaagucuuggaagaccag

SEQ ID NO: 561299 - RNA, 20 nt, Human
aagcaaaaaugaaauggagg

SEQ ID NO: 561300 - RNA, 22 nt, Human
acagggaaaacgcaagaggaua

SEQ ID NO: 561301 - RNA, 21 nt, Human
agcaggcuggaacuaacagag

SEQ ID NO: 561302 - RNA, 23 nt, Human
aggauguuuuuguacaaguacag

SEQ ID NO: 561303 - RNA, 18 nt, Human
auaaugccgaagaaguga

SEQ ID NO: 561304 - RNA, 24 nt, Human
cacagcaaucaaaugcaaaguaaa

SEQ ID NO: 561305 - RNA, 24 nt, Human
cacccucacuccucucucuggcuc

SEQ ID NO: 561306 - RNA, 23 nt, Human
ccacugagauaagugaguggcaa

SEQ ID NO: 561307 - RNA, 25 nt, Human
cccuugguugugugacaagaccacc

SEQ ID NO: 561308 - RNA, 21 nt, Human
ccucauagcaaaagcggccaa

SEQ ID NO: 561309 - RNA, 26 nt, Human
cucacuccucucucuggcucucuccc

SEQ ID NO: 561310 - RNA, 23 nt, Human
cuccucucucuggcucucuccca

SEQ ID NO: 561311 - RNA, 21 nt, Human
gggaaaacagcugacacagug

SEQ ID NO: 561312 - RNA, 18 nt, Human
gggggucacugauucacu

SEQ ID NO: 561313 - RNA, 19 nt, Human
gugaaggucaaugauaugg

SEQ ID NO: 561314 - RNA, 24 nt, Human
guuguugcacagacaagauggcca

SEQ ID NO: 561315 - RNA, 18 nt, Human
uaccucagggaaaacagc

SEQ ID NO: 561316 - RNA, 21 nt, Human
uaccucagggaaaacagcuga

SEQ ID NO: 561317 - RNA, 23 nt, Human
ugaaaauaccauggcuuuauuuu

SEQ ID NO: 561318 - RNA, 21 nt, Human
ugacaugaaggggauaaaagu

SEQ ID NO: 561319 - RNA, 23 nt, Human
ugacaugaaggggauaaaagucu

SEQ ID NO: 561320 - RNA, 20 nt, Human
uguacaaguacagcccuugg

SEQ ID NO: 561321 - RNA, 23 nt, Human
ugucacacuugaacgugcgugua

SEQ ID NO: 561322 - RNA, 22 nt, Human
uuuuguacaaguacagcccuug

SEQ ID NO: 561323 - RNA, 21 nt, Human
aaaauacuuccccuacaacug

SEQ ID NO: 561324 - RNA, 18 nt, Human
aaacaggaaaaacgacca

SEQ ID NO: 561325 - RNA, 22 nt, Human
aaagccaccaacagagcaaaac

SEQ ID NO: 561326 - RNA, 24 nt, Human
aacaggacagguguuuaaaaaaaa

SEQ ID NO: 561327 - RNA, 22 nt, Human
aagcaaccgcgaagcggcggag

SEQ ID NO: 561328 - RNA, 22 nt, Human
aaguaauaaggaauaaaacccu

SEQ ID NO: 561329 - RNA, 19 nt, Human
acaaagcuaauuaagaagc

SEQ ID NO: 561330 - RNA, 22 nt, Human
acaaucuuucuucauuucucag

SEQ ID NO: 561331 - RNA, 20 nt, Human
acagagcaaaacaaaaacaa

SEQ ID NO: 561332 - RNA, 26 nt, Human
accaacaucaaauauuggaagcuuug

SEQ ID NO: 561333 - RNA, 26 nt, Human
agacaucuccucaaaucagccaaucc

SEQ ID NO: 561334 - RNA, 21 nt, Human
agagcuuaaccaacaucaaau

SEQ ID NO: 561335 - RNA, 22 nt, Human
agccaccaacagagcaaaacaa

SEQ ID NO: 561336 - RNA, 20 nt, Human
aggccgaagucgggcgagga

SEQ ID NO: 561337 - RNA, 20 nt, Human
aggcgacaggacgcuggagg

SEQ ID NO: 561338 - RNA, 18 nt, Human
aggcgcgggagaccgagu

SEQ ID NO: 561339 - RNA, 23 nt, Human
caaaaacaaagcuaauuaagaag

SEQ ID NO: 561340 - RNA, 19 nt, Human
caacagagcaaaacaaaaa

SEQ ID NO: 561341 - RNA, 19 nt, Human
caacuguacucuauccuug

SEQ ID NO: 561342 - RNA, 20 nt, Human
cagcucccgcgcucagcccu

SEQ ID NO: 561343 - RNA, 22 nt, Human
ccaagaagcugauuauacaaua

SEQ ID NO: 561344 - RNA, 25 nt, Human
ccaugccucgaagcaauucaaaacc

SEQ ID NO: 561345 - RNA, 19 nt, Human
ccauuagucuacugguucu

SEQ ID NO: 561346 - RNA, 21 nt, Human
cccaggcaaagauuuuuaaag

SEQ ID NO: 561347 - RNA, 23 nt, Human
ccccuacaacuguacucuauccu

SEQ ID NO: 561348 - RNA, 24 nt, Human
ccccuacaacuguacucuauccuu

SEQ ID NO: 561349 - RNA, 22 nt, Human
cggcccggacguugagaagcaa

SEQ ID NO: 561350 - RNA, 24 nt, Human
cucgaagcaauucaaaaccaagaa

SEQ ID NO: 561351 - RNA, 18 nt, Human
cuuuuugcucuaagaaug

SEQ ID NO: 561352 - RNA, 19 nt, Human
gaaaacagggggaagcagg

SEQ ID NO: 561353 - RNA, 19 nt, Human
gaagcaauucaaaaccaag

SEQ ID NO: 561354 - RNA, 20 nt, Human
gaggaauggagggaaacagg

SEQ ID NO: 561355 - RNA, 18 nt, Human
gagugccgauagcugcgg

SEQ ID NO: 561356 - RNA, 22 nt, Human
gccuagggcuggggcuccggcu

SEQ ID NO: 561357 - RNA, 24 nt, Human
gccuagggcuggggcuccggcucg

SEQ ID NO: 561358 - RNA, 22 nt, Human
gcgaagcggcggagauucgaac

SEQ ID NO: 561359 - RNA, 18 nt, Human
ggagggaaacaggacagg

SEQ ID NO: 561360 - RNA, 18 nt, Human
ggaggggguagggcgggg

SEQ ID NO: 561361 - RNA, 18 nt, Human
ggaggggguagggcgggg

SEQ ID NO: 561362 - RNA, 19 nt, Human
ggcccagaggcucgggcgg

SEQ ID NO: 561363 - RNA, 25 nt, Human
gggaaaacagggggaagccgguacc

SEQ ID NO: 561364 - RNA, 18 nt, Human
gggcuggggcuccggcuc

SEQ ID NO: 561365 - RNA, 19 nt, Human
uaacaaagccaccaacaga

SEQ ID NO: 561366 - RNA, 21 nt, Human
uaacaaagccaccaacagagc

SEQ ID NO: 561367 - RNA, 24 nt, Human
uaacaaagccaccaacagagcaaa

SEQ ID NO: 561368 - RNA, 26 nt, Human
uaaggaauaaaaccaugccucgaagc

SEQ ID NO: 561369 - RNA, 23 nt, Human
uacauaaaauacuuccccuacaa

SEQ ID NO: 561370 - RNA, 22 nt, Human
uauuaaaugagaaucucucaag

SEQ ID NO: 561371 - RNA, 24 nt, Human
ucacuuagagacaucuccucaaau

SEQ ID NO: 561372 - RNA, 18 nt, Human
ucagaacaaucuuucuuc

SEQ ID NO: 561373 - RNA, 18 nt, Human
ucccacugcuucggcucc

SEQ ID NO: 561374 - RNA, 18 nt, Human
ucgccgccgccgagaugc

SEQ ID NO: 561375 - RNA, 19 nt, Human
ugagaagcaaccgcgaagc

SEQ ID NO: 561376 - RNA, 21 nt, Human
ugggaaaacagggggaagcag

SEQ ID NO: 561377 - RNA, 22 nt, Human
uguaacaaagccaccaacagag

SEQ ID NO: 561378 - RNA, 24 nt, Human
uguaacaaagccaccaacagagca

SEQ ID NO: 561379 - RNA, 21 nt, Human
ugucaguguugaaaacuacag

SEQ ID NO: 561380 - RNA, 22 nt, Human
uucuuuaacaaugaaauaguaa

SEQ ID NO: 561381 - RNA, 21 nt, Human
uuuaaagugcugucaguguug

SEQ ID NO: 561382 - RNA, 19 nt, Human
accacggucacucuccagc

SEQ ID NO: 561383 - RNA, 22 nt, Human
accacggucacucuccagcccc

SEQ ID NO: 561384 - RNA, 20 nt, Human
acgcagccgucccaggucac

SEQ ID NO: 561385 - RNA, 20 nt, Human
agcccccggcccagcgccag

SEQ ID NO: 561386 - RNA, 22 nt, Human
aggagucagccccagccucgcc

SEQ ID NO: 561387 - RNA, 25 nt, Human
agggagcaggccaugggacccucau

SEQ ID NO: 561388 - RNA, 19 nt, Human
cacucuccagcccccggcc

SEQ ID NO: 561389 - RNA, 19 nt, Human
cagcccccggcccagcgcc

SEQ ID NO: 561390 - RNA, 22 nt, Human
cagccgucccaggucacucaga

SEQ ID NO: 561391 - RNA, 20 nt, Human
ccaccccggcccacgcagcc

SEQ ID NO: 561392 - RNA, 18 nt, Human
ccacggucacucuccagc

SEQ ID NO: 561393 - RNA, 21 nt, Human
ccagcccccggcccagcgcca

SEQ ID NO: 561394 - RNA, 21 nt, Human
ccagcgccaggguuagccgag

SEQ ID NO: 561395 - RNA, 20 nt, Human
ccgccaggacccggcgcggg

SEQ ID NO: 561396 - RNA, 20 nt, Human
ccugagggagcaggccaugg

SEQ ID NO: 561397 - RNA, 19 nt, Human
cgccaggguuagccgagaa

SEQ ID NO: 561398 - RNA, 22 nt, Human
cgcggcccgagcgccgccccuc

SEQ ID NO: 561399 - RNA, 21 nt, Human
cggcgcgggcagcgcgcggcc

SEQ ID NO: 561400 - RNA, 22 nt, Human
gcggcccgagcgccgccccucc

SEQ ID NO: 561401 - RNA, 20 nt, Human
ggccaugggacccucaucgg

SEQ ID NO: 561402 - RNA, 19 nt, Human
uagccgagaacaggaagua

SEQ ID NO: 561403 - RNA, 20 nt, Human
ucgccgcccgccaggacccg

SEQ ID NO: 561404 - RNA, 23 nt, Human
ucuggugcccggcuuugaggccc

SEQ ID NO: 561405 - RNA, 24 nt, Human
ugaggcaggagucagccccagccu

SEQ ID NO: 561406 - RNA, 20 nt, Human
ugagggagcaggccauggga

SEQ ID NO: 561407 - RNA, 24 nt, Human
ugcccggcuuugaggcccaccuua

SEQ ID NO: 561408 - RNA, 22 nt, Human
ugguaagaugccucuuuauugg

SEQ ID NO: 561409 - RNA, 20 nt, Human
uggugcuggagcuguuccug

SEQ ID NO: 561410 - RNA, 23 nt, Human
uuccugagggagcaggccauggg

SEQ ID NO: 561411 - RNA, 21 nt, Human
aagagaagaagguccagcaaa

SEQ ID NO: 561412 - RNA, 23 nt, Human
aagagaagaagguccagcaaaga

SEQ ID NO: 561413 - RNA, 18 nt, Human
aaucuauggauuaaccuu

SEQ ID NO: 561414 - RNA, 22 nt, Human
agaagugcaaaaucuguaaaaa

SEQ ID NO: 561415 - RNA, 18 nt, Human
agaauuuuccugaaacac

SEQ ID NO: 561416 - RNA, 19 nt, Human
aguuuuuaaccugaauuca

SEQ ID NO: 561417 - RNA, 20 nt, Human
augaggcaaagauuaagcac

SEQ ID NO: 561418 - RNA, 20 nt, Human
caagucacaguccucuaagc

SEQ ID NO: 561419 - RNA, 24 nt, Human
caaguuccuugcuuaaguggcaau

SEQ ID NO: 561420 - RNA, 20 nt, Human
caccgcgccagcguccaggu

SEQ ID NO: 561421 - RNA, 21 nt, Human
cagcguccaggugcggggaca

SEQ ID NO: 561422 - RNA, 20 nt, Human
ccgcgccagcguccaggugc

SEQ ID NO: 561423 - RNA, 21 nt, Human
ccuuaaagucuuuucaguaac

SEQ ID NO: 561424 - RNA, 20 nt, Human
gcccgggcgucgcgggcugg

SEQ ID NO: 561425 - RNA, 21 nt, Human
gcggggacagcggcagcccgg

SEQ ID NO: 561426 - RNA, 21 nt, Human
gcugguccgcgcgcaucacgc

SEQ ID NO: 561427 - RNA, 24 nt, Human
gcuuuuuuuccccucuuuuaauuc

SEQ ID NO: 561428 - RNA, 18 nt, Human
gugaguuuucuucgggcu

SEQ ID NO: 561429 - RNA, 21 nt, Human
uaacaugaaccaugaucucuu

SEQ ID NO: 561430 - RNA, 22 nt, Human
uacaaugcauuaauaaauggag

SEQ ID NO: 561431 - RNA, 28 nt, Human
uaggaagaauuuuccugaaacacagcag

SEQ ID NO: 561432 - RNA, 24 nt, Human
ucacgccgcggccggggacgcggg

SEQ ID NO: 561433 - RNA, 19 nt, Human
uccgcgcgcaucacgccgc

SEQ ID NO: 561434 - RNA, 24 nt, Human
uccgcgcgcaucacgccgcggccg

SEQ ID NO: 561435 - RNA, 20 nt, Human
ugaaccaugaucucuugaca

SEQ ID NO: 561436 - RNA, 22 nt, Human
ugcggggacagcggcagcccgg

SEQ ID NO: 561437 - RNA, 18 nt, Human
uggggcgugaguuuucuu

SEQ ID NO: 561438 - RNA, 19 nt, Human
uguagagagaagcaagcug

SEQ ID NO: 561439 - RNA, 20 nt, Human
aaccacaaugaggcagaaaa

SEQ ID NO: 561440 - RNA, 18 nt, Human
aagaugaugggaugggau

SEQ ID NO: 561441 - RNA, 21 nt, Human
acacacacccaauccuaaacc

SEQ ID NO: 561442 - RNA, 21 nt, Human
acucugggcuuccgugcucuc

SEQ ID NO: 561443 - RNA, 19 nt, Human
agccguauccuggaacuuc

SEQ ID NO: 561444 - RNA, 22 nt, Human
agguggccuguccuggagauga

SEQ ID NO: 561445 - RNA, 20 nt, Human
agugccauucagagaggaga

SEQ ID NO: 561446 - RNA, 19 nt, Human
augcucauugggcccauga

SEQ ID NO: 561447 - RNA, 22 nt, Human
auggcguuucccgcuaacuucu

SEQ ID NO: 561448 - RNA, 21 nt, Human
cacaauuaaugccaagaugag

SEQ ID NO: 561449 - RNA, 22 nt, Human
cacccuguucccuccugaugcu

SEQ ID NO: 561450 - RNA, 19 nt, Human
cagcaaacauuugagugcc

SEQ ID NO: 561451 - RNA, 28 nt, Human
ccaauccuaaaccacaaugaggcagaaa

SEQ ID NO: 561452 - RNA, 20 nt, Human
cccuuggggcuggacucccg

SEQ ID NO: 561453 - RNA, 23 nt, Human
cccuuggggcuggacucccgagc

SEQ ID NO: 561454 - RNA, 23 nt, Human
ccuaaaccacaaugaggcagaaa

SEQ ID NO: 561455 - RNA, 20 nt, Human
ccugcugugugugaggcugu

SEQ ID NO: 561456 - RNA, 24 nt, Human
ccugugguagggcuuuugcagggc

SEQ ID NO: 561457 - RNA, 23 nt, Human
cgggcuuguaacaccuucaugaa

SEQ ID NO: 561458 - RNA, 23 nt, Human
cgugcucucauuaauguaguucu

SEQ ID NO: 561459 - RNA, 23 nt, Human
cuuggcacaggucacuugcacau

SEQ ID NO: 561460 - RNA, 24 nt, Human
cuuggcacaggucacuugcacaug

SEQ ID NO: 561461 - RNA, 25 nt, Human
cuuggggcuggacucccgagccuuu

SEQ ID NO: 561462 - RNA, 22 nt, Human
gaagggugucagcacagagacu

SEQ ID NO: 561463 - RNA, 19 nt, Human
gcagaaaaguauaaucaaa

SEQ ID NO: 561464 - RNA, 20 nt, Human
gcucuuggcugaacgaaggc

SEQ ID NO: 561465 - RNA, 20 nt, Human
gcuguacaccccagucacgc

SEQ ID NO: 561466 - RNA, 21 nt, Human
ggagacacacacacccaaucc

SEQ ID NO: 561467 - RNA, 23 nt, Human
ggccccugcugugugugaggcug

SEQ ID NO: 561468 - RNA, 24 nt, Human
gggcuggacucccgagccuuuuuu

SEQ ID NO: 561469 - RNA, 18 nt, Human
guccauagcuguacaccc

SEQ ID NO: 561470 - RNA, 18 nt, Human
guccuggagaugagcuug

SEQ ID NO: 561471 - RNA, 23 nt, Human
gugguagggcuuuugcagggcug

SEQ ID NO: 561472 - RNA, 24 nt, Human
guuuugugaaagcgguauuuuuuu

SEQ ID NO: 561473 - RNA, 20 nt, Human
uaacuucucaggccccugcu

SEQ ID NO: 561474 - RNA, 18 nt, Human
uacugcugagaaauaugg

SEQ ID NO: 561475 - RNA, 25 nt, Human
uagauggcguuucccgcuaacuucu

SEQ ID NO: 561476 - RNA, 20 nt, Human
uagccguauccuggaacuuc

SEQ ID NO: 561477 - RNA, 23 nt, Human
uaguguguguugucuuucaaucu

SEQ ID NO: 561478 - RNA, 25 nt, Human
ucaacagucagcucagugcuugugu

SEQ ID NO: 561479 - RNA, 23 nt, Human
ucacauuguuguuggggauaagg

SEQ ID NO: 561480 - RNA, 23 nt, Human
uccacagaugccugggcacccug

SEQ ID NO: 561481 - RNA, 19 nt, Human
ucccgagccuuuuuucuuc

SEQ ID NO: 561482 - RNA, 19 nt, Human
ucccuuggggcuggacucc

SEQ ID NO: 561483 - RNA, 20 nt, Human
ucccuuggggcuggacuccc

SEQ ID NO: 561484 - RNA, 21 nt, Human
ucccuuggggcuggacucccg

SEQ ID NO: 561485 - RNA, 18 nt, Human
ucucaggccccugcugug

SEQ ID NO: 561486 - RNA, 20 nt, Human
ucucuuucuguucacucugg

SEQ ID NO: 561487 - RNA, 19 nt, Human
ucuuugccaggcuguuucc

SEQ ID NO: 561488 - RNA, 22 nt, Human
ugaagugccuuuucuggaugcu

SEQ ID NO: 561489 - RNA, 20 nt, Human
ugccuuaugcucuuggcuga

SEQ ID NO: 561490 - RNA, 22 nt, Human
ugcucacucccaaagccugaca

SEQ ID NO: 561491 - RNA, 19 nt, Human
ugcugucugagggcuccuc

SEQ ID NO: 561492 - RNA, 18 nt, Human
uggaugcucauugggccc

SEQ ID NO: 561493 - RNA, 21 nt, Human
uguacaccccagucacgcaga

SEQ ID NO: 561494 - RNA, 23 nt, Human
uguacaccccagucacgcagagu

SEQ ID NO: 561495 - RNA, 21 nt, Human
uuggggcuggacucccgagcc

SEQ ID NO: 561496 - RNA, 19 nt, Human
uuugaagugccuuuucugg

SEQ ID NO: 561497 - RNA, 22 nt, Human
aaaauaaaagagaugggagaga

SEQ ID NO: 561498 - RNA, 24 nt, Human
aaaguccuaggauuauagguguga

SEQ ID NO: 561499 - RNA, 24 nt, Human
aagcaaucugccugccucagccuc

SEQ ID NO: 561500 - RNA, 22 nt, Human
aaguacccuggacuacagacaa

SEQ ID NO: 561501 - RNA, 19 nt, Human
aagugauagcaagaaagaa

SEQ ID NO: 561502 - RNA, 18 nt, Human
acaggauuucauugggaa

SEQ ID NO: 561503 - RNA, 24 nt, Human
accauguugcccaggcuggucucg

SEQ ID NO: 561504 - RNA, 25 nt, Human
accauguugcccaggcuggucucga

SEQ ID NO: 561505 - RNA, 18 nt, Human
acggggucucaccauguu

SEQ ID NO: 561506 - RNA, 19 nt, Human
acggggucucaccauguug

SEQ ID NO: 561507 - RNA, 24 nt, Human
acggggucucaccauguugcccag

SEQ ID NO: 561508 - RNA, 20 nt, Human
acuuauuuuaucucccuucu

SEQ ID NO: 561509 - RNA, 26 nt, Human
acuuugucacccaggcuggaguagug

SEQ ID NO: 561510 - RNA, 19 nt, Human
aggugugagccaccuuacc

SEQ ID NO: 561511 - RNA, 21 nt, Human
agguucaagugaucccccuac

SEQ ID NO: 561512 - RNA, 23 nt, Human
auagcaucuucuccaagagcaag

SEQ ID NO: 561513 - RNA, 22 nt, Human
auaggcuggguagaaucaaaag

SEQ ID NO: 561514 - RNA, 24 nt, Human
caaaguccuaggauuauaggugug

SEQ ID NO: 561515 - RNA, 23 nt, Human
caagaaagaacugcuacaacucu

SEQ ID NO: 561516 - RNA, 20 nt, Human
caagugaucccccuaccuca

SEQ ID NO: 561517 - RNA, 24 nt, Human
caccacgccuggcuaauuuuugua

SEQ ID NO: 561518 - RNA, 24 nt, Human
caccauguugcccaggcuggucuc

SEQ ID NO: 561519 - RNA, 27 nt, Human
caccauguugcccaggcuggucucgaa

SEQ ID NO: 561520 - RNA, 23 nt, Human
cagccucgaccacccagguucaa

SEQ ID NO: 561521 - RNA, 21 nt, Human
cauagacggacaauaucaaga

SEQ ID NO: 561522 - RNA, 21 nt, Human
caucaaagucaauaaaaaauc

SEQ ID NO: 561523 - RNA, 25 nt, Human
caucucuauuuccagacuauaaggg

SEQ ID NO: 561524 - RNA, 19 nt, Human
cauguugcccaggcugguc

SEQ ID NO: 561525 - RNA, 23 nt, Human
cauguugcccaggcuggucucga

SEQ ID NO: 561526 - RNA, 24 nt, Human
cauguugcccaggcuggucucgaa

SEQ ID NO: 561527 - RNA, 21 nt, Human
ccaaaguccuaggauuauagg

SEQ ID NO: 561528 - RNA, 24 nt, Human
ccaaaguccuaggauuauaggugu

SEQ ID NO: 561529 - RNA, 20 nt, Human
ccaccacgccuggcuaauuu

SEQ ID NO: 561530 - RNA, 22 nt, Human
cccagguucaagugaucccccu

SEQ ID NO: 561531 - RNA, 25 nt, Human
cccccuaccucaggcccucaaguac

SEQ ID NO: 561532 - RNA, 18 nt, Human
ccuaaaaguaacagagau

SEQ ID NO: 561533 - RNA, 23 nt, Human
ccugagcucaagcaaucugccug

SEQ ID NO: 561534 - RNA, 20 nt, Human
ccuggacuacagacaagugc

SEQ ID NO: 561535 - RNA, 21 nt, Human
ccuggccaaaaaaaaaaaaaa

SEQ ID NO: 561536 - RNA, 21 nt, Human
ccuggccaaaaaaaaaaaaaa

SEQ ID NO: 561537 - RNA, 22 nt, Human
ccuggccaaaaaaaaaaaaaag

SEQ ID NO: 561538 - RNA, 24 nt, Human
cggggucucaccauguugcccagg

SEQ ID NO: 561539 - RNA, 22 nt, Human
cucaaguacccuggacuacaga

SEQ ID NO: 561540 - RNA, 21 nt, Human
cucagccucccaaaguccuag

SEQ ID NO: 561541 - RNA, 22 nt, Human
cucggcucacugcagccucgac

SEQ ID NO: 561542 - RNA, 25 nt, Human
cugcuacaacucuagucaauuaugu

SEQ ID NO: 561543 - RNA, 23 nt, Human
cuggccaaaaaaaaaaaaaagcc

SEQ ID NO: 561544 - RNA, 19 nt, Human
gaaaaaaaucucuaccucc

SEQ ID NO: 561545 - RNA, 23 nt, Human
gaacuccugagcucaagcaaucu

SEQ ID NO: 561546 - RNA, 24 nt, Human
gagcucaagcaaucugccugccuc

SEQ ID NO: 561547 - RNA, 18 nt, Human
gauuauaggugugagcca

SEQ ID NO: 561548 - RNA, 20 nt, Human
gauuauaggugugagccacc

SEQ ID NO: 561549 - RNA, 24 nt, Human
gauuauaggugugagccaccuuac

SEQ ID NO: 561550 - RNA, 24 nt, Human
gcaaucugccugccucagccuccc

SEQ ID NO: 561551 - RNA, 22 nt, Human
gcagccucgaccacccagguuc

SEQ ID NO: 561552 - RNA, 19 nt, Human
gccuccauuuuuuuuucuu

SEQ ID NO: 561553 - RNA, 24 nt, Human
gcuggaguaguggcgcgaucucgg

SEQ ID NO: 561554 - RNA, 22 nt, Human
ggacuacagacaagugccacca

SEQ ID NO: 561555 - RNA, 19 nt, Human
ggagcaaauggguaaaguc

SEQ ID NO: 561556 - RNA, 22 nt, Human
ggagcucauucagaaaaugggg

SEQ ID NO: 561557 - RNA, 24 nt, Human
ggaguaguggcgcgaucucggcuc

SEQ ID NO: 561558 - RNA, 21 nt, Human
ggggaaaaaaguugucucugu

SEQ ID NO: 561559 - RNA, 22 nt, Human
gggucucaccauguugcccagg

SEQ ID NO: 561560 - RNA, 22 nt, Human
guagagacggggucucaccaug

SEQ ID NO: 561561 - RNA, 21 nt, Human
guaguggcgcgaucucggcuc

SEQ ID NO: 561562 - RNA, 18 nt, Human
uaaaagagaugggagaga

SEQ ID NO: 561563 - RNA, 22 nt, Human
uaaaauaaaagagaugggagag

SEQ ID NO: 561564 - RNA, 22 nt, Human
uaagaaaaaaaucucuaccucc

SEQ ID NO: 561565 - RNA, 20 nt, Human
uaagagaauuggguuacagg

SEQ ID NO: 561566 - RNA, 23 nt, Human
uaauuuuuguacuuuuguagaga

SEQ ID NO: 561567 - RNA, 19 nt, Human
uacaaugcuacucacagag

SEQ ID NO: 561568 - RNA, 22 nt, Human
uacagacaagugccaccacgcc

SEQ ID NO: 561569 - RNA, 22 nt, Human
uacagacaagugccaccacgcc

SEQ ID NO: 561570 - RNA, 19 nt, Human
uaccucaggcccucaagua

SEQ ID NO: 561571 - RNA, 18 nt, Human
uaccuccaaaagcuggua

SEQ ID NO: 561572 - RNA, 25 nt, Human
uaccuggccaaaaaaaaaaaaaagc

SEQ ID NO: 561573 - RNA, 22 nt, Human
uacuuugucacccaggcuggag

SEQ ID NO: 561574 - RNA, 22 nt, Human
uagagacggggucucaccaugu

SEQ ID NO: 561575 - RNA, 18 nt, Human
uaggauuauaggugugag

SEQ ID NO: 561576 - RNA, 19 nt, Human
uaggauuauaggugugagc

SEQ ID NO: 561577 - RNA, 21 nt, Human
uaggauuauaggugugagcca

SEQ ID NO: 561578 - RNA, 22 nt, Human
uaggauuauaggugugagccac

SEQ ID NO: 561579 - RNA, 23 nt, Human
uaggauuauaggugugagccacc

SEQ ID NO: 561580 - RNA, 22 nt, Human
ucaaaagggcugagggagcaaa

SEQ ID NO: 561581 - RNA, 24 nt, Human
ucacugcagccucgaccacccagg

SEQ ID NO: 561582 - RNA, 19 nt, Human
ucagccucccaaaguccua

SEQ ID NO: 561583 - RNA, 19 nt, Human
ucauucagaaaauggggaa

SEQ ID NO: 561584 - RNA, 23 nt, Human
ucccaaaguccuaggauuauagg

SEQ ID NO: 561585 - RNA, 23 nt, Human
ucccuucuuaguauuuaguacaa

SEQ ID NO: 561586 - RNA, 23 nt, Human
ucucaccauguugcccaggcugg

SEQ ID NO: 561587 - RNA, 26 nt, Human
ucucaccauguugcccaggcuggucu

SEQ ID NO: 561588 - RNA, 27 nt, Human
ucucaccauguugcccaggcuggucuc

SEQ ID NO: 561589 - RNA, 23 nt, Human
ucucgaacuccugagcucaagca

SEQ ID NO: 561590 - RNA, 18 nt, Human
ucuggcuuacaacaaugg

SEQ ID NO: 561591 - RNA, 22 nt, Human
ucugucucuuagaccugccucc

SEQ ID NO: 561592 - RNA, 23 nt, Human
ucuuacuuugucacccaggcugg

SEQ ID NO: 561593 - RNA, 24 nt, Human
ucuuacuuugucacccaggcugga

SEQ ID NO: 561594 - RNA, 21 nt, Human
ugauagcaagaaagaacugcu

SEQ ID NO: 561595 - RNA, 24 nt, Human
ugcccaggcuggucucgaacuccu

SEQ ID NO: 561596 - RNA, 28 nt, Human
ugcccaggcuggucucgaacuccugagc

SEQ ID NO: 561597 - RNA, 23 nt, Human
ugccucagccucccaaaguccua

SEQ ID NO: 561598 - RNA, 24 nt, Human
ugccucagccucccaaaguccuag

SEQ ID NO: 561599 - RNA, 23 nt, Human
ugcuagauauagcaucuucucca

SEQ ID NO: 561600 - RNA, 24 nt, Human
ugcucuacuucaucucuauuucca

SEQ ID NO: 561601 - RNA, 23 nt, Human
uggacuacagacaagugccacca

SEQ ID NO: 561602 - RNA, 22 nt, Human
uggaguaguggcgcgaucucgg

SEQ ID NO: 561603 - RNA, 21 nt, Human
uggccaaaaaaaaaaaaaagc

SEQ ID NO: 561604 - RNA, 24 nt, Human
uguagagacggggucucaccaugu

SEQ ID NO: 561605 - RNA, 18 nt, Human
uuacuuugucacccaggc

SEQ ID NO: 561606 - RNA, 24 nt, Human
uuacuuugucacccaggcuggagu

SEQ ID NO: 561607 - RNA, 23 nt, Human
uucaagugaucccccuaccucag

SEQ ID NO: 561608 - RNA, 25 nt, Human
uucaagugaucccccuaccucaggc

SEQ ID NO: 561609 - RNA, 21 nt, Human
uucauugggaauauuaauuga

SEQ ID NO: 561610 - RNA, 24 nt, Human
uuccacaggcuuagaaaguuucau

SEQ ID NO: 561611 - RNA, 23 nt, Human
uucucagucuuccacaggcuuag

SEQ ID NO: 561612 - RNA, 20 nt, Human
uugaagaaauuagauggugu

SEQ ID NO: 561613 - RNA, 21 nt, Human
uugaagaaauuagaugguguu

SEQ ID NO: 561614 - RNA, 24 nt, Human
uuguagagacggggucucaccaug

SEQ ID NO: 561615 - RNA, 18 nt, Human
uuuccagacuauaagggc

SEQ ID NO: 561616 - RNA, 18 nt, Human
uuuguagagacggggucu

SEQ ID NO: 561617 - RNA, 24 nt, Human
uuuguagagacggggucucaccau

SEQ ID NO: 561618 - RNA, 22 nt, Human
uuugucacccaggcuggaguag

SEQ ID NO: 561619 - RNA, 20 nt, Human
uuuuuuuucuuugaagaaau

SEQ ID NO: 561620 - RNA, 19 nt, Human
aaacacaugcccaugcucu

SEQ ID NO: 561621 - RNA, 25 nt, Human
agcagccagagccccagccuggagc

SEQ ID NO: 561622 - RNA, 19 nt, Human
agugaccaggucgaggcug

SEQ ID NO: 561623 - RNA, 24 nt, Human
auggguccugcucuccagguuccu

SEQ ID NO: 561624 - RNA, 19 nt, Human
caccagccagcagaugcuc

SEQ ID NO: 561625 - RNA, 21 nt, Human
caccagccagcagaugcucca

SEQ ID NO: 561626 - RNA, 19 nt, Human
cacgcacagccugcacagc

SEQ ID NO: 561627 - RNA, 19 nt, Human
cacuccaucaucuuguccc

SEQ ID NO: 561628 - RNA, 19 nt, Human
cagcccccucugcaggucc

SEQ ID NO: 561629 - RNA, 22 nt, Human
caggaucuucccgcugcccagg

SEQ ID NO: 561630 - RNA, 21 nt, Human
ccagucgcccaacuucgccag

SEQ ID NO: 561631 - RNA, 20 nt, Human
ccaucuugauugagggucag

SEQ ID NO: 561632 - RNA, 19 nt, Human
ccccagagggaagaugguu

SEQ ID NO: 561633 - RNA, 18 nt, Human
cccucugcagguccccuc

SEQ ID NO: 561634 - RNA, 26 nt, Human
ccgacagcccccucugcagguccccu

SEQ ID NO: 561635 - RNA, 23 nt, Human
ccgcccagccauggguccugcuc

SEQ ID NO: 561636 - RNA, 18 nt, Human
ccugcucuccagguuccu

SEQ ID NO: 561637 - RNA, 26 nt, Human
ccuggagcugaggcucuuccuggggc

SEQ ID NO: 561638 - RNA, 19 nt, Human
ccuugacgcuguccuucuc

SEQ ID NO: 561639 - RNA, 19 nt, Human
cuaccgccgcuuccgcgcc

SEQ ID NO: 561640 - RNA, 21 nt, Human
cucgucccccuuguagaacac

SEQ ID NO: 561641 - RNA, 18 nt, Human
cugguggcggaaucggaa

SEQ ID NO: 561642 - RNA, 19 nt, Human
gaaauguucaaaauuccuc

SEQ ID NO: 561643 - RNA, 21 nt, Human
gaaggggaacucgggccaccc

SEQ ID NO: 561644 - RNA, 24 nt, Human
gcagccagagccccagccuggagc

SEQ ID NO: 561645 - RNA, 20 nt, Human
gcccaagguauacaggaacc

SEQ ID NO: 561646 - RNA, 19 nt, Human
gcucucuuucuucugaagc

SEQ ID NO: 561647 - RNA, 21 nt, Human
gcugcagcuaccgccgcuucc

SEQ ID NO: 561648 - RNA, 20 nt, Human
gggaggcuccuccgcaaucc

SEQ ID NO: 561649 - RNA, 26 nt, Human
gggcagcagcaagcuggcccuugggc

SEQ ID NO: 561650 - RNA, 19 nt, Human
gggccacaaacacgucacc

SEQ ID NO: 561651 - RNA, 19 nt, Human
gggcucucucaggccaccu

SEQ ID NO: 561652 - RNA, 18 nt, Human
ggggcggugaaggggaac

SEQ ID NO: 561653 - RNA, 19 nt, Human
gugaaggggaacucgggcc

SEQ ID NO: 561654 - RNA, 22 nt, Human
uaccagggcucucucaggccac

SEQ ID NO: 561655 - RNA, 20 nt, Human
uauucucagcagcgauuuuc

SEQ ID NO: 561656 - RNA, 19 nt, Human
ucacuggggcucucagugg

SEQ ID NO: 561657 - RNA, 20 nt, Human
ucaguggccaucccagcucu

SEQ ID NO: 561658 - RNA, 26 nt, Human
ucaguggccaucccagcucugcgcug

SEQ ID NO: 561659 - RNA, 23 nt, Human
uccccccagagggaagaugguuc

SEQ ID NO: 561660 - RNA, 28 nt, Human
ucccgacagcccccucugcagguccccu

SEQ ID NO: 561661 - RNA, 23 nt, Human
uccuggggcucgccgggccccug

SEQ ID NO: 561662 - RNA, 23 nt, Human
ucuauggaaauaaagugaccagg

SEQ ID NO: 561663 - RNA, 21 nt, Human
ucucuggcccaagguauacag

SEQ ID NO: 561664 - RNA, 20 nt, Human
ucugcgcuggcccuucugga

SEQ ID NO: 561665 - RNA, 19 nt, Human
uggaccaucuucugggcug

SEQ ID NO: 561666 - RNA, 22 nt, Human
uggagcugaggcucuuccuggg

SEQ ID NO: 561667 - RNA, 24 nt, Human
uggcccaagguauacaggaaccaa

SEQ ID NO: 561668 - RNA, 18 nt, Human
uguagaacacagcaaacu

SEQ ID NO: 561669 - RNA, 18 nt, Human
ugucacuggggcucucag

SEQ ID NO: 561670 - RNA, 20 nt, Human
ugucacuggggcucucagug

SEQ ID NO: 561671 - RNA, 18 nt, Human
ugucccgacagcccccuc

SEQ ID NO: 561672 - RNA, 20 nt, Human
ugucccggaccagugcugcg

SEQ ID NO: 561673 - RNA, 18 nt, Human
uguccuguggcaagggca

SEQ ID NO: 561674 - RNA, 21 nt, Human
uucaaaauuccucuucccgau

SEQ ID NO: 561675 - RNA, 22 nt, Human
uucaaaauuccucuucccgaug

SEQ ID NO: 561676 - RNA, 21 nt, Human
uucugggcugucacuggggcu

SEQ ID NO: 561677 - RNA, 23 nt, Human
aaacauuuagcuuuccaaaaaua

SEQ ID NO: 561678 - RNA, 19 nt, Human
aggagaagcggaggccugg

SEQ ID NO: 561679 - RNA, 23 nt, Human
caccaccaaggagaugcguuccg

SEQ ID NO: 561680 - RNA, 21 nt, Human
ccaggcugggccagggcgcag

SEQ ID NO: 561681 - RNA, 24 nt, Human
cgccgcgcucuucuggggcgcuca

SEQ ID NO: 561682 - RNA, 21 nt, Human
cuccucuaagucucuuucccc

SEQ ID NO: 561683 - RNA, 21 nt, Human
cuuucccccaccaccaaggag

SEQ ID NO: 561684 - RNA, 21 nt, Human
gagccgagccaggcugggcca

SEQ ID NO: 561685 - RNA, 19 nt, Human
gagcugagccgagccaggc

SEQ ID NO: 561686 - RNA, 22 nt, Human
gagggaaggaagggcaaggcag

SEQ ID NO: 561687 - RNA, 21 nt, Human
ggagggaaggaagggcaaggc

SEQ ID NO: 561688 - RNA, 21 nt, Human
ggcugccccaggagaagcgga

SEQ ID NO: 561689 - RNA, 21 nt, Human
ggugggggccacgaguuugcu

SEQ ID NO: 561690 - RNA, 20 nt, Human
uacaggaggauuuacauggc

SEQ ID NO: 561691 - RNA, 20 nt, Human
ucacggugacaggcuggggu

SEQ ID NO: 561692 - RNA, 20 nt, Human
ucucuuucccccaccaccaa

SEQ ID NO: 561693 - RNA, 19 nt, Human
ugccccaggagaagcggag

SEQ ID NO: 561694 - RNA, 23 nt, Human
uucccccaccaccaaggagaugc

SEQ ID NO: 561695 - RNA, 19 nt, Human
uugcugccagucaucgagg

SEQ ID NO: 561696 - RNA, 26 nt, Human
uuuccugaauauacaaaggugggggc

SEQ ID NO: 561697 - RNA, 19 nt, Human
uuuuuuuuuuuuuuuguuu

SEQ ID NO: 561698 - RNA, 27 nt, Human
aaaaaaaaaaaaaagggaauugcagag

SEQ ID NO: 561699 - RNA, 22 nt, Human
aaaaaaaaaaagggaauugcag

SEQ ID NO: 561700 - RNA, 22 nt, Human
aaaaaaacaaaaagucagcaaa

SEQ ID NO: 561701 - RNA, 19 nt, Human
aaaaacaaaaugaacagag

SEQ ID NO: 561702 - RNA, 25 nt, Human
aaaaauacgucacuccuuagaauac

SEQ ID NO: 561703 - RNA, 23 nt, Human
aaaacaaaaaaccacuucaacau

SEQ ID NO: 561704 - RNA, 22 nt, Human
aaaacaaaaacaaaaacaaaaa

SEQ ID NO: 561705 - RNA, 23 nt, Human
aaaacaaaaacaaaaacaaaaaa

SEQ ID NO: 561706 - RNA, 18 nt, Human
aaaacaaaaugaacagag

SEQ ID NO: 561707 - RNA, 20 nt, Human
aaaagccuuaucagaccauc

SEQ ID NO: 561708 - RNA, 28 nt, Human
aaacaaaaacaaaaacaaaaaaccacuu

SEQ ID NO: 561709 - RNA, 24 nt, Human
aaacaaaaagucagcaaaaccagc

SEQ ID NO: 561710 - RNA, 27 nt, Human
aaauaaaaacaaaaugaacagagacaa

SEQ ID NO: 561711 - RNA, 20 nt, Human
aacaaaaaaccacuucaaca

SEQ ID NO: 561712 - RNA, 24 nt, Human
aacaaaaaaccacuucaacaugaa

SEQ ID NO: 561713 - RNA, 19 nt, Human
aagagcgacaguaucacaa

SEQ ID NO: 561714 - RNA, 24 nt, Human
aagagcgacaguaucacaaggaca

SEQ ID NO: 561715 - RNA, 22 nt, Human
aaucaccaacuuuuucuuuuuu

SEQ ID NO: 561716 - RNA, 30 nt, Human
acaaauuaaaaaaacaaaaacaaaaacaaa

SEQ ID NO: 561717 - RNA, 24 nt, Human
accacuucaacaugaagcuaccau

SEQ ID NO: 561718 - RNA, 21 nt, Human
acugguuuaacaauacaccac

SEQ ID NO: 561719 - RNA, 20 nt, Human
agaauccaaacaggugaaaa

SEQ ID NO: 561720 - RNA, 18 nt, Human
agcgacaguaucacaagg

SEQ ID NO: 561721 - RNA, 19 nt, Human
aggccccucacgcggccag

SEQ ID NO: 561722 - RNA, 22 nt, Human
aggccccucacgcggccaguuc

SEQ ID NO: 561723 - RNA, 19 nt, Human
aguuccccucgccuccgcc

SEQ ID NO: 561724 - RNA, 21 nt, Human
auaacucugaagucagugggg

SEQ ID NO: 561725 - RNA, 21 nt, Human
auuagaacaagcuaacuuucc

SEQ ID NO: 561726 - RNA, 20 nt, Human
caaaaacaaaaaaccacuuc

SEQ ID NO: 561727 - RNA, 25 nt, Human
caaaaacaaaaaaccacuucaacau

SEQ ID NO: 561728 - RNA, 27 nt, Human
caaaaacaaaaacaaaaaaccacuuca

SEQ ID NO: 561729 - RNA, 22 nt, Human
caaaaagucagcaaaaccagca

SEQ ID NO: 561730 - RNA, 21 nt, Human
caacgagaaacccguagcgcc

SEQ ID NO: 561731 - RNA, 26 nt, Human
caacuuuuucuuuuuuuauaaauaua

SEQ ID NO: 561732 - RNA, 21 nt, Human
cagaccacuaauauagaaucc

SEQ ID NO: 561733 - RNA, 19 nt, Human
cagcugccacgaaggccgc

SEQ ID NO: 561734 - RNA, 21 nt, Human
cauagccccuauuagaacaag

SEQ ID NO: 561735 - RNA, 19 nt, Human
ccggccgcccuucccacaa

SEQ ID NO: 561736 - RNA, 23 nt, Human
ccucacgcggccaguuccccucg

SEQ ID NO: 561737 - RNA, 23 nt, Human
ccucagaccacuaauauagaauc

SEQ ID NO: 561738 - RNA, 21 nt, Human
ccucaggccccucacgcggcc

SEQ ID NO: 561739 - RNA, 19 nt, Human
cucuuccucagaccacuag

SEQ ID NO: 561740 - RNA, 24 nt, Human
cugcaccggccgcccuucccacaa

SEQ ID NO: 561741 - RNA, 25 nt, Human
gaaggaaaaaaaaaaaaaaaaggga

SEQ ID NO: 561742 - RNA, 22 nt, Human
gaucugcucuuccucagaccac

SEQ ID NO: 561743 - RNA, 18 nt, Human
gccaggcgccccuaagau

SEQ ID NO: 561744 - RNA, 23 nt, Human
gccuccaacgagaaacccguagc

SEQ ID NO: 561745 - RNA, 23 nt, Human
uacaaaguuuuuccauuuuucuu

SEQ ID NO: 561746 - RNA, 23 nt, Human
uagaauacaacaaugaucugaua

SEQ ID NO: 561747 - RNA, 18 nt, Human
uagguccaguaauacccu

SEQ ID NO: 561748 - RNA, 25 nt, Human
uauaaaaaaacaaaaagucagcaaa

SEQ ID NO: 561749 - RNA, 22 nt, Human
ucaagagcgacaguaucacaag

SEQ ID NO: 561750 - RNA, 21 nt, Human
ucagaccauccauaguuuuac

SEQ ID NO: 561751 - RNA, 19 nt, Human
uccaguaauacccugggaa

SEQ ID NO: 561752 - RNA, 24 nt, Human
ugaaauaaaaacaaaaugaacaga

SEQ ID NO: 561753 - RNA, 23 nt, Human
ugaaauaaaaacaaaaugaacuu

SEQ ID NO: 561754 - RNA, 20 nt, Human
ugaccaacuguuuccuuacc

SEQ ID NO: 561755 - RNA, 24 nt, Human
ugacuuaguggaaggaaaaaaaaa

SEQ ID NO: 561756 - RNA, 20 nt, Human
ugaucugcucuuccucagac

SEQ ID NO: 561757 - RNA, 22 nt, Human
ugcaccggccgcccuucccaca

SEQ ID NO: 561758 - RNA, 22 nt, Human
uguaucaggaacaucaagagcg

SEQ ID NO: 561759 - RNA, 24 nt, Human
uuuacaaugugaucugcucuuccu

SEQ ID NO: 561760 - RNA, 21 nt, Human
uuuacacaauggggaaugcug

SEQ ID NO: 561761 - RNA, 21 nt, Human
aaauagucuuuauuaugagaa

SEQ ID NO: 561762 - RNA, 22 nt, Human
aacaauucucccccucugcaag

SEQ ID NO: 561763 - RNA, 20 nt, Human
aagacacucucaggcuaugg

SEQ ID NO: 561764 - RNA, 23 nt, Human
aagagccuuggcaccagaaacac

SEQ ID NO: 561765 - RNA, 22 nt, Human
aagcagaaggaacaauucuccc

SEQ ID NO: 561766 - RNA, 23 nt, Human
aaguguacgaugaguuucuaagc

SEQ ID NO: 561767 - RNA, 22 nt, Human
aauugcucuugaacagggcuac

SEQ ID NO: 561768 - RNA, 18 nt, Human
acacagugggugagugac

SEQ ID NO: 561769 - RNA, 18 nt, Human
agaccccgacaccacuaa

SEQ ID NO: 561770 - RNA, 24 nt, Human
aggaaagcagaaggaaccgguacc

SEQ ID NO: 561771 - RNA, 26 nt, Human
aggcaaauagaaggcucaaggucaag

SEQ ID NO: 561772 - RNA, 18 nt, Human
agguacccgugagcccag

SEQ ID NO: 561773 - RNA, 18 nt, Human
agucccugguagggaaag

SEQ ID NO: 561774 - RNA, 19 nt, Human
ccccuaggaaagcagaagg

SEQ ID NO: 561775 - RNA, 19 nt, Human
ccuccgagucccugguagg

SEQ ID NO: 561776 - RNA, 25 nt, Human
ccuggaaauaucuccuaugccuucc

SEQ ID NO: 561777 - RNA, 18 nt, Human
ccugguagggaaaggagg

SEQ ID NO: 561778 - RNA, 21 nt, Human
cggaugacuccccaaaaacca

SEQ ID NO: 561779 - RNA, 22 nt, Human
cuaagcucaagaguccccuagg

SEQ ID NO: 561780 - RNA, 23 nt, Human
cucucaggcuauggcaggcaguc

SEQ ID NO: 561781 - RNA, 20 nt, Human
cucuguccacuagaccccga

SEQ ID NO: 561782 - RNA, 18 nt, Human
cuuccuccgagucccugg

SEQ ID NO: 561783 - RNA, 18 nt, Human
gaaaggagggaugagagu

SEQ ID NO: 561784 - RNA, 18 nt, Human
gacuccccaaaaaccagg

SEQ ID NO: 561785 - RNA, 19 nt, Human
gagcagggggcucugggcc

SEQ ID NO: 561786 - RNA, 21 nt, Human
gagcuaagagcucucaaauau

SEQ ID NO: 561787 - RNA, 21 nt, Human
gaguggggcccucaagagccu

SEQ ID NO: 561788 - RNA, 22 nt, Human
gcaggcagucacugaugggucc

SEQ ID NO: 561789 - RNA, 22 nt, Human
gcagggggcucugggccccuug

SEQ ID NO: 561790 - RNA, 19 nt, Human
gcucugggccccuuguuag

SEQ ID NO: 561791 - RNA, 21 nt, Human
ggaagcauagacauccuugag

SEQ ID NO: 561792 - RNA, 19 nt, Human
ggcccagggguacugacga

SEQ ID NO: 561793 - RNA, 18 nt, Human
gggggcucugggccccuu

SEQ ID NO: 561794 - RNA, 21 nt, Human
gggguuuuuuccaggaagcac

SEQ ID NO: 561795 - RNA, 21 nt, Human
ucaaauaucugaugcuagcac

SEQ ID NO: 561796 - RNA, 19 nt, Human
ucacaugcugguuucuuuc

SEQ ID NO: 561797 - RNA, 18 nt, Human
uccagauguggcuggagc

SEQ ID NO: 561798 - RNA, 30 nt, Human
ucccugguagggaaaggagggaugagaguu

SEQ ID NO: 561799 - RNA, 22 nt, Human
ucucaaauaucugaugcuagca

SEQ ID NO: 561800 - RNA, 18 nt, Human
ucucccccucugcaaggu

SEQ ID NO: 561801 - RNA, 22 nt, Human
ugacuccccaaaaaccaggcac

SEQ ID NO: 561802 - RNA, 25 nt, Human
ugagaaagcaguguuaucuaggaaa

SEQ ID NO: 561803 - RNA, 26 nt, Human
ugagaguggggcccucaagagccuug

SEQ ID NO: 561804 - RNA, 20 nt, Human
ugagcccagggucguaagcc

SEQ ID NO: 561805 - RNA, 26 nt, Human
ugaggcaaauagaaggcucaagguca

SEQ ID NO: 561806 - RNA, 19 nt, Human
uggcacauccacagugcuc

SEQ ID NO: 561807 - RNA, 24 nt, Human
uggcuggagcagggggcucugggc

SEQ ID NO: 561808 - RNA, 20 nt, Human
uggggcccucaagagccuug

SEQ ID NO: 561809 - RNA, 19 nt, Human
uguggcuggagcagggggc

SEQ ID NO: 561810 - RNA, 21 nt, Human
uguuagcaguggcccaggggu

SEQ ID NO: 561811 - RNA, 19 nt, Human
uucucccccucugcaaggu

SEQ ID NO: 561812 - RNA, 23 nt, Human
uucucuguccacuagaccccgac

SEQ ID NO: 561813 - RNA, 19 nt, Human
aaagcaagagaagagugag

SEQ ID NO: 561814 - RNA, 20 nt, Human
acaggcucucggcccgcucc

SEQ ID NO: 561815 - RNA, 29 nt, Human
acauccacgccccuccuuucucacgaaaa

SEQ ID NO: 561816 - RNA, 28 nt, Human
accuucauccucauucauugucuuugau

SEQ ID NO: 561817 - RNA, 18 nt, Human
agcuugcugcugcugcug

SEQ ID NO: 561818 - RNA, 18 nt, Human
aggacaagggucuggcuc

SEQ ID NO: 561819 - RNA, 21 nt, Human
agggggcagagggggaguccc

SEQ ID NO: 561820 - RNA, 22 nt, Human
aggucucuuuugcuagcaguuc

SEQ ID NO: 561821 - RNA, 25 nt, Human
auaauaauaaagauucgcaaggcac

SEQ ID NO: 561822 - RNA, 25 nt, Human
auccuuuucuccuuccacgguguuu

SEQ ID NO: 561823 - RNA, 22 nt, Human
caccaucuguacacaagaaagu

SEQ ID NO: 561824 - RNA, 21 nt, Human
cagcacagagggccuagggag

SEQ ID NO: 561825 - RNA, 20 nt, Human
ccaaccuucauccucauuca

SEQ ID NO: 561826 - RNA, 21 nt, Human
ccacagcaauccuacauccac

SEQ ID NO: 561827 - RNA, 21 nt, Human
cccauccuuuucuccuuccac

SEQ ID NO: 561828 - RNA, 19 nt, Human
ccgcugccgcuggcacugu

SEQ ID NO: 561829 - RNA, 21 nt, Human
ccgcugccgcuggcacugugc

SEQ ID NO: 561830 - RNA, 22 nt, Human
ccuacagaaaacaaaagaaaac

SEQ ID NO: 561831 - RNA, 19 nt, Human
ccuacauccacgccccucc

SEQ ID NO: 561832 - RNA, 24 nt, Human
ccuccugccggcuggccuucugaa

SEQ ID NO: 561833 - RNA, 21 nt, Human
ccuuugggccgagccagaaca

SEQ ID NO: 561834 - RNA, 22 nt, Human
cggaggacaggcucucggcccg

SEQ ID NO: 561835 - RNA, 20 nt, Human
gaaagcaagagaagagugag

SEQ ID NO: 561836 - RNA, 18 nt, Human
gaccgucgcccugcccag

SEQ ID NO: 561837 - RNA, 25 nt, Human
gagccagaacacagugcuuggggga

SEQ ID NO: 561838 - RNA, 19 nt, Human
gcaguaauaggagaggcug

SEQ ID NO: 561839 - RNA, 24 nt, Human
gcccgcgugcagccgggagcucac

SEQ ID NO: 561840 - RNA, 18 nt, Human
gcuugggggaagccaccu

SEQ ID NO: 561841 - RNA, 22 nt, Human
ggacagggggcagagggggagu

SEQ ID NO: 561842 - RNA, 19 nt, Human
ggcccgccgggaaggcggg

SEQ ID NO: 561843 - RNA, 24 nt, Human
gggaaggcggcugguugguucagg

SEQ ID NO: 561844 - RNA, 30 nt, Human
gggaaggcggcugguugguucagggggcuu

SEQ ID NO: 561845 - RNA, 21 nt, Human
gggcagagggggagucccuuc

SEQ ID NO: 561846 - RNA, 20 nt, Human
ggggagaggcauucguagug

SEQ ID NO: 561847 - RNA, 24 nt, Human
gugcaacaucucugaagucgaaac

SEQ ID NO: 561848 - RNA, 18 nt, Human
gugcagccgggagcucac

SEQ ID NO: 561849 - RNA, 20 nt, Human
uacagaaaacaaaagaaaac

SEQ ID NO: 561850 - RNA, 24 nt, Human
uacagaaaacaaaagaaaacucgc

SEQ ID NO: 561851 - RNA, 21 nt, Human
uccacagcaauccuacauccc

SEQ ID NO: 561852 - RNA, 22 nt, Human
ucccauccuuuucuccuuccac

SEQ ID NO: 561853 - RNA, 20 nt, Human
uccucaaagugcuuuuucag

SEQ ID NO: 561854 - RNA, 24 nt, Human
uccuugcccgcgugcagccgggag

SEQ ID NO: 561855 - RNA, 18 nt, Human
ucuucugguccaggcugg

SEQ ID NO: 561856 - RNA, 19 nt, Human
ugcugcugcugcuggcguc

SEQ ID NO: 561857 - RNA, 22 nt, Human
ugggaggcccgccgggaaggcg

SEQ ID NO: 561858 - RNA, 22 nt, Human
ugguucagggggcugcuggugc

SEQ ID NO: 561859 - RNA, 18 nt, Human
uguucgcuuuccacagca

SEQ ID NO: 561860 - RNA, 24 nt, Human
uuaagguuccucaaagugcuuuuu

SEQ ID NO: 561861 - RNA, 21 nt, Human
uucauccucauucauugucuu

SEQ ID NO: 561862 - RNA, 23 nt, Human
uuccuacagaaaacaaaagaaaa

SEQ ID NO: 561863 - RNA, 19 nt, Human
uucuucugguccaggcugg

SEQ ID NO: 561864 - RNA, 22 nt, Human
uucuuguuuguuuuguuguuuu

SEQ ID NO: 561865 - RNA, 24 nt, Human
uugacguuugcaccuuuccuacag

SEQ ID NO: 561866 - RNA, 21 nt, Human
uuggucucagcagcgcaguaa

SEQ ID NO: 561867 - RNA, 22 nt, Human
uugguucagggggcugcuggug

SEQ ID NO: 561868 - RNA, 24 nt, Human
uugguucagggggcugcuggugcc

SEQ ID NO: 561869 - RNA, 18 nt, Human
uuguguucgcuuuccaca

SEQ ID NO: 561870 - RNA, 24 nt, Human
uuguuuuguuguuuucaucuugac

SEQ ID NO: 561871 - RNA, 21 nt, Human
uuuguuguuuucaucuugacu

SEQ ID NO: 561872 - RNA, 23 nt, Human
uuuucaucuugacuagcaccauc

SEQ ID NO: 561873 - RNA, 24 nt, Human
uuuucaucuugacuagcaccaucu

SEQ ID NO: 561874 - RNA, 20 nt, Human
aaauauucuaacucuucauu

SEQ ID NO: 561875 - RNA, 24 nt, Human
aagcagagaugguggcagcaggaa

SEQ ID NO: 561876 - RNA, 23 nt, Human
aauauagguccaaaaccguacaa

SEQ ID NO: 561877 - RNA, 18 nt, Human
acacugaaaauauggcau

SEQ ID NO: 561878 - RNA, 20 nt, Human
acagaggggguggugagcug

SEQ ID NO: 561879 - RNA, 20 nt, Human
acuccacaacugucucacca

SEQ ID NO: 561880 - RNA, 20 nt, Human
agacagaggggguggugagc

SEQ ID NO: 561881 - RNA, 19 nt, Human
agaggccaucgagggaggg

SEQ ID NO: 561882 - RNA, 18 nt, Human
agcaggaaggcugggccu

SEQ ID NO: 561883 - RNA, 18 nt, Human
aggaaggcugggccugcu

SEQ ID NO: 561884 - RNA, 26 nt, Human
aggagaaagcaaacagugaaacagaa

SEQ ID NO: 561885 - RNA, 24 nt, Human
agggcugcuuccucugagaugcuu

SEQ ID NO: 561886 - RNA, 22 nt, Human
aucaaaaaggauaaagguggcc

SEQ ID NO: 561887 - RNA, 23 nt, Human
auccauaucaucuuccagccuca

SEQ ID NO: 561888 - RNA, 21 nt, Human
aucgaaaauuaaaagccauaa

SEQ ID NO: 561889 - RNA, 21 nt, Human
caaugcaaaucacaauucuua

SEQ ID NO: 561890 - RNA, 19 nt, Human
caccuugagggcauuuugg

SEQ ID NO: 561891 - RNA, 18 nt, Human
cagcaggaaggcugggcc

SEQ ID NO: 561892 - RNA, 19 nt, Human
caugaaagggcucugcaua

SEQ ID NO: 561893 - RNA, 21 nt, Human
ccauaaaaguguaacacugaa

SEQ ID NO: 561894 - RNA, 24 nt, Human
ccuccaggaccaccccucuccgcc

SEQ ID NO: 561895 - RNA, 23 nt, Human
ccucugagaugcuuaaugacagg

SEQ ID NO: 561896 - RNA, 20 nt, Human
cuccaggaccaccccucucc

SEQ ID NO: 561897 - RNA, 20 nt, Human
cugaaaaaccacaguauaaa

SEQ ID NO: 561898 - RNA, 18 nt, Human
gccaucaaaacgugaaca

SEQ ID NO: 561899 - RNA, 18 nt, Human
gcugcuuccucugagaug

SEQ ID NO: 561900 - RNA, 20 nt, Human
ggccuccaggaccaccccuc

SEQ ID NO: 561901 - RNA, 20 nt, Human
ggggagaagcagagauggug

SEQ ID NO: 561902 - RNA, 21 nt, Human
gugaaacagaaucauggguga

SEQ ID NO: 561903 - RNA, 20 nt, Human
gugaacaauauagguccaaa

SEQ ID NO: 561904 - RNA, 20 nt, Human
uaacaagaaaaguauauuag

SEQ ID NO: 561905 - RNA, 19 nt, Human
uaacacugaaaauauggca

SEQ ID NO: 561906 - RNA, 21 nt, Human
uacccuguuauccuccaccca

SEQ ID NO: 561907 - RNA, 21 nt, Human
uacuccacaacugucucacca

SEQ ID NO: 561908 - RNA, 18 nt, Human
uagcagcaaaaccacagc

SEQ ID NO: 561909 - RNA, 27 nt, Human
uauuucguuuuuuuuaaaagccagggg

SEQ ID NO: 561910 - RNA, 21 nt, Human
ucaaaaaggauaaagguggcc

SEQ ID NO: 561911 - RNA, 18 nt, Human
ucagugccaguacacaug

SEQ ID NO: 561912 - RNA, 18 nt, Human
ucccgggcaggacagaga

SEQ ID NO: 561913 - RNA, 19 nt, Human
ucccgggcaggacagagau

SEQ ID NO: 561914 - RNA, 28 nt, Human
uccgccaucaaaacgugaaccggggucc

SEQ ID NO: 561915 - RNA, 20 nt, Human
uccucuggggagaagcagag

SEQ ID NO: 561916 - RNA, 22 nt, Human
uccucuggggagaagcagagau

SEQ ID NO: 561917 - RNA, 21 nt, Human
ucgcugagccuugaagauggg

SEQ ID NO: 561918 - RNA, 24 nt, Human
ucuaaguuccucuggggagaagca

SEQ ID NO: 561919 - RNA, 22 nt, Human
ucucuuggcauucagucucuga

SEQ ID NO: 561920 - RNA, 21 nt, Human
ucuugcucuguucccaaaugg

SEQ ID NO: 561921 - RNA, 21 nt, Human
ugaaaauauggcaucaaaaag

SEQ ID NO: 561922 - RNA, 23 nt, Human
ugaagcauugggccuccaggacc

SEQ ID NO: 561923 - RNA, 20 nt, Human
ugacucugaagcauugggcc

SEQ ID NO: 561924 - RNA, 18 nt, Human
ugacuuccuggaucaccu

SEQ ID NO: 561925 - RNA, 23 nt, Human
ugcacauuucucuuaaccaugac

SEQ ID NO: 561926 - RNA, 24 nt, Human
ugcuugaguuuuagacagaggggg

SEQ ID NO: 561927 - RNA, 18 nt, Human
uggcagcaggaaggcugg

SEQ ID NO: 561928 - RNA, 19 nt, Human
uggcagcaggaaggcuggg

SEQ ID NO: 561929 - RNA, 22 nt, Human
uggcagcaggaaggcugggccu

SEQ ID NO: 561930 - RNA, 24 nt, Human
uggcagcaggaaggcugggccugc

SEQ ID NO: 561931 - RNA, 21 nt, Human
ugggccuccaggaccaccccu

SEQ ID NO: 561932 - RNA, 22 nt, Human
uuccagccucagucgcugagcc

SEQ ID NO: 561933 - RNA, 24 nt, Human
uuccucuggggagaagcagagaug

SEQ ID NO: 561934 - RNA, 21 nt, Human
uugcucugcgcccucucucca

SEQ ID NO: 561935 - RNA, 22 nt, Human
uugcuugaguuuuagacagagg

SEQ ID NO: 561936 - RNA, 18 nt, Human
uuuaccgaguucucuugg

SEQ ID NO: 561937 - RNA, 19 nt, Human
uuuaccgaguucucuuggc

SEQ ID NO: 561938 - RNA, 22 nt, Human
aaacacaaaacgaacauaaaac

SEQ ID NO: 561939 - RNA, 27 nt, Human
aaaguuguguuccucagggguucguaa

SEQ ID NO: 561940 - RNA, 22 nt, Human
aaccacacagaugucaaccacc

SEQ ID NO: 561941 - RNA, 19 nt, Human
aagaauauagacauacugc

SEQ ID NO: 561942 - RNA, 18 nt, Human
aagugcagguugaacacu

SEQ ID NO: 561943 - RNA, 19 nt, Human
acacugguuaaaauacuga

SEQ ID NO: 561944 - RNA, 20 nt, Human
acugaaauuaccagcaaaau

SEQ ID NO: 561945 - RNA, 24 nt, Human
acugcagccuuugacuuuaacauc

SEQ ID NO: 561946 - RNA, 24 nt, Human
agaacuauagggcuacaagaaaau

SEQ ID NO: 561947 - RNA, 18 nt, Human
agaagucaagauaauagu

SEQ ID NO: 561948 - RNA, 23 nt, Human
agacugaauacauuuaugaacaa

SEQ ID NO: 561949 - RNA, 22 nt, Human
agcaaaaugauggaauaucuuu

SEQ ID NO: 561950 - RNA, 20 nt, Human
agcaagcuaaggaccagggg

SEQ ID NO: 561951 - RNA, 23 nt, Human
agcauuugaaauguuaauaugag

SEQ ID NO: 561952 - RNA, 20 nt, Human
agucuucaaacuggcaauuc

SEQ ID NO: 561953 - RNA, 19 nt, Human
caaaaauuauuuugaugac

SEQ ID NO: 561954 - RNA, 24 nt, Human
caagaaaaucccacaaguuuauag

SEQ ID NO: 561955 - RNA, 24 nt, Human
caagcuaaggaccaggggcaacua

SEQ ID NO: 561956 - RNA, 25 nt, Human
caaguuuauagcuuaacuggaauca

SEQ ID NO: 561957 - RNA, 20 nt, Human
cacuauuuaaacucacauua

SEQ ID NO: 561958 - RNA, 19 nt, Human
cagucuucaaacuggcaau

SEQ ID NO: 561959 - RNA, 20 nt, Human
caguuacugaaauuaccagc

SEQ ID NO: 561960 - RNA, 23 nt, Human
ccaccgggccuugcaaaugcaga

SEQ ID NO: 561961 - RNA, 25 nt, Human
ccuuugacuuuaacaucaacacacu

SEQ ID NO: 561962 - RNA, 18 nt, Human
cgaaccacacaaagucac

SEQ ID NO: 561963 - RNA, 22 nt, Human
cuaaacacaaaacgaacauaaa

SEQ ID NO: 561964 - RNA, 18 nt, Human
gaacagucuucaaacugg

SEQ ID NO: 561965 - RNA, 20 nt, Human
gaacauaaauuaccagaagu

SEQ ID NO: 561966 - RNA, 18 nt, Human
gcuaaaguuguguuccuc

SEQ ID NO: 561967 - RNA, 23 nt, Human
gguaucgcuaaaguuguguuccu

SEQ ID NO: 561968 - RNA, 21 nt, Human
guccauggaaaguuacucuug

SEQ ID NO: 561969 - RNA, 22 nt, Human
uaagguaagcaagguaaauucc

SEQ ID NO: 561970 - RNA, 22 nt, Human
uaauaacuuuagagcucaugua

SEQ ID NO: 561971 - RNA, 23 nt, Human
uacugaaacuaccaaugaguaca

SEQ ID NO: 561972 - RNA, 20 nt, Human
uacugagaaauucgaaccac

SEQ ID NO: 561973 - RNA, 19 nt, Human
uauaaagaauaaaagacug

SEQ ID NO: 561974 - RNA, 24 nt, Human
ucaaccaccgggccuugcaaaugc

SEQ ID NO: 561975 - RNA, 26 nt, Human
ucccuuauacacaaaaauuauuuuga

SEQ ID NO: 561976 - RNA, 21 nt, Human
ugaacauaaauuaccagaagu

SEQ ID NO: 561977 - RNA, 24 nt, Human
ugagauacaauuucacuauuuaaa

SEQ ID NO: 561978 - RNA, 26 nt, Human
uuaacauuuacacacaauuauaaaga

SEQ ID NO: 561979 - RNA, 26 nt, Human
uuuaacuucuuuaauaauucacucaa

SEQ ID NO: 561980 - RNA, 22 nt, Human
uuuuucaauaaugaaucugaaa

SEQ ID NO: 561981 - RNA, 27 nt, Human
aaacaaaaaguggaacaaagucuccaa

SEQ ID NO: 561982 - RNA, 23 nt, Human
aagcaaaacaauauuuuuacugg

SEQ ID NO: 561983 - RNA, 20 nt, Human
caacaauagaggucaguggc

SEQ ID NO: 561984 - RNA, 24 nt, Human
cauacaaaaacaaauuucaucaaa

SEQ ID NO: 561985 - RNA, 22 nt, Human
ccauacaaaaacaaauuucauc

SEQ ID NO: 561986 - RNA, 19 nt, Human
cugacuuucacuacaggaa

SEQ ID NO: 561987 - RNA, 23 nt, Human
uacaaaaacaaauuucaucaaag

SEQ ID NO: 561988 - RNA, 23 nt, Human
uccuguguggcuuuugucucuuc

SEQ ID NO: 561989 - RNA, 19 nt, Human
uguguacagaugaagcaaa

SEQ ID NO: 561990 - RNA, 19 nt, Human
uuguccacacuggcuuugu

SEQ ID NO: 561991 - RNA, 23 nt, Human
aaaaacaucuccacccaacccuc

SEQ ID NO: 561992 - RNA, 19 nt, Human
aaaaaggccacccucuggc

SEQ ID NO: 561993 - RNA, 23 nt, Human
aaaaaggccacccucuggccuuu

SEQ ID NO: 561994 - RNA, 18 nt, Human
aaccuggagccaggggcu

SEQ ID NO: 561995 - RNA, 18 nt, Human
aagcacugcagaugugaa

SEQ ID NO: 561996 - RNA, 18 nt, Human
aaggagcguuuggggaug

SEQ ID NO: 561997 - RNA, 25 nt, Human
aagucaaaaaaggaacacaaggcag

SEQ ID NO: 561998 - RNA, 18 nt, Human
aauaugccacccaccuuc

SEQ ID NO: 561999 - RNA, 18 nt, Human
accucuucuggccugugu

SEQ ID NO: 562000 - RNA, 23 nt, Human
acuguuuggggaaaaaggccacc

SEQ ID NO: 562001 - RNA, 24 nt, Human
agagagagggaaggaagcaaagag

SEQ ID NO: 562002 - RNA, 22 nt, Human
agagagggaaggaagcaaagag

SEQ ID NO: 562003 - RNA, 18 nt, Human
agagcacacaaauaaaac

SEQ ID NO: 562004 - RNA, 18 nt, Human
agagcucaaacuuggcug

SEQ ID NO: 562005 - RNA, 20 nt, Human
agagggaaggaagcaaagag

SEQ ID NO: 562006 - RNA, 18 nt, Human
agaguccuccacccccuc

SEQ ID NO: 562007 - RNA, 21 nt, Human
aggaggcagggaaccuggagc

SEQ ID NO: 562008 - RNA, 20 nt, Human
aggcaggcuccggcucccuc

SEQ ID NO: 562009 - RNA, 22 nt, Human
aggcaggcuccggcucccucca

SEQ ID NO: 562010 - RNA, 21 nt, Human
aggcgaagcgcgcgcagcagc

SEQ ID NO: 562011 - RNA, 21 nt, Human
aggcuccggcucccuccaccc

SEQ ID NO: 562012 - RNA, 22 nt, Human
agggaaccuggagccaggggcu

SEQ ID NO: 562013 - RNA, 19 nt, Human
agggaaggaagcaaagagg

SEQ ID NO: 562014 - RNA, 21 nt, Human
aggugaccacccgcuuaaauc

SEQ ID NO: 562015 - RNA, 27 nt, Human
aggugaccacccgcuuaaauccagagc

SEQ ID NO: 562016 - RNA, 24 nt, Human
agugcaaaggccacgagggaaaga

SEQ ID NO: 562017 - RNA, 18 nt, Human
auacugaacccuucugca

SEQ ID NO: 562018 - RNA, 18 nt, Human
aucuggaagaaaucaggg

SEQ ID NO: 562019 - RNA, 19 nt, Human
caaacaauacuccaggacu

SEQ ID NO: 562020 - RNA, 18 nt, Human
caaagaggagccgccucc

SEQ ID NO: 562021 - RNA, 18 nt, Human
caaaggccacgagggaaa

SEQ ID NO: 562022 - RNA, 20 nt, Human
caaauaaaacgucccaucug

SEQ ID NO: 562023 - RNA, 21 nt, Human
cacaagucaaaaaaggaacac

SEQ ID NO: 562024 - RNA, 28 nt, Human
cacaagucaaaaaaggaacacaaggcag

SEQ ID NO: 562025 - RNA, 18 nt, Human
cacacaaauaaaacgucc

SEQ ID NO: 562026 - RNA, 18 nt, Human
cacccaacccuccugcca

SEQ ID NO: 562027 - RNA, 19 nt, Human
cacccgcuuaaauccagag

SEQ ID NO: 562028 - RNA, 21 nt, Human
caccugaacuggcccccaggg

SEQ ID NO: 562029 - RNA, 24 nt, Human
cagagccuucuuuucuguccaaag

SEQ ID NO: 562030 - RNA, 20 nt, Human
cagcagauggcccccucccc

SEQ ID NO: 562031 - RNA, 20 nt, Human
cagcagauggcccccucccc

SEQ ID NO: 562032 - RNA, 21 nt, Human
cagcagauggcccccucccca

SEQ ID NO: 562033 - RNA, 19 nt, Human
caggaacaauguguaccug

SEQ ID NO: 562034 - RNA, 24 nt, Human
caggcuccggcucccuccaccccc

SEQ ID NO: 562035 - RNA, 20 nt, Human
caggggcugccuggcagggc

SEQ ID NO: 562036 - RNA, 21 nt, Human
cagguccccaauaugccaccc

SEQ ID NO: 562037 - RNA, 23 nt, Human
caggugaccacccgcuuaaaucc

SEQ ID NO: 562038 - RNA, 28 nt, Human
cagguuaugcgcccauuccccugaaagg

SEQ ID NO: 562039 - RNA, 19 nt, Human
cagucaagggagagcacac

SEQ ID NO: 562040 - RNA, 20 nt, Human
cagucccaagguagaccugg

SEQ ID NO: 562041 - RNA, 22 nt, Human
ccaagguagaccuggucucaca

SEQ ID NO: 562042 - RNA, 18 nt, Human
ccacccaacccuccugcc

SEQ ID NO: 562043 - RNA, 22 nt, Human
ccacccacuacugugaaauuuc

SEQ ID NO: 562044 - RNA, 19 nt, Human
ccaccugaacuggccccca

SEQ ID NO: 562045 - RNA, 25 nt, Human
ccagagccuucuuuucuguccaaag

SEQ ID NO: 562046 - RNA, 26 nt, Human
cccaagguagaccuggucucacaggu

SEQ ID NO: 562047 - RNA, 22 nt, Human
ccccaaagcguaguucccuuca

SEQ ID NO: 562048 - RNA, 21 nt, Human
ccccagaggcaggggagaguc

SEQ ID NO: 562049 - RNA, 21 nt, Human
ccccuaaacuggucagcgcag

SEQ ID NO: 562050 - RNA, 19 nt, Human
cccggcgcagccaagcucu

SEQ ID NO: 562051 - RNA, 18 nt, Human
cccuaaacuggucagcgc

SEQ ID NO: 562052 - RNA, 20 nt, Human
cccuccccagaggcagggga

SEQ ID NO: 562053 - RNA, 21 nt, Human
ccuccaggagcauucugacuu

SEQ ID NO: 562054 - RNA, 20 nt, Human
ccuugcacucagaaagaccc

SEQ ID NO: 562055 - RNA, 19 nt, Human
cgcuggacaagagucugca

SEQ ID NO: 562056 - RNA, 20 nt, Human
cgugguaucugucagagccu

SEQ ID NO: 562057 - RNA, 22 nt, Human
cuacaggucuacacuaauggaa

SEQ ID NO: 562058 - RNA, 18 nt, Human
cucacaggugaccacccg

SEQ ID NO: 562059 - RNA, 19 nt, Human
cuccggcucccuccacccc

SEQ ID NO: 562060 - RNA, 18 nt, Human
cuggagccaggggcugcc

SEQ ID NO: 562061 - RNA, 18 nt, Human
cuggcccccaggguugcc

SEQ ID NO: 562062 - RNA, 25 nt, Human
cugguacacacugauccuauggggg

SEQ ID NO: 562063 - RNA, 18 nt, Human
cugugcucuucagaucug

SEQ ID NO: 562064 - RNA, 21 nt, Human
cuucgcaccuccuccucgaga

SEQ ID NO: 562065 - RNA, 19 nt, Human
gaaagaccuuuuaaccaga

SEQ ID NO: 562066 - RNA, 19 nt, Human
gaccucuucuggccugugu

SEQ ID NO: 562067 - RNA, 22 nt, Human
gagagagggaaggaagcaaaga

SEQ ID NO: 562068 - RNA, 18 nt, Human
gagcaagagcugaaggcg

SEQ ID NO: 562069 - RNA, 22 nt, Human
gagcugaaggcgaggagagcgc

SEQ ID NO: 562070 - RNA, 21 nt, Human
gaggagaagcuggagggagua

SEQ ID NO: 562071 - RNA, 19 nt, Human
gaggagccgccucccuucc

SEQ ID NO: 562072 - RNA, 23 nt, Human
gcagcuugacgagcugagcuggg

SEQ ID NO: 562073 - RNA, 21 nt, Human
gccccagagcgccaaggccuc

SEQ ID NO: 562074 - RNA, 21 nt, Human
gcucaaacuuggcuguguaac

SEQ ID NO: 562075 - RNA, 20 nt, Human
ggagagagagggaaggaagc

SEQ ID NO: 562076 - RNA, 18 nt, Human
ggaggagagagagggaag

SEQ ID NO: 562077 - RNA, 20 nt, Human
gggaagcuggggaaaugagg

SEQ ID NO: 562078 - RNA, 24 nt, Human
gggaugguaguggggagacaggcc

SEQ ID NO: 562079 - RNA, 20 nt, Human
ggggguagguuagccagagg

SEQ ID NO: 562080 - RNA, 22 nt, Human
gggggugggaggagagagaggg

SEQ ID NO: 562081 - RNA, 19 nt, Human
gguaguggggagacaggcc

SEQ ID NO: 562082 - RNA, 24 nt, Human
ggugaccacccgcuuaaauccaga

SEQ ID NO: 562083 - RNA, 19 nt, Human
ggugaugaacgaggaaggg

SEQ ID NO: 562084 - RNA, 27 nt, Human
gguggcuacaggucuacacuaauggaa

SEQ ID NO: 562085 - RNA, 18 nt, Human
guaguucccuucacuggc

SEQ ID NO: 562086 - RNA, 19 nt, Human
guaguucccuucacuggcu

SEQ ID NO: 562087 - RNA, 29 nt, Human
gucaaaaaaggaacacaaggcaggcuccc

SEQ ID NO: 562088 - RNA, 22 nt, Human
guccacaggaaccacgccccaa

SEQ ID NO: 562089 - RNA, 20 nt, Human
gugaaacgggggcgugcccc

SEQ ID NO: 562090 - RNA, 24 nt, Human
gugggaggagagagagggaaggaa

SEQ ID NO: 562091 - RNA, 22 nt, Human
uaaaaacaucuccacccaaccc

SEQ ID NO: 562092 - RNA, 25 nt, Human
uaaaaacaucuccacccaacccucc

SEQ ID NO: 562093 - RNA, 20 nt, Human
uaaaaggaaccaaacuguuu

SEQ ID NO: 562094 - RNA, 21 nt, Human
uaaaaggaaccaaacuguuug

SEQ ID NO: 562095 - RNA, 20 nt, Human
uaagccccuaaacuggucag

SEQ ID NO: 562096 - RNA, 24 nt, Human
uaagccccuaaacuggucagcgca

SEQ ID NO: 562097 - RNA, 21 nt, Human
uaggcugaagcccccaaagcg

SEQ ID NO: 562098 - RNA, 23 nt, Human
ucagagccuuaaaacaggcccac

SEQ ID NO: 562099 - RNA, 23 nt, Human
uccaccagcaggcacuccaguua

SEQ ID NO: 562100 - RNA, 23 nt, Human
ucccagguccccaauaugccacc

SEQ ID NO: 562101 - RNA, 19 nt, Human
uccuaugggggugggagga

SEQ ID NO: 562102 - RNA, 23 nt, Human
ucgcaccucucgaggcucaaauc

SEQ ID NO: 562103 - RNA, 21 nt, Human
ucgccaaaagcgucgcgcacu

SEQ ID NO: 562104 - RNA, 26 nt, Human
ucgccugaagaccucuucuggccugu

SEQ ID NO: 562105 - RNA, 22 nt, Human
ucuaggcugaagcccccaaagc

SEQ ID NO: 562106 - RNA, 19 nt, Human
ucugcuaaaaacaucucca

SEQ ID NO: 562107 - RNA, 24 nt, Human
ucugggucugaguuuccccaucug

SEQ ID NO: 562108 - RNA, 23 nt, Human
ucuugcagcucugaaacggcuuc

SEQ ID NO: 562109 - RNA, 23 nt, Human
ugaaaaaugucacaagucaaaaa

SEQ ID NO: 562110 - RNA, 24 nt, Human
ugaaaaaugucacaagucaaaaaa

SEQ ID NO: 562111 - RNA, 21 nt, Human
ugaaauuugaucuccuccuuc

SEQ ID NO: 562112 - RNA, 22 nt, Human
ugagacagcagagcauaagucc

SEQ ID NO: 562113 - RNA, 19 nt, Human
ugagaggagaagcuggagg

SEQ ID NO: 562114 - RNA, 24 nt, Human
ugcaaaggccacgagggaaagacc

SEQ ID NO: 562115 - RNA, 18 nt, Human
ugccagaagggggaaggc

SEQ ID NO: 562116 - RNA, 21 nt, Human
ugccagaagggggaaggucgg

SEQ ID NO: 562117 - RNA, 24 nt, Human
ugccagaagggggaaggucgguuc

SEQ ID NO: 562118 - RNA, 22 nt, Human
uggaagaaaucagggaagcugg

SEQ ID NO: 562119 - RNA, 21 nt, Human
uggaaugucucuguggucuug

SEQ ID NO: 562120 - RNA, 18 nt, Human
uggagggaguauggggcc

SEQ ID NO: 562121 - RNA, 21 nt, Human
uggagggaguauggggccugg

SEQ ID NO: 562122 - RNA, 22 nt, Human
uggagggaguauggggccuggu

SEQ ID NO: 562123 - RNA, 21 nt, Human
uggcaggcaucugcuaagccc

SEQ ID NO: 562124 - RNA, 19 nt, Human
uggcccccaggguugccuu

SEQ ID NO: 562125 - RNA, 21 nt, Human
ugggaggagagagagggaagg

SEQ ID NO: 562126 - RNA, 23 nt, Human
ugggaugaacauuugagccgcug

SEQ ID NO: 562127 - RNA, 19 nt, Human
uggggaugguaguggggag

SEQ ID NO: 562128 - RNA, 23 nt, Human
ugggggugggaggagagagaggg

SEQ ID NO: 562129 - RNA, 21 nt, Human
ugucacaagucaaaaaaggaa

SEQ ID NO: 562130 - RNA, 19 nt, Human
uguccaaagccacugaaau

SEQ ID NO: 562131 - RNA, 24 nt, Human
uguccaaagccacugaaauuugau

SEQ ID NO: 562132 - RNA, 20 nt, Human
uuaagagcucaaacuuggcu

SEQ ID NO: 562133 - RNA, 21 nt, Human
uuaauuugcucaagaucgcug

SEQ ID NO: 562134 - RNA, 22 nt, Human
uuaugcgcccauuccgagaccc

SEQ ID NO: 562135 - RNA, 20 nt, Human
uucacacauucccagguccc

SEQ ID NO: 562136 - RNA, 19 nt, Human
uucauucuuaaggauaucg

SEQ ID NO: 562137 - RNA, 20 nt, Human
uucccccucuuucuaaggaa

SEQ ID NO: 562138 - RNA, 24 nt, Human
uucugcaguguaguacacguugcu

SEQ ID NO: 562139 - RNA, 22 nt, Human
uugccucucucucaacacaagg

SEQ ID NO: 562140 - RNA, 23 nt, Human
uuggggaaaaaggccacccucug

SEQ ID NO: 562141 - RNA, 19 nt, Human
uuuugcggcuuaaagagau

SEQ ID NO: 562142 - RNA, 18 nt, Human
uuuuuuuuuuuuuugcgg

SEQ ID NO: 562143 - RNA, 21 nt, Human
uuuuuuuuuuuuuuuuugcgg

SEQ ID NO: 562144 - RNA, 23 nt, Human
uuuuuuuuuuuuuuuuugcggcu

SEQ ID NO: 562145 - RNA, 27 nt, Human
uuuuuuuuuuuuuuuuuuuuuuugggg

SEQ ID NO: 562146 - RNA, 24 nt, Human
aaaaaccccuuaaaugcgcuccac

SEQ ID NO: 562147 - RNA, 21 nt, Human
aaaauaaauguauacaaggca

SEQ ID NO: 562148 - RNA, 23 nt, Human
aaagaaaauaaauguauacaagg

SEQ ID NO: 562149 - RNA, 21 nt, Human
aagcaaaacaaacaaccacaa

SEQ ID NO: 562150 - RNA, 26 nt, Human
aagcaaaacaaacaaccacaaucuaa

SEQ ID NO: 562151 - RNA, 23 nt, Human
aauccccccccgcccgccgccau

SEQ ID NO: 562152 - RNA, 23 nt, Human
acaaacaaccacaaucuaaacca

SEQ ID NO: 562153 - RNA, 23 nt, Human
accacaaucuaaaccagccgcga

SEQ ID NO: 562154 - RNA, 18 nt, Human
accgccaaaaaacgugga

SEQ ID NO: 562155 - RNA, 18 nt, Human
agaaagaaaauaaaugua

SEQ ID NO: 562156 - RNA, 18 nt, Human
agaaagaaaauaaauguu

SEQ ID NO: 562157 - RNA, 19 nt, Human
agaagagacuaguuaagug

SEQ ID NO: 562158 - RNA, 20 nt, Human
agaauccccccccgcccgcc

SEQ ID NO: 562159 - RNA, 26 nt, Human
agcugaacuccugcgggaugguuccg

SEQ ID NO: 562160 - RNA, 18 nt, Human
aggaggcuguguggggca

SEQ ID NO: 562161 - RNA, 21 nt, Human
aggaggcuguguggggcaaca

SEQ ID NO: 562162 - RNA, 21 nt, Human
aggcagcaucucuuuccaaag

SEQ ID NO: 562163 - RNA, 22 nt, Human
aggcagcaucucuuuccaaagc

SEQ ID NO: 562164 - RNA, 19 nt, Human
auacaaggcagcagucaca

SEQ ID NO: 562165 - RNA, 23 nt, Human
auccaaauggcuccaugcacagc

SEQ ID NO: 562166 - RNA, 19 nt, Human
aucuaaaccagccgcgagg

SEQ ID NO: 562167 - RNA, 20 nt, Human
augugguccacagauucacc

SEQ ID NO: 562168 - RNA, 24 nt, Human
caacaaaaaccccuuaaaugcgcu

SEQ ID NO: 562169 - RNA, 22 nt, Human
caaggcagcagucacaacaaaa

SEQ ID NO: 562170 - RNA, 24 nt, Human
caaggcagcagucacaacaaaaac

SEQ ID NO: 562171 - RNA, 24 nt, Human
cacacuagaaaauaucagcugaac

SEQ ID NO: 562172 - RNA, 23 nt, Human
cagcuggccccuccgcuucucaa

SEQ ID NO: 562173 - RNA, 22 nt, Human
cagucuuaguagaagcaaaaca

SEQ ID NO: 562174 - RNA, 21 nt, Human
ccacacccuugaauguggucc

SEQ ID NO: 562175 - RNA, 20 nt, Human
ccacagauucaccagcucca

SEQ ID NO: 562176 - RNA, 21 nt, Human
cccccccgcccgccgccaucc

SEQ ID NO: 562177 - RNA, 21 nt, Human
ccccgcccgccgccauccaaa

SEQ ID NO: 562178 - RNA, 20 nt, Human
cccgugcggauggcugcggu

SEQ ID NO: 562179 - RNA, 18 nt, Human
cccucaaagaacaacagc

SEQ ID NO: 562180 - RNA, 22 nt, Human
ccugagccucaccgcuuaguuc

SEQ ID NO: 562181 - RNA, 18 nt, Human
ccugcagcaggaggcugu

SEQ ID NO: 562182 - RNA, 25 nt, Human
ccugcagcaggaggcuguguggggc

SEQ ID NO: 562183 - RNA, 24 nt, Human
cgaggccucccgugcggauggcug

SEQ ID NO: 562184 - RNA, 18 nt, Human
cgcccgaacuaggguggg

SEQ ID NO: 562185 - RNA, 22 nt, Human
cuccaugcacagcuggccccuc

SEQ ID NO: 562186 - RNA, 24 nt, Human
cucccauucccucucugagccuua

SEQ ID NO: 562187 - RNA, 21 nt, Human
cucccgugcggauggcugcgg

SEQ ID NO: 562188 - RNA, 20 nt, Human
cucugcgagagccgccaccu

SEQ ID NO: 562189 - RNA, 24 nt, Human
gacagcaaacacaaaacuuguuuc

SEQ ID NO: 562190 - RNA, 18 nt, Human
gcggcucugccuccgccc

SEQ ID NO: 562191 - RNA, 20 nt, Human
gcugcgguggaagggcccgc

SEQ ID NO: 562192 - RNA, 24 nt, Human
ggaagaugccugugccacacccuu

SEQ ID NO: 562193 - RNA, 22 nt, Human
gggaggagggcgaggcccaguu

SEQ ID NO: 562194 - RNA, 18 nt, Human
ggugugagagacaggagg

SEQ ID NO: 562195 - RNA, 19 nt, Human
ggugugagagacaggaggg

SEQ ID NO: 562196 - RNA, 22 nt, Human
uaaacacagagggaagagccag

SEQ ID NO: 562197 - RNA, 24 nt, Human
uacaaggcagcagucacaacaaaa

SEQ ID NO: 562198 - RNA, 18 nt, Human
uacagagaaucccccccc

SEQ ID NO: 562199 - RNA, 20 nt, Human
uagaagcaaaacaaacaacc

SEQ ID NO: 562200 - RNA, 22 nt, Human
uagacagcaaacacaaaacuug

SEQ ID NO: 562201 - RNA, 21 nt, Human
uaguagaagcaaaacaaacaa

SEQ ID NO: 562202 - RNA, 26 nt, Human
uaguagaagcaaaacaaacaaccaca

SEQ ID NO: 562203 - RNA, 19 nt, Human
ucaaagaacaacagcauca

SEQ ID NO: 562204 - RNA, 22 nt, Human
ucaaagaacaacagcaucaggg

SEQ ID NO: 562205 - RNA, 24 nt, Human
ucaccagcuccaaggcagcaucuc

SEQ ID NO: 562206 - RNA, 20 nt, Human
ucagugggaggagggcgagg

SEQ ID NO: 562207 - RNA, 19 nt, Human
uccaaagcaccugcagcag

SEQ ID NO: 562208 - RNA, 21 nt, Human
uccacaaaaucucucgcccca

SEQ ID NO: 562209 - RNA, 19 nt, Human
ugaaacaaaacagucuuag

SEQ ID NO: 562210 - RNA, 21 nt, Human
ugagagacaggagggagcgug

SEQ ID NO: 562211 - RNA, 20 nt, Human
ugcagcaggaggcugugugg

SEQ ID NO: 562212 - RNA, 22 nt, Human
ugccuccgccccuuggagaucu

SEQ ID NO: 562213 - RNA, 24 nt, Human
ugccuccgccccuuggagaucugc

SEQ ID NO: 562214 - RNA, 22 nt, Human
uguauacaaggcagcagucaca

SEQ ID NO: 562215 - RNA, 19 nt, Human
uuaagcccucaaagaacaa

SEQ ID NO: 562216 - RNA, 23 nt, Human
uuuccuagcuggaaaggagaaug

SEQ ID NO: 562217 - RNA, 19 nt, Human
aaacauuaacacacgugga

SEQ ID NO: 562218 - RNA, 18 nt, Human
acaauuuuguuacacaau

SEQ ID NO: 562219 - RNA, 19 nt, Human
acagcggcaccagugagcg

SEQ ID NO: 562220 - RNA, 19 nt, Human
accugcaauaaccaaucug

SEQ ID NO: 562221 - RNA, 20 nt, Human
acuauuugagccuuauauac

SEQ ID NO: 562222 - RNA, 21 nt, Human
agccauaguacugcuccacag

SEQ ID NO: 562223 - RNA, 18 nt, Human
agccaugacagcggcacc

SEQ ID NO: 562224 - RNA, 25 nt, Human
auuuuguuacacaauuauacacauu

SEQ ID NO: 562225 - RNA, 18 nt, Human
caaucuauccacuucccu

SEQ ID NO: 562226 - RNA, 22 nt, Human
cagaaaagcagcuggcaucuuc

SEQ ID NO: 562227 - RNA, 23 nt, Human
cagaggagaaugaugaugggcac

SEQ ID NO: 562228 - RNA, 22 nt, Human
cagcagcaucucgagcugaauu

SEQ ID NO: 562229 - RNA, 19 nt, Human
cagcaucucgagcugaauu

SEQ ID NO: 562230 - RNA, 21 nt, Human
cagugauuaauggaaucuucu

SEQ ID NO: 562231 - RNA, 22 nt, Human
cccucuguccuggagaucucac

SEQ ID NO: 562232 - RNA, 23 nt, Human
cguccucgauggaguccccguca

SEQ ID NO: 562233 - RNA, 22 nt, Human
cuccucugucaccagggcugga

SEQ ID NO: 562234 - RNA, 22 nt, Human
cugcuaaaucauuuaauauuuc

SEQ ID NO: 562235 - RNA, 23 nt, Human
cugcugagaauagauuccuucug

SEQ ID NO: 562236 - RNA, 19 nt, Human
cuggaacuguugcaggucc

SEQ ID NO: 562237 - RNA, 25 nt, Human
cuggcaucuucacuuuuugcaguga

SEQ ID NO: 562238 - RNA, 20 nt, Human
gaccuugcuuauagcaguuc

SEQ ID NO: 562239 - RNA, 23 nt, Human
gacggggucuccucugucaccag

SEQ ID NO: 562240 - RNA, 24 nt, Human
gagcaaacuguucuuugauaauag

SEQ ID NO: 562241 - RNA, 19 nt, Human
gcucuuugccacucagcgg

SEQ ID NO: 562242 - RNA, 19 nt, Human
uaacacacguggagacugc

SEQ ID NO: 562243 - RNA, 18 nt, Human
uaccugcaauaaccaauc

SEQ ID NO: 562244 - RNA, 22 nt, Human
uaccugcaauaaccaaucuguu

SEQ ID NO: 562245 - RNA, 20 nt, Human
ucagcagaggagaaugauga

SEQ ID NO: 562246 - RNA, 19 nt, Human
ucagcggcucuccuuuuuc

SEQ ID NO: 562247 - RNA, 18 nt, Human
ucaggcucucaggguccg

SEQ ID NO: 562248 - RNA, 22 nt, Human
uccuccaguuugcggcagaggu

SEQ ID NO: 562249 - RNA, 24 nt, Human
ucucaaucuucugcacagcagcau

SEQ ID NO: 562250 - RNA, 23 nt, Human
ucucaggguccggugggguguag

SEQ ID NO: 562251 - RNA, 21 nt, Human
ucuccucugucaccagggcug

SEQ ID NO: 562252 - RNA, 23 nt, Human
ucuccucugucaccagggcugga

SEQ ID NO: 562253 - RNA, 24 nt, Human
ugaaaucucggauucuucuccagg

SEQ ID NO: 562254 - RNA, 22 nt, Human
ugacagcggcaccagugagcga

SEQ ID NO: 562255 - RNA, 22 nt, Human
ugagaauagauuccuucuguac

SEQ ID NO: 562256 - RNA, 21 nt, Human
ugagacggggucuccucuguc

SEQ ID NO: 562257 - RNA, 18 nt, Human
ugcgugcccuaugcccug

SEQ ID NO: 562258 - RNA, 21 nt, Human
uguagccaugacagcggcacc

SEQ ID NO: 562259 - RNA, 21 nt, Human
uguucuuugauaauagucuca

SEQ ID NO: 562260 - RNA, 22 nt, Human
uuccucaggcucucaggguccg

SEQ ID NO: 562261 - RNA, 22 nt, Human
uucucaauugcuuuaugccgcu

SEQ ID NO: 562262 - RNA, 20 nt, Human
uugcagaaaagcagcuggca

SEQ ID NO: 562263 - RNA, 18 nt, Human
uuuaggcugugauaccug

SEQ ID NO: 562264 - RNA, 23 nt, Human
uuugcagaaaagcagcuggcauc

SEQ ID NO: 562265 - RNA, 27 nt, Human
uuuucgcauugucauugcucuuugcca

SEQ ID NO: 562266 - RNA, 25 nt, Human
aaaacauccaaaacagacaugaggg

SEQ ID NO: 562267 - RNA, 18 nt, Human
aaacauccaaaacagaca

SEQ ID NO: 562268 - RNA, 19 nt, Human
aagaaaacauuuuaugggc

SEQ ID NO: 562269 - RNA, 19 nt, Human
aagccaauuaacgcucaag

SEQ ID NO: 562270 - RNA, 18 nt, Human
acacaaaacauccaaaac

SEQ ID NO: 562271 - RNA, 23 nt, Human
agaauuucuccacaguuccacau

SEQ ID NO: 562272 - RNA, 19 nt, Human
caaaacagacaugaggggc

SEQ ID NO: 562273 - RNA, 23 nt, Human
caagaaaacauuuuaugggcacc

SEQ ID NO: 562274 - RNA, 22 nt, Human
cacaguuccacaucuugagacc

SEQ ID NO: 562275 - RNA, 23 nt, Human
ccauaauguuugcuguccucgau

SEQ ID NO: 562276 - RNA, 25 nt, Human
cccgggccggaggaagaccgggguc

SEQ ID NO: 562277 - RNA, 24 nt, Human
ccuccacaccucuaucugaacaaa

SEQ ID NO: 562278 - RNA, 21 nt, Human
ccuuuuaugggcauuugagau

SEQ ID NO: 562279 - RNA, 19 nt, Human
cuccacaccucuaucugaa

SEQ ID NO: 562280 - RNA, 20 nt, Human
cuccacaccucuaucugaac

SEQ ID NO: 562281 - RNA, 20 nt, Human
cuuguucauguccuagaauu

SEQ ID NO: 562282 - RNA, 20 nt, Human
gcguggggugggcggagccc

SEQ ID NO: 562283 - RNA, 23 nt, Human
gggccagggcccgggccggagga

SEQ ID NO: 562284 - RNA, 23 nt, Human
uaaauaaauaagccaauuaacgc

SEQ ID NO: 562285 - RNA, 19 nt, Human
uaccauaguccaaaaagac

SEQ ID NO: 562286 - RNA, 23 nt, Human
uaggaaagggcgggcuuguagug

SEQ ID NO: 562287 - RNA, 26 nt, Human
uaucaaguuucaauuugacaugucaa

SEQ ID NO: 562288 - RNA, 18 nt, Human
ucaaauuaaaagagaaag

SEQ ID NO: 562289 - RNA, 26 nt, Human
ucaaucaaauuaaaagagaaagacau

SEQ ID NO: 562290 - RNA, 20 nt, Human
ugaaaggauagcuuguucau

SEQ ID NO: 562291 - RNA, 23 nt, Human
ugacaugucaaaacaaaaguuuu

SEQ ID NO: 562292 - RNA, 23 nt, Human
uggagagacacaaaacauccaaa

SEQ ID NO: 562293 - RNA, 19 nt, Human
uggggugggcggagcccgg

SEQ ID NO: 562294 - RNA, 20 nt, Human
uuccacaucuugagaccaag

SEQ ID NO: 562295 - RNA, 23 nt, Human
aacaaucacugggcuuccaucau

SEQ ID NO: 562296 - RNA, 21 nt, Human
aaggcuggguccgcgggcggg

SEQ ID NO: 562297 - RNA, 18 nt, Human
agcaggaauuuacauaua

SEQ ID NO: 562298 - RNA, 21 nt, Human
agcuggaagccacccaacugu

SEQ ID NO: 562299 - RNA, 19 nt, Human
aggcuggguccgcgggcgg

SEQ ID NO: 562300 - RNA, 19 nt, Human
auacacucuguacaaugcg

SEQ ID NO: 562301 - RNA, 23 nt, Human
caauuucugcgaccuuucaaggc

SEQ ID NO: 562302 - RNA, 21 nt, Human
cagccacgacaucccauccua

SEQ ID NO: 562303 - RNA, 19 nt, Human
caucccauccuagccccgc

SEQ ID NO: 562304 - RNA, 23 nt, Human
cccccgauacuaacugaaauuaa

SEQ ID NO: 562305 - RNA, 23 nt, Human
cccccucgcuacggcggccuugg

SEQ ID NO: 562306 - RNA, 18 nt, Human
cuccuccgcgaaccccgg

SEQ ID NO: 562307 - RNA, 18 nt, Human
cuccuggcauaagcugga

SEQ ID NO: 562308 - RNA, 24 nt, Human
cugugguaggccgucccaggcagg

SEQ ID NO: 562309 - RNA, 23 nt, Human
cuuccgggccccgcccccucgcu

SEQ ID NO: 562310 - RNA, 22 nt, Human
gaccuuucaaggcagucuuuga

SEQ ID NO: 562311 - RNA, 21 nt, Human
gaguugccucggaggauuugg

SEQ ID NO: 562312 - RNA, 18 nt, Human
gcaggccaaacgccuuuc

SEQ ID NO: 562313 - RNA, 19 nt, Human
gcgggugaggaggagacuc

SEQ ID NO: 562314 - RNA, 18 nt, Human
ggccccgcccccucgcua

SEQ ID NO: 562315 - RNA, 18 nt, Human
uaagcuggaagccaccca

SEQ ID NO: 562316 - RNA, 21 nt, Human
uacacucuguacaaugcguua

SEQ ID NO: 562317 - RNA, 21 nt, Human
uagcggcccgagccugcgcuc

SEQ ID NO: 562318 - RNA, 20 nt, Human
uaggacgagccagggcagca

SEQ ID NO: 562319 - RNA, 19 nt, Human
uccuggcauaagcuggaag

SEQ ID NO: 562320 - RNA, 24 nt, Human
ucuuugaaaugucaagguuuuaaa

SEQ ID NO: 562321 - RNA, 21 nt, Human
ugaaaugucaagguuuuaaaa

SEQ ID NO: 562322 - RNA, 20 nt, Human
ugaaauuaaaaauagaaauc

SEQ ID NO: 562323 - RNA, 23 nt, Human
ugccucggaggauuuggcagcca

SEQ ID NO: 562324 - RNA, 18 nt, Human
ugcuggaaggcugggucc

SEQ ID NO: 562325 - RNA, 20 nt, Human
ugcuggaaggcuggguccgc

SEQ ID NO: 562326 - RNA, 21 nt, Human
uggaagccacccaacuguucc

SEQ ID NO: 562327 - RNA, 18 nt, Human
uggaaggcuggguccgcg

SEQ ID NO: 562328 - RNA, 24 nt, Human
uggaaggcuggguccgcgggcggg

SEQ ID NO: 562329 - RNA, 20 nt, Human
uuccgggccccgcccccucg

SEQ ID NO: 562330 - RNA, 24 nt, Human
uuuuuuuugaaaauagaaaaauuc

SEQ ID NO: 562331 - RNA, 27 nt, Human
uuuuuuuuuuuuuuuuuuuuuuugggg

SEQ ID NO: 562332 - RNA, 19 nt, Human
aacccaacaucaacucagu

SEQ ID NO: 562333 - RNA, 22 nt, Human
aacucagucccucccaccccca

SEQ ID NO: 562334 - RNA, 22 nt, Human
agagcuugggggagguauggag

SEQ ID NO: 562335 - RNA, 18 nt, Human
agcaggugcacaccacag

SEQ ID NO: 562336 - RNA, 19 nt, Human
caacucagucccucccacc

SEQ ID NO: 562337 - RNA, 21 nt, Human
caacucagucccucccacccc

SEQ ID NO: 562338 - RNA, 23 nt, Human
caccaccuuucuuggaaucugcg

SEQ ID NO: 562339 - RNA, 25 nt, Human
cacccccaucuccucucucuggccc

SEQ ID NO: 562340 - RNA, 24 nt, Human
cagcucagccacauacuggcccug

SEQ ID NO: 562341 - RNA, 23 nt, Human
caggacagcagggcugagcccug

SEQ ID NO: 562342 - RNA, 24 nt, Human
cccucccacccccaucuccucucu

SEQ ID NO: 562343 - RNA, 23 nt, Human
ccuggaccuccacgguggagcag

SEQ ID NO: 562344 - RNA, 19 nt, Human
cuuccgcugguccuggagc

SEQ ID NO: 562345 - RNA, 18 nt, Human
gagcuugggggagguaug

SEQ ID NO: 562346 - RNA, 22 nt, Human
gcucaggacagcagggcugagc

SEQ ID NO: 562347 - RNA, 18 nt, Human
gcuggaggagagcuuggg

SEQ ID NO: 562348 - RNA, 19 nt, Human
gguauggagaaugagaaaa

SEQ ID NO: 562349 - RNA, 23 nt, Human
ucagucccucccacccccaucuc

SEQ ID NO: 562350 - RNA, 21 nt, Human
ucccacccccaucuccucucu

SEQ ID NO: 562351 - RNA, 24 nt, Human
ucccucccacccccaucuccucuc

SEQ ID NO: 562352 - RNA, 19 nt, Human
uccgcugguccuggagcag

SEQ ID NO: 562353 - RNA, 26 nt, Human
ucgcugucggaacuguuucgacagcg

SEQ ID NO: 562354 - RNA, 18 nt, Human
ucugcgugcuguggccca

SEQ ID NO: 562355 - RNA, 22 nt, Human
ugaaaaacccaacaucaacuca

SEQ ID NO: 562356 - RNA, 23 nt, Human
ugagcagggcggacagcacggcc

SEQ ID NO: 562357 - RNA, 19 nt, Human
ugagcccugggaagggcug

SEQ ID NO: 562358 - RNA, 20 nt, Human
ugagcccugggaagggcugg

SEQ ID NO: 562359 - RNA, 19 nt, Human
uggaaucugcgugcugugg

SEQ ID NO: 562360 - RNA, 21 nt, Human
uggaggagagcuugggggagg

SEQ ID NO: 562361 - RNA, 19 nt, Human
uggcccaggagacgcucag

SEQ ID NO: 562362 - RNA, 21 nt, Human
ugggaagggcuggaggagagc

SEQ ID NO: 562363 - RNA, 26 nt, Human
ugggaagggcuggaggagagcuuggg

SEQ ID NO: 562364 - RNA, 20 nt, Human
ugggagggcugcaucugaca

SEQ ID NO: 562365 - RNA, 23 nt, Human
aaagaaaaccagcccaaguucug

SEQ ID NO: 562366 - RNA, 18 nt, Human
aagaaagaaaaccagccc

SEQ ID NO: 562367 - RNA, 25 nt, Human
agcugugugugugugugugugugug

SEQ ID NO: 562368 - RNA, 19 nt, Human
ccgcuugugggcaagugac

SEQ ID NO: 562369 - RNA, 21 nt, Human
cucugcacagcuggcucagcg

SEQ ID NO: 562370 - RNA, 22 nt, Human
guacagcugugugugugugugu

SEQ ID NO: 562371 - RNA, 19 nt, Human
gucaggaggaggggggaug

SEQ ID NO: 562372 - RNA, 30 nt, Human
guguacagcugugugugugugugugugugg

SEQ ID NO: 562373 - RNA, 18 nt, Human
gugugugugugugugugu

SEQ ID NO: 562374 - RNA, 21 nt, Human
gugugugugugugugugugug

SEQ ID NO: 562375 - RNA, 21 nt, Human
gugugugugugugugugugug

SEQ ID NO: 562376 - RNA, 21 nt, Human
gugugugugugugugugugug

SEQ ID NO: 562377 - RNA, 21 nt, Human
gugugugugugugugugugug

SEQ ID NO: 562378 - RNA, 21 nt, Human
gugugugugugugugugugug

SEQ ID NO: 562379 - RNA, 21 nt, Human
gugugugugugugugugugug

SEQ ID NO: 562380 - RNA, 21 nt, Human
gugugugugugugugugugug

SEQ ID NO: 562381 - RNA, 21 nt, Human
gugugugugugugugugugug

SEQ ID NO: 562382 - RNA, 25 nt, Human
ucagcgcccacgaagcagcaucucu

SEQ ID NO: 562383 - RNA, 18 nt, Human
ucugcacagcuggcucag

SEQ ID NO: 562384 - RNA, 18 nt, Human
ugggaagaaagaaaacca

SEQ ID NO: 562385 - RNA, 26 nt, Human
ugggaagaaagaaaaccagcccaagu

SEQ ID NO: 562386 - RNA, 24 nt, Human
ugguuugucaggaggaggggggau

SEQ ID NO: 562387 - RNA, 18 nt, Human
ugugugugugugugugug

SEQ ID NO: 562388 - RNA, 18 nt, Human
ugugugugugugugugug

SEQ ID NO: 562389 - RNA, 18 nt, Human
ugugugugugugugugug

SEQ ID NO: 562390 - RNA, 18 nt, Human
ugugugugugugugugug

SEQ ID NO: 562391 - RNA, 18 nt, Human
ugugugugugugugugug

SEQ ID NO: 562392 - RNA, 18 nt, Human
ugugugugugugugugug

SEQ ID NO: 562393 - RNA, 18 nt, Human
ugugugugugugugugug

SEQ ID NO: 562394 - RNA, 18 nt, Human
ugugugugugugugugug

SEQ ID NO: 562395 - RNA, 18 nt, Human
ugugugugugugugugug

SEQ ID NO: 562396 - RNA, 18 nt, Human
ugugugugugugugugug

SEQ ID NO: 562397 - RNA, 18 nt, Human
ugugugugugugugugug

SEQ ID NO: 562398 - RNA, 18 nt, Human
ugugugugugugugugug

SEQ ID NO: 562399 - RNA, 18 nt, Human
ugugugugugugugugug

SEQ ID NO: 562400 - RNA, 18 nt, Human
ugugugugugugugugug

SEQ ID NO: 562401 - RNA, 18 nt, Human
ugugugugugugugugug

SEQ ID NO: 562402 - RNA, 18 nt, Human
ugugugugugugugugug

SEQ ID NO: 562403 - RNA, 18 nt, Human
ugugugugugugugugug

SEQ ID NO: 562404 - RNA, 18 nt, Human
ugugugugugugugugug

SEQ ID NO: 562405 - RNA, 18 nt, Human
ugugugugugugugugug

SEQ ID NO: 562406 - RNA, 18 nt, Human
ugugugugugugugugug

SEQ ID NO: 562407 - RNA, 22 nt, Human
ugugugugugugugugugugag

SEQ ID NO: 562408 - RNA, 21 nt, Human
ugugugugugugugugugugu

SEQ ID NO: 562409 - RNA, 21 nt, Human
ugugugugugugugugugugu

SEQ ID NO: 562410 - RNA, 21 nt, Human
ugugugugugugugugugugu

SEQ ID NO: 562411 - RNA, 21 nt, Human
ugugugugugugugugugugu

SEQ ID NO: 562412 - RNA, 21 nt, Human
ugugugugugugugugugugu

SEQ ID NO: 562413 - RNA, 21 nt, Human
ugugugugugugugugugugu

SEQ ID NO: 562414 - RNA, 21 nt, Human
ugugugugugugugugugugu

SEQ ID NO: 562415 - RNA, 21 nt, Human
ugugugugugugugugugugu

SEQ ID NO: 562416 - RNA, 21 nt, Human
ugugugugugugugugugugu

SEQ ID NO: 562417 - RNA, 21 nt, Human
ugugugugugugugugugugu

SEQ ID NO: 562418 - RNA, 21 nt, Human
ugugugugugugugugugugu

SEQ ID NO: 562419 - RNA, 21 nt, Human
ugugugugugugugugugugu

SEQ ID NO: 562420 - RNA, 21 nt, Human
ugugugugugugugugugugu

SEQ ID NO: 562421 - RNA, 21 nt, Human
ugugugugugugugugugugu

SEQ ID NO: 562422 - RNA, 21 nt, Human
ugugugugugugugugugugu

SEQ ID NO: 562423 - RNA, 21 nt, Human
ugugugugugugugugugugu

SEQ ID NO: 562424 - RNA, 21 nt, Human
ugugugugugugugugugugu

SEQ ID NO: 562425 - RNA, 21 nt, Human
ugugugugugugugugugugu

SEQ ID NO: 562426 - RNA, 21 nt, Human
ugugugugugugugugugugu

SEQ ID NO: 562427 - RNA, 21 nt, Human
ugugugugugugugugugugu

SEQ ID NO: 562428 - RNA, 21 nt, Human
ugugugugugugugugugugu

SEQ ID NO: 562429 - RNA, 21 nt, Human
ugugugugugugugugugugu

SEQ ID NO: 562430 - RNA, 21 nt, Human
ugugugugugugugugugugu

SEQ ID NO: 562431 - RNA, 21 nt, Human
ugugugugugugugugugugu

SEQ ID NO: 562432 - RNA, 21 nt, Human
ugugugugugugugugugugu

SEQ ID NO: 562433 - RNA, 21 nt, Human
ugugugugugugugugugugu

SEQ ID NO: 562434 - RNA, 21 nt, Human
ugugugugugugugugugugu

SEQ ID NO: 562435 - RNA, 21 nt, Human
ugugugugugugugugugugu

SEQ ID NO: 562436 - RNA, 21 nt, Human
ugugugugugugugugugugu

SEQ ID NO: 562437 - RNA, 21 nt, Human
ugugugugugugugugugugu

SEQ ID NO: 562438 - RNA, 21 nt, Human
ugugugugugugugugugugu

SEQ ID NO: 562439 - RNA, 21 nt, Human
ugugugugugugugugugugu

SEQ ID NO: 562440 - RNA, 21 nt, Human
ugugugugugugugugugugu

SEQ ID NO: 562441 - RNA, 21 nt, Human
ugugugugugugugugugugu

SEQ ID NO: 562442 - RNA, 21 nt, Human
ugugugugugugugugugugu

SEQ ID NO: 562443 - RNA, 21 nt, Human
ugugugugugugugugugugu

SEQ ID NO: 562444 - RNA, 22 nt, Human
ugugugugugugugugugugug

SEQ ID NO: 562445 - RNA, 22 nt, Human
ugugugugugugugugugugug

SEQ ID NO: 562446 - RNA, 22 nt, Human
ugugugugugugugugugugug

SEQ ID NO: 562447 - RNA, 22 nt, Human
ugugugugugugugugugugug

SEQ ID NO: 562448 - RNA, 22 nt, Human
ugugugugugugugugugugug

SEQ ID NO: 562449 - RNA, 22 nt, Human
ugugugugugugugugugugug

SEQ ID NO: 562450 - RNA, 22 nt, Human
ugugugugugugugugugugug

SEQ ID NO: 562451 - RNA, 22 nt, Human
ugugugugugugugugugugug

SEQ ID NO: 562452 - RNA, 22 nt, Human
ugugugugugugugugugugug

SEQ ID NO: 562453 - RNA, 22 nt, Human
uguguguguguguguguuccca

SEQ ID NO: 562454 - RNA, 26 nt, Human
aaaaacaccuagacgccucggccuuc

SEQ ID NO: 562455 - RNA, 24 nt, Human
aaacuccaacaaauaagucuucuc

SEQ ID NO: 562456 - RNA, 18 nt, Human
aacaagugaaacuccaac

SEQ ID NO: 562457 - RNA, 20 nt, Human
aacagcgagaaaaacuguac

SEQ ID NO: 562458 - RNA, 23 nt, Human
acgcagcuucuggaugcucaggg

SEQ ID NO: 562459 - RNA, 23 nt, Human
caaaauaagcccagaccauuaaa

SEQ ID NO: 562460 - RNA, 19 nt, Human
caagcuccccucccuccuc

SEQ ID NO: 562461 - RNA, 19 nt, Human
caagcuccccucccuccuc

SEQ ID NO: 562462 - RNA, 19 nt, Human
ccaaaauaagcccagacca

SEQ ID NO: 562463 - RNA, 21 nt, Human
ccaccgccgccgccgucgccc

SEQ ID NO: 562464 - RNA, 19 nt, Human
cccgcaagcuccccucccu

SEQ ID NO: 562465 - RNA, 21 nt, Human
ccgucgcccccucucgggccc

SEQ ID NO: 562466 - RNA, 25 nt, Human
ccucaggccaccgccgccgccgucg

SEQ ID NO: 562467 - RNA, 22 nt, Human
ccucguagcucaucugugagaa

SEQ ID NO: 562468 - RNA, 19 nt, Human
ccuggggccagggucgggg

SEQ ID NO: 562469 - RNA, 24 nt, Human
ccuucgccgccaccgccgccgcuc

SEQ ID NO: 562470 - RNA, 18 nt, Human
cgccgccaccgccgccgc

SEQ ID NO: 562471 - RNA, 21 nt, Human
cgccgccgccgucgcccccuc

SEQ ID NO: 562472 - RNA, 21 nt, Human
cgccgcucgggccuccucagg

SEQ ID NO: 562473 - RNA, 20 nt, Human
cgucgcccccucucgggccc

SEQ ID NO: 562474 - RNA, 19 nt, Human
cucccgcaccgaccaccgc

SEQ ID NO: 562475 - RNA, 24 nt, Human
cugcagcuccugcagagcguuucg

SEQ ID NO: 562476 - RNA, 22 nt, Human
cugcagcucuuccaaaaacacc

SEQ ID NO: 562477 - RNA, 24 nt, Human
cuggaugcucagggcuaucuugug

SEQ ID NO: 562478 - RNA, 21 nt, Human
cuucgccgccaccgccgccgc

SEQ ID NO: 562479 - RNA, 23 nt, Human
cuuuggugacguucugagacucc

SEQ ID NO: 562480 - RNA, 19 nt, Human
gcagcggugguucccccgg

SEQ ID NO: 562481 - RNA, 19 nt, Human
gcagcucuuccaaaaacac

SEQ ID NO: 562482 - RNA, 20 nt, Human
gccccauccuuggcaguagg

SEQ ID NO: 562483 - RNA, 20 nt, Human
gccggggugggcuaggggag

SEQ ID NO: 562484 - RNA, 18 nt, Human
gggccagggucgggggac

SEQ ID NO: 562485 - RNA, 19 nt, Human
ggggacggcgguggcgagg

SEQ ID NO: 562486 - RNA, 20 nt, Human
ggggugggcuaggggaggcu

SEQ ID NO: 562487 - RNA, 24 nt, Human
ggguggugguggcggcagccacgg

SEQ ID NO: 562488 - RNA, 20 nt, Human
ggugguggcggcagccacgg

SEQ ID NO: 562489 - RNA, 26 nt, Human
gguggugguggcggcagccacgguga

SEQ ID NO: 562490 - RNA, 21 nt, Human
guagggguggugguggcggca

SEQ ID NO: 562491 - RNA, 19 nt, Human
gugguggcggcagccacgg

SEQ ID NO: 562492 - RNA, 23 nt, Human
uaggggaggcucagcaccuggca

SEQ ID NO: 562493 - RNA, 18 nt, Human
uccucaggccaccgccgc

SEQ ID NO: 562494 - RNA, 20 nt, Human
uccuuggcaguagggguggu

SEQ ID NO: 562495 - RNA, 18 nt, Human
ucgcccccucucgggccc

SEQ ID NO: 562496 - RNA, 22 nt, Human
ucgccgccaccgccgccgcucg

SEQ ID NO: 562497 - RNA, 23 nt, Human
ucgccgccaccgccgccgcucgg

SEQ ID NO: 562498 - RNA, 18 nt, Human
ucugucucucacgcagcu

SEQ ID NO: 562499 - RNA, 23 nt, Human
ucugugccggggugggcuagggg

SEQ ID NO: 562500 - RNA, 22 nt, Human
ugagaagagggcugcagcucuu

SEQ ID NO: 562501 - RNA, 24 nt, Human
ugccuuugucugugccgggguggg

SEQ ID NO: 562502 - RNA, 25 nt, Human
uggaugcucagggcuaucuuguggc

SEQ ID NO: 562503 - RNA, 22 nt, Human
uggcgagggccagcgccgucac

SEQ ID NO: 562504 - RNA, 20 nt, Human
ugggcuaggggaggcucagc

SEQ ID NO: 562505 - RNA, 18 nt, Human
uggggccagggucggggg

SEQ ID NO: 562506 - RNA, 21 nt, Human
uggugguggcggcagccacgg

SEQ ID NO: 562507 - RNA, 18 nt, Human
ugguucccccggggcccc

SEQ ID NO: 562508 - RNA, 19 nt, Human
uuccaaaauaagcccaggg

SEQ ID NO: 562509 - RNA, 20 nt, Human
uucgccgccaccgccgccgg

SEQ ID NO: 562510 - RNA, 21 nt, Human
uuuuguuuguuuuuuuuuuuu

SEQ ID NO: 562511 - RNA, 19 nt, Human
aaacucaaaauauuucccc

SEQ ID NO: 562512 - RNA, 24 nt, Human
aauaaugggguggcaaaguacacc

SEQ ID NO: 562513 - RNA, 22 nt, Human
acuccccccucaagaucuuacg

SEQ ID NO: 562514 - RNA, 23 nt, Human
aucuagaaacauucucacagcau

SEQ ID NO: 562515 - RNA, 24 nt, Human
auuccacccaacacuccccccuca

SEQ ID NO: 562516 - RNA, 20 nt, Human
auucguggugacagcucccc

SEQ ID NO: 562517 - RNA, 22 nt, Human
caaagacugggaucucagacac

SEQ ID NO: 562518 - RNA, 19 nt, Human
caaaguacacccccaaacu

SEQ ID NO: 562519 - RNA, 24 nt, Human
caaaguacacccccaaacucaaaa

SEQ ID NO: 562520 - RNA, 21 nt, Human
cacccaacacuccccccucaa

SEQ ID NO: 562521 - RNA, 21 nt, Human
cacuccccccucaagaucuua

SEQ ID NO: 562522 - RNA, 18 nt, Human
cccaguaguuugccgcug

SEQ ID NO: 562523 - RNA, 24 nt, Human
ccccaaacucaaaauauuucccca

SEQ ID NO: 562524 - RNA, 22 nt, Human
ccucaagaucuuacgggguaga

SEQ ID NO: 562525 - RNA, 25 nt, Human
gcaaaguacacccccaaacucaaaa

SEQ ID NO: 562526 - RNA, 20 nt, Human
uaaaucccaaaaaugugggg

SEQ ID NO: 562527 - RNA, 19 nt, Human
ucaucuuggcccaguaguu

SEQ ID NO: 562528 - RNA, 23 nt, Human
ugaucuagaaacauucucacagc

SEQ ID NO: 562529 - RNA, 20 nt, Human
ugauuccacccaacacuccc

SEQ ID NO: 562530 - RNA, 26 nt, Human
uggcccguagagcaauggagccaucc

SEQ ID NO: 562531 - RNA, 24 nt, Human
ugggaucucagacacaauggcccg

SEQ ID NO: 562532 - RNA, 20 nt, Human
ugugggguugcucaucuugg

SEQ ID NO: 562533 - RNA, 19 nt, Human
aaaaaaaaaaccaaaaacc

SEQ ID NO: 562534 - RNA, 26 nt, Human
aaaaaaaaccaaaaaccaaaaaacau

SEQ ID NO: 562535 - RNA, 22 nt, Human
aaaaaaaccaaaaaccaaaaaa

SEQ ID NO: 562536 - RNA, 21 nt, Human
aaaaaacauuccacuggcuca

SEQ ID NO: 562537 - RNA, 22 nt, Human
aaaaaaccaaaaaccaaaaaac

SEQ ID NO: 562538 - RNA, 22 nt, Human
aaaaaaccaaaaaccaaaaaac

SEQ ID NO: 562539 - RNA, 18 nt, Human
aaaaacauuccacuggcu

SEQ ID NO: 562540 - RNA, 23 nt, Human
aaaaccaaaaaacauuccacugg

SEQ ID NO: 562541 - RNA, 21 nt, Human
aaacgaagauucccagugagc

SEQ ID NO: 562542 - RNA, 23 nt, Human
aacacggugaaacaugaaacccc

SEQ ID NO: 562543 - RNA, 29 nt, Human
aacacggugaaacaugaaaccccaccuuc

SEQ ID NO: 562544 - RNA, 19 nt, Human
aacauagcaaaaccccauc

SEQ ID NO: 562545 - RNA, 21 nt, Human
aacauagcaaaaccccaucuc

SEQ ID NO: 562546 - RNA, 21 nt, Human
aacauagcaaaaccccaucuc

SEQ ID NO: 562547 - RNA, 24 nt, Human
aaccaaaaaccaaaaaacauucca

SEQ ID NO: 562548 - RNA, 26 nt, Human
aaccaaaaaccaaaaaacauuccacu

SEQ ID NO: 562549 - RNA, 19 nt, Human
aaugauccuccugccucag

SEQ ID NO: 562550 - RNA, 22 nt, Human
acagagcaagacugucucaaaa

SEQ ID NO: 562551 - RNA, 20 nt, Human
acccugccugcucucccagc

SEQ ID NO: 562552 - RNA, 23 nt, Human
acccugccugcucucccagcccu

SEQ ID NO: 562553 - RNA, 24 nt, Human
accugaggucaggaguucgggacc

SEQ ID NO: 562554 - RNA, 18 nt, Human
accuguaaucucagcuac

SEQ ID NO: 562555 - RNA, 22 nt, Human
acggugaaacaugaaaccccac

SEQ ID NO: 562556 - RNA, 24 nt, Human
agccugggcaacauagcaaaaccc

SEQ ID NO: 562557 - RNA, 24 nt, Human
aggcaggagaaucucuugaacccg

SEQ ID NO: 562558 - RNA, 24 nt, Human
aggcggagguugcagugagccaag

SEQ ID NO: 562559 - RNA, 22 nt, Human
aggcggguggaucaccugaggu

SEQ ID NO: 562560 - RNA, 26 nt, Human
aggcggguggaucaccugaggucagg

SEQ ID NO: 562561 - RNA, 24 nt, Human
aggcugaggcaggagaaucucuug

SEQ ID NO: 562562 - RNA, 21 nt, Human
aggcugaggcggguggaucac

SEQ ID NO: 562563 - RNA, 24 nt, Human
aggcugaggcggguggaucaccug

SEQ ID NO: 562564 - RNA, 19 nt, Human
aggggcugaagagccagcg

SEQ ID NO: 562565 - RNA, 24 nt, Human
aggggucucacuauguuuccuggg

SEQ ID NO: 562566 - RNA, 26 nt, Human
auagcaaaaccccaucuccgaaaaag

SEQ ID NO: 562567 - RNA, 19 nt, Human
aucgcacuccagccugggu

SEQ ID NO: 562568 - RNA, 24 nt, Human
aucgcacuccagccugggugacag

SEQ ID NO: 562569 - RNA, 24 nt, Human
aucgcgccaucgcacuccagccug

SEQ ID NO: 562570 - RNA, 24 nt, Human
augauccuccugccucagccuccu

SEQ ID NO: 562571 - RNA, 22 nt, Human
caaaaaccaaaaaacauuccac

SEQ ID NO: 562572 - RNA, 20 nt, Human
caaaugauccuccugccuca

SEQ ID NO: 562573 - RNA, 27 nt, Human
caaaugauccuccugccucagccuccu

SEQ ID NO: 562574 - RNA, 31 nt, Human
caagacugucucaaaaaaaaaaaaaaaaaaa

SEQ ID NO: 562575 - RNA, 24 nt, Human
cacagccccaggugugacaaccga

SEQ ID NO: 562576 - RNA, 18 nt, Human
cacccugccugcucuccc

SEQ ID NO: 562577 - RNA, 23 nt, Human
caccucuacuaaaaauacaaaaa

SEQ ID NO: 562578 - RNA, 23 nt, Human
caccugaggucaggaguucggga

SEQ ID NO: 562579 - RNA, 22 nt, Human
caccuguaaucccagcuacuug

SEQ ID NO: 562580 - RNA, 25 nt, Human
caccuguaaucccagcuacuuguga

SEQ ID NO: 562581 - RNA, 22 nt, Human
cacuccagccugggugacagag

SEQ ID NO: 562582 - RNA, 23 nt, Human
cacuccagccugggugacagagc

SEQ ID NO: 562583 - RNA, 21 nt, Human
cagcagcacccugccaguagc

SEQ ID NO: 562584 - RNA, 20 nt, Human
cagccaaggcguccguccag

SEQ ID NO: 562585 - RNA, 21 nt, Human
cagccacgcucacucccaccc

SEQ ID NO: 562586 - RNA, 20 nt, Human
cagcccaggccagagagcga

SEQ ID NO: 562587 - RNA, 22 nt, Human
cagccuccuaaguagcugggag

SEQ ID NO: 562588 - RNA, 18 nt, Human
cagcugugcuccuggguu

SEQ ID NO: 562589 - RNA, 18 nt, Human
cagguuccagcugugcuc

SEQ ID NO: 562590 - RNA, 20 nt, Human
caguagcacagccccaggug

SEQ ID NO: 562591 - RNA, 27 nt, Human
cauagcaaaaccccaucuccgaaaaaa

SEQ ID NO: 562592 - RNA, 19 nt, Human
caucgcacuccagccuggg

SEQ ID NO: 562593 - RNA, 23 nt, Human
caucgcacuccagccugggugac

SEQ ID NO: 562594 - RNA, 24 nt, Human
caucgcacuccagccugggugaca

SEQ ID NO: 562595 - RNA, 24 nt, Human
caucgcacuccagccugggugaca

SEQ ID NO: 562596 - RNA, 23 nt, Human
ccaaaaaacauuccacuggcuca

SEQ ID NO: 562597 - RNA, 18 nt, Human
ccagcccuuggccugguu

SEQ ID NO: 562598 - RNA, 20 nt, Human
ccaggugugacaaccgaaaa

SEQ ID NO: 562599 - RNA, 20 nt, Human
ccaucgcacuccagccuggg

SEQ ID NO: 562600 - RNA, 21 nt, Human
ccaucgcacuccagccugggu

SEQ ID NO: 562601 - RNA, 24 nt, Human
ccaucgcacuccagccugggugac

SEQ ID NO: 562602 - RNA, 21 nt, Human
cccagaacagggccccaucac

SEQ ID NO: 562603 - RNA, 20 nt, Human
cccccagaacagggccccau

SEQ ID NO: 562604 - RNA, 24 nt, Human
cccuggggaccagccaaggcgucc

SEQ ID NO: 562605 - RNA, 27 nt, Human
cccuggggaccagccaaggcguccguc

SEQ ID NO: 562606 - RNA, 21 nt, Human
ccucagccacgcucacuccca

SEQ ID NO: 562607 - RNA, 19 nt, Human
ccugacagugcuggucccc

SEQ ID NO: 562608 - RNA, 22 nt, Human
ccugaggucaggaguucgggac

SEQ ID NO: 562609 - RNA, 23 nt, Human
ccugccucagccuccuaaguagc

SEQ ID NO: 562610 - RNA, 24 nt, Human
ccugccucagccuccuaaguagcu

SEQ ID NO: 562611 - RNA, 24 nt, Human
ccugggcaacauagcaaaacccca

SEQ ID NO: 562612 - RNA, 22 nt, Human
ccugggcucaaaugauccuccu

SEQ ID NO: 562613 - RNA, 20 nt, Human
ccugggugacagagcaagac

SEQ ID NO: 562614 - RNA, 20 nt, Human
ccuguaaucccagcuacuug

SEQ ID NO: 562615 - RNA, 22 nt, Human
ccuguaaucucagcuacucaag

SEQ ID NO: 562616 - RNA, 24 nt, Human
cgcacuccagccugggugacagag

SEQ ID NO: 562617 - RNA, 26 nt, Human
cgccaucgcacuccagccugggugac

SEQ ID NO: 562618 - RNA, 24 nt, Human
cgggaggcggagguugcagugagc

SEQ ID NO: 562619 - RNA, 24 nt, Human
cggguggaucaccugaggucagga

SEQ ID NO: 562620 - RNA, 18 nt, Human
cucaaaaaaaaaaaaaaa

SEQ ID NO: 562621 - RNA, 26 nt, Human
cucaaaaaaaaaaaaaaaaaaaaaaa

SEQ ID NO: 562622 - RNA, 24 nt, Human
cucaaaugauccuccugccucagc

SEQ ID NO: 562623 - RNA, 21 nt, Human
cucccacccugccugcucucc

SEQ ID NO: 562624 - RNA, 22 nt, Human
cucccucagccacgcucacucc

SEQ ID NO: 562625 - RNA, 23 nt, Human
cugcuugagcccgggaguucaag

SEQ ID NO: 562626 - RNA, 25 nt, Human
cugggaggcugaggcggguggauca

SEQ ID NO: 562627 - RNA, 23 nt, Human
cugggcaacauagcaaaacccca

SEQ ID NO: 562628 - RNA, 22 nt, Human
cugucucaaaaaaaaaaaaaaa

SEQ ID NO: 562629 - RNA, 27 nt, Human
gagcaagacugucucaaaaaaaaaaaa

SEQ ID NO: 562630 - RNA, 18 nt, Human
gaggcugaggcaggagaa

SEQ ID NO: 562631 - RNA, 23 nt, Human
gagguugcagugagccaagaucg

SEQ ID NO: 562632 - RNA, 21 nt, Human
gaucaccugaggucaggaguu

SEQ ID NO: 562633 - RNA, 23 nt, Human
gaucaccugaggucaggaguucg

SEQ ID NO: 562634 - RNA, 24 nt, Human
gaucaccugaggucaggaguucgg

SEQ ID NO: 562635 - RNA, 25 nt, Human
gaucaccugaggucaggaguucggg

SEQ ID NO: 562636 - RNA, 24 nt, Human
gcacuccagccugggugacagagc

SEQ ID NO: 562637 - RNA, 19 nt, Human
gccaucgcacuccagccug

SEQ ID NO: 562638 - RNA, 24 nt, Human
gccaucgcacuccagccuggguga

SEQ ID NO: 562639 - RNA, 20 nt, Human
gcccuuggccugguuccugg

SEQ ID NO: 562640 - RNA, 20 nt, Human
gcgggcaccuguaaucccag

SEQ ID NO: 562641 - RNA, 19 nt, Human
gcucacucccacccugccu

SEQ ID NO: 562642 - RNA, 22 nt, Human
gcuugagcccgggaguucaaga

SEQ ID NO: 562643 - RNA, 20 nt, Human
ggagguugcagugagccaag

SEQ ID NO: 562644 - RNA, 24 nt, Human
ggagguugcagugagccaagaucg

SEQ ID NO: 562645 - RNA, 24 nt, Human
ggcaccuguaaucccagcuacuug

SEQ ID NO: 562646 - RNA, 21 nt, Human
ggcgggcaccuguaaucccag

SEQ ID NO: 562647 - RNA, 29 nt, Human
gggcauuuuaaacgagcucucaggugauu

SEQ ID NO: 562648 - RNA, 22 nt, Human
gggcucaaaugauccuccugcc

SEQ ID NO: 562649 - RNA, 19 nt, Human
gggcugaagagccagcgug

SEQ ID NO: 562650 - RNA, 23 nt, Human
ggugacagagcaagacugucuca

SEQ ID NO: 562651 - RNA, 23 nt, Human
gguggugcguaccuguaaucuca

SEQ ID NO: 562652 - RNA, 22 nt, Human
gugacagagcaagacugucuca

SEQ ID NO: 562653 - RNA, 23 nt, Human
guggugcguaccuguaaucucag

SEQ ID NO: 562654 - RNA, 21 nt, Human
uaaaaauacaaaaauuagcca

SEQ ID NO: 562655 - RNA, 19 nt, Human
uaaggaaacaauuuaaauc

SEQ ID NO: 562656 - RNA, 19 nt, Human
uaaggggucucacuauguu

SEQ ID NO: 562657 - RNA, 20 nt, Human
uaaggggucucacuauguuu

SEQ ID NO: 562658 - RNA, 24 nt, Human
uaaguagcugggaggcugaggcgg

SEQ ID NO: 562659 - RNA, 22 nt, Human
uaccuguaaucucagcuacuca

SEQ ID NO: 562660 - RNA, 22 nt, Human
ucaaaaaaaaaaaaaaaaaaaa

SEQ ID NO: 562661 - RNA, 23 nt, Human
ucaaaaaaaaaaaaaaaaaaaaa

SEQ ID NO: 562662 - RNA, 20 nt, Human
ucaccugaggucaggaguuc

SEQ ID NO: 562663 - RNA, 26 nt, Human
ucacucccacccugccugcucuccca

SEQ ID NO: 562664 - RNA, 24 nt, Human
uccagccugggugacagagcaaga

SEQ ID NO: 562665 - RNA, 21 nt, Human
ucccccagaacagggccccau

SEQ ID NO: 562666 - RNA, 18 nt, Human
uccgucugccccucccuc

SEQ ID NO: 562667 - RNA, 26 nt, Human
uccuccugccucagccuccuaaguag

SEQ ID NO: 562668 - RNA, 22 nt, Human
uccugggcucaaaugauccucc

SEQ ID NO: 562669 - RNA, 27 nt, Human
ucgccaaaucaacccugguugagaguc

SEQ ID NO: 562670 - RNA, 23 nt, Human
ucucccagcccuuggccugguuc

SEQ ID NO: 562671 - RNA, 20 nt, Human
ucuccgaaaaaaaaaaaaaa

SEQ ID NO: 562672 - RNA, 24 nt, Human
ucucuugaacccgggaggcggagg

SEQ ID NO: 562673 - RNA, 19 nt, Human
ugaaaccccaccucuacua

SEQ ID NO: 562674 - RNA, 21 nt, Human
ugacaggcguguggaacucca

SEQ ID NO: 562675 - RNA, 23 nt, Human
ugacagugcuggucccccagaac

SEQ ID NO: 562676 - RNA, 22 nt, Human
ugagagucacugcugcaggucu

SEQ ID NO: 562677 - RNA, 22 nt, Human
ugagccaagaucgcgccaucgc

SEQ ID NO: 562678 - RNA, 23 nt, Human
ugagcccgggaguucaagaccag

SEQ ID NO: 562679 - RNA, 20 nt, Human
ugaggcaggagaaucucuug

SEQ ID NO: 562680 - RNA, 24 nt, Human
ugaggcaggagaaucucuugaacc

SEQ ID NO: 562681 - RNA, 25 nt, Human
ugaggcaggagaaucucuugaaccc

SEQ ID NO: 562682 - RNA, 20 nt, Human
ugaggcggguggaucaccug

SEQ ID NO: 562683 - RNA, 22 nt, Human
ugaggcggguggaucaccugag

SEQ ID NO: 562684 - RNA, 24 nt, Human
ugaggcggguggaucaccugaggu

SEQ ID NO: 562685 - RNA, 26 nt, Human
ugaggcggguggaucaccugagguca

SEQ ID NO: 562686 - RNA, 24 nt, Human
ugccucagccuccuaaguagcugg

SEQ ID NO: 562687 - RNA, 21 nt, Human
ugcugcaggucuuaaaagggc

SEQ ID NO: 562688 - RNA, 23 nt, Human
ugcugcaggucuuaaaagggcau

SEQ ID NO: 562689 - RNA, 24 nt, Human
uggacaacacggugaaacaugaaa

SEQ ID NO: 562690 - RNA, 24 nt, Human
uggaucaccugaggucaggaguuc

SEQ ID NO: 562691 - RNA, 27 nt, Human
uggaucaccugaggucaggaguucggg

SEQ ID NO: 562692 - RNA, 19 nt, Human
uggcagcacagcagcgucu

SEQ ID NO: 562693 - RNA, 22 nt, Human
uggcgggcaccuguaaucccag

SEQ ID NO: 562694 - RNA, 19 nt, Human
uggcucaugacaaacgaag

SEQ ID NO: 562695 - RNA, 23 nt, Human
ugggaggcugaggcggguggauc

SEQ ID NO: 562696 - RNA, 24 nt, Human
ugggaggcugaggcggguggauca

SEQ ID NO: 562697 - RNA, 20 nt, Human
ugggauguucagcagcaccc

SEQ ID NO: 562698 - RNA, 22 nt, Human
ugggcaacauagcaaaacccca

SEQ ID NO: 562699 - RNA, 24 nt, Human
ugggcucaaaugauccuccugccu

SEQ ID NO: 562700 - RNA, 23 nt, Human
uggguuccugacagugcuggucc

SEQ ID NO: 562701 - RNA, 22 nt, Human
uggugcguaccuguaaucucag

SEQ ID NO: 562702 - RNA, 24 nt, Human
ugguggcgggcaccuguaauccca

SEQ ID NO: 562703 - RNA, 23 nt, Human
ugguugagagucacugcugcagg

SEQ ID NO: 562704 - RNA, 19 nt, Human
ugugguggcgggcaccugu

SEQ ID NO: 562705 - RNA, 21 nt, Human
uuccagcugugcuccuggguu

SEQ ID NO: 562706 - RNA, 24 nt, Human
uugaacccgggaggcggagguugc

SEQ ID NO: 562707 - RNA, 22 nt, Human
uugagcccgggaguucaagacc

SEQ ID NO: 562708 - RNA, 22 nt, Human
uugcagugagccaagaucgcgc

SEQ ID NO: 562709 - RNA, 24 nt, Human
uuuccugggcucaaaugauccucc

SEQ ID NO: 562710 - RNA, 18 nt, Human
aaaaaacccaaaccuguc

SEQ ID NO: 562711 - RNA, 20 nt, Human
aaccugucccauaccccucc

SEQ ID NO: 562712 - RNA, 20 nt, Human
agccacagggacagcccaaa

SEQ ID NO: 562713 - RNA, 22 nt, Human
agccacagggacagcccaaaca

SEQ ID NO: 562714 - RNA, 20 nt, Human
auaaaaaaaaaacccaaacc

SEQ ID NO: 562715 - RNA, 18 nt, Human
caccccagaaccagccac

SEQ ID NO: 562716 - RNA, 19 nt, Human
cauaccccucccacucaug

SEQ ID NO: 562717 - RNA, 18 nt, Human
ccaaacaacugcagggga

SEQ ID NO: 562718 - RNA, 24 nt, Human
ccauaccccucccacucaugcaaa

SEQ ID NO: 562719 - RNA, 28 nt, Human
cccauaccccucccacucaaucgguugg

SEQ ID NO: 562720 - RNA, 22 nt, Human
ccgcacaccccagaaccagcca

SEQ ID NO: 562721 - RNA, 24 nt, Human
cuggccgcacaccccagaaccagc

SEQ ID NO: 562722 - RNA, 24 nt, Human
uaaaaaaaaaacccaaaccugucc

SEQ ID NO: 562723 - RNA, 25 nt, Human
uaccccucccacucaugcaaacagc

SEQ ID NO: 562724 - RNA, 23 nt, Human
ugucccauaccccucccacucau

SEQ ID NO: 562725 - RNA, 22 nt, Human
uucaugagcauaaaaaaaaaac

SEQ ID NO: 562726 - RNA, 23 nt, Human
uucaugagcauaaaaaaaaaacc

SEQ ID NO: 562727 - RNA, 29 nt, Human
uuuuuuuuuuuuuuuuuuuuucauaaaaa

SEQ ID NO: 562728 - RNA, 18 nt, Human
aacaagaaccacgaagga

SEQ ID NO: 562729 - RNA, 21 nt, Human
aagaaauggcagugcacucac

SEQ ID NO: 562730 - RNA, 19 nt, Human
aagaaccacgaaggaggcc

SEQ ID NO: 562731 - RNA, 33 nt, Human
acaaccaacaagaaccacgaaggaggcgccuuc

SEQ ID NO: 562732 - RNA, 23 nt, Human
acagccugagccuuuaccucccc

SEQ ID NO: 562733 - RNA, 24 nt, Human
acgcaacuucugagggcuggaggg

SEQ ID NO: 562734 - RNA, 22 nt, Human
agaaguguggugagcuaccaga

SEQ ID NO: 562735 - RNA, 19 nt, Human
aggcagaagcacaaccaac

SEQ ID NO: 562736 - RNA, 23 nt, Human
aggcagaagcacaaccaacaaga

SEQ ID NO: 562737 - RNA, 19 nt, Human
agggcagcugcugaccgcc

SEQ ID NO: 562738 - RNA, 20 nt, Human
cacaaccaacaagaaccacu

SEQ ID NO: 562739 - RNA, 21 nt, Human
cagcaccacucccccacccug

SEQ ID NO: 562740 - RNA, 21 nt, Human
cagccugagccuuuaccuccc

SEQ ID NO: 562741 - RNA, 19 nt, Human
cauggaaagggcugccuga

SEQ ID NO: 562742 - RNA, 25 nt, Human
ccagacauuccaugcagcccgcuga

SEQ ID NO: 562743 - RNA, 22 nt, Human
ccagaggcagaagcacaaccaa

SEQ ID NO: 562744 - RNA, 21 nt, Human
cccugugucagucaggguccc

SEQ ID NO: 562745 - RNA, 23 nt, Human
ccuccccaggccugaacaggggc

SEQ ID NO: 562746 - RNA, 22 nt, Human
ccugagccuuuaccuccccagg

SEQ ID NO: 562747 - RNA, 22 nt, Human
cggcguccagaggcagaagcac

SEQ ID NO: 562748 - RNA, 24 nt, Human
cuccugugauuggccagcaccacu

SEQ ID NO: 562749 - RNA, 22 nt, Human
cugaaaaagcugaauuuggaac

SEQ ID NO: 562750 - RNA, 21 nt, Human
cugaauugacuggaaauccau

SEQ ID NO: 562751 - RNA, 24 nt, Human
cuuauccccuuucaaaaaacugcc

SEQ ID NO: 562752 - RNA, 23 nt, Human
gaagcacaaccaacaagaaccag

SEQ ID NO: 562753 - RNA, 19 nt, Human
gacaaggugaguguggcuc

SEQ ID NO: 562754 - RNA, 23 nt, Human
gaugcugcauguccugcaguggg

SEQ ID NO: 562755 - RNA, 24 nt, Human
gcauggaaagggcugccugacagg

SEQ ID NO: 562756 - RNA, 20 nt, Human
gccugaacaggggcauggaa

SEQ ID NO: 562757 - RNA, 20 nt, Human
gcgaaggaugcugcaugucc

SEQ ID NO: 562758 - RNA, 19 nt, Human
gcuucaggagcugggugcu

SEQ ID NO: 562759 - RNA, 21 nt, Human
ggagaaccaucccuguaaagu

SEQ ID NO: 562760 - RNA, 20 nt, Human
ggcagcugcugaccgccugg

SEQ ID NO: 562761 - RNA, 22 nt, Human
ggccagcaccacucccccaccc

SEQ ID NO: 562762 - RNA, 21 nt, Human
gggcagcugcugaccgccugg

SEQ ID NO: 562763 - RNA, 22 nt, Human
ggggugcgcuggccuuuaguga

SEQ ID NO: 562764 - RNA, 18 nt, Human
ggugcuucaggagcuggg

SEQ ID NO: 562765 - RNA, 22 nt, Human
guaaagugucaguaguagcccc

SEQ ID NO: 562766 - RNA, 20 nt, Human
gucccugcaagaaauggcag

SEQ ID NO: 562767 - RNA, 22 nt, Human
gugaguguggcucucugcggcu

SEQ ID NO: 562768 - RNA, 19 nt, Human
guggaggcgcugugucucc

SEQ ID NO: 562769 - RNA, 23 nt, Human
uaaagucaauaaauccauaacca

SEQ ID NO: 562770 - RNA, 21 nt, Human
uaaccagcaauacuauggggc

SEQ ID NO: 562771 - RNA, 23 nt, Human
uaauauagagaauuacuggcuuu

SEQ ID NO: 562772 - RNA, 22 nt, Human
uaccagacauuccaugcagccc

SEQ ID NO: 562773 - RNA, 23 nt, Human
uagccaagggcagccaggaauaa

SEQ ID NO: 562774 - RNA, 25 nt, Human
uauagagaauuacuggcuuuaacag

SEQ ID NO: 562775 - RNA, 24 nt, Human
uccagaggcagaagcacaaccaac

SEQ ID NO: 562776 - RNA, 25 nt, Human
uccauaaccagcaauacuauggggc

SEQ ID NO: 562777 - RNA, 18 nt, Human
uccccuuucaaaaaacug

SEQ ID NO: 562778 - RNA, 19 nt, Human
ucccugcaagaaauggcag

SEQ ID NO: 562779 - RNA, 23 nt, Human
uccugugauuggccagcaccacu

SEQ ID NO: 562780 - RNA, 23 nt, Human
ucuccuacgcaacuucugagggc

SEQ ID NO: 562781 - RNA, 21 nt, Human
ugagaagccacgugagugggg

SEQ ID NO: 562782 - RNA, 23 nt, Human
ugccaagggcagcugcugaccgc

SEQ ID NO: 562783 - RNA, 24 nt, Human
ugccaagggcagcugcugaccgcc

SEQ ID NO: 562784 - RNA, 19 nt, Human
ugccucaguggaggcgcug

SEQ ID NO: 562785 - RNA, 20 nt, Human
uggggccuggggugcgcugg

SEQ ID NO: 562786 - RNA, 27 nt, Human
uggggugcuggggaacgucgcgguggu

SEQ ID NO: 562787 - RNA, 21 nt, Human
uggugcuucaggagcugggug

SEQ ID NO: 562788 - RNA, 23 nt, Human
uuagccaagggcagccaggaaua

SEQ ID NO: 562789 - RNA, 24 nt, Human
uucaggagcugggugcuggggaag

SEQ ID NO: 562790 - RNA, 20 nt, Human
aaacaauuacaugggcccca

SEQ ID NO: 562791 - RNA, 19 nt, Human
aaacacauacacauaaaca

SEQ ID NO: 562792 - RNA, 20 nt, Human
aacaaaagugagccuuccac

SEQ ID NO: 562793 - RNA, 23 nt, Human
aacgcagcacaagagucugagca

SEQ ID NO: 562794 - RNA, 21 nt, Human
aagugagccuuccacuaacuu

SEQ ID NO: 562795 - RNA, 19 nt, Human
aaguguuagaaggcagcuu

SEQ ID NO: 562796 - RNA, 21 nt, Human
aauaaaauuaaacgagcuucc

SEQ ID NO: 562797 - RNA, 19 nt, Human
acaagaaauauagcacaca

SEQ ID NO: 562798 - RNA, 22 nt, Human
acaauaaaauuaaacgagcuuc

SEQ ID NO: 562799 - RNA, 26 nt, Human
acuucacugcaguuaugguuaacucc

SEQ ID NO: 562800 - RNA, 18 nt, Human
agacaaguuuacugcucu

SEQ ID NO: 562801 - RNA, 19 nt, Human
agcugcugucaggacucug

SEQ ID NO: 562802 - RNA, 21 nt, Human
auucacuuucucaaaccccca

SEQ ID NO: 562803 - RNA, 18 nt, Human
auuugcuuugcuuccccu

SEQ ID NO: 562804 - RNA, 21 nt, Human
caaagcggggcucaguuugcu

SEQ ID NO: 562805 - RNA, 23 nt, Human
cacaauaaaauuaaacgagcuuc

SEQ ID NO: 562806 - RNA, 18 nt, Human
cacauuccuaacaagccu

SEQ ID NO: 562807 - RNA, 18 nt, Human
caccagccaccaaacauu

SEQ ID NO: 562808 - RNA, 20 nt, Human
cauuacagaaugcauuuucc

SEQ ID NO: 562809 - RNA, 22 nt, Human
cauuccuaacaagccugcacug

SEQ ID NO: 562810 - RNA, 26 nt, Human
ccaaaagccccauauccaucacacga

SEQ ID NO: 562811 - RNA, 23 nt, Human
ccacacauuccuaacaagccugc

SEQ ID NO: 562812 - RNA, 20 nt, Human
cccacuucauuacagaaugc

SEQ ID NO: 562813 - RNA, 21 nt, Human
cccacuucauuacagaaugca

SEQ ID NO: 562814 - RNA, 25 nt, Human
ccucugaagcugcugucaggacucu

SEQ ID NO: 562815 - RNA, 23 nt, Human
cuaaaaacacauacacauaaaca

SEQ ID NO: 562816 - RNA, 21 nt, Human
cugaaugagauucauuaacgc

SEQ ID NO: 562817 - RNA, 27 nt, Human
cuuccaaucuucccuuccacacauucc

SEQ ID NO: 562818 - RNA, 21 nt, Human
gaaucuaccuuagaccuucuu

SEQ ID NO: 562819 - RNA, 22 nt, Human
gagcacguucugauauggacaa

SEQ ID NO: 562820 - RNA, 19 nt, Human
gaguaaauggaaauaaugu

SEQ ID NO: 562821 - RNA, 19 nt, Human
gauauuuauauugaaaauu

SEQ ID NO: 562822 - RNA, 21 nt, Human
gccaccaaacauuucuauagg

SEQ ID NO: 562823 - RNA, 25 nt, Human
ggaccuuugacaccagccaccaaac

SEQ ID NO: 562824 - RNA, 21 nt, Human
uaaaaacacauacacauaaac

SEQ ID NO: 562825 - RNA, 20 nt, Human
uaaaaguuccgaagcuguga

SEQ ID NO: 562826 - RNA, 20 nt, Human
uaaagugcaacacaacagaa

SEQ ID NO: 562827 - RNA, 20 nt, Human
uaacaaggagaauuacaguc

SEQ ID NO: 562828 - RNA, 19 nt, Human
uaacgcagcacaagagucu

SEQ ID NO: 562829 - RNA, 18 nt, Human
uaacucaaagcggggcuc

SEQ ID NO: 562830 - RNA, 23 nt, Human
uaacuuuguaaauuauacaagaa

SEQ ID NO: 562831 - RNA, 22 nt, Human
uaaggaccuuugacaccagcca

SEQ ID NO: 562832 - RNA, 20 nt, Human
uaaucucuaccccacgcguc

SEQ ID NO: 562833 - RNA, 19 nt, Human
uacacuguuaaccaaguaa

SEQ ID NO: 562834 - RNA, 20 nt, Human
uauagcacacaacuugaauu

SEQ ID NO: 562835 - RNA, 19 nt, Human
ucagacuucacugcaguua

SEQ ID NO: 562836 - RNA, 23 nt, Human
ucagacuucacugcaguuauggu

SEQ ID NO: 562837 - RNA, 20 nt, Human
ucauuccugauagguuauca

SEQ ID NO: 562838 - RNA, 25 nt, Human
uccaaaagccccauauccaucacac

SEQ ID NO: 562839 - RNA, 21 nt, Human
ucgguaacaaggagaauuaca

SEQ ID NO: 562840 - RNA, 22 nt, Human
ucgguaacaaggagaauuacag

SEQ ID NO: 562841 - RNA, 21 nt, Human
ucucaaaugcaugaacacuaa

SEQ ID NO: 562842 - RNA, 19 nt, Human
ugaaaggcuccaggcuuca

SEQ ID NO: 562843 - RNA, 19 nt, Human
ugaauuaaucuaaaaacac

SEQ ID NO: 562844 - RNA, 18 nt, Human
ugacaccagccaccaaac

SEQ ID NO: 562845 - RNA, 24 nt, Human
ugcaacacaacagaacaugucugc

SEQ ID NO: 562846 - RNA, 21 nt, Human
uggaacaguguaacucaaagc

SEQ ID NO: 562847 - RNA, 19 nt, Human
ugguugcauguuguuuuga

SEQ ID NO: 562848 - RNA, 18 nt, Human
uuguuccugagaugagca

SEQ ID NO: 562849 - RNA, 22 nt, Human
aaaaacaaugaaaaacaaacaa

SEQ ID NO: 562850 - RNA, 19 nt, Human
aaagugcugggguuacagg

SEQ ID NO: 562851 - RNA, 24 nt, Human
aaagugcugggguuacaggcguga

SEQ ID NO: 562852 - RNA, 20 nt, Human
aacaagugauuaagaaguaa

SEQ ID NO: 562853 - RNA, 22 nt, Human
aacagagauaaaauauuaaaaa

SEQ ID NO: 562854 - RNA, 20 nt, Human
aacagaggacugacugccuc

SEQ ID NO: 562855 - RNA, 21 nt, Human
aaccacuggauuaguccuuug

SEQ ID NO: 562856 - RNA, 22 nt, Human
aagcagcugggauuacaggcau

SEQ ID NO: 562857 - RNA, 24 nt, Human
aagcagcugggauuacaggcaugc

SEQ ID NO: 562858 - RNA, 24 nt, Human
aagugauccacccgccucggccuc

SEQ ID NO: 562859 - RNA, 25 nt, Human
aagugauucuccugccucagccucc

SEQ ID NO: 562860 - RNA, 19 nt, Human
aagugcugggguuacaggc

SEQ ID NO: 562861 - RNA, 19 nt, Human
aagugcugggguuacaggc

SEQ ID NO: 562862 - RNA, 23 nt, Human
acagcaacagaggacugacugcc

SEQ ID NO: 562863 - RNA, 25 nt, Human
acccgccucggccucccaaagugcu

SEQ ID NO: 562864 - RNA, 24 nt, Human
acuauauuggucaggcuggucuug

SEQ ID NO: 562865 - RNA, 24 nt, Human
agugcaauggugcacucucggcuc

SEQ ID NO: 562866 - RNA, 20 nt, Human
aguuuugcucuuuuugccca

SEQ ID NO: 562867 - RNA, 18 nt, Human
auucuccugccucagccu

SEQ ID NO: 562868 - RNA, 24 nt, Human
caaaaacaaugaaaaacaaacaac

SEQ ID NO: 562869 - RNA, 24 nt, Human
caaagugcugggguuacaggcgug

SEQ ID NO: 562870 - RNA, 22 nt, Human
caagugauucuccugccucagc

SEQ ID NO: 562871 - RNA, 23 nt, Human
cacccgccucggccucccaaagu

SEQ ID NO: 562872 - RNA, 21 nt, Human
cacuauauuggucaggcuggu

SEQ ID NO: 562873 - RNA, 24 nt, Human
cacuauauuggucaggcuggucuu

SEQ ID NO: 562874 - RNA, 18 nt, Human
cacugcaaccucugccuc

SEQ ID NO: 562875 - RNA, 21 nt, Human
cacugcaaccucugccuccug

SEQ ID NO: 562876 - RNA, 18 nt, Human
cagcgcccgcagcagccg

SEQ ID NO: 562877 - RNA, 24 nt, Human
caggcgugagucacugugcccggc

SEQ ID NO: 562878 - RNA, 23 nt, Human
cauaacaagugauuaagaaguaa

SEQ ID NO: 562879 - RNA, 18 nt, Human
caugcaccaugcccggcu

SEQ ID NO: 562880 - RNA, 19 nt, Human
caugcaccaugcccggcua

SEQ ID NO: 562881 - RNA, 20 nt, Human
ccaaagugcugggguuacag

SEQ ID NO: 562882 - RNA, 22 nt, Human
ccaaagugcugggguuacaggc

SEQ ID NO: 562883 - RNA, 22 nt, Human
ccaaagugcugggguuacaggc

SEQ ID NO: 562884 - RNA, 24 nt, Human
ccaaagugcugggguuacaggcgu

SEQ ID NO: 562885 - RNA, 23 nt, Human
ccaagcagcugggauuacaggca

SEQ ID NO: 562886 - RNA, 24 nt, Human
ccaagcagcugggauuacaggcau

SEQ ID NO: 562887 - RNA, 22 nt, Human
ccacgcuucaccgccacggccg

SEQ ID NO: 562888 - RNA, 22 nt, Human
ccacuggauuaguccuuuguau

SEQ ID NO: 562889 - RNA, 19 nt, Human
cccaagcagcugggauuac

SEQ ID NO: 562890 - RNA, 24 nt, Human
cccaagcagcugggauuacaggca

SEQ ID NO: 562891 - RNA, 19 nt, Human
cccaggcuggagugcaaug

SEQ ID NO: 562892 - RNA, 24 nt, Human
ccccacgcuucaccgccacggccg

SEQ ID NO: 562893 - RNA, 19 nt, Human
cccgaacagucaccgucuc

SEQ ID NO: 562894 - RNA, 20 nt, Human
ccgccacggccgccgccgcc

SEQ ID NO: 562895 - RNA, 22 nt, Human
ccgccgccgccgccgcugccgc

SEQ ID NO: 562896 - RNA, 18 nt, Human
ccgccgccgccgcugccg

SEQ ID NO: 562897 - RNA, 24 nt, Human
ccgccgccgccgcugccgcugccg

SEQ ID NO: 562898 - RNA, 25 nt, Human
ccgccgccgccgcugccgcugccgc

SEQ ID NO: 562899 - RNA, 27 nt, Human
ccgccgccgccgcugccgcugccgcuc

SEQ ID NO: 562900 - RNA, 18 nt, Human
ccgcugccgcucggggga

SEQ ID NO: 562901 - RNA, 22 nt, Human
ccgcugccgcugccgcucgggg

SEQ ID NO: 562902 - RNA, 24 nt, Human
ccuccuguguucaagugauucucc

SEQ ID NO: 562903 - RNA, 22 nt, Human
ccugaccucaagugauccaccc

SEQ ID NO: 562904 - RNA, 23 nt, Human
ccugaccucaagugauccacccg

SEQ ID NO: 562905 - RNA, 25 nt, Human
cgcaaaaacaaugaaaaacaaacaa

SEQ ID NO: 562906 - RNA, 21 nt, Human
cgccgcugccgcugccgcucg

SEQ ID NO: 562907 - RNA, 24 nt, Human
cgccucggccucccaaagugcugg

SEQ ID NO: 562908 - RNA, 20 nt, Human
cgcugccgcucgggggagga

SEQ ID NO: 562909 - RNA, 25 nt, Human
cggccgccgccgccuagaguagcac

SEQ ID NO: 562910 - RNA, 20 nt, Human
cuagaguagcacucgucgac

SEQ ID NO: 562911 - RNA, 21 nt, Human
cucacugcaaccucugccucc

SEQ ID NO: 562912 - RNA, 19 nt, Human
cuccuguguucaagugauu

SEQ ID NO: 562913 - RNA, 20 nt, Human
cucuuuuugcccaggcugga

SEQ ID NO: 562914 - RNA, 24 nt, Human
cugcaaccucugccuccuguguuc

SEQ ID NO: 562915 - RNA, 23 nt, Human
cugccucagccucccaagcagcu

SEQ ID NO: 562916 - RNA, 24 nt, Human
gaccucaagugauccacccgccuc

SEQ ID NO: 562917 - RNA, 18 nt, Human
gagugcaauggugcacuc

SEQ ID NO: 562918 - RNA, 20 nt, Human
gagugcaauggugcacucuc

SEQ ID NO: 562919 - RNA, 20 nt, Human
gauuacaggcaugcaccaug

SEQ ID NO: 562920 - RNA, 21 nt, Human
gauucuccugccucagccucc

SEQ ID NO: 562921 - RNA, 22 nt, Human
gcaaccucugccuccuguguuc

SEQ ID NO: 562922 - RNA, 19 nt, Human
gcccaggcuggagugcaau

SEQ ID NO: 562923 - RNA, 23 nt, Human
gccgccgccgccgccgcugccgg

SEQ ID NO: 562924 - RNA, 21 nt, Human
gccucccaagcagcugggauu

SEQ ID NO: 562925 - RNA, 21 nt, Human
gcucuuuuugcccaggcugga

SEQ ID NO: 562926 - RNA, 24 nt, Human
gcucuuuuugcccaggcuggagug

SEQ ID NO: 562927 - RNA, 23 nt, Human
gcuggucuugagcuccugaccuc

SEQ ID NO: 562928 - RNA, 21 nt, Human
ggauuacaggcaugcaccaug

SEQ ID NO: 562929 - RNA, 22 nt, Human
ggccccacgcuucaccgccacg

SEQ ID NO: 562930 - RNA, 24 nt, Human
ggcuggucuugagcuccugaccuc

SEQ ID NO: 562931 - RNA, 24 nt, Human
gguuacaggcgugagucacugugc

SEQ ID NO: 562932 - RNA, 24 nt, Human
gugauccacccgccucggccuccc

SEQ ID NO: 562933 - RNA, 24 nt, Human
gugauucuccugccucagccuccc

SEQ ID NO: 562934 - RNA, 19 nt, Human
uaaaaagaacagaugaggu

SEQ ID NO: 562935 - RNA, 20 nt, Human
uaaaaagaacagaugaggua

SEQ ID NO: 562936 - RNA, 22 nt, Human
uaaaagacaaauucuauaagga

SEQ ID NO: 562937 - RNA, 23 nt, Human
uaaagaacuugcuauaauacagg

SEQ ID NO: 562938 - RNA, 21 nt, Human
uaauacagggaagaggauaau

SEQ ID NO: 562939 - RNA, 19 nt, Human
uacugcuguaaaccacugg

SEQ ID NO: 562940 - RNA, 18 nt, Human
uaguaccuuuacugcugu

SEQ ID NO: 562941 - RNA, 24 nt, Human
uauauuggucaggcuggucuugag

SEQ ID NO: 562942 - RNA, 19 nt, Human
ucaagugauucuccugccu

SEQ ID NO: 562943 - RNA, 21 nt, Human
ucaccgccacggccgccgccg

SEQ ID NO: 562944 - RNA, 24 nt, Human
ucaccgccacggccgccgccgccu

SEQ ID NO: 562945 - RNA, 19 nt, Human
ucacugcaaccucugccuc

SEQ ID NO: 562946 - RNA, 20 nt, Human
ucacugcaaccucugccucc

SEQ ID NO: 562947 - RNA, 22 nt, Human
ucacugcaaccucugccuccug

SEQ ID NO: 562948 - RNA, 23 nt, Human
ucacugcaaccucugccuccugu

SEQ ID NO: 562949 - RNA, 27 nt, Human
ucacugcaaccucugccuccuguguuc

SEQ ID NO: 562950 - RNA, 20 nt, Human
ucagccucccaagcagcugg

SEQ ID NO: 562951 - RNA, 18 nt, Human
ucagcgcccgcagcagcc

SEQ ID NO: 562952 - RNA, 24 nt, Human
ucccaaagugcugggguuacaggc

SEQ ID NO: 562953 - RNA, 24 nt, Human
ucccaagcagcugggauuacaggc

SEQ ID NO: 562954 - RNA, 19 nt, Human
uccugugcagccgcggccg

SEQ ID NO: 562955 - RNA, 24 nt, Human
uccuguguucaagugauucuccug

SEQ ID NO: 562956 - RNA, 18 nt, Human
ucggccucccaaagugcu

SEQ ID NO: 562957 - RNA, 23 nt, Human
ucggccucccaaagugcuggggu

SEQ ID NO: 562958 - RNA, 20 nt, Human
ucuccugagacaagauggac

SEQ ID NO: 562959 - RNA, 23 nt, Human
ucuccugccucagccucccaagc

SEQ ID NO: 562960 - RNA, 23 nt, Human
ucucuacaaacagagauaaaaua

SEQ ID NO: 562961 - RNA, 20 nt, Human
ucugcuacauuggagaaagg

SEQ ID NO: 562962 - RNA, 24 nt, Human
ugaccucaagugauccacccgccu

SEQ ID NO: 562963 - RNA, 23 nt, Human
ugagacaagauggaccaagucuc

SEQ ID NO: 562964 - RNA, 24 nt, Human
ugcacucucggcucacugcaaccu

SEQ ID NO: 562965 - RNA, 18 nt, Human
ugcccaggcuggagugca

SEQ ID NO: 562966 - RNA, 21 nt, Human
ugcccaggcuggagugcaaug

SEQ ID NO: 562967 - RNA, 24 nt, Human
ugcccaggcuggagugcaauggug

SEQ ID NO: 562968 - RNA, 23 nt, Human
ugcccggcuaauucuguauuuuu

SEQ ID NO: 562969 - RNA, 18 nt, Human
ugccgcugccgcucgggg

SEQ ID NO: 562970 - RNA, 24 nt, Human
ugccucagccucccaagcagcugg

SEQ ID NO: 562971 - RNA, 22 nt, Human
ugcucuuuuugcccaggcugga

SEQ ID NO: 562972 - RNA, 24 nt, Human
ugcucuuuuugcccaggcuggagu

SEQ ID NO: 562973 - RNA, 24 nt, Human
uggagugcaauggugcacucucgg

SEQ ID NO: 562974 - RNA, 21 nt, Human
ugggauuacaggcaugcacca

SEQ ID NO: 562975 - RNA, 21 nt, Human
ugggauuacaggcaugcacca

SEQ ID NO: 562976 - RNA, 23 nt, Human
ugggauuacaggcaugcaccaug

SEQ ID NO: 562977 - RNA, 27 nt, Human
ugggauuacaggcaugcaccaugcccg

SEQ ID NO: 562978 - RNA, 18 nt, Human
ugggguuacaggcgugag

SEQ ID NO: 562979 - RNA, 22 nt, Human
ugggguuacaggcgugagucac

SEQ ID NO: 562980 - RNA, 22 nt, Human
ugggguuacaggcgugagucac

SEQ ID NO: 562981 - RNA, 24 nt, Human
ugggguuacaggcgugagucacug

SEQ ID NO: 562982 - RNA, 24 nt, Human
uggucaggcuggucuugagcuccu

SEQ ID NO: 562983 - RNA, 24 nt, Human
uguguucaagugauucuccugccu

SEQ ID NO: 562984 - RNA, 19 nt, Human
uuacaggcgugagucacug

SEQ ID NO: 562985 - RNA, 26 nt, Human
uuagaacuaucaaacguuagcucucc

SEQ ID NO: 562986 - RNA, 21 nt, Human
uucaagugauucuccugccuc

SEQ ID NO: 562987 - RNA, 23 nt, Human
uucaagugauucuccugccucag

SEQ ID NO: 562988 - RNA, 24 nt, Human
uucaagugauucuccugccucagc

SEQ ID NO: 562989 - RNA, 22 nt, Human
uucagcgcccgcagcagccgcc

SEQ ID NO: 562990 - RNA, 18 nt, Human
uugcccaggcuggagugc

SEQ ID NO: 562991 - RNA, 22 nt, Human
uugcucuuuuugcccaggcugg

SEQ ID NO: 562992 - RNA, 23 nt, Human
uugcucuuuuugcccaggcugga

SEQ ID NO: 562993 - RNA, 24 nt, Human
uuugcucuuuuugcccaggcugga

SEQ ID NO: 562994 - RNA, 24 nt, Human
uuuugcucuuuuugcccaggcugg

SEQ ID NO: 562995 - RNA, 24 nt, Human
uuuuuaguacagacaguguuucac

SEQ ID NO: 562996 - RNA, 23 nt, Human
aaaucucagcaaucccuuacucc

SEQ ID NO: 562997 - RNA, 20 nt, Human
aaccugugguuuucaucaaa

SEQ ID NO: 562998 - RNA, 23 nt, Human
aagaguauggaagagggaauuca

SEQ ID NO: 562999 - RNA, 20 nt, Human
aagcaaauauacaaggacuc

SEQ ID NO: 563000 - RNA, 18 nt, Human
aagcagacuggcgagaga

SEQ ID NO: 563001 - RNA, 18 nt, Human
aagcagacuggcgagaga

SEQ ID NO: 563002 - RNA, 25 nt, Human
aagcagacuggcgagagaaaucaaa

SEQ ID NO: 563003 - RNA, 21 nt, Human
aagccccaauccugagucugc

SEQ ID NO: 563004 - RNA, 21 nt, Human
accugagucuacauuucuaac

SEQ ID NO: 563005 - RNA, 24 nt, Human
aggaaaaagacgaugaucggaaga

SEQ ID NO: 563006 - RNA, 25 nt, Human
aggaaaauguuaaagugaacaacug

SEQ ID NO: 563007 - RNA, 25 nt, Human
aggaacacagaaaacagcaggaacu

SEQ ID NO: 563008 - RNA, 21 nt, Human
agggacaauggggaggggugg

SEQ ID NO: 563009 - RNA, 21 nt, Human
aggugaaguagaaaaagaaug

SEQ ID NO: 563010 - RNA, 23 nt, Human
auaaagcaaauauacaaggacuc

SEQ ID NO: 563011 - RNA, 18 nt, Human
auauggugugaauccaag

SEQ ID NO: 563012 - RNA, 20 nt, Human
auggaucugugguuucaggu

SEQ ID NO: 563013 - RNA, 18 nt, Human
auuuguaaucgcuucccu

SEQ ID NO: 563014 - RNA, 23 nt, Human
caaaacucaaaacaguagugagu

SEQ ID NO: 563015 - RNA, 25 nt, Human
caaaacucaaaacaguagugaguuu

SEQ ID NO: 563016 - RNA, 23 nt, Human
caaaucugauuugaagucaaaga

SEQ ID NO: 563017 - RNA, 19 nt, Human
caaccuacauaguauauca

SEQ ID NO: 563018 - RNA, 18 nt, Human
caagaaccuagagaacuu

SEQ ID NO: 563019 - RNA, 23 nt, Human
caccaucuggggaucuuguucca

SEQ ID NO: 563020 - RNA, 19 nt, Human
caguucuagcuaagaugga

SEQ ID NO: 563021 - RNA, 23 nt, Human
cauggagggugagcucagcuugc

SEQ ID NO: 563022 - RNA, 20 nt, Human
ccaggaacacagaaaacauu

SEQ ID NO: 563023 - RNA, 18 nt, Human
ccuaaacucuaaaagaga

SEQ ID NO: 563024 - RNA, 27 nt, Human
ccugcaacugguggaaaaccggggucc

SEQ ID NO: 563025 - RNA, 22 nt, Human
cgagagaaaucaaaacucaaaa

SEQ ID NO: 563026 - RNA, 19 nt, Human
cucuaagacagugguccuc

SEQ ID NO: 563027 - RNA, 19 nt, Human
cugguaauuuuucuucucu

SEQ ID NO: 563028 - RNA, 21 nt, Human
cugugcguaggcaccaucugg

SEQ ID NO: 563029 - RNA, 18 nt, Human
cuuagacuugaggacagc

SEQ ID NO: 563030 - RNA, 18 nt, Human
gaacuagaaaagaugaug

SEQ ID NO: 563031 - RNA, 24 nt, Human
gaagaguauggaagagggaauuca

SEQ ID NO: 563032 - RNA, 19 nt, Human
gacaaaagaacuaggaaaa

SEQ ID NO: 563033 - RNA, 24 nt, Human
gacagagaaaaguuccaagagaaa

SEQ ID NO: 563034 - RNA, 19 nt, Human
gagucugcacaccuguggc

SEQ ID NO: 563035 - RNA, 18 nt, Human
gauccuacuccugaaaga

SEQ ID NO: 563036 - RNA, 19 nt, Human
gaugaugaaugggagaggg

SEQ ID NO: 563037 - RNA, 18 nt, Human
gccacaaagcugagcugg

SEQ ID NO: 563038 - RNA, 23 nt, Human
gccucaaagcaagccccaauccu

SEQ ID NO: 563039 - RNA, 22 nt, Human
ggacaccaugguagagcugcug

SEQ ID NO: 563040 - RNA, 20 nt, Human
ggagagggacaauggggagg

SEQ ID NO: 563041 - RNA, 21 nt, Human
ggagagggacaauggggaggg

SEQ ID NO: 563042 - RNA, 18 nt, Human
gggaaucccugcaacugg

SEQ ID NO: 563043 - RNA, 21 nt, Human
gggagagggacaauggggagg

SEQ ID NO: 563044 - RNA, 24 nt, Human
gggagagggacaauggggaggggu

SEQ ID NO: 563045 - RNA, 19 nt, Human
gggagggguggauaucugg

SEQ ID NO: 563046 - RNA, 20 nt, Human
gguagagcugcuguuacaga

SEQ ID NO: 563047 - RNA, 21 nt, Human
ggugugaauccaagccacaaa

SEQ ID NO: 563048 - RNA, 23 nt, Human
uaaaagggagcagcauuguggca

SEQ ID NO: 563049 - RNA, 19 nt, Human
uaaagcaaauauacaagga

SEQ ID NO: 563050 - RNA, 20 nt, Human
uaaagcaaauauacaaggac

SEQ ID NO: 563051 - RNA, 19 nt, Human
uaagacagugguccucaac

SEQ ID NO: 563052 - RNA, 21 nt, Human
uaagacagugguccucaacau

SEQ ID NO: 563053 - RNA, 20 nt, Human
uaaucgcuucccuggugucu

SEQ ID NO: 563054 - RNA, 22 nt, Human
uagcuaagauggagaaagcaca

SEQ ID NO: 563055 - RNA, 20 nt, Human
uauacaaggacucugaaaag

SEQ ID NO: 563056 - RNA, 24 nt, Human
uauacaucuaucaagacuaguuug

SEQ ID NO: 563057 - RNA, 23 nt, Human
uauauacacgucauuugcuuuua

SEQ ID NO: 563058 - RNA, 18 nt, Human
uaucuggagauacaaccu

SEQ ID NO: 563059 - RNA, 24 nt, Human
uauuacuaaaaauccuggaaagaa

SEQ ID NO: 563060 - RNA, 20 nt, Human
uauuuauauuuuacgagugg

SEQ ID NO: 563061 - RNA, 18 nt, Human
ucaauagcaacaaaucug

SEQ ID NO: 563062 - RNA, 20 nt, Human
ucagcaaucccuuacucccu

SEQ ID NO: 563063 - RNA, 18 nt, Human
uccugagucugcacaccu

SEQ ID NO: 563064 - RNA, 21 nt, Human
uccuucuggcuagagaacuag

SEQ ID NO: 563065 - RNA, 20 nt, Human
ucuucugacaaaagaacuag

SEQ ID NO: 563066 - RNA, 19 nt, Human
ugaacaaaggaaugaaugu

SEQ ID NO: 563067 - RNA, 20 nt, Human
ugaagacagagaaaaguucc

SEQ ID NO: 563068 - RNA, 27 nt, Human
ugacaaaagaacuaggaaaaagacgau

SEQ ID NO: 563069 - RNA, 23 nt, Human
ugagacagaguuuugcccuuguu

SEQ ID NO: 563070 - RNA, 19 nt, Human
ugaucggaagaguauggaa

SEQ ID NO: 563071 - RNA, 23 nt, Human
ugcuuuuacgcaauccucuaaga

SEQ ID NO: 563072 - RNA, 18 nt, Human
uggcugguagcugucucc

SEQ ID NO: 563073 - RNA, 22 nt, Human
ugggagagggacaauggggagg

SEQ ID NO: 563074 - RNA, 23 nt, Human
ugggagagggacaauggggaggg

SEQ ID NO: 563075 - RNA, 26 nt, Human
uggggaucuuguuccaauucagcagg

SEQ ID NO: 563076 - RNA, 23 nt, Human
ugguaauuuuucuucucucucag

SEQ ID NO: 563077 - RNA, 19 nt, Human
uguauaaacauguacaagg

SEQ ID NO: 563078 - RNA, 18 nt, Human
ugugaauccaagccacaa

SEQ ID NO: 563079 - RNA, 22 nt, Human
uguguguucugaacaaaggaau

SEQ ID NO: 563080 - RNA, 20 nt, Human
uuaauuaucuggagauacaa

SEQ ID NO: 563081 - RNA, 24 nt, Human
uuacugugcguaggcaccaucugg

SEQ ID NO: 563082 - RNA, 23 nt, Human
uucucccacauaugucagcuuag

SEQ ID NO: 563083 - RNA, 21 nt, Human
uucuucucucucagcucugcc

SEQ ID NO: 563084 - RNA, 26 nt, Human
uuuguaaucgcuucccuggugucucu

SEQ ID NO: 563085 - RNA, 18 nt, Human
uuuugcccuuguugccca

SEQ ID NO: 563086 - RNA, 21 nt, Human
uuuuguucuugauaguagggg

SEQ ID NO: 563087 - RNA, 21 nt, Human
uuuuucuucucucucagcucu

SEQ ID NO: 563088 - RNA, 21 nt, Human
aaaagucauaucuuuuauucu

SEQ ID NO: 563089 - RNA, 19 nt, Human
aaguaggguguauugacgc

SEQ ID NO: 563090 - RNA, 21 nt, Human
accagguuacgcuaaccucaa

SEQ ID NO: 563091 - RNA, 21 nt, Human
accaguuucaucaaacuguca

SEQ ID NO: 563092 - RNA, 22 nt, Human
agaaauagauuuuagcaauauc

SEQ ID NO: 563093 - RNA, 22 nt, Human
agcagcuuccacagcuggccca

SEQ ID NO: 563094 - RNA, 19 nt, Human
aggaagaacaaaaguaugg

SEQ ID NO: 563095 - RNA, 24 nt, Human
aggaagaacaaaaguauggcaaaa

SEQ ID NO: 563096 - RNA, 22 nt, Human
aggggaagagagaaaugcguag

SEQ ID NO: 563097 - RNA, 18 nt, Human
auaaagacagcccgugga

SEQ ID NO: 563098 - RNA, 19 nt, Human
caaaguacaaguagggugu

SEQ ID NO: 563099 - RNA, 21 nt, Human
cagcagguccugaauuguucc

SEQ ID NO: 563100 - RNA, 18 nt, Human
caucaccaggggggcucu

SEQ ID NO: 563101 - RNA, 20 nt, Human
ccagcagguccugaauuguu

SEQ ID NO: 563102 - RNA, 19 nt, Human
ccccacauuccuuuuccag

SEQ ID NO: 563103 - RNA, 21 nt, Human
cuagaguccugcaaacucaac

SEQ ID NO: 563104 - RNA, 22 nt, Human
cuagaguccugcaaacucaacc

SEQ ID NO: 563105 - RNA, 24 nt, Human
cuagaguccugcaaacucaaccaa

SEQ ID NO: 563106 - RNA, 22 nt, Human
cuuccacagcuggcccagagga

SEQ ID NO: 563107 - RNA, 21 nt, Human
gaagaggaaucaaagcucagg

SEQ ID NO: 563108 - RNA, 22 nt, Human
ggaagaacaaaaguauggcaaa

SEQ ID NO: 563109 - RNA, 25 nt, Human
ggauucuucacaagugcagcagcuu

SEQ ID NO: 563110 - RNA, 19 nt, Human
ggcaucaccaggggggcuc

SEQ ID NO: 563111 - RNA, 20 nt, Human
gggcucuuucaugcaugccu

SEQ ID NO: 563112 - RNA, 20 nt, Human
uagaguccugcaaacucaac

SEQ ID NO: 563113 - RNA, 22 nt, Human
uaggaagaacaaaaguauggca

SEQ ID NO: 563114 - RNA, 26 nt, Human
ucaccaggggggcucuuucaugcaug

SEQ ID NO: 563115 - RNA, 21 nt, Human
ucccaggugcccaagauucca

SEQ ID NO: 563116 - RNA, 18 nt, Human
ugagggaggggaagagag

SEQ ID NO: 563117 - RNA, 24 nt, Human
ugagggaggggaagagagaaaugc

SEQ ID NO: 563118 - RNA, 22 nt, Human
uggauaaaaccucagcugcaga

SEQ ID NO: 563119 - RNA, 22 nt, Human
ugggaacaaauacugugacaac

SEQ ID NO: 563120 - RNA, 20 nt, Human
ugggauguaaauguaaccag

SEQ ID NO: 563121 - RNA, 22 nt, Human
uuccagcagguccugaauuguu

SEQ ID NO: 563122 - RNA, 23 nt, Human
uucccaggugcccaagauuccau

SEQ ID NO: 563123 - RNA, 23 nt, Human
uuuaguguuuucaucaaacaagg

SEQ ID NO: 563124 - RNA, 20 nt, Human
aacacaaucuuuuccugucu

SEQ ID NO: 563125 - RNA, 19 nt, Human
aaggauagaaaauugaugg

SEQ ID NO: 563126 - RNA, 20 nt, Human
agauguguucggacuucacu

SEQ ID NO: 563127 - RNA, 24 nt, Human
aucccauuucucucacuauggcag

SEQ ID NO: 563128 - RNA, 22 nt, Human
caaaaacagaagucauguuauc

SEQ ID NO: 563129 - RNA, 22 nt, Human
caacagcaccggcgacuuccaa

SEQ ID NO: 563130 - RNA, 24 nt, Human
caacagcaccggcgacuuccaaag

SEQ ID NO: 563131 - RNA, 19 nt, Human
caacugugaacuucacacu

SEQ ID NO: 563132 - RNA, 23 nt, Human
cacauacaugaauuaagcaaagc

SEQ ID NO: 563133 - RNA, 18 nt, Human
cacaugagacuaaaauaa

SEQ ID NO: 563134 - RNA, 23 nt, Human
cacucugucagaaaauccucacc

SEQ ID NO: 563135 - RNA, 24 nt, Human
cacugcacacauacaugaauuaag

SEQ ID NO: 563136 - RNA, 24 nt, Human
cagaaaauccucaccaagaagcca

SEQ ID NO: 563137 - RNA, 28 nt, Human
cauugcagcacugcacacauacagugug

SEQ ID NO: 563138 - RNA, 22 nt, Human
cugaugcgaugguaggucuuuu

SEQ ID NO: 563139 - RNA, 24 nt, Human
cuggugauaacaacgaugagguuu

SEQ ID NO: 563140 - RNA, 24 nt, Human
gaaauugacaagccuuucaaacaa

SEQ ID NO: 563141 - RNA, 23 nt, Human
gauuuuugcuucaaaaacagaag

SEQ ID NO: 563142 - RNA, 18 nt, Human
ggaugauauaaaacacaa

SEQ ID NO: 563143 - RNA, 27 nt, Human
gugauaacaacgaugagguuuauuuuu

SEQ ID NO: 563144 - RNA, 25 nt, Human
uacaacagcaccggcgacuuccaaa

SEQ ID NO: 563145 - RNA, 22 nt, Human
uagcaccaugaauugugaugaa

SEQ ID NO: 563146 - RNA, 21 nt, Human
uaugaaauugacaagccuuuc

SEQ ID NO: 563147 - RNA, 23 nt, Human
ucacacuacauugucuaaggaua

SEQ ID NO: 563148 - RNA, 22 nt, Human
uccauuuuagaaacuggugggu

SEQ ID NO: 563149 - RNA, 20 nt, Human
uggcaggacuguaugcagua

SEQ ID NO: 563150 - RNA, 26 nt, Human
uggguaucacucugucagaaaauccu

SEQ ID NO: 563151 - RNA, 21 nt, Human
uggguuacaauagauagggau

SEQ ID NO: 563152 - RNA, 22 nt, Human
uggugggugugcucacguuugu

SEQ ID NO: 563153 - RNA, 22 nt, Human
ugucagaaaauccucaccaaga

SEQ ID NO: 563154 - RNA, 24 nt, Human
uguuugucaacugugaacuucaca

SEQ ID NO: 563155 - RNA, 21 nt, Human
uucaaggaauaugaaauugac

SEQ ID NO: 563156 - RNA, 23 nt, Human
uuuucauuuuagcaccaugaauu

SEQ ID NO: 563157 - RNA, 22 nt, Human
aaaacccaauuauccaacauca

SEQ ID NO: 563158 - RNA, 22 nt, Human
aaaugaaauaggagcccgagau

SEQ ID NO: 563159 - RNA, 21 nt, Human
aacaaagaacuggacaaacac

SEQ ID NO: 563160 - RNA, 25 nt, Human
aacacacaaacaaagcaaggaaaga

SEQ ID NO: 563161 - RNA, 24 nt, Human
aacuacagacagaguaaauaauac

SEQ ID NO: 563162 - RNA, 21 nt, Human
aacuggacaaacacacaaaca

SEQ ID NO: 563163 - RNA, 22 nt, Human
aagauuauuuagggagaaguga

SEQ ID NO: 563164 - RNA, 18 nt, Human
aagcaacaaaagcagaga

SEQ ID NO: 563165 - RNA, 23 nt, Human
aagcaacaaaagcagagauuuau

SEQ ID NO: 563166 - RNA, 22 nt, Human
aaugaagcaacaaaagcagaga

SEQ ID NO: 563167 - RNA, 19 nt, Human
acaaagcaaggaaagaaug

SEQ ID NO: 563168 - RNA, 20 nt, Human
acaaagcaaggaaagaauga

SEQ ID NO: 563169 - RNA, 23 nt, Human
acaaagcaaggaaagaaugaagc

SEQ ID NO: 563170 - RNA, 24 nt, Human
agaaauucuuuucuccugguuggc

SEQ ID NO: 563171 - RNA, 19 nt, Human
agaagugaaaauagacaaa

SEQ ID NO: 563172 - RNA, 21 nt, Human
agacaaaacccaauuauccaa

SEQ ID NO: 563173 - RNA, 22 nt, Human
agcccgagaucagucugaaugg

SEQ ID NO: 563174 - RNA, 21 nt, Human
cacaaacaaagcaaggaaaga

SEQ ID NO: 563175 - RNA, 19 nt, Human
cacuccacagggugggagc

SEQ ID NO: 563176 - RNA, 23 nt, Human
cagggugggagcaggcccgagga

SEQ ID NO: 563177 - RNA, 22 nt, Human
cccaauuauccaacaucacauc

SEQ ID NO: 563178 - RNA, 23 nt, Human
cucaguagcccaguccauuuucc

SEQ ID NO: 563179 - RNA, 27 nt, Human
uagacaaaacccaauuauccaacauca

SEQ ID NO: 563180 - RNA, 19 nt, Human
uauuuucacagaauuagag

SEQ ID NO: 563181 - RNA, 27 nt, Human
ugaaaaauaucucaguagcccagucca

SEQ ID NO: 563182 - RNA, 21 nt, Human
ugaacaaagaacuggacaaac

SEQ ID NO: 563183 - RNA, 20 nt, Human
ugcacacaauguaaaugaaa

SEQ ID NO: 563184 - RNA, 20 nt, Human
ugcacuccacagggugggag

SEQ ID NO: 563185 - RNA, 22 nt, Human
uggacaaacacacaaacaaagc

SEQ ID NO: 563186 - RNA, 22 nt, Human
uuaacaaauuaauuuuccuaau

SEQ ID NO: 563187 - RNA, 19 nt, Human
uuucccacugguuacuugg

SEQ ID NO: 563188 - RNA, 22 nt, Human
uuuuccuaauaucccucaaaca

SEQ ID NO: 563189 - RNA, 18 nt, Human
uuuuuuuucaagcaugga

SEQ ID NO: 563190 - RNA, 18 nt, Human
aaaauguccuaucagaaa

SEQ ID NO: 563191 - RNA, 26 nt, Human
aaacccugacaccaucuguggaaaug

SEQ ID NO: 563192 - RNA, 18 nt, Human
aaagcaccugccuuugcu

SEQ ID NO: 563193 - RNA, 21 nt, Human
agaaagaagaaaggaaaaugu

SEQ ID NO: 563194 - RNA, 18 nt, Human
agagggugcccaucgguc

SEQ ID NO: 563195 - RNA, 23 nt, Human
caaaaacaagggaaagaaaacaa

SEQ ID NO: 563196 - RNA, 18 nt, Human
caaagcaccugccuuugc

SEQ ID NO: 563197 - RNA, 24 nt, Human
caacugauggaaggaaaaggcgau

SEQ ID NO: 563198 - RNA, 24 nt, Human
caagggaaagaaaacagaaagaag

SEQ ID NO: 563199 - RNA, 23 nt, Human
caccaucuguggaaaugcuuccg

SEQ ID NO: 563200 - RNA, 22 nt, Human
caccucuguccccuucuagcuu

SEQ ID NO: 563201 - RNA, 23 nt, Human
cacucauaucauuuaugagacuu

SEQ ID NO: 563202 - RNA, 21 nt, Human
caguggggagccugcugggga

SEQ ID NO: 563203 - RNA, 18 nt, Human
caucgcaccagcuuuugc

SEQ ID NO: 563204 - RNA, 23 nt, Human
cccccuguguggcucagggauug

SEQ ID NO: 563205 - RNA, 21 nt, Human
ccccuggaagcccuaagacuu

SEQ ID NO: 563206 - RNA, 20 nt, Human
ccuccaccuuugagcuacag

SEQ ID NO: 563207 - RNA, 22 nt, Human
ccucuguccccuucuagcuuuc

SEQ ID NO: 563208 - RNA, 22 nt, Human
ccuggccuuugcuaaaaugaug

SEQ ID NO: 563209 - RNA, 18 nt, Human
cggaaucaaucauuauuc

SEQ ID NO: 563210 - RNA, 19 nt, Human
cuaagacuucuugaaaccc

SEQ ID NO: 563211 - RNA, 23 nt, Human
cuucuugaaacccugacaccauc

SEQ ID NO: 563212 - RNA, 23 nt, Human
gaaaacccaggacccaccgggcc

SEQ ID NO: 563213 - RNA, 22 nt, Human
gaacaacucugaggucggcuug

SEQ ID NO: 563214 - RNA, 20 nt, Human
gacaccaucuguggaaaugc

SEQ ID NO: 563215 - RNA, 22 nt, Human
gaggucggcuuggugugauggg

SEQ ID NO: 563216 - RNA, 18 nt, Human
gugguccuccauguuugc

SEQ ID NO: 563217 - RNA, 19 nt, Human
uaacugggaugcucccacg

SEQ ID NO: 563218 - RNA, 28 nt, Human
uauaauugauauuugaaaaaaaaacccc

SEQ ID NO: 563219 - RNA, 18 nt, Human
uauucuaaagcuuccagg

SEQ ID NO: 563220 - RNA, 21 nt, Human
ucagaaagugguccuccaugu

SEQ ID NO: 563221 - RNA, 21 nt, Human
ucagggacaccucuguccccu

SEQ ID NO: 563222 - RNA, 20 nt, Human
ucagggaugaggcacuucuc

SEQ ID NO: 563223 - RNA, 18 nt, Human
ucccauaaggaagaugaa

SEQ ID NO: 563224 - RNA, 21 nt, Human
ucucuuggugcuugagaaauu

SEQ ID NO: 563225 - RNA, 20 nt, Human
ucuguccccuucuagcuuuc

SEQ ID NO: 563226 - RNA, 24 nt, Human
ucuguggaaaugcuuccgaggucc

SEQ ID NO: 563227 - RNA, 22 nt, Human
ucuugaaacccugacaccaucu

SEQ ID NO: 563228 - RNA, 20 nt, Human
ugaaaaaaaaacccauaaau

SEQ ID NO: 563229 - RNA, 18 nt, Human
ugaaacagguaggugaca

SEQ ID NO: 563230 - RNA, 23 nt, Human
ugaaacagguaggugacaccuuu

SEQ ID NO: 563231 - RNA, 18 nt, Human
ugaacaacucugaggucg

SEQ ID NO: 563232 - RNA, 19 nt, Human
ugcagaaaacccaggaccc

SEQ ID NO: 563233 - RNA, 20 nt, Human
ugcagaaaacccaggaccca

SEQ ID NO: 563234 - RNA, 23 nt, Human
ugcagaaaacccaggacccaccg

SEQ ID NO: 563235 - RNA, 18 nt, Human
uggaaggaaaaggcgaug

SEQ ID NO: 563236 - RNA, 22 nt, Human
ugggagagggugcccaucgguc

SEQ ID NO: 563237 - RNA, 20 nt, Human
ugggaugcucccacgccccc

SEQ ID NO: 563238 - RNA, 25 nt, Human
ugguaguaacaguauuuuaaauucc

SEQ ID NO: 563239 - RNA, 21 nt, Human
uuauuucuauuuuuccuccug

SEQ ID NO: 563240 - RNA, 18 nt, Human
uuccauuuucccugaagc

SEQ ID NO: 563241 - RNA, 21 nt, Human
uuggugcuugagaaauuucag

SEQ ID NO: 563242 - RNA, 21 nt, Human
uuugcagaaaacccaggaccc

SEQ ID NO: 563243 - RNA, 26 nt, Human
uuuuccuccuggccuuugcuaaaaug

SEQ ID NO: 563244 - RNA, 24 nt, Human
aaacaaccaaaagguuaauuaaac

SEQ ID NO: 563245 - RNA, 23 nt, Human
aaacacaggcucuucuggugagg

SEQ ID NO: 563246 - RNA, 21 nt, Human
aagaaauaauuacaaagagaa

SEQ ID NO: 563247 - RNA, 22 nt, Human
aaggaaggaggugggucagggu

SEQ ID NO: 563248 - RNA, 27 nt, Human
acagcugggcuaaggacuugggugcau

SEQ ID NO: 563249 - RNA, 23 nt, Human
accaaaauguguucacugucccu

SEQ ID NO: 563250 - RNA, 21 nt, Human
accaggcucuccagagauucc

SEQ ID NO: 563251 - RNA, 20 nt, Human
aggaacaguggguguucagc

SEQ ID NO: 563252 - RNA, 19 nt, Human
aggaaggaggugggucagg

SEQ ID NO: 563253 - RNA, 18 nt, Human
aggauagguuuccucucc

SEQ ID NO: 563254 - RNA, 20 nt, Human
aggcccaagagggccagcag

SEQ ID NO: 563255 - RNA, 24 nt, Human
aggcgagagaugccaugggugggg

SEQ ID NO: 563256 - RNA, 21 nt, Human
agggccagcagggagccacca

SEQ ID NO: 563257 - RNA, 24 nt, Human
aggggaguugagguggguagcugg

SEQ ID NO: 563258 - RNA, 22 nt, Human
aguucuuuuuucuuucuuuuuu

SEQ ID NO: 563259 - RNA, 21 nt, Human
aucccuuucacucauugguga

SEQ ID NO: 563260 - RNA, 23 nt, Human
auucucuccaucccacccccuca

SEQ ID NO: 563261 - RNA, 26 nt, Human
auucucuccaucccacccccucacug

SEQ ID NO: 563262 - RNA, 18 nt, Human
caagagaggcaaauuucc

SEQ ID NO: 563263 - RNA, 22 nt, Human
caagagcgaacuccugcaggug

SEQ ID NO: 563264 - RNA, 23 nt, Human
caaguucacccccaggauagccc

SEQ ID NO: 563265 - RNA, 21 nt, Human
cacccccucacugaagguuug

SEQ ID NO: 563266 - RNA, 19 nt, Human
cagaagggcugaggcggag

SEQ ID NO: 563267 - RNA, 21 nt, Human
cagagauuccugcagccccuc

SEQ ID NO: 563268 - RNA, 18 nt, Human
cagcagaaaaacacaggc

SEQ ID NO: 563269 - RNA, 22 nt, Human
cagcuuuaccagaguggagggu

SEQ ID NO: 563270 - RNA, 25 nt, Human
caggaacaguggguguucagcagaa

SEQ ID NO: 563271 - RNA, 19 nt, Human
caggcucuccagagauucc

SEQ ID NO: 563272 - RNA, 20 nt, Human
cagggcugggcugagacgag

SEQ ID NO: 563273 - RNA, 18 nt, Human
caucgugaagcaccaggc

SEQ ID NO: 563274 - RNA, 23 nt, Human
ccaaaauguguucacugucccug

SEQ ID NO: 563275 - RNA, 22 nt, Human
ccacugggauaggaaccaaaau

SEQ ID NO: 563276 - RNA, 19 nt, Human
ccagaagcagaagggcuga

SEQ ID NO: 563277 - RNA, 20 nt, Human
cccacgaucccuuucacucu

SEQ ID NO: 563278 - RNA, 21 nt, Human
ccccagaggugcagcuuuacc

SEQ ID NO: 563279 - RNA, 28 nt, Human
ccccucacugaagguuugaaguggaagu

SEQ ID NO: 563280 - RNA, 30 nt, Human
ccccucauucccccagaggugcagcuuuaa

SEQ ID NO: 563281 - RNA, 24 nt, Human
ccucuuacccacugggauaggaac

SEQ ID NO: 563282 - RNA, 19 nt, Human
ccugcuuauguauggacag

SEQ ID NO: 563283 - RNA, 18 nt, Human
cuccaucccacccccuca

SEQ ID NO: 563284 - RNA, 20 nt, Human
cuccaucccacccccucacu

SEQ ID NO: 563285 - RNA, 19 nt, Human
cuuuucccagcuacaaaau

SEQ ID NO: 563286 - RNA, 18 nt, Human
cuuuuuuucuuuuuuucc

SEQ ID NO: 563287 - RNA, 22 nt, Human
cuuuuuuucuuuuuuuccuuuu

SEQ ID NO: 563288 - RNA, 19 nt, Human
gaacuccugcagguggcac

SEQ ID NO: 563289 - RNA, 20 nt, Human
gacagaccagcgugggcugg

SEQ ID NO: 563290 - RNA, 21 nt, Human
gauagcccuuccagaagcaga

SEQ ID NO: 563291 - RNA, 22 nt, Human
gccaugggugggggagcugcuc

SEQ ID NO: 563292 - RNA, 23 nt, Human
ggaacaguggguguucagcagaa

SEQ ID NO: 563293 - RNA, 19 nt, Human
gggaaggcauggggacaga

SEQ ID NO: 563294 - RNA, 20 nt, Human
gggaaggcauggggacagac

SEQ ID NO: 563295 - RNA, 25 nt, Human
guucuuuuuucuuucuuuuuuaauu

SEQ ID NO: 563296 - RNA, 21 nt, Human
guuggcacaagucagaguuuc

SEQ ID NO: 563297 - RNA, 19 nt, Human
uaagugccucuuacccacu

SEQ ID NO: 563298 - RNA, 19 nt, Human
uacaaagagaaaaacccca

SEQ ID NO: 563299 - RNA, 20 nt, Human
uacaaagagaaaaaccccau

SEQ ID NO: 563300 - RNA, 19 nt, Human
uacaagaaucaccagagca

SEQ ID NO: 563301 - RNA, 20 nt, Human
uacaagaaucaccagagcag

SEQ ID NO: 563302 - RNA, 19 nt, Human
ucagcagaaaaacacaggc

SEQ ID NO: 563303 - RNA, 20 nt, Human
uccagggcugggcugagacc

SEQ ID NO: 563304 - RNA, 24 nt, Human
uccagggcugggcugagacgagcg

SEQ ID NO: 563305 - RNA, 20 nt, Human
ucccaagagaggcaaauuuc

SEQ ID NO: 563306 - RNA, 27 nt, Human
ucccacccccucacugaaaggucggac

SEQ ID NO: 563307 - RNA, 18 nt, Human
ucccagagauaagugccu

SEQ ID NO: 563308 - RNA, 24 nt, Human
ucccagagauaagugccucuuacc

SEQ ID NO: 563309 - RNA, 18 nt, Human
ucccuucuuggggagggg

SEQ ID NO: 563310 - RNA, 24 nt, Human
ucucuccaucccacccccucacug

SEQ ID NO: 563311 - RNA, 20 nt, Human
ucucucggugucccugaccc

SEQ ID NO: 563312 - RNA, 20 nt, Human
ucucuggauucugaacccca

SEQ ID NO: 563313 - RNA, 21 nt, Human
ucucuggauucugaaccccaa

SEQ ID NO: 563314 - RNA, 21 nt, Human
ugaagcaccaggcucuccaga

SEQ ID NO: 563315 - RNA, 24 nt, Human
ugaagcaccaggcucuccagagau

SEQ ID NO: 563316 - RNA, 21 nt, Human
ugagagcacaaaggcuggguc

SEQ ID NO: 563317 - RNA, 23 nt, Human
ugagguggguagcugguuggaca

SEQ ID NO: 563318 - RNA, 23 nt, Human
ugcacaaacaaccaaaagguuaa

SEQ ID NO: 563319 - RNA, 18 nt, Human
ugcaucugacaugaagaa

SEQ ID NO: 563320 - RNA, 21 nt, Human
uggauucugaaccccaaagga

SEQ ID NO: 563321 - RNA, 19 nt, Human
uggcacagcugggcuaagg

SEQ ID NO: 563322 - RNA, 18 nt, Human
uggcagaggagauuuggg

SEQ ID NO: 563323 - RNA, 19 nt, Human
uggcauggcccucccugcc

SEQ ID NO: 563324 - RNA, 20 nt, Human
uggcauggcccucccugccu

SEQ ID NO: 563325 - RNA, 23 nt, Human
uggcauggcccucccugccugcu

SEQ ID NO: 563326 - RNA, 23 nt, Human
ugggauaggaaccaaaauguguu

SEQ ID NO: 563327 - RNA, 23 nt, Human
ugggucauccuauuguuggcaca

SEQ ID NO: 563328 - RNA, 22 nt, Human
uggucucuggauucugaacccc

SEQ ID NO: 563329 - RNA, 24 nt, Human
uguauggacagaguauguugucuc

SEQ ID NO: 563330 - RNA, 23 nt, Human
uuacaaagagaaaaaccccaucc

SEQ ID NO: 563331 - RNA, 19 nt, Human
uucacugucccuguuuagc

SEQ ID NO: 563332 - RNA, 24 nt, Human
uucacugucccuguuuagccaagg

SEQ ID NO: 563333 - RNA, 20 nt, Human
uucagcauucucuccauccc

SEQ ID NO: 563334 - RNA, 20 nt, Human
uuccaggaauggaaaaugcc

SEQ ID NO: 563335 - RNA, 24 nt, Human
uucccaggugugagcagaggccca

SEQ ID NO: 563336 - RNA, 20 nt, Human
uuccugcagccccucauucc

SEQ ID NO: 563337 - RNA, 21 nt, Human
uucucagucuuccagggcugg

SEQ ID NO: 563338 - RNA, 24 nt, Human
uucuuuuuucuuucuuuuuuaauu

SEQ ID NO: 563339 - RNA, 20 nt, Human
uugagguggguagcugguug

SEQ ID NO: 563340 - RNA, 24 nt, Human
uuucccagcuacaaaauacucugg

SEQ ID NO: 563341 - RNA, 22 nt, Human
uuuuuuucuuuuuuuccuuuuu

SEQ ID NO: 563342 - RNA, 24 nt, Human
aaaacuacaaaagccagcacacua

SEQ ID NO: 563343 - RNA, 20 nt, Human
aaaccaaauauaaaugcuga

SEQ ID NO: 563344 - RNA, 19 nt, Human
aaagggaauaaaugaggau

SEQ ID NO: 563345 - RNA, 23 nt, Human
aaugacaauuacucuaauacaug

SEQ ID NO: 563346 - RNA, 23 nt, Human
acaaaauguaugcgccacuaccc

SEQ ID NO: 563347 - RNA, 19 nt, Human
acaaaccaaauauaaaugg

SEQ ID NO: 563348 - RNA, 21 nt, Human
augaaagacuaauuuucuaca

SEQ ID NO: 563349 - RNA, 24 nt, Human
auguacacuuaagucauuaguagu

SEQ ID NO: 563350 - RNA, 19 nt, Human
auguuuucgcaacauuuuu

SEQ ID NO: 563351 - RNA, 26 nt, Human
caauaaguaucuugagcuugaggccc

SEQ ID NO: 563352 - RNA, 25 nt, Human
cagauucuucacagaagaaaacaau

SEQ ID NO: 563353 - RNA, 20 nt, Human
gauaacaaaauguaugcgcc

SEQ ID NO: 563354 - RNA, 19 nt, Human
gcccuggcuaaguauuccu

SEQ ID NO: 563355 - RNA, 23 nt, Human
gcccuggcuaaguauuccuuuug

SEQ ID NO: 563356 - RNA, 20 nt, Human
ggaagagguaaacugugaca

SEQ ID NO: 563357 - RNA, 18 nt, Human
ggaugcguauagucagau

SEQ ID NO: 563358 - RNA, 19 nt, Human
uacaguacauagcaacaga

SEQ ID NO: 563359 - RNA, 23 nt, Human
uacauagcaacagauucuucaca

SEQ ID NO: 563360 - RNA, 25 nt, Human
uagagguuuucuuucuaugauuagc

SEQ ID NO: 563361 - RNA, 23 nt, Human
uagcuaugaaacaaaccaaauau

SEQ ID NO: 563362 - RNA, 25 nt, Human
uauacaguacauagcaacagauucu

SEQ ID NO: 563363 - RNA, 25 nt, Human
uaugcgccacuacccauguuuucgc

SEQ ID NO: 563364 - RNA, 20 nt, Human
ucaaaacuacaaaagccagc

SEQ ID NO: 563365 - RNA, 19 nt, Human
uccucagucugagagucug

SEQ ID NO: 563366 - RNA, 19 nt, Human
ugacauaguuccccugugc

SEQ ID NO: 563367 - RNA, 21 nt, Human
ugccuucacugguaauggcuu

SEQ ID NO: 563368 - RNA, 21 nt, Human
ugugcugcugauucuuuuggg

SEQ ID NO: 563369 - RNA, 21 nt, Human
uuugauaaacucauccgugcc

SEQ ID NO: 563370 - RNA, 21 nt, Human
aaaaauguccacauauaaguc

SEQ ID NO: 563371 - RNA, 21 nt, Human
aaaauguccacauauaaguca

SEQ ID NO: 563372 - RNA, 23 nt, Human
aaacaaaauagggauaagaugca

SEQ ID NO: 563373 - RNA, 18 nt, Human
aaaugaccugauaaaaga

SEQ ID NO: 563374 - RNA, 21 nt, Human
aacuacuuuaccaaucuccau

SEQ ID NO: 563375 - RNA, 23 nt, Human
aaucacuaccucuugaacuuaag

SEQ ID NO: 563376 - RNA, 22 nt, Human
acauggguaacuaacuuaaaca

SEQ ID NO: 563377 - RNA, 25 nt, Human
acuaccacuacuauuacuaguuaau

SEQ ID NO: 563378 - RNA, 24 nt, Human
agaaaccagucaugaguuaaauaa

SEQ ID NO: 563379 - RNA, 26 nt, Human
aggcagaaacaaaauagggauaaggu

SEQ ID NO: 563380 - RNA, 19 nt, Human
agggauaagaugcagaaga

SEQ ID NO: 563381 - RNA, 21 nt, Human
agguuuuugguuucauuaucu

SEQ ID NO: 563382 - RNA, 30 nt, Human
auaaauuuccaaaauuaauacaaacagaag

SEQ ID NO: 563383 - RNA, 24 nt, Human
auaugagacuaaagucaggaauuu

SEQ ID NO: 563384 - RNA, 21 nt, Human
caaaauagggauaagaugcag

SEQ ID NO: 563385 - RNA, 23 nt, Human
caaaucauauaaucauagaacua

SEQ ID NO: 563386 - RNA, 25 nt, Human
caaauucucagauuggcccuuguua

SEQ ID NO: 563387 - RNA, 23 nt, Human
caagauauaugagacuaaaguca

SEQ ID NO: 563388 - RNA, 22 nt, Human
cacaacaaccuugugagguagg

SEQ ID NO: 563389 - RNA, 19 nt, Human
cacagcauuuuuuaaaguu

SEQ ID NO: 563390 - RNA, 23 nt, Human
cauccccauuuuaaaaggaggaa

SEQ ID NO: 563391 - RNA, 18 nt, Human
cccaaacagaagagaaca

SEQ ID NO: 563392 - RNA, 21 nt, Human
cccuucuaaagaggauuacuu

SEQ ID NO: 563393 - RNA, 18 nt, Human
cuaaaauuaguaauucug

SEQ ID NO: 563394 - RNA, 22 nt, Human
cucauuugaugcucacaacaac

SEQ ID NO: 563395 - RNA, 26 nt, Human
uaaaaaauauuaaauaaaaucaaagg

SEQ ID NO: 563396 - RNA, 22 nt, Human
uaaguaucuuuuuggaaguucu

SEQ ID NO: 563397 - RNA, 20 nt, Human
uagguagcaugcccaagguc

SEQ ID NO: 563398 - RNA, 24 nt, Human
uauuucaaauuugugaauuauguu

SEQ ID NO: 563399 - RNA, 24 nt, Human
ucaaauucucagauuggcccuugu

SEQ ID NO: 563400 - RNA, 18 nt, Human
uccacauauaagucaaau

SEQ ID NO: 563401 - RNA, 19 nt, Human
ucuaugcauuuuacuugug

SEQ ID NO: 563402 - RNA, 21 nt, Human
ucucuaauguuuggauuucug

SEQ ID NO: 563403 - RNA, 22 nt, Human
ucuuuuuucuuugaaaacagcu

SEQ ID NO: 563404 - RNA, 21 nt, Human
ugaaccgagacagucugacaa

SEQ ID NO: 563405 - RNA, 21 nt, Human
ugacaagauauaugagacuaa

SEQ ID NO: 563406 - RNA, 18 nt, Human
ugacacaauaaaaaaagg

SEQ ID NO: 563407 - RNA, 19 nt, Human
uuaauugugaauaucucug

SEQ ID NO: 563408 - RNA, 19 nt, Human
uugaaccgagacagucuga

SEQ ID NO: 563409 - RNA, 21 nt, Human
uugagaaaaucacaauugugc

SEQ ID NO: 563410 - RNA, 25 nt, Human
uuuuaugacacaaauuaguauugcu

SEQ ID NO: 563411 - RNA, 19 nt, Human
uuuuuugguggaagacaga

SEQ ID NO: 563412 - RNA, 19 nt, Human
aaaaacaaaaaacacauca

SEQ ID NO: 563413 - RNA, 21 nt, Human
aaacagaagcagggaugacaa

SEQ ID NO: 563414 - RNA, 18 nt, Human
aacaggcguucgguuuua

SEQ ID NO: 563415 - RNA, 18 nt, Human
aagguuuuuuuacugcag

SEQ ID NO: 563416 - RNA, 20 nt, Human
aaugaggaaaaggagaggaa

SEQ ID NO: 563417 - RNA, 19 nt, Human
acgaaggugaaugcugaag

SEQ ID NO: 563418 - RNA, 23 nt, Human
acucaucugcgugucccccacac

SEQ ID NO: 563419 - RNA, 22 nt, Human
aggaaaaggagaggaaagagaa

SEQ ID NO: 563420 - RNA, 23 nt, Human
aggaaagagaagaucugggcugu

SEQ ID NO: 563421 - RNA, 24 nt, Human
aggaauaaaugaggaaaaggagag

SEQ ID NO: 563422 - RNA, 21 nt, Human
aguugacaggaauaaaaagga

SEQ ID NO: 563423 - RNA, 23 nt, Human
aguugacaggaauaaaaaggaau

SEQ ID NO: 563424 - RNA, 26 nt, Human
aucacacuuaggccacuacaaugauu

SEQ ID NO: 563425 - RNA, 25 nt, Human
caaaaugaacauauaauugggaggg

SEQ ID NO: 563426 - RNA, 21 nt, Human
cacgaaggugaaugcugaaga

SEQ ID NO: 563427 - RNA, 25 nt, Human
cacucuaagaccaaacagaagcagg

SEQ ID NO: 563428 - RNA, 28 nt, Human
cacucuaagaccaaacagaagcagggau

SEQ ID NO: 563429 - RNA, 20 nt, Human
cagacgcuccaaugcuuuuc

SEQ ID NO: 563430 - RNA, 24 nt, Human
ccaauucacucaucugcguguccc

SEQ ID NO: 563431 - RNA, 25 nt, Human
ccacacggguaaggggaacaggcgu

SEQ ID NO: 563432 - RNA, 19 nt, Human
cccacacggguaaggggaa

SEQ ID NO: 563433 - RNA, 18 nt, Human
cccgucaagccccgaggc

SEQ ID NO: 563434 - RNA, 23 nt, Human
ccgccacaaucccgucaagcccc

SEQ ID NO: 563435 - RNA, 22 nt, Human
cgaaggugaaugcugaagacca

SEQ ID NO: 563436 - RNA, 20 nt, Human
cugguuucuacucaucuuuc

SEQ ID NO: 563437 - RNA, 22 nt, Human
uaaaaacaaaaaacacaucaaa

SEQ ID NO: 563438 - RNA, 19 nt, Human
uaaccagauguguuaaugg

SEQ ID NO: 563439 - RNA, 21 nt, Human
uacagcaguaaccagaugugu

SEQ ID NO: 563440 - RNA, 20 nt, Human
uccaaacacucuaagaccaa

SEQ ID NO: 563441 - RNA, 18 nt, Human
uccacagagccccagagu

SEQ ID NO: 563442 - RNA, 22 nt, Human
uccacagagccccagaguggug

SEQ ID NO: 563443 - RNA, 25 nt, Human
uccacagagccccagaguggugaca

SEQ ID NO: 563444 - RNA, 19 nt, Human
uccgaauugggagagagga

SEQ ID NO: 563445 - RNA, 21 nt, Human
ucuacaauucaguuauaucca

SEQ ID NO: 563446 - RNA, 20 nt, Human
ucuuccacagagccccagag

SEQ ID NO: 563447 - RNA, 18 nt, Human
ugacaggaauaaaaagga

SEQ ID NO: 563448 - RNA, 21 nt, Human
ugagagcguccggagguagcu

SEQ ID NO: 563449 - RNA, 26 nt, Human
ugggcugugcuggugcugaccacugg

SEQ ID NO: 563450 - RNA, 18 nt, Human
uucaguuuguuaaagaac

SEQ ID NO: 563451 - RNA, 18 nt, Human
uucuuccacagagcccca

SEQ ID NO: 563452 - RNA, 22 nt, Human
aaacaaaaaacuacucugcaac

SEQ ID NO: 563453 - RNA, 21 nt, Human
aaacagccugaaaacauacaa

SEQ ID NO: 563454 - RNA, 23 nt, Human
aaacgcagccaacgugucccccg

SEQ ID NO: 563455 - RNA, 25 nt, Human
aacuaauuauuccacccaaaauuca

SEQ ID NO: 563456 - RNA, 23 nt, Human
aaucaaauaaaagacagaucaaa

SEQ ID NO: 563457 - RNA, 21 nt, Human
acaaaaaacuacucugcaacc

SEQ ID NO: 563458 - RNA, 21 nt, Human
acaaaagaccugaagaugaua

SEQ ID NO: 563459 - RNA, 21 nt, Human
acaaccaacaacugugggccu

SEQ ID NO: 563460 - RNA, 26 nt, Human
acucauuuaguucuccccccuccccu

SEQ ID NO: 563461 - RNA, 19 nt, Human
acuguaaaaaaaaacuaga

SEQ ID NO: 563462 - RNA, 22 nt, Human
agagauauuacaguaaaaaaga

SEQ ID NO: 563463 - RNA, 22 nt, Human
agccccccaaaauuaaauccaa

SEQ ID NO: 563464 - RNA, 23 nt, Human
aggaacaaccaacaacugugggc

SEQ ID NO: 563465 - RNA, 23 nt, Human
aggaaggagguaaaaggagggac

SEQ ID NO: 563466 - RNA, 23 nt, Human
aggaauaaagacauaaucaaaga

SEQ ID NO: 563467 - RNA, 24 nt, Human
aggcaaugggcaugcauuuugagg

SEQ ID NO: 563468 - RNA, 21 nt, Human
auaaccccucccaucccuuaa

SEQ ID NO: 563469 - RNA, 21 nt, Human
auaacuguaaaaaaaaacuag

SEQ ID NO: 563470 - RNA, 20 nt, Human
caccaaauacauugugaaau

SEQ ID NO: 563471 - RNA, 22 nt, Human
cagggguccuggcaagccuuca

SEQ ID NO: 563472 - RNA, 23 nt, Human
cauagccuccuggaaaaaacaaa

SEQ ID NO: 563473 - RNA, 19 nt, Human
cauggcaaacagguuacca

SEQ ID NO: 563474 - RNA, 19 nt, Human
cauuuggccaguugcuacc

SEQ ID NO: 563475 - RNA, 23 nt, Human
ccaccuaaaguaucuucugucac

SEQ ID NO: 563476 - RNA, 20 nt, Human
ccccccaaaauuaaauccaa

SEQ ID NO: 563477 - RNA, 20 nt, Human
ccccuccccuacacaccaaa

SEQ ID NO: 563478 - RNA, 19 nt, Human
cccgccgaaaacgcagcca

SEQ ID NO: 563479 - RNA, 27 nt, Human
ccgaaaacgcagccaacgugucccccg

SEQ ID NO: 563480 - RNA, 21 nt, Human
ccuuguauaagccccccaaaa

SEQ ID NO: 563481 - RNA, 25 nt, Human
cgcagccaacgugucccccggcgcc

SEQ ID NO: 563482 - RNA, 20 nt, Human
cuaaaguaucuucugucaca

SEQ ID NO: 563483 - RNA, 19 nt, Human
cuaaaguaucuucugucca

SEQ ID NO: 563484 - RNA, 23 nt, Human
cuaauuauuccacccaaaauuca

SEQ ID NO: 563485 - RNA, 21 nt, Human
cuccuggaaaaaacaaaaaac

SEQ ID NO: 563486 - RNA, 22 nt, Human
gacugcccgacucuagagccua

SEQ ID NO: 563487 - RNA, 25 nt, Human
gagaacggggacaaagacuuaaaga

SEQ ID NO: 563488 - RNA, 24 nt, Human
gaggaacaaccaacaacugugggc

SEQ ID NO: 563489 - RNA, 22 nt, Human
gcaaugggcaugcauuuugagg

SEQ ID NO: 563490 - RNA, 22 nt, Human
gcucagggguccuggcaagccc

SEQ ID NO: 563491 - RNA, 20 nt, Human
ggaaaucauuugacuuucca

SEQ ID NO: 563492 - RNA, 18 nt, Human
ggcaugcauuuugaggag

SEQ ID NO: 563493 - RNA, 18 nt, Human
gguccuggcaagccuuca

SEQ ID NO: 563494 - RNA, 24 nt, Human
guccaaacgguagccgcuagacac

SEQ ID NO: 563495 - RNA, 19 nt, Human
guccuggcaagccuucagg

SEQ ID NO: 563496 - RNA, 19 nt, Human
guucaaaagacgauuguuc

SEQ ID NO: 563497 - RNA, 18 nt, Human
uaaaaggaaacaaggaac

SEQ ID NO: 563498 - RNA, 22 nt, Human
uaaaaggaacauaaccugagcg

SEQ ID NO: 563499 - RNA, 21 nt, Human
uaaagcugaaaacucauuuaa

SEQ ID NO: 563500 - RNA, 22 nt, Human
uaaaguaucuucugucacagga

SEQ ID NO: 563501 - RNA, 23 nt, Human
uaaaugacaaauaaccccuccca

SEQ ID NO: 563502 - RNA, 23 nt, Human
uaaaugcaagaaaauuacaauac

SEQ ID NO: 563503 - RNA, 24 nt, Human
uaacaugggguagacuguacucuu

SEQ ID NO: 563504 - RNA, 24 nt, Human
uaacuguaaaaaaaaacuagaccu

SEQ ID NO: 563505 - RNA, 24 nt, Human
uaacuuguuccuagggcaagugga

SEQ ID NO: 563506 - RNA, 18 nt, Human
uaaguauagaaucuaggu

SEQ ID NO: 563507 - RNA, 23 nt, Human
uacaaacagccugaaaacauaca

SEQ ID NO: 563508 - RNA, 24 nt, Human
uacaaacagccugaaaacauacaa

SEQ ID NO: 563509 - RNA, 25 nt, Human
uacauucauacauacauauauguuu

SEQ ID NO: 563510 - RNA, 21 nt, Human
uaccaagccaugcucuagagc

SEQ ID NO: 563511 - RNA, 20 nt, Human
uacugcacaaucaucaaggu

SEQ ID NO: 563512 - RNA, 18 nt, Human
uagauaguggggauggag

SEQ ID NO: 563513 - RNA, 20 nt, Human
uagggcaaguggauuauaac

SEQ ID NO: 563514 - RNA, 19 nt, Human
uagugcuccauggcaaaca

SEQ ID NO: 563515 - RNA, 21 nt, Human
uauaagccccccaaaauuaaa

SEQ ID NO: 563516 - RNA, 27 nt, Human
uauacaaacagccugaaaacauacaau

SEQ ID NO: 563517 - RNA, 24 nt, Human
uauguacauucauacauacauaua

SEQ ID NO: 563518 - RNA, 20 nt, Human
ucaaaauuaaauagcacuac

SEQ ID NO: 563519 - RNA, 19 nt, Human
ucaauaggaguuaaaaaua

SEQ ID NO: 563520 - RNA, 19 nt, Human
ucagauggaagaauaaaag

SEQ ID NO: 563521 - RNA, 19 nt, Human
ugaauuagagacauagccu

SEQ ID NO: 563522 - RNA, 18 nt, Human
ugacaaauaaccccuccc

SEQ ID NO: 563523 - RNA, 22 nt, Human
ugacaaauaaccccucccaucc

SEQ ID NO: 563524 - RNA, 21 nt, Human
ugcuacccuauuggacugcac

SEQ ID NO: 563525 - RNA, 20 nt, Human
uggaaaaaacaaaaaacuac

SEQ ID NO: 563526 - RNA, 21 nt, Human
uggaacagaaacauuuuacau

SEQ ID NO: 563527 - RNA, 18 nt, Human
uggaagaauaaaaggaaa

SEQ ID NO: 563528 - RNA, 22 nt, Human
uggacugcacauaggacguuuc

SEQ ID NO: 563529 - RNA, 18 nt, Human
uggcaagccuucagaaac

SEQ ID NO: 563530 - RNA, 19 nt, Human
uggcuacauaguuccaccu

SEQ ID NO: 563531 - RNA, 22 nt, Human
ugucacaggauguaucuaccag

SEQ ID NO: 563532 - RNA, 28 nt, Human
uguuuugaggaacaaccaacaacugugg

SEQ ID NO: 563533 - RNA, 18 nt, Human
uugcaaaaaaguuauugg

SEQ ID NO: 563534 - RNA, 21 nt, Human
aaaacaaaacagauccaggca

SEQ ID NO: 563535 - RNA, 21 nt, Human
aaacagauccaggcauggcca

SEQ ID NO: 563536 - RNA, 18 nt, Human
aaaccaaaacaaaacaga

SEQ ID NO: 563537 - RNA, 23 nt, Human
aaccaaaaaccaaaacaaaacag

SEQ ID NO: 563538 - RNA, 25 nt, Human
aagagguaccuuuauuugaacagaa

SEQ ID NO: 563539 - RNA, 18 nt, Human
aagcacccuggccccagg

SEQ ID NO: 563540 - RNA, 23 nt, Human
aagcccugacccaaaaaccaaaa

SEQ ID NO: 563541 - RNA, 24 nt, Human
aagcugaggcaggaggaucacuug

SEQ ID NO: 563542 - RNA, 20 nt, Human
aaggucaaggucacagugag

SEQ ID NO: 563543 - RNA, 26 nt, Human
acagugaagcccugacccaaaaacca

SEQ ID NO: 563544 - RNA, 28 nt, Human
accaaaaaccucccacugaaaauccuuu

SEQ ID NO: 563545 - RNA, 24 nt, Human
accacugcacucuagccugggcaa

SEQ ID NO: 563546 - RNA, 21 nt, Human
accaggccccuggaugcacac

SEQ ID NO: 563547 - RNA, 18 nt, Human
acugcacucuagccuggg

SEQ ID NO: 563548 - RNA, 23 nt, Human
acugcacucuagccugggcaaca

SEQ ID NO: 563549 - RNA, 20 nt, Human
agccugggcaacacagugaa

SEQ ID NO: 563550 - RNA, 24 nt, Human
agccugggcaacacagugaagccc

SEQ ID NO: 563551 - RNA, 18 nt, Human
aggcaggaggaucacuug

SEQ ID NO: 563552 - RNA, 23 nt, Human
aggcaggaggaucacuugagucc

SEQ ID NO: 563553 - RNA, 24 nt, Human
aggcaggaggaucacuugagucca

SEQ ID NO: 563554 - RNA, 23 nt, Human
aggccauucacagcuuugucugg

SEQ ID NO: 563555 - RNA, 23 nt, Human
aggccccuggaugcacacaacuc

SEQ ID NO: 563556 - RNA, 22 nt, Human
aggcuggggccggcgccaaaaa

SEQ ID NO: 563557 - RNA, 23 nt, Human
agguggauccuggggccccaggg

SEQ ID NO: 563558 - RNA, 23 nt, Human
auaaaaugcagccccugcccaca

SEQ ID NO: 563559 - RNA, 20 nt, Human
augcagccccugcccacacc

SEQ ID NO: 563560 - RNA, 23 nt, Human
caaaccaaaaaccucccacugaa

SEQ ID NO: 563561 - RNA, 19 nt, Human
cacacaacucaggcagggc

SEQ ID NO: 563562 - RNA, 21 nt, Human
cacacaacucaggcagggcac

SEQ ID NO: 563563 - RNA, 22 nt, Human
cacacaacucaggcagggcacc

SEQ ID NO: 563564 - RNA, 20 nt, Human
caccacugcacucuagccug

SEQ ID NO: 563565 - RNA, 24 nt, Human
caccacugcacucuagccugggca

SEQ ID NO: 563566 - RNA, 20 nt, Human
cacccuggccccagggcaac

SEQ ID NO: 563567 - RNA, 19 nt, Human
cacugcacucuagccuggg

SEQ ID NO: 563568 - RNA, 21 nt, Human
cacugcacucuagccugggca

SEQ ID NO: 563569 - RNA, 22 nt, Human
cacugcacucuagccugggcaa

SEQ ID NO: 563570 - RNA, 23 nt, Human
cacugcacucuagccugggcaac

SEQ ID NO: 563571 - RNA, 24 nt, Human
cacugcacucuagccugggcaaca

SEQ ID NO: 563572 - RNA, 22 nt, Human
cacuuccccaggugcacagcca

SEQ ID NO: 563573 - RNA, 23 nt, Human
cagcagcacguggcaccaggugc

SEQ ID NO: 563574 - RNA, 21 nt, Human
cagccccugcccacacccacc

SEQ ID NO: 563575 - RNA, 18 nt, Human
cagggcaaccacuucccc

SEQ ID NO: 563576 - RNA, 25 nt, Human
caugccaccagccugggggcucacc

SEQ ID NO: 563577 - RNA, 19 nt, Human
cauggcugggcagggccag

SEQ ID NO: 563578 - RNA, 30 nt, Human
ccaaaaaccaaaaaccaaaacaaaacagag

SEQ ID NO: 563579 - RNA, 21 nt, Human
ccacacccaccuggcuucagg

SEQ ID NO: 563580 - RNA, 20 nt, Human
ccacugcacucuagccuggg

SEQ ID NO: 563581 - RNA, 21 nt, Human
ccacugcacucuagccugggc

SEQ ID NO: 563582 - RNA, 23 nt, Human
ccacugcacucuagccugggcaa

SEQ ID NO: 563583 - RNA, 24 nt, Human
ccacugcacucuagccugggcaac

SEQ ID NO: 563584 - RNA, 19 nt, Human
ccaguuagguggauccugg

SEQ ID NO: 563585 - RNA, 23 nt, Human
cccaaaaaccaaaaaccaaaaca

SEQ ID NO: 563586 - RNA, 24 nt, Human
cccaaaaaccaaaaaccaaaacaa

SEQ ID NO: 563587 - RNA, 19 nt, Human
cccacacccaccuggcuuc

SEQ ID NO: 563588 - RNA, 20 nt, Human
ccccaggugcacagccaggg

SEQ ID NO: 563589 - RNA, 23 nt, Human
ccccaggugcacagccagggccc

SEQ ID NO: 563590 - RNA, 19 nt, Human
ccccuaggccauucacagc

SEQ ID NO: 563591 - RNA, 23 nt, Human
cccgcugcacgcugaccaccgug

SEQ ID NO: 563592 - RNA, 19 nt, Human
cccuggccccagggcaacc

SEQ ID NO: 563593 - RNA, 20 nt, Human
ccuggccccagggcaaccac

SEQ ID NO: 563594 - RNA, 22 nt, Human
ccugggcaacacagugaagccc

SEQ ID NO: 563595 - RNA, 19 nt, Human
ccugugauccccgcuacuu

SEQ ID NO: 563596 - RNA, 20 nt, Human
cgggaacccgggccgcgccc

SEQ ID NO: 563597 - RNA, 21 nt, Human
cugggcagggccagucccguc

SEQ ID NO: 563598 - RNA, 19 nt, Human
gaacaagcacccuggcccc

SEQ ID NO: 563599 - RNA, 24 nt, Human
gaucacuugaguccagaaggucaa

SEQ ID NO: 563600 - RNA, 24 nt, Human
gcacacaacucaggcagggcaccu

SEQ ID NO: 563601 - RNA, 22 nt, Human
gcauggccaagcgauucauggc

SEQ ID NO: 563602 - RNA, 20 nt, Human
gccccagggagcgcagcuug

SEQ ID NO: 563603 - RNA, 19 nt, Human
gccccagggcaaccacuuc

SEQ ID NO: 563604 - RNA, 21 nt, Human
gcggcucaugccugugauccc

SEQ ID NO: 563605 - RNA, 19 nt, Human
ggaaaagagguaccuuuau

SEQ ID NO: 563606 - RNA, 21 nt, Human
gggccccagggagcgcagcuu

SEQ ID NO: 563607 - RNA, 21 nt, Human
gguguggcggcucaugccugu

SEQ ID NO: 563608 - RNA, 28 nt, Human
gugugauggccggguguggcggcucaug

SEQ ID NO: 563609 - RNA, 21 nt, Human
uccaaaccaaaaaccucccac

SEQ ID NO: 563610 - RNA, 18 nt, Human
uccccgcucaggcugggg

SEQ ID NO: 563611 - RNA, 18 nt, Human
ugaagcccugacccaaaa

SEQ ID NO: 563612 - RNA, 22 nt, Human
ugacccaaaaaccaaaaaccaa

SEQ ID NO: 563613 - RNA, 20 nt, Human
ugaggcaggaggaucacuug

SEQ ID NO: 563614 - RNA, 24 nt, Human
ugaggcaggaggaucacuugaguc

SEQ ID NO: 563615 - RNA, 25 nt, Human
ugaggcaggaggaucacuugagucc

SEQ ID NO: 563616 - RNA, 22 nt, Human
ugcacagccagggcccuccugu

SEQ ID NO: 563617 - RNA, 18 nt, Human
ugcagccccugcccacac

SEQ ID NO: 563618 - RNA, 24 nt, Human
ugccugugauccccgcuacuuggg

SEQ ID NO: 563619 - RNA, 20 nt, Human
uggauccuggggccccaggg

SEQ ID NO: 563620 - RNA, 21 nt, Human
uggaugcacacaacucaggca

SEQ ID NO: 563621 - RNA, 25 nt, Human
uggaugucuccaaaccaaaaaccuc

SEQ ID NO: 563622 - RNA, 24 nt, Human
uggccggguguggcggcucaugcc

SEQ ID NO: 563623 - RNA, 23 nt, Human
uggcggcucaugccugugauccc

SEQ ID NO: 563624 - RNA, 22 nt, Human
uggcugggcagggccagucccg

SEQ ID NO: 563625 - RNA, 22 nt, Human
uggcugggcagggccagucccg

SEQ ID NO: 563626 - RNA, 22 nt, Human
uggcuucaggcuuuggaugucu

SEQ ID NO: 563627 - RNA, 24 nt, Human
ugggaagcugaggcaggaggauca

SEQ ID NO: 563628 - RNA, 18 nt, Human
uucacagcugguguggga

SEQ ID NO: 563629 - RNA, 27 nt, Human
uugaacagaacaagcacccuggcccca

SEQ ID NO: 563630 - RNA, 25 nt, Human
uugggaagcugaggcaggaggauca

SEQ ID NO: 563631 - RNA, 23 nt, Human
uugucuggcucuguacauucauu

SEQ ID NO: 563632 - RNA, 24 nt, Human
aaaaaaaaaaaggaaagcagaagg

SEQ ID NO: 563633 - RNA, 21 nt, Human
aaaaaccaaacauaaaacaga

SEQ ID NO: 563634 - RNA, 18 nt, Human
aaaaauacaaaaaucacc

SEQ ID NO: 563635 - RNA, 24 nt, Human
aaaagaaaagcaaauccauuagaa

SEQ ID NO: 563636 - RNA, 18 nt, Human
aaaauacaaccuccugcu

SEQ ID NO: 563637 - RNA, 23 nt, Human
aaacaguugauuuuaucuggaac

SEQ ID NO: 563638 - RNA, 19 nt, Human
aacauggugaaaccccguc

SEQ ID NO: 563639 - RNA, 20 nt, Human
aacauggugaaaccccgucu

SEQ ID NO: 563640 - RNA, 21 nt, Human
aacauggugaaaccccgucuc

SEQ ID NO: 563641 - RNA, 24 nt, Human
aaucgcuugaacccaggagacgga

SEQ ID NO: 563642 - RNA, 25 nt, Human
acagagcaagacucugucuccaaaa

SEQ ID NO: 563643 - RNA, 24 nt, Human
accaacauggugaaaccccgucuc

SEQ ID NO: 563644 - RNA, 24 nt, Human
acccaggagacggagguugcggug

SEQ ID NO: 563645 - RNA, 24 nt, Human
accccgucucuacuaaaaauacaa

SEQ ID NO: 563646 - RNA, 18 nt, Human
acugcacuccagccuggg

SEQ ID NO: 563647 - RNA, 18 nt, Human
acugcacuccagccuggg

SEQ ID NO: 563648 - RNA, 19 nt, Human
acugcacuccagccugggc

SEQ ID NO: 563649 - RNA, 20 nt, Human
acugcacuccagccugggca

SEQ ID NO: 563650 - RNA, 21 nt, Human
acugcacuccagccugggcaa

SEQ ID NO: 563651 - RNA, 22 nt, Human
acugcacuccagccugggcaac

SEQ ID NO: 563652 - RNA, 24 nt, Human
acugcacuccagccugggcaacag

SEQ ID NO: 563653 - RNA, 24 nt, Human
acugcacuccagccugggcaacag

SEQ ID NO: 563654 - RNA, 23 nt, Human
agacggagguugcggugagagcc

SEQ ID NO: 563655 - RNA, 24 nt, Human
agcacuuugggaggccgaggaggg

SEQ ID NO: 563656 - RNA, 24 nt, Human
agccugaccaacauggugaaaccc

SEQ ID NO: 563657 - RNA, 24 nt, Human
agccugggcaacagagcaagacuc

SEQ ID NO: 563658 - RNA, 24 nt, Human
agcugugguggcucaugccuguaa

SEQ ID NO: 563659 - RNA, 20 nt, Human
aggaguuugagaccagccug

SEQ ID NO: 563660 - RNA, 23 nt, Human
aggcaggagaaucgcuugaaccc

SEQ ID NO: 563661 - RNA, 24 nt, Human
aggcaggagaaucgcuugaaccca

SEQ ID NO: 563662 - RNA, 21 nt, Human
aggccgaggaggguggaucac

SEQ ID NO: 563663 - RNA, 20 nt, Human
aggcugaggcaggagaaucg

SEQ ID NO: 563664 - RNA, 24 nt, Human
aggcugaggcaggagaaucgcuug

SEQ ID NO: 563665 - RNA, 24 nt, Human
aggugugguggcacaugccuguaa

SEQ ID NO: 563666 - RNA, 21 nt, Human
auaaaacagaagggggccagc

SEQ ID NO: 563667 - RNA, 24 nt, Human
aucgugcuacugcacuccagccug

SEQ ID NO: 563668 - RNA, 19 nt, Human
augccuguaaucccagcac

SEQ ID NO: 563669 - RNA, 21 nt, Human
caaaauacaaccuccugcuaa

SEQ ID NO: 563670 - RNA, 24 nt, Human
caacauggugaaaccccgucucua

SEQ ID NO: 563671 - RNA, 23 nt, Human
cacuccagccugggcaacagagc

SEQ ID NO: 563672 - RNA, 20 nt, Human
cagaagggggccagcugugg

SEQ ID NO: 563673 - RNA, 22 nt, Human
cagaagggggccagcuguggug

SEQ ID NO: 563674 - RNA, 24 nt, Human
cagauacuuaggaggcugaggcag

SEQ ID NO: 563675 - RNA, 23 nt, Human
cagcacuuugggaggccgaggag

SEQ ID NO: 563676 - RNA, 26 nt, Human
cagcacuuugggaggccgaggagggu

SEQ ID NO: 563677 - RNA, 19 nt, Human
cagcagaaacucauugcau

SEQ ID NO: 563678 - RNA, 19 nt, Human
cagcggaugcuccgcagcu

SEQ ID NO: 563679 - RNA, 18 nt, Human
cagcucccgcaccggccu

SEQ ID NO: 563680 - RNA, 26 nt, Human
cauauaaaaagaaaagcaaauccauu

SEQ ID NO: 563681 - RNA, 24 nt, Human
caugccuguaaucccagcacuuug

SEQ ID NO: 563682 - RNA, 22 nt, Human
ccaaaaaaaaaaaaggaaagca

SEQ ID NO: 563683 - RNA, 18 nt, Human
ccaaaauuaccuaauuug

SEQ ID NO: 563684 - RNA, 21 nt, Human
ccaggugugguggcacaugcc

SEQ ID NO: 563685 - RNA, 23 nt, Human
ccauauaaaaagaaaagcaaauc

SEQ ID NO: 563686 - RNA, 22 nt, Human
ccgcagcucccgcaccggccug

SEQ ID NO: 563687 - RNA, 24 nt, Human
ccggcgaauccgcgcgggggucuc

SEQ ID NO: 563688 - RNA, 23 nt, Human
ccugaccaacauggugaaacccc

SEQ ID NO: 563689 - RNA, 24 nt, Human
ccugaccaacauggugaaaccccg

SEQ ID NO: 563690 - RNA, 22 nt, Human
ccugggcaacagagcaagacuc

SEQ ID NO: 563691 - RNA, 22 nt, Human
ccuguaaucccagcacuuuggg

SEQ ID NO: 563692 - RNA, 22 nt, Human
cuaaaaauacaaaaaucaccca

SEQ ID NO: 563693 - RNA, 23 nt, Human
cuaagacuagcaagucagcagaa

SEQ ID NO: 563694 - RNA, 21 nt, Human
cuacugcacuccagccugggc

SEQ ID NO: 563695 - RNA, 24 nt, Human
cuacugcacuccagccugggcaac

SEQ ID NO: 563696 - RNA, 23 nt, Human
cucaugccuguaaucccagcacu

SEQ ID NO: 563697 - RNA, 24 nt, Human
cucaugccuguaaucccagcacuu

SEQ ID NO: 563698 - RNA, 21 nt, Human
cuccaaaaaaaaaaaaggaaa

SEQ ID NO: 563699 - RNA, 19 nt, Human
gaauccauauaaaaagaaa

SEQ ID NO: 563700 - RNA, 20 nt, Human
gaauuuugaaauuuauaugg

SEQ ID NO: 563701 - RNA, 23 nt, Human
gagaaucgcuugaacccaggaga

SEQ ID NO: 563702 - RNA, 23 nt, Human
gagaucgugcuacugcacuccag

SEQ ID NO: 563703 - RNA, 21 nt, Human
gagcaagacucugucuccaaa

SEQ ID NO: 563704 - RNA, 21 nt, Human
gagccgagaucgugcuacugc

SEQ ID NO: 563705 - RNA, 23 nt, Human
gaggaggguggaucacuagguca

SEQ ID NO: 563706 - RNA, 21 nt, Human
gaucacuaggucaggaguuug

SEQ ID NO: 563707 - RNA, 22 nt, Human
gaucacuaggucaggaguuuga

SEQ ID NO: 563708 - RNA, 24 nt, Human
gaucacuaggucaggaguuugaga

SEQ ID NO: 563709 - RNA, 24 nt, Human
gcacuccagccugggcaacagagc

SEQ ID NO: 563710 - RNA, 22 nt, Human
gcaggagaaucgcuugaaccca

SEQ ID NO: 563711 - RNA, 19 nt, Human
gccagcugugguggcucau

SEQ ID NO: 563712 - RNA, 20 nt, Human
gccuguaaucccagauacuu

SEQ ID NO: 563713 - RNA, 22 nt, Human
gcuacugcacuccagccugggc

SEQ ID NO: 563714 - RNA, 24 nt, Human
gcuacugcacuccagccugggcaa

SEQ ID NO: 563715 - RNA, 23 nt, Human
ggaaagcagaagggggccgguac

SEQ ID NO: 563716 - RNA, 21 nt, Human
ggaggcugaggcaggagaauc

SEQ ID NO: 563717 - RNA, 26 nt, Human
ggagguugcggugagagccgagaucg

SEQ ID NO: 563718 - RNA, 21 nt, Human
ggcacaugccuguaaucccag

SEQ ID NO: 563719 - RNA, 18 nt, Human
ggccgaggaggguggauc

SEQ ID NO: 563720 - RNA, 24 nt, Human
gggccagcugugguggcucaugcc

SEQ ID NO: 563721 - RNA, 19 nt, Human
ggucaggaguuugagacca

SEQ ID NO: 563722 - RNA, 23 nt, Human
gguggaucacuaggucaggaguu

SEQ ID NO: 563723 - RNA, 24 nt, Human
gguggcacaugccuguaaucccag

SEQ ID NO: 563724 - RNA, 24 nt, Human
gguggcucaugccuguaaucccag

SEQ ID NO: 563725 - RNA, 23 nt, Human
guggaucacuaggucaggaguuu

SEQ ID NO: 563726 - RNA, 21 nt, Human
uaaaaagaaaagcaaauccau

SEQ ID NO: 563727 - RNA, 20 nt, Human
uaagaaggcugcacggauga

SEQ ID NO: 563728 - RNA, 22 nt, Human
uacugcacuccagccugggcaa

SEQ ID NO: 563729 - RNA, 24 nt, Human
uacugcacuccagccugggcaaca

SEQ ID NO: 563730 - RNA, 24 nt, Human
ucacuaggucaggaguuugagacc

SEQ ID NO: 563731 - RNA, 20 nt, Human
ucauccaggugcgaggacag

SEQ ID NO: 563732 - RNA, 23 nt, Human
ucgugcuacugcacuccagccug

SEQ ID NO: 563733 - RNA, 18 nt, Human
ucuccaaaaaaaaaaaag

SEQ ID NO: 563734 - RNA, 21 nt, Human
ucuccaaaaaaaaaaaaggaa

SEQ ID NO: 563735 - RNA, 21 nt, Human
ucucuacuaaaaauacaaaaa

SEQ ID NO: 563736 - RNA, 21 nt, Human
ucucuggcgucgagaggaccc

SEQ ID NO: 563737 - RNA, 21 nt, Human
ucugucuccaaaaaaaaaaaa

SEQ ID NO: 563738 - RNA, 24 nt, Human
ugaccaacauggugaaaccccguc

SEQ ID NO: 563739 - RNA, 23 nt, Human
ugagaccagccugaccaacaugg

SEQ ID NO: 563740 - RNA, 24 nt, Human
ugagaccagccugaccaacauggu

SEQ ID NO: 563741 - RNA, 20 nt, Human
ugaggcaggagaaucgcuug

SEQ ID NO: 563742 - RNA, 24 nt, Human
ugaggcaggagaaucgcuugaacc

SEQ ID NO: 563743 - RNA, 25 nt, Human
ugaggcaggagaaucgcuugaaccc

SEQ ID NO: 563744 - RNA, 24 nt, Human
ugccuguaaucccagauacuuagg

SEQ ID NO: 563745 - RNA, 23 nt, Human
ugccuguaaucccagcacuuugg

SEQ ID NO: 563746 - RNA, 23 nt, Human
ugccuguaaucccagcacuuugg

SEQ ID NO: 563747 - RNA, 20 nt, Human
ugcuaagacuagcaagucaa

SEQ ID NO: 563748 - RNA, 21 nt, Human
uggaaggaacuacaucuggaa

SEQ ID NO: 563749 - RNA, 21 nt, Human
uggaucacuaggucaggaguu

SEQ ID NO: 563750 - RNA, 21 nt, Human
uggcacaugccuguaauccca

SEQ ID NO: 563751 - RNA, 22 nt, Human
uggcacaugccuguaaucccag

SEQ ID NO: 563752 - RNA, 19 nt, Human
uggcggguuuugugguuag

SEQ ID NO: 563753 - RNA, 24 nt, Human
uggcucaugccuguaaucccagca

SEQ ID NO: 563754 - RNA, 23 nt, Human
ugggaggccgaggaggguggauc

SEQ ID NO: 563755 - RNA, 24 nt, Human
ugggaggccgaggaggguggauca

SEQ ID NO: 563756 - RNA, 24 nt, Human
ugguggcacaugccuguaauccca

SEQ ID NO: 563757 - RNA, 24 nt, Human
ugguggcucaugccuguaauccca

SEQ ID NO: 563758 - RNA, 18 nt, Human
ugucauccaggugcgagg

SEQ ID NO: 563759 - RNA, 24 nt, Human
ugugaaugaauuggaaccuaggug

SEQ ID NO: 563760 - RNA, 22 nt, Human
uuacuuuacauagagcuuuguu

SEQ ID NO: 563761 - RNA, 25 nt, Human
uugggaggccgaggaggguggauca

SEQ ID NO: 563762 - RNA, 21 nt, Human
uuuuccugucuucaaaauaca

SEQ ID NO: 563763 - RNA, 19 nt, Human
aagaggccaccugugcccc

SEQ ID NO: 563764 - RNA, 23 nt, Human
aagcaggagcagcagagggccca

SEQ ID NO: 563765 - RNA, 20 nt, Human
aagggccugaguccgacucu

SEQ ID NO: 563766 - RNA, 18 nt, Human
acaaaaauuccacaaaca

SEQ ID NO: 563767 - RNA, 19 nt, Human
acauacuuuaugcauaaga

SEQ ID NO: 563768 - RNA, 21 nt, Human
accgacaagcaggagcagcag

SEQ ID NO: 563769 - RNA, 21 nt, Human
agagggcccagaagcacugcc

SEQ ID NO: 563770 - RNA, 21 nt, Human
agagucuucaucuuucucuuc

SEQ ID NO: 563771 - RNA, 25 nt, Human
caaccgacaagcaggagcagcagag

SEQ ID NO: 563772 - RNA, 21 nt, Human
caagagagagaaaguaaauga

SEQ ID NO: 563773 - RNA, 21 nt, Human
cacaaaaauuccacaaacaga

SEQ ID NO: 563774 - RNA, 19 nt, Human
cacccugucucugcuccug

SEQ ID NO: 563775 - RNA, 18 nt, Human
cagcaugcuggcugcugg

SEQ ID NO: 563776 - RNA, 20 nt, Human
cagcuuucuuucucgguauc

SEQ ID NO: 563777 - RNA, 21 nt, Human
cauccuggucgggaucccugc

SEQ ID NO: 563778 - RNA, 18 nt, Human
caucuucauagucuucaa

SEQ ID NO: 563779 - RNA, 19 nt, Human
ccacaaaaauuccacaaac

SEQ ID NO: 563780 - RNA, 21 nt, Human
ccacaaaaauuccacaaacag

SEQ ID NO: 563781 - RNA, 18 nt, Human
ccagcgccuagcaaccga

SEQ ID NO: 563782 - RNA, 23 nt, Human
ccagcuuccaccacacagaagag

SEQ ID NO: 563783 - RNA, 22 nt, Human
ccccgaagaggccaccugugcc

SEQ ID NO: 563784 - RNA, 22 nt, Human
cccgcaggcccgggcggccgcg

SEQ ID NO: 563785 - RNA, 22 nt, Human
cccggucuuuugcgucucuucu

SEQ ID NO: 563786 - RNA, 23 nt, Human
cccuugugcugcuuuuuucucgg

SEQ ID NO: 563787 - RNA, 22 nt, Human
ccgcgguguccucggccccggc

SEQ ID NO: 563788 - RNA, 21 nt, Human
ccgggcccuucugucuuuuuc

SEQ ID NO: 563789 - RNA, 23 nt, Human
ccguacugcagcuuucuuucucg

SEQ ID NO: 563790 - RNA, 18 nt, Human
ccucguggccaugcuucc

SEQ ID NO: 563791 - RNA, 18 nt, Human
ccucucccucugucuguc

SEQ ID NO: 563792 - RNA, 23 nt, Human
ccucucgccuucuucuuuauaaa

SEQ ID NO: 563793 - RNA, 21 nt, Human
ccugacuguauggcccagaga

SEQ ID NO: 563794 - RNA, 23 nt, Human
ccuggaaguuuuguaaaugcuag

SEQ ID NO: 563795 - RNA, 19 nt, Human
ccugugccccgcacccuuc

SEQ ID NO: 563796 - RNA, 20 nt, Human
ccuugcugucuccguacugc

SEQ ID NO: 563797 - RNA, 19 nt, Human
cgcgguccucucagccaca

SEQ ID NO: 563798 - RNA, 20 nt, Human
cgcuucugaaacaguuucaa

SEQ ID NO: 563799 - RNA, 23 nt, Human
cucgaaauacucucagaaaagag

SEQ ID NO: 563800 - RNA, 24 nt, Human
cugaggucaucugcuuuccaggua

SEQ ID NO: 563801 - RNA, 22 nt, Human
cugcuccuggcauccuggucga

SEQ ID NO: 563802 - RNA, 22 nt, Human
cuggaaguuuuguaaaugcuag

SEQ ID NO: 563803 - RNA, 19 nt, Human
cuggcucucugggcuuccu

SEQ ID NO: 563804 - RNA, 24 nt, Human
cugucucugucccucuccccacga

SEQ ID NO: 563805 - RNA, 20 nt, Human
cuuacuuuacuuacugagcg

SEQ ID NO: 563806 - RNA, 25 nt, Human
cuuucuuucuuccuuggaaccaccu

SEQ ID NO: 563807 - RNA, 21 nt, Human
gaaguucuuccaguuuuucuc

SEQ ID NO: 563808 - RNA, 19 nt, Human
gacaagcaggagcagcaga

SEQ ID NO: 563809 - RNA, 18 nt, Human
gacuguauggcccagaga

SEQ ID NO: 563810 - RNA, 23 nt, Human
gagcagcagagggcccagaagca

SEQ ID NO: 563811 - RNA, 23 nt, Human
gaucuggcucucugggcuuccug

SEQ ID NO: 563812 - RNA, 19 nt, Human
gcaggcccgggcggccgcg

SEQ ID NO: 563813 - RNA, 22 nt, Human
gcgccuagcaaccgacaagcag

SEQ ID NO: 563814 - RNA, 21 nt, Human
gcgucucuucuccucucccuc

SEQ ID NO: 563815 - RNA, 23 nt, Human
gcugcuggucccaucucuuuuug

SEQ ID NO: 563816 - RNA, 22 nt, Human
gcuuccaccacacagaagagcc

SEQ ID NO: 563817 - RNA, 19 nt, Human
ggagcagcagagggcccag

SEQ ID NO: 563818 - RNA, 21 nt, Human
ggagcagcagagggcccagaa

SEQ ID NO: 563819 - RNA, 23 nt, Human
ggcccagcagguuguggugggcc

SEQ ID NO: 563820 - RNA, 19 nt, Human
ggcccgggcggccgcggug

SEQ ID NO: 563821 - RNA, 24 nt, Human
gggcccuucugucuuuuucuuuuu

SEQ ID NO: 563822 - RNA, 22 nt, Human
gggcuccuuuucaaauucuguu

SEQ ID NO: 563823 - RNA, 19 nt, Human
ggugguagauccaagagag

SEQ ID NO: 563824 - RNA, 22 nt, Human
guccugggcuccuuuucaaauu

SEQ ID NO: 563825 - RNA, 21 nt, Human
guucuucucuucccgggcucc

SEQ ID NO: 563826 - RNA, 24 nt, Human
uaaaauaaauuauauacagaauau

SEQ ID NO: 563827 - RNA, 18 nt, Human
uaccaaagaaauauucau

SEQ ID NO: 563828 - RNA, 19 nt, Human
uaccaaagaaauauucaug

SEQ ID NO: 563829 - RNA, 21 nt, Human
uacuugagaggguuguccuug

SEQ ID NO: 563830 - RNA, 23 nt, Human
uagaggaaguucuuccaguuuuu

SEQ ID NO: 563831 - RNA, 20 nt, Human
uagauccaagagagagaaag

SEQ ID NO: 563832 - RNA, 23 nt, Human
uauggcccagagauguuuucuga

SEQ ID NO: 563833 - RNA, 22 nt, Human
uauucauguaaaauaaauuaua

SEQ ID NO: 563834 - RNA, 18 nt, Human
ucaaaaugaaaaccuucu

SEQ ID NO: 563835 - RNA, 18 nt, Human
uccaagagagagaaagua

SEQ ID NO: 563836 - RNA, 18 nt, Human
uccacaaaaauuccacaa

SEQ ID NO: 563837 - RNA, 21 nt, Human
uccacaaacagaggcucugga

SEQ ID NO: 563838 - RNA, 22 nt, Human
ucccgcaggcccgggcggccgc

SEQ ID NO: 563839 - RNA, 18 nt, Human
ucccugcaccucggcucc

SEQ ID NO: 563840 - RNA, 23 nt, Human
uccgcccgcuccaggagcugccg

SEQ ID NO: 563841 - RNA, 18 nt, Human
uccucucagccacacccg

SEQ ID NO: 563842 - RNA, 20 nt, Human
uccuucagcuuuucuuucuc

SEQ ID NO: 563843 - RNA, 27 nt, Human
ucuaaaucaguuucuuccuuuucaauu

SEQ ID NO: 563844 - RNA, 19 nt, Human
ucucccucugucugucucu

SEQ ID NO: 563845 - RNA, 24 nt, Human
ucuccuucagcuuuucuuucuccc

SEQ ID NO: 563846 - RNA, 21 nt, Human
ucugccucucgauguuucucc

SEQ ID NO: 563847 - RNA, 20 nt, Human
ucugucucugucccucuccc

SEQ ID NO: 563848 - RNA, 25 nt, Human
ucuuucuuccccuuugucagagaau

SEQ ID NO: 563849 - RNA, 21 nt, Human
ugaaaaaucuaagucaaugag

SEQ ID NO: 563850 - RNA, 18 nt, Human
ugagaggguuguccuugc

SEQ ID NO: 563851 - RNA, 20 nt, Human
ugagccgaagcaguuuugua

SEQ ID NO: 563852 - RNA, 20 nt, Human
ugaggcaaaauccacaaaaa

SEQ ID NO: 563853 - RNA, 22 nt, Human
ugaggcaaaauccacaaaaauu

SEQ ID NO: 563854 - RNA, 23 nt, Human
ugccucucgauguuucuccuuca

SEQ ID NO: 563855 - RNA, 20 nt, Human
ugcuggcugcuggucccauc

SEQ ID NO: 563856 - RNA, 18 nt, Human
uggaauauuucucucuuu

SEQ ID NO: 563857 - RNA, 19 nt, Human
uguacuucgcaucuuuugc

SEQ ID NO: 563858 - RNA, 19 nt, Human
uguauggcccagagauguu

SEQ ID NO: 563859 - RNA, 21 nt, Human
ugucuccuggcccagcagguu

SEQ ID NO: 563860 - RNA, 18 nt, Human
ugucucugucccucuccc

SEQ ID NO: 563861 - RNA, 23 nt, Human
uguguucacauacuuuaugcaua

SEQ ID NO: 563862 - RNA, 23 nt, Human
uucauagucuucaaaaucaucuu

SEQ ID NO: 563863 - RNA, 20 nt, Human
uucauuaagauacauuuuca

SEQ ID NO: 563864 - RNA, 18 nt, Human
uuccccuggaaguuuugu

SEQ ID NO: 563865 - RNA, 18 nt, Human
uucccgcaggcccgggcg

SEQ ID NO: 563866 - RNA, 19 nt, Human
uugguucuucucuucccgg

SEQ ID NO: 563867 - RNA, 25 nt, Human
uuucccuguccuuuccucugcugug

SEQ ID NO: 563868 - RNA, 23 nt, Human
uuugcgguggaguaauuccuuuu

SEQ ID NO: 563869 - RNA, 21 nt, Human
uuugguucuucucuucccggg

SEQ ID NO: 563870 - RNA, 20 nt, Human
uuuucuuucucccggucuuu

SEQ ID NO: 563871 - RNA, 29 nt, Human
uuuuucccuugugcugcuuuuuucucggu

SEQ ID NO: 563872 - RNA, 18 nt, Human
uuuuuuuuuuuuuugcgg

SEQ ID NO: 563873 - RNA, 19 nt, Human
uuuuuuuuuuuuuuuuugc

SEQ ID NO: 563874 - RNA, 22 nt, Human
uuuuuuuuuuuuuuuuuugcgg

SEQ ID NO: 563875 - RNA, 25 nt, Human
uuuuuuuuuuuuuuuuuugcggugg

SEQ ID NO: 563876 - RNA, 23 nt, Human
acacacacacacacacacacaca

SEQ ID NO: 563877 - RNA, 33 nt, Human
acacacacacacacacacacacaggcauguggu

SEQ ID NO: 563878 - RNA, 25 nt, Human
acacacacacaggcauguguucacg

SEQ ID NO: 563879 - RNA, 18 nt, Human
acucggugggcccuccuc

SEQ ID NO: 563880 - RNA, 19 nt, Human
acucugagaggagcuuggg

SEQ ID NO: 563881 - RNA, 26 nt, Human
agacacagcagccuccggccccaaca

SEQ ID NO: 563882 - RNA, 21 nt, Human
aggaggggcaagcucuuuuuc

SEQ ID NO: 563883 - RNA, 21 nt, Human
aguggucucugaggcuauagc

SEQ ID NO: 563884 - RNA, 20 nt, Human
cacacacacacacacacaca

SEQ ID NO: 563885 - RNA, 20 nt, Human
cacacacacacacacacaca

SEQ ID NO: 563886 - RNA, 24 nt, Human
cacacacacacacacaggcaugug

SEQ ID NO: 563887 - RNA, 29 nt, Human
cacacacacacacaggcauguguucacgu

SEQ ID NO: 563888 - RNA, 31 nt, Human
cacacacacacacaggcauguguucacguag

SEQ ID NO: 563889 - RNA, 23 nt, Human
cacacacaggcauguguucacgu

SEQ ID NO: 563890 - RNA, 21 nt, Human
cagagcucuagugugcuggag

SEQ ID NO: 563891 - RNA, 25 nt, Human
cagccuccggccccaacacugcccu

SEQ ID NO: 563892 - RNA, 22 nt, Human
ccacugggugggcagccagcuc

SEQ ID NO: 563893 - RNA, 22 nt, Human
cccagcccugguccugacaggc

SEQ ID NO: 563894 - RNA, 21 nt, Human
ccuccggccccaacacugccc

SEQ ID NO: 563895 - RNA, 27 nt, Human
cggugggcccuccuccgugccaggccu

SEQ ID NO: 563896 - RNA, 18 nt, Human
cguauguauacauauaca

SEQ ID NO: 563897 - RNA, 26 nt, Human
cguauguauacauauacacacagugu

SEQ ID NO: 563898 - RNA, 26 nt, Human
cgugcauacaaguacacacacacaca

SEQ ID NO: 563899 - RNA, 29 nt, Human
cuacgugcauacaaguacacacacacaca

SEQ ID NO: 563900 - RNA, 26 nt, Human
cuccggccccaacacugcccuggguu

SEQ ID NO: 563901 - RNA, 25 nt, Human
cuccucgggagggcgugacgacccu

SEQ ID NO: 563902 - RNA, 18 nt, Human
cugaggcuauagcccccc

SEQ ID NO: 563903 - RNA, 23 nt, Human
cuggggcucuuucagugcuggcu

SEQ ID NO: 563904 - RNA, 23 nt, Human
cugggugggcagccagcucugug

SEQ ID NO: 563905 - RNA, 22 nt, Human
cuuugugcuggugccuacgugc

SEQ ID NO: 563906 - RNA, 26 nt, Human
gagcucuagugugcuggaggaggggc

SEQ ID NO: 563907 - RNA, 22 nt, Human
gcccugguccugacaggcaggu

SEQ ID NO: 563908 - RNA, 19 nt, Human
ggcagacacagcagccucc

SEQ ID NO: 563909 - RNA, 25 nt, Human
guacacacacacacacacacacaca

SEQ ID NO: 563910 - RNA, 25 nt, Human
guacacacacacacacacacacagu

SEQ ID NO: 563911 - RNA, 33 nt, Human
gugcauacaaguacacacacacacacacacagu

SEQ ID NO: 563912 - RNA, 20 nt, Human
uacacacacacacacacaca

SEQ ID NO: 563913 - RNA, 26 nt, Human
uacacacacacacacacacacacagg

SEQ ID NO: 563914 - RNA, 21 nt, Human
uauuagaaagagguugauucc

SEQ ID NO: 563915 - RNA, 23 nt, Human
uauuucuuuauuggggugggggu

SEQ ID NO: 563916 - RNA, 20 nt, Human
ucaugggaccacucgguggg

SEQ ID NO: 563917 - RNA, 23 nt, Human
uccaagaggguauuagaaagagg

SEQ ID NO: 563918 - RNA, 20 nt, Human
ucuuugugcuggugccuacg

SEQ ID NO: 563919 - RNA, 18 nt, Human
ucuuuuuccaagagggua

SEQ ID NO: 563920 - RNA, 19 nt, Human
ugaagacacugaugccgcu

SEQ ID NO: 563921 - RNA, 21 nt, Human
ugaggcuauagccccccacug

SEQ ID NO: 563922 - RNA, 21 nt, Human
ugcagugaagacacugaugcc

SEQ ID NO: 563923 - RNA, 23 nt, Human
uggcaggcccagcccugguccug

SEQ ID NO: 563924 - RNA, 18 nt, Human
ugggguggggguggggug

SEQ ID NO: 563925 - RNA, 24 nt, Human
uguauacauauacacacaaggcca

SEQ ID NO: 563926 - RNA, 24 nt, Human
ugugcuggugccuacgugcauaca

SEQ ID NO: 563927 - RNA, 20 nt, Human
uguguucacguauguauaca

SEQ ID NO: 563928 - RNA, 26 nt, Human
uguguucacguauguauacauauaca

SEQ ID NO: 563929 - RNA, 20 nt, Human
uguucacguauguauacauu

SEQ ID NO: 563930 - RNA, 19 nt, Human
uuagaaagagguugauucc

SEQ ID NO: 563931 - RNA, 20 nt, Human
uuccagaggaugaguggucu

SEQ ID NO: 563932 - RNA, 20 nt, Human
aacagagucacucuccaucu

SEQ ID NO: 563933 - RNA, 20 nt, Human
aagucugugcccugaagccg

SEQ ID NO: 563934 - RNA, 21 nt, Human
aaguuuuggggcaccagcuau

SEQ ID NO: 563935 - RNA, 26 nt, Human
accaauggcagggggaaaagguaguc

SEQ ID NO: 563936 - RNA, 22 nt, Human
agacugagguaggagguacacu

SEQ ID NO: 563937 - RNA, 18 nt, Human
agaggccacagcagcauc

SEQ ID NO: 563938 - RNA, 18 nt, Human
agggagggagguggaagu

SEQ ID NO: 563939 - RNA, 27 nt, Human
agggagggagguggaaguuuugggggg

SEQ ID NO: 563940 - RNA, 18 nt, Human
agguggccagggagggag

SEQ ID NO: 563941 - RNA, 21 nt, Human
auccucgccugccuucugcca

SEQ ID NO: 563942 - RNA, 20 nt, Human
cacaggcacacacauucucu

SEQ ID NO: 563943 - RNA, 19 nt, Human
cacauaaacugcucuuggc

SEQ ID NO: 563944 - RNA, 18 nt, Human
cagccccuguggccuccu

SEQ ID NO: 563945 - RNA, 21 nt, Human
caggagcagaggccaggccag

SEQ ID NO: 563946 - RNA, 19 nt, Human
caucuuguucacugugaac

SEQ ID NO: 563947 - RNA, 19 nt, Human
ccagggcccagcccuucuc

SEQ ID NO: 563948 - RNA, 20 nt, Human
cccacaggcacacacauucu

SEQ ID NO: 563949 - RNA, 21 nt, Human
cccagagguucugacuggggc

SEQ ID NO: 563950 - RNA, 24 nt, Human
ccccuugagagcaggagcagaggc

SEQ ID NO: 563951 - RNA, 20 nt, Human
cccuugagagcaggagcaga

SEQ ID NO: 563952 - RNA, 21 nt, Human
ccucgccugccuucugccaac

SEQ ID NO: 563953 - RNA, 18 nt, Human
cgccugccuucugccaac

SEQ ID NO: 563954 - RNA, 22 nt, Human
cgucccgcucuugcugagugca

SEQ ID NO: 563955 - RNA, 22 nt, Human
cucuccaucucugcuggcuggg

SEQ ID NO: 563956 - RNA, 18 nt, Human
cugagaucccagagguuc

SEQ ID NO: 563957 - RNA, 20 nt, Human
cuuggcaaagauuuguuuca

SEQ ID NO: 563958 - RNA, 19 nt, Human
gaccaggcucacaaggcuc

SEQ ID NO: 563959 - RNA, 27 nt, Human
gagggaaggaagaauucuagaggacag

SEQ ID NO: 563960 - RNA, 18 nt, Human
gcaggagcagaggccagg

SEQ ID NO: 563961 - RNA, 25 nt, Human
ggcaaaaaaaauacucaguggcugu

SEQ ID NO: 563962 - RNA, 20 nt, Human
ggccaggccagcuucacuga

SEQ ID NO: 563963 - RNA, 25 nt, Human
ggcugguagcuggucuuguuccagg

SEQ ID NO: 563964 - RNA, 23 nt, Human
gggaaggaagaauucuagaggac

SEQ ID NO: 563965 - RNA, 19 nt, Human
gggggagggaaggaagaau

SEQ ID NO: 563966 - RNA, 18 nt, Human
ggugugggggagggaagg

SEQ ID NO: 563967 - RNA, 23 nt, Human
gugaacuccuugaaaggaggccu

SEQ ID NO: 563968 - RNA, 23 nt, Human
uaacccgggacugguuggugcaa

SEQ ID NO: 563969 - RNA, 18 nt, Human
uagagacccacaggcaca

SEQ ID NO: 563970 - RNA, 18 nt, Human
uaggggagcuaaggggug

SEQ ID NO: 563971 - RNA, 24 nt, Human
ucacugagaucccagagguucuga

SEQ ID NO: 563972 - RNA, 22 nt, Human
ucccuggugcccggcccagcac

SEQ ID NO: 563973 - RNA, 18 nt, Human
uccuagcccaggauaggg

SEQ ID NO: 563974 - RNA, 19 nt, Human
uccucgccugccuucugcc

SEQ ID NO: 563975 - RNA, 24 nt, Human
uccucucacauagacugagguagg

SEQ ID NO: 563976 - RNA, 20 nt, Human
uccuugaaaggaggccucug

SEQ ID NO: 563977 - RNA, 21 nt, Human
ucucugcuggcugggucugau

SEQ ID NO: 563978 - RNA, 23 nt, Human
ucugccaacagagucacucucca

SEQ ID NO: 563979 - RNA, 19 nt, Human
ucugugcccugaagccaga

SEQ ID NO: 563980 - RNA, 30 nt, Human
ugaaaagcagccccuugagagcaggagcag

SEQ ID NO: 563981 - RNA, 21 nt, Human
uggaaguuuuggggcaccagc

SEQ ID NO: 563982 - RNA, 18 nt, Human
uggcugggucugauccug

SEQ ID NO: 563983 - RNA, 19 nt, Human
ugggcaucccuggcuucua

SEQ ID NO: 563984 - RNA, 19 nt, Human
ugguugaaaagcagccccu

SEQ ID NO: 563985 - RNA, 24 nt, Human
uugaaaagcagccccuugagagca

SEQ ID NO: 563986 - RNA, 19 nt, Human
uugcagggacagaaugaug

SEQ ID NO: 563987 - RNA, 20 nt, Human
aagucuacuggauacccaaa

SEQ ID NO: 563988 - RNA, 23 nt, Human
agcagacagaucuccugcuucag

SEQ ID NO: 563989 - RNA, 21 nt, Human
auacccaaaucccuugaauga

SEQ ID NO: 563990 - RNA, 19 nt, Human
uaaaacauagucuucuuuc

SEQ ID NO: 563991 - RNA, 20 nt, Human
aaagcccgacacagagcagg

SEQ ID NO: 563992 - RNA, 18 nt, Human
aaaggaagaaucuggacu

SEQ ID NO: 563993 - RNA, 24 nt, Human
aacacauuguuucccugggacuuu

SEQ ID NO: 563994 - RNA, 25 nt, Human
aagcaccuccaauguaccaggaucc

SEQ ID NO: 563995 - RNA, 18 nt, Human
acacauuguuucccuggg

SEQ ID NO: 563996 - RNA, 20 nt, Human
accagccaaagcccgacaca

SEQ ID NO: 563997 - RNA, 21 nt, Human
acccuccuuccuucuugguuu

SEQ ID NO: 563998 - RNA, 19 nt, Human
acucacccuccuuccuucu

SEQ ID NO: 563999 - RNA, 19 nt, Human
agacaggggagggggagau

SEQ ID NO: 564000 - RNA, 18 nt, Human
agacaggguuucuccaug

SEQ ID NO: 564001 - RNA, 20 nt, Human
agacaggguuucuccaugcu

SEQ ID NO: 564002 - RNA, 23 nt, Human
agacaggguuucuccaugcuggc

SEQ ID NO: 564003 - RNA, 19 nt, Human
agaguuggggugagaauuc

SEQ ID NO: 564004 - RNA, 23 nt, Human
agaucuuuuaaccacacugagcc

SEQ ID NO: 564005 - RNA, 22 nt, Human
agccaacaagaggaucuggcau

SEQ ID NO: 564006 - RNA, 22 nt, Human
agcugcuuagagcgguuucaga

SEQ ID NO: 564007 - RNA, 21 nt, Human
aggcaguaagcuggccuuggg

SEQ ID NO: 564008 - RNA, 19 nt, Human
aggcgcaaaccaccacgcc

SEQ ID NO: 564009 - RNA, 20 nt, Human
aggggguggggguagaccag

SEQ ID NO: 564010 - RNA, 22 nt, Human
aguagagacaggguuucuccau

SEQ ID NO: 564011 - RNA, 23 nt, Human
agucugggcuuggcaguugggca

SEQ ID NO: 564012 - RNA, 18 nt, Human
aguggcugggauuacagg

SEQ ID NO: 564013 - RNA, 19 nt, Human
aguggcugggauuacaggc

SEQ ID NO: 564014 - RNA, 19 nt, Human
aguggcugggauuacaggc

SEQ ID NO: 564015 - RNA, 21 nt, Human
auucacaguuacucaagcacc

SEQ ID NO: 564016 - RNA, 23 nt, Human
auuuuguauuuuuaguagagaca

SEQ ID NO: 564017 - RNA, 24 nt, Human
caaaccaccacgcccagccaauuu

SEQ ID NO: 564018 - RNA, 20 nt, Human
caauguaccaggauccugug

SEQ ID NO: 564019 - RNA, 18 nt, Human
cacaguuacucaagcacc

SEQ ID NO: 564020 - RNA, 18 nt, Human
caccagccaaagcccgac

SEQ ID NO: 564021 - RNA, 25 nt, Human
caccagccaaagcccgacacagagc

SEQ ID NO: 564022 - RNA, 21 nt, Human
cacugcaaccucugccucccg

SEQ ID NO: 564023 - RNA, 23 nt, Human
cacugcaaccucugccucccggg

SEQ ID NO: 564024 - RNA, 19 nt, Human
cauguagagaugaccgagu

SEQ ID NO: 564025 - RNA, 19 nt, Human
cauucuaggaaaggaagaa

SEQ ID NO: 564026 - RNA, 23 nt, Human
ccaauguaccaggauccugugcu

SEQ ID NO: 564027 - RNA, 24 nt, Human
ccaauuuuguauuuuuaguagaga

SEQ ID NO: 564028 - RNA, 19 nt, Human
ccaccagccaaagcccgac

SEQ ID NO: 564029 - RNA, 22 nt, Human
cccgacacagagcaggcuucag

SEQ ID NO: 564030 - RNA, 18 nt, Human
cccuccuuccuucuuggu

SEQ ID NO: 564031 - RNA, 23 nt, Human
ccuguauggggucaugcgucacu

SEQ ID NO: 564032 - RNA, 22 nt, Human
ccuugggggacagggcucuagc

SEQ ID NO: 564033 - RNA, 19 nt, Human
cgacacagagcaggcuuca

SEQ ID NO: 564034 - RNA, 21 nt, Human
cucaagcaccuccaauguacc

SEQ ID NO: 564035 - RNA, 24 nt, Human
cucacugcaaccucugccucccgg

SEQ ID NO: 564036 - RNA, 23 nt, Human
cucagcacuucccuagcccugac

SEQ ID NO: 564037 - RNA, 20 nt, Human
cuccaugcuggccagacuuc

SEQ ID NO: 564038 - RNA, 23 nt, Human
cucgaguggcugggauuacaggc

SEQ ID NO: 564039 - RNA, 19 nt, Human
cucuuggcucugccaccuu

SEQ ID NO: 564040 - RNA, 21 nt, Human
cucuuguugugcaggcuggag

SEQ ID NO: 564041 - RNA, 22 nt, Human
cucuuguugugcaggcuggagu

SEQ ID NO: 564042 - RNA, 18 nt, Human
cugagccaacaagaggau

SEQ ID NO: 564043 - RNA, 19 nt, Human
cugcaaccucugccucccg

SEQ ID NO: 564044 - RNA, 24 nt, Human
cugcaaccucugccucccggguuc

SEQ ID NO: 564045 - RNA, 18 nt, Human
cuuccuucuugguuuucu

SEQ ID NO: 564046 - RNA, 19 nt, Human
cuuggcaguugggcaaauc

SEQ ID NO: 564047 - RNA, 24 nt, Human
gacuauguuccuguauucacaguu

SEQ ID NO: 564048 - RNA, 20 nt, Human
gagacaggguuucuccaugc

SEQ ID NO: 564049 - RNA, 21 nt, Human
gagacaggguuucuccaugcu

SEQ ID NO: 564050 - RNA, 19 nt, Human
gagcaggcuucagacagcu

SEQ ID NO: 564051 - RNA, 20 nt, Human
gaggggaggcaguaagcugg

SEQ ID NO: 564052 - RNA, 19 nt, Human
gcaaaccaccacgcccagc

SEQ ID NO: 564053 - RNA, 19 nt, Human
gcaguaagcuggccuuggg

SEQ ID NO: 564054 - RNA, 22 nt, Human
gcaguggaugggcagaacugga

SEQ ID NO: 564055 - RNA, 23 nt, Human
gcucugccaccuuccaagaauga

SEQ ID NO: 564056 - RNA, 25 nt, Human
gcuggagugcaauggcacugucccg

SEQ ID NO: 564057 - RNA, 18 nt, Human
gcuggccagacuucaugu

SEQ ID NO: 564058 - RNA, 20 nt, Human
ggagacaggggagggggaga

SEQ ID NO: 564059 - RNA, 18 nt, Human
ggaggagacaggggaggg

SEQ ID NO: 564060 - RNA, 20 nt, Human
gggacaggcaggccugcauu

SEQ ID NO: 564061 - RNA, 18 nt, Human
gggaggggaggcaguaag

SEQ ID NO: 564062 - RNA, 22 nt, Human
gggaggggaggcaguaagcugg

SEQ ID NO: 564063 - RNA, 22 nt, Human
gggguggggguagaccagaggg

SEQ ID NO: 564064 - RNA, 20 nt, Human
gguggggguagaccagaggg

SEQ ID NO: 564065 - RNA, 23 nt, Human
gugcaauggcacugucccggcuc

SEQ ID NO: 564066 - RNA, 18 nt, Human
guggcugggauuacaggc

SEQ ID NO: 564067 - RNA, 19 nt, Human
guggggguagaccagaggg

SEQ ID NO: 564068 - RNA, 22 nt, Human
guugggcaaauccagguuuacu

SEQ ID NO: 564069 - RNA, 22 nt, Human
uaaaagggacucgaaaaucuua

SEQ ID NO: 564070 - RNA, 21 nt, Human
uaggaaaggaagaaucuggac

SEQ ID NO: 564071 - RNA, 24 nt, Human
uaggggguggggguagaccagagg

SEQ ID NO: 564072 - RNA, 24 nt, Human
uaguagagacaggguuucuccaug

SEQ ID NO: 564073 - RNA, 27 nt, Human
uauccuugucuuucauaaaauuagggg

SEQ ID NO: 564074 - RNA, 21 nt, Human
uaugggaggagacaggggagg

SEQ ID NO: 564075 - RNA, 24 nt, Human
ucacucacccuccuuccuucuugg

SEQ ID NO: 564076 - RNA, 24 nt, Human
ucacugcaaccucugccucccggg

SEQ ID NO: 564077 - RNA, 25 nt, Human
ucacugcaaccucugccucccgggu

SEQ ID NO: 564078 - RNA, 22 nt, Human
uccaccagccaaagcccgacac

SEQ ID NO: 564079 - RNA, 21 nt, Human
uccaccuguaagaugaggagg

SEQ ID NO: 564080 - RNA, 20 nt, Human
uccaggugggaugccaggcg

SEQ ID NO: 564081 - RNA, 19 nt, Human
ucccggguucaaaugauuc

SEQ ID NO: 564082 - RNA, 21 nt, Human
ucccggguucaaaugauucuc

SEQ ID NO: 564083 - RNA, 18 nt, Human
ucccuagcccugacauuc

SEQ ID NO: 564084 - RNA, 21 nt, Human
uccugagccaacaagaggauc

SEQ ID NO: 564085 - RNA, 24 nt, Human
ucucgaguggcugggauuacaggc

SEQ ID NO: 564086 - RNA, 18 nt, Human
ucuuguugugcaggcugg

SEQ ID NO: 564087 - RNA, 22 nt, Human
ugacacugacugaggcuggggg

SEQ ID NO: 564088 - RNA, 23 nt, Human
ugacauucuaggaaaggaagaau

SEQ ID NO: 564089 - RNA, 18 nt, Human
ugacugaggcugggggag

SEQ ID NO: 564090 - RNA, 19 nt, Human
ugagggggaggggaggcag

SEQ ID NO: 564091 - RNA, 22 nt, Human
ugcaggcuggagugcaauggca

SEQ ID NO: 564092 - RNA, 23 nt, Human
uggaagaacaguaauucggaguc

SEQ ID NO: 564093 - RNA, 24 nt, Human
uggaagggggacuggaagaacagu

SEQ ID NO: 564094 - RNA, 24 nt, Human
uggaccuccccacugagggcucac

SEQ ID NO: 564095 - RNA, 24 nt, Human
uggagugcaauggcacugucccgg

SEQ ID NO: 564096 - RNA, 18 nt, Human
uggcaugggcugagcucc

SEQ ID NO: 564097 - RNA, 19 nt, Human
ugggauuacaggcgcaaac

SEQ ID NO: 564098 - RNA, 22 nt, Human
ugggauuacaggcgcaaaccac

SEQ ID NO: 564099 - RNA, 24 nt, Human
ugggauuacaggcgcaaaccacca

SEQ ID NO: 564100 - RNA, 22 nt, Human
uguaagaugaggagggcaaugc

SEQ ID NO: 564101 - RNA, 19 nt, Human
uguugugcaggcuggagug

SEQ ID NO: 564102 - RNA, 24 nt, Human
uuaguagagacaggguuucuccau

SEQ ID NO: 564103 - RNA, 19 nt, Human
uuauagagccuguaugggg

SEQ ID NO: 564104 - RNA, 18 nt, Human
uucacaguuacucaagca

SEQ ID NO: 564105 - RNA, 23 nt, Human
uucauguaugggaggagacaggg

SEQ ID NO: 564106 - RNA, 18 nt, Human
uuccaagaaugacaccuu

SEQ ID NO: 564107 - RNA, 22 nt, Human
uucccuagcccugacauucuag

SEQ ID NO: 564108 - RNA, 24 nt, Human
uucuccaugcuggccagacuucau

SEQ ID NO: 564109 - RNA, 19 nt, Human
uugggcaaauccagguuua

SEQ ID NO: 564110 - RNA, 23 nt, Human
uuguugugcaggcuggagugcaa

SEQ ID NO: 564111 - RNA, 19 nt, Human
uuuuguauuuuuaguagag

SEQ ID NO: 564112 - RNA, 20 nt, Human
uuuuguauuuuuaguagaga

SEQ ID NO: 564113 - RNA, 19 nt, Human
aagagcugcaacucaaaca

SEQ ID NO: 564114 - RNA, 19 nt, Human
acaaaaauacaaagcucug

SEQ ID NO: 564115 - RNA, 22 nt, Human
acaguacguaacaaaaauacaa

SEQ ID NO: 564116 - RNA, 20 nt, Human
accaccacuucuacccaaca

SEQ ID NO: 564117 - RNA, 19 nt, Human
acuucuacccaacagcccc

SEQ ID NO: 564118 - RNA, 27 nt, Human
agaagaagagcugcaacucaaacagaa

SEQ ID NO: 564119 - RNA, 20 nt, Human
agaggagggcuggagaggcc

SEQ ID NO: 564120 - RNA, 20 nt, Human
agggugggugggaaggugga

SEQ ID NO: 564121 - RNA, 18 nt, Human
caccacacugucuuguag

SEQ ID NO: 564122 - RNA, 22 nt, Human
caccaccacuucuacccaacag

SEQ ID NO: 564123 - RNA, 24 nt, Human
cagaagaagagcugcaacucaaac

SEQ ID NO: 564124 - RNA, 23 nt, Human
cagggagcccuuggcugaagccu

SEQ ID NO: 564125 - RNA, 18 nt, Human
ccaacagccccuugccag

SEQ ID NO: 564126 - RNA, 20 nt, Human
ccacuagagccccccgagga

SEQ ID NO: 564127 - RNA, 21 nt, Human
cccaccaccacuucuacccaa

SEQ ID NO: 564128 - RNA, 22 nt, Human
cccccaccaccacuucuaccca

SEQ ID NO: 564129 - RNA, 30 nt, Human
ccccccaccaccacuucuacccaacagccc

SEQ ID NO: 564130 - RNA, 32 nt, Human
ccccccaccaccacuucuacccaacagccccc

SEQ ID NO: 564131 - RNA, 19 nt, Human
cccccgaggaucccggcuc

SEQ ID NO: 564132 - RNA, 31 nt, Human
cccccgaggaucccggcucacagagcggagg

SEQ ID NO: 564133 - RNA, 18 nt, Human
cccuuggcugaagccugg

SEQ ID NO: 564134 - RNA, 19 nt, Human
cccuuggcugaagccugga

SEQ ID NO: 564135 - RNA, 18 nt, Human
ccgccgcagcccaguccc

SEQ ID NO: 564136 - RNA, 20 nt, Human
ccggguaucagccgcgcgcu

SEQ ID NO: 564137 - RNA, 21 nt, Human
ccuggacgcugucccugaggu

SEQ ID NO: 564138 - RNA, 22 nt, Human
cgccgccgcagcuccugcgggc

SEQ ID NO: 564139 - RNA, 22 nt, Human
cgggagaggacuaaccgccgca

SEQ ID NO: 564140 - RNA, 23 nt, Human
cuagagccccccgaggaucccgg

SEQ ID NO: 564141 - RNA, 25 nt, Human
cuccugcgggcaauaugucggaggc

SEQ ID NO: 564142 - RNA, 23 nt, Human
cugaagccuggacgcugucccug

SEQ ID NO: 564143 - RNA, 21 nt, Human
ggugggugggaagguggauac

SEQ ID NO: 564144 - RNA, 22 nt, Human
uaucaaagaaacaguacguaac

SEQ ID NO: 564145 - RNA, 23 nt, Human
uaucaaagaaacaguacguaaca

SEQ ID NO: 564146 - RNA, 20 nt, Human
ucccccccaccaccacuucu

SEQ ID NO: 564147 - RNA, 18 nt, Human
ucccggguaucagccgcg

SEQ ID NO: 564148 - RNA, 18 nt, Human
ucggaggcgacggcggcc

SEQ ID NO: 564149 - RNA, 20 nt, Human
ucguccucccaucuccuccc

SEQ ID NO: 564150 - RNA, 23 nt, Human
ugccagggagcccuuggcugaag

SEQ ID NO: 564151 - RNA, 20 nt, Human
ugcuggccuggacuggcagc

SEQ ID NO: 564152 - RNA, 19 nt, Human
ugguggauuuuuuugucuu

SEQ ID NO: 564153 - RNA, 22 nt, Human
uucagggaggugugggagggug

SEQ ID NO: 564154 - RNA, 21 nt, Human
uuugucccccccaccaccacu

SEQ ID NO: 564155 - RNA, 20 nt, Human
uuugucuuuuguccccccca

SEQ ID NO: 564156 - RNA, 21 nt, Human
uuuugucuuuuguccccccca

SEQ ID NO: 564157 - RNA, 18 nt, Human
aaacagggacgaaggcgg

SEQ ID NO: 564158 - RNA, 24 nt, Human
aaacuccaggagcagcugcuggcg

SEQ ID NO: 564159 - RNA, 22 nt, Human
aacuuggucaguuacaaaacag

SEQ ID NO: 564160 - RNA, 24 nt, Human
acgaaggcgggaggaagcccagug

SEQ ID NO: 564161 - RNA, 22 nt, Human
agcagguaguagagccccaggg

SEQ ID NO: 564162 - RNA, 23 nt, Human
agcccggaggcgcgccaaggccc

SEQ ID NO: 564163 - RNA, 18 nt, Human
aggaagcccagugucacc

SEQ ID NO: 564164 - RNA, 23 nt, Human
aggaagcccagugucaccaggug

SEQ ID NO: 564165 - RNA, 18 nt, Human
aggcaggaugucgggggc

SEQ ID NO: 564166 - RNA, 20 nt, Human
aggcccgggcgggcaggggc

SEQ ID NO: 564167 - RNA, 22 nt, Human
cacagcccggaggcgcgccaag

SEQ ID NO: 564168 - RNA, 19 nt, Human
caccaggugggaccgggug

SEQ ID NO: 564169 - RNA, 21 nt, Human
cacccgggacccaacuugguc

SEQ ID NO: 564170 - RNA, 19 nt, Human
cagcucugcggcacagccc

SEQ ID NO: 564171 - RNA, 20 nt, Human
caggagcagcugcuggcgcc

SEQ ID NO: 564172 - RNA, 19 nt, Human
cagggugaggcuccccacc

SEQ ID NO: 564173 - RNA, 18 nt, Human
ccaggagcagcugcuggc

SEQ ID NO: 564174 - RNA, 18 nt, Human
ccccacccgggacccaaa

SEQ ID NO: 564175 - RNA, 25 nt, Human
ccccagggagagcagguccccgugg

SEQ ID NO: 564176 - RNA, 20 nt, Human
ccccagggugaggcucccca

SEQ ID NO: 564177 - RNA, 22 nt, Human
ccccgggccccgagcgcggccc

SEQ ID NO: 564178 - RNA, 18 nt, Human
ccucugcagcagcguguc

SEQ ID NO: 564179 - RNA, 24 nt, Human
cggagaugugcgccccggggaugg

SEQ ID NO: 564180 - RNA, 18 nt, Human
cgggaggaagcccagugu

SEQ ID NO: 564181 - RNA, 19 nt, Human
cgggaggaagcccaguguc

SEQ ID NO: 564182 - RNA, 19 nt, Human
cgggugccgggccuguggg

SEQ ID NO: 564183 - RNA, 20 nt, Human
cuccaggagcagcugcuggc

SEQ ID NO: 564184 - RNA, 19 nt, Human
cugcagcagcguguccucc

SEQ ID NO: 564185 - RNA, 23 nt, Human
cugcagcagcguguccuccaggu

SEQ ID NO: 564186 - RNA, 23 nt, Human
gagcagcugcuggcgccggggca

SEQ ID NO: 564187 - RNA, 23 nt, Human
gcaccacgguccugugccccacc

SEQ ID NO: 564188 - RNA, 23 nt, Human
gccccagggagagcagguccccg

SEQ ID NO: 564189 - RNA, 19 nt, Human
gccgggccugugggggugu

SEQ ID NO: 564190 - RNA, 21 nt, Human
gcgccaaggcccgggcgggca

SEQ ID NO: 564191 - RNA, 20 nt, Human
gcggccccgcacagccggcc

SEQ ID NO: 564192 - RNA, 19 nt, Human
gcugagaggcugaugcugg

SEQ ID NO: 564193 - RNA, 18 nt, Human
ggcugggccugcgcgggg

SEQ ID NO: 564194 - RNA, 18 nt, Human
ggggaggcggcuccccgg

SEQ ID NO: 564195 - RNA, 18 nt, Human
uccccgcggccuggccgc

SEQ ID NO: 564196 - RNA, 21 nt, Human
ugaguaggggaggcggcuccc

SEQ ID NO: 564197 - RNA, 21 nt, Human
ugggccugcgcgggguccuug

SEQ ID NO: 564198 - RNA, 18 nt, Human
uuggucaguuacaaaaca

SEQ ID NO: 564199 - RNA, 19 nt, Human
agccaguaaaguugacuca

SEQ ID NO: 564200 - RNA, 24 nt, Human
aggugcuggaagucucuucagacu

SEQ ID NO: 564201 - RNA, 25 nt, Human
auauacauauauccauccacagaua

SEQ ID NO: 564202 - RNA, 21 nt, Human
auucugauuuugacucccauc

SEQ ID NO: 564203 - RNA, 24 nt, Human
cacacacauauauauuucugcaug

SEQ ID NO: 564204 - RNA, 27 nt, Human
cagauacacacacacauauauauuucu

SEQ ID NO: 564205 - RNA, 19 nt, Human
cagcaucucuauuaucuca

SEQ ID NO: 564206 - RNA, 24 nt, Human
ccuuuauuuucaguaucauagaau

SEQ ID NO: 564207 - RNA, 19 nt, Human
gucaggaggguucuugcuc

SEQ ID NO: 564208 - RNA, 23 nt, Human
uacacacacacauauauauuucu

SEQ ID NO: 564209 - RNA, 24 nt, Human
uauauuucugcauguauauauaca

SEQ ID NO: 564210 - RNA, 23 nt, Human
uaucauagaauuuaaauacagag

SEQ ID NO: 564211 - RNA, 25 nt, Human
uaucauagaauuuaaauacagaguc

SEQ ID NO: 564212 - RNA, 18 nt, Human
uaucugaagacuccgcug

SEQ ID NO: 564213 - RNA, 20 nt, Human
uccacagauacacacacaca

SEQ ID NO: 564214 - RNA, 24 nt, Human
uccacagauacacacacacauaua

SEQ ID NO: 564215 - RNA, 23 nt, Human
uccacugacaacuucugcacauc

SEQ ID NO: 564216 - RNA, 24 nt, Human
uccacugacaacuucugcacaucg

SEQ ID NO: 564217 - RNA, 31 nt, Human
uccauccacagauacacacacacauauagug

SEQ ID NO: 564218 - RNA, 19 nt, Human
ucccauccuccaccauuua

SEQ ID NO: 564219 - RNA, 19 nt, Human
ucugcauguauauauacau

SEQ ID NO: 564220 - RNA, 21 nt, Human
ucugcuuggccguauuugaag

SEQ ID NO: 564221 - RNA, 21 nt, Human
ugaauacauaucuauguucug

SEQ ID NO: 564222 - RNA, 27 nt, Human
ugacucccauccuccaccauuuacucc

SEQ ID NO: 564223 - RNA, 22 nt, Human
uuaauacuauuuuccacugaca

SEQ ID NO: 564224 - RNA, 21 nt, Human
uuccugagccaguaaaguuga

SEQ ID NO: 564225 - RNA, 22 nt, Human
aaaaaugcuuuggaagcuugag

SEQ ID NO: 564226 - RNA, 23 nt, Human
aaaccauaaucccacaccuacaa

SEQ ID NO: 564227 - RNA, 21 nt, Human
aaagaggaaaugaaaaugcag

SEQ ID NO: 564228 - RNA, 18 nt, Human
aaagguaucccaauaaac

SEQ ID NO: 564229 - RNA, 23 nt, Human
aacaauaaaaaugcaagaacaau

SEQ ID NO: 564230 - RNA, 26 nt, Human
aagcacagccaugcuaacuucaguac

SEQ ID NO: 564231 - RNA, 23 nt, Human
aagccaagacccaggauaaagga

SEQ ID NO: 564232 - RNA, 18 nt, Human
aaggaggggggggagggg

SEQ ID NO: 564233 - RNA, 21 nt, Human
aaugcaagaacaaucugugca

SEQ ID NO: 564234 - RNA, 20 nt, Human
acagccaugcuaacuucagu

SEQ ID NO: 564235 - RNA, 18 nt, Human
accacaugcccaauccca

SEQ ID NO: 564236 - RNA, 21 nt, Human
acccaggauaaaggauuuaau

SEQ ID NO: 564237 - RNA, 23 nt, Human
agccuaaaaaccucugcaucaga

SEQ ID NO: 564238 - RNA, 20 nt, Human
aggaaggagggagggaagga

SEQ ID NO: 564239 - RNA, 22 nt, Human
aggaaggagggagggaaggagg

SEQ ID NO: 564240 - RNA, 24 nt, Human
aggaaggagggagggaaggagggg

SEQ ID NO: 564241 - RNA, 18 nt, Human
aggaggggggggaggggg

SEQ ID NO: 564242 - RNA, 21 nt, Human
agggaaggaggggggggaggg

SEQ ID NO: 564243 - RNA, 21 nt, Human
aggggggggagggggccaagc

SEQ ID NO: 564244 - RNA, 23 nt, Human
agguaucccaauaaacgucuuug

SEQ ID NO: 564245 - RNA, 21 nt, Human
aucccacaccuacaaaacaaa

SEQ ID NO: 564246 - RNA, 20 nt, Human
aucugccccacccucucccc

SEQ ID NO: 564247 - RNA, 21 nt, Human
aucugccccacccucucccca

SEQ ID NO: 564248 - RNA, 22 nt, Human
aucugccccacccucuccccau

SEQ ID NO: 564249 - RNA, 24 nt, Human
augcagccuacagggagagcuuga

SEQ ID NO: 564250 - RNA, 24 nt, Human
augcugccuucuuguacauuggca

SEQ ID NO: 564251 - RNA, 19 nt, Human
auuaccacaugcccaaucc

SEQ ID NO: 564252 - RNA, 22 nt, Human
caaaugacacauguaacaacca

SEQ ID NO: 564253 - RNA, 22 nt, Human
caaguuguaagaacaaucuauc

SEQ ID NO: 564254 - RNA, 24 nt, Human
caauaaauggaauuacaaaggcac

SEQ ID NO: 564255 - RNA, 19 nt, Human
cagacuguacauuucaaaa

SEQ ID NO: 564256 - RNA, 18 nt, Human
cagccuaaaaaccucugc

SEQ ID NO: 564257 - RNA, 20 nt, Human
ccacacucaugaugguucug

SEQ ID NO: 564258 - RNA, 23 nt, Human
cccaaucccagucuaugcauuuc

SEQ ID NO: 564259 - RNA, 19 nt, Human
cccacaccuacaaaacaaa

SEQ ID NO: 564260 - RNA, 22 nt, Human
ccuuauacaaauuuaaccaaca

SEQ ID NO: 564261 - RNA, 21 nt, Human
cgaaaagcacagccaugcuaa

SEQ ID NO: 564262 - RNA, 25 nt, Human
cggaaggaaggagggagggaaggag

SEQ ID NO: 564263 - RNA, 21 nt, Human
cuauuacgaaaagcacagcca

SEQ ID NO: 564264 - RNA, 27 nt, Human
cucaaacagcaaucuccauuaucaaua

SEQ ID NO: 564265 - RNA, 26 nt, Human
cugccccacccucuccccauuacaug

SEQ ID NO: 564266 - RNA, 19 nt, Human
gaaagaggaaaugaaaaug

SEQ ID NO: 564267 - RNA, 23 nt, Human
gaaaugaaaaugcagccuacagg

SEQ ID NO: 564268 - RNA, 20 nt, Human
gaaggaaggagggagggaag

SEQ ID NO: 564269 - RNA, 19 nt, Human
gacauccaagauccauucu

SEQ ID NO: 564270 - RNA, 20 nt, Human
gagggaaggaggggggggag

SEQ ID NO: 564271 - RNA, 20 nt, Human
gagggaaggaggggggggag

SEQ ID NO: 564272 - RNA, 21 nt, Human
ggaaaaaagcagauuuaauca

SEQ ID NO: 564273 - RNA, 19 nt, Human
ggaaaagccaagacccagg

SEQ ID NO: 564274 - RNA, 19 nt, Human
ggaaggaggggggggaggg

SEQ ID NO: 564275 - RNA, 23 nt, Human
ggagggaaggaggggggggaggg

SEQ ID NO: 564276 - RNA, 22 nt, Human
ggagggagggaaggaggggggg

SEQ ID NO: 564277 - RNA, 23 nt, Human
ggaggggggggagggggccaagc

SEQ ID NO: 564278 - RNA, 26 nt, Human
ggaggggggggagggggccaagcucg

SEQ ID NO: 564279 - RNA, 18 nt, Human
gguaacuguggagaauau

SEQ ID NO: 564280 - RNA, 23 nt, Human
guaacaaccacugacaaagggaa

SEQ ID NO: 564281 - RNA, 24 nt, Human
uaaaaaaaggacacuauaucaagc

SEQ ID NO: 564282 - RNA, 23 nt, Human
uaaaaaaugcuaacauauugucc

SEQ ID NO: 564283 - RNA, 25 nt, Human
uaaaaaccucugcaucagaaacuaa

SEQ ID NO: 564284 - RNA, 20 nt, Human
uaaaacauuuucaggacaua

SEQ ID NO: 564285 - RNA, 23 nt, Human
uaacaaaugggggaaaagccaag

SEQ ID NO: 564286 - RNA, 24 nt, Human
uaacaaaugggggaaaagccaaga

SEQ ID NO: 564287 - RNA, 18 nt, Human
uaagugucccuuugaggu

SEQ ID NO: 564288 - RNA, 22 nt, Human
uaaugcagcacagcauuacuuu

SEQ ID NO: 564289 - RNA, 19 nt, Human
uacaaauuuaaccaacaug

SEQ ID NO: 564290 - RNA, 21 nt, Human
uaucaaguauucuaauaaaga

SEQ ID NO: 564291 - RNA, 20 nt, Human
uauugccuuauacaaauuua

SEQ ID NO: 564292 - RNA, 23 nt, Human
ucaaaaacaaacaauaaaaaugc

SEQ ID NO: 564293 - RNA, 23 nt, Human
ucuaauaaagauuauugauuacc

SEQ ID NO: 564294 - RNA, 20 nt, Human
ucucaaagucuuuagcauuc

SEQ ID NO: 564295 - RNA, 19 nt, Human
ugaaaacaccaaugcaaua

SEQ ID NO: 564296 - RNA, 19 nt, Human
ugacacauguaacaaccac

SEQ ID NO: 564297 - RNA, 21 nt, Human
ugaugaaaucacagccuaaaa

SEQ ID NO: 564298 - RNA, 23 nt, Human
ugaugaaaucacagccuaaaaac

SEQ ID NO: 564299 - RNA, 22 nt, Human
ugcagcacagcauuacuuuuaa

SEQ ID NO: 564300 - RNA, 20 nt, Human
ugccccacccucuccccauu

SEQ ID NO: 564301 - RNA, 19 nt, Human
uggaacaaaguaaucaaau

SEQ ID NO: 564302 - RNA, 24 nt, Human
uggaauuacaaaggcacuucccua

SEQ ID NO: 564303 - RNA, 28 nt, Human
uguaacaaccacugacaaaaggucaucc

SEQ ID NO: 564304 - RNA, 21 nt, Human
uucuauuacgaaaagcacagc

SEQ ID NO: 564305 - RNA, 23 nt, Human
aaauaucaagagucucaagaacc

SEQ ID NO: 564306 - RNA, 20 nt, Human
acacuacacaaaauaaauac

SEQ ID NO: 564307 - RNA, 21 nt, Human
agacagaaauaucaagagucc

SEQ ID NO: 564308 - RNA, 23 nt, Human
aggagaagacagaaauaucaaga

SEQ ID NO: 564309 - RNA, 23 nt, Human
auuuuuucucugaagaugauacc

SEQ ID NO: 564310 - RNA, 24 nt, Human
caaaauaaauacuuggauaacuca

SEQ ID NO: 564311 - RNA, 25 nt, Human
cacaaaauaaauacuuggauaacuc

SEQ ID NO: 564312 - RNA, 19 nt, Human
cagcuauacacaauuccca

SEQ ID NO: 564313 - RNA, 21 nt, Human
caguuucccacaaaaaaucag

SEQ ID NO: 564314 - RNA, 21 nt, Human
ccacaaaaaaucagcuauaca

SEQ ID NO: 564315 - RNA, 19 nt, Human
cuacacaaaauaaauacuu

SEQ ID NO: 564316 - RNA, 19 nt, Human
cuauauauguauuuuuucc

SEQ ID NO: 564317 - RNA, 19 nt, Human
cuuuauuuuuucucugaag

SEQ ID NO: 564318 - RNA, 20 nt, Human
gaaagcacaaggagaagaca

SEQ ID NO: 564319 - RNA, 23 nt, Human
gaaagcacaaggagaagacagaa

SEQ ID NO: 564320 - RNA, 18 nt, Human
ggacuuuggccuacaauu

SEQ ID NO: 564321 - RNA, 20 nt, Human
uaccuguccuuuugauguua

SEQ ID NO: 564322 - RNA, 19 nt, Human
uacucuuagugaagagaca

SEQ ID NO: 564323 - RNA, 21 nt, Human
uagaaaguucaacuggacuuu

SEQ ID NO: 564324 - RNA, 24 nt, Human
ucccaaacucauuuuaugagccuc

SEQ ID NO: 564325 - RNA, 22 nt, Human
uucccacaaaaaaucagcuaua

SEQ ID NO: 564326 - RNA, 21 nt, Human
uuuaugagccucaucaagauu

SEQ ID NO: 564327 - RNA, 21 nt, Human
uuucccacaaaaaaucagcua

SEQ ID NO: 564328 - RNA, 24 nt, Human
aacaaggaacaaggcagcccacaa

SEQ ID NO: 564329 - RNA, 22 nt, Human
aauacagguagcaaagguccac

SEQ ID NO: 564330 - RNA, 20 nt, Human
acccaagcgaacacguccaa

SEQ ID NO: 564331 - RNA, 20 nt, Human
agaagagggugagggaaggg

SEQ ID NO: 564332 - RNA, 21 nt, Human
agagaggcuccggccgccccc

SEQ ID NO: 564333 - RNA, 20 nt, Human
agagauugcgagguggcugc

SEQ ID NO: 564334 - RNA, 25 nt, Human
agagggugagggaaggggugaagag

SEQ ID NO: 564335 - RNA, 25 nt, Human
agcaaaaugaggccacugguauuaa

SEQ ID NO: 564336 - RNA, 20 nt, Human
agugaagggcauguucuaga

SEQ ID NO: 564337 - RNA, 24 nt, Human
augauacagcaaaaugaggccacc

SEQ ID NO: 564338 - RNA, 23 nt, Human
caagcgaacacguccaacccucg

SEQ ID NO: 564339 - RNA, 18 nt, Human
caccguggggugugaggc

SEQ ID NO: 564340 - RNA, 19 nt, Human
cagcaaaaugaggccacug

SEQ ID NO: 564341 - RNA, 20 nt, Human
caggagccaagcgggucgcg

SEQ ID NO: 564342 - RNA, 23 nt, Human
caggagccaagcgggucgcggag

SEQ ID NO: 564343 - RNA, 20 nt, Human
caggggcaguggccagggac

SEQ ID NO: 564344 - RNA, 20 nt, Human
caguagcuugcgagcggcga

SEQ ID NO: 564345 - RNA, 21 nt, Human
cagugaagggcauguucuaga

SEQ ID NO: 564346 - RNA, 24 nt, Human
ccagcuuuaauccuuuucaaacau

SEQ ID NO: 564347 - RNA, 21 nt, Human
ccgcugccgccgcugccuccg

SEQ ID NO: 564348 - RNA, 18 nt, Human
ccguggggugugaggcug

SEQ ID NO: 564349 - RNA, 21 nt, Human
ccuacccgacgggcucaggag

SEQ ID NO: 564350 - RNA, 21 nt, Human
cgagcggcgaucgaugcagag

SEQ ID NO: 564351 - RNA, 22 nt, Human
cggcaggggcaguggccaggga

SEQ ID NO: 564352 - RNA, 18 nt, Human
cggcccgggugagagcgg

SEQ ID NO: 564353 - RNA, 24 nt, Human
cgggggcagcugaggcgccgggcu

SEQ ID NO: 564354 - RNA, 24 nt, Human
cuagauccuuucugaagucgaaaa

SEQ ID NO: 564355 - RNA, 19 nt, Human
cucccccgagagaggcucc

SEQ ID NO: 564356 - RNA, 25 nt, Human
cuuugcgccgcgccugaggcgcuuc

SEQ ID NO: 564357 - RNA, 24 nt, Human
gaaagaagagggugagggaagggg

SEQ ID NO: 564358 - RNA, 18 nt, Human
gagagcgggaggggcggu

SEQ ID NO: 564359 - RNA, 27 nt, Human
gagaggcuccggccgcccccgccgucc

SEQ ID NO: 564360 - RNA, 18 nt, Human
gagggaaggggugaagag

SEQ ID NO: 564361 - RNA, 20 nt, Human
gcccgaguacggucaguagc

SEQ ID NO: 564362 - RNA, 18 nt, Human
gccgcugccgccgcugcc

SEQ ID NO: 564363 - RNA, 22 nt, Human
gcgccgcgccugaggcgcuucu

SEQ ID NO: 564364 - RNA, 21 nt, Human
ggccgggggcagcugaggcgc

SEQ ID NO: 564365 - RNA, 22 nt, Human
ggccgggggcagcugaggcgcc

SEQ ID NO: 564366 - RNA, 18 nt, Human
ggcucaggagccaagcgg

SEQ ID NO: 564367 - RNA, 21 nt, Human
ggcugccgcagcaggaaccca

SEQ ID NO: 564368 - RNA, 21 nt, Human
gggacgggugacgaaagaaga

SEQ ID NO: 564369 - RNA, 19 nt, Human
ggggcgguggcgggcagaa

SEQ ID NO: 564370 - RNA, 23 nt, Human
ggggugaagagcgggaacucgag

SEQ ID NO: 564371 - RNA, 23 nt, Human
gggguucuuccgccuccucaggc

SEQ ID NO: 564372 - RNA, 23 nt, Human
gggugugaggcuggaacgcggcu

SEQ ID NO: 564373 - RNA, 25 nt, Human
ggugacgaaagaagagggugaggga

SEQ ID NO: 564374 - RNA, 25 nt, Human
uacacaaccagugaagggcauguuc

SEQ ID NO: 564375 - RNA, 20 nt, Human
uacagcaaaaugaggccacu

SEQ ID NO: 564376 - RNA, 19 nt, Human
uacccgacgggcucaggag

SEQ ID NO: 564377 - RNA, 22 nt, Human
uauaagaagccaaauuguaaug

SEQ ID NO: 564378 - RNA, 27 nt, Human
uccgcggcaggggcaguggccagggac

SEQ ID NO: 564379 - RNA, 18 nt, Human
ucgaaaacagcaccgugg

SEQ ID NO: 564380 - RNA, 19 nt, Human
ucgcggagcgccggcugug

SEQ ID NO: 564381 - RNA, 23 nt, Human
ucggggacgggugacgaaagaag

SEQ ID NO: 564382 - RNA, 23 nt, Human
ucuacaguuuuauuuacacaacc

SEQ ID NO: 564383 - RNA, 18 nt, Human
ucuuccgccuccucaggc

SEQ ID NO: 564384 - RNA, 20 nt, Human
ugcaugucauaauugggacc

SEQ ID NO: 564385 - RNA, 24 nt, Human
ugcaugucauaauugggaccucuu

SEQ ID NO: 564386 - RNA, 23 nt, Human
ugccacugacgaaagcuugaaau

SEQ ID NO: 564387 - RNA, 27 nt, Human
ugccgcagcaggaacccaagcgaacac

SEQ ID NO: 564388 - RNA, 23 nt, Human
uggcauugcugcaugucauaauu

SEQ ID NO: 564389 - RNA, 21 nt, Human
ugggaccucuugcaacaacuc

SEQ ID NO: 564390 - RNA, 19 nt, Human
uggggucggggacggguga

SEQ ID NO: 564391 - RNA, 22 nt, Human
uuuacacaaccagugaagggcu

SEQ ID NO: 564392 - RNA, 24 nt, Human
uuuuuuuuuuuuuuuuuugucauu

SEQ ID NO: 564393 - RNA, 24 nt, Human
uuuuuuuuuuuuuuuuuuuuuggg

SEQ ID NO: 564394 - RNA, 19 nt, Human
aaaacaaaaacaaaaaaca

SEQ ID NO: 564395 - RNA, 23 nt, Human
aaaauacaaaaacaaaauuagcc

SEQ ID NO: 564396 - RNA, 21 nt, Human
aaacaaaaacaaaaaacaaaa

SEQ ID NO: 564397 - RNA, 24 nt, Human
aaacaaaaacaaaaaacaaaauua

SEQ ID NO: 564398 - RNA, 20 nt, Human
aacauggugaaacccugccu

SEQ ID NO: 564399 - RNA, 21 nt, Human
aacauggugaaacccugccuc

SEQ ID NO: 564400 - RNA, 24 nt, Human
acccugccucuacuaaaaauacaa

SEQ ID NO: 564401 - RNA, 18 nt, Human
acugcacuucagccuggg

SEQ ID NO: 564402 - RNA, 24 nt, Human
acugcacuucagccugggagacag

SEQ ID NO: 564403 - RNA, 24 nt, Human
acuucagccugggagacagagcga

SEQ ID NO: 564404 - RNA, 20 nt, Human
agagagaguggguuagagag

SEQ ID NO: 564405 - RNA, 24 nt, Human
agcacuuugggaggccgaggaggg

SEQ ID NO: 564406 - RNA, 19 nt, Human
agccaggcgugguggcggg

SEQ ID NO: 564407 - RNA, 22 nt, Human
agccuggucaacauggugaaac

SEQ ID NO: 564408 - RNA, 24 nt, Human
agccuggucaacauggugaaaccc

SEQ ID NO: 564409 - RNA, 23 nt, Human
agcugggcaugguggugcaugcc

SEQ ID NO: 564410 - RNA, 18 nt, Human
aggccgaggagggcagau

SEQ ID NO: 564411 - RNA, 24 nt, Human
aggcgggagaauggugugaaccug

SEQ ID NO: 564412 - RNA, 18 nt, Human
aggcugaggcgggagaau

SEQ ID NO: 564413 - RNA, 18 nt, Human
aggcugaggcgggagaau

SEQ ID NO: 564414 - RNA, 24 nt, Human
agguggagcuugcagugagccgag

SEQ ID NO: 564415 - RNA, 24 nt, Human
aucgugccacugcacuucagccug

SEQ ID NO: 564416 - RNA, 19 nt, Human
caaaacaaaaacaaaaaac

SEQ ID NO: 564417 - RNA, 19 nt, Human
caacauggugaaacccugc

SEQ ID NO: 564418 - RNA, 22 nt, Human
caacauggugaaacccugccuc

SEQ ID NO: 564419 - RNA, 24 nt, Human
caacauggugaaacccugccucua

SEQ ID NO: 564420 - RNA, 24 nt, Human
cacgccuguaaucccagcacuuug

SEQ ID NO: 564421 - RNA, 18 nt, Human
cacugcacuucagccugg

SEQ ID NO: 564422 - RNA, 19 nt, Human
cacugcacuucagccuggg

SEQ ID NO: 564423 - RNA, 22 nt, Human
cacugcacuucagccugggaga

SEQ ID NO: 564424 - RNA, 24 nt, Human
cacugcacuucagccugggagaca

SEQ ID NO: 564425 - RNA, 25 nt, Human
cacugcacuucagccugggagacag

SEQ ID NO: 564426 - RNA, 23 nt, Human
cacuucagccugggagacagagc

SEQ ID NO: 564427 - RNA, 24 nt, Human
cacuucagccugggagacagagcg

SEQ ID NO: 564428 - RNA, 23 nt, Human
cagcacuuugggaggccgaggag

SEQ ID NO: 564429 - RNA, 24 nt, Human
cagcacuuugggaggccgaggagg

SEQ ID NO: 564430 - RNA, 21 nt, Human
cagccugggagacagagcgag

SEQ ID NO: 564431 - RNA, 24 nt, Human
cagcuacucagaaggcugaggcgg

SEQ ID NO: 564432 - RNA, 21 nt, Human
caugccuguagucccggcuac

SEQ ID NO: 564433 - RNA, 19 nt, Human
ccacugcacuucagccugg

SEQ ID NO: 564434 - RNA, 20 nt, Human
ccacugcacuucagccuggg

SEQ ID NO: 564435 - RNA, 22 nt, Human
ccacugcacuucagccugggag

SEQ ID NO: 564436 - RNA, 24 nt, Human
ccacugcacuucagccugggagac

SEQ ID NO: 564437 - RNA, 18 nt, Human
ccccacaauccugcugug

SEQ ID NO: 564438 - RNA, 22 nt, Human
ccuggucaacauggugaaaccc

SEQ ID NO: 564439 - RNA, 24 nt, Human
ccuggucaacauggugaaacccug

SEQ ID NO: 564440 - RNA, 22 nt, Human
ccuguaaucccagcacuuuggg

SEQ ID NO: 564441 - RNA, 22 nt, Human
ccuguagucccggcuacucagg

SEQ ID NO: 564442 - RNA, 26 nt, Human
cgaggagggcagaugaucugagguca

SEQ ID NO: 564443 - RNA, 23 nt, Human
cgccuguaaucccagcacuuugg

SEQ ID NO: 564444 - RNA, 19 nt, Human
cgccuguacucccagcuac

SEQ ID NO: 564445 - RNA, 24 nt, Human
cgccuguacucccagcuacucaga

SEQ ID NO: 564446 - RNA, 22 nt, Human
cucacgccuguaaucccagcac

SEQ ID NO: 564447 - RNA, 24 nt, Human
cucacgccuguaaucccagcacuu

SEQ ID NO: 564448 - RNA, 18 nt, Human
cucagaaggcugaggcgg

SEQ ID NO: 564449 - RNA, 20 nt, Human
cucuacuaaaaauacaaaaa

SEQ ID NO: 564450 - RNA, 24 nt, Human
cuugcagugagccgagaucgugcc

SEQ ID NO: 564451 - RNA, 19 nt, Human
gaaacccugccucuacuaa

SEQ ID NO: 564452 - RNA, 23 nt, Human
gagaucgugccacugcacuucag

SEQ ID NO: 564453 - RNA, 18 nt, Human
gagcaggaguggguuaga

SEQ ID NO: 564454 - RNA, 23 nt, Human
gagcuugcagugagccgagaucg

SEQ ID NO: 564455 - RNA, 24 nt, Human
gagggccgggcgcgguggcucacg

SEQ ID NO: 564456 - RNA, 24 nt, Human
gaugaucugaggucagcaguucgg

SEQ ID NO: 564457 - RNA, 24 nt, Human
gcacuucagccugggagacagagc

SEQ ID NO: 564458 - RNA, 21 nt, Human
gcagccuggucaacaugguga

SEQ ID NO: 564459 - RNA, 20 nt, Human
gccgagaucgugccacugca

SEQ ID NO: 564460 - RNA, 18 nt, Human
gcgccuguacucccagcu

SEQ ID NO: 564461 - RNA, 22 nt, Human
ggagacugaggcagccucgugc

SEQ ID NO: 564462 - RNA, 24 nt, Human
ggagcuugcagugagccgagaucg

SEQ ID NO: 564463 - RNA, 24 nt, Human
gggcgcgguggcucacgccuguaa

SEQ ID NO: 564464 - RNA, 22 nt, Human
gggcuagagaacgagcaaggga

SEQ ID NO: 564465 - RNA, 23 nt, Human
ggugcaugccuguagucccggcu

SEQ ID NO: 564466 - RNA, 23 nt, Human
gguggcucacgccuguaauccca

SEQ ID NO: 564467 - RNA, 24 nt, Human
gguggcucacgccuguaaucccag

SEQ ID NO: 564468 - RNA, 21 nt, Human
gugcaugccuguagucccggc

SEQ ID NO: 564469 - RNA, 26 nt, Human
uaaaaauacaaaaacaaaauuagcca

SEQ ID NO: 564470 - RNA, 21 nt, Human
uaaagagggccgggcgcggug

SEQ ID NO: 564471 - RNA, 21 nt, Human
uacaaagaauacaaguaacug

SEQ ID NO: 564472 - RNA, 23 nt, Human
uacaggagcacacaccuaagggg

SEQ ID NO: 564473 - RNA, 26 nt, Human
uccccacaauccugcuguuucccugg

SEQ ID NO: 564474 - RNA, 23 nt, Human
ucgugccacugcacuucagccug

SEQ ID NO: 564475 - RNA, 24 nt, Human
ugaaccugggagguggagcuugca

SEQ ID NO: 564476 - RNA, 20 nt, Human
ugaaugaagggggcaucuug

SEQ ID NO: 564477 - RNA, 20 nt, Human
ugagccagugaaugagugag

SEQ ID NO: 564478 - RNA, 22 nt, Human
ugagccgagaucgugccacugc

SEQ ID NO: 564479 - RNA, 23 nt, Human
ugaggcgggagaauggugugaac

SEQ ID NO: 564480 - RNA, 24 nt, Human
ugccuguagucccggcuacucagg

SEQ ID NO: 564481 - RNA, 24 nt, Human
uggcucacgccuguaaucccagca

SEQ ID NO: 564482 - RNA, 20 nt, Human
ugggaggccgaggagggcag

SEQ ID NO: 564483 - RNA, 22 nt, Human
ugggaggccgaggagggcagau

SEQ ID NO: 564484 - RNA, 29 nt, Human
ugggagguggagcuugcagugacaacggu

SEQ ID NO: 564485 - RNA, 24 nt, Human
ugggagguggagcuugcagugagc

SEQ ID NO: 564486 - RNA, 18 nt, Human
uggugcaugccuguaguc

SEQ ID NO: 564487 - RNA, 23 nt, Human
ugguggugcaugccuguaguccc

SEQ ID NO: 564488 - RNA, 21 nt, Human
ugugcgagggugggcuagaga

SEQ ID NO: 564489 - RNA, 19 nt, Human
ugugcgcacaccacaggug

SEQ ID NO: 564490 - RNA, 24 nt, Human
uuagcugggcaugguggugcaugc

SEQ ID NO: 564491 - RNA, 18 nt, Human
uugcagugagccgagauc

SEQ ID NO: 564492 - RNA, 21 nt, Human
uugcagugagccgagaucgug

SEQ ID NO: 564493 - RNA, 22 nt, Human
uugcagugagccgagaucgugc

SEQ ID NO: 564494 - RNA, 25 nt, Human
uuuuuuuuuuccccuuuuucacauu

SEQ ID NO: 564495 - RNA, 24 nt, Human
uuuuuuuuuuuuuuuccccuuuuu

SEQ ID NO: 564496 - RNA, 18 nt, Human
aacucacagggaaaacgg

SEQ ID NO: 564497 - RNA, 22 nt, Human
augcauccugcucuccaggguc

SEQ ID NO: 564498 - RNA, 19 nt, Human
cagagcucacggacaccac

SEQ ID NO: 564499 - RNA, 20 nt, Human
caggcggaacagcugagacc

SEQ ID NO: 564500 - RNA, 21 nt, Human
cauccugcucuccagggucca

SEQ ID NO: 564501 - RNA, 22 nt, Human
cauccugcucuccaggguccac

SEQ ID NO: 564502 - RNA, 23 nt, Human
ccagaaguccuuugcagagcuga

SEQ ID NO: 564503 - RNA, 24 nt, Human
ccagaaguccuuugcagagcugaa

SEQ ID NO: 564504 - RNA, 24 nt, Human
ccagagcucacggacaccacugac

SEQ ID NO: 564505 - RNA, 21 nt, Human
ccagcccgccagcucuggcug

SEQ ID NO: 564506 - RNA, 21 nt, Human
cccaguacguauaccucguug

SEQ ID NO: 564507 - RNA, 24 nt, Human
cccuugccagcccgccagcucugg

SEQ ID NO: 564508 - RNA, 22 nt, Human
ccgccagcucuggcugggagga

SEQ ID NO: 564509 - RNA, 21 nt, Human
cgccucaggcggaacagcuga

SEQ ID NO: 564510 - RNA, 18 nt, Human
cggcccggagcaggucaa

SEQ ID NO: 564511 - RNA, 19 nt, Human
cucacagggaaaacggggc

SEQ ID NO: 564512 - RNA, 25 nt, Human
cuggcugggaggacuugcucuuggg

SEQ ID NO: 564513 - RNA, 19 nt, Human
gacaccacugacaguaugg

SEQ ID NO: 564514 - RNA, 18 nt, Human
gacaguaugggggguguu

SEQ ID NO: 564515 - RNA, 20 nt, Human
gacugagggcgagggucccc

SEQ ID NO: 564516 - RNA, 19 nt, Human
gcagccugcaucaggagcc

SEQ ID NO: 564517 - RNA, 19 nt, Human
gcuuuuuggccagaagucc

SEQ ID NO: 564518 - RNA, 20 nt, Human
ggcggcccgcggcccggagc

SEQ ID NO: 564519 - RNA, 20 nt, Human
uaugcauccugcucuccagg

SEQ ID NO: 564520 - RNA, 21 nt, Human
uaugggggguguucugcuugg

SEQ ID NO: 564521 - RNA, 19 nt, Human
uauuguagcacauuucauc

SEQ ID NO: 564522 - RNA, 24 nt, Human
ucaggagccuccacuuuccccagu

SEQ ID NO: 564523 - RNA, 22 nt, Human
ucugcagccugcaucaggagcc

SEQ ID NO: 564524 - RNA, 23 nt, Human
ucugcagccugcaucaggagccu

SEQ ID NO: 564525 - RNA, 21 nt, Human
ucugguggcagggcccagagc

SEQ ID NO: 564526 - RNA, 24 nt, Human
ugacaguaugggggguguucugcu

SEQ ID NO: 564527 - RNA, 22 nt, Human
uggcagggcccagagcucacgg

SEQ ID NO: 564528 - RNA, 24 nt, Human
ugggggguguucugcuuggcacca

SEQ ID NO: 564529 - RNA, 23 nt, Human
uguucugcuuggcaccaugucug

SEQ ID NO: 564530 - RNA, 20 nt, Human
uuugcagagcugaauauccc

SEQ ID NO: 564531 - RNA, 24 nt, Human
aaaaacaacagagaggacccaccc

SEQ ID NO: 564532 - RNA, 18 nt, Human
aaaacaacagagaggacc

SEQ ID NO: 564533 - RNA, 21 nt, Human
aaaacaacagagaggacccac

SEQ ID NO: 564534 - RNA, 24 nt, Human
aagaggccagagaggcugugagug

SEQ ID NO: 564535 - RNA, 21 nt, Human
aagggaagaggccagagaggc

SEQ ID NO: 564536 - RNA, 18 nt, Human
aaggugucccccaucccc

SEQ ID NO: 564537 - RNA, 24 nt, Human
aaggugucccccauccccagaccu

SEQ ID NO: 564538 - RNA, 26 nt, Human
aaggugucccccauccccagaccugg

SEQ ID NO: 564539 - RNA, 20 nt, Human
aaguagcgacucggaggcgg

SEQ ID NO: 564540 - RNA, 23 nt, Human
aaucagaugcaguaacacugauu

SEQ ID NO: 564541 - RNA, 22 nt, Human
acagcuuucuugaggaaggcuu

SEQ ID NO: 564542 - RNA, 23 nt, Human
accaaguucgaggcggggggguc

SEQ ID NO: 564543 - RNA, 18 nt, Human
acgcccggcccggcccgg

SEQ ID NO: 564544 - RNA, 24 nt, Human
acgcuuucugcgcucuugccgcuc

SEQ ID NO: 564545 - RNA, 19 nt, Human
acuguaccccaccaaauca

SEQ ID NO: 564546 - RNA, 19 nt, Human
agagaggaagaucucccca

SEQ ID NO: 564547 - RNA, 22 nt, Human
agagaggaagaucuccccaggg

SEQ ID NO: 564548 - RNA, 21 nt, Human
agagaggacccacccccaggg

SEQ ID NO: 564549 - RNA, 21 nt, Human
agcgacucggaggcgggggcg

SEQ ID NO: 564550 - RNA, 23 nt, Human
agcgccccgggacccagcccccc

SEQ ID NO: 564551 - RNA, 18 nt, Human
agcggcggcggcggcggc

SEQ ID NO: 564552 - RNA, 22 nt, Human
agcggcggcggcggcggcggcc

SEQ ID NO: 564553 - RNA, 18 nt, Human
aggcugcaggccauucac

SEQ ID NO: 564554 - RNA, 24 nt, Human
aggggcccaggccacuuccaucuu

SEQ ID NO: 564555 - RNA, 21 nt, Human
aggucgaggcagguggcccgc

SEQ ID NO: 564556 - RNA, 26 nt, Human
aucuccuccagacgcuuucugcgcuc

SEQ ID NO: 564557 - RNA, 24 nt, Human
auuguaccgcccgggcugggccug

SEQ ID NO: 564558 - RNA, 22 nt, Human
caaaucaaggcaaauacuacag

SEQ ID NO: 564559 - RNA, 23 nt, Human
caacagagaggacccacccccag

SEQ ID NO: 564560 - RNA, 23 nt, Human
caaggcaaacccucuuaaaggac

SEQ ID NO: 564561 - RNA, 22 nt, Human
cacgcccggcccggcccggccc

SEQ ID NO: 564562 - RNA, 21 nt, Human
cagccucccggcgccucuccc

SEQ ID NO: 564563 - RNA, 18 nt, Human
cagcuuucuugaggaagg

SEQ ID NO: 564564 - RNA, 22 nt, Human
cauucuccuggugugcugggag

SEQ ID NO: 564565 - RNA, 21 nt, Human
ccaaggcaaacccucuuaaag

SEQ ID NO: 564566 - RNA, 27 nt, Human
ccaccaaaucaaggcaaauacuacagg

SEQ ID NO: 564567 - RNA, 20 nt, Human
ccaccccagcagcgccccgg

SEQ ID NO: 564568 - RNA, 24 nt, Human
ccaccccagcagcgccccgggacc

SEQ ID NO: 564569 - RNA, 21 nt, Human
ccagacauccugguaggugau

SEQ ID NO: 564570 - RNA, 20 nt, Human
ccagacgcuuucugcgcucu

SEQ ID NO: 564571 - RNA, 24 nt, Human
ccagcagcgccccgggacccagcc

SEQ ID NO: 564572 - RNA, 20 nt, Human
ccagccccccgcgcccgcgc

SEQ ID NO: 564573 - RNA, 19 nt, Human
cccaggccacuuccaucuu

SEQ ID NO: 564574 - RNA, 22 nt, Human
cccagggggcuuuggggggagg

SEQ ID NO: 564575 - RNA, 21 nt, Human
cccagucccggccucggccca

SEQ ID NO: 564576 - RNA, 23 nt, Human
cccagucccggccucggcccaac

SEQ ID NO: 564577 - RNA, 18 nt, Human
cccauccccagaccuggg

SEQ ID NO: 564578 - RNA, 18 nt, Human
ccccagggggcuuugggg

SEQ ID NO: 564579 - RNA, 20 nt, Human
ccccagggggcuuugggggg

SEQ ID NO: 564580 - RNA, 19 nt, Human
ccccccgcgcccgcgccgu

SEQ ID NO: 564581 - RNA, 20 nt, Human
cccccgccccggagccccgc

SEQ ID NO: 564582 - RNA, 20 nt, Human
cccccgcgcccgcgccgucc

SEQ ID NO: 564583 - RNA, 24 nt, Human
ccccgcgcccgcagccucccggcg

SEQ ID NO: 564584 - RNA, 18 nt, Human
ccccggagccccgcgccc

SEQ ID NO: 564585 - RNA, 19 nt, Human
cccgcagccucccggcgcc

SEQ ID NO: 564586 - RNA, 24 nt, Human
cccgcagccucccggcgccucucc

SEQ ID NO: 564587 - RNA, 25 nt, Human
cccggccucggcccaacccuauugu

SEQ ID NO: 564588 - RNA, 19 nt, Human
cccgugccagcugcuccuc

SEQ ID NO: 564589 - RNA, 22 nt, Human
cccgugccagcugcuccucucg

SEQ ID NO: 564590 - RNA, 23 nt, Human
ccgcccgggcugggccuggccuc

SEQ ID NO: 564591 - RNA, 22 nt, Human
ccgccuccgggccuccgccucc

SEQ ID NO: 564592 - RNA, 23 nt, Human
ccgccuccgggccuccgccuccc

SEQ ID NO: 564593 - RNA, 18 nt, Human
ccgcgcccgcagccuccc

SEQ ID NO: 564594 - RNA, 22 nt, Human
ccgcgcccgcagccucccggcg

SEQ ID NO: 564595 - RNA, 22 nt, Human
ccgcgcccgcagccucccggcg

SEQ ID NO: 564596 - RNA, 22 nt, Human
ccgcgccguucgcgccgccccc

SEQ ID NO: 564597 - RNA, 23 nt, Human
ccgcggcgcaucacgcccggccc

SEQ ID NO: 564598 - RNA, 19 nt, Human
ccgcuccgccucuucccgc

SEQ ID NO: 564599 - RNA, 22 nt, Human
ccucacaacugugcccggaucc

SEQ ID NO: 564600 - RNA, 20 nt, Human
ccucugcaaagggcaggagu

SEQ ID NO: 564601 - RNA, 25 nt, Human
ccugcugcuggaagugcuuuucccg

SEQ ID NO: 564602 - RNA, 25 nt, Human
cgcccccgccccggagccccgcgcc

SEQ ID NO: 564603 - RNA, 19 nt, Human
cgcccgggcugggccuggc

SEQ ID NO: 564604 - RNA, 19 nt, Human
cgcccgggcugggccuggc

SEQ ID NO: 564605 - RNA, 23 nt, Human
cgccggcccagucccggccucgg

SEQ ID NO: 564606 - RNA, 24 nt, Human
cgccggcccagucccggccucggc

SEQ ID NO: 564607 - RNA, 23 nt, Human
cgccucccgcuccgcccgggccu

SEQ ID NO: 564608 - RNA, 22 nt, Human
cgcggcgcaucacgcccggccc

SEQ ID NO: 564609 - RNA, 22 nt, Human
cggcccggcccggcaaguagcg

SEQ ID NO: 564610 - RNA, 18 nt, Human
cgugccuccugcuccucc

SEQ ID NO: 564611 - RNA, 18 nt, Human
cuauuguaccgcccgggc

SEQ ID NO: 564612 - RNA, 19 nt, Human
cucagcggcggcggcggcg

SEQ ID NO: 564613 - RNA, 26 nt, Human
cucagcggcggcggcggcggcggccu

SEQ ID NO: 564614 - RNA, 25 nt, Human
cuccagacgcugccgcuccgccucu

SEQ ID NO: 564615 - RNA, 21 nt, Human
cucccgugccagcugcuccuc

SEQ ID NO: 564616 - RNA, 22 nt, Human
cuccgcccgggccucggccucc

SEQ ID NO: 564617 - RNA, 19 nt, Human
cuccucccgccuccgggcc

SEQ ID NO: 564618 - RNA, 19 nt, Human
cucgugccuccugcuccuc

SEQ ID NO: 564619 - RNA, 22 nt, Human
cucuugcuccugcugcuggaag

SEQ ID NO: 564620 - RNA, 20 nt, Human
cugcuccucccgccuccggg

SEQ ID NO: 564621 - RNA, 19 nt, Human
cugggccuggccucucgcu

SEQ ID NO: 564622 - RNA, 23 nt, Human
cuugaggaaggcuucugccucug

SEQ ID NO: 564623 - RNA, 18 nt, Human
cuuucugcuucugcagcc

SEQ ID NO: 564624 - RNA, 23 nt, Human
gccccggagccccgcgcccgcag

SEQ ID NO: 564625 - RNA, 24 nt, Human
gccccggagccccgcgcccgcagc

SEQ ID NO: 564626 - RNA, 27 nt, Human
gccccggagccccgcgcccgcagccuc

SEQ ID NO: 564627 - RNA, 23 nt, Human
gccccgggacccagccccccgcg

SEQ ID NO: 564628 - RNA, 18 nt, Human
gcccuggggaccgagccc

SEQ ID NO: 564629 - RNA, 20 nt, Human
gccggcccagucccggccuc

SEQ ID NO: 564630 - RNA, 20 nt, Human
gccguccgcgccguucgcgc

SEQ ID NO: 564631 - RNA, 20 nt, Human
gcggcggcggcggcggccag

SEQ ID NO: 564632 - RNA, 25 nt, Human
gcggcggcggcggcggccaguggcc

SEQ ID NO: 564633 - RNA, 22 nt, Human
gcugccgcuccgccucuucccg

SEQ ID NO: 564634 - RNA, 21 nt, Human
gcugggccuggccucucgcug

SEQ ID NO: 564635 - RNA, 23 nt, Human
ggacaggggucccgcggcgcauc

SEQ ID NO: 564636 - RNA, 20 nt, Human
ggcggcggcggcggccagug

SEQ ID NO: 564637 - RNA, 23 nt, Human
ggcggcggcggcggccaguggcc

SEQ ID NO: 564638 - RNA, 21 nt, Human
gggacccagccccccgcgccc

SEQ ID NO: 564639 - RNA, 18 nt, Human
gggccuggccucucgcug

SEQ ID NO: 564640 - RNA, 18 nt, Human
gggggagggucugccucc

SEQ ID NO: 564641 - RNA, 19 nt, Human
ggggggagggucugccucc

SEQ ID NO: 564642 - RNA, 29 nt, Human
ggggucucagcggcggcggcggcggcggg

SEQ ID NO: 564643 - RNA, 20 nt, Human
ggugucccccauccccagac

SEQ ID NO: 564644 - RNA, 18 nt, Human
gugccggucgcccggggu

SEQ ID NO: 564645 - RNA, 20 nt, Human
guggccccuccccaagggaa

SEQ ID NO: 564646 - RNA, 25 nt, Human
uaaaaacaacagagaggacccaccc

SEQ ID NO: 564647 - RNA, 19 nt, Human
uaaucagaugcaguaacac

SEQ ID NO: 564648 - RNA, 23 nt, Human
ucagacucuuguccccagagggu

SEQ ID NO: 564649 - RNA, 23 nt, Human
uccaaggcaaacccucuuaaagg

SEQ ID NO: 564650 - RNA, 22 nt, Human
uccucuuucugcuucugcagcc

SEQ ID NO: 564651 - RNA, 23 nt, Human
uccucuuucugcuucugcagccg

SEQ ID NO: 564652 - RNA, 19 nt, Human
uccugcuccucccgccucc

SEQ ID NO: 564653 - RNA, 18 nt, Human
uccugcuucuugguuuca

SEQ ID NO: 564654 - RNA, 21 nt, Human
uccuggugugcugggagaggc

SEQ ID NO: 564655 - RNA, 22 nt, Human
ucgcccggggucucucggcugc

SEQ ID NO: 564656 - RNA, 22 nt, Human
ucggccuccucuuucugcuucu

SEQ ID NO: 564657 - RNA, 26 nt, Human
ucucggaggugccggucgcccggggu

SEQ ID NO: 564658 - RNA, 21 nt, Human
ucugagcacaagcuauuuaca

SEQ ID NO: 564659 - RNA, 19 nt, Human
ucugcagcccuggggaccg

SEQ ID NO: 564660 - RNA, 20 nt, Human
ucugggcuggaaccguuggc

SEQ ID NO: 564661 - RNA, 25 nt, Human
ugaagcaaccaguauccuguggccc

SEQ ID NO: 564662 - RNA, 20 nt, Human
ugcacagccuccuucugcag

SEQ ID NO: 564663 - RNA, 26 nt, Human
ugcacugaggggcagaucuggcuccg

SEQ ID NO: 564664 - RNA, 21 nt, Human
ugccuccugcuccucccgccu

SEQ ID NO: 564665 - RNA, 19 nt, Human
uggcaacuccuugcuuggg

SEQ ID NO: 564666 - RNA, 19 nt, Human
ugggagacuccacugaggc

SEQ ID NO: 564667 - RNA, 23 nt, Human
uggugugcugggagaggcugcag

SEQ ID NO: 564668 - RNA, 23 nt, Human
uguaccgcccgggcugggccugg

SEQ ID NO: 564669 - RNA, 20 nt, Human
uguccugcuucuugguuuca

SEQ ID NO: 564670 - RNA, 21 nt, Human
ugugaccugcggggacugcac

SEQ ID NO: 564671 - RNA, 19 nt, Human
ugugaguguauaugugugu

SEQ ID NO: 564672 - RNA, 22 nt, Human
ugugaguguauauguguguaug

SEQ ID NO: 564673 - RNA, 21 nt, Human
ugugcugggagaggcugcagg

SEQ ID NO: 564674 - RNA, 22 nt, Human
uguucugucuuuuucuccucca

SEQ ID NO: 564675 - RNA, 22 nt, Human
uuaaaaacaacagagaggaccc

SEQ ID NO: 564676 - RNA, 26 nt, Human
uucaugaucuccuccagacgcuuucu

SEQ ID NO: 564677 - RNA, 21 nt, Human
uuuaaucagaugcaguaacac

SEQ ID NO: 564678 - RNA, 23 nt, Human
aaagaguacuuggaauguuugac

SEQ ID NO: 564679 - RNA, 18 nt, Human
aaaugacgcacaugagaa

SEQ ID NO: 564680 - RNA, 22 nt, Human
aacgaguuaaaaguuccacuug

SEQ ID NO: 564681 - RNA, 18 nt, Human
acccugaggaccuuugac

SEQ ID NO: 564682 - RNA, 22 nt, Human
acgccuuccaaaauaagauugc

SEQ ID NO: 564683 - RNA, 19 nt, Human
agacaaagguauugugaac

SEQ ID NO: 564684 - RNA, 21 nt, Human
aggaauucucugcuagaaaug

SEQ ID NO: 564685 - RNA, 18 nt, Human
aucccaaaacugggcaua

SEQ ID NO: 564686 - RNA, 22 nt, Human
caaaauuaauguuuugaagcac

SEQ ID NO: 564687 - RNA, 21 nt, Human
caaagagacguugccaccaug

SEQ ID NO: 564688 - RNA, 19 nt, Human
caaauaauacagagaugaa

SEQ ID NO: 564689 - RNA, 18 nt, Human
caaugcgcuggccagcac

SEQ ID NO: 564690 - RNA, 21 nt, Human
cacagaguuauucacaaucug

SEQ ID NO: 564691 - RNA, 23 nt, Human
cacagcucaaaucucaguaaccu

SEQ ID NO: 564692 - RNA, 23 nt, Human
cagaacucucuucucaccuguaa

SEQ ID NO: 564693 - RNA, 24 nt, Human
cauccaaagagacguugccaccau

SEQ ID NO: 564694 - RNA, 22 nt, Human
ccaaaaguguucugaagcugaa

SEQ ID NO: 564695 - RNA, 21 nt, Human
ccaaaugguuuggaggucaaa

SEQ ID NO: 564696 - RNA, 18 nt, Human
ccagcaaaacuuuuuucu

SEQ ID NO: 564697 - RNA, 21 nt, Human
ccagguacuaagccauucacu

SEQ ID NO: 564698 - RNA, 20 nt, Human
cccagaagcucccaagucgc

SEQ ID NO: 564699 - RNA, 23 nt, Human
ccuugacauaagguggcgcuaaa

SEQ ID NO: 564700 - RNA, 22 nt, Human
cggcgugacugugaggcaaugc

SEQ ID NO: 564701 - RNA, 20 nt, Human
cgguuugaacugcacgggca

SEQ ID NO: 564702 - RNA, 25 nt, Human
cucaaagaguacuuggaauguuuga

SEQ ID NO: 564703 - RNA, 21 nt, Human
cucaguaaccucacagaguua

SEQ ID NO: 564704 - RNA, 20 nt, Human
cugcuucgaugcuuugucca

SEQ ID NO: 564705 - RNA, 24 nt, Human
cuggccagcacagcucaaaucuca

SEQ ID NO: 564706 - RNA, 19 nt, Human
cuuuggaagaaggcugaag

SEQ ID NO: 564707 - RNA, 22 nt, Human
gauaaggaggaauuaggacuca

SEQ ID NO: 564708 - RNA, 20 nt, Human
gccauuucacgucuguggug

SEQ ID NO: 564709 - RNA, 21 nt, Human
gggaagaucauauacuucagu

SEQ ID NO: 564710 - RNA, 25 nt, Human
gggcaaaaaugugauggagacuuuu

SEQ ID NO: 564711 - RNA, 20 nt, Human
guaaauguugaguuguagau

SEQ ID NO: 564712 - RNA, 24 nt, Human
guacaaauuuaucuggaaaaaucc

SEQ ID NO: 564713 - RNA, 19 nt, Human
gucuagccaacaugcaaga

SEQ ID NO: 564714 - RNA, 21 nt, Human
gucuguggugccaugauucuc

SEQ ID NO: 564715 - RNA, 26 nt, Human
guuggaaucucaacguguguuucaug

SEQ ID NO: 564716 - RNA, 25 nt, Human
uacaaaauauauauacaaaagcaua

SEQ ID NO: 564717 - RNA, 19 nt, Human
uacaauacuaugggcuaga

SEQ ID NO: 564718 - RNA, 19 nt, Human
uagaaagauaaaguuaaca

SEQ ID NO: 564719 - RNA, 23 nt, Human
uagaauggcucucugggacucaa

SEQ ID NO: 564720 - RNA, 19 nt, Human
uagcaauacucuugccuuc

SEQ ID NO: 564721 - RNA, 23 nt, Human
ucaacaucccaaaacugggcaua

SEQ ID NO: 564722 - RNA, 20 nt, Human
ucacaaggagaaggagcuac

SEQ ID NO: 564723 - RNA, 24 nt, Human
ucagauaauuuuuuaacgccuucc

SEQ ID NO: 564724 - RNA, 20 nt, Human
uccaaagagacguugccacc

SEQ ID NO: 564725 - RNA, 19 nt, Human
uccaccaaauaaguauaca

SEQ ID NO: 564726 - RNA, 18 nt, Human
uccacgagcagucacauc

SEQ ID NO: 564727 - RNA, 19 nt, Human
uccaugcugcggcgugacu

SEQ ID NO: 564728 - RNA, 24 nt, Human
uccaugcugcggcgugacugugag

SEQ ID NO: 564729 - RNA, 25 nt, Human
uccaugcugcggcgugacugugagg

SEQ ID NO: 564730 - RNA, 20 nt, Human
uccucuggggcauaaacucc

SEQ ID NO: 564731 - RNA, 21 nt, Human
ucgcagauugacuuuaagugu

SEQ ID NO: 564732 - RNA, 21 nt, Human
ucuaaaaacaucuccacuuuc

SEQ ID NO: 564733 - RNA, 24 nt, Human
ucugaaccaaaaguguucugaagc

SEQ ID NO: 564734 - RNA, 26 nt, Human
ucugaaccaaaaguguucugaagcug

SEQ ID NO: 564735 - RNA, 21 nt, Human
ucuuccuugggugaauucuga

SEQ ID NO: 564736 - RNA, 20 nt, Human
ucuucuguccaucgucacag

SEQ ID NO: 564737 - RNA, 21 nt, Human
ugaagcugaaagcaguccuga

SEQ ID NO: 564738 - RNA, 21 nt, Human
ugaaguuucaccagguucugu

SEQ ID NO: 564739 - RNA, 22 nt, Human
ugaauucugaucucacaguuac

SEQ ID NO: 564740 - RNA, 19 nt, Human
ugacugguaaaacauccaa

SEQ ID NO: 564741 - RNA, 21 nt, Human
ugauguaaugcugggcucuca

SEQ ID NO: 564742 - RNA, 18 nt, Human
uggaagaaggcugaagga

SEQ ID NO: 564743 - RNA, 19 nt, Human
uggaagaaggcugaaggaa

SEQ ID NO: 564744 - RNA, 18 nt, Human
uggaaggcgguuuuguca

SEQ ID NO: 564745 - RNA, 20 nt, Human
ugugagagaagaggagaacc

SEQ ID NO: 564746 - RNA, 23 nt, Human
ugugagagaagaggagaacccug

SEQ ID NO: 564747 - RNA, 20 nt, Human
uuacacaaaaauguauucua

SEQ ID NO: 564748 - RNA, 23 nt, Human
uuacuuuacacaaaaauguauuc

SEQ ID NO: 564749 - RNA, 20 nt, Human
uuccaagcuagcuuuggaag

SEQ ID NO: 564750 - RNA, 22 nt, Human
uuugacugguaaaacauccaaa

SEQ ID NO: 564751 - RNA, 22 nt, Human
aaagaggagaacaugggcugcc

SEQ ID NO: 564752 - RNA, 25 nt, Human
agaaggcaccaagcuagggagacua

SEQ ID NO: 564753 - RNA, 24 nt, Human
agacuagagauagugguggcaggg

SEQ ID NO: 564754 - RNA, 22 nt, Human
agcgcagccagaccauucucca

SEQ ID NO: 564755 - RNA, 23 nt, Human
caccagggacuccaguugaccug

SEQ ID NO: 564756 - RNA, 23 nt, Human
caccucagaauggagucaccagg

SEQ ID NO: 564757 - RNA, 27 nt, Human
cagccagaccauucuccaguuuguguc

SEQ ID NO: 564758 - RNA, 18 nt, Human
caggaagcagagggaaga

SEQ ID NO: 564759 - RNA, 23 nt, Human
cagggggugagaaaagaggagaa

SEQ ID NO: 564760 - RNA, 24 nt, Human
ccaggaugggaaagcaccggaaga

SEQ ID NO: 564761 - RNA, 19 nt, Human
cccaggaugggaaagcacc

SEQ ID NO: 564762 - RNA, 21 nt, Human
ccccacugccaucccagccca

SEQ ID NO: 564763 - RNA, 21 nt, Human
ccuccaggguaugaaggcaag

SEQ ID NO: 564764 - RNA, 22 nt, Human
ccuggcagagaugauucuucuc

SEQ ID NO: 564765 - RNA, 21 nt, Human
cgcccagggcuccauuaugcc

SEQ ID NO: 564766 - RNA, 22 nt, Human
cgcccagggcuccauuaugccc

SEQ ID NO: 564767 - RNA, 26 nt, Human
cgguuccccugucacacccuccuauu

SEQ ID NO: 564768 - RNA, 22 nt, Human
cuagagauagugguggcagggc

SEQ ID NO: 564769 - RNA, 22 nt, Human
cucagggaaagucaggggguga

SEQ ID NO: 564770 - RNA, 20 nt, Human
cugccaucccagcccaaagu

SEQ ID NO: 564771 - RNA, 26 nt, Human
cuucucagggaaagucagggggugag

SEQ ID NO: 564772 - RNA, 28 nt, Human
gagaggagaagcugcacgcaaguucugg

SEQ ID NO: 564773 - RNA, 20 nt, Human
gcccagggcuccauuaugcc

SEQ ID NO: 564774 - RNA, 18 nt, Human
uccuggauacaguggccc

SEQ ID NO: 564775 - RNA, 22 nt, Human
ugacuccugcaggagaaggcac

SEQ ID NO: 564776 - RNA, 19 nt, Human
ugccccacugccaucccag

SEQ ID NO: 564777 - RNA, 23 nt, Human
uggcagagaugauucuucucagg

SEQ ID NO: 564778 - RNA, 23 nt, Human
uguggcugcucugacuccugcag

SEQ ID NO: 564779 - RNA, 23 nt, Human
uucucagggaaagucagggggug

SEQ ID NO: 564780 - RNA, 19 nt, Human
aacauggcacccaacaccc

SEQ ID NO: 564781 - RNA, 19 nt, Human
aagccagguggggauuuug

SEQ ID NO: 564782 - RNA, 22 nt, Human
aggcaccaaaaguaacauggca

SEQ ID NO: 564783 - RNA, 24 nt, Human
aggcacugagcagguagaccucgc

SEQ ID NO: 564784 - RNA, 20 nt, Human
augaaacaccacagaaaguc

SEQ ID NO: 564785 - RNA, 20 nt, Human
augaaucaccugggagagaa

SEQ ID NO: 564786 - RNA, 20 nt, Human
caaaaauaaaaauaugaaau

SEQ ID NO: 564787 - RNA, 19 nt, Human
cagccaaggcacugagcag

SEQ ID NO: 564788 - RNA, 22 nt, Human
cauggcacccaacacccaaaaa

SEQ ID NO: 564789 - RNA, 23 nt, Human
cauuuacucuuucugcagcucua

SEQ ID NO: 564790 - RNA, 23 nt, Human
ccaaaaguaacauggcacccaac

SEQ ID NO: 564791 - RNA, 20 nt, Human
gagugugaacucugaguaga

SEQ ID NO: 564792 - RNA, 21 nt, Human
gcaggagaggcuuauguggca

SEQ ID NO: 564793 - RNA, 23 nt, Human
ggcacccaacacccaaaaauaaa

SEQ ID NO: 564794 - RNA, 18 nt, Human
guggcagcacaagccagg

SEQ ID NO: 564795 - RNA, 22 nt, Human
ucacuagugauuuucuccagau

SEQ ID NO: 564796 - RNA, 19 nt, Human
uggcagcacaagccaggug

SEQ ID NO: 564797 - RNA, 26 nt, Human
ugggagagaaugccuuccagauaggg

SEQ ID NO: 564798 - RNA, 20 nt, Human
uucacuagugauuuucucca

SEQ ID NO: 564799 - RNA, 19 nt, Human
aagcugcuccagggauguu

SEQ ID NO: 564800 - RNA, 20 nt, Human
aaggccuccugcccugacca

SEQ ID NO: 564801 - RNA, 20 nt, Human
aaggccuccugcccugacca

SEQ ID NO: 564802 - RNA, 23 nt, Human
acagagaagggaccuccuggggc

SEQ ID NO: 564803 - RNA, 20 nt, Human
acccugaaguaguguuggaa

SEQ ID NO: 564804 - RNA, 23 nt, Human
agcacagugacaggugggggcag

SEQ ID NO: 564805 - RNA, 20 nt, Human
agcagcagggguccccgagg

SEQ ID NO: 564806 - RNA, 18 nt, Human
aguguuggaagcugcucc

SEQ ID NO: 564807 - RNA, 25 nt, Human
cacagugacaggugggggcaggagg

SEQ ID NO: 564808 - RNA, 22 nt, Human
caccucgcaagcaccugagaaa

SEQ ID NO: 564809 - RNA, 19 nt, Human
ccccaaacacugccacccu

SEQ ID NO: 564810 - RNA, 22 nt, Human
ccccaaacacugccacccugaa

SEQ ID NO: 564811 - RNA, 24 nt, Human
ccccaaacacugccacccugaagu

SEQ ID NO: 564812 - RNA, 18 nt, Human
ccugaaguaguguuggaa

SEQ ID NO: 564813 - RNA, 21 nt, Human
cgccaaggccuccugcccuga

SEQ ID NO: 564814 - RNA, 18 nt, Human
cgcccagugccccaaaca

SEQ ID NO: 564815 - RNA, 26 nt, Human
cuccagucacgccaaggccuccugcc

SEQ ID NO: 564816 - RNA, 21 nt, Human
cuguccggccuccagucacgc

SEQ ID NO: 564817 - RNA, 20 nt, Human
ucgcccagugccccaaacac

SEQ ID NO: 564818 - RNA, 22 nt, Human
ugacaggugggggcaggagcag

SEQ ID NO: 564819 - RNA, 22 nt, Human
ugaucaccucgcaagcaccuga

SEQ ID NO: 564820 - RNA, 19 nt, Human
ugccccaaacacugccacc

SEQ ID NO: 564821 - RNA, 18 nt, Human
uggggcugaggccccugg

SEQ ID NO: 564822 - RNA, 19 nt, Human
uuugccuucugaucaccuc

SEQ ID NO: 564823 - RNA, 24 nt, Human
aagcauugggucuggguucaggag

SEQ ID NO: 564824 - RNA, 21 nt, Human
acaccccauccccaaccuguc

SEQ ID NO: 564825 - RNA, 22 nt, Human
acacugcuucauagcaaggccu

SEQ ID NO: 564826 - RNA, 22 nt, Human
accccauccccaaccuguccac

SEQ ID NO: 564827 - RNA, 18 nt, Human
accuggcucuccaucacu

SEQ ID NO: 564828 - RNA, 23 nt, Human
aggagccacgaugcugccccggg

SEQ ID NO: 564829 - RNA, 22 nt, Human
augcugccccggguaccccccc

SEQ ID NO: 564830 - RNA, 21 nt, Human
caaagaugaaccuggcucucc

SEQ ID NO: 564831 - RNA, 20 nt, Human
cacacaccccauccccaacc

SEQ ID NO: 564832 - RNA, 24 nt, Human
cacugagccagacauucauucaac

SEQ ID NO: 564833 - RNA, 24 nt, Human
cagcaaaguuggcagcuggagcag

SEQ ID NO: 564834 - RNA, 23 nt, Human
cauucaacauuguccauucacac

SEQ ID NO: 564835 - RNA, 18 nt, Human
ccaacagggcagcugggc

SEQ ID NO: 564836 - RNA, 26 nt, Human
ccccauccccaaccuguccacggguc

SEQ ID NO: 564837 - RNA, 21 nt, Human
cccgggaaggaacugggaagg

SEQ ID NO: 564838 - RNA, 19 nt, Human
ccuguccacgggucccugg

SEQ ID NO: 564839 - RNA, 21 nt, Human
cgagccaagccacugcgaaac

SEQ ID NO: 564840 - RNA, 23 nt, Human
cuccaucacugagccagacauuc

SEQ ID NO: 564841 - RNA, 25 nt, Human
cuccugugaugagcacaggguaccc

SEQ ID NO: 564842 - RNA, 18 nt, Human
gaacguggagagcuggug

SEQ ID NO: 564843 - RNA, 22 nt, Human
gaaggagcagacaggguggggc

SEQ ID NO: 564844 - RNA, 18 nt, Human
gacaggguggggcugggg

SEQ ID NO: 564845 - RNA, 23 nt, Human
gagccaagccacugcgaaacuga

SEQ ID NO: 564846 - RNA, 20 nt, Human
gagccagacauucauucaac

SEQ ID NO: 564847 - RNA, 21 nt, Human
gaucugugaccuguagcccuu

SEQ ID NO: 564848 - RNA, 22 nt, Human
gccccggguacccccccugcca

SEQ ID NO: 564849 - RNA, 26 nt, Human
ggaaggagcagacaggguggggcugg

SEQ ID NO: 564850 - RNA, 22 nt, Human
ggagcagcguguggggcccggg

SEQ ID NO: 564851 - RNA, 21 nt, Human
ggccugggcucauuuuccuuu

SEQ ID NO: 564852 - RNA, 21 nt, Human
ggcggcaguggcucugcagca

SEQ ID NO: 564853 - RNA, 22 nt, Human
gggaacguggagagcugguggc

SEQ ID NO: 564854 - RNA, 19 nt, Human
gggaaggaacugggaagga

SEQ ID NO: 564855 - RNA, 21 nt, Human
gggcacacaccccauccccaa

SEQ ID NO: 564856 - RNA, 19 nt, Human
gggccauggugggguuggg

SEQ ID NO: 564857 - RNA, 25 nt, Human
gggcggcaguggcucugcagcaaag

SEQ ID NO: 564858 - RNA, 20 nt, Human
gugaugagcacagugggcac

SEQ ID NO: 564859 - RNA, 18 nt, Human
uaagcauugggucugggu

SEQ ID NO: 564860 - RNA, 23 nt, Human
uacuauuguuuauguugauaaag

SEQ ID NO: 564861 - RNA, 23 nt, Human
ucaauguucuuucucaggcacug

SEQ ID NO: 564862 - RNA, 21 nt, Human
ucccugggccauggugggguu

SEQ ID NO: 564863 - RNA, 23 nt, Human
ucugcagcaaaguuggcagcugg

SEQ ID NO: 564864 - RNA, 22 nt, Human
ucugugaccuguagcccuuuuu

SEQ ID NO: 564865 - RNA, 23 nt, Human
ugagcacagugggcacacacccc

SEQ ID NO: 564866 - RNA, 21 nt, Human
ugccaaggaucccgagccaag

SEQ ID NO: 564867 - RNA, 21 nt, Human
ugccccggguacccccccugc

SEQ ID NO: 564868 - RNA, 23 nt, Human
ugccccggguacccccccugcca

SEQ ID NO: 564869 - RNA, 27 nt, Human
ugccuuacuguaccccgcucacucuca

SEQ ID NO: 564870 - RNA, 19 nt, Human
ugcuaugaggggaacgugg

SEQ ID NO: 564871 - RNA, 19 nt, Human
ugcuucauagcaaggccug

SEQ ID NO: 564872 - RNA, 18 nt, Human
uggcacagacacaggccu

SEQ ID NO: 564873 - RNA, 19 nt, Human
ugggaaggagcagacaggg

SEQ ID NO: 564874 - RNA, 23 nt, Human
ugggaaggagcagacaggguggg

SEQ ID NO: 564875 - RNA, 21 nt, Human
ugggcucauuuuccuuugacu

SEQ ID NO: 564876 - RNA, 21 nt, Human
uggggcccgggaaggaacugg

SEQ ID NO: 564877 - RNA, 22 nt, Human
uggggcccgggaaggaacuggg

SEQ ID NO: 564878 - RNA, 21 nt, Human
uggggcugggggaacugccaa

SEQ ID NO: 564879 - RNA, 28 nt, Human
uugaagaugacgguacugcacuuucccc

SEQ ID NO: 564880 - RNA, 25 nt, Human
uuucucaggcacugacgaucuguga

SEQ ID NO: 564881 - RNA, 18 nt, Human
aaaaggaagggagaggga

SEQ ID NO: 564882 - RNA, 18 nt, Human
aaagcaagacauuuuccu

SEQ ID NO: 564883 - RNA, 22 nt, Human
aaccucgcccucuccccuucac

SEQ ID NO: 564884 - RNA, 27 nt, Human
aagaaaaguaggaaagaaguuaacagc

SEQ ID NO: 564885 - RNA, 24 nt, Human
aagacagacaacccgaaccaucag

SEQ ID NO: 564886 - RNA, 27 nt, Human
aaggaaagacaggcucagaggcaggaa

SEQ ID NO: 564887 - RNA, 21 nt, Human
acagcaaucaacuaguauguc

SEQ ID NO: 564888 - RNA, 20 nt, Human
accucgcccucuccccuuca

SEQ ID NO: 564889 - RNA, 20 nt, Human
agacagacaacccgaaccau

SEQ ID NO: 564890 - RNA, 24 nt, Human
agacagacaacccgaaccaucagg

SEQ ID NO: 564891 - RNA, 22 nt, Human
aggcucagaggcaggaagaacu

SEQ ID NO: 564892 - RNA, 24 nt, Human
agggggcugagagugaagaacagc

SEQ ID NO: 564893 - RNA, 19 nt, Human
agugaagaacagcaaagcc

SEQ ID NO: 564894 - RNA, 23 nt, Human
aucaguaagguagcugaaaaggg

SEQ ID NO: 564895 - RNA, 24 nt, Human
caagaaaaguaggaaagaaguuaa

SEQ ID NO: 564896 - RNA, 20 nt, Human
cacuaaggaaccucgcccuc

SEQ ID NO: 564897 - RNA, 29 nt, Human
cagagcccaggauuuuuacuauggggucc

SEQ ID NO: 564898 - RNA, 22 nt, Human
cagcaauaaauuuaaugugguc

SEQ ID NO: 564899 - RNA, 20 nt, Human
cagcagaaggaaagacaggc

SEQ ID NO: 564900 - RNA, 22 nt, Human
caucuccuuuaaucgcuggaag

SEQ ID NO: 564901 - RNA, 19 nt, Human
ccgaaccaucaggauagca

SEQ ID NO: 564902 - RNA, 20 nt, Human
ccugugcacacuagcaagau

SEQ ID NO: 564903 - RNA, 21 nt, Human
cgcccucuccccuucacacca

SEQ ID NO: 564904 - RNA, 25 nt, Human
cucaagaaguagauaguaagacaga

SEQ ID NO: 564905 - RNA, 23 nt, Human
cucgcccucuccccuucacacca

SEQ ID NO: 564906 - RNA, 19 nt, Human
gagagggaugcaagaaaag

SEQ ID NO: 564907 - RNA, 22 nt, Human
gaugcaagaaaaguaggaaaga

SEQ ID NO: 564908 - RNA, 20 nt, Human
gcagagguagggaggcgagc

SEQ ID NO: 564909 - RNA, 23 nt, Human
ggaaagacaggcucagaggcagg

SEQ ID NO: 564910 - RNA, 19 nt, Human
uaagacagacaacccgaac

SEQ ID NO: 564911 - RNA, 20 nt, Human
uaagacagacaacccgaacc

SEQ ID NO: 564912 - RNA, 21 nt, Human
uaagacagacaacccgaaccc

SEQ ID NO: 564913 - RNA, 24 nt, Human
uaagugcuuaucaguaagguagcu

SEQ ID NO: 564914 - RNA, 18 nt, Human
uaauguggucucucuacu

SEQ ID NO: 564915 - RNA, 18 nt, Human
uacagcaucaucacccaa

SEQ ID NO: 564916 - RNA, 21 nt, Human
uaggguacagcaucaucaccc

SEQ ID NO: 564917 - RNA, 23 nt, Human
uccuucaacuucccaguuuuggc

SEQ ID NO: 564918 - RNA, 24 nt, Human
ucuacaagaaagacggcaggaaaa

SEQ ID NO: 564919 - RNA, 23 nt, Human
ugaagaacagcaaagcccugcca

SEQ ID NO: 564920 - RNA, 24 nt, Human
ugaagaacagcaaagcccugccac

SEQ ID NO: 564921 - RNA, 21 nt, Human
ugcaagaaaaguaggaaagaa

SEQ ID NO: 564922 - RNA, 23 nt, Human
ugugcacacuagcaagaugcccu

SEQ ID NO: 564923 - RNA, 26 nt, Human
aaaaauugguaauaauuauagacaca

SEQ ID NO: 564924 - RNA, 25 nt, Human
aagcucacacgccgagagauuccgg

SEQ ID NO: 564925 - RNA, 20 nt, Human
acaguggcagugcccuuggg

SEQ ID NO: 564926 - RNA, 19 nt, Human
acgcgagccgaaacgcugg

SEQ ID NO: 564927 - RNA, 23 nt, Human
aggccggcgcacgcgagccgaaa

SEQ ID NO: 564928 - RNA, 20 nt, Human
cacaacccagcuucuuaccc

SEQ ID NO: 564929 - RNA, 19 nt, Human
cacacaauaucucauuuag

SEQ ID NO: 564930 - RNA, 26 nt, Human
cagcacuccagaaugcuuuuucaggg

SEQ ID NO: 564931 - RNA, 21 nt, Human
ccaaagcgcgugagggcgcga

SEQ ID NO: 564932 - RNA, 19 nt, Human
ccagaaugcuuuuucaggu

SEQ ID NO: 564933 - RNA, 20 nt, Human
ccagggcaccuccgagcaca

SEQ ID NO: 564934 - RNA, 18 nt, Human
gagagacacgggggaugg

SEQ ID NO: 564935 - RNA, 21 nt, Human
ggagcccaggagugucaccag

SEQ ID NO: 564936 - RNA, 23 nt, Human
gggaaacccaaagcgcgugaggg

SEQ ID NO: 564937 - RNA, 20 nt, Human
ggggauggggaggagcccag

SEQ ID NO: 564938 - RNA, 27 nt, Human
uaacgaaccacacaucaaaggauggac

SEQ ID NO: 564939 - RNA, 23 nt, Human
ucaccagaaaguacacaacccag

SEQ ID NO: 564940 - RNA, 20 nt, Human
ugagagacacgggggauggg

SEQ ID NO: 564941 - RNA, 22 nt, Human
uggggaggagcccaggaguguc

SEQ ID NO: 564942 - RNA, 18 nt, Human
ugguaggacaaccaagcu

SEQ ID NO: 564943 - RNA, 19 nt, Human
uucuuacccagccugcugc

SEQ ID NO: 564944 - RNA, 25 nt, Human
uugguaauaauuauagacacaacuu

SEQ ID NO: 564945 - RNA, 21 nt, Human
acgucaucuugaucaucucuu

SEQ ID NO: 564946 - RNA, 23 nt, Human
auaaaauagagccucaaguuuga

SEQ ID NO: 564947 - RNA, 26 nt, Human
cacacuggaaacgucaucuugaucau

SEQ ID NO: 564948 - RNA, 20 nt, Human
caucucuuuuuucucuaucu

SEQ ID NO: 564949 - RNA, 24 nt, Human
cccguccucggccucuuccucgac

SEQ ID NO: 564950 - RNA, 19 nt, Human
ccgggauccaggucuuucu

SEQ ID NO: 564951 - RNA, 22 nt, Human
gucaucuugaucaucucuuuuu

SEQ ID NO: 564952 - RNA, 20 nt, Human
uaaaauagagccucaaguuu

SEQ ID NO: 564953 - RNA, 20 nt, Human
ucacuguuacuucucuuuuc

SEQ ID NO: 564954 - RNA, 24 nt, Human
ucaguccuuucaccauguucuuga

SEQ ID NO: 564955 - RNA, 20 nt, Human
ucccgguuuucuuugcuguc

SEQ ID NO: 564956 - RNA, 26 nt, Human
ucuccuauuguuauguguugguuuau

SEQ ID NO: 564957 - RNA, 21 nt, Human
ucucugaucuuacaacaucuu

SEQ ID NO: 564958 - RNA, 22 nt, Human
ucucuuuucaaccuucucuucu

SEQ ID NO: 564959 - RNA, 20 nt, Human
ucugccucguccucuucccc

SEQ ID NO: 564960 - RNA, 18 nt, Human
ugaaaugguugaucaguc

SEQ ID NO: 564961 - RNA, 21 nt, Human
ugacugagccucauccucacu

SEQ ID NO: 564962 - RNA, 23 nt, Human
ugagaaaauauaaacagcaacau

SEQ ID NO: 564963 - RNA, 18 nt, Human
ugccucguccucuucccc

SEQ ID NO: 564964 - RNA, 24 nt, Human
uggaaacgucaucuugaucaucuc

SEQ ID NO: 564965 - RNA, 21 nt, Human
uguguugguuuauuugcuuca

SEQ ID NO: 564966 - RNA, 18 nt, Human
uuacuugacugagccuca

SEQ ID NO: 564967 - RNA, 21 nt, Human
uucaccucacuguagaagguc

SEQ ID NO: 564968 - RNA, 18 nt, Human
uucuuugcugucacuguu

SEQ ID NO: 564969 - RNA, 23 nt, Human
uucuuugcugucacuguuacuuc

SEQ ID NO: 564970 - RNA, 22 nt, Human
uuuccucugccucguccucuuc

SEQ ID NO: 564971 - RNA, 21 nt, Human
uuuucaaccuucucuucucua

SEQ ID NO: 564972 - RNA, 22 nt, Human
aaagcccuuuaacgucaggccu

SEQ ID NO: 564973 - RNA, 23 nt, Human
aagggaaaagagauuauugcaaa

SEQ ID NO: 564974 - RNA, 21 nt, Human
agaagaaaaaauaaaggaaag

SEQ ID NO: 564975 - RNA, 22 nt, Human
agcccuacugugucaacaaaga

SEQ ID NO: 564976 - RNA, 22 nt, Human
auaaaauggaaggauuaaacac

SEQ ID NO: 564977 - RNA, 19 nt, Human
auacaaaaugcaaaaggag

SEQ ID NO: 564978 - RNA, 20 nt, Human
auugcaaaauuaugaaugaa

SEQ ID NO: 564979 - RNA, 24 nt, Human
cacuccuauuucaauauccugaag

SEQ ID NO: 564980 - RNA, 23 nt, Human
cagcccuacugugucaacaaaga

SEQ ID NO: 564981 - RNA, 21 nt, Human
cccauacaaguccagcaaggc

SEQ ID NO: 564982 - RNA, 18 nt, Human
cgauagcagacugagcuc

SEQ ID NO: 564983 - RNA, 19 nt, Human
cuaaaauaugcugcacucc

SEQ ID NO: 564984 - RNA, 32 nt, Human
cuaauguacgauagcagacugagcuccccuuu

SEQ ID NO: 564985 - RNA, 26 nt, Human
cugcccagcccuacugugucaacaaa

SEQ ID NO: 564986 - RNA, 22 nt, Human
cugugucaacaaagacgguaca

SEQ ID NO: 564987 - RNA, 20 nt, Human
uaaaauaugcugcacuccuu

SEQ ID NO: 564988 - RNA, 19 nt, Human
uagcagacugagcuccccu

SEQ ID NO: 564989 - RNA, 24 nt, Human
ucaacaaagacgguacaauucaaa

SEQ ID NO: 564990 - RNA, 22 nt, Human
uccaaaaggccugauuaaaaaa

SEQ ID NO: 564991 - RNA, 25 nt, Human
uccaaaaggccugauuaaaaaaaaa

SEQ ID NO: 564992 - RNA, 20 nt, Human
uccugaagcguugaaagccc

SEQ ID NO: 564993 - RNA, 18 nt, Human
ucucaucugcuaccuaga

SEQ ID NO: 564994 - RNA, 20 nt, Human
ugaaugaaguccaaaaggcc

SEQ ID NO: 564995 - RNA, 21 nt, Human
uucagaagaaaaaauaaagga

SEQ ID NO: 564996 - RNA, 23 nt, Human
uucagaagaaaaaauaaaggaaa

SEQ ID NO: 564997 - RNA, 21 nt, Human
uuuagucagaaaacuauuacu

SEQ ID NO: 564998 - RNA, 24 nt, Human
aaaagcuacuuauucuggaaauac

SEQ ID NO: 564999 - RNA, 25 nt, Human
aagauaaagcaggucuauuuuuuaa

SEQ ID NO: 565000 - RNA, 18 nt, Human
aauaaaguuguuuuuaac

SEQ ID NO: 565001 - RNA, 20 nt, Human
aggaaaacaagcuuuaaaaa

SEQ ID NO: 565002 - RNA, 21 nt, Human
aggcaagauaaagcaggucua

SEQ ID NO: 565003 - RNA, 25 nt, Human
caucauggauuuuauucauacagaa

SEQ ID NO: 565004 - RNA, 21 nt, Human
ccuauaucagaugggaggaug

SEQ ID NO: 565005 - RNA, 22 nt, Human
cuuacaauuccuuccuuuuaaa

SEQ ID NO: 565006 - RNA, 22 nt, Human
gaaaacaagcuuuaaaaacuca

SEQ ID NO: 565007 - RNA, 20 nt, Human
gaggaugguauaugaauucu

SEQ ID NO: 565008 - RNA, 23 nt, Human
gaggaugguauaugaauucuuug

SEQ ID NO: 565009 - RNA, 19 nt, Human
uaaaguaauauacugguuu

SEQ ID NO: 565010 - RNA, 19 nt, Human
uaauuugcauacuaucaga

SEQ ID NO: 565011 - RNA, 25 nt, Human
uguucaaaauaaaguuguuuuuaac

SEQ ID NO: 565012 - RNA, 21 nt, Human
uuacuuugauagagcuaaagu

SEQ ID NO: 565013 - RNA, 21 nt, Human
aagcacagcggagauuagccg

SEQ ID NO: 565014 - RNA, 19 nt, Human
cagaagacucccgggagga

SEQ ID NO: 565015 - RNA, 20 nt, Human
ccuccucuucugggaguagg

SEQ ID NO: 565016 - RNA, 24 nt, Human
cgacgcagagcuaaagaaacccac

SEQ ID NO: 565017 - RNA, 21 nt, Human
cgggaggagaggcgaacagcg

SEQ ID NO: 565018 - RNA, 22 nt, Human
cucccgggaggagaggcgaaca

SEQ ID NO: 565019 - RNA, 19 nt, Human
ucucagggauccgacgcag

SEQ ID NO: 565020 - RNA, 23 nt, Human
ugcagaggaagcacagcggagau

SEQ ID NO: 565021 - RNA, 21 nt, Human
uuagccucagccaggauggcu

SEQ ID NO: 565022 - RNA, 22 nt, Human
uucugggaguaggcagaagacu

SEQ ID NO: 565023 - RNA, 22 nt, Human
aaaauuuauccgagccagccac

SEQ ID NO: 565024 - RNA, 19 nt, Human
aacaagagcaucuucaaua

SEQ ID NO: 565025 - RNA, 25 nt, Human
aagaggccuuguuuaaaacaagagc

SEQ ID NO: 565026 - RNA, 24 nt, Human
aagcagccuugcaguccacauggu

SEQ ID NO: 565027 - RNA, 20 nt, Human
accacgacaaaagccaggcu

SEQ ID NO: 565028 - RNA, 21 nt, Human
agccaccacgacaaaagccag

SEQ ID NO: 565029 - RNA, 21 nt, Human
aggaggagacguaguccuaaa

SEQ ID NO: 565030 - RNA, 22 nt, Human
auacaaggcaacgcccaaagcc

SEQ ID NO: 565031 - RNA, 25 nt, Human
caaggcaacgcccaaagccucuguc

SEQ ID NO: 565032 - RNA, 21 nt, Human
caccacgacaaaagccaggcu

SEQ ID NO: 565033 - RNA, 21 nt, Human
cagccaccacgacaaaagcca

SEQ ID NO: 565034 - RNA, 21 nt, Human
ccagucuuagaguauauaaaa

SEQ ID NO: 565035 - RNA, 23 nt, Human
cgacaaaagccaggcugaccaaa

SEQ ID NO: 565036 - RNA, 22 nt, Human
cuccauuuuuuuuugguuguuu

SEQ ID NO: 565037 - RNA, 19 nt, Human
cugugaaucaagcagccuu

SEQ ID NO: 565038 - RNA, 18 nt, Human
gaauucuucacaggagga

SEQ ID NO: 565039 - RNA, 26 nt, Human
gagccagccaccacgacaaaagccag

SEQ ID NO: 565040 - RNA, 20 nt, Human
ggcucgaggcucaaugauca

SEQ ID NO: 565041 - RNA, 21 nt, Human
uaaguaauagcuuauuuaucc

SEQ ID NO: 565042 - RNA, 22 nt, Human
uagcauuuuuauauacaaggca

SEQ ID NO: 565043 - RNA, 21 nt, Human
uauauacaaggcaacgcccaa

SEQ ID NO: 565044 - RNA, 22 nt, Human
uauauacaaggcaacgcccaaa

SEQ ID NO: 565045 - RNA, 23 nt, Human
ugaaucaagcagccuugcagucc

SEQ ID NO: 565046 - RNA, 22 nt, Human
ugcuugaaggaguaaggucuuc

SEQ ID NO: 565047 - RNA, 19 nt, Human
uguaucacuuguucucuuu

SEQ ID NO: 565048 - RNA, 25 nt, Human
uuaaaauaauagcaauugaguccau

SEQ ID NO: 565049 - RNA, 24 nt, Human
uucaccaagacuaaaauuacaaag

SEQ ID NO: 565050 - RNA, 18 nt, Human
uucuucacaggaggagac

SEQ ID NO: 565051 - RNA, 23 nt, Human
uucuugcuugacaagguaggaac

SEQ ID NO: 565052 - RNA, 23 nt, Human
uugaccccaaacauuugcuugaa

SEQ ID NO: 565053 - RNA, 23 nt, Human
uuuaauaaucauuuuuuccaucc

SEQ ID NO: 565054 - RNA, 19 nt, Human
agcaauuuuuucuucuuuu

SEQ ID NO: 565055 - RNA, 21 nt, Human
agcuucuaaagcagcaauuuu

SEQ ID NO: 565056 - RNA, 21 nt, Human
auaggccagugaugucucaaa

SEQ ID NO: 565057 - RNA, 24 nt, Human
cagcaauuuuuucuucuuuuauuu

SEQ ID NO: 565058 - RNA, 22 nt, Human
cgagcuucuaaagcagcaauuu

SEQ ID NO: 565059 - RNA, 19 nt, Human
cuacuggucuuucaacucc

SEQ ID NO: 565060 - RNA, 22 nt, Human
guggauucuucuaaucgagcuu

SEQ ID NO: 565061 - RNA, 20 nt, Human
uagaggagcgucuacugguc

SEQ ID NO: 565062 - RNA, 20 nt, Human
uauucuguucuuguaaugac

SEQ ID NO: 565063 - RNA, 24 nt, Human
ugacacugucugccucugaagugc

SEQ ID NO: 565064 - RNA, 20 nt, Human
uguucugugucucaaguugc

SEQ ID NO: 565065 - RNA, 22 nt, Human
uucugugucucaaguugcuuca

SEQ ID NO: 565066 - RNA, 20 nt, Human
uugaagagugguauucuguu

SEQ ID NO: 565067 - RNA, 27 nt, Human
aaaaaaacaaaauaaaaacaaaaacaa

SEQ ID NO: 565068 - RNA, 28 nt, Human
aaaaaaaccaaacacaaagagagcaggg

SEQ ID NO: 565069 - RNA, 23 nt, Human
aaaaaacaaaauaaaaacaaaaa

SEQ ID NO: 565070 - RNA, 27 nt, Human
aaaaacaaaaaaaccaaacacaaagag

SEQ ID NO: 565071 - RNA, 26 nt, Human
aaaaacaaaaaaaccaaacacaaagg

SEQ ID NO: 565072 - RNA, 21 nt, Human
aaaacaaaauaaaaacaaaaa

SEQ ID NO: 565073 - RNA, 25 nt, Human
aaacaaaaaaaccaaacacaaagag

SEQ ID NO: 565074 - RNA, 30 nt, Human
aaacaaaaaaaccaaacacaaagagagcaa

SEQ ID NO: 565075 - RNA, 22 nt, Human
aaacaaaaacaaaaaaaccaaa

SEQ ID NO: 565076 - RNA, 27 nt, Human
aaacaaaaacaaaaaaaccaaacacaa

SEQ ID NO: 565077 - RNA, 23 nt, Human
aaacacaaagagagcaguguugg

SEQ ID NO: 565078 - RNA, 26 nt, Human
aaauaaaaacaaaaacaaaaaaacca

SEQ ID NO: 565079 - RNA, 21 nt, Human
aacaaaaaaaccaaacacaaa

SEQ ID NO: 565080 - RNA, 21 nt, Human
aacaaaaacaaaaaaaccaaa

SEQ ID NO: 565081 - RNA, 24 nt, Human
aacaaaaacaaaaaaaccaaacac

SEQ ID NO: 565082 - RNA, 20 nt, Human
aaccaaacacaaagagagca

SEQ ID NO: 565083 - RNA, 23 nt, Human
aagcagcucagccugggcagggc

SEQ ID NO: 565084 - RNA, 23 nt, Human
acaaaaacaaaaaaaccaaacac

SEQ ID NO: 565085 - RNA, 26 nt, Human
acaaaaacaaaaaaaccaaacacaaa

SEQ ID NO: 565086 - RNA, 28 nt, Human
acaaaaacaaaaaaaccaaacacaaaga

SEQ ID NO: 565087 - RNA, 24 nt, Human
acaaaauaaaaacaaaaacaaaaa

SEQ ID NO: 565088 - RNA, 19 nt, Human
acaguaucaaaaguaaaga

SEQ ID NO: 565089 - RNA, 18 nt, Human
acgccuucagcuggcagu

SEQ ID NO: 565090 - RNA, 21 nt, Human
agcaguaccaucagcccuggc

SEQ ID NO: 565091 - RNA, 26 nt, Human
caaaaaaaccaaacacaaagagagca

SEQ ID NO: 565092 - RNA, 24 nt, Human
caaaaacaaaaaaaccaaacacaa

SEQ ID NO: 565093 - RNA, 19 nt, Human
cacaguagcagcagucaca

SEQ ID NO: 565094 - RNA, 18 nt, Human
cacaguaucaaaaguaaa

SEQ ID NO: 565095 - RNA, 24 nt, Human
cagucacagaacuucccaucucuc

SEQ ID NO: 565096 - RNA, 21 nt, Human
caguccacgggcucugagugu

SEQ ID NO: 565097 - RNA, 21 nt, Human
ccagcccaguccacgggcucu

SEQ ID NO: 565098 - RNA, 21 nt, Human
cccaucucucuggugggugga

SEQ ID NO: 565099 - RNA, 19 nt, Human
cccuuaggccagcccaguc

SEQ ID NO: 565100 - RNA, 20 nt, Human
ccuuaggccagcccaguccc

SEQ ID NO: 565101 - RNA, 18 nt, Human
cucugguggguggaggau

SEQ ID NO: 565102 - RNA, 24 nt, Human
gaaaaaaacaaaauaaaaacaaaa

SEQ ID NO: 565103 - RNA, 19 nt, Human
gaacucacaguagcagcag

SEQ ID NO: 565104 - RNA, 18 nt, Human
gacucgucggggcagcgg

SEQ ID NO: 565105 - RNA, 19 nt, Human
gagcacagagggucuugga

SEQ ID NO: 565106 - RNA, 18 nt, Human
gaggaugaggugcaggag

SEQ ID NO: 565107 - RNA, 20 nt, Human
gcauuguggccgaagaacuc

SEQ ID NO: 565108 - RNA, 22 nt, Human
ggcagcuccucuuuccgccugg

SEQ ID NO: 565109 - RNA, 24 nt, Human
guguggaggcugcguagcaccagg

SEQ ID NO: 565110 - RNA, 25 nt, Human
uaaaaacaaaaacaaaaaaaccaaa

SEQ ID NO: 565111 - RNA, 28 nt, Human
uaaaaacaaaaacaaaaaaaccaaagag

SEQ ID NO: 565112 - RNA, 24 nt, Human
ucagcuuuugguuggaccaggaug

SEQ ID NO: 565113 - RNA, 20 nt, Human
uccacgggcucugagugugg

SEQ ID NO: 565114 - RNA, 23 nt, Human
ucugcugaggucaaggggcccca

SEQ ID NO: 565115 - RNA, 20 nt, Human
ugcuuuaucuuucggcacga

SEQ ID NO: 565116 - RNA, 22 nt, Human
uggaaaaaaacaaaauaaaaac

SEQ ID NO: 565117 - RNA, 24 nt, Human
uggggagcacagagggucuuggac

SEQ ID NO: 565118 - RNA, 18 nt, Human
uugguuggaccaggaugg

SEQ ID NO: 565119 - RNA, 22 nt, Human
uuugguuggaccaggauggugg

SEQ ID NO: 565120 - RNA, 22 nt, Human
aagcaaucgguacagaaaaggc

SEQ ID NO: 565121 - RNA, 18 nt, Human
aagcucaacaggccagga

SEQ ID NO: 565122 - RNA, 19 nt, Human
accacacacacaaaaagca

SEQ ID NO: 565123 - RNA, 19 nt, Human
acugucccaucuguaguug

SEQ ID NO: 565124 - RNA, 21 nt, Human
agaaugcugaacauuuacugu

SEQ ID NO: 565125 - RNA, 23 nt, Human
agaauuucuuuccaugauuucuc

SEQ ID NO: 565126 - RNA, 19 nt, Human
agcaaccaccacgacaaag

SEQ ID NO: 565127 - RNA, 18 nt, Human
aggcaggaaggccccagg

SEQ ID NO: 565128 - RNA, 24 nt, Human
auuucuuuccaugauuucucccau

SEQ ID NO: 565129 - RNA, 18 nt, Human
caaagcaaccaccacgac

SEQ ID NO: 565130 - RNA, 20 nt, Human
cagcaguguaaugaacacag

SEQ ID NO: 565131 - RNA, 21 nt, Human
caggaaccgcccucugccucg

SEQ ID NO: 565132 - RNA, 26 nt, Human
cccaggaggacccugcugggucugcc

SEQ ID NO: 565133 - RNA, 22 nt, Human
cccgcccgccaccgcaguucag

SEQ ID NO: 565134 - RNA, 19 nt, Human
ccgcaguucaaaggcagga

SEQ ID NO: 565135 - RNA, 19 nt, Human
ccugagcgaagcccggccc

SEQ ID NO: 565136 - RNA, 23 nt, Human
cgcaguucaaaggcaggaaggcc

SEQ ID NO: 565137 - RNA, 19 nt, Human
cuccaggaaccgcccucug

SEQ ID NO: 565138 - RNA, 20 nt, Human
cuuuccaugauuucucccau

SEQ ID NO: 565139 - RNA, 19 nt, Human
gccccaggaggacccugcu

SEQ ID NO: 565140 - RNA, 19 nt, Human
gccgcgcagacacgucccg

SEQ ID NO: 565141 - RNA, 19 nt, Human
gucugccucaaacgcugcc

SEQ ID NO: 565142 - RNA, 21 nt, Human
uaccacacacacaaaaagcaa

SEQ ID NO: 565143 - RNA, 18 nt, Human
ucccugcgaggcuucguc

SEQ ID NO: 565144 - RNA, 23 nt, Human
ugagaauuucuuuccaugauuuc

SEQ ID NO: 565145 - RNA, 25 nt, Human
ugccugagcgaagcccggcccaggc

SEQ ID NO: 565146 - RNA, 24 nt, Human
uguaaaauugaauaaagauuuuau

SEQ ID NO: 565147 - RNA, 18 nt, Human
uuuuuuuuuuuuuuucug

SEQ ID NO: 565148 - RNA, 19 nt, Human
uuuuuuuuuuuuuuucugu

SEQ ID NO: 565149 - RNA, 20 nt, Human
aaggagccccugccaccugc

SEQ ID NO: 565150 - RNA, 26 nt, Human
agagucccugcaucugcucccugccu

SEQ ID NO: 565151 - RNA, 22 nt, Human
aggguucccuaacuuuucccuu

SEQ ID NO: 565152 - RNA, 21 nt, Human
agucgucuagagagcaaauac

SEQ ID NO: 565153 - RNA, 27 nt, Human
cagggugcacacaucccugcaggucuc

SEQ ID NO: 565154 - RNA, 24 nt, Human
cauguguuuucuccuccagaaugc

SEQ ID NO: 565155 - RNA, 19 nt, Human
ccacaguccccuccaaguc

SEQ ID NO: 565156 - RNA, 24 nt, Human
cccacauccacagaagggccacaa

SEQ ID NO: 565157 - RNA, 25 nt, Human
ccuccagaaugcgcuuggaaaccac

SEQ ID NO: 565158 - RNA, 22 nt, Human
cgggagcuggaggccaaggagc

SEQ ID NO: 565159 - RNA, 24 nt, Human
cguggcagagucccugcaucugcu

SEQ ID NO: 565160 - RNA, 18 nt, Human
cuccucagucccacaguc

SEQ ID NO: 565161 - RNA, 23 nt, Human
cucuaucucgacguaggccuccg

SEQ ID NO: 565162 - RNA, 18 nt, Human
cugcucccugccuggccu

SEQ ID NO: 565163 - RNA, 19 nt, Human
cuucggagucaccgcacag

SEQ ID NO: 565164 - RNA, 22 nt, Human
cuuuucgaggcugaggaaagac

SEQ ID NO: 565165 - RNA, 23 nt, Human
cuuuuuuuuuuuucaucuuuuug

SEQ ID NO: 565166 - RNA, 19 nt, Human
gaaucacuggcacggaagc

SEQ ID NO: 565167 - RNA, 19 nt, Human
gaccauauuuacucuaucu

SEQ ID NO: 565168 - RNA, 22 nt, Human
gagcaaauacacaguaauuccc

SEQ ID NO: 565169 - RNA, 21 nt, Human
gaggcugaggaaagaccccga

SEQ ID NO: 565170 - RNA, 18 nt, Human
gcucucugcucugugcuc

SEQ ID NO: 565171 - RNA, 20 nt, Human
gggcacagcggaagggcugc

SEQ ID NO: 565172 - RNA, 18 nt, Human
gucacggccaugauccau

SEQ ID NO: 565173 - RNA, 24 nt, Human
gucccugcaucugcucccugccug

SEQ ID NO: 565174 - RNA, 21 nt, Human
uacaaugucccucaccagaau

SEQ ID NO: 565175 - RNA, 18 nt, Human
ucaccuuuuaauuggacc

SEQ ID NO: 565176 - RNA, 23 nt, Human
ucacuggcacggaagcuuuuccu

SEQ ID NO: 565177 - RNA, 26 nt, Human
ucauguguuuucuccuccagaaugcg

SEQ ID NO: 565178 - RNA, 19 nt, Human
ucccacaguccccuccaag

SEQ ID NO: 565179 - RNA, 21 nt, Human
uccccuccaagucacgggagc

SEQ ID NO: 565180 - RNA, 24 nt, Human
ucccugcaggucucggggcuccug

SEQ ID NO: 565181 - RNA, 25 nt, Human
uccuggguugcuucuggaagggccc

SEQ ID NO: 565182 - RNA, 18 nt, Human
ucucugcucugugcuccu

SEQ ID NO: 565183 - RNA, 19 nt, Human
ucugcucccugccuggccu

SEQ ID NO: 565184 - RNA, 21 nt, Human
ucugucggcagagaacccuga

SEQ ID NO: 565185 - RNA, 21 nt, Human
ugaggaaagaccccgagagcg

SEQ ID NO: 565186 - RNA, 20 nt, Human
ugaggcaacgaaucacuggc

SEQ ID NO: 565187 - RNA, 22 nt, Human
ugcaccucucaggguucccuaa

SEQ ID NO: 565188 - RNA, 18 nt, Human
ugcaggucucggggcucc

SEQ ID NO: 565189 - RNA, 18 nt, Human
ugccuggccugggcuccc

SEQ ID NO: 565190 - RNA, 22 nt, Human
ugcucugugcuccucaguccca

SEQ ID NO: 565191 - RNA, 22 nt, Human
uggcugcaggugcagggcuaug

SEQ ID NO: 565192 - RNA, 23 nt, Human
uuuuucagggguugauugucggg

SEQ ID NO: 565193 - RNA, 22 nt, Human
aagaguccgaugugccccagcc

SEQ ID NO: 565194 - RNA, 26 nt, Human
aagcagcaagcagugcauuccagagc

SEQ ID NO: 565195 - RNA, 19 nt, Human
aagcagugcauuccagagc

SEQ ID NO: 565196 - RNA, 22 nt, Human
accggagcccaagggggcacug

SEQ ID NO: 565197 - RNA, 23 nt, Human
acuccacuagcuccaacucuacc

SEQ ID NO: 565198 - RNA, 24 nt, Human
agacagaacucuagggucugcagg

SEQ ID NO: 565199 - RNA, 24 nt, Human
agaguaaagccaccggagcccaag

SEQ ID NO: 565200 - RNA, 22 nt, Human
agcaagcagugcauuccagagc

SEQ ID NO: 565201 - RNA, 18 nt, Human
agcagaaagagaagucga

SEQ ID NO: 565202 - RNA, 23 nt, Human
agcagaaauuauuuagcagcagc

SEQ ID NO: 565203 - RNA, 23 nt, Human
agcagacgaaccacugagccucu

SEQ ID NO: 565204 - RNA, 23 nt, Human
agccgcaacaguauaagguggcc

SEQ ID NO: 565205 - RNA, 19 nt, Human
aggcuucuuucucuccucu

SEQ ID NO: 565206 - RNA, 19 nt, Human
caaaucgccgcugcucuuc

SEQ ID NO: 565207 - RNA, 22 nt, Human
caacguguggagcagaaagaga

SEQ ID NO: 565208 - RNA, 22 nt, Human
caacuccacuagcuccaacucu

SEQ ID NO: 565209 - RNA, 22 nt, Human
cacaguggggucagcaccugcu

SEQ ID NO: 565210 - RNA, 24 nt, Human
cacccccaucuuccaaaucaucuc

SEQ ID NO: 565211 - RNA, 22 nt, Human
cagaguccccacagucaacucc

SEQ ID NO: 565212 - RNA, 18 nt, Human
cagcagcagacgaaccac

SEQ ID NO: 565213 - RNA, 19 nt, Human
cagcagcuccaaacguccc

SEQ ID NO: 565214 - RNA, 20 nt, Human
cagcugcugcaugcaggaga

SEQ ID NO: 565215 - RNA, 19 nt, Human
cauuccagagcucuggcug

SEQ ID NO: 565216 - RNA, 20 nt, Human
ccaaacuuuauugugauuaa

SEQ ID NO: 565217 - RNA, 21 nt, Human
ccaccggagcccaagggggca

SEQ ID NO: 565218 - RNA, 22 nt, Human
ccacugagccucuuccagcugc

SEQ ID NO: 565219 - RNA, 18 nt, Human
ccagugugucugagguga

SEQ ID NO: 565220 - RNA, 18 nt, Human
cccacagucaacuccacu

SEQ ID NO: 565221 - RNA, 21 nt, Human
cccgaguguccuucaccccca

SEQ ID NO: 565222 - RNA, 24 nt, Human
ccgaugugccccagccuccugguc

SEQ ID NO: 565223 - RNA, 18 nt, Human
ccuccugcuccugcugcc

SEQ ID NO: 565224 - RNA, 21 nt, Human
cgagguagugaaagggaguca

SEQ ID NO: 565225 - RNA, 23 nt, Human
cgaguguccuucacccccaucuu

SEQ ID NO: 565226 - RNA, 24 nt, Human
cucacaaagauccagaguccccac

SEQ ID NO: 565227 - RNA, 24 nt, Human
cucgcaaguccucaggucgauugc

SEQ ID NO: 565228 - RNA, 22 nt, Human
cucucaggucccugaguuggcc

SEQ ID NO: 565229 - RNA, 18 nt, Human
cugcuccugcugccucug

SEQ ID NO: 565230 - RNA, 19 nt, Human
cugcuccugcugccucugc

SEQ ID NO: 565231 - RNA, 21 nt, Human
cugcugccucugcugcuguuc

SEQ ID NO: 565232 - RNA, 22 nt, Human
cugcugccucugcugcuguucc

SEQ ID NO: 565233 - RNA, 19 nt, Human
cuguuccucccguugccgc

SEQ ID NO: 565234 - RNA, 20 nt, Human
cuucuugaguuugcuggaga

SEQ ID NO: 565235 - RNA, 22 nt, Human
cuuuucuccuucuuauuccuuu

SEQ ID NO: 565236 - RNA, 26 nt, Human
cuuuucuccuucuuauuccuuuuucu

SEQ ID NO: 565237 - RNA, 19 nt, Human
gagcagaaagagaagucga

SEQ ID NO: 565238 - RNA, 24 nt, Human
gaucuuucuuauuucuuccucagu

SEQ ID NO: 565239 - RNA, 19 nt, Human
gcagagucagggauuggag

SEQ ID NO: 565240 - RNA, 21 nt, Human
gccaucuucucccuccgaccc

SEQ ID NO: 565241 - RNA, 19 nt, Human
ggagauuccucauucugcc

SEQ ID NO: 565242 - RNA, 23 nt, Human
ggauuucugcaacacaacaaucc

SEQ ID NO: 565243 - RNA, 18 nt, Human
ggcccaagggggcagcaa

SEQ ID NO: 565244 - RNA, 22 nt, Human
ggcuuuucuccuucuuauuccu

SEQ ID NO: 565245 - RNA, 20 nt, Human
uaaaauuccagagacaguac

SEQ ID NO: 565246 - RNA, 22 nt, Human
uaaagccaccggagcccaaggg

SEQ ID NO: 565247 - RNA, 23 nt, Human
uaccucuagcccugucuuugccc

SEQ ID NO: 565248 - RNA, 25 nt, Human
uaguucccgaguguccuucaccccc

SEQ ID NO: 565249 - RNA, 25 nt, Human
uccagaguccccacagucaacuccc

SEQ ID NO: 565250 - RNA, 18 nt, Human
uccagcugcagcugcugc

SEQ ID NO: 565251 - RNA, 19 nt, Human
ucccguugccgccgggcug

SEQ ID NO: 565252 - RNA, 24 nt, Human
ucccuccgacccugaacccuguuu

SEQ ID NO: 565253 - RNA, 20 nt, Human
ucccugaguuggccccaggu

SEQ ID NO: 565254 - RNA, 19 nt, Human
ucccugcagaucuuucuua

SEQ ID NO: 565255 - RNA, 18 nt, Human
uccuccugcuccugcugc

SEQ ID NO: 565256 - RNA, 21 nt, Human
uccugcuccugcugccucugc

SEQ ID NO: 565257 - RNA, 25 nt, Human
uccugcuccugcugccucugcugcu

SEQ ID NO: 565258 - RNA, 20 nt, Human
uccugcugccucugcugcug

SEQ ID NO: 565259 - RNA, 18 nt, Human
ucugcucccuuuuccgug

SEQ ID NO: 565260 - RNA, 22 nt, Human
ugaaagccaucuucucccuccg

SEQ ID NO: 565261 - RNA, 18 nt, Human
ugaaagggagucaggccu

SEQ ID NO: 565262 - RNA, 18 nt, Human
ugaccaggggcuuuggcc

SEQ ID NO: 565263 - RNA, 20 nt, Human
ugccccacaacuccagcagc

SEQ ID NO: 565264 - RNA, 18 nt, Human
ugccccagccuccugguc

SEQ ID NO: 565265 - RNA, 24 nt, Human
ugccccagcgcuuccuuuucaucc

SEQ ID NO: 565266 - RNA, 19 nt, Human
ugggaugacuguguggaag

SEQ ID NO: 565267 - RNA, 18 nt, Human
ugggcagcgagucggcgc

SEQ ID NO: 565268 - RNA, 24 nt, Human
uguccuucacccccaucuuccaaa

SEQ ID NO: 565269 - RNA, 18 nt, Human
uguggagcagaaagagaa

SEQ ID NO: 565270 - RNA, 19 nt, Human
uuacuguuuuccagugugu

SEQ ID NO: 565271 - RNA, 23 nt, Human
uuccaaaucaucucugguuucac

SEQ ID NO: 565272 - RNA, 23 nt, Human
uuccagagcucuggcugaccagg

SEQ ID NO: 565273 - RNA, 19 nt, Human
uuuccguguagccugccgu

SEQ ID NO: 565274 - RNA, 18 nt, Human
aaacacaggccagcugag

SEQ ID NO: 565275 - RNA, 19 nt, Human
aaagagaaaacccaagucu

SEQ ID NO: 565276 - RNA, 22 nt, Human
aaccaguaaaccaagcaacccu

SEQ ID NO: 565277 - RNA, 18 nt, Human
aagcaacccuggacuucu

SEQ ID NO: 565278 - RNA, 23 nt, Human
agaugaacacugcugccugaagc

SEQ ID NO: 565279 - RNA, 18 nt, Human
agauucaugccccaaaca

SEQ ID NO: 565280 - RNA, 21 nt, Human
agcauccaccuuccugcccca

SEQ ID NO: 565281 - RNA, 18 nt, Human
auccaccuuccugcccca

SEQ ID NO: 565282 - RNA, 18 nt, Human
caacucccacagcuccau

SEQ ID NO: 565283 - RNA, 18 nt, Human
caagaggacagaugggga

SEQ ID NO: 565284 - RNA, 19 nt, Human
caagcugcagccucuaaac

SEQ ID NO: 565285 - RNA, 18 nt, Human
caccaaagagaaaaccca

SEQ ID NO: 565286 - RNA, 23 nt, Human
cagacaaggaggagaggagagau

SEQ ID NO: 565287 - RNA, 24 nt, Human
cagagugccaacucccacagcucc

SEQ ID NO: 565288 - RNA, 20 nt, Human
cagaugagggagcgccuucc

SEQ ID NO: 565289 - RNA, 19 nt, Human
caguuccuuuugcaaagau

SEQ ID NO: 565290 - RNA, 26 nt, Human
ccaauuucccuccugauuguagcuca

SEQ ID NO: 565291 - RNA, 18 nt, Human
ccaugacaacagcaucca

SEQ ID NO: 565292 - RNA, 22 nt, Human
ccugcagacccugggaagggcu

SEQ ID NO: 565293 - RNA, 23 nt, Human
ccuuccugccccaacacuguucc

SEQ ID NO: 565294 - RNA, 23 nt, Human
cgauggaagaagucucagagucu

SEQ ID NO: 565295 - RNA, 21 nt, Human
cgccuuggcucuguguugccu

SEQ ID NO: 565296 - RNA, 23 nt, Human
cuccaugacaacagcauccaccu

SEQ ID NO: 565297 - RNA, 18 nt, Human
cugccaggagcugcacug

SEQ ID NO: 565298 - RNA, 23 nt, Human
cuggagcuuuucuucuccugugu

SEQ ID NO: 565299 - RNA, 21 nt, Human
cuuggcucuguguugccuacc

SEQ ID NO: 565300 - RNA, 24 nt, Human
gacacggugccaauuuacugccaa

SEQ ID NO: 565301 - RNA, 26 nt, Human
gccaacucccacagcuccaugacaac

SEQ ID NO: 565302 - RNA, 20 nt, Human
gccugaagcucagggcagcu

SEQ ID NO: 565303 - RNA, 23 nt, Human
gcuccaugacaacagcauccacc

SEQ ID NO: 565304 - RNA, 21 nt, Human
ggaagaaaccccuccucugga

SEQ ID NO: 565305 - RNA, 21 nt, Human
ggaaucccuucagaggcccuu

SEQ ID NO: 565306 - RNA, 21 nt, Human
gggcagcugcccacagugagg

SEQ ID NO: 565307 - RNA, 23 nt, Human
ggugcuuucagauuucuuauaaa

SEQ ID NO: 565308 - RNA, 18 nt, Human
uaaaccaguaaaccaagc

SEQ ID NO: 565309 - RNA, 24 nt, Human
uaaaccaguaaaccaagcaacccu

SEQ ID NO: 565310 - RNA, 22 nt, Human
uacuugaaucccaggaaacagu

SEQ ID NO: 565311 - RNA, 26 nt, Human
uagaaaccaccaaagagaaaacccaa

SEQ ID NO: 565312 - RNA, 22 nt, Human
uccuggagcuuuucuucuccug

SEQ ID NO: 565313 - RNA, 20 nt, Human
ugaaggagaaaagaaguugu

SEQ ID NO: 565314 - RNA, 24 nt, Human
ugacacggugccaauuuacugcca

SEQ ID NO: 565315 - RNA, 18 nt, Human
ugcccgguuugucaacag

SEQ ID NO: 565316 - RNA, 19 nt, Human
ugccugaagcucagggcag

SEQ ID NO: 565317 - RNA, 21 nt, Human
uggaaaccagacaacuggcca

SEQ ID NO: 565318 - RNA, 18 nt, Human
uggaagaagucucagagu

SEQ ID NO: 565319 - RNA, 18 nt, Human
uggagggcagauggacug

SEQ ID NO: 565320 - RNA, 22 nt, Human
uggccagagaugaacacugcug

SEQ ID NO: 565321 - RNA, 24 nt, Human
ugggaagggcugaucugaauccug

SEQ ID NO: 565322 - RNA, 24 nt, Human
uggggacagggauccuggagcuuu

SEQ ID NO: 565323 - RNA, 22 nt, Human
ugucagaggugcuuucagauuu

SEQ ID NO: 565324 - RNA, 21 nt, Human
uguucugguugcauacuugaa

SEQ ID NO: 565325 - RNA, 20 nt, Human
uuccaauuucccuccugauu

SEQ ID NO: 565326 - RNA, 18 nt, Human
uucccuccugauuguagc

SEQ ID NO: 565327 - RNA, 20 nt, Human
uuccgucuggcuuccagcac

SEQ ID NO: 565328 - RNA, 18 nt, Human
uugcauacuugaauccca

SEQ ID NO: 565329 - RNA, 24 nt, Human
uuggcccagaugagggagcgccuu

SEQ ID NO: 565330 - RNA, 21 nt, Human
uuuuuugacagaaguaaaaau

SEQ ID NO: 565331 - RNA, 18 nt, Human
uuuuuuuuuuuuuuuuug

SEQ ID NO: 565332 - RNA, 22 nt, Human
uuuuuuuuuuuuuuuuugacag

SEQ ID NO: 565333 - RNA, 21 nt, Human
aaagcugacagccacaaaaca

SEQ ID NO: 565334 - RNA, 24 nt, Human
aaagcugacagccacaaaacaauc

SEQ ID NO: 565335 - RNA, 19 nt, Human
aauaggccaccugcaggcc

SEQ ID NO: 565336 - RNA, 23 nt, Human
accacggggaaagcugacagcca

SEQ ID NO: 565337 - RNA, 20 nt, Human
agaaacuggauagaugauuu

SEQ ID NO: 565338 - RNA, 21 nt, Human
agaccacggggaaagcugaca

SEQ ID NO: 565339 - RNA, 20 nt, Human
agaguggacugguguggcca

SEQ ID NO: 565340 - RNA, 20 nt, Human
agcagagccaccagagauaa

SEQ ID NO: 565341 - RNA, 18 nt, Human
aggagagggcggaucugg

SEQ ID NO: 565342 - RNA, 18 nt, Human
aguauuuaagaaauccug

SEQ ID NO: 565343 - RNA, 21 nt, Human
augcagccacaaacucagacc

SEQ ID NO: 565344 - RNA, 21 nt, Human
caaaauaggccaccugcaggc

SEQ ID NO: 565345 - RNA, 22 nt, Human
caccagagauaaaaaugcagcc

SEQ ID NO: 565346 - RNA, 19 nt, Human
ccacaaacucagaccacgg

SEQ ID NO: 565347 - RNA, 23 nt, Human
ccaccugcaggccucaugcaaaa

SEQ ID NO: 565348 - RNA, 20 nt, Human
ccucgaaugacaaucaguuu

SEQ ID NO: 565349 - RNA, 23 nt, Human
gaagccccccauuugcucugcuc

SEQ ID NO: 565350 - RNA, 24 nt, Human
gcaguuuccagucucugcagcugc

SEQ ID NO: 565351 - RNA, 24 nt, Human
gccuugaaggcaguuuccagucuc

SEQ ID NO: 565352 - RNA, 20 nt, Human
ggcggaucuggggugugguc

SEQ ID NO: 565353 - RNA, 28 nt, Human
uaaaaaugcagccacaaacucagaccac

SEQ ID NO: 565354 - RNA, 19 nt, Human
ucaccgucugagucaaaau

SEQ ID NO: 565355 - RNA, 22 nt, Human
ucagaccacggggaaagcugac

SEQ ID NO: 565356 - RNA, 19 nt, Human
uccucgaaugacaaucagu

SEQ ID NO: 565357 - RNA, 24 nt, Human
uccucgaaugacaaucaguuuuau

SEQ ID NO: 565358 - RNA, 24 nt, Human
ucucugcagcugcgggaugagggu

SEQ ID NO: 565359 - RNA, 20 nt, Human
ucugcgccgccguagcagag

SEQ ID NO: 565360 - RNA, 23 nt, Human
ugaccagccguggccuugaaggc

SEQ ID NO: 565361 - RNA, 22 nt, Human
ugcagccacaaacucagaccac

SEQ ID NO: 565362 - RNA, 19 nt, Human
ugcucugcucagccucucu

SEQ ID NO: 565363 - RNA, 19 nt, Human
ugcuuuuuucaccgucuga

SEQ ID NO: 565364 - RNA, 18 nt, Human
acccagacgguguccugg

SEQ ID NO: 565365 - RNA, 19 nt, Human
acccugccgcccugcacgg

SEQ ID NO: 565366 - RNA, 19 nt, Human
agaacuccuccagcuucuu

SEQ ID NO: 565367 - RNA, 23 nt, Human
agacgguguccuggguggacgcc

SEQ ID NO: 565368 - RNA, 22 nt, Human
agcagggcccgcacaacacgag

SEQ ID NO: 565369 - RNA, 26 nt, Human
agccacgguggggaagcugaauuugc

SEQ ID NO: 565370 - RNA, 19 nt, Human
auggccguguggggcucag

SEQ ID NO: 565371 - RNA, 24 nt, Human
caccacguugaccugugugaggau

SEQ ID NO: 565372 - RNA, 20 nt, Human
cagaccaggcccugggaggg

SEQ ID NO: 565373 - RNA, 19 nt, Human
cagcccugccagccuucug

SEQ ID NO: 565374 - RNA, 21 nt, Human
cagcgucuccuccaccuucuc

SEQ ID NO: 565375 - RNA, 18 nt, Human
cagcucagccuugcgcuu

SEQ ID NO: 565376 - RNA, 20 nt, Human
ccagcccugccagccuucug

SEQ ID NO: 565377 - RNA, 22 nt, Human
ccagcccugccagccuucugau

SEQ ID NO: 565378 - RNA, 18 nt, Human
cccccaaggaagguuccu

SEQ ID NO: 565379 - RNA, 22 nt, Human
cccccgggaagggcugcugccc

SEQ ID NO: 565380 - RNA, 21 nt, Human
cccggucauguucuuucuucc

SEQ ID NO: 565381 - RNA, 21 nt, Human
cccuccaggaucagcugcuuc

SEQ ID NO: 565382 - RNA, 18 nt, Human
cccugggaggggacuggg

SEQ ID NO: 565383 - RNA, 24 nt, Human
ccuccagcuucuucuuggggccgc

SEQ ID NO: 565384 - RNA, 24 nt, Human
ccuccaguuugaucucacacucuc

SEQ ID NO: 565385 - RNA, 26 nt, Human
ccugcagccugaaucuuggccagggc

SEQ ID NO: 565386 - RNA, 21 nt, Human
ccugccagccuucugucgcuu

SEQ ID NO: 565387 - RNA, 19 nt, Human
ccuucugucgcuucagcgu

SEQ ID NO: 565388 - RNA, 21 nt, Human
cgcaccacguugaccugugug

SEQ ID NO: 565389 - RNA, 21 nt, Human
cgggaagggcugcugccccca

SEQ ID NO: 565390 - RNA, 18 nt, Human
cucagccuugcgcuuggc

SEQ ID NO: 565391 - RNA, 25 nt, Human
cucagccuugcgcuuggccuccagg

SEQ ID NO: 565392 - RNA, 23 nt, Human
cuccuccagcuucuucuugaucu

SEQ ID NO: 565393 - RNA, 20 nt, Human
cucgguggauguagaucuug

SEQ ID NO: 565394 - RNA, 21 nt, Human
cugacccugccgcccugcacg

SEQ ID NO: 565395 - RNA, 23 nt, Human
cugagugggacccagacgguguc

SEQ ID NO: 565396 - RNA, 20 nt, Human
gagcagggcccgcacaacac

SEQ ID NO: 565397 - RNA, 19 nt, Human
gaggggacugggccugagu

SEQ ID NO: 565398 - RNA, 24 nt, Human
gaucucacacucucuucgcaccac

SEQ ID NO: 565399 - RNA, 24 nt, Human
gcccccaaggaagguuccuccgac

SEQ ID NO: 565400 - RNA, 25 nt, Human
gcccgcacaacacgagcgcccacca

SEQ ID NO: 565401 - RNA, 21 nt, Human
gcuucaucauggagugcagag

SEQ ID NO: 565402 - RNA, 20 nt, Human
ggaagguuccuccgacccuc

SEQ ID NO: 565403 - RNA, 22 nt, Human
ggaagucaaaagacccguuuau

SEQ ID NO: 565404 - RNA, 21 nt, Human
gggaagggaccagccaguggu

SEQ ID NO: 565405 - RNA, 21 nt, Human
ucagcgucuccuccaccuucu

SEQ ID NO: 565406 - RNA, 19 nt, Human
ucagggaagggaccagcca

SEQ ID NO: 565407 - RNA, 26 nt, Human
ucuuggggagcccggggguguugugg

SEQ ID NO: 565408 - RNA, 20 nt, Human
ucuuucuuccccugcagccu

SEQ ID NO: 565409 - RNA, 24 nt, Human
ugaggaucuguagcaccucggccu

SEQ ID NO: 565410 - RNA, 20 nt, Human
ugagugggacccagacggug

SEQ ID NO: 565411 - RNA, 21 nt, Human
uggccuccaggucaggguccu

SEQ ID NO: 565412 - RNA, 21 nt, Human
uggggaagcugaauuugcgca

SEQ ID NO: 565413 - RNA, 21 nt, Human
uggggcucagaccaggcccug

SEQ ID NO: 565414 - RNA, 19 nt, Human
uggggucacaaccucccgg

SEQ ID NO: 565415 - RNA, 19 nt, Human
uguggggcucagaccaggc

SEQ ID NO: 565416 - RNA, 19 nt, Human
uucaucauggagugcagag

SEQ ID NO: 565417 - RNA, 20 nt, Human
uuccuccgacccucagcucc

SEQ ID NO: 565418 - RNA, 20 nt, Human
uucugcuucaucauggagug

SEQ ID NO: 565419 - RNA, 19 nt, Human
uuggccagcucagccuugc

SEQ ID NO: 565420 - RNA, 18 nt, Human
aaguagcugggauuacag

SEQ ID NO: 565421 - RNA, 19 nt, Human
aaguagcugggauuacagc

SEQ ID NO: 565422 - RNA, 24 nt, Human
agcgauucuucugccucagccucc

SEQ ID NO: 565423 - RNA, 22 nt, Human
caagcgauucuucugccucagc

SEQ ID NO: 565424 - RNA, 27 nt, Human
caagcgauucuucugccucagccuccc

SEQ ID NO: 565425 - RNA, 23 nt, Human
cccaaguagcugggauuacagcu

SEQ ID NO: 565426 - RNA, 23 nt, Human
cccggguucaagcgauucuucug

SEQ ID NO: 565427 - RNA, 24 nt, Human
ccgccucccggguucaagcgauuc

SEQ ID NO: 565428 - RNA, 24 nt, Human
ccucccggguucaagcgauucuuc

SEQ ID NO: 565429 - RNA, 20 nt, Human
cucaaccuccgccucccggg

SEQ ID NO: 565430 - RNA, 22 nt, Human
cucaaccuccgccucccggguu

SEQ ID NO: 565431 - RNA, 24 nt, Human
cucagccucccaaguagcugggau

SEQ ID NO: 565432 - RNA, 19 nt, Human
cuggaggcagacaguucac

SEQ ID NO: 565433 - RNA, 24 nt, Human
gcgauucuucugccucagccuccc

SEQ ID NO: 565434 - RNA, 24 nt, Human
gcucaaccuccgccucccggguuc

SEQ ID NO: 565435 - RNA, 24 nt, Human
guugcucaaccuccgccucccggg

SEQ ID NO: 565436 - RNA, 18 nt, Human
ucagccucccaaguagcu

SEQ ID NO: 565437 - RNA, 20 nt, Human
ucagccucccaaguagcugg

SEQ ID NO: 565438 - RNA, 22 nt, Human
ucccaaguagcugggauuacag

SEQ ID NO: 565439 - RNA, 20 nt, Human
ucccggguucaagcgauucu

SEQ ID NO: 565440 - RNA, 24 nt, Human
ucccggguucaagcgauucuucug

SEQ ID NO: 565441 - RNA, 24 nt, Human
ucugccucagccucccaaguagcu

SEQ ID NO: 565442 - RNA, 24 nt, Human
ugccucagccucccaaguagcugg

SEQ ID NO: 565443 - RNA, 23 nt, Human
uucaagcgauucuucugccucag

SEQ ID NO: 565444 - RNA, 24 nt, Human
uucaagcgauucuucugccucagc

SEQ ID NO: 565445 - RNA, 23 nt, Human
uugcucaaccuccgccucccggg

SEQ ID NO: 565446 - RNA, 22 nt, Human
uuuacaaagugggcacaggggc

SEQ ID NO: 565447 - RNA, 25 nt, Human
aaaaagccccaaacagaacaccucc

SEQ ID NO: 565448 - RNA, 18 nt, Human
aaaagccccaaacagaac

SEQ ID NO: 565449 - RNA, 18 nt, Human
aaagaggagaggcugugc

SEQ ID NO: 565450 - RNA, 23 nt, Human
aacaauagaaggaacauccugaa

SEQ ID NO: 565451 - RNA, 22 nt, Human
acaauagaaggaacauccugaa

SEQ ID NO: 565452 - RNA, 27 nt, Human
agaaaacaauagaaggaaccgguaccc

SEQ ID NO: 565453 - RNA, 24 nt, Human
agcagucuaaaaagccccaaacag

SEQ ID NO: 565454 - RNA, 21 nt, Human
auggauucagggaagggcuga

SEQ ID NO: 565455 - RNA, 18 nt, Human
caaccagcugagcagcag

SEQ ID NO: 565456 - RNA, 19 nt, Human
caauagaaggaacauccug

SEQ ID NO: 565457 - RNA, 24 nt, Human
cagcagcagucuaaaaagccccaa

SEQ ID NO: 565458 - RNA, 18 nt, Human
cauccugaauucuagagu

SEQ ID NO: 565459 - RNA, 19 nt, Human
cauccugaauucuagaguu

SEQ ID NO: 565460 - RNA, 19 nt, Human
cccuaccugccugucuagc

SEQ ID NO: 565461 - RNA, 20 nt, Human
ccugccugucuagcuuucuc

SEQ ID NO: 565462 - RNA, 19 nt, Human
ccuuggaauaagccaaaaa

SEQ ID NO: 565463 - RNA, 24 nt, Human
cuaaaaagccccaaacagaacacc

SEQ ID NO: 565464 - RNA, 20 nt, Human
cuagcucuugacuuagcuua

SEQ ID NO: 565465 - RNA, 19 nt, Human
cuuucuaguaugugccaaa

SEQ ID NO: 565466 - RNA, 21 nt, Human
gcacaggaugacuagggaaug

SEQ ID NO: 565467 - RNA, 19 nt, Human
gccaaaaaaaacauaacuc

SEQ ID NO: 565468 - RNA, 18 nt, Human
gcuguggugaggcacagg

SEQ ID NO: 565469 - RNA, 22 nt, Human
uaagaaaacaauagaaggaaca

SEQ ID NO: 565470 - RNA, 21 nt, Human
uaccccuuggaauaagccaaa

SEQ ID NO: 565471 - RNA, 23 nt, Human
uagaacaaaaguacaauugggca

SEQ ID NO: 565472 - RNA, 22 nt, Human
uaggaucacgcucaccucacga

SEQ ID NO: 565473 - RNA, 23 nt, Human
uauguccugggaucaggggugcu

SEQ ID NO: 565474 - RNA, 18 nt, Human
ucagggaagggcugaggc

SEQ ID NO: 565475 - RNA, 19 nt, Human
ucuaagcaagcugugguga

SEQ ID NO: 565476 - RNA, 18 nt, Human
ucuccuccccuccccaca

SEQ ID NO: 565477 - RNA, 20 nt, Human
ucugaauuggggcccagggg

SEQ ID NO: 565478 - RNA, 21 nt, Human
ucugguucuucagcguccucg

SEQ ID NO: 565479 - RNA, 18 nt, Human
ugaauuggggcccagggg

SEQ ID NO: 565480 - RNA, 21 nt, Human
ugaauuggggcccaggggacu

SEQ ID NO: 565481 - RNA, 20 nt, Human
uggcuaagaaaacaauagaa

SEQ ID NO: 565482 - RNA, 22 nt, Human
ugggcaucuuuccuuauguccu

SEQ ID NO: 565483 - RNA, 18 nt, Human
uggggagggaaaaggagu

SEQ ID NO: 565484 - RNA, 22 nt, Human
ugugccaaaaaaaacauaacuc

SEQ ID NO: 565485 - RNA, 22 nt, Human
uuaccccuuggaauaagccaaa

SEQ ID NO: 565486 - RNA, 26 nt, Human
uuaguccauucuccuaaguaaagccu

SEQ ID NO: 565487 - RNA, 19 nt, Human
uucagggaagggcugaggc

SEQ ID NO: 565488 - RNA, 22 nt, Human
uucuccuccccuccccacagcc

SEQ ID NO: 565489 - RNA, 19 nt, Human
uuucuggcuuaccccuugg

SEQ ID NO: 565490 - RNA, 24 nt, Human
uuuucuggcuuaccccuuggaaua

SEQ ID NO: 565491 - RNA, 22 nt, Human
uuuuuuuuuuuuuuuuucccuu

SEQ ID NO: 565492 - RNA, 19 nt, Human
acacgcauucucagguccc

SEQ ID NO: 565493 - RNA, 18 nt, Human
agagcucauacugcugcc

SEQ ID NO: 565494 - RNA, 18 nt, Human
agcaugggaugcaggaga

SEQ ID NO: 565495 - RNA, 19 nt, Human
aggagaaagcagaggcagg

SEQ ID NO: 565496 - RNA, 19 nt, Human
agguccccacuggugggga

SEQ ID NO: 565497 - RNA, 20 nt, Human
aucgaggacagcaggccaca

SEQ ID NO: 565498 - RNA, 19 nt, Human
caagcagugugcuaugcga

SEQ ID NO: 565499 - RNA, 19 nt, Human
cacaggcggggaucugugg

SEQ ID NO: 565500 - RNA, 18 nt, Human
cagaggccgagucgaggu

SEQ ID NO: 565501 - RNA, 22 nt, Human
caugccagcagucacauguggc

SEQ ID NO: 565502 - RNA, 24 nt, Human
ccaauacuggaggccuuacccagu

SEQ ID NO: 565503 - RNA, 21 nt, Human
cccaccaccccugucuguacc

SEQ ID NO: 565504 - RNA, 21 nt, Human
ccgagucgaggugggggucag

SEQ ID NO: 565505 - RNA, 21 nt, Human
ccucuggaagagccaucaccu

SEQ ID NO: 565506 - RNA, 24 nt, Human
ccucuguaucaacaauacccacuu

SEQ ID NO: 565507 - RNA, 20 nt, Human
ccugucuguaccagcaaggu

SEQ ID NO: 565508 - RNA, 28 nt, Human
ccugucuguaccagcaagguacagaguu

SEQ ID NO: 565509 - RNA, 20 nt, Human
ccuuuguucucuggcaggga

SEQ ID NO: 565510 - RNA, 24 nt, Human
ccuuuguucucuggcagggaaggc

SEQ ID NO: 565511 - RNA, 18 nt, Human
gaagagagggaaggcaag

SEQ ID NO: 565512 - RNA, 23 nt, Human
gcaagaucucggccuggggucug

SEQ ID NO: 565513 - RNA, 18 nt, Human
ggaauuccuuucacugcu

SEQ ID NO: 565514 - RNA, 21 nt, Human
gugccuacugcaguggacaac

SEQ ID NO: 565515 - RNA, 21 nt, Human
uacagagcugacacuaggggc

SEQ ID NO: 565516 - RNA, 22 nt, Human
uaccaacacgggggaagagagg

SEQ ID NO: 565517 - RNA, 19 nt, Human
uacccacuucugcucagag

SEQ ID NO: 565518 - RNA, 20 nt, Human
uaguccagugcaagggcggg

SEQ ID NO: 565519 - RNA, 18 nt, Human
ucagagcucauacugcug

SEQ ID NO: 565520 - RNA, 19 nt, Human
ucagguccccacugguggg

SEQ ID NO: 565521 - RNA, 21 nt, Human
ucauagagccuggcugcccac

SEQ ID NO: 565522 - RNA, 23 nt, Human
uccagugcaagggcgggggcugg

SEQ ID NO: 565523 - RNA, 19 nt, Human
uccccuggagcagggcuga

SEQ ID NO: 565524 - RNA, 23 nt, Human
uccggucuaucgaggacagcagg

SEQ ID NO: 565525 - RNA, 24 nt, Human
uccugugaccuucgauuucuggcu

SEQ ID NO: 565526 - RNA, 28 nt, Human
ucuaggacaaggaauuagaacccaaccu

SEQ ID NO: 565527 - RNA, 19 nt, Human
ucuaucgaggacagcaggc

SEQ ID NO: 565528 - RNA, 24 nt, Human
ugacaacuuccugugaccuucgau

SEQ ID NO: 565529 - RNA, 20 nt, Human
ugaccagcagaacucucuug

SEQ ID NO: 565530 - RNA, 19 nt, Human
ugaugaugaaaaccuuucu

SEQ ID NO: 565531 - RNA, 18 nt, Human
ugcacugccaucucagcc

SEQ ID NO: 565532 - RNA, 23 nt, Human
ugcaguggacaacaauacagccc

SEQ ID NO: 565533 - RNA, 21 nt, Human
ugccagcagucacauguggcc

SEQ ID NO: 565534 - RNA, 22 nt, Human
uggcagaggccgagucgaggug

SEQ ID NO: 565535 - RNA, 20 nt, Human
uggcagggaaggcagcuggc

SEQ ID NO: 565536 - RNA, 18 nt, Human
uggcugcccaccaccccu

SEQ ID NO: 565537 - RNA, 23 nt, Human
uggcugcccaccaccccugucug

SEQ ID NO: 565538 - RNA, 19 nt, Human
uguggccggugccuacugc

SEQ ID NO: 565539 - RNA, 21 nt, Human
uuagaacccaacacacaaaac

SEQ ID NO: 565540 - RNA, 24 nt, Human
uucagaccaugacccugcuuagca

SEQ ID NO: 565541 - RNA, 19 nt, Human
uugaaaguucucguggcaa

SEQ ID NO: 565542 - RNA, 21 nt, Human
uuucuggcucuggggugugcc

SEQ ID NO: 565543 - RNA, 24 nt, Human
aaagugcugggauuacaggcguga

SEQ ID NO: 565544 - RNA, 24 nt, Human
aaaguguugggauuacagguguga

SEQ ID NO: 565545 - RNA, 18 nt, Human
aagcaaaaauaaaguuga

SEQ ID NO: 565546 - RNA, 20 nt, Human
aagcaaaaauaaaguugaug

SEQ ID NO: 565547 - RNA, 20 nt, Human
aaguagcugggauuacaggc

SEQ ID NO: 565548 - RNA, 25 nt, Human
aaguagcugggauuacaggcgucca

SEQ ID NO: 565549 - RNA, 24 nt, Human
aagugaucugcccgccucagccuc

SEQ ID NO: 565550 - RNA, 19 nt, Human
aagugcugggauuacaggc

SEQ ID NO: 565551 - RNA, 19 nt, Human
aagugcugggauuacaggc

SEQ ID NO: 565552 - RNA, 26 nt, Human
aagugcugggauuacaggcgugagcc

SEQ ID NO: 565553 - RNA, 23 nt, Human
aaguguuaggauuacagguguga

SEQ ID NO: 565554 - RNA, 26 nt, Human
aaguguuaggauuacaggugugagcc

SEQ ID NO: 565555 - RNA, 21 nt, Human
aaguguugggauuacaggugu

SEQ ID NO: 565556 - RNA, 26 nt, Human
aaguguugggauuacaggugugagcc

SEQ ID NO: 565557 - RNA, 24 nt, Human
accauguuacccaggcuggucuug

SEQ ID NO: 565558 - RNA, 25 nt, Human
accauguuacccaggcuggucuuga

SEQ ID NO: 565559 - RNA, 20 nt, Human
accgugccuggccagaaaca

SEQ ID NO: 565560 - RNA, 21 nt, Human
acugcaaccucugccuccugg

SEQ ID NO: 565561 - RNA, 22 nt, Human
acugcaaccucugccuccuggg

SEQ ID NO: 565562 - RNA, 21 nt, Human
acugugucgcccaggcuguag

SEQ ID NO: 565563 - RNA, 23 nt, Human
acugugucgcccaggcuguagcg

SEQ ID NO: 565564 - RNA, 18 nt, Human
agacagggucuuacugug

SEQ ID NO: 565565 - RNA, 22 nt, Human
agcaaagacuauuaauacccau

SEQ ID NO: 565566 - RNA, 18 nt, Human
agccucccgaauagcugg

SEQ ID NO: 565567 - RNA, 20 nt, Human
agcgcaguggcgugaucaug

SEQ ID NO: 565568 - RNA, 24 nt, Human
agcgcaguggcgugaucaugacuc

SEQ ID NO: 565569 - RNA, 23 nt, Human
aggcgugagccaccgugccuggc

SEQ ID NO: 565570 - RNA, 18 nt, Human
aggcuguagcgcaguggc

SEQ ID NO: 565571 - RNA, 22 nt, Human
aggcuuaggugauccucuuacc

SEQ ID NO: 565572 - RNA, 28 nt, Human
aggugauccacccaucugggucggccuc

SEQ ID NO: 565573 - RNA, 24 nt, Human
agguguuucgccauguuggccagg

SEQ ID NO: 565574 - RNA, 23 nt, Human
agugcagaggcacgaucuuggcu

SEQ ID NO: 565575 - RNA, 18 nt, Human
agugcugggauuacaggc

SEQ ID NO: 565576 - RNA, 20 nt, Human
auggcucuuuuuuagcuucu

SEQ ID NO: 565577 - RNA, 24 nt, Human
augggauuucaccauguuacccag

SEQ ID NO: 565578 - RNA, 19 nt, Human
augggguuucaccauguug

SEQ ID NO: 565579 - RNA, 20 nt, Human
augggguuucaccauguugu

SEQ ID NO: 565580 - RNA, 24 nt, Human
auuuuuguauuuuuaguagagaca

SEQ ID NO: 565581 - RNA, 24 nt, Human
caaagugcugggauuacaggcgug

SEQ ID NO: 565582 - RNA, 24 nt, Human
caaaguguugggauuacaggugug

SEQ ID NO: 565583 - RNA, 24 nt, Human
caaguguuaggauuacagguguga

SEQ ID NO: 565584 - RNA, 23 nt, Human
cacacauuuuuaaaaaaagagaa

SEQ ID NO: 565585 - RNA, 24 nt, Human
caccacaccagacgauaaacacac

SEQ ID NO: 565586 - RNA, 23 nt, Human
caccauguuacccaggcuggucu

SEQ ID NO: 565587 - RNA, 24 nt, Human
caccauguuacccaggcuggucuu

SEQ ID NO: 565588 - RNA, 27 nt, Human
caccauguuacccaggcuggucuugaa

SEQ ID NO: 565589 - RNA, 24 nt, Human
caccauguugucaaggcuggucuc

SEQ ID NO: 565590 - RNA, 22 nt, Human
cagagaugggguuucaccaugu

SEQ ID NO: 565591 - RNA, 24 nt, Human
cagggucuuacugugucgcccagg

SEQ ID NO: 565592 - RNA, 24 nt, Human
cagguguuucgccauguuggccag

SEQ ID NO: 565593 - RNA, 23 nt, Human
caugcaccaccauggucggcuaa

SEQ ID NO: 565594 - RNA, 24 nt, Human
cauguuacccaggcuggucuugaa

SEQ ID NO: 565595 - RNA, 24 nt, Human
cauguuggccaggcuggucucgaa

SEQ ID NO: 565596 - RNA, 22 nt, Human
ccaaagugcugggauuacaggc

SEQ ID NO: 565597 - RNA, 22 nt, Human
ccaaagugcugggauuacaggc

SEQ ID NO: 565598 - RNA, 24 nt, Human
ccaaagugcugggauuacaggcgu

SEQ ID NO: 565599 - RNA, 21 nt, Human
ccaaaguguugggauuacagg

SEQ ID NO: 565600 - RNA, 21 nt, Human
ccaaaguguugggauuacagg

SEQ ID NO: 565601 - RNA, 24 nt, Human
ccaaaguguugggauuacaggugu

SEQ ID NO: 565602 - RNA, 22 nt, Human
ccaaguagcugggauuacaggc

SEQ ID NO: 565603 - RNA, 24 nt, Human
ccaaguagcugggauuacaggcgu

SEQ ID NO: 565604 - RNA, 19 nt, Human
ccaaguguuaggauuacag

SEQ ID NO: 565605 - RNA, 23 nt, Human
ccaaguguuaggauuacaggugu

SEQ ID NO: 565606 - RNA, 24 nt, Human
ccaggcuggucuugaacuccuggg

SEQ ID NO: 565607 - RNA, 18 nt, Human
ccaucacccagguuggag

SEQ ID NO: 565608 - RNA, 19 nt, Human
ccauguuggccaggcuggu

SEQ ID NO: 565609 - RNA, 22 nt, Human
ccauguuggccaggcuggucuc

SEQ ID NO: 565610 - RNA, 23 nt, Human
ccauguuggccaggcuggucucg

SEQ ID NO: 565611 - RNA, 23 nt, Human
cccaaguagcugggauuacaggc

SEQ ID NO: 565612 - RNA, 23 nt, Human
cccaaguagcugggauuacaggc

SEQ ID NO: 565613 - RNA, 24 nt, Human
cccaaguguuaggauuacaggugu

SEQ ID NO: 565614 - RNA, 21 nt, Human
cccaggcuguagcgcaguggc

SEQ ID NO: 565615 - RNA, 21 nt, Human
cccagguuggagugcagaggc

SEQ ID NO: 565616 - RNA, 24 nt, Human
cccgaauagcugggacuacaggca

SEQ ID NO: 565617 - RNA, 19 nt, Human
ccucugccuccuggguuca

SEQ ID NO: 565618 - RNA, 26 nt, Human
ccucuuaccucagccucccgaauagc

SEQ ID NO: 565619 - RNA, 23 nt, Human
ccugaccucaggugauccaccca

SEQ ID NO: 565620 - RNA, 24 nt, Human
ccugaccucaggugauccacccau

SEQ ID NO: 565621 - RNA, 22 nt, Human
ccuggguuuaagugaucugccc

SEQ ID NO: 565622 - RNA, 22 nt, Human
ccuggguuuaagugaucugccc

SEQ ID NO: 565623 - RNA, 27 nt, Human
cgccauguuggccaggcuggucucgaa

SEQ ID NO: 565624 - RNA, 24 nt, Human
cgccucagccuccccaaguguuag

SEQ ID NO: 565625 - RNA, 24 nt, Human
cuaccagagaugggguuucaccau

SEQ ID NO: 565626 - RNA, 21 nt, Human
cuaggccucccaaagugcugg

SEQ ID NO: 565627 - RNA, 24 nt, Human
cucagccucccaaguagcugggau

SEQ ID NO: 565628 - RNA, 18 nt, Human
cuccaucacccagguugg

SEQ ID NO: 565629 - RNA, 24 nt, Human
cucccgaauagcugggacuacagg

SEQ ID NO: 565630 - RNA, 20 nt, Human
cuccugaccucaugaucugc

SEQ ID NO: 565631 - RNA, 19 nt, Human
cucuaguuuuacugaaagg

SEQ ID NO: 565632 - RNA, 23 nt, Human
cugcaaccucugccuccuggguu

SEQ ID NO: 565633 - RNA, 24 nt, Human
cugcaaccucugccuccuggguuc

SEQ ID NO: 565634 - RNA, 24 nt, Human
cugcccgccucagccuccccaagu

SEQ ID NO: 565635 - RNA, 19 nt, Human
cuggucuugaacuccuggg

SEQ ID NO: 565636 - RNA, 21 nt, Human
cuuacugugucgcccaggcug

SEQ ID NO: 565637 - RNA, 24 nt, Human
gaauagcugggacuacaggcaugc

SEQ ID NO: 565638 - RNA, 22 nt, Human
gaccucaggugauccacccauc

SEQ ID NO: 565639 - RNA, 18 nt, Human
gagaugggguuucaccau

SEQ ID NO: 565640 - RNA, 23 nt, Human
gagaugggguuucaccauguugu

SEQ ID NO: 565641 - RNA, 22 nt, Human
gaugggguuucaccauguuguc

SEQ ID NO: 565642 - RNA, 21 nt, Human
gauuacaggcguccaccacca

SEQ ID NO: 565643 - RNA, 18 nt, Human
gauuacaggcgugagcca

SEQ ID NO: 565644 - RNA, 20 nt, Human
gauuacaggcgugagccacc

SEQ ID NO: 565645 - RNA, 21 nt, Human
gauuacaggcgugagccaccg

SEQ ID NO: 565646 - RNA, 18 nt, Human
gauuacaggugugagcca

SEQ ID NO: 565647 - RNA, 18 nt, Human
gauuacaggugugagcca

SEQ ID NO: 565648 - RNA, 21 nt, Human
gauuacaggugugagccacca

SEQ ID NO: 565649 - RNA, 22 nt, Human
gauuacaggugugagccaccac

SEQ ID NO: 565650 - RNA, 22 nt, Human
gauuacaggugugagccacugc

SEQ ID NO: 565651 - RNA, 22 nt, Human
gauuacaggugugagccacugc

SEQ ID NO: 565652 - RNA, 21 nt, Human
gauuauucugccucagccucc

SEQ ID NO: 565653 - RNA, 18 nt, Human
gcccggccuaauuuuugu

SEQ ID NO: 565654 - RNA, 22 nt, Human
gcccgguuaauuuuuuauauuu

SEQ ID NO: 565655 - RNA, 24 nt, Human
gcgauuauucugccucagccuccc

SEQ ID NO: 565656 - RNA, 23 nt, Human
gcuggucucaaacuccugaccuc

SEQ ID NO: 565657 - RNA, 23 nt, Human
gcuggucucgaacuccugaccuc

SEQ ID NO: 565658 - RNA, 21 nt, Human
gcuuacugcaaccucugccuc

SEQ ID NO: 565659 - RNA, 24 nt, Human
ggacuacaggcaugcaccaccaug

SEQ ID NO: 565660 - RNA, 22 nt, Human
ggagauggagucuugcuccauc

SEQ ID NO: 565661 - RNA, 22 nt, Human
ggauuacaggugugagccacca

SEQ ID NO: 565662 - RNA, 24 nt, Human
ggcuggucucaaacuccugaccuc

SEQ ID NO: 565663 - RNA, 24 nt, Human
ggcuggucucgaacuccugaccuc

SEQ ID NO: 565664 - RNA, 18 nt, Human
ggcuggucuugaacuccu

SEQ ID NO: 565665 - RNA, 22 nt, Human
ggcuguagcgcaguggcgugau

SEQ ID NO: 565666 - RNA, 23 nt, Human
ggcuuaggugauccucuuaccuc

SEQ ID NO: 565667 - RNA, 22 nt, Human
gggauuucaccauguuacccag

SEQ ID NO: 565668 - RNA, 24 nt, Human
ggguuuaagugaucugcccgccuc

SEQ ID NO: 565669 - RNA, 19 nt, Human
ggucucgaacuccugaccu

SEQ ID NO: 565670 - RNA, 22 nt, Human
gguguuucgccauguuggccag

SEQ ID NO: 565671 - RNA, 23 nt, Human
gguguuucgccauguuggccagg

SEQ ID NO: 565672 - RNA, 18 nt, Human
guagcugggauuacaggc

SEQ ID NO: 565673 - RNA, 24 nt, Human
gugauccucuuaccucagccuccc

SEQ ID NO: 565674 - RNA, 24 nt, Human
gugaucugcccgccucagccuccc

SEQ ID NO: 565675 - RNA, 21 nt, Human
uaaaaaaagagaauuucccac

SEQ ID NO: 565676 - RNA, 24 nt, Human
uaauuuuuguauuuuuaguagaga

SEQ ID NO: 565677 - RNA, 24 nt, Human
uaauuuuuuauauuucuaccagag

SEQ ID NO: 565678 - RNA, 27 nt, Human
uacacauaauuaagcaaaaauaaaguu

SEQ ID NO: 565679 - RNA, 22 nt, Human
uacaggcgugagccaccgugcc

SEQ ID NO: 565680 - RNA, 22 nt, Human
uacaggcgugagccaccgugcc

SEQ ID NO: 565681 - RNA, 23 nt, Human
uacaggcgugagccaccgugccu

SEQ ID NO: 565682 - RNA, 22 nt, Human
uacaggugugagccaccacacc

SEQ ID NO: 565683 - RNA, 19 nt, Human
uacaggugugagccacugc

SEQ ID NO: 565684 - RNA, 23 nt, Human
uacaggugugagccacugcgccc

SEQ ID NO: 565685 - RNA, 24 nt, Human
uaccagagaugggguuucaccaug

SEQ ID NO: 565686 - RNA, 25 nt, Human
uaccagagaugggguuucaccaugu

SEQ ID NO: 565687 - RNA, 24 nt, Human
uacccaggcuggucuugaacuccu

SEQ ID NO: 565688 - RNA, 26 nt, Human
uaccucagccucccgaauagcuggga

SEQ ID NO: 565689 - RNA, 21 nt, Human
uacugcaaccucugccuccug

SEQ ID NO: 565690 - RNA, 23 nt, Human
uacugcaaccucugccuccuggg

SEQ ID NO: 565691 - RNA, 23 nt, Human
uagagacagguguuucgccaugu

SEQ ID NO: 565692 - RNA, 22 nt, Human
uagauaugggauuucaccaugu

SEQ ID NO: 565693 - RNA, 18 nt, Human
uaggauuacaggugugag

SEQ ID NO: 565694 - RNA, 19 nt, Human
uaggauuacaggugugagc

SEQ ID NO: 565695 - RNA, 22 nt, Human
uaggauuacaggugugagccac

SEQ ID NO: 565696 - RNA, 24 nt, Human
uaggauuacaggugugagccacca

SEQ ID NO: 565697 - RNA, 25 nt, Human
uaguagagacagguguuucgccaug

SEQ ID NO: 565698 - RNA, 20 nt, Human
uaugaaaaacaaaggaaaag

SEQ ID NO: 565699 - RNA, 18 nt, Human
ucacccagguuggagugc

SEQ ID NO: 565700 - RNA, 20 nt, Human
ucagccucccaaguagcugg

SEQ ID NO: 565701 - RNA, 18 nt, Human
ucagccucccgaauagcu

SEQ ID NO: 565702 - RNA, 20 nt, Human
ucagccucccgaauagcugg

SEQ ID NO: 565703 - RNA, 24 nt, Human
uccaucacccagguuggagugcag

SEQ ID NO: 565704 - RNA, 24 nt, Human
ucccaaagugcugggauuacaggc

SEQ ID NO: 565705 - RNA, 23 nt, Human
ucccaaaguguugggauuacagg

SEQ ID NO: 565706 - RNA, 24 nt, Human
ucccaaguagcugggauuacaggc

SEQ ID NO: 565707 - RNA, 19 nt, Human
uccccaaguguuaggauua

SEQ ID NO: 565708 - RNA, 23 nt, Human
uccccaaguguuaggauuacagg

SEQ ID NO: 565709 - RNA, 24 nt, Human
ucccgaauagcugggacuacaggc

SEQ ID NO: 565710 - RNA, 22 nt, Human
uccuggguucaagcgauuauuc

SEQ ID NO: 565711 - RNA, 24 nt, Human
uccuggguucaagcgauuauucug

SEQ ID NO: 565712 - RNA, 22 nt, Human
ucgccauguuggccaggcuggu

SEQ ID NO: 565713 - RNA, 24 nt, Human
ucgccauguuggccaggcuggucu

SEQ ID NO: 565714 - RNA, 21 nt, Human
ucucgaacuccugaccucaug

SEQ ID NO: 565715 - RNA, 22 nt, Human
ucugcccgccucagccucccca

SEQ ID NO: 565716 - RNA, 24 nt, Human
ucugccucagccucccaaguagcu

SEQ ID NO: 565717 - RNA, 19 nt, Human
ucuuacugugucgcccagg

SEQ ID NO: 565718 - RNA, 23 nt, Human
ucuugcuccaucacccagguugg

SEQ ID NO: 565719 - RNA, 24 nt, Human
ucuugcuccaucacccagguugga

SEQ ID NO: 565720 - RNA, 22 nt, Human
ucuuuuuuuugagacagggucu

SEQ ID NO: 565721 - RNA, 21 nt, Human
ugaccucaggugauccaccca

SEQ ID NO: 565722 - RNA, 24 nt, Human
ugaccucaggugauccacccaucu

SEQ ID NO: 565723 - RNA, 24 nt, Human
ugaucugcccaccuaggccuccca

SEQ ID NO: 565724 - RNA, 24 nt, Human
ugccucagccucccaaguagcugg

SEQ ID NO: 565725 - RNA, 22 nt, Human
ugcuccaucacccagguuggag

SEQ ID NO: 565726 - RNA, 24 nt, Human
ugcuccaucacccagguuggagug

SEQ ID NO: 565727 - RNA, 24 nt, Human
ugcugggauuacaggcgugagcca

SEQ ID NO: 565728 - RNA, 23 nt, Human
uggagugcagaggcacgaucuug

SEQ ID NO: 565729 - RNA, 24 nt, Human
uggagugcagaggcacgaucuugg

SEQ ID NO: 565730 - RNA, 24 nt, Human
uggccaggcuggucucgaacuccu

SEQ ID NO: 565731 - RNA, 21 nt, Human
ugggacuacaggcaugcacca

SEQ ID NO: 565732 - RNA, 24 nt, Human
ugggacuacaggcaugcaccacca

SEQ ID NO: 565733 - RNA, 18 nt, Human
ugggauuacaggcgucca

SEQ ID NO: 565734 - RNA, 21 nt, Human
ugggauuacaggcguccacca

SEQ ID NO: 565735 - RNA, 24 nt, Human
ugggauuacaggcguccaccacca

SEQ ID NO: 565736 - RNA, 25 nt, Human
ugggauuacaggcguccaccaccau

SEQ ID NO: 565737 - RNA, 18 nt, Human
ugggauuacaggcgugag

SEQ ID NO: 565738 - RNA, 21 nt, Human
ugggauuacaggcgugagcca

SEQ ID NO: 565739 - RNA, 22 nt, Human
ugggauuacaggcgugagccac

SEQ ID NO: 565740 - RNA, 23 nt, Human
ugggauuacaggcgugagccacc

SEQ ID NO: 565741 - RNA, 23 nt, Human
ugggauuacaggcgugagccacc

SEQ ID NO: 565742 - RNA, 24 nt, Human
ugggauuacaggcgugagccaccg

SEQ ID NO: 565743 - RNA, 18 nt, Human
ugggauuacaggugugag

SEQ ID NO: 565744 - RNA, 19 nt, Human
ugggauuacaggugugagc

SEQ ID NO: 565745 - RNA, 21 nt, Human
ugggauuacaggugugagcca

SEQ ID NO: 565746 - RNA, 22 nt, Human
ugggauuacaggugugagccac

SEQ ID NO: 565747 - RNA, 22 nt, Human
ugggauuacaggugugagccac

SEQ ID NO: 565748 - RNA, 24 nt, Human
ugggauuacaggugugagccacug

SEQ ID NO: 565749 - RNA, 24 nt, Human
ugggauuucaccauguuacccagg

SEQ ID NO: 565750 - RNA, 23 nt, Human
ugggguuucaccauguugucaag

SEQ ID NO: 565751 - RNA, 24 nt, Human
uggguuuaagugaucugcccgccu

SEQ ID NO: 565752 - RNA, 24 nt, Human
ugucauggcucuuuuuuagcuucu

SEQ ID NO: 565753 - RNA, 19 nt, Human
ugugucgcccaggcuguag

SEQ ID NO: 565754 - RNA, 24 nt, Human
uuacugcaaccucugccuccuggg

SEQ ID NO: 565755 - RNA, 25 nt, Human
uuacugcaaccucugccuccugggu

SEQ ID NO: 565756 - RNA, 25 nt, Human
uuaguagagacagguguuucgccau

SEQ ID NO: 565757 - RNA, 23 nt, Human
uucaagcgauuauucugccucag

SEQ ID NO: 565758 - RNA, 28 nt, Human
uucucuaguuuuacugaaagguagaaua

SEQ ID NO: 565759 - RNA, 19 nt, Human
uucuuuuuuuugagacagg

SEQ ID NO: 565760 - RNA, 20 nt, Human
uucuuuuuuuugagacaggg

SEQ ID NO: 565761 - RNA, 22 nt, Human
uugagacagggucuuacugugu

SEQ ID NO: 565762 - RNA, 24 nt, Human
uugcuccaucacccagguuggagu

SEQ ID NO: 565763 - RNA, 21 nt, Human
uugggauuacaggugugagcc

SEQ ID NO: 565764 - RNA, 24 nt, Human
uuguagauaugggauuucaccaug

SEQ ID NO: 565765 - RNA, 23 nt, Human
uuuaagugaucugcccgccucag

SEQ ID NO: 565766 - RNA, 21 nt, Human
uuucaccauguugucaaggcu

SEQ ID NO: 565767 - RNA, 24 nt, Human
uuucgccauguuggccaggcuggu

SEQ ID NO: 565768 - RNA, 24 nt, Human
uuucuaccagagaugggguuucac

SEQ ID NO: 565769 - RNA, 24 nt, Human
uuuguagauaugggauuucaccau

SEQ ID NO: 565770 - RNA, 23 nt, Human
uuuuuaguagagacagguguuuc

SEQ ID NO: 565771 - RNA, 20 nt, Human
uuuuuguauuuuuaguagag

SEQ ID NO: 565772 - RNA, 20 nt, Human
aaagagguuccuguuccucc

SEQ ID NO: 565773 - RNA, 22 nt, Human
acauuugacaguuugggcauau

SEQ ID NO: 565774 - RNA, 21 nt, Human
agcgcuccagccacaaggaaa

SEQ ID NO: 565775 - RNA, 19 nt, Human
aggaaacaauuuggauuuu

SEQ ID NO: 565776 - RNA, 20 nt, Human
aggaauagggacgaauacau

SEQ ID NO: 565777 - RNA, 19 nt, Human
auaguuaaggaauagggac

SEQ ID NO: 565778 - RNA, 26 nt, Human
caacuuuccuucucucacugaaauaa

SEQ ID NO: 565779 - RNA, 19 nt, Human
cccuuucuuuuauagcucc

SEQ ID NO: 565780 - RNA, 19 nt, Human
ccuccagcacgaggauggg

SEQ ID NO: 565781 - RNA, 20 nt, Human
ccuccagcacgaggaugggg

SEQ ID NO: 565782 - RNA, 25 nt, Human
cgcuccagccacaaggaaacggcuc

SEQ ID NO: 565783 - RNA, 29 nt, Human
cuagugguccucuaaauccugcuccuucc

SEQ ID NO: 565784 - RNA, 18 nt, Human
cuccugaaagagguuccu

SEQ ID NO: 565785 - RNA, 25 nt, Human
ggaaaccacccucccuccgaccuuc

SEQ ID NO: 565786 - RNA, 18 nt, Human
guuaggaaacaauuugga

SEQ ID NO: 565787 - RNA, 18 nt, Human
uaaaauauaggugacuau

SEQ ID NO: 565788 - RNA, 19 nt, Human
uaaauccugcuccuucccc

SEQ ID NO: 565789 - RNA, 24 nt, Human
uaaauccugcuccuuccccgaggc

SEQ ID NO: 565790 - RNA, 23 nt, Human
uagcuccugaaagagguuccuuc

SEQ ID NO: 565791 - RNA, 22 nt, Human
ucccuccgaccuuccccggcuc

SEQ ID NO: 565792 - RNA, 24 nt, Human
ucccuccgaccuuccccggcuccc

SEQ ID NO: 565793 - RNA, 20 nt, Human
ugaaauaaaaauacauaguu

SEQ ID NO: 565794 - RNA, 21 nt, Human
uuugcuguuuuagagguaucu

SEQ ID NO: 565795 - RNA, 22 nt, Human
uuuuuuuuuuuuugggaguacu

SEQ ID NO: 565796 - RNA, 18 nt, Human
uuuuuuuuuuuuuuuuug

SEQ ID NO: 565797 - RNA, 24 nt, Human
uuuuuuuuuuuuuuuuuuuuuggg

SEQ ID NO: 565798 - RNA, 20 nt, Human
acaagcaguguucgcgggcc

SEQ ID NO: 565799 - RNA, 24 nt, Human
caguguucgcgggcaccuccagga

SEQ ID NO: 565800 - RNA, 23 nt, Human
ccaccgccgccaccuagguccug

SEQ ID NO: 565801 - RNA, 22 nt, Human
cugcuucguccucuccgguugc

SEQ ID NO: 565802 - RNA, 20 nt, Human
gcccaggcgacaagcagugu

SEQ ID NO: 565803 - RNA, 25 nt, Human
uaccaccgccgccaccuagguccug

SEQ ID NO: 565804 - RNA, 24 nt, Human
ucaaaaauugucuugcauuuucuc

SEQ ID NO: 565805 - RNA, 24 nt, Human
uccaguaucaaaaauugucuugca

SEQ ID NO: 565806 - RNA, 18 nt, Human
ugcagccgguaccaccgc

SEQ ID NO: 565807 - RNA, 24 nt, Human
ugcuucguccucuccgguugccca

SEQ ID NO: 565808 - RNA, 18 nt, Human
uugcauuuucucaucagc

SEQ ID NO: 565809 - RNA, 24 nt, Human
aacacaaaaccagaauuuauugaa

SEQ ID NO: 565810 - RNA, 23 nt, Human
aagaacuuaaaagaauacaacuu

SEQ ID NO: 565811 - RNA, 18 nt, Human
aauaagccugaagggaag

SEQ ID NO: 565812 - RNA, 18 nt, Human
acagaagaaaacacaaaa

SEQ ID NO: 565813 - RNA, 24 nt, Human
acagaagaaaacacaaaaccagaa

SEQ ID NO: 565814 - RNA, 22 nt, Human
acagacagcucuaccuaacugg

SEQ ID NO: 565815 - RNA, 25 nt, Human
acuucacacucaaacaauaagccug

SEQ ID NO: 565816 - RNA, 21 nt, Human
agaagaaaacacaaaaccaga

SEQ ID NO: 565817 - RNA, 22 nt, Human
agaagaaaacacaaaaccagaa

SEQ ID NO: 565818 - RNA, 24 nt, Human
agacauggaaguugucuccaaacc

SEQ ID NO: 565819 - RNA, 20 nt, Human
agagcccuacaugagaaagc

SEQ ID NO: 565820 - RNA, 21 nt, Human
agcagaaaugccagaugcaga

SEQ ID NO: 565821 - RNA, 18 nt, Human
agccuggggaugaggacu

SEQ ID NO: 565822 - RNA, 22 nt, Human
agcucacuuaucugagccuaaa

SEQ ID NO: 565823 - RNA, 19 nt, Human
aggaggaagaggagggcug

SEQ ID NO: 565824 - RNA, 23 nt, Human
aggaggaggaagaggagggcugg

SEQ ID NO: 565825 - RNA, 19 nt, Human
aggaggaggaggaagagga

SEQ ID NO: 565826 - RNA, 22 nt, Human
aggaggaggaggaggaagagga

SEQ ID NO: 565827 - RNA, 28 nt, Human
aggagggcugguagggggaggugucaug

SEQ ID NO: 565828 - RNA, 23 nt, Human
aggcaaaaggcagcagcucagag

SEQ ID NO: 565829 - RNA, 22 nt, Human
aggcagggcagggugaagagga

SEQ ID NO: 565830 - RNA, 23 nt, Human
aggcagggcagggugaagaggau

SEQ ID NO: 565831 - RNA, 22 nt, Human
agugagagagagcggcucuaca

SEQ ID NO: 565832 - RNA, 23 nt, Human
auaaaaccuccagaaucugggcc

SEQ ID NO: 565833 - RNA, 21 nt, Human
auaagccugaagggaagaagu

SEQ ID NO: 565834 - RNA, 21 nt, Human
augggagggugaacagacagc

SEQ ID NO: 565835 - RNA, 21 nt, Human
caaaaggcagcagcucagaga

SEQ ID NO: 565836 - RNA, 22 nt, Human
caaaauaauaacaaauaccaca

SEQ ID NO: 565837 - RNA, 26 nt, Human
caaauucuuagaacauagcacaugau

SEQ ID NO: 565838 - RNA, 19 nt, Human
cacacccgccccuguuccc

SEQ ID NO: 565839 - RNA, 18 nt, Human
cacccgccccuguuccca

SEQ ID NO: 565840 - RNA, 19 nt, Human
caccuucuggaccuacccu

SEQ ID NO: 565841 - RNA, 18 nt, Human
cacucaaacaauaagccu

SEQ ID NO: 565842 - RNA, 22 nt, Human
cacugaccaccucccacaggag

SEQ ID NO: 565843 - RNA, 23 nt, Human
cacugcugccaacuguccugcuc

SEQ ID NO: 565844 - RNA, 19 nt, Human
cagaauuuauugaaaguag

SEQ ID NO: 565845 - RNA, 19 nt, Human
cagcagcucagagagcagg

SEQ ID NO: 565846 - RNA, 23 nt, Human
caggcagggcagggugaagagga

SEQ ID NO: 565847 - RNA, 26 nt, Human
cagggauaaacauaaaacacugcucc

SEQ ID NO: 565848 - RNA, 24 nt, Human
cauggaaugaggccaccaagcaaa

SEQ ID NO: 565849 - RNA, 22 nt, Human
ccacaagcagacuucagaacua

SEQ ID NO: 565850 - RNA, 20 nt, Human
ccacuaacuagggagguaga

SEQ ID NO: 565851 - RNA, 23 nt, Human
ccagcaagcagugacugggauca

SEQ ID NO: 565852 - RNA, 18 nt, Human
ccaggcacaggcacacau

SEQ ID NO: 565853 - RNA, 24 nt, Human
ccagugagagagagcggcucuaca

SEQ ID NO: 565854 - RNA, 19 nt, Human
ccccccaccuucuggaccu

SEQ ID NO: 565855 - RNA, 19 nt, Human
cccggucucaagcauagag

SEQ ID NO: 565856 - RNA, 20 nt, Human
ccggucucaagcauagagag

SEQ ID NO: 565857 - RNA, 23 nt, Human
ccuccagaaucugggcccuacag

SEQ ID NO: 565858 - RNA, 20 nt, Human
ccuucaagccuggggaugag

SEQ ID NO: 565859 - RNA, 24 nt, Human
cgccacccaauucaaacuccacag

SEQ ID NO: 565860 - RNA, 18 nt, Human
cgcccccucaacugcagg

SEQ ID NO: 565861 - RNA, 22 nt, Human
cuacaugagaaagccaugugcc

SEQ ID NO: 565862 - RNA, 25 nt, Human
cucaaacaauaagccugagguaccc

SEQ ID NO: 565863 - RNA, 20 nt, Human
cucauggcccagagcucacu

SEQ ID NO: 565864 - RNA, 21 nt, Human
cucuacagucaaccgccaccc

SEQ ID NO: 565865 - RNA, 26 nt, Human
cugacucugcuuaacaaaguccaugc

SEQ ID NO: 565866 - RNA, 22 nt, Human
cugagcaaaaccucgcugugcc

SEQ ID NO: 565867 - RNA, 23 nt, Human
cuguacaguuccccccaccuucu

SEQ ID NO: 565868 - RNA, 20 nt, Human
cuguccugcucugcugaucu

SEQ ID NO: 565869 - RNA, 21 nt, Human
cuucgcccccucaacugcagg

SEQ ID NO: 565870 - RNA, 18 nt, Human
gaaagaucccuaaguccc

SEQ ID NO: 565871 - RNA, 21 nt, Human
gaagaaaacacaaaaccagaa

SEQ ID NO: 565872 - RNA, 24 nt, Human
gagggcugguagggggagguguca

SEQ ID NO: 565873 - RNA, 23 nt, Human
gcaaaaccucgcugugccaguga

SEQ ID NO: 565874 - RNA, 22 nt, Human
gcaagacauggaaguugucucc

SEQ ID NO: 565875 - RNA, 19 nt, Human
gcagcucagagagcaggga

SEQ ID NO: 565876 - RNA, 21 nt, Human
gccagaugcagagguucucug

SEQ ID NO: 565877 - RNA, 20 nt, Human
gcggucccgagacaagggcu

SEQ ID NO: 565878 - RNA, 22 nt, Human
gcucucugaagucuacagacuu

SEQ ID NO: 565879 - RNA, 25 nt, Human
gcuuaacaaaguccaugccccaggc

SEQ ID NO: 565880 - RNA, 18 nt, Human
ggaggaggaggaagagga

SEQ ID NO: 565881 - RNA, 21 nt, Human
ggaggaggaggaagaggaggg

SEQ ID NO: 565882 - RNA, 23 nt, Human
ggaggaggaggaggaagaggagg

SEQ ID NO: 565883 - RNA, 20 nt, Human
ggaggauucagcugggagac

SEQ ID NO: 565884 - RNA, 22 nt, Human
ggaggcagucuuccugagaaca

SEQ ID NO: 565885 - RNA, 18 nt, Human
ggcugagcaaaaccucgc

SEQ ID NO: 565886 - RNA, 18 nt, Human
ggcugguagggggaggug

SEQ ID NO: 565887 - RNA, 21 nt, Human
guagacggacauguucccuac

SEQ ID NO: 565888 - RNA, 19 nt, Human
guggaggcagucuuccuga

SEQ ID NO: 565889 - RNA, 20 nt, Human
uaaaauggucuuguugcaaa

SEQ ID NO: 565890 - RNA, 24 nt, Human
uaacaaaguccaugccccaggcac

SEQ ID NO: 565891 - RNA, 19 nt, Human
uacaguuccccccaccuuc

SEQ ID NO: 565892 - RNA, 21 nt, Human
uaccacagagagcccuacaug

SEQ ID NO: 565893 - RNA, 24 nt, Human
uacucagaacaauauauacaaaaa

SEQ ID NO: 565894 - RNA, 19 nt, Human
uacugaggucacugcugcc

SEQ ID NO: 565895 - RNA, 22 nt, Human
ucaaagauaccauuacucagaa

SEQ ID NO: 565896 - RNA, 24 nt, Human
ucaaauucuuagaacauagcacau

SEQ ID NO: 565897 - RNA, 21 nt, Human
ucacugcugccaacuguccug

SEQ ID NO: 565898 - RNA, 18 nt, Human
ucagagagcagggaggau

SEQ ID NO: 565899 - RNA, 18 nt, Human
ucagcugggaugggaggg

SEQ ID NO: 565900 - RNA, 21 nt, Human
uccaugccccaggcacaggca

SEQ ID NO: 565901 - RNA, 19 nt, Human
ucccuacugaggucacugc

SEQ ID NO: 565902 - RNA, 21 nt, Human
ucccuuauccaaauuuccacu

SEQ ID NO: 565903 - RNA, 18 nt, Human
uccugcucugcugaucug

SEQ ID NO: 565904 - RNA, 22 nt, Human
ucuccaaaccaguauuuggucu

SEQ ID NO: 565905 - RNA, 22 nt, Human
ugaacagacagcucuaccuaac

SEQ ID NO: 565906 - RNA, 26 nt, Human
ugaagaggauguugaguugcaggagg

SEQ ID NO: 565907 - RNA, 21 nt, Human
ugagaacacaggguucuucuu

SEQ ID NO: 565908 - RNA, 19 nt, Human
ugagugcgagaggguagac

SEQ ID NO: 565909 - RNA, 20 nt, Human
ugaucuguacaguucccccc

SEQ ID NO: 565910 - RNA, 18 nt, Human
ugccuucaagccugggga

SEQ ID NO: 565911 - RNA, 21 nt, Human
ugcucuggaacuucacacuca

SEQ ID NO: 565912 - RNA, 19 nt, Human
uggagaaugaggaccucac

SEQ ID NO: 565913 - RNA, 21 nt, Human
uggccaaugacauaaaaccuc

SEQ ID NO: 565914 - RNA, 18 nt, Human
ugggaagcuuccauggca

SEQ ID NO: 565915 - RNA, 18 nt, Human
ugggaugggagggugaac

SEQ ID NO: 565916 - RNA, 22 nt, Human
uggguagcggugguggaggcag

SEQ ID NO: 565917 - RNA, 18 nt, Human
ugguagggggagguguca

SEQ ID NO: 565918 - RNA, 23 nt, Human
ugguagggggaggugucaugagu

SEQ ID NO: 565919 - RNA, 19 nt, Human
ugguggaggcagucuuccu

SEQ ID NO: 565920 - RNA, 22 nt, Human
uguacaguuccccccaccuucu

SEQ ID NO: 565921 - RNA, 22 nt, Human
uguccugcucugcugaucugua

SEQ ID NO: 565922 - RNA, 19 nt, Human
ugugccagugagagagagc

SEQ ID NO: 565923 - RNA, 23 nt, Human
uguucccaugaaccccauaagag

SEQ ID NO: 565924 - RNA, 22 nt, Human
uguucccuacugaggucacugc

SEQ ID NO: 565925 - RNA, 22 nt, Human
uuacucagaacaauauauacaa

SEQ ID NO: 565926 - RNA, 20 nt, Human
uuagaacauagcacaugauu

SEQ ID NO: 565927 - RNA, 20 nt, Human
uuagagacaguuauucugug

SEQ ID NO: 565928 - RNA, 21 nt, Human
uucacacucaaacaauaagcc

SEQ ID NO: 565929 - RNA, 21 nt, Human
uucagggucccagaagugccc

SEQ ID NO: 565930 - RNA, 18 nt, Human
uuccauggcauggcccca

SEQ ID NO: 565931 - RNA, 18 nt, Human
uuggucuucaguaaacag

SEQ ID NO: 565932 - RNA, 19 nt, Human
cagacgaccuucacuguca

SEQ ID NO: 565933 - RNA, 22 nt, Human
cagcagucucauucccccggga

SEQ ID NO: 565934 - RNA, 20 nt, Human
cccaugcagguuugugacca

SEQ ID NO: 565935 - RNA, 23 nt, Human
cgcuaugcauauguaaacauauu

SEQ ID NO: 565936 - RNA, 23 nt, Human
cuuuaaggucauucggaaaaaag

SEQ ID NO: 565937 - RNA, 19 nt, Human
gaccacuccaguuggaaac

SEQ ID NO: 565938 - RNA, 28 nt, Human
ggaacagacggcccagcgcuguaaugac

SEQ ID NO: 565939 - RNA, 24 nt, Human
ggaaggcucuugggcguuggagag

SEQ ID NO: 565940 - RNA, 18 nt, Human
ggaggaaggcucuugggc

SEQ ID NO: 565941 - RNA, 21 nt, Human
guccuugaugauuuuuuuuuc

SEQ ID NO: 565942 - RNA, 22 nt, Human
guccuugaugauuuuuuuuucc

SEQ ID NO: 565943 - RNA, 24 nt, Human
gugccuagaaggaacagacggccc

SEQ ID NO: 565944 - RNA, 24 nt, Human
uaaaaggccacuauugccauggua

SEQ ID NO: 565945 - RNA, 19 nt, Human
uagaaggaacagacggccc

SEQ ID NO: 565946 - RNA, 23 nt, Human
uccucuggcuacguucaguccga

SEQ ID NO: 565947 - RNA, 21 nt, Human
ugugggcagggcgugagcggc

SEQ ID NO: 565948 - RNA, 22 nt, Human
uuuguccuugaugauuuuuuuu

SEQ ID NO: 565949 - RNA, 18 nt, Human
aaaaaaaaaaaccccaaa

SEQ ID NO: 565950 - RNA, 19 nt, Human
aaaaaaaaccccaaaaucc

SEQ ID NO: 565951 - RNA, 27 nt, Human
aaaaaaccccaaaauccccaaucuuga

SEQ ID NO: 565952 - RNA, 25 nt, Human
aaaauaggagcccauguaaaaaaaa

SEQ ID NO: 565953 - RNA, 18 nt, Human
aaaccaacuuacauuaga

SEQ ID NO: 565954 - RNA, 23 nt, Human
aaacugaaaucucccuuuuacca

SEQ ID NO: 565955 - RNA, 22 nt, Human
aaagaaaaaagcguaucauaga

SEQ ID NO: 565956 - RNA, 24 nt, Human
aaauacuaaaaaaaaaaaccccaa

SEQ ID NO: 565957 - RNA, 22 nt, Human
aaauccccaaucuugaaaccaa

SEQ ID NO: 565958 - RNA, 21 nt, Human
aaccccaaaauccccaaucuu

SEQ ID NO: 565959 - RNA, 21 nt, Human
aauacugucuuaaagguucua

SEQ ID NO: 565960 - RNA, 23 nt, Human
aaugcaagacaguaggggaaaaa

SEQ ID NO: 565961 - RNA, 24 nt, Human
aauguuauuuuuuuaaaugaaacu

SEQ ID NO: 565962 - RNA, 21 nt, Human
acaaagaacagaacucacagu

SEQ ID NO: 565963 - RNA, 23 nt, Human
acagugaugguggccucccucuu

SEQ ID NO: 565964 - RNA, 27 nt, Human
accccaaaauccccaaucuugaaacca

SEQ ID NO: 565965 - RNA, 18 nt, Human
acuagugugcccguuuug

SEQ ID NO: 565966 - RNA, 22 nt, Human
agaacucacaguuugaacagaa

SEQ ID NO: 565967 - RNA, 20 nt, Human
aggagcccauguaaaaaaaa

SEQ ID NO: 565968 - RNA, 22 nt, Human
auaacugauucagaaagauaaa

SEQ ID NO: 565969 - RNA, 21 nt, Human
auauguacauauguauauaua

SEQ ID NO: 565970 - RNA, 24 nt, Human
caaagaacagaacucacaguuuga

SEQ ID NO: 565971 - RNA, 21 nt, Human
caaaucaaacucuacuaacac

SEQ ID NO: 565972 - RNA, 25 nt, Human
ccauguaaaaaaaaaaaaauccacu

SEQ ID NO: 565973 - RNA, 27 nt, Human
ccccaaaauccccaaucuugaaaccaa

SEQ ID NO: 565974 - RNA, 20 nt, Human
cgggggugacuagugugccc

SEQ ID NO: 565975 - RNA, 19 nt, Human
cuaaaaaaaaaaaccccaa

SEQ ID NO: 565976 - RNA, 20 nt, Human
cuagaggaggauauguggua

SEQ ID NO: 565977 - RNA, 21 nt, Human
cucacaaagaacagaacucac

SEQ ID NO: 565978 - RNA, 25 nt, Human
gaccacagccaucgcccgucuccca

SEQ ID NO: 565979 - RNA, 19 nt, Human
guguaaugaaagaaaaaag

SEQ ID NO: 565980 - RNA, 23 nt, Human
uaaaaaaaaaaaccccaaaaucc

SEQ ID NO: 565981 - RNA, 24 nt, Human
uaaaaaaaaaaaccccaaaauccc

SEQ ID NO: 565982 - RNA, 22 nt, Human
uaaaaagauaacucccauagca

SEQ ID NO: 565983 - RNA, 28 nt, Human
uaaaacaguacuaauuuuaaguuuuaaa

SEQ ID NO: 565984 - RNA, 21 nt, Human
uaaaauguaaaaaaccugaaa

SEQ ID NO: 565985 - RNA, 20 nt, Human
uaaagguucuauugcucuuc

SEQ ID NO: 565986 - RNA, 19 nt, Human
uaauuucuaacuuguguua

SEQ ID NO: 565987 - RNA, 18 nt, Human
uacauauguauauauaua

SEQ ID NO: 565988 - RNA, 23 nt, Human
uacuaaaaaaaaaaaccccaaaa

SEQ ID NO: 565989 - RNA, 25 nt, Human
uaggagcccauguaaaaaaaaaaaa

SEQ ID NO: 565990 - RNA, 18 nt, Human
uaggggaaaaaauaggag

SEQ ID NO: 565991 - RNA, 18 nt, Human
uauguacauauguauaua

SEQ ID NO: 565992 - RNA, 18 nt, Human
uauguacauauguauaua

SEQ ID NO: 565993 - RNA, 20 nt, Human
uauguacauauguauauaua

SEQ ID NO: 565994 - RNA, 24 nt, Human
ucaaacucuacuaacacagcacau

SEQ ID NO: 565995 - RNA, 24 nt, Human
ucaagugcaagauuaucauaugau

SEQ ID NO: 565996 - RNA, 20 nt, Human
ucacaaagaacagaacucac

SEQ ID NO: 565997 - RNA, 22 nt, Human
ucagaaagauaaaugaaccuug

SEQ ID NO: 565998 - RNA, 22 nt, Human
uccaauauauguaaaauuucuc

SEQ ID NO: 565999 - RNA, 23 nt, Human
ucccauagcaauauuuguuuacu

SEQ ID NO: 566000 - RNA, 24 nt, Human
ucccauagcaauauuuguuuacuc

SEQ ID NO: 566001 - RNA, 27 nt, Human
uccccaaucuugaaaccaacuuacauu

SEQ ID NO: 566002 - RNA, 21 nt, Human
ucgcugcgcucgguuggauuc

SEQ ID NO: 566003 - RNA, 24 nt, Human
ucuccaagauggcggaggcagcuu

SEQ ID NO: 566004 - RNA, 24 nt, Human
ugaaaaauguuucuuccacugaaa

SEQ ID NO: 566005 - RNA, 24 nt, Human
ugaaaauacacuucuaauuuuaua

SEQ ID NO: 566006 - RNA, 20 nt, Human
ugaaauuacaaacaaaaaaa

SEQ ID NO: 566007 - RNA, 20 nt, Human
ugagguuaguuuauaacuuu

SEQ ID NO: 566008 - RNA, 26 nt, Human
ugcuucacaccuuuaauacugucuua

SEQ ID NO: 566009 - RNA, 21 nt, Human
uggauguccuucagcuagggu

SEQ ID NO: 566010 - RNA, 18 nt, Human
uguacauauguauauaua

SEQ ID NO: 566011 - RNA, 19 nt, Human
uguacauauguauauauau

SEQ ID NO: 566012 - RNA, 19 nt, Human
uguacauauguauauauau

SEQ ID NO: 566013 - RNA, 20 nt, Human
uuaaagguucuauugcucuu

SEQ ID NO: 566014 - RNA, 18 nt, Human
uuaaaucuccacauucag

SEQ ID NO: 566015 - RNA, 25 nt, Human
uucuauaaauacuaaaaaaaaaaac

SEQ ID NO: 566016 - RNA, 23 nt, Human
uuuaauacugucuuaaagguucu

SEQ ID NO: 566017 - RNA, 21 nt, Human
uuuacaguauauauagaauuu

SEQ ID NO: 566018 - RNA, 21 nt, Human
aaagccccuaaaugccucaca

SEQ ID NO: 566019 - RNA, 20 nt, Human
aaagguacaggaaaaggaga

SEQ ID NO: 566020 - RNA, 22 nt, Human
aagagcaccuucaagguucacc

SEQ ID NO: 566021 - RNA, 24 nt, Human
aaggaagauggaagauacuggaaa

SEQ ID NO: 566022 - RNA, 22 nt, Human
acauggagaaacagguauucaa

SEQ ID NO: 566023 - RNA, 18 nt, Human
agacaauguccaugcccu

SEQ ID NO: 566024 - RNA, 22 nt, Human
agaguagaugugaaguggcagg

SEQ ID NO: 566025 - RNA, 18 nt, Human
aggaagauggaagauacu

SEQ ID NO: 566026 - RNA, 23 nt, Human
aggcaagaaaagcagcacugcag

SEQ ID NO: 566027 - RNA, 21 nt, Human
aggcacacaggaagugguaga

SEQ ID NO: 566028 - RNA, 24 nt, Human
aggcauacuccaccuuuuacuaaa

SEQ ID NO: 566029 - RNA, 22 nt, Human
caagaaaagcagcacugcaggu

SEQ ID NO: 566030 - RNA, 22 nt, Human
caagcuaaggucugaggcuggc

SEQ ID NO: 566031 - RNA, 22 nt, Human
caaggaggcaguauacugugcc

SEQ ID NO: 566032 - RNA, 21 nt, Human
caccuucaagguucacccaca

SEQ ID NO: 566033 - RNA, 23 nt, Human
cagagacaauguccaugcccuca

SEQ ID NO: 566034 - RNA, 20 nt, Human
cagaucacucugaggccucc

SEQ ID NO: 566035 - RNA, 20 nt, Human
cccacaaacucaguccucuu

SEQ ID NO: 566036 - RNA, 22 nt, Human
cccucaggauggcuugguccac

SEQ ID NO: 566037 - RNA, 19 nt, Human
ccuauggccuucccaaugg

SEQ ID NO: 566038 - RNA, 25 nt, Human
ccucaagcugcuucaagcuaagguc

SEQ ID NO: 566039 - RNA, 21 nt, Human
ccugaaagccccuaaaugccu

SEQ ID NO: 566040 - RNA, 22 nt, Human
ccuucaagguucacccacaaac

SEQ ID NO: 566041 - RNA, 24 nt, Human
ccuuuuacuaaauuccugaaagcc

SEQ ID NO: 566042 - RNA, 18 nt, Human
cucccuccauccuccuac

SEQ ID NO: 566043 - RNA, 21 nt, Human
cucccuccauccuccuaccuc

SEQ ID NO: 566044 - RNA, 23 nt, Human
cucgggccaaagggaggaaaugg

SEQ ID NO: 566045 - RNA, 20 nt, Human
cucuccguuccuuugaguaa

SEQ ID NO: 566046 - RNA, 25 nt, Human
cuggaaaggcauacuccaccuuuua

SEQ ID NO: 566047 - RNA, 20 nt, Human
cuggccucaagcugcuucaa

SEQ ID NO: 566048 - RNA, 19 nt, Human
gaagaguagaugugaagug

SEQ ID NO: 566049 - RNA, 19 nt, Human
gacagaucacucugaggcc

SEQ ID NO: 566050 - RNA, 19 nt, Human
gccaggguugaggccacag

SEQ ID NO: 566051 - RNA, 19 nt, Human
ggagaaacagguauucaau

SEQ ID NO: 566052 - RNA, 18 nt, Human
ggaguagcuauaauugcc

SEQ ID NO: 566053 - RNA, 23 nt, Human
guagcagccucccuccauccucc

SEQ ID NO: 566054 - RNA, 24 nt, Human
guccacaaaauggagaaauggggc

SEQ ID NO: 566055 - RNA, 18 nt, Human
guuguggggaguggagcu

SEQ ID NO: 566056 - RNA, 25 nt, Human
uaauugccaggguugaggccacagu

SEQ ID NO: 566057 - RNA, 20 nt, Human
uacuaaauuccugaaagccc

SEQ ID NO: 566058 - RNA, 23 nt, Human
uagaguagcagccucccuccauc

SEQ ID NO: 566059 - RNA, 22 nt, Human
uagcagccucccuccauccucc

SEQ ID NO: 566060 - RNA, 18 nt, Human
uauauauauguauauaua

SEQ ID NO: 566061 - RNA, 24 nt, Human
uauauguauauauauuuauguaca

SEQ ID NO: 566062 - RNA, 24 nt, Human
uauguacacagacacaaggguaua

SEQ ID NO: 566063 - RNA, 19 nt, Human
uauguauauauauauguau

SEQ ID NO: 566064 - RNA, 22 nt, Human
uauguauauauauauguauaua

SEQ ID NO: 566065 - RNA, 19 nt, Human
uauguauauauauuuaugu

SEQ ID NO: 566066 - RNA, 20 nt, Human
uauguauauauauuuaugua

SEQ ID NO: 566067 - RNA, 18 nt, Human
ucacuaagguguuggaaa

SEQ ID NO: 566068 - RNA, 22 nt, Human
ucagagguccuaaggguuuucc

SEQ ID NO: 566069 - RNA, 18 nt, Human
uccacaaaauggagaaau

SEQ ID NO: 566070 - RNA, 28 nt, Human
ucccuccauccuccuaccucgggccaaa

SEQ ID NO: 566071 - RNA, 21 nt, Human
uccuuugaguauguugugggg

SEQ ID NO: 566072 - RNA, 24 nt, Human
ugaaguggcaggauccagaggcac

SEQ ID NO: 566073 - RNA, 19 nt, Human
uggaaagggcaagaaggua

SEQ ID NO: 566074 - RNA, 23 nt, Human
uggagaaacagguauucaaugca

SEQ ID NO: 566075 - RNA, 23 nt, Human
uggcggcagcucugccgucuucc

SEQ ID NO: 566076 - RNA, 20 nt, Human
uggcuugguccacaaaaugg

SEQ ID NO: 566077 - RNA, 22 nt, Human
uguauauauauauguauauaua

SEQ ID NO: 566078 - RNA, 21 nt, Human
ugugaaguggcaggauccaga

SEQ ID NO: 566079 - RNA, 20 nt, Human
uguggggaguggagcucgga

SEQ ID NO: 566080 - RNA, 19 nt, Human
uuacuaaauuccugaaagc

SEQ ID NO: 566081 - RNA, 24 nt, Human
uuccggguccccgcaggggggucc

SEQ ID NO: 566082 - RNA, 23 nt, Human
uuccuagagucuaggcaagaaaa

SEQ ID NO: 566083 - RNA, 22 nt, Human
uuguggggaguggagcucggau

SEQ ID NO: 566084 - RNA, 20 nt, Human
uuuauguacacagacacaag

SEQ ID NO: 566085 - RNA, 21 nt, Human
uuuuuuuuuuuuguacaaagu

SEQ ID NO: 566086 - RNA, 23 nt, Human
uuuuuuuuuuuuuuuguacaaag

SEQ ID NO: 566087 - RNA, 19 nt, Human
uuuuuuuuuuuuuuuuugu

SEQ ID NO: 566088 - RNA, 21 nt, Human
uuuuuuuuuuuuuuuuuuugg

SEQ ID NO: 566089 - RNA, 24 nt, Human
aaacaaccucaaagacaccccgag

SEQ ID NO: 566090 - RNA, 18 nt, Human
aaauuuuacagaaaccug

SEQ ID NO: 566091 - RNA, 23 nt, Human
aacccugucaucuguuaaucucu

SEQ ID NO: 566092 - RNA, 18 nt, Human
aacuugcuguuuccacaa

SEQ ID NO: 566093 - RNA, 19 nt, Human
aagaagagacaguccaaua

SEQ ID NO: 566094 - RNA, 18 nt, Human
aagaccuuccagcuccac

SEQ ID NO: 566095 - RNA, 24 nt, Human
acaaggccagcucagggcucacca

SEQ ID NO: 566096 - RNA, 22 nt, Human
acauacaucaaggugugucucc

SEQ ID NO: 566097 - RNA, 22 nt, Human
acauucauaacugcaagcuaaa

SEQ ID NO: 566098 - RNA, 18 nt, Human
acauugucagacuuggaa

SEQ ID NO: 566099 - RNA, 22 nt, Human
accaaaccucagaaaacaggga

SEQ ID NO: 566100 - RNA, 25 nt, Human
accccgagccuuugaacggagcccu

SEQ ID NO: 566101 - RNA, 18 nt, Human
accuuugcuuugucagga

SEQ ID NO: 566102 - RNA, 19 nt, Human
acugagcccugagaguagg

SEQ ID NO: 566103 - RNA, 21 nt, Human
agagagaagcugaggguucuc

SEQ ID NO: 566104 - RNA, 22 nt, Human
agaggaggacggaaagggggcc

SEQ ID NO: 566105 - RNA, 18 nt, Human
agcacauuuucauuggcu

SEQ ID NO: 566106 - RNA, 18 nt, Human
agccgaacagcggcucgg

SEQ ID NO: 566107 - RNA, 24 nt, Human
aggaagcuuugacccaaggcacca

SEQ ID NO: 566108 - RNA, 24 nt, Human
aggcaacagcucuguggcaaaaca

SEQ ID NO: 566109 - RNA, 18 nt, Human
aggcagagagaagcugag

SEQ ID NO: 566110 - RNA, 19 nt, Human
aggcagagagaagcugagg

SEQ ID NO: 566111 - RNA, 20 nt, Human
aggcagagagaagcugaggg

SEQ ID NO: 566112 - RNA, 21 nt, Human
aggggugagacccggucuguu

SEQ ID NO: 566113 - RNA, 22 nt, Human
agguaaaaaaagagguuuccag

SEQ ID NO: 566114 - RNA, 24 nt, Human
auguaacacaucaccuccaagacu

SEQ ID NO: 566115 - RNA, 21 nt, Human
auuauauacacaaaacucauc

SEQ ID NO: 566116 - RNA, 27 nt, Human
auuguacuuauugccagaauuuaccuu

SEQ ID NO: 566117 - RNA, 19 nt, Human
caaaacagggcucccugcc

SEQ ID NO: 566118 - RNA, 24 nt, Human
caaaacagggcucccugcccugcu

SEQ ID NO: 566119 - RNA, 23 nt, Human
caaaugugaaccacaccucuuuu

SEQ ID NO: 566120 - RNA, 25 nt, Human
caaccuuccaugaggaucuucaaaa

SEQ ID NO: 566121 - RNA, 23 nt, Human
caagcuaaacaaauuccugcugg

SEQ ID NO: 566122 - RNA, 23 nt, Human
caauuugcuuucucaaaacaaaa

SEQ ID NO: 566123 - RNA, 23 nt, Human
caccaauuugcuuucucaaaaca

SEQ ID NO: 566124 - RNA, 19 nt, Human
caccagcauguccuguggc

SEQ ID NO: 566125 - RNA, 24 nt, Human
cagacauccagaccagaaaaccau

SEQ ID NO: 566126 - RNA, 23 nt, Human
cagaggcagagagaagcugaggg

SEQ ID NO: 566127 - RNA, 18 nt, Human
cagggcucaccagcaugu

SEQ ID NO: 566128 - RNA, 22 nt, Human
ccagcuccacauaccacccuuc

SEQ ID NO: 566129 - RNA, 20 nt, Human
cccacagccugaaaugcuuu

SEQ ID NO: 566130 - RNA, 21 nt, Human
cccagcuugauaaacaaccuc

SEQ ID NO: 566131 - RNA, 23 nt, Human
ccgagccuuugaacggagcccuc

SEQ ID NO: 566132 - RNA, 19 nt, Human
ccucaaggacgucgaccaa

SEQ ID NO: 566133 - RNA, 23 nt, Human
ccugugagcacuacaguacugaa

SEQ ID NO: 566134 - RNA, 18 nt, Human
ccuucgugaggaucugca

SEQ ID NO: 566135 - RNA, 23 nt, Human
ccuuguuuguaaucucuuccaca

SEQ ID NO: 566136 - RNA, 21 nt, Human
cgcccucggcuccggccaucc

SEQ ID NO: 566137 - RNA, 19 nt, Human
cuacaagaagagacagucc

SEQ ID NO: 566138 - RNA, 26 nt, Human
cucguccuccucaaggacgucgacca

SEQ ID NO: 566139 - RNA, 19 nt, Human
cucugcacaaggccagcuc

SEQ ID NO: 566140 - RNA, 26 nt, Human
cucuuccacagucugucucuuccaaa

SEQ ID NO: 566141 - RNA, 24 nt, Human
cuggggugcagguacuacaggcau

SEQ ID NO: 566142 - RNA, 21 nt, Human
cugguucuucucccucugggg

SEQ ID NO: 566143 - RNA, 22 nt, Human
cuguggccacaagaccuuccag

SEQ ID NO: 566144 - RNA, 24 nt, Human
gaaaacagggacgugaaagaagga

SEQ ID NO: 566145 - RNA, 24 nt, Human
gaccaggcuugaggaagcuuugac

SEQ ID NO: 566146 - RNA, 24 nt, Human
gacugucaggaaagaccuugguua

SEQ ID NO: 566147 - RNA, 19 nt, Human
gacuuccccucaaaugugg

SEQ ID NO: 566148 - RNA, 21 nt, Human
gaggaagcuuugacccaaggc

SEQ ID NO: 566149 - RNA, 19 nt, Human
gcauguccuguggccacaa

SEQ ID NO: 566150 - RNA, 19 nt, Human
gccuagagaaaacaagccc

SEQ ID NO: 566151 - RNA, 22 nt, Human
gccuuguuuguaaucucuucca

SEQ ID NO: 566152 - RNA, 22 nt, Human
gcucuguggcaaaacacacaca

SEQ ID NO: 566153 - RNA, 19 nt, Human
gcugaguuaacugaucggu

SEQ ID NO: 566154 - RNA, 23 nt, Human
ggaggacggaaagggggccaaaa

SEQ ID NO: 566155 - RNA, 24 nt, Human
gggaagcacauuuucauuggcuug

SEQ ID NO: 566156 - RNA, 19 nt, Human
gggcaaauguucuccagga

SEQ ID NO: 566157 - RNA, 22 nt, Human
gucucuuccaaaacagggcucc

SEQ ID NO: 566158 - RNA, 19 nt, Human
gugcagguacuacaggcau

SEQ ID NO: 566159 - RNA, 19 nt, Human
guggcaaaacacacacauc

SEQ ID NO: 566160 - RNA, 21 nt, Human
uaaagagaaugaagggagcgc

SEQ ID NO: 566161 - RNA, 25 nt, Human
uaauauguuggccaaaaucagucuc

SEQ ID NO: 566162 - RNA, 22 nt, Human
uaauguaacacaucaccuccaa

SEQ ID NO: 566163 - RNA, 21 nt, Human
uacacagaugcuggacacaua

SEQ ID NO: 566164 - RNA, 24 nt, Human
uagaaucaugaacgaaaauuucac

SEQ ID NO: 566165 - RNA, 19 nt, Human
uagagaaaacaagccccaa

SEQ ID NO: 566166 - RNA, 21 nt, Human
uaggagcacuucucggagucg

SEQ ID NO: 566167 - RNA, 25 nt, Human
uaguaccuuucauaaaacaagcccu

SEQ ID NO: 566168 - RNA, 19 nt, Human
uagugcaaccuugcaaaaa

SEQ ID NO: 566169 - RNA, 22 nt, Human
uagugcaaccuugcaaaaaggg

SEQ ID NO: 566170 - RNA, 28 nt, Human
uauauacacaaaacucaucauucgugca

SEQ ID NO: 566171 - RNA, 20 nt, Human
uaucaagaaauccagaggac

SEQ ID NO: 566172 - RNA, 19 nt, Human
ucaggaaagaccuuggucc

SEQ ID NO: 566173 - RNA, 25 nt, Human
uccacacgguggcuacugcagcuaa

SEQ ID NO: 566174 - RNA, 25 nt, Human
uccacagucugucucuuccaaaaca

SEQ ID NO: 566175 - RNA, 21 nt, Human
uccaggaagcccugugagcac

SEQ ID NO: 566176 - RNA, 19 nt, Human
ucgaaacauugucagacuu

SEQ ID NO: 566177 - RNA, 22 nt, Human
ucgcugccgcccaggacagcgc

SEQ ID NO: 566178 - RNA, 20 nt, Human
ucggcuccggccauccucaa

SEQ ID NO: 566179 - RNA, 24 nt, Human
ucggcuccggccauccucaacugu

SEQ ID NO: 566180 - RNA, 22 nt, Human
ucuccagcuccucguccuccuc

SEQ ID NO: 566181 - RNA, 25 nt, Human
ucuguuaaucucuccgccugugaca

SEQ ID NO: 566182 - RNA, 21 nt, Human
ucuucaaaaaaaagaucucau

SEQ ID NO: 566183 - RNA, 22 nt, Human
ugaaaggacuuccccucaaaug

SEQ ID NO: 566184 - RNA, 21 nt, Human
ugaauacacagaugcuggaca

SEQ ID NO: 566185 - RNA, 25 nt, Human
ugaccaaaccucagaaaacagggac

SEQ ID NO: 566186 - RNA, 18 nt, Human
ugagaagauuaaaaguuu

SEQ ID NO: 566187 - RNA, 23 nt, Human
ugagacccggucuguuuucuagg

SEQ ID NO: 566188 - RNA, 24 nt, Human
ugaguuaacugaucgguacuauug

SEQ ID NO: 566189 - RNA, 22 nt, Human
ugcagcuaaagagaaugaaggg

SEQ ID NO: 566190 - RNA, 21 nt, Human
ugccagaacuccuuaaaagca

SEQ ID NO: 566191 - RNA, 18 nt, Human
ugccagaauuuaccuuug

SEQ ID NO: 566192 - RNA, 18 nt, Human
ugccagaauuuaccuuug

SEQ ID NO: 566193 - RNA, 21 nt, Human
uggccccacagccugaaaugc

SEQ ID NO: 566194 - RNA, 19 nt, Human
ugggaagcacauuuucauu

SEQ ID NO: 566195 - RNA, 24 nt, Human
ugguccuccagaggcagagagaag

SEQ ID NO: 566196 - RNA, 21 nt, Human
ugguggccccacagccugaaa

SEQ ID NO: 566197 - RNA, 24 nt, Human
ugucaggaaagaccuugguccucc

SEQ ID NO: 566198 - RNA, 26 nt, Human
uguccuguggccacaagaccuuccag

SEQ ID NO: 566199 - RNA, 20 nt, Human
ugugacuuccaugacauuca

SEQ ID NO: 566200 - RNA, 24 nt, Human
uuaaagagaucucauaucaacuga

SEQ ID NO: 566201 - RNA, 21 nt, Human
uuccaguuaaugugaaagaag

SEQ ID NO: 566202 - RNA, 22 nt, Human
uucguaaaccaccaagauuuca

SEQ ID NO: 566203 - RNA, 20 nt, Human
uucuacaaaaaugcacauac

SEQ ID NO: 566204 - RNA, 27 nt, Human
uucuaggugacgggaagagagccuucc

SEQ ID NO: 566205 - RNA, 24 nt, Human
uugaacggagcccucugcacaaag

SEQ ID NO: 566206 - RNA, 24 nt, Human
uugauauaugcuuaugaauauccc

SEQ ID NO: 566207 - RNA, 24 nt, Human
uugggccuagagaaaacaagcccc

SEQ ID NO: 566208 - RNA, 21 nt, Human
uuucacaggggugagacccgg

SEQ ID NO: 566209 - RNA, 26 nt, Human
uuugagaagauuaaaaguuuuccgga

SEQ ID NO: 566210 - RNA, 19 nt, Human
uuugcauaaaacaugcauu

SEQ ID NO: 566211 - RNA, 23 nt, Human
aaaaaaaaaaaaaacagcacuag

SEQ ID NO: 566212 - RNA, 21 nt, Human
aaaaaaaaaaaacagcacuag

SEQ ID NO: 566213 - RNA, 24 nt, Human
aacaucccagaacuucagaccagg

SEQ ID NO: 566214 - RNA, 23 nt, Human
aagcacauuacaauaaucuuuca

SEQ ID NO: 566215 - RNA, 19 nt, Human
aagugacaucagaugaaag

SEQ ID NO: 566216 - RNA, 24 nt, Human
aauccugggcucaagagauccucc

SEQ ID NO: 566217 - RNA, 22 nt, Human
aaugcaaucuauugaugucauc

SEQ ID NO: 566218 - RNA, 24 nt, Human
accuaagaaugcagugacugaaau

SEQ ID NO: 566219 - RNA, 23 nt, Human
acuaccaaauuuugaagcuuaau

SEQ ID NO: 566220 - RNA, 22 nt, Human
caagagauccuccugccucagc

SEQ ID NO: 566221 - RNA, 19 nt, Human
cacccauuccuuguggcuu

SEQ ID NO: 566222 - RNA, 20 nt, Human
cacccauuccuuguggcuua

SEQ ID NO: 566223 - RNA, 18 nt, Human
cagcugggacuacaggug

SEQ ID NO: 566224 - RNA, 19 nt, Human
caugaaaagugacaucaga

SEQ ID NO: 566225 - RNA, 24 nt, Human
ccugagcagcugggacuacaggug

SEQ ID NO: 566226 - RNA, 20 nt, Human
ccugggcucaagagauccuc

SEQ ID NO: 566227 - RNA, 21 nt, Human
ccugggcucaagagauccucc

SEQ ID NO: 566228 - RNA, 18 nt, Human
cucaagagauccuccugc

SEQ ID NO: 566229 - RNA, 23 nt, Human
cugccucagccuccugagcagcu

SEQ ID NO: 566230 - RNA, 20 nt, Human
cuuaauguauucauugccaa

SEQ ID NO: 566231 - RNA, 21 nt, Human
gaaagcugagaucugugaaag

SEQ ID NO: 566232 - RNA, 19 nt, Human
gaccagguuaagggggcca

SEQ ID NO: 566233 - RNA, 24 nt, Human
gagcagcugggacuacaggugugc

SEQ ID NO: 566234 - RNA, 21 nt, Human
gauccuccugccucagccucc

SEQ ID NO: 566235 - RNA, 21 nt, Human
gccacacuccacagcugaugu

SEQ ID NO: 566236 - RNA, 21 nt, Human
gccuccugagcagcugggacu

SEQ ID NO: 566237 - RNA, 22 nt, Human
ggccaaugagaagaucaugaaa

SEQ ID NO: 566238 - RNA, 22 nt, Human
gggcucaagagauccuccugcc

SEQ ID NO: 566239 - RNA, 18 nt, Human
gugaauaagagaacuucg

SEQ ID NO: 566240 - RNA, 22 nt, Human
uagagauggaaucuugcuaugu

SEQ ID NO: 566241 - RNA, 23 nt, Human
uaucaguaccaacccacuuuaau

SEQ ID NO: 566242 - RNA, 23 nt, Human
ucaguuuuuccaaguaaguccac

SEQ ID NO: 566243 - RNA, 22 nt, Human
uccacagaccauuugauaggcu

SEQ ID NO: 566244 - RNA, 24 nt, Human
uccugagcagcugggacuacaggu

SEQ ID NO: 566245 - RNA, 18 nt, Human
uccugggcucaagagauc

SEQ ID NO: 566246 - RNA, 23 nt, Human
ucuauugaugucaucauauuugg

SEQ ID NO: 566247 - RNA, 23 nt, Human
ucuugcuauguuguccacgaugg

SEQ ID NO: 566248 - RNA, 24 nt, Human
ucuugcuauguuguccacgaugga

SEQ ID NO: 566249 - RNA, 21 nt, Human
ugaaaacaucccagaacuuca

SEQ ID NO: 566250 - RNA, 18 nt, Human
ugaaaauagaaaaaucaa

SEQ ID NO: 566251 - RNA, 20 nt, Human
ugaaaauagaaaaaucaaac

SEQ ID NO: 566252 - RNA, 19 nt, Human
ugaaaugucuguucuaaaa

SEQ ID NO: 566253 - RNA, 22 nt, Human
ugagaagaucaugaaaagugac

SEQ ID NO: 566254 - RNA, 24 nt, Human
ugccucagccuccugagcagcugg

SEQ ID NO: 566255 - RNA, 22 nt, Human
ugcuaaaaaaaaaaaaaaaaaa

SEQ ID NO: 566256 - RNA, 30 nt, Human
ugcuaaaaaaaaaaaaaaaaaaaaacagcu

SEQ ID NO: 566257 - RNA, 18 nt, Human
uggaaucuugcuauguug

SEQ ID NO: 566258 - RNA, 19 nt, Human
uggaaucuugcuauguugu

SEQ ID NO: 566259 - RNA, 20 nt, Human
ugggacuacaggugugcacc

SEQ ID NO: 566260 - RNA, 21 nt, Human
ugggacuacaggugugcaccg

SEQ ID NO: 566261 - RNA, 24 nt, Human
ugggacuacaggugugcaccgcca

SEQ ID NO: 566262 - RNA, 24 nt, Human
ugggcucaagagauccuccugccu

SEQ ID NO: 566263 - RNA, 19 nt, Human
uucaaaauccugggcucaa

SEQ ID NO: 566264 - RNA, 18 nt, Human
acucgcuccaggugacau

SEQ ID NO: 566265 - RNA, 22 nt, Human
agggcuagugcgcgccacugcc

SEQ ID NO: 566266 - RNA, 24 nt, Human
cagagucugagaacagagguuaag

SEQ ID NO: 566267 - RNA, 19 nt, Human
cccgcccagcccucguguc

SEQ ID NO: 566268 - RNA, 21 nt, Human
cccgcccagcccucguguccc

SEQ ID NO: 566269 - RNA, 23 nt, Human
ccgcgcgcuacucgcuccaggug

SEQ ID NO: 566270 - RNA, 22 nt, Human
ccuguacaguauuuauuguucc

SEQ ID NO: 566271 - RNA, 19 nt, Human
cugagaacagagguuaaga

SEQ ID NO: 566272 - RNA, 22 nt, Human
cugugugucuguccugcauccc

SEQ ID NO: 566273 - RNA, 21 nt, Human
cuuuuccagagucugagaaca

SEQ ID NO: 566274 - RNA, 21 nt, Human
gcgagggcuagugcgcgccac

SEQ ID NO: 566275 - RNA, 18 nt, Human
ggagacaggccggcuucc

SEQ ID NO: 566276 - RNA, 19 nt, Human
ggcuagugcgcgccacugc

SEQ ID NO: 566277 - RNA, 18 nt, Human
gugcggcgcgagggcuag

SEQ ID NO: 566278 - RNA, 23 nt, Human
ucacugagugucugugugucugu

SEQ ID NO: 566279 - RNA, 20 nt, Human
ucccuaggucugaaggcgga

SEQ ID NO: 566280 - RNA, 23 nt, Human
ucccuaggucugaaggcggagac

SEQ ID NO: 566281 - RNA, 18 nt, Human
ucgugucccgugcggcgc

SEQ ID NO: 566282 - RNA, 22 nt, Human
ucucccuaggucugaaggcgga

SEQ ID NO: 566283 - RNA, 26 nt, Human
ugagaacagagguuaagaccucuccc

SEQ ID NO: 566284 - RNA, 21 nt, Human
ugagauguggagggaaugcga

SEQ ID NO: 566285 - RNA, 18 nt, Human
aaaauaggaauuguucuc

SEQ ID NO: 566286 - RNA, 19 nt, Human
aaagauuagaaagaacaug

SEQ ID NO: 566287 - RNA, 19 nt, Human
aacuagaaaacuaaaacag

SEQ ID NO: 566288 - RNA, 21 nt, Human
aagcauaaucacaugauacac

SEQ ID NO: 566289 - RNA, 20 nt, Human
acaaaacauaggauuaacaa

SEQ ID NO: 566290 - RNA, 25 nt, Human
accaauauauucagaccaacaaaga

SEQ ID NO: 566291 - RNA, 20 nt, Human
acuagaaaaaagacauagug

SEQ ID NO: 566292 - RNA, 21 nt, Human
agaaaaaagacauaguggaaa

SEQ ID NO: 566293 - RNA, 27 nt, Human
agaaaaaagacauaguggaaaaauuuu

SEQ ID NO: 566294 - RNA, 29 nt, Human
agaaaaaagacauaguggaaaaauuuuug

SEQ ID NO: 566295 - RNA, 21 nt, Human
agaccaacaaagauuagaaag

SEQ ID NO: 566296 - RNA, 18 nt, Human
caaccgaagcagccgcgg

SEQ ID NO: 566297 - RNA, 18 nt, Human
caacuagaaaacuaaaac

SEQ ID NO: 566298 - RNA, 22 nt, Human
cacaauauaacagguagauaag

SEQ ID NO: 566299 - RNA, 21 nt, Human
cacagccgcggccgcccgcuc

SEQ ID NO: 566300 - RNA, 24 nt, Human
cacauacauagaaaaauuagcaca

SEQ ID NO: 566301 - RNA, 24 nt, Human
cacaucacauacauagaaaaauua

SEQ ID NO: 566302 - RNA, 21 nt, Human
cagaaaggggaagucucccuc

SEQ ID NO: 566303 - RNA, 22 nt, Human
cagccgcggcuacugguucccc

SEQ ID NO: 566304 - RNA, 21 nt, Human
ccaacaaagauuagaaagaac

SEQ ID NO: 566305 - RNA, 23 nt, Human
ccaccgaccgcggcaaccgaagc

SEQ ID NO: 566306 - RNA, 19 nt, Human
ccgcggccgcccgcuccuc

SEQ ID NO: 566307 - RNA, 21 nt, Human
ccgcggcuacugguuccccgc

SEQ ID NO: 566308 - RNA, 25 nt, Human
cgcccgcuccuccgcgccggcucca

SEQ ID NO: 566309 - RNA, 18 nt, Human
cuccuccgcgccggcucc

SEQ ID NO: 566310 - RNA, 25 nt, Human
cucguaacacucuacaaauacaauc

SEQ ID NO: 566311 - RNA, 20 nt, Human
gaaaggggaagucucccuca

SEQ ID NO: 566312 - RNA, 19 nt, Human
gaccgcggcaaccgaagca

SEQ ID NO: 566313 - RNA, 21 nt, Human
uaaaacaagggcaugaaaaag

SEQ ID NO: 566314 - RNA, 20 nt, Human
uaacaaaaccauacgaaagc

SEQ ID NO: 566315 - RNA, 22 nt, Human
uaacagguagauaagaaaaaaa

SEQ ID NO: 566316 - RNA, 22 nt, Human
uauaacaaaaccauacgaaagc

SEQ ID NO: 566317 - RNA, 18 nt, Human
ucaagcuccuaaaaugaa

SEQ ID NO: 566318 - RNA, 19 nt, Human
ugagagagaaaaaaauaag

SEQ ID NO: 566319 - RNA, 18 nt, Human
ugucaaguaaaaauuuaa

SEQ ID NO: 566320 - RNA, 27 nt, Human
ugucagagauauucaacuagaaaacua

SEQ ID NO: 566321 - RNA, 18 nt, Human
ugucuucuuuuauuaaua

SEQ ID NO: 566322 - RNA, 24 nt, Human
uuagcacaauauaacagguagaua

SEQ ID NO: 566323 - RNA, 23 nt, Human
uuuuuggccuuguagagcucauc

SEQ ID NO: 566324 - RNA, 23 nt, Human
aaaaacaaaaacaaaaaaaacac

SEQ ID NO: 566325 - RNA, 22 nt, Human
aaaaacacaaaauugcugccac

SEQ ID NO: 566326 - RNA, 19 nt, Human
aaaaagccuuuacauggca

SEQ ID NO: 566327 - RNA, 22 nt, Human
aaaaagccuuuacauggcauuc

SEQ ID NO: 566328 - RNA, 21 nt, Human
aaaacaaaaacaaaaaaaaca

SEQ ID NO: 566329 - RNA, 24 nt, Human
aaaacaaaaacaaaaacaaaaaaa

SEQ ID NO: 566330 - RNA, 19 nt, Human
aaacacggggggggggggg

SEQ ID NO: 566331 - RNA, 25 nt, Human
aaagccuauguacaaguaagaaccu

SEQ ID NO: 566332 - RNA, 22 nt, Human
aaagugaggucuuaaccaaaaa

SEQ ID NO: 566333 - RNA, 24 nt, Human
aaauaaaaacacaaaauugcugcc

SEQ ID NO: 566334 - RNA, 21 nt, Human
aaucuguacagcaggggccug

SEQ ID NO: 566335 - RNA, 21 nt, Human
acagugacaaugaauaggcac

SEQ ID NO: 566336 - RNA, 26 nt, Human
acuguaaauacacauaugugugucca

SEQ ID NO: 566337 - RNA, 21 nt, Human
agcaggaaagccuauguacaa

SEQ ID NO: 566338 - RNA, 19 nt, Human
aguaugaaggcagcucaaa

SEQ ID NO: 566339 - RNA, 22 nt, Human
auuagccgucuccaaaauaaaa

SEQ ID NO: 566340 - RNA, 22 nt, Human
caaaaacaaaaaaaacacgggg

SEQ ID NO: 566341 - RNA, 23 nt, Human
caaaacaaaaacaaaaacaaaaa

SEQ ID NO: 566342 - RNA, 26 nt, Human
caaaacaaaaacaaaaacaaaaaaaa

SEQ ID NO: 566343 - RNA, 19 nt, Human
caauuuucagagcaaggac

SEQ ID NO: 566344 - RNA, 23 nt, Human
cacaaacuuagcauucuucuagg

SEQ ID NO: 566345 - RNA, 23 nt, Human
cucaaaugaugaacuaagguacc

SEQ ID NO: 566346 - RNA, 18 nt, Human
cugcacuguaaauacaca

SEQ ID NO: 566347 - RNA, 23 nt, Human
cuuaaggcaguuuuaaaagugag

SEQ ID NO: 566348 - RNA, 23 nt, Human
cuugauuuaccaauuuucagagc

SEQ ID NO: 566349 - RNA, 25 nt, Human
gcauucaaaacaaaaacaaaaacaa

SEQ ID NO: 566350 - RNA, 21 nt, Human
gccgucuccaaaauaaaaaca

SEQ ID NO: 566351 - RNA, 18 nt, Human
ggggggggggggggucac

SEQ ID NO: 566352 - RNA, 22 nt, Human
gggggggggggggucacuuaaa

SEQ ID NO: 566353 - RNA, 24 nt, Human
ggggggggggggucacuuaaaucu

SEQ ID NO: 566354 - RNA, 22 nt, Human
gggggggggggucacuuaaauc

SEQ ID NO: 566355 - RNA, 19 nt, Human
gucuccaaaauaaaaacac

SEQ ID NO: 566356 - RNA, 22 nt, Human
uaaaaacacaaaauugcugcca

SEQ ID NO: 566357 - RNA, 18 nt, Human
uaaauuauguacccaaaa

SEQ ID NO: 566358 - RNA, 24 nt, Human
uaagaauauauaacuccucccugg

SEQ ID NO: 566359 - RNA, 22 nt, Human
uaccauuagccgucuccaaaau

SEQ ID NO: 566360 - RNA, 23 nt, Human
uacuacagaacuauuuacacugc

SEQ ID NO: 566361 - RNA, 23 nt, Human
uagccgucuccaaaauaaaaaca

SEQ ID NO: 566362 - RNA, 18 nt, Human
uauguacccaaaaucugu

SEQ ID NO: 566363 - RNA, 23 nt, Human
uauuuauacuuaaggcaguuuua

SEQ ID NO: 566364 - RNA, 21 nt, Human
ucacagaguuaguccauaagg

SEQ ID NO: 566365 - RNA, 21 nt, Human
uccaaaauaaaaacacaaaau

SEQ ID NO: 566366 - RNA, 24 nt, Human
uccuaccauuagccgucuccaaaa

SEQ ID NO: 566367 - RNA, 24 nt, Human
ucucuuggacugacuaaaagagcu

SEQ ID NO: 566368 - RNA, 22 nt, Human
ucuuggacugacuaaaagagcu

SEQ ID NO: 566369 - RNA, 18 nt, Human
ugaauaggcacucaauac

SEQ ID NO: 566370 - RNA, 19 nt, Human
ugaauaggcacucaauaca

SEQ ID NO: 566371 - RNA, 23 nt, Human
ugcacuguaaauacacauaugug

SEQ ID NO: 566372 - RNA, 20 nt, Human
ugcugccacauguucagcag

SEQ ID NO: 566373 - RNA, 26 nt, Human
uuaaccucuacuacagaacuauuuac

SEQ ID NO: 566374 - RNA, 20 nt, Human
uuacaggcugaaggaaggcu

SEQ ID NO: 566375 - RNA, 23 nt, Human
uuccuaccauuagccgucuccaa

SEQ ID NO: 566376 - RNA, 23 nt, Human
uucuaggaauggaaaacuugccc

SEQ ID NO: 566377 - RNA, 21 nt, Human
uuguuuugucuuauaagaaua

SEQ ID NO: 566378 - RNA, 21 nt, Human
uuuauugagacaagguaaaca

SEQ ID NO: 566379 - RNA, 19 nt, Human
uaaaaagugcauauguugg

SEQ ID NO: 566380 - RNA, 24 nt, Human
uaaauguaaaaagugcauauguug

SEQ ID NO: 566381 - RNA, 18 nt, Human
acuaccuuuaauacuagu

SEQ ID NO: 566382 - RNA, 19 nt, Human
agccagaccagcccccucc

SEQ ID NO: 566383 - RNA, 21 nt, Human
agguaagaaaacaaaaaaugc

SEQ ID NO: 566384 - RNA, 22 nt, Human
cacagcauauauuugagaaaac

SEQ ID NO: 566385 - RNA, 21 nt, Human
cacagccagaccagcccccuc

SEQ ID NO: 566386 - RNA, 25 nt, Human
cagagagaacauuaaaguacaaaga

SEQ ID NO: 566387 - RNA, 19 nt, Human
cagcccccucccaucugcc

SEQ ID NO: 566388 - RNA, 18 nt, Human
ccaacgcaggauacaaac

SEQ ID NO: 566389 - RNA, 22 nt, Human
ccagaccagcccccucccaucu

SEQ ID NO: 566390 - RNA, 19 nt, Human
ccuaugguccucugagccu

SEQ ID NO: 566391 - RNA, 22 nt, Human
gacugugacgguggccacagcc

SEQ ID NO: 566392 - RNA, 21 nt, Human
gcuuugguaaacuaccuuuaa

SEQ ID NO: 566393 - RNA, 23 nt, Human
ggacucuuaaagcucucucccaa

SEQ ID NO: 566394 - RNA, 22 nt, Human
ggcggccagcccaggaccuggg

SEQ ID NO: 566395 - RNA, 25 nt, Human
uaaaauucaaaauaucaaagaccuc

SEQ ID NO: 566396 - RNA, 19 nt, Human
uaucggacuaaacauaaau

SEQ ID NO: 566397 - RNA, 24 nt, Human
uaugugcuuuugggcacacauagu

SEQ ID NO: 566398 - RNA, 20 nt, Human
uccuaugguccucugagccu

SEQ ID NO: 566399 - RNA, 19 nt, Human
uccuggacugugacggugg

SEQ ID NO: 566400 - RNA, 18 nt, Human
ugagaaaagugauucagu

SEQ ID NO: 566401 - RNA, 20 nt, Human
ugagaccaacgcaggauaca

SEQ ID NO: 566402 - RNA, 20 nt, Human
uuguaucucucuugaaagac

SEQ ID NO: 566403 - RNA, 21 nt, Human
aaccaguaguguucuauaacc

SEQ ID NO: 566404 - RNA, 24 nt, Human
aacuccuuucuucagggcugcauu

SEQ ID NO: 566405 - RNA, 21 nt, Human
aagagccauccaugcucuugc

SEQ ID NO: 566406 - RNA, 19 nt, Human
accaguaguguucuauaac

SEQ ID NO: 566407 - RNA, 21 nt, Human
accuucauuuucauuuaagaa

SEQ ID NO: 566408 - RNA, 19 nt, Human
acucaauugcauagugcuu

SEQ ID NO: 566409 - RNA, 19 nt, Human
acugcugcuguuaccuuca

SEQ ID NO: 566410 - RNA, 23 nt, Human
agaagugaguggcuaggcccagc

SEQ ID NO: 566411 - RNA, 18 nt, Human
agaggaucugaugcgagg

SEQ ID NO: 566412 - RNA, 23 nt, Human
agaugaugauaagagccauccau

SEQ ID NO: 566413 - RNA, 24 nt, Human
agcuuagcuugggucuucuggcuc

SEQ ID NO: 566414 - RNA, 18 nt, Human
aggagcuucugcugagga

SEQ ID NO: 566415 - RNA, 19 nt, Human
aggcucaaagcgcggcgca

SEQ ID NO: 566416 - RNA, 22 nt, Human
agucugaguguguuuauagccu

SEQ ID NO: 566417 - RNA, 25 nt, Human
agugugcucaagaggggaggauucc

SEQ ID NO: 566418 - RNA, 22 nt, Human
aguuaccuuauuccuaaauaac

SEQ ID NO: 566419 - RNA, 26 nt, Human
auaacuaauuacuccuaacauagcag

SEQ ID NO: 566420 - RNA, 19 nt, Human
aucucuuuaauuuuacugg

SEQ ID NO: 566421 - RNA, 21 nt, Human
auggccuagaggcucaaagcg

SEQ ID NO: 566422 - RNA, 24 nt, Human
auuuucugagucuuuuccauuaug

SEQ ID NO: 566423 - RNA, 21 nt, Human
caaaauaccuuaagaguuugg

SEQ ID NO: 566424 - RNA, 22 nt, Human
caaaauaccuuaagaguuuggc

SEQ ID NO: 566425 - RNA, 20 nt, Human
caagaggggaggauucccag

SEQ ID NO: 566426 - RNA, 22 nt, Human
cacaauuauuuuuuuccugcaa

SEQ ID NO: 566427 - RNA, 20 nt, Human
cacugcauaccauacuaggu

SEQ ID NO: 566428 - RNA, 23 nt, Human
cagagugugcucaagaggggagg

SEQ ID NO: 566429 - RNA, 18 nt, Human
cagcacagaggaucugau

SEQ ID NO: 566430 - RNA, 22 nt, Human
caucagagugagcaagagguga

SEQ ID NO: 566431 - RNA, 19 nt, Human
cauccuguugcuuuuguug

SEQ ID NO: 566432 - RNA, 23 nt, Human
caugaacacuagguggaaucaac

SEQ ID NO: 566433 - RNA, 23 nt, Human
caugcaaauacugcuuauucccu

SEQ ID NO: 566434 - RNA, 24 nt, Human
ccaagcccagccugcuucuuuacu

SEQ ID NO: 566435 - RNA, 21 nt, Human
ccagaucacacacuuacacag

SEQ ID NO: 566436 - RNA, 21 nt, Human
ccagcucacggggcaggagau

SEQ ID NO: 566437 - RNA, 25 nt, Human
ccaguaguguucuauaaccacaauu

SEQ ID NO: 566438 - RNA, 27 nt, Human
ccauaccauugcuucacaugcaccgua

SEQ ID NO: 566439 - RNA, 23 nt, Human
ccaugguccuugcucggccuucc

SEQ ID NO: 566440 - RNA, 22 nt, Human
ccuaacauagcagcuuaaaaua

SEQ ID NO: 566441 - RNA, 19 nt, Human
ccuccuuccucucuuaacu

SEQ ID NO: 566442 - RNA, 21 nt, Human
ccuccuuccucucuuaacucc

SEQ ID NO: 566443 - RNA, 21 nt, Human
ccugccacaugggccucuccc

SEQ ID NO: 566444 - RNA, 22 nt, Human
ccuucugcaaacaauuuuccca

SEQ ID NO: 566445 - RNA, 20 nt, Human
cuaggcccagcucacggggc

SEQ ID NO: 566446 - RNA, 24 nt, Human
cucuuuaauuuuacuggggggccg

SEQ ID NO: 566447 - RNA, 22 nt, Human
cuucagggcugcauuuuucucc

SEQ ID NO: 566448 - RNA, 21 nt, Human
gaaagacugggaggcucagaa

SEQ ID NO: 566449 - RNA, 20 nt, Human
gaagucugaguguguuuaua

SEQ ID NO: 566450 - RNA, 21 nt, Human
gagaacagauaggguggagug

SEQ ID NO: 566451 - RNA, 20 nt, Human
gagcagucugcugcuggaga

SEQ ID NO: 566452 - RNA, 23 nt, Human
gccacugcauaccauacuaggua

SEQ ID NO: 566453 - RNA, 18 nt, Human
ggcaggagaucacacgug

SEQ ID NO: 566454 - RNA, 19 nt, Human
ggccuagaggcucaaagcg

SEQ ID NO: 566455 - RNA, 19 nt, Human
ggcucaaagcgcggcgcac

SEQ ID NO: 566456 - RNA, 24 nt, Human
gguccuugcucggccuuccacguc

SEQ ID NO: 566457 - RNA, 25 nt, Human
guagcuccuccuuccucucuuaacu

SEQ ID NO: 566458 - RNA, 24 nt, Human
uaauauaaauguauuaguuaccuu

SEQ ID NO: 566459 - RNA, 22 nt, Human
uaccuuauuccuaaauaacuaa

SEQ ID NO: 566460 - RNA, 18 nt, Human
uacuuaaaaagaagucaa

SEQ ID NO: 566461 - RNA, 20 nt, Human
uaguuaccuuauuccuaaau

SEQ ID NO: 566462 - RNA, 24 nt, Human
uaguucucuuuaucucuucgggcc

SEQ ID NO: 566463 - RNA, 19 nt, Human
uaucaugguaucugugggu

SEQ ID NO: 566464 - RNA, 18 nt, Human
uccagguguagcuuagcu

SEQ ID NO: 566465 - RNA, 23 nt, Human
uccuccuuccucucuuaacuccu

SEQ ID NO: 566466 - RNA, 21 nt, Human
uccugggauuacaaagucaca

SEQ ID NO: 566467 - RNA, 18 nt, Human
ucugcuuccagagaagua

SEQ ID NO: 566468 - RNA, 23 nt, Human
ucugugacugcuauucaccucag

SEQ ID NO: 566469 - RNA, 23 nt, Human
ugaacacuagguggaaucagggg

SEQ ID NO: 566470 - RNA, 24 nt, Human
ugagacauaguagcuccuccuucc

SEQ ID NO: 566471 - RNA, 20 nt, Human
ugcauagugcuuggugaggc

SEQ ID NO: 566472 - RNA, 19 nt, Human
ugcuuggugaggcaguuuc

SEQ ID NO: 566473 - RNA, 21 nt, Human
ugcuuuuguuggcuucugucu

SEQ ID NO: 566474 - RNA, 20 nt, Human
uggaaucagggggguccucu

SEQ ID NO: 566475 - RNA, 21 nt, Human
uggaggggugucuucuggugg

SEQ ID NO: 566476 - RNA, 18 nt, Human
uggccaaagacuuccuca

SEQ ID NO: 566477 - RNA, 23 nt, Human
uggguggaaaugaaaauguuggc

SEQ ID NO: 566478 - RNA, 23 nt, Human
ugguaucugugggucaggaaucc

SEQ ID NO: 566479 - RNA, 25 nt, Human
ugguaucugugggucaggaauccag

SEQ ID NO: 566480 - RNA, 18 nt, Human
uggugggcacucaauugc

SEQ ID NO: 566481 - RNA, 22 nt, Human
uguauuaguuaccuuauuccua

SEQ ID NO: 566482 - RNA, 22 nt, Human
uucacuuacucccagauaucac

SEQ ID NO: 566483 - RNA, 18 nt, Human
uuccagaucacacacuua

SEQ ID NO: 566484 - RNA, 21 nt, Human
uucccuuuuccugggauuaca

SEQ ID NO: 566485 - RNA, 20 nt, Human
uugcauagugcuuggugagg

SEQ ID NO: 566486 - RNA, 21 nt, Human
uuggauuuccuaaauguaaua

SEQ ID NO: 566487 - RNA, 19 nt, Human
uuggcaauaaagccuuuuc

SEQ ID NO: 566488 - RNA, 20 nt, Human
uuggcuucugucugucagaa

SEQ ID NO: 566489 - RNA, 20 nt, Human
uuucaacucacuuagcagca

SEQ ID NO: 566490 - RNA, 22 nt, Human
uuuccugggauuacaaagucac

SEQ ID NO: 566491 - RNA, 24 nt, Human
uuuguuggcuucugucugucagaa

SEQ ID NO: 566492 - RNA, 23 nt, Human
aaauaauaagcaaaauacaucag

SEQ ID NO: 566493 - RNA, 21 nt, Human
aacuaacuuaagcugacccug

SEQ ID NO: 566494 - RNA, 23 nt, Human
acggcggcggcccggcucuccuc

SEQ ID NO: 566495 - RNA, 21 nt, Human
agccgcgcaguccuucagcuc

SEQ ID NO: 566496 - RNA, 22 nt, Human
aguauacacucucuuuauuaug

SEQ ID NO: 566497 - RNA, 20 nt, Human
caccgugcaaugccacaggu

SEQ ID NO: 566498 - RNA, 20 nt, Human
cgcccuucuuccuugggcuu

SEQ ID NO: 566499 - RNA, 26 nt, Human
cggacggcggcaacggcccaguuacc

SEQ ID NO: 566500 - RNA, 24 nt, Human
cggcggcccggcucuccucucagg

SEQ ID NO: 566501 - RNA, 22 nt, Human
cuggcugaggauaaucccuucu

SEQ ID NO: 566502 - RNA, 19 nt, Human
ggcugcagagacggcggcg

SEQ ID NO: 566503 - RNA, 18 nt, Human
gucugaagcaagucgagg

SEQ ID NO: 566504 - RNA, 25 nt, Human
uaauaagcaaaauacaucaggaauu

SEQ ID NO: 566505 - RNA, 23 nt, Human
uaaucccuucuguccacugcacc

SEQ ID NO: 566506 - RNA, 23 nt, Human
uccucucaggcggcggccauguu

SEQ ID NO: 566507 - RNA, 23 nt, Human
ucugguuccgcccuucuuccuug

SEQ ID NO: 566508 - RNA, 21 nt, Human
ucuugcucugugucgucugaa

SEQ ID NO: 566509 - RNA, 20 nt, Human
ugcaaugccacaggucauga

SEQ ID NO: 566510 - RNA, 19 nt, Human
ugcagagacggcggcggcc

SEQ ID NO: 566511 - RNA, 18 nt, Human
uugcucugugucgucuga

SEQ ID NO: 566512 - RNA, 22 nt, Human
aaacuucucuucagguaggucc

SEQ ID NO: 566513 - RNA, 18 nt, Human
aaagcauguacccuucau

SEQ ID NO: 566514 - RNA, 18 nt, Human
aacaaagcaacuccaucu

SEQ ID NO: 566515 - RNA, 22 nt, Human
aaccaaaauacuuucauaaaca

SEQ ID NO: 566516 - RNA, 31 nt, Human
aagcacaguaaaauauucaguaauucaugcc

SEQ ID NO: 566517 - RNA, 23 nt, Human
aagcugcacauacacaugugguu

SEQ ID NO: 566518 - RNA, 22 nt, Human
aauacaaggaaacaccuacuga

SEQ ID NO: 566519 - RNA, 20 nt, Human
acaaaguaaggccuagagac

SEQ ID NO: 566520 - RNA, 20 nt, Human
acaguaaaauauucaguaau

SEQ ID NO: 566521 - RNA, 23 nt, Human
agagaccauuuauaguuguuugc

SEQ ID NO: 566522 - RNA, 18 nt, Human
agagacccaggcggcgcg

SEQ ID NO: 566523 - RNA, 18 nt, Human
agaguuguuuuucuaggg

SEQ ID NO: 566524 - RNA, 21 nt, Human
agaguuguuuuucuaggggac

SEQ ID NO: 566525 - RNA, 21 nt, Human
aggcacaaaagaggguaacaa

SEQ ID NO: 566526 - RNA, 18 nt, Human
agguccugaggcuugaaa

SEQ ID NO: 566527 - RNA, 21 nt, Human
auguaaagcugcacauacaca

SEQ ID NO: 566528 - RNA, 19 nt, Human
auugcaaauugcacuugac

SEQ ID NO: 566529 - RNA, 21 nt, Human
auugcaaauugcacuugacag

SEQ ID NO: 566530 - RNA, 21 nt, Human
caaagcaacuccaucuguagc

SEQ ID NO: 566531 - RNA, 23 nt, Human
caaaguaaggccuagagaccauu

SEQ ID NO: 566532 - RNA, 26 nt, Human
caaccggacuaacucagggagccaaa

SEQ ID NO: 566533 - RNA, 25 nt, Human
caaggaaacaccuacugaauagaac

SEQ ID NO: 566534 - RNA, 23 nt, Human
cacaaaagacaauacaaggaaac

SEQ ID NO: 566535 - RNA, 25 nt, Human
cacaaaagacaauacaaggaaacac

SEQ ID NO: 566536 - RNA, 19 nt, Human
cacacaguccuugagccca

SEQ ID NO: 566537 - RNA, 19 nt, Human
caccacaacaauggaaaac

SEQ ID NO: 566538 - RNA, 25 nt, Human
caccuacggaugagguagagaccca

SEQ ID NO: 566539 - RNA, 22 nt, Human
cacguaaaauaaaauguaaagc

SEQ ID NO: 566540 - RNA, 21 nt, Human
cagggccacaccuacggauga

SEQ ID NO: 566541 - RNA, 23 nt, Human
caguggacccaugguuuuuaaau

SEQ ID NO: 566542 - RNA, 19 nt, Human
caucuguagccucuguccu

SEQ ID NO: 566543 - RNA, 21 nt, Human
caugaauaaaaucuuaaauuc

SEQ ID NO: 566544 - RNA, 22 nt, Human
ccaucuguagccucuguccuuu

SEQ ID NO: 566545 - RNA, 23 nt, Human
cccaugguuuuuaaauaugaggc

SEQ ID NO: 566546 - RNA, 21 nt, Human
cccuucgguucgcagccccgg

SEQ ID NO: 566547 - RNA, 19 nt, Human
ccuacggaugagguagaga

SEQ ID NO: 566548 - RNA, 19 nt, Human
ccuugagcccaaaagugaa

SEQ ID NO: 566549 - RNA, 22 nt, Human
cggcgcggagcgagcccuucgg

SEQ ID NO: 566550 - RNA, 25 nt, Human
cugccacaccaucagggccacaccu

SEQ ID NO: 566551 - RNA, 19 nt, Human
gacaauacaaggaaacacc

SEQ ID NO: 566552 - RNA, 19 nt, Human
gagcccuucgguucgcagc

SEQ ID NO: 566553 - RNA, 21 nt, Human
gcacaacuugagcuacaagaa

SEQ ID NO: 566554 - RNA, 21 nt, Human
gccacaccuacggaugaggua

SEQ ID NO: 566555 - RNA, 23 nt, Human
ggccgcggcgaucgcaaacaacc

SEQ ID NO: 566556 - RNA, 19 nt, Human
guagaguuguuuuucuagg

SEQ ID NO: 566557 - RNA, 21 nt, Human
guagaguuguuuuucuagggg

SEQ ID NO: 566558 - RNA, 19 nt, Human
guccagagccugccacacc

SEQ ID NO: 566559 - RNA, 22 nt, Human
uaaaaaggcacaaaagagggua

SEQ ID NO: 566560 - RNA, 23 nt, Human
uaaaaaggcacaaaagaggguug

SEQ ID NO: 566561 - RNA, 20 nt, Human
uaaaugaaagaaaacaaacc

SEQ ID NO: 566562 - RNA, 23 nt, Human
uaacaguggacccaugguuuuua

SEQ ID NO: 566563 - RNA, 23 nt, Human
uaacucagggagccaaagagcga

SEQ ID NO: 566564 - RNA, 22 nt, Human
uacuguguucaaaugaauguuu

SEQ ID NO: 566565 - RNA, 24 nt, Human
uagagacccaggcggcgcggagcg

SEQ ID NO: 566566 - RNA, 23 nt, Human
uauaaugaauaaggcugcaaaau

SEQ ID NO: 566567 - RNA, 24 nt, Human
ucaacuagaaccacauuuggucac

SEQ ID NO: 566568 - RNA, 18 nt, Human
ucaagaauugauauaagc

SEQ ID NO: 566569 - RNA, 23 nt, Human
ucacauucaaacagucuccaaaa

SEQ ID NO: 566570 - RNA, 19 nt, Human
ucagggccacaccuacgga

SEQ ID NO: 566571 - RNA, 23 nt, Human
ucucaagaauugauauaagccaa

SEQ ID NO: 566572 - RNA, 18 nt, Human
ucugucgagcaauucaug

SEQ ID NO: 566573 - RNA, 23 nt, Human
ugaaaagaagucaacuagaacca

SEQ ID NO: 566574 - RNA, 20 nt, Human
ugaaaugcagcauaugcgau

SEQ ID NO: 566575 - RNA, 24 nt, Human
ugaggcaauuaaaugaaagaaaac

SEQ ID NO: 566576 - RNA, 24 nt, Human
ugagguagagacccaggcggcgcg

SEQ ID NO: 566577 - RNA, 24 nt, Human
ugauauaagccaaagugaaaagaa

SEQ ID NO: 566578 - RNA, 20 nt, Human
ugcacauacacaugugguuu

SEQ ID NO: 566579 - RNA, 19 nt, Human
uggcaaaauaaaaaggcac

SEQ ID NO: 566580 - RNA, 19 nt, Human
uggcaaaauaaaaaggcac

SEQ ID NO: 566581 - RNA, 19 nt, Human
uggcaaaauaaaaaggcac

SEQ ID NO: 566582 - RNA, 19 nt, Human
uguagaguuguuuuucuag

SEQ ID NO: 566583 - RNA, 18 nt, Human
uguguucaaaugaauguu

SEQ ID NO: 566584 - RNA, 21 nt, Human
uucuaugccaugcacaugaau

SEQ ID NO: 566585 - RNA, 18 nt, Human
uuuauuucuucauaagca

SEQ ID NO: 566586 - RNA, 25 nt, Human
aaauaaccaagagggaaaauuaaac

SEQ ID NO: 566587 - RNA, 24 nt, Human
aaccaagagggaaaauuaaaccca

SEQ ID NO: 566588 - RNA, 21 nt, Human
aagagccagaauucuaagaua

SEQ ID NO: 566589 - RNA, 22 nt, Human
accaguauuuaaaauacaugca

SEQ ID NO: 566590 - RNA, 20 nt, Human
agaaauccagaacaaacagc

SEQ ID NO: 566591 - RNA, 21 nt, Human
agaacaaacagcauaugaaug

SEQ ID NO: 566592 - RNA, 30 nt, Human
augaaggaaaaugcauggauugaaaccucu

SEQ ID NO: 566593 - RNA, 21 nt, Human
caagaggaguuaacuggggca

SEQ ID NO: 566594 - RNA, 23 nt, Human
cagaauucuaagauauagccaag

SEQ ID NO: 566595 - RNA, 18 nt, Human
gcuuuuacaauauagacu

SEQ ID NO: 566596 - RNA, 23 nt, Human
guaauaauccuuucuacuccucu

SEQ ID NO: 566597 - RNA, 20 nt, Human
uaacaagaggaguuaacugg

SEQ ID NO: 566598 - RNA, 19 nt, Human
uaaccaagagggaaaauua

SEQ ID NO: 566599 - RNA, 18 nt, Human
uaacuggggcagguuaga

SEQ ID NO: 566600 - RNA, 24 nt, Human
uaauaagacucugcacuuuugaaa

SEQ ID NO: 566601 - RNA, 25 nt, Human
uacagaagagauuuaugcuuuuuau

SEQ ID NO: 566602 - RNA, 20 nt, Human
ucccugugguuuauaaaagu

SEQ ID NO: 566603 - RNA, 18 nt, Human
uugcuguacauuuucuug

SEQ ID NO: 566604 - RNA, 19 nt, Human
uuuaagcauucccuuugug

SEQ ID NO: 566605 - RNA, 23 nt, Human
uuuaggcuuuuacaauauagacu

SEQ ID NO: 566606 - RNA, 23 nt, Human
uuugcuguacauuuucuuggcau

SEQ ID NO: 566607 - RNA, 25 nt, Human
aaaaaguccuaaccaaaaaaaaucc

SEQ ID NO: 566608 - RNA, 19 nt, Human
aaaguacuuuuauucacuu

SEQ ID NO: 566609 - RNA, 20 nt, Human
aagaaaaauuugugacucuc

SEQ ID NO: 566610 - RNA, 22 nt, Human
aagcaaagaggacaaaaccuaa

SEQ ID NO: 566611 - RNA, 18 nt, Human
acaaaaccuaaaagcuca

SEQ ID NO: 566612 - RNA, 23 nt, Human
acuaguuuacaggggcaagcauu

SEQ ID NO: 566613 - RNA, 22 nt, Human
agcaaagaggacaaaaccuaaa

SEQ ID NO: 566614 - RNA, 23 nt, Human
agcaaagaggacaaaaccuaaaa

SEQ ID NO: 566615 - RNA, 19 nt, Human
agggaggcuaagcgagguu

SEQ ID NO: 566616 - RNA, 27 nt, Human
aguaaaaaggaacuucaaaaaaagucc

SEQ ID NO: 566617 - RNA, 18 nt, Human
augagaaacaugauuuga

SEQ ID NO: 566618 - RNA, 21 nt, Human
caaaaaaaguccuaaccaaaa

SEQ ID NO: 566619 - RNA, 25 nt, Human
caaaaaaaguccuaaccaaaaaaaa

SEQ ID NO: 566620 - RNA, 23 nt, Human
ccaaaugaugcaugaaaucaagu

SEQ ID NO: 566621 - RNA, 18 nt, Human
ccagcaauaacagcccgg

SEQ ID NO: 566622 - RNA, 19 nt, Human
ccucuguccuaagugaaua

SEQ ID NO: 566623 - RNA, 18 nt, Human
ccuguggcagaacucuag

SEQ ID NO: 566624 - RNA, 22 nt, Human
cucacuaguuuacaggggcaag

SEQ ID NO: 566625 - RNA, 21 nt, Human
cucaggcugaaacacugaaga

SEQ ID NO: 566626 - RNA, 20 nt, Human
gauuccagcaauaacagccc

SEQ ID NO: 566627 - RNA, 20 nt, Human
guccuaaccaaaaaaaaucc

SEQ ID NO: 566628 - RNA, 21 nt, Human
uacacauuagcaggaagggag

SEQ ID NO: 566629 - RNA, 25 nt, Human
uaccucuguccuaagugaauaaucu

SEQ ID NO: 566630 - RNA, 19 nt, Human
ucacaccuaaguaaaaagg

SEQ ID NO: 566631 - RNA, 20 nt, Human
ucuggguaugagaaacauga

SEQ ID NO: 566632 - RNA, 20 nt, Human
ucuugcaggcauucagaagc

SEQ ID NO: 566633 - RNA, 18 nt, Human
ugaaaacacuaaaccacu

SEQ ID NO: 566634 - RNA, 22 nt, Human
ugaaaacacuaaaccacuauau

SEQ ID NO: 566635 - RNA, 21 nt, Human
ugaaaucaagucaaaauuggg

SEQ ID NO: 566636 - RNA, 21 nt, Human
ugagaaacaugauuugaaaac

SEQ ID NO: 566637 - RNA, 23 nt, Human
ugaugaggaugaugaagcaaaug

SEQ ID NO: 566638 - RNA, 23 nt, Human
ugcuacuccucacuauauuaugu

SEQ ID NO: 566639 - RNA, 24 nt, Human
uggauuccuuccaucuaaagacuu

SEQ ID NO: 566640 - RNA, 23 nt, Human
uggcagaacucuagaucugacuu

SEQ ID NO: 566641 - RNA, 20 nt, Human
uggggaagcaaagaggacaa

SEQ ID NO: 566642 - RNA, 21 nt, Human
uggguaucuuuuaucuguuuc

SEQ ID NO: 566643 - RNA, 21 nt, Human
uucucuugaugaggaugauga

SEQ ID NO: 566644 - RNA, 24 nt, Human
uugaaaacacuaaaccacuauauu

SEQ ID NO: 566645 - RNA, 22 nt, Human
uuugaaaacacuaaaccacuau

SEQ ID NO: 566646 - RNA, 25 nt, Human
agcaaaaaucacuuuacguacucau

SEQ ID NO: 566647 - RNA, 21 nt, Human
auuacaugcauaaaacuauaa

SEQ ID NO: 566648 - RNA, 23 nt, Human
cauacugaaaauguuuacauuua

SEQ ID NO: 566649 - RNA, 21 nt, Human
uacacagagagcaaaaaucac

SEQ ID NO: 566650 - RNA, 25 nt, Human
aaaaaacaaaaucuuccccaccgcu

SEQ ID NO: 566651 - RNA, 19 nt, Human
aaaccaauccugagauccu

SEQ ID NO: 566652 - RNA, 26 nt, Human
aaaccaauccugagauccuaagcugg

SEQ ID NO: 566653 - RNA, 21 nt, Human
aaagcacacccaggugugcua

SEQ ID NO: 566654 - RNA, 21 nt, Human
aacaaaaucuuccccaccgcu

SEQ ID NO: 566655 - RNA, 21 nt, Human
aacuagaacuuggaacucugg

SEQ ID NO: 566656 - RNA, 21 nt, Human
aagaacacuuaagaacagccc

SEQ ID NO: 566657 - RNA, 20 nt, Human
aaggacgacaaugucacugu

SEQ ID NO: 566658 - RNA, 18 nt, Human
aaguacccaucaauuacu

SEQ ID NO: 566659 - RNA, 20 nt, Human
aaguagcugggacuacaggc

SEQ ID NO: 566660 - RNA, 22 nt, Human
aaguagcugggacuacaggcau

SEQ ID NO: 566661 - RNA, 24 nt, Human
aaguagcugggacuacaggcaugc

SEQ ID NO: 566662 - RNA, 18 nt, Human
aaucguucacuagcugcu

SEQ ID NO: 566663 - RNA, 18 nt, Human
aaugcaaacaaaccauga

SEQ ID NO: 566664 - RNA, 18 nt, Human
acaaagccagccaggacc

SEQ ID NO: 566665 - RNA, 26 nt, Human
acacagaaaauaaagaaaagggaccc

SEQ ID NO: 566666 - RNA, 20 nt, Human
acaccugcuaguugcucuuc

SEQ ID NO: 566667 - RNA, 18 nt, Human
acaggauuccuagucucu

SEQ ID NO: 566668 - RNA, 18 nt, Human
accauguuggucaggcug

SEQ ID NO: 566669 - RNA, 24 nt, Human
acccaguuaauuuuuguauuuuua

SEQ ID NO: 566670 - RNA, 18 nt, Human
accggacacaagguucua

SEQ ID NO: 566671 - RNA, 20 nt, Human
accugcccacaucuugaagc

SEQ ID NO: 566672 - RNA, 23 nt, Human
acucacgaucguaugaauuugcu

SEQ ID NO: 566673 - RNA, 22 nt, Human
agaaaaaacaaaaucuucccca

SEQ ID NO: 566674 - RNA, 21 nt, Human
agaagguagcagaggcucaga

SEQ ID NO: 566675 - RNA, 18 nt, Human
agccggugguccccagca

SEQ ID NO: 566676 - RNA, 22 nt, Human
agccuggacaacguagugaaac

SEQ ID NO: 566677 - RNA, 20 nt, Human
agcguaaugcugagagccgg

SEQ ID NO: 566678 - RNA, 23 nt, Human
aggaguccaagaccagccuggac

SEQ ID NO: 566679 - RNA, 24 nt, Human
aggauugcuugaggccaggagucc

SEQ ID NO: 566680 - RNA, 24 nt, Human
aggcugaggugggaggauugcuug

SEQ ID NO: 566681 - RNA, 25 nt, Human
aggcuggagugcaguggcgcgaucu

SEQ ID NO: 566682 - RNA, 24 nt, Human
aggggccgggugcaguggcucacg

SEQ ID NO: 566683 - RNA, 23 nt, Human
aggugggaggauugcuugaggcc

SEQ ID NO: 566684 - RNA, 19 nt, Human
agguucuagaagcuagcuu

SEQ ID NO: 566685 - RNA, 22 nt, Human
aguagagaugggguuucaccau

SEQ ID NO: 566686 - RNA, 19 nt, Human
agugacaggacaacucaga

SEQ ID NO: 566687 - RNA, 20 nt, Human
agugcaguggcgcgaucucg

SEQ ID NO: 566688 - RNA, 24 nt, Human
agugcaguggcgcgaucucgacuc

SEQ ID NO: 566689 - RNA, 19 nt, Human
aguggcucacgccuauaau

SEQ ID NO: 566690 - RNA, 24 nt, Human
aguggcucacgccuauaauuuugg

SEQ ID NO: 566691 - RNA, 18 nt, Human
augcaccuauacccaaaa

SEQ ID NO: 566692 - RNA, 19 nt, Human
augcgcaccacugcaccca

SEQ ID NO: 566693 - RNA, 21 nt, Human
augggguuucaccauguuggu

SEQ ID NO: 566694 - RNA, 24 nt, Human
augggguuucaccauguuggucag

SEQ ID NO: 566695 - RNA, 21 nt, Human
auucuccugccucagccuccc

SEQ ID NO: 566696 - RNA, 23 nt, Human
auugccacaaagcacacccaggu

SEQ ID NO: 566697 - RNA, 24 nt, Human
auuuuuguauuuuuaguagagaug

SEQ ID NO: 566698 - RNA, 20 nt, Human
caaacaaaccaugauuccca

SEQ ID NO: 566699 - RNA, 20 nt, Human
caaacaacaucuaaccagca

SEQ ID NO: 566700 - RNA, 25 nt, Human
caaagagaugcccacagcguaaugc

SEQ ID NO: 566701 - RNA, 21 nt, Human
caaaguagucugaggcaaggc

SEQ ID NO: 566702 - RNA, 19 nt, Human
caaauccuaagccugccca

SEQ ID NO: 566703 - RNA, 19 nt, Human
caacucuucagauacagga

SEQ ID NO: 566704 - RNA, 22 nt, Human
caagcaauucuccugccucagc

SEQ ID NO: 566705 - RNA, 27 nt, Human
caagcaauucuccugccucagccuccc

SEQ ID NO: 566706 - RNA, 25 nt, Human
caaggcaaagaaauacaaacugagc

SEQ ID NO: 566707 - RNA, 23 nt, Human
cacauaacgucccucauaguuaa

SEQ ID NO: 566708 - RNA, 18 nt, Human
caccauguuggucaggcu

SEQ ID NO: 566709 - RNA, 24 nt, Human
caccgaggcuggagugcaguggcg

SEQ ID NO: 566710 - RNA, 19 nt, Human
caccugcuaguugcucuuc

SEQ ID NO: 566711 - RNA, 23 nt, Human
cacugaaacuaggccugggcaac

SEQ ID NO: 566712 - RNA, 18 nt, Human
cacugcaaccucugccuc

SEQ ID NO: 566713 - RNA, 21 nt, Human
cacugcaaccucugccuccca

SEQ ID NO: 566714 - RNA, 24 nt, Human
cacugcacccaguuaauuuuugua

SEQ ID NO: 566715 - RNA, 18 nt, Human
cacuucacaccuggaaca

SEQ ID NO: 566716 - RNA, 21 nt, Human
cagaaaaugcuugaugcccac

SEQ ID NO: 566717 - RNA, 22 nt, Human
cagaaucagaacuacuagacac

SEQ ID NO: 566718 - RNA, 19 nt, Human
cagcaugccuucaagguuu

SEQ ID NO: 566719 - RNA, 21 nt, Human
cagcuccagauuccucugccu

SEQ ID NO: 566720 - RNA, 18 nt, Human
caggaguccaagaccagc

SEQ ID NO: 566721 - RNA, 27 nt, Human
caggcccaaagacaaagccagccagga

SEQ ID NO: 566722 - RNA, 22 nt, Human
caucaaaucaguaccaagacga

SEQ ID NO: 566723 - RNA, 18 nt, Human
ccaaagacaaagccagcc

SEQ ID NO: 566724 - RNA, 18 nt, Human
ccacugcacccaguuaau

SEQ ID NO: 566725 - RNA, 21 nt, Human
ccaggcccaaagacaaagccc

SEQ ID NO: 566726 - RNA, 18 nt, Human
ccaucacugggccugcca

SEQ ID NO: 566727 - RNA, 19 nt, Human
cccaaagagaugcccacag

SEQ ID NO: 566728 - RNA, 23 nt, Human
cccaagaaauggauaauguagau

SEQ ID NO: 566729 - RNA, 23 nt, Human
cccaaguagcugggacuacaggc

SEQ ID NO: 566730 - RNA, 24 nt, Human
cccaaguagcugggacuacaggca

SEQ ID NO: 566731 - RNA, 23 nt, Human
cccagaaaaugcuugaugcccac

SEQ ID NO: 566732 - RNA, 24 nt, Human
cccaggguucaagcaauucuccug

SEQ ID NO: 566733 - RNA, 21 nt, Human
ccccagaaaaugcuugaugcc

SEQ ID NO: 566734 - RNA, 22 nt, Human
ccucauaguuaagucucuugcu

SEQ ID NO: 566735 - RNA, 19 nt, Human
ccucauccauagaagcaga

SEQ ID NO: 566736 - RNA, 25 nt, Human
ccucccaggguucaagcaauucucc

SEQ ID NO: 566737 - RNA, 23 nt, Human
ccugccucagccucccaaguagc

SEQ ID NO: 566738 - RNA, 24 nt, Human
ccugccucagccucccaaguagcu

SEQ ID NO: 566739 - RNA, 25 nt, Human
cgacaaugucacugugccuggcuuu

SEQ ID NO: 566740 - RNA, 21 nt, Human
cggugguccccagcauugguc

SEQ ID NO: 566741 - RNA, 22 nt, Human
cguggaaaugcaccuauaccca

SEQ ID NO: 566742 - RNA, 22 nt, Human
cuaaaauauuaaagggucauua

SEQ ID NO: 566743 - RNA, 24 nt, Human
cuagaaucauacuaaugcaaacaa

SEQ ID NO: 566744 - RNA, 22 nt, Human
cucacgaucguaugaauuugcu

SEQ ID NO: 566745 - RNA, 24 nt, Human
cucacgccuauaauuuuggcacuu

SEQ ID NO: 566746 - RNA, 24 nt, Human
cucacugcaaccucugccucccag

SEQ ID NO: 566747 - RNA, 24 nt, Human
cucacugcaaccucugccucccag

SEQ ID NO: 566748 - RNA, 24 nt, Human
cucagccucccaaguagcugggac

SEQ ID NO: 566749 - RNA, 23 nt, Human
cucuucuaaaaugacagcuccag

SEQ ID NO: 566750 - RNA, 18 nt, Human
cucuugguggcaaucugc

SEQ ID NO: 566751 - RNA, 21 nt, Human
cugaaaguaagcauccaaugg

SEQ ID NO: 566752 - RNA, 25 nt, Human
cugcaaccucugccucccaggguuc

SEQ ID NO: 566753 - RNA, 21 nt, Human
cugcuuuuuaauuccaauccu

SEQ ID NO: 566754 - RNA, 19 nt, Human
cuggaacacaaguguuauu

SEQ ID NO: 566755 - RNA, 25 nt, Human
cuggcuagaaaaaacaaaaucuucc

SEQ ID NO: 566756 - RNA, 21 nt, Human
cuugcucugucaccgaggcug

SEQ ID NO: 566757 - RNA, 24 nt, Human
cuugcucugucaccgaggcuggag

SEQ ID NO: 566758 - RNA, 21 nt, Human
gaaaagguuagggaggcaaau

SEQ ID NO: 566759 - RNA, 20 nt, Human
gaaaguaagcauccaauggu

SEQ ID NO: 566760 - RNA, 23 nt, Human
gacagcuccagauuccucugccu

SEQ ID NO: 566761 - RNA, 22 nt, Human
gaccugaccaccuguauccucu

SEQ ID NO: 566762 - RNA, 25 nt, Human
gacuacaggcaugcgcaccacugca

SEQ ID NO: 566763 - RNA, 24 nt, Human
gagaugggguuucaccauguuggu

SEQ ID NO: 566764 - RNA, 22 nt, Human
gaggugggaggauugcuugagg

SEQ ID NO: 566765 - RNA, 20 nt, Human
gcaaggcaaagaaauacaaa

SEQ ID NO: 566766 - RNA, 19 nt, Human
gcacuuuaggaggcugagg

SEQ ID NO: 566767 - RNA, 22 nt, Human
gcacuuuaggaggcugaggugg

SEQ ID NO: 566768 - RNA, 23 nt, Human
gcacuuuaggaggcugagguggg

SEQ ID NO: 566769 - RNA, 24 nt, Human
gccacugaaacuaggccugggcaa

SEQ ID NO: 566770 - RNA, 19 nt, Human
gccugcccaggcccaaaga

SEQ ID NO: 566771 - RNA, 20 nt, Human
gccuggacaacguagugaaa

SEQ ID NO: 566772 - RNA, 19 nt, Human
gcuggagugcaguggcgcg

SEQ ID NO: 566773 - RNA, 19 nt, Human
gcuuugaccuaucacucau

SEQ ID NO: 566774 - RNA, 19 nt, Human
ggaacacaaguguuauugc

SEQ ID NO: 566775 - RNA, 22 nt, Human
ggacuacaggcaugcgcaccac

SEQ ID NO: 566776 - RNA, 20 nt, Human
ggagauggcuguuuggggag

SEQ ID NO: 566777 - RNA, 21 nt, Human
ggauaaaaccaauccugaggg

SEQ ID NO: 566778 - RNA, 23 nt, Human
ggcacuuuaggaggcugaggugg

SEQ ID NO: 566779 - RNA, 19 nt, Human
ggccgggugcaguggcuca

SEQ ID NO: 566780 - RNA, 18 nt, Human
gggaaaucuagugcaaca

SEQ ID NO: 566781 - RNA, 20 nt, Human
ggggcugcuaggcgcuagca

SEQ ID NO: 566782 - RNA, 22 nt, Human
gggguuucaccauguuggucag

SEQ ID NO: 566783 - RNA, 24 nt, Human
gggugcaguggcucacgccuauaa

SEQ ID NO: 566784 - RNA, 23 nt, Human
guagagaugggguuucaccaugu

SEQ ID NO: 566785 - RNA, 25 nt, Human
gucacacagaaaauaaagaaaauaa

SEQ ID NO: 566786 - RNA, 21 nt, Human
gucaggcuggacaaggcuuuu

SEQ ID NO: 566787 - RNA, 21 nt, Human
uaaaaccaauccugagauccu

SEQ ID NO: 566788 - RNA, 26 nt, Human
uaaaaggcacaacuagaacuuggaac

SEQ ID NO: 566789 - RNA, 22 nt, Human
uaaaaugacagcuccagauucc

SEQ ID NO: 566790 - RNA, 23 nt, Human
uaaacccaagaaauggauaaugu

SEQ ID NO: 566791 - RNA, 21 nt, Human
uaaaguacccaucaauuacuc

SEQ ID NO: 566792 - RNA, 24 nt, Human
uaacgucccucauaguuaagucuc

SEQ ID NO: 566793 - RNA, 18 nt, Human
uaacuggauaacuggaau

SEQ ID NO: 566794 - RNA, 25 nt, Human
uaacuucuugcucugcugagacacc

SEQ ID NO: 566795 - RNA, 22 nt, Human
uaagaacagccccucagucuga

SEQ ID NO: 566796 - RNA, 23 nt, Human
uaagauucacauaacgucccuca

SEQ ID NO: 566797 - RNA, 19 nt, Human
uaagccugcccaggcccaa

SEQ ID NO: 566798 - RNA, 19 nt, Human
uaagcuggcuagaaaaaac

SEQ ID NO: 566799 - RNA, 24 nt, Human
uaauuuuuguauuuuuaguagaga

SEQ ID NO: 566800 - RNA, 26 nt, Human
uacaauaaugguuaaugaaggcuuua

SEQ ID NO: 566801 - RNA, 26 nt, Human
uacaggcaugcgcaccacugcaccca

SEQ ID NO: 566802 - RNA, 26 nt, Human
uacuagacaccugcaacucuucagau

SEQ ID NO: 566803 - RNA, 23 nt, Human
uagaaaaaacaaaaucuucccca

SEQ ID NO: 566804 - RNA, 20 nt, Human
uagaagcagaagguagcaga

SEQ ID NO: 566805 - RNA, 26 nt, Human
uagaaucauacuaaugcaaacaaagu

SEQ ID NO: 566806 - RNA, 22 nt, Human
uagagaugggguuucaccaugu

SEQ ID NO: 566807 - RNA, 18 nt, Human
uagcugcuuccaucacug

SEQ ID NO: 566808 - RNA, 22 nt, Human
uaggaggcugaggugggaggau

SEQ ID NO: 566809 - RNA, 24 nt, Human
uaggaggcugaggugggaggauug

SEQ ID NO: 566810 - RNA, 24 nt, Human
uaguagagaugggguuucaccaug

SEQ ID NO: 566811 - RNA, 26 nt, Human
uaguagagaugggguuucaccauguu

SEQ ID NO: 566812 - RNA, 21 nt, Human
ucaacaaccccuccauacucu

SEQ ID NO: 566813 - RNA, 21 nt, Human
ucacacagaaaauaaagaaaa

SEQ ID NO: 566814 - RNA, 22 nt, Human
ucaccugaaaguaagcauccaa

SEQ ID NO: 566815 - RNA, 18 nt, Human
ucacugcaaccucugccu

SEQ ID NO: 566816 - RNA, 19 nt, Human
ucacugcaaccucugccuc

SEQ ID NO: 566817 - RNA, 24 nt, Human
ucacugcaaccucugccucccagg

SEQ ID NO: 566818 - RNA, 24 nt, Human
ucacugcaaccucugccucccagg

SEQ ID NO: 566819 - RNA, 25 nt, Human
ucacugcaaccucugccucccaggg

SEQ ID NO: 566820 - RNA, 21 nt, Human
ucagaaauaaaccggacacaa

SEQ ID NO: 566821 - RNA, 20 nt, Human
ucagccucccaaguagcugg

SEQ ID NO: 566822 - RNA, 19 nt, Human
ucagccuucaaggucagaa

SEQ ID NO: 566823 - RNA, 24 nt, Human
ucccaaguagcugggacuacaggc

SEQ ID NO: 566824 - RNA, 22 nt, Human
ucccaggguucaagcaauucuc

SEQ ID NO: 566825 - RNA, 24 nt, Human
ucccaggguucaagcaauucuccc

SEQ ID NO: 566826 - RNA, 25 nt, Human
uccccagaaaaugcuugaugcccac

SEQ ID NO: 566827 - RNA, 20 nt, Human
uccuaagccugcccaggccc

SEQ ID NO: 566828 - RNA, 23 nt, Human
ucguacuuguccuuuaagccacg

SEQ ID NO: 566829 - RNA, 22 nt, Human
ucguaugaauuugcuuccaaaa

SEQ ID NO: 566830 - RNA, 26 nt, Human
ucuccugccucagccucccaaguagc

SEQ ID NO: 566831 - RNA, 18 nt, Human
ucuugcucugucaccgaa

SEQ ID NO: 566832 - RNA, 23 nt, Human
ucuugcucugucaccgaggcugg

SEQ ID NO: 566833 - RNA, 24 nt, Human
ucuugcucugucaccgaggcugga

SEQ ID NO: 566834 - RNA, 23 nt, Human
ugaaacaucuauuucuacaaaaa

SEQ ID NO: 566835 - RNA, 19 nt, Human
ugaacaggacacugaccug

SEQ ID NO: 566836 - RNA, 22 nt, Human
ugagauggagucuugcucuguc

SEQ ID NO: 566837 - RNA, 21 nt, Human
ugaggcaaggcaaagaaauac

SEQ ID NO: 566838 - RNA, 20 nt, Human
ugaggugggaggauugcuug

SEQ ID NO: 566839 - RNA, 23 nt, Human
ugaggugggaggauugcuugagg

SEQ ID NO: 566840 - RNA, 24 nt, Human
ugaggugggaggauugcuugaggc

SEQ ID NO: 566841 - RNA, 26 nt, Human
ugaggugggaggauugcuugaggcca

SEQ ID NO: 566842 - RNA, 21 nt, Human
ugcaacaaccccuugccggag

SEQ ID NO: 566843 - RNA, 22 nt, Human
ugcagacaauaaacagggaucu

SEQ ID NO: 566844 - RNA, 18 nt, Human
ugcccaggcccaaagaca

SEQ ID NO: 566845 - RNA, 24 nt, Human
ugccucagccucccaaguagcugg

SEQ ID NO: 566846 - RNA, 21 nt, Human
ugcgcaccacugcacccaguu

SEQ ID NO: 566847 - RNA, 24 nt, Human
ugcucugucaccgaggcuggagug

SEQ ID NO: 566848 - RNA, 20 nt, Human
uggaaaugcaccuauaccca

SEQ ID NO: 566849 - RNA, 19 nt, Human
uggaacucuggggaaaucu

SEQ ID NO: 566850 - RNA, 20 nt, Human
uggaacucuggggaaaucua

SEQ ID NO: 566851 - RNA, 21 nt, Human
uggagucuugcucugucaccg

SEQ ID NO: 566852 - RNA, 23 nt, Human
uggagugcaguggcgcgaucucg

SEQ ID NO: 566853 - RNA, 24 nt, Human
uggcaaaguagucugaggcaaggc

SEQ ID NO: 566854 - RNA, 19 nt, Human
uggcaaucugcugaagcca

SEQ ID NO: 566855 - RNA, 24 nt, Human
uggcucacgccuauaauuuuggca

SEQ ID NO: 566856 - RNA, 23 nt, Human
ugggacuacaggcaugcgcacca

SEQ ID NO: 566857 - RNA, 26 nt, Human
ugggacuacaggcaugcgcaccacug

SEQ ID NO: 566858 - RNA, 23 nt, Human
uggggagauggcuguuuggggag

SEQ ID NO: 566859 - RNA, 24 nt, Human
ugggguuucaccauguuggucagg

SEQ ID NO: 566860 - RNA, 23 nt, Human
uguauaaagaacacuuaagaaca

SEQ ID NO: 566861 - RNA, 21 nt, Human
ugucaccgaggcuggagugca

SEQ ID NO: 566862 - RNA, 25 nt, Human
ugucauauuccccagaaaaugcuug

SEQ ID NO: 566863 - RNA, 28 nt, Human
uuaaugcacuaggcauuagcaaagggaa

SEQ ID NO: 566864 - RNA, 23 nt, Human
uuaauuuuuguauuuuuaguaga

SEQ ID NO: 566865 - RNA, 18 nt, Human
uuaguagagaugggguuu

SEQ ID NO: 566866 - RNA, 22 nt, Human
uuaguagagaugggguuucacc

SEQ ID NO: 566867 - RNA, 24 nt, Human
uuaguagagaugggguuucaccau

SEQ ID NO: 566868 - RNA, 19 nt, Human
uucaaauaggggccgggug

SEQ ID NO: 566869 - RNA, 21 nt, Human
uucaagcaauucuccugccuc

SEQ ID NO: 566870 - RNA, 24 nt, Human
uucaagcaauucuccugccucagc

SEQ ID NO: 566871 - RNA, 20 nt, Human
uucaaggucagaaauaaacc

SEQ ID NO: 566872 - RNA, 23 nt, Human
uucuagaagcuagcuuuuacaaa

SEQ ID NO: 566873 - RNA, 22 nt, Human
uucuugcucugcugagacaccu

SEQ ID NO: 566874 - RNA, 21 nt, Human
uugagauggagucuugcucug

SEQ ID NO: 566875 - RNA, 23 nt, Human
uugcuugaggccaggaguccaag

SEQ ID NO: 566876 - RNA, 22 nt, Human
uuggcacuuuaggaggcugagg

SEQ ID NO: 566877 - RNA, 24 nt, Human
uuguacaaguguccccuucuuccu

SEQ ID NO: 566878 - RNA, 23 nt, Human
uuguauuuuuaguagagaugggg

SEQ ID NO: 566879 - RNA, 21 nt, Human
uuucaccauguuggucaggcu

SEQ ID NO: 566880 - RNA, 24 nt, Human
uuuuuaguagagaugggguuucac

SEQ ID NO: 566881 - RNA, 20 nt, Human
uuuuuguauuuuuaguagag

SEQ ID NO: 566882 - RNA, 27 nt, Human
uuuuuuuuuuuuuuuuuuuuuuugggg

SEQ ID NO: 566883 - RNA, 23 nt, Human
aaaaauuuuuuuaaaacaagagg

SEQ ID NO: 566884 - RNA, 24 nt, Human
accagcccacacacucgcacacac

SEQ ID NO: 566885 - RNA, 18 nt, Human
acgagagccgggcguggc

SEQ ID NO: 566886 - RNA, 19 nt, Human
agacgucggggucgucggc

SEQ ID NO: 566887 - RNA, 24 nt, Human
agagcagacccuggcagaucagga

SEQ ID NO: 566888 - RNA, 21 nt, Human
aggccacaggcccacagugcc

SEQ ID NO: 566889 - RNA, 20 nt, Human
agugcccauugagugagacc

SEQ ID NO: 566890 - RNA, 19 nt, Human
augacacccuggucagugc

SEQ ID NO: 566891 - RNA, 18 nt, Human
auggagccguccuccucu

SEQ ID NO: 566892 - RNA, 20 nt, Human
auucacacaccagcccacac

SEQ ID NO: 566893 - RNA, 26 nt, Human
caagagguuuuccuuugcucuggccc

SEQ ID NO: 566894 - RNA, 28 nt, Human
cacacacucgcacacacucacacgcaca

SEQ ID NO: 566895 - RNA, 21 nt, Human
caccagcccacacacucgcac

SEQ ID NO: 566896 - RNA, 21 nt, Human
cagccgaggcacgggcagcag

SEQ ID NO: 566897 - RNA, 22 nt, Human
caucucguaaauggagccgucc

SEQ ID NO: 566898 - RNA, 21 nt, Human
ccaaaacacucugaaaaaaau

SEQ ID NO: 566899 - RNA, 20 nt, Human
ccaaagcugcgccaucagca

SEQ ID NO: 566900 - RNA, 21 nt, Human
ccaaagcugcgccaucagcag

SEQ ID NO: 566901 - RNA, 24 nt, Human
ccaagcccuaaaacuccuccccaa

SEQ ID NO: 566902 - RNA, 23 nt, Human
ccagagcuccaauauguacagac

SEQ ID NO: 566903 - RNA, 22 nt, Human
ccagauguguccucccucuccc

SEQ ID NO: 566904 - RNA, 22 nt, Human
ccagcccacacacucgcacaca

SEQ ID NO: 566905 - RNA, 20 nt, Human
ccauuuccuccagauguguc

SEQ ID NO: 566906 - RNA, 26 nt, Human
cccaagcccuaaaacuccuccccaaa

SEQ ID NO: 566907 - RNA, 18 nt, Human
ccccaagcccuaaaacuc

SEQ ID NO: 566908 - RNA, 21 nt, Human
ccccaagcccuaaaacuccuc

SEQ ID NO: 566909 - RNA, 18 nt, Human
ccccucagccuccuccug

SEQ ID NO: 566910 - RNA, 21 nt, Human
cccgucuggcuuguccuccuc

SEQ ID NO: 566911 - RNA, 19 nt, Human
cccgugcagguccuagagc

SEQ ID NO: 566912 - RNA, 25 nt, Human
cccucagccuccuccuggucacucc

SEQ ID NO: 566913 - RNA, 24 nt, Human
cccuggucagugcccacccagagc

SEQ ID NO: 566914 - RNA, 18 nt, Human
ccgccggagaugauggcc

SEQ ID NO: 566915 - RNA, 22 nt, Human
ccuaaaacuccuccccaaaaca

SEQ ID NO: 566916 - RNA, 23 nt, Human
ccugcagcugugcccucugaggg

SEQ ID NO: 566917 - RNA, 24 nt, Human
ccugugaucuuggggaugccuucc

SEQ ID NO: 566918 - RNA, 22 nt, Human
cgcacacacucacacgcacaca

SEQ ID NO: 566919 - RNA, 27 nt, Human
cgcacacacucacacgcacacacccuu

SEQ ID NO: 566920 - RNA, 24 nt, Human
cgcuagggcccaaacaagugauac

SEQ ID NO: 566921 - RNA, 22 nt, Human
cucacacgcacacacccuucca

SEQ ID NO: 566922 - RNA, 21 nt, Human
cucagcccggggccccucagc

SEQ ID NO: 566923 - RNA, 23 nt, Human
cucccucuccccaagcccuaaaa

SEQ ID NO: 566924 - RNA, 19 nt, Human
cucgcugugcuccaaagcu

SEQ ID NO: 566925 - RNA, 25 nt, Human
cugugcuccaaagcugcgccaucag

SEQ ID NO: 566926 - RNA, 21 nt, Human
gacccuggcagaucaggaggc

SEQ ID NO: 566927 - RNA, 19 nt, Human
gaggaugcccuucuugcgg

SEQ ID NO: 566928 - RNA, 24 nt, Human
gaguccaggcccauccacaagucc

SEQ ID NO: 566929 - RNA, 18 nt, Human
gcaguugugagguuuugu

SEQ ID NO: 566930 - RNA, 27 nt, Human
gcccuaaaacuccuccccaaaacacuc

SEQ ID NO: 566931 - RNA, 21 nt, Human
gccugcagcugugcccucuga

SEQ ID NO: 566932 - RNA, 20 nt, Human
gcgggucagcucucggccca

SEQ ID NO: 566933 - RNA, 26 nt, Human
ggcccaaacaagugauacugggcuug

SEQ ID NO: 566934 - RNA, 21 nt, Human
gguuuuguguuuuuugcuuuu

SEQ ID NO: 566935 - RNA, 21 nt, Human
uacugcaagaggaugcccuuc

SEQ ID NO: 566936 - RNA, 21 nt, Human
uagauauucacacaccagccc

SEQ ID NO: 566937 - RNA, 23 nt, Human
uagcccugcccgccggagaugau

SEQ ID NO: 566938 - RNA, 23 nt, Human
uauguacagacuuuauuuauaca

SEQ ID NO: 566939 - RNA, 22 nt, Human
uauucacacaccagcccacaca

SEQ ID NO: 566940 - RNA, 19 nt, Human
ucacacgcacacacccuuc

SEQ ID NO: 566941 - RNA, 23 nt, Human
uccaggaggggcguguggcugcc

SEQ ID NO: 566942 - RNA, 20 nt, Human
uccccaaaacacucugaaaa

SEQ ID NO: 566943 - RNA, 22 nt, Human
uccccaaaacacucugaaaaaa

SEQ ID NO: 566944 - RNA, 18 nt, Human
uccuccccaaaacacucu

SEQ ID NO: 566945 - RNA, 18 nt, Human
uccuugcggugggcgucg

SEQ ID NO: 566946 - RNA, 26 nt, Human
ucgcacacacucacacgcacacaccc

SEQ ID NO: 566947 - RNA, 22 nt, Human
ucgcugugcuccaaagcugcgc

SEQ ID NO: 566948 - RNA, 21 nt, Human
ucucggcccacguggcugucg

SEQ ID NO: 566949 - RNA, 24 nt, Human
ucugaaaaaaauuuuuuuaaaaca

SEQ ID NO: 566950 - RNA, 18 nt, Human
ugaagcaggaguaugaac

SEQ ID NO: 566951 - RNA, 18 nt, Human
ugaggggagaggggaggc

SEQ ID NO: 566952 - RNA, 21 nt, Human
ugccaaaguugcgguagcccu

SEQ ID NO: 566953 - RNA, 23 nt, Human
ugcccagagcgcugccaaaguug

SEQ ID NO: 566954 - RNA, 21 nt, Human
ugccuuggagucccgcuaggg

SEQ ID NO: 566955 - RNA, 20 nt, Human
ugcggugggcgucgcgggcc

SEQ ID NO: 566956 - RNA, 20 nt, Human
ugucaggggccaggaugcug

SEQ ID NO: 566957 - RNA, 21 nt, Human
ugucaggggccaggaugcugg

SEQ ID NO: 566958 - RNA, 22 nt, Human
uugcgggucagcucucggccca

SEQ ID NO: 566959 - RNA, 18 nt, Human
uugugagguuuuguguuu

SEQ ID NO: 566960 - RNA, 19 nt, Human
uuuuguguuuuuugcuuuu

SEQ ID NO: 566961 - RNA, 20 nt, Human
aaaaaccauuacauuucucu

SEQ ID NO: 566962 - RNA, 20 nt, Human
aaaacacaucuguccuaaca

SEQ ID NO: 566963 - RNA, 18 nt, Human
aaaccaagaaaacuggca

SEQ ID NO: 566964 - RNA, 24 nt, Human
aaauacucaaggccacagaaguac

SEQ ID NO: 566965 - RNA, 20 nt, Human
aacuccucccccuaccccau

SEQ ID NO: 566966 - RNA, 23 nt, Human
aacuguaugaggcugcuucucca

SEQ ID NO: 566967 - RNA, 29 nt, Human
aagaaaccaagaaaacuggcagugggcac

SEQ ID NO: 566968 - RNA, 21 nt, Human
aagaaaggggagagaaaacgu

SEQ ID NO: 566969 - RNA, 22 nt, Human
aauuaccuuaccuauaaaaccu

SEQ ID NO: 566970 - RNA, 26 nt, Human
acaaagcagcauaaaaccaauuaaaa

SEQ ID NO: 566971 - RNA, 20 nt, Human
acauucaaaacacaucuguu

SEQ ID NO: 566972 - RNA, 21 nt, Human
accgcgaagagagaagaaagg

SEQ ID NO: 566973 - RNA, 18 nt, Human
agaaaccaagaaaacugg

SEQ ID NO: 566974 - RNA, 19 nt, Human
agaaagacgggagcgaagg

SEQ ID NO: 566975 - RNA, 22 nt, Human
agaagaaaggggagagaaaacg

SEQ ID NO: 566976 - RNA, 25 nt, Human
agaagaaaggggagagaaaacguca

SEQ ID NO: 566977 - RNA, 29 nt, Human
agacagaaacuggucacaaaagggacccc

SEQ ID NO: 566978 - RNA, 22 nt, Human
agacgggagcgaagguggagcu

SEQ ID NO: 566979 - RNA, 19 nt, Human
agagaagaaaggggagaga

SEQ ID NO: 566980 - RNA, 20 nt, Human
agauauaaacucagguuacc

SEQ ID NO: 566981 - RNA, 18 nt, Human
agggcacccgcagcagcc

SEQ ID NO: 566982 - RNA, 18 nt, Human
augaagaucagcaugaau

SEQ ID NO: 566983 - RNA, 23 nt, Human
auucaaaacacaucuguccuaac

SEQ ID NO: 566984 - RNA, 21 nt, Human
caaaacacaucuguccuaaca

SEQ ID NO: 566985 - RNA, 20 nt, Human
caaaaucaacuguaugaggc

SEQ ID NO: 566986 - RNA, 21 nt, Human
caaccccuagcagaaguacca

SEQ ID NO: 566987 - RNA, 19 nt, Human
caacuccucccccuacccc

SEQ ID NO: 566988 - RNA, 21 nt, Human
caagaaaacuggcagucaaga

SEQ ID NO: 566989 - RNA, 23 nt, Human
caauugucuaugaaaauucaagc

SEQ ID NO: 566990 - RNA, 20 nt, Human
cacaacagcaucuuuuuaaa

SEQ ID NO: 566991 - RNA, 23 nt, Human
cacacacaggccggaugcacccu

SEQ ID NO: 566992 - RNA, 18 nt, Human
cacacauauagucagaug

SEQ ID NO: 566993 - RNA, 24 nt, Human
cacauacacaaaaucaacuguaug

SEQ ID NO: 566994 - RNA, 21 nt, Human
cacccugccggaacucugagc

SEQ ID NO: 566995 - RNA, 22 nt, Human
cagaaacuggucacaaaaacca

SEQ ID NO: 566996 - RNA, 22 nt, Human
caggccggaugcacccugccgg

SEQ ID NO: 566997 - RNA, 24 nt, Human
cauguaaucuacaguauacucucc

SEQ ID NO: 566998 - RNA, 21 nt, Human
cauuauagucauuuuauugcu

SEQ ID NO: 566999 - RNA, 20 nt, Human
cauucaaaacacaucugucc

SEQ ID NO: 567000 - RNA, 21 nt, Human
ccaauuagguugaaacaaauu

SEQ ID NO: 567001 - RNA, 25 nt, Human
ccaauuagguugaaacaaauuuuag

SEQ ID NO: 567002 - RNA, 22 nt, Human
ccccacaacuccucccccuacc

SEQ ID NO: 567003 - RNA, 18 nt, Human
cccggguaccggcuuccc

SEQ ID NO: 567004 - RNA, 23 nt, Human
cccuagcagaaguaccagcugcu

SEQ ID NO: 567005 - RNA, 21 nt, Human
cccugccucgcgccacacaca

SEQ ID NO: 567006 - RNA, 23 nt, Human
ccgagaucaaagcgguguuucca

SEQ ID NO: 567007 - RNA, 19 nt, Human
ccuaagaauauccccuuuu

SEQ ID NO: 567008 - RNA, 22 nt, Human
ccucccccuaccccauucccaa

SEQ ID NO: 567009 - RNA, 23 nt, Human
ccucgcgccacacacaggccgga

SEQ ID NO: 567010 - RNA, 23 nt, Human
ccugccggaacucugagccucca

SEQ ID NO: 567011 - RNA, 23 nt, Human
ccuggugcagccgacuggaucca

SEQ ID NO: 567012 - RNA, 26 nt, Human
cgacgccgcaaccgcgaagagagaag

SEQ ID NO: 567013 - RNA, 24 nt, Human
cggaaauaaaauuuuagaagauca

SEQ ID NO: 567014 - RNA, 22 nt, Human
cggggugaagcccuaaagagcc

SEQ ID NO: 567015 - RNA, 22 nt, Human
cgucagcgcuggggccaggacc

SEQ ID NO: 567016 - RNA, 24 nt, Human
cucccccuaccccauucccaauca

SEQ ID NO: 567017 - RNA, 21 nt, Human
cuuacaguugagccuuuuaaa

SEQ ID NO: 567018 - RNA, 24 nt, Human
cuucuccagcuuaguggacaaaua

SEQ ID NO: 567019 - RNA, 20 nt, Human
gaaagcugugucacuacugc

SEQ ID NO: 567020 - RNA, 20 nt, Human
gaaaugcacauuauuccccc

SEQ ID NO: 567021 - RNA, 23 nt, Human
gagaagaaaggggagagaaaacg

SEQ ID NO: 567022 - RNA, 25 nt, Human
ggccaggacccggguaccggcuucc

SEQ ID NO: 567023 - RNA, 21 nt, Human
gguaaugaagaucagcaugaa

SEQ ID NO: 567024 - RNA, 21 nt, Human
ggugcagccgacuggauccag

SEQ ID NO: 567025 - RNA, 24 nt, Human
guaaaauuuucucaaaacuuuuua

SEQ ID NO: 567026 - RNA, 25 nt, Human
guaaaauuuucucaaaacuuuuuaa

SEQ ID NO: 567027 - RNA, 25 nt, Human
guuaccaauuagguugaaacaaauu

SEQ ID NO: 567028 - RNA, 21 nt, Human
uaaaaaauacucaaggccaca

SEQ ID NO: 567029 - RNA, 21 nt, Human
uaaaaaauacucaaggccagu

SEQ ID NO: 567030 - RNA, 21 nt, Human
uaaaagaaggauuuccuguuu

SEQ ID NO: 567031 - RNA, 28 nt, Human
uaacaaagcagcauaaaaccaauuaaaa

SEQ ID NO: 567032 - RNA, 19 nt, Human
uaagaaaccaagaaaacug

SEQ ID NO: 567033 - RNA, 21 nt, Human
uacaacccaaaucaaaguuga

SEQ ID NO: 567034 - RNA, 26 nt, Human
uacacugagaaguguuaaaaucauua

SEQ ID NO: 567035 - RNA, 19 nt, Human
uacaugcagacagaaacug

SEQ ID NO: 567036 - RNA, 22 nt, Human
uaccuauaaaaccuuccauuua

SEQ ID NO: 567037 - RNA, 30 nt, Human
uaccugucccgcaccgccgagaucaaagcu

SEQ ID NO: 567038 - RNA, 25 nt, Human
uacugcuuucugcuuucaauggcuu

SEQ ID NO: 567039 - RNA, 21 nt, Human
uagauacagacuucuuuaacc

SEQ ID NO: 567040 - RNA, 25 nt, Human
uagcaacacagcacaguaaaauuuu

SEQ ID NO: 567041 - RNA, 21 nt, Human
uaggugaccccaaauauuuau

SEQ ID NO: 567042 - RNA, 24 nt, Human
uauaaugguacauucaaaacacau

SEQ ID NO: 567043 - RNA, 19 nt, Human
ucaaaacacaucuguccua

SEQ ID NO: 567044 - RNA, 23 nt, Human
ucaaaacacaucuguccuaacaa

SEQ ID NO: 567045 - RNA, 22 nt, Human
ucaauggcuaggugaccccaaa

SEQ ID NO: 567046 - RNA, 23 nt, Human
uccaaauuacaugcagacagaaa

SEQ ID NO: 567047 - RNA, 18 nt, Human
ucccccacaacuccuccc

SEQ ID NO: 567048 - RNA, 24 nt, Human
ucccccacaacuccucccccuacc

SEQ ID NO: 567049 - RNA, 22 nt, Human
ucucaaaauguacugaauucac

SEQ ID NO: 567050 - RNA, 18 nt, Human
ucuucauuacauuccuuu

SEQ ID NO: 567051 - RNA, 20 nt, Human
ugaaaugcacauuauucccc

SEQ ID NO: 567052 - RNA, 24 nt, Human
ugaaaugcacauuauucccccaca

SEQ ID NO: 567053 - RNA, 28 nt, Human
ugaaaugcacauuauucccccacaacuc

SEQ ID NO: 567054 - RNA, 18 nt, Human
ugaagcccuaaagagcca

SEQ ID NO: 567055 - RNA, 20 nt, Human
ugaagggaaagcugugucac

SEQ ID NO: 567056 - RNA, 19 nt, Human
ugaauguauuugagaaauc

SEQ ID NO: 567057 - RNA, 22 nt, Human
ugagaaauccaaauuacaugca

SEQ ID NO: 567058 - RNA, 23 nt, Human
ugcagacagaaacuggucacaaa

SEQ ID NO: 567059 - RNA, 24 nt, Human
ugccaagaaaaugauuauuuuucc

SEQ ID NO: 567060 - RNA, 19 nt, Human
ugcgacgccgcaaccgcga

SEQ ID NO: 567061 - RNA, 18 nt, Human
ugcugaaucuucauuaca

SEQ ID NO: 567062 - RNA, 21 nt, Human
uggcuaggugaccccaaauau

SEQ ID NO: 567063 - RNA, 23 nt, Human
uguacugaauucacauaugugua

SEQ ID NO: 567064 - RNA, 23 nt, Human
uuacaaaaauacaaaaauagcug

SEQ ID NO: 567065 - RNA, 19 nt, Human
uuacauuccuuucaaaagg

SEQ ID NO: 567066 - RNA, 19 nt, Human
uuaguaaaagaaggauuuc

SEQ ID NO: 567067 - RNA, 21 nt, Human
uucacauauguguaucaccau

SEQ ID NO: 567068 - RNA, 21 nt, Human
uucaggauagacacacauaua

SEQ ID NO: 567069 - RNA, 21 nt, Human
uuccaccgagaugcauuuaug

SEQ ID NO: 567070 - RNA, 22 nt, Human
uuccuuucaaaaggcaucuaaa

SEQ ID NO: 567071 - RNA, 21 nt, Human
uucggggugaagcccuaaaga

SEQ ID NO: 567072 - RNA, 21 nt, Human
uuuaaaaaauacucaaggcca

SEQ ID NO: 567073 - RNA, 23 nt, Human
agauccccuggccuugcugaggu

SEQ ID NO: 567074 - RNA, 19 nt, Human
caacuugugccucccaucc

SEQ ID NO: 567075 - RNA, 21 nt, Human
ccgguaggacagaaucucuuu

SEQ ID NO: 567076 - RNA, 21 nt, Human
uaacacaacgugcagaucccc

SEQ ID NO: 567077 - RNA, 24 nt, Human
uaaguaguggaaaaacuuuuauac

SEQ ID NO: 567078 - RNA, 19 nt, Human
ugcaaaauggggcagugga

SEQ ID NO: 567079 - RNA, 23 nt, Human
ugcaaaauggggcaguggacuga

SEQ ID NO: 567080 - RNA, 22 nt, Human
ugcagauccccuggccuugcug

SEQ ID NO: 567081 - RNA, 21 nt, Human
ugcccaaucacaacuugugcc

SEQ ID NO: 567082 - RNA, 22 nt, Human
uggggcaguggacugacaggcu

SEQ ID NO: 567083 - RNA, 25 nt, Human
aaaaaaacauagauaguaaagcuga

SEQ ID NO: 567084 - RNA, 21 nt, Human
aaaaagaaaaaaaaaaagucc

SEQ ID NO: 567085 - RNA, 21 nt, Human
aaaauauacuaucccggccaa

SEQ ID NO: 567086 - RNA, 21 nt, Human
aaagggagucacaccggcugc

SEQ ID NO: 567087 - RNA, 20 nt, Human
aacauaaugaaaccccgucu

SEQ ID NO: 567088 - RNA, 21 nt, Human
aacauaaugaaaccccgucuc

SEQ ID NO: 567089 - RNA, 19 nt, Human
aacauggugaaaccccauc

SEQ ID NO: 567090 - RNA, 20 nt, Human
aacauggugaaaccccaucu

SEQ ID NO: 567091 - RNA, 21 nt, Human
aacauggugaaaccccaucuc

SEQ ID NO: 567092 - RNA, 21 nt, Human
aacauggugaaaccccaucuc

SEQ ID NO: 567093 - RNA, 19 nt, Human
aacugcacagcccagaccu

SEQ ID NO: 567094 - RNA, 24 nt, Human
aagcgugguggcucaugucuguaa

SEQ ID NO: 567095 - RNA, 18 nt, Human
aaggagagauccugggaa

SEQ ID NO: 567096 - RNA, 20 nt, Human
aaggagagauccugggaauu

SEQ ID NO: 567097 - RNA, 24 nt, Human
aaucccacacccucucuugacacc

SEQ ID NO: 567098 - RNA, 26 nt, Human
aauguauguauacauacacacagugu

SEQ ID NO: 567099 - RNA, 18 nt, Human
aauugcuugaaccuggga

SEQ ID NO: 567100 - RNA, 24 nt, Human
aauugcuugaaccugggaggcaga

SEQ ID NO: 567101 - RNA, 23 nt, Human
aauuucucacccuggacuucuac

SEQ ID NO: 567102 - RNA, 18 nt, Human
acaccacugcacuccagc

SEQ ID NO: 567103 - RNA, 20 nt, Human
acaccacugcacuccagccu

SEQ ID NO: 567104 - RNA, 24 nt, Human
acagagugagacuccaucucaaaa

SEQ ID NO: 567105 - RNA, 19 nt, Human
accacugcacuccagccug

SEQ ID NO: 567106 - RNA, 24 nt, Human
accacugcacuccagccuggguga

SEQ ID NO: 567107 - RNA, 24 nt, Human
accccaucucuacuaaaaauacaa

SEQ ID NO: 567108 - RNA, 24 nt, Human
acuccagccugggugacagaguga

SEQ ID NO: 567109 - RNA, 24 nt, Human
acugcacuccagccugggugacag

SEQ ID NO: 567110 - RNA, 26 nt, Human
acugcacuccagccugggugacagag

SEQ ID NO: 567111 - RNA, 21 nt, Human
agaaaaaaagaaaaaaaaaaa

SEQ ID NO: 567112 - RNA, 20 nt, Human
agaaaagaaaaaagaaaaaa

SEQ ID NO: 567113 - RNA, 21 nt, Human
agaaaagaaaaaagaaaaaaa

SEQ ID NO: 567114 - RNA, 22 nt, Human
agagaaggcagcaaucaguagg

SEQ ID NO: 567115 - RNA, 20 nt, Human
agagguugcagugagccaag

SEQ ID NO: 567116 - RNA, 23 nt, Human
agagguugcagugagccaagauc

SEQ ID NO: 567117 - RNA, 24 nt, Human
agagguugcagugagccaagauca

SEQ ID NO: 567118 - RNA, 24 nt, Human
agcacuuugggaggcugagguggg

SEQ ID NO: 567119 - RNA, 18 nt, Human
agcagcaggcagaggcuu

SEQ ID NO: 567120 - RNA, 24 nt, Human
agccuggccaacauaaugaaaccc

SEQ ID NO: 567121 - RNA, 24 nt, Human
agccugggugacagagugagacuc

SEQ ID NO: 567122 - RNA, 21 nt, Human
aggaguuggagaccagccugg

SEQ ID NO: 567123 - RNA, 24 nt, Human
aggcagagguugcagugagccaag

SEQ ID NO: 567124 - RNA, 22 nt, Human
aggcaggagaauugcuugaacc

SEQ ID NO: 567125 - RNA, 24 nt, Human
aggcaggagaauugcuugaaccug

SEQ ID NO: 567126 - RNA, 19 nt, Human
aggcagggggaggaacugc

SEQ ID NO: 567127 - RNA, 21 nt, Human
aggcgggcagaucacuuuagg

SEQ ID NO: 567128 - RNA, 26 nt, Human
aggcgggcagaucacuuuaggucagg

SEQ ID NO: 567129 - RNA, 21 nt, Human
aggcugaggcaggagaauugc

SEQ ID NO: 567130 - RNA, 24 nt, Human
aggcugaggcaggagaauugcuug

SEQ ID NO: 567131 - RNA, 19 nt, Human
aggcugagguggguggauc

SEQ ID NO: 567132 - RNA, 19 nt, Human
agggagggaaauggguuga

SEQ ID NO: 567133 - RNA, 20 nt, Human
agggagggaaauggguugag

SEQ ID NO: 567134 - RNA, 24 nt, Human
agguggguggaucacaaggucaag

SEQ ID NO: 567135 - RNA, 20 nt, Human
aguacagagaacuuagagga

SEQ ID NO: 567136 - RNA, 19 nt, Human
aguugggugugguggcgug

SEQ ID NO: 567137 - RNA, 23 nt, Human
aguugggugugguggcgugugcc

SEQ ID NO: 567138 - RNA, 20 nt, Human
auaagggguagggagggaaa

SEQ ID NO: 567139 - RNA, 24 nt, Human
aucacaccacugcacuccagccug

SEQ ID NO: 567140 - RNA, 22 nt, Human
aucccagcacuuugggaggcca

SEQ ID NO: 567141 - RNA, 19 nt, Human
augccuguaaucccagcac

SEQ ID NO: 567142 - RNA, 19 nt, Human
augucuguaaucccagcac

SEQ ID NO: 567143 - RNA, 23 nt, Human
auugcaauagcagcaggcagagg

SEQ ID NO: 567144 - RNA, 24 nt, Human
caacauggugaaaccccaucucua

SEQ ID NO: 567145 - RNA, 24 nt, Human
caaggcgggcagaucacuuuaggu

SEQ ID NO: 567146 - RNA, 26 nt, Human
caaggcgggcagaucacuuuagguca

SEQ ID NO: 567147 - RNA, 26 nt, Human
cacacaguuuccauaaaaaaacauag

SEQ ID NO: 567148 - RNA, 21 nt, Human
cacaccacugcacuccagccu

SEQ ID NO: 567149 - RNA, 18 nt, Human
cacacccucucuugacac

SEQ ID NO: 567150 - RNA, 18 nt, Human
cacagcccagaccuggga

SEQ ID NO: 567151 - RNA, 26 nt, Human
caccacugcacuccagccugggugac

SEQ ID NO: 567152 - RNA, 22 nt, Human
cacuccagccugggugacagag

SEQ ID NO: 567153 - RNA, 22 nt, Human
cacuccagccugggugacagag

SEQ ID NO: 567154 - RNA, 24 nt, Human
cacuccagccugggugacagagug

SEQ ID NO: 567155 - RNA, 19 nt, Human
cacugcacuccagccuggg

SEQ ID NO: 567156 - RNA, 19 nt, Human
cacugcacuccagccuggg

SEQ ID NO: 567157 - RNA, 19 nt, Human
cacugcacuccagccuggg

SEQ ID NO: 567158 - RNA, 22 nt, Human
cacugcacuccagccuggguga

SEQ ID NO: 567159 - RNA, 24 nt, Human
cacugcacuccagccugggugaca

SEQ ID NO: 567160 - RNA, 24 nt, Human
cacugcacuccagccugggugaca

SEQ ID NO: 567161 - RNA, 19 nt, Human
cacuggguuccuuugaguu

SEQ ID NO: 567162 - RNA, 27 nt, Human
cagaucacuuuaggucaggaguuggag

SEQ ID NO: 567163 - RNA, 24 nt, Human
cagcacuuugggaggccaaggcgg

SEQ ID NO: 567164 - RNA, 21 nt, Human
cagcacuuugggaggcugagg

SEQ ID NO: 567165 - RNA, 24 nt, Human
cagcacuuugggaggcugaggugg

SEQ ID NO: 567166 - RNA, 24 nt, Human
cagcuacuugggaggcugaggcag

SEQ ID NO: 567167 - RNA, 22 nt, Human
cauagauaguaaagcugauuaa

SEQ ID NO: 567168 - RNA, 20 nt, Human
caugccuguaaucccagcac

SEQ ID NO: 567169 - RNA, 24 nt, Human
caugccuguaaucccagcacuuug

SEQ ID NO: 567170 - RNA, 24 nt, Human
caugucuguaaucccagcacuuug

SEQ ID NO: 567171 - RNA, 20 nt, Human
ccacugcacuccagccuggg

SEQ ID NO: 567172 - RNA, 20 nt, Human
ccacugcacuccagccuggg

SEQ ID NO: 567173 - RNA, 20 nt, Human
ccacugcacuccagccuggg

SEQ ID NO: 567174 - RNA, 21 nt, Human
ccacugcacuccagccugggu

SEQ ID NO: 567175 - RNA, 24 nt, Human
ccacugcacuccagccugggugac

SEQ ID NO: 567176 - RNA, 25 nt, Human
ccacugcacuccagccugggugaca

SEQ ID NO: 567177 - RNA, 19 nt, Human
ccagaaagggagucacacc

SEQ ID NO: 567178 - RNA, 20 nt, Human
ccagaaagggagucacaccg

SEQ ID NO: 567179 - RNA, 21 nt, Human
ccaucucaaaaaaaaaaagaa

SEQ ID NO: 567180 - RNA, 19 nt, Human
ccauuacacuccacuuaac

SEQ ID NO: 567181 - RNA, 24 nt, Human
cccggccaagcgugguggcucaug

SEQ ID NO: 567182 - RNA, 24 nt, Human
ccuagcccuagcuccacucugggc

SEQ ID NO: 567183 - RNA, 23 nt, Human
ccuggccaacauaaugaaacccc

SEQ ID NO: 567184 - RNA, 24 nt, Human
ccuggccaacauaaugaaaccccg

SEQ ID NO: 567185 - RNA, 22 nt, Human
ccuggccaacauggugaaaccc

SEQ ID NO: 567186 - RNA, 23 nt, Human
ccuggccaacauggugaaacccc

SEQ ID NO: 567187 - RNA, 24 nt, Human
ccuggccaacauggugaaacccca

SEQ ID NO: 567188 - RNA, 25 nt, Human
ccugggaggcagagguugcagugag

SEQ ID NO: 567189 - RNA, 22 nt, Human
ccugggucccaaucccacaccc

SEQ ID NO: 567190 - RNA, 22 nt, Human
ccugggugacagagugagacuc

SEQ ID NO: 567191 - RNA, 22 nt, Human
ccuguaaucccagcacuuuggg

SEQ ID NO: 567192 - RNA, 20 nt, Human
ccuguaauucuguggguccc

SEQ ID NO: 567193 - RNA, 18 nt, Human
ccuguagucccagcuacu

SEQ ID NO: 567194 - RNA, 21 nt, Human
ccuguagucccagcuacuugg

SEQ ID NO: 567195 - RNA, 23 nt, Human
ccuguccuauugguaccagcacc

SEQ ID NO: 567196 - RNA, 19 nt, Human
cgcugggugugguggcuca

SEQ ID NO: 567197 - RNA, 24 nt, Human
cggccaagcgugguggcucauguc

SEQ ID NO: 567198 - RNA, 24 nt, Human
cgggcagaucacuuuaggucagga

SEQ ID NO: 567199 - RNA, 18 nt, Human
cuagauuaaguaaaaaaa

SEQ ID NO: 567200 - RNA, 19 nt, Human
cuagcuagauuaaguaaaa

SEQ ID NO: 567201 - RNA, 24 nt, Human
cucaugccuguaaucccagcacuu

SEQ ID NO: 567202 - RNA, 23 nt, Human
cucaugucuguaaucccagcacu

SEQ ID NO: 567203 - RNA, 24 nt, Human
cucaugucuguaaucccagcacuu

SEQ ID NO: 567204 - RNA, 19 nt, Human
cuccaucucaaaaaaaaaa

SEQ ID NO: 567205 - RNA, 25 nt, Human
cucccaauauugagaugaaaccugc

SEQ ID NO: 567206 - RNA, 20 nt, Human
cugaagaguccugaagauaa

SEQ ID NO: 567207 - RNA, 23 nt, Human
cuggccaacauggugaaacccca

SEQ ID NO: 567208 - RNA, 21 nt, Human
cugggucccaaucccacaccc

SEQ ID NO: 567209 - RNA, 19 nt, Human
cuugacaccuagcccuagc

SEQ ID NO: 567210 - RNA, 24 nt, Human
cuugacaccuagcccuagcuccac

SEQ ID NO: 567211 - RNA, 22 nt, Human
gaagauaagggguagggaggga

SEQ ID NO: 567212 - RNA, 24 nt, Human
gacagagugagacuccaucucaaa

SEQ ID NO: 567213 - RNA, 23 nt, Human
gagaauugcuugaaccugggagg

SEQ ID NO: 567214 - RNA, 22 nt, Human
gagguggguggaucacaagguc

SEQ ID NO: 567215 - RNA, 18 nt, Human
gagguugcagugagccaa

SEQ ID NO: 567216 - RNA, 20 nt, Human
gagucacaccggcugcuacc

SEQ ID NO: 567217 - RNA, 18 nt, Human
gaucacuuuaggucagga

SEQ ID NO: 567218 - RNA, 23 nt, Human
gaucacuuuaggucaggaguugg

SEQ ID NO: 567219 - RNA, 24 nt, Human
gaucacuuuaggucaggaguugga

SEQ ID NO: 567220 - RNA, 23 nt, Human
gcacuccagccugggugacagag

SEQ ID NO: 567221 - RNA, 21 nt, Human
gccaacauaaugaaaccccgu

SEQ ID NO: 567222 - RNA, 24 nt, Human
gccaacauggugaaaccccaucuc

SEQ ID NO: 567223 - RNA, 20 nt, Human
gccaagaucacaccacugca

SEQ ID NO: 567224 - RNA, 22 nt, Human
gcugggugugguggcucaugcc

SEQ ID NO: 567225 - RNA, 25 nt, Human
gcuucccuguaacuucccuguaauu

SEQ ID NO: 567226 - RNA, 24 nt, Human
ggagacaauccuggccaacauggu

SEQ ID NO: 567227 - RNA, 25 nt, Human
ggcagaucacuuuaggucaggaguu

SEQ ID NO: 567228 - RNA, 18 nt, Human
gggagggaaauggguuga

SEQ ID NO: 567229 - RNA, 19 nt, Human
gggagggaaauggguugag

SEQ ID NO: 567230 - RNA, 19 nt, Human
ggguagggagggaaauggg

SEQ ID NO: 567231 - RNA, 18 nt, Human
gguagggagggaaauggg

SEQ ID NO: 567232 - RNA, 18 nt, Human
gguggaucacaaggucaa

SEQ ID NO: 567233 - RNA, 24 nt, Human
gguggcucaugccuguaaucccag

SEQ ID NO: 567234 - RNA, 24 nt, Human
gguggcucaugucuguaaucccag

SEQ ID NO: 567235 - RNA, 23 nt, Human
ggugugguggcucaugccuguaa

SEQ ID NO: 567236 - RNA, 18 nt, Human
gucaagagauggagacaa

SEQ ID NO: 567237 - RNA, 20 nt, Human
gucaagagauggagacaauc

SEQ ID NO: 567238 - RNA, 23 nt, Human
gucucgcugggugugguggcuca

SEQ ID NO: 567239 - RNA, 23 nt, Human
guggcucaugccuguaaucccag

SEQ ID NO: 567240 - RNA, 23 nt, Human
guggcucaugucuguaaucccag

SEQ ID NO: 567241 - RNA, 23 nt, Human
uaaaaauuccuagugacagccca

SEQ ID NO: 567242 - RNA, 22 nt, Human
uaacugagaaccaacugaguac

SEQ ID NO: 567243 - RNA, 23 nt, Human
uagcagcaggcagaggcuuuugg

SEQ ID NO: 567244 - RNA, 26 nt, Human
uagcuagauuaaguaaaaaaaaaaaa

SEQ ID NO: 567245 - RNA, 23 nt, Human
ucacaccacugcacuccagccug

SEQ ID NO: 567246 - RNA, 20 nt, Human
ucaggaguuggagaccagcc

SEQ ID NO: 567247 - RNA, 22 nt, Human
ucaugccuguaaucccagcacu

SEQ ID NO: 567248 - RNA, 23 nt, Human
uccagccugggugacagagugag

SEQ ID NO: 567249 - RNA, 24 nt, Human
uccagccugggugacagagugaga

SEQ ID NO: 567250 - RNA, 19 nt, Human
uccaucucaaaaaaaaaaa

SEQ ID NO: 567251 - RNA, 24 nt, Human
uccaucucaaaaaaaaaaagaaaa

SEQ ID NO: 567252 - RNA, 19 nt, Human
ucccaagguucuggaucuc

SEQ ID NO: 567253 - RNA, 21 nt, Human
ucccaaucccacacccucucu

SEQ ID NO: 567254 - RNA, 25 nt, Human
ucccuguaauucugugggucccuug

SEQ ID NO: 567255 - RNA, 27 nt, Human
ucccuguaauucugugggucccuugua

SEQ ID NO: 567256 - RNA, 25 nt, Human
ucccuguaauucugugggucccuuu

SEQ ID NO: 567257 - RNA, 23 nt, Human
uccugaagauaagggguagggag

SEQ ID NO: 567258 - RNA, 24 nt, Human
ucucgcugggugugguggcucaug

SEQ ID NO: 567259 - RNA, 21 nt, Human
ucucuacuaaaaauacaaaaa

SEQ ID NO: 567260 - RNA, 21 nt, Human
ucucuugacaccuagcccuag

SEQ ID NO: 567261 - RNA, 21 nt, Human
ugaaaaacauaaucucuauaa

SEQ ID NO: 567262 - RNA, 19 nt, Human
ugaaaccccaucucuacua

SEQ ID NO: 567263 - RNA, 24 nt, Human
ugaaccugggaggcagagguugca

SEQ ID NO: 567264 - RNA, 22 nt, Human
ugaagcccuucuacaaaauucc

SEQ ID NO: 567265 - RNA, 21 nt, Human
ugacagcccacuccuucucag

SEQ ID NO: 567266 - RNA, 24 nt, Human
ugaggcaggagaauugcuugaacc

SEQ ID NO: 567267 - RNA, 25 nt, Human
ugaggcaggagaauugcuugaaccu

SEQ ID NO: 567268 - RNA, 19 nt, Human
ugagguggguggaucacaa

SEQ ID NO: 567269 - RNA, 21 nt, Human
ugagguggguggaucacaagg

SEQ ID NO: 567270 - RNA, 24 nt, Human
ugagguggguggaucacaagguca

SEQ ID NO: 567271 - RNA, 23 nt, Human
ugagguggguggaucacaagguu

SEQ ID NO: 567272 - RNA, 20 nt, Human
ugauuggccagguuggcuca

SEQ ID NO: 567273 - RNA, 25 nt, Human
ugcacagcccagaccugggagggag

SEQ ID NO: 567274 - RNA, 23 nt, Human
ugccuguaaucccagcacuuugg

SEQ ID NO: 567275 - RNA, 24 nt, Human
ugccuguagucccagcuacuuggg

SEQ ID NO: 567276 - RNA, 24 nt, Human
uggccaacauggugaaaccccauc

SEQ ID NO: 567277 - RNA, 24 nt, Human
uggcgugugccuguagucccagcu

SEQ ID NO: 567278 - RNA, 24 nt, Human
uggcucaugccuguaaucccagca

SEQ ID NO: 567279 - RNA, 24 nt, Human
uggcucaugucuguaaucccagca

SEQ ID NO: 567280 - RNA, 24 nt, Human
ugggaggcagagguugcagugagc

SEQ ID NO: 567281 - RNA, 24 nt, Human
ugggaggccaaggcgggcagauca

SEQ ID NO: 567282 - RNA, 19 nt, Human
ugggaggcugaggcaggag

SEQ ID NO: 567283 - RNA, 22 nt, Human
ugggaggcugaggcaggagaau

SEQ ID NO: 567284 - RNA, 20 nt, Human
ugggaggcugaggugggugg

SEQ ID NO: 567285 - RNA, 23 nt, Human
ugggaggcugagguggguggauc

SEQ ID NO: 567286 - RNA, 24 nt, Human
ugggaggcugagguggguggauca

SEQ ID NO: 567287 - RNA, 24 nt, Human
ugggagggagggauccagggaagg

SEQ ID NO: 567288 - RNA, 18 nt, Human
ugggugugguggcgugug

SEQ ID NO: 567289 - RNA, 18 nt, Human
ugggugugguggcucaug

SEQ ID NO: 567290 - RNA, 24 nt, Human
ugguggcgugugccuguaguccca

SEQ ID NO: 567291 - RNA, 24 nt, Human
ugguggcucaugccuguaauccca

SEQ ID NO: 567292 - RNA, 24 nt, Human
ugguggcucaugucuguaauccca

SEQ ID NO: 567293 - RNA, 25 nt, Human
uguauacauacacacaguuuccaua

SEQ ID NO: 567294 - RNA, 23 nt, Human
ugucuguaaucccagcacuuugg

SEQ ID NO: 567295 - RNA, 23 nt, Human
ugucuguaaucccagcacuuugg

SEQ ID NO: 567296 - RNA, 24 nt, Human
ugucuguaaucccagcacuuuggg

SEQ ID NO: 567297 - RNA, 23 nt, Human
uuaaaaucuuccuguccuauugg

SEQ ID NO: 567298 - RNA, 21 nt, Human
uuagcucugaagaguccugaa

SEQ ID NO: 567299 - RNA, 20 nt, Human
uuaguugggugugguggcgu

SEQ ID NO: 567300 - RNA, 22 nt, Human
uuaguugggugugguggcgugu

SEQ ID NO: 567301 - RNA, 24 nt, Human
uuaguugggugugguggcgugugc

SEQ ID NO: 567302 - RNA, 24 nt, Human
uugaaccugggaggcagagguugc

SEQ ID NO: 567303 - RNA, 20 nt, Human
uugcagugagccaagaucac

SEQ ID NO: 567304 - RNA, 24 nt, Human
uugcuugaaccugggaggcagagg

SEQ ID NO: 567305 - RNA, 23 nt, Human
uugggaggcugaggcaggagaau

SEQ ID NO: 567306 - RNA, 25 nt, Human
uugggaggcugagguggguggauca

SEQ ID NO: 567307 - RNA, 21 nt, Human
uugguuccuauuguuuccugg

SEQ ID NO: 567308 - RNA, 24 nt, Human
uuuggccaguaugacucacauggu

SEQ ID NO: 567309 - RNA, 22 nt, Human
aaacaaaagguauaaacaggga

SEQ ID NO: 567310 - RNA, 31 nt, Human
aacaagaaaaaagucuguacauguuugguaa

SEQ ID NO: 567311 - RNA, 20 nt, Human
aaguacaccuccuaaaauaa

SEQ ID NO: 567312 - RNA, 20 nt, Human
aauaacaagaaaaaagucug

SEQ ID NO: 567313 - RNA, 27 nt, Human
acaacccagguguccaucgagagguca

SEQ ID NO: 567314 - RNA, 23 nt, Human
acaaugaauaaaaccaccuaaga

SEQ ID NO: 567315 - RNA, 18 nt, Human
acgcaggguauacauacg

SEQ ID NO: 567316 - RNA, 20 nt, Human
agagaauaauaacaagaaaa

SEQ ID NO: 567317 - RNA, 20 nt, Human
agcuuuauuuauaacagccc

SEQ ID NO: 567318 - RNA, 25 nt, Human
auaauaacaagaaaaaagucuguac

SEQ ID NO: 567319 - RNA, 23 nt, Human
auacuaaaauccucagaugcuca

SEQ ID NO: 567320 - RNA, 19 nt, Human
auacugaguaaaauaugcc

SEQ ID NO: 567321 - RNA, 22 nt, Human
augaagcaguacucagcaauga

SEQ ID NO: 567322 - RNA, 19 nt, Human
augggcucuacauucugga

SEQ ID NO: 567323 - RNA, 18 nt, Human
caaaauaacuauacugag

SEQ ID NO: 567324 - RNA, 18 nt, Human
cacacaaauacagugggc

SEQ ID NO: 567325 - RNA, 25 nt, Human
cacauccuccugcacaguuuaaauc

SEQ ID NO: 567326 - RNA, 23 nt, Human
cagccccaaacuggaaacaaccc

SEQ ID NO: 567327 - RNA, 20 nt, Human
cagguguccaucgagagguc

SEQ ID NO: 567328 - RNA, 25 nt, Human
cauuguacacuuuugauacgugcag

SEQ ID NO: 567329 - RNA, 23 nt, Human
ccaaacuggaaacaacccaggug

SEQ ID NO: 567330 - RNA, 18 nt, Human
ccgccgcguucccgccac

SEQ ID NO: 567331 - RNA, 20 nt, Human
ccgccgcguucccgccacgc

SEQ ID NO: 567332 - RNA, 19 nt, Human
ccgcguucccgccacgcaa

SEQ ID NO: 567333 - RNA, 21 nt, Human
ccggacgcaagggccggcgcc

SEQ ID NO: 567334 - RNA, 27 nt, Human
cucaacaaugaauaaaaccaccuaaga

SEQ ID NO: 567335 - RNA, 19 nt, Human
cuuuugauacgugcaguuu

SEQ ID NO: 567336 - RNA, 23 nt, Human
gaacuugaagucagaccccucga

SEQ ID NO: 567337 - RNA, 19 nt, Human
gccgccgcguucccgccac

SEQ ID NO: 567338 - RNA, 23 nt, Human
uaaaaaauggugcaguauuugca

SEQ ID NO: 567339 - RNA, 18 nt, Human
uaaaauccucagaugcuc

SEQ ID NO: 567340 - RNA, 19 nt, Human
uaacagcuuuauuuauaac

SEQ ID NO: 567341 - RNA, 19 nt, Human
uacaaagugaaaaugaaga

SEQ ID NO: 567342 - RNA, 20 nt, Human
uacaauguaaaugcugugga

SEQ ID NO: 567343 - RNA, 19 nt, Human
uagaauucuaggacaugca

SEQ ID NO: 567344 - RNA, 20 nt, Human
uauacauacgccaacacauu

SEQ ID NO: 567345 - RNA, 23 nt, Human
uauauuacccaauacaauguaaa

SEQ ID NO: 567346 - RNA, 19 nt, Human
uauuugcauauaaccuacc

SEQ ID NO: 567347 - RNA, 26 nt, Human
ucacuagauuacuuauauuacccaau

SEQ ID NO: 567348 - RNA, 21 nt, Human
ucacugccgccgcguucccgc

SEQ ID NO: 567349 - RNA, 24 nt, Human
uccuggcugaggucgaacgccggg

SEQ ID NO: 567350 - RNA, 20 nt, Human
ugaauaaaaccaccuaagaa

SEQ ID NO: 567351 - RNA, 20 nt, Human
ugaauccacagauguggaac

SEQ ID NO: 567352 - RNA, 21 nt, Human
ugaggauacuaaaauccucag

SEQ ID NO: 567353 - RNA, 23 nt, Human
ugaguaaaauaugccugaccaaa

SEQ ID NO: 567354 - RNA, 23 nt, Human
ugcaguauuugcauauaaccuac

SEQ ID NO: 567355 - RNA, 22 nt, Human
ugcauauaaccuacccacaucc

SEQ ID NO: 567356 - RNA, 25 nt, Human
uggaacacacaaauacagugggcug

SEQ ID NO: 567357 - RNA, 18 nt, Human
uggcugaggucgaacgcc

SEQ ID NO: 567358 - RNA, 21 nt, Human
ugggcucuacauucuggagac

SEQ ID NO: 567359 - RNA, 23 nt, Human
uggguccguuccucacuucaguu

SEQ ID NO: 567360 - RNA, 18 nt, Human
ugucauaaaguugucccc

SEQ ID NO: 567361 - RNA, 23 nt, Human
uguggugauaguuuuacgcaggg

SEQ ID NO: 567362 - RNA, 23 nt, Human
uuaaaucaucacuagauuacuua

SEQ ID NO: 567363 - RNA, 26 nt, Human
uuacauagaauucuaggacaugcaaa

SEQ ID NO: 567364 - RNA, 19 nt, Human
uugguugaauccacagaug

SEQ ID NO: 567365 - RNA, 21 nt, Human
uuuacauagaauucuaggaca

SEQ ID NO: 567366 - RNA, 22 nt, Human
aaauggucgccaaguccaaaga

SEQ ID NO: 567367 - RNA, 19 nt, Human
aagagaaaugcacagcagc

SEQ ID NO: 567368 - RNA, 20 nt, Human
aagcagaaugugcuaaugua

SEQ ID NO: 567369 - RNA, 19 nt, Human
aagcagcaauaaagaucaa

SEQ ID NO: 567370 - RNA, 19 nt, Human
aauaugaaaaaaaaaauag

SEQ ID NO: 567371 - RNA, 20 nt, Human
acugaccugcccucccuggc

SEQ ID NO: 567372 - RNA, 24 nt, Human
agaaaacauuguguguggccacuu

SEQ ID NO: 567373 - RNA, 24 nt, Human
agaucugaucauuacauugcccag

SEQ ID NO: 567374 - RNA, 23 nt, Human
agcaauaaagaucaagaaaaucc

SEQ ID NO: 567375 - RNA, 23 nt, Human
auccuugguuaauuaucuuugau

SEQ ID NO: 567376 - RNA, 24 nt, Human
auccuugguuaauuaucuuugauu

SEQ ID NO: 567377 - RNA, 20 nt, Human
augcccacaagcuaacagaa

SEQ ID NO: 567378 - RNA, 22 nt, Human
augcccacaagcuaacagaaaa

SEQ ID NO: 567379 - RNA, 25 nt, Human
caaacagauacuguuucgugcgcag

SEQ ID NO: 567380 - RNA, 22 nt, Human
caagcuaacagaaaauacagua

SEQ ID NO: 567381 - RNA, 24 nt, Human
caccaccucuuaacaauggacauu

SEQ ID NO: 567382 - RNA, 18 nt, Human
cagaaaauacaguauuga

SEQ ID NO: 567383 - RNA, 24 nt, Human
cagagcgggcagagauugaauccc

SEQ ID NO: 567384 - RNA, 23 nt, Human
cagcaauaaagaucaagaaaauc

SEQ ID NO: 567385 - RNA, 28 nt, Human
cagcaauaaagaucaagaaaauccccaa

SEQ ID NO: 567386 - RNA, 19 nt, Human
cagcugaagcgaagcgcgg

SEQ ID NO: 567387 - RNA, 21 nt, Human
cagcuuuaagaaugccaaaaa

SEQ ID NO: 567388 - RNA, 20 nt, Human
caguagacgcugcucaccac

SEQ ID NO: 567389 - RNA, 22 nt, Human
cauucugucauugcagccugau

SEQ ID NO: 567390 - RNA, 23 nt, Human
cauuguguguggccacuuaagaa

SEQ ID NO: 567391 - RNA, 21 nt, Human
ccagcuagcagcugaagcgaa

SEQ ID NO: 567392 - RNA, 21 nt, Human
ccagcuuuaagaaugccaaaa

SEQ ID NO: 567393 - RNA, 26 nt, Human
cccaacuuuucuaauaaccgcuauac

SEQ ID NO: 567394 - RNA, 21 nt, Human
cccacugaccugcccucccug

SEQ ID NO: 567395 - RNA, 18 nt, Human
ccccucgccacccuccgc

SEQ ID NO: 567396 - RNA, 22 nt, Human
cccuccgcggucgccucccuug

SEQ ID NO: 567397 - RNA, 18 nt, Human
ccggaccggcccggcccc

SEQ ID NO: 567398 - RNA, 19 nt, Human
ccuccgcggucgccucccu

SEQ ID NO: 567399 - RNA, 22 nt, Human
cgcccagccgggugccaggcac

SEQ ID NO: 567400 - RNA, 19 nt, Human
cgcggucgccucccuuggg

SEQ ID NO: 567401 - RNA, 25 nt, Human
cucaccacauucugucauugcagcc

SEQ ID NO: 567402 - RNA, 19 nt, Human
cugaaauggucgccaaguc

SEQ ID NO: 567403 - RNA, 19 nt, Human
cugcccucccuggcggucc

SEQ ID NO: 567404 - RNA, 21 nt, Human
gaaaugcacagcagccuaaaa

SEQ ID NO: 567405 - RNA, 20 nt, Human
gagaaaacauuguguguggc

SEQ ID NO: 567406 - RNA, 20 nt, Human
gagguaucacugccaagaga

SEQ ID NO: 567407 - RNA, 18 nt, Human
gaucugcccacugaccug

SEQ ID NO: 567408 - RNA, 19 nt, Human
gccccggggcugcgggucc

SEQ ID NO: 567409 - RNA, 18 nt, Human
ggucgccucccuugggcc

SEQ ID NO: 567410 - RNA, 24 nt, Human
guguggccacuuaagauuaugccu

SEQ ID NO: 567411 - RNA, 22 nt, Human
uaagcagcaauaaagaucaaga

SEQ ID NO: 567412 - RNA, 24 nt, Human
uaagcauguuagaaaaccugaaga

SEQ ID NO: 567413 - RNA, 21 nt, Human
uacauggguuuauuaaaguuu

SEQ ID NO: 567414 - RNA, 24 nt, Human
uaugcaaaaugugaaauauauaau

SEQ ID NO: 567415 - RNA, 19 nt, Human
uccaaagaagcgaucgaag

SEQ ID NO: 567416 - RNA, 21 nt, Human
ucccuugggccagcuagcagc

SEQ ID NO: 567417 - RNA, 21 nt, Human
ucccuugggccagcuagcagc

SEQ ID NO: 567418 - RNA, 26 nt, Human
ucgccacccuccgcggucgccucccu

SEQ ID NO: 567419 - RNA, 23 nt, Human
ugaaauauauaauucaaaaugcc

SEQ ID NO: 567420 - RNA, 19 nt, Human
ugagcgccagggaaaagga

SEQ ID NO: 567421 - RNA, 18 nt, Human
ugucaaagguagauaggc

SEQ ID NO: 567422 - RNA, 22 nt, Human
uuaacccauuagcaauaaccug

SEQ ID NO: 567423 - RNA, 18 nt, Human
uucaaacccccaaaacau

SEQ ID NO: 567424 - RNA, 23 nt, Human
aaguaaaauuuugauacuaccuc

SEQ ID NO: 567425 - RNA, 20 nt, Human
aagugcauaucaggagauaa

SEQ ID NO: 567426 - RNA, 21 nt, Human
acuaaaaaaaaaaaaaaaacc

SEQ ID NO: 567427 - RNA, 18 nt, Human
agacagaaacuguaagcc

SEQ ID NO: 567428 - RNA, 24 nt, Human
caacauuaauucacuaaacaacca

SEQ ID NO: 567429 - RNA, 20 nt, Human
cacuaaacaaccaaagaagu

SEQ ID NO: 567430 - RNA, 22 nt, Human
cagaaugaaugauagcaaacac

SEQ ID NO: 567431 - RNA, 22 nt, Human
cagacuaaaaaaaaaaaaaaaa

SEQ ID NO: 567432 - RNA, 20 nt, Human
cuaaaaacagucuucagaac

SEQ ID NO: 567433 - RNA, 23 nt, Human
cuucccaaaaagacuagggaguu

SEQ ID NO: 567434 - RNA, 22 nt, Human
gauuuuucaaguuccagaugac

SEQ ID NO: 567435 - RNA, 21 nt, Human
guuaaccaauaaaugaguucc

SEQ ID NO: 567436 - RNA, 22 nt, Human
uaaaaaaaaaaaaaaaacccaa

SEQ ID NO: 567437 - RNA, 22 nt, Human
uaaaauaaaugugcuaagguuc

SEQ ID NO: 567438 - RNA, 24 nt, Human
uagcaggcauaucuuaacuacuuc

SEQ ID NO: 567439 - RNA, 22 nt, Human
uaugcacuagacaguguaugua

SEQ ID NO: 567440 - RNA, 24 nt, Human
uauggaacaaucuaaaaaaaaaac

SEQ ID NO: 567441 - RNA, 20 nt, Human
uauuuuggguuuucuuguuu

SEQ ID NO: 567442 - RNA, 21 nt, Human
ugaguuccauucaggcauuau

SEQ ID NO: 567443 - RNA, 26 nt, Human
uggaacaaucuaaaaaaaaaacacuu

SEQ ID NO: 567444 - RNA, 18 nt, Human
uuuaaagugcauaucagg

SEQ ID NO: 567445 - RNA, 21 nt, Human
uuuuaugguuuuaggcaaaua

SEQ ID NO: 567446 - RNA, 22 nt, Human
aaaaaaaaaaaaaaacccacaa

SEQ ID NO: 567447 - RNA, 25 nt, Human
aaaaaaaaacccacaagauuaucaa

SEQ ID NO: 567448 - RNA, 26 nt, Human
aaaaaaaacuaggagcauauucaaaa

SEQ ID NO: 567449 - RNA, 22 nt, Human
aaaaaaagaaaaaaaagcccaa

SEQ ID NO: 567450 - RNA, 20 nt, Human
aaaaacaacucuaccugacc

SEQ ID NO: 567451 - RNA, 21 nt, Human
aaaaacaacucuaccugacca

SEQ ID NO: 567452 - RNA, 22 nt, Human
aaaaaggcauucuuauuaggcc

SEQ ID NO: 567453 - RNA, 19 nt, Human
aaaagcccaacaacaacaa

SEQ ID NO: 567454 - RNA, 20 nt, Human
aaaagcccaacaacaacaac

SEQ ID NO: 567455 - RNA, 20 nt, Human
aaaauaguacauacuggaca

SEQ ID NO: 567456 - RNA, 19 nt, Human
aaacugcucauagucuuug

SEQ ID NO: 567457 - RNA, 23 nt, Human
aaacuuugauuaugcacaaagca

SEQ ID NO: 567458 - RNA, 25 nt, Human
aacaaaaacaacucuaccugaccac

SEQ ID NO: 567459 - RNA, 21 nt, Human
aacagaacugccaauagcaau

SEQ ID NO: 567460 - RNA, 20 nt, Human
aaccugaauucaucauuggc

SEQ ID NO: 567461 - RNA, 21 nt, Human
aagaacuaaggacauauaguu

SEQ ID NO: 567462 - RNA, 24 nt, Human
aagcaaagccaaaauaucagaaga

SEQ ID NO: 567463 - RNA, 25 nt, Human
aauguuauuuuucuugccaaaguuc

SEQ ID NO: 567464 - RNA, 22 nt, Human
aauuagaacacugcucaaagug

SEQ ID NO: 567465 - RNA, 24 nt, Human
acaacaacaaaaacaacucuaccu

SEQ ID NO: 567466 - RNA, 19 nt, Human
acaagacaacuaagaagcc

SEQ ID NO: 567467 - RNA, 26 nt, Human
acacaaaucugggcaagucugggagc

SEQ ID NO: 567468 - RNA, 25 nt, Human
acacuacaaaacagaaggagguguc

SEQ ID NO: 567469 - RNA, 25 nt, Human
accaaaaaaaaaaaaagaaaaaaaa

SEQ ID NO: 567470 - RNA, 24 nt, Human
accaaaagagaccaaaaaaaaaaa

SEQ ID NO: 567471 - RNA, 21 nt, Human
accaggauacacuacaaaaca

SEQ ID NO: 567472 - RNA, 22 nt, Human
agaaauuggaaguggcugaacu

SEQ ID NO: 567473 - RNA, 24 nt, Human
agaaauuggaaguggcugaacuuu

SEQ ID NO: 567474 - RNA, 19 nt, Human
agacacuucgacaccaaug

SEQ ID NO: 567475 - RNA, 24 nt, Human
agaccucuguauuugaaacaguuu

SEQ ID NO: 567476 - RNA, 21 nt, Human
agcacccuaaaaaaaaacuag

SEQ ID NO: 567477 - RNA, 19 nt, Human
agccaaaauaucagaagaa

SEQ ID NO: 567478 - RNA, 22 nt, Human
agcccaacaacaacaacaaaaa

SEQ ID NO: 567479 - RNA, 19 nt, Human
agcuauuucccuaccagga

SEQ ID NO: 567480 - RNA, 18 nt, Human
auauaacuuagcaaugaa

SEQ ID NO: 567481 - RNA, 23 nt, Human
auauauccucauccauguguaca

SEQ ID NO: 567482 - RNA, 21 nt, Human
aucaaggcccucacauacuaa

SEQ ID NO: 567483 - RNA, 21 nt, Human
aucauuaagcaaagccaaaau

SEQ ID NO: 567484 - RNA, 24 nt, Human
aucauuggcaauauuacauaacaa

SEQ ID NO: 567485 - RNA, 22 nt, Human
aucauuuucuugccuuuacaag

SEQ ID NO: 567486 - RNA, 19 nt, Human
aucugcaaacuauuucccc

SEQ ID NO: 567487 - RNA, 21 nt, Human
caaaaacaacucuaccugacc

SEQ ID NO: 567488 - RNA, 22 nt, Human
caaaaacaacucuaccugacca

SEQ ID NO: 567489 - RNA, 20 nt, Human
caaaauaaagacuguggcaa

SEQ ID NO: 567490 - RNA, 24 nt, Human
caaaauaaagacuguggcaaauaa

SEQ ID NO: 567491 - RNA, 21 nt, Human
caaauaaagacaagacaacua

SEQ ID NO: 567492 - RNA, 19 nt, Human
caacaaaaacaacucuacc

SEQ ID NO: 567493 - RNA, 21 nt, Human
caacaacaaaaacaacucuac

SEQ ID NO: 567494 - RNA, 25 nt, Human
caacaacaacaaaaacaacucuacc

SEQ ID NO: 567495 - RNA, 26 nt, Human
caacaacaacaacaaaaacaacucua

SEQ ID NO: 567496 - RNA, 24 nt, Human
caacuaagaagcauuuuccaccau

SEQ ID NO: 567497 - RNA, 21 nt, Human
caaguuaaaccaacagaacca

SEQ ID NO: 567498 - RNA, 20 nt, Human
caaguuuugcagacauaaug

SEQ ID NO: 567499 - RNA, 23 nt, Human
caaucguauuugaauguucaggu

SEQ ID NO: 567500 - RNA, 22 nt, Human
caaugacaucugaaggcagcac

SEQ ID NO: 567501 - RNA, 22 nt, Human
caaugcugagggugcuuucaga

SEQ ID NO: 567502 - RNA, 25 nt, Human
caccaguagccaauauuucaugauc

SEQ ID NO: 567503 - RNA, 18 nt, Human
cacccccaccccaccaaa

SEQ ID NO: 567504 - RNA, 19 nt, Human
cacuacaaaacagaaggag

SEQ ID NO: 567505 - RNA, 24 nt, Human
cacugaaacugcagauaucaaugc

SEQ ID NO: 567506 - RNA, 24 nt, Human
cacugcuaacacuuaaaggaauua

SEQ ID NO: 567507 - RNA, 25 nt, Human
cagaaaagguccauuggauacagug

SEQ ID NO: 567508 - RNA, 23 nt, Human
cagcacccuaaaaaaaaacuagg

SEQ ID NO: 567509 - RNA, 28 nt, Human
caggagaaacaucaaugacaucugaagg

SEQ ID NO: 567510 - RNA, 18 nt, Human
caggagcagaugccccca

SEQ ID NO: 567511 - RNA, 19 nt, Human
caguaacagagagucucca

SEQ ID NO: 567512 - RNA, 23 nt, Human
caguggcuuccaaguucggcugc

SEQ ID NO: 567513 - RNA, 24 nt, Human
caucaaaaaaaaaaaaaaacccac

SEQ ID NO: 567514 - RNA, 21 nt, Human
cauuagugaauaaagaacaga

SEQ ID NO: 567515 - RNA, 18 nt, Human
ccaaaucaaaacauaacu

SEQ ID NO: 567516 - RNA, 23 nt, Human
ccacauucacagaaaaugacacc

SEQ ID NO: 567517 - RNA, 26 nt, Human
ccaguggcaauaaguacaauacacaa

SEQ ID NO: 567518 - RNA, 26 nt, Human
ccaugcaucaaaaaaaaaaaaaaacc

SEQ ID NO: 567519 - RNA, 20 nt, Human
cccaccccaccaaaagagac

SEQ ID NO: 567520 - RNA, 26 nt, Human
cccaugcaucaaaaaaaaaaaaaaaa

SEQ ID NO: 567521 - RNA, 27 nt, Human
cccaugcaucaaaaaaaaaaaaaaacc

SEQ ID NO: 567522 - RNA, 25 nt, Human
ccccaccccaccaaaagagaccaaa

SEQ ID NO: 567523 - RNA, 26 nt, Human
cccccaccccaccaaaagagaccaaa

SEQ ID NO: 567524 - RNA, 25 nt, Human
ccgacacuaacacauauaacuuagc

SEQ ID NO: 567525 - RNA, 21 nt, Human
cgaaagggacugucggaagua

SEQ ID NO: 567526 - RNA, 23 nt, Human
cgcggaaauguagagagcaguag

SEQ ID NO: 567527 - RNA, 21 nt, Human
cgugccaguguagucuguguu

SEQ ID NO: 567528 - RNA, 20 nt, Human
cuauuuccccgacacuaaca

SEQ ID NO: 567529 - RNA, 20 nt, Human
cucacauacuaaugauuucc

SEQ ID NO: 567530 - RNA, 21 nt, Human
cucccguuucacugucacagg

SEQ ID NO: 567531 - RNA, 30 nt, Human
cuccggggucguaguugagcacuaggcggg

SEQ ID NO: 567532 - RNA, 18 nt, Human
cugcagcucuucuuuuaa

SEQ ID NO: 567533 - RNA, 19 nt, Human
cugggaagaaagcugcaga

SEQ ID NO: 567534 - RNA, 19 nt, Human
cuuuauauagcagggcauc

SEQ ID NO: 567535 - RNA, 18 nt, Human
gaaacuugugcuaaaaac

SEQ ID NO: 567536 - RNA, 20 nt, Human
gaacagcacccuaaaaaaaa

SEQ ID NO: 567537 - RNA, 23 nt, Human
gaccaaaaaaaaaaaaagaaaaa

SEQ ID NO: 567538 - RNA, 18 nt, Human
gagggggaauuuuuuuuc

SEQ ID NO: 567539 - RNA, 18 nt, Human
gcaaguuaaaccaacaga

SEQ ID NO: 567540 - RNA, 18 nt, Human
gcaucaaaaaaaaaaaaa

SEQ ID NO: 567541 - RNA, 19 nt, Human
gcggaguacuuccucaaca

SEQ ID NO: 567542 - RNA, 24 nt, Human
ggagcauauucaaaauaaagacug

SEQ ID NO: 567543 - RNA, 24 nt, Human
gggcugugcucuuucaagcaacug

SEQ ID NO: 567544 - RNA, 19 nt, Human
gggucuccggggucguagu

SEQ ID NO: 567545 - RNA, 19 nt, Human
uaaaaaggcauucuuauua

SEQ ID NO: 567546 - RNA, 22 nt, Human
uaaaacuguagcuauuucccua

SEQ ID NO: 567547 - RNA, 22 nt, Human
uaaacugaaacauacuuugugc

SEQ ID NO: 567548 - RNA, 24 nt, Human
uaaauaagcacugucaaagcugca

SEQ ID NO: 567549 - RNA, 18 nt, Human
uaagcaaagccaaaauau

SEQ ID NO: 567550 - RNA, 21 nt, Human
uaagcaaagccaaaauaucag

SEQ ID NO: 567551 - RNA, 23 nt, Human
uaagcaaagccaaaauaucagaa

SEQ ID NO: 567552 - RNA, 23 nt, Human
uacaauacacaaaucugggcaag

SEQ ID NO: 567553 - RNA, 27 nt, Human
uauaccaaaucuaucuauugaaagccc

SEQ ID NO: 567554 - RNA, 20 nt, Human
uaucagaagaacagucaacu

SEQ ID NO: 567555 - RNA, 26 nt, Human
uaucccgugccaguguagucuguguu

SEQ ID NO: 567556 - RNA, 21 nt, Human
ucaaugccuguggaacauaag

SEQ ID NO: 567557 - RNA, 23 nt, Human
ucacugucacucucugaucugga

SEQ ID NO: 567558 - RNA, 23 nt, Human
ucagaauaaaacuacucuccuuc

SEQ ID NO: 567559 - RNA, 20 nt, Human
ucaguuguggguucugaggu

SEQ ID NO: 567560 - RNA, 24 nt, Human
ucauaagacacugcuaacacuuaa

SEQ ID NO: 567561 - RNA, 23 nt, Human
ucauuggcaauauuacauaacaa

SEQ ID NO: 567562 - RNA, 24 nt, Human
ucccaugcaucaaaaaaaaaaaaa

SEQ ID NO: 567563 - RNA, 24 nt, Human
uccccauaaaaauuaaccggaaga

SEQ ID NO: 567564 - RNA, 22 nt, Human
uccuccuagcuucaaccuaccu

SEQ ID NO: 567565 - RNA, 25 nt, Human
ucuguauuugaaacaguuucuaagc

SEQ ID NO: 567566 - RNA, 18 nt, Human
ugaagugcaggacuggug

SEQ ID NO: 567567 - RNA, 20 nt, Human
ugacaccaggauacacuaca

SEQ ID NO: 567568 - RNA, 19 nt, Human
ugacucacuugucuucccc

SEQ ID NO: 567569 - RNA, 18 nt, Human
ugagaauaccagcauaaa

SEQ ID NO: 567570 - RNA, 23 nt, Human
ugcacaaagcauggccauaaaca

SEQ ID NO: 567571 - RNA, 18 nt, Human
ugcaucaaaaaaaaaaaa

SEQ ID NO: 567572 - RNA, 22 nt, Human
ugcugagggugcuuucagacau

SEQ ID NO: 567573 - RNA, 24 nt, Human
uggaaagcaaauaaagacaagaca

SEQ ID NO: 567574 - RNA, 25 nt, Human
uggaaagcaaauaaagacaagacaa

SEQ ID NO: 567575 - RNA, 27 nt, Human
uggaaagcaaauaaagacaagacaacu

SEQ ID NO: 567576 - RNA, 20 nt, Human
uggcagguggaguugguggg

SEQ ID NO: 567577 - RNA, 19 nt, Human
uggcuacugugucacaaac

SEQ ID NO: 567578 - RNA, 18 nt, Human
ugggaagaaagcugcaga

SEQ ID NO: 567579 - RNA, 24 nt, Human
ugggcaagucugggagcauuauuc

SEQ ID NO: 567580 - RNA, 20 nt, Human
uguagcaaauguccgcaaac

SEQ ID NO: 567581 - RNA, 18 nt, Human
ugucaaagcugcagcucu

SEQ ID NO: 567582 - RNA, 20 nt, Human
ugucaaagcugcagcucuuc

SEQ ID NO: 567583 - RNA, 21 nt, Human
ugucacaaacggguggcaggc

SEQ ID NO: 567584 - RNA, 22 nt, Human
uguccgcaaacacagcacgaaa

SEQ ID NO: 567585 - RNA, 24 nt, Human
ugugcuaaaaacaaccugaauuca

SEQ ID NO: 567586 - RNA, 19 nt, Human
ugugucacaaacggguggc

SEQ ID NO: 567587 - RNA, 24 nt, Human
uguuauauacucgcauaguuuuuu

SEQ ID NO: 567588 - RNA, 22 nt, Human
uuaaccggaagaagugcauuua

SEQ ID NO: 567589 - RNA, 19 nt, Human
uuauaaguaggcaaaccau

SEQ ID NO: 567590 - RNA, 22 nt, Human
uucaacacaaaacuguuacaaa

SEQ ID NO: 567591 - RNA, 23 nt, Human
uuccuuacauuuaaucauaaacu

SEQ ID NO: 567592 - RNA, 21 nt, Human
uucuccaugucuuguacuagg

SEQ ID NO: 567593 - RNA, 19 nt, Human
uugccaaccucccaugcau

SEQ ID NO: 567594 - RNA, 18 nt, Human
uuucaugaucagaaaugg

SEQ ID NO: 567595 - RNA, 21 nt, Human
uuuuuuucauaauacugcuga

SEQ ID NO: 567596 - RNA, 24 nt, Human
aaagugcugggauuacagguguga

SEQ ID NO: 567597 - RNA, 20 nt, Human
aagccagagcuggucaggga

SEQ ID NO: 567598 - RNA, 18 nt, Human
aagugcugggauuacagg

SEQ ID NO: 567599 - RNA, 19 nt, Human
aagugcugggauuacaggu

SEQ ID NO: 567600 - RNA, 26 nt, Human
aagugcugggauuacaggugugagcc

SEQ ID NO: 567601 - RNA, 23 nt, Human
accauguuggucaggcuggucuc

SEQ ID NO: 567602 - RNA, 21 nt, Human
acccggccccuuauccacaaa

SEQ ID NO: 567603 - RNA, 22 nt, Human
acugcaaucuccaucuccuggg

SEQ ID NO: 567604 - RNA, 19 nt, Human
agaagccagagcuggucag

SEQ ID NO: 567605 - RNA, 21 nt, Human
agcucucugcuccagcuucuc

SEQ ID NO: 567606 - RNA, 25 nt, Human
aggcuggagugcaguggcaucaucu

SEQ ID NO: 567607 - RNA, 24 nt, Human
aggugauccacucaccuuggccuc

SEQ ID NO: 567608 - RNA, 27 nt, Human
augggguuucauuucaccauguuggga

SEQ ID NO: 567609 - RNA, 30 nt, Human
augggguuucauuucaccauguuggucagg

SEQ ID NO: 567610 - RNA, 19 nt, Human
auuucaccauguuggucag

SEQ ID NO: 567611 - RNA, 20 nt, Human
auuucaccauguuggucagg

SEQ ID NO: 567612 - RNA, 26 nt, Human
caaacuucugaccucaggugauccaa

SEQ ID NO: 567613 - RNA, 24 nt, Human
caaagugcugggauuacaggugug

SEQ ID NO: 567614 - RNA, 25 nt, Human
caacagaccucucauucuacuuccc

SEQ ID NO: 567615 - RNA, 22 nt, Human
caagcgauucuccugucucagc

SEQ ID NO: 567616 - RNA, 22 nt, Human
caccaccacgccuggcuaauuu

SEQ ID NO: 567617 - RNA, 21 nt, Human
caccauguuggucaggcuggu

SEQ ID NO: 567618 - RNA, 24 nt, Human
caccauguuggucaggcuggucuc

SEQ ID NO: 567619 - RNA, 22 nt, Human
cagaccucucauucuacuuccc

SEQ ID NO: 567620 - RNA, 18 nt, Human
cagccucccgaguaaccg

SEQ ID NO: 567621 - RNA, 26 nt, Human
caggagcagaagccagagcuggucag

SEQ ID NO: 567622 - RNA, 19 nt, Human
cagggagguaggaugaggu

SEQ ID NO: 567623 - RNA, 23 nt, Human
caugcaccaccacgccuggcuaa

SEQ ID NO: 567624 - RNA, 28 nt, Human
cauucuacuucccccagguaacuccuua

SEQ ID NO: 567625 - RNA, 20 nt, Human
ccaaagugcugggauuacag

SEQ ID NO: 567626 - RNA, 21 nt, Human
ccaaagugcugggauuacagg

SEQ ID NO: 567627 - RNA, 21 nt, Human
ccaaagugcugggauuacagg

SEQ ID NO: 567628 - RNA, 24 nt, Human
ccaaagugcugggauuacaggugu

SEQ ID NO: 567629 - RNA, 24 nt, Human
ccacaaauuuggauugagcuacag

SEQ ID NO: 567630 - RNA, 24 nt, Human
cccgaguaaccgggacuacaggca

SEQ ID NO: 567631 - RNA, 25 nt, Human
ccuauacucaugccagcucucugcu

SEQ ID NO: 567632 - RNA, 23 nt, Human
ccuggguucaagcgauucuccug

SEQ ID NO: 567633 - RNA, 24 nt, Human
cgcucuguagcccaggcuggagug

SEQ ID NO: 567634 - RNA, 21 nt, Human
cgggacuacaggcaugcacca

SEQ ID NO: 567635 - RNA, 24 nt, Human
cuacugcaaucuccaucuccuggg

SEQ ID NO: 567636 - RNA, 24 nt, Human
cucaggugauccacucaccuuggc

SEQ ID NO: 567637 - RNA, 21 nt, Human
cuccuggguucaagcgauucu

SEQ ID NO: 567638 - RNA, 21 nt, Human
cucgcucuguagcccaggcug

SEQ ID NO: 567639 - RNA, 21 nt, Human
cucucauucuacuucccccag

SEQ ID NO: 567640 - RNA, 23 nt, Human
cugaccucaggugauccacucac

SEQ ID NO: 567641 - RNA, 19 nt, Human
cugucucagccucccgagu

SEQ ID NO: 567642 - RNA, 19 nt, Human
cuuauccacaaauuuggau

SEQ ID NO: 567643 - RNA, 22 nt, Human
cuuucauagcauuccccuuugg

SEQ ID NO: 567644 - RNA, 19 nt, Human
gaaaauguguccuuccucc

SEQ ID NO: 567645 - RNA, 23 nt, Human
gaccucaggugauccacucaccu

SEQ ID NO: 567646 - RNA, 27 nt, Human
gagaugggguuucauuucaccaugucg

SEQ ID NO: 567647 - RNA, 30 nt, Human
gagaugggguuucauuucaccauguugguu

SEQ ID NO: 567648 - RNA, 20 nt, Human
gagcagaagccagagcuggu

SEQ ID NO: 567649 - RNA, 24 nt, Human
gaguaaccgggacuacaggcaugc

SEQ ID NO: 567650 - RNA, 18 nt, Human
gauuacaggugugagcca

SEQ ID NO: 567651 - RNA, 22 nt, Human
gauuacaggugugagccacugc

SEQ ID NO: 567652 - RNA, 23 nt, Human
gauuacaggugugagccacugca

SEQ ID NO: 567653 - RNA, 21 nt, Human
gauucuccugucucagccucc

SEQ ID NO: 567654 - RNA, 18 nt, Human
gcaucaucuuggccuacu

SEQ ID NO: 567655 - RNA, 22 nt, Human
gccacugcacccggccccuuau

SEQ ID NO: 567656 - RNA, 23 nt, Human
gcccaggcuggagugcaguggca

SEQ ID NO: 567657 - RNA, 24 nt, Human
gcccaggcuggagugcaguggcau

SEQ ID NO: 567658 - RNA, 24 nt, Human
gcgauucuccugucucagccuccc

SEQ ID NO: 567659 - RNA, 22 nt, Human
gcucuguagcccaggcuggagu

SEQ ID NO: 567660 - RNA, 20 nt, Human
gcuggagugcaguggcauca

SEQ ID NO: 567661 - RNA, 24 nt, Human
ggcuggucucaaacuucugaccuc

SEQ ID NO: 567662 - RNA, 23 nt, Human
gggacuacaggcaugcaccacca

SEQ ID NO: 567663 - RNA, 19 nt, Human
ggucucaaacuucugaccu

SEQ ID NO: 567664 - RNA, 24 nt, Human
gugauccacucaccuuggccuccc

SEQ ID NO: 567665 - RNA, 24 nt, Human
uaauuuuuauauuuuuaguugaga

SEQ ID NO: 567666 - RNA, 22 nt, Human
uacaggcaugcaccaccacgcc

SEQ ID NO: 567667 - RNA, 19 nt, Human
uacaggugugagccacugc

SEQ ID NO: 567668 - RNA, 23 nt, Human
uacaggugugagccacugcaccc

SEQ ID NO: 567669 - RNA, 18 nt, Human
uagcccaggcuggagugc

SEQ ID NO: 567670 - RNA, 30 nt, Human
uaguugagaugggguuucauuucaccaugg

SEQ ID NO: 567671 - RNA, 22 nt, Human
uauucccaacagaccucucauu

SEQ ID NO: 567672 - RNA, 21 nt, Human
ucagccucccgaguaaccggg

SEQ ID NO: 567673 - RNA, 23 nt, Human
ucccaaagugcugggauuacagg

SEQ ID NO: 567674 - RNA, 24 nt, Human
ucccgaguaaccgggacuacaggc

SEQ ID NO: 567675 - RNA, 21 nt, Human
uccuggguucaagcgauucuc

SEQ ID NO: 567676 - RNA, 24 nt, Human
uccuggguucaagcgauucuccug

SEQ ID NO: 567677 - RNA, 22 nt, Human
uccuuccuccuucccuauacuc

SEQ ID NO: 567678 - RNA, 24 nt, Human
ucuccuggguucaagcgauucucc

SEQ ID NO: 567679 - RNA, 24 nt, Human
ucuccugucucagccucccgagua

SEQ ID NO: 567680 - RNA, 23 nt, Human
ucucgcucuguagcccaggcugg

SEQ ID NO: 567681 - RNA, 24 nt, Human
ucucgcucuguagcccaggcugga

SEQ ID NO: 567682 - RNA, 24 nt, Human
ucuguagcccaggcuggagugcag

SEQ ID NO: 567683 - RNA, 23 nt, Human
ugaaaauguguccuuccuccuuc

SEQ ID NO: 567684 - RNA, 20 nt, Human
ugaccucaggugauccacuc

SEQ ID NO: 567685 - RNA, 24 nt, Human
ugauccacucaccuuggccuccca

SEQ ID NO: 567686 - RNA, 21 nt, Human
ugcuccagcuucucuuggccc

SEQ ID NO: 567687 - RNA, 24 nt, Human
ugcugggauuacaggugugagcca

SEQ ID NO: 567688 - RNA, 23 nt, Human
uggagugcaguggcaucaucuug

SEQ ID NO: 567689 - RNA, 24 nt, Human
uggagugcaguggcaucaucuugg

SEQ ID NO: 567690 - RNA, 20 nt, Human
uggcaucaucuuggccuacu

SEQ ID NO: 567691 - RNA, 18 nt, Human
ugggauuacaggugugag

SEQ ID NO: 567692 - RNA, 19 nt, Human
ugggauuacaggugugagc

SEQ ID NO: 567693 - RNA, 21 nt, Human
ugggauuacaggugugagcca

SEQ ID NO: 567694 - RNA, 22 nt, Human
ugggauuacaggugugagccac

SEQ ID NO: 567695 - RNA, 22 nt, Human
ugggauuacaggugugagccac

SEQ ID NO: 567696 - RNA, 24 nt, Human
ugggauuacaggugugagccacug

SEQ ID NO: 567697 - RNA, 30 nt, Human
ugggguuucauuucaccauguuggucaggg

SEQ ID NO: 567698 - RNA, 23 nt, Human
uggguucaagcgauucuccuguc

SEQ ID NO: 567699 - RNA, 24 nt, Human
uggguucaagcgauucuccugucu

SEQ ID NO: 567700 - RNA, 24 nt, Human
uggucaggcuggucucaaacuucu

SEQ ID NO: 567701 - RNA, 24 nt, Human
ugucucagccucccgaguaaccgg

SEQ ID NO: 567702 - RNA, 18 nt, Human
uuaguugagaugggguuu

SEQ ID NO: 567703 - RNA, 21 nt, Human
uuaguugagaugggguuucau

SEQ ID NO: 567704 - RNA, 30 nt, Human
uuaguugagaugggguuucauuucaccauu

SEQ ID NO: 567705 - RNA, 23 nt, Human
uucaagcgauucuccugucucag

SEQ ID NO: 567706 - RNA, 18 nt, Human
uuggccucccaaagugcu

SEQ ID NO: 567707 - RNA, 24 nt, Human
uuucaccauguuggucaggcuggu

SEQ ID NO: 567708 - RNA, 24 nt, Human
uuuuuaguugagaugggguuucau

SEQ ID NO: 567709 - RNA, 27 nt, Human
aaaaaaaaaaaaaaaaaaaagacagaa

SEQ ID NO: 567710 - RNA, 25 nt, Human
aaaaaaaaaaaaaaagacagaaaag

SEQ ID NO: 567711 - RNA, 19 nt, Human
aacacggugaaaccccguc

SEQ ID NO: 567712 - RNA, 20 nt, Human
aacacggugaaaccccgucu

SEQ ID NO: 567713 - RNA, 21 nt, Human
aacacggugaaaccccgucuc

SEQ ID NO: 567714 - RNA, 24 nt, Human
acagaacaagacucugccucaaaa

SEQ ID NO: 567715 - RNA, 24 nt, Human
accccgucucuacuaaaaauacaa

SEQ ID NO: 567716 - RNA, 28 nt, Human
acucugccucaaaaaaaaaaaaaaaaaa

SEQ ID NO: 567717 - RNA, 18 nt, Human
acugcacgccagccuggg

SEQ ID NO: 567718 - RNA, 24 nt, Human
acugcacgccagccugggcgacag

SEQ ID NO: 567719 - RNA, 19 nt, Human
agacagaaaagucccaauu

SEQ ID NO: 567720 - RNA, 24 nt, Human
agagcuugcagugagccgagaucg

SEQ ID NO: 567721 - RNA, 24 nt, Human
agaugggcggaucacgaggucagg

SEQ ID NO: 567722 - RNA, 24 nt, Human
agcacuuugggaggccgagauggg

SEQ ID NO: 567723 - RNA, 24 nt, Human
agccugggcgacagaacaagacuc

SEQ ID NO: 567724 - RNA, 21 nt, Human
aggcagagcuugcagugagcc

SEQ ID NO: 567725 - RNA, 24 nt, Human
aggcagagcuugcagugagccgag

SEQ ID NO: 567726 - RNA, 24 nt, Human
aggcaggagaauggcgugaacccg

SEQ ID NO: 567727 - RNA, 21 nt, Human
aggccgagaugggcggaucac

SEQ ID NO: 567728 - RNA, 18 nt, Human
aggcugaggcaggagaau

SEQ ID NO: 567729 - RNA, 21 nt, Human
agggcccagugucugcaugua

SEQ ID NO: 567730 - RNA, 21 nt, Human
auacauacaaugguacuaccu

SEQ ID NO: 567731 - RNA, 24 nt, Human
aucgcgccacugcacgccagccug

SEQ ID NO: 567732 - RNA, 25 nt, Human
caaaaaaaauuggccgggcguggug

SEQ ID NO: 567733 - RNA, 20 nt, Human
caagaugagcaccauccucc

SEQ ID NO: 567734 - RNA, 23 nt, Human
caagaugagcaccauccuccauu

SEQ ID NO: 567735 - RNA, 24 nt, Human
cacgccuguaaucccagcacuuug

SEQ ID NO: 567736 - RNA, 20 nt, Human
cacugcacgccagccugggc

SEQ ID NO: 567737 - RNA, 23 nt, Human
cacugcacgccagccugggcgac

SEQ ID NO: 567738 - RNA, 24 nt, Human
cacugcacgccagccugggcgaca

SEQ ID NO: 567739 - RNA, 24 nt, Human
cagaaggcugggcacgguggcuca

SEQ ID NO: 567740 - RNA, 19 nt, Human
cagcaauagcaccuuccca

SEQ ID NO: 567741 - RNA, 24 nt, Human
cagcacuuugggaggccgagaugg

SEQ ID NO: 567742 - RNA, 28 nt, Human
cagcacuuugggaggccgagaugggcgg

SEQ ID NO: 567743 - RNA, 24 nt, Human
cagcuacucaggaggcugaggcag

SEQ ID NO: 567744 - RNA, 21 nt, Human
ccacugcacgccagccugggc

SEQ ID NO: 567745 - RNA, 21 nt, Human
ccacugcacgccagccugggc

SEQ ID NO: 567746 - RNA, 24 nt, Human
ccacugcacgccagccugggcgac

SEQ ID NO: 567747 - RNA, 24 nt, Human
ccgcuccgccgcacuucuccggcc

SEQ ID NO: 567748 - RNA, 23 nt, Human
ccugacuaacacggugaaacccc

SEQ ID NO: 567749 - RNA, 24 nt, Human
ccugacuaacacggugaaaccccg

SEQ ID NO: 567750 - RNA, 21 nt, Human
ccuguagucccagcuacucag

SEQ ID NO: 567751 - RNA, 22 nt, Human
ccuguagucccagcuacucagg

SEQ ID NO: 567752 - RNA, 24 nt, Human
cgagaccauccugacuaacacggu

SEQ ID NO: 567753 - RNA, 24 nt, Human
cgagaugggcggaucacgagguca

SEQ ID NO: 567754 - RNA, 23 nt, Human
cgccuguaaucccagcacuuugg

SEQ ID NO: 567755 - RNA, 24 nt, Human
cgccuguaaucccagcacuuuggg

SEQ ID NO: 567756 - RNA, 24 nt, Human
cgccuguagucccagcuacucagg

SEQ ID NO: 567757 - RNA, 18 nt, Human
cucaaaaaaaaaaaaaaa

SEQ ID NO: 567758 - RNA, 22 nt, Human
cucacgccuguaaucccagcac

SEQ ID NO: 567759 - RNA, 24 nt, Human
cucacgccuguaaucccagcacuu

SEQ ID NO: 567760 - RNA, 22 nt, Human
cuccauuuauccuuguauuucc

SEQ ID NO: 567761 - RNA, 19 nt, Human
cucugccucaaaaaaaaaa

SEQ ID NO: 567762 - RNA, 22 nt, Human
cucugccucaaaaaaaaaaaaa

SEQ ID NO: 567763 - RNA, 18 nt, Human
cugacuaacacggugaaa

SEQ ID NO: 567764 - RNA, 19 nt, Human
cuugcagugagccgagauc

SEQ ID NO: 567765 - RNA, 21 nt, Human
cuugcagugagccgagaucgc

SEQ ID NO: 567766 - RNA, 20 nt, Human
gaacccgggaggcagagcuu

SEQ ID NO: 567767 - RNA, 23 nt, Human
gacagaacaagacucugccucaa

SEQ ID NO: 567768 - RNA, 23 nt, Human
gagaucgcgccacugcacgccag

SEQ ID NO: 567769 - RNA, 18 nt, Human
gagcuugcagugagccga

SEQ ID NO: 567770 - RNA, 24 nt, Human
gccacugcacgccagccugggcga

SEQ ID NO: 567771 - RNA, 20 nt, Human
gccgagaucgcgccacugca

SEQ ID NO: 567772 - RNA, 19 nt, Human
gccgggcgugguggcgggc

SEQ ID NO: 567773 - RNA, 21 nt, Human
gccgggcgugguggcgggcgc

SEQ ID NO: 567774 - RNA, 22 nt, Human
gcugaggcaggagaauggcgug

SEQ ID NO: 567775 - RNA, 19 nt, Human
gcugggcacgguggcucac

SEQ ID NO: 567776 - RNA, 23 nt, Human
ggcacgguggcucacgccuguaa

SEQ ID NO: 567777 - RNA, 21 nt, Human
ggcggaucacgaggucaggag

SEQ ID NO: 567778 - RNA, 18 nt, Human
ggcgugguggcgggcgcc

SEQ ID NO: 567779 - RNA, 18 nt, Human
gggcacgguggcucacgc

SEQ ID NO: 567780 - RNA, 24 nt, Human
gggcgugguggcgggcgccuguag

SEQ ID NO: 567781 - RNA, 24 nt, Human
gguggcgggcgccuguagucccag

SEQ ID NO: 567782 - RNA, 23 nt, Human
gguggcucacgccuguaauccca

SEQ ID NO: 567783 - RNA, 24 nt, Human
gguggcucacgccuguaaucccag

SEQ ID NO: 567784 - RNA, 23 nt, Human
uaaauagaacagaaggcugggca

SEQ ID NO: 567785 - RNA, 22 nt, Human
uaacacggugaaaccccgucuc

SEQ ID NO: 567786 - RNA, 24 nt, Human
uaacacggugaaaccccgucucua

SEQ ID NO: 567787 - RNA, 21 nt, Human
uaccuucaccaacuuuuucau

SEQ ID NO: 567788 - RNA, 22 nt, Human
ucaaaaaaaaaaaaaaaaaaaa

SEQ ID NO: 567789 - RNA, 18 nt, Human
ucacgaggucaggagauc

SEQ ID NO: 567790 - RNA, 24 nt, Human
ucacgaggucaggagaucgagacc

SEQ ID NO: 567791 - RNA, 20 nt, Human
uccgcgcgccgccgcgcccg

SEQ ID NO: 567792 - RNA, 23 nt, Human
ucgcgccacugcacgccagccug

SEQ ID NO: 567793 - RNA, 20 nt, Human
ucggccuaaacaguaauaaa

SEQ ID NO: 567794 - RNA, 22 nt, Human
ucucuacuaaaaauacaaaaaa

SEQ ID NO: 567795 - RNA, 23 nt, Human
ucugccucaaaaaaaaaaaaaaa

SEQ ID NO: 567796 - RNA, 22 nt, Human
ugagccgagaucgcgccacugc

SEQ ID NO: 567797 - RNA, 23 nt, Human
ugaggcaggagaauggcgugaac

SEQ ID NO: 567798 - RNA, 24 nt, Human
ugaggcaggagaauggcgugaacc

SEQ ID NO: 567799 - RNA, 25 nt, Human
ugaggcaggagaauggcgugaaccc

SEQ ID NO: 567800 - RNA, 25 nt, Human
ugcacgccagccugggcgacagaac

SEQ ID NO: 567801 - RNA, 24 nt, Human
uggcucacgccuguaaucccagca

SEQ ID NO: 567802 - RNA, 19 nt, Human
ugggaggccgagaugggcg

SEQ ID NO: 567803 - RNA, 24 nt, Human
ugggaggccgagaugggcggauca

SEQ ID NO: 567804 - RNA, 24 nt, Human
ugguggcgggcgccuguaguccca

SEQ ID NO: 567805 - RNA, 23 nt, Human
uuaagcagcaauagcaccuuccc

SEQ ID NO: 567806 - RNA, 21 nt, Human
uuaauauuaacauacauacaa

SEQ ID NO: 567807 - RNA, 20 nt, Human
uucuccgcgcgccgccgcgc

SEQ ID NO: 567808 - RNA, 18 nt, Human
uugcagugagccgagauc

SEQ ID NO: 567809 - RNA, 19 nt, Human
uugcagugagccgagaucg

SEQ ID NO: 567810 - RNA, 22 nt, Human
uugcagugagccgagaucgcgc

SEQ ID NO: 567811 - RNA, 22 nt, Human
aaaaguccaaaauuauauagaa

SEQ ID NO: 567812 - RNA, 23 nt, Human
aacaaggggagccuccgccacca

SEQ ID NO: 567813 - RNA, 23 nt, Human
aacuaaauguuuuaacucucaaa

SEQ ID NO: 567814 - RNA, 21 nt, Human
aacuccagaggcaaaaaaaaa

SEQ ID NO: 567815 - RNA, 19 nt, Human
accccggagcccgcagccc

SEQ ID NO: 567816 - RNA, 21 nt, Human
acuccagaggcaaaaaaaaaa

SEQ ID NO: 567817 - RNA, 18 nt, Human
acugcuaucuccgcgcgc

SEQ ID NO: 567818 - RNA, 21 nt, Human
aggcgccaccuccgggucgcc

SEQ ID NO: 567819 - RNA, 24 nt, Human
aguccugcucccccggcuugggga

SEQ ID NO: 567820 - RNA, 24 nt, Human
aucacaaaacuuaucuccauaagg

SEQ ID NO: 567821 - RNA, 23 nt, Human
caaauagaaaacauacacaucua

SEQ ID NO: 567822 - RNA, 22 nt, Human
cacgcagguaucguggccuccg

SEQ ID NO: 567823 - RNA, 19 nt, Human
cagaggcaaaaaaaaaaaa

SEQ ID NO: 567824 - RNA, 22 nt, Human
caggcuccgggaggacaaacaa

SEQ ID NO: 567825 - RNA, 21 nt, Human
caggugaguuuucuccuccuu

SEQ ID NO: 567826 - RNA, 23 nt, Human
ccacacugcuaucuccgcgcgca

SEQ ID NO: 567827 - RNA, 22 nt, Human
ccagaggcaaaaaaaaaaaaaa

SEQ ID NO: 567828 - RNA, 18 nt, Human
ccccggagcccgcagccc

SEQ ID NO: 567829 - RNA, 21 nt, Human
ccccggagcccgcagccccag

SEQ ID NO: 567830 - RNA, 18 nt, Human
ccccucgcgagcggaagc

SEQ ID NO: 567831 - RNA, 24 nt, Human
ccccucgcgagcggaagcgcaggc

SEQ ID NO: 567832 - RNA, 21 nt, Human
ccgcgcgcacucucucuuccc

SEQ ID NO: 567833 - RNA, 22 nt, Human
ccgcgugccugcucaaguccuu

SEQ ID NO: 567834 - RNA, 27 nt, Human
cgcagaagaaccccacgccaggcuccg

SEQ ID NO: 567835 - RNA, 18 nt, Human
cgcgagcggaagcgcagg

SEQ ID NO: 567836 - RNA, 22 nt, Human
cgcgcacucucucuucccgcag

SEQ ID NO: 567837 - RNA, 22 nt, Human
cgcuggccgcccgugcccuccg

SEQ ID NO: 567838 - RNA, 21 nt, Human
cuucccgcagaagaaccccac

SEQ ID NO: 567839 - RNA, 19 nt, Human
gacacgcuccucuccagcu

SEQ ID NO: 567840 - RNA, 22 nt, Human
gacuccucgcguguuuccacac

SEQ ID NO: 567841 - RNA, 18 nt, Human
gaguuuucuccuccagga

SEQ ID NO: 567842 - RNA, 18 nt, Human
gccgcccgugcccuccga

SEQ ID NO: 567843 - RNA, 21 nt, Human
gggaggacaaacaaggggagc

SEQ ID NO: 567844 - RNA, 24 nt, Human
uagaaaacauacacaucuauuaca

SEQ ID NO: 567845 - RNA, 23 nt, Human
uaucuccaauuucccccaugaga

SEQ ID NO: 567846 - RNA, 24 nt, Human
uaucuccaauuucccccaugagaa

SEQ ID NO: 567847 - RNA, 19 nt, Human
uccagaggcaaaaaaaaaa

SEQ ID NO: 567848 - RNA, 19 nt, Human
uccagaggcaaaaaaaaaa

SEQ ID NO: 567849 - RNA, 23 nt, Human
uccagaggcaaaaaaaaaaaaaa

SEQ ID NO: 567850 - RNA, 26 nt, Human
uccagaggcaaaaaaaaaaaaaauua

SEQ ID NO: 567851 - RNA, 23 nt, Human
uccgcgcgcacucucucuucccg

SEQ ID NO: 567852 - RNA, 25 nt, Human
uccgcgcgcacucucucuucccgca

SEQ ID NO: 567853 - RNA, 23 nt, Human
ucucaaauguuuuaacucucaaa

SEQ ID NO: 567854 - RNA, 24 nt, Human
ucuccaauuucccccaugagaauc

SEQ ID NO: 567855 - RNA, 18 nt, Human
ugaccccggagcccgcag

SEQ ID NO: 567856 - RNA, 18 nt, Human
ugcggccggcggaggcgc

SEQ ID NO: 567857 - RNA, 21 nt, Human
uuaagacaacaguuaacagaa

SEQ ID NO: 567858 - RNA, 25 nt, Human
uuuaaacuccagaggcaaaaaaaaa

SEQ ID NO: 567859 - RNA, 19 nt, Human
aaaaccaagcuacaggucc

SEQ ID NO: 567860 - RNA, 22 nt, Human
aaacaugcagagggcuuggagu

SEQ ID NO: 567861 - RNA, 22 nt, Human
aacucaucagagaaugucccag

SEQ ID NO: 567862 - RNA, 23 nt, Human
acaacaaaaaggcgguagucagg

SEQ ID NO: 567863 - RNA, 24 nt, Human
acacagaaaauuauuuucuuuaau

SEQ ID NO: 567864 - RNA, 18 nt, Human
acauagcucucuuucaca

SEQ ID NO: 567865 - RNA, 25 nt, Human
accaggaagcuuaagggguggccca

SEQ ID NO: 567866 - RNA, 18 nt, Human
agacaaugacugaagcuc

SEQ ID NO: 567867 - RNA, 18 nt, Human
agccaggucgcggugagg

SEQ ID NO: 567868 - RNA, 21 nt, Human
agucagguacugaaugcccuc

SEQ ID NO: 567869 - RNA, 19 nt, Human
cacucaauaaagaaguaca

SEQ ID NO: 567870 - RNA, 22 nt, Human
cagccgagggccagcccgcgcc

SEQ ID NO: 567871 - RNA, 18 nt, Human
cagguacugaaugcccuc

SEQ ID NO: 567872 - RNA, 19 nt, Human
cagguacugaaugcccucc

SEQ ID NO: 567873 - RNA, 18 nt, Human
caggugggugaucuucuc

SEQ ID NO: 567874 - RNA, 19 nt, Human
cccuccagacuaaccaagg

SEQ ID NO: 567875 - RNA, 21 nt, Human
cccuccagacuaaccaaggag

SEQ ID NO: 567876 - RNA, 26 nt, Human
ccuccucgcucagcaccagccgaggg

SEQ ID NO: 567877 - RNA, 21 nt, Human
ccucgcucagcaccagccgag

SEQ ID NO: 567878 - RNA, 20 nt, Human
cgcccgaaccgccuccucgc

SEQ ID NO: 567879 - RNA, 22 nt, Human
cgggguucagccggaaguccac

SEQ ID NO: 567880 - RNA, 19 nt, Human
cucgguuaaggcguggagc

SEQ ID NO: 567881 - RNA, 18 nt, Human
cugaagcucagccagguc

SEQ ID NO: 567882 - RNA, 18 nt, Human
cuucaccacgggguucag

SEQ ID NO: 567883 - RNA, 22 nt, Human
gaaugcccuccagacuaaccaa

SEQ ID NO: 567884 - RNA, 20 nt, Human
gacugaagcucagccagguc

SEQ ID NO: 567885 - RNA, 19 nt, Human
gcccgaaccgccuccucgc

SEQ ID NO: 567886 - RNA, 21 nt, Human
gccuccucgcucagcaccagc

SEQ ID NO: 567887 - RNA, 21 nt, Human
gguggcccagcuucucggcag

SEQ ID NO: 567888 - RNA, 26 nt, Human
guacugaaugcccuccagacuaacca

SEQ ID NO: 567889 - RNA, 25 nt, Human
uaguagagauugagacucuccaaug

SEQ ID NO: 567890 - RNA, 21 nt, Human
ucaaccuucaccacgggguuc

SEQ ID NO: 567891 - RNA, 21 nt, Human
ucagccggaaguccacaucca

SEQ ID NO: 567892 - RNA, 20 nt, Human
ucaggcucaaccuucaccac

SEQ ID NO: 567893 - RNA, 21 nt, Human
ucaucagagaaugucccaggu

SEQ ID NO: 567894 - RNA, 22 nt, Human
uccaaaaauccuaaauaauuac

SEQ ID NO: 567895 - RNA, 21 nt, Human
uccacgagcucgguuaaggcg

SEQ ID NO: 567896 - RNA, 18 nt, Human
uccugaauacauuccaaa

SEQ ID NO: 567897 - RNA, 21 nt, Human
ucggugcacuuggcucugggg

SEQ ID NO: 567898 - RNA, 23 nt, Human
ugaaugcccuccagacuaaccaa

SEQ ID NO: 567899 - RNA, 21 nt, Human
ugcagucagguacugaaugcc

SEQ ID NO: 567900 - RNA, 22 nt, Human
ugcuggagcuuggggagcaggu

SEQ ID NO: 567901 - RNA, 20 nt, Human
uggccaaggccucggugcac

SEQ ID NO: 567902 - RNA, 19 nt, Human
uggcccagcuucucggcag

SEQ ID NO: 567903 - RNA, 22 nt, Human
ugguguggucugcccucuuucc

SEQ ID NO: 567904 - RNA, 19 nt, Human
uguaguagagauugagacu

SEQ ID NO: 567905 - RNA, 19 nt, Human
uuaaacucaucagagaaug

SEQ ID NO: 567906 - RNA, 24 nt, Human
uuccaaaaauccuaaauaauuacc

SEQ ID NO: 567907 - RNA, 24 nt, Human
uuccaggaauagacaaugacugaa

SEQ ID NO: 567908 - RNA, 19 nt, Human
uuguaguagagauugagac

SEQ ID NO: 567909 - RNA, 25 nt, Human
uuuaauuaucauacauagcucucuu

SEQ ID NO: 567910 - RNA, 21 nt, Human
uuuagaaaaccaagcuacagg

SEQ ID NO: 567911 - RNA, 21 nt, Human
aagcaaccaaggaguuagaac

SEQ ID NO: 567912 - RNA, 24 nt, Human
aagcaaccaaggaguuagaacuca

SEQ ID NO: 567913 - RNA, 19 nt, Human
acaaacaugucguacagcc

SEQ ID NO: 567914 - RNA, 19 nt, Human
aggaacucgcagucccccu

SEQ ID NO: 567915 - RNA, 18 nt, Human
aggucuugcggcaccaac

SEQ ID NO: 567916 - RNA, 23 nt, Human
caacucccgggcucgcugcaccu

SEQ ID NO: 567917 - RNA, 23 nt, Human
caccaccggcuggucuuccucag

SEQ ID NO: 567918 - RNA, 23 nt, Human
cagacaugacccgagcgcucucc

SEQ ID NO: 567919 - RNA, 20 nt, Human
ccccugggcagacaugaccc

SEQ ID NO: 567920 - RNA, 21 nt, Human
ccccugggcagacaugacccg

SEQ ID NO: 567921 - RNA, 19 nt, Human
cccgagcgcucuccagccu

SEQ ID NO: 567922 - RNA, 19 nt, Human
cccgagcugugucuggugg

SEQ ID NO: 567923 - RNA, 22 nt, Human
cccggcgguggcgguccgcucu

SEQ ID NO: 567924 - RNA, 22 nt, Human
ccgccagcccgaagcggccgga

SEQ ID NO: 567925 - RNA, 23 nt, Human
ccuacaauuacacaggcccgagc

SEQ ID NO: 567926 - RNA, 20 nt, Human
ccucccggcgguggcggucc

SEQ ID NO: 567927 - RNA, 25 nt, Human
cuccagccgccagcccgaagcggcc

SEQ ID NO: 567928 - RNA, 22 nt, Human
cucgcagucccccugggcagac

SEQ ID NO: 567929 - RNA, 26 nt, Human
cugauguaauaaugcugauuucucuc

SEQ ID NO: 567930 - RNA, 23 nt, Human
cugcgggccgugaucagccacgc

SEQ ID NO: 567931 - RNA, 24 nt, Human
gccauggcaaucacugcugagugu

SEQ ID NO: 567932 - RNA, 26 nt, Human
gcucugugccauggcaaucacugcug

SEQ ID NO: 567933 - RNA, 24 nt, Human
gcugagugucuucuccuacaauua

SEQ ID NO: 567934 - RNA, 19 nt, Human
ggaacucgcagucccccug

SEQ ID NO: 567935 - RNA, 25 nt, Human
gucugccggguagaggcugcgggcc

SEQ ID NO: 567936 - RNA, 26 nt, Human
uaaacuucuuaaaaauuggguuuguu

SEQ ID NO: 567937 - RNA, 23 nt, Human
uagaacucagaugguuuucuucu

SEQ ID NO: 567938 - RNA, 19 nt, Human
ucccccugggcagacauga

SEQ ID NO: 567939 - RNA, 20 nt, Human
uccuacaauuacacaggccc

SEQ ID NO: 567940 - RNA, 22 nt, Human
ucuccagccgccagcccgaagc

SEQ ID NO: 567941 - RNA, 18 nt, Human
uguaacagcaacaaugac

SEQ ID NO: 567942 - RNA, 23 nt, Human
ugucguacagcagccucccggcg

SEQ ID NO: 567943 - RNA, 21 nt, Human
uuacacaggcccgagcugugu

SEQ ID NO: 567944 - RNA, 23 nt, Human
uuagaacucagaugguuuucuuc

SEQ ID NO: 567945 - RNA, 20 nt, Human
uuuaggaugauuuuuauuua

SEQ ID NO: 567946 - RNA, 18 nt, Human
uaaauaacagccugggua

SEQ ID NO: 567947 - RNA, 20 nt, Human
uaaauaacagccuggguauc

SEQ ID NO: 567948 - RNA, 21 nt, Human
ugggguaauaaucaguucaug

SEQ ID NO: 567949 - RNA, 21 nt, Human
uucacgaaacggguguaacag

SEQ ID NO: 567950 - RNA, 21 nt, Human
aagugggggcaauaugaagug

SEQ ID NO: 567951 - RNA, 18 nt, Human
agcggguacuaaugcugc

SEQ ID NO: 567952 - RNA, 21 nt, Human
agcggguacuaaugcugcaca

SEQ ID NO: 567953 - RNA, 19 nt, Human
cagcacucgaaacaagaaa

SEQ ID NO: 567954 - RNA, 21 nt, Human
cgacucccgcggcucgggccu

SEQ ID NO: 567955 - RNA, 18 nt, Human
cuaaugcugcacacagac

SEQ ID NO: 567956 - RNA, 22 nt, Human
gauccgucaaaguguuuucccu

SEQ ID NO: 567957 - RNA, 20 nt, Human
gggucagucagcacucgaaa

SEQ ID NO: 567958 - RNA, 21 nt, Human
uccgucaaaguguuuucccuu

SEQ ID NO: 567959 - RNA, 23 nt, Human
ucugacaaaaacgauccgucaaa

SEQ ID NO: 567960 - RNA, 18 nt, Human
ugaggggagaaaagggga

SEQ ID NO: 567961 - RNA, 21 nt, Human
uuaaugaauaauguaaacuug

SEQ ID NO: 567962 - RNA, 21 nt, Human
uucacacgcacaaaaugaaau

SEQ ID NO: 567963 - RNA, 19 nt, Human
uuuaacacagcaagguaga

SEQ ID NO: 567964 - RNA, 21 nt, Human
uuucccuuucacacgcacaaa

SEQ ID NO: 567965 - RNA, 25 nt, Human
uuugaacuacauuuauuuuucaaca

SEQ ID NO: 567966 - RNA, 18 nt, Human
aaaagccuccccgccccc

SEQ ID NO: 567967 - RNA, 23 nt, Human
aaagccuccccgcccccccaccu

SEQ ID NO: 567968 - RNA, 18 nt, Human
aacagaaacggaagccau

SEQ ID NO: 567969 - RNA, 21 nt, Human
aagccuccccgcccccccacc

SEQ ID NO: 567970 - RNA, 21 nt, Human
aauacagguagaauucacaug

SEQ ID NO: 567971 - RNA, 23 nt, Human
acaacagaaacggaagccaugag

SEQ ID NO: 567972 - RNA, 18 nt, Human
acacugcagaccacaaac

SEQ ID NO: 567973 - RNA, 19 nt, Human
acgacacugcagaccacaa

SEQ ID NO: 567974 - RNA, 19 nt, Human
acucaagggagagaacaac

SEQ ID NO: 567975 - RNA, 21 nt, Human
acucaagggagagaacaacag

SEQ ID NO: 567976 - RNA, 19 nt, Human
agucagacccaggagacag

SEQ ID NO: 567977 - RNA, 26 nt, Human
aguuaugugcuuuguuccuauagcuu

SEQ ID NO: 567978 - RNA, 21 nt, Human
auggcagcagccgccgcgggc

SEQ ID NO: 567979 - RNA, 19 nt, Human
caacagaaacggaagccau

SEQ ID NO: 567980 - RNA, 22 nt, Human
caccucagccucacgacacugc

SEQ ID NO: 567981 - RNA, 22 nt, Human
cauaaaccccauaccaccccug

SEQ ID NO: 567982 - RNA, 18 nt, Human
ccaaaagcugccaggaca

SEQ ID NO: 567983 - RNA, 23 nt, Human
ccacucagacccuuacccggccg

SEQ ID NO: 567984 - RNA, 20 nt, Human
ccaggagacagauuugugug

SEQ ID NO: 567985 - RNA, 18 nt, Human
cccauaccacugcuguca

SEQ ID NO: 567986 - RNA, 23 nt, Human
cccauaccacugcugucauucca

SEQ ID NO: 567987 - RNA, 27 nt, Human
cccauaccacugcugucauuccaaaag

SEQ ID NO: 567988 - RNA, 22 nt, Human
ccgccgcggcccccgaaggcgc

SEQ ID NO: 567989 - RNA, 24 nt, Human
ccgccgcggcccccgaaggcgcuc

SEQ ID NO: 567990 - RNA, 25 nt, Human
ccgccgcggcccccgaaggcgcucu

SEQ ID NO: 567991 - RNA, 25 nt, Human
ccuauagcuuugaaguucauccacc

SEQ ID NO: 567992 - RNA, 23 nt, Human
ccuccccgcccccccaccuuaaa

SEQ ID NO: 567993 - RNA, 18 nt, Human
cgaaggcgcucuggccug

SEQ ID NO: 567994 - RNA, 21 nt, Human
cgacacugcagaccacaaacc

SEQ ID NO: 567995 - RNA, 22 nt, Human
cgcggcccccgaaggcgcucug

SEQ ID NO: 567996 - RNA, 22 nt, Human
cucaagggagagaacaacagaa

SEQ ID NO: 567997 - RNA, 21 nt, Human
cugcagaccacaaacccggcg

SEQ ID NO: 567998 - RNA, 26 nt, Human
gaaaaaagccuccccgcccccccacc

SEQ ID NO: 567999 - RNA, 24 nt, Human
gagaacaacagaaacggaagccgg

SEQ ID NO: 568000 - RNA, 19 nt, Human
ggcugcaaacuccuggccu

SEQ ID NO: 568001 - RNA, 19 nt, Human
gugguccagcccuggaaua

SEQ ID NO: 568002 - RNA, 23 nt, Human
uauuucaaguuuguaacaaaaua

SEQ ID NO: 568003 - RNA, 21 nt, Human
ucagugaaaaagauuaaagug

SEQ ID NO: 568004 - RNA, 24 nt, Human
ugcuuuguuccuauagcuuugaag

SEQ ID NO: 568005 - RNA, 18 nt, Human
uggaaggucucaggucuu

SEQ ID NO: 568006 - RNA, 23 nt, Human
uggaaguuaucaagugguccagc

SEQ ID NO: 568007 - RNA, 18 nt, Human
uggaauacagguagaauu

SEQ ID NO: 568008 - RNA, 19 nt, Human
uggcagcagccgccgcggg

SEQ ID NO: 568009 - RNA, 24 nt, Human
uggcaggagauccacucagacccu

SEQ ID NO: 568010 - RNA, 20 nt, Human
uggcaucaagucaugaaggc

SEQ ID NO: 568011 - RNA, 24 nt, Human
uggguagcagucagacccaggaga

SEQ ID NO: 568012 - RNA, 22 nt, Human
ugguccagcccuggaauacagg

SEQ ID NO: 568013 - RNA, 24 nt, Human
uuauagcaucauaaaccccauacc

SEQ ID NO: 568014 - RNA, 19 nt, Human
uuccgccgcggcccccgaa

SEQ ID NO: 568015 - RNA, 21 nt, Human
aaaaacacacagagccacgug

SEQ ID NO: 568016 - RNA, 20 nt, Human
aagagaaaaaagaaccucaa

SEQ ID NO: 568017 - RNA, 23 nt, Human
acaauuuuuaaaaacacacagag

SEQ ID NO: 568018 - RNA, 19 nt, Human
acuccgccagccucccacc

SEQ ID NO: 568019 - RNA, 25 nt, Human
agaaaaaagaaccucaaaaucagug

SEQ ID NO: 568020 - RNA, 23 nt, Human
agcugguggagcaggcgccuccc

SEQ ID NO: 568021 - RNA, 18 nt, Human
agugacgcgacaggaaga

SEQ ID NO: 568022 - RNA, 19 nt, Human
aucacaccuuccuccugaa

SEQ ID NO: 568023 - RNA, 18 nt, Human
cacacagagccacguggg

SEQ ID NO: 568024 - RNA, 22 nt, Human
caccaagagaaaaaagaaccuc

SEQ ID NO: 568025 - RNA, 23 nt, Human
caccaagagaaaaaagaaccuca

SEQ ID NO: 568026 - RNA, 18 nt, Human
cagcugguggagcaggcg

SEQ ID NO: 568027 - RNA, 18 nt, Human
ccagcugguggagcaggc

SEQ ID NO: 568028 - RNA, 19 nt, Human
ccagcugguggagcaggcg

SEQ ID NO: 568029 - RNA, 19 nt, Human
cgacaggaagaauucggac

SEQ ID NO: 568030 - RNA, 19 nt, Human
cggcccguggcgcccuucg

SEQ ID NO: 568031 - RNA, 23 nt, Human
cugggcacaaagugcuucuuggu

SEQ ID NO: 568032 - RNA, 20 nt, Human
cuggugcuuggcgauuacaa

SEQ ID NO: 568033 - RNA, 22 nt, Human
cugguggagcaggcgccucccu

SEQ ID NO: 568034 - RNA, 19 nt, Human
gagaaaaaagaaccucaaa

SEQ ID NO: 568035 - RNA, 21 nt, Human
ggacugggcuguacggugcgc

SEQ ID NO: 568036 - RNA, 19 nt, Human
guggacugggcuguacggu

SEQ ID NO: 568037 - RNA, 21 nt, Human
gugggucaccuauugucacca

SEQ ID NO: 568038 - RNA, 22 nt, Human
ucacaccuuccuccugaacgug

SEQ ID NO: 568039 - RNA, 23 nt, Human
ucaccaagagaaaaaagaaccuc

SEQ ID NO: 568040 - RNA, 18 nt, Human
ucccugagacccgggcug

SEQ ID NO: 568041 - RNA, 21 nt, Human
ugacggcaucacaccuuccuc

SEQ ID NO: 568042 - RNA, 22 nt, Human
ugcuucaggaacuuucugggca

SEQ ID NO: 568043 - RNA, 21 nt, Human
uggagcaggcgccucccugcc

SEQ ID NO: 568044 - RNA, 21 nt, Human
ugucaccaagagaaaaaagaa

SEQ ID NO: 568045 - RNA, 25 nt, Human
uuacaaacacccaccagcuggugga

SEQ ID NO: 568046 - RNA, 24 nt, Human
uugucaccaagagaaaaaagaacc

SEQ ID NO: 568047 - RNA, 18 nt, Human
uuuuuuuuuuuuuuucug

SEQ ID NO: 568048 - RNA, 20 nt, Human
uuuuuuuuuuuuuuucugcu

SEQ ID NO: 568049 - RNA, 23 nt, Human
aaacguugaggcugcagugagcc

SEQ ID NO: 568050 - RNA, 23 nt, Human
aaaucucagaagugcaaugaacc

SEQ ID NO: 568051 - RNA, 22 nt, Human
aacaacaaacaauaauaacaau

SEQ ID NO: 568052 - RNA, 20 nt, Human
aacaauaacaaagaaauaac

SEQ ID NO: 568053 - RNA, 21 nt, Human
aagcagauaaauaaaugagca

SEQ ID NO: 568054 - RNA, 20 nt, Human
acaaaaauaaaaaaacguuu

SEQ ID NO: 568055 - RNA, 24 nt, Human
acagagcaagacccugccucaaaa

SEQ ID NO: 568056 - RNA, 21 nt, Human
agguugggacaggaggaauag

SEQ ID NO: 568057 - RNA, 19 nt, Human
agugcaggugugcgauggg

SEQ ID NO: 568058 - RNA, 21 nt, Human
caaugaaccucuaagaaguuu

SEQ ID NO: 568059 - RNA, 27 nt, Human
cacaacaauaacaaagaaauaacaaca

SEQ ID NO: 568060 - RNA, 23 nt, Human
cacaccgccauuugagggaacac

SEQ ID NO: 568061 - RNA, 22 nt, Human
cacuguagccuugaucucccag

SEQ ID NO: 568062 - RNA, 23 nt, Human
caggcgaacucucuucacaccgc

SEQ ID NO: 568063 - RNA, 26 nt, Human
ccagagcauacauuuaaaauguacag

SEQ ID NO: 568064 - RNA, 28 nt, Human
ccucaaaauaaauaaacaguaaacacaa

SEQ ID NO: 568065 - RNA, 22 nt, Human
ccucucucucucucucucuccc

SEQ ID NO: 568066 - RNA, 18 nt, Human
ccuugaucucccaggcca

SEQ ID NO: 568067 - RNA, 24 nt, Human
cgaaggggggucagggcugcagug

SEQ ID NO: 568068 - RNA, 22 nt, Human
cgacaacuccaaguuguaaaca

SEQ ID NO: 568069 - RNA, 18 nt, Human
cucccugaaaggaucucc

SEQ ID NO: 568070 - RNA, 23 nt, Human
cucucucccugaaaggaucucca

SEQ ID NO: 568071 - RNA, 19 nt, Human
cugcagugagccugggaga

SEQ ID NO: 568072 - RNA, 20 nt, Human
cuguugcaccaggacuggag

SEQ ID NO: 568073 - RNA, 22 nt, Human
gaaugcaaccaagcaaaaauaa

SEQ ID NO: 568074 - RNA, 20 nt, Human
gacaggaggaauagcauggg

SEQ ID NO: 568075 - RNA, 19 nt, Human
gaggacacugaggcucagg

SEQ ID NO: 568076 - RNA, 21 nt, Human
gaggaucacuucagcucaaaa

SEQ ID NO: 568077 - RNA, 20 nt, Human
gcacagaauuauaacuaaug

SEQ ID NO: 568078 - RNA, 24 nt, Human
gcucaaaacguugaggcugcagug

SEQ ID NO: 568079 - RNA, 21 nt, Human
gcucacuguagccuugaucuc

SEQ ID NO: 568080 - RNA, 22 nt, Human
gcucacuguagccuugaucucc

SEQ ID NO: 568081 - RNA, 19 nt, Human
ggaagcagaggcgagagga

SEQ ID NO: 568082 - RNA, 21 nt, Human
ggaauagcaugggccgaaggg

SEQ ID NO: 568083 - RNA, 24 nt, Human
ggcugcagugagccugggagacag

SEQ ID NO: 568084 - RNA, 24 nt, Human
ggggggucagggcugcagugggcc

SEQ ID NO: 568085 - RNA, 19 nt, Human
ggucgcggcucacuguagc

SEQ ID NO: 568086 - RNA, 23 nt, Human
uaaacaguaaacacaacaauaac

SEQ ID NO: 568087 - RNA, 24 nt, Human
uaaaugagcagacaacuaagauca

SEQ ID NO: 568088 - RNA, 20 nt, Human
uaacaggugccaucuagugu

SEQ ID NO: 568089 - RNA, 24 nt, Human
uacuauucuggaaauuauauaugu

SEQ ID NO: 568090 - RNA, 24 nt, Human
uauuaagcacaaaaauaaaaaaac

SEQ ID NO: 568091 - RNA, 23 nt, Human
ucacuguagccuugaucucccag

SEQ ID NO: 568092 - RNA, 24 nt, Human
ucacuguagccuugaucucccagg

SEQ ID NO: 568093 - RNA, 23 nt, Human
ucacuucaucggaugccagagcu

SEQ ID NO: 568094 - RNA, 19 nt, Human
uccaagaaugcaaccaagc

SEQ ID NO: 568095 - RNA, 24 nt, Human
ucccaggccaggaccucccagguu

SEQ ID NO: 568096 - RNA, 18 nt, Human
ucucaaguaaaauggaag

SEQ ID NO: 568097 - RNA, 21 nt, Human
ucucaaguaaaauggaagacu

SEQ ID NO: 568098 - RNA, 21 nt, Human
ucucccaggccaggaccuccc

SEQ ID NO: 568099 - RNA, 18 nt, Human
ucugucuucuccucucuc

SEQ ID NO: 568100 - RNA, 20 nt, Human
ucugucuucuccucucucuc

SEQ ID NO: 568101 - RNA, 22 nt, Human
ucugucuucuccucucucucuc

SEQ ID NO: 568102 - RNA, 21 nt, Human
ucuuuauuuggcaaaugagga

SEQ ID NO: 568103 - RNA, 20 nt, Human
ugaaaggaucuccaucuguu

SEQ ID NO: 568104 - RNA, 19 nt, Human
ugaggacacugaggcucag

SEQ ID NO: 568105 - RNA, 18 nt, Human
ugaggcugcagugagccu

SEQ ID NO: 568106 - RNA, 18 nt, Human
ugaggcugcagugagccu

SEQ ID NO: 568107 - RNA, 22 nt, Human
ugaguuacuauucuggaaauua

SEQ ID NO: 568108 - RNA, 19 nt, Human
ugcaggugugcgauggguc

SEQ ID NO: 568109 - RNA, 19 nt, Human
ugcucacaauucaaacuuu

SEQ ID NO: 568110 - RNA, 25 nt, Human
ugggacaggaggaauagcaugggcc

SEQ ID NO: 568111 - RNA, 19 nt, Human
ugggucgcggcucacugua

SEQ ID NO: 568112 - RNA, 19 nt, Human
uguagccuugaucucccag

SEQ ID NO: 568113 - RNA, 20 nt, Human
uguccaagaaugcaaccaag

SEQ ID NO: 568114 - RNA, 22 nt, Human
uguccaagaaugcaaccaagca

SEQ ID NO: 568115 - RNA, 24 nt, Human
uguuuguuuaaagcauagaaguac

SEQ ID NO: 568116 - RNA, 25 nt, Human
uuaguagaaacacuaauuguaugaa

SEQ ID NO: 568117 - RNA, 26 nt, Human
uucuucagugaaaccugggaucuggc

SEQ ID NO: 568118 - RNA, 23 nt, Human
uuggcaaaugaggacacugaggc

SEQ ID NO: 568119 - RNA, 24 nt, Human
uugggacaggaggaauagcauggg

SEQ ID NO: 568120 - RNA, 20 nt, Human
uuugaacuacaauuuaaaac

SEQ ID NO: 568121 - RNA, 18 nt, Human
aaacacauaccaaaaaca

SEQ ID NO: 568122 - RNA, 23 nt, Human
aaacacauaccaaaaacacagcc

SEQ ID NO: 568123 - RNA, 23 nt, Human
acaauauaaugaaaaaguagaac

SEQ ID NO: 568124 - RNA, 22 nt, Human
acacagccacaaauaccaaaaa

SEQ ID NO: 568125 - RNA, 20 nt, Human
acauaccaaaaacacagcca

SEQ ID NO: 568126 - RNA, 23 nt, Human
accaaaaacaaaaaccagcucag

SEQ ID NO: 568127 - RNA, 18 nt, Human
accaaaaacacagccaca

SEQ ID NO: 568128 - RNA, 22 nt, Human
agaacaaccaaucuuuauuaga

SEQ ID NO: 568129 - RNA, 24 nt, Human
agccacaaauaccaaaaacaaaaa

SEQ ID NO: 568130 - RNA, 19 nt, Human
auacugaacuccuguaacc

SEQ ID NO: 568131 - RNA, 23 nt, Human
caaaaacaaaaaccagcucaagu

SEQ ID NO: 568132 - RNA, 19 nt, Human
caaaaacacagccacaaau

SEQ ID NO: 568133 - RNA, 23 nt, Human
caaaaacacagccacaaauacca

SEQ ID NO: 568134 - RNA, 26 nt, Human
caaaaacacagccacaaauaccaaaa

SEQ ID NO: 568135 - RNA, 30 nt, Human
caaaaacacagccacaaauaccaaaaacag

SEQ ID NO: 568136 - RNA, 22 nt, Human
caacaauauaaugaaaaaguag

SEQ ID NO: 568137 - RNA, 24 nt, Human
cacagccacaaauaccaaaaacaa

SEQ ID NO: 568138 - RNA, 20 nt, Human
cacauaccaaaaacacagcc

SEQ ID NO: 568139 - RNA, 21 nt, Human
cacauaccaaaaacacagcca

SEQ ID NO: 568140 - RNA, 20 nt, Human
cagccacaaauaccaaaaac

SEQ ID NO: 568141 - RNA, 23 nt, Human
ccaaaaacaaaaaccagcucaag

SEQ ID NO: 568142 - RNA, 22 nt, Human
ccaaaacacauuuuggauuugg

SEQ ID NO: 568143 - RNA, 20 nt, Human
gaaaacacaguaaacacaua

SEQ ID NO: 568144 - RNA, 22 nt, Human
uaaacacauaccaaaaacacag

SEQ ID NO: 568145 - RNA, 24 nt, Human
uacaauaaauaucaacaauauaau

SEQ ID NO: 568146 - RNA, 19 nt, Human
uaccaaaaacaaaaaccag

SEQ ID NO: 568147 - RNA, 21 nt, Human
uaccaaaaacacagccacaaa

SEQ ID NO: 568148 - RNA, 30 nt, Human
uaccaaaaacacagccacaaauaccaaaaa

SEQ ID NO: 568149 - RNA, 23 nt, Human
uaguuuccaaauacugaacuccu

SEQ ID NO: 568150 - RNA, 24 nt, Human
uaguuuccaaauacugaacuccuu

SEQ ID NO: 568151 - RNA, 21 nt, Human
ugggaaaacacaguaaacaca

SEQ ID NO: 568152 - RNA, 27 nt, Human
aaagaagaaaaucauacaaccaaaggg

SEQ ID NO: 568153 - RNA, 18 nt, Human
aaauauccuggcuccugg

SEQ ID NO: 568154 - RNA, 25 nt, Human
aagaacaggggcaggagcagaagga

SEQ ID NO: 568155 - RNA, 20 nt, Human
aagagccccaugagcuaaga

SEQ ID NO: 568156 - RNA, 23 nt, Human
aaggagcuuaguaaugggagggg

SEQ ID NO: 568157 - RNA, 23 nt, Human
aauguguguguguguacgcaugu

SEQ ID NO: 568158 - RNA, 18 nt, Human
acccugggaacagagcug

SEQ ID NO: 568159 - RNA, 24 nt, Human
accucccugccccacccugggaac

SEQ ID NO: 568160 - RNA, 23 nt, Human
acgccaggaucaaaccgccuggc

SEQ ID NO: 568161 - RNA, 18 nt, Human
acuacucccccaaccccc

SEQ ID NO: 568162 - RNA, 19 nt, Human
acugucacagaggcugggg

SEQ ID NO: 568163 - RNA, 18 nt, Human
agaaauauacaccacuga

SEQ ID NO: 568164 - RNA, 21 nt, Human
agccagccuccuccugacccc

SEQ ID NO: 568165 - RNA, 24 nt, Human
agcucgguucccauuuccugccuc

SEQ ID NO: 568166 - RNA, 21 nt, Human
agcuguggcagccgcagcccu

SEQ ID NO: 568167 - RNA, 18 nt, Human
aggcuggguccagcugug

SEQ ID NO: 568168 - RNA, 21 nt, Human
agggcccacgggagggucggg

SEQ ID NO: 568169 - RNA, 23 nt, Human
aggggcaggagcagaaggagcuu

SEQ ID NO: 568170 - RNA, 19 nt, Human
agguggaugggccgagcuc

SEQ ID NO: 568171 - RNA, 19 nt, Human
auccaugucaaauguaguu

SEQ ID NO: 568172 - RNA, 19 nt, Human
auccuggcuccuggcucug

SEQ ID NO: 568173 - RNA, 22 nt, Human
auccuggcuccuggcucuguuc

SEQ ID NO: 568174 - RNA, 25 nt, Human
caacauuguaaacauacacggucua

SEQ ID NO: 568175 - RNA, 18 nt, Human
caacccccaccucccugc

SEQ ID NO: 568176 - RNA, 21 nt, Human
caacccccaccucccugcccc

SEQ ID NO: 568177 - RNA, 19 nt, Human
cacagcaucacaccacagg

SEQ ID NO: 568178 - RNA, 22 nt, Human
cacagcaucacaccacagggcc

SEQ ID NO: 568179 - RNA, 20 nt, Human
caccacagggcccacgggag

SEQ ID NO: 568180 - RNA, 18 nt, Human
caccucccugccccaccc

SEQ ID NO: 568181 - RNA, 20 nt, Human
caccucccugccccacccuu

SEQ ID NO: 568182 - RNA, 19 nt, Human
cacugaacaccgagcacau

SEQ ID NO: 568183 - RNA, 19 nt, Human
cagaaggagcuuaguaaug

SEQ ID NO: 568184 - RNA, 21 nt, Human
caggaucaaaccgccuggcca

SEQ ID NO: 568185 - RNA, 19 nt, Human
caggggcaggagcagaagg

SEQ ID NO: 568186 - RNA, 22 nt, Human
caguaugggggcuggaucuuag

SEQ ID NO: 568187 - RNA, 18 nt, Human
ccagucugugugaugcag

SEQ ID NO: 568188 - RNA, 20 nt, Human
cccaaaccauaggugggagc

SEQ ID NO: 568189 - RNA, 23 nt, Human
cccacuacucccccaacccccac

SEQ ID NO: 568190 - RNA, 19 nt, Human
ccccaacccccaccucccu

SEQ ID NO: 568191 - RNA, 18 nt, Human
cccccaacccccaccucc

SEQ ID NO: 568192 - RNA, 20 nt, Human
cccccaacccccaccucccu

SEQ ID NO: 568193 - RNA, 22 nt, Human
cccccaacccccaccucccugc

SEQ ID NO: 568194 - RNA, 20 nt, Human
cccccuaacucagccucugc

SEQ ID NO: 568195 - RNA, 22 nt, Human
cccugccccacccugggaacag

SEQ ID NO: 568196 - RNA, 18 nt, Human
ccgcaggucuccgggcgc

SEQ ID NO: 568197 - RNA, 26 nt, Human
ccgugccccacuacucccccaacccc

SEQ ID NO: 568198 - RNA, 23 nt, Human
ccuaacucagccucugcuucagc

SEQ ID NO: 568199 - RNA, 22 nt, Human
ccucccugccccacccugggaa

SEQ ID NO: 568200 - RNA, 18 nt, Human
ccugcagccaugucucuc

SEQ ID NO: 568201 - RNA, 22 nt, Human
ccugcaguuggggaggagaggc

SEQ ID NO: 568202 - RNA, 23 nt, Human
ccugcggguaaauauccuggcuc

SEQ ID NO: 568203 - RNA, 18 nt, Human
ccugucagcccaggcugg

SEQ ID NO: 568204 - RNA, 21 nt, Human
ccuuugaucaggacacagagc

SEQ ID NO: 568205 - RNA, 21 nt, Human
cggggaagggagaaugcagug

SEQ ID NO: 568206 - RNA, 24 nt, Human
cuaaucccaggaaugguucucagc

SEQ ID NO: 568207 - RNA, 20 nt, Human
cuacucccccaacccccacc

SEQ ID NO: 568208 - RNA, 19 nt, Human
cucauggagggggagaagu

SEQ ID NO: 568209 - RNA, 20 nt, Human
cucccccaacccccaccucc

SEQ ID NO: 568210 - RNA, 22 nt, Human
cucgguucccauuuccugccuc

SEQ ID NO: 568211 - RNA, 18 nt, Human
cugagaccuugguccugu

SEQ ID NO: 568212 - RNA, 19 nt, Human
cuuauaaagagccccauga

SEQ ID NO: 568213 - RNA, 20 nt, Human
gaaaggcagcucuaauccca

SEQ ID NO: 568214 - RNA, 20 nt, Human
gagaggcagcgagccugggg

SEQ ID NO: 568215 - RNA, 19 nt, Human
gagcaggcaggcacgcucc

SEQ ID NO: 568216 - RNA, 18 nt, Human
gagcucccagccaacccu

SEQ ID NO: 568217 - RNA, 22 nt, Human
gaggcuggguggccaggagcac

SEQ ID NO: 568218 - RNA, 19 nt, Human
gccucuaccccccaacucc

SEQ ID NO: 568219 - RNA, 18 nt, Human
gcugcuggaggcgaggcc

SEQ ID NO: 568220 - RNA, 19 nt, Human
ggaccggggcggggaaggg

SEQ ID NO: 568221 - RNA, 19 nt, Human
ggagaggaucaugucccuu

SEQ ID NO: 568222 - RNA, 22 nt, Human
ggagcacuguccucuagccccc

SEQ ID NO: 568223 - RNA, 18 nt, Human
ggagggcucuggucuaca

SEQ ID NO: 568224 - RNA, 21 nt, Human
ggagggggaggggccaaggcc

SEQ ID NO: 568225 - RNA, 18 nt, Human
ggccgagcucccagccaa

SEQ ID NO: 568226 - RNA, 23 nt, Human
gggaagggagaaugcagugaacu

SEQ ID NO: 568227 - RNA, 20 nt, Human
gggcuggaucuuaggagccg

SEQ ID NO: 568228 - RNA, 24 nt, Human
guauguacauggggaaccugugug

SEQ ID NO: 568229 - RNA, 21 nt, Human
guaugugcauguauguacaug

SEQ ID NO: 568230 - RNA, 22 nt, Human
guguguaaaugugugugugugu

SEQ ID NO: 568231 - RNA, 21 nt, Human
uaaauguguguguguguacgc

SEQ ID NO: 568232 - RNA, 20 nt, Human
uaacucagccucugcuucag

SEQ ID NO: 568233 - RNA, 20 nt, Human
uaaggagaggaucauguccc

SEQ ID NO: 568234 - RNA, 23 nt, Human
uaaucccaggaaugguucucagc

SEQ ID NO: 568235 - RNA, 20 nt, Human
uacagccagccuccuccuga

SEQ ID NO: 568236 - RNA, 20 nt, Human
uagauccuccgcaggucucc

SEQ ID NO: 568237 - RNA, 18 nt, Human
uaugugcauguauguaca

SEQ ID NO: 568238 - RNA, 20 nt, Human
uaugugcauguauguacaug

SEQ ID NO: 568239 - RNA, 21 nt, Human
uaugugcauguauguacaugg

SEQ ID NO: 568240 - RNA, 19 nt, Human
ucacagaggcugggggcag

SEQ ID NO: 568241 - RNA, 18 nt, Human
ucagucgggucugccggu

SEQ ID NO: 568242 - RNA, 20 nt, Human
ucccccaacccccaccuccc

SEQ ID NO: 568243 - RNA, 21 nt, Human
ucccccaacccccaccucccu

SEQ ID NO: 568244 - RNA, 25 nt, Human
ucccccaacccccaccucccugccc

SEQ ID NO: 568245 - RNA, 21 nt, Human
ucccuuggggcgugugcccca

SEQ ID NO: 568246 - RNA, 24 nt, Human
uccgagccuuuuauuacugucucc

SEQ ID NO: 568247 - RNA, 19 nt, Human
uccugucagcccaggcugg

SEQ ID NO: 568248 - RNA, 19 nt, Human
ucugucaguaugggggcug

SEQ ID NO: 568249 - RNA, 21 nt, Human
ucuuaggagccgugccccacu

SEQ ID NO: 568250 - RNA, 20 nt, Human
ugagaacaaggcugggucca

SEQ ID NO: 568251 - RNA, 24 nt, Human
ugagaacaaggcuggguccagcug

SEQ ID NO: 568252 - RNA, 19 nt, Human
ugagcgaagaacaggggca

SEQ ID NO: 568253 - RNA, 21 nt, Human
ugagcgaagaacaggggcagg

SEQ ID NO: 568254 - RNA, 18 nt, Human
ugagggcagagcuucuug

SEQ ID NO: 568255 - RNA, 23 nt, Human
ugaguaugugcauguauguacau

SEQ ID NO: 568256 - RNA, 18 nt, Human
ugcagggagaacagggag

SEQ ID NO: 568257 - RNA, 19 nt, Human
ugcagggagaacagggagg

SEQ ID NO: 568258 - RNA, 19 nt, Human
ugcaguuggggaggagagg

SEQ ID NO: 568259 - RNA, 22 nt, Human
ugccccacuacucccccaaccc

SEQ ID NO: 568260 - RNA, 23 nt, Human
ugccccacuacucccccaacccc

SEQ ID NO: 568261 - RNA, 19 nt, Human
ugccucuaccccccaacuc

SEQ ID NO: 568262 - RNA, 20 nt, Human
ugccugggccacagccucua

SEQ ID NO: 568263 - RNA, 27 nt, Human
ugccugggccacagccucuacucuggc

SEQ ID NO: 568264 - RNA, 21 nt, Human
ugcguguguaaaugugugugu

SEQ ID NO: 568265 - RNA, 24 nt, Human
ugcguguguaaaugugugugugug

SEQ ID NO: 568266 - RNA, 26 nt, Human
ugcguguguaaaugugugugugugua

SEQ ID NO: 568267 - RNA, 20 nt, Human
uggaacagguauggccccca

SEQ ID NO: 568268 - RNA, 23 nt, Human
uggaggcgaggccugccuggggc

SEQ ID NO: 568269 - RNA, 22 nt, Human
uggcuccuggcucuguucuccu

SEQ ID NO: 568270 - RNA, 19 nt, Human
uggggacgcauaggcagcu

SEQ ID NO: 568271 - RNA, 23 nt, Human
uggggaggagaggcagcgagccu

SEQ ID NO: 568272 - RNA, 18 nt, Human
uggggcugcuggaggcga

SEQ ID NO: 568273 - RNA, 23 nt, Human
ugggggcagguggggcugcugga

SEQ ID NO: 568274 - RNA, 24 nt, Human
ugggggcuggaucuuaggagccgu

SEQ ID NO: 568275 - RNA, 21 nt, Human
uguaaacauacacggucuaua

SEQ ID NO: 568276 - RNA, 23 nt, Human
ugucagcccaggcuggggacgca

SEQ ID NO: 568277 - RNA, 21 nt, Human
ugugaugcagugggccuucgg

SEQ ID NO: 568278 - RNA, 22 nt, Human
ugugcugagaccuugguccugu

SEQ ID NO: 568279 - RNA, 19 nt, Human
uguguaaaugugugugugu

SEQ ID NO: 568280 - RNA, 19 nt, Human
uguguaaaugugugugugu

SEQ ID NO: 568281 - RNA, 21 nt, Human
uguguacgcauguuugaguau

SEQ ID NO: 568282 - RNA, 19 nt, Human
ugugugcaaguauguacaa

SEQ ID NO: 568283 - RNA, 28 nt, Human
uguguguacgcauguuugaguaugugca

SEQ ID NO: 568284 - RNA, 19 nt, Human
uguguguguguacgcaugu

SEQ ID NO: 568285 - RNA, 18 nt, Human
uguguguguguguacgca

SEQ ID NO: 568286 - RNA, 18 nt, Human
uucuccuuugcgccaugc

SEQ ID NO: 568287 - RNA, 19 nt, Human
uucuccuuugcgccaugcu

SEQ ID NO: 568288 - RNA, 23 nt, Human
uugcgccaugcuccccacuuccc

SEQ ID NO: 568289 - RNA, 21 nt, Human
uuggggaggagaggcagcgag

SEQ ID NO: 568290 - RNA, 19 nt, Human
aaaagaacacaagucagaa

SEQ ID NO: 568291 - RNA, 19 nt, Human
aaacagcaaucacaacagc

SEQ ID NO: 568292 - RNA, 20 nt, Human
aaaguccucuagaugggccc

SEQ ID NO: 568293 - RNA, 21 nt, Human
aagaacacaagucagaauuua

SEQ ID NO: 568294 - RNA, 21 nt, Human
aagccagauccauuuaggaga

SEQ ID NO: 568295 - RNA, 23 nt, Human
aagggugcacaguggcacagugg

SEQ ID NO: 568296 - RNA, 20 nt, Human
aaguccucuagaugggcccu

SEQ ID NO: 568297 - RNA, 21 nt, Human
acaaacagcaaucacaacagc

SEQ ID NO: 568298 - RNA, 20 nt, Human
acucaagggugcacaguggc

SEQ ID NO: 568299 - RNA, 21 nt, Human
agaggacagguuaaggcugcc

SEQ ID NO: 568300 - RNA, 18 nt, Human
aggucugugggaaagcuu

SEQ ID NO: 568301 - RNA, 24 nt, Human
auggcggcaaggggaccagggcac

SEQ ID NO: 568302 - RNA, 18 nt, Human
caacagcauccacauggc

SEQ ID NO: 568303 - RNA, 24 nt, Human
cacucccgccucuucucuccgaga

SEQ ID NO: 568304 - RNA, 25 nt, Human
cacucccgccucuucucuccgagaa

SEQ ID NO: 568305 - RNA, 21 nt, Human
cagauccauuuaggagauaac

SEQ ID NO: 568306 - RNA, 19 nt, Human
cagccuccaggaaaagcca

SEQ ID NO: 568307 - RNA, 19 nt, Human
caguugcuucccuggcuug

SEQ ID NO: 568308 - RNA, 22 nt, Human
cccccaaaguccucuagauggg

SEQ ID NO: 568309 - RNA, 23 nt, Human
cccucugauaccaucuuccaacc

SEQ ID NO: 568310 - RNA, 22 nt, Human
ccgcagcaggggcaggggcugu

SEQ ID NO: 568311 - RNA, 23 nt, Human
ccuccaggaaaagccagauccau

SEQ ID NO: 568312 - RNA, 30 nt, Human
ccucgccgcgccgcagcaggggcaggggcu

SEQ ID NO: 568313 - RNA, 20 nt, Human
ccucuaggugggccagggag

SEQ ID NO: 568314 - RNA, 24 nt, Human
ccucuaggugggccagggaggucu

SEQ ID NO: 568315 - RNA, 23 nt, Human
ccugacccuggcccggagacaga

SEQ ID NO: 568316 - RNA, 27 nt, Human
ccugacccuggcccggagaccgguucc

SEQ ID NO: 568317 - RNA, 20 nt, Human
ccugcaggacucgcugggag

SEQ ID NO: 568318 - RNA, 20 nt, Human
cgagaucauccuucuggcca

SEQ ID NO: 568319 - RNA, 21 nt, Human
cggagacagacugcccaggca

SEQ ID NO: 568320 - RNA, 23 nt, Human
cggaggccgcgccuggguccggu

SEQ ID NO: 568321 - RNA, 23 nt, Human
cggcgugcugggacacucugggu

SEQ ID NO: 568322 - RNA, 22 nt, Human
cugauggcccccaaaguccucu

SEQ ID NO: 568323 - RNA, 19 nt, Human
cuggagugggucugcucag

SEQ ID NO: 568324 - RNA, 24 nt, Human
cuugaaaucacccugguccuagca

SEQ ID NO: 568325 - RNA, 21 nt, Human
gaagagaaaggaaugacaaag

SEQ ID NO: 568326 - RNA, 23 nt, Human
gacagaaaugggaucuaagucua

SEQ ID NO: 568327 - RNA, 21 nt, Human
gacccuggcccggagacagac

SEQ ID NO: 568328 - RNA, 23 nt, Human
gaccuaagaaucuuccugggagc

SEQ ID NO: 568329 - RNA, 18 nt, Human
gaggccgcgccugggucc

SEQ ID NO: 568330 - RNA, 19 nt, Human
gagggucccugacccuggc

SEQ ID NO: 568331 - RNA, 21 nt, Human
gauguacaggaagagaaagga

SEQ ID NO: 568332 - RNA, 19 nt, Human
gcccggagacagacugccc

SEQ ID NO: 568333 - RNA, 24 nt, Human
gccgcgccgcagcaggggcagggg

SEQ ID NO: 568334 - RNA, 21 nt, Human
gcgggcuggggagggacaguu

SEQ ID NO: 568335 - RNA, 20 nt, Human
gcucagcaggacuggagccu

SEQ ID NO: 568336 - RNA, 18 nt, Human
gcugccagaggcagaggg

SEQ ID NO: 568337 - RNA, 22 nt, Human
ggaaaagccagauccauuuagg

SEQ ID NO: 568338 - RNA, 21 nt, Human
ggcaggggcuguggcuguggc

SEQ ID NO: 568339 - RNA, 21 nt, Human
ggcuguggcuguggcggaggc

SEQ ID NO: 568340 - RNA, 22 nt, Human
gggcaggggcuguggcuguggc

SEQ ID NO: 568341 - RNA, 23 nt, Human
gggcaggggcuguggcuguggcg

SEQ ID NO: 568342 - RNA, 22 nt, Human
gggcuguggcuguggcggaggc

SEQ ID NO: 568343 - RNA, 25 nt, Human
uaacuaacauucccgccugugacac

SEQ ID NO: 568344 - RNA, 22 nt, Human
uacaaacagcaaucacaacagc

SEQ ID NO: 568345 - RNA, 22 nt, Human
uacaggaagagaaaggaaugac

SEQ ID NO: 568346 - RNA, 22 nt, Human
uaggggagacccaaggccuguu

SEQ ID NO: 568347 - RNA, 24 nt, Human
ucagaauuuagaacugaaguaccu

SEQ ID NO: 568348 - RNA, 21 nt, Human
ucagggucccaguugcuuccc

SEQ ID NO: 568349 - RNA, 21 nt, Human
uccacauggcggcaaggggac

SEQ ID NO: 568350 - RNA, 21 nt, Human
ucccgccucuucucuccgaga

SEQ ID NO: 568351 - RNA, 26 nt, Human
ucccggcgugcugggacacucugggu

SEQ ID NO: 568352 - RNA, 25 nt, Human
ucccugacccuggcccggagacaga

SEQ ID NO: 568353 - RNA, 19 nt, Human
ucccuggcuugaaaucacc

SEQ ID NO: 568354 - RNA, 19 nt, Human
ugaagacgaaaagaacaca

SEQ ID NO: 568355 - RNA, 20 nt, Human
ugacaggaaaggcaacaugg

SEQ ID NO: 568356 - RNA, 18 nt, Human
ugaccaagaaagccucua

SEQ ID NO: 568357 - RNA, 18 nt, Human
ugaccagguccacucccg

SEQ ID NO: 568358 - RNA, 18 nt, Human
ugcgcaccuaguccgcgc

SEQ ID NO: 568359 - RNA, 21 nt, Human
ugcugggacacucuggguucc

SEQ ID NO: 568360 - RNA, 20 nt, Human
ugggccagggaggucuguga

SEQ ID NO: 568361 - RNA, 25 nt, Human
uggggagggacaguuuucagggucc

SEQ ID NO: 568362 - RNA, 20 nt, Human
ugugauugacaggaaaggca

SEQ ID NO: 568363 - RNA, 18 nt, Human
uuagaacugaaguaccug

SEQ ID NO: 568364 - RNA, 20 nt, Human
aaaaaaucaggguagaaaca

SEQ ID NO: 568365 - RNA, 19 nt, Human
aaaaauauauuccuuuggu

SEQ ID NO: 568366 - RNA, 24 nt, Human
aaagacaguguauugcuaacaaaa

SEQ ID NO: 568367 - RNA, 21 nt, Human
aaagagcacauuaaacuaaaa

SEQ ID NO: 568368 - RNA, 24 nt, Human
aaagugcugggauuacaggcguga

SEQ ID NO: 568369 - RNA, 19 nt, Human
aacaacaacaacaaaaggc

SEQ ID NO: 568370 - RNA, 21 nt, Human
aacaacaacaacaacaaaagg

SEQ ID NO: 568371 - RNA, 19 nt, Human
aacacugguauuuucuuua

SEQ ID NO: 568372 - RNA, 18 nt, Human
aacccaggaacuggagga

SEQ ID NO: 568373 - RNA, 21 nt, Human
aagaaaaaaaucaggguagaa

SEQ ID NO: 568374 - RNA, 21 nt, Human
aagcaaauaguggccaaagau

SEQ ID NO: 568375 - RNA, 19 nt, Human
aagcacuuugggaggcuga

SEQ ID NO: 568376 - RNA, 24 nt, Human
aagcacuuugggaggcugaggugg

SEQ ID NO: 568377 - RNA, 22 nt, Human
aagccaggugugauggcacaca

SEQ ID NO: 568378 - RNA, 18 nt, Human
aagugagagaaucguguu

SEQ ID NO: 568379 - RNA, 19 nt, Human
aagugcugggauuacaggc

SEQ ID NO: 568380 - RNA, 19 nt, Human
aagugcugggauuacaggc

SEQ ID NO: 568381 - RNA, 23 nt, Human
aauuguuuuacuuuuaaucuugu

SEQ ID NO: 568382 - RNA, 21 nt, Human
acaaugcaagaaaagauucaa

SEQ ID NO: 568383 - RNA, 23 nt, Human
acagaagacuacucauauaaaca

SEQ ID NO: 568384 - RNA, 20 nt, Human
acaggguuucaccauuuugg

SEQ ID NO: 568385 - RNA, 21 nt, Human
acaggguuucaccauuuuggu

SEQ ID NO: 568386 - RNA, 24 nt, Human
acaggguuucaccauuuuggucag

SEQ ID NO: 568387 - RNA, 23 nt, Human
accauuuuggucaggcuggucuc

SEQ ID NO: 568388 - RNA, 23 nt, Human
accucagccucccaaagugcugg

SEQ ID NO: 568389 - RNA, 22 nt, Human
accuccuccuccaccgcccgcg

SEQ ID NO: 568390 - RNA, 18 nt, Human
accuguaauucuauuucc

SEQ ID NO: 568391 - RNA, 24 nt, Human
accuguaauucuauuuccuauggg

SEQ ID NO: 568392 - RNA, 24 nt, Human
accuugugaucugcccaccucagc

SEQ ID NO: 568393 - RNA, 21 nt, Human
acuccagccugggugauggag

SEQ ID NO: 568394 - RNA, 21 nt, Human
acuccagccugggugauggag

SEQ ID NO: 568395 - RNA, 23 nt, Human
acuccagccugggugauggagug

SEQ ID NO: 568396 - RNA, 24 nt, Human
acuccagccugggugauggagugg

SEQ ID NO: 568397 - RNA, 20 nt, Human
acugcacccggccuuaccag

SEQ ID NO: 568398 - RNA, 24 nt, Human
acuggacuccagccugggugaugg

SEQ ID NO: 568399 - RNA, 26 nt, Human
acuggacuccagccugggugauggag

SEQ ID NO: 568400 - RNA, 26 nt, Human
agacagaacuagcuuuguugcguuuc

SEQ ID NO: 568401 - RNA, 27 nt, Human
agauacccaugaaaagaaaaaaaucag

SEQ ID NO: 568402 - RNA, 20 nt, Human
agauuagaaccauuaaaaua

SEQ ID NO: 568403 - RNA, 24 nt, Human
agcacuuugggaggcugagguggg

SEQ ID NO: 568404 - RNA, 22 nt, Human
agcacuuuuuucauauuuacau

SEQ ID NO: 568405 - RNA, 24 nt, Human
agcgauucucucgccucagcuucc

SEQ ID NO: 568406 - RNA, 20 nt, Human
aggaaccguagaggcccugc

SEQ ID NO: 568407 - RNA, 24 nt, Human
aggaucacuugagcucaggaguuu

SEQ ID NO: 568408 - RNA, 18 nt, Human
aggcaggagggauggcuu

SEQ ID NO: 568409 - RNA, 20 nt, Human
aggcaggagggauggcuugg

SEQ ID NO: 568410 - RNA, 24 nt, Human
aggcgagcggaggcggaggccaag

SEQ ID NO: 568411 - RNA, 23 nt, Human
aggcugaggcagaggaucacuug

SEQ ID NO: 568412 - RNA, 19 nt, Human
aggcugaggcaggagggau

SEQ ID NO: 568413 - RNA, 25 nt, Human
aggcugaggcaggagggauggcuug

SEQ ID NO: 568414 - RNA, 24 nt, Human
aggcugagguggaaggaucauuug

SEQ ID NO: 568415 - RNA, 24 nt, Human
aggcugaggugggaggaucacuug

SEQ ID NO: 568416 - RNA, 25 nt, Human
aggcuggagugcaguggugugaucu

SEQ ID NO: 568417 - RNA, 24 nt, Human
aggugcaguggcucgcaccuguca

SEQ ID NO: 568418 - RNA, 18 nt, Human
aggugggaggaucacuug

SEQ ID NO: 568419 - RNA, 23 nt, Human
aggugggaggaucacuugagccu

SEQ ID NO: 568420 - RNA, 24 nt, Human
aggugugauggcacacaccuguag

SEQ ID NO: 568421 - RNA, 19 nt, Human
aguagcugggauuacaggc

SEQ ID NO: 568422 - RNA, 19 nt, Human
agucauuacaaaaaaaaaa

SEQ ID NO: 568423 - RNA, 18 nt, Human
aguccugcuccacaagga

SEQ ID NO: 568424 - RNA, 19 nt, Human
agugcaguggugugaucuc

SEQ ID NO: 568425 - RNA, 21 nt, Human
agugcaguggugugaucucag

SEQ ID NO: 568426 - RNA, 23 nt, Human
agugcaguggugugaucucagcu

SEQ ID NO: 568427 - RNA, 24 nt, Human
agugcaguggugugaucucagcuc

SEQ ID NO: 568428 - RNA, 18 nt, Human
agugcugggauuacaggc

SEQ ID NO: 568429 - RNA, 24 nt, Human
aguggugugaucucagcucacugc

SEQ ID NO: 568430 - RNA, 24 nt, Human
aucacaccacuggacuccagccug

SEQ ID NO: 568431 - RNA, 20 nt, Human
aucacuugagcucaggaguu

SEQ ID NO: 568432 - RNA, 24 nt, Human
aucacuugagcucaggaguuugag

SEQ ID NO: 568433 - RNA, 19 nt, Human
augaaacaaaaauauacaa

SEQ ID NO: 568434 - RNA, 23 nt, Human
augcaccuauagucccagccaca

SEQ ID NO: 568435 - RNA, 19 nt, Human
auuacaggcgcaugccacc

SEQ ID NO: 568436 - RNA, 24 nt, Human
caaagugcugggauuacaggcgug

SEQ ID NO: 568437 - RNA, 21 nt, Human
caacaacaaaaggcuaucuau

SEQ ID NO: 568438 - RNA, 18 nt, Human
caacaacaacaacaacaa

SEQ ID NO: 568439 - RNA, 20 nt, Human
caacaacaacaacaacaaaa

SEQ ID NO: 568440 - RNA, 20 nt, Human
caagcgauucucucgccuca

SEQ ID NO: 568441 - RNA, 25 nt, Human
cacaagcaaauaguggccaaagaug

SEQ ID NO: 568442 - RNA, 23 nt, Human
cacaccuguaguuccagcuacug

SEQ ID NO: 568443 - RNA, 21 nt, Human
cacaugggaggcugaggugga

SEQ ID NO: 568444 - RNA, 19 nt, Human
caccacgucuggcuaauuu

SEQ ID NO: 568445 - RNA, 19 nt, Human
caccauauggcuucaaaaa

SEQ ID NO: 568446 - RNA, 21 nt, Human
caccauuuuggucaggcuggu

SEQ ID NO: 568447 - RNA, 24 nt, Human
caccauuuuggucaggcuggucuc

SEQ ID NO: 568448 - RNA, 19 nt, Human
caccggauccggauccggc

SEQ ID NO: 568449 - RNA, 23 nt, Human
caccuauagucccagccacaugg

SEQ ID NO: 568450 - RNA, 24 nt, Human
caccuauagucccagccacauggg

SEQ ID NO: 568451 - RNA, 20 nt, Human
caccuccuccuccaccgccc

SEQ ID NO: 568452 - RNA, 19 nt, Human
caccucgccucugcccccu

SEQ ID NO: 568453 - RNA, 22 nt, Human
caccuguaguuccagcuacugg

SEQ ID NO: 568454 - RNA, 23 nt, Human
caccuguaguuccagcuacuggg

SEQ ID NO: 568455 - RNA, 20 nt, Human
caccugucauccaagcacuu

SEQ ID NO: 568456 - RNA, 21 nt, Human
cacugcaaccuuugccucccg

SEQ ID NO: 568457 - RNA, 23 nt, Human
cacugcaaccuuugccucccggg

SEQ ID NO: 568458 - RNA, 22 nt, Human
cacuggacuccagccuggguga

SEQ ID NO: 568459 - RNA, 21 nt, Human
cagaagacuacucauauaaac

SEQ ID NO: 568460 - RNA, 22 nt, Human
cagacguggcagcgccaacgcc

SEQ ID NO: 568461 - RNA, 21 nt, Human
cagaucaguucgucuguauag

SEQ ID NO: 568462 - RNA, 24 nt, Human
cagccacaugggaggcugaggugg

SEQ ID NO: 568463 - RNA, 20 nt, Human
cagcuuccugaguagcuggg

SEQ ID NO: 568464 - RNA, 19 nt, Human
caggaaccguagaggcccu

SEQ ID NO: 568465 - RNA, 24 nt, Human
caggguuucaccauuuuggucagg

SEQ ID NO: 568466 - RNA, 24 nt, Human
cauauguaaucccagauacucugg

SEQ ID NO: 568467 - RNA, 24 nt, Human
caugccaccacgucuggcuaauuu

SEQ ID NO: 568468 - RNA, 18 nt, Human
caugugauaaacagccuu

SEQ ID NO: 568469 - RNA, 22 nt, Human
ccaaagugcugggauuacaggc

SEQ ID NO: 568470 - RNA, 22 nt, Human
ccaaagugcugggauuacaggc

SEQ ID NO: 568471 - RNA, 24 nt, Human
ccaaagugcugggauuacaggcgu

SEQ ID NO: 568472 - RNA, 20 nt, Human
ccacagaaaaauguaaagcc

SEQ ID NO: 568473 - RNA, 19 nt, Human
ccacugcacccggccuuac

SEQ ID NO: 568474 - RNA, 19 nt, Human
ccacugcacccggccuuac

SEQ ID NO: 568475 - RNA, 20 nt, Human
ccacuggacuccagccuggg

SEQ ID NO: 568476 - RNA, 21 nt, Human
ccacuggacuccagccugggu

SEQ ID NO: 568477 - RNA, 23 nt, Human
ccacuggacuccagccuggguga

SEQ ID NO: 568478 - RNA, 23 nt, Human
ccacuggacuccagccuggguga

SEQ ID NO: 568479 - RNA, 24 nt, Human
ccacuggacuccagccugggugau

SEQ ID NO: 568480 - RNA, 19 nt, Human
ccauacucuugacuaccaa

SEQ ID NO: 568481 - RNA, 24 nt, Human
ccauuuuugaaaaaacuuagaggc

SEQ ID NO: 568482 - RNA, 24 nt, Human
ccccaccuccuccuccaccgcccg

SEQ ID NO: 568483 - RNA, 21 nt, Human
ccccugcgcucuagccugggc

SEQ ID NO: 568484 - RNA, 24 nt, Human
ccccugcgcucuagccugggcaac

SEQ ID NO: 568485 - RNA, 21 nt, Human
cccgcgccacaguugggaacc

SEQ ID NO: 568486 - RNA, 20 nt, Human
cccggguucaagcgauucuc

SEQ ID NO: 568487 - RNA, 19 nt, Human
cccugcgcucuagccuggg

SEQ ID NO: 568488 - RNA, 19 nt, Human
cccugcgcucuagccuggg

SEQ ID NO: 568489 - RNA, 20 nt, Human
cccugcgcucuagccugggc

SEQ ID NO: 568490 - RNA, 19 nt, Human
ccggcuucagcgccagccc

SEQ ID NO: 568491 - RNA, 21 nt, Human
ccguagaggcccugcggucgg

SEQ ID NO: 568492 - RNA, 23 nt, Human
ccucccggguucaagcgauucuc

SEQ ID NO: 568493 - RNA, 23 nt, Human
ccugaguagcugggauuacaggc

SEQ ID NO: 568494 - RNA, 23 nt, Human
ccugaguagcugggauuacaggc

SEQ ID NO: 568495 - RNA, 24 nt, Human
ccugcgcucuagccugggcaacag

SEQ ID NO: 568496 - RNA, 19 nt, Human
ccugggcaacauagacucc

SEQ ID NO: 568497 - RNA, 20 nt, Human
ccugggugauggagugggac

SEQ ID NO: 568498 - RNA, 21 nt, Human
ccugggugauggagugggaca

SEQ ID NO: 568499 - RNA, 22 nt, Human
ccuguaguuccagcuacugggg

SEQ ID NO: 568500 - RNA, 24 nt, Human
cgcaccugucauccaagcacuuug

SEQ ID NO: 568501 - RNA, 25 nt, Human
cgcaggcgagcggaggcggaggcca

SEQ ID NO: 568502 - RNA, 23 nt, Human
cgccaggcuggagugcaguggug

SEQ ID NO: 568503 - RNA, 24 nt, Human
cgccaggcuggagugcaguggugu

SEQ ID NO: 568504 - RNA, 22 nt, Human
cgcccgcgccacaguugggaac

SEQ ID NO: 568505 - RNA, 22 nt, Human
cgccucagcuuccugaguagcu

SEQ ID NO: 568506 - RNA, 22 nt, Human
cuaguacaauacauuaaguauu

SEQ ID NO: 568507 - RNA, 24 nt, Human
cucacugcaaccuuugccucccgg

SEQ ID NO: 568508 - RNA, 24 nt, Human
cucagcuuccugaguagcugggau

SEQ ID NO: 568509 - RNA, 22 nt, Human
cuccugaccuugugaucugccc

SEQ ID NO: 568510 - RNA, 23 nt, Human
cucucucugucgccaggcuggag

SEQ ID NO: 568511 - RNA, 23 nt, Human
cucucugucgccaggcuggagug

SEQ ID NO: 568512 - RNA, 18 nt, Human
cucuugacuaccaagaaa

SEQ ID NO: 568513 - RNA, 18 nt, Human
cugaagugccaaccuugu

SEQ ID NO: 568514 - RNA, 22 nt, Human
cugaguagcugggauuacaggc

SEQ ID NO: 568515 - RNA, 23 nt, Human
cugcaaccuuugccucccggguu

SEQ ID NO: 568516 - RNA, 24 nt, Human
cugcaaccuuugccucccggguuc

SEQ ID NO: 568517 - RNA, 20 nt, Human
cugcacccggccuuaccagg

SEQ ID NO: 568518 - RNA, 23 nt, Human
cugcauggagggaaauccaaaau

SEQ ID NO: 568519 - RNA, 23 nt, Human
cugcgcucuagccugggcaacag

SEQ ID NO: 568520 - RNA, 20 nt, Human
cuggaggaugcagugagcua

SEQ ID NO: 568521 - RNA, 18 nt, Human
cuggaggcugaggcagag

SEQ ID NO: 568522 - RNA, 24 nt, Human
cuggagugcaguggugugaucuca

SEQ ID NO: 568523 - RNA, 23 nt, Human
cuucugaaaagacagaacuagcu

SEQ ID NO: 568524 - RNA, 23 nt, Human
cuugagcucaggaguuugagacc

SEQ ID NO: 568525 - RNA, 23 nt, Human
gaccccacagaaaaauguaaagc

SEQ ID NO: 568526 - RNA, 22 nt, Human
gaccuugugaucugcccaccuc

SEQ ID NO: 568527 - RNA, 24 nt, Human
gaccuugugaucugcccaccucag

SEQ ID NO: 568528 - RNA, 18 nt, Human
gagauugaagcggcagug

SEQ ID NO: 568529 - RNA, 24 nt, Human
gagcccaggagauugaagcggcag

SEQ ID NO: 568530 - RNA, 20 nt, Human
gaggcggaggccaaggcgcc

SEQ ID NO: 568531 - RNA, 24 nt, Human
gaggcggaggccaaggcgccaccc

SEQ ID NO: 568532 - RNA, 26 nt, Human
gaguagcugggauuacaggcgcaugc

SEQ ID NO: 568533 - RNA, 24 nt, Human
gaucacuugagcucaggaguuuga

SEQ ID NO: 568534 - RNA, 24 nt, Human
gaucauuugagcccaggagauuga

SEQ ID NO: 568535 - RNA, 24 nt, Human
gauggcacacaccuguaguuccag

SEQ ID NO: 568536 - RNA, 18 nt, Human
gauuacaggcgcaugcca

SEQ ID NO: 568537 - RNA, 18 nt, Human
gauuacaggcgugagcca

SEQ ID NO: 568538 - RNA, 19 nt, Human
gauuacaggcgugagccac

SEQ ID NO: 568539 - RNA, 23 nt, Human
gauuacaggcgugagccacugca

SEQ ID NO: 568540 - RNA, 18 nt, Human
gcauggagggaaauccaa

SEQ ID NO: 568541 - RNA, 19 nt, Human
gccagccccaccuccuccu

SEQ ID NO: 568542 - RNA, 24 nt, Human
gccccugcgcucuagccugggcaa

SEQ ID NO: 568543 - RNA, 23 nt, Human
gccucagcuuccugaguagcugg

SEQ ID NO: 568544 - RNA, 24 nt, Human
gccucagcuuccugaguagcuggg

SEQ ID NO: 568545 - RNA, 23 nt, Human
gcgagaccuugucucaacaacaa

SEQ ID NO: 568546 - RNA, 24 nt, Human
gcgauucucucgccucagcuuccu

SEQ ID NO: 568547 - RNA, 21 nt, Human
gcgccagccccaccuccuccu

SEQ ID NO: 568548 - RNA, 21 nt, Human
gcuugaacccaggaacuggag

SEQ ID NO: 568549 - RNA, 22 nt, Human
gcuugggcaauauaguaagacc

SEQ ID NO: 568550 - RNA, 21 nt, Human
ggaaaggguaggucauccaca

SEQ ID NO: 568551 - RNA, 20 nt, Human
ggacagugucucuuuaaaaa

SEQ ID NO: 568552 - RNA, 24 nt, Human
ggacuccagccugggugauggagu

SEQ ID NO: 568553 - RNA, 18 nt, Human
ggaggaugcagugagcua

SEQ ID NO: 568554 - RNA, 24 nt, Human
ggaggaugcagugagcuaugauca

SEQ ID NO: 568555 - RNA, 26 nt, Human
ggaggaugcagugagcuauggcuagg

SEQ ID NO: 568556 - RNA, 21 nt, Human
ggaggcugaggcagaggauca

SEQ ID NO: 568557 - RNA, 23 nt, Human
ggaggcugaggcaggagggaugg

SEQ ID NO: 568558 - RNA, 22 nt, Human
ggaucacuugagcucaggaguu

SEQ ID NO: 568559 - RNA, 21 nt, Human
ggcaugcaccuauagucccag

SEQ ID NO: 568560 - RNA, 18 nt, Human
ggccaggugcaguggcuc

SEQ ID NO: 568561 - RNA, 22 nt, Human
ggcuggagugcaguggugugau

SEQ ID NO: 568562 - RNA, 23 nt, Human
ggcuggucucaaacuccugaccu

SEQ ID NO: 568563 - RNA, 22 nt, Human
ggcuugggcaauauaguaagac

SEQ ID NO: 568564 - RNA, 20 nt, Human
ggucucaaacuccugaccuu

SEQ ID NO: 568565 - RNA, 24 nt, Human
gguggcaugcaccuauagucccag

SEQ ID NO: 568566 - RNA, 18 nt, Human
guagcugggauuacaggc

SEQ ID NO: 568567 - RNA, 20 nt, Human
gugauaaacagccuuauuca

SEQ ID NO: 568568 - RNA, 24 nt, Human
gugaucugcccaccucagccuccc

SEQ ID NO: 568569 - RNA, 19 nt, Human
gugguacuuuuuaucuaca

SEQ ID NO: 568570 - RNA, 18 nt, Human
uaaaagacaguguauugc

SEQ ID NO: 568571 - RNA, 18 nt, Human
uaaaauuacagaucacca

SEQ ID NO: 568572 - RNA, 18 nt, Human
uaaacuuucaguaaaaca

SEQ ID NO: 568573 - RNA, 21 nt, Human
uaaacuuucaguaaaacauuu

SEQ ID NO: 568574 - RNA, 21 nt, Human
uaacuccuuauuacccauacu

SEQ ID NO: 568575 - RNA, 24 nt, Human
uaauuuuucuuuuuuuuaguagag

SEQ ID NO: 568576 - RNA, 25 nt, Human
uaauuuuucuuuuuuuuaguagaga

SEQ ID NO: 568577 - RNA, 21 nt, Human
uacagaucaccauuguccuca

SEQ ID NO: 568578 - RNA, 19 nt, Human
uacaggcgcaugccaccac

SEQ ID NO: 568579 - RNA, 19 nt, Human
uacaggcgugagccacugc

SEQ ID NO: 568580 - RNA, 23 nt, Human
uacaggcgugagccacugcaccc

SEQ ID NO: 568581 - RNA, 18 nt, Human
uaccaagaaaggaagcca

SEQ ID NO: 568582 - RNA, 22 nt, Human
uaccaagaaaggaagccaaacu

SEQ ID NO: 568583 - RNA, 22 nt, Human
uaccaggcuaauuuuuaaaaac

SEQ ID NO: 568584 - RNA, 20 nt, Human
uaccuguaauucuauuuccu

SEQ ID NO: 568585 - RNA, 19 nt, Human
uacucuggaggcugaggca

SEQ ID NO: 568586 - RNA, 19 nt, Human
uacugugcuucaucaaauc

SEQ ID NO: 568587 - RNA, 20 nt, Human
uagagacaggguuucaccau

SEQ ID NO: 568588 - RNA, 21 nt, Human
uagaggcccugcggucggccg

SEQ ID NO: 568589 - RNA, 18 nt, Human
uagccugggcaacagcga

SEQ ID NO: 568590 - RNA, 20 nt, Human
uagcugggugugguggcaug

SEQ ID NO: 568591 - RNA, 19 nt, Human
uaguagagacaggguuuca

SEQ ID NO: 568592 - RNA, 20 nt, Human
uauaguaagaccccacagaa

SEQ ID NO: 568593 - RNA, 19 nt, Human
uauggaggucacucggcug

SEQ ID NO: 568594 - RNA, 22 nt, Human
uaugugggaaacaauacacccc

SEQ ID NO: 568595 - RNA, 21 nt, Human
ucaacaacaacaacaacaaaa

SEQ ID NO: 568596 - RNA, 23 nt, Human
ucacaccacuggacuccagccug

SEQ ID NO: 568597 - RNA, 20 nt, Human
ucacucggcugcagcaacaa

SEQ ID NO: 568598 - RNA, 24 nt, Human
ucacugcaaccuuugccucccggg

SEQ ID NO: 568599 - RNA, 25 nt, Human
ucacugcaaccuuugccucccgggu

SEQ ID NO: 568600 - RNA, 18 nt, Human
ucacuugagccuaggagu

SEQ ID NO: 568601 - RNA, 18 nt, Human
ucagccucccaaagugcu

SEQ ID NO: 568602 - RNA, 20 nt, Human
ucagcuuccugaguagcugg

SEQ ID NO: 568603 - RNA, 18 nt, Human
uccagccugggugaugga

SEQ ID NO: 568604 - RNA, 19 nt, Human
uccagccugggugauggag

SEQ ID NO: 568605 - RNA, 24 nt, Human
uccagccugggugauggaguggga

SEQ ID NO: 568606 - RNA, 24 nt, Human
ucccaaagugcugggauuacaggc

SEQ ID NO: 568607 - RNA, 20 nt, Human
ucccccaccagugugcacag

SEQ ID NO: 568608 - RNA, 21 nt, Human
ucccggguucaagcgauucuc

SEQ ID NO: 568609 - RNA, 24 nt, Human
ucccggguucaagcgauucucucg

SEQ ID NO: 568610 - RNA, 24 nt, Human
uccugaguagcugggauuacaggc

SEQ ID NO: 568611 - RNA, 24 nt, Human
ucgccaggcuggagugcaguggug

SEQ ID NO: 568612 - RNA, 20 nt, Human
ucgccucugcccccucacgc

SEQ ID NO: 568613 - RNA, 23 nt, Human
ucucucucugucgccaggcugga

SEQ ID NO: 568614 - RNA, 23 nt, Human
ucucucugucgccaggcuggagu

SEQ ID NO: 568615 - RNA, 21 nt, Human
ucugcccaccucagccuccca

SEQ ID NO: 568616 - RNA, 21 nt, Human
ucugucgccaggcuggagugc

SEQ ID NO: 568617 - RNA, 23 nt, Human
ucugucgccaggcuggagugcag

SEQ ID NO: 568618 - RNA, 23 nt, Human
ucuuuaaaaaaugugggccaggu

SEQ ID NO: 568619 - RNA, 21 nt, Human
ugaaacaaaaauauacaaaac

SEQ ID NO: 568620 - RNA, 22 nt, Human
ugaaacaaaaauauacaaaaca

SEQ ID NO: 568621 - RNA, 27 nt, Human
ugaaacaaaaauauacaaaacaugaga

SEQ ID NO: 568622 - RNA, 23 nt, Human
ugaccuugugaucugcccaccuc

SEQ ID NO: 568623 - RNA, 22 nt, Human
ugagauggagucucucucuguc

SEQ ID NO: 568624 - RNA, 22 nt, Human
ugagcccaggagauugaagcgg

SEQ ID NO: 568625 - RNA, 24 nt, Human
ugagccuaggaguuaagagaccag

SEQ ID NO: 568626 - RNA, 23 nt, Human
ugaggcagaggaucacuugagcu

SEQ ID NO: 568627 - RNA, 24 nt, Human
ugaggcagaggaucacuugagcuc

SEQ ID NO: 568628 - RNA, 18 nt, Human
ugaggcaggagggauggc

SEQ ID NO: 568629 - RNA, 25 nt, Human
ugaggcaggagggauggcuugaacc

SEQ ID NO: 568630 - RNA, 26 nt, Human
ugaggcaggagggauggcuugaaccc

SEQ ID NO: 568631 - RNA, 24 nt, Human
ugagguggaaggaucauuugagcc

SEQ ID NO: 568632 - RNA, 19 nt, Human
ugaggugggaggaucacuu

SEQ ID NO: 568633 - RNA, 21 nt, Human
ugaggugggaggaucacuuga

SEQ ID NO: 568634 - RNA, 23 nt, Human
ugaggugggaggaucacuugagc

SEQ ID NO: 568635 - RNA, 24 nt, Human
ugaggugggaggaucacuugagcc

SEQ ID NO: 568636 - RNA, 23 nt, Human
ugauaaacagccuuauucaaugu

SEQ ID NO: 568637 - RNA, 24 nt, Human
ugaucugcccaccucagccuccca

SEQ ID NO: 568638 - RNA, 23 nt, Human
ugauggcacacaccuguaguucc

SEQ ID NO: 568639 - RNA, 23 nt, Human
ugauggcacacaccuguaguucc

SEQ ID NO: 568640 - RNA, 21 nt, Human
ugcaccuauagucccagccac

SEQ ID NO: 568641 - RNA, 24 nt, Human
ugcaccuauagucccagccacaug

SEQ ID NO: 568642 - RNA, 22 nt, Human
ugcaguggugugaucucagcuc

SEQ ID NO: 568643 - RNA, 18 nt, Human
ugcauacugugcuucauc

SEQ ID NO: 568644 - RNA, 20 nt, Human
ugcggucggcgcuccuagcc

SEQ ID NO: 568645 - RNA, 24 nt, Human
ugcugggauuacaggcgugagcca

SEQ ID NO: 568646 - RNA, 19 nt, Human
uggagggaaauccaaaauc

SEQ ID NO: 568647 - RNA, 19 nt, Human
uggagugcaguggugugau

SEQ ID NO: 568648 - RNA, 24 nt, Human
uggagugcaguggugugaucucag

SEQ ID NO: 568649 - RNA, 23 nt, Human
uggagugggacagugucucuuua

SEQ ID NO: 568650 - RNA, 19 nt, Human
uggcacacaccuguaguuc

SEQ ID NO: 568651 - RNA, 24 nt, Human
ugggaggcugagguggaaggauca

SEQ ID NO: 568652 - RNA, 19 nt, Human
ugggaggcugaggugggag

SEQ ID NO: 568653 - RNA, 24 nt, Human
ugggaggcugaggugggaggauca

SEQ ID NO: 568654 - RNA, 21 nt, Human
ugggauuacaggcgcaugcca

SEQ ID NO: 568655 - RNA, 22 nt, Human
ugggauuacaggcgcaugccac

SEQ ID NO: 568656 - RNA, 24 nt, Human
ugggauuacaggcgcaugccacca

SEQ ID NO: 568657 - RNA, 19 nt, Human
ugggauuacaggcgugagc

SEQ ID NO: 568658 - RNA, 21 nt, Human
ugggauuacaggcgugagcca

SEQ ID NO: 568659 - RNA, 22 nt, Human
ugggauuacaggcgugagccac

SEQ ID NO: 568660 - RNA, 22 nt, Human
ugggauuacaggcgugagccac

SEQ ID NO: 568661 - RNA, 24 nt, Human
ugggauuacaggcgugagccacug

SEQ ID NO: 568662 - RNA, 26 nt, Human
ugggauuacaggcgugagccacugca

SEQ ID NO: 568663 - RNA, 22 nt, Human
ugggcaauauaguaagacccca

SEQ ID NO: 568664 - RNA, 24 nt, Human
uggucaggcuggucucaaacuccu

SEQ ID NO: 568665 - RNA, 18 nt, Human
uggugugagucaauggga

SEQ ID NO: 568666 - RNA, 24 nt, Human
uggugugaucucagcucacugcaa

SEQ ID NO: 568667 - RNA, 18 nt, Human
ugugcugguuacaggaac

SEQ ID NO: 568668 - RNA, 22 nt, Human
uguggugauugugccccugcgc

SEQ ID NO: 568669 - RNA, 19 nt, Human
uuagcugggugugguggca

SEQ ID NO: 568670 - RNA, 22 nt, Human
uuagcugggugugguggcaugc

SEQ ID NO: 568671 - RNA, 24 nt, Human
uuaguagagacaggguuucaccau

SEQ ID NO: 568672 - RNA, 23 nt, Human
uucaagcgauucucucgccucag

SEQ ID NO: 568673 - RNA, 22 nt, Human
uucacaagcaaauaguggccaa

SEQ ID NO: 568674 - RNA, 19 nt, Human
uucagcgccagccccaccu

SEQ ID NO: 568675 - RNA, 22 nt, Human
uuggaagugagagaaucguguu

SEQ ID NO: 568676 - RNA, 25 nt, Human
uugggaggcugaggugggaggauca

SEQ ID NO: 568677 - RNA, 24 nt, Human
uuguuuuguuuugagauggagucu

SEQ ID NO: 568678 - RNA, 19 nt, Human
uuuaugcaugugauaaaca

SEQ ID NO: 568679 - RNA, 24 nt, Human
uuucaccauuuuggucaggcuggu

SEQ ID NO: 568680 - RNA, 22 nt, Human
uuucuuuuuuuuaguagagaca

SEQ ID NO: 568681 - RNA, 24 nt, Human
uuuuuaguagagacaggguuucac

SEQ ID NO: 568682 - RNA, 23 nt, Human
uuuuuuaguagagacaggguuuc

SEQ ID NO: 568683 - RNA, 19 nt, Human
aaagugcugggauuacaga

SEQ ID NO: 568684 - RNA, 24 nt, Human
aaagugcugggauuacagacguga

SEQ ID NO: 568685 - RNA, 21 nt, Human
aagcagauagguucaaaucug

SEQ ID NO: 568686 - RNA, 19 nt, Human
aaguagcugggauuacagg

SEQ ID NO: 568687 - RNA, 19 nt, Human
aagugcugggauuacagac

SEQ ID NO: 568688 - RNA, 26 nt, Human
aagugcugggauuacagacgugagcc

SEQ ID NO: 568689 - RNA, 24 nt, Human
accauguuggccaggcuggucucg

SEQ ID NO: 568690 - RNA, 24 nt, Human
acggggccucaccauguuggccag

SEQ ID NO: 568691 - RNA, 21 nt, Human
acgugagccacagcacccagc

SEQ ID NO: 568692 - RNA, 24 nt, Human
aggugauccgcccaccucggccuc

SEQ ID NO: 568693 - RNA, 24 nt, Human
agugcugggauuacagacgugagc

SEQ ID NO: 568694 - RNA, 24 nt, Human
caaagugcugggauuacagacgug

SEQ ID NO: 568695 - RNA, 21 nt, Human
caccauguuggccaggcuggu

SEQ ID NO: 568696 - RNA, 24 nt, Human
caccauguuggccaggcuggucuc

SEQ ID NO: 568697 - RNA, 27 nt, Human
caccauguuggccaggcuggucucgaa

SEQ ID NO: 568698 - RNA, 24 nt, Human
caccucggccucccaaagugcugg

SEQ ID NO: 568699 - RNA, 18 nt, Human
cacugcaaccucugccuc

SEQ ID NO: 568700 - RNA, 21 nt, Human
cacugcaaccucugccuccca

SEQ ID NO: 568701 - RNA, 19 nt, Human
cagauagguucaaaucugc

SEQ ID NO: 568702 - RNA, 19 nt, Human
cagcacccagccgggacug

SEQ ID NO: 568703 - RNA, 22 nt, Human
caggcgauucuccugccucagc

SEQ ID NO: 568704 - RNA, 21 nt, Human
caggcgauucuccugccuuag

SEQ ID NO: 568705 - RNA, 24 nt, Human
cauguuggccaggcuggucucgaa

SEQ ID NO: 568706 - RNA, 22 nt, Human
ccaaagugcugggauuacagac

SEQ ID NO: 568707 - RNA, 24 nt, Human
ccaaagugcugggauuacagacgu

SEQ ID NO: 568708 - RNA, 21 nt, Human
ccaaguagcugggauuacagg

SEQ ID NO: 568709 - RNA, 22 nt, Human
cccaaguagcugggauuacagg

SEQ ID NO: 568710 - RNA, 23 nt, Human
cccaaguagcugggauuacaggu

SEQ ID NO: 568711 - RNA, 24 nt, Human
cccaaguagcugggauuacaggug

SEQ ID NO: 568712 - RNA, 23 nt, Human
cccagguucaggcgauucuccug

SEQ ID NO: 568713 - RNA, 23 nt, Human
cccagguucaggcgauucuccug

SEQ ID NO: 568714 - RNA, 24 nt, Human
cccgaccucaggugauccgcccac

SEQ ID NO: 568715 - RNA, 24 nt, Human
ccucccagguucaggcgauucucc

SEQ ID NO: 568716 - RNA, 18 nt, Human
cgaccucaggugauccgc

SEQ ID NO: 568717 - RNA, 24 nt, Human
cggaguuucguguuguugcccagg

SEQ ID NO: 568718 - RNA, 24 nt, Human
cguguuguugcccaggcuagagug

SEQ ID NO: 568719 - RNA, 24 nt, Human
cucacugcaaccucugccucccag

SEQ ID NO: 568720 - RNA, 24 nt, Human
cucacugcaaccucugccucccag

SEQ ID NO: 568721 - RNA, 24 nt, Human
cucagccucccaaguagcugggau

SEQ ID NO: 568722 - RNA, 23 nt, Human
cucccagguucaggcgauucucc

SEQ ID NO: 568723 - RNA, 23 nt, Human
cuccugccuuagucucccagguu

SEQ ID NO: 568724 - RNA, 23 nt, Human
cugcaaccucugccucccagguu

SEQ ID NO: 568725 - RNA, 24 nt, Human
cugcaaccucugccucccagguuc

SEQ ID NO: 568726 - RNA, 23 nt, Human
cugccucagccucccaaguagcu

SEQ ID NO: 568727 - RNA, 23 nt, Human
cugcuugcucucuucacuuccgg

SEQ ID NO: 568728 - RNA, 23 nt, Human
cuggugcuuggagcggaagggaa

SEQ ID NO: 568729 - RNA, 24 nt, Human
gaccucaggugauccgcccaccuc

SEQ ID NO: 568730 - RNA, 18 nt, Human
gauuacagacgugagcca

SEQ ID NO: 568731 - RNA, 23 nt, Human
gauuacagacgugagccacagca

SEQ ID NO: 568732 - RNA, 21 nt, Human
gauucuccugccucagccucc

SEQ ID NO: 568733 - RNA, 22 nt, Human
gcaaccucugccucccagguuc

SEQ ID NO: 568734 - RNA, 20 nt, Human
gccucagccucccaaguagc

SEQ ID NO: 568735 - RNA, 22 nt, Human
gccuuagucucccagguucagg

SEQ ID NO: 568736 - RNA, 24 nt, Human
gcgauucuccugccucagccuccc

SEQ ID NO: 568737 - RNA, 24 nt, Human
gcuagagugcaauggugccgucug

SEQ ID NO: 568738 - RNA, 21 nt, Human
gcucacugcaaccucugccuc

SEQ ID NO: 568739 - RNA, 23 nt, Human
gcuggucucgaacucccgaccuc

SEQ ID NO: 568740 - RNA, 23 nt, Human
ggaguuucguguuguugcccagg

SEQ ID NO: 568741 - RNA, 18 nt, Human
ggccucaccauguuggcc

SEQ ID NO: 568742 - RNA, 22 nt, Human
gggccucaccauguuggccagg

SEQ ID NO: 568743 - RNA, 23 nt, Human
ggggccucaccauguuggccagg

SEQ ID NO: 568744 - RNA, 23 nt, Human
guagagacggggccucaccaugu

SEQ ID NO: 568745 - RNA, 18 nt, Human
guagcugggauuacaggu

SEQ ID NO: 568746 - RNA, 24 nt, Human
gugauccgcccaccucggccuccc

SEQ ID NO: 568747 - RNA, 22 nt, Human
uagagacggggccucaccaugu

SEQ ID NO: 568748 - RNA, 24 nt, Human
uaguagagacggggccucaccaug

SEQ ID NO: 568749 - RNA, 26 nt, Human
uaguagagacggggccucaccauguu

SEQ ID NO: 568750 - RNA, 19 nt, Human
ucacugcaaccucugccuc

SEQ ID NO: 568751 - RNA, 24 nt, Human
ucacugcaaccucugccucccagg

SEQ ID NO: 568752 - RNA, 25 nt, Human
ucacugcaaccucugccucccaggu

SEQ ID NO: 568753 - RNA, 18 nt, Human
ucacugguauucccccgu

SEQ ID NO: 568754 - RNA, 18 nt, Human
ucagccucccaaguagcu

SEQ ID NO: 568755 - RNA, 20 nt, Human
ucagccucccaaguagcugg

SEQ ID NO: 568756 - RNA, 18 nt, Human
ucccaaagugcugggauu

SEQ ID NO: 568757 - RNA, 24 nt, Human
ucccaaagugcugggauuacagac

SEQ ID NO: 568758 - RNA, 23 nt, Human
ucccaaguagcugggauuacagg

SEQ ID NO: 568759 - RNA, 24 nt, Human
ucccaaguagcugggauuacaggu

SEQ ID NO: 568760 - RNA, 19 nt, Human
ucccagguucaggcgauuc

SEQ ID NO: 568761 - RNA, 21 nt, Human
ucccagguucaggcgauucuc

SEQ ID NO: 568762 - RNA, 21 nt, Human
ucccagguucaggcgauucuc

SEQ ID NO: 568763 - RNA, 24 nt, Human
ucccagguucaggcgauucuccug

SEQ ID NO: 568764 - RNA, 24 nt, Human
ucccagguucaggcgauucuccug

SEQ ID NO: 568765 - RNA, 18 nt, Human
ucggccucccaaagugcu

SEQ ID NO: 568766 - RNA, 22 nt, Human
ucguguuguugcccaggcuaga

SEQ ID NO: 568767 - RNA, 24 nt, Human
ucguguuguugcccaggcuagagu

SEQ ID NO: 568768 - RNA, 19 nt, Human
ucucccagguucaggcgau

SEQ ID NO: 568769 - RNA, 26 nt, Human
ucuccugccucagccucccaaguagc

SEQ ID NO: 568770 - RNA, 22 nt, Human
ucucuucacuuccggcggggau

SEQ ID NO: 568771 - RNA, 21 nt, Human
ugagaagcgagggcaacacga

SEQ ID NO: 568772 - RNA, 24 nt, Human
ugauccgcccaccucggccuccca

SEQ ID NO: 568773 - RNA, 21 nt, Human
ugcccaggcuagagugcaaug

SEQ ID NO: 568774 - RNA, 24 nt, Human
ugccucagccucccaaguagcugg

SEQ ID NO: 568775 - RNA, 21 nt, Human
ugccuuagucucccagguuca

SEQ ID NO: 568776 - RNA, 25 nt, Human
ugcugggauuacagacgugagccac

SEQ ID NO: 568777 - RNA, 23 nt, Human
uggccaggcuggucucgaacucc

SEQ ID NO: 568778 - RNA, 18 nt, Human
ugggauuacagacgugag

SEQ ID NO: 568779 - RNA, 19 nt, Human
ugggauuacagacgugagc

SEQ ID NO: 568780 - RNA, 21 nt, Human
ugggauuacagacgugagcca

SEQ ID NO: 568781 - RNA, 22 nt, Human
ugggauuacagacgugagccac

SEQ ID NO: 568782 - RNA, 26 nt, Human
ugggauuacagacgugagccacagca

SEQ ID NO: 568783 - RNA, 27 nt, Human
ugggauuacagacgugagccacagcac

SEQ ID NO: 568784 - RNA, 19 nt, Human
ugggauuacaggugccacc

SEQ ID NO: 568785 - RNA, 20 nt, Human
ugggauuacaggugccacca

SEQ ID NO: 568786 - RNA, 19 nt, Human
uggucucgaacucccgacc

SEQ ID NO: 568787 - RNA, 20 nt, Human
uguugcccaggcuagagugc

SEQ ID NO: 568788 - RNA, 22 nt, Human
uguugcccaggcuagagugcaa

SEQ ID NO: 568789 - RNA, 21 nt, Human
uuacaggugccaccaagcacg

SEQ ID NO: 568790 - RNA, 24 nt, Human
uuaguagagacggggccucaccau

SEQ ID NO: 568791 - RNA, 18 nt, Human
uucaggcgauucuccugc

SEQ ID NO: 568792 - RNA, 21 nt, Human
uucaggcgauucuccugccuc

SEQ ID NO: 568793 - RNA, 23 nt, Human
uucaggcgauucuccugccucag

SEQ ID NO: 568794 - RNA, 23 nt, Human
uuguauuuuuaguagagacgggg

SEQ ID NO: 568795 - RNA, 23 nt, Human
uuguugcccaggcuagagugcaa

SEQ ID NO: 568796 - RNA, 24 nt, Human
uuucguguuguugcccaggcuaga

SEQ ID NO: 568797 - RNA, 24 nt, Human
uuuuuaguagagacggggccucac

SEQ ID NO: 568798 - RNA, 21 nt, Human
uuuuuguauuuuuaguagaga

SEQ ID NO: 568799 - RNA, 21 nt, Human
uuuuuuguauuuuuaguagag

SEQ ID NO: 568800 - RNA, 24 nt, Human
uuuuuuguauuuuuaguagagacg

SEQ ID NO: 568801 - RNA, 20 nt, Human
aaagcaaccggcacagcccu

SEQ ID NO: 568802 - RNA, 24 nt, Human
aaauagccgagaaaucaacauuuu

SEQ ID NO: 568803 - RNA, 21 nt, Human
aacuaguaagucacuaaaaag

SEQ ID NO: 568804 - RNA, 25 nt, Human
aacugugucugggggacaugguaga

SEQ ID NO: 568805 - RNA, 21 nt, Human
aagcaaccggcacagcccucc

SEQ ID NO: 568806 - RNA, 24 nt, Human
agaagacugccauaaaucaacaaa

SEQ ID NO: 568807 - RNA, 20 nt, Human
aggcauuuccuuggaggcuc

SEQ ID NO: 568808 - RNA, 19 nt, Human
auuacuauaauuccuacaa

SEQ ID NO: 568809 - RNA, 22 nt, Human
auuaggcuaaacaacaagcacc

SEQ ID NO: 568810 - RNA, 19 nt, Human
caaaacauuuugaugcuaa

SEQ ID NO: 568811 - RNA, 25 nt, Human
caacaagcaccugucagcaguggaa

SEQ ID NO: 568812 - RNA, 24 nt, Human
cacuccagccgcgccaccgccugc

SEQ ID NO: 568813 - RNA, 21 nt, Human
cauguaccacaaaaucagaga

SEQ ID NO: 568814 - RNA, 20 nt, Human
ccaaaacauuuugaugcuaa

SEQ ID NO: 568815 - RNA, 25 nt, Human
cccaaacuauuuuucuucugucugc

SEQ ID NO: 568816 - RNA, 19 nt, Human
cccaugguccacuguaauc

SEQ ID NO: 568817 - RNA, 19 nt, Human
cccgcggcacuccagccgc

SEQ ID NO: 568818 - RNA, 23 nt, Human
ccgaaaggccaaguaauguggug

SEQ ID NO: 568819 - RNA, 23 nt, Human
ccgccugccuaagcgcgccgccc

SEQ ID NO: 568820 - RNA, 24 nt, Human
ccgccugccuaagcgcgccgcccu

SEQ ID NO: 568821 - RNA, 22 nt, Human
ccgcgccaccgccugccuaagc

SEQ ID NO: 568822 - RNA, 22 nt, Human
ccucucagggaaaugugaaaau

SEQ ID NO: 568823 - RNA, 21 nt, Human
cgcgccaccgccugccuaagc

SEQ ID NO: 568824 - RNA, 18 nt, Human
cucauugucauugcuguu

SEQ ID NO: 568825 - RNA, 24 nt, Human
cuccccgcggcacuccagccgcgc

SEQ ID NO: 568826 - RNA, 20 nt, Human
cugagguuuuuuuuuuuuuu

SEQ ID NO: 568827 - RNA, 21 nt, Human
cuggccgagaugcggcugcag

SEQ ID NO: 568828 - RNA, 20 nt, Human
gagguuuuuuuuuuuuuuuc

SEQ ID NO: 568829 - RNA, 20 nt, Human
uaaaauauugugccaggucc

SEQ ID NO: 568830 - RNA, 24 nt, Human
uaaauauccacauuaggcuaaaca

SEQ ID NO: 568831 - RNA, 23 nt, Human
uaccacaaaaucagagaagacac

SEQ ID NO: 568832 - RNA, 22 nt, Human
uaccacaaaaucagagaagacu

SEQ ID NO: 568833 - RNA, 22 nt, Human
uacuggaauuaaacaaaggcca

SEQ ID NO: 568834 - RNA, 20 nt, Human
ucagagaagacacgaggaca

SEQ ID NO: 568835 - RNA, 18 nt, Human
ucagugaaauagccgaga

SEQ ID NO: 568836 - RNA, 25 nt, Human
uccacuuagaauaguuacauguucc

SEQ ID NO: 568837 - RNA, 23 nt, Human
uccccgcggcacuccagccgcgc

SEQ ID NO: 568838 - RNA, 18 nt, Human
ucucccgcauguccuccg

SEQ ID NO: 568839 - RNA, 22 nt, Human
ugaugcuaaaaaauauacaaga

SEQ ID NO: 568840 - RNA, 24 nt, Human
ugccaaauaauuaaauuuaaaaua

SEQ ID NO: 568841 - RNA, 25 nt, Human
ugcggcugcagaaagcaaccggcac

SEQ ID NO: 568842 - RNA, 22 nt, Human
uggcuucuguaucccauggucc

SEQ ID NO: 568843 - RNA, 22 nt, Human
ugucugggggacaugguagaga

SEQ ID NO: 568844 - RNA, 22 nt, Human
aaacacaaaccacagcugaucc

SEQ ID NO: 568845 - RNA, 23 nt, Human
aaacagaacuacagaagauaguc

SEQ ID NO: 568846 - RNA, 19 nt, Human
aaaccacagcugauccuga

SEQ ID NO: 568847 - RNA, 21 nt, Human
aaacccucuaucucuagauuu

SEQ ID NO: 568848 - RNA, 21 nt, Human
aaagaaaccacauuguaagag

SEQ ID NO: 568849 - RNA, 18 nt, Human
aaagggaggcagggaggg

SEQ ID NO: 568850 - RNA, 22 nt, Human
aaauaaggaaagaaagcaucau

SEQ ID NO: 568851 - RNA, 19 nt, Human
aaaucuggccaaaaaaauc

SEQ ID NO: 568852 - RNA, 22 nt, Human
aagaagaaagagagggacaaga

SEQ ID NO: 568853 - RNA, 19 nt, Human
aagaaggaaagaagaaaga

SEQ ID NO: 568854 - RNA, 21 nt, Human
aagaauauguauugaaccuuc

SEQ ID NO: 568855 - RNA, 21 nt, Human
aagcaacagccugggaaaaca

SEQ ID NO: 568856 - RNA, 19 nt, Human
aagcaucaucaauagagag

SEQ ID NO: 568857 - RNA, 24 nt, Human
aagcugacuccucuuucuucaaga

SEQ ID NO: 568858 - RNA, 21 nt, Human
aagguugcuccauuccaacug

SEQ ID NO: 568859 - RNA, 18 nt, Human
aaguaaucauaaaaaucu

SEQ ID NO: 568860 - RNA, 19 nt, Human
aaucuggccaaaaaaaucc

SEQ ID NO: 568861 - RNA, 24 nt, Human
aaucuugcagaccaggccuugcua

SEQ ID NO: 568862 - RNA, 25 nt, Human
acagaacuacagaagauagucagaa

SEQ ID NO: 568863 - RNA, 23 nt, Human
accacagcugauccugaugcauu

SEQ ID NO: 568864 - RNA, 24 nt, Human
acuucacacacuaagaacacccaa

SEQ ID NO: 568865 - RNA, 23 nt, Human
agaaacacacucucuuggacaua

SEQ ID NO: 568866 - RNA, 19 nt, Human
agaaagagagggacaagaa

SEQ ID NO: 568867 - RNA, 20 nt, Human
agaagaaagagagggacaag

SEQ ID NO: 568868 - RNA, 19 nt, Human
agagaacaagcacagcuga

SEQ ID NO: 568869 - RNA, 23 nt, Human
agagccggcgaggcauuaaauaa

SEQ ID NO: 568870 - RNA, 20 nt, Human
agauuacacuuuuauaagcc

SEQ ID NO: 568871 - RNA, 19 nt, Human
agcuuguuuuaaggccagu

SEQ ID NO: 568872 - RNA, 21 nt, Human
aggaagccuuuuaacuauaga

SEQ ID NO: 568873 - RNA, 24 nt, Human
agggaagaaggaaagaagaaagag

SEQ ID NO: 568874 - RNA, 22 nt, Human
agguugcuccauuccaacuggu

SEQ ID NO: 568875 - RNA, 18 nt, Human
aguucaugccagaaaacu

SEQ ID NO: 568876 - RNA, 20 nt, Human
aguugccucauaguguuuau

SEQ ID NO: 568877 - RNA, 24 nt, Human
auauguauugaaccuucucuugaa

SEQ ID NO: 568878 - RNA, 21 nt, Human
aucaccaucuccccagcucug

SEQ ID NO: 568879 - RNA, 23 nt, Human
auugaaccuucucuugaacagaa

SEQ ID NO: 568880 - RNA, 24 nt, Human
auugaagaugccccugcaugaaua

SEQ ID NO: 568881 - RNA, 19 nt, Human
caaaaggaggcugguauuu

SEQ ID NO: 568882 - RNA, 22 nt, Human
caaaccacagcugauccugaug

SEQ ID NO: 568883 - RNA, 20 nt, Human
caaacccucuaucucuagau

SEQ ID NO: 568884 - RNA, 26 nt, Human
caaagcugacaauaucugaaaagccc

SEQ ID NO: 568885 - RNA, 23 nt, Human
caagacuccccaaagaaaccaca

SEQ ID NO: 568886 - RNA, 24 nt, Human
caagcacagcugacauuucuuugu

SEQ ID NO: 568887 - RNA, 20 nt, Human
caagcuuuaacucagcacca

SEQ ID NO: 568888 - RNA, 22 nt, Human
cacaaaccacagcugauccuga

SEQ ID NO: 568889 - RNA, 20 nt, Human
cagagaacaagcacagcuga

SEQ ID NO: 568890 - RNA, 23 nt, Human
cagcccugacugaacaaagccaa

SEQ ID NO: 568891 - RNA, 21 nt, Human
ccagaaaacugucuccugcaa

SEQ ID NO: 568892 - RNA, 27 nt, Human
ccaggaauuuccaauaagaaaagaggg

SEQ ID NO: 568893 - RNA, 22 nt, Human
ccaugcaguuguccaucaccau

SEQ ID NO: 568894 - RNA, 21 nt, Human
cccaagagcuuguuuuaaggc

SEQ ID NO: 568895 - RNA, 24 nt, Human
cccaaucuucccaugacacguuug

SEQ ID NO: 568896 - RNA, 19 nt, Human
ccgaucaauuagaaaacca

SEQ ID NO: 568897 - RNA, 22 nt, Human
cugacaauaucugaaaagcccu

SEQ ID NO: 568898 - RNA, 20 nt, Human
cuggaauguacuguacuacc

SEQ ID NO: 568899 - RNA, 20 nt, Human
cuucacacacuaagaacacc

SEQ ID NO: 568900 - RNA, 20 nt, Human
cuugaacagaaugacgagcc

SEQ ID NO: 568901 - RNA, 18 nt, Human
gaaagaagaaagagaggg

SEQ ID NO: 568902 - RNA, 18 nt, Human
gaccauuuuagaugcuuu

SEQ ID NO: 568903 - RNA, 21 nt, Human
gagaaagagagagggacaaaa

SEQ ID NO: 568904 - RNA, 20 nt, Human
gauaaagaaacagugagaaa

SEQ ID NO: 568905 - RNA, 21 nt, Human
gcagggagggaagaaggaaag

SEQ ID NO: 568906 - RNA, 21 nt, Human
gcuccugcucgcccucuuuuc

SEQ ID NO: 568907 - RNA, 21 nt, Human
ggaaaacagagaacaagcaca

SEQ ID NO: 568908 - RNA, 18 nt, Human
gggaaaacagagaacaag

SEQ ID NO: 568909 - RNA, 22 nt, Human
gggaagaaggaaagaagaaaga

SEQ ID NO: 568910 - RNA, 19 nt, Human
guaaaacacagaaguaaaa

SEQ ID NO: 568911 - RNA, 23 nt, Human
uaaaaagauagauuacacuuuua

SEQ ID NO: 568912 - RNA, 18 nt, Human
uaaaacacaaaccacagc

SEQ ID NO: 568913 - RNA, 20 nt, Human
uaaaacacaaaccacagcug

SEQ ID NO: 568914 - RNA, 21 nt, Human
uaaaacacaaaccacagcuga

SEQ ID NO: 568915 - RNA, 25 nt, Human
uaaaagaauacaauccuggaaugua

SEQ ID NO: 568916 - RNA, 18 nt, Human
uaaauaaaaaucaagcuu

SEQ ID NO: 568917 - RNA, 24 nt, Human
uaacuauagagaaagagagaggga

SEQ ID NO: 568918 - RNA, 21 nt, Human
uaagaacacccaaucuuccca

SEQ ID NO: 568919 - RNA, 23 nt, Human
uaagccuaaguaaucauaaaaau

SEQ ID NO: 568920 - RNA, 27 nt, Human
uaauauagaugaggaagccuuuuaacu

SEQ ID NO: 568921 - RNA, 21 nt, Human
uacaaaacuaauaaauucaau

SEQ ID NO: 568922 - RNA, 23 nt, Human
uacaaaacuaauaaauucaauga

SEQ ID NO: 568923 - RNA, 24 nt, Human
ucauaaaauguccuuggaauacaa

SEQ ID NO: 568924 - RNA, 18 nt, Human
uccaucaccaucucccca

SEQ ID NO: 568925 - RNA, 18 nt, Human
uccccugauaaagaaaca

SEQ ID NO: 568926 - RNA, 26 nt, Human
ucccuuuuuaacaacuuuuuccacaa

SEQ ID NO: 568927 - RNA, 18 nt, Human
ucuaaaucaagcauggaa

SEQ ID NO: 568928 - RNA, 23 nt, Human
ucucaaaaauucaggggaagagu

SEQ ID NO: 568929 - RNA, 23 nt, Human
ucuugaacagaaugacgagccuu

SEQ ID NO: 568930 - RNA, 21 nt, Human
ugaagauuuuuaauuuaaagg

SEQ ID NO: 568931 - RNA, 24 nt, Human
ugacaauaucugaaaagcccuggc

SEQ ID NO: 568932 - RNA, 22 nt, Human
ugacaauggcuuguggaacaac

SEQ ID NO: 568933 - RNA, 19 nt, Human
ugagaaagcagcagguccc

SEQ ID NO: 568934 - RNA, 22 nt, Human
ugccacaccgcccagguuuacc

SEQ ID NO: 568935 - RNA, 18 nt, Human
ugcuccauuccaacuggu

SEQ ID NO: 568936 - RNA, 21 nt, Human
uggaauuacagcccacauuua

SEQ ID NO: 568937 - RNA, 21 nt, Human
uggccaaaaaaauccgaucaa

SEQ ID NO: 568938 - RNA, 20 nt, Human
uggcuccuaaguaaugaccu

SEQ ID NO: 568939 - RNA, 21 nt, Human
uggcuccuaaguaaugaccuu

SEQ ID NO: 568940 - RNA, 18 nt, Human
ugggaagguuggaggagg

SEQ ID NO: 568941 - RNA, 24 nt, Human
ugggcuccugcucgcccucuuuuc

SEQ ID NO: 568942 - RNA, 23 nt, Human
uucaaaauaaauucccaaugauc

SEQ ID NO: 568943 - RNA, 22 nt, Human
uucaggggaagagucaguaugu

SEQ ID NO: 568944 - RNA, 19 nt, Human
uugacacacaaauugggaa

SEQ ID NO: 568945 - RNA, 25 nt, Human
uugcagaccaggccuugcuagaguu

SEQ ID NO: 568946 - RNA, 24 nt, Human
uuuuccacaugggcuccugcucgc

SEQ ID NO: 568947 - RNA, 19 nt, Human
aaagaacucccauuacuca

SEQ ID NO: 568948 - RNA, 20 nt, Human
aacuccucucuucaaugcua

SEQ ID NO: 568949 - RNA, 24 nt, Human
aauaaauaaaguuacuauuaaacu

SEQ ID NO: 568950 - RNA, 19 nt, Human
aauuuuuuuucugcuuuua

SEQ ID NO: 568951 - RNA, 22 nt, Human
acaggaaaccaaccccuuuuca

SEQ ID NO: 568952 - RNA, 25 nt, Human
acaguggugucuacuggauaaagag

SEQ ID NO: 568953 - RNA, 19 nt, Human
accccgucuaacugcagcu

SEQ ID NO: 568954 - RNA, 25 nt, Human
acucacacacacaccagcacacaca

SEQ ID NO: 568955 - RNA, 19 nt, Human
acuuugguaagugcuuugg

SEQ ID NO: 568956 - RNA, 18 nt, Human
agaaaagauuccccugga

SEQ ID NO: 568957 - RNA, 26 nt, Human
agaaaagauuccccuggagcuacaga

SEQ ID NO: 568958 - RNA, 23 nt, Human
agaacuaaaccaucauuuauaac

SEQ ID NO: 568959 - RNA, 20 nt, Human
agaaugcacacuccccaugc

SEQ ID NO: 568960 - RNA, 20 nt, Human
agccacugaugagcuaggcc

SEQ ID NO: 568961 - RNA, 19 nt, Human
agcuaggcccacugucuag

SEQ ID NO: 568962 - RNA, 22 nt, Human
agcuggucucuuccgugacaca

SEQ ID NO: 568963 - RNA, 23 nt, Human
agggaagagauaagccuccaaga

SEQ ID NO: 568964 - RNA, 18 nt, Human
aguacaguggugucuacu

SEQ ID NO: 568965 - RNA, 24 nt, Human
auauauauacaggaaaccaacccc

SEQ ID NO: 568966 - RNA, 24 nt, Human
augaaugaccuauauguacaaaug

SEQ ID NO: 568967 - RNA, 21 nt, Human
auguauguacguguguauaua

SEQ ID NO: 568968 - RNA, 21 nt, Human
auguguguguuccuggcaccc

SEQ ID NO: 568969 - RNA, 23 nt, Human
caacuauacgaguuucagcuucc

SEQ ID NO: 568970 - RNA, 18 nt, Human
caagcagaggccaugaaa

SEQ ID NO: 568971 - RNA, 24 nt, Human
caagcagaggccaugaaagaacuc

SEQ ID NO: 568972 - RNA, 21 nt, Human
caauaucacaaaaaacacagg

SEQ ID NO: 568973 - RNA, 22 nt, Human
cacacacaccagcacacacagu

SEQ ID NO: 568974 - RNA, 19 nt, Human
caccagcacacacaguccc

SEQ ID NO: 568975 - RNA, 22 nt, Human
cacgugccucuggcugcuggag

SEQ ID NO: 568976 - RNA, 24 nt, Human
cagaaugcacacuccccaugcgcu

SEQ ID NO: 568977 - RNA, 21 nt, Human
caggcaucuggccagggaaga

SEQ ID NO: 568978 - RNA, 19 nt, Human
cauggaauuaaugacaggg

SEQ ID NO: 568979 - RNA, 24 nt, Human
ccaauucuaaaaguaaaaauaaac

SEQ ID NO: 568980 - RNA, 19 nt, Human
ccagcacacacagucccca

SEQ ID NO: 568981 - RNA, 26 nt, Human
ccagcacacacaguccccaauuuaaa

SEQ ID NO: 568982 - RNA, 20 nt, Human
ccgcuuuauagaauaaaauc

SEQ ID NO: 568983 - RNA, 26 nt, Human
ccuggcaccccggguuagaccucaga

SEQ ID NO: 568984 - RNA, 19 nt, Human
cgucuaacugcagcucugu

SEQ ID NO: 568985 - RNA, 20 nt, Human
cucaaaaaucauucccuugu

SEQ ID NO: 568986 - RNA, 23 nt, Human
cucacacacacaccagcacacac

SEQ ID NO: 568987 - RNA, 22 nt, Human
cuuggcaaaaagaauugccaga

SEQ ID NO: 568988 - RNA, 18 nt, Human
gaaauggaauuuuuuuuc

SEQ ID NO: 568989 - RNA, 23 nt, Human
gaauugccagauucaaccagggc

SEQ ID NO: 568990 - RNA, 18 nt, Human
gaguugagcaggugaugc

SEQ ID NO: 568991 - RNA, 20 nt, Human
gaguuucagcuucccgcuug

SEQ ID NO: 568992 - RNA, 21 nt, Human
gcagaggccaugaaagaacuc

SEQ ID NO: 568993 - RNA, 22 nt, Human
gcccaaggcuuuauuuaccagc

SEQ ID NO: 568994 - RNA, 19 nt, Human
gcugauacagauggugguu

SEQ ID NO: 568995 - RNA, 25 nt, Human
ggaccaauucuaaaaguaaaaauaa

SEQ ID NO: 568996 - RNA, 21 nt, Human
gggaauaaauaggcauuugua

SEQ ID NO: 568997 - RNA, 21 nt, Human
guauauacauacauauauaua

SEQ ID NO: 568998 - RNA, 22 nt, Human
guauauauguauauauaugaaa

SEQ ID NO: 568999 - RNA, 25 nt, Human
gucaccucuuaaauaugcuggauuc

SEQ ID NO: 569000 - RNA, 24 nt, Human
guguauauacauacauauauauac

SEQ ID NO: 569001 - RNA, 21 nt, Human
uaaaaguaaaaauaaacaccc

SEQ ID NO: 569002 - RNA, 22 nt, Human
uaagaagucgcuugcccaaggc

SEQ ID NO: 569003 - RNA, 20 nt, Human
uaagcaacuccucucuucaa

SEQ ID NO: 569004 - RNA, 22 nt, Human
uaagugcuuuggcacgggccac

SEQ ID NO: 569005 - RNA, 22 nt, Human
uacguguguauauacauacaua

SEQ ID NO: 569006 - RNA, 22 nt, Human
uagaauaaaauccuucaguucc

SEQ ID NO: 569007 - RNA, 25 nt, Human
uagaauaaaauccuucaguuccauc

SEQ ID NO: 569008 - RNA, 22 nt, Human
uauauacauacauauauauaca

SEQ ID NO: 569009 - RNA, 22 nt, Human
uauauacauacauauauauaca

SEQ ID NO: 569010 - RNA, 27 nt, Human
uauauacauacauauauauacaggaaa

SEQ ID NO: 569011 - RNA, 20 nt, Human
uauauauaugaauguaugua

SEQ ID NO: 569012 - RNA, 26 nt, Human
uauaugaauguauguacguguguaua

SEQ ID NO: 569013 - RNA, 19 nt, Human
uauauguauauauaugaau

SEQ ID NO: 569014 - RNA, 20 nt, Human
uauguacguguguauauaca

SEQ ID NO: 569015 - RNA, 21 nt, Human
uauguauauauaugaauguau

SEQ ID NO: 569016 - RNA, 24 nt, Human
uauguauauauaugaauguaugua

SEQ ID NO: 569017 - RNA, 18 nt, Human
uauguauauauguauaua

SEQ ID NO: 569018 - RNA, 20 nt, Human
uauguauauauguauauaua

SEQ ID NO: 569019 - RNA, 22 nt, Human
uauguauauauguauauauaug

SEQ ID NO: 569020 - RNA, 20 nt, Human
uauguauauauguauauauu

SEQ ID NO: 569021 - RNA, 22 nt, Human
uauuaaacugaucacauauggu

SEQ ID NO: 569022 - RNA, 26 nt, Human
ucaaugcuacacacaggccuuaacac

SEQ ID NO: 569023 - RNA, 24 nt, Human
ucagaaggggccacucacacaagu

SEQ ID NO: 569024 - RNA, 24 nt, Human
ucccuuguuuucaagggcucuucu

SEQ ID NO: 569025 - RNA, 18 nt, Human
ucuaugcugggauggagg

SEQ ID NO: 569026 - RNA, 19 nt, Human
ucugaucaggcaucuggcc

SEQ ID NO: 569027 - RNA, 19 nt, Human
ucuuagucaucaucacuuu

SEQ ID NO: 569028 - RNA, 21 nt, Human
ugaguucugaucuaagaaguc

SEQ ID NO: 569029 - RNA, 24 nt, Human
ugccacuuagcuugauaacgacuc

SEQ ID NO: 569030 - RNA, 24 nt, Human
ugcuggagagauucagaaggggcc

SEQ ID NO: 569031 - RNA, 18 nt, Human
ugcugggauggaggaugu

SEQ ID NO: 569032 - RNA, 22 nt, Human
ugcuuuggcacgggccacuguu

SEQ ID NO: 569033 - RNA, 25 nt, Human
uggauaaagagcccauucuaggcac

SEQ ID NO: 569034 - RNA, 19 nt, Human
uggcaaaaagaauugccag

SEQ ID NO: 569035 - RNA, 23 nt, Human
ugggauggaggauguguguguuc

SEQ ID NO: 569036 - RNA, 19 nt, Human
uguacguguguauauacau

SEQ ID NO: 569037 - RNA, 20 nt, Human
uguauauacauacauauaua

SEQ ID NO: 569038 - RNA, 19 nt, Human
uguauauauguauauauau

SEQ ID NO: 569039 - RNA, 29 nt, Human
uguauauauguauauauaugaauguaugu

SEQ ID NO: 569040 - RNA, 21 nt, Human
uguaugaaugaccuauaugua

SEQ ID NO: 569041 - RNA, 18 nt, Human
uguguauauacauacaua

SEQ ID NO: 569042 - RNA, 22 nt, Human
uguguauauacauacauauagu

SEQ ID NO: 569043 - RNA, 22 nt, Human
uguguauauacauacauauaua

SEQ ID NO: 569044 - RNA, 25 nt, Human
uguguauauacauacauauauauag

SEQ ID NO: 569045 - RNA, 23 nt, Human
uguguguguguuucuauauauuu

SEQ ID NO: 569046 - RNA, 23 nt, Human
uguuccuggcaccccggguuaga

SEQ ID NO: 569047 - RNA, 25 nt, Human
uuccccuggagcuacagagaaaaga

SEQ ID NO: 569048 - RNA, 22 nt, Human
uuucaagggcucuucuuucuug

SEQ ID NO: 569049 - RNA, 20 nt, Human
aggaauuugacugaaaaguu

SEQ ID NO: 569050 - RNA, 19 nt, Human
agggcuccuacccuuggcu

SEQ ID NO: 569051 - RNA, 18 nt, Human
caagaccagggucccagc

SEQ ID NO: 569052 - RNA, 24 nt, Human
caggcuuuauuccagccucuuuuu

SEQ ID NO: 569053 - RNA, 21 nt, Human
ccuacccuuggcuccagcaau

SEQ ID NO: 569054 - RNA, 22 nt, Human
gaggccuccaggaaggaaccgg

SEQ ID NO: 569055 - RNA, 19 nt, Human
gccgcagucgcuugggcag

SEQ ID NO: 569056 - RNA, 23 nt, Human
ggacaggaggccuccaggaagga

SEQ ID NO: 569057 - RNA, 19 nt, Human
gugcugggguccccgagga

SEQ ID NO: 569058 - RNA, 22 nt, Human
uacccuuggcuccagcaaugcu

SEQ ID NO: 569059 - RNA, 19 nt, Human
ucccauccugggcuccuag

SEQ ID NO: 569060 - RNA, 23 nt, Human
uccccgaggacaggaggccucca

SEQ ID NO: 569061 - RNA, 24 nt, Human
uccugggcuccuaguguagggcuc

SEQ ID NO: 569062 - RNA, 18 nt, Human
ugcugggguccccgagga

SEQ ID NO: 569063 - RNA, 23 nt, Human
uugaggaauuugacugaaaaguu

SEQ ID NO: 569064 - RNA, 21 nt, Human
cugagggguggauggcuggag

SEQ ID NO: 569065 - RNA, 19 nt, Human
gagggguggauggcuggag

SEQ ID NO: 569066 - RNA, 24 nt, Human
gagggguggauggcuggagcuggg

SEQ ID NO: 569067 - RNA, 18 nt, Human
ggugacguugaagaaaag

SEQ ID NO: 569068 - RNA, 23 nt, Human
ugaagaaaagggcugaggggugg

SEQ ID NO: 569069 - RNA, 22 nt, Human
ugacguugaagaaaagggcuga

SEQ ID NO: 569070 - RNA, 18 nt, Human
uggauggcuggagcuggg

SEQ ID NO: 569071 - RNA, 22 nt, Human
aaaaacauuuccagagagaaca

SEQ ID NO: 569072 - RNA, 21 nt, Human
agagagaacacuuuauaccau

SEQ ID NO: 569073 - RNA, 21 nt, Human
aguacaaaaaugacagcugaa

SEQ ID NO: 569074 - RNA, 23 nt, Human
cacagucgggagugucuggugcc

SEQ ID NO: 569075 - RNA, 19 nt, Human
caccgguccuucccaggcu

SEQ ID NO: 569076 - RNA, 19 nt, Human
cagccucucuggaaaaggc

SEQ ID NO: 569077 - RNA, 24 nt, Human
ccugcagugaaaacgaacagaggc

SEQ ID NO: 569078 - RNA, 18 nt, Human
cuucccaggcuuccuaag

SEQ ID NO: 569079 - RNA, 19 nt, Human
gcaaagagaagccuaagaa

SEQ ID NO: 569080 - RNA, 22 nt, Human
gcacaccgguccuucccaggcu

SEQ ID NO: 569081 - RNA, 18 nt, Human
gcuggcugggcggggaga

SEQ ID NO: 569082 - RNA, 25 nt, Human
uaccauaaaauaaacuuguauaauu

SEQ ID NO: 569083 - RNA, 24 nt, Human
uauaucgaauuccgcacaaaauau

SEQ ID NO: 569084 - RNA, 22 nt, Human
ucccaggcuuccuaagagcagg

SEQ ID NO: 569085 - RNA, 22 nt, Human
ucgcaaagagaagccuaagaau

SEQ ID NO: 569086 - RNA, 21 nt, Human
ucuggaaaaggcugcuggcug

SEQ ID NO: 569087 - RNA, 18 nt, Human
ugccugguccugcaguga

SEQ ID NO: 569088 - RNA, 19 nt, Human
uucccaggcuuccuaagag

SEQ ID NO: 569089 - RNA, 21 nt, Human
aacccuccgcucgccuccgcu

SEQ ID NO: 569090 - RNA, 23 nt, Human
acaccacugcacucagccuaggc

SEQ ID NO: 569091 - RNA, 21 nt, Human
acccuccgcucgccuccgcug

SEQ ID NO: 569092 - RNA, 20 nt, Human
acugcacucagccuaggcag

SEQ ID NO: 569093 - RNA, 23 nt, Human
acugcacucagccuaggcagcag

SEQ ID NO: 569094 - RNA, 24 nt, Human
agcagagugagacuccgccgcggg

SEQ ID NO: 569095 - RNA, 24 nt, Human
agccuaggcagcagagugagacuc

SEQ ID NO: 569096 - RNA, 24 nt, Human
aggaggucaaggcugcagugcgcc

SEQ ID NO: 569097 - RNA, 22 nt, Human
aggccgaggugaggaucgcuug

SEQ ID NO: 569098 - RNA, 20 nt, Human
aguguaguggcgcgugccug

SEQ ID NO: 569099 - RNA, 19 nt, Human
aucacaccacugcacucag

SEQ ID NO: 569100 - RNA, 22 nt, Human
cacugcacucagccuaggcagc

SEQ ID NO: 569101 - RNA, 20 nt, Human
cagaaaagcagccuugccag

SEQ ID NO: 569102 - RNA, 21 nt, Human
cagcagagugagacuccgccg

SEQ ID NO: 569103 - RNA, 18 nt, Human
ccacugcacucagccuag

SEQ ID NO: 569104 - RNA, 19 nt, Human
ccacugcacucagccuagg

SEQ ID NO: 569105 - RNA, 20 nt, Human
ccacugcacucagccuaggc

SEQ ID NO: 569106 - RNA, 23 nt, Human
ccacugcacucagccuaggcagc

SEQ ID NO: 569107 - RNA, 21 nt, Human
ccgcucgccuccgcugcuacc

SEQ ID NO: 569108 - RNA, 19 nt, Human
ccuguagucccagcuacuc

SEQ ID NO: 569109 - RNA, 21 nt, Human
ccuguagucccagcuacucgg

SEQ ID NO: 569110 - RNA, 24 nt, Human
ccuguagucccagcuacucgguag

SEQ ID NO: 569111 - RNA, 21 nt, Human
cuuguggacaagucugacugu

SEQ ID NO: 569112 - RNA, 22 nt, Human
gcgccucgaucacaccacugca

SEQ ID NO: 569113 - RNA, 24 nt, Human
gcucaggaggucaaggcugcagug

SEQ ID NO: 569114 - RNA, 18 nt, Human
ggaaacccuccgcucgcc

SEQ ID NO: 569115 - RNA, 21 nt, Human
uaccacuuuuaccgcggccag

SEQ ID NO: 569116 - RNA, 24 nt, Human
uaguggcgcgugccuguaguccca

SEQ ID NO: 569117 - RNA, 21 nt, Human
uccgcugcuaccacuuuuacc

SEQ ID NO: 569118 - RNA, 18 nt, Human
ucgcuugagcucaggagg

SEQ ID NO: 569119 - RNA, 18 nt, Human
ucuuguggacaagucuga

SEQ ID NO: 569120 - RNA, 24 nt, Human
ugcacucagccuaggcagcagagu

SEQ ID NO: 569121 - RNA, 23 nt, Human
ugccuguagucccagcuacucgg

SEQ ID NO: 569122 - RNA, 24 nt, Human
uggcgcgugccuguagucccagcu

SEQ ID NO: 569123 - RNA, 21 nt, Human
uuagcacagaaaagcagccuu

SEQ ID NO: 569124 - RNA, 19 nt, Human
aaaccaccgcucccccucc

SEQ ID NO: 569125 - RNA, 22 nt, Human
aaaccgucaggauuugaaucug

SEQ ID NO: 569126 - RNA, 24 nt, Human
acuucaccucuucaucgaccccag

SEQ ID NO: 569127 - RNA, 22 nt, Human
agggagccucucaggggguggc

SEQ ID NO: 569128 - RNA, 23 nt, Human
agggaguggggacccugcaugcu

SEQ ID NO: 569129 - RNA, 23 nt, Human
augcagcuuucuuucauuugguc

SEQ ID NO: 569130 - RNA, 23 nt, Human
caaagcugcuccucuuccccaga

SEQ ID NO: 569131 - RNA, 20 nt, Human
caccccuccuuccagggcca

SEQ ID NO: 569132 - RNA, 21 nt, Human
caccccuccuuccagggccca

SEQ ID NO: 569133 - RNA, 19 nt, Human
ccaccccuccuuccagggc

SEQ ID NO: 569134 - RNA, 19 nt, Human
ccacgcccaguagcaccug

SEQ ID NO: 569135 - RNA, 19 nt, Human
ccagcuccgccugacaacc

SEQ ID NO: 569136 - RNA, 20 nt, Human
cccaugcuggacuggaaggg

SEQ ID NO: 569137 - RNA, 23 nt, Human
ccccagagagggaguggggaccc

SEQ ID NO: 569138 - RNA, 21 nt, Human
cccccggggucuucuggcagg

SEQ ID NO: 569139 - RNA, 19 nt, Human
ccccuuccaggcaaagcug

SEQ ID NO: 569140 - RNA, 19 nt, Human
cccugcaugcugcccccuc

SEQ ID NO: 569141 - RNA, 22 nt, Human
cccugcaugcugcccccucccc

SEQ ID NO: 569142 - RNA, 22 nt, Human
cccugcaugcugcccccucccc

SEQ ID NO: 569143 - RNA, 20 nt, Human
ccgcucccccuccuaggagg

SEQ ID NO: 569144 - RNA, 20 nt, Human
ccuccccgcccccggggucu

SEQ ID NO: 569145 - RNA, 21 nt, Human
ccuugcggcgggagccagggc

SEQ ID NO: 569146 - RNA, 22 nt, Human
cgaccccagagagggagugggg

SEQ ID NO: 569147 - RNA, 22 nt, Human
cggggucuucuggcaggacugg

SEQ ID NO: 569148 - RNA, 20 nt, Human
cuaaagccugagcuagaaac

SEQ ID NO: 569149 - RNA, 22 nt, Human
cuaaagccugagcuagaaacca

SEQ ID NO: 569150 - RNA, 25 nt, Human
cuccccuaccagcuccgccugacaa

SEQ ID NO: 569151 - RNA, 22 nt, Human
cucucugauccuaaagccugag

SEQ ID NO: 569152 - RNA, 21 nt, Human
cucuuccccagacccaugcug

SEQ ID NO: 569153 - RNA, 24 nt, Human
cugauccuaaagccugagcuagaa

SEQ ID NO: 569154 - RNA, 18 nt, Human
cugcaugcugcccccucc

SEQ ID NO: 569155 - RNA, 20 nt, Human
cugcucucugauccuaaagc

SEQ ID NO: 569156 - RNA, 18 nt, Human
gccccuuccaggcaaagc

SEQ ID NO: 569157 - RNA, 19 nt, Human
gccccuuccaggcaaagcu

SEQ ID NO: 569158 - RNA, 18 nt, Human
gcggcgggagccagggcc

SEQ ID NO: 569159 - RNA, 21 nt, Human
gcgguccacgcccaguagcac

SEQ ID NO: 569160 - RNA, 21 nt, Human
gcucuggggggcagcuccccu

SEQ ID NO: 569161 - RNA, 18 nt, Human
gcugcccccuccccgccc

SEQ ID NO: 569162 - RNA, 22 nt, Human
gcuuucuuucauuuggucacuu

SEQ ID NO: 569163 - RNA, 21 nt, Human
ggacuggaagggaggggacug

SEQ ID NO: 569164 - RNA, 21 nt, Human
ggccccuuccaggcaaagcug

SEQ ID NO: 569165 - RNA, 22 nt, Human
uagaaaccaccgcucccccucc

SEQ ID NO: 569166 - RNA, 21 nt, Human
uccccagacccaugcuggacu

SEQ ID NO: 569167 - RNA, 20 nt, Human
ugcugcucucugauccuaaa

SEQ ID NO: 569168 - RNA, 24 nt, Human
ugggagcugugggggccgaggcag

SEQ ID NO: 569169 - RNA, 22 nt, Human
uggggaagggagccucucaggg

SEQ ID NO: 569170 - RNA, 21 nt, Human
uucaccucuucaucgacccca

SEQ ID NO: 569171 - RNA, 20 nt, Human
uucgcagaucaaguaaacgg

SEQ ID NO: 569172 - RNA, 24 nt, Human
uucuggcaggacuggggaagggag

SEQ ID NO: 569173 - RNA, 26 nt, Human
aaccuucaacccuggauccagcagcc

SEQ ID NO: 569174 - RNA, 22 nt, Human
aauacauucccagcagcugccu

SEQ ID NO: 569175 - RNA, 23 nt, Human
aauguccaguuauccuuggaugg

SEQ ID NO: 569176 - RNA, 21 nt, Human
accagcaccgccguccgcacc

SEQ ID NO: 569177 - RNA, 19 nt, Human
acccccggccauccuccuc

SEQ ID NO: 569178 - RNA, 19 nt, Human
acccuggauccagcagccu

SEQ ID NO: 569179 - RNA, 24 nt, Human
accuaauuuuucuccucccugcaa

SEQ ID NO: 569180 - RNA, 20 nt, Human
auacauucccagcagcugcc

SEQ ID NO: 569181 - RNA, 26 nt, Human
auccugcuuaugucucacugauucca

SEQ ID NO: 569182 - RNA, 21 nt, Human
aucucugucucaauuuggaag

SEQ ID NO: 569183 - RNA, 20 nt, Human
auugucucuuuuuccccagu

SEQ ID NO: 569184 - RNA, 21 nt, Human
caacccuggauccagcagccu

SEQ ID NO: 569185 - RNA, 22 nt, Human
caccagcaccgccguccgcacc

SEQ ID NO: 569186 - RNA, 20 nt, Human
caccgccgccgccgcccucu

SEQ ID NO: 569187 - RNA, 22 nt, Human
caccgccguccgcaccggcgcc

SEQ ID NO: 569188 - RNA, 18 nt, Human
caccggcgccagcacccc

SEQ ID NO: 569189 - RNA, 25 nt, Human
ccaccagcaccgccguccgcaccgg

SEQ ID NO: 569190 - RNA, 27 nt, Human
ccagcagccucuuuucauccauuuccc

SEQ ID NO: 569191 - RNA, 28 nt, Human
ccagcagccucuuuucauccauuucccg

SEQ ID NO: 569192 - RNA, 21 nt, Human
ccccggccauccuccucccac

SEQ ID NO: 569193 - RNA, 20 nt, Human
ccccucgccgccauuuugac

SEQ ID NO: 569194 - RNA, 19 nt, Human
cccuggauccagcagccuc

SEQ ID NO: 569195 - RNA, 22 nt, Human
cccuggaugaauacucuaguuu

SEQ ID NO: 569196 - RNA, 18 nt, Human
ccgcccucuccucuccug

SEQ ID NO: 569197 - RNA, 23 nt, Human
ccgccgccgccaccagcaccgcc

SEQ ID NO: 569198 - RNA, 19 nt, Human
ccgccgccgcccucuccuc

SEQ ID NO: 569199 - RNA, 19 nt, Human
ccgccgccgccgccaccag

SEQ ID NO: 569200 - RNA, 27 nt, Human
ccgcugccgucgccuccgccgccgccg

SEQ ID NO: 569201 - RNA, 19 nt, Human
ccgcugcugcugccgcugg

SEQ ID NO: 569202 - RNA, 18 nt, Human
ccucccaccgccgccgcc

SEQ ID NO: 569203 - RNA, 23 nt, Human
ccucccaccgccgccgccgcccu

SEQ ID NO: 569204 - RNA, 21 nt, Human
ccucccgccgcugcugcugcc

SEQ ID NO: 569205 - RNA, 22 nt, Human
ccuggauccagcagccucuuuu

SEQ ID NO: 569206 - RNA, 20 nt, Human
ccuucacuucucuguucuug

SEQ ID NO: 569207 - RNA, 19 nt, Human
ccuuugcuuccuucccgug

SEQ ID NO: 569208 - RNA, 22 nt, Human
cgccagcacccccggccauccu

SEQ ID NO: 569209 - RNA, 25 nt, Human
cucccgccgcugcugcugccgcugg

SEQ ID NO: 569210 - RNA, 22 nt, Human
cuccgccgccgccgccaccagc

SEQ ID NO: 569211 - RNA, 20 nt, Human
cuccucccgccgcugcugcu

SEQ ID NO: 569212 - RNA, 21 nt, Human
cuccuuagauacugucuucuc

SEQ ID NO: 569213 - RNA, 21 nt, Human
cucuguucuugguuugcuucg

SEQ ID NO: 569214 - RNA, 23 nt, Human
cugguauauauuucuaaagccuc

SEQ ID NO: 569215 - RNA, 20 nt, Human
gcauggaaccuaauuuuucu

SEQ ID NO: 569216 - RNA, 24 nt, Human
gccgccgccgccaccagcaccgcc

SEQ ID NO: 569217 - RNA, 18 nt, Human
gccgucgccuccgccgcc

SEQ ID NO: 569218 - RNA, 21 nt, Human
gccgucgccuccgccgccgcc

SEQ ID NO: 569219 - RNA, 18 nt, Human
gcgccagcacccccggcc

SEQ ID NO: 569220 - RNA, 21 nt, Human
gcuuuuggaagacacuacuuc

SEQ ID NO: 569221 - RNA, 19 nt, Human
ggaagcuuuccucaaaugu

SEQ ID NO: 569222 - RNA, 20 nt, Human
guucuucagaguauaauccc

SEQ ID NO: 569223 - RNA, 19 nt, Human
uagauccuucacuucucug

SEQ ID NO: 569224 - RNA, 20 nt, Human
uauauuucuaaagccacuau

SEQ ID NO: 569225 - RNA, 23 nt, Human
ucaaauguccaguuauccuugga

SEQ ID NO: 569226 - RNA, 23 nt, Human
ucaacccuggauccagcagccuc

SEQ ID NO: 569227 - RNA, 21 nt, Human
ucaauuuggaagcuuuccuca

SEQ ID NO: 569228 - RNA, 24 nt, Human
ucccaccgccgccgccgcccucuc

SEQ ID NO: 569229 - RNA, 19 nt, Human
ucccagcagcugccugagu

SEQ ID NO: 569230 - RNA, 22 nt, Human
uccccaguguucugaaaaagaa

SEQ ID NO: 569231 - RNA, 22 nt, Human
ucccggucugggcuagacugaa

SEQ ID NO: 569232 - RNA, 21 nt, Human
uccucccgccgcugcugcugc

SEQ ID NO: 569233 - RNA, 19 nt, Human
uccuucccguguuggagcc

SEQ ID NO: 569234 - RNA, 21 nt, Human
ucuaaaagcuccuguuuuuac

SEQ ID NO: 569235 - RNA, 20 nt, Human
ucucaauaccaucugauucc

SEQ ID NO: 569236 - RNA, 24 nt, Human
ucucuguucuugguuugcuucguc

SEQ ID NO: 569237 - RNA, 20 nt, Human
ucuucucuucacuuuucucu

SEQ ID NO: 569238 - RNA, 25 nt, Human
ugaaaaagaaacuuuuuauauagaa

SEQ ID NO: 569239 - RNA, 22 nt, Human
ugaaaaucucaauaccaucuga

SEQ ID NO: 569240 - RNA, 23 nt, Human
ugaaccuucaacccuggauccag

SEQ ID NO: 569241 - RNA, 30 nt, Human
ugaaccuucaacccuggauccagcagccuu

SEQ ID NO: 569242 - RNA, 20 nt, Human
ugaugcgugggaucucccuu

SEQ ID NO: 569243 - RNA, 21 nt, Human
ugauuucuuccgagacaccuc

SEQ ID NO: 569244 - RNA, 26 nt, Human
uggcucaggcuccgggacugcuccag

SEQ ID NO: 569245 - RNA, 19 nt, Human
uguuuggcuaaauauagga

SEQ ID NO: 569246 - RNA, 22 nt, Human
uucauugucugcuuccuccagg

SEQ ID NO: 569247 - RNA, 22 nt, Human
uuccccucgccgccauuuugac

SEQ ID NO: 569248 - RNA, 22 nt, Human
uugcauggaaccuaauuuuucu

SEQ ID NO: 569249 - RNA, 21 nt, Human
uuggaagcuuuccucaaaugu

SEQ ID NO: 569250 - RNA, 22 nt, Human
uuggagacuuucacccucccgg

SEQ ID NO: 569251 - RNA, 30 nt, Human
uugucugcuuccuccaggacuuuguucuuu

SEQ ID NO: 569252 - RNA, 18 nt, Human
uuuggcuaaauauaggau

SEQ ID NO: 569253 - RNA, 19 nt, Human
uuugucuccacucaucucu

SEQ ID NO: 569254 - RNA, 24 nt, Human
aaagugcugggauuacagguguga

SEQ ID NO: 569255 - RNA, 26 nt, Human
aaccccaaaggaccacacuuuggcac

SEQ ID NO: 569256 - RNA, 19 nt, Human
aacuucuguuuccuccucu

SEQ ID NO: 569257 - RNA, 18 nt, Human
aagaagacuggcaacuuc

SEQ ID NO: 569258 - RNA, 27 nt, Human
aagcauuucagaaguuuuuccuuacgg

SEQ ID NO: 569259 - RNA, 22 nt, Human
aagcuuucaaagcacucaguuu

SEQ ID NO: 569260 - RNA, 19 nt, Human
aaguagcugggauuacaga

SEQ ID NO: 569261 - RNA, 26 nt, Human
aaguagcugggauuacagacgaaugc

SEQ ID NO: 569262 - RNA, 23 nt, Human
aagucaguucuaugacuagcuuu

SEQ ID NO: 569263 - RNA, 18 nt, Human
aagugcugggauuacagg

SEQ ID NO: 569264 - RNA, 19 nt, Human
aagugcugggauuacaggu

SEQ ID NO: 569265 - RNA, 26 nt, Human
aagugcugggauuacaggugugagcc

SEQ ID NO: 569266 - RNA, 24 nt, Human
aauuuuuguauuuuaguagagacg

SEQ ID NO: 569267 - RNA, 23 nt, Human
acagaacaugguggaagugaugc

SEQ ID NO: 569268 - RNA, 18 nt, Human
acagacgaaugccaccau

SEQ ID NO: 569269 - RNA, 25 nt, Human
acagcagaagaaccaccuagcugaa

SEQ ID NO: 569270 - RNA, 22 nt, Human
accauguuggccaggcuggucu

SEQ ID NO: 569271 - RNA, 24 nt, Human
acggugucucaccauguuggccag

SEQ ID NO: 569272 - RNA, 20 nt, Human
agaagacuggcaacuucugu

SEQ ID NO: 569273 - RNA, 21 nt, Human
agcugcauuuacacaaaaguu

SEQ ID NO: 569274 - RNA, 20 nt, Human
aggcauuuagugaugcagca

SEQ ID NO: 569275 - RNA, 25 nt, Human
aggcuggagugcaguggagugaucu

SEQ ID NO: 569276 - RNA, 26 nt, Human
agggaacagcagaagaaccaccuagc

SEQ ID NO: 569277 - RNA, 23 nt, Human
agugcaguggagugaucuuggcu

SEQ ID NO: 569278 - RNA, 24 nt, Human
agugcaguggagugaucuuggcuc

SEQ ID NO: 569279 - RNA, 19 nt, Human
aucaaguagcugggauuac

SEQ ID NO: 569280 - RNA, 21 nt, Human
caaaggaccacacuuuggcac

SEQ ID NO: 569281 - RNA, 18 nt, Human
caaagucaguucuaugac

SEQ ID NO: 569282 - RNA, 24 nt, Human
caaagugcugggauuacaggugug

SEQ ID NO: 569283 - RNA, 20 nt, Human
caaccucuaucuccuggguu

SEQ ID NO: 569284 - RNA, 23 nt, Human
caaccucuaucuccuggguucaa

SEQ ID NO: 569285 - RNA, 18 nt, Human
caacuucuguuuccuccu

SEQ ID NO: 569286 - RNA, 22 nt, Human
caagcaauucuuuugccucagc

SEQ ID NO: 569287 - RNA, 18 nt, Human
caccaugucuggcuaauu

SEQ ID NO: 569288 - RNA, 24 nt, Human
caccaugucuggcuaauuuuugua

SEQ ID NO: 569289 - RNA, 21 nt, Human
caccauguuggccaggcuggu

SEQ ID NO: 569290 - RNA, 23 nt, Human
caccauguuggccaggcuggucu

SEQ ID NO: 569291 - RNA, 24 nt, Human
caccauguuggccaggcuggucuu

SEQ ID NO: 569292 - RNA, 27 nt, Human
caccauguuggccaggcuggucuugaa

SEQ ID NO: 569293 - RNA, 21 nt, Human
caccuagcugaacucagcaac

SEQ ID NO: 569294 - RNA, 24 nt, Human
caccucggccucccaaagugcugg

SEQ ID NO: 569295 - RNA, 19 nt, Human
cagcaauaguuaacagcac

SEQ ID NO: 569296 - RNA, 24 nt, Human
cauguuggccaggcuggucuugaa

SEQ ID NO: 569297 - RNA, 24 nt, Human
cauucugucgcccaggcuggagug

SEQ ID NO: 569298 - RNA, 21 nt, Human
ccaaagugcugggauuacagg

SEQ ID NO: 569299 - RNA, 21 nt, Human
ccaaagugcugggauuacagg

SEQ ID NO: 569300 - RNA, 24 nt, Human
ccaaagugcugggauuacaggugu

SEQ ID NO: 569301 - RNA, 19 nt, Human
ccucuggaugacuccaguc

SEQ ID NO: 569302 - RNA, 19 nt, Human
ccugaccucaagugaucug

SEQ ID NO: 569303 - RNA, 24 nt, Human
ccugaccucaagugaucugcccac

SEQ ID NO: 569304 - RNA, 21 nt, Human
ccuggguucaagcaauucuuu

SEQ ID NO: 569305 - RNA, 18 nt, Human
ccuuguguaguccucuuc

SEQ ID NO: 569306 - RNA, 24 nt, Human
cggugucucaccauguuggccagg

SEQ ID NO: 569307 - RNA, 24 nt, Human
cucaagugaucugcccaccucggc

SEQ ID NO: 569308 - RNA, 24 nt, Human
cucauucugucgcccaggcuggag

SEQ ID NO: 569309 - RNA, 24 nt, Human
cucauugcaaccucuaucuccugg

SEQ ID NO: 569310 - RNA, 21 nt, Human
cuccuggguucaagcaauucu

SEQ ID NO: 569311 - RNA, 23 nt, Human
cugggcucauaugagagaaaucu

SEQ ID NO: 569312 - RNA, 24 nt, Human
gaccucaagugaucugcccaccuc

SEQ ID NO: 569313 - RNA, 24 nt, Human
gagccaccacauccagcccaucua

SEQ ID NO: 569314 - RNA, 18 nt, Human
gauuacagacgaaugcca

SEQ ID NO: 569315 - RNA, 24 nt, Human
gauuacagacgaaugccaccaugu

SEQ ID NO: 569316 - RNA, 18 nt, Human
gauuacaggugugagcca

SEQ ID NO: 569317 - RNA, 21 nt, Human
gauuacaggugugagccacca

SEQ ID NO: 569318 - RNA, 22 nt, Human
gauuacaggugugagccaccac

SEQ ID NO: 569319 - RNA, 22 nt, Human
gcaaccucuaucuccuggguuc

SEQ ID NO: 569320 - RNA, 22 nt, Human
gccucuggaugacuccagucuu

SEQ ID NO: 569321 - RNA, 21 nt, Human
gcucauugcaaccucuaucuc

SEQ ID NO: 569322 - RNA, 23 nt, Human
gcuggucuugaacuccugaccuc

SEQ ID NO: 569323 - RNA, 21 nt, Human
gcuuuugggagcccugggcuc

SEQ ID NO: 569324 - RNA, 21 nt, Human
ggagcugcauuuacacaaaag

SEQ ID NO: 569325 - RNA, 23 nt, Human
ggagucuucccauauaaggcacu

SEQ ID NO: 569326 - RNA, 24 nt, Human
ggaugacuccagucuuaguagucc

SEQ ID NO: 569327 - RNA, 19 nt, Human
ggcuggagugcaguggagu

SEQ ID NO: 569328 - RNA, 24 nt, Human
ggcuggucuugaacuccugaccuc

SEQ ID NO: 569329 - RNA, 20 nt, Human
gggccucuggaugacuccag

SEQ ID NO: 569330 - RNA, 19 nt, Human
ggucuugaacuccugaccu

SEQ ID NO: 569331 - RNA, 23 nt, Human
ggugucucaccauguuggccagg

SEQ ID NO: 569332 - RNA, 24 nt, Human
gugaucugcccaccucggccuccc

SEQ ID NO: 569333 - RNA, 20 nt, Human
uaacagcacaugugacggaa

SEQ ID NO: 569334 - RNA, 23 nt, Human
uaauuuuuguauuuuaguagaga

SEQ ID NO: 569335 - RNA, 20 nt, Human
uacacgugacauuaucucac

SEQ ID NO: 569336 - RNA, 24 nt, Human
uacaggugugagccaccacaucca

SEQ ID NO: 569337 - RNA, 18 nt, Human
uacauggauagggggcaa

SEQ ID NO: 569338 - RNA, 21 nt, Human
uaccaaagugauuugcugucc

SEQ ID NO: 569339 - RNA, 26 nt, Human
uacuuuuucaucuauuuguuuuuggu

SEQ ID NO: 569340 - RNA, 22 nt, Human
uagagacggugucucaccaugu

SEQ ID NO: 569341 - RNA, 24 nt, Human
uaguagagacggugucucaccaug

SEQ ID NO: 569342 - RNA, 20 nt, Human
uauccuguaggcucucuguu

SEQ ID NO: 569343 - RNA, 22 nt, Human
uaugacuuuaaccaacagaaca

SEQ ID NO: 569344 - RNA, 21 nt, Human
uauuuguuuuauguaaucuaa

SEQ ID NO: 569345 - RNA, 20 nt, Human
ucaaagaugaaccccaaagg

SEQ ID NO: 569346 - RNA, 22 nt, Human
ucaaagcauuucagaaguuuac

SEQ ID NO: 569347 - RNA, 24 nt, Human
ucauucugucgcccaggcuggagu

SEQ ID NO: 569348 - RNA, 24 nt, Human
ucauugcaaccucuaucuccuggg

SEQ ID NO: 569349 - RNA, 18 nt, Human
uccaagcuggucuaugac

SEQ ID NO: 569350 - RNA, 23 nt, Human
ucccaaagugcugggauuacagg

SEQ ID NO: 569351 - RNA, 21 nt, Human
uccuggguucaagcaauucuu

SEQ ID NO: 569352 - RNA, 24 nt, Human
uccuggguucaagcaauucuuuug

SEQ ID NO: 569353 - RNA, 18 nt, Human
uccuucauggcauccuuc

SEQ ID NO: 569354 - RNA, 23 nt, Human
ucgcccaggcuggagugcagugg

SEQ ID NO: 569355 - RNA, 18 nt, Human
ucggccucccaaagugcu

SEQ ID NO: 569356 - RNA, 24 nt, Human
ucuaucuccuggguucaagcaauu

SEQ ID NO: 569357 - RNA, 24 nt, Human
ucucaccauguuggccaggcuggu

SEQ ID NO: 569358 - RNA, 23 nt, Human
ucucauucugucgcccaggcugg

SEQ ID NO: 569359 - RNA, 24 nt, Human
ucucauucugucgcccaggcugga

SEQ ID NO: 569360 - RNA, 24 nt, Human
ucuccuggguucaagcaauucuuu

SEQ ID NO: 569361 - RNA, 22 nt, Human
ucugucgcccaggcuggagugc

SEQ ID NO: 569362 - RNA, 24 nt, Human
ucugucgcccaggcuggagugcag

SEQ ID NO: 569363 - RNA, 21 nt, Human
ucuugaacuccugaccucaag

SEQ ID NO: 569364 - RNA, 24 nt, Human
ucuugagacaauugcuuuugggag

SEQ ID NO: 569365 - RNA, 18 nt, Human
ugaccucaagugaucugc

SEQ ID NO: 569366 - RNA, 18 nt, Human
ugagacagagucucauuc

SEQ ID NO: 569367 - RNA, 22 nt, Human
ugagacagagucucauucuguc

SEQ ID NO: 569368 - RNA, 18 nt, Human
ugagagaaaucucugcag

SEQ ID NO: 569369 - RNA, 24 nt, Human
ugaucugcccaccucggccuccca

SEQ ID NO: 569370 - RNA, 20 nt, Human
ugauuugcuguccucaaagu

SEQ ID NO: 569371 - RNA, 20 nt, Human
ugcaaccucuaucuccuggg

SEQ ID NO: 569372 - RNA, 22 nt, Human
ugcaguggagugaucuuggcuc

SEQ ID NO: 569373 - RNA, 21 nt, Human
ugcgagggaagugguuuuggg

SEQ ID NO: 569374 - RNA, 23 nt, Human
ugcgagggaagugguuuuggggu

SEQ ID NO: 569375 - RNA, 24 nt, Human
ugcugggauuacaggugugagcca

SEQ ID NO: 569376 - RNA, 18 nt, Human
uggaagauucuggauugc

SEQ ID NO: 569377 - RNA, 19 nt, Human
uggaagauucuggauugcu

SEQ ID NO: 569378 - RNA, 20 nt, Human
uggagugcaguggagugauc

SEQ ID NO: 569379 - RNA, 23 nt, Human
uggagugcaguggagugaucuug

SEQ ID NO: 569380 - RNA, 24 nt, Human
uggagugcaguggagugaucuugg

SEQ ID NO: 569381 - RNA, 24 nt, Human
uggccaggcuggucuugaacuccu

SEQ ID NO: 569382 - RNA, 24 nt, Human
ugggauuacagacgaaugccacca

SEQ ID NO: 569383 - RNA, 25 nt, Human
ugggauuacagacgaaugccaccau

SEQ ID NO: 569384 - RNA, 18 nt, Human
ugggauuacaggugugag

SEQ ID NO: 569385 - RNA, 19 nt, Human
ugggauuacaggugugagc

SEQ ID NO: 569386 - RNA, 22 nt, Human
ugggauuacaggugugagccac

SEQ ID NO: 569387 - RNA, 23 nt, Human
ugggauuacaggugugagccacc

SEQ ID NO: 569388 - RNA, 24 nt, Human
ugggauuacaggugugagccacca

SEQ ID NO: 569389 - RNA, 24 nt, Human
uggggccucuggaugacuccaguc

SEQ ID NO: 569390 - RNA, 20 nt, Human
uguuuccuccucuugagaca

SEQ ID NO: 569391 - RNA, 24 nt, Human
uuaguagagacggugucucaccau

SEQ ID NO: 569392 - RNA, 19 nt, Human
uuagugaugcagcaauagu

SEQ ID NO: 569393 - RNA, 24 nt, Human
uuaugcuaaacauggagcugcauu

SEQ ID NO: 569394 - RNA, 22 nt, Human
uucagaggaaagcugcgaggga

SEQ ID NO: 569395 - RNA, 18 nt, Human
uucugucgcccaggcugg

SEQ ID NO: 569396 - RNA, 22 nt, Human
uugaacuuuaauucacaacgau

SEQ ID NO: 569397 - RNA, 24 nt, Human
uugcaaccucuaucuccuggguuc

SEQ ID NO: 569398 - RNA, 20 nt, Human
uugcuuuguuuuaaagcuuu

SEQ ID NO: 569399 - RNA, 25 nt, Human
uuuaaccaacagaacaugguggaag

SEQ ID NO: 569400 - RNA, 28 nt, Human
uuugccucagccuucgcaucaaguagcu

SEQ ID NO: 569401 - RNA, 18 nt, Human
uuuuugguuuuuuguuuu

SEQ ID NO: 569402 - RNA, 19 nt, Human
uuuuuguauuuuaguagag

SEQ ID NO: 569403 - RNA, 18 nt, Human
aaacaaguccuuaacuga

SEQ ID NO: 569404 - RNA, 18 nt, Human
aaccaaacucugagaaau

SEQ ID NO: 569405 - RNA, 19 nt, Human
acaaugaaagugggaacca

SEQ ID NO: 569406 - RNA, 22 nt, Human
cagcgaaauauuuugaacagaa

SEQ ID NO: 569407 - RNA, 22 nt, Human
cucaagauggguagaauuucaa

SEQ ID NO: 569408 - RNA, 18 nt, Human
gaaaaauaaauuuugcua

SEQ ID NO: 569409 - RNA, 24 nt, Human
uaccauccauuucuuacacauggc

SEQ ID NO: 569410 - RNA, 22 nt, Human
uccccggugaauaccauccauu

SEQ ID NO: 569411 - RNA, 21 nt, Human
ugaaaaaaaguuuacaauuag

SEQ ID NO: 569412 - RNA, 21 nt, Human
ugauuuguauaagcauuccuu

SEQ ID NO: 569413 - RNA, 19 nt, Human
uggcaauuacaaaaccaca

SEQ ID NO: 569414 - RNA, 18 nt, Human
uucacaaguauaaaauaa

SEQ ID NO: 569415 - RNA, 21 nt, Human
aaaaacccugauucagagugc

SEQ ID NO: 569416 - RNA, 19 nt, Human
aaaagagugauggcaucca

SEQ ID NO: 569417 - RNA, 22 nt, Human
aaacagggaaaguucaucuucc

SEQ ID NO: 569418 - RNA, 25 nt, Human
aaaccauagcagcccuacggcacca

SEQ ID NO: 569419 - RNA, 23 nt, Human
aaauagaaaccaguuccagaacc

SEQ ID NO: 569420 - RNA, 22 nt, Human
aaaugcaccccaagucccaaaa

SEQ ID NO: 569421 - RNA, 24 nt, Human
aaauggaaaaaaauauauauuuug

SEQ ID NO: 569422 - RNA, 19 nt, Human
aacaguucucuagacuuuc

SEQ ID NO: 569423 - RNA, 19 nt, Human
aacauuuagucccuucuac

SEQ ID NO: 569424 - RNA, 19 nt, Human
aaguccugggaccuggaaa

SEQ ID NO: 569425 - RNA, 22 nt, Human
acagagaagaacugggcuuaca

SEQ ID NO: 569426 - RNA, 22 nt, Human
accccaagucccaaaaguugac

SEQ ID NO: 569427 - RNA, 20 nt, Human
agaaaaugcaccccaagucc

SEQ ID NO: 569428 - RNA, 26 nt, Human
agaaaccaguuccagaaccaaaguug

SEQ ID NO: 569429 - RNA, 22 nt, Human
agaaauacaaacaagagauuuc

SEQ ID NO: 569430 - RNA, 19 nt, Human
agaacagacuccugugugg

SEQ ID NO: 569431 - RNA, 20 nt, Human
agauacagccaaagaagaac

SEQ ID NO: 569432 - RNA, 25 nt, Human
agggagucacuauuuaacacuuucu

SEQ ID NO: 569433 - RNA, 18 nt, Human
aguuuguggaggauuggu

SEQ ID NO: 569434 - RNA, 22 nt, Human
auaacacuacaggacuauccac

SEQ ID NO: 569435 - RNA, 22 nt, Human
caaaaaaaaaauuuacaaaaag

SEQ ID NO: 569436 - RNA, 22 nt, Human
caaccagguuucauaauugugc

SEQ ID NO: 569437 - RNA, 22 nt, Human
caacuccuaauuaguucuuccc

SEQ ID NO: 569438 - RNA, 23 nt, Human
caccccaagucccaaaaguugac

SEQ ID NO: 569439 - RNA, 23 nt, Human
cacuacaggacuauccaccuaac

SEQ ID NO: 569440 - RNA, 20 nt, Human
cacuguauguggagaaaaga

SEQ ID NO: 569441 - RNA, 22 nt, Human
caggaucuaugauuaguaaccu

SEQ ID NO: 569442 - RNA, 22 nt, Human
cauuucuugagaaaaugaaguc

SEQ ID NO: 569443 - RNA, 21 nt, Human
ccaaaauagcugcaucuggac

SEQ ID NO: 569444 - RNA, 21 nt, Human
ccauucaaaccauagcagccc

SEQ ID NO: 569445 - RNA, 20 nt, Human
cccaagucccaaaaguugac

SEQ ID NO: 569446 - RNA, 25 nt, Human
cccaagucccaaaaguugacuaaaa

SEQ ID NO: 569447 - RNA, 23 nt, Human
cccaggaguacauaguuuauaaa

SEQ ID NO: 569448 - RNA, 19 nt, Human
cccagggugugaguguggc

SEQ ID NO: 569449 - RNA, 20 nt, Human
cccaggugagcuaucagcgg

SEQ ID NO: 569450 - RNA, 25 nt, Human
ccccaagucccaaaaguugacuaaa

SEQ ID NO: 569451 - RNA, 22 nt, Human
ccuaaccugucuccaucucuug

SEQ ID NO: 569452 - RNA, 20 nt, Human
ccugggaccuggaaagaggc

SEQ ID NO: 569453 - RNA, 22 nt, Human
ccugguuccccucuaugguccu

SEQ ID NO: 569454 - RNA, 19 nt, Human
cuaguauguaaagcaauga

SEQ ID NO: 569455 - RNA, 21 nt, Human
cucaaauaauuacaaacaguu

SEQ ID NO: 569456 - RNA, 25 nt, Human
gaaaauauuucaacaaacuucuaaa

SEQ ID NO: 569457 - RNA, 22 nt, Human
gaaaccaguuccagaaccaaag

SEQ ID NO: 569458 - RNA, 18 nt, Human
gaacaacaguuggcaaca

SEQ ID NO: 569459 - RNA, 19 nt, Human
gcaaaguccugggaccugg

SEQ ID NO: 569460 - RNA, 21 nt, Human
gcagaucauaaauaaggucaa

SEQ ID NO: 569461 - RNA, 24 nt, Human
gcugaaaagaugacuucuaaauca

SEQ ID NO: 569462 - RNA, 21 nt, Human
gggucauccccacuuuugcug

SEQ ID NO: 569463 - RNA, 23 nt, Human
guagugauggaaggagagaagga

SEQ ID NO: 569464 - RNA, 20 nt, Human
gugcaugugauaggagauac

SEQ ID NO: 569465 - RNA, 20 nt, Human
guggauggcuggaacaacag

SEQ ID NO: 569466 - RNA, 20 nt, Human
uaaaaagaugaguugcucau

SEQ ID NO: 569467 - RNA, 22 nt, Human
uaaaagauuucaaaucuuccca

SEQ ID NO: 569468 - RNA, 20 nt, Human
uaaaaggaaacugauuugac

SEQ ID NO: 569469 - RNA, 24 nt, Human
uaaaauaguaaacaaaccaacauu

SEQ ID NO: 569470 - RNA, 21 nt, Human
uaacugacaacuuaguuuucc

SEQ ID NO: 569471 - RNA, 18 nt, Human
uaauaauaaaaacuaacu

SEQ ID NO: 569472 - RNA, 20 nt, Human
uaauacacacaaaucaucac

SEQ ID NO: 569473 - RNA, 23 nt, Human
uacaaucaaguccuaacuauacc

SEQ ID NO: 569474 - RNA, 18 nt, Human
uacagucauucaaaaacc

SEQ ID NO: 569475 - RNA, 22 nt, Human
uaccugaagaaauacaaacaag

SEQ ID NO: 569476 - RNA, 21 nt, Human
uacggcaccaugcuuuucucu

SEQ ID NO: 569477 - RNA, 22 nt, Human
uagaaaccaguuccagaaccaa

SEQ ID NO: 569478 - RNA, 24 nt, Human
uagaaugucaaaauguauauuauu

SEQ ID NO: 569479 - RNA, 20 nt, Human
uagcagaucauaaauaaggu

SEQ ID NO: 569480 - RNA, 24 nt, Human
uaggagauaccaaaauagcugcau

SEQ ID NO: 569481 - RNA, 24 nt, Human
uaugaaacaagacuacauccuuag

SEQ ID NO: 569482 - RNA, 19 nt, Human
uauguaaagcaaugaauga

SEQ ID NO: 569483 - RNA, 23 nt, Human
ucaacaaacuucuaaaagauuuc

SEQ ID NO: 569484 - RNA, 21 nt, Human
ucacaaaucucaucaagcucu

SEQ ID NO: 569485 - RNA, 18 nt, Human
ucacacggcugaaaagau

SEQ ID NO: 569486 - RNA, 19 nt, Human
ucaccuccccacuuggcug

SEQ ID NO: 569487 - RNA, 22 nt, Human
ucagaaucaguucaguaacuau

SEQ ID NO: 569488 - RNA, 19 nt, Human
ucaugguuagguggauuca

SEQ ID NO: 569489 - RNA, 24 nt, Human
uccauuuccuacaccuagggacag

SEQ ID NO: 569490 - RNA, 21 nt, Human
uccuaguuagagcaguguuac

SEQ ID NO: 569491 - RNA, 22 nt, Human
ucuaacuuucccaauuaguuaa

SEQ ID NO: 569492 - RNA, 23 nt, Human
ucuaugauuaguaaccugugaac

SEQ ID NO: 569493 - RNA, 25 nt, Human
ucugucaccuccccacuuggcugaa

SEQ ID NO: 569494 - RNA, 23 nt, Human
ucugugagaaaaugcaccccaag

SEQ ID NO: 569495 - RNA, 21 nt, Human
ugaaaauaaguuaacauacaa

SEQ ID NO: 569496 - RNA, 21 nt, Human
ugaaauggugaaaauauuuca

SEQ ID NO: 569497 - RNA, 18 nt, Human
ugaauggauaaaucacca

SEQ ID NO: 569498 - RNA, 18 nt, Human
ugacuucuaaaucagacu

SEQ ID NO: 569499 - RNA, 23 nt, Human
ugagaaaaugaagucuuccuuuu

SEQ ID NO: 569500 - RNA, 21 nt, Human
ugaguacaaauccacagcuua

SEQ ID NO: 569501 - RNA, 23 nt, Human
ugaguacuaucacuuaucacaaa

SEQ ID NO: 569502 - RNA, 18 nt, Human
ugauaggagauaccaaaa

SEQ ID NO: 569503 - RNA, 26 nt, Human
ugcaacaacuaugaaacaagacuaca

SEQ ID NO: 569504 - RNA, 22 nt, Human
ugcuauugccaccucagaacag

SEQ ID NO: 569505 - RNA, 22 nt, Human
uggcaguuggaauggaacuuuc

SEQ ID NO: 569506 - RNA, 18 nt, Human
uggcugaaucuuuuucuu

SEQ ID NO: 569507 - RNA, 22 nt, Human
uggcugaaucuuuuucuuccau

SEQ ID NO: 569508 - RNA, 18 nt, Human
uggcuggaacaacaguug

SEQ ID NO: 569509 - RNA, 18 nt, Human
uguaaagcaaugaaugaa

SEQ ID NO: 569510 - RNA, 20 nt, Human
uguaaagcaaugaaugaaaa

SEQ ID NO: 569511 - RNA, 20 nt, Human
ugucucaggcuacuuuacug

SEQ ID NO: 569512 - RNA, 23 nt, Human
ugugaguguggcugcugcaugcu

SEQ ID NO: 569513 - RNA, 24 nt, Human
uuaaaaucaguaucuaagucagaa

SEQ ID NO: 569514 - RNA, 24 nt, Human
uuacaagugaaggacauucauggu

SEQ ID NO: 569515 - RNA, 25 nt, Human
uuacaagugaaggacauucaugguu

SEQ ID NO: 569516 - RNA, 26 nt, Human
uuagcagaucauaaauaaggucaaga

SEQ ID NO: 569517 - RNA, 23 nt, Human
uuauagaaaaacccugauucaga

SEQ ID NO: 569518 - RNA, 26 nt, Human
uugaaaauaaucacuauuugugagcu

SEQ ID NO: 569519 - RNA, 21 nt, Human
uuggcuauugagcacagcuga

SEQ ID NO: 569520 - RNA, 28 nt, Human
uuguggaggauuggucgaggggugggau

SEQ ID NO: 569521 - RNA, 18 nt, Human
uuuaaucaagggagucac

SEQ ID NO: 569522 - RNA, 20 nt, Human
uuuagagcagauacuggcau

SEQ ID NO: 569523 - RNA, 21 nt, Human
uuuuuuuuuuucaaaaagaac

SEQ ID NO: 569524 - RNA, 24 nt, Human
aaaauuuuauccgcuuucccauau

SEQ ID NO: 569525 - RNA, 18 nt, Human
aagaacacccacaccccc

SEQ ID NO: 569526 - RNA, 21 nt, Human
aaggugcuccagcgcaccaag

SEQ ID NO: 569527 - RNA, 20 nt, Human
acaaacacaggcugugggcu

SEQ ID NO: 569528 - RNA, 19 nt, Human
acacaggcugugggcugga

SEQ ID NO: 569529 - RNA, 18 nt, Human
acccagggauguggcagc

SEQ ID NO: 569530 - RNA, 22 nt, Human
accccagggccccugcuguccu

SEQ ID NO: 569531 - RNA, 20 nt, Human
accugggaugggguggggac

SEQ ID NO: 569532 - RNA, 18 nt, Human
agacugugcucccuuugg

SEQ ID NO: 569533 - RNA, 24 nt, Human
agauagccgaugucuuauuagagc

SEQ ID NO: 569534 - RNA, 19 nt, Human
agcugggugcagacugugc

SEQ ID NO: 569535 - RNA, 19 nt, Human
aggaaccaaguguguccac

SEQ ID NO: 569536 - RNA, 25 nt, Human
aucauaaacccagggauguggcagc

SEQ ID NO: 569537 - RNA, 20 nt, Human
augacucgggaagcuguggu

SEQ ID NO: 569538 - RNA, 24 nt, Human
auuuggucuccaggugucaccuuu

SEQ ID NO: 569539 - RNA, 21 nt, Human
ccaagugagggaguuagggac

SEQ ID NO: 569540 - RNA, 21 nt, Human
cccacacccccuuguuacccu

SEQ ID NO: 569541 - RNA, 18 nt, Human
ccccagggccccugcugu

SEQ ID NO: 569542 - RNA, 25 nt, Human
cccugcauuuggucuccagguguca

SEQ ID NO: 569543 - RNA, 21 nt, Human
ccugcaggcaagcuaaaccag

SEQ ID NO: 569544 - RNA, 21 nt, Human
ccuucccgcagcuucuucuug

SEQ ID NO: 569545 - RNA, 22 nt, Human
ccuuucgagcagcgccucccag

SEQ ID NO: 569546 - RNA, 21 nt, Human
cgagcagcgccucccaguggc

SEQ ID NO: 569547 - RNA, 19 nt, Human
cuaaaaccccagggccccu

SEQ ID NO: 569548 - RNA, 19 nt, Human
cugaugggaugagagcugg

SEQ ID NO: 569549 - RNA, 24 nt, Human
cugauuuggaauuuaacauucucc

SEQ ID NO: 569550 - RNA, 20 nt, Human
cugggaugggguggggacag

SEQ ID NO: 569551 - RNA, 18 nt, Human
cuggguugugaagggucu

SEQ ID NO: 569552 - RNA, 19 nt, Human
cugugacuucccugugacc

SEQ ID NO: 569553 - RNA, 22 nt, Human
cuuggcuuugugaggaaacgag

SEQ ID NO: 569554 - RNA, 18 nt, Human
cuuuucucaaacuuuccu

SEQ ID NO: 569555 - RNA, 18 nt, Human
gaaccgaguguguccagg

SEQ ID NO: 569556 - RNA, 18 nt, Human
gaagggucucaaguccaa

SEQ ID NO: 569557 - RNA, 21 nt, Human
gagcagcgccucccaguggcc

SEQ ID NO: 569558 - RNA, 21 nt, Human
gauccuugauucagacaguuu

SEQ ID NO: 569559 - RNA, 24 nt, Human
gaugggugggacuguguuggccag

SEQ ID NO: 569560 - RNA, 21 nt, Human
gcaaggcugaaaagaacaccc

SEQ ID NO: 569561 - RNA, 25 nt, Human
gcaaggcugaaaagaacacccacac

SEQ ID NO: 569562 - RNA, 22 nt, Human
gcagcgccucccaguggccgga

SEQ ID NO: 569563 - RNA, 18 nt, Human
gcagcugcagcgggcuug

SEQ ID NO: 569564 - RNA, 18 nt, Human
gcagcugcagcgggcuug

SEQ ID NO: 569565 - RNA, 18 nt, Human
gcagcugcagcgggcuug

SEQ ID NO: 569566 - RNA, 18 nt, Human
gcagcugcagcgggcuug

SEQ ID NO: 569567 - RNA, 18 nt, Human
gcagcugcagcgggcuug

SEQ ID NO: 569568 - RNA, 19 nt, Human
gcuaaaaccccagggcccc

SEQ ID NO: 569569 - RNA, 22 nt, Human
ggaauuuaacauucuccaaaca

SEQ ID NO: 569570 - RNA, 23 nt, Human
ggaccuggguucagccagguggu

SEQ ID NO: 569571 - RNA, 24 nt, Human
ggaccuggguucagccagguggug

SEQ ID NO: 569572 - RNA, 21 nt, Human
ggaguuagggacuugggaggg

SEQ ID NO: 569573 - RNA, 20 nt, Human
ggccagaggcuaaaacccca

SEQ ID NO: 569574 - RNA, 18 nt, Human
gggaagcugugguuggcc

SEQ ID NO: 569575 - RNA, 19 nt, Human
ggggaccuggguucagcca

SEQ ID NO: 569576 - RNA, 21 nt, Human
gggugggacuguguuggccag

SEQ ID NO: 569577 - RNA, 21 nt, Human
ggugcagacugugcuccccgg

SEQ ID NO: 569578 - RNA, 18 nt, Human
gucaccuuucugccaugu

SEQ ID NO: 569579 - RNA, 20 nt, Human
gugaccucugcaguacuccu

SEQ ID NO: 569580 - RNA, 21 nt, Human
guuggcccugauuucuucuuu

SEQ ID NO: 569581 - RNA, 24 nt, Human
uaguauuuugcagaugcuuuucuc

SEQ ID NO: 569582 - RNA, 19 nt, Human
ucccaguggccggaagcuu

SEQ ID NO: 569583 - RNA, 23 nt, Human
ucucaaguccaagugagggaguu

SEQ ID NO: 569584 - RNA, 18 nt, Human
ucuccaggugucaccuuu

SEQ ID NO: 569585 - RNA, 18 nt, Human
ucugcaguacuccuuacc

SEQ ID NO: 569586 - RNA, 19 nt, Human
ucuucuguucuucacgccc

SEQ ID NO: 569587 - RNA, 25 nt, Human
ugaaaagaacacccacacccccuug

SEQ ID NO: 569588 - RNA, 22 nt, Human
ugaagggucucaaguccaagug

SEQ ID NO: 569589 - RNA, 21 nt, Human
ugaaugacucgggaagcugug

SEQ ID NO: 569590 - RNA, 18 nt, Human
ugacuucccugugaccuc

SEQ ID NO: 569591 - RNA, 18 nt, Human
ugagggaguuagggacuu

SEQ ID NO: 569592 - RNA, 19 nt, Human
ugaugggaugagagcuggg

SEQ ID NO: 569593 - RNA, 20 nt, Human
ugcauuuggucuccaggugu

SEQ ID NO: 569594 - RNA, 24 nt, Human
ugccaccuggugaaugacucggga

SEQ ID NO: 569595 - RNA, 22 nt, Human
uggcagaaagggggaacccaca

SEQ ID NO: 569596 - RNA, 19 nt, Human
uggccagaggcugagagga

SEQ ID NO: 569597 - RNA, 19 nt, Human
uggcuuugugaggaaacga

SEQ ID NO: 569598 - RNA, 19 nt, Human
uggcuuugugaggaaacga

SEQ ID NO: 569599 - RNA, 20 nt, Human
ugggaugagagcugggugca

SEQ ID NO: 569600 - RNA, 18 nt, Human
ugggaugggguggggaca

SEQ ID NO: 569601 - RNA, 19 nt, Human
ugggguggggacagacaau

SEQ ID NO: 569602 - RNA, 24 nt, Human
ugggugcagacugugcucccuuug

SEQ ID NO: 569603 - RNA, 21 nt, Human
ugucuucuguucuucacgccc

SEQ ID NO: 569604 - RNA, 19 nt, Human
ugugaagggucucaagucc

SEQ ID NO: 569605 - RNA, 24 nt, Human
uguggcagcugcagcgggcuuggc

SEQ ID NO: 569606 - RNA, 24 nt, Human
uguggcagcugcagcgggcuuggc

SEQ ID NO: 569607 - RNA, 24 nt, Human
uguggcagcugcagcgggcuuggc

SEQ ID NO: 569608 - RNA, 24 nt, Human
uguggcagcugcagcgggcuuggc

SEQ ID NO: 569609 - RNA, 24 nt, Human
uguggcagcugcagcgggcuuggc

SEQ ID NO: 569610 - RNA, 26 nt, Human
ugugguuggcccugauuucuucuuug

SEQ ID NO: 569611 - RNA, 19 nt, Human
uuacaaacacaggcugugg

SEQ ID NO: 569612 - RNA, 23 nt, Human
uuccaguccaaugaaaauuuuau

SEQ ID NO: 569613 - RNA, 24 nt, Human
uucccauauaaaaauucuucccac

SEQ ID NO: 569614 - RNA, 19 nt, Human
uucccgcagcuucuucuug

SEQ ID NO: 569615 - RNA, 22 nt, Human
uugugaagggucucaaguccaa

SEQ ID NO: 569616 - RNA, 27 nt, Human
uuguuuuugggucggggaccuggguuc

SEQ ID NO: 569617 - RNA, 18 nt, Human
aaagacaggguuucccua

SEQ ID NO: 569618 - RNA, 19 nt, Human
aaagugcugggauuacagg

SEQ ID NO: 569619 - RNA, 22 nt, Human
aaagugcugggauuacaggcag

SEQ ID NO: 569620 - RNA, 18 nt, Human
aagugcugggauuacagg

SEQ ID NO: 569621 - RNA, 19 nt, Human
aagugcugggauuacaggc

SEQ ID NO: 569622 - RNA, 23 nt, Human
aagugcugggauuacaggcagcc

SEQ ID NO: 569623 - RNA, 18 nt, Human
agaugccggagggugacc

SEQ ID NO: 569624 - RNA, 18 nt, Human
agcaggaggcagggugcc

SEQ ID NO: 569625 - RNA, 21 nt, Human
agcaggaggcagggugccugg

SEQ ID NO: 569626 - RNA, 19 nt, Human
aggagaaagagguccccua

SEQ ID NO: 569627 - RNA, 25 nt, Human
aggcagccaugcccagccagggcag

SEQ ID NO: 569628 - RNA, 19 nt, Human
aggcagggugccugggcca

SEQ ID NO: 569629 - RNA, 26 nt, Human
aggcagggugccugggccaggcuucc

SEQ ID NO: 569630 - RNA, 24 nt, Human
agggauccucccaccucagccucc

SEQ ID NO: 569631 - RNA, 19 nt, Human
auaaauuuacaguucuuga

SEQ ID NO: 569632 - RNA, 27 nt, Human
caaagugcugggauuacaggcagccau

SEQ ID NO: 569633 - RNA, 21 nt, Human
caccuaugauacauaaauuua

SEQ ID NO: 569634 - RNA, 24 nt, Human
caccucagccucccaaagugcugg

SEQ ID NO: 569635 - RNA, 20 nt, Human
cagcacuacuggggagagau

SEQ ID NO: 569636 - RNA, 20 nt, Human
cauuuuuaugcacaacuuuc

SEQ ID NO: 569637 - RNA, 19 nt, Human
ccaaagugcugggauuaca

SEQ ID NO: 569638 - RNA, 23 nt, Human
ccaaagugcugggauuacaggca

SEQ ID NO: 569639 - RNA, 24 nt, Human
cccaaagugcugggauuacaggca

SEQ ID NO: 569640 - RNA, 18 nt, Human
ccugggcucaagggaucc

SEQ ID NO: 569641 - RNA, 19 nt, Human
ccuuugggaaauguggucc

SEQ ID NO: 569642 - RNA, 22 nt, Human
cgcgcgcccuccacuccgggcc

SEQ ID NO: 569643 - RNA, 19 nt, Human
cucaagggauccucccacc

SEQ ID NO: 569644 - RNA, 24 nt, Human
cucaagggauccucccaccucagc

SEQ ID NO: 569645 - RNA, 20 nt, Human
cuccacuccgggccagaccc

SEQ ID NO: 569646 - RNA, 23 nt, Human
cuccugggcucaagggauccucc

SEQ ID NO: 569647 - RNA, 24 nt, Human
gaacuccugggcucaagggauccu

SEQ ID NO: 569648 - RNA, 18 nt, Human
gagcaggaggcagggugc

SEQ ID NO: 569649 - RNA, 18 nt, Human
gauuacaggcagccaugc

SEQ ID NO: 569650 - RNA, 23 nt, Human
gcuggucuggaacuccugggcuc

SEQ ID NO: 569651 - RNA, 19 nt, Human
ggagggugaccagcacuac

SEQ ID NO: 569652 - RNA, 18 nt, Human
ggauuacaggcagccaug

SEQ ID NO: 569653 - RNA, 21 nt, Human
ggccgagcgggagggcuggga

SEQ ID NO: 569654 - RNA, 22 nt, Human
uauauugcccaggcuggucugg

SEQ ID NO: 569655 - RNA, 23 nt, Human
uauauugcccaggcuggucugga

SEQ ID NO: 569656 - RNA, 24 nt, Human
uauauugcccaggcuggucuggaa

SEQ ID NO: 569657 - RNA, 19 nt, Human
uauugcccaggcuggucug

SEQ ID NO: 569658 - RNA, 18 nt, Human
ucagccucccaaagugcu

SEQ ID NO: 569659 - RNA, 24 nt, Human
ucccaaagugcugggauuacaggc

SEQ ID NO: 569660 - RNA, 27 nt, Human
uccucccaccucagccucccaaagugc

SEQ ID NO: 569661 - RNA, 18 nt, Human
uccugggcucaagggauc

SEQ ID NO: 569662 - RNA, 24 nt, Human
uccugggcucaagggauccuccca

SEQ ID NO: 569663 - RNA, 19 nt, Human
ucuccugggucaccuccaa

SEQ ID NO: 569664 - RNA, 21 nt, Human
ucuggaacuccugggcucaag

SEQ ID NO: 569665 - RNA, 24 nt, Human
ugcccaggcuggucuggaacuccu

SEQ ID NO: 569666 - RNA, 28 nt, Human
ugcccaggcuggucuggaacuccugggc

SEQ ID NO: 569667 - RNA, 21 nt, Human
ugcugggauuacaggcagcca

SEQ ID NO: 569668 - RNA, 22 nt, Human
ugggagagaugcaugccaaagg

SEQ ID NO: 569669 - RNA, 18 nt, Human
ugggauuacaggcagcca

SEQ ID NO: 569670 - RNA, 19 nt, Human
ugggauuacaggcagccau

SEQ ID NO: 569671 - RNA, 24 nt, Human
ugggauuacaggcagccaugccca

SEQ ID NO: 569672 - RNA, 23 nt, Human
uuguaaagacaggguuucccuau

SEQ ID NO: 569673 - RNA, 23 nt, Human
uuucccuauauugcccaggcugg

SEQ ID NO: 569674 - RNA, 21 nt, Human
uuuuuuuuuguaaagacaggg

SEQ ID NO: 569675 - RNA, 26 nt, Human
aaaaaaaaaaaaaguggccuggggga

SEQ ID NO: 569676 - RNA, 24 nt, Human
aaaaacaaaaaaauguuaacugag

SEQ ID NO: 569677 - RNA, 30 nt, Human
aaaaaugaugaaaacaucucaucgcacaaa

SEQ ID NO: 569678 - RNA, 19 nt, Human
aaaacaaacaaaaaaaagc

SEQ ID NO: 569679 - RNA, 21 nt, Human
aaacaaacaaaaaaaagcuga

SEQ ID NO: 569680 - RNA, 27 nt, Human
aaacacuaagaguugcaagaaagaacu

SEQ ID NO: 569681 - RNA, 26 nt, Human
aaacaggacagucauauaccccaaga

SEQ ID NO: 569682 - RNA, 21 nt, Human
aaaccugguuucaauucaugc

SEQ ID NO: 569683 - RNA, 23 nt, Human
aaagauccggaguucagauauac

SEQ ID NO: 569684 - RNA, 22 nt, Human
aaagcgagacucuugucuaaaa

SEQ ID NO: 569685 - RNA, 23 nt, Human
aaaugcugaacaucagcacagcu

SEQ ID NO: 569686 - RNA, 18 nt, Human
aacuuacaauuccuucaa

SEQ ID NO: 569687 - RNA, 18 nt, Human
aacuucuaucucccaauc

SEQ ID NO: 569688 - RNA, 19 nt, Human
aagaaagaacucaauucaa

SEQ ID NO: 569689 - RNA, 23 nt, Human
aagagcaagacccugucucaaaa

SEQ ID NO: 569690 - RNA, 21 nt, Human
aagaguugcaagaaagaacuc

SEQ ID NO: 569691 - RNA, 22 nt, Human
aagcugaguaugguggcacgug

SEQ ID NO: 569692 - RNA, 24 nt, Human
aauucaagaccagccugggcaaca

SEQ ID NO: 569693 - RNA, 24 nt, Human
acuacuguacuccugccugggcaa

SEQ ID NO: 569694 - RNA, 18 nt, Human
acugaaguaaaaaacgug

SEQ ID NO: 569695 - RNA, 19 nt, Human
acuguacuccugccugggc

SEQ ID NO: 569696 - RNA, 22 nt, Human
acuguacuccugccugggcaag

SEQ ID NO: 569697 - RNA, 24 nt, Human
acuguacuccugccugggcaagag

SEQ ID NO: 569698 - RNA, 24 nt, Human
agaaaaaaaaaaaaaguggccugg

SEQ ID NO: 569699 - RNA, 20 nt, Human
agaaaugaauaaauaauuca

SEQ ID NO: 569700 - RNA, 21 nt, Human
agacaaaggcugugaaaacau

SEQ ID NO: 569701 - RNA, 25 nt, Human
agacaaaggcugugaaaacauguag

SEQ ID NO: 569702 - RNA, 23 nt, Human
agacugaggcaggaggauccuug

SEQ ID NO: 569703 - RNA, 21 nt, Human
agacuguuuccuauuacaauu

SEQ ID NO: 569704 - RNA, 22 nt, Human
agcaagagaaugcuaagaggga

SEQ ID NO: 569705 - RNA, 23 nt, Human
agcacuuugggaggcugaggugg

SEQ ID NO: 569706 - RNA, 20 nt, Human
agccaaaaauaggaaauaaa

SEQ ID NO: 569707 - RNA, 24 nt, Human
agccugggcaacaaagcgagacuc

SEQ ID NO: 569708 - RNA, 23 nt, Human
agcugaguaugguggcacgugcc

SEQ ID NO: 569709 - RNA, 20 nt, Human
aggaaauaaaaagauccgga

SEQ ID NO: 569710 - RNA, 23 nt, Human
aggaauucaagaccagccugggc

SEQ ID NO: 569711 - RNA, 21 nt, Human
aggauccuugagcccuggagg

SEQ ID NO: 569712 - RNA, 22 nt, Human
aggcaggaggauccuugagccc

SEQ ID NO: 569713 - RNA, 24 nt, Human
aggcaggaggauccuugagcccug

SEQ ID NO: 569714 - RNA, 21 nt, Human
aggcugagguggaagaguugc

SEQ ID NO: 569715 - RNA, 24 nt, Human
aggcugagguggaagaguugcuug

SEQ ID NO: 569716 - RNA, 24 nt, Human
aguuuggcagugaacauuaugcag

SEQ ID NO: 569717 - RNA, 19 nt, Human
auacagaaaugugaaggcc

SEQ ID NO: 569718 - RNA, 24 nt, Human
caaaagcacacugggugaaacuaa

SEQ ID NO: 569719 - RNA, 24 nt, Human
caagccaguaaucucagcacuuug

SEQ ID NO: 569720 - RNA, 21 nt, Human
cacagcucagugcacauccuc

SEQ ID NO: 569721 - RNA, 22 nt, Human
cacagcucagugcacauccucu

SEQ ID NO: 569722 - RNA, 23 nt, Human
caccagccagcaggggaaaagga

SEQ ID NO: 569723 - RNA, 18 nt, Human
caccccccuuccuuccuu

SEQ ID NO: 569724 - RNA, 24 nt, Human
cagcacuuugggaggcugaggugg

SEQ ID NO: 569725 - RNA, 23 nt, Human
caggggaaaaggagaaauccacc

SEQ ID NO: 569726 - RNA, 25 nt, Human
ccaaaagcacacugggugaaacuaa

SEQ ID NO: 569727 - RNA, 19 nt, Human
ccagaaagaugguuuuacu

SEQ ID NO: 569728 - RNA, 22 nt, Human
cccagaaaccuuaaauauagac

SEQ ID NO: 569729 - RNA, 24 nt, Human
ccccccuuccuuccuuacaaauuc

SEQ ID NO: 569730 - RNA, 23 nt, Human
ccugucucaaaagaaaaaaaaaa

SEQ ID NO: 569731 - RNA, 24 nt, Human
ccugucucaaaagaaaaaaaaaaa

SEQ ID NO: 569732 - RNA, 18 nt, Human
cuaaaacaaacaaaaaaa

SEQ ID NO: 569733 - RNA, 25 nt, Human
cuaaaacaaacaaaaaaaagcugag

SEQ ID NO: 569734 - RNA, 18 nt, Human
cucaaaagaaaaaaaaaa

SEQ ID NO: 569735 - RNA, 24 nt, Human
cucaagccaguaaucucagcacuu

SEQ ID NO: 569736 - RNA, 20 nt, Human
cucagugcacauccucuuua

SEQ ID NO: 569737 - RNA, 22 nt, Human
cuccuggguuauggcuggacgc

SEQ ID NO: 569738 - RNA, 22 nt, Human
cuggaggucaaggcugcaguca

SEQ ID NO: 569739 - RNA, 24 nt, Human
gaaaacaucucaucgcacaaaacu

SEQ ID NO: 569740 - RNA, 25 nt, Human
gaaaaccugguuucaauucaugccg

SEQ ID NO: 569741 - RNA, 18 nt, Human
gacccugucucaaaagaa

SEQ ID NO: 569742 - RNA, 20 nt, Human
gagaaaauguucauugggug

SEQ ID NO: 569743 - RNA, 24 nt, Human
gagauaccuaaagugaaaaacaaa

SEQ ID NO: 569744 - RNA, 24 nt, Human
gagguggaagaguugcuugagccc

SEQ ID NO: 569745 - RNA, 22 nt, Human
ggaaaaggagaaauccaccugc

SEQ ID NO: 569746 - RNA, 21 nt, Human
ggaaacaaaaaugaugaaaac

SEQ ID NO: 569747 - RNA, 23 nt, Human
ggaggggugggugcaguggcuca

SEQ ID NO: 569748 - RNA, 21 nt, Human
ggccagaaagaugguuuuacu

SEQ ID NO: 569749 - RNA, 23 nt, Human
ggugcaguggcucaagccaguaa

SEQ ID NO: 569750 - RNA, 23 nt, Human
gucucugacagucaccagccagc

SEQ ID NO: 569751 - RNA, 19 nt, Human
gucuggaggggugggugca

SEQ ID NO: 569752 - RNA, 20 nt, Human
uaaaacaaacaaaaaaaagc

SEQ ID NO: 569753 - RNA, 18 nt, Human
uaaaguagucuggagggg

SEQ ID NO: 569754 - RNA, 20 nt, Human
uaagacugaugacuaggagc

SEQ ID NO: 569755 - RNA, 18 nt, Human
uaagaguugcaagaaaga

SEQ ID NO: 569756 - RNA, 22 nt, Human
uaaguagauuuggcagaggaga

SEQ ID NO: 569757 - RNA, 22 nt, Human
uaccuaaagugaaaaacaaaaa

SEQ ID NO: 569758 - RNA, 19 nt, Human
uaggagcacaucuauggau

SEQ ID NO: 569759 - RNA, 24 nt, Human
uaggaucuuucuuaauaaagcuuc

SEQ ID NO: 569760 - RNA, 22 nt, Human
uauuauacagaaaugugaaggc

SEQ ID NO: 569761 - RNA, 21 nt, Human
ucagccucacauuuagagacu

SEQ ID NO: 569762 - RNA, 18 nt, Human
ucauuuagacauuugccc

SEQ ID NO: 569763 - RNA, 22 nt, Human
uccagagaccaucugcuccaaa

SEQ ID NO: 569764 - RNA, 23 nt, Human
uccccaaaucacaagucugauuc

SEQ ID NO: 569765 - RNA, 21 nt, Human
uccggaguucagauauacuga

SEQ ID NO: 569766 - RNA, 23 nt, Human
ucuauggagaagcccugaaguug

SEQ ID NO: 569767 - RNA, 22 nt, Human
ucuggaggggugggugcagugg

SEQ ID NO: 569768 - RNA, 22 nt, Human
ugaaguaaaaaacguguuagag

SEQ ID NO: 569769 - RNA, 18 nt, Human
ugaaguugcucuccccaa

SEQ ID NO: 569770 - RNA, 23 nt, Human
ugagcccaggaauucaagaccag

SEQ ID NO: 569771 - RNA, 19 nt, Human
ugaggcaggaggauccuug

SEQ ID NO: 569772 - RNA, 23 nt, Human
ugaggcaggaggauccuugagcc

SEQ ID NO: 569773 - RNA, 24 nt, Human
ugaggcaggaggauccuugagccc

SEQ ID NO: 569774 - RNA, 20 nt, Human
ugauggggucucugacaguu

SEQ ID NO: 569775 - RNA, 18 nt, Human
ugauucaagaaaaggaaa

SEQ ID NO: 569776 - RNA, 23 nt, Human
ugccuguagucccacuuaguugg

SEQ ID NO: 569777 - RNA, 24 nt, Human
ugccuguagucccacuuaguuggg

SEQ ID NO: 569778 - RNA, 20 nt, Human
ugcucuccccaaaucacaag

SEQ ID NO: 569779 - RNA, 20 nt, Human
uggagaacucaaaaucccau

SEQ ID NO: 569780 - RNA, 23 nt, Human
uggaguggaaguguagggagaaa

SEQ ID NO: 569781 - RNA, 18 nt, Human
uggcagaggagagaaaug

SEQ ID NO: 569782 - RNA, 19 nt, Human
uggcagaggagagaaauga

SEQ ID NO: 569783 - RNA, 20 nt, Human
ugggaggcugagguggaaga

SEQ ID NO: 569784 - RNA, 21 nt, Human
ugggaggcugagguggaagag

SEQ ID NO: 569785 - RNA, 24 nt, Human
ugggaggcugagguggaagaguug

SEQ ID NO: 569786 - RNA, 18 nt, Human
ugggugaaacuaaaccac

SEQ ID NO: 569787 - RNA, 19 nt, Human
uggguucacccaguuuauu

SEQ ID NO: 569788 - RNA, 24 nt, Human
ugguggcacgugccuguaguccca

SEQ ID NO: 569789 - RNA, 19 nt, Human
uuaugauagaaaacaaacu

SEQ ID NO: 569790 - RNA, 19 nt, Human
uucaaagaaaagaaaaagc

SEQ ID NO: 569791 - RNA, 20 nt, Human
uucaagaaaaggaaacaaaa

SEQ ID NO: 569792 - RNA, 25 nt, Human
uucugauguuacuccuggguuaugg

SEQ ID NO: 569793 - RNA, 24 nt, Human
uugcccuagugaaugagggagcaa

SEQ ID NO: 569794 - RNA, 25 nt, Human
uuggcagugaacauuaugcagauuc

SEQ ID NO: 569795 - RNA, 19 nt, Human
uugggaggcugagguggaa

SEQ ID NO: 569796 - RNA, 23 nt, Human
uuucaugccaccccccuuccuuc

SEQ ID NO: 569797 - RNA, 23 nt, Human
aaaacaagaccaaaagguggaaa

SEQ ID NO: 569798 - RNA, 21 nt, Human
aaacaaauguaguguauacac

SEQ ID NO: 569799 - RNA, 18 nt, Human
aaacaagaccaaaaggug

SEQ ID NO: 569800 - RNA, 19 nt, Human
aagauuaaaaacaagacca

SEQ ID NO: 569801 - RNA, 22 nt, Human
accaaaagguggaaauuuuaaa

SEQ ID NO: 569802 - RNA, 18 nt, Human
caagauuaaaaacaagac

SEQ ID NO: 569803 - RNA, 24 nt, Human
cacaagauuaaaaacaagggacau

SEQ ID NO: 569804 - RNA, 19 nt, Human
cauuacuuucuacuucugc

SEQ ID NO: 569805 - RNA, 18 nt, Human
ccaagaaaucuugcacaa

SEQ ID NO: 569806 - RNA, 23 nt, Human
ccgaaauauccucuucaucagag

SEQ ID NO: 569807 - RNA, 24 nt, Human
cuagaaaauucauuuuucucagaa

SEQ ID NO: 569808 - RNA, 22 nt, Human
cuucauguauuacuugcucuuc

SEQ ID NO: 569809 - RNA, 23 nt, Human
cuugcucuucuuccucaggucug

SEQ ID NO: 569810 - RNA, 19 nt, Human
gaggaaaauauaaaggcuc

SEQ ID NO: 569811 - RNA, 21 nt, Human
gcgauauaacuucagacucau

SEQ ID NO: 569812 - RNA, 21 nt, Human
uacuugcucuucuuccucagg

SEQ ID NO: 569813 - RNA, 24 nt, Human
uauccucuucaucagagaggacca

SEQ ID NO: 569814 - RNA, 22 nt, Human
ucacccgaaauauccucuucau

SEQ ID NO: 569815 - RNA, 19 nt, Human
ugauuuagaacguuuucgu

SEQ ID NO: 569816 - RNA, 18 nt, Human
uggcaaacucucacuacu

SEQ ID NO: 569817 - RNA, 22 nt, Human
ugggguaucaugcacaagauua

SEQ ID NO: 569818 - RNA, 23 nt, Human
uuucaucaucuucauguauuacu

SEQ ID NO: 569819 - RNA, 23 nt, Human
aaaaaauagaacucucucagaga

SEQ ID NO: 569820 - RNA, 24 nt, Human
aaaaauucuaacccaaaacaacuc

SEQ ID NO: 569821 - RNA, 22 nt, Human
aaacauguaacaaagaguauaa

SEQ ID NO: 569822 - RNA, 24 nt, Human
aaacauguaacaaagaguauaaaa

SEQ ID NO: 569823 - RNA, 28 nt, Human
aaauagaacucucucagagaacuauaaa

SEQ ID NO: 569824 - RNA, 21 nt, Human
aacaaaaccaaaaaauagaac

SEQ ID NO: 569825 - RNA, 25 nt, Human
aacaguacaaaaagaaaaauucuaa

SEQ ID NO: 569826 - RNA, 24 nt, Human
aacccauucaaaauccaaacauac

SEQ ID NO: 569827 - RNA, 22 nt, Human
aagaaaaauucuaacccaaaac

SEQ ID NO: 569828 - RNA, 18 nt, Human
aagaaaacacaaaacaaa

SEQ ID NO: 569829 - RNA, 21 nt, Human
aagaaaacacaaaacaaaacc

SEQ ID NO: 569830 - RNA, 24 nt, Human
aagacugcuuuaaacacccuucgg

SEQ ID NO: 569831 - RNA, 21 nt, Human
aagaguaccucugcugcauuu

SEQ ID NO: 569832 - RNA, 21 nt, Human
aagggacagaagaguaccucu

SEQ ID NO: 569833 - RNA, 18 nt, Human
acaucgaggaagugcuaa

SEQ ID NO: 569834 - RNA, 26 nt, Human
acaugacaaaaaccugacuauauaaa

SEQ ID NO: 569835 - RNA, 18 nt, Human
acuuaaaaguuccuagug

SEQ ID NO: 569836 - RNA, 23 nt, Human
acuuuuauaguaguccagcccuu

SEQ ID NO: 569837 - RNA, 24 nt, Human
agaaaacacaaaacaaaaccaaaa

SEQ ID NO: 569838 - RNA, 20 nt, Human
agcacccagaacaggaaacg

SEQ ID NO: 569839 - RNA, 27 nt, Human
aguacaaaaagaaaaauucuaacccaa

SEQ ID NO: 569840 - RNA, 20 nt, Human
augcaaaagaaaacacaaaa

SEQ ID NO: 569841 - RNA, 19 nt, Human
caaaaaauagaacucucuc

SEQ ID NO: 569842 - RNA, 19 nt, Human
caaaaaauagaacucucuc

SEQ ID NO: 569843 - RNA, 23 nt, Human
caaaaaauagaacucucucagag

SEQ ID NO: 569844 - RNA, 24 nt, Human
caaaagaaaacacaaaacaaaacc

SEQ ID NO: 569845 - RNA, 22 nt, Human
caaaagaauuccuuuucuuaaa

SEQ ID NO: 569846 - RNA, 26 nt, Human
caaaaugcaaaagaaaacacaaaaca

SEQ ID NO: 569847 - RNA, 22 nt, Human
caaaaugcaaaagaaaacacag

SEQ ID NO: 569848 - RNA, 18 nt, Human
caacagccuagacaguac

SEQ ID NO: 569849 - RNA, 18 nt, Human
caugacaaaaaccugacu

SEQ ID NO: 569850 - RNA, 18 nt, Human
cccuucggcauggccuga

SEQ ID NO: 569851 - RNA, 18 nt, Human
cgagaaaacaaaucccau

SEQ ID NO: 569852 - RNA, 19 nt, Human
cggaagggacagaagagua

SEQ ID NO: 569853 - RNA, 22 nt, Human
cuaaauacugauacaaacaugu

SEQ ID NO: 569854 - RNA, 23 nt, Human
cucaaaugguuuuccacuaaaua

SEQ ID NO: 569855 - RNA, 18 nt, Human
cuuaaaaaaaaaaaaaaa

SEQ ID NO: 569856 - RNA, 21 nt, Human
gaaaacacaaaacaaaaccaa

SEQ ID NO: 569857 - RNA, 20 nt, Human
gaaguugugcaucccgacuc

SEQ ID NO: 569858 - RNA, 22 nt, Human
gauaagucggugguugaaguug

SEQ ID NO: 569859 - RNA, 26 nt, Human
gauuuuuuucugucaagagccagaga

SEQ ID NO: 569860 - RNA, 19 nt, Human
gcaguagcacccagaacag

SEQ ID NO: 569861 - RNA, 21 nt, Human
gggaaaggagcgaccugcaag

SEQ ID NO: 569862 - RNA, 24 nt, Human
uaauaaauuacaugacaaaaaccu

SEQ ID NO: 569863 - RNA, 23 nt, Human
uacaaaaugcaaaagaaaacaca

SEQ ID NO: 569864 - RNA, 27 nt, Human
uacaaaaugcaaaagaaaacacaaaac

SEQ ID NO: 569865 - RNA, 18 nt, Human
uacaugacaaaaaccuga

SEQ ID NO: 569866 - RNA, 19 nt, Human
uagauuccuagcuucaguu

SEQ ID NO: 569867 - RNA, 23 nt, Human
uagauuccuagcuucaguuuuua

SEQ ID NO: 569868 - RNA, 20 nt, Human
uauauacacaaaagaauucc

SEQ ID NO: 569869 - RNA, 25 nt, Human
uauccacggcugggaaaggagcgac

SEQ ID NO: 569870 - RNA, 19 nt, Human
uccacggcugggaaaggag

SEQ ID NO: 569871 - RNA, 19 nt, Human
uccccauuccucaaaaugg

SEQ ID NO: 569872 - RNA, 25 nt, Human
uccuuuucuuaaaaaaaaaaaaaaa

SEQ ID NO: 569873 - RNA, 23 nt, Human
ucggugguugaaguugugcaucc

SEQ ID NO: 569874 - RNA, 19 nt, Human
ugaaauggcugaacuaaac

SEQ ID NO: 569875 - RNA, 26 nt, Human
ugaaauggcugaacuaaacccgggug

SEQ ID NO: 569876 - RNA, 18 nt, Human
ugaggaaaucagcauucc

SEQ ID NO: 569877 - RNA, 22 nt, Human
ugcaaaagaaaacacaaaacaa

SEQ ID NO: 569878 - RNA, 22 nt, Human
ugcaagacugcuuuaaacaccc

SEQ ID NO: 569879 - RNA, 24 nt, Human
ugccgagaaaacaaaucccauuuu

SEQ ID NO: 569880 - RNA, 21 nt, Human
ugucucaaaugugaacucacu

SEQ ID NO: 569881 - RNA, 22 nt, Human
uguuuuaaagaaacaguacaaa

SEQ ID NO: 569882 - RNA, 21 nt, Human
uuaaaaaaaaaaaaaaaaaaa

SEQ ID NO: 569883 - RNA, 22 nt, Human
uuaaaaaaaaaaaaaaaaaagg

SEQ ID NO: 569884 - RNA, 21 nt, Human
uucaaaauccaaacauacaaa

SEQ ID NO: 569885 - RNA, 20 nt, Human
uuuuccacuaaauacugaua

SEQ ID NO: 569886 - RNA, 20 nt, Human
uuuuuauccacggcugggaa

SEQ ID NO: 569887 - RNA, 24 nt, Human
uuuuuauuccaauguggacaggga

SEQ ID NO: 569888 - RNA, 18 nt, Human
aaaacucuuccaugacuc

SEQ ID NO: 569889 - RNA, 19 nt, Human
aaacaggaagagauucaag

SEQ ID NO: 569890 - RNA, 18 nt, Human
aaaccuaggagggugaug

SEQ ID NO: 569891 - RNA, 19 nt, Human
aaagaugggugggagcugg

SEQ ID NO: 569892 - RNA, 21 nt, Human
aacacaacauggggcaguggc

SEQ ID NO: 569893 - RNA, 25 nt, Human
aagacuuuuuccccccauaucucaa

SEQ ID NO: 569894 - RNA, 26 nt, Human
acaaucaggcuuuuuuuuuuuucuuu

SEQ ID NO: 569895 - RNA, 18 nt, Human
acgagaggaccccuucug

SEQ ID NO: 569896 - RNA, 26 nt, Human
agacaagaggaaagguaagggggacc

SEQ ID NO: 569897 - RNA, 20 nt, Human
agccaguguagagagaacca

SEQ ID NO: 569898 - RNA, 23 nt, Human
aggcagucaguggagagaaaagc

SEQ ID NO: 569899 - RNA, 22 nt, Human
auauaaggcaacuugccaacac

SEQ ID NO: 569900 - RNA, 18 nt, Human
aucccaaacuccaaugug

SEQ ID NO: 569901 - RNA, 24 nt, Human
auggucaaauacuuccaagaugcc

SEQ ID NO: 569902 - RNA, 19 nt, Human
auuuuguuuuuguugaggg

SEQ ID NO: 569903 - RNA, 24 nt, Human
caaaggucacuguauuuuucuagg

SEQ ID NO: 569904 - RNA, 18 nt, Human
caagaugcccuugagauc

SEQ ID NO: 569905 - RNA, 22 nt, Human
caauauagacacaaaacaaagc

SEQ ID NO: 569906 - RNA, 24 nt, Human
cacacacaaugcuacucaaaccca

SEQ ID NO: 569907 - RNA, 21 nt, Human
cacacuacauucauacagaaa

SEQ ID NO: 569908 - RNA, 20 nt, Human
caggcuuuuuuuuuuuucuu

SEQ ID NO: 569909 - RNA, 19 nt, Human
cauuccgucagcccacacc

SEQ ID NO: 569910 - RNA, 19 nt, Human
ccaauguaggcccagcuca

SEQ ID NO: 569911 - RNA, 19 nt, Human
ccagcuccagguguuagaa

SEQ ID NO: 569912 - RNA, 23 nt, Human
cccacacuacauucauacagaaa

SEQ ID NO: 569913 - RNA, 23 nt, Human
ccccauaucucaagaaaugguca

SEQ ID NO: 569914 - RNA, 26 nt, Human
cccgccgccaccacuucuccacugcc

SEQ ID NO: 569915 - RNA, 23 nt, Human
ccgucagcccacaccucagucgu

SEQ ID NO: 569916 - RNA, 21 nt, Human
ccuucuguccccacuuagauc

SEQ ID NO: 569917 - RNA, 20 nt, Human
cgcccgccgcccgccgccac

SEQ ID NO: 569918 - RNA, 21 nt, Human
cuaggagggugauguaugaug

SEQ ID NO: 569919 - RNA, 21 nt, Human
cuagguuuggaaaggggaguc

SEQ ID NO: 569920 - RNA, 22 nt, Human
cuagguuuggaaaggggagucu

SEQ ID NO: 569921 - RNA, 24 nt, Human
cucaaacccacacuacauucauac

SEQ ID NO: 569922 - RNA, 23 nt, Human
cucauggcugcuccuuugccgcc

SEQ ID NO: 569923 - RNA, 20 nt, Human
cuccagguguuagaaccaug

SEQ ID NO: 569924 - RNA, 19 nt, Human
cucuuccaugacuccucag

SEQ ID NO: 569925 - RNA, 21 nt, Human
gaaauggucaaauacuuccaa

SEQ ID NO: 569926 - RNA, 19 nt, Human
gcaaaaccuuaaauaagaa

SEQ ID NO: 569927 - RNA, 20 nt, Human
gcuggaggggaggacgagag

SEQ ID NO: 569928 - RNA, 28 nt, Human
gcuuuuuuuuuuuucuuuuuccuuuuaa

SEQ ID NO: 569929 - RNA, 19 nt, Human
ggaagggggguagcaacag

SEQ ID NO: 569930 - RNA, 21 nt, Human
ggaccccuucuguccccacuu

SEQ ID NO: 569931 - RNA, 22 nt, Human
ggcugcuccuuugccgcccgcc

SEQ ID NO: 569932 - RNA, 20 nt, Human
gggaggacgagaggaccccu

SEQ ID NO: 569933 - RNA, 22 nt, Human
gggcuguggggaggugaguuag

SEQ ID NO: 569934 - RNA, 20 nt, Human
ggggcaguggcucacacugg

SEQ ID NO: 569935 - RNA, 18 nt, Human
guaaaaaauaaaaaagcc

SEQ ID NO: 569936 - RNA, 21 nt, Human
guaaaaaauaaaaaagcccaa

SEQ ID NO: 569937 - RNA, 22 nt, Human
gugaaacuuugaaacuauccag

SEQ ID NO: 569938 - RNA, 21 nt, Human
gugaacaaaaugcaaaaccuu

SEQ ID NO: 569939 - RNA, 18 nt, Human
guuuguuuuuuuuuuccu

SEQ ID NO: 569940 - RNA, 19 nt, Human
uaaaaaagcccaauucugc

SEQ ID NO: 569941 - RNA, 25 nt, Human
uaaauaagaaccaucagcugacauu

SEQ ID NO: 569942 - RNA, 24 nt, Human
uagguucuaacauaaaaccaaaag

SEQ ID NO: 569943 - RNA, 20 nt, Human
uaugauguguugcacgugga

SEQ ID NO: 569944 - RNA, 23 nt, Human
ucaaacccacacuacauucauac

SEQ ID NO: 569945 - RNA, 18 nt, Human
ucaaaggucacuguauuu

SEQ ID NO: 569946 - RNA, 22 nt, Human
ucaguggagagaaaagccuggg

SEQ ID NO: 569947 - RNA, 20 nt, Human
uccccagagacaagaggaaa

SEQ ID NO: 569948 - RNA, 26 nt, Human
uccuuugccgcccgccgcccgccgcc

SEQ ID NO: 569949 - RNA, 23 nt, Human
ugacaggcagucaguggagagaa

SEQ ID NO: 569950 - RNA, 18 nt, Human
ugagaaagggaucuuggg

SEQ ID NO: 569951 - RNA, 19 nt, Human
ugcacguggagggcagcag

SEQ ID NO: 569952 - RNA, 18 nt, Human
uggagggaggggaagggg

SEQ ID NO: 569953 - RNA, 18 nt, Human
ugggagcuggcuggaaau

SEQ ID NO: 569954 - RNA, 23 nt, Human
ugguguuuuuaaucccaaacucc

SEQ ID NO: 569955 - RNA, 21 nt, Human
uguaggcccagcuccaggugu

SEQ ID NO: 569956 - RNA, 20 nt, Human
uguaugauguguugcacgug

SEQ ID NO: 569957 - RNA, 20 nt, Human
ugugggaucaauauagacac

SEQ ID NO: 569958 - RNA, 18 nt, Human
uuccccagagacaagagg

SEQ ID NO: 569959 - RNA, 19 nt, Human
uuccgucagcccacaccuc

SEQ ID NO: 569960 - RNA, 18 nt, Human
uugaaggauaugaagacu

SEQ ID NO: 569961 - RNA, 21 nt, Human
uugaaggauaugaagacuggg

SEQ ID NO: 569962 - RNA, 20 nt, Human
uugccgcccgccgcccgccg

SEQ ID NO: 569963 - RNA, 25 nt, Human
uuuaaaaacucuuccaugacuccuc

SEQ ID NO: 569964 - RNA, 18 nt, Human
uuuccaauguaggcccag

SEQ ID NO: 569965 - RNA, 21 nt, Human
uuucuuagacaucuaagaaug

SEQ ID NO: 569966 - RNA, 23 nt, Human
uuuuuuuuuuucuuuuuccuuuu

SEQ ID NO: 569967 - RNA, 18 nt, Human
uuuuuuuuuuuucuuuuu

SEQ ID NO: 569968 - RNA, 22 nt, Human
aaaaaaaaaagaaaaaaaagaa

SEQ ID NO: 569969 - RNA, 19 nt, Human
aaaaaaaagaaaaaaaaga

SEQ ID NO: 569970 - RNA, 21 nt, Human
aaaaaaacuaacuagagagca

SEQ ID NO: 569971 - RNA, 22 nt, Human
aaaaaaacuaacuagagagcac

SEQ ID NO: 569972 - RNA, 28 nt, Human
aaaaauauauaauucuuuggaaacuguc

SEQ ID NO: 569973 - RNA, 27 nt, Human
aaaacacaugcauccggggauaccucc

SEQ ID NO: 569974 - RNA, 28 nt, Human
aaacagacugacacacacgccggacccc

SEQ ID NO: 569975 - RNA, 22 nt, Human
aaagaaagaaaaagaaagaaaa

SEQ ID NO: 569976 - RNA, 24 nt, Human
aacaauaacaaaagaacacacagc

SEQ ID NO: 569977 - RNA, 19 nt, Human
aagaaaaagaaagaaaaga

SEQ ID NO: 569978 - RNA, 21 nt, Human
aagaaagaaaaagaaagaaaa

SEQ ID NO: 569979 - RNA, 21 nt, Human
aagaaagaaaagauaaaaaga

SEQ ID NO: 569980 - RNA, 23 nt, Human
aagauuuuggcaucuugcagcuu

SEQ ID NO: 569981 - RNA, 24 nt, Human
aagcauuuuaaaccaacugugguc

SEQ ID NO: 569982 - RNA, 19 nt, Human
acaauaacaacaauaacaa

SEQ ID NO: 569983 - RNA, 21 nt, Human
acacacacgcacacacacauc

SEQ ID NO: 569984 - RNA, 22 nt, Human
acaugcauccggggauaccucc

SEQ ID NO: 569985 - RNA, 26 nt, Human
acucccaaaaaaacuaacuagagagc

SEQ ID NO: 569986 - RNA, 21 nt, Human
agaaaaaaaagaaaaaaagaa

SEQ ID NO: 569987 - RNA, 26 nt, Human
agaaaaaaaagaaaaaaagaaaagaa

SEQ ID NO: 569988 - RNA, 25 nt, Human
agaaaaagaaagaaaagauaaaaag

SEQ ID NO: 569989 - RNA, 23 nt, Human
agaaaagaaagaaaaagaaagaa

SEQ ID NO: 569990 - RNA, 20 nt, Human
aggcgaaacaaaacuuaccc

SEQ ID NO: 569991 - RNA, 23 nt, Human
aggggaaggaggggucugcaggg

SEQ ID NO: 569992 - RNA, 20 nt, Human
agguauaaacacuauaaaaa

SEQ ID NO: 569993 - RNA, 23 nt, Human
aguuacugaguaacaacaauaac

SEQ ID NO: 569994 - RNA, 21 nt, Human
auagugcaaccuguggaagca

SEQ ID NO: 569995 - RNA, 20 nt, Human
auuaccuugaccagaaaccc

SEQ ID NO: 569996 - RNA, 24 nt, Human
auucacauuuguacauuaccauuu

SEQ ID NO: 569997 - RNA, 19 nt, Human
caaaaaaaaaaaaaaagaa

SEQ ID NO: 569998 - RNA, 21 nt, Human
caaaaaaacuaacuagagagc

SEQ ID NO: 569999 - RNA, 21 nt, Human
caaaagaacacacagcagaag

SEQ ID NO: 570000 - RNA, 18 nt, Human
caaacagacugacacaca

SEQ ID NO: 570001 - RNA, 31 nt, Human
caaacagacugacacacacgcacacacacag

SEQ ID NO: 570002 - RNA, 23 nt, Human
caaccuguggaagcaaaaaaaaa

SEQ ID NO: 570003 - RNA, 22 nt, Human
caccaucagcacugcugauuuu

SEQ ID NO: 570004 - RNA, 31 nt, Human
cagaacaaaaauuagaaaauaaccugaaugg

SEQ ID NO: 570005 - RNA, 25 nt, Human
cagcuugagauaaacucuacgucuu

SEQ ID NO: 570006 - RNA, 23 nt, Human
cagggcagggagaaggggaagga

SEQ ID NO: 570007 - RNA, 23 nt, Human
cagguuuguccuuacucccaaaa

SEQ ID NO: 570008 - RNA, 18 nt, Human
caucccccucugcucacc

SEQ ID NO: 570009 - RNA, 19 nt, Human
caucuugcagcuuuuuacc

SEQ ID NO: 570010 - RNA, 19 nt, Human
ccaaaaaaacuaacuagag

SEQ ID NO: 570011 - RNA, 22 nt, Human
ccaaagacaugcacugucagaa

SEQ ID NO: 570012 - RNA, 25 nt, Human
cccaaaaaaacuaacuagagagcac

SEQ ID NO: 570013 - RNA, 23 nt, Human
cccagguauaaacacuauaaaaa

SEQ ID NO: 570014 - RNA, 21 nt, Human
ccuugaccagaaacccagggc

SEQ ID NO: 570015 - RNA, 21 nt, Human
cuaacuagagagcacaacuga

SEQ ID NO: 570016 - RNA, 24 nt, Human
cucaaguguuuccucauugucuac

SEQ ID NO: 570017 - RNA, 20 nt, Human
cucucuguuacucgacuccu

SEQ ID NO: 570018 - RNA, 21 nt, Human
cugaaugcaugauaugcaacc

SEQ ID NO: 570019 - RNA, 18 nt, Human
gagaaggggaaggagggg

SEQ ID NO: 570020 - RNA, 18 nt, Human
gagaaggggaaggagggg

SEQ ID NO: 570021 - RNA, 18 nt, Human
gaguaacaacaauaacaa

SEQ ID NO: 570022 - RNA, 19 nt, Human
gauaccucccacagcaaug

SEQ ID NO: 570023 - RNA, 18 nt, Human
ggaagcaaaaaaaaaaaa

SEQ ID NO: 570024 - RNA, 21 nt, Human
gggaaggaggggucugcaggg

SEQ ID NO: 570025 - RNA, 23 nt, Human
gggaaggaggggucugcaggguu

SEQ ID NO: 570026 - RNA, 18 nt, Human
gggcagggagaaggggaa

SEQ ID NO: 570027 - RNA, 25 nt, Human
ggggaaggaggggucugcaggguuu

SEQ ID NO: 570028 - RNA, 22 nt, Human
ggggauaccucccacagcaaug

SEQ ID NO: 570029 - RNA, 27 nt, Human
guaacaacaauaacaacaauaacaaaa

SEQ ID NO: 570030 - RNA, 20 nt, Human
uaaaaagaccaacugucccc

SEQ ID NO: 570031 - RNA, 24 nt, Human
uaaaaaugcaauaaccaaugcugu

SEQ ID NO: 570032 - RNA, 19 nt, Human
uaaaccaacuguggucugu

SEQ ID NO: 570033 - RNA, 19 nt, Human
uaacaacaauaacaaaaga

SEQ ID NO: 570034 - RNA, 23 nt, Human
uaacaacaauaacaaaagaacac

SEQ ID NO: 570035 - RNA, 24 nt, Human
uaacaacaauaacaaaagaacaca

SEQ ID NO: 570036 - RNA, 22 nt, Human
uaacacacucacaaacagacug

SEQ ID NO: 570037 - RNA, 25 nt, Human
uaccaccaucagcacugcugauuuu

SEQ ID NO: 570038 - RNA, 21 nt, Human
uaccuugaccagaaacccagg

SEQ ID NO: 570039 - RNA, 20 nt, Human
uagccuuuaacacacucaca

SEQ ID NO: 570040 - RNA, 20 nt, Human
uauauuuauagacucaaaac

SEQ ID NO: 570041 - RNA, 23 nt, Human
ucauuucaugcuuuaauaaaccu

SEQ ID NO: 570042 - RNA, 22 nt, Human
ucugcucacccgaaguaaaagc

SEQ ID NO: 570043 - RNA, 20 nt, Human
ugaaaaaaauauauaauucu

SEQ ID NO: 570044 - RNA, 24 nt, Human
ugacacacacgcacacacacaucc

SEQ ID NO: 570045 - RNA, 20 nt, Human
ugaccagaaacccagggcag

SEQ ID NO: 570046 - RNA, 22 nt, Human
ugagugacaaagcaaauuaaga

SEQ ID NO: 570047 - RNA, 23 nt, Human
ugcaaccuguggaagcaaaaaaa

SEQ ID NO: 570048 - RNA, 21 nt, Human
uguacuuccuucuaaaacuac

SEQ ID NO: 570049 - RNA, 19 nt, Human
uguccuuacucccaaaaaa

SEQ ID NO: 570050 - RNA, 19 nt, Human
uuccagguuuguccuuacu

SEQ ID NO: 570051 - RNA, 22 nt, Human
uucuuuggaaacugucccugau

SEQ ID NO: 570052 - RNA, 19 nt, Human
uuggaaacugucccugauu

SEQ ID NO: 570053 - RNA, 21 nt, Human
uuuaacacacucacaaacaga

SEQ ID NO: 570054 - RNA, 22 nt, Human
uuucaguuuugcuaucuauucc

SEQ ID NO: 570055 - RNA, 26 nt, Human
uuuuaugcaaaugauaugcuucaaca

SEQ ID NO: 570056 - RNA, 18 nt, Human
aaaaaagucugcaccuuc

SEQ ID NO: 570057 - RNA, 21 nt, Human
aaaaaagucugcaccuuccau

SEQ ID NO: 570058 - RNA, 20 nt, Human
aaaaguauccugaaccagga

SEQ ID NO: 570059 - RNA, 18 nt, Human
aaaauugccaauacaacc

SEQ ID NO: 570060 - RNA, 25 nt, Human
aaacaagagacagaaauaagggacc

SEQ ID NO: 570061 - RNA, 23 nt, Human
aaacaagagacagaagggacccc

SEQ ID NO: 570062 - RNA, 21 nt, Human
aaacagacaaaaaaugcaucc

SEQ ID NO: 570063 - RNA, 21 nt, Human
aaacagcaucaguuccucagu

SEQ ID NO: 570064 - RNA, 21 nt, Human
aacacauaagcagguguacca

SEQ ID NO: 570065 - RNA, 21 nt, Human
aacaggaugcuuuaguuccuc

SEQ ID NO: 570066 - RNA, 21 nt, Human
aacaugcuucaaagaauaaga

SEQ ID NO: 570067 - RNA, 24 nt, Human
aaccaggaagaaaaaacaagagac

SEQ ID NO: 570068 - RNA, 18 nt, Human
aacuagcccacagacccc

SEQ ID NO: 570069 - RNA, 21 nt, Human
aagaaacaaaaucacacacag

SEQ ID NO: 570070 - RNA, 18 nt, Human
aagcaaacaaacagcauc

SEQ ID NO: 570071 - RNA, 26 nt, Human
aagcaggcaggucuagaguugucaca

SEQ ID NO: 570072 - RNA, 25 nt, Human
aagucaacuuuaugacuggauauaa

SEQ ID NO: 570073 - RNA, 18 nt, Human
aauuuacaaaugaaccag

SEQ ID NO: 570074 - RNA, 25 nt, Human
acaaaacaggaugcuuuaguuccuc

SEQ ID NO: 570075 - RNA, 26 nt, Human
acagacaaaaaaugcauccaccuaaa

SEQ ID NO: 570076 - RNA, 24 nt, Human
accaauauaaaaaucuggcccaga

SEQ ID NO: 570077 - RNA, 19 nt, Human
accccauucuuugagggcu

SEQ ID NO: 570078 - RNA, 21 nt, Human
acccuuaaaaugcaaguuuau

SEQ ID NO: 570079 - RNA, 27 nt, Human
agacaaaaaaugcauccaaccccgggg

SEQ ID NO: 570080 - RNA, 18 nt, Human
agacagaaauaaugaucu

SEQ ID NO: 570081 - RNA, 20 nt, Human
agacagaaauaaugaucugg

SEQ ID NO: 570082 - RNA, 20 nt, Human
agacccaggaagccgagcgg

SEQ ID NO: 570083 - RNA, 23 nt, Human
agcaggauaucuuuaauauucau

SEQ ID NO: 570084 - RNA, 20 nt, Human
agcaggcaggucuagaguug

SEQ ID NO: 570085 - RNA, 19 nt, Human
aggaagaaaaaacaagaga

SEQ ID NO: 570086 - RNA, 22 nt, Human
aggaagaaaaaacaagagacag

SEQ ID NO: 570087 - RNA, 21 nt, Human
aguaaacagacaaaaaaugca

SEQ ID NO: 570088 - RNA, 21 nt, Human
aguauccugaaccaggaagaa

SEQ ID NO: 570089 - RNA, 24 nt, Human
agugcaaagaaccaacauugaucu

SEQ ID NO: 570090 - RNA, 21 nt, Human
agugcugcuuaacaaaagaaa

SEQ ID NO: 570091 - RNA, 27 nt, Human
auagaacaaacagauguuugaacaaag

SEQ ID NO: 570092 - RNA, 18 nt, Human
aucuggacagauacaaaa

SEQ ID NO: 570093 - RNA, 19 nt, Human
caaaagaaacaaaaucaca

SEQ ID NO: 570094 - RNA, 21 nt, Human
caaacaaacagcaucaguucc

SEQ ID NO: 570095 - RNA, 18 nt, Human
caaagaauaagaagagaa

SEQ ID NO: 570096 - RNA, 20 nt, Human
caacaugcuucaaagaauaa

SEQ ID NO: 570097 - RNA, 24 nt, Human
caagcaaguugccacauucuuugu

SEQ ID NO: 570098 - RNA, 18 nt, Human
cacagagucacacauucu

SEQ ID NO: 570099 - RNA, 18 nt, Human
cacaugcauuugugagau

SEQ ID NO: 570100 - RNA, 23 nt, Human
caccagugcaaagaaccaacauu

SEQ ID NO: 570101 - RNA, 22 nt, Human
cagaaagaccagaauggaaaua

SEQ ID NO: 570102 - RNA, 19 nt, Human
caggaguuaagagugucau

SEQ ID NO: 570103 - RNA, 21 nt, Human
cagucuauaaauuaaaacuga

SEQ ID NO: 570104 - RNA, 25 nt, Human
ccaggaagaaaaaacaagagacaga

SEQ ID NO: 570105 - RNA, 22 nt, Human
ccccuuaaaaaaguauccugaa

SEQ ID NO: 570106 - RNA, 22 nt, Human
ccgcccggacccuccaacggcu

SEQ ID NO: 570107 - RNA, 21 nt, Human
ccuaugcaguccccacagagu

SEQ ID NO: 570108 - RNA, 22 nt, Human
ccuccuuuuaggcacaagcaag

SEQ ID NO: 570109 - RNA, 19 nt, Human
cggccgggagcgagaacgg

SEQ ID NO: 570110 - RNA, 21 nt, Human
cgggaggacggacgagcggcg

SEQ ID NO: 570111 - RNA, 18 nt, Human
cuccucucggaaacuucc

SEQ ID NO: 570112 - RNA, 25 nt, Human
cucggaaacuuccaaaaaagucugc

SEQ ID NO: 570113 - RNA, 19 nt, Human
cugaaaaccaauauaaaaa

SEQ ID NO: 570114 - RNA, 20 nt, Human
cugaaccaggaagaaaaaac

SEQ ID NO: 570115 - RNA, 22 nt, Human
cugcuuaacaaaagaaacaaaa

SEQ ID NO: 570116 - RNA, 22 nt, Human
cuuaacaaaagaaacaaaauca

SEQ ID NO: 570117 - RNA, 22 nt, Human
gaaaaaacaagagacagaaaua

SEQ ID NO: 570118 - RNA, 20 nt, Human
gaagagaaauuuaaaagccc

SEQ ID NO: 570119 - RNA, 19 nt, Human
gaaggaccguauucuggga

SEQ ID NO: 570120 - RNA, 18 nt, Human
gcagaaucucaccagugc

SEQ ID NO: 570121 - RNA, 22 nt, Human
gcagaaucucaccagugcaaag

SEQ ID NO: 570122 - RNA, 23 nt, Human
gccaagaaggacuggaagacuuc

SEQ ID NO: 570123 - RNA, 23 nt, Human
gcccagaaagaccagaauggaaa

SEQ ID NO: 570124 - RNA, 23 nt, Human
gcggcggcgucgacgacuuccac

SEQ ID NO: 570125 - RNA, 24 nt, Human
ggacagauacaaaacaggaugcuu

SEQ ID NO: 570126 - RNA, 25 nt, Human
ggguuuaggaaggaccguauucugg

SEQ ID NO: 570127 - RNA, 18 nt, Human
guccccacagagucacac

SEQ ID NO: 570128 - RNA, 24 nt, Human
uaaacagacaaaaaaugcauccac

SEQ ID NO: 570129 - RNA, 25 nt, Human
uaaauaucccuucauuuacagaacc

SEQ ID NO: 570130 - RNA, 24 nt, Human
uaacaaaagaaacaaaaucacaca

SEQ ID NO: 570131 - RNA, 25 nt, Human
uaacaaaagaaacaaaaucacacac

SEQ ID NO: 570132 - RNA, 18 nt, Human
uaacagguuuuauuauau

SEQ ID NO: 570133 - RNA, 20 nt, Human
uaaguuaaaauugccaauac

SEQ ID NO: 570134 - RNA, 22 nt, Human
uaaucaagaugucuaauggcac

SEQ ID NO: 570135 - RNA, 20 nt, Human
uacaacccuuaaaaugcaag

SEQ ID NO: 570136 - RNA, 23 nt, Human
uagaacaaacagauguuugaaca

SEQ ID NO: 570137 - RNA, 28 nt, Human
uagaacaaacagauguuugaacaaagac

SEQ ID NO: 570138 - RNA, 18 nt, Human
uagaagcaaacaaacagc

SEQ ID NO: 570139 - RNA, 20 nt, Human
uagacauuuacugaaaacca

SEQ ID NO: 570140 - RNA, 25 nt, Human
uaucauagaagcaaacaaacagcau

SEQ ID NO: 570141 - RNA, 20 nt, Human
ucaaagaauaagaagagaaa

SEQ ID NO: 570142 - RNA, 20 nt, Human
uccacacgagcgggccuccg

SEQ ID NO: 570143 - RNA, 22 nt, Human
ucccacaugagucauucacgcc

SEQ ID NO: 570144 - RNA, 29 nt, Human
ucucaaccccuuaaaaaaguauccucccc

SEQ ID NO: 570145 - RNA, 20 nt, Human
ucucaccagugcaaagaacc

SEQ ID NO: 570146 - RNA, 23 nt, Human
ugaaaaaggcaauuucugggguu

SEQ ID NO: 570147 - RNA, 23 nt, Human
ugaaaaccaauauaaaaaucugg

SEQ ID NO: 570148 - RNA, 23 nt, Human
ugaacaacaguagcaaguuuaaa

SEQ ID NO: 570149 - RNA, 21 nt, Human
ugaaccaggaagaaaaaacaa

SEQ ID NO: 570150 - RNA, 25 nt, Human
ugacuggagauagaacaaacagaug

SEQ ID NO: 570151 - RNA, 23 nt, Human
ugacuggauauaaaaagucagga

SEQ ID NO: 570152 - RNA, 21 nt, Human
ugagaagagcaguaaacagac

SEQ ID NO: 570153 - RNA, 23 nt, Human
ugagaagagcaguaaacagacaa

SEQ ID NO: 570154 - RNA, 21 nt, Human
ugauagaguucucagaaagca

SEQ ID NO: 570155 - RNA, 25 nt, Human
ugcauccaccuaaauaaaaaaauuc

SEQ ID NO: 570156 - RNA, 18 nt, Human
ugccaaagcuuacaucag

SEQ ID NO: 570157 - RNA, 27 nt, Human
uggcaccagucaaaagagugccaaagc

SEQ ID NO: 570158 - RNA, 24 nt, Human
ugucaguauuaagcuacuggacuc

SEQ ID NO: 570159 - RNA, 24 nt, Human
ugugacugauuauuaaacaaccug

SEQ ID NO: 570160 - RNA, 22 nt, Human
uguuaaaaguuuucacaugcag

SEQ ID NO: 570161 - RNA, 19 nt, Human
uuaaaaugcaaguuuauug

SEQ ID NO: 570162 - RNA, 20 nt, Human
uuaagagugucaugcagcag

SEQ ID NO: 570163 - RNA, 20 nt, Human
uuaggcacaagcaaguugcc

SEQ ID NO: 570164 - RNA, 24 nt, Human
uucauuaaaagaacuuacuguuga

SEQ ID NO: 570165 - RNA, 21 nt, Human
uucuaguuccaauuccuccuu

SEQ ID NO: 570166 - RNA, 21 nt, Human
uuggaaaaucuucaauucuca

SEQ ID NO: 570167 - RNA, 22 nt, Human
uuuaacuagcccacagacccca

SEQ ID NO: 570168 - RNA, 20 nt, Human
aaaaacaaaaaaguacugug

SEQ ID NO: 570169 - RNA, 22 nt, Human
aaaagcuaugaugacaaaucuc

SEQ ID NO: 570170 - RNA, 24 nt, Human
aaaaugcugggauuacagguguga

SEQ ID NO: 570171 - RNA, 23 nt, Human
aaacaaaaauagagcugguaaau

SEQ ID NO: 570172 - RNA, 27 nt, Human
aaacaaaaauagagcugguaaaucuag

SEQ ID NO: 570173 - RNA, 26 nt, Human
aaaugcugggauuacaggugugagcc

SEQ ID NO: 570174 - RNA, 18 nt, Human
aaaugucuuuuuaaaugu

SEQ ID NO: 570175 - RNA, 20 nt, Human
aacucaauaccagcccucca

SEQ ID NO: 570176 - RNA, 18 nt, Human
aagcagagccuggggaag

SEQ ID NO: 570177 - RNA, 22 nt, Human
aaugucuagagaaaaugaaaac

SEQ ID NO: 570178 - RNA, 18 nt, Human
acaggguuucaccauguu

SEQ ID NO: 570179 - RNA, 21 nt, Human
acaggguuucaccauguuggc

SEQ ID NO: 570180 - RNA, 24 nt, Human
acaggguuucaccauguuggccag

SEQ ID NO: 570181 - RNA, 26 nt, Human
accagcccuccacaccucggcagcac

SEQ ID NO: 570182 - RNA, 18 nt, Human
accauguuggccaggcug

SEQ ID NO: 570183 - RNA, 24 nt, Human
acucugucguccaggcuggagugc

SEQ ID NO: 570184 - RNA, 23 nt, Human
acuugcugccuagaaaaggcugc

SEQ ID NO: 570185 - RNA, 19 nt, Human
agcaggagguuccaggugu

SEQ ID NO: 570186 - RNA, 22 nt, Human
agccagaagccagcgggggcca

SEQ ID NO: 570187 - RNA, 26 nt, Human
agcugguccacguccugcacagugcc

SEQ ID NO: 570188 - RNA, 21 nt, Human
aggcugcaggucccuuccagu

SEQ ID NO: 570189 - RNA, 25 nt, Human
aggcuggagugcaguggcgcgaucu

SEQ ID NO: 570190 - RNA, 21 nt, Human
agguagacaggcccaguuucc

SEQ ID NO: 570191 - RNA, 25 nt, Human
aggucuggaugcugggcacuacggg

SEQ ID NO: 570192 - RNA, 24 nt, Human
aggugauccaccugccucggccuc

SEQ ID NO: 570193 - RNA, 23 nt, Human
aguagcugggauuacaggcaugu

SEQ ID NO: 570194 - RNA, 20 nt, Human
agugcaguggcgcgaucucg

SEQ ID NO: 570195 - RNA, 24 nt, Human
agugcaguggcgcgaucucgacuc

SEQ ID NO: 570196 - RNA, 23 nt, Human
aucagcgacaaugcacccaggaa

SEQ ID NO: 570197 - RNA, 18 nt, Human
aucucacucugucgucca

SEQ ID NO: 570198 - RNA, 19 nt, Human
aucugcggcgacucuccuc

SEQ ID NO: 570199 - RNA, 21 nt, Human
augaagccuggaagauacgcu

SEQ ID NO: 570200 - RNA, 18 nt, Human
augacaaaucuccaaaca

SEQ ID NO: 570201 - RNA, 20 nt, Human
auucuuaacagcuuugacgu

SEQ ID NO: 570202 - RNA, 24 nt, Human
auuuuuguauuuuuaguagagaca

SEQ ID NO: 570203 - RNA, 19 nt, Human
caaaagcuaugaugacaaa

SEQ ID NO: 570204 - RNA, 24 nt, Human
caaaaugcugggauuacaggugug

SEQ ID NO: 570205 - RNA, 22 nt, Human
caaagcagccgugucccgagga

SEQ ID NO: 570206 - RNA, 24 nt, Human
caaagcagccgugucccgaggaac

SEQ ID NO: 570207 - RNA, 20 nt, Human
caaccaggcggacacgagaa

SEQ ID NO: 570208 - RNA, 19 nt, Human
caagaggauggaaagaacc

SEQ ID NO: 570209 - RNA, 22 nt, Human
caagcgaaucuccugccucagc

SEQ ID NO: 570210 - RNA, 22 nt, Human
cacaugccguguugccagugcc

SEQ ID NO: 570211 - RNA, 24 nt, Human
caccaugcccggcuaauuuuugua

SEQ ID NO: 570212 - RNA, 21 nt, Human
caccauguuggccaggcuggu

SEQ ID NO: 570213 - RNA, 24 nt, Human
caccauguuggccaggcuggucuc

SEQ ID NO: 570214 - RNA, 27 nt, Human
caccauguuggccaggcuggucucaaa

SEQ ID NO: 570215 - RNA, 23 nt, Human
caccugccucggccucccaaaau

SEQ ID NO: 570216 - RNA, 24 nt, Human
cacucugucguccaggcuggagug

SEQ ID NO: 570217 - RNA, 22 nt, Human
cagccagaagccagcgggggcc

SEQ ID NO: 570218 - RNA, 22 nt, Human
cagccuccaagcacacuaaccu

SEQ ID NO: 570219 - RNA, 20 nt, Human
cagccuccugaguagcuggg

SEQ ID NO: 570220 - RNA, 21 nt, Human
cagcgacaaugcacccaggaa

SEQ ID NO: 570221 - RNA, 20 nt, Human
cagcgggggccaggcggggu

SEQ ID NO: 570222 - RNA, 24 nt, Human
caggguuucaccauguuggccagg

SEQ ID NO: 570223 - RNA, 22 nt, Human
caggugauccaccugccucggc

SEQ ID NO: 570224 - RNA, 19 nt, Human
cauggugcaaggacagacu

SEQ ID NO: 570225 - RNA, 24 nt, Human
cauguuggccaggcuggucucaaa

SEQ ID NO: 570226 - RNA, 21 nt, Human
ccaaaaugcugggauuacagg

SEQ ID NO: 570227 - RNA, 21 nt, Human
ccaaaaugcugggauuacagg

SEQ ID NO: 570228 - RNA, 24 nt, Human
ccaaaaugcugggauuacaggugu

SEQ ID NO: 570229 - RNA, 25 nt, Human
ccagcaggagguuccaggugucccu

SEQ ID NO: 570230 - RNA, 20 nt, Human
ccaggcggggucugcaggcu

SEQ ID NO: 570231 - RNA, 21 nt, Human
ccaggcggggucugcaggcug

SEQ ID NO: 570232 - RNA, 18 nt, Human
ccaggcuggagugcagug

SEQ ID NO: 570233 - RNA, 24 nt, Human
ccaucagauguuccugaagcccag

SEQ ID NO: 570234 - RNA, 22 nt, Human
cccacaggcggcgcuauggcuc

SEQ ID NO: 570235 - RNA, 20 nt, Human
cccucugugaccaucucugc

SEQ ID NO: 570236 - RNA, 21 nt, Human
ccugaccucaggugauccacc

SEQ ID NO: 570237 - RNA, 23 nt, Human
ccugaccucaggugauccaccug

SEQ ID NO: 570238 - RNA, 23 nt, Human
ccugaccucaggugauccaccug

SEQ ID NO: 570239 - RNA, 23 nt, Human
ccugaguagcugggauuacaggc

SEQ ID NO: 570240 - RNA, 24 nt, Human
ccugaguagcugggauuacaggca

SEQ ID NO: 570241 - RNA, 23 nt, Human
ccugaguucaagcgaaucucccc

SEQ ID NO: 570242 - RNA, 23 nt, Human
ccugaguucaagcgaaucuccug

SEQ ID NO: 570243 - RNA, 24 nt, Human
ccugccucggccucccaaaaugcu

SEQ ID NO: 570244 - RNA, 27 nt, Human
cgagaaacagaugauaacauggugcaa

SEQ ID NO: 570245 - RNA, 22 nt, Human
cgcugccggacgcugguucgcc

SEQ ID NO: 570246 - RNA, 26 nt, Human
cggcagcacucguggguccuccucaa

SEQ ID NO: 570247 - RNA, 24 nt, Human
cguccaggcuggagugcaguggcg

SEQ ID NO: 570248 - RNA, 23 nt, Human
cgugugccguugcuaugcaaagc

SEQ ID NO: 570249 - RNA, 21 nt, Human
cuaaaaauuuaaaccuuccag

SEQ ID NO: 570250 - RNA, 19 nt, Human
cuaaagguagacaggccca

SEQ ID NO: 570251 - RNA, 22 nt, Human
cucaauaccagcccuccacacc

SEQ ID NO: 570252 - RNA, 24 nt, Human
cucacucugucguccaggcuggag

SEQ ID NO: 570253 - RNA, 19 nt, Human
cucacuguaaccuccgucu

SEQ ID NO: 570254 - RNA, 24 nt, Human
cucagccuccugaguagcugggau

SEQ ID NO: 570255 - RNA, 21 nt, Human
cuccacaccucggcagcacuc

SEQ ID NO: 570256 - RNA, 27 nt, Human
cuccucugugcugggcagcagcucccc

SEQ ID NO: 570257 - RNA, 22 nt, Human
cuccugccucagccuccugagu

SEQ ID NO: 570258 - RNA, 22 nt, Human
cucucacaccgcagcuagguca

SEQ ID NO: 570259 - RNA, 19 nt, Human
cucucucacaccgcagcua

SEQ ID NO: 570260 - RNA, 22 nt, Human
cucugugcugggcagcagcucc

SEQ ID NO: 570261 - RNA, 23 nt, Human
cugaguagcugggauuacaggca

SEQ ID NO: 570262 - RNA, 24 nt, Human
cugaguagcugggauuacaggcau

SEQ ID NO: 570263 - RNA, 23 nt, Human
cugccucagccuccugaguagcu

SEQ ID NO: 570264 - RNA, 22 nt, Human
cugcugcccucugugaccaucu

SEQ ID NO: 570265 - RNA, 23 nt, Human
cugcugcccucugugaccaucuc

SEQ ID NO: 570266 - RNA, 23 nt, Human
cugguccacguccugcacagugc

SEQ ID NO: 570267 - RNA, 18 nt, Human
gaagcagagccuggggaa

SEQ ID NO: 570268 - RNA, 19 nt, Human
gaagccaacccagcugcuu

SEQ ID NO: 570269 - RNA, 24 nt, Human
gaccucaggugauccaccugccuc

SEQ ID NO: 570270 - RNA, 22 nt, Human
gaguagcugggauuacaggcau

SEQ ID NO: 570271 - RNA, 25 nt, Human
gaguagcugggauuacaggcaugug

SEQ ID NO: 570272 - RNA, 18 nt, Human
gauuacaggcaugugcca

SEQ ID NO: 570273 - RNA, 24 nt, Human
gauuacaggcaugugccaccaugc

SEQ ID NO: 570274 - RNA, 18 nt, Human
gauuacaggugugagcca

SEQ ID NO: 570275 - RNA, 21 nt, Human
gauuacaggugugagccacca

SEQ ID NO: 570276 - RNA, 22 nt, Human
gauuacaggugugagccaccac

SEQ ID NO: 570277 - RNA, 21 nt, Human
gcagagccuggggaaggucug

SEQ ID NO: 570278 - RNA, 23 nt, Human
gccaagcuccuucuucaucguag

SEQ ID NO: 570279 - RNA, 22 nt, Human
gccaugcucucucacaccgcag

SEQ ID NO: 570280 - RNA, 22 nt, Human
gcccggcuaauuuuuguauuuu

SEQ ID NO: 570281 - RNA, 20 nt, Human
gccucagccuccugaguagc

SEQ ID NO: 570282 - RNA, 24 nt, Human
gcgaaucuccugccucagccuccu

SEQ ID NO: 570283 - RNA, 21 nt, Human
gcgggggccaggcggggucug

SEQ ID NO: 570284 - RNA, 19 nt, Human
gcuggagugcaguggcgcg

SEQ ID NO: 570285 - RNA, 23 nt, Human
gcuggucucaaacuccugaccuc

SEQ ID NO: 570286 - RNA, 24 nt, Human
ggauuacaggcaugugccaccaug

SEQ ID NO: 570287 - RNA, 24 nt, Human
ggcuggucucaaacuccugaccuc

SEQ ID NO: 570288 - RNA, 18 nt, Human
gggacccgcaguaaaaug

SEQ ID NO: 570289 - RNA, 21 nt, Human
gggcagcaaggcacgccugug

SEQ ID NO: 570290 - RNA, 24 nt, Human
gggggcagcaaggcacgccuguga

SEQ ID NO: 570291 - RNA, 22 nt, Human
ggguuucaccauguuggccagg

SEQ ID NO: 570292 - RNA, 18 nt, Human
guagcugggauuacaggc

SEQ ID NO: 570293 - RNA, 20 nt, Human
guagcugggauuacaggcau

SEQ ID NO: 570294 - RNA, 30 nt, Human
gugaauucuauaaacuuuucugaacaaaag

SEQ ID NO: 570295 - RNA, 24 nt, Human
gugauccaccugccucggccuccc

SEQ ID NO: 570296 - RNA, 22 nt, Human
gugugccguugcuaugcaaagc

SEQ ID NO: 570297 - RNA, 24 nt, Human
uaaauguaauuaaaauauauuuua

SEQ ID NO: 570298 - RNA, 21 nt, Human
uaaccuccgucuccugaguuc

SEQ ID NO: 570299 - RNA, 19 nt, Human
uaagaaacaucgacaguuc

SEQ ID NO: 570300 - RNA, 23 nt, Human
uaaguccuguucucagaagccaa

SEQ ID NO: 570301 - RNA, 24 nt, Human
uaauuuuuguauuuuuaguagaga

SEQ ID NO: 570302 - RNA, 23 nt, Human
uacaggcaugugccaccaugccc

SEQ ID NO: 570303 - RNA, 23 nt, Human
uacaggugugagccaccacgccc

SEQ ID NO: 570304 - RNA, 20 nt, Human
uaccuuaguauuuuguaaau

SEQ ID NO: 570305 - RNA, 18 nt, Human
uagacauaucauccgcaa

SEQ ID NO: 570306 - RNA, 22 nt, Human
uagagacaggguuucaccaugu

SEQ ID NO: 570307 - RNA, 24 nt, Human
uaguagagacaggguuucaccaug

SEQ ID NO: 570308 - RNA, 26 nt, Human
uaguagagacaggguuucaccauguu

SEQ ID NO: 570309 - RNA, 18 nt, Human
uauauaaacggugugaga

SEQ ID NO: 570310 - RNA, 18 nt, Human
uaugaagcuucucaggca

SEQ ID NO: 570311 - RNA, 24 nt, Human
ucacucugucguccaggcuggagu

SEQ ID NO: 570312 - RNA, 21 nt, Human
ucacuggaccagccagaagcc

SEQ ID NO: 570313 - RNA, 19 nt, Human
ucacuguaaccuccgucuc

SEQ ID NO: 570314 - RNA, 20 nt, Human
ucacuguaaccuccgucucc

SEQ ID NO: 570315 - RNA, 22 nt, Human
ucacuguaaccuccgucuccug

SEQ ID NO: 570316 - RNA, 25 nt, Human
ucacuguaaccuccgucuccugagu

SEQ ID NO: 570317 - RNA, 20 nt, Human
ucagaagccaacccagcugc

SEQ ID NO: 570318 - RNA, 20 nt, Human
ucagccuccugaguagcugg

SEQ ID NO: 570319 - RNA, 21 nt, Human
ucaggugauccaccugccucg

SEQ ID NO: 570320 - RNA, 23 nt, Human
uccaagcacacuaaccucagcca

SEQ ID NO: 570321 - RNA, 24 nt, Human
uccaccugccucggccucccaaaa

SEQ ID NO: 570322 - RNA, 19 nt, Human
uccagcugguccacguccu

SEQ ID NO: 570323 - RNA, 18 nt, Human
uccaguccugucccugcu

SEQ ID NO: 570324 - RNA, 23 nt, Human
ucccaaaaugcugggauuacagg

SEQ ID NO: 570325 - RNA, 20 nt, Human
ucccaaagcagccguguccc

SEQ ID NO: 570326 - RNA, 19 nt, Human
ucccuuccaguccuguccc

SEQ ID NO: 570327 - RNA, 24 nt, Human
uccugaguagcugggauuacaggc

SEQ ID NO: 570328 - RNA, 21 nt, Human
uccugaguucaagcgaaucuc

SEQ ID NO: 570329 - RNA, 24 nt, Human
uccugaguucaagcgaaucuccug

SEQ ID NO: 570330 - RNA, 20 nt, Human
uccugcuuaacuugcugccu

SEQ ID NO: 570331 - RNA, 18 nt, Human
ucggccucccaaaaugcu

SEQ ID NO: 570332 - RNA, 24 nt, Human
ucguccaggcuggagugcaguggc

SEQ ID NO: 570333 - RNA, 18 nt, Human
ucgugccacgugugccgu

SEQ ID NO: 570334 - RNA, 18 nt, Human
ucuauaaacuuuucugaa

SEQ ID NO: 570335 - RNA, 23 nt, Human
ucucacucugucguccaggcugg

SEQ ID NO: 570336 - RNA, 24 nt, Human
ucucacucugucguccaggcugga

SEQ ID NO: 570337 - RNA, 18 nt, Human
ucugcuggaaucgugcca

SEQ ID NO: 570338 - RNA, 24 nt, Human
ucugucguccaggcuggagugcag

SEQ ID NO: 570339 - RNA, 24 nt, Human
ugaccucaggugauccaccugccu

SEQ ID NO: 570340 - RNA, 18 nt, Human
ugagacagaaucucacuc

SEQ ID NO: 570341 - RNA, 22 nt, Human
ugagacagaaucucacucuguc

SEQ ID NO: 570342 - RNA, 24 nt, Human
ugagguagggucaacagugauguc

SEQ ID NO: 570343 - RNA, 18 nt, Human
ugcacagugcugcagggg

SEQ ID NO: 570344 - RNA, 24 nt, Human
ugcccggcuaauuuuuguauuuuu

SEQ ID NO: 570345 - RNA, 24 nt, Human
ugccucagccuccugaguagcugg

SEQ ID NO: 570346 - RNA, 21 nt, Human
ugccucggccucccaaaaugc

SEQ ID NO: 570347 - RNA, 24 nt, Human
ugccucggccucccaaaaugcugg

SEQ ID NO: 570348 - RNA, 21 nt, Human
ugcggcgacucuccucugugc

SEQ ID NO: 570349 - RNA, 19 nt, Human
ugcuaagaaacaucgacag

SEQ ID NO: 570350 - RNA, 24 nt, Human
ugcugggauuacaggugugagcca

SEQ ID NO: 570351 - RNA, 22 nt, Human
uggaaucagcgacaaugcaccc

SEQ ID NO: 570352 - RNA, 23 nt, Human
uggagugcaguggcgcgaucucg

SEQ ID NO: 570353 - RNA, 24 nt, Human
uggccaggcuggucucaaacuccu

SEQ ID NO: 570354 - RNA, 24 nt, Human
uggcgcgaucucgacucacuguaa

SEQ ID NO: 570355 - RNA, 25 nt, Human
ugggauggcgccucugguuucaugg

SEQ ID NO: 570356 - RNA, 18 nt, Human
ugggauuacaggcaugug

SEQ ID NO: 570357 - RNA, 21 nt, Human
ugggauuacaggcaugugcca

SEQ ID NO: 570358 - RNA, 22 nt, Human
ugggauuacaggcaugugccac

SEQ ID NO: 570359 - RNA, 24 nt, Human
ugggauuacaggcaugugccacca

SEQ ID NO: 570360 - RNA, 18 nt, Human
ugggauuacaggugugag

SEQ ID NO: 570361 - RNA, 19 nt, Human
ugggauuacaggugugagc

SEQ ID NO: 570362 - RNA, 22 nt, Human
ugggauuacaggugugagccac

SEQ ID NO: 570363 - RNA, 23 nt, Human
ugggauuacaggugugagccacc

SEQ ID NO: 570364 - RNA, 24 nt, Human
ugggauuacaggugugagccacca

SEQ ID NO: 570365 - RNA, 19 nt, Human
ugucguccaggcuggagug

SEQ ID NO: 570366 - RNA, 18 nt, Human
ugucuagagaaaaugaaa

SEQ ID NO: 570367 - RNA, 21 nt, Human
ugugagccaccacgcccggcc

SEQ ID NO: 570368 - RNA, 24 nt, Human
uuaguagagacaggguuucaccau

SEQ ID NO: 570369 - RNA, 21 nt, Human
uucauggaaaaaugucuuuuu

SEQ ID NO: 570370 - RNA, 24 nt, Human
uuucaccauguuggccaggcuggu

SEQ ID NO: 570371 - RNA, 24 nt, Human
uuuuuaguagagacaggguuucac

SEQ ID NO: 570372 - RNA, 20 nt, Human
uuuuuguauuuuuaguagag

SEQ ID NO: 570373 - RNA, 20 nt, Human
aacccaguucugccuaguga

SEQ ID NO: 570374 - RNA, 24 nt, Human
aagagccuggagaaggucugaaac

SEQ ID NO: 570375 - RNA, 24 nt, Human
acaaagcaucaaacccaguucugc

SEQ ID NO: 570376 - RNA, 25 nt, Human
accuuccugagacauacuuucguca

SEQ ID NO: 570377 - RNA, 23 nt, Human
agaaaauguacagacauaaguau

SEQ ID NO: 570378 - RNA, 22 nt, Human
augcacaaaugugcuuuuaauu

SEQ ID NO: 570379 - RNA, 21 nt, Human
cauagcuccucuggccagcua

SEQ ID NO: 570380 - RNA, 24 nt, Human
cauccugugagagcuccuaagagc

SEQ ID NO: 570381 - RNA, 18 nt, Human
ccuccuugaaaagagccu

SEQ ID NO: 570382 - RNA, 22 nt, Human
ccucuggccagcuacuuaauuc

SEQ ID NO: 570383 - RNA, 19 nt, Human
cuccuaagagcugcaccau

SEQ ID NO: 570384 - RNA, 22 nt, Human
cuggcuugacugguuaauucau

SEQ ID NO: 570385 - RNA, 18 nt, Human
gaaaagagccuggagaag

SEQ ID NO: 570386 - RNA, 21 nt, Human
gagaaggucugaaacuuacaa

SEQ ID NO: 570387 - RNA, 23 nt, Human
gagacaaugagaggagucggggc

SEQ ID NO: 570388 - RNA, 19 nt, Human
gcacagauaugcugaacac

SEQ ID NO: 570389 - RNA, 21 nt, Human
ggcuugacaguccucuggcuu

SEQ ID NO: 570390 - RNA, 18 nt, Human
guaaaauauuccuuagag

SEQ ID NO: 570391 - RNA, 24 nt, Human
uauaugaaggacugaggaggggag

SEQ ID NO: 570392 - RNA, 23 nt, Human
ugaaaagagccuggagaaggucc

SEQ ID NO: 570393 - RNA, 25 nt, Human
ugacaaagcaucaaacccaguucug

SEQ ID NO: 570394 - RNA, 21 nt, Human
ugcugaacacauccugugaga

SEQ ID NO: 570395 - RNA, 21 nt, Human
ugugagagcuccuaagagcug

SEQ ID NO: 570396 - RNA, 24 nt, Human
uugacaguccucuggcuugacugg

SEQ ID NO: 570397 - RNA, 20 nt, Human
uuggcuugacaguccucugg

SEQ ID NO: 570398 - RNA, 19 nt, Human
acagaccccagcuccagcc

SEQ ID NO: 570399 - RNA, 18 nt, Human
acccgcaccacaagacau

SEQ ID NO: 570400 - RNA, 21 nt, Human
accugggucuggcccuggcag

SEQ ID NO: 570401 - RNA, 24 nt, Human
agacggaaaaugcaucucccaaga

SEQ ID NO: 570402 - RNA, 21 nt, Human
agcacccacccucacaguggc

SEQ ID NO: 570403 - RNA, 19 nt, Human
agccagugccuacaacagg

SEQ ID NO: 570404 - RNA, 18 nt, Human
agcccaguccccacccag

SEQ ID NO: 570405 - RNA, 26 nt, Human
agccucacccucccccugugagccag

SEQ ID NO: 570406 - RNA, 20 nt, Human
aggaaggaggccugccccuu

SEQ ID NO: 570407 - RNA, 19 nt, Human
aggcaggggugggaggggu

SEQ ID NO: 570408 - RNA, 22 nt, Human
aggcgcccccucaccuggcucu

SEQ ID NO: 570409 - RNA, 24 nt, Human
cacagcccaguccccacccaggag

SEQ ID NO: 570410 - RNA, 22 nt, Human
cacccacccucacaguggccug

SEQ ID NO: 570411 - RNA, 18 nt, Human
caccugccuggcuccugc

SEQ ID NO: 570412 - RNA, 18 nt, Human
caggggccggcaaggcag

SEQ ID NO: 570413 - RNA, 18 nt, Human
caggggccggcaaggcag

SEQ ID NO: 570414 - RNA, 24 nt, Human
caggggccggcaaggcaggggugg

SEQ ID NO: 570415 - RNA, 19 nt, Human
cauccugggggacagaggc

SEQ ID NO: 570416 - RNA, 20 nt, Human
cauccugggggacagaggcu

SEQ ID NO: 570417 - RNA, 20 nt, Human
ccaccugggucuggcccugg

SEQ ID NO: 570418 - RNA, 22 nt, Human
ccaccugggucuggcccuggca

SEQ ID NO: 570419 - RNA, 23 nt, Human
ccccaccugggucuggcccuggc

SEQ ID NO: 570420 - RNA, 21 nt, Human
ccccagcuccagccacaggcu

SEQ ID NO: 570421 - RNA, 22 nt, Human
cccccugugagccagacggaaa

SEQ ID NO: 570422 - RNA, 19 nt, Human
cccgcaccacaagacaucc

SEQ ID NO: 570423 - RNA, 20 nt, Human
cccgcaccacaagacauccu

SEQ ID NO: 570424 - RNA, 24 nt, Human
cccgcaccacaagacauccugggg

SEQ ID NO: 570425 - RNA, 21 nt, Human
cccucacaguggccugggcag

SEQ ID NO: 570426 - RNA, 20 nt, Human
cccucaccuggcucugcugu

SEQ ID NO: 570427 - RNA, 18 nt, Human
cccucccuagccagugcc

SEQ ID NO: 570428 - RNA, 19 nt, Human
cccuccucccuccucucuc

SEQ ID NO: 570429 - RNA, 20 nt, Human
cccugggcacagcccagucc

SEQ ID NO: 570430 - RNA, 18 nt, Human
ccgccagguucccuccuc

SEQ ID NO: 570431 - RNA, 24 nt, Human
ccgccgccgccgcuaccgccgccg

SEQ ID NO: 570432 - RNA, 18 nt, Human
ccgccgcuaccgccgccg

SEQ ID NO: 570433 - RNA, 20 nt, Human
ccgccgcuaccgccgccggg

SEQ ID NO: 570434 - RNA, 21 nt, Human
ccucacaguggccugggcagg

SEQ ID NO: 570435 - RNA, 24 nt, Human
ccucacaguggccugggcaggggc

SEQ ID NO: 570436 - RNA, 25 nt, Human
ccucacccucccccugugagccaga

SEQ ID NO: 570437 - RNA, 18 nt, Human
ccuccucccuccucucuc

SEQ ID NO: 570438 - RNA, 19 nt, Human
ccuccucucucagggucac

SEQ ID NO: 570439 - RNA, 22 nt, Human
ccuggcaggcgcccccucaccu

SEQ ID NO: 570440 - RNA, 19 nt, Human
cgagaacaaagacaucacc

SEQ ID NO: 570441 - RNA, 20 nt, Human
cggcugggagcagccuccac

SEQ ID NO: 570442 - RNA, 21 nt, Human
cggcugggagcagccuccacg

SEQ ID NO: 570443 - RNA, 22 nt, Human
cucacccucccccugugagcca

SEQ ID NO: 570444 - RNA, 22 nt, Human
cucagggucaccagugugugaa

SEQ ID NO: 570445 - RNA, 19 nt, Human
cugccuggcuccugcugcc

SEQ ID NO: 570446 - RNA, 18 nt, Human
gagaacaaagacaucacc

SEQ ID NO: 570447 - RNA, 21 nt, Human
gagaacaaagacaucaccugc

SEQ ID NO: 570448 - RNA, 20 nt, Human
gagccgguuuuuuuuuuuuu

SEQ ID NO: 570449 - RNA, 19 nt, Human
gcaaagccucacccucccc

SEQ ID NO: 570450 - RNA, 20 nt, Human
gcaaagccucacccuccccc

SEQ ID NO: 570451 - RNA, 22 nt, Human
gcagaacggccgacccgcacca

SEQ ID NO: 570452 - RNA, 22 nt, Human
gcccugggcacagcccaguccc

SEQ ID NO: 570453 - RNA, 21 nt, Human
gcuguggaucucccuguggac

SEQ ID NO: 570454 - RNA, 22 nt, Human
gggcaggggcuggggugcaaag

SEQ ID NO: 570455 - RNA, 22 nt, Human
gggccggcaaggcagggguggg

SEQ ID NO: 570456 - RNA, 24 nt, Human
guggccugggcaggggcuggggug

SEQ ID NO: 570457 - RNA, 22 nt, Human
uagguaaacagaccccagcucc

SEQ ID NO: 570458 - RNA, 20 nt, Human
ucacaguggccugggcaggg

SEQ ID NO: 570459 - RNA, 22 nt, Human
uccccacccaggagcauauccu

SEQ ID NO: 570460 - RNA, 24 nt, Human
ucucucagggucaccaguguguga

SEQ ID NO: 570461 - RNA, 22 nt, Human
ucugcugugggagccgagaaca

SEQ ID NO: 570462 - RNA, 18 nt, Human
uggcccuggcaggcgccc

SEQ ID NO: 570463 - RNA, 24 nt, Human
uggccugggcaggggcuggggugc

SEQ ID NO: 570464 - RNA, 21 nt, Human
ugggcaggggcuggggugcaa

SEQ ID NO: 570465 - RNA, 20 nt, Human
ugggggacagaggcccuggg

SEQ ID NO: 570466 - RNA, 22 nt, Human
uucccuccucccuccucucuca

SEQ ID NO: 570467 - RNA, 21 nt, Human
aaaaacaaaugauccaaccca

SEQ ID NO: 570468 - RNA, 20 nt, Human
aaaaggaaacaaaaggaaca

SEQ ID NO: 570469 - RNA, 24 nt, Human
aaaauacaacaaaaaaagcugcug

SEQ ID NO: 570470 - RNA, 19 nt, Human
aaacagaacagaaacuuga

SEQ ID NO: 570471 - RNA, 21 nt, Human
aaacaggugcagaggaccaga

SEQ ID NO: 570472 - RNA, 22 nt, Human
aaaccauagaaaucucagguua

SEQ ID NO: 570473 - RNA, 24 nt, Human
aacaaacgagucauacaaaagaaa

SEQ ID NO: 570474 - RNA, 19 nt, Human
aacauggugaaaccccauc

SEQ ID NO: 570475 - RNA, 20 nt, Human
aacauggugaaaccccaucu

SEQ ID NO: 570476 - RNA, 20 nt, Human
aacauggugaaaccccaucu

SEQ ID NO: 570477 - RNA, 21 nt, Human
aacauggugaaaccccaucuc

SEQ ID NO: 570478 - RNA, 22 nt, Human
aaccccagaaauauacaaaaca

SEQ ID NO: 570479 - RNA, 24 nt, Human
aaccuggccaacauggugaaaccc

SEQ ID NO: 570480 - RNA, 23 nt, Human
aagaacaaacgagucauacaaaa

SEQ ID NO: 570481 - RNA, 23 nt, Human
aagaggcugaggcaggagaauca

SEQ ID NO: 570482 - RNA, 21 nt, Human
aagcagaaucguaaagccaag

SEQ ID NO: 570483 - RNA, 25 nt, Human
aaggaaacaaaaggaacaauacaca

SEQ ID NO: 570484 - RNA, 23 nt, Human
aaggaaacagaacagaaacuuga

SEQ ID NO: 570485 - RNA, 19 nt, Human
aaguacacaaaaaaaauua

SEQ ID NO: 570486 - RNA, 18 nt, Human
aauaacaaaacaauguug

SEQ ID NO: 570487 - RNA, 24 nt, Human
aaucauuugaacccaggaggcgga

SEQ ID NO: 570488 - RNA, 24 nt, Human
aaucauuugaacccaggaggcgga

SEQ ID NO: 570489 - RNA, 22 nt, Human
acaaagcaacaggcacugcuag

SEQ ID NO: 570490 - RNA, 23 nt, Human
acaaagcaacaggcacugcuagg

SEQ ID NO: 570491 - RNA, 24 nt, Human
acaaagcaacaggcacugcuaggg

SEQ ID NO: 570492 - RNA, 25 nt, Human
acaaagcaacaggcacugcuagggg

SEQ ID NO: 570493 - RNA, 24 nt, Human
acaacaaaaaaagcugcugcugaa

SEQ ID NO: 570494 - RNA, 22 nt, Human
accacugcacuccagccugggc

SEQ ID NO: 570495 - RNA, 24 nt, Human
accccaucucuacuaaaaauacaa

SEQ ID NO: 570496 - RNA, 20 nt, Human
accgcagaauccaacucucc

SEQ ID NO: 570497 - RNA, 22 nt, Human
acuccagccugggcaacaguga

SEQ ID NO: 570498 - RNA, 24 nt, Human
acugcacuccagccugggcaacag

SEQ ID NO: 570499 - RNA, 22 nt, Human
agaaaggaaggaaacagaacag

SEQ ID NO: 570500 - RNA, 21 nt, Human
agaaucguaaagccaaggaca

SEQ ID NO: 570501 - RNA, 18 nt, Human
agagucucuaucuccacu

SEQ ID NO: 570502 - RNA, 24 nt, Human
agcauuuugggaggcugaggaggg

SEQ ID NO: 570503 - RNA, 22 nt, Human
agcgggaagcaaccuuaaacau

SEQ ID NO: 570504 - RNA, 23 nt, Human
agcugggugugguggcaggugcc

SEQ ID NO: 570505 - RNA, 19 nt, Human
aggaaggaaacagaacaga

SEQ ID NO: 570506 - RNA, 24 nt, Human
aggaggcggagauugcacugaacu

SEQ ID NO: 570507 - RNA, 23 nt, Human
aggagggugaucacuugagucca

SEQ ID NO: 570508 - RNA, 20 nt, Human
aggaguuugagaccaaccug

SEQ ID NO: 570509 - RNA, 25 nt, Human
aggauaagugaaaaacagaucuguu

SEQ ID NO: 570510 - RNA, 18 nt, Human
aggcaggagaaucauuug

SEQ ID NO: 570511 - RNA, 23 nt, Human
aggcaggagaaucauuugaaccc

SEQ ID NO: 570512 - RNA, 24 nt, Human
aggcaggagaaucauuugaaccca

SEQ ID NO: 570513 - RNA, 20 nt, Human
aggcggagauugcacugaac

SEQ ID NO: 570514 - RNA, 24 nt, Human
aggcggagauugcacugaacugag

SEQ ID NO: 570515 - RNA, 20 nt, Human
aggcugaggcaggagaauca

SEQ ID NO: 570516 - RNA, 24 nt, Human
aggcugaggcaggagaaucauuug

SEQ ID NO: 570517 - RNA, 24 nt, Human
aggggcucaugcccauagucccag

SEQ ID NO: 570518 - RNA, 21 nt, Human
agucugcauggcccauaaaca

SEQ ID NO: 570519 - RNA, 24 nt, Human
auugcaccacugcacuccagccug

SEQ ID NO: 570520 - RNA, 28 nt, Human
auugcaccacugcacuccagccugggca

SEQ ID NO: 570521 - RNA, 21 nt, Human
auugcacugaacugagauugc

SEQ ID NO: 570522 - RNA, 18 nt, Human
caacaaacuuuccucccu

SEQ ID NO: 570523 - RNA, 24 nt, Human
caacauggugaaaccccaucucua

SEQ ID NO: 570524 - RNA, 23 nt, Human
caacccauaccaccaacuaauaa

SEQ ID NO: 570525 - RNA, 27 nt, Human
caacccauaccaccaacuaauaaagaa

SEQ ID NO: 570526 - RNA, 21 nt, Human
caacuaccauuuuacucaagu

SEQ ID NO: 570527 - RNA, 18 nt, Human
caccaacaaccaacggcg

SEQ ID NO: 570528 - RNA, 23 nt, Human
caccaacaaccaacggcgggggc

SEQ ID NO: 570529 - RNA, 24 nt, Human
caccccaccagucugcauggccca

SEQ ID NO: 570530 - RNA, 20 nt, Human
cacuccagccugggcaacag

SEQ ID NO: 570531 - RNA, 21 nt, Human
cacuccagccugggcaacagu

SEQ ID NO: 570532 - RNA, 22 nt, Human
cacuccagccugggcaacagug

SEQ ID NO: 570533 - RNA, 18 nt, Human
cacugcacuccagccugg

SEQ ID NO: 570534 - RNA, 19 nt, Human
cacugcacuccagccuggg

SEQ ID NO: 570535 - RNA, 21 nt, Human
cacugcacuccagccugggca

SEQ ID NO: 570536 - RNA, 23 nt, Human
cacugcacuccagccugggcaac

SEQ ID NO: 570537 - RNA, 24 nt, Human
cacugcacuccagccugggcaaca

SEQ ID NO: 570538 - RNA, 25 nt, Human
cacugcacuccagccugggcaacaa

SEQ ID NO: 570539 - RNA, 25 nt, Human
cacugcacuccagccugggcaacag

SEQ ID NO: 570540 - RNA, 19 nt, Human
cacugcuaggggucuuagg

SEQ ID NO: 570541 - RNA, 21 nt, Human
cagaacagaaacuugacccau

SEQ ID NO: 570542 - RNA, 19 nt, Human
cagcagcaccgcagaaucc

SEQ ID NO: 570543 - RNA, 22 nt, Human
cagcagcaccgcagaauccaac

SEQ ID NO: 570544 - RNA, 23 nt, Human
cagcauuuugggaggcugaggag

SEQ ID NO: 570545 - RNA, 24 nt, Human
cagcauuuugggaggcugaggagg

SEQ ID NO: 570546 - RNA, 24 nt, Human
caugcccauagucccagcauuuug

SEQ ID NO: 570547 - RNA, 18 nt, Human
cauggcccauaaacaggu

SEQ ID NO: 570548 - RNA, 18 nt, Human
ccaacuaauaaagaacaa

SEQ ID NO: 570549 - RNA, 18 nt, Human
ccacucacaaagcaacag

SEQ ID NO: 570550 - RNA, 20 nt, Human
ccacugcacuccagccuggg

SEQ ID NO: 570551 - RNA, 21 nt, Human
ccacugcacuccagccugggc

SEQ ID NO: 570552 - RNA, 23 nt, Human
ccacugcacuccagccugggcaa

SEQ ID NO: 570553 - RNA, 24 nt, Human
ccacugcacuccagccugggcaac

SEQ ID NO: 570554 - RNA, 18 nt, Human
ccauaaacaggugcagag

SEQ ID NO: 570555 - RNA, 24 nt, Human
cccuugcuuuaacauuuuugagga

SEQ ID NO: 570556 - RNA, 23 nt, Human
ccuggccaacauggugaaacccc

SEQ ID NO: 570557 - RNA, 24 nt, Human
ccuggccaacauggugaaacccca

SEQ ID NO: 570558 - RNA, 22 nt, Human
ccuguaccuagcuacucaagag

SEQ ID NO: 570559 - RNA, 24 nt, Human
cucaugcccauagucccagcauuu

SEQ ID NO: 570560 - RNA, 23 nt, Human
cuggccaacauggugaaacccca

SEQ ID NO: 570561 - RNA, 18 nt, Human
cuuaaacauuuuaaaccc

SEQ ID NO: 570562 - RNA, 20 nt, Human
gagaacuuugaaaaauauug

SEQ ID NO: 570563 - RNA, 23 nt, Human
gagaaucauuugaacccaggagg

SEQ ID NO: 570564 - RNA, 18 nt, Human
gagagaagaacaucuugc

SEQ ID NO: 570565 - RNA, 23 nt, Human
gagauugcaccacugcacuccag

SEQ ID NO: 570566 - RNA, 23 nt, Human
gagauugcacugaacugagauug

SEQ ID NO: 570567 - RNA, 21 nt, Human
gaggcugaggagggugaucac

SEQ ID NO: 570568 - RNA, 21 nt, Human
gaucacuugaguccaggaguu

SEQ ID NO: 570569 - RNA, 24 nt, Human
gaucacuugaguccaggaguuuga

SEQ ID NO: 570570 - RNA, 22 nt, Human
gcaggagaaucauuugaaccca

SEQ ID NO: 570571 - RNA, 24 nt, Human
gccaacauggugaaaccccaucuc

SEQ ID NO: 570572 - RNA, 20 nt, Human
gcugaagucaugucuauuuu

SEQ ID NO: 570573 - RNA, 22 nt, Human
gcuguugaaggucaggcgcagg

SEQ ID NO: 570574 - RNA, 19 nt, Human
ggaauuaacagccuuucuu

SEQ ID NO: 570575 - RNA, 22 nt, Human
ggagauugcacugaacugagau

SEQ ID NO: 570576 - RNA, 24 nt, Human
ggagauugcacugaacugagauug

SEQ ID NO: 570577 - RNA, 18 nt, Human
ggauaagugaaaaacaga

SEQ ID NO: 570578 - RNA, 21 nt, Human
ggcgggggcgggcaggagaga

SEQ ID NO: 570579 - RNA, 21 nt, Human
gggcaaaaaaaaagauccccu

SEQ ID NO: 570580 - RNA, 20 nt, Human
gggcaggagagaagaacauc

SEQ ID NO: 570581 - RNA, 24 nt, Human
gggcucaugcccauagucccagca

SEQ ID NO: 570582 - RNA, 22 nt, Human
guaauaacaaaacaauguugga

SEQ ID NO: 570583 - RNA, 22 nt, Human
gugaaaaacagaucuguuccca

SEQ ID NO: 570584 - RNA, 23 nt, Human
uaaagaacaaacgagucauacaa

SEQ ID NO: 570585 - RNA, 24 nt, Human
uaaagaacaaacgagucauacaaa

SEQ ID NO: 570586 - RNA, 25 nt, Human
uaaagaacaaacgagucauacaaaa

SEQ ID NO: 570587 - RNA, 25 nt, Human
uaagugaaauaauacaaagucccuu

SEQ ID NO: 570588 - RNA, 26 nt, Human
uaauaaagaacaaacgagucauacaa

SEQ ID NO: 570589 - RNA, 24 nt, Human
uaccaccaacuaauaaagaacaaa

SEQ ID NO: 570590 - RNA, 21 nt, Human
uaccuaaguaguuuuaaaaac

SEQ ID NO: 570591 - RNA, 23 nt, Human
uaccuaaguaguuuuaaaaacaa

SEQ ID NO: 570592 - RNA, 18 nt, Human
uaccuagcuacucaagag

SEQ ID NO: 570593 - RNA, 18 nt, Human
uagaaaggaaggaaacag

SEQ ID NO: 570594 - RNA, 24 nt, Human
uagcuacucaagaggcugaggcag

SEQ ID NO: 570595 - RNA, 22 nt, Human
uaugugcagcuuuuuguaugug

SEQ ID NO: 570596 - RNA, 19 nt, Human
uauuuuacauacacaucuu

SEQ ID NO: 570597 - RNA, 19 nt, Human
ucacuugaguccaggaguu

SEQ ID NO: 570598 - RNA, 21 nt, Human
ucagcagcaccgcagaaucca

SEQ ID NO: 570599 - RNA, 20 nt, Human
ucaugcccauagucccagca

SEQ ID NO: 570600 - RNA, 22 nt, Human
uccagccugggcaacagugaga

SEQ ID NO: 570601 - RNA, 18 nt, Human
uccccuacuuguaauaac

SEQ ID NO: 570602 - RNA, 22 nt, Human
ucucaaaauacaacaaaaaaag

SEQ ID NO: 570603 - RNA, 22 nt, Human
ucucuacuaaaaauacaaaaaa

SEQ ID NO: 570604 - RNA, 21 nt, Human
ucuuaggcuaacaucugccac

SEQ ID NO: 570605 - RNA, 19 nt, Human
ugaaaccccaucucuacua

SEQ ID NO: 570606 - RNA, 24 nt, Human
ugagaccaaccuggccaacauggu

SEQ ID NO: 570607 - RNA, 20 nt, Human
ugaggcaggagaaucauuug

SEQ ID NO: 570608 - RNA, 24 nt, Human
ugaggcaggagaaucauuugaacc

SEQ ID NO: 570609 - RNA, 25 nt, Human
ugaggcaggagaaucauuugaaccc

SEQ ID NO: 570610 - RNA, 19 nt, Human
ugaguuaagaacacuaaca

SEQ ID NO: 570611 - RNA, 23 nt, Human
ugaucacuugaguccaggaguuu

SEQ ID NO: 570612 - RNA, 21 nt, Human
ugcaccacugcacuccagccu

SEQ ID NO: 570613 - RNA, 24 nt, Human
uggccaacauggugaaaccccauc

SEQ ID NO: 570614 - RNA, 19 nt, Human
ugggaggcugaggagggug

SEQ ID NO: 570615 - RNA, 23 nt, Human
ugggaggcugaggagggugauca

SEQ ID NO: 570616 - RNA, 22 nt, Human
ugugguggcaggugccuguacc

SEQ ID NO: 570617 - RNA, 24 nt, Human
uuagcugggugugguggcaggugc

SEQ ID NO: 570618 - RNA, 22 nt, Human
uugaguccaggaguuugagacc

SEQ ID NO: 570619 - RNA, 23 nt, Human
uugcaccacugcacuccagccug

SEQ ID NO: 570620 - RNA, 21 nt, Human
uuggaaugaagcagcuccuaa

SEQ ID NO: 570621 - RNA, 21 nt, Human
uuuaggaaguacacaaaaaaa

SEQ ID NO: 570622 - RNA, 19 nt, Human
uuucuacauauuaacuaca

SEQ ID NO: 570623 - RNA, 20 nt, Human
aaaagccagccccagcuacc

SEQ ID NO: 570624 - RNA, 18 nt, Human
aaauauuaaaaguagcuu

SEQ ID NO: 570625 - RNA, 21 nt, Human
aagaacaggagggacagaggc

SEQ ID NO: 570626 - RNA, 18 nt, Human
aagcagcgccggacaaga

SEQ ID NO: 570627 - RNA, 25 nt, Human
aagccagccccagcuaccgcgccua

SEQ ID NO: 570628 - RNA, 19 nt, Human
agaaggcugcccgcgcccc

SEQ ID NO: 570629 - RNA, 22 nt, Human
agcaacaaaacaugacaauuau

SEQ ID NO: 570630 - RNA, 22 nt, Human
aggagggacagaggcuucgggc

SEQ ID NO: 570631 - RNA, 20 nt, Human
caaaauacagaaauauucug

SEQ ID NO: 570632 - RNA, 24 nt, Human
caaaauacagaaauauucugugca

SEQ ID NO: 570633 - RNA, 21 nt, Human
cacaauagcaacaaaacauga

SEQ ID NO: 570634 - RNA, 23 nt, Human
caggccuccgacccagucagaag

SEQ ID NO: 570635 - RNA, 19 nt, Human
cccucaaaagccagcccca

SEQ ID NO: 570636 - RNA, 20 nt, Human
cccucaaaagccagccccag

SEQ ID NO: 570637 - RNA, 23 nt, Human
ccgcgccccucaaaagccagccc

SEQ ID NO: 570638 - RNA, 18 nt, Human
cggaggggcuaagcagcg

SEQ ID NO: 570639 - RNA, 18 nt, Human
cuuucugcccagcuucuc

SEQ ID NO: 570640 - RNA, 24 nt, Human
gaacaggagggacagaggcuucgg

SEQ ID NO: 570641 - RNA, 21 nt, Human
gacaagaacaggagggacaga

SEQ ID NO: 570642 - RNA, 25 nt, Human
uaauucaucacaguauacuuauuuc

SEQ ID NO: 570643 - RNA, 22 nt, Human
uaucaaguaaaagaauuaaaua

SEQ ID NO: 570644 - RNA, 19 nt, Human
ugacuacgcggaggggcua

SEQ ID NO: 570645 - RNA, 19 nt, Human
ugcccgcgccccucaaaag

SEQ ID NO: 570646 - RNA, 21 nt, Human
ugugcaauaaauuuguuguca

SEQ ID NO: 570647 - RNA, 19 nt, Human
aaaaaacaaguagaaaaau

SEQ ID NO: 570648 - RNA, 21 nt, Human
aaaaacgacuaacuuucaccc

SEQ ID NO: 570649 - RNA, 20 nt, Human
aaaagaagaccaaaaacgaa

SEQ ID NO: 570650 - RNA, 22 nt, Human
aaaagcaagcucaacggacaca

SEQ ID NO: 570651 - RNA, 19 nt, Human
aaacaaaagucugaaacaa

SEQ ID NO: 570652 - RNA, 26 nt, Human
aaacaaaagucugaaacaaucuuaau

SEQ ID NO: 570653 - RNA, 25 nt, Human
aaacaccacccaucauagcacaaau

SEQ ID NO: 570654 - RNA, 26 nt, Human
aaaucaaugugcauuucugaagcuag

SEQ ID NO: 570655 - RNA, 18 nt, Human
aacaaaagucugaaacaa

SEQ ID NO: 570656 - RNA, 23 nt, Human
aaccaaaagugaaagaugauaaa

SEQ ID NO: 570657 - RNA, 24 nt, Human
aagauguuuaaaaacagaggaaaa

SEQ ID NO: 570658 - RNA, 18 nt, Human
aagcacacaaacaaaagu

SEQ ID NO: 570659 - RNA, 25 nt, Human
aagcaggagacaaaauucacuaagg

SEQ ID NO: 570660 - RNA, 20 nt, Human
aagccgacaucucugagucc

SEQ ID NO: 570661 - RNA, 24 nt, Human
aaucaaaaaugaaaagaagaccaa

SEQ ID NO: 570662 - RNA, 18 nt, Human
acacaaacaacugugucc

SEQ ID NO: 570663 - RNA, 20 nt, Human
acaccacuguauuccagucu

SEQ ID NO: 570664 - RNA, 24 nt, Human
acaccacuguauuccagucugggc

SEQ ID NO: 570665 - RNA, 23 nt, Human
accacuguauuccagucugggca

SEQ ID NO: 570666 - RNA, 24 nt, Human
accacuguauuccagucugggcaa

SEQ ID NO: 570667 - RNA, 23 nt, Human
acuaagggaacucacucaaaugg

SEQ ID NO: 570668 - RNA, 24 nt, Human
acuccccuucccaccccaauagac

SEQ ID NO: 570669 - RNA, 22 nt, Human
acuguauuccagucugggcaag

SEQ ID NO: 570670 - RNA, 24 nt, Human
acuguauuccagucugggcaagag

SEQ ID NO: 570671 - RNA, 24 nt, Human
agcacacaaacaaaagucugaaac

SEQ ID NO: 570672 - RNA, 19 nt, Human
agcaggagacaaaauucac

SEQ ID NO: 570673 - RNA, 22 nt, Human
agguugaggcugcagugagccg

SEQ ID NO: 570674 - RNA, 18 nt, Human
auaaaacaccauuggaua

SEQ ID NO: 570675 - RNA, 21 nt, Human
auaccuaagauguuuaaaaac

SEQ ID NO: 570676 - RNA, 27 nt, Human
auagaacagugauuguuacaaacacca

SEQ ID NO: 570677 - RNA, 19 nt, Human
aucuggaaacaaggguugu

SEQ ID NO: 570678 - RNA, 24 nt, Human
augcuuuuugaaagaccuguucuc

SEQ ID NO: 570679 - RNA, 20 nt, Human
augugcauuucugaagcuag

SEQ ID NO: 570680 - RNA, 25 nt, Human
auuuuggugcuuuuucaaggugaaa

SEQ ID NO: 570681 - RNA, 24 nt, Human
caaaugacuuaguaaucuaauaug

SEQ ID NO: 570682 - RNA, 18 nt, Human
caacagugccccagagca

SEQ ID NO: 570683 - RNA, 25 nt, Human
caauccccaggucagcaucuuuaau

SEQ ID NO: 570684 - RNA, 24 nt, Human
cacacaaacaaaagucugaaacaa

SEQ ID NO: 570685 - RNA, 21 nt, Human
cacaccacuguauuccagucu

SEQ ID NO: 570686 - RNA, 19 nt, Human
cacauccucaacagugccc

SEQ ID NO: 570687 - RNA, 23 nt, Human
caccacccaucauagcacaaauc

SEQ ID NO: 570688 - RNA, 19 nt, Human
caccggcagcgaagaggag

SEQ ID NO: 570689 - RNA, 20 nt, Human
cacuccccuucccaccccaa

SEQ ID NO: 570690 - RNA, 22 nt, Human
cacuguauuccagucugggcaa

SEQ ID NO: 570691 - RNA, 22 nt, Human
cacuguauuccagucugggcaa

SEQ ID NO: 570692 - RNA, 23 nt, Human
cacuguauuccagucugggcaag

SEQ ID NO: 570693 - RNA, 24 nt, Human
caggcuccagguucagaagagaga

SEQ ID NO: 570694 - RNA, 22 nt, Human
caguucaaauaaacuacugucu

SEQ ID NO: 570695 - RNA, 22 nt, Human
cauaaccaguucaaauaaacua

SEQ ID NO: 570696 - RNA, 22 nt, Human
caucaacgcaagcacacaaaca

SEQ ID NO: 570697 - RNA, 23 nt, Human
caucaacgcaagcacacaaacaa

SEQ ID NO: 570698 - RNA, 21 nt, Human
ccaaaagugaaagaugauaaa

SEQ ID NO: 570699 - RNA, 21 nt, Human
ccacuguauuccagucugggc

SEQ ID NO: 570700 - RNA, 24 nt, Human
ccacuguauuccagucugggcaag

SEQ ID NO: 570701 - RNA, 18 nt, Human
cccaccggcagcgaagag

SEQ ID NO: 570702 - RNA, 18 nt, Human
cccaggagaguugcugcc

SEQ ID NO: 570703 - RNA, 25 nt, Human
ccccaggucagcaucuuuaauucac

SEQ ID NO: 570704 - RNA, 24 nt, Human
cccuucccaccccaauagacacaa

SEQ ID NO: 570705 - RNA, 21 nt, Human
ccgcagggaucuccgaagcuc

SEQ ID NO: 570706 - RNA, 18 nt, Human
cggugcccaccggcagcg

SEQ ID NO: 570707 - RNA, 21 nt, Human
cuacacaaacaacuguguccc

SEQ ID NO: 570708 - RNA, 22 nt, Human
cuauaaauaagccgacaucucu

SEQ ID NO: 570709 - RNA, 24 nt, Human
cucaaauggaaaugaguucaugga

SEQ ID NO: 570710 - RNA, 20 nt, Human
cucaagaaaagccguacacc

SEQ ID NO: 570711 - RNA, 24 nt, Human
cuccauucaucucacaauucccca

SEQ ID NO: 570712 - RNA, 18 nt, Human
cugaagcuaguaagaaaa

SEQ ID NO: 570713 - RNA, 19 nt, Human
cuggaaacaaggguuguuu

SEQ ID NO: 570714 - RNA, 21 nt, Human
gaacacucuuacaucccaaag

SEQ ID NO: 570715 - RNA, 21 nt, Human
gcaaagcaaaacauugcucuu

SEQ ID NO: 570716 - RNA, 21 nt, Human
gcaacuaaggcagcacuuaac

SEQ ID NO: 570717 - RNA, 25 nt, Human
gcacacaaacaaaagucugaaacaa

SEQ ID NO: 570718 - RNA, 21 nt, Human
gcuuuuugaaagaccuguucu

SEQ ID NO: 570719 - RNA, 21 nt, Human
gggggcuggggcuccuaggcc

SEQ ID NO: 570720 - RNA, 24 nt, Human
ggucaagaaaagggggcuggggcu

SEQ ID NO: 570721 - RNA, 18 nt, Human
gucaagaaaagggggcug

SEQ ID NO: 570722 - RNA, 24 nt, Human
guccaggagguugaggcugcagug

SEQ ID NO: 570723 - RNA, 21 nt, Human
guuacuuuguuuauuaacaug

SEQ ID NO: 570724 - RNA, 19 nt, Human
uaaaaacagaggaaaacca

SEQ ID NO: 570725 - RNA, 22 nt, Human
uaaaguagauaaagcaaauucc

SEQ ID NO: 570726 - RNA, 24 nt, Human
uacauaaauacagcuuacauacua

SEQ ID NO: 570727 - RNA, 23 nt, Human
uacuaaacuagcaacuaaggcag

SEQ ID NO: 570728 - RNA, 21 nt, Human
uagaacagugauuguuacaaa

SEQ ID NO: 570729 - RNA, 23 nt, Human
uagaacgaauucuaaccgacuaa

SEQ ID NO: 570730 - RNA, 21 nt, Human
uagcacaaaucaaugugcauu

SEQ ID NO: 570731 - RNA, 21 nt, Human
uagcaugucuucacccacuug

SEQ ID NO: 570732 - RNA, 24 nt, Human
uaguaguuguagcaugucuucacc

SEQ ID NO: 570733 - RNA, 18 nt, Human
ucaaauggaaaugaguuc

SEQ ID NO: 570734 - RNA, 23 nt, Human
ucaaauuucuuucauuaucaacu

SEQ ID NO: 570735 - RNA, 19 nt, Human
ucaacgcaagcacacaaac

SEQ ID NO: 570736 - RNA, 21 nt, Human
ucaacggacacacaugaugaa

SEQ ID NO: 570737 - RNA, 21 nt, Human
ucaagaaaagggggcuggggc

SEQ ID NO: 570738 - RNA, 23 nt, Human
ucacaccacuguauuccagucug

SEQ ID NO: 570739 - RNA, 20 nt, Human
ucacucaaauggaaaugagu

SEQ ID NO: 570740 - RNA, 23 nt, Human
ucagaagauuguugauacguggc

SEQ ID NO: 570741 - RNA, 23 nt, Human
uccagcccaaauuuacgaaaggu

SEQ ID NO: 570742 - RNA, 21 nt, Human
uccauaaccaguucaaauaaa

SEQ ID NO: 570743 - RNA, 24 nt, Human
uccauuauuacauuagaugaaaaa

SEQ ID NO: 570744 - RNA, 21 nt, Human
ucccaaagucaccuuccauaa

SEQ ID NO: 570745 - RNA, 20 nt, Human
uccccaacuaucacugcucc

SEQ ID NO: 570746 - RNA, 24 nt, Human
uccccaggucagcaucuuuaauuc

SEQ ID NO: 570747 - RNA, 20 nt, Human
ucccgcgggaccgcagggau

SEQ ID NO: 570748 - RNA, 21 nt, Human
uccucuaaucaaaaaugaaaa

SEQ ID NO: 570749 - RNA, 18 nt, Human
ugaaagaugauaaaguuu

SEQ ID NO: 570750 - RNA, 20 nt, Human
ugaaauaaaacaccauugga

SEQ ID NO: 570751 - RNA, 19 nt, Human
ugaaugaacuaucuaugga

SEQ ID NO: 570752 - RNA, 20 nt, Human
ugacuaaccuagaauauuua

SEQ ID NO: 570753 - RNA, 19 nt, Human
ugauuaacaaaaaaacaag

SEQ ID NO: 570754 - RNA, 18 nt, Human
ugccccagagcacucaca

SEQ ID NO: 570755 - RNA, 21 nt, Human
ugccccagagcacucacacag

SEQ ID NO: 570756 - RNA, 23 nt, Human
ugccccagagcacucacacagaa

SEQ ID NO: 570757 - RNA, 18 nt, Human
uggaaaugaguucaugga

SEQ ID NO: 570758 - RNA, 21 nt, Human
uggauaaguaguggagauucu

SEQ ID NO: 570759 - RNA, 19 nt, Human
uggcuucaagcaauuccua

SEQ ID NO: 570760 - RNA, 27 nt, Human
uggucaagaaaagggggcuggggcucc

SEQ ID NO: 570761 - RNA, 21 nt, Human
uggugggggacaauuuaaacu

SEQ ID NO: 570762 - RNA, 21 nt, Human
uguuauguuccuacacaaaca

SEQ ID NO: 570763 - RNA, 24 nt, Human
uguucacaccacuguauuccaguc

SEQ ID NO: 570764 - RNA, 21 nt, Human
uuaaauauuuuaauguuacuu

SEQ ID NO: 570765 - RNA, 23 nt, Human
uuacauaaauacagcuuacauac

SEQ ID NO: 570766 - RNA, 23 nt, Human
uuaucuggaaacaaggguuguuu

SEQ ID NO: 570767 - RNA, 22 nt, Human
uucaaguaagagcaauaguaaa

SEQ ID NO: 570768 - RNA, 21 nt, Human
uucacccuuuuacauguucca

SEQ ID NO: 570769 - RNA, 20 nt, Human
uucacgauggggccucucca

SEQ ID NO: 570770 - RNA, 24 nt, Human
uuccaguaagaaguucaagaguac

SEQ ID NO: 570771 - RNA, 19 nt, Human
uugaaaaaaaguuuucaag

SEQ ID NO: 570772 - RNA, 19 nt, Human
uuggcucugaaaauguauu

SEQ ID NO: 570773 - RNA, 21 nt, Human
uuguuacaaacaccacccauc

SEQ ID NO: 570774 - RNA, 18 nt, Human
uuuaauaggaucuuuuca

SEQ ID NO: 570775 - RNA, 23 nt, Human
uuugcauuuauagaagaaggugg

SEQ ID NO: 570776 - RNA, 20 nt, Human
aaagagagcuggguguggug

SEQ ID NO: 570777 - RNA, 19 nt, Human
aaagucaccagggugaaaa

SEQ ID NO: 570778 - RNA, 18 nt, Human
aaccaagaaagagagcug

SEQ ID NO: 570779 - RNA, 19 nt, Human
aacccaaaacaagaaagau

SEQ ID NO: 570780 - RNA, 19 nt, Human
aacuuauaggacaguccuu

SEQ ID NO: 570781 - RNA, 18 nt, Human
aagaaagagagcugggug

SEQ ID NO: 570782 - RNA, 22 nt, Human
aagaagcuuauucucucuaagc

SEQ ID NO: 570783 - RNA, 18 nt, Human
aagagaaggaagaucuga

SEQ ID NO: 570784 - RNA, 23 nt, Human
aagaguuucuuccaaagucacca

SEQ ID NO: 570785 - RNA, 18 nt, Human
aaggcccuggaaagacug

SEQ ID NO: 570786 - RNA, 20 nt, Human
aaguacaaaacaccucuuuu

SEQ ID NO: 570787 - RNA, 22 nt, Human
aaugaugaaaaaccaagaaaga

SEQ ID NO: 570788 - RNA, 24 nt, Human
acagagcaagaaagggcuucagag

SEQ ID NO: 570789 - RNA, 25 nt, Human
acagagcaagaaagggcuucagaga

SEQ ID NO: 570790 - RNA, 18 nt, Human
acucugccaggggcuccu

SEQ ID NO: 570791 - RNA, 18 nt, Human
agaaaacaacccaaaaca

SEQ ID NO: 570792 - RNA, 19 nt, Human
agaagcuuauucucucuaa

SEQ ID NO: 570793 - RNA, 23 nt, Human
agagaaaacaacccaaaacaaga

SEQ ID NO: 570794 - RNA, 19 nt, Human
agagagaaaacaacccaaa

SEQ ID NO: 570795 - RNA, 21 nt, Human
agagagagagagagagaaaac

SEQ ID NO: 570796 - RNA, 20 nt, Human
agaguuguaguuucaccacc

SEQ ID NO: 570797 - RNA, 23 nt, Human
agcugggugugguggcacgugcc

SEQ ID NO: 570798 - RNA, 24 nt, Human
agguucucauaagauuaacaauuu

SEQ ID NO: 570799 - RNA, 23 nt, Human
aguggaccccacuccuaggcaac

SEQ ID NO: 570800 - RNA, 23 nt, Human
auacaugaaaugaugaaaaacca

SEQ ID NO: 570801 - RNA, 19 nt, Human
aucauccaugagaucuccc

SEQ ID NO: 570802 - RNA, 24 nt, Human
auugugugugugugugugugugug

SEQ ID NO: 570803 - RNA, 24 nt, Human
cacugcccuauauccuagacaaca

SEQ ID NO: 570804 - RNA, 19 nt, Human
cagguaguuguagggcacu

SEQ ID NO: 570805 - RNA, 24 nt, Human
caguggaccccacuccuaggcaac

SEQ ID NO: 570806 - RNA, 19 nt, Human
caugucucuaagaagagag

SEQ ID NO: 570807 - RNA, 20 nt, Human
ccaagaagcuuauucucucu

SEQ ID NO: 570808 - RNA, 20 nt, Human
ccacugcuuuuucgagcugg

SEQ ID NO: 570809 - RNA, 21 nt, Human
ccccgggaggcuugaaggauc

SEQ ID NO: 570810 - RNA, 21 nt, Human
ccuguggucccagcuccccgg

SEQ ID NO: 570811 - RNA, 24 nt, Human
cgccugagccuaagaguuugaggc

SEQ ID NO: 570812 - RNA, 25 nt, Human
cucauaagauuaacaauuuaaauaa

SEQ ID NO: 570813 - RNA, 19 nt, Human
cuccuaggcaaccuggcca

SEQ ID NO: 570814 - RNA, 20 nt, Human
cuugauguaggcccgcugca

SEQ ID NO: 570815 - RNA, 20 nt, Human
gagaucucccggagccuggg

SEQ ID NO: 570816 - RNA, 24 nt, Human
gagcacacgugagaguuguaguuu

SEQ ID NO: 570817 - RNA, 22 nt, Human
gagcugggugugguggcacgug

SEQ ID NO: 570818 - RNA, 24 nt, Human
gaucgccugagccuaagaguuuga

SEQ ID NO: 570819 - RNA, 18 nt, Human
gcaguauucaagaguuuc

SEQ ID NO: 570820 - RNA, 27 nt, Human
ggcaacacaagcauccuuaggaagaga

SEQ ID NO: 570821 - RNA, 19 nt, Human
ggcccuggaaagacugaag

SEQ ID NO: 570822 - RNA, 22 nt, Human
guaaguacaaaacaccucuuuu

SEQ ID NO: 570823 - RNA, 23 nt, Human
gugagcugcuuccacugcuuuuu

SEQ ID NO: 570824 - RNA, 21 nt, Human
gugugugugugugugugugug

SEQ ID NO: 570825 - RNA, 25 nt, Human
uaagcuuuugaauuugcagcaacuu

SEQ ID NO: 570826 - RNA, 23 nt, Human
uacaacuuauaggacaguccuuu

SEQ ID NO: 570827 - RNA, 20 nt, Human
uacaguaaucauccaugaga

SEQ ID NO: 570828 - RNA, 18 nt, Human
uaccauggcucuguacaa

SEQ ID NO: 570829 - RNA, 24 nt, Human
uagauugauagauugaggcaacac

SEQ ID NO: 570830 - RNA, 20 nt, Human
uauccuagacaacaugguua

SEQ ID NO: 570831 - RNA, 18 nt, Human
uccaguguaaguuuauug

SEQ ID NO: 570832 - RNA, 20 nt, Human
uccccgggaggcuugaagga

SEQ ID NO: 570833 - RNA, 22 nt, Human
uccucagacccaaaguggagcu

SEQ ID NO: 570834 - RNA, 22 nt, Human
ucuggaguacuguggaggguga

SEQ ID NO: 570835 - RNA, 20 nt, Human
ucugugaauagccacugccc

SEQ ID NO: 570836 - RNA, 22 nt, Human
ucuuccaaagucaccaggguga

SEQ ID NO: 570837 - RNA, 18 nt, Human
ugaaaagccauucuacua

SEQ ID NO: 570838 - RNA, 22 nt, Human
ugaggcagcguggacucugcca

SEQ ID NO: 570839 - RNA, 27 nt, Human
ugcagcaacuuaauugugugugugugu

SEQ ID NO: 570840 - RNA, 23 nt, Human
ugccuguggucccagcuccccgg

SEQ ID NO: 570841 - RNA, 23 nt, Human
ugccuguggucccagcuccccgg

SEQ ID NO: 570842 - RNA, 24 nt, Human
ugccuguggucccagcuccccggg

SEQ ID NO: 570843 - RNA, 24 nt, Human
uggcacgugccuguggucccagcu

SEQ ID NO: 570844 - RNA, 18 nt, Human
ugggugugguggcacgug

SEQ ID NO: 570845 - RNA, 24 nt, Human
ugguggcacgugccugugguccca

SEQ ID NO: 570846 - RNA, 23 nt, Human
uguaaguacaaaacaccucuuuu

SEQ ID NO: 570847 - RNA, 20 nt, Human
ugugguggcacgugccugug

SEQ ID NO: 570848 - RNA, 21 nt, Human
ugugguggcacgugccugugg

SEQ ID NO: 570849 - RNA, 18 nt, Human
ugugugugugugugugug

SEQ ID NO: 570850 - RNA, 18 nt, Human
ugugugugugugugugug

SEQ ID NO: 570851 - RNA, 18 nt, Human
ugugugugugugugugug

SEQ ID NO: 570852 - RNA, 18 nt, Human
ugugugugugugugugug

SEQ ID NO: 570853 - RNA, 18 nt, Human
ugugugugugugugugug

SEQ ID NO: 570854 - RNA, 18 nt, Human
ugugugugugugugugug

SEQ ID NO: 570855 - RNA, 18 nt, Human
ugugugugugugugugug

SEQ ID NO: 570856 - RNA, 18 nt, Human
ugugugugugugugugug

SEQ ID NO: 570857 - RNA, 20 nt, Human
ugugugugugugugugugug

SEQ ID NO: 570858 - RNA, 21 nt, Human
ugugugugugugugugugugu

SEQ ID NO: 570859 - RNA, 21 nt, Human
ugugugugugugugugugugu

SEQ ID NO: 570860 - RNA, 21 nt, Human
ugugugugugugugugugugu

SEQ ID NO: 570861 - RNA, 21 nt, Human
ugugugugugugugugugugu

SEQ ID NO: 570862 - RNA, 21 nt, Human
ugugugugugugugugugugu

SEQ ID NO: 570863 - RNA, 21 nt, Human
ugugugugugugugugugugu

SEQ ID NO: 570864 - RNA, 21 nt, Human
ugugugugugugugugugugu

SEQ ID NO: 570865 - RNA, 21 nt, Human
ugugugugugugugugugugu

SEQ ID NO: 570866 - RNA, 21 nt, Human
ugugugugugugugugugugu

SEQ ID NO: 570867 - RNA, 21 nt, Human
ugugugugugugugugugugu

SEQ ID NO: 570868 - RNA, 21 nt, Human
ugugugugugugugugugugu

SEQ ID NO: 570869 - RNA, 21 nt, Human
ugugugugugugugugugugu

SEQ ID NO: 570870 - RNA, 21 nt, Human
ugugugugugugugugugugu

SEQ ID NO: 570871 - RNA, 21 nt, Human
ugugugugugugugugugugu

SEQ ID NO: 570872 - RNA, 22 nt, Human
ugugugugugugugugugugug

SEQ ID NO: 570873 - RNA, 22 nt, Human
ugugugugugugugugugugug

SEQ ID NO: 570874 - RNA, 22 nt, Human
ugugugugugugugugugugug

SEQ ID NO: 570875 - RNA, 22 nt, Human
ugugugugugugugugugugug

SEQ ID NO: 570876 - RNA, 20 nt, Human
uguguguguguguguguuug

SEQ ID NO: 570877 - RNA, 25 nt, Human
uucaagaguuucuuccaaagucacc

SEQ ID NO: 570878 - RNA, 21 nt, Human
uuguaguuucaccaccaagaa

SEQ ID NO: 570879 - RNA, 25 nt, Human
uuuaaauaaauauuugauagaacau

SEQ ID NO: 570880 - RNA, 23 nt, Human
aaacaaguaaaucagaaagcuua

SEQ ID NO: 570881 - RNA, 24 nt, Human
aaacgaagccagccuggaccauag

SEQ ID NO: 570882 - RNA, 21 nt, Human
aaagaaaacagacccuccuaa

SEQ ID NO: 570883 - RNA, 21 nt, Human
aagcagaagccccaaaguuca

SEQ ID NO: 570884 - RNA, 23 nt, Human
aaggugcaguugaauucaguggg

SEQ ID NO: 570885 - RNA, 23 nt, Human
aaucagaaagcuuauuuucuauu

SEQ ID NO: 570886 - RNA, 21 nt, Human
acacuuauauaaaaagaaaac

SEQ ID NO: 570887 - RNA, 21 nt, Human
acugccuggaggcucuguauu

SEQ ID NO: 570888 - RNA, 23 nt, Human
agaaaaacaaacugugcuuuaaa

SEQ ID NO: 570889 - RNA, 22 nt, Human
agaagccccaaaguucacauua

SEQ ID NO: 570890 - RNA, 19 nt, Human
augaagcagaagccccaaa

SEQ ID NO: 570891 - RNA, 23 nt, Human
caaaggcuccuuggaaaaacgaa

SEQ ID NO: 570892 - RNA, 22 nt, Human
caagaagauuccuucuaacuga

SEQ ID NO: 570893 - RNA, 21 nt, Human
caagaugccaacaucggugug

SEQ ID NO: 570894 - RNA, 18 nt, Human
cagaaagcuuauuuucua

SEQ ID NO: 570895 - RNA, 21 nt, Human
cagaagccccaaaguucacau

SEQ ID NO: 570896 - RNA, 19 nt, Human
caucggggugggugcaggc

SEQ ID NO: 570897 - RNA, 20 nt, Human
caucggggugggugcaggcu

SEQ ID NO: 570898 - RNA, 20 nt, Human
cauuuuucaguagcaggacc

SEQ ID NO: 570899 - RNA, 24 nt, Human
ccguucguggcaauuguucucaac

SEQ ID NO: 570900 - RNA, 26 nt, Human
ccuuggaaaaacgaagccagccugga

SEQ ID NO: 570901 - RNA, 22 nt, Human
cuuucacucuccuuuugaccuu

SEQ ID NO: 570902 - RNA, 25 nt, Human
gaaaacagacccuccuaacauguaa

SEQ ID NO: 570903 - RNA, 20 nt, Human
gccagccauuuuucaguagc

SEQ ID NO: 570904 - RNA, 18 nt, Human
gcuucaucggggugggug

SEQ ID NO: 570905 - RNA, 22 nt, Human
ggagcuucaucggggugggugc

SEQ ID NO: 570906 - RNA, 21 nt, Human
ggccagccauuuuucaguagc

SEQ ID NO: 570907 - RNA, 19 nt, Human
gggcuugccuaaggccagc

SEQ ID NO: 570908 - RNA, 22 nt, Human
gugaagcgcuggauauuuacca

SEQ ID NO: 570909 - RNA, 18 nt, Human
gugacagaaaaacaaacu

SEQ ID NO: 570910 - RNA, 23 nt, Human
uaaaaagaaaacagacccuccua

SEQ ID NO: 570911 - RNA, 23 nt, Human
uaaaaaugaagcagaagccccaa

SEQ ID NO: 570912 - RNA, 24 nt, Human
uaagacacacuuauauaaaaagaa

SEQ ID NO: 570913 - RNA, 20 nt, Human
uaccagauaauugaacucac

SEQ ID NO: 570914 - RNA, 21 nt, Human
uagagugcauucuugcacucu

SEQ ID NO: 570915 - RNA, 19 nt, Human
uauagagugcauucuugca

SEQ ID NO: 570916 - RNA, 23 nt, Human
ucaggugaagcgcuggauauuua

SEQ ID NO: 570917 - RNA, 22 nt, Human
ucccguggagcuucaucggggu

SEQ ID NO: 570918 - RNA, 20 nt, Human
uccuuggaaaaacgaagcca

SEQ ID NO: 570919 - RNA, 19 nt, Human
ucuaugaggaacuagauuc

SEQ ID NO: 570920 - RNA, 21 nt, Human
ucuugcacucuauaggugaca

SEQ ID NO: 570921 - RNA, 22 nt, Human
ugaaacauaagaucuaugagga

SEQ ID NO: 570922 - RNA, 24 nt, Human
ugaagcagaagccccaaaguucac

SEQ ID NO: 570923 - RNA, 31 nt, Human
ugacagaaaaacaaacugugcuuuaaauacu

SEQ ID NO: 570924 - RNA, 20 nt, Human
ugagcucucaguuacaguuc

SEQ ID NO: 570925 - RNA, 21 nt, Human
uggaaaaacgaagccagccug

SEQ ID NO: 570926 - RNA, 22 nt, Human
uuauauaaaaagaaaacagacc

SEQ ID NO: 570927 - RNA, 19 nt, Human
uugcacucuauaggugaca

SEQ ID NO: 570928 - RNA, 22 nt, Human
uuuaaaauauaucuaagacaca

SEQ ID NO: 570929 - RNA, 20 nt, Human
uuugcucccguggagcuuca

SEQ ID NO: 570930 - RNA, 23 nt, Human
aaaaaaaaaaaaaaaaauccaaa

SEQ ID NO: 570931 - RNA, 20 nt, Human
aaacaggaggcagcacuagg

SEQ ID NO: 570932 - RNA, 24 nt, Human
aaacaggaggcagcacuaggucca

SEQ ID NO: 570933 - RNA, 21 nt, Human
aacaaugacuggccugggccc

SEQ ID NO: 570934 - RNA, 20 nt, Human
aagagauucaggauuaccac

SEQ ID NO: 570935 - RNA, 20 nt, Human
aagcacccaaauguagauca

SEQ ID NO: 570936 - RNA, 18 nt, Human
accugccccucucuggcc

SEQ ID NO: 570937 - RNA, 24 nt, Human
accugccccucucuggccucuguc

SEQ ID NO: 570938 - RNA, 24 nt, Human
acuacguaauucaaaagacagcug

SEQ ID NO: 570939 - RNA, 27 nt, Human
acuccaaaaaaaaaaaaaaaaauccaa

SEQ ID NO: 570940 - RNA, 19 nt, Human
acucccuuuuuucuuagca

SEQ ID NO: 570941 - RNA, 21 nt, Human
agacuagguucuagaccaaaa

SEQ ID NO: 570942 - RNA, 24 nt, Human
agguucuagaccaaaaugucaccc

SEQ ID NO: 570943 - RNA, 21 nt, Human
auacccuuccccacuccaaaa

SEQ ID NO: 570944 - RNA, 24 nt, Human
auaugugcacauacauuagacacu

SEQ ID NO: 570945 - RNA, 23 nt, Human
aucaaugucacucaaauauuuua

SEQ ID NO: 570946 - RNA, 22 nt, Human
caaaucucagaaacaagcaccc

SEQ ID NO: 570947 - RNA, 20 nt, Human
caacaaaaugguccuguacu

SEQ ID NO: 570948 - RNA, 27 nt, Human
caaguaaacuucagucagacucccucu

SEQ ID NO: 570949 - RNA, 20 nt, Human
cacccaaauguagaucaccc

SEQ ID NO: 570950 - RNA, 21 nt, Human
caccccucuuucggcacuucc

SEQ ID NO: 570951 - RNA, 22 nt, Human
cacccugcugaagcucaaauca

SEQ ID NO: 570952 - RNA, 22 nt, Human
cagaaacaagcacccaaaugua

SEQ ID NO: 570953 - RNA, 24 nt, Human
cagcaacaaugacuggccugggcc

SEQ ID NO: 570954 - RNA, 24 nt, Human
ccacuccaaaaaaaaaaaaaaaaa

SEQ ID NO: 570955 - RNA, 23 nt, Human
ccagaagacaggccuaucacuaa

SEQ ID NO: 570956 - RNA, 23 nt, Human
ccagcgacaucggcggcggcuuu

SEQ ID NO: 570957 - RNA, 20 nt, Human
ccauguuauacuucucugca

SEQ ID NO: 570958 - RNA, 28 nt, Human
ccccacuccaaaaaaaaaaaaaaaaauc

SEQ ID NO: 570959 - RNA, 21 nt, Human
cccuuuuuucuuagcaagccc

SEQ ID NO: 570960 - RNA, 24 nt, Human
ccuccuaaaacuucugagcacccc

SEQ ID NO: 570961 - RNA, 23 nt, Human
ccuggagugagaggucaggguga

SEQ ID NO: 570962 - RNA, 21 nt, Human
cgaguucccaacaccccucuu

SEQ ID NO: 570963 - RNA, 18 nt, Human
cuaccugccccucucugg

SEQ ID NO: 570964 - RNA, 23 nt, Human
cuccuuggcacgaagguucccga

SEQ ID NO: 570965 - RNA, 28 nt, Human
cucucuggccucugucuugggagagauc

SEQ ID NO: 570966 - RNA, 24 nt, Human
cugaggcugcugcuaugcaggucu

SEQ ID NO: 570967 - RNA, 18 nt, Human
cuggagauacugcaggau

SEQ ID NO: 570968 - RNA, 21 nt, Human
gaagaugagcagaucaaaucc

SEQ ID NO: 570969 - RNA, 19 nt, Human
gauuuuaaacauuuuccuc

SEQ ID NO: 570970 - RNA, 22 nt, Human
gccagcaacaaugacuggccug

SEQ ID NO: 570971 - RNA, 18 nt, Human
gcccuuucuuuccaagua

SEQ ID NO: 570972 - RNA, 21 nt, Human
gccuacgcugagaguuucucc

SEQ ID NO: 570973 - RNA, 23 nt, Human
gccuccuuuauacccuuccccac

SEQ ID NO: 570974 - RNA, 22 nt, Human
gcugcuaccgucuucuucgacu

SEQ ID NO: 570975 - RNA, 19 nt, Human
ggagaggguggacaagacu

SEQ ID NO: 570976 - RNA, 19 nt, Human
guccuguacucuaggagcu

SEQ ID NO: 570977 - RNA, 22 nt, Human
gucucaaucaauaaauuuccac

SEQ ID NO: 570978 - RNA, 22 nt, Human
gucucucucucuccuuuaccaa

SEQ ID NO: 570979 - RNA, 23 nt, Human
guugggguagaagaucucaaaga

SEQ ID NO: 570980 - RNA, 18 nt, Human
uaaaacuucugagcaccc

SEQ ID NO: 570981 - RNA, 22 nt, Human
uaaaugguauacuuggaagagc

SEQ ID NO: 570982 - RNA, 19 nt, Human
uacccuuccccacuccaaa

SEQ ID NO: 570983 - RNA, 23 nt, Human
uaccugccccucucuggccucug

SEQ ID NO: 570984 - RNA, 20 nt, Human
uagaagaucucaaagacucc

SEQ ID NO: 570985 - RNA, 18 nt, Human
uagaggaacuaccauguu

SEQ ID NO: 570986 - RNA, 21 nt, Human
uagaucacccugcugaagcuc

SEQ ID NO: 570987 - RNA, 19 nt, Human
uaggaaaaugaugaguugg

SEQ ID NO: 570988 - RNA, 20 nt, Human
uaucaucauuuuuacucccu

SEQ ID NO: 570989 - RNA, 19 nt, Human
uaucuaccacuugggaacu

SEQ ID NO: 570990 - RNA, 25 nt, Human
uccaaauucaaacaagucuucugaa

SEQ ID NO: 570991 - RNA, 20 nt, Human
uccagcauccagucuuggag

SEQ ID NO: 570992 - RNA, 25 nt, Human
uccccacuccaaaaaaaaaaaaaaa

SEQ ID NO: 570993 - RNA, 24 nt, Human
ucggcggcggcugcgggcuucccc

SEQ ID NO: 570994 - RNA, 19 nt, Human
ucuaccugccccucucugg

SEQ ID NO: 570995 - RNA, 20 nt, Human
ucuaugagauccagcaucca

SEQ ID NO: 570996 - RNA, 20 nt, Human
ucucaaagacuccagauuag

SEQ ID NO: 570997 - RNA, 21 nt, Human
ucucaaagacuccagauuaga

SEQ ID NO: 570998 - RNA, 22 nt, Human
ucuccuuuaccaagacagcugc

SEQ ID NO: 570999 - RNA, 19 nt, Human
ucucuggccucugucuugc

SEQ ID NO: 571000 - RNA, 21 nt, Human
ucuugcuuaaggggaaagaau

SEQ ID NO: 571001 - RNA, 22 nt, Human
ugaaacucaaacccuagugcug

SEQ ID NO: 571002 - RNA, 19 nt, Human
ugaagcaugaaacucaaac

SEQ ID NO: 571003 - RNA, 21 nt, Human
ugacuuuugagacuuguaugg

SEQ ID NO: 571004 - RNA, 21 nt, Human
ugagaugauaaccucaacuca

SEQ ID NO: 571005 - RNA, 19 nt, Human
ugagcagaucaaaucccuu

SEQ ID NO: 571006 - RNA, 19 nt, Human
ugagggcauucaacugaag

SEQ ID NO: 571007 - RNA, 21 nt, Human
ugaguugggguagaagaucuc

SEQ ID NO: 571008 - RNA, 21 nt, Human
ugcaaagggcucaugagacua

SEQ ID NO: 571009 - RNA, 18 nt, Human
ugccccucucuggccucu

SEQ ID NO: 571010 - RNA, 19 nt, Human
ugccuuggaggccagcaac

SEQ ID NO: 571011 - RNA, 18 nt, Human
uggacaagacuccaggac

SEQ ID NO: 571012 - RNA, 22 nt, Human
ugguuucuaaauucugcuucuu

SEQ ID NO: 571013 - RNA, 19 nt, Human
uguagcuggguaagacaca

SEQ ID NO: 571014 - RNA, 21 nt, Human
ugugcacauacauuagacacu

SEQ ID NO: 571015 - RNA, 26 nt, Human
uguuguaaauucuccugggggugacc

SEQ ID NO: 571016 - RNA, 24 nt, Human
uuaccacuuucaaauauauccacu

SEQ ID NO: 571017 - RNA, 20 nt, Human
uuagaaugcuacagggcugc

SEQ ID NO: 571018 - RNA, 27 nt, Human
uucaaacaagucuucugaauuaucuac

SEQ ID NO: 571019 - RNA, 18 nt, Human
uuccccgggacgccaccc

SEQ ID NO: 571020 - RNA, 23 nt, Human
uuccccgggacgccacccucuuu

SEQ ID NO: 571021 - RNA, 18 nt, Human
uucuggagauacugcagg

SEQ ID NO: 571022 - RNA, 21 nt, Human
aaaaaaaaaaaaaaaggcaag

SEQ ID NO: 571023 - RNA, 20 nt, Human
aaaaauacacaccauggaac

SEQ ID NO: 571024 - RNA, 23 nt, Human
aaaagaacaagccugcuaacuug

SEQ ID NO: 571025 - RNA, 19 nt, Human
aaaaggaaaacauggcaaa

SEQ ID NO: 571026 - RNA, 20 nt, Human
aaaauacacaccauggaaca

SEQ ID NO: 571027 - RNA, 21 nt, Human
aaaauaccaacucauggaaug

SEQ ID NO: 571028 - RNA, 19 nt, Human
aaauaaaaauacacaccau

SEQ ID NO: 571029 - RNA, 19 nt, Human
aaauacacaccauggaaca

SEQ ID NO: 571030 - RNA, 20 nt, Human
aacauacagauggcacaaga

SEQ ID NO: 571031 - RNA, 22 nt, Human
aagaaaaggaaaacauggcaaa

SEQ ID NO: 571032 - RNA, 23 nt, Human
aagaaaaggaaaacauggcaaaa

SEQ ID NO: 571033 - RNA, 18 nt, Human
aagcuccuuccaacaaag

SEQ ID NO: 571034 - RNA, 19 nt, Human
acaagacagcucugaccuc

SEQ ID NO: 571035 - RNA, 23 nt, Human
accacaaggaguaagaacuguaa

SEQ ID NO: 571036 - RNA, 24 nt, Human
acccaggucacuauuggauccagc

SEQ ID NO: 571037 - RNA, 22 nt, Human
accugcucauaguuaagggaua

SEQ ID NO: 571038 - RNA, 18 nt, Human
acucagcccauuaaguga

SEQ ID NO: 571039 - RNA, 22 nt, Human
acuugaucuuucuucccacagu

SEQ ID NO: 571040 - RNA, 20 nt, Human
agaaaaccauuuacuaucca

SEQ ID NO: 571041 - RNA, 24 nt, Human
agaaaaccauuuacuauccaauua

SEQ ID NO: 571042 - RNA, 24 nt, Human
agaaaaggaaaacauggcaaaaaa

SEQ ID NO: 571043 - RNA, 24 nt, Human
agaaaaggggaucaagcuuaacgc

SEQ ID NO: 571044 - RNA, 23 nt, Human
agacagcucugaccucaggcccc

SEQ ID NO: 571045 - RNA, 20 nt, Human
aggcauagaagaaaauuugg

SEQ ID NO: 571046 - RNA, 21 nt, Human
aggccccgugcugaacaagag

SEQ ID NO: 571047 - RNA, 19 nt, Human
agggaaggucaggacccaa

SEQ ID NO: 571048 - RNA, 18 nt, Human
auaguuaagggauagggc

SEQ ID NO: 571049 - RNA, 23 nt, Human
aucccagcccuugacuuccccaa

SEQ ID NO: 571050 - RNA, 23 nt, Human
augcuaaaaaauauauggccaaa

SEQ ID NO: 571051 - RNA, 25 nt, Human
auggaacacugacaauugaguacca

SEQ ID NO: 571052 - RNA, 22 nt, Human
auuaagugacaaccaggaaaaa

SEQ ID NO: 571053 - RNA, 18 nt, Human
auuccuugcaaaagaaca

SEQ ID NO: 571054 - RNA, 19 nt, Human
caaagcaccaaggcuaaag

SEQ ID NO: 571055 - RNA, 21 nt, Human
caaagcaccaaggcuaaagac

SEQ ID NO: 571056 - RNA, 22 nt, Human
caagcuuuuuacucagcccauu

SEQ ID NO: 571057 - RNA, 18 nt, Human
cacaguauagcaaaggga

SEQ ID NO: 571058 - RNA, 20 nt, Human
cacaguauagcaaagggaau

SEQ ID NO: 571059 - RNA, 19 nt, Human
cacaucaggaaaguaaggc

SEQ ID NO: 571060 - RNA, 22 nt, Human
cacuagaaauaaauguuccaug

SEQ ID NO: 571061 - RNA, 18 nt, Human
cagcaauggaacuagaaa

SEQ ID NO: 571062 - RNA, 22 nt, Human
cagcccauuaagugacaaccag

SEQ ID NO: 571063 - RNA, 25 nt, Human
cagcccuugacuuccccaaacucaa

SEQ ID NO: 571064 - RNA, 26 nt, Human
cagggcacagaaacaaugcaugcuaa

SEQ ID NO: 571065 - RNA, 22 nt, Human
caucauaguuguaucuacugcu

SEQ ID NO: 571066 - RNA, 19 nt, Human
caugcuaaaaaauauaugg

SEQ ID NO: 571067 - RNA, 23 nt, Human
ccauuagacaacaugauuauuuc

SEQ ID NO: 571068 - RNA, 21 nt, Human
cccaaaaauaaaaauacacac

SEQ ID NO: 571069 - RNA, 19 nt, Human
ccccgugcugaacaagagu

SEQ ID NO: 571070 - RNA, 18 nt, Human
cccugaauccagaguacc

SEQ ID NO: 571071 - RNA, 18 nt, Human
cucauaaccaaugagugg

SEQ ID NO: 571072 - RNA, 18 nt, Human
cugccagccuucuuucag

SEQ ID NO: 571073 - RNA, 20 nt, Human
cuguauaugcacucuacacu

SEQ ID NO: 571074 - RNA, 25 nt, Human
cuuuuuauuccaggauuuagccuua

SEQ ID NO: 571075 - RNA, 25 nt, Human
gaaaaggaaaacauggcaaaaaaaa

SEQ ID NO: 571076 - RNA, 19 nt, Human
gaauuaauguggucucugc

SEQ ID NO: 571077 - RNA, 24 nt, Human
gaauuaauguggucucugcuuggu

SEQ ID NO: 571078 - RNA, 22 nt, Human
gcacaagacagcucugaccuca

SEQ ID NO: 571079 - RNA, 20 nt, Human
ggguauaacucuuuauaacc

SEQ ID NO: 571080 - RNA, 21 nt, Human
guauaugcacucuacacuaaa

SEQ ID NO: 571081 - RNA, 18 nt, Human
guuaagggauagggcacc

SEQ ID NO: 571082 - RNA, 20 nt, Human
uaaaaauacacaccauggaa

SEQ ID NO: 571083 - RNA, 22 nt, Human
uaaaauaaauaucccaaaaggu

SEQ ID NO: 571084 - RNA, 18 nt, Human
uaaaccggaccacaccug

SEQ ID NO: 571085 - RNA, 20 nt, Human
uaacaaaauaccagauuccc

SEQ ID NO: 571086 - RNA, 21 nt, Human
uaacaagaaaaggggaucaag

SEQ ID NO: 571087 - RNA, 19 nt, Human
uaaccacugugaccccauc

SEQ ID NO: 571088 - RNA, 27 nt, Human
uaaccacugugaccccaucugucuggc

SEQ ID NO: 571089 - RNA, 21 nt, Human
uaagccauauuaaggggguug

SEQ ID NO: 571090 - RNA, 19 nt, Human
uaagugacaaccaggaaaa

SEQ ID NO: 571091 - RNA, 20 nt, Human
uaagugugaauucuccaacc

SEQ ID NO: 571092 - RNA, 18 nt, Human
uacaggauuaucuaugac

SEQ ID NO: 571093 - RNA, 19 nt, Human
uagaagacaagacgucugu

SEQ ID NO: 571094 - RNA, 22 nt, Human
uagcaguuagaacuaaaaauac

SEQ ID NO: 571095 - RNA, 19 nt, Human
uaucaugaagggaaaaggu

SEQ ID NO: 571096 - RNA, 23 nt, Human
uaucaugaagggaaaagguuugu

SEQ ID NO: 571097 - RNA, 19 nt, Human
uauccacagucauguggaa

SEQ ID NO: 571098 - RNA, 22 nt, Human
uaugacaucaguuacucaauaa

SEQ ID NO: 571099 - RNA, 19 nt, Human
ucagaacauacagauggca

SEQ ID NO: 571100 - RNA, 21 nt, Human
ucagcccauuaagugacaacc

SEQ ID NO: 571101 - RNA, 24 nt, Human
ucaggaaaguaaggccaggaaggu

SEQ ID NO: 571102 - RNA, 23 nt, Human
ucccaaaaauaaaaauacacacc

SEQ ID NO: 571103 - RNA, 19 nt, Human
uccccaaacucaauuuccg

SEQ ID NO: 571104 - RNA, 20 nt, Human
ucccuuuagacccccacuaa

SEQ ID NO: 571105 - RNA, 25 nt, Human
uccucauaaccaaugaguggcagaa

SEQ ID NO: 571106 - RNA, 25 nt, Human
ucuauggauguuaucaugaagggaa

SEQ ID NO: 571107 - RNA, 19 nt, Human
ugaccccaucugucuggca

SEQ ID NO: 571108 - RNA, 21 nt, Human
ugauauguugguuucuuaaga

SEQ ID NO: 571109 - RNA, 24 nt, Human
uggaacacugacaauugaguacca

SEQ ID NO: 571110 - RNA, 21 nt, Human
uggauccagcuuucugggucc

SEQ ID NO: 571111 - RNA, 23 nt, Human
uggcacaagacagcucugaccuc

SEQ ID NO: 571112 - RNA, 23 nt, Human
uggcagaaccaagaccgaaaguc

SEQ ID NO: 571113 - RNA, 20 nt, Human
ugggaggaagggaaggucaa

SEQ ID NO: 571114 - RNA, 21 nt, Human
ugggaggaagggaaggucagg

SEQ ID NO: 571115 - RNA, 19 nt, Human
ugguaauaucuugcugauu

SEQ ID NO: 571116 - RNA, 24 nt, Human
uguaaauauccacagucaugugga

SEQ ID NO: 571117 - RNA, 21 nt, Human
uuaagaaagaugaagaacaaa

SEQ ID NO: 571118 - RNA, 19 nt, Human
uucuuucagugauauguug

SEQ ID NO: 571119 - RNA, 20 nt, Human
uuugcaaaaacucuaguccc

SEQ ID NO: 571120 - RNA, 18 nt, Human
aaaaccagaggaaggagg

SEQ ID NO: 571121 - RNA, 23 nt, Human
aaaauggagaugaauguuacaga

SEQ ID NO: 571122 - RNA, 24 nt, Human
aaacagccaugggccaggcugcag

SEQ ID NO: 571123 - RNA, 18 nt, Human
aaacccgcaaucugcucc

SEQ ID NO: 571124 - RNA, 24 nt, Human
aaccuuuuuaaaaaauggagauga

SEQ ID NO: 571125 - RNA, 21 nt, Human
aaguggcucacgcuccugugg

SEQ ID NO: 571126 - RNA, 18 nt, Human
acacaggccagcucaagc

SEQ ID NO: 571127 - RNA, 20 nt, Human
acaccuccagacccagccaa

SEQ ID NO: 571128 - RNA, 23 nt, Human
acccgcaaucugcuccagauuca

SEQ ID NO: 571129 - RNA, 21 nt, Human
accuccagacccagccaagaa

SEQ ID NO: 571130 - RNA, 22 nt, Human
agaaaccuuuuuaaaaaaugga

SEQ ID NO: 571131 - RNA, 22 nt, Human
agcacgugugcucgggacacag

SEQ ID NO: 571132 - RNA, 20 nt, Human
agcugcagugccaccugcug

SEQ ID NO: 571133 - RNA, 20 nt, Human
aggaaagguuuauuguggug

SEQ ID NO: 571134 - RNA, 19 nt, Human
aggcaguggagggacacag

SEQ ID NO: 571135 - RNA, 20 nt, Human
agguggguggugcaggcagu

SEQ ID NO: 571136 - RNA, 20 nt, Human
agguggucaugggaagccag

SEQ ID NO: 571137 - RNA, 21 nt, Human
agucagggccagagcccuucc

SEQ ID NO: 571138 - RNA, 22 nt, Human
aguggcucacgcuccuguggug

SEQ ID NO: 571139 - RNA, 18 nt, Human
auaaaaacaucugauguc

SEQ ID NO: 571140 - RNA, 24 nt, Human
auggcugccacuuccaggccccga

SEQ ID NO: 571141 - RNA, 18 nt, Human
cacaggcccugguguucc

SEQ ID NO: 571142 - RNA, 18 nt, Human
cacgacgcucaccgcggc

SEQ ID NO: 571143 - RNA, 19 nt, Human
cacuacccugucccaagcc

SEQ ID NO: 571144 - RNA, 18 nt, Human
cacugcacucuggaggug

SEQ ID NO: 571145 - RNA, 22 nt, Human
cacugcacucuggaggugggug

SEQ ID NO: 571146 - RNA, 24 nt, Human
cacugcacucuggagguggguggu

SEQ ID NO: 571147 - RNA, 20 nt, Human
cagcaacagcuguggguggg

SEQ ID NO: 571148 - RNA, 21 nt, Human
cagcagaggcucccugaccgg

SEQ ID NO: 571149 - RNA, 18 nt, Human
caggccccgagagacagg

SEQ ID NO: 571150 - RNA, 19 nt, Human
ccagaagcaccugcggcag

SEQ ID NO: 571151 - RNA, 18 nt, Human
ccagacccagccaagaac

SEQ ID NO: 571152 - RNA, 21 nt, Human
ccagagcccuucccuccagga

SEQ ID NO: 571153 - RNA, 21 nt, Human
cccagaagcaccugcggcaga

SEQ ID NO: 571154 - RNA, 26 nt, Human
cccagaagcaccugcggcagaggcgc

SEQ ID NO: 571155 - RNA, 25 nt, Human
cccccagcacccucaaaagcugggg

SEQ ID NO: 571156 - RNA, 24 nt, Human
ccccccacgccagcugucucagcc

SEQ ID NO: 571157 - RNA, 22 nt, Human
ccuccagacccagccaagaacu

SEQ ID NO: 571158 - RNA, 24 nt, Human
ccuccagacccagccaagaacuac

SEQ ID NO: 571159 - RNA, 23 nt, Human
ccugcggcagaggcgcacgggaa

SEQ ID NO: 571160 - RNA, 19 nt, Human
ccuguggugagggcagggu

SEQ ID NO: 571161 - RNA, 21 nt, Human
ccuguggugagggcagggugc

SEQ ID NO: 571162 - RNA, 18 nt, Human
cuacccccagcacccuca

SEQ ID NO: 571163 - RNA, 24 nt, Human
cuauaauaauaauauaaaauaaaa

SEQ ID NO: 571164 - RNA, 22 nt, Human
cuccgaggggucagcaagagca

SEQ ID NO: 571165 - RNA, 18 nt, Human
cugcagugccaccugcug

SEQ ID NO: 571166 - RNA, 21 nt, Human
cugcagugccaccugcugggu

SEQ ID NO: 571167 - RNA, 19 nt, Human
cugcaucccaagugggcac

SEQ ID NO: 571168 - RNA, 18 nt, Human
cugcaugucccuucacau

SEQ ID NO: 571169 - RNA, 20 nt, Human
cugcuuuucagguuguuucc

SEQ ID NO: 571170 - RNA, 18 nt, Human
cuggaggccggcgcagcu

SEQ ID NO: 571171 - RNA, 18 nt, Human
cugucccaagccgagggg

SEQ ID NO: 571172 - RNA, 18 nt, Human
cuguggugagggcagggu

SEQ ID NO: 571173 - RNA, 19 nt, Human
cuucccuccaggaacugau

SEQ ID NO: 571174 - RNA, 21 nt, Human
gaaaacagccaugggccaggc

SEQ ID NO: 571175 - RNA, 22 nt, Human
gagcacaggcccugguguuccu

SEQ ID NO: 571176 - RNA, 23 nt, Human
gagcacaggcccugguguuccug

SEQ ID NO: 571177 - RNA, 18 nt, Human
gaggaugggugcccagaa

SEQ ID NO: 571178 - RNA, 23 nt, Human
gaggcgcacgggaagcccggggc

SEQ ID NO: 571179 - RNA, 19 nt, Human
gagggcagggugcuccaca

SEQ ID NO: 571180 - RNA, 19 nt, Human
gagggcagggugcuccaca

SEQ ID NO: 571181 - RNA, 20 nt, Human
gcagaggaugggugcccaga

SEQ ID NO: 571182 - RNA, 20 nt, Human
gcagcucugggaguggggaa

SEQ ID NO: 571183 - RNA, 18 nt, Human
gcaguggagggacacagg

SEQ ID NO: 571184 - RNA, 25 nt, Human
gccugcuuuucagguuguuucccau

SEQ ID NO: 571185 - RNA, 20 nt, Human
gcgcagcuuggggcccccca

SEQ ID NO: 571186 - RNA, 22 nt, Human
gcuuggggccccccacgccagc

SEQ ID NO: 571187 - RNA, 24 nt, Human
ggaggccugccugcuuuucagguu

SEQ ID NO: 571188 - RNA, 18 nt, Human
ggccguggggccgucaga

SEQ ID NO: 571189 - RNA, 21 nt, Human
ggcugcggucagcacgugugc

SEQ ID NO: 571190 - RNA, 18 nt, Human
gggaagcccggggcccag

SEQ ID NO: 571191 - RNA, 20 nt, Human
gggccaggcugcagucuggu

SEQ ID NO: 571192 - RNA, 20 nt, Human
ggggucagcaagagcaacug

SEQ ID NO: 571193 - RNA, 20 nt, Human
gggguccuagcuccgcugca

SEQ ID NO: 571194 - RNA, 28 nt, Human
gugcggcgcuugcuccgaggggucagca

SEQ ID NO: 571195 - RNA, 18 nt, Human
guggaggaagggucugaa

SEQ ID NO: 571196 - RNA, 22 nt, Human
ucacguaacuuuacugcagccg

SEQ ID NO: 571197 - RNA, 19 nt, Human
ucagagaaaccuuuuuaaa

SEQ ID NO: 571198 - RNA, 21 nt, Human
ucagauaccagugcuggggag

SEQ ID NO: 571199 - RNA, 21 nt, Human
ucagcaagagcaacugauggc

SEQ ID NO: 571200 - RNA, 21 nt, Human
uccacagacaccuccagaccc

SEQ ID NO: 571201 - RNA, 24 nt, Human
uccacagacaccuccagacccagc

SEQ ID NO: 571202 - RNA, 27 nt, Human
uccacagacaccuccagacccagccaa

SEQ ID NO: 571203 - RNA, 18 nt, Human
uccagauucaagcaguaa

SEQ ID NO: 571204 - RNA, 19 nt, Human
ucccaagugggcacgugga

SEQ ID NO: 571205 - RNA, 22 nt, Human
uccucuugagcugcccuugccc

SEQ ID NO: 571206 - RNA, 22 nt, Human
uccuugggaaaacagccauggg

SEQ ID NO: 571207 - RNA, 18 nt, Human
ugagcagcucugggagug

SEQ ID NO: 571208 - RNA, 19 nt, Human
ugagggcagggugcuccac

SEQ ID NO: 571209 - RNA, 23 nt, Human
ugccaagcgccugguccuguccu

SEQ ID NO: 571210 - RNA, 19 nt, Human
ugcccagaagcaccugcgg

SEQ ID NO: 571211 - RNA, 22 nt, Human
ugcccagaagcaccugcggcag

SEQ ID NO: 571212 - RNA, 23 nt, Human
ugccucaguccuacccccagcac

SEQ ID NO: 571213 - RNA, 19 nt, Human
ugcggcgcuugcuccgagg

SEQ ID NO: 571214 - RNA, 24 nt, Human
ugcuccgaggggucagcaagagca

SEQ ID NO: 571215 - RNA, 22 nt, Human
uggagggacacaggccagcuca

SEQ ID NO: 571216 - RNA, 18 nt, Human
uggcugccacuuccaggc

SEQ ID NO: 571217 - RNA, 23 nt, Human
uggcugccacuuccaggccccga

SEQ ID NO: 571218 - RNA, 21 nt, Human
ugggaguggggaaaaaagacg

SEQ ID NO: 571219 - RNA, 19 nt, Human
ugggccaggcugcagucug

SEQ ID NO: 571220 - RNA, 21 nt, Human
uggguugggugugucugaugu

SEQ ID NO: 571221 - RNA, 18 nt, Human
ugguaccaccuucuauaa

SEQ ID NO: 571222 - RNA, 23 nt, Human
uggugcaggcaguggagggacac

SEQ ID NO: 571223 - RNA, 24 nt, Human
uguacagucgacugcaaaugaaac

SEQ ID NO: 571224 - RNA, 23 nt, Human
ugucccaagccgagggggccggu

SEQ ID NO: 571225 - RNA, 20 nt, Human
ugugggugggcuggaggccg

SEQ ID NO: 571226 - RNA, 21 nt, Human
uuacugcagccgagguccagg

SEQ ID NO: 571227 - RNA, 20 nt, Human
uuauaaacccgcaaucugcu

SEQ ID NO: 571228 - RNA, 23 nt, Human
uucaaaaccagaggaaggagguu

SEQ ID NO: 571229 - RNA, 24 nt, Human
uucaaaaccagaggaaggagguuc

SEQ ID NO: 571230 - RNA, 25 nt, Human
uuccaggccccgagagacaggccuc

SEQ ID NO: 571231 - RNA, 25 nt, Human
uucccauguucagcuuggacugcag

SEQ ID NO: 571232 - RNA, 18 nt, Human
uucucagauaaaaagcag

SEQ ID NO: 571233 - RNA, 24 nt, Human
uucucagauaaaaagcaguuuuau

SEQ ID NO: 571234 - RNA, 25 nt, Human
aaaagacccugcccguuuaaaaucc

SEQ ID NO: 571235 - RNA, 21 nt, Human
aaacaauaucuuugcuccagc

SEQ ID NO: 571236 - RNA, 26 nt, Human
aaacaucaccaacuugggcacaauuc

SEQ ID NO: 571237 - RNA, 19 nt, Human
aaaugagaggaaaaaagac

SEQ ID NO: 571238 - RNA, 19 nt, Human
aagcaggcaacaaacagca

SEQ ID NO: 571239 - RNA, 23 nt, Human
aauccaaaaccauaaacucuccu

SEQ ID NO: 571240 - RNA, 26 nt, Human
acaaacagcaugaaaggaaaagcuga

SEQ ID NO: 571241 - RNA, 22 nt, Human
accagaugacucugggagugaa

SEQ ID NO: 571242 - RNA, 21 nt, Human
acuaaaaugggaagaggugac

SEQ ID NO: 571243 - RNA, 18 nt, Human
agaguaaaaauaaaggcg

SEQ ID NO: 571244 - RNA, 18 nt, Human
agcacagaauacagggga

SEQ ID NO: 571245 - RNA, 19 nt, Human
agggacagcagaagaggga

SEQ ID NO: 571246 - RNA, 18 nt, Human
agucaauuccaaguacug

SEQ ID NO: 571247 - RNA, 18 nt, Human
auaaacucuccuucaaac

SEQ ID NO: 571248 - RNA, 20 nt, Human
auaaacucuccuucaaacaa

SEQ ID NO: 571249 - RNA, 24 nt, Human
auaagucgauuuuauacucaaagu

SEQ ID NO: 571250 - RNA, 23 nt, Human
aucuuugcuccagcagaagcauc

SEQ ID NO: 571251 - RNA, 22 nt, Human
auugcaaccugaccagaugacu

SEQ ID NO: 571252 - RNA, 21 nt, Human
caacaaacagcaugaaaggaa

SEQ ID NO: 571253 - RNA, 21 nt, Human
cacacaggcuuugacaauuaa

SEQ ID NO: 571254 - RNA, 21 nt, Human
cagaagcauccugggauuagu

SEQ ID NO: 571255 - RNA, 20 nt, Human
caggcaacaaacagcaugaa

SEQ ID NO: 571256 - RNA, 23 nt, Human
ccacccaggucaaaggcucaugu

SEQ ID NO: 571257 - RNA, 22 nt, Human
ccugcccguuuaaaauccaaaa

SEQ ID NO: 571258 - RNA, 19 nt, Human
cucagaaaggggugaagcu

SEQ ID NO: 571259 - RNA, 20 nt, Human
cugaccagaugacucuggga

SEQ ID NO: 571260 - RNA, 20 nt, Human
cuuucugccccacccagguc

SEQ ID NO: 571261 - RNA, 20 nt, Human
gaaggccucucuuguccaca

SEQ ID NO: 571262 - RNA, 24 nt, Human
gaaggccucucuuguccacaaaaa

SEQ ID NO: 571263 - RNA, 21 nt, Human
gcacagaauacaggggaacug

SEQ ID NO: 571264 - RNA, 22 nt, Human
gcaggaaguugcuguuuggucc

SEQ ID NO: 571265 - RNA, 22 nt, Human
ggcaacaaacagcaugaaagga

SEQ ID NO: 571266 - RNA, 23 nt, Human
ggcuggcuuugccuuccaaauuu

SEQ ID NO: 571267 - RNA, 20 nt, Human
gggagaauucuucauuuuuc

SEQ ID NO: 571268 - RNA, 18 nt, Human
guaaaggaaagccuuuuc

SEQ ID NO: 571269 - RNA, 23 nt, Human
guccuggaaguguaaaggaaagc

SEQ ID NO: 571270 - RNA, 21 nt, Human
uaaacaucaccaacuugggca

SEQ ID NO: 571271 - RNA, 20 nt, Human
uaaaccgaggcacuagacaa

SEQ ID NO: 571272 - RNA, 24 nt, Human
uaaaccgaggcacuagacaaggaa

SEQ ID NO: 571273 - RNA, 24 nt, Human
uacuaaaaugggaagaggugacuc

SEQ ID NO: 571274 - RNA, 23 nt, Human
uacuaaucauuaauaagucgauu

SEQ ID NO: 571275 - RNA, 21 nt, Human
uagacugaagugacccagaug

SEQ ID NO: 571276 - RNA, 18 nt, Human
uauacuggacagccccug

SEQ ID NO: 571277 - RNA, 20 nt, Human
uauuaaguaagcucaguguc

SEQ ID NO: 571278 - RNA, 20 nt, Human
ucaaacaauaucuuugcucc

SEQ ID NO: 571279 - RNA, 24 nt, Human
uccacaaaaaugagaggaaaaaag

SEQ ID NO: 571280 - RNA, 21 nt, Human
uccucauauugcaaccugaca

SEQ ID NO: 571281 - RNA, 21 nt, Human
uccuuguucacuucuccagcc

SEQ ID NO: 571282 - RNA, 23 nt, Human
ucucccagugauaggguggaagu

SEQ ID NO: 571283 - RNA, 23 nt, Human
ucucuuguccacaaaaaugagag

SEQ ID NO: 571284 - RNA, 20 nt, Human
ugaaaggaaaagcugagugg

SEQ ID NO: 571285 - RNA, 20 nt, Human
ugaaguagacugaagugacc

SEQ ID NO: 571286 - RNA, 18 nt, Human
ugacaagucacuucuggg

SEQ ID NO: 571287 - RNA, 22 nt, Human
ugcaacaagcaggcaacaaaca

SEQ ID NO: 571288 - RNA, 23 nt, Human
ugcaacaagcaggcaacaaacag

SEQ ID NO: 571289 - RNA, 19 nt, Human
ugcuccagcagaagcaucc

SEQ ID NO: 571290 - RNA, 25 nt, Human
uggaaguguaaaggaaagccuuuuu

SEQ ID NO: 571291 - RNA, 20 nt, Human
uggaaguguguggcaggaag

SEQ ID NO: 571292 - RNA, 24 nt, Human
uggaaguguguggcaggaaguugg

SEQ ID NO: 571293 - RNA, 24 nt, Human
ugggaaaauaaauuugacuccuug

SEQ ID NO: 571294 - RNA, 24 nt, Human
ugggagauggaguuugugguuccc

SEQ ID NO: 571295 - RNA, 24 nt, Human
ugguccuggaaguguaaaggaaag

SEQ ID NO: 571296 - RNA, 19 nt, Human
uguuugguccuggaagugu

SEQ ID NO: 571297 - RNA, 18 nt, Human
uucaaaguucuauuggga

SEQ ID NO: 571298 - RNA, 24 nt, Human
uuucugccccacccaggucaaagg

SEQ ID NO: 571299 - RNA, 22 nt, Human
uuuuaagucuugacaagucacu

SEQ ID NO: 571300 - RNA, 18 nt, Human
aaaaacuaaagcaaacgu

SEQ ID NO: 571301 - RNA, 19 nt, Human
aaaaacuaaagcaaacguu

SEQ ID NO: 571302 - RNA, 18 nt, Human
aaagcaggggcaggaggc

SEQ ID NO: 571303 - RNA, 23 nt, Human
aaagcuucauccuuacucagcag

SEQ ID NO: 571304 - RNA, 21 nt, Human
aacucugccagcgaggcaaag

SEQ ID NO: 571305 - RNA, 18 nt, Human
aagaacacaugauuuauu

SEQ ID NO: 571306 - RNA, 18 nt, Human
aagacaacucgucaucaa

SEQ ID NO: 571307 - RNA, 22 nt, Human
aagaggcugacuuugaucuugg

SEQ ID NO: 571308 - RNA, 24 nt, Human
aagcaccuccccugaguggagccc

SEQ ID NO: 571309 - RNA, 22 nt, Human
aaggagguggaaggagacaggc

SEQ ID NO: 571310 - RNA, 22 nt, Human
aaguccuggagagaggguggcc

SEQ ID NO: 571311 - RNA, 27 nt, Human
acaaaacagaugaaaaaacuaaagcaa

SEQ ID NO: 571312 - RNA, 23 nt, Human
acacacacacacacacacacaca

SEQ ID NO: 571313 - RNA, 23 nt, Human
acacacacacacacacacacaca

SEQ ID NO: 571314 - RNA, 23 nt, Human
acacacacacacacacacacaca

SEQ ID NO: 571315 - RNA, 23 nt, Human
acacacacacacacacacacaca

SEQ ID NO: 571316 - RNA, 23 nt, Human
acacacacacacacacacacaca

SEQ ID NO: 571317 - RNA, 23 nt, Human
acacacacacacacacacacaca

SEQ ID NO: 571318 - RNA, 23 nt, Human
acacacacacacacacacacaca

SEQ ID NO: 571319 - RNA, 23 nt, Human
acacacacacacacacacacaca

SEQ ID NO: 571320 - RNA, 23 nt, Human
acacacacacacacacacacaca

SEQ ID NO: 571321 - RNA, 23 nt, Human
acacacacacacacacacacaca

SEQ ID NO: 571322 - RNA, 23 nt, Human
acacacacacacacacacacaca

SEQ ID NO: 571323 - RNA, 23 nt, Human
acacacacacacacacacacaca

SEQ ID NO: 571324 - RNA, 23 nt, Human
acacacacacacacacacacaca

SEQ ID NO: 571325 - RNA, 23 nt, Human
acacacacacacacacacacagu

SEQ ID NO: 571326 - RNA, 21 nt, Human
acacacacacacacacacacg

SEQ ID NO: 571327 - RNA, 25 nt, Human
acacacacacacacacacggagaag

SEQ ID NO: 571328 - RNA, 23 nt, Human
acaccugcuccagcccugggaac

SEQ ID NO: 571329 - RNA, 22 nt, Human
accaaggccuggucccugugcu

SEQ ID NO: 571330 - RNA, 23 nt, Human
accagaagcaggaacugaggcug

SEQ ID NO: 571331 - RNA, 20 nt, Human
acccaugccucauccccaga

SEQ ID NO: 571332 - RNA, 23 nt, Human
acccucacucccuaacacacaca

SEQ ID NO: 571333 - RNA, 18 nt, Human
acccugggcucagaaucc

SEQ ID NO: 571334 - RNA, 24 nt, Human
accgacuacagacaucugugggug

SEQ ID NO: 571335 - RNA, 33 nt, Human
acucccuaacacacacacacacacacacacagu

SEQ ID NO: 571336 - RNA, 26 nt, Human
agaaggcccugcaccucccucagccc

SEQ ID NO: 571337 - RNA, 26 nt, Human
agacaggcaggugcggaaauccaggc

SEQ ID NO: 571338 - RNA, 23 nt, Human
agagccgaggcagggaggggccc

SEQ ID NO: 571339 - RNA, 22 nt, Human
agaggguggcccaggugagcag

SEQ ID NO: 571340 - RNA, 21 nt, Human
agccgaggcagggaggggccc

SEQ ID NO: 571341 - RNA, 21 nt, Human
agcucagcuaccccuggcccc

SEQ ID NO: 571342 - RNA, 22 nt, Human
aggaacaaaacagaugaaaaaa

SEQ ID NO: 571343 - RNA, 22 nt, Human
aggaacaaaacagaugaaaaaa

SEQ ID NO: 571344 - RNA, 19 nt, Human
aggcaagcggggagaggag

SEQ ID NO: 571345 - RNA, 21 nt, Human
aggcaagcggggagaggaggu

SEQ ID NO: 571346 - RNA, 24 nt, Human
aggcaagcggggagaggagguggc

SEQ ID NO: 571347 - RNA, 19 nt, Human
aggcaccccaacagagaag

SEQ ID NO: 571348 - RNA, 22 nt, Human
aggcagagagguagagacagag

SEQ ID NO: 571349 - RNA, 20 nt, Human
aggcaggggucagagaaggc

SEQ ID NO: 571350 - RNA, 23 nt, Human
aggcgguguccugcugggagccg

SEQ ID NO: 571351 - RNA, 20 nt, Human
agggggcagacaagagugag

SEQ ID NO: 571352 - RNA, 24 nt, Human
aggggucagagaaggcccugcacc

SEQ ID NO: 571353 - RNA, 24 nt, Human
agggguuggagaaggggcugaacc

SEQ ID NO: 571354 - RNA, 19 nt, Human
agguagagacagagaagga

SEQ ID NO: 571355 - RNA, 18 nt, Human
agugugguuccaggaggg

SEQ ID NO: 571356 - RNA, 18 nt, Human
agugugguuccaggaggg

SEQ ID NO: 571357 - RNA, 18 nt, Human
auaaggcaccccaacaga

SEQ ID NO: 571358 - RNA, 20 nt, Human
augaagcaagacacaguccc

SEQ ID NO: 571359 - RNA, 20 nt, Human
auggcacccggcuuccggac

SEQ ID NO: 571360 - RNA, 19 nt, Human
caaaggccaagcuugaccu

SEQ ID NO: 571361 - RNA, 22 nt, Human
caaagucucccaaauacugugc

SEQ ID NO: 571362 - RNA, 20 nt, Human
caacagagaagggcagggag

SEQ ID NO: 571363 - RNA, 19 nt, Human
caacuccuuucucccuucc

SEQ ID NO: 571364 - RNA, 25 nt, Human
caacuucccgagcuccagcccuccu

SEQ ID NO: 571365 - RNA, 20 nt, Human
caagacacagucccacucug

SEQ ID NO: 571366 - RNA, 20 nt, Human
caauacauagccaggagucu

SEQ ID NO: 571367 - RNA, 20 nt, Human
cacacacacacacacacaca

SEQ ID NO: 571368 - RNA, 20 nt, Human
cacacacacacacacacaca

SEQ ID NO: 571369 - RNA, 20 nt, Human
cacacacacacacacacaca

SEQ ID NO: 571370 - RNA, 20 nt, Human
cacacacacacacacacaca

SEQ ID NO: 571371 - RNA, 20 nt, Human
cacacacacacacacacaca

SEQ ID NO: 571372 - RNA, 20 nt, Human
cacacacacacacacacaca

SEQ ID NO: 571373 - RNA, 20 nt, Human
cacacacacacacacacaca

SEQ ID NO: 571374 - RNA, 20 nt, Human
cacacacacacacacacaca

SEQ ID NO: 571375 - RNA, 20 nt, Human
cacacacacacacacacaca

SEQ ID NO: 571376 - RNA, 20 nt, Human
cacacacacacacacacaca

SEQ ID NO: 571377 - RNA, 20 nt, Human
cacacacacacacacacaca

SEQ ID NO: 571378 - RNA, 20 nt, Human
cacacacacacacacacaca

SEQ ID NO: 571379 - RNA, 20 nt, Human
cacacacacacacacacaca

SEQ ID NO: 571380 - RNA, 20 nt, Human
cacacacacacacacacaca

SEQ ID NO: 571381 - RNA, 20 nt, Human
cacacacacacacacacaca

SEQ ID NO: 571382 - RNA, 20 nt, Human
cacacacacacacacacaca

SEQ ID NO: 571383 - RNA, 20 nt, Human
cacacacacacacacacaca

SEQ ID NO: 571384 - RNA, 20 nt, Human
cacacacacacacacacaca

SEQ ID NO: 571385 - RNA, 20 nt, Human
cacacacacacacacacaca

SEQ ID NO: 571386 - RNA, 20 nt, Human
cacacacacacacacacaca

SEQ ID NO: 571387 - RNA, 22 nt, Human
cacacacacacacacacacaca

SEQ ID NO: 571388 - RNA, 22 nt, Human
cacacacacacacacacacaca

SEQ ID NO: 571389 - RNA, 22 nt, Human
cacacacacacacacacacaca

SEQ ID NO: 571390 - RNA, 22 nt, Human
cacacacacacacacacacaca

SEQ ID NO: 571391 - RNA, 22 nt, Human
cacacacacacacacacacaca

SEQ ID NO: 571392 - RNA, 22 nt, Human
cacacacacacacacacacaca

SEQ ID NO: 571393 - RNA, 22 nt, Human
cacacacacacacacacacaca

SEQ ID NO: 571394 - RNA, 22 nt, Human
cacacacacacacacacacaca

SEQ ID NO: 571395 - RNA, 26 nt, Human
cacacacacacacacacacacacaca

SEQ ID NO: 571396 - RNA, 26 nt, Human
cacacacacacacacacacacacaca

SEQ ID NO: 571397 - RNA, 26 nt, Human
cacacacacacacacacacacacaca

SEQ ID NO: 571398 - RNA, 26 nt, Human
cacacacacacacacacacacacaca

SEQ ID NO: 571399 - RNA, 26 nt, Human
cacacacacacacacacacacacaca

SEQ ID NO: 571400 - RNA, 26 nt, Human
cacacacacacacacacacacacaca

SEQ ID NO: 571401 - RNA, 26 nt, Human
cacacacacacacacacacacacaca

SEQ ID NO: 571402 - RNA, 26 nt, Human
cacacacacacacacacacacacaca

SEQ ID NO: 571403 - RNA, 26 nt, Human
cacacacacacacacacacacacaca

SEQ ID NO: 571404 - RNA, 26 nt, Human
cacacacacacacacacacacacaca

SEQ ID NO: 571405 - RNA, 26 nt, Human
cacacacacacacacacacacacaca

SEQ ID NO: 571406 - RNA, 26 nt, Human
cacacacacacacacacacacacaca

SEQ ID NO: 571407 - RNA, 26 nt, Human
cacacacacacacacacacacacaca

SEQ ID NO: 571408 - RNA, 26 nt, Human
cacacacacacacacacacacacaca

SEQ ID NO: 571409 - RNA, 26 nt, Human
cacacacacacacacacacacacacg

SEQ ID NO: 571410 - RNA, 27 nt, Human
cacacacacacacacacacggagaaga

SEQ ID NO: 571411 - RNA, 20 nt, Human
caccagcugacaaguccugg

SEQ ID NO: 571412 - RNA, 19 nt, Human
cacggcacagugugucccc

SEQ ID NO: 571413 - RNA, 21 nt, Human
cacucuggcucuguggggacc

SEQ ID NO: 571414 - RNA, 21 nt, Human
cagaaaaaccagcucccccuc

SEQ ID NO: 571415 - RNA, 18 nt, Human
cagaagcaggaacugagg

SEQ ID NO: 571416 - RNA, 22 nt, Human
cagccaggaccugcucgaaaac

SEQ ID NO: 571417 - RNA, 19 nt, Human
cagcccaguucucuuccca

SEQ ID NO: 571418 - RNA, 20 nt, Human
cagcggguggagggguacac

SEQ ID NO: 571419 - RNA, 19 nt, Human
caggauaaggcaccccaac

SEQ ID NO: 571420 - RNA, 20 nt, Human
caggcacucuggcucugugg

SEQ ID NO: 571421 - RNA, 23 nt, Human
cagggcugggggaugggaacagg

SEQ ID NO: 571422 - RNA, 24 nt, Human
caggggcaggaggcucaaagcuuc

SEQ ID NO: 571423 - RNA, 21 nt, Human
caggggccuugcugagccagu

SEQ ID NO: 571424 - RNA, 21 nt, Human
caguauccugggcaaagaggg

SEQ ID NO: 571425 - RNA, 23 nt, Human
cagugccagaaacggcccuggcc

SEQ ID NO: 571426 - RNA, 20 nt, Human
ccagccucccagugccagaa

SEQ ID NO: 571427 - RNA, 18 nt, Human
ccaggcaguggcccaagc

SEQ ID NO: 571428 - RNA, 25 nt, Human
cccaacccuggguugggaccuggaa

SEQ ID NO: 571429 - RNA, 18 nt, Human
cccaagcuuaugaagggg

SEQ ID NO: 571430 - RNA, 21 nt, Human
cccaggaaggacaacuucccg

SEQ ID NO: 571431 - RNA, 22 nt, Human
cccccucuuccuucucccuccc

SEQ ID NO: 571432 - RNA, 21 nt, Human
ccccucaggcuggguuccuac

SEQ ID NO: 571433 - RNA, 21 nt, Human
ccccucuuccuucucccuccc

SEQ ID NO: 571434 - RNA, 31 nt, Human
cccuaacacacacacacacacacacacacag

SEQ ID NO: 571435 - RNA, 24 nt, Human
cccucacucccuaacacacacaca

SEQ ID NO: 571436 - RNA, 20 nt, Human
ccucaggcacucuggcucug

SEQ ID NO: 571437 - RNA, 18 nt, Human
ccucaucugucucccagg

SEQ ID NO: 571438 - RNA, 21 nt, Human
ccucaucugucucccagguuc

SEQ ID NO: 571439 - RNA, 19 nt, Human
ccuccagaaaaaccagcuc

SEQ ID NO: 571440 - RNA, 22 nt, Human
ccuccagaaaaaccagcucccc

SEQ ID NO: 571441 - RNA, 23 nt, Human
ccuccagaaaaaccagcuccccc

SEQ ID NO: 571442 - RNA, 20 nt, Human
ccucccaguugggaggaccu

SEQ ID NO: 571443 - RNA, 19 nt, Human
ccucgggccccacuugccc

SEQ ID NO: 571444 - RNA, 19 nt, Human
ccucgggccccacuugccc

SEQ ID NO: 571445 - RNA, 24 nt, Human
ccucugggggaaccuccagaaaaa

SEQ ID NO: 571446 - RNA, 21 nt, Human
ccugcccaccagacucggaaa

SEQ ID NO: 571447 - RNA, 21 nt, Human
ccuggguugggaccuggaagc

SEQ ID NO: 571448 - RNA, 22 nt, Human
cggaaagcuuugggggcaggag

SEQ ID NO: 571449 - RNA, 24 nt, Human
cggcagaagaaggagcacggcaca

SEQ ID NO: 571450 - RNA, 19 nt, Human
cggcccuggcccaggaagg

SEQ ID NO: 571451 - RNA, 20 nt, Human
cggcuuccggacgcaaaccu

SEQ ID NO: 571452 - RNA, 18 nt, Human
cggguucagaacccucua

SEQ ID NO: 571453 - RNA, 20 nt, Human
cuauacccaugccucauccc

SEQ ID NO: 571454 - RNA, 24 nt, Human
cuauggcacccggcuuccggacgc

SEQ ID NO: 571455 - RNA, 22 nt, Human
cucaacccaacccuggguuggg

SEQ ID NO: 571456 - RNA, 21 nt, Human
cucauccccagagcacuugcc

SEQ ID NO: 571457 - RNA, 26 nt, Human
cuccaacuccuuucucccuuccuaua

SEQ ID NO: 571458 - RNA, 18 nt, Human
cuccuggaacuggcagga

SEQ ID NO: 571459 - RNA, 23 nt, Human
cuccuggaacuggcaggacccag

SEQ ID NO: 571460 - RNA, 21 nt, Human
cucuguggggaccucccuugg

SEQ ID NO: 571461 - RNA, 18 nt, Human
cucuuccuucucccuccc

SEQ ID NO: 571462 - RNA, 19 nt, Human
cugagagacccucacuccc

SEQ ID NO: 571463 - RNA, 24 nt, Human
cugaguggagcccaggagaagacc

SEQ ID NO: 571464 - RNA, 22 nt, Human
cuggggaagccuuuccuggccc

SEQ ID NO: 571465 - RNA, 24 nt, Human
cuggucccugugcucuugaccuuc

SEQ ID NO: 571466 - RNA, 18 nt, Human
cugugggugagacagacg

SEQ ID NO: 571467 - RNA, 21 nt, Human
cuucccgagcuccagcccucc

SEQ ID NO: 571468 - RNA, 20 nt, Human
cuuccuucucccucccuggg

SEQ ID NO: 571469 - RNA, 18 nt, Human
cuugagaaucuggggaag

SEQ ID NO: 571470 - RNA, 26 nt, Human
gaaaaaccagcucccccucuuccuuc

SEQ ID NO: 571471 - RNA, 23 nt, Human
gaaagcuuugggggcaggagggc

SEQ ID NO: 571472 - RNA, 21 nt, Human
gaagaugccuggggacuuggg

SEQ ID NO: 571473 - RNA, 22 nt, Human
gaagguagggggcagacaagag

SEQ ID NO: 571474 - RNA, 18 nt, Human
gacccagggccuuuaagc

SEQ ID NO: 571475 - RNA, 19 nt, Human
gaccuggaagccgagggaa

SEQ ID NO: 571476 - RNA, 20 nt, Human
gacuuggugagaacugggag

SEQ ID NO: 571477 - RNA, 18 nt, Human
gagaaggaggggcuggga

SEQ ID NO: 571478 - RNA, 22 nt, Human
gagccagggcacagggucggga

SEQ ID NO: 571479 - RNA, 23 nt, Human
gagccagggcugggggaugggaa

SEQ ID NO: 571480 - RNA, 19 nt, Human
gagcuccagcccuccucag

SEQ ID NO: 571481 - RNA, 23 nt, Human
gagcugggcguggcggcagaaga

SEQ ID NO: 571482 - RNA, 20 nt, Human
gagggaagguagggggcaga

SEQ ID NO: 571483 - RNA, 21 nt, Human
gcaccccaacagagaagggcc

SEQ ID NO: 571484 - RNA, 23 nt, Human
gcagaagaaggagcacggcacag

SEQ ID NO: 571485 - RNA, 20 nt, Human
gcauggggagaagaggcuga

SEQ ID NO: 571486 - RNA, 21 nt, Human
gccagccucccagugccagaa

SEQ ID NO: 571487 - RNA, 18 nt, Human
gccagcugccccugcuca

SEQ ID NO: 571488 - RNA, 24 nt, Human
gcucccccucuuccuucucccucc

SEQ ID NO: 571489 - RNA, 24 nt, Human
gcugaauucauacagcucaaucug

SEQ ID NO: 571490 - RNA, 18 nt, Human
gcugacaaguccuggaga

SEQ ID NO: 571491 - RNA, 25 nt, Human
gcugagccagucuccucaucugucu

SEQ ID NO: 571492 - RNA, 23 nt, Human
ggaagccgagggaaugacaacuc

SEQ ID NO: 571493 - RNA, 23 nt, Human
ggaaggagguggaaggagacagg

SEQ ID NO: 571494 - RNA, 24 nt, Human
ggagacaggcaggugcggaaaucc

SEQ ID NO: 571495 - RNA, 18 nt, Human
ggagcccaggagaagacc

SEQ ID NO: 571496 - RNA, 18 nt, Human
ggaugggaacaggaggca

SEQ ID NO: 571497 - RNA, 20 nt, Human
ggcagaaagcaggggcagga

SEQ ID NO: 571498 - RNA, 23 nt, Human
ggcagagugcagggcaggugggg

SEQ ID NO: 571499 - RNA, 23 nt, Human
ggcaggagggcugcuggggccug

SEQ ID NO: 571500 - RNA, 21 nt, Human
ggcccaaagccgggcuuggaa

SEQ ID NO: 571501 - RNA, 19 nt, Human
ggcugggagaccuggaggc

SEQ ID NO: 571502 - RNA, 24 nt, Human
gggaaggagguggaaggagacagg

SEQ ID NO: 571503 - RNA, 19 nt, Human
gggaccuggaagccgaggg

SEQ ID NO: 571504 - RNA, 20 nt, Human
gggaggaccuaggagccagg

SEQ ID NO: 571505 - RNA, 19 nt, Human
gggcauggccugggucucg

SEQ ID NO: 571506 - RNA, 20 nt, Human
gggcguggcggcagaagaag

SEQ ID NO: 571507 - RNA, 19 nt, Human
ggggcugggagaccuggag

SEQ ID NO: 571508 - RNA, 23 nt, Human
gguagagacagagaaggaggggc

SEQ ID NO: 571509 - RNA, 24 nt, Human
gucaaggagagggcacuugaccca

SEQ ID NO: 571510 - RNA, 19 nt, Human
gucaucaacagcacugacu

SEQ ID NO: 571511 - RNA, 21 nt, Human
guccugcugggagcucagccu

SEQ ID NO: 571512 - RNA, 24 nt, Human
gugauucaaguagugugguuccag

SEQ ID NO: 571513 - RNA, 21 nt, Human
guggagcagccgaagugcccc

SEQ ID NO: 571514 - RNA, 19 nt, Human
uaaggcaccccaacagaga

SEQ ID NO: 571515 - RNA, 21 nt, Human
uaaggcaccccaacagagaag

SEQ ID NO: 571516 - RNA, 28 nt, Human
uaaggcaccccaacagagaagggcaggg

SEQ ID NO: 571517 - RNA, 19 nt, Human
uaaguguccaagauccagg

SEQ ID NO: 571518 - RNA, 23 nt, Human
uacacagaggcacagacauggcc

SEQ ID NO: 571519 - RNA, 20 nt, Human
ucaaagucucccaaauacug

SEQ ID NO: 571520 - RNA, 19 nt, Human
ucagagcccgcucagccag

SEQ ID NO: 571521 - RNA, 20 nt, Human
ucagcuaccccuggccccag

SEQ ID NO: 571522 - RNA, 18 nt, Human
ucaugaagcaagacacag

SEQ ID NO: 571523 - RNA, 23 nt, Human
uccaagauuucuguguagggaac

SEQ ID NO: 571524 - RNA, 27 nt, Human
ucccucagcccgcagcggguggagggg

SEQ ID NO: 571525 - RNA, 23 nt, Human
uccugggcaaagagggcagagug

SEQ ID NO: 571526 - RNA, 25 nt, Human
uccuguggcuuccccucaggcuggg

SEQ ID NO: 571527 - RNA, 19 nt, Human
ucgaaaaccaggcaguucc

SEQ ID NO: 571528 - RNA, 26 nt, Human
ucugggagaggagacaggcaggugcg

SEQ ID NO: 571529 - RNA, 26 nt, Human
ucugugggugagacagacggcaggac

SEQ ID NO: 571530 - RNA, 24 nt, Human
ucuugucuccaacuccuuucuccc

SEQ ID NO: 571531 - RNA, 21 nt, Human
ugacccaacucugccagcgag

SEQ ID NO: 571532 - RNA, 20 nt, Human
ugacucaaggaacaaaacag

SEQ ID NO: 571533 - RNA, 18 nt, Human
ugagacccgcugaauuca

SEQ ID NO: 571534 - RNA, 27 nt, Human
ugaguggagcccaggagaagaccagaa

SEQ ID NO: 571535 - RNA, 19 nt, Human
ugcaggcgguguccugcug

SEQ ID NO: 571536 - RNA, 20 nt, Human
ugcaggcgguguccugcugg

SEQ ID NO: 571537 - RNA, 21 nt, Human
ugccucugccucauccuggag

SEQ ID NO: 571538 - RNA, 20 nt, Human
ugccuggggacuugggccca

SEQ ID NO: 571539 - RNA, 23 nt, Human
ugcugggucccaggcaguggccc

SEQ ID NO: 571540 - RNA, 21 nt, Human
uggagcccaggagaagaccag

SEQ ID NO: 571541 - RNA, 19 nt, Human
uggagucagcccaguucuc

SEQ ID NO: 571542 - RNA, 21 nt, Human
uggagugagacccgcugaauu

SEQ ID NO: 571543 - RNA, 18 nt, Human
uggcucaggauaaggcac

SEQ ID NO: 571544 - RNA, 19 nt, Human
ugggaaggagguggaagga

SEQ ID NO: 571545 - RNA, 21 nt, Human
ugggaaggagguggaaggaga

SEQ ID NO: 571546 - RNA, 21 nt, Human
ugggagaccuggaggccugag

SEQ ID NO: 571547 - RNA, 18 nt, Human
ugggcaaagagggcagag

SEQ ID NO: 571548 - RNA, 19 nt, Human
uggggaagccuuuccuggc

SEQ ID NO: 571549 - RNA, 19 nt, Human
ugggggaugggaacaggag

SEQ ID NO: 571550 - RNA, 19 nt, Human
ugggggcaggagggcugcu

SEQ ID NO: 571551 - RNA, 23 nt, Human
ugggggcaggagggcugcugggg

SEQ ID NO: 571552 - RNA, 24 nt, Human
ugggucccaggcaguggcccaagc

SEQ ID NO: 571553 - RNA, 20 nt, Human
ugguagaagagccaccuggg

SEQ ID NO: 571554 - RNA, 27 nt, Human
ugucccgggagccagggcacagggucg

SEQ ID NO: 571555 - RNA, 22 nt, Human
ugugcucuugaccuucaucuca

SEQ ID NO: 571556 - RNA, 23 nt, Human
uucggacaggagggccucugggg

SEQ ID NO: 571557 - RNA, 23 nt, Human
uugggaccuggaagccgagggaa

SEQ ID NO: 571558 - RNA, 21 nt, Human
uugggcccacauucacaccga

SEQ ID NO: 571559 - RNA, 18 nt, Human
uuuuuuuuuuuuuuuuug

SEQ ID NO: 571560 - RNA, 22 nt, Human
aaagaaggggaggggccgggag

SEQ ID NO: 571561 - RNA, 18 nt, Human
aaagggcuaggccucugg

SEQ ID NO: 571562 - RNA, 24 nt, Human
aaagugguuuggaacccccaauca

SEQ ID NO: 571563 - RNA, 19 nt, Human
accaccaaauggugaagag

SEQ ID NO: 571564 - RNA, 20 nt, Human
accugccuccuggagauggg

SEQ ID NO: 571565 - RNA, 23 nt, Human
agacaaagaaggggaggggccgg

SEQ ID NO: 571566 - RNA, 23 nt, Human
agcaacagcagucuauccucucg

SEQ ID NO: 571567 - RNA, 20 nt, Human
agggcauggggccagccccg

SEQ ID NO: 571568 - RNA, 24 nt, Human
aggggaggggccgggagagggucg

SEQ ID NO: 571569 - RNA, 21 nt, Human
agucagcucugcagcuggugg

SEQ ID NO: 571570 - RNA, 24 nt, Human
agugguuuggaacccccaaucauu

SEQ ID NO: 571571 - RNA, 21 nt, Human
caaagguacugagcccagaga

SEQ ID NO: 571572 - RNA, 23 nt, Human
caaagguacugagcccagagaca

SEQ ID NO: 571573 - RNA, 22 nt, Human
cacacaugcccaucaaggaccc

SEQ ID NO: 571574 - RNA, 21 nt, Human
caccgugccccgagucucagc

SEQ ID NO: 571575 - RNA, 22 nt, Human
cagcaacagcagucuauccucu

SEQ ID NO: 571576 - RNA, 18 nt, Human
cagcucgucagagcccca

SEQ ID NO: 571577 - RNA, 23 nt, Human
cagcugccucuagcuucaugucc

SEQ ID NO: 571578 - RNA, 18 nt, Human
cagggcaaagguacugag

SEQ ID NO: 571579 - RNA, 18 nt, Human
caguaagugaagacucuc

SEQ ID NO: 571580 - RNA, 19 nt, Human
cagugcuucaccgugcccc

SEQ ID NO: 571581 - RNA, 25 nt, Human
caucacacaugcccaucaaggaccc

SEQ ID NO: 571582 - RNA, 19 nt, Human
ccaagggagaagaaagugg

SEQ ID NO: 571583 - RNA, 18 nt, Human
ccacgccuggcccugacu

SEQ ID NO: 571584 - RNA, 19 nt, Human
ccccaaggccagacuccac

SEQ ID NO: 571585 - RNA, 18 nt, Human
ccccagggcuuccuccac

SEQ ID NO: 571586 - RNA, 23 nt, Human
ccccagugucuccgcgccucucc

SEQ ID NO: 571587 - RNA, 25 nt, Human
cccugaguuccaggaggcgugaccc

SEQ ID NO: 571588 - RNA, 24 nt, Human
ccgugccccgagucucagcggucc

SEQ ID NO: 571589 - RNA, 22 nt, Human
ccuccacaauugaugaguccac

SEQ ID NO: 571590 - RNA, 19 nt, Human
ccuccaucuggcucccgag

SEQ ID NO: 571591 - RNA, 19 nt, Human
ccuggagaugggggugggg

SEQ ID NO: 571592 - RNA, 23 nt, Human
cgagcggguguuggcucugaggc

SEQ ID NO: 571593 - RNA, 19 nt, Human
cgccaccuccaucuggcuc

SEQ ID NO: 571594 - RNA, 19 nt, Human
cgccagacccagccagacc

SEQ ID NO: 571595 - RNA, 24 nt, Human
cgccucucccuccacccagucuca

SEQ ID NO: 571596 - RNA, 21 nt, Human
cgcgccucucccuccacccag

SEQ ID NO: 571597 - RNA, 18 nt, Human
cgucagagccccaguguc

SEQ ID NO: 571598 - RNA, 19 nt, Human
cucccgagcgccagaccca

SEQ ID NO: 571599 - RNA, 21 nt, Human
cucccgagcgccagacccagc

SEQ ID NO: 571600 - RNA, 24 nt, Human
cugaaugcacagaaacuugggguc

SEQ ID NO: 571601 - RNA, 21 nt, Human
cugcuauuaaccagagugcaa

SEQ ID NO: 571602 - RNA, 21 nt, Human
cugcugcuauuaaccagagug

SEQ ID NO: 571603 - RNA, 22 nt, Human
cugggagacugcuccuucccca

SEQ ID NO: 571604 - RNA, 22 nt, Human
cugggcuguccaagugagccug

SEQ ID NO: 571605 - RNA, 21 nt, Human
cuuagagccccaaggccagac

SEQ ID NO: 571606 - RNA, 22 nt, Human
gaauagagucggcaaggucccc

SEQ ID NO: 571607 - RNA, 20 nt, Human
gagaggugcgagcgcggggg

SEQ ID NO: 571608 - RNA, 23 nt, Human
gagcagacccagggcugggagac

SEQ ID NO: 571609 - RNA, 18 nt, Human
gagucagcucugcagcug

SEQ ID NO: 571610 - RNA, 25 nt, Human
gccgggagaggugcgagcgcggggg

SEQ ID NO: 571611 - RNA, 19 nt, Human
gccucugguggggaggggg

SEQ ID NO: 571612 - RNA, 22 nt, Human
gcugccucuagcuucaugucca

SEQ ID NO: 571613 - RNA, 18 nt, Human
ggagaugggggugggggg

SEQ ID NO: 571614 - RNA, 18 nt, Human
ggagaugggggugggggg

SEQ ID NO: 571615 - RNA, 19 nt, Human
ggagcugacauucuuggaa

SEQ ID NO: 571616 - RNA, 19 nt, Human
ggcagccuuggggagcgcc

SEQ ID NO: 571617 - RNA, 22 nt, Human
ggcucccauggccccuaucgcc

SEQ ID NO: 571618 - RNA, 18 nt, Human
gggaggggccgggagagg

SEQ ID NO: 571619 - RNA, 21 nt, Human
ggggagcagacccagggcugg

SEQ ID NO: 571620 - RNA, 20 nt, Human
ggggaggggccgggagaggg

SEQ ID NO: 571621 - RNA, 24 nt, Human
gucgagcggguguuggcucugagg

SEQ ID NO: 571622 - RNA, 23 nt, Human
gugcgagcgcggggguccaccgg

SEQ ID NO: 571623 - RNA, 25 nt, Human
gugggacucacaggagggagaggua

SEQ ID NO: 571624 - RNA, 21 nt, Human
guuuggaacccccaaucauuc

SEQ ID NO: 571625 - RNA, 18 nt, Human
uagcuucauguccaauuc

SEQ ID NO: 571626 - RNA, 21 nt, Human
uaggauuuggagcuauagaga

SEQ ID NO: 571627 - RNA, 23 nt, Human
ucacacagaaacacucugggggc

SEQ ID NO: 571628 - RNA, 19 nt, Human
ucagagucagcucugcagc

SEQ ID NO: 571629 - RNA, 22 nt, Human
uccacugcugcugccucuggcu

SEQ ID NO: 571630 - RNA, 20 nt, Human
uccaggaggcgugacccccc

SEQ ID NO: 571631 - RNA, 19 nt, Human
ucccauggccccuaucgcc

SEQ ID NO: 571632 - RNA, 27 nt, Human
uccccaggguccccagggcuuccucca

SEQ ID NO: 571633 - RNA, 19 nt, Human
ucccugaguuccaggaggc

SEQ ID NO: 571634 - RNA, 22 nt, Human
ucuucagagucagcucugcagc

SEQ ID NO: 571635 - RNA, 24 nt, Human
ucuucagagucagcucugcagcug

SEQ ID NO: 571636 - RNA, 18 nt, Human
ugaagacucucuucagag

SEQ ID NO: 571637 - RNA, 21 nt, Human
ugaagugauaugguccagggc

SEQ ID NO: 571638 - RNA, 18 nt, Human
ugagaggguuucacacag

SEQ ID NO: 571639 - RNA, 23 nt, Human
ugagaggguuucacacagaaaca

SEQ ID NO: 571640 - RNA, 22 nt, Human
ugagccugacuucccuuccaag

SEQ ID NO: 571641 - RNA, 22 nt, Human
ugaggcuuguccuaggagcugg

SEQ ID NO: 571642 - RNA, 21 nt, Human
ugcaaaagacaaagaagggga

SEQ ID NO: 571643 - RNA, 21 nt, Human
ugcaaaagacaaagaagggga

SEQ ID NO: 571644 - RNA, 19 nt, Human
ugcagcugguggagucauc

SEQ ID NO: 571645 - RNA, 24 nt, Human
ugccucuagcuucauguccaauuc

SEQ ID NO: 571646 - RNA, 20 nt, Human
ugcuucaccgugccccgagu

SEQ ID NO: 571647 - RNA, 21 nt, Human
uggagauggggguggggggag

SEQ ID NO: 571648 - RNA, 21 nt, Human
uggcucccgagcgccagaccc

SEQ ID NO: 571649 - RNA, 21 nt, Human
uggggagcagacccagggcug

SEQ ID NO: 571650 - RNA, 24 nt, Human
ugggggccuucggugacaaaaggg

SEQ ID NO: 571651 - RNA, 19 nt, Human
uguccuaggagcuggcugg

SEQ ID NO: 571652 - RNA, 22 nt, Human
uucauccuaagcuaccuuaaaa

SEQ ID NO: 571653 - RNA, 23 nt, Human
aaaaaccuccagggagcccaaag

SEQ ID NO: 571654 - RNA, 23 nt, Human
aaaaaccuccagggagcccaaag

SEQ ID NO: 571655 - RNA, 19 nt, Human
aaaacaaggccucaaaccc

SEQ ID NO: 571656 - RNA, 19 nt, Human
aaaacaaggccucaaaccc

SEQ ID NO: 571657 - RNA, 19 nt, Human
aaacccgcaggggcucaga

SEQ ID NO: 571658 - RNA, 19 nt, Human
aaacccgcaggggcucaga

SEQ ID NO: 571659 - RNA, 18 nt, Human
aaaggagggaaagggucc

SEQ ID NO: 571660 - RNA, 18 nt, Human
aaaggagggaaagggucc

SEQ ID NO: 571661 - RNA, 20 nt, Human
aaaggccgggucuggagggc

SEQ ID NO: 571662 - RNA, 20 nt, Human
aaaggccgggucuggagggc

SEQ ID NO: 571663 - RNA, 19 nt, Human
aacaacuuccagaagcuga

SEQ ID NO: 571664 - RNA, 21 nt, Human
aacaaucuaacaggccaagug

SEQ ID NO: 571665 - RNA, 21 nt, Human
aacaaucuaacaggccaagug

SEQ ID NO: 571666 - RNA, 19 nt, Human
aaccagaaaggccgggucu

SEQ ID NO: 571667 - RNA, 19 nt, Human
aaccagaaaggccgggucu

SEQ ID NO: 571668 - RNA, 20 nt, Human
aagagaccugggcagggacg

SEQ ID NO: 571669 - RNA, 20 nt, Human
aagagaccugggcagggacg

SEQ ID NO: 571670 - RNA, 20 nt, Human
aagcugccccuucaaaggcc

SEQ ID NO: 571671 - RNA, 20 nt, Human
aagcugccccuucaaaggcc

SEQ ID NO: 571672 - RNA, 19 nt, Human
aagggcaaacucuccaagc

SEQ ID NO: 571673 - RNA, 19 nt, Human
aagggcaaacucuccaagc

SEQ ID NO: 571674 - RNA, 19 nt, Human
acaacuuccagaagcugcc

SEQ ID NO: 571675 - RNA, 19 nt, Human
acaacuuccagaagcugcc

SEQ ID NO: 571676 - RNA, 21 nt, Human
acacagguguccugccgccgc

SEQ ID NO: 571677 - RNA, 20 nt, Human
accccacccaccacgugcug

SEQ ID NO: 571678 - RNA, 18 nt, Human
accuccucauccugaaaa

SEQ ID NO: 571679 - RNA, 22 nt, Human
acucccuucuucaggagugcca

SEQ ID NO: 571680 - RNA, 22 nt, Human
acucccuucuucaggagugcca

SEQ ID NO: 571681 - RNA, 20 nt, Human
acuggcucucagcacuaaaa

SEQ ID NO: 571682 - RNA, 23 nt, Human
agacaagagcugcaggggacguc

SEQ ID NO: 571683 - RNA, 23 nt, Human
agacaagagcugcaggggacguc

SEQ ID NO: 571684 - RNA, 19 nt, Human
agacaagagcugcaggugu

SEQ ID NO: 571685 - RNA, 19 nt, Human
agacaagagcugcaggugu

SEQ ID NO: 571686 - RNA, 23 nt, Human
agacaagggcaaacucuccaagc

SEQ ID NO: 571687 - RNA, 23 nt, Human
agacaagggcaaacucuccaagc

SEQ ID NO: 571688 - RNA, 18 nt, Human
agaugcagaucagguggg

SEQ ID NO: 571689 - RNA, 18 nt, Human
agaugcagaucagguggg

SEQ ID NO: 571690 - RNA, 19 nt, Human
agauggagguugucuucuc

SEQ ID NO: 571691 - RNA, 19 nt, Human
agauggagguugucuucuc

SEQ ID NO: 571692 - RNA, 22 nt, Human
agcagaaugaacagagucucuu

SEQ ID NO: 571693 - RNA, 22 nt, Human
agcagaaugaacagagucucuu

SEQ ID NO: 571694 - RNA, 22 nt, Human
agcaggcagcuuggcaugcagg

SEQ ID NO: 571695 - RNA, 22 nt, Human
agcaggcagcuuggcaugcagg

SEQ ID NO: 571696 - RNA, 19 nt, Human
agcugccccuucaaaggcc

SEQ ID NO: 571697 - RNA, 19 nt, Human
agcugccccuucaaaggcc

SEQ ID NO: 571698 - RNA, 21 nt, Human
aggagaaaacaacuuccagaa

SEQ ID NO: 571699 - RNA, 21 nt, Human
aggagaaaacaacuuccagaa

SEQ ID NO: 571700 - RNA, 22 nt, Human
aggagaaaacaacuuccagaag

SEQ ID NO: 571701 - RNA, 22 nt, Human
aggagaaaacaacuuccagaag

SEQ ID NO: 571702 - RNA, 21 nt, Human
agguguccugccgccagcccc

SEQ ID NO: 571703 - RNA, 23 nt, Human
agucaagguucuucaagccacag

SEQ ID NO: 571704 - RNA, 23 nt, Human
agucaagguucuucaagccacag

SEQ ID NO: 571705 - RNA, 24 nt, Human
augcaaacaaagaugcagaucagg

SEQ ID NO: 571706 - RNA, 24 nt, Human
augcaaacaaagaugcagaucagg

SEQ ID NO: 571707 - RNA, 20 nt, Human
caaaagggccugagcggcga

SEQ ID NO: 571708 - RNA, 21 nt, Human
caacaaggagaaaccccacuc

SEQ ID NO: 571709 - RNA, 21 nt, Human
caacaaggagaaaccccacuc

SEQ ID NO: 571710 - RNA, 18 nt, Human
caacuuccagaagcugcc

SEQ ID NO: 571711 - RNA, 18 nt, Human
caacuuccagaagcugcc

SEQ ID NO: 571712 - RNA, 19 nt, Human
caagccacaggcguucucg

SEQ ID NO: 571713 - RNA, 19 nt, Human
caagccacaggcguucucg

SEQ ID NO: 571714 - RNA, 22 nt, Human
caaugcccaccugugccugcug

SEQ ID NO: 571715 - RNA, 22 nt, Human
caaugcccaccugugccugcug

SEQ ID NO: 571716 - RNA, 20 nt, Human
cacaccuaacccucaucucc

SEQ ID NO: 571717 - RNA, 20 nt, Human
cacaccuaacccucaucucc

SEQ ID NO: 571718 - RNA, 25 nt, Human
cacuaaaaacaaggccucaaacccg

SEQ ID NO: 571719 - RNA, 25 nt, Human
cacuaaaaacaaggccucaaacccg

SEQ ID NO: 571720 - RNA, 22 nt, Human
cacucaggacuucccaccccgc

SEQ ID NO: 571721 - RNA, 21 nt, Human
cagcccccaggcuuggccucc

SEQ ID NO: 571722 - RNA, 23 nt, Human
cagcgcagccugcacaggacuuc

SEQ ID NO: 571723 - RNA, 23 nt, Human
cagcgcagccugcacaggacuuc

SEQ ID NO: 571724 - RNA, 18 nt, Human
cagcgcagucacgcuccc

SEQ ID NO: 571725 - RNA, 18 nt, Human
cagcugcaccccacccac

SEQ ID NO: 571726 - RNA, 20 nt, Human
cagggguuaaccagaaaggc

SEQ ID NO: 571727 - RNA, 20 nt, Human
cagggguuaaccagaaaggc

SEQ ID NO: 571728 - RNA, 19 nt, Human
cagggucugagucgggagg

SEQ ID NO: 571729 - RNA, 19 nt, Human
cagggucugagucgggagg

SEQ ID NO: 571730 - RNA, 23 nt, Human
caggguuccaggccuguggccuc

SEQ ID NO: 571731 - RNA, 22 nt, Human
cagguguccugccgccagcccc

SEQ ID NO: 571732 - RNA, 21 nt, Human
cauccugaaaacccuuugccc

SEQ ID NO: 571733 - RNA, 21 nt, Human
cauccugucuugaccuccuca

SEQ ID NO: 571734 - RNA, 21 nt, Human
cauccugucuugaccuccuca

SEQ ID NO: 571735 - RNA, 19 nt, Human
caugacaaggcagccaggc

SEQ ID NO: 571736 - RNA, 19 nt, Human
caugacaaggcagccaggc

SEQ ID NO: 571737 - RNA, 24 nt, Human
caugggccucccucccuuccaggg

SEQ ID NO: 571738 - RNA, 20 nt, Human
ccaaaggagggaaagggucc

SEQ ID NO: 571739 - RNA, 20 nt, Human
ccaaaggagggaaagggucc

SEQ ID NO: 571740 - RNA, 19 nt, Human
ccaagcagaggagaaaaca

SEQ ID NO: 571741 - RNA, 19 nt, Human
ccaagcagaggagaaaaca

SEQ ID NO: 571742 - RNA, 18 nt, Human
ccaccacagcucucccag

SEQ ID NO: 571743 - RNA, 18 nt, Human
ccaccacagcucucccag

SEQ ID NO: 571744 - RNA, 23 nt, Human
ccacccgcccccagcccccaggc

SEQ ID NO: 571745 - RNA, 23 nt, Human
ccaccugugccugcugaucugga

SEQ ID NO: 571746 - RNA, 23 nt, Human
ccaccugugccugcugaucugga

SEQ ID NO: 571747 - RNA, 18 nt, Human
ccagaccagcugcacccc

SEQ ID NO: 571748 - RNA, 18 nt, Human
ccagcccauauucccacc

SEQ ID NO: 571749 - RNA, 18 nt, Human
ccagcccauauucccacc

SEQ ID NO: 571750 - RNA, 23 nt, Human
ccagcccccaggcuuggccuccc

SEQ ID NO: 571751 - RNA, 21 nt, Human
ccagcugcaccccacccacca

SEQ ID NO: 571752 - RNA, 20 nt, Human
ccaggccuguggccucuguc

SEQ ID NO: 571753 - RNA, 22 nt, Human
ccaggcugcugcuggacuggac

SEQ ID NO: 571754 - RNA, 22 nt, Human
ccaggcugcugcuggacuggac

SEQ ID NO: 571755 - RNA, 22 nt, Human
ccaggcuuggccucccaugggc

SEQ ID NO: 571756 - RNA, 21 nt, Human
cccaaaggagggaaagggucc

SEQ ID NO: 571757 - RNA, 21 nt, Human
cccaaaggagggaaagggucc

SEQ ID NO: 571758 - RNA, 18 nt, Human
cccaagagacaagagacc

SEQ ID NO: 571759 - RNA, 18 nt, Human
cccaagagacaagagacc

SEQ ID NO: 571760 - RNA, 21 nt, Human
cccacccgcccccagccccca

SEQ ID NO: 571761 - RNA, 18 nt, Human
cccaccuugccucuuccc

SEQ ID NO: 571762 - RNA, 24 nt, Human
cccacuugcccccaacacccacag

SEQ ID NO: 571763 - RNA, 24 nt, Human
cccacuugcccccaacacccacag

SEQ ID NO: 571764 - RNA, 19 nt, Human
cccaggacuccuaguucag

SEQ ID NO: 571765 - RNA, 19 nt, Human
cccaggacuccuaguucag

SEQ ID NO: 571766 - RNA, 24 nt, Human
ccccaacacccacagaugaacucg

SEQ ID NO: 571767 - RNA, 24 nt, Human
ccccaacacccacagaugaacucg

SEQ ID NO: 571768 - RNA, 19 nt, Human
ccccaccuugccucuuccc

SEQ ID NO: 571769 - RNA, 22 nt, Human
ccccacuugcccccaacaccca

SEQ ID NO: 571770 - RNA, 22 nt, Human
ccccacuugcccccaacaccca

SEQ ID NO: 571771 - RNA, 22 nt, Human
cccccacuugcccccaacaccc

SEQ ID NO: 571772 - RNA, 22 nt, Human
cccccacuugcccccaacaccc

SEQ ID NO: 571773 - RNA, 24 nt, Human
cccccagcccccaggcuuggccuc

SEQ ID NO: 571774 - RNA, 19 nt, Human
cccccaggcuuggccuccc

SEQ ID NO: 571775 - RNA, 25 nt, Human
cccgcccccagcccccaggcuuggc

SEQ ID NO: 571776 - RNA, 26 nt, Human
cccuaagaugccagguugagggccuc

SEQ ID NO: 571777 - RNA, 26 nt, Human
cccuaagaugccagguugagggccuc

SEQ ID NO: 571778 - RNA, 19 nt, Human
cccugcagcagugccagcc

SEQ ID NO: 571779 - RNA, 19 nt, Human
cccugcagcagugccagcc

SEQ ID NO: 571780 - RNA, 20 nt, Human
cccuggaaguggcagggaga

SEQ ID NO: 571781 - RNA, 20 nt, Human
cccuggaaguggcagggaga

SEQ ID NO: 571782 - RNA, 21 nt, Human
cccuuugcccagaguuugacc

SEQ ID NO: 571783 - RNA, 23 nt, Human
ccgaccuaucaguuccuucccaa

SEQ ID NO: 571784 - RNA, 21 nt, Human
ccuagguccuugcuucucaaa

SEQ ID NO: 571785 - RNA, 21 nt, Human
ccuagguccuugcuucucaaa

SEQ ID NO: 571786 - RNA, 18 nt, Human
ccucaagcucuggggccu

SEQ ID NO: 571787 - RNA, 18 nt, Human
ccucaagcucuggggccu

SEQ ID NO: 571788 - RNA, 24 nt, Human
ccucauccugaaaacccuuugccc

SEQ ID NO: 571789 - RNA, 18 nt, Human
ccuccagggagcccaaag

SEQ ID NO: 571790 - RNA, 18 nt, Human
ccuccagggagcccaaag

SEQ ID NO: 571791 - RNA, 22 nt, Human
ccucccucccuuccaggguucc

SEQ ID NO: 571792 - RNA, 19 nt, Human
ccugcacaggacuucagcc

SEQ ID NO: 571793 - RNA, 19 nt, Human
ccugcacaggacuucagcc

SEQ ID NO: 571794 - RNA, 19 nt, Human
ccugccgccagcccccagg

SEQ ID NO: 571795 - RNA, 20 nt, Human
ccuuugcccagaguuugacc

SEQ ID NO: 571796 - RNA, 22 nt, Human
cggaggacauccccagccuagg

SEQ ID NO: 571797 - RNA, 18 nt, Human
cguccacggcacacagga

SEQ ID NO: 571798 - RNA, 18 nt, Human
cguccacggcacacagga

SEQ ID NO: 571799 - RNA, 24 nt, Human
cuagguccuugcuucucaaacucu

SEQ ID NO: 571800 - RNA, 24 nt, Human
cuagguccuugcuucucaaacucu

SEQ ID NO: 571801 - RNA, 18 nt, Human
cucaaacccgcaggggcu

SEQ ID NO: 571802 - RNA, 18 nt, Human
cucaaacccgcaggggcu

SEQ ID NO: 571803 - RNA, 22 nt, Human
cucacugugagcucugauuugg

SEQ ID NO: 571804 - RNA, 21 nt, Human
cuccacagaugaggagaaggu

SEQ ID NO: 571805 - RNA, 21 nt, Human
cuccacagaugaggagaaggu

SEQ ID NO: 571806 - RNA, 26 nt, Human
cuccuagcgcccugcgcagcgcaguc

SEQ ID NO: 571807 - RNA, 22 nt, Human
cugagcggcgacaaugccuccu

SEQ ID NO: 571808 - RNA, 23 nt, Human
cugcacaggacuucagcccccac

SEQ ID NO: 571809 - RNA, 23 nt, Human
cugcacaggacuucagcccccac

SEQ ID NO: 571810 - RNA, 24 nt, Human
cugcugguccucgggcuccuacau

SEQ ID NO: 571811 - RNA, 24 nt, Human
cugcugguccucgggcuccuacau

SEQ ID NO: 571812 - RNA, 22 nt, Human
cugcuguaagcuaucuauccag

SEQ ID NO: 571813 - RNA, 19 nt, Human
cugcuguucucugggccaa

SEQ ID NO: 571814 - RNA, 19 nt, Human
cuggcucucagcacuaaaa

SEQ ID NO: 571815 - RNA, 19 nt, Human
cuggcucucagcacuaaaa

SEQ ID NO: 571816 - RNA, 21 nt, Human
cugggccaccucucccgcagc

SEQ ID NO: 571817 - RNA, 21 nt, Human
cugggccaccucucccgcagc

SEQ ID NO: 571818 - RNA, 27 nt, Human
cugggcccugcagagggccgcauccag

SEQ ID NO: 571819 - RNA, 27 nt, Human
cugggcccugcagagggccgcauccag

SEQ ID NO: 571820 - RNA, 24 nt, Human
cuucaggagugccaugcagacucu

SEQ ID NO: 571821 - RNA, 24 nt, Human
cuucaggagugccaugcagacucu

SEQ ID NO: 571822 - RNA, 23 nt, Human
cuugcccccaacacccacagaug

SEQ ID NO: 571823 - RNA, 23 nt, Human
cuugcccccaacacccacagaug

SEQ ID NO: 571824 - RNA, 18 nt, Human
cuugcuggguacugucca

SEQ ID NO: 571825 - RNA, 19 nt, Human
cuugcuggguacuguccca

SEQ ID NO: 571826 - RNA, 25 nt, Human
cuuggccucccaugggccucccucc

SEQ ID NO: 571827 - RNA, 20 nt, Human
cuuugggcguuggccuggga

SEQ ID NO: 571828 - RNA, 20 nt, Human
cuuugggcguuggccuggga

SEQ ID NO: 571829 - RNA, 22 nt, Human
gaaaccccacuccagggcacaa

SEQ ID NO: 571830 - RNA, 22 nt, Human
gaaaccccacuccagggcacaa

SEQ ID NO: 571831 - RNA, 20 nt, Human
gaacacaggcucagaucccu

SEQ ID NO: 571832 - RNA, 20 nt, Human
gaacacaggcucagaucccu

SEQ ID NO: 571833 - RNA, 23 nt, Human
gacaagagaccugggcagggacg

SEQ ID NO: 571834 - RNA, 23 nt, Human
gacaagagaccugggcagggacg

SEQ ID NO: 571835 - RNA, 21 nt, Human
gaccuaucaguuccuucccaa

SEQ ID NO: 571836 - RNA, 20 nt, Human
gaccuaucaguuccuucccu

SEQ ID NO: 571837 - RNA, 20 nt, Human
gaccuaucaguuccuucccu

SEQ ID NO: 571838 - RNA, 24 nt, Human
gaggagaaaacaacuuccagaagc

SEQ ID NO: 571839 - RNA, 23 nt, Human
gcaaugcccaccugugccugcug

SEQ ID NO: 571840 - RNA, 23 nt, Human
gcaaugcccaccugugccugcug

SEQ ID NO: 571841 - RNA, 20 nt, Human
gccccaggcccucuccuggu

SEQ ID NO: 571842 - RNA, 20 nt, Human
gccccaggcccucuccuggu

SEQ ID NO: 571843 - RNA, 20 nt, Human
gccgcugcugguccacagac

SEQ ID NO: 571844 - RNA, 20 nt, Human
gccgcugcugguccacagac

SEQ ID NO: 571845 - RNA, 22 nt, Human
gccuugggauacgagcagaaug

SEQ ID NO: 571846 - RNA, 22 nt, Human
gccuugggauacgagcagaaug

SEQ ID NO: 571847 - RNA, 18 nt, Human
gcuaaaaugcagggucug

SEQ ID NO: 571848 - RNA, 18 nt, Human
gcuaaaaugcagggucug

SEQ ID NO: 571849 - RNA, 19 nt, Human
ggagcuggcuggcuacaaa

SEQ ID NO: 571850 - RNA, 19 nt, Human
ggagcuggcuggcuacaaa

SEQ ID NO: 571851 - RNA, 18 nt, Human
ggcaggagaucugccuga

SEQ ID NO: 571852 - RNA, 18 nt, Human
ggcaggagaucugccuga

SEQ ID NO: 571853 - RNA, 20 nt, Human
ggcucagaaaauaccuggca

SEQ ID NO: 571854 - RNA, 20 nt, Human
ggcucagaaaauaccuggca

SEQ ID NO: 571855 - RNA, 23 nt, Human
gggacggagcacucaggacuucc

SEQ ID NO: 571856 - RNA, 21 nt, Human
gggacggagcacucagggacu

SEQ ID NO: 571857 - RNA, 24 nt, Human
gggacggagcacucagggacuucc

SEQ ID NO: 571858 - RNA, 24 nt, Human
gggcacaaggcagguggggccagc

SEQ ID NO: 571859 - RNA, 24 nt, Human
gggcacaaggcagguggggccagc

SEQ ID NO: 571860 - RNA, 18 nt, Human
gggcagcaacuggcucuc

SEQ ID NO: 571861 - RNA, 18 nt, Human
gggcagcaacuggcucuc

SEQ ID NO: 571862 - RNA, 18 nt, Human
gggcagcaggcagcuugg

SEQ ID NO: 571863 - RNA, 18 nt, Human
gggcagcaggcagcuugg

SEQ ID NO: 571864 - RNA, 24 nt, Human
gggcaggagaucugccugaguuug

SEQ ID NO: 571865 - RNA, 24 nt, Human
gggcaggagaucugccugaguuug

SEQ ID NO: 571866 - RNA, 23 nt, Human
gggccucaggugucucuggagau

SEQ ID NO: 571867 - RNA, 23 nt, Human
gggccucaggugucucuggagau

SEQ ID NO: 571868 - RNA, 21 nt, Human
gugacugcaggucccacuccc

SEQ ID NO: 571869 - RNA, 21 nt, Human
guggggucuggggcacugagu

SEQ ID NO: 571870 - RNA, 21 nt, Human
guggggucuggggcacugagu

SEQ ID NO: 571871 - RNA, 19 nt, Human
uaacaggccaagugucucc

SEQ ID NO: 571872 - RNA, 19 nt, Human
uaacaggccaagugucucc

SEQ ID NO: 571873 - RNA, 19 nt, Human
uaccugaggaccaagcagu

SEQ ID NO: 571874 - RNA, 19 nt, Human
uaccugaggaccaagcagu

SEQ ID NO: 571875 - RNA, 19 nt, Human
uacugcucugagcaguggu

SEQ ID NO: 571876 - RNA, 19 nt, Human
uacugcucugagcaguggu

SEQ ID NO: 571877 - RNA, 18 nt, Human
uacugcuguaagcuaucu

SEQ ID NO: 571878 - RNA, 23 nt, Human
uacugcuguaagcuaucuaucca

SEQ ID NO: 571879 - RNA, 24 nt, Human
uagccuuaggaguaguaaaguggc

SEQ ID NO: 571880 - RNA, 24 nt, Human
uagccuuaggaguaguaaaguggc

SEQ ID NO: 571881 - RNA, 24 nt, Human
uagggugaggccuagacucugcau

SEQ ID NO: 571882 - RNA, 24 nt, Human
uagggugaggccuagacucugcau

SEQ ID NO: 571883 - RNA, 20 nt, Human
ucaagcucuggggccucagg

SEQ ID NO: 571884 - RNA, 20 nt, Human
ucaagcucuggggccucagg

SEQ ID NO: 571885 - RNA, 25 nt, Human
ucagcacuaaaaacaaggccucaaa

SEQ ID NO: 571886 - RNA, 25 nt, Human
ucagcacuaaaaacaaggccucaaa

SEQ ID NO: 571887 - RNA, 19 nt, Human
uccaagacagacaagggca

SEQ ID NO: 571888 - RNA, 24 nt, Human
uccaagacagacaagggcaaacuc

SEQ ID NO: 571889 - RNA, 24 nt, Human
uccaagacagacaagggcaaacuc

SEQ ID NO: 571890 - RNA, 20 nt, Human
ucccaagagacaagagaccc

SEQ ID NO: 571891 - RNA, 19 nt, Human
ucccaccaguccagggacc

SEQ ID NO: 571892 - RNA, 19 nt, Human
ucccaccaguccagggacc

SEQ ID NO: 571893 - RNA, 19 nt, Human
ucccuggaaguggcaggga

SEQ ID NO: 571894 - RNA, 19 nt, Human
ucccuggaaguggcaggga

SEQ ID NO: 571895 - RNA, 19 nt, Human
uccugaaaacccuuugccc

SEQ ID NO: 571896 - RNA, 19 nt, Human
uccugaaaacccuuugccc

SEQ ID NO: 571897 - RNA, 24 nt, Human
uccuucccaagagacaagagaccc

SEQ ID NO: 571898 - RNA, 23 nt, Human
ucucugggccaccucucccgcag

SEQ ID NO: 571899 - RNA, 23 nt, Human
ucucugggccaccucucccgcag

SEQ ID NO: 571900 - RNA, 21 nt, Human
ucuggggccucaggugucucu

SEQ ID NO: 571901 - RNA, 21 nt, Human
ucuggggccucaggugucucu

SEQ ID NO: 571902 - RNA, 19 nt, Human
ugacagagcugacgugacu

SEQ ID NO: 571903 - RNA, 20 nt, Human
ugacagagcugacgugacuu

SEQ ID NO: 571904 - RNA, 20 nt, Human
ugacagagcugacgugacuu

SEQ ID NO: 571905 - RNA, 22 nt, Human
ugaccaaccaggccuugggaua

SEQ ID NO: 571906 - RNA, 22 nt, Human
ugaccaaccaggccuugggaua

SEQ ID NO: 571907 - RNA, 23 nt, Human
ugaccuccucauccugaaaaccc

SEQ ID NO: 571908 - RNA, 23 nt, Human
ugaccuccucauccugaaaaccc

SEQ ID NO: 571909 - RNA, 20 nt, Human
ugacugcaggucccacuccc

SEQ ID NO: 571910 - RNA, 22 nt, Human
ugaggaccuggggcagcaggca

SEQ ID NO: 571911 - RNA, 22 nt, Human
ugaggaccuggggcagcaggca

SEQ ID NO: 571912 - RNA, 18 nt, Human
ugaggugaggaccugggg

SEQ ID NO: 571913 - RNA, 18 nt, Human
ugaggugaggaccugggg

SEQ ID NO: 571914 - RNA, 18 nt, Human
ugaggugaggaccugggg

SEQ ID NO: 571915 - RNA, 18 nt, Human
ugaggugaggaccugggg

SEQ ID NO: 571916 - RNA, 21 nt, Human
ugaguuggcuugcuccacaga

SEQ ID NO: 571917 - RNA, 21 nt, Human
ugaguuggcuugcuccacaga

SEQ ID NO: 571918 - RNA, 21 nt, Human
ugcacaggacuucagccccca

SEQ ID NO: 571919 - RNA, 21 nt, Human
ugcacaggacuucagccccca

SEQ ID NO: 571920 - RNA, 25 nt, Human
ugccagcccauauucccaccacagc

SEQ ID NO: 571921 - RNA, 25 nt, Human
ugccagcccauauucccaccacagc

SEQ ID NO: 571922 - RNA, 20 nt, Human
ugcccccaacacccacagau

SEQ ID NO: 571923 - RNA, 22 nt, Human
ugccucaagcucuggggccuca

SEQ ID NO: 571924 - RNA, 22 nt, Human
ugccucaagcucuggggccuca

SEQ ID NO: 571925 - RNA, 20 nt, Human
ugcucggcccacccgccccc

SEQ ID NO: 571926 - RNA, 23 nt, Human
ugcugggugggcaugaggagggu

SEQ ID NO: 571927 - RNA, 20 nt, Human
ugcugguccacagaccacac

SEQ ID NO: 571928 - RNA, 20 nt, Human
ugcugguccacagaccacac

SEQ ID NO: 571929 - RNA, 19 nt, Human
uggagggcugggcacaccu

SEQ ID NO: 571930 - RNA, 19 nt, Human
uggagggcugggcacaccu

SEQ ID NO: 571931 - RNA, 20 nt, Human
uggccucugucccuugcugg

SEQ ID NO: 571932 - RNA, 19 nt, Human
uggccugggagcuggcugg

SEQ ID NO: 571933 - RNA, 19 nt, Human
uggccugggagcuggcugg

SEQ ID NO: 571934 - RNA, 22 nt, Human
ugggaaaccaggacagcugguc

SEQ ID NO: 571935 - RNA, 22 nt, Human
ugggaaaccaggacagcugguc

SEQ ID NO: 571936 - RNA, 23 nt, Human
uggggucuggggcacugaguugg

SEQ ID NO: 571937 - RNA, 23 nt, Human
uggggucuggggcacugaguugg

SEQ ID NO: 571938 - RNA, 19 nt, Human
ugggugggcaugaggaggg

SEQ ID NO: 571939 - RNA, 20 nt, Human
ugucuugaccuccucauccu

SEQ ID NO: 571940 - RNA, 20 nt, Human
ugucuugaccuccucauccu

SEQ ID NO: 571941 - RNA, 21 nt, Human
uguuugugcacaucagagaag

SEQ ID NO: 571942 - RNA, 21 nt, Human
uguuugugcacaucagagaag

SEQ ID NO: 571943 - RNA, 21 nt, Human
uuaaccagaaaggccgggucu

SEQ ID NO: 571944 - RNA, 21 nt, Human
uuaaccagaaaggccgggucu

SEQ ID NO: 571945 - RNA, 27 nt, Human
uuauaggaaucagcugggggucuugcu

SEQ ID NO: 571946 - RNA, 27 nt, Human
uuauaggaaucagcugggggucuugcu

SEQ ID NO: 571947 - RNA, 20 nt, Human
uucaacaaggagaaacccca

SEQ ID NO: 571948 - RNA, 20 nt, Human
uucaacaaggagaaacccca

SEQ ID NO: 571949 - RNA, 23 nt, Human
uucaacaaggagaaaccccacuc

SEQ ID NO: 571950 - RNA, 23 nt, Human
uucaacaaggagaaaccccacuc

SEQ ID NO: 571951 - RNA, 21 nt, Human
uucagcccccacuugccccca

SEQ ID NO: 571952 - RNA, 21 nt, Human
uucagcccccacuugccccca

SEQ ID NO: 571953 - RNA, 21 nt, Human
uucccaccacagcucucccag

SEQ ID NO: 571954 - RNA, 21 nt, Human
uucccaccacagcucucccag

SEQ ID NO: 571955 - RNA, 19 nt, Human
uucccaccaguccagggac

SEQ ID NO: 571956 - RNA, 19 nt, Human
uucccaccaguccagggac

SEQ ID NO: 571957 - RNA, 24 nt, Human
uucccaccaguccagggaccacag

SEQ ID NO: 571958 - RNA, 24 nt, Human
uucccaccaguccagggaccacag

SEQ ID NO: 571959 - RNA, 24 nt, Human
uugcugggugggcaugaggagggu

SEQ ID NO: 571960 - RNA, 24 nt, Human
uuugcacagcagcugugagugccg

SEQ ID NO: 571961 - RNA, 24 nt, Human
uuugcacagcagcugugagugccg

SEQ ID NO: 571962 - RNA, 23 nt, Human
aaacaacuggccugaggucucca

SEQ ID NO: 571963 - RNA, 21 nt, Human
aagccaccaggggccagguag

SEQ ID NO: 571964 - RNA, 18 nt, Human
acagcaucaucacugacc

SEQ ID NO: 571965 - RNA, 20 nt, Human
accaggggccagguaguaaa

SEQ ID NO: 571966 - RNA, 20 nt, Human
acccacccuaacuuccuucu

SEQ ID NO: 571967 - RNA, 23 nt, Human
accuccauuuuacagacuggagg

SEQ ID NO: 571968 - RNA, 19 nt, Human
accucgaucauccagggag

SEQ ID NO: 571969 - RNA, 23 nt, Human
acgccagcccgggagggcagucu

SEQ ID NO: 571970 - RNA, 19 nt, Human
acuccgugggacgccagcc

SEQ ID NO: 571971 - RNA, 24 nt, Human
acuccgugggacgccagcccggga

SEQ ID NO: 571972 - RNA, 20 nt, Human
acugaccagcagaucagugg

SEQ ID NO: 571973 - RNA, 18 nt, Human
agaagggagggggugcug

SEQ ID NO: 571974 - RNA, 24 nt, Human
agagaggggggcccgaggggcagg

SEQ ID NO: 571975 - RNA, 20 nt, Human
aggagcuaccggagaaggga

SEQ ID NO: 571976 - RNA, 18 nt, Human
aggcaacccuaggaccag

SEQ ID NO: 571977 - RNA, 22 nt, Human
aggcagggguaggagcuaccgg

SEQ ID NO: 571978 - RNA, 26 nt, Human
aggccacagcaucaucacugaccagc

SEQ ID NO: 571979 - RNA, 18 nt, Human
agggauagagccaagggg

SEQ ID NO: 571980 - RNA, 23 nt, Human
aggggcagcagagaggggggccc

SEQ ID NO: 571981 - RNA, 22 nt, Human
agggugcugugugucuuucggg

SEQ ID NO: 571982 - RNA, 21 nt, Human
agguacuaccugugaccacug

SEQ ID NO: 571983 - RNA, 27 nt, Human
agguaguaaauccuugucggguggacc

SEQ ID NO: 571984 - RNA, 22 nt, Human
agguggcaguggucccaggagg

SEQ ID NO: 571985 - RNA, 20 nt, Human
aguggccacggugggcugga

SEQ ID NO: 571986 - RNA, 27 nt, Human
aucauccagggaggcuuguccugcagu

SEQ ID NO: 571987 - RNA, 21 nt, Human
augacauuucccagacucccu

SEQ ID NO: 571988 - RNA, 24 nt, Human
auggggaugaggguugggcagggg

SEQ ID NO: 571989 - RNA, 21 nt, Human
caaggccggggagacauuuag

SEQ ID NO: 571990 - RNA, 25 nt, Human
cacagcaucaucacugaccagcaga

SEQ ID NO: 571991 - RNA, 21 nt, Human
cacuccuccaguucccaccuc

SEQ ID NO: 571992 - RNA, 23 nt, Human
cagacuggaggcuggaggguaaa

SEQ ID NO: 571993 - RNA, 24 nt, Human
cagagcuacagaacaucgaugcug

SEQ ID NO: 571994 - RNA, 20 nt, Human
cagcagagaggggggcccga

SEQ ID NO: 571995 - RNA, 21 nt, Human
caggacaacccuagaugugga

SEQ ID NO: 571996 - RNA, 20 nt, Human
caggacuagaaagaaaaguc

SEQ ID NO: 571997 - RNA, 19 nt, Human
caggcaacccuaggaccag

SEQ ID NO: 571998 - RNA, 22 nt, Human
caggccacagcaucaucacuga

SEQ ID NO: 571999 - RNA, 22 nt, Human
caggucacagaggccuggcuga

SEQ ID NO: 572000 - RNA, 22 nt, Human
cauaaaaugggcaacauuuuaa

SEQ ID NO: 572001 - RNA, 22 nt, Human
ccacagcaucaucacugaccag

SEQ ID NO: 572002 - RNA, 21 nt, Human
ccagauucugguaguugaagg

SEQ ID NO: 572003 - RNA, 18 nt, Human
ccccugagaagaugggga

SEQ ID NO: 572004 - RNA, 23 nt, Human
cccgcacaggcagggguaggagc

SEQ ID NO: 572005 - RNA, 19 nt, Human
cccuaggaccagguacuac

SEQ ID NO: 572006 - RNA, 18 nt, Human
cccucggccugugggcag

SEQ ID NO: 572007 - RNA, 18 nt, Human
cccugaggagaagccaug

SEQ ID NO: 572008 - RNA, 18 nt, Human
ccucccagugcuuggguc

SEQ ID NO: 572009 - RNA, 18 nt, Human
ccugaggucagggcuggg

SEQ ID NO: 572010 - RNA, 21 nt, Human
cgcugggaguuccuggaaauu

SEQ ID NO: 572011 - RNA, 19 nt, Human
cuagccaacagccccuccc

SEQ ID NO: 572012 - RNA, 21 nt, Human
cuagccaacagccccucccag

SEQ ID NO: 572013 - RNA, 23 nt, Human
cuauuggcuggcacggaccgugg

SEQ ID NO: 572014 - RNA, 23 nt, Human
cucccgaguucuucacgauugga

SEQ ID NO: 572015 - RNA, 19 nt, Human
cuggaagccuccugcaccc

SEQ ID NO: 572016 - RNA, 21 nt, Human
cugggcuggagggagacacug

SEQ ID NO: 572017 - RNA, 20 nt, Human
cuguaucccuaucaagguca

SEQ ID NO: 572018 - RNA, 22 nt, Human
cuucuggaagccuccugcaccc

SEQ ID NO: 572019 - RNA, 25 nt, Human
gacucuuguucagagcuacugggga

SEQ ID NO: 572020 - RNA, 18 nt, Human
gaggucagggcugggcug

SEQ ID NO: 572021 - RNA, 19 nt, Human
gcagagggagccuaguucu

SEQ ID NO: 572022 - RNA, 22 nt, Human
gcagcccacuccuccaguuccc

SEQ ID NO: 572023 - RNA, 22 nt, Human
gccacagcaucaucacugacca

SEQ ID NO: 572024 - RNA, 22 nt, Human
gcccacuccuccaguucccacc

SEQ ID NO: 572025 - RNA, 19 nt, Human
gcccgaggggcaggggggc

SEQ ID NO: 572026 - RNA, 21 nt, Human
gcggcugagacuccgugggac

SEQ ID NO: 572027 - RNA, 23 nt, Human
gcuuuuaggcuaaugggcucugc

SEQ ID NO: 572028 - RNA, 21 nt, Human
ggacucaacuaccaggugccu

SEQ ID NO: 572029 - RNA, 25 nt, Human
ggagaagccaugucacauccuugga

SEQ ID NO: 572030 - RNA, 19 nt, Human
ggagaagggagggggugcu

SEQ ID NO: 572031 - RNA, 20 nt, Human
ggagguuguggucuccuucu

SEQ ID NO: 572032 - RNA, 21 nt, Human
ggcagaaaaacgcaggugggg

SEQ ID NO: 572033 - RNA, 20 nt, Human
ggcagggauagagccaaggg

SEQ ID NO: 572034 - RNA, 20 nt, Human
ggcagggguugcccugagga

SEQ ID NO: 572035 - RNA, 18 nt, Human
ggcccggguggcgggggg

SEQ ID NO: 572036 - RNA, 21 nt, Human
ggccggggagacauuuaggcu

SEQ ID NO: 572037 - RNA, 20 nt, Human
ggcgccaggggcagcagaga

SEQ ID NO: 572038 - RNA, 22 nt, Human
gggcagggauagagccaagggg

SEQ ID NO: 572039 - RNA, 20 nt, Human
gggcuggaguccaggucuuc

SEQ ID NO: 572040 - RNA, 19 nt, Human
ggggaugaggguugggcag

SEQ ID NO: 572041 - RNA, 26 nt, Human
gguggcgggggcagccauuuuaagaa

SEQ ID NO: 572042 - RNA, 19 nt, Human
gguggggcuugcuccaccc

SEQ ID NO: 572043 - RNA, 18 nt, Human
gguguggggguggcagga

SEQ ID NO: 572044 - RNA, 18 nt, Human
gguuguggucuccuucug

SEQ ID NO: 572045 - RNA, 26 nt, Human
guggcagaaaaacgcagguggggcuu

SEQ ID NO: 572046 - RNA, 19 nt, Human
uaaaccagcuacaaguggc

SEQ ID NO: 572047 - RNA, 22 nt, Human
uaacucauaaaaugggcaacau

SEQ ID NO: 572048 - RNA, 19 nt, Human
uacaaguggcucuuguuuu

SEQ ID NO: 572049 - RNA, 23 nt, Human
uaccaggugccuuccacaggccu

SEQ ID NO: 572050 - RNA, 24 nt, Human
uacccucacccugucccucggccu

SEQ ID NO: 572051 - RNA, 20 nt, Human
uaggccccaggacuagaaag

SEQ ID NO: 572052 - RNA, 19 nt, Human
ucacauccuuggaucaaag

SEQ ID NO: 572053 - RNA, 22 nt, Human
uccaggucuucuaucuccuggg

SEQ ID NO: 572054 - RNA, 19 nt, Human
ucggaggcagcaccgaggg

SEQ ID NO: 572055 - RNA, 22 nt, Human
ucuagccaacagccccucccag

SEQ ID NO: 572056 - RNA, 20 nt, Human
ucuccaguggccacgguggg

SEQ ID NO: 572057 - RNA, 23 nt, Human
ucucccgaguucuucacgauugg

SEQ ID NO: 572058 - RNA, 18 nt, Human
ugaagugggagaggggca

SEQ ID NO: 572059 - RNA, 23 nt, Human
ugcagccaagguucuggaucuga

SEQ ID NO: 572060 - RNA, 22 nt, Human
ugcccaagggaggcccgggugg

SEQ ID NO: 572061 - RNA, 18 nt, Human
ugcuucuccagcucuucc

SEQ ID NO: 572062 - RNA, 24 nt, Human
ugcuuggguccuaauuacaacaac

SEQ ID NO: 572063 - RNA, 19 nt, Human
uggcacggaccguggcaga

SEQ ID NO: 572064 - RNA, 20 nt, Human
uggcagaaaaacgcaggugg

SEQ ID NO: 572065 - RNA, 24 nt, Human
uggccugaggucuccaguggccac

SEQ ID NO: 572066 - RNA, 23 nt, Human
uggcuggacucuuguucagagcu

SEQ ID NO: 572067 - RNA, 22 nt, Human
ugggcagggauagagccaaggg

SEQ ID NO: 572068 - RNA, 19 nt, Human
ugggcuggagggagacacu

SEQ ID NO: 572069 - RNA, 25 nt, Human
ugggcuggaguccaggucuucuauc

SEQ ID NO: 572070 - RNA, 21 nt, Human
uggggucaaggguaaauggcc

SEQ ID NO: 572071 - RNA, 22 nt, Human
uggucagggguaagucuuaggc

SEQ ID NO: 572072 - RNA, 26 nt, Human
uguccggaaggaggguaacgcgaggg

SEQ ID NO: 572073 - RNA, 20 nt, Human
ugugggcaggaagguggugg

SEQ ID NO: 572074 - RNA, 24 nt, Human
uguugugucagagaccccaagugc

SEQ ID NO: 572075 - RNA, 24 nt, Human
uuagcucuuccggcuacuuuggga

SEQ ID NO: 572076 - RNA, 25 nt, Human
uuccacaggccacagcaucaucacu

SEQ ID NO: 572077 - RNA, 21 nt, Human
uucuugguguggggguggcag

SEQ ID NO: 572078 - RNA, 24 nt, Human
uugcagcccacuccuccaguuccc

SEQ ID NO: 572079 - RNA, 18 nt, Human
uugugucagagaccccaa

SEQ ID NO: 572080 - RNA, 21 nt, Human
aaaggagcccuccccgccucc

SEQ ID NO: 572081 - RNA, 18 nt, Human
aaagggagguggaggcug

SEQ ID NO: 572082 - RNA, 20 nt, Human
aagcagagccaggcucugga

SEQ ID NO: 572083 - RNA, 23 nt, Human
accacucccucuccugucccccc

SEQ ID NO: 572084 - RNA, 24 nt, Human
acccauguguccccucucccaccc

SEQ ID NO: 572085 - RNA, 20 nt, Human
acgauaggcccuggggggcc

SEQ ID NO: 572086 - RNA, 18 nt, Human
agaagcacaggagagcac

SEQ ID NO: 572087 - RNA, 22 nt, Human
agaagcacaggagagcacguug

SEQ ID NO: 572088 - RNA, 20 nt, Human
agaggagguggcugcugggg

SEQ ID NO: 572089 - RNA, 21 nt, Human
agcaccuuucugaugggaucc

SEQ ID NO: 572090 - RNA, 24 nt, Human
agcacguuggggagcauguuuccu

SEQ ID NO: 572091 - RNA, 22 nt, Human
agccacagcacaaagcagagcc

SEQ ID NO: 572092 - RNA, 18 nt, Human
agccaggaaggccccagg

SEQ ID NO: 572093 - RNA, 21 nt, Human
agccaggaaggccccaggagc

SEQ ID NO: 572094 - RNA, 24 nt, Human
agccugguggggugaaggggaccc

SEQ ID NO: 572095 - RNA, 21 nt, Human
aggcucucccacgauaggccc

SEQ ID NO: 572096 - RNA, 18 nt, Human
aggggagggauggggugg

SEQ ID NO: 572097 - RNA, 21 nt, Human
agggggagacggacuggaggc

SEQ ID NO: 572098 - RNA, 25 nt, Human
agguggaggcuguugaguguccggg

SEQ ID NO: 572099 - RNA, 22 nt, Human
auauaaggcagccccaauucca

SEQ ID NO: 572100 - RNA, 18 nt, Human
auccugcccaggcucucc

SEQ ID NO: 572101 - RNA, 19 nt, Human
auccugcccaggcucuccc

SEQ ID NO: 572102 - RNA, 22 nt, Human
caaaacagaagcacaggagagc

SEQ ID NO: 572103 - RNA, 22 nt, Human
caaaugaaucacuuucugggcc

SEQ ID NO: 572104 - RNA, 24 nt, Human
caagauagguacauccauguguca

SEQ ID NO: 572105 - RNA, 18 nt, Human
cacagcacaaagcagagc

SEQ ID NO: 572106 - RNA, 20 nt, Human
cacagcacaaagcagagcca

SEQ ID NO: 572107 - RNA, 18 nt, Human
caccucacccuuggccac

SEQ ID NO: 572108 - RNA, 24 nt, Human
cacuuucugggccagagccaggaa

SEQ ID NO: 572109 - RNA, 25 nt, Human
caggagacugcugguucugguuuug

SEQ ID NO: 572110 - RNA, 23 nt, Human
caggcucucccacgauaggcccu

SEQ ID NO: 572111 - RNA, 19 nt, Human
cauuccagauaggaagacc

SEQ ID NO: 572112 - RNA, 19 nt, Human
ccacagcacaaagcagagc

SEQ ID NO: 572113 - RNA, 26 nt, Human
ccaccccauccucuuggcucccucua

SEQ ID NO: 572114 - RNA, 21 nt, Human
ccaggagcugugaggguagaa

SEQ ID NO: 572115 - RNA, 21 nt, Human
ccaggggugguuaugguucag

SEQ ID NO: 572116 - RNA, 23 nt, Human
cccacccaucaccaagauaggua

SEQ ID NO: 572117 - RNA, 24 nt, Human
cccaccccauccucuuggcucccu

SEQ ID NO: 572118 - RNA, 25 nt, Human
cccagagugcagaauugagcucugg

SEQ ID NO: 572119 - RNA, 19 nt, Human
cccagcagccccacccccu

SEQ ID NO: 572120 - RNA, 18 nt, Human
ccccacccaucaccaaga

SEQ ID NO: 572121 - RNA, 20 nt, Human
cccccacccaucaccaagau

SEQ ID NO: 572122 - RNA, 24 nt, Human
ccccuccagacaggagaaugaggu

SEQ ID NO: 572123 - RNA, 20 nt, Human
ccucaccacucccucuccug

SEQ ID NO: 572124 - RNA, 21 nt, Human
ccucacccuuggccacguccc

SEQ ID NO: 572125 - RNA, 20 nt, Human
ccuccagacaggagaaugag

SEQ ID NO: 572126 - RNA, 19 nt, Human
ccuccccgccuccuucccc

SEQ ID NO: 572127 - RNA, 23 nt, Human
ccuccccgccuccuuccccaggc

SEQ ID NO: 572128 - RNA, 26 nt, Human
ccuggcccccaccccauccucuuggc

SEQ ID NO: 572129 - RNA, 21 nt, Human
cuccuuccccaggccaggaag

SEQ ID NO: 572130 - RNA, 21 nt, Human
cugacgcuugaggcuucaccu

SEQ ID NO: 572131 - RNA, 22 nt, Human
cugacgcuugaggcuucaccuu

SEQ ID NO: 572132 - RNA, 24 nt, Human
cugggccagagccaggaaggcccc

SEQ ID NO: 572133 - RNA, 19 nt, Human
gacuggaggcucagggcac

SEQ ID NO: 572134 - RNA, 21 nt, Human
gagcugugaggguagaaaggg

SEQ ID NO: 572135 - RNA, 19 nt, Human
gaggcuguugaguguccgg

SEQ ID NO: 572136 - RNA, 18 nt, Human
gagguggaggcuguugag

SEQ ID NO: 572137 - RNA, 20 nt, Human
gcacaaagcagagccaggcu

SEQ ID NO: 572138 - RNA, 18 nt, Human
gcagaaagaaaaccauga

SEQ ID NO: 572139 - RNA, 22 nt, Human
gcagccccacccccucggagcc

SEQ ID NO: 572140 - RNA, 22 nt, Human
gcagggggacaaaacagaagca

SEQ ID NO: 572141 - RNA, 21 nt, Human
gccagagccaggaaggcccca

SEQ ID NO: 572142 - RNA, 24 nt, Human
gcccccaccccauccucuuggcuc

SEQ ID NO: 572143 - RNA, 20 nt, Human
gccugaggcugggaaugaug

SEQ ID NO: 572144 - RNA, 18 nt, Human
ggacuggaggcucagggc

SEQ ID NO: 572145 - RNA, 22 nt, Human
ggagagacaucccuggaaggag

SEQ ID NO: 572146 - RNA, 19 nt, Human
ggagcccuccccgccuccu

SEQ ID NO: 572147 - RNA, 22 nt, Human
ggagggaacaaggcaggagacu

SEQ ID NO: 572148 - RNA, 19 nt, Human
ggcacuggagguagaaagg

SEQ ID NO: 572149 - RNA, 19 nt, Human
ggccagacagauggguagg

SEQ ID NO: 572150 - RNA, 18 nt, Human
ggccugagggccagggag

SEQ ID NO: 572151 - RNA, 26 nt, Human
gggccagagccaggaaggccccagga

SEQ ID NO: 572152 - RNA, 19 nt, Human
ggggacccccggaaggggg

SEQ ID NO: 572153 - RNA, 19 nt, Human
gguaaacacacauauaagg

SEQ ID NO: 572154 - RNA, 19 nt, Human
gguagaaagggagguggag

SEQ ID NO: 572155 - RNA, 20 nt, Human
gguggaggcuguugaguguc

SEQ ID NO: 572156 - RNA, 20 nt, Human
guuggggagcauguuuccuc

SEQ ID NO: 572157 - RNA, 18 nt, Human
uaagccacagcacaaagc

SEQ ID NO: 572158 - RNA, 21 nt, Human
uagaaaggagcccuccccgcc

SEQ ID NO: 572159 - RNA, 23 nt, Human
ucaguggcaaccacuggggucug

SEQ ID NO: 572160 - RNA, 20 nt, Human
uccagacaggagaaugaggu

SEQ ID NO: 572161 - RNA, 25 nt, Human
ucccacgauaggcccuggggggccc

SEQ ID NO: 572162 - RNA, 21 nt, Human
ucccagcagccccacccccuc

SEQ ID NO: 572163 - RNA, 22 nt, Human
uccccgccuccuuccccaggcc

SEQ ID NO: 572164 - RNA, 21 nt, Human
uccccuccggcuaagccacag

SEQ ID NO: 572165 - RNA, 19 nt, Human
ucugaugggauccugccca

SEQ ID NO: 572166 - RNA, 22 nt, Human
ucugggccagagccaggaaggc

SEQ ID NO: 572167 - RNA, 18 nt, Human
ucuucaguggcaaccacu

SEQ ID NO: 572168 - RNA, 19 nt, Human
ugagggccagggagggaac

SEQ ID NO: 572169 - RNA, 22 nt, Human
ugaggguagaaagggaggugga

SEQ ID NO: 572170 - RNA, 19 nt, Human
ugauuggaucugguuugga

SEQ ID NO: 572171 - RNA, 22 nt, Human
uggaaggagggccugagggcca

SEQ ID NO: 572172 - RNA, 19 nt, Human
uggacacccaugugucccc

SEQ ID NO: 572173 - RNA, 19 nt, Human
uggagguagaaaggagccc

SEQ ID NO: 572174 - RNA, 19 nt, Human
uggcuggucacuuuggcau

SEQ ID NO: 572175 - RNA, 21 nt, Human
ugggguggcuggucacuuugg

SEQ ID NO: 572176 - RNA, 22 nt, Human
ugguucaggaccuggcugcagg

SEQ ID NO: 572177 - RNA, 26 nt, Human
uguguccccucucccacccuguccaa

SEQ ID NO: 572178 - RNA, 26 nt, Human
uuccccaggccaggaagggguaaaca

SEQ ID NO: 572179 - RNA, 20 nt, Human
uucuuggcccccacccaucu

SEQ ID NO: 572180 - RNA, 20 nt, Human
uuucccaggggugguuaugg

SEQ ID NO: 572181 - RNA, 22 nt, Human
uuuggagcucagcaccucccac

SEQ ID NO: 572182 - RNA, 21 nt, Human
aaaagaagaugagcuggagaa

SEQ ID NO: 572183 - RNA, 18 nt, Human
aaaagacucugaagggaa

SEQ ID NO: 572184 - RNA, 24 nt, Human
aaaagcugcaauauuccagauucu

SEQ ID NO: 572185 - RNA, 23 nt, Human
aaagacucugaagggaaccagga

SEQ ID NO: 572186 - RNA, 23 nt, Human
aagcagcccucugauggaccccc

SEQ ID NO: 572187 - RNA, 20 nt, Human
aaguccuccagagccuucuc

SEQ ID NO: 572188 - RNA, 26 nt, Human
acaaagacaacagaagcuaacccgag

SEQ ID NO: 572189 - RNA, 19 nt, Human
accagugucuuuacuggac

SEQ ID NO: 572190 - RNA, 21 nt, Human
acccggggaccccugcccagc

SEQ ID NO: 572191 - RNA, 20 nt, Human
acuagggaagggaagcagag

SEQ ID NO: 572192 - RNA, 20 nt, Human
acuagggaagggaagcagag

SEQ ID NO: 572193 - RNA, 24 nt, Human
agaggaaaaauguccauggcacag

SEQ ID NO: 572194 - RNA, 21 nt, Human
agagucaucaucaggccaaaa

SEQ ID NO: 572195 - RNA, 19 nt, Human
agcccucugauggacccag

SEQ ID NO: 572196 - RNA, 19 nt, Human
aggaaaaauguccauggca

SEQ ID NO: 572197 - RNA, 20 nt, Human
aggaggcgucucagagcucc

SEQ ID NO: 572198 - RNA, 22 nt, Human
agggaagggaagcagaggagga

SEQ ID NO: 572199 - RNA, 21 nt, Human
aucaggccaaaaagacucuga

SEQ ID NO: 572200 - RNA, 22 nt, Human
caaacaccagcagccagauacc

SEQ ID NO: 572201 - RNA, 18 nt, Human
cacccggggaccccugcc

SEQ ID NO: 572202 - RNA, 20 nt, Human
cacgcucucccccguccaag

SEQ ID NO: 572203 - RNA, 18 nt, Human
cacugcaccaggcccagc

SEQ ID NO: 572204 - RNA, 25 nt, Human
cacugcaccaggcccagcaugccuc

SEQ ID NO: 572205 - RNA, 22 nt, Human
cagcacuaggggccacgucaga

SEQ ID NO: 572206 - RNA, 22 nt, Human
cagcagccagauaccaccaagc

SEQ ID NO: 572207 - RNA, 22 nt, Human
ccagagaacacgucaacgucag

SEQ ID NO: 572208 - RNA, 24 nt, Human
ccagauaccaccaagcuagucacc

SEQ ID NO: 572209 - RNA, 18 nt, Human
ccagauucuuaaauucuc

SEQ ID NO: 572210 - RNA, 18 nt, Human
ccggaggaaagacuaggg

SEQ ID NO: 572211 - RNA, 19 nt, Human
ccggucugcccugcugggg

SEQ ID NO: 572212 - RNA, 25 nt, Human
ccguacgccuucagcacacgcgugg

SEQ ID NO: 572213 - RNA, 19 nt, Human
cgaaaccguaccaugcccc

SEQ ID NO: 572214 - RNA, 24 nt, Human
cgaaaccguaccaugccccgcuaa

SEQ ID NO: 572215 - RNA, 21 nt, Human
cgcucucccccguccaaggug

SEQ ID NO: 572216 - RNA, 20 nt, Human
cgucaaauuaguagugacaa

SEQ ID NO: 572217 - RNA, 19 nt, Human
cuccccacccacacacuca

SEQ ID NO: 572218 - RNA, 20 nt, Human
cuccccacccacacacucaa

SEQ ID NO: 572219 - RNA, 18 nt, Human
cuuccuaagcauacguga

SEQ ID NO: 572220 - RNA, 27 nt, Human
gaaaccguaccaugccccgcuaagaca

SEQ ID NO: 572221 - RNA, 20 nt, Human
gacaacagaagcuaacccga

SEQ ID NO: 572222 - RNA, 18 nt, Human
gaccccugcccagcuccc

SEQ ID NO: 572223 - RNA, 23 nt, Human
gagaaacucuguugagcugcuaa

SEQ ID NO: 572224 - RNA, 18 nt, Human
gagcaggccgagaaacuc

SEQ ID NO: 572225 - RNA, 20 nt, Human
gagcaggccgagaaacucug

SEQ ID NO: 572226 - RNA, 25 nt, Human
gccaaacaccagcagccagauacca

SEQ ID NO: 572227 - RNA, 20 nt, Human
gcccuugcuguggaaagaug

SEQ ID NO: 572228 - RNA, 26 nt, Human
gcgugggacaggaggcguccugaggg

SEQ ID NO: 572229 - RNA, 22 nt, Human
gcuguggaaagaugcuacugaa

SEQ ID NO: 572230 - RNA, 21 nt, Human
ggaaaaccauccacaaagaca

SEQ ID NO: 572231 - RNA, 22 nt, Human
ggaagcagaggaggaacgaagg

SEQ ID NO: 572232 - RNA, 20 nt, Human
ggaagggaagcagaggagga

SEQ ID NO: 572233 - RNA, 19 nt, Human
ggaccccugcccagcuccc

SEQ ID NO: 572234 - RNA, 21 nt, Human
ggagagcgugggacaggaggc

SEQ ID NO: 572235 - RNA, 19 nt, Human
ggccgguggguaucauggg

SEQ ID NO: 572236 - RNA, 24 nt, Human
gggaagcagaggaggaacgaaggg

SEQ ID NO: 572237 - RNA, 24 nt, Human
gggacaggaggcgucucagagcuc

SEQ ID NO: 572238 - RNA, 20 nt, Human
gucagaccccaggcugcagc

SEQ ID NO: 572239 - RNA, 21 nt, Human
gucaggccgcuccaggaaaac

SEQ ID NO: 572240 - RNA, 22 nt, Human
gucugcaucacaggguaucacc

SEQ ID NO: 572241 - RNA, 18 nt, Human
uaagcauacgugaccacg

SEQ ID NO: 572242 - RNA, 18 nt, Human
uaagccaaacaccagcag

SEQ ID NO: 572243 - RNA, 23 nt, Human
uaccaccaagcuagucaccacuu

SEQ ID NO: 572244 - RNA, 19 nt, Human
ucaggcacgaaaccguacc

SEQ ID NO: 572245 - RNA, 18 nt, Human
ucaggccaaaaagacucu

SEQ ID NO: 572246 - RNA, 20 nt, Human
ucaucaggccaaaaagacuc

SEQ ID NO: 572247 - RNA, 22 nt, Human
uccccagaggaaaaauguccau

SEQ ID NO: 572248 - RNA, 21 nt, Human
uccccgguccggucugcccug

SEQ ID NO: 572249 - RNA, 18 nt, Human
ucccuaaggacacggcug

SEQ ID NO: 572250 - RNA, 22 nt, Human
ucgccauaacaucuccaaccau

SEQ ID NO: 572251 - RNA, 24 nt, Human
ucgccauaacaucuccaaccaugc

SEQ ID NO: 572252 - RNA, 22 nt, Human
ucgccgaucugggagcaggccg

SEQ ID NO: 572253 - RNA, 20 nt, Human
ugauggacccagucagugca

SEQ ID NO: 572254 - RNA, 22 nt, Human
ugauuuucuucauuuccgucuu

SEQ ID NO: 572255 - RNA, 19 nt, Human
uggaaagaugcuacugaaa

SEQ ID NO: 572256 - RNA, 22 nt, Human
uggaaagaugcuacugaaagua

SEQ ID NO: 572257 - RNA, 23 nt, Human
uggacgcgaacaucccuaaggac

SEQ ID NO: 572258 - RNA, 23 nt, Human
uggagaacgaagcagcccucuga

SEQ ID NO: 572259 - RNA, 24 nt, Human
uggcaaccaauuuaugcucaaguu

SEQ ID NO: 572260 - RNA, 22 nt, Human
ugggaccagagaacacgucaac

SEQ ID NO: 572261 - RNA, 23 nt, Human
ugggagcaggccgagaaacucug

SEQ ID NO: 572262 - RNA, 23 nt, Human
uggggcaugucugcaucacaggg

SEQ ID NO: 572263 - RNA, 21 nt, Human
uucacauguaggcagugaagc

SEQ ID NO: 572264 - RNA, 26 nt, Human
aacagcacaagacaacaucagcaaac

SEQ ID NO: 572265 - RNA, 22 nt, Human
aacuccgaaagagaaggcacag

SEQ ID NO: 572266 - RNA, 23 nt, Human
aagcaaaauaugaacuuauagga

SEQ ID NO: 572267 - RNA, 20 nt, Human
aagcgauguacuuaagggcc

SEQ ID NO: 572268 - RNA, 24 nt, Human
aagggccucaggcggucgagaggc

SEQ ID NO: 572269 - RNA, 20 nt, Human
acaaagagagacccagcggc

SEQ ID NO: 572270 - RNA, 21 nt, Human
acaaguccacaaagagagacc

SEQ ID NO: 572271 - RNA, 20 nt, Human
acacaggcccagaggccgaa

SEQ ID NO: 572272 - RNA, 27 nt, Human
acagcacaagacaacaucagcaaacca

SEQ ID NO: 572273 - RNA, 23 nt, Human
agacaacaucagcaaacccuggc

SEQ ID NO: 572274 - RNA, 19 nt, Human
agaggcaacguggcuucca

SEQ ID NO: 572275 - RNA, 22 nt, Human
agcaaacccuggcgcaccuaac

SEQ ID NO: 572276 - RNA, 24 nt, Human
agcacggaacaacuccgaaagaga

SEQ ID NO: 572277 - RNA, 23 nt, Human
aggaagagagagacucguggcaa

SEQ ID NO: 572278 - RNA, 22 nt, Human
auucucuauccuuccccucacc

SEQ ID NO: 572279 - RNA, 25 nt, Human
caaagagagacccagcggcccagca

SEQ ID NO: 572280 - RNA, 23 nt, Human
caagacaacaucagcaaacccug

SEQ ID NO: 572281 - RNA, 23 nt, Human
cacagacacacaggcccagaggc

SEQ ID NO: 572282 - RNA, 25 nt, Human
cacagacacacaggcccagaggccu

SEQ ID NO: 572283 - RNA, 21 nt, Human
caccccugcgagcaaaguggc

SEQ ID NO: 572284 - RNA, 21 nt, Human
cagacacacaggcccagaggc

SEQ ID NO: 572285 - RNA, 27 nt, Human
cagcacaagacaacaucagcaaacccu

SEQ ID NO: 572286 - RNA, 21 nt, Human
cagccuccugggcaccaccag

SEQ ID NO: 572287 - RNA, 23 nt, Human
caggcggucgagaggcaacgugg

SEQ ID NO: 572288 - RNA, 24 nt, Human
ccagccaguggagaaggggaagca

SEQ ID NO: 572289 - RNA, 21 nt, Human
ccaugaucaaacacagaugcc

SEQ ID NO: 572290 - RNA, 20 nt, Human
ccccgagcccgggggauccc

SEQ ID NO: 572291 - RNA, 21 nt, Human
ccccucaccccugcgagcaaa

SEQ ID NO: 572292 - RNA, 22 nt, Human
cgagcaaaguggccuuucccaa

SEQ ID NO: 572293 - RNA, 20 nt, Human
cgauguacuuaagggccucc

SEQ ID NO: 572294 - RNA, 26 nt, Human
cuccugcuccagguacaagacaucgg

SEQ ID NO: 572295 - RNA, 18 nt, Human
cuccugggcaccaccaga

SEQ ID NO: 572296 - RNA, 24 nt, Human
cuuaagggccucaggcggucgaga

SEQ ID NO: 572297 - RNA, 24 nt, Human
gagcucacagacacacaggcccag

SEQ ID NO: 572298 - RNA, 18 nt, Human
gaggacgcagauguggca

SEQ ID NO: 572299 - RNA, 18 nt, Human
gccucucguugcuuuuaa

SEQ ID NO: 572300 - RNA, 18 nt, Human
gccugguguccgggucac

SEQ ID NO: 572301 - RNA, 21 nt, Human
gcguaugccugguguccgggu

SEQ ID NO: 572302 - RNA, 20 nt, Human
ggaagcacgugggagcacgg

SEQ ID NO: 572303 - RNA, 23 nt, Human
ggaucaggcuuuucugggacagu

SEQ ID NO: 572304 - RNA, 24 nt, Human
ggucgagaggcaacguggcuucca

SEQ ID NO: 572305 - RNA, 19 nt, Human
ggucugcuggagccaagag

SEQ ID NO: 572306 - RNA, 18 nt, Human
guaugccugguguccggg

SEQ ID NO: 572307 - RNA, 19 nt, Human
uaaaaagcuggcucaaagc

SEQ ID NO: 572308 - RNA, 24 nt, Human
uaaaaauagauucucuauccuucc

SEQ ID NO: 572309 - RNA, 23 nt, Human
uagccagguugagcucacagaca

SEQ ID NO: 572310 - RNA, 21 nt, Human
ucaaacacagaugcccgaguu

SEQ ID NO: 572311 - RNA, 18 nt, Human
ucaaagcaaaauaugaac

SEQ ID NO: 572312 - RNA, 21 nt, Human
ucacagacacacaggcccaga

SEQ ID NO: 572313 - RNA, 22 nt, Human
uccagguacaaguccacaaaga

SEQ ID NO: 572314 - RNA, 21 nt, Human
uccgcggcacgcgucccucuc

SEQ ID NO: 572315 - RNA, 19 nt, Human
ucgcggccagcuuccaggu

SEQ ID NO: 572316 - RNA, 24 nt, Human
ucguugcuuuuaacaguccagcca

SEQ ID NO: 572317 - RNA, 24 nt, Human
ugagcucacagacacacaggccca

SEQ ID NO: 572318 - RNA, 22 nt, Human
ugcuuuuaacaguccagccaga

SEQ ID NO: 572319 - RNA, 24 nt, Human
ugggacagugggucugcuggagcc

SEQ ID NO: 572320 - RNA, 19 nt, Human
ugggagugacucugccuuu

SEQ ID NO: 572321 - RNA, 21 nt, Human
ugggcaggaagagagagacuc

SEQ ID NO: 572322 - RNA, 20 nt, Human
uuuaacaguccagccagaga

SEQ ID NO: 572323 - RNA, 20 nt, Human
aaaccagguuugcagcgaag

SEQ ID NO: 572324 - RNA, 18 nt, Human
aaacggcaggccugguaa

SEQ ID NO: 572325 - RNA, 19 nt, Human
aaacuugcaagggcuaaua

SEQ ID NO: 572326 - RNA, 20 nt, Human
aaagauggugacaguuuggu

SEQ ID NO: 572327 - RNA, 24 nt, Human
aaagugcugggauuacaggcguga

SEQ ID NO: 572328 - RNA, 21 nt, Human
aagaauauggcagggccaccc

SEQ ID NO: 572329 - RNA, 20 nt, Human
aagagaaggugaguagagaa

SEQ ID NO: 572330 - RNA, 21 nt, Human
aagaggaaggcgggaggaaga

SEQ ID NO: 572331 - RNA, 24 nt, Human
aagcaauucauccgccucagccuc

SEQ ID NO: 572332 - RNA, 19 nt, Human
aagugcugggauuacaggc

SEQ ID NO: 572333 - RNA, 19 nt, Human
aagugcugggauuacaggc

SEQ ID NO: 572334 - RNA, 26 nt, Human
aagugcugggauuacaggcgugagcc

SEQ ID NO: 572335 - RNA, 18 nt, Human
acaaaaacaaguuaaccu

SEQ ID NO: 572336 - RNA, 21 nt, Human
acacacacacacaaugacaca

SEQ ID NO: 572337 - RNA, 25 nt, Human
acacacacacacacacacaaugaca

SEQ ID NO: 572338 - RNA, 23 nt, Human
acacacacacacacacacacaca

SEQ ID NO: 572339 - RNA, 23 nt, Human
acacacacacacacacacacaca

SEQ ID NO: 572340 - RNA, 29 nt, Human
acacacacacacacacacacacaaugaca

SEQ ID NO: 572341 - RNA, 24 nt, Human
acacacacacacacacacacacag

SEQ ID NO: 572342 - RNA, 22 nt, Human
acacagcuguguagcugcaaac

SEQ ID NO: 572343 - RNA, 18 nt, Human
acaguuuggugcaaagau

SEQ ID NO: 572344 - RNA, 29 nt, Human
acaugcgcacgcaaacacacacacacaca

SEQ ID NO: 572345 - RNA, 23 nt, Human
accauguuggucaagcuggucuu

SEQ ID NO: 572346 - RNA, 21 nt, Human
acccaccucaggauccuccaa

SEQ ID NO: 572347 - RNA, 21 nt, Human
acccagcucuuccaaaugcca

SEQ ID NO: 572348 - RNA, 18 nt, Human
accuucugcugcaaagau

SEQ ID NO: 572349 - RNA, 19 nt, Human
acgaagcccuaauggaccc

SEQ ID NO: 572350 - RNA, 26 nt, Human
acuacuguucaccauguuaauacauu

SEQ ID NO: 572351 - RNA, 27 nt, Human
acucugcugcccaggcuggagugccgu

SEQ ID NO: 572352 - RNA, 22 nt, Human
agaauuuucccaauccucuuac

SEQ ID NO: 572353 - RNA, 21 nt, Human
agcaauucauccgccucagcc

SEQ ID NO: 572354 - RNA, 24 nt, Human
agcuggucuuaaacgccugaccuc

SEQ ID NO: 572355 - RNA, 22 nt, Human
agcugugcuguuggaauugaug

SEQ ID NO: 572356 - RNA, 19 nt, Human
aggaagaauauggcagggc

SEQ ID NO: 572357 - RNA, 23 nt, Human
aggcgugagccaccgugcccggc

SEQ ID NO: 572358 - RNA, 18 nt, Human
aguagcugggauuacagg

SEQ ID NO: 572359 - RNA, 23 nt, Human
aguagcugggauuacaggcgcgc

SEQ ID NO: 572360 - RNA, 24 nt, Human
agugccguggcacaaucuuggcuc

SEQ ID NO: 572361 - RNA, 18 nt, Human
agugcugggauuacaggc

SEQ ID NO: 572362 - RNA, 19 nt, Human
auagagauccaccucccuu

SEQ ID NO: 572363 - RNA, 21 nt, Human
aucaacaggggcccuaagaga

SEQ ID NO: 572364 - RNA, 21 nt, Human
aucacaaaaacugaagucgga

SEQ ID NO: 572365 - RNA, 25 nt, Human
augcgcacgcaaacacacacacaca

SEQ ID NO: 572366 - RNA, 27 nt, Human
augcgcacgcaaacacacacacacaca

SEQ ID NO: 572367 - RNA, 21 nt, Human
augggguuucaccauguuggu

SEQ ID NO: 572368 - RNA, 25 nt, Human
augggguuucaccauguuggucaag

SEQ ID NO: 572369 - RNA, 24 nt, Human
auggugacaguuuggugcaaagau

SEQ ID NO: 572370 - RNA, 21 nt, Human
auuccgaggagggagcaaggc

SEQ ID NO: 572371 - RNA, 24 nt, Human
caaagugcugggauuacaggcgug

SEQ ID NO: 572372 - RNA, 22 nt, Human
caaguuaaccuaugaacacaag

SEQ ID NO: 572373 - RNA, 23 nt, Human
cacaaaaacugaagucggaaaag

SEQ ID NO: 572374 - RNA, 19 nt, Human
cacacaaugacacauggug

SEQ ID NO: 572375 - RNA, 24 nt, Human
cacacacacacaaugacacauggu

SEQ ID NO: 572376 - RNA, 20 nt, Human
cacacacacacacacacaca

SEQ ID NO: 572377 - RNA, 20 nt, Human
cacacacacacacacacaca

SEQ ID NO: 572378 - RNA, 20 nt, Human
cacacacacacacacacaca

SEQ ID NO: 572379 - RNA, 20 nt, Human
cacacacacacacacacaca

SEQ ID NO: 572380 - RNA, 22 nt, Human
cacacacacacacacacacaca

SEQ ID NO: 572381 - RNA, 26 nt, Human
cacacacacacacacacacacacaau

SEQ ID NO: 572382 - RNA, 24 nt, Human
caccacgcccagcuaauuuuugua

SEQ ID NO: 572383 - RNA, 24 nt, Human
caccauguuggucaagcuggucuu

SEQ ID NO: 572384 - RNA, 24 nt, Human
cacccaagaccucaccuaucguuu

SEQ ID NO: 572385 - RNA, 19 nt, Human
caccugaacagucacggca

SEQ ID NO: 572386 - RNA, 20 nt, Human
cacgagaaauuuguuuuaaa

SEQ ID NO: 572387 - RNA, 24 nt, Human
cacgagaaauuuguuuuaaaguug

SEQ ID NO: 572388 - RNA, 18 nt, Human
cacgcaaacacacacaca

SEQ ID NO: 572389 - RNA, 24 nt, Human
cacucugcugcccaggcuggagug

SEQ ID NO: 572390 - RNA, 20 nt, Human
cagacucuaaaacucaaaga

SEQ ID NO: 572391 - RNA, 20 nt, Human
cagccuccugaguagcuggg

SEQ ID NO: 572392 - RNA, 20 nt, Human
caggauccuccaaguuagcc

SEQ ID NO: 572393 - RNA, 22 nt, Human
cagucacggcagaacaagagca

SEQ ID NO: 572394 - RNA, 19 nt, Human
caucacccaccucaggauc

SEQ ID NO: 572395 - RNA, 21 nt, Human
cauugcaaccucugccuccug

SEQ ID NO: 572396 - RNA, 20 nt, Human
ccaaagugcugggauuacag

SEQ ID NO: 572397 - RNA, 22 nt, Human
ccaaagugcugggauuacaggc

SEQ ID NO: 572398 - RNA, 22 nt, Human
ccaaagugcugggauuacaggc

SEQ ID NO: 572399 - RNA, 24 nt, Human
ccaaagugcugggauuacaggcgu

SEQ ID NO: 572400 - RNA, 20 nt, Human
ccaccacgcccagcuaauuu

SEQ ID NO: 572401 - RNA, 26 nt, Human
ccacccaagaccucaccuaucguuua

SEQ ID NO: 572402 - RNA, 21 nt, Human
ccaccucccuuccccaacucc

SEQ ID NO: 572403 - RNA, 22 nt, Human
cccaacucccucccacccaaga

SEQ ID NO: 572404 - RNA, 21 nt, Human
cccucccacccaagaccucac

SEQ ID NO: 572405 - RNA, 23 nt, Human
ccgccucagccuccugaguagcu

SEQ ID NO: 572406 - RNA, 22 nt, Human
ccgugcccggccaacagccaag

SEQ ID NO: 572407 - RNA, 23 nt, Human
ccugaguagcugggauuacaggc

SEQ ID NO: 572408 - RNA, 24 nt, Human
ccugaguagcugggauuacaggcg

SEQ ID NO: 572409 - RNA, 21 nt, Human
ccugccuggaguucuucuucu

SEQ ID NO: 572410 - RNA, 22 nt, Human
ccuggaguucuucuucugcuuc

SEQ ID NO: 572411 - RNA, 22 nt, Human
ccuggauucaagcaauucaucc

SEQ ID NO: 572412 - RNA, 24 nt, Human
cgccucagccuccugaguagcugg

SEQ ID NO: 572413 - RNA, 24 nt, Human
cgccugaccucgugaucgaccugc

SEQ ID NO: 572414 - RNA, 21 nt, Human
cgcgcgccaccacgcccagcu

SEQ ID NO: 572415 - RNA, 19 nt, Human
cguggcacaaucuuggcuc

SEQ ID NO: 572416 - RNA, 23 nt, Human
cucagccuccugaguagcuggga

SEQ ID NO: 572417 - RNA, 24 nt, Human
cucauugcaaccucugccuccugg

SEQ ID NO: 572418 - RNA, 22 nt, Human
cugaguagcugggauuacaggc

SEQ ID NO: 572419 - RNA, 22 nt, Human
cugcaaacggaaaccacucucu

SEQ ID NO: 572420 - RNA, 23 nt, Human
cugccucagccucccaaagugcu

SEQ ID NO: 572421 - RNA, 24 nt, Human
cugccucagccucccaaagugcug

SEQ ID NO: 572422 - RNA, 29 nt, Human
cuuagcuccagcccugcgaaccgguuccg

SEQ ID NO: 572423 - RNA, 22 nt, Human
cuuccccaacucccucccaccc

SEQ ID NO: 572424 - RNA, 20 nt, Human
cuuucagcaucacccaccuc

SEQ ID NO: 572425 - RNA, 18 nt, Human
gaacaucuaacaacuguu

SEQ ID NO: 572426 - RNA, 22 nt, Human
gacccugcucucuccucuacac

SEQ ID NO: 572427 - RNA, 22 nt, Human
gaccucgugaucgaccugccuc

SEQ ID NO: 572428 - RNA, 24 nt, Human
gaccucgugaucgaccugccucag

SEQ ID NO: 572429 - RNA, 20 nt, Human
gagacuuagcuccagcccug

SEQ ID NO: 572430 - RNA, 18 nt, Human
gagagagucucacucugc

SEQ ID NO: 572431 - RNA, 24 nt, Human
gagaugggguuucaccauguuggu

SEQ ID NO: 572432 - RNA, 19 nt, Human
gauccaccucccuucccca

SEQ ID NO: 572433 - RNA, 18 nt, Human
gauuacaggcgcgcgcca

SEQ ID NO: 572434 - RNA, 18 nt, Human
gauuacaggcgugagcca

SEQ ID NO: 572435 - RNA, 21 nt, Human
gauuacaggcgugagccaccg

SEQ ID NO: 572436 - RNA, 24 nt, Human
gauuacaggcgugagccaccgugc

SEQ ID NO: 572437 - RNA, 21 nt, Human
gcaaagauggugacaguuggg

SEQ ID NO: 572438 - RNA, 24 nt, Human
gcaauucauccgccucagccuccu

SEQ ID NO: 572439 - RNA, 25 nt, Human
gcacgcaaacacacacacacacaca

SEQ ID NO: 572440 - RNA, 23 nt, Human
gcagacauucuuuuucccuaaaa

SEQ ID NO: 572441 - RNA, 21 nt, Human
gccguggcacaaucuuggcuc

SEQ ID NO: 572442 - RNA, 24 nt, Human
gcgcacgcaaacacacacacacac

SEQ ID NO: 572443 - RNA, 29 nt, Human
gcgcacgcaaacacacacacacacacaca

SEQ ID NO: 572444 - RNA, 18 nt, Human
gcgcgccaccacgcccag

SEQ ID NO: 572445 - RNA, 18 nt, Human
gcggugaaacggcaggcc

SEQ ID NO: 572446 - RNA, 21 nt, Human
gcucauugcaaccucugccuc

SEQ ID NO: 572447 - RNA, 18 nt, Human
gcuucuuucuccuggagc

SEQ ID NO: 572448 - RNA, 18 nt, Human
gcuuucagcaucacccac

SEQ ID NO: 572449 - RNA, 21 nt, Human
gcuuucagcaucacccaccuc

SEQ ID NO: 572450 - RNA, 18 nt, Human
ggaggauggaagcuggag

SEQ ID NO: 572451 - RNA, 20 nt, Human
ggagggagcaaggcgugggg

SEQ ID NO: 572452 - RNA, 24 nt, Human
ggauucaagcaauucauccgccuc

SEQ ID NO: 572453 - RNA, 18 nt, Human
ggccugcagaggucgcug

SEQ ID NO: 572454 - RNA, 22 nt, Human
gggguuucaccauguuggucaa

SEQ ID NO: 572455 - RNA, 19 nt, Human
guagagaugggguuucacc

SEQ ID NO: 572456 - RNA, 21 nt, Human
guagagaugggguuucaccau

SEQ ID NO: 572457 - RNA, 22 nt, Human
guagagaugggguuucaccaug

SEQ ID NO: 572458 - RNA, 18 nt, Human
guagcugggauuacaggc

SEQ ID NO: 572459 - RNA, 24 nt, Human
guagugaccuucugcugcaaagau

SEQ ID NO: 572460 - RNA, 24 nt, Human
gugaucgaccugccucagccuccc

SEQ ID NO: 572461 - RNA, 18 nt, Human
guuuuaaaguugaaucac

SEQ ID NO: 572462 - RNA, 18 nt, Human
uaaaaccagguuugcagc

SEQ ID NO: 572463 - RNA, 24 nt, Human
uacaggcgcgcgccaccacgccca

SEQ ID NO: 572464 - RNA, 23 nt, Human
uacaggcgugagccaccgugccc

SEQ ID NO: 572465 - RNA, 19 nt, Human
uagaauuuucccaauccuc

SEQ ID NO: 572466 - RNA, 22 nt, Human
uagagaugggguuucaccaugu

SEQ ID NO: 572467 - RNA, 24 nt, Human
uauaaucaccccccuuccccacag

SEQ ID NO: 572468 - RNA, 22 nt, Human
uaucugaguagucacuuuucag

SEQ ID NO: 572469 - RNA, 22 nt, Human
ucaccccccuuccccacaggau

SEQ ID NO: 572470 - RNA, 24 nt, Human
ucacucugcugcccaggcuggagu

SEQ ID NO: 572471 - RNA, 26 nt, Human
ucagcaucacccaccucaggauccuc

SEQ ID NO: 572472 - RNA, 20 nt, Human
ucagccuccugaguagcugg

SEQ ID NO: 572473 - RNA, 19 nt, Human
ucauugcaaccucugccuc

SEQ ID NO: 572474 - RNA, 23 nt, Human
ucauugcaaccucugccuccugg

SEQ ID NO: 572475 - RNA, 26 nt, Human
uccaaagucuuauucagugacaagga

SEQ ID NO: 572476 - RNA, 20 nt, Human
uccaccucccuuccccaacu

SEQ ID NO: 572477 - RNA, 21 nt, Human
uccaccucccuuccccaacuc

SEQ ID NO: 572478 - RNA, 24 nt, Human
ucccaaagugcugggauuacaggc

SEQ ID NO: 572479 - RNA, 19 nt, Human
ucccuauaaucaccccccu

SEQ ID NO: 572480 - RNA, 19 nt, Human
uccuccaaguuagcugugc

SEQ ID NO: 572481 - RNA, 24 nt, Human
uccugaguagcugggauuacaggc

SEQ ID NO: 572482 - RNA, 19 nt, Human
uccuggauucaagcaauuc

SEQ ID NO: 572483 - RNA, 19 nt, Human
ucgaccugccucagccucc

SEQ ID NO: 572484 - RNA, 24 nt, Human
ucgcugaccauuccgaggagggag

SEQ ID NO: 572485 - RNA, 21 nt, Human
ucgcuuggcacacaccccagg

SEQ ID NO: 572486 - RNA, 23 nt, Human
ucucacucugcugcccaggcugg

SEQ ID NO: 572487 - RNA, 24 nt, Human
ucucacucugcugcccaggcugga

SEQ ID NO: 572488 - RNA, 24 nt, Human
ucugccuccuggauucaagcaauu

SEQ ID NO: 572489 - RNA, 19 nt, Human
ucuuaccaacucuccugcc

SEQ ID NO: 572490 - RNA, 19 nt, Human
ucuuauucagugacaagag

SEQ ID NO: 572491 - RNA, 21 nt, Human
ucuucuucugcuucuuucucc

SEQ ID NO: 572492 - RNA, 18 nt, Human
ugaaacggcaggccuggu

SEQ ID NO: 572493 - RNA, 21 nt, Human
ugaaggagcaauaaaaccagg

SEQ ID NO: 572494 - RNA, 20 nt, Human
ugacuugguacgucuuccuu

SEQ ID NO: 572495 - RNA, 18 nt, Human
ugagaaaaauagauuugg

SEQ ID NO: 572496 - RNA, 19 nt, Human
ugagaaaaauagauuugga

SEQ ID NO: 572497 - RNA, 23 nt, Human
ugagaacaucuaacaacuguuca

SEQ ID NO: 572498 - RNA, 19 nt, Human
ugcaaacggaaaccacucu

SEQ ID NO: 572499 - RNA, 23 nt, Human
ugccagggccugcagaggucgcu

SEQ ID NO: 572500 - RNA, 21 nt, Human
ugcccaggcuggagugccgug

SEQ ID NO: 572501 - RNA, 24 nt, Human
ugcccaggcuggagugccguggca

SEQ ID NO: 572502 - RNA, 21 nt, Human
ugcccggccaacagccaaguu

SEQ ID NO: 572503 - RNA, 24 nt, Human
ugccucagccucccaaagugcugg

SEQ ID NO: 572504 - RNA, 24 nt, Human
ugcugggauuacaggcgugagcca

SEQ ID NO: 572505 - RNA, 20 nt, Human
uggaggauggaagcuggaga

SEQ ID NO: 572506 - RNA, 24 nt, Human
uggagugccguggcacaaucuugg

SEQ ID NO: 572507 - RNA, 20 nt, Human
uggauggaauuagagcuggg

SEQ ID NO: 572508 - RNA, 21 nt, Human
uggauucaagcaauucauccg

SEQ ID NO: 572509 - RNA, 18 nt, Human
uggcacaaucuuggcuca

SEQ ID NO: 572510 - RNA, 22 nt, Human
ugggauuacaggcgcgcgccac

SEQ ID NO: 572511 - RNA, 24 nt, Human
ugggauuacaggcgcgcgccacca

SEQ ID NO: 572512 - RNA, 18 nt, Human
ugggauuacaggcgugag

SEQ ID NO: 572513 - RNA, 21 nt, Human
ugggauuacaggcgugagcca

SEQ ID NO: 572514 - RNA, 22 nt, Human
ugggauuacaggcgugagccac

SEQ ID NO: 572515 - RNA, 23 nt, Human
ugggauuacaggcgugagccacc

SEQ ID NO: 572516 - RNA, 23 nt, Human
ugggauuacaggcgugagccacc

SEQ ID NO: 572517 - RNA, 24 nt, Human
ugggauuacaggcgugagccaccg

SEQ ID NO: 572518 - RNA, 24 nt, Human
ugggguuucaccauguuggucaag

SEQ ID NO: 572519 - RNA, 24 nt, Human
uggugcaaagauggugacaguugg

SEQ ID NO: 572520 - RNA, 25 nt, Human
uggugucaacuuguuaacacaacga

SEQ ID NO: 572521 - RNA, 20 nt, Human
uguacaaaaacaaguuaacc

SEQ ID NO: 572522 - RNA, 24 nt, Human
uguagagaugggguuucaccaugu

SEQ ID NO: 572523 - RNA, 19 nt, Human
uuagcugugcuguuggaau

SEQ ID NO: 572524 - RNA, 18 nt, Human
uucagcaucacccaccuc

SEQ ID NO: 572525 - RNA, 23 nt, Human
uuccccaacucccucccacccaa

SEQ ID NO: 572526 - RNA, 22 nt, Human
uugaugccuuuggguuuuuucc

SEQ ID NO: 572527 - RNA, 23 nt, Human
uugcaaccucugccuccuggauu

SEQ ID NO: 572528 - RNA, 24 nt, Human
uugcaaccucugccuccuggauuc

SEQ ID NO: 572529 - RNA, 19 nt, Human
uuggcacacaccccaggag

SEQ ID NO: 572530 - RNA, 24 nt, Human
uuguagagaugggguuucaccaug

SEQ ID NO: 572531 - RNA, 23 nt, Human
uuuacaagaaacucaauuuuaag

SEQ ID NO: 572532 - RNA, 21 nt, Human
uuucaccauguuggucaagcu

SEQ ID NO: 572533 - RNA, 24 nt, Human
uuuguagagaugggguuucaccau

SEQ ID NO: 572534 - RNA, 23 nt, Human
uuuuuguagagaugggguuucac

SEQ ID NO: 572535 - RNA, 22 nt, Human
aacacauuccugacaagugaca

SEQ ID NO: 572536 - RNA, 18 nt, Human
acgcaguuucccuguggu

SEQ ID NO: 572537 - RNA, 22 nt, Human
augaacgucucccaggacaaag

SEQ ID NO: 572538 - RNA, 24 nt, Human
cagaagaguccggcagcugcagcg

SEQ ID NO: 572539 - RNA, 26 nt, Human
cagcaguaccauauaaauacguugau

SEQ ID NO: 572540 - RNA, 22 nt, Human
cgcgucacagcaguaccauaua

SEQ ID NO: 572541 - RNA, 24 nt, Human
cucuauuuauauauauauauauau

SEQ ID NO: 572542 - RNA, 18 nt, Human
gguaaaaacacauuccug

SEQ ID NO: 572543 - RNA, 20 nt, Human
uaaaaacacauuccugacaa

SEQ ID NO: 572544 - RNA, 19 nt, Human
uaaauagauuccaauauga

SEQ ID NO: 572545 - RNA, 24 nt, Human
uagcaguuaaauagauuccaauau

SEQ ID NO: 572546 - RNA, 22 nt, Human
uauuuauauauauauauauaua

SEQ ID NO: 572547 - RNA, 19 nt, Human
ucucccaggacaaagcugc

SEQ ID NO: 572548 - RNA, 19 nt, Human
ugcgugcccacggugcugc

SEQ ID NO: 572549 - RNA, 19 nt, Human
uuuauauauauauauauau

SEQ ID NO: 572550 - RNA, 20 nt, Human
aaaaacaaacauaugacaaa

SEQ ID NO: 572551 - RNA, 21 nt, Human
aaaaacaaacauaugacaaaa

SEQ ID NO: 572552 - RNA, 23 nt, Human
aaacaaaaacaaacauaugacaa

SEQ ID NO: 572553 - RNA, 21 nt, Human
caacccucccgccaagugacu

SEQ ID NO: 572554 - RNA, 20 nt, Human
cguccaacccucccgccaag

SEQ ID NO: 572555 - RNA, 18 nt, Human
ggugguagguaugugagu

SEQ ID NO: 572556 - RNA, 19 nt, Human
gugaguucucccuaaacug

SEQ ID NO: 572557 - RNA, 33 nt, Human
uaauguuucaaacaaaaacaaacauaugacaac

SEQ ID NO: 572558 - RNA, 24 nt, Human
uguuuuuuguauucuccuauauuu

SEQ ID NO: 572559 - RNA, 21 nt, Human
uuccuuggggauggccgucca

SEQ ID NO: 572560 - RNA, 24 nt, Human
aagaggucuagaugagcugcuggc

SEQ ID NO: 572561 - RNA, 26 nt, Human
aagcauaauguuccugaacccuccac

SEQ ID NO: 572562 - RNA, 19 nt, Human
agcugcuggccauuuaggg

SEQ ID NO: 572563 - RNA, 21 nt, Human
ccugaacccuccacucccaga

SEQ ID NO: 572564 - RNA, 18 nt, Human
ggcuugacauaaugggac

SEQ ID NO: 572565 - RNA, 20 nt, Human
ggugagggaggcauuugagg

SEQ ID NO: 572566 - RNA, 21 nt, Human
ggugagggaggcauuugaggg

SEQ ID NO: 572567 - RNA, 20 nt, Human
ugaacccuccacucccagau

SEQ ID NO: 572568 - RNA, 27 nt, Human
uuaggggugagggaggcauuugagggc

SEQ ID NO: 572569 - RNA, 23 nt, Human
aaaaugcuguuuuaucuacauuu

SEQ ID NO: 572570 - RNA, 24 nt, Human
aaacagacccaacgccauccaggc

SEQ ID NO: 572571 - RNA, 18 nt, Human
aaacccuccaaguccucc

SEQ ID NO: 572572 - RNA, 19 nt, Human
aaacuggguugcaggagug

SEQ ID NO: 572573 - RNA, 24 nt, Human
aaagugcugggauuacagguguga

SEQ ID NO: 572574 - RNA, 19 nt, Human
aaagugcugggauuaccgg

SEQ ID NO: 572575 - RNA, 24 nt, Human
aaagugcugggauuaccgguguga

SEQ ID NO: 572576 - RNA, 22 nt, Human
aaccaucagagaaaccacaaaa

SEQ ID NO: 572577 - RNA, 21 nt, Human
aacuugucucacuuccuucug

SEQ ID NO: 572578 - RNA, 19 nt, Human
aagaacuugucucacuucc

SEQ ID NO: 572579 - RNA, 19 nt, Human
aagcaaguaagucacauga

SEQ ID NO: 572580 - RNA, 24 nt, Human
aagcaauccacccgccccagccuc

SEQ ID NO: 572581 - RNA, 21 nt, Human
aagcaccacgcuacaaagagc

SEQ ID NO: 572582 - RNA, 23 nt, Human
aagcaggcaccucugugagcaac

SEQ ID NO: 572583 - RNA, 24 nt, Human
aaguagcugagauuacaggcaugu

SEQ ID NO: 572584 - RNA, 25 nt, Human
aaguagcugagauuacaggcaugug

SEQ ID NO: 572585 - RNA, 25 nt, Human
aagucacagcugcacuagccccuga

SEQ ID NO: 572586 - RNA, 24 nt, Human
aagugaucugcccaccuuggucuc

SEQ ID NO: 572587 - RNA, 18 nt, Human
aagugcugggauuacagg

SEQ ID NO: 572588 - RNA, 19 nt, Human
aagugcugggauuacaggu

SEQ ID NO: 572589 - RNA, 26 nt, Human
aagugcugggauuacaggugugagcc

SEQ ID NO: 572590 - RNA, 18 nt, Human
aagugcugggauuaccgg

SEQ ID NO: 572591 - RNA, 26 nt, Human
aagugcugggauuaccggugugagcc

SEQ ID NO: 572592 - RNA, 18 nt, Human
aaugcucuugauggcauc

SEQ ID NO: 572593 - RNA, 25 nt, Human
acagaagcaccacgcuacaaagagc

SEQ ID NO: 572594 - RNA, 18 nt, Human
acaggguuucaccauguu

SEQ ID NO: 572595 - RNA, 19 nt, Human
acaggguuucaccauguug

SEQ ID NO: 572596 - RNA, 24 nt, Human
acaggguuucaccauguugcccag

SEQ ID NO: 572597 - RNA, 18 nt, Human
acaggguuuugccauguu

SEQ ID NO: 572598 - RNA, 21 nt, Human
acaggguuuugccauguuggu

SEQ ID NO: 572599 - RNA, 23 nt, Human
acaggguuuugccauguugguca

SEQ ID NO: 572600 - RNA, 24 nt, Human
acaggguuuugccauguuggucag

SEQ ID NO: 572601 - RNA, 24 nt, Human
accauguugcccaggcuggucuug

SEQ ID NO: 572602 - RNA, 25 nt, Human
accauguugcccaggcuggucuuga

SEQ ID NO: 572603 - RNA, 22 nt, Human
acccaacgccauccaggcuuug

SEQ ID NO: 572604 - RNA, 24 nt, Human
acgaguucuuccaggcuugggaaa

SEQ ID NO: 572605 - RNA, 24 nt, Human
agaaauacgcaucacuuucaguuc

SEQ ID NO: 572606 - RNA, 23 nt, Human
agaagucuguccuaucauggacu

SEQ ID NO: 572607 - RNA, 23 nt, Human
agacaggguuucaccauguugcc

SEQ ID NO: 572608 - RNA, 18 nt, Human
agacaggguuuugccaug

SEQ ID NO: 572609 - RNA, 19 nt, Human
agauuacaggcaugugcca

SEQ ID NO: 572610 - RNA, 21 nt, Human
agcaauccacccgccccagcc

SEQ ID NO: 572611 - RNA, 23 nt, Human
agcaauccacccgccccagccuc

SEQ ID NO: 572612 - RNA, 22 nt, Human
agccauauuuugaaagaaaucu

SEQ ID NO: 572613 - RNA, 20 nt, Human
aggaaaagauaaguugcuga

SEQ ID NO: 572614 - RNA, 19 nt, Human
aggaauuuggaguugacag

SEQ ID NO: 572615 - RNA, 20 nt, Human
aggaguagauuccauuucaa

SEQ ID NO: 572616 - RNA, 21 nt, Human
aggagucaauccucucaaacc

SEQ ID NO: 572617 - RNA, 25 nt, Human
aggcuggagugcaguggcaggaucu

SEQ ID NO: 572618 - RNA, 24 nt, Human
aguaauucucgugccucagccucc

SEQ ID NO: 572619 - RNA, 22 nt, Human
aguagagacaggguuuugccau

SEQ ID NO: 572620 - RNA, 23 nt, Human
agugcaguggcaggaucuuggcu

SEQ ID NO: 572621 - RNA, 24 nt, Human
agugcaguggcaggaucuuggcuc

SEQ ID NO: 572622 - RNA, 22 nt, Human
auaaaaugcuguuuuaucuaca

SEQ ID NO: 572623 - RNA, 22 nt, Human
aucuauuucuuccaaauuccaa

SEQ ID NO: 572624 - RNA, 27 nt, Human
augcuguuugacagcauuugugaacca

SEQ ID NO: 572625 - RNA, 23 nt, Human
auggcagaaggggaagcaggcac

SEQ ID NO: 572626 - RNA, 21 nt, Human
auuguuaaugaguagcaauau

SEQ ID NO: 572627 - RNA, 24 nt, Human
auuuuuguauuuuuaguagagaca

SEQ ID NO: 572628 - RNA, 24 nt, Human
caaagugcugggauuacaggugug

SEQ ID NO: 572629 - RNA, 27 nt, Human
caaagugcugggauuaccggugugagc

SEQ ID NO: 572630 - RNA, 23 nt, Human
caaccuccaccucccggguucaa

SEQ ID NO: 572631 - RNA, 27 nt, Human
caaguaauucucgugccucagccuccc

SEQ ID NO: 572632 - RNA, 26 nt, Human
caauccugaaggaucauuucaccaaa

SEQ ID NO: 572633 - RNA, 24 nt, Human
caccaugccuggcuaauuuuugua

SEQ ID NO: 572634 - RNA, 24 nt, Human
caccauguugcccaggcuggucuu

SEQ ID NO: 572635 - RNA, 27 nt, Human
caccauguugcccaggcuggucuugaa

SEQ ID NO: 572636 - RNA, 23 nt, Human
cacccgccccagccucccaaagu

SEQ ID NO: 572637 - RNA, 24 nt, Human
cacugagaugggccaccaccccag

SEQ ID NO: 572638 - RNA, 21 nt, Human
cacugcaaccuccaccucccg

SEQ ID NO: 572639 - RNA, 23 nt, Human
cacugcaaccuccaccucccggg

SEQ ID NO: 572640 - RNA, 20 nt, Human
cacuuucaguuccagaccac

SEQ ID NO: 572641 - RNA, 20 nt, Human
cagaaccaucagagaaacca

SEQ ID NO: 572642 - RNA, 24 nt, Human
cagaaccaucagagaaaccacaaa

SEQ ID NO: 572643 - RNA, 20 nt, Human
caggaucuuggcucacugca

SEQ ID NO: 572644 - RNA, 23 nt, Human
caggcaugaaaacaguauucauc

SEQ ID NO: 572645 - RNA, 24 nt, Human
caggguuucaccauguugcccagg

SEQ ID NO: 572646 - RNA, 24 nt, Human
caggguuuugccauguuggucagg

SEQ ID NO: 572647 - RNA, 23 nt, Human
cauaucuuaagggcccugggaaa

SEQ ID NO: 572648 - RNA, 19 nt, Human
caucuacaguuccuuccuc

SEQ ID NO: 572649 - RNA, 20 nt, Human
cauguugcccaggcuggucu

SEQ ID NO: 572650 - RNA, 23 nt, Human
cauguugcccaggcuggucuuga

SEQ ID NO: 572651 - RNA, 24 nt, Human
cauguugcccaggcuggucuugaa

SEQ ID NO: 572652 - RNA, 18 nt, Human
ccaaagugcugggauuac

SEQ ID NO: 572653 - RNA, 21 nt, Human
ccaaagugcugggauuacagg

SEQ ID NO: 572654 - RNA, 21 nt, Human
ccaaagugcugggauuacagg

SEQ ID NO: 572655 - RNA, 24 nt, Human
ccaaagugcugggauuacaggugu

SEQ ID NO: 572656 - RNA, 21 nt, Human
ccaaagugcugggauuaccgg

SEQ ID NO: 572657 - RNA, 24 nt, Human
ccaaagugcugggauuaccggugu

SEQ ID NO: 572658 - RNA, 23 nt, Human
ccaaguagcugagauuacaggca

SEQ ID NO: 572659 - RNA, 24 nt, Human
ccaaguagcugagauuacaggcau

SEQ ID NO: 572660 - RNA, 26 nt, Human
ccacccgccccagccucccaaagugc

SEQ ID NO: 572661 - RNA, 19 nt, Human
ccaccgugcccagccacaa

SEQ ID NO: 572662 - RNA, 24 nt, Human
ccaccucccggguucaaguaauuc

SEQ ID NO: 572663 - RNA, 24 nt, Human
ccaccuuggucucccaaagugcug

SEQ ID NO: 572664 - RNA, 23 nt, Human
ccagaaccaucagagaaaccaca

SEQ ID NO: 572665 - RNA, 21 nt, Human
ccaggcuguaaacagacccaa

SEQ ID NO: 572666 - RNA, 19 nt, Human
ccauguuggucaggcuggu

SEQ ID NO: 572667 - RNA, 19 nt, Human
cccaaguagcugagauuac

SEQ ID NO: 572668 - RNA, 24 nt, Human
cccaaguagcugagauuacaggca

SEQ ID NO: 572669 - RNA, 20 nt, Human
cccggguucaaguaauucuc

SEQ ID NO: 572670 - RNA, 20 nt, Human
cccggguucaaguaauucuc

SEQ ID NO: 572671 - RNA, 24 nt, Human
ccgccccagccucccaaagugcug

SEQ ID NO: 572672 - RNA, 19 nt, Human
ccucaccucucacauuuag

SEQ ID NO: 572673 - RNA, 19 nt, Human
ccucugugagcaacagaag

SEQ ID NO: 572674 - RNA, 24 nt, Human
ccugacuucaagugaucugcccac

SEQ ID NO: 572675 - RNA, 19 nt, Human
ccugcagcuuccucaccuc

SEQ ID NO: 572676 - RNA, 22 nt, Human
ccuggcaucaagcaauccaccc

SEQ ID NO: 572677 - RNA, 19 nt, Human
cgugaauugaaugcucuug

SEQ ID NO: 572678 - RNA, 19 nt, Human
cuaaaagaacuugucucac

SEQ ID NO: 572679 - RNA, 20 nt, Human
cuaggucucaacagugggcu

SEQ ID NO: 572680 - RNA, 21 nt, Human
cuaugaaaguccuagauggca

SEQ ID NO: 572681 - RNA, 26 nt, Human
cucaacagugggcuuacucaguagac

SEQ ID NO: 572682 - RNA, 24 nt, Human
cucacugcaaccuccaccucccgg

SEQ ID NO: 572683 - RNA, 21 nt, Human
cucccaaguagcugagauuac

SEQ ID NO: 572684 - RNA, 23 nt, Human
cuccuggcaucaagcaauccacc

SEQ ID NO: 572685 - RNA, 25 nt, Human
cucgugccucagccucccaaguagc

SEQ ID NO: 572686 - RNA, 20 nt, Human
cucuguugcccaggcuggag

SEQ ID NO: 572687 - RNA, 20 nt, Human
cugaagccugcagugacugu

SEQ ID NO: 572688 - RNA, 23 nt, Human
cugcaaccuccaccucccggguu

SEQ ID NO: 572689 - RNA, 24 nt, Human
cugcaaccuccaccucccggguuc

SEQ ID NO: 572690 - RNA, 19 nt, Human
cuguugcccaggcuggagu

SEQ ID NO: 572691 - RNA, 18 nt, Human
cuuaaaguaagacaacag

SEQ ID NO: 572692 - RNA, 19 nt, Human
cuucuguguaacuucuaca

SEQ ID NO: 572693 - RNA, 18 nt, Human
cuugucucacuuccuucu

SEQ ID NO: 572694 - RNA, 25 nt, Human
gaccacugcaauaaaccaaauacaa

SEQ ID NO: 572695 - RNA, 24 nt, Human
gacuucaagugaucugcccaccuu

SEQ ID NO: 572696 - RNA, 20 nt, Human
gagacaggguuucaccaugu

SEQ ID NO: 572697 - RNA, 18 nt, Human
gauuacaggcaugugcca

SEQ ID NO: 572698 - RNA, 24 nt, Human
gauuacaggcaugugccaccaugc

SEQ ID NO: 572699 - RNA, 18 nt, Human
gauuacaggugugagcca

SEQ ID NO: 572700 - RNA, 21 nt, Human
gauuacaggugugagccaccg

SEQ ID NO: 572701 - RNA, 24 nt, Human
gauuacaggugugagccaccgugc

SEQ ID NO: 572702 - RNA, 18 nt, Human
gauuaccggugugagcca

SEQ ID NO: 572703 - RNA, 22 nt, Human
gauuaccggugugagccacugc

SEQ ID NO: 572704 - RNA, 23 nt, Human
gauuaccggugugagccacugca

SEQ ID NO: 572705 - RNA, 23 nt, Human
gcaacagaagcaccacgcuacaa

SEQ ID NO: 572706 - RNA, 20 nt, Human
gccauguuggucaggcuggu

SEQ ID NO: 572707 - RNA, 23 nt, Human
gccauguuggucaggcuggucuc

SEQ ID NO: 572708 - RNA, 23 nt, Human
gcccagaaccaucagagaaacca

SEQ ID NO: 572709 - RNA, 20 nt, Human
gcccaggcuggagugcagug

SEQ ID NO: 572710 - RNA, 23 nt, Human
gccccagccucccaaagugcugg

SEQ ID NO: 572711 - RNA, 25 nt, Human
gcucuguugcccaggcuggagugca

SEQ ID NO: 572712 - RNA, 24 nt, Human
ggcuggucucaaacuccugacuuc

SEQ ID NO: 572713 - RNA, 18 nt, Human
ggcuggucuugaacuccu

SEQ ID NO: 572714 - RNA, 22 nt, Human
ggguuuugccauguuggucagg

SEQ ID NO: 572715 - RNA, 24 nt, Human
guaauucucgugccucagccuccc

SEQ ID NO: 572716 - RNA, 23 nt, Human
guagagacaggguuuugccaugu

SEQ ID NO: 572717 - RNA, 18 nt, Human
gucacguuguacuuuuau

SEQ ID NO: 572718 - RNA, 21 nt, Human
gugaauugaaugcucuugaug

SEQ ID NO: 572719 - RNA, 24 nt, Human
gugcaguggcaggaucuuggcuca

SEQ ID NO: 572720 - RNA, 22 nt, Human
gugccucagccucccaaguagc

SEQ ID NO: 572721 - RNA, 23 nt, Human
gugccucagccucccaaguagcu

SEQ ID NO: 572722 - RNA, 24 nt, Human
guuucaccauguugcccaggcugg

SEQ ID NO: 572723 - RNA, 22 nt, Human
uaaaagaacuugucucacuucc

SEQ ID NO: 572724 - RNA, 20 nt, Human
uaacaugguucauacuguag

SEQ ID NO: 572725 - RNA, 23 nt, Human
uaaguugcugaagccugcaguga

SEQ ID NO: 572726 - RNA, 20 nt, Human
uaauucucgugccucagccu

SEQ ID NO: 572727 - RNA, 22 nt, Human
uaauuuaaaaguacuuuuaaau

SEQ ID NO: 572728 - RNA, 24 nt, Human
uaauuuuuguauuuuuaguagaga

SEQ ID NO: 572729 - RNA, 22 nt, Human
uacaggcaugugccaccaugcc

SEQ ID NO: 572730 - RNA, 24 nt, Human
uacaggugugagccaccgugccca

SEQ ID NO: 572731 - RNA, 22 nt, Human
uaccccaucaauccugaaggau

SEQ ID NO: 572732 - RNA, 24 nt, Human
uaccggugugagccacugcaccca

SEQ ID NO: 572733 - RNA, 22 nt, Human
uagagacaggguuuugccaugu

SEQ ID NO: 572734 - RNA, 23 nt, Human
uaggccccuccacuucuaguucu

SEQ ID NO: 572735 - RNA, 24 nt, Human
uaguagagacaggguuuugccaug

SEQ ID NO: 572736 - RNA, 21 nt, Human
uauuaccccaucaauccugaa

SEQ ID NO: 572737 - RNA, 23 nt, Human
ucacugcaaccuccaccucccgg

SEQ ID NO: 572738 - RNA, 24 nt, Human
ucacugcaaccuccaccucccggg

SEQ ID NO: 572739 - RNA, 25 nt, Human
ucacugcaaccuccaccucccgggu

SEQ ID NO: 572740 - RNA, 27 nt, Human
ucacugcaaccuccaccucccggguuc

SEQ ID NO: 572741 - RNA, 21 nt, Human
ucagccucccaaguagcugag

SEQ ID NO: 572742 - RNA, 19 nt, Human
uccacauggcuggggaggc

SEQ ID NO: 572743 - RNA, 21 nt, Human
uccacccgccccagccuccca

SEQ ID NO: 572744 - RNA, 21 nt, Human
uccaugagaaggaacuucuca

SEQ ID NO: 572745 - RNA, 23 nt, Human
ucccaaagugcugggauuacagg

SEQ ID NO: 572746 - RNA, 21 nt, Human
ucccaaagugcugggauuacc

SEQ ID NO: 572747 - RNA, 23 nt, Human
ucccaaagugcugggauuaccgg

SEQ ID NO: 572748 - RNA, 24 nt, Human
ucccaaguagcugagauuacaggc

SEQ ID NO: 572749 - RNA, 24 nt, Human
ucccacugguggcuggaaaacugg

SEQ ID NO: 572750 - RNA, 21 nt, Human
ucccggguucaaguaauucuc

SEQ ID NO: 572751 - RNA, 24 nt, Human
ucccggguucaaguaauucucgug

SEQ ID NO: 572752 - RNA, 19 nt, Human
uccugaaggaucauuucac

SEQ ID NO: 572753 - RNA, 22 nt, Human
ucucacuuccuucuggccucca

SEQ ID NO: 572754 - RNA, 21 nt, Human
ucucuaggccccuccacuucu

SEQ ID NO: 572755 - RNA, 18 nt, Human
ucuguugcccaggcugga

SEQ ID NO: 572756 - RNA, 24 nt, Human
ucuguugcccaggcuggagugcag

SEQ ID NO: 572757 - RNA, 21 nt, Human
ucuugaacuccuggcaucaag

SEQ ID NO: 572758 - RNA, 23 nt, Human
ucuugcucuguugcccaggcugg

SEQ ID NO: 572759 - RNA, 24 nt, Human
ucuugcucuguugcccaggcugga

SEQ ID NO: 572760 - RNA, 21 nt, Human
ucuuuggguuucacucagcuu

SEQ ID NO: 572761 - RNA, 19 nt, Human
ugaaacccuccaaguccuc

SEQ ID NO: 572762 - RNA, 22 nt, Human
ugaagucuugaaacccuccaag

SEQ ID NO: 572763 - RNA, 21 nt, Human
ugaaugcucuugauggcaucu

SEQ ID NO: 572764 - RNA, 18 nt, Human
ugacuucaagugaucugc

SEQ ID NO: 572765 - RNA, 21 nt, Human
ugacuucaagugaucugccca

SEQ ID NO: 572766 - RNA, 21 nt, Human
ugagauuacaggcaugugcca

SEQ ID NO: 572767 - RNA, 22 nt, Human
ugagauuacaggcaugugccac

SEQ ID NO: 572768 - RNA, 24 nt, Human
ugagauuacaggcaugugccacca

SEQ ID NO: 572769 - RNA, 24 nt, Human
ugaucugcccaccuuggucuccca

SEQ ID NO: 572770 - RNA, 22 nt, Human
ugcaguggcaggaucuuggcuc

SEQ ID NO: 572771 - RNA, 24 nt, Human
ugccauguuggucaggcuggucuc

SEQ ID NO: 572772 - RNA, 22 nt, Human
ugcccagaaccaucagagaaac

SEQ ID NO: 572773 - RNA, 25 nt, Human
ugcccagaaccaucagagaaaccac

SEQ ID NO: 572774 - RNA, 18 nt, Human
ugcccaggcuggagugca

SEQ ID NO: 572775 - RNA, 21 nt, Human
ugcccaggcuggagugcagug

SEQ ID NO: 572776 - RNA, 22 nt, Human
ugcccaggcuggagugcagugg

SEQ ID NO: 572777 - RNA, 24 nt, Human
ugcccaggcuggagugcaguggca

SEQ ID NO: 572778 - RNA, 24 nt, Human
ugcccaggcuggucuugaacuccu

SEQ ID NO: 572779 - RNA, 24 nt, Human
ugccucagccucccaaguagcuga

SEQ ID NO: 572780 - RNA, 18 nt, Human
ugcuauuuucagcccauc

SEQ ID NO: 572781 - RNA, 23 nt, Human
ugcugcauuuauuaacucuuuca

SEQ ID NO: 572782 - RNA, 24 nt, Human
ugcugggauuacaggugugagcca

SEQ ID NO: 572783 - RNA, 26 nt, Human
uggaaaacuggguugcaggacagagg

SEQ ID NO: 572784 - RNA, 23 nt, Human
uggagugcaguggcaggaucuug

SEQ ID NO: 572785 - RNA, 24 nt, Human
uggagugcaguggcaggaucuugg

SEQ ID NO: 572786 - RNA, 19 nt, Human
uggcaguuucuuaaaguaa

SEQ ID NO: 572787 - RNA, 20 nt, Human
uggcaucaagcaauccaccc

SEQ ID NO: 572788 - RNA, 18 nt, Human
uggccuccaugguuuccu

SEQ ID NO: 572789 - RNA, 18 nt, Human
ugggauuacaggugugag

SEQ ID NO: 572790 - RNA, 21 nt, Human
ugggauuacaggugugagcca

SEQ ID NO: 572791 - RNA, 22 nt, Human
ugggauuacaggugugagccac

SEQ ID NO: 572792 - RNA, 23 nt, Human
ugggauuacaggugugagccacc

SEQ ID NO: 572793 - RNA, 23 nt, Human
ugggauuacaggugugagccacc

SEQ ID NO: 572794 - RNA, 24 nt, Human
ugggauuacaggugugagccaccg

SEQ ID NO: 572795 - RNA, 19 nt, Human
ugggauuaccggugugagc

SEQ ID NO: 572796 - RNA, 22 nt, Human
ugggauuaccggugugagccac

SEQ ID NO: 572797 - RNA, 22 nt, Human
ugggauuaccggugugagccac

SEQ ID NO: 572798 - RNA, 24 nt, Human
ugggauuaccggugugagccacug

SEQ ID NO: 572799 - RNA, 24 nt, Human
uggucaggcuggucucaaacuccu

SEQ ID NO: 572800 - RNA, 22 nt, Human
uggugaauccuuuccagaaggu

SEQ ID NO: 572801 - RNA, 24 nt, Human
uguaaacagacccaacgccaucca

SEQ ID NO: 572802 - RNA, 24 nt, Human
ugucucacuuccuucuggccucca

SEQ ID NO: 572803 - RNA, 18 nt, Human
ugugucucagggaauagg

SEQ ID NO: 572804 - RNA, 24 nt, Human
uuaaaaucuguuguuuaguguagc

SEQ ID NO: 572805 - RNA, 21 nt, Human
uuaaaguaagacaacagugaa

SEQ ID NO: 572806 - RNA, 24 nt, Human
uuaguagagacaggguuuugccau

SEQ ID NO: 572807 - RNA, 24 nt, Human
uucaaauuuucuccugcagcuucc

SEQ ID NO: 572808 - RNA, 23 nt, Human
uucaaguaauucucgugccucag

SEQ ID NO: 572809 - RNA, 20 nt, Human
uucaagugaucugcccaccu

SEQ ID NO: 572810 - RNA, 24 nt, Human
uucaagugaucugcccaccuuggu

SEQ ID NO: 572811 - RNA, 24 nt, Human
uucaagugaucugcccaccuuggu

SEQ ID NO: 572812 - RNA, 23 nt, Human
uucucuaacuaugaaaguccuag

SEQ ID NO: 572813 - RNA, 21 nt, Human
uucuuugcucguccaugagaa

SEQ ID NO: 572814 - RNA, 25 nt, Human
uugaagccaggcauugaguuucucu

SEQ ID NO: 572815 - RNA, 23 nt, Human
uugaggcagucuugcucuguugc

SEQ ID NO: 572816 - RNA, 24 nt, Human
uugccauguuggucaggcuggucu

SEQ ID NO: 572817 - RNA, 18 nt, Human
uugguuuuuuggauuugu

SEQ ID NO: 572818 - RNA, 19 nt, Human
uugucucacuuccuucugg

SEQ ID NO: 572819 - RNA, 21 nt, Human
uuuaucuacauuuaaaaucug

SEQ ID NO: 572820 - RNA, 19 nt, Human
uuucaagaaaucaccuucu

SEQ ID NO: 572821 - RNA, 23 nt, Human
uuucaccauguugcccaggcugg

SEQ ID NO: 572822 - RNA, 24 nt, Human
uuucaccauguugcccaggcuggu

SEQ ID NO: 572823 - RNA, 18 nt, Human
uuucuugaugcuuucaag

SEQ ID NO: 572824 - RNA, 24 nt, Human
uuugguuuuuuggauuuguuuuuu

SEQ ID NO: 572825 - RNA, 25 nt, Human
uuuugagacaggguuucaccauguu

SEQ ID NO: 572826 - RNA, 23 nt, Human
uuuugccauguuggucaggcugg

SEQ ID NO: 572827 - RNA, 21 nt, Human
uuuuuaguagagacaggguuu

SEQ ID NO: 572828 - RNA, 24 nt, Human
uuuuuaguagagacaggguuuugc

SEQ ID NO: 572829 - RNA, 24 nt, Human
uuuuugagacaggguuucaccaug

SEQ ID NO: 572830 - RNA, 20 nt, Human
uuuuuguauuuuuaguagag

SEQ ID NO: 572831 - RNA, 20 nt, Human
aaacagagccugcaucuccc

SEQ ID NO: 572832 - RNA, 20 nt, Human
aaacuggucccccuucuucc

SEQ ID NO: 572833 - RNA, 23 nt, Human
aaagcugaaagcagcucuagcua

SEQ ID NO: 572834 - RNA, 23 nt, Human
aaaggccuucucaaguagcgucc

SEQ ID NO: 572835 - RNA, 23 nt, Human
aaccaaaaacuaaaucauaacag

SEQ ID NO: 572836 - RNA, 22 nt, Human
aacccacucaaaucaaaaccaa

SEQ ID NO: 572837 - RNA, 26 nt, Human
aacuggucccccuucuucccagcccc

SEQ ID NO: 572838 - RNA, 24 nt, Human
aagcagagacucugggccauaauc

SEQ ID NO: 572839 - RNA, 19 nt, Human
aagcagcucuagcuaacca

SEQ ID NO: 572840 - RNA, 23 nt, Human
aagcagcucuagcuaaccaaccc

SEQ ID NO: 572841 - RNA, 26 nt, Human
aagcgcuaggauuacaggcauaagcc

SEQ ID NO: 572842 - RNA, 22 nt, Human
aagucacccuguggggaaaggc

SEQ ID NO: 572843 - RNA, 24 nt, Human
aagugauccuccugccuuggccuc

SEQ ID NO: 572844 - RNA, 24 nt, Human
aaucauaacaguaaaaauaugacc

SEQ ID NO: 572845 - RNA, 18 nt, Human
acauacggcuuccaacuc

SEQ ID NO: 572846 - RNA, 21 nt, Human
acaucccugcugcugcuccug

SEQ ID NO: 572847 - RNA, 18 nt, Human
accuggcaccuucucccu

SEQ ID NO: 572848 - RNA, 19 nt, Human
acuacauugcccagggugg

SEQ ID NO: 572849 - RNA, 23 nt, Human
agcagaaagguggaauccccaac

SEQ ID NO: 572850 - RNA, 20 nt, Human
agccaccacaccuggccccc

SEQ ID NO: 572851 - RNA, 22 nt, Human
agccucaagugauccuccugcc

SEQ ID NO: 572852 - RNA, 19 nt, Human
agcugcugaucagcucuac

SEQ ID NO: 572853 - RNA, 21 nt, Human
aggaaaagcugaaagcagcuc

SEQ ID NO: 572854 - RNA, 21 nt, Human
aggcuggccgaggacugcagg

SEQ ID NO: 572855 - RNA, 20 nt, Human
aggucccugacccucuccaa

SEQ ID NO: 572856 - RNA, 18 nt, Human
aucaugcuauaacacucc

SEQ ID NO: 572857 - RNA, 22 nt, Human
augaccagcaaacaacgaaaga

SEQ ID NO: 572858 - RNA, 19 nt, Human
auuugauuuucuuucuuuu

SEQ ID NO: 572859 - RNA, 19 nt, Human
caaaaacuaaaucauaaca

SEQ ID NO: 572860 - RNA, 24 nt, Human
caaagcgcuaggauuacaggcaua

SEQ ID NO: 572861 - RNA, 24 nt, Human
caaccaacccacucaaaucaaaac

SEQ ID NO: 572862 - RNA, 18 nt, Human
caacccacucaaaucaaa

SEQ ID NO: 572863 - RNA, 24 nt, Human
caacccacucaaaucaaaaccaaa

SEQ ID NO: 572864 - RNA, 23 nt, Human
caagcacccacaagcagagacuc

SEQ ID NO: 572865 - RNA, 22 nt, Human
caagugauccuccugccuuggc

SEQ ID NO: 572866 - RNA, 27 nt, Human
caagugauccuccugccuuggccuccc

SEQ ID NO: 572867 - RNA, 27 nt, Human
caagugauccuccugccuuggccuccc

SEQ ID NO: 572868 - RNA, 18 nt, Human
cacaaauauacccuugga

SEQ ID NO: 572869 - RNA, 21 nt, Human
cacaguuuccuacgggagacc

SEQ ID NO: 572870 - RNA, 23 nt, Human
caccuggcccccauauucgagcc

SEQ ID NO: 572871 - RNA, 18 nt, Human
cacuacauugcccagggu

SEQ ID NO: 572872 - RNA, 22 nt, Human
cacuacauugcccagggugguc

SEQ ID NO: 572873 - RNA, 22 nt, Human
cagagcaaaggacauccuggcc

SEQ ID NO: 572874 - RNA, 18 nt, Human
cagcaagggggccaacca

SEQ ID NO: 572875 - RNA, 24 nt, Human
caucucacuccagaaccaguuuca

SEQ ID NO: 572876 - RNA, 22 nt, Human
caucucccagccuugccccacc

SEQ ID NO: 572877 - RNA, 18 nt, Human
ccaaacuggucccccuuc

SEQ ID NO: 572878 - RNA, 24 nt, Human
ccaaagcgcuaggauuacaggcau

SEQ ID NO: 572879 - RNA, 23 nt, Human
ccaaccaacccacucaaaucaaa

SEQ ID NO: 572880 - RNA, 19 nt, Human
ccaaccccccucuaaaccc

SEQ ID NO: 572881 - RNA, 22 nt, Human
ccaaccccccucuaaacccccu

SEQ ID NO: 572882 - RNA, 19 nt, Human
ccacucaaaucaaaaccaa

SEQ ID NO: 572883 - RNA, 21 nt, Human
ccagcaagggggccaaccaac

SEQ ID NO: 572884 - RNA, 26 nt, Human
ccagccuugccccaccuggucccaca

SEQ ID NO: 572885 - RNA, 21 nt, Human
cccagccccuuuuguaccucc

SEQ ID NO: 572886 - RNA, 19 nt, Human
ccccagccgagcucaucuc

SEQ ID NO: 572887 - RNA, 24 nt, Human
cccccugacauacauacggcuucc

SEQ ID NO: 572888 - RNA, 22 nt, Human
ccccucuaaacccccugacaua

SEQ ID NO: 572889 - RNA, 21 nt, Human
ccccuucuucccagccccuuu

SEQ ID NO: 572890 - RNA, 22 nt, Human
ccgaugaucaugcuauaacacu

SEQ ID NO: 572891 - RNA, 18 nt, Human
ccuagccucaagugaucc

SEQ ID NO: 572892 - RNA, 23 nt, Human
ccuagccucaagugauccuccug

SEQ ID NO: 572893 - RNA, 21 nt, Human
ccucaagaucuccggugccuc

SEQ ID NO: 572894 - RNA, 20 nt, Human
ccucaagugauccuccugcc

SEQ ID NO: 572895 - RNA, 21 nt, Human
ccucaagugauccuccugccu

SEQ ID NO: 572896 - RNA, 21 nt, Human
ccuccagcuccgagaaggcgc

SEQ ID NO: 572897 - RNA, 24 nt, Human
ccuccugccuuggccucccaaagc

SEQ ID NO: 572898 - RNA, 23 nt, Human
ccuggcaccuucucccuugggga

SEQ ID NO: 572899 - RNA, 24 nt, Human
ccuguggggaaaggccuucucaag

SEQ ID NO: 572900 - RNA, 22 nt, Human
cgagccuaauguuccuuuggga

SEQ ID NO: 572901 - RNA, 27 nt, Human
cgcuaggauuacaggcauaagccacca

SEQ ID NO: 572902 - RNA, 23 nt, Human
cuauacaucccugcugcugcucc

SEQ ID NO: 572903 - RNA, 24 nt, Human
cucaagugauccuccugccuuggc

SEQ ID NO: 572904 - RNA, 21 nt, Human
cucacugaagaugggccucca

SEQ ID NO: 572905 - RNA, 18 nt, Human
cucaggucccugacccuc

SEQ ID NO: 572906 - RNA, 19 nt, Human
cucccaccugccuggccgc

SEQ ID NO: 572907 - RNA, 21 nt, Human
cuccgagaaggcgcucagcag

SEQ ID NO: 572908 - RNA, 20 nt, Human
cuccugcugaccuggcaccu

SEQ ID NO: 572909 - RNA, 21 nt, Human
cuccuuuugucuccaggaaaa

SEQ ID NO: 572910 - RNA, 19 nt, Human
cucgcuccaccuuccagcc

SEQ ID NO: 572911 - RNA, 23 nt, Human
cugccuuggccucccaaagcgcu

SEQ ID NO: 572912 - RNA, 26 nt, Human
cuuuugucuccaggaaaagcugaaag

SEQ ID NO: 572913 - RNA, 19 nt, Human
gagccugcaucucccagcc

SEQ ID NO: 572914 - RNA, 22 nt, Human
gagugugacccagagcccuggg

SEQ ID NO: 572915 - RNA, 21 nt, Human
gaugccaacccccaaaagaaa

SEQ ID NO: 572916 - RNA, 21 nt, Human
gaugccaggcacaagcugcug

SEQ ID NO: 572917 - RNA, 18 nt, Human
gauuacaggcauaagcca

SEQ ID NO: 572918 - RNA, 21 nt, Human
gauuacaggcauaagccacca

SEQ ID NO: 572919 - RNA, 18 nt, Human
gccuuggccucccaaagc

SEQ ID NO: 572920 - RNA, 21 nt, Human
gcuaaccaaccccccucuaaa

SEQ ID NO: 572921 - RNA, 22 nt, Human
ggacuuaggguagacacugugg

SEQ ID NO: 572922 - RNA, 19 nt, Human
ggauuacaggcauaagcca

SEQ ID NO: 572923 - RNA, 22 nt, Human
ggauuacaggcauaagccacca

SEQ ID NO: 572924 - RNA, 22 nt, Human
gggggcauccacuucucgcucc

SEQ ID NO: 572925 - RNA, 22 nt, Human
ggucccccuucuucccagcccc

SEQ ID NO: 572926 - RNA, 22 nt, Human
guaaagaggaugccaaccccca

SEQ ID NO: 572927 - RNA, 21 nt, Human
gucccccuucuucccagcccc

SEQ ID NO: 572928 - RNA, 27 nt, Human
uaaaaauaugaccagcaaacaacgaaa

SEQ ID NO: 572929 - RNA, 23 nt, Human
uaacacuccuuuugucuccagga

SEQ ID NO: 572930 - RNA, 24 nt, Human
uaacuccuagccucaagugauccu

SEQ ID NO: 572931 - RNA, 22 nt, Human
uacaggcauaagccaccacacc

SEQ ID NO: 572932 - RNA, 24 nt, Human
uacauugcccaggguggucucuaa

SEQ ID NO: 572933 - RNA, 23 nt, Human
uagacacugugggacccagagca

SEQ ID NO: 572934 - RNA, 20 nt, Human
uagccucaagugauccuccu

SEQ ID NO: 572935 - RNA, 24 nt, Human
uagccucaagugauccuccugccu

SEQ ID NO: 572936 - RNA, 22 nt, Human
uaggauuacaggcauaagccac

SEQ ID NO: 572937 - RNA, 24 nt, Human
uaggauuacaggcauaagccacca

SEQ ID NO: 572938 - RNA, 24 nt, Human
uaggauuacaggcauaagccacca

SEQ ID NO: 572939 - RNA, 21 nt, Human
uaggguagacacugugggacc

SEQ ID NO: 572940 - RNA, 23 nt, Human
ucaaaaccaaaaacuaaaucaua

SEQ ID NO: 572941 - RNA, 20 nt, Human
ucagcucaggucccugaccc

SEQ ID NO: 572942 - RNA, 19 nt, Human
ucaucucacuccagaacca

SEQ ID NO: 572943 - RNA, 24 nt, Human
ucccaaagcgcuaggauuacaggc

SEQ ID NO: 572944 - RNA, 18 nt, Human
ucccacacuccuugcagg

SEQ ID NO: 572945 - RNA, 19 nt, Human
ucccagcagguggaucaag

SEQ ID NO: 572946 - RNA, 19 nt, Human
ucccugcugcugcuccugc

SEQ ID NO: 572947 - RNA, 26 nt, Human
uccuuugggaaacaacugaguaaagg

SEQ ID NO: 572948 - RNA, 20 nt, Human
ucuacauuugauuuucuuuc

SEQ ID NO: 572949 - RNA, 19 nt, Human
ucucacuacauugcccagg

SEQ ID NO: 572950 - RNA, 20 nt, Human
ucucacuacauugcccaggg

SEQ ID NO: 572951 - RNA, 21 nt, Human
ucucccagccuugccccaccu

SEQ ID NO: 572952 - RNA, 24 nt, Human
ucucgcuccaccuuccagccuggg

SEQ ID NO: 572953 - RNA, 21 nt, Human
ucucuguccuggagccagaaa

SEQ ID NO: 572954 - RNA, 23 nt, Human
ucuucccagccccuuuuguaccu

SEQ ID NO: 572955 - RNA, 19 nt, Human
ugacccagagcccuggggg

SEQ ID NO: 572956 - RNA, 20 nt, Human
ugaccuggcaccuucucccu

SEQ ID NO: 572957 - RNA, 24 nt, Human
ugaggucucacuacauugcccagg

SEQ ID NO: 572958 - RNA, 21 nt, Human
ugaucaugcuauaacacuccu

SEQ ID NO: 572959 - RNA, 23 nt, Human
ugcaaacagagccugcaucuccc

SEQ ID NO: 572960 - RNA, 18 nt, Human
ugccaggcacaagcugcu

SEQ ID NO: 572961 - RNA, 20 nt, Human
ugccucaagaucuccggugc

SEQ ID NO: 572962 - RNA, 24 nt, Human
ugccucaagaucuccggugccuca

SEQ ID NO: 572963 - RNA, 21 nt, Human
ugccuuggccucccaaagcgc

SEQ ID NO: 572964 - RNA, 23 nt, Human
ugccuuggccucccaaagcgcua

SEQ ID NO: 572965 - RNA, 20 nt, Human
uggaucaagcacccacaagc

SEQ ID NO: 572966 - RNA, 20 nt, Human
uggcccccauauucgagccu

SEQ ID NO: 572967 - RNA, 22 nt, Human
uggcugauuucuggcauucucu

SEQ ID NO: 572968 - RNA, 20 nt, Human
ugggcacugcaucacuuuau

SEQ ID NO: 572969 - RNA, 21 nt, Human
uggucccacaguuuccuacgg

SEQ ID NO: 572970 - RNA, 22 nt, Human
uucccagccccuuuuguaccuc

SEQ ID NO: 572971 - RNA, 22 nt, Human
uucuaagagaugaggucucacu

SEQ ID NO: 572972 - RNA, 29 nt, Human
uuuuuuuuuucuaagagaugaggucucaa

SEQ ID NO: 572973 - RNA, 18 nt, Human
aaacacuaggaaacaagu

SEQ ID NO: 572974 - RNA, 24 nt, Human
aaacauaauaugauauauaauugc

SEQ ID NO: 572975 - RNA, 22 nt, Human
aagaaccccaaccuauaaccuu

SEQ ID NO: 572976 - RNA, 18 nt, Human
aaguguggcagggugacc

SEQ ID NO: 572977 - RNA, 21 nt, Human
acaacaccuuauacuaggagc

SEQ ID NO: 572978 - RNA, 21 nt, Human
acuguuaucauuauauaaucc

SEQ ID NO: 572979 - RNA, 25 nt, Human
agacauuaaaugauuacaaaacacu

SEQ ID NO: 572980 - RNA, 20 nt, Human
agauauauacuacaugugac

SEQ ID NO: 572981 - RNA, 22 nt, Human
agcaagagcaguauuaggucua

SEQ ID NO: 572982 - RNA, 20 nt, Human
caaaaaguucuaagaacccc

SEQ ID NO: 572983 - RNA, 22 nt, Human
caaacaccacauaagacuacuu

SEQ ID NO: 572984 - RNA, 23 nt, Human
cacgguagcgucgagccuuuuuu

SEQ ID NO: 572985 - RNA, 22 nt, Human
cagcgcagaccggcuuucucag

SEQ ID NO: 572986 - RNA, 19 nt, Human
ccaccgaggaacagcgcag

SEQ ID NO: 572987 - RNA, 21 nt, Human
ccgcucguuuuauucgccggc

SEQ ID NO: 572988 - RNA, 22 nt, Human
ccggccccucccgacaaccucc

SEQ ID NO: 572989 - RNA, 20 nt, Human
ccucccgacaaccucccugg

SEQ ID NO: 572990 - RNA, 21 nt, Human
ccucuaaauucuacuuccgga

SEQ ID NO: 572991 - RNA, 22 nt, Human
cuacaacccacugggaguggcu

SEQ ID NO: 572992 - RNA, 22 nt, Human
cucugaacuaaaaaggagccug

SEQ ID NO: 572993 - RNA, 24 nt, Human
cucuguuggcuguuuuuugaagaa

SEQ ID NO: 572994 - RNA, 21 nt, Human
cugacauccuaagcaaaaugu

SEQ ID NO: 572995 - RNA, 21 nt, Human
gacagacucuuaacagaagcc

SEQ ID NO: 572996 - RNA, 20 nt, Human
gcuacugacauccuaagcaa

SEQ ID NO: 572997 - RNA, 20 nt, Human
ggaaugguggcccgcaagga

SEQ ID NO: 572998 - RNA, 23 nt, Human
ggagacauuagcuuuuaaaaugu

SEQ ID NO: 572999 - RNA, 20 nt, Human
ggccaacacacaccacaaaa

SEQ ID NO: 573000 - RNA, 22 nt, Human
ggucacuuaaaguccaacuuga

SEQ ID NO: 573001 - RNA, 20 nt, Human
gucucuaacauggucucugg

SEQ ID NO: 573002 - RNA, 22 nt, Human
guguggcagggugacccaggac

SEQ ID NO: 573003 - RNA, 20 nt, Human
uaaaaaggagccugacccuu

SEQ ID NO: 573004 - RNA, 24 nt, Human
uaaaaugagcccaagugaaucauu

SEQ ID NO: 573005 - RNA, 24 nt, Human
uaaacuguuaucauuauauaaucc

SEQ ID NO: 573006 - RNA, 23 nt, Human
uaacaacaccuuauacuaggagc

SEQ ID NO: 573007 - RNA, 23 nt, Human
uaacaagcuuacuuaaaaacuaa

SEQ ID NO: 573008 - RNA, 21 nt, Human
uaagaaccccaaccuauaacc

SEQ ID NO: 573009 - RNA, 25 nt, Human
uaagaaccccaaccuauaaccuuga

SEQ ID NO: 573010 - RNA, 22 nt, Human
uaagacacagcaagagcaguau

SEQ ID NO: 573011 - RNA, 21 nt, Human
uaauaagacacagcaagagca

SEQ ID NO: 573012 - RNA, 21 nt, Human
uacaacccacugggaguggcu

SEQ ID NO: 573013 - RNA, 23 nt, Human
uaccuauacccugcaacuccggu

SEQ ID NO: 573014 - RNA, 22 nt, Human
uacuacaugugacuaaaauaag

SEQ ID NO: 573015 - RNA, 21 nt, Human
ucauucagugauuuuucacuc

SEQ ID NO: 573016 - RNA, 21 nt, Human
uccacauuaaaaauauaagau

SEQ ID NO: 573017 - RNA, 22 nt, Human
ucuaaauucuacuuccggaaug

SEQ ID NO: 573018 - RNA, 18 nt, Human
ucucugaacuaaaaagga

SEQ ID NO: 573019 - RNA, 22 nt, Human
ucugagucgcucuaggccaaca

SEQ ID NO: 573020 - RNA, 21 nt, Human
ucuguaacaacaccuuauacu

SEQ ID NO: 573021 - RNA, 20 nt, Human
ugacaaugaacugcucugaa

SEQ ID NO: 573022 - RNA, 23 nt, Human
ugaguauuaaucuuuaaugcauu

SEQ ID NO: 573023 - RNA, 21 nt, Human
ugccacagaaacacuaggaaa

SEQ ID NO: 573024 - RNA, 24 nt, Human
ugccacagaaacacuaggaaacaa

SEQ ID NO: 573025 - RNA, 18 nt, Human
uggcugcagacauuaaau

SEQ ID NO: 573026 - RNA, 21 nt, Human
uggucacuuaaaguccaacuu

SEQ ID NO: 573027 - RNA, 18 nt, Human
uuaacagaagcccugagg

SEQ ID NO: 573028 - RNA, 21 nt, Human
uuaacagaagcccugaggcuc

SEQ ID NO: 573029 - RNA, 22 nt, Human
uuacaauuaaaucauucaguga

SEQ ID NO: 573030 - RNA, 19 nt, Human
uucagugauuuuucacuca

SEQ ID NO: 573031 - RNA, 22 nt, Human
uucucagacagacucuuaacag

SEQ ID NO: 573032 - RNA, 25 nt, Human
uuuacaauuaaaucauucagugauu

SEQ ID NO: 573033 - RNA, 22 nt, Human
uuugucucuguuggcuguuuuu

SEQ ID NO: 573034 - RNA, 24 nt, Human
aaagcuaacggaggaauacucaca

SEQ ID NO: 573035 - RNA, 18 nt, Human
aaccugcucuuucucccu

SEQ ID NO: 573036 - RNA, 19 nt, Human
aaccugcucuuucucccug

SEQ ID NO: 573037 - RNA, 24 nt, Human
aagagaaaacaucacugaaaaaga

SEQ ID NO: 573038 - RNA, 23 nt, Human
aagagacaggguggggccccuca

SEQ ID NO: 573039 - RNA, 21 nt, Human
aagcagauacucccaaccuua

SEQ ID NO: 573040 - RNA, 23 nt, Human
agaagagaaaacaucacugaaaa

SEQ ID NO: 573041 - RNA, 21 nt, Human
agggagaagagaaaacaucac

SEQ ID NO: 573042 - RNA, 21 nt, Human
agggugcucuguggaggaugg

SEQ ID NO: 573043 - RNA, 21 nt, Human
aguuugggcuacuucugugcu

SEQ ID NO: 573044 - RNA, 23 nt, Human
auggagcuugggggauucuuucc

SEQ ID NO: 573045 - RNA, 22 nt, Human
cacaaccccuacucaggacagg

SEQ ID NO: 573046 - RNA, 19 nt, Human
cacccaccuguuuggggcu

SEQ ID NO: 573047 - RNA, 20 nt, Human
cauagcucuaagagaugggu

SEQ ID NO: 573048 - RNA, 19 nt, Human
caucacccacccugcggcc

SEQ ID NO: 573049 - RNA, 19 nt, Human
ccacaugccucagggagcu

SEQ ID NO: 573050 - RNA, 20 nt, Human
ccagaggcgguugcuccuuc

SEQ ID NO: 573051 - RNA, 21 nt, Human
ccagaggcgguugcuccuucu

SEQ ID NO: 573052 - RNA, 19 nt, Human
ccaggaagguguggacaag

SEQ ID NO: 573053 - RNA, 18 nt, Human
ccugcaaggucugugggu

SEQ ID NO: 573054 - RNA, 21 nt, Human
ccugcaaggucuguggguucu

SEQ ID NO: 573055 - RNA, 20 nt, Human
cgaccaauggcaaaggccuu

SEQ ID NO: 573056 - RNA, 20 nt, Human
cucaagacuuugccuaaaau

SEQ ID NO: 573057 - RNA, 23 nt, Human
cuccugaggaagcuaccacuggc

SEQ ID NO: 573058 - RNA, 18 nt, Human
cuggcaggggaggaggca

SEQ ID NO: 573059 - RNA, 23 nt, Human
cugggagaggaggagggguccuc

SEQ ID NO: 573060 - RNA, 23 nt, Human
cuggggauggaggaggagaggga

SEQ ID NO: 573061 - RNA, 18 nt, Human
gacagguucauggugggg

SEQ ID NO: 573062 - RNA, 22 nt, Human
gacggcccuuggcuucagagcc

SEQ ID NO: 573063 - RNA, 23 nt, Human
gagcuggaggaaacugagcggcu

SEQ ID NO: 573064 - RNA, 21 nt, Human
gaggagggguccucuaugaug

SEQ ID NO: 573065 - RNA, 18 nt, Human
gaggcgguugcuccuucu

SEQ ID NO: 573066 - RNA, 21 nt, Human
gcaaaggccuuguguucccug

SEQ ID NO: 573067 - RNA, 18 nt, Human
gcagagggaagaguuugg

SEQ ID NO: 573068 - RNA, 18 nt, Human
gcccuuggcuucagagcc

SEQ ID NO: 573069 - RNA, 27 nt, Human
ggaaagaggcugacagguucauggugg

SEQ ID NO: 573070 - RNA, 24 nt, Human
ggacuggauuugagcuguccagag

SEQ ID NO: 573071 - RNA, 21 nt, Human
ggauuugagcuguccagaggu

SEQ ID NO: 573072 - RNA, 24 nt, Human
ggcaggggaggaggcagaggaaag

SEQ ID NO: 573073 - RNA, 21 nt, Human
ggcugcggagacacgugagca

SEQ ID NO: 573074 - RNA, 28 nt, Human
ggggauggaggaggagagggaugcccag

SEQ ID NO: 573075 - RNA, 18 nt, Human
gguggggccccucaaggc

SEQ ID NO: 573076 - RNA, 23 nt, Human
uaagaauggccccauagcucuaa

SEQ ID NO: 573077 - RNA, 20 nt, Human
ucagagccgggcuggcaccg

SEQ ID NO: 573078 - RNA, 19 nt, Human
uccacggcacugccaggac

SEQ ID NO: 573079 - RNA, 21 nt, Human
uccacggcacugccaggacug

SEQ ID NO: 573080 - RNA, 21 nt, Human
uccugaggaagcuaccacugg

SEQ ID NO: 573081 - RNA, 19 nt, Human
ucuaccgacucucuucacc

SEQ ID NO: 573082 - RNA, 24 nt, Human
ucucuggguagucacgcuagggcu

SEQ ID NO: 573083 - RNA, 19 nt, Human
ucugaccagcccagcccac

SEQ ID NO: 573084 - RNA, 21 nt, Human
ugaaaaagaaggugucgggga

SEQ ID NO: 573085 - RNA, 20 nt, Human
ugacagguucaugguggggg

SEQ ID NO: 573086 - RNA, 22 nt, Human
ugagaacugggagaggaggagg

SEQ ID NO: 573087 - RNA, 23 nt, Human
ugagcggcucucacgcuuacuca

SEQ ID NO: 573088 - RNA, 18 nt, Human
uggaagaggauguccgga

SEQ ID NO: 573089 - RNA, 20 nt, Human
uggaagaggauguccggaug

SEQ ID NO: 573090 - RNA, 19 nt, Human
uggaggaggagagggaugc

SEQ ID NO: 573091 - RNA, 19 nt, Human
uggcaggggaggaggcaga

SEQ ID NO: 573092 - RNA, 20 nt, Human
uggcaggggaggaggcagag

SEQ ID NO: 573093 - RNA, 23 nt, Human
uggcaggggaggaggcagaggaa

SEQ ID NO: 573094 - RNA, 22 nt, Human
uggccaggcuccugaggaagcu

SEQ ID NO: 573095 - RNA, 23 nt, Human
ugggaaagaggcugacagguuca

SEQ ID NO: 573096 - RNA, 18 nt, Human
ugggaaaugucuauuagc

SEQ ID NO: 573097 - RNA, 19 nt, Human
ugggagaggaggagggguc

SEQ ID NO: 573098 - RNA, 21 nt, Human
ugggagaggaggagggguccu

SEQ ID NO: 573099 - RNA, 21 nt, Human
uggggauggaggaggagaggg

SEQ ID NO: 573100 - RNA, 20 nt, Human
uuagcuuaggacucuucuca

SEQ ID NO: 573101 - RNA, 22 nt, Human
uucccgagccggcugcggagac

SEQ ID NO: 573102 - RNA, 25 nt, Human
uucucagccuucuccaucacccacc

SEQ ID NO: 573103 - RNA, 18 nt, Human
uucugaccagcccagccc

SEQ ID NO: 573104 - RNA, 18 nt, Human
uuugaugaaagagacagg

SEQ ID NO: 573105 - RNA, 18 nt, Human
uuuguaaacauuagaccu

SEQ ID NO: 573106 - RNA, 19 nt, Human
aaacaaaccaaccacugug

SEQ ID NO: 573107 - RNA, 19 nt, Human
aagcaugauuaaaccagug

SEQ ID NO: 573108 - RNA, 19 nt, Human
acccugaagcauauuaugg

SEQ ID NO: 573109 - RNA, 25 nt, Human
agaauucagugaaaaccugcuccca

SEQ ID NO: 573110 - RNA, 24 nt, Human
agaccaucagcauauacaacauca

SEQ ID NO: 573111 - RNA, 19 nt, Human
auguggauacccugugugc

SEQ ID NO: 573112 - RNA, 22 nt, Human
cacacgccgaggacugcagagc

SEQ ID NO: 573113 - RNA, 20 nt, Human
caccuucuuucucuuucccc

SEQ ID NO: 573114 - RNA, 25 nt, Human
caccuucuuucucuuuccccugccc

SEQ ID NO: 573115 - RNA, 23 nt, Human
cagugggggggccacaguuugcc

SEQ ID NO: 573116 - RNA, 24 nt, Human
ccagcaaggcuaacuaaaucaaac

SEQ ID NO: 573117 - RNA, 22 nt, Human
ccccagccaagcugcccggggc

SEQ ID NO: 573118 - RNA, 22 nt, Human
ccccggaagccuagccccagcc

SEQ ID NO: 573119 - RNA, 21 nt, Human
ccccugcccaggcccuaaguu

SEQ ID NO: 573120 - RNA, 23 nt, Human
cccucagaauucagugaaaaccu

SEQ ID NO: 573121 - RNA, 23 nt, Human
cuaacucaacaauguagcugcag

SEQ ID NO: 573122 - RNA, 19 nt, Human
cuuucucuuuccccugccc

SEQ ID NO: 573123 - RNA, 19 nt, Human
gcccaugaaagccacaaag

SEQ ID NO: 573124 - RNA, 20 nt, Human
gcccuaaguuaggguuccca

SEQ ID NO: 573125 - RNA, 19 nt, Human
gccuuggaggacaugcaga

SEQ ID NO: 573126 - RNA, 23 nt, Human
uaaaaacaaaacaaaccaaccac

SEQ ID NO: 573127 - RNA, 18 nt, Human
uaaaccagugcagaaaaa

SEQ ID NO: 573128 - RNA, 20 nt, Human
uaacaaagacuucuggucag

SEQ ID NO: 573129 - RNA, 24 nt, Human
uaacuaaaucaaacugugguuuaa

SEQ ID NO: 573130 - RNA, 19 nt, Human
uacaacaucaucacuaacu

SEQ ID NO: 573131 - RNA, 19 nt, Human
ucaccuucuuucucuuucc

SEQ ID NO: 573132 - RNA, 22 nt, Human
ucccugcccaugaaagccacaa

SEQ ID NO: 573133 - RNA, 19 nt, Human
ucucucaccuucuuucucu

SEQ ID NO: 573134 - RNA, 23 nt, Human
ugaaagccacaaagagauuucuu

SEQ ID NO: 573135 - RNA, 21 nt, Human
ugacagugggggggccacagu

SEQ ID NO: 573136 - RNA, 24 nt, Human
ugcaggguaacauguggauacccu

SEQ ID NO: 573137 - RNA, 21 nt, Human
ugccuuggaggacaugcagag

SEQ ID NO: 573138 - RNA, 27 nt, Human
uguagcugcaggguaacauguggauac

SEQ ID NO: 573139 - RNA, 19 nt, Human
uuugccaaacuuugccuug

SEQ ID NO: 573140 - RNA, 21 nt, Human
uuuguaauccaguuaagacca

SEQ ID NO: 573141 - RNA, 18 nt, Human
uuuuacacacccugaagc

SEQ ID NO: 573142 - RNA, 24 nt, Human
aacagaauuuuccuuaaaguggag

SEQ ID NO: 573143 - RNA, 24 nt, Human
aaccaauucuccugccccagccuc

SEQ ID NO: 573144 - RNA, 20 nt, Human
aacuuuuuuuuuuuuuuaaa

SEQ ID NO: 573145 - RNA, 19 nt, Human
aagugaaaccagucacaaa

SEQ ID NO: 573146 - RNA, 18 nt, Human
aagugcugggauuacagg

SEQ ID NO: 573147 - RNA, 19 nt, Human
aagugcugggauuacaggc

SEQ ID NO: 573148 - RNA, 19 nt, Human
aagugcugggauuacaggc

SEQ ID NO: 573149 - RNA, 23 nt, Human
aagugcugggauuacaggcguga

SEQ ID NO: 573150 - RNA, 26 nt, Human
aagugcugggauuacaggcgugagcc

SEQ ID NO: 573151 - RNA, 24 nt, Human
aauuuuguauuuuuaguagagaug

SEQ ID NO: 573152 - RNA, 22 nt, Human
acucuuguugcccaggcuggag

SEQ ID NO: 573153 - RNA, 20 nt, Human
acugcaacucccggcauguc

SEQ ID NO: 573154 - RNA, 25 nt, Human
aggcuggagugcaguggcacaaucu

SEQ ID NO: 573155 - RNA, 24 nt, Human
aggugauccgccugccuuggccuc

SEQ ID NO: 573156 - RNA, 23 nt, Human
aguagcugggauuacaggcaugu

SEQ ID NO: 573157 - RNA, 20 nt, Human
agucacaaaaggacaaauac

SEQ ID NO: 573158 - RNA, 20 nt, Human
agugcaguggcacaaucucg

SEQ ID NO: 573159 - RNA, 24 nt, Human
agugcaguggcacaaucucggcuc

SEQ ID NO: 573160 - RNA, 18 nt, Human
agugcugggauuacaggc

SEQ ID NO: 573161 - RNA, 20 nt, Human
augggguuucuccauguuug

SEQ ID NO: 573162 - RNA, 21 nt, Human
augggguuucuccauguuugu

SEQ ID NO: 573163 - RNA, 24 nt, Human
augggguuucuccauguuugucag

SEQ ID NO: 573164 - RNA, 18 nt, Human
augugccaccacgcccag

SEQ ID NO: 573165 - RNA, 21 nt, Human
caaacagaauuuuccuuaaag

SEQ ID NO: 573166 - RNA, 20 nt, Human
caaccuccgccuccuggguu

SEQ ID NO: 573167 - RNA, 24 nt, Human
caagugcugggauuacaggcguga

SEQ ID NO: 573168 - RNA, 24 nt, Human
cacucuuguugcccaggcuggagu

SEQ ID NO: 573169 - RNA, 21 nt, Human
cacugcaaccuccgccuccug

SEQ ID NO: 573170 - RNA, 23 nt, Human
cacugcaaccuccgccuccuggg

SEQ ID NO: 573171 - RNA, 20 nt, Human
cagccuccugaguagcuggg

SEQ ID NO: 573172 - RNA, 22 nt, Human
caucaguuccuucugaagcccu

SEQ ID NO: 573173 - RNA, 24 nt, Human
caucuuaaagacuuuaugcuaagu

SEQ ID NO: 573174 - RNA, 19 nt, Human
ccaagugcugggauuacag

SEQ ID NO: 573175 - RNA, 21 nt, Human
ccaagugcugggauuacaggc

SEQ ID NO: 573176 - RNA, 24 nt, Human
ccaagugcugggauuacaggcgug

SEQ ID NO: 573177 - RNA, 21 nt, Human
ccaauucuccugccccagccu

SEQ ID NO: 573178 - RNA, 20 nt, Human
ccaccacgcccagcuaauuu

SEQ ID NO: 573179 - RNA, 18 nt, Human
ccaccaugcccggcugca

SEQ ID NO: 573180 - RNA, 22 nt, Human
ccaguaauuacgaagggucaca

SEQ ID NO: 573181 - RNA, 22 nt, Human
cccaagugcugggauuacaggc

SEQ ID NO: 573182 - RNA, 24 nt, Human
cccaagugcugggauuacaggcgu

SEQ ID NO: 573183 - RNA, 24 nt, Human
ccgccuccuggguucaaccaauuc

SEQ ID NO: 573184 - RNA, 18 nt, Human
ccucccaagugcugggau

SEQ ID NO: 573185 - RNA, 19 nt, Human
ccuccgccuccuggguuca

SEQ ID NO: 573186 - RNA, 24 nt, Human
ccuccuggguucaaccaauucucc

SEQ ID NO: 573187 - RNA, 18 nt, Human
ccugaccucaggugaucc

SEQ ID NO: 573188 - RNA, 21 nt, Human
ccugaccucaggugauccgcc

SEQ ID NO: 573189 - RNA, 23 nt, Human
ccugaccucaggugauccgccug

SEQ ID NO: 573190 - RNA, 23 nt, Human
ccugaguagcugggauuacaggc

SEQ ID NO: 573191 - RNA, 24 nt, Human
ccugaguagcugggauuacaggca

SEQ ID NO: 573192 - RNA, 23 nt, Human
ccugccccagccuccugaguagc

SEQ ID NO: 573193 - RNA, 24 nt, Human
ccugccccagccuccugaguagcu

SEQ ID NO: 573194 - RNA, 21 nt, Human
ccugccuuggccucccaagug

SEQ ID NO: 573195 - RNA, 23 nt, Human
ccugccuuggccucccaagugcu

SEQ ID NO: 573196 - RNA, 23 nt, Human
ccuggguucaaccaauucuccug

SEQ ID NO: 573197 - RNA, 24 nt, Human
cgaaacacuggaaacauggaugca

SEQ ID NO: 573198 - RNA, 18 nt, Human
cgccuccuggguucaacc

SEQ ID NO: 573199 - RNA, 24 nt, Human
cuaaaaaaaccgaaacacuggaaa

SEQ ID NO: 573200 - RNA, 24 nt, Human
cuaauuuuguauuuuuaguagaga

SEQ ID NO: 573201 - RNA, 24 nt, Human
cucacugcaaccuccgccuccugg

SEQ ID NO: 573202 - RNA, 20 nt, Human
cucccggcauguccccuuua

SEQ ID NO: 573203 - RNA, 26 nt, Human
cuccugaccucaggugauccgccugc

SEQ ID NO: 573204 - RNA, 21 nt, Human
cuccuggguucaaccaauucu

SEQ ID NO: 573205 - RNA, 18 nt, Human
cucuuguugcccaggcug

SEQ ID NO: 573206 - RNA, 23 nt, Human
cugaguagcugggauuacaggca

SEQ ID NO: 573207 - RNA, 24 nt, Human
cugaguagcugggauuacaggcau

SEQ ID NO: 573208 - RNA, 24 nt, Human
cugcaaccuccgccuccuggguuc

SEQ ID NO: 573209 - RNA, 23 nt, Human
cuuggccucccaagugcugggau

SEQ ID NO: 573210 - RNA, 24 nt, Human
cuuguugcccaggcuggagugcag

SEQ ID NO: 573211 - RNA, 19 nt, Human
gaaaaaggacuaaauguua

SEQ ID NO: 573212 - RNA, 22 nt, Human
gaaacacuggaaacauggaugc

SEQ ID NO: 573213 - RNA, 26 nt, Human
gaagaagccaauauggaaaaaggacu

SEQ ID NO: 573214 - RNA, 23 nt, Human
gaccucaggugauccgccugccu

SEQ ID NO: 573215 - RNA, 22 nt, Human
gagacagaguuucacucuuguu

SEQ ID NO: 573216 - RNA, 18 nt, Human
gagaugggguuucuccau

SEQ ID NO: 573217 - RNA, 24 nt, Human
gagaugggguuucuccauguuugu

SEQ ID NO: 573218 - RNA, 22 nt, Human
gaguagcugggauuacaggcau

SEQ ID NO: 573219 - RNA, 25 nt, Human
gaguagcugggauuacaggcaugug

SEQ ID NO: 573220 - RNA, 18 nt, Human
gauuacaggcaugugcca

SEQ ID NO: 573221 - RNA, 18 nt, Human
gauuacaggcgugagcca

SEQ ID NO: 573222 - RNA, 21 nt, Human
gauuacaggcgugagccacca

SEQ ID NO: 573223 - RNA, 24 nt, Human
gauuacaggcgugagccaccaugc

SEQ ID NO: 573224 - RNA, 19 nt, Human
gcccaggcuggagugcagu

SEQ ID NO: 573225 - RNA, 20 nt, Human
gcccaggcuggagugcagug

SEQ ID NO: 573226 - RNA, 19 nt, Human
gcgugagccaccaugcccg

SEQ ID NO: 573227 - RNA, 19 nt, Human
gcuggagugcaguggcaca

SEQ ID NO: 573228 - RNA, 23 nt, Human
gcugguguuuaacuccugaccuc

SEQ ID NO: 573229 - RNA, 18 nt, Human
ggaagauggaaaacuucu

SEQ ID NO: 573230 - RNA, 20 nt, Human
ggaucacacagugaagaaaa

SEQ ID NO: 573231 - RNA, 19 nt, Human
ggauuacaggcaugugcca

SEQ ID NO: 573232 - RNA, 24 nt, Human
ggauuacaggcgugagccaccaug

SEQ ID NO: 573233 - RNA, 24 nt, Human
ggcugguguuuaacuccugaccuc

SEQ ID NO: 573234 - RNA, 21 nt, Human
gggaucacacagugaagaaaa

SEQ ID NO: 573235 - RNA, 21 nt, Human
ggggaaggggagguggggagu

SEQ ID NO: 573236 - RNA, 20 nt, Human
guagcugggauuacaggcau

SEQ ID NO: 573237 - RNA, 26 nt, Human
gucacauuuuuguucagcuuugcccc

SEQ ID NO: 573238 - RNA, 25 nt, Human
uaaaaaaaccgaaacacuggaaaca

SEQ ID NO: 573239 - RNA, 24 nt, Human
uaaaagacaaccaguuuuaagaac

SEQ ID NO: 573240 - RNA, 22 nt, Human
uaaauguuaaaaaaaaaaaaaa

SEQ ID NO: 573241 - RNA, 24 nt, Human
uaagaacacugucaggcaagcuac

SEQ ID NO: 573242 - RNA, 19 nt, Human
uaagugaaaccagucacaa

SEQ ID NO: 573243 - RNA, 24 nt, Human
uacaggcaugugccaccacgccca

SEQ ID NO: 573244 - RNA, 23 nt, Human
uacaggcgugagccaccaugccc

SEQ ID NO: 573245 - RNA, 24 nt, Human
uaguagagaugggguuucuccaug

SEQ ID NO: 573246 - RNA, 23 nt, Human
ucacucuuguugcccaggcugga

SEQ ID NO: 573247 - RNA, 23 nt, Human
ucacugcaaccuccgccuccugg

SEQ ID NO: 573248 - RNA, 24 nt, Human
ucacugcaaccuccgccuccuggg

SEQ ID NO: 573249 - RNA, 25 nt, Human
ucacugcaaccuccgccuccugggu

SEQ ID NO: 573250 - RNA, 18 nt, Human
ucaguuccuucugaagcc

SEQ ID NO: 573251 - RNA, 22 nt, Human
ucaucaguuccuucugaagccc

SEQ ID NO: 573252 - RNA, 25 nt, Human
uccaugacaaugacuucuuccugag

SEQ ID NO: 573253 - RNA, 27 nt, Human
uccauguccaugacaaugacuucuucc

SEQ ID NO: 573254 - RNA, 23 nt, Human
ucccaagugcugggauuacaggc

SEQ ID NO: 573255 - RNA, 24 nt, Human
ucccaagugcugggauuacaggcg

SEQ ID NO: 573256 - RNA, 24 nt, Human
uccugaguagcugggauuacaggc

SEQ ID NO: 573257 - RNA, 21 nt, Human
uccuggguucaaccaauucuc

SEQ ID NO: 573258 - RNA, 24 nt, Human
uccuggguucaaccaauucuccug

SEQ ID NO: 573259 - RNA, 22 nt, Human
uccuugacuccaugcuuagcuc

SEQ ID NO: 573260 - RNA, 28 nt, Human
ucuaaaaaaaccgaaacacuggaaacaa

SEQ ID NO: 573261 - RNA, 23 nt, Human
ucucauggaaguccaaguucauc

SEQ ID NO: 573262 - RNA, 24 nt, Human
ucuccugccccagccuccugagua

SEQ ID NO: 573263 - RNA, 19 nt, Human
ucucgguugaggacaauca

SEQ ID NO: 573264 - RNA, 22 nt, Human
ucuuguugcccaggcuggagug

SEQ ID NO: 573265 - RNA, 18 nt, Human
ugaccucaggugauccgc

SEQ ID NO: 573266 - RNA, 24 nt, Human
ugaccucaggugauccgccugccu

SEQ ID NO: 573267 - RNA, 18 nt, Human
ugagaaauaugaguagug

SEQ ID NO: 573268 - RNA, 20 nt, Human
ugaggguacugcaacucccg

SEQ ID NO: 573269 - RNA, 22 nt, Human
ugcaguggcacaaucucggcuc

SEQ ID NO: 573270 - RNA, 18 nt, Human
ugcauauuuaaaaauggg

SEQ ID NO: 573271 - RNA, 18 nt, Human
ugcccaggcuggagugca

SEQ ID NO: 573272 - RNA, 21 nt, Human
ugcccaggcuggagugcagug

SEQ ID NO: 573273 - RNA, 22 nt, Human
ugcccaggcuggagugcagugg

SEQ ID NO: 573274 - RNA, 24 nt, Human
ugcccaggcuggagugcaguggca

SEQ ID NO: 573275 - RNA, 24 nt, Human
ugccccagccuccugaguagcugg

SEQ ID NO: 573276 - RNA, 24 nt, Human
ugcugggauuacaggcgugagcca

SEQ ID NO: 573277 - RNA, 24 nt, Human
ugcuuagcucuuucagacuuccca

SEQ ID NO: 573278 - RNA, 18 nt, Human
uggaaaaaggacuaaaug

SEQ ID NO: 573279 - RNA, 25 nt, Human
uggaaaaaggacuaaauguuaaaaa

SEQ ID NO: 573280 - RNA, 23 nt, Human
uggagugcaguggcacaaucucg

SEQ ID NO: 573281 - RNA, 24 nt, Human
uggagugcaguggcacaaucucgg

SEQ ID NO: 573282 - RNA, 24 nt, Human
uggcacaaucucggcucacugcaa

SEQ ID NO: 573283 - RNA, 20 nt, Human
uggcuggacaacaaugagaa

SEQ ID NO: 573284 - RNA, 22 nt, Human
uggcuguugcuaggggaagggg

SEQ ID NO: 573285 - RNA, 18 nt, Human
ugggauuacaggcaugug

SEQ ID NO: 573286 - RNA, 21 nt, Human
ugggauuacaggcaugugcca

SEQ ID NO: 573287 - RNA, 22 nt, Human
ugggauuacaggcaugugccac

SEQ ID NO: 573288 - RNA, 24 nt, Human
ugggauuacaggcaugugccacca

SEQ ID NO: 573289 - RNA, 18 nt, Human
ugggauuacaggcgugag

SEQ ID NO: 573290 - RNA, 22 nt, Human
ugggauuacaggcgugagccac

SEQ ID NO: 573291 - RNA, 23 nt, Human
ugggauuacaggcgugagccacc

SEQ ID NO: 573292 - RNA, 24 nt, Human
ugggauuacaggcgugagccacca

SEQ ID NO: 573293 - RNA, 25 nt, Human
ugggauuacaggcgugagccaccau

SEQ ID NO: 573294 - RNA, 20 nt, Human
uggguucaaccaauucuccu

SEQ ID NO: 573295 - RNA, 21 nt, Human
uguauuuuuaguagagauggg

SEQ ID NO: 573296 - RNA, 23 nt, Human
ugucaggcugguguuuaacuccu

SEQ ID NO: 573297 - RNA, 24 nt, Human
uguccaugacaaugacuucuuccu

SEQ ID NO: 573298 - RNA, 19 nt, Human
ugugaggcucucuucucuu

SEQ ID NO: 573299 - RNA, 21 nt, Human
uuaaaaaaaaaaaaagccaac

SEQ ID NO: 573300 - RNA, 22 nt, Human
uuaaaaaaaaaaaaagccaacu

SEQ ID NO: 573301 - RNA, 18 nt, Human
uuaguagagaugggguuu

SEQ ID NO: 573302 - RNA, 24 nt, Human
uuaguagagaugggguuucuccau

SEQ ID NO: 573303 - RNA, 24 nt, Human
uucacucuuguugcccaggcugga

SEQ ID NO: 573304 - RNA, 23 nt, Human
uuguauuuuuaguagagaugggg

SEQ ID NO: 573305 - RNA, 22 nt, Human
uuguucagcuuugcccagugcu

SEQ ID NO: 573306 - RNA, 24 nt, Human
uuucacucuuguugcccaggcugg

SEQ ID NO: 573307 - RNA, 21 nt, Human
uuucuaaaaaaaccgaaacac

SEQ ID NO: 573308 - RNA, 19 nt, Human
uuuuguauuuuuaguagag

SEQ ID NO: 573309 - RNA, 20 nt, Human
uuuuguauuuuuaguagaga

SEQ ID NO: 573310 - RNA, 22 nt, Human
uuuuuaguagagaugggguuuc

SEQ ID NO: 573311 - RNA, 19 nt, Human
aaaaaaaaaaaacagagac

SEQ ID NO: 573312 - RNA, 20 nt, Human
aaacugaagauggaaagggu

SEQ ID NO: 573313 - RNA, 23 nt, Human
aaagaaaaccuaacgggcucagg

SEQ ID NO: 573314 - RNA, 18 nt, Human
aagcaggagaaucgcuug

SEQ ID NO: 573315 - RNA, 22 nt, Human
aagcaggagaaucgcuugaacc

SEQ ID NO: 573316 - RNA, 23 nt, Human
acagcacaagccucuucuguaca

SEQ ID NO: 573317 - RNA, 21 nt, Human
acaguuauaccacuuugcacc

SEQ ID NO: 573318 - RNA, 26 nt, Human
accagguuaaaaaaaaaaaacagaga

SEQ ID NO: 573319 - RNA, 18 nt, Human
acgcacagucagggccca

SEQ ID NO: 573320 - RNA, 21 nt, Human
acuccaggccgacugccugau

SEQ ID NO: 573321 - RNA, 23 nt, Human
agcagguggcaccuguucccucc

SEQ ID NO: 573322 - RNA, 23 nt, Human
agcaguggacgcacagucagggc

SEQ ID NO: 573323 - RNA, 24 nt, Human
agcccuagcucugcaagagccuug

SEQ ID NO: 573324 - RNA, 22 nt, Human
aggcagggcucaacucugacgg

SEQ ID NO: 573325 - RNA, 21 nt, Human
aggccuccugcugcugcccca

SEQ ID NO: 573326 - RNA, 24 nt, Human
aggcugaagcaggagaaucgcuug

SEQ ID NO: 573327 - RNA, 26 nt, Human
agggaaguuguggggaugaccuucgg

SEQ ID NO: 573328 - RNA, 21 nt, Human
agggauggcucugggcagagc

SEQ ID NO: 573329 - RNA, 21 nt, Human
aguacacagcccgccugccuu

SEQ ID NO: 573330 - RNA, 19 nt, Human
agucagggcccaguacaca

SEQ ID NO: 573331 - RNA, 18 nt, Human
auguaaauacauauacac

SEQ ID NO: 573332 - RNA, 22 nt, Human
auucccuggcccagggcaggca

SEQ ID NO: 573333 - RNA, 22 nt, Human
auuugcacacaguuauaccacc

SEQ ID NO: 573334 - RNA, 26 nt, Human
cacacaguuauaccacuuugcaccac

SEQ ID NO: 573335 - RNA, 19 nt, Human
cacagcccgccugccuuuc

SEQ ID NO: 573336 - RNA, 22 nt, Human
caccaagaaaagaaaaccuaac

SEQ ID NO: 573337 - RNA, 23 nt, Human
caccaagaaaagaaaaccuaacg

SEQ ID NO: 573338 - RNA, 24 nt, Human
caccacagcacaagccucuucugu

SEQ ID NO: 573339 - RNA, 20 nt, Human
caccaccaagaaaagaaaac

SEQ ID NO: 573340 - RNA, 23 nt, Human
caccuguucccuccugccaccca

SEQ ID NO: 573341 - RNA, 25 nt, Human
cacuguuuugaaguguaaugcccca

SEQ ID NO: 573342 - RNA, 21 nt, Human
cagacuccaggccgacugccu

SEQ ID NO: 573343 - RNA, 24 nt, Human
cagagcaugucguugaggcacuuu

SEQ ID NO: 573344 - RNA, 19 nt, Human
cagaggacauuuggagucc

SEQ ID NO: 573345 - RNA, 22 nt, Human
cagcaaggauggccugugacug

SEQ ID NO: 573346 - RNA, 20 nt, Human
caggccuccugcugcugccc

SEQ ID NO: 573347 - RNA, 18 nt, Human
cagggaaaaugucucccc

SEQ ID NO: 573348 - RNA, 20 nt, Human
cagggaaaaugucuccccca

SEQ ID NO: 573349 - RNA, 21 nt, Human
cagggauaaaucgaacccacc

SEQ ID NO: 573350 - RNA, 24 nt, Human
cauuuggaguccccaauauuuuuc

SEQ ID NO: 573351 - RNA, 22 nt, Human
ccaccaagaaaagaaaaccuaa

SEQ ID NO: 573352 - RNA, 23 nt, Human
ccagcagguggcaccuguucccu

SEQ ID NO: 573353 - RNA, 19 nt, Human
ccagguuaaaaaaaaaaaa

SEQ ID NO: 573354 - RNA, 18 nt, Human
cccccaggccuccugcug

SEQ ID NO: 573355 - RNA, 19 nt, Human
ccccggcauggccuucccu

SEQ ID NO: 573356 - RNA, 25 nt, Human
ccccuucagagcccuagcucugcaa

SEQ ID NO: 573357 - RNA, 18 nt, Human
ccccuugggcugauuucu

SEQ ID NO: 573358 - RNA, 20 nt, Human
cccgggguccagagcccagg

SEQ ID NO: 573359 - RNA, 22 nt, Human
cccgggguccagagcccagggc

SEQ ID NO: 573360 - RNA, 22 nt, Human
cccuucucagcaaggcucucug

SEQ ID NO: 573361 - RNA, 22 nt, Human
ccgcucggagcgaccgcggcag

SEQ ID NO: 573362 - RNA, 23 nt, Human
ccucaucugugacauucucucug

SEQ ID NO: 573363 - RNA, 20 nt, Human
ccuccugccacccaccuuau

SEQ ID NO: 573364 - RNA, 19 nt, Human
ccuccugcugcugccccag

SEQ ID NO: 573365 - RNA, 21 nt, Human
ccucgugugcccgggguccag

SEQ ID NO: 573366 - RNA, 23 nt, Human
ccugggagucguucaaacugaag

SEQ ID NO: 573367 - RNA, 22 nt, Human
ccuguaaucccagcuacuccgg

SEQ ID NO: 573368 - RNA, 23 nt, Human
ccuguaaucccagcuacuccgga

SEQ ID NO: 573369 - RNA, 28 nt, Human
ccugugacuggaggacagaccggggucc

SEQ ID NO: 573370 - RNA, 26 nt, Human
ccuuguuaugccaaggcaaugcuaaa

SEQ ID NO: 573371 - RNA, 23 nt, Human
cucaugaaaccucccuggcgggg

SEQ ID NO: 573372 - RNA, 22 nt, Human
cuccaggccgacugccugauuu

SEQ ID NO: 573373 - RNA, 20 nt, Human
cuccauugcccaugcucucc

SEQ ID NO: 573374 - RNA, 21 nt, Human
cucccuagaguguuuucucuu

SEQ ID NO: 573375 - RNA, 24 nt, Human
cucugggcagagccguugccuucc

SEQ ID NO: 573376 - RNA, 24 nt, Human
cugaagauggaaagggugagaagg

SEQ ID NO: 573377 - RNA, 18 nt, Human
cugccuuucgugugauug

SEQ ID NO: 573378 - RNA, 18 nt, Human
cuguacaaaaagugugug

SEQ ID NO: 573379 - RNA, 24 nt, Human
cuucccucuugugcuuuggggcag

SEQ ID NO: 573380 - RNA, 18 nt, Human
gaagagaccagccgcugc

SEQ ID NO: 573381 - RNA, 21 nt, Human
gaccucaaaccuccuauuugc

SEQ ID NO: 573382 - RNA, 22 nt, Human
gagcagcaaggauggccuguga

SEQ ID NO: 573383 - RNA, 22 nt, Human
gagcagcuucagcccaaucccu

SEQ ID NO: 573384 - RNA, 22 nt, Human
gaggacgugcacuggguucugc

SEQ ID NO: 573385 - RNA, 25 nt, Human
gcaccuguucccuccugccacccac

SEQ ID NO: 573386 - RNA, 19 nt, Human
gcccaugcucucccugccu

SEQ ID NO: 573387 - RNA, 18 nt, Human
gcucuucuccugcuuuuc

SEQ ID NO: 573388 - RNA, 22 nt, Human
gcuggguguguuggcacgugcc

SEQ ID NO: 573389 - RNA, 19 nt, Human
ggaaguuguggggaugggg

SEQ ID NO: 573390 - RNA, 22 nt, Human
ggaaguuguggggauggggugg

SEQ ID NO: 573391 - RNA, 22 nt, Human
ggaggacgugcacuggguucug

SEQ ID NO: 573392 - RNA, 23 nt, Human
ggagucguucaaacugaagaugg

SEQ ID NO: 573393 - RNA, 19 nt, Human
ggaugcugcugccaguagc

SEQ ID NO: 573394 - RNA, 21 nt, Human
ggcagggauaaaucgaaccca

SEQ ID NO: 573395 - RNA, 18 nt, Human
gggaaguagcaaaaggga

SEQ ID NO: 573396 - RNA, 21 nt, Human
gggagcagcaaggauggccug

SEQ ID NO: 573397 - RNA, 24 nt, Human
gggaucauuggugggucuccauug

SEQ ID NO: 573398 - RNA, 20 nt, Human
ggggaucauuggugggucuc

SEQ ID NO: 573399 - RNA, 25 nt, Human
ggggaucauuggugggucuccauug

SEQ ID NO: 573400 - RNA, 20 nt, Human
gguuggggaucauugguggg

SEQ ID NO: 573401 - RNA, 18 nt, Human
guggagcagcuucagccc

SEQ ID NO: 573402 - RNA, 22 nt, Human
gugggcucuucuccugcuuuuc

SEQ ID NO: 573403 - RNA, 21 nt, Human
guggggauggggugggcaggg

SEQ ID NO: 573404 - RNA, 24 nt, Human
guuggcacgugccuguaaucccag

SEQ ID NO: 573405 - RNA, 24 nt, Human
uaaauacauauacacauaugugug

SEQ ID NO: 573406 - RNA, 22 nt, Human
uaaggagccauucccuggccca

SEQ ID NO: 573407 - RNA, 26 nt, Human
uaaggagccauucccuggcccagggc

SEQ ID NO: 573408 - RNA, 20 nt, Human
uacauauacacauaugugug

SEQ ID NO: 573409 - RNA, 18 nt, Human
uagccuggugagguaggg

SEQ ID NO: 573410 - RNA, 25 nt, Human
uauacacauauguguguauauuaca

SEQ ID NO: 573411 - RNA, 32 nt, Human
uauauguaaauacauauacacauauguguggc

SEQ ID NO: 573412 - RNA, 26 nt, Human
uauguaaauacauauacacauaugug

SEQ ID NO: 573413 - RNA, 21 nt, Human
ucagcccaaucccuccauccu

SEQ ID NO: 573414 - RNA, 23 nt, Human
ucagcccaaucccuccauccucc

SEQ ID NO: 573415 - RNA, 19 nt, Human
ucagcccaggcagggcuca

SEQ ID NO: 573416 - RNA, 28 nt, Human
ucccuccauccucccaccaccgggcaaa

SEQ ID NO: 573417 - RNA, 19 nt, Human
ucccucuugugcuuugggg

SEQ ID NO: 573418 - RNA, 22 nt, Human
ucccucuugugcuuuggggcag

SEQ ID NO: 573419 - RNA, 24 nt, Human
ucuccauugcccaugcucucccug

SEQ ID NO: 573420 - RNA, 19 nt, Human
ucuccugcuuuucacugaa

SEQ ID NO: 573421 - RNA, 18 nt, Human
ucucugcaaaugucacaa

SEQ ID NO: 573422 - RNA, 24 nt, Human
ucucugggcagccuucacuggccc

SEQ ID NO: 573423 - RNA, 20 nt, Human
ucucuugcucucccccuugg

SEQ ID NO: 573424 - RNA, 21 nt, Human
ucuugagcaccuucagccaga

SEQ ID NO: 573425 - RNA, 23 nt, Human
ucuugcucucccccuugggcuga

SEQ ID NO: 573426 - RNA, 24 nt, Human
ugaagcaggagaaucgcuugaacc

SEQ ID NO: 573427 - RNA, 24 nt, Human
ugaggcacuuuuguacccagaggc

SEQ ID NO: 573428 - RNA, 22 nt, Human
ugagguggagcagcuucagccc

SEQ ID NO: 573429 - RNA, 24 nt, Human
ugaugugcucucgggaugcugcug

SEQ ID NO: 573430 - RNA, 26 nt, Human
ugcaccaccaagaaaagaaaaccuaa

SEQ ID NO: 573431 - RNA, 22 nt, Human
ugcacuggguucugcuaugugc

SEQ ID NO: 573432 - RNA, 18 nt, Human
ugcagugggcucuucucc

SEQ ID NO: 573433 - RNA, 20 nt, Human
ugcagugggcucuucuccug

SEQ ID NO: 573434 - RNA, 21 nt, Human
ugccugauuuuccuccccccc

SEQ ID NO: 573435 - RNA, 19 nt, Human
ugccuguaaucccagcuac

SEQ ID NO: 573436 - RNA, 24 nt, Human
ugccuguaaucccagcuacuccgg

SEQ ID NO: 573437 - RNA, 19 nt, Human
ugcugcugccccaggugga

SEQ ID NO: 573438 - RNA, 24 nt, Human
ugcuuuaccugcccccuucucagc

SEQ ID NO: 573439 - RNA, 23 nt, Human
uggaaaauaccugcaggaagagc

SEQ ID NO: 573440 - RNA, 22 nt, Human
uggaguccccaauauuuuuccu

SEQ ID NO: 573441 - RNA, 18 nt, Human
uggcacagcagauggaaa

SEQ ID NO: 573442 - RNA, 21 nt, Human
uggcacgugccuguaauccca

SEQ ID NO: 573443 - RNA, 20 nt, Human
uggcccagggcaggcagcca

SEQ ID NO: 573444 - RNA, 23 nt, Human
uggcccagggcaggcagccaggu

SEQ ID NO: 573445 - RNA, 23 nt, Human
uggcggggagggggcaggggcag

SEQ ID NO: 573446 - RNA, 22 nt, Human
uggcuggguguguuggcacgug

SEQ ID NO: 573447 - RNA, 19 nt, Human
ugggauuuccagagcaugu

SEQ ID NO: 573448 - RNA, 24 nt, Human
ugggauuuccagagcaugucguug

SEQ ID NO: 573449 - RNA, 21 nt, Human
ugggcugauuucuaaaggguc

SEQ ID NO: 573450 - RNA, 18 nt, Human
uguacaaaaagugugugu

SEQ ID NO: 573451 - RNA, 22 nt, Human
uguccagcagguggcaccuguu

SEQ ID NO: 573452 - RNA, 24 nt, Human
uguguguauaucauucugaauagu

SEQ ID NO: 573453 - RNA, 24 nt, Human
uguuggcacgugccuguaauccca

SEQ ID NO: 573454 - RNA, 19 nt, Human
uuagauaucaaccucagac

SEQ ID NO: 573455 - RNA, 22 nt, Human
uuaugccaaggcaaugcuaaaa

SEQ ID NO: 573456 - RNA, 24 nt, Human
uucagcccaaucccuccauccucc

SEQ ID NO: 573457 - RNA, 23 nt, Human
uuccagagcaugucguugaggca

SEQ ID NO: 573458 - RNA, 23 nt, Human
uucccuccccuucagagcccuag

SEQ ID NO: 573459 - RNA, 21 nt, Human
uucuguggcagaucaaccugg

SEQ ID NO: 573460 - RNA, 18 nt, Human
uugcucucccccuugggc

SEQ ID NO: 573461 - RNA, 23 nt, Human
uuggaccucaaaccuccuauuug

SEQ ID NO: 573462 - RNA, 21 nt, Human
uuggcacgugccuguaauccc

SEQ ID NO: 573463 - RNA, 22 nt, Human
uugggcugauuucuaaaggguc

SEQ ID NO: 573464 - RNA, 21 nt, Human
uuggggaaguagcaaaaggga

SEQ ID NO: 573465 - RNA, 23 nt, Human
aaagugcucgauuauagguguga

SEQ ID NO: 573466 - RNA, 23 nt, Human
aacucucagucucaagcaacccu

SEQ ID NO: 573467 - RNA, 19 nt, Human
aagagggaaaggaaagagg

SEQ ID NO: 573468 - RNA, 24 nt, Human
aagugauccuccugucuuggccuc

SEQ ID NO: 573469 - RNA, 23 nt, Human
aaugacaaccagaacuuauuuuu

SEQ ID NO: 573470 - RNA, 23 nt, Human
acaccaccaugucuggcucauuu

SEQ ID NO: 573471 - RNA, 18 nt, Human
accugggaaggaaggccc

SEQ ID NO: 573472 - RNA, 21 nt, Human
acgucaguguccugaguagcu

SEQ ID NO: 573473 - RNA, 21 nt, Human
agacagaaggcagaaagcauc

SEQ ID NO: 573474 - RNA, 24 nt, Human
agacagaaggcagaaagcaucaag

SEQ ID NO: 573475 - RNA, 20 nt, Human
aggaaggcccacuaggcaag

SEQ ID NO: 573476 - RNA, 21 nt, Human
aggcuggagugcaguggggca

SEQ ID NO: 573477 - RNA, 19 nt, Human
aggugagggcaggauuccu

SEQ ID NO: 573478 - RNA, 23 nt, Human
aguagcuggaacuacaggcaugc

SEQ ID NO: 573479 - RNA, 23 nt, Human
agugcaguggggcauucauggcu

SEQ ID NO: 573480 - RNA, 23 nt, Human
agugccguggugcauucacagcu

SEQ ID NO: 573481 - RNA, 19 nt, Human
aguggcugggacuacaggc

SEQ ID NO: 573482 - RNA, 21 nt, Human
aguggcugggacuacaggcau

SEQ ID NO: 573483 - RNA, 19 nt, Human
aucauacuaaagagaagac

SEQ ID NO: 573484 - RNA, 23 nt, Human
aucgcagccuccaacucucaguc

SEQ ID NO: 573485 - RNA, 22 nt, Human
caagcgauccuccugccucagc

SEQ ID NO: 573486 - RNA, 27 nt, Human
caagcgauccuccugccucagccuucu

SEQ ID NO: 573487 - RNA, 22 nt, Human
caagugauccuccugucuuggc

SEQ ID NO: 573488 - RNA, 27 nt, Human
caagugauccuccugucuuggccuccc

SEQ ID NO: 573489 - RNA, 23 nt, Human
caccaugucuggcucauuucuuc

SEQ ID NO: 573490 - RNA, 21 nt, Human
cacucugagaacuuacccagg

SEQ ID NO: 573491 - RNA, 23 nt, Human
cacuucccugggcaaguuggaaa

SEQ ID NO: 573492 - RNA, 21 nt, Human
caggaucuugcuacauugccc

SEQ ID NO: 573493 - RNA, 24 nt, Human
caggaucuugcuacauugcccagg

SEQ ID NO: 573494 - RNA, 21 nt, Human
caguggggcauucauggcuca

SEQ ID NO: 573495 - RNA, 18 nt, Human
caucaagcucucuguuua

SEQ ID NO: 573496 - RNA, 23 nt, Human
caucaccugagacagaaggcaga

SEQ ID NO: 573497 - RNA, 20 nt, Human
ccaaagugcucgauuauagg

SEQ ID NO: 573498 - RNA, 23 nt, Human
ccaaagugcucgauuauaggugu

SEQ ID NO: 573499 - RNA, 20 nt, Human
ccacccguggacagcuggau

SEQ ID NO: 573500 - RNA, 25 nt, Human
ccagaacuuauuuuuuuugagaugg

SEQ ID NO: 573501 - RNA, 20 nt, Human
cccuaauuucuuuccucauu

SEQ ID NO: 573502 - RNA, 23 nt, Human
ccguggugcccagccgacaacca

SEQ ID NO: 573503 - RNA, 20 nt, Human
ccucagccuucugaguggcu

SEQ ID NO: 573504 - RNA, 24 nt, Human
ccuccugccucagccuucugagug

SEQ ID NO: 573505 - RNA, 26 nt, Human
ccuccugucuuggccucccaaagugc

SEQ ID NO: 573506 - RNA, 18 nt, Human
ccugagacagaaggcaga

SEQ ID NO: 573507 - RNA, 24 nt, Human
ccugccucagccuucugaguggcu

SEQ ID NO: 573508 - RNA, 18 nt, Human
ccuggccucaagugaucc

SEQ ID NO: 573509 - RNA, 21 nt, Human
ccuggccucaagugauccucc

SEQ ID NO: 573510 - RNA, 22 nt, Human
ccuggccucaagugauccuccu

SEQ ID NO: 573511 - RNA, 23 nt, Human
ccuggccucaagugauccuccug

SEQ ID NO: 573512 - RNA, 22 nt, Human
ccugucuuggccucccaaagug

SEQ ID NO: 573513 - RNA, 24 nt, Human
ccugucuuggccucccaaagugcu

SEQ ID NO: 573514 - RNA, 18 nt, Human
ccuuggguaucuucugca

SEQ ID NO: 573515 - RNA, 25 nt, Human
cgcccaggcuggagugcaguggggc

SEQ ID NO: 573516 - RNA, 24 nt, Human
cguucugucgcccaggcuggagug

SEQ ID NO: 573517 - RNA, 20 nt, Human
cuaaagagaagacaggaaaa

SEQ ID NO: 573518 - RNA, 21 nt, Human
cucaagcaacccuccuacguc

SEQ ID NO: 573519 - RNA, 26 nt, Human
cucaagcaacccuccuacgucagugu

SEQ ID NO: 573520 - RNA, 20 nt, Human
cucaagcgauccuccugccu

SEQ ID NO: 573521 - RNA, 24 nt, Human
cucaagcgauccuccugccucagc

SEQ ID NO: 573522 - RNA, 24 nt, Human
cucagccuucugaguggcugggac

SEQ ID NO: 573523 - RNA, 20 nt, Human
cucaucgcagccuccaacuc

SEQ ID NO: 573524 - RNA, 24 nt, Human
cucguucugucgcccaggcuggag

SEQ ID NO: 573525 - RNA, 19 nt, Human
cucuguuuaucccaauuca

SEQ ID NO: 573526 - RNA, 23 nt, Human
cuuggucucaagcgauccuccug

SEQ ID NO: 573527 - RNA, 21 nt, Human
gaaaaggacaggacccgcaga

SEQ ID NO: 573528 - RNA, 19 nt, Human
gacaagagggaaaggaaag

SEQ ID NO: 573529 - RNA, 24 nt, Human
gacuacaggcauacaccaccaugu

SEQ ID NO: 573530 - RNA, 23 nt, Human
gagaagacaggaaaacaccagua

SEQ ID NO: 573531 - RNA, 24 nt, Human
gaguggcugggacuacaggcauac

SEQ ID NO: 573532 - RNA, 24 nt, Human
gccucagccuucugaguggcuggg

SEQ ID NO: 573533 - RNA, 24 nt, Human
gcgauccuccugccucagccuucu

SEQ ID NO: 573534 - RNA, 18 nt, Human
ggaaggaaggcccacuag

SEQ ID NO: 573535 - RNA, 24 nt, Human
ggacuacaggcauacaccaccaug

SEQ ID NO: 573536 - RNA, 19 nt, Human
ggccucaagugauccuccu

SEQ ID NO: 573537 - RNA, 24 nt, Human
ggccucaagugauccuccugucuu

SEQ ID NO: 573538 - RNA, 22 nt, Human
gggucucguucugucgcccagg

SEQ ID NO: 573539 - RNA, 21 nt, Human
guagagacaggaucuugcuac

SEQ ID NO: 573540 - RNA, 18 nt, Human
gugcucgauuauaggugu

SEQ ID NO: 573541 - RNA, 21 nt, Human
uacaggcaugcaccaccacac

SEQ ID NO: 573542 - RNA, 21 nt, Human
uacccagggugacucagcugu

SEQ ID NO: 573543 - RNA, 22 nt, Human
uagagacaggaucuugcuacau

SEQ ID NO: 573544 - RNA, 29 nt, Human
ucaaugacaaccagaacuuauuuuuuuug

SEQ ID NO: 573545 - RNA, 23 nt, Human
ucagccuucugaguggcugggac

SEQ ID NO: 573546 - RNA, 24 nt, Human
ucaucgcagccuccaacucucagu

SEQ ID NO: 573547 - RNA, 22 nt, Human
ucccaaagugcucgauuauagg

SEQ ID NO: 573548 - RNA, 23 nt, Human
ucccugggcaaguuggaaaaggg

SEQ ID NO: 573549 - RNA, 24 nt, Human
uccugaguagcuggaacuacaggc

SEQ ID NO: 573550 - RNA, 23 nt, Human
ucgcccaggcuggagugcagugg

SEQ ID NO: 573551 - RNA, 24 nt, Human
ucguucugucgcccaggcuggagu

SEQ ID NO: 573552 - RNA, 23 nt, Human
ucucguucugucgcccaggcugg

SEQ ID NO: 573553 - RNA, 24 nt, Human
ucucguucugucgcccaggcugga

SEQ ID NO: 573554 - RNA, 23 nt, Human
ucugaguggcugggacuacaggc

SEQ ID NO: 573555 - RNA, 24 nt, Human
ucugaguggcugggacuacaggca

SEQ ID NO: 573556 - RNA, 24 nt, Human
ucugucgcccaggcuggagugcag

SEQ ID NO: 573557 - RNA, 23 nt, Human
ucuuguuuuguugccuaggcuug

SEQ ID NO: 573558 - RNA, 20 nt, Human
ugagacaaaaucauccuucc

SEQ ID NO: 573559 - RNA, 22 nt, Human
ugagauggggucucguucuguc

SEQ ID NO: 573560 - RNA, 18 nt, Human
ugccuaggcuugucucag

SEQ ID NO: 573561 - RNA, 24 nt, Human
ugccucagccuucugaguggcugg

SEQ ID NO: 573562 - RNA, 19 nt, Human
ugcuacauugcccaggcuu

SEQ ID NO: 573563 - RNA, 21 nt, Human
uggaacuacaggcaugcacca

SEQ ID NO: 573564 - RNA, 24 nt, Human
uggaacuacaggcaugcaccacca

SEQ ID NO: 573565 - RNA, 19 nt, Human
uggaaggaagagcaacugg

SEQ ID NO: 573566 - RNA, 21 nt, Human
uggagauggcacacagagggc

SEQ ID NO: 573567 - RNA, 24 nt, Human
uggagauggcacacagagggcuug

SEQ ID NO: 573568 - RNA, 19 nt, Human
uggagugcaguggggcauu

SEQ ID NO: 573569 - RNA, 24 nt, Human
uggagugcaguggggcauucaugg

SEQ ID NO: 573570 - RNA, 18 nt, Human
uggccucaagugauccuc

SEQ ID NO: 573571 - RNA, 20 nt, Human
uggccucaagugauccuccu

SEQ ID NO: 573572 - RNA, 24 nt, Human
uggccucaagugauccuccugucu

SEQ ID NO: 573573 - RNA, 24 nt, Human
uggcucaucgcagccuccaacucu

SEQ ID NO: 573574 - RNA, 21 nt, Human
ugggacuacaggcauacacca

SEQ ID NO: 573575 - RNA, 24 nt, Human
ugggacuacaggcauacaccacca

SEQ ID NO: 573576 - RNA, 24 nt, Human
uggggucucguucugucgcccagg

SEQ ID NO: 573577 - RNA, 24 nt, Human
uggucucaagcgauccuccugccu

SEQ ID NO: 573578 - RNA, 23 nt, Human
ugucucuaguggagacugagggg

SEQ ID NO: 573579 - RNA, 21 nt, Human
uguuuuguugccuaggcuugu

SEQ ID NO: 573580 - RNA, 23 nt, Human
uuaaacuuuuuguagagacagag

SEQ ID NO: 573581 - RNA, 21 nt, Human
uugagauggggucucguucug

SEQ ID NO: 573582 - RNA, 24 nt, Human
uugagggaucauacuaaagagaag

SEQ ID NO: 573583 - RNA, 18 nt, Human
uugcccaggcuugagugc

SEQ ID NO: 573584 - RNA, 23 nt, Human
uugcccaggcuugagugccgugg

SEQ ID NO: 573585 - RNA, 24 nt, Human
uugcccaggcuugagugccguggu

SEQ ID NO: 573586 - RNA, 19 nt, Human
uuguagagacagagucuug

SEQ ID NO: 573587 - RNA, 24 nt, Human
uuguagagacaggaucuugcuaca

SEQ ID NO: 573588 - RNA, 20 nt, Human
uuuguagagacagagucuug

SEQ ID NO: 573589 - RNA, 23 nt, Human
uuuuggaccuuggguaucuucug

SEQ ID NO: 573590 - RNA, 18 nt, Human
uuuuuugagauggggucu

SEQ ID NO: 573591 - RNA, 22 nt, Human
aagcaauuuucaaaagcagaaa

SEQ ID NO: 573592 - RNA, 24 nt, Human
acaagcaauuuucaaaagcagaaa

SEQ ID NO: 573593 - RNA, 21 nt, Human
acuaaaaucaaacaugcauca

SEQ ID NO: 573594 - RNA, 30 nt, Human
cagaaacucacauucauaaaacuuuauacc

SEQ ID NO: 573595 - RNA, 19 nt, Human
cggcuaacaucgaagccau

SEQ ID NO: 573596 - RNA, 21 nt, Human
uacaagcaauuuucaaaagca

SEQ ID NO: 573597 - RNA, 24 nt, Human
uacuacuaaaaucaaacaugcauc

SEQ ID NO: 573598 - RNA, 24 nt, Human
ucauccuaaaacacuuugcaaugc

SEQ ID NO: 573599 - RNA, 20 nt, Human
aaaaaaauaaauaaaaacua

SEQ ID NO: 573600 - RNA, 25 nt, Human
aaaaaugcauauuccugggccccau

SEQ ID NO: 573601 - RNA, 23 nt, Human
aaaauagcagcaccuguggagga

SEQ ID NO: 573602 - RNA, 22 nt, Human
aaacaggagccggagcucacaa

SEQ ID NO: 573603 - RNA, 21 nt, Human
aaagaagagaaauggaagggc

SEQ ID NO: 573604 - RNA, 18 nt, Human
aaagcuaaacaggagccg

SEQ ID NO: 573605 - RNA, 21 nt, Human
aacaaacaaacacuuaaagca

SEQ ID NO: 573606 - RNA, 18 nt, Human
aacuacuaaagaacuagc

SEQ ID NO: 573607 - RNA, 28 nt, Human
aagcaagagcuaaaaaaaaagggacccc

SEQ ID NO: 573608 - RNA, 19 nt, Human
accgucacaccaaaauaaa

SEQ ID NO: 573609 - RNA, 25 nt, Human
agaaaagccaauuugaaauguuuaa

SEQ ID NO: 573610 - RNA, 20 nt, Human
agcaagagcuaaaaaaaaaa

SEQ ID NO: 573611 - RNA, 20 nt, Human
aggauaaagaacauucuaau

SEQ ID NO: 573612 - RNA, 27 nt, Human
caaaauagcagcaccuguggaggagcc

SEQ ID NO: 573613 - RNA, 18 nt, Human
caaagcaggugacagagc

SEQ ID NO: 573614 - RNA, 23 nt, Human
caccaaaauaaaacaugcgcuaa

SEQ ID NO: 573615 - RNA, 25 nt, Human
caccaaaauaaaacaugcgcuaaug

SEQ ID NO: 573616 - RNA, 21 nt, Human
cacgacaccagcaaauacaua

SEQ ID NO: 573617 - RNA, 22 nt, Human
cagaagaaaguccuuuuccguc

SEQ ID NO: 573618 - RNA, 22 nt, Human
cagccugaggaaaguccguguu

SEQ ID NO: 573619 - RNA, 18 nt, Human
cagggcaggaaugcacuu

SEQ ID NO: 573620 - RNA, 24 nt, Human
ccaauauuuacacgacaccagcaa

SEQ ID NO: 573621 - RNA, 22 nt, Human
ccagggcaggaaugcacuuucc

SEQ ID NO: 573622 - RNA, 21 nt, Human
ccccauccccaaauuuggguu

SEQ ID NO: 573623 - RNA, 19 nt, Human
ccguguuuaggagggccaa

SEQ ID NO: 573624 - RNA, 20 nt, Human
cgucacaccaaaauaaaaca

SEQ ID NO: 573625 - RNA, 22 nt, Human
cuagcauuuuccgguauuguag

SEQ ID NO: 573626 - RNA, 18 nt, Human
cucacaaaauagcagcac

SEQ ID NO: 573627 - RNA, 28 nt, Human
cuccaaguacaguugagggacaacuuac

SEQ ID NO: 573628 - RNA, 21 nt, Human
cugagguuagaaccggggucc

SEQ ID NO: 573629 - RNA, 21 nt, Human
cuuuuggucccaccgguggcc

SEQ ID NO: 573630 - RNA, 18 nt, Human
gaaauguuuaacuacuaa

SEQ ID NO: 573631 - RNA, 20 nt, Human
gaauacagcugagguugaac

SEQ ID NO: 573632 - RNA, 21 nt, Human
gaauuuaugugcuuacaucua

SEQ ID NO: 573633 - RNA, 18 nt, Human
gacacuguugggauggcu

SEQ ID NO: 573634 - RNA, 20 nt, Human
gacauaggaaaaggucaccu

SEQ ID NO: 573635 - RNA, 18 nt, Human
gaccccaaauaaguuuuc

SEQ ID NO: 573636 - RNA, 22 nt, Human
ggaaauacagaaggagaaaagc

SEQ ID NO: 573637 - RNA, 18 nt, Human
ggaagaaaacagaagaaa

SEQ ID NO: 573638 - RNA, 20 nt, Human
ggaagaaaacagaagaaagg

SEQ ID NO: 573639 - RNA, 20 nt, Human
ggcacaugagcagaauacuu

SEQ ID NO: 573640 - RNA, 18 nt, Human
gggggcacaugagcagaa

SEQ ID NO: 573641 - RNA, 18 nt, Human
ggguagaccccaaauaag

SEQ ID NO: 573642 - RNA, 20 nt, Human
gguauggaaauacagaagga

SEQ ID NO: 573643 - RNA, 23 nt, Human
ggucaccagggcaggaaugcacu

SEQ ID NO: 573644 - RNA, 18 nt, Human
guggcucucaugcaaacc

SEQ ID NO: 573645 - RNA, 21 nt, Human
uaaaaaaaaaauuuccauuua

SEQ ID NO: 573646 - RNA, 19 nt, Human
uaaaacaugcgcuaaugga

SEQ ID NO: 573647 - RNA, 19 nt, Human
uaaacaggagccggagcuc

SEQ ID NO: 573648 - RNA, 23 nt, Human
uaaagaacauucuaauaaaaaaa

SEQ ID NO: 573649 - RNA, 23 nt, Human
uaaauaaaaacuagcauuuuccg

SEQ ID NO: 573650 - RNA, 21 nt, Human
uacuuuugggggcacaugagc

SEQ ID NO: 573651 - RNA, 21 nt, Human
uagcacggucaaagaagagaa

SEQ ID NO: 573652 - RNA, 19 nt, Human
uaggaagcacuacuuaaaa

SEQ ID NO: 573653 - RNA, 23 nt, Human
ucacaaaauagcagcaccugugg

SEQ ID NO: 573654 - RNA, 23 nt, Human
ucuugaaccagccugaggaaagu

SEQ ID NO: 573655 - RNA, 21 nt, Human
ugaaaaugcccuggggacccu

SEQ ID NO: 573656 - RNA, 23 nt, Human
ugaagggugucaaauuguuguga

SEQ ID NO: 573657 - RNA, 18 nt, Human
ugacagagcacacuuugg

SEQ ID NO: 573658 - RNA, 19 nt, Human
ugacagagcacacuuuggg

SEQ ID NO: 573659 - RNA, 21 nt, Human
ugacagagcacacuuugggaa

SEQ ID NO: 573660 - RNA, 24 nt, Human
ugacagagcacacuuugggaagca

SEQ ID NO: 573661 - RNA, 20 nt, Human
ugagauaacaaacaaacacu

SEQ ID NO: 573662 - RNA, 19 nt, Human
ugagcagaauacuuugugg

SEQ ID NO: 573663 - RNA, 21 nt, Human
ugcaaaccauuuaggaagcac

SEQ ID NO: 573664 - RNA, 23 nt, Human
ugccaugaaaaugcccuggggac

SEQ ID NO: 573665 - RNA, 25 nt, Human
ugcccuggggacccucugacgacac

SEQ ID NO: 573666 - RNA, 20 nt, Human
ugcuuacaucuauacagaaa

SEQ ID NO: 573667 - RNA, 19 nt, Human
uggaaauacagaaggagaa

SEQ ID NO: 573668 - RNA, 18 nt, Human
uggagugggggcagaggg

SEQ ID NO: 573669 - RNA, 24 nt, Human
ugggaagcacugcuggaguggggg

SEQ ID NO: 573670 - RNA, 23 nt, Human
ugggaagggcagaugacuuuuua

SEQ ID NO: 573671 - RNA, 18 nt, Human
ugggggcagagggguacu

SEQ ID NO: 573672 - RNA, 22 nt, Human
ugggguagaccccaaauaaguu

SEQ ID NO: 573673 - RNA, 23 nt, Human
ugguauggaaauacagaaggaga

SEQ ID NO: 573674 - RNA, 19 nt, Human
uggucucagagugcuuguc

SEQ ID NO: 573675 - RNA, 20 nt, Human
aaaaauguccauucuuggcc

SEQ ID NO: 573676 - RNA, 20 nt, Human
aaaguuuucccaaauagcac

SEQ ID NO: 573677 - RNA, 19 nt, Human
aacauggugagacccuguc

SEQ ID NO: 573678 - RNA, 20 nt, Human
aacauggugagacccugucu

SEQ ID NO: 573679 - RNA, 28 nt, Human
acagagcaagacucugucugucucaaaa

SEQ ID NO: 573680 - RNA, 19 nt, Human
acccagugggguugugauu

SEQ ID NO: 573681 - RNA, 24 nt, Human
acggagaaaaagcugucgggcgac

SEQ ID NO: 573682 - RNA, 24 nt, Human
acugcacuccagccugggugacag

SEQ ID NO: 573683 - RNA, 26 nt, Human
acugcacuccagccugggugacagag

SEQ ID NO: 573684 - RNA, 18 nt, Human
agaaaaagcugucgggcg

SEQ ID NO: 573685 - RNA, 24 nt, Human
agagcuugcagugacccgagauug

SEQ ID NO: 573686 - RNA, 20 nt, Human
agcaagggaaaagaucucga

SEQ ID NO: 573687 - RNA, 24 nt, Human
agcacuuugggaggccgaggucgg

SEQ ID NO: 573688 - RNA, 24 nt, Human
agccugggugacagagcaagacuc

SEQ ID NO: 573689 - RNA, 23 nt, Human
agcugggcaugguggcaggugcc

SEQ ID NO: 573690 - RNA, 21 nt, Human
aggcagagcuugcagugaccc

SEQ ID NO: 573691 - RNA, 24 nt, Human
aggcagagcuugcagugacccgag

SEQ ID NO: 573692 - RNA, 21 nt, Human
aggcaggagaauggcaugaac

SEQ ID NO: 573693 - RNA, 24 nt, Human
aggcaggagaauggcaugaacuug

SEQ ID NO: 573694 - RNA, 21 nt, Human
aggccgaggucggcggaucac

SEQ ID NO: 573695 - RNA, 24 nt, Human
aggcgcaguggcucacgccuguaa

SEQ ID NO: 573696 - RNA, 19 nt, Human
aggcugaggcaggagaaug

SEQ ID NO: 573697 - RNA, 24 nt, Human
aggucggcggaucacgaggucaga

SEQ ID NO: 573698 - RNA, 19 nt, Human
aguagguaaggccccagga

SEQ ID NO: 573699 - RNA, 24 nt, Human
aguggcucacgccuguaauuccag

SEQ ID NO: 573700 - RNA, 21 nt, Human
auguagccucucagggugcua

SEQ ID NO: 573701 - RNA, 21 nt, Human
auuaagaccauucagccaaga

SEQ ID NO: 573702 - RNA, 24 nt, Human
auugcgccacugcacuccagccug

SEQ ID NO: 573703 - RNA, 25 nt, Human
auuuacauuugcugccaccuuuaau

SEQ ID NO: 573704 - RNA, 21 nt, Human
auuuuugauauacaaaacuua

SEQ ID NO: 573705 - RNA, 23 nt, Human
caacucgcauacuacggagaaaa

SEQ ID NO: 573706 - RNA, 24 nt, Human
caagaccauccuggcuaacauggu

SEQ ID NO: 573707 - RNA, 25 nt, Human
caagcacaaaauccaugggauaccu

SEQ ID NO: 573708 - RNA, 20 nt, Human
caagucuaagucuaggaaau

SEQ ID NO: 573709 - RNA, 24 nt, Human
cacgccuguaauuccagcacuuug

SEQ ID NO: 573710 - RNA, 22 nt, Human
cacuccagccugggugacagag

SEQ ID NO: 573711 - RNA, 23 nt, Human
cacuccagccugggugacagagc

SEQ ID NO: 573712 - RNA, 19 nt, Human
cacugcacuccagccuggg

SEQ ID NO: 573713 - RNA, 19 nt, Human
cacugcacuccagccuggg

SEQ ID NO: 573714 - RNA, 22 nt, Human
cacugcacuccagccuggguga

SEQ ID NO: 573715 - RNA, 23 nt, Human
cacugcacuccagccugggugac

SEQ ID NO: 573716 - RNA, 24 nt, Human
cacugcacuccagccugggugaca

SEQ ID NO: 573717 - RNA, 24 nt, Human
cacugcacuccagccugggugaca

SEQ ID NO: 573718 - RNA, 18 nt, Human
cacugugccucuaaucaa

SEQ ID NO: 573719 - RNA, 25 nt, Human
cagcacuuugggaggccgaggucgg

SEQ ID NO: 573720 - RNA, 24 nt, Human
cagcuacuugggaggcugaggcag

SEQ ID NO: 573721 - RNA, 19 nt, Human
cagcugccugcccacucgc

SEQ ID NO: 573722 - RNA, 20 nt, Human
caugguggcaggugccugua

SEQ ID NO: 573723 - RNA, 22 nt, Human
caugguggcaggugccuguagu

SEQ ID NO: 573724 - RNA, 19 nt, Human
ccaagcacaaaauccaugg

SEQ ID NO: 573725 - RNA, 20 nt, Human
ccaccuuuaauagcacugau

SEQ ID NO: 573726 - RNA, 20 nt, Human
ccacugcacuccagccuggg

SEQ ID NO: 573727 - RNA, 20 nt, Human
ccacugcacuccagccuggg

SEQ ID NO: 573728 - RNA, 21 nt, Human
ccacugcacuccagccugggu

SEQ ID NO: 573729 - RNA, 21 nt, Human
ccacugcacuccagccugggu

SEQ ID NO: 573730 - RNA, 23 nt, Human
ccacugcacuccagccuggguga

SEQ ID NO: 573731 - RNA, 24 nt, Human
ccacugcacuccagccugggugac

SEQ ID NO: 573732 - RNA, 20 nt, Human
cccugagcucugccuguacc

SEQ ID NO: 573733 - RNA, 22 nt, Human
ccugcccacucgcucuuuucuu

SEQ ID NO: 573734 - RNA, 22 nt, Human
ccuggcuaacauggugagaccc

SEQ ID NO: 573735 - RNA, 22 nt, Human
ccuggcuaacauggugagaccc

SEQ ID NO: 573736 - RNA, 23 nt, Human
ccuggcuaacauggugagacccu

SEQ ID NO: 573737 - RNA, 22 nt, Human
ccugggugacagagcaagacuc

SEQ ID NO: 573738 - RNA, 22 nt, Human
ccuguaauuccagcacuuuggg

SEQ ID NO: 573739 - RNA, 22 nt, Human
ccuguaccauggcuuccaggag

SEQ ID NO: 573740 - RNA, 21 nt, Human
ccuguagucccagcuacuugg

SEQ ID NO: 573741 - RNA, 20 nt, Human
ccuuucuucuccaccccgca

SEQ ID NO: 573742 - RNA, 27 nt, Human
cgaggucggcggaucacgaggucagau

SEQ ID NO: 573743 - RNA, 26 nt, Human
cgccacugcacuccagccugggugac

SEQ ID NO: 573744 - RNA, 23 nt, Human
cgccuguaauuccagcacuuugg

SEQ ID NO: 573745 - RNA, 22 nt, Human
cggcggaucacgaggucagauc

SEQ ID NO: 573746 - RNA, 20 nt, Human
cucaaaaaaaaaaaguccau

SEQ ID NO: 573747 - RNA, 21 nt, Human
cucaaaaaaaaaaaguccauc

SEQ ID NO: 573748 - RNA, 24 nt, Human
cucacgccuguaauuccagcacuu

SEQ ID NO: 573749 - RNA, 23 nt, Human
cuccaccccgcaucuacccgguu

SEQ ID NO: 573750 - RNA, 18 nt, Human
cucgagccgccuccugga

SEQ ID NO: 573751 - RNA, 24 nt, Human
cucuacugaaaaaaaaaaaauuag

SEQ ID NO: 573752 - RNA, 21 nt, Human
cugccaccuuuaauagcacug

SEQ ID NO: 573753 - RNA, 20 nt, Human
cugcccacucgcucuuuucu

SEQ ID NO: 573754 - RNA, 22 nt, Human
cugcugcugcugcuucugcaaa

SEQ ID NO: 573755 - RNA, 24 nt, Human
cuggcuaacauggugagacccugu

SEQ ID NO: 573756 - RNA, 21 nt, Human
cuugcagugacccgagauugc

SEQ ID NO: 573757 - RNA, 24 nt, Human
cuuggccaggcgcaguggcucacg

SEQ ID NO: 573758 - RNA, 18 nt, Human
gaacagcucgagccgccu

SEQ ID NO: 573759 - RNA, 20 nt, Human
gaacuugggaggcagagcuu

SEQ ID NO: 573760 - RNA, 23 nt, Human
gagauugcgccacugcacuccag

SEQ ID NO: 573761 - RNA, 18 nt, Human
gagcuugcagugacccga

SEQ ID NO: 573762 - RNA, 24 nt, Human
gcacuccagccugggugacagagc

SEQ ID NO: 573763 - RNA, 19 nt, Human
gccacugcacuccagccug

SEQ ID NO: 573764 - RNA, 24 nt, Human
gccacugcacuccagccuggguga

SEQ ID NO: 573765 - RNA, 20 nt, Human
gcgcaguggcucacgccugu

SEQ ID NO: 573766 - RNA, 24 nt, Human
gcuaacauggugagacccugucuc

SEQ ID NO: 573767 - RNA, 19 nt, Human
ggcaugaacuugggaggca

SEQ ID NO: 573768 - RNA, 18 nt, Human
ggcggaucacgaggucag

SEQ ID NO: 573769 - RNA, 23 nt, Human
gucaaacaugacccagugggguu

SEQ ID NO: 573770 - RNA, 27 nt, Human
gucuucugcugcugcugcuucugcaaa

SEQ ID NO: 573771 - RNA, 24 nt, Human
guuguacugcgguggaaucccagg

SEQ ID NO: 573772 - RNA, 22 nt, Human
uaacauggugagacccugucuc

SEQ ID NO: 573773 - RNA, 24 nt, Human
uaacauggugagacccugucucua

SEQ ID NO: 573774 - RNA, 18 nt, Human
uaaggguuuuuaauguuu

SEQ ID NO: 573775 - RNA, 21 nt, Human
uacgaacagcucgagccgccu

SEQ ID NO: 573776 - RNA, 23 nt, Human
uacugaaaaaaaaaaaauuagcu

SEQ ID NO: 573777 - RNA, 19 nt, Human
uagguaagcuuauauggca

SEQ ID NO: 573778 - RNA, 25 nt, Human
uaguagguaaggccccaggaucucc

SEQ ID NO: 573779 - RNA, 22 nt, Human
ucacgccuguaauuccagcacu

SEQ ID NO: 573780 - RNA, 18 nt, Human
ucaguugaggaauaggga

SEQ ID NO: 573781 - RNA, 24 nt, Human
uccagccugggugacagagcaaga

SEQ ID NO: 573782 - RNA, 21 nt, Human
ucucuacugaaaaaaaaaaaa

SEQ ID NO: 573783 - RNA, 18 nt, Human
ucugucccaagcacaaaa

SEQ ID NO: 573784 - RNA, 24 nt, Human
ucugucugucucaaaaaaaaaaag

SEQ ID NO: 573785 - RNA, 18 nt, Human
ucuucagucgauuccgcu

SEQ ID NO: 573786 - RNA, 21 nt, Human
ucuuuggggaucgagcuuccu

SEQ ID NO: 573787 - RNA, 22 nt, Human
ugacccgagauugcgccacugc

SEQ ID NO: 573788 - RNA, 23 nt, Human
ugaggcaggagaauggcaugaac

SEQ ID NO: 573789 - RNA, 23 nt, Human
ugaggcaggagaauggcaugaac

SEQ ID NO: 573790 - RNA, 25 nt, Human
ugaggcaggagaauggcaugaacuu

SEQ ID NO: 573791 - RNA, 23 nt, Human
ugccuguagucccagcuacuugg

SEQ ID NO: 573792 - RNA, 24 nt, Human
ugccuguagucccagcuacuuggg

SEQ ID NO: 573793 - RNA, 23 nt, Human
ugcgguggaaucccaggcagagc

SEQ ID NO: 573794 - RNA, 19 nt, Human
uggaaucccaggcagagcc

SEQ ID NO: 573795 - RNA, 18 nt, Human
uggcaugaacuugggagg

SEQ ID NO: 573796 - RNA, 24 nt, Human
uggccaggcgcaguggcucacgcc

SEQ ID NO: 573797 - RNA, 22 nt, Human
uggcucacgccuguaauuccag

SEQ ID NO: 573798 - RNA, 24 nt, Human
uggcucacgccuguaauuccagca

SEQ ID NO: 573799 - RNA, 18 nt, Human
ugggaggccgaggucggc

SEQ ID NO: 573800 - RNA, 19 nt, Human
ugggaggccgaggucggcg

SEQ ID NO: 573801 - RNA, 24 nt, Human
ugggaggccgaggucggcggauca

SEQ ID NO: 573802 - RNA, 18 nt, Human
ugggaggcugaggcagga

SEQ ID NO: 573803 - RNA, 24 nt, Human
ugggaggcugaggcaggagaaugg

SEQ ID NO: 573804 - RNA, 24 nt, Human
ugguggcaggugccuguaguccca

SEQ ID NO: 573805 - RNA, 21 nt, Human
ugugucuucugcugcugcugc

SEQ ID NO: 573806 - RNA, 24 nt, Human
uuagcugggcaugguggcaggugc

SEQ ID NO: 573807 - RNA, 26 nt, Human
uucagcuauuuuuguguugacauuuu

SEQ ID NO: 573808 - RNA, 21 nt, Human
uucugcugcugcugcuucugc

SEQ ID NO: 573809 - RNA, 23 nt, Human
uucuuuggggaucgagcuuccua

SEQ ID NO: 573810 - RNA, 23 nt, Human
uucuuuuucacugugccucuaau

SEQ ID NO: 573811 - RNA, 22 nt, Human
uugcagugacccgagauugcgc

SEQ ID NO: 573812 - RNA, 23 nt, Human
uugcgccacugcacuccagccug

SEQ ID NO: 573813 - RNA, 25 nt, Human
uugggaggccgaggucggcggauca

SEQ ID NO: 573814 - RNA, 20 nt, Human
uuuaauagcacugaugaaaa

SEQ ID NO: 573815 - RNA, 18 nt, Human
uuuguuaaaauauuaagg

SEQ ID NO: 573816 - RNA, 22 nt, Human
uuuguuaaaauauuaaggguuu

SEQ ID NO: 573817 - RNA, 23 nt, Human
aaaaauagcagaaguaucaaagc

SEQ ID NO: 573818 - RNA, 30 nt, Human
aaaaaugugucuuugcauuuccagcccucc

SEQ ID NO: 573819 - RNA, 25 nt, Human
aaaauccaugggcacaccugaauga

SEQ ID NO: 573820 - RNA, 19 nt, Human
aaguaucaaagccauuggc

SEQ ID NO: 573821 - RNA, 20 nt, Human
aauuguguguaagcucaaaa

SEQ ID NO: 573822 - RNA, 27 nt, Human
acagagcaagacuuccgucuauuaaaa

SEQ ID NO: 573823 - RNA, 18 nt, Human
accauuugcccagugaau

SEQ ID NO: 573824 - RNA, 23 nt, Human
accgcacuccagccugcaugaca

SEQ ID NO: 573825 - RNA, 24 nt, Human
accgcacuccagccugcaugacag

SEQ ID NO: 573826 - RNA, 26 nt, Human
accgcacuccagccugcaugacagag

SEQ ID NO: 573827 - RNA, 19 nt, Human
acgcaguuucaccagcugg

SEQ ID NO: 573828 - RNA, 19 nt, Human
acgguguguaccgcacccc

SEQ ID NO: 573829 - RNA, 24 nt, Human
agcuacucaggaggcugagguggg

SEQ ID NO: 573830 - RNA, 23 nt, Human
agcuaggcgugguggcacacgcc

SEQ ID NO: 573831 - RNA, 21 nt, Human
agcugggcaugguggcauacc

SEQ ID NO: 573832 - RNA, 24 nt, Human
aggaauucaagaccagccugggaa

SEQ ID NO: 573833 - RNA, 24 nt, Human
aggcgugguggcacacgccugugg

SEQ ID NO: 573834 - RNA, 24 nt, Human
aggcugaggugggaggaucacuug

SEQ ID NO: 573835 - RNA, 23 nt, Human
aggguguugggagcuggcaagcu

SEQ ID NO: 573836 - RNA, 18 nt, Human
aggugggaggaucacuug

SEQ ID NO: 573837 - RNA, 23 nt, Human
aggugggaggaucacuugagccc

SEQ ID NO: 573838 - RNA, 24 nt, Human
agucgugguggcucaugccuauaa

SEQ ID NO: 573839 - RNA, 23 nt, Human
aguuucaccagcuggaugugcag

SEQ ID NO: 573840 - RNA, 24 nt, Human
aucgcaccaccgcacuccagccug

SEQ ID NO: 573841 - RNA, 18 nt, Human
caaaauccaugggcacac

SEQ ID NO: 573842 - RNA, 24 nt, Human
caaaugaagauuaacaaaugccag

SEQ ID NO: 573843 - RNA, 24 nt, Human
caacacuuugggagggcaaggugg

SEQ ID NO: 573844 - RNA, 20 nt, Human
caaccgggcaggcaaaauua

SEQ ID NO: 573845 - RNA, 23 nt, Human
cacagcacugagcauacuuagua

SEQ ID NO: 573846 - RNA, 27 nt, Human
caccaccgcacuccagccugcaugaca

SEQ ID NO: 573847 - RNA, 27 nt, Human
caccaggaaggguguugggagcuggca

SEQ ID NO: 573848 - RNA, 20 nt, Human
caccccuaccaggaauuauc

SEQ ID NO: 573849 - RNA, 18 nt, Human
caccgcacuccagccugc

SEQ ID NO: 573850 - RNA, 18 nt, Human
cacgccuguggucucagc

SEQ ID NO: 573851 - RNA, 23 nt, Human
cacuccagccugcaugacagagc

SEQ ID NO: 573852 - RNA, 19 nt, Human
cacuuugggagggcaaggu

SEQ ID NO: 573853 - RNA, 24 nt, Human
cagcuacucaggaggcugaggugg

SEQ ID NO: 573854 - RNA, 20 nt, Human
cagcuggaugugcagagaau

SEQ ID NO: 573855 - RNA, 22 nt, Human
caguacgucacgcacacacccc

SEQ ID NO: 573856 - RNA, 24 nt, Human
caugccuauaaucccaacacuuug

SEQ ID NO: 573857 - RNA, 19 nt, Human
ccacagugccuagaucuag

SEQ ID NO: 573858 - RNA, 26 nt, Human
ccacagugccuagaucuagaccucaa

SEQ ID NO: 573859 - RNA, 18 nt, Human
ccaccgcacuccagccug

SEQ ID NO: 573860 - RNA, 19 nt, Human
ccaccgcacuccagccugc

SEQ ID NO: 573861 - RNA, 24 nt, Human
ccaccgcacuccagccugcaugac

SEQ ID NO: 573862 - RNA, 25 nt, Human
ccaccgcacuccagccugcaugaca

SEQ ID NO: 573863 - RNA, 23 nt, Human
ccagccugcaugacagagcaaga

SEQ ID NO: 573864 - RNA, 20 nt, Human
ccaggagguugaggcugcag

SEQ ID NO: 573865 - RNA, 20 nt, Human
cccaagaguucgaggcugca

SEQ ID NO: 573866 - RNA, 25 nt, Human
cccaaggaaagauauacuguaaaau

SEQ ID NO: 573867 - RNA, 24 nt, Human
ccccuguagucucagcuacucugg

SEQ ID NO: 573868 - RNA, 20 nt, Human
ccggcaguggguaccgcgga

SEQ ID NO: 573869 - RNA, 22 nt, Human
ccuauaaucccaacacuuuggg

SEQ ID NO: 573870 - RNA, 22 nt, Human
ccuauaaucccaacacuuuggg

SEQ ID NO: 573871 - RNA, 20 nt, Human
ccugcaugacagagcaagac

SEQ ID NO: 573872 - RNA, 21 nt, Human
ccugcaugacagagcaagacu

SEQ ID NO: 573873 - RNA, 19 nt, Human
ccuguagucucagcuacuc

SEQ ID NO: 573874 - RNA, 25 nt, Human
ccuguagucucagcuacucuggugg

SEQ ID NO: 573875 - RNA, 21 nt, Human
cgcaccaccgcacuccagccu

SEQ ID NO: 573876 - RNA, 24 nt, Human
cgccuguggucucagcuacucagg

SEQ ID NO: 573877 - RNA, 21 nt, Human
cggcaguggguaccgcggagg

SEQ ID NO: 573878 - RNA, 22 nt, Human
cggcaguggguaccgcggaggc

SEQ ID NO: 573879 - RNA, 18 nt, Human
cggguagcgcggaggccg

SEQ ID NO: 573880 - RNA, 21 nt, Human
cucaaaauccaugggcacacc

SEQ ID NO: 573881 - RNA, 23 nt, Human
cucaaaauccaugggcacaccug

SEQ ID NO: 573882 - RNA, 24 nt, Human
cucaugccuauaaucccaacacuu

SEQ ID NO: 573883 - RNA, 22 nt, Human
cugcagugagcuaugaucgcac

SEQ ID NO: 573884 - RNA, 24 nt, Human
cugcggccggguagcgcggaggcc

SEQ ID NO: 573885 - RNA, 25 nt, Human
cuggccagucgugguggcucaugcc

SEQ ID NO: 573886 - RNA, 21 nt, Human
cugggcaugguggcauacccc

SEQ ID NO: 573887 - RNA, 18 nt, Human
cugguggcugacacagga

SEQ ID NO: 573888 - RNA, 22 nt, Human
cuggugggccugugaauugugu

SEQ ID NO: 573889 - RNA, 23 nt, Human
cuugaagcccaagaguucgaggc

SEQ ID NO: 573890 - RNA, 23 nt, Human
cuugagcccaggagguugaggcu

SEQ ID NO: 573891 - RNA, 21 nt, Human
gaauuguguguaagcucaaaa

SEQ ID NO: 573892 - RNA, 21 nt, Human
gaggugggaggaucacuugag

SEQ ID NO: 573893 - RNA, 19 nt, Human
gaguaccgcgcaggccggc

SEQ ID NO: 573894 - RNA, 24 nt, Human
gaucacuugagcccaggagguuga

SEQ ID NO: 573895 - RNA, 18 nt, Human
gcacacaccccuaccagg

SEQ ID NO: 573896 - RNA, 20 nt, Human
gcaccaccgcacuccagccu

SEQ ID NO: 573897 - RNA, 24 nt, Human
gcacuccagccugcaugacagagc

SEQ ID NO: 573898 - RNA, 23 nt, Human
gcggaggccggcagugaguaccg

SEQ ID NO: 573899 - RNA, 23 nt, Human
gcggaggccggcaguggguaccg

SEQ ID NO: 573900 - RNA, 19 nt, Human
gcugacacaggaggauugc

SEQ ID NO: 573901 - RNA, 18 nt, Human
ggaacaacacagagaagg

SEQ ID NO: 573902 - RNA, 19 nt, Human
ggauuuccacagcucgaaa

SEQ ID NO: 573903 - RNA, 22 nt, Human
ggccacaauauagcuuuuaacc

SEQ ID NO: 573904 - RNA, 21 nt, Human
ggccagucgugguggcucaug

SEQ ID NO: 573905 - RNA, 23 nt, Human
ggguagcgcggaggccggcaguu

SEQ ID NO: 573906 - RNA, 24 nt, Human
gguggcacacgccuguggucucag

SEQ ID NO: 573907 - RNA, 19 nt, Human
gguggcucaugccuauaau

SEQ ID NO: 573908 - RNA, 23 nt, Human
gguggcucaugccuauaauccca

SEQ ID NO: 573909 - RNA, 24 nt, Human
guaccgcggaggccggcagugagu

SEQ ID NO: 573910 - RNA, 19 nt, Human
guauugcucuuugagaaag

SEQ ID NO: 573911 - RNA, 24 nt, Human
gucuaaaaaaauagcagaaguauc

SEQ ID NO: 573912 - RNA, 24 nt, Human
gugaauaguaaucuaaggcccaag

SEQ ID NO: 573913 - RNA, 24 nt, Human
guggcacacgccuguggucucagc

SEQ ID NO: 573914 - RNA, 19 nt, Human
guggguaccgcggaggccg

SEQ ID NO: 573915 - RNA, 22 nt, Human
uaaaacaaaaacaaauaccauu

SEQ ID NO: 573916 - RNA, 24 nt, Human
uaaaacaaaaacaaauaccauuug

SEQ ID NO: 573917 - RNA, 18 nt, Human
uaagcucaaaagcaucac

SEQ ID NO: 573918 - RNA, 20 nt, Human
uaagcucaaaagcaucacuc

SEQ ID NO: 573919 - RNA, 19 nt, Human
uaccgcaccccaggaaggc

SEQ ID NO: 573920 - RNA, 22 nt, Human
uagcuaggcgugguggcacacg

SEQ ID NO: 573921 - RNA, 18 nt, Human
uccacagugccuagaucu

SEQ ID NO: 573922 - RNA, 19 nt, Human
ucccaggaauucaagacca

SEQ ID NO: 573923 - RNA, 20 nt, Human
ucccuggcuucuugacuuuu

SEQ ID NO: 573924 - RNA, 18 nt, Human
ucuaaaaaaauagcagaa

SEQ ID NO: 573925 - RNA, 19 nt, Human
ugagaaaguuuauuggcac

SEQ ID NO: 573926 - RNA, 19 nt, Human
ugaggugggaggaucacuu

SEQ ID NO: 573927 - RNA, 22 nt, Human
ugaggugggaggaucacuugag

SEQ ID NO: 573928 - RNA, 24 nt, Human
ugaggugggaggaucacuugagcc

SEQ ID NO: 573929 - RNA, 23 nt, Human
ugccuauaaucccaacacuuugg

SEQ ID NO: 573930 - RNA, 19 nt, Human
ugcuuaagcuaagaccuuu

SEQ ID NO: 573931 - RNA, 19 nt, Human
ugcuugguucagauagugg

SEQ ID NO: 573932 - RNA, 21 nt, Human
uggcacacgccuguggucuca

SEQ ID NO: 573933 - RNA, 24 nt, Human
uggcacacgccuguggucucagcu

SEQ ID NO: 573934 - RNA, 21 nt, Human
uggcucaugccuauaauccca

SEQ ID NO: 573935 - RNA, 24 nt, Human
uggcugacacaggaggauugcuug

SEQ ID NO: 573936 - RNA, 24 nt, Human
ugggagggcaagguggaaggauug

SEQ ID NO: 573937 - RNA, 19 nt, Human
ugggcacaccugaaugaca

SEQ ID NO: 573938 - RNA, 24 nt, Human
ugguggcacacgccuguggucuca

SEQ ID NO: 573939 - RNA, 24 nt, Human
ugguggcucaugccuauaauccca

SEQ ID NO: 573940 - RNA, 20 nt, Human
ugucuaaaaaaauagcagaa

SEQ ID NO: 573941 - RNA, 21 nt, Human
ugucuugggccacaauauagc

SEQ ID NO: 573942 - RNA, 22 nt, Human
ugugauaagaaugacuuaauuu

SEQ ID NO: 573943 - RNA, 23 nt, Human
ugugauaagaaugacuuaauuug

SEQ ID NO: 573944 - RNA, 19 nt, Human
uguguaccgcaccccagga

SEQ ID NO: 573945 - RNA, 24 nt, Human
uguguaccgcaccccaggaaggcu

SEQ ID NO: 573946 - RNA, 18 nt, Human
uuagcuaggcgugguggc

SEQ ID NO: 573947 - RNA, 24 nt, Human
uuagcuaggcgugguggcacacgc

SEQ ID NO: 573948 - RNA, 22 nt, Human
uucagauaguggugaauuacua

SEQ ID NO: 573949 - RNA, 23 nt, Human
uugaagcccaagaguucgaggcu

SEQ ID NO: 573950 - RNA, 19 nt, Human
uugcugaauuaacggugug

SEQ ID NO: 573951 - RNA, 24 nt, Human
uugggagggcaagguggaaggauu

SEQ ID NO: 573952 - RNA, 21 nt, Human
aaaaaacaaucacacagauga

SEQ ID NO: 573953 - RNA, 18 nt, Human
aaacagaguccagcugca

SEQ ID NO: 573954 - RNA, 20 nt, Human
aaagaacacacauggcagag

SEQ ID NO: 573955 - RNA, 22 nt, Human
aaagcugggaggaucuuguuag

SEQ ID NO: 573956 - RNA, 21 nt, Human
aagcaauguuacaugauccaa

SEQ ID NO: 573957 - RNA, 23 nt, Human
aauaauaguuacugguguuugag

SEQ ID NO: 573958 - RNA, 22 nt, Human
acccaacaacauucagcaaaac

SEQ ID NO: 573959 - RNA, 21 nt, Human
accccacuuuccucuguccaa

SEQ ID NO: 573960 - RNA, 19 nt, Human
acugggaacaaacugaggu

SEQ ID NO: 573961 - RNA, 19 nt, Human
agaaagcugggaggaucuu

SEQ ID NO: 573962 - RNA, 21 nt, Human
agaaaggagcaguauagaaaa

SEQ ID NO: 573963 - RNA, 23 nt, Human
agacccacaagcucaggccaaau

SEQ ID NO: 573964 - RNA, 25 nt, Human
agagcagguggagcuagccaaggug

SEQ ID NO: 573965 - RNA, 22 nt, Human
agaggggcaguggguucaugag

SEQ ID NO: 573966 - RNA, 20 nt, Human
agcagguggagcuagccaag

SEQ ID NO: 573967 - RNA, 24 nt, Human
aggcauuuaguacagguucuggca

SEQ ID NO: 573968 - RNA, 20 nt, Human
aggcuguagaaagcccauca

SEQ ID NO: 573969 - RNA, 21 nt, Human
aggggaaaaaacaaucacaca

SEQ ID NO: 573970 - RNA, 24 nt, Human
agguucuggcauaugggccaguuc

SEQ ID NO: 573971 - RNA, 18 nt, Human
auucgcgguuauucccuu

SEQ ID NO: 573972 - RNA, 24 nt, Human
auuuccaccuuaaaauugacaggg

SEQ ID NO: 573973 - RNA, 20 nt, Human
caaccuuuaagaccucuauu

SEQ ID NO: 573974 - RNA, 23 nt, Human
cagcugcacagagcauucgcggu

SEQ ID NO: 573975 - RNA, 21 nt, Human
caguuucaaaccaugagagga

SEQ ID NO: 573976 - RNA, 18 nt, Human
caucaagaaaaugcaaac

SEQ ID NO: 573977 - RNA, 23 nt, Human
caucaagaaaaugcaaacucuug

SEQ ID NO: 573978 - RNA, 24 nt, Human
ccucuaagcccacugggaacaaac

SEQ ID NO: 573979 - RNA, 19 nt, Human
cuaaagaacacacauggca

SEQ ID NO: 573980 - RNA, 19 nt, Human
cuccggcugcugcuagugc

SEQ ID NO: 573981 - RNA, 21 nt, Human
cugaacagacccacaagcuca

SEQ ID NO: 573982 - RNA, 23 nt, Human
gaaacagaguccagcugcacaga

SEQ ID NO: 573983 - RNA, 18 nt, Human
gaacacacauggcagaga

SEQ ID NO: 573984 - RNA, 20 nt, Human
gaacaggcauaaaaagcaaa

SEQ ID NO: 573985 - RNA, 24 nt, Human
gaacuaaucauaguuuucucauac

SEQ ID NO: 573986 - RNA, 20 nt, Human
gaagaagauucuucuacuaa

SEQ ID NO: 573987 - RNA, 26 nt, Human
gagcaguauagaaaagagauuaaaua

SEQ ID NO: 573988 - RNA, 19 nt, Human
ggauaagcaucagaaagga

SEQ ID NO: 573989 - RNA, 19 nt, Human
ggcaguggguucaugagaa

SEQ ID NO: 573990 - RNA, 22 nt, Human
ggccaggauugaaggcaggcau

SEQ ID NO: 573991 - RNA, 20 nt, Human
uaaaauaaaacuaaagaaca

SEQ ID NO: 573992 - RNA, 20 nt, Human
uaaagaacacacauggcaga

SEQ ID NO: 573993 - RNA, 20 nt, Human
uaagcccacugggaacaaac

SEQ ID NO: 573994 - RNA, 28 nt, Human
uaagggaaguaucuguggaaauuuucuc

SEQ ID NO: 573995 - RNA, 18 nt, Human
uacugaaaggagacuaag

SEQ ID NO: 573996 - RNA, 21 nt, Human
uacugaaaggagacuaagcaa

SEQ ID NO: 573997 - RNA, 18 nt, Human
uagaagaagauucuucua

SEQ ID NO: 573998 - RNA, 19 nt, Human
uaugaaagauuccuuacug

SEQ ID NO: 573999 - RNA, 21 nt, Human
uauugccaaauacugaaagga

SEQ ID NO: 574000 - RNA, 20 nt, Human
ucagaacaggcauaaaaagc

SEQ ID NO: 574001 - RNA, 23 nt, Human
ucagguccucccucuaagcccac

SEQ ID NO: 574002 - RNA, 23 nt, Human
ucccucuaagcccacugggaaca

SEQ ID NO: 574003 - RNA, 20 nt, Human
ucccugaugaggcaagggcu

SEQ ID NO: 574004 - RNA, 18 nt, Human
uccggcugcugcuagugc

SEQ ID NO: 574005 - RNA, 21 nt, Human
ugaaaggauaagcaucagaaa

SEQ ID NO: 574006 - RNA, 25 nt, Human
ugaacagacccacaagcucaggcca

SEQ ID NO: 574007 - RNA, 25 nt, Human
ugaacagacccacaagcucaggcca

SEQ ID NO: 574008 - RNA, 23 nt, Human
ugagaggagacagucugaacagu

SEQ ID NO: 574009 - RNA, 21 nt, Human
ugaggaaaaugcagaggggca

SEQ ID NO: 574010 - RNA, 21 nt, Human
ugaggaaaaugcagaggggca

SEQ ID NO: 574011 - RNA, 23 nt, Human
ugcaguuucaaaccaugagagga

SEQ ID NO: 574012 - RNA, 21 nt, Human
ugcgcccgggugcuuuccgcc

SEQ ID NO: 574013 - RNA, 23 nt, Human
ugcggcaccggcuccggcugcgc

SEQ ID NO: 574014 - RNA, 21 nt, Human
ugcuaccaaugauacagaguu

SEQ ID NO: 574015 - RNA, 22 nt, Human
uggaaucagucaucagguccuc

SEQ ID NO: 574016 - RNA, 18 nt, Human
uggauaugaaaugucuac

SEQ ID NO: 574017 - RNA, 23 nt, Human
uggcuuaggacaaguguggagaa

SEQ ID NO: 574018 - RNA, 23 nt, Human
uguagaaagcccaucauccuuag

SEQ ID NO: 574019 - RNA, 19 nt, Human
ugucaugcaaggguaaaaa

SEQ ID NO: 574020 - RNA, 19 nt, Human
uucccuuguucuaucauuu

SEQ ID NO: 574021 - RNA, 22 nt, Human
uucuucuuucuuuuauugccaa

SEQ ID NO: 574022 - RNA, 21 nt, Human
uugauuaaaaugaaaauguca

SEQ ID NO: 574023 - RNA, 22 nt, Human
aaacccacagcgagaccuacac

SEQ ID NO: 574024 - RNA, 21 nt, Human
aagaugggagcagcuggggga

SEQ ID NO: 574025 - RNA, 21 nt, Human
acugugucuguuuuauccugg

SEQ ID NO: 574026 - RNA, 21 nt, Human
acuucuaagagcacagaagag

SEQ ID NO: 574027 - RNA, 23 nt, Human
agaacaucgcuuugaaucuacag

SEQ ID NO: 574028 - RNA, 22 nt, Human
agcagugcuggcucuuggcccu

SEQ ID NO: 574029 - RNA, 19 nt, Human
agguccggaggcugcaggu

SEQ ID NO: 574030 - RNA, 20 nt, Human
cacugugucuguuuuauccu

SEQ ID NO: 574031 - RNA, 22 nt, Human
cagcacaguagccugccuacag

SEQ ID NO: 574032 - RNA, 22 nt, Human
cagcagugcuggcucuuggccc

SEQ ID NO: 574033 - RNA, 18 nt, Human
caggucagggggcugcgc

SEQ ID NO: 574034 - RNA, 21 nt, Human
cauaaaacagagcgcaaacaa

SEQ ID NO: 574035 - RNA, 19 nt, Human
ccaagaaauuccagcaaga

SEQ ID NO: 574036 - RNA, 22 nt, Human
cccacagcgagaccuacacagg

SEQ ID NO: 574037 - RNA, 21 nt, Human
cccauaaaacagagcgcaaac

SEQ ID NO: 574038 - RNA, 27 nt, Human
ccccagcaaacccacagcgagaccuac

SEQ ID NO: 574039 - RNA, 25 nt, Human
ccccuuuucaucacccccuuggucc

SEQ ID NO: 574040 - RNA, 18 nt, Human
cccuccccuuuucaucac

SEQ ID NO: 574041 - RNA, 18 nt, Human
ccucucuugggcaggagc

SEQ ID NO: 574042 - RNA, 23 nt, Human
ccucucuugggcaggagcuccgc

SEQ ID NO: 574043 - RNA, 19 nt, Human
ccucuggcucccucagucc

SEQ ID NO: 574044 - RNA, 21 nt, Human
cucccucaguccugguagauu

SEQ ID NO: 574045 - RNA, 22 nt, Human
cucuuggcccugucacuguguc

SEQ ID NO: 574046 - RNA, 22 nt, Human
cuggggccccacagccccucuc

SEQ ID NO: 574047 - RNA, 24 nt, Human
gagcagcagccagggcugccggga

SEQ ID NO: 574048 - RNA, 20 nt, Human
gaggguggggcgagcagcag

SEQ ID NO: 574049 - RNA, 30 nt, Human
gcagcagccagggcugccgggaugggagcc

SEQ ID NO: 574050 - RNA, 19 nt, Human
gccccacagccccucucuu

SEQ ID NO: 574051 - RNA, 22 nt, Human
gcgcaaacaaaucacccagcag

SEQ ID NO: 574052 - RNA, 19 nt, Human
ggagaagccgcccaagaaa

SEQ ID NO: 574053 - RNA, 20 nt, Human
ggcaugacaccaaggccagc

SEQ ID NO: 574054 - RNA, 19 nt, Human
ggccggguccgcgcugccg

SEQ ID NO: 574055 - RNA, 18 nt, Human
ggcugcgcggaaggggug

SEQ ID NO: 574056 - RNA, 20 nt, Human
ggggcgagcagcagccaggg

SEQ ID NO: 574057 - RNA, 22 nt, Human
guggagaagccgcccaagaaau

SEQ ID NO: 574058 - RNA, 19 nt, Human
guuacugcugaacucccua

SEQ ID NO: 574059 - RNA, 18 nt, Human
uaagagcacagaagagaa

SEQ ID NO: 574060 - RNA, 23 nt, Human
uccccagcaaacccacagcgaga

SEQ ID NO: 574061 - RNA, 18 nt, Human
ucccucaguccugguaga

SEQ ID NO: 574062 - RNA, 21 nt, Human
ucccucaguccugguagauuc

SEQ ID NO: 574063 - RNA, 24 nt, Human
uccgcgcugcagcgagguccggag

SEQ ID NO: 574064 - RNA, 19 nt, Human
ugagcuguggcugcaucuc

SEQ ID NO: 574065 - RNA, 20 nt, Human
ugcgcggaaggggugcgcgc

SEQ ID NO: 574066 - RNA, 24 nt, Human
uggcugcaucucauacagaagcug

SEQ ID NO: 574067 - RNA, 22 nt, Human
aaacuacagggcaucgacauaa

SEQ ID NO: 574068 - RNA, 22 nt, Human
acacagggcuucaccaagccaa

SEQ ID NO: 574069 - RNA, 22 nt, Human
agaauaguacuauuuugaaaca

SEQ ID NO: 574070 - RNA, 18 nt, Human
aggggaacaggccacaau

SEQ ID NO: 574071 - RNA, 24 nt, Human
agugugaaagcaaaacagguacau

SEQ ID NO: 574072 - RNA, 22 nt, Human
auaaaacccaaggggaacaggc

SEQ ID NO: 574073 - RNA, 19 nt, Human
auaaacaaaaacaaaucag

SEQ ID NO: 574074 - RNA, 25 nt, Human
caaagcagccacacugaaagaaauc

SEQ ID NO: 574075 - RNA, 23 nt, Human
cacacagggcuucaccaagccaa

SEQ ID NO: 574076 - RNA, 20 nt, Human
cagcccgccagcccgccuug

SEQ ID NO: 574077 - RNA, 18 nt, Human
ccaagccaaagcagccac

SEQ ID NO: 574078 - RNA, 18 nt, Human
ccagcccgccagcccgcc

SEQ ID NO: 574079 - RNA, 20 nt, Human
ccagcccgccagcccgccuu

SEQ ID NO: 574080 - RNA, 20 nt, Human
ccgccuugggucgccucuuc

SEQ ID NO: 574081 - RNA, 24 nt, Human
cgacauaaacaaaaacaaaucaga

SEQ ID NO: 574082 - RNA, 22 nt, Human
cgccucuucucccacuuccugc

SEQ ID NO: 574083 - RNA, 21 nt, Human
cucuucucccacuuccugcug

SEQ ID NO: 574084 - RNA, 20 nt, Human
cugcaggcugauucucucau

SEQ ID NO: 574085 - RNA, 22 nt, Human
gauguccaaucuaccacacagg

SEQ ID NO: 574086 - RNA, 22 nt, Human
gccagguccugcaugaauccaa

SEQ ID NO: 574087 - RNA, 21 nt, Human
gggcaucgacauaaacaaaaa

SEQ ID NO: 574088 - RNA, 23 nt, Human
gggcaucgacauaaacaaaaaca

SEQ ID NO: 574089 - RNA, 18 nt, Human
gugaaagcaaaacaggua

SEQ ID NO: 574090 - RNA, 19 nt, Human
uaauaaaaauguugaccau

SEQ ID NO: 574091 - RNA, 18 nt, Human
uacaacaaagacaaauaa

SEQ ID NO: 574092 - RNA, 18 nt, Human
uacuauuuugaaacagcc

SEQ ID NO: 574093 - RNA, 22 nt, Human
uaguacuauuuugaaacagcca

SEQ ID NO: 574094 - RNA, 23 nt, Human
uaucugaaaauauuccauuuuau

SEQ ID NO: 574095 - RNA, 25 nt, Human
uccuuuggacuuaggugaauucuaa

SEQ ID NO: 574096 - RNA, 19 nt, Human
ucucucaugggaggucagg

SEQ ID NO: 574097 - RNA, 19 nt, Human
ugaaacagccaauauagua

SEQ ID NO: 574098 - RNA, 21 nt, Human
ugaaagaaaucugccaggucc

SEQ ID NO: 574099 - RNA, 23 nt, Human
ugaauguuguggcacaaugacug

SEQ ID NO: 574100 - RNA, 21 nt, Human
ugagaaauggaaaguugcuag

SEQ ID NO: 574101 - RNA, 22 nt, Human
ugagaacuuuuuuuaccuaaug

SEQ ID NO: 574102 - RNA, 22 nt, Human
ugagguaaguccauaauccauc

SEQ ID NO: 574103 - RNA, 18 nt, Human
uggcacaaugacuggaca

SEQ ID NO: 574104 - RNA, 25 nt, Human
uguaaugccuuuauugagaacuuuu

SEQ ID NO: 574105 - RNA, 22 nt, Human
uuuccaaaaaaaguaacuugca

SEQ ID NO: 574106 - RNA, 22 nt, Human
aaaaaaauaaaacaaagaggcc

SEQ ID NO: 574107 - RNA, 22 nt, Human
aaaauaaaacaaagaggccgca

SEQ ID NO: 574108 - RNA, 21 nt, Human
aaaaucauaauugcaauaugg

SEQ ID NO: 574109 - RNA, 21 nt, Human
aaaggacaucccuuugaccca

SEQ ID NO: 574110 - RNA, 19 nt, Human
aacaagagaauucagcaga

SEQ ID NO: 574111 - RNA, 25 nt, Human
aacaagagaauucagcagagaccug

SEQ ID NO: 574112 - RNA, 26 nt, Human
aaccacggugacaaagcucccucgcc

SEQ ID NO: 574113 - RNA, 18 nt, Human
aagaaagaggcauuuagc

SEQ ID NO: 574114 - RNA, 24 nt, Human
aagaaagaggcauuuagcagagga

SEQ ID NO: 574115 - RNA, 19 nt, Human
aagaucacccucaaaacca

SEQ ID NO: 574116 - RNA, 18 nt, Human
aagcgcuaucuacaugug

SEQ ID NO: 574117 - RNA, 20 nt, Human
aaggucacucagucacucua

SEQ ID NO: 574118 - RNA, 24 nt, Human
acaaaaccacucauuucuaaaguc

SEQ ID NO: 574119 - RNA, 23 nt, Human
acaagagcuuccccucucagaca

SEQ ID NO: 574120 - RNA, 19 nt, Human
acagacccagaugacacga

SEQ ID NO: 574121 - RNA, 24 nt, Human
accccauacaccaacauggaauaa

SEQ ID NO: 574122 - RNA, 18 nt, Human
acccucaaugcugagaaa

SEQ ID NO: 574123 - RNA, 23 nt, Human
acgauggaacgugaauacugaag

SEQ ID NO: 574124 - RNA, 24 nt, Human
acgcugaacucacacgugcccggc

SEQ ID NO: 574125 - RNA, 20 nt, Human
acuacacuaacagacccaga

SEQ ID NO: 574126 - RNA, 24 nt, Human
agaaaaagcacgcgucaauaucac

SEQ ID NO: 574127 - RNA, 23 nt, Human
agaacacagaugaaaccaaaagg

SEQ ID NO: 574128 - RNA, 23 nt, Human
agacaaagguggauaagagggac

SEQ ID NO: 574129 - RNA, 18 nt, Human
agacacauacacaaaacc

SEQ ID NO: 574130 - RNA, 22 nt, Human
agacacauacacaaaaccacuc

SEQ ID NO: 574131 - RNA, 18 nt, Human
agacagaugcagcagcgg

SEQ ID NO: 574132 - RNA, 19 nt, Human
agacccagaugacacgaug

SEQ ID NO: 574133 - RNA, 25 nt, Human
agaccuggacauuuuaaaccagugg

SEQ ID NO: 574134 - RNA, 21 nt, Human
agcaagaucacccucaaaacc

SEQ ID NO: 574135 - RNA, 21 nt, Human
augcagcagcgggaggaaggg

SEQ ID NO: 574136 - RNA, 19 nt, Human
auucgcauaauuacccacc

SEQ ID NO: 574137 - RNA, 21 nt, Human
caaagaaaaagcacgcgucaa

SEQ ID NO: 574138 - RNA, 20 nt, Human
caaagcucccucgcccaaag

SEQ ID NO: 574139 - RNA, 20 nt, Human
caacaacugccacaggcccc

SEQ ID NO: 574140 - RNA, 19 nt, Human
caacagagcacuccauccu

SEQ ID NO: 574141 - RNA, 23 nt, Human
caaccacggugacaaagcucccc

SEQ ID NO: 574142 - RNA, 24 nt, Human
cacauacacaaaaccacucauuuc

SEQ ID NO: 574143 - RNA, 20 nt, Human
caccgcggagcagcagcgcu

SEQ ID NO: 574144 - RNA, 18 nt, Human
cacgcugcauccuaaggc

SEQ ID NO: 574145 - RNA, 21 nt, Human
cacugaauagcugaaaggcuc

SEQ ID NO: 574146 - RNA, 21 nt, Human
cagaaugugcauaaaagucuc

SEQ ID NO: 574147 - RNA, 21 nt, Human
cagacacauacacaaaaccac

SEQ ID NO: 574148 - RNA, 25 nt, Human
cagagcacuccauccuauuuuaccc

SEQ ID NO: 574149 - RNA, 22 nt, Human
cagagcagcagaaguacuuuuc

SEQ ID NO: 574150 - RNA, 19 nt, Human
cagaggagguuggagagcu

SEQ ID NO: 574151 - RNA, 22 nt, Human
cauacgccuaaucgagaaauca

SEQ ID NO: 574152 - RNA, 22 nt, Human
cauggaauaaauggaagcacua

SEQ ID NO: 574153 - RNA, 18 nt, Human
cauuuugccacccugcuc

SEQ ID NO: 574154 - RNA, 18 nt, Human
ccaaagugcuauuacagg

SEQ ID NO: 574155 - RNA, 24 nt, Human
ccacgcugaacucacacgugcccg

SEQ ID NO: 574156 - RNA, 21 nt, Human
cccaaaugaucaacagagcac

SEQ ID NO: 574157 - RNA, 19 nt, Human
cccaaccacggugacaaag

SEQ ID NO: 574158 - RNA, 21 nt, Human
cccacaguuccaaagugcuau

SEQ ID NO: 574159 - RNA, 21 nt, Human
ccccagcuugaugaacaccau

SEQ ID NO: 574160 - RNA, 21 nt, Human
ccccggaacuccuccgugcac

SEQ ID NO: 574161 - RNA, 18 nt, Human
ccccguacagaaccuguc

SEQ ID NO: 574162 - RNA, 20 nt, Human
cccucaaaaccagcuugugg

SEQ ID NO: 574163 - RNA, 21 nt, Human
ccgcaggguuaggggcauagg

SEQ ID NO: 574164 - RNA, 18 nt, Human
ccuauccaacguuuagga

SEQ ID NO: 574165 - RNA, 19 nt, Human
ccuuuuccauuuugccacc

SEQ ID NO: 574166 - RNA, 21 nt, Human
cggagcagcagcgcucaacuc

SEQ ID NO: 574167 - RNA, 19 nt, Human
cucaaaucaaagaaaaagc

SEQ ID NO: 574168 - RNA, 21 nt, Human
cucaaaucaaagaaaaagcac

SEQ ID NO: 574169 - RNA, 22 nt, Human
cucaaugcugagaaauuacucc

SEQ ID NO: 574170 - RNA, 18 nt, Human
cuccugggcccagaaguu

SEQ ID NO: 574171 - RNA, 18 nt, Human
cugaaacucuccccgucu

SEQ ID NO: 574172 - RNA, 20 nt, Human
cuggcccccggaacuccucc

SEQ ID NO: 574173 - RNA, 24 nt, Human
cuguaccucaaaucaaagaaaaag

SEQ ID NO: 574174 - RNA, 20 nt, Human
cuuaaacuagaagcugcagc

SEQ ID NO: 574175 - RNA, 20 nt, Human
gaaaaaaauaaaacaaagag

SEQ ID NO: 574176 - RNA, 22 nt, Human
gacaaagcucccucgcccaaag

SEQ ID NO: 574177 - RNA, 19 nt, Human
gacccagugagcagcugga

SEQ ID NO: 574178 - RNA, 23 nt, Human
gcugcugcuggugaaguagaaca

SEQ ID NO: 574179 - RNA, 21 nt, Human
gcuuucccugggaccaacaga

SEQ ID NO: 574180 - RNA, 24 nt, Human
ggacagggaaacauucgcauaauu

SEQ ID NO: 574181 - RNA, 23 nt, Human
ggaguuaggugggucaaagcuga

SEQ ID NO: 574182 - RNA, 24 nt, Human
ggucacuacacuaacagacccaga

SEQ ID NO: 574183 - RNA, 24 nt, Human
ggucauucuugcugcugugggugu

SEQ ID NO: 574184 - RNA, 20 nt, Human
ggugugaguaaaaugcuuag

SEQ ID NO: 574185 - RNA, 23 nt, Human
gugaaguaaauuaaacaugcccc

SEQ ID NO: 574186 - RNA, 19 nt, Human
guguuucaagacaucuguu

SEQ ID NO: 574187 - RNA, 18 nt, Human
uaagauggaggccuccgc

SEQ ID NO: 574188 - RNA, 21 nt, Human
uaaggcacaaaucagguaacc

SEQ ID NO: 574189 - RNA, 26 nt, Human
uacaauaaaacacauagacacugaag

SEQ ID NO: 574190 - RNA, 23 nt, Human
uacaccaacauggaauaaaugga

SEQ ID NO: 574191 - RNA, 24 nt, Human
uacacuaacagacccagaugacac

SEQ ID NO: 574192 - RNA, 19 nt, Human
uacuaagauggaggccucc

SEQ ID NO: 574193 - RNA, 25 nt, Human
uacuucagaacacagaugaaaccaa

SEQ ID NO: 574194 - RNA, 22 nt, Human
uagcaaauucuaagaauucaua

SEQ ID NO: 574195 - RNA, 23 nt, Human
uagcugaaaggcucgcugaaauc

SEQ ID NO: 574196 - RNA, 21 nt, Human
uagcuuggaauuuaaguuucu

SEQ ID NO: 574197 - RNA, 22 nt, Human
uaucucaagaacaagggcagcc

SEQ ID NO: 574198 - RNA, 21 nt, Human
uauuauaacuuuuaaaauugc

SEQ ID NO: 574199 - RNA, 24 nt, Human
ucaaagguccuuuucuccuuuucu

SEQ ID NO: 574200 - RNA, 22 nt, Human
ucaacaucuguguugguaaacu

SEQ ID NO: 574201 - RNA, 23 nt, Human
ucaauaaacuucucaacaucugu

SEQ ID NO: 574202 - RNA, 22 nt, Human
ucacuacacuaacagacccaga

SEQ ID NO: 574203 - RNA, 24 nt, Human
ucagaacacagaugaaaccaaaag

SEQ ID NO: 574204 - RNA, 22 nt, Human
ucagugccuuucaauaaacuuc

SEQ ID NO: 574205 - RNA, 23 nt, Human
uccucaaaagaaaauuuccuugc

SEQ ID NO: 574206 - RNA, 18 nt, Human
uccugcuguguguauggc

SEQ ID NO: 574207 - RNA, 20 nt, Human
uccugggcccagaaguuguc

SEQ ID NO: 574208 - RNA, 19 nt, Human
uccuuggaaguauggaagg

SEQ ID NO: 574209 - RNA, 20 nt, Human
ucuugcccacgcugaacuca

SEQ ID NO: 574210 - RNA, 25 nt, Human
ugaaguaaauuaaacaugccccucg

SEQ ID NO: 574211 - RNA, 25 nt, Human
ugaauaucaucagacacauacacaa

SEQ ID NO: 574212 - RNA, 18 nt, Human
ugaaugacagaaugugca

SEQ ID NO: 574213 - RNA, 19 nt, Human
ugaauuaacgcugcugcug

SEQ ID NO: 574214 - RNA, 21 nt, Human
ugacagaaugugcauaaaagu

SEQ ID NO: 574215 - RNA, 22 nt, Human
ugagauguaucaagaauacauc

SEQ ID NO: 574216 - RNA, 19 nt, Human
ugagccuagacaaaggugg

SEQ ID NO: 574217 - RNA, 22 nt, Human
ugcagcagcgggaggaagggcu

SEQ ID NO: 574218 - RNA, 19 nt, Human
ugcauaaaagucucuugcc

SEQ ID NO: 574219 - RNA, 19 nt, Human
ugccucagggaauuuucca

SEQ ID NO: 574220 - RNA, 20 nt, Human
ugccucagggaauuuuccag

SEQ ID NO: 574221 - RNA, 21 nt, Human
ugccucagggaauuuuccagu

SEQ ID NO: 574222 - RNA, 25 nt, Human
ugcuauuacagguggaauaucuggu

SEQ ID NO: 574223 - RNA, 18 nt, Human
uggaagaaagaggcauuu

SEQ ID NO: 574224 - RNA, 24 nt, Human
uggcaaaaugacucagacccacaa

SEQ ID NO: 574225 - RNA, 21 nt, Human
uggcaagaaaugagaggaguu

SEQ ID NO: 574226 - RNA, 24 nt, Human
uggcaagaaaugagaggaguucaa

SEQ ID NO: 574227 - RNA, 23 nt, Human
uggccagugaguuuugccucagg

SEQ ID NO: 574228 - RNA, 21 nt, Human
ugucuucuauauucucuccca

SEQ ID NO: 574229 - RNA, 23 nt, Human
uguggaaugggggcuacccuuuu

SEQ ID NO: 574230 - RNA, 25 nt, Human
uguggaaugggggcuacccuuuuua

SEQ ID NO: 574231 - RNA, 23 nt, Human
uuagagcaagaucacccucaaaa

SEQ ID NO: 574232 - RNA, 19 nt, Human
uucaaaacccauacgcccu

SEQ ID NO: 574233 - RNA, 19 nt, Human
uucacuuuaaguuauaugc

SEQ ID NO: 574234 - RNA, 18 nt, Human
uuccucauaaacgguucc

SEQ ID NO: 574235 - RNA, 23 nt, Human
uuccugaguggggaaaaccgcug

SEQ ID NO: 574236 - RNA, 21 nt, Human
uuccuuuuccauuuugccacc

SEQ ID NO: 574237 - RNA, 18 nt, Human
uuggaaguauggaaggag

SEQ ID NO: 574238 - RNA, 29 nt, Human
uuggagagcuaugaauucaacaaggaaga

SEQ ID NO: 574239 - RNA, 23 nt, Human
uuucauuguggucuggucagauu

SEQ ID NO: 574240 - RNA, 19 nt, Human
uuuuuaauagcaaauucua

SEQ ID NO: 574241 - RNA, 24 nt, Human
aaaaaacaacaacaaaaaagcaau

SEQ ID NO: 574242 - RNA, 23 nt, Human
aaaaauuucuggaauauuaguac

SEQ ID NO: 574243 - RNA, 23 nt, Human
aaaaugcaacacaauucuuugaa

SEQ ID NO: 574244 - RNA, 21 nt, Human
aaacagcagaaaacaggagga

SEQ ID NO: 574245 - RNA, 18 nt, Human
aaacaggaggaacuuagg

SEQ ID NO: 574246 - RNA, 25 nt, Human
aaacaggcauucuucuacacaaaca

SEQ ID NO: 574247 - RNA, 19 nt, Human
aaacuugaaaaguguggca

SEQ ID NO: 574248 - RNA, 21 nt, Human
aaagauuuaagcaguagacac

SEQ ID NO: 574249 - RNA, 22 nt, Human
aaagcuagguugaauaggacug

SEQ ID NO: 574250 - RNA, 19 nt, Human
aaaguauacauuacccagg

SEQ ID NO: 574251 - RNA, 19 nt, Human
aacagauaaaacuccaaau

SEQ ID NO: 574252 - RNA, 18 nt, Human
aacuuaggccaucaaugg

SEQ ID NO: 574253 - RNA, 23 nt, Human
aagcauuuauacacaugaaaaug

SEQ ID NO: 574254 - RNA, 24 nt, Human
aaugcaacacaauucuuugaaagg

SEQ ID NO: 574255 - RNA, 23 nt, Human
acauacuccaaaauccccauaau

SEQ ID NO: 574256 - RNA, 18 nt, Human
acccugacaggaaccgcu

SEQ ID NO: 574257 - RNA, 19 nt, Human
accucaacaaagaugguac

SEQ ID NO: 574258 - RNA, 18 nt, Human
agaaaacaggaggaacuu

SEQ ID NO: 574259 - RNA, 21 nt, Human
agaaaacaggaggaacuuagg

SEQ ID NO: 574260 - RNA, 18 nt, Human
agaauaaaaacagccuga

SEQ ID NO: 574261 - RNA, 19 nt, Human
agcaaacaacaaagacugc

SEQ ID NO: 574262 - RNA, 25 nt, Human
agccaccagcgccaccgccacagcc

SEQ ID NO: 574263 - RNA, 22 nt, Human
agcgccaccgccacagccaccu

SEQ ID NO: 574264 - RNA, 20 nt, Human
agggaagaagcaaacaacaa

SEQ ID NO: 574265 - RNA, 22 nt, Human
agggaagaagcaaacaacaaag

SEQ ID NO: 574266 - RNA, 21 nt, Human
auaaaacuugaaaaguguggc

SEQ ID NO: 574267 - RNA, 24 nt, Human
auaaagccuauaagaaaaagaaau

SEQ ID NO: 574268 - RNA, 23 nt, Human
auacacauauacagcuucauaug

SEQ ID NO: 574269 - RNA, 24 nt, Human
auaguuccugaaaauuaaugcauc

SEQ ID NO: 574270 - RNA, 22 nt, Human
aucaaacagcagaaaacaggag

SEQ ID NO: 574271 - RNA, 23 nt, Human
auuaaucaaaaguauacauuacc

SEQ ID NO: 574272 - RNA, 19 nt, Human
caaacagcagaaaacagga

SEQ ID NO: 574273 - RNA, 27 nt, Human
caaagaacacaccaaauaccggggccc

SEQ ID NO: 574274 - RNA, 20 nt, Human
caaauaacuguacuggauaa

SEQ ID NO: 574275 - RNA, 24 nt, Human
caacaaagaugguacuuuaagcau

SEQ ID NO: 574276 - RNA, 22 nt, Human
cagaauaaaaacagccugagua

SEQ ID NO: 574277 - RNA, 21 nt, Human
cagagacuauaugaauguucc

SEQ ID NO: 574278 - RNA, 22 nt, Human
cagauaucagcauucgaaagcu

SEQ ID NO: 574279 - RNA, 20 nt, Human
cagcagaaaacaggaggaaa

SEQ ID NO: 574280 - RNA, 24 nt, Human
caggauaaccauacaucaaguacu

SEQ ID NO: 574281 - RNA, 22 nt, Human
cagguggaccacccagggggcc

SEQ ID NO: 574282 - RNA, 23 nt, Human
caguaaaaaaacaacaacaaaaa

SEQ ID NO: 574283 - RNA, 22 nt, Human
caguagacacaagucacaugaa

SEQ ID NO: 574284 - RNA, 24 nt, Human
ccaacuucaaaaugacauacuaac

SEQ ID NO: 574285 - RNA, 18 nt, Human
ccacccagggggcccgcc

SEQ ID NO: 574286 - RNA, 21 nt, Human
ccagcgccaccgccacagcca

SEQ ID NO: 574287 - RNA, 22 nt, Human
cccccaacaauguauccccgaa

SEQ ID NO: 574288 - RNA, 20 nt, Human
ccccgaaaauaaacugccaa

SEQ ID NO: 574289 - RNA, 23 nt, Human
ccgccacagccaccuccgcugua

SEQ ID NO: 574290 - RNA, 21 nt, Human
ccgccgccgccgccgcagcca

SEQ ID NO: 574291 - RNA, 25 nt, Human
ccgccgccgccgccgcagccaccag

SEQ ID NO: 574292 - RNA, 18 nt, Human
ccgcugccgccgccgccg

SEQ ID NO: 574293 - RNA, 22 nt, Human
ccuaagcaggaccuacccaacc

SEQ ID NO: 574294 - RNA, 20 nt, Human
ccuauaugcaaaaguggaau

SEQ ID NO: 574295 - RNA, 24 nt, Human
cgccgcugccgccgccgccgccgg

SEQ ID NO: 574296 - RNA, 22 nt, Human
cgcgauuugcagguggaccacc

SEQ ID NO: 574297 - RNA, 18 nt, Human
cuucagaauaaauaauau

SEQ ID NO: 574298 - RNA, 23 nt, Human
gaaauuucaggauaaccauacau

SEQ ID NO: 574299 - RNA, 22 nt, Human
gagaaagugcugaaagggcucu

SEQ ID NO: 574300 - RNA, 23 nt, Human
gaugagaaagugcugaaagggcu

SEQ ID NO: 574301 - RNA, 18 nt, Human
gccacagccaccuccgcu

SEQ ID NO: 574302 - RNA, 18 nt, Human
ggaugguaguccuccuua

SEQ ID NO: 574303 - RNA, 21 nt, Human
uaaaacagauaaaacuccaaa

SEQ ID NO: 574304 - RNA, 20 nt, Human
uaaaagucauuaugaaacac

SEQ ID NO: 574305 - RNA, 19 nt, Human
uaaaauaauucauuaguaa

SEQ ID NO: 574306 - RNA, 25 nt, Human
uaaagauuuaagcaguagacacaag

SEQ ID NO: 574307 - RNA, 20 nt, Human
uaacauaggacauacuaacc

SEQ ID NO: 574308 - RNA, 21 nt, Human
uaacauaggacauacuaacca

SEQ ID NO: 574309 - RNA, 19 nt, Human
uaacuaaagagaaugugca

SEQ ID NO: 574310 - RNA, 20 nt, Human
uaacuaaagagaaugugcau

SEQ ID NO: 574311 - RNA, 26 nt, Human
uaacuaaagagaaugugcauacacau

SEQ ID NO: 574312 - RNA, 19 nt, Human
uaacugaaggaaaauauaa

SEQ ID NO: 574313 - RNA, 28 nt, Human
uaagaaaaagaaaugucuucccuccccc

SEQ ID NO: 574314 - RNA, 18 nt, Human
uaagcaggaccuacccaa

SEQ ID NO: 574315 - RNA, 21 nt, Human
uaagcaggaccuacccaacca

SEQ ID NO: 574316 - RNA, 24 nt, Human
uaauacauauuuucaugcaugugg

SEQ ID NO: 574317 - RNA, 18 nt, Human
uaccugcagaauaaaaac

SEQ ID NO: 574318 - RNA, 21 nt, Human
uacguauuauaauuuaucaug

SEQ ID NO: 574319 - RNA, 19 nt, Human
uagaaugccauuucagcag

SEQ ID NO: 574320 - RNA, 21 nt, Human
uagacaaagaacacaccaaaa

SEQ ID NO: 574321 - RNA, 23 nt, Human
uagacaaagaacacaccaaauac

SEQ ID NO: 574322 - RNA, 18 nt, Human
uagagaucaaacagcaga

SEQ ID NO: 574323 - RNA, 23 nt, Human
uagggaagaagcaaacaacaaag

SEQ ID NO: 574324 - RNA, 22 nt, Human
uauuaaccauuacauuguuuuu

SEQ ID NO: 574325 - RNA, 21 nt, Human
ucaaaacacuuaccugcagaa

SEQ ID NO: 574326 - RNA, 23 nt, Human
ucauauguuauauaaaacuugaa

SEQ ID NO: 574327 - RNA, 23 nt, Human
ucauguacauacuccaaaauccc

SEQ ID NO: 574328 - RNA, 23 nt, Human
uccacaaaauacauacacauaua

SEQ ID NO: 574329 - RNA, 20 nt, Human
ucccccaacaauguaucccc

SEQ ID NO: 574330 - RNA, 21 nt, Human
ucccccaacaauguauccccg

SEQ ID NO: 574331 - RNA, 22 nt, Human
ucccccaacaauguauccccga

SEQ ID NO: 574332 - RNA, 21 nt, Human
uccccgaaaauaaacugccaa

SEQ ID NO: 574333 - RNA, 25 nt, Human
uccuaagcaggaccuacccaaccac

SEQ ID NO: 574334 - RNA, 25 nt, Human
uccuuaaacagcacagacucaaucu

SEQ ID NO: 574335 - RNA, 21 nt, Human
ucuccauuaagcauuuacaug

SEQ ID NO: 574336 - RNA, 18 nt, Human
ucuuucucugaauccuga

SEQ ID NO: 574337 - RNA, 24 nt, Human
ugaaaacagucuccauuaagcauu

SEQ ID NO: 574338 - RNA, 21 nt, Human
ugaaaaguguggcacauuucu

SEQ ID NO: 574339 - RNA, 24 nt, Human
ugaaacacacauucuuuuaacuga

SEQ ID NO: 574340 - RNA, 24 nt, Human
ugaaaucaaagcuaagcuugacaa

SEQ ID NO: 574341 - RNA, 19 nt, Human
ugaaggacugacaaaacag

SEQ ID NO: 574342 - RNA, 20 nt, Human
ugacaggaaccgcucgagcg

SEQ ID NO: 574343 - RNA, 19 nt, Human
ugagcauaaagccuauaag

SEQ ID NO: 574344 - RNA, 26 nt, Human
ugauuuaaaauauaacugaaggaaaa

SEQ ID NO: 574345 - RNA, 21 nt, Human
ugcagaauaaaaacagccuga

SEQ ID NO: 574346 - RNA, 24 nt, Human
uggaaagaguggcagaaaccccuc

SEQ ID NO: 574347 - RNA, 22 nt, Human
uggcagaaaccccucuccccca

SEQ ID NO: 574348 - RNA, 23 nt, Human
uggcagaaaccccucucccccaa

SEQ ID NO: 574349 - RNA, 25 nt, Human
ugggugcauuuaaaaugcaacacaa

SEQ ID NO: 574350 - RNA, 19 nt, Human
uguaaaacagauaaaacuc

SEQ ID NO: 574351 - RNA, 25 nt, Human
uuaaaguaugucuuaggaaaaccaa

SEQ ID NO: 574352 - RNA, 23 nt, Human
uucauauguuauauaaaacuuga

SEQ ID NO: 574353 - RNA, 20 nt, Human
uuuuagaaaaguuaugugcc

SEQ ID NO: 574354 - RNA, 18 nt, Human
aaaagaaaagacguagcc

SEQ ID NO: 574355 - RNA, 24 nt, Human
aaaagaacaguucucaaauauugc

SEQ ID NO: 574356 - RNA, 26 nt, Human
aagaaaaaaaaagaacaguucucaaa

SEQ ID NO: 574357 - RNA, 20 nt, Human
acaguuugaagagacuaaau

SEQ ID NO: 574358 - RNA, 25 nt, Human
accgcugugcaacucaacgcugcgc

SEQ ID NO: 574359 - RNA, 22 nt, Human
acuaaaagcauacuaaaaacac

SEQ ID NO: 574360 - RNA, 18 nt, Human
agaacaguucucaaauau

SEQ ID NO: 574361 - RNA, 24 nt, Human
aggcaaaagaaaagacguagccaa

SEQ ID NO: 574362 - RNA, 21 nt, Human
augaaacagaggaggaccaaa

SEQ ID NO: 574363 - RNA, 20 nt, Human
auggaauaugcuguauaucc

SEQ ID NO: 574364 - RNA, 24 nt, Human
cauacuaaaaacacuuuaucguca

SEQ ID NO: 574365 - RNA, 28 nt, Human
cauagaacguucaucaaggcaaaagaaa

SEQ ID NO: 574366 - RNA, 22 nt, Human
ccccaguuacaagagacuaaaa

SEQ ID NO: 574367 - RNA, 19 nt, Human
ccuaaaaaaaaaacacugc

SEQ ID NO: 574368 - RNA, 21 nt, Human
cuaaaagcauacuaaaaacac

SEQ ID NO: 574369 - RNA, 18 nt, Human
uaaaaacacuuuaucguc

SEQ ID NO: 574370 - RNA, 19 nt, Human
uaaauacacauccuaaaug

SEQ ID NO: 574371 - RNA, 20 nt, Human
uaaauacacauccuaaaugg

SEQ ID NO: 574372 - RNA, 24 nt, Human
uaaaugcauuaaauacacauccua

SEQ ID NO: 574373 - RNA, 18 nt, Human
uacaagagacuaaaagca

SEQ ID NO: 574374 - RNA, 22 nt, Human
uagaacguucaucaaggcaaaa

SEQ ID NO: 574375 - RNA, 24 nt, Human
uagccaacaauggaaagauggcac

SEQ ID NO: 574376 - RNA, 23 nt, Human
uauacacaguuugaagagacuaa

SEQ ID NO: 574377 - RNA, 24 nt, Human
uccuaaaaaaaaaacacugcuucu

SEQ ID NO: 574378 - RNA, 22 nt, Human
ugaagagacuaaaugccagaga

SEQ ID NO: 574379 - RNA, 19 nt, Human
ugagaauaccgcugugcaa

SEQ ID NO: 574380 - RNA, 20 nt, Human
uggcacacacaagaaaaaaa

SEQ ID NO: 574381 - RNA, 24 nt, Human
uggcacacacaagaaaaaaaaaga

SEQ ID NO: 574382 - RNA, 19 nt, Human
uguggccggcacuguggcc

SEQ ID NO: 574383 - RNA, 19 nt, Human
uugaagagacuaaaugcca

SEQ ID NO: 574384 - RNA, 21 nt, Human
aagacagccagccagucaccu

SEQ ID NO: 574385 - RNA, 19 nt, Human
aagagccaccucuucacuc

SEQ ID NO: 574386 - RNA, 22 nt, Human
accucuuggaaaacuucuccug

SEQ ID NO: 574387 - RNA, 24 nt, Human
agaagaaaaugagccugaaguuga

SEQ ID NO: 574388 - RNA, 21 nt, Human
agccagugagggacugcagga

SEQ ID NO: 574389 - RNA, 22 nt, Human
aggcaaguaaacgaaaccaaag

SEQ ID NO: 574390 - RNA, 24 nt, Human
agguggcuugugagggcagccagu

SEQ ID NO: 574391 - RNA, 19 nt, Human
augaaccucuuggaaaacu

SEQ ID NO: 574392 - RNA, 21 nt, Human
auggccucucaugccacuccu

SEQ ID NO: 574393 - RNA, 24 nt, Human
auggccucucaugccacuccucag

SEQ ID NO: 574394 - RNA, 20 nt, Human
caagacagccagccagucac

SEQ ID NO: 574395 - RNA, 22 nt, Human
caagacagccagccagucaccu

SEQ ID NO: 574396 - RNA, 21 nt, Human
caaguaaacgaaaccaaaggc

SEQ ID NO: 574397 - RNA, 19 nt, Human
cacuccuuaagccagagga

SEQ ID NO: 574398 - RNA, 21 nt, Human
cagaggacaccacaaagacac

SEQ ID NO: 574399 - RNA, 22 nt, Human
cagugcugggaauaaguccaga

SEQ ID NO: 574400 - RNA, 27 nt, Human
ccagaccauuucccucaagagccaccu

SEQ ID NO: 574401 - RNA, 24 nt, Human
ccagaggacaccacaaagacacag

SEQ ID NO: 574402 - RNA, 24 nt, Human
ccucaagagccaccucuucacucc

SEQ ID NO: 574403 - RNA, 24 nt, Human
ccucuucacuccuuaagccagagg

SEQ ID NO: 574404 - RNA, 19 nt, Human
cucagaguagaaaaugcag

SEQ ID NO: 574405 - RNA, 18 nt, Human
cugggacugaugcaagac

SEQ ID NO: 574406 - RNA, 26 nt, Human
cuuggaaaacuucuccugucccacuu

SEQ ID NO: 574407 - RNA, 20 nt, Human
gccagucaccuccgccuccc

SEQ ID NO: 574408 - RNA, 19 nt, Human
gccugggacugaugcaaga

SEQ ID NO: 574409 - RNA, 24 nt, Human
uagcagucacugaacuccucaaac

SEQ ID NO: 574410 - RNA, 22 nt, Human
uaggcaaguaaacgaaaccaaa

SEQ ID NO: 574411 - RNA, 24 nt, Human
uaggcaaguaaacgaaaccaaagg

SEQ ID NO: 574412 - RNA, 24 nt, Human
ucaauagcagucacugaacuccuc

SEQ ID NO: 574413 - RNA, 21 nt, Human
uccagaccauuucccucaaga

SEQ ID NO: 574414 - RNA, 22 nt, Human
ucccacuucugucacccuccag

SEQ ID NO: 574415 - RNA, 18 nt, Human
ucccaugaaccucuugga

SEQ ID NO: 574416 - RNA, 19 nt, Human
uccucagguggcuugugag

SEQ ID NO: 574417 - RNA, 18 nt, Human
ucugucacccuccagcuc

SEQ ID NO: 574418 - RNA, 18 nt, Human
ugagaagaaaaugagccu

SEQ ID NO: 574419 - RNA, 20 nt, Human
ugagggcagccagugagggg

SEQ ID NO: 574420 - RNA, 19 nt, Human
ugccugaaacagugcuggg

SEQ ID NO: 574421 - RNA, 24 nt, Human
uggaaaacuucuccugucccacuu

SEQ ID NO: 574422 - RNA, 23 nt, Human
uggguucacuuuaccauauuuug

SEQ ID NO: 574423 - RNA, 23 nt, Human
uuaauggccucucaugccacucc

SEQ ID NO: 574424 - RNA, 27 nt, Human
uucacuccuuaagccagaggacaccac

SEQ ID NO: 574425 - RNA, 18 nt, Human
aaaggcaucuucuacaaa

SEQ ID NO: 574426 - RNA, 22 nt, Human
aagcaguuagaacauaccuuga

SEQ ID NO: 574427 - RNA, 23 nt, Human
aaguagguggcuacucaguccau

SEQ ID NO: 574428 - RNA, 24 nt, Human
aauuuaaaacucuggaaacaauuu

SEQ ID NO: 574429 - RNA, 21 nt, Human
aggaagaaaggcaucuucuac

SEQ ID NO: 574430 - RNA, 24 nt, Human
aggaauuuuuggaaaaagaaaauc

SEQ ID NO: 574431 - RNA, 23 nt, Human
aggcacauaaauaauuuaaaacu

SEQ ID NO: 574432 - RNA, 20 nt, Human
aguuagauccaucuugggag

SEQ ID NO: 574433 - RNA, 23 nt, Human
auacaguucacuuuuaaucauuc

SEQ ID NO: 574434 - RNA, 21 nt, Human
aucuucuacaaacccuauuca

SEQ ID NO: 574435 - RNA, 19 nt, Human
caaaggcuaggcuaaaagc

SEQ ID NO: 574436 - RNA, 25 nt, Human
caacaggcacauaaauaauuuaaaa

SEQ ID NO: 574437 - RNA, 24 nt, Human
caauggcagaugaugccaaaguca

SEQ ID NO: 574438 - RNA, 18 nt, Human
cacaccugagaccgcccc

SEQ ID NO: 574439 - RNA, 24 nt, Human
caucaauggcagaugaugccaaag

SEQ ID NO: 574440 - RNA, 18 nt, Human
ccgccccagcccgcggcg

SEQ ID NO: 574441 - RNA, 19 nt, Human
ccgcgaggcgaaacggguc

SEQ ID NO: 574442 - RNA, 23 nt, Human
ccuucuauguacaucuguccuag

SEQ ID NO: 574443 - RNA, 23 nt, Human
cuaauacaauacaaugaaccaaa

SEQ ID NO: 574444 - RNA, 24 nt, Human
cucauuucugucaaaggcuaggcu

SEQ ID NO: 574445 - RNA, 25 nt, Human
gcauaggcuccaaagcaugaccugc

SEQ ID NO: 574446 - RNA, 18 nt, Human
gcccgaugauugagcaga

SEQ ID NO: 574447 - RNA, 19 nt, Human
gcuaaaagcuuuuugaggg

SEQ ID NO: 574448 - RNA, 19 nt, Human
gcuuuuugagggucacacu

SEQ ID NO: 574449 - RNA, 23 nt, Human
ggaagaaaggcaucuucuacaaa

SEQ ID NO: 574450 - RNA, 28 nt, Human
ggacacaguaaagaguuaaccgguaccc

SEQ ID NO: 574451 - RNA, 27 nt, Human
gugcauaggcuccaaagcaugaccugc

SEQ ID NO: 574452 - RNA, 20 nt, Human
guggaagugaugacagcucc

SEQ ID NO: 574453 - RNA, 23 nt, Human
uaacccagcuuccucggggacac

SEQ ID NO: 574454 - RNA, 21 nt, Human
uaagaaacuuaauuacuaguu

SEQ ID NO: 574455 - RNA, 19 nt, Human
uaauacaauacaaugaacc

SEQ ID NO: 574456 - RNA, 23 nt, Human
uacaauacaaugaaccaaacagg

SEQ ID NO: 574457 - RNA, 24 nt, Human
uacaugcuguuccucccagcaagg

SEQ ID NO: 574458 - RNA, 20 nt, Human
ucacacucguuccuuuugua

SEQ ID NO: 574459 - RNA, 23 nt, Human
ucaccaaaugaaaguaauugugc

SEQ ID NO: 574460 - RNA, 24 nt, Human
ucaguugccaugccuaacaaaccc

SEQ ID NO: 574461 - RNA, 25 nt, Human
uccaaaaaacaguuucuucccauuu

SEQ ID NO: 574462 - RNA, 20 nt, Human
ucucuaaacaacgcgaggug

SEQ ID NO: 574463 - RNA, 24 nt, Human
ucuucuacaaacccuauucaaaag

SEQ ID NO: 574464 - RNA, 19 nt, Human
ugaaaucaucaaaauacaa

SEQ ID NO: 574465 - RNA, 21 nt, Human
ugaccagagcuucggcacacc

SEQ ID NO: 574466 - RNA, 22 nt, Human
ugcuaccaaguccucuuugaag

SEQ ID NO: 574467 - RNA, 24 nt, Human
uggaagcaguuagaacauaccuug

SEQ ID NO: 574468 - RNA, 19 nt, Human
uggaagucaccaaaugaaa

SEQ ID NO: 574469 - RNA, 19 nt, Human
uggcagaugaugccaaagu

SEQ ID NO: 574470 - RNA, 23 nt, Human
uggccagcucuuuaaaaaguuua

SEQ ID NO: 574471 - RNA, 22 nt, Human
uguccuagugcuuuugaguguu

SEQ ID NO: 574472 - RNA, 18 nt, Human
uuacaugcuguuccuccc

SEQ ID NO: 574473 - RNA, 23 nt, Human
uuacaugcuguuccucccagcaa

SEQ ID NO: 574474 - RNA, 18 nt, Human
uuagaacauaccuugaga

SEQ ID NO: 574475 - RNA, 18 nt, Human
uuccucccagcaaggccc

SEQ ID NO: 574476 - RNA, 20 nt, Human
uuccucccagcaaggcccca

SEQ ID NO: 574477 - RNA, 20 nt, Human
uucggcacaccugagaccgc

SEQ ID NO: 574478 - RNA, 19 nt, Human
uuuuguauuaacuuuuauu

SEQ ID NO: 574479 - RNA, 27 nt, Human
aaaaaagccaaacauccuuaacuuaag

SEQ ID NO: 574480 - RNA, 22 nt, Human
aaaaagaagaaaagaaagaaaa

SEQ ID NO: 574481 - RNA, 23 nt, Human
aaaagaagaaaagaaagaaaaag

SEQ ID NO: 574482 - RNA, 24 nt, Human
aaaauaaaaaagaagaaaagaaga

SEQ ID NO: 574483 - RNA, 23 nt, Human
aaaauaaaaaucgcuagauggag

SEQ ID NO: 574484 - RNA, 22 nt, Human
aaaauuccuuuaaaaaaaaagc

SEQ ID NO: 574485 - RNA, 20 nt, Human
aaacauccuuaacuuaagaa

SEQ ID NO: 574486 - RNA, 19 nt, Human
aaagaagaaaagaaagaaa

SEQ ID NO: 574487 - RNA, 19 nt, Human
aagaaaaaggaagagacac

SEQ ID NO: 574488 - RNA, 18 nt, Human
aagaagaaaagaaagaaa

SEQ ID NO: 574489 - RNA, 20 nt, Human
aagaagaaaagaaagaaaaa

SEQ ID NO: 574490 - RNA, 21 nt, Human
aagaagaaaagaaagaaaaag

SEQ ID NO: 574491 - RNA, 23 nt, Human
aagaagaaaagaaagaaaaagga

SEQ ID NO: 574492 - RNA, 25 nt, Human
aagaagaaaagaaagaaaaaggaag

SEQ ID NO: 574493 - RNA, 21 nt, Human
aaggaagagacacuuaaaaaa

SEQ ID NO: 574494 - RNA, 20 nt, Human
agaaaaaagccaaacauccu

SEQ ID NO: 574495 - RNA, 23 nt, Human
agaaaagaaagaaaaaggaagag

SEQ ID NO: 574496 - RNA, 26 nt, Human
agaagaaaagaaagaaaaaggaagag

SEQ ID NO: 574497 - RNA, 19 nt, Human
agaagcggcggguggaugg

SEQ ID NO: 574498 - RNA, 20 nt, Human
aggaagagacacuuaaaaaa

SEQ ID NO: 574499 - RNA, 23 nt, Human
cagccucaguaucuagaaaugau

SEQ ID NO: 574500 - RNA, 26 nt, Human
cauccuuaacuuaagaaacuuaagga

SEQ ID NO: 574501 - RNA, 21 nt, Human
cucugcgcuaggacccuaaac

SEQ ID NO: 574502 - RNA, 21 nt, Human
cugcaaagcaaugccaaaaaa

SEQ ID NO: 574503 - RNA, 19 nt, Human
cuggcuauucuugcacucc

SEQ ID NO: 574504 - RNA, 24 nt, Human
gaacauaugucaaaaucggaaaug

SEQ ID NO: 574505 - RNA, 23 nt, Human
ggaguuuucacaauuccuaaguc

SEQ ID NO: 574506 - RNA, 19 nt, Human
ggaugggaagauaucaacu

SEQ ID NO: 574507 - RNA, 22 nt, Human
ggcaggaauauaaagaaccuca

SEQ ID NO: 574508 - RNA, 24 nt, Human
uaaaaaauuaaagaaaaaagccaa

SEQ ID NO: 574509 - RNA, 18 nt, Human
uagaaaggaggcuaacug

SEQ ID NO: 574510 - RNA, 22 nt, Human
uaggacccuaaacuguauguua

SEQ ID NO: 574511 - RNA, 18 nt, Human
uauaaagaaccucaauaa

SEQ ID NO: 574512 - RNA, 22 nt, Human
uauaaugauggggugaaaaguu

SEQ ID NO: 574513 - RNA, 18 nt, Human
ucaguacauucuuugugg

SEQ ID NO: 574514 - RNA, 19 nt, Human
uccacugccacagaacuag

SEQ ID NO: 574515 - RNA, 20 nt, Human
ucugcaaagcaaugccaaaa

SEQ ID NO: 574516 - RNA, 19 nt, Human
ucugcgcuaggacccuaaa

SEQ ID NO: 574517 - RNA, 25 nt, Human
ugaaaaauuucuuagacauccacuu

SEQ ID NO: 574518 - RNA, 19 nt, Human
ugaaagaagggauaugcag

SEQ ID NO: 574519 - RNA, 23 nt, Human
ugcacuccuaacauaggaaaaug

SEQ ID NO: 574520 - RNA, 20 nt, Human
ugguauaaugauggggugaa

SEQ ID NO: 574521 - RNA, 19 nt, Human
uuaaagaaaaaagccaaac

SEQ ID NO: 574522 - RNA, 19 nt, Human
acuggauucuguuuuuaau

SEQ ID NO: 574523 - RNA, 18 nt, Human
ccgccucuguaccuucgc

SEQ ID NO: 574524 - RNA, 19 nt, Human
ccuggcgaaaaaggaaucc

SEQ ID NO: 574525 - RNA, 19 nt, Human
cgccuggacgacugaggag

SEQ ID NO: 574526 - RNA, 24 nt, Human
ugggggaggaaagcauauuguuug

SEQ ID NO: 574527 - RNA, 18 nt, Human
ugaguaaagagaaagaga

SEQ ID NO: 574528 - RNA, 25 nt, Human
ugaguaaagagaaagagagaaggaa

SEQ ID NO: 574529 - RNA, 21 nt, Human
ugcccccccggcaucccccuc

SEQ ID NO: 574530 - RNA, 20 nt, Human
aaaaaacacuuccauuugcu

SEQ ID NO: 574531 - RNA, 20 nt, Human
aaagugcuggguuuacaggc

SEQ ID NO: 574532 - RNA, 24 nt, Human
aaagugcuggguuuacaggcguga

SEQ ID NO: 574533 - RNA, 22 nt, Human
aacaaaaagcaggcugggaaaa

SEQ ID NO: 574534 - RNA, 20 nt, Human
aacacaauaccuauaaaaac

SEQ ID NO: 574535 - RNA, 24 nt, Human
aaccucggacugaagaccuugcca

SEQ ID NO: 574536 - RNA, 21 nt, Human
aacucaugaccucaagugauc

SEQ ID NO: 574537 - RNA, 18 nt, Human
aagaaacaaaaagcaggc

SEQ ID NO: 574538 - RNA, 21 nt, Human
aagcaggcugggaaaagugac

SEQ ID NO: 574539 - RNA, 23 nt, Human
aagcaggcugggaaaagugacuc

SEQ ID NO: 574540 - RNA, 23 nt, Human
aagucaauucugaauugacucua

SEQ ID NO: 574541 - RNA, 21 nt, Human
aauaaacauaaaaaaacugag

SEQ ID NO: 574542 - RNA, 26 nt, Human
acucaaacucaagucaauucugaauu

SEQ ID NO: 574543 - RNA, 18 nt, Human
acugaagacuuugugaca

SEQ ID NO: 574544 - RNA, 21 nt, Human
agaaacaaaaagcaggcuggg

SEQ ID NO: 574545 - RNA, 18 nt, Human
aguaaccucggacugaag

SEQ ID NO: 574546 - RNA, 21 nt, Human
auaaaaaaacugagaauuuca

SEQ ID NO: 574547 - RNA, 21 nt, Human
cauaaacaauaaaaaauuuaa

SEQ ID NO: 574548 - RNA, 19 nt, Human
cauuauggauucuccaaug

SEQ ID NO: 574549 - RNA, 21 nt, Human
ccacacgccuggcccaauccu

SEQ ID NO: 574550 - RNA, 18 nt, Human
ccucuuaacauaaacacc

SEQ ID NO: 574551 - RNA, 27 nt, Human
ccuggucugcgcggaugucgggcggcc

SEQ ID NO: 574552 - RNA, 24 nt, Human
cuaaagugcuggguuuacaggcgu

SEQ ID NO: 574553 - RNA, 24 nt, Human
cucaagugaucuauccaccuuggg

SEQ ID NO: 574554 - RNA, 20 nt, Human
cugaagacuuugugacaauc

SEQ ID NO: 574555 - RNA, 18 nt, Human
cugaccaccaaaggcucu

SEQ ID NO: 574556 - RNA, 20 nt, Human
cuugacugaagaccuugcca

SEQ ID NO: 574557 - RNA, 18 nt, Human
cuuguaagaccuccuuca

SEQ ID NO: 574558 - RNA, 20 nt, Human
cuuguaagaccuccuucauu

SEQ ID NO: 574559 - RNA, 23 nt, Human
gaccucaagugaucuauccaccu

SEQ ID NO: 574560 - RNA, 19 nt, Human
gacuguugccuaaaaaccu

SEQ ID NO: 574561 - RNA, 18 nt, Human
gguuuuuguuaaagaaac

SEQ ID NO: 574562 - RNA, 21 nt, Human
uaaaaaaacugagaauuucac

SEQ ID NO: 574563 - RNA, 18 nt, Human
uaagaaauacuuaggaau

SEQ ID NO: 574564 - RNA, 24 nt, Human
uaagucaacucaaacucaagucaa

SEQ ID NO: 574565 - RNA, 20 nt, Human
uaaugcuucaacugaauguu

SEQ ID NO: 574566 - RNA, 21 nt, Human
uacaggcgugagccacacgcc

SEQ ID NO: 574567 - RNA, 21 nt, Human
uacaggcgugagccacacgcc

SEQ ID NO: 574568 - RNA, 22 nt, Human
uacaggcgugagccacacgccu

SEQ ID NO: 574569 - RNA, 22 nt, Human
uauccaccuugggcuccuaaag

SEQ ID NO: 574570 - RNA, 19 nt, Human
ucaacucaaacucaaguca

SEQ ID NO: 574571 - RNA, 20 nt, Human
ucaauccacgggauccgcuu

SEQ ID NO: 574572 - RNA, 27 nt, Human
uccauaaacaauaaaaaauuuaaacga

SEQ ID NO: 574573 - RNA, 21 nt, Human
ucccuauaccauggauugcuu

SEQ ID NO: 574574 - RNA, 24 nt, Human
uccuaaagugcuggguuuacaggc

SEQ ID NO: 574575 - RNA, 24 nt, Human
uccucuuccguguuuuuuccucac

SEQ ID NO: 574576 - RNA, 22 nt, Human
ucuacugucaauccuugauggu

SEQ ID NO: 574577 - RNA, 19 nt, Human
ugaccucaagugaucuauc

SEQ ID NO: 574578 - RNA, 19 nt, Human
ugacuccuuugcuuuccuc

SEQ ID NO: 574579 - RNA, 21 nt, Human
uggccaggcugaucucaaacu

SEQ ID NO: 574580 - RNA, 18 nt, Human
uggguuuacaggcgugag

SEQ ID NO: 574581 - RNA, 19 nt, Human
uggguuuacaggcgugagc

SEQ ID NO: 574582 - RNA, 22 nt, Human
uggguuuacaggcgugagccac

SEQ ID NO: 574583 - RNA, 23 nt, Human
uggguuuacaggcgugagccaca

SEQ ID NO: 574584 - RNA, 26 nt, Human
uguaagaccuccuucauuauggauuc

SEQ ID NO: 574585 - RNA, 19 nt, Human
uguacaguuccuuuccagu

SEQ ID NO: 574586 - RNA, 21 nt, Human
ugugagguuucucuccuguau

SEQ ID NO: 574587 - RNA, 21 nt, Human
uguugccuaaaaaccuugcaa

SEQ ID NO: 574588 - RNA, 19 nt, Human
uguuggccaggcugaucuc

SEQ ID NO: 574589 - RNA, 22 nt, Human
uguuuugcaauggcuguaauau

SEQ ID NO: 574590 - RNA, 18 nt, Human
uuaagucaacucaaacuc

SEQ ID NO: 574591 - RNA, 23 nt, Human
uuacacuuguaagaccuccuuca

SEQ ID NO: 574592 - RNA, 23 nt, Human
uuacacuuguacaguuccuuucc

SEQ ID NO: 574593 - RNA, 21 nt, Human
uuacugaagacuuugugacaa

SEQ ID NO: 574594 - RNA, 19 nt, Human
uuccguguuuuuuccucac

SEQ ID NO: 574595 - RNA, 19 nt, Human
uugggcuccuaaagugcug

SEQ ID NO: 574596 - RNA, 22 nt, Human
uuguacaguuccuuuccagugu

SEQ ID NO: 574597 - RNA, 24 nt, Human
uuugcacaaugcaauagcagcacc

SEQ ID NO: 574598 - RNA, 21 nt, Human
uuuguaagauuucucuccugu

SEQ ID NO: 574599 - RNA, 19 nt, Human
uuuguaagguuucucucca

SEQ ID NO: 574600 - RNA, 19 nt, Human
uuuguaugguuucucucca

SEQ ID NO: 574601 - RNA, 24 nt, Human
uuuguuaaagaaacaaaaagcagg

SEQ ID NO: 574602 - RNA, 21 nt, Human
aaaaaaaaaaaaaaaagccua

SEQ ID NO: 574603 - RNA, 25 nt, Human
aaaaaaaaaaagccuacuuuaaaga

SEQ ID NO: 574604 - RNA, 19 nt, Human
aaaaaaaacaaaaagacac

SEQ ID NO: 574605 - RNA, 24 nt, Human
aaaaaacaaaaagacacaccuuac

SEQ ID NO: 574606 - RNA, 18 nt, Human
aaaauaagaucuucucca

SEQ ID NO: 574607 - RNA, 22 nt, Human
aaaaugcuuuacccccaaacug

SEQ ID NO: 574608 - RNA, 18 nt, Human
aaacaaaacaaaacccaa

SEQ ID NO: 574609 - RNA, 22 nt, Human
aaacaauguucccccacccccc

SEQ ID NO: 574610 - RNA, 23 nt, Human
aaacuaguuuuauuuuaaaauua

SEQ ID NO: 574611 - RNA, 23 nt, Human
aaagauauauucucuuuugagcc

SEQ ID NO: 574612 - RNA, 21 nt, Human
aaauacugaaaauuggacucc

SEQ ID NO: 574613 - RNA, 22 nt, Human
aaaucuuucuucccccagaaag

SEQ ID NO: 574614 - RNA, 24 nt, Human
aacaauguucccccaccccccaaa

SEQ ID NO: 574615 - RNA, 18 nt, Human
aaccaccccaucccaccc

SEQ ID NO: 574616 - RNA, 22 nt, Human
aaccagaaagcuucccuccacc

SEQ ID NO: 574617 - RNA, 20 nt, Human
aacuuuccuucauaaaagac

SEQ ID NO: 574618 - RNA, 20 nt, Human
aagaucuucuccacccuuaa

SEQ ID NO: 574619 - RNA, 20 nt, Human
aagcuacccacccacauuca

SEQ ID NO: 574620 - RNA, 20 nt, Human
acaaaacaaaacccaaacaa

SEQ ID NO: 574621 - RNA, 23 nt, Human
acaauguucccccaccccccaaa

SEQ ID NO: 574622 - RNA, 18 nt, Human
accaccccaucccacccc

SEQ ID NO: 574623 - RNA, 18 nt, Human
accugaagaguucugaug

SEQ ID NO: 574624 - RNA, 24 nt, Human
agaaaacaauuuucaugcuuaaaa

SEQ ID NO: 574625 - RNA, 26 nt, Human
agaaaacaauuuucaugcuuaaaaac

SEQ ID NO: 574626 - RNA, 18 nt, Human
agaaaggagcacaaugua

SEQ ID NO: 574627 - RNA, 23 nt, Human
agaauggcauauaaaccaaucaa

SEQ ID NO: 574628 - RNA, 21 nt, Human
agcacaaccugagaacuaccc

SEQ ID NO: 574629 - RNA, 23 nt, Human
aggccauuggcuugauuacugag

SEQ ID NO: 574630 - RNA, 26 nt, Human
auauuauguucucauuugaaaacaca

SEQ ID NO: 574631 - RNA, 23 nt, Human
caaaacaaaacccaaacaauguu

SEQ ID NO: 574632 - RNA, 20 nt, Human
caaaggccauuggcuugauu

SEQ ID NO: 574633 - RNA, 21 nt, Human
caaccaccccaucccaccccg

SEQ ID NO: 574634 - RNA, 18 nt, Human
caccccaucccaccccgg

SEQ ID NO: 574635 - RNA, 21 nt, Human
cagaauaaaaaaaaccuuuuc

SEQ ID NO: 574636 - RNA, 18 nt, Human
caugauuuaaaaaauaag

SEQ ID NO: 574637 - RNA, 19 nt, Human
caugucacaaagcagucug

SEQ ID NO: 574638 - RNA, 24 nt, Human
ccagauaccuacacuauuugugag

SEQ ID NO: 574639 - RNA, 20 nt, Human
cccaaaagauuauuaaucca

SEQ ID NO: 574640 - RNA, 21 nt, Human
cccaaacaauguucccccacc

SEQ ID NO: 574641 - RNA, 24 nt, Human
cccagaugcuaccacaggucaaau

SEQ ID NO: 574642 - RNA, 24 nt, Human
ccccaucccaccccggguaugcag

SEQ ID NO: 574643 - RNA, 21 nt, Human
cccccaccccccaaagcuagc

SEQ ID NO: 574644 - RNA, 20 nt, Human
ccccuucccuuccugacaaa

SEQ ID NO: 574645 - RNA, 24 nt, Human
cccuggccacagucccuuccaaaa

SEQ ID NO: 574646 - RNA, 18 nt, Human
cccuugaaauaacuuuuu

SEQ ID NO: 574647 - RNA, 21 nt, Human
cucaaaauggcaaauugaagu

SEQ ID NO: 574648 - RNA, 24 nt, Human
cucccaggauucauggugcauuaa

SEQ ID NO: 574649 - RNA, 19 nt, Human
cuccugcugcauacccaca

SEQ ID NO: 574650 - RNA, 22 nt, Human
cugagauaugcaaaaccuacau

SEQ ID NO: 574651 - RNA, 21 nt, Human
gacagaagcuacccacccaca

SEQ ID NO: 574652 - RNA, 18 nt, Human
gaucucuaucccaauauc

SEQ ID NO: 574653 - RNA, 18 nt, Human
uaaaaaaaacaaaaagac

SEQ ID NO: 574654 - RNA, 19 nt, Human
uaaaaaaaacaaaaagaca

SEQ ID NO: 574655 - RNA, 19 nt, Human
uacaguuaugccaucccuu

SEQ ID NO: 574656 - RNA, 20 nt, Human
uaccaaaauccaauuagcag

SEQ ID NO: 574657 - RNA, 20 nt, Human
uagucucccaggauucaugg

SEQ ID NO: 574658 - RNA, 19 nt, Human
uauagcauaacaauucaug

SEQ ID NO: 574659 - RNA, 22 nt, Human
uauaguaaguuugucuucgaug

SEQ ID NO: 574660 - RNA, 19 nt, Human
uauuuuauucuacccuccc

SEQ ID NO: 574661 - RNA, 23 nt, Human
uauuuuauucuacccucccaaaa

SEQ ID NO: 574662 - RNA, 22 nt, Human
ucaaaaaaaaaaaaaaaagccu

SEQ ID NO: 574663 - RNA, 19 nt, Human
ucaauccaaugaaaguagc

SEQ ID NO: 574664 - RNA, 24 nt, Human
ucacacuauaacauucccaaggca

SEQ ID NO: 574665 - RNA, 24 nt, Human
ucagaaaacaauuuucaugcuuaa

SEQ ID NO: 574666 - RNA, 22 nt, Human
uccacauaacaaagugcugcuc

SEQ ID NO: 574667 - RNA, 18 nt, Human
uccacaucaugcccuaug

SEQ ID NO: 574668 - RNA, 28 nt, Human
uccaguauucucaaaaaaaaaaaaaaaa

SEQ ID NO: 574669 - RNA, 19 nt, Human
ucccccaccccccaaagcu

SEQ ID NO: 574670 - RNA, 22 nt, Human
uccccgggagccaucuggauca

SEQ ID NO: 574671 - RNA, 19 nt, Human
ucuaccagacuaauaaauc

SEQ ID NO: 574672 - RNA, 22 nt, Human
ucuaccagacuaauaaauccac

SEQ ID NO: 574673 - RNA, 22 nt, Human
ucuacccucccaaaagauuauu

SEQ ID NO: 574674 - RNA, 23 nt, Human
ucuagcacaaccugagaacuacc

SEQ ID NO: 574675 - RNA, 18 nt, Human
ucucaaaaaaaaaaaaaa

SEQ ID NO: 574676 - RNA, 19 nt, Human
ucucaaaaaaaaaaaaaaa

SEQ ID NO: 574677 - RNA, 20 nt, Human
ucuguacuugaguaguguuu

SEQ ID NO: 574678 - RNA, 19 nt, Human
ucuuccuggugcugguacc

SEQ ID NO: 574679 - RNA, 22 nt, Human
ucuuugacuuagaagccaacau

SEQ ID NO: 574680 - RNA, 19 nt, Human
ugaaauuuagucaucaguu

SEQ ID NO: 574681 - RNA, 23 nt, Human
ugagaacuacccuggccacaguc

SEQ ID NO: 574682 - RNA, 19 nt, Human
ugagccuacuuucccccaa

SEQ ID NO: 574683 - RNA, 18 nt, Human
ugagguaagaacuaccaa

SEQ ID NO: 574684 - RNA, 23 nt, Human
ugagguaagaacuaccaaaaucc

SEQ ID NO: 574685 - RNA, 22 nt, Human
ugagugaguguucuuaccugag

SEQ ID NO: 574686 - RNA, 20 nt, Human
ugcauuaaaaaggauauuca

SEQ ID NO: 574687 - RNA, 19 nt, Human
ugcuuuacccccaaacugc

SEQ ID NO: 574688 - RNA, 19 nt, Human
ugguauagcauaacaauuc

SEQ ID NO: 574689 - RNA, 20 nt, Human
uuaaaaaaaacaaaaagaca

SEQ ID NO: 574690 - RNA, 24 nt, Human
uuaaaaaaaacaaaaagacacacc

SEQ ID NO: 574691 - RNA, 25 nt, Human
uuagucuuugacuuagaagccaaca

SEQ ID NO: 574692 - RNA, 20 nt, Human
uucccuuccugacaaaggcc

SEQ ID NO: 574693 - RNA, 20 nt, Human
uuucaaaaauuaauacugua

SEQ ID NO: 574694 - RNA, 19 nt, Human
uuugaaaaauuuggaccau

SEQ ID NO: 574695 - RNA, 24 nt, Human
uuuugguuugcagucuguacuuga

SEQ ID NO: 574696 - RNA, 22 nt, Human
aaaaaacccaacuggucaaccc

SEQ ID NO: 574697 - RNA, 19 nt, Human
aaaaacaaaaaaggaaaca

SEQ ID NO: 574698 - RNA, 22 nt, Human
aaaaagccagaagugaaaagug

SEQ ID NO: 574699 - RNA, 25 nt, Human
aaaaaggaaacaagaaagaaaaaga

SEQ ID NO: 574700 - RNA, 23 nt, Human
aaaacccugaauccaaguccugc

SEQ ID NO: 574701 - RNA, 28 nt, Human
aaaagaaacaaaaacaagcaaccaaaaa

SEQ ID NO: 574702 - RNA, 26 nt, Human
aaacaaaaaaggaaacaagagggacc

SEQ ID NO: 574703 - RNA, 20 nt, Human
aaacaaaaacaagcaaccaa

SEQ ID NO: 574704 - RNA, 21 nt, Human
aaacaaaaacaagcaaccaaa

SEQ ID NO: 574705 - RNA, 25 nt, Human
aaacaagaaagaaaaagaaacaaaa

SEQ ID NO: 574706 - RNA, 24 nt, Human
aaacacuaccugugaaaugaauuc

SEQ ID NO: 574707 - RNA, 21 nt, Human
aaacccaacuggucaacccuu

SEQ ID NO: 574708 - RNA, 24 nt, Human
aaagaaacaaaaacaagcaaccaa

SEQ ID NO: 574709 - RNA, 21 nt, Human
aaagcagaaaaaucacuuuca

SEQ ID NO: 574710 - RNA, 20 nt, Human
aaagcucucucguaccuccc

SEQ ID NO: 574711 - RNA, 26 nt, Human
aaagcucucucguaccuccccugcuu

SEQ ID NO: 574712 - RNA, 21 nt, Human
aaaguauauacucccauucua

SEQ ID NO: 574713 - RNA, 23 nt, Human
aaauguaaaaaaucuguacuuug

SEQ ID NO: 574714 - RNA, 23 nt, Human
aacaaaaaaggaaacaagaaaga

SEQ ID NO: 574715 - RNA, 20 nt, Human
aacaaguuuaaacuguucug

SEQ ID NO: 574716 - RNA, 22 nt, Human
aacaguaccaguaacuaguaac

SEQ ID NO: 574717 - RNA, 23 nt, Human
aaccaucuggaccaaccugucga

SEQ ID NO: 574718 - RNA, 22 nt, Human
aaccugcggccagacuguccag

SEQ ID NO: 574719 - RNA, 18 nt, Human
aacuaaagauucuuggcu

SEQ ID NO: 574720 - RNA, 19 nt, Human
aacuggucaacccuucccu

SEQ ID NO: 574721 - RNA, 21 nt, Human
aagaaacaaaaacaagcaacc

SEQ ID NO: 574722 - RNA, 18 nt, Human
aagaaagaaaaagaaaca

SEQ ID NO: 574723 - RNA, 19 nt, Human
aagaaagaaaaagaaacaa

SEQ ID NO: 574724 - RNA, 22 nt, Human
aagaaagaaaaagaaacaaaaa

SEQ ID NO: 574725 - RNA, 21 nt, Human
aagcaggggcucugaagaugu

SEQ ID NO: 574726 - RNA, 26 nt, Human
aaggugcuuucuccugucugcaacua

SEQ ID NO: 574727 - RNA, 21 nt, Human
aauggcugcuggugcuggcga

SEQ ID NO: 574728 - RNA, 24 nt, Human
acaagaaagaaaaagaaacaaaaa

SEQ ID NO: 574729 - RNA, 21 nt, Human
acagaaugaacaaauguggca

SEQ ID NO: 574730 - RNA, 22 nt, Human
acagaggaaaaccuuucugaca

SEQ ID NO: 574731 - RNA, 28 nt, Human
acccugaauccaaguccugcaaaggcug

SEQ ID NO: 574732 - RNA, 20 nt, Human
accugugaaaugaauuccuu

SEQ ID NO: 574733 - RNA, 24 nt, Human
acuggucaacccuucccuuccccc

SEQ ID NO: 574734 - RNA, 23 nt, Human
agaaagaaaaagaaacaaaaaca

SEQ ID NO: 574735 - RNA, 18 nt, Human
agaagccaagaaccaagu

SEQ ID NO: 574736 - RNA, 20 nt, Human
agaagcugcuggcaaagugc

SEQ ID NO: 574737 - RNA, 21 nt, Human
agaaugggggcaaaacagaga

SEQ ID NO: 574738 - RNA, 20 nt, Human
agacacuaugaggcugugcc

SEQ ID NO: 574739 - RNA, 20 nt, Human
agacagcaguaauccaaaca

SEQ ID NO: 574740 - RNA, 24 nt, Human
agacagcaguaauccaaacaaggg

SEQ ID NO: 574741 - RNA, 23 nt, Human
agaccgggaucuugagagguggu

SEQ ID NO: 574742 - RNA, 25 nt, Human
agagauccucauccuuugggcacuu

SEQ ID NO: 574743 - RNA, 19 nt, Human
agaggccucugacacaggc

SEQ ID NO: 574744 - RNA, 20 nt, Human
agcagaggugacuggcuucu

SEQ ID NO: 574745 - RNA, 27 nt, Human
aggaaaaagguaaagcagaagggaccc

SEQ ID NO: 574746 - RNA, 18 nt, Human
aggaaaugucagaaggga

SEQ ID NO: 574747 - RNA, 19 nt, Human
aggagcggagcaggggcug

SEQ ID NO: 574748 - RNA, 18 nt, Human
agucacuagagaaggauu

SEQ ID NO: 574749 - RNA, 20 nt, Human
agugccuucuugcugugcuu

SEQ ID NO: 574750 - RNA, 18 nt, Human
aguucuggcuccuguucu

SEQ ID NO: 574751 - RNA, 18 nt, Human
caaaaacaagcaaccaaa

SEQ ID NO: 574752 - RNA, 18 nt, Human
caacaagaguugcuagag

SEQ ID NO: 574753 - RNA, 26 nt, Human
caacagcagcugacuaucuagcacua

SEQ ID NO: 574754 - RNA, 21 nt, Human
caacccuucccuucccccucc

SEQ ID NO: 574755 - RNA, 21 nt, Human
caagaaagaaaaagaaacaaa

SEQ ID NO: 574756 - RNA, 21 nt, Human
caagaaccaagucagggcuuu

SEQ ID NO: 574757 - RNA, 19 nt, Human
caaguuacuacccaacuga

SEQ ID NO: 574758 - RNA, 19 nt, Human
cacaaugaacaggugaggc

SEQ ID NO: 574759 - RNA, 21 nt, Human
caccugcucuuuuuucccucc

SEQ ID NO: 574760 - RNA, 21 nt, Human
cacugcugcugcugcuguucu

SEQ ID NO: 574761 - RNA, 20 nt, Human
cacuucaccuuggcuuucac

SEQ ID NO: 574762 - RNA, 19 nt, Human
cagaagugaaaagugaaaa

SEQ ID NO: 574763 - RNA, 19 nt, Human
cagaauggaguccgguguc

SEQ ID NO: 574764 - RNA, 18 nt, Human
caggugaggcaccugaga

SEQ ID NO: 574765 - RNA, 19 nt, Human
cagguugaacagaaugaac

SEQ ID NO: 574766 - RNA, 25 nt, Human
caucacugcugcugcugcuguucuc

SEQ ID NO: 574767 - RNA, 25 nt, Human
caucucagguguaaacucaccugcu

SEQ ID NO: 574768 - RNA, 22 nt, Human
caucuggaccaaccugucgauc

SEQ ID NO: 574769 - RNA, 19 nt, Human
ccaagcagauugcuuggca

SEQ ID NO: 574770 - RNA, 19 nt, Human
ccagagaggcacucccuuc

SEQ ID NO: 574771 - RNA, 22 nt, Human
ccagcaggugcuguaguugcac

SEQ ID NO: 574772 - RNA, 18 nt, Human
ccagcccucggcccuggc

SEQ ID NO: 574773 - RNA, 21 nt, Human
ccaucacugcugcugcugcug

SEQ ID NO: 574774 - RNA, 19 nt, Human
ccaucacugcuuucuucug

SEQ ID NO: 574775 - RNA, 20 nt, Human
ccauguugcagguuuggcag

SEQ ID NO: 574776 - RNA, 22 nt, Human
ccggcauuaaacuuuucucagu

SEQ ID NO: 574777 - RNA, 27 nt, Human
ccugagauuagagcaggaccggggucc

SEQ ID NO: 574778 - RNA, 20 nt, Human
ccugcauugcugcugcugcu

SEQ ID NO: 574779 - RNA, 23 nt, Human
ccugcgauggaugaaaccggggc

SEQ ID NO: 574780 - RNA, 21 nt, Human
ccuggaccuuguccacccccu

SEQ ID NO: 574781 - RNA, 21 nt, Human
ccugggucaagaugaagaggc

SEQ ID NO: 574782 - RNA, 24 nt, Human
ccugucuguccaucagauugcuuu

SEQ ID NO: 574783 - RNA, 20 nt, Human
ccuuggcuuucacacucuuc

SEQ ID NO: 574784 - RNA, 20 nt, Human
ccuugggccacaaaaaagcc

SEQ ID NO: 574785 - RNA, 21 nt, Human
cgcaaaaaacccaacugguca

SEQ ID NO: 574786 - RNA, 22 nt, Human
cgcaaaaaacccaacuggucaa

SEQ ID NO: 574787 - RNA, 20 nt, Human
cggcagcggcagcugcugcc

SEQ ID NO: 574788 - RNA, 18 nt, Human
cggcggcagcggcagcug

SEQ ID NO: 574789 - RNA, 22 nt, Human
cuaaucuggaaugugacuuaac

SEQ ID NO: 574790 - RNA, 27 nt, Human
cuagcagucugcccuucaccacccucu

SEQ ID NO: 574791 - RNA, 21 nt, Human
cucguaccuccccugcuucca

SEQ ID NO: 574792 - RNA, 19 nt, Human
cucuagcagucugcccuuc

SEQ ID NO: 574793 - RNA, 28 nt, Human
cucugucugagccuggacugccuccucc

SEQ ID NO: 574794 - RNA, 19 nt, Human
cugaguaaaacccugaauc

SEQ ID NO: 574795 - RNA, 25 nt, Human
cugcaaaggcugaauaaucuaugaa

SEQ ID NO: 574796 - RNA, 21 nt, Human
cugcccuucaccacccucucc

SEQ ID NO: 574797 - RNA, 23 nt, Human
cugcccuucaccacccucuccug

SEQ ID NO: 574798 - RNA, 22 nt, Human
cuggcuucugcuccaagagauc

SEQ ID NO: 574799 - RNA, 22 nt, Human
cuggucaacccuucccuucccc

SEQ ID NO: 574800 - RNA, 24 nt, Human
cuggucaagauugaggcaguguau

SEQ ID NO: 574801 - RNA, 20 nt, Human
cuuacuaggaccugcuuuga

SEQ ID NO: 574802 - RNA, 19 nt, Human
cuuagaaucuucaaggcuc

SEQ ID NO: 574803 - RNA, 21 nt, Human
cuuuccuucccauguugcagg

SEQ ID NO: 574804 - RNA, 24 nt, Human
cuuuccuuuuccaccugcucuuuu

SEQ ID NO: 574805 - RNA, 25 nt, Human
gaaaacgagcccugggagagaccug

SEQ ID NO: 574806 - RNA, 21 nt, Human
gaaaauauacuccuuaucccc

SEQ ID NO: 574807 - RNA, 18 nt, Human
gaacagcaauguuuagga

SEQ ID NO: 574808 - RNA, 19 nt, Human
gaauucucaccugcaucuc

SEQ ID NO: 574809 - RNA, 18 nt, Human
gacacaggcauggauuuu

SEQ ID NO: 574810 - RNA, 19 nt, Human
gaccugaaauggcugcugg

SEQ ID NO: 574811 - RNA, 19 nt, Human
gacugcggggaggacgacg

SEQ ID NO: 574812 - RNA, 21 nt, Human
gacuuagacuuacuauacaag

SEQ ID NO: 574813 - RNA, 22 nt, Human
gagguucuuucauauuagucuc

SEQ ID NO: 574814 - RNA, 18 nt, Human
gcaacaggucucuuuaaa

SEQ ID NO: 574815 - RNA, 19 nt, Human
gcaaccaaaaaaccuuuag

SEQ ID NO: 574816 - RNA, 27 nt, Human
gcacauuuaguucuuuucauuugucug

SEQ ID NO: 574817 - RNA, 21 nt, Human
gcagccuucuuaucucuuagc

SEQ ID NO: 574818 - RNA, 23 nt, Human
gccacaaaaaagccagaagugaa

SEQ ID NO: 574819 - RNA, 18 nt, Human
gcugaagcuggaacacag

SEQ ID NO: 574820 - RNA, 20 nt, Human
gcugaggaaagcaggggcuc

SEQ ID NO: 574821 - RNA, 23 nt, Human
gcuggaacacagauauuaauccu

SEQ ID NO: 574822 - RNA, 21 nt, Human
ggcaaagugcucgagggugga

SEQ ID NO: 574823 - RNA, 26 nt, Human
ggcauggauuuugguuguucagcugg

SEQ ID NO: 574824 - RNA, 24 nt, Human
ggccugcauugcugcugcugcuuc

SEQ ID NO: 574825 - RNA, 19 nt, Human
ggcugcacuucaccuuggc

SEQ ID NO: 574826 - RNA, 18 nt, Human
ggcuggugaugggacacu

SEQ ID NO: 574827 - RNA, 25 nt, Human
ggggagggaguuacagccacugggg

SEQ ID NO: 574828 - RNA, 22 nt, Human
guaaagcagaaaaaucacuuuc

SEQ ID NO: 574829 - RNA, 19 nt, Human
guauugugugugugugugu

SEQ ID NO: 574830 - RNA, 23 nt, Human
gucaacccuucccuucccccucc

SEQ ID NO: 574831 - RNA, 24 nt, Human
gugauguggggguggggugggcag

SEQ ID NO: 574832 - RNA, 23 nt, Human
gugcuguaguugcacugaccugg

SEQ ID NO: 574833 - RNA, 18 nt, Human
guggccucuucucccagc

SEQ ID NO: 574834 - RNA, 22 nt, Human
gugggcuggugaugggacacuu

SEQ ID NO: 574835 - RNA, 23 nt, Human
guggggugggcagugguggguag

SEQ ID NO: 574836 - RNA, 30 nt, Human
gugguacuuuucgcaccuggauucuuccua

SEQ ID NO: 574837 - RNA, 22 nt, Human
gugguggguaguagaauggggg

SEQ ID NO: 574838 - RNA, 19 nt, Human
guuccugggguuuuaaggc

SEQ ID NO: 574839 - RNA, 21 nt, Human
uaaaaacaaaaaaggaaacaa

SEQ ID NO: 574840 - RNA, 21 nt, Human
uaaaaaucccugauaccuuuc

SEQ ID NO: 574841 - RNA, 23 nt, Human
uaaacccuuccuggauugcccaa

SEQ ID NO: 574842 - RNA, 25 nt, Human
uaaagcagaaaaaucacuuucauca

SEQ ID NO: 574843 - RNA, 23 nt, Human
uaagaugaauggcuuuccacuug

SEQ ID NO: 574844 - RNA, 19 nt, Human
uaagaugaugucauccugu

SEQ ID NO: 574845 - RNA, 21 nt, Human
uaagugcaaacuugucacaaa

SEQ ID NO: 574846 - RNA, 22 nt, Human
uacaguagaagccaagaaccaa

SEQ ID NO: 574847 - RNA, 27 nt, Human
uagaagaugcccucuucaccucuggag

SEQ ID NO: 574848 - RNA, 27 nt, Human
uagcauggaaucaauuccaaaacucuc

SEQ ID NO: 574849 - RNA, 20 nt, Human
uagcucaaaucacccaauca

SEQ ID NO: 574850 - RNA, 21 nt, Human
uagcucaaaucacccaaucac

SEQ ID NO: 574851 - RNA, 22 nt, Human
uauacuccuuauccccaauccu

SEQ ID NO: 574852 - RNA, 21 nt, Human
uaugaaggacaaauacaacug

SEQ ID NO: 574853 - RNA, 24 nt, Human
uaugaggcugugccuggcuugggg

SEQ ID NO: 574854 - RNA, 25 nt, Human
uaugaggcugugccuggcuuggggu

SEQ ID NO: 574855 - RNA, 21 nt, Human
uauugagaaagggcuguggug

SEQ ID NO: 574856 - RNA, 24 nt, Human
ucaagaugaagaggcacaauaugg

SEQ ID NO: 574857 - RNA, 22 nt, Human
ucacaauuucuucagucacuag

SEQ ID NO: 574858 - RNA, 20 nt, Human
ucacacucuucuuuucugcc

SEQ ID NO: 574859 - RNA, 24 nt, Human
ucacugcugcugcugcuguucuca

SEQ ID NO: 574860 - RNA, 25 nt, Human
ucacugcuuucuucugaaccuucug

SEQ ID NO: 574861 - RNA, 18 nt, Human
ucagaacucugggaaucu

SEQ ID NO: 574862 - RNA, 21 nt, Human
ucagacagcaguaauccaaac

SEQ ID NO: 574863 - RNA, 18 nt, Human
ucagcagaggugacuggc

SEQ ID NO: 574864 - RNA, 22 nt, Human
ucaggccagaacucugcccaua

SEQ ID NO: 574865 - RNA, 23 nt, Human
ucagguguaaacucaccugcuuc

SEQ ID NO: 574866 - RNA, 20 nt, Human
uccaaaacucucaaccucuu

SEQ ID NO: 574867 - RNA, 21 nt, Human
uccaaaaggacgcaaaaaacc

SEQ ID NO: 574868 - RNA, 22 nt, Human
ucccagagaggcacucccuuca

SEQ ID NO: 574869 - RNA, 23 nt, Human
ucccagagaggcacucccuucac

SEQ ID NO: 574870 - RNA, 19 nt, Human
uccccugcuuccaguuccu

SEQ ID NO: 574871 - RNA, 20 nt, Human
ucgcagauuuguauuaacca

SEQ ID NO: 574872 - RNA, 20 nt, Human
ucuaaaacaggaaaaauguc

SEQ ID NO: 574873 - RNA, 24 nt, Human
ucuaaaauguaaaaaaucuguacu

SEQ ID NO: 574874 - RNA, 20 nt, Human
ucucccagcucacaggggcc

SEQ ID NO: 574875 - RNA, 27 nt, Human
ucucccagcucacaggggccucuucuu

SEQ ID NO: 574876 - RNA, 18 nt, Human
ucuccuaaucuggaaugu

SEQ ID NO: 574877 - RNA, 19 nt, Human
ucucuaaacggacuuaaaa

SEQ ID NO: 574878 - RNA, 19 nt, Human
ucugugauggagaaaugac

SEQ ID NO: 574879 - RNA, 19 nt, Human
ucugugcuuugaccaguug

SEQ ID NO: 574880 - RNA, 18 nt, Human
ucugugguuucacucccc

SEQ ID NO: 574881 - RNA, 20 nt, Human
ugaaacggcaugggggagau

SEQ ID NO: 574882 - RNA, 20 nt, Human
ugaacaaauguggcauuggu

SEQ ID NO: 574883 - RNA, 21 nt, Human
ugaacagaaugaacaaaugug

SEQ ID NO: 574884 - RNA, 19 nt, Human
ugaagauguggagaaguuc

SEQ ID NO: 574885 - RNA, 22 nt, Human
ugacaggaaaaagguaaagcag

SEQ ID NO: 574886 - RNA, 24 nt, Human
ugagagcugaggaaagcaggggcu

SEQ ID NO: 574887 - RNA, 20 nt, Human
ugaggcugugccuggcuugg

SEQ ID NO: 574888 - RNA, 21 nt, Human
ugagggaagacuuccucuuga

SEQ ID NO: 574889 - RNA, 18 nt, Human
ugaguuuugagggcugcc

SEQ ID NO: 574890 - RNA, 19 nt, Human
ugauguggggguggggugg

SEQ ID NO: 574891 - RNA, 19 nt, Human
ugcaaugcuucuucuuuac

SEQ ID NO: 574892 - RNA, 18 nt, Human
ugcagcagcugcggcggc

SEQ ID NO: 574893 - RNA, 21 nt, Human
uggaauggucccuccaacuga

SEQ ID NO: 574894 - RNA, 18 nt, Human
uggaccuuguccaccccc

SEQ ID NO: 574895 - RNA, 19 nt, Human
uggacugccuccucuagca

SEQ ID NO: 574896 - RNA, 19 nt, Human
uggcaauaucuguuuuagg

SEQ ID NO: 574897 - RNA, 22 nt, Human
uggcgauguaacuaaagauucu

SEQ ID NO: 574898 - RNA, 21 nt, Human
uggcuccacuuuuuucuccuu

SEQ ID NO: 574899 - RNA, 19 nt, Human
uggcugaagcuggaacaca

SEQ ID NO: 574900 - RNA, 20 nt, Human
uggcuguugcucuggugggg

SEQ ID NO: 574901 - RNA, 19 nt, Human
uggcuugggguggucuugg

SEQ ID NO: 574902 - RNA, 22 nt, Human
ugggagagaagaggaaaagaga

SEQ ID NO: 574903 - RNA, 25 nt, Human
ugggcccuuguggauggcugacaac

SEQ ID NO: 574904 - RNA, 18 nt, Human
uggggugggcaguggugg

SEQ ID NO: 574905 - RNA, 22 nt, Human
uggugagaugguucuucucaga

SEQ ID NO: 574906 - RNA, 23 nt, Human
ugguggguaguagaaugggggca

SEQ ID NO: 574907 - RNA, 24 nt, Human
ugguggguaguagaaugggggcaa

SEQ ID NO: 574908 - RNA, 24 nt, Human
uguaacaacacagggggucccaga

SEQ ID NO: 574909 - RNA, 23 nt, Human
uguaagugcaaacuugucacaaa

SEQ ID NO: 574910 - RNA, 19 nt, Human
uguacauacacguaugugu

SEQ ID NO: 574911 - RNA, 21 nt, Human
uguauugugugugugugugua

SEQ ID NO: 574912 - RNA, 21 nt, Human
ugucacaaauucacaaagucu

SEQ ID NO: 574913 - RNA, 21 nt, Human
ugucagaagggagacagcuuc

SEQ ID NO: 574914 - RNA, 20 nt, Human
ugucugagccuggacugccu

SEQ ID NO: 574915 - RNA, 21 nt, Human
ugugaagcauugcauucaggc

SEQ ID NO: 574916 - RNA, 19 nt, Human
uguguacauacacguaugu

SEQ ID NO: 574917 - RNA, 25 nt, Human
uguguacauacacguauguguaaag

SEQ ID NO: 574918 - RNA, 24 nt, Human
uguguguacauacacguaugugua

SEQ ID NO: 574919 - RNA, 21 nt, Human
uguguguguguguacauacac

SEQ ID NO: 574920 - RNA, 21 nt, Human
uguguguguguguacauacac

SEQ ID NO: 574921 - RNA, 20 nt, Human
uguguguguguguguacaua

SEQ ID NO: 574922 - RNA, 20 nt, Human
uguuaggacuagugauggag

SEQ ID NO: 574923 - RNA, 23 nt, Human
uguucagcuuuuaagaugaaugg

SEQ ID NO: 574924 - RNA, 21 nt, Human
uguuggagaaggugcuuucuc

SEQ ID NO: 574925 - RNA, 20 nt, Human
uguuggaggcacuggggggg

SEQ ID NO: 574926 - RNA, 23 nt, Human
uuacaguguaucucuuucuaguc

SEQ ID NO: 574927 - RNA, 24 nt, Human
uuagagcaggaccuguuggagaag

SEQ ID NO: 574928 - RNA, 20 nt, Human
uuagugccuucuugcugugc

SEQ ID NO: 574929 - RNA, 24 nt, Human
uuagugccuucuugcugugcuucu

SEQ ID NO: 574930 - RNA, 20 nt, Human
uucaccuuggcuuucacacu

SEQ ID NO: 574931 - RNA, 18 nt, Human
uucacggacuacauucac

SEQ ID NO: 574932 - RNA, 21 nt, Human
uucacggacuacauucacugu

SEQ ID NO: 574933 - RNA, 18 nt, Human
uucacugucucagggcag

SEQ ID NO: 574934 - RNA, 21 nt, Human
uucccauguugcagguuuggc

SEQ ID NO: 574935 - RNA, 22 nt, Human
uucccauguugcagguuuggca

SEQ ID NO: 574936 - RNA, 23 nt, Human
uucccauguugcagguuuggcag

SEQ ID NO: 574937 - RNA, 20 nt, Human
uuccuaguuauagucuguuc

SEQ ID NO: 574938 - RNA, 23 nt, Human
uuccugccaguuccagugugggg

SEQ ID NO: 574939 - RNA, 27 nt, Human
uuccugggguuuuaaggcuagaagcug

SEQ ID NO: 574940 - RNA, 23 nt, Human
uuccuuaccaaaaauuucaauuu

SEQ ID NO: 574941 - RNA, 27 nt, Human
uugcugcugcugcuucuucugcuguug

SEQ ID NO: 574942 - RNA, 23 nt, Human
uugcuggaauuguugcacugcac

SEQ ID NO: 574943 - RNA, 21 nt, Human
uuggccuugggccacaaaaaa

SEQ ID NO: 574944 - RNA, 18 nt, Human
uugggccacaaaaaagcc

SEQ ID NO: 574945 - RNA, 25 nt, Human
uuuccagauguucccuuagccauuc

SEQ ID NO: 574946 - RNA, 22 nt, Human
uuucuaccugcaacagcagcug

SEQ ID NO: 574947 - RNA, 22 nt, Human
uuucugugguuucacuccccuu

SEQ ID NO: 574948 - RNA, 22 nt, Human
uuuguaagugcaaacuugucac

SEQ ID NO: 574949 - RNA, 21 nt, Human
uuuguuauaauuagaagcugu

SEQ ID NO: 574950 - RNA, 25 nt, Human
aaaaauaagugagaguugugacaac

SEQ ID NO: 574951 - RNA, 19 nt, Human
aaccuuuugaggccaucca

SEQ ID NO: 574952 - RNA, 20 nt, Human
aaccuuuugaggccauccaa

SEQ ID NO: 574953 - RNA, 18 nt, Human
aagcagccagggccacag

SEQ ID NO: 574954 - RNA, 21 nt, Human
aagcagccagggccacaggag

SEQ ID NO: 574955 - RNA, 24 nt, Human
aagcagcgagggccacaggaguca

SEQ ID NO: 574956 - RNA, 19 nt, Human
acauggccacuccucucac

SEQ ID NO: 574957 - RNA, 18 nt, Human
accucgccgcguuagcgg

SEQ ID NO: 574958 - RNA, 23 nt, Human
acgacuguguaguuccuccccaa

SEQ ID NO: 574959 - RNA, 24 nt, Human
acuccgcuccagccccgguacugc

SEQ ID NO: 574960 - RNA, 22 nt, Human
agaaaugauccucuucagucca

SEQ ID NO: 574961 - RNA, 22 nt, Human
agacuaaugacuccaugcccuc

SEQ ID NO: 574962 - RNA, 24 nt, Human
agauccgaugcaauuuugggaagg

SEQ ID NO: 574963 - RNA, 19 nt, Human
aguuccuccccaaaauaau

SEQ ID NO: 574964 - RNA, 24 nt, Human
caagcucuuaucuuagaaagcaca

SEQ ID NO: 574965 - RNA, 19 nt, Human
cacuccgcuccagccccgg

SEQ ID NO: 574966 - RNA, 19 nt, Human
cacuccgcuccagccccgg

SEQ ID NO: 574967 - RNA, 20 nt, Human
cacuccgcuccagccccggu

SEQ ID NO: 574968 - RNA, 18 nt, Human
cagcagacagcuucacuc

SEQ ID NO: 574969 - RNA, 21 nt, Human
cagcagacagcuucacuccgc

SEQ ID NO: 574970 - RNA, 22 nt, Human
caggaaaggggcugaguucuga

SEQ ID NO: 574971 - RNA, 22 nt, Human
ccaacuugaaaacaccugaacc

SEQ ID NO: 574972 - RNA, 23 nt, Human
ccagccccgguacugcggucugu

SEQ ID NO: 574973 - RNA, 24 nt, Human
ccagccccgguacugcggucugug

SEQ ID NO: 574974 - RNA, 20 nt, Human
cccgugucccuguguuuacu

SEQ ID NO: 574975 - RNA, 24 nt, Human
cccgugucccuguguuuacugccu

SEQ ID NO: 574976 - RNA, 21 nt, Human
ccggacagugaccucacgaac

SEQ ID NO: 574977 - RNA, 18 nt, Human
ccgugucccuguguuuac

SEQ ID NO: 574978 - RNA, 19 nt, Human
ccucacauggccacuccuc

SEQ ID NO: 574979 - RNA, 18 nt, Human
ccucugaguguggacgcu

SEQ ID NO: 574980 - RNA, 18 nt, Human
ccucuuacagcagacagc

SEQ ID NO: 574981 - RNA, 18 nt, Human
ccuguguuuacugccuua

SEQ ID NO: 574982 - RNA, 25 nt, Human
cgcuccagccccgguacugcggucu

SEQ ID NO: 574983 - RNA, 22 nt, Human
cucucacagcagacagcuucac

SEQ ID NO: 574984 - RNA, 24 nt, Human
cucucaggacuagcauucuggcag

SEQ ID NO: 574985 - RNA, 24 nt, Human
cucucgggacuagcauucuggcag

SEQ ID NO: 574986 - RNA, 21 nt, Human
cuuagaaguaaaaucaggaaa

SEQ ID NO: 574987 - RNA, 27 nt, Human
gaaagcacagacacguuuagcucaggg

SEQ ID NO: 574988 - RNA, 19 nt, Human
gacuguguaguuccucccc

SEQ ID NO: 574989 - RNA, 21 nt, Human
gagugaaagaagauggagacc

SEQ ID NO: 574990 - RNA, 22 nt, Human
gagugccugcagaccugugggc

SEQ ID NO: 574991 - RNA, 22 nt, Human
gccccgguacugcggucugugg

SEQ ID NO: 574992 - RNA, 24 nt, Human
gcuccagccccgguacugcggucu

SEQ ID NO: 574993 - RNA, 19 nt, Human
ggaccuggauagcccgaug

SEQ ID NO: 574994 - RNA, 21 nt, Human
ggacgcugucccccgugucuc

SEQ ID NO: 574995 - RNA, 23 nt, Human
ggccacaggagucaaagaagaug

SEQ ID NO: 574996 - RNA, 19 nt, Human
ggccacaggagugaaagaa

SEQ ID NO: 574997 - RNA, 23 nt, Human
ggccacaggagugaaagaagaug

SEQ ID NO: 574998 - RNA, 21 nt, Human
gggaaggguugguaauaaacc

SEQ ID NO: 574999 - RNA, 19 nt, Human
gucuggucaugauaugaga

SEQ ID NO: 575000 - RNA, 19 nt, Human
gucuggucgugauaugaga

SEQ ID NO: 575001 - RNA, 19 nt, Human
gugccugcagaccuguggg

SEQ ID NO: 575002 - RNA, 22 nt, Human
guguaaagcagccagggccaca

SEQ ID NO: 575003 - RNA, 22 nt, Human
guguaaagcagcgagggccaca

SEQ ID NO: 575004 - RNA, 26 nt, Human
uaaaaaauaagugagaguugugacaa

SEQ ID NO: 575005 - RNA, 26 nt, Human
uaaaaaauaauugagaguugugacaa

SEQ ID NO: 575006 - RNA, 26 nt, Human
uaacuugaaaacaauuuugaguauuu

SEQ ID NO: 575007 - RNA, 21 nt, Human
uaauaaaccaaaacucaaucu

SEQ ID NO: 575008 - RNA, 23 nt, Human
uaauaaaccaaaacucuaucuau

SEQ ID NO: 575009 - RNA, 18 nt, Human
uaauucguccuuggagaa

SEQ ID NO: 575010 - RNA, 19 nt, Human
uaauucguccuuggagaau

SEQ ID NO: 575011 - RNA, 20 nt, Human
uaccuugaaaucagauaauc

SEQ ID NO: 575012 - RNA, 26 nt, Human
uagaaagcacagacacguuuagcuca

SEQ ID NO: 575013 - RNA, 21 nt, Human
uagaacagauuguguaaagca

SEQ ID NO: 575014 - RNA, 18 nt, Human
uagcccgaugauucgcac

SEQ ID NO: 575015 - RNA, 18 nt, Human
uagcucaggguagugcaa

SEQ ID NO: 575016 - RNA, 20 nt, Human
ucaagaaccuuuugaggcca

SEQ ID NO: 575017 - RNA, 18 nt, Human
ucacuccgcuccagcccc

SEQ ID NO: 575018 - RNA, 21 nt, Human
ucacuccgcuccagccccggu

SEQ ID NO: 575019 - RNA, 23 nt, Human
ucacuccgcuccagccccgguac

SEQ ID NO: 575020 - RNA, 22 nt, Human
uccaaaguguguuugugagacu

SEQ ID NO: 575021 - RNA, 22 nt, Human
uccaaguuuuuguccuucagua

SEQ ID NO: 575022 - RNA, 25 nt, Human
ucccccgugucccuguguuuacugc

SEQ ID NO: 575023 - RNA, 25 nt, Human
ucccccgugucuccauguuuacugc

SEQ ID NO: 575024 - RNA, 20 nt, Human
uccgcuccagccccgguacu

SEQ ID NO: 575025 - RNA, 18 nt, Human
uccucuuagaaguaaaau

SEQ ID NO: 575026 - RNA, 19 nt, Human
uccuuggagaaucacagug

SEQ ID NO: 575027 - RNA, 20 nt, Human
ugaggggaagaggcccaggg

SEQ ID NO: 575028 - RNA, 24 nt, Human
ugccugcagaccugugggcagcca

SEQ ID NO: 575029 - RNA, 19 nt, Human
ugcuaacuugaaaacaauu

SEQ ID NO: 575030 - RNA, 23 nt, Human
ugcugucuuaagacagaagaaag

SEQ ID NO: 575031 - RNA, 23 nt, Human
ugcugucuuaagauagaagaaag

SEQ ID NO: 575032 - RNA, 24 nt, Human
uggcugcuccaugaaauccaaggg

SEQ ID NO: 575033 - RNA, 24 nt, Human
uggcugcuccaugaaaucuaaggg

SEQ ID NO: 575034 - RNA, 18 nt, Human
ugggaaggguuaguaaua

SEQ ID NO: 575035 - RNA, 18 nt, Human
ugggaaggguugguaaua

SEQ ID NO: 575036 - RNA, 20 nt, Human
ugggaaugggaugagaucua

SEQ ID NO: 575037 - RNA, 22 nt, Human
ugggaaugggaugagaucuagu

SEQ ID NO: 575038 - RNA, 20 nt, Human
ugucccuguguuuacugccu

SEQ ID NO: 575039 - RNA, 21 nt, Human
uguggcccaggcccucugagu

SEQ ID NO: 575040 - RNA, 18 nt, Human
uuagaaguaaaaucagga

SEQ ID NO: 575041 - RNA, 19 nt, Human
uuccucuuagaaguaaaau

SEQ ID NO: 575042 - RNA, 19 nt, Human
uuguguaaagcagccaggg

SEQ ID NO: 575043 - RNA, 20 nt, Human
aaaaaaaaaauaauaaaagg

SEQ ID NO: 575044 - RNA, 21 nt, Human
aaagaggcacucagggguggg

SEQ ID NO: 575045 - RNA, 19 nt, Human
aacaugaugaaaccccauc

SEQ ID NO: 575046 - RNA, 20 nt, Human
aacaugaugaaaccccaucu

SEQ ID NO: 575047 - RNA, 21 nt, Human
aacaugaugaaaccccaucuc

SEQ ID NO: 575048 - RNA, 21 nt, Human
aacaugaugaaaccccaucuc

SEQ ID NO: 575049 - RNA, 22 nt, Human
aaccacaagcauggaccagccc

SEQ ID NO: 575050 - RNA, 18 nt, Human
aaccagaacaugccacaa

SEQ ID NO: 575051 - RNA, 25 nt, Human
aacucagcucucccuaccucuccua

SEQ ID NO: 575052 - RNA, 18 nt, Human
aagcaggguauucacgca

SEQ ID NO: 575053 - RNA, 24 nt, Human
aagggccaggugcgguggcucaug

SEQ ID NO: 575054 - RNA, 18 nt, Human
aaggggcuuagagacaaa

SEQ ID NO: 575055 - RNA, 18 nt, Human
aaguauuuagcacuaaac

SEQ ID NO: 575056 - RNA, 23 nt, Human
aaucauaucacagggguauugag

SEQ ID NO: 575057 - RNA, 21 nt, Human
acaaaaaacagacuuuauuga

SEQ ID NO: 575058 - RNA, 18 nt, Human
acaccagaguucuuggaa

SEQ ID NO: 575059 - RNA, 24 nt, Human
acagagcgagacuccaucucaaaa

SEQ ID NO: 575060 - RNA, 18 nt, Human
acagcauuccagccuggg

SEQ ID NO: 575061 - RNA, 19 nt, Human
acagcauuccagccugggc

SEQ ID NO: 575062 - RNA, 24 nt, Human
acagcauuccagccugggcgacag

SEQ ID NO: 575063 - RNA, 26 nt, Human
acagcauuccagccugggcgacagag

SEQ ID NO: 575064 - RNA, 18 nt, Human
acccagagaccugggaaa

SEQ ID NO: 575065 - RNA, 18 nt, Human
accccaucucuacuaaaa

SEQ ID NO: 575066 - RNA, 21 nt, Human
accuggaagcaaagaaggccc

SEQ ID NO: 575067 - RNA, 24 nt, Human
acuugaggucaggaguucgagacc

SEQ ID NO: 575068 - RNA, 21 nt, Human
agaacucccaagguggcucac

SEQ ID NO: 575069 - RNA, 23 nt, Human
agacaggcaaggccuuaagucca

SEQ ID NO: 575070 - RNA, 22 nt, Human
agacggggguugcagugagccg

SEQ ID NO: 575071 - RNA, 19 nt, Human
agacuugcuccagucgcug

SEQ ID NO: 575072 - RNA, 20 nt, Human
agagaccugggaaauggggg

SEQ ID NO: 575073 - RNA, 24 nt, Human
agaguaggcccaaaaguugggggu

SEQ ID NO: 575074 - RNA, 23 nt, Human
agcagaagcauagcugguggggg

SEQ ID NO: 575075 - RNA, 18 nt, Human
agcaggcaugguggugcu

SEQ ID NO: 575076 - RNA, 25 nt, Human
agcccaggcugggguacccagagac

SEQ ID NO: 575077 - RNA, 24 nt, Human
agccuggccaacaugaugaaaccc

SEQ ID NO: 575078 - RNA, 24 nt, Human
agccugggcgacagagcgagacuc

SEQ ID NO: 575079 - RNA, 23 nt, Human
aggcacucagggguggggggguc

SEQ ID NO: 575080 - RNA, 18 nt, Human
aggcaggagauucgcuug

SEQ ID NO: 575081 - RNA, 24 nt, Human
aggcaggagauucgcuugaacccg

SEQ ID NO: 575082 - RNA, 18 nt, Human
aggcagguggaucacuug

SEQ ID NO: 575083 - RNA, 22 nt, Human
aggcagguggaucacuugaggu

SEQ ID NO: 575084 - RNA, 26 nt, Human
aggcagguggaucacuugaggucagg

SEQ ID NO: 575085 - RNA, 24 nt, Human
aggcaugguggugcuugccuguaa

SEQ ID NO: 575086 - RNA, 26 nt, Human
aggcccaaaaguuggggguugcuucg

SEQ ID NO: 575087 - RNA, 24 nt, Human
aggcugaggcaggagauucgcuug

SEQ ID NO: 575088 - RNA, 22 nt, Human
aggggucugggagcccacaggg

SEQ ID NO: 575089 - RNA, 24 nt, Human
aggugcgguggcucaugccuguaa

SEQ ID NO: 575090 - RNA, 22 nt, Human
agguggaucacuugaggucagg

SEQ ID NO: 575091 - RNA, 19 nt, Human
agucagaacucagcucucc

SEQ ID NO: 575092 - RNA, 21 nt, Human
agucaugugcaugaguaugua

SEQ ID NO: 575093 - RNA, 24 nt, Human
aucacuugaggucaggaguucgag

SEQ ID NO: 575094 - RNA, 24 nt, Human
aucuugcuacagcauuccagccug

SEQ ID NO: 575095 - RNA, 19 nt, Human
augccuguaaucccagcac

SEQ ID NO: 575096 - RNA, 24 nt, Human
caaaccggaaaagcacagcaucca

SEQ ID NO: 575097 - RNA, 24 nt, Human
caaaccggaaaagcacagcaucca

SEQ ID NO: 575098 - RNA, 24 nt, Human
caaggcagguggaucacuugaggu

SEQ ID NO: 575099 - RNA, 26 nt, Human
caaggcagguggaucacuugagguca

SEQ ID NO: 575100 - RNA, 19 nt, Human
cacagcauccaagcagggu

SEQ ID NO: 575101 - RNA, 19 nt, Human
cacagggcauagacagggu

SEQ ID NO: 575102 - RNA, 23 nt, Human
cacuugaggucaggaguucgaga

SEQ ID NO: 575103 - RNA, 24 nt, Human
cagcacuuugaaaggccaaggcag

SEQ ID NO: 575104 - RNA, 20 nt, Human
cagcccccagccagaccccc

SEQ ID NO: 575105 - RNA, 24 nt, Human
cagcuacucagaaggcugaggcag

SEQ ID NO: 575106 - RNA, 23 nt, Human
cagcuggguggucuuagcacagg

SEQ ID NO: 575107 - RNA, 18 nt, Human
cagcuuccagacuugcuc

SEQ ID NO: 575108 - RNA, 24 nt, Human
cagguggaucacuugaggucagga

SEQ ID NO: 575109 - RNA, 24 nt, Human
caucccuucagccuccugcauccu

SEQ ID NO: 575110 - RNA, 21 nt, Human
caucucaaaaacaaacaaaau

SEQ ID NO: 575111 - RNA, 20 nt, Human
caugccuguaaucccagcac

SEQ ID NO: 575112 - RNA, 23 nt, Human
cauuccagccugggcgacagagc

SEQ ID NO: 575113 - RNA, 18 nt, Human
ccagagcacagagcguug

SEQ ID NO: 575114 - RNA, 23 nt, Human
ccaguccagguaacaugggggca

SEQ ID NO: 575115 - RNA, 22 nt, Human
cccaggcugggguacccagaga

SEQ ID NO: 575116 - RNA, 23 nt, Human
ccccagggaauuucuuagaaccc

SEQ ID NO: 575117 - RNA, 23 nt, Human
cccccagccagacccccugaggc

SEQ ID NO: 575118 - RNA, 23 nt, Human
cccccagguuccuuugaugggcc

SEQ ID NO: 575119 - RNA, 21 nt, Human
cccgggagacggggguugcag

SEQ ID NO: 575120 - RNA, 21 nt, Human
cccuaccucuccuagccucaa

SEQ ID NO: 575121 - RNA, 19 nt, Human
cccugaccuggaagcaaag

SEQ ID NO: 575122 - RNA, 23 nt, Human
ccuaccucuccuagccucaauuc

SEQ ID NO: 575123 - RNA, 19 nt, Human
ccuccugcauccuccccca

SEQ ID NO: 575124 - RNA, 18 nt, Human
ccugcauccucccccagg

SEQ ID NO: 575125 - RNA, 18 nt, Human
ccugcgauggggaugggg

SEQ ID NO: 575126 - RNA, 20 nt, Human
ccugcgauggggauggggga

SEQ ID NO: 575127 - RNA, 24 nt, Human
ccuggccaacaugaugaaacccca

SEQ ID NO: 575128 - RNA, 22 nt, Human
ccugggcgacagagcgagacuc

SEQ ID NO: 575129 - RNA, 20 nt, Human
ccuguaaucccagcacuuug

SEQ ID NO: 575130 - RNA, 21 nt, Human
ccuguaaucccagcuacucag

SEQ ID NO: 575131 - RNA, 22 nt, Human
ccuguaaucccagcuacucaga

SEQ ID NO: 575132 - RNA, 21 nt, Human
ccuucugcuauauucacaguc

SEQ ID NO: 575133 - RNA, 21 nt, Human
cgagaccagccuggccaacau

SEQ ID NO: 575134 - RNA, 24 nt, Human
cgggagacggggguugcagugagc

SEQ ID NO: 575135 - RNA, 21 nt, Human
cuacagcauuccagccugggc

SEQ ID NO: 575136 - RNA, 21 nt, Human
cucagcucucccuaccucucc

SEQ ID NO: 575137 - RNA, 24 nt, Human
cucaugccuguaaucccagcacuu

SEQ ID NO: 575138 - RNA, 19 nt, Human
cuccagcaauagugggaca

SEQ ID NO: 575139 - RNA, 18 nt, Human
cuccaggucaucggccug

SEQ ID NO: 575140 - RNA, 26 nt, Human
cucccccagcccaggcugggguaccc

SEQ ID NO: 575141 - RNA, 23 nt, Human
cugcuguccacuaaccacaagca

SEQ ID NO: 575142 - RNA, 21 nt, Human
cuuaaguccaguaggccaaac

SEQ ID NO: 575143 - RNA, 19 nt, Human
gaaagaggcacucaggggu

SEQ ID NO: 575144 - RNA, 26 nt, Human
gaaccagagcacagagcguuggagaa

SEQ ID NO: 575145 - RNA, 20 nt, Human
gaccuggaagcaaagaaggc

SEQ ID NO: 575146 - RNA, 24 nt, Human
gaucacuugaggucaggaguucga

SEQ ID NO: 575147 - RNA, 20 nt, Human
gcauuccagccugggcgaca

SEQ ID NO: 575148 - RNA, 24 nt, Human
gcauuccagccugggcgacagagc

SEQ ID NO: 575149 - RNA, 24 nt, Human
gccaacaugaugaaaccccaucuc

SEQ ID NO: 575150 - RNA, 19 nt, Human
gcccccaaagaaaauucag

SEQ ID NO: 575151 - RNA, 18 nt, Human
gcccuaggaugagaaccc

SEQ ID NO: 575152 - RNA, 18 nt, Human
gcuacagcauuccagccu

SEQ ID NO: 575153 - RNA, 22 nt, Human
gcuacagcauuccagccugggc

SEQ ID NO: 575154 - RNA, 24 nt, Human
gcuacagcauuccagccugggcga

SEQ ID NO: 575155 - RNA, 18 nt, Human
gcuugccuguaaucccag

SEQ ID NO: 575156 - RNA, 22 nt, Human
ggaaaagcacagcauccaagca

SEQ ID NO: 575157 - RNA, 20 nt, Human
ggagcugaaagaggcacuca

SEQ ID NO: 575158 - RNA, 22 nt, Human
ggaucacuugaggucaggaguu

SEQ ID NO: 575159 - RNA, 18 nt, Human
ggccaggugcgguggcuc

SEQ ID NO: 575160 - RNA, 25 nt, Human
gggccaggggcaguuccccagggaa

SEQ ID NO: 575161 - RNA, 18 nt, Human
ggggguugcagugagccg

SEQ ID NO: 575162 - RNA, 22 nt, Human
gggguugcagugagccgaaauc

SEQ ID NO: 575163 - RNA, 23 nt, Human
gguggcucaugccuguaauccca

SEQ ID NO: 575164 - RNA, 24 nt, Human
gguggcucaugccuguaaucccag

SEQ ID NO: 575165 - RNA, 24 nt, Human
gguggugcuugccuguaaucccag

SEQ ID NO: 575166 - RNA, 19 nt, Human
gugcaucccuucagccucc

SEQ ID NO: 575167 - RNA, 24 nt, Human
guugcagugagccgaaaucuugcu

SEQ ID NO: 575168 - RNA, 18 nt, Human
uaagagcacagugagaga

SEQ ID NO: 575169 - RNA, 23 nt, Human
uaagagcacagugagagaaaugc

SEQ ID NO: 575170 - RNA, 21 nt, Human
uaaugaaugcccccaaagaaa

SEQ ID NO: 575171 - RNA, 21 nt, Human
uacagcauuccagccugggcg

SEQ ID NO: 575172 - RNA, 19 nt, Human
uaccauguccagccuccag

SEQ ID NO: 575173 - RNA, 21 nt, Human
uagaaccagagcacagagcgu

SEQ ID NO: 575174 - RNA, 22 nt, Human
uagcaagacaauacaccaccgg

SEQ ID NO: 575175 - RNA, 20 nt, Human
uagcugaggacacagccacu

SEQ ID NO: 575176 - RNA, 23 nt, Human
uaggaacugugacucccucuccc

SEQ ID NO: 575177 - RNA, 18 nt, Human
uaggcccaaaaguugggg

SEQ ID NO: 575178 - RNA, 23 nt, Human
uagggggucaggaaaauagcagg

SEQ ID NO: 575179 - RNA, 26 nt, Human
uauaaauaaccaccuucucagagcag

SEQ ID NO: 575180 - RNA, 21 nt, Human
ucagaacucagcucucccuac

SEQ ID NO: 575181 - RNA, 22 nt, Human
ucagcucucccuaccucuccua

SEQ ID NO: 575182 - RNA, 22 nt, Human
ucaugccuguaaucccagcacu

SEQ ID NO: 575183 - RNA, 23 nt, Human
uccacauauauaaauccuuaggu

SEQ ID NO: 575184 - RNA, 22 nt, Human
uccagccuccagcaauaguggg

SEQ ID NO: 575185 - RNA, 21 nt, Human
uccagccugggcgacagagcg

SEQ ID NO: 575186 - RNA, 23 nt, Human
uccagccugggcgacagagcgag

SEQ ID NO: 575187 - RNA, 24 nt, Human
uccagccugggcgacagagcgaga

SEQ ID NO: 575188 - RNA, 21 nt, Human
ucccuucagccuccugcaucc

SEQ ID NO: 575189 - RNA, 20 nt, Human
uccuuaggucagggcuucug

SEQ ID NO: 575190 - RNA, 23 nt, Human
ucgcuugaacccgggagacgggg

SEQ ID NO: 575191 - RNA, 20 nt, Human
ucucccccagcccaggcugg

SEQ ID NO: 575192 - RNA, 23 nt, Human
ucucccccagcccaggcuggggu

SEQ ID NO: 575193 - RNA, 19 nt, Human
ucuccuagccucaauucag

SEQ ID NO: 575194 - RNA, 22 nt, Human
ucucuacuaaaaauaaaaaauu

SEQ ID NO: 575195 - RNA, 20 nt, Human
ucuguagcugaggacacagc

SEQ ID NO: 575196 - RNA, 19 nt, Human
ugaaaccccaucucuacua

SEQ ID NO: 575197 - RNA, 24 nt, Human
ugaaaggccaaggcagguggauca

SEQ ID NO: 575198 - RNA, 21 nt, Human
ugacucaaagcucaggggucu

SEQ ID NO: 575199 - RNA, 18 nt, Human
ugagaggccagggaaacc

SEQ ID NO: 575200 - RNA, 24 nt, Human
ugaggcaggagauucgcuugaacc

SEQ ID NO: 575201 - RNA, 25 nt, Human
ugaggcaggagauucgcuugaaccc

SEQ ID NO: 575202 - RNA, 18 nt, Human
ugaggcuacaaacuguga

SEQ ID NO: 575203 - RNA, 19 nt, Human
ugaugccacugacucaaag

SEQ ID NO: 575204 - RNA, 20 nt, Human
ugaugccacugacucaaagc

SEQ ID NO: 575205 - RNA, 18 nt, Human
ugcacaggugaagucaga

SEQ ID NO: 575206 - RNA, 23 nt, Human
ugcaucccuucagccuccugcau

SEQ ID NO: 575207 - RNA, 23 nt, Human
ugcccuggagaaaggggcuuaga

SEQ ID NO: 575208 - RNA, 23 nt, Human
ugccuguaaucccagcacuuuga

SEQ ID NO: 575209 - RNA, 19 nt, Human
ugccuguaaucccagcuac

SEQ ID NO: 575210 - RNA, 20 nt, Human
ugcucagccgucuccuggcu

SEQ ID NO: 575211 - RNA, 19 nt, Human
ugcuuucucauugaagcag

SEQ ID NO: 575212 - RNA, 24 nt, Human
uggaucacuugaggucaggaguuc

SEQ ID NO: 575213 - RNA, 27 nt, Human
uggaucacuugaggucaggaguucgag

SEQ ID NO: 575214 - RNA, 20 nt, Human
uggcucagaacaaggcacuc

SEQ ID NO: 575215 - RNA, 22 nt, Human
uggcucaugccuguaaucccag

SEQ ID NO: 575216 - RNA, 24 nt, Human
uggcucaugccuguaaucccagca

SEQ ID NO: 575217 - RNA, 19 nt, Human
ugggaaaugggggagaguc

SEQ ID NO: 575218 - RNA, 22 nt, Human
ugggaaaugggggagagucaug

SEQ ID NO: 575219 - RNA, 22 nt, Human
ugggagugaguauguccauguu

SEQ ID NO: 575220 - RNA, 22 nt, Human
ugguggggggaguaggaacugu

SEQ ID NO: 575221 - RNA, 24 nt, Human
ugguggugcuugccuguaauccca

SEQ ID NO: 575222 - RNA, 28 nt, Human
ugguuuuugggacuaugaucaguacacu

SEQ ID NO: 575223 - RNA, 25 nt, Human
ugugccucuucuaggucagacacca

SEQ ID NO: 575224 - RNA, 20 nt, Human
uucagccuccugcauccucc

SEQ ID NO: 575225 - RNA, 18 nt, Human
uugcagugagccgaaauc

SEQ ID NO: 575226 - RNA, 19 nt, Human
uugcagugagccgaaaucu

SEQ ID NO: 575227 - RNA, 24 nt, Human
aaaaacacacccucacaagaugcc

SEQ ID NO: 575228 - RNA, 23 nt, Human
aaagacuaggaaaauuugcagga

SEQ ID NO: 575229 - RNA, 22 nt, Human
aaagcgcucccguacccagcca

SEQ ID NO: 575230 - RNA, 24 nt, Human
aacacagcacucaccacuucaaca

SEQ ID NO: 575231 - RNA, 18 nt, Human
aacuacauaaaagaaguc

SEQ ID NO: 575232 - RNA, 20 nt, Human
aacuccgccccaggcucggc

SEQ ID NO: 575233 - RNA, 21 nt, Human
acacagcacucaccacuucaa

SEQ ID NO: 575234 - RNA, 20 nt, Human
acggcgggggcggcugcggc

SEQ ID NO: 575235 - RNA, 21 nt, Human
acuauuaccucuauuuguacc

SEQ ID NO: 575236 - RNA, 23 nt, Human
acugggaaaaacacacccucaca

SEQ ID NO: 575237 - RNA, 18 nt, Human
agaacuacauaaaagaag

SEQ ID NO: 575238 - RNA, 23 nt, Human
agaccacaguugagggagaauuu

SEQ ID NO: 575239 - RNA, 19 nt, Human
agccaaauaauaaaacuuc

SEQ ID NO: 575240 - RNA, 23 nt, Human
agcgcaacugagacgcuaauacu

SEQ ID NO: 575241 - RNA, 21 nt, Human
agcucaaaacacagcacucac

SEQ ID NO: 575242 - RNA, 21 nt, Human
aguacccauuuagcccauggc

SEQ ID NO: 575243 - RNA, 20 nt, Human
agucccugacuccggaaaca

SEQ ID NO: 575244 - RNA, 22 nt, Human
caaagcgcucccguacccagcc

SEQ ID NO: 575245 - RNA, 18 nt, Human
caagguucaugcaugugu

SEQ ID NO: 575246 - RNA, 19 nt, Human
caccaaaaggagaaaacau

SEQ ID NO: 575247 - RNA, 21 nt, Human
caccacuucaacagcagcuca

SEQ ID NO: 575248 - RNA, 24 nt, Human
cacgggccgaaggaaugcagacca

SEQ ID NO: 575249 - RNA, 21 nt, Human
cacugggaaaaacacacccuc

SEQ ID NO: 575250 - RNA, 24 nt, Human
cagcgcaacugagacgcuaauacu

SEQ ID NO: 575251 - RNA, 18 nt, Human
cagcucaaagucaaaugg

SEQ ID NO: 575252 - RNA, 23 nt, Human
cauuuuuaaaauuaucuaaacaa

SEQ ID NO: 575253 - RNA, 19 nt, Human
ccaaagcgcucccguaccc

SEQ ID NO: 575254 - RNA, 22 nt, Human
ccccagucagcccaaacuccgc

SEQ ID NO: 575255 - RNA, 19 nt, Human
cccgccccagaucagccca

SEQ ID NO: 575256 - RNA, 22 nt, Human
cccggcugcagcgcaacugaga

SEQ ID NO: 575257 - RNA, 22 nt, Human
cccucacaagaugccuauccau

SEQ ID NO: 575258 - RNA, 22 nt, Human
ccuuggcguacaugaggggcag

SEQ ID NO: 575259 - RNA, 20 nt, Human
cucacaagaugccuauccau

SEQ ID NO: 575260 - RNA, 19 nt, Human
gaaaaacacacccucacaa

SEQ ID NO: 575261 - RNA, 19 nt, Human
gcagcggcggcgucuugcc

SEQ ID NO: 575262 - RNA, 23 nt, Human
gccaaauaauaaaacuucuaaua

SEQ ID NO: 575263 - RNA, 22 nt, Human
gcucggccuccuccuuccuccc

SEQ ID NO: 575264 - RNA, 20 nt, Human
ggaaaaacacacccucacaa

SEQ ID NO: 575265 - RNA, 21 nt, Human
ggaaaaacacacccucacaag

SEQ ID NO: 575266 - RNA, 22 nt, Human
ggaggauauacuaggaccugag

SEQ ID NO: 575267 - RNA, 24 nt, Human
guccagccccagucagcccaaacu

SEQ ID NO: 575268 - RNA, 22 nt, Human
uaaaauuaucuaaacaaauugg

SEQ ID NO: 575269 - RNA, 22 nt, Human
uagcaccaaaaggagaaaacau

SEQ ID NO: 575270 - RNA, 21 nt, Human
uaguagcuagaacuaaaaaac

SEQ ID NO: 575271 - RNA, 24 nt, Human
uauggacugacaaaaaaaauuacc

SEQ ID NO: 575272 - RNA, 18 nt, Human
uauguucccuuuuuuggc

SEQ ID NO: 575273 - RNA, 19 nt, Human
ucaaaacacagcacucacc

SEQ ID NO: 575274 - RNA, 20 nt, Human
ucaaaacacagcacucacca

SEQ ID NO: 575275 - RNA, 21 nt, Human
ucaaaacacagcacucaccac

SEQ ID NO: 575276 - RNA, 25 nt, Human
ucagcccacgggccgaaggaaugca

SEQ ID NO: 575277 - RNA, 20 nt, Human
ucuaguacccauuuagccca

SEQ ID NO: 575278 - RNA, 19 nt, Human
ugaggggcaguuguuguuc

SEQ ID NO: 575279 - RNA, 22 nt, Human
ugcgcucagcugcagucccuga

SEQ ID NO: 575280 - RNA, 24 nt, Human
uggacugacaaaaaaaauuaccaa

SEQ ID NO: 575281 - RNA, 23 nt, Human
uuagcaccaaaaggagaaaacau

SEQ ID NO: 575282 - RNA, 22 nt, Human
uuccuccccggcugcagcgcaa

SEQ ID NO: 575283 - RNA, 26 nt, Human
uugagucaguggucagauggggcagu

SEQ ID NO: 575284 - RNA, 20 nt, Human
aaagccugcgugaagguggu

SEQ ID NO: 575285 - RNA, 24 nt, Human
aagccucuucuuuugcaggcccug

SEQ ID NO: 575286 - RNA, 25 nt, Human
agcugagcagccucccggaaaccuc

SEQ ID NO: 575287 - RNA, 18 nt, Human
aucacacugaacaagcau

SEQ ID NO: 575288 - RNA, 22 nt, Human
aucugaagccuaaagaaagcca

SEQ ID NO: 575289 - RNA, 24 nt, Human
cagcugagcagccucccggaaacc

SEQ ID NO: 575290 - RNA, 19 nt, Human
caggaaguacugcaggaac

SEQ ID NO: 575291 - RNA, 21 nt, Human
ccaugccacagcuccaacacg

SEQ ID NO: 575292 - RNA, 19 nt, Human
cccaacaugugagcagggu

SEQ ID NO: 575293 - RNA, 18 nt, Human
ccucccuggugaccaggc

SEQ ID NO: 575294 - RNA, 20 nt, Human
cucccggaaaccuccuaacc

SEQ ID NO: 575295 - RNA, 22 nt, Human
cuuccugggaucugaagccuaa

SEQ ID NO: 575296 - RNA, 22 nt, Human
gagcagccucccggaaaccucc

SEQ ID NO: 575297 - RNA, 25 nt, Human
gcaacuguucacagccccucacuca

SEQ ID NO: 575298 - RNA, 19 nt, Human
gcaggacagggacaggucc

SEQ ID NO: 575299 - RNA, 18 nt, Human
gccaugccacagcuccaa

SEQ ID NO: 575300 - RNA, 21 nt, Human
gcccauuccucaaccuggaca

SEQ ID NO: 575301 - RNA, 19 nt, Human
ggagccauggucaguccug

SEQ ID NO: 575302 - RNA, 19 nt, Human
gggccggggagggaggggg

SEQ ID NO: 575303 - RNA, 20 nt, Human
gggccggggagggagggggu

SEQ ID NO: 575304 - RNA, 19 nt, Human
ggggagggugcacaaggca

SEQ ID NO: 575305 - RNA, 18 nt, Human
gugacgccaugccacagc

SEQ ID NO: 575306 - RNA, 19 nt, Human
guuugggggccaaaaucaa

SEQ ID NO: 575307 - RNA, 18 nt, Human
uccugggaucugaagccu

SEQ ID NO: 575308 - RNA, 18 nt, Human
ucuccaggaaguacugca

SEQ ID NO: 575309 - RNA, 21 nt, Human
ucuuccugggaucugaagccu

SEQ ID NO: 575310 - RNA, 24 nt, Human
ugaacaagcauuuuauuccaggga

SEQ ID NO: 575311 - RNA, 19 nt, Human
ugacaaggugggccagaac

SEQ ID NO: 575312 - RNA, 22 nt, Human
ugcuucucccucuucuccagga

SEQ ID NO: 575313 - RNA, 18 nt, Human
uggaagccucugacaagg

SEQ ID NO: 575314 - RNA, 24 nt, Human
uggaagccucugacaaggugggcc

SEQ ID NO: 575315 - RNA, 19 nt, Human
ugggaucugaagccuaaag

SEQ ID NO: 575316 - RNA, 24 nt, Human
ugggaucugaagccuaaagaaagc

SEQ ID NO: 575317 - RNA, 22 nt, Human
uggggagggugcacaaggcagc

SEQ ID NO: 575318 - RNA, 22 nt, Human
ugugagcaggguggaagccucu

SEQ ID NO: 575319 - RNA, 26 nt, Human
ugugcaggacagggacaggggaacgc

SEQ ID NO: 575320 - RNA, 23 nt, Human
uguuccuacaaccacagugacgu

SEQ ID NO: 575321 - RNA, 25 nt, Human
uucacagccccucacucagccuccc

SEQ ID NO: 575322 - RNA, 19 nt, Human
uucagcccauuccucaacc

SEQ ID NO: 575323 - RNA, 19 nt, Human
aaacugacaguuggaacuc

SEQ ID NO: 575324 - RNA, 19 nt, Human
aagcaaaauccuucaccau

SEQ ID NO: 575325 - RNA, 19 nt, Human
aaucaagguaacagggcca

SEQ ID NO: 575326 - RNA, 20 nt, Human
accacuaaacauuaaaaggg

SEQ ID NO: 575327 - RNA, 18 nt, Human
agagauguguuucuuguc

SEQ ID NO: 575328 - RNA, 26 nt, Human
agcagcauguggcacacagaguugac

SEQ ID NO: 575329 - RNA, 21 nt, Human
caaaauccuucaccaugugau

SEQ ID NO: 575330 - RNA, 23 nt, Human
caauguuuaccuucagcauccca

SEQ ID NO: 575331 - RNA, 23 nt, Human
cacacagaguugacaaacugaca

SEQ ID NO: 575332 - RNA, 19 nt, Human
caccuuacaaccacaggau

SEQ ID NO: 575333 - RNA, 21 nt, Human
cacuaaacauuaaaagggccc

SEQ ID NO: 575334 - RNA, 21 nt, Human
cagaacuuaguagggccaucu

SEQ ID NO: 575335 - RNA, 19 nt, Human
caggauccucaaaaaagaa

SEQ ID NO: 575336 - RNA, 21 nt, Human
cagggccaaagguguccaggc

SEQ ID NO: 575337 - RNA, 19 nt, Human
caguaaauacuguagucac

SEQ ID NO: 575338 - RNA, 20 nt, Human
cauugcuuccucagaagcaa

SEQ ID NO: 575339 - RNA, 19 nt, Human
cauuguguugcagaaauac

SEQ ID NO: 575340 - RNA, 23 nt, Human
ccaucugucgauaagcuuucacu

SEQ ID NO: 575341 - RNA, 23 nt, Human
cugucuuucaccaugcuugguuc

SEQ ID NO: 575342 - RNA, 23 nt, Human
cuucagaaaaugccucacucucu

SEQ ID NO: 575343 - RNA, 20 nt, Human
cuugaaucaagguaacaggg

SEQ ID NO: 575344 - RNA, 19 nt, Human
cuugucuuuuaguuugauu

SEQ ID NO: 575345 - RNA, 21 nt, Human
gcuuccucagaagcaaaaucc

SEQ ID NO: 575346 - RNA, 22 nt, Human
guagagagcagcauguggcaca

SEQ ID NO: 575347 - RNA, 19 nt, Human
uaaaguagaaugaaacuca

SEQ ID NO: 575348 - RNA, 28 nt, Human
uaacagggccaaagguguccaggcugaa

SEQ ID NO: 575349 - RNA, 21 nt, Human
uaacaugcagagguuuuccuu

SEQ ID NO: 575350 - RNA, 22 nt, Human
uaaguggagguuaggaguagcu

SEQ ID NO: 575351 - RNA, 19 nt, Human
uacauuguguugcagaaau

SEQ ID NO: 575352 - RNA, 19 nt, Human
uagagagcagcauguggca

SEQ ID NO: 575353 - RNA, 20 nt, Human
uaguagguuccacuugcucu

SEQ ID NO: 575354 - RNA, 19 nt, Human
uccacuguccagaucugcc

SEQ ID NO: 575355 - RNA, 18 nt, Human
ucuaccaaaggaaccuua

SEQ ID NO: 575356 - RNA, 18 nt, Human
ucuuucuuuugguuugua

SEQ ID NO: 575357 - RNA, 24 nt, Human
ugagaaguauuucuguggcuacac

SEQ ID NO: 575358 - RNA, 24 nt, Human
ugauugaagauaacaugcagaggu

SEQ ID NO: 575359 - RNA, 26 nt, Human
ugccucacucucuuccuugaucuuca

SEQ ID NO: 575360 - RNA, 19 nt, Human
ugcucugucaccacuaaac

SEQ ID NO: 575361 - RNA, 19 nt, Human
uguccagaucugccaaagu

SEQ ID NO: 575362 - RNA, 18 nt, Human
ugucuaguaggaaagaua

SEQ ID NO: 575363 - RNA, 22 nt, Human
uuacaagucuuucuuuugguuu

SEQ ID NO: 575364 - RNA, 22 nt, Human
uuauaauaacauaaaaaugaga

SEQ ID NO: 575365 - RNA, 21 nt, Human
uucaaagcaauaaugaaagga

SEQ ID NO: 575366 - RNA, 19 nt, Human
uucacuucuaccaaaggaa

SEQ ID NO: 575367 - RNA, 27 nt, Human
uugcagaaauaccugucuuucaccaug

SEQ ID NO: 575368 - RNA, 21 nt, Human
uuuccacuguccagaucugcc

SEQ ID NO: 575369 - RNA, 19 nt, Human
aaacaugauuuauuacuuu

SEQ ID NO: 575370 - RNA, 21 nt, Human
aaagaacaggaagggccuggg

SEQ ID NO: 575371 - RNA, 22 nt, Human
aaauuuacugucaccuggaccu

SEQ ID NO: 575372 - RNA, 18 nt, Human
aacuccugcagccauccc

SEQ ID NO: 575373 - RNA, 19 nt, Human
aagaaauggaacagaagca

SEQ ID NO: 575374 - RNA, 21 nt, Human
aagaacaaaaaaaaaucugca

SEQ ID NO: 575375 - RNA, 23 nt, Human
aagaucacgccauugcauuccag

SEQ ID NO: 575376 - RNA, 23 nt, Human
aagccagagcugagcagcuguga

SEQ ID NO: 575377 - RNA, 24 nt, Human
aaucacccgaacccaggaggcgga

SEQ ID NO: 575378 - RNA, 20 nt, Human
acaagcgcgaaacuccaucu

SEQ ID NO: 575379 - RNA, 24 nt, Human
acccaggaggcggagguugcagug

SEQ ID NO: 575380 - RNA, 22 nt, Human
agaacaaaaaaaaaucugcaaa

SEQ ID NO: 575381 - RNA, 21 nt, Human
agaaugacaggagggggccgu

SEQ ID NO: 575382 - RNA, 18 nt, Human
agcaagaucagguuuccu

SEQ ID NO: 575383 - RNA, 20 nt, Human
agcaaggaggggcguagggc

SEQ ID NO: 575384 - RNA, 20 nt, Human
agcacuuuggguggcuaagg

SEQ ID NO: 575385 - RNA, 24 nt, Human
agccugggcaaugagacaaaaccc

SEQ ID NO: 575386 - RNA, 20 nt, Human
aggaguuugagaccagccug

SEQ ID NO: 575387 - RNA, 24 nt, Human
aggcaccugagguugccgggagcc

SEQ ID NO: 575388 - RNA, 18 nt, Human
aggcaggagaaucacccg

SEQ ID NO: 575389 - RNA, 18 nt, Human
aggcaggagaaucacccg

SEQ ID NO: 575390 - RNA, 24 nt, Human
aggcaggagaaucacccgaaccca

SEQ ID NO: 575391 - RNA, 18 nt, Human
aggcagggccaacggccu

SEQ ID NO: 575392 - RNA, 18 nt, Human
aggcccaggagggucgag

SEQ ID NO: 575393 - RNA, 24 nt, Human
aggcggagguugcagugagccaag

SEQ ID NO: 575394 - RNA, 19 nt, Human
aggcugaggcaggagaauc

SEQ ID NO: 575395 - RNA, 19 nt, Human
aggcugcugguggugggga

SEQ ID NO: 575396 - RNA, 21 nt, Human
agggagguagguucuacucag

SEQ ID NO: 575397 - RNA, 22 nt, Human
aggggcguagggcaaagaacag

SEQ ID NO: 575398 - RNA, 21 nt, Human
aggggcuccagagcccgaagc

SEQ ID NO: 575399 - RNA, 24 nt, Human
aggggcucuugggcagggaaggug

SEQ ID NO: 575400 - RNA, 20 nt, Human
agggggccgugccauggagc

SEQ ID NO: 575401 - RNA, 22 nt, Human
auacagguaugcaaugcauaau

SEQ ID NO: 575402 - RNA, 24 nt, Human
aucacgccauugcauuccagccug

SEQ ID NO: 575403 - RNA, 23 nt, Human
auggaacccagcagcuggcacug

SEQ ID NO: 575404 - RNA, 24 nt, Human
auugcauuccagccugggcaacaa

SEQ ID NO: 575405 - RNA, 22 nt, Human
caacuccuucagccuagacacc

SEQ ID NO: 575406 - RNA, 25 nt, Human
caagacucccaaccaggcugaucca

SEQ ID NO: 575407 - RNA, 24 nt, Human
caaugagacaaaaccccgucucua

SEQ ID NO: 575408 - RNA, 24 nt, Human
caauuaugcucuuuauuuuuaaau

SEQ ID NO: 575409 - RNA, 24 nt, Human
cacccauguaauuccagcacuuug

SEQ ID NO: 575410 - RNA, 18 nt, Human
caccuggaccucauccug

SEQ ID NO: 575411 - RNA, 20 nt, Human
cacugggucuaguuugggga

SEQ ID NO: 575412 - RNA, 26 nt, Human
cagaagccagagcugagcagugggca

SEQ ID NO: 575413 - RNA, 22 nt, Human
cagacagcggggagaaguuggg

SEQ ID NO: 575414 - RNA, 18 nt, Human
cagcaaggaggggcguag

SEQ ID NO: 575415 - RNA, 20 nt, Human
cagcacuuuggguggcuaag

SEQ ID NO: 575416 - RNA, 23 nt, Human
cagcacuuuggguggcuaaggca

SEQ ID NO: 575417 - RNA, 22 nt, Human
cagcgacaaccggcugcccaaa

SEQ ID NO: 575418 - RNA, 24 nt, Human
cagcuacucgggaggcugaggcag

SEQ ID NO: 575419 - RNA, 20 nt, Human
caggagauguuacugcuggg

SEQ ID NO: 575420 - RNA, 19 nt, Human
caggauucaaaugcuuucc

SEQ ID NO: 575421 - RNA, 22 nt, Human
caggggcuccagagcccgaagc

SEQ ID NO: 575422 - RNA, 23 nt, Human
caucuagauuuuuaaaaauaauu

SEQ ID NO: 575423 - RNA, 19 nt, Human
cauggagccaagacuccca

SEQ ID NO: 575424 - RNA, 22 nt, Human
cauuccagccugggcaacaagc

SEQ ID NO: 575425 - RNA, 18 nt, Human
cauugcauuccagccugg

SEQ ID NO: 575426 - RNA, 19 nt, Human
cauugcauuccagccuggg

SEQ ID NO: 575427 - RNA, 24 nt, Human
cauugcauuccagccugggcaaca

SEQ ID NO: 575428 - RNA, 20 nt, Human
ccagaccgagguaguuucug

SEQ ID NO: 575429 - RNA, 20 nt, Human
ccauugcauuccagccuggg

SEQ ID NO: 575430 - RNA, 21 nt, Human
ccauugcauuccagccugggc

SEQ ID NO: 575431 - RNA, 22 nt, Human
ccauugcauuccagccugggca

SEQ ID NO: 575432 - RNA, 23 nt, Human
ccauugcauuccagccugggcaa

SEQ ID NO: 575433 - RNA, 24 nt, Human
ccauugcauuccagccugggcaac

SEQ ID NO: 575434 - RNA, 23 nt, Human
cccacacagggagcgcgcaggau

SEQ ID NO: 575435 - RNA, 21 nt, Human
cccgcggucccagcuacucgg

SEQ ID NO: 575436 - RNA, 22 nt, Human
cccgucucuacaaaaaaauaca

SEQ ID NO: 575437 - RNA, 22 nt, Human
ccguuagugauggcugaucgag

SEQ ID NO: 575438 - RNA, 24 nt, Human
ccuacagagcaggguuacccuaaa

SEQ ID NO: 575439 - RNA, 24 nt, Human
ccuccccucuuuccaggauucaaa

SEQ ID NO: 575440 - RNA, 21 nt, Human
ccugcagaugcgccagggccc

SEQ ID NO: 575441 - RNA, 23 nt, Human
ccugggcaaugagacaaaacccc

SEQ ID NO: 575442 - RNA, 24 nt, Human
ccugggcaaugagacaaaaccccg

SEQ ID NO: 575443 - RNA, 23 nt, Human
ccuucagccuagacacccugauc

SEQ ID NO: 575444 - RNA, 22 nt, Human
cgagggugguuucugguucacc

SEQ ID NO: 575445 - RNA, 22 nt, Human
cggagccaccuggaggucucug

SEQ ID NO: 575446 - RNA, 24 nt, Human
cgggaggcugaggcaggagaauca

SEQ ID NO: 575447 - RNA, 19 nt, Human
cuacaaaaaaauacaaaaa

SEQ ID NO: 575448 - RNA, 19 nt, Human
cuacagcuuucucugucug

SEQ ID NO: 575449 - RNA, 18 nt, Human
cuagagucccuccccucu

SEQ ID NO: 575450 - RNA, 22 nt, Human
cuagagucccuccccucuuucc

SEQ ID NO: 575451 - RNA, 20 nt, Human
cucaagaacaaaaaaaaauc

SEQ ID NO: 575452 - RNA, 24 nt, Human
cucacccauguaauuccagcacuu

SEQ ID NO: 575453 - RNA, 22 nt, Human
cuggagcccacacagggagcgc

SEQ ID NO: 575454 - RNA, 18 nt, Human
cuggggaccagucagggg

SEQ ID NO: 575455 - RNA, 19 nt, Human
gaacaaaaaaaaaucugca

SEQ ID NO: 575456 - RNA, 18 nt, Human
gaccugggcgaggaaggc

SEQ ID NO: 575457 - RNA, 18 nt, Human
gacuaagaaauggaacag

SEQ ID NO: 575458 - RNA, 21 nt, Human
gagagugucagcucagguaga

SEQ ID NO: 575459 - RNA, 24 nt, Human
gagccacugggucuaguuugggga

SEQ ID NO: 575460 - RNA, 19 nt, Human
gaggcuggacacgguagcu

SEQ ID NO: 575461 - RNA, 22 nt, Human
gagguugcagugagccaagauc

SEQ ID NO: 575462 - RNA, 19 nt, Human
gaugcgccagggcccgagu

SEQ ID NO: 575463 - RNA, 22 nt, Human
gcaggagaaucacccgaaccca

SEQ ID NO: 575464 - RNA, 22 nt, Human
gccauugcauuccagccugggc

SEQ ID NO: 575465 - RNA, 24 nt, Human
gccauugcauuccagccugggcaa

SEQ ID NO: 575466 - RNA, 25 nt, Human
gcccugggacuccucuggaauccca

SEQ ID NO: 575467 - RNA, 23 nt, Human
gcugcuggugguggggagaucca

SEQ ID NO: 575468 - RNA, 22 nt, Human
ggaggcggagguugcagugagc

SEQ ID NO: 575469 - RNA, 20 nt, Human
ggagguugcagugagccaag

SEQ ID NO: 575470 - RNA, 24 nt, Human
ggagguugcagugagccaagauca

SEQ ID NO: 575471 - RNA, 24 nt, Human
ggcaaggggaccaccuggagccca

SEQ ID NO: 575472 - RNA, 19 nt, Human
ggcuccuguaggcaagggg

SEQ ID NO: 575473 - RNA, 21 nt, Human
gggccuggguuugggagaagc

SEQ ID NO: 575474 - RNA, 23 nt, Human
ggggaccagucaggggcucuugg

SEQ ID NO: 575475 - RNA, 20 nt, Human
ggggagaggcagguguucug

SEQ ID NO: 575476 - RNA, 24 nt, Human
ggggcguagggcaaagaacaggaa

SEQ ID NO: 575477 - RNA, 23 nt, Human
guagggcaaagaacaggaagagg

SEQ ID NO: 575478 - RNA, 23 nt, Human
guuagugauggcugaucgagggu

SEQ ID NO: 575479 - RNA, 19 nt, Human
uaagaguagccucauccag

SEQ ID NO: 575480 - RNA, 22 nt, Human
uaccuggcgguuuacagaagcc

SEQ ID NO: 575481 - RNA, 21 nt, Human
uagagucccuccccucuuucc

SEQ ID NO: 575482 - RNA, 22 nt, Human
uagcucacccauguaauuccag

SEQ ID NO: 575483 - RNA, 24 nt, Human
uagcucacccauguaauuccagca

SEQ ID NO: 575484 - RNA, 26 nt, Human
uaguuuggggaaacccgggggugggu

SEQ ID NO: 575485 - RNA, 23 nt, Human
ucacgccauugcauuccagccug

SEQ ID NO: 575486 - RNA, 19 nt, Human
ucaucgaaggggcggggaa

SEQ ID NO: 575487 - RNA, 19 nt, Human
uccaacuccugcagccauc

SEQ ID NO: 575488 - RNA, 20 nt, Human
uccaccuccgaccggagcca

SEQ ID NO: 575489 - RNA, 20 nt, Human
uccagccugggcaacaagcg

SEQ ID NO: 575490 - RNA, 25 nt, Human
ucccugcagcgacaaccggcugccc

SEQ ID NO: 575491 - RNA, 22 nt, Human
uccuucagccuagacacccuga

SEQ ID NO: 575492 - RNA, 25 nt, Human
ucgggaggcugaggcaggagaauca

SEQ ID NO: 575493 - RNA, 19 nt, Human
ucuacucaggagauguuac

SEQ ID NO: 575494 - RNA, 22 nt, Human
ugagacaaaaccccgucucuac

SEQ ID NO: 575495 - RNA, 20 nt, Human
ugaggcaggagaaucacccg

SEQ ID NO: 575496 - RNA, 21 nt, Human
ugaggcaggagaaucacccga

SEQ ID NO: 575497 - RNA, 24 nt, Human
ugaggcaggagaaucacccgaacc

SEQ ID NO: 575498 - RNA, 25 nt, Human
ugaggcaggagaaucacccgaaccc

SEQ ID NO: 575499 - RNA, 18 nt, Human
ugaggcuuggaggggagc

SEQ ID NO: 575500 - RNA, 20 nt, Human
ugauagcaagaucagguuuc

SEQ ID NO: 575501 - RNA, 27 nt, Human
ugauuggcagacacccucagcuccucu

SEQ ID NO: 575502 - RNA, 21 nt, Human
ugcaaaucugcacaaucgcac

SEQ ID NO: 575503 - RNA, 19 nt, Human
ugcauuccagccugggcaa

SEQ ID NO: 575504 - RNA, 22 nt, Human
ugcauuccagccugggcaacaa

SEQ ID NO: 575505 - RNA, 19 nt, Human
ugcccggagcgggcugaaa

SEQ ID NO: 575506 - RNA, 22 nt, Human
uggcacacacccgcggucccag

SEQ ID NO: 575507 - RNA, 21 nt, Human
uggcacuggacguuugccagg

SEQ ID NO: 575508 - RNA, 18 nt, Human
ugggagaagccuaggagu

SEQ ID NO: 575509 - RNA, 19 nt, Human
ugggagaagccuaggagug

SEQ ID NO: 575510 - RNA, 22 nt, Human
ugggcagggaaggugggggcuc

SEQ ID NO: 575511 - RNA, 23 nt, Human
ugguggcacacacccgcgguccc

SEQ ID NO: 575512 - RNA, 18 nt, Human
ugugguggcacacacccg

SEQ ID NO: 575513 - RNA, 23 nt, Human
uuacugcugggcguggcuugcgg

SEQ ID NO: 575514 - RNA, 25 nt, Human
uuacugcugggcguggcuugcgggg

SEQ ID NO: 575515 - RNA, 21 nt, Human
uucccuccaacuccugcagcc

SEQ ID NO: 575516 - RNA, 20 nt, Human
uugcagugagccaagaucac

SEQ ID NO: 575517 - RNA, 26 nt, Human
uuuaagcagcagcaauugauagcaag

SEQ ID NO: 575518 - RNA, 26 nt, Human
aaaaaaaaaaauuaaagugcuucagg

SEQ ID NO: 575519 - RNA, 24 nt, Human
aaaacggacagucucccccaagua

SEQ ID NO: 575520 - RNA, 18 nt, Human
aaacggacagucuccccc

SEQ ID NO: 575521 - RNA, 20 nt, Human
aacccgaaccgagacccggc

SEQ ID NO: 575522 - RNA, 22 nt, Human
aacccuugcccuggccuagggg

SEQ ID NO: 575523 - RNA, 18 nt, Human
aagaugaccucaucugug

SEQ ID NO: 575524 - RNA, 21 nt, Human
aaugaggaagagacuuuguaa

SEQ ID NO: 575525 - RNA, 19 nt, Human
aaugucagaggugggaaag

SEQ ID NO: 575526 - RNA, 26 nt, Human
acaaucuuggccuuaggugucccugg

SEQ ID NO: 575527 - RNA, 21 nt, Human
acaggcagcucugccaggccu

SEQ ID NO: 575528 - RNA, 19 nt, Human
acccccacccccaggaucc

SEQ ID NO: 575529 - RNA, 19 nt, Human
accggaggccgaccgccgg

SEQ ID NO: 575530 - RNA, 21 nt, Human
agacaggcagcucugccaggc

SEQ ID NO: 575531 - RNA, 21 nt, Human
agacccggcagcgcccggacg

SEQ ID NO: 575532 - RNA, 18 nt, Human
agcgcaacaccagcagaa

SEQ ID NO: 575533 - RNA, 20 nt, Human
aggaaggucacugucagggg

SEQ ID NO: 575534 - RNA, 21 nt, Human
aggcagcucugccaggccucu

SEQ ID NO: 575535 - RNA, 23 nt, Human
agggagggaaugucagagguggg

SEQ ID NO: 575536 - RNA, 25 nt, Human
aguuacaggaacagaccaaaaaaaa

SEQ ID NO: 575537 - RNA, 21 nt, Human
aucaccacccucuaaucucag

SEQ ID NO: 575538 - RNA, 25 nt, Human
aucuguggacacaaucgguuccucu

SEQ ID NO: 575539 - RNA, 21 nt, Human
caagacaggcagcucugccag

SEQ ID NO: 575540 - RNA, 20 nt, Human
caagacaggcagcucugccg

SEQ ID NO: 575541 - RNA, 23 nt, Human
cacagcuucuucccccaucccuc

SEQ ID NO: 575542 - RNA, 22 nt, Human
cacggucaaguguuuuccagcc

SEQ ID NO: 575543 - RNA, 27 nt, Human
cagaccaaaaaaaaaaaaauuaaagug

SEQ ID NO: 575544 - RNA, 20 nt, Human
cagagggucccgacaccucc

SEQ ID NO: 575545 - RNA, 25 nt, Human
cagcagaaaacggacagucuccccc

SEQ ID NO: 575546 - RNA, 22 nt, Human
cagcagcgugcucacuugggcc

SEQ ID NO: 575547 - RNA, 24 nt, Human
cagccaugcccgcccacuucacag

SEQ ID NO: 575548 - RNA, 19 nt, Human
cagcgcaacaccagcagaa

SEQ ID NO: 575549 - RNA, 18 nt, Human
cagugaaacggugagugg

SEQ ID NO: 575550 - RNA, 18 nt, Human
ccagggcgguugccaguu

SEQ ID NO: 575551 - RNA, 19 nt, Human
cccaaccccugagacagga

SEQ ID NO: 575552 - RNA, 25 nt, Human
cccacaggaacucggggaauacugg

SEQ ID NO: 575553 - RNA, 24 nt, Human
cccacccccaggauccccuccccc

SEQ ID NO: 575554 - RNA, 25 nt, Human
ccccaucccucaucagcagacacaa

SEQ ID NO: 575555 - RNA, 24 nt, Human
cccccacccccaggauccccuccc

SEQ ID NO: 575556 - RNA, 20 nt, Human
cccccaggauccccuccccc

SEQ ID NO: 575557 - RNA, 22 nt, Human
ccccccacaggaacucggggaa

SEQ ID NO: 575558 - RNA, 22 nt, Human
ccccccggcaucccgccuccgg

SEQ ID NO: 575559 - RNA, 20 nt, Human
cccccggugccggaccccgc

SEQ ID NO: 575560 - RNA, 26 nt, Human
cccgcaccgccccggcagcgcaacac

SEQ ID NO: 575561 - RNA, 21 nt, Human
cccggugccggaccccgcacc

SEQ ID NO: 575562 - RNA, 23 nt, Human
ccgccccccggcaucccgccucc

SEQ ID NO: 575563 - RNA, 19 nt, Human
ccgccccggcagcgcaaca

SEQ ID NO: 575564 - RNA, 19 nt, Human
ccgccgccccccggcaucc

SEQ ID NO: 575565 - RNA, 23 nt, Human
ccgccgccccccggcaucccgcc

SEQ ID NO: 575566 - RNA, 23 nt, Human
ccgccgccccccggcaucccgcc

SEQ ID NO: 575567 - RNA, 24 nt, Human
ccgccgccccccggcaucccgccu

SEQ ID NO: 575568 - RNA, 21 nt, Human
ccgcgcgcggcggcagcggca

SEQ ID NO: 575569 - RNA, 18 nt, Human
ccggggcaacgaacccga

SEQ ID NO: 575570 - RNA, 19 nt, Human
ccggggcaacgaacccgaa

SEQ ID NO: 575571 - RNA, 19 nt, Human
ccggucccggcaccggggc

SEQ ID NO: 575572 - RNA, 24 nt, Human
ccuccacaggcagcguggucgcuc

SEQ ID NO: 575573 - RNA, 21 nt, Human
ccucuggagcccaagcccggg

SEQ ID NO: 575574 - RNA, 23 nt, Human
ccucugggggcguugggucucug

SEQ ID NO: 575575 - RNA, 23 nt, Human
ccuggcccuguccccaaccccug

SEQ ID NO: 575576 - RNA, 27 nt, Human
ccuggcccuguccccaaccccugagac

SEQ ID NO: 575577 - RNA, 21 nt, Human
cgaauccuggucgccggcgcc

SEQ ID NO: 575578 - RNA, 22 nt, Human
cgaauccuggucgccggcgccg

SEQ ID NO: 575579 - RNA, 22 nt, Human
cgcaacaccagcagaaaacgga

SEQ ID NO: 575580 - RNA, 24 nt, Human
cgcccgguaccggcccggaucccc

SEQ ID NO: 575581 - RNA, 21 nt, Human
cggcaccggggcaacgaaccc

SEQ ID NO: 575582 - RNA, 22 nt, Human
cggcagcgcaacaccagcagaa

SEQ ID NO: 575583 - RNA, 21 nt, Human
cggcccggauccccugccagc

SEQ ID NO: 575584 - RNA, 24 nt, Human
cggcggcagcggcacggccgggaa

SEQ ID NO: 575585 - RNA, 26 nt, Human
cggugccggaccccgcaccgccccgg

SEQ ID NO: 575586 - RNA, 24 nt, Human
cuagggguggggccagcccccccc

SEQ ID NO: 575587 - RNA, 21 nt, Human
cucugccaggccucuucaccc

SEQ ID NO: 575588 - RNA, 21 nt, Human
cugcagcaaucgcagguagcc

SEQ ID NO: 575589 - RNA, 22 nt, Human
cuggagcccaagcccgggccgc

SEQ ID NO: 575590 - RNA, 20 nt, Human
cuggcccuguccccaacccc

SEQ ID NO: 575591 - RNA, 18 nt, Human
gaacaaacccccaccccc

SEQ ID NO: 575592 - RNA, 25 nt, Human
gaaccgagacccggcagcgcccgga

SEQ ID NO: 575593 - RNA, 18 nt, Human
gaaugaggaagagacuuu

SEQ ID NO: 575594 - RNA, 20 nt, Human
gacuuuguaaacucagaacc

SEQ ID NO: 575595 - RNA, 20 nt, Human
gauaacuggcguugaaguug

SEQ ID NO: 575596 - RNA, 22 nt, Human
gcagggcccgggccgugggugg

SEQ ID NO: 575597 - RNA, 19 nt, Human
gcaucucagaaccggaggg

SEQ ID NO: 575598 - RNA, 24 nt, Human
gcccacuucacagcuucuuccccc

SEQ ID NO: 575599 - RNA, 21 nt, Human
gcccggauccccugccagcuc

SEQ ID NO: 575600 - RNA, 19 nt, Human
gcccuggccuagggguggg

SEQ ID NO: 575601 - RNA, 23 nt, Human
ggaacaaacccccacccccagga

SEQ ID NO: 575602 - RNA, 18 nt, Human
ggagcccaagcccgggcc

SEQ ID NO: 575603 - RNA, 21 nt, Human
ggcaacgaacccgaaccgaga

SEQ ID NO: 575604 - RNA, 18 nt, Human
ggcccuguccccaacccc

SEQ ID NO: 575605 - RNA, 18 nt, Human
ggcccuguccccaacccc

SEQ ID NO: 575606 - RNA, 23 nt, Human
gggcagcgcccgguaccggcccg

SEQ ID NO: 575607 - RNA, 21 nt, Human
gggccgugggugagaaggggg

SEQ ID NO: 575608 - RNA, 24 nt, Human
gguggggccagccccccccacagg

SEQ ID NO: 575609 - RNA, 21 nt, Human
uaaguuacaggaacagaccaa

SEQ ID NO: 575610 - RNA, 20 nt, Human
uaccggcccggauccccugc

SEQ ID NO: 575611 - RNA, 19 nt, Human
uagcagggcccgggccgug

SEQ ID NO: 575612 - RNA, 20 nt, Human
uaggguggguccagaggguc

SEQ ID NO: 575613 - RNA, 22 nt, Human
uaguuggaaaauaaguuacagg

SEQ ID NO: 575614 - RNA, 19 nt, Human
uauccagugaaacggugag

SEQ ID NO: 575615 - RNA, 18 nt, Human
ucacuacaaucuuggccu

SEQ ID NO: 575616 - RNA, 22 nt, Human
ucacuacaaucuuggccuuagg

SEQ ID NO: 575617 - RNA, 19 nt, Human
ucagcagcgugcucacucc

SEQ ID NO: 575618 - RNA, 18 nt, Human
ucccagccaugcccgccc

SEQ ID NO: 575619 - RNA, 23 nt, Human
ucccucaucagcagacacaagac

SEQ ID NO: 575620 - RNA, 23 nt, Human
ucccuccugaacaggcauuuaau

SEQ ID NO: 575621 - RNA, 20 nt, Human
ucgccggcgccgccgccccc

SEQ ID NO: 575622 - RNA, 20 nt, Human
ucgguuccuccacaggcagc

SEQ ID NO: 575623 - RNA, 18 nt, Human
ucucugaccucuggugcc

SEQ ID NO: 575624 - RNA, 24 nt, Human
ugaccucuggugccucaaucuccc

SEQ ID NO: 575625 - RNA, 20 nt, Human
ugagaagggggcugcagccu

SEQ ID NO: 575626 - RNA, 18 nt, Human
ugagacaggaaggucacu

SEQ ID NO: 575627 - RNA, 19 nt, Human
ugagaggagcuguucagca

SEQ ID NO: 575628 - RNA, 21 nt, Human
ugcccuggccuaggggugggg

SEQ ID NO: 575629 - RNA, 19 nt, Human
ugccucaaucucccgcuuc

SEQ ID NO: 575630 - RNA, 22 nt, Human
ugcucacuugggccuugaaagc

SEQ ID NO: 575631 - RNA, 20 nt, Human
uggaaaauaaguuacaggaa

SEQ ID NO: 575632 - RNA, 24 nt, Human
uggacacaaucgguuccuccacag

SEQ ID NO: 575633 - RNA, 19 nt, Human
uggagcccaagcccgggcc

SEQ ID NO: 575634 - RNA, 24 nt, Human
uggagcccaagcccgggccgcccc

SEQ ID NO: 575635 - RNA, 20 nt, Human
uggcccuguccccaaccccu

SEQ ID NO: 575636 - RNA, 19 nt, Human
ugggaaagaacucaacggg

SEQ ID NO: 575637 - RNA, 20 nt, Human
ugggaaagaacucaacggga

SEQ ID NO: 575638 - RNA, 19 nt, Human
ugggagcccggaccggagg

SEQ ID NO: 575639 - RNA, 22 nt, Human
ugucagaggugggaaagaacuc

SEQ ID NO: 575640 - RNA, 27 nt, Human
uuacaggaacagaccaaaaaaaaaaaa

SEQ ID NO: 575641 - RNA, 22 nt, Human
uucacagcuucuucccccaucc

SEQ ID NO: 575642 - RNA, 24 nt, Human
uugaaagcgcucugcucgccccgg

SEQ ID NO: 575643 - RNA, 18 nt, Human
uuucucccuccugaacag

SEQ ID NO: 575644 - RNA, 24 nt, Human
uuuuuuuuuuucucccuccugaac

SEQ ID NO: 575645 - RNA, 25 nt, Human
uuuuuuuuuuuuucucccuccuccc

SEQ ID NO: 575646 - RNA, 26 nt, Human
uuuuuuuuuuuuuucucccuccccca

SEQ ID NO: 575647 - RNA, 24 nt, Human
aaagugcugggauuacaggcgcga

SEQ ID NO: 575648 - RNA, 24 nt, Human
aacgauucuccugccucagccucc

SEQ ID NO: 575649 - RNA, 20 nt, Human
aagaaacugcacaacuucca

SEQ ID NO: 575650 - RNA, 24 nt, Human
aagcaaacgugugaacacauucuu

SEQ ID NO: 575651 - RNA, 18 nt, Human
aagugcugggauuacagg

SEQ ID NO: 575652 - RNA, 19 nt, Human
aagugcugggauuacaggc

SEQ ID NO: 575653 - RNA, 26 nt, Human
aagugcugggauuacaggcgcgagcc

SEQ ID NO: 575654 - RNA, 24 nt, Human
acccgggcuggagugcaauggcau

SEQ ID NO: 575655 - RNA, 24 nt, Human
accucgugaucugcccaccuuggc

SEQ ID NO: 575656 - RNA, 24 nt, Human
acuguaacccgggcuggagugcaa

SEQ ID NO: 575657 - RNA, 22 nt, Human
agaaagccucacacuguaaccc

SEQ ID NO: 575658 - RNA, 20 nt, Human
agaagugcagaggggacugu

SEQ ID NO: 575659 - RNA, 22 nt, Human
agacuacaggugccauccacca

SEQ ID NO: 575660 - RNA, 23 nt, Human
agcaaacgugugaacacauucuu

SEQ ID NO: 575661 - RNA, 19 nt, Human
agccuccugaguagcuaag

SEQ ID NO: 575662 - RNA, 19 nt, Human
aggguaggucguguguguc

SEQ ID NO: 575663 - RNA, 20 nt, Human
aggugccauccaccacgccc

SEQ ID NO: 575664 - RNA, 23 nt, Human
agguucaaacgauucuccugccu

SEQ ID NO: 575665 - RNA, 24 nt, Human
agugcaauggcaugaucuuggcuc

SEQ ID NO: 575666 - RNA, 18 nt, Human
agugcugggauuacaggc

SEQ ID NO: 575667 - RNA, 23 nt, Human
auuugcauaauaguaaacaucac

SEQ ID NO: 575668 - RNA, 23 nt, Human
caaacacagaagagaaaagccga

SEQ ID NO: 575669 - RNA, 20 nt, Human
caaacgauucuccugccuca

SEQ ID NO: 575670 - RNA, 22 nt, Human
caaacgauucuccugccucagc

SEQ ID NO: 575671 - RNA, 24 nt, Human
caaagugcugggauuacaggcgcg

SEQ ID NO: 575672 - RNA, 27 nt, Human
caacaaugauccuguaaggaacauuaa

SEQ ID NO: 575673 - RNA, 23 nt, Human
caaccuccaccucccagguucaa

SEQ ID NO: 575674 - RNA, 18 nt, Human
cacaggcuuccaggagag

SEQ ID NO: 575675 - RNA, 21 nt, Human
cacugcaaccuccaccuccca

SEQ ID NO: 575676 - RNA, 21 nt, Human
cacugcacucgaccgcccuga

SEQ ID NO: 575677 - RNA, 20 nt, Human
cagacucaggaggaagacag

SEQ ID NO: 575678 - RNA, 23 nt, Human
cagcaggcaaacacagaagagaa

SEQ ID NO: 575679 - RNA, 18 nt, Human
cagccucaccucuacgaa

SEQ ID NO: 575680 - RNA, 20 nt, Human
cagccuccugaguagcuaag

SEQ ID NO: 575681 - RNA, 19 nt, Human
caggucaguucaacaacaa

SEQ ID NO: 575682 - RNA, 23 nt, Human
cauccaccacgcccaacuaauuu

SEQ ID NO: 575683 - RNA, 19 nt, Human
ccaaagugcugggauuaca

SEQ ID NO: 575684 - RNA, 22 nt, Human
ccaaagugcugggauuacaggc

SEQ ID NO: 575685 - RNA, 23 nt, Human
ccaaagugcugggauuacaggcg

SEQ ID NO: 575686 - RNA, 20 nt, Human
ccaccacgcccaacuaauuu

SEQ ID NO: 575687 - RNA, 24 nt, Human
ccaccucccagguucaaacgauuc

SEQ ID NO: 575688 - RNA, 24 nt, Human
ccacugcacucgaccgcccugagc

SEQ ID NO: 575689 - RNA, 21 nt, Human
ccauccaccacgcccaacuaa

SEQ ID NO: 575690 - RNA, 19 nt, Human
cccacagagaagugcagag

SEQ ID NO: 575691 - RNA, 21 nt, Human
cccggcaccagcaaguacacu

SEQ ID NO: 575692 - RNA, 24 nt, Human
ccuauguuuaccagguuggucucg

SEQ ID NO: 575693 - RNA, 24 nt, Human
ccucccagguucaaacgauucucc

SEQ ID NO: 575694 - RNA, 24 nt, Human
ccugaguagcuaagacuacaggug

SEQ ID NO: 575695 - RNA, 22 nt, Human
ccugcaacuagagggucugauc

SEQ ID NO: 575696 - RNA, 20 nt, Human
ccugcagcucugcaauguuu

SEQ ID NO: 575697 - RNA, 23 nt, Human
ccugccucagccuccugaguagc

SEQ ID NO: 575698 - RNA, 24 nt, Human
ccugccucagccuccugaguagcu

SEQ ID NO: 575699 - RNA, 24 nt, Human
cucacugcaaccuccaccucccag

SEQ ID NO: 575700 - RNA, 20 nt, Human
cuccucaccucgugaucugc

SEQ ID NO: 575701 - RNA, 24 nt, Human
cuccugaguagcuaagacuacagg

SEQ ID NO: 575702 - RNA, 22 nt, Human
cuccugccucagccuccugagu

SEQ ID NO: 575703 - RNA, 22 nt, Human
cucuacgaagcucccugcagag

SEQ ID NO: 575704 - RNA, 23 nt, Human
cugcaaccuccaccucccagguu

SEQ ID NO: 575705 - RNA, 24 nt, Human
cugcaaccuccaccucccagguuc

SEQ ID NO: 575706 - RNA, 25 nt, Human
cugcagaggccaugaaacagccugg

SEQ ID NO: 575707 - RNA, 24 nt, Human
cuggagcagaccugaugggaaggg

SEQ ID NO: 575708 - RNA, 24 nt, Human
cuggagugcaauggcaugaucuug

SEQ ID NO: 575709 - RNA, 24 nt, Human
cuuccaggagagccaggagucagg

SEQ ID NO: 575710 - RNA, 22 nt, Human
gaaacagccugggggugggcag

SEQ ID NO: 575711 - RNA, 24 nt, Human
gagaaaagccgaaucccugugaca

SEQ ID NO: 575712 - RNA, 20 nt, Human
gagauaggguuucccuaugu

SEQ ID NO: 575713 - RNA, 20 nt, Human
gagcagaccugaugggaagg

SEQ ID NO: 575714 - RNA, 19 nt, Human
gagcuuuuuuuccugcaac

SEQ ID NO: 575715 - RNA, 20 nt, Human
gauaggguuucccuauguuu

SEQ ID NO: 575716 - RNA, 18 nt, Human
gauuacaggcgcgagcca

SEQ ID NO: 575717 - RNA, 22 nt, Human
gauuacaggcgcgagccacugc

SEQ ID NO: 575718 - RNA, 23 nt, Human
gauuacaggcgcgagccacugca

SEQ ID NO: 575719 - RNA, 22 nt, Human
gcaaccuccaccucccagguuc

SEQ ID NO: 575720 - RNA, 24 nt, Human
gccccacagagaagugcagagggg

SEQ ID NO: 575721 - RNA, 24 nt, Human
gcucugcaauguuuggggaagaag

SEQ ID NO: 575722 - RNA, 19 nt, Human
gcuggagugcaauggcaug

SEQ ID NO: 575723 - RNA, 24 nt, Human
ggggugggcaggaagcccgggggg

SEQ ID NO: 575724 - RNA, 27 nt, Human
ggggugggcaggaagcccggggggcag

SEQ ID NO: 575725 - RNA, 24 nt, Human
guuguuguuuuguuuuuguuuuua

SEQ ID NO: 575726 - RNA, 22 nt, Human
uaaaaagcaaauaaguuaaauu

SEQ ID NO: 575727 - RNA, 23 nt, Human
uaaacaucacacguaaguucaca

SEQ ID NO: 575728 - RNA, 24 nt, Human
uaagacuacaggugccauccacca

SEQ ID NO: 575729 - RNA, 18 nt, Human
uaaggaacauuaauucuu

SEQ ID NO: 575730 - RNA, 21 nt, Human
uacaggcgcgagccacugcac

SEQ ID NO: 575731 - RNA, 23 nt, Human
uagaagagauaggguuucccuau

SEQ ID NO: 575732 - RNA, 22 nt, Human
uagccaggcuggagcagaccug

SEQ ID NO: 575733 - RNA, 23 nt, Human
uagccaggcuggagcagaccuga

SEQ ID NO: 575734 - RNA, 18 nt, Human
uagcuaagacuacaggug

SEQ ID NO: 575735 - RNA, 24 nt, Human
uaggguuucccuauguuuaccagg

SEQ ID NO: 575736 - RNA, 18 nt, Human
uauccuaaugcgauugcu

SEQ ID NO: 575737 - RNA, 28 nt, Human
uauuuuuuuuuuuuuagaagagauaggg

SEQ ID NO: 575738 - RNA, 19 nt, Human
ucaaacgauucuccugccu

SEQ ID NO: 575739 - RNA, 19 nt, Human
ucacacuguaacccgggcu

SEQ ID NO: 575740 - RNA, 24 nt, Human
ucacacuguaacccgggcuggagu

SEQ ID NO: 575741 - RNA, 19 nt, Human
ucacggauggaaaggcacu

SEQ ID NO: 575742 - RNA, 24 nt, Human
ucacugcaaccuccaccucccagg

SEQ ID NO: 575743 - RNA, 25 nt, Human
ucacugcaaccuccaccucccaggu

SEQ ID NO: 575744 - RNA, 27 nt, Human
ucacugcaaccuccaccucccagguuc

SEQ ID NO: 575745 - RNA, 18 nt, Human
ucagguugaacguggcug

SEQ ID NO: 575746 - RNA, 24 nt, Human
ucagguugaacguggcugagaaau

SEQ ID NO: 575747 - RNA, 22 nt, Human
ucaucagguugaacguggcuga

SEQ ID NO: 575748 - RNA, 20 nt, Human
uccaggagagccaggaguca

SEQ ID NO: 575749 - RNA, 24 nt, Human
ucccaaagugcugggauuacaggc

SEQ ID NO: 575750 - RNA, 21 nt, Human
ucccagguucaaacgauucuc

SEQ ID NO: 575751 - RNA, 24 nt, Human
ucccagguucaaacgauucuccug

SEQ ID NO: 575752 - RNA, 21 nt, Human
ucccugcagaggccaugaaac

SEQ ID NO: 575753 - RNA, 19 nt, Human
ucccugugacacuggcucc

SEQ ID NO: 575754 - RNA, 18 nt, Human
ucccugugacacuggcuu

SEQ ID NO: 575755 - RNA, 24 nt, Human
uccugaguagcuaagacuacaggu

SEQ ID NO: 575756 - RNA, 23 nt, Human
ucugcccggcaccagcaaguaca

SEQ ID NO: 575757 - RNA, 18 nt, Human
ugaaacagccugggggug

SEQ ID NO: 575758 - RNA, 23 nt, Human
ugaacguggcugagaaauccacc

SEQ ID NO: 575759 - RNA, 18 nt, Human
ugagaugaugccuggagg

SEQ ID NO: 575760 - RNA, 19 nt, Human
ugagguggucugaagcaga

SEQ ID NO: 575761 - RNA, 24 nt, Human
ugaucugcccaccuuggccuccca

SEQ ID NO: 575762 - RNA, 20 nt, Human
ugcacucgaccgcccugagc

SEQ ID NO: 575763 - RNA, 18 nt, Human
ugcagaggggacugugag

SEQ ID NO: 575764 - RNA, 23 nt, Human
ugccucagccuccugaguagcua

SEQ ID NO: 575765 - RNA, 24 nt, Human
ugccucagccuccugaguagcuaa

SEQ ID NO: 575766 - RNA, 23 nt, Human
ugcggagauacuagcaggugugu

SEQ ID NO: 575767 - RNA, 24 nt, Human
ugcugggauuacaggcgcgagcca

SEQ ID NO: 575768 - RNA, 24 nt, Human
uggaaaggcacugucuuggcccug

SEQ ID NO: 575769 - RNA, 19 nt, Human
uggagugcaauggcaugau

SEQ ID NO: 575770 - RNA, 24 nt, Human
uggagugcaauggcaugaucuugg

SEQ ID NO: 575771 - RNA, 23 nt, Human
uggcaccagccucaccucuacga

SEQ ID NO: 575772 - RNA, 19 nt, Human
uggcaugaucuuggcucac

SEQ ID NO: 575773 - RNA, 21 nt, Human
uggcaugaucuuggcucacug

SEQ ID NO: 575774 - RNA, 18 nt, Human
uggcccugaagcugcuca

SEQ ID NO: 575775 - RNA, 19 nt, Human
uggcugagaaauccaccuu

SEQ ID NO: 575776 - RNA, 19 nt, Human
ugggauuacaggcgcgagc

SEQ ID NO: 575777 - RNA, 21 nt, Human
ugggauuacaggcgcgagcca

SEQ ID NO: 575778 - RNA, 22 nt, Human
ugggauuacaggcgcgagccac

SEQ ID NO: 575779 - RNA, 22 nt, Human
ugggauuacaggcgcgagccac

SEQ ID NO: 575780 - RNA, 24 nt, Human
ugggauuacaggcgcgagccacug

SEQ ID NO: 575781 - RNA, 24 nt, Human
ugggauuacaggcgcgagccacug

SEQ ID NO: 575782 - RNA, 21 nt, Human
ugggggugggcaggaagcccg

SEQ ID NO: 575783 - RNA, 20 nt, Human
uguauuuuuuuuuuuuuaga

SEQ ID NO: 575784 - RNA, 18 nt, Human
ugugaaggagcaccacag

SEQ ID NO: 575785 - RNA, 29 nt, Human
uguuguuguuguuguuuuguuuuugauuu

SEQ ID NO: 575786 - RNA, 20 nt, Human
uguuguuuuguuuuuguuuu

SEQ ID NO: 575787 - RNA, 24 nt, Human
uuaccagguuggucucgaacuccu

SEQ ID NO: 575788 - RNA, 23 nt, Human
uuagaagagauaggguuucccua

SEQ ID NO: 575789 - RNA, 24 nt, Human
uucaaacgauucuccugccucagc

SEQ ID NO: 575790 - RNA, 19 nt, Human
uucacggauggaaaggcac

SEQ ID NO: 575791 - RNA, 22 nt, Human
uucacggauggaaaggcacugu

SEQ ID NO: 575792 - RNA, 19 nt, Human
uucccuauguuuaccaggu

SEQ ID NO: 575793 - RNA, 21 nt, Human
uuccugcaacuagagggucug

SEQ ID NO: 575794 - RNA, 18 nt, Human
uuggccucccaaagugcu

SEQ ID NO: 575795 - RNA, 19 nt, Human
uuguuguuguuuuguuuuu

SEQ ID NO: 575796 - RNA, 22 nt, Human
uuguuguuuuguuuuuguuuuu

SEQ ID NO: 575797 - RNA, 19 nt, Human
uuuuuuuuuuuagaagaga

SEQ ID NO: 575798 - RNA, 21 nt, Human
uuuuuuuuuuuuagaagagau

SEQ ID NO: 575799 - RNA, 24 nt, Human
aaacaauagaaacagaucugcuac

SEQ ID NO: 575800 - RNA, 18 nt, Human
aaccuuaaaaaaguccug

SEQ ID NO: 575801 - RNA, 22 nt, Human
aacuaacugccccaaagaccua

SEQ ID NO: 575802 - RNA, 22 nt, Human
aacuuauugucacccugacucu

SEQ ID NO: 575803 - RNA, 21 nt, Human
acaaagcaucuuuaagucucc

SEQ ID NO: 575804 - RNA, 18 nt, Human
acucucaucuccaccaac

SEQ ID NO: 575805 - RNA, 18 nt, Human
caaaagaaagaaagauaa

SEQ ID NO: 575806 - RNA, 20 nt, Human
caaauucuaacucgaaacac

SEQ ID NO: 575807 - RNA, 23 nt, Human
caccaaaauuaucuguuuuuucc

SEQ ID NO: 575808 - RNA, 23 nt, Human
caucuccaccaacaaugucuuac

SEQ ID NO: 575809 - RNA, 19 nt, Human
caugauaauuucuguuaua

SEQ ID NO: 575810 - RNA, 23 nt, Human
ccaauuucucauuaauuuuccca

SEQ ID NO: 575811 - RNA, 18 nt, Human
ccucaaaagaaagaaaga

SEQ ID NO: 575812 - RNA, 25 nt, Human
cucucaaacucucaucuccaccaac

SEQ ID NO: 575813 - RNA, 19 nt, Human
gaaacagaucugcuacaga

SEQ ID NO: 575814 - RNA, 18 nt, Human
guuggguuaagugaauuu

SEQ ID NO: 575815 - RNA, 21 nt, Human
uaaacuacaugcccuuguuuu

SEQ ID NO: 575816 - RNA, 20 nt, Human
uaauaaacaauagaaacaga

SEQ ID NO: 575817 - RNA, 26 nt, Human
uacaugcccuuguuuuuuaacaaagc

SEQ ID NO: 575818 - RNA, 26 nt, Human
uccaccaacaaugucuuacuguuugu

SEQ ID NO: 575819 - RNA, 27 nt, Human
uccaccaacaaugucuuacuguuugua

SEQ ID NO: 575820 - RNA, 20 nt, Human
ugauaaccuuaaaaaagucc

SEQ ID NO: 575821 - RNA, 19 nt, Human
aaaaaacaaacacauaaac

SEQ ID NO: 575822 - RNA, 23 nt, Human
aaaaaacaaacacauaaacaaaa

SEQ ID NO: 575823 - RNA, 19 nt, Human
aaaacaaaauaagacaaaa

SEQ ID NO: 575824 - RNA, 18 nt, Human
aaacaaaaaaagcaaaca

SEQ ID NO: 575825 - RNA, 26 nt, Human
aaacaaaaaaagcaaacaugcccugg

SEQ ID NO: 575826 - RNA, 21 nt, Human
aaacaaaacaaaauaagacaa

SEQ ID NO: 575827 - RNA, 26 nt, Human
aaacaaacacauaaacaaaaaaagca

SEQ ID NO: 575828 - RNA, 19 nt, Human
aaacaagcauaaaaaucac

SEQ ID NO: 575829 - RNA, 24 nt, Human
aaacaagcauaaaaaucacaaaaa

SEQ ID NO: 575830 - RNA, 23 nt, Human
aacaaauguggaguaggccacaa

SEQ ID NO: 575831 - RNA, 23 nt, Human
aacacauaaacaaaaaaagcaaa

SEQ ID NO: 575832 - RNA, 18 nt, Human
aagaacuuucaguucaau

SEQ ID NO: 575833 - RNA, 24 nt, Human
aagucaguucuagaucaucaccau

SEQ ID NO: 575834 - RNA, 18 nt, Human
aaguucuaggaauucuuc

SEQ ID NO: 575835 - RNA, 21 nt, Human
aaucacaugagaaacauuuaa

SEQ ID NO: 575836 - RNA, 27 nt, Human
aaucacgugaacccaggaggcggagcu

SEQ ID NO: 575837 - RNA, 21 nt, Human
aauggaauacaggaggaacug

SEQ ID NO: 575838 - RNA, 21 nt, Human
acaaaacaaaauaagacaaaa

SEQ ID NO: 575839 - RNA, 25 nt, Human
acaaacacauaaacaaaaaaagcaa

SEQ ID NO: 575840 - RNA, 24 nt, Human
acaguguaagagagaauacaacuu

SEQ ID NO: 575841 - RNA, 24 nt, Human
acagugugagacucugucucaaaa

SEQ ID NO: 575842 - RNA, 22 nt, Human
acauaaaucccaacauauucca

SEQ ID NO: 575843 - RNA, 19 nt, Human
acgccggagcccacgggga

SEQ ID NO: 575844 - RNA, 20 nt, Human
acgguguuucaccacguugg

SEQ ID NO: 575845 - RNA, 24 nt, Human
acgguguuucaccacguuggccag

SEQ ID NO: 575846 - RNA, 18 nt, Human
agagagcaacugaaacau

SEQ ID NO: 575847 - RNA, 23 nt, Human
agcaaaaggggcaggaggaagaa

SEQ ID NO: 575848 - RNA, 20 nt, Human
agcaggaaaaaaaugcauaa

SEQ ID NO: 575849 - RNA, 23 nt, Human
agccgggcgugauggugcacgcc

SEQ ID NO: 575850 - RNA, 24 nt, Human
agccugggccacagugugagacuc

SEQ ID NO: 575851 - RNA, 20 nt, Human
agcgauucuccugccucagc

SEQ ID NO: 575852 - RNA, 24 nt, Human
agcgauucuccugccucagccucc

SEQ ID NO: 575853 - RNA, 25 nt, Human
agcuggacucaccaguuucaaccug

SEQ ID NO: 575854 - RNA, 20 nt, Human
aggaaaaugugaaaucccau

SEQ ID NO: 575855 - RNA, 19 nt, Human
aggaggaagaagguacaga

SEQ ID NO: 575856 - RNA, 19 nt, Human
aggaggaagaagguacaga

SEQ ID NO: 575857 - RNA, 23 nt, Human
aggaugaaaguuggaauugcaaa

SEQ ID NO: 575858 - RNA, 22 nt, Human
aggccgagaccccaggagcaaa

SEQ ID NO: 575859 - RNA, 20 nt, Human
aguacaguggugcaaucuug

SEQ ID NO: 575860 - RNA, 24 nt, Human
aguacaguggugcaaucuuggcuc

SEQ ID NO: 575861 - RNA, 25 nt, Human
auaaauccuuccccaguuucuuuaa

SEQ ID NO: 575862 - RNA, 26 nt, Human
auaaauccuuccccaguuucuuuaaa

SEQ ID NO: 575863 - RNA, 22 nt, Human
aucauagcauuuuccagcaauu

SEQ ID NO: 575864 - RNA, 21 nt, Human
auguaagaacuuucaguucaa

SEQ ID NO: 575865 - RNA, 25 nt, Human
caaaaaaagcaaacaugcccuggug

SEQ ID NO: 575866 - RNA, 24 nt, Human
caaaacaaaauaagacaaaacuug

SEQ ID NO: 575867 - RNA, 25 nt, Human
caaaacucacuaggaaccaaucucc

SEQ ID NO: 575868 - RNA, 22 nt, Human
caaccuccacaucccagguucc

SEQ ID NO: 575869 - RNA, 20 nt, Human
caaccuucucacccgcgggc

SEQ ID NO: 575870 - RNA, 24 nt, Human
cacagugugagacucugucucaaa

SEQ ID NO: 575871 - RNA, 22 nt, Human
cacauaaacaaaaaaagcaaac

SEQ ID NO: 575872 - RNA, 19 nt, Human
caccaccacaccuaauuuu

SEQ ID NO: 575873 - RNA, 18 nt, Human
caccacguuggccaggcc

SEQ ID NO: 575874 - RNA, 21 nt, Human
caccacguuggccaggccggu

SEQ ID NO: 575875 - RNA, 24 nt, Human
caccacguuggccaggccggucuc

SEQ ID NO: 575876 - RNA, 30 nt, Human
caccuaauuuuuuguauuuuuaguagagaa

SEQ ID NO: 575877 - RNA, 26 nt, Human
cacgcccgacgcggcugaacgcaguc

SEQ ID NO: 575878 - RNA, 24 nt, Human
cacgccugugaucccagccacccg

SEQ ID NO: 575879 - RNA, 28 nt, Human
cacguuggccaggccggucucgacugaa

SEQ ID NO: 575880 - RNA, 25 nt, Human
cacugugcuggaguccagccugggc

SEQ ID NO: 575881 - RNA, 18 nt, Human
cagaggcaaacauaaauc

SEQ ID NO: 575882 - RNA, 19 nt, Human
cagcaggaaaaaaaugcau

SEQ ID NO: 575883 - RNA, 23 nt, Human
cagccaauccgcggucccggcgc

SEQ ID NO: 575884 - RNA, 22 nt, Human
cagccggccaaggccgagaccc

SEQ ID NO: 575885 - RNA, 30 nt, Human
cagccggccaaggccgagaccccaggagcc

SEQ ID NO: 575886 - RNA, 20 nt, Human
cauauuaaauugaagauaau

SEQ ID NO: 575887 - RNA, 24 nt, Human
caucccagguuccagcgauucucc

SEQ ID NO: 575888 - RNA, 18 nt, Human
cauugcucaagacuucca

SEQ ID NO: 575889 - RNA, 22 nt, Human
ccaaggccgagaccccaggagc

SEQ ID NO: 575890 - RNA, 21 nt, Human
ccacccaccucccgucgcaac

SEQ ID NO: 575891 - RNA, 27 nt, Human
ccagcgauucuccugccucagccuccc

SEQ ID NO: 575892 - RNA, 26 nt, Human
cccaacauauuccaccgaccaaacaa

SEQ ID NO: 575893 - RNA, 19 nt, Human
cccaggcuggaguacagug

SEQ ID NO: 575894 - RNA, 22 nt, Human
ccccaggagcaaagcccgcgcc

SEQ ID NO: 575895 - RNA, 22 nt, Human
cccgacagcugcgcaagccgcc

SEQ ID NO: 575896 - RNA, 22 nt, Human
cccucuguugcccaggcuggag

SEQ ID NO: 575897 - RNA, 21 nt, Human
ccggccaaggccgagacccca

SEQ ID NO: 575898 - RNA, 21 nt, Human
ccucccgucgcaaccuucuca

SEQ ID NO: 575899 - RNA, 22 nt, Human
ccucccgucgcaaccuucucac

SEQ ID NO: 575900 - RNA, 23 nt, Human
ccucccgucgcaaccuucucacc

SEQ ID NO: 575901 - RNA, 25 nt, Human
ccucuguugcccaggcuggaguaca

SEQ ID NO: 575902 - RNA, 23 nt, Human
ccugccucagccucccgaguggc

SEQ ID NO: 575903 - RNA, 20 nt, Human
ccugugaucccagccacccg

SEQ ID NO: 575904 - RNA, 22 nt, Human
ccugugaucccagccacccggg

SEQ ID NO: 575905 - RNA, 24 nt, Human
ccugugaucccagccacccgggag

SEQ ID NO: 575906 - RNA, 19 nt, Human
cgaccaaacaagcauaaaa

SEQ ID NO: 575907 - RNA, 22 nt, Human
cgaggcagccaauccgcggucc

SEQ ID NO: 575908 - RNA, 21 nt, Human
cgccugugaucccagccaccc

SEQ ID NO: 575909 - RNA, 23 nt, Human
cggccaaggccgagaccccagga

SEQ ID NO: 575910 - RNA, 24 nt, Human
cgggaggcugaggcaugagaauca

SEQ ID NO: 575911 - RNA, 24 nt, Human
cgguguuucaccacguuggccagg

SEQ ID NO: 575912 - RNA, 25 nt, Human
cuaacccugaggaaggaagaacaaa

SEQ ID NO: 575913 - RNA, 28 nt, Human
cuaauuuuuuguauuuuuaguagagacg

SEQ ID NO: 575914 - RNA, 25 nt, Human
cuagaaaacacauuccacauauuaa

SEQ ID NO: 575915 - RNA, 22 nt, Human
cuagauggagucucccucuguu

SEQ ID NO: 575916 - RNA, 21 nt, Human
cuagggcacccgaacuugggc

SEQ ID NO: 575917 - RNA, 18 nt, Human
cucaagacuuccauucag

SEQ ID NO: 575918 - RNA, 21 nt, Human
cucacuaggaaccaaucucca

SEQ ID NO: 575919 - RNA, 24 nt, Human
cucacugcaaccuccacaucccag

SEQ ID NO: 575920 - RNA, 24 nt, Human
cucccucuguugcccaggcuggag

SEQ ID NO: 575921 - RNA, 20 nt, Human
cugcaaccuccacaucccaa

SEQ ID NO: 575922 - RNA, 24 nt, Human
cugcaaccuccacaucccagguuc

SEQ ID NO: 575923 - RNA, 22 nt, Human
cugccucagccucccgaguggc

SEQ ID NO: 575924 - RNA, 20 nt, Human
cugguuuaaacaaacaaaac

SEQ ID NO: 575925 - RNA, 24 nt, Human
gaacaaacauagcagaauugccuu

SEQ ID NO: 575926 - RNA, 22 nt, Human
gaacaaauguggaguaggccac

SEQ ID NO: 575927 - RNA, 27 nt, Human
gaccaaacaagcauaaaaaucacaaaa

SEQ ID NO: 575928 - RNA, 23 nt, Human
gagcugagaucaugccacugugc

SEQ ID NO: 575929 - RNA, 22 nt, Human
gagggccggucgccggcugccg

SEQ ID NO: 575930 - RNA, 18 nt, Human
gauauaagauaaaauucu

SEQ ID NO: 575931 - RNA, 24 nt, Human
gauggugcacgccugugaucccag

SEQ ID NO: 575932 - RNA, 21 nt, Human
gcaaaagcagagcgcaacccg

SEQ ID NO: 575933 - RNA, 24 nt, Human
gccaccaauaaagaauucuaagca

SEQ ID NO: 575934 - RNA, 24 nt, Human
gcgauucuccugccucagccuccc

SEQ ID NO: 575935 - RNA, 26 nt, Human
gcuaaaccagguugccauacauaauu

SEQ ID NO: 575936 - RNA, 23 nt, Human
gcuagggcacccgaacuugggca

SEQ ID NO: 575937 - RNA, 30 nt, Human
ggaagaacaaauguggaguaggccacaaag

SEQ ID NO: 575938 - RNA, 22 nt, Human
ggagcaaagcccgcgccucccg

SEQ ID NO: 575939 - RNA, 23 nt, Human
ggagucucccucuguugcccagg

SEQ ID NO: 575940 - RNA, 21 nt, Human
ggcgaguuccacccaccuccc

SEQ ID NO: 575941 - RNA, 23 nt, Human
gggaauacaggcacgcaccacca

SEQ ID NO: 575942 - RNA, 24 nt, Human
gggcgugauggugcacgccuguga

SEQ ID NO: 575943 - RNA, 23 nt, Human
gguaauaauagaaaaaucauagc

SEQ ID NO: 575944 - RNA, 20 nt, Human
gguccagccggccaaggccc

SEQ ID NO: 575945 - RNA, 23 nt, Human
guaaaauacucuguacccuguca

SEQ ID NO: 575946 - RNA, 21 nt, Human
guauacccaaaguuuaaccca

SEQ ID NO: 575947 - RNA, 20 nt, Human
gugaagaacaaacauagcag

SEQ ID NO: 575948 - RNA, 20 nt, Human
gugugagacucugucucaaa

SEQ ID NO: 575949 - RNA, 18 nt, Human
uaaaaaagcaaaaggggc

SEQ ID NO: 575950 - RNA, 25 nt, Human
uaaaauacucuguacccugucaaaa

SEQ ID NO: 575951 - RNA, 23 nt, Human
uaaaauagauacaacauuugggc

SEQ ID NO: 575952 - RNA, 24 nt, Human
uaaaauagauacaacauuugggca

SEQ ID NO: 575953 - RNA, 21 nt, Human
uaacccaauuguugcaacccc

SEQ ID NO: 575954 - RNA, 24 nt, Human
uaauaauagaaaaaucauagcauu

SEQ ID NO: 575955 - RNA, 25 nt, Human
uaauuuuuuguauuuuuaguagagg

SEQ ID NO: 575956 - RNA, 22 nt, Human
uacagaaaucacaugagaaaca

SEQ ID NO: 575957 - RNA, 19 nt, Human
uacaguggugcaaucuugg

SEQ ID NO: 575958 - RNA, 21 nt, Human
uacccugucaaaacuccuuug

SEQ ID NO: 575959 - RNA, 18 nt, Human
uagaaaacacauuccaca

SEQ ID NO: 575960 - RNA, 19 nt, Human
uaguagagacgguguuuca

SEQ ID NO: 575961 - RNA, 24 nt, Human
uaguagagacgguguuucaccacg

SEQ ID NO: 575962 - RNA, 20 nt, Human
ucaaccuguggaaaugaaau

SEQ ID NO: 575963 - RNA, 24 nt, Human
ucaacugagaacuauuuuaaauau

SEQ ID NO: 575964 - RNA, 22 nt, Human
ucacuagaaagacgcuagcuau

SEQ ID NO: 575965 - RNA, 21 nt, Human
ucacugcaaccuccacauccc

SEQ ID NO: 575966 - RNA, 24 nt, Human
ucacugcaaccuccacaucccagg

SEQ ID NO: 575967 - RNA, 21 nt, Human
ucagccucccgaguggccggg

SEQ ID NO: 575968 - RNA, 20 nt, Human
uccacauauuaaauugaaga

SEQ ID NO: 575969 - RNA, 23 nt, Human
uccacaucccagguuccagcgau

SEQ ID NO: 575970 - RNA, 21 nt, Human
ucccagguuccagcgauucuc

SEQ ID NO: 575971 - RNA, 24 nt, Human
ucccagguuccagcgauucuccug

SEQ ID NO: 575972 - RNA, 19 nt, Human
uccccaguuucuuuaaaaa

SEQ ID NO: 575973 - RNA, 22 nt, Human
ucccggcgcuggcgaguuccac

SEQ ID NO: 575974 - RNA, 20 nt, Human
ucccucuguugcccaggcug

SEQ ID NO: 575975 - RNA, 24 nt, Human
ucccucuguugcccaggcuggagu

SEQ ID NO: 575976 - RNA, 23 nt, Human
ucucccucuguugcccaggcugg

SEQ ID NO: 575977 - RNA, 24 nt, Human
ucucccucuguugcccaggcugga

SEQ ID NO: 575978 - RNA, 26 nt, Human
ucuccugccucagccucccgaguggc

SEQ ID NO: 575979 - RNA, 18 nt, Human
ucuguugcccaggcugga

SEQ ID NO: 575980 - RNA, 20 nt, Human
ugaagaacaaacauagcaga

SEQ ID NO: 575981 - RNA, 23 nt, Human
ugaaguaagucaguucuagauca

SEQ ID NO: 575982 - RNA, 24 nt, Human
ugagauggagucuagauggagucu

SEQ ID NO: 575983 - RNA, 20 nt, Human
ugaggcaugagaaucacgug

SEQ ID NO: 575984 - RNA, 24 nt, Human
ugaggcaugagaaucacgugaacc

SEQ ID NO: 575985 - RNA, 24 nt, Human
ugauggugcacgccugugauccca

SEQ ID NO: 575986 - RNA, 18 nt, Human
ugccauacauaauucaaa

SEQ ID NO: 575987 - RNA, 21 nt, Human
ugccauuacaguuauuauucu

SEQ ID NO: 575988 - RNA, 21 nt, Human
ugcccaggcuggaguacagug

SEQ ID NO: 575989 - RNA, 24 nt, Human
ugcccaggcuggaguacaguggug

SEQ ID NO: 575990 - RNA, 20 nt, Human
ugcccuggugcuuccaaugu

SEQ ID NO: 575991 - RNA, 24 nt, Human
ugccucagccucccgaguggccgg

SEQ ID NO: 575992 - RNA, 23 nt, Human
ugccuuaguugaggcuacagugu

SEQ ID NO: 575993 - RNA, 20 nt, Human
ugcuggaguccagccugggc

SEQ ID NO: 575994 - RNA, 22 nt, Human
ugcuuccaauguauacccaaag

SEQ ID NO: 575995 - RNA, 24 nt, Human
uggaguacaguggugcaaucuugg

SEQ ID NO: 575996 - RNA, 19 nt, Human
uggagucuagauggagucu

SEQ ID NO: 575997 - RNA, 24 nt, Human
uggagucucccucuguugcccagg

SEQ ID NO: 575998 - RNA, 20 nt, Human
uggccaggccggucucgacu

SEQ ID NO: 575999 - RNA, 21 nt, Human
uggugcacgccugugauccca

SEQ ID NO: 576000 - RNA, 24 nt, Human
ugguuuaaacaaacaaaacaaaau

SEQ ID NO: 576001 - RNA, 22 nt, Human
uguaagagagaauacaacuuag

SEQ ID NO: 576002 - RNA, 19 nt, Human
ugucucaaaaaacaaacac

SEQ ID NO: 576003 - RNA, 18 nt, Human
ugugaaaucccaucucaa

SEQ ID NO: 576004 - RNA, 21 nt, Human
uuaaaaauacuuuuaguaaaa

SEQ ID NO: 576005 - RNA, 22 nt, Human
uuaacccaauuguugcaacccc

SEQ ID NO: 576006 - RNA, 20 nt, Human
uuagccgggcgugauggugc

SEQ ID NO: 576007 - RNA, 24 nt, Human
uuagccgggcgugauggugcacgc

SEQ ID NO: 576008 - RNA, 18 nt, Human
uuaguagagacgguguuu

SEQ ID NO: 576009 - RNA, 20 nt, Human
uucagaggcaaacauaaauc

SEQ ID NO: 576010 - RNA, 22 nt, Human
uucagcaggaaaaaaaugcaua

SEQ ID NO: 576011 - RNA, 18 nt, Human
uuccagcgauucuccugc

SEQ ID NO: 576012 - RNA, 18 nt, Human
uucucuuucacuagaaag

SEQ ID NO: 576013 - RNA, 24 nt, Human
uugcccaggcuggaguacaguggu

SEQ ID NO: 576014 - RNA, 23 nt, Human
uuuaaacaaacaaaacaaaauaa

SEQ ID NO: 576015 - RNA, 24 nt, Human
uuucaccacguuggccaggccggu

SEQ ID NO: 576016 - RNA, 24 nt, Human
uuuuuaguagagacgguguuucac

SEQ ID NO: 576017 - RNA, 22 nt, Human
uuuuuguauuuuuaguagagaa

SEQ ID NO: 576018 - RNA, 22 nt, Human
uuuuuuuuuuuuuugagaugga

SEQ ID NO: 576019 - RNA, 23 nt, Human
uuuuuuuuuuuuuuuuuuuuggg

SEQ ID NO: 576020 - RNA, 24 nt, Human
aagcaaacccaacccucgugauua

SEQ ID NO: 576021 - RNA, 22 nt, Human
agagagacaggcauuuuccaaa

SEQ ID NO: 576022 - RNA, 23 nt, Human
agcuaaggaagguagcaguaggu

SEQ ID NO: 576023 - RNA, 19 nt, Human
caaagcaaacccaacccuc

SEQ ID NO: 576024 - RNA, 21 nt, Human
cacgccagucauuuuauuucc

SEQ ID NO: 576025 - RNA, 25 nt, Human
caucauccuugugaagaaauggaag

SEQ ID NO: 576026 - RNA, 20 nt, Human
ccaaagcaaacccaacccuc

SEQ ID NO: 576027 - RNA, 23 nt, Human
gccagucauuuuauuuccaucau

SEQ ID NO: 576028 - RNA, 21 nt, Human
uaggugguaggaucagcaccu

SEQ ID NO: 576029 - RNA, 22 nt, Human
ucagcaccuugguuccaggcau

SEQ ID NO: 576030 - RNA, 21 nt, Human
uccuugugaagaaauggaagu

SEQ ID NO: 576031 - RNA, 31 nt, Human
uccuugugaagaaauggaagucuggagaggg

SEQ ID NO: 576032 - RNA, 19 nt, Human
ucuccggcccugcaccguc

SEQ ID NO: 576033 - RNA, 21 nt, Human
ugaaggcaaucuggccacaaa

SEQ ID NO: 576034 - RNA, 23 nt, Human
ugaugaaggcaaucuggccacaa

SEQ ID NO: 576035 - RNA, 23 nt, Human
uggagaggugaaaugaugaaggc

SEQ ID NO: 576036 - RNA, 22 nt, Human
ugguaggaucagcaccuugguu

SEQ ID NO: 576037 - RNA, 18 nt, Human
uucuuuaucauucaagua

SEQ ID NO: 576038 - RNA, 24 nt, Human
uucuuuaucauucaaguagagaga

SEQ ID NO: 576039 - RNA, 18 nt, Human
aaaaacagcuuugaccua

SEQ ID NO: 576040 - RNA, 24 nt, Human
aaauaaacuggcaaucacaagaac

SEQ ID NO: 576041 - RNA, 19 nt, Human
aacauggugaaaccccguc

SEQ ID NO: 576042 - RNA, 20 nt, Human
aacauggugaaaccccgucu

SEQ ID NO: 576043 - RNA, 21 nt, Human
aacauggugaaaccccgucuc

SEQ ID NO: 576044 - RNA, 24 nt, Human
aagcugagguaggagaauugcuug

SEQ ID NO: 576045 - RNA, 24 nt, Human
accccgucuccacuaaaaauacaa

SEQ ID NO: 576046 - RNA, 23 nt, Human
accuguaaucccagcacuuuggg

SEQ ID NO: 576047 - RNA, 24 nt, Human
acugcacuccaaugugggcaacag

SEQ ID NO: 576048 - RNA, 26 nt, Human
agaugggcagaucacuugagcucagg

SEQ ID NO: 576049 - RNA, 24 nt, Human
agcacuuugggaggcugagauggg

SEQ ID NO: 576050 - RNA, 23 nt, Human
agccaggugugguggugggugcc

SEQ ID NO: 576051 - RNA, 24 nt, Human
agccauacucuguuugaaccuaaa

SEQ ID NO: 576052 - RNA, 22 nt, Human
agccuggccaacauggugaaac

SEQ ID NO: 576053 - RNA, 24 nt, Human
agccuggccaacauggugaaaccc

SEQ ID NO: 576054 - RNA, 20 nt, Human
aggaaaagcuauaaauagug

SEQ ID NO: 576055 - RNA, 21 nt, Human
aggcugagaugggcagaucac

SEQ ID NO: 576056 - RNA, 23 nt, Human
agguaggagaauugcuugaaccc

SEQ ID NO: 576057 - RNA, 23 nt, Human
agguggcggaggcugcaaugagc

SEQ ID NO: 576058 - RNA, 24 nt, Human
agguggcggaggcugcaaugagcu

SEQ ID NO: 576059 - RNA, 24 nt, Human
agugggggauacauuaagagacug

SEQ ID NO: 576060 - RNA, 22 nt, Human
aucgugccacugcacuccaaug

SEQ ID NO: 576061 - RNA, 22 nt, Human
augaaaaaaugagugaaaaaga

SEQ ID NO: 576062 - RNA, 19 nt, Human
auggaaagcagauuaccca

SEQ ID NO: 576063 - RNA, 24 nt, Human
caacauggugaaaccccgucucca

SEQ ID NO: 576064 - RNA, 20 nt, Human
caauaucacaccagauagcc

SEQ ID NO: 576065 - RNA, 18 nt, Human
caaugugggcaacagagc

SEQ ID NO: 576066 - RNA, 24 nt, Human
cacaccagauagccucuugaaaac

SEQ ID NO: 576067 - RNA, 25 nt, Human
caccagauagccucuugaaaacucc

SEQ ID NO: 576068 - RNA, 19 nt, Human
cacugcacuccaauguggg

SEQ ID NO: 576069 - RNA, 23 nt, Human
cacugcacuccaaugugggcaac

SEQ ID NO: 576070 - RNA, 24 nt, Human
cacugcacuccaaugugggcaaca

SEQ ID NO: 576071 - RNA, 26 nt, Human
cagaaacacuaaggcaaauuugacug

SEQ ID NO: 576072 - RNA, 24 nt, Human
cagaucacuugagcucaggaguuc

SEQ ID NO: 576073 - RNA, 24 nt, Human
cagcacuuugggaggcugagaugg

SEQ ID NO: 576074 - RNA, 24 nt, Human
cauaccuguaaucccagcacuuug

SEQ ID NO: 576075 - RNA, 20 nt, Human
ccacugcacuccaauguggg

SEQ ID NO: 576076 - RNA, 20 nt, Human
ccacugcacuccaauguggg

SEQ ID NO: 576077 - RNA, 21 nt, Human
ccacugcacuccaaugugggc

SEQ ID NO: 576078 - RNA, 24 nt, Human
ccacugcacuccaaugugggcaac

SEQ ID NO: 576079 - RNA, 21 nt, Human
ccagaccacacuuugacaacc

SEQ ID NO: 576080 - RNA, 24 nt, Human
ccagaccagccuggccaacauggu

SEQ ID NO: 576081 - RNA, 21 nt, Human
cccagaccacacuuugacaac

SEQ ID NO: 576082 - RNA, 22 nt, Human
cccagaccacacuuugacaacc

SEQ ID NO: 576083 - RNA, 23 nt, Human
cccccagaccacacuuugacaac

SEQ ID NO: 576084 - RNA, 21 nt, Human
cccgucccgcggccgcagcca

SEQ ID NO: 576085 - RNA, 21 nt, Human
cccgucuccacuaaaaauaca

SEQ ID NO: 576086 - RNA, 19 nt, Human
cccuggaccucagaaagag

SEQ ID NO: 576087 - RNA, 19 nt, Human
ccgaaaucaaagcgagagc

SEQ ID NO: 576088 - RNA, 19 nt, Human
ccuauaaucccagcuacuc

SEQ ID NO: 576089 - RNA, 21 nt, Human
ccuauaaucccagcuacucgg

SEQ ID NO: 576090 - RNA, 23 nt, Human
ccuggccaacauggugaaacccc

SEQ ID NO: 576091 - RNA, 24 nt, Human
ccuggccaacauggugaaaccccg

SEQ ID NO: 576092 - RNA, 22 nt, Human
cgcgagggcggaggcgccgaaa

SEQ ID NO: 576093 - RNA, 22 nt, Human
cuaaugaccuguccuauucccu

SEQ ID NO: 576094 - RNA, 24 nt, Human
cucauaccuguaaucccagcacuu

SEQ ID NO: 576095 - RNA, 22 nt, Human
cuccucugcauacucaugaaaa

SEQ ID NO: 576096 - RNA, 19 nt, Human
cugaugacagacgaaagcu

SEQ ID NO: 576097 - RNA, 23 nt, Human
cugcaaauaaacuggcaaucaca

SEQ ID NO: 576098 - RNA, 23 nt, Human
cuugaaaacuccucugcauacuc

SEQ ID NO: 576099 - RNA, 18 nt, Human
cuuguaucugcuuuugca

SEQ ID NO: 576100 - RNA, 20 nt, Human
gaaaaaaugagugaaaaaga

SEQ ID NO: 576101 - RNA, 19 nt, Human
gaacagaaacacuaaggca

SEQ ID NO: 576102 - RNA, 18 nt, Human
gagaucgugccacugcac

SEQ ID NO: 576103 - RNA, 24 nt, Human
gagguaggagaauugcuugaaccc

SEQ ID NO: 576104 - RNA, 20 nt, Human
gaguuccagaccagccuggc

SEQ ID NO: 576105 - RNA, 21 nt, Human
gauaaaauggaguuguuccga

SEQ ID NO: 576106 - RNA, 22 nt, Human
gaucacuugagcucaggaguuc

SEQ ID NO: 576107 - RNA, 24 nt, Human
gccaacauggugaaaccccgucuc

SEQ ID NO: 576108 - RNA, 24 nt, Human
gccacugcacuccaaugugggcaa

SEQ ID NO: 576109 - RNA, 18 nt, Human
gcucacuaccccgucccg

SEQ ID NO: 576110 - RNA, 20 nt, Human
gcugagaucgugccacugca

SEQ ID NO: 576111 - RNA, 18 nt, Human
gcugcaaugagcugagau

SEQ ID NO: 576112 - RNA, 24 nt, Human
ggacgcgccuggcagcggcaggaa

SEQ ID NO: 576113 - RNA, 24 nt, Human
ggaggcugcaaugagcugagaucg

SEQ ID NO: 576114 - RNA, 23 nt, Human
ggcguuguggcucauaccuguaa

SEQ ID NO: 576115 - RNA, 18 nt, Human
ggcuaucagguuggggaa

SEQ ID NO: 576116 - RNA, 19 nt, Human
gggauacauuaagagacug

SEQ ID NO: 576117 - RNA, 22 nt, Human
gggcagaucacuugagcucagg

SEQ ID NO: 576118 - RNA, 26 nt, Human
gggcagaucacuugagcucaggaguu

SEQ ID NO: 576119 - RNA, 24 nt, Human
gguggugggugccuauaaucccag

SEQ ID NO: 576120 - RNA, 22 nt, Human
guggcucauaccuguaauccca

SEQ ID NO: 576121 - RNA, 22 nt, Human
uaaaaaaaaggaaaagcuauaa

SEQ ID NO: 576122 - RNA, 21 nt, Human
uaaaaauacaaaaauuagcca

SEQ ID NO: 576123 - RNA, 22 nt, Human
uaaguugcaaaaauugucacaa

SEQ ID NO: 576124 - RNA, 20 nt, Human
uacaauaucacaccagauag

SEQ ID NO: 576125 - RNA, 21 nt, Human
uacccauaauaucaguauuua

SEQ ID NO: 576126 - RNA, 23 nt, Human
uaccuguaaucccagcacuuugg

SEQ ID NO: 576127 - RNA, 23 nt, Human
uacucuguuugaaccuaaacuac

SEQ ID NO: 576128 - RNA, 19 nt, Human
uagccucuugaaaacuccu

SEQ ID NO: 576129 - RNA, 18 nt, Human
uauauuacccucucccca

SEQ ID NO: 576130 - RNA, 21 nt, Human
uaucugcuuuugcauucagcc

SEQ ID NO: 576131 - RNA, 19 nt, Human
ucaauuggaaaccugggaa

SEQ ID NO: 576132 - RNA, 20 nt, Human
uccaaugugggcaacagagc

SEQ ID NO: 576133 - RNA, 18 nt, Human
ucuauuugaacagaaaca

SEQ ID NO: 576134 - RNA, 23 nt, Human
ucucuccccgcgagggcggaggc

SEQ ID NO: 576135 - RNA, 26 nt, Human
ugaaaaagauaaaugauggcugggcg

SEQ ID NO: 576136 - RNA, 22 nt, Human
ugaaaccccgucuccacuaaaa

SEQ ID NO: 576137 - RNA, 24 nt, Human
ugaaaggcucuugaggccccccca

SEQ ID NO: 576138 - RNA, 24 nt, Human
ugacaaccacugcucuagacgaau

SEQ ID NO: 576139 - RNA, 22 nt, Human
ugacauauuucagaaaaauuuu

SEQ ID NO: 576140 - RNA, 18 nt, Human
ugaccuguccuauucccu

SEQ ID NO: 576141 - RNA, 22 nt, Human
ugagaaacucaacaucacagcc

SEQ ID NO: 576142 - RNA, 19 nt, Human
ugagaugggcagaucacuu

SEQ ID NO: 576143 - RNA, 22 nt, Human
ugagcugagaucgugccacugc

SEQ ID NO: 576144 - RNA, 24 nt, Human
ugagguaggagaauugcuugaacc

SEQ ID NO: 576145 - RNA, 24 nt, Human
ugccuauaaucccagcuacucggg

SEQ ID NO: 576146 - RNA, 26 nt, Human
uggaaaccugggaaauacacccuaau

SEQ ID NO: 576147 - RNA, 18 nt, Human
uggaauacaauucaauga

SEQ ID NO: 576148 - RNA, 24 nt, Human
uggccaacauggugaaaccccguc

SEQ ID NO: 576149 - RNA, 24 nt, Human
uggcggaggcugcaaugagcugag

SEQ ID NO: 576150 - RNA, 21 nt, Human
uggcucauaccuguaauccca

SEQ ID NO: 576151 - RNA, 22 nt, Human
uggcucauaccuguaaucccag

SEQ ID NO: 576152 - RNA, 24 nt, Human
uggcucauaccuguaaucccagca

SEQ ID NO: 576153 - RNA, 23 nt, Human
uggcugggcguuguggcucauac

SEQ ID NO: 576154 - RNA, 20 nt, Human
ugggaggcugagaugggcag

SEQ ID NO: 576155 - RNA, 24 nt, Human
ugggaggcugagaugggcagauca

SEQ ID NO: 576156 - RNA, 24 nt, Human
uggugggugccuauaaucccagcu

SEQ ID NO: 576157 - RNA, 24 nt, Human
ugguggugggugccuauaauccca

SEQ ID NO: 576158 - RNA, 23 nt, Human
uguccuauucccuguaaguugca

SEQ ID NO: 576159 - RNA, 28 nt, Human
ugucucacuucucuugguuuagauucuc

SEQ ID NO: 576160 - RNA, 24 nt, Human
ugucugaugacagacgaaagcugg

SEQ ID NO: 576161 - RNA, 22 nt, Human
ugucuuaguguuauaaaaacag

SEQ ID NO: 576162 - RNA, 24 nt, Human
uguggcucauaccuguaaucccag

SEQ ID NO: 576163 - RNA, 20 nt, Human
uuagauucucaauuggaaac

SEQ ID NO: 576164 - RNA, 24 nt, Human
uuagccaggugugguggugggugc

SEQ ID NO: 576165 - RNA, 24 nt, Human
uugcuugaacccagguggcggagg

SEQ ID NO: 576166 - RNA, 24 nt, Human
uuggaaaccugggaaauacacccu

SEQ ID NO: 576167 - RNA, 25 nt, Human
uugggaggcugagaugggcagauca

SEQ ID NO: 576168 - RNA, 23 nt, Human
uuugcauucagccuauuacaaua

SEQ ID NO: 576169 - RNA, 18 nt, Human
aacucaugaucccuccuc

SEQ ID NO: 576170 - RNA, 21 nt, Human
aaguaauggcaagacaauuau

SEQ ID NO: 576171 - RNA, 20 nt, Human
agaaucaggaaaagacuaac

SEQ ID NO: 576172 - RNA, 20 nt, Human
caggaaaagacuaacuuaug

SEQ ID NO: 576173 - RNA, 22 nt, Human
cagggucaacugucuaaagguc

SEQ ID NO: 576174 - RNA, 23 nt, Human
ccagugcccaaauaugucccaag

SEQ ID NO: 576175 - RNA, 23 nt, Human
cccaagauuuuuaccuaagacuu

SEQ ID NO: 576176 - RNA, 22 nt, Human
cuuggccaaaccagugcccaaa

SEQ ID NO: 576177 - RNA, 23 nt, Human
gagaauuauccaugggcaauguc

SEQ ID NO: 576178 - RNA, 18 nt, Human
ggaugaagucuacauaua

SEQ ID NO: 576179 - RNA, 20 nt, Human
guuucugauauugggaccca

SEQ ID NO: 576180 - RNA, 22 nt, Human
uaagaaucaggaaaagacuaac

SEQ ID NO: 576181 - RNA, 22 nt, Human
uacuaaaauuacacagugcaua

SEQ ID NO: 576182 - RNA, 23 nt, Human
uaggauguuugacaauugggaug

SEQ ID NO: 576183 - RNA, 24 nt, Human
uauuucaccccuucaguguugugu

SEQ ID NO: 576184 - RNA, 19 nt, Human
ucaauuccuacucuugcua

SEQ ID NO: 576185 - RNA, 24 nt, Human
ucacuucucuuuucuuucgcugga

SEQ ID NO: 576186 - RNA, 20 nt, Human
ucagagccuaaugaaacugg

SEQ ID NO: 576187 - RNA, 19 nt, Human
ucaguccagguaaaguugu

SEQ ID NO: 576188 - RNA, 23 nt, Human
ucagugaucaaauaauuagaagu

SEQ ID NO: 576189 - RNA, 23 nt, Human
uccaugggcaauguccagaaauc

SEQ ID NO: 576190 - RNA, 21 nt, Human
ucugagugguggcaacucaug

SEQ ID NO: 576191 - RNA, 19 nt, Human
ugcauguucuuguaaacuu

SEQ ID NO: 576192 - RNA, 18 nt, Human
ugcucaaaagaaagucaa

SEQ ID NO: 576193 - RNA, 26 nt, Human
ugcucaaaagaaagucaaaaaaauuc

SEQ ID NO: 576194 - RNA, 22 nt, Human
uggaagaauaaacuucugagug

SEQ ID NO: 576195 - RNA, 24 nt, Human
uggaagaauaaacuucugaguggu

SEQ ID NO: 576196 - RNA, 23 nt, Human
uggccaaaccagugcccaaauau

SEQ ID NO: 576197 - RNA, 20 nt, Human
ugucuaaaggucucaggugu

SEQ ID NO: 576198 - RNA, 21 nt, Human
uguugcacaauuuacaaucuu

SEQ ID NO: 576199 - RNA, 22 nt, Human
uuaaagugcaucauugcauguu

SEQ ID NO: 576200 - RNA, 22 nt, Human
uuaagaaucaggaaaagacuaa

SEQ ID NO: 576201 - RNA, 25 nt, Human
uuaguucaauuuucuaacauagucu

SEQ ID NO: 576202 - RNA, 21 nt, Human
uucucuuuucuuucgcuggau

SEQ ID NO: 576203 - RNA, 18 nt, Human
uugacaauugggaugaag

SEQ ID NO: 576204 - RNA, 18 nt, Human
uuguaauggcuucagagc

SEQ ID NO: 576205 - RNA, 19 nt, Human
uuuaccuaagacuuuccuc

SEQ ID NO: 576206 - RNA, 25 nt, Human
uuuagcuugagauccaucagugaga

SEQ ID NO: 576207 - RNA, 20 nt, Human
uuuaguguuaugaugcaaga

SEQ ID NO: 576208 - RNA, 20 nt, Human
uuugacaauugggaugaagu

SEQ ID NO: 576209 - RNA, 25 nt, Human
aaaacagacgccagugaaucaaugu

SEQ ID NO: 576210 - RNA, 21 nt, Human
aaacagcaacgccugagccuc

SEQ ID NO: 576211 - RNA, 25 nt, Human
aaaccaauaugauaaaaacaaaaau

SEQ ID NO: 576212 - RNA, 22 nt, Human
aaauauaaaaaauauuacuuuu

SEQ ID NO: 576213 - RNA, 24 nt, Human
aagccccuccacccucccaccccc

SEQ ID NO: 576214 - RNA, 22 nt, Human
acccccaacagcaucuauuagc

SEQ ID NO: 576215 - RNA, 18 nt, Human
agaagccccuccacccuc

SEQ ID NO: 576216 - RNA, 24 nt, Human
agaagccccuccacccucccaccc

SEQ ID NO: 576217 - RNA, 25 nt, Human
agaagccccuccacccucccacccc

SEQ ID NO: 576218 - RNA, 19 nt, Human
agaaguaaugaaaaaccaa

SEQ ID NO: 576219 - RNA, 21 nt, Human
agaaguaaugaaaaaccaaua

SEQ ID NO: 576220 - RNA, 23 nt, Human
agacaagaaacagcaacgccuga

SEQ ID NO: 576221 - RNA, 24 nt, Human
agacaagaaacagcaacgccugag

SEQ ID NO: 576222 - RNA, 20 nt, Human
agagcacguuuuccaggccc

SEQ ID NO: 576223 - RNA, 21 nt, Human
agaguaaccacuugacuugga

SEQ ID NO: 576224 - RNA, 18 nt, Human
auggguuuuucuuuacuu

SEQ ID NO: 576225 - RNA, 22 nt, Human
auuauaaaguuccugaccaaag

SEQ ID NO: 576226 - RNA, 24 nt, Human
caaagucagagcacguuuuccagg

SEQ ID NO: 576227 - RNA, 20 nt, Human
caacagcaucuauuagcuau

SEQ ID NO: 576228 - RNA, 30 nt, Human
caacagcaucuauuagcuauaacuuuaauu

SEQ ID NO: 576229 - RNA, 21 nt, Human
caacuggcuaacacuguccaa

SEQ ID NO: 576230 - RNA, 19 nt, Human
cacccccauucuuccaguc

SEQ ID NO: 576231 - RNA, 26 nt, Human
cacccccauucuuccagucugcucca

SEQ ID NO: 576232 - RNA, 18 nt, Human
cagaaguaaugaaaaacc

SEQ ID NO: 576233 - RNA, 20 nt, Human
caggcccaauggcccauuug

SEQ ID NO: 576234 - RNA, 21 nt, Human
caggccuaucuugauuuuucu

SEQ ID NO: 576235 - RNA, 22 nt, Human
caguaaagaaggaaccugucca

SEQ ID NO: 576236 - RNA, 22 nt, Human
cauuauaaaguuccugaccaaa

SEQ ID NO: 576237 - RNA, 19 nt, Human
ccccuccacccucccaccc

SEQ ID NO: 576238 - RNA, 19 nt, Human
cccuccacccucccacccc

SEQ ID NO: 576239 - RNA, 24 nt, Human
ccucccacccccauucuuccaguc

SEQ ID NO: 576240 - RNA, 23 nt, Human
gcacagaaauccuuuagaauuua

SEQ ID NO: 576241 - RNA, 20 nt, Human
gccccuccacccucccaccc

SEQ ID NO: 576242 - RNA, 19 nt, Human
ggugacaaagucagagcac

SEQ ID NO: 576243 - RNA, 19 nt, Human
uaaaauauaaaaaauauua

SEQ ID NO: 576244 - RNA, 20 nt, Human
uaaaguuccugaccaaagac

SEQ ID NO: 576245 - RNA, 18 nt, Human
uagauccuuggcagaaca

SEQ ID NO: 576246 - RNA, 18 nt, Human
uagcacagaaauccuuua

SEQ ID NO: 576247 - RNA, 19 nt, Human
uauauuggauuauuuuacu

SEQ ID NO: 576248 - RNA, 24 nt, Human
ucacaaaggagaagccccuccacc

SEQ ID NO: 576249 - RNA, 21 nt, Human
uccauuaccagaguaaccacu

SEQ ID NO: 576250 - RNA, 21 nt, Human
ucccacccccauucuuccagu

SEQ ID NO: 576251 - RNA, 24 nt, Human
uccuccaguaaagaaggaaccugu

SEQ ID NO: 576252 - RNA, 22 nt, Human
ucugcuccaacgccaagucugu

SEQ ID NO: 576253 - RNA, 19 nt, Human
ugagaacuugcaaaugaga

SEQ ID NO: 576254 - RNA, 19 nt, Human
ugcaaaugagacaagggaa

SEQ ID NO: 576255 - RNA, 19 nt, Human
ugcuccaacgccaagucug

SEQ ID NO: 576256 - RNA, 18 nt, Human
uggaagacaagaaacagc

SEQ ID NO: 576257 - RNA, 18 nt, Human
uggaagacaagaaacagc

SEQ ID NO: 576258 - RNA, 22 nt, Human
ugggaaagagccucuaacagca

SEQ ID NO: 576259 - RNA, 20 nt, Human
ugggugaauugggugacaaa

SEQ ID NO: 576260 - RNA, 25 nt, Human
uuacaacagugcuucuaagcugggu

SEQ ID NO: 576261 - RNA, 22 nt, Human
uucauguaaauagaaagcugau

SEQ ID NO: 576262 - RNA, 19 nt, Human
uuccagucugcuccaacgc

SEQ ID NO: 576263 - RNA, 18 nt, Human
uucuuccagucugcucca

SEQ ID NO: 576264 - RNA, 20 nt, Human
uugacuuggaagacaagaaa

SEQ ID NO: 576265 - RNA, 18 nt, Human
uuucucaucuuuucuugg

SEQ ID NO: 576266 - RNA, 19 nt, Human
aaaacaaaauguuuccucc

SEQ ID NO: 576267 - RNA, 23 nt, Human
aaaagacagcaagccuucaucaa

SEQ ID NO: 576268 - RNA, 21 nt, Human
aaaagugcaaaaucaaagagu

SEQ ID NO: 576269 - RNA, 24 nt, Human
aaacaaaaaaauuagaaaccaaaa

SEQ ID NO: 576270 - RNA, 18 nt, Human
aacaccaagaacaagaac

SEQ ID NO: 576271 - RNA, 26 nt, Human
aacacgcucacaacaacaaauacaga

SEQ ID NO: 576272 - RNA, 18 nt, Human
aacuugugcuacuuccuu

SEQ ID NO: 576273 - RNA, 18 nt, Human
aagaagacaaccaguucu

SEQ ID NO: 576274 - RNA, 22 nt, Human
aagcaacuaagauauccaguaa

SEQ ID NO: 576275 - RNA, 19 nt, Human
aagcaagaucuaaagcaua

SEQ ID NO: 576276 - RNA, 25 nt, Human
aagcagcaaauaugagggccuaaca

SEQ ID NO: 576277 - RNA, 26 nt, Human
aaugaaaaaacaaaaaaauuagaaac

SEQ ID NO: 576278 - RNA, 22 nt, Human
acaaagcagcaaauaugagggc

SEQ ID NO: 576279 - RNA, 24 nt, Human
acccugcaacaccgcccaagaaga

SEQ ID NO: 576280 - RNA, 23 nt, Human
acguuguggguggagaaauguug

SEQ ID NO: 576281 - RNA, 19 nt, Human
acugccacugcaugcagaa

SEQ ID NO: 576282 - RNA, 26 nt, Human
agaaaccccgaaaaagaaauacacag

SEQ ID NO: 576283 - RNA, 20 nt, Human
agaaauguaggguuagaaug

SEQ ID NO: 576284 - RNA, 25 nt, Human
agaaauucucaaauuuagcaauguc

SEQ ID NO: 576285 - RNA, 22 nt, Human
agacagcccuaaaaugcccuga

SEQ ID NO: 576286 - RNA, 28 nt, Human
agacugccacugcaugcagaaaccccga

SEQ ID NO: 576287 - RNA, 21 nt, Human
agacuguguuacauuucuugg

SEQ ID NO: 576288 - RNA, 23 nt, Human
agagucacugcuugguccaaaaa

SEQ ID NO: 576289 - RNA, 21 nt, Human
aggagaaaagguaugaaauga

SEQ ID NO: 576290 - RNA, 21 nt, Human
aggcaaauauaaacauucuga

SEQ ID NO: 576291 - RNA, 24 nt, Human
agucaugaaucuugagaagaaagu

SEQ ID NO: 576292 - RNA, 23 nt, Human
agugauuugccuguaaauguagu

SEQ ID NO: 576293 - RNA, 23 nt, Human
auaaauuuuuucuaauguuuucu

SEQ ID NO: 576294 - RNA, 24 nt, Human
augcaacccuaagaaaaaaaaauc

SEQ ID NO: 576295 - RNA, 19 nt, Human
caaaaugcacauuuccaau

SEQ ID NO: 576296 - RNA, 23 nt, Human
caacagaccaugcucccuguaac

SEQ ID NO: 576297 - RNA, 24 nt, Human
caagacagcccuaaaaugcccuga

SEQ ID NO: 576298 - RNA, 19 nt, Human
caauggaaaaaucucuaaa

SEQ ID NO: 576299 - RNA, 23 nt, Human
cacaaaauucaggugagagguuu

SEQ ID NO: 576300 - RNA, 20 nt, Human
caccaagaacaagaacauca

SEQ ID NO: 576301 - RNA, 24 nt, Human
cacugcaugcagaaaccccgaaaa

SEQ ID NO: 576302 - RNA, 24 nt, Human
cacugcuugguccaaaaaauaaaa

SEQ ID NO: 576303 - RNA, 18 nt, Human
cauguacagaaguuaauc

SEQ ID NO: 576304 - RNA, 21 nt, Human
cauuguguauaaacauuugaa

SEQ ID NO: 576305 - RNA, 19 nt, Human
cauuucuuggugaucugcc

SEQ ID NO: 576306 - RNA, 23 nt, Human
ccaaauuauccaguguauaugac

SEQ ID NO: 576307 - RNA, 27 nt, Human
ccacccgaaacaaucugcuuuagcuau

SEQ ID NO: 576308 - RNA, 20 nt, Human
ccacugcaugcagaaacccc

SEQ ID NO: 576309 - RNA, 19 nt, Human
ccccuucccuucugauccc

SEQ ID NO: 576310 - RNA, 19 nt, Human
ccuaaaaugcccugaacug

SEQ ID NO: 576311 - RNA, 21 nt, Human
ccuaaaaugcccugaacugac

SEQ ID NO: 576312 - RNA, 23 nt, Human
ccuaaaaugcccugaacugacuu

SEQ ID NO: 576313 - RNA, 21 nt, Human
cuccccuucccuucugauccc

SEQ ID NO: 576314 - RNA, 23 nt, Human
cucccuguaacaaaaccuuccaa

SEQ ID NO: 576315 - RNA, 30 nt, Human
cucuccccuucccuucugaucccucaaaaa

SEQ ID NO: 576316 - RNA, 18 nt, Human
cugcaacaccgcccaaga

SEQ ID NO: 576317 - RNA, 22 nt, Human
cuguaacaaaaccuuccaaacc

SEQ ID NO: 576318 - RNA, 23 nt, Human
cuguaacaaaaccuuccaaaccc

SEQ ID NO: 576319 - RNA, 21 nt, Human
cuuccccuaauugggcuggag

SEQ ID NO: 576320 - RNA, 29 nt, Human
gaaaaaacaaaaaaauuagaaaccaaaag

SEQ ID NO: 576321 - RNA, 21 nt, Human
gaaggcaaucuguaaauuaua

SEQ ID NO: 576322 - RNA, 23 nt, Human
ggcaaucuguaaauuauaaaugc

SEQ ID NO: 576323 - RNA, 18 nt, Human
ggcauggaagagaggaga

SEQ ID NO: 576324 - RNA, 23 nt, Human
gguacuaggugcauuacaggcau

SEQ ID NO: 576325 - RNA, 23 nt, Human
guuagaauuuuaaguuuugauuu

SEQ ID NO: 576326 - RNA, 18 nt, Human
guuucaaaauggauauac

SEQ ID NO: 576327 - RNA, 24 nt, Human
uaaaaacaaaauguuuccuccauc

SEQ ID NO: 576328 - RNA, 26 nt, Human
uaaaagacagcaagccuucaucaagg

SEQ ID NO: 576329 - RNA, 23 nt, Human
uaaaaugcccugaacugacuucc

SEQ ID NO: 576330 - RNA, 21 nt, Human
uaaauaagcaagaucuaaagc

SEQ ID NO: 576331 - RNA, 18 nt, Human
uaaauuauaaaugcaacc

SEQ ID NO: 576332 - RNA, 23 nt, Human
uaacacgcucacaacaacaaaua

SEQ ID NO: 576333 - RNA, 20 nt, Human
uaagaaaaaaaaauccuggu

SEQ ID NO: 576334 - RNA, 19 nt, Human
uaaggaugcuguguaacac

SEQ ID NO: 576335 - RNA, 25 nt, Human
uaagucuuuagccuauauuuacaua

SEQ ID NO: 576336 - RNA, 26 nt, Human
uacaaugaauuguacacugauagacc

SEQ ID NO: 576337 - RNA, 19 nt, Human
uacacagguuucaaaaugg

SEQ ID NO: 576338 - RNA, 23 nt, Human
uacuaggugcauuacaggcauac

SEQ ID NO: 576339 - RNA, 22 nt, Human
uagcuaucaaguaguuugguuu

SEQ ID NO: 576340 - RNA, 20 nt, Human
uauaacaguaugccaguaaa

SEQ ID NO: 576341 - RNA, 25 nt, Human
uauaacaguaugccaguaaaugaaa

SEQ ID NO: 576342 - RNA, 21 nt, Human
uauagcaagacagcccuaaaa

SEQ ID NO: 576343 - RNA, 22 nt, Human
uauaucaacuugcaacaaagca

SEQ ID NO: 576344 - RNA, 19 nt, Human
uaucaaguaguuugguuug

SEQ ID NO: 576345 - RNA, 19 nt, Human
uauccaguguauaugacug

SEQ ID NO: 576346 - RNA, 22 nt, Human
uaugccaguaaaugaaaaaaca

SEQ ID NO: 576347 - RNA, 19 nt, Human
ucagaguaugaaaugcaaa

SEQ ID NO: 576348 - RNA, 20 nt, Human
uccacugugaacucugguuu

SEQ ID NO: 576349 - RNA, 24 nt, Human
uccaucacaaaagcaacacauaua

SEQ ID NO: 576350 - RNA, 19 nt, Human
ucccucaaaaaaaaagugc

SEQ ID NO: 576351 - RNA, 23 nt, Human
ucccucaaaaaaaaagugcaaaa

SEQ ID NO: 576352 - RNA, 26 nt, Human
ucccuguaacaaaaccuuccaaaccc

SEQ ID NO: 576353 - RNA, 21 nt, Human
ucugaucccucaaaaaaaaag

SEQ ID NO: 576354 - RNA, 23 nt, Human
ugaaaaaacaaaaaaauuagaaa

SEQ ID NO: 576355 - RNA, 22 nt, Human
ugaacccugcaacaccgcccaa

SEQ ID NO: 576356 - RNA, 22 nt, Human
ugagguauaacaguaugccagu

SEQ ID NO: 576357 - RNA, 21 nt, Human
ugauuugagucuaauuguuuu

SEQ ID NO: 576358 - RNA, 22 nt, Human
ugcaacaccgcccaagaagaca

SEQ ID NO: 576359 - RNA, 23 nt, Human
ugcaacaccgcccaagaagacaa

SEQ ID NO: 576360 - RNA, 23 nt, Human
ugcaacccuaagaaaaaaaaauc

SEQ ID NO: 576361 - RNA, 18 nt, Human
ugcagaaaccccgaaaaa

SEQ ID NO: 576362 - RNA, 24 nt, Human
ugcagaaaccccgaaaaagaaaua

SEQ ID NO: 576363 - RNA, 20 nt, Human
ugccacaggaaauauuggag

SEQ ID NO: 576364 - RNA, 19 nt, Human
ugcuugguccaaaaaauaa

SEQ ID NO: 576365 - RNA, 21 nt, Human
uggaagagaggagaaaaggua

SEQ ID NO: 576366 - RNA, 19 nt, Human
uggagaaauaaaaagugua

SEQ ID NO: 576367 - RNA, 21 nt, Human
uggauauacuucauuuuguuu

SEQ ID NO: 576368 - RNA, 19 nt, Human
uggguggagaaauguuggc

SEQ ID NO: 576369 - RNA, 20 nt, Human
uggguggagaaauguuggcc

SEQ ID NO: 576370 - RNA, 20 nt, Human
uguugcccccuugaggucca

SEQ ID NO: 576371 - RNA, 20 nt, Human
uuacugccaaaccaacuugu

SEQ ID NO: 576372 - RNA, 22 nt, Human
uuccucuuguagugcaugugcc

SEQ ID NO: 576373 - RNA, 22 nt, Human
uucuccccacccgaaacaaucu

SEQ ID NO: 576374 - RNA, 21 nt, Human
uugagucuaauuguuuuccug

SEQ ID NO: 576375 - RNA, 24 nt, Human
uuuaacacgcucacaacaacaaau

SEQ ID NO: 576376 - RNA, 23 nt, Human
uuucuaauguuuucuguacauau

SEQ ID NO: 576377 - RNA, 23 nt, Human
uuugauauauguucaugaacacc

SEQ ID NO: 576378 - RNA, 18 nt, Human
aucuggacuagaagaaua

SEQ ID NO: 576379 - RNA, 18 nt, Human
cccccugccgacccccgc

SEQ ID NO: 576380 - RNA, 22 nt, Human
cccccugccgacccccgccgcg

SEQ ID NO: 576381 - RNA, 21 nt, Human
ccggcccccugccgacccccg

SEQ ID NO: 576382 - RNA, 19 nt, Human
cggcccccugccgaccccc

SEQ ID NO: 576383 - RNA, 20 nt, Human
uacaacaaaagcugccaggc

SEQ ID NO: 576384 - RNA, 22 nt, Human
uagaagaauaugugcuugaucu

SEQ ID NO: 576385 - RNA, 21 nt, Human
uccccaaacaggggacaucau

SEQ ID NO: 576386 - RNA, 21 nt, Human
uuuuuuuuuuuuuuuuuuugg

SEQ ID NO: 576387 - RNA, 20 nt, Human
aaaaugcuguguaauuaccc

SEQ ID NO: 576388 - RNA, 25 nt, Human
aaaugcaccuguggguucuuucaac

SEQ ID NO: 576389 - RNA, 20 nt, Human
acacuagagacaaacaucac

SEQ ID NO: 576390 - RNA, 23 nt, Human
agaacacuagagacaaacaucac

SEQ ID NO: 576391 - RNA, 22 nt, Human
aggauaacaggagagaauccac

SEQ ID NO: 576392 - RNA, 24 nt, Human
auaggauuugugcuacauuagaac

SEQ ID NO: 576393 - RNA, 21 nt, Human
caacaguacaaaaaggauuag

SEQ ID NO: 576394 - RNA, 19 nt, Human
cacuagagacaaacaucac

SEQ ID NO: 576395 - RNA, 24 nt, Human
caggauaacaggagagaauccacu

SEQ ID NO: 576396 - RNA, 22 nt, Human
ccacucuccugauuguuaauuu

SEQ ID NO: 576397 - RNA, 23 nt, Human
ccuuucauaaaaacugguccagg

SEQ ID NO: 576398 - RNA, 23 nt, Human
cuguggguucuuucaacaggcuc

SEQ ID NO: 576399 - RNA, 23 nt, Human
gaguuuuuccagucuacauggaa

SEQ ID NO: 576400 - RNA, 23 nt, Human
uaacaggagagaauccacucucc

SEQ ID NO: 576401 - RNA, 22 nt, Human
uacauuagaacacuagagacaa

SEQ ID NO: 576402 - RNA, 22 nt, Human
uagaacacuagagacaaacauc

SEQ ID NO: 576403 - RNA, 23 nt, Human
uagagacaaacaucacuugagua

SEQ ID NO: 576404 - RNA, 22 nt, Human
ucaaaaauacauaguaugauuu

SEQ ID NO: 576405 - RNA, 20 nt, Human
uccaggauaacaggagagaa

SEQ ID NO: 576406 - RNA, 21 nt, Human
ugaacagcacuuaacacauua

SEQ ID NO: 576407 - RNA, 18 nt, Human
ugcaaacuuggguacuga

SEQ ID NO: 576408 - RNA, 27 nt, Human
ugguacacuccauucuauggaaggggu

SEQ ID NO: 576409 - RNA, 18 nt, Human
uuagaacacuagagacaa

SEQ ID NO: 576410 - RNA, 19 nt, Human
uucaacaguacaaaaagga

SEQ ID NO: 576411 - RNA, 24 nt, Human
uucugcuucgcuuucaaaaugcug

SEQ ID NO: 576412 - RNA, 18 nt, Human
uuuuccagucuacaugga

SEQ ID NO: 576413 - RNA, 22 nt, Human
uuuuuacuugcaaacuugggua

SEQ ID NO: 576414 - RNA, 22 nt, Human
aagcacacauuaaaacaauuac

SEQ ID NO: 576415 - RNA, 20 nt, Human
aaguauacccaaggcuggac

SEQ ID NO: 576416 - RNA, 22 nt, Human
acagagaggacauacauuuaug

SEQ ID NO: 576417 - RNA, 21 nt, Human
auuacagagaggacauacauu

SEQ ID NO: 576418 - RNA, 19 nt, Human
cauuuggcccuuaaaaaua

SEQ ID NO: 576419 - RNA, 22 nt, Human
ccuacauaugacagcccagaau

SEQ ID NO: 576420 - RNA, 20 nt, Human
uaaaacacauaaauaccugu

SEQ ID NO: 576421 - RNA, 24 nt, Human
uaaaugcaaguauacccaaggcug

SEQ ID NO: 576422 - RNA, 18 nt, Human
uacaaaaauucaaaauau

SEQ ID NO: 576423 - RNA, 21 nt, Human
uacagagaggacauacauuua

SEQ ID NO: 576424 - RNA, 20 nt, Human
ugauagaaauauaaauguac

SEQ ID NO: 576425 - RNA, 22 nt, Human
uucaccuuaaaggucaaacaug

SEQ ID NO: 576426 - RNA, 23 nt, Human
uuuaugauuuaugcaaauuaagg

SEQ ID NO: 576427 - RNA, 22 nt, Human
uuuuuaguaggaauguuaguuu

SEQ ID NO: 576428 - RNA, 18 nt, Human
aaacaaccagagaacacg

SEQ ID NO: 576429 - RNA, 23 nt, Human
aaacaauaccucaagggucuuga

SEQ ID NO: 576430 - RNA, 20 nt, Human
aacaacgucucgggaacaac

SEQ ID NO: 576431 - RNA, 18 nt, Human
aagcuucuggcaucagca

SEQ ID NO: 576432 - RNA, 23 nt, Human
auggcacagaagcuucuggcauc

SEQ ID NO: 576433 - RNA, 20 nt, Human
caacaggaccccacucuggu

SEQ ID NO: 576434 - RNA, 21 nt, Human
caaccagagaacacguggcau

SEQ ID NO: 576435 - RNA, 24 nt, Human
cacaggggacucaacaacgucucg

SEQ ID NO: 576436 - RNA, 22 nt, Human
caccagacauugcaguuccucc

SEQ ID NO: 576437 - RNA, 22 nt, Human
cacggacacugccuguuccaac

SEQ ID NO: 576438 - RNA, 19 nt, Human
cacucugguccaccagagc

SEQ ID NO: 576439 - RNA, 18 nt, Human
cagcacgcagcccagaug

SEQ ID NO: 576440 - RNA, 24 nt, Human
cauguuuguuuucuuuauugaaag

SEQ ID NO: 576441 - RNA, 20 nt, Human
ccccacucugguccaccaga

SEQ ID NO: 576442 - RNA, 20 nt, Human
cugguccaccagagcugcac

SEQ ID NO: 576443 - RNA, 19 nt, Human
cuuccugguugacugguaa

SEQ ID NO: 576444 - RNA, 18 nt, Human
gaacaacggcccggcggg

SEQ ID NO: 576445 - RNA, 22 nt, Human
gaacuggggcucccaauucuua

SEQ ID NO: 576446 - RNA, 24 nt, Human
gaugaaacaauaccucaagggucu

SEQ ID NO: 576447 - RNA, 20 nt, Human
gcaauggcacagaagcuucu

SEQ ID NO: 576448 - RNA, 22 nt, Human
gcacgcagcccagauguccucg

SEQ ID NO: 576449 - RNA, 21 nt, Human
guugaacuggggcucccaauu

SEQ ID NO: 576450 - RNA, 20 nt, Human
ucaaacccaaguccucgaau

SEQ ID NO: 576451 - RNA, 18 nt, Human
uccaaaacaaccagagaa

SEQ ID NO: 576452 - RNA, 19 nt, Human
uccacacccacauaguacc

SEQ ID NO: 576453 - RNA, 18 nt, Human
uccucggaggacugcuca

SEQ ID NO: 576454 - RNA, 21 nt, Human
uccucggaggacugcucaugg

SEQ ID NO: 576455 - RNA, 24 nt, Human
ucgggaacaacggcccggcgggug

SEQ ID NO: 576456 - RNA, 22 nt, Human
ucucugguuucuguucuccacc

SEQ ID NO: 576457 - RNA, 23 nt, Human
ugugagacuaagcggccaggagg

SEQ ID NO: 576458 - RNA, 21 nt, Human
uguuccaacguccacacccac

SEQ ID NO: 576459 - RNA, 19 nt, Human
uuuuuugguugcacauguu

SEQ ID NO: 576460 - RNA, 21 nt, Human
uuuuuuuuuuuuuuuuugguu

SEQ ID NO: 576461 - RNA, 28 nt, Human
uuuuuuuuuuuuuuuuuuuuuuuggggg

SEQ ID NO: 576462 - RNA, 24 nt, Human
aaagugcugggauuacagguguga

SEQ ID NO: 576463 - RNA, 18 nt, Human
aaaguuccucuuccaccu

SEQ ID NO: 576464 - RNA, 30 nt, Human
aaccuaauuacaagaauugagcaagaccag

SEQ ID NO: 576465 - RNA, 22 nt, Human
aaggagucccugcaaguggagc

SEQ ID NO: 576466 - RNA, 18 nt, Human
aagugcugggauuacagg

SEQ ID NO: 576467 - RNA, 19 nt, Human
aagugcugggauuacaggu

SEQ ID NO: 576468 - RNA, 26 nt, Human
aagugcugggauuacaggugugagcc

SEQ ID NO: 576469 - RNA, 18 nt, Human
aaguucuugccaugcgca

SEQ ID NO: 576470 - RNA, 24 nt, Human
aaugacuguauuaacaagaaccua

SEQ ID NO: 576471 - RNA, 21 nt, Human
accaggcuguucuagaucuuc

SEQ ID NO: 576472 - RNA, 24 nt, Human
accucaugauccgcucgccuuggc

SEQ ID NO: 576473 - RNA, 18 nt, Human
acgggguuucaccauguu

SEQ ID NO: 576474 - RNA, 19 nt, Human
acgggguuucaccauguug

SEQ ID NO: 576475 - RNA, 24 nt, Human
acgggguuucaccauguugaccag

SEQ ID NO: 576476 - RNA, 23 nt, Human
agacagucaagaggaaaaggaaa

SEQ ID NO: 576477 - RNA, 18 nt, Human
agaugcccgccacuaagc

SEQ ID NO: 576478 - RNA, 19 nt, Human
agaugcccgccacuaagcc

SEQ ID NO: 576479 - RNA, 22 nt, Human
agaugcccgccacuaagccugg

SEQ ID NO: 576480 - RNA, 20 nt, Human
aggcaagggggaaaaagagg

SEQ ID NO: 576481 - RNA, 25 nt, Human
agggaaauaaaaggagucccugcaa

SEQ ID NO: 576482 - RNA, 23 nt, Human
aggguucaagugauucuccugcc

SEQ ID NO: 576483 - RNA, 18 nt, Human
aguagcugggacuacaga

SEQ ID NO: 576484 - RNA, 20 nt, Human
agugcaguggcaugaucucg

SEQ ID NO: 576485 - RNA, 23 nt, Human
agugcaguggcaugaucucggcu

SEQ ID NO: 576486 - RNA, 24 nt, Human
agugcaguggcaugaucucggcuc

SEQ ID NO: 576487 - RNA, 24 nt, Human
aguggcaugaucucggcucacugc

SEQ ID NO: 576488 - RNA, 19 nt, Human
auccgcucgccuuggccuc

SEQ ID NO: 576489 - RNA, 24 nt, Human
caaagugcugggauuacaggugug

SEQ ID NO: 576490 - RNA, 24 nt, Human
caagaaccuaauuacaagaauuga

SEQ ID NO: 576491 - RNA, 20 nt, Human
caagugauucuccugccuca

SEQ ID NO: 576492 - RNA, 22 nt, Human
caagugauucuccugccucagc

SEQ ID NO: 576493 - RNA, 21 nt, Human
caaguuuccaaucugugaugg

SEQ ID NO: 576494 - RNA, 18 nt, Human
caccauguugaccaggcu

SEQ ID NO: 576495 - RNA, 22 nt, Human
caccauguugaccaggcuguuc

SEQ ID NO: 576496 - RNA, 21 nt, Human
cacccagccuaaaagucauuu

SEQ ID NO: 576497 - RNA, 21 nt, Human
caccugcucugcucagcgcuc

SEQ ID NO: 576498 - RNA, 24 nt, Human
cacuaagccuggcuaauuuuugua

SEQ ID NO: 576499 - RNA, 22 nt, Human
cacugcacccagccuaaaaguc

SEQ ID NO: 576500 - RNA, 20 nt, Human
cagccuccugaguagcuggg

SEQ ID NO: 576501 - RNA, 20 nt, Human
cagcgcucagaagccaauaa

SEQ ID NO: 576502 - RNA, 25 nt, Human
cagugcaguggcaugaucucggcuc

SEQ ID NO: 576503 - RNA, 22 nt, Human
cauuucagcucuuucuuaggga

SEQ ID NO: 576504 - RNA, 21 nt, Human
ccaaagugcugggauuacagg

SEQ ID NO: 576505 - RNA, 21 nt, Human
ccaaagugcugggauuacagg

SEQ ID NO: 576506 - RNA, 24 nt, Human
ccaaagugcugggauuacaggugu

SEQ ID NO: 576507 - RNA, 19 nt, Human
ccacugcacccagccuaaa

SEQ ID NO: 576508 - RNA, 19 nt, Human
ccacugcacccagccuaaa

SEQ ID NO: 576509 - RNA, 21 nt, Human
ccacugcacccagccuaaaag

SEQ ID NO: 576510 - RNA, 24 nt, Human
ccagccugccaccacaggagccag

SEQ ID NO: 576511 - RNA, 20 nt, Human
ccaggguucaagugauucuc

SEQ ID NO: 576512 - RNA, 23 nt, Human
ccaggguucaagugauucuccug

SEQ ID NO: 576513 - RNA, 23 nt, Human
ccagugaugaagccuuaucauga

SEQ ID NO: 576514 - RNA, 23 nt, Human
cccagagaggcauaccccugaga

SEQ ID NO: 576515 - RNA, 21 nt, Human
cccaggcuggagugcagugca

SEQ ID NO: 576516 - RNA, 24 nt, Human
ccuccaggguucaagugauucucc

SEQ ID NO: 576517 - RNA, 21 nt, Human
ccucgugcccagccugccacc

SEQ ID NO: 576518 - RNA, 24 nt, Human
ccucgugcccagccugccaccaca

SEQ ID NO: 576519 - RNA, 19 nt, Human
ccucuagaaggacuauuca

SEQ ID NO: 576520 - RNA, 23 nt, Human
ccugaguagcugggacuacagau

SEQ ID NO: 576521 - RNA, 23 nt, Human
ccugccucagccuccugaguagc

SEQ ID NO: 576522 - RNA, 24 nt, Human
ccugcucugcucagcgcucagaag

SEQ ID NO: 576523 - RNA, 20 nt, Human
cgccuuggccucccaaagug

SEQ ID NO: 576524 - RNA, 27 nt, Human
cucacugcaaccuccaccuccaggguu

SEQ ID NO: 576525 - RNA, 24 nt, Human
cucagaagccaauaaucgcacuca

SEQ ID NO: 576526 - RNA, 24 nt, Human
cucagccuccugaguagcugggac

SEQ ID NO: 576527 - RNA, 18 nt, Human
cucaugauccgcucgccu

SEQ ID NO: 576528 - RNA, 19 nt, Human
cuccaggguucaagugauu

SEQ ID NO: 576529 - RNA, 23 nt, Human
cugacugguugcauuuccuccug

SEQ ID NO: 576530 - RNA, 23 nt, Human
cugccucagccuccugaguagcu

SEQ ID NO: 576531 - RNA, 24 nt, Human
cuucugaccucaugauccgcucgc

SEQ ID NO: 576532 - RNA, 21 nt, Human
cuugcuuugucacccaggcug

SEQ ID NO: 576533 - RNA, 20 nt, Human
gaccucaugauccgcucgcc

SEQ ID NO: 576534 - RNA, 20 nt, Human
gagacgggguuucaccaugu

SEQ ID NO: 576535 - RNA, 26 nt, Human
gaguagcugggacuacagaugcccgc

SEQ ID NO: 576536 - RNA, 24 nt, Human
gaugguuuccauuagauuuuguca

SEQ ID NO: 576537 - RNA, 18 nt, Human
gauuacaggugugagcca

SEQ ID NO: 576538 - RNA, 22 nt, Human
gauuacaggugugagccacugc

SEQ ID NO: 576539 - RNA, 23 nt, Human
gauuacaggugugagccacugca

SEQ ID NO: 576540 - RNA, 21 nt, Human
gauucuccugccucagccucc

SEQ ID NO: 576541 - RNA, 22 nt, Human
gcaaccuccaccuccaggguuc

SEQ ID NO: 576542 - RNA, 22 nt, Human
gccuuggccucccaaagugcug

SEQ ID NO: 576543 - RNA, 23 nt, Human
gggguuucaccauguugaccagg

SEQ ID NO: 576544 - RNA, 23 nt, Human
ggguucaagugauucuccugccu

SEQ ID NO: 576545 - RNA, 22 nt, Human
ggguuucaccauguugaccagg

SEQ ID NO: 576546 - RNA, 23 nt, Human
guagagacgggguuucaccaugu

SEQ ID NO: 576547 - RNA, 24 nt, Human
gucuugcuuugucacccaggcugg

SEQ ID NO: 576548 - RNA, 23 nt, Human
gugauucuccugccucagccucc

SEQ ID NO: 576549 - RNA, 20 nt, Human
uaaaaaacacucguaaagac

SEQ ID NO: 576550 - RNA, 21 nt, Human
uaaaaggagucccugcaagug

SEQ ID NO: 576551 - RNA, 18 nt, Human
uaacucuaaggaggaaag

SEQ ID NO: 576552 - RNA, 18 nt, Human
uaaguaacaauucagcuu

SEQ ID NO: 576553 - RNA, 24 nt, Human
uaauuuuuguauuuuuaguagaga

SEQ ID NO: 576554 - RNA, 24 nt, Human
uacaagaauugagcaagaggacau

SEQ ID NO: 576555 - RNA, 19 nt, Human
uacaggugugagccacugc

SEQ ID NO: 576556 - RNA, 24 nt, Human
uacaggugugagccacugcaccca

SEQ ID NO: 576557 - RNA, 22 nt, Human
uagagacgggguuucaccaugu

SEQ ID NO: 576558 - RNA, 24 nt, Human
uaguagagacgggguuucaccaug

SEQ ID NO: 576559 - RNA, 26 nt, Human
uaguagagacgggguuucaccauguu

SEQ ID NO: 576560 - RNA, 20 nt, Human
ucaagaggaaaaggaaacca

SEQ ID NO: 576561 - RNA, 19 nt, Human
ucaagugauucuccugccu

SEQ ID NO: 576562 - RNA, 23 nt, Human
ucacccaggcuggagugcagugc

SEQ ID NO: 576563 - RNA, 23 nt, Human
ucacugcaaccuccaccuccagg

SEQ ID NO: 576564 - RNA, 24 nt, Human
ucacugcaaccuccaccuccaggg

SEQ ID NO: 576565 - RNA, 25 nt, Human
ucacugcaaccuccaccuccagggu

SEQ ID NO: 576566 - RNA, 27 nt, Human
ucacugcaaccuccaccuccaggguuc

SEQ ID NO: 576567 - RNA, 23 nt, Human
ucagccuccugaguagcugggac

SEQ ID NO: 576568 - RNA, 24 nt, Human
uccaccuccaggguucaagugauu

SEQ ID NO: 576569 - RNA, 24 nt, Human
uccaggguucaagugauucuccug

SEQ ID NO: 576570 - RNA, 23 nt, Human
ucccaaagugcugggauuacagg

SEQ ID NO: 576571 - RNA, 22 nt, Human
uccccagagaggcauaccccug

SEQ ID NO: 576572 - RNA, 18 nt, Human
uccugaguagcugggacu

SEQ ID NO: 576573 - RNA, 24 nt, Human
ucgccuuggccucccaaagugcug

SEQ ID NO: 576574 - RNA, 22 nt, Human
ucgugcccagccugccaccaca

SEQ ID NO: 576575 - RNA, 18 nt, Human
ucuagaaggacuauucau

SEQ ID NO: 576576 - RNA, 24 nt, Human
ucuccugccucagccuccugagua

SEQ ID NO: 576577 - RNA, 22 nt, Human
ucucuagaauauagaaucucug

SEQ ID NO: 576578 - RNA, 23 nt, Human
ucuugcuuugucacccaggcugg

SEQ ID NO: 576579 - RNA, 24 nt, Human
ucuugcuuugucacccaggcugga

SEQ ID NO: 576580 - RNA, 22 nt, Human
ugaauuuauuaaguaacaauuc

SEQ ID NO: 576581 - RNA, 24 nt, Human
ugaggaacagguaucuuguguuau

SEQ ID NO: 576582 - RNA, 20 nt, Human
ugauucuccugccucagccu

SEQ ID NO: 576583 - RNA, 24 nt, Human
ugcagugcaguggcaugaucucgg

SEQ ID NO: 576584 - RNA, 25 nt, Human
ugcagugcaguggcaugaucucggg

SEQ ID NO: 576585 - RNA, 24 nt, Human
ugccucagccuccugaguagcugg

SEQ ID NO: 576586 - RNA, 20 nt, Human
ugcucaaaguuccucuucca

SEQ ID NO: 576587 - RNA, 23 nt, Human
ugcucagcgcucagaagccaaua

SEQ ID NO: 576588 - RNA, 24 nt, Human
ugcugggauuacaggugugagcca

SEQ ID NO: 576589 - RNA, 24 nt, Human
ugcuuugucacccaggcuggagug

SEQ ID NO: 576590 - RNA, 25 nt, Human
uggagugcagugcaguggcaugauc

SEQ ID NO: 576591 - RNA, 28 nt, Human
uggagugcagugcaguggcaugaucucg

SEQ ID NO: 576592 - RNA, 21 nt, Human
ugggacuacagaugcccgcca

SEQ ID NO: 576593 - RNA, 22 nt, Human
ugggacuacagaugcccgccac

SEQ ID NO: 576594 - RNA, 24 nt, Human
ugggacuacagaugcccgccacua

SEQ ID NO: 576595 - RNA, 18 nt, Human
ugggauuacaggugugag

SEQ ID NO: 576596 - RNA, 19 nt, Human
ugggauuacaggugugagc

SEQ ID NO: 576597 - RNA, 21 nt, Human
ugggauuacaggugugagcca

SEQ ID NO: 576598 - RNA, 22 nt, Human
ugggauuacaggugugagccac

SEQ ID NO: 576599 - RNA, 22 nt, Human
ugggauuacaggugugagccac

SEQ ID NO: 576600 - RNA, 24 nt, Human
ugggauuacaggugugagccacug

SEQ ID NO: 576601 - RNA, 23 nt, Human
uuaaaaaguaauuccauggaaug

SEQ ID NO: 576602 - RNA, 22 nt, Human
uuaacaagaaccuaauuacaag

SEQ ID NO: 576603 - RNA, 18 nt, Human
uuaguagagacgggguuu

SEQ ID NO: 576604 - RNA, 22 nt, Human
uuaguagagacgggguuucacc

SEQ ID NO: 576605 - RNA, 24 nt, Human
uuaguagagacgggguuucaccau

SEQ ID NO: 576606 - RNA, 21 nt, Human
uucaagugauucuccugccuc

SEQ ID NO: 576607 - RNA, 23 nt, Human
uucaagugauucuccugccucag

SEQ ID NO: 576608 - RNA, 24 nt, Human
uucaagugauucuccugccucagc

SEQ ID NO: 576609 - RNA, 26 nt, Human
uucuagaucuucugaccucaugaucc

SEQ ID NO: 576610 - RNA, 21 nt, Human
uugccaugcgcauccccucuu

SEQ ID NO: 576611 - RNA, 24 nt, Human
uugcuuugucacccaggcuggagu

SEQ ID NO: 576612 - RNA, 23 nt, Human
uuguauuuuuaguagagacgggg

SEQ ID NO: 576613 - RNA, 19 nt, Human
uuguguuauuguagaagua

SEQ ID NO: 576614 - RNA, 21 nt, Human
uuucaccauguugaccaggcu

SEQ ID NO: 576615 - RNA, 24 nt, Human
uuugucacccaggcuggagugcag

SEQ ID NO: 576616 - RNA, 21 nt, Human
uuuuguauuuuuaguagagac

SEQ ID NO: 576617 - RNA, 24 nt, Human
uuuuuaguagagacgggguuucac

SEQ ID NO: 576618 - RNA, 20 nt, Human
uuuuuguauuuuuaguagag

SEQ ID NO: 576619 - RNA, 18 nt, Human
uuuuuuuuuuuuuuuuug

SEQ ID NO: 576620 - RNA, 20 nt, Human
uuuuuuuuuuuuuuuuugcu

SEQ ID NO: 576621 - RNA, 23 nt, Human
uuuuuuuuuuuuuuuuuugcuaa

SEQ ID NO: 576622 - RNA, 23 nt, Human
aaaaauuaaaacaacacugaacu

SEQ ID NO: 576623 - RNA, 23 nt, Human
aagcaaagaggagaaagaaaaca

SEQ ID NO: 576624 - RNA, 22 nt, Human
aagccugcuggcuggcaccugg

SEQ ID NO: 576625 - RNA, 24 nt, Human
agaacaaguacucccuauauucuu

SEQ ID NO: 576626 - RNA, 21 nt, Human
agcccaguucugcggucaagu

SEQ ID NO: 576627 - RNA, 24 nt, Human
aggagcugggaacaaaagguacca

SEQ ID NO: 576628 - RNA, 22 nt, Human
caaagcggaaacucccucugcc

SEQ ID NO: 576629 - RNA, 23 nt, Human
cagaauuucagucaacuugacau

SEQ ID NO: 576630 - RNA, 22 nt, Human
cagagaugaauggaagcaaaga

SEQ ID NO: 576631 - RNA, 21 nt, Human
caucaacagcagccaacagag

SEQ ID NO: 576632 - RNA, 21 nt, Human
ccccugggcaaacccaugauc

SEQ ID NO: 576633 - RNA, 23 nt, Human
cccucugccgccgccgccgccgc

SEQ ID NO: 576634 - RNA, 23 nt, Human
ccgccgccgccgccgccgccgcc

SEQ ID NO: 576635 - RNA, 24 nt, Human
ccgccgccgccgccgccgccgccu

SEQ ID NO: 576636 - RNA, 18 nt, Human
ccgccgccgccgccuccg

SEQ ID NO: 576637 - RNA, 19 nt, Human
ccuccgggagacccuggcc

SEQ ID NO: 576638 - RNA, 20 nt, Human
ccuggcccuccggcccccug

SEQ ID NO: 576639 - RNA, 23 nt, Human
ccugggccaccugcuggguacuu

SEQ ID NO: 576640 - RNA, 23 nt, Human
cgccgccgccgccgccgccuccg

SEQ ID NO: 576641 - RNA, 19 nt, Human
cggcccccugggcaaaccc

SEQ ID NO: 576642 - RNA, 26 nt, Human
cgggguggagugcaaagcggaaacuu

SEQ ID NO: 576643 - RNA, 22 nt, Human
cuaaaugccuucuguuuacuga

SEQ ID NO: 576644 - RNA, 22 nt, Human
cucccuauauucuucauaggau

SEQ ID NO: 576645 - RNA, 20 nt, Human
cugcaucucucuacugucgc

SEQ ID NO: 576646 - RNA, 23 nt, Human
gaacaaguacucccuauauucuu

SEQ ID NO: 576647 - RNA, 25 nt, Human
gaugaauggaagcaaagaggagaaa

SEQ ID NO: 576648 - RNA, 21 nt, Human
gcacaaggucuguuuucaauu

SEQ ID NO: 576649 - RNA, 19 nt, Human
gccgccgccgccgccgccg

SEQ ID NO: 576650 - RNA, 23 nt, Human
gccgccgccgccgccgccgccgg

SEQ ID NO: 576651 - RNA, 20 nt, Human
gcugucaccaccaagccugc

SEQ ID NO: 576652 - RNA, 24 nt, Human
ggagacccuggcccuccggccccc

SEQ ID NO: 576653 - RNA, 21 nt, Human
gggaacaaaagguaccauggc

SEQ ID NO: 576654 - RNA, 18 nt, Human
gggaagguauaauuuuua

SEQ ID NO: 576655 - RNA, 24 nt, Human
gggagacccuggcccuccggcccc

SEQ ID NO: 576656 - RNA, 22 nt, Human
uaaaaucaaugacauacagcca

SEQ ID NO: 576657 - RNA, 18 nt, Human
uaaggcgagagcgaagcc

SEQ ID NO: 576658 - RNA, 19 nt, Human
uaaggcgagagcgaagccc

SEQ ID NO: 576659 - RNA, 19 nt, Human
uacuugugcaguaggaacu

SEQ ID NO: 576660 - RNA, 19 nt, Human
ucaaagggugauaagccuu

SEQ ID NO: 576661 - RNA, 23 nt, Human
ucaacagagaacaaguacucccu

SEQ ID NO: 576662 - RNA, 20 nt, Human
ucaacagcagccaacagaga

SEQ ID NO: 576663 - RNA, 21 nt, Human
ucagaguccauacaaauacag

SEQ ID NO: 576664 - RNA, 27 nt, Human
uccaucaacagcagccaacagagauga

SEQ ID NO: 576665 - RNA, 21 nt, Human
ucccucugccgccgccgccgc

SEQ ID NO: 576666 - RNA, 18 nt, Human
uccgggagacccuggccc

SEQ ID NO: 576667 - RNA, 18 nt, Human
uccucagcacaaggucug

SEQ ID NO: 576668 - RNA, 23 nt, Human
ucuuggauagcccaguucugcgg

SEQ ID NO: 576669 - RNA, 23 nt, Human
ugaaaaacaucuuggauagccca

SEQ ID NO: 576670 - RNA, 18 nt, Human
ugaaaugcccagcugcaa

SEQ ID NO: 576671 - RNA, 18 nt, Human
ugaaaugcccagcugcaa

SEQ ID NO: 576672 - RNA, 18 nt, Human
ugaauggaagcaaagagg

SEQ ID NO: 576673 - RNA, 20 nt, Human
ugcccugaaaugcccagcug

SEQ ID NO: 576674 - RNA, 22 nt, Human
ugccgcggagcugcuaccgggg

SEQ ID NO: 576675 - RNA, 25 nt, Human
ugcggucaagugugcuguaucugcc

SEQ ID NO: 576676 - RNA, 18 nt, Human
ugcuggguacuugugcag

SEQ ID NO: 576677 - RNA, 18 nt, Human
ugcuguaucugccucccu

SEQ ID NO: 576678 - RNA, 18 nt, Human
uggcaccuggaggagcug

SEQ ID NO: 576679 - RNA, 20 nt, Human
uggcaccuggaggagcuggg

SEQ ID NO: 576680 - RNA, 19 nt, Human
uugcugaacuaauacuugc

SEQ ID NO: 576681 - RNA, 21 nt, Human
uuuacugucugacuccaucaa

SEQ ID NO: 576682 - RNA, 20 nt, Human
uuucagucaacuugacauuu

SEQ ID NO: 576683 - RNA, 26 nt, Human
uuuccaccuccgggagacccuggccc

SEQ ID NO: 576684 - RNA, 18 nt, Human
uuuuuuuuuuuguagggg

SEQ ID NO: 576685 - RNA, 19 nt, Human
uuuuuuuuuuuuguagggg

SEQ ID NO: 576686 - RNA, 19 nt, Human
uuuuuuuuuuuuuuguagg

SEQ ID NO: 576687 - RNA, 22 nt, Human
uuuuuuuuuuuuuuuuguaggg

SEQ ID NO: 576688 - RNA, 24 nt, Human
aacugguacuuugggaguuuuaua

SEQ ID NO: 576689 - RNA, 25 nt, Human
aagccagcacaucucugugacaggg

SEQ ID NO: 576690 - RNA, 19 nt, Human
aagguguuguguucuugug

SEQ ID NO: 576691 - RNA, 19 nt, Human
aagugcuucugcauuacag

SEQ ID NO: 576692 - RNA, 23 nt, Human
accagccccccucccacacacac

SEQ ID NO: 576693 - RNA, 19 nt, Human
agcaggaucugaugaaacu

SEQ ID NO: 576694 - RNA, 20 nt, Human
aggcauuugccacaucuuaa

SEQ ID NO: 576695 - RNA, 19 nt, Human
aucugaaucaaauccaaag

SEQ ID NO: 576696 - RNA, 21 nt, Human
auuaaucaucauaaacuguaa

SEQ ID NO: 576697 - RNA, 18 nt, Human
auuucuuuugugcaagau

SEQ ID NO: 576698 - RNA, 20 nt, Human
caagguguuguguucuugug

SEQ ID NO: 576699 - RNA, 23 nt, Human
cacacuuuuuaauaauggguuaa

SEQ ID NO: 576700 - RNA, 20 nt, Human
cacugauuuuuuauacacgu

SEQ ID NO: 576701 - RNA, 20 nt, Human
cagccccccucccacacaca

SEQ ID NO: 576702 - RNA, 21 nt, Human
cagucagaaauuuucugcguu

SEQ ID NO: 576703 - RNA, 20 nt, Human
ccauucugaacuaaacuguc

SEQ ID NO: 576704 - RNA, 19 nt, Human
cugcugcuauuaaucauca

SEQ ID NO: 576705 - RNA, 22 nt, Human
cugguacuuugggaguuuuaua

SEQ ID NO: 576706 - RNA, 23 nt, Human
cuugaucagaacaggcaucuacu

SEQ ID NO: 576707 - RNA, 23 nt, Human
gcaaaauggaaccauuuucuguc

SEQ ID NO: 576708 - RNA, 23 nt, Human
gcaaaauggaaccauuuucuguc

SEQ ID NO: 576709 - RNA, 18 nt, Human
gccccccucccacacaca

SEQ ID NO: 576710 - RNA, 21 nt, Human
gcuuugucuuuaucuuuagua

SEQ ID NO: 576711 - RNA, 18 nt, Human
ggaucugaugaaacuaaa

SEQ ID NO: 576712 - RNA, 20 nt, Human
gguggucaggcauuugccac

SEQ ID NO: 576713 - RNA, 19 nt, Human
gguuuggaaggugccugag

SEQ ID NO: 576714 - RNA, 18 nt, Human
uaaaccagccccccuccc

SEQ ID NO: 576715 - RNA, 21 nt, Human
uaagcgaaacugaacaugcug

SEQ ID NO: 576716 - RNA, 21 nt, Human
uacaacacugggcaaaaugga

SEQ ID NO: 576717 - RNA, 22 nt, Human
uacaaugugaccaccuaaaaau

SEQ ID NO: 576718 - RNA, 28 nt, Human
uagaugagucuuuuuccugauuaggauu

SEQ ID NO: 576719 - RNA, 21 nt, Human
uauuguaaaccagccccccuc

SEQ ID NO: 576720 - RNA, 23 nt, Human
ucauucuagaaaaugugcuuugu

SEQ ID NO: 576721 - RNA, 21 nt, Human
ucuaaaauuaaggccaucagg

SEQ ID NO: 576722 - RNA, 24 nt, Human
ucucugugaguucauucuagaaaa

SEQ ID NO: 576723 - RNA, 22 nt, Human
ucugaacuaaacugucuguuuu

SEQ ID NO: 576724 - RNA, 20 nt, Human
ucuggaaaacugguacuuug

SEQ ID NO: 576725 - RNA, 24 nt, Human
ucuugaucagaacaggccgggguc

SEQ ID NO: 576726 - RNA, 20 nt, Human
ugaaacagugucaucagaac

SEQ ID NO: 576727 - RNA, 22 nt, Human
ugaugcauuuucuuauagugcu

SEQ ID NO: 576728 - RNA, 18 nt, Human
ugcuugauugacagaucu

SEQ ID NO: 576729 - RNA, 21 nt, Human
uggaaaacugguacuuuggga

SEQ ID NO: 576730 - RNA, 19 nt, Human
uggaaccauuuucuguccu

SEQ ID NO: 576731 - RNA, 19 nt, Human
uggaaggugccugagauac

SEQ ID NO: 576732 - RNA, 20 nt, Human
ugggaggcaauggucugacg

SEQ ID NO: 576733 - RNA, 21 nt, Human
ugggaggcaauggucugacgu

SEQ ID NO: 576734 - RNA, 25 nt, Human
uggucaggcauuugccacaucuuaa

SEQ ID NO: 576735 - RNA, 23 nt, Human
ugugguacaacacugggcaaaau

SEQ ID NO: 576736 - RNA, 25 nt, Human
uuaaucaucauaaacuguaaaaugu

SEQ ID NO: 576737 - RNA, 18 nt, Human
uucacacuacugcuugau

SEQ ID NO: 576738 - RNA, 25 nt, Human
uucucauauaagcgaaacugaacau

SEQ ID NO: 576739 - RNA, 23 nt, Human
uuucuggaaaacugguacuuugg

SEQ ID NO: 576740 - RNA, 22 nt, Human
uuuucacacuacugcuugauug

SEQ ID NO: 576741 - RNA, 19 nt, Human
uuuucccuuucuguaaggc

SEQ ID NO: 576742 - RNA, 23 nt, Human
aaaaaaaauucuuuuaauuaaaa

SEQ ID NO: 576743 - RNA, 24 nt, Human
acagagcgagacuuugucucaaaa

SEQ ID NO: 576744 - RNA, 19 nt, Human
acccaggcuggagugcaau

SEQ ID NO: 576745 - RNA, 24 nt, Human
acugcaauccugcuugggugacag

SEQ ID NO: 576746 - RNA, 24 nt, Human
acugucacccaggcuggagugcaa

SEQ ID NO: 576747 - RNA, 23 nt, Human
acuuccuguggaguucauaaaaa

SEQ ID NO: 576748 - RNA, 24 nt, Human
agugcaauggagcgaucuuggcuc

SEQ ID NO: 576749 - RNA, 23 nt, Human
augacagacauacuuuuauucuu

SEQ ID NO: 576750 - RNA, 21 nt, Human
auuaaaaaaaaaaaaaaagcu

SEQ ID NO: 576751 - RNA, 25 nt, Human
cacccaggcuggagugcaauggagc

SEQ ID NO: 576752 - RNA, 23 nt, Human
cacugcaauccugcuugggugac

SEQ ID NO: 576753 - RNA, 23 nt, Human
cccaggcuggagugcaauggagc

SEQ ID NO: 576754 - RNA, 21 nt, Human
gacagacauacuuuuauucuu

SEQ ID NO: 576755 - RNA, 24 nt, Human
gacagagcgagacuuugucucaaa

SEQ ID NO: 576756 - RNA, 18 nt, Human
gagauggaguuucacugu

SEQ ID NO: 576757 - RNA, 20 nt, Human
ggaguuucacugucacccag

SEQ ID NO: 576758 - RNA, 21 nt, Human
ggaguuucacugucacccagg

SEQ ID NO: 576759 - RNA, 24 nt, Human
gugacagagcgagacuuugucuca

SEQ ID NO: 576760 - RNA, 23 nt, Human
guuucacugucacccaggcugga

SEQ ID NO: 576761 - RNA, 22 nt, Human
uaaaaaaaaaaaaaaagcuuua

SEQ ID NO: 576762 - RNA, 25 nt, Human
uacuuuuauucuuuuauuuuugaga

SEQ ID NO: 576763 - RNA, 23 nt, Human
uaggagcuggaugacagacauac

SEQ ID NO: 576764 - RNA, 23 nt, Human
uauggguugcgacugccccucgu

SEQ ID NO: 576765 - RNA, 18 nt, Human
ucacccaggcuggagugc

SEQ ID NO: 576766 - RNA, 19 nt, Human
ucacugcaauccugcuugg

SEQ ID NO: 576767 - RNA, 24 nt, Human
ucacugcaauccugcuugggugac

SEQ ID NO: 576768 - RNA, 20 nt, Human
ucacugucacccaggcugga

SEQ ID NO: 576769 - RNA, 22 nt, Human
ucacugucacccaggcuggagu

SEQ ID NO: 576770 - RNA, 23 nt, Human
ucacugucacccaggcuggagug

SEQ ID NO: 576771 - RNA, 18 nt, Human
uccugcuugggugacaga

SEQ ID NO: 576772 - RNA, 21 nt, Human
uccugcuugggugacagagcg

SEQ ID NO: 576773 - RNA, 24 nt, Human
uccugcuugggugacagagcgaga

SEQ ID NO: 576774 - RNA, 24 nt, Human
ucuuuuauuuuugagauggaguuu

SEQ ID NO: 576775 - RNA, 26 nt, Human
ugaaaauguugauauacacaagcugu

SEQ ID NO: 576776 - RNA, 23 nt, Human
ugcuugggugacagagcgagacu

SEQ ID NO: 576777 - RNA, 24 nt, Human
ugcuugggugacagagcgagacuu

SEQ ID NO: 576778 - RNA, 23 nt, Human
uggagugcaauggagcgaucuug

SEQ ID NO: 576779 - RNA, 24 nt, Human
uggagugcaauggagcgaucuugg

SEQ ID NO: 576780 - RNA, 22 nt, Human
uggaguuucacugucacccagg

SEQ ID NO: 576781 - RNA, 19 nt, Human
ugggugacagagcgagacu

SEQ ID NO: 576782 - RNA, 20 nt, Human
ugucacccaggcuggagugc

SEQ ID NO: 576783 - RNA, 19 nt, Human
uguugauauacacaagcug

SEQ ID NO: 576784 - RNA, 26 nt, Human
uuaauuaaaaaaaaaaaaaaagcuuu

SEQ ID NO: 576785 - RNA, 19 nt, Human
uuucacugucacccaggcu

SEQ ID NO: 576786 - RNA, 22 nt, Human
uuucacugucacccaggcugga

SEQ ID NO: 576787 - RNA, 20 nt, Human
uuuuuuuuuuuuuuuuccau

SEQ ID NO: 576788 - RNA, 25 nt, Human
uuuuuuuuuuuuuuuuuuuccaugg

SEQ ID NO: 576789 - RNA, 24 nt, Human
aagugcuagaaaauacacacaauu

SEQ ID NO: 576790 - RNA, 21 nt, Human
aauauaugaauaaaucacugc

SEQ ID NO: 576791 - RNA, 24 nt, Human
aaucacucccuccccacccuccug

SEQ ID NO: 576792 - RNA, 21 nt, Human
aaugucagacuccagaaagga

SEQ ID NO: 576793 - RNA, 22 nt, Human
acuccuggaccucugggguugg

SEQ ID NO: 576794 - RNA, 18 nt, Human
acugcccucugccggggg

SEQ ID NO: 576795 - RNA, 22 nt, Human
agaaaggaggaguggaagggaa

SEQ ID NO: 576796 - RNA, 21 nt, Human
agacuccagaaaggaggagug

SEQ ID NO: 576797 - RNA, 20 nt, Human
agaugcaguccugagcugga

SEQ ID NO: 576798 - RNA, 19 nt, Human
agccuggaagucuggcccc

SEQ ID NO: 576799 - RNA, 21 nt, Human
agcugcaugguuuagggaguc

SEQ ID NO: 576800 - RNA, 22 nt, Human
aggaggaguggaagggaaaugg

SEQ ID NO: 576801 - RNA, 22 nt, Human
aggugcagagaccacaggaaca

SEQ ID NO: 576802 - RNA, 20 nt, Human
agucuuugggagccuuggaa

SEQ ID NO: 576803 - RNA, 18 nt, Human
agugcuagaaaauacaca

SEQ ID NO: 576804 - RNA, 18 nt, Human
augucuuuccaaguucug

SEQ ID NO: 576805 - RNA, 18 nt, Human
cacaggggccccaccucc

SEQ ID NO: 576806 - RNA, 21 nt, Human
cacucccuccccacccuccug

SEQ ID NO: 576807 - RNA, 19 nt, Human
cagaugcaguccugagcug

SEQ ID NO: 576808 - RNA, 19 nt, Human
caggcagaugcaguccuga

SEQ ID NO: 576809 - RNA, 19 nt, Human
caggugcccuggcugcccu

SEQ ID NO: 576810 - RNA, 21 nt, Human
caguccugagcuggugccccc

SEQ ID NO: 576811 - RNA, 22 nt, Human
ccaauacacaagugcuagaaaa

SEQ ID NO: 576812 - RNA, 21 nt, Human
ccccacccuccugaagcuaga

SEQ ID NO: 576813 - RNA, 26 nt, Human
cccccuugccuucgcagucgugccua

SEQ ID NO: 576814 - RNA, 24 nt, Human
cccuggcugcccuugcugccccuc

SEQ ID NO: 576815 - RNA, 26 nt, Human
ccuccccacccuccugaagcuagagg

SEQ ID NO: 576816 - RNA, 18 nt, Human
ccucuuugacacaggggc

SEQ ID NO: 576817 - RNA, 21 nt, Human
cgccucugcccugucuggcuu

SEQ ID NO: 576818 - RNA, 19 nt, Human
cuaaugucuuuccaaguuc

SEQ ID NO: 576819 - RNA, 20 nt, Human
cuagaggaagauuugcucag

SEQ ID NO: 576820 - RNA, 26 nt, Human
cuaugguuggaacugaaccggggucc

SEQ ID NO: 576821 - RNA, 21 nt, Human
cuccccacccuccugaagcua

SEQ ID NO: 576822 - RNA, 22 nt, Human
cucccuccccacccuccugaag

SEQ ID NO: 576823 - RNA, 24 nt, Human
cuggagcuggagaucagcguuagc

SEQ ID NO: 576824 - RNA, 25 nt, Human
gaacugaacccuugcaaucacguaa

SEQ ID NO: 576825 - RNA, 23 nt, Human
gacagaaaggaggugcagagacc

SEQ ID NO: 576826 - RNA, 26 nt, Human
gaccacaggaacacucaugaaaagga

SEQ ID NO: 576827 - RNA, 21 nt, Human
gagaucacuccuggaccucug

SEQ ID NO: 576828 - RNA, 23 nt, Human
gcagaugcaguccugagcuggug

SEQ ID NO: 576829 - RNA, 20 nt, Human
guaaguucuuugcuagguuu

SEQ ID NO: 576830 - RNA, 19 nt, Human
guccagggaagcuuugaag

SEQ ID NO: 576831 - RNA, 21 nt, Human
guggaggguggcagcguuugu

SEQ ID NO: 576832 - RNA, 26 nt, Human
guggaggguggcagcguuuguuugug

SEQ ID NO: 576833 - RNA, 22 nt, Human
guugggaaguggaggguggcag

SEQ ID NO: 576834 - RNA, 21 nt, Human
ucagagaucacuccuggaccu

SEQ ID NO: 576835 - RNA, 22 nt, Human
uccagggucucaucaugggagu

SEQ ID NO: 576836 - RNA, 21 nt, Human
uccccagagacacugaggugc

SEQ ID NO: 576837 - RNA, 19 nt, Human
uccucuguaguggguucca

SEQ ID NO: 576838 - RNA, 18 nt, Human
ucugccucuguuuucagu

SEQ ID NO: 576839 - RNA, 19 nt, Human
ucuuugggagccuuggaag

SEQ ID NO: 576840 - RNA, 21 nt, Human
ucuuugggagccuuggaaguc

SEQ ID NO: 576841 - RNA, 18 nt, Human
ugacaaugagcugcaugg

SEQ ID NO: 576842 - RNA, 22 nt, Human
ugagcugcaugguuuagggagu

SEQ ID NO: 576843 - RNA, 19 nt, Human
ugaguggaagcuccuuaac

SEQ ID NO: 576844 - RNA, 19 nt, Human
uggugggcugaguggaagc

SEQ ID NO: 576845 - RNA, 19 nt, Human
uguaaaaugagauggcuga

SEQ ID NO: 576846 - RNA, 19 nt, Human
uguccugucuuuguugagu

SEQ ID NO: 576847 - RNA, 18 nt, Human
uguggcuuuggacaggaa

SEQ ID NO: 576848 - RNA, 18 nt, Human
uuccagugauggcuuaug

SEQ ID NO: 576849 - RNA, 25 nt, Human
aagacucuuuccauuucaaggcacc

SEQ ID NO: 576850 - RNA, 20 nt, Human
acagagcaagacucuuucca

SEQ ID NO: 576851 - RNA, 24 nt, Human
acagcacuccagucugggcgacag

SEQ ID NO: 576852 - RNA, 26 nt, Human
acagcacuccagucugggcgacagag

SEQ ID NO: 576853 - RNA, 24 nt, Human
acccaggagguagagguugcagug

SEQ ID NO: 576854 - RNA, 24 nt, Human
acguacaguucggucaucuggagg

SEQ ID NO: 576855 - RNA, 24 nt, Human
agagguugcagugagccgagaucg

SEQ ID NO: 576856 - RNA, 23 nt, Human
aggcaaaaaccguggucugagca

SEQ ID NO: 576857 - RNA, 18 nt, Human
aggcaggagaacugcuug

SEQ ID NO: 576858 - RNA, 24 nt, Human
aggcaggagaacugcuugaaccca

SEQ ID NO: 576859 - RNA, 24 nt, Human
aggcugaggcaggagaacugcuug

SEQ ID NO: 576860 - RNA, 24 nt, Human
agguagagguugcagugagccgag

SEQ ID NO: 576861 - RNA, 24 nt, Human
agucugggcgacagagcaagacuc

SEQ ID NO: 576862 - RNA, 22 nt, Human
agucuguaaucccagcugcucg

SEQ ID NO: 576863 - RNA, 24 nt, Human
aucgcgccacagcacuccagucug

SEQ ID NO: 576864 - RNA, 23 nt, Human
auuuucacuguugcccaacugac

SEQ ID NO: 576865 - RNA, 22 nt, Human
caauccugcugucaacauuagc

SEQ ID NO: 576866 - RNA, 24 nt, Human
cacagcacuccagucugggcgaca

SEQ ID NO: 576867 - RNA, 21 nt, Human
caccuguuacacaguuuuuca

SEQ ID NO: 576868 - RNA, 23 nt, Human
cacuccagucugggcgacagagc

SEQ ID NO: 576869 - RNA, 18 nt, Human
caggcaagccaccugcau

SEQ ID NO: 576870 - RNA, 18 nt, Human
cauugcccugaguugcag

SEQ ID NO: 576871 - RNA, 20 nt, Human
ccacagcacuccagucuggg

SEQ ID NO: 576872 - RNA, 21 nt, Human
ccacagcacuccagucugggc

SEQ ID NO: 576873 - RNA, 24 nt, Human
ccacagcacuccagucugggcgac

SEQ ID NO: 576874 - RNA, 21 nt, Human
cccuagagcuuuuuuccaccu

SEQ ID NO: 576875 - RNA, 21 nt, Human
ccuagagcuuuuuuccaccuc

SEQ ID NO: 576876 - RNA, 18 nt, Human
ccugcugucaacauuagc

SEQ ID NO: 576877 - RNA, 20 nt, Human
cgcuaggcugaggcaggaga

SEQ ID NO: 576878 - RNA, 19 nt, Human
cguguaccauugcccugag

SEQ ID NO: 576879 - RNA, 21 nt, Human
cucuggggaucggacugugga

SEQ ID NO: 576880 - RNA, 22 nt, Human
cugaacucuguguccccagugg

SEQ ID NO: 576881 - RNA, 21 nt, Human
cugggcgacagagcaagacuc

SEQ ID NO: 576882 - RNA, 18 nt, Human
gacuguggacugacgagg

SEQ ID NO: 576883 - RNA, 23 nt, Human
gagaucgcgccacagcacuccag

SEQ ID NO: 576884 - RNA, 24 nt, Human
gcacuccagucugggcgacagagc

SEQ ID NO: 576885 - RNA, 22 nt, Human
gcaggagaacugcuugaaccca

SEQ ID NO: 576886 - RNA, 22 nt, Human
gccacagcacuccagucugggc

SEQ ID NO: 576887 - RNA, 24 nt, Human
gccacagcacuccagucugggcga

SEQ ID NO: 576888 - RNA, 22 nt, Human
ggagaacugcuugaacccagga

SEQ ID NO: 576889 - RNA, 18 nt, Human
ggaggaagacaacgugcu

SEQ ID NO: 576890 - RNA, 19 nt, Human
ggaggcaggagcgcuuucc

SEQ ID NO: 576891 - RNA, 22 nt, Human
ggagguagagguugcagugagc

SEQ ID NO: 576892 - RNA, 20 nt, Human
ggcaauggcggugagagccc

SEQ ID NO: 576893 - RNA, 22 nt, Human
gggaauccuuuauuucccgguu

SEQ ID NO: 576894 - RNA, 19 nt, Human
gugccacuggugaggagga

SEQ ID NO: 576895 - RNA, 18 nt, Human
guguaccauugcccugag

SEQ ID NO: 576896 - RNA, 23 nt, Human
guuaccaccagggaucucugacu

SEQ ID NO: 576897 - RNA, 19 nt, Human
guugcagugagccgagauc

SEQ ID NO: 576898 - RNA, 21 nt, Human
guugcagugagccgagaucgc

SEQ ID NO: 576899 - RNA, 18 nt, Human
ucaccuucacguacaguu

SEQ ID NO: 576900 - RNA, 20 nt, Human
ucagaaaaccauauucgcag

SEQ ID NO: 576901 - RNA, 24 nt, Human
uccagucugggcgacagagcaaga

SEQ ID NO: 576902 - RNA, 22 nt, Human
ucccggaauaaccuuuuggcuc

SEQ ID NO: 576903 - RNA, 24 nt, Human
ucuauaagccaggcucuggggcag

SEQ ID NO: 576904 - RNA, 21 nt, Human
ucuccagcuuuuucagcuggg

SEQ ID NO: 576905 - RNA, 22 nt, Human
ucucuggggaucggacugugga

SEQ ID NO: 576906 - RNA, 23 nt, Human
ucuguaaucccagcugcucgcua

SEQ ID NO: 576907 - RNA, 23 nt, Human
ugaccagucucaugugccacugg

SEQ ID NO: 576908 - RNA, 22 nt, Human
ugagccgagaucgcgccacagc

SEQ ID NO: 576909 - RNA, 24 nt, Human
ugaggcaggagaacugcuugaacc

SEQ ID NO: 576910 - RNA, 25 nt, Human
ugaggcaggagaacugcuugaaccc

SEQ ID NO: 576911 - RNA, 24 nt, Human
ugcagcagauacucauuaguuacc

SEQ ID NO: 576912 - RNA, 22 nt, Human
uggcauagacauaacuaguagu

SEQ ID NO: 576913 - RNA, 23 nt, Human
uggcauagacauaacuaguaguu

SEQ ID NO: 576914 - RNA, 21 nt, Human
ugguggcaauggcggugagag

SEQ ID NO: 576915 - RNA, 18 nt, Human
ugucuucucccuagagcu

SEQ ID NO: 576916 - RNA, 25 nt, Human
uucccgguuggggaagggggguucc

SEQ ID NO: 576917 - RNA, 18 nt, Human
uugcagugagccgagauc

SEQ ID NO: 576918 - RNA, 19 nt, Human
uugcagugagccgagaucg

SEQ ID NO: 576919 - RNA, 22 nt, Human
uugcagugagccgagaucgcgc

SEQ ID NO: 576920 - RNA, 21 nt, Human
uugcccaacugacuaaaaugc

SEQ ID NO: 576921 - RNA, 24 nt, Human
uuucccggaauaaccuuuuggcuc

SEQ ID NO: 576922 - RNA, 22 nt, Human
uuuuucagcugggcaagcuccu

SEQ ID NO: 576923 - RNA, 23 nt, Human
aaaagaaacaagauugcaaacaa

SEQ ID NO: 576924 - RNA, 25 nt, Human
aaaagaaacaagauugcaaacaaaa

SEQ ID NO: 576925 - RNA, 18 nt, Human
aaaagaacuuaguuguag

SEQ ID NO: 576926 - RNA, 18 nt, Human
aaaaggaaguagucuuca

SEQ ID NO: 576927 - RNA, 18 nt, Human
aaacagauuuugcauaug

SEQ ID NO: 576928 - RNA, 18 nt, Human
aacaacaaaacaaaaccc

SEQ ID NO: 576929 - RNA, 30 nt, Human
aacaacaaaacaaaacccuccaggaaaaaa

SEQ ID NO: 576930 - RNA, 21 nt, Human
aacaacaacaaaacaaaaccc

SEQ ID NO: 576931 - RNA, 19 nt, Human
aacaagauugcaaacaaaa

SEQ ID NO: 576932 - RNA, 29 nt, Human
aacaauuuuuuuuuucuauaggggggccc

SEQ ID NO: 576933 - RNA, 27 nt, Human
aagaaacaagauugcaaacaaaaaugu

SEQ ID NO: 576934 - RNA, 19 nt, Human
aagagcuuaaaaaaauaaa

SEQ ID NO: 576935 - RNA, 24 nt, Human
aagcaaagucuuuucaacaacaac

SEQ ID NO: 576936 - RNA, 26 nt, Human
acaaaacaaaacccuccaggaaaaac

SEQ ID NO: 576937 - RNA, 27 nt, Human
acaaaacaaaacccuccaggaaaaacu

SEQ ID NO: 576938 - RNA, 19 nt, Human
acaacaacaaaacaaaacc

SEQ ID NO: 576939 - RNA, 20 nt, Human
acaacauguacaaagcuaca

SEQ ID NO: 576940 - RNA, 22 nt, Human
acaauacaugaggaccuggagc

SEQ ID NO: 576941 - RNA, 23 nt, Human
accuuuacuucagagauugagga

SEQ ID NO: 576942 - RNA, 23 nt, Human
caaaacaaaacccuccaggaaaa

SEQ ID NO: 576943 - RNA, 21 nt, Human
caacaaaacaaaacccuccag

SEQ ID NO: 576944 - RNA, 23 nt, Human
caacaaaacaaaacccuccagga

SEQ ID NO: 576945 - RNA, 24 nt, Human
caacaacaaaacaaaacccuccag

SEQ ID NO: 576946 - RNA, 22 nt, Human
caacaacaacaaaacaaaaccc

SEQ ID NO: 576947 - RNA, 21 nt, Human
cacaauacaugaggaccugga

SEQ ID NO: 576948 - RNA, 20 nt, Human
caggaaaaacuauauggcug

SEQ ID NO: 576949 - RNA, 19 nt, Human
caguaggacuaucuucugc

SEQ ID NO: 576950 - RNA, 20 nt, Human
caguaggacuaucuucugcu

SEQ ID NO: 576951 - RNA, 25 nt, Human
caugcgcccagaaugcacacggugu

SEQ ID NO: 576952 - RNA, 27 nt, Human
ccagaaugcacacgaguaaaaaugcag

SEQ ID NO: 576953 - RNA, 20 nt, Human
cgcccagaaugcacacgagu

SEQ ID NO: 576954 - RNA, 23 nt, Human
cucacaaguaaagaaaauuuaca

SEQ ID NO: 576955 - RNA, 26 nt, Human
cucucugccaauguuacuugaaaauc

SEQ ID NO: 576956 - RNA, 24 nt, Human
gaaaaaaucuuuaauguacaaaua

SEQ ID NO: 576957 - RNA, 26 nt, Human
gaaaaucuuccaugucaaaacaacuu

SEQ ID NO: 576958 - RNA, 18 nt, Human
gcucauuuucucaguagg

SEQ ID NO: 576959 - RNA, 19 nt, Human
guaccaaaaccgccaagga

SEQ ID NO: 576960 - RNA, 23 nt, Human
gucuacccaccccugaguucagc

SEQ ID NO: 576961 - RNA, 22 nt, Human
uaaaaagaacuuaguuguagua

SEQ ID NO: 576962 - RNA, 26 nt, Human
uaaagaaaauuuacaagaaaaaacuu

SEQ ID NO: 576963 - RNA, 22 nt, Human
uaacaaaagaaacaagauugca

SEQ ID NO: 576964 - RNA, 25 nt, Human
uaacaaaaguuucaauaaaaguauu

SEQ ID NO: 576965 - RNA, 18 nt, Human
uaaccuuaggaucacagu

SEQ ID NO: 576966 - RNA, 19 nt, Human
uacaagaaaaaacuuaaca

SEQ ID NO: 576967 - RNA, 19 nt, Human
uaccaaaaccgccaaggaa

SEQ ID NO: 576968 - RNA, 21 nt, Human
uaccaaaaccgccaaggaagu

SEQ ID NO: 576969 - RNA, 19 nt, Human
uaccuuuacuucagagauu

SEQ ID NO: 576970 - RNA, 21 nt, Human
uacuguaugacuaauaaaagc

SEQ ID NO: 576971 - RNA, 21 nt, Human
uagcaggaaguuaacagagug

SEQ ID NO: 576972 - RNA, 24 nt, Human
uaggaucacagugcauggaaucca

SEQ ID NO: 576973 - RNA, 19 nt, Human
uaguagaaacagauuuugc

SEQ ID NO: 576974 - RNA, 22 nt, Human
uaguagaaacagauuuugcaua

SEQ ID NO: 576975 - RNA, 24 nt, Human
uauaugcccuuaauuaacaacaug

SEQ ID NO: 576976 - RNA, 20 nt, Human
uccaugucaaaacaacuuga

SEQ ID NO: 576977 - RNA, 18 nt, Human
ugagacaaauaagcaacc

SEQ ID NO: 576978 - RNA, 26 nt, Human
ugagacaaauaagcaaccauuugaua

SEQ ID NO: 576979 - RNA, 19 nt, Human
ugaggaacuauauacaaca

SEQ ID NO: 576980 - RNA, 20 nt, Human
ugaguguaaaauuauaugcc

SEQ ID NO: 576981 - RNA, 22 nt, Human
ugauacucacaaguaaagaaaa

SEQ ID NO: 576982 - RNA, 22 nt, Human
ugaucaaagugcucauuuucuc

SEQ ID NO: 576983 - RNA, 26 nt, Human
ugccuggacugaaccagccggggguc

SEQ ID NO: 576984 - RNA, 23 nt, Human
uggaaaaaaucuuuaauguacaa

SEQ ID NO: 576985 - RNA, 22 nt, Human
uggaauccaaauauaaacaguu

SEQ ID NO: 576986 - RNA, 20 nt, Human
uguaaaauuauaugcccuua

SEQ ID NO: 576987 - RNA, 21 nt, Human
uguaaaauuauaugcccuuaa

SEQ ID NO: 576988 - RNA, 22 nt, Human
uguacaaagcuacaaaauguca

SEQ ID NO: 576989 - RNA, 22 nt, Human
uguaguagaaacagauuuugca

SEQ ID NO: 576990 - RNA, 20 nt, Human
uguaguaucauuaacucaca

SEQ ID NO: 576991 - RNA, 18 nt, Human
ugucaaaacaacuugaca

SEQ ID NO: 576992 - RNA, 20 nt, Human
uguuggaucccucacuuuau

SEQ ID NO: 576993 - RNA, 24 nt, Human
uucuauagaaaguuucaucuagcu

SEQ ID NO: 576994 - RNA, 24 nt, Human
uugaaaaucuuccaugucaaaaca

SEQ ID NO: 576995 - RNA, 20 nt, Human
uugaguguaaaauuauaugc

SEQ ID NO: 576996 - RNA, 24 nt, Human
aaagugcugagauuucaggcguga

SEQ ID NO: 576997 - RNA, 23 nt, Human
acaucuuuaaaagaagcugagag

SEQ ID NO: 576998 - RNA, 26 nt, Human
acccuauuccuauauaaacccauccc

SEQ ID NO: 576999 - RNA, 18 nt, Human
agaagcugagagaagagu

SEQ ID NO: 577000 - RNA, 21 nt, Human
aggugcucuauuauugaaaaa

SEQ ID NO: 577001 - RNA, 21 nt, Human
auagccacuccagcuuucuua

SEQ ID NO: 577002 - RNA, 24 nt, Human
caaacccaacacacauuauuauaa

SEQ ID NO: 577003 - RNA, 24 nt, Human
caaagugcugagauuucaggcgug

SEQ ID NO: 577004 - RNA, 24 nt, Human
cagauaaacacuaacuuaauucca

SEQ ID NO: 577005 - RNA, 24 nt, Human
cagggucuugcuguguugcccagg

SEQ ID NO: 577006 - RNA, 23 nt, Human
cauuccuucuuuugcauuauuuc

SEQ ID NO: 577007 - RNA, 26 nt, Human
cauuuuauuguuuuugauaugccuca

SEQ ID NO: 577008 - RNA, 24 nt, Human
ccaaagugcugagauuucaggcgu

SEQ ID NO: 577009 - RNA, 18 nt, Human
cccauguggucagagggc

SEQ ID NO: 577010 - RNA, 19 nt, Human
ccuauauaaacccaucccc

SEQ ID NO: 577011 - RNA, 22 nt, Human
cuucauguauuuugggcucuac

SEQ ID NO: 577012 - RNA, 22 nt, Human
cuugcuguguugcccaggcugg

SEQ ID NO: 577013 - RNA, 25 nt, Human
cuuucaguuuuugcuucauguauuu

SEQ ID NO: 577014 - RNA, 24 nt, Human
cuuuuugcuucuccauuccuucuu

SEQ ID NO: 577015 - RNA, 21 nt, Human
ggaauccucccacuucggccu

SEQ ID NO: 577016 - RNA, 24 nt, Human
gucuugcuguguugcccaggcugg

SEQ ID NO: 577017 - RNA, 23 nt, Human
uaaaagaagcugagagaagagua

SEQ ID NO: 577018 - RNA, 23 nt, Human
uaacuaaacagaauaggcuucag

SEQ ID NO: 577019 - RNA, 20 nt, Human
uacucuuuaucuccaguaac

SEQ ID NO: 577020 - RNA, 19 nt, Human
uaggcuucagauaaacacu

SEQ ID NO: 577021 - RNA, 23 nt, Human
uauauuuguuuuccauccuuuua

SEQ ID NO: 577022 - RNA, 19 nt, Human
ucagauaaacacuaacuua

SEQ ID NO: 577023 - RNA, 19 nt, Human
ucagugguugcucuagggc

SEQ ID NO: 577024 - RNA, 21 nt, Human
ucauuguaacauuuuacucuu

SEQ ID NO: 577025 - RNA, 19 nt, Human
uccaacucuuuuuauggac

SEQ ID NO: 577026 - RNA, 20 nt, Human
uccaacucuuuuuauggacu

SEQ ID NO: 577027 - RNA, 26 nt, Human
uccaaggaauccucccacuucggccu

SEQ ID NO: 577028 - RNA, 20 nt, Human
uccgguauuagaauagccac

SEQ ID NO: 577029 - RNA, 18 nt, Human
ucuugcuguguugcccag

SEQ ID NO: 577030 - RNA, 19 nt, Human
ucuugcuguguugcccagg

SEQ ID NO: 577031 - RNA, 23 nt, Human
ucuugcuguguugcccaggcugg

SEQ ID NO: 577032 - RNA, 24 nt, Human
ucuugcuguguugcccaggcuggu

SEQ ID NO: 577033 - RNA, 21 nt, Human
ugaaguggaaucagacuuguu

SEQ ID NO: 577034 - RNA, 24 nt, Human
ugcccaggcuggucuugaauuccu

SEQ ID NO: 577035 - RNA, 24 nt, Human
ugcuguguugcccaggcuggucuu

SEQ ID NO: 577036 - RNA, 24 nt, Human
uguguugcccaggcuggucuugaa

SEQ ID NO: 577037 - RNA, 19 nt, Human
uguuauuuugauauaggaa

SEQ ID NO: 577038 - RNA, 18 nt, Human
uguugcccaggcuggucu

SEQ ID NO: 577039 - RNA, 22 nt, Human
uguugcccaggcuggucuugaa

SEQ ID NO: 577040 - RNA, 21 nt, Human
uuacaaacccaacacacauua

SEQ ID NO: 577041 - RNA, 22 nt, Human
uucagauaaacacuaacuuaau

SEQ ID NO: 577042 - RNA, 21 nt, Human
uucccaacuuuucauuguuuu

SEQ ID NO: 577043 - RNA, 21 nt, Human
uucuaaagugugucucaaaua

SEQ ID NO: 577044 - RNA, 23 nt, Human
uuuacauuuaauaauauuuuuga

SEQ ID NO: 577045 - RNA, 24 nt, Human
aacccuuuguuuccuggggacuuc

SEQ ID NO: 577046 - RNA, 23 nt, Human
auuguuuucuguuaccaccugag

SEQ ID NO: 577047 - RNA, 21 nt, Human
caagguaaacaguuuacaguc

SEQ ID NO: 577048 - RNA, 19 nt, Human
caccugagggucaugcuuc

SEQ ID NO: 577049 - RNA, 24 nt, Human
cagcaugacaccagcuuaccuccc

SEQ ID NO: 577050 - RNA, 25 nt, Human
cagcaugggacagaugcugacaauc

SEQ ID NO: 577051 - RNA, 21 nt, Human
caugacaccagcuuaccuccc

SEQ ID NO: 577052 - RNA, 25 nt, Human
caugacaccagcuuaccucccugug

SEQ ID NO: 577053 - RNA, 22 nt, Human
ccucgcccugaguuuuccuucc

SEQ ID NO: 577054 - RNA, 23 nt, Human
ccucuccggagcuuggcggggac

SEQ ID NO: 577055 - RNA, 20 nt, Human
ccugcuaugcauccagggag

SEQ ID NO: 577056 - RNA, 25 nt, Human
ccuuccccagcaacauuccuucucu

SEQ ID NO: 577057 - RNA, 20 nt, Human
cggggacagccucuuccugg

SEQ ID NO: 577058 - RNA, 24 nt, Human
cuccuaguguccugaaugacagcu

SEQ ID NO: 577059 - RNA, 21 nt, Human
cugcugagcuuaacccgcugu

SEQ ID NO: 577060 - RNA, 21 nt, Human
cugggugauugucccugaagu

SEQ ID NO: 577061 - RNA, 20 nt, Human
cuuccccagcaacauuccuu

SEQ ID NO: 577062 - RNA, 22 nt, Human
cuuggcggggacagccucuucc

SEQ ID NO: 577063 - RNA, 19 nt, Human
gaaugucaugaacuuaaaa

SEQ ID NO: 577064 - RNA, 27 nt, Human
gcccugaguuuuccuuccccagcaacc

SEQ ID NO: 577065 - RNA, 18 nt, Human
gcuguucaacuucugcau

SEQ ID NO: 577066 - RNA, 18 nt, Human
gugauugugugccuuugg

SEQ ID NO: 577067 - RNA, 24 nt, Human
uacacagagugaaacuccagauau

SEQ ID NO: 577068 - RNA, 23 nt, Human
uaccaggugcucaaagauguuuc

SEQ ID NO: 577069 - RNA, 25 nt, Human
ucaacaucucagcuaaugacuaacc

SEQ ID NO: 577070 - RNA, 22 nt, Human
ucaccugcuaugcauccaggga

SEQ ID NO: 577071 - RNA, 23 nt, Human
uccccagcaacauuccuucucua

SEQ ID NO: 577072 - RNA, 20 nt, Human
ucccugggugauugucccug

SEQ ID NO: 577073 - RNA, 23 nt, Human
ucccugggugauugucccugaag

SEQ ID NO: 577074 - RNA, 18 nt, Human
uccuggggacuucugcuc

SEQ ID NO: 577075 - RNA, 21 nt, Human
ucuguaccaggugcucaaaga

SEQ ID NO: 577076 - RNA, 23 nt, Human
ugacuaacccuuuguuuccuggg

SEQ ID NO: 577077 - RNA, 20 nt, Human
uggauaugggcacaaugacc

SEQ ID NO: 577078 - RNA, 19 nt, Human
ugugacaagcagcauggga

SEQ ID NO: 577079 - RNA, 22 nt, Human
uuaguuauuaguucccugggug

SEQ ID NO: 577080 - RNA, 20 nt, Human
uuccagguuggguacaaugu

SEQ ID NO: 577081 - RNA, 22 nt, Human
uuccagguuggguacaauguuu

SEQ ID NO: 577082 - RNA, 21 nt, Human
uuccccagcaacauuccuucu

SEQ ID NO: 577083 - RNA, 22 nt, Human
uuccccagcaacauuccuucuc

SEQ ID NO: 577084 - RNA, 22 nt, Human
uuccuggggacuucugcucuac

SEQ ID NO: 577085 - RNA, 28 nt, Human
uuccugguuagagguucugggguucacc

SEQ ID NO: 577086 - RNA, 22 nt, Human
uuucuguuaccaccugaggguc

SEQ ID NO: 577087 - RNA, 23 nt, Human
uuuuccagguuggguacaauguu

SEQ ID NO: 577088 - RNA, 23 nt, Human
uuuuggccagccuccccaauccc

SEQ ID NO: 577089 - RNA, 23 nt, Human
aaaguacacaagacagcggacac

SEQ ID NO: 577090 - RNA, 19 nt, Human
acaagacagcggacacgaa

SEQ ID NO: 577091 - RNA, 21 nt, Human
acaaggacgugacaucagaac

SEQ ID NO: 577092 - RNA, 20 nt, Human
accugauuacaacacuaaca

SEQ ID NO: 577093 - RNA, 27 nt, Human
caucagaacaagaagucuauaaguccc

SEQ ID NO: 577094 - RNA, 19 nt, Human
ccaguaucacugaucugau

SEQ ID NO: 577095 - RNA, 25 nt, Human
ccaguaucacugaucugauauuuac

SEQ ID NO: 577096 - RNA, 20 nt, Human
ccuucuauaguccugucaag

SEQ ID NO: 577097 - RNA, 22 nt, Human
cggacacgaaaaaauccaugua

SEQ ID NO: 577098 - RNA, 18 nt, Human
cuaaagaacaucuacaua

SEQ ID NO: 577099 - RNA, 22 nt, Human
uacaacacuaacaccaguauca

SEQ ID NO: 577100 - RNA, 24 nt, Human
ucagaacaagaagucuauaagucc

SEQ ID NO: 577101 - RNA, 26 nt, Human
ugaaaaguagaauucaugaacuaaaa

SEQ ID NO: 577102 - RNA, 20 nt, Human
ugaacaaggacgugacauca

SEQ ID NO: 577103 - RNA, 24 nt, Human
uuacaacacuaacaccaguaucac

SEQ ID NO: 577104 - RNA, 19 nt, Human
uucaagagaugaaaauaac

SEQ ID NO: 577105 - RNA, 21 nt, Human
uugaaaaguagaauucaugaa

SEQ ID NO: 577106 - RNA, 21 nt, Human
aaaacaaauacuuccugggca

SEQ ID NO: 577107 - RNA, 22 nt, Human
agaggaagaaaaaagagaaaaa

SEQ ID NO: 577108 - RNA, 19 nt, Human
cagaggaagaaaaaagaga

SEQ ID NO: 577109 - RNA, 24 nt, Human
cauaaauuuuuccaaaaacccgcu

SEQ ID NO: 577110 - RNA, 22 nt, Human
ccacgccauuccagaaaacucc

SEQ ID NO: 577111 - RNA, 18 nt, Human
ccugccgcagcucacggc

SEQ ID NO: 577112 - RNA, 19 nt, Human
cgaagucagaggaagaaaa

SEQ ID NO: 577113 - RNA, 18 nt, Human
cgugggagcugccugcgc

SEQ ID NO: 577114 - RNA, 21 nt, Human
cugccugcgcuuccgugaacg

SEQ ID NO: 577115 - RNA, 21 nt, Human
gaagaaaaaagagaaaaaugg

SEQ ID NO: 577116 - RNA, 18 nt, Human
ggagcaaacuggugaucc

SEQ ID NO: 577117 - RNA, 20 nt, Human
guuauuuuccuggacuucuu

SEQ ID NO: 577118 - RNA, 26 nt, Human
uaagaauggcaaaacaaauacuuccu

SEQ ID NO: 577119 - RNA, 19 nt, Human
uaaggguuuuaagcacagc

SEQ ID NO: 577120 - RNA, 19 nt, Human
uaggguacuuagagaguga

SEQ ID NO: 577121 - RNA, 19 nt, Human
uauguauuuuaauggagaa

SEQ ID NO: 577122 - RNA, 23 nt, Human
uaugugccacgccauuccagaaa

SEQ ID NO: 577123 - RNA, 19 nt, Human
ucuccagccguccugccgc

SEQ ID NO: 577124 - RNA, 21 nt, Human
ugagaaaugcuucaauaugug

SEQ ID NO: 577125 - RNA, 19 nt, Human
ugccacgccauuccagaaa

SEQ ID NO: 577126 - RNA, 24 nt, Human
uuaggacaguaagagcuccaaagg

SEQ ID NO: 577127 - RNA, 24 nt, Human
aaagugcugggauuacagguguga

SEQ ID NO: 577128 - RNA, 24 nt, Human
aaggaguuucaccauguuggccag

SEQ ID NO: 577129 - RNA, 18 nt, Human
aagugcugggauuacagg

SEQ ID NO: 577130 - RNA, 19 nt, Human
aagugcugggauuacaggu

SEQ ID NO: 577131 - RNA, 26 nt, Human
aagugcugggauuacaggugugagcc

SEQ ID NO: 577132 - RNA, 18 nt, Human
accauguuggccaggcug

SEQ ID NO: 577133 - RNA, 24 nt, Human
aggaguuucaccauguuggccagg

SEQ ID NO: 577134 - RNA, 24 nt, Human
aggugauccaccugccucagccuc

SEQ ID NO: 577135 - RNA, 24 nt, Human
caaagugcugggauuacaggugug

SEQ ID NO: 577136 - RNA, 21 nt, Human
caccauguuggccaggcuggu

SEQ ID NO: 577137 - RNA, 24 nt, Human
caccauguuggccaggcuggucuc

SEQ ID NO: 577138 - RNA, 27 nt, Human
caccauguuggccaggcuggucucaaa

SEQ ID NO: 577139 - RNA, 23 nt, Human
caccugccucagccucccaaagu

SEQ ID NO: 577140 - RNA, 22 nt, Human
caggugauccaccugccucagc

SEQ ID NO: 577141 - RNA, 24 nt, Human
cauguuggccaggcuggucucaaa

SEQ ID NO: 577142 - RNA, 21 nt, Human
ccaaagugcugggauuacagg

SEQ ID NO: 577143 - RNA, 21 nt, Human
ccaaagugcugggauuacagg

SEQ ID NO: 577144 - RNA, 24 nt, Human
ccaaagugcugggauuacaggugu

SEQ ID NO: 577145 - RNA, 26 nt, Human
ccaccugccucagccucccaaagugc

SEQ ID NO: 577146 - RNA, 18 nt, Human
ccacugcacccagcuggg

SEQ ID NO: 577147 - RNA, 18 nt, Human
ccacugcacccagcuggg

SEQ ID NO: 577148 - RNA, 19 nt, Human
ccacugcacccagcugggu

SEQ ID NO: 577149 - RNA, 21 nt, Human
ccugaccucaggugauccacc

SEQ ID NO: 577150 - RNA, 23 nt, Human
ccugaccucaggugauccaccug

SEQ ID NO: 577151 - RNA, 23 nt, Human
ccugaccucaggugauccaccug

SEQ ID NO: 577152 - RNA, 24 nt, Human
ccugccucagccucccaaagugcu

SEQ ID NO: 577153 - RNA, 23 nt, Human
cucaggugauccaccugccucag

SEQ ID NO: 577154 - RNA, 24 nt, Human
cugccucagccucccaaagugcug

SEQ ID NO: 577155 - RNA, 23 nt, Human
cuguauuuuuaguggggaaggag

SEQ ID NO: 577156 - RNA, 24 nt, Human
gaccucaggugauccaccugccuc

SEQ ID NO: 577157 - RNA, 18 nt, Human
gauuacaggugugagcca

SEQ ID NO: 577158 - RNA, 19 nt, Human
gauuacaggugugagccac

SEQ ID NO: 577159 - RNA, 23 nt, Human
gauuacaggugugagccacugca

SEQ ID NO: 577160 - RNA, 23 nt, Human
gcuggucucaaacuccugaccuc

SEQ ID NO: 577161 - RNA, 22 nt, Human
ggaguuucaccauguuggccag

SEQ ID NO: 577162 - RNA, 23 nt, Human
ggaguuucaccauguuggccagg

SEQ ID NO: 577163 - RNA, 24 nt, Human
ggcuggucucaaacuccugaccuc

SEQ ID NO: 577164 - RNA, 24 nt, Human
ggugauccaccugccucagccucc

SEQ ID NO: 577165 - RNA, 18 nt, Human
gugauccaccugccucag

SEQ ID NO: 577166 - RNA, 24 nt, Human
gugauccaccugccucagccuccc

SEQ ID NO: 577167 - RNA, 19 nt, Human
uacaggugugagccacugc

SEQ ID NO: 577168 - RNA, 24 nt, Human
uacaggugugagccacugcaccca

SEQ ID NO: 577169 - RNA, 24 nt, Human
uaguggggaaggaguuucaccaug

SEQ ID NO: 577170 - RNA, 22 nt, Human
ucaggugauccaccugccucag

SEQ ID NO: 577171 - RNA, 23 nt, Human
ucccaaagugcugggauuacagg

SEQ ID NO: 577172 - RNA, 22 nt, Human
ucucauggagugaggcagaguu

SEQ ID NO: 577173 - RNA, 24 nt, Human
ugaccucaggugauccaccugccu

SEQ ID NO: 577174 - RNA, 24 nt, Human
ugccucagccucccaaagugcugg

SEQ ID NO: 577175 - RNA, 24 nt, Human
ugcugggauuacaggugugagcca

SEQ ID NO: 577176 - RNA, 24 nt, Human
uggccaggcuggucucaaacuccu

SEQ ID NO: 577177 - RNA, 18 nt, Human
ugggauuacaggugugag

SEQ ID NO: 577178 - RNA, 19 nt, Human
ugggauuacaggugugagc

SEQ ID NO: 577179 - RNA, 21 nt, Human
ugggauuacaggugugagcca

SEQ ID NO: 577180 - RNA, 22 nt, Human
ugggauuacaggugugagccac

SEQ ID NO: 577181 - RNA, 22 nt, Human
ugggauuacaggugugagccac

SEQ ID NO: 577182 - RNA, 24 nt, Human
ugggauuacaggugugagccacug

SEQ ID NO: 577183 - RNA, 22 nt, Human
uguuauggaucaucucauggag

SEQ ID NO: 577184 - RNA, 24 nt, Human
uuaguggggaaggaguuucaccau

SEQ ID NO: 577185 - RNA, 18 nt, Human
uucuguauuuuuaguggg

SEQ ID NO: 577186 - RNA, 24 nt, Human
uuucaccauguuggccaggcuggu

SEQ ID NO: 577187 - RNA, 24 nt, Human
uuuuuaguggggaaggaguuucac

SEQ ID NO: 577188 - RNA, 25 nt, Human
aaaaaauuguagagaugggggucuc

SEQ ID NO: 577189 - RNA, 19 nt, Human
aacccagacagaucacagc

SEQ ID NO: 577190 - RNA, 25 nt, Human
aagcaguccuccugccucagccucu

SEQ ID NO: 577191 - RNA, 19 nt, Human
acuauguugcccagguugg

SEQ ID NO: 577192 - RNA, 19 nt, Human
acugcagcccugaacuccu

SEQ ID NO: 577193 - RNA, 20 nt, Human
agaaaaaccaugaacccaga

SEQ ID NO: 577194 - RNA, 22 nt, Human
agaaaaaccaugaacccagaca

SEQ ID NO: 577195 - RNA, 24 nt, Human
aggccccacacccacccucugccu

SEQ ID NO: 577196 - RNA, 18 nt, Human
aggcuggagugcaguggc

SEQ ID NO: 577197 - RNA, 20 nt, Human
aggcuggagugcaguggcuu

SEQ ID NO: 577198 - RNA, 23 nt, Human
aguagcuggaaccgcagguaugu

SEQ ID NO: 577199 - RNA, 21 nt, Human
aguccuccugccucagccucu

SEQ ID NO: 577200 - RNA, 23 nt, Human
agugcaguggcuugaucguaccu

SEQ ID NO: 577201 - RNA, 24 nt, Human
caaagugcgaggauuacagucgug

SEQ ID NO: 577202 - RNA, 22 nt, Human
caagcaguccuccugccucagc

SEQ ID NO: 577203 - RNA, 26 nt, Human
caagcgacccuuagccugagccuccc

SEQ ID NO: 577204 - RNA, 24 nt, Human
cacagcaguacugcccaaaugaga

SEQ ID NO: 577205 - RNA, 22 nt, Human
cacuauguugcccagguugguc

SEQ ID NO: 577206 - RNA, 19 nt, Human
cagagcucagggucccuug

SEQ ID NO: 577207 - RNA, 20 nt, Human
cagcccugaacuccugggcu

SEQ ID NO: 577208 - RNA, 27 nt, Human
cagcccugaacuccugggcucaagcag

SEQ ID NO: 577209 - RNA, 26 nt, Human
caguggaccauccaucucucccagga

SEQ ID NO: 577210 - RNA, 21 nt, Human
ccagcccgauggcucccugcc

SEQ ID NO: 577211 - RNA, 21 nt, Human
ccagcccgauggcucccuggc

SEQ ID NO: 577212 - RNA, 19 nt, Human
cccacacccacccucugcc

SEQ ID NO: 577213 - RNA, 22 nt, Human
cccacacccacccucugccuuc

SEQ ID NO: 577214 - RNA, 18 nt, Human
cccugaacuccugggcuc

SEQ ID NO: 577215 - RNA, 27 nt, Human
ccucccagaaucuuccugcugguccaa

SEQ ID NO: 577216 - RNA, 24 nt, Human
ccuccugccucagccucuugagua

SEQ ID NO: 577217 - RNA, 20 nt, Human
ccugggcucaagcaguccuc

SEQ ID NO: 577218 - RNA, 23 nt, Human
ccugggcucaagcaguccuccug

SEQ ID NO: 577219 - RNA, 19 nt, Human
ccuuccauccuugcagcug

SEQ ID NO: 577220 - RNA, 24 nt, Human
ccuuccauccuugcagcuggguug

SEQ ID NO: 577221 - RNA, 22 nt, Human
cgauggcucccugccucaaagc

SEQ ID NO: 577222 - RNA, 24 nt, Human
cucacugcagcccugaacuccugg

SEQ ID NO: 577223 - RNA, 22 nt, Human
cucccugccucaaagcagugga

SEQ ID NO: 577224 - RNA, 20 nt, Human
cucucagcuucaagcgaccc

SEQ ID NO: 577225 - RNA, 20 nt, Human
cucugucgcccaggcuggag

SEQ ID NO: 577226 - RNA, 23 nt, Human
cucugucgcccaggcuggagugc

SEQ ID NO: 577227 - RNA, 23 nt, Human
cugccucagccucuugaguagcu

SEQ ID NO: 577228 - RNA, 18 nt, Human
cugccucugcugcccacc

SEQ ID NO: 577229 - RNA, 22 nt, Human
cugcugcccaccuggaaguggc

SEQ ID NO: 577230 - RNA, 21 nt, Human
cuugcucugucgcccaggcug

SEQ ID NO: 577231 - RNA, 24 nt, Human
gaucguaccucacugcagcccuga

SEQ ID NO: 577232 - RNA, 19 nt, Human
gauuacagucgugagcccc

SEQ ID NO: 577233 - RNA, 24 nt, Human
gauuacagucgugagcccccaugc

SEQ ID NO: 577234 - RNA, 20 nt, Human
gcacagcaguacugcccaaa

SEQ ID NO: 577235 - RNA, 23 nt, Human
gcagugaccucccagaaucuucc

SEQ ID NO: 577236 - RNA, 19 nt, Human
gcccaggcuggagugcagu

SEQ ID NO: 577237 - RNA, 19 nt, Human
gcccuugugggcucagggg

SEQ ID NO: 577238 - RNA, 21 nt, Human
gcccuugugggcucagggguu

SEQ ID NO: 577239 - RNA, 24 nt, Human
gccucaaagcaguggaccauccau

SEQ ID NO: 577240 - RNA, 21 nt, Human
gcucagggucccuugcugucc

SEQ ID NO: 577241 - RNA, 19 nt, Human
gcuggagugcaguggcuug

SEQ ID NO: 577242 - RNA, 20 nt, Human
ggcucaggggucgcaguggu

SEQ ID NO: 577243 - RNA, 18 nt, Human
ggcuggagugcaguggcu

SEQ ID NO: 577244 - RNA, 18 nt, Human
gggcagcaaggggagcuc

SEQ ID NO: 577245 - RNA, 24 nt, Human
gggggucucacuauguugcccagg

SEQ ID NO: 577246 - RNA, 22 nt, Human
gggucucacuauguugcccagg

SEQ ID NO: 577247 - RNA, 23 nt, Human
guagagaugggggucucacuaug

SEQ ID NO: 577248 - RNA, 24 nt, Human
gugaagccucaggccccacaccca

SEQ ID NO: 577249 - RNA, 21 nt, Human
gugcaguggcuugaucguacc

SEQ ID NO: 577250 - RNA, 27 nt, Human
gugggcucaggggucgcaguggugguc

SEQ ID NO: 577251 - RNA, 20 nt, Human
uacagguauguaccgccaca

SEQ ID NO: 577252 - RNA, 23 nt, Human
uaccucacugcagcccugaacuc

SEQ ID NO: 577253 - RNA, 24 nt, Human
uaccucacugcagcccugaacucc

SEQ ID NO: 577254 - RNA, 19 nt, Human
uauguugcccagguugguc

SEQ ID NO: 577255 - RNA, 24 nt, Human
uauguugcccagguuggucuugaa

SEQ ID NO: 577256 - RNA, 24 nt, Human
ucacugcagcccugaacuccuggg

SEQ ID NO: 577257 - RNA, 23 nt, Human
ucagccucuugaguagcuggaac

SEQ ID NO: 577258 - RNA, 22 nt, Human
ucagggucccuugcuguccucu

SEQ ID NO: 577259 - RNA, 18 nt, Human
uccucagcaucuuaccug

SEQ ID NO: 577260 - RNA, 22 nt, Human
uccugggcucaagcaguccucc

SEQ ID NO: 577261 - RNA, 22 nt, Human
uccugggcucaagcaguccucc

SEQ ID NO: 577262 - RNA, 24 nt, Human
uccugggcucaagcaguccuccug

SEQ ID NO: 577263 - RNA, 22 nt, Human
ucgcagugguggucacacuggg

SEQ ID NO: 577264 - RNA, 24 nt, Human
ucgcccaggcuggagugcaguggc

SEQ ID NO: 577265 - RNA, 18 nt, Human
ucucacuauguugcccag

SEQ ID NO: 577266 - RNA, 19 nt, Human
ucucacuauguugcccagg

SEQ ID NO: 577267 - RNA, 19 nt, Human
ucucacuauguugcccagg

SEQ ID NO: 577268 - RNA, 23 nt, Human
ucucacuauguugcccagguugg

SEQ ID NO: 577269 - RNA, 24 nt, Human
ucucacuauguugcccagguuggu

SEQ ID NO: 577270 - RNA, 21 nt, Human
ucucagcuucaagcgacccuu

SEQ ID NO: 577271 - RNA, 26 nt, Human
ucuccugugcgucucucagaaugcug

SEQ ID NO: 577272 - RNA, 24 nt, Human
ucugucgcccaggcuggagugcag

SEQ ID NO: 577273 - RNA, 24 nt, Human
ucuugaguagcuggaaccgcaggu

SEQ ID NO: 577274 - RNA, 23 nt, Human
ucuugcucugucgcccaggcugg

SEQ ID NO: 577275 - RNA, 24 nt, Human
ucuugcucugucgcccaggcugga

SEQ ID NO: 577276 - RNA, 20 nt, Human
ugaacccagacagaucacag

SEQ ID NO: 577277 - RNA, 24 nt, Human
ugaacuccugggcucaagcagucc

SEQ ID NO: 577278 - RNA, 25 nt, Human
ugaacuccugggcucaagcaguccu

SEQ ID NO: 577279 - RNA, 23 nt, Human
ugaagccucaggccccacaccca

SEQ ID NO: 577280 - RNA, 20 nt, Human
ugaccucccagaaucuuccu

SEQ ID NO: 577281 - RNA, 23 nt, Human
ugagaaaaaccaugaacccagac

SEQ ID NO: 577282 - RNA, 22 nt, Human
ugagagcagugaccucccagaa

SEQ ID NO: 577283 - RNA, 21 nt, Human
ugcacagcaguacugcccaaa

SEQ ID NO: 577284 - RNA, 24 nt, Human
ugccucagccucuugaguagcugg

SEQ ID NO: 577285 - RNA, 20 nt, Human
ugccuuccauccuugcagcu

SEQ ID NO: 577286 - RNA, 21 nt, Human
ugcucugcccuugugggcuca

SEQ ID NO: 577287 - RNA, 20 nt, Human
uggaaccgcagguauguaca

SEQ ID NO: 577288 - RNA, 18 nt, Human
uggaaggaaaaguguucu

SEQ ID NO: 577289 - RNA, 19 nt, Human
uggaccauccaucucuccc

SEQ ID NO: 577290 - RNA, 19 nt, Human
uggagugcaguggcuugau

SEQ ID NO: 577291 - RNA, 19 nt, Human
uggagugcaguggcuugau

SEQ ID NO: 577292 - RNA, 28 nt, Human
uggagugcaguggcuugauggcucuagc

SEQ ID NO: 577293 - RNA, 26 nt, Human
uggcuuggucuccugugcgucucuca

SEQ ID NO: 577294 - RNA, 24 nt, Human
ugggcucaagcaguccuccugccu

SEQ ID NO: 577295 - RNA, 25 nt, Human
uguagagaugggggucucacuaugu

SEQ ID NO: 577296 - RNA, 22 nt, Human
uucagaccacauggaaggaaaa

SEQ ID NO: 577297 - RNA, 18 nt, Human
uugcccagguuggucuug

SEQ ID NO: 577298 - RNA, 24 nt, Human
uugcucugucgcccaggcuggagu

SEQ ID NO: 577299 - RNA, 24 nt, Human
uuguagagaugggggucucacuau

SEQ ID NO: 577300 - RNA, 25 nt, Human
uuguagagaugggggucucacuaug

SEQ ID NO: 577301 - RNA, 19 nt, Human
aaacaacaugaugccaaac

SEQ ID NO: 577302 - RNA, 25 nt, Human
aaacccauuuuauuccaguaaaacu

SEQ ID NO: 577303 - RNA, 21 nt, Human
aaagacauauccuaacugaag

SEQ ID NO: 577304 - RNA, 20 nt, Human
aagaagaaaaauaauuuaga

SEQ ID NO: 577305 - RNA, 20 nt, Human
aaggcaguuaguaaacuaca

SEQ ID NO: 577306 - RNA, 26 nt, Human
acaaaacagaauuuauacaaacacac

SEQ ID NO: 577307 - RNA, 22 nt, Human
acacacacacacaacagaauua

SEQ ID NO: 577308 - RNA, 19 nt, Human
acugaagcauacccacaau

SEQ ID NO: 577309 - RNA, 18 nt, Human
agagacuaacauaagaau

SEQ ID NO: 577310 - RNA, 21 nt, Human
aggcaggaagccugaccaagc

SEQ ID NO: 577311 - RNA, 22 nt, Human
aggcaggaagccugaccaagca

SEQ ID NO: 577312 - RNA, 24 nt, Human
auaaaacaacaugaugccaaaccc

SEQ ID NO: 577313 - RNA, 20 nt, Human
auaacacacacacacacaac

SEQ ID NO: 577314 - RNA, 19 nt, Human
augcuuuauaagcauaaaa

SEQ ID NO: 577315 - RNA, 20 nt, Human
auguaaaacauuuauacagu

SEQ ID NO: 577316 - RNA, 23 nt, Human
auuaagaaccaugcaauuuuaag

SEQ ID NO: 577317 - RNA, 24 nt, Human
cacacacacaacagaauuacagua

SEQ ID NO: 577318 - RNA, 20 nt, Human
caccuuuuugaaaaauguca

SEQ ID NO: 577319 - RNA, 24 nt, Human
cauauaacacacacacacacaaca

SEQ ID NO: 577320 - RNA, 21 nt, Human
cccacagaagucauaaagaaa

SEQ ID NO: 577321 - RNA, 22 nt, Human
cccacagaagucauaaagaaaa

SEQ ID NO: 577322 - RNA, 22 nt, Human
ccuaaggucaaaaacagaaaaa

SEQ ID NO: 577323 - RNA, 23 nt, Human
cgggagagucugucucuguaaug

SEQ ID NO: 577324 - RNA, 26 nt, Human
cucucuguagauaacauacaugagag

SEQ ID NO: 577325 - RNA, 18 nt, Human
cuucauggcuaauaaugg

SEQ ID NO: 577326 - RNA, 19 nt, Human
gaccacaguuaugugcuug

SEQ ID NO: 577327 - RNA, 18 nt, Human
uaaaacaacaugaugcca

SEQ ID NO: 577328 - RNA, 19 nt, Human
uaacugaagcauacccaca

SEQ ID NO: 577329 - RNA, 19 nt, Human
uaacugaagcauacccaca

SEQ ID NO: 577330 - RNA, 19 nt, Human
uaaggaagacaacguaaua

SEQ ID NO: 577331 - RNA, 26 nt, Human
uaaggucaaaaacagaaaaauauaaa

SEQ ID NO: 577332 - RNA, 18 nt, Human
uagauaacauacaugaga

SEQ ID NO: 577333 - RNA, 22 nt, Human
uaugugcuugugcauaugcaug

SEQ ID NO: 577334 - RNA, 21 nt, Human
ucucuguaaugauccucucug

SEQ ID NO: 577335 - RNA, 20 nt, Human
ugccugaaaaacuauuuugg

SEQ ID NO: 577336 - RNA, 20 nt, Human
ugccugaaaaacuauuuugu

SEQ ID NO: 577337 - RNA, 22 nt, Human
ugcuuuauaagcauaaaacaac

SEQ ID NO: 577338 - RNA, 19 nt, Human
uguauguacauuuaucaua

SEQ ID NO: 577339 - RNA, 18 nt, Human
ugugcauaugcauguaua

SEQ ID NO: 577340 - RNA, 21 nt, Human
ugugcauaugcauguauagau

SEQ ID NO: 577341 - RNA, 23 nt, Human
uguggcccaugucucgggagagu

SEQ ID NO: 577342 - RNA, 22 nt, Human
uguuacaaaacagaauuuauac

SEQ ID NO: 577343 - RNA, 24 nt, Human
uguuaugaaccaugcaacaugaaa

SEQ ID NO: 577344 - RNA, 25 nt, Human
uguuugauuauuacucuguguuaca

SEQ ID NO: 577345 - RNA, 18 nt, Human
uuacagcacuuaaaaaag

SEQ ID NO: 577346 - RNA, 22 nt, Human
uuagaaaacuucauauaccuaa

SEQ ID NO: 577347 - RNA, 18 nt, Human
uuccuaugugacaaagau

SEQ ID NO: 577348 - RNA, 28 nt, Human
uuuaucauauaacacacacacacacagu

SEQ ID NO: 577349 - RNA, 20 nt, Human
uuuuuuuuuuuuuuuuccau

SEQ ID NO: 577350 - RNA, 26 nt, Human
aagcgauucucgugccucagccuccc

SEQ ID NO: 577351 - RNA, 22 nt, Human
aaucucugcucacugcaaccuc

SEQ ID NO: 577352 - RNA, 18 nt, Human
acaggguuucaccauguu

SEQ ID NO: 577353 - RNA, 19 nt, Human
acaggguuucaccauguug

SEQ ID NO: 577354 - RNA, 19 nt, Human
accauguugcccaagaugg

SEQ ID NO: 577355 - RNA, 23 nt, Human
accucagccucccauagugcugg

SEQ ID NO: 577356 - RNA, 18 nt, Human
acuacagccacaugccac

SEQ ID NO: 577357 - RNA, 18 nt, Human
acucuguaguccaaacug

SEQ ID NO: 577358 - RNA, 24 nt, Human
acuggaguacaguggcgcaaucuc

SEQ ID NO: 577359 - RNA, 21 nt, Human
acuucuccagguuuuccauua

SEQ ID NO: 577360 - RNA, 23 nt, Human
agacaggguuucaccauguugcc

SEQ ID NO: 577361 - RNA, 24 nt, Human
agcgauucucgugccucagccucc

SEQ ID NO: 577362 - RNA, 19 nt, Human
aguacaguggcgcaaucuc

SEQ ID NO: 577363 - RNA, 22 nt, Human
aguccaaacuggaguacagugg

SEQ ID NO: 577364 - RNA, 18 nt, Human
agugcugggauuacaggc

SEQ ID NO: 577365 - RNA, 22 nt, Human
agugcugggauuacaggcauga

SEQ ID NO: 577366 - RNA, 24 nt, Human
auagugcugggauuacaggcauga

SEQ ID NO: 577367 - RNA, 22 nt, Human
caacugcauuuuccccucucaa

SEQ ID NO: 577368 - RNA, 27 nt, Human
caauagcugugacuccuggguacaagc

SEQ ID NO: 577369 - RNA, 18 nt, Human
caccauguugcccaagau

SEQ ID NO: 577370 - RNA, 31 nt, Human
caccauguugcccaagauggugucgaacucc

SEQ ID NO: 577371 - RNA, 18 nt, Human
cacuuuaucaacccuguc

SEQ ID NO: 577372 - RNA, 21 nt, Human
cagaaauacauuacuguagca

SEQ ID NO: 577373 - RNA, 18 nt, Human
caggguuucaccauguug

SEQ ID NO: 577374 - RNA, 24 nt, Human
cauagugcugggauuacaggcaug

SEQ ID NO: 577375 - RNA, 24 nt, Human
caugccaccacgcccagcuaauuu

SEQ ID NO: 577376 - RNA, 24 nt, Human
cauguugcccaagauggugucgaa

SEQ ID NO: 577377 - RNA, 20 nt, Human
ccagggcucaagcgauucuc

SEQ ID NO: 577378 - RNA, 23 nt, Human
ccauagugcugggauuacaggca

SEQ ID NO: 577379 - RNA, 24 nt, Human
ccauagugcugggauuacaggcau

SEQ ID NO: 577380 - RNA, 19 nt, Human
cccgaguagcugggacuac

SEQ ID NO: 577381 - RNA, 24 nt, Human
ccuccguuuuccugaaaaggaaaa

SEQ ID NO: 577382 - RNA, 21 nt, Human
ccugucugaaguuucaacugc

SEQ ID NO: 577383 - RNA, 24 nt, Human
cgugccucagccucccgaguagcu

SEQ ID NO: 577384 - RNA, 21 nt, Human
cucacugcaaccuccaacucc

SEQ ID NO: 577385 - RNA, 23 nt, Human
cucacugcaaccuccaacuccag

SEQ ID NO: 577386 - RNA, 24 nt, Human
cucagccucccgaguagcugggac

SEQ ID NO: 577387 - RNA, 20 nt, Human
cuccuggguacaagcucccg

SEQ ID NO: 577388 - RNA, 25 nt, Human
cucgugccucagccucccgaguagc

SEQ ID NO: 577389 - RNA, 19 nt, Human
cuguagucugguuccugac

SEQ ID NO: 577390 - RNA, 24 nt, Human
cuucauguggagacugagucuuau

SEQ ID NO: 577391 - RNA, 24 nt, Human
gaaaaccuccaugccccgugagag

SEQ ID NO: 577392 - RNA, 21 nt, Human
gacuacagccacaugccacca

SEQ ID NO: 577393 - RNA, 24 nt, Human
gagaucugcccaccucagccuccc

SEQ ID NO: 577394 - RNA, 24 nt, Human
gagcucaggagaucugcccaccuc

SEQ ID NO: 577395 - RNA, 26 nt, Human
gaguagcugggacuacagccacaugc

SEQ ID NO: 577396 - RNA, 18 nt, Human
gauuacaggcaugagcca

SEQ ID NO: 577397 - RNA, 22 nt, Human
gauuacaggcaugagccacugc

SEQ ID NO: 577398 - RNA, 23 nt, Human
gauuacaggcaugagccacugca

SEQ ID NO: 577399 - RNA, 18 nt, Human
gcaaccuccaacuccagg

SEQ ID NO: 577400 - RNA, 24 nt, Human
gcccagcuaauuuuuuuguauuuu

SEQ ID NO: 577401 - RNA, 24 nt, Human
gcgauucucgugccucagccuccc

SEQ ID NO: 577402 - RNA, 24 nt, Human
ggagaucugcccaccucagccucc

SEQ ID NO: 577403 - RNA, 22 nt, Human
ggauuacaggcaugagccacug

SEQ ID NO: 577404 - RNA, 18 nt, Human
gguccacuguagucuggu

SEQ ID NO: 577405 - RNA, 22 nt, Human
gugccucagccucccgaguagc

SEQ ID NO: 577406 - RNA, 23 nt, Human
guuuuuugcuguuguuguuuugu

SEQ ID NO: 577407 - RNA, 22 nt, Human
uacagccacaugccaccacgcc

SEQ ID NO: 577408 - RNA, 24 nt, Human
uacagccacaugccaccacgccca

SEQ ID NO: 577409 - RNA, 22 nt, Human
uacaggcaugagccacugcacc

SEQ ID NO: 577410 - RNA, 22 nt, Human
uagcauaagaauggcauuuauu

SEQ ID NO: 577411 - RNA, 22 nt, Human
uaguagacaggguuucaccaug

SEQ ID NO: 577412 - RNA, 24 nt, Human
uagugcugggauuacaggcaugag

SEQ ID NO: 577413 - RNA, 23 nt, Human
uauuuuaguagacaggguuucac

SEQ ID NO: 577414 - RNA, 18 nt, Human
ucaagguucuccaggguc

SEQ ID NO: 577415 - RNA, 23 nt, Human
ucacugcaaccuccaacuccagg

SEQ ID NO: 577416 - RNA, 24 nt, Human
ucacugcaaccuccaacuccaggg

SEQ ID NO: 577417 - RNA, 27 nt, Human
ucacugcaaccuccaacuccagggcuc

SEQ ID NO: 577418 - RNA, 23 nt, Human
ucagccucccgaguagcugggac

SEQ ID NO: 577419 - RNA, 22 nt, Human
uccacuguagucugguuccuga

SEQ ID NO: 577420 - RNA, 24 nt, Human
ucccauagugcugggauuacaggc

SEQ ID NO: 577421 - RNA, 22 nt, Human
ucccgaguagcugggacuacag

SEQ ID NO: 577422 - RNA, 23 nt, Human
ucccgaguagcugggacuacagc

SEQ ID NO: 577423 - RNA, 23 nt, Human
ucgaaaaccuccaugccccguga

SEQ ID NO: 577424 - RNA, 23 nt, Human
ucucacucuguaguccaaacugg

SEQ ID NO: 577425 - RNA, 24 nt, Human
ucucacucuguaguccaaacugga

SEQ ID NO: 577426 - RNA, 23 nt, Human
ucucuguaaccuccguuuuccug

SEQ ID NO: 577427 - RNA, 28 nt, Human
ucucuguaaccuccguuuuggguccucc

SEQ ID NO: 577428 - RNA, 21 nt, Human
ucugcccaccucagccuccca

SEQ ID NO: 577429 - RNA, 20 nt, Human
ugaaaaggaaaaauguucuu

SEQ ID NO: 577430 - RNA, 22 nt, Human
ugacuccuggguacaagcuccc

SEQ ID NO: 577431 - RNA, 24 nt, Human
ugccucagccucccgaguagcugg

SEQ ID NO: 577432 - RNA, 19 nt, Human
uggaguacaguggcgcaau

SEQ ID NO: 577433 - RNA, 24 nt, Human
ugggacuacagccacaugccacca

SEQ ID NO: 577434 - RNA, 18 nt, Human
ugggauuacaggcaugag

SEQ ID NO: 577435 - RNA, 19 nt, Human
ugggauuacaggcaugagc

SEQ ID NO: 577436 - RNA, 21 nt, Human
ugggauuacaggcaugagcca

SEQ ID NO: 577437 - RNA, 22 nt, Human
ugggauuacaggcaugagccac

SEQ ID NO: 577438 - RNA, 22 nt, Human
ugggauuacaggcaugagccac

SEQ ID NO: 577439 - RNA, 24 nt, Human
ugggauuacaggcaugagccacug

SEQ ID NO: 577440 - RNA, 24 nt, Human
ugggauuacaggcaugagccacug

SEQ ID NO: 577441 - RNA, 20 nt, Human
ugucgaacuccugagcucag

SEQ ID NO: 577442 - RNA, 22 nt, Human
uguuuuguuuuguuuugagaug

SEQ ID NO: 577443 - RNA, 25 nt, Human
uuacauauacuuuucucuguaaccu

SEQ ID NO: 577444 - RNA, 22 nt, Human
uuaguagacaggguuucaccau

SEQ ID NO: 577445 - RNA, 23 nt, Human
uuaguagacaggguuucaccaug

SEQ ID NO: 577446 - RNA, 19 nt, Human
uucgaaaaccuccaugccc

SEQ ID NO: 577447 - RNA, 23 nt, Human
uucuccagguuuuccauuagaca

SEQ ID NO: 577448 - RNA, 20 nt, Human
uuguuguuuuguuuuguuuu

SEQ ID NO: 577449 - RNA, 23 nt, Human
uuuaguagacaggguuucaccau

SEQ ID NO: 577450 - RNA, 24 nt, Human
uuuaguagacaggguuucaccaug

SEQ ID NO: 577451 - RNA, 19 nt, Human
uuucaccauguugcccaag

SEQ ID NO: 577452 - RNA, 24 nt, Human
aacaaguuaggaaaauuaagccug

SEQ ID NO: 577453 - RNA, 22 nt, Human
cagaauucuucuaggcuucuau

SEQ ID NO: 577454 - RNA, 19 nt, Human
gaacauaaaucuucucagg

SEQ ID NO: 577455 - RNA, 23 nt, Human
ugaaauagucuaaagauaagaca

SEQ ID NO: 577456 - RNA, 19 nt, Human
aaaauguccaccaggaaac

SEQ ID NO: 577457 - RNA, 26 nt, Human
aaacagccuggggcuugcgauuggca

SEQ ID NO: 577458 - RNA, 20 nt, Human
acaagcuuggcuauuucaag

SEQ ID NO: 577459 - RNA, 20 nt, Human
acacccaaaacggacucaac

SEQ ID NO: 577460 - RNA, 21 nt, Human
acacccaaaacggacucaaca

SEQ ID NO: 577461 - RNA, 22 nt, Human
acagcaccggagagcacuguac

SEQ ID NO: 577462 - RNA, 24 nt, Human
acucugagauguuccaaaaccaau

SEQ ID NO: 577463 - RNA, 22 nt, Human
agaaagaaaccuuagauguugc

SEQ ID NO: 577464 - RNA, 18 nt, Human
agaaguggggagcggucu

SEQ ID NO: 577465 - RNA, 20 nt, Human
agacaaaaggccugaagaau

SEQ ID NO: 577466 - RNA, 22 nt, Human
agacaaaaggccugaagaauua

SEQ ID NO: 577467 - RNA, 21 nt, Human
agagcacuguacaaaaugucc

SEQ ID NO: 577468 - RNA, 24 nt, Human
agaguagaaagaaaccuuagaugu

SEQ ID NO: 577469 - RNA, 22 nt, Human
agcggucuugugggacugaguc

SEQ ID NO: 577470 - RNA, 18 nt, Human
auguuccaaaaccaauaa

SEQ ID NO: 577471 - RNA, 23 nt, Human
auuaagcaaaccccaggaggggg

SEQ ID NO: 577472 - RNA, 21 nt, Human
caccggagagcacuguacaaa

SEQ ID NO: 577473 - RNA, 21 nt, Human
cagaauugaauuggaggacac

SEQ ID NO: 577474 - RNA, 24 nt, Human
cagccuucaaucuucucuccuucu

SEQ ID NO: 577475 - RNA, 26 nt, Human
cauucggaaaucagaaucuacaaggg

SEQ ID NO: 577476 - RNA, 19 nt, Human
cccauguugcaauccuggg

SEQ ID NO: 577477 - RNA, 20 nt, Human
ccccaggagggggucauggg

SEQ ID NO: 577478 - RNA, 22 nt, Human
gacaucuuucuuugaaaguuuc

SEQ ID NO: 577479 - RNA, 20 nt, Human
gagaucugacacuaucucca

SEQ ID NO: 577480 - RNA, 23 nt, Human
gagcacucagaccccgguugaca

SEQ ID NO: 577481 - RNA, 25 nt, Human
gcaaaccccaggagggggggaacgc

SEQ ID NO: 577482 - RNA, 18 nt, Human
ggcucacugauuuucgca

SEQ ID NO: 577483 - RNA, 25 nt, Human
guacaaaauguccaccaggaaacca

SEQ ID NO: 577484 - RNA, 22 nt, Human
gucugcuuuggcuucccaggaa

SEQ ID NO: 577485 - RNA, 21 nt, Human
uacaagcuuggcuauuucaag

SEQ ID NO: 577486 - RNA, 23 nt, Human
uacacccaaaacggacucaacau

SEQ ID NO: 577487 - RNA, 26 nt, Human
uacacccaaaacggacucaacaucag

SEQ ID NO: 577488 - RNA, 18 nt, Human
ucaacaucagcuucuggc

SEQ ID NO: 577489 - RNA, 24 nt, Human
ucagcaaaucuaaccuuaccauuu

SEQ ID NO: 577490 - RNA, 19 nt, Human
ucaugggaucccugauuua

SEQ ID NO: 577491 - RNA, 23 nt, Human
uccaaaaccaauaaauccaggca

SEQ ID NO: 577492 - RNA, 22 nt, Human
ucccaggaacuuagaguuucug

SEQ ID NO: 577493 - RNA, 18 nt, Human
ucccugauuuagauguac

SEQ ID NO: 577494 - RNA, 18 nt, Human
ucccuuuaguucgcugcu

SEQ ID NO: 577495 - RNA, 20 nt, Human
ucuucagcuccuugaauagc

SEQ ID NO: 577496 - RNA, 22 nt, Human
ucuugugggacugaguccuaag

SEQ ID NO: 577497 - RNA, 19 nt, Human
ugagagaagguucaguugu

SEQ ID NO: 577498 - RNA, 20 nt, Human
ugagcacucagaccccgguu

SEQ ID NO: 577499 - RNA, 19 nt, Human
ugaguucugugagacaguc

SEQ ID NO: 577500 - RNA, 19 nt, Human
ugcugggugggagaaaucu

SEQ ID NO: 577501 - RNA, 19 nt, Human
ugcuuguucuucccgccca

SEQ ID NO: 577502 - RNA, 18 nt, Human
uggcggcggaagaggaca

SEQ ID NO: 577503 - RNA, 19 nt, Human
uggcuuggacaauacucug

SEQ ID NO: 577504 - RNA, 18 nt, Human
uggucgcgguugcagcug

SEQ ID NO: 577505 - RNA, 28 nt, Human
uguacaaaauguccaccaggaaaccaaa

SEQ ID NO: 577506 - RNA, 24 nt, Human
uucaaucuucucuccuucugaaga

SEQ ID NO: 577507 - RNA, 25 nt, Human
uucaaucuucucuccuucugaagau

SEQ ID NO: 577508 - RNA, 22 nt, Human
uugaaggccucagguucccuuu

SEQ ID NO: 577509 - RNA, 18 nt, Human
uuggaggacacauagcug

SEQ ID NO: 577510 - RNA, 19 nt, Human
uuuacuugacuucaaugag

SEQ ID NO: 577511 - RNA, 18 nt, Human
uuuuuuguacaagcuugg

SEQ ID NO: 577512 - RNA, 18 nt, Human
aaagaacagcauagauau

SEQ ID NO: 577513 - RNA, 21 nt, Human
aaaguaaguagcaggauacag

SEQ ID NO: 577514 - RNA, 18 nt, Human
aagaagggaaauacaaug

SEQ ID NO: 577515 - RNA, 23 nt, Human
aagaagggaaauacaaugcuuua

SEQ ID NO: 577516 - RNA, 18 nt, Human
acaguuaggucccugaac

SEQ ID NO: 577517 - RNA, 20 nt, Human
acuauuacuaccaacaggau

SEQ ID NO: 577518 - RNA, 21 nt, Human
acuguuguuggagacugugga

SEQ ID NO: 577519 - RNA, 21 nt, Human
agaaacauuaguaacuuaagc

SEQ ID NO: 577520 - RNA, 20 nt, Human
agaaacccucuacuuuaacc

SEQ ID NO: 577521 - RNA, 21 nt, Human
augaauguuuaccccugcugu

SEQ ID NO: 577522 - RNA, 22 nt, Human
augaggcagaauggaucacccc

SEQ ID NO: 577523 - RNA, 18 nt, Human
caagaaccccaaauaaaa

SEQ ID NO: 577524 - RNA, 22 nt, Human
caagaaccccaaauaaaauuaa

SEQ ID NO: 577525 - RNA, 19 nt, Human
cacagauuuuguaaaucca

SEQ ID NO: 577526 - RNA, 24 nt, Human
caggauuuuacacaagaaacauua

SEQ ID NO: 577527 - RNA, 22 nt, Human
ccaagcaguuuguaaaaguaag

SEQ ID NO: 577528 - RNA, 23 nt, Human
ccacuaugcaggauccaaccguc

SEQ ID NO: 577529 - RNA, 19 nt, Human
ccauacugggccuggaacu

SEQ ID NO: 577530 - RNA, 23 nt, Human
ccuuuagguagaaguccagccuu

SEQ ID NO: 577531 - RNA, 21 nt, Human
cucaagaaccccaaauaaaau

SEQ ID NO: 577532 - RNA, 18 nt, Human
cugcagaugaauguuuac

SEQ ID NO: 577533 - RNA, 18 nt, Human
gcacacugcagaugaaug

SEQ ID NO: 577534 - RNA, 22 nt, Human
gcuaaucaagaaacccucuacu

SEQ ID NO: 577535 - RNA, 23 nt, Human
ggguaauuuucuuuuaaagauau

SEQ ID NO: 577536 - RNA, 24 nt, Human
uaaccaagcaguuuguaaaaguaa

SEQ ID NO: 577537 - RNA, 22 nt, Human
uacaucacaaagcuaaucaaga

SEQ ID NO: 577538 - RNA, 21 nt, Human
uagcaggauacagaaauccuc

SEQ ID NO: 577539 - RNA, 18 nt, Human
uaggucccugaacuugua

SEQ ID NO: 577540 - RNA, 23 nt, Human
ucaaaguuuuaacuguuguugga

SEQ ID NO: 577541 - RNA, 21 nt, Human
uccacaguuaggucccugaac

SEQ ID NO: 577542 - RNA, 21 nt, Human
ucccugaacuuguacuccaga

SEQ ID NO: 577543 - RNA, 20 nt, Human
uccuuaguucuuccacaguu

SEQ ID NO: 577544 - RNA, 18 nt, Human
ugaagaagggaaauacaa

SEQ ID NO: 577545 - RNA, 24 nt, Human
ugacacagauuuuguaaauccaua

SEQ ID NO: 577546 - RNA, 26 nt, Human
ugaggcagaauggaucaccccucuca

SEQ ID NO: 577547 - RNA, 19 nt, Human
ugcaggauccaaccgucuu

SEQ ID NO: 577548 - RNA, 22 nt, Human
ugcauuugagaaucaaaguuuu

SEQ ID NO: 577549 - RNA, 19 nt, Human
ugcuuuggaguuucucagu

SEQ ID NO: 577550 - RNA, 22 nt, Human
ugcuuuggaguuucucaguaac

SEQ ID NO: 577551 - RNA, 24 nt, Human
uuacaucacaaagcuaaucaagaa

SEQ ID NO: 577552 - RNA, 23 nt, Human
uuuuaaaaauucacuuuccauuu

SEQ ID NO: 577553 - RNA, 22 nt, Human
uuuuuggcacggcucauucacu

SEQ ID NO: 577554 - RNA, 22 nt, Human
uuuuuugguagguaauuaauuu

SEQ ID NO: 577555 - RNA, 23 nt, Human
aaaaagaaaagauuuagagguuc

SEQ ID NO: 577556 - RNA, 21 nt, Human
aaaaagacaccccaccagacc

SEQ ID NO: 577557 - RNA, 24 nt, Human
aaagacaccccaccagaccugcgg

SEQ ID NO: 577558 - RNA, 22 nt, Human
aaagcagaugaaggcaggaacu

SEQ ID NO: 577559 - RNA, 21 nt, Human
aaccaggggcuucuaagccac

SEQ ID NO: 577560 - RNA, 19 nt, Human
aaccguggggcugggaggc

SEQ ID NO: 577561 - RNA, 20 nt, Human
aagacaccccaccagaccug

SEQ ID NO: 577562 - RNA, 20 nt, Human
accagggccuccccucagca

SEQ ID NO: 577563 - RNA, 21 nt, Human
accagggccuccccucagcag

SEQ ID NO: 577564 - RNA, 22 nt, Human
accagggccuccccucagcagc

SEQ ID NO: 577565 - RNA, 22 nt, Human
acccaaaaacagggcaggccag

SEQ ID NO: 577566 - RNA, 27 nt, Human
acccaaaaacagggcaggccagggagu

SEQ ID NO: 577567 - RNA, 19 nt, Human
accccaaaccaggggcuuc

SEQ ID NO: 577568 - RNA, 20 nt, Human
accccggggacgaauuugcu

SEQ ID NO: 577569 - RNA, 20 nt, Human
agacacgugcccuccuccuc

SEQ ID NO: 577570 - RNA, 18 nt, Human
agacuuggaaggagggug

SEQ ID NO: 577571 - RNA, 24 nt, Human
aggagaaaaaagacaccccaccag

SEQ ID NO: 577572 - RNA, 23 nt, Human
aggagacuuggaaggagggugag

SEQ ID NO: 577573 - RNA, 25 nt, Human
aggcaggaacugaggcaugaccagg

SEQ ID NO: 577574 - RNA, 20 nt, Human
aggccccucaagggcagccc

SEQ ID NO: 577575 - RNA, 18 nt, Human
aggccucacugcuggcuc

SEQ ID NO: 577576 - RNA, 21 nt, Human
agggagggagggaccccuggg

SEQ ID NO: 577577 - RNA, 20 nt, Human
caaaccaggggcuucuaagc

SEQ ID NO: 577578 - RNA, 22 nt, Human
caagacaucaaucgucuguuag

SEQ ID NO: 577579 - RNA, 22 nt, Human
caagccccacuuggagacaacu

SEQ ID NO: 577580 - RNA, 22 nt, Human
caccccaaaccaggggcuucua

SEQ ID NO: 577581 - RNA, 18 nt, Human
caggccagggaguggcag

SEQ ID NO: 577582 - RNA, 23 nt, Human
cagggucccgggggucuuggggg

SEQ ID NO: 577583 - RNA, 23 nt, Human
cccacaagaugcucagugccaaa

SEQ ID NO: 577584 - RNA, 23 nt, Human
ccccccgccgucgcgcguucgag

SEQ ID NO: 577585 - RNA, 21 nt, Human
ccccucaagggcagcccgggc

SEQ ID NO: 577586 - RNA, 19 nt, Human
ccccuggagaccugggauu

SEQ ID NO: 577587 - RNA, 24 nt, Human
ccguggggacucgggggccaggcg

SEQ ID NO: 577588 - RNA, 25 nt, Human
ccuccggaaagcagaugaaggcagg

SEQ ID NO: 577589 - RNA, 20 nt, Human
ccuccuccuccacccacccc

SEQ ID NO: 577590 - RNA, 21 nt, Human
cgccaagccccacuuggagac

SEQ ID NO: 577591 - RNA, 23 nt, Human
cggaaagcagaugaaggcaggaa

SEQ ID NO: 577592 - RNA, 25 nt, Human
cuccacccaccccaaaccaggggcu

SEQ ID NO: 577593 - RNA, 18 nt, Human
cuccuccacccaccccaa

SEQ ID NO: 577594 - RNA, 26 nt, Human
cuccuccacccaccccaaaccagggg

SEQ ID NO: 577595 - RNA, 19 nt, Human
cuuccccccgccgucgcgc

SEQ ID NO: 577596 - RNA, 22 nt, Human
gaaaccguggggcugggaggca

SEQ ID NO: 577597 - RNA, 19 nt, Human
gaacaaauguggccagaga

SEQ ID NO: 577598 - RNA, 19 nt, Human
gaaggagggagggagggac

SEQ ID NO: 577599 - RNA, 19 nt, Human
gaaggagggagggagggac

SEQ ID NO: 577600 - RNA, 21 nt, Human
gaaggggggcacugggguucu

SEQ ID NO: 577601 - RNA, 20 nt, Human
gacugccuggccaacagggc

SEQ ID NO: 577602 - RNA, 19 nt, Human
gagcugcacagggaccccc

SEQ ID NO: 577603 - RNA, 22 nt, Human
gagcugcacagggacccccugg

SEQ ID NO: 577604 - RNA, 25 nt, Human
gaggagaaaaaagacaccccaccag

SEQ ID NO: 577605 - RNA, 19 nt, Human
gagggcaccccaggggagg

SEQ ID NO: 577606 - RNA, 20 nt, Human
gccaccucucacugcuccug

SEQ ID NO: 577607 - RNA, 18 nt, Human
gcgcaggagacuuggaag

SEQ ID NO: 577608 - RNA, 23 nt, Human
gcgggaaggggacugccuggcca

SEQ ID NO: 577609 - RNA, 19 nt, Human
ggaaggagggagggaggga

SEQ ID NO: 577610 - RNA, 20 nt, Human
ggaaggagggcaccccaggg

SEQ ID NO: 577611 - RNA, 19 nt, Human
ggacucgggggccaggcga

SEQ ID NO: 577612 - RNA, 20 nt, Human
ggagaaaaaagacaccccac

SEQ ID NO: 577613 - RNA, 19 nt, Human
ggagacuuggaaggagggu

SEQ ID NO: 577614 - RNA, 21 nt, Human
ggcgcggagggguggaaagga

SEQ ID NO: 577615 - RNA, 21 nt, Human
gggaaggagggagggagggac

SEQ ID NO: 577616 - RNA, 20 nt, Human
gggccuccccucagcagcuu

SEQ ID NO: 577617 - RNA, 22 nt, Human
gggcgaaggggggcacuggggu

SEQ ID NO: 577618 - RNA, 22 nt, Human
uaaaaacaguaaaaccaaucaa

SEQ ID NO: 577619 - RNA, 21 nt, Human
uauaccaccgacuuuggguuc

SEQ ID NO: 577620 - RNA, 21 nt, Human
ucaaaaagaaaagauuuagag

SEQ ID NO: 577621 - RNA, 18 nt, Human
ucaggccagggucccggg

SEQ ID NO: 577622 - RNA, 19 nt, Human
ucagugccaaauggaaggu

SEQ ID NO: 577623 - RNA, 25 nt, Human
ucagugccaaauggaaggucccaag

SEQ ID NO: 577624 - RNA, 19 nt, Human
ucccaagccccuaaggagc

SEQ ID NO: 577625 - RNA, 22 nt, Human
uccguagcaauguugacccaaa

SEQ ID NO: 577626 - RNA, 22 nt, Human
ucucagccaguuaaggccccac

SEQ ID NO: 577627 - RNA, 24 nt, Human
ucucagccaguuaaggccccacaa

SEQ ID NO: 577628 - RNA, 19 nt, Human
ugaaugccugaaaccgugg

SEQ ID NO: 577629 - RNA, 19 nt, Human
ugacccaaaaacagggcag

SEQ ID NO: 577630 - RNA, 25 nt, Human
ugacccaaaaacagggcaggccagg

SEQ ID NO: 577631 - RNA, 22 nt, Human
ugcacagggacccccuggagac

SEQ ID NO: 577632 - RNA, 19 nt, Human
ugcuggcuccguagcaaug

SEQ ID NO: 577633 - RNA, 21 nt, Human
ugcuuugggaaggagggaggg

SEQ ID NO: 577634 - RNA, 18 nt, Human
uggaaaggagggaggaga

SEQ ID NO: 577635 - RNA, 20 nt, Human
uggaaaggagggaggagaaa

SEQ ID NO: 577636 - RNA, 19 nt, Human
uggaaggagggugagucau

SEQ ID NO: 577637 - RNA, 24 nt, Human
uggaaggucccaagccccuaagga

SEQ ID NO: 577638 - RNA, 21 nt, Human
uggcagggcgcggaggggugg

SEQ ID NO: 577639 - RNA, 19 nt, Human
ugggaugggggaaggaggg

SEQ ID NO: 577640 - RNA, 21 nt, Human
ugggaugggggaaggagggca

SEQ ID NO: 577641 - RNA, 22 nt, Human
ugggauuccacccgccagcccg

SEQ ID NO: 577642 - RNA, 21 nt, Human
uuaaggccccacaagaugcuc

SEQ ID NO: 577643 - RNA, 18 nt, Human
uucuaagccaccucucac

SEQ ID NO: 577644 - RNA, 20 nt, Human
uuugccggcaggcucccucg

SEQ ID NO: 577645 - RNA, 18 nt, Human
acugaagagggaacauga

SEQ ID NO: 577646 - RNA, 23 nt, Human
acuuagguuuaacugaagaggga

SEQ ID NO: 577647 - RNA, 24 nt, Human
augcaaaguuucauuuugguuuua

SEQ ID NO: 577648 - RNA, 18 nt, Human
cagugacacuucuccggg

SEQ ID NO: 577649 - RNA, 26 nt, Human
cggcgcggagcgaacgggcuaccggg

SEQ ID NO: 577650 - RNA, 24 nt, Human
uaguucaugauuuguuucuaauga

SEQ ID NO: 577651 - RNA, 22 nt, Human
uauaugcaaaguuucauuuugg

SEQ ID NO: 577652 - RNA, 23 nt, Human
uccccugcccuagcccgccaagc

SEQ ID NO: 577653 - RNA, 20 nt, Human
ugaaaaucagcagcaugcga

SEQ ID NO: 577654 - RNA, 23 nt, Human
ugauuuguuucuaaugaaaaacu

SEQ ID NO: 577655 - RNA, 27 nt, Human
aaacaagcauacaccacacacaccccu

SEQ ID NO: 577656 - RNA, 21 nt, Human
aaagaagaaaccaaaagaaaa

SEQ ID NO: 577657 - RNA, 23 nt, Human
aaaucucagaaacguacaaagcc

SEQ ID NO: 577658 - RNA, 24 nt, Human
aagaaaacaaacacaucuuuauaa

SEQ ID NO: 577659 - RNA, 20 nt, Human
aagaaaccaaaagaaaauaa

SEQ ID NO: 577660 - RNA, 20 nt, Human
aagaagaaaccaaaagaaaa

SEQ ID NO: 577661 - RNA, 22 nt, Human
aagcauacaccacacacacccc

SEQ ID NO: 577662 - RNA, 23 nt, Human
aagcauacaccacacacaccccc

SEQ ID NO: 577663 - RNA, 22 nt, Human
aauggccucuugcucuuuuucu

SEQ ID NO: 577664 - RNA, 19 nt, Human
aaugguuuuauugauucaa

SEQ ID NO: 577665 - RNA, 25 nt, Human
aauguaaagaagaaaccaaaagaaa

SEQ ID NO: 577666 - RNA, 20 nt, Human
agcaucucaucaagagucau

SEQ ID NO: 577667 - RNA, 24 nt, Human
augaaacaauaauauauuuacuac

SEQ ID NO: 577668 - RNA, 21 nt, Human
auggcuuuugggucauaucau

SEQ ID NO: 577669 - RNA, 21 nt, Human
caagagucaucaugaaacaau

SEQ ID NO: 577670 - RNA, 23 nt, Human
caauucuacaugauuuggaaaga

SEQ ID NO: 577671 - RNA, 19 nt, Human
cagaagagguuagguaaug

SEQ ID NO: 577672 - RNA, 24 nt, Human
cauuugcauacauacauauuaaug

SEQ ID NO: 577673 - RNA, 18 nt, Human
ccaguguggguuugucau

SEQ ID NO: 577674 - RNA, 23 nt, Human
cucuguugcugcuacuacuaaua

SEQ ID NO: 577675 - RNA, 23 nt, Human
cucuuuuucuuuuagaaagccuu

SEQ ID NO: 577676 - RNA, 23 nt, Human
gaaacguacaaagcccaugaaag

SEQ ID NO: 577677 - RNA, 21 nt, Human
uaaauguaaagaagaaaccaa

SEQ ID NO: 577678 - RNA, 18 nt, Human
uaauucagaguguguauu

SEQ ID NO: 577679 - RNA, 22 nt, Human
uacacugagaaaucucagaaac

SEQ ID NO: 577680 - RNA, 24 nt, Human
uacucuguugcugcuacuacuaau

SEQ ID NO: 577681 - RNA, 20 nt, Human
uaggaaacaagcauacacca

SEQ ID NO: 577682 - RNA, 18 nt, Human
ucagaguguguauuuuga

SEQ ID NO: 577683 - RNA, 23 nt, Human
ucucagaaacguacaaagcccau

SEQ ID NO: 577684 - RNA, 20 nt, Human
ugaacuggaaaucaauucua

SEQ ID NO: 577685 - RNA, 20 nt, Human
uggaaagaaaacaaacacau

SEQ ID NO: 577686 - RNA, 25 nt, Human
uguaaagaagaaaccaaaagaaaau

SEQ ID NO: 577687 - RNA, 18 nt, Human
uugaagcauccugccugu

SEQ ID NO: 577688 - RNA, 18 nt, Human
uuguauuguucguuuuca

SEQ ID NO: 577689 - RNA, 24 nt, Human
uuguuuauguuuuuccugaaguuc

SEQ ID NO: 577690 - RNA, 23 nt, Human
aagaaggaagugauguggcagag

SEQ ID NO: 577691 - RNA, 27 nt, Human
aagcgccccuuugagucuuucccaccc

SEQ ID NO: 577692 - RNA, 24 nt, Human
aagugcaccaggcuugagccccac

SEQ ID NO: 577693 - RNA, 18 nt, Human
aaugacaaaaaucaugua

SEQ ID NO: 577694 - RNA, 22 nt, Human
aaugacaaaaaucauguaggga

SEQ ID NO: 577695 - RNA, 21 nt, Human
acacacacacacacacacaca

SEQ ID NO: 577696 - RNA, 28 nt, Human
acacacacacacacgcauacgcacucuu

SEQ ID NO: 577697 - RNA, 19 nt, Human
acccugcuuaggcagggag

SEQ ID NO: 577698 - RNA, 19 nt, Human
agaaggaagugauguggca

SEQ ID NO: 577699 - RNA, 22 nt, Human
agaaggaagugauguggcagag

SEQ ID NO: 577700 - RNA, 18 nt, Human
agccugaguacguuagcu

SEQ ID NO: 577701 - RNA, 24 nt, Human
agccuggaggggggcaauuccuau

SEQ ID NO: 577702 - RNA, 19 nt, Human
agggaagaagggagugggu

SEQ ID NO: 577703 - RNA, 23 nt, Human
agggaagaagggagugggugggc

SEQ ID NO: 577704 - RNA, 23 nt, Human
agggagggugaagccuggagggg

SEQ ID NO: 577705 - RNA, 21 nt, Human
agggagugggugggcugaggg

SEQ ID NO: 577706 - RNA, 20 nt, Human
aucauaucccuccccagucc

SEQ ID NO: 577707 - RNA, 18 nt, Human
auuuucaaugaauucuga

SEQ ID NO: 577708 - RNA, 22 nt, Human
caagucgccuaggacuagggcu

SEQ ID NO: 577709 - RNA, 20 nt, Human
cacacacacacacacacaca

SEQ ID NO: 577710 - RNA, 26 nt, Human
cacacacacacacacacacacgcaua

SEQ ID NO: 577711 - RNA, 25 nt, Human
cacacacacacacacacacgcauac

SEQ ID NO: 577712 - RNA, 26 nt, Human
cacacacacacacacacgcauacgca

SEQ ID NO: 577713 - RNA, 21 nt, Human
caccuggggccucagugcuca

SEQ ID NO: 577714 - RNA, 26 nt, Human
cacguacacacacacacacacacaca

SEQ ID NO: 577715 - RNA, 23 nt, Human
cacucccguugucaggcccaggg

SEQ ID NO: 577716 - RNA, 23 nt, Human
ccaaaaaugucauggcucugccc

SEQ ID NO: 577717 - RNA, 23 nt, Human
ccaaaacaaauuuucaaugaauu

SEQ ID NO: 577718 - RNA, 20 nt, Human
ccaugaaugacaaaaaucau

SEQ ID NO: 577719 - RNA, 20 nt, Human
cccaacuauaugaccucuau

SEQ ID NO: 577720 - RNA, 21 nt, Human
cccacacagggaagaagggag

SEQ ID NO: 577721 - RNA, 22 nt, Human
ccccaaggcuucccuuguuggc

SEQ ID NO: 577722 - RNA, 18 nt, Human
ccccccacugcugacagc

SEQ ID NO: 577723 - RNA, 21 nt, Human
ccgacacagccggaggggucc

SEQ ID NO: 577724 - RNA, 22 nt, Human
ccgacacagccggagggguccu

SEQ ID NO: 577725 - RNA, 19 nt, Human
ccuagaagcccccucucag

SEQ ID NO: 577726 - RNA, 20 nt, Human
ccuguucucacccacccacc

SEQ ID NO: 577727 - RNA, 25 nt, Human
cguacacacacacacacacacacac

SEQ ID NO: 577728 - RNA, 21 nt, Human
cuagaaacccaaugccgaagg

SEQ ID NO: 577729 - RNA, 31 nt, Human
cugccucacguacacacacacacacacacag

SEQ ID NO: 577730 - RNA, 25 nt, Human
cugggaauccccugccagcuucaag

SEQ ID NO: 577731 - RNA, 23 nt, Human
cuuccuagaagcccccucucaga

SEQ ID NO: 577732 - RNA, 24 nt, Human
cuuccuagaagcccccucucagaa

SEQ ID NO: 577733 - RNA, 22 nt, Human
gaaccuguucucacccacccac

SEQ ID NO: 577734 - RNA, 18 nt, Human
gaagaagggagugggugg

SEQ ID NO: 577735 - RNA, 21 nt, Human
gaaggcuccuuuaaaccaaaa

SEQ ID NO: 577736 - RNA, 22 nt, Human
ggcugccaacaauugccccaug

SEQ ID NO: 577737 - RNA, 19 nt, Human
gggagggaggacaccuggg

SEQ ID NO: 577738 - RNA, 24 nt, Human
gggggagggaggacaccuggggcc

SEQ ID NO: 577739 - RNA, 22 nt, Human
gugggugggcugaggccuucag

SEQ ID NO: 577740 - RNA, 20 nt, Human
uacacacacacacacacaca

SEQ ID NO: 577741 - RNA, 25 nt, Human
uacacacacacacacacacacacgc

SEQ ID NO: 577742 - RNA, 24 nt, Human
uacugagccauauucccuagaaac

SEQ ID NO: 577743 - RNA, 19 nt, Human
uagaaacccaaugccgaag

SEQ ID NO: 577744 - RNA, 23 nt, Human
uaggcuuucaagaaggaagugau

SEQ ID NO: 577745 - RNA, 22 nt, Human
ucaggcccagggaggacccaug

SEQ ID NO: 577746 - RNA, 24 nt, Human
ucauggagcuuuauucagacggga

SEQ ID NO: 577747 - RNA, 19 nt, Human
ucccagacagugggggagg

SEQ ID NO: 577748 - RNA, 21 nt, Human
uccccugccagcuucaaggac

SEQ ID NO: 577749 - RNA, 23 nt, Human
ucccuccccaguccgacacagcc

SEQ ID NO: 577750 - RNA, 22 nt, Human
ucucggccagagaugagaaggc

SEQ ID NO: 577751 - RNA, 30 nt, Human
ucugccucacguacacacacacacacagug

SEQ ID NO: 577752 - RNA, 23 nt, Human
ucuuugugggcagggaggagagu

SEQ ID NO: 577753 - RNA, 23 nt, Human
ugacacagggagaagcugacauc

SEQ ID NO: 577754 - RNA, 20 nt, Human
ugagcuugcacaaggggccg

SEQ ID NO: 577755 - RNA, 18 nt, Human
ugagucuuucccacccag

SEQ ID NO: 577756 - RNA, 18 nt, Human
ugcccugagguccauggc

SEQ ID NO: 577757 - RNA, 22 nt, Human
ugccucaaccagccuauagcuc

SEQ ID NO: 577758 - RNA, 19 nt, Human
uggcccaacuauaugaccu

SEQ ID NO: 577759 - RNA, 22 nt, Human
ugggugggcugaggccuucagc

SEQ ID NO: 577760 - RNA, 23 nt, Human
uuugagucuuucccacccaggag

SEQ ID NO: 577761 - RNA, 24 nt, Human
aaacaaaaacaaacaagaaaccca

SEQ ID NO: 577762 - RNA, 25 nt, Human
aaacaagaaacccaaaacuugcaac

SEQ ID NO: 577763 - RNA, 21 nt, Human
aaacagaugagaaaugaaacu

SEQ ID NO: 577764 - RNA, 23 nt, Human
aaacucccaauggccaaagggcu

SEQ ID NO: 577765 - RNA, 24 nt, Human
aaacuugcaaccuaaacucuccgg

SEQ ID NO: 577766 - RNA, 25 nt, Human
aaagcaggaagcaaaacaaaaacaa

SEQ ID NO: 577767 - RNA, 19 nt, Human
aacacuuccagcccucccc

SEQ ID NO: 577768 - RNA, 21 nt, Human
aacacuuccagcccuccccuu

SEQ ID NO: 577769 - RNA, 19 nt, Human
aacuaugcagucacagagc

SEQ ID NO: 577770 - RNA, 19 nt, Human
aagaaacccaaaacuugca

SEQ ID NO: 577771 - RNA, 21 nt, Human
aagcaaaacaaaaacaaacaa

SEQ ID NO: 577772 - RNA, 27 nt, Human
aagcaggaagcaaaacaaaagggaccc

SEQ ID NO: 577773 - RNA, 18 nt, Human
aauaauaggagaguggaa

SEQ ID NO: 577774 - RNA, 19 nt, Human
aaugcagcccugauguacc

SEQ ID NO: 577775 - RNA, 20 nt, Human
acaaacaagaaacccaaaac

SEQ ID NO: 577776 - RNA, 20 nt, Human
acaacucaagcagccaacgg

SEQ ID NO: 577777 - RNA, 24 nt, Human
acccaaaacuugcaaccuaaacuc

SEQ ID NO: 577778 - RNA, 21 nt, Human
accccguccauggaaaaacug

SEQ ID NO: 577779 - RNA, 22 nt, Human
acccgcaagcugcccuuagucc

SEQ ID NO: 577780 - RNA, 20 nt, Human
acuggucccuggugccaaaa

SEQ ID NO: 577781 - RNA, 19 nt, Human
acuugugaaaucccucccc

SEQ ID NO: 577782 - RNA, 21 nt, Human
agaaaagacuuuucugugaga

SEQ ID NO: 577783 - RNA, 21 nt, Human
agaaacccaaaacuugcaacc

SEQ ID NO: 577784 - RNA, 24 nt, Human
agaauauaagaaacaacucaagca

SEQ ID NO: 577785 - RNA, 18 nt, Human
aggaagcaaaacaaaaac

SEQ ID NO: 577786 - RNA, 22 nt, Human
aggaagcaaaacaaaaacaaac

SEQ ID NO: 577787 - RNA, 23 nt, Human
augaaacaaacaggucucccuuc

SEQ ID NO: 577788 - RNA, 19 nt, Human
auggaaugagagaagcccu

SEQ ID NO: 577789 - RNA, 24 nt, Human
caaaaacaaacaagaaacccaaaa

SEQ ID NO: 577790 - RNA, 20 nt, Human
caaaacaaaaacaaacaaga

SEQ ID NO: 577791 - RNA, 25 nt, Human
caaaacaaaaacaaacaagaaaccc

SEQ ID NO: 577792 - RNA, 19 nt, Human
caaacaagaaacccaaaac

SEQ ID NO: 577793 - RNA, 21 nt, Human
caaacucccaauggccaaagg

SEQ ID NO: 577794 - RNA, 23 nt, Human
caagaaacccaaaacuugcaacc

SEQ ID NO: 577795 - RNA, 19 nt, Human
caagggcugaaacacagua

SEQ ID NO: 577796 - RNA, 22 nt, Human
cacaguaagguuagccacaaaa

SEQ ID NO: 577797 - RNA, 19 nt, Human
caccugaaaucaaauccau

SEQ ID NO: 577798 - RNA, 20 nt, Human
cagaggcccacaggugaaaa

SEQ ID NO: 577799 - RNA, 22 nt, Human
cagcaagggcugaaacacagua

SEQ ID NO: 577800 - RNA, 21 nt, Human
cagcauuaaaauccagccuga

SEQ ID NO: 577801 - RNA, 25 nt, Human
ccaaaacuugcaaccuaaacucucc

SEQ ID NO: 577802 - RNA, 26 nt, Human
ccaccaccccguccauggaaaaacug

SEQ ID NO: 577803 - RNA, 21 nt, Human
ccagugccuuucuagugcucu

SEQ ID NO: 577804 - RNA, 22 nt, Human
cccaaacagaugagaaaugaaa

SEQ ID NO: 577805 - RNA, 19 nt, Human
cccaaacucuaacauugua

SEQ ID NO: 577806 - RNA, 25 nt, Human
ccuaaacucuccgggaaaaaaaaaa

SEQ ID NO: 577807 - RNA, 23 nt, Human
cuagugcucuaaaaucaucuccc

SEQ ID NO: 577808 - RNA, 19 nt, Human
cucccaaacagaugagaaa

SEQ ID NO: 577809 - RNA, 23 nt, Human
cucccaaacagaugagaaaugaa

SEQ ID NO: 577810 - RNA, 19 nt, Human
cucuccgggaaaaaaaaaa

SEQ ID NO: 577811 - RNA, 20 nt, Human
cuggaaaagcagcauuaaaa

SEQ ID NO: 577812 - RNA, 19 nt, Human
cuggucccuggugccaaaa

SEQ ID NO: 577813 - RNA, 18 nt, Human
cuugugaaaucccucccc

SEQ ID NO: 577814 - RNA, 19 nt, Human
cuugugaaaucccucccca

SEQ ID NO: 577815 - RNA, 25 nt, Human
gaaaucccuccccacaccugcacuu

SEQ ID NO: 577816 - RNA, 20 nt, Human
gcagucacagagcuaacccg

SEQ ID NO: 577817 - RNA, 21 nt, Human
ggaaaaacuguguuccacaaa

SEQ ID NO: 577818 - RNA, 25 nt, Human
ggccaaagggcugugaggaagggca

SEQ ID NO: 577819 - RNA, 26 nt, Human
gggaaaaaaaaaauugcuauaaaugu

SEQ ID NO: 577820 - RNA, 23 nt, Human
gggcaaugaagagggaccuauuu

SEQ ID NO: 577821 - RNA, 22 nt, Human
ggugaugggcaaugaagaggga

SEQ ID NO: 577822 - RNA, 23 nt, Human
guggaaguuucauccuccaccac

SEQ ID NO: 577823 - RNA, 24 nt, Human
uaaagcaggaagcaaaacaaaaac

SEQ ID NO: 577824 - RNA, 23 nt, Human
uaagaaacaacucaagcagccaa

SEQ ID NO: 577825 - RNA, 22 nt, Human
uaauaggagaguggaagauggu

SEQ ID NO: 577826 - RNA, 18 nt, Human
uaauagggauucaucugu

SEQ ID NO: 577827 - RNA, 18 nt, Human
uaaugaacccaaacucua

SEQ ID NO: 577828 - RNA, 22 nt, Human
uacuggaaaagcagcauuaaaa

SEQ ID NO: 577829 - RNA, 24 nt, Human
uaggagaguggaagauggugaugg

SEQ ID NO: 577830 - RNA, 20 nt, Human
uauaaauguuaaaagacuua

SEQ ID NO: 577831 - RNA, 18 nt, Human
uaucaaagaucaaacggc

SEQ ID NO: 577832 - RNA, 19 nt, Human
uaucaaagaucaaacggca

SEQ ID NO: 577833 - RNA, 23 nt, Human
uaucaaagaucaaacggcagcaa

SEQ ID NO: 577834 - RNA, 23 nt, Human
ucauggaagaaaagacuuuucug

SEQ ID NO: 577835 - RNA, 19 nt, Human
uccauagccaauggugagg

SEQ ID NO: 577836 - RNA, 30 nt, Human
ugaaacaaacaggucucccuucuugaguag

SEQ ID NO: 577837 - RNA, 18 nt, Human
ugaacuggccguuaauaa

SEQ ID NO: 577838 - RNA, 20 nt, Human
ugagaaaugaaacaaacagg

SEQ ID NO: 577839 - RNA, 18 nt, Human
ugagagaagcccuaaccc

SEQ ID NO: 577840 - RNA, 23 nt, Human
ugagauagaacagaccaucugcu

SEQ ID NO: 577841 - RNA, 21 nt, Human
ugagggacagccaaacuccca

SEQ ID NO: 577842 - RNA, 24 nt, Human
ugaguaguggcaaaauaauaggag

SEQ ID NO: 577843 - RNA, 19 nt, Human
uggaagauggugaugggca

SEQ ID NO: 577844 - RNA, 20 nt, Human
uguacacacucaacacuucu

SEQ ID NO: 577845 - RNA, 18 nt, Human
ugucucuuccuaccuucc

SEQ ID NO: 577846 - RNA, 19 nt, Human
uucaaacugcuggauguuu

SEQ ID NO: 577847 - RNA, 25 nt, Human
uucuagugcucuaaaaucaucuccc

SEQ ID NO: 577848 - RNA, 22 nt, Human
uuuacagaauuucucaccagag

SEQ ID NO: 577849 - RNA, 19 nt, Human
uuuagaauauaagaaacaa

SEQ ID NO: 577850 - RNA, 23 nt, Human
aaaacugagcuauaucugaauaa

SEQ ID NO: 577851 - RNA, 22 nt, Human
aacugaaggaaaaaauggauaa

SEQ ID NO: 577852 - RNA, 24 nt, Human
aauuuuguguauuuuuaguagaga

SEQ ID NO: 577853 - RNA, 19 nt, Human
acccaggcuggagugcagu

SEQ ID NO: 577854 - RNA, 25 nt, Human
accucccagguucacaccauucucc

SEQ ID NO: 577855 - RNA, 24 nt, Human
accucgugauccgcccgccuuggc

SEQ ID NO: 577856 - RNA, 21 nt, Human
acugcaagcuccaccucccag

SEQ ID NO: 577857 - RNA, 22 nt, Human
aggaagauaaaagacucugcca

SEQ ID NO: 577858 - RNA, 25 nt, Human
aggcuggagugcaguggagcgaucu

SEQ ID NO: 577859 - RNA, 21 nt, Human
aggugagguugcaagauggcu

SEQ ID NO: 577860 - RNA, 18 nt, Human
aguagcugggacuacagg

SEQ ID NO: 577861 - RNA, 20 nt, Human
agugcaguggagcgaucucg

SEQ ID NO: 577862 - RNA, 24 nt, Human
agugcaguggagcgaucucgguuc

SEQ ID NO: 577863 - RNA, 23 nt, Human
aucaucuucaccauuaaacuaac

SEQ ID NO: 577864 - RNA, 19 nt, Human
auccgcccgccuuggccuc

SEQ ID NO: 577865 - RNA, 24 nt, Human
aucugucacccaggcuggagugca

SEQ ID NO: 577866 - RNA, 20 nt, Human
augggguuucacgguguuag

SEQ ID NO: 577867 - RNA, 27 nt, Human
auugaaacaaucauuuacuucaagcau

SEQ ID NO: 577868 - RNA, 18 nt, Human
caagauggcuggucucug

SEQ ID NO: 577869 - RNA, 22 nt, Human
cacaccauucuccugccucagc

SEQ ID NO: 577870 - RNA, 25 nt, Human
cacccaggcuggagugcaguggagc

SEQ ID NO: 577871 - RNA, 24 nt, Human
cacgguguuagccaggacggucuc

SEQ ID NO: 577872 - RNA, 21 nt, Human
cacugcaagcuccaccuccca

SEQ ID NO: 577873 - RNA, 19 nt, Human
caggugcccaccaccacgc

SEQ ID NO: 577874 - RNA, 21 nt, Human
caggugcccaccaccacgccc

SEQ ID NO: 577875 - RNA, 27 nt, Human
ccagauacguaaauauauuuauguaac

SEQ ID NO: 577876 - RNA, 21 nt, Human
cccaccaccacgcccagcuaa

SEQ ID NO: 577877 - RNA, 20 nt, Human
cccagguucacaccauucuc

SEQ ID NO: 577878 - RNA, 23 nt, Human
cccgaguagcugggacuacaggu

SEQ ID NO: 577879 - RNA, 24 nt, Human
cccgaguagcugggacuacaggug

SEQ ID NO: 577880 - RNA, 22 nt, Human
cccgccuuggccucccaaagug

SEQ ID NO: 577881 - RNA, 24 nt, Human
cucagccucccgaguagcugggac

SEQ ID NO: 577882 - RNA, 24 nt, Human
cuccugaccucgugauccgcccgc

SEQ ID NO: 577883 - RNA, 24 nt, Human
cugcaagcuccaccucccagguuc

SEQ ID NO: 577884 - RNA, 23 nt, Human
cugccucagccucccgaguagcu

SEQ ID NO: 577885 - RNA, 20 nt, Human
gaccucgugauccgcccgcc

SEQ ID NO: 577886 - RNA, 21 nt, Human
gaccucgugauccgcccgccu

SEQ ID NO: 577887 - RNA, 24 nt, Human
gaccucgugauccgcccgccuugg

SEQ ID NO: 577888 - RNA, 23 nt, Human
gacggucucgaucuccugaccuc

SEQ ID NO: 577889 - RNA, 22 nt, Human
gcaagcuccaccucccagguuc

SEQ ID NO: 577890 - RNA, 20 nt, Human
gccucagccucccgaguagc

SEQ ID NO: 577891 - RNA, 22 nt, Human
gccuuggccucccaaagugcug

SEQ ID NO: 577892 - RNA, 19 nt, Human
ggcuggagugcaguggagc

SEQ ID NO: 577893 - RNA, 18 nt, Human
gggguuucacgguguuag

SEQ ID NO: 577894 - RNA, 22 nt, Human
ggguuucacgguguuagccagg

SEQ ID NO: 577895 - RNA, 21 nt, Human
uaacugagaagaguaugauau

SEQ ID NO: 577896 - RNA, 24 nt, Human
uaauuuuguguauuuuuaguagag

SEQ ID NO: 577897 - RNA, 24 nt, Human
uacaggugcccaccaccacgccca

SEQ ID NO: 577898 - RNA, 19 nt, Human
uacguaaauauauuuaugu

SEQ ID NO: 577899 - RNA, 21 nt, Human
uagaaaauguguaauuuccaa

SEQ ID NO: 577900 - RNA, 20 nt, Human
uaguagagaugggguuucac

SEQ ID NO: 577901 - RNA, 22 nt, Human
uaguagagaugggguuucacgg

SEQ ID NO: 577902 - RNA, 24 nt, Human
uaguagagaugggguuucacggug

SEQ ID NO: 577903 - RNA, 22 nt, Human
uaugcacacagaagagugagua

SEQ ID NO: 577904 - RNA, 21 nt, Human
ucacaccauucuccugccuca

SEQ ID NO: 577905 - RNA, 23 nt, Human
ucacccaggcuggagugcagugg

SEQ ID NO: 577906 - RNA, 24 nt, Human
ucacgguguuagccaggacggucu

SEQ ID NO: 577907 - RNA, 19 nt, Human
ucacugcaagcuccaccuc

SEQ ID NO: 577908 - RNA, 24 nt, Human
ucacugcaagcuccaccucccagg

SEQ ID NO: 577909 - RNA, 23 nt, Human
ucagccucccgaguagcugggac

SEQ ID NO: 577910 - RNA, 20 nt, Human
ucccagguucacaccauucu

SEQ ID NO: 577911 - RNA, 21 nt, Human
ucccagguucacaccauucuc

SEQ ID NO: 577912 - RNA, 24 nt, Human
ucccagguucacaccauucuccug

SEQ ID NO: 577913 - RNA, 19 nt, Human
uccccuguuaaucaucuuc

SEQ ID NO: 577914 - RNA, 23 nt, Human
ucccgaguagcugggacuacagg

SEQ ID NO: 577915 - RNA, 24 nt, Human
ucccgaguagcugggacuacaggu

SEQ ID NO: 577916 - RNA, 22 nt, Human
uccuugccaggcuuugagauga

SEQ ID NO: 577917 - RNA, 20 nt, Human
ucggccuuaugcacacagaa

SEQ ID NO: 577918 - RNA, 24 nt, Human
ucuccugccucagccucccgagua

SEQ ID NO: 577919 - RNA, 23 nt, Human
ucucuguggcguguugagugcuc

SEQ ID NO: 577920 - RNA, 24 nt, Human
ucuggaucugucacccaggcugga

SEQ ID NO: 577921 - RNA, 20 nt, Human
ucugucacccaggcuggagu

SEQ ID NO: 577922 - RNA, 24 nt, Human
ucugucacccaggcuggagugcag

SEQ ID NO: 577923 - RNA, 18 nt, Human
ugaaggaaaaaauggaua

SEQ ID NO: 577924 - RNA, 19 nt, Human
ugaauaacugagaagagua

SEQ ID NO: 577925 - RNA, 20 nt, Human
ugagacagagucuggaucug

SEQ ID NO: 577926 - RNA, 22 nt, Human
ugagacagagucuggaucuguc

SEQ ID NO: 577927 - RNA, 25 nt, Human
ugagauuuuaauaggaagauaaaag

SEQ ID NO: 577928 - RNA, 19 nt, Human
ugaggugagguugcaagau

SEQ ID NO: 577929 - RNA, 19 nt, Human
ugcaagcuccaccucccag

SEQ ID NO: 577930 - RNA, 24 nt, Human
ugccagaaguauucuuuacuggcu

SEQ ID NO: 577931 - RNA, 24 nt, Human
ugccucagccucccgaguagcugg

SEQ ID NO: 577932 - RNA, 23 nt, Human
uggagugcaguggagcgaucucg

SEQ ID NO: 577933 - RNA, 24 nt, Human
uggagugcaguggagcgaucucgg

SEQ ID NO: 577934 - RNA, 24 nt, Human
uggaucugucacccaggcuggagu

SEQ ID NO: 577935 - RNA, 21 nt, Human
ugggacuacaggugcccacca

SEQ ID NO: 577936 - RNA, 24 nt, Human
ugggacuacaggugcccaccacca

SEQ ID NO: 577937 - RNA, 24 nt, Human
ugggguuucacgguguuagccagg

SEQ ID NO: 577938 - RNA, 20 nt, Human
uuaaaagugaaagggaaaau

SEQ ID NO: 577939 - RNA, 21 nt, Human
uuacuucaagcauuuccccug

SEQ ID NO: 577940 - RNA, 18 nt, Human
uuaguagagaugggguuu

SEQ ID NO: 577941 - RNA, 21 nt, Human
uuaguagagaugggguuucac

SEQ ID NO: 577942 - RNA, 24 nt, Human
uuaguagagaugggguuucacggu

SEQ ID NO: 577943 - RNA, 22 nt, Human
uugagacagagucuggaucugu

SEQ ID NO: 577944 - RNA, 24 nt, Human
uuuuguguauuuuuaguagagaug

SEQ ID NO: 577945 - RNA, 24 nt, Human
uuuuuaguagagaugggguuucac

SEQ ID NO: 577946 - RNA, 22 nt, Human
uuuuuuuugagacagagucugg

SEQ ID NO: 577947 - RNA, 23 nt, Human
uuuuuuuuugagacagagucugg

SEQ ID NO: 577948 - RNA, 18 nt, Human
uuuuuuuuuuuuuuuuug

SEQ ID NO: 577949 - RNA, 20 nt, Human
aaacaauaaguauucaaagu

SEQ ID NO: 577950 - RNA, 22 nt, Human
aauaagugaguggaagcuacaa

SEQ ID NO: 577951 - RNA, 22 nt, Human
aaucaaacaucuaccaauggcc

SEQ ID NO: 577952 - RNA, 20 nt, Human
caaacaucuaccaauggcca

SEQ ID NO: 577953 - RNA, 23 nt, Human
caaacaucuaccaauggccaaug

SEQ ID NO: 577954 - RNA, 18 nt, Human
caaggggagauuaucugc

SEQ ID NO: 577955 - RNA, 21 nt, Human
cauaagcaaaaaauucaaugc

SEQ ID NO: 577956 - RNA, 23 nt, Human
cccacugcaaacaaagaauugau

SEQ ID NO: 577957 - RNA, 23 nt, Human
ccuuaguuacgagugccugagag

SEQ ID NO: 577958 - RNA, 19 nt, Human
cucugaaugcaagaauaag

SEQ ID NO: 577959 - RNA, 20 nt, Human
gagcacucgacuaugcuaaa

SEQ ID NO: 577960 - RNA, 24 nt, Human
gagguugcaacuaucuuucucuag

SEQ ID NO: 577961 - RNA, 23 nt, Human
gaucuuucuuucucaaaaaccac

SEQ ID NO: 577962 - RNA, 23 nt, Human
ggugagguugcaacuaucuuucu

SEQ ID NO: 577963 - RNA, 18 nt, Human
uaacaugacauagcuugg

SEQ ID NO: 577964 - RNA, 18 nt, Human
uaagauuacccacugcaa

SEQ ID NO: 577965 - RNA, 22 nt, Human
uaagucaaucaaacaucuacca

SEQ ID NO: 577966 - RNA, 20 nt, Human
uagagagaaucuagaagaaa

SEQ ID NO: 577967 - RNA, 21 nt, Human
ucaaaguguugagugagggag

SEQ ID NO: 577968 - RNA, 18 nt, Human
ucuacaaucaucuccauc

SEQ ID NO: 577969 - RNA, 19 nt, Human
ucuacaaucaucuccaucu

SEQ ID NO: 577970 - RNA, 23 nt, Human
ucuuucucaaaaaccacauggga

SEQ ID NO: 577971 - RNA, 19 nt, Human
uucacuuuuucagcauuug

SEQ ID NO: 577972 - RNA, 23 nt, Human
uucucugcaugucuaaggaagaa

SEQ ID NO: 577973 - RNA, 22 nt, Human
uuuuuggucucuugcauacauu

SEQ ID NO: 577974 - RNA, 27 nt, Human
uuuuuggucucuugcauacauuuucuc

SEQ ID NO: 577975 - RNA, 23 nt, Human
aaauaauggaaacacaugaaauc

SEQ ID NO: 577976 - RNA, 20 nt, Human
aacaaauaauggaaacacau

SEQ ID NO: 577977 - RNA, 21 nt, Human
aacuucuaguuaccuuuuccu

SEQ ID NO: 577978 - RNA, 20 nt, Human
aagauaucagcaauaagaug

SEQ ID NO: 577979 - RNA, 23 nt, Human
aauagacaaaucccuagcauucu

SEQ ID NO: 577980 - RNA, 23 nt, Human
acagagcaugauggccuucaaaa

SEQ ID NO: 577981 - RNA, 24 nt, Human
acagauacaucugugcauguuccu

SEQ ID NO: 577982 - RNA, 19 nt, Human
agcacaguuuuucccagac

SEQ ID NO: 577983 - RNA, 18 nt, Human
agcacccugugguggugg

SEQ ID NO: 577984 - RNA, 18 nt, Human
agcuuuuuuuuuaaaagg

SEQ ID NO: 577985 - RNA, 26 nt, Human
auacagauacaucugugcauguuccu

SEQ ID NO: 577986 - RNA, 23 nt, Human
auggucuacauggguaaaaauga

SEQ ID NO: 577987 - RNA, 23 nt, Human
auugcuacugcugcuacuguugu

SEQ ID NO: 577988 - RNA, 19 nt, Human
caaaccaggaaacccugcc

SEQ ID NO: 577989 - RNA, 26 nt, Human
caacauugaaaauucuucagaaacau

SEQ ID NO: 577990 - RNA, 21 nt, Human
cacuauuucuuuguacaauaa

SEQ ID NO: 577991 - RNA, 20 nt, Human
cagcagcaagaaaaaaaauc

SEQ ID NO: 577992 - RNA, 23 nt, Human
cagcagcaagaaaaaaaauccau

SEQ ID NO: 577993 - RNA, 24 nt, Human
cagcagcaagaaaaaaaauccauu

SEQ ID NO: 577994 - RNA, 21 nt, Human
cauagaaaccaaagaauuuug

SEQ ID NO: 577995 - RNA, 26 nt, Human
ccaauauccauuuuugaguuuucuca

SEQ ID NO: 577996 - RNA, 22 nt, Human
ccagugcagcacaguuuuuccc

SEQ ID NO: 577997 - RNA, 22 nt, Human
ccugugguggugguagcuaucu

SEQ ID NO: 577998 - RNA, 18 nt, Human
cucacaaaccaggaaacc

SEQ ID NO: 577999 - RNA, 21 nt, Human
cugaauacaaacaaaagcuag

SEQ ID NO: 578000 - RNA, 22 nt, Human
cugauaucaccaugaaauucug

SEQ ID NO: 578001 - RNA, 25 nt, Human
cugaucaaaaaaauuuuguaucacu

SEQ ID NO: 578002 - RNA, 23 nt, Human
cuuguacaugacaauacuguaca

SEQ ID NO: 578003 - RNA, 21 nt, Human
gaacaauauucaaaaugacac

SEQ ID NO: 578004 - RNA, 24 nt, Human
gagaauuucacaauggggaaagga

SEQ ID NO: 578005 - RNA, 21 nt, Human
gccuuuuuuuuauuagaaagc

SEQ ID NO: 578006 - RNA, 23 nt, Human
uaaauaaccaauauuuaauuccu

SEQ ID NO: 578007 - RNA, 24 nt, Human
uaaauacuaaagaaaugaagagaa

SEQ ID NO: 578008 - RNA, 25 nt, Human
uaagaugauauccuuauauuacaga

SEQ ID NO: 578009 - RNA, 23 nt, Human
uaaggauagcaaacuaggauaag

SEQ ID NO: 578010 - RNA, 22 nt, Human
uaaucucuugaccauugaucac

SEQ ID NO: 578011 - RNA, 23 nt, Human
uacacugguagucucugguaggu

SEQ ID NO: 578012 - RNA, 21 nt, Human
uagcacccuguggugguggua

SEQ ID NO: 578013 - RNA, 21 nt, Human
uagcugugcuuuggcugcugc

SEQ ID NO: 578014 - RNA, 20 nt, Human
uauacagauacaucugugca

SEQ ID NO: 578015 - RNA, 20 nt, Human
uauagaaaaagaguuucuca

SEQ ID NO: 578016 - RNA, 22 nt, Human
uauauacagauacaucugugca

SEQ ID NO: 578017 - RNA, 24 nt, Human
uauucaaaaugacacagauugacu

SEQ ID NO: 578018 - RNA, 22 nt, Human
ucagcaauaagaugauauccuu

SEQ ID NO: 578019 - RNA, 19 nt, Human
ucagcagcaagaaaaaaaa

SEQ ID NO: 578020 - RNA, 18 nt, Human
ucaguguugccacugccg

SEQ ID NO: 578021 - RNA, 20 nt, Human
ucccaauagacaaaucccua

SEQ ID NO: 578022 - RNA, 23 nt, Human
ucugauaucaccaugaaauucug

SEQ ID NO: 578023 - RNA, 18 nt, Human
ucugcuagggacucucca

SEQ ID NO: 578024 - RNA, 23 nt, Human
ucugcuagggacucuccaaagau

SEQ ID NO: 578025 - RNA, 19 nt, Human
ugaauacaaacaaaagcua

SEQ ID NO: 578026 - RNA, 22 nt, Human
ugacaacaaauaauggaaacac

SEQ ID NO: 578027 - RNA, 19 nt, Human
ugccauugugaaaaaaauc

SEQ ID NO: 578028 - RNA, 22 nt, Human
uggcuuauuuugcaguuuggaa

SEQ ID NO: 578029 - RNA, 22 nt, Human
uguacaauaaaagauaaagugu

SEQ ID NO: 578030 - RNA, 22 nt, Human
ugugaaaaaaaucagcuuccca

SEQ ID NO: 578031 - RNA, 23 nt, Human
uuagcacccugugguggugguag

SEQ ID NO: 578032 - RNA, 21 nt, Human
uuauagaaaaagaguuucuca

SEQ ID NO: 578033 - RNA, 22 nt, Human
uugcuagcugugcuuuggcugc

SEQ ID NO: 578034 - RNA, 21 nt, Human
uuggcugcugcugagaguaaa

SEQ ID NO: 578035 - RNA, 24 nt, Human
uuguaucacuguuucuuuuagcag

SEQ ID NO: 578036 - RNA, 27 nt, Human
uuuaaagugcuauguccuucaguguug

SEQ ID NO: 578037 - RNA, 18 nt, Human
uuuucccagacuguacaa

SEQ ID NO: 578038 - RNA, 24 nt, Human
uuuuugaguuuucucaaacaaaua

SEQ ID NO: 578039 - RNA, 20 nt, Human
aaaaaaaaaauuguuuaagc

SEQ ID NO: 578040 - RNA, 23 nt, Human
aaacauaacaaaacauaaagccu

SEQ ID NO: 578041 - RNA, 20 nt, Human
aagaggccaaaagagccacc

SEQ ID NO: 578042 - RNA, 25 nt, Human
aagaggccaaaagagccacugaaau

SEQ ID NO: 578043 - RNA, 24 nt, Human
aagauaccacuuuuauuaaaaaug

SEQ ID NO: 578044 - RNA, 19 nt, Human
aaguguuggagaccaacuu

SEQ ID NO: 578045 - RNA, 23 nt, Human
acaacgaaaacacaaacauaaca

SEQ ID NO: 578046 - RNA, 20 nt, Human
acacugccucucaaaaaaua

SEQ ID NO: 578047 - RNA, 19 nt, Human
aggguuucauugccccaga

SEQ ID NO: 578048 - RNA, 23 nt, Human
aguuucucccgcagcagcaauuu

SEQ ID NO: 578049 - RNA, 21 nt, Human
auguuagccuggaacacuauu

SEQ ID NO: 578050 - RNA, 24 nt, Human
caaacauaacaaaacauaaagccu

SEQ ID NO: 578051 - RNA, 24 nt, Human
cacaaacauaacaaaacauaaagc

SEQ ID NO: 578052 - RNA, 20 nt, Human
cacaauuuagaccacaaaaa

SEQ ID NO: 578053 - RNA, 28 nt, Human
cacaauuuagaccacaaaaaaaucuugu

SEQ ID NO: 578054 - RNA, 21 nt, Human
caugaucaggguuucauugcc

SEQ ID NO: 578055 - RNA, 22 nt, Human
ccaguguggcaaagaaaaaaaa

SEQ ID NO: 578056 - RNA, 27 nt, Human
ccggcuacagcggcuccaguuucuccc

SEQ ID NO: 578057 - RNA, 22 nt, Human
ccuacuggaaaccuauauacca

SEQ ID NO: 578058 - RNA, 23 nt, Human
cgaaaacacaaacauaacaaaac

SEQ ID NO: 578059 - RNA, 23 nt, Human
cgccuggaggaagggugacucuu

SEQ ID NO: 578060 - RNA, 20 nt, Human
cgggugagggggccggcgcc

SEQ ID NO: 578061 - RNA, 19 nt, Human
cucauggauaaagaaugaa

SEQ ID NO: 578062 - RNA, 23 nt, Human
gaaaacacaaacauaacaaaaca

SEQ ID NO: 578063 - RNA, 21 nt, Human
gaaacaagacuauccccccua

SEQ ID NO: 578064 - RNA, 18 nt, Human
gacucuugucuccuccuc

SEQ ID NO: 578065 - RNA, 21 nt, Human
gaggagacuguuaaggaaagg

SEQ ID NO: 578066 - RNA, 21 nt, Human
gcaauguuauucuagccauau

SEQ ID NO: 578067 - RNA, 23 nt, Human
gcccacaauuuagaccacaaaaa

SEQ ID NO: 578068 - RNA, 21 nt, Human
gggccggcgccgccuggagga

SEQ ID NO: 578069 - RNA, 23 nt, Human
gugacucuugucuccuccucguc

SEQ ID NO: 578070 - RNA, 21 nt, Human
uaaccaucaacaacaugauca

SEQ ID NO: 578071 - RNA, 18 nt, Human
uaagugagcaaagccugg

SEQ ID NO: 578072 - RNA, 20 nt, Human
uagaucauuaacacugccuc

SEQ ID NO: 578073 - RNA, 24 nt, Human
uagccuggaacacuauuuuuucag

SEQ ID NO: 578074 - RNA, 23 nt, Human
uauaaaaaccauuuacauauggu

SEQ ID NO: 578075 - RNA, 24 nt, Human
uaugcuaaccaucaacaacaugau

SEQ ID NO: 578076 - RNA, 18 nt, Human
ucaggguuucauugcccc

SEQ ID NO: 578077 - RNA, 22 nt, Human
uccccccuaguaagaggccaaa

SEQ ID NO: 578078 - RNA, 18 nt, Human
ugaagaggcggcgguugg

SEQ ID NO: 578079 - RNA, 21 nt, Human
ugaccggcaaagcggccgccu

SEQ ID NO: 578080 - RNA, 19 nt, Human
ugaccuacuggaaaccuau

SEQ ID NO: 578081 - RNA, 28 nt, Human
uggaacacuauuuuuucaggacaaaggu

SEQ ID NO: 578082 - RNA, 18 nt, Human
uggcaaagaaaaaaaaau

SEQ ID NO: 578083 - RNA, 22 nt, Human
uguaaaaaagaagacucacucc

SEQ ID NO: 578084 - RNA, 19 nt, Human
uugguccagggaauguugc

SEQ ID NO: 578085 - RNA, 21 nt, Human
uuuacaaaggcuuucaaauuc

SEQ ID NO: 578086 - RNA, 23 nt, Human
aaaauuucucuaugcuccugcca

SEQ ID NO: 578087 - RNA, 24 nt, Human
aaacaagauuagcucaauuaugaa

SEQ ID NO: 578088 - RNA, 18 nt, Human
acauuuacucagcuggau

SEQ ID NO: 578089 - RNA, 21 nt, Human
agaaacaaggauugggaaaaa

SEQ ID NO: 578090 - RNA, 20 nt, Human
agagcuagaguggaugggcc

SEQ ID NO: 578091 - RNA, 20 nt, Human
agagguugguggggaguugc

SEQ ID NO: 578092 - RNA, 21 nt, Human
agcagugacacagacggguga

SEQ ID NO: 578093 - RNA, 18 nt, Human
agcaguucagccuagccc

SEQ ID NO: 578094 - RNA, 21 nt, Human
agcccuuggucaccacagccc

SEQ ID NO: 578095 - RNA, 26 nt, Human
aggcaaguagaggacauggacuccag

SEQ ID NO: 578096 - RNA, 21 nt, Human
aggccggaggcaaguagagga

SEQ ID NO: 578097 - RNA, 22 nt, Human
agggcuagggaaacaagauuag

SEQ ID NO: 578098 - RNA, 21 nt, Human
aggugcuaaagucagugggcc

SEQ ID NO: 578099 - RNA, 18 nt, Human
auaggccaaugagccugu

SEQ ID NO: 578100 - RNA, 22 nt, Human
aucucaaagucccucuccgcca

SEQ ID NO: 578101 - RNA, 19 nt, Human
augggacaccgauaggcca

SEQ ID NO: 578102 - RNA, 25 nt, Human
cacaucuguccacucauucauucaa

SEQ ID NO: 578103 - RNA, 18 nt, Human
caccacagcccaagaggu

SEQ ID NO: 578104 - RNA, 22 nt, Human
cagguaccaguucagacagcag

SEQ ID NO: 578105 - RNA, 23 nt, Human
cauucauucaacacacauguaug

SEQ ID NO: 578106 - RNA, 21 nt, Human
cccaugcagcagagaugagca

SEQ ID NO: 578107 - RNA, 20 nt, Human
ccccaugcagcagagaugag

SEQ ID NO: 578108 - RNA, 18 nt, Human
ccuccacggagugugagg

SEQ ID NO: 578109 - RNA, 23 nt, Human
ccuuggucaccacagcccaagag

SEQ ID NO: 578110 - RNA, 18 nt, Human
cuagccccaugcagcaga

SEQ ID NO: 578111 - RNA, 19 nt, Human
cuccuaggaccagcccuca

SEQ ID NO: 578112 - RNA, 20 nt, Human
gaguggaugggccugacccu

SEQ ID NO: 578113 - RNA, 23 nt, Human
gauaaaaauuucucuaugcuccu

SEQ ID NO: 578114 - RNA, 26 nt, Human
gcagcagagaugagcaagcauccaga

SEQ ID NO: 578115 - RNA, 18 nt, Human
gcccuaagggcauggacu

SEQ ID NO: 578116 - RNA, 18 nt, Human
gcuaaagucagugggcca

SEQ ID NO: 578117 - RNA, 22 nt, Human
ggaccucagcagguaccaguuc

SEQ ID NO: 578118 - RNA, 18 nt, Human
ggaguugcuuuagaaaca

SEQ ID NO: 578119 - RNA, 20 nt, Human
ggaugcccuaagggcaugga

SEQ ID NO: 578120 - RNA, 18 nt, Human
gggcauggacuccagcag

SEQ ID NO: 578121 - RNA, 25 nt, Human
ggucaccacagcccaagagguuggu

SEQ ID NO: 578122 - RNA, 22 nt, Human
gucagagagcagagguggagau

SEQ ID NO: 578123 - RNA, 18 nt, Human
uagccccaugcagcagag

SEQ ID NO: 578124 - RNA, 23 nt, Human
uagcucaauuaugaaaaauaacc

SEQ ID NO: 578125 - RNA, 22 nt, Human
uaggaccagcccucaucauucc

SEQ ID NO: 578126 - RNA, 28 nt, Human
uccuaggaccagcccucaucccacggug

SEQ ID NO: 578127 - RNA, 21 nt, Human
ucgcguggcuccuaggaccag

SEQ ID NO: 578128 - RNA, 18 nt, Human
ucucuaugcuccugccau

SEQ ID NO: 578129 - RNA, 22 nt, Human
ucucuguaauaagagcuagagu

SEQ ID NO: 578130 - RNA, 23 nt, Human
ugagggaccuggaaguguccaug

SEQ ID NO: 578131 - RNA, 27 nt, Human
ugagggaccuggaaguguccauguccu

SEQ ID NO: 578132 - RNA, 24 nt, Human
ugcccuaaccagauggaccucagc

SEQ ID NO: 578133 - RNA, 18 nt, Human
ugcuuuagaaacacccag

SEQ ID NO: 578134 - RNA, 20 nt, Human
uggaccucagcagguaccag

SEQ ID NO: 578135 - RNA, 20 nt, Human
uggcacauacaagcuuugug

SEQ ID NO: 578136 - RNA, 20 nt, Human
uggcuccuaggaccagcccu

SEQ ID NO: 578137 - RNA, 18 nt, Human
uggcuugaagcuuauccu

SEQ ID NO: 578138 - RNA, 24 nt, Human
ugggagaaggucagcccuuggcuu

SEQ ID NO: 578139 - RNA, 23 nt, Human
ugucagaaguggagcaaaaguca

SEQ ID NO: 578140 - RNA, 20 nt, Human
ugucauagggcugcugucuc

SEQ ID NO: 578141 - RNA, 19 nt, Human
ugucuccucuagcuccucc

SEQ ID NO: 578142 - RNA, 22 nt, Human
uguuacagaggcugugauggga

SEQ ID NO: 578143 - RNA, 18 nt, Human
uuuuauguagaugagguc

SEQ ID NO: 578144 - RNA, 21 nt, Human
agaugcuggggacacagcagg

SEQ ID NO: 578145 - RNA, 22 nt, Human
agauggaggcugcagugaacug

SEQ ID NO: 578146 - RNA, 23 nt, Human
agccaggcauggugaugcgugcc

SEQ ID NO: 578147 - RNA, 26 nt, Human
aggcauggugaugcgugccuguagcc

SEQ ID NO: 578148 - RNA, 21 nt, Human
aggccgagguggguggauugc

SEQ ID NO: 578149 - RNA, 24 nt, Human
aggccgagguggguggauugcuug

SEQ ID NO: 578150 - RNA, 23 nt, Human
auugcuugagcccaggagaugga

SEQ ID NO: 578151 - RNA, 26 nt, Human
cacagcagggauucauacugacaaga

SEQ ID NO: 578152 - RNA, 21 nt, Human
cagagcaagacacugucucuu

SEQ ID NO: 578153 - RNA, 24 nt, Human
cagcuacgugggaggccgaggugg

SEQ ID NO: 578154 - RNA, 22 nt, Human
ccaggagauggaggcugcagug

SEQ ID NO: 578155 - RNA, 21 nt, Human
ccuguagccccagcuacgugg

SEQ ID NO: 578156 - RNA, 22 nt, Human
ccuguagccccagcuacguggg

SEQ ID NO: 578157 - RNA, 23 nt, Human
cgagguggguggauugcuugagc

SEQ ID NO: 578158 - RNA, 24 nt, Human
gagguggguggauugcuugagccc

SEQ ID NO: 578159 - RNA, 22 nt, Human
gaugcuggggacacagcaggga

SEQ ID NO: 578160 - RNA, 19 nt, Human
gcagagcaagacacugucu

SEQ ID NO: 578161 - RNA, 21 nt, Human
ggacacagcagggauucauac

SEQ ID NO: 578162 - RNA, 18 nt, Human
ggaggcugcagugaacug

SEQ ID NO: 578163 - RNA, 18 nt, Human
uagaugcuggggacacag

SEQ ID NO: 578164 - RNA, 21 nt, Human
ugacaagagccaggcauggug

SEQ ID NO: 578165 - RNA, 23 nt, Human
ugccuguagccccagcuacgugg

SEQ ID NO: 578166 - RNA, 24 nt, Human
ugccuguagccccagcuacguggg

SEQ ID NO: 578167 - RNA, 22 nt, Human
ugggaggccgagguggguggau

SEQ ID NO: 578168 - RNA, 24 nt, Human
ugggaggccgagguggguggauug

SEQ ID NO: 578169 - RNA, 24 nt, Human
uggugaugcgugccuguagcccca

SEQ ID NO: 578170 - RNA, 24 nt, Human
uugcuugagcccaggagauggagg

SEQ ID NO: 578171 - RNA, 19 nt, Human
aaaaaaguggggaaaggac

SEQ ID NO: 578172 - RNA, 20 nt, Human
aaaucugaaguuuacaaaag

SEQ ID NO: 578173 - RNA, 23 nt, Human
aagagaaggcaagaccaggccca

SEQ ID NO: 578174 - RNA, 25 nt, Human
aagagacagagagggggcagcucug

SEQ ID NO: 578175 - RNA, 26 nt, Human
aauguccacuauuauaaaugaacagc

SEQ ID NO: 578176 - RNA, 21 nt, Human
acaccauuuuccacucagccu

SEQ ID NO: 578177 - RNA, 18 nt, Human
acgggguuucaucauguu

SEQ ID NO: 578178 - RNA, 23 nt, Human
acgggguuucaucauguuggcca

SEQ ID NO: 578179 - RNA, 24 nt, Human
acgggguuucaucauguuggccag

SEQ ID NO: 578180 - RNA, 20 nt, Human
acuauuauaaaugaacagca

SEQ ID NO: 578181 - RNA, 23 nt, Human
agacagagagggggcagcucugg

SEQ ID NO: 578182 - RNA, 18 nt, Human
agacagccccaagggcaa

SEQ ID NO: 578183 - RNA, 19 nt, Human
aggaagacagccccaaggg

SEQ ID NO: 578184 - RNA, 20 nt, Human
aggagaaacacuugugaagg

SEQ ID NO: 578185 - RNA, 20 nt, Human
aggcaugagccaccacgccc

SEQ ID NO: 578186 - RNA, 18 nt, Human
aggcuggagugcaguggc

SEQ ID NO: 578187 - RNA, 19 nt, Human
aguagcugggacuacaggc

SEQ ID NO: 578188 - RNA, 19 nt, Human
aguagcugggacuacaggc

SEQ ID NO: 578189 - RNA, 21 nt, Human
agugcaguggcgccauuucag

SEQ ID NO: 578190 - RNA, 18 nt, Human
aucaggaggggguccugg

SEQ ID NO: 578191 - RNA, 20 nt, Human
augagccaccacgcccggcc

SEQ ID NO: 578192 - RNA, 18 nt, Human
auugaagagacagagagg

SEQ ID NO: 578193 - RNA, 24 nt, Human
caacgugcugggauuauaggcaug

SEQ ID NO: 578194 - RNA, 20 nt, Human
caagcgauccuccuaccuca

SEQ ID NO: 578195 - RNA, 27 nt, Human
caagcgauccuccuaccucagccuccc

SEQ ID NO: 578196 - RNA, 24 nt, Human
caaguccaaacauaauuugaagug

SEQ ID NO: 578197 - RNA, 22 nt, Human
cacaccauuuuccacucagccu

SEQ ID NO: 578198 - RNA, 23 nt, Human
cacucucucucaaggggucagga

SEQ ID NO: 578199 - RNA, 20 nt, Human
cagagcucuccauaaugucc

SEQ ID NO: 578200 - RNA, 25 nt, Human
cagcagagaacagaagugaaaggga

SEQ ID NO: 578201 - RNA, 19 nt, Human
cagccucuacccaggcuca

SEQ ID NO: 578202 - RNA, 19 nt, Human
caggaggggguccuggggc

SEQ ID NO: 578203 - RNA, 20 nt, Human
caucaguggcugguggagcu

SEQ ID NO: 578204 - RNA, 24 nt, Human
caucauguuggccaggcugguccc

SEQ ID NO: 578205 - RNA, 18 nt, Human
cauguuggccaggcuggu

SEQ ID NO: 578206 - RNA, 19 nt, Human
cauguuggccaggcugguc

SEQ ID NO: 578207 - RNA, 24 nt, Human
cauguuggccaggcuggucccgaa

SEQ ID NO: 578208 - RNA, 24 nt, Human
ccaacgugcugggauuauaggcau

SEQ ID NO: 578209 - RNA, 22 nt, Human
ccagccccuucaucggcccucg

SEQ ID NO: 578210 - RNA, 24 nt, Human
ccagcgacuaccacugugaccaga

SEQ ID NO: 578211 - RNA, 20 nt, Human
cccaggcucaagcgauccuc

SEQ ID NO: 578212 - RNA, 19 nt, Human
ccccaagggcaggagaaac

SEQ ID NO: 578213 - RNA, 21 nt, Human
ccccgugugacaccugggggu

SEQ ID NO: 578214 - RNA, 23 nt, Human
cccgaguagcugggacuacaggc

SEQ ID NO: 578215 - RNA, 24 nt, Human
cccgaguagcugggacuacaggcg

SEQ ID NO: 578216 - RNA, 24 nt, Human
ccgauccgcccgccucagccuccc

SEQ ID NO: 578217 - RNA, 22 nt, Human
ccgcccgccucagccucccaac

SEQ ID NO: 578218 - RNA, 23 nt, Human
ccuaaccucgccucgugccgguu

SEQ ID NO: 578219 - RNA, 23 nt, Human
ccuaccucagccucccgaguagc

SEQ ID NO: 578220 - RNA, 23 nt, Human
ccucgccagaucacucucucuca

SEQ ID NO: 578221 - RNA, 23 nt, Human
ccucucugcugccacuucccuca

SEQ ID NO: 578222 - RNA, 21 nt, Human
ccuuauuuauuuauugagucg

SEQ ID NO: 578223 - RNA, 18 nt, Human
ccuuggucauaacuucca

SEQ ID NO: 578224 - RNA, 21 nt, Human
cgaacgccugagcucaaccga

SEQ ID NO: 578225 - RNA, 19 nt, Human
cgccucagccucccaacgu

SEQ ID NO: 578226 - RNA, 24 nt, Human
cgccucagccucccaacgugcugg

SEQ ID NO: 578227 - RNA, 19 nt, Human
cgcucagaaacucaccugg

SEQ ID NO: 578228 - RNA, 24 nt, Human
cgcucuguuacccaggcuggagug

SEQ ID NO: 578229 - RNA, 24 nt, Human
cgggguuucaucauguuggccagg

SEQ ID NO: 578230 - RNA, 19 nt, Human
cgugcgccaccaggcccgg

SEQ ID NO: 578231 - RNA, 23 nt, Human
cuaccucagccucccgaguagcu

SEQ ID NO: 578232 - RNA, 24 nt, Human
cucaagcgauccuccuaccucagc

SEQ ID NO: 578233 - RNA, 21 nt, Human
cucacagcagccucuacccag

SEQ ID NO: 578234 - RNA, 23 nt, Human
cucaccuggggucuccuggcugc

SEQ ID NO: 578235 - RNA, 24 nt, Human
cucagccucccgaguagcugggac

SEQ ID NO: 578236 - RNA, 21 nt, Human
cucgcucuguuacccaggcug

SEQ ID NO: 578237 - RNA, 24 nt, Human
cucgcucuguuacccaggcuggag

SEQ ID NO: 578238 - RNA, 19 nt, Human
cucucugcugccacuuccc

SEQ ID NO: 578239 - RNA, 22 nt, Human
cuggccucucugcugccacuuc

SEQ ID NO: 578240 - RNA, 23 nt, Human
cuuauucauauuauguaggaauc

SEQ ID NO: 578241 - RNA, 20 nt, Human
gacagccccaagggcaggag

SEQ ID NO: 578242 - RNA, 18 nt, Human
gagacgggguuucaucau

SEQ ID NO: 578243 - RNA, 24 nt, Human
gagacgggguuucaucauguuggc

SEQ ID NO: 578244 - RNA, 24 nt, Human
gaguagcugggacuacaggcgugc

SEQ ID NO: 578245 - RNA, 21 nt, Human
gauuauaggcaugagccacca

SEQ ID NO: 578246 - RNA, 22 nt, Human
gauuauaggcaugagccaccac

SEQ ID NO: 578247 - RNA, 30 nt, Human
gcacaaccugcacaucuaucguuucuucag

SEQ ID NO: 578248 - RNA, 23 nt, Human
gccaaaaucaggaggggguccug

SEQ ID NO: 578249 - RNA, 19 nt, Human
gccuauccauccuuauuca

SEQ ID NO: 578250 - RNA, 25 nt, Human
gcucuguuacccaggcuggagugca

SEQ ID NO: 578251 - RNA, 20 nt, Human
gcuggagugcaguggcgcca

SEQ ID NO: 578252 - RNA, 18 nt, Human
ggaauguggcuuuaaaaa

SEQ ID NO: 578253 - RNA, 19 nt, Human
ggacuacaggcgugcgcca

SEQ ID NO: 578254 - RNA, 22 nt, Human
ggaggggguccuggggccagcg

SEQ ID NO: 578255 - RNA, 19 nt, Human
ggauuauaggcaugagcca

SEQ ID NO: 578256 - RNA, 24 nt, Human
ggcuauauuuuuuucuauuuuugg

SEQ ID NO: 578257 - RNA, 19 nt, Human
gggccuaggcagagggagc

SEQ ID NO: 578258 - RNA, 23 nt, Human
gggguuucaucauguuggccagg

SEQ ID NO: 578259 - RNA, 21 nt, Human
guagagacgggguuucaucau

SEQ ID NO: 578260 - RNA, 22 nt, Human
guagagacgggguuucaucaug

SEQ ID NO: 578261 - RNA, 23 nt, Human
guagagacgggguuucaucaugu

SEQ ID NO: 578262 - RNA, 21 nt, Human
gugcugggauuauaggcauga

SEQ ID NO: 578263 - RNA, 18 nt, Human
uaaaaugucuuagcauaa

SEQ ID NO: 578264 - RNA, 19 nt, Human
uaaaugaacagcauaauuc

SEQ ID NO: 578265 - RNA, 23 nt, Human
uaaaugaacagcauaauucccuu

SEQ ID NO: 578266 - RNA, 21 nt, Human
uaagcagaaaaauacaaauaa

SEQ ID NO: 578267 - RNA, 25 nt, Human
uacccaggcucaagcgauccuccua

SEQ ID NO: 578268 - RNA, 21 nt, Human
uacccaggcuggagugcagug

SEQ ID NO: 578269 - RNA, 24 nt, Human
uacccaggcuggagugcaguggcg

SEQ ID NO: 578270 - RNA, 24 nt, Human
uaccucagccucccgaguagcugg

SEQ ID NO: 578271 - RNA, 20 nt, Human
uaggcagagggagcaaccga

SEQ ID NO: 578272 - RNA, 29 nt, Human
uauauuuuuuucuauuuuugguagagacg

SEQ ID NO: 578273 - RNA, 21 nt, Human
ucaaggggucaggauucagac

SEQ ID NO: 578274 - RNA, 19 nt, Human
ucaccuggggucuccuggc

SEQ ID NO: 578275 - RNA, 18 nt, Human
ucagccucccaacgugcu

SEQ ID NO: 578276 - RNA, 20 nt, Human
ucagccucccaacgugcugg

SEQ ID NO: 578277 - RNA, 23 nt, Human
ucagccucccgaguagcugggac

SEQ ID NO: 578278 - RNA, 23 nt, Human
ucauaacuuccauuccaaauucu

SEQ ID NO: 578279 - RNA, 22 nt, Human
uccaaacauaauuugaagugag

SEQ ID NO: 578280 - RNA, 24 nt, Human
ucccaacgugcugggauuauaggc

SEQ ID NO: 578281 - RNA, 24 nt, Human
ucccgaguagcugggacuacaggc

SEQ ID NO: 578282 - RNA, 21 nt, Human
uccgcccgccucagccuccca

SEQ ID NO: 578283 - RNA, 24 nt, Human
uccgcccgccucagccucccaacg

SEQ ID NO: 578284 - RNA, 26 nt, Human
uccuccuaccucagccucccgaguag

SEQ ID NO: 578285 - RNA, 21 nt, Human
uccuuauuuauuuauugaguc

SEQ ID NO: 578286 - RNA, 22 nt, Human
ucgccagaucacucucucucaa

SEQ ID NO: 578287 - RNA, 24 nt, Human
ucgcucuguuacccaggcuggagu

SEQ ID NO: 578288 - RNA, 19 nt, Human
ucucgcucuguuacccagg

SEQ ID NO: 578289 - RNA, 23 nt, Human
ucucgcucuguuacccaggcugg

SEQ ID NO: 578290 - RNA, 24 nt, Human
ucucgcucuguuacccaggcugga

SEQ ID NO: 578291 - RNA, 26 nt, Human
ucucgcucuguuacccaggcuggagu

SEQ ID NO: 578292 - RNA, 27 nt, Human
ucucgcucuguuacccaggcuggagug

SEQ ID NO: 578293 - RNA, 21 nt, Human
ucuggccucucugcugccacu

SEQ ID NO: 578294 - RNA, 24 nt, Human
ucuguuacccaggcuggagugcag

SEQ ID NO: 578295 - RNA, 20 nt, Human
ugaaagggagaagggaugag

SEQ ID NO: 578296 - RNA, 20 nt, Human
ugaagagacagagagggggc

SEQ ID NO: 578297 - RNA, 21 nt, Human
ugaagagacagagagggggca

SEQ ID NO: 578298 - RNA, 23 nt, Human
ugaagagacagagagggggcagc

SEQ ID NO: 578299 - RNA, 23 nt, Human
ugacaccuggggguaagaaccaa

SEQ ID NO: 578300 - RNA, 20 nt, Human
ugcaagucugcuuucugcag

SEQ ID NO: 578301 - RNA, 22 nt, Human
ugcaguggcgccauuucagcuc

SEQ ID NO: 578302 - RNA, 18 nt, Human
uggagugcaguggcgcca

SEQ ID NO: 578303 - RNA, 28 nt, Human
uggagugcaguggcgccauggcucuagc

SEQ ID NO: 578304 - RNA, 28 nt, Human
uggagugcaguggcgccauucuagcacg

SEQ ID NO: 578305 - RNA, 21 nt, Human
uggagugcaguggcgccauuu

SEQ ID NO: 578306 - RNA, 24 nt, Human
uggccaggcuggucccgaacgccu

SEQ ID NO: 578307 - RNA, 21 nt, Human
uggcgccauuucagcucacag

SEQ ID NO: 578308 - RNA, 18 nt, Human
ugggacuacaggcgugcg

SEQ ID NO: 578309 - RNA, 21 nt, Human
ugggacuacaggcgugcgcca

SEQ ID NO: 578310 - RNA, 22 nt, Human
ugggacuacaggcgugcgccac

SEQ ID NO: 578311 - RNA, 24 nt, Human
ugggacuacaggcgugcgccacca

SEQ ID NO: 578312 - RNA, 18 nt, Human
ugggauuauaggcaugag

SEQ ID NO: 578313 - RNA, 19 nt, Human
ugggauuauaggcaugagc

SEQ ID NO: 578314 - RNA, 22 nt, Human
ugggauuauaggcaugagccac

SEQ ID NO: 578315 - RNA, 23 nt, Human
ugggauuauaggcaugagccacc

SEQ ID NO: 578316 - RNA, 24 nt, Human
ugggauuauaggcaugagccacca

SEQ ID NO: 578317 - RNA, 18 nt, Human
uggggccagcgacuacca

SEQ ID NO: 578318 - RNA, 24 nt, Human
ugguagagacgggguuucaucaug

SEQ ID NO: 578319 - RNA, 19 nt, Human
ugugaaggguccauugaag

SEQ ID NO: 578320 - RNA, 24 nt, Human
uuacccaggcuggagugcaguggc

SEQ ID NO: 578321 - RNA, 22 nt, Human
uucuauuuuugguagagacggg

SEQ ID NO: 578322 - RNA, 21 nt, Human
uucuucaggggcuggagcugg

SEQ ID NO: 578323 - RNA, 24 nt, Human
uugguagagacgggguuucaucau

SEQ ID NO: 578324 - RNA, 18 nt, Human
uuuaaaaugaguauauau

SEQ ID NO: 578325 - RNA, 23 nt, Human
uuucaucauguuggccaggcugu

SEQ ID NO: 578326 - RNA, 22 nt, Human
uuucuucaggggcuggagcugg

SEQ ID NO: 578327 - RNA, 20 nt, Human
uuugaagugagguagguagu

SEQ ID NO: 578328 - RNA, 21 nt, Human
uuuuucuauuuuugguagaga

SEQ ID NO: 578329 - RNA, 22 nt, Human
uuuuugguagagacgggguuuc

SEQ ID NO: 578330 - RNA, 24 nt, Human
uuuuugguagagacgggguuucau

SEQ ID NO: 578331 - RNA, 21 nt, Human
uuuuuucuauuuuugguagag

SEQ ID NO: 578332 - RNA, 25 nt, Human
aaaaauaaagaaaaaccauccaugc

SEQ ID NO: 578333 - RNA, 18 nt, Human
auaaaacaaacuguacac

SEQ ID NO: 578334 - RNA, 20 nt, Human
auaguaacaaaaaaaguaaa

SEQ ID NO: 578335 - RNA, 18 nt, Human
auauauguauauauaaaa

SEQ ID NO: 578336 - RNA, 20 nt, Human
caagccaccaacucccaaau

SEQ ID NO: 578337 - RNA, 18 nt, Human
cauacauauguauauaua

SEQ ID NO: 578338 - RNA, 20 nt, Human
cauacauauguauauauaca

SEQ ID NO: 578339 - RNA, 26 nt, Human
ccccuuauggacaaagucaagccacc

SEQ ID NO: 578340 - RNA, 21 nt, Human
cuauacagauacaugugugua

SEQ ID NO: 578341 - RNA, 26 nt, Human
cuuuuuccuguuguuguccauauuaa

SEQ ID NO: 578342 - RNA, 22 nt, Human
gaagaacauaaagguuaaagaa

SEQ ID NO: 578343 - RNA, 23 nt, Human
gccccuuauggacaaagucaagc

SEQ ID NO: 578344 - RNA, 20 nt, Human
guauauauacacacauauac

SEQ ID NO: 578345 - RNA, 18 nt, Human
gugaaguggccacgcccc

SEQ ID NO: 578346 - RNA, 19 nt, Human
uaacaaaaaaaguaaagag

SEQ ID NO: 578347 - RNA, 26 nt, Human
uacauguguguauauaaacauacaua

SEQ ID NO: 578348 - RNA, 20 nt, Human
uagcuguuuuucccuacuug

SEQ ID NO: 578349 - RNA, 20 nt, Human
uaguaacaaaaaaaguaaag

SEQ ID NO: 578350 - RNA, 23 nt, Human
uaguaacaaaaaaaguaaagaga

SEQ ID NO: 578351 - RNA, 24 nt, Human
uauaaaauaaggccauguuucuaa

SEQ ID NO: 578352 - RNA, 24 nt, Human
uauaaacauacauauguauauaua

SEQ ID NO: 578353 - RNA, 24 nt, Human
uauacagauacauguguguauaua

SEQ ID NO: 578354 - RNA, 22 nt, Human
uauauaaacauacauauguaua

SEQ ID NO: 578355 - RNA, 24 nt, Human
uauauguauauauaaaacuauaca

SEQ ID NO: 578356 - RNA, 24 nt, Human
uauguauauauacacacauauacu

SEQ ID NO: 578357 - RNA, 22 nt, Human
uauguguauauauguauauaua

SEQ ID NO: 578358 - RNA, 25 nt, Human
uauugcaacugugaccaccgucacu

SEQ ID NO: 578359 - RNA, 25 nt, Human
ucacugaaaaauaaagaaaaaccau

SEQ ID NO: 578360 - RNA, 22 nt, Human
ucccuacuuguuuucuucuugc

SEQ ID NO: 578361 - RNA, 18 nt, Human
ucugcaguggucugucag

SEQ ID NO: 578362 - RNA, 18 nt, Human
ugcugaaaugcuagcuuu

SEQ ID NO: 578363 - RNA, 19 nt, Human
uguaccuguaauccugaag

SEQ ID NO: 578364 - RNA, 24 nt, Human
uguauauauacacacauauacuua

SEQ ID NO: 578365 - RNA, 22 nt, Human
uguauauauacacacauauagu

SEQ ID NO: 578366 - RNA, 20 nt, Human
uguaugucuauguguauaua

SEQ ID NO: 578367 - RNA, 19 nt, Human
ugugaaguggccacgcccc

SEQ ID NO: 578368 - RNA, 20 nt, Human
uguguauauaaacauacaua

SEQ ID NO: 578369 - RNA, 24 nt, Human
uguguauauaaacauacauaugua

SEQ ID NO: 578370 - RNA, 18 nt, Human
uguguauauauguauaua

SEQ ID NO: 578371 - RNA, 20 nt, Human
uguguauauauguauauaua

SEQ ID NO: 578372 - RNA, 22 nt, Human
uguguguauauaaacauacaua

SEQ ID NO: 578373 - RNA, 28 nt, Human
uguguguauauaaacauacauauguaua

SEQ ID NO: 578374 - RNA, 21 nt, Human
uucagaggaaaucacugaaaa

SEQ ID NO: 578375 - RNA, 31 nt, Human
aaaaauauacauugcuugccauagaccuucc

SEQ ID NO: 578376 - RNA, 21 nt, Human
acagcuucuagaggaacuccu

SEQ ID NO: 578377 - RNA, 23 nt, Human
acuucacugugagggcucuggcu

SEQ ID NO: 578378 - RNA, 20 nt, Human
agcuucuaguauggagcaag

SEQ ID NO: 578379 - RNA, 18 nt, Human
auguagacagcagggcag

SEQ ID NO: 578380 - RNA, 22 nt, Human
cagggcagaaagacauuauucu

SEQ ID NO: 578381 - RNA, 25 nt, Human
cagggcagaaagacauuauucuuua

SEQ ID NO: 578382 - RNA, 24 nt, Human
ccaggagagaagggaaacggagca

SEQ ID NO: 578383 - RNA, 20 nt, Human
gagcgucagacgcgccacag

SEQ ID NO: 578384 - RNA, 25 nt, Human
gcagggcagaaagacauuauucuuu

SEQ ID NO: 578385 - RNA, 23 nt, Human
uaggaucugacuccacuucacug

SEQ ID NO: 578386 - RNA, 22 nt, Human
uaugacaagcuccauagaaaaa

SEQ ID NO: 578387 - RNA, 19 nt, Human
uccacuucacugugagggc

SEQ ID NO: 578388 - RNA, 21 nt, Human
ucuaggaucugacuccacuuc

SEQ ID NO: 578389 - RNA, 23 nt, Human
ucuuuauaaauaaaagguucauc

SEQ ID NO: 578390 - RNA, 18 nt, Human
ugaacccaaaagaagcuu

SEQ ID NO: 578391 - RNA, 22 nt, Human
ugaacccaaaagaagcuucuag

SEQ ID NO: 578392 - RNA, 19 nt, Human
ugagggcucuggcuccacg

SEQ ID NO: 578393 - RNA, 20 nt, Human
ugccauagaccuucucugga

SEQ ID NO: 578394 - RNA, 22 nt, Human
ugccauagaccuucucuggaua

SEQ ID NO: 578395 - RNA, 23 nt, Human
uggauaaaaucagacgaaucuag

SEQ ID NO: 578396 - RNA, 23 nt, Human
uugaacccaaaagaagcuucuag

SEQ ID NO: 578397 - RNA, 22 nt, Human
uugcuugccauagaccuucucu

SEQ ID NO: 578398 - RNA, 24 nt, Human
aaagugcugggauuacaggcguga

SEQ ID NO: 578399 - RNA, 24 nt, Human
aagcagauggacacaaagucuaug

SEQ ID NO: 578400 - RNA, 21 nt, Human
aaguaguugagauuacaggca

SEQ ID NO: 578401 - RNA, 19 nt, Human
aagugcugggauuacaggc

SEQ ID NO: 578402 - RNA, 19 nt, Human
aagugcugggauuacaggc

SEQ ID NO: 578403 - RNA, 26 nt, Human
aagugcugggauuacaggcgugagcc

SEQ ID NO: 578404 - RNA, 24 nt, Human
accaucuuggccaagcuggucuug

SEQ ID NO: 578405 - RNA, 18 nt, Human
acugcgcccagcuaauuu

SEQ ID NO: 578406 - RNA, 23 nt, Human
agauuacaggcaacugcuacugc

SEQ ID NO: 578407 - RNA, 21 nt, Human
agccacagcgccuguccaauu

SEQ ID NO: 578408 - RNA, 24 nt, Human
agcuggucuugaacuccugaccuc

SEQ ID NO: 578409 - RNA, 22 nt, Human
aguagagaugggguuucaccau

SEQ ID NO: 578410 - RNA, 25 nt, Human
aguaguugagauuacaggcaacugc

SEQ ID NO: 578411 - RNA, 19 nt, Human
agugcgguggugugaucuc

SEQ ID NO: 578412 - RNA, 20 nt, Human
agugcgguggugugaucucg

SEQ ID NO: 578413 - RNA, 24 nt, Human
agugcgguggugugaucucggcuc

SEQ ID NO: 578414 - RNA, 18 nt, Human
agugcugggauuacaggc

SEQ ID NO: 578415 - RNA, 20 nt, Human
aguucaagugauucuccugc

SEQ ID NO: 578416 - RNA, 18 nt, Human
augggguuucaccaucuu

SEQ ID NO: 578417 - RNA, 20 nt, Human
augggguuucaccaucuugg

SEQ ID NO: 578418 - RNA, 24 nt, Human
auuuuuguauuuuuaguagagaug

SEQ ID NO: 578419 - RNA, 25 nt, Human
caaagcagauggacacaaagucuau

SEQ ID NO: 578420 - RNA, 24 nt, Human
caaagugcugggauuacaggcgug

SEQ ID NO: 578421 - RNA, 23 nt, Human
caagucucugguugguuguuuuu

SEQ ID NO: 578422 - RNA, 22 nt, Human
caagugauucuccugccucagc

SEQ ID NO: 578423 - RNA, 27 nt, Human
caagugauucuccugccucagccuccc

SEQ ID NO: 578424 - RNA, 24 nt, Human
caccaucuuggccaagcuggucuu

SEQ ID NO: 578425 - RNA, 20 nt, Human
cacugcaaccucugcccccc

SEQ ID NO: 578426 - RNA, 21 nt, Human
cacugcaaccucugccccccg

SEQ ID NO: 578427 - RNA, 22 nt, Human
cacuuugcuucccaggguggag

SEQ ID NO: 578428 - RNA, 18 nt, Human
cagaaacugcccaugauc

SEQ ID NO: 578429 - RNA, 22 nt, Human
ccaaagugcugggauuacaggc

SEQ ID NO: 578430 - RNA, 22 nt, Human
ccaaagugcugggauuacaggc

SEQ ID NO: 578431 - RNA, 24 nt, Human
ccaaagugcugggauuacaggcgu

SEQ ID NO: 578432 - RNA, 19 nt, Human
cccaaguaguugagauuac

SEQ ID NO: 578433 - RNA, 24 nt, Human
cccaaguaguugagauuacaggca

SEQ ID NO: 578434 - RNA, 21 nt, Human
cccaggucaaagcagauggac

SEQ ID NO: 578435 - RNA, 24 nt, Human
cccaggucaaagcagauggacaca

SEQ ID NO: 578436 - RNA, 21 nt, Human
ccccgaguucaagugauucuc

SEQ ID NO: 578437 - RNA, 24 nt, Human
ccccgaguucaagugauucuccug

SEQ ID NO: 578438 - RNA, 18 nt, Human
ccccgcgcggcgccccgc

SEQ ID NO: 578439 - RNA, 20 nt, Human
cccgaguucaagugauucuc

SEQ ID NO: 578440 - RNA, 19 nt, Human
ccguaccagccgccccgcc

SEQ ID NO: 578441 - RNA, 19 nt, Human
ccguccccuuccagccucc

SEQ ID NO: 578442 - RNA, 23 nt, Human
ccuagcccggccucgcgccgguu

SEQ ID NO: 578443 - RNA, 20 nt, Human
ccugaccucaggugauccac

SEQ ID NO: 578444 - RNA, 22 nt, Human
ccugaccucaggugauccacug

SEQ ID NO: 578445 - RNA, 23 nt, Human
ccugaccucaggugauccacugg

SEQ ID NO: 578446 - RNA, 26 nt, Human
cuacuggacaaacuugcaggcugugc

SEQ ID NO: 578447 - RNA, 19 nt, Human
cucacugcaaccucugccc

SEQ ID NO: 578448 - RNA, 22 nt, Human
cucacugcaaccucugcccccc

SEQ ID NO: 578449 - RNA, 24 nt, Human
cucacugcaaccucugccccccga

SEQ ID NO: 578450 - RNA, 21 nt, Human
cucccaaguaguugagauuac

SEQ ID NO: 578451 - RNA, 19 nt, Human
cugcaaccucugccccccg

SEQ ID NO: 578452 - RNA, 23 nt, Human
cugcaaccucugccccccgaguu

SEQ ID NO: 578453 - RNA, 24 nt, Human
cugcaaccucugccccccgaguuc

SEQ ID NO: 578454 - RNA, 23 nt, Human
cugccccccgaguucaagugauu

SEQ ID NO: 578455 - RNA, 21 nt, Human
cugccucagccucccaaguag

SEQ ID NO: 578456 - RNA, 24 nt, Human
gaccucaggugauccacuggccuc

SEQ ID NO: 578457 - RNA, 18 nt, Human
gagaugggguuucaccau

SEQ ID NO: 578458 - RNA, 24 nt, Human
gagaugggguuucaccaucuuggc

SEQ ID NO: 578459 - RNA, 22 nt, Human
gaguucaagugauucuccugcc

SEQ ID NO: 578460 - RNA, 18 nt, Human
gauuacaggcgugagcca

SEQ ID NO: 578461 - RNA, 22 nt, Human
gauuacaggcgugagccacagc

SEQ ID NO: 578462 - RNA, 21 nt, Human
gauucuccugccucagccucc

SEQ ID NO: 578463 - RNA, 22 nt, Human
gcaaccucugccccccgaguuc

SEQ ID NO: 578464 - RNA, 18 nt, Human
gcccagcuaauuuuugua

SEQ ID NO: 578465 - RNA, 22 nt, Human
gcccagcuaauuuuuguauuuu

SEQ ID NO: 578466 - RNA, 22 nt, Human
gccccccgaguucaagugauuc

SEQ ID NO: 578467 - RNA, 18 nt, Human
gcgcggggcaccccggca

SEQ ID NO: 578468 - RNA, 18 nt, Human
ggcaccccggcagcaggg

SEQ ID NO: 578469 - RNA, 18 nt, Human
gggguuucaccaucuugg

SEQ ID NO: 578470 - RNA, 22 nt, Human
ggguuucaccaucuuggccaag

SEQ ID NO: 578471 - RNA, 19 nt, Human
ggucuugaacuccugaccu

SEQ ID NO: 578472 - RNA, 24 nt, Human
gugauccacuggccucggccuccc

SEQ ID NO: 578473 - RNA, 24 nt, Human
gugauucuccugccucagccuccc

SEQ ID NO: 578474 - RNA, 22 nt, Human
guugguuguuuuuaugcagauu

SEQ ID NO: 578475 - RNA, 24 nt, Human
uaauuuuuguauuuuuaguagaga

SEQ ID NO: 578476 - RNA, 24 nt, Human
uacaggcaacugcuacugcgccca

SEQ ID NO: 578477 - RNA, 22 nt, Human
uacaggcgugagccacagcgcc

SEQ ID NO: 578478 - RNA, 23 nt, Human
uacaggcgugagccacagcgccu

SEQ ID NO: 578479 - RNA, 22 nt, Human
uaggaucagagauaaagguagg

SEQ ID NO: 578480 - RNA, 19 nt, Human
uaguagagaugggguuuca

SEQ ID NO: 578481 - RNA, 23 nt, Human
uaguagagaugggguuucaccau

SEQ ID NO: 578482 - RNA, 26 nt, Human
uaguagagaugggguuucaccaucuu

SEQ ID NO: 578483 - RNA, 18 nt, Human
uaguugagauuacaggca

SEQ ID NO: 578484 - RNA, 23 nt, Human
ucaaagcagauggacacaaaguc

SEQ ID NO: 578485 - RNA, 26 nt, Human
ucaaagcagauggacacaaagucuau

SEQ ID NO: 578486 - RNA, 18 nt, Human
ucaagugauucuccugcc

SEQ ID NO: 578487 - RNA, 18 nt, Human
ucacugcaaccucugccc

SEQ ID NO: 578488 - RNA, 21 nt, Human
ucacugcaaccucugcccccc

SEQ ID NO: 578489 - RNA, 22 nt, Human
ucacugcaaccucugccccccg

SEQ ID NO: 578490 - RNA, 24 nt, Human
ucacugcaaccucugccccccgag

SEQ ID NO: 578491 - RNA, 20 nt, Human
ucaguaucuaaugcccaggu

SEQ ID NO: 578492 - RNA, 19 nt, Human
ucaguggccccuucguucc

SEQ ID NO: 578493 - RNA, 24 nt, Human
ucccaaagugcugggauuacaggc

SEQ ID NO: 578494 - RNA, 24 nt, Human
ucccaaguaguugagauuacaggc

SEQ ID NO: 578495 - RNA, 21 nt, Human
ucccaggguggagugcggugg

SEQ ID NO: 578496 - RNA, 18 nt, Human
uccuugagagggaauaag

SEQ ID NO: 578497 - RNA, 18 nt, Human
ucggccucccaaagugcu

SEQ ID NO: 578498 - RNA, 21 nt, Human
ucuauggagccauucugguga

SEQ ID NO: 578499 - RNA, 19 nt, Human
ucuccugccucagccuccc

SEQ ID NO: 578500 - RNA, 23 nt, Human
ucuugaacuccugaccucaggug

SEQ ID NO: 578501 - RNA, 25 nt, Human
ugaacugagucucaguuuacaucua

SEQ ID NO: 578502 - RNA, 19 nt, Human
ugaccucaggugauccacu

SEQ ID NO: 578503 - RNA, 22 nt, Human
ugagauuacaggcaacugcuac

SEQ ID NO: 578504 - RNA, 22 nt, Human
ugagauuacaggcaacugcuac

SEQ ID NO: 578505 - RNA, 24 nt, Human
ugagauuacaggcaacugcuacug

SEQ ID NO: 578506 - RNA, 20 nt, Human
ugauucuccugccucagccu

SEQ ID NO: 578507 - RNA, 23 nt, Human
ugcccaggucaaagcagauggac

SEQ ID NO: 578508 - RNA, 22 nt, Human
ugccccccgaguucaagugauu

SEQ ID NO: 578509 - RNA, 24 nt, Human
ugccucagccucccaaguaguuga

SEQ ID NO: 578510 - RNA, 24 nt, Human
ugcugggauuacaggcgugagcca

SEQ ID NO: 578511 - RNA, 18 nt, Human
uggaauauuugaugggcc

SEQ ID NO: 578512 - RNA, 24 nt, Human
uggagugcgguggugugaucucgg

SEQ ID NO: 578513 - RNA, 24 nt, Human
uggccaagcuggucuugaacuccu

SEQ ID NO: 578514 - RNA, 20 nt, Human
ugggaaaggguccuugagag

SEQ ID NO: 578515 - RNA, 18 nt, Human
ugggauuacaggcgugag

SEQ ID NO: 578516 - RNA, 19 nt, Human
ugggauuacaggcgugagc

SEQ ID NO: 578517 - RNA, 21 nt, Human
ugggauuacaggcgugagcca

SEQ ID NO: 578518 - RNA, 22 nt, Human
ugggauuacaggcgugagccac

SEQ ID NO: 578519 - RNA, 22 nt, Human
ugggauuacaggcgugagccac

SEQ ID NO: 578520 - RNA, 23 nt, Human
ugggauuacaggcgugagccaca

SEQ ID NO: 578521 - RNA, 24 nt, Human
ugggauuacaggcgugagccacag

SEQ ID NO: 578522 - RNA, 24 nt, Human
ugggauuacaggcgugagccacag

SEQ ID NO: 578523 - RNA, 27 nt, Human
ugggauuacaggcgugagccacagcgc

SEQ ID NO: 578524 - RNA, 24 nt, Human
ugggguuucaccaucuuggccaag

SEQ ID NO: 578525 - RNA, 21 nt, Human
uguauuuuuaguagagauggg

SEQ ID NO: 578526 - RNA, 18 nt, Human
uuaguagagaugggguuu

SEQ ID NO: 578527 - RNA, 22 nt, Human
uuaguagagaugggguuucacc

SEQ ID NO: 578528 - RNA, 24 nt, Human
uuaguagagaugggguuucaccau

SEQ ID NO: 578529 - RNA, 22 nt, Human
uuauucaguaucuaaugcccag

SEQ ID NO: 578530 - RNA, 21 nt, Human
uucaagugauucuccugccuc

SEQ ID NO: 578531 - RNA, 23 nt, Human
uucaagugauucuccugccucag

SEQ ID NO: 578532 - RNA, 24 nt, Human
uucaagugauucuccugccucagc

SEQ ID NO: 578533 - RNA, 24 nt, Human
uucccaggguggagugcgguggug

SEQ ID NO: 578534 - RNA, 23 nt, Human
uuguauuuuuaguagagaugggg

SEQ ID NO: 578535 - RNA, 21 nt, Human
uuucaccaucuuggccaagcu

SEQ ID NO: 578536 - RNA, 24 nt, Human
uuuuuaguagagaugggguuucac

SEQ ID NO: 578537 - RNA, 20 nt, Human
uuuuuguauuuuuaguagag

SEQ ID NO: 578538 - RNA, 21 nt, Human
aacacuuaauaacaucuaagu

SEQ ID NO: 578539 - RNA, 20 nt, Human
aacagagguugggugcugca

SEQ ID NO: 578540 - RNA, 22 nt, Human
aagucaacaaugccaaaacuga

SEQ ID NO: 578541 - RNA, 23 nt, Human
aauucaggauacccccaaaucaa

SEQ ID NO: 578542 - RNA, 21 nt, Human
acagaacuuccagugaguuau

SEQ ID NO: 578543 - RNA, 25 nt, Human
agcaugccccucugcuccacucaga

SEQ ID NO: 578544 - RNA, 20 nt, Human
agucaguucuaagauaacca

SEQ ID NO: 578545 - RNA, 18 nt, Human
augaaacacagccuuccg

SEQ ID NO: 578546 - RNA, 20 nt, Human
auuacaggugauuugcugca

SEQ ID NO: 578547 - RNA, 21 nt, Human
caacccaaagcaaacugcucu

SEQ ID NO: 578548 - RNA, 20 nt, Human
cagugaccuccucucuugcc

SEQ ID NO: 578549 - RNA, 21 nt, Human
cauuucuauucuaagauauag

SEQ ID NO: 578550 - RNA, 27 nt, Human
ccccucugcuccacucagaacugagga

SEQ ID NO: 578551 - RNA, 18 nt, Human
ccgagacuucauauucaa

SEQ ID NO: 578552 - RNA, 25 nt, Human
cucuucuucagaggaccaaacuguu

SEQ ID NO: 578553 - RNA, 21 nt, Human
gaaauccuuuccgccuggagu

SEQ ID NO: 578554 - RNA, 19 nt, Human
gagacagaacuuccaguga

SEQ ID NO: 578555 - RNA, 19 nt, Human
gaucaauucagugaccucc

SEQ ID NO: 578556 - RNA, 19 nt, Human
gccacaacaucugcuuccc

SEQ ID NO: 578557 - RNA, 22 nt, Human
gccacaacaucugcuucccgag

SEQ ID NO: 578558 - RNA, 22 nt, Human
gcccuggaaggcauugccauuu

SEQ ID NO: 578559 - RNA, 19 nt, Human
gcugaaugauaguuuuucu

SEQ ID NO: 578560 - RNA, 19 nt, Human
ggagacugaauggguggga

SEQ ID NO: 578561 - RNA, 22 nt, Human
guuauuuuccugcuuucugacc

SEQ ID NO: 578562 - RNA, 23 nt, Human
ucaagaaaacaaaguuuucucau

SEQ ID NO: 578563 - RNA, 21 nt, Human
ucugccaacccaaagcaaacu

SEQ ID NO: 578564 - RNA, 19 nt, Human
ugagaaaauagcaaacuca

SEQ ID NO: 578565 - RNA, 22 nt, Human
ugccaaaacugaaauuugcauu

SEQ ID NO: 578566 - RNA, 21 nt, Human
ugccaagggcuaaaaauucag

SEQ ID NO: 578567 - RNA, 18 nt, Human
uggagacugaaugggugg

SEQ ID NO: 578568 - RNA, 25 nt, Human
uguccuuuucuccugcauccucuca

SEQ ID NO: 578569 - RNA, 23 nt, Human
uguuuguauuuccugaauccuga

SEQ ID NO: 578570 - RNA, 18 nt, Human
uuuuaaacaaguucccag

SEQ ID NO: 578571 - RNA, 26 nt, Human
aaaaaggaaaaaagaaccaaagaaaa

SEQ ID NO: 578572 - RNA, 26 nt, Human
aaaaaggagacauauagauuugaaaa

SEQ ID NO: 578573 - RNA, 20 nt, Human
aaaacauucagacuaaucaa

SEQ ID NO: 578574 - RNA, 28 nt, Human
aaaagaagaaacauuauccaacaaaaag

SEQ ID NO: 578575 - RNA, 31 nt, Human
aaaagaagaaacauuauccaacaaaaaggaa

SEQ ID NO: 578576 - RNA, 23 nt, Human
aaacaaacacaaauauuuucaca

SEQ ID NO: 578577 - RNA, 24 nt, Human
aaacauuauccaacaaaaaggaga

SEQ ID NO: 578578 - RNA, 23 nt, Human
aaagaacuuucacacaccuaaag

SEQ ID NO: 578579 - RNA, 27 nt, Human
aaagaagaaacauuauccaacaaaaag

SEQ ID NO: 578580 - RNA, 19 nt, Human
aaagugcugggauuaccgg

SEQ ID NO: 578581 - RNA, 24 nt, Human
aaagugcugggauuaccgguguga

SEQ ID NO: 578582 - RNA, 26 nt, Human
aaaucaguucuaauucauuuaugcag

SEQ ID NO: 578583 - RNA, 19 nt, Human
aacaacaacaacaaacaga

SEQ ID NO: 578584 - RNA, 22 nt, Human
aacaacaacaacaaacagauag

SEQ ID NO: 578585 - RNA, 22 nt, Human
aacacagaaacacuagaaaaca

SEQ ID NO: 578586 - RNA, 29 nt, Human
aagaagaaacauuauccaacaaaaaggaa

SEQ ID NO: 578587 - RNA, 25 nt, Human
aagcaauccucccaccucggccucc

SEQ ID NO: 578588 - RNA, 26 nt, Human
aagcaugauaugauaacaacauugua

SEQ ID NO: 578589 - RNA, 18 nt, Human
aagugcugggauuaccgg

SEQ ID NO: 578590 - RNA, 20 nt, Human
aauaucaaaaauagaaaguc

SEQ ID NO: 578591 - RNA, 23 nt, Human
aauuaccuucuaucugcuucuac

SEQ ID NO: 578592 - RNA, 20 nt, Human
acaacaacaacaaacagaua

SEQ ID NO: 578593 - RNA, 18 nt, Human
accagccgggggacagga

SEQ ID NO: 578594 - RNA, 23 nt, Human
accccuaaacaacacacuaucug

SEQ ID NO: 578595 - RNA, 23 nt, Human
accucggccucccaaagugcugg

SEQ ID NO: 578596 - RNA, 21 nt, Human
agaacuuucacacaccuaaag

SEQ ID NO: 578597 - RNA, 27 nt, Human
agacaaaacaaacacaaagccuuucgg

SEQ ID NO: 578598 - RNA, 20 nt, Human
agauauagacacaauuaacc

SEQ ID NO: 578599 - RNA, 20 nt, Human
agggggcccaaagcaucugu

SEQ ID NO: 578600 - RNA, 23 nt, Human
auagacacaauuaaccccuaaac

SEQ ID NO: 578601 - RNA, 19 nt, Human
augcauuuacuuuuauaag

SEQ ID NO: 578602 - RNA, 19 nt, Human
auguugcccagacuggucu

SEQ ID NO: 578603 - RNA, 23 nt, Human
caaacaucuucauguuuguaaug

SEQ ID NO: 578604 - RNA, 26 nt, Human
caaagugcugggauuaccggugugag

SEQ ID NO: 578605 - RNA, 19 nt, Human
caacaaaaaggagacauau

SEQ ID NO: 578606 - RNA, 28 nt, Human
caacacacuaucugauucucaaaagcaa

SEQ ID NO: 578607 - RNA, 27 nt, Human
caagcaauccucccaccucggccuccc

SEQ ID NO: 578608 - RNA, 28 nt, Human
caagcaauccucccaccucggccuccca

SEQ ID NO: 578609 - RNA, 24 nt, Human
cacagaaacacuagaaaacaguga

SEQ ID NO: 578610 - RNA, 21 nt, Human
caccuaaagauagcauuuagc

SEQ ID NO: 578611 - RNA, 19 nt, Human
cagauaggcaggggaaguc

SEQ ID NO: 578612 - RNA, 24 nt, Human
cauuaaaaagaagaaacauuaucc

SEQ ID NO: 578613 - RNA, 18 nt, Human
ccaaagugcugggauuac

SEQ ID NO: 578614 - RNA, 21 nt, Human
ccaaagugcugggauuaccgg

SEQ ID NO: 578615 - RNA, 24 nt, Human
ccaaagugcugggauuaccggugu

SEQ ID NO: 578616 - RNA, 23 nt, Human
ccagaccccggaccagccggggg

SEQ ID NO: 578617 - RNA, 22 nt, Human
cccagaccccggaccagccggg

SEQ ID NO: 578618 - RNA, 22 nt, Human
cccagacuggucuugaacucau

SEQ ID NO: 578619 - RNA, 20 nt, Human
ccccaucaccaccaaaucug

SEQ ID NO: 578620 - RNA, 22 nt, Human
cccccaucaccaccaaaucugu

SEQ ID NO: 578621 - RNA, 19 nt, Human
ccccccaucaccaccaagg

SEQ ID NO: 578622 - RNA, 26 nt, Human
ccccuaaacaacacacuaucugauuc

SEQ ID NO: 578623 - RNA, 25 nt, Human
ccgccgggcgccugaggagcugcgu

SEQ ID NO: 578624 - RNA, 19 nt, Human
ccggacgacgccgaccaca

SEQ ID NO: 578625 - RNA, 18 nt, Human
ccuaaaaaaggaaaaaag

SEQ ID NO: 578626 - RNA, 21 nt, Human
ccuaaacaacacacuaucuga

SEQ ID NO: 578627 - RNA, 26 nt, Human
ccucccaccucggccucccaaagugc

SEQ ID NO: 578628 - RNA, 24 nt, Human
ccugacgccgccgacccaacaaau

SEQ ID NO: 578629 - RNA, 19 nt, Human
cgcccagaccccggaccag

SEQ ID NO: 578630 - RNA, 24 nt, Human
cgcuauguugcccagacuggucuu

SEQ ID NO: 578631 - RNA, 27 nt, Human
cgcuauguugcccagacuggucuugaa

SEQ ID NO: 578632 - RNA, 21 nt, Human
cuaaaaaaggaaaaaagaacc

SEQ ID NO: 578633 - RNA, 24 nt, Human
cuaaaacaaaacuuuacaaacauc

SEQ ID NO: 578634 - RNA, 18 nt, Human
cuaaagauagcauuuagc

SEQ ID NO: 578635 - RNA, 22 nt, Human
cuaauucacaacuguaguaaag

SEQ ID NO: 578636 - RNA, 24 nt, Human
cucaagcaauccucccaccucggc

SEQ ID NO: 578637 - RNA, 21 nt, Human
cucuauccccccaucaccacc

SEQ ID NO: 578638 - RNA, 19 nt, Human
cucuucuccaacagcuuua

SEQ ID NO: 578639 - RNA, 21 nt, Human
gaaaaauccacaguaugaagg

SEQ ID NO: 578640 - RNA, 22 nt, Human
gaaauaaaaagcaaaacgcaau

SEQ ID NO: 578641 - RNA, 23 nt, Human
gaccagccgggggacaggagcgu

SEQ ID NO: 578642 - RNA, 18 nt, Human
gcauuaaauuacaucgug

SEQ ID NO: 578643 - RNA, 22 nt, Human
gcuucuaccucuauccccccau

SEQ ID NO: 578644 - RNA, 25 nt, Human
ggaaaaaagaaccaaagaaaaaugu

SEQ ID NO: 578645 - RNA, 19 nt, Human
ggacucagaauugaagcag

SEQ ID NO: 578646 - RNA, 22 nt, Human
ggagucucgcuauguugcccag

SEQ ID NO: 578647 - RNA, 19 nt, Human
ggcagcggagacagccgaa

SEQ ID NO: 578648 - RNA, 22 nt, Human
ggggaaaaugauucauaauaaa

SEQ ID NO: 578649 - RNA, 23 nt, Human
uaaaaaaggaaaaaagaaccaaa

SEQ ID NO: 578650 - RNA, 23 nt, Human
uaaaaagcaaaacgcaauccaac

SEQ ID NO: 578651 - RNA, 23 nt, Human
uaaaacaaaacuuuacaaacauc

SEQ ID NO: 578652 - RNA, 26 nt, Human
uaaaaggacaauaacauaucaaagaa

SEQ ID NO: 578653 - RNA, 25 nt, Human
uaaacuaauucacaacuguaguaaa

SEQ ID NO: 578654 - RNA, 20 nt, Human
uaaccccuaaacaacacacu

SEQ ID NO: 578655 - RNA, 19 nt, Human
uacaacuacacccauuuag

SEQ ID NO: 578656 - RNA, 22 nt, Human
uacacaaguacauacaugcugg

SEQ ID NO: 578657 - RNA, 26 nt, Human
uacacaaguacauacaugcuggcauu

SEQ ID NO: 578658 - RNA, 21 nt, Human
uaccggugugagcaacugcac

SEQ ID NO: 578659 - RNA, 27 nt, Human
uaccucuauccccccaucaccaccaaa

SEQ ID NO: 578660 - RNA, 18 nt, Human
uagaaaacagugaaugaa

SEQ ID NO: 578661 - RNA, 22 nt, Human
uagagauggagucucgcuaugu

SEQ ID NO: 578662 - RNA, 20 nt, Human
uagcauuaaauuacaucgug

SEQ ID NO: 578663 - RNA, 22 nt, Human
uauacacauguaacaccuuucu

SEQ ID NO: 578664 - RNA, 23 nt, Human
uauagagauggagucucgcuaug

SEQ ID NO: 578665 - RNA, 26 nt, Human
uaucaaaaauagaaagucugaguuuc

SEQ ID NO: 578666 - RNA, 27 nt, Human
uaucaaagaacuuucacacaccuaaag

SEQ ID NO: 578667 - RNA, 20 nt, Human
uauguugcccagacuggucu

SEQ ID NO: 578668 - RNA, 23 nt, Human
uauguugcccagacuggucuuga

SEQ ID NO: 578669 - RNA, 24 nt, Human
uauguugcccagacuggucuugaa

SEQ ID NO: 578670 - RNA, 18 nt, Human
ucaaaaauagaaagucug

SEQ ID NO: 578671 - RNA, 19 nt, Human
ucaaagaacuuucacacac

SEQ ID NO: 578672 - RNA, 24 nt, Human
uccaacaaaaaggagacauauaga

SEQ ID NO: 578673 - RNA, 23 nt, Human
uccaacagcuuuagauguuuuuc

SEQ ID NO: 578674 - RNA, 21 nt, Human
ucccaaagugcugggauuacc

SEQ ID NO: 578675 - RNA, 23 nt, Human
ucccaaagugcugggauuaccgg

SEQ ID NO: 578676 - RNA, 23 nt, Human
uccuaaaaaaggaaaaaagaacc

SEQ ID NO: 578677 - RNA, 23 nt, Human
ucuaccucuauccccccaucacc

SEQ ID NO: 578678 - RNA, 19 nt, Human
ucucgcuauguugcccaga

SEQ ID NO: 578679 - RNA, 23 nt, Human
ucucgcuauguugcccagacugg

SEQ ID NO: 578680 - RNA, 24 nt, Human
ucucgcuauguugcccagacuggu

SEQ ID NO: 578681 - RNA, 26 nt, Human
ucucgcuauguugcccagacuggucu

SEQ ID NO: 578682 - RNA, 21 nt, Human
ucuguuguuuuguuuuuccua

SEQ ID NO: 578683 - RNA, 23 nt, Human
ucuugaacucaugagcucaagca

SEQ ID NO: 578684 - RNA, 21 nt, Human
ugaaaacacuuauuuuacugu

SEQ ID NO: 578685 - RNA, 22 nt, Human
ugaaaacauucagacuaaucaa

SEQ ID NO: 578686 - RNA, 22 nt, Human
ugacuaaaacaaaacuuuacaa

SEQ ID NO: 578687 - RNA, 22 nt, Human
ugacugcaaagaaaaugacuaa

SEQ ID NO: 578688 - RNA, 18 nt, Human
ugagaaaaccuaaggaug

SEQ ID NO: 578689 - RNA, 23 nt, Human
ugcaaagaaaaugacuaaaacaa

SEQ ID NO: 578690 - RNA, 18 nt, Human
uggagucucgcuauguug

SEQ ID NO: 578691 - RNA, 20 nt, Human
ugggauuaccggugugagca

SEQ ID NO: 578692 - RNA, 20 nt, Human
ugggauuaccggugugagca

SEQ ID NO: 578693 - RNA, 22 nt, Human
ugggauuaccggugugagcaac

SEQ ID NO: 578694 - RNA, 22 nt, Human
ugggauuaccggugugagcaac

SEQ ID NO: 578695 - RNA, 24 nt, Human
ugggauuaccggugugagcaacug

SEQ ID NO: 578696 - RNA, 19 nt, Human
uguaacaccuuucuagugg

SEQ ID NO: 578697 - RNA, 24 nt, Human
uguaauguauuaaugcacaaaaua

SEQ ID NO: 578698 - RNA, 18 nt, Human
uuaaugcauuuccuuuuu

SEQ ID NO: 578699 - RNA, 22 nt, Human
uuaccggugugagcaacugcac

SEQ ID NO: 578700 - RNA, 23 nt, Human
uuauagagauggagucucgcuau

SEQ ID NO: 578701 - RNA, 24 nt, Human
uuauagagauggagucucgcuaug

SEQ ID NO: 578702 - RNA, 19 nt, Human
uucaacaacaacaacaaac

SEQ ID NO: 578703 - RNA, 19 nt, Human
uucacauuuccuauguuug

SEQ ID NO: 578704 - RNA, 19 nt, Human
uuccuaaaaaaggaaaaaa

SEQ ID NO: 578705 - RNA, 20 nt, Human
uugaagaacaagaauauuua

SEQ ID NO: 578706 - RNA, 23 nt, Human
uuuauaaagaaauaaaaagcaaa

SEQ ID NO: 578707 - RNA, 24 nt, Human
uuuguuuuuaacuuuacuucauaa

SEQ ID NO: 578708 - RNA, 23 nt, Human
uuuuauuuauagagauggagucu

SEQ ID NO: 578709 - RNA, 25 nt, Human
uuuuuuuuuuuuuuuuuuuacuuag

SEQ ID NO: 578710 - RNA, 21 nt, Human
aaagaaacaaauacaaaacag

SEQ ID NO: 578711 - RNA, 19 nt, Human
aaagugcugggauuacagg

SEQ ID NO: 578712 - RNA, 23 nt, Human
aaagugcugggauuacaggcgua

SEQ ID NO: 578713 - RNA, 20 nt, Human
aaccucugccuccugaguuc

SEQ ID NO: 578714 - RNA, 22 nt, Human
aagaaacaaauacaaaacagga

SEQ ID NO: 578715 - RNA, 22 nt, Human
aagucagggccaauucagagga

SEQ ID NO: 578716 - RNA, 19 nt, Human
aagugcugggauuacaggc

SEQ ID NO: 578717 - RNA, 19 nt, Human
aagugcugggauuacaggc

SEQ ID NO: 578718 - RNA, 26 nt, Human
aagugcugggauuacaggcguaagcc

SEQ ID NO: 578719 - RNA, 18 nt, Human
accauguuggccaggcug

SEQ ID NO: 578720 - RNA, 23 nt, Human
acccaucuguggaguggcuacac

SEQ ID NO: 578721 - RNA, 22 nt, Human
agaauacaauccaauucaaaag

SEQ ID NO: 578722 - RNA, 20 nt, Human
agagcuuugguuucagucuc

SEQ ID NO: 578723 - RNA, 19 nt, Human
agaggauguggcugaaggc

SEQ ID NO: 578724 - RNA, 25 nt, Human
agcaaaacacuaaaagaagagcguu

SEQ ID NO: 578725 - RNA, 19 nt, Human
agcgaucuccugccucagc

SEQ ID NO: 578726 - RNA, 23 nt, Human
agcgaucuccugccucagccucc

SEQ ID NO: 578727 - RNA, 23 nt, Human
aggcguaagccacugugccuggc

SEQ ID NO: 578728 - RNA, 25 nt, Human
aggcuggagugcaguggcaugaucu

SEQ ID NO: 578729 - RNA, 24 nt, Human
aggugaucugcccgucucagccuc

SEQ ID NO: 578730 - RNA, 22 nt, Human
aguagagauggaguuucaccau

SEQ ID NO: 578731 - RNA, 18 nt, Human
aguagcugggauuacagg

SEQ ID NO: 578732 - RNA, 20 nt, Human
agugcaguggcaugaucuug

SEQ ID NO: 578733 - RNA, 23 nt, Human
agugcaguggcaugaucuuggcu

SEQ ID NO: 578734 - RNA, 24 nt, Human
agugcaguggcaugaucuuggcuc

SEQ ID NO: 578735 - RNA, 18 nt, Human
agugcugggauuacaggc

SEQ ID NO: 578736 - RNA, 24 nt, Human
aguggcaugaucuuggcucacugc

SEQ ID NO: 578737 - RNA, 20 nt, Human
aucauuuuaggauuacugag

SEQ ID NO: 578738 - RNA, 20 nt, Human
aucauuuuaggauuacugag

SEQ ID NO: 578739 - RNA, 18 nt, Human
auggaguuucaccauguu

SEQ ID NO: 578740 - RNA, 22 nt, Human
auggaguuucaccauguuggcc

SEQ ID NO: 578741 - RNA, 26 nt, Human
auucugaucccaagagaccacccauc

SEQ ID NO: 578742 - RNA, 24 nt, Human
auuuuuguauuuuuaguagagaug

SEQ ID NO: 578743 - RNA, 22 nt, Human
caaaaggacauaaauucacaaa

SEQ ID NO: 578744 - RNA, 24 nt, Human
caaagugcugggauuacaggcgua

SEQ ID NO: 578745 - RNA, 18 nt, Human
cacagaacaaccgcugga

SEQ ID NO: 578746 - RNA, 26 nt, Human
caccagaacaauggcuguaaaggaga

SEQ ID NO: 578747 - RNA, 18 nt, Human
caccauguuggccaggcu

SEQ ID NO: 578748 - RNA, 22 nt, Human
caccauguuggccaggcuguuc

SEQ ID NO: 578749 - RNA, 24 nt, Human
caccauguuggccaggcuguucuc

SEQ ID NO: 578750 - RNA, 27 nt, Human
caccauguuggccaggcuguucucaaa

SEQ ID NO: 578751 - RNA, 18 nt, Human
cacugcaaccucugccuc

SEQ ID NO: 578752 - RNA, 21 nt, Human
cacugcaaccucugccuccug

SEQ ID NO: 578753 - RNA, 18 nt, Human
cacugcguggguggaagc

SEQ ID NO: 578754 - RNA, 24 nt, Human
cagacuuugaccauaugcuaacca

SEQ ID NO: 578755 - RNA, 24 nt, Human
cagagucuugcucuguugcccagg

SEQ ID NO: 578756 - RNA, 24 nt, Human
cagcaugccuggcuaauuuuugua

SEQ ID NO: 578757 - RNA, 19 nt, Human
caggacagggccccagcuc

SEQ ID NO: 578758 - RNA, 18 nt, Human
cagguuacauaaaaaaca

SEQ ID NO: 578759 - RNA, 20 nt, Human
cagguuacauaaaaaacaau

SEQ ID NO: 578760 - RNA, 25 nt, Human
cauaaauucacaaaccugccugggc

SEQ ID NO: 578761 - RNA, 23 nt, Human
cauguguaaccagcuuuggaaau

SEQ ID NO: 578762 - RNA, 24 nt, Human
cauguuggccaggcuguucucaaa

SEQ ID NO: 578763 - RNA, 18 nt, Human
cauucugaucccaagaga

SEQ ID NO: 578764 - RNA, 23 nt, Human
cauuuuaggauuacugagugcug

SEQ ID NO: 578765 - RNA, 22 nt, Human
ccaaagugcugggauuacaggc

SEQ ID NO: 578766 - RNA, 22 nt, Human
ccaaagugcugggauuacaggc

SEQ ID NO: 578767 - RNA, 24 nt, Human
ccaaagugcugggauuacaggcgu

SEQ ID NO: 578768 - RNA, 20 nt, Human
ccacccaucuguggaguggc

SEQ ID NO: 578769 - RNA, 26 nt, Human
ccagcgaucuccugccucagccuccc

SEQ ID NO: 578770 - RNA, 27 nt, Human
ccagcgaucuccugccucagccucccg

SEQ ID NO: 578771 - RNA, 22 nt, Human
ccauaugcuaaccagaauacaa

SEQ ID NO: 578772 - RNA, 23 nt, Human
cccgaguagcugggauuacaggu

SEQ ID NO: 578773 - RNA, 24 nt, Human
cccgaguagcugggauuacaggug

SEQ ID NO: 578774 - RNA, 21 nt, Human
ccgaguagcugggauuacagg

SEQ ID NO: 578775 - RNA, 24 nt, Human
ccgaguagcugggauuacaggugu

SEQ ID NO: 578776 - RNA, 24 nt, Human
ccgucucagccucccaaagugcug

SEQ ID NO: 578777 - RNA, 22 nt, Human
ccugaucucaggugaucugccc

SEQ ID NO: 578778 - RNA, 23 nt, Human
ccugccucagccucccgaguagc

SEQ ID NO: 578779 - RNA, 19 nt, Human
cgacuucacacagaacaac

SEQ ID NO: 578780 - RNA, 24 nt, Human
cgucucagccucccaaagugcugg

SEQ ID NO: 578781 - RNA, 21 nt, Human
cucacugcaaccucugccucc

SEQ ID NO: 578782 - RNA, 24 nt, Human
cucagccucccgaguagcugggau

SEQ ID NO: 578783 - RNA, 21 nt, Human
cucaggugaucugcccgucuc

SEQ ID NO: 578784 - RNA, 22 nt, Human
cuccgagcuguaucaacugcau

SEQ ID NO: 578785 - RNA, 23 nt, Human
cuccuauaccuacaccuguugua

SEQ ID NO: 578786 - RNA, 19 nt, Human
cuccugaguuccagcgauc

SEQ ID NO: 578787 - RNA, 25 nt, Human
cucugcauacauucccacuuuuccu

SEQ ID NO: 578788 - RNA, 23 nt, Human
cucuguugcccaggcuggagugc

SEQ ID NO: 578789 - RNA, 23 nt, Human
cugcaaccucugccuccugaguu

SEQ ID NO: 578790 - RNA, 24 nt, Human
cugcaaccucugccuccugaguuc

SEQ ID NO: 578791 - RNA, 23 nt, Human
cugccucagccucccgaguagcu

SEQ ID NO: 578792 - RNA, 24 nt, Human
cuggagugcaguggcaugaucuug

SEQ ID NO: 578793 - RNA, 21 nt, Human
cuugcucuguugcccaggcug

SEQ ID NO: 578794 - RNA, 21 nt, Human
cuuuuuuguuucuuuugagag

SEQ ID NO: 578795 - RNA, 21 nt, Human
gagacagagucuugcucuguu

SEQ ID NO: 578796 - RNA, 24 nt, Human
gaguagcugggauuacaggugugc

SEQ ID NO: 578797 - RNA, 19 nt, Human
gaucuccugccucagccuc

SEQ ID NO: 578798 - RNA, 18 nt, Human
gauuacaggcguaagcca

SEQ ID NO: 578799 - RNA, 21 nt, Human
gauuacaggcguaagccacug

SEQ ID NO: 578800 - RNA, 24 nt, Human
gauuacaggcguaagccacugugc

SEQ ID NO: 578801 - RNA, 21 nt, Human
gauuacaggugugcaccagca

SEQ ID NO: 578802 - RNA, 21 nt, Human
gauuacaggugugcaccagca

SEQ ID NO: 578803 - RNA, 22 nt, Human
gcaaaacacuaaaagaagagcg

SEQ ID NO: 578804 - RNA, 21 nt, Human
gcacauaacaaugaacucugg

SEQ ID NO: 578805 - RNA, 20 nt, Human
gcccaggcuggagugcagug

SEQ ID NO: 578806 - RNA, 24 nt, Human
gcccaggcuggagugcaguggcau

SEQ ID NO: 578807 - RNA, 23 nt, Human
gcgaucuccugccucagccuccc

SEQ ID NO: 578808 - RNA, 21 nt, Human
gcucacugcaaccucugccuc

SEQ ID NO: 578809 - RNA, 22 nt, Human
ggaguuucaccauguuggccag

SEQ ID NO: 578810 - RNA, 24 nt, Human
ggauuacaggcguaagccacugug

SEQ ID NO: 578811 - RNA, 22 nt, Human
gggagacagcuguucguuccgc

SEQ ID NO: 578812 - RNA, 18 nt, Human
guagcugggauuacaggu

SEQ ID NO: 578813 - RNA, 24 nt, Human
gugaucugcccgucucagccuccc

SEQ ID NO: 578814 - RNA, 19 nt, Human
guggaguggcuacacagcc

SEQ ID NO: 578815 - RNA, 21 nt, Human
uaaaagaagagcguucuaguu

SEQ ID NO: 578816 - RNA, 18 nt, Human
uaaagaaacaaauacaaa

SEQ ID NO: 578817 - RNA, 23 nt, Human
uaaagaaacaaauacaaaacagg

SEQ ID NO: 578818 - RNA, 20 nt, Human
uaaggaauuaucaaagauca

SEQ ID NO: 578819 - RNA, 24 nt, Human
uaauuuuuguauuuuuaguagaga

SEQ ID NO: 578820 - RNA, 23 nt, Human
uacaaaacaggauuucagcaaaa

SEQ ID NO: 578821 - RNA, 22 nt, Human
uacaauccaauucaaaagugga

SEQ ID NO: 578822 - RNA, 22 nt, Human
uacaggcguaagccacugugcc

SEQ ID NO: 578823 - RNA, 22 nt, Human
uagagauggaguuucaccaugu

SEQ ID NO: 578824 - RNA, 24 nt, Human
uaguagagauggaguuucaccaug

SEQ ID NO: 578825 - RNA, 25 nt, Human
uaguagagauggaguuucaccaugu

SEQ ID NO: 578826 - RNA, 23 nt, Human
uaguuuguuuaaggaauuaucaa

SEQ ID NO: 578827 - RNA, 20 nt, Human
uaucaaagaucauacuuggc

SEQ ID NO: 578828 - RNA, 18 nt, Human
uaugcaaaaggacauaaa

SEQ ID NO: 578829 - RNA, 19 nt, Human
ucacugcaaccucugccuc

SEQ ID NO: 578830 - RNA, 20 nt, Human
ucacugcaaccucugccucc

SEQ ID NO: 578831 - RNA, 22 nt, Human
ucacugcaaccucugccuccug

SEQ ID NO: 578832 - RNA, 24 nt, Human
ucacugcaaccucugccuccugag

SEQ ID NO: 578833 - RNA, 25 nt, Human
ucacugcaaccucugccuccugagu

SEQ ID NO: 578834 - RNA, 22 nt, Human
ucagcaaaacacuaaaagaaga

SEQ ID NO: 578835 - RNA, 20 nt, Human
ucagccucccgaguagcugg

SEQ ID NO: 578836 - RNA, 19 nt, Human
ucagggccaauucagagga

SEQ ID NO: 578837 - RNA, 27 nt, Human
uccaccagaacaauggcuguaaaggag

SEQ ID NO: 578838 - RNA, 21 nt, Human
uccauuuaauuucccaugguu

SEQ ID NO: 578839 - RNA, 24 nt, Human
ucccaaagugcugggauuacaggc

SEQ ID NO: 578840 - RNA, 23 nt, Human
ucccgaguagcugggauuacagg

SEQ ID NO: 578841 - RNA, 24 nt, Human
ucccgaguagcugggauuacaggu

SEQ ID NO: 578842 - RNA, 20 nt, Human
uccugaguuccagcgaucuc

SEQ ID NO: 578843 - RNA, 24 nt, Human
ucucacaacaagggagacagcugu

SEQ ID NO: 578844 - RNA, 24 nt, Human
ucuccugccucagccucccgagua

SEQ ID NO: 578845 - RNA, 19 nt, Human
ucuguaaugagaaagucuu

SEQ ID NO: 578846 - RNA, 24 nt, Human
ucuguugcccaggcuggagugcag

SEQ ID NO: 578847 - RNA, 23 nt, Human
ucuugcucuguugcccaggcugg

SEQ ID NO: 578848 - RNA, 24 nt, Human
ucuugcucuguugcccaggcugga

SEQ ID NO: 578849 - RNA, 20 nt, Human
ugaaccaacucaacgugcuc

SEQ ID NO: 578850 - RNA, 19 nt, Human
ugaccuccuauaccuacac

SEQ ID NO: 578851 - RNA, 26 nt, Human
ugacuaaacucuguaaugagaaaguc

SEQ ID NO: 578852 - RNA, 24 nt, Human
ugaucucaggugaucugcccgucu

SEQ ID NO: 578853 - RNA, 18 nt, Human
ugcaagugaaaagugaac

SEQ ID NO: 578854 - RNA, 22 nt, Human
ugcaguggcaugaucuuggcuc

SEQ ID NO: 578855 - RNA, 20 nt, Human
ugccaggauuuggaguaccu

SEQ ID NO: 578856 - RNA, 18 nt, Human
ugcccaggcuggagugca

SEQ ID NO: 578857 - RNA, 21 nt, Human
ugcccaggcuggagugcagug

SEQ ID NO: 578858 - RNA, 22 nt, Human
ugcccaggcuggagugcagugg

SEQ ID NO: 578859 - RNA, 24 nt, Human
ugcccaggcuggagugcaguggca

SEQ ID NO: 578860 - RNA, 24 nt, Human
ugccucagccucccgaguagcugg

SEQ ID NO: 578861 - RNA, 27 nt, Human
ugccuccugaguuccagcgaucuccuu

SEQ ID NO: 578862 - RNA, 19 nt, Human
ugccuggcccaaugugugg

SEQ ID NO: 578863 - RNA, 18 nt, Human
ugcuacguugacuaaacu

SEQ ID NO: 578864 - RNA, 24 nt, Human
ugcucuguugcccaggcuggagug

SEQ ID NO: 578865 - RNA, 24 nt, Human
ugcugggauuacaggcguaagcca

SEQ ID NO: 578866 - RNA, 19 nt, Human
uggagugcaguggcaugau

SEQ ID NO: 578867 - RNA, 24 nt, Human
uggagugcaguggcaugaucuugg

SEQ ID NO: 578868 - RNA, 24 nt, Human
uggaguuucaccauguuggccagg

SEQ ID NO: 578869 - RNA, 19 nt, Human
uggcaaaauaaaaaaauag

SEQ ID NO: 578870 - RNA, 19 nt, Human
uggcaugaucuuggcucac

SEQ ID NO: 578871 - RNA, 21 nt, Human
uggcaugaucuuggcucacug

SEQ ID NO: 578872 - RNA, 24 nt, Human
uggccaggcuguucucaaacuccu

SEQ ID NO: 578873 - RNA, 21 nt, Human
ugggauuacaggcguaagcca

SEQ ID NO: 578874 - RNA, 22 nt, Human
ugggauuacaggcguaagccac

SEQ ID NO: 578875 - RNA, 22 nt, Human
ugggauuacaggcguaagccac

SEQ ID NO: 578876 - RNA, 22 nt, Human
ugggauuacaggcguaagccac

SEQ ID NO: 578877 - RNA, 23 nt, Human
ugggauuacaggcguaagccacu

SEQ ID NO: 578878 - RNA, 24 nt, Human
ugggauuacaggcguaagccacug

SEQ ID NO: 578879 - RNA, 21 nt, Human
ugggauuacaggugugcacca

SEQ ID NO: 578880 - RNA, 21 nt, Human
ugggauuacaggugugcacca

SEQ ID NO: 578881 - RNA, 21 nt, Human
ugggauuacaggugugcacca

SEQ ID NO: 578882 - RNA, 25 nt, Human
ugggauuacaggugugcaccagcau

SEQ ID NO: 578883 - RNA, 23 nt, Human
uguaaagaaacaaauacaaaaca

SEQ ID NO: 578884 - RNA, 19 nt, Human
uguaucaacugcauucugu

SEQ ID NO: 578885 - RNA, 22 nt, Human
uguauuuuuaguagagauggag

SEQ ID NO: 578886 - RNA, 27 nt, Human
uguggcacauaacaaugaacucuggug

SEQ ID NO: 578887 - RNA, 19 nt, Human
ugugugcagcugcuguuuc

SEQ ID NO: 578888 - RNA, 22 nt, Human
ugugugcagcugcuguuucugg

SEQ ID NO: 578889 - RNA, 26 nt, Human
uuaauuaucuuuccauuuaauuuccc

SEQ ID NO: 578890 - RNA, 24 nt, Human
uuaccgaacuccuuuucuugaccu

SEQ ID NO: 578891 - RNA, 18 nt, Human
uuaguagagauggaguuu

SEQ ID NO: 578892 - RNA, 24 nt, Human
uuaguagagauggaguuucaccau

SEQ ID NO: 578893 - RNA, 19 nt, Human
uugacuaaacucuguaaug

SEQ ID NO: 578894 - RNA, 24 nt, Human
uugcucuguugcccaggcuggagu

SEQ ID NO: 578895 - RNA, 23 nt, Human
uuguauuuuuaguagagauggag

SEQ ID NO: 578896 - RNA, 23 nt, Human
uuguccaccagaacaauggcugu

SEQ ID NO: 578897 - RNA, 21 nt, Human
uuucaccauguuggccaggcu

SEQ ID NO: 578898 - RNA, 24 nt, Human
uuuuuaguagagauggaguuucac

SEQ ID NO: 578899 - RNA, 20 nt, Human
uuuuuguauuuuuaguagag

SEQ ID NO: 578900 - RNA, 25 nt, Human
aaaaaacaaaaaaaacuagcaugcc

SEQ ID NO: 578901 - RNA, 24 nt, Human
aaaaaaucauuuacccacuccaac

SEQ ID NO: 578902 - RNA, 18 nt, Human
aaacaagaagaaaacagg

SEQ ID NO: 578903 - RNA, 23 nt, Human
aaacaagaagaaaacaggaaacc

SEQ ID NO: 578904 - RNA, 28 nt, Human
aaacaagaagaaaacaggaaaccuccag

SEQ ID NO: 578905 - RNA, 19 nt, Human
aagaaaacaggaaaccucc

SEQ ID NO: 578906 - RNA, 24 nt, Human
aagaagaaaacaggaaaccuccag

SEQ ID NO: 578907 - RNA, 18 nt, Human
aagcaaagcaaaacaaaa

SEQ ID NO: 578908 - RNA, 21 nt, Human
aagugacccuccuacuucagc

SEQ ID NO: 578909 - RNA, 23 nt, Human
aaucaaaagcauuaugagcuaaa

SEQ ID NO: 578910 - RNA, 22 nt, Human
accaccaguuaaaacaagaaga

SEQ ID NO: 578911 - RNA, 19 nt, Human
acccaguaaaguacuaccu

SEQ ID NO: 578912 - RNA, 24 nt, Human
agaagaaaacaggaaaccuccagu

SEQ ID NO: 578913 - RNA, 22 nt, Human
agaggugcaacaggucagagau

SEQ ID NO: 578914 - RNA, 24 nt, Human
agcugggauuauaguagucgaguc

SEQ ID NO: 578915 - RNA, 23 nt, Human
auuguuacugauaaccuacaauc

SEQ ID NO: 578916 - RNA, 21 nt, Human
caaaaaaaacuagcaugccug

SEQ ID NO: 578917 - RNA, 27 nt, Human
caacaagcaaagcaaaacaaaaccuuu

SEQ ID NO: 578918 - RNA, 20 nt, Human
cacccugccuggcuuaauuu

SEQ ID NO: 578919 - RNA, 24 nt, Human
cagcagcugggauuauaguagugc

SEQ ID NO: 578920 - RNA, 22 nt, Human
caggucagagaugcaggaagug

SEQ ID NO: 578921 - RNA, 23 nt, Human
ccacaaaggcccuacaccucuga

SEQ ID NO: 578922 - RNA, 19 nt, Human
ccaguuaaaacaagaagaa

SEQ ID NO: 578923 - RNA, 20 nt, Human
ccaguuaaaacaagaagaaa

SEQ ID NO: 578924 - RNA, 23 nt, Human
ccaguuaaaacaagaagaaaaca

SEQ ID NO: 578925 - RNA, 26 nt, Human
ccaguuaaaacaagaagaaaacagga

SEQ ID NO: 578926 - RNA, 21 nt, Human
ccuccaguuaagaggguuuua

SEQ ID NO: 578927 - RNA, 23 nt, Human
ccuugcuauguugccuaggcugg

SEQ ID NO: 578928 - RNA, 21 nt, Human
cucaagggucagcugaggcag

SEQ ID NO: 578929 - RNA, 24 nt, Human
cuggcuuaauuucaguuuucuuaa

SEQ ID NO: 578930 - RNA, 18 nt, Human
cuuuauguguacauugau

SEQ ID NO: 578931 - RNA, 18 nt, Human
gcaaagcaaaacaaaacc

SEQ ID NO: 578932 - RNA, 19 nt, Human
gcaaagcaaaacaaaaccu

SEQ ID NO: 578933 - RNA, 21 nt, Human
gcaaagcaaaacaaaaccuuu

SEQ ID NO: 578934 - RNA, 19 nt, Human
gggcgauauuaacuugaaa

SEQ ID NO: 578935 - RNA, 18 nt, Human
guauguauguauuauguu

SEQ ID NO: 578936 - RNA, 22 nt, Human
guauuucugccucacuucacug

SEQ ID NO: 578937 - RNA, 19 nt, Human
gugcauuucgaccaguagg

SEQ ID NO: 578938 - RNA, 21 nt, Human
gugcuaauuagagugcaugag

SEQ ID NO: 578939 - RNA, 22 nt, Human
gugcuugcugcuaagauaacag

SEQ ID NO: 578940 - RNA, 21 nt, Human
guuuucuuaaaaaaaaaaaac

SEQ ID NO: 578941 - RNA, 26 nt, Human
uaaaaaaaaaaaacaaaaaaaacuag

SEQ ID NO: 578942 - RNA, 22 nt, Human
uaaaaagacacaugacugggua

SEQ ID NO: 578943 - RNA, 24 nt, Human
uaaaaagagcauccucguauguaa

SEQ ID NO: 578944 - RNA, 27 nt, Human
uaaaaagagcauccucguauguaaugg

SEQ ID NO: 578945 - RNA, 18 nt, Human
uaaaacaagaagaaaaca

SEQ ID NO: 578946 - RNA, 25 nt, Human
uaaaacaagaagaaaacaggaaacc

SEQ ID NO: 578947 - RNA, 22 nt, Human
uaacuacugcugccaccugcug

SEQ ID NO: 578948 - RNA, 19 nt, Human
uaauuccauuagaagguaa

SEQ ID NO: 578949 - RNA, 24 nt, Human
uacgugaauauacuuguguaugua

SEQ ID NO: 578950 - RNA, 24 nt, Human
uacuggaaaccaccaguuaaaaca

SEQ ID NO: 578951 - RNA, 21 nt, Human
uacuucagccgccccagcagc

SEQ ID NO: 578952 - RNA, 22 nt, Human
uagagaugggaccuugcuaugu

SEQ ID NO: 578953 - RNA, 23 nt, Human
uaugaaaaugcacucuuuucuca

SEQ ID NO: 578954 - RNA, 24 nt, Human
uauguacgugaauauacuugugua

SEQ ID NO: 578955 - RNA, 18 nt, Human
uauguugccuaggcuggc

SEQ ID NO: 578956 - RNA, 18 nt, Human
uauguugccuaggcuggc

SEQ ID NO: 578957 - RNA, 21 nt, Human
uauguugccuaggcuggcaga

SEQ ID NO: 578958 - RNA, 20 nt, Human
ucacaacaagcaaagcaaaa

SEQ ID NO: 578959 - RNA, 23 nt, Human
ucucuuaacuacugcugccaccu

SEQ ID NO: 578960 - RNA, 22 nt, Human
ucuuaaaaaaaaaaaacaaaaa

SEQ ID NO: 578961 - RNA, 24 nt, Human
ucuuaaaaaaaaaaaacaaaaaaa

SEQ ID NO: 578962 - RNA, 19 nt, Human
ugccuaggcuggcagauuu

SEQ ID NO: 578963 - RNA, 23 nt, Human
ugcugcuaagauaacagaggugc

SEQ ID NO: 578964 - RNA, 24 nt, Human
ugggaccuugcuauguugccuagg

SEQ ID NO: 578965 - RNA, 21 nt, Human
ugggauuauaguagugcgcca

SEQ ID NO: 578966 - RNA, 22 nt, Human
ugggauuauaguagugcgccac

SEQ ID NO: 578967 - RNA, 21 nt, Human
uguauguauguauuauguuau

SEQ ID NO: 578968 - RNA, 19 nt, Human
uguguguauuuauguacgu

SEQ ID NO: 578969 - RNA, 22 nt, Human
uguguguauuuauguacgugaa

SEQ ID NO: 578970 - RNA, 19 nt, Human
uugaaugaaacucaaucuu

SEQ ID NO: 578971 - RNA, 24 nt, Human
uugauguacuuuucaggagcuuau

SEQ ID NO: 578972 - RNA, 20 nt, Human
uuucucagcaugaucucucc

SEQ ID NO: 578973 - RNA, 18 nt, Human
uuuuggggaaaaaaauca

SEQ ID NO: 578974 - RNA, 24 nt, Human
aaaaaagacaaaugagggcucaaa

SEQ ID NO: 578975 - RNA, 25 nt, Human
aaaaaagacaaaugagggcucaaaa

SEQ ID NO: 578976 - RNA, 25 nt, Human
aaaaaggaauuacaguaacuuuaaa

SEQ ID NO: 578977 - RNA, 26 nt, Human
aaaaaggaauuacaguaacuuuaaaa

SEQ ID NO: 578978 - RNA, 19 nt, Human
aaugagggcucaaaaagga

SEQ ID NO: 578979 - RNA, 22 nt, Human
caaaaaagacaaaugagggcuc

SEQ ID NO: 578980 - RNA, 18 nt, Human
gauagccuuggcucaaaa

SEQ ID NO: 578981 - RNA, 24 nt, Human
uacaguaacuuuaaaaaauauauu

SEQ ID NO: 578982 - RNA, 23 nt, Human
aaacccaggccagacaugcuuga

SEQ ID NO: 578983 - RNA, 18 nt, Human
agaaagaagguggaaugu

SEQ ID NO: 578984 - RNA, 19 nt, Human
augaagcauucauggaagg

SEQ ID NO: 578985 - RNA, 18 nt, Human
augggcauggacguggcu

SEQ ID NO: 578986 - RNA, 21 nt, Human
cagcccuccugcacucucuuc

SEQ ID NO: 578987 - RNA, 19 nt, Human
ccaggccauagaccaccag

SEQ ID NO: 578988 - RNA, 19 nt, Human
cccacagaacacagggguc

SEQ ID NO: 578989 - RNA, 21 nt, Human
cccuccugcacucucuucuca

SEQ ID NO: 578990 - RNA, 19 nt, Human
ccuccugcacucucuucuc

SEQ ID NO: 578991 - RNA, 24 nt, Human
ccucuuuuuuugaaaacccaggcc

SEQ ID NO: 578992 - RNA, 20 nt, Human
ccuugcacagggaggcccuc

SEQ ID NO: 578993 - RNA, 19 nt, Human
cgcccuugaaccaauggcu

SEQ ID NO: 578994 - RNA, 18 nt, Human
cugcacucucuucucauc

SEQ ID NO: 578995 - RNA, 21 nt, Human
cuggucccucugggaugaagc

SEQ ID NO: 578996 - RNA, 23 nt, Human
cuugcaucucgcugucagcugga

SEQ ID NO: 578997 - RNA, 20 nt, Human
gaacacugaaagacccucau

SEQ ID NO: 578998 - RNA, 18 nt, Human
gaccaccaggucaugagg

SEQ ID NO: 578999 - RNA, 18 nt, Human
gcacggaaugggcaugga

SEQ ID NO: 579000 - RNA, 19 nt, Human
gcccuccugcacucucuuc

SEQ ID NO: 579001 - RNA, 19 nt, Human
gcucugcucucugucccca

SEQ ID NO: 579002 - RNA, 24 nt, Human
gggagguugcaaagagcccauggc

SEQ ID NO: 579003 - RNA, 18 nt, Human
uaaacaggaacacugaaa

SEQ ID NO: 579004 - RNA, 23 nt, Human
ucacccacagaacacagggguug

SEQ ID NO: 579005 - RNA, 21 nt, Human
ucaugaggaucccucuuuuuu

SEQ ID NO: 579006 - RNA, 19 nt, Human
uccauggcccccagcccuc

SEQ ID NO: 579007 - RNA, 24 nt, Human
ucccucuuuuuuugaaaacccagg

SEQ ID NO: 579008 - RNA, 19 nt, Human
ucccuugcacagggaggcc

SEQ ID NO: 579009 - RNA, 23 nt, Human
ucucaggaguguucuguuaauau

SEQ ID NO: 579010 - RNA, 23 nt, Human
ugaaagacccucaucuugaccca

SEQ ID NO: 579011 - RNA, 23 nt, Human
ugagccuugggccugaggacuga

SEQ ID NO: 579012 - RNA, 18 nt, Human
ugaggcccgagugugcuc

SEQ ID NO: 579013 - RNA, 19 nt, Human
ugcucugcucucugucccc

SEQ ID NO: 579014 - RNA, 20 nt, Human
uggcagcaucuuugaagggc

SEQ ID NO: 579015 - RNA, 22 nt, Human
uggcccccagcccuccugcacu

SEQ ID NO: 579016 - RNA, 21 nt, Human
ugggagggaugaggcccgagu

SEQ ID NO: 579017 - RNA, 20 nt, Human
ugggaugaagcauucaugga

SEQ ID NO: 579018 - RNA, 23 nt, Human
uguaauaacucuagggcgaacac

SEQ ID NO: 579019 - RNA, 20 nt, Human
uucaggguaaggagagcuga

SEQ ID NO: 579020 - RNA, 19 nt, Human
uuccagucugguuaguggg

SEQ ID NO: 579021 - RNA, 20 nt, Human
uuccuccauggcccccagcc

SEQ ID NO: 579022 - RNA, 19 nt, Human
uugaagggcuagaaagaag

SEQ ID NO: 579023 - RNA, 19 nt, Human
uugcacagggaggcccucu

SEQ ID NO: 579024 - RNA, 22 nt, Human
uuggcagugauaaagaaguucc

SEQ ID NO: 579025 - RNA, 22 nt, Human
uugugcuauuucuucuucaacu

SEQ ID NO: 579026 - RNA, 21 nt, Human
aaaacccaccuggcauuaccc

SEQ ID NO: 579027 - RNA, 21 nt, Human
acaaacacuuugggucuuucc

SEQ ID NO: 579028 - RNA, 19 nt, Human
acagggggaaggaagugag

SEQ ID NO: 579029 - RNA, 21 nt, Human
acauacauggauccaccaaca

SEQ ID NO: 579030 - RNA, 22 nt, Human
accacaaggagcagagacggca

SEQ ID NO: 579031 - RNA, 22 nt, Human
acggcacccgacaacggagaag

SEQ ID NO: 579032 - RNA, 22 nt, Human
agaggcuggaagccuaagagcu

SEQ ID NO: 579033 - RNA, 18 nt, Human
aggagcagagacggcacc

SEQ ID NO: 579034 - RNA, 23 nt, Human
agguuuuguagcaucuucugagc

SEQ ID NO: 579035 - RNA, 22 nt, Human
caaaaagguaaacagaagcuga

SEQ ID NO: 579036 - RNA, 19 nt, Human
caauaaccacaaggagcag

SEQ ID NO: 579037 - RNA, 23 nt, Human
caccuucacucucaaaggaaagg

SEQ ID NO: 579038 - RNA, 20 nt, Human
cagagacggcacccgacaac

SEQ ID NO: 579039 - RNA, 23 nt, Human
cagcaggccgcugugcuggacac

SEQ ID NO: 579040 - RNA, 23 nt, Human
caggagacgcgcgcagggaucac

SEQ ID NO: 579041 - RNA, 20 nt, Human
cagggcugagcaauaaccac

SEQ ID NO: 579042 - RNA, 18 nt, Human
cagggggaaggaagugag

SEQ ID NO: 579043 - RNA, 21 nt, Human
caucaguccuucuguguucuc

SEQ ID NO: 579044 - RNA, 22 nt, Human
ccacaaggagcagagacggcac

SEQ ID NO: 579045 - RNA, 19 nt, Human
cccagccauggaacacaug

SEQ ID NO: 579046 - RNA, 24 nt, Human
ccccuggggaugccagggcugagc

SEQ ID NO: 579047 - RNA, 18 nt, Human
cccgaauucucuccccuu

SEQ ID NO: 579048 - RNA, 20 nt, Human
cccuggggaugccagggcug

SEQ ID NO: 579049 - RNA, 18 nt, Human
ccucacugcugccauucc

SEQ ID NO: 579050 - RNA, 25 nt, Human
ccucccaucuaccucacugcugcca

SEQ ID NO: 579051 - RNA, 26 nt, Human
cggcacccgacaacggagaagagaug

SEQ ID NO: 579052 - RNA, 19 nt, Human
cuaauauuaauaauaccua

SEQ ID NO: 579053 - RNA, 18 nt, Human
cucagaguccagcaggcc

SEQ ID NO: 579054 - RNA, 21 nt, Human
cuccacccaccuucacucuca

SEQ ID NO: 579055 - RNA, 18 nt, Human
cugcuggaagcugagacc

SEQ ID NO: 579056 - RNA, 24 nt, Human
cuguguggcuccuaccaccccaaa

SEQ ID NO: 579057 - RNA, 19 nt, Human
gaaaccaugauuccuucuc

SEQ ID NO: 579058 - RNA, 23 nt, Human
gacccagcucucaaaacccaccu

SEQ ID NO: 579059 - RNA, 19 nt, Human
gccugugaguccugagaug

SEQ ID NO: 579060 - RNA, 23 nt, Human
gcgcagcgcggcgcacugacccg

SEQ ID NO: 579061 - RNA, 18 nt, Human
ggaaggaagugagugagg

SEQ ID NO: 579062 - RNA, 21 nt, Human
ggagaagagaugucugcagua

SEQ ID NO: 579063 - RNA, 18 nt, Human
ggcugagcaauaaccaca

SEQ ID NO: 579064 - RNA, 19 nt, Human
gggaaggaagugagugagg

SEQ ID NO: 579065 - RNA, 21 nt, Human
gggaaggaagugagugagggg

SEQ ID NO: 579066 - RNA, 21 nt, Human
guagaggcuggaagccuaaga

SEQ ID NO: 579067 - RNA, 22 nt, Human
guagaggcuggaagccuaagag

SEQ ID NO: 579068 - RNA, 24 nt, Human
gucaacuccacccaccuucacucu

SEQ ID NO: 579069 - RNA, 18 nt, Human
guggcuccuaccacccca

SEQ ID NO: 579070 - RNA, 23 nt, Human
uaaacagaagcugaugugggugg

SEQ ID NO: 579071 - RNA, 21 nt, Human
uaaccacaaggagcagagacg

SEQ ID NO: 579072 - RNA, 20 nt, Human
uaccucacugcugccauucc

SEQ ID NO: 579073 - RNA, 20 nt, Human
uacuucauuccuauaguaga

SEQ ID NO: 579074 - RNA, 23 nt, Human
uagaucccuuccugcuaauauua

SEQ ID NO: 579075 - RNA, 21 nt, Human
ucagaauuuccugccagccag

SEQ ID NO: 579076 - RNA, 22 nt, Human
ucagaguccagcaggccgcugu

SEQ ID NO: 579077 - RNA, 20 nt, Human
ucauuauuugaugccaaaaa

SEQ ID NO: 579078 - RNA, 21 nt, Human
uccaccaacauacaucagucc

SEQ ID NO: 579079 - RNA, 23 nt, Human
uccacccaccuucacucucaaag

SEQ ID NO: 579080 - RNA, 21 nt, Human
uccagauguguuuauuaggcu

SEQ ID NO: 579081 - RNA, 20 nt, Human
uccccuggggaugccagggc

SEQ ID NO: 579082 - RNA, 20 nt, Human
ucucaaaacccaccuggcau

SEQ ID NO: 579083 - RNA, 20 nt, Human
ucucacaguugcuacuggcu

SEQ ID NO: 579084 - RNA, 19 nt, Human
ucucagaguccagcaggcc

SEQ ID NO: 579085 - RNA, 21 nt, Human
ucucuccugcaugguagaggc

SEQ ID NO: 579086 - RNA, 22 nt, Human
ucucuggucaacuccacccacc

SEQ ID NO: 579087 - RNA, 20 nt, Human
ucugguuucccgaagauaag

SEQ ID NO: 579088 - RNA, 19 nt, Human
ucugugccuccugcaaguu

SEQ ID NO: 579089 - RNA, 21 nt, Human
ucuguguggcuccuaccaccc

SEQ ID NO: 579090 - RNA, 24 nt, Human
ugagaggcacuucuagaaaccaug

SEQ ID NO: 579091 - RNA, 21 nt, Human
ugagcaauaaccacaaggagc

SEQ ID NO: 579092 - RNA, 19 nt, Human
ugccuguagaaagauuucc

SEQ ID NO: 579093 - RNA, 23 nt, Human
ugcucugaucuuucccaguucuc

SEQ ID NO: 579094 - RNA, 25 nt, Human
ugcugccauuccccuggggaugcca

SEQ ID NO: 579095 - RNA, 18 nt, Human
uggaacacauguuggccu

SEQ ID NO: 579096 - RNA, 22 nt, Human
uggaagcugagaccaucagcag

SEQ ID NO: 579097 - RNA, 21 nt, Human
uggcagacaguaggcaugagg

SEQ ID NO: 579098 - RNA, 18 nt, Human
ugguagaggcuggaagcc

SEQ ID NO: 579099 - RNA, 22 nt, Human
ugguaggcaauucccagccaug

SEQ ID NO: 579100 - RNA, 19 nt, Human
ugugcuggacacauacaug

SEQ ID NO: 579101 - RNA, 24 nt, Human
uucccagccauggaacacauguug

SEQ ID NO: 579102 - RNA, 21 nt, Human
uucccgaagauaagaggcaag

SEQ ID NO: 579103 - RNA, 19 nt, Human
uucuagaaaccaugauucc

SEQ ID NO: 579104 - RNA, 21 nt, Human
uugaugccaaaaagguaaaca

SEQ ID NO: 579105 - RNA, 24 nt, Human
aagcauggcuguggccacccauac

SEQ ID NO: 579106 - RNA, 19 nt, Human
aagguuuuuaaauuaauag

SEQ ID NO: 579107 - RNA, 19 nt, Human
aaucucagaaagcauaugu

SEQ ID NO: 579108 - RNA, 19 nt, Human
acccauacacauacacaca

SEQ ID NO: 579109 - RNA, 22 nt, Human
auacacauacacacaccucaua

SEQ ID NO: 579110 - RNA, 20 nt, Human
auagagcaacaggaugcaaa

SEQ ID NO: 579111 - RNA, 26 nt, Human
cacacucaugacaaacuccauaaaaa

SEQ ID NO: 579112 - RNA, 19 nt, Human
ccaccacguggaagagcuc

SEQ ID NO: 579113 - RNA, 25 nt, Human
ccacccauacacauacacacaccuc

SEQ ID NO: 579114 - RNA, 22 nt, Human
cccauacacauacacacaccuc

SEQ ID NO: 579115 - RNA, 23 nt, Human
cccauacacauacacacaccuca

SEQ ID NO: 579116 - RNA, 24 nt, Human
cccauacacauacacacaccucau

SEQ ID NO: 579117 - RNA, 23 nt, Human
cuaugccuguggguguauauacc

SEQ ID NO: 579118 - RNA, 24 nt, Human
cucacgagcagcaaauacgaucac

SEQ ID NO: 579119 - RNA, 25 nt, Human
cuuugaaugaugcagauguuggccu

SEQ ID NO: 579120 - RNA, 24 nt, Human
gagcaacaggaugcaaauacuggg

SEQ ID NO: 579121 - RNA, 18 nt, Human
gaucacacucaugacaaa

SEQ ID NO: 579122 - RNA, 19 nt, Human
ggcuguggccacccauaca

SEQ ID NO: 579123 - RNA, 25 nt, Human
ucaaaucaaauuaaaaucuaggaag

SEQ ID NO: 579124 - RNA, 22 nt, Human
ugcauagauuccaccacgugga

SEQ ID NO: 579125 - RNA, 25 nt, Human
uggaugguuuuccagaauuaaugag

SEQ ID NO: 579126 - RNA, 22 nt, Human
uggccuuuccccaaaauaaaag

SEQ ID NO: 579127 - RNA, 24 nt, Human
uguggccacccauacacauacaca

SEQ ID NO: 579128 - RNA, 22 nt, Human
uugcauagauuccaccacgugg

SEQ ID NO: 579129 - RNA, 22 nt, Human
aaaaaguaaagugagaagaagu

SEQ ID NO: 579130 - RNA, 18 nt, Human
aaaacauucaggcaaaug

SEQ ID NO: 579131 - RNA, 22 nt, Human
aaacauucaggcaaaugaaaug

SEQ ID NO: 579132 - RNA, 19 nt, Human
aaccaaauacuuucauggg

SEQ ID NO: 579133 - RNA, 20 nt, Human
aaucauggcugaaagauccc

SEQ ID NO: 579134 - RNA, 20 nt, Human
acauuuuauauacgcacaaa

SEQ ID NO: 579135 - RNA, 23 nt, Human
accuuggguaccacugaaacagc

SEQ ID NO: 579136 - RNA, 22 nt, Human
agaggaacaaaagauacauuug

SEQ ID NO: 579137 - RNA, 23 nt, Human
agagguuucccaaaaauucacau

SEQ ID NO: 579138 - RNA, 19 nt, Human
aucugaaaggagugugggg

SEQ ID NO: 579139 - RNA, 20 nt, Human
augcauuucagaaggacacc

SEQ ID NO: 579140 - RNA, 23 nt, Human
auucauuucuccccuacccccac

SEQ ID NO: 579141 - RNA, 21 nt, Human
caaaaaguaaagugagaagaa

SEQ ID NO: 579142 - RNA, 18 nt, Human
cagaaggacaccuugggu

SEQ ID NO: 579143 - RNA, 22 nt, Human
cagcaccgagagguuucccaaa

SEQ ID NO: 579144 - RNA, 22 nt, Human
cccaugcaugagggugugugca

SEQ ID NO: 579145 - RNA, 24 nt, Human
ccccuacccccaccugccuuucug

SEQ ID NO: 579146 - RNA, 23 nt, Human
cccugcuguaggcuggcauccag

SEQ ID NO: 579147 - RNA, 19 nt, Human
cgcaacuaggacacccaug

SEQ ID NO: 579148 - RNA, 22 nt, Human
cggaaauaacugaaucuuaaug

SEQ ID NO: 579149 - RNA, 19 nt, Human
cuccuggcuguucucaagg

SEQ ID NO: 579150 - RNA, 22 nt, Human
cugcuguaggcuggcauccagc

SEQ ID NO: 579151 - RNA, 21 nt, Human
cuuuucgcugggcugacccuc

SEQ ID NO: 579152 - RNA, 25 nt, Human
gaaaugauuauaauaauuagguaag

SEQ ID NO: 579153 - RNA, 23 nt, Human
gaaugaugaggucugcaggagac

SEQ ID NO: 579154 - RNA, 20 nt, Human
gcaucagaaggcaaccaaau

SEQ ID NO: 579155 - RNA, 19 nt, Human
gcauccagcaccgagaggu

SEQ ID NO: 579156 - RNA, 19 nt, Human
gcggaaauaacugaaucuu

SEQ ID NO: 579157 - RNA, 22 nt, Human
gggugcugcuguccaaagucgg

SEQ ID NO: 579158 - RNA, 22 nt, Human
gugugugcacauguguguaugu

SEQ ID NO: 579159 - RNA, 25 nt, Human
uaaaaacugcacaaaguauguguca

SEQ ID NO: 579160 - RNA, 18 nt, Human
uaagaggaacaaaagaua

SEQ ID NO: 579161 - RNA, 24 nt, Human
uacagagggugccacagggcaugc

SEQ ID NO: 579162 - RNA, 21 nt, Human
uacuuucaugggacccucauu

SEQ ID NO: 579163 - RNA, 21 nt, Human
uaggacacccaugcaugaggg

SEQ ID NO: 579164 - RNA, 21 nt, Human
uauuguauguagcuuauuuua

SEQ ID NO: 579165 - RNA, 25 nt, Human
ucaugcuuccuccugagacauucuu

SEQ ID NO: 579166 - RNA, 18 nt, Human
uccaagugggcuccuggc

SEQ ID NO: 579167 - RNA, 22 nt, Human
ucgcugggcugacccucuacgc

SEQ ID NO: 579168 - RNA, 25 nt, Human
ucucccaguuuuaacuggacaaaca

SEQ ID NO: 579169 - RNA, 20 nt, Human
ugaaacagccauaacauugg

SEQ ID NO: 579170 - RNA, 20 nt, Human
ugaaaggaguguggggcugg

SEQ ID NO: 579171 - RNA, 22 nt, Human
ugaaaggaguguggggcugggg

SEQ ID NO: 579172 - RNA, 24 nt, Human
ugaaggaggaggaaguauacagag

SEQ ID NO: 579173 - RNA, 23 nt, Human
ugagugaucucuagggaccuucc

SEQ ID NO: 579174 - RNA, 22 nt, Human
ugcuguaggcuggcauccagca

SEQ ID NO: 579175 - RNA, 18 nt, Human
uggcaucagaaggcaacc

SEQ ID NO: 579176 - RNA, 20 nt, Human
ugggugcugcuguccaaagu

SEQ ID NO: 579177 - RNA, 19 nt, Human
ugucaacaaaauacagucu

SEQ ID NO: 579178 - RNA, 26 nt, Human
ugugcacauguguguaugucugugca

SEQ ID NO: 579179 - RNA, 19 nt, Human
ugugugcacauguguguau

SEQ ID NO: 579180 - RNA, 20 nt, Human
ugugugcacauguguguaug

SEQ ID NO: 579181 - RNA, 22 nt, Human
uguguguaugucugugcacgug

SEQ ID NO: 579182 - RNA, 19 nt, Human
uucuccccuacccccaccu

SEQ ID NO: 579183 - RNA, 20 nt, Human
uugcauacauuuuauauacg

SEQ ID NO: 579184 - RNA, 22 nt, Human
uuguauguagcuuauuuuacuu

SEQ ID NO: 579185 - RNA, 19 nt, Human
uuguuaucuccuauuucag

SEQ ID NO: 579186 - RNA, 24 nt, Human
uuucacagucuugggguuguugcu

SEQ ID NO: 579187 - RNA, 22 nt, Human
uuucuccccuacccccaccugc

SEQ ID NO: 579188 - RNA, 23 nt, Human
aaaaagaauguuucugggagcac

SEQ ID NO: 579189 - RNA, 23 nt, Human
aagaacacagacagguugaagau

SEQ ID NO: 579190 - RNA, 26 nt, Human
aagcagaggcaggcaagucaguuggg

SEQ ID NO: 579191 - RNA, 21 nt, Human
aauggaaaaaccaagucuaaa

SEQ ID NO: 579192 - RNA, 19 nt, Human
aauucaguuuaaaaaguug

SEQ ID NO: 579193 - RNA, 20 nt, Human
acccgcuccccuccauuccu

SEQ ID NO: 579194 - RNA, 18 nt, Human
agagaggcuggggccugg

SEQ ID NO: 579195 - RNA, 20 nt, Human
agauaaaaggacauucaagu

SEQ ID NO: 579196 - RNA, 24 nt, Human
agcacaugaacguucucaagaaca

SEQ ID NO: 579197 - RNA, 22 nt, Human
agcaugaaggggaauaggcagg

SEQ ID NO: 579198 - RNA, 18 nt, Human
aggaggcucucaggaggc

SEQ ID NO: 579199 - RNA, 25 nt, Human
aggcagacaaaaagaauguuucugg

SEQ ID NO: 579200 - RNA, 27 nt, Human
aggcaggcaagucaguugggggccagg

SEQ ID NO: 579201 - RNA, 25 nt, Human
aggucuguggagggcagagaagagu

SEQ ID NO: 579202 - RNA, 21 nt, Human
agguugaagaugaccaugacc

SEQ ID NO: 579203 - RNA, 24 nt, Human
agucaguugggggccagggaaggg

SEQ ID NO: 579204 - RNA, 21 nt, Human
auggcagggaggccagagagg

SEQ ID NO: 579205 - RNA, 18 nt, Human
caaaagcacacaacagag

SEQ ID NO: 579206 - RNA, 19 nt, Human
caaaagcacacaacagagu

SEQ ID NO: 579207 - RNA, 18 nt, Human
caaggacagacuccugga

SEQ ID NO: 579208 - RNA, 21 nt, Human
cacaugaacguucucaagaac

SEQ ID NO: 579209 - RNA, 19 nt, Human
cagaaagacagauguggga

SEQ ID NO: 579210 - RNA, 19 nt, Human
cagaaggacaaguaaaaug

SEQ ID NO: 579211 - RNA, 19 nt, Human
cagauaaaaggacauucaa

SEQ ID NO: 579212 - RNA, 24 nt, Human
cagcacggaggucuguggagggca

SEQ ID NO: 579213 - RNA, 26 nt, Human
cagccaagcccuuccguuaggaaguc

SEQ ID NO: 579214 - RNA, 21 nt, Human
caguugggggccagggaaggg

SEQ ID NO: 579215 - RNA, 21 nt, Human
ccagccccucuucucucaguu

SEQ ID NO: 579216 - RNA, 27 nt, Human
ccagccccucuucucucaguuuccuua

SEQ ID NO: 579217 - RNA, 21 nt, Human
ccucacuguaacuggaacauc

SEQ ID NO: 579218 - RNA, 19 nt, Human
ccucuauuacccgcucccc

SEQ ID NO: 579219 - RNA, 22 nt, Human
ccucucuauggaguuacugcca

SEQ ID NO: 579220 - RNA, 23 nt, Human
cgcacuccagccccucuucucuc

SEQ ID NO: 579221 - RNA, 22 nt, Human
cggguccaguucuggauggcuu

SEQ ID NO: 579222 - RNA, 26 nt, Human
cguuaggaaguccuggcagcacggag

SEQ ID NO: 579223 - RNA, 19 nt, Human
cuaaacucagaaagacaga

SEQ ID NO: 579224 - RNA, 19 nt, Human
cuccuggauuuccagaagc

SEQ ID NO: 579225 - RNA, 18 nt, Human
cuggaacaucaauuuucc

SEQ ID NO: 579226 - RNA, 19 nt, Human
cuuaggauccucuauuacc

SEQ ID NO: 579227 - RNA, 25 nt, Human
cuuuaugcugagauuuauucuccuc

SEQ ID NO: 579228 - RNA, 18 nt, Human
gacacaaaauauacaaua

SEQ ID NO: 579229 - RNA, 21 nt, Human
gaccaggaaaggcagacaaaa

SEQ ID NO: 579230 - RNA, 20 nt, Human
gcagcacggaggucugugga

SEQ ID NO: 579231 - RNA, 24 nt, Human
ggaaaaaccaagucuaaacucaga

SEQ ID NO: 579232 - RNA, 23 nt, Human
ggacaaguaaaauguuagccaag

SEQ ID NO: 579233 - RNA, 20 nt, Human
ggcagggaggccagagaggc

SEQ ID NO: 579234 - RNA, 27 nt, Human
gggaauaggcagggacagccgguaccc

SEQ ID NO: 579235 - RNA, 19 nt, Human
ggucccucggguccaguuc

SEQ ID NO: 579236 - RNA, 18 nt, Human
ggucuguggagggcagag

SEQ ID NO: 579237 - RNA, 19 nt, Human
gugaagcacugcugaaggc

SEQ ID NO: 579238 - RNA, 22 nt, Human
uaaacaaugaugguagaucaga

SEQ ID NO: 579239 - RNA, 18 nt, Human
uagauuccagagaaggga

SEQ ID NO: 579240 - RNA, 19 nt, Human
uagccaaggcaaugcacag

SEQ ID NO: 579241 - RNA, 26 nt, Human
uaguggguccuuccuccuaccaccau

SEQ ID NO: 579242 - RNA, 25 nt, Human
uauuuuucauauuccuguuuguaaa

SEQ ID NO: 579243 - RNA, 22 nt, Human
ucaaaagcacacaacagaguac

SEQ ID NO: 579244 - RNA, 19 nt, Human
ucagaaagacagauguggg

SEQ ID NO: 579245 - RNA, 22 nt, Human
ucagaaagacagaugugggaca

SEQ ID NO: 579246 - RNA, 21 nt, Human
ucagaaggacaaguaaaaugu

SEQ ID NO: 579247 - RNA, 19 nt, Human
ucaguugggggccagggaa

SEQ ID NO: 579248 - RNA, 21 nt, Human
uccagagaagggaggcuagaa

SEQ ID NO: 579249 - RNA, 18 nt, Human
ucuagagccagcaugaag

SEQ ID NO: 579250 - RNA, 21 nt, Human
ucuauuacccgcuccccucca

SEQ ID NO: 579251 - RNA, 23 nt, Human
ucugugagcccugcaaagucaga

SEQ ID NO: 579252 - RNA, 22 nt, Human
ugacacagucaaauguggccag

SEQ ID NO: 579253 - RNA, 20 nt, Human
ugaccaaggacagacuccug

SEQ ID NO: 579254 - RNA, 19 nt, Human
ugagaaaagagagaaguga

SEQ ID NO: 579255 - RNA, 21 nt, Human
ugagcccugcaaagucagaga

SEQ ID NO: 579256 - RNA, 18 nt, Human
ugagguaggacacaaaau

SEQ ID NO: 579257 - RNA, 19 nt, Human
uggaacaucaauuuucccc

SEQ ID NO: 579258 - RNA, 25 nt, Human
uggcagggaggccagagaggcugac

SEQ ID NO: 579259 - RNA, 28 nt, Human
ugggagcacaugaacguucucaagaaca

SEQ ID NO: 579260 - RNA, 19 nt, Human
uguggccagaccaggaaag

SEQ ID NO: 579261 - RNA, 26 nt, Human
uuaggauccucuauuacccgcucccc

SEQ ID NO: 579262 - RNA, 22 nt, Human
uuaguggguccuuccuccuacc

SEQ ID NO: 579263 - RNA, 24 nt, Human
uuccagaagcugcuugaugauucu

SEQ ID NO: 579264 - RNA, 25 nt, Human
aaacaaaacauuuuuuguccuuagu

SEQ ID NO: 579265 - RNA, 21 nt, Human
acaucuaucuauuuuagcaac

SEQ ID NO: 579266 - RNA, 21 nt, Human
agcacccgggccgaaucccac

SEQ ID NO: 579267 - RNA, 25 nt, Human
agcuaaacugaaacucuuuaucccc

SEQ ID NO: 579268 - RNA, 20 nt, Human
auaauacuuuaacuguuaac

SEQ ID NO: 579269 - RNA, 22 nt, Human
augaaaagcaaucuucauuuua

SEQ ID NO: 579270 - RNA, 21 nt, Human
auuaccgaaaaacaauuuugc

SEQ ID NO: 579271 - RNA, 23 nt, Human
auuuuuuuucuuuuaccauuuag

SEQ ID NO: 579272 - RNA, 19 nt, Human
caaaaggagcuaaacugaa

SEQ ID NO: 579273 - RNA, 18 nt, Human
caaccgcaggagcagcag

SEQ ID NO: 579274 - RNA, 20 nt, Human
caccaaccgcaggagcagcg

SEQ ID NO: 579275 - RNA, 24 nt, Human
cacccgggccgaaucccacguggc

SEQ ID NO: 579276 - RNA, 18 nt, Human
caccuacauugugcucuu

SEQ ID NO: 579277 - RNA, 23 nt, Human
cagcagcucacaagagcacccgg

SEQ ID NO: 579278 - RNA, 23 nt, Human
caugacacugaaugauauaucaa

SEQ ID NO: 579279 - RNA, 28 nt, Human
ccucccagccugaaauucaguccgagga

SEQ ID NO: 579280 - RNA, 19 nt, Human
cucuccacaaauaaaaccu

SEQ ID NO: 579281 - RNA, 27 nt, Human
cuuacauuuaaaaaguuuuuugaggaa

SEQ ID NO: 579282 - RNA, 22 nt, Human
gaaacucuuuauccccuuuguc

SEQ ID NO: 579283 - RNA, 20 nt, Human
gagcagcagcucacaagagc

SEQ ID NO: 579284 - RNA, 21 nt, Human
gcaggagcagcagcucacaag

SEQ ID NO: 579285 - RNA, 21 nt, Human
gcugauauccaguuaaccuaa

SEQ ID NO: 579286 - RNA, 20 nt, Human
ggagcagcagcucacaagag

SEQ ID NO: 579287 - RNA, 24 nt, Human
uaauauacaaucaaaaggagcuaa

SEQ ID NO: 579288 - RNA, 22 nt, Human
uacacaagaaaaacaaaacauu

SEQ ID NO: 579289 - RNA, 18 nt, Human
uagaagaaaaaguagcau

SEQ ID NO: 579290 - RNA, 23 nt, Human
ucccuuauucuguaaaaaaggaa

SEQ ID NO: 579291 - RNA, 22 nt, Human
uguuuuucaugacacugaauga

SEQ ID NO: 579292 - RNA, 23 nt, Human
uuauauugcucccucccagccug

SEQ ID NO: 579293 - RNA, 19 nt, Human
uucaaaagauaaauaauaa

SEQ ID NO: 579294 - RNA, 21 nt, Human
uucaaaagauaaauaauaauc

SEQ ID NO: 579295 - RNA, 18 nt, Human
uucacaauaaaaaagcaa

SEQ ID NO: 579296 - RNA, 23 nt, Human
uucagaaguaaaaaaaguuauaa

SEQ ID NO: 579297 - RNA, 24 nt, Human
aaaccccaucucuuaauuguucca

SEQ ID NO: 579298 - RNA, 19 nt, Human
aacacuuugggaggcugag

SEQ ID NO: 579299 - RNA, 19 nt, Human
aacaugacgaaaccccauc

SEQ ID NO: 579300 - RNA, 20 nt, Human
aacaugacgaaaccccaucu

SEQ ID NO: 579301 - RNA, 21 nt, Human
aacaugacgaaaccccaucuc

SEQ ID NO: 579302 - RNA, 27 nt, Human
agaaagcuuugaaauauuucuuuuuga

SEQ ID NO: 579303 - RNA, 18 nt, Human
agacaggcggaucacuug

SEQ ID NO: 579304 - RNA, 26 nt, Human
agacaggcggaucacuuguagccagg

SEQ ID NO: 579305 - RNA, 26 nt, Human
agccaggaguucgagaccagucuggc

SEQ ID NO: 579306 - RNA, 23 nt, Human
aggaguucgagaccagucuggcc

SEQ ID NO: 579307 - RNA, 24 nt, Human
aggcacaguggcucaugccuguaa

SEQ ID NO: 579308 - RNA, 24 nt, Human
agucuggccaacaugacgaaaccc

SEQ ID NO: 579309 - RNA, 23 nt, Human
aguggcucaugccuguaauccca

SEQ ID NO: 579310 - RNA, 23 nt, Human
aguggugcuuucuuuuccugcug

SEQ ID NO: 579311 - RNA, 20 nt, Human
auaguauuauuuacuugguc

SEQ ID NO: 579312 - RNA, 24 nt, Human
aucacuuguagccaggaguucgag

SEQ ID NO: 579313 - RNA, 19 nt, Human
augccuguaaucccaacac

SEQ ID NO: 579314 - RNA, 18 nt, Human
caaaaucguaaguggugg

SEQ ID NO: 579315 - RNA, 20 nt, Human
caacacuuugggaggcugag

SEQ ID NO: 579316 - RNA, 28 nt, Human
caacacuuugggaggcugagacaggcgg

SEQ ID NO: 579317 - RNA, 24 nt, Human
caacaugacgaaaccccaucucuu

SEQ ID NO: 579318 - RNA, 26 nt, Human
caaccaaguucuucuaacagaaaauu

SEQ ID NO: 579319 - RNA, 21 nt, Human
caagcgacgcuuaccuccucc

SEQ ID NO: 579320 - RNA, 18 nt, Human
caauuuucagauagaacu

SEQ ID NO: 579321 - RNA, 20 nt, Human
cacugugcuuauuacucuuc

SEQ ID NO: 579322 - RNA, 21 nt, Human
cagccaaaaaauuuuccuguu

SEQ ID NO: 579323 - RNA, 24 nt, Human
caggcggaucacuuguagccagga

SEQ ID NO: 579324 - RNA, 18 nt, Human
cagggagagacugccgca

SEQ ID NO: 579325 - RNA, 24 nt, Human
caugccuguaaucccaacacuuug

SEQ ID NO: 579326 - RNA, 20 nt, Human
ccagcccucaggccaggcac

SEQ ID NO: 579327 - RNA, 26 nt, Human
ccaggaguucgagaccagucgaguuc

SEQ ID NO: 579328 - RNA, 18 nt, Human
ccaguuuucuguuuuugu

SEQ ID NO: 579329 - RNA, 24 nt, Human
cccgcggcggccaggcgccaagcg

SEQ ID NO: 579330 - RNA, 23 nt, Human
ccuaaguuuguugugcucaaucc

SEQ ID NO: 579331 - RNA, 22 nt, Human
ccuguaaucccaacacuuuggg

SEQ ID NO: 579332 - RNA, 21 nt, Human
cgagaccagucuggccaacau

SEQ ID NO: 579333 - RNA, 24 nt, Human
cggaucacuuguagccaggaguuc

SEQ ID NO: 579334 - RNA, 24 nt, Human
cucaugccuguaaucccaacacuu

SEQ ID NO: 579335 - RNA, 19 nt, Human
cuccgcgcggagagagggc

SEQ ID NO: 579336 - RNA, 23 nt, Human
cucuauaauuacauuacugugcc

SEQ ID NO: 579337 - RNA, 19 nt, Human
cugaaucuuuuguuugacc

SEQ ID NO: 579338 - RNA, 23 nt, Human
cuggccaacaugacgaaacccca

SEQ ID NO: 579339 - RNA, 20 nt, Human
cuguuguccucucacuauca

SEQ ID NO: 579340 - RNA, 23 nt, Human
cuuggaggagaaagcuuugaaau

SEQ ID NO: 579341 - RNA, 20 nt, Human
cuugguucagaguuggaagu

SEQ ID NO: 579342 - RNA, 23 nt, Human
cuuguagccaggaguucgagacc

SEQ ID NO: 579343 - RNA, 21 nt, Human
cuuuuccugcuggcacugaau

SEQ ID NO: 579344 - RNA, 20 nt, Human
cuuuuuggauuuagugguug

SEQ ID NO: 579345 - RNA, 20 nt, Human
gaagucccuucuguuguccu

SEQ ID NO: 579346 - RNA, 19 nt, Human
gagggccgcacgccgccgg

SEQ ID NO: 579347 - RNA, 24 nt, Human
gaucacuuguagccaggaguucga

SEQ ID NO: 579348 - RNA, 18 nt, Human
gcccacgguguauccugc

SEQ ID NO: 579349 - RNA, 22 nt, Human
gcuuucuuuuccugcuggcacu

SEQ ID NO: 579350 - RNA, 19 nt, Human
ggaucacuuguagccagga

SEQ ID NO: 579351 - RNA, 23 nt, Human
ggaucacuuguagccaggaguuc

SEQ ID NO: 579352 - RNA, 19 nt, Human
uaacagaaaauucacuuaa

SEQ ID NO: 579353 - RNA, 22 nt, Human
uaacaguuugaaauauucuugg

SEQ ID NO: 579354 - RNA, 21 nt, Human
uaaguccauuuguaacaguuu

SEQ ID NO: 579355 - RNA, 18 nt, Human
uaaguggugguggcucuu

SEQ ID NO: 579356 - RNA, 23 nt, Human
uagcaaccaaguucuucuaacag

SEQ ID NO: 579357 - RNA, 21 nt, Human
uagcuccuggugacucacugu

SEQ ID NO: 579358 - RNA, 21 nt, Human
uauuucuuuuugaccuccgag

SEQ ID NO: 579359 - RNA, 19 nt, Human
ucacugugcuuauuacucu

SEQ ID NO: 579360 - RNA, 21 nt, Human
ucagcagaaucaacgcuuucu

SEQ ID NO: 579361 - RNA, 25 nt, Human
ucaggccaggcacaguggcucaugc

SEQ ID NO: 579362 - RNA, 22 nt, Human
uccacagaaaccuuggaugaag

SEQ ID NO: 579363 - RNA, 18 nt, Human
ucccuucuguuguccucu

SEQ ID NO: 579364 - RNA, 21 nt, Human
ucccuucuguuguccucucac

SEQ ID NO: 579365 - RNA, 22 nt, Human
ucuguagcuccuggugacucac

SEQ ID NO: 579366 - RNA, 24 nt, Human
ucuguuguccucucacuaucagaa

SEQ ID NO: 579367 - RNA, 22 nt, Human
ugaaauauucuuggaggagaaa

SEQ ID NO: 579368 - RNA, 26 nt, Human
ugagacaggcggaucacuuguagcca

SEQ ID NO: 579369 - RNA, 19 nt, Human
ugcaucauuuuucauugau

SEQ ID NO: 579370 - RNA, 18 nt, Human
ugcccgcggcggccaggc

SEQ ID NO: 579371 - RNA, 23 nt, Human
ugccuguaaucccaacacuuugg

SEQ ID NO: 579372 - RNA, 18 nt, Human
ugcucuuuccaauuuucu

SEQ ID NO: 579373 - RNA, 18 nt, Human
uggaaauccaaacauaaa

SEQ ID NO: 579374 - RNA, 22 nt, Human
uggaaccuggaagaccugucuc

SEQ ID NO: 579375 - RNA, 24 nt, Human
uggcucaugccuguaaucccaaca

SEQ ID NO: 579376 - RNA, 18 nt, Human
ugggaaccuuaauguugg

SEQ ID NO: 579377 - RNA, 24 nt, Human
ugggaggcugagacaggcggauca

SEQ ID NO: 579378 - RNA, 20 nt, Human
uguagccaggaguucgagac

SEQ ID NO: 579379 - RNA, 23 nt, Human
ugucacggacagaucuuccaguu

SEQ ID NO: 579380 - RNA, 23 nt, Human
uguggcacauguuuaauucugua

SEQ ID NO: 579381 - RNA, 18 nt, Human
uguucaucagcagaauca

SEQ ID NO: 579382 - RNA, 23 nt, Human
uguucuugguucagaguuggaag

SEQ ID NO: 579383 - RNA, 20 nt, Human
uguucuuuucaccagcccuc

SEQ ID NO: 579384 - RNA, 24 nt, Human
uguuuggucuuuucccuguucuuu

SEQ ID NO: 579385 - RNA, 24 nt, Human
uucaccagcccucaggccaggcac

SEQ ID NO: 579386 - RNA, 18 nt, Human
uuccugcuggcacugaau

SEQ ID NO: 579387 - RNA, 22 nt, Human
uucuuggaggagaaagcuuuga

SEQ ID NO: 579388 - RNA, 23 nt, Human
uucuuggaggagaaagcuuugaa

SEQ ID NO: 579389 - RNA, 25 nt, Human
uugggaggcugagacaggcggauca

SEQ ID NO: 579390 - RNA, 20 nt, Human
uuguccucucacuaucagaa

SEQ ID NO: 579391 - RNA, 24 nt, Human
uuuguaacaguuugaaauauucuu

SEQ ID NO: 579392 - RNA, 23 nt, Human
aacuuugacugaagaccuugcca

SEQ ID NO: 579393 - RNA, 20 nt, Human
aaugaagccucugccacaca

SEQ ID NO: 579394 - RNA, 24 nt, Human
caacaugcacaaaauauacaaaga

SEQ ID NO: 579395 - RNA, 22 nt, Human
cuaaaugaagccucugccacac

SEQ ID NO: 579396 - RNA, 20 nt, Human
cucuuuagcauggacucuga

SEQ ID NO: 579397 - RNA, 21 nt, Human
cugaugcuguguaggagugaa

SEQ ID NO: 579398 - RNA, 25 nt, Human
uaaauccuuggauguguuacaguuu

SEQ ID NO: 579399 - RNA, 26 nt, Human
uaaggauucucucaagaaugaaauuc

SEQ ID NO: 579400 - RNA, 20 nt, Human
uacacauuuugaugucuagu

SEQ ID NO: 579401 - RNA, 18 nt, Human
uagcauggacucugaugu

SEQ ID NO: 579402 - RNA, 19 nt, Human
ugacuccuuugcucuccuc

SEQ ID NO: 579403 - RNA, 24 nt, Human
ugacugaaaaccuugccacauuua

SEQ ID NO: 579404 - RNA, 23 nt, Human
ugccacacaguuagguguauaug

SEQ ID NO: 579405 - RNA, 25 nt, Human
uguaauaugaaaaguuuaucagcac

SEQ ID NO: 579406 - RNA, 18 nt, Human
uguaugguuucucucuga

SEQ ID NO: 579407 - RNA, 21 nt, Human
uguuacaguuuugauccuugg

SEQ ID NO: 579408 - RNA, 23 nt, Human
uguugugugaguuuuaacacauu

SEQ ID NO: 579409 - RNA, 22 nt, Human
uuagguguauaugauuucucuu

SEQ ID NO: 579410 - RNA, 22 nt, Human
uuguaugguuucucucugauau

SEQ ID NO: 579411 - RNA, 21 nt, Human
uugugacugaaaaccuugcca

SEQ ID NO: 579412 - RNA, 24 nt, Human
aaaagugaagacaaacaaacaaac

SEQ ID NO: 579413 - RNA, 23 nt, Human
aaacaaaaaaaaaaacaaaaccc

SEQ ID NO: 579414 - RNA, 25 nt, Human
aaacaaaaaaaaaaacaaaacccua

SEQ ID NO: 579415 - RNA, 21 nt, Human
aaacaaaaacagaaaagcaaa

SEQ ID NO: 579416 - RNA, 21 nt, Human
aaacagaaaagcaaaaaacag

SEQ ID NO: 579417 - RNA, 23 nt, Human
aacaaugcuggagagcauuuggc

SEQ ID NO: 579418 - RNA, 24 nt, Human
aacagaaaagcaaaaaacaguuaa

SEQ ID NO: 579419 - RNA, 19 nt, Human
aacauggugagaccccauc

SEQ ID NO: 579420 - RNA, 20 nt, Human
aacauggugagaccccaucu

SEQ ID NO: 579421 - RNA, 21 nt, Human
aacauggugagaccccaucuc

SEQ ID NO: 579422 - RNA, 23 nt, Human
aagggccuguuacuaaaccaaga

SEQ ID NO: 579423 - RNA, 22 nt, Human
aaguuuacucaaccagaccacc

SEQ ID NO: 579424 - RNA, 26 nt, Human
aauuuacuucucaucugucuccccua

SEQ ID NO: 579425 - RNA, 18 nt, Human
acaaacaaacaaacaaac

SEQ ID NO: 579426 - RNA, 24 nt, Human
acaacaggagccuaauguuuuguu

SEQ ID NO: 579427 - RNA, 21 nt, Human
acaucuguaaucccagcacuu

SEQ ID NO: 579428 - RNA, 23 nt, Human
acaucuguaaucccagcacuucg

SEQ ID NO: 579429 - RNA, 19 nt, Human
accagaccaccuugauacc

SEQ ID NO: 579430 - RNA, 28 nt, Human
agacaaacaaacaaacaaaccggacccc

SEQ ID NO: 579431 - RNA, 19 nt, Human
agacccgggaaagccggcg

SEQ ID NO: 579432 - RNA, 22 nt, Human
agccuggguaacauggugagac

SEQ ID NO: 579433 - RNA, 23 nt, Human
agccuggguaacauggugagacc

SEQ ID NO: 579434 - RNA, 24 nt, Human
agccuggguaacauggugagaccc

SEQ ID NO: 579435 - RNA, 20 nt, Human
aggaguuugagaccagccug

SEQ ID NO: 579436 - RNA, 24 nt, Human
agugacuuacaucuguaaucccag

SEQ ID NO: 579437 - RNA, 20 nt, Human
aucuagacuuggcaauaaag

SEQ ID NO: 579438 - RNA, 22 nt, Human
caaaaaaaaaaacaaaacccua

SEQ ID NO: 579439 - RNA, 24 nt, Human
caaaaacagaaaagcaaaaaacag

SEQ ID NO: 579440 - RNA, 20 nt, Human
caaaacaaaaacagaaaagc

SEQ ID NO: 579441 - RNA, 25 nt, Human
caaaacaaaaacagaaaagcaaaaa

SEQ ID NO: 579442 - RNA, 30 nt, Human
caaaacaaaaacagaaaagcaaaaaaccag

SEQ ID NO: 579443 - RNA, 28 nt, Human
caaaacccuaaaaaauacuuaaggaaga

SEQ ID NO: 579444 - RNA, 23 nt, Human
caaacaaaaaaaaaaacaaaacc

SEQ ID NO: 579445 - RNA, 26 nt, Human
caaacaaacaaacaaaaaaaaaaaca

SEQ ID NO: 579446 - RNA, 25 nt, Human
caaacaaacaaacaaacaaaaaaaa

SEQ ID NO: 579447 - RNA, 21 nt, Human
caaccagaccaccuugauacc

SEQ ID NO: 579448 - RNA, 23 nt, Human
caacugaaaguuaauauaaaaca

SEQ ID NO: 579449 - RNA, 23 nt, Human
caagauacaacaggagccuaaug

SEQ ID NO: 579450 - RNA, 21 nt, Human
cagcaaaacaaaaacagaaaa

SEQ ID NO: 579451 - RNA, 24 nt, Human
cagcacuucgggaggcgaaggcag

SEQ ID NO: 579452 - RNA, 26 nt, Human
cagcacuucgggaggcgaaggcaggu

SEQ ID NO: 579453 - RNA, 23 nt, Human
caucuguaaucccagcacuucgg

SEQ ID NO: 579454 - RNA, 24 nt, Human
caucuguaaucccagcacuucggg

SEQ ID NO: 579455 - RNA, 18 nt, Human
ccaucauucacaacugac

SEQ ID NO: 579456 - RNA, 21 nt, Human
cccuaaguacuaagacauguc

SEQ ID NO: 579457 - RNA, 24 nt, Human
ccucaacccggccagcucucuccg

SEQ ID NO: 579458 - RNA, 24 nt, Human
ccuggguaacauggugagacccca

SEQ ID NO: 579459 - RNA, 25 nt, Human
cugaacuaaagagauacuaaagauc

SEQ ID NO: 579460 - RNA, 22 nt, Human
cuucucaucugucuccccuaaa

SEQ ID NO: 579461 - RNA, 21 nt, Human
cuugaugccaaaaaauuuacc

SEQ ID NO: 579462 - RNA, 20 nt, Human
gacaaacaaacaaacaaaca

SEQ ID NO: 579463 - RNA, 18 nt, Human
gauugcuugugcccagga

SEQ ID NO: 579464 - RNA, 23 nt, Human
gcaaaacaaaaacagaaaagcaa

SEQ ID NO: 579465 - RNA, 20 nt, Human
gcccaggaguuugagaccag

SEQ ID NO: 579466 - RNA, 22 nt, Human
gcccaggaguuugagaccagcc

SEQ ID NO: 579467 - RNA, 19 nt, Human
ggaagacucauguacaaau

SEQ ID NO: 579468 - RNA, 25 nt, Human
ggcggaagcgcuuuuuuuuuuuuuu

SEQ ID NO: 579469 - RNA, 20 nt, Human
guuaguuucuggcuggggua

SEQ ID NO: 579470 - RNA, 20 nt, Human
guuguuguccuuuccuucau

SEQ ID NO: 579471 - RNA, 22 nt, Human
uaaaauuaaaaaaaaaaaaaag

SEQ ID NO: 579472 - RNA, 24 nt, Human
uaaaccaagauacaacaggagccu

SEQ ID NO: 579473 - RNA, 23 nt, Human
uaaagagauacuaaagaucagaa

SEQ ID NO: 579474 - RNA, 22 nt, Human
uaacauggugagaccccaucuc

SEQ ID NO: 579475 - RNA, 24 nt, Human
uaacauggugagaccccaucucua

SEQ ID NO: 579476 - RNA, 24 nt, Human
uaaguuaauuaagggccuguuacu

SEQ ID NO: 579477 - RNA, 25 nt, Human
uacuaaaccaagauacaacaggagc

SEQ ID NO: 579478 - RNA, 28 nt, Human
uacuaaaccaagauacaacaggagccua

SEQ ID NO: 579479 - RNA, 24 nt, Human
uacuucucaucugucuccccuaaa

SEQ ID NO: 579480 - RNA, 18 nt, Human
uaucugaaaaaaguauca

SEQ ID NO: 579481 - RNA, 21 nt, Human
ucaacagaccugggggaaaag

SEQ ID NO: 579482 - RNA, 23 nt, Human
ucagcaaaacaaaaacagaaaag

SEQ ID NO: 579483 - RNA, 18 nt, Human
ucauacagcucaacagac

SEQ ID NO: 579484 - RNA, 20 nt, Human
ucccuuacucuuuacauaaa

SEQ ID NO: 579485 - RNA, 19 nt, Human
ucuagacuuggcaauaaag

SEQ ID NO: 579486 - RNA, 22 nt, Human
ucuccccuaaaagggcaggggc

SEQ ID NO: 579487 - RNA, 26 nt, Human
ucucuccgggcggaagcgcuuuuuuu

SEQ ID NO: 579488 - RNA, 21 nt, Human
ugaaaaaaguaucaaucuaga

SEQ ID NO: 579489 - RNA, 22 nt, Human
ugaaugaaucucauacagcuca

SEQ ID NO: 579490 - RNA, 22 nt, Human
ugacuuacaucuguaaucccag

SEQ ID NO: 579491 - RNA, 24 nt, Human
ugacuuacaucuguaaucccagca

SEQ ID NO: 579492 - RNA, 20 nt, Human
ugauaucuacaaugaccucc

SEQ ID NO: 579493 - RNA, 18 nt, Human
ugcuugugcccaggaguu

SEQ ID NO: 579494 - RNA, 23 nt, Human
uggauugcuugugcccaggaguu

SEQ ID NO: 579495 - RNA, 24 nt, Human
uggauugcuugugcccaggaguuu

SEQ ID NO: 579496 - RNA, 24 nt, Human
uggcugggguagugacuuacaucu

SEQ ID NO: 579497 - RNA, 22 nt, Human
ugucugguacauguaaguguuc

SEQ ID NO: 579498 - RNA, 26 nt, Human
uugaaugaauaaaugaaguaugaaug

SEQ ID NO: 579499 - RNA, 26 nt, Human
uuuaaaggaaaauaaaucaaguaggu

SEQ ID NO: 579500 - RNA, 20 nt, Human
aaccauggcguaccgauuua

SEQ ID NO: 579501 - RNA, 19 nt, Human
aaccuccguccuacagccc

SEQ ID NO: 579502 - RNA, 19 nt, Human
acagacuucccccagggaa

SEQ ID NO: 579503 - RNA, 24 nt, Human
accaaagaacagacuucccccagg

SEQ ID NO: 579504 - RNA, 19 nt, Human
acugaagggaaaaauucca

SEQ ID NO: 579505 - RNA, 23 nt, Human
agagaaaaauuccauaccaaaga

SEQ ID NO: 579506 - RNA, 19 nt, Human
aucgaggacagcucaguca

SEQ ID NO: 579507 - RNA, 21 nt, Human
cacacucacacacaucagcca

SEQ ID NO: 579508 - RNA, 18 nt, Human
cagccggucggcagugac

SEQ ID NO: 579509 - RNA, 24 nt, Human
caucacacucacacacaucagcca

SEQ ID NO: 579510 - RNA, 18 nt, Human
caugccagguguuuguca

SEQ ID NO: 579511 - RNA, 21 nt, Human
ccgcaaggcccagccagccgg

SEQ ID NO: 579512 - RNA, 20 nt, Human
cgaaggugguuuucagugga

SEQ ID NO: 579513 - RNA, 18 nt, Human
gaagcccuugcauggccu

SEQ ID NO: 579514 - RNA, 18 nt, Human
gaagcccuugcauggccu

SEQ ID NO: 579515 - RNA, 22 nt, Human
gggaaaaauuccauaccaaaga

SEQ ID NO: 579516 - RNA, 23 nt, Human
uaccaaagaacagacuuccccca

SEQ ID NO: 579517 - RNA, 24 nt, Human
uaccaaagaagagagaaaaauucc

SEQ ID NO: 579518 - RNA, 20 nt, Human
uacuugacagguaacaucga

SEQ ID NO: 579519 - RNA, 22 nt, Human
ucccccagggaaccuccguccu

SEQ ID NO: 579520 - RNA, 22 nt, Human
uccugaacucucaggaagcccu

SEQ ID NO: 579521 - RNA, 19 nt, Human
ugggaagaacaggaguccu

SEQ ID NO: 579522 - RNA, 18 nt, Human
uugcauggccuaucgagg

SEQ ID NO: 579523 - RNA, 20 nt, Human
uuguauuaaaaauagaaggu

SEQ ID NO: 579524 - RNA, 23 nt, Human
aaucucgcccuuccuugcaaggc

SEQ ID NO: 579525 - RNA, 21 nt, Human
acccccacccccgggagacca

SEQ ID NO: 579526 - RNA, 24 nt, Human
agacccccacccccgggagaccag

SEQ ID NO: 579527 - RNA, 23 nt, Human
ccagaggguaccccccagacccc

SEQ ID NO: 579528 - RNA, 22 nt, Human
cccagacccccacccccgggag

SEQ ID NO: 579529 - RNA, 21 nt, Human
ccccagacccccacccccggg

SEQ ID NO: 579530 - RNA, 18 nt, Human
ccccagaggguacccccc

SEQ ID NO: 579531 - RNA, 25 nt, Human
ccccagaggguaccccccagacccc

SEQ ID NO: 579532 - RNA, 18 nt, Human
cccccacccccgggagac

SEQ ID NO: 579533 - RNA, 24 nt, Human
ccccccgccccgcccccgaaaucu

SEQ ID NO: 579534 - RNA, 19 nt, Human
ccccgaaaucucgcccuuc

SEQ ID NO: 579535 - RNA, 18 nt, Human
ccccgccccgcccccgaa

SEQ ID NO: 579536 - RNA, 18 nt, Human
ccccggccuaggcccgcc

SEQ ID NO: 579537 - RNA, 22 nt, Human
ccccggccuaggcccgcccccc

SEQ ID NO: 579538 - RNA, 22 nt, Human
ccccgggagaccaguccucacc

SEQ ID NO: 579539 - RNA, 21 nt, Human
cccggccuaggcccgcccccc

SEQ ID NO: 579540 - RNA, 21 nt, Human
ccgcccccgaaaucucgcccu

SEQ ID NO: 579541 - RNA, 25 nt, Human
ccgccccgcccccgaaaucucgccc

SEQ ID NO: 579542 - RNA, 26 nt, Human
ccgccccgcccccgaaaucucgcccu

SEQ ID NO: 579543 - RNA, 27 nt, Human
ccggccuaggcccgccccccgccccgc

SEQ ID NO: 579544 - RNA, 20 nt, Human
ccugggcgaguccucagccu

SEQ ID NO: 579545 - RNA, 22 nt, Human
cuggggcagugggggaaucuau

SEQ ID NO: 579546 - RNA, 21 nt, Human
gcccaggggucugagagacca

SEQ ID NO: 579547 - RNA, 21 nt, Human
ggaaucuauaaccccagaggg

SEQ ID NO: 579548 - RNA, 21 nt, Human
gguaccccccagacccccacc

SEQ ID NO: 579549 - RNA, 18 nt, Human
gguccagucagagcuggg

SEQ ID NO: 579550 - RNA, 24 nt, Human
uaaccccagaggguaccccccaga

SEQ ID NO: 579551 - RNA, 22 nt, Human
uaccccccagacccccaccccc

SEQ ID NO: 579552 - RNA, 20 nt, Human
uaggcccgccccccgccccg

SEQ ID NO: 579553 - RNA, 23 nt, Human
uccagucaaaaggauagagacau

SEQ ID NO: 579554 - RNA, 23 nt, Human
uccccaaguugggggaaguccac

SEQ ID NO: 579555 - RNA, 21 nt, Human
ugagaccccggccuaggcccg

SEQ ID NO: 579556 - RNA, 19 nt, Human
ugggguccagucagagcug

SEQ ID NO: 579557 - RNA, 19 nt, Human
cuacugcagucuuugacuc

SEQ ID NO: 579558 - RNA, 20 nt, Human
gggcgcugacaccugcccaa

SEQ ID NO: 579559 - RNA, 23 nt, Human
gugacacgggcgcugacaccugc

SEQ ID NO: 579560 - RNA, 18 nt, Human
uaccacucuacugcaguc

SEQ ID NO: 579561 - RNA, 19 nt, Human
uaccacucuacugcagucu

SEQ ID NO: 579562 - RNA, 24 nt, Human
aaaaaaacaaaacaaaacagaaaa

SEQ ID NO: 579563 - RNA, 22 nt, Human
aaaaaacaaaacaaaacagaaa

SEQ ID NO: 579564 - RNA, 24 nt, Human
aaaaauagacaauguagcacaucc

SEQ ID NO: 579565 - RNA, 20 nt, Human
aaaacaaaacaaaacagaaa

SEQ ID NO: 579566 - RNA, 18 nt, Human
aaacaaaacaaaacagaa

SEQ ID NO: 579567 - RNA, 18 nt, Human
aaacagagcuuuuucccc

SEQ ID NO: 579568 - RNA, 22 nt, Human
aaacagagcuuuuuccccaugg

SEQ ID NO: 579569 - RNA, 26 nt, Human
aaacauuuugauacaaaauuuuuuuc

SEQ ID NO: 579570 - RNA, 20 nt, Human
aaagugaaauacgcugcaaa

SEQ ID NO: 579571 - RNA, 26 nt, Human
aacacaaaaauagaacaguucacacu

SEQ ID NO: 579572 - RNA, 19 nt, Human
aaccuuaacguuuucaagc

SEQ ID NO: 579573 - RNA, 29 nt, Human
aagcaaaagaugaaauauuaagggacccc

SEQ ID NO: 579574 - RNA, 24 nt, Human
aagcaggcaaaaggcacacgcuag

SEQ ID NO: 579575 - RNA, 21 nt, Human
aaugcaaaaugccucugcagu

SEQ ID NO: 579576 - RNA, 21 nt, Human
acacaaaccaauucacaccac

SEQ ID NO: 579577 - RNA, 19 nt, Human
acacagcucuugcucuaag

SEQ ID NO: 579578 - RNA, 19 nt, Human
accacacuacagaaacgcg

SEQ ID NO: 579579 - RNA, 22 nt, Human
accagagcccagugggaaucca

SEQ ID NO: 579580 - RNA, 18 nt, Human
agacaaaugcaaaaugcc

SEQ ID NO: 579581 - RNA, 19 nt, Human
agacaaaugcaaaaugccu

SEQ ID NO: 579582 - RNA, 20 nt, Human
agagaagcaggcaaaaggca

SEQ ID NO: 579583 - RNA, 20 nt, Human
agcagcaccacugacgggau

SEQ ID NO: 579584 - RNA, 18 nt, Human
agccgcugagcagcacca

SEQ ID NO: 579585 - RNA, 22 nt, Human
aguaagcagaaaugucaacuua

SEQ ID NO: 579586 - RNA, 23 nt, Human
auaaaaucaugugcuaaacagag

SEQ ID NO: 579587 - RNA, 18 nt, Human
augauaugugaaaagacu

SEQ ID NO: 579588 - RNA, 19 nt, Human
augcaggucaggcuaccuu

SEQ ID NO: 579589 - RNA, 27 nt, Human
augugugcauacauucuaauguacaca

SEQ ID NO: 579590 - RNA, 21 nt, Human
auucacaccacacgacucuuc

SEQ ID NO: 579591 - RNA, 18 nt, Human
auucaggaaacaauuuga

SEQ ID NO: 579592 - RNA, 24 nt, Human
auuucuuccuagcaagucugcgug

SEQ ID NO: 579593 - RNA, 19 nt, Human
auuuugcuuaucaugaucc

SEQ ID NO: 579594 - RNA, 26 nt, Human
caaaaauagaacaguucacacugaaa

SEQ ID NO: 579595 - RNA, 19 nt, Human
caaaacaaaacagaaaacc

SEQ ID NO: 579596 - RNA, 20 nt, Human
caaaacagaaaaccuuaacg

SEQ ID NO: 579597 - RNA, 21 nt, Human
caaaacagaaaaccuuaacgu

SEQ ID NO: 579598 - RNA, 24 nt, Human
caaaauacacaauccucccagccu

SEQ ID NO: 579599 - RNA, 26 nt, Human
caaaauacacaauccucccagccuuc

SEQ ID NO: 579600 - RNA, 18 nt, Human
caacuuaaaggacuauga

SEQ ID NO: 579601 - RNA, 19 nt, Human
caagguucacaccgacucu

SEQ ID NO: 579602 - RNA, 21 nt, Human
cacaauccucccagccuucuc

SEQ ID NO: 579603 - RNA, 22 nt, Human
cacacgacucuucaaagaugau

SEQ ID NO: 579604 - RNA, 19 nt, Human
cagccuucucaaguuguca

SEQ ID NO: 579605 - RNA, 26 nt, Human
caguaauaauacaaacaaaaguuuaa

SEQ ID NO: 579606 - RNA, 22 nt, Human
caguagcuggugaagcccacuc

SEQ ID NO: 579607 - RNA, 23 nt, Human
ccaaaaauagacaauguagcaca

SEQ ID NO: 579608 - RNA, 19 nt, Human
ccagcagccccgaugcuaa

SEQ ID NO: 579609 - RNA, 19 nt, Human
cccuuuccuuugaacaucc

SEQ ID NO: 579610 - RNA, 18 nt, Human
cuuaaagaguucaacucu

SEQ ID NO: 579611 - RNA, 24 nt, Human
gaacauccugacacuuccuaaaua

SEQ ID NO: 579612 - RNA, 20 nt, Human
gaacuucuugacacagacaa

SEQ ID NO: 579613 - RNA, 23 nt, Human
gagcagcaccacugacgggaucc

SEQ ID NO: 579614 - RNA, 18 nt, Human
gauccaacugguauguuu

SEQ ID NO: 579615 - RNA, 19 nt, Human
gcacuuauggcacagacaa

SEQ ID NO: 579616 - RNA, 24 nt, Human
gcagccgccaaaaauagacaaugu

SEQ ID NO: 579617 - RNA, 23 nt, Human
gcuaaaguuguacaaccagguau

SEQ ID NO: 579618 - RNA, 25 nt, Human
ggaaauaaacaaauucguucaguca

SEQ ID NO: 579619 - RNA, 20 nt, Human
ggaccagagcccagugggaa

SEQ ID NO: 579620 - RNA, 20 nt, Human
ggugaacuucuugacacaga

SEQ ID NO: 579621 - RNA, 21 nt, Human
uacaaccagguauguuugccc

SEQ ID NO: 579622 - RNA, 27 nt, Human
uacacaaaccaauucacaccacacgac

SEQ ID NO: 579623 - RNA, 24 nt, Human
uagaaaauaauucaagucaguauc

SEQ ID NO: 579624 - RNA, 21 nt, Human
uagaaauaagcaaaagaugaa

SEQ ID NO: 579625 - RNA, 18 nt, Human
uagaacaguucacacuga

SEQ ID NO: 579626 - RNA, 19 nt, Human
uagcugcaagauacuaaau

SEQ ID NO: 579627 - RNA, 21 nt, Human
uagcugcaagauacuaaauac

SEQ ID NO: 579628 - RNA, 21 nt, Human
uauuucacuggcuugagaagg

SEQ ID NO: 579629 - RNA, 20 nt, Human
ucaaagagaagcaggcaaaa

SEQ ID NO: 579630 - RNA, 27 nt, Human
ucaaguuguaauaaauugaaaauaaca

SEQ ID NO: 579631 - RNA, 18 nt, Human
ucacacugaaaggucuuc

SEQ ID NO: 579632 - RNA, 18 nt, Human
ucaguaauaauacaaaca

SEQ ID NO: 579633 - RNA, 18 nt, Human
ucauccaaacacacccuu

SEQ ID NO: 579634 - RNA, 21 nt, Human
ucauccaaacacacccuuuuc

SEQ ID NO: 579635 - RNA, 18 nt, Human
uccaaacacacccuuuuc

SEQ ID NO: 579636 - RNA, 27 nt, Human
uccaaacacacccuuuucugaaaaaca

SEQ ID NO: 579637 - RNA, 19 nt, Human
uccaaccaagguucacacc

SEQ ID NO: 579638 - RNA, 22 nt, Human
uccaccacacuacagaaacgcg

SEQ ID NO: 579639 - RNA, 21 nt, Human
uccugaguguccauggaugug

SEQ ID NO: 579640 - RNA, 18 nt, Human
ucugcauuucuuccuagc

SEQ ID NO: 579641 - RNA, 21 nt, Human
ucuuccuagcaagucugcgug

SEQ ID NO: 579642 - RNA, 21 nt, Human
ugacgggauccaagggaagga

SEQ ID NO: 579643 - RNA, 22 nt, Human
ugacuugcaaaauacacaaucc

SEQ ID NO: 579644 - RNA, 24 nt, Human
ugacuugcaaaauacacaauccuc

SEQ ID NO: 579645 - RNA, 18 nt, Human
ugagaaggugaacuucuu

SEQ ID NO: 579646 - RNA, 18 nt, Human
ugaguuagaauccacaua

SEQ ID NO: 579647 - RNA, 19 nt, Human
ugaucuuaugcaggucagg

SEQ ID NO: 579648 - RNA, 22 nt, Human
ugcaaaauacacaauccuccca

SEQ ID NO: 579649 - RNA, 23 nt, Human
ugcaaauuaagcaauuucaauaa

SEQ ID NO: 579650 - RNA, 20 nt, Human
uggacagagcaggagaaacu

SEQ ID NO: 579651 - RNA, 25 nt, Human
uguaacacagucacuuaauuuuccc

SEQ ID NO: 579652 - RNA, 23 nt, Human
uguacacaaaccaauucacacca

SEQ ID NO: 579653 - RNA, 23 nt, Human
ugugagaagauuaguauaguucu

SEQ ID NO: 579654 - RNA, 22 nt, Human
ugugugcauacauucuaaugua

SEQ ID NO: 579655 - RNA, 20 nt, Human
uguuuaaugugggccacuga

SEQ ID NO: 579656 - RNA, 23 nt, Human
uuaaaaaaacaaaacaaaacaga

SEQ ID NO: 579657 - RNA, 22 nt, Human
uuaaggagaagcuucuaauuuu

SEQ ID NO: 579658 - RNA, 24 nt, Human
uucaacgacuguauuuuauagacc

SEQ ID NO: 579659 - RNA, 19 nt, Human
uucaagugaucuuaugcag

SEQ ID NO: 579660 - RNA, 18 nt, Human
uuccauggcuaaaaaucg

SEQ ID NO: 579661 - RNA, 22 nt, Human
uugauauuaaaaaaacaaaaca

SEQ ID NO: 579662 - RNA, 24 nt, Human
uuuacccuuuccuuugaacauccu

SEQ ID NO: 579663 - RNA, 23 nt, Human
aaaagauaaagaaauagauuuag

SEQ ID NO: 579664 - RNA, 18 nt, Human
aaacacacauacauaaac

SEQ ID NO: 579665 - RNA, 22 nt, Human
aacacacauacauaaacauaca

SEQ ID NO: 579666 - RNA, 26 nt, Human
aacacacauacauaaacauacauaug

SEQ ID NO: 579667 - RNA, 21 nt, Human
aauuuccuucccuuuuaaggc

SEQ ID NO: 579668 - RNA, 24 nt, Human
accacauuuuauuuaucuauucau

SEQ ID NO: 579669 - RNA, 19 nt, Human
accuuuuggcuguugugaa

SEQ ID NO: 579670 - RNA, 25 nt, Human
auccaucuccagaacuuuuuacccc

SEQ ID NO: 579671 - RNA, 18 nt, Human
augucagaauuuccuucc

SEQ ID NO: 579672 - RNA, 26 nt, Human
auuuuauuuaucuauucaucuaucca

SEQ ID NO: 579673 - RNA, 28 nt, Human
cacacauacauaaacauacauauguaca

SEQ ID NO: 579674 - RNA, 18 nt, Human
cacuaaacacucacucuc

SEQ ID NO: 579675 - RNA, 22 nt, Human
cauguucauauauauuugugug

SEQ ID NO: 579676 - RNA, 21 nt, Human
ccacuaaacacucacucucca

SEQ ID NO: 579677 - RNA, 19 nt, Human
ccgcugugaacauuggugu

SEQ ID NO: 579678 - RNA, 21 nt, Human
ccuacuuucacuucuuuugga

SEQ ID NO: 579679 - RNA, 18 nt, Human
cggcacugcacaagggaa

SEQ ID NO: 579680 - RNA, 20 nt, Human
cuaaaacucugacccacuaa

SEQ ID NO: 579681 - RNA, 24 nt, Human
cuaaaacucugacccacuaaacac

SEQ ID NO: 579682 - RNA, 21 nt, Human
cuccauugcccucuucuccca

SEQ ID NO: 579683 - RNA, 22 nt, Human
cuuuaagcuucauccauauugc

SEQ ID NO: 579684 - RNA, 18 nt, Human
cuuuuggcuguugugaau

SEQ ID NO: 579685 - RNA, 18 nt, Human
gcccucuucucccagccc

SEQ ID NO: 579686 - RNA, 23 nt, Human
guugcuuccaccuuuuggcuguu

SEQ ID NO: 579687 - RNA, 19 nt, Human
uaaaaaaaaaaaucaaaua

SEQ ID NO: 579688 - RNA, 22 nt, Human
uaaacaauagcccauuguaugu

SEQ ID NO: 579689 - RNA, 25 nt, Human
uaaacauacauauguacacauuuug

SEQ ID NO: 579690 - RNA, 23 nt, Human
uacauucacacuguugagcaccc

SEQ ID NO: 579691 - RNA, 18 nt, Human
uauaaacacacauacaua

SEQ ID NO: 579692 - RNA, 26 nt, Human
uauaaacacacauacauaaacauaca

SEQ ID NO: 579693 - RNA, 24 nt, Human
uccagaacuuuuuaccuucccaaa

SEQ ID NO: 579694 - RNA, 22 nt, Human
uccaucuccagaacuuuuuacc

SEQ ID NO: 579695 - RNA, 21 nt, Human
uccucauauaaguagaauuau

SEQ ID NO: 579696 - RNA, 24 nt, Human
uccuuaaaaaaaaaaaucaaauaa

SEQ ID NO: 579697 - RNA, 19 nt, Human
ucucugugaaacugacugc

SEQ ID NO: 579698 - RNA, 21 nt, Human
ucucugugaaacugacugcuc

SEQ ID NO: 579699 - RNA, 21 nt, Human
ucugacccacuaaacacucac

SEQ ID NO: 579700 - RNA, 23 nt, Human
ucugugaaacugacugcucuaga

SEQ ID NO: 579701 - RNA, 20 nt, Human
ucuuuuggauagauauccag

SEQ ID NO: 579702 - RNA, 18 nt, Human
ugaaacugacugcucuag

SEQ ID NO: 579703 - RNA, 20 nt, Human
ugauuugcaaaugcccuucu

SEQ ID NO: 579704 - RNA, 24 nt, Human
ugauuugcaaaugcccuucuccuc

SEQ ID NO: 579705 - RNA, 19 nt, Human
ugccaacauuuaucuucug

SEQ ID NO: 579706 - RNA, 22 nt, Human
uguggaacugcagaucauacgg

SEQ ID NO: 579707 - RNA, 23 nt, Human
uguggaacugcagaucauacggc

SEQ ID NO: 579708 - RNA, 23 nt, Human
uguguguguauuuuuucccauuu

SEQ ID NO: 579709 - RNA, 24 nt, Human
uguuuacucauaaggcagaacacg

SEQ ID NO: 579710 - RNA, 26 nt, Human
uugcuucuaaauaauagcuauccuuu

SEQ ID NO: 579711 - RNA, 22 nt, Human
uuguguguguguauuuuuuccc

SEQ ID NO: 579712 - RNA, 24 nt, Human
uuuuggcuguugugaauaaagccg

SEQ ID NO: 579713 - RNA, 20 nt, Human
uggaaugucauuucucuuua

SEQ ID NO: 579714 - RNA, 20 nt, Human
acugucuugaggauggggau

SEQ ID NO: 579715 - RNA, 20 nt, Human
agccagcagccccaaggagc

SEQ ID NO: 579716 - RNA, 24 nt, Human
aggauggggaugcaaacagugcuc

SEQ ID NO: 579717 - RNA, 23 nt, Human
auacaaaaaaucuaugcuuuacc

SEQ ID NO: 579718 - RNA, 22 nt, Human
aucuaugcuuuacccaauuuug

SEQ ID NO: 579719 - RNA, 19 nt, Human
caacgguggagcugcgcgc

SEQ ID NO: 579720 - RNA, 23 nt, Human
ccaaacagacaauggauaccuaa

SEQ ID NO: 579721 - RNA, 22 nt, Human
cccgccgcaaacgcagcagcca

SEQ ID NO: 579722 - RNA, 18 nt, Human
ccgcggccaccaccuccc

SEQ ID NO: 579723 - RNA, 19 nt, Human
cgcgcucggguguuuacgc

SEQ ID NO: 579724 - RNA, 23 nt, Human
cuaugcuuuacccaauuuugaug

SEQ ID NO: 579725 - RNA, 19 nt, Human
cucccgccgcaaacgcagc

SEQ ID NO: 579726 - RNA, 21 nt, Human
cuugaggauggggaugcaaac

SEQ ID NO: 579727 - RNA, 22 nt, Human
gaaaaauaccccuucucguggg

SEQ ID NO: 579728 - RNA, 20 nt, Human
gaccgcggccaccaccuccc

SEQ ID NO: 579729 - RNA, 21 nt, Human
ggagcugcgcgcccuccgcuc

SEQ ID NO: 579730 - RNA, 19 nt, Human
ucucgugggaccgcggcca

SEQ ID NO: 579731 - RNA, 18 nt, Human
uggagcugcgcgcccucc

SEQ ID NO: 579732 - RNA, 22 nt, Human
uguaaaacaaaaguuaugcuga

SEQ ID NO: 579733 - RNA, 20 nt, Human
aaacuccaucaaaagucgcc

SEQ ID NO: 579734 - RNA, 21 nt, Human
aacaagcaguagaauagucaa

SEQ ID NO: 579735 - RNA, 22 nt, Human
aagcaguagaauagucaacuca

SEQ ID NO: 579736 - RNA, 27 nt, Human
acaauagcagggaaggccgaggcuucc

SEQ ID NO: 579737 - RNA, 23 nt, Human
acuacgucugaugccaaagcucu

SEQ ID NO: 579738 - RNA, 20 nt, Human
acucuaaaacucaauauaga

SEQ ID NO: 579739 - RNA, 21 nt, Human
agguaaaguucagaaauuuau

SEQ ID NO: 579740 - RNA, 22 nt, Human
caaaucacuaugagaggaaacu

SEQ ID NO: 579741 - RNA, 22 nt, Human
cagcucaaccucggcugccugu

SEQ ID NO: 579742 - RNA, 22 nt, Human
caucaaaagucgccaauuguuc

SEQ ID NO: 579743 - RNA, 22 nt, Human
cgcagcucaaccucggcugccu

SEQ ID NO: 579744 - RNA, 23 nt, Human
gcuccgaagcccagcggggcuca

SEQ ID NO: 579745 - RNA, 23 nt, Human
ggaaggccgaggcuuccuacaga

SEQ ID NO: 579746 - RNA, 21 nt, Human
ggagagcacagauugcaccug

SEQ ID NO: 579747 - RNA, 19 nt, Human
guagaauagucaacucaaa

SEQ ID NO: 579748 - RNA, 19 nt, Human
uacccagcuaacaagcagu

SEQ ID NO: 579749 - RNA, 23 nt, Human
uacugugcuacggaagccugguu

SEQ ID NO: 579750 - RNA, 20 nt, Human
uccccucgugucuccccuaa

SEQ ID NO: 579751 - RNA, 18 nt, Human
uccgaagcccagcggggc

SEQ ID NO: 579752 - RNA, 18 nt, Human
ugagcuuuggcuacccag

SEQ ID NO: 579753 - RNA, 21 nt, Human
ugccaaagcucuaacucuaaa

SEQ ID NO: 579754 - RNA, 19 nt, Human
ugcuccgaagcccagcggg

SEQ ID NO: 579755 - RNA, 20 nt, Human
uacaauguuacuucagaaaa

SEQ ID NO: 579756 - RNA, 20 nt, Human
uagcaugauuaugguaauuu

SEQ ID NO: 579757 - RNA, 30 nt, Human
uagccaugcucccauuuuugaugaaagcuu

SEQ ID NO: 579758 - RNA, 26 nt, Human
ucuaugauacaauguuacuucagaaa

SEQ ID NO: 579759 - RNA, 23 nt, Human
uugcacaaacacucccucacaaa

SEQ ID NO: 579760 - RNA, 21 nt, Human
uuuugcacaaacacucccuca

SEQ ID NO: 579761 - RNA, 18 nt, Human
aaaaagaaagcacagaga

SEQ ID NO: 579762 - RNA, 24 nt, Human
aaaaagaaagcacagagauaaaaa

SEQ ID NO: 579763 - RNA, 24 nt, Human
aacauuaucacuauauauuugacu

SEQ ID NO: 579764 - RNA, 22 nt, Human
acaacaguggucucuagcaccu

SEQ ID NO: 579765 - RNA, 23 nt, Human
acuaaggcaaucuuuaucuauau

SEQ ID NO: 579766 - RNA, 21 nt, Human
agacauagcuaucacaauaua

SEQ ID NO: 579767 - RNA, 25 nt, Human
aggaugaaaauauauuuauaaagga

SEQ ID NO: 579768 - RNA, 23 nt, Human
caccaaagucuuucuccuaacca

SEQ ID NO: 579769 - RNA, 20 nt, Human
caccaugaaaaagaaagcac

SEQ ID NO: 579770 - RNA, 26 nt, Human
cagcaauaaaaacuggaauuuauaca

SEQ ID NO: 579771 - RNA, 21 nt, Human
caguagcuaggauguauauac

SEQ ID NO: 579772 - RNA, 21 nt, Human
ccgccagccggaggagcagca

SEQ ID NO: 579773 - RNA, 22 nt, Human
gcagcagcggccgcagccgcgc

SEQ ID NO: 579774 - RNA, 24 nt, Human
gcuuuucuuucuuccaccaccaaa

SEQ ID NO: 579775 - RNA, 19 nt, Human
uaaaaauacuaauggccag

SEQ ID NO: 579776 - RNA, 19 nt, Human
uaccauugcaggcagauga

SEQ ID NO: 579777 - RNA, 24 nt, Human
uagcauugaguuuuauaaaaauac

SEQ ID NO: 579778 - RNA, 21 nt, Human
uagcuaggauguauauacaca

SEQ ID NO: 579779 - RNA, 27 nt, Human
ucaguagucuuuguuuuaugcuuuucu

SEQ ID NO: 579780 - RNA, 25 nt, Human
ucauaacauccaauaaaucugcaau

SEQ ID NO: 579781 - RNA, 19 nt, Human
ucuccuaaccaccauucac

SEQ ID NO: 579782 - RNA, 22 nt, Human
ugaaaaagaaagcacagagaua

SEQ ID NO: 579783 - RNA, 18 nt, Human
uggaauuuauacaggaga

SEQ ID NO: 579784 - RNA, 22 nt, Human
uuaauaaacaccaugaaaaaga

SEQ ID NO: 579785 - RNA, 20 nt, Human
uuagaaucagaggucuaagg

SEQ ID NO: 579786 - RNA, 28 nt, Human
uucaaaaggaugaaaauauauuuauaaa

SEQ ID NO: 579787 - RNA, 22 nt, Human
uugcaggcagaugaaaaucuac

SEQ ID NO: 579788 - RNA, 18 nt, Human
aaacaguacccugaaccc

SEQ ID NO: 579789 - RNA, 19 nt, Human
aaagugcugggaauacagg

SEQ ID NO: 579790 - RNA, 24 nt, Human
aaagugcugggaauacagguguga

SEQ ID NO: 579791 - RNA, 21 nt, Human
aaauaaacaguacccugaacc

SEQ ID NO: 579792 - RNA, 19 nt, Human
aaccauuuaugaugcgucu

SEQ ID NO: 579793 - RNA, 24 nt, Human
aacccugucuguccucuguagcac

SEQ ID NO: 579794 - RNA, 26 nt, Human
aagagcucuccauuuuuuguaacacc

SEQ ID NO: 579795 - RNA, 25 nt, Human
aagcaauccuccugccuaggccucc

SEQ ID NO: 579796 - RNA, 24 nt, Human
aaguaacuaggacuacaggcacac

SEQ ID NO: 579797 - RNA, 25 nt, Human
aauuacucauuuaguguauuuccau

SEQ ID NO: 579798 - RNA, 20 nt, Human
acaagggggauccccagcac

SEQ ID NO: 579799 - RNA, 23 nt, Human
acacaucuuuagaaauacaacua

SEQ ID NO: 579800 - RNA, 25 nt, Human
accaauccaagcacuaaagacacca

SEQ ID NO: 579801 - RNA, 23 nt, Human
accucagccucccaaguaacuag

SEQ ID NO: 579802 - RNA, 27 nt, Human
acucuguugcccagacuggagugcauu

SEQ ID NO: 579803 - RNA, 18 nt, Human
acugcagccuccaccucc

SEQ ID NO: 579804 - RNA, 24 nt, Human
agacuauauaucaaguugugccag

SEQ ID NO: 579805 - RNA, 21 nt, Human
agagguaccugccacugagcc

SEQ ID NO: 579806 - RNA, 22 nt, Human
agcaagagcaaaaggugcgacc

SEQ ID NO: 579807 - RNA, 18 nt, Human
agcagggagaaacaaggu

SEQ ID NO: 579808 - RNA, 20 nt, Human
aggagugcugaaauagcagg

SEQ ID NO: 579809 - RNA, 20 nt, Human
agugcugggaauacaggugu

SEQ ID NO: 579810 - RNA, 21 nt, Human
aguguugugggacauccagcc

SEQ ID NO: 579811 - RNA, 20 nt, Human
aguucauucacuaagaauaa

SEQ ID NO: 579812 - RNA, 23 nt, Human
aucucacacaaauaaaaaaaaac

SEQ ID NO: 579813 - RNA, 19 nt, Human
aucucugucaaacucuucc

SEQ ID NO: 579814 - RNA, 25 nt, Human
augaaugcuugacauagcuuucauc

SEQ ID NO: 579815 - RNA, 19 nt, Human
augguuuucaccugacuug

SEQ ID NO: 579816 - RNA, 20 nt, Human
caaaacccugucuguccucu

SEQ ID NO: 579817 - RNA, 24 nt, Human
caaagugcugggaauacaggugug

SEQ ID NO: 579818 - RNA, 27 nt, Human
caagcaauccuccugccuaggccuccc

SEQ ID NO: 579819 - RNA, 28 nt, Human
caagcaauccuccugccuaggccuccca

SEQ ID NO: 579820 - RNA, 24 nt, Human
caagguggcagaauuucaaaacca

SEQ ID NO: 579821 - RNA, 24 nt, Human
cacacaaauaaaaaaaaacgacag

SEQ ID NO: 579822 - RNA, 21 nt, Human
caccccuuuacucacccaaca

SEQ ID NO: 579823 - RNA, 24 nt, Human
caccgcacuuggcuaauuuuugua

SEQ ID NO: 579824 - RNA, 20 nt, Human
cacucuguucauuguggcau

SEQ ID NO: 579825 - RNA, 23 nt, Human
cacucuguugcccagacuggagu

SEQ ID NO: 579826 - RNA, 24 nt, Human
cacucuguugcccagacuggagug

SEQ ID NO: 579827 - RNA, 23 nt, Human
cacugcagccuccaccuccuggg

SEQ ID NO: 579828 - RNA, 21 nt, Human
cagaguaaaucccauucuaua

SEQ ID NO: 579829 - RNA, 21 nt, Human
cagcaagagcaaaaggugcga

SEQ ID NO: 579830 - RNA, 23 nt, Human
cagcaagagcaaaaggugcgacc

SEQ ID NO: 579831 - RNA, 18 nt, Human
cagccagcauucuuaaug

SEQ ID NO: 579832 - RNA, 24 nt, Human
cagccagcauucuuaauguuuucu

SEQ ID NO: 579833 - RNA, 19 nt, Human
cagccuccaccuccugggc

SEQ ID NO: 579834 - RNA, 23 nt, Human
cagccuccaccuccugggcucag

SEQ ID NO: 579835 - RNA, 23 nt, Human
cagccucccaaguaacuaggacu

SEQ ID NO: 579836 - RNA, 21 nt, Human
cagggagaaacaagguggcag

SEQ ID NO: 579837 - RNA, 22 nt, Human
caggugauucucccaccucagc

SEQ ID NO: 579838 - RNA, 20 nt, Human
caguuccaguguuacaaggg

SEQ ID NO: 579839 - RNA, 21 nt, Human
ccaaagugcugggaauacagg

SEQ ID NO: 579840 - RNA, 24 nt, Human
ccaaagugcugggaauacaggugu

SEQ ID NO: 579841 - RNA, 18 nt, Human
ccacacauggguuuaugc

SEQ ID NO: 579842 - RNA, 18 nt, Human
ccaccacaggucccaugg

SEQ ID NO: 579843 - RNA, 24 nt, Human
ccaccuccugggcucaggugauuc

SEQ ID NO: 579844 - RNA, 24 nt, Human
cccaaguaacuaggacuacaggca

SEQ ID NO: 579845 - RNA, 26 nt, Human
cccaaucuaauugugcagagagaugu

SEQ ID NO: 579846 - RNA, 28 nt, Human
cccaccaauccaagcacuaaagaggggg

SEQ ID NO: 579847 - RNA, 18 nt, Human
cccacuacgaaugggcaa

SEQ ID NO: 579848 - RNA, 20 nt, Human
cccaggcucaagcaauccuc

SEQ ID NO: 579849 - RNA, 18 nt, Human
cccccuucuccauucuuc

SEQ ID NO: 579850 - RNA, 21 nt, Human
ccccuuuacucacccaacaaa

SEQ ID NO: 579851 - RNA, 18 nt, Human
cccugaacccagaaguuc

SEQ ID NO: 579852 - RNA, 24 nt, Human
ccuccugggcucaggugauucucc

SEQ ID NO: 579853 - RNA, 24 nt, Human
ccugggcucaggugauucucccac

SEQ ID NO: 579854 - RNA, 21 nt, Human
cuaggccucccaaagugcugg

SEQ ID NO: 579855 - RNA, 24 nt, Human
cuauauuauagcacuacaaacauc

SEQ ID NO: 579856 - RNA, 19 nt, Human
cucaaaacccugucugucc

SEQ ID NO: 579857 - RNA, 24 nt, Human
cucaagcaauccuccugccuaggc

SEQ ID NO: 579858 - RNA, 19 nt, Human
cucaccccuuuacucaccc

SEQ ID NO: 579859 - RNA, 21 nt, Human
cucacugcagccuccaccucc

SEQ ID NO: 579860 - RNA, 24 nt, Human
cucacugcagccuccaccuccugg

SEQ ID NO: 579861 - RNA, 23 nt, Human
cucaggugauucucccaccucag

SEQ ID NO: 579862 - RNA, 24 nt, Human
cucaggugauucucccaccucagc

SEQ ID NO: 579863 - RNA, 19 nt, Human
cucccuacacccccaugcc

SEQ ID NO: 579864 - RNA, 19 nt, Human
cuccugccuaggccuccca

SEQ ID NO: 579865 - RNA, 21 nt, Human
cuccugggcucaggugauucu

SEQ ID NO: 579866 - RNA, 19 nt, Human
cucuugggccuuucuucuc

SEQ ID NO: 579867 - RNA, 22 nt, Human
cugaucucacuuggccacacau

SEQ ID NO: 579868 - RNA, 23 nt, Human
cugcagccuccaccuccugggcu

SEQ ID NO: 579869 - RNA, 24 nt, Human
cugcagccuccaccuccugggcuc

SEQ ID NO: 579870 - RNA, 18 nt, Human
cugcucgaagugaggcag

SEQ ID NO: 579871 - RNA, 20 nt, Human
cuggagugcauuggcauggc

SEQ ID NO: 579872 - RNA, 19 nt, Human
cuucuugucucgcucuugg

SEQ ID NO: 579873 - RNA, 20 nt, Human
gaaacuccaucgugaggagc

SEQ ID NO: 579874 - RNA, 18 nt, Human
gaauacaggugugagcca

SEQ ID NO: 579875 - RNA, 21 nt, Human
gaauacaggugugagccacca

SEQ ID NO: 579876 - RNA, 20 nt, Human
gaauuuuauaagugcucucc

SEQ ID NO: 579877 - RNA, 25 nt, Human
gacaccaaguuaaaaacaggaagaa

SEQ ID NO: 579878 - RNA, 24 nt, Human
gaccucaugagcagggagaaacaa

SEQ ID NO: 579879 - RNA, 20 nt, Human
gagagaugugaaaaugaagc

SEQ ID NO: 579880 - RNA, 20 nt, Human
gaguauuucuuaagcuccua

SEQ ID NO: 579881 - RNA, 21 nt, Human
gauucucccaccucagccucc

SEQ ID NO: 579882 - RNA, 19 nt, Human
gcaaaaggugcgaccucau

SEQ ID NO: 579883 - RNA, 23 nt, Human
gcacuacaaacauccuuagucau

SEQ ID NO: 579884 - RNA, 21 nt, Human
gcucacugcagccuccaccuc

SEQ ID NO: 579885 - RNA, 21 nt, Human
gcugaucucacuuggccacac

SEQ ID NO: 579886 - RNA, 22 nt, Human
ggaauacaggugugagccacca

SEQ ID NO: 579887 - RNA, 20 nt, Human
ggacuacaggcacaccaccg

SEQ ID NO: 579888 - RNA, 23 nt, Human
ggagcuaccccgaacucccuaca

SEQ ID NO: 579889 - RNA, 22 nt, Human
ggcaugaaaugaauuugagaug

SEQ ID NO: 579890 - RNA, 18 nt, Human
ggcaugaagagaaggagc

SEQ ID NO: 579891 - RNA, 18 nt, Human
ggcauggcucacugcagc

SEQ ID NO: 579892 - RNA, 18 nt, Human
gggcccaaauggcagcgg

SEQ ID NO: 579893 - RNA, 22 nt, Human
gggcucaggugauucucccacc

SEQ ID NO: 579894 - RNA, 24 nt, Human
gggcucaggugauucucccaccuc

SEQ ID NO: 579895 - RNA, 21 nt, Human
guagagaugggauuuugccau

SEQ ID NO: 579896 - RNA, 23 nt, Human
gucauuccuucauuuguucauuc

SEQ ID NO: 579897 - RNA, 25 nt, Human
gucccaggcucaagcaauccuccug

SEQ ID NO: 579898 - RNA, 24 nt, Human
gugauucucccaccucagccuccc

SEQ ID NO: 579899 - RNA, 24 nt, Human
guuguagagaugggauuuugccau

SEQ ID NO: 579900 - RNA, 18 nt, Human
uaaagcagaguaaauccc

SEQ ID NO: 579901 - RNA, 20 nt, Human
uaaagcagaguaaaucccaa

SEQ ID NO: 579902 - RNA, 23 nt, Human
uaagugcucuccugauaaaaaaa

SEQ ID NO: 579903 - RNA, 18 nt, Human
uaauuuuuguauuuuugu

SEQ ID NO: 579904 - RNA, 26 nt, Human
uaauuuuuguauuuuuguuguagaga

SEQ ID NO: 579905 - RNA, 19 nt, Human
uacaggcacaccaccgcac

SEQ ID NO: 579906 - RNA, 24 nt, Human
uacaggugugagccaccacagcca

SEQ ID NO: 579907 - RNA, 21 nt, Human
uacagugagucgcagugaacc

SEQ ID NO: 579908 - RNA, 19 nt, Human
uacauucucuaggaaacac

SEQ ID NO: 579909 - RNA, 19 nt, Human
uaccccgaacucccuacac

SEQ ID NO: 579910 - RNA, 18 nt, Human
uacccugaacccagaagu

SEQ ID NO: 579911 - RNA, 22 nt, Human
uagagaugggauuuugccaugu

SEQ ID NO: 579912 - RNA, 18 nt, Human
uagcagcaagagcaaaag

SEQ ID NO: 579913 - RNA, 23 nt, Human
ucaaaacccugucuguccucugu

SEQ ID NO: 579914 - RNA, 18 nt, Human
ucaccccuuuacucaccc

SEQ ID NO: 579915 - RNA, 23 nt, Human
ucacugagugagacugaauucuu

SEQ ID NO: 579916 - RNA, 23 nt, Human
ucacugcagccuccaccuccugg

SEQ ID NO: 579917 - RNA, 24 nt, Human
ucacugcagccuccaccuccuggg

SEQ ID NO: 579918 - RNA, 25 nt, Human
ucacugcagccuccaccuccugggc

SEQ ID NO: 579919 - RNA, 27 nt, Human
ucacugcagccuccaccuccugggcuc

SEQ ID NO: 579920 - RNA, 19 nt, Human
uccagccacaggcaugaag

SEQ ID NO: 579921 - RNA, 23 nt, Human
ucccaaagugcugggaauacagg

SEQ ID NO: 579922 - RNA, 24 nt, Human
ucccaaguaacuaggacuacaggc

SEQ ID NO: 579923 - RNA, 18 nt, Human
ucccaggcucaagcaauc

SEQ ID NO: 579924 - RNA, 24 nt, Human
ucccaggcucaagcaauccuccug

SEQ ID NO: 579925 - RNA, 24 nt, Human
uccccugauuucacuuuguaauaa

SEQ ID NO: 579926 - RNA, 22 nt, Human
ucccuacacccccaugcccucc

SEQ ID NO: 579927 - RNA, 26 nt, Human
uccgaaacaucccaccaauccaagca

SEQ ID NO: 579928 - RNA, 22 nt, Human
uccuacaguguaccaggaggca

SEQ ID NO: 579929 - RNA, 23 nt, Human
uccugggcucaggugauucuccc

SEQ ID NO: 579930 - RNA, 19 nt, Human
uccuuagucauuccuucau

SEQ ID NO: 579931 - RNA, 24 nt, Human
ucucacucuguugcccagacugga

SEQ ID NO: 579932 - RNA, 26 nt, Human
ucucacucuguugcccagacuggagu

SEQ ID NO: 579933 - RNA, 27 nt, Human
ucucacucuguugcccagacuggagug

SEQ ID NO: 579934 - RNA, 23 nt, Human
ucucccaccucagccucccaagu

SEQ ID NO: 579935 - RNA, 25 nt, Human
ucucccaccucagccucccaaguaa

SEQ ID NO: 579936 - RNA, 19 nt, Human
ucucgaagucccaggcuca

SEQ ID NO: 579937 - RNA, 22 nt, Human
ucuguaguucuugcuuaacaca

SEQ ID NO: 579938 - RNA, 19 nt, Human
ucugucaaacucuuccauu

SEQ ID NO: 579939 - RNA, 23 nt, Human
ucuguccucuguagcacuuuuag

SEQ ID NO: 579940 - RNA, 23 nt, Human
ucuuggcugcccccuucuccauu

SEQ ID NO: 579941 - RNA, 25 nt, Human
ucuuuauucauuuauuuauuuauuu

SEQ ID NO: 579942 - RNA, 23 nt, Human
ugaaaccauuccaccuggcauua

SEQ ID NO: 579943 - RNA, 24 nt, Human
ugacuuguugaaaccauuccaccu

SEQ ID NO: 579944 - RNA, 20 nt, Human
ugagacagggucucacucug

SEQ ID NO: 579945 - RNA, 22 nt, Human
ugagacagggucucacucuguu

SEQ ID NO: 579946 - RNA, 19 nt, Human
ugaggcagaaguauggauu

SEQ ID NO: 579947 - RNA, 19 nt, Human
ugagucgcagugaacccag

SEQ ID NO: 579948 - RNA, 20 nt, Human
ugauucucccaccucagccu

SEQ ID NO: 579949 - RNA, 24 nt, Human
ugcccagacuggagugcauuggca

SEQ ID NO: 579950 - RNA, 21 nt, Human
ugcucugcccuuggcaugugc

SEQ ID NO: 579951 - RNA, 19 nt, Human
ugcugcagaugcaucccaa

SEQ ID NO: 579952 - RNA, 18 nt, Human
uggagugcauuggcaugg

SEQ ID NO: 579953 - RNA, 20 nt, Human
uggcauuacaaagauaaaga

SEQ ID NO: 579954 - RNA, 21 nt, Human
uggccucaaaacccugucugu

SEQ ID NO: 579955 - RNA, 18 nt, Human
ugggaauacaggugugag

SEQ ID NO: 579956 - RNA, 22 nt, Human
ugggaauacaggugugagccac

SEQ ID NO: 579957 - RNA, 24 nt, Human
ugggaauacaggugugagccacca

SEQ ID NO: 579958 - RNA, 23 nt, Human
ugggauuuugccauguuucccag

SEQ ID NO: 579959 - RNA, 23 nt, Human
ugggcaauuagcagcaagagcaa

SEQ ID NO: 579960 - RNA, 24 nt, Human
ugggcucaggugauucucccaccu

SEQ ID NO: 579961 - RNA, 25 nt, Human
uggugguauaaaggccucucaguag

SEQ ID NO: 579962 - RNA, 24 nt, Human
uguagagaugggauuuugccaugu

SEQ ID NO: 579963 - RNA, 24 nt, Human
uguagcacuuuuagaaauggccug

SEQ ID NO: 579964 - RNA, 19 nt, Human
ugugcagagagaugugaaa

SEQ ID NO: 579965 - RNA, 18 nt, Human
uuacuguacaugguggua

SEQ ID NO: 579966 - RNA, 23 nt, Human
uuauuuauuuauuuauuuuuggu

SEQ ID NO: 579967 - RNA, 22 nt, Human
uucaagggcugcuucuuccucu

SEQ ID NO: 579968 - RNA, 24 nt, Human
uucaugcauucagugaguauuucu

SEQ ID NO: 579969 - RNA, 22 nt, Human
uucauucacuaagaauaaaauu

SEQ ID NO: 579970 - RNA, 21 nt, Human
uucauuccaccacagguccca

SEQ ID NO: 579971 - RNA, 22 nt, Human
uugagacagggucucacucugu

SEQ ID NO: 579972 - RNA, 21 nt, Human
uugcccagacuggagugcauu

SEQ ID NO: 579973 - RNA, 24 nt, Human
uugcccagacuggagugcauuggc

SEQ ID NO: 579974 - RNA, 23 nt, Human
uuguagagaugggauuuugccau

SEQ ID NO: 579975 - RNA, 24 nt, Human
uuguagagaugggauuuugccaug

SEQ ID NO: 579976 - RNA, 24 nt, Human
uuuauuuauuuuugagacaggguc

SEQ ID NO: 579977 - RNA, 24 nt, Human
uuucccagucuggucucgaagucc

SEQ ID NO: 579978 - RNA, 24 nt, Human
uuucuguauaugaauuuguuaaua

SEQ ID NO: 579979 - RNA, 22 nt, Human
uuuuuguauuuuuguuguagag

SEQ ID NO: 579980 - RNA, 25 nt, Human
uuuuuguauuuuuguuguagagaug

SEQ ID NO: 579981 - RNA, 20 nt, Human
aaaaaaaaaaagcagagaaa

SEQ ID NO: 579982 - RNA, 18 nt, Human
aaaaaaaagcagagaaaa

SEQ ID NO: 579983 - RNA, 24 nt, Human
aaagugcugggauuacaggcauga

SEQ ID NO: 579984 - RNA, 24 nt, Human
aaauccauaccugauggagacagg

SEQ ID NO: 579985 - RNA, 18 nt, Human
aacaugaauacagcaaaa

SEQ ID NO: 579986 - RNA, 19 nt, Human
aaccucagaagagaugagg

SEQ ID NO: 579987 - RNA, 19 nt, Human
aagcagacuccugacauua

SEQ ID NO: 579988 - RNA, 24 nt, Human
aaguaauuuacccaccuuggccuc

SEQ ID NO: 579989 - RNA, 19 nt, Human
aagugcugggauuacaggc

SEQ ID NO: 579990 - RNA, 21 nt, Human
aagugcugggauuacaggcau

SEQ ID NO: 579991 - RNA, 26 nt, Human
aagugcugggauuacaggcaugagcc

SEQ ID NO: 579992 - RNA, 24 nt, Human
aauaaacauuaaaacacaucuaaa

SEQ ID NO: 579993 - RNA, 18 nt, Human
acaaagcuaagaguauca

SEQ ID NO: 579994 - RNA, 19 nt, Human
accugcccaacucuucagc

SEQ ID NO: 579995 - RNA, 18 nt, Human
accuguuguucaugcagg

SEQ ID NO: 579996 - RNA, 18 nt, Human
acuaugccgcccaggcaa

SEQ ID NO: 579997 - RNA, 20 nt, Human
acugaauuuauugguaagcu

SEQ ID NO: 579998 - RNA, 22 nt, Human
agagaaaauuguuuaucagagg

SEQ ID NO: 579999 - RNA, 19 nt, Human
agaguucauguucucuccu

SEQ ID NO: 580000 - RNA, 24 nt, Human
caaagugcugggauuacaggcaug

SEQ ID NO: 580001 - RNA, 23 nt, Human
caaguaauuuacccaccuuggcc

SEQ ID NO: 580002 - RNA, 24 nt, Human
cacuaugccgcccaggcaagucuc

SEQ ID NO: 580003 - RNA, 23 nt, Human
cacuuucauuuuuuuucugccac

SEQ ID NO: 580004 - RNA, 23 nt, Human
cagcaaguagaaggcucccuucu

SEQ ID NO: 580005 - RNA, 18 nt, Human
caggaagggccuuuagug

SEQ ID NO: 580006 - RNA, 24 nt, Human
caguagagacaaggucucacuaug

SEQ ID NO: 580007 - RNA, 23 nt, Human
ccaaagugcugggauuacaggca

SEQ ID NO: 580008 - RNA, 24 nt, Human
ccaaagugcugggauuacaggcau

SEQ ID NO: 580009 - RNA, 21 nt, Human
ccaacucuucagcccugaccu

SEQ ID NO: 580010 - RNA, 24 nt, Human
cccaaagugcugggauuacaggca

SEQ ID NO: 580011 - RNA, 21 nt, Human
cccaacucuucagcccugacc

SEQ ID NO: 580012 - RNA, 23 nt, Human
cccaagcagacuccugacauuaa

SEQ ID NO: 580013 - RNA, 21 nt, Human
cccaugcagauaacaaccugc

SEQ ID NO: 580014 - RNA, 23 nt, Human
ccccaccucuccacuggaaccua

SEQ ID NO: 580015 - RNA, 18 nt, Human
cuggccaaauguugcccc

SEQ ID NO: 580016 - RNA, 18 nt, Human
gagacaggaagggccuuu

SEQ ID NO: 580017 - RNA, 18 nt, Human
gauuacaggcaugagcca

SEQ ID NO: 580018 - RNA, 18 nt, Human
gauuacaggcaugagcca

SEQ ID NO: 580019 - RNA, 22 nt, Human
gauuacaggcaugagccaucac

SEQ ID NO: 580020 - RNA, 19 nt, Human
gcagauaacaaccugccca

SEQ ID NO: 580021 - RNA, 23 nt, Human
ggauuacaggcaugagccaucac

SEQ ID NO: 580022 - RNA, 24 nt, Human
guaauuuacccaccuuggccuccc

SEQ ID NO: 580023 - RNA, 21 nt, Human
uaaacaaagcacugaauuaga

SEQ ID NO: 580024 - RNA, 19 nt, Human
uaacaaccugcccaacucu

SEQ ID NO: 580025 - RNA, 20 nt, Human
uaagacauucguuguaaaca

SEQ ID NO: 580026 - RNA, 25 nt, Human
uaagucacaaaaacaugaauacagc

SEQ ID NO: 580027 - RNA, 24 nt, Human
uaauuuacccaccuuggccuccca

SEQ ID NO: 580028 - RNA, 22 nt, Human
uacaggcaugagccaucacacc

SEQ ID NO: 580029 - RNA, 22 nt, Human
uacccaccuuggccucccaaag

SEQ ID NO: 580030 - RNA, 23 nt, Human
uacccaccuuggccucccaaagu

SEQ ID NO: 580031 - RNA, 18 nt, Human
uagaaggcucccuuucag

SEQ ID NO: 580032 - RNA, 18 nt, Human
uagcaaagaaaggcuaug

SEQ ID NO: 580033 - RNA, 24 nt, Human
uaugccgcccaggcaagucucgaa

SEQ ID NO: 580034 - RNA, 23 nt, Human
uauucucauuuuacagaugagaa

SEQ ID NO: 580035 - RNA, 19 nt, Human
ucaaguaauuuacccaccu

SEQ ID NO: 580036 - RNA, 22 nt, Human
ucacaccuggccaauuuuucua

SEQ ID NO: 580037 - RNA, 26 nt, Human
ucacauuaucuccuuuacauuuuaag

SEQ ID NO: 580038 - RNA, 21 nt, Human
ucaguagagacaaggucucac

SEQ ID NO: 580039 - RNA, 26 nt, Human
ucauaauuaaaaaaaaaaagcagaga

SEQ ID NO: 580040 - RNA, 23 nt, Human
uccacuggaaccuagugacccca

SEQ ID NO: 580041 - RNA, 21 nt, Human
uccauaccugauggagacagg

SEQ ID NO: 580042 - RNA, 22 nt, Human
uccauacucgauaugaaagggg

SEQ ID NO: 580043 - RNA, 24 nt, Human
ucccaaagugcugggauuacaggc

SEQ ID NO: 580044 - RNA, 26 nt, Human
ucucacuaugccgcccaggcaagucu

SEQ ID NO: 580045 - RNA, 21 nt, Human
ucucgaacugcuggguucaag

SEQ ID NO: 580046 - RNA, 22 nt, Human
ucuucagcccugaccuggcauc

SEQ ID NO: 580047 - RNA, 20 nt, Human
ugaauacagcaaaauuucac

SEQ ID NO: 580048 - RNA, 21 nt, Human
ugaauacagcaaaauuucacu

SEQ ID NO: 580049 - RNA, 19 nt, Human
ugaauuagacagaauagau

SEQ ID NO: 580050 - RNA, 19 nt, Human
ugaccuggcaucauauuua

SEQ ID NO: 580051 - RNA, 22 nt, Human
ugagaacgaccagagauguuag

SEQ ID NO: 580052 - RNA, 20 nt, Human
ugccagguggcugcagagcg

SEQ ID NO: 580053 - RNA, 19 nt, Human
ugcccaaaauuacucaaau

SEQ ID NO: 580054 - RNA, 27 nt, Human
ugcccaacucuucagcccugaccuggc

SEQ ID NO: 580055 - RNA, 20 nt, Human
ugccccaaauccauaccuga

SEQ ID NO: 580056 - RNA, 19 nt, Human
uggcaguucuucucugacu

SEQ ID NO: 580057 - RNA, 18 nt, Human
ugggauuacaggcaugag

SEQ ID NO: 580058 - RNA, 19 nt, Human
ugggauuacaggcaugagc

SEQ ID NO: 580059 - RNA, 21 nt, Human
ugggauuacaggcaugagcca

SEQ ID NO: 580060 - RNA, 21 nt, Human
ugggauuacaggcaugagcca

SEQ ID NO: 580061 - RNA, 22 nt, Human
ugggauuacaggcaugagccau

SEQ ID NO: 580062 - RNA, 23 nt, Human
ugggauuacaggcaugagccauc

SEQ ID NO: 580063 - RNA, 24 nt, Human
ugggauuacaggcaugagccauca

SEQ ID NO: 580064 - RNA, 24 nt, Human
ugggauuacaggcaugagccauca

SEQ ID NO: 580065 - RNA, 27 nt, Human
ugggauuacaggcaugagccaucacac

SEQ ID NO: 580066 - RNA, 21 nt, Human
ugucacauuaucuccuuuaca

SEQ ID NO: 580067 - RNA, 19 nt, Human
ugucagguacuucuuauuc

SEQ ID NO: 580068 - RNA, 21 nt, Human
uguuagcuugcccaaaauuac

SEQ ID NO: 580069 - RNA, 21 nt, Human
uguuuucaguagagacaaggu

SEQ ID NO: 580070 - RNA, 22 nt, Human
uuaaaaaaaaaaagcagagaaa

SEQ ID NO: 580071 - RNA, 21 nt, Human
uuaaaaugucuuccgcaacua

SEQ ID NO: 580072 - RNA, 23 nt, Human
uucaaguaauuuacccaccuugg

SEQ ID NO: 580073 - RNA, 24 nt, Human
uucaaguaauuuacccaccuuggc

SEQ ID NO: 580074 - RNA, 18 nt, Human
uuggccucccaaagugcu

SEQ ID NO: 580075 - RNA, 21 nt, Human
uuuacccaccuuggccuccca

SEQ ID NO: 580076 - RNA, 23 nt, Human
uuucauuuuuuuucugccacauu

SEQ ID NO: 580077 - RNA, 23 nt, Human
aaaaaaaaaaaaagcagcauuug

SEQ ID NO: 580078 - RNA, 26 nt, Human
aaaaaaaagcagcauuugccugggaa

SEQ ID NO: 580079 - RNA, 22 nt, Human
aaaaaagcagcauuugccuggg

SEQ ID NO: 580080 - RNA, 20 nt, Human
aaacaaaacaucaaauggcc

SEQ ID NO: 580081 - RNA, 24 nt, Human
aaacaauaacaaaaacccugccca

SEQ ID NO: 580082 - RNA, 24 nt, Human
aaacaauaacaaaaacccugccca

SEQ ID NO: 580083 - RNA, 20 nt, Human
aaagguaucuaagacaaagg

SEQ ID NO: 580084 - RNA, 24 nt, Human
aagcaaguacauauacaaauccac

SEQ ID NO: 580085 - RNA, 18 nt, Human
aagguaucaucauuuuaa

SEQ ID NO: 580086 - RNA, 23 nt, Human
acaauaacaaaaacccugcccaa

SEQ ID NO: 580087 - RNA, 20 nt, Human
acaaucgacugaugaaaaaa

SEQ ID NO: 580088 - RNA, 23 nt, Human
agaacacaccuacaauuaacuua

SEQ ID NO: 580089 - RNA, 20 nt, Human
agagauaaagcaaguacaua

SEQ ID NO: 580090 - RNA, 19 nt, Human
aggaucuacuuuuuacaca

SEQ ID NO: 580091 - RNA, 24 nt, Human
auaaagcaaguacauauacaaauc

SEQ ID NO: 580092 - RNA, 21 nt, Human
caaaacaucaaauggccugaa

SEQ ID NO: 580093 - RNA, 19 nt, Human
caauaacaaaaacccugcc

SEQ ID NO: 580094 - RNA, 19 nt, Human
cacuauaagcaaacaaaac

SEQ ID NO: 580095 - RNA, 23 nt, Human
cagaacacaccuacaauuaacuu

SEQ ID NO: 580096 - RNA, 21 nt, Human
caucacuauaagcaaacaaaa

SEQ ID NO: 580097 - RNA, 23 nt, Human
ccauaauacauauuauuucacga

SEQ ID NO: 580098 - RNA, 22 nt, Human
cccaaaaaaaaaaaaagcagca

SEQ ID NO: 580099 - RNA, 21 nt, Human
cgacugaugaaaaaacaagcu

SEQ ID NO: 580100 - RNA, 23 nt, Human
cgacugaugaaaaaacaagcuuc

SEQ ID NO: 580101 - RNA, 23 nt, Human
cuaagacaaagguauagauaccc

SEQ ID NO: 580102 - RNA, 28 nt, Human
cuggugguggcaguugcaaguaucuuuu

SEQ ID NO: 580103 - RNA, 25 nt, Human
cuuccaaaaaaagguaucuaagaca

SEQ ID NO: 580104 - RNA, 19 nt, Human
gaacacaccuacaauuaac

SEQ ID NO: 580105 - RNA, 21 nt, Human
gaacacaucacuauaagcaaa

SEQ ID NO: 580106 - RNA, 23 nt, Human
gguggcaguugcaaguaucuuuu

SEQ ID NO: 580107 - RNA, 25 nt, Human
gucauaugugaaucaaccuuuucug

SEQ ID NO: 580108 - RNA, 23 nt, Human
uaaagcaaguacauauacaaauc

SEQ ID NO: 580109 - RNA, 24 nt, Human
uaaagcaaguacauauacaaaucc

SEQ ID NO: 580110 - RNA, 24 nt, Human
uaacaaaaacccugcccaaauauu

SEQ ID NO: 580111 - RNA, 21 nt, Human
uaagaaauauuaaaugugaua

SEQ ID NO: 580112 - RNA, 19 nt, Human
uacaaacaauaacaaaaac

SEQ ID NO: 580113 - RNA, 20 nt, Human
uacaagguaucaucauuuua

SEQ ID NO: 580114 - RNA, 25 nt, Human
uacaauuaacuuauuaaugcugaag

SEQ ID NO: 580115 - RNA, 18 nt, Human
ucagaacacaccuacaau

SEQ ID NO: 580116 - RNA, 18 nt, Human
ucccaaaaaaaaaaaaag

SEQ ID NO: 580117 - RNA, 20 nt, Human
ucccaaaaaaaaaaaaagca

SEQ ID NO: 580118 - RNA, 20 nt, Human
ucuaaaauaccuuuggauua

SEQ ID NO: 580119 - RNA, 23 nt, Human
ugaaaaaacaagcuucauauuca

SEQ ID NO: 580120 - RNA, 18 nt, Human
ugcugcacugaaggaggc

SEQ ID NO: 580121 - RNA, 24 nt, Human
uggaaaagcuaaguuuggagcuga

SEQ ID NO: 580122 - RNA, 25 nt, Human
ugguggcaguugcaaguaucuuuug

SEQ ID NO: 580123 - RNA, 22 nt, Human
uucaguaauacacagucacuau

SEQ ID NO: 580124 - RNA, 19 nt, Human
uuccaaaaaaagguaucua

SEQ ID NO: 580125 - RNA, 28 nt, Human
uugcaaguaucuuuugcugcacugaagg

SEQ ID NO: 580126 - RNA, 21 nt, Human
uuuaagaaauauuaaauguga

SEQ ID NO: 580127 - RNA, 19 nt, Human
uuuacacaaucucaguaac

SEQ ID NO: 580128 - RNA, 21 nt, Human
aaacaagucuacaccauucuu

SEQ ID NO: 580129 - RNA, 19 nt, Human
aagcuguaacuggaaccua

SEQ ID NO: 580130 - RNA, 21 nt, Human
aauaagugacaaaaacaugca

SEQ ID NO: 580131 - RNA, 22 nt, Human
aauuuauaaaacaggaaaaaag

SEQ ID NO: 580132 - RNA, 18 nt, Human
agaagugugaacuuuagg

SEQ ID NO: 580133 - RNA, 24 nt, Human
aggcaaucacuaaccugaaauaag

SEQ ID NO: 580134 - RNA, 22 nt, Human
auuguacuauaggggaaguauc

SEQ ID NO: 580135 - RNA, 25 nt, Human
caauagauauuucuucuuuaaaucc

SEQ ID NO: 580136 - RNA, 23 nt, Human
cacaaaacuauaacuaauacaga

SEQ ID NO: 580137 - RNA, 21 nt, Human
cagaguggagaguuacaagaa

SEQ ID NO: 580138 - RNA, 29 nt, Human
gaaaagcaacauaaaaaaauggagcauua

SEQ ID NO: 580139 - RNA, 19 nt, Human
gaaauaagugacaaaaaca

SEQ ID NO: 580140 - RNA, 22 nt, Human
gaggacagggucguggagucca

SEQ ID NO: 580141 - RNA, 25 nt, Human
gcgcggacagggccgaggacagggu

SEQ ID NO: 580142 - RNA, 20 nt, Human
ggggguggagcgaccggccu

SEQ ID NO: 580143 - RNA, 18 nt, Human
uaaaacaggaaaaaaggu

SEQ ID NO: 580144 - RNA, 21 nt, Human
uaaagcuguauaaaagccaug

SEQ ID NO: 580145 - RNA, 19 nt, Human
uaaaugucuagcuaaaagc

SEQ ID NO: 580146 - RNA, 23 nt, Human
uaaccugaaauaagugacaaaaa

SEQ ID NO: 580147 - RNA, 24 nt, Human
uaagugacaaaaacaugcagauga

SEQ ID NO: 580148 - RNA, 22 nt, Human
uaaguuucucaaauuauguuua

SEQ ID NO: 580149 - RNA, 21 nt, Human
uaggcaaucacuaaccugaaa

SEQ ID NO: 580150 - RNA, 18 nt, Human
uauaaaagccaugcacag

SEQ ID NO: 580151 - RNA, 23 nt, Human
uauuguacuauaggggaaguauc

SEQ ID NO: 580152 - RNA, 19 nt, Human
ucacaaaacuauaacuaau

SEQ ID NO: 580153 - RNA, 18 nt, Human
ucccuguaggggauaggc

SEQ ID NO: 580154 - RNA, 18 nt, Human
ucuauaaaaacauucaga

SEQ ID NO: 580155 - RNA, 20 nt, Human
ugaaauacuaucauauaaca

SEQ ID NO: 580156 - RNA, 26 nt, Human
ugagaaacuuguuguaaugagucugu

SEQ ID NO: 580157 - RNA, 26 nt, Human
uuacuaaagcuguauaaaagccaugc

SEQ ID NO: 580158 - RNA, 21 nt, Human
uucccagucuauggguuucug

SEQ ID NO: 580159 - RNA, 18 nt, Human
uuggcuuauaaguguuag

SEQ ID NO: 580160 - RNA, 19 nt, Human
uuguaaugagucuguacca

SEQ ID NO: 580161 - RNA, 26 nt, Human
uuuauaaaacaggaaaaaagguuauu

SEQ ID NO: 580162 - RNA, 21 nt, Human
aaaaaaaaaaaaaacaaaaaa

SEQ ID NO: 580163 - RNA, 21 nt, Human
aaaaaaaaaaaaacaaaaaaa

SEQ ID NO: 580164 - RNA, 28 nt, Human
aaaaaaaaaaaaacaaaaaaaaaggacc

SEQ ID NO: 580165 - RNA, 25 nt, Human
aaaaaaaaaaaacaaaaaaaaagga

SEQ ID NO: 580166 - RNA, 23 nt, Human
aaaaaaaaaacaaaaaaaaagga

SEQ ID NO: 580167 - RNA, 23 nt, Human
aaaacaaaaaaaaaggacaacca

SEQ ID NO: 580168 - RNA, 18 nt, Human
aaacaaaaaaaaaggaca

SEQ ID NO: 580169 - RNA, 22 nt, Human
aaacaaaaaaaaaggacaacca

SEQ ID NO: 580170 - RNA, 20 nt, Human
aaagcuuuuccauuacucag

SEQ ID NO: 580171 - RNA, 25 nt, Human
aacacaaugggaugucuauagcuaa

SEQ ID NO: 580172 - RNA, 22 nt, Human
aaccagcccaccagucccagca

SEQ ID NO: 580173 - RNA, 23 nt, Human
aagaagaaagagacauagcuuaa

SEQ ID NO: 580174 - RNA, 19 nt, Human
aagauaacacaaugggaug

SEQ ID NO: 580175 - RNA, 19 nt, Human
aagcuccucccaccucucc

SEQ ID NO: 580176 - RNA, 21 nt, Human
aagugacucaagcgaaccugu

SEQ ID NO: 580177 - RNA, 23 nt, Human
acagguauucugcaaaggagaac

SEQ ID NO: 580178 - RNA, 22 nt, Human
accagucccagcaaacucuccu

SEQ ID NO: 580179 - RNA, 23 nt, Human
acccggcaacagacccuuuuugc

SEQ ID NO: 580180 - RNA, 18 nt, Human
acuacagcugccauggcc

SEQ ID NO: 580181 - RNA, 27 nt, Human
agaaagagacauagcuuaauuacagaa

SEQ ID NO: 580182 - RNA, 24 nt, Human
agaacuugacaaggaaugcuacaa

SEQ ID NO: 580183 - RNA, 21 nt, Human
agacccuuuuugcugauauua

SEQ ID NO: 580184 - RNA, 20 nt, Human
agcaaucuaaggucccaggc

SEQ ID NO: 580185 - RNA, 19 nt, Human
aggaagugaguagcuguca

SEQ ID NO: 580186 - RNA, 21 nt, Human
aggugauccgccccccagagc

SEQ ID NO: 580187 - RNA, 26 nt, Human
augaaguucuccucuuuuccuuaaaa

SEQ ID NO: 580188 - RNA, 24 nt, Human
caacagacccuuuuugcugauauu

SEQ ID NO: 580189 - RNA, 18 nt, Human
caagaggcggccccgaag

SEQ ID NO: 580190 - RNA, 22 nt, Human
cacccacaaccacuagacaaca

SEQ ID NO: 580191 - RNA, 18 nt, Human
cacgugccggcuguucuc

SEQ ID NO: 580192 - RNA, 22 nt, Human
cagacccuuuuugcugauauua

SEQ ID NO: 580193 - RNA, 20 nt, Human
cagcugccauggccgccaag

SEQ ID NO: 580194 - RNA, 25 nt, Human
caggaaaccagcccaccagucccag

SEQ ID NO: 580195 - RNA, 23 nt, Human
ccagcaaacucuccuccgagccu

SEQ ID NO: 580196 - RNA, 21 nt, Human
ccaguucuuuaggccuuccca

SEQ ID NO: 580197 - RNA, 20 nt, Human
ccaucuucccugagaauagg

SEQ ID NO: 580198 - RNA, 21 nt, Human
cccccagagcaggaaaccagc

SEQ ID NO: 580199 - RNA, 24 nt, Human
cccccagagcaggaaaccagcccu

SEQ ID NO: 580200 - RNA, 22 nt, Human
ccccccagagcaggaaaccagc

SEQ ID NO: 580201 - RNA, 24 nt, Human
cccggcaacagacccuuuuugcug

SEQ ID NO: 580202 - RNA, 18 nt, Human
cccuauacccggugcugc

SEQ ID NO: 580203 - RNA, 19 nt, Human
cccuggaccaaggcuggac

SEQ ID NO: 580204 - RNA, 22 nt, Human
cccuggaccaaggcuggaccuu

SEQ ID NO: 580205 - RNA, 23 nt, Human
ccuagaacugaaacuacuagaac

SEQ ID NO: 580206 - RNA, 20 nt, Human
ccucucuaggaauguggaga

SEQ ID NO: 580207 - RNA, 24 nt, Human
ccucuggacucuaggaauacaugu

SEQ ID NO: 580208 - RNA, 18 nt, Human
ccuggaccaaggcuggac

SEQ ID NO: 580209 - RNA, 21 nt, Human
cgaaccuguucguucccuagg

SEQ ID NO: 580210 - RNA, 21 nt, Human
cgaaggugauccgccccccuc

SEQ ID NO: 580211 - RNA, 24 nt, Human
cgauugucggauugaggguggcac

SEQ ID NO: 580212 - RNA, 25 nt, Human
cgccccugucuccaagaggcggccc

SEQ ID NO: 580213 - RNA, 18 nt, Human
cgugccaaaggagcuguu

SEQ ID NO: 580214 - RNA, 23 nt, Human
cucacuggauggcaaacggcccu

SEQ ID NO: 580215 - RNA, 19 nt, Human
cucccaccucuccugcucc

SEQ ID NO: 580216 - RNA, 23 nt, Human
cuuucaaugugucuugcuaucau

SEQ ID NO: 580217 - RNA, 21 nt, Human
gaagaaagagacauagcuuaa

SEQ ID NO: 580218 - RNA, 25 nt, Human
gaagcuccucccaccucuccugcuc

SEQ ID NO: 580219 - RNA, 19 nt, Human
gaaggugauccgcccccca

SEQ ID NO: 580220 - RNA, 18 nt, Human
gacccggagucgccgaua

SEQ ID NO: 580221 - RNA, 21 nt, Human
gacugaggaagugaguagcug

SEQ ID NO: 580222 - RNA, 20 nt, Human
gagccugggaugaggaaagg

SEQ ID NO: 580223 - RNA, 24 nt, Human
gaggaagugaguagcugucacgug

SEQ ID NO: 580224 - RNA, 22 nt, Human
ggaaaagucaauggggaaaaug

SEQ ID NO: 580225 - RNA, 23 nt, Human
guucuccucuuuuccuuaaaacu

SEQ ID NO: 580226 - RNA, 23 nt, Human
uaaaaaaagcuacuacaaagaua

SEQ ID NO: 580227 - RNA, 21 nt, Human
uaaacuaagaagaaagagaca

SEQ ID NO: 580228 - RNA, 20 nt, Human
uaaaucaauaggcaaacacu

SEQ ID NO: 580229 - RNA, 22 nt, Human
uaacagagaugggaaaagucaa

SEQ ID NO: 580230 - RNA, 24 nt, Human
uaauuaaaaaaaaaaaaaacaaaa

SEQ ID NO: 580231 - RNA, 21 nt, Human
uacaaagauaucaauaaccau

SEQ ID NO: 580232 - RNA, 22 nt, Human
uagaacuuggcuccucucuagg

SEQ ID NO: 580233 - RNA, 18 nt, Human
uagaagcuccucccaccu

SEQ ID NO: 580234 - RNA, 21 nt, Human
uagaagcuccucccaccucuc

SEQ ID NO: 580235 - RNA, 21 nt, Human
uagcuaacugcaacguaaaug

SEQ ID NO: 580236 - RNA, 21 nt, Human
ucaauggauaucucuuuugag

SEQ ID NO: 580237 - RNA, 21 nt, Human
ucacccacaaccacuagacaa

SEQ ID NO: 580238 - RNA, 18 nt, Human
ucaccuccccucuggacu

SEQ ID NO: 580239 - RNA, 21 nt, Human
ucacuggauggcaaacggccc

SEQ ID NO: 580240 - RNA, 18 nt, Human
ucccaccucuccugcucc

SEQ ID NO: 580241 - RNA, 19 nt, Human
ucccaggcucuggguucuc

SEQ ID NO: 580242 - RNA, 22 nt, Human
ucccuagagggauugcugaucu

SEQ ID NO: 580243 - RNA, 22 nt, Human
ucccuaggcgccccugucucca

SEQ ID NO: 580244 - RNA, 21 nt, Human
ucgccaaagcugaccuaguau

SEQ ID NO: 580245 - RNA, 23 nt, Human
ucucuaggaauguggagacaggu

SEQ ID NO: 580246 - RNA, 27 nt, Human
ucuugaacguacccggcaacagacccu

SEQ ID NO: 580247 - RNA, 21 nt, Human
ugaaggaaagccuagaacuga

SEQ ID NO: 580248 - RNA, 22 nt, Human
ugacacaaagcugucucugccc

SEQ ID NO: 580249 - RNA, 24 nt, Human
ugacucaagcgaaccuguucguuc

SEQ ID NO: 580250 - RNA, 21 nt, Human
ugaggaaaggaguccugcagg

SEQ ID NO: 580251 - RNA, 18 nt, Human
ugagugggugcuaugacc

SEQ ID NO: 580252 - RNA, 20 nt, Human
ugaucugacuguucuugaag

SEQ ID NO: 580253 - RNA, 19 nt, Human
ugcugcccaugguacugca

SEQ ID NO: 580254 - RNA, 28 nt, Human
uggagacagguauucugcaaaggagaac

SEQ ID NO: 580255 - RNA, 22 nt, Human
ugggaaccauguuaaaaaucaa

SEQ ID NO: 580256 - RNA, 20 nt, Human
uggguucucagaugccaguc

SEQ ID NO: 580257 - RNA, 18 nt, Human
ugucucugcccuauaccc

SEQ ID NO: 580258 - RNA, 23 nt, Human
uuaaaacuaaauuccaucuuccc

SEQ ID NO: 580259 - RNA, 23 nt, Human
uuaaauggugcuuagguucuuua

SEQ ID NO: 580260 - RNA, 20 nt, Human
uuaacagagaugggaaaagu

SEQ ID NO: 580261 - RNA, 20 nt, Human
uuacauggugggaaccaugu

SEQ ID NO: 580262 - RNA, 22 nt, Human
uuacauggugggaaccauguuu

SEQ ID NO: 580263 - RNA, 20 nt, Human
uuccaagagagugggcuuuc

SEQ ID NO: 580264 - RNA, 18 nt, Human
uuccaguucuuuaggccu

SEQ ID NO: 580265 - RNA, 21 nt, Human
uucucguggguuaacagagau

SEQ ID NO: 580266 - RNA, 23 nt, Human
uugaacguacccggcaacagacc

SEQ ID NO: 580267 - RNA, 25 nt, Human
uuuaauaucccuuaauuuccaaaga

SEQ ID NO: 580268 - RNA, 21 nt, Human
uuuagaagcuccucccaccuc

SEQ ID NO: 580269 - RNA, 20 nt, Human
uuuccugacccuaaucccag

SEQ ID NO: 580270 - RNA, 20 nt, Human
aaaacaaaugaaaaaccaag

SEQ ID NO: 580271 - RNA, 21 nt, Human
aaacaaauaaaugucccaaga

SEQ ID NO: 580272 - RNA, 22 nt, Human
aaacaaauaaaugucccaagau

SEQ ID NO: 580273 - RNA, 21 nt, Human
aaacaaaugaaaaaccaagau

SEQ ID NO: 580274 - RNA, 19 nt, Human
aaauaaaugucccaagauc

SEQ ID NO: 580275 - RNA, 21 nt, Human
aacuuaccaccuccuucaaau

SEQ ID NO: 580276 - RNA, 21 nt, Human
aagcaaauuuuuuuaaaaucu

SEQ ID NO: 580277 - RNA, 22 nt, Human
aauaaucaaugaauguaaaagc

SEQ ID NO: 580278 - RNA, 20 nt, Human
acauagcaagagcuuuagag

SEQ ID NO: 580279 - RNA, 21 nt, Human
acauagcaagagcuuuagaga

SEQ ID NO: 580280 - RNA, 23 nt, Human
accaccuccuucaaauaaaagcg

SEQ ID NO: 580281 - RNA, 19 nt, Human
acuuucaaaaaugcaagaa

SEQ ID NO: 580282 - RNA, 20 nt, Human
agaaaaugcuauaaagcaau

SEQ ID NO: 580283 - RNA, 25 nt, Human
aucaaaauacagaagagguauucua

SEQ ID NO: 580284 - RNA, 19 nt, Human
augacauucuacuuuucca

SEQ ID NO: 580285 - RNA, 20 nt, Human
caaaauaaccuuuacuaagc

SEQ ID NO: 580286 - RNA, 22 nt, Human
caaauaaaugucccaagaucuc

SEQ ID NO: 580287 - RNA, 22 nt, Human
caaaugaaaaaccaagaugaug

SEQ ID NO: 580288 - RNA, 23 nt, Human
cagccgaguccuuugugagacuu

SEQ ID NO: 580289 - RNA, 19 nt, Human
caggauuuuuauuagggca

SEQ ID NO: 580290 - RNA, 24 nt, Human
ccuccuucaaauaaaagcgagaac

SEQ ID NO: 580291 - RNA, 21 nt, Human
cggcacugagaaaagcagcca

SEQ ID NO: 580292 - RNA, 18 nt, Human
cuaaggagaaauuaguaa

SEQ ID NO: 580293 - RNA, 24 nt, Human
gaacaauuucagcauauaaaccaa

SEQ ID NO: 580294 - RNA, 21 nt, Human
gacaacuacuucuaaugugua

SEQ ID NO: 580295 - RNA, 24 nt, Human
uaaaaaaacaaugaauaugcagga

SEQ ID NO: 580296 - RNA, 24 nt, Human
uaaaaucucaggaacuauagacau

SEQ ID NO: 580297 - RNA, 22 nt, Human
uagauuuuuaacacugugaccc

SEQ ID NO: 580298 - RNA, 25 nt, Human
uagcaacauagcaagagcuuuagag

SEQ ID NO: 580299 - RNA, 26 nt, Human
uauagcaacauagcaagagcuuuaga

SEQ ID NO: 580300 - RNA, 24 nt, Human
uauuucuuaaagcaguggagaaua

SEQ ID NO: 580301 - RNA, 20 nt, Human
ucaggaacuauagacaugau

SEQ ID NO: 580302 - RNA, 18 nt, Human
ugaaaugccaaggugaaa

SEQ ID NO: 580303 - RNA, 18 nt, Human
ugaacugaauuauuucuu

SEQ ID NO: 580304 - RNA, 20 nt, Human
ugaacugaauuauuucuuaa

SEQ ID NO: 580305 - RNA, 19 nt, Human
uguaacagauacugaaaug

SEQ ID NO: 580306 - RNA, 21 nt, Human
uguaacagauacugaaaugcc

SEQ ID NO: 580307 - RNA, 18 nt, Human
uuaacacugugacccaau

SEQ ID NO: 580308 - RNA, 21 nt, Human
uucagcauauaaaccaacaag

SEQ ID NO: 580309 - RNA, 22 nt, Human
uugugagacuucucugaagucu

SEQ ID NO: 580310 - RNA, 18 nt, Human
uuuuuuuuuuuuuuuuug

SEQ ID NO: 580311 - RNA, 18 nt, Human
uuuuuuuuuuuuuuuuug

SEQ ID NO: 580312 - RNA, 22 nt, Human
uuuuuuuuuuuuuuuuuggcag

SEQ ID NO: 580313 - RNA, 22 nt, Human
uuuuuuuuuuuuuuuuuuuggc

SEQ ID NO: 580314 - RNA, 22 nt, Human
aaauaagagauagaaacccaaa

SEQ ID NO: 580315 - RNA, 21 nt, Human
aagagauagaaacccaaauua

SEQ ID NO: 580316 - RNA, 22 nt, Human
aagcagaagagaugcauucugg

SEQ ID NO: 580317 - RNA, 22 nt, Human
acaguccauaaauaaguuaucc

SEQ ID NO: 580318 - RNA, 23 nt, Human
agagaaggcagcagcacgugagg

SEQ ID NO: 580319 - RNA, 23 nt, Human
agcagcacgugaggucaaggaca

SEQ ID NO: 580320 - RNA, 19 nt, Human
agccaacuagccauagccu

SEQ ID NO: 580321 - RNA, 19 nt, Human
agcuuauacagguuuacac

SEQ ID NO: 580322 - RNA, 18 nt, Human
aggcagagaaggcagcag

SEQ ID NO: 580323 - RNA, 23 nt, Human
aggcagcagcacgugaggucaag

SEQ ID NO: 580324 - RNA, 18 nt, Human
agggaccucaccccagag

SEQ ID NO: 580325 - RNA, 22 nt, Human
agggggugcuguuccaagauug

SEQ ID NO: 580326 - RNA, 20 nt, Human
aggucgcucagagagucuuc

SEQ ID NO: 580327 - RNA, 22 nt, Human
augaugggugucuguucuccuu

SEQ ID NO: 580328 - RNA, 29 nt, Human
augggggagauaggugcaaugaagggggc

SEQ ID NO: 580329 - RNA, 21 nt, Human
caaauaagagauagaaaccca

SEQ ID NO: 580330 - RNA, 22 nt, Human
cauuaccaagucugaccuuggc

SEQ ID NO: 580331 - RNA, 20 nt, Human
ccacuuccggacucacgccc

SEQ ID NO: 580332 - RNA, 22 nt, Human
ccggacucacgcccaguacugg

SEQ ID NO: 580333 - RNA, 20 nt, Human
ccucuggaagaaggggcagg

SEQ ID NO: 580334 - RNA, 18 nt, Human
cgcccaguacugggggca

SEQ ID NO: 580335 - RNA, 24 nt, Human
cugagucgccgagucuauggcaug

SEQ ID NO: 580336 - RNA, 30 nt, Human
cugggugaugaugggugucuguucuccuuu

SEQ ID NO: 580337 - RNA, 23 nt, Human
gaaccagaaacccaccaauccua

SEQ ID NO: 580338 - RNA, 18 nt, Human
gacacaguagaaaucugg

SEQ ID NO: 580339 - RNA, 21 nt, Human
gagaaggaggguucagccgug

SEQ ID NO: 580340 - RNA, 18 nt, Human
gaugggggagauaggugc

SEQ ID NO: 580341 - RNA, 21 nt, Human
gcaagccaacuagccauagcc

SEQ ID NO: 580342 - RNA, 21 nt, Human
gcagaagagaugcauucugga

SEQ ID NO: 580343 - RNA, 21 nt, Human
gccagccuggcacuggggcag

SEQ ID NO: 580344 - RNA, 22 nt, Human
gcucucauccccaacaguccau

SEQ ID NO: 580345 - RNA, 23 nt, Human
gcucugaaacaacuggagacagg

SEQ ID NO: 580346 - RNA, 18 nt, Human
ggauccacuugacacagu

SEQ ID NO: 580347 - RNA, 18 nt, Human
ggcaagggccguuagugc

SEQ ID NO: 580348 - RNA, 19 nt, Human
ggcaagggccguuagugcu

SEQ ID NO: 580349 - RNA, 18 nt, Human
gggaagcagaagagaugc

SEQ ID NO: 580350 - RNA, 21 nt, Human
ggggacuuaaagaagggggug

SEQ ID NO: 580351 - RNA, 19 nt, Human
gggggcacuggaggagggu

SEQ ID NO: 580352 - RNA, 20 nt, Human
gggugaugaugggugucugu

SEQ ID NO: 580353 - RNA, 21 nt, Human
ucacgcccaguacugggggca

SEQ ID NO: 580354 - RNA, 19 nt, Human
ucagggaccgggaguugag

SEQ ID NO: 580355 - RNA, 22 nt, Human
uccuuuccaagggauccacuug

SEQ ID NO: 580356 - RNA, 19 nt, Human
ugagaugggggagauaggu

SEQ ID NO: 580357 - RNA, 21 nt, Human
ugaggucaaggacauuaccaa

SEQ ID NO: 580358 - RNA, 19 nt, Human
ugcaaugaagggggcugcc

SEQ ID NO: 580359 - RNA, 18 nt, Human
ugccuaggugaucaggag

SEQ ID NO: 580360 - RNA, 20 nt, Human
uggaagaaggggcaggccag

SEQ ID NO: 580361 - RNA, 19 nt, Human
uggaggagggugaaggcag

SEQ ID NO: 580362 - RNA, 22 nt, Human
uggcaaggagagggcaagggcc

SEQ ID NO: 580363 - RNA, 19 nt, Human
ugggggcacuggaggaggg

SEQ ID NO: 580364 - RNA, 23 nt, Human
ugggggcacuggaggagggugaa

SEQ ID NO: 580365 - RNA, 22 nt, Human
uuacaaauaagagauagaaacc

SEQ ID NO: 580366 - RNA, 25 nt, Human
uuuguugccugcucucauccccaac

SEQ ID NO: 580367 - RNA, 22 nt, Human
aagacuccuguucaaguaaagg

SEQ ID NO: 580368 - RNA, 21 nt, Human
aauaucuuggccucagauggc

SEQ ID NO: 580369 - RNA, 18 nt, Human
acaaaguagccacagacc

SEQ ID NO: 580370 - RNA, 21 nt, Human
acauggacucucucucucccc

SEQ ID NO: 580371 - RNA, 21 nt, Human
acucugaagaaaguugggggg

SEQ ID NO: 580372 - RNA, 19 nt, Human
acucuuauucuagaaagga

SEQ ID NO: 580373 - RNA, 21 nt, Human
acuguggaucugugacccugg

SEQ ID NO: 580374 - RNA, 21 nt, Human
acuuguacuuugguaaggaga

SEQ ID NO: 580375 - RNA, 23 nt, Human
agcccaaguuguucuggccacac

SEQ ID NO: 580376 - RNA, 22 nt, Human
aggaaucccccccgucaauauc

SEQ ID NO: 580377 - RNA, 19 nt, Human
aggcaaaaaaagaaucaag

SEQ ID NO: 580378 - RNA, 20 nt, Human
aggcaaaaaaagaaucaaga

SEQ ID NO: 580379 - RNA, 22 nt, Human
aguuggggggccagggcuccua

SEQ ID NO: 580380 - RNA, 23 nt, Human
aguuguucuggccacaccuucuu

SEQ ID NO: 580381 - RNA, 18 nt, Human
auccugguggggggaugg

SEQ ID NO: 580382 - RNA, 18 nt, Human
caaaaaaagaaucaagac

SEQ ID NO: 580383 - RNA, 19 nt, Human
cacaccuucuuuguggcuc

SEQ ID NO: 580384 - RNA, 19 nt, Human
cacugcgcggcucagccgc

SEQ ID NO: 580385 - RNA, 22 nt, Human
cagaccgugucugguuuguauc

SEQ ID NO: 580386 - RNA, 18 nt, Human
caggacuuuuauccuggu

SEQ ID NO: 580387 - RNA, 18 nt, Human
ccccccgucaauaucuug

SEQ ID NO: 580388 - RNA, 22 nt, Human
ccccccuaccugggugcgcccg

SEQ ID NO: 580389 - RNA, 18 nt, Human
cccuaggcccuagaggac

SEQ ID NO: 580390 - RNA, 20 nt, Human
cccugggcgcugaaaauggg

SEQ ID NO: 580391 - RNA, 19 nt, Human
ccgucgguccagcagccgc

SEQ ID NO: 580392 - RNA, 23 nt, Human
ccugugcccacuccaaccucaac

SEQ ID NO: 580393 - RNA, 20 nt, Human
cgcggcucagccgccccccu

SEQ ID NO: 580394 - RNA, 24 nt, Human
cuggugguaccaugccugugccca

SEQ ID NO: 580395 - RNA, 24 nt, Human
cuguaccagcggggaggcuggugg

SEQ ID NO: 580396 - RNA, 19 nt, Human
cuucuuuguggcucagugc

SEQ ID NO: 580397 - RNA, 27 nt, Human
gaaaaugggacccaggaaucccccccg

SEQ ID NO: 580398 - RNA, 19 nt, Human
gacuuuuauccuggugggg

SEQ ID NO: 580399 - RNA, 23 nt, Human
gcaaaaaaagaaucaagacuccu

SEQ ID NO: 580400 - RNA, 19 nt, Human
gcggcucagccgccccccu

SEQ ID NO: 580401 - RNA, 23 nt, Human
ggaaucccccccgucaauaucuu

SEQ ID NO: 580402 - RNA, 20 nt, Human
ggaugccuggcaaaagccuu

SEQ ID NO: 580403 - RNA, 18 nt, Human
ggccucagauggcucccc

SEQ ID NO: 580404 - RNA, 18 nt, Human
ggcucagugccaaugugu

SEQ ID NO: 580405 - RNA, 21 nt, Human
gggcgcugaaaaugggaccca

SEQ ID NO: 580406 - RNA, 19 nt, Human
gguaaggagauagggaagg

SEQ ID NO: 580407 - RNA, 21 nt, Human
guggcggcggcgcaguucccc

SEQ ID NO: 580408 - RNA, 22 nt, Human
uaccaggauggugucuacuggg

SEQ ID NO: 580409 - RNA, 20 nt, Human
ucagauggcuccccaagguc

SEQ ID NO: 580410 - RNA, 22 nt, Human
ucagguaacugugcccuguacc

SEQ ID NO: 580411 - RNA, 22 nt, Human
uccgcacugcgcggcucagccg

SEQ ID NO: 580412 - RNA, 24 nt, Human
ucucucaggaaggccgccaugcuc

SEQ ID NO: 580413 - RNA, 18 nt, Human
ugaggagauggaagauca

SEQ ID NO: 580414 - RNA, 28 nt, Human
ugaggagauggaagaucagggcuuguau

SEQ ID NO: 580415 - RNA, 21 nt, Human
ugccugugcccacuccaaccg

SEQ ID NO: 580416 - RNA, 25 nt, Human
ugccugugcccacuccaaccucaac

SEQ ID NO: 580417 - RNA, 23 nt, Human
ugggaaagaugugacuuguacuu

SEQ ID NO: 580418 - RNA, 21 nt, Human
ugggacccaggaauccccccc

SEQ ID NO: 580419 - RNA, 19 nt, Human
ugggaggggccaggggaug

SEQ ID NO: 580420 - RNA, 25 nt, Human
ugggaggggccaggggaugccuggc

SEQ ID NO: 580421 - RNA, 18 nt, Human
ugguaaggagauagggaa

SEQ ID NO: 580422 - RNA, 20 nt, Human
uggugagaggacauggacuc

SEQ ID NO: 580423 - RNA, 23 nt, Human
ugguggggggauggggaguccag

SEQ ID NO: 580424 - RNA, 26 nt, Human
uguaccagcggggaggcuggugguac

SEQ ID NO: 580425 - RNA, 23 nt, Human
uguucuggccacaccuucuuugu

SEQ ID NO: 580426 - RNA, 20 nt, Human
uucaaguaaagggcagaggg

SEQ ID NO: 580427 - RNA, 20 nt, Human
uuccucuguccccuaggccc

SEQ ID NO: 580428 - RNA, 21 nt, Human
uucucugaugaggcaaaaaaa

SEQ ID NO: 580429 - RNA, 19 nt, Human
uucuggugagaggacaugg

SEQ ID NO: 580430 - RNA, 19 nt, Human
uucuggugagaggacaugg

SEQ ID NO: 580431 - RNA, 22 nt, Human
uugagcucauaucuuauaauaa

SEQ ID NO: 580432 - RNA, 19 nt, Human
uuguggcucagugccaaug

SEQ ID NO: 580433 - RNA, 24 nt, Human
uuuugcugaggagauggaagauca

SEQ ID NO: 580434 - RNA, 21 nt, Human
aaauggccagcgaagcguucg

SEQ ID NO: 580435 - RNA, 20 nt, Human
acagggccagccaggcuggu

SEQ ID NO: 580436 - RNA, 20 nt, Human
agccaggcugguagcuggca

SEQ ID NO: 580437 - RNA, 21 nt, Human
aggugcccaaaaaaaaguuca

SEQ ID NO: 580438 - RNA, 25 nt, Human
auccucucaaucccgcuccuccaaa

SEQ ID NO: 580439 - RNA, 20 nt, Human
caaacuguacacauaaaaac

SEQ ID NO: 580440 - RNA, 24 nt, Human
caaucccgcuccuccaaaggagca

SEQ ID NO: 580441 - RNA, 23 nt, Human
cccaugucuugugagacuuaaaa

SEQ ID NO: 580442 - RNA, 21 nt, Human
ccgauccucucaaucccgcuc

SEQ ID NO: 580443 - RNA, 18 nt, Human
ccgcuccuccaaaggagc

SEQ ID NO: 580444 - RNA, 23 nt, Human
cuacaauggugcaggcuuccuuu

SEQ ID NO: 580445 - RNA, 18 nt, Human
cucucaaucccgcuccuc

SEQ ID NO: 580446 - RNA, 28 nt, Human
cugguagcuggcagcagucucuucaucu

SEQ ID NO: 580447 - RNA, 19 nt, Human
cuucacaaaacaacauggg

SEQ ID NO: 580448 - RNA, 24 nt, Human
gacagggccagccaggcugguagc

SEQ ID NO: 580449 - RNA, 22 nt, Human
ggaguuggggcaaugagggugg

SEQ ID NO: 580450 - RNA, 20 nt, Human
gucuggcuuugagcagagcu

SEQ ID NO: 580451 - RNA, 22 nt, Human
uacaaaaacuuuguuuuucucu

SEQ ID NO: 580452 - RNA, 24 nt, Human
uacgucuggcuuugagcagagcuc

SEQ ID NO: 580453 - RNA, 23 nt, Human
ucaggugcccaaaaaaaaguuca

SEQ ID NO: 580454 - RNA, 18 nt, Human
ucucaaucccgcuccucc

SEQ ID NO: 580455 - RNA, 20 nt, Human
ucuuguuuggucuccccacc

SEQ ID NO: 580456 - RNA, 25 nt, Human
ugacaaacuguacacauaaaaacaa

SEQ ID NO: 580457 - RNA, 19 nt, Human
ugagcagagcuccuaaaug

SEQ ID NO: 580458 - RNA, 22 nt, Human
ugaggguuccugggauucaggu

SEQ ID NO: 580459 - RNA, 23 nt, Human
ugaggguuccugggauucaggug

SEQ ID NO: 580460 - RNA, 21 nt, Human
ugcccaaaaaaaaguucaggg

SEQ ID NO: 580461 - RNA, 21 nt, Human
uggacaggacagggccagcca

SEQ ID NO: 580462 - RNA, 22 nt, Human
uggacaggacagggccagccag

SEQ ID NO: 580463 - RNA, 20 nt, Human
ugggauucaggugcccaaaa

SEQ ID NO: 580464 - RNA, 19 nt, Human
uuggggcaaugagggugga

SEQ ID NO: 580465 - RNA, 25 nt, Human
uuggucuccccaccccgauccucuc

SEQ ID NO: 580466 - RNA, 23 nt, Human
uuuguuuuucucugacaaacugu

SEQ ID NO: 580467 - RNA, 19 nt, Human
uuuuuuuuuuuuuucuugc

SEQ ID NO: 580468 - RNA, 27 nt, Human
uuuuuuuuuuuuuuuuuuuucuugggg

SEQ ID NO: 580469 - RNA, 24 nt, Human
aaccacuaaucuacuuccucuaua

SEQ ID NO: 580470 - RNA, 26 nt, Human
aagcaggcacaucuuauauggccaga

SEQ ID NO: 580471 - RNA, 22 nt, Human
aauaaccagugaagaugggggc

SEQ ID NO: 580472 - RNA, 26 nt, Human
aaucccaucgccucccaccagggggc

SEQ ID NO: 580473 - RNA, 18 nt, Human
aaugcagaugacauuucu

SEQ ID NO: 580474 - RNA, 22 nt, Human
accauacaauucaccaacguaa

SEQ ID NO: 580475 - RNA, 20 nt, Human
acgggguuucuccauguugg

SEQ ID NO: 580476 - RNA, 21 nt, Human
acgggguuucuccauguuggu

SEQ ID NO: 580477 - RNA, 24 nt, Human
acgggguuucuccauguuggugcg

SEQ ID NO: 580478 - RNA, 25 nt, Human
acucugucgcccaggcuggagugca

SEQ ID NO: 580479 - RNA, 23 nt, Human
agauccaaaccacaucaauagug

SEQ ID NO: 580480 - RNA, 21 nt, Human
aggcagcuucugcucuuuuuc

SEQ ID NO: 580481 - RNA, 18 nt, Human
aguagcugggauuacagg

SEQ ID NO: 580482 - RNA, 18 nt, Human
agugaagaugggggcuag

SEQ ID NO: 580483 - RNA, 24 nt, Human
agugauucuccugccucagccucc

SEQ ID NO: 580484 - RNA, 19 nt, Human
agugcagcggcgcaaucuc

SEQ ID NO: 580485 - RNA, 19 nt, Human
aucccaucgccucccacca

SEQ ID NO: 580486 - RNA, 19 nt, Human
auggagacuguugggugca

SEQ ID NO: 580487 - RNA, 19 nt, Human
auuacaggugcgcgccacc

SEQ ID NO: 580488 - RNA, 19 nt, Human
caacaggcagcuucugcuc

SEQ ID NO: 580489 - RNA, 25 nt, Human
caagucccuuguuuagagucggagg

SEQ ID NO: 580490 - RNA, 20 nt, Human
caagugauucuccugccuca

SEQ ID NO: 580491 - RNA, 22 nt, Human
caagugauucuccugccucagc

SEQ ID NO: 580492 - RNA, 19 nt, Human
caccacacacuuugaagca

SEQ ID NO: 580493 - RNA, 21 nt, Human
caccagggggcuuacauuuca

SEQ ID NO: 580494 - RNA, 24 nt, Human
cacucugucgcccaggcuggagug

SEQ ID NO: 580495 - RNA, 19 nt, Human
cagcuucccugucacccgg

SEQ ID NO: 580496 - RNA, 21 nt, Human
cagcuucccugucacccggug

SEQ ID NO: 580497 - RNA, 23 nt, Human
ccacacacuuugaagcaaccaga

SEQ ID NO: 580498 - RNA, 20 nt, Human
ccaccacgccuggcuaauuu

SEQ ID NO: 580499 - RNA, 19 nt, Human
ccagagcaggagggagaca

SEQ ID NO: 580500 - RNA, 19 nt, Human
ccccauaaucccaucgccu

SEQ ID NO: 580501 - RNA, 22 nt, Human
cccccgcuguacacuaacugaa

SEQ ID NO: 580502 - RNA, 21 nt, Human
ccccgcuguacacuaacugaa

SEQ ID NO: 580503 - RNA, 23 nt, Human
cccgaguagcugggauuacaggu

SEQ ID NO: 580504 - RNA, 24 nt, Human
cccgaguagcugggauuacaggug

SEQ ID NO: 580505 - RNA, 23 nt, Human
cccugguucaagugauucuccuc

SEQ ID NO: 580506 - RNA, 23 nt, Human
cccugguucaagugauucuccug

SEQ ID NO: 580507 - RNA, 20 nt, Human
ccgaagcaaccacuaaucua

SEQ ID NO: 580508 - RNA, 21 nt, Human
ccgaguagcugggauuacagg

SEQ ID NO: 580509 - RNA, 24 nt, Human
ccucccugguucaagugauucucc

SEQ ID NO: 580510 - RNA, 23 nt, Human
ccugccucagccucccgaguagc

SEQ ID NO: 580511 - RNA, 24 nt, Human
ccugccucagccucccgaguagcu

SEQ ID NO: 580512 - RNA, 22 nt, Human
ccugguucaagugauucuccug

SEQ ID NO: 580513 - RNA, 20 nt, Human
cgggcucccagaugacuccu

SEQ ID NO: 580514 - RNA, 24 nt, Human
cucacucugucgcccaggcuggag

SEQ ID NO: 580515 - RNA, 24 nt, Human
cucagccucccgaguagcugggau

SEQ ID NO: 580516 - RNA, 19 nt, Human
cucccugguucaagugauu

SEQ ID NO: 580517 - RNA, 23 nt, Human
cugccucccugguucaagugauu

SEQ ID NO: 580518 - RNA, 24 nt, Human
cugguucaagugauucuccugccu

SEQ ID NO: 580519 - RNA, 21 nt, Human
cuuugaagcaaccagauguga

SEQ ID NO: 580520 - RNA, 23 nt, Human
gagacgggguuucuccauguugg

SEQ ID NO: 580521 - RNA, 24 nt, Human
gagacgggguuucuccauguuggu

SEQ ID NO: 580522 - RNA, 21 nt, Human
gaggacucugccccauaaucc

SEQ ID NO: 580523 - RNA, 24 nt, Human
gaguagcugggauuacaggugcgc

SEQ ID NO: 580524 - RNA, 18 nt, Human
gauuacaggugcgcgcca

SEQ ID NO: 580525 - RNA, 19 nt, Human
gcccaggcuggagugcagc

SEQ ID NO: 580526 - RNA, 21 nt, Human
gccccauaaucccaucgccuc

SEQ ID NO: 580527 - RNA, 24 nt, Human
gccuggcuaauuuuuuuguauuuu

SEQ ID NO: 580528 - RNA, 21 nt, Human
gcgugagccacugugcccggc

SEQ ID NO: 580529 - RNA, 25 nt, Human
gcuggagugcagcggcgcaaucucc

SEQ ID NO: 580530 - RNA, 26 nt, Human
ggcccuuggucuugacauggagacug

SEQ ID NO: 580531 - RNA, 21 nt, Human
gguaguaaauaccgcagcuuc

SEQ ID NO: 580532 - RNA, 21 nt, Human
gguucaagugauucuccugcc

SEQ ID NO: 580533 - RNA, 23 nt, Human
guagagacgggguuucuccaugu

SEQ ID NO: 580534 - RNA, 24 nt, Human
gugauucuccugccucagccuccc

SEQ ID NO: 580535 - RNA, 24 nt, Human
gugcuuucaugcuuuugauuaucu

SEQ ID NO: 580536 - RNA, 25 nt, Human
guugggugcagccgugcucugcaag

SEQ ID NO: 580537 - RNA, 23 nt, Human
uaaauaccgcagcuucccuguca

SEQ ID NO: 580538 - RNA, 22 nt, Human
uacaggugcgcgccaccacgcc

SEQ ID NO: 580539 - RNA, 21 nt, Human
uagaaggcgaaggagaagcag

SEQ ID NO: 580540 - RNA, 24 nt, Human
uaggacauuuuuaucacugcaaaa

SEQ ID NO: 580541 - RNA, 24 nt, Human
uaguagagacgggguuucuccaug

SEQ ID NO: 580542 - RNA, 21 nt, Human
uauggccagagcaggagggag

SEQ ID NO: 580543 - RNA, 19 nt, Human
ucaagugauucuccugccu

SEQ ID NO: 580544 - RNA, 24 nt, Human
ucacucugucgcccaggcuggagu

SEQ ID NO: 580545 - RNA, 18 nt, Human
ucacugcaaaagaaagac

SEQ ID NO: 580546 - RNA, 19 nt, Human
ucacugcaaacucugccuc

SEQ ID NO: 580547 - RNA, 24 nt, Human
ucacugcaaacucugccucccugg

SEQ ID NO: 580548 - RNA, 20 nt, Human
ucagccucccgaguagcugg

SEQ ID NO: 580549 - RNA, 18 nt, Human
uccacaggcaacaggcag

SEQ ID NO: 580550 - RNA, 24 nt, Human
uccacaggcaacaggcagcuucug

SEQ ID NO: 580551 - RNA, 23 nt, Human
ucccaaaugugucucgugaacca

SEQ ID NO: 580552 - RNA, 25 nt, Human
ucccaucgccucccaccagggggcu

SEQ ID NO: 580553 - RNA, 21 nt, Human
ucccgaagcaaccacuaaucu

SEQ ID NO: 580554 - RNA, 23 nt, Human
ucccgaguagcugggauuacagg

SEQ ID NO: 580555 - RNA, 24 nt, Human
ucccgaguagcugggauuacaggu

SEQ ID NO: 580556 - RNA, 21 nt, Human
ucccugguucaagugauucuc

SEQ ID NO: 580557 - RNA, 24 nt, Human
ucccugguucaagugauucuccug

SEQ ID NO: 580558 - RNA, 23 nt, Human
uccuuaguggacgugagcccccg

SEQ ID NO: 580559 - RNA, 18 nt, Human
ucgcccaggcuggagugc

SEQ ID NO: 580560 - RNA, 22 nt, Human
ucggaggaacccaacuaggaca

SEQ ID NO: 580561 - RNA, 23 nt, Human
ucucacucugucgcccaggcugg

SEQ ID NO: 580562 - RNA, 24 nt, Human
ucucacucugucgcccaggcugga

SEQ ID NO: 580563 - RNA, 26 nt, Human
ucucacucugucgcccaggcuggagu

SEQ ID NO: 580564 - RNA, 27 nt, Human
ucucacucugucgcccaggcuggagug

SEQ ID NO: 580565 - RNA, 24 nt, Human
ucuccugccucagccucccgagua

SEQ ID NO: 580566 - RNA, 24 nt, Human
ucugucgcccaggcuggagugcag

SEQ ID NO: 580567 - RNA, 21 nt, Human
ugaacuauaauuuacauacca

SEQ ID NO: 580568 - RNA, 22 nt, Human
ugaagcaaccagaugugaugag

SEQ ID NO: 580569 - RNA, 23 nt, Human
ugacauggagacuguugggugca

SEQ ID NO: 580570 - RNA, 20 nt, Human
ugauucuccugccucagccu

SEQ ID NO: 580571 - RNA, 22 nt, Human
ugccccauaaucccaucgccuc

SEQ ID NO: 580572 - RNA, 24 nt, Human
ugccucagccucccgaguagcugg

SEQ ID NO: 580573 - RNA, 21 nt, Human
ugcuaaaccguuugugaggac

SEQ ID NO: 580574 - RNA, 19 nt, Human
uggagugcagcggcgcaau

SEQ ID NO: 580575 - RNA, 23 nt, Human
ugggacaguuccacaggcaacag

SEQ ID NO: 580576 - RNA, 18 nt, Human
ugggauuacaggugcgcg

SEQ ID NO: 580577 - RNA, 22 nt, Human
ugggauuacaggugcgcgccac

SEQ ID NO: 580578 - RNA, 24 nt, Human
ugggauuacaggugcgcgccacca

SEQ ID NO: 580579 - RNA, 20 nt, Human
uggucuuaagcauauucaga

SEQ ID NO: 580580 - RNA, 23 nt, Human
ugguguuuccaggaggcccuugg

SEQ ID NO: 580581 - RNA, 21 nt, Human
uguauuuuuaguagagacggg

SEQ ID NO: 580582 - RNA, 20 nt, Human
ugucucgugaaccaucccuu

SEQ ID NO: 580583 - RNA, 18 nt, Human
ugugaggacucugcccca

SEQ ID NO: 580584 - RNA, 19 nt, Human
uguugggugcagccgugcu

SEQ ID NO: 580585 - RNA, 18 nt, Human
uuaguagagacgggguuu

SEQ ID NO: 580586 - RNA, 24 nt, Human
uuaguagagacgggguuucuccau

SEQ ID NO: 580587 - RNA, 19 nt, Human
uuaguggacgugagccccc

SEQ ID NO: 580588 - RNA, 21 nt, Human
uucaagugauucuccugccuc

SEQ ID NO: 580589 - RNA, 23 nt, Human
uucaagugauucuccugccucag

SEQ ID NO: 580590 - RNA, 24 nt, Human
uucaagugauucuccugccucagc

SEQ ID NO: 580591 - RNA, 19 nt, Human
uuggcucacgguccaguag

SEQ ID NO: 580592 - RNA, 19 nt, Human
uuggucuugacauggagac

SEQ ID NO: 580593 - RNA, 23 nt, Human
uuguauuuuuaguagagacgggg

SEQ ID NO: 580594 - RNA, 22 nt, Human
uuuaucacugcaaaagaaagac

SEQ ID NO: 580595 - RNA, 22 nt, Human
uuuuuaguagagacgggguuuc

SEQ ID NO: 580596 - RNA, 21 nt, Human
uuuuuguauuuuuaguagaga

SEQ ID NO: 580597 - RNA, 21 nt, Human
uuuuuuguauuuuuaguagag

SEQ ID NO: 580598 - RNA, 24 nt, Human
uuuuuuguauuuuuaguagagacg

SEQ ID NO: 580599 - RNA, 23 nt, Human
aaagacagccuucaggaaccaca

SEQ ID NO: 580600 - RNA, 21 nt, Human
aagaacauaccauguguauaa

SEQ ID NO: 580601 - RNA, 23 nt, Human
aauucagaauacgcuuuuuacac

SEQ ID NO: 580602 - RNA, 24 nt, Human
aguuacaaagacagccuucaggaa

SEQ ID NO: 580603 - RNA, 18 nt, Human
caaaaaguuacaaagaca

SEQ ID NO: 580604 - RNA, 23 nt, Human
cacaaagaacuacaaaaaguuac

SEQ ID NO: 580605 - RNA, 20 nt, Human
cagaauacgcuuuuuacaca

SEQ ID NO: 580606 - RNA, 24 nt, Human
cgagcagccuucacgcaaagccuc

SEQ ID NO: 580607 - RNA, 20 nt, Human
cucacaaagacuccagaacc

SEQ ID NO: 580608 - RNA, 21 nt, Human
cucacaaagacuccagaacca

SEQ ID NO: 580609 - RNA, 20 nt, Human
cuccagaaccagccgagucc

SEQ ID NO: 580610 - RNA, 21 nt, Human
gcaaagccuccuucaaagaag

SEQ ID NO: 580611 - RNA, 20 nt, Human
uaaaucaaauuaaauucugc

SEQ ID NO: 580612 - RNA, 24 nt, Human
uaaauucugcuuuuaaaaaggugc

SEQ ID NO: 580613 - RNA, 24 nt, Human
uaauauauaaaaauagauguaucc

SEQ ID NO: 580614 - RNA, 22 nt, Human
uacaaaaaguuacaaagacagc

SEQ ID NO: 580615 - RNA, 22 nt, Human
ucaaagaagucucacaaagacu

SEQ ID NO: 580616 - RNA, 21 nt, Human
ucacaaagacuccagaaccag

SEQ ID NO: 580617 - RNA, 22 nt, Human
ucacaaagacuccagaaccagc

SEQ ID NO: 580618 - RNA, 23 nt, Human
ugaagaacauaccauguguauaa

SEQ ID NO: 580619 - RNA, 20 nt, Human
aacucgcucauuuccucccu

SEQ ID NO: 580620 - RNA, 21 nt, Human
aacucgcucauuuccucccuc

SEQ ID NO: 580621 - RNA, 21 nt, Human
acaaggcaagcggcucagaac

SEQ ID NO: 580622 - RNA, 18 nt, Human
accagcuguaacaccucc

SEQ ID NO: 580623 - RNA, 24 nt, Human
acccaguccacaccacagcacgcu

SEQ ID NO: 580624 - RNA, 24 nt, Human
accccauucccaggccacugccca

SEQ ID NO: 580625 - RNA, 18 nt, Human
accguauucugauugggu

SEQ ID NO: 580626 - RNA, 24 nt, Human
acgggccccggggccgggccaucc

SEQ ID NO: 580627 - RNA, 21 nt, Human
acuuguaaacacugguuccuu

SEQ ID NO: 580628 - RNA, 21 nt, Human
acuuguaaacacugguuccuu

SEQ ID NO: 580629 - RNA, 22 nt, Human
agaaggaagggguucaacucuc

SEQ ID NO: 580630 - RNA, 18 nt, Human
agccccaccuggggagga

SEQ ID NO: 580631 - RNA, 21 nt, Human
aggagguggggccuuuggagc

SEQ ID NO: 580632 - RNA, 20 nt, Human
aggccacugcccagcagccc

SEQ ID NO: 580633 - RNA, 18 nt, Human
aggggcgccagacacagc

SEQ ID NO: 580634 - RNA, 20 nt, Human
augguagcagaggagcuggc

SEQ ID NO: 580635 - RNA, 21 nt, Human
caaaugcccaccagaagggcc

SEQ ID NO: 580636 - RNA, 19 nt, Human
cacccaguccacaccacag

SEQ ID NO: 580637 - RNA, 19 nt, Human
cacuauauagaguaaaaac

SEQ ID NO: 580638 - RNA, 20 nt, Human
cagacaggcccuggaggcag

SEQ ID NO: 580639 - RNA, 23 nt, Human
cagccccaccuggggaggaaggc

SEQ ID NO: 580640 - RNA, 21 nt, Human
cagccccuggggaucugcugg

SEQ ID NO: 580641 - RNA, 18 nt, Human
cagcuccuuggcucugcu

SEQ ID NO: 580642 - RNA, 23 nt, Human
caggcccuggaggcagaaggaag

SEQ ID NO: 580643 - RNA, 22 nt, Human
cagggccagaggagccacgcag

SEQ ID NO: 580644 - RNA, 18 nt, Human
cagggugaggcugccugc

SEQ ID NO: 580645 - RNA, 23 nt, Human
ccaaaggaaggccggucuguggg

SEQ ID NO: 580646 - RNA, 19 nt, Human
ccaggccacacuuuccucc

SEQ ID NO: 580647 - RNA, 18 nt, Human
cccagccccccaggacug

SEQ ID NO: 580648 - RNA, 22 nt, Human
cccaguccacaccacagcacgc

SEQ ID NO: 580649 - RNA, 22 nt, Human
cccccacucccccugcaaauuc

SEQ ID NO: 580650 - RNA, 20 nt, Human
cccucgggaaggacaaaaac

SEQ ID NO: 580651 - RNA, 22 nt, Human
cccuggaggcagaaggaagggg

SEQ ID NO: 580652 - RNA, 19 nt, Human
cccuggggaucugcuggug

SEQ ID NO: 580653 - RNA, 19 nt, Human
cgagaaggcaccaucuaug

SEQ ID NO: 580654 - RNA, 23 nt, Human
cgcuucagaggggcccuauucau

SEQ ID NO: 580655 - RNA, 22 nt, Human
cucacaauccaccccauuccca

SEQ ID NO: 580656 - RNA, 20 nt, Human
cucacaauccaccccauucu

SEQ ID NO: 580657 - RNA, 23 nt, Human
cuccaaaggaaggccggucugug

SEQ ID NO: 580658 - RNA, 24 nt, Human
cuccaaaggaaggccggucugugg

SEQ ID NO: 580659 - RNA, 25 nt, Human
cuccaaaggaaggccggucuguggg

SEQ ID NO: 580660 - RNA, 22 nt, Human
cuccagguggcugugguagggc

SEQ ID NO: 580661 - RNA, 23 nt, Human
cucgggaaggacaaaaacucaga

SEQ ID NO: 580662 - RNA, 24 nt, Human
cucuaagagaagcaugguucccuu

SEQ ID NO: 580663 - RNA, 21 nt, Human
cugcaagccacccugagcgca

SEQ ID NO: 580664 - RNA, 21 nt, Human
cuucuaccauugaggauacag

SEQ ID NO: 580665 - RNA, 22 nt, Human
cuucucaaccaccguauucuga

SEQ ID NO: 580666 - RNA, 19 nt, Human
cuugcagagaucuaggggc

SEQ ID NO: 580667 - RNA, 24 nt, Human
cuuggcucugcuuucagaaggcug

SEQ ID NO: 580668 - RNA, 24 nt, Human
gaaauuugugugugucccccacuc

SEQ ID NO: 580669 - RNA, 18 nt, Human
gaagggccagggacugca

SEQ ID NO: 580670 - RNA, 19 nt, Human
gagaagagagaagcagcuc

SEQ ID NO: 580671 - RNA, 24 nt, Human
gagagaagcagcuccuucucccgg

SEQ ID NO: 580672 - RNA, 18 nt, Human
gagcugauugggucaugg

SEQ ID NO: 580673 - RNA, 20 nt, Human
gaggauguuaaugacccugc

SEQ ID NO: 580674 - RNA, 20 nt, Human
gaggcagacaggcccuggag

SEQ ID NO: 580675 - RNA, 20 nt, Human
gcagcuccuuggcucugcuu

SEQ ID NO: 580676 - RNA, 24 nt, Human
gcccagcagccccuggggaucugc

SEQ ID NO: 580677 - RNA, 25 nt, Human
gcccuggaggcagaaggaagggguu

SEQ ID NO: 580678 - RNA, 20 nt, Human
gcuuguuugugcuucuacca

SEQ ID NO: 580679 - RNA, 18 nt, Human
ggaaggacaaaaacucag

SEQ ID NO: 580680 - RNA, 18 nt, Human
ggacaggugccacucagg

SEQ ID NO: 580681 - RNA, 19 nt, Human
ggauacagcgagaaggcac

SEQ ID NO: 580682 - RNA, 21 nt, Human
gggagaagagagaagcagcuc

SEQ ID NO: 580683 - RNA, 20 nt, Human
gggagguagaacugggagaa

SEQ ID NO: 580684 - RNA, 22 nt, Human
ggggaucugcuggugucagagg

SEQ ID NO: 580685 - RNA, 18 nt, Human
gugccacucagggccaga

SEQ ID NO: 580686 - RNA, 21 nt, Human
uaaacacugguuccuucucaa

SEQ ID NO: 580687 - RNA, 22 nt, Human
uaagccacccggccuacggcaa

SEQ ID NO: 580688 - RNA, 20 nt, Human
uaccugggccaggugcuggg

SEQ ID NO: 580689 - RNA, 22 nt, Human
uaccugggccaggugcugggag

SEQ ID NO: 580690 - RNA, 21 nt, Human
uacggcauuuugauauaggag

SEQ ID NO: 580691 - RNA, 23 nt, Human
ucagaggggcccuauucauggua

SEQ ID NO: 580692 - RNA, 20 nt, Human
ucagggccagaggagccacg

SEQ ID NO: 580693 - RNA, 21 nt, Human
ucagggccagaggagccacgc

SEQ ID NO: 580694 - RNA, 25 nt, Human
uccacaccacagcacgcuucugggg

SEQ ID NO: 580695 - RNA, 21 nt, Human
uccaccccauucccaggccac

SEQ ID NO: 580696 - RNA, 23 nt, Human
uccagguggcugugguagggccg

SEQ ID NO: 580697 - RNA, 21 nt, Human
ucuauaaguagcacccagucc

SEQ ID NO: 580698 - RNA, 18 nt, Human
ucucaaccaccguauucu

SEQ ID NO: 580699 - RNA, 20 nt, Human
ucugcuggugucagagggaa

SEQ ID NO: 580700 - RNA, 22 nt, Human
ucugugggcccagggugaggcu

SEQ ID NO: 580701 - RNA, 18 nt, Human
ucuugggcgucccagccc

SEQ ID NO: 580702 - RNA, 22 nt, Human
ugaagggugguauggccccgaa

SEQ ID NO: 580703 - RNA, 26 nt, Human
ugaaucacaaacaacucagggcauca

SEQ ID NO: 580704 - RNA, 22 nt, Human
ugagcaauacguuucuguuguu

SEQ ID NO: 580705 - RNA, 23 nt, Human
ugaggcugccugcccaccgcaga

SEQ ID NO: 580706 - RNA, 22 nt, Human
ugaggggacuggagagggaggg

SEQ ID NO: 580707 - RNA, 23 nt, Human
ugauauuacuuguaaacacuggu

SEQ ID NO: 580708 - RNA, 24 nt, Human
ugaucuugggcgucccagcccccc

SEQ ID NO: 580709 - RNA, 21 nt, Human
ugccugucccuguccucagag

SEQ ID NO: 580710 - RNA, 22 nt, Human
ugcuuguuugugcuucuaccau

SEQ ID NO: 580711 - RNA, 18 nt, Human
uggagagggaggggggag

SEQ ID NO: 580712 - RNA, 24 nt, Human
uggagcugauugggucaugggggc

SEQ ID NO: 580713 - RNA, 21 nt, Human
uggaggcagacaggcccugga

SEQ ID NO: 580714 - RNA, 19 nt, Human
ugggagaagagagaagcag

SEQ ID NO: 580715 - RNA, 20 nt, Human
ugggguccaggagaccgccu

SEQ ID NO: 580716 - RNA, 20 nt, Human
ugguagcagaggagcuggaa

SEQ ID NO: 580717 - RNA, 23 nt, Human
ugguagcagaggagcuggccucg

SEQ ID NO: 580718 - RNA, 23 nt, Human
uguauagauggugagcacuuucu

SEQ ID NO: 580719 - RNA, 19 nt, Human
ugucccuucaagguuguug

SEQ ID NO: 580720 - RNA, 23 nt, Human
ugugucccccacucccccugcaa

SEQ ID NO: 580721 - RNA, 20 nt, Human
ugugugugucccccacuccc

SEQ ID NO: 580722 - RNA, 21 nt, Human
uguuaccugggccaggugcug

SEQ ID NO: 580723 - RNA, 21 nt, Human
uuaaccucuaagagaagcaug

SEQ ID NO: 580724 - RNA, 22 nt, Human
uuaaugacccugcuuaaccucu

SEQ ID NO: 580725 - RNA, 19 nt, Human
uucccaggccacugcccag

SEQ ID NO: 580726 - RNA, 18 nt, Human
uuuguaagccacccggcc

SEQ ID NO: 580727 - RNA, 21 nt, Human
uuuguaagccacccggccuac

SEQ ID NO: 580728 - RNA, 23 nt, Human
uuuuuuuuuuuuuuuucuuaugg

SEQ ID NO: 580729 - RNA, 21 nt, Human
aaaaaaaaaaaaaggggcucu

SEQ ID NO: 580730 - RNA, 20 nt, Human
acacaagaggcuccccagca

SEQ ID NO: 580731 - RNA, 18 nt, Human
acgcgggccuaggcugga

SEQ ID NO: 580732 - RNA, 19 nt, Human
cagaaagggucuuucggca

SEQ ID NO: 580733 - RNA, 22 nt, Human
caguggauuucucaacaagucu

SEQ ID NO: 580734 - RNA, 19 nt, Human
cauuagaguacagaacagg

SEQ ID NO: 580735 - RNA, 19 nt, Human
ccccggcgccgggaauccc

SEQ ID NO: 580736 - RNA, 21 nt, Human
cccggcgccgggaauccccuc

SEQ ID NO: 580737 - RNA, 21 nt, Human
ccggcgccgggaauccccucc

SEQ ID NO: 580738 - RNA, 18 nt, Human
ccggcguccggauuccgu

SEQ ID NO: 580739 - RNA, 21 nt, Human
ccucuggcacugagcuccacu

SEQ ID NO: 580740 - RNA, 19 nt, Human
cggcaaaaaaaaaaaaagg

SEQ ID NO: 580741 - RNA, 20 nt, Human
cuccucuggcacugagcucc

SEQ ID NO: 580742 - RNA, 18 nt, Human
gcuggacacaagaggcuc

SEQ ID NO: 580743 - RNA, 19 nt, Human
uacuauauagccauuuucc

SEQ ID NO: 580744 - RNA, 20 nt, Human
ucacuuuccaagaagacgau

SEQ ID NO: 580745 - RNA, 22 nt, Human
ucuuucggcaaaaaaaaaaaaa

SEQ ID NO: 580746 - RNA, 20 nt, Human
uggcuagugaguaauacugc

SEQ ID NO: 580747 - RNA, 28 nt, Human
uucaacagugauacacaauauucuuccc

SEQ ID NO: 580748 - RNA, 18 nt, Human
uucacuuuccaagaagac

SEQ ID NO: 580749 - RNA, 19 nt, Human
aaaaaaaaucaaggacaga

SEQ ID NO: 580750 - RNA, 28 nt, Human
aaaaaaggaaauacuuuaaugaaaaaaa

SEQ ID NO: 580751 - RNA, 27 nt, Human
aaaaaggaaauacuuuaaugaaaaaaa

SEQ ID NO: 580752 - RNA, 22 nt, Human
aaaacaaaaucagcaaaggaaa

SEQ ID NO: 580753 - RNA, 18 nt, Human
aaagguagucucugccug

SEQ ID NO: 580754 - RNA, 19 nt, Human
aaagguagucucugccugg

SEQ ID NO: 580755 - RNA, 19 nt, Human
aaguucccagaugccaauc

SEQ ID NO: 580756 - RNA, 20 nt, Human
acagugaaaggauacaaaac

SEQ ID NO: 580757 - RNA, 20 nt, Human
agaacgucuucugauuuagg

SEQ ID NO: 580758 - RNA, 21 nt, Human
agaaggaaagcagguguucag

SEQ ID NO: 580759 - RNA, 22 nt, Human
agacacauggggugaagucagg

SEQ ID NO: 580760 - RNA, 22 nt, Human
agccaaauuuuagaaauagcuc

SEQ ID NO: 580761 - RNA, 25 nt, Human
aggaaaaaagacacauggggugaag

SEQ ID NO: 580762 - RNA, 21 nt, Human
caagggccaaccuuguaaagc

SEQ ID NO: 580763 - RNA, 23 nt, Human
cacagcaauuuuaucucaacauu

SEQ ID NO: 580764 - RNA, 19 nt, Human
cagaugccaaucaagggcc

SEQ ID NO: 580765 - RNA, 22 nt, Human
cagcugguccuucuucacaauu

SEQ ID NO: 580766 - RNA, 23 nt, Human
caggaucuuucauuucuuauccc

SEQ ID NO: 580767 - RNA, 21 nt, Human
cauaccaacuaaacaugugau

SEQ ID NO: 580768 - RNA, 21 nt, Human
ccaagaauccuccgccagugg

SEQ ID NO: 580769 - RNA, 22 nt, Human
cccccugaacuccaaguuccca

SEQ ID NO: 580770 - RNA, 19 nt, Human
cccugaacuccaaguuccc

SEQ ID NO: 580771 - RNA, 20 nt, Human
cgucuucugauuuagguggc

SEQ ID NO: 580772 - RNA, 25 nt, Human
cucuuuaauuuuaccaaucagaaua

SEQ ID NO: 580773 - RNA, 21 nt, Human
cugggguuuuuacugggagcu

SEQ ID NO: 580774 - RNA, 18 nt, Human
gaaaaaaaaucaaggaca

SEQ ID NO: 580775 - RNA, 21 nt, Human
gaaaaaaaaucaaggacagaa

SEQ ID NO: 580776 - RNA, 23 nt, Human
gaaaaaaaaucaaggacagaagg

SEQ ID NO: 580777 - RNA, 21 nt, Human
gaaaagccuaaaguaucagga

SEQ ID NO: 580778 - RNA, 21 nt, Human
gaaauuucuccaucauuucaa

SEQ ID NO: 580779 - RNA, 18 nt, Human
gaaggaaagcagguguuc

SEQ ID NO: 580780 - RNA, 25 nt, Human
gagaaaauuuucuaaacagcagcug

SEQ ID NO: 580781 - RNA, 19 nt, Human
ggaaagcagguguucagga

SEQ ID NO: 580782 - RNA, 25 nt, Human
ggaaagcagguguucaggagaaacu

SEQ ID NO: 580783 - RNA, 21 nt, Human
gugaaaggauacaaaacaaaa

SEQ ID NO: 580784 - RNA, 18 nt, Human
gugaagucaggggaaacu

SEQ ID NO: 580785 - RNA, 20 nt, Human
guuagagacugagugccugg

SEQ ID NO: 580786 - RNA, 18 nt, Human
uaacagcacuugugaaac

SEQ ID NO: 580787 - RNA, 22 nt, Human
uaagucuuugacacaugcucau

SEQ ID NO: 580788 - RNA, 20 nt, Human
uacaaaacaaaaucagcaag

SEQ ID NO: 580789 - RNA, 18 nt, Human
uacaaaauagaggaaagg

SEQ ID NO: 580790 - RNA, 23 nt, Human
uacauuaguuuacauaccaacua

SEQ ID NO: 580791 - RNA, 20 nt, Human
uacuuuauacauuauauaaa

SEQ ID NO: 580792 - RNA, 18 nt, Human
uauacacauguauauaua

SEQ ID NO: 580793 - RNA, 19 nt, Human
uauacacauguauauauau

SEQ ID NO: 580794 - RNA, 19 nt, Human
uauacacauguauauauau

SEQ ID NO: 580795 - RNA, 20 nt, Human
uauacacauguauauauaug

SEQ ID NO: 580796 - RNA, 18 nt, Human
uauauuguuuuacaguuu

SEQ ID NO: 580797 - RNA, 23 nt, Human
ucaaggcucaaucuacaccucac

SEQ ID NO: 580798 - RNA, 21 nt, Human
ucaaugcccauaaauacucag

SEQ ID NO: 580799 - RNA, 22 nt, Human
ucaaugcccauaaauacucagu

SEQ ID NO: 580800 - RNA, 19 nt, Human
ucagcaaaggaaaaaagac

SEQ ID NO: 580801 - RNA, 19 nt, Human
ucuaaacagcagcuggucc

SEQ ID NO: 580802 - RNA, 23 nt, Human
ucugucuauaauaaaaaacaaaa

SEQ ID NO: 580803 - RNA, 23 nt, Human
ugaaacacugucaaccagaaaag

SEQ ID NO: 580804 - RNA, 23 nt, Human
ugaaaggauacaaaacaaaauca

SEQ ID NO: 580805 - RNA, 18 nt, Human
ugaauuaaaaaaaggaaa

SEQ ID NO: 580806 - RNA, 25 nt, Human
ugagugccugggguuuuuacuggga

SEQ ID NO: 580807 - RNA, 23 nt, Human
ugccugggguuuuuacugggagc

SEQ ID NO: 580808 - RNA, 22 nt, Human
uggcaaucacuugccuaguucu

SEQ ID NO: 580809 - RNA, 19 nt, Human
uggggugaagucaggggaa

SEQ ID NO: 580810 - RNA, 22 nt, Human
uggggugaagucaggggaaacu

SEQ ID NO: 580811 - RNA, 23 nt, Human
ugugaacuuuauuaugcuucuga

SEQ ID NO: 580812 - RNA, 25 nt, Human
uuaaaaauacuacaucauugcuuua

SEQ ID NO: 580813 - RNA, 26 nt, Human
uuagagacugagugccugggguuuuu

SEQ ID NO: 580814 - RNA, 20 nt, Human
uuuacaaaauagaggaaagg

SEQ ID NO: 580815 - RNA, 23 nt, Human
uuucauuucuuaucccucuucca

SEQ ID NO: 580816 - RNA, 19 nt, Human
aaaaaaacaaaaacagucc

SEQ ID NO: 580817 - RNA, 20 nt, Human
aaaaaaacaaaaacagucca

SEQ ID NO: 580818 - RNA, 24 nt, Human
aaaaaaacaaaaacaguccagucg

SEQ ID NO: 580819 - RNA, 18 nt, Human
aaaaaaacaccagggaau

SEQ ID NO: 580820 - RNA, 22 nt, Human
aaaaaacaaaaacaguccaguc

SEQ ID NO: 580821 - RNA, 24 nt, Human
aaaaagaaaaggagguacagaaag

SEQ ID NO: 580822 - RNA, 19 nt, Human
aaaaauaagagugggaggg

SEQ ID NO: 580823 - RNA, 22 nt, Human
aaacagcugacgccuggauuuc

SEQ ID NO: 580824 - RNA, 19 nt, Human
aaacuguaccaucuccaac

SEQ ID NO: 580825 - RNA, 18 nt, Human
aaagaaaaagaaaaggag

SEQ ID NO: 580826 - RNA, 18 nt, Human
aaagaagaggaggggcug

SEQ ID NO: 580827 - RNA, 19 nt, Human
aacaaagaaaaagaaaagg

SEQ ID NO: 580828 - RNA, 20 nt, Human
aacaaagaaaaagaaaagga

SEQ ID NO: 580829 - RNA, 21 nt, Human
aacuuauuaaccccucaccuc

SEQ ID NO: 580830 - RNA, 19 nt, Human
aagaacacaggggaaugga

SEQ ID NO: 580831 - RNA, 21 nt, Human
aagaggaggggcuguuuuccc

SEQ ID NO: 580832 - RNA, 22 nt, Human
aagauagcggggcugcugcaaa

SEQ ID NO: 580833 - RNA, 21 nt, Human
aagcccccagcccugggccag

SEQ ID NO: 580834 - RNA, 21 nt, Human
aaggaggccaguccaagggac

SEQ ID NO: 580835 - RNA, 20 nt, Human
aaggccauccagggcccagg

SEQ ID NO: 580836 - RNA, 23 nt, Human
aauccuccccucccugucaacac

SEQ ID NO: 580837 - RNA, 19 nt, Human
aaugacgacgacagggaga

SEQ ID NO: 580838 - RNA, 23 nt, Human
acaaacccagcgcuggaggccca

SEQ ID NO: 580839 - RNA, 30 nt, Human
acaaagaaaaagaaaaggagguacagaaaa

SEQ ID NO: 580840 - RNA, 24 nt, Human
accaaaaaaacaaaaacaguccag

SEQ ID NO: 580841 - RNA, 22 nt, Human
accccauuccaccucacccccu

SEQ ID NO: 580842 - RNA, 29 nt, Human
accccauuccaccucacccccuccccagg

SEQ ID NO: 580843 - RNA, 28 nt, Human
acccucaccccucagaucccuucuccac

SEQ ID NO: 580844 - RNA, 19 nt, Human
agaagaacacaggggaaug

SEQ ID NO: 580845 - RNA, 20 nt, Human
agagcucaucaacaaagaaa

SEQ ID NO: 580846 - RNA, 20 nt, Human
agcaauugguagaaaaauaa

SEQ ID NO: 580847 - RNA, 20 nt, Human
agccagugugggaucggccc

SEQ ID NO: 580848 - RNA, 21 nt, Human
agccagugugggaucggcccc

SEQ ID NO: 580849 - RNA, 19 nt, Human
agcccccagcccugggcca

SEQ ID NO: 580850 - RNA, 22 nt, Human
aggaaggaaaggggugcuguga

SEQ ID NO: 580851 - RNA, 23 nt, Human
aggaggugggaggagaggaagga

SEQ ID NO: 580852 - RNA, 20 nt, Human
aggaugucgguccagccccg

SEQ ID NO: 580853 - RNA, 22 nt, Human
aggauuuacccccaagccccca

SEQ ID NO: 580854 - RNA, 23 nt, Human
aggccaaggccauccagggccca

SEQ ID NO: 580855 - RNA, 21 nt, Human
aggccagaacggggugggaga

SEQ ID NO: 580856 - RNA, 23 nt, Human
aggccagaacggggugggagagu

SEQ ID NO: 580857 - RNA, 20 nt, Human
aggccagggggaggccaggu

SEQ ID NO: 580858 - RNA, 19 nt, Human
aggcccagaggccaggggg

SEQ ID NO: 580859 - RNA, 22 nt, Human
aggcccuccugccuuuggaugg

SEQ ID NO: 580860 - RNA, 20 nt, Human
aggcgugaggaggggggccg

SEQ ID NO: 580861 - RNA, 22 nt, Human
agggaggaggugggaggagagg

SEQ ID NO: 580862 - RNA, 22 nt, Human
agggcccagguuuggucuuggu

SEQ ID NO: 580863 - RNA, 21 nt, Human
agggggcggggacagggaagc

SEQ ID NO: 580864 - RNA, 21 nt, Human
agguagccagugugggaucgg

SEQ ID NO: 580865 - RNA, 18 nt, Human
auaggacagcaggagcca

SEQ ID NO: 580866 - RNA, 20 nt, Human
augcuggcauugauaaggcg

SEQ ID NO: 580867 - RNA, 22 nt, Human
auuccaccucacccccucccca

SEQ ID NO: 580868 - RNA, 22 nt, Human
caaacccagcgcuggaggccca

SEQ ID NO: 580869 - RNA, 21 nt, Human
caagcccccagcccugggcca

SEQ ID NO: 580870 - RNA, 18 nt, Human
caagcuccucucucucuc

SEQ ID NO: 580871 - RNA, 21 nt, Human
cacaaguccauguucccccac

SEQ ID NO: 580872 - RNA, 23 nt, Human
cacaauccuccccucccugucaa

SEQ ID NO: 580873 - RNA, 21 nt, Human
caccccauuccaccucacccc

SEQ ID NO: 580874 - RNA, 20 nt, Human
cacccucaccccucagaucc

SEQ ID NO: 580875 - RNA, 18 nt, Human
caccgcaucaugaacugg

SEQ ID NO: 580876 - RNA, 19 nt, Human
cacggcgaggcccuccugc

SEQ ID NO: 580877 - RNA, 19 nt, Human
cagagcccucugcagauuc

SEQ ID NO: 580878 - RNA, 23 nt, Human
cagagcucaucaacaaagaaaaa

SEQ ID NO: 580879 - RNA, 21 nt, Human
cagcccugggccagcagcaac

SEQ ID NO: 580880 - RNA, 21 nt, Human
caggagccagauggucuccag

SEQ ID NO: 580881 - RNA, 19 nt, Human
caggaugucgguccagccc

SEQ ID NO: 580882 - RNA, 23 nt, Human
caggcccccaggcaugaguggag

SEQ ID NO: 580883 - RNA, 23 nt, Human
cagggaagcaacccaagcuccuc

SEQ ID NO: 580884 - RNA, 22 nt, Human
cagggcccagguuuggucuugg

SEQ ID NO: 580885 - RNA, 21 nt, Human
cagggcuguguagccagcaac

SEQ ID NO: 580886 - RNA, 24 nt, Human
caucaacaaagaaaaagaaaagga

SEQ ID NO: 580887 - RNA, 23 nt, Human
caucuucacugucuuucuggagg

SEQ ID NO: 580888 - RNA, 19 nt, Human
ccaagcuccucucucucuc

SEQ ID NO: 580889 - RNA, 23 nt, Human
ccaagcuccucucucucucucac

SEQ ID NO: 580890 - RNA, 18 nt, Human
ccaccucccaccaccccc

SEQ ID NO: 580891 - RNA, 24 nt, Human
ccaccucccaccacccccgggacc

SEQ ID NO: 580892 - RNA, 23 nt, Human
ccagagcccucugcagauuccca

SEQ ID NO: 580893 - RNA, 25 nt, Human
ccagagcccucugcagauucccaag

SEQ ID NO: 580894 - RNA, 21 nt, Human
ccagcgcuggaggcccagagg

SEQ ID NO: 580895 - RNA, 19 nt, Human
ccaucagcaaccacgauaa

SEQ ID NO: 580896 - RNA, 19 nt, Human
cccaccacccccgggaccu

SEQ ID NO: 580897 - RNA, 18 nt, Human
cccaccccauuccaccuc

SEQ ID NO: 580898 - RNA, 20 nt, Human
cccaucagcaaccacgauaa

SEQ ID NO: 580899 - RNA, 20 nt, Human
cccaucagcaaccacgauaa

SEQ ID NO: 580900 - RNA, 23 nt, Human
ccccaagcccccagcccugggcc

SEQ ID NO: 580901 - RNA, 21 nt, Human
ccccaucagcaaccacgauaa

SEQ ID NO: 580902 - RNA, 22 nt, Human
cccccaccccauuccaccucac

SEQ ID NO: 580903 - RNA, 18 nt, Human
cccccgggaccucuuguc

SEQ ID NO: 580904 - RNA, 25 nt, Human
ccccucaccucacaauccuccccuc

SEQ ID NO: 580905 - RNA, 22 nt, Human
cccgggaccucuuguccucaga

SEQ ID NO: 580906 - RNA, 21 nt, Human
cccucugcaggagggucucac

SEQ ID NO: 580907 - RNA, 23 nt, Human
cccuucuccacgcuccuuuauua

SEQ ID NO: 580908 - RNA, 22 nt, Human
ccucaccucacaauccuccccu

SEQ ID NO: 580909 - RNA, 24 nt, Human
ccugcccuugccuagcaaacagcu

SEQ ID NO: 580910 - RNA, 23 nt, Human
ccuuauagccaagacgcgccgcc

SEQ ID NO: 580911 - RNA, 26 nt, Human
cgaguagguagccaguguuguaauga

SEQ ID NO: 580912 - RNA, 19 nt, Human
cggaaggagaaagaagagg

SEQ ID NO: 580913 - RNA, 24 nt, Human
cggaaggagaaagaagaggagggg

SEQ ID NO: 580914 - RNA, 21 nt, Human
cggcgccaccucccaccaccc

SEQ ID NO: 580915 - RNA, 23 nt, Human
cggggacagggaagcaacccaag

SEQ ID NO: 580916 - RNA, 21 nt, Human
cggggugggagaguggaggca

SEQ ID NO: 580917 - RNA, 23 nt, Human
cguauuauugccucauucugcag

SEQ ID NO: 580918 - RNA, 21 nt, Human
cucagccccaggcccccaggc

SEQ ID NO: 580919 - RNA, 22 nt, Human
cucgacaaacccagcgcuggag

SEQ ID NO: 580920 - RNA, 19 nt, Human
cucgugccguccugcgcac

SEQ ID NO: 580921 - RNA, 23 nt, Human
cucucucucucucacucgacaaa

SEQ ID NO: 580922 - RNA, 18 nt, Human
cugagggcugggagguga

SEQ ID NO: 580923 - RNA, 21 nt, Human
cuggauuucacauccggcagu

SEQ ID NO: 580924 - RNA, 23 nt, Human
cugggccagcagcaaccagcuuc

SEQ ID NO: 580925 - RNA, 21 nt, Human
cuguaggugacucugaggccu

SEQ ID NO: 580926 - RNA, 22 nt, Human
cuuuggaugguacauacucuac

SEQ ID NO: 580927 - RNA, 24 nt, Human
gaaagacaaggaggugggggaagg

SEQ ID NO: 580928 - RNA, 26 nt, Human
gacagggaggccagaacgggguggga

SEQ ID NO: 580929 - RNA, 19 nt, Human
gaccacuuuccugcccuug

SEQ ID NO: 580930 - RNA, 22 nt, Human
gaccacuuuccugcccuugccu

SEQ ID NO: 580931 - RNA, 19 nt, Human
gaggagaggaaggaaaggg

SEQ ID NO: 580932 - RNA, 19 nt, Human
gaggagaggaaggaaaggg

SEQ ID NO: 580933 - RNA, 23 nt, Human
gaggccaguccaagggaccccgg

SEQ ID NO: 580934 - RNA, 26 nt, Human
gaggcccagaggccagggggaggcca

SEQ ID NO: 580935 - RNA, 23 nt, Human
gcacucugaggggggccgggugc

SEQ ID NO: 580936 - RNA, 27 nt, Human
gcacugcaguucacguuggccccgugc

SEQ ID NO: 580937 - RNA, 21 nt, Human
gcagugaagaaggcgugagga

SEQ ID NO: 580938 - RNA, 22 nt, Human
gccacccucaccccucagaucc

SEQ ID NO: 580939 - RNA, 21 nt, Human
gcuccucucucucucucacuc

SEQ ID NO: 580940 - RNA, 24 nt, Human
ggaaaggggugcugugagucucag

SEQ ID NO: 580941 - RNA, 18 nt, Human
ggaaggagaaagaagagg

SEQ ID NO: 580942 - RNA, 19 nt, Human
ggaaggagaaagaagagga

SEQ ID NO: 580943 - RNA, 18 nt, Human
ggagaaagaagaggaggg

SEQ ID NO: 580944 - RNA, 23 nt, Human
ggagaugagaacuaauuguaacc

SEQ ID NO: 580945 - RNA, 21 nt, Human
ggcagggauggggguggcuga

SEQ ID NO: 580946 - RNA, 22 nt, Human
ggcccagaggccagggggaggc

SEQ ID NO: 580947 - RNA, 22 nt, Human
ggcgugaggaggggggccaccc

SEQ ID NO: 580948 - RNA, 18 nt, Human
ggcugagggaggaggugg

SEQ ID NO: 580949 - RNA, 18 nt, Human
gggaauggaguugggggg

SEQ ID NO: 580950 - RNA, 23 nt, Human
gggaccucuuguccucagacaug

SEQ ID NO: 580951 - RNA, 24 nt, Human
gggaggaggugggaggagaggaag

SEQ ID NO: 580952 - RNA, 19 nt, Human
gguccagccccgggaacaa

SEQ ID NO: 580953 - RNA, 20 nt, Human
ggugauucacaucuucacug

SEQ ID NO: 580954 - RNA, 21 nt, Human
gguggcugagggcugggaggu

SEQ ID NO: 580955 - RNA, 26 nt, Human
gugcacucugaggggggccggguguc

SEQ ID NO: 580956 - RNA, 23 nt, Human
uaaaauaaauacuacagaagaca

SEQ ID NO: 580957 - RNA, 21 nt, Human
uaaccaaaaaaacaaaaacag

SEQ ID NO: 580958 - RNA, 26 nt, Human
uaaccaaaaaaacaaaaacaguccag

SEQ ID NO: 580959 - RNA, 22 nt, Human
uaccacucagccccaggccccc

SEQ ID NO: 580960 - RNA, 21 nt, Human
ucacaucuucacugucuuucu

SEQ ID NO: 580961 - RNA, 23 nt, Human
ucagagcucaucaacaaagaaaa

SEQ ID NO: 580962 - RNA, 20 nt, Human
ucaucaacaaagaaaaagaa

SEQ ID NO: 580963 - RNA, 22 nt, Human
uccaagggaccccggcgccacc

SEQ ID NO: 580964 - RNA, 19 nt, Human
uccacccccaucagcaacc

SEQ ID NO: 580965 - RNA, 19 nt, Human
uccaccucacccccucccc

SEQ ID NO: 580966 - RNA, 21 nt, Human
ucccaaggagaaugaggggcu

SEQ ID NO: 580967 - RNA, 20 nt, Human
uccugcccuugccuagcaaa

SEQ ID NO: 580968 - RNA, 19 nt, Human
uccugcgcacugcaguuca

SEQ ID NO: 580969 - RNA, 23 nt, Human
ucuacaaggauuguucggaaaaa

SEQ ID NO: 580970 - RNA, 25 nt, Human
ucucagaaggggcagggaugggggu

SEQ ID NO: 580971 - RNA, 20 nt, Human
ugaggaggggggccacccuc

SEQ ID NO: 580972 - RNA, 22 nt, Human
ugagggaggaggugggaggaga

SEQ ID NO: 580973 - RNA, 26 nt, Human
ugagggaggaggugggaggagaggaa

SEQ ID NO: 580974 - RNA, 23 nt, Human
ugcagggcuguguagccagcauu

SEQ ID NO: 580975 - RNA, 19 nt, Human
ugcuccagcaggauguuca

SEQ ID NO: 580976 - RNA, 18 nt, Human
ugggagggacaaugccac

SEQ ID NO: 580977 - RNA, 21 nt, Human
uggggguggcugagggcuggg

SEQ ID NO: 580978 - RNA, 22 nt, Human
uuacccccaagcccccagcccu

SEQ ID NO: 580979 - RNA, 20 nt, Human
uucaacuuuccacccccauc

SEQ ID NO: 580980 - RNA, 21 nt, Human
uuccaccucacccccucccca

SEQ ID NO: 580981 - RNA, 19 nt, Human
uucguuagucacaagucca

SEQ ID NO: 580982 - RNA, 23 nt, Human
uucuguggguuucacuggggugg

SEQ ID NO: 580983 - RNA, 22 nt, Human
uuuacccccaagcccccagccc

SEQ ID NO: 580984 - RNA, 18 nt, Human
uuucucauuucuccucgg

SEQ ID NO: 580985 - RNA, 24 nt, Human
aaacaaaaaagcaaauauguguaa

SEQ ID NO: 580986 - RNA, 20 nt, Human
aaacugcugggauuacaggu

SEQ ID NO: 580987 - RNA, 24 nt, Human
aaacugcugggauuacagguauga

SEQ ID NO: 580988 - RNA, 26 nt, Human
aaccucuucuuccacaggcucuccug

SEQ ID NO: 580989 - RNA, 19 nt, Human
acacaacccaauucaaaac

SEQ ID NO: 580990 - RNA, 23 nt, Human
acaccaccacgcccggcuaauuu

SEQ ID NO: 580991 - RNA, 18 nt, Human
acaggguuucaccauguu

SEQ ID NO: 580992 - RNA, 21 nt, Human
acaggguuucaccauguuggc

SEQ ID NO: 580993 - RNA, 24 nt, Human
acaggguuucaccauguuggccag

SEQ ID NO: 580994 - RNA, 23 nt, Human
accaaguaucaccagaaacgggc

SEQ ID NO: 580995 - RNA, 24 nt, Human
accauguuggccaggcuggucucg

SEQ ID NO: 580996 - RNA, 19 nt, Human
accccuugcccagagcugg

SEQ ID NO: 580997 - RNA, 22 nt, Human
accggguccaugcacgaagccu

SEQ ID NO: 580998 - RNA, 23 nt, Human
agaagcagugccuguuccggagc

SEQ ID NO: 580999 - RNA, 21 nt, Human
agaaggaaguggauucuagaa

SEQ ID NO: 581000 - RNA, 23 nt, Human
agaaggaaguggauucuagaagc

SEQ ID NO: 581001 - RNA, 23 nt, Human
agagauacauuuucuuuaaggcu

SEQ ID NO: 581002 - RNA, 27 nt, Human
agagauacauuuucuuuaaggcuuguc

SEQ ID NO: 581003 - RNA, 19 nt, Human
agagccuggguccuucgcc

SEQ ID NO: 581004 - RNA, 23 nt, Human
agccuuauucuccaaaacccagg

SEQ ID NO: 581005 - RNA, 20 nt, Human
aggcauacaccaccacgccc

SEQ ID NO: 581006 - RNA, 24 nt, Human
aggugaucugccugccuuggccuc

SEQ ID NO: 581007 - RNA, 21 nt, Human
agguucaagugauucuccugc

SEQ ID NO: 581008 - RNA, 22 nt, Human
agguucaagugauucuccugcc

SEQ ID NO: 581009 - RNA, 23 nt, Human
agguucaagugauucuccugccu

SEQ ID NO: 581010 - RNA, 22 nt, Human
aguagagacaggguuucaccau

SEQ ID NO: 581011 - RNA, 21 nt, Human
aguagcugggauuacaggcau

SEQ ID NO: 581012 - RNA, 23 nt, Human
agucucgcuggagugcaguggug

SEQ ID NO: 581013 - RNA, 20 nt, Human
agugcaguggugcaaucucg

SEQ ID NO: 581014 - RNA, 24 nt, Human
agugcaguggugcaaucucggcuc

SEQ ID NO: 581015 - RNA, 18 nt, Human
auguugcaucccaucuug

SEQ ID NO: 581016 - RNA, 24 nt, Human
auuuuuguauuuuuaguagagaca

SEQ ID NO: 581017 - RNA, 25 nt, Human
caaaaccagaucaacuuccugcuga

SEQ ID NO: 581018 - RNA, 18 nt, Human
caaaacccaggcccugca

SEQ ID NO: 581019 - RNA, 24 nt, Human
caaacugcugggauuacagguaug

SEQ ID NO: 581020 - RNA, 19 nt, Human
caacccaauucaaaaccag

SEQ ID NO: 581021 - RNA, 24 nt, Human
caacccaauucaaaaccagaucaa

SEQ ID NO: 581022 - RNA, 20 nt, Human
caaccuccgccucccagguu

SEQ ID NO: 581023 - RNA, 21 nt, Human
caagccuuauucuccaaaacc

SEQ ID NO: 581024 - RNA, 19 nt, Human
caaguaucaccagaaacgg

SEQ ID NO: 581025 - RNA, 20 nt, Human
caagugauucuccugccuca

SEQ ID NO: 581026 - RNA, 22 nt, Human
caagugauucuccugccucagc

SEQ ID NO: 581027 - RNA, 24 nt, Human
cacacaacccaauucaaaaccaga

SEQ ID NO: 581028 - RNA, 24 nt, Human
cacacacaacccaauucaaaacca

SEQ ID NO: 581029 - RNA, 20 nt, Human
caccacaaccuccgccuccc

SEQ ID NO: 581030 - RNA, 21 nt, Human
caccacaaccuccgccuccca

SEQ ID NO: 581031 - RNA, 22 nt, Human
caccacaaccuccgccucccag

SEQ ID NO: 581032 - RNA, 24 nt, Human
caccacgcccggcuaauuuuugua

SEQ ID NO: 581033 - RNA, 21 nt, Human
caccauguuggccaggcuggu

SEQ ID NO: 581034 - RNA, 24 nt, Human
caccauguuggccaggcuggucuc

SEQ ID NO: 581035 - RNA, 20 nt, Human
cacccucugccucugcacag

SEQ ID NO: 581036 - RNA, 21 nt, Human
cagagucucgcuggagugcag

SEQ ID NO: 581037 - RNA, 24 nt, Human
cagcuucucaagcuaccggauccu

SEQ ID NO: 581038 - RNA, 24 nt, Human
caggguuucaccauguuggccagg

SEQ ID NO: 581039 - RNA, 23 nt, Human
cauacaccaccacgcccggcuaa

SEQ ID NO: 581040 - RNA, 23 nt, Human
caucugguccugcgagaaggaag

SEQ ID NO: 581041 - RNA, 23 nt, Human
cauguuggccaggcuggucucga

SEQ ID NO: 581042 - RNA, 18 nt, Human
ccaaaacccaggcccugc

SEQ ID NO: 581043 - RNA, 21 nt, Human
ccaaacugcugggauuacagg

SEQ ID NO: 581044 - RNA, 21 nt, Human
ccaaacugcugggauuacagg

SEQ ID NO: 581045 - RNA, 22 nt, Human
ccaaacugcugggauuacaggu

SEQ ID NO: 581046 - RNA, 24 nt, Human
ccaaacugcugggauuacagguau

SEQ ID NO: 581047 - RNA, 19 nt, Human
ccaaagaggaccugaggcu

SEQ ID NO: 581048 - RNA, 24 nt, Human
ccacaaccuccgccucccagguuc

SEQ ID NO: 581049 - RNA, 22 nt, Human
ccaccacauguaaucuccuaca

SEQ ID NO: 581050 - RNA, 18 nt, Human
ccagcggcagcugcacag

SEQ ID NO: 581051 - RNA, 21 nt, Human
cccagguucaagugauucucc

SEQ ID NO: 581052 - RNA, 23 nt, Human
cccagguucaagugauucuccug

SEQ ID NO: 581053 - RNA, 20 nt, Human
ccccuugcccagagcuggcu

SEQ ID NO: 581054 - RNA, 23 nt, Human
cccgaguagcugggauuacaggc

SEQ ID NO: 581055 - RNA, 24 nt, Human
cccgaguagcugggauuacaggca

SEQ ID NO: 581056 - RNA, 22 nt, Human
cccuccacugaaccucuucuuc

SEQ ID NO: 581057 - RNA, 22 nt, Human
cccuccgccuuggcccagaggg

SEQ ID NO: 581058 - RNA, 23 nt, Human
ccgaguagcugggauuacaggca

SEQ ID NO: 581059 - RNA, 24 nt, Human
ccgaguagcugggauuacaggcau

SEQ ID NO: 581060 - RNA, 24 nt, Human
ccgccucccagguucaagugauuc

SEQ ID NO: 581061 - RNA, 18 nt, Human
ccggagcagcugccuugc

SEQ ID NO: 581062 - RNA, 24 nt, Human
ccucccagguucaagugauucucc

SEQ ID NO: 581063 - RNA, 24 nt, Human
ccugcagguaggggaucccaaagc

SEQ ID NO: 581064 - RNA, 23 nt, Human
ccugccucagccucccgaguagc

SEQ ID NO: 581065 - RNA, 18 nt, Human
ccuugcccagagcuggcu

SEQ ID NO: 581066 - RNA, 22 nt, Human
cgccucccagguucaagugauu

SEQ ID NO: 581067 - RNA, 24 nt, Human
cucaccacaaccuccgccucccag

SEQ ID NO: 581068 - RNA, 23 nt, Human
cucagccucccgaguagcuggga

SEQ ID NO: 581069 - RNA, 21 nt, Human
cucccaaacugcugggauuac

SEQ ID NO: 581070 - RNA, 20 nt, Human
cucccaggccugaagggcuc

SEQ ID NO: 581071 - RNA, 19 nt, Human
cucccagguucaagugauu

SEQ ID NO: 581072 - RNA, 20 nt, Human
cucgcuggagugcaguggug

SEQ ID NO: 581073 - RNA, 25 nt, Human
cucugaccucaggugaucugccugc

SEQ ID NO: 581074 - RNA, 18 nt, Human
cucugcacagggcacccc

SEQ ID NO: 581075 - RNA, 20 nt, Human
cugaccucaggugaucugcc

SEQ ID NO: 581076 - RNA, 19 nt, Human
cugagaauuuccucccagg

SEQ ID NO: 581077 - RNA, 23 nt, Human
cugccucagccucccgaguagcu

SEQ ID NO: 581078 - RNA, 19 nt, Human
cugccuugcugagugacag

SEQ ID NO: 581079 - RNA, 21 nt, Human
cuggguccuucgccagcugga

SEQ ID NO: 581080 - RNA, 18 nt, Human
cuucucaagcuaccggau

SEQ ID NO: 581081 - RNA, 25 nt, Human
cuugacucauuuuugagaaaggguc

SEQ ID NO: 581082 - RNA, 22 nt, Human
cuugcucugcugcagaucugaa

SEQ ID NO: 581083 - RNA, 20 nt, Human
cuuggggccaagccuuauuc

SEQ ID NO: 581084 - RNA, 20 nt, Human
cuuugcaccggguccaugcc

SEQ ID NO: 581085 - RNA, 23 nt, Human
gaaaguguggccuuuggaagggc

SEQ ID NO: 581086 - RNA, 21 nt, Human
gacagcggccucaugaccugc

SEQ ID NO: 581087 - RNA, 23 nt, Human
gaccucaggugaucugccugccu

SEQ ID NO: 581088 - RNA, 22 nt, Human
gagcugggaggaaacaaccccu

SEQ ID NO: 581089 - RNA, 23 nt, Human
gaggaaacaaccccuugcccaga

SEQ ID NO: 581090 - RNA, 24 nt, Human
gaguagcugggauuacaggcauac

SEQ ID NO: 581091 - RNA, 18 nt, Human
gauuacagguaugagcca

SEQ ID NO: 581092 - RNA, 19 nt, Human
gauuacagguaugagccac

SEQ ID NO: 581093 - RNA, 21 nt, Human
gauuacagguaugagccacug

SEQ ID NO: 581094 - RNA, 21 nt, Human
gauucuccugccucagccucc

SEQ ID NO: 581095 - RNA, 22 nt, Human
gcccggcuaauuuuuguauuuu

SEQ ID NO: 581096 - RNA, 18 nt, Human
gccuuauucuccaaaacc

SEQ ID NO: 581097 - RNA, 22 nt, Human
ggacagcggccucaugaccugc

SEQ ID NO: 581098 - RNA, 22 nt, Human
gggauguccacaauguuggcag

SEQ ID NO: 581099 - RNA, 21 nt, Human
ggguccgggcucugcccacug

SEQ ID NO: 581100 - RNA, 22 nt, Human
ggguuucaccauguuggccagg

SEQ ID NO: 581101 - RNA, 18 nt, Human
ggucucgagcucugaccu

SEQ ID NO: 581102 - RNA, 23 nt, Human
ggugagguuaucuaucuagauau

SEQ ID NO: 581103 - RNA, 18 nt, Human
guagcugggauuacaggc

SEQ ID NO: 581104 - RNA, 20 nt, Human
guagcugggauuacaggcau

SEQ ID NO: 581105 - RNA, 18 nt, Human
guccgggcucugcccacu

SEQ ID NO: 581106 - RNA, 24 nt, Human
gugauucuccugccucagccuccc

SEQ ID NO: 581107 - RNA, 25 nt, Human
gugcacacacaacccaauucaaaac

SEQ ID NO: 581108 - RNA, 18 nt, Human
guggaggggauguccaca

SEQ ID NO: 581109 - RNA, 21 nt, Human
guuccggagcagcugccuugc

SEQ ID NO: 581110 - RNA, 24 nt, Human
uaauuuuuguauuuuuaguagaga

SEQ ID NO: 581111 - RNA, 23 nt, Human
uacagguaugagccacugugccc

SEQ ID NO: 581112 - RNA, 24 nt, Human
uacagguaugagccacugugcccu

SEQ ID NO: 581113 - RNA, 18 nt, Human
uacccucugcaccaagua

SEQ ID NO: 581114 - RNA, 22 nt, Human
uagagacaggguuucaccaugu

SEQ ID NO: 581115 - RNA, 26 nt, Human
uagcaaacaccagucucaguaaccau

SEQ ID NO: 581116 - RNA, 18 nt, Human
uagcaggaucagcacaga

SEQ ID NO: 581117 - RNA, 24 nt, Human
uaguagagacaggguuucaccaug

SEQ ID NO: 581118 - RNA, 26 nt, Human
uaguagagacaggguuucaccauguu

SEQ ID NO: 581119 - RNA, 26 nt, Human
uauauauguguauaauuguguguaua

SEQ ID NO: 581120 - RNA, 22 nt, Human
uauguguauaauuguguguaua

SEQ ID NO: 581121 - RNA, 24 nt, Human
uauguguauaauuguguguauaca

SEQ ID NO: 581122 - RNA, 19 nt, Human
ucaagugauucuccugccu

SEQ ID NO: 581123 - RNA, 24 nt, Human
ucaccacaaccuccgccucccagg

SEQ ID NO: 581124 - RNA, 25 nt, Human
ucaccacaaccuccgccucccaggu

SEQ ID NO: 581125 - RNA, 27 nt, Human
ucaccacaaccuccgccucccagguuc

SEQ ID NO: 581126 - RNA, 18 nt, Human
ucagccacugagcuggga

SEQ ID NO: 581127 - RNA, 20 nt, Human
ucagccucccgaguagcugg

SEQ ID NO: 581128 - RNA, 21 nt, Human
uccaaaacccaggcccugcag

SEQ ID NO: 581129 - RNA, 21 nt, Human
uccacugaaccucuucuucca

SEQ ID NO: 581130 - RNA, 23 nt, Human
ucccaaacugcugggauuacagg

SEQ ID NO: 581131 - RNA, 24 nt, Human
ucccaaacugcugggauuacaggu

SEQ ID NO: 581132 - RNA, 24 nt, Human
ucccaggcagcagcgucccuccac

SEQ ID NO: 581133 - RNA, 20 nt, Human
ucccaggccugaagggcucu

SEQ ID NO: 581134 - RNA, 21 nt, Human
ucccagguucaagugauucuc

SEQ ID NO: 581135 - RNA, 24 nt, Human
ucccagguucaagugauucuccug

SEQ ID NO: 581136 - RNA, 24 nt, Human
ucccgaguagcugggauuacaggc

SEQ ID NO: 581137 - RNA, 23 nt, Human
uccgggcucugcccacugcuccc

SEQ ID NO: 581138 - RNA, 18 nt, Human
uccugcgagaaggaagug

SEQ ID NO: 581139 - RNA, 24 nt, Human
ucuccugccucagccucccgagua

SEQ ID NO: 581140 - RNA, 23 nt, Human
ucugaccucaggugaucugccug

SEQ ID NO: 581141 - RNA, 23 nt, Human
ucugcaccaaguaucaccagaaa

SEQ ID NO: 581142 - RNA, 24 nt, Human
ucuuccacaggcucuccugagaau

SEQ ID NO: 581143 - RNA, 23 nt, Human
ucuugcucugcugcagaucugaa

SEQ ID NO: 581144 - RNA, 21 nt, Human
ugaaaguguggccuuuggaag

SEQ ID NO: 581145 - RNA, 18 nt, Human
ugaccucaggugaucugc

SEQ ID NO: 581146 - RNA, 24 nt, Human
ugaccucaggugaucugccugccu

SEQ ID NO: 581147 - RNA, 22 nt, Human
ugacuccagugcacacacaacc

SEQ ID NO: 581148 - RNA, 20 nt, Human
ugauucuccugccucagccu

SEQ ID NO: 581149 - RNA, 20 nt, Human
ugcacccagcggcagcugca

SEQ ID NO: 581150 - RNA, 22 nt, Human
ugcacgaagccugugauugggg

SEQ ID NO: 581151 - RNA, 23 nt, Human
ugccaaagaggaccugaggcucc

SEQ ID NO: 581152 - RNA, 18 nt, Human
ugcccagagcuggcugga

SEQ ID NO: 581153 - RNA, 24 nt, Human
ugccucagccucccgaguagcugg

SEQ ID NO: 581154 - RNA, 18 nt, Human
ugccugccuuggccuccc

SEQ ID NO: 581155 - RNA, 21 nt, Human
ugccuuggccucccaaacugc

SEQ ID NO: 581156 - RNA, 24 nt, Human
ugcugggauuacagguaugagcca

SEQ ID NO: 581157 - RNA, 20 nt, Human
uggacagcggccucaugacc

SEQ ID NO: 581158 - RNA, 23 nt, Human
uggaggggucagcacgcacagcu

SEQ ID NO: 581159 - RNA, 23 nt, Human
uggagugcaguggugcaaucucg

SEQ ID NO: 581160 - RNA, 24 nt, Human
uggagugcaguggugcaaucucgg

SEQ ID NO: 581161 - RNA, 23 nt, Human
uggccaggcuggucucgagcucu

SEQ ID NO: 581162 - RNA, 21 nt, Human
uggcccagagggaacaguuua

SEQ ID NO: 581163 - RNA, 25 nt, Human
uggcccagagggaacaguuuauguu

SEQ ID NO: 581164 - RNA, 21 nt, Human
ugggauuacaggcauacacca

SEQ ID NO: 581165 - RNA, 24 nt, Human
ugggauuacaggcauacaccacca

SEQ ID NO: 581166 - RNA, 18 nt, Human
ugggauuacagguaugag

SEQ ID NO: 581167 - RNA, 21 nt, Human
ugggauuacagguaugagcca

SEQ ID NO: 581168 - RNA, 22 nt, Human
ugggauuacagguaugagccac

SEQ ID NO: 581169 - RNA, 22 nt, Human
ugggauuacagguaugagccac

SEQ ID NO: 581170 - RNA, 22 nt, Human
ugggauuacagguaugagccac

SEQ ID NO: 581171 - RNA, 23 nt, Human
ugggauuacagguaugagccacu

SEQ ID NO: 581172 - RNA, 24 nt, Human
ugggauuacagguaugagccacug

SEQ ID NO: 581173 - RNA, 24 nt, Human
uggugcaaucucggcucaccacaa

SEQ ID NO: 581174 - RNA, 23 nt, Human
uguaaaauaauguuugacuccag

SEQ ID NO: 581175 - RNA, 20 nt, Human
uguguauaauuguguguaua

SEQ ID NO: 581176 - RNA, 24 nt, Human
uuaguagagacaggguuucaccau

SEQ ID NO: 581177 - RNA, 21 nt, Human
uucaagugauucuccugccuc

SEQ ID NO: 581178 - RNA, 23 nt, Human
uucaagugauucuccugccucag

SEQ ID NO: 581179 - RNA, 24 nt, Human
uucaagugauucuccugccucagc

SEQ ID NO: 581180 - RNA, 21 nt, Human
uucccuugccuuuuaaaaggg

SEQ ID NO: 581181 - RNA, 24 nt, Human
uucuccaaaacccaggcccugcag

SEQ ID NO: 581182 - RNA, 19 nt, Human
uugacuccagugcacacac

SEQ ID NO: 581183 - RNA, 19 nt, Human
uugcugagugacagggugc

SEQ ID NO: 581184 - RNA, 19 nt, Human
uuggggugagguuaucuau

SEQ ID NO: 581185 - RNA, 22 nt, Human
uugucaccugcugacacaucug

SEQ ID NO: 581186 - RNA, 24 nt, Human
uuucaccauguuggccaggcuggu

SEQ ID NO: 581187 - RNA, 24 nt, Human
uuuuuaguagagacaggguuucac

SEQ ID NO: 581188 - RNA, 20 nt, Human
uuuuuguauuuuuaguagag

SEQ ID NO: 581189 - RNA, 21 nt, Human
aaaacccagcaauaacaauuu

SEQ ID NO: 581190 - RNA, 24 nt, Human
aaaacuuaacacauauaaaaguuu

SEQ ID NO: 581191 - RNA, 19 nt, Human
aagcauuaaaagcagaagc

SEQ ID NO: 581192 - RNA, 19 nt, Human
acccaaagaaauggaaaga

SEQ ID NO: 581193 - RNA, 19 nt, Human
aggaggaaagcucuagucu

SEQ ID NO: 581194 - RNA, 21 nt, Human
aggcaaagccagauauuggga

SEQ ID NO: 581195 - RNA, 18 nt, Human
auaugaaaggcaaagcca

SEQ ID NO: 581196 - RNA, 20 nt, Human
auccuggaggaggaaagcuc

SEQ ID NO: 581197 - RNA, 21 nt, Human
aucucuucuuguacagauguu

SEQ ID NO: 581198 - RNA, 22 nt, Human
caaagaaauggaaagaauugga

SEQ ID NO: 581199 - RNA, 27 nt, Human
caacaaaacccaaagaaauggaaagaa

SEQ ID NO: 581200 - RNA, 21 nt, Human
caagugaaacuaaauuaagua

SEQ ID NO: 581201 - RNA, 18 nt, Human
cagaagccaguaaaugag

SEQ ID NO: 581202 - RNA, 24 nt, Human
ccagugcaacaaaacccaaagaaa

SEQ ID NO: 581203 - RNA, 20 nt, Human
ccaugcacuagauccucucc

SEQ ID NO: 581204 - RNA, 23 nt, Human
cuccaaaacauccuggaggagga

SEQ ID NO: 581205 - RNA, 18 nt, Human
cuuuggggucaaaaccca

SEQ ID NO: 581206 - RNA, 19 nt, Human
gaaguuccuccuuauccuu

SEQ ID NO: 581207 - RNA, 19 nt, Human
gcaacaaaacccaaagaaa

SEQ ID NO: 581208 - RNA, 25 nt, Human
gcacuagauccucuccaaccggagg

SEQ ID NO: 581209 - RNA, 19 nt, Human
ggaacacaaugaaaaaugg

SEQ ID NO: 581210 - RNA, 21 nt, Human
ggaagaacagcagucaacaag

SEQ ID NO: 581211 - RNA, 18 nt, Human
ggaaugggaggaagaggg

SEQ ID NO: 581212 - RNA, 19 nt, Human
ggaaugggaggaagaggga

SEQ ID NO: 581213 - RNA, 19 nt, Human
ggauaaagagauauucugu

SEQ ID NO: 581214 - RNA, 24 nt, Human
ggcaggcugagugcaugcggggcc

SEQ ID NO: 581215 - RNA, 18 nt, Human
gugaaggaaaaagcagcc

SEQ ID NO: 581216 - RNA, 19 nt, Human
gugcuaugcuauaucugcc

SEQ ID NO: 581217 - RNA, 24 nt, Human
guggagguggaaugggaggaagag

SEQ ID NO: 581218 - RNA, 24 nt, Human
uaacacauauaaaaguuucaaaaa

SEQ ID NO: 581219 - RNA, 20 nt, Human
uacucugagaaugaagaacc

SEQ ID NO: 581220 - RNA, 20 nt, Human
uagccagugcaacaaaaccc

SEQ ID NO: 581221 - RNA, 19 nt, Human
ucccuggagaugcucuggc

SEQ ID NO: 581222 - RNA, 22 nt, Human
ucccuggagaugcucuggcugu

SEQ ID NO: 581223 - RNA, 22 nt, Human
uccuggaggaggaaagcucuag

SEQ ID NO: 581224 - RNA, 19 nt, Human
ugacaaaaacuacucugag

SEQ ID NO: 581225 - RNA, 26 nt, Human
ugcacuagauccucuccaaaacaucc

SEQ ID NO: 581226 - RNA, 21 nt, Human
ugcccugaaaacuuaacacau

SEQ ID NO: 581227 - RNA, 22 nt, Human
uggaaagaauuggaacacaaug

SEQ ID NO: 581228 - RNA, 19 nt, Human
uggaaugggaggaagaggg

SEQ ID NO: 581229 - RNA, 24 nt, Human
uggaggaggaaagcucuagucuuu

SEQ ID NO: 581230 - RNA, 21 nt, Human
uggcaggcugagugcaugcgg

SEQ ID NO: 581231 - RNA, 22 nt, Human
uggcaugaggaagauaaaaugg

SEQ ID NO: 581232 - RNA, 22 nt, Human
ugggaggaagagggaguccaug

SEQ ID NO: 581233 - RNA, 18 nt, Human
ugguaagaaauaccagaa

SEQ ID NO: 581234 - RNA, 20 nt, Human
uuccggaucagggcagaggg

SEQ ID NO: 581235 - RNA, 22 nt, Human
uuugugcuaugcuauaucugcc

SEQ ID NO: 581236 - RNA, 19 nt, Human
aaacgccuccacggccaag

SEQ ID NO: 581237 - RNA, 18 nt, Human
aaagugcccagaucugcc

SEQ ID NO: 581238 - RNA, 21 nt, Human
aaagugcuuucaaucccauua

SEQ ID NO: 581239 - RNA, 21 nt, Human
aagcaacaguaagaaaauaac

SEQ ID NO: 581240 - RNA, 18 nt, Human
aagcaggcaucucucuua

SEQ ID NO: 581241 - RNA, 21 nt, Human
aagcaucacaaauuaaaaaua

SEQ ID NO: 581242 - RNA, 23 nt, Human
aaguguuggaaacacauuaaacu

SEQ ID NO: 581243 - RNA, 21 nt, Human
acacagaggaaagacaaugag

SEQ ID NO: 581244 - RNA, 24 nt, Human
acaucaacuggguugaagggggac

SEQ ID NO: 581245 - RNA, 19 nt, Human
agaaaagcaucacaaauua

SEQ ID NO: 581246 - RNA, 23 nt, Human
agaaugggcacccacuccccauu

SEQ ID NO: 581247 - RNA, 28 nt, Human
agcaacaguaagaaaauaaccgguaccc

SEQ ID NO: 581248 - RNA, 20 nt, Human
agcaggcaaacacugccagg

SEQ ID NO: 581249 - RNA, 18 nt, Human
agcggcaaacgccuccac

SEQ ID NO: 581250 - RNA, 23 nt, Human
aggagccacguggggcccggagc

SEQ ID NO: 581251 - RNA, 24 nt, Human
aggcaaaugcuggaaaacccuccg

SEQ ID NO: 581252 - RNA, 24 nt, Human
aggccagaacacagaacugugauc

SEQ ID NO: 581253 - RNA, 25 nt, Human
aggcuucccuggagacgcauaaacc

SEQ ID NO: 581254 - RNA, 24 nt, Human
aggguguuuggaaacacgaucuga

SEQ ID NO: 581255 - RNA, 19 nt, Human
auuuguaaaaaaugaggug

SEQ ID NO: 581256 - RNA, 21 nt, Human
caacacucgcaauaacugagu

SEQ ID NO: 581257 - RNA, 20 nt, Human
caagucuugaacuugaacca

SEQ ID NO: 581258 - RNA, 18 nt, Human
cacaguccuguuuugggg

SEQ ID NO: 581259 - RNA, 21 nt, Human
caccaugaucuagagcacagg

SEQ ID NO: 581260 - RNA, 22 nt, Human
cacccacuccccauuucaccuc

SEQ ID NO: 581261 - RNA, 20 nt, Human
cacccaggaugugugucuuc

SEQ ID NO: 581262 - RNA, 20 nt, Human
caccugagccauuguaacca

SEQ ID NO: 581263 - RNA, 22 nt, Human
cacgagccucgcugccagugcc

SEQ ID NO: 581264 - RNA, 18 nt, Human
cacuccaaguuuuuggca

SEQ ID NO: 581265 - RNA, 21 nt, Human
cagcaacacucgcaauaacug

SEQ ID NO: 581266 - RNA, 22 nt, Human
cagcaacacucgcaauaacuga

SEQ ID NO: 581267 - RNA, 18 nt, Human
cagggucacucacuacac

SEQ ID NO: 581268 - RNA, 22 nt, Human
cauuucccucucuccccugccc

SEQ ID NO: 581269 - RNA, 21 nt, Human
ccacaggccagaacacagaac

SEQ ID NO: 581270 - RNA, 19 nt, Human
ccacgggggccuuccuuca

SEQ ID NO: 581271 - RNA, 21 nt, Human
ccagaaauuccuuguuucugg

SEQ ID NO: 581272 - RNA, 22 nt, Human
ccagaacacagaacugugauca

SEQ ID NO: 581273 - RNA, 23 nt, Human
ccagaacacagaacugugaucau

SEQ ID NO: 581274 - RNA, 21 nt, Human
ccagcggcccuucccggcccu

SEQ ID NO: 581275 - RNA, 25 nt, Human
ccagcucauucuaccacgggggccu

SEQ ID NO: 581276 - RNA, 22 nt, Human
ccaucguagagaauucgguugu

SEQ ID NO: 581277 - RNA, 22 nt, Human
cccaccagcuaagcagagggaa

SEQ ID NO: 581278 - RNA, 26 nt, Human
cccaugcgccucguggagagcaacca

SEQ ID NO: 581279 - RNA, 28 nt, Human
cccaugcgccucguggagagcaaccacg

SEQ ID NO: 581280 - RNA, 23 nt, Human
ccccauuucaccacuguacaccc

SEQ ID NO: 581281 - RNA, 23 nt, Human
cccugccacaggccagaacacag

SEQ ID NO: 581282 - RNA, 19 nt, Human
cccuguuguucugaggggc

SEQ ID NO: 581283 - RNA, 21 nt, Human
ccgaggcuucccuggagacgc

SEQ ID NO: 581284 - RNA, 18 nt, Human
ccugaccagaguugucac

SEQ ID NO: 581285 - RNA, 22 nt, Human
ccugccacaggccagaacacag

SEQ ID NO: 581286 - RNA, 20 nt, Human
cgagccucgcugccagugcc

SEQ ID NO: 581287 - RNA, 25 nt, Human
cgccucguggagagcaaccacgucu

SEQ ID NO: 581288 - RNA, 20 nt, Human
cuacuuauuuuucaagacaa

SEQ ID NO: 581289 - RNA, 21 nt, Human
cuagagcacaggagccacgug

SEQ ID NO: 581290 - RNA, 20 nt, Human
cugcccaccagcuaagcaga

SEQ ID NO: 581291 - RNA, 26 nt, Human
cuucacagucaccaguccacgcugcc

SEQ ID NO: 581292 - RNA, 21 nt, Human
gacaccugagccauuguaacc

SEQ ID NO: 581293 - RNA, 18 nt, Human
gcuaagcagagggaauga

SEQ ID NO: 581294 - RNA, 21 nt, Human
gcuccccaugcgccucgugga

SEQ ID NO: 581295 - RNA, 22 nt, Human
ggacuggguaaucccagaaauu

SEQ ID NO: 581296 - RNA, 18 nt, Human
ggagaggaggggacaucu

SEQ ID NO: 581297 - RNA, 23 nt, Human
gggcccggagcaugcggacagca

SEQ ID NO: 581298 - RNA, 20 nt, Human
guagcucaggugagcggcaa

SEQ ID NO: 581299 - RNA, 23 nt, Human
guggagagcaaccacgucuguuc

SEQ ID NO: 581300 - RNA, 19 nt, Human
guggggcccggagcaugcg

SEQ ID NO: 581301 - RNA, 20 nt, Human
gugugucuucuucuaagaga

SEQ ID NO: 581302 - RNA, 20 nt, Human
guuuuuggcauuucccucuc

SEQ ID NO: 581303 - RNA, 19 nt, Human
uaaaaauaaaaaauagcau

SEQ ID NO: 581304 - RNA, 21 nt, Human
uaaaagugcuuucaaucccau

SEQ ID NO: 581305 - RNA, 22 nt, Human
uaagaaaauaaccugaagauau

SEQ ID NO: 581306 - RNA, 21 nt, Human
uagaaaagcaucacaaauuaa

SEQ ID NO: 581307 - RNA, 19 nt, Human
ucaccacuguacacccagg

SEQ ID NO: 581308 - RNA, 21 nt, Human
uccaaccacagggcgggggag

SEQ ID NO: 581309 - RNA, 23 nt, Human
ucccggcccugccacaggccaga

SEQ ID NO: 581310 - RNA, 22 nt, Human
ucccuggagacgcauaaaccug

SEQ ID NO: 581311 - RNA, 23 nt, Human
uccguggcaucgauuccaaccac

SEQ ID NO: 581312 - RNA, 24 nt, Human
uccguggcaucgauuccaaccaca

SEQ ID NO: 581313 - RNA, 25 nt, Human
uccuucacuccaaguuuuuggcauu

SEQ ID NO: 581314 - RNA, 22 nt, Human
ucggaagccagcggcccuuccc

SEQ ID NO: 581315 - RNA, 18 nt, Human
ucuccaugugguaaaagu

SEQ ID NO: 581316 - RNA, 22 nt, Human
ucugcccaccacucuggcaccg

SEQ ID NO: 581317 - RNA, 19 nt, Human
ucugcgacaaagcuuaggg

SEQ ID NO: 581318 - RNA, 26 nt, Human
ugagcaaauggccaucguuguaauga

SEQ ID NO: 581319 - RNA, 20 nt, Human
ugagcaggcaaacacugcca

SEQ ID NO: 581320 - RNA, 19 nt, Human
ugaguagaauagauucugu

SEQ ID NO: 581321 - RNA, 23 nt, Human
ugaucaugcaaagagccgugacu

SEQ ID NO: 581322 - RNA, 23 nt, Human
ugcaaagagccgugacugaggcc

SEQ ID NO: 581323 - RNA, 22 nt, Human
ugccacaggccagaacacagaa

SEQ ID NO: 581324 - RNA, 21 nt, Human
uggagaggaggggacaucugc

SEQ ID NO: 581325 - RNA, 22 nt, Human
uggcaugaggcaaaugcuggaa

SEQ ID NO: 581326 - RNA, 22 nt, Human
uguuuugggguuuuuccaaggc

SEQ ID NO: 581327 - RNA, 23 nt, Human
uuccaaccacagggcgggggagu

SEQ ID NO: 581328 - RNA, 21 nt, Human
uucugaggggccacucugagc

SEQ ID NO: 581329 - RNA, 23 nt, Human
uuggaaacacgaucugaaauuug

SEQ ID NO: 581330 - RNA, 19 nt, Human
aaaauucuuucauuucugu

SEQ ID NO: 581331 - RNA, 20 nt, Human
aagcuccagagucccuuacu

SEQ ID NO: 581332 - RNA, 21 nt, Human
cacuccaucaguuagcaucuu

SEQ ID NO: 581333 - RNA, 18 nt, Human
cagagucccuuacucucc

SEQ ID NO: 581334 - RNA, 21 nt, Human
cagaucccagaucuacagaaa

SEQ ID NO: 581335 - RNA, 20 nt, Human
caucuuguuuacugccuucc

SEQ ID NO: 581336 - RNA, 19 nt, Human
ccaguguaccaaagauaca

SEQ ID NO: 581337 - RNA, 20 nt, Human
cccaaacuuucauuuaacau

SEQ ID NO: 581338 - RNA, 25 nt, Human
cccccugcuuccauccugaguguac

SEQ ID NO: 581339 - RNA, 18 nt, Human
ccugaugacagauggaag

SEQ ID NO: 581340 - RNA, 19 nt, Human
ccuggggauuucacuccau

SEQ ID NO: 581341 - RNA, 19 nt, Human
cuccugccccugaggccuc

SEQ ID NO: 581342 - RNA, 23 nt, Human
cuuccugccacuauaucaucgau

SEQ ID NO: 581343 - RNA, 26 nt, Human
gaaaauucuuucauuucuguuguguc

SEQ ID NO: 581344 - RNA, 20 nt, Human
ggggcagguguccagauccc

SEQ ID NO: 581345 - RNA, 21 nt, Human
uaugguucuacugcuggugac

SEQ ID NO: 581346 - RNA, 21 nt, Human
ucagagcagucuggaaucaag

SEQ ID NO: 581347 - RNA, 19 nt, Human
uccaggaggcggggccauc

SEQ ID NO: 581348 - RNA, 26 nt, Human
uccaggaggcggggccaucccguccg

SEQ ID NO: 581349 - RNA, 19 nt, Human
ucuacagaaaauucuuuca

SEQ ID NO: 581350 - RNA, 27 nt, Human
ucuccaguguaccaaagauacaguccu

SEQ ID NO: 581351 - RNA, 22 nt, Human
ucuccugaugacagauggaagu

SEQ ID NO: 581352 - RNA, 22 nt, Human
ucugcaucuccuggggauuuca

SEQ ID NO: 581353 - RNA, 20 nt, Human
ugaccucauagaagcagagu

SEQ ID NO: 581354 - RNA, 19 nt, Human
ugccuaguuugagcuccaa

SEQ ID NO: 581355 - RNA, 22 nt, Human
uggaaguccaggaggcggggcc

SEQ ID NO: 581356 - RNA, 23 nt, Human
uggaaguccaggaggcggggcca

SEQ ID NO: 581357 - RNA, 23 nt, Human
ugucauguucauuaguuccuuca

SEQ ID NO: 581358 - RNA, 24 nt, Human
uuccgagcuuuauuaaaaugucga

SEQ ID NO: 581359 - RNA, 19 nt, Human
uucuguugugucccccugc

SEQ ID NO: 581360 - RNA, 22 nt, Human
uuugagcuccaacugucacaga

SEQ ID NO: 581361 - RNA, 20 nt, Human
aaacaacagaaacuggcugg

SEQ ID NO: 581362 - RNA, 24 nt, Human
aaagugcugggagccacucacagg

SEQ ID NO: 581363 - RNA, 30 nt, Human
aaagugcugggagccacucacaggugugaa

SEQ ID NO: 581364 - RNA, 21 nt, Human
aaccccgugccucccaccugc

SEQ ID NO: 581365 - RNA, 25 nt, Human
aaccgcggccgcgggauccgcaacc

SEQ ID NO: 581366 - RNA, 18 nt, Human
aagcaguccucccuccuc

SEQ ID NO: 581367 - RNA, 25 nt, Human
aagcaguccucccuccucggccucu

SEQ ID NO: 581368 - RNA, 20 nt, Human
aagcugccucuucaacccca

SEQ ID NO: 581369 - RNA, 21 nt, Human
aagcugccucuucaaccccag

SEQ ID NO: 581370 - RNA, 29 nt, Human
aagcugccucuucaaccccagcucugccc

SEQ ID NO: 581371 - RNA, 23 nt, Human
acccugggacacacagagcuuua

SEQ ID NO: 581372 - RNA, 18 nt, Human
acgccacuguacuccagc

SEQ ID NO: 581373 - RNA, 22 nt, Human
acgccacuguacuccagccugg

SEQ ID NO: 581374 - RNA, 21 nt, Human
acugcagucccagcuacucag

SEQ ID NO: 581375 - RNA, 24 nt, Human
acuguacuccagccugggugacag

SEQ ID NO: 581376 - RNA, 21 nt, Human
agagauugguggggggagggc

SEQ ID NO: 581377 - RNA, 24 nt, Human
aggcaggaggaugucuugagcccg

SEQ ID NO: 581378 - RNA, 24 nt, Human
aggccgaggcaggaggaugucuug

SEQ ID NO: 581379 - RNA, 24 nt, Human
aucacgccacuguacuccagccug

SEQ ID NO: 581380 - RNA, 21 nt, Human
caaacaacagaaacuggcugg

SEQ ID NO: 581381 - RNA, 24 nt, Human
caaagugcugggagccacucacag

SEQ ID NO: 581382 - RNA, 24 nt, Human
caaccccagcucugccgggggcuc

SEQ ID NO: 581383 - RNA, 22 nt, Human
cacacagagcuuuacggugggg

SEQ ID NO: 581384 - RNA, 24 nt, Human
cacaggugugagccaccacgccca

SEQ ID NO: 581385 - RNA, 18 nt, Human
caccacgcccagcagagc

SEQ ID NO: 581386 - RNA, 19 nt, Human
cacuguacuccagccuggg

SEQ ID NO: 581387 - RNA, 19 nt, Human
cacuguacuccagccuggg

SEQ ID NO: 581388 - RNA, 19 nt, Human
cacuguacuccagccuggg

SEQ ID NO: 581389 - RNA, 19 nt, Human
cacuguacuccagccuggg

SEQ ID NO: 581390 - RNA, 22 nt, Human
cacuguacuccagccuggguga

SEQ ID NO: 581391 - RNA, 24 nt, Human
cacuguacuccagccugggugaca

SEQ ID NO: 581392 - RNA, 24 nt, Human
cacuguacuccagccugggugaca

SEQ ID NO: 581393 - RNA, 24 nt, Human
cagcuacucaggaggccgaggcag

SEQ ID NO: 581394 - RNA, 20 nt, Human
ccacgcccagcagagcuucg

SEQ ID NO: 581395 - RNA, 20 nt, Human
ccacuguacuccagccuggg

SEQ ID NO: 581396 - RNA, 20 nt, Human
ccacuguacuccagccuggg

SEQ ID NO: 581397 - RNA, 21 nt, Human
ccacuguacuccagccugggu

SEQ ID NO: 581398 - RNA, 21 nt, Human
ccacuguacuccagccugggu

SEQ ID NO: 581399 - RNA, 23 nt, Human
ccacuguacuccagccuggguga

SEQ ID NO: 581400 - RNA, 24 nt, Human
ccacuguacuccagccugggugac

SEQ ID NO: 581401 - RNA, 19 nt, Human
ccucccuccucggccucuc

SEQ ID NO: 581402 - RNA, 27 nt, Human
cgcgggauccgcaaccccgugccuccc

SEQ ID NO: 581403 - RNA, 18 nt, Human
cgugaugugcaggcuggu

SEQ ID NO: 581404 - RNA, 24 nt, Human
cgugaugugcaggcuggucuugaa

SEQ ID NO: 581405 - RNA, 19 nt, Human
cucacaggugugagccacc

SEQ ID NO: 581406 - RNA, 22 nt, Human
cucccaccugcccggcuaggga

SEQ ID NO: 581407 - RNA, 21 nt, Human
cugcagucccagcuacucagg

SEQ ID NO: 581408 - RNA, 19 nt, Human
gccacuguacuccagccug

SEQ ID NO: 581409 - RNA, 24 nt, Human
gccacuguacuccagccuggguga

SEQ ID NO: 581410 - RNA, 24 nt, Human
gcccgggaggucaaggcugcagug

SEQ ID NO: 581411 - RNA, 21 nt, Human
gccugggugacaggaagaccc

SEQ ID NO: 581412 - RNA, 21 nt, Human
ggcuuacaacugcagucccag

SEQ ID NO: 581413 - RNA, 23 nt, Human
gggauccgcaaccccgugccucc

SEQ ID NO: 581414 - RNA, 19 nt, Human
guacuccagccugggugac

SEQ ID NO: 581415 - RNA, 21 nt, Human
guccgaaccgcggccgcggga

SEQ ID NO: 581416 - RNA, 24 nt, Human
guggcuuacaacugcagucccagc

SEQ ID NO: 581417 - RNA, 18 nt, Human
uacuccagccugggugac

SEQ ID NO: 581418 - RNA, 20 nt, Human
uacuccagccugggugacag

SEQ ID NO: 581419 - RNA, 24 nt, Human
uacuccagccugggugacaggaag

SEQ ID NO: 581420 - RNA, 29 nt, Human
ucaaagugcugggagccacucacaggugu

SEQ ID NO: 581421 - RNA, 30 nt, Human
ucaaagugcugggagccacucacagguguu

SEQ ID NO: 581422 - RNA, 18 nt, Human
ucacaggugugagccacc

SEQ ID NO: 581423 - RNA, 19 nt, Human
ucacaggugugagccacca

SEQ ID NO: 581424 - RNA, 23 nt, Human
ucacgccacuguacuccagccug

SEQ ID NO: 581425 - RNA, 18 nt, Human
uccagccugggugacagg

SEQ ID NO: 581426 - RNA, 21 nt, Human
uccgcaaccccgugccuccca

SEQ ID NO: 581427 - RNA, 18 nt, Human
ucucaaagugcugggagc

SEQ ID NO: 581428 - RNA, 24 nt, Human
ucucgugaugugcaggcuggucuu

SEQ ID NO: 581429 - RNA, 23 nt, Human
ucuggcuucaagcaguccucccu

SEQ ID NO: 581430 - RNA, 24 nt, Human
ucuugaacuucuggcuucaagcag

SEQ ID NO: 581431 - RNA, 24 nt, Human
ugaacuucuggcuucaagcagucc

SEQ ID NO: 581432 - RNA, 24 nt, Human
ugagcccgggaggucaaggcugca

SEQ ID NO: 581433 - RNA, 19 nt, Human
uggcuucaagcaguccucc

SEQ ID NO: 581434 - RNA, 20 nt, Human
uggcuucaagcaguccuccc

SEQ ID NO: 581435 - RNA, 27 nt, Human
ugggagccacucacaggucgaccuggu

SEQ ID NO: 581436 - RNA, 21 nt, Human
ugggggcuucaaacaacagaa

SEQ ID NO: 581437 - RNA, 26 nt, Human
ugggugacaggaagacccugggacac

SEQ ID NO: 581438 - RNA, 24 nt, Human
ugugaucacgccacuguacuccag

SEQ ID NO: 581439 - RNA, 24 nt, Human
ugugcaggcuggucuugaacuucu

SEQ ID NO: 581440 - RNA, 22 nt, Human
aaaaaaaaaaaaggaacaaaag

SEQ ID NO: 581441 - RNA, 22 nt, Human
aaaaaaaaaaaaggaacaaaag

SEQ ID NO: 581442 - RNA, 22 nt, Human
aaaaaaaaaaaggaacaaaagg

SEQ ID NO: 581443 - RNA, 18 nt, Human
aaaaacaaauaaggauuu

SEQ ID NO: 581444 - RNA, 19 nt, Human
aaaagaaugcccagaggca

SEQ ID NO: 581445 - RNA, 21 nt, Human
aaaaucacgguauguuaucac

SEQ ID NO: 581446 - RNA, 21 nt, Human
aaagauuucuccuuaaccucc

SEQ ID NO: 581447 - RNA, 18 nt, Human
aaccacagacucaaaguc

SEQ ID NO: 581448 - RNA, 21 nt, Human
aagaaaaaaaaaaaaaaagga

SEQ ID NO: 581449 - RNA, 24 nt, Human
aagaaauccucacucauuacuauc

SEQ ID NO: 581450 - RNA, 25 nt, Human
aagauuucuccuuaaccuccuacua

SEQ ID NO: 581451 - RNA, 18 nt, Human
aagcaucauagcucagag

SEQ ID NO: 581452 - RNA, 21 nt, Human
aagccucuuccugaaugcucc

SEQ ID NO: 581453 - RNA, 25 nt, Human
acaagacaaaggauagagaacaaaa

SEQ ID NO: 581454 - RNA, 18 nt, Human
accaguucucagcuggug

SEQ ID NO: 581455 - RNA, 24 nt, Human
acccaggaaaggugacacaacucc

SEQ ID NO: 581456 - RNA, 25 nt, Human
acccaggaaaggugacacaacucuu

SEQ ID NO: 581457 - RNA, 21 nt, Human
accuguuucuuucaugcugug

SEQ ID NO: 581458 - RNA, 21 nt, Human
accuuuuuuuuuuuuuugcaa

SEQ ID NO: 581459 - RNA, 23 nt, Human
acuuccccacccaccccuuagug

SEQ ID NO: 581460 - RNA, 27 nt, Human
agaaaaaaaaaaaaaaaggaacaaaag

SEQ ID NO: 581461 - RNA, 19 nt, Human
agaaaaacaaggugcucag

SEQ ID NO: 581462 - RNA, 21 nt, Human
agaaaacccaaaucacccagg

SEQ ID NO: 581463 - RNA, 20 nt, Human
agaacaaaagauaguccucc

SEQ ID NO: 581464 - RNA, 26 nt, Human
agauggccuaguauauuuucuaaaac

SEQ ID NO: 581465 - RNA, 23 nt, Human
aggauuuuuauuugcaguacuuu

SEQ ID NO: 581466 - RNA, 22 nt, Human
agguuacaggcuuggaagggca

SEQ ID NO: 581467 - RNA, 18 nt, Human
aucccccacaacucagua

SEQ ID NO: 581468 - RNA, 18 nt, Human
auggagaaaacccaaauc

SEQ ID NO: 581469 - RNA, 24 nt, Human
auggccuggagguugucuucaacu

SEQ ID NO: 581470 - RNA, 29 nt, Human
auuacaaagucuacaaaaacaaauaaggg

SEQ ID NO: 581471 - RNA, 19 nt, Human
caaaagaaugcccagaggc

SEQ ID NO: 581472 - RNA, 20 nt, Human
caagacaaaggauagagaac

SEQ ID NO: 581473 - RNA, 18 nt, Human
cacccaggaaaggugaca

SEQ ID NO: 581474 - RNA, 22 nt, Human
cacccaggaaaggugacacaac

SEQ ID NO: 581475 - RNA, 18 nt, Human
caccccuuagugcuccca

SEQ ID NO: 581476 - RNA, 23 nt, Human
caccucaaagaaacacugauggg

SEQ ID NO: 581477 - RNA, 22 nt, Human
cacucuaacaagacaaaggaua

SEQ ID NO: 581478 - RNA, 24 nt, Human
cacucuaacaagacaaaggauaga

SEQ ID NO: 581479 - RNA, 21 nt, Human
cagaacaguaaaagaaaaaaa

SEQ ID NO: 581480 - RNA, 22 nt, Human
cagauggccuaguauauuuucu

SEQ ID NO: 581481 - RNA, 19 nt, Human
cagccaacaugauaagggc

SEQ ID NO: 581482 - RNA, 22 nt, Human
cauuccuagaacaaaaaaaaag

SEQ ID NO: 581483 - RNA, 24 nt, Human
cccccacaacucaguagagagguu

SEQ ID NO: 581484 - RNA, 24 nt, Human
ccuuuuuuuuuuuuuugcaauccc

SEQ ID NO: 581485 - RNA, 18 nt, Human
cuacaagcuccuugaaug

SEQ ID NO: 581486 - RNA, 19 nt, Human
cuaugugccaguucagagc

SEQ ID NO: 581487 - RNA, 20 nt, Human
cucacucauuacuaucaccg

SEQ ID NO: 581488 - RNA, 26 nt, Human
cucacucauuacuaucacuguauucc

SEQ ID NO: 581489 - RNA, 24 nt, Human
cuccauggcccauacaaggacucc

SEQ ID NO: 581490 - RNA, 23 nt, Human
cuccuacuaaaaacuaaaauuaa

SEQ ID NO: 581491 - RNA, 21 nt, Human
cugcuccuaacccaaccuguu

SEQ ID NO: 581492 - RNA, 23 nt, Human
cuguagcauuccauuccuucugc

SEQ ID NO: 581493 - RNA, 20 nt, Human
cuguggucacuccugcuggc

SEQ ID NO: 581494 - RNA, 20 nt, Human
cuuccuuuaaaaacuugcca

SEQ ID NO: 581495 - RNA, 24 nt, Human
cuugaguaaaucacacagaccucu

SEQ ID NO: 581496 - RNA, 19 nt, Human
cuuucuagcaugagcucag

SEQ ID NO: 581497 - RNA, 23 nt, Human
gagcccaccuaggccagaaccag

SEQ ID NO: 581498 - RNA, 20 nt, Human
gcagcugccuccuuuccucc

SEQ ID NO: 581499 - RNA, 28 nt, Human
gccaacuucccuaaugcaaucaccucaa

SEQ ID NO: 581500 - RNA, 23 nt, Human
gggcugagacuucggccccacag

SEQ ID NO: 581501 - RNA, 21 nt, Human
gucaaacccuaguaugaauaa

SEQ ID NO: 581502 - RNA, 18 nt, Human
gugaaccacagacucaaa

SEQ ID NO: 581503 - RNA, 22 nt, Human
guucuagagcccaccuaggcca

SEQ ID NO: 581504 - RNA, 20 nt, Human
guuucagguucugcagugcu

SEQ ID NO: 581505 - RNA, 19 nt, Human
uaaaugguucuagagccca

SEQ ID NO: 581506 - RNA, 21 nt, Human
uaacaagacaaaggauagaga

SEQ ID NO: 581507 - RNA, 19 nt, Human
uaacauacaacauaucccc

SEQ ID NO: 581508 - RNA, 21 nt, Human
uacuaugugccaguucagagc

SEQ ID NO: 581509 - RNA, 18 nt, Human
uaucccccacaacucagu

SEQ ID NO: 581510 - RNA, 23 nt, Human
ucacugagcuguccccucccugu

SEQ ID NO: 581511 - RNA, 18 nt, Human
ucacuuccccacccaccc

SEQ ID NO: 581512 - RNA, 20 nt, Human
ucacuuccccacccaccccu

SEQ ID NO: 581513 - RNA, 20 nt, Human
ucagaacaguaaaagaaaaa

SEQ ID NO: 581514 - RNA, 25 nt, Human
ucagaacaguaaaagaaaaaaaaaa

SEQ ID NO: 581515 - RNA, 27 nt, Human
ucagagcuacaagcuccuugaauggag

SEQ ID NO: 581516 - RNA, 20 nt, Human
ucccaauaaaagcaucauag

SEQ ID NO: 581517 - RNA, 23 nt, Human
ucccaauaaaagcaucauagcuc

SEQ ID NO: 581518 - RNA, 25 nt, Human
ucccagagccaacuucccuaaugca

SEQ ID NO: 581519 - RNA, 24 nt, Human
uccccacccaccccuuagugcucc

SEQ ID NO: 581520 - RNA, 20 nt, Human
uccuugaauggagaaaaccc

SEQ ID NO: 581521 - RNA, 20 nt, Human
uccuuuaaaaacuugccauu

SEQ ID NO: 581522 - RNA, 19 nt, Human
ucuccauggcccauacaag

SEQ ID NO: 581523 - RNA, 23 nt, Human
ucuccauggcccauacaaggacu

SEQ ID NO: 581524 - RNA, 22 nt, Human
ugaaccacagacucaaagucuu

SEQ ID NO: 581525 - RNA, 18 nt, Human
ugacccacucuaacaaga

SEQ ID NO: 581526 - RNA, 20 nt, Human
ugacugggcugaguagagag

SEQ ID NO: 581527 - RNA, 19 nt, Human
ugaguaaaucacacagaag

SEQ ID NO: 581528 - RNA, 19 nt, Human
ugcagugcuuauaagguag

SEQ ID NO: 581529 - RNA, 20 nt, Human
uggagaaaacccaaaucacc

SEQ ID NO: 581530 - RNA, 20 nt, Human
uggagaaaacccaaaucacc

SEQ ID NO: 581531 - RNA, 22 nt, Human
uggcaaaauaugacugggcuga

SEQ ID NO: 581532 - RNA, 21 nt, Human
uggcagugaucucucuuuggc

SEQ ID NO: 581533 - RNA, 22 nt, Human
uggcaucucaagcagcagggga

SEQ ID NO: 581534 - RNA, 27 nt, Human
uucagaacaguaaaagaaaaaaaaaaa

SEQ ID NO: 581535 - RNA, 19 nt, Human
uucuagagcccaccuaggc

SEQ ID NO: 581536 - RNA, 19 nt, Human
uuuaaagagaaagggggaa

SEQ ID NO: 581537 - RNA, 20 nt, Human
uuuuuuuuuugcaaucccag

SEQ ID NO: 581538 - RNA, 25 nt, Human
aacucgcugccgggcagcucccccg

SEQ ID NO: 581539 - RNA, 21 nt, Human
aagcauuacacuucauuccuu

SEQ ID NO: 581540 - RNA, 19 nt, Human
aaggccccugccggcuccc

SEQ ID NO: 581541 - RNA, 21 nt, Human
acccgcggcacccgggccccg

SEQ ID NO: 581542 - RNA, 18 nt, Human
acccgggccccgcggcuc

SEQ ID NO: 581543 - RNA, 24 nt, Human
agaggcccggcucccucggccccc

SEQ ID NO: 581544 - RNA, 20 nt, Human
agccccugggccgcccggcc

SEQ ID NO: 581545 - RNA, 19 nt, Human
aggggguuucgaaggcccc

SEQ ID NO: 581546 - RNA, 21 nt, Human
cacaacaguucgcuccccccg

SEQ ID NO: 581547 - RNA, 18 nt, Human
cagccgcuccccaaggac

SEQ ID NO: 581548 - RNA, 21 nt, Human
cagcggggcaaacucgcugcc

SEQ ID NO: 581549 - RNA, 24 nt, Human
ccacaacaguucgcuccccccgcc

SEQ ID NO: 581550 - RNA, 22 nt, Human
ccagcccgggcgcugcccugcc

SEQ ID NO: 581551 - RNA, 19 nt, Human
ccccaaggacuccgggccu

SEQ ID NO: 581552 - RNA, 30 nt, Human
ccccaaggacuccgggccuggguugccagg

SEQ ID NO: 581553 - RNA, 18 nt, Human
cccccgggguggcgcggc

SEQ ID NO: 581554 - RNA, 22 nt, Human
ccccgccccgggccggucccuc

SEQ ID NO: 581555 - RNA, 19 nt, Human
ccccgcguccgagaggccc

SEQ ID NO: 581556 - RNA, 23 nt, Human
ccccgguaggccacuccgcggcc

SEQ ID NO: 581557 - RNA, 23 nt, Human
cccgcggcacccgggccccgcgg

SEQ ID NO: 581558 - RNA, 24 nt, Human
cccgcggcagccccugggccgccc

SEQ ID NO: 581559 - RNA, 19 nt, Human
cccggaggagccuucugcc

SEQ ID NO: 581560 - RNA, 21 nt, Human
cccggccucgaacccgcggcc

SEQ ID NO: 581561 - RNA, 21 nt, Human
cccgggccccgcggcucgucc

SEQ ID NO: 581562 - RNA, 21 nt, Human
cccucugggggaggguccccg

SEQ ID NO: 581563 - RNA, 22 nt, Human
cccugccccgcguccgagaggc

SEQ ID NO: 581564 - RNA, 22 nt, Human
cccuucgcgggacagcggaagu

SEQ ID NO: 581565 - RNA, 19 nt, Human
ccgagaggcccggcucccu

SEQ ID NO: 581566 - RNA, 27 nt, Human
ccgcaccacaacaguucgcuccccccg

SEQ ID NO: 581567 - RNA, 18 nt, Human
ccgcggcucguccggccc

SEQ ID NO: 581568 - RNA, 18 nt, Human
ccggaagcccccuuccuc

SEQ ID NO: 581569 - RNA, 19 nt, Human
ccggcccacuccaccccug

SEQ ID NO: 581570 - RNA, 20 nt, Human
ccgggggucacccggaggag

SEQ ID NO: 581571 - RNA, 21 nt, Human
ccucccggcucgaggccccgg

SEQ ID NO: 581572 - RNA, 23 nt, Human
ccuccggaagcccccuuccuccc

SEQ ID NO: 581573 - RNA, 26 nt, Human
ccucgaacccgcggcacccgggcccc

SEQ ID NO: 581574 - RNA, 21 nt, Human
ccucgcgcggggcccggccuc

SEQ ID NO: 581575 - RNA, 21 nt, Human
cgccccgagucccgcggcagc

SEQ ID NO: 581576 - RNA, 20 nt, Human
cgccgcccgccgaacgcucc

SEQ ID NO: 581577 - RNA, 21 nt, Human
cggaagcccccuuccucccgg

SEQ ID NO: 581578 - RNA, 25 nt, Human
cggcucccgcggcucgcagggcccc

SEQ ID NO: 581579 - RNA, 24 nt, Human
cggcucgcagggccccgccggggg

SEQ ID NO: 581580 - RNA, 18 nt, Human
cucccgccuucuuucggc

SEQ ID NO: 581581 - RNA, 26 nt, Human
cuccgcaccacaacaguucgcucccc

SEQ ID NO: 581582 - RNA, 19 nt, Human
cuccgcggccgcgcuugcc

SEQ ID NO: 581583 - RNA, 19 nt, Human
cuccgggccuggguugcca

SEQ ID NO: 581584 - RNA, 22 nt, Human
gccccgagucccgcggcagccc

SEQ ID NO: 581585 - RNA, 22 nt, Human
gccgaacgcuccgcaccacaac

SEQ ID NO: 581586 - RNA, 22 nt, Human
gcggcacccgggccccgcggcu

SEQ ID NO: 581587 - RNA, 22 nt, Human
gcggccgcgcuugccgcggggc

SEQ ID NO: 581588 - RNA, 24 nt, Human
gcugcccugccccgcguccgagag

SEQ ID NO: 581589 - RNA, 23 nt, Human
ggcccacuccaccccugcagcca

SEQ ID NO: 581590 - RNA, 21 nt, Human
ggcccccggcccuccgccucc

SEQ ID NO: 581591 - RNA, 19 nt, Human
gggguguccgggagggcgu

SEQ ID NO: 581592 - RNA, 21 nt, Human
gggguuucgaaggccccugcc

SEQ ID NO: 581593 - RNA, 22 nt, Human
guguccgggagggcgucccagg

SEQ ID NO: 581594 - RNA, 19 nt, Human
uaugggcuuaaauguagua

SEQ ID NO: 581595 - RNA, 18 nt, Human
ucccagaguccgucucca

SEQ ID NO: 581596 - RNA, 20 nt, Human
ucccucggcccccggcccuc

SEQ ID NO: 581597 - RNA, 22 nt, Human
uccgggccuggguugccagggg

SEQ ID NO: 581598 - RNA, 18 nt, Human
ucgaaggccccugccggc

SEQ ID NO: 581599 - RNA, 24 nt, Human
ugagacccccgcagccgagggucc

SEQ ID NO: 581600 - RNA, 21 nt, Human
aggccguggcuggcgcggccg

SEQ ID NO: 581601 - RNA, 19 nt, Human
cagcacaaagcgcgucucc

SEQ ID NO: 581602 - RNA, 21 nt, Human
cccccgcccgcccccggcccc

SEQ ID NO: 581603 - RNA, 23 nt, Human
cccccgcccgcccccggccccgc

SEQ ID NO: 581604 - RNA, 19 nt, Human
ccccgcccgcccccggccc

SEQ ID NO: 581605 - RNA, 20 nt, Human
cccgcccccggccccgccgc

SEQ ID NO: 581606 - RNA, 19 nt, Human
cccucggcccgccccccgc

SEQ ID NO: 581607 - RNA, 21 nt, Human
ccgcgcccucggcccgccccc

SEQ ID NO: 581608 - RNA, 22 nt, Human
ccgcgcccucggcccgcccccc

SEQ ID NO: 581609 - RNA, 23 nt, Human
ccgcgcccucggcccgccccccg

SEQ ID NO: 581610 - RNA, 19 nt, Human
cggccgcccgcgcccucgg

SEQ ID NO: 581611 - RNA, 22 nt, Human
cguggcuggcgcggccggcgcc

SEQ ID NO: 581612 - RNA, 20 nt, Human
gccgcaggccguggcuggcg

SEQ ID NO: 581613 - RNA, 18 nt, Human
gcuggcgcggccggcgcc

SEQ ID NO: 581614 - RNA, 20 nt, Human
guacaaggauacgauggaag

SEQ ID NO: 581615 - RNA, 20 nt, Human
uggaagaagccacuaugggc

SEQ ID NO: 581616 - RNA, 20 nt, Human
uggaagaagccacuaugggc

SEQ ID NO: 581617 - RNA, 19 nt, Human
uggcgcggccggcgcccag

SEQ ID NO: 581618 - RNA, 19 nt, Human
aaacaagaauaaacagcug

SEQ ID NO: 581619 - RNA, 22 nt, Human
aaagcaaacaaggcugaaauac

SEQ ID NO: 581620 - RNA, 21 nt, Human
aacaaaguaaauauuacaguu

SEQ ID NO: 581621 - RNA, 20 nt, Human
aacagcgagggagaagggaa

SEQ ID NO: 581622 - RNA, 18 nt, Human
aagcaaacaaggcugaaa

SEQ ID NO: 581623 - RNA, 18 nt, Human
aagguggacagaaaagga

SEQ ID NO: 581624 - RNA, 18 nt, Human
acaaaaagucaaacaaga

SEQ ID NO: 581625 - RNA, 22 nt, Human
acacagaagagccaucuccaaa

SEQ ID NO: 581626 - RNA, 21 nt, Human
agaagagccaucuccaaagaa

SEQ ID NO: 581627 - RNA, 26 nt, Human
agacggagguagaagagaggggaccc

SEQ ID NO: 581628 - RNA, 19 nt, Human
agcaaggaauucagaagag

SEQ ID NO: 581629 - RNA, 21 nt, Human
agcucagugacugucaggaac

SEQ ID NO: 581630 - RNA, 18 nt, Human
aggaaauguugaaaauag

SEQ ID NO: 581631 - RNA, 19 nt, Human
aggaaauguugaaaauagc

SEQ ID NO: 581632 - RNA, 18 nt, Human
aggcuggggcugagccuc

SEQ ID NO: 581633 - RNA, 22 nt, Human
aguguggauucuccaagagaga

SEQ ID NO: 581634 - RNA, 18 nt, Human
auccagcaaaccgcuaac

SEQ ID NO: 581635 - RNA, 18 nt, Human
caagaaacccacagucac

SEQ ID NO: 581636 - RNA, 22 nt, Human
caagaaacccacagucacagga

SEQ ID NO: 581637 - RNA, 26 nt, Human
caagagagauggguuguuggggaggc

SEQ ID NO: 581638 - RNA, 20 nt, Human
caagcgagucuccuccgccc

SEQ ID NO: 581639 - RNA, 18 nt, Human
cacacgcgaaucacgcac

SEQ ID NO: 581640 - RNA, 22 nt, Human
cacagcucugcgugcccgcggc

SEQ ID NO: 581641 - RNA, 24 nt, Human
cacaucuaacuccucuacuaguuc

SEQ ID NO: 581642 - RNA, 21 nt, Human
cacgacacugguuuccacacg

SEQ ID NO: 581643 - RNA, 19 nt, Human
cacugaagaaaagcgagac

SEQ ID NO: 581644 - RNA, 21 nt, Human
cagacccgaucgagccagagg

SEQ ID NO: 581645 - RNA, 22 nt, Human
cagcaaggaauucagaagagaa

SEQ ID NO: 581646 - RNA, 18 nt, Human
cagcagauuuaaagugac

SEQ ID NO: 581647 - RNA, 18 nt, Human
cagccugagcggcggaga

SEQ ID NO: 581648 - RNA, 19 nt, Human
cagggucugggaggugagg

SEQ ID NO: 581649 - RNA, 24 nt, Human
caucuaacuccucuacuaguucua

SEQ ID NO: 581650 - RNA, 22 nt, Human
ccacaagccaacccguaauugc

SEQ ID NO: 581651 - RNA, 19 nt, Human
ccccgcgcgcgucccccuc

SEQ ID NO: 581652 - RNA, 23 nt, Human
ccccgcgcgcgucccccucuccu

SEQ ID NO: 581653 - RNA, 25 nt, Human
cccguaauugcaaagcaaacaaggc

SEQ ID NO: 581654 - RNA, 26 nt, Human
ccucccugcagugacuccgcgggucg

SEQ ID NO: 581655 - RNA, 18 nt, Human
ccuccgccgccucccccc

SEQ ID NO: 581656 - RNA, 18 nt, Human
cgagaagagggcugggga

SEQ ID NO: 581657 - RNA, 19 nt, Human
cgcgcgucccccucuccuc

SEQ ID NO: 581658 - RNA, 21 nt, Human
cggagguagaagagagaggga

SEQ ID NO: 581659 - RNA, 18 nt, Human
cuccggcgaaagguccuc

SEQ ID NO: 581660 - RNA, 19 nt, Human
cugcagugacuccgcgggu

SEQ ID NO: 581661 - RNA, 24 nt, Human
cuucauuugugggagggaguuggg

SEQ ID NO: 581662 - RNA, 26 nt, Human
gaacgcacccagcagcugauuuacac

SEQ ID NO: 581663 - RNA, 19 nt, Human
gaccuagaagaaacgaagu

SEQ ID NO: 581664 - RNA, 25 nt, Human
gacgguauucacccuauuucucuua

SEQ ID NO: 581665 - RNA, 20 nt, Human
gagacggagcugggggucca

SEQ ID NO: 581666 - RNA, 21 nt, Human
gagaggagaagcaguaucugg

SEQ ID NO: 581667 - RNA, 21 nt, Human
gagggaagcggaggccuuagc

SEQ ID NO: 581668 - RNA, 23 nt, Human
gaggugacauaugcaugcccaga

SEQ ID NO: 581669 - RNA, 23 nt, Human
gaguugggggagagaggagaagc

SEQ ID NO: 581670 - RNA, 20 nt, Human
gaucacucagcuaaucgugg

SEQ ID NO: 581671 - RNA, 19 nt, Human
gcagauuuaaagugacuuu

SEQ ID NO: 581672 - RNA, 20 nt, Human
gccuagagucggcccugcuc

SEQ ID NO: 581673 - RNA, 21 nt, Human
gcucaugguuaaccccuuccu

SEQ ID NO: 581674 - RNA, 21 nt, Human
ggaccuagaagaaacgaagug

SEQ ID NO: 581675 - RNA, 21 nt, Human
ggaggcucaugguuaaccccu

SEQ ID NO: 581676 - RNA, 20 nt, Human
ggaguugggggagagaggag

SEQ ID NO: 581677 - RNA, 18 nt, Human
gggaggcucaugguuaac

SEQ ID NO: 581678 - RNA, 19 nt, Human
gguagaagagagagggaag

SEQ ID NO: 581679 - RNA, 18 nt, Human
gguguggggaaccgagaa

SEQ ID NO: 581680 - RNA, 21 nt, Human
uaaccccuuccugcucgccuc

SEQ ID NO: 581681 - RNA, 27 nt, Human
uagacgguauucacccuauuucucuua

SEQ ID NO: 581682 - RNA, 22 nt, Human
uaucuggaaaggcucccuggag

SEQ ID NO: 581683 - RNA, 23 nt, Human
ucacucagcuaaucguggggugc

SEQ ID NO: 581684 - RNA, 19 nt, Human
ucagaagagaaaacuucau

SEQ ID NO: 581685 - RNA, 22 nt, Human
uccaaagaauuaaaagugggcc

SEQ ID NO: 581686 - RNA, 27 nt, Human
uccacuacuguucugcugauacaaacu

SEQ ID NO: 581687 - RNA, 19 nt, Human
ucccccucuccucccugca

SEQ ID NO: 581688 - RNA, 21 nt, Human
ucccugcagugacuccgcggg

SEQ ID NO: 581689 - RNA, 23 nt, Human
ucuaacuccucuacuaguucuaa

SEQ ID NO: 581690 - RNA, 22 nt, Human
ucuccaaagaauuaaaaguggg

SEQ ID NO: 581691 - RNA, 18 nt, Human
ucuguuugugcagcucua

SEQ ID NO: 581692 - RNA, 21 nt, Human
ugaagaaaagcgagacggagg

SEQ ID NO: 581693 - RNA, 26 nt, Human
ugaagaaaagcgagacggagguagaa

SEQ ID NO: 581694 - RNA, 23 nt, Human
ugacaguaccagcaaggaauuca

SEQ ID NO: 581695 - RNA, 23 nt, Human
ugagaccucaggagggaagcgga

SEQ ID NO: 581696 - RNA, 24 nt, Human
ugcaaagcaaacaaggcugaaaua

SEQ ID NO: 581697 - RNA, 20 nt, Human
ugcagcagauuuaaagugac

SEQ ID NO: 581698 - RNA, 23 nt, Human
ugcaugcccagagaucuacccaa

SEQ ID NO: 581699 - RNA, 24 nt, Human
ugcaugcccagagaucuacccaaa

SEQ ID NO: 581700 - RNA, 18 nt, Human
ugcccuagaucacucagc

SEQ ID NO: 581701 - RNA, 20 nt, Human
ugcccuagaucacucagcua

SEQ ID NO: 581702 - RNA, 26 nt, Human
ugcuuuauucuuucugcagcagauuu

SEQ ID NO: 581703 - RNA, 19 nt, Human
uggcaccguagccacaagc

SEQ ID NO: 581704 - RNA, 20 nt, Human
uggcaccguagccacaagcc

SEQ ID NO: 581705 - RNA, 21 nt, Human
ugggaggcucaugguuaaccc

SEQ ID NO: 581706 - RNA, 20 nt, Human
ugggagggaguugggggaga

SEQ ID NO: 581707 - RNA, 20 nt, Human
ugggagugggcaccaggaag

SEQ ID NO: 581708 - RNA, 21 nt, Human
uggggaaacuaagacuuagag

SEQ ID NO: 581709 - RNA, 18 nt, Human
ugucugugaaauauaagg

SEQ ID NO: 581710 - RNA, 23 nt, Human
uucaaaauaaaggaaacuaaucu

SEQ ID NO: 581711 - RNA, 26 nt, Human
uucaaaauaaaggaaacuaaucugau

SEQ ID NO: 581712 - RNA, 22 nt, Human
uucaacagcagccaagauuuaa

SEQ ID NO: 581713 - RNA, 20 nt, Human
uucugcagcagauuuaaagu

SEQ ID NO: 581714 - RNA, 23 nt, Human
uuggagaugaaaauuuguucccu

SEQ ID NO: 581715 - RNA, 18 nt, Human
uuuguacaaaaagucaaa

SEQ ID NO: 581716 - RNA, 21 nt, Human
uuuguacaaaaagucaaacaa

SEQ ID NO: 581717 - RNA, 21 nt, Human
uuugugggagggaguuggggg

SEQ ID NO: 581718 - RNA, 24 nt, Human
aacaaggagacacagguaggagga

SEQ ID NO: 581719 - RNA, 21 nt, Human
aaccacaugacugaguuugag

SEQ ID NO: 581720 - RNA, 24 nt, Human
acacagcagucuccagaucgucug

SEQ ID NO: 581721 - RNA, 22 nt, Human
accuguaguuccgugggucccg

SEQ ID NO: 581722 - RNA, 22 nt, Human
acucacacacacauaccacaca

SEQ ID NO: 581723 - RNA, 23 nt, Human
aggugggucagagucuggccagg

SEQ ID NO: 581724 - RNA, 18 nt, Human
agucugauccaugccugc

SEQ ID NO: 581725 - RNA, 25 nt, Human
augcacacucacacacacauaccac

SEQ ID NO: 581726 - RNA, 18 nt, Human
caaagacaagcuugugca

SEQ ID NO: 581727 - RNA, 22 nt, Human
caagccuagcugugcguccccu

SEQ ID NO: 581728 - RNA, 23 nt, Human
cacacauaccacacaaagacaag

SEQ ID NO: 581729 - RNA, 21 nt, Human
cacacucacacacacauacca

SEQ ID NO: 581730 - RNA, 25 nt, Human
cagcuccugagcucagcaggacccu

SEQ ID NO: 581731 - RNA, 21 nt, Human
caggaccccaaaacaaggaga

SEQ ID NO: 581732 - RNA, 27 nt, Human
caggaccccaaaacaaggagacacagg

SEQ ID NO: 581733 - RNA, 18 nt, Human
ccaaaacaaggagacaca

SEQ ID NO: 581734 - RNA, 21 nt, Human
ccaacugaugccucgugcccc

SEQ ID NO: 581735 - RNA, 23 nt, Human
ccacacaaagacaagcuugugca

SEQ ID NO: 581736 - RNA, 19 nt, Human
ccccaaaacaaggagacac

SEQ ID NO: 581737 - RNA, 20 nt, Human
cccucaacacacagcagucu

SEQ ID NO: 581738 - RNA, 21 nt, Human
ccucaacacacagcagucucc

SEQ ID NO: 581739 - RNA, 21 nt, Human
ccucagcccagccccaggagu

SEQ ID NO: 581740 - RNA, 24 nt, Human
cggccuuuaugcugggccugggcu

SEQ ID NO: 581741 - RNA, 21 nt, Human
cucacccugccccacaccugu

SEQ ID NO: 581742 - RNA, 19 nt, Human
cucuucccaacugaugccu

SEQ ID NO: 581743 - RNA, 21 nt, Human
cugacucugcccccuggacac

SEQ ID NO: 581744 - RNA, 21 nt, Human
cugcugcacuggcaaggugac

SEQ ID NO: 581745 - RNA, 24 nt, Human
cuucccaacugaugccucgugccc

SEQ ID NO: 581746 - RNA, 19 nt, Human
cuuuaugcugggccugggc

SEQ ID NO: 581747 - RNA, 18 nt, Human
gagacacagguaggagga

SEQ ID NO: 581748 - RNA, 22 nt, Human
gagucuggaguggggaaugggg

SEQ ID NO: 581749 - RNA, 18 nt, Human
gccccuagcuugcagucu

SEQ ID NO: 581750 - RNA, 19 nt, Human
gccugcugcacuggcaagg

SEQ ID NO: 581751 - RNA, 25 nt, Human
gccugggcuggggggccuggggaca

SEQ ID NO: 581752 - RNA, 24 nt, Human
gccuuuaugcugggccugggcugg

SEQ ID NO: 581753 - RNA, 19 nt, Human
ggacaacuggagucuggag

SEQ ID NO: 581754 - RNA, 21 nt, Human
ggacugaggcugggucagagu

SEQ ID NO: 581755 - RNA, 19 nt, Human
ggggaaugggguaguuugg

SEQ ID NO: 581756 - RNA, 23 nt, Human
gggggccccccaacacggccuuu

SEQ ID NO: 581757 - RNA, 22 nt, Human
gggggccuggggacaucccgau

SEQ ID NO: 581758 - RNA, 21 nt, Human
ggggugccccucaccccagcu

SEQ ID NO: 581759 - RNA, 28 nt, Human
gucaggaccccaaaacaaggggcucuuc

SEQ ID NO: 581760 - RNA, 22 nt, Human
uaaaaaaaaguaccagguacaa

SEQ ID NO: 581761 - RNA, 18 nt, Human
uaacuuggcuuucagaga

SEQ ID NO: 581762 - RNA, 19 nt, Human
uaccacacaaagacaagcu

SEQ ID NO: 581763 - RNA, 19 nt, Human
uagcuugcagucugaucca

SEQ ID NO: 581764 - RNA, 23 nt, Human
ucaacacacagcagucuccagau

SEQ ID NO: 581765 - RNA, 22 nt, Human
ucacacacacauaccacacaaa

SEQ ID NO: 581766 - RNA, 20 nt, Human
uccacgcucacccugcccca

SEQ ID NO: 581767 - RNA, 21 nt, Human
uccgcgucccuucuuccacgc

SEQ ID NO: 581768 - RNA, 20 nt, Human
uccugagcucagcaggaccc

SEQ ID NO: 581769 - RNA, 21 nt, Human
uccugagcucagcaggacccu

SEQ ID NO: 581770 - RNA, 19 nt, Human
ucguaucuucccucaacac

SEQ ID NO: 581771 - RNA, 22 nt, Human
ucuucagucaggaccccaaaac

SEQ ID NO: 581772 - RNA, 21 nt, Human
ugacucugcccccuggacacc

SEQ ID NO: 581773 - RNA, 23 nt, Human
ugagaggaggcaccccagugcuu

SEQ ID NO: 581774 - RNA, 25 nt, Human
ugagaggaggcaccccagugcuugg

SEQ ID NO: 581775 - RNA, 19 nt, Human
ugagguaggugggucagag

SEQ ID NO: 581776 - RNA, 27 nt, Human
ugagguaggugggucagagucuggcca

SEQ ID NO: 581777 - RNA, 22 nt, Human
ugcaaagcgcacccccauccgc

SEQ ID NO: 581778 - RNA, 20 nt, Human
ugcacacucacacacacaua

SEQ ID NO: 581779 - RNA, 23 nt, Human
ugcacacucacacacacauacca

SEQ ID NO: 581780 - RNA, 19 nt, Human
ugcagcuccugagcucagc

SEQ ID NO: 581781 - RNA, 24 nt, Human
ugccccuagcuugcagucugaucc

SEQ ID NO: 581782 - RNA, 22 nt, Human
ugccucgugccccuagcuugca

SEQ ID NO: 581783 - RNA, 26 nt, Human
ugcuuguuccccucagcccagcccca

SEQ ID NO: 581784 - RNA, 18 nt, Human
ugcuuuguuuuuucaagu

SEQ ID NO: 581785 - RNA, 22 nt, Human
ugcuuuguuuuuucaaguuuca

SEQ ID NO: 581786 - RNA, 19 nt, Human
ugggccugggcuggggggc

SEQ ID NO: 581787 - RNA, 21 nt, Human
ugugcacacacacauacgcag

SEQ ID NO: 581788 - RNA, 24 nt, Human
ugugcacacacacauacgcauaac

SEQ ID NO: 581789 - RNA, 23 nt, Human
ugugcacacacacauacgcauag

SEQ ID NO: 581790 - RNA, 26 nt, Human
ugugugcauacaugcacacucacaca

SEQ ID NO: 581791 - RNA, 26 nt, Human
ugugugcauacaugcacacucacaca

SEQ ID NO: 581792 - RNA, 24 nt, Human
uuaggacugaggcugggucagagu

SEQ ID NO: 581793 - RNA, 19 nt, Human
uuccccucagcccagcccc

SEQ ID NO: 581794 - RNA, 21 nt, Human
uuccccucagcccagccccag

SEQ ID NO: 581795 - RNA, 18 nt, Human
aaaacugauaaaaaggag

SEQ ID NO: 581796 - RNA, 19 nt, Human
aaacuggccucuuucucca

SEQ ID NO: 581797 - RNA, 20 nt, Human
aacuuccucccccagaucuu

SEQ ID NO: 581798 - RNA, 23 nt, Human
aacuuccucccccagaucuucca

SEQ ID NO: 581799 - RNA, 20 nt, Human
accauaguccuaccaccuaa

SEQ ID NO: 581800 - RNA, 21 nt, Human
accuaaagaacacucacugac

SEQ ID NO: 581801 - RNA, 23 nt, Human
acuuccucccccagaucuuccau

SEQ ID NO: 581802 - RNA, 22 nt, Human
agaaaagagaacagacagaaga

SEQ ID NO: 581803 - RNA, 23 nt, Human
agacagaagauaagagaagagaa

SEQ ID NO: 581804 - RNA, 26 nt, Human
agacagaagauaagagaagagggacc

SEQ ID NO: 581805 - RNA, 22 nt, Human
agagaaaagagaacagacagaa

SEQ ID NO: 581806 - RNA, 18 nt, Human
agagaacagacagaagau

SEQ ID NO: 581807 - RNA, 20 nt, Human
agagaaggguauacagucug

SEQ ID NO: 581808 - RNA, 22 nt, Human
auacaauagaccacauauccag

SEQ ID NO: 581809 - RNA, 20 nt, Human
caaaacugauaaaaaggaga

SEQ ID NO: 581810 - RNA, 22 nt, Human
caauaucugcugauugaucuaa

SEQ ID NO: 581811 - RNA, 23 nt, Human
cacaccaaaacugauaaaaagga

SEQ ID NO: 581812 - RNA, 19 nt, Human
caccuaaagaacacucacu

SEQ ID NO: 581813 - RNA, 24 nt, Human
ccaaaauaauaccugguauaccgg

SEQ ID NO: 581814 - RNA, 23 nt, Human
ccacaccaaaacugauaaaaagg

SEQ ID NO: 581815 - RNA, 27 nt, Human
cccaaaauaauaccugguauaccggac

SEQ ID NO: 581816 - RNA, 19 nt, Human
ccuugaacuuccuccccca

SEQ ID NO: 581817 - RNA, 21 nt, Human
cucuauauaaggcauaaaggu

SEQ ID NO: 581818 - RNA, 21 nt, Human
gacagaagauaagagaagaga

SEQ ID NO: 581819 - RNA, 21 nt, Human
gagggagagaaaagagaacag

SEQ ID NO: 581820 - RNA, 20 nt, Human
gcugcaaacaugaguuguac

SEQ ID NO: 581821 - RNA, 18 nt, Human
ggugagagagagagagag

SEQ ID NO: 581822 - RNA, 21 nt, Human
uaacaaguuuaauauugaaaa

SEQ ID NO: 581823 - RNA, 25 nt, Human
uacauaucauacacuuuuguguaua

SEQ ID NO: 581824 - RNA, 21 nt, Human
uagcuuaccccaaaauaauac

SEQ ID NO: 581825 - RNA, 19 nt, Human
uaucuguaccacucaguug

SEQ ID NO: 581826 - RNA, 28 nt, Human
ucucuauauaaggcauaaaggugagggu

SEQ ID NO: 581827 - RNA, 22 nt, Human
ugaaagccuauuuaaacuggcc

SEQ ID NO: 581828 - RNA, 20 nt, Human
ugagggagggagagaaaaga

SEQ ID NO: 581829 - RNA, 22 nt, Human
ugagggagggagagaaaagaga

SEQ ID NO: 581830 - RNA, 28 nt, Human
ugagggagggagagaaaagagaacaaca

SEQ ID NO: 581831 - RNA, 22 nt, Human
uggugccuuccuugaacuuccu

SEQ ID NO: 581832 - RNA, 24 nt, Human
uguacuuguuagcuuaccccaaaa

SEQ ID NO: 581833 - RNA, 24 nt, Human
ugugauguaugucuuauguuucca

SEQ ID NO: 581834 - RNA, 19 nt, Human
uguguauaaugugauguau

SEQ ID NO: 581835 - RNA, 22 nt, Human
uuaaagcuuucaggucaccuag

SEQ ID NO: 581836 - RNA, 23 nt, Human
uuccaugucauaucuguaccacu

SEQ ID NO: 581837 - RNA, 22 nt, Human
uucugguguggugccuuccuug

SEQ ID NO: 581838 - RNA, 21 nt, Human
uugaaaaucugaaaaaggcag

SEQ ID NO: 581839 - RNA, 23 nt, Human
aaaugcugggauuacaggcguga

SEQ ID NO: 581840 - RNA, 26 nt, Human
aaaugcugggauuacaggcgugagcc

SEQ ID NO: 581841 - RNA, 19 nt, Human
aaucugcucaucugauccg

SEQ ID NO: 581842 - RNA, 21 nt, Human
aauuccuauguuucuucaaau

SEQ ID NO: 581843 - RNA, 24 nt, Human
acacugaccuucacuaaccaaucu

SEQ ID NO: 581844 - RNA, 18 nt, Human
acaguaauggaagcaucc

SEQ ID NO: 581845 - RNA, 24 nt, Human
acucuuguugcccaggcuggagug

SEQ ID NO: 581846 - RNA, 19 nt, Human
agaaacacagcaacugacc

SEQ ID NO: 581847 - RNA, 20 nt, Human
agaaacacagcaacugacca

SEQ ID NO: 581848 - RNA, 24 nt, Human
agagauucuccugccucagccucc

SEQ ID NO: 581849 - RNA, 24 nt, Human
agguaauccacccacaucagccuc

SEQ ID NO: 581850 - RNA, 18 nt, Human
aguagcugggauuacagg

SEQ ID NO: 581851 - RNA, 18 nt, Human
augggguuucaccauauu

SEQ ID NO: 581852 - RNA, 24 nt, Human
augggguuucaccauauuggccag

SEQ ID NO: 581853 - RNA, 21 nt, Human
caaacagagagaugaacaagc

SEQ ID NO: 581854 - RNA, 23 nt, Human
caaauacucuucaauccuccaga

SEQ ID NO: 581855 - RNA, 22 nt, Human
caagagauucuccugccucagc

SEQ ID NO: 581856 - RNA, 23 nt, Human
cacagcaacugaccaaacagaga

SEQ ID NO: 581857 - RNA, 23 nt, Human
cacaucagccucccaaaugcugg

SEQ ID NO: 581858 - RNA, 18 nt, Human
caccauauuggccaggcc

SEQ ID NO: 581859 - RNA, 21 nt, Human
caccauauuggccaggccggu

SEQ ID NO: 581860 - RNA, 24 nt, Human
caccauauuggccaggccggucuc

SEQ ID NO: 581861 - RNA, 25 nt, Human
caccauguccagcuaauuuuuugua

SEQ ID NO: 581862 - RNA, 19 nt, Human
cacccacaucagccuccca

SEQ ID NO: 581863 - RNA, 21 nt, Human
cacccacaucagccucccaaa

SEQ ID NO: 581864 - RNA, 24 nt, Human
cacucuuguugcccaggcuggagu

SEQ ID NO: 581865 - RNA, 18 nt, Human
cacugcaaccucugccuc

SEQ ID NO: 581866 - RNA, 19 nt, Human
cagacuucaaauacucuuc

SEQ ID NO: 581867 - RNA, 24 nt, Human
cagccaaugcucuuuccagaaauu

SEQ ID NO: 581868 - RNA, 24 nt, Human
cauauuggccaggccggucucgaa

SEQ ID NO: 581869 - RNA, 19 nt, Human
ccaaacagagagaugaaca

SEQ ID NO: 581870 - RNA, 19 nt, Human
ccaaaugcugggauuacag

SEQ ID NO: 581871 - RNA, 21 nt, Human
ccaaaugcugggauuacaggc

SEQ ID NO: 581872 - RNA, 23 nt, Human
ccaaaugcugggauuacaggcgu

SEQ ID NO: 581873 - RNA, 24 nt, Human
ccaaaugcugggauuacaggcgug

SEQ ID NO: 581874 - RNA, 23 nt, Human
ccacccacaucagccucccaaau

SEQ ID NO: 581875 - RNA, 24 nt, Human
cccaaaugcugggauuacaggcgu

SEQ ID NO: 581876 - RNA, 19 nt, Human
cccaggcuggagugcaaug

SEQ ID NO: 581877 - RNA, 23 nt, Human
cccaggcuggagugcaauggagc

SEQ ID NO: 581878 - RNA, 23 nt, Human
cccuaguagcugggauuacaggu

SEQ ID NO: 581879 - RNA, 23 nt, Human
ccuaguagcugggauuacaggua

SEQ ID NO: 581880 - RNA, 18 nt, Human
ccucccaaaugcugggau

SEQ ID NO: 581881 - RNA, 24 nt, Human
ccucucagguucaagagauucucc

SEQ ID NO: 581882 - RNA, 24 nt, Human
ccugacgucagguaauccacccac

SEQ ID NO: 581883 - RNA, 20 nt, Human
cgagacaguaauggaagcau

SEQ ID NO: 581884 - RNA, 20 nt, Human
cuaguagcugggauuacagg

SEQ ID NO: 581885 - RNA, 24 nt, Human
cucacucuuguugcccaggcugga

SEQ ID NO: 581886 - RNA, 24 nt, Human
cucacugcaaccucugccucucag

SEQ ID NO: 581887 - RNA, 24 nt, Human
cucagccucccuaguagcugggau

SEQ ID NO: 581888 - RNA, 21 nt, Human
cucagguucaagagauucucc

SEQ ID NO: 581889 - RNA, 20 nt, Human
cuccaaaauuccacuuauga

SEQ ID NO: 581890 - RNA, 24 nt, Human
cuccagaagcuucucaagcucaga

SEQ ID NO: 581891 - RNA, 18 nt, Human
cucuuguugcccaggcug

SEQ ID NO: 581892 - RNA, 24 nt, Human
cugcaaccucugccucucagguuc

SEQ ID NO: 581893 - RNA, 23 nt, Human
cugccucagccucccuaguagcu

SEQ ID NO: 581894 - RNA, 23 nt, Human
gaaauuuucacaagccuuucacu

SEQ ID NO: 581895 - RNA, 22 nt, Human
gaacaagccagccaaugcucuu

SEQ ID NO: 581896 - RNA, 22 nt, Human
gaagcuucucaagcucagaaac

SEQ ID NO: 581897 - RNA, 19 nt, Human
gaccucggcucacugcaac

SEQ ID NO: 581898 - RNA, 23 nt, Human
gagaugggguuucaccauauugg

SEQ ID NO: 581899 - RNA, 24 nt, Human
gagaugggguuucaccauauuggc

SEQ ID NO: 581900 - RNA, 24 nt, Human
gagauucuccugccucagccuccc

SEQ ID NO: 581901 - RNA, 18 nt, Human
gauuacaggcgugagcca

SEQ ID NO: 581902 - RNA, 21 nt, Human
gauuacaggcgugagccacua

SEQ ID NO: 581903 - RNA, 22 nt, Human
gauuacaggcgugagccacuac

SEQ ID NO: 581904 - RNA, 22 nt, Human
gauuacagguacccaccaccau

SEQ ID NO: 581905 - RNA, 19 nt, Human
gcccaggcuggagugcaau

SEQ ID NO: 581906 - RNA, 22 nt, Human
ggcagaaacacagcaacugacc

SEQ ID NO: 581907 - RNA, 19 nt, Human
ggcuggagugcaauggagc

SEQ ID NO: 581908 - RNA, 18 nt, Human
gggguuucaccauauugg

SEQ ID NO: 581909 - RNA, 22 nt, Human
gggguuucaccauauuggccag

SEQ ID NO: 581910 - RNA, 24 nt, Human
guaauccacccacaucagccuccc

SEQ ID NO: 581911 - RNA, 24 nt, Human
uaauccacccacaucagccuccca

SEQ ID NO: 581912 - RNA, 24 nt, Human
uaauuuuuuguauuuuuaguagag

SEQ ID NO: 581913 - RNA, 25 nt, Human
uaauuuuuuguauuuuuaguagaga

SEQ ID NO: 581914 - RNA, 23 nt, Human
uacaggcgugagccacuacaccc

SEQ ID NO: 581915 - RNA, 24 nt, Human
uacagguacccaccaccaugucca

SEQ ID NO: 581916 - RNA, 19 nt, Human
uaguagagaugggguuuca

SEQ ID NO: 581917 - RNA, 23 nt, Human
uaguagagaugggguuucaccau

SEQ ID NO: 581918 - RNA, 26 nt, Human
uaguagagaugggguuucaccauauu

SEQ ID NO: 581919 - RNA, 25 nt, Human
uaguagcugggauuacagguaccca

SEQ ID NO: 581920 - RNA, 21 nt, Human
ucaauccuccagaagcuucuc

SEQ ID NO: 581921 - RNA, 19 nt, Human
ucacugcaaccucugccuc

SEQ ID NO: 581922 - RNA, 24 nt, Human
ucacugcaaccucugccucucagg

SEQ ID NO: 581923 - RNA, 24 nt, Human
ucagaaacaaucuucuucucacac

SEQ ID NO: 581924 - RNA, 22 nt, Human
ucagugcaaagccauucuuuuu

SEQ ID NO: 581925 - RNA, 21 nt, Human
uccacccacaucagccuccca

SEQ ID NO: 581926 - RNA, 24 nt, Human
uccagaaauuuucacaagccuuuc

SEQ ID NO: 581927 - RNA, 22 nt, Human
ucccaaaugcugggauuacagg

SEQ ID NO: 581928 - RNA, 23 nt, Human
ucccaaaugcugggauuacaggc

SEQ ID NO: 581929 - RNA, 24 nt, Human
ucccaaaugcugggauuacaggcg

SEQ ID NO: 581930 - RNA, 23 nt, Human
ucccuaguagcugggauuacagg

SEQ ID NO: 581931 - RNA, 24 nt, Human
ucccuaguagcugggauuacaggu

SEQ ID NO: 581932 - RNA, 24 nt, Human
ucucacucuuguugcccaggcugg

SEQ ID NO: 581933 - RNA, 25 nt, Human
ucucacucuuguugcccaggcugga

SEQ ID NO: 581934 - RNA, 21 nt, Human
ucucagguucaagagauucuc

SEQ ID NO: 581935 - RNA, 24 nt, Human
ucucagguucaagagauucuccug

SEQ ID NO: 581936 - RNA, 21 nt, Human
ucuccaaaauuccacuuauga

SEQ ID NO: 581937 - RNA, 25 nt, Human
ucuccugccucagccucccuaguag

SEQ ID NO: 581938 - RNA, 22 nt, Human
ucuuguugcccaggcuggagug

SEQ ID NO: 581939 - RNA, 22 nt, Human
ugaacaagccagccaaugcugu

SEQ ID NO: 581940 - RNA, 21 nt, Human
ugacacagacuucaaauacuc

SEQ ID NO: 581941 - RNA, 20 nt, Human
ugcaauggagcgaccucggc

SEQ ID NO: 581942 - RNA, 18 nt, Human
ugcccaggcuggagugca

SEQ ID NO: 581943 - RNA, 21 nt, Human
ugcccaggcuggagugcaaug

SEQ ID NO: 581944 - RNA, 25 nt, Human
ugcccaggcuggagugcaauggagc

SEQ ID NO: 581945 - RNA, 24 nt, Human
ugccucagccucccuaguagcugg

SEQ ID NO: 581946 - RNA, 19 nt, Human
ugcucagugcaaagccauu

SEQ ID NO: 581947 - RNA, 24 nt, Human
ugcugggauuacaggcgugagcca

SEQ ID NO: 581948 - RNA, 24 nt, Human
uggccaggccggucucgaauuccu

SEQ ID NO: 581949 - RNA, 18 nt, Human
ugggauuacaggcgugag

SEQ ID NO: 581950 - RNA, 19 nt, Human
ugggauuacaggcgugagc

SEQ ID NO: 581951 - RNA, 21 nt, Human
ugggauuacaggcgugagcca

SEQ ID NO: 581952 - RNA, 22 nt, Human
ugggauuacaggcgugagccac

SEQ ID NO: 581953 - RNA, 22 nt, Human
ugggauuacaggcgugagccac

SEQ ID NO: 581954 - RNA, 23 nt, Human
ugggauuacaggcgugagccacu

SEQ ID NO: 581955 - RNA, 24 nt, Human
ugggauuacaggcgugagccacua

SEQ ID NO: 581956 - RNA, 26 nt, Human
ugggauuacaggcgugagccacuaca

SEQ ID NO: 581957 - RNA, 19 nt, Human
ugggauuacagguacccac

SEQ ID NO: 581958 - RNA, 21 nt, Human
ugggauuacagguacccacca

SEQ ID NO: 581959 - RNA, 24 nt, Human
ugggauuacagguacccaccacca

SEQ ID NO: 581960 - RNA, 25 nt, Human
ugggauuacagguacccaccaccau

SEQ ID NO: 581961 - RNA, 24 nt, Human
ugggguuucaccauauuggccagg

SEQ ID NO: 581962 - RNA, 21 nt, Human
uguauuuuuaguagagauggg

SEQ ID NO: 581963 - RNA, 20 nt, Human
uguugcccaggcuggagugc

SEQ ID NO: 581964 - RNA, 22 nt, Human
uguugcccaggcuggagugcaa

SEQ ID NO: 581965 - RNA, 21 nt, Human
uuaauuccccuucacuaaccc

SEQ ID NO: 581966 - RNA, 18 nt, Human
uuaguagagaugggguuu

SEQ ID NO: 581967 - RNA, 22 nt, Human
uuaguagagaugggguuucacc

SEQ ID NO: 581968 - RNA, 24 nt, Human
uuaguagagaugggguuucaccau

SEQ ID NO: 581969 - RNA, 23 nt, Human
uucaagagauucuccugccucag

SEQ ID NO: 581970 - RNA, 18 nt, Human
uugcccaggcuggagugc

SEQ ID NO: 581971 - RNA, 24 nt, Human
uuucaccauauuggccaggccggu

SEQ ID NO: 581972 - RNA, 24 nt, Human
uuuuuaguagagaugggguuucac

SEQ ID NO: 581973 - RNA, 21 nt, Human
uuuuuguauuuuuaguagaga

SEQ ID NO: 581974 - RNA, 24 nt, Human
uuuuuuguauuuuuaguagagaug

SEQ ID NO: 581975 - RNA, 30 nt, Human
caaggucagauuugucuucugccagcgccc

SEQ ID NO: 581976 - RNA, 20 nt, Human
cacgacacgggcagcgcgua

SEQ ID NO: 581977 - RNA, 26 nt, Human
cacgcacgacacgggcagcgcguagc

SEQ ID NO: 581978 - RNA, 21 nt, Human
cacuguuuucaaggucagauu

SEQ ID NO: 581979 - RNA, 27 nt, Human
caggcucaggccguucugcuucucuag

SEQ ID NO: 581980 - RNA, 22 nt, Human
cccauaaucuuuaaccucucca

SEQ ID NO: 581981 - RNA, 18 nt, Human
cccucaggucucugugua

SEQ ID NO: 581982 - RNA, 18 nt, Human
ccgccccucaggucucug

SEQ ID NO: 581983 - RNA, 26 nt, Human
cgcacgcacgacacgggcagcgcgua

SEQ ID NO: 581984 - RNA, 19 nt, Human
cgcucggcuuccgccccuc

SEQ ID NO: 581985 - RNA, 22 nt, Human
cggcuuccgccccucaggucuc

SEQ ID NO: 581986 - RNA, 19 nt, Human
cgguacacggcguacaccu

SEQ ID NO: 581987 - RNA, 22 nt, Human
cgguacacggcguacaccuucu

SEQ ID NO: 581988 - RNA, 24 nt, Human
cguucugcuucucuagccgagcca

SEQ ID NO: 581989 - RNA, 22 nt, Human
cucugugccuggcgaggccucc

SEQ ID NO: 581990 - RNA, 20 nt, Human
gcagacguuguccuccagga

SEQ ID NO: 581991 - RNA, 23 nt, Human
gggcagcgcguagcagacguugu

SEQ ID NO: 581992 - RNA, 20 nt, Human
ggggggcucucgggcccggc

SEQ ID NO: 581993 - RNA, 27 nt, Human
ggucagauuugucuucugccagcgccc

SEQ ID NO: 581994 - RNA, 20 nt, Human
guggagcaacagcgcgcccc

SEQ ID NO: 581995 - RNA, 19 nt, Human
uagccgagccaccacugcc

SEQ ID NO: 581996 - RNA, 19 nt, Human
ucaggccguucugcuucuc

SEQ ID NO: 581997 - RNA, 18 nt, Human
ucgcgcacgcacgacacg

SEQ ID NO: 581998 - RNA, 19 nt, Human
ucgcucggcuuccgccccu

SEQ ID NO: 581999 - RNA, 23 nt, Human
ucgcucggcuuccgccccucagg

SEQ ID NO: 582000 - RNA, 22 nt, Human
ucucgggcccggcgcccaauuc

SEQ ID NO: 582001 - RNA, 23 nt, Human
ucucuguguaggacaacgagaau

SEQ ID NO: 582002 - RNA, 22 nt, Human
ugccucgaugcucuugugcgcc

SEQ ID NO: 582003 - RNA, 20 nt, Human
uucaaggucagauuugucuu

SEQ ID NO: 582004 - RNA, 22 nt, Human
aaaaaaacaaacccaagauuua

SEQ ID NO: 582005 - RNA, 20 nt, Human
aaaaacacaaaacacuauua

SEQ ID NO: 582006 - RNA, 24 nt, Human
aaaaggacaugacuagaugaaaua

SEQ ID NO: 582007 - RNA, 22 nt, Human
acaaaacacuauuaugccaaac

SEQ ID NO: 582008 - RNA, 21 nt, Human
accacugcuaauuuagaggac

SEQ ID NO: 582009 - RNA, 25 nt, Human
agauaggaaggaaauacuuaacuag

SEQ ID NO: 582010 - RNA, 23 nt, Human
aggaaggaaauacuuaacuagua

SEQ ID NO: 582011 - RNA, 24 nt, Human
caaugagaaaaaaaacacaaaaca

SEQ ID NO: 582012 - RNA, 22 nt, Human
cacaaaacacuauuaugccaaa

SEQ ID NO: 582013 - RNA, 23 nt, Human
cacugcuaauuuagaggaccaaa

SEQ ID NO: 582014 - RNA, 20 nt, Human
caggugaaaaacaagggcug

SEQ ID NO: 582015 - RNA, 24 nt, Human
cauauucuacaggugaaaaacaag

SEQ ID NO: 582016 - RNA, 24 nt, Human
cauguauauuugugugugugugua

SEQ ID NO: 582017 - RNA, 25 nt, Human
cauguauauuuguguguguguguau

SEQ ID NO: 582018 - RNA, 20 nt, Human
cauucuguguauguaugugc

SEQ ID NO: 582019 - RNA, 20 nt, Human
cauucuguguauguaugugg

SEQ ID NO: 582020 - RNA, 26 nt, Human
cccccucgcccuagcaggcucgggaa

SEQ ID NO: 582021 - RNA, 24 nt, Human
cuugaucgccaugucaguuucuug

SEQ ID NO: 582022 - RNA, 20 nt, Human
gagaaaaaaaacacaaaacc

SEQ ID NO: 582023 - RNA, 20 nt, Human
gggcugcauuauuuuuaaac

SEQ ID NO: 582024 - RNA, 20 nt, Human
guauauuugugugugugugu

SEQ ID NO: 582025 - RNA, 19 nt, Human
uacugcauucuguguaugu

SEQ ID NO: 582026 - RNA, 18 nt, Human
uauguaugugcauguaua

SEQ ID NO: 582027 - RNA, 22 nt, Human
uaugugcauguauauuugugug

SEQ ID NO: 582028 - RNA, 24 nt, Human
uaugugcauguauauuugugugug

SEQ ID NO: 582029 - RNA, 20 nt, Human
uauuucaaugagaaaaaaaa

SEQ ID NO: 582030 - RNA, 23 nt, Human
ucaucaaccauucaccccccucg

SEQ ID NO: 582031 - RNA, 19 nt, Human
ucuguguauguaugugcau

SEQ ID NO: 582032 - RNA, 18 nt, Human
ugaaauacaugccgaaaa

SEQ ID NO: 582033 - RNA, 18 nt, Human
ugagaaaaaaaacacaaa

SEQ ID NO: 582034 - RNA, 22 nt, Human
ugagaaaaaaaacacaaaacac

SEQ ID NO: 582035 - RNA, 19 nt, Human
ugcauguauauuugugugu

SEQ ID NO: 582036 - RNA, 18 nt, Human
ugcugaagggcguucucg

SEQ ID NO: 582037 - RNA, 20 nt, Human
uguauguaugugcauguaua

SEQ ID NO: 582038 - RNA, 21 nt, Human
ugugcauguauauuugugugu

SEQ ID NO: 582039 - RNA, 29 nt, Human
ugugcauguauauuuguguguguguguau

SEQ ID NO: 582040 - RNA, 22 nt, Human
uguguauguaugugcauguaua

SEQ ID NO: 582041 - RNA, 19 nt, Human
uguguguguaugcaagcuc

SEQ ID NO: 582042 - RNA, 21 nt, Human
uguguguguguguaugcaagc

SEQ ID NO: 582043 - RNA, 24 nt, Human
uucaaugagaaaaaaaacacaaaa

SEQ ID NO: 582044 - RNA, 23 nt, Human
aaaaagacccaaauauccgagua

SEQ ID NO: 582045 - RNA, 22 nt, Human
aaaacaguccccaaacaagccu

SEQ ID NO: 582046 - RNA, 22 nt, Human
aaaagacccaaauauccgagua

SEQ ID NO: 582047 - RNA, 19 nt, Human
aaaagccauaucuaccuuu

SEQ ID NO: 582048 - RNA, 18 nt, Human
aagaaagugcagggcaca

SEQ ID NO: 582049 - RNA, 19 nt, Human
aagagaaagagcgaagcug

SEQ ID NO: 582050 - RNA, 23 nt, Human
aagagcaccuguuauuuuucacc

SEQ ID NO: 582051 - RNA, 18 nt, Human
aagcagaacagggguaaa

SEQ ID NO: 582052 - RNA, 18 nt, Human
aagcuuccucuguccacu

SEQ ID NO: 582053 - RNA, 18 nt, Human
acacagauucucuccccu

SEQ ID NO: 582054 - RNA, 18 nt, Human
agagaaagagcgaagcug

SEQ ID NO: 582055 - RNA, 21 nt, Human
agcagaacagggguaaaggaa

SEQ ID NO: 582056 - RNA, 19 nt, Human
aggaaaggcaggaagagaa

SEQ ID NO: 582057 - RNA, 22 nt, Human
aggagagagaggucaccuuggg

SEQ ID NO: 582058 - RNA, 23 nt, Human
aggcaggaagagaaagaggggac

SEQ ID NO: 582059 - RNA, 19 nt, Human
agguacuucugggcuuggc

SEQ ID NO: 582060 - RNA, 23 nt, Human
auggaacacauggucucuacccc

SEQ ID NO: 582061 - RNA, 19 nt, Human
augguucugagaagaaauu

SEQ ID NO: 582062 - RNA, 24 nt, Human
auuagccccacaaacaaaauguuc

SEQ ID NO: 582063 - RNA, 20 nt, Human
caaaauccucccagucuuaa

SEQ ID NO: 582064 - RNA, 18 nt, Human
cacacagauucucucccc

SEQ ID NO: 582065 - RNA, 19 nt, Human
caccaggaaggauacauga

SEQ ID NO: 582066 - RNA, 21 nt, Human
caccaggaaggauacaugaua

SEQ ID NO: 582067 - RNA, 19 nt, Human
caccuguuauuuuucaccu

SEQ ID NO: 582068 - RNA, 18 nt, Human
caccuuauucaugccaag

SEQ ID NO: 582069 - RNA, 22 nt, Human
cacuuuguauacaagaucaguc

SEQ ID NO: 582070 - RNA, 18 nt, Human
caggaccaucccugggca

SEQ ID NO: 582071 - RNA, 25 nt, Human
cagggcagggucuaaagucucuauc

SEQ ID NO: 582072 - RNA, 25 nt, Human
caucaauguuccuaggaagacccuc

SEQ ID NO: 582073 - RNA, 19 nt, Human
ccaaauauccgaguaugga

SEQ ID NO: 582074 - RNA, 19 nt, Human
ccaggaaggauacaugaua

SEQ ID NO: 582075 - RNA, 21 nt, Human
ccuaccaggaagagucagacc

SEQ ID NO: 582076 - RNA, 22 nt, Human
cucaaaaagacccaaauauccg

SEQ ID NO: 582077 - RNA, 21 nt, Human
cuccaacuucccucuugaguu

SEQ ID NO: 582078 - RNA, 20 nt, Human
cucucucaaaaagacccaaa

SEQ ID NO: 582079 - RNA, 24 nt, Human
cugaaaucuucauucuugcaaccu

SEQ ID NO: 582080 - RNA, 20 nt, Human
cugcagcuucaauggccuca

SEQ ID NO: 582081 - RNA, 19 nt, Human
cuggcaccuuauucaugcc

SEQ ID NO: 582082 - RNA, 18 nt, Human
gcagcuucaauggccuca

SEQ ID NO: 582083 - RNA, 22 nt, Human
gcuucagcuuagacagcagagu

SEQ ID NO: 582084 - RNA, 21 nt, Human
ggaagacccucgcugcgagga

SEQ ID NO: 582085 - RNA, 24 nt, Human
ggcaggaccaucccugggcagggc

SEQ ID NO: 582086 - RNA, 18 nt, Human
ggcagggcuuccugcagc

SEQ ID NO: 582087 - RNA, 21 nt, Human
ggcagggcuuccugcagcuuc

SEQ ID NO: 582088 - RNA, 18 nt, Human
ggcuuccuggccuucuga

SEQ ID NO: 582089 - RNA, 21 nt, Human
gggcagggcuuccugcagcuu

SEQ ID NO: 582090 - RNA, 21 nt, Human
guaaaacaguccccaaacaag

SEQ ID NO: 582091 - RNA, 19 nt, Human
uaaaacaguccccaaacaa

SEQ ID NO: 582092 - RNA, 21 nt, Human
uaaaacaguccccaaacaagc

SEQ ID NO: 582093 - RNA, 19 nt, Human
uaaacaguaaagagcaccu

SEQ ID NO: 582094 - RNA, 21 nt, Human
uaaacaguaaagagcaccugu

SEQ ID NO: 582095 - RNA, 24 nt, Human
uaaacugaauucacacauaccuca

SEQ ID NO: 582096 - RNA, 22 nt, Human
uaaagucucuaucuaaagcuuc

SEQ ID NO: 582097 - RNA, 22 nt, Human
uaaggacuguccauaagcacac

SEQ ID NO: 582098 - RNA, 20 nt, Human
uaaggagaaaaggccuuuag

SEQ ID NO: 582099 - RNA, 21 nt, Human
uacaugauauccaugauagug

SEQ ID NO: 582100 - RNA, 19 nt, Human
uagcuaugacacuugaaca

SEQ ID NO: 582101 - RNA, 19 nt, Human
uauccgaguauggaacaca

SEQ ID NO: 582102 - RNA, 20 nt, Human
ucaaaaagacccaaauaucc

SEQ ID NO: 582103 - RNA, 22 nt, Human
ucaaaaagacccaaauauccga

SEQ ID NO: 582104 - RNA, 26 nt, Human
ucaguccucauuuguuucaauuuaug

SEQ ID NO: 582105 - RNA, 19 nt, Human
ucaugccaagcauaaugua

SEQ ID NO: 582106 - RNA, 25 nt, Human
uccccaaacaagccucugggcucau

SEQ ID NO: 582107 - RNA, 18 nt, Human
uccucuguccacugaaaa

SEQ ID NO: 582108 - RNA, 23 nt, Human
ucucucaaaaagacccaaauauc

SEQ ID NO: 582109 - RNA, 20 nt, Human
ucucugcaacagacauacuc

SEQ ID NO: 582110 - RNA, 23 nt, Human
ucuguaauuacaauagaccaaac

SEQ ID NO: 582111 - RNA, 22 nt, Human
ugaagaaagugcagggcacaga

SEQ ID NO: 582112 - RNA, 20 nt, Human
ugaggagagagaggucaccu

SEQ ID NO: 582113 - RNA, 21 nt, Human
ugcaacauucagaaacagcuu

SEQ ID NO: 582114 - RNA, 19 nt, Human
ugccuaguaguagcugaca

SEQ ID NO: 582115 - RNA, 18 nt, Human
ugcgaggaagaggcuuca

SEQ ID NO: 582116 - RNA, 19 nt, Human
uggcaggaccaucccuggg

SEQ ID NO: 582117 - RNA, 25 nt, Human
uggcaggagcagaauucacaaucuu

SEQ ID NO: 582118 - RNA, 19 nt, Human
ugggcagggcuuccugcag

SEQ ID NO: 582119 - RNA, 22 nt, Human
uuaauuuuccagucuucuacau

SEQ ID NO: 582120 - RNA, 18 nt, Human
uuccuggccuucugagcu

SEQ ID NO: 582121 - RNA, 18 nt, Human
uugaacacagugaagaaa

SEQ ID NO: 582122 - RNA, 23 nt, Human
uugcuggcuuccuggccuucuga

SEQ ID NO: 582123 - RNA, 21 nt, Human
uugggaaugugcccucuucga

SEQ ID NO: 582124 - RNA, 21 nt, Human
uuuaaacugcauucuucacaa

SEQ ID NO: 582125 - RNA, 24 nt, Human
uuuccuggcaccuuauucaugcca

SEQ ID NO: 582126 - RNA, 21 nt, Human
aaauauguacauggaaccccc

SEQ ID NO: 582127 - RNA, 18 nt, Human
aaggggacugagccauua

SEQ ID NO: 582128 - RNA, 21 nt, Human
acuuggaaauggggugaaggg

SEQ ID NO: 582129 - RNA, 24 nt, Human
agccccaccagggaaaaaagucaa

SEQ ID NO: 582130 - RNA, 21 nt, Human
agcccgcucggcaccggcccc

SEQ ID NO: 582131 - RNA, 21 nt, Human
agccuuugggggugggggcaa

SEQ ID NO: 582132 - RNA, 19 nt, Human
aggcuaggaacacagcacc

SEQ ID NO: 582133 - RNA, 22 nt, Human
aggcugagccuuuggggguggg

SEQ ID NO: 582134 - RNA, 23 nt, Human
aggcugggguugcugccgugagg

SEQ ID NO: 582135 - RNA, 21 nt, Human
aggggcaaagguguaccucag

SEQ ID NO: 582136 - RNA, 20 nt, Human
agguggccggaaauggucgg

SEQ ID NO: 582137 - RNA, 24 nt, Human
cacccuuagccuggggcaggguuu

SEQ ID NO: 582138 - RNA, 19 nt, Human
cagcccagguccccagguc

SEQ ID NO: 582139 - RNA, 21 nt, Human
cauggcccccgagaugagcca

SEQ ID NO: 582140 - RNA, 21 nt, Human
cauguugggggaaccggggcu

SEQ ID NO: 582141 - RNA, 20 nt, Human
ccaccccugggccgaccccc

SEQ ID NO: 582142 - RNA, 21 nt, Human
ccagaggcuaggaacacagca

SEQ ID NO: 582143 - RNA, 24 nt, Human
ccagcccuggcuuaaaaccucagc

SEQ ID NO: 582144 - RNA, 21 nt, Human
ccaugcacacgccccucuccc

SEQ ID NO: 582145 - RNA, 19 nt, Human
cccaccccugggccgaccc

SEQ ID NO: 582146 - RNA, 19 nt, Human
cccaggaguccugggggca

SEQ ID NO: 582147 - RNA, 18 nt, Human
ccccaccuucccagggag

SEQ ID NO: 582148 - RNA, 23 nt, Human
cccccugcagggagccaaaggag

SEQ ID NO: 582149 - RNA, 20 nt, Human
cccccuguuggucaucuccu

SEQ ID NO: 582150 - RNA, 19 nt, Human
ccccgacccccccccguuc

SEQ ID NO: 582151 - RNA, 22 nt, Human
ccccgacccccccccguucccu

SEQ ID NO: 582152 - RNA, 18 nt, Human
ccccgagaugagccacac

SEQ ID NO: 582153 - RNA, 20 nt, Human
ccccugcagggagccaaagg

SEQ ID NO: 582154 - RNA, 21 nt, Human
ccccuguaaaaauguacaaaa

SEQ ID NO: 582155 - RNA, 22 nt, Human
ccccuuccuugagccccuccuc

SEQ ID NO: 582156 - RNA, 20 nt, Human
cccuccagcccaggucccca

SEQ ID NO: 582157 - RNA, 20 nt, Human
ccucaaagguggccggaaau

SEQ ID NO: 582158 - RNA, 22 nt, Human
ccucagcccuaggaccugguua

SEQ ID NO: 582159 - RNA, 30 nt, Human
ccuccagcccuggcuuaaaaccucagcccc

SEQ ID NO: 582160 - RNA, 25 nt, Human
ccuccucccccagcccucggagggc

SEQ ID NO: 582161 - RNA, 23 nt, Human
ccucugcucucccagugacccua

SEQ ID NO: 582162 - RNA, 18 nt, Human
ccugcaguccccuuuccc

SEQ ID NO: 582163 - RNA, 22 nt, Human
ccuucuagguugggccccagcc

SEQ ID NO: 582164 - RNA, 21 nt, Human
ccuugagccccuccuccccca

SEQ ID NO: 582165 - RNA, 27 nt, Human
cucggcaccggccccagucgugguggc

SEQ ID NO: 582166 - RNA, 20 nt, Human
cugcccuucccuccagccca

SEQ ID NO: 582167 - RNA, 18 nt, Human
gagaggccagaggcuagg

SEQ ID NO: 582168 - RNA, 23 nt, Human
gagaggccagaggcuaggaacac

SEQ ID NO: 582169 - RNA, 20 nt, Human
gaggcugagccuuugggggu

SEQ ID NO: 582170 - RNA, 24 nt, Human
gccccagccuggaggcgccugcug

SEQ ID NO: 582171 - RNA, 20 nt, Human
gccccuccucccccagcccu

SEQ ID NO: 582172 - RNA, 19 nt, Human
gcccucggagggcaugagg

SEQ ID NO: 582173 - RNA, 19 nt, Human
gcccuggcuuaaaaccuca

SEQ ID NO: 582174 - RNA, 19 nt, Human
gcccuuacaggggcaaagg

SEQ ID NO: 582175 - RNA, 20 nt, Human
gcgccugcugcuuugggaag

SEQ ID NO: 582176 - RNA, 21 nt, Human
gcuggaaggcccccugcaggg

SEQ ID NO: 582177 - RNA, 20 nt, Human
ggaagcagggcccaggaguc

SEQ ID NO: 582178 - RNA, 21 nt, Human
ggaaggcccccugcagggagc

SEQ ID NO: 582179 - RNA, 18 nt, Human
ggagcuuugccccgaccc

SEQ ID NO: 582180 - RNA, 22 nt, Human
ggaggcaggcccagggccuaga

SEQ ID NO: 582181 - RNA, 18 nt, Human
ggaggccccauggccccc

SEQ ID NO: 582182 - RNA, 21 nt, Human
ggcacuuggaaauggggugaa

SEQ ID NO: 582183 - RNA, 19 nt, Human
ggcccaggaguccuggggg

SEQ ID NO: 582184 - RNA, 19 nt, Human
ggcuggaaggcccccugca

SEQ ID NO: 582185 - RNA, 20 nt, Human
gggcaggguuuuggagaaca

SEQ ID NO: 582186 - RNA, 23 nt, Human
gggcaggguuuuggagaacaggg

SEQ ID NO: 582187 - RNA, 20 nt, Human
gggggcacuuuggccucugg

SEQ ID NO: 582188 - RNA, 20 nt, Human
ggguuuuggagaacaggguu

SEQ ID NO: 582189 - RNA, 23 nt, Human
gguggccggaaauggucggggau

SEQ ID NO: 582190 - RNA, 21 nt, Human
ggugggggcagagugaacggg

SEQ ID NO: 582191 - RNA, 21 nt, Human
ggugguaggugaacgggaggg

SEQ ID NO: 582192 - RNA, 23 nt, Human
gucccuucccggcucuucccccu

SEQ ID NO: 582193 - RNA, 18 nt, Human
uaauuaaccaggaaggga

SEQ ID NO: 582194 - RNA, 19 nt, Human
uagaggcccuuacaggggc

SEQ ID NO: 582195 - RNA, 25 nt, Human
uaugugaaaggggugauaaauaugu

SEQ ID NO: 582196 - RNA, 19 nt, Human
ucagggaagcagggcccag

SEQ ID NO: 582197 - RNA, 19 nt, Human
ucccagguuccaugaccuc

SEQ ID NO: 582198 - RNA, 19 nt, Human
ucccaugcacacgccccuc

SEQ ID NO: 582199 - RNA, 21 nt, Human
uccccagguccugcccccugu

SEQ ID NO: 582200 - RNA, 22 nt, Human
ucccugguuuccucaaaggugg

SEQ ID NO: 582201 - RNA, 22 nt, Human
ucggcaccggccccagucgugg

SEQ ID NO: 582202 - RNA, 19 nt, Human
ucucuagaggcugugaccu

SEQ ID NO: 582203 - RNA, 19 nt, Human
ucucuggccacccuuagcc

SEQ ID NO: 582204 - RNA, 18 nt, Human
ucuugggcuggaaggccc

SEQ ID NO: 582205 - RNA, 23 nt, Human
ugagccuuugggggugggggcag

SEQ ID NO: 582206 - RNA, 21 nt, Human
ugaggacuugggugguaggug

SEQ ID NO: 582207 - RNA, 27 nt, Human
ugcccuucccuccagcccaggucccca

SEQ ID NO: 582208 - RNA, 20 nt, Human
ugccuucuagguugggcccc

SEQ ID NO: 582209 - RNA, 19 nt, Human
ugcuuugggaaggcugggg

SEQ ID NO: 582210 - RNA, 19 nt, Human
ugcuuugggaaggcugggg

SEQ ID NO: 582211 - RNA, 19 nt, Human
uggaaauggggugaagggg

SEQ ID NO: 582212 - RNA, 27 nt, Human
uggcccccgagaugagccacacucccu

SEQ ID NO: 582213 - RNA, 23 nt, Human
uggccucuggcuuagugagcccu

SEQ ID NO: 582214 - RNA, 21 nt, Human
uggcuggugagguuaugaccu

SEQ ID NO: 582215 - RNA, 19 nt, Human
ugggagagcccgcucggca

SEQ ID NO: 582216 - RNA, 21 nt, Human
uggggaggcaggcccagggcc

SEQ ID NO: 582217 - RNA, 18 nt, Human
ugggggaaccggggcugu

SEQ ID NO: 582218 - RNA, 24 nt, Human
ugguggagucugagauuuagaggc

SEQ ID NO: 582219 - RNA, 21 nt, Human
ugugaugcuuggucuuguggg

SEQ ID NO: 582220 - RNA, 21 nt, Human
uguuagauugaccccugccuu

SEQ ID NO: 582221 - RNA, 22 nt, Human
uuccaugaccucagagguggcu

SEQ ID NO: 582222 - RNA, 21 nt, Human
uucccggcucuucccccugca

SEQ ID NO: 582223 - RNA, 22 nt, Human
uucccggcucuucccccugcag

SEQ ID NO: 582224 - RNA, 19 nt, Human
uuccuugagccccuccucc

SEQ ID NO: 582225 - RNA, 20 nt, Human
uuccuugagccccuccuccc

SEQ ID NO: 582226 - RNA, 25 nt, Human
uuccuugagccccuccucccccagc

SEQ ID NO: 582227 - RNA, 20 nt, Human
uucuagguugggccccagcc

SEQ ID NO: 582228 - RNA, 24 nt, Human
uucuuuggugugugguacauggug

SEQ ID NO: 582229 - RNA, 18 nt, Human
uuggagaacaggguucag

SEQ ID NO: 582230 - RNA, 19 nt, Human
uuguuagauugaccccugc

SEQ ID NO: 582231 - RNA, 19 nt, Human
uuugggggugggggcagag

SEQ ID NO: 582232 - RNA, 24 nt, Human
aaagugcugggauuacaggcguga

SEQ ID NO: 582233 - RNA, 19 nt, Human
aagugcugggauuacaggc

SEQ ID NO: 582234 - RNA, 19 nt, Human
aagugcugggauuacaggc

SEQ ID NO: 582235 - RNA, 26 nt, Human
aagugcugggauuacaggcgugagcc

SEQ ID NO: 582236 - RNA, 21 nt, Human
acgggguuucaccauagccag

SEQ ID NO: 582237 - RNA, 24 nt, Human
acgggguuucaccauagccaggau

SEQ ID NO: 582238 - RNA, 19 nt, Human
agccggugcaggugagcac

SEQ ID NO: 582239 - RNA, 18 nt, Human
aguagagacgggguuuca

SEQ ID NO: 582240 - RNA, 22 nt, Human
aguagagacgggguuucaccau

SEQ ID NO: 582241 - RNA, 23 nt, Human
aguagagacgggguuucaccaua

SEQ ID NO: 582242 - RNA, 18 nt, Human
agugcugggauuacaggc

SEQ ID NO: 582243 - RNA, 24 nt, Human
caaagugcugggauuacaggcgug

SEQ ID NO: 582244 - RNA, 21 nt, Human
caccauagccaggauggucuu

SEQ ID NO: 582245 - RNA, 19 nt, Human
caccgcgcccggcccuccu

SEQ ID NO: 582246 - RNA, 22 nt, Human
ccaaagugcugggauuacaggc

SEQ ID NO: 582247 - RNA, 22 nt, Human
ccaaagugcugggauuacaggc

SEQ ID NO: 582248 - RNA, 24 nt, Human
ccaaagugcugggauuacaggcgu

SEQ ID NO: 582249 - RNA, 19 nt, Human
ccaccgcgcccggcccucc

SEQ ID NO: 582250 - RNA, 18 nt, Human
cccggcccuccugcugug

SEQ ID NO: 582251 - RNA, 21 nt, Human
ccugaccucgugauccgccug

SEQ ID NO: 582252 - RNA, 24 nt, Human
ccugccucggccucccaaagugcu

SEQ ID NO: 582253 - RNA, 24 nt, Human
cuccugaccucgugauccgccugc

SEQ ID NO: 582254 - RNA, 18 nt, Human
cuuugaggagcucccugc

SEQ ID NO: 582255 - RNA, 22 nt, Human
gaccucgugauccgccugccuc

SEQ ID NO: 582256 - RNA, 22 nt, Human
gaccucgugauccgccugccuc

SEQ ID NO: 582257 - RNA, 24 nt, Human
gaccucgugauccgccugccucgg

SEQ ID NO: 582258 - RNA, 19 nt, Human
gagacgggguuucaccaua

SEQ ID NO: 582259 - RNA, 18 nt, Human
gauuacaggcgugagcca

SEQ ID NO: 582260 - RNA, 22 nt, Human
gauuacaggcgugagccaccgc

SEQ ID NO: 582261 - RNA, 22 nt, Human
gauuacaggcgugagccaccgc

SEQ ID NO: 582262 - RNA, 21 nt, Human
gcagccggugcaggugagcac

SEQ ID NO: 582263 - RNA, 24 nt, Human
ggauggucuugaucuccugaccuc

SEQ ID NO: 582264 - RNA, 21 nt, Human
gguuucaccauagccaggaug

SEQ ID NO: 582265 - RNA, 21 nt, Human
gugaauuaauuugcacagguu

SEQ ID NO: 582266 - RNA, 21 nt, Human
guuccugagcucuuugaggag

SEQ ID NO: 582267 - RNA, 21 nt, Human
uaauuugcacagguuuucccc

SEQ ID NO: 582268 - RNA, 23 nt, Human
uacaggcgugagccaccgcgccc

SEQ ID NO: 582269 - RNA, 24 nt, Human
ucccaaagugcugggauuacaggc

SEQ ID NO: 582270 - RNA, 18 nt, Human
ucggccucccaaagugcu

SEQ ID NO: 582271 - RNA, 19 nt, Human
ugaauuuucugaaccaugu

SEQ ID NO: 582272 - RNA, 23 nt, Human
ugagcacgacggggacaccugug

SEQ ID NO: 582273 - RNA, 21 nt, Human
ugccucggccucccaaagugc

SEQ ID NO: 582274 - RNA, 24 nt, Human
ugccucggccucccaaagugcugg

SEQ ID NO: 582275 - RNA, 24 nt, Human
ugcugggauuacaggcgugagcca

SEQ ID NO: 582276 - RNA, 18 nt, Human
ugggauuacaggcgugag

SEQ ID NO: 582277 - RNA, 19 nt, Human
ugggauuacaggcgugagc

SEQ ID NO: 582278 - RNA, 21 nt, Human
ugggauuacaggcgugagcca

SEQ ID NO: 582279 - RNA, 22 nt, Human
ugggauuacaggcgugagccac

SEQ ID NO: 582280 - RNA, 23 nt, Human
ugggauuacaggcgugagccacc

SEQ ID NO: 582281 - RNA, 24 nt, Human
ugggauuacaggcgugagccaccg

SEQ ID NO: 582282 - RNA, 19 nt, Human
uuccugagcucuuugagga

SEQ ID NO: 582283 - RNA, 24 nt, Human
uuccugagcucuuugaggagcucc

SEQ ID NO: 582284 - RNA, 23 nt, Human
uuucaccauagccaggauggucu

SEQ ID NO: 582285 - RNA, 24 nt, Human
uuucaccauagccaggauggucuu

SEQ ID NO: 582286 - RNA, 24 nt, Human
aaagugcugggauuacagguguga

SEQ ID NO: 582287 - RNA, 18 nt, Human
aagugcugggauuacagg

SEQ ID NO: 582288 - RNA, 19 nt, Human
aagugcugggauuacaggu

SEQ ID NO: 582289 - RNA, 26 nt, Human
aagugcugggauuacaggugugagcc

SEQ ID NO: 582290 - RNA, 25 nt, Human
aaucuuguucuguugcccaggcugg

SEQ ID NO: 582291 - RNA, 21 nt, Human
acagguacccaccaccaugcc

SEQ ID NO: 582292 - RNA, 21 nt, Human
acagguacccaccaccaugcc

SEQ ID NO: 582293 - RNA, 22 nt, Human
accauguuggccaggcuggucu

SEQ ID NO: 582294 - RNA, 24 nt, Human
accccgcccugucuggccuuuuua

SEQ ID NO: 582295 - RNA, 20 nt, Human
acccuguucccaaaggcuga

SEQ ID NO: 582296 - RNA, 18 nt, Human
acuggccuugccccgccg

SEQ ID NO: 582297 - RNA, 20 nt, Human
agccaccacaccccgcccug

SEQ ID NO: 582298 - RNA, 21 nt, Human
aggacaaacuccaagucuagc

SEQ ID NO: 582299 - RNA, 25 nt, Human
aggcuggagugcaguagugugaucu

SEQ ID NO: 582300 - RNA, 18 nt, Human
aguagcugggauuacagg

SEQ ID NO: 582301 - RNA, 24 nt, Human
agugaucugcccuccucggccucc

SEQ ID NO: 582302 - RNA, 23 nt, Human
agugcaguagugugaucuuggcu

SEQ ID NO: 582303 - RNA, 24 nt, Human
agugcaguagugugaucuuggcuc

SEQ ID NO: 582304 - RNA, 24 nt, Human
aucuuguucuguugcccaggcugg

SEQ ID NO: 582305 - RNA, 24 nt, Human
caaagugcugggauuacaggugug

SEQ ID NO: 582306 - RNA, 20 nt, Human
caaccuccacuucccggguu

SEQ ID NO: 582307 - RNA, 22 nt, Human
caagcaauucuccugccucagc

SEQ ID NO: 582308 - RNA, 22 nt, Human
cacacacaugggcagagcuugg

SEQ ID NO: 582309 - RNA, 19 nt, Human
cacacccuucaggggcucc

SEQ ID NO: 582310 - RNA, 19 nt, Human
caccaucugacuggccaca

SEQ ID NO: 582311 - RNA, 24 nt, Human
caccaugccuggcuaauuuuugua

SEQ ID NO: 582312 - RNA, 21 nt, Human
caccauguuggccaggcuggu

SEQ ID NO: 582313 - RNA, 24 nt, Human
caccauguuggccaggcuggucuu

SEQ ID NO: 582314 - RNA, 27 nt, Human
caccauguuggccaggcuggucuugaa

SEQ ID NO: 582315 - RNA, 23 nt, Human
cacugcaaccuccacuucccggg

SEQ ID NO: 582316 - RNA, 26 nt, Human
cacugccuggaaaccucucugcccca

SEQ ID NO: 582317 - RNA, 24 nt, Human
cagaaucuuguucuguugcccagg

SEQ ID NO: 582318 - RNA, 22 nt, Human
cagcagagguccagcuugugcu

SEQ ID NO: 582319 - RNA, 21 nt, Human
cagccuccugagccguccccc

SEQ ID NO: 582320 - RNA, 20 nt, Human
cagccuccugaguagcuggg

SEQ ID NO: 582321 - RNA, 18 nt, Human
cagcuccgggacggggaa

SEQ ID NO: 582322 - RNA, 25 nt, Human
cagcugccaccucucacugccugga

SEQ ID NO: 582323 - RNA, 23 nt, Human
caggacaaacuccaagucuagca

SEQ ID NO: 582324 - RNA, 24 nt, Human
cauguuggccaggcuggucuugaa

SEQ ID NO: 582325 - RNA, 23 nt, Human
cauuccugcuguuuccagcagag

SEQ ID NO: 582326 - RNA, 21 nt, Human
ccaaagugcugggauuacagg

SEQ ID NO: 582327 - RNA, 21 nt, Human
ccaaagugcugggauuacagg

SEQ ID NO: 582328 - RNA, 24 nt, Human
ccaaagugcugggauuacaggugu

SEQ ID NO: 582329 - RNA, 19 nt, Human
ccauggugugucugcaucc

SEQ ID NO: 582330 - RNA, 24 nt, Human
cccauggugugucugcauccugcc

SEQ ID NO: 582331 - RNA, 22 nt, Human
ccccgccgcagccuccugagcc

SEQ ID NO: 582332 - RNA, 21 nt, Human
ccccucuccucugcccuccac

SEQ ID NO: 582333 - RNA, 24 nt, Human
cccggguuucaagcaauucuccug

SEQ ID NO: 582334 - RNA, 21 nt, Human
cccuccacacacacccuucag

SEQ ID NO: 582335 - RNA, 24 nt, Human
ccgccgcagccuccugagccgucc

SEQ ID NO: 582336 - RNA, 19 nt, Human
ccucuugacaucuuggugc

SEQ ID NO: 582337 - RNA, 22 nt, Human
ccugaguagcugggauuacagg

SEQ ID NO: 582338 - RNA, 23 nt, Human
ccugaguagcugggauuacaggu

SEQ ID NO: 582339 - RNA, 24 nt, Human
ccugaguagcugggauuacaggua

SEQ ID NO: 582340 - RNA, 24 nt, Human
ccugaucucaagugaucugcccuc

SEQ ID NO: 582341 - RNA, 24 nt, Human
ccugccagccagcugccccaaggc

SEQ ID NO: 582342 - RNA, 23 nt, Human
ccugccucagccuccugaguagc

SEQ ID NO: 582343 - RNA, 24 nt, Human
ccugccucagccuccugaguagcu

SEQ ID NO: 582344 - RNA, 19 nt, Human
ccuggaaaccucucugccc

SEQ ID NO: 582345 - RNA, 23 nt, Human
cgcagccuccugagccguccccc

SEQ ID NO: 582346 - RNA, 19 nt, Human
cuagcaccucuugacaucu

SEQ ID NO: 582347 - RNA, 21 nt, Human
cucaagugaucugcccuccuc

SEQ ID NO: 582348 - RNA, 24 nt, Human
cucacugcaaccuccacuucccgg

SEQ ID NO: 582349 - RNA, 24 nt, Human
cucagccuccugaguagcugggau

SEQ ID NO: 582350 - RNA, 23 nt, Human
cucauggccaggucaccaaaccc

SEQ ID NO: 582351 - RNA, 24 nt, Human
cucauggccaggucaccaaacccc

SEQ ID NO: 582352 - RNA, 24 nt, Human
cuccacacacacccuucaggggcu

SEQ ID NO: 582353 - RNA, 18 nt, Human
cucugcugaaggccaccg

SEQ ID NO: 582354 - RNA, 21 nt, Human
cugaguagcugggauuacagg

SEQ ID NO: 582355 - RNA, 24 nt, Human
cugcaaccuccacuucccggguuu

SEQ ID NO: 582356 - RNA, 25 nt, Human
cugcaaccuccacuucccggguuuc

SEQ ID NO: 582357 - RNA, 20 nt, Human
cuggaaaccucucugcccca

SEQ ID NO: 582358 - RNA, 22 nt, Human
cuucaggggcuccaucaccucu

SEQ ID NO: 582359 - RNA, 25 nt, Human
cuugguggcucagcucagcugccac

SEQ ID NO: 582360 - RNA, 24 nt, Human
cuuguccccucuccucugcccucc

SEQ ID NO: 582361 - RNA, 22 nt, Human
gaguagcugggauuacagguac

SEQ ID NO: 582362 - RNA, 24 nt, Human
gauuacagguacccaccaccaugc

SEQ ID NO: 582363 - RNA, 18 nt, Human
gauuacaggugugagcca

SEQ ID NO: 582364 - RNA, 21 nt, Human
gauuacaggugugagccacca

SEQ ID NO: 582365 - RNA, 22 nt, Human
gauuacaggugugagccaccac

SEQ ID NO: 582366 - RNA, 20 nt, Human
gccacacacaugggcagagc

SEQ ID NO: 582367 - RNA, 21 nt, Human
gccaggccgccgcugccgccg

SEQ ID NO: 582368 - RNA, 20 nt, Human
gcccaggcuggagugcagua

SEQ ID NO: 582369 - RNA, 24 nt, Human
gcugaagggcccuucucuccaucu

SEQ ID NO: 582370 - RNA, 19 nt, Human
ggcaggcucuggugacacu

SEQ ID NO: 582371 - RNA, 24 nt, Human
ggccaggccgccgcugccgccgcg

SEQ ID NO: 582372 - RNA, 24 nt, Human
ggcuggucuugaacuccugaucuc

SEQ ID NO: 582373 - RNA, 21 nt, Human
gggcgcccgcaugucccuggc

SEQ ID NO: 582374 - RNA, 18 nt, Human
gggggguuucaccauguu

SEQ ID NO: 582375 - RNA, 20 nt, Human
gggggguuucaccauguugg

SEQ ID NO: 582376 - RNA, 24 nt, Human
gggggguuucaccauguuggccag

SEQ ID NO: 582377 - RNA, 24 nt, Human
ggggguuucaccauguuggccagg

SEQ ID NO: 582378 - RNA, 22 nt, Human
gggguuucaccauguuggccag

SEQ ID NO: 582379 - RNA, 23 nt, Human
gggguuucaccauguuggccagg

SEQ ID NO: 582380 - RNA, 22 nt, Human
guagagagggggguuucaccau

SEQ ID NO: 582381 - RNA, 23 nt, Human
guagagagggggguuucaccaug

SEQ ID NO: 582382 - RNA, 18 nt, Human
guagcuccagcccuuccc

SEQ ID NO: 582383 - RNA, 18 nt, Human
guagcugggauuacaggu

SEQ ID NO: 582384 - RNA, 19 nt, Human
gugugagccaccacacccc

SEQ ID NO: 582385 - RNA, 24 nt, Human
uaauuuuuguauuguuuguagaga

SEQ ID NO: 582386 - RNA, 22 nt, Human
uacagguacccaccaccaugcc

SEQ ID NO: 582387 - RNA, 23 nt, Human
uacaggugugagccaccacaccc

SEQ ID NO: 582388 - RNA, 22 nt, Human
uagagagggggguuucaccaug

SEQ ID NO: 582389 - RNA, 22 nt, Human
uaucaccugccaggacaaacuc

SEQ ID NO: 582390 - RNA, 19 nt, Human
ucaagcaauucuccugccu

SEQ ID NO: 582391 - RNA, 20 nt, Human
ucaccucugggcuaaauccu

SEQ ID NO: 582392 - RNA, 24 nt, Human
ucacugcaaccuccacuucccggg

SEQ ID NO: 582393 - RNA, 25 nt, Human
ucacugcaaccuccacuucccgggu

SEQ ID NO: 582394 - RNA, 20 nt, Human
ucagccuccugaguagcugg

SEQ ID NO: 582395 - RNA, 20 nt, Human
ucccaaaggcugaagggccc

SEQ ID NO: 582396 - RNA, 21 nt, Human
ucccaaaggcugaagggccuc

SEQ ID NO: 582397 - RNA, 23 nt, Human
ucccaaagugcugggauuacagg

SEQ ID NO: 582398 - RNA, 20 nt, Human
uccccucuccucugcccucc

SEQ ID NO: 582399 - RNA, 21 nt, Human
ucccggguuucaagcaauucu

SEQ ID NO: 582400 - RNA, 22 nt, Human
ucccggguuucaagcaauucuc

SEQ ID NO: 582401 - RNA, 25 nt, Human
ucccggguuucaagcaauucuccug

SEQ ID NO: 582402 - RNA, 20 nt, Human
ucccuggcucuggcccucug

SEQ ID NO: 582403 - RNA, 21 nt, Human
uccucggccucccaaagugcu

SEQ ID NO: 582404 - RNA, 24 nt, Human
uccugaguagcugggauuacaggu

SEQ ID NO: 582405 - RNA, 23 nt, Human
ucucaagugaucugcccuccucg

SEQ ID NO: 582406 - RNA, 24 nt, Human
ucuccugccucagccuccugagua

SEQ ID NO: 582407 - RNA, 22 nt, Human
ucucuguagcuccagcccuucc

SEQ ID NO: 582408 - RNA, 21 nt, Human
ucugcccuccucggccuccca

SEQ ID NO: 582409 - RNA, 19 nt, Human
ucuggccuuuuuauguggu

SEQ ID NO: 582410 - RNA, 18 nt, Human
ucuguugcccaggcugga

SEQ ID NO: 582411 - RNA, 19 nt, Human
ucuguugcccaggcuggag

SEQ ID NO: 582412 - RNA, 24 nt, Human
ucuguugcccaggcuggagugcag

SEQ ID NO: 582413 - RNA, 21 nt, Human
ucuugaacuccugaucucaag

SEQ ID NO: 582414 - RNA, 22 nt, Human
ucuuguucuguugcccaggcug

SEQ ID NO: 582415 - RNA, 23 nt, Human
ucuuguucuguugcccaggcugg

SEQ ID NO: 582416 - RNA, 24 nt, Human
ucuuguucuguugcccaggcugga

SEQ ID NO: 582417 - RNA, 22 nt, Human
ugacccuguucccaaaggcuga

SEQ ID NO: 582418 - RNA, 18 nt, Human
ugagacagaaucuuguuc

SEQ ID NO: 582419 - RNA, 22 nt, Human
ugagacagaaucuuguucuguu

SEQ ID NO: 582420 - RNA, 21 nt, Human
ugaucucaagugaucugcccu

SEQ ID NO: 582421 - RNA, 22 nt, Human
ugaucucaagugaucugcccuc

SEQ ID NO: 582422 - RNA, 24 nt, Human
ugaucugcccuccucggccuccca

SEQ ID NO: 582423 - RNA, 22 nt, Human
ugcaguagugugaucuuggcuc

SEQ ID NO: 582424 - RNA, 18 nt, Human
ugcccaggcuggagugca

SEQ ID NO: 582425 - RNA, 24 nt, Human
ugcccaggcuggagugcaguagug

SEQ ID NO: 582426 - RNA, 18 nt, Human
ugcccgaagcagauuugg

SEQ ID NO: 582427 - RNA, 24 nt, Human
ugccucagccuccugaguagcugg

SEQ ID NO: 582428 - RNA, 20 nt, Human
ugccugggucugaagcccag

SEQ ID NO: 582429 - RNA, 24 nt, Human
ugcugggauuacaggugugagcca

SEQ ID NO: 582430 - RNA, 18 nt, Human
uggaaaccucucugcccc

SEQ ID NO: 582431 - RNA, 21 nt, Human
uggaaagggcugggcugccug

SEQ ID NO: 582432 - RNA, 21 nt, Human
uggaaagggcugggcugccug

SEQ ID NO: 582433 - RNA, 19 nt, Human
uggagugcaguagugugau

SEQ ID NO: 582434 - RNA, 23 nt, Human
uggagugcaguagugugaucuug

SEQ ID NO: 582435 - RNA, 24 nt, Human
uggagugcaguagugugaucuugg

SEQ ID NO: 582436 - RNA, 24 nt, Human
uggccaggcuggucuugaacuccu

SEQ ID NO: 582437 - RNA, 19 nt, Human
ugggauuacagguacccac

SEQ ID NO: 582438 - RNA, 21 nt, Human
ugggauuacagguacccacca

SEQ ID NO: 582439 - RNA, 24 nt, Human
ugggauuacagguacccaccacca

SEQ ID NO: 582440 - RNA, 25 nt, Human
ugggauuacagguacccaccaccau

SEQ ID NO: 582441 - RNA, 18 nt, Human
ugggauuacaggugugag

SEQ ID NO: 582442 - RNA, 19 nt, Human
ugggauuacaggugugagc

SEQ ID NO: 582443 - RNA, 22 nt, Human
ugggauuacaggugugagccac

SEQ ID NO: 582444 - RNA, 23 nt, Human
ugggauuacaggugugagccacc

SEQ ID NO: 582445 - RNA, 24 nt, Human
ugggauuacaggugugagccacca

SEQ ID NO: 582446 - RNA, 22 nt, Human
ugggcuaaauccucaggcugac

SEQ ID NO: 582447 - RNA, 24 nt, Human
uguagagagggggguuucaccaug

SEQ ID NO: 582448 - RNA, 20 nt, Human
uguagcuccagcccuuccca

SEQ ID NO: 582449 - RNA, 28 nt, Human
ugucuuguccccucuccucugcccucca

SEQ ID NO: 582450 - RNA, 19 nt, Human
ugugcuccaccuccuuugc

SEQ ID NO: 582451 - RNA, 21 nt, Human
uucaagcaauucuccugccuc

SEQ ID NO: 582452 - RNA, 24 nt, Human
uucaagcaauucuccugccucagc

SEQ ID NO: 582453 - RNA, 24 nt, Human
uuguagagagggggguuucaccau

SEQ ID NO: 582454 - RNA, 24 nt, Human
uuguucuguugcccaggcuggagu

SEQ ID NO: 582455 - RNA, 24 nt, Human
uuucaccauguuggccaggcuggu

SEQ ID NO: 582456 - RNA, 20 nt, Human
uuuuuguauuguuuguagag

SEQ ID NO: 582457 - RNA, 25 nt, Human
aaaaaacaaaauacagucuggaaga

SEQ ID NO: 582458 - RNA, 24 nt, Human
aaaaacaaaauacagucuggaaga

SEQ ID NO: 582459 - RNA, 21 nt, Human
aaaggcaauuccuucuaccuc

SEQ ID NO: 582460 - RNA, 21 nt, Human
aauuccuucuaccuccaucuc

SEQ ID NO: 582461 - RNA, 20 nt, Human
accccacacgagguaccgug

SEQ ID NO: 582462 - RNA, 19 nt, Human
agaguucucaguccccacc

SEQ ID NO: 582463 - RNA, 21 nt, Human
agaguugguccuagaauaauu

SEQ ID NO: 582464 - RNA, 23 nt, Human
aggaaaaaacaaaauacagucug

SEQ ID NO: 582465 - RNA, 21 nt, Human
aggcugcaggugcacgugucu

SEQ ID NO: 582466 - RNA, 22 nt, Human
auggauuccagaugcaauccau

SEQ ID NO: 582467 - RNA, 21 nt, Human
cacagaacacucggcagucac

SEQ ID NO: 582468 - RNA, 23 nt, Human
cagaacacucggcagucacagcc

SEQ ID NO: 582469 - RNA, 22 nt, Human
cagccuuaguuaacaaucuugc

SEQ ID NO: 582470 - RNA, 20 nt, Human
cagucaugaucauaaaaaug

SEQ ID NO: 582471 - RNA, 18 nt, Human
caugaggcuguucauuuu

SEQ ID NO: 582472 - RNA, 22 nt, Human
ccaaaauagcaaaaauaggccu

SEQ ID NO: 582473 - RNA, 24 nt, Human
ccaaaauagcaaaaauaggccuau

SEQ ID NO: 582474 - RNA, 20 nt, Human
ccccaccccacacgagguac

SEQ ID NO: 582475 - RNA, 18 nt, Human
ccucucgugagaggcgga

SEQ ID NO: 582476 - RNA, 24 nt, Human
ccuucuaccuccaucucuggaguc

SEQ ID NO: 582477 - RNA, 25 nt, Human
cucaaagaguucucaguccccaccc

SEQ ID NO: 582478 - RNA, 19 nt, Human
cuggcacuuaaugccagcc

SEQ ID NO: 582479 - RNA, 23 nt, Human
gcagguuucacacaguuugacag

SEQ ID NO: 582480 - RNA, 24 nt, Human
gucugaaaucuuuuaaaaucccua

SEQ ID NO: 582481 - RNA, 18 nt, Human
uaaaauacacauggaaca

SEQ ID NO: 582482 - RNA, 19 nt, Human
uaccuccaucucuggaguc

SEQ ID NO: 582483 - RNA, 24 nt, Human
uaccuccaucucuggagucagcug

SEQ ID NO: 582484 - RNA, 23 nt, Human
uagcaaaaauaggccuauuucag

SEQ ID NO: 582485 - RNA, 19 nt, Human
ucauguggcuagaaaggaa

SEQ ID NO: 582486 - RNA, 23 nt, Human
uccccagaggauuguccuaacuc

SEQ ID NO: 582487 - RNA, 26 nt, Human
ucggcagucacagccacaguccucuc

SEQ ID NO: 582488 - RNA, 25 nt, Human
ucucaaagaguucucaguccccacc

SEQ ID NO: 582489 - RNA, 19 nt, Human
ucuucagcuugaaugaaca

SEQ ID NO: 582490 - RNA, 23 nt, Human
ugaacuagacucuccccagagga

SEQ ID NO: 582491 - RNA, 21 nt, Human
ugcaaugccacagucaugugg

SEQ ID NO: 582492 - RNA, 20 nt, Human
uggagcucugaucuacacag

SEQ ID NO: 582493 - RNA, 19 nt, Human
uguccaaaauagcaaaaau

SEQ ID NO: 582494 - RNA, 22 nt, Human
uguccaagcuaagaaucaagau

SEQ ID NO: 582495 - RNA, 21 nt, Human
uucagcuugaaugaacaugag

SEQ ID NO: 582496 - RNA, 22 nt, Human
uucagcuugaaugaacaugagg

SEQ ID NO: 582497 - RNA, 22 nt, Human
uuugugcaaugccacagucaug

SEQ ID NO: 582498 - RNA, 23 nt, Human
aaaaaagaaaaaaagaaagaaaa

SEQ ID NO: 582499 - RNA, 19 nt, Human
aaccugcacauccugcaca

SEQ ID NO: 582500 - RNA, 21 nt, Human
aagauccugucucacaaaaaa

SEQ ID NO: 582501 - RNA, 25 nt, Human
acagagcaagauccugucucacaaa

SEQ ID NO: 582502 - RNA, 21 nt, Human
accgacucuccacacaaguac

SEQ ID NO: 582503 - RNA, 23 nt, Human
acuccagccugggagacagagca

SEQ ID NO: 582504 - RNA, 18 nt, Human
acugcacuccagccuggg

SEQ ID NO: 582505 - RNA, 24 nt, Human
acugcacuccagccugggagacag

SEQ ID NO: 582506 - RNA, 25 nt, Human
acuguguugcccaggcuggucucca

SEQ ID NO: 582507 - RNA, 21 nt, Human
acuucaaccuccugaguagcu

SEQ ID NO: 582508 - RNA, 22 nt, Human
agagacagggucuugcucuguu

SEQ ID NO: 582509 - RNA, 22 nt, Human
agaguguaggcgugagccacug

SEQ ID NO: 582510 - RNA, 24 nt, Human
agaguguaggcgugagccacugca

SEQ ID NO: 582511 - RNA, 18 nt, Human
agccucaaccucccuggc

SEQ ID NO: 582512 - RNA, 20 nt, Human
agccucaaccucccuggccc

SEQ ID NO: 582513 - RNA, 21 nt, Human
agccugggcaacaaagugaga

SEQ ID NO: 582514 - RNA, 26 nt, Human
aggaucacuugagcucacgggaguuc

SEQ ID NO: 582515 - RNA, 18 nt, Human
aggcaagaggaucacuug

SEQ ID NO: 582516 - RNA, 24 nt, Human
aggcacuguggcucacgccuguag

SEQ ID NO: 582517 - RNA, 21 nt, Human
aggcgugagccacugcaucca

SEQ ID NO: 582518 - RNA, 21 nt, Human
aggcuggucuccaacuccugg

SEQ ID NO: 582519 - RNA, 24 nt, Human
aggguucucacuguguugcccagg

SEQ ID NO: 582520 - RNA, 21 nt, Human
aguacaguggugugaucauag

SEQ ID NO: 582521 - RNA, 23 nt, Human
aguacaguggugugaucauagcu

SEQ ID NO: 582522 - RNA, 24 nt, Human
aguacaguggugugaucauagcuc

SEQ ID NO: 582523 - RNA, 19 nt, Human
aguagcugggacuacaggc

SEQ ID NO: 582524 - RNA, 21 nt, Human
aguagcugggacuacaggcau

SEQ ID NO: 582525 - RNA, 18 nt, Human
auacagccaacagacacc

SEQ ID NO: 582526 - RNA, 22 nt, Human
auacgcaaggcaugagaaacag

SEQ ID NO: 582527 - RNA, 24 nt, Human
auagcucacugcagccucaaccuc

SEQ ID NO: 582528 - RNA, 25 nt, Human
aucacuugagcucacgggaguucaa

SEQ ID NO: 582529 - RNA, 24 nt, Human
aucaguccucccaccucuaccucc

SEQ ID NO: 582530 - RNA, 19 nt, Human
aucaugaaucaggccaggc

SEQ ID NO: 582531 - RNA, 21 nt, Human
auccaagcugucuaacugcuc

SEQ ID NO: 582532 - RNA, 24 nt, Human
auugugccacugcacuccagccug

SEQ ID NO: 582533 - RNA, 18 nt, Human
caaaucagaaugucaauc

SEQ ID NO: 582534 - RNA, 21 nt, Human
caacagacaccgacucuccac

SEQ ID NO: 582535 - RNA, 24 nt, Human
caacuccuggccucaaucaguccu

SEQ ID NO: 582536 - RNA, 22 nt, Human
caaggcaagaggaucacuugag

SEQ ID NO: 582537 - RNA, 23 nt, Human
caaggcaagaggaucacuugagc

SEQ ID NO: 582538 - RNA, 20 nt, Human
caauacuuugggaggccaag

SEQ ID NO: 582539 - RNA, 23 nt, Human
caauacuuugggaggccaaggca

SEQ ID NO: 582540 - RNA, 21 nt, Human
caaugugcuacaccccccaaa

SEQ ID NO: 582541 - RNA, 24 nt, Human
caccccccaaaauccaagcugucu

SEQ ID NO: 582542 - RNA, 22 nt, Human
caccuagaacaccuguaucagg

SEQ ID NO: 582543 - RNA, 24 nt, Human
caccucacuuggcuaauuuuugua

SEQ ID NO: 582544 - RNA, 23 nt, Human
caccuccacaaaaaauuuaaaaa

SEQ ID NO: 582545 - RNA, 23 nt, Human
cacuccagccugggagacagagc

SEQ ID NO: 582546 - RNA, 18 nt, Human
cacugcacuccagccugg

SEQ ID NO: 582547 - RNA, 19 nt, Human
cacugcacuccagccuggg

SEQ ID NO: 582548 - RNA, 22 nt, Human
cacugcacuccagccugggaga

SEQ ID NO: 582549 - RNA, 24 nt, Human
cacugcacuccagccugggagaca

SEQ ID NO: 582550 - RNA, 24 nt, Human
cacugcacuccagccugggagaca

SEQ ID NO: 582551 - RNA, 19 nt, Human
cacuguguugcccaggcug

SEQ ID NO: 582552 - RNA, 21 nt, Human
cacuguguugcccaggcuggu

SEQ ID NO: 582553 - RNA, 24 nt, Human
cacuguguugcccaggcuggucuc

SEQ ID NO: 582554 - RNA, 24 nt, Human
cacuucaaccuccugaguagcugg

SEQ ID NO: 582555 - RNA, 21 nt, Human
cagccucaaccucccuggccc

SEQ ID NO: 582556 - RNA, 24 nt, Human
cagccucaaccucccuggcccgag

SEQ ID NO: 582557 - RNA, 22 nt, Human
caggagggacagcaucaugaua

SEQ ID NO: 582558 - RNA, 24 nt, Human
cagggucuugcucuguugcccagg

SEQ ID NO: 582559 - RNA, 24 nt, Human
cauacgcaaggcaugagaaacagg

SEQ ID NO: 582560 - RNA, 21 nt, Human
cauagauuccccuuuccaccu

SEQ ID NO: 582561 - RNA, 27 nt, Human
cauccugcacauguauccuggaacuua

SEQ ID NO: 582562 - RNA, 27 nt, Human
cauuacaccccagcccauaaggagcaa

SEQ ID NO: 582563 - RNA, 22 nt, Human
ccaaaauccaagcugucuaacu

SEQ ID NO: 582564 - RNA, 21 nt, Human
ccacaguucccucaacuugga

SEQ ID NO: 582565 - RNA, 18 nt, Human
ccacugcacuccagccug

SEQ ID NO: 582566 - RNA, 19 nt, Human
ccacugcacuccagccugg

SEQ ID NO: 582567 - RNA, 20 nt, Human
ccacugcacuccagccuggg

SEQ ID NO: 582568 - RNA, 22 nt, Human
ccacugcacuccagccugggag

SEQ ID NO: 582569 - RNA, 24 nt, Human
ccacugcacuccagccugggagac

SEQ ID NO: 582570 - RNA, 19 nt, Human
ccacugcauccagccucaa

SEQ ID NO: 582571 - RNA, 21 nt, Human
ccacugcauccagccucaaau

SEQ ID NO: 582572 - RNA, 21 nt, Human
ccagagaguaacaauauaaua

SEQ ID NO: 582573 - RNA, 22 nt, Human
ccaggaauucaaggcugcagug

SEQ ID NO: 582574 - RNA, 21 nt, Human
ccaggcacagugaugugugcc

SEQ ID NO: 582575 - RNA, 20 nt, Human
ccaggcuggucuccaacucc

SEQ ID NO: 582576 - RNA, 19 nt, Human
cccaggcuggaguacagug

SEQ ID NO: 582577 - RNA, 21 nt, Human
ccccuuuccaccuucccuucc

SEQ ID NO: 582578 - RNA, 20 nt, Human
cccucuagcucacauccugg

SEQ ID NO: 582579 - RNA, 24 nt, Human
cccugccagccacagacuccacaa

SEQ ID NO: 582580 - RNA, 22 nt, Human
ccucaaccucccuggcccgaga

SEQ ID NO: 582581 - RNA, 31 nt, Human
ccucccaccucuaccucccagaguguaggcc

SEQ ID NO: 582582 - RNA, 24 nt, Human
ccucccacuucaaccuccugagua

SEQ ID NO: 582583 - RNA, 19 nt, Human
ccucccugcuagccuggga

SEQ ID NO: 582584 - RNA, 26 nt, Human
ccucccugcuagccugggagcagcca

SEQ ID NO: 582585 - RNA, 24 nt, Human
ccucugcacauuacaccccagccc

SEQ ID NO: 582586 - RNA, 19 nt, Human
ccucugugccccuccugug

SEQ ID NO: 582587 - RNA, 23 nt, Human
ccugaguagcugggacuacaggc

SEQ ID NO: 582588 - RNA, 24 nt, Human
ccugaguagcugggacuacaggca

SEQ ID NO: 582589 - RNA, 21 nt, Human
ccugcggucccagcuacuugg

SEQ ID NO: 582590 - RNA, 22 nt, Human
ccugcggucccagcuacuuggg

SEQ ID NO: 582591 - RNA, 18 nt, Human
ccugguucaggacuggag

SEQ ID NO: 582592 - RNA, 20 nt, Human
ccugguucaggacuggagcu

SEQ ID NO: 582593 - RNA, 21 nt, Human
cuacaccccccaaaauccaag

SEQ ID NO: 582594 - RNA, 24 nt, Human
cucaaucaguccucccaccucuac

SEQ ID NO: 582595 - RNA, 24 nt, Human
cucacgccuguagucccaauacuu

SEQ ID NO: 582596 - RNA, 21 nt, Human
cucacugcagccucaaccucc

SEQ ID NO: 582597 - RNA, 21 nt, Human
cuccacaaaaaauuuaaaaaa

SEQ ID NO: 582598 - RNA, 22 nt, Human
cuccacacaaguacuggcgucc

SEQ ID NO: 582599 - RNA, 20 nt, Human
cuccguccucugugccccuc

SEQ ID NO: 582600 - RNA, 21 nt, Human
cuccucugcacauuacacccc

SEQ ID NO: 582601 - RNA, 27 nt, Human
cuccuggccucaaucaguccucccacc

SEQ ID NO: 582602 - RNA, 24 nt, Human
cugcagccucaaccucccuggccc

SEQ ID NO: 582603 - RNA, 22 nt, Human
cugcagugagcuuugauugugc

SEQ ID NO: 582604 - RNA, 23 nt, Human
cugccagccacagacuccacaag

SEQ ID NO: 582605 - RNA, 22 nt, Human
cugcucccacaguucccucaac

SEQ ID NO: 582606 - RNA, 21 nt, Human
gacagagcaagauccugucuc

SEQ ID NO: 582607 - RNA, 22 nt, Human
gagagacagggucuugcucugu

SEQ ID NO: 582608 - RNA, 23 nt, Human
gagaggguucucacuguguugcc

SEQ ID NO: 582609 - RNA, 22 nt, Human
gagauacagccaacagacaccg

SEQ ID NO: 582610 - RNA, 23 nt, Human
gagauccucccacuucaaggcac

SEQ ID NO: 582611 - RNA, 20 nt, Human
gagcaaaucaaucuucccuc

SEQ ID NO: 582612 - RNA, 25 nt, Human
gaguagcugggacuacaggcauaua

SEQ ID NO: 582613 - RNA, 26 nt, Human
gaucacuugagcucacgggaguucaa

SEQ ID NO: 582614 - RNA, 19 nt, Human
gaucauagcucacugcagc

SEQ ID NO: 582615 - RNA, 21 nt, Human
gauugugccacugcacuccag

SEQ ID NO: 582616 - RNA, 24 nt, Human
gcacuccagccugggagacagagc

SEQ ID NO: 582617 - RNA, 22 nt, Human
gcauacgcaaggcaugagaaac

SEQ ID NO: 582618 - RNA, 20 nt, Human
gcccaggcuggaguacagug

SEQ ID NO: 582619 - RNA, 24 nt, Human
gcccaggcuggaguacaguggugu

SEQ ID NO: 582620 - RNA, 22 nt, Human
gccuguagucccaauacuuugg

SEQ ID NO: 582621 - RNA, 25 nt, Human
gcucuguugcccaggcuggaguaca

SEQ ID NO: 582622 - RNA, 23 nt, Human
gcuggucuccaacuccuggccuc

SEQ ID NO: 582623 - RNA, 18 nt, Human
ggacuggagcuccagaca

SEQ ID NO: 582624 - RNA, 21 nt, Human
ggagaaccgcucgagcccagg

SEQ ID NO: 582625 - RNA, 19 nt, Human
ggccugguucaggacugga

SEQ ID NO: 582626 - RNA, 22 nt, Human
ggcuggaguacaguggugugau

SEQ ID NO: 582627 - RNA, 24 nt, Human
ggcuggucuccaacuccuggccuc

SEQ ID NO: 582628 - RNA, 18 nt, Human
gggcagggacugaguugc

SEQ ID NO: 582629 - RNA, 22 nt, Human
gguucucacuguguugcccagg

SEQ ID NO: 582630 - RNA, 22 nt, Human
gucccaauacuuugggaggcca

SEQ ID NO: 582631 - RNA, 22 nt, Human
gucucacaaaaaaaaagaaaaa

SEQ ID NO: 582632 - RNA, 22 nt, Human
guggcucacgccuguaguccca

SEQ ID NO: 582633 - RNA, 23 nt, Human
uaaaaaacuagccaggcacagug

SEQ ID NO: 582634 - RNA, 24 nt, Human
uaauuuuuguauuuuuuguagaga

SEQ ID NO: 582635 - RNA, 18 nt, Human
uacaccccccaaaaucca

SEQ ID NO: 582636 - RNA, 19 nt, Human
uacaguggugugaucauag

SEQ ID NO: 582637 - RNA, 23 nt, Human
uagagaggguucucacuguguug

SEQ ID NO: 582638 - RNA, 22 nt, Human
uagauuccccuuuccaccuucc

SEQ ID NO: 582639 - RNA, 24 nt, Human
uagcucacugcagccucaaccucc

SEQ ID NO: 582640 - RNA, 20 nt, Human
uauaccaccucacuuggcua

SEQ ID NO: 582641 - RNA, 19 nt, Human
ucacugcagccucaaccuc

SEQ ID NO: 582642 - RNA, 25 nt, Human
ucacugcagccucaaccucccuggc

SEQ ID NO: 582643 - RNA, 21 nt, Human
ucacuggcauagauuccccuu

SEQ ID NO: 582644 - RNA, 21 nt, Human
ucacuuggcuaauuuuuguau

SEQ ID NO: 582645 - RNA, 19 nt, Human
ucaggccaggcacuguggc

SEQ ID NO: 582646 - RNA, 24 nt, Human
ucaggccaggcacuguggcucacg

SEQ ID NO: 582647 - RNA, 25 nt, Human
ucaguccucccaccucuaccuccca

SEQ ID NO: 582648 - RNA, 19 nt, Human
uccaagcugucuaacugcu

SEQ ID NO: 582649 - RNA, 21 nt, Human
uccccagcuugggccugguuc

SEQ ID NO: 582650 - RNA, 20 nt, Human
ucccuuccagagaguaacaa

SEQ ID NO: 582651 - RNA, 24 nt, Human
uccugaguagcugggacuacaggc

SEQ ID NO: 582652 - RNA, 21 nt, Human
ucucacaaaaaaaaagaaaaa

SEQ ID NO: 582653 - RNA, 23 nt, Human
ucucacaaaaaaaaagaaaaaaa

SEQ ID NO: 582654 - RNA, 18 nt, Human
ucucacuguguugcccag

SEQ ID NO: 582655 - RNA, 19 nt, Human
ucucacuguguugcccagg

SEQ ID NO: 582656 - RNA, 19 nt, Human
ucucacuguguugcccagg

SEQ ID NO: 582657 - RNA, 23 nt, Human
ucucacuguguugcccaggcugg

SEQ ID NO: 582658 - RNA, 24 nt, Human
ucucacuguguugcccaggcuggu

SEQ ID NO: 582659 - RNA, 26 nt, Human
ucucacuguguugcccaggcuggucu

SEQ ID NO: 582660 - RNA, 27 nt, Human
ucucacuguguugcccaggcuggucuc

SEQ ID NO: 582661 - RNA, 25 nt, Human
ucugugccccuccugugcacggcua

SEQ ID NO: 582662 - RNA, 18 nt, Human
ucuguugcccaggcugga

SEQ ID NO: 582663 - RNA, 23 nt, Human
ucuugcucuguugcccaggcugg

SEQ ID NO: 582664 - RNA, 24 nt, Human
ucuugcucuguugcccaggcugga

SEQ ID NO: 582665 - RNA, 19 nt, Human
ucuuucuuuuucucucuuu

SEQ ID NO: 582666 - RNA, 22 nt, Human
ucuuucuuuuucucucuuuucc

SEQ ID NO: 582667 - RNA, 21 nt, Human
ugaacaugccccugccagcca

SEQ ID NO: 582668 - RNA, 27 nt, Human
ugagaaacaggugcuggugccaacuua

SEQ ID NO: 582669 - RNA, 24 nt, Human
ugaugugugccugcggucccagcu

SEQ ID NO: 582670 - RNA, 21 nt, Human
ugcccaggcuggaguacagug

SEQ ID NO: 582671 - RNA, 24 nt, Human
ugcccaggcuggaguacaguggug

SEQ ID NO: 582672 - RNA, 24 nt, Human
ugcccaggcuggucuccaacuccu

SEQ ID NO: 582673 - RNA, 23 nt, Human
ugccugcggucccagcuacuugg

SEQ ID NO: 582674 - RNA, 24 nt, Human
ugccugcggucccagcuacuuggg

SEQ ID NO: 582675 - RNA, 22 nt, Human
ugcucuguugcccaggcuggag

SEQ ID NO: 582676 - RNA, 19 nt, Human
uggaguacaguggugugau

SEQ ID NO: 582677 - RNA, 19 nt, Human
uggaguacaguggugugau

SEQ ID NO: 582678 - RNA, 28 nt, Human
uggaguacaguggugugauggcucuagc

SEQ ID NO: 582679 - RNA, 21 nt, Human
uggccaaagggcaugaaccug

SEQ ID NO: 582680 - RNA, 21 nt, Human
uggcucacgccuguaguccca

SEQ ID NO: 582681 - RNA, 22 nt, Human
uggcucacgccuguagucccaa

SEQ ID NO: 582682 - RNA, 24 nt, Human
uggcucacgccuguagucccaaua

SEQ ID NO: 582683 - RNA, 21 nt, Human
ugggacuacaggcauauacca

SEQ ID NO: 582684 - RNA, 24 nt, Human
ugggacuacaggcauauaccaccu

SEQ ID NO: 582685 - RNA, 19 nt, Human
ugggaggccaaggcaagag

SEQ ID NO: 582686 - RNA, 24 nt, Human
ugggaggccaaggcaagaggauca

SEQ ID NO: 582687 - RNA, 21 nt, Human
ugggccuaagagcaugccgag

SEQ ID NO: 582688 - RNA, 18 nt, Human
uggugugaucauagcuca

SEQ ID NO: 582689 - RNA, 24 nt, Human
uggugugaucauagcucacugcag

SEQ ID NO: 582690 - RNA, 25 nt, Human
ugguuuagacaccuaccucccugcu

SEQ ID NO: 582691 - RNA, 21 nt, Human
uguaggcgugagccacugcau

SEQ ID NO: 582692 - RNA, 19 nt, Human
uguguugcccaggcugguc

SEQ ID NO: 582693 - RNA, 24 nt, Human
uguguugcccaggcuggucuccaa

SEQ ID NO: 582694 - RNA, 23 nt, Human
uguguugugcucacuggcauaga

SEQ ID NO: 582695 - RNA, 22 nt, Human
uguugcccaggcuggucuccaa

SEQ ID NO: 582696 - RNA, 23 nt, Human
uuaugaucccuuuaacauccaau

SEQ ID NO: 582697 - RNA, 24 nt, Human
uucucacuguguugcccaggcugg

SEQ ID NO: 582698 - RNA, 24 nt, Human
uugcucuguugcccaggcuggagu

SEQ ID NO: 582699 - RNA, 22 nt, Human
uuuucccaccuagaacaccuuc

SEQ ID NO: 582700 - RNA, 19 nt, Human
uuuucuuucuuuuucucuc

SEQ ID NO: 582701 - RNA, 20 nt, Human
uuuuuguauuuuuuguagag

SEQ ID NO: 582702 - RNA, 23 nt, Human
aaacugaaacauguaaaaagcaa

SEQ ID NO: 582703 - RNA, 18 nt, Human
aggaacacaaaaaccaaa

SEQ ID NO: 582704 - RNA, 22 nt, Human
aggaacacaaaaaccaaaugca

SEQ ID NO: 582705 - RNA, 21 nt, Human
agguagucauuaacagucagg

SEQ ID NO: 582706 - RNA, 22 nt, Human
augaaguuagacacuuucccau

SEQ ID NO: 582707 - RNA, 18 nt, Human
cagaugagacuccaaaag

SEQ ID NO: 582708 - RNA, 21 nt, Human
caggcucagcgccgcgggccu

SEQ ID NO: 582709 - RNA, 20 nt, Human
cagggaccgaauuucguuuc

SEQ ID NO: 582710 - RNA, 23 nt, Human
caguuuauugagaaaaucaugau

SEQ ID NO: 582711 - RNA, 19 nt, Human
cccgggaggaggcccaggg

SEQ ID NO: 582712 - RNA, 24 nt, Human
ccgcggccucucccucgcggcucc

SEQ ID NO: 582713 - RNA, 18 nt, Human
cgccgcaggcucagcgcc

SEQ ID NO: 582714 - RNA, 20 nt, Human
cguuucguuuccgagaccag

SEQ ID NO: 582715 - RNA, 21 nt, Human
cucccucgcggcuccgcuagu

SEQ ID NO: 582716 - RNA, 21 nt, Human
gcagcgcccgggaggaggccc

SEQ ID NO: 582717 - RNA, 19 nt, Human
gggaggaggcccagggacc

SEQ ID NO: 582718 - RNA, 21 nt, Human
ucaggaacacaaaaaccaaau

SEQ ID NO: 582719 - RNA, 24 nt, Human
ugaaauuggccucuuccuuccccc

SEQ ID NO: 582720 - RNA, 24 nt, Human
uuccggguggcgcggcgcgcugag

SEQ ID NO: 582721 - RNA, 18 nt, Human
aaaaagcccaccugagag

SEQ ID NO: 582722 - RNA, 24 nt, Human
aaaaugugagaauuacgggcauga

SEQ ID NO: 582723 - RNA, 21 nt, Human
aaaggggaaaggagagagcag

SEQ ID NO: 582724 - RNA, 19 nt, Human
aacaacuggcccagggucc

SEQ ID NO: 582725 - RNA, 18 nt, Human
aaccuagcuggagcuagg

SEQ ID NO: 582726 - RNA, 18 nt, Human
aaccuccucccugccucc

SEQ ID NO: 582727 - RNA, 24 nt, Human
aagacugcucgaggccaggaguuc

SEQ ID NO: 582728 - RNA, 21 nt, Human
aaguagcugggaccacaggca

SEQ ID NO: 582729 - RNA, 24 nt, Human
aaguagcugggaccacaggcacgc

SEQ ID NO: 582730 - RNA, 19 nt, Human
aauuacgggcaugagccac

SEQ ID NO: 582731 - RNA, 21 nt, Human
aauuacgggcaugagccacug

SEQ ID NO: 582732 - RNA, 25 nt, Human
acauuagguagaaagagacggcugu

SEQ ID NO: 582733 - RNA, 21 nt, Human
acccaggcuggagugcagugu

SEQ ID NO: 582734 - RNA, 23 nt, Human
accccuaauccaaacaaccccuc

SEQ ID NO: 582735 - RNA, 18 nt, Human
accuccucccugccucca

SEQ ID NO: 582736 - RNA, 21 nt, Human
accuguaaugccagcauguug

SEQ ID NO: 582737 - RNA, 23 nt, Human
accuguagucccagcuauuuggg

SEQ ID NO: 582738 - RNA, 23 nt, Human
acgcagcacaccaccaugcccag

SEQ ID NO: 582739 - RNA, 24 nt, Human
acucuaucacccaggcuggagugc

SEQ ID NO: 582740 - RNA, 18 nt, Human
acugcccuccagccuggg

SEQ ID NO: 582741 - RNA, 24 nt, Human
acugcccuccagccugggcaacgg

SEQ ID NO: 582742 - RNA, 20 nt, Human
acuguguugcccaaagcugg

SEQ ID NO: 582743 - RNA, 23 nt, Human
agaauuacgggcaugagccacug

SEQ ID NO: 582744 - RNA, 20 nt, Human
agagacuggggauauagagg

SEQ ID NO: 582745 - RNA, 22 nt, Human
agagaugggagugcaauguggg

SEQ ID NO: 582746 - RNA, 18 nt, Human
agaggaaaaggggaaagg

SEQ ID NO: 582747 - RNA, 23 nt, Human
agccgggaguggugguguagacc

SEQ ID NO: 582748 - RNA, 23 nt, Human
aggaaggaaaaccguaucagcac

SEQ ID NO: 582749 - RNA, 23 nt, Human
aggaguucgagaccagccugggc

SEQ ID NO: 582750 - RNA, 21 nt, Human
aggucucacuguguugcccaa

SEQ ID NO: 582751 - RNA, 23 nt, Human
agugcagugucaugaacauggcu

SEQ ID NO: 582752 - RNA, 19 nt, Human
auacaccauuguccaaaga

SEQ ID NO: 582753 - RNA, 23 nt, Human
auaccuguaaugccagcauguug

SEQ ID NO: 582754 - RNA, 24 nt, Human
aucacgucacugcccuccagccug

SEQ ID NO: 582755 - RNA, 23 nt, Human
aucaguaucacacaaagcgaacc

SEQ ID NO: 582756 - RNA, 18 nt, Human
augaacauggcucacugc

SEQ ID NO: 582757 - RNA, 24 nt, Human
auggcucacugcagccuugaccuc

SEQ ID NO: 582758 - RNA, 22 nt, Human
auuuuuuuuuucuuuccuuuga

SEQ ID NO: 582759 - RNA, 24 nt, Human
caaaaccuccucccugccuccagg

SEQ ID NO: 582760 - RNA, 20 nt, Human
caaagccuacauuuuucuca

SEQ ID NO: 582761 - RNA, 20 nt, Human
caaaggccacuagggaugaa

SEQ ID NO: 582762 - RNA, 22 nt, Human
cacaaagcgaaccccagucucc

SEQ ID NO: 582763 - RNA, 18 nt, Human
cacaccaccaugcccagc

SEQ ID NO: 582764 - RNA, 19 nt, Human
cacacuaacacuuacugaa

SEQ ID NO: 582765 - RNA, 24 nt, Human
caccugagagggaagccaacucag

SEQ ID NO: 582766 - RNA, 22 nt, Human
cacucuaucacccaggcuggag

SEQ ID NO: 582767 - RNA, 23 nt, Human
cacucuaucacccaggcuggagu

SEQ ID NO: 582768 - RNA, 19 nt, Human
cacugcccuccagccuggg

SEQ ID NO: 582769 - RNA, 20 nt, Human
cacugcccuccagccugggc

SEQ ID NO: 582770 - RNA, 22 nt, Human
cacugcccuccagccugggcaa

SEQ ID NO: 582771 - RNA, 23 nt, Human
cacugcccuccagccugggcaac

SEQ ID NO: 582772 - RNA, 23 nt, Human
cacugcccuccagccugggcaac

SEQ ID NO: 582773 - RNA, 18 nt, Human
cacuguguugcccaaagc

SEQ ID NO: 582774 - RNA, 22 nt, Human
cagaagauauacccacuuacac

SEQ ID NO: 582775 - RNA, 23 nt, Human
cagcauguugggagcccgaggca

SEQ ID NO: 582776 - RNA, 24 nt, Human
cagcauguugggagcccgaggcag

SEQ ID NO: 582777 - RNA, 23 nt, Human
cagccuugaccuccaggcuaaag

SEQ ID NO: 582778 - RNA, 21 nt, Human
cauacaccauuguccaaagau

SEQ ID NO: 582779 - RNA, 18 nt, Human
cauccugcugccuccacc

SEQ ID NO: 582780 - RNA, 21 nt, Human
cauccugcugccuccaccccu

SEQ ID NO: 582781 - RNA, 27 nt, Human
cauggcucacugcagccuugaccucca

SEQ ID NO: 582782 - RNA, 24 nt, Human
ccaaaaugugagaauuacgggcau

SEQ ID NO: 582783 - RNA, 25 nt, Human
ccaggaguucgagaccagccugggc

SEQ ID NO: 582784 - RNA, 21 nt, Human
ccauacaccauuguccaaaga

SEQ ID NO: 582785 - RNA, 18 nt, Human
cccaccucugccucuugg

SEQ ID NO: 582786 - RNA, 19 nt, Human
ccgggcucaagcaauacuc

SEQ ID NO: 582787 - RNA, 20 nt, Human
ccgggcucaagcaauacucc

SEQ ID NO: 582788 - RNA, 22 nt, Human
ccgggcucaagcaauacuccug

SEQ ID NO: 582789 - RNA, 23 nt, Human
ccuaccuuagccuuccaaguagc

SEQ ID NO: 582790 - RNA, 23 nt, Human
ccucacauggcuuucuaucacuc

SEQ ID NO: 582791 - RNA, 23 nt, Human
ccucagaccaaucuccauuuugc

SEQ ID NO: 582792 - RNA, 26 nt, Human
ccucauaucuguguaugucagagggc

SEQ ID NO: 582793 - RNA, 22 nt, Human
ccuccagccugggcaacggugu

SEQ ID NO: 582794 - RNA, 26 nt, Human
ccuccuaccuuagccuuccaaguagc

SEQ ID NO: 582795 - RNA, 21 nt, Human
ccuguagucccagcuauuugg

SEQ ID NO: 582796 - RNA, 18 nt, Human
ccuuagggucuacccugg

SEQ ID NO: 582797 - RNA, 19 nt, Human
ccuugcugagcacuuuccc

SEQ ID NO: 582798 - RNA, 24 nt, Human
cucaaagaccuuccugacuucugc

SEQ ID NO: 582799 - RNA, 20 nt, Human
cucacucuaucacccaggcc

SEQ ID NO: 582800 - RNA, 21 nt, Human
cucacugcagccuugaccucc

SEQ ID NO: 582801 - RNA, 24 nt, Human
cucaggccuucccugggagucucu

SEQ ID NO: 582802 - RNA, 27 nt, Human
cucaucacugucucucuuauauaaacu

SEQ ID NO: 582803 - RNA, 24 nt, Human
cucauggaacccucagaccaaucu

SEQ ID NO: 582804 - RNA, 19 nt, Human
cuccuugcugagcacuuuc

SEQ ID NO: 582805 - RNA, 18 nt, Human
cucucagaacaagcucaa

SEQ ID NO: 582806 - RNA, 23 nt, Human
cucucguccccucacauggcuuu

SEQ ID NO: 582807 - RNA, 24 nt, Human
cuuagccuuccaaguagcugggac

SEQ ID NO: 582808 - RNA, 19 nt, Human
cuugcugagcacuuuccca

SEQ ID NO: 582809 - RNA, 19 nt, Human
gaacauggcucacugcagc

SEQ ID NO: 582810 - RNA, 19 nt, Human
gaauuacgggcaugagcca

SEQ ID NO: 582811 - RNA, 24 nt, Human
gaccuguagucccagcuauuuggg

SEQ ID NO: 582812 - RNA, 22 nt, Human
gagaauuacgggcaugagccac

SEQ ID NO: 582813 - RNA, 24 nt, Human
gagaauuacgggcaugagccacug

SEQ ID NO: 582814 - RNA, 18 nt, Human
gagauaaccuaaccaugg

SEQ ID NO: 582815 - RNA, 20 nt, Human
gagcuugcaaauggccccaa

SEQ ID NO: 582816 - RNA, 25 nt, Human
gaggcaggaagacugcucgaggcca

SEQ ID NO: 582817 - RNA, 18 nt, Human
gagggaagccaacucaga

SEQ ID NO: 582818 - RNA, 23 nt, Human
gauaagaggaaaaggggaaagga

SEQ ID NO: 582819 - RNA, 20 nt, Human
gcagcacaccaccaugccca

SEQ ID NO: 582820 - RNA, 19 nt, Human
gcagccuugaccuccaggc

SEQ ID NO: 582821 - RNA, 20 nt, Human
gcccccucuucuuguaacuu

SEQ ID NO: 582822 - RNA, 22 nt, Human
gcccgaggcaggaagacugcuc

SEQ ID NO: 582823 - RNA, 23 nt, Human
gccuaucaauucugguuuuugcu

SEQ ID NO: 582824 - RNA, 22 nt, Human
gccucgaccucccaaaauguga

SEQ ID NO: 582825 - RNA, 19 nt, Human
gccugggcaacauauggag

SEQ ID NO: 582826 - RNA, 22 nt, Human
gccuugaccuccaggcuaaagg

SEQ ID NO: 582827 - RNA, 21 nt, Human
gcucacugcagccuugaccuc

SEQ ID NO: 582828 - RNA, 19 nt, Human
gcugggcgcgguggcucau

SEQ ID NO: 582829 - RNA, 22 nt, Human
ggcaugagccacugugccuggc

SEQ ID NO: 582830 - RNA, 20 nt, Human
ggccucaggccuucccuggg

SEQ ID NO: 582831 - RNA, 20 nt, Human
gggaguggugguguagaccu

SEQ ID NO: 582832 - RNA, 24 nt, Human
gggcgcgguggcucauaccuguaa

SEQ ID NO: 582833 - RNA, 24 nt, Human
ggggcccaccucugccucuuggag

SEQ ID NO: 582834 - RNA, 24 nt, Human
gguggcucauaccuguaaugccag

SEQ ID NO: 582835 - RNA, 22 nt, Human
ggugggcuggaagugcugagaa

SEQ ID NO: 582836 - RNA, 22 nt, Human
guaguuccuaggcagcaugggg

SEQ ID NO: 582837 - RNA, 21 nt, Human
gugaugccacuaacacacuaa

SEQ ID NO: 582838 - RNA, 21 nt, Human
guuuuuuuuuuuuuuugugga

SEQ ID NO: 582839 - RNA, 18 nt, Human
uaaaaaauuagccgggag

SEQ ID NO: 582840 - RNA, 23 nt, Human
uaaaggaauccuccuccuaccuu

SEQ ID NO: 582841 - RNA, 24 nt, Human
uaacacacuaacacuuacugaaaa

SEQ ID NO: 582842 - RNA, 21 nt, Human
uaagaggaaaaggggaaagga

SEQ ID NO: 582843 - RNA, 19 nt, Human
uaaguaacacuucagcaaa

SEQ ID NO: 582844 - RNA, 25 nt, Human
uaauggauuuugccaaauugcuauu

SEQ ID NO: 582845 - RNA, 24 nt, Human
uacccacuuacacugccccaaagc

SEQ ID NO: 582846 - RNA, 24 nt, Human
uaccuguaaugccagcauguuggg

SEQ ID NO: 582847 - RNA, 24 nt, Human
uacgggcaugagccacugugccug

SEQ ID NO: 582848 - RNA, 23 nt, Human
uacuccugccucgaccucccaaa

SEQ ID NO: 582849 - RNA, 24 nt, Human
uacuccugccucgaccucccaaaa

SEQ ID NO: 582850 - RNA, 22 nt, Human
uagagguggacaaaaccuccuu

SEQ ID NO: 582851 - RNA, 20 nt, Human
uagggccagcucaugaaccc

SEQ ID NO: 582852 - RNA, 21 nt, Human
uauauggaugggggugggcug

SEQ ID NO: 582853 - RNA, 20 nt, Human
uaucacacaaagcgaacccc

SEQ ID NO: 582854 - RNA, 18 nt, Human
uauggaugggggugggcu

SEQ ID NO: 582855 - RNA, 19 nt, Human
ucacauuguccugguugga

SEQ ID NO: 582856 - RNA, 24 nt, Human
ucacccaggcuggagugcaguguc

SEQ ID NO: 582857 - RNA, 23 nt, Human
ucacgucacugcccuccagccug

SEQ ID NO: 582858 - RNA, 24 nt, Human
ucacucuaucacccaggcuggagu

SEQ ID NO: 582859 - RNA, 19 nt, Human
ucacugcagccuugaccuc

SEQ ID NO: 582860 - RNA, 23 nt, Human
ucacugcagccuugaccuccagg

SEQ ID NO: 582861 - RNA, 24 nt, Human
ucacugcccuccagccugggcaac

SEQ ID NO: 582862 - RNA, 19 nt, Human
ucagaacaagcucaaagac

SEQ ID NO: 582863 - RNA, 22 nt, Human
ucagaccaaucuccauuuugcc

SEQ ID NO: 582864 - RNA, 24 nt, Human
uccaaguagcugggaccacaggca

SEQ ID NO: 582865 - RNA, 24 nt, Human
ucccaaaaugugagaauuacgggc

SEQ ID NO: 582866 - RNA, 21 nt, Human
ucccugcauccagcccggccu

SEQ ID NO: 582867 - RNA, 21 nt, Human
uccgggcucaagcaauacucc

SEQ ID NO: 582868 - RNA, 22 nt, Human
ucgaggccaggaguucgagacc

SEQ ID NO: 582869 - RNA, 24 nt, Human
ucuaucacccaggcuggagugcag

SEQ ID NO: 582870 - RNA, 22 nt, Human
ucucacucuaucacccaggcug

SEQ ID NO: 582871 - RNA, 23 nt, Human
ucucacucuaucacccaggcugg

SEQ ID NO: 582872 - RNA, 24 nt, Human
ucucacucuaucacccaggcugga

SEQ ID NO: 582873 - RNA, 26 nt, Human
ucucacucuaucacccaggcuggagu

SEQ ID NO: 582874 - RNA, 27 nt, Human
ucucacucuaucacccaggcuggagug

SEQ ID NO: 582875 - RNA, 18 nt, Human
ucucacuguguugcccaa

SEQ ID NO: 582876 - RNA, 19 nt, Human
ucucacuguguugcccaaa

SEQ ID NO: 582877 - RNA, 24 nt, Human
ucucacuguguugcccaaagcugg

SEQ ID NO: 582878 - RNA, 21 nt, Human
ucucgaacuuccgggcucaag

SEQ ID NO: 582879 - RNA, 18 nt, Human
ugaaccuagcuggagcua

SEQ ID NO: 582880 - RNA, 18 nt, Human
ugaagaccucccaccccc

SEQ ID NO: 582881 - RNA, 22 nt, Human
ugacuugugcagaaucucaucu

SEQ ID NO: 582882 - RNA, 22 nt, Human
ugagagagaccuagcccgagug

SEQ ID NO: 582883 - RNA, 22 nt, Human
ugagagggaagccaacucagau

SEQ ID NO: 582884 - RNA, 18 nt, Human
ugagucccugcauccagc

SEQ ID NO: 582885 - RNA, 22 nt, Human
ugcauuugggucauuuucaauc

SEQ ID NO: 582886 - RNA, 22 nt, Human
ugcucgagcccugggguguuga

SEQ ID NO: 582887 - RNA, 22 nt, Human
uggaacccucagaccaaucucc

SEQ ID NO: 582888 - RNA, 24 nt, Human
uggagugcagugucaugaacaugg

SEQ ID NO: 582889 - RNA, 24 nt, Human
uggcucacugcagccuugaccucc

SEQ ID NO: 582890 - RNA, 24 nt, Human
uggcucauaccuguaaugccagca

SEQ ID NO: 582891 - RNA, 23 nt, Human
ugggaaggguaguaccaaggagg

SEQ ID NO: 582892 - RNA, 26 nt, Human
ugggaccacaggcacgcagcacacca

SEQ ID NO: 582893 - RNA, 28 nt, Human
ugggaccacaggcacgcagcacaccacc

SEQ ID NO: 582894 - RNA, 29 nt, Human
ugggaccacaggcacgcagcacaccacca

SEQ ID NO: 582895 - RNA, 26 nt, Human
ugggagcccgaggcaggaagacugac

SEQ ID NO: 582896 - RNA, 20 nt, Human
ugggaggcugaagugggaca

SEQ ID NO: 582897 - RNA, 24 nt, Human
ugggaggcugaagugggacaacug

SEQ ID NO: 582898 - RNA, 24 nt, Human
ugggcaacauauggagacccuguc

SEQ ID NO: 582899 - RNA, 24 nt, Human
uggugguguagaccuguaguccca

SEQ ID NO: 582900 - RNA, 23 nt, Human
uguaaugccagcauguugggagc

SEQ ID NO: 582901 - RNA, 20 nt, Human
uguccugguuggauacuuuc

SEQ ID NO: 582902 - RNA, 19 nt, Human
ugugcaguuuccuuucugc

SEQ ID NO: 582903 - RNA, 18 nt, Human
ugugcuggaauguauaug

SEQ ID NO: 582904 - RNA, 25 nt, Human
uguguugcccaaagcuggucucgaa

SEQ ID NO: 582905 - RNA, 19 nt, Human
uuaaagacuuguccaacca

SEQ ID NO: 582906 - RNA, 19 nt, Human
uucacagaagauauaccca

SEQ ID NO: 582907 - RNA, 23 nt, Human
uuccaaguagcugggaccacagg

SEQ ID NO: 582908 - RNA, 24 nt, Human
uuccaaguagcugggaccacaggc

SEQ ID NO: 582909 - RNA, 24 nt, Human
uucccaccauacaccauuguccaa

SEQ ID NO: 582910 - RNA, 22 nt, Human
uuccucucagaacaagcucaaa

SEQ ID NO: 582911 - RNA, 23 nt, Human
uucugcucauccugcugccucca

SEQ ID NO: 582912 - RNA, 26 nt, Human
uugaagaccucccacccccaaaggcc

SEQ ID NO: 582913 - RNA, 22 nt, Human
uuggauacuuucugucuccugu

SEQ ID NO: 582914 - RNA, 20 nt, Human
uuggcggccucaggccuucc

SEQ ID NO: 582915 - RNA, 19 nt, Human
uugugcagaaucucaucuc

SEQ ID NO: 582916 - RNA, 24 nt, Human
uuugagacaaguucucacucuauc

SEQ ID NO: 582917 - RNA, 18 nt, Human
uuuguggagaccuccaau

SEQ ID NO: 582918 - RNA, 21 nt, Human
uuuucagaagugagaugggcu

SEQ ID NO: 582919 - RNA, 21 nt, Human
uuuuccucucagaacaagcuc

SEQ ID NO: 582920 - RNA, 21 nt, Human
aaacaaacaaaacacauuuuu

SEQ ID NO: 582921 - RNA, 24 nt, Human
aaaguccugggauuacaggcauga

SEQ ID NO: 582922 - RNA, 23 nt, Human
aacaguuaaaaacaaacaaaaca

SEQ ID NO: 582923 - RNA, 20 nt, Human
aaccagaaagacagggauuc

SEQ ID NO: 582924 - RNA, 24 nt, Human
aacgugcugagauuguaggcguga

SEQ ID NO: 582925 - RNA, 22 nt, Human
aaggagcacugaccagacagag

SEQ ID NO: 582926 - RNA, 22 nt, Human
acaaaaaugaaaaucuaguguc

SEQ ID NO: 582927 - RNA, 27 nt, Human
acagcagcuggugguacaaaauugggc

SEQ ID NO: 582928 - RNA, 19 nt, Human
acagcccccugugccagaa

SEQ ID NO: 582929 - RNA, 20 nt, Human
accagacagagagaaagcca

SEQ ID NO: 582930 - RNA, 24 nt, Human
accauguuggccaggauggucucg

SEQ ID NO: 582931 - RNA, 25 nt, Human
acccaccucggccucccaaaguccu

SEQ ID NO: 582932 - RNA, 18 nt, Human
acccccuccccacacccg

SEQ ID NO: 582933 - RNA, 18 nt, Human
accugaccuuagguuggu

SEQ ID NO: 582934 - RNA, 24 nt, Human
acucaucacaccagcagccaugcc

SEQ ID NO: 582935 - RNA, 24 nt, Human
acuguguuggccaggauggucuug

SEQ ID NO: 582936 - RNA, 20 nt, Human
agaaaccacccccauaacuc

SEQ ID NO: 582937 - RNA, 21 nt, Human
agaaaguaaagucaagucaag

SEQ ID NO: 582938 - RNA, 24 nt, Human
agaacagacaggcuacucccacug

SEQ ID NO: 582939 - RNA, 23 nt, Human
agaagguugggggucaaagcuaa

SEQ ID NO: 582940 - RNA, 23 nt, Human
agagcucuucuauguccccagcu

SEQ ID NO: 582941 - RNA, 20 nt, Human
agagggcuggagcccaaggc

SEQ ID NO: 582942 - RNA, 23 nt, Human
agcacagcuccucaguacuaccu

SEQ ID NO: 582943 - RNA, 23 nt, Human
agcacugaccagacagagagaaa

SEQ ID NO: 582944 - RNA, 21 nt, Human
agcggaacagaagccccacaa

SEQ ID NO: 582945 - RNA, 23 nt, Human
agcggaacagaagccccacaaga

SEQ ID NO: 582946 - RNA, 21 nt, Human
agcucauggggucagaagucc

SEQ ID NO: 582947 - RNA, 19 nt, Human
aggcagagggcuggagccc

SEQ ID NO: 582948 - RNA, 24 nt, Human
aggcaggaaaaacaccagcuccag

SEQ ID NO: 582949 - RNA, 20 nt, Human
aggcgcccaccaccacgccc

SEQ ID NO: 582950 - RNA, 25 nt, Human
aggcuggagugcaguggcacaaucu

SEQ ID NO: 582951 - RNA, 24 nt, Human
agggauucucccgccucagccucc

SEQ ID NO: 582952 - RNA, 19 nt, Human
aggugaugugucugucuag

SEQ ID NO: 582953 - RNA, 18 nt, Human
aguacaggccugcccagu

SEQ ID NO: 582954 - RNA, 18 nt, Human
aguagcugggauuacagg

SEQ ID NO: 582955 - RNA, 19 nt, Human
aguagcugggauuacaggc

SEQ ID NO: 582956 - RNA, 23 nt, Human
aguagcugggauuacaggcgccc

SEQ ID NO: 582957 - RNA, 20 nt, Human
agugcaguggcacaaucucg

SEQ ID NO: 582958 - RNA, 24 nt, Human
agugcaguggcacaaucucggcuc

SEQ ID NO: 582959 - RNA, 20 nt, Human
aguguaguggcacaaucucg

SEQ ID NO: 582960 - RNA, 24 nt, Human
aguguaguggcacaaucucgguuc

SEQ ID NO: 582961 - RNA, 24 nt, Human
auaaagucuuacuucagccagaag

SEQ ID NO: 582962 - RNA, 20 nt, Human
auauccuaaguuccagcuca

SEQ ID NO: 582963 - RNA, 20 nt, Human
aucugccaucgucacagagc

SEQ ID NO: 582964 - RNA, 24 nt, Human
augauccacccaccucggccuccc

SEQ ID NO: 582965 - RNA, 22 nt, Human
augcugcccucuggcagggggu

SEQ ID NO: 582966 - RNA, 18 nt, Human
augggguuucaccauguu

SEQ ID NO: 582967 - RNA, 22 nt, Human
augggguuucaccauguuggcc

SEQ ID NO: 582968 - RNA, 24 nt, Human
augggguuucaccauguuggccag

SEQ ID NO: 582969 - RNA, 24 nt, Human
augggguuucacuguguuggccag

SEQ ID NO: 582970 - RNA, 18 nt, Human
auucuccugccucagccu

SEQ ID NO: 582971 - RNA, 19 nt, Human
auugggaagaggacuucua

SEQ ID NO: 582972 - RNA, 24 nt, Human
caaaagcaucuaacccccuaaacc

SEQ ID NO: 582973 - RNA, 24 nt, Human
caaaguccugggauuacaggcaug

SEQ ID NO: 582974 - RNA, 20 nt, Human
caaccuccgccucccagguu

SEQ ID NO: 582975 - RNA, 24 nt, Human
caacgugcugagauuguaggcgug

SEQ ID NO: 582976 - RNA, 18 nt, Human
caagaugcacaucuugcu

SEQ ID NO: 582977 - RNA, 22 nt, Human
cacaaccaggguacacccaaau

SEQ ID NO: 582978 - RNA, 24 nt, Human
caccaagcccaguuaauuuuugua

SEQ ID NO: 582979 - RNA, 21 nt, Human
caccagcagccaugccuuugc

SEQ ID NO: 582980 - RNA, 18 nt, Human
caccauguuggccaggau

SEQ ID NO: 582981 - RNA, 22 nt, Human
caccauguuggccaggaugguc

SEQ ID NO: 582982 - RNA, 24 nt, Human
caccauguuggccaggauggucuc

SEQ ID NO: 582983 - RNA, 22 nt, Human
cacccaccucggccucccaaag

SEQ ID NO: 582984 - RNA, 23 nt, Human
cacccaccucggccucccaaagu

SEQ ID NO: 582985 - RNA, 19 nt, Human
caccccaugaauucacacc

SEQ ID NO: 582986 - RNA, 24 nt, Human
caccucggccucccaaaguccugg

SEQ ID NO: 582987 - RNA, 21 nt, Human
cacuacaaccuccgccuccca

SEQ ID NO: 582988 - RNA, 19 nt, Human
cacucaucacaccagcagc

SEQ ID NO: 582989 - RNA, 21 nt, Human
cacuggcagccaggcaagagg

SEQ ID NO: 582990 - RNA, 20 nt, Human
cacugggcucuguacacccu

SEQ ID NO: 582991 - RNA, 18 nt, Human
cacuguguuggccaggau

SEQ ID NO: 582992 - RNA, 21 nt, Human
cacuguguuggccaggauggu

SEQ ID NO: 582993 - RNA, 24 nt, Human
cacuguguuggccaggauggucuu

SEQ ID NO: 582994 - RNA, 21 nt, Human
cagaaaccacccccauaacuc

SEQ ID NO: 582995 - RNA, 18 nt, Human
cagagcucuucuaugucc

SEQ ID NO: 582996 - RNA, 20 nt, Human
cagccuccugaguagcuggg

SEQ ID NO: 582997 - RNA, 20 nt, Human
cagccuccugaguagcuggg

SEQ ID NO: 582998 - RNA, 19 nt, Human
cagcuccucaguacuaccu

SEQ ID NO: 582999 - RNA, 22 nt, Human
cagcuggugguacaaaauuggg

SEQ ID NO: 583000 - RNA, 22 nt, Human
caggaaaaacaccagcuccagg

SEQ ID NO: 583001 - RNA, 21 nt, Human
caggcgcccaccaccacgccc

SEQ ID NO: 583002 - RNA, 19 nt, Human
caucacaccagcagccaug

SEQ ID NO: 583003 - RNA, 21 nt, Human
caucugccaucgucacagagc

SEQ ID NO: 583004 - RNA, 18 nt, Human
cauucaaaagcaucuaac

SEQ ID NO: 583005 - RNA, 24 nt, Human
ccaaaguccugggauuacaggcau

SEQ ID NO: 583006 - RNA, 22 nt, Human
ccaacgugcugagauuguaggc

SEQ ID NO: 583007 - RNA, 22 nt, Human
ccaacgugcugagauuguaggc

SEQ ID NO: 583008 - RNA, 24 nt, Human
ccaacgugcugagauuguaggcgu

SEQ ID NO: 583009 - RNA, 19 nt, Human
ccagaaaguacaaaugggg

SEQ ID NO: 583010 - RNA, 23 nt, Human
ccagaacagacaggcuacuccca

SEQ ID NO: 583011 - RNA, 21 nt, Human
ccagacagagagaaagccaca

SEQ ID NO: 583012 - RNA, 21 nt, Human
ccagauggaauccagaaagua

SEQ ID NO: 583013 - RNA, 20 nt, Human
ccaggcagucagccguugcc

SEQ ID NO: 583014 - RNA, 24 nt, Human
cccaaaguccugggauuacaggca

SEQ ID NO: 583015 - RNA, 22 nt, Human
cccaauuaauuuuuguauuuuu

SEQ ID NO: 583016 - RNA, 24 nt, Human
cccaggaaaaggaauguagcagau

SEQ ID NO: 583017 - RNA, 21 nt, Human
cccagguucaagggauucucc

SEQ ID NO: 583018 - RNA, 23 nt, Human
cccaguuaauuuuuguauuuuua

SEQ ID NO: 583019 - RNA, 21 nt, Human
ccccuccacaguauuguguau

SEQ ID NO: 583020 - RNA, 19 nt, Human
ccccuccccacacccagcc

SEQ ID NO: 583021 - RNA, 24 nt, Human
cccgccucagccuccugaguagcu

SEQ ID NO: 583022 - RNA, 18 nt, Human
cccugggggcccugugag

SEQ ID NO: 583023 - RNA, 23 nt, Human
ccuaaaauaaacccugggggccc

SEQ ID NO: 583024 - RNA, 24 nt, Human
ccucccagguucaagggauucucc

SEQ ID NO: 583025 - RNA, 24 nt, Human
ccucuggguaagccacauaacccu

SEQ ID NO: 583026 - RNA, 22 nt, Human
ccugacuucaugauccacccac

SEQ ID NO: 583027 - RNA, 23 nt, Human
ccugaguagcugggauuacaggc

SEQ ID NO: 583028 - RNA, 23 nt, Human
ccugaguagcugggauuacaggc

SEQ ID NO: 583029 - RNA, 23 nt, Human
ccugaguagcugggauuacaggc

SEQ ID NO: 583030 - RNA, 24 nt, Human
ccugaguagcugggauuacaggcg

SEQ ID NO: 583031 - RNA, 19 nt, Human
ccugccucaccaucucugg

SEQ ID NO: 583032 - RNA, 23 nt, Human
ccugccucagccuccugaguagc

SEQ ID NO: 583033 - RNA, 19 nt, Human
ccuggcacauuggcaugaa

SEQ ID NO: 583034 - RNA, 19 nt, Human
ccuggccucgugauccacc

SEQ ID NO: 583035 - RNA, 21 nt, Human
ccuggccucgugauccaccug

SEQ ID NO: 583036 - RNA, 21 nt, Human
ccugugccagaacagacaggc

SEQ ID NO: 583037 - RNA, 23 nt, Human
ccuugcucuguugccaggcugga

SEQ ID NO: 583038 - RNA, 24 nt, Human
cgccucagccuccugaguagcugg

SEQ ID NO: 583039 - RNA, 21 nt, Human
cgccuggguggcugugaaggc

SEQ ID NO: 583040 - RNA, 20 nt, Human
cgucacagagcucuucuaug

SEQ ID NO: 583041 - RNA, 20 nt, Human
cuaaaauaaacccugggggc

SEQ ID NO: 583042 - RNA, 24 nt, Human
cuacaaccuccgccucccagguuc

SEQ ID NO: 583043 - RNA, 22 nt, Human
cuacccccuccccacacccagc

SEQ ID NO: 583044 - RNA, 22 nt, Human
cuagugucuucccuuguuuucu

SEQ ID NO: 583045 - RNA, 19 nt, Human
cucaaaugccaccuccuca

SEQ ID NO: 583046 - RNA, 24 nt, Human
cucacuacaaccuccgccucccag

SEQ ID NO: 583047 - RNA, 22 nt, Human
cucagagaggccuuccuggacc

SEQ ID NO: 583048 - RNA, 24 nt, Human
cucagccuccugaguagcugggau

SEQ ID NO: 583049 - RNA, 24 nt, Human
cucagccuccugaguagcugggau

SEQ ID NO: 583050 - RNA, 18 nt, Human
cuccugacuucaugaucc

SEQ ID NO: 583051 - RNA, 22 nt, Human
cuccugccucagccuccugagu

SEQ ID NO: 583052 - RNA, 21 nt, Human
cuccuggccucgugauccacc

SEQ ID NO: 583053 - RNA, 24 nt, Human
cuccuggccucgugauccaccugc

SEQ ID NO: 583054 - RNA, 21 nt, Human
cugaccagacagagagaaagc

SEQ ID NO: 583055 - RNA, 22 nt, Human
cugaguagcugggauuacaggc

SEQ ID NO: 583056 - RNA, 22 nt, Human
cugaguagcugggauuacaggc

SEQ ID NO: 583057 - RNA, 24 nt, Human
cugaguagcugggauuacaggcgu

SEQ ID NO: 583058 - RNA, 23 nt, Human
cugccucagccuccugaguagcu

SEQ ID NO: 583059 - RNA, 21 nt, Human
gaaacaccaauggaaauucca

SEQ ID NO: 583060 - RNA, 23 nt, Human
gaaaccacccccauaacucuggu

SEQ ID NO: 583061 - RNA, 21 nt, Human
gaacagacaggcuacucccac

SEQ ID NO: 583062 - RNA, 22 nt, Human
gacuucaugauccacccaccuc

SEQ ID NO: 583063 - RNA, 21 nt, Human
gagacggagccuugcucuguu

SEQ ID NO: 583064 - RNA, 20 nt, Human
gagaugggguuucaccaugu

SEQ ID NO: 583065 - RNA, 24 nt, Human
gagaugggguuucaccauguuggc

SEQ ID NO: 583066 - RNA, 18 nt, Human
gagcagagcaguggccgg

SEQ ID NO: 583067 - RNA, 19 nt, Human
gagcagagcaguggccggc

SEQ ID NO: 583068 - RNA, 21 nt, Human
gagggcuggagcccaaggcug

SEQ ID NO: 583069 - RNA, 20 nt, Human
gaguagcugggauuacaggc

SEQ ID NO: 583070 - RNA, 24 nt, Human
gaguagcugggauuacaggcgugc

SEQ ID NO: 583071 - RNA, 18 nt, Human
gauuacaggcaugagcca

SEQ ID NO: 583072 - RNA, 19 nt, Human
gauuacaggcaugagccac

SEQ ID NO: 583073 - RNA, 22 nt, Human
gauuacaggcaugagccacugc

SEQ ID NO: 583074 - RNA, 20 nt, Human
gcccaauuaauuuuuguauu

SEQ ID NO: 583075 - RNA, 22 nt, Human
gcccaguuaauuuuuguauuuu

SEQ ID NO: 583076 - RNA, 20 nt, Human
gccucagccuccugaguagc

SEQ ID NO: 583077 - RNA, 24 nt, Human
gccuugcucuguugccaggcugga

SEQ ID NO: 583078 - RNA, 18 nt, Human
gcucagucugguccuugg

SEQ ID NO: 583079 - RNA, 19 nt, Human
gcuggagugcaguggcaca

SEQ ID NO: 583080 - RNA, 18 nt, Human
ggagagguggggucugcu

SEQ ID NO: 583081 - RNA, 22 nt, Human
ggauuacaggcaugagccacug

SEQ ID NO: 583082 - RNA, 18 nt, Human
ggccucgugauccaccug

SEQ ID NO: 583083 - RNA, 22 nt, Human
ggccucgugauccaccugccuc

SEQ ID NO: 583084 - RNA, 24 nt, Human
gggauucucccgccucagccuccu

SEQ ID NO: 583085 - RNA, 19 nt, Human
gggcggugucuccgccuag

SEQ ID NO: 583086 - RNA, 22 nt, Human
gggguuucaccauguuggccag

SEQ ID NO: 583087 - RNA, 22 nt, Human
gggguuucacuguguuggccag

SEQ ID NO: 583088 - RNA, 23 nt, Human
gggguuucacuguguuggccagg

SEQ ID NO: 583089 - RNA, 18 nt, Human
ggguuucaccauguuggc

SEQ ID NO: 583090 - RNA, 18 nt, Human
ggguuucacuguguuggc

SEQ ID NO: 583091 - RNA, 20 nt, Human
ggucuugaucuccugacuuc

SEQ ID NO: 583092 - RNA, 24 nt, Human
gguuucaccauguuggccaggaug

SEQ ID NO: 583093 - RNA, 19 nt, Human
guagagaugggguuucacc

SEQ ID NO: 583094 - RNA, 21 nt, Human
guagagaugggguuucaccau

SEQ ID NO: 583095 - RNA, 22 nt, Human
guagagaugggguuucaccaug

SEQ ID NO: 583096 - RNA, 18 nt, Human
guagcugggauuacaggc

SEQ ID NO: 583097 - RNA, 18 nt, Human
guagcugggauuacaggc

SEQ ID NO: 583098 - RNA, 18 nt, Human
guagcugggauuacaggc

SEQ ID NO: 583099 - RNA, 20 nt, Human
guccuugggagagguggggu

SEQ ID NO: 583100 - RNA, 24 nt, Human
gucucgcucuguggccaggcugga

SEQ ID NO: 583101 - RNA, 24 nt, Human
gugauccaccugccucgaccuccc

SEQ ID NO: 583102 - RNA, 21 nt, Human
gugcugagauuguaggcguga

SEQ ID NO: 583103 - RNA, 18 nt, Human
guggaaugaaugaaugaa

SEQ ID NO: 583104 - RNA, 19 nt, Human
uaaaauaaacccugggggc

SEQ ID NO: 583105 - RNA, 20 nt, Human
uaaccccuccacaguauugu

SEQ ID NO: 583106 - RNA, 22 nt, Human
uaagugagugcuauuggacuug

SEQ ID NO: 583107 - RNA, 22 nt, Human
uaaguuccagcucaugggguca

SEQ ID NO: 583108 - RNA, 19 nt, Human
uaaucuauuucgcuuuccc

SEQ ID NO: 583109 - RNA, 22 nt, Human
uaauuuuuguauuuuuaguaga

SEQ ID NO: 583110 - RNA, 23 nt, Human
uaauuuuuguauuuuuguagaga

SEQ ID NO: 583111 - RNA, 22 nt, Human
uacacccucaaugcugcccucu

SEQ ID NO: 583112 - RNA, 23 nt, Human
uacaggcaugagccacugcgccc

SEQ ID NO: 583113 - RNA, 22 nt, Human
uacccccuccccacacccagcc

SEQ ID NO: 583114 - RNA, 21 nt, Human
uacuucuagaucagauauccu

SEQ ID NO: 583115 - RNA, 22 nt, Human
uagagaugggguuucaccaugu

SEQ ID NO: 583116 - RNA, 22 nt, Human
uagaugaaauuauuggccaauu

SEQ ID NO: 583117 - RNA, 20 nt, Human
uaguagacaugggguuucac

SEQ ID NO: 583118 - RNA, 23 nt, Human
uaguagacaugggguuucacugu

SEQ ID NO: 583119 - RNA, 24 nt, Human
uaguagacaugggguuucacugug

SEQ ID NO: 583120 - RNA, 18 nt, Human
ucacaaaguacaggccug

SEQ ID NO: 583121 - RNA, 24 nt, Human
ucaccauguuggccaggauggucu

SEQ ID NO: 583122 - RNA, 20 nt, Human
ucaccccaugaauucacacc

SEQ ID NO: 583123 - RNA, 19 nt, Human
ucacuacaaccuccgccuc

SEQ ID NO: 583124 - RNA, 24 nt, Human
ucacuacaaccuccgccucccagg

SEQ ID NO: 583125 - RNA, 25 nt, Human
ucacuacaaccuccgccucccaggu

SEQ ID NO: 583126 - RNA, 27 nt, Human
ucacuacaaccuccgccucccagguuc

SEQ ID NO: 583127 - RNA, 19 nt, Human
ucacugcaaccucugauuc

SEQ ID NO: 583128 - RNA, 28 nt, Human
ucacugcaaccucugauucggguccucc

SEQ ID NO: 583129 - RNA, 22 nt, Human
ucacugcaaccucugauucucc

SEQ ID NO: 583130 - RNA, 24 nt, Human
ucacugcaaccucugauucuccug

SEQ ID NO: 583131 - RNA, 23 nt, Human
ucagaccaagaugcacaucuugc

SEQ ID NO: 583132 - RNA, 20 nt, Human
ucagccuccugaguagcugg

SEQ ID NO: 583133 - RNA, 20 nt, Human
ucagccuccugaguagcugg

SEQ ID NO: 583134 - RNA, 18 nt, Human
ucagggacauuuguggca

SEQ ID NO: 583135 - RNA, 18 nt, Human
ucauggggucagaagucc

SEQ ID NO: 583136 - RNA, 24 nt, Human
uccaccugccucgaccucccaacg

SEQ ID NO: 583137 - RNA, 18 nt, Human
uccagaaaguacaaaugg

SEQ ID NO: 583138 - RNA, 20 nt, Human
uccaguguaaggcacuugag

SEQ ID NO: 583139 - RNA, 24 nt, Human
ucccaaaguccugggauuacaggc

SEQ ID NO: 583140 - RNA, 24 nt, Human
ucccaacgugcugagauuguaggc

SEQ ID NO: 583141 - RNA, 21 nt, Human
ucccagguucaagggauucuc

SEQ ID NO: 583142 - RNA, 24 nt, Human
ucccagguucaagggauucucccg

SEQ ID NO: 583143 - RNA, 23 nt, Human
ucccuaaaauaaacccugggggc

SEQ ID NO: 583144 - RNA, 24 nt, Human
uccugaguagcugggauuacaggc

SEQ ID NO: 583145 - RNA, 24 nt, Human
uccugaguagcugggauuacaggc

SEQ ID NO: 583146 - RNA, 24 nt, Human
ucucccgccucagccuccugagua

SEQ ID NO: 583147 - RNA, 21 nt, Human
ucucgcucuguggccaggcug

SEQ ID NO: 583148 - RNA, 22 nt, Human
ucucgcucuguggccaggcugg

SEQ ID NO: 583149 - RNA, 23 nt, Human
ucucgcucuguggccaggcugga

SEQ ID NO: 583150 - RNA, 23 nt, Human
ucucucucccuaaaauaaacccu

SEQ ID NO: 583151 - RNA, 24 nt, Human
ucugauucuccugccucagccucc

SEQ ID NO: 583152 - RNA, 21 nt, Human
ucugguuucugguacaguggg

SEQ ID NO: 583153 - RNA, 23 nt, Human
ucuguggccaggcuggaguguag

SEQ ID NO: 583154 - RNA, 18 nt, Human
ucuguugccaggcuggag

SEQ ID NO: 583155 - RNA, 23 nt, Human
ucuguugccaggcuggagugcag

SEQ ID NO: 583156 - RNA, 23 nt, Human
ugaaaaggcagagggcuggagcc

SEQ ID NO: 583157 - RNA, 18 nt, Human
ugaaucaccccaugaauu

SEQ ID NO: 583158 - RNA, 21 nt, Human
ugaaugaaugaaugauuagcc

SEQ ID NO: 583159 - RNA, 22 nt, Human
ugaaugaaugaaugauuagcca

SEQ ID NO: 583160 - RNA, 23 nt, Human
ugacagcagcuggugguacaaaa

SEQ ID NO: 583161 - RNA, 23 nt, Human
ugacccuccauauggaacagccc

SEQ ID NO: 583162 - RNA, 20 nt, Human
ugacuucaugauccacccac

SEQ ID NO: 583163 - RNA, 18 nt, Human
ugagauuguaggcgugag

SEQ ID NO: 583164 - RNA, 19 nt, Human
ugagauuguaggcgugagc

SEQ ID NO: 583165 - RNA, 20 nt, Human
ugagauuguaggcgugagcc

SEQ ID NO: 583166 - RNA, 21 nt, Human
ugagauuguaggcgugagccg

SEQ ID NO: 583167 - RNA, 25 nt, Human
ugagauuguaggcgugagccgcugc

SEQ ID NO: 583168 - RNA, 19 nt, Human
ugagucucgcucuguggcc

SEQ ID NO: 583169 - RNA, 24 nt, Human
ugauccacccaccucggccuccca

SEQ ID NO: 583170 - RNA, 18 nt, Human
ugauucuccugccucagc

SEQ ID NO: 583171 - RNA, 22 nt, Human
ugauucuccugccucagccucc

SEQ ID NO: 583172 - RNA, 21 nt, Human
ugccaggcuggagugcagugg

SEQ ID NO: 583173 - RNA, 23 nt, Human
ugccaggcuggagugcaguggca

SEQ ID NO: 583174 - RNA, 24 nt, Human
ugccucagccuccugaguagcugg

SEQ ID NO: 583175 - RNA, 24 nt, Human
ugccucgaccucccaacgugcuga

SEQ ID NO: 583176 - RNA, 18 nt, Human
uggaaggaacgccugggu

SEQ ID NO: 583177 - RNA, 19 nt, Human
uggaaggaacgccugggug

SEQ ID NO: 583178 - RNA, 21 nt, Human
uggaaggaacgccuggguggc

SEQ ID NO: 583179 - RNA, 18 nt, Human
uggaaugaaugaaugaau

SEQ ID NO: 583180 - RNA, 23 nt, Human
uggagugcaguggcacaaucucg

SEQ ID NO: 583181 - RNA, 24 nt, Human
uggagugcaguggcacaaucucgg

SEQ ID NO: 583182 - RNA, 23 nt, Human
uggaguguaguggcacaaucucg

SEQ ID NO: 583183 - RNA, 24 nt, Human
uggaguguaguggcacaaucucgg

SEQ ID NO: 583184 - RNA, 24 nt, Human
uggcacaaucucggcucacuacaa

SEQ ID NO: 583185 - RNA, 24 nt, Human
uggcacaaucucgguucacugcaa

SEQ ID NO: 583186 - RNA, 23 nt, Human
uggcaugaacaaacaguuaaaaa

SEQ ID NO: 583187 - RNA, 24 nt, Human
uggccaggauggucucgaucuccu

SEQ ID NO: 583188 - RNA, 24 nt, Human
uggccaggauggucuugaucuccu

SEQ ID NO: 583189 - RNA, 24 nt, Human
uggccaggcuggaguguaguggca

SEQ ID NO: 583190 - RNA, 21 nt, Human
ugggaagaggacuucuagagg

SEQ ID NO: 583191 - RNA, 21 nt, Human
ugggaagaggacuucuagagg

SEQ ID NO: 583192 - RNA, 18 nt, Human
ugggauuacaggcaugag

SEQ ID NO: 583193 - RNA, 19 nt, Human
ugggauuacaggcaugagc

SEQ ID NO: 583194 - RNA, 21 nt, Human
ugggauuacaggcaugagcca

SEQ ID NO: 583195 - RNA, 22 nt, Human
ugggauuacaggcaugagccac

SEQ ID NO: 583196 - RNA, 22 nt, Human
ugggauuacaggcaugagccac

SEQ ID NO: 583197 - RNA, 23 nt, Human
ugggauuacaggcaugagccacu

SEQ ID NO: 583198 - RNA, 24 nt, Human
ugggauuacaggcaugagccacug

SEQ ID NO: 583199 - RNA, 26 nt, Human
ugggauuacaggcaugagccacugcg

SEQ ID NO: 583200 - RNA, 21 nt, Human
ugggauuacaggcgcccacca

SEQ ID NO: 583201 - RNA, 24 nt, Human
ugggauuacaggcgcccaccacca

SEQ ID NO: 583202 - RNA, 21 nt, Human
ugggauuacaggcgugcacca

SEQ ID NO: 583203 - RNA, 22 nt, Human
ugggauuacaggcgugcaccac

SEQ ID NO: 583204 - RNA, 24 nt, Human
ugggauuacaggcgugcaccacca

SEQ ID NO: 583205 - RNA, 21 nt, Human
ugggggcccugugaguccugc

SEQ ID NO: 583206 - RNA, 24 nt, Human
ugggguuucaccauguuggccagg

SEQ ID NO: 583207 - RNA, 24 nt, Human
ugggguuucacuguguuggccagg

SEQ ID NO: 583208 - RNA, 24 nt, Human
uggguaagccacauaaccccucca

SEQ ID NO: 583209 - RNA, 21 nt, Human
uggguggcugugaaggccagu

SEQ ID NO: 583210 - RNA, 23 nt, Human
uggguggcugugaaggccaguuu

SEQ ID NO: 583211 - RNA, 24 nt, Human
uguagagaugggguuucaccaugu

SEQ ID NO: 583212 - RNA, 21 nt, Human
uguauuuuuaguagacauggg

SEQ ID NO: 583213 - RNA, 23 nt, Human
ugucuaguuccuagaacagaacc

SEQ ID NO: 583214 - RNA, 19 nt, Human
ugugagcagagcaguggcc

SEQ ID NO: 583215 - RNA, 18 nt, Human
uuaguagacaugggguuu

SEQ ID NO: 583216 - RNA, 21 nt, Human
uuaguagacaugggguuucac

SEQ ID NO: 583217 - RNA, 21 nt, Human
uuaguagacaugggguuucac

SEQ ID NO: 583218 - RNA, 24 nt, Human
uuaguagacaugggguuucacugu

SEQ ID NO: 583219 - RNA, 23 nt, Human
uucaagggauucucccgccucag

SEQ ID NO: 583220 - RNA, 18 nt, Human
uucauggggaaaggaaga

SEQ ID NO: 583221 - RNA, 21 nt, Human
uucccaugaaucaccccauga

SEQ ID NO: 583222 - RNA, 21 nt, Human
uugccaggcuggagugcagug

SEQ ID NO: 583223 - RNA, 21 nt, Human
uugcuaucugggcaccucugg

SEQ ID NO: 583224 - RNA, 24 nt, Human
uuguagagaugggguuucaccaug

SEQ ID NO: 583225 - RNA, 23 nt, Human
uuguauuuuuaguagacaugggg

SEQ ID NO: 583226 - RNA, 19 nt, Human
uuucaccauguuggccagg

SEQ ID NO: 583227 - RNA, 20 nt, Human
uuucaccauguuggccagga

SEQ ID NO: 583228 - RNA, 19 nt, Human
uuucacuguguuggccagg

SEQ ID NO: 583229 - RNA, 19 nt, Human
uuucuacccccuccccaca

SEQ ID NO: 583230 - RNA, 24 nt, Human
uuuguagagaugggguuucaccau

SEQ ID NO: 583231 - RNA, 19 nt, Human
uuuuguauuuuuguagaga

SEQ ID NO: 583232 - RNA, 24 nt, Human
uuuuuaguagacaugggguuucac

SEQ ID NO: 583233 - RNA, 23 nt, Human
uuuuuguagagaugggguuucac

SEQ ID NO: 583234 - RNA, 18 nt, Human
uuuuuguauuuuuaguag

SEQ ID NO: 583235 - RNA, 21 nt, Human
uuuuuguauuuuuaguagaca

SEQ ID NO: 583236 - RNA, 18 nt, Human
aaaaaccuaaauagauaa

SEQ ID NO: 583237 - RNA, 22 nt, Human
aaagucccaggcaaacugagac

SEQ ID NO: 583238 - RNA, 24 nt, Human
aaagugcugggauuacagguguga

SEQ ID NO: 583239 - RNA, 22 nt, Human
aaaucuaacaucccuguuuuug

SEQ ID NO: 583240 - RNA, 23 nt, Human
aagaaagucaccccuucaggcac

SEQ ID NO: 583241 - RNA, 21 nt, Human
aagugcccaugugccacuacc

SEQ ID NO: 583242 - RNA, 18 nt, Human
aagugcugggauuacagg

SEQ ID NO: 583243 - RNA, 19 nt, Human
aagugcugggauuacaggu

SEQ ID NO: 583244 - RNA, 23 nt, Human
aaugaguacauacuuaaaauuca

SEQ ID NO: 583245 - RNA, 21 nt, Human
acacuacuggcuaaccagccc

SEQ ID NO: 583246 - RNA, 20 nt, Human
acauaacauuugcccauucu

SEQ ID NO: 583247 - RNA, 22 nt, Human
accacaaaguuugagcuugcca

SEQ ID NO: 583248 - RNA, 24 nt, Human
accauguuggccaggcuggucucg

SEQ ID NO: 583249 - RNA, 22 nt, Human
acccauuaucucaguuugccca

SEQ ID NO: 583250 - RNA, 23 nt, Human
acgagccaugccagugggaacaa

SEQ ID NO: 583251 - RNA, 18 nt, Human
acgggguuucaccauguu

SEQ ID NO: 583252 - RNA, 23 nt, Human
acgggguuucaccauguuggcca

SEQ ID NO: 583253 - RNA, 24 nt, Human
acgggguuucaccauguuggccag

SEQ ID NO: 583254 - RNA, 23 nt, Human
agagugaauguucaauuucuuug

SEQ ID NO: 583255 - RNA, 23 nt, Human
agagugaauguucaauuucuuug

SEQ ID NO: 583256 - RNA, 19 nt, Human
agccaugccagugggaaca

SEQ ID NO: 583257 - RNA, 20 nt, Human
aggaaggagaagcugugguc

SEQ ID NO: 583258 - RNA, 20 nt, Human
aggaagguggcgauggcaau

SEQ ID NO: 583259 - RNA, 22 nt, Human
aggccacuguccaugagccucc

SEQ ID NO: 583260 - RNA, 19 nt, Human
agggaaaagucauuuggaa

SEQ ID NO: 583261 - RNA, 18 nt, Human
agguggcgauggcaauga

SEQ ID NO: 583262 - RNA, 23 nt, Human
aggugugagccacugugcccggc

SEQ ID NO: 583263 - RNA, 18 nt, Human
aguagcugggauuacagg

SEQ ID NO: 583264 - RNA, 24 nt, Human
agugcaauggcauggucucggcuc

SEQ ID NO: 583265 - RNA, 24 nt, Human
agugccauccauauaugcagcagc

SEQ ID NO: 583266 - RNA, 18 nt, Human
auagaaccucugaaaacu

SEQ ID NO: 583267 - RNA, 20 nt, Human
aucaaguacuguaauggaac

SEQ ID NO: 583268 - RNA, 23 nt, Human
augaaaccaugaaacaugacacu

SEQ ID NO: 583269 - RNA, 24 nt, Human
caaaaaaagcuuaauaaauagaaa

SEQ ID NO: 583270 - RNA, 24 nt, Human
caaaaaaagcuuaauaaauagaaa

SEQ ID NO: 583271 - RNA, 24 nt, Human
caaaaagagcuuaauaaauagaaa

SEQ ID NO: 583272 - RNA, 21 nt, Human
caaacaauucuccugccucag

SEQ ID NO: 583273 - RNA, 24 nt, Human
caaagugcugggauuacaggugug

SEQ ID NO: 583274 - RNA, 23 nt, Human
cacaguacauagaaccucugaag

SEQ ID NO: 583275 - RNA, 21 nt, Human
caccagggccugccacaauga

SEQ ID NO: 583276 - RNA, 24 nt, Human
caccaugcccagcuaauuuuugua

SEQ ID NO: 583277 - RNA, 21 nt, Human
caccauguuggccaggcuggu

SEQ ID NO: 583278 - RNA, 24 nt, Human
caccauguuggccaggcuggucuc

SEQ ID NO: 583279 - RNA, 27 nt, Human
caccauguuggccaggcuggucucgaa

SEQ ID NO: 583280 - RNA, 23 nt, Human
caccugccucggccucccaaagu

SEQ ID NO: 583281 - RNA, 23 nt, Human
cagcauuccugacaugcugacca

SEQ ID NO: 583282 - RNA, 19 nt, Human
cagcuucuagcucaguccu

SEQ ID NO: 583283 - RNA, 20 nt, Human
caggcacccgccaccaugcc

SEQ ID NO: 583284 - RNA, 23 nt, Human
cauaccuccuacgagccaugcca

SEQ ID NO: 583285 - RNA, 24 nt, Human
cauguuggccaggcuggucucgaa

SEQ ID NO: 583286 - RNA, 19 nt, Human
cauuuaaaugcaagccacu

SEQ ID NO: 583287 - RNA, 21 nt, Human
ccaaagugcugggauuacagg

SEQ ID NO: 583288 - RNA, 21 nt, Human
ccaaagugcugggauuacagg

SEQ ID NO: 583289 - RNA, 24 nt, Human
ccaaagugcugggauuacaggugu

SEQ ID NO: 583290 - RNA, 20 nt, Human
ccaggguucaaacaauucuc

SEQ ID NO: 583291 - RNA, 23 nt, Human
cccgaguagcugggauuacaggc

SEQ ID NO: 583292 - RNA, 24 nt, Human
cccgaguagcugggauuacaggca

SEQ ID NO: 583293 - RNA, 21 nt, Human
cccuaggccugcuacccacac

SEQ ID NO: 583294 - RNA, 26 nt, Human
cccugcucuucagcugcgugcuguug

SEQ ID NO: 583295 - RNA, 23 nt, Human
ccgaguagcugggauuacaggca

SEQ ID NO: 583296 - RNA, 24 nt, Human
ccuccaggguucaaacaauucucc

SEQ ID NO: 583297 - RNA, 19 nt, Human
ccucuaggcauucuggaag

SEQ ID NO: 583298 - RNA, 19 nt, Human
ccugacaucgugauccacc

SEQ ID NO: 583299 - RNA, 28 nt, Human
ccugggucacucccuacccucuaaggag

SEQ ID NO: 583300 - RNA, 23 nt, Human
cgccgagcgcucucgcuggcucc

SEQ ID NO: 583301 - RNA, 19 nt, Human
cggcuaaaccuaacaaagu

SEQ ID NO: 583302 - RNA, 21 nt, Human
cgguagaaauaaugguucaug

SEQ ID NO: 583303 - RNA, 22 nt, Human
cuaaaaggugggaccagaaaag

SEQ ID NO: 583304 - RNA, 26 nt, Human
cuaccacccauugaucacagugcuuu

SEQ ID NO: 583305 - RNA, 20 nt, Human
cuaggccugcuacccacacu

SEQ ID NO: 583306 - RNA, 23 nt, Human
cucagucucccgaguagcuggga

SEQ ID NO: 583307 - RNA, 21 nt, Human
cuccauccgacuuugggggcu

SEQ ID NO: 583308 - RNA, 23 nt, Human
cucccucggccgggaaacagccc

SEQ ID NO: 583309 - RNA, 24 nt, Human
cuccugacaucgugauccaccugc

SEQ ID NO: 583310 - RNA, 19 nt, Human
cucguucuuaacuugaugg

SEQ ID NO: 583311 - RNA, 22 nt, Human
cucuagacuccugacgggcccc

SEQ ID NO: 583312 - RNA, 25 nt, Human
cucugucgcccaggcuggagugcaa

SEQ ID NO: 583313 - RNA, 24 nt, Human
cugcaacuuccgccuccaggguuc

SEQ ID NO: 583314 - RNA, 19 nt, Human
cugcaugguguacuuaaag

SEQ ID NO: 583315 - RNA, 25 nt, Human
cugccaccagggccugccacaauga

SEQ ID NO: 583316 - RNA, 23 nt, Human
cugccucagucucccgaguagcu

SEQ ID NO: 583317 - RNA, 23 nt, Human
cugccucggccucccaaagugcu

SEQ ID NO: 583318 - RNA, 23 nt, Human
cugcgugcuguuggccucugcuc

SEQ ID NO: 583319 - RNA, 24 nt, Human
cugcucugucgcccaggcuggagu

SEQ ID NO: 583320 - RNA, 19 nt, Human
cuggagugcaauggcaugg

SEQ ID NO: 583321 - RNA, 22 nt, Human
cuguuuugaugaugcuaccuuu

SEQ ID NO: 583322 - RNA, 20 nt, Human
cuuuuguucuuuggaacugu

SEQ ID NO: 583323 - RNA, 22 nt, Human
gacaucgugauccaccugccuc

SEQ ID NO: 583324 - RNA, 24 nt, Human
gacaucgugauccaccugccucgg

SEQ ID NO: 583325 - RNA, 24 nt, Human
gagacgggguuucaccauguuggc

SEQ ID NO: 583326 - RNA, 25 nt, Human
gaguagcugggauuacaggcacccg

SEQ ID NO: 583327 - RNA, 21 nt, Human
gagucacucucuuguagggcg

SEQ ID NO: 583328 - RNA, 20 nt, Human
gagugcaauggcauggucuc

SEQ ID NO: 583329 - RNA, 22 nt, Human
gauuacaggcacccgccaccau

SEQ ID NO: 583330 - RNA, 18 nt, Human
gauuacaggugugagcca

SEQ ID NO: 583331 - RNA, 21 nt, Human
gauuacaggugugagccacug

SEQ ID NO: 583332 - RNA, 24 nt, Human
gauuacaggugugagccacugugc

SEQ ID NO: 583333 - RNA, 23 nt, Human
gauugcauuaaagguuuguauuc

SEQ ID NO: 583334 - RNA, 21 nt, Human
gccacaaugacaugcuuugcc

SEQ ID NO: 583335 - RNA, 22 nt, Human
gcccagcuaauuuuuguauuuu

SEQ ID NO: 583336 - RNA, 23 nt, Human
gcccaggcuggagugcaauggca

SEQ ID NO: 583337 - RNA, 24 nt, Human
gcccaggcuggagugcaauggcau

SEQ ID NO: 583338 - RNA, 24 nt, Human
gccucagucucccgaguagcuggg

SEQ ID NO: 583339 - RNA, 26 nt, Human
gcuccauccgacuuugggggcugagu

SEQ ID NO: 583340 - RNA, 19 nt, Human
gcucucguucuuaacuuga

SEQ ID NO: 583341 - RNA, 19 nt, Human
gcugcagcuuauaaaaacc

SEQ ID NO: 583342 - RNA, 21 nt, Human
gcugcagcuuauaaaaaccua

SEQ ID NO: 583343 - RNA, 19 nt, Human
gcuggagugcaauggcaug

SEQ ID NO: 583344 - RNA, 20 nt, Human
ggcgauggcaaugaagaccc

SEQ ID NO: 583345 - RNA, 22 nt, Human
gggaaacagcccagcgccgagc

SEQ ID NO: 583346 - RNA, 25 nt, Human
gggccccugcuugucaagacccguc

SEQ ID NO: 583347 - RNA, 23 nt, Human
gggguuucaccauguuggccagg

SEQ ID NO: 583348 - RNA, 22 nt, Human
ggguuucaccauguuggccagg

SEQ ID NO: 583349 - RNA, 23 nt, Human
guagagacgggguuucaccaugu

SEQ ID NO: 583350 - RNA, 18 nt, Human
guagcugggauuacaggc

SEQ ID NO: 583351 - RNA, 20 nt, Human
gucuuugucagugcuguucu

SEQ ID NO: 583352 - RNA, 24 nt, Human
gugauccaccugccucggccuccc

SEQ ID NO: 583353 - RNA, 26 nt, Human
uaaaaaccuaaauagauaacacugaa

SEQ ID NO: 583354 - RNA, 27 nt, Human
uaaaacaaauguuuacacaauaaauac

SEQ ID NO: 583355 - RNA, 18 nt, Human
uaaaccuaacaaaguccc

SEQ ID NO: 583356 - RNA, 28 nt, Human
uaaauagauaacacugauuacauaacau

SEQ ID NO: 583357 - RNA, 24 nt, Human
uaauuuuuguauuuuuaguagaga

SEQ ID NO: 583358 - RNA, 24 nt, Human
uacaggcacccgccaccaugccca

SEQ ID NO: 583359 - RNA, 23 nt, Human
uacaggugugagccacugugccc

SEQ ID NO: 583360 - RNA, 23 nt, Human
uacaggugugagccacugugccc

SEQ ID NO: 583361 - RNA, 22 nt, Human
uagagacgggguuucaccaugu

SEQ ID NO: 583362 - RNA, 24 nt, Human
uaguagagacgggguuucaccaug

SEQ ID NO: 583363 - RNA, 21 nt, Human
uaucggguggugacuccucca

SEQ ID NO: 583364 - RNA, 24 nt, Human
uaucucaguuugcccagacugagg

SEQ ID NO: 583365 - RNA, 19 nt, Human
uaugaagccacaaauacag

SEQ ID NO: 583366 - RNA, 26 nt, Human
uauucacuggaagaggagccuguggg

SEQ ID NO: 583367 - RNA, 22 nt, Human
ucaauuagaaaaaggaacccua

SEQ ID NO: 583368 - RNA, 24 nt, Human
ucaauuagaucaaaguuucccuga

SEQ ID NO: 583369 - RNA, 23 nt, Human
ucacugcaacuuccgccuccagg

SEQ ID NO: 583370 - RNA, 24 nt, Human
ucacugcaacuuccgccuccaggg

SEQ ID NO: 583371 - RNA, 25 nt, Human
ucacugcaacuuccgccuccagggu

SEQ ID NO: 583372 - RNA, 27 nt, Human
ucacugcaacuuccgccuccaggguuc

SEQ ID NO: 583373 - RNA, 23 nt, Human
ucagucucccgaguagcugggau

SEQ ID NO: 583374 - RNA, 21 nt, Human
ucaugcacaaauuccuuaccu

SEQ ID NO: 583375 - RNA, 24 nt, Human
ucauucuaagcucuggcccgguag

SEQ ID NO: 583376 - RNA, 24 nt, Human
uccaggguucaaacaauucuccug

SEQ ID NO: 583377 - RNA, 23 nt, Human
ucccaaagugcugggauuacagg

SEQ ID NO: 583378 - RNA, 24 nt, Human
ucccgaguagcugggauuacaggc

SEQ ID NO: 583379 - RNA, 19 nt, Human
uccgugccucuccccuccc

SEQ ID NO: 583380 - RNA, 23 nt, Human
uccugcucugucgcccaggcugg

SEQ ID NO: 583381 - RNA, 24 nt, Human
uccugcucugucgcccaggcugga

SEQ ID NO: 583382 - RNA, 22 nt, Human
uccugugacuucagaauuucuc

SEQ ID NO: 583383 - RNA, 18 nt, Human
ucgcccaggcuggagugc

SEQ ID NO: 583384 - RNA, 23 nt, Human
ucuaaauugcugacugaggauug

SEQ ID NO: 583385 - RNA, 22 nt, Human
ucuacucuuuuuguuuccagaa

SEQ ID NO: 583386 - RNA, 20 nt, Human
ucuagagaagggaaaaguca

SEQ ID NO: 583387 - RNA, 22 nt, Human
ucuagagaagggaaaagucauu

SEQ ID NO: 583388 - RNA, 22 nt, Human
ucucccauuucugaagaaaguc

SEQ ID NO: 583389 - RNA, 24 nt, Human
ucucuugggcuuuuauaacucucc

SEQ ID NO: 583390 - RNA, 21 nt, Human
ucugcauacacauaccccaga

SEQ ID NO: 583391 - RNA, 24 nt, Human
ucugucgcccaggcuggagugcaa

SEQ ID NO: 583392 - RNA, 24 nt, Human
ugaaaugccuuugcacagcuagau

SEQ ID NO: 583393 - RNA, 21 nt, Human
ugaaucacaguacauagaacc

SEQ ID NO: 583394 - RNA, 19 nt, Human
ugacccugaauuuauuccu

SEQ ID NO: 583395 - RNA, 18 nt, Human
ugacuaaaaccuaggcuc

SEQ ID NO: 583396 - RNA, 26 nt, Human
ugaguacauacuuaaaauucagacaa

SEQ ID NO: 583397 - RNA, 21 nt, Human
ugccaaaguuugacuaaaacc

SEQ ID NO: 583398 - RNA, 19 nt, Human
ugccaugcauccucaccug

SEQ ID NO: 583399 - RNA, 23 nt, Human
ugccucagucucccgaguagcug

SEQ ID NO: 583400 - RNA, 24 nt, Human
ugccucagucucccgaguagcugg

SEQ ID NO: 583401 - RNA, 21 nt, Human
ugccucggccucccaaagugc

SEQ ID NO: 583402 - RNA, 24 nt, Human
ugccucggccucccaaagugcugg

SEQ ID NO: 583403 - RNA, 24 nt, Human
ugcuccauccgacuuugggggcug

SEQ ID NO: 583404 - RNA, 24 nt, Human
ugcucugucgcccaggcuggagug

SEQ ID NO: 583405 - RNA, 24 nt, Human
ugcugggauuacaggugugagcca

SEQ ID NO: 583406 - RNA, 20 nt, Human
uggaacuguagacuuuggaa

SEQ ID NO: 583407 - RNA, 18 nt, Human
uggaggaagguggcgaug

SEQ ID NO: 583408 - RNA, 21 nt, Human
uggaguaccaugcagaugaug

SEQ ID NO: 583409 - RNA, 20 nt, Human
uggagugcaauggcaugguc

SEQ ID NO: 583410 - RNA, 24 nt, Human
uggagugcaauggcauggucucgg

SEQ ID NO: 583411 - RNA, 19 nt, Human
uggcauggucucggcucac

SEQ ID NO: 583412 - RNA, 24 nt, Human
uggccaggcuggucucgaacuccu

SEQ ID NO: 583413 - RNA, 21 nt, Human
ugggauuacaggcacccgcca

SEQ ID NO: 583414 - RNA, 22 nt, Human
ugggauuacaggcacccgccac

SEQ ID NO: 583415 - RNA, 24 nt, Human
ugggauuacaggcacccgccacca

SEQ ID NO: 583416 - RNA, 25 nt, Human
ugggauuacaggcacccgccaccau

SEQ ID NO: 583417 - RNA, 21 nt, Human
ugggauuacaggugugagcca

SEQ ID NO: 583418 - RNA, 22 nt, Human
ugggauuacaggugugagccac

SEQ ID NO: 583419 - RNA, 22 nt, Human
ugggauuacaggugugagccac

SEQ ID NO: 583420 - RNA, 22 nt, Human
ugggauuacaggugugagccac

SEQ ID NO: 583421 - RNA, 24 nt, Human
ugggauuacaggugugagccacug

SEQ ID NO: 583422 - RNA, 19 nt, Human
uguacagaaagucaugcug

SEQ ID NO: 583423 - RNA, 23 nt, Human
uguaggaaggagaagcugugguc

SEQ ID NO: 583424 - RNA, 21 nt, Human
uguauuuuuaguagagacggg

SEQ ID NO: 583425 - RNA, 20 nt, Human
ugucagugcuguucuagagg

SEQ ID NO: 583426 - RNA, 20 nt, Human
ugucgcccaggcuggagugc

SEQ ID NO: 583427 - RNA, 20 nt, Human
uuaauauauucacuggaaga

SEQ ID NO: 583428 - RNA, 18 nt, Human
uuaguagagacgggguuu

SEQ ID NO: 583429 - RNA, 22 nt, Human
uuaguagagacgggguuucacc

SEQ ID NO: 583430 - RNA, 24 nt, Human
uuaguagagacgggguuucaccau

SEQ ID NO: 583431 - RNA, 19 nt, Human
uuauuuuuaaaaggaagaa

SEQ ID NO: 583432 - RNA, 25 nt, Human
uucaaacaauucuccugccucaguc

SEQ ID NO: 583433 - RNA, 19 nt, Human
uucaaagagccugggucac

SEQ ID NO: 583434 - RNA, 20 nt, Human
uucaaagagccugggucacu

SEQ ID NO: 583435 - RNA, 21 nt, Human
uucacuggaagaggagccugu

SEQ ID NO: 583436 - RNA, 26 nt, Human
uucagcugcgugcuguuggccucugc

SEQ ID NO: 583437 - RNA, 19 nt, Human
uuccaaagacaguuuggga

SEQ ID NO: 583438 - RNA, 25 nt, Human
uuccugugacuucagaauuucucuu

SEQ ID NO: 583439 - RNA, 21 nt, Human
uugagauggaguccugcucug

SEQ ID NO: 583440 - RNA, 22 nt, Human
uugggacaggugcagagaaaaa

SEQ ID NO: 583441 - RNA, 20 nt, Human
uuggucacccuaccacuauu

SEQ ID NO: 583442 - RNA, 23 nt, Human
uuguauuuuuaguagagacgggg

SEQ ID NO: 583443 - RNA, 22 nt, Human
uuuauuccuuguuuccuugcuc

SEQ ID NO: 583444 - RNA, 24 nt, Human
uuucaccauguuggccaggcuggu

SEQ ID NO: 583445 - RNA, 23 nt, Human
uuucuuugaaaugccuuugcaca

SEQ ID NO: 583446 - RNA, 23 nt, Human
uuucuuugaaaugccuuugcaca

SEQ ID NO: 583447 - RNA, 18 nt, Human
uuugaaaugccuuugcac

SEQ ID NO: 583448 - RNA, 18 nt, Human
uuugaaaugccuuugcac

SEQ ID NO: 583449 - RNA, 21 nt, Human
uuugucagugcuguucuagag

SEQ ID NO: 583450 - RNA, 21 nt, Human
uuuuguauuuuuaguagagac

SEQ ID NO: 583451 - RNA, 24 nt, Human
uuuuuaguagagacgggguuucac

SEQ ID NO: 583452 - RNA, 20 nt, Human
uuuuuguauuuuuaguagag

SEQ ID NO: 583453 - RNA, 18 nt, Human
aaaaagaacugauuuaaa

SEQ ID NO: 583454 - RNA, 25 nt, Human
aaaacauaaaacaauauaagaaaau

SEQ ID NO: 583455 - RNA, 25 nt, Human
aaacaagaaaacauaaaacaauaua

SEQ ID NO: 583456 - RNA, 22 nt, Human
aaacaauauaagaaaaugccag

SEQ ID NO: 583457 - RNA, 21 nt, Human
aaacacucuuuaccuccccuu

SEQ ID NO: 583458 - RNA, 19 nt, Human
aagcagggcucuacagccu

SEQ ID NO: 583459 - RNA, 23 nt, Human
aaggcauuacaaaaaaaccccaa

SEQ ID NO: 583460 - RNA, 19 nt, Human
acaaaaaaaccccaaagaa

SEQ ID NO: 583461 - RNA, 26 nt, Human
acaagagaaaaacaagaaaacauaaa

SEQ ID NO: 583462 - RNA, 19 nt, Human
acaugaaucuacuaccaac

SEQ ID NO: 583463 - RNA, 24 nt, Human
accccaaagaaaauaagauaaaaa

SEQ ID NO: 583464 - RNA, 20 nt, Human
acgcacaguuagcaacuugc

SEQ ID NO: 583465 - RNA, 25 nt, Human
acugggucugggagagcagaggugg

SEQ ID NO: 583466 - RNA, 21 nt, Human
agaaaaacaagaaaacauaaa

SEQ ID NO: 583467 - RNA, 23 nt, Human
agaagggaagcagggcucuacag

SEQ ID NO: 583468 - RNA, 25 nt, Human
aggucagagaagggaagcagggcuc

SEQ ID NO: 583469 - RNA, 19 nt, Human
aucuuccugcaguucuguu

SEQ ID NO: 583470 - RNA, 21 nt, Human
augccagauauuuacagccuc

SEQ ID NO: 583471 - RNA, 21 nt, Human
caacugcaugaaagagaugau

SEQ ID NO: 583472 - RNA, 22 nt, Human
cagaugaagcuggugccagcca

SEQ ID NO: 583473 - RNA, 27 nt, Human
ccuccccuugcaaaaaacagaggcugg

SEQ ID NO: 583474 - RNA, 20 nt, Human
cgggcggcggcggcgccccc

SEQ ID NO: 583475 - RNA, 21 nt, Human
cuaaacacucuuuaccucccc

SEQ ID NO: 583476 - RNA, 18 nt, Human
gaacaaacuacucaaagu

SEQ ID NO: 583477 - RNA, 23 nt, Human
gagaaaaacaagaaaacauaaaa

SEQ ID NO: 583478 - RNA, 19 nt, Human
gauaaaaacaacaagagaa

SEQ ID NO: 583479 - RNA, 24 nt, Human
gggagacauucauucuaagaaggg

SEQ ID NO: 583480 - RNA, 20 nt, Human
gggcugaggcgggcggcggc

SEQ ID NO: 583481 - RNA, 21 nt, Human
gguaucacagaugaagcuggu

SEQ ID NO: 583482 - RNA, 21 nt, Human
ggugaauaccagcaaagagag

SEQ ID NO: 583483 - RNA, 24 nt, Human
uaaaacaaaaccagagaacauuuc

SEQ ID NO: 583484 - RNA, 19 nt, Human
uaaaguaagacccaauguc

SEQ ID NO: 583485 - RNA, 21 nt, Human
uaagaaaaugccagauauuua

SEQ ID NO: 583486 - RNA, 21 nt, Human
uaagaagggagaaacgcacag

SEQ ID NO: 583487 - RNA, 18 nt, Human
uaagauagguaauuacua

SEQ ID NO: 583488 - RNA, 20 nt, Human
uacaaaaaaaccccaaagaa

SEQ ID NO: 583489 - RNA, 20 nt, Human
uaccuccccuugcaaaaaac

SEQ ID NO: 583490 - RNA, 24 nt, Human
uagcaacuugcugggauuacaaca

SEQ ID NO: 583491 - RNA, 19 nt, Human
uagguaauuacuaaacacu

SEQ ID NO: 583492 - RNA, 19 nt, Human
uauacaaaagaauaaaaag

SEQ ID NO: 583493 - RNA, 19 nt, Human
ucaccacauuuagaacaaa

SEQ ID NO: 583494 - RNA, 23 nt, Human
ucagcauaaaacaaaaccagaga

SEQ ID NO: 583495 - RNA, 21 nt, Human
ugaagcuggugccagccaguu

SEQ ID NO: 583496 - RNA, 23 nt, Human
ugaauaaauaagugaaaaaacaa

SEQ ID NO: 583497 - RNA, 22 nt, Human
ugaauauuggcaacugcaugaa

SEQ ID NO: 583498 - RNA, 23 nt, Human
ugaggcgggcggcggcggcgccc

SEQ ID NO: 583499 - RNA, 20 nt, Human
ugaggucagagaagggaagc

SEQ ID NO: 583500 - RNA, 22 nt, Human
ugaggucagagaagggaagcag

SEQ ID NO: 583501 - RNA, 21 nt, Human
ugccagauauuuacagccucc

SEQ ID NO: 583502 - RNA, 25 nt, Human
ugcugggauuacaacauugucuuca

SEQ ID NO: 583503 - RNA, 18 nt, Human
uggccacgaacucaggug

SEQ ID NO: 583504 - RNA, 26 nt, Human
uguacaaaggcauuacaaaaaaaccc

SEQ ID NO: 583505 - RNA, 22 nt, Human
uguuacuaaaaaugacauaaag

SEQ ID NO: 583506 - RNA, 21 nt, Human
uuagaacaaacuacucaaagu

SEQ ID NO: 583507 - RNA, 22 nt, Human
uucagcauaaaacaaaaccaga

SEQ ID NO: 583508 - RNA, 24 nt, Human
uucagcauaaaacaaaaccagaga

SEQ ID NO: 583509 - RNA, 22 nt, Human
uucaucuuccugcaguucuguu

SEQ ID NO: 583510 - RNA, 18 nt, Human
uuuuuuuuuuuuuuuuug

SEQ ID NO: 583511 - RNA, 25 nt, Human
uuuuuuuuuuuuuuuuuuguuuuuu

SEQ ID NO: 583512 - RNA, 22 nt, Human
aaaacgccgaugggccccgcgg

SEQ ID NO: 583513 - RNA, 20 nt, Human
aaaauagcucccagcgccga

SEQ ID NO: 583514 - RNA, 21 nt, Human
aagcgaugccccgccggccca

SEQ ID NO: 583515 - RNA, 18 nt, Human
agacagcggggugggggg

SEQ ID NO: 583516 - RNA, 20 nt, Human
agccagcguccgccugcugg

SEQ ID NO: 583517 - RNA, 20 nt, Human
agcccccccauccccccccc

SEQ ID NO: 583518 - RNA, 21 nt, Human
caagcgaugccccgccggccc

SEQ ID NO: 583519 - RNA, 21 nt, Human
ccaaaacgccgaugggccccg

SEQ ID NO: 583520 - RNA, 22 nt, Human
ccagcguccgccugcuggcgcc

SEQ ID NO: 583521 - RNA, 22 nt, Human
ccccaaaacgccgaugggcccc

SEQ ID NO: 583522 - RNA, 24 nt, Human
cccccaucccccccccuugggcaa

SEQ ID NO: 583523 - RNA, 26 nt, Human
ccccccaucccccccccuugggcaaa

SEQ ID NO: 583524 - RNA, 24 nt, Human
cccccccuugggcaaaaauagcuc

SEQ ID NO: 583525 - RNA, 26 nt, Human
ccccccuugggcaaaaauagcuccca

SEQ ID NO: 583526 - RNA, 19 nt, Human
ccccuggcggucagcgcag

SEQ ID NO: 583527 - RNA, 23 nt, Human
cccuugggcaaaaauagcuccca

SEQ ID NO: 583528 - RNA, 19 nt, Human
ccuccugcugcggcugugc

SEQ ID NO: 583529 - RNA, 24 nt, Human
cgcaggcucgggccuccuccugcu

SEQ ID NO: 583530 - RNA, 19 nt, Human
cgccccgcccaggcagccu

SEQ ID NO: 583531 - RNA, 24 nt, Human
cggcccgcccagguggucugcgcu

SEQ ID NO: 583532 - RNA, 19 nt, Human
cgggauggggccucgaggg

SEQ ID NO: 583533 - RNA, 24 nt, Human
cuggcgcaggcucgggccuccucc

SEQ ID NO: 583534 - RNA, 21 nt, Human
gaccuggccccgcccaccgga

SEQ ID NO: 583535 - RNA, 19 nt, Human
gaggaaugggggguaggaa

SEQ ID NO: 583536 - RNA, 21 nt, Human
gccagcccccccauccccccc

SEQ ID NO: 583537 - RNA, 24 nt, Human
gccagcccccccaucccccccccu

SEQ ID NO: 583538 - RNA, 18 nt, Human
gcccccccaucccccccc

SEQ ID NO: 583539 - RNA, 20 nt, Human
gcccccccaucccccccccu

SEQ ID NO: 583540 - RNA, 21 nt, Human
gcccgggucggggcggagggg

SEQ ID NO: 583541 - RNA, 28 nt, Human
gccugccuuggccguggcguugggggga

SEQ ID NO: 583542 - RNA, 20 nt, Human
gcggggcccgggucggggcg

SEQ ID NO: 583543 - RNA, 22 nt, Human
gcucaccaagcgaugccccgcc

SEQ ID NO: 583544 - RNA, 22 nt, Human
gcugcagaccuggcgcaggcuc

SEQ ID NO: 583545 - RNA, 18 nt, Human
ggccugccuuggccgugg

SEQ ID NO: 583546 - RNA, 20 nt, Human
ggggcggaggggucccaggc

SEQ ID NO: 583547 - RNA, 23 nt, Human
uacaaggucaucuuccgugaggg

SEQ ID NO: 583548 - RNA, 20 nt, Human
ucaggccgggugcgucuacg

SEQ ID NO: 583549 - RNA, 18 nt, Human
ucccagcgccgaggaaug

SEQ ID NO: 583550 - RNA, 24 nt, Human
ucccccccccuugggcaaaaauug

SEQ ID NO: 583551 - RNA, 21 nt, Human
ucccggcugcggccccaaaac

SEQ ID NO: 583552 - RNA, 18 nt, Human
uccuccugcugcggcugu

SEQ ID NO: 583553 - RNA, 24 nt, Human
ucgguggcgccagcccccccaucc

SEQ ID NO: 583554 - RNA, 21 nt, Human
ugaccuggccccgcccaccgg

SEQ ID NO: 583555 - RNA, 18 nt, Human
ugagaugugcagguucgg

SEQ ID NO: 583556 - RNA, 22 nt, Human
ugccacgccccgcccaggcagc

SEQ ID NO: 583557 - RNA, 21 nt, Human
uggcgccagcccccccauccc

SEQ ID NO: 583558 - RNA, 22 nt, Human
uuggccguggcguuggggggaa

SEQ ID NO: 583559 - RNA, 23 nt, Human
aaacaauucugcgauggcugccc

SEQ ID NO: 583560 - RNA, 21 nt, Human
aaaguucuucagauucugccu

SEQ ID NO: 583561 - RNA, 19 nt, Human
aagaaagaauucaggcacc

SEQ ID NO: 583562 - RNA, 20 nt, Human
aagcagcccuuugcccacaa

SEQ ID NO: 583563 - RNA, 18 nt, Human
agcagccaggcucagcuu

SEQ ID NO: 583564 - RNA, 19 nt, Human
agggauuggagaucugaag

SEQ ID NO: 583565 - RNA, 21 nt, Human
agggauuggagaucugaagcc

SEQ ID NO: 583566 - RNA, 24 nt, Human
aucauaacgucucuaggaaucugu

SEQ ID NO: 583567 - RNA, 24 nt, Human
auuaauaccuucacuuaaaacccc

SEQ ID NO: 583568 - RNA, 25 nt, Human
caaacaauucugcgauggcugccca

SEQ ID NO: 583569 - RNA, 22 nt, Human
caaagcauucugauccuccuuu

SEQ ID NO: 583570 - RNA, 19 nt, Human
caagaaggcuccgaugaua

SEQ ID NO: 583571 - RNA, 23 nt, Human
caaguuugugacuuagccccauc

SEQ ID NO: 583572 - RNA, 23 nt, Human
cagcccuuugcccacaaacaauu

SEQ ID NO: 583573 - RNA, 18 nt, Human
caggcucagcuuccucug

SEQ ID NO: 583574 - RNA, 25 nt, Human
caguuugacuauugaaaucauaagc

SEQ ID NO: 583575 - RNA, 20 nt, Human
caguuuggcugccaucgugu

SEQ ID NO: 583576 - RNA, 24 nt, Human
caugugaugccgaggacaugugua

SEQ ID NO: 583577 - RNA, 21 nt, Human
ccuacaugugaugccgaggac

SEQ ID NO: 583578 - RNA, 18 nt, Human
cucugugucagcuaugac

SEQ ID NO: 583579 - RNA, 23 nt, Human
cugcccaauuaaucccaaagcau

SEQ ID NO: 583580 - RNA, 20 nt, Human
cuuaaaacccccugugcccu

SEQ ID NO: 583581 - RNA, 20 nt, Human
gaguuggggugguggcaggg

SEQ ID NO: 583582 - RNA, 23 nt, Human
gcuaaagcagcccuuugcccaca

SEQ ID NO: 583583 - RNA, 23 nt, Human
gcugcaguuuggcugccaucgug

SEQ ID NO: 583584 - RNA, 24 nt, Human
gcuguuuaucuugcaacuuuaaga

SEQ ID NO: 583585 - RNA, 22 nt, Human
ggcuucacuguguuugucaugu

SEQ ID NO: 583586 - RNA, 20 nt, Human
gugucggcgaaaagaaagaa

SEQ ID NO: 583587 - RNA, 30 nt, Human
gugucggcgaaaagaaagaauucaggcacc

SEQ ID NO: 583588 - RNA, 22 nt, Human
uaaaacccccugugccugagag

SEQ ID NO: 583589 - RNA, 21 nt, Human
uaaccuggcaaccuagguaga

SEQ ID NO: 583590 - RNA, 21 nt, Human
uaacgucucuaggaaucugua

SEQ ID NO: 583591 - RNA, 23 nt, Human
uaccugccagaccucuuauuaau

SEQ ID NO: 583592 - RNA, 18 nt, Human
uaccuucacuuaaaaccc

SEQ ID NO: 583593 - RNA, 18 nt, Human
ucuuuacaucaacaaaca

SEQ ID NO: 583594 - RNA, 18 nt, Human
ugaacagucuccuacaug

SEQ ID NO: 583595 - RNA, 22 nt, Human
ugccagaccucuuauuaauacc

SEQ ID NO: 583596 - RNA, 23 nt, Human
ugccaucgugucggcgaaaagaa

SEQ ID NO: 583597 - RNA, 21 nt, Human
ugggaaaaaaauuaaaacaag

SEQ ID NO: 583598 - RNA, 22 nt, Human
ugggcacacucuggaaaguucu

SEQ ID NO: 583599 - RNA, 19 nt, Human
uuaagaauuuauuuuacca

SEQ ID NO: 583600 - RNA, 20 nt, Human
aaaaucucugaccuaaaaca

SEQ ID NO: 583601 - RNA, 18 nt, Human
aagauggcuuuuguuguc

SEQ ID NO: 583602 - RNA, 19 nt, Human
acaaauuuuugagccacug

SEQ ID NO: 583603 - RNA, 21 nt, Human
accacauguuugauuuaaagc

SEQ ID NO: 583604 - RNA, 23 nt, Human
accacuuaaaaucucugaccuaa

SEQ ID NO: 583605 - RNA, 20 nt, Human
accuggugauaacacucucc

SEQ ID NO: 583606 - RNA, 20 nt, Human
auauguuaauauuuugaacu

SEQ ID NO: 583607 - RNA, 23 nt, Human
caacauaacuauauguuaauauu

SEQ ID NO: 583608 - RNA, 19 nt, Human
cauuucaaauguagacuga

SEQ ID NO: 583609 - RNA, 25 nt, Human
cuuaaaaucucugaccuaaaacaaa

SEQ ID NO: 583610 - RNA, 20 nt, Human
uaacacucuccgcuucuuuc

SEQ ID NO: 583611 - RNA, 25 nt, Human
uaacauuucaaauguagacugacca

SEQ ID NO: 583612 - RNA, 24 nt, Human
uauaccacuuaaaaucucugaccu

SEQ ID NO: 583613 - RNA, 24 nt, Human
uauguuaauauuuugaacuaacau

SEQ ID NO: 583614 - RNA, 24 nt, Human
ucaauguucccuuuugugaagaug

SEQ ID NO: 583615 - RNA, 22 nt, Human
uucccuuuugugaagauggcuu

SEQ ID NO: 583616 - RNA, 22 nt, Human
aagaaggcagaaagcagcucac

SEQ ID NO: 583617 - RNA, 20 nt, Human
aagcagcucacccaagccua

SEQ ID NO: 583618 - RNA, 19 nt, Human
accucaucuucacccugaa

SEQ ID NO: 583619 - RNA, 23 nt, Human
acuggaugcagggagaagccagu

SEQ ID NO: 583620 - RNA, 20 nt, Human
agaagccaggucugucuuca

SEQ ID NO: 583621 - RNA, 21 nt, Human
agauagucuaugugauaaaac

SEQ ID NO: 583622 - RNA, 21 nt, Human
aggcagaaagcagcucaccca

SEQ ID NO: 583623 - RNA, 27 nt, Human
aggcagaaagcagcucacccaagccua

SEQ ID NO: 583624 - RNA, 19 nt, Human
auacuggggaacuggaugc

SEQ ID NO: 583625 - RNA, 23 nt, Human
augaacccaaagguuuuaugcca

SEQ ID NO: 583626 - RNA, 23 nt, Human
caaagccucaaacaauaaugcaa

SEQ ID NO: 583627 - RNA, 18 nt, Human
caagccuaaccuggcccu

SEQ ID NO: 583628 - RNA, 24 nt, Human
cacacaauauucuauuuuacuuaa

SEQ ID NO: 583629 - RNA, 19 nt, Human
cacccaagccuaaccuggc

SEQ ID NO: 583630 - RNA, 23 nt, Human
cagaaagcagcucacccaagccu

SEQ ID NO: 583631 - RNA, 21 nt, Human
caggacagaggggggccuugg

SEQ ID NO: 583632 - RNA, 21 nt, Human
caggcaguggcaagggggcaa

SEQ ID NO: 583633 - RNA, 22 nt, Human
caucaucuaauaagggacuucu

SEQ ID NO: 583634 - RNA, 21 nt, Human
cauuagccaugaaaccuaaga

SEQ ID NO: 583635 - RNA, 22 nt, Human
ccaaagccucaaacaauaaugc

SEQ ID NO: 583636 - RNA, 22 nt, Human
ccaacuagccucucaguauuua

SEQ ID NO: 583637 - RNA, 24 nt, Human
ccagaaaggcguuucaaugcucaa

SEQ ID NO: 583638 - RNA, 19 nt, Human
cccaagccuaaccuggccc

SEQ ID NO: 583639 - RNA, 23 nt, Human
cccacagcacauacuggggaacu

SEQ ID NO: 583640 - RNA, 23 nt, Human
ccucucaguauuuagaugaggau

SEQ ID NO: 583641 - RNA, 25 nt, Human
cgggccgcggcgggggucucugggc

SEQ ID NO: 583642 - RNA, 23 nt, Human
cuaccgagacccucgcgggaccc

SEQ ID NO: 583643 - RNA, 21 nt, Human
cucgcgggacccccgcgagcc

SEQ ID NO: 583644 - RNA, 19 nt, Human
cucuccacugcuuacugug

SEQ ID NO: 583645 - RNA, 20 nt, Human
cugucuucaggaggucacag

SEQ ID NO: 583646 - RNA, 23 nt, Human
gagaagccaggucugucuucagg

SEQ ID NO: 583647 - RNA, 19 nt, Human
gaggaacacugggugccag

SEQ ID NO: 583648 - RNA, 19 nt, Human
gcagaaagcagcucaccca

SEQ ID NO: 583649 - RNA, 23 nt, Human
gcagaaagcagcucacccaagcc

SEQ ID NO: 583650 - RNA, 18 nt, Human
gcagaauauuuguauuaa

SEQ ID NO: 583651 - RNA, 18 nt, Human
gcagggacuaucuggaag

SEQ ID NO: 583652 - RNA, 22 nt, Human
gccaucuucauuauuuguuuca

SEQ ID NO: 583653 - RNA, 22 nt, Human
gcgcggcuaccgagacccucgc

SEQ ID NO: 583654 - RNA, 19 nt, Human
gcggcgggggucucugggc

SEQ ID NO: 583655 - RNA, 24 nt, Human
ggagaagccaggucugucuucagg

SEQ ID NO: 583656 - RNA, 19 nt, Human
ggcagacaaagauguggug

SEQ ID NO: 583657 - RNA, 18 nt, Human
gggcagggacuaucugga

SEQ ID NO: 583658 - RNA, 21 nt, Human
gguacacaaggggaacuccag

SEQ ID NO: 583659 - RNA, 22 nt, Human
gugccaaugcauuagccaugaa

SEQ ID NO: 583660 - RNA, 22 nt, Human
uacacaaggggaacuccaggca

SEQ ID NO: 583661 - RNA, 18 nt, Human
uaccaagaaggcagaaag

SEQ ID NO: 583662 - RNA, 24 nt, Human
uaccaagaaggcagaaagcagcuc

SEQ ID NO: 583663 - RNA, 20 nt, Human
uagaaaaaauaagcaauaug

SEQ ID NO: 583664 - RNA, 22 nt, Human
uagaacagauacgguguaacac

SEQ ID NO: 583665 - RNA, 20 nt, Human
uaucuggaaggacugcaggg

SEQ ID NO: 583666 - RNA, 23 nt, Human
uaucuugugguacuuuuugauuu

SEQ ID NO: 583667 - RNA, 19 nt, Human
ucaaugccuaccagaaagg

SEQ ID NO: 583668 - RNA, 24 nt, Human
ucaaugcucaauagaauacucuua

SEQ ID NO: 583669 - RNA, 22 nt, Human
ucacccaagccuaaccuggccc

SEQ ID NO: 583670 - RNA, 21 nt, Human
ucuuauucuuuugaugccauc

SEQ ID NO: 583671 - RNA, 23 nt, Human
ugcagggagaagccaggucuguc

SEQ ID NO: 583672 - RNA, 20 nt, Human
uggaugcagggagaagccag

SEQ ID NO: 583673 - RNA, 26 nt, Human
uggcaagggggcaauacguggagaaa

SEQ ID NO: 583674 - RNA, 20 nt, Human
uggcagacaaagauguggug

SEQ ID NO: 583675 - RNA, 24 nt, Human
uggggggauggggacacuauggug

SEQ ID NO: 583676 - RNA, 21 nt, Human
ugggugccaggacagaggggg

SEQ ID NO: 583677 - RNA, 22 nt, Human
uguaccaagaaggcagaaagca

SEQ ID NO: 583678 - RNA, 18 nt, Human
uuaaugaacccaaagguu

SEQ ID NO: 583679 - RNA, 19 nt, Human
uuuccauguaucuuucauc

SEQ ID NO: 583680 - RNA, 23 nt, Human
uuuuucacacaauauucuauuuu

SEQ ID NO: 583681 - RNA, 21 nt, Human
uuuuuuuuuuuucuuuuauuu

SEQ ID NO: 583682 - RNA, 24 nt, Human
uuuuuuuuuuuuuuuuuuucuuuu

SEQ ID NO: 583683 - RNA, 22 nt, Human
aaaacagcucccaccuccccca

SEQ ID NO: 583684 - RNA, 19 nt, Human
aaacagcucccaccucccc

SEQ ID NO: 583685 - RNA, 20 nt, Human
aaacagcucccaccuccccc

SEQ ID NO: 583686 - RNA, 21 nt, Human
aagaagccagcgggggcugcc

SEQ ID NO: 583687 - RNA, 20 nt, Human
aagcucggcucaugcccuuc

SEQ ID NO: 583688 - RNA, 21 nt, Human
aagugcaauucccaaaagcca

SEQ ID NO: 583689 - RNA, 20 nt, Human
acaguagaggcaggacugaa

SEQ ID NO: 583690 - RNA, 20 nt, Human
accacaguccacgaccagcc

SEQ ID NO: 583691 - RNA, 24 nt, Human
agacaguagaggcaggacugaacc

SEQ ID NO: 583692 - RNA, 19 nt, Human
agagacaguagaggcagga

SEQ ID NO: 583693 - RNA, 22 nt, Human
agagcagguuccagagcccaaa

SEQ ID NO: 583694 - RNA, 19 nt, Human
agagcccaaaggcccaaaa

SEQ ID NO: 583695 - RNA, 19 nt, Human
agcccaaaggcccaaaagu

SEQ ID NO: 583696 - RNA, 22 nt, Human
agcgcccgcguuccacugcccc

SEQ ID NO: 583697 - RNA, 19 nt, Human
agcgggggcugccccuucc

SEQ ID NO: 583698 - RNA, 20 nt, Human
agcucccaccucccccaacc

SEQ ID NO: 583699 - RNA, 23 nt, Human
agugcaauucccaaaagccaagg

SEQ ID NO: 583700 - RNA, 18 nt, Human
caaaaccaagaagccagc

SEQ ID NO: 583701 - RNA, 18 nt, Human
caagaagccagcgggggc

SEQ ID NO: 583702 - RNA, 24 nt, Human
caaggagcucccagagauccagcg

SEQ ID NO: 583703 - RNA, 25 nt, Human
cacaaaaccaagaagccagcggggg

SEQ ID NO: 583704 - RNA, 19 nt, Human
caccucccccaaccacagu

SEQ ID NO: 583705 - RNA, 19 nt, Human
caccucccccaaccacagu

SEQ ID NO: 583706 - RNA, 18 nt, Human
cagaccaccugggucgga

SEQ ID NO: 583707 - RNA, 20 nt, Human
cagagcccaaaggcccaaaa

SEQ ID NO: 583708 - RNA, 18 nt, Human
cagcaaagauuaaaagga

SEQ ID NO: 583709 - RNA, 22 nt, Human
caguagaggcaggacugaaccg

SEQ ID NO: 583710 - RNA, 20 nt, Human
ccacaagagaccagcuccac

SEQ ID NO: 583711 - RNA, 21 nt, Human
ccaccugggucggaggcugag

SEQ ID NO: 583712 - RNA, 21 nt, Human
ccagagcccaaaggcccaaaa

SEQ ID NO: 583713 - RNA, 21 nt, Human
ccagcuccacaguccacguaa

SEQ ID NO: 583714 - RNA, 21 nt, Human
cccaaccacaguccacgacca

SEQ ID NO: 583715 - RNA, 25 nt, Human
cccacaccaagguguggaacuagga

SEQ ID NO: 583716 - RNA, 18 nt, Human
cccuggugcgaccuccgc

SEQ ID NO: 583717 - RNA, 19 nt, Human
cccuuccuccuccuccuca

SEQ ID NO: 583718 - RNA, 23 nt, Human
ccggcacaggagagggggcacaa

SEQ ID NO: 583719 - RNA, 18 nt, Human
ccugcacccaguaaccca

SEQ ID NO: 583720 - RNA, 26 nt, Human
cgcccaggcuggcuggacucggaagc

SEQ ID NO: 583721 - RNA, 18 nt, Human
cucccaccucccccaacc

SEQ ID NO: 583722 - RNA, 22 nt, Human
cucccaccucccccaaccacag

SEQ ID NO: 583723 - RNA, 18 nt, Human
cucccccaaccacagucc

SEQ ID NO: 583724 - RNA, 24 nt, Human
cucccccaaccacaguccacgacc

SEQ ID NO: 583725 - RNA, 23 nt, Human
cuccgcacggcgcugagccacaa

SEQ ID NO: 583726 - RNA, 23 nt, Human
cuuccaagucucaccaaugaccc

SEQ ID NO: 583727 - RNA, 21 nt, Human
gagaaagaagggggaccccac

SEQ ID NO: 583728 - RNA, 24 nt, Human
gaggcuggcaaccacaaaaccaag

SEQ ID NO: 583729 - RNA, 22 nt, Human
gcacggcgcugagccacaagag

SEQ ID NO: 583730 - RNA, 19 nt, Human
gcagguuccagagcccaaa

SEQ ID NO: 583731 - RNA, 18 nt, Human
ggaacggacuccucgggu

SEQ ID NO: 583732 - RNA, 18 nt, Human
ggagagggggcacacggu

SEQ ID NO: 583733 - RNA, 20 nt, Human
ggaugcccacgccggcacag

SEQ ID NO: 583734 - RNA, 27 nt, Human
ggcccaaaagugcaauucccaaaagcu

SEQ ID NO: 583735 - RNA, 20 nt, Human
gggcacacgguuaaaacagc

SEQ ID NO: 583736 - RNA, 21 nt, Human
ggucugggagccaucaaggag

SEQ ID NO: 583737 - RNA, 19 nt, Human
guccacgaccagccucuca

SEQ ID NO: 583738 - RNA, 20 nt, Human
uacaguggagaaagaagggg

SEQ ID NO: 583739 - RNA, 21 nt, Human
uacccaagggccacccuugag

SEQ ID NO: 583740 - RNA, 20 nt, Human
uacgcuucaaccuccgcacg

SEQ ID NO: 583741 - RNA, 19 nt, Human
ucagcaaagauuaaaagga

SEQ ID NO: 583742 - RNA, 20 nt, Human
uccgcacggcgcugagccac

SEQ ID NO: 583743 - RNA, 18 nt, Human
uccuccucacgcccuggu

SEQ ID NO: 583744 - RNA, 23 nt, Human
ugaggcuggcaaccacaaaacca

SEQ ID NO: 583745 - RNA, 21 nt, Human
ugccaccacucucccggcagg

SEQ ID NO: 583746 - RNA, 19 nt, Human
ugcccacgccggcacagga

SEQ ID NO: 583747 - RNA, 19 nt, Human
ugccccgggggaugcccac

SEQ ID NO: 583748 - RNA, 22 nt, Human
aaaaaaauaauaaucuacagca

SEQ ID NO: 583749 - RNA, 20 nt, Human
aaaaaagcaaaaucaacuca

SEQ ID NO: 583750 - RNA, 18 nt, Human
aaaaagcaaaaucaacuc

SEQ ID NO: 583751 - RNA, 20 nt, Human
aaaaugccagcuccuugaaa

SEQ ID NO: 583752 - RNA, 18 nt, Human
aaacaaaugcgcaacgcc

SEQ ID NO: 583753 - RNA, 19 nt, Human
aaacaaaugcgcaacgcca

SEQ ID NO: 583754 - RNA, 22 nt, Human
aaacaacccugcugacugcagc

SEQ ID NO: 583755 - RNA, 20 nt, Human
aaaggaggggccaggguccu

SEQ ID NO: 583756 - RNA, 19 nt, Human
aaauagucucaaacaaccc

SEQ ID NO: 583757 - RNA, 25 nt, Human
aaauagucucaaacaacccugcuga

SEQ ID NO: 583758 - RNA, 18 nt, Human
aacuccccccuucugcau

SEQ ID NO: 583759 - RNA, 26 nt, Human
aagcaaggugcuggaagggacacggg

SEQ ID NO: 583760 - RNA, 20 nt, Human
accccccuucgcuucagccc

SEQ ID NO: 583761 - RNA, 22 nt, Human
acugcagcugccuucugaaggc

SEQ ID NO: 583762 - RNA, 18 nt, Human
agcaacccccuacccccc

SEQ ID NO: 583763 - RNA, 18 nt, Human
agcagaaagaggcaggga

SEQ ID NO: 583764 - RNA, 18 nt, Human
agcagaaagaggcaggga

SEQ ID NO: 583765 - RNA, 20 nt, Human
aggagggagggagggaggaa

SEQ ID NO: 583766 - RNA, 19 nt, Human
aggagguggagauagagca

SEQ ID NO: 583767 - RNA, 23 nt, Human
auagagcagaaagaggcagggaa

SEQ ID NO: 583768 - RNA, 18 nt, Human
aucuaaaggggugcgggg

SEQ ID NO: 583769 - RNA, 25 nt, Human
aucuccucccuccccuucuucccag

SEQ ID NO: 583770 - RNA, 23 nt, Human
augccauccuccccccucuacaa

SEQ ID NO: 583771 - RNA, 19 nt, Human
caaccaauaaauagucuca

SEQ ID NO: 583772 - RNA, 21 nt, Human
caacggcagagcacgcaggaa

SEQ ID NO: 583773 - RNA, 18 nt, Human
caacuaaaaaaugccagc

SEQ ID NO: 583774 - RNA, 22 nt, Human
caaggugcuggaagggacacgg

SEQ ID NO: 583775 - RNA, 19 nt, Human
cacaauaggggacaagggg

SEQ ID NO: 583776 - RNA, 19 nt, Human
cagaaagaggcagggaaag

SEQ ID NO: 583777 - RNA, 18 nt, Human
cagagagggaggcgggga

SEQ ID NO: 583778 - RNA, 19 nt, Human
cagagcacgcaggaaacgg

SEQ ID NO: 583779 - RNA, 18 nt, Human
cagagcagcaacccccua

SEQ ID NO: 583780 - RNA, 22 nt, Human
cagagcagcaacccccuacccc

SEQ ID NO: 583781 - RNA, 21 nt, Human
cagcaacccccuaccccccuu

SEQ ID NO: 583782 - RNA, 19 nt, Human
cagccccuagcagcugcuc

SEQ ID NO: 583783 - RNA, 19 nt, Human
cagcugccuucugaaggcu

SEQ ID NO: 583784 - RNA, 22 nt, Human
caggaagacuaacaacuaaaaa

SEQ ID NO: 583785 - RNA, 22 nt, Human
ccaucacccgagagacgcccga

SEQ ID NO: 583786 - RNA, 19 nt, Human
ccaugcaaguaaccugaac

SEQ ID NO: 583787 - RNA, 21 nt, Human
cccccaugccauccucccccc

SEQ ID NO: 583788 - RNA, 24 nt, Human
cccccaugccauccuccccccucu

SEQ ID NO: 583789 - RNA, 23 nt, Human
ccccccucuacaauucgaacucc

SEQ ID NO: 583790 - RNA, 18 nt, Human
ccccuucgcuucagcccc

SEQ ID NO: 583791 - RNA, 23 nt, Human
ccccuucuucccaggaucuuucc

SEQ ID NO: 583792 - RNA, 22 nt, Human
cccgagagacgcccgagaggaa

SEQ ID NO: 583793 - RNA, 20 nt, Human
cccucuacaauucgaacucc

SEQ ID NO: 583794 - RNA, 20 nt, Human
ccucccuccccuucuuccca

SEQ ID NO: 583795 - RNA, 22 nt, Human
ccuucuucccaggaucuuuccg

SEQ ID NO: 583796 - RNA, 28 nt, Human
ccuugggaucuccucccuccccuucuuc

SEQ ID NO: 583797 - RNA, 21 nt, Human
ccuuucuguuucaaucaagag

SEQ ID NO: 583798 - RNA, 21 nt, Human
cgcccgagaggaaaacugccc

SEQ ID NO: 583799 - RNA, 21 nt, Human
cuaccccccuucgcuucagcc

SEQ ID NO: 583800 - RNA, 22 nt, Human
cucaaacaacccugcugacugc

SEQ ID NO: 583801 - RNA, 18 nt, Human
cuccugaucaggcugccu

SEQ ID NO: 583802 - RNA, 22 nt, Human
cucuuccuccuccuagcauccc

SEQ ID NO: 583803 - RNA, 20 nt, Human
cugaaggcugggaaaaggag

SEQ ID NO: 583804 - RNA, 20 nt, Human
cuuccuccuccuagcauccc

SEQ ID NO: 583805 - RNA, 27 nt, Human
cuuuccguaaaucuaaaggagaguacu

SEQ ID NO: 583806 - RNA, 20 nt, Human
gaaagggaggagggguucag

SEQ ID NO: 583807 - RNA, 19 nt, Human
gaacuccccccuucugcau

SEQ ID NO: 583808 - RNA, 22 nt, Human
gagcagaaagaggcagggaaag

SEQ ID NO: 583809 - RNA, 20 nt, Human
gaguaacacaucugcccaga

SEQ ID NO: 583810 - RNA, 19 nt, Human
ggagggagggagggaggaa

SEQ ID NO: 583811 - RNA, 18 nt, Human
ggagggguucagucccgg

SEQ ID NO: 583812 - RNA, 24 nt, Human
gucucuaggagggagggagggagg

SEQ ID NO: 583813 - RNA, 22 nt, Human
gugaaagggaggagggguucag

SEQ ID NO: 583814 - RNA, 28 nt, Human
guggagauagagcagaaagaggcaggga

SEQ ID NO: 583815 - RNA, 22 nt, Human
guuguuaucuuucccuuucugu

SEQ ID NO: 583816 - RNA, 18 nt, Human
uaccccccuucgcuucag

SEQ ID NO: 583817 - RNA, 23 nt, Human
uagaaacgauuaaaaaaaaagga

SEQ ID NO: 583818 - RNA, 21 nt, Human
uagcaucccccaugccauccu

SEQ ID NO: 583819 - RNA, 18 nt, Human
ucccuccccuucuuccca

SEQ ID NO: 583820 - RNA, 19 nt, Human
uccucccuccccuucuucc

SEQ ID NO: 583821 - RNA, 20 nt, Human
uccuugaaaggaggggccag

SEQ ID NO: 583822 - RNA, 27 nt, Human
uccuugggaucuccucccuccccuucu

SEQ ID NO: 583823 - RNA, 23 nt, Human
uccuugggcaacuuuccuuuuug

SEQ ID NO: 583824 - RNA, 22 nt, Human
ucugaaggcugggaaaaggagg

SEQ ID NO: 583825 - RNA, 20 nt, Human
ugaaggcugggaaaaggagg

SEQ ID NO: 583826 - RNA, 19 nt, Human
ugaagggggccgaauaaug

SEQ ID NO: 583827 - RNA, 24 nt, Human
ugacugcagcugccuucugaaggc

SEQ ID NO: 583828 - RNA, 19 nt, Human
ugcccagagagggaggcgg

SEQ ID NO: 583829 - RNA, 21 nt, Human
ugcccagagagggaggcgggg

SEQ ID NO: 583830 - RNA, 20 nt, Human
ugcucggaugagguaaucug

SEQ ID NO: 583831 - RNA, 21 nt, Human
ugugugcaccaacggcagagc

SEQ ID NO: 583832 - RNA, 23 nt, Human
uucgaacuccccccuucugcauc

SEQ ID NO: 583833 - RNA, 22 nt, Human
uugucagucuccugaucaggcu

SEQ ID NO: 583834 - RNA, 24 nt, Human
uuugcugaagggggccgaauaaug

SEQ ID NO: 583835 - RNA, 19 nt, Human
aaaccuuuuucugaaagac

SEQ ID NO: 583836 - RNA, 20 nt, Human
aggaacaagaggaugaagga

SEQ ID NO: 583837 - RNA, 24 nt, Human
ccuucgcuguugauuauccacaac

SEQ ID NO: 583838 - RNA, 23 nt, Human
cuuagaaacaaaaaccaaagaaa

SEQ ID NO: 583839 - RNA, 22 nt, Human
cuucaacagacauacucagcau

SEQ ID NO: 583840 - RNA, 18 nt, Human
uaacaccauaaauccaag

SEQ ID NO: 583841 - RNA, 24 nt, Human
uauggucagcauuuuaauaacacc

SEQ ID NO: 583842 - RNA, 24 nt, Human
ucuuucuuagaaacaaaaaccaaa

SEQ ID NO: 583843 - RNA, 21 nt, Human
uggucagcauuuuaauaacac

SEQ ID NO: 583844 - RNA, 20 nt, Human
uguuucguuuucuguuuuug

SEQ ID NO: 583845 - RNA, 25 nt, Human
uuuaauaucucugcucgucuucaac

SEQ ID NO: 583846 - RNA, 20 nt, Human
aaaaaaacaaccaaagaaca

SEQ ID NO: 583847 - RNA, 25 nt, Human
aaaaaaacagugcacaugccacaaa

SEQ ID NO: 583848 - RNA, 19 nt, Human
aaaaaacaaccaaagaaca

SEQ ID NO: 583849 - RNA, 23 nt, Human
aaacaaccaaagaacaauaacaa

SEQ ID NO: 583850 - RNA, 21 nt, Human
aacagcuccugcucaaaguca

SEQ ID NO: 583851 - RNA, 18 nt, Human
aaccaaagaacaauaaca

SEQ ID NO: 583852 - RNA, 19 nt, Human
aaccaaagaacaauaacaa

SEQ ID NO: 583853 - RNA, 22 nt, Human
aaccaaagaacaauaacaaaaa

SEQ ID NO: 583854 - RNA, 23 nt, Human
aagucacagaaauucacagacuu

SEQ ID NO: 583855 - RNA, 22 nt, Human
aaugcagcuuacuaaauugguc

SEQ ID NO: 583856 - RNA, 21 nt, Human
augccacaaagcaaaccaaac

SEQ ID NO: 583857 - RNA, 21 nt, Human
caaaaaaacaaccaaagaaca

SEQ ID NO: 583858 - RNA, 19 nt, Human
caaagaacaauaacaaaaa

SEQ ID NO: 583859 - RNA, 23 nt, Human
caaagcguacuuuuuuucccaaa

SEQ ID NO: 583860 - RNA, 20 nt, Human
caacagcuccugcucaaagu

SEQ ID NO: 583861 - RNA, 19 nt, Human
caaccaaagaacaauaaca

SEQ ID NO: 583862 - RNA, 20 nt, Human
caaguuagaaugacaauaaa

SEQ ID NO: 583863 - RNA, 21 nt, Human
cacaugccacaaagcaaaccc

SEQ ID NO: 583864 - RNA, 22 nt, Human
cagacuuaauaugcacacccaa

SEQ ID NO: 583865 - RNA, 21 nt, Human
cagugcacaugccacaaagca

SEQ ID NO: 583866 - RNA, 21 nt, Human
cauguguaggggccucuccuc

SEQ ID NO: 583867 - RNA, 24 nt, Human
ccaaaacauaaaaucauucagcaa

SEQ ID NO: 583868 - RNA, 24 nt, Human
ccaaagaacaauaacaaaaaaaca

SEQ ID NO: 583869 - RNA, 18 nt, Human
cucaguuuuccuacugau

SEQ ID NO: 583870 - RNA, 23 nt, Human
cugauggcuuauagaaugcagcu

SEQ ID NO: 583871 - RNA, 19 nt, Human
gcaaaccaaacauagcuca

SEQ ID NO: 583872 - RNA, 22 nt, Human
gguugagguagggaaaaucuug

SEQ ID NO: 583873 - RNA, 22 nt, Human
gucuuuuaauuuuggcaugugg

SEQ ID NO: 583874 - RNA, 22 nt, Human
gugcacaugccacaaagcaaac

SEQ ID NO: 583875 - RNA, 18 nt, Human
guggaagucacagaaauu

SEQ ID NO: 583876 - RNA, 25 nt, Human
uaaaaucauucagcaaaaaaacaac

SEQ ID NO: 583877 - RNA, 21 nt, Human
uaacaaaaaaacagugcacau

SEQ ID NO: 583878 - RNA, 18 nt, Human
uauagaaugcagcuuacu

SEQ ID NO: 583879 - RNA, 19 nt, Human
ucacagaaauucacagacu

SEQ ID NO: 583880 - RNA, 18 nt, Human
ucagcaaaaaaacaacca

SEQ ID NO: 583881 - RNA, 21 nt, Human
uccugcucaaagucagguuga

SEQ ID NO: 583882 - RNA, 22 nt, Human
ugaaaauacauauucaucuaca

SEQ ID NO: 583883 - RNA, 21 nt, Human
ugccacaaagcaaaccaaaca

SEQ ID NO: 583884 - RNA, 22 nt, Human
uggcauguggaagucacagaaa

SEQ ID NO: 583885 - RNA, 19 nt, Human
uguuuuguuuuuugcuuuu

SEQ ID NO: 583886 - RNA, 18 nt, Human
uuaaaugagcccgaagga

SEQ ID NO: 583887 - RNA, 21 nt, Human
uucagcaaaaaaacaaccaaa

SEQ ID NO: 583888 - RNA, 21 nt, Human
uuuuuuuuuuguuuuguuuuu

SEQ ID NO: 583889 - RNA, 21 nt, Human
aaauagagacaggguucucug

SEQ ID NO: 583890 - RNA, 21 nt, Human
aaaugucggaggucgaauucu

SEQ ID NO: 583891 - RNA, 25 nt, Human
aacaauacaggcauaauacaacaau

SEQ ID NO: 583892 - RNA, 21 nt, Human
aacauggcgagaccucauuuc

SEQ ID NO: 583893 - RNA, 24 nt, Human
aaccuuuuuguuuguuuguuuuuu

SEQ ID NO: 583894 - RNA, 25 nt, Human
aagcaauccucccaccucagccucc

SEQ ID NO: 583895 - RNA, 18 nt, Human
aagugggaggaucgcuug

SEQ ID NO: 583896 - RNA, 19 nt, Human
acaauacaggcauaauaca

SEQ ID NO: 583897 - RNA, 18 nt, Human
acagcucacugcagccuc

SEQ ID NO: 583898 - RNA, 24 nt, Human
accacguugcccaggcuggucucg

SEQ ID NO: 583899 - RNA, 25 nt, Human
accacguugcccaggcuggucucga

SEQ ID NO: 583900 - RNA, 23 nt, Human
acccaggccuauaagaaccuagu

SEQ ID NO: 583901 - RNA, 20 nt, Human
accucagccuccccagcagc

SEQ ID NO: 583902 - RNA, 23 nt, Human
accucagccuccccagcagcugg

SEQ ID NO: 583903 - RNA, 18 nt, Human
accucauuucuacuaaaa

SEQ ID NO: 583904 - RNA, 19 nt, Human
acucuaguguguucugggc

SEQ ID NO: 583905 - RNA, 18 nt, Human
acugcacuccggccuggg

SEQ ID NO: 583906 - RNA, 24 nt, Human
acugcacuccggccugggugacag

SEQ ID NO: 583907 - RNA, 21 nt, Human
acuggggcacaccagaaugug

SEQ ID NO: 583908 - RNA, 18 nt, Human
agaagagagcaacaaaaa

SEQ ID NO: 583909 - RNA, 19 nt, Human
agaagagagcaacaaaaag

SEQ ID NO: 583910 - RNA, 20 nt, Human
agagaagccagaaacccaga

SEQ ID NO: 583911 - RNA, 20 nt, Human
agagagcaacaaaaagaggc

SEQ ID NO: 583912 - RNA, 18 nt, Human
agagaggucuucggccuc

SEQ ID NO: 583913 - RNA, 21 nt, Human
aggcacaaacccaggccuaua

SEQ ID NO: 583914 - RNA, 24 nt, Human
aggcugaagugggaggaucgcuug

SEQ ID NO: 583915 - RNA, 24 nt, Human
aggguucucuguugcccaggcugg

SEQ ID NO: 583916 - RNA, 19 nt, Human
aggucuucggccucccagc

SEQ ID NO: 583917 - RNA, 24 nt, Human
agguugaggcugcagugagccuug

SEQ ID NO: 583918 - RNA, 20 nt, Human
aguucccaaccuggcaauuc

SEQ ID NO: 583919 - RNA, 21 nt, Human
auggcgagaccucauuucuac

SEQ ID NO: 583920 - RNA, 18 nt, Human
augggguuucaccacguu

SEQ ID NO: 583921 - RNA, 19 nt, Human
augggguuucaccacguug

SEQ ID NO: 583922 - RNA, 24 nt, Human
augggguuucaccacguugcccag

SEQ ID NO: 583923 - RNA, 24 nt, Human
auugugccacugcacuccggccug

SEQ ID NO: 583924 - RNA, 27 nt, Human
caagcaauccucccaccucagccuccc

SEQ ID NO: 583925 - RNA, 19 nt, Human
caaguucauuaucaggagg

SEQ ID NO: 583926 - RNA, 21 nt, Human
caauaggggagugagcaccua

SEQ ID NO: 583927 - RNA, 21 nt, Human
cacacccagcuaauuuuugua

SEQ ID NO: 583928 - RNA, 24 nt, Human
caccacguugcccaggcuggucuc

SEQ ID NO: 583929 - RNA, 27 nt, Human
caccacguugcccaggcuggucucgaa

SEQ ID NO: 583930 - RNA, 23 nt, Human
caccucagcuuccgaaagugcag

SEQ ID NO: 583931 - RNA, 24 nt, Human
cacguugcccaggcuggucucgaa

SEQ ID NO: 583932 - RNA, 22 nt, Human
cacuccggccugggugacagug

SEQ ID NO: 583933 - RNA, 19 nt, Human
cacugcacuccggccuggg

SEQ ID NO: 583934 - RNA, 21 nt, Human
cacugcacuccggccugggug

SEQ ID NO: 583935 - RNA, 22 nt, Human
cacugcacuccggccuggguga

SEQ ID NO: 583936 - RNA, 23 nt, Human
cacugcacuccggccugggugac

SEQ ID NO: 583937 - RNA, 24 nt, Human
cacugcacuccggccugggugaca

SEQ ID NO: 583938 - RNA, 25 nt, Human
cacugcacuccggccugggugacag

SEQ ID NO: 583939 - RNA, 22 nt, Human
cacugcagccucgaccucccag

SEQ ID NO: 583940 - RNA, 24 nt, Human
cagcagcugggaccacagaugugc

SEQ ID NO: 583941 - RNA, 19 nt, Human
cagcaguucccaaccuggc

SEQ ID NO: 583942 - RNA, 21 nt, Human
cagccucgaccucccaggccc

SEQ ID NO: 583943 - RNA, 24 nt, Human
cagccucgaccucccaggcccaag

SEQ ID NO: 583944 - RNA, 25 nt, Human
cagccucgaccucccaggcccaagc

SEQ ID NO: 583945 - RNA, 22 nt, Human
cagugacuuccuacuucuaaac

SEQ ID NO: 583946 - RNA, 20 nt, Human
cagugggaagcaagagagua

SEQ ID NO: 583947 - RNA, 28 nt, Human
caucuaaagucuccaugugacuguugcc

SEQ ID NO: 583948 - RNA, 20 nt, Human
ccacugcacuccggccuggg

SEQ ID NO: 583949 - RNA, 20 nt, Human
ccacugcacuccggccuggg

SEQ ID NO: 583950 - RNA, 20 nt, Human
ccacugcacuccggccuggg

SEQ ID NO: 583951 - RNA, 21 nt, Human
ccacugcacuccggccugggu

SEQ ID NO: 583952 - RNA, 21 nt, Human
ccacugcacuccggccugggu

SEQ ID NO: 583953 - RNA, 24 nt, Human
ccacugcacuccggccugggugac

SEQ ID NO: 583954 - RNA, 22 nt, Human
ccagaagguugaggcugcagug

SEQ ID NO: 583955 - RNA, 23 nt, Human
ccagagucccgcccauauuacac

SEQ ID NO: 583956 - RNA, 23 nt, Human
ccaggcccaagcaauccucccac

SEQ ID NO: 583957 - RNA, 21 nt, Human
cccaagcaauccucccaccuc

SEQ ID NO: 583958 - RNA, 24 nt, Human
cccaagcaauccucccaccucagc

SEQ ID NO: 583959 - RNA, 21 nt, Human
ccccagcagcugggaccacag

SEQ ID NO: 583960 - RNA, 22 nt, Human
cccgucucaaaaagccucggaa

SEQ ID NO: 583961 - RNA, 25 nt, Human
ccucccaccucagccuccccagcag

SEQ ID NO: 583962 - RNA, 20 nt, Human
ccucgaccucccaggcccaa

SEQ ID NO: 583963 - RNA, 25 nt, Human
cgaccucccaggcccaagcaauccu

SEQ ID NO: 583964 - RNA, 21 nt, Human
cggcaucgucggaaucagcca

SEQ ID NO: 583965 - RNA, 21 nt, Human
cguacagagcucucugcuagg

SEQ ID NO: 583966 - RNA, 21 nt, Human
cucccaccucagccuccccag

SEQ ID NO: 583967 - RNA, 19 nt, Human
cucuguugcccaggcugga

SEQ ID NO: 583968 - RNA, 23 nt, Human
cucuguugcccaggcuggaaugc

SEQ ID NO: 583969 - RNA, 22 nt, Human
cugcagccucgaccucccaggc

SEQ ID NO: 583970 - RNA, 23 nt, Human
cugcagccucgaccucccaggcc

SEQ ID NO: 583971 - RNA, 22 nt, Human
cugcagugagccuugauugugc

SEQ ID NO: 583972 - RNA, 20 nt, Human
gaagagaagccagaaaccca

SEQ ID NO: 583973 - RNA, 23 nt, Human
gaccucccaggcccaagcaaucc

SEQ ID NO: 583974 - RNA, 21 nt, Human
gagaauggggagcgaugggga

SEQ ID NO: 583975 - RNA, 27 nt, Human
gagagcaacaaaaagaggccgguaccc

SEQ ID NO: 583976 - RNA, 20 nt, Human
gagaguagauaagugugcaa

SEQ ID NO: 583977 - RNA, 18 nt, Human
gagaugggguuucaccac

SEQ ID NO: 583978 - RNA, 20 nt, Human
gagaugggguuucaccacgu

SEQ ID NO: 583979 - RNA, 25 nt, Human
gagcugccauggcuggccaaggcug

SEQ ID NO: 583980 - RNA, 19 nt, Human
gauugugccacugcacucc

SEQ ID NO: 583981 - RNA, 24 nt, Human
gcaccuaccacguacagagcucuc

SEQ ID NO: 583982 - RNA, 18 nt, Human
gcauggagucucuccacc

SEQ ID NO: 583983 - RNA, 23 nt, Human
gccaaggcugucuuuuaaaaagc

SEQ ID NO: 583984 - RNA, 19 nt, Human
gccacugcacuccggccug

SEQ ID NO: 583985 - RNA, 24 nt, Human
gccacugcacuccggccuggguga

SEQ ID NO: 583986 - RNA, 20 nt, Human
gcccaaagaagguaucugca

SEQ ID NO: 583987 - RNA, 18 nt, Human
gcugugguggcccaugcc

SEQ ID NO: 583988 - RNA, 19 nt, Human
ggaggcugaauauagaauu

SEQ ID NO: 583989 - RNA, 24 nt, Human
ggcccaugccuguagucaucccag

SEQ ID NO: 583990 - RNA, 23 nt, Human
ggcucaagcuaucugcccaccuc

SEQ ID NO: 583991 - RNA, 24 nt, Human
ggcugugguggcccaugccuguag

SEQ ID NO: 583992 - RNA, 24 nt, Human
gggcacgugcccaucuaaagucuc

SEQ ID NO: 583993 - RNA, 22 nt, Human
gggguuucaccacguugcccag

SEQ ID NO: 583994 - RNA, 23 nt, Human
gggguuucaccacguugcccagg

SEQ ID NO: 583995 - RNA, 24 nt, Human
ggguucucuguugcccaggcugga

SEQ ID NO: 583996 - RNA, 20 nt, Human
gguaaucacagcucacugca

SEQ ID NO: 583997 - RNA, 19 nt, Human
guagagaugggguuucacc

SEQ ID NO: 583998 - RNA, 22 nt, Human
guagagaugggguuucaccacg

SEQ ID NO: 583999 - RNA, 19 nt, Human
guauuuuuuguagagaugg

SEQ ID NO: 584000 - RNA, 20 nt, Human
guucucuguugcccaggcug

SEQ ID NO: 584001 - RNA, 22 nt, Human
guucucuguugcccaggcugga

SEQ ID NO: 584002 - RNA, 22 nt, Human
uaaguaggcacagagcuugcca

SEQ ID NO: 584003 - RNA, 27 nt, Human
uaaguaggcacagagcuugccaccuau

SEQ ID NO: 584004 - RNA, 23 nt, Human
uaagugugcaacaggcacaaacc

SEQ ID NO: 584005 - RNA, 21 nt, Human
uaaucugccgacagcuuccuu

SEQ ID NO: 584006 - RNA, 22 nt, Human
uaauuuuuguauuuuuuguaga

SEQ ID NO: 584007 - RNA, 24 nt, Human
uaauuuuuguauuuuuuguagaga

SEQ ID NO: 584008 - RNA, 22 nt, Human
uagagaugggguuucaccacgu

SEQ ID NO: 584009 - RNA, 24 nt, Human
uagggagaugagcaagcauuuugu

SEQ ID NO: 584010 - RNA, 24 nt, Human
uagguucucugggggcagcaguuc

SEQ ID NO: 584011 - RNA, 21 nt, Human
uaguauugaaaucacaaaguc

SEQ ID NO: 584012 - RNA, 24 nt, Human
uaguauugaaaucacaaagucaga

SEQ ID NO: 584013 - RNA, 21 nt, Human
ucaccacguugcccaggcugg

SEQ ID NO: 584014 - RNA, 19 nt, Human
ucacugcagccucgaccuc

SEQ ID NO: 584015 - RNA, 23 nt, Human
ucacugcagccucgaccucccag

SEQ ID NO: 584016 - RNA, 24 nt, Human
ucacugcagccucgaccucccagg

SEQ ID NO: 584017 - RNA, 18 nt, Human
ucagccuccccagcagcu

SEQ ID NO: 584018 - RNA, 20 nt, Human
ucagccuccccagcagcugg

SEQ ID NO: 584019 - RNA, 23 nt, Human
ucagcuggcugugguggcccaug

SEQ ID NO: 584020 - RNA, 21 nt, Human
ucccaccucagccuccccagc

SEQ ID NO: 584021 - RNA, 21 nt, Human
ucccaggcccaagcaauccuc

SEQ ID NO: 584022 - RNA, 22 nt, Human
ucuacuaaaaagaaaaaaaaaa

SEQ ID NO: 584023 - RNA, 18 nt, Human
ucuccaugugacuguugc

SEQ ID NO: 584024 - RNA, 19 nt, Human
ucuccaugugacuguugcc

SEQ ID NO: 584025 - RNA, 22 nt, Human
ucucgaacuccucggcucaagc

SEQ ID NO: 584026 - RNA, 18 nt, Human
ucucuggcugaagguggc

SEQ ID NO: 584027 - RNA, 19 nt, Human
ucucuggcugaagguggcg

SEQ ID NO: 584028 - RNA, 18 nt, Human
ucucugggggcagcaguu

SEQ ID NO: 584029 - RNA, 18 nt, Human
ucucuguugcccaggcug

SEQ ID NO: 584030 - RNA, 23 nt, Human
ucucuguugcccaggcuggaaug

SEQ ID NO: 584031 - RNA, 21 nt, Human
ucugcaagccagguacaaacc

SEQ ID NO: 584032 - RNA, 25 nt, Human
ucugcaagccagguacaaaccagca

SEQ ID NO: 584033 - RNA, 19 nt, Human
ucugcauggagucucucca

SEQ ID NO: 584034 - RNA, 19 nt, Human
ucugcccaccucagcuucc

SEQ ID NO: 584035 - RNA, 19 nt, Human
ucugcuagguucucugggg

SEQ ID NO: 584036 - RNA, 18 nt, Human
ucuguugcccaggcugga

SEQ ID NO: 584037 - RNA, 24 nt, Human
ucuguugcccaggcuggaaugcag

SEQ ID NO: 584038 - RNA, 24 nt, Human
ucuucggccucccagccucucugg

SEQ ID NO: 584039 - RNA, 23 nt, Human
ugaaaggcugaagugggaggauc

SEQ ID NO: 584040 - RNA, 19 nt, Human
ugaacauugugcugcccaa

SEQ ID NO: 584041 - RNA, 20 nt, Human
ugaacauugugcugcccaaa

SEQ ID NO: 584042 - RNA, 18 nt, Human
ugacuguugcccugcagg

SEQ ID NO: 584043 - RNA, 22 nt, Human
ugacuuccuacuucuaaacacc

SEQ ID NO: 584044 - RNA, 26 nt, Human
ugagcaccuaccacguacagagcucu

SEQ ID NO: 584045 - RNA, 18 nt, Human
ugaggcugcagugagccu

SEQ ID NO: 584046 - RNA, 23 nt, Human
ugcaacaggcacaaacccaggcc

SEQ ID NO: 584047 - RNA, 22 nt, Human
ugcccaaagaagguaucugcaa

SEQ ID NO: 584048 - RNA, 24 nt, Human
ugcccaggcuggucucgaacuccu

SEQ ID NO: 584049 - RNA, 20 nt, Human
uggcuggccaaggcugucuu

SEQ ID NO: 584050 - RNA, 21 nt, Human
ugggaccacagaugugcacca

SEQ ID NO: 584051 - RNA, 22 nt, Human
ugggcacgugcccaucuaaagu

SEQ ID NO: 584052 - RNA, 24 nt, Human
ugggguuucaccacguugcccagg

SEQ ID NO: 584053 - RNA, 21 nt, Human
ugguggcccaugccuguaguc

SEQ ID NO: 584054 - RNA, 26 nt, Human
ugucggaggucgaauucuaguucugc

SEQ ID NO: 584055 - RNA, 22 nt, Human
uguguugguucaagaccagucu

SEQ ID NO: 584056 - RNA, 20 nt, Human
uguugguucaagaccagucu

SEQ ID NO: 584057 - RNA, 23 nt, Human
uuaguauugaaaucacaaaguca

SEQ ID NO: 584058 - RNA, 24 nt, Human
uucuacuaaaaagaaaaaaaaaau

SEQ ID NO: 584059 - RNA, 19 nt, Human
uucucugggggcagcaguu

SEQ ID NO: 584060 - RNA, 24 nt, Human
uucucuguugcccaggcuggaaug

SEQ ID NO: 584061 - RNA, 24 nt, Human
uugaaaggcugaagugggaggauc

SEQ ID NO: 584062 - RNA, 21 nt, Human
uugaaaucacaaagucagaaa

SEQ ID NO: 584063 - RNA, 20 nt, Human
uugauacaaaguauccaguu

SEQ ID NO: 584064 - RNA, 21 nt, Human
uugccaccuauuagguacuca

SEQ ID NO: 584065 - RNA, 23 nt, Human
uugcccaggcuggaaugcaguga

SEQ ID NO: 584066 - RNA, 24 nt, Human
uuggaggcugaauauagaauuuua

SEQ ID NO: 584067 - RNA, 24 nt, Human
uuguagagaugggguuucaccacg

SEQ ID NO: 584068 - RNA, 23 nt, Human
uugugccacugcacuccggccug

SEQ ID NO: 584069 - RNA, 25 nt, Human
uuuguagagaugggguuucaccacg

SEQ ID NO: 584070 - RNA, 23 nt, Human
uuuuguuuguuuguuuuuuuccc

SEQ ID NO: 584071 - RNA, 20 nt, Human
uuuuuguauuuuuuguagag

SEQ ID NO: 584072 - RNA, 23 nt, Human
uuuuuguauuuuuuguagagaug

SEQ ID NO: 584073 - RNA, 20 nt, Human
uuuuuguuuguuuguuuuuu

SEQ ID NO: 584074 - RNA, 21 nt, Human
uuuuuguuuguuuguuuuuuu

SEQ ID NO: 584075 - RNA, 22 nt, Human
uuuuuuguagagaugggguuuc

SEQ ID NO: 584076 - RNA, 24 nt, Human
uuuuuuguagagaugggguuucac

SEQ ID NO: 584077 - RNA, 23 nt, Human
aaaacuucauauuaugaaagcaa

SEQ ID NO: 584078 - RNA, 18 nt, Human
aacugcaugaucuucugc

SEQ ID NO: 584079 - RNA, 19 nt, Human
acugcagcuucaugccucc

SEQ ID NO: 584080 - RNA, 21 nt, Human
acuucagacuagaggguucag

SEQ ID NO: 584081 - RNA, 20 nt, Human
acuuuucuuguuggccacca

SEQ ID NO: 584082 - RNA, 22 nt, Human
auauuccaaguuucaaagauuu

SEQ ID NO: 584083 - RNA, 20 nt, Human
caugaaaacuuccaaacugc

SEQ ID NO: 584084 - RNA, 19 nt, Human
cccuagaaacagggacaga

SEQ ID NO: 584085 - RNA, 18 nt, Human
ccucucaucuccccgacu

SEQ ID NO: 584086 - RNA, 18 nt, Human
cgggaacucagcacugcg

SEQ ID NO: 584087 - RNA, 24 nt, Human
cucaaagguuucacuguugacauu

SEQ ID NO: 584088 - RNA, 20 nt, Human
cuccugcgaacuuguagaac

SEQ ID NO: 584089 - RNA, 18 nt, Human
cucucaucuccccgacug

SEQ ID NO: 584090 - RNA, 23 nt, Human
cugcagcuucaugccuccucuca

SEQ ID NO: 584091 - RNA, 20 nt, Human
cugcaugaucuucugccagg

SEQ ID NO: 584092 - RNA, 21 nt, Human
cuucaucaacauaagcuccua

SEQ ID NO: 584093 - RNA, 23 nt, Human
gagggugcuggcucccucaaagg

SEQ ID NO: 584094 - RNA, 19 nt, Human
gaucuugcggcugaucucg

SEQ ID NO: 584095 - RNA, 18 nt, Human
gcagcuucaugccuccuc

SEQ ID NO: 584096 - RNA, 25 nt, Human
gcgcuaggaauggcaagugguggca

SEQ ID NO: 584097 - RNA, 19 nt, Human
gcuuaauaucaaucacauc

SEQ ID NO: 584098 - RNA, 18 nt, Human
ggcugccgcggacuccua

SEQ ID NO: 584099 - RNA, 22 nt, Human
ggcuuacccggaggcugccgcg

SEQ ID NO: 584100 - RNA, 21 nt, Human
guagaaacucuggaaucucuu

SEQ ID NO: 584101 - RNA, 18 nt, Human
gucggguugcagcuccau

SEQ ID NO: 584102 - RNA, 21 nt, Human
uaagcuccuaauucuuguaau

SEQ ID NO: 584103 - RNA, 20 nt, Human
ucaaagguuucacuguugac

SEQ ID NO: 584104 - RNA, 22 nt, Human
uccucugucauuugguccugac

SEQ ID NO: 584105 - RNA, 21 nt, Human
ugaaagcaauauauuccaagu

SEQ ID NO: 584106 - RNA, 22 nt, Human
ugacauuugugguuuuugacuc

SEQ ID NO: 584107 - RNA, 21 nt, Human
uuccaaguuucaaagauuuga

SEQ ID NO: 584108 - RNA, 21 nt, Human
aagguugcaaggcccgugugu

SEQ ID NO: 584109 - RNA, 21 nt, Human
acagcacuggaaggcagcagc

SEQ ID NO: 584110 - RNA, 18 nt, Human
acagggaccugcugugga

SEQ ID NO: 584111 - RNA, 21 nt, Human
accaggcugcagaccucccac

SEQ ID NO: 584112 - RNA, 28 nt, Human
acuggaaggcagcagcagggugggggcc

SEQ ID NO: 584113 - RNA, 23 nt, Human
agaaaaccagagugagcaguggg

SEQ ID NO: 584114 - RNA, 21 nt, Human
agagccaggggaugggggcag

SEQ ID NO: 584115 - RNA, 21 nt, Human
agaugacagaucugggcucca

SEQ ID NO: 584116 - RNA, 20 nt, Human
agcccagccguccaccaccc

SEQ ID NO: 584117 - RNA, 19 nt, Human
aggcagcagcagggugggg

SEQ ID NO: 584118 - RNA, 18 nt, Human
aggcagggucccuucacg

SEQ ID NO: 584119 - RNA, 20 nt, Human
aggcagggugagggcccugu

SEQ ID NO: 584120 - RNA, 21 nt, Human
aggccaugaccaggcugcaga

SEQ ID NO: 584121 - RNA, 24 nt, Human
aggcggcgggguggucggcugcuc

SEQ ID NO: 584122 - RNA, 19 nt, Human
augaccaggcugcagaccu

SEQ ID NO: 584123 - RNA, 21 nt, Human
augcagauaugucuguccaca

SEQ ID NO: 584124 - RNA, 25 nt, Human
cacgacagcccagccguccaccacc

SEQ ID NO: 584125 - RNA, 20 nt, Human
cagaaaaccagagugagcac

SEQ ID NO: 584126 - RNA, 20 nt, Human
cagaggagggagacagcagc

SEQ ID NO: 584127 - RNA, 19 nt, Human
cagcagcagggugggggcc

SEQ ID NO: 584128 - RNA, 22 nt, Human
cagcagcagggugggggccuag

SEQ ID NO: 584129 - RNA, 19 nt, Human
cagccguccaccacccgcc

SEQ ID NO: 584130 - RNA, 21 nt, Human
caggggccuccugguuggccc

SEQ ID NO: 584131 - RNA, 24 nt, Human
ccaccacccgccucaucucugccc

SEQ ID NO: 584132 - RNA, 23 nt, Human
ccacugccuggguuacagccagg

SEQ ID NO: 584133 - RNA, 22 nt, Human
cccaccagccacaccgagggga

SEQ ID NO: 584134 - RNA, 19 nt, Human
ccccaugcaccggaggcgg

SEQ ID NO: 584135 - RNA, 22 nt, Human
cccccgggggcgcgcucagccc

SEQ ID NO: 584136 - RNA, 26 nt, Human
ccccgggggcgcgcucagccccagcg

SEQ ID NO: 584137 - RNA, 18 nt, Human
cccugugcagacccugcc

SEQ ID NO: 584138 - RNA, 19 nt, Human
ccucaggcuucccaagccc

SEQ ID NO: 584139 - RNA, 18 nt, Human
ccugaaaggcaggguccc

SEQ ID NO: 584140 - RNA, 24 nt, Human
cgcgcucagccccagcgauggcuc

SEQ ID NO: 584141 - RNA, 19 nt, Human
cggcgggguggucggcugc

SEQ ID NO: 584142 - RNA, 20 nt, Human
cggcgggguggucggcugcu

SEQ ID NO: 584143 - RNA, 26 nt, Human
cuccagacccugagcagaaaaccaga

SEQ ID NO: 584144 - RNA, 22 nt, Human
cuccaggggccuccugguuggc

SEQ ID NO: 584145 - RNA, 23 nt, Human
cuccggccgcccggcaucgggcg

SEQ ID NO: 584146 - RNA, 20 nt, Human
cuccugguuggcccuugugg

SEQ ID NO: 584147 - RNA, 22 nt, Human
cugcagaccucccacugccugg

SEQ ID NO: 584148 - RNA, 22 nt, Human
cuucccagggguccgugggccc

SEQ ID NO: 584149 - RNA, 23 nt, Human
gccucaggcuucccaagcccugg

SEQ ID NO: 584150 - RNA, 20 nt, Human
ggcagaggagggagacagca

SEQ ID NO: 584151 - RNA, 20 nt, Human
gggcagaggagggagacagc

SEQ ID NO: 584152 - RNA, 21 nt, Human
gggucccuucacggcucaccc

SEQ ID NO: 584153 - RNA, 21 nt, Human
ggugguucccucccuuccaag

SEQ ID NO: 584154 - RNA, 19 nt, Human
guggaggccaugaccaggc

SEQ ID NO: 584155 - RNA, 25 nt, Human
uaccgggaacugguggcgcguagug

SEQ ID NO: 584156 - RNA, 23 nt, Human
uccacagggaccugcuguggagg

SEQ ID NO: 584157 - RNA, 19 nt, Human
uccaccacccgccucaucu

SEQ ID NO: 584158 - RNA, 20 nt, Human
uccagacccugagcagaaaa

SEQ ID NO: 584159 - RNA, 27 nt, Human
uccccccgggggcgcgcucagcccccc

SEQ ID NO: 584160 - RNA, 20 nt, Human
uccccgaucuccccccgggg

SEQ ID NO: 584161 - RNA, 22 nt, Human
ucccuucacggcucacccacca

SEQ ID NO: 584162 - RNA, 23 nt, Human
ugagcagaaaaccagagugagca

SEQ ID NO: 584163 - RNA, 19 nt, Human
ugcccaggggagagccagg

SEQ ID NO: 584164 - RNA, 18 nt, Human
ugccuggguuacagccag

SEQ ID NO: 584165 - RNA, 19 nt, Human
uggcuccucagccaguccc

SEQ ID NO: 584166 - RNA, 18 nt, Human
ugggggcagaggagggag

SEQ ID NO: 584167 - RNA, 20 nt, Human
ugggggcagaggagggagac

SEQ ID NO: 584168 - RNA, 20 nt, Human
ugggggcagggagaggcaga

SEQ ID NO: 584169 - RNA, 20 nt, Human
ugguucccucccuuccaagg

SEQ ID NO: 584170 - RNA, 25 nt, Human
aaaaauuaucuugguucaaaacaau

SEQ ID NO: 584171 - RNA, 18 nt, Human
aacccuuguguugcccuu

SEQ ID NO: 584172 - RNA, 22 nt, Human
aagagacaaaaucuugcuaugu

SEQ ID NO: 584173 - RNA, 21 nt, Human
aaggacauuugggugguuucu

SEQ ID NO: 584174 - RNA, 22 nt, Human
acagugcacuacagcccagaac

SEQ ID NO: 584175 - RNA, 22 nt, Human
acccacuucucuccucucuccc

SEQ ID NO: 584176 - RNA, 19 nt, Human
accuaguuacccccaaugg

SEQ ID NO: 584177 - RNA, 18 nt, Human
agacaaaaucuugcuaug

SEQ ID NO: 584178 - RNA, 18 nt, Human
agcacagugcacuacagc

SEQ ID NO: 584179 - RNA, 22 nt, Human
auaccacaaugucacaaccagg

SEQ ID NO: 584180 - RNA, 18 nt, Human
auacugaugcagaacuua

SEQ ID NO: 584181 - RNA, 24 nt, Human
caaaaucuugcuauguugcccagg

SEQ ID NO: 584182 - RNA, 19 nt, Human
caagaaacugccaaacugc

SEQ ID NO: 584183 - RNA, 19 nt, Human
cacaguuuaauuauucgcc

SEQ ID NO: 584184 - RNA, 22 nt, Human
cacaguuuaauuauucgccccu

SEQ ID NO: 584185 - RNA, 24 nt, Human
cacccacuucucuccucucuccca

SEQ ID NO: 584186 - RNA, 22 nt, Human
cacuacagcccagaacuccugg

SEQ ID NO: 584187 - RNA, 22 nt, Human
ccacagucaaggcacagaaugc

SEQ ID NO: 584188 - RNA, 23 nt, Human
ccacuucucuccucucucccaaa

SEQ ID NO: 584189 - RNA, 21 nt, Human
cccacuucucuccucucuccc

SEQ ID NO: 584190 - RNA, 22 nt, Human
cccacuucucuccucucuccca

SEQ ID NO: 584191 - RNA, 23 nt, Human
ccccuuaccuaguuacccccaau

SEQ ID NO: 584192 - RNA, 22 nt, Human
ccugggcucaagugauccuccu

SEQ ID NO: 584193 - RNA, 23 nt, Human
ccugggcucaagugauccuccug

SEQ ID NO: 584194 - RNA, 23 nt, Human
cuacagcccagaacuccugggcu

SEQ ID NO: 584195 - RNA, 18 nt, Human
cucaagugauccuccugc

SEQ ID NO: 584196 - RNA, 20 nt, Human
cuccagaaaaaucuuuuaag

SEQ ID NO: 584197 - RNA, 24 nt, Human
cuccucucucccaaacuccaucuc

SEQ ID NO: 584198 - RNA, 25 nt, Human
cugcugggucauauggcaauugcau

SEQ ID NO: 584199 - RNA, 20 nt, Human
cugguggucccccacuccca

SEQ ID NO: 584200 - RNA, 21 nt, Human
cuuugauugugugguaguucu

SEQ ID NO: 584201 - RNA, 24 nt, Human
gaacuccugggcucaagugauccu

SEQ ID NO: 584202 - RNA, 19 nt, Human
gcucaagugauccuccugc

SEQ ID NO: 584203 - RNA, 22 nt, Human
gcugaagugcaguggcuauuca

SEQ ID NO: 584204 - RNA, 19 nt, Human
gggcucaagugauccuccu

SEQ ID NO: 584205 - RNA, 18 nt, Human
ggugguuucuaguuucug

SEQ ID NO: 584206 - RNA, 22 nt, Human
gucacaaccaggauauucagau

SEQ ID NO: 584207 - RNA, 18 nt, Human
uaccacaaugucacaacc

SEQ ID NO: 584208 - RNA, 20 nt, Human
uacccccaaugguaacaucu

SEQ ID NO: 584209 - RNA, 25 nt, Human
uaguaauaucuuauuguggguuuua

SEQ ID NO: 584210 - RNA, 18 nt, Human
uauguugcccaggcugaa

SEQ ID NO: 584211 - RNA, 23 nt, Human
uauguugcccaggcugaagugca

SEQ ID NO: 584212 - RNA, 20 nt, Human
ucacaagugcuaucccacua

SEQ ID NO: 584213 - RNA, 19 nt, Human
ucccaaacuccaucucuaa

SEQ ID NO: 584214 - RNA, 21 nt, Human
uccugggcucaagugauccuc

SEQ ID NO: 584215 - RNA, 22 nt, Human
uccugggcucaagugauccucc

SEQ ID NO: 584216 - RNA, 22 nt, Human
uccugggcucaagugauccucc

SEQ ID NO: 584217 - RNA, 24 nt, Human
uccugggcucaagugauccuccug

SEQ ID NO: 584218 - RNA, 18 nt, Human
uccuuaggcaaccuggug

SEQ ID NO: 584219 - RNA, 22 nt, Human
uccuuaggcaaccugguggucc

SEQ ID NO: 584220 - RNA, 19 nt, Human
ucuugcuauguugcccagg

SEQ ID NO: 584221 - RNA, 23 nt, Human
ucuugcuauguugcccaggcuga

SEQ ID NO: 584222 - RNA, 24 nt, Human
ucuugcuauguugcccaggcugaa

SEQ ID NO: 584223 - RNA, 23 nt, Human
ugaaaaaaaauuaucuugguuca

SEQ ID NO: 584224 - RNA, 23 nt, Human
ugcacgaaugauuuguuucuuuu

SEQ ID NO: 584225 - RNA, 23 nt, Human
ugcccaggcugaagugcaguggc

SEQ ID NO: 584226 - RNA, 24 nt, Human
ugcuauguugcccaggcugaagug

SEQ ID NO: 584227 - RNA, 25 nt, Human
ugcuauguugcccaggcugaagugc

SEQ ID NO: 584228 - RNA, 19 nt, Human
uggcagguguguaguaaua

SEQ ID NO: 584229 - RNA, 19 nt, Human
ugggauaaaugccugugag

SEQ ID NO: 584230 - RNA, 20 nt, Human
ugggcucaagugauccuccu

SEQ ID NO: 584231 - RNA, 18 nt, Human
ugguggucccccacuccc

SEQ ID NO: 584232 - RNA, 20 nt, Human
ugucggauaugugguuugca

SEQ ID NO: 584233 - RNA, 19 nt, Human
uguguacagguuucugugu

SEQ ID NO: 584234 - RNA, 24 nt, Human
uguuucuaaccaggaccuguucac

SEQ ID NO: 584235 - RNA, 19 nt, Human
uguuucuuuuauugcuggg

SEQ ID NO: 584236 - RNA, 23 nt, Human
uuccaaaauuugaugguguugcc

SEQ ID NO: 584237 - RNA, 22 nt, Human
uucuuuagauauucuaaacacu

SEQ ID NO: 584238 - RNA, 23 nt, Human
uugaugguguugccauuuuuuau

SEQ ID NO: 584239 - RNA, 24 nt, Human
uugcccaggcugaagugcaguggc

SEQ ID NO: 584240 - RNA, 25 nt, Human
uugguucaaaacaauuguuggagua

SEQ ID NO: 584241 - RNA, 18 nt, Human
aaaccauauuugccuaca

SEQ ID NO: 584242 - RNA, 25 nt, Human
aagagcccugaacaauuuuuaaucc

SEQ ID NO: 584243 - RNA, 24 nt, Human
accaucucuaagagcccugaacaa

SEQ ID NO: 584244 - RNA, 21 nt, Human
accauucaugcauccauaauc

SEQ ID NO: 584245 - RNA, 25 nt, Human
auccauuuccuaaacaagauauguu

SEQ ID NO: 584246 - RNA, 21 nt, Human
auuugccuacacaccacugcc

SEQ ID NO: 584247 - RNA, 25 nt, Human
cacuugauuuuuuuauacauccauu

SEQ ID NO: 584248 - RNA, 24 nt, Human
cauuaaaagacgaaugccaaacca

SEQ ID NO: 584249 - RNA, 23 nt, Human
ccacugccuuuucccuuucuuuc

SEQ ID NO: 584250 - RNA, 18 nt, Human
uauaguauaaagauggcu

SEQ ID NO: 584251 - RNA, 22 nt, Human
ucaaaaugacaucauaucaggu

SEQ ID NO: 584252 - RNA, 18 nt, Human
ucuaagagcccugaacaa

SEQ ID NO: 584253 - RNA, 22 nt, Human
ucuccaaagcaugaccauucau

SEQ ID NO: 584254 - RNA, 23 nt, Human
ucucuaagagcccugaacaauuu

SEQ ID NO: 584255 - RNA, 25 nt, Human
uguuuauucaucuuuuuaauccuca

SEQ ID NO: 584256 - RNA, 19 nt, Human
uugcacuugauuuuuuuau

SEQ ID NO: 584257 - RNA, 27 nt, Human
aaggagaaguuggaacaaaugcagugg

SEQ ID NO: 584258 - RNA, 20 nt, Human
aaugcagugggcacaaugac

SEQ ID NO: 584259 - RNA, 20 nt, Human
cgaccccgccuccaccagcc

SEQ ID NO: 584260 - RNA, 21 nt, Human
cucgaccccgccuccaccagc

SEQ ID NO: 584261 - RNA, 23 nt, Human
cuggggugaguuuauacaaggag

SEQ ID NO: 584262 - RNA, 21 nt, Human
gaacaaacuaaaagcaucuau

SEQ ID NO: 584263 - RNA, 24 nt, Human
gaacaggcuuuaguacugaggucc

SEQ ID NO: 584264 - RNA, 22 nt, Human
gaccccgccuccaccagcccac

SEQ ID NO: 584265 - RNA, 19 nt, Human
gcccuguguugcuggggug

SEQ ID NO: 584266 - RNA, 21 nt, Human
uacaaggagaaguuggaacaa

SEQ ID NO: 584267 - RNA, 22 nt, Human
uacagcugacuuucugugauuu

SEQ ID NO: 584268 - RNA, 22 nt, Human
ucaguucaaaguaggucuuggg

SEQ ID NO: 584269 - RNA, 21 nt, Human
ucgaccccgccuccaccagcc

SEQ ID NO: 584270 - RNA, 24 nt, Human
ucgaccccgccuccaccagcccac

SEQ ID NO: 584271 - RNA, 19 nt, Human
ugcucauuguugaucaggg

SEQ ID NO: 584272 - RNA, 19 nt, Human
uggaacaaaugcagugggc

SEQ ID NO: 584273 - RNA, 18 nt, Human
uuauuuccuccagagaac

SEQ ID NO: 584274 - RNA, 23 nt, Human
uucuuuauuuccuccagagaaca

SEQ ID NO: 584275 - RNA, 26 nt, Human
aaaaaaaaaacaaaacacauagacaa

SEQ ID NO: 584276 - RNA, 25 nt, Human
aaaaaaaaacaaaacacauagacaa

SEQ ID NO: 584277 - RNA, 18 nt, Human
aaaacaaaacacauagac

SEQ ID NO: 584278 - RNA, 18 nt, Human
aaacaccacagcccagug

SEQ ID NO: 584279 - RNA, 24 nt, Human
aaacaccacagcccagugaugaac

SEQ ID NO: 584280 - RNA, 22 nt, Human
aaacagguaauucucaaccugg

SEQ ID NO: 584281 - RNA, 19 nt, Human
aaccaggaagcaaaggcca

SEQ ID NO: 584282 - RNA, 22 nt, Human
aaccaggaagcaaaggccagga

SEQ ID NO: 584283 - RNA, 20 nt, Human
aagaggguuuucucucccuu

SEQ ID NO: 584284 - RNA, 18 nt, Human
aagcaagggcucgagaca

SEQ ID NO: 584285 - RNA, 21 nt, Human
aagcagcugucagaagaacuu

SEQ ID NO: 584286 - RNA, 20 nt, Human
aaguagcuaagauuauauac

SEQ ID NO: 584287 - RNA, 18 nt, Human
aagucuagauuucuccag

SEQ ID NO: 584288 - RNA, 21 nt, Human
acaaaguaagagcaagacuug

SEQ ID NO: 584289 - RNA, 24 nt, Human
acaacugugguugaacaaaugcuc

SEQ ID NO: 584290 - RNA, 19 nt, Human
acacugggggacugugggg

SEQ ID NO: 584291 - RNA, 24 nt, Human
accacagcccagugaugaacgccu

SEQ ID NO: 584292 - RNA, 18 nt, Human
accaucacacuacaugcu

SEQ ID NO: 584293 - RNA, 19 nt, Human
accccuccccaccccagcc

SEQ ID NO: 584294 - RNA, 22 nt, Human
acucuggaaagcucuucagcac

SEQ ID NO: 584295 - RNA, 18 nt, Human
acuggaaccugaacucca

SEQ ID NO: 584296 - RNA, 21 nt, Human
agacacaccugagccugaggg

SEQ ID NO: 584297 - RNA, 18 nt, Human
agcccagugaugaacgcc

SEQ ID NO: 584298 - RNA, 18 nt, Human
agcuaaccuugcaaagca

SEQ ID NO: 584299 - RNA, 18 nt, Human
aggaaagcaagggcucga

SEQ ID NO: 584300 - RNA, 24 nt, Human
aggaagaggguuuucucucccuuc

SEQ ID NO: 584301 - RNA, 26 nt, Human
aggcaaaccaggaagcaaaggccagg

SEQ ID NO: 584302 - RNA, 22 nt, Human
aggcacucggaugaagaguuuu

SEQ ID NO: 584303 - RNA, 20 nt, Human
aggccaggacugaacuagga

SEQ ID NO: 584304 - RNA, 21 nt, Human
agggaaacagcagaaagagca

SEQ ID NO: 584305 - RNA, 21 nt, Human
agggggauugcaucggcuggu

SEQ ID NO: 584306 - RNA, 22 nt, Human
auaaucaguuaaaagucaaagu

SEQ ID NO: 584307 - RNA, 25 nt, Human
auacugaagcccucaaaaaccggag

SEQ ID NO: 584308 - RNA, 21 nt, Human
auagacaaguaaugcaaacaa

SEQ ID NO: 584309 - RNA, 23 nt, Human
augaacaaugagcaaagcauguc

SEQ ID NO: 584310 - RNA, 18 nt, Human
augccuaggaaauguuag

SEQ ID NO: 584311 - RNA, 22 nt, Human
caaaccaggaagcaaaggccag

SEQ ID NO: 584312 - RNA, 21 nt, Human
caaagcuaaaaugggaacugg

SEQ ID NO: 584313 - RNA, 20 nt, Human
caaaguaagagcaagacuug

SEQ ID NO: 584314 - RNA, 19 nt, Human
caaagucaaucaauagcca

SEQ ID NO: 584315 - RNA, 21 nt, Human
caagaaacaccacagcccagu

SEQ ID NO: 584316 - RNA, 22 nt, Human
caagaaacaccacagcccagug

SEQ ID NO: 584317 - RNA, 20 nt, Human
caagacccaaggcuagaagc

SEQ ID NO: 584318 - RNA, 23 nt, Human
caagacccaaggcuagaagcuaa

SEQ ID NO: 584319 - RNA, 20 nt, Human
caagacccaaggcuagaagg

SEQ ID NO: 584320 - RNA, 23 nt, Human
cacaccaggaugaccccucccca

SEQ ID NO: 584321 - RNA, 18 nt, Human
cagaucaaugaggugcca

SEQ ID NO: 584322 - RNA, 20 nt, Human
cagcagaccucaggaaauga

SEQ ID NO: 584323 - RNA, 23 nt, Human
cagcagaccucaggaaaugacug

SEQ ID NO: 584324 - RNA, 25 nt, Human
cagcgacagacaaaguggggucuac

SEQ ID NO: 584325 - RNA, 18 nt, Human
caggagagguggagaagg

SEQ ID NO: 584326 - RNA, 18 nt, Human
caucacacuacaugcuuu

SEQ ID NO: 584327 - RNA, 23 nt, Human
ccaacaucugacuuaggcaaacc

SEQ ID NO: 584328 - RNA, 22 nt, Human
ccacucaucagcacccuacccc

SEQ ID NO: 584329 - RNA, 25 nt, Human
ccacugaauugaaucuaaaauucca

SEQ ID NO: 584330 - RNA, 19 nt, Human
ccagcuaaccuugcaaagc

SEQ ID NO: 584331 - RNA, 27 nt, Human
cccaccccagcccuaugacucuggaaa

SEQ ID NO: 584332 - RNA, 26 nt, Human
cccagugaugaacgccaggaugccuc

SEQ ID NO: 584333 - RNA, 23 nt, Human
cccagugaugaacgccaggguac

SEQ ID NO: 584334 - RNA, 27 nt, Human
ccccaccccagcccuaugaccgguucc

SEQ ID NO: 584335 - RNA, 22 nt, Human
cccccgaaacucacagccccuu

SEQ ID NO: 584336 - RNA, 19 nt, Human
ccccuccccaccccagccc

SEQ ID NO: 584337 - RNA, 21 nt, Human
cccucaggaaagcaagggcuc

SEQ ID NO: 584338 - RNA, 19 nt, Human
ccucaaaauccucuuugga

SEQ ID NO: 584339 - RNA, 19 nt, Human
ccucaggaaagcaagggcu

SEQ ID NO: 584340 - RNA, 23 nt, Human
ccuccccaccccagcccuaugac

SEQ ID NO: 584341 - RNA, 22 nt, Human
ccucuuuggagaaaguaggggc

SEQ ID NO: 584342 - RNA, 23 nt, Human
ccugucccugcaucuucagucgu

SEQ ID NO: 584343 - RNA, 23 nt, Human
ccuucuuuggugucugggccaaa

SEQ ID NO: 584344 - RNA, 18 nt, Human
cggcaagacccaaggcua

SEQ ID NO: 584345 - RNA, 24 nt, Human
cggcaagacccaaggcuagaagcu

SEQ ID NO: 584346 - RNA, 23 nt, Human
cuaaccuugcaaagcacacacac

SEQ ID NO: 584347 - RNA, 18 nt, Human
cucaugucuucagcguca

SEQ ID NO: 584348 - RNA, 25 nt, Human
cuccugccuacuuuuccccuuuaaa

SEQ ID NO: 584349 - RNA, 22 nt, Human
cuucagucgucucuacugccac

SEQ ID NO: 584350 - RNA, 20 nt, Human
cuugcccaccaucacacuac

SEQ ID NO: 584351 - RNA, 19 nt, Human
cuuuccuccuuucuccucc

SEQ ID NO: 584352 - RNA, 20 nt, Human
gaaaauggccccuucaccaa

SEQ ID NO: 584353 - RNA, 20 nt, Human
gaaacaccacagcccaguga

SEQ ID NO: 584354 - RNA, 23 nt, Human
gaaacagcagaaagagcagagaa

SEQ ID NO: 584355 - RNA, 23 nt, Human
gacccugucccugcaucuucagu

SEQ ID NO: 584356 - RNA, 18 nt, Human
gcaaagcaugucuugccc

SEQ ID NO: 584357 - RNA, 19 nt, Human
gccaaaaccaccaaccccg

SEQ ID NO: 584358 - RNA, 23 nt, Human
gccccuucaccaacuaccacuca

SEQ ID NO: 584359 - RNA, 19 nt, Human
gcuuuggauuggguguugu

SEQ ID NO: 584360 - RNA, 19 nt, Human
ggagguguggaggugccag

SEQ ID NO: 584361 - RNA, 21 nt, Human
ggcaggacgaguugcugcaga

SEQ ID NO: 584362 - RNA, 23 nt, Human
gggaaacagcagaaagagcagag

SEQ ID NO: 584363 - RNA, 22 nt, Human
ggggcaucucaguaagcagcug

SEQ ID NO: 584364 - RNA, 22 nt, Human
guacauugauugagacuuggcu

SEQ ID NO: 584365 - RNA, 26 nt, Human
gucaucuuucaugccuaggaaauguu

SEQ ID NO: 584366 - RNA, 20 nt, Human
guggaacaagaaacaccaca

SEQ ID NO: 584367 - RNA, 23 nt, Human
uaaaacaguaucuuucuaauccc

SEQ ID NO: 584368 - RNA, 20 nt, Human
uacagagggagcucaguccg

SEQ ID NO: 584369 - RNA, 24 nt, Human
uagcacagaugagagcaaagcuaa

SEQ ID NO: 584370 - RNA, 18 nt, Human
uagugugucuucaaccuc

SEQ ID NO: 584371 - RNA, 18 nt, Human
uauacugaagccauuucu

SEQ ID NO: 584372 - RNA, 24 nt, Human
uaucccagaacuacuuaugauuua

SEQ ID NO: 584373 - RNA, 18 nt, Human
uauuuguucucugggcuu

SEQ ID NO: 584374 - RNA, 23 nt, Human
ucaguuaaaagucaaagucaauc

SEQ ID NO: 584375 - RNA, 22 nt, Human
uccccaccccagcccuaugacu

SEQ ID NO: 584376 - RNA, 20 nt, Human
ucccugcaucuucagucguc

SEQ ID NO: 584377 - RNA, 22 nt, Human
ucuacagccuucacccuucugc

SEQ ID NO: 584378 - RNA, 23 nt, Human
ucuccaguuacuuguaagaagcc

SEQ ID NO: 584379 - RNA, 24 nt, Human
ucucugggcuuugggguagcagag

SEQ ID NO: 584380 - RNA, 19 nt, Human
ucugucucccuuggggacu

SEQ ID NO: 584381 - RNA, 27 nt, Human
ugaccccuccccaccccagcccuauga

SEQ ID NO: 584382 - RNA, 24 nt, Human
ugacucuggaaagcucuucagcac

SEQ ID NO: 584383 - RNA, 20 nt, Human
ugaggacaaucaggaggugu

SEQ ID NO: 584384 - RNA, 24 nt, Human
ugccacaugcccuguccacaccag

SEQ ID NO: 584385 - RNA, 21 nt, Human
ugcccaccaucacacuacaug

SEQ ID NO: 584386 - RNA, 19 nt, Human
ugcggcaagacccaaggcu

SEQ ID NO: 584387 - RNA, 25 nt, Human
uggaaaacagguaauucucaaccug

SEQ ID NO: 584388 - RNA, 18 nt, Human
uggaggccuugcuuaggu

SEQ ID NO: 584389 - RNA, 19 nt, Human
ugguugaacaaaugcucag

SEQ ID NO: 584390 - RNA, 21 nt, Human
ugucagaagaacuuugaggau

SEQ ID NO: 584391 - RNA, 20 nt, Human
ugucaggaagugggggagau

SEQ ID NO: 584392 - RNA, 26 nt, Human
ugucuucaaccucggcaaaauaaccu

SEQ ID NO: 584393 - RNA, 24 nt, Human
ugucuugcccaccaucacacuaca

SEQ ID NO: 584394 - RNA, 27 nt, Human
uguggggcaucucaguaagcagcuggu

SEQ ID NO: 584395 - RNA, 23 nt, Human
ugugguugaacaaaugcucagug

SEQ ID NO: 584396 - RNA, 18 nt, Human
uguugggcaggcguugcg

SEQ ID NO: 584397 - RNA, 20 nt, Human
uguuguggggaauaaauaga

SEQ ID NO: 584398 - RNA, 25 nt, Human
uuacauagugaccuuguguuugucu

SEQ ID NO: 584399 - RNA, 24 nt, Human
uuaggagucuuaacuuuauucccc

SEQ ID NO: 584400 - RNA, 21 nt, Human
uuccuccuuucuccuccugcc

SEQ ID NO: 584401 - RNA, 25 nt, Human
uugaggauggaggccuugcuuaggu

SEQ ID NO: 584402 - RNA, 18 nt, Human
uuggagaaaguaggggcc

SEQ ID NO: 584403 - RNA, 18 nt, Human
uuggucugucucccuugg

SEQ ID NO: 584404 - RNA, 18 nt, Human
uuuauuccccuccucuua

SEQ ID NO: 584405 - RNA, 22 nt, Human
uuugaggacaaucaggaggugu

SEQ ID NO: 584406 - RNA, 22 nt, Human
uuuugaggacaaucaggaggug

SEQ ID NO: 584407 - RNA, 21 nt, Human
acucaggcaugguggcagcau

SEQ ID NO: 584408 - RNA, 22 nt, Human
agccaggaucuccuauggagug

SEQ ID NO: 584409 - RNA, 19 nt, Human
auggaguguguaggugucc

SEQ ID NO: 584410 - RNA, 18 nt, Human
cacgaguguaccggugug

SEQ ID NO: 584411 - RNA, 21 nt, Human
cagcauugagggaaagacagg

SEQ ID NO: 584412 - RNA, 24 nt, Human
cagcauugagggaaagacaggugu

SEQ ID NO: 584413 - RNA, 21 nt, Human
cagccaguucuuuucccaccu

SEQ ID NO: 584414 - RNA, 21 nt, Human
caggucagggcaaaggucaca

SEQ ID NO: 584415 - RNA, 18 nt, Human
ccacauguaggucccagg

SEQ ID NO: 584416 - RNA, 21 nt, Human
cccacuggucccuggcuccaa

SEQ ID NO: 584417 - RNA, 20 nt, Human
cccgccacgccgggacaccg

SEQ ID NO: 584418 - RNA, 19 nt, Human
cccgcgcccagugcgcucc

SEQ ID NO: 584419 - RNA, 25 nt, Human
ccgccacgccgggacaccgccgucc

SEQ ID NO: 584420 - RNA, 21 nt, Human
ccuugcccacccuggaaagcc

SEQ ID NO: 584421 - RNA, 21 nt, Human
ccuugcccuugcccacccugg

SEQ ID NO: 584422 - RNA, 18 nt, Human
cucuccugggaagugaag

SEQ ID NO: 584423 - RNA, 18 nt, Human
gacucgggagccguccgg

SEQ ID NO: 584424 - RNA, 19 nt, Human
gcuucccgccacgccggga

SEQ ID NO: 584425 - RNA, 21 nt, Human
ggacaccgccguccggcccag

SEQ ID NO: 584426 - RNA, 23 nt, Human
ggcugggcccuuccaggucaggg

SEQ ID NO: 584427 - RNA, 22 nt, Human
gggagcgggguccccaccugcc

SEQ ID NO: 584428 - RNA, 19 nt, Human
gggcaaaggucacagccag

SEQ ID NO: 584429 - RNA, 24 nt, Human
guaggucccaggcucaggggcuua

SEQ ID NO: 584430 - RNA, 22 nt, Human
ucacagccaguucuuuucccac

SEQ ID NO: 584431 - RNA, 22 nt, Human
ucaggcaugguggcagcauuga

SEQ ID NO: 584432 - RNA, 23 nt, Human
uccacgaguguaccggugugcgg

SEQ ID NO: 584433 - RNA, 19 nt, Human
uccaggucagggcaaaggu

SEQ ID NO: 584434 - RNA, 22 nt, Human
ucccugcgccucccggucccgc

SEQ ID NO: 584435 - RNA, 19 nt, Human
uggcuccaagccugcuccu

SEQ ID NO: 584436 - RNA, 20 nt, Human
uggcuccaagccugcuccuu

SEQ ID NO: 584437 - RNA, 20 nt, Human
ugggaagugaagacuucuuc

SEQ ID NO: 584438 - RNA, 18 nt, Human
uguuggggagcggggucc

SEQ ID NO: 584439 - RNA, 19 nt, Human
aaaaucucuccaacuggau

SEQ ID NO: 584440 - RNA, 22 nt, Human
aaacaaaguuugcgaugcucau

SEQ ID NO: 584441 - RNA, 21 nt, Human
aaauguuccucuugccuacug

SEQ ID NO: 584442 - RNA, 21 nt, Human
aacacauuuuuucaaggcacu

SEQ ID NO: 584443 - RNA, 23 nt, Human
aacuuuuugagucagucgcaaca

SEQ ID NO: 584444 - RNA, 24 nt, Human
acuggaucaaauuuuuuauauacu

SEQ ID NO: 584445 - RNA, 21 nt, Human
augauaauguuaaaacauauc

SEQ ID NO: 584446 - RNA, 24 nt, Human
caguauuagucugguuuccuacag

SEQ ID NO: 584447 - RNA, 20 nt, Human
ccucaaacuucaagggugaa

SEQ ID NO: 584448 - RNA, 24 nt, Human
cuucaagggugaaaagcauaccau

SEQ ID NO: 584449 - RNA, 21 nt, Human
gagucagucgcaacagacugg

SEQ ID NO: 584450 - RNA, 18 nt, Human
uacaauuuuuagaaaagg

SEQ ID NO: 584451 - RNA, 24 nt, Human
uacaggaaaaauguuccucuugcc

SEQ ID NO: 584452 - RNA, 18 nt, Human
uagaacccacaacagcug

SEQ ID NO: 584453 - RNA, 21 nt, Human
ugaggaagaauuuggacuagc

SEQ ID NO: 584454 - RNA, 24 nt, Human
ugaggaagaauuuggacuagcugg

SEQ ID NO: 584455 - RNA, 19 nt, Human
uguaaaaauauuuuucuuc

SEQ ID NO: 584456 - RNA, 21 nt, Human
uucaagggugaaaagcauacc

SEQ ID NO: 584457 - RNA, 27 nt, Human
uucagcaguggcaacauuuaacuuuuu

SEQ ID NO: 584458 - RNA, 28 nt, Human
uuccuacagaagccuguccugaggaaga

SEQ ID NO: 584459 - RNA, 27 nt, Human
uuuaaaaucucuccaacuggaucaaau

SEQ ID NO: 584460 - RNA, 24 nt, Human
aaaagaaaccaaaauccagagaaa

SEQ ID NO: 584461 - RNA, 21 nt, Human
aaaccaaaauccagagaaaaa

SEQ ID NO: 584462 - RNA, 18 nt, Human
aaagccaaaagaaaccaa

SEQ ID NO: 584463 - RNA, 19 nt, Human
aaaugcacucgacccaaaa

SEQ ID NO: 584464 - RNA, 23 nt, Human
aagcaggaacucaaagggacagc

SEQ ID NO: 584465 - RNA, 23 nt, Human
aagcaucuuugggugugaagagg

SEQ ID NO: 584466 - RNA, 24 nt, Human
aagccaaaagaaaccaaaauccag

SEQ ID NO: 584467 - RNA, 19 nt, Human
aagccagccccagcucccc

SEQ ID NO: 584468 - RNA, 21 nt, Human
aagccagccccagcuccccgg

SEQ ID NO: 584469 - RNA, 25 nt, Human
acagcgcagccaucuugacaaagca

SEQ ID NO: 584470 - RNA, 21 nt, Human
acagcucugaggccuggaagc

SEQ ID NO: 584471 - RNA, 21 nt, Human
acaggccucugguccuggggc

SEQ ID NO: 584472 - RNA, 20 nt, Human
accaccccuccacacaacag

SEQ ID NO: 584473 - RNA, 21 nt, Human
acccaaccccaccucuucccc

SEQ ID NO: 584474 - RNA, 20 nt, Human
acucuccuggcccuccuccu

SEQ ID NO: 584475 - RNA, 24 nt, Human
agacagccagaaagacauggggaa

SEQ ID NO: 584476 - RNA, 21 nt, Human
agagaaaggggaaggcaaggg

SEQ ID NO: 584477 - RNA, 24 nt, Human
agaggaaaccaagacccuucucug

SEQ ID NO: 584478 - RNA, 23 nt, Human
agaggaacauagagacagccaga

SEQ ID NO: 584479 - RNA, 22 nt, Human
agaguuggaacccaaccccacc

SEQ ID NO: 584480 - RNA, 22 nt, Human
agcaaacgaguucaggagccua

SEQ ID NO: 584481 - RNA, 19 nt, Human
agcaggaaaggaggggaca

SEQ ID NO: 584482 - RNA, 18 nt, Human
aggaaauggguucuuugu

SEQ ID NO: 584483 - RNA, 18 nt, Human
aggaacauagagacagcc

SEQ ID NO: 584484 - RNA, 23 nt, Human
aggaaggcugggcagggaggaag

SEQ ID NO: 584485 - RNA, 21 nt, Human
aggaagggaguaggagaggaa

SEQ ID NO: 584486 - RNA, 26 nt, Human
aggagcaaacgaguucaggagccuaa

SEQ ID NO: 584487 - RNA, 21 nt, Human
aggcaccaggucugguuaggu

SEQ ID NO: 584488 - RNA, 21 nt, Human
aggccucugguccuggggcag

SEQ ID NO: 584489 - RNA, 19 nt, Human
agggaagggggagacaggg

SEQ ID NO: 584490 - RNA, 19 nt, Human
agggaggggcuggggcgug

SEQ ID NO: 584491 - RNA, 22 nt, Human
aggggacagaaacgggugccag

SEQ ID NO: 584492 - RNA, 22 nt, Human
aguguuggagacagagaaaggg

SEQ ID NO: 584493 - RNA, 26 nt, Human
aguuggaacccaaccccaccucuucc

SEQ ID NO: 584494 - RNA, 19 nt, Human
auagagacagccagaaaga

SEQ ID NO: 584495 - RNA, 31 nt, Human
auuuuuuucuuuucuuuuuuuuuuuuuuuuu

SEQ ID NO: 584496 - RNA, 22 nt, Human
caaaagaaaccaaaauccagag

SEQ ID NO: 584497 - RNA, 21 nt, Human
caaagcaucuuugggugugaa

SEQ ID NO: 584498 - RNA, 18 nt, Human
caaagggacagcgcagcc

SEQ ID NO: 584499 - RNA, 18 nt, Human
caaggagggaggggcugg

SEQ ID NO: 584500 - RNA, 19 nt, Human
cacacagcucugaggccug

SEQ ID NO: 584501 - RNA, 27 nt, Human
cacacagcucugaggccuggaagccac

SEQ ID NO: 584502 - RNA, 22 nt, Human
cacagaccucugaccaccccuc

SEQ ID NO: 584503 - RNA, 18 nt, Human
cacgggacaaaccaccau

SEQ ID NO: 584504 - RNA, 25 nt, Human
cacuggacugcagugauguccagcc

SEQ ID NO: 584505 - RNA, 20 nt, Human
cagaccucugaccaccccuc

SEQ ID NO: 584506 - RNA, 24 nt, Human
cagagucgucuggcaagacugucc

SEQ ID NO: 584507 - RNA, 21 nt, Human
ccacaccuguucccuuacacg

SEQ ID NO: 584508 - RNA, 24 nt, Human
ccaccucuuccccacaccuguucc

SEQ ID NO: 584509 - RNA, 18 nt, Human
ccagccccagcagggggc

SEQ ID NO: 584510 - RNA, 22 nt, Human
ccccaccucuuccccacaccug

SEQ ID NO: 584511 - RNA, 19 nt, Human
cccccuggaacucuccugg

SEQ ID NO: 584512 - RNA, 21 nt, Human
ccccuggaacucuccuggccc

SEQ ID NO: 584513 - RNA, 21 nt, Human
cccgauacacccucucucccu

SEQ ID NO: 584514 - RNA, 21 nt, Human
cccuccacacaacagagcucc

SEQ ID NO: 584515 - RNA, 23 nt, Human
cccuccacacaacagagcuccca

SEQ ID NO: 584516 - RNA, 20 nt, Human
ccgguggggagggaaggggg

SEQ ID NO: 584517 - RNA, 22 nt, Human
ccgucccagcuggggugggggc

SEQ ID NO: 584518 - RNA, 23 nt, Human
ccuccuccuggugucgggggcag

SEQ ID NO: 584519 - RNA, 25 nt, Human
ccuggcccuccuccugguccccugg

SEQ ID NO: 584520 - RNA, 26 nt, Human
ccuggccucacuucuccuccccaucu

SEQ ID NO: 584521 - RNA, 19 nt, Human
cgcccgccccggcggggac

SEQ ID NO: 584522 - RNA, 19 nt, Human
cggcgagaguccccagagc

SEQ ID NO: 584523 - RNA, 19 nt, Human
cgggagaagggaggggcuu

SEQ ID NO: 584524 - RNA, 23 nt, Human
cuagugcaguccgggaagggcca

SEQ ID NO: 584525 - RNA, 23 nt, Human
cucaugccuccugcccgcucuuc

SEQ ID NO: 584526 - RNA, 18 nt, Human
cuccggagaaagcccggg

SEQ ID NO: 584527 - RNA, 20 nt, Human
cuccggagaaagcccgggcu

SEQ ID NO: 584528 - RNA, 19 nt, Human
cuccucagagucgucuggc

SEQ ID NO: 584529 - RNA, 19 nt, Human
cuccucgccugcucaugcc

SEQ ID NO: 584530 - RNA, 19 nt, Human
cuccuggcccuccuccugg

SEQ ID NO: 584531 - RNA, 21 nt, Human
cucuccuggcccuccuccugg

SEQ ID NO: 584532 - RNA, 20 nt, Human
cucugcuccggagaaagccc

SEQ ID NO: 584533 - RNA, 23 nt, Human
cucugcuccggagaaagcccggg

SEQ ID NO: 584534 - RNA, 24 nt, Human
cugcagugauguccagccccagcc

SEQ ID NO: 584535 - RNA, 21 nt, Human
cugcuccggagaaagcccggg

SEQ ID NO: 584536 - RNA, 23 nt, Human
cuggaacucuccuggcccuccuc

SEQ ID NO: 584537 - RNA, 20 nt, Human
cuggcaagacugucccuggc

SEQ ID NO: 584538 - RNA, 21 nt, Human
gaaagccaaaagaaaccaaaa

SEQ ID NO: 584539 - RNA, 24 nt, Human
gaacccaaccccaccucuucccca

SEQ ID NO: 584540 - RNA, 23 nt, Human
gagcucccagccuagugcagucc

SEQ ID NO: 584541 - RNA, 18 nt, Human
gaggccuggaagccaccc

SEQ ID NO: 584542 - RNA, 25 nt, Human
gaggggacagaaacgggugccagga

SEQ ID NO: 584543 - RNA, 20 nt, Human
gauacaaggaaggcugggca

SEQ ID NO: 584544 - RNA, 18 nt, Human
gcagccaucuugacaaag

SEQ ID NO: 584545 - RNA, 22 nt, Human
gcgcagccaucuugacaaagca

SEQ ID NO: 584546 - RNA, 19 nt, Human
ggacaagccagccccagcu

SEQ ID NO: 584547 - RNA, 22 nt, Human
ggacaagccagccccagcuccc

SEQ ID NO: 584548 - RNA, 26 nt, Human
ggacaagccagccccagcuccccggg

SEQ ID NO: 584549 - RNA, 21 nt, Human
ggacagaaacgggugccagga

SEQ ID NO: 584550 - RNA, 23 nt, Human
ggaggaggcccgaauggacagaa

SEQ ID NO: 584551 - RNA, 19 nt, Human
ggagggaagggggagacag

SEQ ID NO: 584552 - RNA, 20 nt, Human
ggaggggcuggggcguggga

SEQ ID NO: 584553 - RNA, 22 nt, Human
ggcaagggaaagccaaaagaaa

SEQ ID NO: 584554 - RNA, 21 nt, Human
ggcuggggcgugggagguggg

SEQ ID NO: 584555 - RNA, 19 nt, Human
gggaaagccaaaagaaacc

SEQ ID NO: 584556 - RNA, 18 nt, Human
gggaggggcuggggcgug

SEQ ID NO: 584557 - RNA, 19 nt, Human
gggcuggggcgugggaggu

SEQ ID NO: 584558 - RNA, 21 nt, Human
gggcuggggcgugggaggugg

SEQ ID NO: 584559 - RNA, 27 nt, Human
ggggacagaaacgggugccaggaagga

SEQ ID NO: 584560 - RNA, 20 nt, Human
ggggcgugggagguggggag

SEQ ID NO: 584561 - RNA, 18 nt, Human
ggggcuggggcgugggag

SEQ ID NO: 584562 - RNA, 19 nt, Human
ggggcuggggcgugggagg

SEQ ID NO: 584563 - RNA, 19 nt, Human
ggugucgggggcagccaca

SEQ ID NO: 584564 - RNA, 21 nt, Human
ggugucgggggcagccacagg

SEQ ID NO: 584565 - RNA, 23 nt, Human
gucugaccccuucuccccuaauu

SEQ ID NO: 584566 - RNA, 18 nt, Human
gucuggagagauacaagg

SEQ ID NO: 584567 - RNA, 18 nt, Human
gugagagguacacgcccc

SEQ ID NO: 584568 - RNA, 19 nt, Human
guugcaucuagauuuuguu

SEQ ID NO: 584569 - RNA, 24 nt, Human
uaagagaagaggaacauagagaca

SEQ ID NO: 584570 - RNA, 21 nt, Human
uacacgggacaaaccaccauc

SEQ ID NO: 584571 - RNA, 22 nt, Human
uccagagaaaaagaauuaacaa

SEQ ID NO: 584572 - RNA, 18 nt, Human
ucccagcugggguggggg

SEQ ID NO: 584573 - RNA, 18 nt, Human
uccccggcgagagucccc

SEQ ID NO: 584574 - RNA, 19 nt, Human
uccccgggagaagggaggg

SEQ ID NO: 584575 - RNA, 24 nt, Human
uccccgggagaagggaggggcuuu

SEQ ID NO: 584576 - RNA, 22 nt, Human
uccccuaauugauggggacaag

SEQ ID NO: 584577 - RNA, 23 nt, Human
ucgucuggcaagacugucccugg

SEQ ID NO: 584578 - RNA, 18 nt, Human
ucuaccagaaaaagccag

SEQ ID NO: 584579 - RNA, 20 nt, Human
ucuccccuaauugaugggga

SEQ ID NO: 584580 - RNA, 22 nt, Human
ucuccuggcccuccuccuggug

SEQ ID NO: 584581 - RNA, 21 nt, Human
ucucucccuuugauuguccga

SEQ ID NO: 584582 - RNA, 22 nt, Human
ucucuggauuguaaacagcugc

SEQ ID NO: 584583 - RNA, 19 nt, Human
ucucugugugccucagccc

SEQ ID NO: 584584 - RNA, 21 nt, Human
ucuggcggcccgcccgccccg

SEQ ID NO: 584585 - RNA, 21 nt, Human
ucugugugccucagcccccug

SEQ ID NO: 584586 - RNA, 21 nt, Human
ucuuuuuuuuucuuuuccauu

SEQ ID NO: 584587 - RNA, 25 nt, Human
ucuuuuuuuuuuuuuuugucuuuuu

SEQ ID NO: 584588 - RNA, 22 nt, Human
ugacuuuuugacucaacaauuu

SEQ ID NO: 584589 - RNA, 22 nt, Human
ugccacacagcucugaggccug

SEQ ID NO: 584590 - RNA, 21 nt, Human
ugccaggaaggaaauggguuc

SEQ ID NO: 584591 - RNA, 21 nt, Human
ugccaggccagcagcgcugcu

SEQ ID NO: 584592 - RNA, 27 nt, Human
ugccucagcccccuggaacucuccugg

SEQ ID NO: 584593 - RNA, 19 nt, Human
ugcucaugccuccugcccg

SEQ ID NO: 584594 - RNA, 18 nt, Human
ugcuccggagaaagcccg

SEQ ID NO: 584595 - RNA, 23 nt, Human
uggaacaggacccgauacacccu

SEQ ID NO: 584596 - RNA, 20 nt, Human
uggaacccaaccccaccucu

SEQ ID NO: 584597 - RNA, 24 nt, Human
uggaagccacccggcgaugccggc

SEQ ID NO: 584598 - RNA, 22 nt, Human
uggacugcagugauguccagcc

SEQ ID NO: 584599 - RNA, 19 nt, Human
uggagagauacaaggaagg

SEQ ID NO: 584600 - RNA, 22 nt, Human
ugggagguggggaggaggcccg

SEQ ID NO: 584601 - RNA, 20 nt, Human
ugggcugcuucccgggacag

SEQ ID NO: 584602 - RNA, 22 nt, Human
uggggagggaagggggagacag

SEQ ID NO: 584603 - RNA, 21 nt, Human
uggggcgugggagguggggag

SEQ ID NO: 584604 - RNA, 26 nt, Human
ugggggcgucaaggcaccaggucugg

SEQ ID NO: 584605 - RNA, 22 nt, Human
uguccagccccagcagggggcc

SEQ ID NO: 584606 - RNA, 27 nt, Human
ugucgggggcagccacaggcugggcug

SEQ ID NO: 584607 - RNA, 24 nt, Human
uuacacgggacaaaccaccaucuu

SEQ ID NO: 584608 - RNA, 22 nt, Human
uucuuuguuucgcuguugcauu

SEQ ID NO: 584609 - RNA, 21 nt, Human
uugcaucuagauuuuguuuuc

SEQ ID NO: 584610 - RNA, 25 nt, Human
uuggaacccaaccccaccucuuccc

SEQ ID NO: 584611 - RNA, 27 nt, Human
uuucuuuuuuuuuuuuuuugucuuuuu

SEQ ID NO: 584612 - RNA, 20 nt, Human
uuuggucugaccccuucucc

SEQ ID NO: 584613 - RNA, 23 nt, Human
uuuucuuuuuuuuuuuuuuuggg

SEQ ID NO: 584614 - RNA, 20 nt, Human
uuuuugucuuuuuuuuucuu

SEQ ID NO: 584615 - RNA, 19 nt, Human
aaagugcuggaauuacagg

SEQ ID NO: 584616 - RNA, 24 nt, Human
aaagugcuggaauuacagguguga

SEQ ID NO: 584617 - RNA, 24 nt, Human
aaagugcugggacuacaggcauga

SEQ ID NO: 584618 - RNA, 21 nt, Human
aaauguuggaaccagagagaa

SEQ ID NO: 584619 - RNA, 23 nt, Human
aacacagcacuucaggaccaccu

SEQ ID NO: 584620 - RNA, 18 nt, Human
aaccuccgccuccgccuc

SEQ ID NO: 584621 - RNA, 19 nt, Human
aaccucugccucccggguc

SEQ ID NO: 584622 - RNA, 19 nt, Human
aagaaagggaaaaaaugga

SEQ ID NO: 584623 - RNA, 24 nt, Human
aagugauccacucgccucagccuc

SEQ ID NO: 584624 - RNA, 26 nt, Human
aagugcuggaauuacaggugugagcc

SEQ ID NO: 584625 - RNA, 19 nt, Human
aagugcugggacuacaggc

SEQ ID NO: 584626 - RNA, 26 nt, Human
aagugcugggacuacaggcaugagcc

SEQ ID NO: 584627 - RNA, 20 nt, Human
aauguuggaaccagagagaa

SEQ ID NO: 584628 - RNA, 18 nt, Human
aauuacaggugugagcca

SEQ ID NO: 584629 - RNA, 19 nt, Human
aauuacaggugugagccac

SEQ ID NO: 584630 - RNA, 21 nt, Human
aauuacaggugugagccacua

SEQ ID NO: 584631 - RNA, 24 nt, Human
acaaagugcuggaauuacaggugu

SEQ ID NO: 584632 - RNA, 20 nt, Human
acaaggguauaaaugagugu

SEQ ID NO: 584633 - RNA, 21 nt, Human
acacaggaagaaggauccuag

SEQ ID NO: 584634 - RNA, 19 nt, Human
accaaauuaaaucaacagc

SEQ ID NO: 584635 - RNA, 24 nt, Human
accauguuggccaggcuggucucg

SEQ ID NO: 584636 - RNA, 18 nt, Human
accauguuggucaggcug

SEQ ID NO: 584637 - RNA, 19 nt, Human
acccauuuucuuccaucag

SEQ ID NO: 584638 - RNA, 24 nt, Human
accuugugauccgccugccucagu

SEQ ID NO: 584639 - RNA, 18 nt, Human
acgagguuucaccauguu

SEQ ID NO: 584640 - RNA, 20 nt, Human
acgagguuucaccauguugg

SEQ ID NO: 584641 - RNA, 24 nt, Human
acgagguuucaccauguuggccag

SEQ ID NO: 584642 - RNA, 25 nt, Human
acucuguugcccagguuggagugca

SEQ ID NO: 584643 - RNA, 19 nt, Human
acuguguaaaacaccugaa

SEQ ID NO: 584644 - RNA, 22 nt, Human
agaaaaccuaacuagagaaaua

SEQ ID NO: 584645 - RNA, 28 nt, Human
aggaauuagcaagaaauagagcuacccc

SEQ ID NO: 584646 - RNA, 23 nt, Human
aggcaugcaccaccaaaccuggc

SEQ ID NO: 584647 - RNA, 29 nt, Human
agggaaaaaauggagacaaaagggacccc

SEQ ID NO: 584648 - RNA, 18 nt, Human
agguucaagugacucuca

SEQ ID NO: 584649 - RNA, 19 nt, Human
agguucuugcuucuuccug

SEQ ID NO: 584650 - RNA, 25 nt, Human
agguuggagugcaguugcacgaucu

SEQ ID NO: 584651 - RNA, 21 nt, Human
aguagcugggauuacaggcau

SEQ ID NO: 584652 - RNA, 23 nt, Human
aguagcugggauuacaggcaugc

SEQ ID NO: 584653 - RNA, 25 nt, Human
aguaggugggauuacaggugcaugu

SEQ ID NO: 584654 - RNA, 21 nt, Human
aguauaaagugucauaccuau

SEQ ID NO: 584655 - RNA, 23 nt, Human
agugacucucaugccucggucuc

SEQ ID NO: 584656 - RNA, 20 nt, Human
agugcagugaugcaaucuug

SEQ ID NO: 584657 - RNA, 24 nt, Human
agugcagugaugcaaucuuggcuc

SEQ ID NO: 584658 - RNA, 24 nt, Human
agugcaguugcacgaucucggcuc

SEQ ID NO: 584659 - RNA, 20 nt, Human
augagccaccacgccuggcc

SEQ ID NO: 584660 - RNA, 22 nt, Human
augccucggucucccgaguagc

SEQ ID NO: 584661 - RNA, 24 nt, Human
augccucggucucccgaguagcug

SEQ ID NO: 584662 - RNA, 19 nt, Human
auuacaggugcaugucacc

SEQ ID NO: 584663 - RNA, 19 nt, Human
auuucaccauguuggucag

SEQ ID NO: 584664 - RNA, 20 nt, Human
auuucaccauguuggucagg

SEQ ID NO: 584665 - RNA, 20 nt, Human
caaagugcuggaauuacagg

SEQ ID NO: 584666 - RNA, 23 nt, Human
caaagugcuggaauuacaggugu

SEQ ID NO: 584667 - RNA, 24 nt, Human
caaagugcuggaauuacaggugug

SEQ ID NO: 584668 - RNA, 24 nt, Human
caaagugcugggacuacaggcaug

SEQ ID NO: 584669 - RNA, 22 nt, Human
caaauuuucagacagaacacaa

SEQ ID NO: 584670 - RNA, 23 nt, Human
caaccuccgccuccgccuccgcc

SEQ ID NO: 584671 - RNA, 19 nt, Human
caacuaacuuuaguauuca

SEQ ID NO: 584672 - RNA, 22 nt, Human
caacuaacuuuaguauucacuc

SEQ ID NO: 584673 - RNA, 22 nt, Human
caagcaauucucuugccucagc

SEQ ID NO: 584674 - RNA, 21 nt, Human
caccauguuggccaggcuggu

SEQ ID NO: 584675 - RNA, 24 nt, Human
caccauguuggccaggcuggucuc

SEQ ID NO: 584676 - RNA, 27 nt, Human
caccauguuggccaggcuggucucgaa

SEQ ID NO: 584677 - RNA, 21 nt, Human
caccauguuggucaggcuggu

SEQ ID NO: 584678 - RNA, 22 nt, Human
caccauguuggucaggcugguc

SEQ ID NO: 584679 - RNA, 24 nt, Human
cacccaagcuggagugcagugaug

SEQ ID NO: 584680 - RNA, 21 nt, Human
cacugcaaccucugccucccg

SEQ ID NO: 584681 - RNA, 23 nt, Human
cacugcaaccucugccucccggg

SEQ ID NO: 584682 - RNA, 24 nt, Human
cacuucaggaccaccuuagguuca

SEQ ID NO: 584683 - RNA, 22 nt, Human
cagaagcaaaaacuugaucacc

SEQ ID NO: 584684 - RNA, 23 nt, Human
cagaagcaaaaacuugaucaccc

SEQ ID NO: 584685 - RNA, 22 nt, Human
cagagagaaaccaaaaucuauu

SEQ ID NO: 584686 - RNA, 20 nt, Human
caggagcuuuuccaacuaac

SEQ ID NO: 584687 - RNA, 24 nt, Human
caguagagacgagguuucaccaug

SEQ ID NO: 584688 - RNA, 26 nt, Human
caguagagacgagguuucaccauguu

SEQ ID NO: 584689 - RNA, 22 nt, Human
cauccccucaagccuucacuuc

SEQ ID NO: 584690 - RNA, 23 nt, Human
caugcaccaccaaaccuggcuaa

SEQ ID NO: 584691 - RNA, 24 nt, Human
caugucaccgcacccaacuaauuu

SEQ ID NO: 584692 - RNA, 24 nt, Human
cauguuggccaggcuggucucgaa

SEQ ID NO: 584693 - RNA, 24 nt, Human
cauguuggucaggcuggucccaaa

SEQ ID NO: 584694 - RNA, 19 nt, Human
ccaaagugcugggacuaca

SEQ ID NO: 584695 - RNA, 24 nt, Human
ccaaagugcugggacuacaggcau

SEQ ID NO: 584696 - RNA, 24 nt, Human
cccaaagugcugggacuacaggca

SEQ ID NO: 584697 - RNA, 18 nt, Human
cccagguuggagugcagu

SEQ ID NO: 584698 - RNA, 23 nt, Human
cccgaguagcugggauuacaggc

SEQ ID NO: 584699 - RNA, 24 nt, Human
cccgaguagcugggauuacaggca

SEQ ID NO: 584700 - RNA, 20 nt, Human
cccggguccaagcaauucuc

SEQ ID NO: 584701 - RNA, 23 nt, Human
ccgaguagcugggauuacaggca

SEQ ID NO: 584702 - RNA, 24 nt, Human
ccgaguagcugggauuacaggcau

SEQ ID NO: 584703 - RNA, 23 nt, Human
ccucccggguccaagcaauucuc

SEQ ID NO: 584704 - RNA, 23 nt, Human
ccuccgccuccgccuccgccaug

SEQ ID NO: 584705 - RNA, 20 nt, Human
ccugaccucaagugauccac

SEQ ID NO: 584706 - RNA, 20 nt, Human
ccugaccucaagugauccac

SEQ ID NO: 584707 - RNA, 22 nt, Human
ccugaguaggugggauuacagg

SEQ ID NO: 584708 - RNA, 23 nt, Human
ccugaguaggugggauuacaggu

SEQ ID NO: 584709 - RNA, 24 nt, Human
ccugccucagucucccaaagugcu

SEQ ID NO: 584710 - RNA, 24 nt, Human
cgagguuucaccauguuggccagg

SEQ ID NO: 584711 - RNA, 20 nt, Human
cuaauuuuuguauuuuuagg

SEQ ID NO: 584712 - RNA, 24 nt, Human
cucacugcaaccucugccucccgg

SEQ ID NO: 584713 - RNA, 24 nt, Human
cuccugaccuugugauccgccugc

SEQ ID NO: 584714 - RNA, 24 nt, Human
cucggucucccgaguagcugggau

SEQ ID NO: 584715 - RNA, 20 nt, Human
cucugucacccaagcuggag

SEQ ID NO: 584716 - RNA, 23 nt, Human
cugaguaggugggauuacaggug

SEQ ID NO: 584717 - RNA, 19 nt, Human
cugcaaccucugccucccg

SEQ ID NO: 584718 - RNA, 23 nt, Human
cugcaaccucugccucccggguc

SEQ ID NO: 584719 - RNA, 24 nt, Human
cugccucagucucccaaagugcug

SEQ ID NO: 584720 - RNA, 18 nt, Human
cugucacccaagcuggag

SEQ ID NO: 584721 - RNA, 20 nt, Human
gaccaccuuagguucauucc

SEQ ID NO: 584722 - RNA, 24 nt, Human
gaccucaagugauccacucgccuc

SEQ ID NO: 584723 - RNA, 24 nt, Human
gaccuugugauccgccugccucag

SEQ ID NO: 584724 - RNA, 21 nt, Human
gacuacaggcaugagccacca

SEQ ID NO: 584725 - RNA, 19 nt, Human
gaggcauccccucaagccu

SEQ ID NO: 584726 - RNA, 23 nt, Human
gagguuucaccauguuggccagg

SEQ ID NO: 584727 - RNA, 21 nt, Human
gccaugagagguucaagugac

SEQ ID NO: 584728 - RNA, 19 nt, Human
gcccagguuggagugcagu

SEQ ID NO: 584729 - RNA, 23 nt, Human
gccucagccucacaaagugcugg

SEQ ID NO: 584730 - RNA, 24 nt, Human
gccucagucucccaaagugcuggg

SEQ ID NO: 584731 - RNA, 25 nt, Human
gcucugucacccaagcuggagugca

SEQ ID NO: 584732 - RNA, 23 nt, Human
gcuggucucgaacuccugaccuc

SEQ ID NO: 584733 - RNA, 19 nt, Human
ggacuacaggcaugagcca

SEQ ID NO: 584734 - RNA, 18 nt, Human
ggagcuuuuccaacuaac

SEQ ID NO: 584735 - RNA, 23 nt, Human
ggcuggucccaaacuccugaccu

SEQ ID NO: 584736 - RNA, 24 nt, Human
ggcuggucucgaacuccugaccuc

SEQ ID NO: 584737 - RNA, 20 nt, Human
ggucccaaacuccugaccuu

SEQ ID NO: 584738 - RNA, 19 nt, Human
ggucucgaacuccugaccu

SEQ ID NO: 584739 - RNA, 18 nt, Human
guagcugggauuacaggc

SEQ ID NO: 584740 - RNA, 20 nt, Human
guagcugggauuacaggcau

SEQ ID NO: 584741 - RNA, 24 nt, Human
guauauuucaccauguuggucagg

SEQ ID NO: 584742 - RNA, 22 nt, Human
gugauccacucgccucagccuc

SEQ ID NO: 584743 - RNA, 18 nt, Human
gugauccgccugccucag

SEQ ID NO: 584744 - RNA, 18 nt, Human
uaaaaacuaucauacuaa

SEQ ID NO: 584745 - RNA, 24 nt, Human
uaacuuuaguauucacuccaagau

SEQ ID NO: 584746 - RNA, 26 nt, Human
uaagaaagggaaaaaauggagacaaa

SEQ ID NO: 584747 - RNA, 22 nt, Human
uacaaguauaaagugucauacc

SEQ ID NO: 584748 - RNA, 22 nt, Human
uacaggcaugagccaccacgcc

SEQ ID NO: 584749 - RNA, 22 nt, Human
uacaggugugagccacuacucc

SEQ ID NO: 584750 - RNA, 23 nt, Human
uacaggugugagccacuacuccu

SEQ ID NO: 584751 - RNA, 21 nt, Human
uacuguauuauguaaauguug

SEQ ID NO: 584752 - RNA, 22 nt, Human
uacuuuuacauuucauuuagca

SEQ ID NO: 584753 - RNA, 21 nt, Human
uagaaaaccuaacuagagaaa

SEQ ID NO: 584754 - RNA, 22 nt, Human
uagagacgagguuucaccaugu

SEQ ID NO: 584755 - RNA, 24 nt, Human
uagcauguggagcaauuuuguuuc

SEQ ID NO: 584756 - RNA, 21 nt, Human
uauccauaaaaggcaauuauc

SEQ ID NO: 584757 - RNA, 22 nt, Human
uauucagaagcaaaaacuugau

SEQ ID NO: 584758 - RNA, 24 nt, Human
ucaaaguaagcaagguugucaauc

SEQ ID NO: 584759 - RNA, 24 nt, Human
ucacaaagugcuggaauuacaggu

SEQ ID NO: 584760 - RNA, 20 nt, Human
ucacugcaaccuccgccucc

SEQ ID NO: 584761 - RNA, 21 nt, Human
ucacugcaaccuccgccuccg

SEQ ID NO: 584762 - RNA, 22 nt, Human
ucacugcaaccuccgccuccgc

SEQ ID NO: 584763 - RNA, 25 nt, Human
ucacugcaaccuccgccuccgccuc

SEQ ID NO: 584764 - RNA, 24 nt, Human
ucacugcaaccucugccucccggg

SEQ ID NO: 584765 - RNA, 25 nt, Human
ucacugcaaccucugccucccgggu

SEQ ID NO: 584766 - RNA, 23 nt, Human
ucagggacucaaguccccaagug

SEQ ID NO: 584767 - RNA, 24 nt, Human
ucaguagagacgagguuucaccau

SEQ ID NO: 584768 - RNA, 25 nt, Human
ucauuaguaauaauacacuuucaaa

SEQ ID NO: 584769 - RNA, 24 nt, Human
ucauuucaguguuuacacaggaag

SEQ ID NO: 584770 - RNA, 24 nt, Human
ucccaaagugcugggacuacaggc

SEQ ID NO: 584771 - RNA, 24 nt, Human
ucccgaguagcugggauuacaggc

SEQ ID NO: 584772 - RNA, 21 nt, Human
ucccggguccaagcaauucuc

SEQ ID NO: 584773 - RNA, 21 nt, Human
ucccggguccaagcaauucuc

SEQ ID NO: 584774 - RNA, 24 nt, Human
uccugaguaggugggauuacaggu

SEQ ID NO: 584775 - RNA, 21 nt, Human
ucucgaacuccugaccucaag

SEQ ID NO: 584776 - RNA, 24 nt, Human
ucucuuguccuuucauuucuguga

SEQ ID NO: 584777 - RNA, 24 nt, Human
ucugccucccggguccaagcaauu

SEQ ID NO: 584778 - RNA, 24 nt, Human
ucugucacccaagcuggagugcag

SEQ ID NO: 584779 - RNA, 23 nt, Human
ucuuacucuguugcccagguugg

SEQ ID NO: 584780 - RNA, 24 nt, Human
ucuuacucuguugcccagguugga

SEQ ID NO: 584781 - RNA, 24 nt, Human
ucuugcucugucacccaagcugga

SEQ ID NO: 584782 - RNA, 20 nt, Human
ucuugucaacucucuugucc

SEQ ID NO: 584783 - RNA, 22 nt, Human
ugaaauagaaaaccuaacuaga

SEQ ID NO: 584784 - RNA, 23 nt, Human
ugaauauuggucagccauguaga

SEQ ID NO: 584785 - RNA, 19 nt, Human
ugaauguaccagaaagaau

SEQ ID NO: 584786 - RNA, 19 nt, Human
ugaauguagaaaaaaaauc

SEQ ID NO: 584787 - RNA, 20 nt, Human
ugaccucaagugauccacuc

SEQ ID NO: 584788 - RNA, 24 nt, Human
ugaccucaagugauccacucgccu

SEQ ID NO: 584789 - RNA, 20 nt, Human
ugauaaaugaucaauucuac

SEQ ID NO: 584790 - RNA, 22 nt, Human
ugcagugaugcaaucuuggcuc

SEQ ID NO: 584791 - RNA, 18 nt, Human
ugcccagguuggagugca

SEQ ID NO: 584792 - RNA, 20 nt, Human
ugcccagguuggagugcagu

SEQ ID NO: 584793 - RNA, 23 nt, Human
ugcccagguuggagugcaguugc

SEQ ID NO: 584794 - RNA, 20 nt, Human
ugccucagccuccugaguag

SEQ ID NO: 584795 - RNA, 24 nt, Human
ugccucagccuccugaguaggugg

SEQ ID NO: 584796 - RNA, 24 nt, Human
ugccucagucucccaaagugcugg

SEQ ID NO: 584797 - RNA, 22 nt, Human
ugccucggucucccgaguagcu

SEQ ID NO: 584798 - RNA, 24 nt, Human
ugcuggaauuacaggugugagcca

SEQ ID NO: 584799 - RNA, 25 nt, Human
ugcuuugcccuacaccaaucugaaa

SEQ ID NO: 584800 - RNA, 18 nt, Human
uggaaccagagagaaacc

SEQ ID NO: 584801 - RNA, 18 nt, Human
uggaauuacaggugugag

SEQ ID NO: 584802 - RNA, 19 nt, Human
uggaauuacaggugugagc

SEQ ID NO: 584803 - RNA, 21 nt, Human
uggaauuacaggugugagcca

SEQ ID NO: 584804 - RNA, 22 nt, Human
uggaauuacaggugugagccac

SEQ ID NO: 584805 - RNA, 22 nt, Human
uggaauuacaggugugagccac

SEQ ID NO: 584806 - RNA, 24 nt, Human
uggaauuacaggugugagccacua

SEQ ID NO: 584807 - RNA, 23 nt, Human
uggagugcagugaugcaaucuug

SEQ ID NO: 584808 - RNA, 24 nt, Human
uggagugcagugaugcaaucuugg

SEQ ID NO: 584809 - RNA, 20 nt, Human
uggagugcaguugcacgauc

SEQ ID NO: 584810 - RNA, 23 nt, Human
uggagugcaguugcacgaucucg

SEQ ID NO: 584811 - RNA, 24 nt, Human
uggagugcaguugcacgaucucgg

SEQ ID NO: 584812 - RNA, 24 nt, Human
uggccaggcuggucucgaacuccu

SEQ ID NO: 584813 - RNA, 18 nt, Human
ugggacuacaggcaugag

SEQ ID NO: 584814 - RNA, 22 nt, Human
ugggacuacaggcaugagccac

SEQ ID NO: 584815 - RNA, 24 nt, Human
ugggacuacaggcaugagccacca

SEQ ID NO: 584816 - RNA, 24 nt, Human
ugggacuacaggcaugagccacca

SEQ ID NO: 584817 - RNA, 21 nt, Human
ugggauuacaggcaugcacca

SEQ ID NO: 584818 - RNA, 24 nt, Human
ugggauuacaggcaugcaccacca

SEQ ID NO: 584819 - RNA, 21 nt, Human
ugggauuacaggugcauguca

SEQ ID NO: 584820 - RNA, 22 nt, Human
ugggauuacaggugcaugucac

SEQ ID NO: 584821 - RNA, 23 nt, Human
ugggauuacaggugcaugucacc

SEQ ID NO: 584822 - RNA, 24 nt, Human
ugggauuacaggugcaugucaccg

SEQ ID NO: 584823 - RNA, 24 nt, Human
uggucaggcuggucccaaacuccu

SEQ ID NO: 584824 - RNA, 18 nt, Human
uguaaaacaccugaaaua

SEQ ID NO: 584825 - RNA, 24 nt, Human
uguauauuucaccauguuggucag

SEQ ID NO: 584826 - RNA, 18 nt, Human
ugucacagaucccuugga

SEQ ID NO: 584827 - RNA, 21 nt, Human
ugucacccaagcuggagugca

SEQ ID NO: 584828 - RNA, 24 nt, Human
ugugauccgccugccucagucucc

SEQ ID NO: 584829 - RNA, 21 nt, Human
uguguaaaacaccugaaauaa

SEQ ID NO: 584830 - RNA, 21 nt, Human
ugugucaaucaacuguuucug

SEQ ID NO: 584831 - RNA, 19 nt, Human
uguguguguucacauaugu

SEQ ID NO: 584832 - RNA, 21 nt, Human
uguugcccagguuggagugca

SEQ ID NO: 584833 - RNA, 23 nt, Human
uucaagugacucucaugccucgg

SEQ ID NO: 584834 - RNA, 22 nt, Human
uucaguguuuacacaggaagaa

SEQ ID NO: 584835 - RNA, 20 nt, Human
uugcuucuuccuguguaucc

SEQ ID NO: 584836 - RNA, 25 nt, Human
uuggaaagguucugcucuaaauuaa

SEQ ID NO: 584837 - RNA, 21 nt, Human
uuguuggauuugaagcuaugu

SEQ ID NO: 584838 - RNA, 24 nt, Human
uuucaccauguuggccaggcuggu

SEQ ID NO: 584839 - RNA, 24 nt, Human
uuucaccauguuggucaggcuggu

SEQ ID NO: 584840 - RNA, 24 nt, Human
uuuguauuuuuguauauuucacca

SEQ ID NO: 584841 - RNA, 24 nt, Human
uuuucaguagagacgagguuucac

SEQ ID NO: 584842 - RNA, 21 nt, Human
uuuuccuaccuguaggcaccu

SEQ ID NO: 584843 - RNA, 18 nt, Human
uuuuuuuuuuuuuuuuug

SEQ ID NO: 584844 - RNA, 22 nt, Human
uuuuuuuuuuuuuuuuugacag

SEQ ID NO: 584845 - RNA, 24 nt, Human
aaaguguugggauuauaggcauga

SEQ ID NO: 584846 - RNA, 18 nt, Human
aagcaggcuggacucacg

SEQ ID NO: 584847 - RNA, 21 nt, Human
aaguguugggauuauaggcau

SEQ ID NO: 584848 - RNA, 21 nt, Human
aauagcugggauuacaggcau

SEQ ID NO: 584849 - RNA, 21 nt, Human
aauggcaccaucucagcucac

SEQ ID NO: 584850 - RNA, 24 nt, Human
aauuuuguauuuuuaguagagaug

SEQ ID NO: 584851 - RNA, 21 nt, Human
acccaaccucccugcccccaa

SEQ ID NO: 584852 - RNA, 18 nt, Human
agccucccgaauagcugg

SEQ ID NO: 584853 - RNA, 18 nt, Human
aggauaucucuucuccgg

SEQ ID NO: 584854 - RNA, 19 nt, Human
aggcaggaggaggcugagu

SEQ ID NO: 584855 - RNA, 20 nt, Human
aggcaugagccaccaugccc

SEQ ID NO: 584856 - RNA, 21 nt, Human
aggcaugagccaccaugcccg

SEQ ID NO: 584857 - RNA, 22 nt, Human
aggcaugcaagcuugccccauu

SEQ ID NO: 584858 - RNA, 24 nt, Human
aggugauccgccugccucggccuu

SEQ ID NO: 584859 - RNA, 21 nt, Human
aguagagaugggguucuccau

SEQ ID NO: 584860 - RNA, 18 nt, Human
auagcugggauuacaggc

SEQ ID NO: 584861 - RNA, 19 nt, Human
aucagcccacccaaccucc

SEQ ID NO: 584862 - RNA, 24 nt, Human
auuacaccauguggauuccugacu

SEQ ID NO: 584863 - RNA, 24 nt, Human
caaaguguugggauuauaggcaug

SEQ ID NO: 584864 - RNA, 23 nt, Human
caaccuccaucuccuggguucaa

SEQ ID NO: 584865 - RNA, 22 nt, Human
caagcaauucuccugccucagc

SEQ ID NO: 584866 - RNA, 18 nt, Human
cacccaaccucccugccc

SEQ ID NO: 584867 - RNA, 19 nt, Human
cacccaaccucccugcccc

SEQ ID NO: 584868 - RNA, 21 nt, Human
cacccaaccucccugccccca

SEQ ID NO: 584869 - RNA, 22 nt, Human
cacccaaccucccugcccccaa

SEQ ID NO: 584870 - RNA, 22 nt, Human
caccuccagcaaccccucugcu

SEQ ID NO: 584871 - RNA, 21 nt, Human
cacuuucuucccugugucccc

SEQ ID NO: 584872 - RNA, 19 nt, Human
cagcagguaguagaugcag

SEQ ID NO: 584873 - RNA, 20 nt, Human
caggcaggaggaggcugagu

SEQ ID NO: 584874 - RNA, 22 nt, Human
caggcuggacucacgcauugag

SEQ ID NO: 584875 - RNA, 22 nt, Human
caggugauccgccugccucggc

SEQ ID NO: 584876 - RNA, 21 nt, Human
cagugaagcccugugagguuc

SEQ ID NO: 584877 - RNA, 21 nt, Human
cauguggauuccugacugcuu

SEQ ID NO: 584878 - RNA, 22 nt, Human
ccaaaguguugggauuauaggc

SEQ ID NO: 584879 - RNA, 24 nt, Human
ccaaaguguugggauuauaggcau

SEQ ID NO: 584880 - RNA, 21 nt, Human
ccaaccucccugcccccaaaa

SEQ ID NO: 584881 - RNA, 24 nt, Human
ccaccaugcccggcuaaagcccag

SEQ ID NO: 584882 - RNA, 18 nt, Human
ccacccaaccucccugcc

SEQ ID NO: 584883 - RNA, 24 nt, Human
ccacccaaccucccugcccccaaa

SEQ ID NO: 584884 - RNA, 19 nt, Human
ccauguggauuccugacug

SEQ ID NO: 584885 - RNA, 22 nt, Human
cccaacacucaagaccuuaccu

SEQ ID NO: 584886 - RNA, 19 nt, Human
cccacccaaccucccugcc

SEQ ID NO: 584887 - RNA, 20 nt, Human
ccccaggaaugcucacaccc

SEQ ID NO: 584888 - RNA, 23 nt, Human
cccgaauagcugggauuacaggc

SEQ ID NO: 584889 - RNA, 24 nt, Human
cccgaauagcugggauuacaggca

SEQ ID NO: 584890 - RNA, 19 nt, Human
cccgugccugugcccgaag

SEQ ID NO: 584891 - RNA, 24 nt, Human
ccgaauagcugggauuacaggcau

SEQ ID NO: 584892 - RNA, 18 nt, Human
ccgcaaccuccaucuccu

SEQ ID NO: 584893 - RNA, 23 nt, Human
ccgcaaccuccaucuccuggguu

SEQ ID NO: 584894 - RNA, 24 nt, Human
ccgcaaccuccaucuccuggguuc

SEQ ID NO: 584895 - RNA, 23 nt, Human
ccucccuccugaagcaggcugga

SEQ ID NO: 584896 - RNA, 20 nt, Human
ccuccugaagcaggcuggac

SEQ ID NO: 584897 - RNA, 24 nt, Human
ccuccugaagcaggcuggacucac

SEQ ID NO: 584898 - RNA, 18 nt, Human
ccugaccucaggugaucc

SEQ ID NO: 584899 - RNA, 21 nt, Human
ccugaccucaggugauccgcc

SEQ ID NO: 584900 - RNA, 23 nt, Human
ccugaccucaggugauccgccug

SEQ ID NO: 584901 - RNA, 23 nt, Human
ccuggguucaagcaauucuccug

SEQ ID NO: 584902 - RNA, 28 nt, Human
ccugugcccgaagccucccuccugaagc

SEQ ID NO: 584903 - RNA, 21 nt, Human
ccuguggaugacgaggugcag

SEQ ID NO: 584904 - RNA, 23 nt, Human
cgguggggauuucccugaggcuc

SEQ ID NO: 584905 - RNA, 25 nt, Human
cuaaagcccagucucuuuauuacac

SEQ ID NO: 584906 - RNA, 28 nt, Human
cuaaagcccagucucuuuauuacaccau

SEQ ID NO: 584907 - RNA, 24 nt, Human
cuaauuuuguauuuuuaguagaga

SEQ ID NO: 584908 - RNA, 20 nt, Human
cuccagcaaccccucugcuu

SEQ ID NO: 584909 - RNA, 24 nt, Human
cucccgaauagcugggauuacagg

SEQ ID NO: 584910 - RNA, 26 nt, Human
cuccugaccucaggugauccgccugc

SEQ ID NO: 584911 - RNA, 21 nt, Human
cuccuggguucaagcaauucu

SEQ ID NO: 584912 - RNA, 20 nt, Human
cucgcucuuguugcccgggc

SEQ ID NO: 584913 - RNA, 23 nt, Human
cugccucagccucccgaauagcu

SEQ ID NO: 584914 - RNA, 19 nt, Human
cugugagguucagagcagg

SEQ ID NO: 584915 - RNA, 20 nt, Human
cugugcccgugccugugccc

SEQ ID NO: 584916 - RNA, 21 nt, Human
cuuuaugugggacccaauccu

SEQ ID NO: 584917 - RNA, 22 nt, Human
gaaacuuguacuccucuaccag

SEQ ID NO: 584918 - RNA, 24 nt, Human
gaauagcugggauuacaggcaugc

SEQ ID NO: 584919 - RNA, 24 nt, Human
gaccucaggugauccgccugccuc

SEQ ID NO: 584920 - RNA, 23 nt, Human
gagaugggguucuccauguuggu

SEQ ID NO: 584921 - RNA, 23 nt, Human
gagugggacugaggucccagggu

SEQ ID NO: 584922 - RNA, 18 nt, Human
gauuacaggcaugcgcca

SEQ ID NO: 584923 - RNA, 24 nt, Human
gauuacaggcaugcgccaccaugc

SEQ ID NO: 584924 - RNA, 21 nt, Human
gauuauaggcaugagccacca

SEQ ID NO: 584925 - RNA, 24 nt, Human
gauuauaggcaugagccaccaugc

SEQ ID NO: 584926 - RNA, 21 nt, Human
gcccccaaaaugguccuucca

SEQ ID NO: 584927 - RNA, 18 nt, Human
gcccgaagccucccuccu

SEQ ID NO: 584928 - RNA, 20 nt, Human
gcugaagugcaauggcacca

SEQ ID NO: 584929 - RNA, 23 nt, Human
gcugguguugaacuccugaccuc

SEQ ID NO: 584930 - RNA, 21 nt, Human
ggaaacuuguacuccucuacc

SEQ ID NO: 584931 - RNA, 23 nt, Human
ggaaacuuguacuccucuaccag

SEQ ID NO: 584932 - RNA, 22 nt, Human
ggaggcugagugggacugaggu

SEQ ID NO: 584933 - RNA, 24 nt, Human
ggaggcugagugggacugaggucc

SEQ ID NO: 584934 - RNA, 24 nt, Human
ggauuacaggcaugcgccaccaug

SEQ ID NO: 584935 - RNA, 24 nt, Human
ggauuauaggcaugagccaccaug

SEQ ID NO: 584936 - RNA, 26 nt, Human
ggcgaaguggauggcagugaagggac

SEQ ID NO: 584937 - RNA, 20 nt, Human
gguguugaacuccugaccuc

SEQ ID NO: 584938 - RNA, 25 nt, Human
gucccaggguccacaauuuauauaa

SEQ ID NO: 584939 - RNA, 24 nt, Human
uagaugcaggggagggccacggug

SEQ ID NO: 584940 - RNA, 23 nt, Human
uaguagagaugggguucuccaug

SEQ ID NO: 584941 - RNA, 19 nt, Human
ucaagcaauucuccugccu

SEQ ID NO: 584942 - RNA, 24 nt, Human
ucaccgcaaccuccaucuccuggg

SEQ ID NO: 584943 - RNA, 27 nt, Human
ucaccgcaaccuccaucuccuggguuc

SEQ ID NO: 584944 - RNA, 21 nt, Human
ucacgcauugaggucugcgcc

SEQ ID NO: 584945 - RNA, 23 nt, Human
ucagcccacccaaccucccugcc

SEQ ID NO: 584946 - RNA, 20 nt, Human
ucagccucccgaauagcugg

SEQ ID NO: 584947 - RNA, 21 nt, Human
ucaggugauccgccugccucg

SEQ ID NO: 584948 - RNA, 23 nt, Human
uccaaaguguugggauuauaggc

SEQ ID NO: 584949 - RNA, 24 nt, Human
ucccgaauagcugggauuacaggc

SEQ ID NO: 584950 - RNA, 23 nt, Human
ucccuguguccccaggaaugcuc

SEQ ID NO: 584951 - RNA, 21 nt, Human
uccuggguucaagcaauucuc

SEQ ID NO: 584952 - RNA, 24 nt, Human
uccuggguucaagcaauucuccug

SEQ ID NO: 584953 - RNA, 20 nt, Human
uccuugucaccuccagcaac

SEQ ID NO: 584954 - RNA, 18 nt, Human
ucuccgggugaccacucc

SEQ ID NO: 584955 - RNA, 20 nt, Human
ucuccgggugaccacuccga

SEQ ID NO: 584956 - RNA, 26 nt, Human
ucuccugccucagccucccgaauagc

SEQ ID NO: 584957 - RNA, 24 nt, Human
ucuccuggguucaagcaauucucc

SEQ ID NO: 584958 - RNA, 19 nt, Human
ucucgcucuuguugcccgg

SEQ ID NO: 584959 - RNA, 20 nt, Human
ucucgcucuuguugcccggg

SEQ ID NO: 584960 - RNA, 24 nt, Human
ucucgcucuuguugcccgggcuga

SEQ ID NO: 584961 - RNA, 25 nt, Human
ucucgcucuuguugcccgggcugaa

SEQ ID NO: 584962 - RNA, 21 nt, Human
ugaagcccugugagguucaga

SEQ ID NO: 584963 - RNA, 19 nt, Human
ugaccacuccgagcagcgu

SEQ ID NO: 584964 - RNA, 18 nt, Human
ugaccucaggugauccgc

SEQ ID NO: 584965 - RNA, 24 nt, Human
ugaccucaggugauccgccugccu

SEQ ID NO: 584966 - RNA, 18 nt, Human
ugagugggacugaggucc

SEQ ID NO: 584967 - RNA, 23 nt, Human
ugcccgaagccucccuccugaag

SEQ ID NO: 584968 - RNA, 23 nt, Human
ugcccgggcugaagugcaauggc

SEQ ID NO: 584969 - RNA, 24 nt, Human
ugcccgggcugaagugcaauggca

SEQ ID NO: 584970 - RNA, 27 nt, Human
ugccucagccucccgaauagcugggau

SEQ ID NO: 584971 - RNA, 24 nt, Human
uggcaccaucucagcucaccgcaa

SEQ ID NO: 584972 - RNA, 18 nt, Human
ugggauuacaggcaugcg

SEQ ID NO: 584973 - RNA, 21 nt, Human
ugggauuacaggcaugcgcca

SEQ ID NO: 584974 - RNA, 22 nt, Human
ugggauuacaggcaugcgccac

SEQ ID NO: 584975 - RNA, 24 nt, Human
ugggauuacaggcaugcgccacca

SEQ ID NO: 584976 - RNA, 18 nt, Human
ugggauuauaggcaugag

SEQ ID NO: 584977 - RNA, 22 nt, Human
ugggauuauaggcaugagccac

SEQ ID NO: 584978 - RNA, 23 nt, Human
ugggauuauaggcaugagccacc

SEQ ID NO: 584979 - RNA, 24 nt, Human
ugggauuauaggcaugagccacca

SEQ ID NO: 584980 - RNA, 25 nt, Human
ugggauuauaggcaugagccaccau

SEQ ID NO: 584981 - RNA, 21 nt, Human
uggguucaagcaauucuccug

SEQ ID NO: 584982 - RNA, 23 nt, Human
uggguucaagcaauucuccugcc

SEQ ID NO: 584983 - RNA, 24 nt, Human
uggucaugcugguguugaacuccu

SEQ ID NO: 584984 - RNA, 22 nt, Human
uguacuccucuaccaggaccug

SEQ ID NO: 584985 - RNA, 21 nt, Human
uguauuuuuaguagagauggg

SEQ ID NO: 584986 - RNA, 22 nt, Human
ugugcccgaagccucccuccug

SEQ ID NO: 584987 - RNA, 18 nt, Human
uuaguagagaugggguuc

SEQ ID NO: 584988 - RNA, 23 nt, Human
uuaguagagaugggguucuccau

SEQ ID NO: 584989 - RNA, 21 nt, Human
uucaagcaauucuccugccuc

SEQ ID NO: 584990 - RNA, 24 nt, Human
uucaagcaauucuccugccucagc

SEQ ID NO: 584991 - RNA, 21 nt, Human
uuccacagccagaagaugagu

SEQ ID NO: 584992 - RNA, 18 nt, Human
uugcccgggcugaagugc

SEQ ID NO: 584993 - RNA, 23 nt, Human
uugccugccuggaaguagggcug

SEQ ID NO: 584994 - RNA, 21 nt, Human
uugggauuauaggcaugagcc

SEQ ID NO: 584995 - RNA, 23 nt, Human
uuguauuuuuaguagagaugggg

SEQ ID NO: 584996 - RNA, 23 nt, Human
uuguugcccgggcugaagugcaa

SEQ ID NO: 584997 - RNA, 24 nt, Human
uuucuccagcagguaguagaugca

SEQ ID NO: 584998 - RNA, 19 nt, Human
uuuuguauuuuuaguagag

SEQ ID NO: 584999 - RNA, 20 nt, Human
uuuuguauuuuuaguagaga

SEQ ID NO: 585000 - RNA, 19 nt, Human
uuuuuaguagagauggggu

SEQ ID NO: 585001 - RNA, 20 nt, Human
aacccaguuuuagccaaugg

SEQ ID NO: 585002 - RNA, 18 nt, Human
aagauacggcaucaggug

SEQ ID NO: 585003 - RNA, 23 nt, Human
accugccucugcagcuggagagc

SEQ ID NO: 585004 - RNA, 22 nt, Human
acucuggggaagagauuugggg

SEQ ID NO: 585005 - RNA, 23 nt, Human
acucuggggaagagauuuggggu

SEQ ID NO: 585006 - RNA, 24 nt, Human
acuuuauuuuaccuccauuuagca

SEQ ID NO: 585007 - RNA, 24 nt, Human
agaccagguaucccaaagguuggg

SEQ ID NO: 585008 - RNA, 20 nt, Human
agcaggcaugccagugggag

SEQ ID NO: 585009 - RNA, 23 nt, Human
aggaaggagacagugcugggagg

SEQ ID NO: 585010 - RNA, 25 nt, Human
aggaaggagacagugcugggagggg

SEQ ID NO: 585011 - RNA, 19 nt, Human
aggagcaggggcuccaagc

SEQ ID NO: 585012 - RNA, 23 nt, Human
aggugcugcaaugggaggcucug

SEQ ID NO: 585013 - RNA, 19 nt, Human
auguggacucugguggcag

SEQ ID NO: 585014 - RNA, 30 nt, Human
caauggaucuuucucucuaaugacagucuu

SEQ ID NO: 585015 - RNA, 24 nt, Human
cacaccugccucugcagcuggaga

SEQ ID NO: 585016 - RNA, 19 nt, Human
cagaccagcugucaguggu

SEQ ID NO: 585017 - RNA, 21 nt, Human
cagaccagcugucagugguug

SEQ ID NO: 585018 - RNA, 21 nt, Human
cagcuagggcacaggcaugga

SEQ ID NO: 585019 - RNA, 19 nt, Human
cagcugucagugguugggc

SEQ ID NO: 585020 - RNA, 26 nt, Human
caggaggaagugcuagauacucagau

SEQ ID NO: 585021 - RNA, 18 nt, Human
caggcugagcagggugcc

SEQ ID NO: 585022 - RNA, 22 nt, Human
cagucagaaagugggcaucucu

SEQ ID NO: 585023 - RNA, 21 nt, Human
caucucugcccugagggcagg

SEQ ID NO: 585024 - RNA, 23 nt, Human
caucucugcccugagggcagggg

SEQ ID NO: 585025 - RNA, 20 nt, Human
ccagggcucugcuuccagag

SEQ ID NO: 585026 - RNA, 20 nt, Human
cccagcaucuucagguucau

SEQ ID NO: 585027 - RNA, 23 nt, Human
ccccaugacgcaguucaggagga

SEQ ID NO: 585028 - RNA, 18 nt, Human
cccuucccuccuuucuuu

SEQ ID NO: 585029 - RNA, 24 nt, Human
ccgaggaagggguggcugccaggu

SEQ ID NO: 585030 - RNA, 24 nt, Human
ccgggccagcagugucuuggccuc

SEQ ID NO: 585031 - RNA, 18 nt, Human
ccuacagaccagguaucc

SEQ ID NO: 585032 - RNA, 25 nt, Human
ccuccacggagcggaacagcugcuc

SEQ ID NO: 585033 - RNA, 21 nt, Human
ccuccuccaccuccuccucgu

SEQ ID NO: 585034 - RNA, 25 nt, Human
ccucggcugccggcgucuucuucuc

SEQ ID NO: 585035 - RNA, 23 nt, Human
ccucuccuccuccaccuccuccu

SEQ ID NO: 585036 - RNA, 19 nt, Human
ccugcaaccccaugacgca

SEQ ID NO: 585037 - RNA, 24 nt, Human
ccugccaccucuccuccuccaccu

SEQ ID NO: 585038 - RNA, 18 nt, Human
ccuggggccccccucugg

SEQ ID NO: 585039 - RNA, 18 nt, Human
cuagucaucaacauuucc

SEQ ID NO: 585040 - RNA, 25 nt, Human
cucaaggcaaaaucuucugcaacgg

SEQ ID NO: 585041 - RNA, 25 nt, Human
cuccgccgucuggucaucacaccug

SEQ ID NO: 585042 - RNA, 21 nt, Human
cuccuccuccaccuccuccuc

SEQ ID NO: 585043 - RNA, 26 nt, Human
cucgggcuuaaccuuggaaggagcca

SEQ ID NO: 585044 - RNA, 21 nt, Human
cucugggcucgggcuuaaccu

SEQ ID NO: 585045 - RNA, 23 nt, Human
cugacugccaggcucccucugga

SEQ ID NO: 585046 - RNA, 20 nt, Human
cuggucccagcaucuucagg

SEQ ID NO: 585047 - RNA, 19 nt, Human
cuucccuccuuucuuuacc

SEQ ID NO: 585048 - RNA, 18 nt, Human
cuuggccucggcugccgg

SEQ ID NO: 585049 - RNA, 19 nt, Human
gaacccaguuuuagccaau

SEQ ID NO: 585050 - RNA, 23 nt, Human
gaaggagccagcagagacucaag

SEQ ID NO: 585051 - RNA, 18 nt, Human
gaauucccucagccuuuc

SEQ ID NO: 585052 - RNA, 19 nt, Human
gacagugcugggaggggag

SEQ ID NO: 585053 - RNA, 20 nt, Human
gaggagcccgaggaaggggu

SEQ ID NO: 585054 - RNA, 20 nt, Human
gcaggaaugcaggggcugcg

SEQ ID NO: 585055 - RNA, 20 nt, Human
gcuagggcacaggcauggaa

SEQ ID NO: 585056 - RNA, 23 nt, Human
ggaaggagacagugcugggaggg

SEQ ID NO: 585057 - RNA, 20 nt, Human
ggaauucccucagccuuucc

SEQ ID NO: 585058 - RNA, 22 nt, Human
ggagauccugaaacucugggga

SEQ ID NO: 585059 - RNA, 18 nt, Human
ggagcggaacagcugcuc

SEQ ID NO: 585060 - RNA, 22 nt, Human
gggaauccucugaccugcagcc

SEQ ID NO: 585061 - RNA, 18 nt, Human
gggguugggagcugggaa

SEQ ID NO: 585062 - RNA, 19 nt, Human
gucagacucagucagaaag

SEQ ID NO: 585063 - RNA, 19 nt, Human
gucuucuucuccuccugcc

SEQ ID NO: 585064 - RNA, 22 nt, Human
uaaauccuaccuguccucuaga

SEQ ID NO: 585065 - RNA, 21 nt, Human
uacaggacucuuccauucccc

SEQ ID NO: 585066 - RNA, 20 nt, Human
uaccuguccucuagagcugg

SEQ ID NO: 585067 - RNA, 23 nt, Human
uaccuuagauucuaugcccuucc

SEQ ID NO: 585068 - RNA, 22 nt, Human
uaucuuggccuacuccuuccug

SEQ ID NO: 585069 - RNA, 22 nt, Human
uaugaacacccauugucacccu

SEQ ID NO: 585070 - RNA, 19 nt, Human
ucagccuuuccuagucauc

SEQ ID NO: 585071 - RNA, 19 nt, Human
ucagcuucccacaguccag

SEQ ID NO: 585072 - RNA, 21 nt, Human
ucccaaagguugggcccaguc

SEQ ID NO: 585073 - RNA, 21 nt, Human
ucccagcaucuucagguucau

SEQ ID NO: 585074 - RNA, 19 nt, Human
ucccuccuuucuuuaccug

SEQ ID NO: 585075 - RNA, 19 nt, Human
uccuccuccaccuccuccu

SEQ ID NO: 585076 - RNA, 24 nt, Human
uccuccuccaccuccuccucguca

SEQ ID NO: 585077 - RNA, 22 nt, Human
uccuccugccaccucuccuccu

SEQ ID NO: 585078 - RNA, 22 nt, Human
uccugccaccucuccuccucca

SEQ ID NO: 585079 - RNA, 19 nt, Human
uccuuggaauucccucagc

SEQ ID NO: 585080 - RNA, 19 nt, Human
ucuaugaacacccauuguc

SEQ ID NO: 585081 - RNA, 24 nt, Human
ucuaugcccuucccuccuuucuuu

SEQ ID NO: 585082 - RNA, 26 nt, Human
ucucuggucccagcaucuucagguuc

SEQ ID NO: 585083 - RNA, 18 nt, Human
ucuuccauuccccacugu

SEQ ID NO: 585084 - RNA, 23 nt, Human
ugacugccaggcucccucuggag

SEQ ID NO: 585085 - RNA, 19 nt, Human
ugagacuggguaucuuggc

SEQ ID NO: 585086 - RNA, 23 nt, Human
ugagcagggugcccacagggugg

SEQ ID NO: 585087 - RNA, 20 nt, Human
ugaggaggagaguacaggac

SEQ ID NO: 585088 - RNA, 25 nt, Human
ugcagcuagggcacaggcauggaac

SEQ ID NO: 585089 - RNA, 22 nt, Human
uggaauucccucagccuuuccu

SEQ ID NO: 585090 - RNA, 19 nt, Human
uggaggagcccgaggaagg

SEQ ID NO: 585091 - RNA, 21 nt, Human
uggaggagcccgaggaagggg

SEQ ID NO: 585092 - RNA, 25 nt, Human
uggaucuuucucucuaaugacaguc

SEQ ID NO: 585093 - RNA, 18 nt, Human
uggcaauggaucuuucuc

SEQ ID NO: 585094 - RNA, 22 nt, Human
uggcagagucagcuucccacag

SEQ ID NO: 585095 - RNA, 21 nt, Human
uggcaggaaugcaggggcugc

SEQ ID NO: 585096 - RNA, 26 nt, Human
uggcucuggguuggcuagcugcgggg

SEQ ID NO: 585097 - RNA, 20 nt, Human
ugggagagacacaggcauug

SEQ ID NO: 585098 - RNA, 21 nt, Human
ugggagcugggaauccucuga

SEQ ID NO: 585099 - RNA, 22 nt, Human
uucacccccauggcacuguuug

SEQ ID NO: 585100 - RNA, 22 nt, Human
uucaggaggaggggcucgcagu

SEQ ID NO: 585101 - RNA, 24 nt, Human
uuccugcaaccccaugacgcaguu

SEQ ID NO: 585102 - RNA, 20 nt, Human
uuccugggguguggagugcu

SEQ ID NO: 585103 - RNA, 25 nt, Human
uugcagcuagggcacaggcauggaa

SEQ ID NO: 585104 - RNA, 18 nt, Human
aaacaggauggaaacaug

SEQ ID NO: 585105 - RNA, 25 nt, Human
aaacaggauggaaacaugcagcccu

SEQ ID NO: 585106 - RNA, 21 nt, Human
aaacuuugugcuucucuuugc

SEQ ID NO: 585107 - RNA, 24 nt, Human
aaagcuguguuucaaccaguuugg

SEQ ID NO: 585108 - RNA, 22 nt, Human
aacaggggugagaaccaggccu

SEQ ID NO: 585109 - RNA, 25 nt, Human
aagaaaacccacagggugguacaga

SEQ ID NO: 585110 - RNA, 23 nt, Human
aagaugucuuuggcuaaaacuuu

SEQ ID NO: 585111 - RNA, 22 nt, Human
aaggagacaaagcagcggcuga

SEQ ID NO: 585112 - RNA, 20 nt, Human
aagggacugagcagcccagc

SEQ ID NO: 585113 - RNA, 20 nt, Human
aagggucauguggcaaugug

SEQ ID NO: 585114 - RNA, 18 nt, Human
aaggguugaccucuccuc

SEQ ID NO: 585115 - RNA, 20 nt, Human
aauaaaagaggcaaacagga

SEQ ID NO: 585116 - RNA, 25 nt, Human
acagugcagaacagaaugcugaaac

SEQ ID NO: 585117 - RNA, 21 nt, Human
acaucacaacagcccuucagc

SEQ ID NO: 585118 - RNA, 21 nt, Human
accucuccugccuccuuguua

SEQ ID NO: 585119 - RNA, 18 nt, Human
acuccaacaggggugaga

SEQ ID NO: 585120 - RNA, 20 nt, Human
agaacagaaugcugaaacac

SEQ ID NO: 585121 - RNA, 19 nt, Human
agacccaugaagggacuga

SEQ ID NO: 585122 - RNA, 21 nt, Human
agcaccggcccaacaccaccc

SEQ ID NO: 585123 - RNA, 21 nt, Human
agccaugaaauggcccagccc

SEQ ID NO: 585124 - RNA, 19 nt, Human
aggaacagggaagggcagg

SEQ ID NO: 585125 - RNA, 24 nt, Human
aggaacagggaagggcaggugggc

SEQ ID NO: 585126 - RNA, 20 nt, Human
aggcagggagcgcgugcaag

SEQ ID NO: 585127 - RNA, 26 nt, Human
aggccaaagauggacagaagggaccc

SEQ ID NO: 585128 - RNA, 25 nt, Human
aggggcucuggccaggccacagucc

SEQ ID NO: 585129 - RNA, 20 nt, Human
agguccccugcacauucauc

SEQ ID NO: 585130 - RNA, 21 nt, Human
aucacaacagcccuucagcac

SEQ ID NO: 585131 - RNA, 20 nt, Human
caaagcagcggcugacaggc

SEQ ID NO: 585132 - RNA, 21 nt, Human
caacaaaaguaggaagauguc

SEQ ID NO: 585133 - RNA, 22 nt, Human
caagaaaacccacaggguggua

SEQ ID NO: 585134 - RNA, 20 nt, Human
caaggcucaaacuuugugcu

SEQ ID NO: 585135 - RNA, 23 nt, Human
cacagccccgcuuuccaccuccu

SEQ ID NO: 585136 - RNA, 18 nt, Human
cacagugcagaacagaau

SEQ ID NO: 585137 - RNA, 19 nt, Human
caccggcccaacaccaccc

SEQ ID NO: 585138 - RNA, 20 nt, Human
cacucagcccauggcagagc

SEQ ID NO: 585139 - RNA, 19 nt, Human
cagaacaucacaacagccc

SEQ ID NO: 585140 - RNA, 20 nt, Human
cagaaugcugaaacacaaca

SEQ ID NO: 585141 - RNA, 26 nt, Human
cagagagccagcccacagugcagaac

SEQ ID NO: 585142 - RNA, 24 nt, Human
cagagcacccagccugagcccaac

SEQ ID NO: 585143 - RNA, 22 nt, Human
caggccaaagauggacagaaga

SEQ ID NO: 585144 - RNA, 18 nt, Human
caggccgcccccgccggc

SEQ ID NO: 585145 - RNA, 20 nt, Human
caggugggccacccuggcca

SEQ ID NO: 585146 - RNA, 21 nt, Human
cagucacagaaagagccccaa

SEQ ID NO: 585147 - RNA, 22 nt, Human
caugaagggacugagcagccca

SEQ ID NO: 585148 - RNA, 22 nt, Human
cauuccaggaggaugggaacag

SEQ ID NO: 585149 - RNA, 19 nt, Human
cauugcugagggcacaggu

SEQ ID NO: 585150 - RNA, 21 nt, Human
ccaaagauggacagaagaaua

SEQ ID NO: 585151 - RNA, 21 nt, Human
ccacagggugguacagaggcc

SEQ ID NO: 585152 - RNA, 19 nt, Human
ccaggggccagugcccagg

SEQ ID NO: 585153 - RNA, 19 nt, Human
cccaacaccacccucgugc

SEQ ID NO: 585154 - RNA, 20 nt, Human
cccacagugcagaacagaau

SEQ ID NO: 585155 - RNA, 28 nt, Human
cccacagugcagaacagaaugcugaaac

SEQ ID NO: 585156 - RNA, 19 nt, Human
cccauggcagagcacccag

SEQ ID NO: 585157 - RNA, 22 nt, Human
ccccgcuuuccaccuccucccc

SEQ ID NO: 585158 - RNA, 21 nt, Human
cccgagcuaaggagacaaagc

SEQ ID NO: 585159 - RNA, 24 nt, Human
cccgccacagccccgcuuuccacc

SEQ ID NO: 585160 - RNA, 23 nt, Human
cccgccggcccgccacagccccc

SEQ ID NO: 585161 - RNA, 24 nt, Human
ccggcccgccacagccccgcuuuc

SEQ ID NO: 585162 - RNA, 23 nt, Human
ccuggcuauaaggcccaggaacc

SEQ ID NO: 585163 - RNA, 25 nt, Human
ccuucagcacuggccagguguccaa

SEQ ID NO: 585164 - RNA, 23 nt, Human
cggcggcagcggcagcagcaccg

SEQ ID NO: 585165 - RNA, 27 nt, Human
cucuccugccuccuuguuaguugagag

SEQ ID NO: 585166 - RNA, 20 nt, Human
cucuggccaggccacagucc

SEQ ID NO: 585167 - RNA, 19 nt, Human
gaaacaugcagcccugcca

SEQ ID NO: 585168 - RNA, 22 nt, Human
gaacaucacaacagcccuucag

SEQ ID NO: 585169 - RNA, 21 nt, Human
gacaggccgcccccgccggcc

SEQ ID NO: 585170 - RNA, 23 nt, Human
gacccgagcuaaggagacaaagc

SEQ ID NO: 585171 - RNA, 18 nt, Human
gagaggggaugugggcag

SEQ ID NO: 585172 - RNA, 18 nt, Human
gauguagugcaaaugucg

SEQ ID NO: 585173 - RNA, 20 nt, Human
gcagagcacccagccugagc

SEQ ID NO: 585174 - RNA, 20 nt, Human
gcagagcaggggcacaggca

SEQ ID NO: 585175 - RNA, 24 nt, Human
gcaugggacaaggguugaccucuc

SEQ ID NO: 585176 - RNA, 21 nt, Human
gcccaacaccacccucgugcc

SEQ ID NO: 585177 - RNA, 21 nt, Human
gcccaacaccacccucguggu

SEQ ID NO: 585178 - RNA, 19 nt, Human
gcccaggaaccauauagga

SEQ ID NO: 585179 - RNA, 20 nt, Human
gcccauggcagagcacccag

SEQ ID NO: 585180 - RNA, 19 nt, Human
ggaaacaugcagcccugcc

SEQ ID NO: 585181 - RNA, 20 nt, Human
ggacaaggguugaccucucc

SEQ ID NO: 585182 - RNA, 19 nt, Human
ggcagagcaggggcacagg

SEQ ID NO: 585183 - RNA, 18 nt, Human
ggggcaugggugguggug

SEQ ID NO: 585184 - RNA, 18 nt, Human
ggggccagugcccagggu

SEQ ID NO: 585185 - RNA, 21 nt, Human
ggugagaaccaggccugggca

SEQ ID NO: 585186 - RNA, 22 nt, Human
gugggcaggggauaaggaaggu

SEQ ID NO: 585187 - RNA, 20 nt, Human
uaaaagaggcaaacaggaug

SEQ ID NO: 585188 - RNA, 21 nt, Human
ucaaggcucaaacuuugugcu

SEQ ID NO: 585189 - RNA, 20 nt, Human
ucacaaaagucgggagcgcc

SEQ ID NO: 585190 - RNA, 20 nt, Human
ucagcccauggcagagcacc

SEQ ID NO: 585191 - RNA, 20 nt, Human
uccauuagcaagacccauga

SEQ ID NO: 585192 - RNA, 18 nt, Human
ucccagcaacagcacaug

SEQ ID NO: 585193 - RNA, 25 nt, Human
ucccccauuccaggaggaugggaac

SEQ ID NO: 585194 - RNA, 18 nt, Human
ucccugcggcagcgcaga

SEQ ID NO: 585195 - RNA, 22 nt, Human
uccucagucacagaaagagccc

SEQ ID NO: 585196 - RNA, 24 nt, Human
uccuggguccaggaaucaaggcuc

SEQ ID NO: 585197 - RNA, 18 nt, Human
ucgcaaccaaguacuaug

SEQ ID NO: 585198 - RNA, 22 nt, Human
ucugggccacucagcccauggc

SEQ ID NO: 585199 - RNA, 21 nt, Human
ugaaacacaacaaaaguagga

SEQ ID NO: 585200 - RNA, 21 nt, Human
ugaaauggcccagccaggggc

SEQ ID NO: 585201 - RNA, 21 nt, Human
ugagccaugaaauggcccagc

SEQ ID NO: 585202 - RNA, 25 nt, Human
ugcagucuguguccccugcuggcac

SEQ ID NO: 585203 - RNA, 19 nt, Human
ugcggcagcgcagaaggga

SEQ ID NO: 585204 - RNA, 24 nt, Human
ugcuuuauuggagaggggaugugg

SEQ ID NO: 585205 - RNA, 21 nt, Human
uggaaacaugcagcccugcca

SEQ ID NO: 585206 - RNA, 20 nt, Human
uggagaggggaugugggcag

SEQ ID NO: 585207 - RNA, 19 nt, Human
uggcaauguggagccaaag

SEQ ID NO: 585208 - RNA, 18 nt, Human
uggcccgggcggccuccc

SEQ ID NO: 585209 - RNA, 24 nt, Human
uguccaagaaaacccacagggugg

SEQ ID NO: 585210 - RNA, 22 nt, Human
uuaagggucauguggcaaugug

SEQ ID NO: 585211 - RNA, 20 nt, Human
uuccuugagcccccagaggc

SEQ ID NO: 585212 - RNA, 18 nt, Human
uucuucucaguucuuuuc

SEQ ID NO: 585213 - RNA, 18 nt, Human
uugagccaugaaauggcc

SEQ ID NO: 585214 - RNA, 24 nt, Human
uuggagaggggaugugggcagggg

SEQ ID NO: 585215 - RNA, 23 nt, Human
uuuuaaagcacauauaugcuacu

SEQ ID NO: 585216 - RNA, 24 nt, Human
aaaaccauuauaaauuaaaugggu

SEQ ID NO: 585217 - RNA, 30 nt, Human
aaaccaucuucuccugaacccaaacaugcu

SEQ ID NO: 585218 - RNA, 22 nt, Human
aaagaggcauacucuuuugauc

SEQ ID NO: 585219 - RNA, 19 nt, Human
aaagugcuaggauuacagg

SEQ ID NO: 585220 - RNA, 24 nt, Human
aaagugcuaggauuacaggcguga

SEQ ID NO: 585221 - RNA, 21 nt, Human
aagaaaaguuuuaacaaagga

SEQ ID NO: 585222 - RNA, 20 nt, Human
aaggcuuuuuaaauauggca

SEQ ID NO: 585223 - RNA, 21 nt, Human
aaguaauagagaacuuggaac

SEQ ID NO: 585224 - RNA, 26 nt, Human
aagugcuaggauuacaggcgugagcc

SEQ ID NO: 585225 - RNA, 24 nt, Human
aauaucuuagguuaacaagcaacu

SEQ ID NO: 585226 - RNA, 25 nt, Human
aauuccaucaaagaaaaccuugcua

SEQ ID NO: 585227 - RNA, 19 nt, Human
acaaaacaaaaugauggau

SEQ ID NO: 585228 - RNA, 22 nt, Human
acagugcuguucaauaacuauu

SEQ ID NO: 585229 - RNA, 20 nt, Human
acauacaguuuuuggcugca

SEQ ID NO: 585230 - RNA, 19 nt, Human
acuaucuacacauuucuug

SEQ ID NO: 585231 - RNA, 22 nt, Human
agaaguaauagagaacuuggaa

SEQ ID NO: 585232 - RNA, 19 nt, Human
agcccugaaaacauagaug

SEQ ID NO: 585233 - RNA, 24 nt, Human
agcgcaguggcacgaucucggcuc

SEQ ID NO: 585234 - RNA, 20 nt, Human
aggaauaauuuuauuucuaa

SEQ ID NO: 585235 - RNA, 18 nt, Human
aggcacgggaagagagag

SEQ ID NO: 585236 - RNA, 23 nt, Human
aggcgugagccaccgugccuggc

SEQ ID NO: 585237 - RNA, 18 nt, Human
aguagcugggacuauagg

SEQ ID NO: 585238 - RNA, 20 nt, Human
auacaugcuggcaaaaggga

SEQ ID NO: 585239 - RNA, 24 nt, Human
augagguguuagccaggauggucu

SEQ ID NO: 585240 - RNA, 21 nt, Human
augcacaugcaugucuuugua

SEQ ID NO: 585241 - RNA, 22 nt, Human
auuaggccauacaaaacaaaau

SEQ ID NO: 585242 - RNA, 18 nt, Human
auugcuauuuugcccagg

SEQ ID NO: 585243 - RNA, 24 nt, Human
caaagugcuaggauuacaggcgug

SEQ ID NO: 585244 - RNA, 25 nt, Human
caacuaagcaaaaaucacuauaucu

SEQ ID NO: 585245 - RNA, 22 nt, Human
caagcaauucuccugccucggc

SEQ ID NO: 585246 - RNA, 21 nt, Human
caauagcagcaaaaauaaguu

SEQ ID NO: 585247 - RNA, 20 nt, Human
cacaauagcagcaaaaauaa

SEQ ID NO: 585248 - RNA, 24 nt, Human
caccucagccucccgaguagcugg

SEQ ID NO: 585249 - RNA, 18 nt, Human
cacugcaaccucugccuc

SEQ ID NO: 585250 - RNA, 21 nt, Human
cacugcaaccucugccuccca

SEQ ID NO: 585251 - RNA, 21 nt, Human
cagcaaaaauaaguuccccug

SEQ ID NO: 585252 - RNA, 20 nt, Human
cagccucccgaguagcuggg

SEQ ID NO: 585253 - RNA, 24 nt, Human
caguaugaaucaaauaauuccauc

SEQ ID NO: 585254 - RNA, 22 nt, Human
cauuucaggcaucacuuccucc

SEQ ID NO: 585255 - RNA, 20 nt, Human
ccaaagugcuaggauuacag

SEQ ID NO: 585256 - RNA, 22 nt, Human
ccaaagugcuaggauuacaggc

SEQ ID NO: 585257 - RNA, 24 nt, Human
ccaaagugcuaggauuacaggcgu

SEQ ID NO: 585258 - RNA, 23 nt, Human
ccaccucagccucccgaguagcu

SEQ ID NO: 585259 - RNA, 22 nt, Human
ccacugcaccugucugaguggc

SEQ ID NO: 585260 - RNA, 24 nt, Human
ccagucaaaauccagccacauuua

SEQ ID NO: 585261 - RNA, 25 nt, Human
ccauacaaaacaaaaugauggauag

SEQ ID NO: 585262 - RNA, 22 nt, Human
cccaaacaugcauacuauuucu

SEQ ID NO: 585263 - RNA, 23 nt, Human
cccagguucaagcaauucuccug

SEQ ID NO: 585264 - RNA, 23 nt, Human
cccauauucccagucaaaaucca

SEQ ID NO: 585265 - RNA, 24 nt, Human
ccucccagguucaagcaauucucc

SEQ ID NO: 585266 - RNA, 19 nt, Human
ccugaacuacaguggagag

SEQ ID NO: 585267 - RNA, 19 nt, Human
ccugaguagcugggacuau

SEQ ID NO: 585268 - RNA, 23 nt, Human
ccugaguagcugggacuauaggc

SEQ ID NO: 585269 - RNA, 24 nt, Human
ccugccucggccuccugaguagcu

SEQ ID NO: 585270 - RNA, 25 nt, Human
ccuggcccacuucuauuuucuuagu

SEQ ID NO: 585271 - RNA, 18 nt, Human
ccuggcuucaagugaucc

SEQ ID NO: 585272 - RNA, 20 nt, Human
ccuggcuucaagugauccuc

SEQ ID NO: 585273 - RNA, 21 nt, Human
ccugucugaguggcuuuuuuu

SEQ ID NO: 585274 - RNA, 24 nt, Human
cucacugcaaccucugccucccag

SEQ ID NO: 585275 - RNA, 24 nt, Human
cucacugcaaccucugccucccag

SEQ ID NO: 585276 - RNA, 24 nt, Human
cucagccucccgaguagcuggggc

SEQ ID NO: 585277 - RNA, 18 nt, Human
cucaugauccgccugccu

SEQ ID NO: 585278 - RNA, 24 nt, Human
cucggccuccugaguagcugggac

SEQ ID NO: 585279 - RNA, 24 nt, Human
cucucucugccacccaggcuggag

SEQ ID NO: 585280 - RNA, 24 nt, Human
cucucugccacccaggcuggagcg

SEQ ID NO: 585281 - RNA, 18 nt, Human
cucugccacccaggcugg

SEQ ID NO: 585282 - RNA, 23 nt, Human
cugcaaccucugccucccagguu

SEQ ID NO: 585283 - RNA, 24 nt, Human
cugcaaccucugccucccagguuc

SEQ ID NO: 585284 - RNA, 23 nt, Human
cugccucggccucccaaagugcu

SEQ ID NO: 585285 - RNA, 19 nt, Human
cuuaaaauuauccauugaa

SEQ ID NO: 585286 - RNA, 24 nt, Human
cuuccgaccucaugauccgccugc

SEQ ID NO: 585287 - RNA, 22 nt, Human
gaccucaugauccgccugccuc

SEQ ID NO: 585288 - RNA, 22 nt, Human
gaccucaugauccgccugccuc

SEQ ID NO: 585289 - RNA, 24 nt, Human
gaccucaugauccgccugccucgg

SEQ ID NO: 585290 - RNA, 24 nt, Human
gacuauaggcgccugccaccaugc

SEQ ID NO: 585291 - RNA, 19 nt, Human
gaguaggugggauuacaug

SEQ ID NO: 585292 - RNA, 18 nt, Human
gauuacaggcgugagcca

SEQ ID NO: 585293 - RNA, 21 nt, Human
gauuacaggcgugagccaccg

SEQ ID NO: 585294 - RNA, 24 nt, Human
gauuacaggcgugagccaccgugc

SEQ ID NO: 585295 - RNA, 18 nt, Human
gauuacaugugugagcca

SEQ ID NO: 585296 - RNA, 19 nt, Human
gauuacaugugugagccac

SEQ ID NO: 585297 - RNA, 23 nt, Human
gauuacaugugugagccacugca

SEQ ID NO: 585298 - RNA, 22 nt, Human
gcaaccucugccucccagguuc

SEQ ID NO: 585299 - RNA, 21 nt, Human
gcaguggcacgaucucggcuc

SEQ ID NO: 585300 - RNA, 23 nt, Human
gcccggcuaauuuuuuguauuuu

SEQ ID NO: 585301 - RNA, 19 nt, Human
gccucagucuucugaguag

SEQ ID NO: 585302 - RNA, 18 nt, Human
gccuccugaguagcuggg

SEQ ID NO: 585303 - RNA, 20 nt, Human
gccucggccuccugaguagc

SEQ ID NO: 585304 - RNA, 21 nt, Human
gccucggccuccugaguagcu

SEQ ID NO: 585305 - RNA, 22 nt, Human
ggauuacaggcgugagccaccg

SEQ ID NO: 585306 - RNA, 18 nt, Human
gggaagagagagagucaa

SEQ ID NO: 585307 - RNA, 19 nt, Human
gggauuacaugugugagcc

SEQ ID NO: 585308 - RNA, 22 nt, Human
ggguagggucauguguucuuug

SEQ ID NO: 585309 - RNA, 21 nt, Human
guguguguguguguuugugua

SEQ ID NO: 585310 - RNA, 23 nt, Human
guguguuuguguauguguguguu

SEQ ID NO: 585311 - RNA, 18 nt, Human
uaacagaaucuugaaaaa

SEQ ID NO: 585312 - RNA, 26 nt, Human
uaagcaaaaaucacuauaaucaacgg

SEQ ID NO: 585313 - RNA, 21 nt, Human
uaauagagaacuuggaacuaa

SEQ ID NO: 585314 - RNA, 24 nt, Human
uaauuuuuuguauuuuuaguagag

SEQ ID NO: 585315 - RNA, 25 nt, Human
uaauuuuuuguauuuuuaguagaga

SEQ ID NO: 585316 - RNA, 22 nt, Human
uacaggcgugagccaccgugcc

SEQ ID NO: 585317 - RNA, 22 nt, Human
uacaggcgugagccaccgugcc

SEQ ID NO: 585318 - RNA, 21 nt, Human
uacaguggagagaagauucac

SEQ ID NO: 585319 - RNA, 24 nt, Human
uacaugugugagccacugcaccug

SEQ ID NO: 585320 - RNA, 20 nt, Human
uaccuggacaaucugugcaa

SEQ ID NO: 585321 - RNA, 18 nt, Human
uaggauuacaggcgugag

SEQ ID NO: 585322 - RNA, 21 nt, Human
uaggauuacaggcgugagcca

SEQ ID NO: 585323 - RNA, 22 nt, Human
uaggauuacaggcgugagccac

SEQ ID NO: 585324 - RNA, 23 nt, Human
uaggauuacaggcgugagccacc

SEQ ID NO: 585325 - RNA, 23 nt, Human
uaggauuacaggcgugagccacc

SEQ ID NO: 585326 - RNA, 24 nt, Human
uaggauuacaggcgugagccaccg

SEQ ID NO: 585327 - RNA, 19 nt, Human
uaggcgccugccaccaugc

SEQ ID NO: 585328 - RNA, 23 nt, Human
uaggcgccugccaccaugcccgg

SEQ ID NO: 585329 - RNA, 23 nt, Human
uaguagagaugagguguuagcca

SEQ ID NO: 585330 - RNA, 24 nt, Human
uauuacuaaucuuucaaaaauguu

SEQ ID NO: 585331 - RNA, 26 nt, Human
uauucaaacuauugacauaauuuaau

SEQ ID NO: 585332 - RNA, 24 nt, Human
uauuuugcccaggcuguucuugag

SEQ ID NO: 585333 - RNA, 26 nt, Human
ucaaagaaaaccuugcuaaacagacu

SEQ ID NO: 585334 - RNA, 19 nt, Human
ucaagugauccuccggccu

SEQ ID NO: 585335 - RNA, 20 nt, Human
ucaagugauccuccggccuc

SEQ ID NO: 585336 - RNA, 23 nt, Human
ucacaucccacgugccuagcaca

SEQ ID NO: 585337 - RNA, 19 nt, Human
ucacugcaaccucugccuc

SEQ ID NO: 585338 - RNA, 24 nt, Human
ucacugcaaccucugccucccagg

SEQ ID NO: 585339 - RNA, 25 nt, Human
ucacugcaaccucugccucccaggu

SEQ ID NO: 585340 - RNA, 23 nt, Human
ucagccucccgaguagcuggggc

SEQ ID NO: 585341 - RNA, 19 nt, Human
uccacgaaacuugcccugg

SEQ ID NO: 585342 - RNA, 18 nt, Human
uccagguacgauguggaa

SEQ ID NO: 585343 - RNA, 24 nt, Human
ucccaaagugcuaggauuacaggc

SEQ ID NO: 585344 - RNA, 21 nt, Human
ucccagguucaagcaauucuc

SEQ ID NO: 585345 - RNA, 24 nt, Human
ucccagguucaagcaauucuccug

SEQ ID NO: 585346 - RNA, 21 nt, Human
ucccgaguagcuggggcuacc

SEQ ID NO: 585347 - RNA, 24 nt, Human
ucccgaguagcuggggcuaccggc

SEQ ID NO: 585348 - RNA, 24 nt, Human
uccugaguagcugggacuauaggc

SEQ ID NO: 585349 - RNA, 23 nt, Human
ucggccuccugaguagcugggac

SEQ ID NO: 585350 - RNA, 23 nt, Human
ucucucucugccacccaggcugg

SEQ ID NO: 585351 - RNA, 24 nt, Human
ucucucucugccacccaggcugga

SEQ ID NO: 585352 - RNA, 19 nt, Human
ucucugccacccaggcugg

SEQ ID NO: 585353 - RNA, 25 nt, Human
ucucugccacccaggcuggagcgca

SEQ ID NO: 585354 - RNA, 24 nt, Human
ucugccacccaggcuggagcgcag

SEQ ID NO: 585355 - RNA, 21 nt, Human
ucuuuugaucauguauauucu

SEQ ID NO: 585356 - RNA, 22 nt, Human
ugagacagagucucucucugcc

SEQ ID NO: 585357 - RNA, 24 nt, Human
ugagacagagucucucucugccac

SEQ ID NO: 585358 - RNA, 21 nt, Human
ugagguguuagccaggauggu

SEQ ID NO: 585359 - RNA, 24 nt, Human
ugagguguuagccaggauggucuc

SEQ ID NO: 585360 - RNA, 24 nt, Human
ugauacauacaguuuuuggcugca

SEQ ID NO: 585361 - RNA, 19 nt, Human
ugauccuccggccucaguc

SEQ ID NO: 585362 - RNA, 24 nt, Human
ugcccaggcuguucuugagcuccu

SEQ ID NO: 585363 - RNA, 25 nt, Human
ugcccggcuaauuuuuuguauuuuu

SEQ ID NO: 585364 - RNA, 22 nt, Human
ugcccuggauuuuccacuucac

SEQ ID NO: 585365 - RNA, 21 nt, Human
ugccucggccucccaaagugc

SEQ ID NO: 585366 - RNA, 24 nt, Human
ugccucggccucccaaagugcuag

SEQ ID NO: 585367 - RNA, 24 nt, Human
ugccucggccuccugaguagcugg

SEQ ID NO: 585368 - RNA, 26 nt, Human
ugccuggcccacuucuauuuucuuag

SEQ ID NO: 585369 - RNA, 24 nt, Human
ugcuaggauuacaggcgugagcca

SEQ ID NO: 585370 - RNA, 24 nt, Human
ugcuuuguucuucccauauuccca

SEQ ID NO: 585371 - RNA, 24 nt, Human
uggagcgcaguggcacgaucucgg

SEQ ID NO: 585372 - RNA, 24 nt, Human
uggcuucaagugauccuccggccu

SEQ ID NO: 585373 - RNA, 21 nt, Human
ugggacuauaggcgccugcca

SEQ ID NO: 585374 - RNA, 22 nt, Human
ugggacuauaggcgccugccac

SEQ ID NO: 585375 - RNA, 24 nt, Human
ugggacuauaggcgccugccacca

SEQ ID NO: 585376 - RNA, 25 nt, Human
ugggacuauaggcgccugccaccau

SEQ ID NO: 585377 - RNA, 19 nt, Human
ugggauuacaugugugagc

SEQ ID NO: 585378 - RNA, 22 nt, Human
ugggauuacaugugugagccac

SEQ ID NO: 585379 - RNA, 22 nt, Human
ugggauuacaugugugagccac

SEQ ID NO: 585380 - RNA, 24 nt, Human
ugggauuacaugugugagccacug

SEQ ID NO: 585381 - RNA, 21 nt, Human
uguaaacagaaaaaugaacca

SEQ ID NO: 585382 - RNA, 24 nt, Human
ugugauuacuagugugugugugug

SEQ ID NO: 585383 - RNA, 19 nt, Human
uguguguguguguuugugu

SEQ ID NO: 585384 - RNA, 21 nt, Human
uguguguguguuuguguaugu

SEQ ID NO: 585385 - RNA, 21 nt, Human
uguguguguguuuguguaugu

SEQ ID NO: 585386 - RNA, 21 nt, Human
uguguguguguuuguguaugu

SEQ ID NO: 585387 - RNA, 24 nt, Human
uguguguucccaugcacaugcaug

SEQ ID NO: 585388 - RNA, 23 nt, Human
uguguuuguguaugugugugugu

SEQ ID NO: 585389 - RNA, 24 nt, Human
uguuuguguauguguguguguguu

SEQ ID NO: 585390 - RNA, 23 nt, Human
uuacuaaucuuucaaaaauguug

SEQ ID NO: 585391 - RNA, 18 nt, Human
uuaguagagaugaggugu

SEQ ID NO: 585392 - RNA, 21 nt, Human
uucaagcaauucuccugccuc

SEQ ID NO: 585393 - RNA, 24 nt, Human
uucaagcaauucuccugccucggc

SEQ ID NO: 585394 - RNA, 23 nt, Human
uucaagugauccuccggccucag

SEQ ID NO: 585395 - RNA, 26 nt, Human
uuccaguaugaaucaaauaauuccau

SEQ ID NO: 585396 - RNA, 18 nt, Human
uuggagcuugauacauac

SEQ ID NO: 585397 - RNA, 25 nt, Human
uuucuaauguuaaacuuucuaguca

SEQ ID NO: 585398 - RNA, 21 nt, Human
uuuuuaguagagaugaggugu

SEQ ID NO: 585399 - RNA, 21 nt, Human
uuuuuguauuuuuaguagaga

SEQ ID NO: 585400 - RNA, 24 nt, Human
uuuuuuguauuuuuaguagagaug

SEQ ID NO: 585401 - RNA, 26 nt, Human
aaacccaauaagcuuaaacaaaguga

SEQ ID NO: 585402 - RNA, 25 nt, Human
aaauaaaauguacuuggcuauaaaa

SEQ ID NO: 585403 - RNA, 22 nt, Human
aagaaaauaguuuugaaaaaga

SEQ ID NO: 585404 - RNA, 21 nt, Human
aagcaugaucaauaccaagau

SEQ ID NO: 585405 - RNA, 19 nt, Human
aaggaaaggcuauuuggua

SEQ ID NO: 585406 - RNA, 18 nt, Human
agaaugcuauagaaagcc

SEQ ID NO: 585407 - RNA, 19 nt, Human
auuucauuacuggguaaca

SEQ ID NO: 585408 - RNA, 23 nt, Human
cagcaagaaaauaaaauguacuu

SEQ ID NO: 585409 - RNA, 25 nt, Human
cagcaagaaaauaaaauguacuugg

SEQ ID NO: 585410 - RNA, 23 nt, Human
cauaaaccuuaaagcaugaucaa

SEQ ID NO: 585411 - RNA, 21 nt, Human
ccaaaaaagcaagaacaguga

SEQ ID NO: 585412 - RNA, 23 nt, Human
ccaucuagaaauuuuucaaauaa

SEQ ID NO: 585413 - RNA, 23 nt, Human
cccaauaagcuuaaacaaaguga

SEQ ID NO: 585414 - RNA, 19 nt, Human
cucuucccaaaaaagcaaa

SEQ ID NO: 585415 - RNA, 22 nt, Human
gaaaaaaauccuuuuauuuuua

SEQ ID NO: 585416 - RNA, 20 nt, Human
ggaguuaacaacuuacaauu

SEQ ID NO: 585417 - RNA, 25 nt, Human
guugaaauauuuaucuacacauuag

SEQ ID NO: 585418 - RNA, 19 nt, Human
uaaaaauuuaaacaccuga

SEQ ID NO: 585419 - RNA, 22 nt, Human
uaaaauguacuuggcuauaaaa

SEQ ID NO: 585420 - RNA, 19 nt, Human
uaagaacaucaguacacuu

SEQ ID NO: 585421 - RNA, 18 nt, Human
uacuugaaaaaggguugc

SEQ ID NO: 585422 - RNA, 23 nt, Human
uacuuggcuauaaaaauacugag

SEQ ID NO: 585423 - RNA, 21 nt, Human
uagaaugcuauagaaagccuc

SEQ ID NO: 585424 - RNA, 20 nt, Human
uagacugcauugaugaaaau

SEQ ID NO: 585425 - RNA, 18 nt, Human
uaguaaagugagguuaca

SEQ ID NO: 585426 - RNA, 22 nt, Human
uccacuugcaauauuuauccaa

SEQ ID NO: 585427 - RNA, 20 nt, Human
ugaaacccaauaagcuuaaa

SEQ ID NO: 585428 - RNA, 22 nt, Human
ugcauaauuuccaacucaucca

SEQ ID NO: 585429 - RNA, 24 nt, Human
ugucguaaacaauagagaaaaaaa

SEQ ID NO: 585430 - RNA, 26 nt, Human
uuaaaaucaugcaauacugcauggua

SEQ ID NO: 585431 - RNA, 22 nt, Human
uucccaaaaaagcaagaacagu

SEQ ID NO: 585432 - RNA, 21 nt, Human
uugcaacaaagugucucuucc

SEQ ID NO: 585433 - RNA, 19 nt, Human
uuuaaacaccugauuaauc

SEQ ID NO: 585434 - RNA, 20 nt, Human
uuuuuuuuuuuuccacuuca

SEQ ID NO: 585435 - RNA, 22 nt, Human
uuuuuuuuuuuuuuuuccacuu

SEQ ID NO: 585436 - RNA, 22 nt, Human
aaccccuuacagccagccccac

SEQ ID NO: 585437 - RNA, 21 nt, Human
aagaagggcgggugggcagaa

SEQ ID NO: 585438 - RNA, 18 nt, Human
accccagaaauauccaag

SEQ ID NO: 585439 - RNA, 19 nt, Human
agagggaagaagggcgggu

SEQ ID NO: 585440 - RNA, 24 nt, Human
aggaaaguccucaaugccucuucc

SEQ ID NO: 585441 - RNA, 24 nt, Human
aucagccuucccacccaccccggg

SEQ ID NO: 585442 - RNA, 20 nt, Human
aucagucccccagcuccacu

SEQ ID NO: 585443 - RNA, 18 nt, Human
caccccagaaauauccaa

SEQ ID NO: 585444 - RNA, 18 nt, Human
caccgagggccggcggcg

SEQ ID NO: 585445 - RNA, 22 nt, Human
cacgcgccgcccgccccaggca

SEQ ID NO: 585446 - RNA, 22 nt, Human
cagcagcugcuccugggggugc

SEQ ID NO: 585447 - RNA, 19 nt, Human
caggugcacugaaugaggc

SEQ ID NO: 585448 - RNA, 20 nt, Human
cccaggcagccggacucugc

SEQ ID NO: 585449 - RNA, 21 nt, Human
cccggguggggcccucccugu

SEQ ID NO: 585450 - RNA, 23 nt, Human
ccgcccgccccaggcagccggac

SEQ ID NO: 585451 - RNA, 21 nt, Human
ccggguggggcccucccuguc

SEQ ID NO: 585452 - RNA, 19 nt, Human
ccucaaugccucuuccucc

SEQ ID NO: 585453 - RNA, 24 nt, Human
ccuggaggugucucuggccagcca

SEQ ID NO: 585454 - RNA, 24 nt, Human
cgcccgccccaggcagccggacuc

SEQ ID NO: 585455 - RNA, 25 nt, Human
cgggugggcagaaggaaggggcugg

SEQ ID NO: 585456 - RNA, 27 nt, Human
cgggugggcagaaggaaggggcuggag

SEQ ID NO: 585457 - RNA, 21 nt, Human
cggguggggcccucccugucu

SEQ ID NO: 585458 - RNA, 24 nt, Human
cuccagaaagguggcccaggggcg

SEQ ID NO: 585459 - RNA, 19 nt, Human
cuccccccagcccccaggc

SEQ ID NO: 585460 - RNA, 18 nt, Human
cugcuggcucccagaucu

SEQ ID NO: 585461 - RNA, 22 nt, Human
cuggccagccacagcauccagc

SEQ ID NO: 585462 - RNA, 19 nt, Human
cuggcucccagaucugucc

SEQ ID NO: 585463 - RNA, 18 nt, Human
cuggcugggccugcuggg

SEQ ID NO: 585464 - RNA, 22 nt, Human
gaaaguccucaaugccucuucc

SEQ ID NO: 585465 - RNA, 18 nt, Human
gagggaagaagggcgggu

SEQ ID NO: 585466 - RNA, 22 nt, Human
gccuggggcuccccccagcccc

SEQ ID NO: 585467 - RNA, 21 nt, Human
gcgccgcccgccccaggcagc

SEQ ID NO: 585468 - RNA, 22 nt, Human
gcuggggcccaggugcacugaa

SEQ ID NO: 585469 - RNA, 19 nt, Human
ggaaaaacagguaaggaaa

SEQ ID NO: 585470 - RNA, 23 nt, Human
ggaaaguccucaaugccucuucc

SEQ ID NO: 585471 - RNA, 21 nt, Human
ggagacagaucaucagccuuc

SEQ ID NO: 585472 - RNA, 25 nt, Human
ggcacuggcgggggggcaaccccuu

SEQ ID NO: 585473 - RNA, 21 nt, Human
ggcagaaggaaggggcuggag

SEQ ID NO: 585474 - RNA, 22 nt, Human
gggcccaggugcacugaaugaa

SEQ ID NO: 585475 - RNA, 21 nt, Human
gggccugcuggggcccaggug

SEQ ID NO: 585476 - RNA, 18 nt, Human
uauucacagcagcugcuc

SEQ ID NO: 585477 - RNA, 19 nt, Human
ucacagcagcugcuccugg

SEQ ID NO: 585478 - RNA, 20 nt, Human
ucacagcagcugcuccuggg

SEQ ID NO: 585479 - RNA, 19 nt, Human
ucagccuucccacccaccc

SEQ ID NO: 585480 - RNA, 19 nt, Human
uccaaggcacuggcggggg

SEQ ID NO: 585481 - RNA, 22 nt, Human
uccucaaugccucuuccuccac

SEQ ID NO: 585482 - RNA, 18 nt, Human
ucucuggccagccacagc

SEQ ID NO: 585483 - RNA, 19 nt, Human
ucuguccaguugcccagag

SEQ ID NO: 585484 - RNA, 20 nt, Human
ucuguccaguugcccagagg

SEQ ID NO: 585485 - RNA, 19 nt, Human
ugaaugaggcuucuaauca

SEQ ID NO: 585486 - RNA, 18 nt, Human
ugagcuggaaaaacaggu

SEQ ID NO: 585487 - RNA, 21 nt, Human
ugcccagagggaagaagggcg

SEQ ID NO: 585488 - RNA, 22 nt, Human
ugcuggggcccaggugcacuga

SEQ ID NO: 585489 - RNA, 21 nt, Human
uggaaaaacagguaaggaaag

SEQ ID NO: 585490 - RNA, 21 nt, Human
uggaaaaacagguaaggaaag

SEQ ID NO: 585491 - RNA, 21 nt, Human
uggcugggccugcuggggccc

SEQ ID NO: 585492 - RNA, 18 nt, Human
ugggcagaaggaaggggc

SEQ ID NO: 585493 - RNA, 20 nt, Human
ugggcagaaggaaggggcug

SEQ ID NO: 585494 - RNA, 23 nt, Human
ugggggugcaggcggccgggcga

SEQ ID NO: 585495 - RNA, 23 nt, Human
uucuaaucagucccccagcucca

SEQ ID NO: 585496 - RNA, 22 nt, Human
agccccgacaggaagcuuuaac

SEQ ID NO: 585497 - RNA, 23 nt, Human
aggaagcuuuaacauaaagccuu

SEQ ID NO: 585498 - RNA, 18 nt, Human
ugacccugagaagcaugg

SEQ ID NO: 585499 - RNA, 20 nt, Human
ugucgugagcagguucaugg

SEQ ID NO: 585500 - RNA, 22 nt, Human
aagaacaccacugugcuguacc

SEQ ID NO: 585501 - RNA, 18 nt, Human
agacagggucucucuaug

SEQ ID NO: 585502 - RNA, 23 nt, Human
agacagggucucucuauguugcc

SEQ ID NO: 585503 - RNA, 19 nt, Human
agacucgggguaguggcag

SEQ ID NO: 585504 - RNA, 19 nt, Human
agagcuaagagagcacagu

SEQ ID NO: 585505 - RNA, 19 nt, Human
aguccuggggccagccugc

SEQ ID NO: 585506 - RNA, 24 nt, Human
auggacgcccgugaguccuggggc

SEQ ID NO: 585507 - RNA, 20 nt, Human
auguugcccaggcuggucuc

SEQ ID NO: 585508 - RNA, 24 nt, Human
caaagugcugugauuaggccuacg

SEQ ID NO: 585509 - RNA, 23 nt, Human
cacccccaagccuggcuggugac

SEQ ID NO: 585510 - RNA, 22 nt, Human
cagagacagggucucucuaugu

SEQ ID NO: 585511 - RNA, 24 nt, Human
cagccucugcagccccacugcccu

SEQ ID NO: 585512 - RNA, 18 nt, Human
cagcucccuccaucagcc

SEQ ID NO: 585513 - RNA, 24 nt, Human
cagcugcauggacgcccgugaguc

SEQ ID NO: 585514 - RNA, 24 nt, Human
cagggucucucuauguugcccagg

SEQ ID NO: 585515 - RNA, 23 nt, Human
ccaaagugcugugauuaggccua

SEQ ID NO: 585516 - RNA, 21 nt, Human
ccaggcagacacagcacgaac

SEQ ID NO: 585517 - RNA, 20 nt, Human
cccagcucccuccaucagcc

SEQ ID NO: 585518 - RNA, 18 nt, Human
ccccacugcccucucuca

SEQ ID NO: 585519 - RNA, 25 nt, Human
ccccacugcccucucucauuaccug

SEQ ID NO: 585520 - RNA, 18 nt, Human
ccccuagggcagcaguuu

SEQ ID NO: 585521 - RNA, 21 nt, Human
cccgugagucccggagacagg

SEQ ID NO: 585522 - RNA, 19 nt, Human
ccuaacacuuaccucaccu

SEQ ID NO: 585523 - RNA, 22 nt, Human
ccuccaucacccccaagccugg

SEQ ID NO: 585524 - RNA, 26 nt, Human
ccucccaccuuggccucccaaagugc

SEQ ID NO: 585525 - RNA, 19 nt, Human
ccuccuccaucacccccaa

SEQ ID NO: 585526 - RNA, 21 nt, Human
ccuccuccaucacccccaagc

SEQ ID NO: 585527 - RNA, 20 nt, Human
ccucugcagccccacugccc

SEQ ID NO: 585528 - RNA, 18 nt, Human
ccuggggccagccugcuu

SEQ ID NO: 585529 - RNA, 21 nt, Human
cguugugugucacuuucuuaa

SEQ ID NO: 585530 - RNA, 19 nt, Human
cuacaguagucuguggcuc

SEQ ID NO: 585531 - RNA, 19 nt, Human
cucaccccagccucugcag

SEQ ID NO: 585532 - RNA, 19 nt, Human
cucagugauccucccaccu

SEQ ID NO: 585533 - RNA, 19 nt, Human
cucagugauccucccaccu

SEQ ID NO: 585534 - RNA, 23 nt, Human
cucagugauccucccaccuuggc

SEQ ID NO: 585535 - RNA, 21 nt, Human
cuggagagacucgggguagug

SEQ ID NO: 585536 - RNA, 19 nt, Human
gaauugcaacuguccaggc

SEQ ID NO: 585537 - RNA, 24 nt, Human
gaccuuaccuuccuguacugccac

SEQ ID NO: 585538 - RNA, 23 nt, Human
gcuguagggaaauaauuuauagg

SEQ ID NO: 585539 - RNA, 19 nt, Human
ggccagccugcuuucucag

SEQ ID NO: 585540 - RNA, 18 nt, Human
ggcugcagggaucuggaa

SEQ ID NO: 585541 - RNA, 18 nt, Human
gguaguggcaggcugcag

SEQ ID NO: 585542 - RNA, 24 nt, Human
gguccagcuccccuccaucagcug

SEQ ID NO: 585543 - RNA, 21 nt, Human
guaguggcaggcugcagggau

SEQ ID NO: 585544 - RNA, 21 nt, Human
guccgguccagcuccccucca

SEQ ID NO: 585545 - RNA, 20 nt, Human
uaaacagccauacuaagaac

SEQ ID NO: 585546 - RNA, 20 nt, Human
uaagaacaccacugugcugu

SEQ ID NO: 585547 - RNA, 23 nt, Human
uaccgaguccuccuccaucaccc

SEQ ID NO: 585548 - RNA, 23 nt, Human
uaccucaccuguguaagaacucc

SEQ ID NO: 585549 - RNA, 23 nt, Human
uauguugcccaggcuggucucag

SEQ ID NO: 585550 - RNA, 24 nt, Human
uauguugcccaggcuggucucagu

SEQ ID NO: 585551 - RNA, 27 nt, Human
ucagugauccucccaccuuggccuccc

SEQ ID NO: 585552 - RNA, 22 nt, Human
ucccaaagugcugugauuaggc

SEQ ID NO: 585553 - RNA, 23 nt, Human
uccgguccagcuccccuccauca

SEQ ID NO: 585554 - RNA, 22 nt, Human
uccuaucucauggaguggaagc

SEQ ID NO: 585555 - RNA, 18 nt, Human
ucuauguugcccaggcug

SEQ ID NO: 585556 - RNA, 18 nt, Human
ucuauguugcccaggcug

SEQ ID NO: 585557 - RNA, 20 nt, Human
ucucuauguugcccaggcug

SEQ ID NO: 585558 - RNA, 23 nt, Human
ucucucuauguugcccaggcugg

SEQ ID NO: 585559 - RNA, 24 nt, Human
ucucucuauguugcccaggcuggu

SEQ ID NO: 585560 - RNA, 19 nt, Human
ucugcagccccacugcccu

SEQ ID NO: 585561 - RNA, 20 nt, Human
ucugcagccccacugcccuc

SEQ ID NO: 585562 - RNA, 30 nt, Human
ucugcgacuguaaacagccauacuaagaac

SEQ ID NO: 585563 - RNA, 21 nt, Human
ucuguggcucaccccagccuc

SEQ ID NO: 585564 - RNA, 21 nt, Human
ugaagcacgagaagcacaguc

SEQ ID NO: 585565 - RNA, 22 nt, Human
ugauucugaaaguuacugggaa

SEQ ID NO: 585566 - RNA, 19 nt, Human
ugcagccccacugcccucu

SEQ ID NO: 585567 - RNA, 19 nt, Human
ugcauggacgcccgugagu

SEQ ID NO: 585568 - RNA, 25 nt, Human
ugcccaggcuggucucagugauccu

SEQ ID NO: 585569 - RNA, 20 nt, Human
ugccuggccacagcaggugc

SEQ ID NO: 585570 - RNA, 21 nt, Human
uggcuggugaccuggagagac

SEQ ID NO: 585571 - RNA, 19 nt, Human
uggggccagccugcuuucu

SEQ ID NO: 585572 - RNA, 20 nt, Human
uggggccagccugcuuucuc

SEQ ID NO: 585573 - RNA, 23 nt, Human
uggucucagugauccucccaccu

SEQ ID NO: 585574 - RNA, 20 nt, Human
uguccaaaaccuucauaaau

SEQ ID NO: 585575 - RNA, 24 nt, Human
ugucccuuaccgaguccuccucca

SEQ ID NO: 585576 - RNA, 22 nt, Human
uuccaaaugacuguccaaaacc

SEQ ID NO: 585577 - RNA, 19 nt, Human
uugcuuaaccaauccccua

SEQ ID NO: 585578 - RNA, 18 nt, Human
uuggccucccaaagugcu

SEQ ID NO: 585579 - RNA, 21 nt, Human
aaaagcaucaacaaaacccag

SEQ ID NO: 585580 - RNA, 24 nt, Human
aaacacacccaaaccugagaccac

SEQ ID NO: 585581 - RNA, 24 nt, Human
aaagugcugggauuacaggcguga

SEQ ID NO: 585582 - RNA, 24 nt, Human
aagcgauccucuagccuuggccuc

SEQ ID NO: 585583 - RNA, 19 nt, Human
aagugcugggauuacaggc

SEQ ID NO: 585584 - RNA, 19 nt, Human
aagugcugggauuacaggc

SEQ ID NO: 585585 - RNA, 26 nt, Human
aagugcugggauuacaggcgugaacu

SEQ ID NO: 585586 - RNA, 19 nt, Human
accaaacacacccaaaccu

SEQ ID NO: 585587 - RNA, 22 nt, Human
accagaccaaacacacccaaac

SEQ ID NO: 585588 - RNA, 24 nt, Human
agaaaagcaucaacaaaacccagg

SEQ ID NO: 585589 - RNA, 23 nt, Human
agaccaaacacacccaaaccuga

SEQ ID NO: 585590 - RNA, 23 nt, Human
agcuugucacgccuugcaccacg

SEQ ID NO: 585591 - RNA, 19 nt, Human
aggcgugaacugcuguacc

SEQ ID NO: 585592 - RNA, 20 nt, Human
agggaccugagcuggcaggg

SEQ ID NO: 585593 - RNA, 21 nt, Human
agggaccugagcuggcagggg

SEQ ID NO: 585594 - RNA, 21 nt, Human
aggggccaagccuucugcccc

SEQ ID NO: 585595 - RNA, 18 nt, Human
agugcugggauuacaggc

SEQ ID NO: 585596 - RNA, 27 nt, Human
aguggcagggaccugagcuggcagggg

SEQ ID NO: 585597 - RNA, 23 nt, Human
auccacugaguggcagggaccug

SEQ ID NO: 585598 - RNA, 25 nt, Human
caaacuccugggcucaagcgauccu

SEQ ID NO: 585599 - RNA, 19 nt, Human
caaaggauggcgcagcacc

SEQ ID NO: 585600 - RNA, 20 nt, Human
caaagucccauccacugagu

SEQ ID NO: 585601 - RNA, 24 nt, Human
caaagugcugggauuacaggcgug

SEQ ID NO: 585602 - RNA, 21 nt, Human
cacaaaggauggcgcagcacc

SEQ ID NO: 585603 - RNA, 25 nt, Human
cacccaaaccugagaccacagaggc

SEQ ID NO: 585604 - RNA, 20 nt, Human
cagaggccgcccagccgggu

SEQ ID NO: 585605 - RNA, 26 nt, Human
cagcagccccugagccccccgaaucg

SEQ ID NO: 585606 - RNA, 19 nt, Human
cagccccugagcccugacc

SEQ ID NO: 585607 - RNA, 18 nt, Human
caggagcccccgacccgg

SEQ ID NO: 585608 - RNA, 19 nt, Human
caggcugaucucaaacucc

SEQ ID NO: 585609 - RNA, 22 nt, Human
cagggaccuugccccaaagcuc

SEQ ID NO: 585610 - RNA, 23 nt, Human
cagggaccuugccccaaagcucc

SEQ ID NO: 585611 - RNA, 20 nt, Human
ccaaagcuccaauugucagg

SEQ ID NO: 585612 - RNA, 22 nt, Human
ccaaagugcugggauuacaggc

SEQ ID NO: 585613 - RNA, 22 nt, Human
ccaaagugcugggauuacaggc

SEQ ID NO: 585614 - RNA, 24 nt, Human
ccaaagugcugggauuacaggcgu

SEQ ID NO: 585615 - RNA, 21 nt, Human
ccacagaggccgcccagccgg

SEQ ID NO: 585616 - RNA, 18 nt, Human
ccagaccaaacacaccca

SEQ ID NO: 585617 - RNA, 20 nt, Human
ccagaccaaacacacccaaa

SEQ ID NO: 585618 - RNA, 25 nt, Human
ccagaccaaacacacccaaaccuga

SEQ ID NO: 585619 - RNA, 24 nt, Human
ccaucuuggccgcgaagcggggac

SEQ ID NO: 585620 - RNA, 22 nt, Human
cccaaaccugagaccacagagg

SEQ ID NO: 585621 - RNA, 23 nt, Human
cccaaaccugagaccacagaggc

SEQ ID NO: 585622 - RNA, 20 nt, Human
cccaaggccuccgauucgau

SEQ ID NO: 585623 - RNA, 21 nt, Human
cccacacuccgccaaaguccc

SEQ ID NO: 585624 - RNA, 18 nt, Human
cccagggcugcagggacc

SEQ ID NO: 585625 - RNA, 21 nt, Human
ccccacagcuguggggaccua

SEQ ID NO: 585626 - RNA, 23 nt, Human
ccccagggcugcagggaccuggg

SEQ ID NO: 585627 - RNA, 23 nt, Human
ccccugagcccugaccagaccaa

SEQ ID NO: 585628 - RNA, 20 nt, Human
ccccuggcaacacacgccug

SEQ ID NO: 585629 - RNA, 21 nt, Human
ccccugugcuagccccagggc

SEQ ID NO: 585630 - RNA, 20 nt, Human
cccggaacgcccuucccggg

SEQ ID NO: 585631 - RNA, 20 nt, Human
cccugugcuagccccagggc

SEQ ID NO: 585632 - RNA, 21 nt, Human
ccgcccagccggguccacagg

SEQ ID NO: 585633 - RNA, 19 nt, Human
ccggcucccggaacgcccu

SEQ ID NO: 585634 - RNA, 22 nt, Human
ccggcugcuccucccaaggccu

SEQ ID NO: 585635 - RNA, 22 nt, Human
ccuccgauucgaugucccugau

SEQ ID NO: 585636 - RNA, 22 nt, Human
ccugagcuggcaggggccaugc

SEQ ID NO: 585637 - RNA, 26 nt, Human
ccugcaggggccccacacuccgccaa

SEQ ID NO: 585638 - RNA, 21 nt, Human
ccuugcaccacggguggcccc

SEQ ID NO: 585639 - RNA, 19 nt, Human
cgucccccgagccagcccc

SEQ ID NO: 585640 - RNA, 21 nt, Human
cgugaccccuucuccagggac

SEQ ID NO: 585641 - RNA, 18 nt, Human
cucccugcaggggcccca

SEQ ID NO: 585642 - RNA, 23 nt, Human
cuccugggcucaagcgauccucu

SEQ ID NO: 585643 - RNA, 24 nt, Human
cuccugggcucaagcgauccucua

SEQ ID NO: 585644 - RNA, 22 nt, Human
cugagcccugaccagaccaaac

SEQ ID NO: 585645 - RNA, 21 nt, Human
cugcugcaggcagcuuaacug

SEQ ID NO: 585646 - RNA, 20 nt, Human
cuuccuggguuugcugggca

SEQ ID NO: 585647 - RNA, 22 nt, Human
gaaaacgaguacuccauucuua

SEQ ID NO: 585648 - RNA, 21 nt, Human
gaccagcagccccugagcccu

SEQ ID NO: 585649 - RNA, 19 nt, Human
gaccuaggccgagguccgc

SEQ ID NO: 585650 - RNA, 19 nt, Human
gacgccacaccuuccuggg

SEQ ID NO: 585651 - RNA, 20 nt, Human
gagaccacagaggccgccca

SEQ ID NO: 585652 - RNA, 24 nt, Human
gagccccggccagggaggcuucag

SEQ ID NO: 585653 - RNA, 21 nt, Human
gauuacaggcgugaacugcug

SEQ ID NO: 585654 - RNA, 22 nt, Human
gauucacuaaaauucacaaaga

SEQ ID NO: 585655 - RNA, 18 nt, Human
gccagccccacagcugug

SEQ ID NO: 585656 - RNA, 22 nt, Human
gccuuggccucccaaagugcug

SEQ ID NO: 585657 - RNA, 18 nt, Human
ggccaagccuucugcccc

SEQ ID NO: 585658 - RNA, 23 nt, Human
ggguggccccauuguggggacag

SEQ ID NO: 585659 - RNA, 18 nt, Human
gucacgccuugcaccacg

SEQ ID NO: 585660 - RNA, 18 nt, Human
gucccauccacugagugg

SEQ ID NO: 585661 - RNA, 25 nt, Human
guggaccagcagccccugagcccug

SEQ ID NO: 585662 - RNA, 24 nt, Human
guggggacagcaguggccaggcgu

SEQ ID NO: 585663 - RNA, 24 nt, Human
uagacccucccugcaggggcccca

SEQ ID NO: 585664 - RNA, 21 nt, Human
uaggacaaaucucuugaaaac

SEQ ID NO: 585665 - RNA, 27 nt, Human
uaugaaaaaccucgaacaaaggagcca

SEQ ID NO: 585666 - RNA, 23 nt, Human
uauguugcccaggcugaucucaa

SEQ ID NO: 585667 - RNA, 24 nt, Human
uauguugcccaggcugaucucaaa

SEQ ID NO: 585668 - RNA, 20 nt, Human
uccacaggcuuggccagggg

SEQ ID NO: 585669 - RNA, 19 nt, Human
uccaccagccagacguggg

SEQ ID NO: 585670 - RNA, 19 nt, Human
uccagggaccuugccccaa

SEQ ID NO: 585671 - RNA, 24 nt, Human
ucccaaagugcugggauuacaggc

SEQ ID NO: 585672 - RNA, 23 nt, Human
uccccacgugaccccuucuccag

SEQ ID NO: 585673 - RNA, 19 nt, Human
uccgccaaagucccaucca

SEQ ID NO: 585674 - RNA, 19 nt, Human
uccucuagccuuggccucc

SEQ ID NO: 585675 - RNA, 21 nt, Human
uccugggcucaagcgauccuc

SEQ ID NO: 585676 - RNA, 23 nt, Human
ucucaaacuccugggcucaagcg

SEQ ID NO: 585677 - RNA, 19 nt, Human
ucuugguauguugcccagg

SEQ ID NO: 585678 - RNA, 23 nt, Human
ucuugguauguugcccaggcuga

SEQ ID NO: 585679 - RNA, 27 nt, Human
ugaauuauucaucaauacuuggcauaa

SEQ ID NO: 585680 - RNA, 22 nt, Human
ugaccagaccaaacacacccaa

SEQ ID NO: 585681 - RNA, 24 nt, Human
ugaggucuugguauguugcccagg

SEQ ID NO: 585682 - RNA, 19 nt, Human
ugccccuggcaacacacgc

SEQ ID NO: 585683 - RNA, 21 nt, Human
ugccguugauaguuaaggucu

SEQ ID NO: 585684 - RNA, 20 nt, Human
ugcugggauuacaggcguga

SEQ ID NO: 585685 - RNA, 22 nt, Human
ugcugggcagaccuggccucug

SEQ ID NO: 585686 - RNA, 22 nt, Human
uggcagggaccugagcuggcag

SEQ ID NO: 585687 - RNA, 21 nt, Human
uggcaggggccaugcuuagca

SEQ ID NO: 585688 - RNA, 22 nt, Human
uggccucugcagggcagccagc

SEQ ID NO: 585689 - RNA, 19 nt, Human
ugggauuacaggcgugaac

SEQ ID NO: 585690 - RNA, 19 nt, Human
ugggauuacaggcgugaac

SEQ ID NO: 585691 - RNA, 19 nt, Human
ugggauuacaggcgugaac

SEQ ID NO: 585692 - RNA, 19 nt, Human
ugggauuacaggcgugaac

SEQ ID NO: 585693 - RNA, 20 nt, Human
ugggauuacaggcgugaacu

SEQ ID NO: 585694 - RNA, 22 nt, Human
ugggauuacaggcgugaacugc

SEQ ID NO: 585695 - RNA, 24 nt, Human
ugggauuacaggcgugaacugcug

SEQ ID NO: 585696 - RNA, 25 nt, Human
ugggauuacaggcgugaacugcugu

SEQ ID NO: 585697 - RNA, 18 nt, Human
ugggcucaagcgauccuc

SEQ ID NO: 585698 - RNA, 23 nt, Human
ugugcuagccccagggcugcagg

SEQ ID NO: 585699 - RNA, 19 nt, Human
uguggaccagcagccccug

SEQ ID NO: 585700 - RNA, 20 nt, Human
uuagaaaagcaucaacaaaa

SEQ ID NO: 585701 - RNA, 19 nt, Human
uuccuggguuugcugggca

SEQ ID NO: 585702 - RNA, 20 nt, Human
uucgaugucccugauuaagg

SEQ ID NO: 585703 - RNA, 18 nt, Human
uuggccucccaaagugcu

SEQ ID NO: 585704 - RNA, 19 nt, Human
aaaaacccccaacucaggu

SEQ ID NO: 585705 - RNA, 20 nt, Human
aaaaccugacauuccccagg

SEQ ID NO: 585706 - RNA, 18 nt, Human
aaagacaagaagggaaag

SEQ ID NO: 585707 - RNA, 19 nt, Human
aaagugcugggauuacggg

SEQ ID NO: 585708 - RNA, 23 nt, Human
aaagugcugggauuacggguaca

SEQ ID NO: 585709 - RNA, 21 nt, Human
aacaacacagaaaccccccua

SEQ ID NO: 585710 - RNA, 21 nt, Human
aaccgaacagaaaaaccccca

SEQ ID NO: 585711 - RNA, 20 nt, Human
aaccugacauuccccaggga

SEQ ID NO: 585712 - RNA, 21 nt, Human
aagccucacuguguuggccag

SEQ ID NO: 585713 - RNA, 24 nt, Human
aaguagcuggaacuacaggcaugc

SEQ ID NO: 585714 - RNA, 18 nt, Human
aagugcugggauuacggg

SEQ ID NO: 585715 - RNA, 26 nt, Human
aagugcugggauuacggguacaagcc

SEQ ID NO: 585716 - RNA, 19 nt, Human
aaucauagcucacuacagc

SEQ ID NO: 585717 - RNA, 20 nt, Human
acagaaauacaaggggcugg

SEQ ID NO: 585718 - RNA, 21 nt, Human
acccccaacucagguuugcug

SEQ ID NO: 585719 - RNA, 21 nt, Human
accccgguaccccggccuuua

SEQ ID NO: 585720 - RNA, 24 nt, Human
agaaaaacccccaacucagguuug

SEQ ID NO: 585721 - RNA, 21 nt, Human
agaaauacaaggggcuggggc

SEQ ID NO: 585722 - RNA, 18 nt, Human
agacaaagccucacugug

SEQ ID NO: 585723 - RNA, 23 nt, Human
agacaagaagggaaagagaacag

SEQ ID NO: 585724 - RNA, 19 nt, Human
agacagaauaaaaagcaca

SEQ ID NO: 585725 - RNA, 23 nt, Human
agacagccaggacacagugaagc

SEQ ID NO: 585726 - RNA, 20 nt, Human
agacuccaggaggacuccga

SEQ ID NO: 585727 - RNA, 21 nt, Human
agacucccagaccagcccucc

SEQ ID NO: 585728 - RNA, 19 nt, Human
agaguguccuccccagccc

SEQ ID NO: 585729 - RNA, 21 nt, Human
agaguguccuccccagccccg

SEQ ID NO: 585730 - RNA, 19 nt, Human
agccaccacacugggccua

SEQ ID NO: 585731 - RNA, 18 nt, Human
agccucgaccucccaggc

SEQ ID NO: 585732 - RNA, 28 nt, Human
agcucacuacagccucgaccucccaggg

SEQ ID NO: 585733 - RNA, 18 nt, Human
aggcuagaaacgaccaaa

SEQ ID NO: 585734 - RNA, 22 nt, Human
aggggcuggggccugaggcuag

SEQ ID NO: 585735 - RNA, 24 nt, Human
auagcucacuacagccucgaccuc

SEQ ID NO: 585736 - RNA, 21 nt, Human
aucuagaacagaaauacaagg

SEQ ID NO: 585737 - RNA, 23 nt, Human
caaagugcugggauuacggguac

SEQ ID NO: 585738 - RNA, 20 nt, Human
caagcgacucuuacagcccu

SEQ ID NO: 585739 - RNA, 22 nt, Human
caagcgaugcuccugccucggc

SEQ ID NO: 585740 - RNA, 18 nt, Human
caaggggcucagaguguc

SEQ ID NO: 585741 - RNA, 18 nt, Human
caauauuuuuaaagacaa

SEQ ID NO: 585742 - RNA, 18 nt, Human
caaucauagcucacuaca

SEQ ID NO: 585743 - RNA, 25 nt, Human
caccacacugggccuacuucuuuau

SEQ ID NO: 585744 - RNA, 24 nt, Human
caccucagccucacaaguagcugg

SEQ ID NO: 585745 - RNA, 22 nt, Human
cacuacagccucgaccucccag

SEQ ID NO: 585746 - RNA, 21 nt, Human
cacuguguuggccaguugaac

SEQ ID NO: 585747 - RNA, 20 nt, Human
cagaccagcccuccgccccu

SEQ ID NO: 585748 - RNA, 22 nt, Human
cagccaggacacagugaagcag

SEQ ID NO: 585749 - RNA, 22 nt, Human
cagccccuaggauuccugcccu

SEQ ID NO: 585750 - RNA, 22 nt, Human
cagcccuguagccuugccgugu

SEQ ID NO: 585751 - RNA, 21 nt, Human
cagccucgaccucccaggcuc

SEQ ID NO: 585752 - RNA, 24 nt, Human
cagccucgaccucccaggcucaag

SEQ ID NO: 585753 - RNA, 21 nt, Human
cagccucgggggcgccagcag

SEQ ID NO: 585754 - RNA, 21 nt, Human
caggagccggagcgccgcgag

SEQ ID NO: 585755 - RNA, 21 nt, Human
caucuagaacagaaauacaag

SEQ ID NO: 585756 - RNA, 18 nt, Human
ccaaagugcugggauuac

SEQ ID NO: 585757 - RNA, 21 nt, Human
ccaaagugcugggauuacggg

SEQ ID NO: 585758 - RNA, 22 nt, Human
ccaaagugcugggauuacgggu

SEQ ID NO: 585759 - RNA, 19 nt, Human
ccacagaagcuggaccagg

SEQ ID NO: 585760 - RNA, 20 nt, Human
ccacgcgccgcgccccaccc

SEQ ID NO: 585761 - RNA, 21 nt, Human
ccacgcgccgcgccccacccc

SEQ ID NO: 585762 - RNA, 20 nt, Human
ccacuaccccaaggggcugu

SEQ ID NO: 585763 - RNA, 24 nt, Human
ccagaccagcccuccgccccugcc

SEQ ID NO: 585764 - RNA, 23 nt, Human
ccagccuguuuccccaugggcag

SEQ ID NO: 585765 - RNA, 19 nt, Human
ccauuaaaaaaauacugua

SEQ ID NO: 585766 - RNA, 19 nt, Human
cccacacccagccagccau

SEQ ID NO: 585767 - RNA, 20 nt, Human
cccaggcucaagcgauccuc

SEQ ID NO: 585768 - RNA, 21 nt, Human
ccccaccccgguaccccggcc

SEQ ID NO: 585769 - RNA, 20 nt, Human
cccccaacucagguuugcug

SEQ ID NO: 585770 - RNA, 21 nt, Human
ccccgccccuauaucccgggc

SEQ ID NO: 585771 - RNA, 22 nt, Human
ccccgccccuauaucccgggcc

SEQ ID NO: 585772 - RNA, 23 nt, Human
ccccgcccgcguccggccgcucc

SEQ ID NO: 585773 - RNA, 19 nt, Human
ccccuauaucccgggcccu

SEQ ID NO: 585774 - RNA, 22 nt, Human
cccgcccaucugggccccgggc

SEQ ID NO: 585775 - RNA, 19 nt, Human
cccgcuggcccaggacagc

SEQ ID NO: 585776 - RNA, 18 nt, Human
cccgggcccugaaccccg

SEQ ID NO: 585777 - RNA, 18 nt, Human
cccgggcccugagccccg

SEQ ID NO: 585778 - RNA, 24 nt, Human
cccuauaucccgggcccugagccc

SEQ ID NO: 585779 - RNA, 20 nt, Human
ccgccccugcccucaaucuu

SEQ ID NO: 585780 - RNA, 21 nt, Human
ccucccaccucagccucacaa

SEQ ID NO: 585781 - RNA, 26 nt, Human
ccucccaccucagccucacaaguagc

SEQ ID NO: 585782 - RNA, 20 nt, Human
ccucgaccucccaggcucaa

SEQ ID NO: 585783 - RNA, 21 nt, Human
ccugaaccccguccacgcccu

SEQ ID NO: 585784 - RNA, 19 nt, Human
ccugcccucaguucagcac

SEQ ID NO: 585785 - RNA, 23 nt, Human
ccugggcucaagcgaugcuccuc

SEQ ID NO: 585786 - RNA, 23 nt, Human
ccugggcucaagcgaugcuccug

SEQ ID NO: 585787 - RNA, 19 nt, Human
ccuucuuuuccacagaagc

SEQ ID NO: 585788 - RNA, 25 nt, Human
cgaccaaagacagaauaaaaagcac

SEQ ID NO: 585789 - RNA, 25 nt, Human
cgaccucccaggcucaagcgauccu

SEQ ID NO: 585790 - RNA, 23 nt, Human
cgcguccaggcgcccgccccgcc

SEQ ID NO: 585791 - RNA, 23 nt, Human
cggagugcaccaagcucacugug

SEQ ID NO: 585792 - RNA, 19 nt, Human
cggccacgccgccgccguc

SEQ ID NO: 585793 - RNA, 19 nt, Human
cggccuuuaagccccgccu

SEQ ID NO: 585794 - RNA, 23 nt, Human
cgggagggagcgaaucucgggca

SEQ ID NO: 585795 - RNA, 19 nt, Human
cgggcccugagccccgccc

SEQ ID NO: 585796 - RNA, 24 nt, Human
cguccacgcccugcgccccgcccc

SEQ ID NO: 585797 - RNA, 22 nt, Human
cguccaggcgcccgccccgccc

SEQ ID NO: 585798 - RNA, 23 nt, Human
cuacagccucgaccucccaggcu

SEQ ID NO: 585799 - RNA, 27 nt, Human
cucaagcgauccucccaccucagccuc

SEQ ID NO: 585800 - RNA, 18 nt, Human
cucaagcgaugcuccugc

SEQ ID NO: 585801 - RNA, 21 nt, Human
cucagaguguccuccccagcc

SEQ ID NO: 585802 - RNA, 19 nt, Human
cucccagccuguuucccca

SEQ ID NO: 585803 - RNA, 25 nt, Human
cucccaggcucaagcgauccuccca

SEQ ID NO: 585804 - RNA, 22 nt, Human
cucccccgcccaucugggcccc

SEQ ID NO: 585805 - RNA, 22 nt, Human
cucccgcuggcccaggacagcc

SEQ ID NO: 585806 - RNA, 19 nt, Human
cugagaagcaggucacuua

SEQ ID NO: 585807 - RNA, 18 nt, Human
cugaggcuagaaacgacc

SEQ ID NO: 585808 - RNA, 21 nt, Human
cugcagcaucugagccucggu

SEQ ID NO: 585809 - RNA, 23 nt, Human
cugccucggccucccaaagugcu

SEQ ID NO: 585810 - RNA, 24 nt, Human
cugcgccccgccccuauaucccgg

SEQ ID NO: 585811 - RNA, 22 nt, Human
cuuacagcccuguagccuugcc

SEQ ID NO: 585812 - RNA, 27 nt, Human
gaaccccguccacgcccugcgccccgc

SEQ ID NO: 585813 - RNA, 21 nt, Human
gaacucuguccccacuacccc

SEQ ID NO: 585814 - RNA, 22 nt, Human
gaagcccuuccugaacaacacu

SEQ ID NO: 585815 - RNA, 18 nt, Human
gaccugucucugccaaag

SEQ ID NO: 585816 - RNA, 20 nt, Human
gacuccuuccaaguacacac

SEQ ID NO: 585817 - RNA, 18 nt, Human
gauuacggguacaagcca

SEQ ID NO: 585818 - RNA, 19 nt, Human
gcaaagagagguacagccu

SEQ ID NO: 585819 - RNA, 23 nt, Human
gcaaggcagggcccuauuccauc

SEQ ID NO: 585820 - RNA, 20 nt, Human
gcagcagagacagccaggac

SEQ ID NO: 585821 - RNA, 20 nt, Human
gccaguugaacuccugggcu

SEQ ID NO: 585822 - RNA, 18 nt, Human
gcccacgcgccgcgcccc

SEQ ID NO: 585823 - RNA, 21 nt, Human
gcccacgcgccgcgccccacc

SEQ ID NO: 585824 - RNA, 18 nt, Human
gccccgccccuauauccc

SEQ ID NO: 585825 - RNA, 20 nt, Human
gccccgcccgcguccggccg

SEQ ID NO: 585826 - RNA, 21 nt, Human
gcccugaaccccguccacgcc

SEQ ID NO: 585827 - RNA, 23 nt, Human
gcccuggggcaggcacagcgggg

SEQ ID NO: 585828 - RNA, 18 nt, Human
gcccuguagccuugccgu

SEQ ID NO: 585829 - RNA, 22 nt, Human
gcucaagcgauccucccaccuc

SEQ ID NO: 585830 - RNA, 18 nt, Human
gcucacuguggcuugggg

SEQ ID NO: 585831 - RNA, 20 nt, Human
gcucagaguguccuccccag

SEQ ID NO: 585832 - RNA, 18 nt, Human
gcuggcccaggacagccu

SEQ ID NO: 585833 - RNA, 24 nt, Human
ggaaaacagccccuaggauuccug

SEQ ID NO: 585834 - RNA, 22 nt, Human
ggaaggcaaggcaaggcagggc

SEQ ID NO: 585835 - RNA, 20 nt, Human
ggagugcaccaagcucacug

SEQ ID NO: 585836 - RNA, 19 nt, Human
ggauuacggguacaagcca

SEQ ID NO: 585837 - RNA, 27 nt, Human
ggcagcagagacagccaggacacagug

SEQ ID NO: 585838 - RNA, 21 nt, Human
ggcaguaucugaugcucugau

SEQ ID NO: 585839 - RNA, 23 nt, Human
ggcuggggccugaggcuagaaac

SEQ ID NO: 585840 - RNA, 18 nt, Human
ggcuggggccugaggcuc

SEQ ID NO: 585841 - RNA, 18 nt, Human
gggagaaggagaaaagga

SEQ ID NO: 585842 - RNA, 19 nt, Human
gggaugcugccgggaaggc

SEQ ID NO: 585843 - RNA, 21 nt, Human
gggcagcagagacagccagga

SEQ ID NO: 585844 - RNA, 22 nt, Human
gggcucaagcgaugcuccugcc

SEQ ID NO: 585845 - RNA, 20 nt, Human
ggguggggugguggcguggg

SEQ ID NO: 585846 - RNA, 18 nt, Human
gguucuugcaaagagagg

SEQ ID NO: 585847 - RNA, 23 nt, Human
guaaugagaaccgaacagaaaaa

SEQ ID NO: 585848 - RNA, 21 nt, Human
guacacacgaucucccgugua

SEQ ID NO: 585849 - RNA, 24 nt, Human
guguuggccaguugaacuccuggg

SEQ ID NO: 585850 - RNA, 19 nt, Human
uaagccccgccuacauucc

SEQ ID NO: 585851 - RNA, 23 nt, Human
uaauuuuuaaauuuuuaguagag

SEQ ID NO: 585852 - RNA, 24 nt, Human
uaauuuuuaaauuuuuaguagaga

SEQ ID NO: 585853 - RNA, 26 nt, Human
uaauuuuuaaauuuuuaguagagaca

SEQ ID NO: 585854 - RNA, 24 nt, Human
uacaggcaugcgccaccaugccca

SEQ ID NO: 585855 - RNA, 19 nt, Human
uaccccggccuuuaagccc

SEQ ID NO: 585856 - RNA, 22 nt, Human
uacucggggcccacacccagcc

SEQ ID NO: 585857 - RNA, 24 nt, Human
uaguagagacaaagccucacugug

SEQ ID NO: 585858 - RNA, 24 nt, Human
uaucaaagaagcccuuccggacgg

SEQ ID NO: 585859 - RNA, 22 nt, Human
ucaaaaccugacauuccccagg

SEQ ID NO: 585860 - RNA, 19 nt, Human
ucacaaggggcucagagug

SEQ ID NO: 585861 - RNA, 24 nt, Human
ucacaaguagcuggaacuacaggc

SEQ ID NO: 585862 - RNA, 23 nt, Human
ucacuacagccucgaccucccag

SEQ ID NO: 585863 - RNA, 24 nt, Human
ucacuacagccucgaccucccagg

SEQ ID NO: 585864 - RNA, 19 nt, Human
ucagugcacaacugaaggu

SEQ ID NO: 585865 - RNA, 21 nt, Human
ucagugcacaacugaagguca

SEQ ID NO: 585866 - RNA, 18 nt, Human
uccacagaagcuggacca

SEQ ID NO: 585867 - RNA, 18 nt, Human
uccacagaagcuggacca

SEQ ID NO: 585868 - RNA, 18 nt, Human
uccaucugcagcaucuga

SEQ ID NO: 585869 - RNA, 19 nt, Human
uccaucugcagcaucugag

SEQ ID NO: 585870 - RNA, 23 nt, Human
ucccaaagugcugggauuacggg

SEQ ID NO: 585871 - RNA, 21 nt, Human
ucccaggcucaagcgauccuc

SEQ ID NO: 585872 - RNA, 22 nt, Human
ucccgggcccugagccccgccc

SEQ ID NO: 585873 - RNA, 22 nt, Human
uccucccaccucagccucacaa

SEQ ID NO: 585874 - RNA, 21 nt, Human
uccugggcucaagcgaugcuc

SEQ ID NO: 585875 - RNA, 22 nt, Human
uccugggcucaagcgaugcucc

SEQ ID NO: 585876 - RNA, 24 nt, Human
uccugggcucaagcgaugcuccug

SEQ ID NO: 585877 - RNA, 18 nt, Human
ucggccucccaaagugcu

SEQ ID NO: 585878 - RNA, 18 nt, Human
ucugcagcaucugagccu

SEQ ID NO: 585879 - RNA, 21 nt, Human
ucugcagcaucugagccucgg

SEQ ID NO: 585880 - RNA, 23 nt, Human
ucugggccccgggcccugaaccc

SEQ ID NO: 585881 - RNA, 23 nt, Human
ucuuacagcccuguagccuugcc

SEQ ID NO: 585882 - RNA, 18 nt, Human
ugagaagcaggucacuua

SEQ ID NO: 585883 - RNA, 22 nt, Human
ugagauuuucaaaaccugacau

SEQ ID NO: 585884 - RNA, 21 nt, Human
ugcccucaaucucagaauugc

SEQ ID NO: 585885 - RNA, 26 nt, Human
ugcccuggggcaggcacagcggggcu

SEQ ID NO: 585886 - RNA, 21 nt, Human
ugccucggccucccaaagugc

SEQ ID NO: 585887 - RNA, 24 nt, Human
ugccucggccucccaaagugcugg

SEQ ID NO: 585888 - RNA, 21 nt, Human
uggaacuacaggcaugcgcca

SEQ ID NO: 585889 - RNA, 24 nt, Human
uggaacuacaggcaugcgccacca

SEQ ID NO: 585890 - RNA, 19 nt, Human
uggcccaggacagccucgg

SEQ ID NO: 585891 - RNA, 23 nt, Human
uggcccaggacagccucgggggc

SEQ ID NO: 585892 - RNA, 22 nt, Human
ugggauuacggguacaagccac

SEQ ID NO: 585893 - RNA, 24 nt, Human
ugggauuacggguacaagccacca

SEQ ID NO: 585894 - RNA, 22 nt, Human
ugggccccgggcccugaacccc

SEQ ID NO: 585895 - RNA, 21 nt, Human
uggggcaggcacagcggggcu

SEQ ID NO: 585896 - RNA, 18 nt, Human
ugggguggggugguggcg

SEQ ID NO: 585897 - RNA, 21 nt, Human
uguaaacuguacagcagagac

SEQ ID NO: 585898 - RNA, 22 nt, Human
uguacucggggcccacacccag

SEQ ID NO: 585899 - RNA, 21 nt, Human
uguuggccaguugaacuccug

SEQ ID NO: 585900 - RNA, 23 nt, Human
uguuggccaguugaacuccuggg

SEQ ID NO: 585901 - RNA, 23 nt, Human
uuaaauuuuuaguagagacaaag

SEQ ID NO: 585902 - RNA, 25 nt, Human
uuccugaacaacacagaaacccccc

SEQ ID NO: 585903 - RNA, 19 nt, Human
uugcugaacucuggaaagu

SEQ ID NO: 585904 - RNA, 23 nt, Human
uuuccacagaagcuggaccaggu

SEQ ID NO: 585905 - RNA, 26 nt, Human
uuuuuucuuuuuuuuuugagagaggg

SEQ ID NO: 585906 - RNA, 30 nt, Human
uuuuuucuuuuuuuuuugagagaggguguu

SEQ ID NO: 585907 - RNA, 20 nt, Human
uuuuuuucuuuuuuuuuugg

SEQ ID NO: 585908 - RNA, 24 nt, Human
aacugcaaccugacgcagggcccg

SEQ ID NO: 585909 - RNA, 19 nt, Human
cagcuggugggcaaacacu

SEQ ID NO: 585910 - RNA, 23 nt, Human
ccaccuuuauuguguuuccccaa

SEQ ID NO: 585911 - RNA, 19 nt, Human
ccagagcuaaaagugaaac

SEQ ID NO: 585912 - RNA, 23 nt, Human
cgagcaggagcuggaggugccca

SEQ ID NO: 585913 - RNA, 19 nt, Human
cuggcgcgucugcucuccc

SEQ ID NO: 585914 - RNA, 23 nt, Human
gagcuaaaagugaaacugcaacc

SEQ ID NO: 585915 - RNA, 20 nt, Human
gggcuagcagcuggugggca

SEQ ID NO: 585916 - RNA, 26 nt, Human
ggugggcaaacacucugcccugcugg

SEQ ID NO: 585917 - RNA, 22 nt, Human
gugggcaaacacucugcccugc

SEQ ID NO: 585918 - RNA, 19 nt, Human
uagggcuagcagcuggugg

SEQ ID NO: 585919 - RNA, 20 nt, Human
uccccaacuccugggcccca

SEQ ID NO: 585920 - RNA, 18 nt, Human
ucccugggagccguccgg

SEQ ID NO: 585921 - RNA, 19 nt, Human
ugaaacugcaaccugacgc

SEQ ID NO: 585922 - RNA, 22 nt, Human
ugcccagagcuaaaagugaaac

SEQ ID NO: 585923 - RNA, 23 nt, Human
uggcuacugggcuccuggccuuc

SEQ ID NO: 585924 - RNA, 20 nt, Human
uuccccaacuccugggcccc

SEQ ID NO: 585925 - RNA, 25 nt, Human
uuuuuuuuuuccuucguaugccacc

SEQ ID NO: 585926 - RNA, 18 nt, Human
uuuuuuuuuuuuccuucg

SEQ ID NO: 585927 - RNA, 18 nt, Human
uuuuuuuuuuuuuuuuug

SEQ ID NO: 585928 - RNA, 26 nt, Human
uuuuuuuuuuuuuuuuuuugguuuuu

SEQ ID NO: 585929 - RNA, 23 nt, Human
aaacaagccaugaagaagcacac

SEQ ID NO: 585930 - RNA, 19 nt, Human
aagaguaaacaagccauga

SEQ ID NO: 585931 - RNA, 23 nt, Human
aagaguaaacaagccaugaagaa

SEQ ID NO: 585932 - RNA, 24 nt, Human
acaagccaugaagaagcacacagu

SEQ ID NO: 585933 - RNA, 26 nt, Human
acacaguccauggcggccucuccucg

SEQ ID NO: 585934 - RNA, 21 nt, Human
agagagcauuccuucugcccc

SEQ ID NO: 585935 - RNA, 21 nt, Human
agguaggaagcaucaacuucu

SEQ ID NO: 585936 - RNA, 24 nt, Human
aggugccuucuauuugcagauccu

SEQ ID NO: 585937 - RNA, 22 nt, Human
auggcggccucuccucggccug

SEQ ID NO: 585938 - RNA, 25 nt, Human
auggggcauggcggaagccagaguu

SEQ ID NO: 585939 - RNA, 23 nt, Human
cacaguccauggcggccucuccu

SEQ ID NO: 585940 - RNA, 19 nt, Human
caggccccaagcuguaggg

SEQ ID NO: 585941 - RNA, 18 nt, Human
caucacaaaucaaggccu

SEQ ID NO: 585942 - RNA, 19 nt, Human
ccccccagcauggaacccc

SEQ ID NO: 585943 - RNA, 21 nt, Human
ccccccagcauggaacccccg

SEQ ID NO: 585944 - RNA, 19 nt, Human
ccuaaggaacagggaaggg

SEQ ID NO: 585945 - RNA, 18 nt, Human
ccucauuuucucauccca

SEQ ID NO: 585946 - RNA, 22 nt, Human
ccucauuuucucaucccaggcu

SEQ ID NO: 585947 - RNA, 24 nt, Human
cucaaugaggauggucagaggagc

SEQ ID NO: 585948 - RNA, 18 nt, Human
cugagacauggggcaugg

SEQ ID NO: 585949 - RNA, 22 nt, Human
cugcugggccgcuccaacaggu

SEQ ID NO: 585950 - RNA, 22 nt, Human
gaacccccgacuagugcaaccu

SEQ ID NO: 585951 - RNA, 21 nt, Human
gauccugugcucuccuagcac

SEQ ID NO: 585952 - RNA, 22 nt, Human
ggaacagggaagggauucagaa

SEQ ID NO: 585953 - RNA, 20 nt, Human
gguaggaagcaucaacuucu

SEQ ID NO: 585954 - RNA, 21 nt, Human
guagggucugugaaagaagag

SEQ ID NO: 585955 - RNA, 22 nt, Human
gucagaggagcccaggccccaa

SEQ ID NO: 585956 - RNA, 22 nt, Human
guuaagaaaagaggcaaauuug

SEQ ID NO: 585957 - RNA, 21 nt, Human
uaagaaaagaggcaaauuugc

SEQ ID NO: 585958 - RNA, 24 nt, Human
uagcacaucacaaaucaaggccuu

SEQ ID NO: 585959 - RNA, 20 nt, Human
uccgagauacuguuuaugcu

SEQ ID NO: 585960 - RNA, 23 nt, Human
ugaaagaagaguaaacaagccau

SEQ ID NO: 585961 - RNA, 26 nt, Human
ugaaagaagaguaaacaagccaugaa

SEQ ID NO: 585962 - RNA, 21 nt, Human
uggcggccucuccucggccug

SEQ ID NO: 585963 - RNA, 21 nt, Human
uguguuaagaaaagaggcaaa

SEQ ID NO: 585964 - RNA, 20 nt, Human
uguucugcuuccccaguaga

SEQ ID NO: 585965 - RNA, 24 nt, Human
uucacaguggagggaguuucuccc

SEQ ID NO: 585966 - RNA, 21 nt, Human
uucugcuuccccaguagagac

SEQ ID NO: 585967 - RNA, 20 nt, Human
aagccagcuuaucagcaggg

SEQ ID NO: 585968 - RNA, 22 nt, Human
aagccagcuuaucagcagggcg

SEQ ID NO: 585969 - RNA, 24 nt, Human
acugccccgccuccuccuuuuccu

SEQ ID NO: 585970 - RNA, 20 nt, Human
agaaaacaguuccccuccgg

SEQ ID NO: 585971 - RNA, 18 nt, Human
cagugguagcggcccgac

SEQ ID NO: 585972 - RNA, 19 nt, Human
ccccacugccccgccuccu

SEQ ID NO: 585973 - RNA, 23 nt, Human
ccccacugccccgccuccuccuu

SEQ ID NO: 585974 - RNA, 20 nt, Human
ccccgccuccuccuuuuccu

SEQ ID NO: 585975 - RNA, 21 nt, Human
ccccgccuccuccuuuuccua

SEQ ID NO: 585976 - RNA, 21 nt, Human
ccgacccguucuagagacgga

SEQ ID NO: 585977 - RNA, 21 nt, Human
ccggagaaaacaguuccccuc

SEQ ID NO: 585978 - RNA, 18 nt, Human
cgaaggccccacugcccc

SEQ ID NO: 585979 - RNA, 26 nt, Human
cggacagugguagcggcccgacccgu

SEQ ID NO: 585980 - RNA, 21 nt, Human
cugcccccucgcaggugugcc

SEQ ID NO: 585981 - RNA, 18 nt, Human
gcggagcacaccugcccc

SEQ ID NO: 585982 - RNA, 18 nt, Human
gucaguuuaaugaagccg

SEQ ID NO: 585983 - RNA, 19 nt, Human
uccggagaaaacaguuccc

SEQ ID NO: 585984 - RNA, 18 nt, Human
ucgccgccgaaggcccca

SEQ ID NO: 585985 - RNA, 20 nt, Human
uuuuuuuuuuuuuuuuuugg

SEQ ID NO: 585986 - RNA, 19 nt, Human
aaacaagaauuugcccaga

SEQ ID NO: 585987 - RNA, 21 nt, Human
aacucagcaagcuguagaaaa

SEQ ID NO: 585988 - RNA, 26 nt, Human
aagcaaugaagacuccuggauguacc

SEQ ID NO: 585989 - RNA, 21 nt, Human
agacauuccugcacaggagag

SEQ ID NO: 585990 - RNA, 18 nt, Human
agacuccuggauguaccc

SEQ ID NO: 585991 - RNA, 21 nt, Human
agagcagggaggaggcagcgg

SEQ ID NO: 585992 - RNA, 24 nt, Human
agaggagacgggguaauaacagaa

SEQ ID NO: 585993 - RNA, 21 nt, Human
agcaagcuguagaaaauggca

SEQ ID NO: 585994 - RNA, 21 nt, Human
agcucagagacauuccugcac

SEQ ID NO: 585995 - RNA, 22 nt, Human
auacccucccccgcacccacag

SEQ ID NO: 585996 - RNA, 20 nt, Human
caacagugaaggaaggaaaa

SEQ ID NO: 585997 - RNA, 21 nt, Human
caacagugaaggaaggaaaaa

SEQ ID NO: 585998 - RNA, 23 nt, Human
cacacuccauacaucccucugcu

SEQ ID NO: 585999 - RNA, 21 nt, Human
cacccuacggccagcagcuug

SEQ ID NO: 586000 - RNA, 23 nt, Human
cacccuacggccagcagcuuggu

SEQ ID NO: 586001 - RNA, 20 nt, Human
caccucccugugcaccggau

SEQ ID NO: 586002 - RNA, 19 nt, Human
cacuuacaguuuccccacc

SEQ ID NO: 586003 - RNA, 22 nt, Human
cagaaucaguuuacagacuugc

SEQ ID NO: 586004 - RNA, 21 nt, Human
cagcagcagugaggcucagag

SEQ ID NO: 586005 - RNA, 23 nt, Human
caucccucugcucauacccugcc

SEQ ID NO: 586006 - RNA, 21 nt, Human
ccagaagaggacuguggagaa

SEQ ID NO: 586007 - RNA, 18 nt, Human
ccaggaucaugcaggaag

SEQ ID NO: 586008 - RNA, 22 nt, Human
cccacaaaguggacaacgcugg

SEQ ID NO: 586009 - RNA, 23 nt, Human
ccggauacccucccccgcaccca

SEQ ID NO: 586010 - RNA, 29 nt, Human
ccuacaaagccccacaaaguggacaaccg

SEQ ID NO: 586011 - RNA, 21 nt, Human
ccucugaggccuccuuccaga

SEQ ID NO: 586012 - RNA, 20 nt, Human
cgggagggcccaggaucaug

SEQ ID NO: 586013 - RNA, 20 nt, Human
cuaccuacaaagccccacaa

SEQ ID NO: 586014 - RNA, 22 nt, Human
cuaccuacaaagccccacaaag

SEQ ID NO: 586015 - RNA, 20 nt, Human
cucagagucacccacacucc

SEQ ID NO: 586016 - RNA, 21 nt, Human
cuccauacaucccucugcuca

SEQ ID NO: 586017 - RNA, 23 nt, Human
gaagaaacaagaauuugcccaga

SEQ ID NO: 586018 - RNA, 22 nt, Human
gaaucaguuuacagacuugcuc

SEQ ID NO: 586019 - RNA, 20 nt, Human
gagagcagggaggaggcagc

SEQ ID NO: 586020 - RNA, 18 nt, Human
gagcagcagugcccgggg

SEQ ID NO: 586021 - RNA, 19 nt, Human
gaggcagcggaaagguacc

SEQ ID NO: 586022 - RNA, 23 nt, Human
gauacccucccccgcacccacag

SEQ ID NO: 586023 - RNA, 24 nt, Human
gcuccgucuaccuacaaagcccca

SEQ ID NO: 586024 - RNA, 19 nt, Human
ggagacgggguaauaacag

SEQ ID NO: 586025 - RNA, 18 nt, Human
ggagagcagggaggaggc

SEQ ID NO: 586026 - RNA, 21 nt, Human
gucuaccuacaaagccccaca

SEQ ID NO: 586027 - RNA, 21 nt, Human
guggagaaaccucugaggccu

SEQ ID NO: 586028 - RNA, 21 nt, Human
uaauaacagaagcaaugaaga

SEQ ID NO: 586029 - RNA, 22 nt, Human
ucacccacacuccauacauccc

SEQ ID NO: 586030 - RNA, 20 nt, Human
ucccccgcacccacaggggu

SEQ ID NO: 586031 - RNA, 23 nt, Human
ucuacacccaagucuugccaacc

SEQ ID NO: 586032 - RNA, 22 nt, Human
ucuuuacuacaacagugaagga

SEQ ID NO: 586033 - RNA, 24 nt, Human
ugaagaaacaagaauuugcccaga

SEQ ID NO: 586034 - RNA, 22 nt, Human
ugaagacuccuggauguaccca

SEQ ID NO: 586035 - RNA, 19 nt, Human
ugcacaggagagcagggag

SEQ ID NO: 586036 - RNA, 20 nt, Human
ugcccagaagaggacugugg

SEQ ID NO: 586037 - RNA, 22 nt, Human
ugcccagaagaggacuguggag

SEQ ID NO: 586038 - RNA, 23 nt, Human
uuccugcacaggagagcagggag

SEQ ID NO: 586039 - RNA, 24 nt, Human
uuggaaauaagcuacugcauuggu

SEQ ID NO: 586040 - RNA, 20 nt, Human
uuggucuuaagcuaguccgg

SEQ ID NO: 586041 - RNA, 19 nt, Human
uuuuuuuuuuuuuuuuugu

SEQ ID NO: 586042 - RNA, 20 nt, Human
uuuuuuuuuuuuuuuuuugg

SEQ ID NO: 586043 - RNA, 22 nt, Human
aaaacccacauugaaacaaauc

SEQ ID NO: 586044 - RNA, 23 nt, Human
aaacaaaaaacccacauugaaac

SEQ ID NO: 586045 - RNA, 22 nt, Human
aaacaaaacaaaaaacccacau

SEQ ID NO: 586046 - RNA, 19 nt, Human
aaacaaaacaaaacaaaaa

SEQ ID NO: 586047 - RNA, 23 nt, Human
aaacaaaacaaaacaaaaaaccc

SEQ ID NO: 586048 - RNA, 24 nt, Human
aaacaaaacaaaacaaaaaaccca

SEQ ID NO: 586049 - RNA, 19 nt, Human
aaagugcugggauuacaga

SEQ ID NO: 586050 - RNA, 24 nt, Human
aaagugcugggauuacagacguga

SEQ ID NO: 586051 - RNA, 19 nt, Human
aagaauaaaagucccacaa

SEQ ID NO: 586052 - RNA, 19 nt, Human
aagugcugggauuacagac

SEQ ID NO: 586053 - RNA, 26 nt, Human
aagugcugggauuacagacgugagcc

SEQ ID NO: 586054 - RNA, 19 nt, Human
acaaaacaaaacaaaaaac

SEQ ID NO: 586055 - RNA, 22 nt, Human
acaaaacaaaacaaaaaaccca

SEQ ID NO: 586056 - RNA, 19 nt, Human
acaagagccaguugagccc

SEQ ID NO: 586057 - RNA, 18 nt, Human
acagacgugagccaccgc

SEQ ID NO: 586058 - RNA, 21 nt, Human
acgugagccaccgcgcccggc

SEQ ID NO: 586059 - RNA, 24 nt, Human
aguagagacguggguuucaccgug

SEQ ID NO: 586060 - RNA, 24 nt, Human
agugcugggauuacagacgugagc

SEQ ID NO: 586061 - RNA, 22 nt, Human
auaacaaugaaauagauccaaa

SEQ ID NO: 586062 - RNA, 20 nt, Human
auaauccuaaacaaucuuua

SEQ ID NO: 586063 - RNA, 24 nt, Human
caaagugcugggauuacagacgug

SEQ ID NO: 586064 - RNA, 22 nt, Human
caaaucagaaaaaauuaaagca

SEQ ID NO: 586065 - RNA, 26 nt, Human
caauaaacaaaacaaaacaaaaaacc

SEQ ID NO: 586066 - RNA, 24 nt, Human
caccguguaagccacgauggucuu

SEQ ID NO: 586067 - RNA, 25 nt, Human
cagguuaggaaaauauaacacauaa

SEQ ID NO: 586068 - RNA, 22 nt, Human
ccaaagugcugggauuacagac

SEQ ID NO: 586069 - RNA, 24 nt, Human
ccaaagugcugggauuacagacgu

SEQ ID NO: 586070 - RNA, 18 nt, Human
ccaguugauauucccuga

SEQ ID NO: 586071 - RNA, 18 nt, Human
ccgcgcccggccugauua

SEQ ID NO: 586072 - RNA, 18 nt, Human
cucaugauccgccugccu

SEQ ID NO: 586073 - RNA, 24 nt, Human
cuccugaccucaugauccgccugc

SEQ ID NO: 586074 - RNA, 24 nt, Human
cugccucaggcucccaaagugcug

SEQ ID NO: 586075 - RNA, 22 nt, Human
gaccucaugauccgccugccuc

SEQ ID NO: 586076 - RNA, 24 nt, Human
gaccucaugauccgccugccucag

SEQ ID NO: 586077 - RNA, 18 nt, Human
gauuacagacgugagcca

SEQ ID NO: 586078 - RNA, 22 nt, Human
gauuacagacgugagccaccgc

SEQ ID NO: 586079 - RNA, 22 nt, Human
guaaacaaauauuuauuugcaa

SEQ ID NO: 586080 - RNA, 23 nt, Human
gucccuggauugaucuauuuucu

SEQ ID NO: 586081 - RNA, 24 nt, Human
guggguuucaccguguaagccacg

SEQ ID NO: 586082 - RNA, 21 nt, Human
uaaauauauaucuauuuaaag

SEQ ID NO: 586083 - RNA, 22 nt, Human
uaacacauaauccuaaacaauc

SEQ ID NO: 586084 - RNA, 19 nt, Human
uaacacuaucuuauuguga

SEQ ID NO: 586085 - RNA, 23 nt, Human
uacagacgugagccaccgcgccc

SEQ ID NO: 586086 - RNA, 25 nt, Human
uacauuacagugcugcacaaaucuu

SEQ ID NO: 586087 - RNA, 26 nt, Human
uaccaauaaacaaaacaaaacaaaaa

SEQ ID NO: 586088 - RNA, 19 nt, Human
uagagacguggguuucacc

SEQ ID NO: 586089 - RNA, 23 nt, Human
uauuuaaaguuucauccacaagg

SEQ ID NO: 586090 - RNA, 24 nt, Human
ucagaaaaaauuaaagcaugaaca

SEQ ID NO: 586091 - RNA, 19 nt, Human
ucaggcucccaaagugcug

SEQ ID NO: 586092 - RNA, 20 nt, Human
uccaaauauuagaaggagga

SEQ ID NO: 586093 - RNA, 18 nt, Human
ucccaaagugcugggauu

SEQ ID NO: 586094 - RNA, 24 nt, Human
ucccaaagugcugggauuacagac

SEQ ID NO: 586095 - RNA, 25 nt, Human
ucccuggauugaucuauuuucuucc

SEQ ID NO: 586096 - RNA, 21 nt, Human
ucuuccaaauauuagaaggag

SEQ ID NO: 586097 - RNA, 19 nt, Human
ugaaauagauccaaaguuc

SEQ ID NO: 586098 - RNA, 19 nt, Human
ugcauuauucuaaucuagc

SEQ ID NO: 586099 - RNA, 21 nt, Human
ugccucaggcucccaaagugc

SEQ ID NO: 586100 - RNA, 24 nt, Human
ugccucaggcucccaaagugcugg

SEQ ID NO: 586101 - RNA, 24 nt, Human
ugcugggauuacagacgugagcca

SEQ ID NO: 586102 - RNA, 19 nt, Human
uggaaaaacaaagaaugaa

SEQ ID NO: 586103 - RNA, 18 nt, Human
ugggauuacagacgugag

SEQ ID NO: 586104 - RNA, 19 nt, Human
ugggauuacagacgugagc

SEQ ID NO: 586105 - RNA, 21 nt, Human
ugggauuacagacgugagcca

SEQ ID NO: 586106 - RNA, 22 nt, Human
ugggauuacagacgugagccac

SEQ ID NO: 586107 - RNA, 23 nt, Human
ugggauuacagacgugagccacc

SEQ ID NO: 586108 - RNA, 24 nt, Human
ugggauuacagacgugagccaccg

SEQ ID NO: 586109 - RNA, 22 nt, Human
uggguuucaccguguaagccac

SEQ ID NO: 586110 - RNA, 23 nt, Human
uguaccaauugaacaagagccag

SEQ ID NO: 586111 - RNA, 21 nt, Human
uuuauuugcaagcuuuucuua

SEQ ID NO: 586112 - RNA, 21 nt, Human
uuugcaagcuuuucuuaauug

SEQ ID NO: 586113 - RNA, 26 nt, Human
uuuuuaaacccauuccuggguaaaca

SEQ ID NO: 586114 - RNA, 20 nt, Human
aaacaggaaccagccuugcg

SEQ ID NO: 586115 - RNA, 24 nt, Human
aaaguguuaggauuacaugcguga

SEQ ID NO: 586116 - RNA, 20 nt, Human
aacacaaucagcccucaguc

SEQ ID NO: 586117 - RNA, 21 nt, Human
aacauccccacaacacaauca

SEQ ID NO: 586118 - RNA, 19 nt, Human
aagccaguguaaggcgccc

SEQ ID NO: 586119 - RNA, 26 nt, Human
aaguguuaggauuacaugcgugagcc

SEQ ID NO: 586120 - RNA, 23 nt, Human
acagcccaccccucugugguccc

SEQ ID NO: 586121 - RNA, 22 nt, Human
accccccgcugcaugacaaccc

SEQ ID NO: 586122 - RNA, 22 nt, Human
acccgccuuggccucccaaagu

SEQ ID NO: 586123 - RNA, 19 nt, Human
acccuaagcccuucuuccu

SEQ ID NO: 586124 - RNA, 20 nt, Human
acuucuaaccucugccccuu

SEQ ID NO: 586125 - RNA, 19 nt, Human
agaaaacaggaaccagccu

SEQ ID NO: 586126 - RNA, 18 nt, Human
agagaggcagagagacag

SEQ ID NO: 586127 - RNA, 22 nt, Human
agauucuccugccucagccucc

SEQ ID NO: 586128 - RNA, 21 nt, Human
agcccuucuuccuccaggaag

SEQ ID NO: 586129 - RNA, 18 nt, Human
agccuccagaguagcugg

SEQ ID NO: 586130 - RNA, 21 nt, Human
agcuccugcccagcacccucc

SEQ ID NO: 586131 - RNA, 21 nt, Human
agcugggauuacaagcgugca

SEQ ID NO: 586132 - RNA, 22 nt, Human
aggagggagggagccgcugggg

SEQ ID NO: 586133 - RNA, 20 nt, Human
aggcagcuccaaguggcuag

SEQ ID NO: 586134 - RNA, 25 nt, Human
aggcuggagugcaguagcacagucu

SEQ ID NO: 586135 - RNA, 18 nt, Human
agggagggagccgcuggg

SEQ ID NO: 586136 - RNA, 21 nt, Human
agggauucacccgccuuggcc

SEQ ID NO: 586137 - RNA, 23 nt, Human
agggauucacccgccuuggccuc

SEQ ID NO: 586138 - RNA, 19 nt, Human
aguagcugggauuacaagc

SEQ ID NO: 586139 - RNA, 20 nt, Human
agugagcugucagccggcac

SEQ ID NO: 586140 - RNA, 24 nt, Human
agugcaguagcacagucucggcuc

SEQ ID NO: 586141 - RNA, 18 nt, Human
augggguuucgccauguu

SEQ ID NO: 586142 - RNA, 24 nt, Human
augggguuucgccauguugaccag

SEQ ID NO: 586143 - RNA, 19 nt, Human
caaacuccacaccagcacc

SEQ ID NO: 586144 - RNA, 23 nt, Human
caaagcccagaaaacaggaacca

SEQ ID NO: 586145 - RNA, 24 nt, Human
caaagcccagaaaacaggaaccag

SEQ ID NO: 586146 - RNA, 23 nt, Human
caacccccagggucugcuguccu

SEQ ID NO: 586147 - RNA, 22 nt, Human
caagagauucuccugccucagc

SEQ ID NO: 586148 - RNA, 19 nt, Human
caaggacuuucaaggccuc

SEQ ID NO: 586149 - RNA, 20 nt, Human
caaggccuccacugcccccu

SEQ ID NO: 586150 - RNA, 25 nt, Human
caaucagcccucagucccuccccaa

SEQ ID NO: 586151 - RNA, 23 nt, Human
cacagcccaccccucuguggucc

SEQ ID NO: 586152 - RNA, 26 nt, Human
cacagcccaccccucuguggucccga

SEQ ID NO: 586153 - RNA, 20 nt, Human
cacaggcugggaggcugggc

SEQ ID NO: 586154 - RNA, 24 nt, Human
caccauaccuggcuaauuuuugua

SEQ ID NO: 586155 - RNA, 19 nt, Human
caccccccgcugcaugaca

SEQ ID NO: 586156 - RNA, 23 nt, Human
cacccgccuuggccucccaaagu

SEQ ID NO: 586157 - RNA, 24 nt, Human
cacccgccuuggccucccaaagug

SEQ ID NO: 586158 - RNA, 21 nt, Human
cacugcaaccucugccucccg

SEQ ID NO: 586159 - RNA, 23 nt, Human
cacugcaaccucugccucccggg

SEQ ID NO: 586160 - RNA, 18 nt, Human
cacugugcuugcaugggg

SEQ ID NO: 586161 - RNA, 18 nt, Human
cagaaccacugucucccu

SEQ ID NO: 586162 - RNA, 25 nt, Human
cagagcuggguccagaaaccaagau

SEQ ID NO: 586163 - RNA, 22 nt, Human
cagcacccgcaaggcaaggaga

SEQ ID NO: 586164 - RNA, 18 nt, Human
cagcccaccccucugugg

SEQ ID NO: 586165 - RNA, 19 nt, Human
cagccccaggccagcuccu

SEQ ID NO: 586166 - RNA, 22 nt, Human
cagcuccugcccagcacccucc

SEQ ID NO: 586167 - RNA, 20 nt, Human
caggagaaagagaggcagag

SEQ ID NO: 586168 - RNA, 20 nt, Human
caggcccagccagcagggcc

SEQ ID NO: 586169 - RNA, 24 nt, Human
caguagagaugggguuucgccaug

SEQ ID NO: 586170 - RNA, 18 nt, Human
caguagcacagucucggc

SEQ ID NO: 586171 - RNA, 18 nt, Human
cagucccuccccaaaugc

SEQ ID NO: 586172 - RNA, 19 nt, Human
ccaaaguguuaggauuaca

SEQ ID NO: 586173 - RNA, 24 nt, Human
ccaaaguguuaggauuacaugcgu

SEQ ID NO: 586174 - RNA, 21 nt, Human
ccacugcccccuacugacagg

SEQ ID NO: 586175 - RNA, 23 nt, Human
ccagaaccacugucucccuccuc

SEQ ID NO: 586176 - RNA, 19 nt, Human
ccagaguagcugggauuac

SEQ ID NO: 586177 - RNA, 23 nt, Human
ccagaguagcugggauuacaagc

SEQ ID NO: 586178 - RNA, 21 nt, Human
ccagcuccugucuccagaacc

SEQ ID NO: 586179 - RNA, 20 nt, Human
ccaggcccagccagcagggc

SEQ ID NO: 586180 - RNA, 19 nt, Human
cccaaauuuguccccaauu

SEQ ID NO: 586181 - RNA, 20 nt, Human
cccaccccucuguggucccg

SEQ ID NO: 586182 - RNA, 20 nt, Human
cccagcacccuccagcucaa

SEQ ID NO: 586183 - RNA, 25 nt, Human
cccauggaacccagaagcaucuaaa

SEQ ID NO: 586184 - RNA, 20 nt, Human
cccauggguggcucuaaccu

SEQ ID NO: 586185 - RNA, 23 nt, Human
cccauggugaauaccaucagagc

SEQ ID NO: 586186 - RNA, 21 nt, Human
ccccaccgaacuguuggccuu

SEQ ID NO: 586187 - RNA, 18 nt, Human
ccccagggucugcugucc

SEQ ID NO: 586188 - RNA, 21 nt, Human
cccccgcugcaugacaacccc

SEQ ID NO: 586189 - RNA, 23 nt, Human
ccccuggguccccgcagcucagg

SEQ ID NO: 586190 - RNA, 23 nt, Human
cccggguucaagagauucuccug

SEQ ID NO: 586191 - RNA, 22 nt, Human
cccugagcacagcccaccccuc

SEQ ID NO: 586192 - RNA, 19 nt, Human
cccuggguccccgcagcuc

SEQ ID NO: 586193 - RNA, 24 nt, Human
ccucccggguucaagagauucucc

SEQ ID NO: 586194 - RNA, 26 nt, Human
ccuggccaagcagaugaaaaguucca

SEQ ID NO: 586195 - RNA, 20 nt, Human
ccuggguccccgcagcucag

SEQ ID NO: 586196 - RNA, 21 nt, Human
ccuggguccccgcagcucagg

SEQ ID NO: 586197 - RNA, 19 nt, Human
ccuugcgccuccucucccc

SEQ ID NO: 586198 - RNA, 20 nt, Human
ccuugcgccuccucucccca

SEQ ID NO: 586199 - RNA, 22 nt, Human
ccuugcgccuccucuccccacc

SEQ ID NO: 586200 - RNA, 24 nt, Human
cgccauguugaccagccuggucuu

SEQ ID NO: 586201 - RNA, 21 nt, Human
cggaguauugcucuguugccc

SEQ ID NO: 586202 - RNA, 23 nt, Human
cgugcaccaccauaccuggcuaa

SEQ ID NO: 586203 - RNA, 23 nt, Human
cuaauuuuuguauuuucaguaga

SEQ ID NO: 586204 - RNA, 24 nt, Human
cucacugcaaccucugccucccgg

SEQ ID NO: 586205 - RNA, 24 nt, Human
cucagccuccagaguagcugggau

SEQ ID NO: 586206 - RNA, 22 nt, Human
cuccacaccagcacccuaagcc

SEQ ID NO: 586207 - RNA, 26 nt, Human
cuccacaccagcacccuaagcccuuc

SEQ ID NO: 586208 - RNA, 21 nt, Human
cuccagaaccacugucucccu

SEQ ID NO: 586209 - RNA, 21 nt, Human
cuccaggaaggagacuguccc

SEQ ID NO: 586210 - RNA, 19 nt, Human
cuccugcccagcacccucc

SEQ ID NO: 586211 - RNA, 23 nt, Human
cucuaaccucccuccuuccagcu

SEQ ID NO: 586212 - RNA, 19 nt, Human
cugcaaccucugccucccg

SEQ ID NO: 586213 - RNA, 23 nt, Human
cugcaaccucugccucccggguu

SEQ ID NO: 586214 - RNA, 24 nt, Human
cugcaaccucugccucccggguuc

SEQ ID NO: 586215 - RNA, 23 nt, Human
cugccucagccuccagaguagcu

SEQ ID NO: 586216 - RNA, 24 nt, Human
cuggccagacacaggccuacucca

SEQ ID NO: 586217 - RNA, 23 nt, Human
cuggcggggggaggguggccagc

SEQ ID NO: 586218 - RNA, 19 nt, Human
cuggguccccgcagcucag

SEQ ID NO: 586219 - RNA, 19 nt, Human
cuguugcccaggcuggagu

SEQ ID NO: 586220 - RNA, 25 nt, Human
gacaaccccaggaaaaagggaacgc

SEQ ID NO: 586221 - RNA, 21 nt, Human
gacagccaugagcugggagga

SEQ ID NO: 586222 - RNA, 18 nt, Human
gagaaagagaggcagaga

SEQ ID NO: 586223 - RNA, 22 nt, Human
gagacuuuccagggacagauuu

SEQ ID NO: 586224 - RNA, 20 nt, Human
gagaugggguuucgccaugu

SEQ ID NO: 586225 - RNA, 24 nt, Human
gaguagcugggauuacaagcgugc

SEQ ID NO: 586226 - RNA, 24 nt, Human
gauuacaagcgugcaccaccauac

SEQ ID NO: 586227 - RNA, 18 nt, Human
gauuacaugcgugagcca

SEQ ID NO: 586228 - RNA, 22 nt, Human
gauucacccgccuuggccuccc

SEQ ID NO: 586229 - RNA, 23 nt, Human
gcacccuaagcccuucuuccucc

SEQ ID NO: 586230 - RNA, 21 nt, Human
gcaugacaaccccaggaaaaa

SEQ ID NO: 586231 - RNA, 19 nt, Human
gccccuuggcaucaccugg

SEQ ID NO: 586232 - RNA, 20 nt, Human
gccuccucuccccaccgaac

SEQ ID NO: 586233 - RNA, 22 nt, Human
gcucacuugaaaaccaggccca

SEQ ID NO: 586234 - RNA, 19 nt, Human
gcucuguugcccaggcugg

SEQ ID NO: 586235 - RNA, 20 nt, Human
gcucuguugcccaggcugga

SEQ ID NO: 586236 - RNA, 25 nt, Human
gcucuguugcccaggcuggagugca

SEQ ID NO: 586237 - RNA, 19 nt, Human
gcuggagugcaguagcaca

SEQ ID NO: 586238 - RNA, 24 nt, Human
gcugggagggcagccccaggccag

SEQ ID NO: 586239 - RNA, 22 nt, Human
ggagaaagagaggcagagagac

SEQ ID NO: 586240 - RNA, 20 nt, Human
ggagaacaggggcugggagg

SEQ ID NO: 586241 - RNA, 20 nt, Human
ggagggagccgcugggggug

SEQ ID NO: 586242 - RNA, 21 nt, Human
ggagggagggagccgcugggg

SEQ ID NO: 586243 - RNA, 24 nt, Human
ggagggagggagccgcugggggug

SEQ ID NO: 586244 - RNA, 18 nt, Human
ggagggcagccccaggcc

SEQ ID NO: 586245 - RNA, 22 nt, Human
ggauuacaugcgugagccacca

SEQ ID NO: 586246 - RNA, 21 nt, Human
ggcugcucugcgggcccuugc

SEQ ID NO: 586247 - RNA, 22 nt, Human
ggcugggagggcagccccaggc

SEQ ID NO: 586248 - RNA, 24 nt, Human
ggcugggagggcagccccaggcca

SEQ ID NO: 586249 - RNA, 18 nt, Human
gggcagccccaggccagc

SEQ ID NO: 586250 - RNA, 23 nt, Human
gggcugggagggcagccccaggc

SEQ ID NO: 586251 - RNA, 22 nt, Human
gggguuucgccauguugaccag

SEQ ID NO: 586252 - RNA, 19 nt, Human
ggguuccuccaccccccgc

SEQ ID NO: 586253 - RNA, 19 nt, Human
ggucuugaacuccugaccu

SEQ ID NO: 586254 - RNA, 19 nt, Human
ggucuugaacuccugaccu

SEQ ID NO: 586255 - RNA, 23 nt, Human
guagagaugggguuucgccaugu

SEQ ID NO: 586256 - RNA, 25 nt, Human
guagcccaggcggacggugaugucc

SEQ ID NO: 586257 - RNA, 18 nt, Human
guagcugggauuacaagc

SEQ ID NO: 586258 - RNA, 19 nt, Human
gucccgagucucagcucug

SEQ ID NO: 586259 - RNA, 23 nt, Human
guggguucagccaggguuugugu

SEQ ID NO: 586260 - RNA, 23 nt, Human
guuucgccauguugaccagccug

SEQ ID NO: 586261 - RNA, 19 nt, Human
uaaccucugccccuuggca

SEQ ID NO: 586262 - RNA, 21 nt, Human
uaaccucugccccuuggcauc

SEQ ID NO: 586263 - RNA, 18 nt, Human
uaaggcgcccauggaacc

SEQ ID NO: 586264 - RNA, 24 nt, Human
uaauuuuuguauuuucaguagaga

SEQ ID NO: 586265 - RNA, 20 nt, Human
uacauuauaucauuaaaucc

SEQ ID NO: 586266 - RNA, 28 nt, Human
uacuccacaggcugggaggcuggggcca

SEQ ID NO: 586267 - RNA, 22 nt, Human
uagagaugggguuucgccaugu

SEQ ID NO: 586268 - RNA, 21 nt, Human
uagcaggagaaagagaggcag

SEQ ID NO: 586269 - RNA, 22 nt, Human
uagcaggagaaagagaggcaga

SEQ ID NO: 586270 - RNA, 22 nt, Human
uaggauuacaugcgugagccac

SEQ ID NO: 586271 - RNA, 24 nt, Human
uaggauuacaugcgugagccacca

SEQ ID NO: 586272 - RNA, 19 nt, Human
uauugcucuguugcccagg

SEQ ID NO: 586273 - RNA, 23 nt, Human
uauugcucuguugcccaggcugg

SEQ ID NO: 586274 - RNA, 24 nt, Human
uauugcucuguugcccaggcugga

SEQ ID NO: 586275 - RNA, 18 nt, Human
ucaaaguccucuccaagg

SEQ ID NO: 586276 - RNA, 24 nt, Human
ucacugcaaccucugccucccggg

SEQ ID NO: 586277 - RNA, 25 nt, Human
ucacugcaaccucugccucccgggu

SEQ ID NO: 586278 - RNA, 18 nt, Human
ucaguagagaugggguuu

SEQ ID NO: 586279 - RNA, 24 nt, Human
ucaguagagaugggguuucgccau

SEQ ID NO: 586280 - RNA, 21 nt, Human
ucagucccuccccaaaugcaa

SEQ ID NO: 586281 - RNA, 24 nt, Human
uccaaggacuuucaaggccuccac

SEQ ID NO: 586282 - RNA, 22 nt, Human
uccaaguggcuaggaucuggcu

SEQ ID NO: 586283 - RNA, 18 nt, Human
ucccaaaguguuaggauu

SEQ ID NO: 586284 - RNA, 19 nt, Human
uccccaaauuuguccccaa

SEQ ID NO: 586285 - RNA, 23 nt, Human
uccccuguucccuuucgaucaaa

SEQ ID NO: 586286 - RNA, 21 nt, Human
ucccggguucaagagauucuc

SEQ ID NO: 586287 - RNA, 24 nt, Human
ucccggguucaagagauucuccug

SEQ ID NO: 586288 - RNA, 25 nt, Human
uccucuggccacaaagcgaggcugg

SEQ ID NO: 586289 - RNA, 22 nt, Human
ucgccauguugaccagccuggu

SEQ ID NO: 586290 - RNA, 19 nt, Human
ucuaagacccccugggucc

SEQ ID NO: 586291 - RNA, 19 nt, Human
ucucccuccucuggccacc

SEQ ID NO: 586292 - RNA, 24 nt, Human
ucuccugccucagccuccagagua

SEQ ID NO: 586293 - RNA, 22 nt, Human
ucucugauucucugccaacauc

SEQ ID NO: 586294 - RNA, 18 nt, Human
ucuguugcccaggcugga

SEQ ID NO: 586295 - RNA, 24 nt, Human
ucuguugcccaggcuggagugcag

SEQ ID NO: 586296 - RNA, 21 nt, Human
ucuugaacuccugaccuuaag

SEQ ID NO: 586297 - RNA, 22 nt, Human
ugaaagcacugugcuugcaugg

SEQ ID NO: 586298 - RNA, 24 nt, Human
ugaccagccuggucuugaacuccu

SEQ ID NO: 586299 - RNA, 18 nt, Human
ugagcacagcccaccccu

SEQ ID NO: 586300 - RNA, 19 nt, Human
ugagcugggagaacagggg

SEQ ID NO: 586301 - RNA, 20 nt, Human
ugagcugggagaacaggggc

SEQ ID NO: 586302 - RNA, 23 nt, Human
ugagcugggagaacaggggcugg

SEQ ID NO: 586303 - RNA, 20 nt, Human
ugagcugggaggauccaguu

SEQ ID NO: 586304 - RNA, 22 nt, Human
ugcaguagcacagucucggcuc

SEQ ID NO: 586305 - RNA, 18 nt, Human
ugcccaggcuggagugca

SEQ ID NO: 586306 - RNA, 19 nt, Human
ugcccaggcuggagugcag

SEQ ID NO: 586307 - RNA, 18 nt, Human
ugccccauccgcuguguu

SEQ ID NO: 586308 - RNA, 24 nt, Human
ugccucagccuccagaguagcugg

SEQ ID NO: 586309 - RNA, 18 nt, Human
ugcucugcgggcccuugc

SEQ ID NO: 586310 - RNA, 24 nt, Human
ugcucuguugcccaggcuggagug

SEQ ID NO: 586311 - RNA, 22 nt, Human
ugcuucaaaguccucuccaagg

SEQ ID NO: 586312 - RNA, 21 nt, Human
uggagcuggcggggggagggu

SEQ ID NO: 586313 - RNA, 24 nt, Human
uggagugcaguagcacagucucgg

SEQ ID NO: 586314 - RNA, 19 nt, Human
ugggagaacaggggcuggg

SEQ ID NO: 586315 - RNA, 23 nt, Human
ugggaggauccaguucuguagca

SEQ ID NO: 586316 - RNA, 21 nt, Human
ugggauuacaagcgugcacca

SEQ ID NO: 586317 - RNA, 24 nt, Human
ugggauuacaagcgugcaccacca

SEQ ID NO: 586318 - RNA, 25 nt, Human
ugggauuacaagcgugcaccaccau

SEQ ID NO: 586319 - RNA, 26 nt, Human
uggggauggagcuggcggggggaggg

SEQ ID NO: 586320 - RNA, 18 nt, Human
ugggguuucgccauguug

SEQ ID NO: 586321 - RNA, 21 nt, Human
uggguggcucuaaccucccuc

SEQ ID NO: 586322 - RNA, 18 nt, Human
uggguuccuccacccccc

SEQ ID NO: 586323 - RNA, 19 nt, Human
uggguuccuccaccccccg

SEQ ID NO: 586324 - RNA, 18 nt, Human
ugucaacauggcucugcu

SEQ ID NO: 586325 - RNA, 18 nt, Human
uucaagagauucuccugc

SEQ ID NO: 586326 - RNA, 23 nt, Human
uucaagagauucuccugccucag

SEQ ID NO: 586327 - RNA, 19 nt, Human
uucaaggccuccacugccc

SEQ ID NO: 586328 - RNA, 20 nt, Human
uucaaggccuccacugcccc

SEQ ID NO: 586329 - RNA, 24 nt, Human
uugcccaggcuggagugcaguagc

SEQ ID NO: 586330 - RNA, 20 nt, Human
uugcucuguugcccaggcug

SEQ ID NO: 586331 - RNA, 20 nt, Human
uugcucuguugcccaggcug

SEQ ID NO: 586332 - RNA, 22 nt, Human
uugcucuguugcccaggcugga

SEQ ID NO: 586333 - RNA, 21 nt, Human
uuggccucccaaaguguuagg

SEQ ID NO: 586334 - RNA, 23 nt, Human
uuucaaggccuccacugcccccu

SEQ ID NO: 586335 - RNA, 23 nt, Human
uuuccagagcuggguccagaaac

SEQ ID NO: 586336 - RNA, 21 nt, Human
uuucgccauguugaccagccu

SEQ ID NO: 586337 - RNA, 22 nt, Human
uuuucaguagagaugggguuuc

SEQ ID NO: 586338 - RNA, 23 nt, Human
uuuucaguagagaugggguuucg

SEQ ID NO: 586339 - RNA, 20 nt, Human
uuuuuguauuuucaguagag

SEQ ID NO: 586340 - RNA, 23 nt, Human
uuuuuguauuuucaguagagaug

SEQ ID NO: 586341 - RNA, 25 nt, Human
aaaaagccagaaaaacaccaagaua

SEQ ID NO: 586342 - RNA, 26 nt, Human
aaaaagccagaaaaacaccaagauac

SEQ ID NO: 586343 - RNA, 20 nt, Human
aaacaccaagauacaggucu

SEQ ID NO: 586344 - RNA, 20 nt, Human
aagacaggaggcgaaagggu

SEQ ID NO: 586345 - RNA, 21 nt, Human
aagcagaaagacaggaggcga

SEQ ID NO: 586346 - RNA, 21 nt, Human
aagccagaaaaacaccaagau

SEQ ID NO: 586347 - RNA, 23 nt, Human
aauaaauagaaaaaaaguuacaa

SEQ ID NO: 586348 - RNA, 22 nt, Human
accagcagcccaagcacacacc

SEQ ID NO: 586349 - RNA, 20 nt, Human
acccacccccgacccgcgcc

SEQ ID NO: 586350 - RNA, 19 nt, Human
agaaagacaggaggcgaaa

SEQ ID NO: 586351 - RNA, 18 nt, Human
agacaggaggcgaaaggg

SEQ ID NO: 586352 - RNA, 18 nt, Human
agagcaagggugggggac

SEQ ID NO: 586353 - RNA, 23 nt, Human
agaugugggggugacuugggggg

SEQ ID NO: 586354 - RNA, 19 nt, Human
agccgggcuccuucccuga

SEQ ID NO: 586355 - RNA, 23 nt, Human
aggugagaagagagggcagcgag

SEQ ID NO: 586356 - RNA, 23 nt, Human
agugggggugagccaaugguccu

SEQ ID NO: 586357 - RNA, 24 nt, Human
augcaccccagucucaaaauaaaa

SEQ ID NO: 586358 - RNA, 23 nt, Human
augugggggugacuugggggggu

SEQ ID NO: 586359 - RNA, 18 nt, Human
caaggugggggaaaggaa

SEQ ID NO: 586360 - RNA, 19 nt, Human
cacaccccuuccaggcuuc

SEQ ID NO: 586361 - RNA, 23 nt, Human
cagccgggcuccuucccugacuu

SEQ ID NO: 586362 - RNA, 23 nt, Human
cagccucccuccuggagcccaag

SEQ ID NO: 586363 - RNA, 23 nt, Human
caggaugcugcucccccugcccc

SEQ ID NO: 586364 - RNA, 22 nt, Human
caguauggcuucugcuucugga

SEQ ID NO: 586365 - RNA, 24 nt, Human
ccaacccugagcccacccugggac

SEQ ID NO: 586366 - RNA, 23 nt, Human
ccacuuuggagguggcauaaugg

SEQ ID NO: 586367 - RNA, 22 nt, Human
ccagaaaaacaccaagauacag

SEQ ID NO: 586368 - RNA, 24 nt, Human
cccaacccugagcccacccuggga

SEQ ID NO: 586369 - RNA, 20 nt, Human
cccacgcaccccacuguccc

SEQ ID NO: 586370 - RNA, 20 nt, Human
ccccaacccugagcccaccc

SEQ ID NO: 586371 - RNA, 19 nt, Human
cccccaucuccagccgggc

SEQ ID NO: 586372 - RNA, 20 nt, Human
cccccugcccccaucuccag

SEQ ID NO: 586373 - RNA, 18 nt, Human
cccccugcccuccuuccc

SEQ ID NO: 586374 - RNA, 19 nt, Human
cccccugcccuccuucccg

SEQ ID NO: 586375 - RNA, 23 nt, Human
cccccugcccuccuucccguccg

SEQ ID NO: 586376 - RNA, 19 nt, Human
cccgcgcccccugcccucc

SEQ ID NO: 586377 - RNA, 24 nt, Human
cccgcuccgcuucgccggcucccg

SEQ ID NO: 586378 - RNA, 19 nt, Human
cccuccuucccguccgucc

SEQ ID NO: 586379 - RNA, 25 nt, Human
cccugagcaguagggggugggggag

SEQ ID NO: 586380 - RNA, 22 nt, Human
cccugagcccacccugggaccc

SEQ ID NO: 586381 - RNA, 23 nt, Human
cccugagcccacccugggacccu

SEQ ID NO: 586382 - RNA, 19 nt, Human
cccugcccccaucuccagc

SEQ ID NO: 586383 - RNA, 22 nt, Human
cccugggacccuagugcccaag

SEQ ID NO: 586384 - RNA, 20 nt, Human
ccgcgccgggccggcagggu

SEQ ID NO: 586385 - RNA, 21 nt, Human
ccgggaccccuaccgcaccca

SEQ ID NO: 586386 - RNA, 21 nt, Human
ccuaccgcacccacccccgac

SEQ ID NO: 586387 - RNA, 21 nt, Human
ccucccagccucccuccugga

SEQ ID NO: 586388 - RNA, 26 nt, Human
ccucccagccucccuccuggagccca

SEQ ID NO: 586389 - RNA, 20 nt, Human
ccucuuuggggggcucgguc

SEQ ID NO: 586390 - RNA, 21 nt, Human
ccugccucccagccucccucc

SEQ ID NO: 586391 - RNA, 19 nt, Human
ccuggagcccaagccaguc

SEQ ID NO: 586392 - RNA, 19 nt, Human
ccugggacccuagugccca

SEQ ID NO: 586393 - RNA, 19 nt, Human
ccuuggccacccagggugg

SEQ ID NO: 586394 - RNA, 21 nt, Human
cggcucccgcgcccccugccc

SEQ ID NO: 586395 - RNA, 25 nt, Human
cggcucccgcgcccccugcccuccu

SEQ ID NO: 586396 - RNA, 18 nt, Human
cuccgcuucgccggcucc

SEQ ID NO: 586397 - RNA, 18 nt, Human
cuccucccugggucaagg

SEQ ID NO: 586398 - RNA, 19 nt, Human
cucugcgcucggccgcccc

SEQ ID NO: 586399 - RNA, 18 nt, Human
cuuccaggcuucugggug

SEQ ID NO: 586400 - RNA, 23 nt, Human
cuuccccaacccugagcccaccc

SEQ ID NO: 586401 - RNA, 20 nt, Human
cuucuggguggcaguauggc

SEQ ID NO: 586402 - RNA, 22 nt, Human
cuuuccuuuccagaucgggggu

SEQ ID NO: 586403 - RNA, 20 nt, Human
cuuuuggggugcccaaagug

SEQ ID NO: 586404 - RNA, 21 nt, Human
gaaaaaaaaaaaggaaaagga

SEQ ID NO: 586405 - RNA, 27 nt, Human
gaaaaagccagaaaaacaccaagauac

SEQ ID NO: 586406 - RNA, 21 nt, Human
gaggcugaggccugaggccuc

SEQ ID NO: 586407 - RNA, 22 nt, Human
gauccccacucccacgcacccc

SEQ ID NO: 586408 - RNA, 23 nt, Human
gaugaaggggcgaagcagaaaga

SEQ ID NO: 586409 - RNA, 19 nt, Human
gaugcugcucccccugccc

SEQ ID NO: 586410 - RNA, 21 nt, Human
gcccaagccagucuggguaag

SEQ ID NO: 586411 - RNA, 21 nt, Human
gcccaagccagucuggguaag

SEQ ID NO: 586412 - RNA, 22 nt, Human
gccccgggaccccuaccgcacc

SEQ ID NO: 586413 - RNA, 22 nt, Human
gcccugagcaguaggggguggg

SEQ ID NO: 586414 - RNA, 18 nt, Human
gccggcucccgcgccccc

SEQ ID NO: 586415 - RNA, 24 nt, Human
gcgaagcagaaagacaggaggagg

SEQ ID NO: 586416 - RNA, 20 nt, Human
gcgaggacuuccccaacccu

SEQ ID NO: 586417 - RNA, 18 nt, Human
gcgcccccugcccuccuu

SEQ ID NO: 586418 - RNA, 24 nt, Human
gcucuggagaugcaccccagucuc

SEQ ID NO: 586419 - RNA, 18 nt, Human
ggaaaaggacauguaaua

SEQ ID NO: 586420 - RNA, 22 nt, Human
ggaccccuaccgcacccacccc

SEQ ID NO: 586421 - RNA, 23 nt, Human
ggaccccuaccgcacccaccccc

SEQ ID NO: 586422 - RNA, 18 nt, Human
ggacccuuggccacccag

SEQ ID NO: 586423 - RNA, 27 nt, Human
ggcccggccggggccaggggagguccu

SEQ ID NO: 586424 - RNA, 20 nt, Human
ggccugaggccucuucaauu

SEQ ID NO: 586425 - RNA, 21 nt, Human
ggcgaagcagaaagacaggag

SEQ ID NO: 586426 - RNA, 20 nt, Human
gggaaaaugugcuacauuga

SEQ ID NO: 586427 - RNA, 18 nt, Human
gggccggcagggugaugc

SEQ ID NO: 586428 - RNA, 23 nt, Human
gggcggggccucuuuggggggcu

SEQ ID NO: 586429 - RNA, 19 nt, Human
gggggugagguaugaggcu

SEQ ID NO: 586430 - RNA, 19 nt, Human
ggugaaaaagccagaaaaa

SEQ ID NO: 586431 - RNA, 19 nt, Human
guccuggcugggcagccac

SEQ ID NO: 586432 - RNA, 23 nt, Human
gugaaaaagccagaaaaacacca

SEQ ID NO: 586433 - RNA, 20 nt, Human
guggcucuggagaugcaccc

SEQ ID NO: 586434 - RNA, 19 nt, Human
uaagaugaaggggcgaagc

SEQ ID NO: 586435 - RNA, 19 nt, Human
uacaccguucaauaaauag

SEQ ID NO: 586436 - RNA, 19 nt, Human
uaccgcacccacccccgac

SEQ ID NO: 586437 - RNA, 26 nt, Human
uaccgcacccacccccgacccgcgcc

SEQ ID NO: 586438 - RNA, 21 nt, Human
uauggcuucugcuucuggagu

SEQ ID NO: 586439 - RNA, 22 nt, Human
ucaaggugggggaaaggaagga

SEQ ID NO: 586440 - RNA, 19 nt, Human
ucccagccucccuccugga

SEQ ID NO: 586441 - RNA, 24 nt, Human
uccccaacccugagcccacccugg

SEQ ID NO: 586442 - RNA, 19 nt, Human
uccccacucccacgcaccc

SEQ ID NO: 586443 - RNA, 19 nt, Human
ucccccugcccccaucucc

SEQ ID NO: 586444 - RNA, 18 nt, Human
ucgccggcucccgcgccc

SEQ ID NO: 586445 - RNA, 23 nt, Human
ucgcgucugugucccccaacccc

SEQ ID NO: 586446 - RNA, 18 nt, Human
ucgcucaguuccugaguu

SEQ ID NO: 586447 - RNA, 20 nt, Human
ucgcucaguuccugaguugu

SEQ ID NO: 586448 - RNA, 22 nt, Human
ucucccuucuccucccuggguc

SEQ ID NO: 586449 - RNA, 22 nt, Human
ucuccucccugggucaaggugg

SEQ ID NO: 586450 - RNA, 23 nt, Human
ucugcgcucggccgccccgggac

SEQ ID NO: 586451 - RNA, 20 nt, Human
ucuggguggcaguauggcuu

SEQ ID NO: 586452 - RNA, 23 nt, Human
ucuucaauuccuucagugggggu

SEQ ID NO: 586453 - RNA, 20 nt, Human
ugaaaaaaaaaaaggaaaag

SEQ ID NO: 586454 - RNA, 21 nt, Human
ugaaaaagccagaaaaacacc

SEQ ID NO: 586455 - RNA, 23 nt, Human
ugaaaaagccagaaaaacaccaa

SEQ ID NO: 586456 - RNA, 21 nt, Human
ugaaaugccacgugggccuaa

SEQ ID NO: 586457 - RNA, 21 nt, Human
ugagggugugaguggcucugg

SEQ ID NO: 586458 - RNA, 23 nt, Human
ugcccccaucuccagccgggcuc

SEQ ID NO: 586459 - RNA, 18 nt, Human
uggcaguauggcuucugc

SEQ ID NO: 586460 - RNA, 21 nt, Human
ugugggggugacuuggggggg

SEQ ID NO: 586461 - RNA, 20 nt, Human
uucccguccguccucugcgc

SEQ ID NO: 586462 - RNA, 22 nt, Human
uucccguccguccucugcgcuc

SEQ ID NO: 586463 - RNA, 20 nt, Human
uucgccggcucccgcgcccc

SEQ ID NO: 586464 - RNA, 18 nt, Human
uucuggagucuugcacac

SEQ ID NO: 586465 - RNA, 22 nt, Human
aagcccacagccagucccccaa

SEQ ID NO: 586466 - RNA, 24 nt, Human
aagcggcugaugcgggaggcaggc

SEQ ID NO: 586467 - RNA, 19 nt, Human
aaguaggccccccaccuuc

SEQ ID NO: 586468 - RNA, 23 nt, Human
accccgcaccccuaccucuccaa

SEQ ID NO: 586469 - RNA, 24 nt, Human
acccgggagaaggcagcuguugga

SEQ ID NO: 586470 - RNA, 19 nt, Human
acucagcuggggccggggu

SEQ ID NO: 586471 - RNA, 19 nt, Human
agauucagcucccccccac

SEQ ID NO: 586472 - RNA, 22 nt, Human
agcaggguacggccugcucugg

SEQ ID NO: 586473 - RNA, 21 nt, Human
agccagucccccaaaguuggc

SEQ ID NO: 586474 - RNA, 21 nt, Human
agcggucacucagcuggggcc

SEQ ID NO: 586475 - RNA, 23 nt, Human
agcucccccccaccccgcacccc

SEQ ID NO: 586476 - RNA, 21 nt, Human
agcuggggccggggugucuuc

SEQ ID NO: 586477 - RNA, 19 nt, Human
aggagcgagggaggcagag

SEQ ID NO: 586478 - RNA, 19 nt, Human
aggcaagacugggaagccc

SEQ ID NO: 586479 - RNA, 20 nt, Human
aguugggaguuccccagccc

SEQ ID NO: 586480 - RNA, 24 nt, Human
augcgggaggcaggcaccuugcgu

SEQ ID NO: 586481 - RNA, 26 nt, Human
auugaagauucagcucccccccaccc

SEQ ID NO: 586482 - RNA, 23 nt, Human
caagaaccuccacauggucccca

SEQ ID NO: 586483 - RNA, 18 nt, Human
caagacugggaagcccaa

SEQ ID NO: 586484 - RNA, 28 nt, Human
cacaaggccaaccaacagucuggcccag

SEQ ID NO: 586485 - RNA, 22 nt, Human
cacccaggccucucccaggccc

SEQ ID NO: 586486 - RNA, 19 nt, Human
caccccgcaccccuaccuc

SEQ ID NO: 586487 - RNA, 24 nt, Human
caccccgcaccccuaccucuccaa

SEQ ID NO: 586488 - RNA, 21 nt, Human
caccccuaccucuccaacaca

SEQ ID NO: 586489 - RNA, 23 nt, Human
cacccucugacugcagacgaccu

SEQ ID NO: 586490 - RNA, 20 nt, Human
ccaagcccacagccaguccc

SEQ ID NO: 586491 - RNA, 25 nt, Human
ccaagcccacagccagucccccaaa

SEQ ID NO: 586492 - RNA, 24 nt, Human
ccacccucugacugcagacgaccu

SEQ ID NO: 586493 - RNA, 21 nt, Human
ccagccccagggauccugagc

SEQ ID NO: 586494 - RNA, 22 nt, Human
ccagcgguggggcccaggcccc

SEQ ID NO: 586495 - RNA, 22 nt, Human
cccagccccagggauccugagc

SEQ ID NO: 586496 - RNA, 22 nt, Human
ccccagggauccugagcuucug

SEQ ID NO: 586497 - RNA, 28 nt, Human
ccccagggauccugagcuucugggccaa

SEQ ID NO: 586498 - RNA, 18 nt, Human
ccccagggccccacaagg

SEQ ID NO: 586499 - RNA, 22 nt, Human
ccccagggccccacaaggccaa

SEQ ID NO: 586500 - RNA, 27 nt, Human
ccccagggccccacaaggccaaccaac

SEQ ID NO: 586501 - RNA, 19 nt, Human
cccccaaaguuggccaagc

SEQ ID NO: 586502 - RNA, 18 nt, Human
cccccccaccccgcaccc

SEQ ID NO: 586503 - RNA, 23 nt, Human
cccccccaccccgcaccccuacc

SEQ ID NO: 586504 - RNA, 18 nt, Human
cccccgaaguaggccccc

SEQ ID NO: 586505 - RNA, 20 nt, Human
ccccgcaccccuaccucucc

SEQ ID NO: 586506 - RNA, 21 nt, Human
ccuagccccaagcccacagcc

SEQ ID NO: 586507 - RNA, 20 nt, Human
ccucaaauguuggcaaagau

SEQ ID NO: 586508 - RNA, 19 nt, Human
ccucacccaggccucuccc

SEQ ID NO: 586509 - RNA, 24 nt, Human
ccucccgugcccugcgaauguccu

SEQ ID NO: 586510 - RNA, 18 nt, Human
ccugcgaauguccuccuc

SEQ ID NO: 586511 - RNA, 25 nt, Human
cgaauguccuccucacccaggccuc

SEQ ID NO: 586512 - RNA, 20 nt, Human
cucccccccaccccgcaccc

SEQ ID NO: 586513 - RNA, 19 nt, Human
cuccuagccccaagcccac

SEQ ID NO: 586514 - RNA, 19 nt, Human
cucggcauuggccuccgac

SEQ ID NO: 586515 - RNA, 18 nt, Human
cugacccagggcagacgg

SEQ ID NO: 586516 - RNA, 20 nt, Human
cuugaggcagaggugagggc

SEQ ID NO: 586517 - RNA, 22 nt, Human
gacaggaaggggcuggagucca

SEQ ID NO: 586518 - RNA, 21 nt, Human
gagcugggaacuggcagagga

SEQ ID NO: 586519 - RNA, 20 nt, Human
gaggagagccaggcaagacu

SEQ ID NO: 586520 - RNA, 22 nt, Human
gcagcggcccaaggcucccuca

SEQ ID NO: 586521 - RNA, 18 nt, Human
gccaucucggccaguacu

SEQ ID NO: 586522 - RNA, 24 nt, Human
gcccaagaaccuccacaugguccc

SEQ ID NO: 586523 - RNA, 23 nt, Human
gcccagaaccacccucugacugc

SEQ ID NO: 586524 - RNA, 23 nt, Human
gccccaagcccacagccaguccc

SEQ ID NO: 586525 - RNA, 23 nt, Human
gcgguggggcccaggccccaggg

SEQ ID NO: 586526 - RNA, 18 nt, Human
gcuucugggccaaggagg

SEQ ID NO: 586527 - RNA, 19 nt, Human
ggaagcccaagggggcucc

SEQ ID NO: 586528 - RNA, 19 nt, Human
ggacugaaucccccaugga

SEQ ID NO: 586529 - RNA, 20 nt, Human
ggagcgagggaggcagaggu

SEQ ID NO: 586530 - RNA, 19 nt, Human
ggcccaggccccagggccc

SEQ ID NO: 586531 - RNA, 18 nt, Human
gggaacuccaagucuuug

SEQ ID NO: 586532 - RNA, 21 nt, Human
gggauccugagcuucugggcc

SEQ ID NO: 586533 - RNA, 21 nt, Human
ggggcccaggccccagggccc

SEQ ID NO: 586534 - RNA, 21 nt, Human
gguggggcccaggccccaggg

SEQ ID NO: 586535 - RNA, 23 nt, Human
uaagaggcacuacagcaggguac

SEQ ID NO: 586536 - RNA, 19 nt, Human
uagccccaagcccacagcc

SEQ ID NO: 586537 - RNA, 23 nt, Human
uaggccccccaccuucagccaca

SEQ ID NO: 586538 - RNA, 18 nt, Human
ucacucagcuggggccgg

SEQ ID NO: 586539 - RNA, 24 nt, Human
ucagccacauugcggaaaauccaa

SEQ ID NO: 586540 - RNA, 19 nt, Human
uccaauggagcguaaguca

SEQ ID NO: 586541 - RNA, 21 nt, Human
uccagcccagaaccacccucu

SEQ ID NO: 586542 - RNA, 18 nt, Human
uccccagccccagggauc

SEQ ID NO: 586543 - RNA, 19 nt, Human
uccccagccccagggaucc

SEQ ID NO: 586544 - RNA, 25 nt, Human
uccccagccccagggauccugagcu

SEQ ID NO: 586545 - RNA, 21 nt, Human
ucccccgaaguaggcccccca

SEQ ID NO: 586546 - RNA, 19 nt, Human
uccugggacgggccucccg

SEQ ID NO: 586547 - RNA, 19 nt, Human
ucucgaacccacacccgug

SEQ ID NO: 586548 - RNA, 19 nt, Human
ucugaucugcauaacgaca

SEQ ID NO: 586549 - RNA, 19 nt, Human
ucugggccaaggaggagag

SEQ ID NO: 586550 - RNA, 18 nt, Human
ucuuccugggacgggccu

SEQ ID NO: 586551 - RNA, 19 nt, Human
ugacccagggcagacgggg

SEQ ID NO: 586552 - RNA, 22 nt, Human
ugacugcagacgaccuccuggc

SEQ ID NO: 586553 - RNA, 18 nt, Human
ugaggacugccuccagga

SEQ ID NO: 586554 - RNA, 21 nt, Human
ugaggcagaggugagggcucc

SEQ ID NO: 586555 - RNA, 21 nt, Human
ugcccugcgaauguccuccuc

SEQ ID NO: 586556 - RNA, 26 nt, Human
uguccuccucacccaggccucuccca

SEQ ID NO: 586557 - RNA, 25 nt, Human
uugaggcagaggugagggcuccccc

SEQ ID NO: 586558 - RNA, 21 nt, Human
uugggaguuccccagccccag

SEQ ID NO: 586559 - RNA, 18 nt, Human
uuuuuuuuuuuggaaggg

SEQ ID NO: 586560 - RNA, 26 nt, Human
uuuuuuuuuuuuggaaggggagggcu

SEQ ID NO: 586561 - RNA, 22 nt, Human
uuuuuuuuuuuuuuuggaaggg

SEQ ID NO: 586562 - RNA, 22 nt, Human
aaagagaaggccaagccaacua

SEQ ID NO: 586563 - RNA, 21 nt, Human
aagccaacuaccccuacucug

SEQ ID NO: 586564 - RNA, 21 nt, Human
acacagccagacauugccacc

SEQ ID NO: 586565 - RNA, 25 nt, Human
acauugccacacaucugccaugagc

SEQ ID NO: 586566 - RNA, 21 nt, Human
acccccuggacuaaggcucaa

SEQ ID NO: 586567 - RNA, 27 nt, Human
accgccccugcccagccccuucugcug

SEQ ID NO: 586568 - RNA, 18 nt, Human
accgggccaggaaggagc

SEQ ID NO: 586569 - RNA, 19 nt, Human
agaggaggccggggagagg

SEQ ID NO: 586570 - RNA, 19 nt, Human
agagguccuggggcccacc

SEQ ID NO: 586571 - RNA, 21 nt, Human
agcaaugcaaauggcuggggg

SEQ ID NO: 586572 - RNA, 20 nt, Human
agcacauccaccaugcagca

SEQ ID NO: 586573 - RNA, 21 nt, Human
aggaggccggggagagggugc

SEQ ID NO: 586574 - RNA, 24 nt, Human
aggaggccggggagagggugcuuc

SEQ ID NO: 586575 - RNA, 18 nt, Human
augguacaaaaauaaagg

SEQ ID NO: 586576 - RNA, 19 nt, Human
caacuaccccuacucugcc

SEQ ID NO: 586577 - RNA, 18 nt, Human
caaggaggcaaugugacc

SEQ ID NO: 586578 - RNA, 22 nt, Human
cacaacaacccugugagguagg

SEQ ID NO: 586579 - RNA, 28 nt, Human
cacagccagacauugccacacaucugcc

SEQ ID NO: 586580 - RNA, 24 nt, Human
cacagccccacgggugcagacaga

SEQ ID NO: 586581 - RNA, 19 nt, Human
caccgccccugcccagccc

SEQ ID NO: 586582 - RNA, 18 nt, Human
cagcugaaggugggcggc

SEQ ID NO: 586583 - RNA, 24 nt, Human
cauccuccucccgggcgcuggggg

SEQ ID NO: 586584 - RNA, 19 nt, Human
ccaggaaggagcacaucca

SEQ ID NO: 586585 - RNA, 22 nt, Human
ccaggccagcuccccacaaccu

SEQ ID NO: 586586 - RNA, 20 nt, Human
cccacaaccugcauccccaa

SEQ ID NO: 586587 - RNA, 19 nt, Human
cccagccccuucugcugcc

SEQ ID NO: 586588 - RNA, 24 nt, Human
cccagccccuucugcugccucucc

SEQ ID NO: 586589 - RNA, 19 nt, Human
ccccaauaccugaaucucc

SEQ ID NO: 586590 - RNA, 18 nt, Human
ccccacaaccugcauccc

SEQ ID NO: 586591 - RNA, 22 nt, Human
ccccacaaccugcauccccaau

SEQ ID NO: 586592 - RNA, 19 nt, Human
ccccgccccccaggccagg

SEQ ID NO: 586593 - RNA, 18 nt, Human
ccccgcuucgcccuuccc

SEQ ID NO: 586594 - RNA, 25 nt, Human
ccccuggacuaaggcucaaggaggc

SEQ ID NO: 586595 - RNA, 19 nt, Human
cccgccccuggaggcagga

SEQ ID NO: 586596 - RNA, 24 nt, Human
ccgccccgcgcugcucccgccccc

SEQ ID NO: 586597 - RNA, 18 nt, Human
ccgccccuggaggcagga

SEQ ID NO: 586598 - RNA, 22 nt, Human
ccgcggcgucugcauccuccuc

SEQ ID NO: 586599 - RNA, 20 nt, Human
ccgggccaggaaggagcaca

SEQ ID NO: 586600 - RNA, 19 nt, Human
ccggucccgccccgcuucg

SEQ ID NO: 586601 - RNA, 23 nt, Human
ccuccaccgccccugcccagccc

SEQ ID NO: 586602 - RNA, 22 nt, Human
ccucccgggcgcugggggcggg

SEQ ID NO: 586603 - RNA, 22 nt, Human
ccuccucccgggcgcugggggc

SEQ ID NO: 586604 - RNA, 24 nt, Human
ccuccucccgggcgcugggggcgg

SEQ ID NO: 586605 - RNA, 23 nt, Human
ccuggacuaaggcucaaggaggc

SEQ ID NO: 586606 - RNA, 18 nt, Human
ccuucugcugccucuccc

SEQ ID NO: 586607 - RNA, 22 nt, Human
ccuucugcugccucuccccgcc

SEQ ID NO: 586608 - RNA, 21 nt, Human
cgccccgccccuggaggcagg

SEQ ID NO: 586609 - RNA, 27 nt, Human
cgccccgccccuggaggcaggaguugg

SEQ ID NO: 586610 - RNA, 20 nt, Human
cgcugggggcgggcggggac

SEQ ID NO: 586611 - RNA, 19 nt, Human
cgcuucgcccuuccccgca

SEQ ID NO: 586612 - RNA, 19 nt, Human
cgggagcuguaguccgcgc

SEQ ID NO: 586613 - RNA, 19 nt, Human
cuaccccuacucugccagg

SEQ ID NO: 586614 - RNA, 21 nt, Human
cuccucugugcacccucacaa

SEQ ID NO: 586615 - RNA, 18 nt, Human
cucuccccgccccccagg

SEQ ID NO: 586616 - RNA, 19 nt, Human
cugcauccuccucccgggc

SEQ ID NO: 586617 - RNA, 21 nt, Human
cugugagguaggugggguggg

SEQ ID NO: 586618 - RNA, 25 nt, Human
gacuuugcuccucugugcacccuca

SEQ ID NO: 586619 - RNA, 24 nt, Human
gagcccgggagaggggacgcaggu

SEQ ID NO: 586620 - RNA, 18 nt, Human
gcccaggggucgggcugg

SEQ ID NO: 586621 - RNA, 18 nt, Human
gccccgcgcugcucccgc

SEQ ID NO: 586622 - RNA, 18 nt, Human
gcggccccuauauacugc

SEQ ID NO: 586623 - RNA, 22 nt, Human
ggaggagugacccccuggacua

SEQ ID NO: 586624 - RNA, 25 nt, Human
ggcaaugugaccgggccaggaagga

SEQ ID NO: 586625 - RNA, 24 nt, Human
gggcaggccgggagcuguaguccg

SEQ ID NO: 586626 - RNA, 18 nt, Human
gggggcgggcggggaccg

SEQ ID NO: 586627 - RNA, 18 nt, Human
gggggcgggcggggaccg

SEQ ID NO: 586628 - RNA, 19 nt, Human
gggugcagacagaggaggc

SEQ ID NO: 586629 - RNA, 26 nt, Human
guccacucugcccagagguccugggg

SEQ ID NO: 586630 - RNA, 25 nt, Human
uaccugaaucuccauuugcaaacac

SEQ ID NO: 586631 - RNA, 24 nt, Human
ucaccaaagagaaggccaagccaa

SEQ ID NO: 586632 - RNA, 21 nt, Human
uccccaauaccugaaucucca

SEQ ID NO: 586633 - RNA, 19 nt, Human
uccccacaaccugcauccc

SEQ ID NO: 586634 - RNA, 22 nt, Human
uccuccaccgccccugcccagc

SEQ ID NO: 586635 - RNA, 23 nt, Human
ucggacacagcugagaagcaagg

SEQ ID NO: 586636 - RNA, 22 nt, Human
ucucaggcccggggcccacccc

SEQ ID NO: 586637 - RNA, 24 nt, Human
ucuccauuugcaaacacaguguua

SEQ ID NO: 586638 - RNA, 23 nt, Human
ucugcauccuccucccgggcgcu

SEQ ID NO: 586639 - RNA, 20 nt, Human
ucugccaggccagcucccca

SEQ ID NO: 586640 - RNA, 23 nt, Human
ugagguagguggggugggaggag

SEQ ID NO: 586641 - RNA, 23 nt, Human
ugaguccuccaccgccccugccc

SEQ ID NO: 586642 - RNA, 26 nt, Human
ugccaggccagcuccccacaaccugc

SEQ ID NO: 586643 - RNA, 21 nt, Human
ugcccagccccuucugcugcc

SEQ ID NO: 586644 - RNA, 19 nt, Human
ugcucccgcccccgguccc

SEQ ID NO: 586645 - RNA, 21 nt, Human
ugcugccucuccccgcccccc

SEQ ID NO: 586646 - RNA, 22 nt, Human
ugggggugggaucaccaaagag

SEQ ID NO: 586647 - RNA, 21 nt, Human
uggguccuucccaucccaggg

SEQ ID NO: 586648 - RNA, 18 nt, Human
uuugcaaacacaguguua

SEQ ID NO: 586649 - RNA, 19 nt, Human
uuugcaaacacaguguuau

SEQ ID NO: 586650 - RNA, 25 nt, Human
aaacagaagagaaggcagaggccca

SEQ ID NO: 586651 - RNA, 19 nt, Human
aagagaacgcugcucggug

SEQ ID NO: 586652 - RNA, 20 nt, Human
aauuccuacccacuguccuc

SEQ ID NO: 586653 - RNA, 21 nt, Human
acucuggucucugcacugggg

SEQ ID NO: 586654 - RNA, 23 nt, Human
agacaacacacaaagcgcagcuc

SEQ ID NO: 586655 - RNA, 21 nt, Human
agacaauacccaacuucugua

SEQ ID NO: 586656 - RNA, 25 nt, Human
aggcuaacaccuuacaggguaacac

SEQ ID NO: 586657 - RNA, 21 nt, Human
auugcugaaagguguguaucu

SEQ ID NO: 586658 - RNA, 20 nt, Human
cacagugacauccacaccag

SEQ ID NO: 586659 - RNA, 21 nt, Human
cagaacuucacagaauugucu

SEQ ID NO: 586660 - RNA, 19 nt, Human
caguaaauguaccagcuuc

SEQ ID NO: 586661 - RNA, 19 nt, Human
ccaaacagaagagaaggca

SEQ ID NO: 586662 - RNA, 21 nt, Human
cccacuguccucgggcaucug

SEQ ID NO: 586663 - RNA, 22 nt, Human
ccuuaucuucacacagugacau

SEQ ID NO: 586664 - RNA, 22 nt, Human
cgacauagacaacacacaaagc

SEQ ID NO: 586665 - RNA, 22 nt, Human
cuagauauuccacugcuguacu

SEQ ID NO: 586666 - RNA, 23 nt, Human
cuucacacagugacauccacacc

SEQ ID NO: 586667 - RNA, 21 nt, Human
gaagagaaggcagaggcccac

SEQ ID NO: 586668 - RNA, 22 nt, Human
gccucuccccugacagacagcu

SEQ ID NO: 586669 - RNA, 19 nt, Human
ggaggagaaauaacaaaaa

SEQ ID NO: 586670 - RNA, 23 nt, Human
ggauuuuggagaggugggcggcu

SEQ ID NO: 586671 - RNA, 18 nt, Human
ggcuagauauuccacugc

SEQ ID NO: 586672 - RNA, 22 nt, Human
uaacaccuuacaggguaacacc

SEQ ID NO: 586673 - RNA, 19 nt, Human
ucagccgacauagacaaca

SEQ ID NO: 586674 - RNA, 25 nt, Human
uccacaccagguggccaaacagaag

SEQ ID NO: 586675 - RNA, 18 nt, Human
uccaugaaaacuuccacc

SEQ ID NO: 586676 - RNA, 23 nt, Human
ucccauauccgcacaucgccgcc

SEQ ID NO: 586677 - RNA, 22 nt, Human
uccgcacaucgccgcccacgcg

SEQ ID NO: 586678 - RNA, 21 nt, Human
ucuccaugaaaacuuccaccu

SEQ ID NO: 586679 - RNA, 20 nt, Human
ugacuggagguagcaagaau

SEQ ID NO: 586680 - RNA, 21 nt, Human
ugaugcugcgcaguccuuggg

SEQ ID NO: 586681 - RNA, 20 nt, Human
ugcugaaagguguguaucug

SEQ ID NO: 586682 - RNA, 18 nt, Human
uggguuuccucuuauccc

SEQ ID NO: 586683 - RNA, 23 nt, Human
uucacacagugacauccacacca

SEQ ID NO: 586684 - RNA, 21 nt, Human
aagaagaagggggguucccag

SEQ ID NO: 586685 - RNA, 22 nt, Human
aagcaagaagaaagguggucag

SEQ ID NO: 586686 - RNA, 21 nt, Human
acccuugaaccagccacagug

SEQ ID NO: 586687 - RNA, 21 nt, Human
agaagaagggggguucccagg

SEQ ID NO: 586688 - RNA, 22 nt, Human
agagagcucaugugcuugguag

SEQ ID NO: 586689 - RNA, 19 nt, Human
agaguggaguuuccaggag

SEQ ID NO: 586690 - RNA, 29 nt, Human
aggaaaagggagggggagaggugaagggg

SEQ ID NO: 586691 - RNA, 20 nt, Human
agggagggggagaggugaag

SEQ ID NO: 586692 - RNA, 19 nt, Human
agggggagaggugaagggg

SEQ ID NO: 586693 - RNA, 22 nt, Human
agggggagaggugaagggguca

SEQ ID NO: 586694 - RNA, 20 nt, Human
aggguccugggacaggcagg

SEQ ID NO: 586695 - RNA, 21 nt, Human
aguggaguuuccaggaguggc

SEQ ID NO: 586696 - RNA, 22 nt, Human
aucaguguaggagcaggucugg

SEQ ID NO: 586697 - RNA, 19 nt, Human
caaaacaaaggaaaaggga

SEQ ID NO: 586698 - RNA, 21 nt, Human
caagaagaaagguggucagac

SEQ ID NO: 586699 - RNA, 19 nt, Human
cagccagcauggccaggug

SEQ ID NO: 586700 - RNA, 24 nt, Human
caggaaagacuuccugggagucag

SEQ ID NO: 586701 - RNA, 18 nt, Human
caggccccagaggcaggg

SEQ ID NO: 586702 - RNA, 24 nt, Human
caggccccagaggcaggggacaga

SEQ ID NO: 586703 - RNA, 26 nt, Human
caggccccagaggcaggggacagaag

SEQ ID NO: 586704 - RNA, 26 nt, Human
cauggccaggugccugcaccgcagcc

SEQ ID NO: 586705 - RNA, 20 nt, Human
ccaaaacaaaggaaaaggga

SEQ ID NO: 586706 - RNA, 18 nt, Human
ccagggcagaagggauca

SEQ ID NO: 586707 - RNA, 18 nt, Human
cccaacugaagcaagaag

SEQ ID NO: 586708 - RNA, 19 nt, Human
ccccaacugaagcaagaag

SEQ ID NO: 586709 - RNA, 23 nt, Human
cccccacccuguuagagagcuca

SEQ ID NO: 586710 - RNA, 21 nt, Human
ccgcagccccggccugugccu

SEQ ID NO: 586711 - RNA, 18 nt, Human
gaagaagggggguuccca

SEQ ID NO: 586712 - RNA, 18 nt, Human
gaggcagacugcugugca

SEQ ID NO: 586713 - RNA, 20 nt, Human
gagggggagaggugaagggg

SEQ ID NO: 586714 - RNA, 20 nt, Human
gagggggagaggugaagggg

SEQ ID NO: 586715 - RNA, 24 nt, Human
gaugcagaguagcagaagcuccuc

SEQ ID NO: 586716 - RNA, 24 nt, Human
ggacaggcagguuuuuuagggucu

SEQ ID NO: 586717 - RNA, 24 nt, Human
ggagcucucacauacccuugaacc

SEQ ID NO: 586718 - RNA, 19 nt, Human
ggagggggagaggugaagg

SEQ ID NO: 586719 - RNA, 21 nt, Human
ggagggucccuggaauggcca

SEQ ID NO: 586720 - RNA, 21 nt, Human
ggcagaagggaucagagucug

SEQ ID NO: 586721 - RNA, 23 nt, Human
ggccaggugccugcaccgcagcc

SEQ ID NO: 586722 - RNA, 18 nt, Human
gggggagaggugaagggg

SEQ ID NO: 586723 - RNA, 20 nt, Human
ggggugccauucaggagaaa

SEQ ID NO: 586724 - RNA, 21 nt, Human
ggugcacgacugguaagggaa

SEQ ID NO: 586725 - RNA, 23 nt, Human
gucucugacaagcaguuuucuga

SEQ ID NO: 586726 - RNA, 23 nt, Human
uagucagggcugugcuugggccg

SEQ ID NO: 586727 - RNA, 20 nt, Human
ucagagucugccccaacuga

SEQ ID NO: 586728 - RNA, 21 nt, Human
ucagaguggaguuuccaggag

SEQ ID NO: 586729 - RNA, 18 nt, Human
ucagccuggcuggaacgg

SEQ ID NO: 586730 - RNA, 22 nt, Human
ucaggagaaagaagaagggggg

SEQ ID NO: 586731 - RNA, 24 nt, Human
ucaggggagaaagguggucuuuug

SEQ ID NO: 586732 - RNA, 21 nt, Human
ucccaaaacaaaggaaaaggg

SEQ ID NO: 586733 - RNA, 18 nt, Human
ucccuggaauggccagaa

SEQ ID NO: 586734 - RNA, 21 nt, Human
ucucacauacccuugaaccag

SEQ ID NO: 586735 - RNA, 24 nt, Human
ucuccagguucuucaauaucagug

SEQ ID NO: 586736 - RNA, 20 nt, Human
ucugacaagcaguuuucuga

SEQ ID NO: 586737 - RNA, 19 nt, Human
ucuuuugugcugcugucau

SEQ ID NO: 586738 - RNA, 24 nt, Human
ucuuuugugcugcugucauccuag

SEQ ID NO: 586739 - RNA, 28 nt, Human
ugaaacacuguguuucugggacaaaggu

SEQ ID NO: 586740 - RNA, 23 nt, Human
ugaagcaagaagaaaggugguca

SEQ ID NO: 586741 - RNA, 19 nt, Human
ugaaggggucagcuagggu

SEQ ID NO: 586742 - RNA, 22 nt, Human
ugaaucccaaaacaaaggaaaa

SEQ ID NO: 586743 - RNA, 19 nt, Human
ugacaagcaguuuucugaa

SEQ ID NO: 586744 - RNA, 24 nt, Human
ugcaccgcagccccggccugugcc

SEQ ID NO: 586745 - RNA, 19 nt, Human
ugccugcaccgcagccccg

SEQ ID NO: 586746 - RNA, 19 nt, Human
ugcugagugucaucaguga

SEQ ID NO: 586747 - RNA, 24 nt, Human
ugcuugguagaagggagucccaua

SEQ ID NO: 586748 - RNA, 18 nt, Human
uggccaggugccugcacc

SEQ ID NO: 586749 - RNA, 19 nt, Human
ugggagaagggaguguugg

SEQ ID NO: 586750 - RNA, 19 nt, Human
uguccaaagcggcagcuuc

SEQ ID NO: 586751 - RNA, 23 nt, Human
uguuagagagcucaugugcuugg

SEQ ID NO: 586752 - RNA, 23 nt, Human
uguuagagagcucaugugcuugg

SEQ ID NO: 586753 - RNA, 18 nt, Human
uuagauguuugguguuca

SEQ ID NO: 586754 - RNA, 19 nt, Human
uucaggaaagacuuccugg

SEQ ID NO: 586755 - RNA, 19 nt, Human
uucccaggccccagaggca

SEQ ID NO: 586756 - RNA, 21 nt, Human
uuugguguucauuaccauagg

SEQ ID NO: 586757 - RNA, 23 nt, Human
uuuugugcugcugucauccuagu

SEQ ID NO: 586758 - RNA, 24 nt, Human
uuuuuagggucucuugaaacacug

SEQ ID NO: 586759 - RNA, 23 nt, Human
uuuuuuuuuuuuuuuuaagccuu

SEQ ID NO: 586760 - RNA, 19 nt, Human
uuuuuuuuuuuuuuuuuaa

SEQ ID NO: 586761 - RNA, 24 nt, Human
aaagugcugggauuacaggcguga

SEQ ID NO: 586762 - RNA, 21 nt, Human
aaagugcuggguuuacaggug

SEQ ID NO: 586763 - RNA, 24 nt, Human
aaagugcuggguuuacagguguga

SEQ ID NO: 586764 - RNA, 18 nt, Human
aacuuccugcaggcagac

SEQ ID NO: 586765 - RNA, 19 nt, Human
aacuucugccccccacccg

SEQ ID NO: 586766 - RNA, 24 nt, Human
aagaaauauuucuuacagcaacug

SEQ ID NO: 586767 - RNA, 21 nt, Human
aagcgaucuuccugccucagc

SEQ ID NO: 586768 - RNA, 20 nt, Human
aaguagcugggauuauaggc

SEQ ID NO: 586769 - RNA, 22 nt, Human
aaguagcugggauuauaggcgu

SEQ ID NO: 586770 - RNA, 24 nt, Human
aaguagcugggauuauaggcgugu

SEQ ID NO: 586771 - RNA, 18 nt, Human
aagugcacccgcagucac

SEQ ID NO: 586772 - RNA, 19 nt, Human
aagugcugggauuacaggc

SEQ ID NO: 586773 - RNA, 19 nt, Human
aagugcugggauuacaggc

SEQ ID NO: 586774 - RNA, 26 nt, Human
aagugcugggauuacaggcgugagcc

SEQ ID NO: 586775 - RNA, 20 nt, Human
acagcgcucgaguggauuag

SEQ ID NO: 586776 - RNA, 18 nt, Human
acaggguuuugcuauguu

SEQ ID NO: 586777 - RNA, 19 nt, Human
acaggguuuugcuauguug

SEQ ID NO: 586778 - RNA, 24 nt, Human
acaggguuuugcuauguugcucag

SEQ ID NO: 586779 - RNA, 18 nt, Human
acaguaacggcaguaagu

SEQ ID NO: 586780 - RNA, 24 nt, Human
accauguuggccaggcuggucucg

SEQ ID NO: 586781 - RNA, 19 nt, Human
acccaggcuggagugcagu

SEQ ID NO: 586782 - RNA, 21 nt, Human
acucauuuucccuuccauacu

SEQ ID NO: 586783 - RNA, 23 nt, Human
acucugagcccuauucauccucc

SEQ ID NO: 586784 - RNA, 25 nt, Human
acucuggagccccauugucagcccc

SEQ ID NO: 586785 - RNA, 21 nt, Human
agaaauaagcagugaagaaaa

SEQ ID NO: 586786 - RNA, 18 nt, Human
agacaggguuuugcuaug

SEQ ID NO: 586787 - RNA, 23 nt, Human
agacaggguuuugcuauguugcu

SEQ ID NO: 586788 - RNA, 25 nt, Human
agcaucucuccugaggucccugcca

SEQ ID NO: 586789 - RNA, 24 nt, Human
agcccuauucauccuccuccccag

SEQ ID NO: 586790 - RNA, 18 nt, Human
agcuggacccaagcccag

SEQ ID NO: 586791 - RNA, 19 nt, Human
agcuggacccaagcccagc

SEQ ID NO: 586792 - RNA, 18 nt, Human
aggagacaguaacggcag

SEQ ID NO: 586793 - RNA, 19 nt, Human
aggcauagagggggcacgg

SEQ ID NO: 586794 - RNA, 21 nt, Human
aggcguguaccaccacaccca

SEQ ID NO: 586795 - RNA, 25 nt, Human
aggcuggagugcaguggcacaaucu

SEQ ID NO: 586796 - RNA, 18 nt, Human
agggggcacgggaggugg

SEQ ID NO: 586797 - RNA, 21 nt, Human
aguacugggacuacaggcacc

SEQ ID NO: 586798 - RNA, 24 nt, Human
aguagacauucaccguugguuugc

SEQ ID NO: 586799 - RNA, 23 nt, Human
aguagagauggggguuucaccau

SEQ ID NO: 586800 - RNA, 19 nt, Human
aguaggugugugaggcuuu

SEQ ID NO: 586801 - RNA, 20 nt, Human
agugcaguggcacaaucucg

SEQ ID NO: 586802 - RNA, 24 nt, Human
agugcaguggcacaaucucggcuc

SEQ ID NO: 586803 - RNA, 18 nt, Human
agugcugggauuacaggc

SEQ ID NO: 586804 - RNA, 18 nt, Human
aucacaauuauuucuuug

SEQ ID NO: 586805 - RNA, 23 nt, Human
auggggguuucaccauguuggcc

SEQ ID NO: 586806 - RNA, 20 nt, Human
auguugcucaggcuggucuc

SEQ ID NO: 586807 - RNA, 24 nt, Human
auuuuuguauuuuuaguagagaug

SEQ ID NO: 586808 - RNA, 24 nt, Human
caaagugcugggauuacaggcgug

SEQ ID NO: 586809 - RNA, 24 nt, Human
caaagugcuggguuuacaggugug

SEQ ID NO: 586810 - RNA, 22 nt, Human
caagcgauucuccugccucagc

SEQ ID NO: 586811 - RNA, 18 nt, Human
caaggccccagagggagg

SEQ ID NO: 586812 - RNA, 22 nt, Human
caaggccccagagggagggggg

SEQ ID NO: 586813 - RNA, 19 nt, Human
cacagugcguagcagugac

SEQ ID NO: 586814 - RNA, 24 nt, Human
caccacacccagcuaauuuuugua

SEQ ID NO: 586815 - RNA, 21 nt, Human
caccauguuggccaggcuggu

SEQ ID NO: 586816 - RNA, 24 nt, Human
caccauguuggccaggcuggucuc

SEQ ID NO: 586817 - RNA, 27 nt, Human
caccauguuggccaggcuggucucgaa

SEQ ID NO: 586818 - RNA, 21 nt, Human
caccuggggcucccaaagugc

SEQ ID NO: 586819 - RNA, 24 nt, Human
cacuacacccagcuaauuuuugua

SEQ ID NO: 586820 - RNA, 20 nt, Human
cacugcaacuucugcccccc

SEQ ID NO: 586821 - RNA, 21 nt, Human
cacugcaacuucugcccccca

SEQ ID NO: 586822 - RNA, 20 nt, Human
cagauggccauuuuccaggg

SEQ ID NO: 586823 - RNA, 19 nt, Human
cagccccaggcccagcccc

SEQ ID NO: 586824 - RNA, 19 nt, Human
cagccccaggggugcuccc

SEQ ID NO: 586825 - RNA, 23 nt, Human
cagccuccgucuccuaggcuuaa

SEQ ID NO: 586826 - RNA, 19 nt, Human
cagccuccugaguacuggg

SEQ ID NO: 586827 - RNA, 24 nt, Human
caggguuuugcuauguugcucagg

SEQ ID NO: 586828 - RNA, 22 nt, Human
caguaacggcaguaagucagcu

SEQ ID NO: 586829 - RNA, 19 nt, Human
cauccuccuccccagccag

SEQ ID NO: 586830 - RNA, 24 nt, Human
cauguuggccaggcuggucucgaa

SEQ ID NO: 586831 - RNA, 18 nt, Human
cauuuguucuccugagca

SEQ ID NO: 586832 - RNA, 22 nt, Human
ccaaagugcugggauuacaggc

SEQ ID NO: 586833 - RNA, 22 nt, Human
ccaaagugcugggauuacaggc

SEQ ID NO: 586834 - RNA, 24 nt, Human
ccaaagugcugggauuacaggcgu

SEQ ID NO: 586835 - RNA, 21 nt, Human
ccaaagugcuggguuuacagg

SEQ ID NO: 586836 - RNA, 24 nt, Human
ccaaagugcuggguuuacaggugu

SEQ ID NO: 586837 - RNA, 21 nt, Human
cccaccuggggcucccaaagu

SEQ ID NO: 586838 - RNA, 23 nt, Human
ccccaggggugcucccggugcug

SEQ ID NO: 586839 - RNA, 22 nt, Human
cccgcagucacucgcagauggc

SEQ ID NO: 586840 - RNA, 21 nt, Human
ccgcaccugcccuugcacuca

SEQ ID NO: 586841 - RNA, 22 nt, Human
ccgcauguauaauuucuuaacc

SEQ ID NO: 586842 - RNA, 19 nt, Human
ccggauucaagcgauucuc

SEQ ID NO: 586843 - RNA, 18 nt, Human
ccuaaccccaccuuuccc

SEQ ID NO: 586844 - RNA, 23 nt, Human
ccuaaguagcugggauuauaggc

SEQ ID NO: 586845 - RNA, 23 nt, Human
ccuaaguagcugggauuauaggc

SEQ ID NO: 586846 - RNA, 19 nt, Human
ccuccccagccagcucacc

SEQ ID NO: 586847 - RNA, 25 nt, Human
ccugaccucgugaucugcccaccug

SEQ ID NO: 586848 - RNA, 24 nt, Human
ccugagcucaagugauuugcccuc

SEQ ID NO: 586849 - RNA, 22 nt, Human
ccugaguacugggacuacaggc

SEQ ID NO: 586850 - RNA, 23 nt, Human
ccugccucagccuccugaguacu

SEQ ID NO: 586851 - RNA, 20 nt, Human
cguguaccaccacacccagc

SEQ ID NO: 586852 - RNA, 22 nt, Human
cguuccacacucuggagcccca

SEQ ID NO: 586853 - RNA, 19 nt, Human
cuaaccccaccuuucccau

SEQ ID NO: 586854 - RNA, 24 nt, Human
cuaaguagcugggauuauaggcgu

SEQ ID NO: 586855 - RNA, 23 nt, Human
cuaauuuuuguauuuuuaguaga

SEQ ID NO: 586856 - RNA, 23 nt, Human
cuaauuuuuguauuuuuuguaga

SEQ ID NO: 586857 - RNA, 23 nt, Human
cuacagccuccgucuccuaggcu

SEQ ID NO: 586858 - RNA, 23 nt, Human
cucaagugauuugcccuccucag

SEQ ID NO: 586859 - RNA, 19 nt, Human
cucacugcaacuucugccc

SEQ ID NO: 586860 - RNA, 25 nt, Human
cucacugcaacuucugccccccacc

SEQ ID NO: 586861 - RNA, 24 nt, Human
cucagccuccuaaguagcugggau

SEQ ID NO: 586862 - RNA, 18 nt, Human
cuccagggcaggugcugu

SEQ ID NO: 586863 - RNA, 23 nt, Human
cuccucagucucccaaagugcug

SEQ ID NO: 586864 - RNA, 22 nt, Human
cuccugaccucgugaucugccc

SEQ ID NO: 586865 - RNA, 18 nt, Human
cuccugagcucaagugau

SEQ ID NO: 586866 - RNA, 24 nt, Human
cucucucugucacccaggcuggag

SEQ ID NO: 586867 - RNA, 24 nt, Human
cucucugucacccaggcuggagug

SEQ ID NO: 586868 - RNA, 22 nt, Human
cucuggagccccauugucagcc

SEQ ID NO: 586869 - RNA, 23 nt, Human
cucugucacccaggcuggagugc

SEQ ID NO: 586870 - RNA, 23 nt, Human
cugccucagccuccuaaguagcu

SEQ ID NO: 586871 - RNA, 20 nt, Human
cuuaagcgaucuuccugccu

SEQ ID NO: 586872 - RNA, 24 nt, Human
cuuccugccucagccuccugagua

SEQ ID NO: 586873 - RNA, 21 nt, Human
cuugagugaacaaaaccagca

SEQ ID NO: 586874 - RNA, 21 nt, Human
gaccucgugaucugcccaccu

SEQ ID NO: 586875 - RNA, 23 nt, Human
gaccucgugaucugcccaccugg

SEQ ID NO: 586876 - RNA, 21 nt, Human
gagacggagucucucucuguc

SEQ ID NO: 586877 - RNA, 18 nt, Human
gauuacaggcgugagcca

SEQ ID NO: 586878 - RNA, 20 nt, Human
gauuacaggcgugagccacc

SEQ ID NO: 586879 - RNA, 22 nt, Human
gauuacaggcgugagccaccgc

SEQ ID NO: 586880 - RNA, 21 nt, Human
gauucuccugccucagccucc

SEQ ID NO: 586881 - RNA, 19 nt, Human
gcaacuucugccccccacc

SEQ ID NO: 586882 - RNA, 20 nt, Human
gcaccggcugccucaugguu

SEQ ID NO: 586883 - RNA, 24 nt, Human
gcagaccuucucagucccucacag

SEQ ID NO: 586884 - RNA, 24 nt, Human
gcccuauucauccuccuccccagc

SEQ ID NO: 586885 - RNA, 23 nt, Human
gccggauucaagcgauucuccug

SEQ ID NO: 586886 - RNA, 20 nt, Human
gccucagccuccuaaguagc

SEQ ID NO: 586887 - RNA, 24 nt, Human
gcgaucuuccugccucagccuccu

SEQ ID NO: 586888 - RNA, 24 nt, Human
gcgauucuccugccucagccuccu

SEQ ID NO: 586889 - RNA, 19 nt, Human
gcuauguugcucaggcugg

SEQ ID NO: 586890 - RNA, 20 nt, Human
gcuauguugcucaggcuggu

SEQ ID NO: 586891 - RNA, 23 nt, Human
gcucaggcuggucucaaacuccu

SEQ ID NO: 586892 - RNA, 19 nt, Human
gcuggagugcaguggcaca

SEQ ID NO: 586893 - RNA, 23 nt, Human
gcuggucucgaacuccugaccuc

SEQ ID NO: 586894 - RNA, 24 nt, Human
ggcuggucucgaacuccugaccuc

SEQ ID NO: 586895 - RNA, 24 nt, Human
ggggguuucaccauguuggccagg

SEQ ID NO: 586896 - RNA, 18 nt, Human
gggguuucaccauguugg

SEQ ID NO: 586897 - RNA, 22 nt, Human
gggguuucaccauguuggccag

SEQ ID NO: 586898 - RNA, 23 nt, Human
gggguuucaccauguuggccagg

SEQ ID NO: 586899 - RNA, 19 nt, Human
ggucucgaacuccugaccu

SEQ ID NO: 586900 - RNA, 19 nt, Human
guacucaucuggagugcag

SEQ ID NO: 586901 - RNA, 18 nt, Human
guagagacaggguuuugc

SEQ ID NO: 586902 - RNA, 20 nt, Human
guagcagugacguguggcac

SEQ ID NO: 586903 - RNA, 18 nt, Human
guagcugggauuauaggc

SEQ ID NO: 586904 - RNA, 18 nt, Human
gugccagugcugguggag

SEQ ID NO: 586905 - RNA, 19 nt, Human
guguaccaccacacccagc

SEQ ID NO: 586906 - RNA, 22 nt, Human
guugguuugcucauuuguucuc

SEQ ID NO: 586907 - RNA, 24 nt, Human
guuuugcuauguugcucaggcugg

SEQ ID NO: 586908 - RNA, 27 nt, Human
uaagcgaucuuccugccucagccuccu

SEQ ID NO: 586909 - RNA, 24 nt, Human
uaauuuuuguauuuuuaguagaga

SEQ ID NO: 586910 - RNA, 22 nt, Human
uaauuuuuguauuuuuuguaga

SEQ ID NO: 586911 - RNA, 24 nt, Human
uaauuuuuguauuuuuuguagaga

SEQ ID NO: 586912 - RNA, 24 nt, Human
uacaggcacccgccacuacaccca

SEQ ID NO: 586913 - RNA, 23 nt, Human
uacaggcgugagccaccgcgccc

SEQ ID NO: 586914 - RNA, 22 nt, Human
uaccaccacacccagcuaauuu

SEQ ID NO: 586915 - RNA, 20 nt, Human
uacuccagggcaggugcugg

SEQ ID NO: 586916 - RNA, 22 nt, Human
uagagacaggguuuugcuaugu

SEQ ID NO: 586917 - RNA, 21 nt, Human
uagcacauuugcucuucuucu

SEQ ID NO: 586918 - RNA, 24 nt, Human
uaggcuuaagcgaucuuccugccu

SEQ ID NO: 586919 - RNA, 25 nt, Human
uaguagagauggggguuucaccaug

SEQ ID NO: 586920 - RNA, 23 nt, Human
uauguugcucaggcuggucucaa

SEQ ID NO: 586921 - RNA, 24 nt, Human
uauguugcucaggcuggucucaaa

SEQ ID NO: 586922 - RNA, 24 nt, Human
ucacccaggcuggagugcaguggc

SEQ ID NO: 586923 - RNA, 19 nt, Human
ucacuacagccuccgucuc

SEQ ID NO: 586924 - RNA, 24 nt, Human
ucacuacagccuccgucuccuagg

SEQ ID NO: 586925 - RNA, 25 nt, Human
ucacuacagccuccgucuccuaggc

SEQ ID NO: 586926 - RNA, 18 nt, Human
ucacugcaacuucugccc

SEQ ID NO: 586927 - RNA, 21 nt, Human
ucacugcaacuucugcccccc

SEQ ID NO: 586928 - RNA, 23 nt, Human
ucacugcaacuucugccccccac

SEQ ID NO: 586929 - RNA, 20 nt, Human
ucauccuccuccccagccag

SEQ ID NO: 586930 - RNA, 20 nt, Human
uccagggcaggugcugugag

SEQ ID NO: 586931 - RNA, 24 nt, Human
ucccaaagugcugggauuacaggc

SEQ ID NO: 586932 - RNA, 23 nt, Human
ucccaaagugcuggguuuacagg

SEQ ID NO: 586933 - RNA, 23 nt, Human
uccccagccagcucaccuggagc

SEQ ID NO: 586934 - RNA, 21 nt, Human
ucccucacagugcguagcagu

SEQ ID NO: 586935 - RNA, 24 nt, Human
uccuaaguagcugggauuauaggc

SEQ ID NO: 586936 - RNA, 20 nt, Human
uccuaggcuuaagcgaucuu

SEQ ID NO: 586937 - RNA, 23 nt, Human
uccugaguacugggacuacaggc

SEQ ID NO: 586938 - RNA, 24 nt, Human
uccugaguacugggacuacaggca

SEQ ID NO: 586939 - RNA, 22 nt, Human
uccuuggaggagacaguaacgg

SEQ ID NO: 586940 - RNA, 21 nt, Human
ucuaucacaauuauuucuuug

SEQ ID NO: 586941 - RNA, 23 nt, Human
ucucaaacuccugagcucaagug

SEQ ID NO: 586942 - RNA, 26 nt, Human
ucucacggagcuuccacuccuuggag

SEQ ID NO: 586943 - RNA, 24 nt, Human
ucuccugccucagccuccuaagua

SEQ ID NO: 586944 - RNA, 19 nt, Human
ucucgaacuccugaccucg

SEQ ID NO: 586945 - RNA, 23 nt, Human
ucucucucugucacccaggcugg

SEQ ID NO: 586946 - RNA, 24 nt, Human
ucucucucugucacccaggcugga

SEQ ID NO: 586947 - RNA, 24 nt, Human
ucucucugucacccaggcuggagu

SEQ ID NO: 586948 - RNA, 22 nt, Human
ucuggagccccauugucagccc

SEQ ID NO: 586949 - RNA, 24 nt, Human
ucugucacccaggcuggagugcag

SEQ ID NO: 586950 - RNA, 25 nt, Human
ugaaacacugggguauuuuuggaaa

SEQ ID NO: 586951 - RNA, 21 nt, Human
ugaauguuuugcccuaacccc

SEQ ID NO: 586952 - RNA, 21 nt, Human
ugagcccuauucauccuccuc

SEQ ID NO: 586953 - RNA, 21 nt, Human
ugagcucaagugauuugcccu

SEQ ID NO: 586954 - RNA, 22 nt, Human
ugagcucaagugauuugcccuc

SEQ ID NO: 586955 - RNA, 19 nt, Human
ugaguccucugguuuugug

SEQ ID NO: 586956 - RNA, 24 nt, Human
ugaucugcccaccuggggcuccca

SEQ ID NO: 586957 - RNA, 22 nt, Human
ugauuugcccuccucagucucc

SEQ ID NO: 586958 - RNA, 22 nt, Human
ugcaguggcaccaucucagcuc

SEQ ID NO: 586959 - RNA, 22 nt, Human
ugcccaccuggggcucccaaag

SEQ ID NO: 586960 - RNA, 24 nt, Human
ugccucagccuccuaaguagcugg

SEQ ID NO: 586961 - RNA, 23 nt, Human
ugccucagccuccugaguacugg

SEQ ID NO: 586962 - RNA, 24 nt, Human
ugcuauguugcucaggcuggucuc

SEQ ID NO: 586963 - RNA, 24 nt, Human
ugcugggauuacaggcgugagcca

SEQ ID NO: 586964 - RNA, 23 nt, Human
uggagugcaguggcacaaucucg

SEQ ID NO: 586965 - RNA, 24 nt, Human
uggagugcaguggcacaaucucgg

SEQ ID NO: 586966 - RNA, 19 nt, Human
uggagugcaguggcaccau

SEQ ID NO: 586967 - RNA, 23 nt, Human
uggagugcaguggcaccaucuca

SEQ ID NO: 586968 - RNA, 24 nt, Human
uggcacaaucucggcucacugcaa

SEQ ID NO: 586969 - RNA, 19 nt, Human
uggcaccaucucagcucac

SEQ ID NO: 586970 - RNA, 23 nt, Human
uggcaccaucucagcucacuaca

SEQ ID NO: 586971 - RNA, 24 nt, Human
uggccaggcuggucucgaacuccu

SEQ ID NO: 586972 - RNA, 21 nt, Human
ugggacuacaggcacccgcca

SEQ ID NO: 586973 - RNA, 22 nt, Human
ugggacuacaggcacccgccac

SEQ ID NO: 586974 - RNA, 22 nt, Human
ugggacuacaggcacccgccac

SEQ ID NO: 586975 - RNA, 24 nt, Human
ugggacuacaggcacccgccacua

SEQ ID NO: 586976 - RNA, 18 nt, Human
ugggauuacaggcgugag

SEQ ID NO: 586977 - RNA, 19 nt, Human
ugggauuacaggcgugagc

SEQ ID NO: 586978 - RNA, 21 nt, Human
ugggauuacaggcgugagcca

SEQ ID NO: 586979 - RNA, 22 nt, Human
ugggauuacaggcgugagccac

SEQ ID NO: 586980 - RNA, 23 nt, Human
ugggauuacaggcgugagccacc

SEQ ID NO: 586981 - RNA, 24 nt, Human
ugggauuacaggcgugagccaccg

SEQ ID NO: 586982 - RNA, 21 nt, Human
ugggauuauaggcguguacca

SEQ ID NO: 586983 - RNA, 22 nt, Human
ugggauuauaggcguguaccac

SEQ ID NO: 586984 - RNA, 24 nt, Human
ugggauuauaggcguguaccacca

SEQ ID NO: 586985 - RNA, 22 nt, Human
ugggcagugggcacaggggccu

SEQ ID NO: 586986 - RNA, 19 nt, Human
ugggccugggcagugggca

SEQ ID NO: 586987 - RNA, 24 nt, Human
uggggguuucaccauguuggccag

SEQ ID NO: 586988 - RNA, 21 nt, Human
ugggucucagugccagugcug

SEQ ID NO: 586989 - RNA, 22 nt, Human
uggguuuacaggugugagcugc

SEQ ID NO: 586990 - RNA, 18 nt, Human
ugguggaguggguggggg

SEQ ID NO: 586991 - RNA, 24 nt, Human
uguagagacaggguuuugcuaugu

SEQ ID NO: 586992 - RNA, 21 nt, Human
uguauuuuuaguagagauggg

SEQ ID NO: 586993 - RNA, 18 nt, Human
ugucaagugauaguaaca

SEQ ID NO: 586994 - RNA, 20 nt, Human
ugucacugaugaaguuugaa

SEQ ID NO: 586995 - RNA, 18 nt, Human
ugugggucauaggggucc

SEQ ID NO: 586996 - RNA, 20 nt, Human
uguugcucaggcuggucuca

SEQ ID NO: 586997 - RNA, 23 nt, Human
uguuugauaaaaguaggugugug

SEQ ID NO: 586998 - RNA, 24 nt, Human
uguuuuguacucagcacaguucua

SEQ ID NO: 586999 - RNA, 25 nt, Human
uuaguagagauggggguuucaccau

SEQ ID NO: 587000 - RNA, 23 nt, Human
uuauguaugucuuucuccuaacu

SEQ ID NO: 587001 - RNA, 18 nt, Human
uucaagaaauaacagucc

SEQ ID NO: 587002 - RNA, 22 nt, Human
uucaagaaauaacaguccagca

SEQ ID NO: 587003 - RNA, 21 nt, Human
uucaagcgauucuccugccuc

SEQ ID NO: 587004 - RNA, 23 nt, Human
uucaagcgauucuccugccucag

SEQ ID NO: 587005 - RNA, 24 nt, Human
uucaagcgauucuccugccucagc

SEQ ID NO: 587006 - RNA, 27 nt, Human
uuccuagaaauaagcagugaagaaaaa

SEQ ID NO: 587007 - RNA, 22 nt, Human
uugaaagacagacagcgcucga

SEQ ID NO: 587008 - RNA, 20 nt, Human
uugcucauuuguucuccuga

SEQ ID NO: 587009 - RNA, 24 nt, Human
uuguagagacaggguuuugcuaug

SEQ ID NO: 587010 - RNA, 24 nt, Human
uuguauuuuuaguagagauggggg

SEQ ID NO: 587011 - RNA, 24 nt, Human
uuucaccauguuggccaggcuggu

SEQ ID NO: 587012 - RNA, 21 nt, Human
uuucuucuuuucuuuucagcc

SEQ ID NO: 587013 - RNA, 24 nt, Human
uuuguagagacaggguuuugcuau

SEQ ID NO: 587014 - RNA, 19 nt, Human
uuuugcuauguugcucagg

SEQ ID NO: 587015 - RNA, 23 nt, Human
uuuugcuauguugcucaggcugg

SEQ ID NO: 587016 - RNA, 25 nt, Human
uuuuuaguagagauggggguuucac

SEQ ID NO: 587017 - RNA, 20 nt, Human
uuuuuguauuuuuaguagag

SEQ ID NO: 587018 - RNA, 20 nt, Human
uuuuuguauuuuuuguagag

SEQ ID NO: 587019 - RNA, 23 nt, Human
uuuuuguauuuuuuguagagaca

SEQ ID NO: 587020 - RNA, 21 nt, Human
uuuuuuguagagacaggguuu

SEQ ID NO: 587021 - RNA, 24 nt, Human
uuuuuuguagagacaggguuuugc

SEQ ID NO: 587022 - RNA, 18 nt, Human
aaacaaccgaaaacaucc

SEQ ID NO: 587023 - RNA, 23 nt, Human
aaccgaaaacaucccgugccgga

SEQ ID NO: 587024 - RNA, 19 nt, Human
aagagcaaacccaaggaac

SEQ ID NO: 587025 - RNA, 20 nt, Human
acaaccgaaaacaucccgug

SEQ ID NO: 587026 - RNA, 24 nt, Human
acaccgggccccaccacaccaggc

SEQ ID NO: 587027 - RNA, 24 nt, Human
acagaauuucaccauguuggccag

SEQ ID NO: 587028 - RNA, 18 nt, Human
accauguuggccaggcug

SEQ ID NO: 587029 - RNA, 19 nt, Human
acccuccggucccaaacac

SEQ ID NO: 587030 - RNA, 23 nt, Human
agaauuucaccauguuggccagg

SEQ ID NO: 587031 - RNA, 18 nt, Human
agccucccgaauagcugg

SEQ ID NO: 587032 - RNA, 20 nt, Human
aggcaugcaccaccaugccc

SEQ ID NO: 587033 - RNA, 25 nt, Human
aggcuggagugcaguggcaugaucu

SEQ ID NO: 587034 - RNA, 19 nt, Human
agugcaguggcaugaucuc

SEQ ID NO: 587035 - RNA, 21 nt, Human
agugcaguggcaugaucucag

SEQ ID NO: 587036 - RNA, 23 nt, Human
agugcaguggcaugaucucagcu

SEQ ID NO: 587037 - RNA, 24 nt, Human
aguggcaugaucucagcucacugc

SEQ ID NO: 587038 - RNA, 19 nt, Human
aucugccugccuuggccuc

SEQ ID NO: 587039 - RNA, 22 nt, Human
auuuuuguauuuuuaguagaga

SEQ ID NO: 587040 - RNA, 24 nt, Human
auuuuuguauuuuuaguagagaca

SEQ ID NO: 587041 - RNA, 21 nt, Human
caaacaccgggccccaccaca

SEQ ID NO: 587042 - RNA, 21 nt, Human
caaccgaaaacaucccgugcc

SEQ ID NO: 587043 - RNA, 26 nt, Human
caaggaacucaucagccgucaacacc

SEQ ID NO: 587044 - RNA, 22 nt, Human
caagugauucuccuaccucagc

SEQ ID NO: 587045 - RNA, 20 nt, Human
caccacaccaggccccucuc

SEQ ID NO: 587046 - RNA, 22 nt, Human
caccaccaugcccggcucauuu

SEQ ID NO: 587047 - RNA, 23 nt, Human
caccaggccccucuccacacucu

SEQ ID NO: 587048 - RNA, 19 nt, Human
caccaugcccggcucauuu

SEQ ID NO: 587049 - RNA, 21 nt, Human
caccauguuggccaggcuggu

SEQ ID NO: 587050 - RNA, 24 nt, Human
caccauguuggccaggcugguuuc

SEQ ID NO: 587051 - RNA, 31 nt, Human; identical to SEQ ID NO: 466129

SEQ ID NO: 587052 - RNA, 23 nt, Human
cacccuccggucccaaacaccuc

SEQ ID NO: 587053 - RNA, 21 nt, Human
cacugcaacuuccgccuccug

SEQ ID NO: 587054 - RNA, 23 nt, Human
cacugcaacuuccgccuccuggg

SEQ ID NO: 587055 - RNA, 24 nt, Human
cagaauuucaccauguuggccagg

SEQ ID NO: 587056 - RNA, 23 nt, Human
cauguuggccaggcugguuucaa

SEQ ID NO: 587057 - RNA, 19 nt, Human
ccacaccaggccccucucc

SEQ ID NO: 587058 - RNA, 27 nt, Human
ccaggccccucuccacacucuccuuuc

SEQ ID NO: 587059 - RNA, 23 nt, Human
ccccaccacaccaggccccucuc

SEQ ID NO: 587060 - RNA, 23 nt, Human
ccccucuccacacucuccuuucc

SEQ ID NO: 587061 - RNA, 24 nt, Human
ccgccuccuggguucaagugauuc

SEQ ID NO: 587062 - RNA, 21 nt, Human
ccggcaugugcugcccuuccu

SEQ ID NO: 587063 - RNA, 20 nt, Human
ccgggccccaccacaccagg

SEQ ID NO: 587064 - RNA, 22 nt, Human
ccuccggucccaaacaccgggc

SEQ ID NO: 587065 - RNA, 24 nt, Human
ccuccuggguucaagugauucucc

SEQ ID NO: 587066 - RNA, 24 nt, Human
ccucuccacacucuccuuuccuca

SEQ ID NO: 587067 - RNA, 21 nt, Human
ccugaucucaaaugaucugcc

SEQ ID NO: 587068 - RNA, 23 nt, Human
ccugaucucaaaugaucugccug

SEQ ID NO: 587069 - RNA, 22 nt, Human
ccugccuuggccucccaaagug

SEQ ID NO: 587070 - RNA, 23 nt, Human
ccuggguucaagugauucuccuc

SEQ ID NO: 587071 - RNA, 24 nt, Human
cgcucuguugcccaggcuggagug

SEQ ID NO: 587072 - RNA, 18 nt, Human
cucaaaugaucugccugc

SEQ ID NO: 587073 - RNA, 20 nt, Human
cucaaaugaucugccugccu

SEQ ID NO: 587074 - RNA, 24 nt, Human
cucacugcaacuuccgccuccugg

SEQ ID NO: 587075 - RNA, 21 nt, Human
cuccggcaugugcugcccuuc

SEQ ID NO: 587076 - RNA, 20 nt, Human
cuccuggguucaagugauuc

SEQ ID NO: 587077 - RNA, 21 nt, Human
cuccuggguucaagugauucu

SEQ ID NO: 587078 - RNA, 24 nt, Human
cucgcucuguugcccaggcuggag

SEQ ID NO: 587079 - RNA, 23 nt, Human
cugcaacuuccgccuccuggguu

SEQ ID NO: 587080 - RNA, 23 nt, Human
cugccuuggccucccaaagugcu

SEQ ID NO: 587081 - RNA, 24 nt, Human
cuggagugcaguggcaugaucuca

SEQ ID NO: 587082 - RNA, 22 nt, Human
cuuccgccuccuggguucaagu

SEQ ID NO: 587083 - RNA, 21 nt, Human
cuuucuccggcaugugcugcc

SEQ ID NO: 587084 - RNA, 24 nt, Human
gaauagcugggcuuacaggcaugc

SEQ ID NO: 587085 - RNA, 21 nt, Human
gagacagaauuucaccauguu

SEQ ID NO: 587086 - RNA, 21 nt, Human
gauucuccuaccucagccucc

SEQ ID NO: 587087 - RNA, 20 nt, Human
gcccaggcuggagugcagug

SEQ ID NO: 587088 - RNA, 24 nt, Human
gcccaggcuggagugcaguggcau

SEQ ID NO: 587089 - RNA, 22 nt, Human
gccuuggccucccaaagugcug

SEQ ID NO: 587090 - RNA, 25 nt, Human
gcucuguugcccaggcuggagugca

SEQ ID NO: 587091 - RNA, 24 nt, Human
gcuuacaggcaugcaccaccaugc

SEQ ID NO: 587092 - RNA, 23 nt, Human
ggagucucgcucuguugcccagg

SEQ ID NO: 587093 - RNA, 24 nt, Human
ggcugguuucaaacuccugaucuc

SEQ ID NO: 587094 - RNA, 24 nt, Human
gugauucuccuaccucagccuccc

SEQ ID NO: 587095 - RNA, 23 nt, Human
uacaggcaugcaccaccaugccc

SEQ ID NO: 587096 - RNA, 27 nt, Human
uaccucagccucccgaauagcugggcu

SEQ ID NO: 587097 - RNA, 22 nt, Human
uagagacagaauuucaccaugu

SEQ ID NO: 587098 - RNA, 24 nt, Human
uaguagagacagaauuucaccaug

SEQ ID NO: 587099 - RNA, 26 nt, Human
uaguagagacagaauuucaccauguu

SEQ ID NO: 587100 - RNA, 24 nt, Human
ucacugcaacuuccgccuccuggg

SEQ ID NO: 587101 - RNA, 25 nt, Human
ucacugcaacuuccgccuccugggu

SEQ ID NO: 587102 - RNA, 27 nt, Human
ucacugcaacuuccgccuccuggguuc

SEQ ID NO: 587103 - RNA, 19 nt, Human
ucagccgucaacacccucc

SEQ ID NO: 587104 - RNA, 20 nt, Human
ucagccucccgaauagcugg

SEQ ID NO: 587105 - RNA, 20 nt, Human
uccacacucuccuuuccuca

SEQ ID NO: 587106 - RNA, 21 nt, Human
uccuggguucaagugauucuc

SEQ ID NO: 587107 - RNA, 23 nt, Human
uccuggguucaagugauucuccu

SEQ ID NO: 587108 - RNA, 24 nt, Human
ucgcucuguugcccaggcuggagu

SEQ ID NO: 587109 - RNA, 26 nt, Human
ucuccuaccucagccucccgaauagc

SEQ ID NO: 587110 - RNA, 19 nt, Human
ucucgcucuguugcccagg

SEQ ID NO: 587111 - RNA, 23 nt, Human
ucucgcucuguugcccaggcugg

SEQ ID NO: 587112 - RNA, 24 nt, Human
ucucgcucuguugcccaggcugga

SEQ ID NO: 587113 - RNA, 26 nt, Human
ucucgcucuguugcccaggcuggagu

SEQ ID NO: 587114 - RNA, 27 nt, Human
ucucgcucuguugcccaggcuggagug

SEQ ID NO: 587115 - RNA, 18 nt, Human
ucuguugcccaggcugga

SEQ ID NO: 587116 - RNA, 24 nt, Human
ucuguugcccaggcuggagugcag

SEQ ID NO: 587117 - RNA, 22 nt, Human
ugagauggagucucgcucuguu

SEQ ID NO: 587118 - RNA, 18 nt, Human
ugaucucaaaugaucugc

SEQ ID NO: 587119 - RNA, 20 nt, Human
ugauucuccuaccucagccu

SEQ ID NO: 587120 - RNA, 22 nt, Human
ugcaguggcaugaucucagcuc

SEQ ID NO: 587121 - RNA, 18 nt, Human
ugcccaggcuggagugca

SEQ ID NO: 587122 - RNA, 21 nt, Human
ugcccaggcuggagugcagug

SEQ ID NO: 587123 - RNA, 22 nt, Human
ugcccaggcuggagugcagugg

SEQ ID NO: 587124 - RNA, 24 nt, Human
ugcccaggcuggagugcaguggca

SEQ ID NO: 587125 - RNA, 18 nt, Human
ugccugccuuggccuccc

SEQ ID NO: 587126 - RNA, 24 nt, Human
uggagucucgcucuguugcccagg

SEQ ID NO: 587127 - RNA, 19 nt, Human
uggagugcaguggcaugau

SEQ ID NO: 587128 - RNA, 24 nt, Human
uggagugcaguggcaugaucucag

SEQ ID NO: 587129 - RNA, 24 nt, Human
uggcaugaucucagcucacugcaa

SEQ ID NO: 587130 - RNA, 24 nt, Human
uggccaggcugguuucaaacuccu

SEQ ID NO: 587131 - RNA, 24 nt, Human
ugggcuuacaggcaugcaccacca

SEQ ID NO: 587132 - RNA, 23 nt, Human
uggguucaagugauucuccuacc

SEQ ID NO: 587133 - RNA, 21 nt, Human
ugugcugcccuuccuggaguc

SEQ ID NO: 587134 - RNA, 24 nt, Human
uuaguagagacagaauuucaccau

SEQ ID NO: 587135 - RNA, 23 nt, Human
uucaagugauucuccuaccucag

SEQ ID NO: 587136 - RNA, 24 nt, Human
uucaagugauucuccuaccucagc

SEQ ID NO: 587137 - RNA, 18 nt, Human
uuggccucccaaagugcu

SEQ ID NO: 587138 - RNA, 24 nt, Human
uuucaccauguuggccaggcuggu

SEQ ID NO: 587139 - RNA, 24 nt, Human
uuuuuaguagagacagaauuucac

SEQ ID NO: 587140 - RNA, 20 nt, Human
uuuuuguauuuuuaguagag

SEQ ID NO: 587141 - RNA, 19 nt, Human
aaggcagaaaaaaacucac

SEQ ID NO: 587142 - RNA, 27 nt, Human
agaaauuaaaugagaauuuaaucaaau

SEQ ID NO: 587143 - RNA, 22 nt, Human
caaaaggaguaaacauacaucu

SEQ ID NO: 587144 - RNA, 24 nt, Human
cagaaaaaaacucacauuuacuca

SEQ ID NO: 587145 - RNA, 25 nt, Human
uacuacuagaaauuaaaugagaagg

SEQ ID NO: 587146 - RNA, 24 nt, Human
uaucauccaucaaaaggaguaaac

SEQ ID NO: 587147 - RNA, 18 nt, Human
uuacaaggcagaaaaaaa

SEQ ID NO: 587148 - RNA, 18 nt, Human
aaaaaaaaaaaagaaaaa

SEQ ID NO: 587149 - RNA, 19 nt, Human
aaaaaaaaaaagaaaaaaa

SEQ ID NO: 587150 - RNA, 22 nt, Human
aaaaaaaaaagaaaaaaaaaag

SEQ ID NO: 587151 - RNA, 22 nt, Human
aaaaaaaagaaaaaaaaaagaa

SEQ ID NO: 587152 - RNA, 24 nt, Human
aaaaaaaagaauguuaucuacagg

SEQ ID NO: 587153 - RNA, 23 nt, Human
aaaacagcuggcacacaccaagc

SEQ ID NO: 587154 - RNA, 18 nt, Human
aaaacaucacucccaaaa

SEQ ID NO: 587155 - RNA, 21 nt, Human
aaaaggagacuggacuuguca

SEQ ID NO: 587156 - RNA, 22 nt, Human
aaacagcuggcacacaccaagc

SEQ ID NO: 587157 - RNA, 18 nt, Human
aaacaucacucccaaaac

SEQ ID NO: 587158 - RNA, 19 nt, Human
aaacaucacucccaaaaca

SEQ ID NO: 587159 - RNA, 21 nt, Human
aaacaucacucccaaaacagc

SEQ ID NO: 587160 - RNA, 22 nt, Human
aaacugauguggccaucauagu

SEQ ID NO: 587161 - RNA, 20 nt, Human
aaagugcugggauuauaggc

SEQ ID NO: 587162 - RNA, 23 nt, Human
aaagugcugggauuauaggcgug

SEQ ID NO: 587163 - RNA, 24 nt, Human
aaagugcugggauuauaggcguga

SEQ ID NO: 587164 - RNA, 22 nt, Human
aacaaggaaaaauugaaaaaaa

SEQ ID NO: 587165 - RNA, 21 nt, Human
aacagcaaagacaaugugacc

SEQ ID NO: 587166 - RNA, 19 nt, Human
aaccaagaaaccuuaacag

SEQ ID NO: 587167 - RNA, 19 nt, Human
aaccuuaacagcaaagaca

SEQ ID NO: 587168 - RNA, 22 nt, Human
aagcauaaccagaacuauauaa

SEQ ID NO: 587169 - RNA, 20 nt, Human
aaggaaaaacaucacuccca

SEQ ID NO: 587170 - RNA, 23 nt, Human
aagugauucuugucucagccucc

SEQ ID NO: 587171 - RNA, 19 nt, Human
aagugcugggauuauaggc

SEQ ID NO: 587172 - RNA, 19 nt, Human
aagugcugggauuauaggc

SEQ ID NO: 587173 - RNA, 26 nt, Human
aagugcugggauuauaggcgugagcc

SEQ ID NO: 587174 - RNA, 19 nt, Human
aaucauauuuacuucucau

SEQ ID NO: 587175 - RNA, 21 nt, Human
accgcaaccuuugccucccgg

SEQ ID NO: 587176 - RNA, 22 nt, Human
accgcaaccuuugccucccggg

SEQ ID NO: 587177 - RNA, 20 nt, Human
acugggcccagccagaaauu

SEQ ID NO: 587178 - RNA, 21 nt, Human
agaaauaaggaaaaacaucac

SEQ ID NO: 587179 - RNA, 23 nt, Human
agagaaauaaggaaaaacaucac

SEQ ID NO: 587180 - RNA, 19 nt, Human
agaugccgaagagcuauag

SEQ ID NO: 587181 - RNA, 21 nt, Human
agaugccgaagagcuauagcc

SEQ ID NO: 587182 - RNA, 20 nt, Human
aggcagagucuugcucugua

SEQ ID NO: 587183 - RNA, 21 nt, Human
aggcgugagccacugggccca

SEQ ID NO: 587184 - RNA, 21 nt, Human
agggacaauggaaagcuuggc

SEQ ID NO: 587185 - RNA, 22 nt, Human
aggguuuugccauguuggccag

SEQ ID NO: 587186 - RNA, 23 nt, Human
aggguuuugccauguuggccagg

SEQ ID NO: 587187 - RNA, 23 nt, Human
aguacaguggcaugcucgcagcu

SEQ ID NO: 587188 - RNA, 23 nt, Human
auaggguuuugccauguuggcca

SEQ ID NO: 587189 - RNA, 24 nt, Human
auaggguuuugccauguuggccag

SEQ ID NO: 587190 - RNA, 28 nt, Human
aucacucccaaaacagcuggcacacacc

SEQ ID NO: 587191 - RNA, 24 nt, Human
auuuuuguauuuuuaguagagaua

SEQ ID NO: 587192 - RNA, 25 nt, Human
caaaacagcuggcacacaccaagcc

SEQ ID NO: 587193 - RNA, 22 nt, Human
caacagagaggaaaagccugaa

SEQ ID NO: 587194 - RNA, 25 nt, Human
caaggaagcaugacuuuaauuuucc

SEQ ID NO: 587195 - RNA, 20 nt, Human
caagugauucuugucucagc

SEQ ID NO: 587196 - RNA, 22 nt, Human
cacagccuuugacaagaacaag

SEQ ID NO: 587197 - RNA, 24 nt, Human
caccacaccugguuaauuuuugua

SEQ ID NO: 587198 - RNA, 26 nt, Human
caccugguuaauuuuuguauuuuuag

SEQ ID NO: 587199 - RNA, 25 nt, Human
cacucccaaaacagcuggcacacug

SEQ ID NO: 587200 - RNA, 21 nt, Human
cacugugguucacuuaaauca

SEQ ID NO: 587201 - RNA, 22 nt, Human
cacuucuaaaagccauccagag

SEQ ID NO: 587202 - RNA, 27 nt, Human
cagaugccgaagagcuauagccagaga

SEQ ID NO: 587203 - RNA, 22 nt, Human
cagccuccugaguagcuacaug

SEQ ID NO: 587204 - RNA, 23 nt, Human
cagcuuaccgcaaccuuugccuc

SEQ ID NO: 587205 - RNA, 20 nt, Human
caggccucaucucagggguc

SEQ ID NO: 587206 - RNA, 18 nt, Human
caguaguaaccuccuugg

SEQ ID NO: 587207 - RNA, 20 nt, Human
caugugccugucaccacacc

SEQ ID NO: 587208 - RNA, 24 nt, Human
cauguuggccaggcuggucucaaa

SEQ ID NO: 587209 - RNA, 22 nt, Human
ccaaaucuggaucacccaauag

SEQ ID NO: 587210 - RNA, 18 nt, Human
ccagggugauggucccuu

SEQ ID NO: 587211 - RNA, 27 nt, Human
ccauccagagagaaagaugcugauugc

SEQ ID NO: 587212 - RNA, 24 nt, Human
ccaucuguaaaccaagaaaccuua

SEQ ID NO: 587213 - RNA, 19 nt, Human
ccauguuggccaggcuggu

SEQ ID NO: 587214 - RNA, 22 nt, Human
ccauguuggccaggcuggucuc

SEQ ID NO: 587215 - RNA, 26 nt, Human
cccaaaacagcuggcacacaccaagc

SEQ ID NO: 587216 - RNA, 19 nt, Human
ccgcaaccuuugccucccg

SEQ ID NO: 587217 - RNA, 23 nt, Human
ccgcaaccuuugccucccggguu

SEQ ID NO: 587218 - RNA, 24 nt, Human
ccgcaaccuuugccucccggguuc

SEQ ID NO: 587219 - RNA, 23 nt, Human
ccuaaagugcugggauuauaggc

SEQ ID NO: 587220 - RNA, 21 nt, Human
ccucccggguucaagugauuc

SEQ ID NO: 587221 - RNA, 20 nt, Human
ccugaccucaaaugauugcc

SEQ ID NO: 587222 - RNA, 23 nt, Human
ccugaccucaaaugauugcccac

SEQ ID NO: 587223 - RNA, 22 nt, Human
cggguucaagugauucuugucu

SEQ ID NO: 587224 - RNA, 24 nt, Human
cuaaagugcugggauuauaggcgu

SEQ ID NO: 587225 - RNA, 21 nt, Human
cuaacuugucugcaacuucac

SEQ ID NO: 587226 - RNA, 21 nt, Human
cuacagguuaauucuugacau

SEQ ID NO: 587227 - RNA, 21 nt, Human
cuauagccagagaggaagggc

SEQ ID NO: 587228 - RNA, 24 nt, Human
cuugucucagccuccugaguagcu

SEQ ID NO: 587229 - RNA, 18 nt, Human
cuuuggaaaauuccaagu

SEQ ID NO: 587230 - RNA, 20 nt, Human
gaaaaaaaaaaaaaagaaaa

SEQ ID NO: 587231 - RNA, 22 nt, Human
gaaaaaaaaaaaaaagaaaaaa

SEQ ID NO: 587232 - RNA, 22 nt, Human
gaauucccaguacagugacugu

SEQ ID NO: 587233 - RNA, 23 nt, Human
gaccucaaaugauugcccaccuu

SEQ ID NO: 587234 - RNA, 24 nt, Human
gagcacuuaacacuuaaacugaug

SEQ ID NO: 587235 - RNA, 19 nt, Human
gauaggguuuugccauguu

SEQ ID NO: 587236 - RNA, 18 nt, Human
gauuauaggcgugagcca

SEQ ID NO: 587237 - RNA, 21 nt, Human
gauuauaggcgugagccacug

SEQ ID NO: 587238 - RNA, 24 nt, Human
gauuauaggcgugagccacugggc

SEQ ID NO: 587239 - RNA, 21 nt, Human
gcaagauuaccaaaaacugac

SEQ ID NO: 587240 - RNA, 20 nt, Human
gccauguuggccaggcuggu

SEQ ID NO: 587241 - RNA, 23 nt, Human
gcucaggcuggaguacaguggca

SEQ ID NO: 587242 - RNA, 24 nt, Human
gcucaggcuggaguacaguggcau

SEQ ID NO: 587243 - RNA, 19 nt, Human
gcuggaguacaguggcaug

SEQ ID NO: 587244 - RNA, 23 nt, Human
gcuggucucaaacuccugaccuc

SEQ ID NO: 587245 - RNA, 23 nt, Human
ggaagggcacugaugcccgcaga

SEQ ID NO: 587246 - RNA, 24 nt, Human
ggcuggucucaaacuccugaccuc

SEQ ID NO: 587247 - RNA, 21 nt, Human
ggguuuugccauguuggccag

SEQ ID NO: 587248 - RNA, 22 nt, Human
ggguuuugccauguuggccagg

SEQ ID NO: 587249 - RNA, 23 nt, Human
guagagauaggguuuugccaugu

SEQ ID NO: 587250 - RNA, 24 nt, Human
gucuugcucuguagcucaggcugg

SEQ ID NO: 587251 - RNA, 21 nt, Human
gugauucuugucucagccucc

SEQ ID NO: 587252 - RNA, 23 nt, Human
guuaauucuugacaucaacagag

SEQ ID NO: 587253 - RNA, 18 nt, Human
uaaaaggagacuggacuu

SEQ ID NO: 587254 - RNA, 21 nt, Human
uaaaaggagacuggacuuguc

SEQ ID NO: 587255 - RNA, 23 nt, Human
uaaagauaauacaaauggcaaga

SEQ ID NO: 587256 - RNA, 24 nt, Human
uaacacuuaaacugauguggccau

SEQ ID NO: 587257 - RNA, 21 nt, Human
uaacaguaacaaaugccuuga

SEQ ID NO: 587258 - RNA, 18 nt, Human
uaauacaaauggcaagau

SEQ ID NO: 587259 - RNA, 24 nt, Human
uaauuuuuguauuuuuaguagaga

SEQ ID NO: 587260 - RNA, 23 nt, Human
uacaaauggcaagauuaccaaaa

SEQ ID NO: 587261 - RNA, 21 nt, Human
uaccgcaaccuuugccucccg

SEQ ID NO: 587262 - RNA, 23 nt, Human
uaccgcaaccuuugccucccggg

SEQ ID NO: 587263 - RNA, 22 nt, Human
uacuuuagcuuccuugggguuc

SEQ ID NO: 587264 - RNA, 19 nt, Human
uagaagggacuacgguggc

SEQ ID NO: 587265 - RNA, 22 nt, Human
uagagauaggguuuugccaugu

SEQ ID NO: 587266 - RNA, 24 nt, Human
uaggguuuugccauguuggccagg

SEQ ID NO: 587267 - RNA, 24 nt, Human
uaguagagauaggguuuugccaug

SEQ ID NO: 587268 - RNA, 19 nt, Human
uaucaaggaagcaugacuu

SEQ ID NO: 587269 - RNA, 28 nt, Human
uaucucaggccucaucucaggggucuaa

SEQ ID NO: 587270 - RNA, 22 nt, Human
ucaaaugauugcccaccuuggc

SEQ ID NO: 587271 - RNA, 18 nt, Human
ucccaguacagugacugu

SEQ ID NO: 587272 - RNA, 20 nt, Human
ucccggguucaagugauucu

SEQ ID NO: 587273 - RNA, 20 nt, Human
ucccggguucaagugauucu

SEQ ID NO: 587274 - RNA, 24 nt, Human
uccuaaagugcugggauuauaggc

SEQ ID NO: 587275 - RNA, 18 nt, Human
uccugaccucaaaugauu

SEQ ID NO: 587276 - RNA, 20 nt, Human
uccugaguagcuacaugugc

SEQ ID NO: 587277 - RNA, 22 nt, Human
ucucaggccucaucucaggggu

SEQ ID NO: 587278 - RNA, 22 nt, Human
ucucauagagagugauaaagau

SEQ ID NO: 587279 - RNA, 19 nt, Human
ucuugcucuguagcucagg

SEQ ID NO: 587280 - RNA, 19 nt, Human
ucuugcucuguagcucagg

SEQ ID NO: 587281 - RNA, 23 nt, Human
ucuugcucuguagcucaggcugg

SEQ ID NO: 587282 - RNA, 24 nt, Human
ucuugcucuguagcucaggcugga

SEQ ID NO: 587283 - RNA, 21 nt, Human
ugaaaaaaaaaaaaaagaaaa

SEQ ID NO: 587284 - RNA, 19 nt, Human
ugacaagaacaaggaaaaa

SEQ ID NO: 587285 - RNA, 22 nt, Human
ugaggacaggccucucacugug

SEQ ID NO: 587286 - RNA, 25 nt, Human
ugaggacaggccucucacugugguu

SEQ ID NO: 587287 - RNA, 19 nt, Human
ugaguaaaccacacuaugg

SEQ ID NO: 587288 - RNA, 20 nt, Human
ugaguaaaccacacuaugga

SEQ ID NO: 587289 - RNA, 23 nt, Human
ugccaugaaagaaaccauggcag

SEQ ID NO: 587290 - RNA, 24 nt, Human
ugccauguuggccaggcuggucuc

SEQ ID NO: 587291 - RNA, 26 nt, Human
ugccauguuggccaggcuggucucaa

SEQ ID NO: 587292 - RNA, 23 nt, Human
ugcucuguagcucaggcuggagu

SEQ ID NO: 587293 - RNA, 22 nt, Human
uggaaagcuuucucuucacugg

SEQ ID NO: 587294 - RNA, 20 nt, Human
uggcaagauuaccaaaaacu

SEQ ID NO: 587295 - RNA, 22 nt, Human
uggcaagauuaccaaaaacuga

SEQ ID NO: 587296 - RNA, 24 nt, Human
uggccaggcuggucucaaacuccu

SEQ ID NO: 587297 - RNA, 18 nt, Human
ugggauuauaggcgugag

SEQ ID NO: 587298 - RNA, 19 nt, Human
ugggauuauaggcgugagc

SEQ ID NO: 587299 - RNA, 21 nt, Human
ugggauuauaggcgugagcca

SEQ ID NO: 587300 - RNA, 22 nt, Human
ugggauuauaggcgugagccac

SEQ ID NO: 587301 - RNA, 22 nt, Human
ugggauuauaggcgugagccac

SEQ ID NO: 587302 - RNA, 24 nt, Human
ugggauuauaggcgugagccacug

SEQ ID NO: 587303 - RNA, 18 nt, Human
ugggcccagccagaaauu

SEQ ID NO: 587304 - RNA, 22 nt, Human
ugggcccagccagaaauucauc

SEQ ID NO: 587305 - RNA, 20 nt, Human
ugucucagccuccugaguag

SEQ ID NO: 587306 - RNA, 23 nt, Human
ugucucagccuccugaguagcua

SEQ ID NO: 587307 - RNA, 22 nt, Human
ugucugcaacuucaccaucugu

SEQ ID NO: 587308 - RNA, 19 nt, Human
ugugaccaaucauucucag

SEQ ID NO: 587309 - RNA, 23 nt, Human
uuaauuuuuguauuuuuaguaga

SEQ ID NO: 587310 - RNA, 24 nt, Human
uuaccgcaaccuuugccucccggg

SEQ ID NO: 587311 - RNA, 25 nt, Human
uuaccgcaaccuuugccucccgggu

SEQ ID NO: 587312 - RNA, 18 nt, Human
uuaguagagauaggguuu

SEQ ID NO: 587313 - RNA, 18 nt, Human
uuaguagagauaggguuu

SEQ ID NO: 587314 - RNA, 24 nt, Human
uuaguagagauaggguuuugccau

SEQ ID NO: 587315 - RNA, 21 nt, Human
uucaagugauucuugucucag

SEQ ID NO: 587316 - RNA, 24 nt, Human
uugccauguuggccaggcuggucu

SEQ ID NO: 587317 - RNA, 23 nt, Human
uugccucccggguucaagugauu

SEQ ID NO: 587318 - RNA, 18 nt, Human
uugcucuguagcucaggc

SEQ ID NO: 587319 - RNA, 27 nt, Human
uuggauggcaguaguaaccuccuugga

SEQ ID NO: 587320 - RNA, 18 nt, Human
uuggccuccuaaagugcu

SEQ ID NO: 587321 - RNA, 18 nt, Human
uuugacaagaacaaggaa

SEQ ID NO: 587322 - RNA, 24 nt, Human
uuuuccaacugcaucuucauccau

SEQ ID NO: 587323 - RNA, 23 nt, Human
uuuugccauguuggccaggcugg

SEQ ID NO: 587324 - RNA, 21 nt, Human
uuuuuaguagagauaggguuu

SEQ ID NO: 587325 - RNA, 21 nt, Human
uuuuuaguagagauaggguuu

SEQ ID NO: 587326 - RNA, 20 nt, Human
uuuuuguauuuuuaguagag

SEQ ID NO: 587327 - RNA, 22 nt, Human
aaaaaggccagacaucgccuuc

SEQ ID NO: 587328 - RNA, 20 nt, Human
aaacggccccccaccggccc

SEQ ID NO: 587329 - RNA, 21 nt, Human
aacaccuccgcagacaaaucu

SEQ ID NO: 587330 - RNA, 24 nt, Human
aacuuauccgucucucccacuguc

SEQ ID NO: 587331 - RNA, 19 nt, Human
aagcagcucuccggcucac

SEQ ID NO: 587332 - RNA, 21 nt, Human
aagcucggggcucuccagcgg

SEQ ID NO: 587333 - RNA, 22 nt, Human
acccuugauucccauuugugcc

SEQ ID NO: 587334 - RNA, 18 nt, Human
accgcagaaaaaaacgca

SEQ ID NO: 587335 - RNA, 23 nt, Human
acuccuucugucuccuccuuccu

SEQ ID NO: 587336 - RNA, 18 nt, Human
agaucagagcuaggagac

SEQ ID NO: 587337 - RNA, 21 nt, Human
agcaagcagcucuccggcuca

SEQ ID NO: 587338 - RNA, 20 nt, Human
agccuggagaucagagcuag

SEQ ID NO: 587339 - RNA, 19 nt, Human
agcugugcaaaaaaggcca

SEQ ID NO: 587340 - RNA, 18 nt, Human
agcugugcccccuccggg

SEQ ID NO: 587341 - RNA, 20 nt, Human
caaacggccccccaccggcc

SEQ ID NO: 587342 - RNA, 21 nt, Human
caacacaggaauuuggggcag

SEQ ID NO: 587343 - RNA, 23 nt, Human
caagcagcucuccggcucacauc

SEQ ID NO: 587344 - RNA, 20 nt, Human
cacaacuccacaggccggga

SEQ ID NO: 587345 - RNA, 22 nt, Human
cacaguucaguccauaacaccu

SEQ ID NO: 587346 - RNA, 29 nt, Human
caccggccccagccccgcugccgguuccg

SEQ ID NO: 587347 - RNA, 19 nt, Human
cagccccgcugcucugcgc

SEQ ID NO: 587348 - RNA, 22 nt, Human
caggcaacagcagcugugcaaa

SEQ ID NO: 587349 - RNA, 23 nt, Human
caggcaacagcagcugugcaaaa

SEQ ID NO: 587350 - RNA, 19 nt, Human
caggugaaugcuauaugaa

SEQ ID NO: 587351 - RNA, 19 nt, Human
ccacacauucaucagcccc

SEQ ID NO: 587352 - RNA, 20 nt, Human
ccagccccgcugcucugcgc

SEQ ID NO: 587353 - RNA, 27 nt, Human
ccagcgguguuuuuagcugugcccccu

SEQ ID NO: 587354 - RNA, 21 nt, Human
ccagggccuggccgccucggu

SEQ ID NO: 587355 - RNA, 18 nt, Human
cccaaacggccccccacc

SEQ ID NO: 587356 - RNA, 23 nt, Human
cccaaacggccccccaccggccc

SEQ ID NO: 587357 - RNA, 22 nt, Human
cccacacauucaucagcccccu

SEQ ID NO: 587358 - RNA, 21 nt, Human
cccacuccuugccauugucgc

SEQ ID NO: 587359 - RNA, 19 nt, Human
ccccaccggccccagcccc

SEQ ID NO: 587360 - RNA, 24 nt, Human
cccccacacauucaucagcccccu

SEQ ID NO: 587361 - RNA, 23 nt, Human
cccccuauuggacaaagucuuau

SEQ ID NO: 587362 - RNA, 21 nt, Human
cccccuccggggcuccugggc

SEQ ID NO: 587363 - RNA, 22 nt, Human
cccggccccgguaaagaaugcg

SEQ ID NO: 587364 - RNA, 23 nt, Human
cccgggccgggagucccacuccu

SEQ ID NO: 587365 - RNA, 21 nt, Human
ccgcugcucugcgcugcaggg

SEQ ID NO: 587366 - RNA, 20 nt, Human
ccgucucucccacuguccca

SEQ ID NO: 587367 - RNA, 18 nt, Human
ccuaaaagccuuaucucc

SEQ ID NO: 587368 - RNA, 24 nt, Human
ccuaaggccacugucggugaaggg

SEQ ID NO: 587369 - RNA, 23 nt, Human
ccucccacaacuccacaggccgg

SEQ ID NO: 587370 - RNA, 19 nt, Human
ccuccgcagacaaaucuga

SEQ ID NO: 587371 - RNA, 26 nt, Human
ccucugcgcggaaucacagggguugg

SEQ ID NO: 587372 - RNA, 23 nt, Human
ccuucaacacaggaauuuggggc

SEQ ID NO: 587373 - RNA, 21 nt, Human
cgaucuccgggcaggcaacag

SEQ ID NO: 587374 - RNA, 19 nt, Human
cgcacucaaggggccccag

SEQ ID NO: 587375 - RNA, 18 nt, Human
cgcugcucugcgcugcag

SEQ ID NO: 587376 - RNA, 19 nt, Human
cucaugcaucccugggcuc

SEQ ID NO: 587377 - RNA, 18 nt, Human
cuccggggcuccugggcg

SEQ ID NO: 587378 - RNA, 24 nt, Human
cuccuucugucuccuccuuccucc

SEQ ID NO: 587379 - RNA, 20 nt, Human
cucugcgcugcagccucccc

SEQ ID NO: 587380 - RNA, 19 nt, Human
cuguggccccugggguugg

SEQ ID NO: 587381 - RNA, 20 nt, Human
gaagggggucuucccucacc

SEQ ID NO: 587382 - RNA, 18 nt, Human
gagcucuggaccgaaaac

SEQ ID NO: 587383 - RNA, 18 nt, Human
gccacccucucaugcauc

SEQ ID NO: 587384 - RNA, 18 nt, Human
gccuuaucuccaaauaca

SEQ ID NO: 587385 - RNA, 18 nt, Human
ggaaucacagggguagcc

SEQ ID NO: 587386 - RNA, 22 nt, Human
ggcccgggugggugaauucugg

SEQ ID NO: 587387 - RNA, 19 nt, Human
ggccgggagucccacuccu

SEQ ID NO: 587388 - RNA, 19 nt, Human
ggguccgggacaggccugg

SEQ ID NO: 587389 - RNA, 19 nt, Human
guucagggcaggacuucuc

SEQ ID NO: 587390 - RNA, 19 nt, Human
uacagucacauggggguua

SEQ ID NO: 587391 - RNA, 21 nt, Human
uagccgccaccccggccccgg

SEQ ID NO: 587392 - RNA, 18 nt, Human
uagccgggacgcaggcgg

SEQ ID NO: 587393 - RNA, 18 nt, Human
uaggagacgcagagccac

SEQ ID NO: 587394 - RNA, 18 nt, Human
uaggccuucaacacagga

SEQ ID NO: 587395 - RNA, 22 nt, Human
uaggccuucaacacaggaauuu

SEQ ID NO: 587396 - RNA, 18 nt, Human
ucaguccauaacaccucc

SEQ ID NO: 587397 - RNA, 18 nt, Human
ucccaaacggccccccac

SEQ ID NO: 587398 - RNA, 20 nt, Human
ucccacuccuugccauuguc

SEQ ID NO: 587399 - RNA, 19 nt, Human
ucccagaggcaggagccac

SEQ ID NO: 587400 - RNA, 21 nt, Human
ucccagaggcaggagccaccc

SEQ ID NO: 587401 - RNA, 23 nt, Human
ucccaguucccagaggcaggagc

SEQ ID NO: 587402 - RNA, 19 nt, Human
ucccccgccgcggugagag

SEQ ID NO: 587403 - RNA, 23 nt, Human
uccgcagacaaaucugaucucug

SEQ ID NO: 587404 - RNA, 18 nt, Human
uccucccacaacuccaca

SEQ ID NO: 587405 - RNA, 20 nt, Human
uccuucugucuccuccuucc

SEQ ID NO: 587406 - RNA, 22 nt, Human
uccuucugucuccuccuuccuc

SEQ ID NO: 587407 - RNA, 24 nt, Human
uccuucugucuccuccuuccuccc

SEQ ID NO: 587408 - RNA, 19 nt, Human
ucggggcucuccagcggug

SEQ ID NO: 587409 - RNA, 21 nt, Human
ucuagccgggacgcaggcggc

SEQ ID NO: 587410 - RNA, 23 nt, Human
ucuccagcgguguuuuuagcugu

SEQ ID NO: 587411 - RNA, 18 nt, Human
ucugucuccuccuuccuc

SEQ ID NO: 587412 - RNA, 19 nt, Human
ugaaugcuauaugaauggg

SEQ ID NO: 587413 - RNA, 19 nt, Human
ugauuuccguccaggucuc

SEQ ID NO: 587414 - RNA, 23 nt, Human
ugcagccuccccgggacgcgggu

SEQ ID NO: 587415 - RNA, 22 nt, Human
ugcgagggacgcacguggcugg

SEQ ID NO: 587416 - RNA, 25 nt, Human
uggagaucagagcuaggagacgcag

SEQ ID NO: 587417 - RNA, 24 nt, Human
uggccccugggguuggcgaacccc

SEQ ID NO: 587418 - RNA, 24 nt, Human
uguaggaggaccuguggccccugg

SEQ ID NO: 587419 - RNA, 18 nt, Human
ugugccucgugugcauuu

SEQ ID NO: 587420 - RNA, 18 nt, Human
aaacccagcaaucuggga

SEQ ID NO: 587421 - RNA, 22 nt, Human
aaagagaaaacagugaacuuaa

SEQ ID NO: 587422 - RNA, 19 nt, Human
aaagugcaagggaaggcug

SEQ ID NO: 587423 - RNA, 24 nt, Human
aaagugcugggauuacagguguga

SEQ ID NO: 587424 - RNA, 18 nt, Human
aacauggugaaaccccau

SEQ ID NO: 587425 - RNA, 19 nt, Human
aacauggugaaaccccauc

SEQ ID NO: 587426 - RNA, 22 nt, Human
aacauggugaaaccccaucccc

SEQ ID NO: 587427 - RNA, 27 nt, Human
aagcgauucuccugccucagcauccca

SEQ ID NO: 587428 - RNA, 20 nt, Human
aagggguuucaccauguugg

SEQ ID NO: 587429 - RNA, 21 nt, Human
aagggguuucaccauguuggu

SEQ ID NO: 587430 - RNA, 18 nt, Human
aagugcugggauuacagg

SEQ ID NO: 587431 - RNA, 19 nt, Human
aagugcugggauuacaggu

SEQ ID NO: 587432 - RNA, 26 nt, Human
aagugcugggauuacaggugugagcc

SEQ ID NO: 587433 - RNA, 24 nt, Human
accauguuggucaggcuggucuag

SEQ ID NO: 587434 - RNA, 23 nt, Human
acccugugaacccugugaaauga

SEQ ID NO: 587435 - RNA, 24 nt, Human
accugaggucaggaguuugagacc

SEQ ID NO: 587436 - RNA, 20 nt, Human
acggcacuccagccuggggg

SEQ ID NO: 587437 - RNA, 24 nt, Human
acggcacuccagccugggggacgg

SEQ ID NO: 587438 - RNA, 22 nt, Human
acuccagccugggggacgguga

SEQ ID NO: 587439 - RNA, 23 nt, Human
agaaaacagugaacuuaaccccc

SEQ ID NO: 587440 - RNA, 21 nt, Human
agauaaacacagaagucacca

SEQ ID NO: 587441 - RNA, 22 nt, Human
agaucaccugaggucaggaguu

SEQ ID NO: 587442 - RNA, 22 nt, Human
agccuggccaacauggugaaac

SEQ ID NO: 587443 - RNA, 24 nt, Human
agccuggccaacauggugaaaccc

SEQ ID NO: 587444 - RNA, 22 nt, Human
agccugggggacggugagacuc

SEQ ID NO: 587445 - RNA, 23 nt, Human
agcuggguguggugacaggugcc

SEQ ID NO: 587446 - RNA, 23 nt, Human
agcuuccugugcuaguggcaagu

SEQ ID NO: 587447 - RNA, 20 nt, Human
aggaguuugagaccagccug

SEQ ID NO: 587448 - RNA, 26 nt, Human
aggcagaucaccugaggucaggaguu

SEQ ID NO: 587449 - RNA, 18 nt, Human
aggcagcaggugcaggca

SEQ ID NO: 587450 - RNA, 18 nt, Human
aggcaggagaauagccug

SEQ ID NO: 587451 - RNA, 24 nt, Human
aggcaggagaauagccugaacccg

SEQ ID NO: 587452 - RNA, 26 nt, Human
aggcaggcagaucaccugaggucagg

SEQ ID NO: 587453 - RNA, 20 nt, Human
aggcugaggcaggagaauag

SEQ ID NO: 587454 - RNA, 20 nt, Human
agguggagguugcagugagc

SEQ ID NO: 587455 - RNA, 24 nt, Human
agguggagguugcagugagcugag

SEQ ID NO: 587456 - RNA, 24 nt, Human
agugcaauggcaucaucuuggcuc

SEQ ID NO: 587457 - RNA, 20 nt, Human
agugcugggauuacaggugu

SEQ ID NO: 587458 - RNA, 24 nt, Human
aguuacaggcaugcaccaccaugc

SEQ ID NO: 587459 - RNA, 24 nt, Human
aucacgccacggcacuccagccug

SEQ ID NO: 587460 - RNA, 24 nt, Human
caaagugcugggauuacaggugug

SEQ ID NO: 587461 - RNA, 24 nt, Human
caacaacugaagaaugaaugauac

SEQ ID NO: 587462 - RNA, 18 nt, Human
caacauggugaaacccca

SEQ ID NO: 587463 - RNA, 22 nt, Human
caagcgauucuccugccucagc

SEQ ID NO: 587464 - RNA, 26 nt, Human
caaggcacacauucugacauuaacuu

SEQ ID NO: 587465 - RNA, 24 nt, Human
caaggcaggcagaucaccugaggu

SEQ ID NO: 587466 - RNA, 26 nt, Human
caaggcaggcagaucaccugagguca

SEQ ID NO: 587467 - RNA, 21 nt, Human
cacacuccugcagauaaacac

SEQ ID NO: 587468 - RNA, 22 nt, Human
caccaccaugccuggcuaauuu

SEQ ID NO: 587469 - RNA, 21 nt, Human
caccauguuggucaggcuggu

SEQ ID NO: 587470 - RNA, 22 nt, Human
caccauguuggucaggcugguc

SEQ ID NO: 587471 - RNA, 23 nt, Human
cacccacccuggugucccaaagu

SEQ ID NO: 587472 - RNA, 23 nt, Human
caccugaggucaggaguuugaga

SEQ ID NO: 587473 - RNA, 22 nt, Human
cacggcacuccagccuggggga

SEQ ID NO: 587474 - RNA, 23 nt, Human
cacggcacuccagccugggggac

SEQ ID NO: 587475 - RNA, 21 nt, Human
cacuccagccugggggacggu

SEQ ID NO: 587476 - RNA, 23 nt, Human
cagauaaacacagaagucaccau

SEQ ID NO: 587477 - RNA, 24 nt, Human
cagaucaccugaggucaggaguuu

SEQ ID NO: 587478 - RNA, 27 nt, Human
cagaucaccugaggucaggaguuugag

SEQ ID NO: 587479 - RNA, 24 nt, Human
cagcuacucgggaggcugaggcag

SEQ ID NO: 587480 - RNA, 24 nt, Human
caggcagaucaccugaggucagga

SEQ ID NO: 587481 - RNA, 25 nt, Human
caggugauccacccacccccugaag

SEQ ID NO: 587482 - RNA, 23 nt, Human
cauagaaagagaaaacagugaac

SEQ ID NO: 587483 - RNA, 21 nt, Human
ccaaagugcugggauuacagg

SEQ ID NO: 587484 - RNA, 21 nt, Human
ccaaagugcugggauuacagg

SEQ ID NO: 587485 - RNA, 24 nt, Human
ccaaagugcugggauuacaggugu

SEQ ID NO: 587486 - RNA, 24 nt, Human
ccaaguaucuggaguuacaggcau

SEQ ID NO: 587487 - RNA, 20 nt, Human
ccacggcacuccagccuggg

SEQ ID NO: 587488 - RNA, 24 nt, Human
ccacggcacuccagccugggggac

SEQ ID NO: 587489 - RNA, 22 nt, Human
ccauaccacaacuauucuccua

SEQ ID NO: 587490 - RNA, 21 nt, Human
cccauccccacuaaaaauaca

SEQ ID NO: 587491 - RNA, 21 nt, Human
cccgggagguggagguugcag

SEQ ID NO: 587492 - RNA, 18 nt, Human
cccuggugucccaaagug

SEQ ID NO: 587493 - RNA, 20 nt, Human
cccuuccccucuuucaguuc

SEQ ID NO: 587494 - RNA, 18 nt, Human
ccgcgccgccgccgcugc

SEQ ID NO: 587495 - RNA, 25 nt, Human
ccgcgccgccgccgcugccgcuucu

SEQ ID NO: 587496 - RNA, 21 nt, Human
ccucaggugauccacccaccc

SEQ ID NO: 587497 - RNA, 24 nt, Human
ccugaccucaggugauccacccac

SEQ ID NO: 587498 - RNA, 22 nt, Human
ccugaggucaggaguuugagac

SEQ ID NO: 587499 - RNA, 23 nt, Human
ccuggccaacauggugaaacccc

SEQ ID NO: 587500 - RNA, 24 nt, Human
ccuggccaacauggugaaacccca

SEQ ID NO: 587501 - RNA, 21 nt, Human
ccuguaaucccagcuacucgg

SEQ ID NO: 587502 - RNA, 22 nt, Human
ccuguaaucccagcuacucggg

SEQ ID NO: 587503 - RNA, 23 nt, Human
cgccacggcacuccagccugggg

SEQ ID NO: 587504 - RNA, 18 nt, Human
cgccgccgccgcugccgc

SEQ ID NO: 587505 - RNA, 21 nt, Human
cgccgccgccgcugccgcuuc

SEQ ID NO: 587506 - RNA, 21 nt, Human
cgccgcgccgccgccgcugcc

SEQ ID NO: 587507 - RNA, 22 nt, Human
cgccgcgccgccgccgcugccg

SEQ ID NO: 587508 - RNA, 29 nt, Human
cgggagguggagguugcagugacaacggu

SEQ ID NO: 587509 - RNA, 24 nt, Human
cgggagguggagguugcagugagc

SEQ ID NO: 587510 - RNA, 23 nt, Human
cguagagaagggguuucaccaug

SEQ ID NO: 587511 - RNA, 23 nt, Human
cucaugccuguaaacccagcaau

SEQ ID NO: 587512 - RNA, 21 nt, Human
cuccccgggccggugccugcg

SEQ ID NO: 587513 - RNA, 23 nt, Human
cucccuuccccucuuucaguucu

SEQ ID NO: 587514 - RNA, 23 nt, Human
cucucuuguugcccaggcuggag

SEQ ID NO: 587515 - RNA, 18 nt, Human
cucuuguugcccaggcug

SEQ ID NO: 587516 - RNA, 24 nt, Human
cugaacccgggagguggagguugc

SEQ ID NO: 587517 - RNA, 19 nt, Human
cugcagauaaacacagaag

SEQ ID NO: 587518 - RNA, 23 nt, Human
cuggccaacauggugaaacccca

SEQ ID NO: 587519 - RNA, 22 nt, Human
cugugcuaguggcaagucagau

SEQ ID NO: 587520 - RNA, 24 nt, Human
cuucucucuuguugcccaggcugg

SEQ ID NO: 587521 - RNA, 24 nt, Human
cuuguugcccaggcuggagugcaa

SEQ ID NO: 587522 - RNA, 19 nt, Human
gaagggguuucaccauguu

SEQ ID NO: 587523 - RNA, 22 nt, Human
gaagggguuucaccauguuggu

SEQ ID NO: 587524 - RNA, 22 nt, Human
gaccucaggugauccacccacc

SEQ ID NO: 587525 - RNA, 24 nt, Human
gagaagggguuucaccauguuggu

SEQ ID NO: 587526 - RNA, 22 nt, Human
gagguugcagugagcugagauc

SEQ ID NO: 587527 - RNA, 24 nt, Human
gaucaccugaggucaggaguuuga

SEQ ID NO: 587528 - RNA, 19 nt, Human
gaugcaaggaaaauccaga

SEQ ID NO: 587529 - RNA, 18 nt, Human
gauuacaggugugagcca

SEQ ID NO: 587530 - RNA, 22 nt, Human
gauuacaggugugagccacugc

SEQ ID NO: 587531 - RNA, 22 nt, Human
gauuacaggugugagccacugc

SEQ ID NO: 587532 - RNA, 28 nt, Human
gcaagggaaggcugggcgugguggcuca

SEQ ID NO: 587533 - RNA, 20 nt, Human
gcaccaccaugccuggcuaa

SEQ ID NO: 587534 - RNA, 22 nt, Human
gccaacauggugaaaccccauc

SEQ ID NO: 587535 - RNA, 24 nt, Human
gcccaggcuggagugcaauggcau

SEQ ID NO: 587536 - RNA, 20 nt, Human
gccugaacccgggaggugga

SEQ ID NO: 587537 - RNA, 22 nt, Human
gccugaacccgggagguggagg

SEQ ID NO: 587538 - RNA, 20 nt, Human
gcuggagugcaauggcauca

SEQ ID NO: 587539 - RNA, 19 nt, Human
gcugggcgugguggcucau

SEQ ID NO: 587540 - RNA, 23 nt, Human
gcuggucuagaacuccugaccuc

SEQ ID NO: 587541 - RNA, 23 nt, Human
ggaaggcugggcgugguggcuca

SEQ ID NO: 587542 - RNA, 22 nt, Human
ggagguugcagugagcugagau

SEQ ID NO: 587543 - RNA, 23 nt, Human
ggagguugcagugagcugagauc

SEQ ID NO: 587544 - RNA, 24 nt, Human
ggagguugcagugagcugagauca

SEQ ID NO: 587545 - RNA, 23 nt, Human
ggcugggcgugguggcucaugcc

SEQ ID NO: 587546 - RNA, 24 nt, Human
ggcuggucuagaacuccugaccuc

SEQ ID NO: 587547 - RNA, 24 nt, Human
gggcgugguggcucaugccuguaa

SEQ ID NO: 587548 - RNA, 22 nt, Human
gggguuucaccauguuggucag

SEQ ID NO: 587549 - RNA, 23 nt, Human
gggguuucaccauguuggucagg

SEQ ID NO: 587550 - RNA, 24 nt, Human
ggguguggugacaggugccuguaa

SEQ ID NO: 587551 - RNA, 22 nt, Human
ggguuucaccauguuggucagg

SEQ ID NO: 587552 - RNA, 19 nt, Human
ggucaggaguuugagacca

SEQ ID NO: 587553 - RNA, 22 nt, Human
ggugaaaccccauccccacuaa

SEQ ID NO: 587554 - RNA, 24 nt, Human
ggugacaggugccuguaaucccag

SEQ ID NO: 587555 - RNA, 19 nt, Human
gguggagguugcagugagc

SEQ ID NO: 587556 - RNA, 24 nt, Human
gguggcucaugccuguaaacccag

SEQ ID NO: 587557 - RNA, 20 nt, Human
guggagguugcagugagcug

SEQ ID NO: 587558 - RNA, 19 nt, Human
guugcagugagcugagauc

SEQ ID NO: 587559 - RNA, 25 nt, Human
uaaacccagcaaucugggaggccaa

SEQ ID NO: 587560 - RNA, 22 nt, Human
uacaggcaugcaccaccaugcc

SEQ ID NO: 587561 - RNA, 22 nt, Human
uacaggugugagccacugcgcc

SEQ ID NO: 587562 - RNA, 22 nt, Human
uacaggugugagccacugcgcc

SEQ ID NO: 587563 - RNA, 23 nt, Human
uacaggugugagccacugcgccu

SEQ ID NO: 587564 - RNA, 20 nt, Human
uaccacaacuauucuccuag

SEQ ID NO: 587565 - RNA, 19 nt, Human
uaccauagaaagagaaaac

SEQ ID NO: 587566 - RNA, 21 nt, Human
uagagaagggguuucaccaug

SEQ ID NO: 587567 - RNA, 22 nt, Human
uagagaagggguuucaccaugu

SEQ ID NO: 587568 - RNA, 24 nt, Human
uagccugaacccgggagguggagg

SEQ ID NO: 587569 - RNA, 24 nt, Human
uauaaagcaagaauuucaaggcac

SEQ ID NO: 587570 - RNA, 22 nt, Human
uauaaagcuugcagaccuauuu

SEQ ID NO: 587571 - RNA, 19 nt, Human
ucaccugaggucaggaguu

SEQ ID NO: 587572 - RNA, 23 nt, Human
ucacgccacggcacuccagccug

SEQ ID NO: 587573 - RNA, 24 nt, Human
uccaaauaacacuccuaaaucaac

SEQ ID NO: 587574 - RNA, 27 nt, Human
uccacuguuaaggcagcaggugcaggc

SEQ ID NO: 587575 - RNA, 21 nt, Human
uccagaguaaaaauaaaaaac

SEQ ID NO: 587576 - RNA, 23 nt, Human
ucccaaagugcugggauuacagg

SEQ ID NO: 587577 - RNA, 18 nt, Human
ucguccugagcuuccugu

SEQ ID NO: 587578 - RNA, 21 nt, Human
ucucauauucaagcgauucuc

SEQ ID NO: 587579 - RNA, 22 nt, Human
ucucauauucaagcgauucucc

SEQ ID NO: 587580 - RNA, 24 nt, Human
ucucauauucaagcgauucuccug

SEQ ID NO: 587581 - RNA, 22 nt, Human
ucucucuuguugcccaggcugg

SEQ ID NO: 587582 - RNA, 23 nt, Human
ucucucuuguugcccaggcugga

SEQ ID NO: 587583 - RNA, 23 nt, Human
ucucuuguugcccaggcuggagu

SEQ ID NO: 587584 - RNA, 24 nt, Human
ucucuuguugcccaggcuggagug

SEQ ID NO: 587585 - RNA, 22 nt, Human
ucuuguugcccaggcuggagug

SEQ ID NO: 587586 - RNA, 19 nt, Human
ugaaaccccauccccacua

SEQ ID NO: 587587 - RNA, 22 nt, Human
ugaaaccccauccccacuaaaa

SEQ ID NO: 587588 - RNA, 22 nt, Human
ugaaaugaaaaugacagaugua

SEQ ID NO: 587589 - RNA, 22 nt, Human
ugacaggugccuguaaucccag

SEQ ID NO: 587590 - RNA, 21 nt, Human
ugaccucaggugauccaccca

SEQ ID NO: 587591 - RNA, 24 nt, Human
ugaccucaggugauccacccaccc

SEQ ID NO: 587592 - RNA, 25 nt, Human
ugaccucaggugauccacccacccu

SEQ ID NO: 587593 - RNA, 23 nt, Human
ugagaccagccuggccaacaugg

SEQ ID NO: 587594 - RNA, 24 nt, Human
ugagaccagccuggccaacauggu

SEQ ID NO: 587595 - RNA, 24 nt, Human
ugagaucacgccacggcacuccag

SEQ ID NO: 587596 - RNA, 22 nt, Human
ugagcugagaucacgccacggc

SEQ ID NO: 587597 - RNA, 20 nt, Human
ugaggcaggagaauagccug

SEQ ID NO: 587598 - RNA, 24 nt, Human
ugaggcaggagaauagccugaacc

SEQ ID NO: 587599 - RNA, 25 nt, Human
ugaggcaggagaauagccugaaccc

SEQ ID NO: 587600 - RNA, 18 nt, Human
ugaggucaggaguuugag

SEQ ID NO: 587601 - RNA, 18 nt, Human
ugcaaggaaaauccagag

SEQ ID NO: 587602 - RNA, 24 nt, Human
ugcaagggaaggcugggcguggug

SEQ ID NO: 587603 - RNA, 18 nt, Human
ugcccaggcuggagugca

SEQ ID NO: 587604 - RNA, 21 nt, Human
ugcccaggcuggagugcaaug

SEQ ID NO: 587605 - RNA, 24 nt, Human
ugcccaggcuggagugcaauggca

SEQ ID NO: 587606 - RNA, 24 nt, Human
ugccucagcaucccaaguaucugg

SEQ ID NO: 587607 - RNA, 23 nt, Human
ugccuguaaucccagcuacucgg

SEQ ID NO: 587608 - RNA, 24 nt, Human
ugccuguaaucccagcuacucggg

SEQ ID NO: 587609 - RNA, 26 nt, Human
ugcgccgcgccgccgccgcugccgcu

SEQ ID NO: 587610 - RNA, 24 nt, Human
ugcugggauuacaggugugagcca

SEQ ID NO: 587611 - RNA, 23 nt, Human
uggagugcaauggcaucaucuug

SEQ ID NO: 587612 - RNA, 24 nt, Human
uggagugcaauggcaucaucuugg

SEQ ID NO: 587613 - RNA, 24 nt, Human
uggaguuacaggcaugcaccacca

SEQ ID NO: 587614 - RNA, 24 nt, Human
uggccaacauggugaaaccccauc

SEQ ID NO: 587615 - RNA, 21 nt, Human
uggcucaugccuguaaaccca

SEQ ID NO: 587616 - RNA, 24 nt, Human
uggcucaugccuguaaacccagca

SEQ ID NO: 587617 - RNA, 24 nt, Human
ugggaggccaaggcaggcagauca

SEQ ID NO: 587618 - RNA, 18 nt, Human
ugggauuacaggugugag

SEQ ID NO: 587619 - RNA, 19 nt, Human
ugggauuacaggugugagc

SEQ ID NO: 587620 - RNA, 21 nt, Human
ugggauuacaggugugagcca

SEQ ID NO: 587621 - RNA, 22 nt, Human
ugggauuacaggugugagccac

SEQ ID NO: 587622 - RNA, 22 nt, Human
ugggauuacaggugugagccac

SEQ ID NO: 587623 - RNA, 24 nt, Human
ugggauuacaggugugagccacug

SEQ ID NO: 587624 - RNA, 24 nt, Human
uggucaggcuggucuagaacuccu

SEQ ID NO: 587625 - RNA, 23 nt, Human
uggucuagaacuccugaccucag

SEQ ID NO: 587626 - RNA, 24 nt, Human
uggugacaggugccuguaauccca

SEQ ID NO: 587627 - RNA, 24 nt, Human
ugguggcucaugccuguaaaccca

SEQ ID NO: 587628 - RNA, 20 nt, Human
uguugcccaggcuggagugc

SEQ ID NO: 587629 - RNA, 24 nt, Human
uuagcuggguguggugacaggugc

SEQ ID NO: 587630 - RNA, 21 nt, Human
uucaagcgauucuccugccuc

SEQ ID NO: 587631 - RNA, 23 nt, Human
uucaagcgauucuccugccucag

SEQ ID NO: 587632 - RNA, 24 nt, Human
uucaagcgauucuccugccucagc

SEQ ID NO: 587633 - RNA, 24 nt, Human
uucucucuuguugcccaggcugga

SEQ ID NO: 587634 - RNA, 18 nt, Human
uugcagugagcugagauc

SEQ ID NO: 587635 - RNA, 20 nt, Human
uugcagugagcugagaucac

SEQ ID NO: 587636 - RNA, 21 nt, Human
uugcagugagcugagaucacg

SEQ ID NO: 587637 - RNA, 19 nt, Human
uuggcuccgccucucauau

SEQ ID NO: 587638 - RNA, 24 nt, Human
uuucaccauguuggucaggcuggu

SEQ ID NO: 587639 - RNA, 25 nt, Human
uuuuguauuuuuuuauacguagaga

SEQ ID NO: 587640 - RNA, 18 nt, Human
aagagaaaaaaaaaaacc

SEQ ID NO: 587641 - RNA, 22 nt, Human
aagcccggacugagcgugcuag

SEQ ID NO: 587642 - RNA, 21 nt, Human
aauguuacauguaaaacacaa

SEQ ID NO: 587643 - RNA, 24 nt, Human
caacugccaaaucuguaugaaaau

SEQ ID NO: 587644 - RNA, 18 nt, Human
cacagaucauggaccaua

SEQ ID NO: 587645 - RNA, 19 nt, Human
caccaccgccgccgccgcc

SEQ ID NO: 587646 - RNA, 20 nt, Human
caccgccgccgccgccgccg

SEQ ID NO: 587647 - RNA, 24 nt, Human
cauaaagugaauaauuacuuuuga

SEQ ID NO: 587648 - RNA, 19 nt, Human
ccaagcccggacugagcgu

SEQ ID NO: 587649 - RNA, 19 nt, Human
ccaccgccgccgccgccgc

SEQ ID NO: 587650 - RNA, 24 nt, Human
ccaccgccgccgccgccgccgccc

SEQ ID NO: 587651 - RNA, 20 nt, Human
cccccucuaccuccuucucc

SEQ ID NO: 587652 - RNA, 18 nt, Human
ccccucuaccuccuucuc

SEQ ID NO: 587653 - RNA, 20 nt, Human
ccgccaccaccgccgccgcc

SEQ ID NO: 587654 - RNA, 24 nt, Human
ccgccaccaccgccgccgccgccg

SEQ ID NO: 587655 - RNA, 23 nt, Human
ccgccgccgccgcccccucuacc

SEQ ID NO: 587656 - RNA, 18 nt, Human
ccgccgccgccgccgccg

SEQ ID NO: 587657 - RNA, 25 nt, Human
ccucuaccuccuucuccgccgcggg

SEQ ID NO: 587658 - RNA, 20 nt, Human
gagaaaaaaaaaaaccucau

SEQ ID NO: 587659 - RNA, 21 nt, Human
gccccaagcccggacugagcg

SEQ ID NO: 587660 - RNA, 20 nt, Human
uaaaacacaauuaaaaucag

SEQ ID NO: 587661 - RNA, 24 nt, Human
uaaaacuuaccccaacagaaacuu

SEQ ID NO: 587662 - RNA, 22 nt, Human
uaaaacuuaccccaacagagga

SEQ ID NO: 587663 - RNA, 24 nt, Human
uaccuccuucuccgccgcggggcc

SEQ ID NO: 587664 - RNA, 24 nt, Human
uccuucuccgccgcggggccccaa

SEQ ID NO: 587665 - RNA, 21 nt, Human
ugccuaagagaaaaaaaaaaa

SEQ ID NO: 587666 - RNA, 22 nt, Human
ugccuaagagaaaaaaaaaaac

SEQ ID NO: 587667 - RNA, 19 nt, Human
uggaaaaaaagaucuacau

SEQ ID NO: 587668 - RNA, 19 nt, Human
ugguuuggcuucuuuaucc

SEQ ID NO: 587669 - RNA, 23 nt, Human
uguaaugauggaaaaaaagaucu

SEQ ID NO: 587670 - RNA, 22 nt, Human
uguaaugauuugcguuugaauc

SEQ ID NO: 587671 - RNA, 25 nt, Human
uugaaguagacauugauauacuuau

SEQ ID NO: 587672 - RNA, 23 nt, Human
uuguaaugauggaaaaaaagauc

SEQ ID NO: 587673 - RNA, 19 nt, Human
aagcagcaggcccaugcgc

SEQ ID NO: 587674 - RNA, 20 nt, Human
acaggcgggacaagcagcag

SEQ ID NO: 587675 - RNA, 26 nt, Human
acccgcaacagggggagccccuccug

SEQ ID NO: 587676 - RNA, 24 nt, Human
agaagcugcaggcguggggggagg

SEQ ID NO: 587677 - RNA, 20 nt, Human
agauaccaccgcacggaaug

SEQ ID NO: 587678 - RNA, 23 nt, Human
aggcgggcgccgggccucccaag

SEQ ID NO: 587679 - RNA, 21 nt, Human
agggacgaggggaggcccggg

SEQ ID NO: 587680 - RNA, 24 nt, Human
agggauggagcuggagugggcagg

SEQ ID NO: 587681 - RNA, 20 nt, Human
agggcuggggugaggggggu

SEQ ID NO: 587682 - RNA, 23 nt, Human
agggcuggggugaggggggugug

SEQ ID NO: 587683 - RNA, 21 nt, Human
aggggcugugggagagacagg

SEQ ID NO: 587684 - RNA, 24 nt, Human
augcgcagggcuggggugaggggg

SEQ ID NO: 587685 - RNA, 22 nt, Human
caggcccagccuccagggcuca

SEQ ID NO: 587686 - RNA, 24 nt, Human
caucugaaaauagagagcagccgc

SEQ ID NO: 587687 - RNA, 20 nt, Human
ccaggccacugagucuaugg

SEQ ID NO: 587688 - RNA, 21 nt, Human
cccccuugggaggcgccgcuc

SEQ ID NO: 587689 - RNA, 22 nt, Human
ccccucgcgagaagcugcaggc

SEQ ID NO: 587690 - RNA, 22 nt, Human
cccgcaacagggggagccccuc

SEQ ID NO: 587691 - RNA, 23 nt, Human
cccgcgagccggucccgccgccu

SEQ ID NO: 587692 - RNA, 22 nt, Human
ccggggcggggucggccgugcc

SEQ ID NO: 587693 - RNA, 18 nt, Human
ccucccgcuucacccgga

SEQ ID NO: 587694 - RNA, 22 nt, Human
cgagggugcgggcaggcgggcg

SEQ ID NO: 587695 - RNA, 22 nt, Human
cgcagggcuggggugagggggg

SEQ ID NO: 587696 - RNA, 18 nt, Human
cgcgagaagcugcaggcg

SEQ ID NO: 587697 - RNA, 18 nt, Human
cggggcagggcccggcgg

SEQ ID NO: 587698 - RNA, 23 nt, Human
cggugggaggacggacuaagggg

SEQ ID NO: 587699 - RNA, 22 nt, Human
cggugggcggugcccggggcgg

SEQ ID NO: 587700 - RNA, 21 nt, Human
cuccgacucuggcugccuccc

SEQ ID NO: 587701 - RNA, 18 nt, Human
cuccugcuggcccgaacc

SEQ ID NO: 587702 - RNA, 21 nt, Human
cugcuggaaggaauaaauaag

SEQ ID NO: 587703 - RNA, 20 nt, Human
cuucacccggacccgcaccc

SEQ ID NO: 587704 - RNA, 20 nt, Human
gacaggggcugugggagaga

SEQ ID NO: 587705 - RNA, 19 nt, Human
gagaauguagagccuggga

SEQ ID NO: 587706 - RNA, 21 nt, Human
gagucgggagggagggcgagg

SEQ ID NO: 587707 - RNA, 18 nt, Human
gcaggcccagccuccagg

SEQ ID NO: 587708 - RNA, 24 nt, Human
gcccgaaccuagggaagagggccc

SEQ ID NO: 587709 - RNA, 22 nt, Human
gcgcagggcuggggugaggggg

SEQ ID NO: 587710 - RNA, 19 nt, Human
gcgccgggccugcgccugg

SEQ ID NO: 587711 - RNA, 19 nt, Human
gcgccuggugcucgggccc

SEQ ID NO: 587712 - RNA, 23 nt, Human
gcgccuggugcucgggcccggcu

SEQ ID NO: 587713 - RNA, 20 nt, Human
gcggggucggccgugccugg

SEQ ID NO: 587714 - RNA, 18 nt, Human
ggaaugggggugauuaag

SEQ ID NO: 587715 - RNA, 22 nt, Human
ggaaugggggugauuaaggccu

SEQ ID NO: 587716 - RNA, 22 nt, Human
ggagacuccagccggcaccucc

SEQ ID NO: 587717 - RNA, 18 nt, Human
ggagccccuccugccacc

SEQ ID NO: 587718 - RNA, 19 nt, Human
ggcggugcccggggcgggg

SEQ ID NO: 587719 - RNA, 20 nt, Human
ggcucuggggucuggggagg

SEQ ID NO: 587720 - RNA, 18 nt, Human
ggcuggggugaggggggu

SEQ ID NO: 587721 - RNA, 19 nt, Human
gggcaggcgggcgccgggc

SEQ ID NO: 587722 - RNA, 22 nt, Human
gggcaggcgggcgccgggccug

SEQ ID NO: 587723 - RNA, 18 nt, Human
gggcggggccggguggga

SEQ ID NO: 587724 - RNA, 19 nt, Human
gggugauuaaggccugggc

SEQ ID NO: 587725 - RNA, 22 nt, Human
gucgggagggagggcgagggug

SEQ ID NO: 587726 - RNA, 22 nt, Human
uacagcaacaucugaaaauaga

SEQ ID NO: 587727 - RNA, 24 nt, Human
uagaagagggacgaggggaggccc

SEQ ID NO: 587728 - RNA, 18 nt, Human
uauacagaagcaacggcc

SEQ ID NO: 587729 - RNA, 18 nt, Human
ucccucagaggccaggag

SEQ ID NO: 587730 - RNA, 19 nt, Human
uccugccaccaggggaccg

SEQ ID NO: 587731 - RNA, 25 nt, Human
ucucuauauacagaagcaacggccg

SEQ ID NO: 587732 - RNA, 19 nt, Human
ucuuggcucuggggucugg

SEQ ID NO: 587733 - RNA, 22 nt, Human
ugaaaauagagagcagccgccu

SEQ ID NO: 587734 - RNA, 23 nt, Human
ugacaagggagaagguuacccug

SEQ ID NO: 587735 - RNA, 21 nt, Human
ugagaugacaagggagaaggu

SEQ ID NO: 587736 - RNA, 18 nt, Human
ugaggggggugugccagg

SEQ ID NO: 587737 - RNA, 22 nt, Human
ugcauaaggccgggaugcgggg

SEQ ID NO: 587738 - RNA, 25 nt, Human
ugccucccgcuucacccggacccuu

SEQ ID NO: 587739 - RNA, 19 nt, Human
ugccugggcggggccgggu

SEQ ID NO: 587740 - RNA, 19 nt, Human
ugccugggcggggccgggu

SEQ ID NO: 587741 - RNA, 20 nt, Human
ugcuggaaggaauaaauaag

SEQ ID NO: 587742 - RNA, 22 nt, Human
uggaaggaauaaauaagggaug

SEQ ID NO: 587743 - RNA, 24 nt, Human
uggaaggaauaaauaagggaugga

SEQ ID NO: 587744 - RNA, 23 nt, Human
uggcucuggggucuggggaggcc

SEQ ID NO: 587745 - RNA, 19 nt, Human
ugggagagacaggcgggac

SEQ ID NO: 587746 - RNA, 21 nt, Human
ugggaggggcagugcauaagg

SEQ ID NO: 587747 - RNA, 22 nt, Human
ugggaggggcagugcauaagga

SEQ ID NO: 587748 - RNA, 23 nt, Human
ugggcggugcccggggcgggguc

SEQ ID NO: 587749 - RNA, 27 nt, Human
uggggggaggcgaggcaggauggcucg

SEQ ID NO: 587750 - RNA, 21 nt, Human
ugugggagagacaggcgggac

SEQ ID NO: 587751 - RNA, 22 nt, Human
uuuuuuuuuuuuuuuuuuucag

SEQ ID NO: 587752 - RNA, 23 nt, Human
aaagacacacacucucaccacaa

SEQ ID NO: 587753 - RNA, 21 nt, Human
aacaaaacagagaaacgaucc

SEQ ID NO: 587754 - RNA, 23 nt, Human
acaaaacagagaaacgaucccuc

SEQ ID NO: 587755 - RNA, 19 nt, Human
acaccugcggcccagacac

SEQ ID NO: 587756 - RNA, 20 nt, Human
acagagaaacgaucccuccc

SEQ ID NO: 587757 - RNA, 22 nt, Human
acagagaaacgaucccucccca

SEQ ID NO: 587758 - RNA, 19 nt, Human
acagugccacaccugcggc

SEQ ID NO: 587759 - RNA, 20 nt, Human
acccugagggaaaacaggag

SEQ ID NO: 587760 - RNA, 21 nt, Human
acgcugaacugaauuguacau

SEQ ID NO: 587761 - RNA, 21 nt, Human
acucauuccuuggagggaagc

SEQ ID NO: 587762 - RNA, 28 nt, Human
agaaacgaucccuccccaagccuacaga

SEQ ID NO: 587763 - RNA, 20 nt, Human
agacacacacucucaccaca

SEQ ID NO: 587764 - RNA, 21 nt, Human
agggcucacccaugagggaca

SEQ ID NO: 587765 - RNA, 19 nt, Human
auccaaaaggaaaaugauu

SEQ ID NO: 587766 - RNA, 25 nt, Human
augacacagacacacgugaacaccg

SEQ ID NO: 587767 - RNA, 21 nt, Human
augggacaacgggacggggag

SEQ ID NO: 587768 - RNA, 21 nt, Human
cacacucucaccacagugcca

SEQ ID NO: 587769 - RNA, 20 nt, Human
cacagacacacgugaacacc

SEQ ID NO: 587770 - RNA, 26 nt, Human
caccacagugccacaccugcggccca

SEQ ID NO: 587771 - RNA, 22 nt, Human
cacccacugcuucacaugccua

SEQ ID NO: 587772 - RNA, 18 nt, Human
cagagaaacgaucccucc

SEQ ID NO: 587773 - RNA, 20 nt, Human
caggagugugucugucuuca

SEQ ID NO: 587774 - RNA, 21 nt, Human
cagguacccaccagauuuaac

SEQ ID NO: 587775 - RNA, 26 nt, Human
caugacacagacacacgugaacaccc

SEQ ID NO: 587776 - RNA, 20 nt, Human
caugacacagacacacgugg

SEQ ID NO: 587777 - RNA, 27 nt, Human
caugugcacacauguauacauuuauug

SEQ ID NO: 587778 - RNA, 21 nt, Human
ccagcccgccgguccuagcag

SEQ ID NO: 587779 - RNA, 24 nt, Human
cccacugcuucacaugccuaauuc

SEQ ID NO: 587780 - RNA, 18 nt, Human
cccugagggaaaacagga

SEQ ID NO: 587781 - RNA, 18 nt, Human
cggguggacacccacugc

SEQ ID NO: 587782 - RNA, 20 nt, Human
cuccccaagccuacagaaca

SEQ ID NO: 587783 - RNA, 19 nt, Human
cugaaggccagaaucccac

SEQ ID NO: 587784 - RNA, 21 nt, Human
cuuccagcacugacagccacu

SEQ ID NO: 587785 - RNA, 21 nt, Human
cuuggcucaggagugugucug

SEQ ID NO: 587786 - RNA, 22 nt, Human
gaacacccagcccgccgguccu

SEQ ID NO: 587787 - RNA, 20 nt, Human
gacaagaacccccuagcaac

SEQ ID NO: 587788 - RNA, 18 nt, Human
gaccacacugccugggcu

SEQ ID NO: 587789 - RNA, 20 nt, Human
gccugggcucacagcuggag

SEQ ID NO: 587790 - RNA, 22 nt, Human
gcuaaagcucaaaggcauacug

SEQ ID NO: 587791 - RNA, 26 nt, Human
gcugaacugaauuguacauaccaacu

SEQ ID NO: 587792 - RNA, 20 nt, Human
ggaaaacaggagagccugag

SEQ ID NO: 587793 - RNA, 19 nt, Human
ggcagcacagggaugcggu

SEQ ID NO: 587794 - RNA, 19 nt, Human
ggcugagugacacgccagc

SEQ ID NO: 587795 - RNA, 23 nt, Human
uaaaauucaucauagcacuuucc

SEQ ID NO: 587796 - RNA, 19 nt, Human
uaacaaaacagagaaacga

SEQ ID NO: 587797 - RNA, 31 nt, Human
uaacaaaacagagaaacgaucccuccccaag

SEQ ID NO: 587798 - RNA, 24 nt, Human
uaacagcuaaagcucaaaggcaua

SEQ ID NO: 587799 - RNA, 25 nt, Human
uaacagcuaaagcucaaaggcauac

SEQ ID NO: 587800 - RNA, 20 nt, Human
uacagugcacacgggugcgg

SEQ ID NO: 587801 - RNA, 22 nt, Human
uacagugcacacgggugcggcu

SEQ ID NO: 587802 - RNA, 19 nt, Human
uccaaaaggaaaaugauuc

SEQ ID NO: 587803 - RNA, 24 nt, Human
uccaaaaggaaaaugauucaagaa

SEQ ID NO: 587804 - RNA, 25 nt, Human
uccaaaaggaaaaugauucaagaaa

SEQ ID NO: 587805 - RNA, 19 nt, Human
ucccgcugcacugugugug

SEQ ID NO: 587806 - RNA, 20 nt, Human
ucccuccuggucucugaagg

SEQ ID NO: 587807 - RNA, 18 nt, Human
ucguguggaagauccagg

SEQ ID NO: 587808 - RNA, 19 nt, Human
ucguguggaagauccaggu

SEQ ID NO: 587809 - RNA, 22 nt, Human
ucugaaggccagaaucccacuc

SEQ ID NO: 587810 - RNA, 18 nt, Human
ugaaauccacucauuccu

SEQ ID NO: 587811 - RNA, 21 nt, Human
ugaacugaauuguacauacca

SEQ ID NO: 587812 - RNA, 18 nt, Human
ugaagacaagaccuuggc

SEQ ID NO: 587813 - RNA, 21 nt, Human
ugaagacaagaccuuggcuca

SEQ ID NO: 587814 - RNA, 18 nt, Human
ugacgcacaguccuccag

SEQ ID NO: 587815 - RNA, 22 nt, Human
ugagggaaaacaggagagccug

SEQ ID NO: 587816 - RNA, 25 nt, Human
ugcaaagacacacacucucaccaca

SEQ ID NO: 587817 - RNA, 18 nt, Human
ugccugggcucacagcug

SEQ ID NO: 587818 - RNA, 21 nt, Human
uggagggcucacccaugaggg

SEQ ID NO: 587819 - RNA, 18 nt, Human
ugggaagggaagaaaggg

SEQ ID NO: 587820 - RNA, 19 nt, Human
ugggaagggaagaaaggga

SEQ ID NO: 587821 - RNA, 24 nt, Human
ugugcaaagacacacacucucacc

SEQ ID NO: 587822 - RNA, 25 nt, Human
uucacagagcaaaaugggacaacgg

SEQ ID NO: 587823 - RNA, 20 nt, Human
uucagucugugcaauaaaga

SEQ ID NO: 587824 - RNA, 19 nt, Human
uuccuggugaggagggucc

SEQ ID NO: 587825 - RNA, 22 nt, Human
uuccuuggagggaagcuggccc

SEQ ID NO: 587826 - RNA, 26 nt, Human
uuuacaacagcuguagguuucuguau

SEQ ID NO: 587827 - RNA, 19 nt, Human
aacacgauuaaccacaucu

SEQ ID NO: 587828 - RNA, 20 nt, Human
aaccacaucuugcuuccucc

SEQ ID NO: 587829 - RNA, 21 nt, Human
gucauuuuuaagcauggaucc

SEQ ID NO: 587830 - RNA, 21 nt, Human
uacugguuuaaaugucgaucu

SEQ ID NO: 587831 - RNA, 24 nt, Human
ugcugucuccuuuucuccucucug

SEQ ID NO: 587832 - RNA, 24 nt, Human
uggcgucuugcugucuccuuuucu

SEQ ID NO: 587833 - RNA, 22 nt, Human
uuuucuccucucugcgcucucu

SEQ ID NO: 587834 - RNA, 19 nt, Human
aaaagcaacgcacaaagac

SEQ ID NO: 587835 - RNA, 20 nt, Human
aaaaugaauaaucaaacuug

SEQ ID NO: 587836 - RNA, 19 nt, Human
aaaggccugacccuaaagc

SEQ ID NO: 587837 - RNA, 21 nt, Human
aacaagagcaaacuccgucuc

SEQ ID NO: 587838 - RNA, 20 nt, Human
aacuugccucccaauuccca

SEQ ID NO: 587839 - RNA, 19 nt, Human
aagcaacgcacaaagacuu

SEQ ID NO: 587840 - RNA, 24 nt, Human
aagcaauccgcccaccuuggccuc

SEQ ID NO: 587841 - RNA, 19 nt, Human
aaguagcugggacuacagg

SEQ ID NO: 587842 - RNA, 20 nt, Human
aaguagcugggacuacaggu

SEQ ID NO: 587843 - RNA, 26 nt, Human
aaguagcugggacuacaggugucugc

SEQ ID NO: 587844 - RNA, 20 nt, Human
aaguugguccccacacaggu

SEQ ID NO: 587845 - RNA, 19 nt, Human
aaucauuaccauugccuaa

SEQ ID NO: 587846 - RNA, 22 nt, Human
acagagcacgaaguuggucccc

SEQ ID NO: 587847 - RNA, 25 nt, Human
acagugcugggguuacaggugacag

SEQ ID NO: 587848 - RNA, 24 nt, Human
acagugcugggguuacagguguga

SEQ ID NO: 587849 - RNA, 20 nt, Human
acccagccuaucaguucauu

SEQ ID NO: 587850 - RNA, 21 nt, Human
acccaucauauccucuuuccu

SEQ ID NO: 587851 - RNA, 22 nt, Human
acccuaaagcccucaaagacuu

SEQ ID NO: 587852 - RNA, 26 nt, Human
acgccgagccugaggagcugcccaau

SEQ ID NO: 587853 - RNA, 18 nt, Human
acgggguuuagccauguu

SEQ ID NO: 587854 - RNA, 19 nt, Human
acgggguuuagccauguug

SEQ ID NO: 587855 - RNA, 24 nt, Human
acgggguuuagccauguugcccag

SEQ ID NO: 587856 - RNA, 21 nt, Human
acuacaggugucugccaccau

SEQ ID NO: 587857 - RNA, 21 nt, Human
acuagauuuaaagcagaagug

SEQ ID NO: 587858 - RNA, 24 nt, Human
acugauaccaaaggccugacccua

SEQ ID NO: 587859 - RNA, 27 nt, Human
acugcacuccagccucaucaacaagag

SEQ ID NO: 587860 - RNA, 21 nt, Human
agcaauccgcccaccuuggcc

SEQ ID NO: 587861 - RNA, 27 nt, Human
agccauguugcccaggcuggucucaaa

SEQ ID NO: 587862 - RNA, 21 nt, Human
agcuguaaggccucaaagagu

SEQ ID NO: 587863 - RNA, 24 nt, Human
aggcggagguugcagugagucaag

SEQ ID NO: 587864 - RNA, 25 nt, Human
agguuccccccucauacuaaaccuc

SEQ ID NO: 587865 - RNA, 22 nt, Human
agugcugggguuacagguguga

SEQ ID NO: 587866 - RNA, 22 nt, Human
auccucccaccucugcccucca

SEQ ID NO: 587867 - RNA, 23 nt, Human
aucgcgccacugcacuccagccu

SEQ ID NO: 587868 - RNA, 21 nt, Human
caaaaugaauaaucaaacuug

SEQ ID NO: 587869 - RNA, 23 nt, Human
caaaggccugacccuaaagcccu

SEQ ID NO: 587870 - RNA, 23 nt, Human
caagagcaaacuccgucucaaaa

SEQ ID NO: 587871 - RNA, 24 nt, Human
caagaucgcgccacugcacuccag

SEQ ID NO: 587872 - RNA, 23 nt, Human
cacacaggucacaauuauguagc

SEQ ID NO: 587873 - RNA, 18 nt, Human
caccaugcuuggcuaauu

SEQ ID NO: 587874 - RNA, 18 nt, Human
caccccucaucuuucaga

SEQ ID NO: 587875 - RNA, 21 nt, Human
caccucugcccuccaaguagc

SEQ ID NO: 587876 - RNA, 24 nt, Human
cacgcagggggaaugacacgcgcg

SEQ ID NO: 587877 - RNA, 22 nt, Human
cacugcacuccagccucaucaa

SEQ ID NO: 587878 - RNA, 24 nt, Human
cacugcacuccagccucaucaaca

SEQ ID NO: 587879 - RNA, 26 nt, Human
cacugcacuccagccucaucaacaag

SEQ ID NO: 587880 - RNA, 21 nt, Human
caggugucugccaccaugcuu

SEQ ID NO: 587881 - RNA, 19 nt, Human
cauggauuuuaaaaacugc

SEQ ID NO: 587882 - RNA, 23 nt, Human
cauguugcccaggcuggucucaa

SEQ ID NO: 587883 - RNA, 24 nt, Human
cauguugcccaggcuggucucaaa

SEQ ID NO: 587884 - RNA, 21 nt, Human
ccaaaggccugacccuaaagc

SEQ ID NO: 587885 - RNA, 21 nt, Human
ccacagugcugggguuacagg

SEQ ID NO: 587886 - RNA, 24 nt, Human
ccacagugcugggguuacaggugu

SEQ ID NO: 587887 - RNA, 20 nt, Human
ccacugcacuccagccucau

SEQ ID NO: 587888 - RNA, 24 nt, Human
ccacugcacuccagccucaucaac

SEQ ID NO: 587889 - RNA, 27 nt, Human
ccacugcacuccagccucaucaacaag

SEQ ID NO: 587890 - RNA, 23 nt, Human
ccagcaaugacagucacauccag

SEQ ID NO: 587891 - RNA, 22 nt, Human
ccauguugcccaggcuggucuc

SEQ ID NO: 587892 - RNA, 20 nt, Human
cccccacaccaugucccuuc

SEQ ID NO: 587893 - RNA, 23 nt, Human
ccccccacaccaugucccuucag

SEQ ID NO: 587894 - RNA, 21 nt, Human
ccccucauacuaaaccucagc

SEQ ID NO: 587895 - RNA, 24 nt, Human
ccuaucaguucauuuauggagucc

SEQ ID NO: 587896 - RNA, 23 nt, Human
ccucaguuccauuucccuacccc

SEQ ID NO: 587897 - RNA, 20 nt, Human
ccucauacuaaaccucagcc

SEQ ID NO: 587898 - RNA, 19 nt, Human
ccucccaccucugcccucc

SEQ ID NO: 587899 - RNA, 23 nt, Human
ccucccaccucugcccuccaagu

SEQ ID NO: 587900 - RNA, 26 nt, Human
ccucccaccucugcccuccaaguagc

SEQ ID NO: 587901 - RNA, 22 nt, Human
ccuucaauuuacuuuaaaaauc

SEQ ID NO: 587902 - RNA, 26 nt, Human
cgccacugcacuccagccucaucaac

SEQ ID NO: 587903 - RNA, 22 nt, Human
cgccaucaaagcuagaaugcag

SEQ ID NO: 587904 - RNA, 20 nt, Human
cggauagucucaacauggga

SEQ ID NO: 587905 - RNA, 24 nt, Human
cgggguuuagccauguugcccagg

SEQ ID NO: 587906 - RNA, 21 nt, Human
cucaaauucuuuuucuuauua

SEQ ID NO: 587907 - RNA, 24 nt, Human
cucaagcaauccgcccaccuuggc

SEQ ID NO: 587908 - RNA, 24 nt, Human
cucaagccauccucccaccucugc

SEQ ID NO: 587909 - RNA, 24 nt, Human
cuccaaguagcugggacuacaggu

SEQ ID NO: 587910 - RNA, 19 nt, Human
cugauaaguauguggaaau

SEQ ID NO: 587911 - RNA, 24 nt, Human
cugcaaacaggcuccagcaaugac

SEQ ID NO: 587912 - RNA, 18 nt, Human
cugccaccaugcuuggcu

SEQ ID NO: 587913 - RNA, 21 nt, Human
cuugccucccaauucccaaaa

SEQ ID NO: 587914 - RNA, 21 nt, Human
cuuggaaaagcaacgcacaaa

SEQ ID NO: 587915 - RNA, 27 nt, Human
cuuugcgcucauugucacaccccuccu

SEQ ID NO: 587916 - RNA, 24 nt, Human
gacuacaggugucugccaccaugc

SEQ ID NO: 587917 - RNA, 24 nt, Human
gagcagcagcuuggaggccuccaa

SEQ ID NO: 587918 - RNA, 24 nt, Human
gagcucagccacggccggggacgc

SEQ ID NO: 587919 - RNA, 22 nt, Human
gaggagcugcccaaugccgccg

SEQ ID NO: 587920 - RNA, 20 nt, Human
gaggcggagguugcagugag

SEQ ID NO: 587921 - RNA, 23 nt, Human
gagguugcagugagucaagaucg

SEQ ID NO: 587922 - RNA, 19 nt, Human
gccauguugcccaggcugg

SEQ ID NO: 587923 - RNA, 19 nt, Human
gcuagaaugcaguggcaug

SEQ ID NO: 587924 - RNA, 21 nt, Human
gcugacaggagaaugaaggaa

SEQ ID NO: 587925 - RNA, 20 nt, Human
ggagguugcagugagucaag

SEQ ID NO: 587926 - RNA, 24 nt, Human
ggagguugcagugagucaagaucg

SEQ ID NO: 587927 - RNA, 19 nt, Human
gggcucuggagaacccagc

SEQ ID NO: 587928 - RNA, 20 nt, Human
ggggacgccgagccugagga

SEQ ID NO: 587929 - RNA, 23 nt, Human
gggguuuagccauguugcccagg

SEQ ID NO: 587930 - RNA, 23 nt, Human
ggugagcagcagcuuggaggccu

SEQ ID NO: 587931 - RNA, 18 nt, Human
gguuacaggugugagcca

SEQ ID NO: 587932 - RNA, 24 nt, Human
gguuacaggugugagccaccgugc

SEQ ID NO: 587933 - RNA, 22 nt, Human
guagagacgggguuuagccaug

SEQ ID NO: 587934 - RNA, 20 nt, Human
gugaggcggagguugcagug

SEQ ID NO: 587935 - RNA, 24 nt, Human
guuuagccauguugcccaggcugg

SEQ ID NO: 587936 - RNA, 26 nt, Human
uaaaacccaccacuucagaagcauua

SEQ ID NO: 587937 - RNA, 19 nt, Human
uaaagcccucaaagacuua

SEQ ID NO: 587938 - RNA, 24 nt, Human
uacaggugugagccaccgugccca

SEQ ID NO: 587939 - RNA, 20 nt, Human
uaccaaacacuuaaugcacc

SEQ ID NO: 587940 - RNA, 21 nt, Human
uaccaaacacuuaaugcaccg

SEQ ID NO: 587941 - RNA, 24 nt, Human
uagaaugcaguggcaugauuaugg

SEQ ID NO: 587942 - RNA, 20 nt, Human
uauagacugauaccaaaggc

SEQ ID NO: 587943 - RNA, 25 nt, Human
ucaagccauccucccaccucugccc

SEQ ID NO: 587944 - RNA, 30 nt, Human
ucaaucaacaaaagugggcagaaaaaaaaa

SEQ ID NO: 587945 - RNA, 22 nt, Human
ucacaccccucaucuuucagaa

SEQ ID NO: 587946 - RNA, 24 nt, Human
ucagcauuauuccaguguguccac

SEQ ID NO: 587947 - RNA, 25 nt, Human
ucaguuccauuucccuaccccccca

SEQ ID NO: 587948 - RNA, 18 nt, Human
uccaaggcgauuaccucc

SEQ ID NO: 587949 - RNA, 22 nt, Human
uccaaguagcugggacuacagg

SEQ ID NO: 587950 - RNA, 23 nt, Human
uccaaguagcugggacuacaggu

SEQ ID NO: 587951 - RNA, 23 nt, Human
ucccacagugcugggguuacagg

SEQ ID NO: 587952 - RNA, 18 nt, Human
ucccaccucugcccucca

SEQ ID NO: 587953 - RNA, 23 nt, Human
uccccccucauacuaaaccucag

SEQ ID NO: 587954 - RNA, 24 nt, Human
ucccuacccccccacaccaugucc

SEQ ID NO: 587955 - RNA, 21 nt, Human
uccgcccaccuuggccuccca

SEQ ID NO: 587956 - RNA, 21 nt, Human
uccuaagcucaagcaauccgc

SEQ ID NO: 587957 - RNA, 24 nt, Human
ucucacuucgccaucaaagcuaga

SEQ ID NO: 587958 - RNA, 19 nt, Human
ugaagcugugaggcggagg

SEQ ID NO: 587959 - RNA, 18 nt, Human
ugacaggagaaugaagga

SEQ ID NO: 587960 - RNA, 20 nt, Human
ugacauggauuuuaaaaacu

SEQ ID NO: 587961 - RNA, 23 nt, Human
ugaccugauaaaugagguaacac

SEQ ID NO: 587962 - RNA, 19 nt, Human
ugaguaaacugaccguggu

SEQ ID NO: 587963 - RNA, 22 nt, Human
ugagucaagaucgcgccacugc

SEQ ID NO: 587964 - RNA, 23 nt, Human
ugagucaagaucgcgccacugca

SEQ ID NO: 587965 - RNA, 24 nt, Human
ugauaccaaaggccugacccuaaa

SEQ ID NO: 587966 - RNA, 22 nt, Human
ugauuaugggcucaagccaucc

SEQ ID NO: 587967 - RNA, 24 nt, Human
ugcccaggcuggucucaaacuccu

SEQ ID NO: 587968 - RNA, 23 nt, Human
uggcagagcucagccacggccgg

SEQ ID NO: 587969 - RNA, 20 nt, Human
uggcaugauuaugggcucaa

SEQ ID NO: 587970 - RNA, 19 nt, Human
ugggacuacaggugucugc

SEQ ID NO: 587971 - RNA, 21 nt, Human
ugggacuacaggugucugcca

SEQ ID NO: 587972 - RNA, 24 nt, Human
ugggacuacaggugucugccacca

SEQ ID NO: 587973 - RNA, 25 nt, Human
ugggacuacaggugucugccaccau

SEQ ID NO: 587974 - RNA, 18 nt, Human
ugggguuacaggugugag

SEQ ID NO: 587975 - RNA, 22 nt, Human
ugggguuacaggugugagccac

SEQ ID NO: 587976 - RNA, 23 nt, Human
ugggguuacaggugugagccacc

SEQ ID NO: 587977 - RNA, 24 nt, Human
ugggguuacaggugugagccaccg

SEQ ID NO: 587978 - RNA, 24 nt, Human
uguagagacgggguuuagccaugu

SEQ ID NO: 587979 - RNA, 23 nt, Human
ugucauuauuugcaugcaaaggu

SEQ ID NO: 587980 - RNA, 19 nt, Human
uuacaggugugagccaccg

SEQ ID NO: 587981 - RNA, 27 nt, Human
uucaaaaugaauaaucaaacuugccuc

SEQ ID NO: 587982 - RNA, 19 nt, Human
uucaugacaauauaccaaa

SEQ ID NO: 587983 - RNA, 20 nt, Human
uuccucaaauucuuuuucuu

SEQ ID NO: 587984 - RNA, 24 nt, Human
uugaagcugugaggcggagguugc

SEQ ID NO: 587985 - RNA, 22 nt, Human
uugcagugagucaagaucgcgc

SEQ ID NO: 587986 - RNA, 24 nt, Human
uuguagagacgggguuuagccaug

SEQ ID NO: 587987 - RNA, 20 nt, Human
uuuaaauagccugguggcuu

SEQ ID NO: 587988 - RNA, 23 nt, Human
uuuagccauguugcccaggcugg

SEQ ID NO: 587989 - RNA, 22 nt, Human
uuugcgcucauugucacacccc

SEQ ID NO: 587990 - RNA, 24 nt, Human
uuuguagagacgggguuuagccau

SEQ ID NO: 587991 - RNA, 24 nt, Human
uuuucugacuagugggguuuuaaa

SEQ ID NO: 587992 - RNA, 22 nt, Human
uuuuuuuguagagacgggguuu

SEQ ID NO: 587993 - RNA, 24 nt, Human
aaaaaagaaaaacgacaaagcaca

SEQ ID NO: 587994 - RNA, 22 nt, Human
aaaaacgacaaagcacaaaacc

SEQ ID NO: 587995 - RNA, 19 nt, Human
aaaaagaaauaauuagaga

SEQ ID NO: 587996 - RNA, 18 nt, Human
aaaaccugccuacaauuc

SEQ ID NO: 587997 - RNA, 24 nt, Human
aaaagaaaaauaaaagccaaagag

SEQ ID NO: 587998 - RNA, 27 nt, Human
aaaagcucuuccauucucaaggcacuc

SEQ ID NO: 587999 - RNA, 18 nt, Human
aaacccaacaaguaaacc

SEQ ID NO: 588000 - RNA, 22 nt, Human
aagcacaaaaccucaauccgac

SEQ ID NO: 588001 - RNA, 19 nt, Human
aagcacaaggcugauaaaa

SEQ ID NO: 588002 - RNA, 20 nt, Human
acuucauugcccagaggcaa

SEQ ID NO: 588003 - RNA, 21 nt, Human
acuuuuucuuguccauggccu

SEQ ID NO: 588004 - RNA, 21 nt, Human
agaaaaacgacaaagcacaaa

SEQ ID NO: 588005 - RNA, 22 nt, Human
agaaaagaggcacacccggagc

SEQ ID NO: 588006 - RNA, 22 nt, Human
agaaaaggaauugcauagaaga

SEQ ID NO: 588007 - RNA, 22 nt, Human
agaccuuuggaacuuaaaaaug

SEQ ID NO: 588008 - RNA, 26 nt, Human
agagaaacauuacuucauugcccaga

SEQ ID NO: 588009 - RNA, 21 nt, Human
agagcccaucaauccuuaggc

SEQ ID NO: 588010 - RNA, 22 nt, Human
agcaaaagcuaagacucauuca

SEQ ID NO: 588011 - RNA, 20 nt, Human
agcaagagggaacuccacaa

SEQ ID NO: 588012 - RNA, 21 nt, Human
agccagggagagaaaagaggc

SEQ ID NO: 588013 - RNA, 18 nt, Human
agcuguagauuucuugcu

SEQ ID NO: 588014 - RNA, 19 nt, Human
aggaaccaugacuuaugaa

SEQ ID NO: 588015 - RNA, 24 nt, Human
aggaucagaggccaaaagagagcc

SEQ ID NO: 588016 - RNA, 24 nt, Human
aggcacucgagagguaaaaaaaug

SEQ ID NO: 588017 - RNA, 22 nt, Human
aggccaaaagagagcccaucaa

SEQ ID NO: 588018 - RNA, 24 nt, Human
agugauguucccugcaacugggcu

SEQ ID NO: 588019 - RNA, 18 nt, Human
aucuaggaaagcgugaag

SEQ ID NO: 588020 - RNA, 22 nt, Human
caaagcacaaaaccucaauccg

SEQ ID NO: 588021 - RNA, 22 nt, Human
caaagccaucuccccacuuuuc

SEQ ID NO: 588022 - RNA, 21 nt, Human
caaagugaucauuacagccag

SEQ ID NO: 588023 - RNA, 27 nt, Human
caacacauauaacaccaugacaucaca

SEQ ID NO: 588024 - RNA, 21 nt, Human
caaugauguacugcuucacaa

SEQ ID NO: 588025 - RNA, 22 nt, Human
caguagguggaugacacugccu

SEQ ID NO: 588026 - RNA, 23 nt, Human
caguagguggaugacacugccuc

SEQ ID NO: 588027 - RNA, 24 nt, Human
cagucaauacuagcucagcaaggu

SEQ ID NO: 588028 - RNA, 21 nt, Human
caguucuacacaaagccaucu

SEQ ID NO: 588029 - RNA, 19 nt, Human
ccagggagagaaaagaggc

SEQ ID NO: 588030 - RNA, 24 nt, Human
ccuacaauucaucuucuacacacc

SEQ ID NO: 588031 - RNA, 27 nt, Human
ccugcugaugccccccaaccaugcuaa

SEQ ID NO: 588032 - RNA, 21 nt, Human
ccuuauuagaucuauaaaauc

SEQ ID NO: 588033 - RNA, 21 nt, Human
cuaauaauuggugggcuugcu

SEQ ID NO: 588034 - RNA, 20 nt, Human
cuagaauucuggaaaugacu

SEQ ID NO: 588035 - RNA, 22 nt, Human
cuccaccacucagcaaggcgcc

SEQ ID NO: 588036 - RNA, 21 nt, Human
cucgaugcauuaugucuggag

SEQ ID NO: 588037 - RNA, 20 nt, Human
cucuucaacacgacugcugg

SEQ ID NO: 588038 - RNA, 18 nt, Human
cugauaguacuuagucca

SEQ ID NO: 588039 - RNA, 23 nt, Human
cugcugaugccccccaaccaugc

SEQ ID NO: 588040 - RNA, 19 nt, Human
gaacucaguccccacgacu

SEQ ID NO: 588041 - RNA, 23 nt, Human
gaauucuggaaaugacuucauuu

SEQ ID NO: 588042 - RNA, 24 nt, Human
gacaaagcacaaaaccucaauccg

SEQ ID NO: 588043 - RNA, 18 nt, Human
gacaguagguggaugaca

SEQ ID NO: 588044 - RNA, 21 nt, Human
gaccuuuggaacuuaaaaaug

SEQ ID NO: 588045 - RNA, 19 nt, Human
gauuggcagccagggagag

SEQ ID NO: 588046 - RNA, 20 nt, Human
gcuugcugugccaguacacu

SEQ ID NO: 588047 - RNA, 18 nt, Human
ggaaaaucaggauuggca

SEQ ID NO: 588048 - RNA, 21 nt, Human
gggacugcagggaaaaucagg

SEQ ID NO: 588049 - RNA, 19 nt, Human
gucugcagagaaaacccac

SEQ ID NO: 588050 - RNA, 19 nt, Human
guuaaaaggcuggcauuca

SEQ ID NO: 588051 - RNA, 22 nt, Human
guuuuucacacuagaauucugg

SEQ ID NO: 588052 - RNA, 24 nt, Human
uaacauugagaaccuauguagcuc

SEQ ID NO: 588053 - RNA, 21 nt, Human
uacacaaagccaucuccccac

SEQ ID NO: 588054 - RNA, 27 nt, Human
uaccacagaugaauacaaugaggugac

SEQ ID NO: 588055 - RNA, 25 nt, Human
uagcuuccuuguuucuacucagaaa

SEQ ID NO: 588056 - RNA, 22 nt, Human
uauaacaccaugacaucacaca

SEQ ID NO: 588057 - RNA, 22 nt, Human
uauaugucacuccgaacagagu

SEQ ID NO: 588058 - RNA, 19 nt, Human
ucacuuguuccacuguucu

SEQ ID NO: 588059 - RNA, 24 nt, Human
ucccucaccuccaccacucagcaa

SEQ ID NO: 588060 - RNA, 20 nt, Human
ucucaggguagcuuccuugu

SEQ ID NO: 588061 - RNA, 22 nt, Human
ucucuugcaaguccuuauauag

SEQ ID NO: 588062 - RNA, 18 nt, Human
ucugaguagacagcaggc

SEQ ID NO: 588063 - RNA, 18 nt, Human
ucugcagagaaaacccac

SEQ ID NO: 588064 - RNA, 19 nt, Human
ucuggaaaugacuucauuu

SEQ ID NO: 588065 - RNA, 21 nt, Human
ugaaggacaaaucugaaaugg

SEQ ID NO: 588066 - RNA, 23 nt, Human
ugacaggaaaaccuaggaaccau

SEQ ID NO: 588067 - RNA, 24 nt, Human
ugacaggaaaaccuaggaaccaug

SEQ ID NO: 588068 - RNA, 24 nt, Human
ugacuauaucucaggguagcuucc

SEQ ID NO: 588069 - RNA, 24 nt, Human
ugagauaauaaaauauuuuccuua

SEQ ID NO: 588070 - RNA, 19 nt, Human
ugaggugacaggaaaaccu

SEQ ID NO: 588071 - RNA, 21 nt, Human
ugcaaaggaaaucuuccaaag

SEQ ID NO: 588072 - RNA, 19 nt, Human
ugcugaucagcaaaaccug

SEQ ID NO: 588073 - RNA, 26 nt, Human
ugcuguacuuuuucuuguccauggga

SEQ ID NO: 588074 - RNA, 19 nt, Human
uggagggcgagggcugcgc

SEQ ID NO: 588075 - RNA, 24 nt, Human
uggaugacacugccucuucaacac

SEQ ID NO: 588076 - RNA, 23 nt, Human
uggcagaucuaggaaagcgugaa

SEQ ID NO: 588077 - RNA, 19 nt, Human
ugggguaagcacaaggcug

SEQ ID NO: 588078 - RNA, 24 nt, Human
uguacugcuucacaaaagcucuuc

SEQ ID NO: 588079 - RNA, 18 nt, Human
ugucacgacauucugcag

SEQ ID NO: 588080 - RNA, 19 nt, Human
uguccugcugaugcccccc

SEQ ID NO: 588081 - RNA, 23 nt, Human
uguugguuuguccugcugaugcc

SEQ ID NO: 588082 - RNA, 22 nt, Human
uuacaaaccaaggggacugcag

SEQ ID NO: 588083 - RNA, 23 nt, Human
uuccaaaggggacaguaggugga

SEQ ID NO: 588084 - RNA, 22 nt, Human
uugcucuuauaugucacuccga

SEQ ID NO: 588085 - RNA, 18 nt, Human
uugcugugccaguacacu

SEQ ID NO: 588086 - RNA, 23 nt, Human
uuguccugcugaugccccccaac

SEQ ID NO: 588087 - RNA, 22 nt, Human
uuuaccccuacauguacagaug

SEQ ID NO: 588088 - RNA, 22 nt, Human
uuucuuguccauggccuggagg

SEQ ID NO: 588089 - RNA, 18 nt, Human
uuuggcuuuccuggccug

SEQ ID NO: 588090 - RNA, 21 nt, Human
aaaaacaaugaaugagagccg

SEQ ID NO: 588091 - RNA, 20 nt, Human
aaacaaugaaugagagcuac

SEQ ID NO: 588092 - RNA, 23 nt, Human
aaagauaugauacccgguucuuc

SEQ ID NO: 588093 - RNA, 21 nt, Human
aaauagcugcaugcuaauuuu

SEQ ID NO: 588094 - RNA, 21 nt, Human
aagguuuuuuuuuuuuuccua

SEQ ID NO: 588095 - RNA, 21 nt, Human
aggcaguucuaucauguagga

SEQ ID NO: 588096 - RNA, 23 nt, Human
caagguuuuuuuuuuuuuccuaa

SEQ ID NO: 588097 - RNA, 23 nt, Human
cacaagguuuuuuuuuuuuuccu

SEQ ID NO: 588098 - RNA, 18 nt, Human
cagucugcccucacagac

SEQ ID NO: 588099 - RNA, 22 nt, Human
ccaaauguuuucuacacugaca

SEQ ID NO: 588100 - RNA, 21 nt, Human
cggggcagcuccgcugcucug

SEQ ID NO: 588101 - RNA, 24 nt, Human
gacacuaaaggcaggaauuaagaa

SEQ ID NO: 588102 - RNA, 20 nt, Human
gauacccgguucuuccacau

SEQ ID NO: 588103 - RNA, 25 nt, Human
gccacaauugaaaccuguauuaacu

SEQ ID NO: 588104 - RNA, 18 nt, Human
ggcaaucuugucuuugca

SEQ ID NO: 588105 - RNA, 21 nt, Human
uaaaaaacaaugaaugagagc

SEQ ID NO: 588106 - RNA, 21 nt, Human
uacccccaaccauagcaucac

SEQ ID NO: 588107 - RNA, 20 nt, Human
ucagaaagaaaauaggggca

SEQ ID NO: 588108 - RNA, 18 nt, Human
ucccgcgccaucuuuguu

SEQ ID NO: 588109 - RNA, 21 nt, Human
ucucccuaacuacccccaacc

SEQ ID NO: 588110 - RNA, 19 nt, Human
ugccacaauugaaaccugu

SEQ ID NO: 588111 - RNA, 24 nt, Human
ugcuagugaacaggucuuauuccu

SEQ ID NO: 588112 - RNA, 18 nt, Human
ugucuuugcauugcuuug

SEQ ID NO: 588113 - RNA, 23 nt, Human
uuagaacccccuugaaaaugcua

SEQ ID NO: 588114 - RNA, 24 nt, Human
uuagaacccccuugaaaaugcuag

SEQ ID NO: 588115 - RNA, 25 nt, Human
uugaaaaugcuagugaacaggucuu

SEQ ID NO: 588116 - RNA, 20 nt, Human
uuuauggcuuuuaagcacuu

SEQ ID NO: 588117 - RNA, 22 nt, Human
uuugugucauucuggcuucccu

SEQ ID NO: 588118 - RNA, 21 nt, Human
uuuuagggccgugcggcuacc

SEQ ID NO: 588119 - RNA, 20 nt, Human
uuuucuacacugacauuuuu

SEQ ID NO: 588120 - RNA, 23 nt, Human
uuuuuuuuuuuuuuuugccagaa

SEQ ID NO: 588121 - RNA, 18 nt, Human
uuuuuuuuuuuuuuuuug

SEQ ID NO: 588122 - RNA, 20 nt, Human
aucauccugagaucuggcgu

SEQ ID NO: 588123 - RNA, 23 nt, Human
cacacccacgaugugcugcaugg

SEQ ID NO: 588124 - RNA, 19 nt, Human
ccccaucauccugagaucu

SEQ ID NO: 588125 - RNA, 21 nt, Human
ccucuggaggaggggccaggg

SEQ ID NO: 588126 - RNA, 19 nt, Human
cgccccaucauccugagau

SEQ ID NO: 588127 - RNA, 20 nt, Human
guaaaugaaccuugucuaca

SEQ ID NO: 588128 - RNA, 22 nt, Human
uccacauucacagcuauugccu

SEQ ID NO: 588129 - RNA, 18 nt, Human
uccugagaucuggcgugg

SEQ ID NO: 588130 - RNA, 20 nt, Human
aaugcuguucucccccagga

SEQ ID NO: 588131 - RNA, 22 nt, Human
agaaucccucacccuccacccc

SEQ ID NO: 588132 - RNA, 22 nt, Human
caccugcccaaccuaggacagc

SEQ ID NO: 588133 - RNA, 22 nt, Human
cagaaucccucacccuccaccc

SEQ ID NO: 588134 - RNA, 23 nt, Human
cagaaucccucacccuccacccc

SEQ ID NO: 588135 - RNA, 21 nt, Human
cagccgcagccgccuaagccg

SEQ ID NO: 588136 - RNA, 19 nt, Human
ccccaggguccucccucuc

SEQ ID NO: 588137 - RNA, 18 nt, Human
cccucacccuccacccca

SEQ ID NO: 588138 - RNA, 22 nt, Human
cccugggccgcaggauguccuc

SEQ ID NO: 588139 - RNA, 24 nt, Human
ccgccguagcagccgcagccgccu

SEQ ID NO: 588140 - RNA, 22 nt, Human
ccgccuaagccguuccaggggc

SEQ ID NO: 588141 - RNA, 18 nt, Human
ccucagggcuggguucca

SEQ ID NO: 588142 - RNA, 18 nt, Human
ggacagcugggccugagc

SEQ ID NO: 588143 - RNA, 22 nt, Human
ggccgcaggauguccucagggc

SEQ ID NO: 588144 - RNA, 21 nt, Human
ggggagaggcuggaggcggcg

SEQ ID NO: 588145 - RNA, 20 nt, Human
uagcagccgcagccgccuaa

SEQ ID NO: 588146 - RNA, 19 nt, Human
uccacagaaucccucaccc

SEQ ID NO: 588147 - RNA, 23 nt, Human
uccacagaaucccucacccucca

SEQ ID NO: 588148 - RNA, 19 nt, Human
ucccucacccuccacccca

SEQ ID NO: 588149 - RNA, 19 nt, Human
ucucucagcaggugucacu

SEQ ID NO: 588150 - RNA, 20 nt, Human
ucucucagcaggugucacuu

SEQ ID NO: 588151 - RNA, 21 nt, Human
ugcccaaccuaggacagcugg

SEQ ID NO: 588152 - RNA, 18 nt, Human
ugggcgggcaggggauuc

SEQ ID NO: 588153 - RNA, 21 nt, Human
uggguccacccaccugcccaa

SEQ ID NO: 588154 - RNA, 19 nt, Human
aaacauuguaggcuauacu

SEQ ID NO: 588155 - RNA, 20 nt, Human
aaacuaagacccccauaaac

SEQ ID NO: 588156 - RNA, 22 nt, Human
aaacuccuagcugaagcugccu

SEQ ID NO: 588157 - RNA, 20 nt, Human
aacgaagcccacaccaauga

SEQ ID NO: 588158 - RNA, 19 nt, Human
aaggcaaaacgaagcccac

SEQ ID NO: 588159 - RNA, 18 nt, Human
acccugaagcauaacagc

SEQ ID NO: 588160 - RNA, 21 nt, Human
acccugaagcauaacagccuu

SEQ ID NO: 588161 - RNA, 22 nt, Human
agcugccagccucaagcaguuu

SEQ ID NO: 588162 - RNA, 25 nt, Human
auuccuuuaggccccggggcugcua

SEQ ID NO: 588163 - RNA, 20 nt, Human
caaacuuccugcuauccucc

SEQ ID NO: 588164 - RNA, 21 nt, Human
caaucuccagggcucucuagu

SEQ ID NO: 588165 - RNA, 22 nt, Human
caccaaugauuauguaagucag

SEQ ID NO: 588166 - RNA, 19 nt, Human
cagaaacaggagcugccag

SEQ ID NO: 588167 - RNA, 20 nt, Human
cauuguacagaacacccaga

SEQ ID NO: 588168 - RNA, 22 nt, Human
cccaaguuuuuuugcuccagca

SEQ ID NO: 588169 - RNA, 19 nt, Human
cccuucccuaccaccaauc

SEQ ID NO: 588170 - RNA, 21 nt, Human
cucuaguuugcuccuauuuuu

SEQ ID NO: 588171 - RNA, 18 nt, Human
cucugugaauuuacugaa

SEQ ID NO: 588172 - RNA, 18 nt, Human
cuucagcaacccugaagc

SEQ ID NO: 588173 - RNA, 21 nt, Human
gaaacaggagcugccagccuc

SEQ ID NO: 588174 - RNA, 23 nt, Human
gacaaaugugucacaaaguccuu

SEQ ID NO: 588175 - RNA, 22 nt, Human
ggcaaaacgaagcccacaccaa

SEQ ID NO: 588176 - RNA, 24 nt, Human
uaagaccucaauuacguaaaccaa

SEQ ID NO: 588177 - RNA, 22 nt, Human
uccagcagguugaccuucaagg

SEQ ID NO: 588178 - RNA, 23 nt, Human
ugaugacagcugauuccuuuagg

SEQ ID NO: 588179 - RNA, 21 nt, Human
ugcaucagucuucagaaacag

SEQ ID NO: 588180 - RNA, 23 nt, Human
uguaaauggagcuacaaauucaa

SEQ ID NO: 588181 - RNA, 21 nt, Human
uugcacgucccucuugaucuc

SEQ ID NO: 588182 - RNA, 24 nt, Human
aaacgggagcgagcaucaagccug

SEQ ID NO: 588183 - RNA, 21 nt, Human
agcaucaagccuguguuuuuu

SEQ ID NO: 588184 - RNA, 22 nt, Human
aggggagccagcugggcgcgcg

SEQ ID NO: 588185 - RNA, 21 nt, Human
cacuaaaccuugauugaagac

SEQ ID NO: 588186 - RNA, 24 nt, Human
cacuaaaccuugauugaagaccua

SEQ ID NO: 588187 - RNA, 19 nt, Human
ccaggcgaggggaugcccu

SEQ ID NO: 588188 - RNA, 22 nt, Human
cccgcacgcauaccaggcugug

SEQ ID NO: 588189 - RNA, 20 nt, Human
ccuccuccaggcgaggggau

SEQ ID NO: 588190 - RNA, 20 nt, Human
ccuccuguagaaacgggagc

SEQ ID NO: 588191 - RNA, 20 nt, Human
ccuguagaaacgggagcgag

SEQ ID NO: 588192 - RNA, 22 nt, Human
cgacccaguagccgugggcccu

SEQ ID NO: 588193 - RNA, 23 nt, Human
cgggagcgagcaucaagccugug

SEQ ID NO: 588194 - RNA, 18 nt, Human
cguuguuuucugaggugg

SEQ ID NO: 588195 - RNA, 19 nt, Human
cuccaggcgaggggaugcc

SEQ ID NO: 588196 - RNA, 24 nt, Human
cugucccagacaauaaaggugccc

SEQ ID NO: 588197 - RNA, 24 nt, Human
gaggggcugagggccugucccaga

SEQ ID NO: 588198 - RNA, 19 nt, Human
ggaggaggccgacccagua

SEQ ID NO: 588199 - RNA, 19 nt, Human
gggagccagcugggcgcgc

SEQ ID NO: 588200 - RNA, 20 nt, Human
gggcaggaggggcugagggc

SEQ ID NO: 588201 - RNA, 23 nt, Human
gggcaggaggggcugagggccug

SEQ ID NO: 588202 - RNA, 20 nt, Human
ggggcaggaggggcugaggg

SEQ ID NO: 588203 - RNA, 22 nt, Human
ggggcaggaggggcugagggcc

SEQ ID NO: 588204 - RNA, 21 nt, Human
gucaaaaccuccuguagaaac

SEQ ID NO: 588205 - RNA, 19 nt, Human
gugagcaagugggugugcu

SEQ ID NO: 588206 - RNA, 19 nt, Human
gugcugggaaccuggccac

SEQ ID NO: 588207 - RNA, 18 nt, Human
gugggugugcugggaacc

SEQ ID NO: 588208 - RNA, 20 nt, Human
uaggaugggcucgagugugg

SEQ ID NO: 588209 - RNA, 25 nt, Human
uaggaugggcucgaguguggcggug

SEQ ID NO: 588210 - RNA, 23 nt, Human
ucuggguggauggggcaggaggg

SEQ ID NO: 588211 - RNA, 23 nt, Human
ugagguggccucgcugucuuuca

SEQ ID NO: 588212 - RNA, 22 nt, Human
uggauggggcaggaggggcuga

SEQ ID NO: 588213 - RNA, 24 nt, Human
uguguacauucgaaacuccacuaa

SEQ ID NO: 588214 - RNA, 22 nt, Human
uucgaaacuccacuaaaccuug

SEQ ID NO: 588215 - RNA, 23 nt, Human
aaaaaacccuucaucugcagacc

SEQ ID NO: 588216 - RNA, 24 nt, Human
aaaauaccccauccagggccugga

SEQ ID NO: 588217 - RNA, 21 nt, Human
aaacacugaaaaaucagguga

SEQ ID NO: 588218 - RNA, 21 nt, Human
aaaccagggcugacaggaaga

SEQ ID NO: 588219 - RNA, 24 nt, Human
aaaggaacaagauacaaacagccc

SEQ ID NO: 588220 - RNA, 18 nt, Human
aacacacuucacaaagga

SEQ ID NO: 588221 - RNA, 19 nt, Human
aacagaaacaucaaacugc

SEQ ID NO: 588222 - RNA, 23 nt, Human
aagcaaaagacugcggcuccucu

SEQ ID NO: 588223 - RNA, 24 nt, Human
aagcaaacucaagucugugaugau

SEQ ID NO: 588224 - RNA, 22 nt, Human
acaccaaaauaccccauccagg

SEQ ID NO: 588225 - RNA, 24 nt, Human
acaccccagcagguccccgcaggc

SEQ ID NO: 588226 - RNA, 20 nt, Human
acacugaaaaaucaggugac

SEQ ID NO: 588227 - RNA, 22 nt, Human
accauggaaaccagggcugacc

SEQ ID NO: 588228 - RNA, 23 nt, Human
acgggucuggcccccaggccacc

SEQ ID NO: 588229 - RNA, 19 nt, Human
agaaaagagaaucaggagg

SEQ ID NO: 588230 - RNA, 20 nt, Human
agaggucacucgcaaagagg

SEQ ID NO: 588231 - RNA, 28 nt, Human
agccaagagcccugaaauugacuucggu

SEQ ID NO: 588232 - RNA, 22 nt, Human
agccgcuuccagcagggaccug

SEQ ID NO: 588233 - RNA, 26 nt, Human
agcuaccaaaggcugcacuaggauuu

SEQ ID NO: 588234 - RNA, 21 nt, Human
aggaaguuaguaaacauuuuu

SEQ ID NO: 588235 - RNA, 23 nt, Human
aggagcggagcccagaggucacu

SEQ ID NO: 588236 - RNA, 23 nt, Human
aggcagacagguuucgugccaga

SEQ ID NO: 588237 - RNA, 24 nt, Human
aggggcccgcugcguccugucuca

SEQ ID NO: 588238 - RNA, 23 nt, Human
agugaggagcggagcccagaggu

SEQ ID NO: 588239 - RNA, 22 nt, Human
auaaauauccuuugacucuaaa

SEQ ID NO: 588240 - RNA, 20 nt, Human
auuugcaggcucuucuccuu

SEQ ID NO: 588241 - RNA, 18 nt, Human
caaaauaccccauccagg

SEQ ID NO: 588242 - RNA, 22 nt, Human
caaaauaccccauccagggccu

SEQ ID NO: 588243 - RNA, 24 nt, Human
caaagcccaaacagccucagauuc

SEQ ID NO: 588244 - RNA, 24 nt, Human
caacccucccucugcccucacacc

SEQ ID NO: 588245 - RNA, 19 nt, Human
cacacagguagaaacacug

SEQ ID NO: 588246 - RNA, 23 nt, Human
cacacagguagaaacacugaaaa

SEQ ID NO: 588247 - RNA, 19 nt, Human
cacacuucacaaaggaaca

SEQ ID NO: 588248 - RNA, 20 nt, Human
cacagcccagcgucuccuuc

SEQ ID NO: 588249 - RNA, 21 nt, Human
cacaggaaggaacucgauuuc

SEQ ID NO: 588250 - RNA, 18 nt, Human
caccauggaaaccagggc

SEQ ID NO: 588251 - RNA, 19 nt, Human
cacccuccgcaccgcacag

SEQ ID NO: 588252 - RNA, 18 nt, Human
caccgcacagcccagcgu

SEQ ID NO: 588253 - RNA, 18 nt, Human
caccuccccaggggaccc

SEQ ID NO: 588254 - RNA, 23 nt, Human
cacgcaagcgcacgcuguguggc

SEQ ID NO: 588255 - RNA, 19 nt, Human
cacgcuguguggcaggcgu

SEQ ID NO: 588256 - RNA, 20 nt, Human
cagaaacaucaaacugccaa

SEQ ID NO: 588257 - RNA, 23 nt, Human
cagccgcuuccagcagggaccug

SEQ ID NO: 588258 - RNA, 27 nt, Human
caggccagggcccaugccccaccugcc

SEQ ID NO: 588259 - RNA, 18 nt, Human
cagggaccuggccugagg

SEQ ID NO: 588260 - RNA, 22 nt, Human
cagggaugaaugcaccagguuu

SEQ ID NO: 588261 - RNA, 22 nt, Human
caggugacggcucggcucugcc

SEQ ID NO: 588262 - RNA, 18 nt, Human
cagugcugcagagaggag

SEQ ID NO: 588263 - RNA, 18 nt, Human
caguggcauuucauucaa

SEQ ID NO: 588264 - RNA, 24 nt, Human
caucacccuccgcaccgcacagcc

SEQ ID NO: 588265 - RNA, 22 nt, Human
cauccucaucacccuccgcacc

SEQ ID NO: 588266 - RNA, 18 nt, Human
caugcuaaaaaacaaguc

SEQ ID NO: 588267 - RNA, 21 nt, Human
cauuggccauuugcaggcucu

SEQ ID NO: 588268 - RNA, 19 nt, Human
ccacaagcaaaagacugcg

SEQ ID NO: 588269 - RNA, 19 nt, Human
ccauccagggccuggaagc

SEQ ID NO: 588270 - RNA, 23 nt, Human
ccauuugcaggcucuucuccuug

SEQ ID NO: 588271 - RNA, 20 nt, Human
ccccaggccaccaggggccc

SEQ ID NO: 588272 - RNA, 22 nt, Human
ccccaggccaccaggggcccgc

SEQ ID NO: 588273 - RNA, 23 nt, Human
cccccaggccaccaggggcccgc

SEQ ID NO: 588274 - RNA, 22 nt, Human
cccccaggccaccaggggcccu

SEQ ID NO: 588275 - RNA, 22 nt, Human
ccccccgcccggcagggaaccu

SEQ ID NO: 588276 - RNA, 23 nt, Human
ccccccgcccggcagggaaccug

SEQ ID NO: 588277 - RNA, 22 nt, Human
ccccgugggagaacacggggcg

SEQ ID NO: 588278 - RNA, 23 nt, Human
ccccgugggagaacacggggcgg

SEQ ID NO: 588279 - RNA, 18 nt, Human
ccccuggaacucgggcug

SEQ ID NO: 588280 - RNA, 21 nt, Human
cccggcagggaaccugacccc

SEQ ID NO: 588281 - RNA, 23 nt, Human
ccgcgugcgcgcccuccgauucu

SEQ ID NO: 588282 - RNA, 19 nt, Human
ccggugcacgcugccgccg

SEQ ID NO: 588283 - RNA, 23 nt, Human
cgaaacagaaacaucaaacugcc

SEQ ID NO: 588284 - RNA, 19 nt, Human
cggcacggcggcggcugcc

SEQ ID NO: 588285 - RNA, 21 nt, Human
cggcagggaaccugaccccac

SEQ ID NO: 588286 - RNA, 20 nt, Human
cggggcggcaccggugcccc

SEQ ID NO: 588287 - RNA, 22 nt, Human
cggugcacgcugccgccggaag

SEQ ID NO: 588288 - RNA, 22 nt, Human
cguuggacugcgcccgucucuu

SEQ ID NO: 588289 - RNA, 19 nt, Human
cuccagggaugaaugcacc

SEQ ID NO: 588290 - RNA, 20 nt, Human
cuggcccccaggccaccagg

SEQ ID NO: 588291 - RNA, 18 nt, Human
cugggucccuucccucgg

SEQ ID NO: 588292 - RNA, 25 nt, Human
gagcuccagcacacagguagaaaca

SEQ ID NO: 588293 - RNA, 20 nt, Human
gaggccccuggaacucgggc

SEQ ID NO: 588294 - RNA, 18 nt, Human
gaggugauugauugaaac

SEQ ID NO: 588295 - RNA, 21 nt, Human
gaggugauugauugaaacgga

SEQ ID NO: 588296 - RNA, 21 nt, Human
gcccgcccggugcacgcugcc

SEQ ID NO: 588297 - RNA, 28 nt, Human
gccgaaacagaaacaucaaacugccaag

SEQ ID NO: 588298 - RNA, 24 nt, Human
ggagcugaagguuguuuuuaaaug

SEQ ID NO: 588299 - RNA, 18 nt, Human
ggccaccaggggcccgcu

SEQ ID NO: 588300 - RNA, 22 nt, Human
ggcggcugccuugcgcuuccag

SEQ ID NO: 588301 - RNA, 19 nt, Human
gggguuccucuucuccucc

SEQ ID NO: 588302 - RNA, 22 nt, Human
gggguuccucuucuccuccuca

SEQ ID NO: 588303 - RNA, 18 nt, Human
ggguuccucuucuccucc

SEQ ID NO: 588304 - RNA, 21 nt, Human
gguuucgugccagagugacac

SEQ ID NO: 588305 - RNA, 23 nt, Human
guacuuacuggccuuggugguca

SEQ ID NO: 588306 - RNA, 23 nt, Human
guccugcuggcaguguccaugcu

SEQ ID NO: 588307 - RNA, 21 nt, Human
guuuuccugcgagaauccugg

SEQ ID NO: 588308 - RNA, 22 nt, Human
uaaaaaaagaggggacuggaaa

SEQ ID NO: 588309 - RNA, 23 nt, Human
uaaaaaacaagucgaggugauug

SEQ ID NO: 588310 - RNA, 18 nt, Human
uaaaaccacaggcuggac

SEQ ID NO: 588311 - RNA, 20 nt, Human
uaagaaaagcagaaaaagug

SEQ ID NO: 588312 - RNA, 26 nt, Human
uaagaaaagcagaaaaaguguuuucu

SEQ ID NO: 588313 - RNA, 19 nt, Human
uaccaaaggcugcacuagg

SEQ ID NO: 588314 - RNA, 18 nt, Human
uacucggguggcugcgug

SEQ ID NO: 588315 - RNA, 19 nt, Human
uacuguuuuccugcgagaa

SEQ ID NO: 588316 - RNA, 24 nt, Human
uaggauuucuucuguguccaacag

SEQ ID NO: 588317 - RNA, 24 nt, Human
uaucguaaaaccacaggcuggacg

SEQ ID NO: 588318 - RNA, 19 nt, Human
uccacaagcaaaagacugc

SEQ ID NO: 588319 - RNA, 21 nt, Human
uccacaagcaaaagacugcgg

SEQ ID NO: 588320 - RNA, 22 nt, Human
uccacaagcaaaagacugcggc

SEQ ID NO: 588321 - RNA, 19 nt, Human
uccagggccuggaagcccc

SEQ ID NO: 588322 - RNA, 22 nt, Human
uccccagaucgggaugucucug

SEQ ID NO: 588323 - RNA, 20 nt, Human
uccccaggggacccagcgga

SEQ ID NO: 588324 - RNA, 20 nt, Human
uccuccucagaagggcugua

SEQ ID NO: 588325 - RNA, 27 nt, Human
ucuccaauuauaaaaucagugacuguu

SEQ ID NO: 588326 - RNA, 22 nt, Human
ucugcccucacaccccagcagg

SEQ ID NO: 588327 - RNA, 26 nt, Human
ucugccuuugacucuaagauggggca

SEQ ID NO: 588328 - RNA, 18 nt, Human
ugaaaaugcacaguggca

SEQ ID NO: 588329 - RNA, 18 nt, Human
ugaaaaugcacaguggca

SEQ ID NO: 588330 - RNA, 18 nt, Human
ugacaccaaaauacccca

SEQ ID NO: 588331 - RNA, 26 nt, Human
ugaggaaguuaguaaacauuuuuucc

SEQ ID NO: 588332 - RNA, 21 nt, Human
ugaggagcggagcccagaggu

SEQ ID NO: 588333 - RNA, 20 nt, Human
ugagggcaagggaggagcgg

SEQ ID NO: 588334 - RNA, 21 nt, Human
ugccccaccugcccacggguc

SEQ ID NO: 588335 - RNA, 21 nt, Human
ugccccaccugcccacggguc

SEQ ID NO: 588336 - RNA, 23 nt, Human
ugccgaaacagaaacaucaaacu

SEQ ID NO: 588337 - RNA, 20 nt, Human
ugcggcuccucucucugcag

SEQ ID NO: 588338 - RNA, 25 nt, Human
ugcuuuaggaagcaaacucaagucu

SEQ ID NO: 588339 - RNA, 24 nt, Human
uggcccccaggccaccaggggccc

SEQ ID NO: 588340 - RNA, 22 nt, Human
ugggaugugcccgcgacccugg

SEQ ID NO: 588341 - RNA, 23 nt, Human
ugggaugugcccgcgacccuggc

SEQ ID NO: 588342 - RNA, 19 nt, Human
uguacagcaggagugagga

SEQ ID NO: 588343 - RNA, 23 nt, Human
ugucaccagacauccucaucacc

SEQ ID NO: 588344 - RNA, 21 nt, Human
uguccgcacggcugucaccag

SEQ ID NO: 588345 - RNA, 18 nt, Human
ugucucacacacaagggg

SEQ ID NO: 588346 - RNA, 24 nt, Human
uuaaaaaaugcugcauguuuccug

SEQ ID NO: 588347 - RNA, 21 nt, Human
uucaaaaaacccuucaucugc

SEQ ID NO: 588348 - RNA, 22 nt, Human
uucagaaaucaaaaaaauuuuc

SEQ ID NO: 588349 - RNA, 21 nt, Human
uuccugaaguaccuaaaugga

SEQ ID NO: 588350 - RNA, 19 nt, Human
uuuacuuauuccauugaaa

SEQ ID NO: 588351 - RNA, 18 nt, Human
uuugacucuaagaugggg

SEQ ID NO: 588352 - RNA, 24 nt, Human
uuuuuuuuuuuuuuuuuucccaag

SEQ ID NO: 588353 - RNA, 24 nt, Human
aaaaugcuuggauuacaggcauga

SEQ ID NO: 588354 - RNA, 21 nt, Human
aaccacagcgcccccgccagc

SEQ ID NO: 588355 - RNA, 25 nt, Human
aagcgauucucccaccucagccucc

SEQ ID NO: 588356 - RNA, 20 nt, Human
acagccacuuuuuuggccca

SEQ ID NO: 588357 - RNA, 21 nt, Human
accacagcgcccccgccagcc

SEQ ID NO: 588358 - RNA, 19 nt, Human
acucuaaguuuuguuuugg

SEQ ID NO: 588359 - RNA, 19 nt, Human
agaaagccaggggugaaaa

SEQ ID NO: 588360 - RNA, 22 nt, Human
agaaugccuuugucccaugaaa

SEQ ID NO: 588361 - RNA, 18 nt, Human
agagggagguggggcuug

SEQ ID NO: 588362 - RNA, 23 nt, Human
aguagcugggauuacgggcgugu

SEQ ID NO: 588363 - RNA, 20 nt, Human
agugcaguggcgcaaucucg

SEQ ID NO: 588364 - RNA, 24 nt, Human
agugcaguggcgcaaucucggcuc

SEQ ID NO: 588365 - RNA, 18 nt, Human
augaaauguucuggaacc

SEQ ID NO: 588366 - RNA, 19 nt, Human
augacacuuccugaagucu

SEQ ID NO: 588367 - RNA, 25 nt, Human
augacacuuccugaagucuugggug

SEQ ID NO: 588368 - RNA, 18 nt, Human
auggggucucgccauguu

SEQ ID NO: 588369 - RNA, 20 nt, Human
auggggucucgccauguugg

SEQ ID NO: 588370 - RNA, 24 nt, Human
auggggucucgccauguuggccag

SEQ ID NO: 588371 - RNA, 24 nt, Human
auuuuuguauuuuuaguagagaug

SEQ ID NO: 588372 - RNA, 24 nt, Human
caaaaugcuuggauuacaggcaug

SEQ ID NO: 588373 - RNA, 24 nt, Human
caacaugcucagcuaauuuuugua

SEQ ID NO: 588374 - RNA, 20 nt, Human
caagcgauucucccaccuca

SEQ ID NO: 588375 - RNA, 20 nt, Human
cacagcgcccccgccagccc

SEQ ID NO: 588376 - RNA, 21 nt, Human
cacagcgcccccgccagcccu

SEQ ID NO: 588377 - RNA, 20 nt, Human
cacccggccacaagcuucua

SEQ ID NO: 588378 - RNA, 24 nt, Human
caccucagccuccugaguagcugg

SEQ ID NO: 588379 - RNA, 21 nt, Human
cacugcaaccugcaccuccug

SEQ ID NO: 588380 - RNA, 23 nt, Human
cacugcaaccugcaccuccuggg

SEQ ID NO: 588381 - RNA, 20 nt, Human
cagccuccugaguagcuggg

SEQ ID NO: 588382 - RNA, 21 nt, Human
cagcgcccccgccagcccucc

SEQ ID NO: 588383 - RNA, 19 nt, Human
caugaaauguucuggaacc

SEQ ID NO: 588384 - RNA, 24 nt, Human
cauguuggccaggcuggucucaaa

SEQ ID NO: 588385 - RNA, 20 nt, Human
ccacagcgcccccgccagcc

SEQ ID NO: 588386 - RNA, 23 nt, Human
ccaccucagccuccugaguagcu

SEQ ID NO: 588387 - RNA, 19 nt, Human
ccacugcacccggccacaa

SEQ ID NO: 588388 - RNA, 19 nt, Human
ccauguuggccaggcuggu

SEQ ID NO: 588389 - RNA, 23 nt, Human
cccaccucagccuccugaguagc

SEQ ID NO: 588390 - RNA, 21 nt, Human
ccccagggugggggggacacc

SEQ ID NO: 588391 - RNA, 19 nt, Human
ccccugcccaccucagaca

SEQ ID NO: 588392 - RNA, 19 nt, Human
cccugcccaccucagacag

SEQ ID NO: 588393 - RNA, 24 nt, Human
ccuccuggguucaagcgauucucc

SEQ ID NO: 588394 - RNA, 23 nt, Human
ccugaguagcugggauuacgggc

SEQ ID NO: 588395 - RNA, 23 nt, Human
ccugaguagcugggauuacgggc

SEQ ID NO: 588396 - RNA, 24 nt, Human
ccuggccucaauugauccaccucc

SEQ ID NO: 588397 - RNA, 19 nt, Human
ccuucaucaccaucagggu

SEQ ID NO: 588398 - RNA, 20 nt, Human
ccuuggagcuggcugagccc

SEQ ID NO: 588399 - RNA, 21 nt, Human
ccuuggagcuggcugagcccu

SEQ ID NO: 588400 - RNA, 22 nt, Human
cgccagcccuccgugggagcac

SEQ ID NO: 588401 - RNA, 24 nt, Human
cgccauguuggccaggcuggucuc

SEQ ID NO: 588402 - RNA, 24 nt, Human
cucacugcaaccugcaccuccugg

SEQ ID NO: 588403 - RNA, 24 nt, Human
cucagccuccugaguagcugggau

SEQ ID NO: 588404 - RNA, 23 nt, Human
cuccuggccucaauugauccacc

SEQ ID NO: 588405 - RNA, 21 nt, Human
cuccuggguucaagcgauucu

SEQ ID NO: 588406 - RNA, 24 nt, Human
cugaguagcugggauuacgggcgu

SEQ ID NO: 588407 - RNA, 21 nt, Human
cugcaaccugcaccuccuggg

SEQ ID NO: 588408 - RNA, 23 nt, Human
cugcaaccugcaccuccuggguu

SEQ ID NO: 588409 - RNA, 19 nt, Human
cuggaaccacagcgccccc

SEQ ID NO: 588410 - RNA, 21 nt, Human
cuugcagaaugccuuuguccc

SEQ ID NO: 588411 - RNA, 20 nt, Human
cuuggauuacaggcaugagc

SEQ ID NO: 588412 - RNA, 19 nt, Human
gaacuuggagagggaggug

SEQ ID NO: 588413 - RNA, 22 nt, Human
gaaggucucccuuccccugccc

SEQ ID NO: 588414 - RNA, 19 nt, Human
gagacaccaucaugugugg

SEQ ID NO: 588415 - RNA, 21 nt, Human
gagauagggucuugcuccauu

SEQ ID NO: 588416 - RNA, 20 nt, Human
gagcacagaggggcaggccu

SEQ ID NO: 588417 - RNA, 20 nt, Human
gaguagcugggauuacgggc

SEQ ID NO: 588418 - RNA, 20 nt, Human
gaguagcugggauuacgggc

SEQ ID NO: 588419 - RNA, 18 nt, Human
gauuacaggcaugagcca

SEQ ID NO: 588420 - RNA, 22 nt, Human
gauuacaggcaugagccacugc

SEQ ID NO: 588421 - RNA, 23 nt, Human
gauuacaggcaugagccacugca

SEQ ID NO: 588422 - RNA, 21 nt, Human
gauucucccaccucagccucc

SEQ ID NO: 588423 - RNA, 22 nt, Human
gccacaagcuucuacuucuugc

SEQ ID NO: 588424 - RNA, 22 nt, Human
gccacugcacccggccacaagc

SEQ ID NO: 588425 - RNA, 25 nt, Human
gccauguuggccaggcuggucucaa

SEQ ID NO: 588426 - RNA, 19 nt, Human
gcuagagugcaguggcgca

SEQ ID NO: 588427 - RNA, 23 nt, Human
gcuggucucaaacuccuggccuc

SEQ ID NO: 588428 - RNA, 18 nt, Human
ggagagggagguggggcu

SEQ ID NO: 588429 - RNA, 22 nt, Human
ggagagggagguggggcuugga

SEQ ID NO: 588430 - RNA, 18 nt, Human
ggagcuggcugagcccug

SEQ ID NO: 588431 - RNA, 19 nt, Human
ggagcuggcugagcccugu

SEQ ID NO: 588432 - RNA, 20 nt, Human
ggauuacaggcaugagccac

SEQ ID NO: 588433 - RNA, 22 nt, Human
ggauuacaggcaugagccacug

SEQ ID NO: 588434 - RNA, 24 nt, Human
ggauuacaggcaugagccacugca

SEQ ID NO: 588435 - RNA, 24 nt, Human
ggcuggucucaaacuccuggccuc

SEQ ID NO: 588436 - RNA, 18 nt, Human
ggggacaccuuguccuug

SEQ ID NO: 588437 - RNA, 21 nt, Human
ggggguguagagaggaggagg

SEQ ID NO: 588438 - RNA, 22 nt, Human
ggggucucgccauguuggccag

SEQ ID NO: 588439 - RNA, 19 nt, Human
gguggggcuuggaaaugcc

SEQ ID NO: 588440 - RNA, 23 nt, Human
guagagauggggucucgccaugu

SEQ ID NO: 588441 - RNA, 18 nt, Human
guagcugggauuacgggc

SEQ ID NO: 588442 - RNA, 24 nt, Human
uaaggaggugguggggaaggucuc

SEQ ID NO: 588443 - RNA, 24 nt, Human
uaauuuuuguauuuuuaguagaga

SEQ ID NO: 588444 - RNA, 23 nt, Human
uacaggcaugagccacugcaccc

SEQ ID NO: 588445 - RNA, 19 nt, Human
uagaaagccaggggugaaa

SEQ ID NO: 588446 - RNA, 22 nt, Human
uagagauggggucucgccaugu

SEQ ID NO: 588447 - RNA, 23 nt, Human
uagagugcaguggcgcaaucucg

SEQ ID NO: 588448 - RNA, 24 nt, Human
uagagugcaguggcgcaaucucgg

SEQ ID NO: 588449 - RNA, 24 nt, Human
uaguagagauggggucucgccaug

SEQ ID NO: 588450 - RNA, 24 nt, Human
ucaaaaugcuuggauuacaggcau

SEQ ID NO: 588451 - RNA, 24 nt, Human
ucacugcaaccugcaccuccuggg

SEQ ID NO: 588452 - RNA, 27 nt, Human
ucacugcaaccugcaccuccuggguuc

SEQ ID NO: 588453 - RNA, 20 nt, Human
ucagccuccugaguagcugg

SEQ ID NO: 588454 - RNA, 23 nt, Human
uccaccuccuuggccucucaaaa

SEQ ID NO: 588455 - RNA, 22 nt, Human
uccacgagugcuaugacacuuc

SEQ ID NO: 588456 - RNA, 24 nt, Human
uccauugcuuaggcuagagugcag

SEQ ID NO: 588457 - RNA, 22 nt, Human
ucccuucucucauuuucuaaaa

SEQ ID NO: 588458 - RNA, 22 nt, Human
uccucugacaauugaguuucca

SEQ ID NO: 588459 - RNA, 24 nt, Human
uccugaguagcugggauuacgggc

SEQ ID NO: 588460 - RNA, 21 nt, Human
uccuggguucaagcgauucuc

SEQ ID NO: 588461 - RNA, 23 nt, Human
uccuggguucaagcgauucuccc

SEQ ID NO: 588462 - RNA, 20 nt, Human
uccuuggagcuggcugagcc

SEQ ID NO: 588463 - RNA, 23 nt, Human
uccuuggagcuggcugagcccug

SEQ ID NO: 588464 - RNA, 25 nt, Human
uccuuggagcuggcugagcccugug

SEQ ID NO: 588465 - RNA, 24 nt, Human
ucgccauguuggccaggcuggucu

SEQ ID NO: 588466 - RNA, 22 nt, Human
ucggcucacugcaaccugcacc

SEQ ID NO: 588467 - RNA, 24 nt, Human
ucucaaaaugcuuggauuacaggc

SEQ ID NO: 588468 - RNA, 23 nt, Human
ucucacaccaggcuaaggaggug

SEQ ID NO: 588469 - RNA, 24 nt, Human
ucucccaccucagccuccugagua

SEQ ID NO: 588470 - RNA, 24 nt, Human
ucucgccauguuggccaggcuggu

SEQ ID NO: 588471 - RNA, 24 nt, Human
ucuugcuccauugcuuaggcuaga

SEQ ID NO: 588472 - RNA, 19 nt, Human
ugaaauguucuggaaccac

SEQ ID NO: 588473 - RNA, 30 nt, Human
ugaaauguucuggaaccacagcgccccccu

SEQ ID NO: 588474 - RNA, 20 nt, Human
ugauccaccuccuuggccuc

SEQ ID NO: 588475 - RNA, 22 nt, Human
ugcaguggcgcaaucucggcuc

SEQ ID NO: 588476 - RNA, 23 nt, Human
ugcaguggcgcaaucucggcuca

SEQ ID NO: 588477 - RNA, 20 nt, Human
ugccagcccaguccuugaac

SEQ ID NO: 588478 - RNA, 19 nt, Human
ugccuuguccccagggugg

SEQ ID NO: 588479 - RNA, 24 nt, Human
ugcuccauugcuuaggcuagagug

SEQ ID NO: 588480 - RNA, 22 nt, Human
ugcuuaggcuagagugcagugg

SEQ ID NO: 588481 - RNA, 24 nt, Human
ugcuuaggcuagagugcaguggcg

SEQ ID NO: 588482 - RNA, 23 nt, Human
uggaaaugccuuguccccagggu

SEQ ID NO: 588483 - RNA, 22 nt, Human
uggaaccacagcgcccccgcca

SEQ ID NO: 588484 - RNA, 20 nt, Human
uggauuacaggcaugagcca

SEQ ID NO: 588485 - RNA, 23 nt, Human
uggauuacaggcaugagccacug

SEQ ID NO: 588486 - RNA, 24 nt, Human
uggccaggcuggucucaaacuccu

SEQ ID NO: 588487 - RNA, 21 nt, Human
uggccucaauugauccaccuc

SEQ ID NO: 588488 - RNA, 20 nt, Human
uggccucuuggggaucccuc

SEQ ID NO: 588489 - RNA, 18 nt, Human
ugggauuacgggcgugug

SEQ ID NO: 588490 - RNA, 21 nt, Human
ugggauuacgggcguguguca

SEQ ID NO: 588491 - RNA, 24 nt, Human
uggggucucgccauguuggccagg

SEQ ID NO: 588492 - RNA, 23 nt, Human
uggguccucugacaauugaguuu

SEQ ID NO: 588493 - RNA, 18 nt, Human
ugguauauucacaaaugc

SEQ ID NO: 588494 - RNA, 21 nt, Human
uguauuuuuaguagagauggg

SEQ ID NO: 588495 - RNA, 18 nt, Human
uuaguagagauggggucu

SEQ ID NO: 588496 - RNA, 24 nt, Human
uuaguagagauggggucucgccau

SEQ ID NO: 588497 - RNA, 23 nt, Human
uucaagcgauucucccaccucag

SEQ ID NO: 588498 - RNA, 24 nt, Human
uucaagcgauucucccaccucagc

SEQ ID NO: 588499 - RNA, 23 nt, Human
uuggaaaugccuuguccccaggg

SEQ ID NO: 588500 - RNA, 23 nt, Human
uuggagagggagguggggcuugg

SEQ ID NO: 588501 - RNA, 22 nt, Human
uuggauuacaggcaugagccac

SEQ ID NO: 588502 - RNA, 24 nt, Human
uuggauuacaggcaugagccacug

SEQ ID NO: 588503 - RNA, 23 nt, Human
uuguauuuuuaguagagaugggg

SEQ ID NO: 588504 - RNA, 19 nt, Human
uuucucagacgauucugug

SEQ ID NO: 588505 - RNA, 21 nt, Human
uuucucagacgauucugugaa

SEQ ID NO: 588506 - RNA, 24 nt, Human
uuuuuaguagagauggggucucgc

SEQ ID NO: 588507 - RNA, 20 nt, Human
uuuuuguauuuuuaguagag

SEQ ID NO: 588508 - RNA, 22 nt, Human
accucccgcggacucuccgcug

SEQ ID NO: 588509 - RNA, 21 nt, Human
aggcaaagggcaagcccagag

SEQ ID NO: 588510 - RNA, 23 nt, Human
caaaacacccugaaccagccacg

SEQ ID NO: 588511 - RNA, 22 nt, Human
caaggccggcucuuccaagcac

SEQ ID NO: 588512 - RNA, 23 nt, Human
cacccaagccaccucccgcggac

SEQ ID NO: 588513 - RNA, 23 nt, Human
cacccugaaccagccacgaagac

SEQ ID NO: 588514 - RNA, 19 nt, Human
ccaagccaccucccgcgga

SEQ ID NO: 588515 - RNA, 27 nt, Human
ccacaaauccucuccucgcccaggucc

SEQ ID NO: 588516 - RNA, 23 nt, Human
ccacgaagacugcugcucccaga

SEQ ID NO: 588517 - RNA, 21 nt, Human
cccaagccaccucccgcggac

SEQ ID NO: 588518 - RNA, 21 nt, Human
cccugagguauagaaccggca

SEQ ID NO: 588519 - RNA, 19 nt, Human
ccucccgcggacucuccgc

SEQ ID NO: 588520 - RNA, 21 nt, Human
ccucgcccaggucccuuuccc

SEQ ID NO: 588521 - RNA, 21 nt, Human
cgcacacccaagccaccuccc

SEQ ID NO: 588522 - RNA, 21 nt, Human
cggaacaaaacacccugaacc

SEQ ID NO: 588523 - RNA, 18 nt, Human
cggcaggcaggcaggcuc

SEQ ID NO: 588524 - RNA, 18 nt, Human
cucuccgcuggcaguccc

SEQ ID NO: 588525 - RNA, 19 nt, Human
gacugcugcucccagacuc

SEQ ID NO: 588526 - RNA, 22 nt, Human
gcugauagccucacucaaccca

SEQ ID NO: 588527 - RNA, 18 nt, Human
ggaacaaaacacccugaa

SEQ ID NO: 588528 - RNA, 20 nt, Human
ggacucuccgcuggcagucc

SEQ ID NO: 588529 - RNA, 18 nt, Human
ggagggcccacccaaggc

SEQ ID NO: 588530 - RNA, 18 nt, Human
ggcagaggguuuucauca

SEQ ID NO: 588531 - RNA, 22 nt, Human
gggcagaggguuuucaucaugu

SEQ ID NO: 588532 - RNA, 20 nt, Human
ggggaggggacgggaggggg

SEQ ID NO: 588533 - RNA, 18 nt, Human
gucccuuucccccuuucu

SEQ ID NO: 588534 - RNA, 20 nt, Human
gucccuuucccccuuucugg

SEQ ID NO: 588535 - RNA, 21 nt, Human
gugaggguagaggcgguggag

SEQ ID NO: 588536 - RNA, 20 nt, Human
uccaaggggaggggacggga

SEQ ID NO: 588537 - RNA, 18 nt, Human
ucugcaggaggcaaaggg

SEQ ID NO: 588538 - RNA, 22 nt, Human
ucugcaggaggcaaagggcaag

SEQ ID NO: 588539 - RNA, 21 nt, Human
ugaggguagaggcgguggagg

SEQ ID NO: 588540 - RNA, 24 nt, Human
ugaggguagaggcgguggagggcc

SEQ ID NO: 588541 - RNA, 18 nt, Human
ugccccugagguauagaa

SEQ ID NO: 588542 - RNA, 22 nt, Human
uggagggcccacccaaggccgg

SEQ ID NO: 588543 - RNA, 21 nt, Human
ugguagaugaggccagggcag

SEQ ID NO: 588544 - RNA, 21 nt, Human
uuuucaaaguucugcaggagg

SEQ ID NO: 588545 - RNA, 22 nt, Human
aaaaacacgaugaaugauaguc

SEQ ID NO: 588546 - RNA, 24 nt, Human
aaaacauaaaaaauaaaagcuaca

SEQ ID NO: 588547 - RNA, 21 nt, Human
aaaauccucuuaaccccacuu

SEQ ID NO: 588548 - RNA, 18 nt, Human
aaaugaaaacacaaauaa

SEQ ID NO: 588549 - RNA, 22 nt, Human
aaaugcagaagaucgauggacu

SEQ ID NO: 588550 - RNA, 18 nt, Human
agacuuuuaacuuucuuc

SEQ ID NO: 588551 - RNA, 23 nt, Human
auagcagacaauaguggcuuggu

SEQ ID NO: 588552 - RNA, 23 nt, Human
auccaaauuguuauguacuguau

SEQ ID NO: 588553 - RNA, 18 nt, Human
auccuauuccuuucccca

SEQ ID NO: 588554 - RNA, 21 nt, Human
auggauccgacagggucgugg

SEQ ID NO: 588555 - RNA, 20 nt, Human
auggaucuggauuaagaugg

SEQ ID NO: 588556 - RNA, 19 nt, Human
auugaaauuccacagguaa

SEQ ID NO: 588557 - RNA, 21 nt, Human
caaagcaaaccaauuuccccu

SEQ ID NO: 588558 - RNA, 22 nt, Human
caaagcaaaccaauuuccccug

SEQ ID NO: 588559 - RNA, 18 nt, Human
caacacucucaaaugaaa

SEQ ID NO: 588560 - RNA, 26 nt, Human
caacacucucaaaugaaaacacaaau

SEQ ID NO: 588561 - RNA, 22 nt, Human
caaugguggucuuaaaauuggu

SEQ ID NO: 588562 - RNA, 27 nt, Human
cacuucaguccuuuugauugcuguuuc

SEQ ID NO: 588563 - RNA, 21 nt, Human
cagacugggauccaaauuguu

SEQ ID NO: 588564 - RNA, 20 nt, Human
cagaggagcugcucugggug

SEQ ID NO: 588565 - RNA, 19 nt, Human
cagcacuacuacaaucuua

SEQ ID NO: 588566 - RNA, 23 nt, Human
ccuguggcugaaucacaguuaac

SEQ ID NO: 588567 - RNA, 21 nt, Human
cugaguuugagaagaagaagg

SEQ ID NO: 588568 - RNA, 24 nt, Human
cuuaaaauccucuuaaccccacuu

SEQ ID NO: 588569 - RNA, 25 nt, Human
cuuaaaauccucuuaaccccacuuc

SEQ ID NO: 588570 - RNA, 19 nt, Human
cuuuggacuguugcuccuc

SEQ ID NO: 588571 - RNA, 18 nt, Human
gaacuaaacuugaaaaaa

SEQ ID NO: 588572 - RNA, 18 nt, Human
guccucuugaccuucugc

SEQ ID NO: 588573 - RNA, 22 nt, Human
gugguucccgagguauagugaa

SEQ ID NO: 588574 - RNA, 19 nt, Human
guuuucaguguucugugcc

SEQ ID NO: 588575 - RNA, 18 nt, Human
uaaaagcuacauaauccu

SEQ ID NO: 588576 - RNA, 21 nt, Human
uaaaggucauucuuuaaaaca

SEQ ID NO: 588577 - RNA, 24 nt, Human
uaagagcagauacugccaccuagg

SEQ ID NO: 588578 - RNA, 28 nt, Human
uacaaucuuaacagucugccuuuuuaaa

SEQ ID NO: 588579 - RNA, 23 nt, Human
uauaaaacauaaaaaauaaaagc

SEQ ID NO: 588580 - RNA, 25 nt, Human
uauaacaaaaacacgaugaaugaua

SEQ ID NO: 588581 - RNA, 21 nt, Human
uauuccagacugggauccaaa

SEQ ID NO: 588582 - RNA, 19 nt, Human
ucaaaacuaugcagaggag

SEQ ID NO: 588583 - RNA, 23 nt, Human
ucaaaccuauaaaugcagaagau

SEQ ID NO: 588584 - RNA, 23 nt, Human
uccgcggaggcgcgguuuuuuuu

SEQ ID NO: 588585 - RNA, 21 nt, Human
uccucaggugagaauuuuguu

SEQ ID NO: 588586 - RNA, 21 nt, Human
ucuccuuuaacugauaaaggu

SEQ ID NO: 588587 - RNA, 24 nt, Human
ucucuccuuuuuccucaggugaga

SEQ ID NO: 588588 - RNA, 23 nt, Human
ucugaguuugagaagaagaaggg

SEQ ID NO: 588589 - RNA, 24 nt, Human
ucugugccauggcuaggucaggga

SEQ ID NO: 588590 - RNA, 19 nt, Human
ugaaaacacaaauaaguuu

SEQ ID NO: 588591 - RNA, 20 nt, Human
ugaaaguggcuacaguugga

SEQ ID NO: 588592 - RNA, 22 nt, Human
ugaacuaaacuugaaaaaaucc

SEQ ID NO: 588593 - RNA, 18 nt, Human
ugccauggcuaggucagg

SEQ ID NO: 588594 - RNA, 23 nt, Human
ugcccuuuuuauuccagacuggg

SEQ ID NO: 588595 - RNA, 27 nt, Human
ugcuggagauggagguggucguacguc

SEQ ID NO: 588596 - RNA, 19 nt, Human
uggauccgacagggucgug

SEQ ID NO: 588597 - RNA, 18 nt, Human
uggcaacaauagcagaca

SEQ ID NO: 588598 - RNA, 22 nt, Human
uggcaacaauagcagacaauag

SEQ ID NO: 588599 - RNA, 24 nt, Human
uuaaauggagaacuagagaauaca

SEQ ID NO: 588600 - RNA, 24 nt, Human
uucaaaccuauaaaugcagaagau

SEQ ID NO: 588601 - RNA, 22 nt, Human
uucaauaucagcaauggugguc

SEQ ID NO: 588602 - RNA, 19 nt, Human
uucaguguucugugccaug

SEQ ID NO: 588603 - RNA, 19 nt, Human
uucaguguucugugccaug

SEQ ID NO: 588604 - RNA, 20 nt, Human
uuccucaggugagaauuuug

SEQ ID NO: 588605 - RNA, 20 nt, Human
uuggguuuagagagguuuuu

SEQ ID NO: 588606 - RNA, 22 nt, Human
uuguucaacacucucaaaugaa

SEQ ID NO: 588607 - RNA, 23 nt, Human
uuuuuucugaguuugagaagaag

SEQ ID NO: 588608 - RNA, 22 nt, Human
aaaaaaagggggauaaacagaa

SEQ ID NO: 588609 - RNA, 20 nt, Human
aaaagauucaguuagccccu

SEQ ID NO: 588610 - RNA, 20 nt, Human
aaacaaugggcuuaaaaaaa

SEQ ID NO: 588611 - RNA, 24 nt, Human
aaacccaacagccacagugauugu

SEQ ID NO: 588612 - RNA, 23 nt, Human
aaccugugccugguggccacaga

SEQ ID NO: 588613 - RNA, 23 nt, Human
aacuccucuggcccuggggcugg

SEQ ID NO: 588614 - RNA, 22 nt, Human
aagcaaagauggggcuccaagg

SEQ ID NO: 588615 - RNA, 25 nt, Human
aagcaaagauggggcuccaaggucu

SEQ ID NO: 588616 - RNA, 22 nt, Human
aaggaaucuagaacaaaguucu

SEQ ID NO: 588617 - RNA, 21 nt, Human
aaggagccaacuccccacgag

SEQ ID NO: 588618 - RNA, 26 nt, Human
aaugggcuuaaaaaaaaaaaaagggg

SEQ ID NO: 588619 - RNA, 18 nt, Human
acacccccacccaccauc

SEQ ID NO: 588620 - RNA, 20 nt, Human
acccccacccaccaucccca

SEQ ID NO: 588621 - RNA, 18 nt, Human
acccugcccaggaaggag

SEQ ID NO: 588622 - RNA, 21 nt, Human
accugugccugguggccacag

SEQ ID NO: 588623 - RNA, 23 nt, Human
acuccacugcccuagacgagugg

SEQ ID NO: 588624 - RNA, 19 nt, Human
acugcuuggggcaagggaa

SEQ ID NO: 588625 - RNA, 20 nt, Human
acugcuuggggcaagggaag

SEQ ID NO: 588626 - RNA, 24 nt, Human
agaaauaggagaaaacccaacagc

SEQ ID NO: 588627 - RNA, 19 nt, Human
agagagggcuaugcugugu

SEQ ID NO: 588628 - RNA, 24 nt, Human
agccaacuccccacgagaagccug

SEQ ID NO: 588629 - RNA, 20 nt, Human
agcugagggggcaucagacc

SEQ ID NO: 588630 - RNA, 25 nt, Human
aggaaaaaacaggcucaagagugaa

SEQ ID NO: 588631 - RNA, 21 nt, Human
aggaagagguaggcaacaaaa

SEQ ID NO: 588632 - RNA, 23 nt, Human
aggaagagguaggcaacaaaagg

SEQ ID NO: 588633 - RNA, 24 nt, Human
aggagucaggagaaagaaccaaca

SEQ ID NO: 588634 - RNA, 18 nt, Human
agguaggcaacaaaagga

SEQ ID NO: 588635 - RNA, 23 nt, Human
agguaggcaacaaaaggaagaga

SEQ ID NO: 588636 - RNA, 18 nt, Human
aggucagggaggugggga

SEQ ID NO: 588637 - RNA, 19 nt, Human
agguguuauccugaagaag

SEQ ID NO: 588638 - RNA, 21 nt, Human
caaaaccacaggagucaggag

SEQ ID NO: 588639 - RNA, 20 nt, Human
caaaauaaauaugccaguuc

SEQ ID NO: 588640 - RNA, 19 nt, Human
caaagcuuaccugccuucc

SEQ ID NO: 588641 - RNA, 24 nt, Human
caauggggcagcagccugaagccc

SEQ ID NO: 588642 - RNA, 21 nt, Human
cacaguagcuguggcucacca

SEQ ID NO: 588643 - RNA, 21 nt, Human
caccucccugaccccugcgcu

SEQ ID NO: 588644 - RNA, 22 nt, Human
cacgcagacuccacugcccuag

SEQ ID NO: 588645 - RNA, 23 nt, Human
cacgcagacuccacugcccuaga

SEQ ID NO: 588646 - RNA, 21 nt, Human
cacggcaaccugggcagucug

SEQ ID NO: 588647 - RNA, 21 nt, Human
cagaccaagggaucaaagcua

SEQ ID NO: 588648 - RNA, 23 nt, Human
cagcagugucuccaccucccuga

SEQ ID NO: 588649 - RNA, 22 nt, Human
cagccagggagccccgcccccu

SEQ ID NO: 588650 - RNA, 21 nt, Human
caggagacacgcagacuccac

SEQ ID NO: 588651 - RNA, 24 nt, Human
ccaacagccacagugauugucaaa

SEQ ID NO: 588652 - RNA, 18 nt, Human
ccaagccggagcaguucu

SEQ ID NO: 588653 - RNA, 22 nt, Human
ccaaugcccugccccagcccca

SEQ ID NO: 588654 - RNA, 23 nt, Human
ccaauggggcagcagccugaagc

SEQ ID NO: 588655 - RNA, 20 nt, Human
ccagagaggaugauaugauc

SEQ ID NO: 588656 - RNA, 30 nt, Human
ccagcgccccaccugcuggaacagccaagg

SEQ ID NO: 588657 - RNA, 24 nt, Human
ccaggccagaagugguaaaagauu

SEQ ID NO: 588658 - RNA, 19 nt, Human
ccagggagccccgcccccu

SEQ ID NO: 588659 - RNA, 21 nt, Human
cccacccaccauccccagaga

SEQ ID NO: 588660 - RNA, 20 nt, Human
cccagaccaagggaucaaag

SEQ ID NO: 588661 - RNA, 21 nt, Human
cccagaccaagggaucaaagc

SEQ ID NO: 588662 - RNA, 27 nt, Human
cccaggagacacgcagacuccacugcc

SEQ ID NO: 588663 - RNA, 19 nt, Human
ccccaagucauugaguugg

SEQ ID NO: 588664 - RNA, 20 nt, Human
ccccacccaccauccccaga

SEQ ID NO: 588665 - RNA, 28 nt, Human
ccccaccugcuggaacagccaagccgga

SEQ ID NO: 588666 - RNA, 19 nt, Human
ccccagaauucaaaccacu

SEQ ID NO: 588667 - RNA, 18 nt, Human
cccccacccaccaucccc

SEQ ID NO: 588668 - RNA, 20 nt, Human
cccugcgcugcuuugcucug

SEQ ID NO: 588669 - RNA, 20 nt, Human
cccuggggcuggcucacugc

SEQ ID NO: 588670 - RNA, 19 nt, Human
ccuacacaaaggccccaga

SEQ ID NO: 588671 - RNA, 24 nt, Human
ccuacuccugcugggcccuagaag

SEQ ID NO: 588672 - RNA, 23 nt, Human
ccucccugaccccugcgcugcuu

SEQ ID NO: 588673 - RNA, 18 nt, Human
ccugagcugugccugggg

SEQ ID NO: 588674 - RNA, 22 nt, Human
ccugccccacccugcccaggaa

SEQ ID NO: 588675 - RNA, 18 nt, Human
ccugccuucccuccuccc

SEQ ID NO: 588676 - RNA, 18 nt, Human
ccuggcccccacuuccua

SEQ ID NO: 588677 - RNA, 24 nt, Human
cgccccaccugcuggaacagccaa

SEQ ID NO: 588678 - RNA, 21 nt, Human
cgggacacugaccggaagcca

SEQ ID NO: 588679 - RNA, 21 nt, Human
cucacugcauccugccccacc

SEQ ID NO: 588680 - RNA, 20 nt, Human
cuccaccucccugaccccug

SEQ ID NO: 588681 - RNA, 23 nt, Human
cuccaggauauugacacccccac

SEQ ID NO: 588682 - RNA, 21 nt, Human
cucccugaccccugcgcugcu

SEQ ID NO: 588683 - RNA, 24 nt, Human
cuccucuggcccuggggcuggcuc

SEQ ID NO: 588684 - RNA, 28 nt, Human
cucguccaaagcuuaccuggccuaaugg

SEQ ID NO: 588685 - RNA, 20 nt, Human
cugaccccugcgcugcuuug

SEQ ID NO: 588686 - RNA, 25 nt, Human
cugccccacccugcccaggaaggag

SEQ ID NO: 588687 - RNA, 18 nt, Human
cugcucuccuggccccca

SEQ ID NO: 588688 - RNA, 20 nt, Human
cuggggcuuucuguugccaa

SEQ ID NO: 588689 - RNA, 23 nt, Human
cuuaaaaaaaaaaaaagggggau

SEQ ID NO: 588690 - RNA, 24 nt, Human
gaaaaaacaggcucaagagugaag

SEQ ID NO: 588691 - RNA, 19 nt, Human
gagagagagagggcuaugc

SEQ ID NO: 588692 - RNA, 19 nt, Human
gcaaagauggggcuccaag

SEQ ID NO: 588693 - RNA, 20 nt, Human
gcagcagccugaagccccgc

SEQ ID NO: 588694 - RNA, 19 nt, Human
gcccaguacuggguggacu

SEQ ID NO: 588695 - RNA, 20 nt, Human
gccccaccugcuggaacagc

SEQ ID NO: 588696 - RNA, 18 nt, Human
gcccuggagagagagagg

SEQ ID NO: 588697 - RNA, 19 nt, Human
gcuggaacagccaagccgg

SEQ ID NO: 588698 - RNA, 23 nt, Human
ggaagccuggggaguaaucuucc

SEQ ID NO: 588699 - RNA, 18 nt, Human
ggcuuaaaaaaaaaaaaa

SEQ ID NO: 588700 - RNA, 22 nt, Human
gggagggagccagugacuggac

SEQ ID NO: 588701 - RNA, 23 nt, Human
ggggaagaaaugccuccuuuagg

SEQ ID NO: 588702 - RNA, 21 nt, Human
ggggcaagggaagccugggga

SEQ ID NO: 588703 - RNA, 21 nt, Human
gggggguggggaaggccacgg

SEQ ID NO: 588704 - RNA, 19 nt, Human
gggguggggaaggccacgg

SEQ ID NO: 588705 - RNA, 25 nt, Human
guggggaagaaaugccuccuuuagg

SEQ ID NO: 588706 - RNA, 25 nt, Human
guugucaccucccgcacaguguccu

SEQ ID NO: 588707 - RNA, 22 nt, Human
uaaacaaugggcuuaaaaaaaa

SEQ ID NO: 588708 - RNA, 19 nt, Human
uaaagugccauuagcaaaa

SEQ ID NO: 588709 - RNA, 21 nt, Human
uaacagaugaccccaacuccu

SEQ ID NO: 588710 - RNA, 24 nt, Human
uaacugccaaugcccugccccagc

SEQ ID NO: 588711 - RNA, 27 nt, Human
uaauaaauaaauaaaggucaggcacaa

SEQ ID NO: 588712 - RNA, 18 nt, Human
uacaacccuaugagguag

SEQ ID NO: 588713 - RNA, 24 nt, Human
uacacaaaggccccagaauucaaa

SEQ ID NO: 588714 - RNA, 20 nt, Human
uaccggccacaccggaagcc

SEQ ID NO: 588715 - RNA, 25 nt, Human
uagcaaaaccacaggagucaggaga

SEQ ID NO: 588716 - RNA, 18 nt, Human
ucacaguagcuguggcuc

SEQ ID NO: 588717 - RNA, 24 nt, Human
ucauugaguugggguaagggagcu

SEQ ID NO: 588718 - RNA, 18 nt, Human
ucccuccucccugagcug

SEQ ID NO: 588719 - RNA, 20 nt, Human
uccgugaaccuugcugcugu

SEQ ID NO: 588720 - RNA, 19 nt, Human
uccucuggcccuggggcug

SEQ ID NO: 588721 - RNA, 23 nt, Human
uccugccccacccugcccaggaa

SEQ ID NO: 588722 - RNA, 23 nt, Human
ucucaaagaauaaacaaugggcu

SEQ ID NO: 588723 - RNA, 23 nt, Human
ucuccaccucccugaccccugcg

SEQ ID NO: 588724 - RNA, 20 nt, Human
ucugaacccaaaugagugga

SEQ ID NO: 588725 - RNA, 23 nt, Human
ugagguaggccguaccacuaucc

SEQ ID NO: 588726 - RNA, 21 nt, Human
ugaguugggguaagggagcuc

SEQ ID NO: 588727 - RNA, 24 nt, Human
ugcaagcaaagauggggcuccaag

SEQ ID NO: 588728 - RNA, 23 nt, Human
ugccaaugcccugccccagcccc

SEQ ID NO: 588729 - RNA, 20 nt, Human
ugccuggggcuuucuguugc

SEQ ID NO: 588730 - RNA, 19 nt, Human
ugcguaacugccaaugccc

SEQ ID NO: 588731 - RNA, 20 nt, Human
ugcuggaacagccaagccgg

SEQ ID NO: 588732 - RNA, 21 nt, Human
uggaacagccaagccggagca

SEQ ID NO: 588733 - RNA, 20 nt, Human
uggagccaggccagaagugg

SEQ ID NO: 588734 - RNA, 20 nt, Human
ugggcuuaaaaaaaaaaaaa

SEQ ID NO: 588735 - RNA, 18 nt, Human
uggggcuccaaggucugu

SEQ ID NO: 588736 - RNA, 20 nt, Human
ugggggguggggaaggccac

SEQ ID NO: 588737 - RNA, 24 nt, Human
ugguccaccugacaucuccaugga

SEQ ID NO: 588738 - RNA, 24 nt, Human
ugucaaagagcugagggggcauca

SEQ ID NO: 588739 - RNA, 25 nt, Human
ugucaaagagcugagggggcaucag

SEQ ID NO: 588740 - RNA, 19 nt, Human
ugugcagagggugucaagg

SEQ ID NO: 588741 - RNA, 22 nt, Human
ugugccaagcacuucacauuua

SEQ ID NO: 588742 - RNA, 22 nt, Human
uguugccaagaaauguuaagga

SEQ ID NO: 588743 - RNA, 23 nt, Human
uuagaaauaggagaaaacccaac

SEQ ID NO: 588744 - RNA, 21 nt, Human
uucauuagcacagcaugauga

SEQ ID NO: 588745 - RNA, 23 nt, Human
uuccacuguagccuagcagggag

SEQ ID NO: 588746 - RNA, 23 nt, Human
uucucguccaaagcuuaccugcc

SEQ ID NO: 588747 - RNA, 22 nt, Human
uuucauuagcacagcaugauga

SEQ ID NO: 588748 - RNA, 23 nt, Human
uuuuuuuuuuuuuuuuuuucacg

SEQ ID NO: 588749 - RNA, 20 nt, Human
acacuuguaugguuucucuu

SEQ ID NO: 588750 - RNA, 19 nt, Human
acugugccugggaggaguu

SEQ ID NO: 588751 - RNA, 21 nt, Human
aggcagaacugaccuuaagcu

SEQ ID NO: 588752 - RNA, 20 nt, Human
aggucuccgaaauggcagga

SEQ ID NO: 588753 - RNA, 24 nt, Human
aucaggauguggaugaguguggcu

SEQ ID NO: 588754 - RNA, 20 nt, Human
caguaugaauucucuuaugu

SEQ ID NO: 588755 - RNA, 22 nt, Human
caugucuacuaaggguugagga

SEQ ID NO: 588756 - RNA, 20 nt, Human
cuaauucuucugccacacac

SEQ ID NO: 588757 - RNA, 24 nt, Human
cuacauggcuguaaaugggccacu

SEQ ID NO: 588758 - RNA, 20 nt, Human
cugggucugcacuauagucc

SEQ ID NO: 588759 - RNA, 27 nt, Human
gcauauggugggccuuggcgguuagcc

SEQ ID NO: 588760 - RNA, 20 nt, Human
ggcagaacugaccuuaagcu

SEQ ID NO: 588761 - RNA, 18 nt, Human
ggccugccuacauggcug

SEQ ID NO: 588762 - RNA, 23 nt, Human
gggccacuuccuccaggucuccg

SEQ ID NO: 588763 - RNA, 22 nt, Human
uaaacugauguuagaagguaaa

SEQ ID NO: 588764 - RNA, 18 nt, Human
uaaguucagaacucucag

SEQ ID NO: 588765 - RNA, 23 nt, Human
uagaaccagacaaugggcauaau

SEQ ID NO: 588766 - RNA, 18 nt, Human
uagcuggcuuguuagagg

SEQ ID NO: 588767 - RNA, 21 nt, Human
uccaggucuccgaaauggcag

SEQ ID NO: 588768 - RNA, 23 nt, Human
uccuccaggucuccgaaauggca

SEQ ID NO: 588769 - RNA, 21 nt, Human
ucucuuauguguaguaaggau

SEQ ID NO: 588770 - RNA, 19 nt, Human
ucugcaggccugccuacau

SEQ ID NO: 588771 - RNA, 19 nt, Human
ugaaugaacucaugucuac

SEQ ID NO: 588772 - RNA, 21 nt, Human
ugaauuuguagugaugagggg

SEQ ID NO: 588773 - RNA, 21 nt, Human
ugaauuuguagugaugagggg

SEQ ID NO: 588774 - RNA, 23 nt, Human
ugacuaauucuucugccacacac

SEQ ID NO: 588775 - RNA, 21 nt, Human
ugaugagggguuuuagcuugg

SEQ ID NO: 588776 - RNA, 22 nt, Human
ugccacauucuucacaaacgua

SEQ ID NO: 588777 - RNA, 21 nt, Human
uggcuuguuagaggggguugg

SEQ ID NO: 588778 - RNA, 18 nt, Human
ugggaggaguuugggaug

SEQ ID NO: 588779 - RNA, 19 nt, Human
uguauaguaaggugugagg

SEQ ID NO: 588780 - RNA, 24 nt, Human
uguguaguaaggauacgggaguac

SEQ ID NO: 588781 - RNA, 19 nt, Human
uuaaaauagaaccagacaa

SEQ ID NO: 588782 - RNA, 24 nt, Human
uuccuccaggucuccgaaauggca

SEQ ID NO: 588783 - RNA, 20 nt, Human
uuggcagucaggucugcaua

SEQ ID NO: 588784 - RNA, 19 nt, Human
aaaaaaacccacccauuuu

SEQ ID NO: 588785 - RNA, 18 nt, Human
aaaacgccauuaaguuug

SEQ ID NO: 588786 - RNA, 21 nt, Human
aaaaugguucuuguauugcca

SEQ ID NO: 588787 - RNA, 20 nt, Human
aaagcaaaugaaauugaagc

SEQ ID NO: 588788 - RNA, 18 nt, Human
aaaugugaacagaaaggu

SEQ ID NO: 588789 - RNA, 21 nt, Human
aagaaggaaguaacuccaaga

SEQ ID NO: 588790 - RNA, 23 nt, Human
aaugguucuuguauugccagaag

SEQ ID NO: 588791 - RNA, 18 nt, Human
accaggaaaaaacuccaa

SEQ ID NO: 588792 - RNA, 23 nt, Human
acuauaagguguaacacuggacc

SEQ ID NO: 588793 - RNA, 24 nt, Human
agagccucuccgggcggcgggaga

SEQ ID NO: 588794 - RNA, 18 nt, Human
aggccagacauucauucu

SEQ ID NO: 588795 - RNA, 22 nt, Human
agguuacacuguaacuaccccc

SEQ ID NO: 588796 - RNA, 20 nt, Human
aguacgugaccucuugugcu

SEQ ID NO: 588797 - RNA, 19 nt, Human
agugaguccucccuuaguu

SEQ ID NO: 588798 - RNA, 21 nt, Human
auaacugcuuaaaaaaaaccc

SEQ ID NO: 588799 - RNA, 23 nt, Human
auaagguguaacacuggaccgaa

SEQ ID NO: 588800 - RNA, 21 nt, Human
auuuuuguuucauuuugaaaa

SEQ ID NO: 588801 - RNA, 21 nt, Human
caaagcaaguaaaagaaagua

SEQ ID NO: 588802 - RNA, 26 nt, Human
caaagccugccucaguuuaaaaauca

SEQ ID NO: 588803 - RNA, 19 nt, Human
caagagauuauuucaugaa

SEQ ID NO: 588804 - RNA, 18 nt, Human
caccauacaagacuaggc

SEQ ID NO: 588805 - RNA, 26 nt, Human
caccuucagucaaagaaagccagagg

SEQ ID NO: 588806 - RNA, 19 nt, Human
cagaaacccucuugcuggc

SEQ ID NO: 588807 - RNA, 18 nt, Human
caggggcugcugcugcug

SEQ ID NO: 588808 - RNA, 21 nt, Human
caguaccgcuaaauuuguaua

SEQ ID NO: 588809 - RNA, 22 nt, Human
cauccuucagaagaaucaaagc

SEQ ID NO: 588810 - RNA, 25 nt, Human
cauuuugaaaaaacaaaaacaucag

SEQ ID NO: 588811 - RNA, 21 nt, Human
ccaagauccugaaaaugguuc

SEQ ID NO: 588812 - RNA, 21 nt, Human
cccacucagauucuauuucca

SEQ ID NO: 588813 - RNA, 21 nt, Human
ccccaguggggcuuauuacuu

SEQ ID NO: 588814 - RNA, 21 nt, Human
ccccgccgucuuuguccuccu

SEQ ID NO: 588815 - RNA, 20 nt, Human
ccgccgucuuuguccuccuc

SEQ ID NO: 588816 - RNA, 19 nt, Human
ccuauaaacaccuucaguc

SEQ ID NO: 588817 - RNA, 20 nt, Human
ccuccucugagcccccgcug

SEQ ID NO: 588818 - RNA, 28 nt, Human
ccucuccgggcggcgggagagcaggggc

SEQ ID NO: 588819 - RNA, 24 nt, Human
ccucugagcccccgcugguggcga

SEQ ID NO: 588820 - RNA, 23 nt, Human
ccuggggcuggggcuggggcugc

SEQ ID NO: 588821 - RNA, 18 nt, Human
cgccaagggggagcggcg

SEQ ID NO: 588822 - RNA, 23 nt, Human
cgggaccgggugccuuuggcgcc

SEQ ID NO: 588823 - RNA, 22 nt, Human
cugcugcugcugcugggccugg

SEQ ID NO: 588824 - RNA, 18 nt, Human
cugcugcugcugggccug

SEQ ID NO: 588825 - RNA, 20 nt, Human
cugggccuggggcuggggcu

SEQ ID NO: 588826 - RNA, 19 nt, Human
cuggggcugcuggggcuug

SEQ ID NO: 588827 - RNA, 22 nt, Human
cuggggcuggggcugcuggggc

SEQ ID NO: 588828 - RNA, 23 nt, Human
cuguguggucugcagccagaggu

SEQ ID NO: 588829 - RNA, 28 nt, Human
cuuccuauaaacaccuucagucaaagaa

SEQ ID NO: 588830 - RNA, 19 nt, Human
cuuuguccuccuccucuga

SEQ ID NO: 588831 - RNA, 18 nt, Human
gaagccgcucuuguugac

SEQ ID NO: 588832 - RNA, 19 nt, Human
gacuaccagacuucacuga

SEQ ID NO: 588833 - RNA, 24 nt, Human
gaugcacugagacugaaauaacau

SEQ ID NO: 588834 - RNA, 21 nt, Human
gaugcuggguaaagugcagag

SEQ ID NO: 588835 - RNA, 20 nt, Human
gcagagagaagcaccacaga

SEQ ID NO: 588836 - RNA, 23 nt, Human
gcaggggcugcugcugcugcugc

SEQ ID NO: 588837 - RNA, 21 nt, Human
gccagacauucauucugugcu

SEQ ID NO: 588838 - RNA, 22 nt, Human
gccuuuggcgccaagggggagc

SEQ ID NO: 588839 - RNA, 20 nt, Human
gcugcugcugcugcugcugg

SEQ ID NO: 588840 - RNA, 20 nt, Human
gcugcuggggcuugcugggg

SEQ ID NO: 588841 - RNA, 20 nt, Human
gcuuucuguuauugcugaaa

SEQ ID NO: 588842 - RNA, 23 nt, Human
ggaaaaaacuccaaacuugugga

SEQ ID NO: 588843 - RNA, 26 nt, Human
ggacugaauuacacuauaagguguaa

SEQ ID NO: 588844 - RNA, 20 nt, Human
ggaggcucccugcuuaccgg

SEQ ID NO: 588845 - RNA, 23 nt, Human
ggccuggggcuggggcuggggcu

SEQ ID NO: 588846 - RNA, 23 nt, Human
gggagagcaggggcugcugcugc

SEQ ID NO: 588847 - RNA, 25 nt, Human
gggcugcuggggcuugcuggggccg

SEQ ID NO: 588848 - RNA, 25 nt, Human
ggggagcggcggcgggagcuccgcg

SEQ ID NO: 588849 - RNA, 19 nt, Human
ggggcuggggcugcugggg

SEQ ID NO: 588850 - RNA, 20 nt, Human
ggggcuggggcugcuggggc

SEQ ID NO: 588851 - RNA, 26 nt, Human
gugaauccuuaaaaauaaaauucaca

SEQ ID NO: 588852 - RNA, 22 nt, Human
gugcagagagaagcaccacaga

SEQ ID NO: 588853 - RNA, 22 nt, Human
guucaagagauuauuucaugaa

SEQ ID NO: 588854 - RNA, 18 nt, Human
uaaaaaucagaugaaaug

SEQ ID NO: 588855 - RNA, 28 nt, Human
uaaaaugucaugaaaugguaccuaaaaa

SEQ ID NO: 588856 - RNA, 22 nt, Human
uaaagugcagagagaagcacca

SEQ ID NO: 588857 - RNA, 27 nt, Human
uaagaaggaaguaacuccaagauccug

SEQ ID NO: 588858 - RNA, 18 nt, Human
uaccuuaaaucuccucac

SEQ ID NO: 588859 - RNA, 24 nt, Human
uacuucagccuuuucauggugccu

SEQ ID NO: 588860 - RNA, 21 nt, Human
uaggguuguccuguguggucu

SEQ ID NO: 588861 - RNA, 25 nt, Human
uagugacagaacauagacuagcuuc

SEQ ID NO: 588862 - RNA, 21 nt, Human
uauugccagaagaauuucagu

SEQ ID NO: 588863 - RNA, 19 nt, Human
ucaaagcaaguaaaagaaa

SEQ ID NO: 588864 - RNA, 19 nt, Human
ucagaacacaucuuuaaca

SEQ ID NO: 588865 - RNA, 22 nt, Human
ucagucaaagaaagccagagga

SEQ ID NO: 588866 - RNA, 23 nt, Human
ucagucaaagaaagccagaggag

SEQ ID NO: 588867 - RNA, 19 nt, Human
uccgcggaggcucccugcu

SEQ ID NO: 588868 - RNA, 19 nt, Human
uccgcggaggcucccugcu

SEQ ID NO: 588869 - RNA, 19 nt, Human
ugaaaaaacaaaaacauca

SEQ ID NO: 588870 - RNA, 20 nt, Human
ugaaaaaacaaaaacaucag

SEQ ID NO: 588871 - RNA, 26 nt, Human
ugaaauaacaucuguugacuaccaga

SEQ ID NO: 588872 - RNA, 22 nt, Human
ugaaaucggccgucugcucucc

SEQ ID NO: 588873 - RNA, 23 nt, Human
ugaaaugugaacagaaagguuuu

SEQ ID NO: 588874 - RNA, 22 nt, Human
ugaggcauaauguucaaagcaa

SEQ ID NO: 588875 - RNA, 21 nt, Human
ugagguaauaacugcuuaaaa

SEQ ID NO: 588876 - RNA, 18 nt, Human
ugaucacuccuggucucu

SEQ ID NO: 588877 - RNA, 21 nt, Human
ugcugcugcugcugggccugg

SEQ ID NO: 588878 - RNA, 18 nt, Human
ugcugcugcugggccugg

SEQ ID NO: 588879 - RNA, 20 nt, Human
ugcuggggcuugcuggggcc

SEQ ID NO: 588880 - RNA, 19 nt, Human
uggggcugcuggggcuugc

SEQ ID NO: 588881 - RNA, 20 nt, Human
uggggcugcuggggcuugcu

SEQ ID NO: 588882 - RNA, 24 nt, Human
ugguucugaagaccugcugaucac

SEQ ID NO: 588883 - RNA, 20 nt, Human
uguccuccuccucugagccc

SEQ ID NO: 588884 - RNA, 25 nt, Human
uguggucugcagccagagguuacac

SEQ ID NO: 588885 - RNA, 20 nt, Human
uuaaaucuccucacgugugu

SEQ ID NO: 588886 - RNA, 26 nt, Human
uuaagaaagauuaagaaggaaguaac

SEQ ID NO: 588887 - RNA, 22 nt, Human
uuacaccauacaagacuaggcu

SEQ ID NO: 588888 - RNA, 20 nt, Human
uugacuaccagacuucacug

SEQ ID NO: 588889 - RNA, 19 nt, Human
uugcuggggccgucgccuc

SEQ ID NO: 588890 - RNA, 25 nt, Human
uuggucuuaauauaagacaucagaa

SEQ ID NO: 588891 - RNA, 18 nt, Human
uuuguuagagucugcaaa

SEQ ID NO: 588892 - RNA, 18 nt, Human
uuuuugguucugaagacc

SEQ ID NO: 588893 - RNA, 24 nt, Human
uuuuugguucugaagaccugcuga

SEQ ID NO: 588894 - RNA, 21 nt, Human
aaaggcagggagguggcaaag

SEQ ID NO: 588895 - RNA, 18 nt, Human
aaccccucccugaaccca

SEQ ID NO: 588896 - RNA, 19 nt, Human
aaccccucccugaacccac

SEQ ID NO: 588897 - RNA, 21 nt, Human
acagagcagacagaaaccccg

SEQ ID NO: 588898 - RNA, 21 nt, Human
accagagaaggcacaccagac

SEQ ID NO: 588899 - RNA, 18 nt, Human
accaggggccaacugaaa

SEQ ID NO: 588900 - RNA, 23 nt, Human
acccaccacuccugagaacagca

SEQ ID NO: 588901 - RNA, 22 nt, Human
accccaucuguggccucuccag

SEQ ID NO: 588902 - RNA, 20 nt, Human
agacaagugccagcggcccc

SEQ ID NO: 588903 - RNA, 18 nt, Human
agccaaccaggggccaac

SEQ ID NO: 588904 - RNA, 21 nt, Human
agccaccagagaaggcacacc

SEQ ID NO: 588905 - RNA, 23 nt, Human
agccauggcacgugccgucccug

SEQ ID NO: 588906 - RNA, 23 nt, Human
agcugugagugcacagcaggcac

SEQ ID NO: 588907 - RNA, 20 nt, Human
aggcagggagguggcaaagg

SEQ ID NO: 588908 - RNA, 26 nt, Human
aggcagggagguggcaaaggggaccc

SEQ ID NO: 588909 - RNA, 23 nt, Human
agguggcaaaggccagcccaacc

SEQ ID NO: 588910 - RNA, 18 nt, Human
agucuccacaaacugugg

SEQ ID NO: 588911 - RNA, 19 nt, Human
caaaggccagcccaaccca

SEQ ID NO: 588912 - RNA, 20 nt, Human
caaaggccagcccaacccag

SEQ ID NO: 588913 - RNA, 21 nt, Human
cacaggcccugcaaaggcagg

SEQ ID NO: 588914 - RNA, 18 nt, Human
cacagucccucaggccca

SEQ ID NO: 588915 - RNA, 21 nt, Human
cagacacagacuccugucagc

SEQ ID NO: 588916 - RNA, 21 nt, Human
cagacagaaaccccggcccuu

SEQ ID NO: 588917 - RNA, 25 nt, Human
cagcacugcuccaaccccucccuga

SEQ ID NO: 588918 - RNA, 19 nt, Human
cagcccaacccagcccucc

SEQ ID NO: 588919 - RNA, 22 nt, Human
cagcccaucaccuggaggugau

SEQ ID NO: 588920 - RNA, 19 nt, Human
cagguccuggcaccaucuc

SEQ ID NO: 588921 - RNA, 22 nt, Human
cagugugaagaggggcugggga

SEQ ID NO: 588922 - RNA, 24 nt, Human
caucccccaccacaggccuccgcu

SEQ ID NO: 588923 - RNA, 24 nt, Human
caucuguggccucuccagccgucc

SEQ ID NO: 588924 - RNA, 22 nt, Human
ccaaaagagccagguccuggca

SEQ ID NO: 588925 - RNA, 24 nt, Human
ccaaccccagcccugccuggaggc

SEQ ID NO: 588926 - RNA, 23 nt, Human
ccagcacugcuccaaccccuccc

SEQ ID NO: 588927 - RNA, 19 nt, Human
ccaggcaguggccaugaac

SEQ ID NO: 588928 - RNA, 23 nt, Human
ccaucuguggccucuccagccgu

SEQ ID NO: 588929 - RNA, 19 nt, Human
ccauggcacgugccguccc

SEQ ID NO: 588930 - RNA, 23 nt, Human
cccagcaggccugcugcagguca

SEQ ID NO: 588931 - RNA, 20 nt, Human
cccaggucacagggagggcg

SEQ ID NO: 588932 - RNA, 22 nt, Human
ccccaggucacagggagggcgg

SEQ ID NO: 588933 - RNA, 25 nt, Human
cccccaccacaggccuccgcugcuc

SEQ ID NO: 588934 - RNA, 23 nt, Human
cccugccuggaggcccuggugag

SEQ ID NO: 588935 - RNA, 21 nt, Human
ccgagcucccagcaggccugc

SEQ ID NO: 588936 - RNA, 21 nt, Human
ccggcccuucuugggggcuuc

SEQ ID NO: 588937 - RNA, 21 nt, Human
ccguccacaggcccugcaaag

SEQ ID NO: 588938 - RNA, 23 nt, Human
ccuccacucuggguacccagagg

SEQ ID NO: 588939 - RNA, 20 nt, Human
ccuggaggcccuggugagcu

SEQ ID NO: 588940 - RNA, 20 nt, Human
cgacaggggugggccccagg

SEQ ID NO: 588941 - RNA, 18 nt, Human
cgcugcucacugcugugc

SEQ ID NO: 588942 - RNA, 22 nt, Human
cgggcaggcaauguacauagcc

SEQ ID NO: 588943 - RNA, 23 nt, Human
cgggcaggcaauguacauagcca

SEQ ID NO: 588944 - RNA, 23 nt, Human
cuccaaccccucccugaacccac

SEQ ID NO: 588945 - RNA, 19 nt, Human
cucccagcaggccugcugc

SEQ ID NO: 588946 - RNA, 25 nt, Human
cucccugaacccacagggcagagcc

SEQ ID NO: 588947 - RNA, 26 nt, Human
gagcccgcccacaccuccaucauacc

SEQ ID NO: 588948 - RNA, 24 nt, Human
gcaggucagaagggccacauccca

SEQ ID NO: 588949 - RNA, 19 nt, Human
gccuggggcauccucugca

SEQ ID NO: 588950 - RNA, 21 nt, Human
gccuugaucggccuggacgag

SEQ ID NO: 588951 - RNA, 21 nt, Human
gcuccaaccccucccugaacc

SEQ ID NO: 588952 - RNA, 21 nt, Human
ggaugccuccuccccugcugg

SEQ ID NO: 588953 - RNA, 21 nt, Human
ggcaaaggccagcccaaccca

SEQ ID NO: 588954 - RNA, 20 nt, Human
ggcacgugccgucccugugg

SEQ ID NO: 588955 - RNA, 18 nt, Human
gggcauccucugcaagag

SEQ ID NO: 588956 - RNA, 20 nt, Human
gggcugggagagugccaguc

SEQ ID NO: 588957 - RNA, 20 nt, Human
gggcuggggacccaccacuc

SEQ ID NO: 588958 - RNA, 18 nt, Human
uaagaggagccaccagag

SEQ ID NO: 588959 - RNA, 18 nt, Human
uacccagaggaaggcgca

SEQ ID NO: 588960 - RNA, 18 nt, Human
uagaggguucaggccugg

SEQ ID NO: 588961 - RNA, 24 nt, Human
uagccauggcacgugccgucccug

SEQ ID NO: 588962 - RNA, 23 nt, Human
uccacagcccaucaccuggaggu

SEQ ID NO: 588963 - RNA, 24 nt, Human
ucccacgagaguccaucccccacc

SEQ ID NO: 588964 - RNA, 20 nt, Human
ucccccaccacaggccuccg

SEQ ID NO: 588965 - RNA, 22 nt, Human
ucccucaggcccaggugaggau

SEQ ID NO: 588966 - RNA, 18 nt, Human
uccgcugcucacugcugu

SEQ ID NO: 588967 - RNA, 21 nt, Human
uccucugcaagaggaucccac

SEQ ID NO: 588968 - RNA, 22 nt, Human
uccuggcaccaucuccgagcuc

SEQ ID NO: 588969 - RNA, 22 nt, Human
ucuccacaaacuguggauccac

SEQ ID NO: 588970 - RNA, 22 nt, Human
ucuccagccguccacaggcccu

SEQ ID NO: 588971 - RNA, 18 nt, Human
ucuugggucccugaccuc

SEQ ID NO: 588972 - RNA, 21 nt, Human
ugaaaaaaugcuggacucucg

SEQ ID NO: 588973 - RNA, 22 nt, Human
ugaacccacagggcagagccag

SEQ ID NO: 588974 - RNA, 20 nt, Human
ugcaaaggcagggagguggc

SEQ ID NO: 588975 - RNA, 18 nt, Human
ugcaagcacuucacauga

SEQ ID NO: 588976 - RNA, 22 nt, Human
ugcuggacucucggucaaggac

SEQ ID NO: 588977 - RNA, 21 nt, Human
uggaggcccuggugagcuugc

SEQ ID NO: 588978 - RNA, 22 nt, Human
ugggaagacccagcugugagug

SEQ ID NO: 588979 - RNA, 23 nt, Human
ugggccccaggucacaggacccu

SEQ ID NO: 588980 - RNA, 23 nt, Human
uggggacccaccacuccugagaa

SEQ ID NO: 588981 - RNA, 19 nt, Human
uggguacccagaggaaggc

SEQ ID NO: 588982 - RNA, 24 nt, Human
ugggucccugaccucauugggccu

SEQ ID NO: 588983 - RNA, 23 nt, Human
ugucagcucaggcguccuggccu

SEQ ID NO: 588984 - RNA, 26 nt, Human
aaucaaaaacacaaaguccaaggauc

SEQ ID NO: 588985 - RNA, 22 nt, Human
acacaaaguccaaggauccucc

SEQ ID NO: 588986 - RNA, 21 nt, Human
agaauaucaacauacaaucaa

SEQ ID NO: 588987 - RNA, 18 nt, Human
caacauacaaucaaaaac

SEQ ID NO: 588988 - RNA, 21 nt, Human
ucaaaaacacaaaguccaagg

SEQ ID NO: 588989 - RNA, 18 nt, Human
aaaaacaaaagacauuca

SEQ ID NO: 588990 - RNA, 21 nt, Human
aaaaacaaaagacauucaaaa

SEQ ID NO: 588991 - RNA, 24 nt, Human
aaacaaaaacaaaagacauucaaa

SEQ ID NO: 588992 - RNA, 26 nt, Human
aaacaaaacaaaaacaaaagacauuc

SEQ ID NO: 588993 - RNA, 26 nt, Human
acaaaacaaaaacaaaagacauucaa

SEQ ID NO: 588994 - RNA, 27 nt, Human
acaaaacaaaaacaaaagacauucaaa

SEQ ID NO: 588995 - RNA, 30 nt, Human
caaaaacaaaagacauucaaaauuccccuu

SEQ ID NO: 588996 - RNA, 23 nt, Human
caaaacaaaaacaaaagacauuc

SEQ ID NO: 588997 - RNA, 23 nt, Human
caaaacaaaacaaaaacaaaaga

SEQ ID NO: 588998 - RNA, 22 nt, Human
caaaagacauucaaaauucccc

SEQ ID NO: 588999 - RNA, 19 nt, Human
cucugugccgcgccgcucc

SEQ ID NO: 589000 - RNA, 18 nt, Human
gaacacuugcaccaggga

SEQ ID NO: 589001 - RNA, 23 nt, Human
gggggugggcuguugcccuggca

SEQ ID NO: 589002 - RNA, 25 nt, Human
ucaaaacaaaacaaaaacaaaagac

SEQ ID NO: 589003 - RNA, 28 nt, Human
ucaaaauuccccugugguggacaacuga

SEQ ID NO: 589004 - RNA, 22 nt, Human
ucccagguugucucagggagca

SEQ ID NO: 589005 - RNA, 23 nt, Human
ugaguugauguggcugauccagg

SEQ ID NO: 589006 - RNA, 23 nt, Human
uggaugaacacuugcaccaggga

SEQ ID NO: 589007 - RNA, 20 nt, Human
uguugcccuggcacggcugg

SEQ ID NO: 589008 - RNA, 25 nt, Human
uucaaaacaaaacaaaaacaaaaga

SEQ ID NO: 589009 - RNA, 18 nt, Human
uucaaaauuccccugugg

SEQ ID NO: 589010 - RNA, 26 nt, Human
aaaaaaaaaaaaaaaggccccuggga

SEQ ID NO: 589011 - RNA, 18 nt, Human
aaaaaaaaaaaaaaggcc

SEQ ID NO: 589012 - RNA, 19 nt, Human
aaaaaaaggccccugggaa

SEQ ID NO: 589013 - RNA, 20 nt, Human
aaaaaggccccugggaauca

SEQ ID NO: 589014 - RNA, 24 nt, Human
aaacaaacaaagucccgcggagca

SEQ ID NO: 589015 - RNA, 21 nt, Human
aaagagggcuuucuccauguu

SEQ ID NO: 589016 - RNA, 22 nt, Human
aacaaagagggacgaggaggaa

SEQ ID NO: 589017 - RNA, 24 nt, Human
aagaaggcuucaggaggcaggaag

SEQ ID NO: 589018 - RNA, 21 nt, Human
acaaacaaagucccgcggagc

SEQ ID NO: 589019 - RNA, 18 nt, Human
acacccccauccccacac

SEQ ID NO: 589020 - RNA, 20 nt, Human
acccccauccccacaccccc

SEQ ID NO: 589021 - RNA, 25 nt, Human
acccccauccccacaccccuuuuga

SEQ ID NO: 589022 - RNA, 26 nt, Human
acggagcgcacgcgccaagggccccc

SEQ ID NO: 589023 - RNA, 18 nt, Human
agaagcccaguccuagac

SEQ ID NO: 589024 - RNA, 24 nt, Human
agacauccaugaggcaagaggucu

SEQ ID NO: 589025 - RNA, 22 nt, Human
agcauggaguagcagggaagaa

SEQ ID NO: 589026 - RNA, 19 nt, Human
agcccaguccuagaccacc

SEQ ID NO: 589027 - RNA, 26 nt, Human
agcggcgugaggggccgcaggcgggg

SEQ ID NO: 589028 - RNA, 21 nt, Human
aggaagagacugaauggauag

SEQ ID NO: 589029 - RNA, 22 nt, Human
aggaagcuccgagauuaacuga

SEQ ID NO: 589030 - RNA, 18 nt, Human
aggcaggaagugggggca

SEQ ID NO: 589031 - RNA, 18 nt, Human
agggaagguuguagagag

SEQ ID NO: 589032 - RNA, 21 nt, Human
agggcggggugggagcacuag

SEQ ID NO: 589033 - RNA, 18 nt, Human
auagaacuagcccuccuc

SEQ ID NO: 589034 - RNA, 21 nt, Human
aucaaaaaaaaaaaaaaaaaa

SEQ ID NO: 589035 - RNA, 22 nt, Human
aucaaaaaaaaaaaaaaaaaaa

SEQ ID NO: 589036 - RNA, 18 nt, Human
caaggcagcucauccucc

SEQ ID NO: 589037 - RNA, 20 nt, Human
cacccccauccccacacccc

SEQ ID NO: 589038 - RNA, 23 nt, Human
cagaaaauccccacccccuucca

SEQ ID NO: 589039 - RNA, 19 nt, Human
cagagccucccucgccucc

SEQ ID NO: 589040 - RNA, 22 nt, Human
cagccuuuguuuccauaggucc

SEQ ID NO: 589041 - RNA, 22 nt, Human
caguccuagaccacccuucuca

SEQ ID NO: 589042 - RNA, 24 nt, Human
cauacagagccucccucgccuccc

SEQ ID NO: 589043 - RNA, 20 nt, Human
ccacaaaccucaacauggaa

SEQ ID NO: 589044 - RNA, 21 nt, Human
ccacaccccuuuugaucaaaa

SEQ ID NO: 589045 - RNA, 23 nt, Human
cccaacaaagagggacgaggagg

SEQ ID NO: 589046 - RNA, 18 nt, Human
ccccacccccuuccauuc

SEQ ID NO: 589047 - RNA, 20 nt, Human
ccguagacacccccaucccc

SEQ ID NO: 589048 - RNA, 25 nt, Human
ccucacccacuccagggaggaacag

SEQ ID NO: 589049 - RNA, 18 nt, Human
ccuggcaggggaagggcc

SEQ ID NO: 589050 - RNA, 19 nt, Human
ccuuccuucccuucuaacc

SEQ ID NO: 589051 - RNA, 19 nt, Human
cgcaggcggggucggggca

SEQ ID NO: 589052 - RNA, 24 nt, Human
cgcccugcuggagaagccgaacuc

SEQ ID NO: 589053 - RNA, 21 nt, Human
cgcggagcacagccgcacgga

SEQ ID NO: 589054 - RNA, 22 nt, Human
cgggcugggggaauguggggcc

SEQ ID NO: 589055 - RNA, 21 nt, Human
cgucucaucccuucuggguca

SEQ ID NO: 589056 - RNA, 21 nt, Human
cucccucgccucccguggagg

SEQ ID NO: 589057 - RNA, 20 nt, Human
cugaggaagagacugaaugg

SEQ ID NO: 589058 - RNA, 22 nt, Human
cugcagccgcccugcuggagaa

SEQ ID NO: 589059 - RNA, 26 nt, Human
cuggagauuucguaucuaaagccuga

SEQ ID NO: 589060 - RNA, 22 nt, Human
cuucccuucuaaccuuacuccg

SEQ ID NO: 589061 - RNA, 18 nt, Human
cuuccuucccuucuaacc

SEQ ID NO: 589062 - RNA, 18 nt, Human
cuuuaugucccugcucuu

SEQ ID NO: 589063 - RNA, 19 nt, Human
cuuuaugucccugcucuuc

SEQ ID NO: 589064 - RNA, 24 nt, Human
gaaucaauuuaaguauagaacuag

SEQ ID NO: 589065 - RNA, 24 nt, Human
gagauuucguaucuaaagccugag

SEQ ID NO: 589066 - RNA, 23 nt, Human
gagcacagccgcacggagcgcac

SEQ ID NO: 589067 - RNA, 26 nt, Human
gcagcucauccuccuaaugggagccu

SEQ ID NO: 589068 - RNA, 21 nt, Human
gcggagcacagccgcacggag

SEQ ID NO: 589069 - RNA, 18 nt, Human
ggcacaucuggcacuggu

SEQ ID NO: 589070 - RNA, 26 nt, Human
ggcggcagaagcccucggccggggga

SEQ ID NO: 589071 - RNA, 18 nt, Human
ggcuuugacgaggcuggu

SEQ ID NO: 589072 - RNA, 21 nt, Human
gggaaaaaccuuugccggagg

SEQ ID NO: 589073 - RNA, 21 nt, Human
ggggcuuugacgaggcuggug

SEQ ID NO: 589074 - RNA, 19 nt, Human
gggguggacaccuuccccc

SEQ ID NO: 589075 - RNA, 22 nt, Human
guagacacccccauccccacac

SEQ ID NO: 589076 - RNA, 21 nt, Human
guccuggcaggggaagggccc

SEQ ID NO: 589077 - RNA, 19 nt, Human
uaaaaauacuauuuacaaa

SEQ ID NO: 589078 - RNA, 18 nt, Human
uaacugaggaagagacug

SEQ ID NO: 589079 - RNA, 19 nt, Human
uaggucccauguaaacacu

SEQ ID NO: 589080 - RNA, 23 nt, Human
ucaaaaaaaaaaaaaaaaaaaaa

SEQ ID NO: 589081 - RNA, 19 nt, Human
uccagggaggaacagaaaa

SEQ ID NO: 589082 - RNA, 20 nt, Human
uccaggucucgguguagcgg

SEQ ID NO: 589083 - RNA, 18 nt, Human
uccauguucuugaucggg

SEQ ID NO: 589084 - RNA, 19 nt, Human
ucccacccucacccacucc

SEQ ID NO: 589085 - RNA, 19 nt, Human
ucccccagaacagggacaa

SEQ ID NO: 589086 - RNA, 24 nt, Human
ucccccagaacagggacaaggcag

SEQ ID NO: 589087 - RNA, 19 nt, Human
ucccgcggagcacagccgc

SEQ ID NO: 589088 - RNA, 19 nt, Human
ucccuucuaaccuuacucc

SEQ ID NO: 589089 - RNA, 22 nt, Human
ugacauuuuccuuuaugucccu

SEQ ID NO: 589090 - RNA, 24 nt, Human
ugaggggccgcaggcggggucggg

SEQ ID NO: 589091 - RNA, 23 nt, Human
ugaucgucaucacccuacagucc

SEQ ID NO: 589092 - RNA, 21 nt, Human
ugcagagggaccagacaucca

SEQ ID NO: 589093 - RNA, 21 nt, Human
ugccaggagggcgggguggga

SEQ ID NO: 589094 - RNA, 21 nt, Human
uggaguagcagggaagaaggc

SEQ ID NO: 589095 - RNA, 24 nt, Human
ugggagcacuagcggcgugagggg

SEQ ID NO: 589096 - RNA, 19 nt, Human
ugggggaauguggggcgcc

SEQ ID NO: 589097 - RNA, 21 nt, Human
ugucccugcucuucuguuuca

SEQ ID NO: 589098 - RNA, 20 nt, Human
uguggggcgccgcggggcgg

SEQ ID NO: 589099 - RNA, 23 nt, Human
uuaaccguagacacccccauccc

SEQ ID NO: 589100 - RNA, 21 nt, Human
uucuccauguucuugaucggg

SEQ ID NO: 589101 - RNA, 28 nt, Human
uugaucuuuccuuccuucccuucuaacc

SEQ ID NO: 589102 - RNA, 19 nt, Human
uugcuuaaccguagacacc

SEQ ID NO: 589103 - RNA, 19 nt, Human
uugguuggagcugugcaga

SEQ ID NO: 589104 - RNA, 23 nt, Human
uugguuggagcugugcagaggga

SEQ ID NO: 589105 - RNA, 19 nt, Human
aggagagcagacaugugcc

SEQ ID NO: 589106 - RNA, 22 nt, Human
cacaguucugaaguucuggggg

SEQ ID NO: 589107 - RNA, 20 nt, Human
ccacacaguucugaaguucu

SEQ ID NO: 589108 - RNA, 25 nt, Human
cuccacacaguucugaaguucuggg

SEQ ID NO: 589109 - RNA, 19 nt, Human
ggguuggggucucccaugu

SEQ ID NO: 589110 - RNA, 18 nt, Human
ggucucccaugugaggga

SEQ ID NO: 589111 - RNA, 21 nt, Human
guucugaaguucugggggcuc

SEQ ID NO: 589112 - RNA, 21 nt, Human
uccacauugucagcuggguug

SEQ ID NO: 589113 - RNA, 18 nt, Human
uccucacauccaaacagc

SEQ ID NO: 589114 - RNA, 24 nt, Human
uugucagcuggguuggggucuccc

SEQ ID NO: 589115 - RNA, 23 nt, Human
uuuguaguuucauucuccucaaa

SEQ ID NO: 589116 - RNA, 23 nt, Human
uuuucaggagagcagacaugugc

SEQ ID NO: 589117 - RNA, 18 nt, Human
uuuuuuuuuuuuuuuuug

SEQ ID NO: 589118 - RNA, 25 nt, Human
uuuuuuuuuuuuuuuuuuguaguuu

SEQ ID NO: 589119 - RNA, 21 nt, Human
aaaaaagaaaagccuauggaa

SEQ ID NO: 589120 - RNA, 21 nt, Human
aaaaagcuccaaccuguagcc

SEQ ID NO: 589121 - RNA, 24 nt, Human
aaaagccccagggaaagggaacaa

SEQ ID NO: 589122 - RNA, 18 nt, Human
aaaccugaaaaaagaaaa

SEQ ID NO: 589123 - RNA, 20 nt, Human
aaagccuauggaaguaggcc

SEQ ID NO: 589124 - RNA, 18 nt, Human
aaagggaacaacuaagag

SEQ ID NO: 589125 - RNA, 18 nt, Human
aaccuaucagaaagacaa

SEQ ID NO: 589126 - RNA, 27 nt, Human
aacuugcuucuuuccucauuccuccug

SEQ ID NO: 589127 - RNA, 25 nt, Human
aagaagugguauguuagcaaggggu

SEQ ID NO: 589128 - RNA, 20 nt, Human
aagacaaacaaaucaccgac

SEQ ID NO: 589129 - RNA, 18 nt, Human
aagacaccaaauuuguga

SEQ ID NO: 589130 - RNA, 28 nt, Human
aaggaaaaaaauacaaugcaguauaaaa

SEQ ID NO: 589131 - RNA, 23 nt, Human
aagggguuuggacccucuuggcc

SEQ ID NO: 589132 - RNA, 23 nt, Human
aaguagccuucugggggaagggc

SEQ ID NO: 589133 - RNA, 19 nt, Human
aauggaaaagccccaggga

SEQ ID NO: 589134 - RNA, 18 nt, Human
acccugggcauauuuugg

SEQ ID NO: 589135 - RNA, 21 nt, Human
acgauugaaguagggcagcac

SEQ ID NO: 589136 - RNA, 21 nt, Human
agaaagacaaacaaaucaccg

SEQ ID NO: 589137 - RNA, 23 nt, Human
agacaaacaaaucaccgacaaca

SEQ ID NO: 589138 - RNA, 25 nt, Human
agacaaacaaaucaccgacaacagg

SEQ ID NO: 589139 - RNA, 22 nt, Human
agagggugguaauuggcucugc

SEQ ID NO: 589140 - RNA, 25 nt, Human
agcccaugcuuacaucaaaccugaa

SEQ ID NO: 589141 - RNA, 25 nt, Human
aggaaguagccuucugggggaaggg

SEQ ID NO: 589142 - RNA, 21 nt, Human
aggaaguaucuccaggcagag

SEQ ID NO: 589143 - RNA, 23 nt, Human
aggaggggcaaguccacugagaa

SEQ ID NO: 589144 - RNA, 21 nt, Human
aggaggugugggauugggagg

SEQ ID NO: 589145 - RNA, 22 nt, Human
aggcagagugagaggagcuauu

SEQ ID NO: 589146 - RNA, 20 nt, Human
agguggggaugggguugggg

SEQ ID NO: 589147 - RNA, 23 nt, Human
agucaaaaggugaaaagagggac

SEQ ID NO: 589148 - RNA, 18 nt, Human
augugccucuccaauccu

SEQ ID NO: 589149 - RNA, 21 nt, Human
caaauggggagaaaaaaauuc

SEQ ID NO: 589150 - RNA, 23 nt, Human
caaccuaucagaaagacaaacaa

SEQ ID NO: 589151 - RNA, 22 nt, Human
caagagguacccaagcacuaag

SEQ ID NO: 589152 - RNA, 22 nt, Human
caaggugaggagaugcaagucc

SEQ ID NO: 589153 - RNA, 20 nt, Human
caaugcaguauaaaagauuu

SEQ ID NO: 589154 - RNA, 19 nt, Human
cacccagucacucuccuag

SEQ ID NO: 589155 - RNA, 18 nt, Human
cacuaagcagcagagggu

SEQ ID NO: 589156 - RNA, 23 nt, Human
cagcaagcaaccucauaggccuu

SEQ ID NO: 589157 - RNA, 22 nt, Human
caggggaaaaaaagcuccaacc

SEQ ID NO: 589158 - RNA, 28 nt, Human
caggggccuggacauguuuucuuccugu

SEQ ID NO: 589159 - RNA, 20 nt, Human
cagucacucuccuagauccu

SEQ ID NO: 589160 - RNA, 19 nt, Human
caugcagaaguagcaucac

SEQ ID NO: 589161 - RNA, 23 nt, Human
ccaggggccuggacauguuuucu

SEQ ID NO: 589162 - RNA, 18 nt, Human
cccaacuugcuucuuucc

SEQ ID NO: 589163 - RNA, 18 nt, Human
cccagcagcaagcaaccu

SEQ ID NO: 589164 - RNA, 24 nt, Human
ccucaccauugaacggcucccgga

SEQ ID NO: 589165 - RNA, 23 nt, Human
ccucgcugcugccuccuccuuca

SEQ ID NO: 589166 - RNA, 21 nt, Human
cgagcagaugaggguacaagg

SEQ ID NO: 589167 - RNA, 20 nt, Human
cugcauggaggaucuauuuu

SEQ ID NO: 589168 - RNA, 23 nt, Human
cugcugccuccuccuucagcagc

SEQ ID NO: 589169 - RNA, 19 nt, Human
cuggacauguuuucuuccu

SEQ ID NO: 589170 - RNA, 21 nt, Human
gaaaaaagaaaagccuaugga

SEQ ID NO: 589171 - RNA, 23 nt, Human
gaaagacaaacaaaucaccgaca

SEQ ID NO: 589172 - RNA, 20 nt, Human
gaaagggaaggggguggggc

SEQ ID NO: 589173 - RNA, 18 nt, Human
gaaggcugggcagcgcag

SEQ ID NO: 589174 - RNA, 21 nt, Human
gagaccaggggccuggacaug

SEQ ID NO: 589175 - RNA, 20 nt, Human
gcagcgcagaguugaaagag

SEQ ID NO: 589176 - RNA, 20 nt, Human
ggagguggggaugggguugg

SEQ ID NO: 589177 - RNA, 22 nt, Human
ggauguuauggaaaagcaauuc

SEQ ID NO: 589178 - RNA, 21 nt, Human
ggccuuuuugagggaugggug

SEQ ID NO: 589179 - RNA, 18 nt, Human
gggaaagggaacaacuaa

SEQ ID NO: 589180 - RNA, 19 nt, Human
gggaaggaagucuucccau

SEQ ID NO: 589181 - RNA, 20 nt, Human
gggaagggccgaaggaggac

SEQ ID NO: 589182 - RNA, 18 nt, Human
ggggaagggccgaaggag

SEQ ID NO: 589183 - RNA, 18 nt, Human
ggggaugggguuggggga

SEQ ID NO: 589184 - RNA, 22 nt, Human
ggggaugggguugggggacagg

SEQ ID NO: 589185 - RNA, 19 nt, Human
gggguuuggaggaaaggga

SEQ ID NO: 589186 - RNA, 20 nt, Human
gucaauacgugagagggaaa

SEQ ID NO: 589187 - RNA, 20 nt, Human
uaaaacaaggaaguagccuu

SEQ ID NO: 589188 - RNA, 22 nt, Human
uaaaacuaaaaauggugucauu

SEQ ID NO: 589189 - RNA, 25 nt, Human
uacaaaaggaaaaaaauacaaugca

SEQ ID NO: 589190 - RNA, 20 nt, Human
uacaagguucucagagggug

SEQ ID NO: 589191 - RNA, 22 nt, Human
uagaacucugagcugaguucau

SEQ ID NO: 589192 - RNA, 22 nt, Human
uagcaucaccccauggguaccg

SEQ ID NO: 589193 - RNA, 19 nt, Human
uaggccauauccugcccaa

SEQ ID NO: 589194 - RNA, 24 nt, Human
uauaugagaaacgugcugggaaca

SEQ ID NO: 589195 - RNA, 21 nt, Human
uaucagaaagacaaacaaauc

SEQ ID NO: 589196 - RNA, 19 nt, Human
uauggagaccaggggccug

SEQ ID NO: 589197 - RNA, 27 nt, Human
uauuacacaauuuucaaccuaucagaa

SEQ ID NO: 589198 - RNA, 24 nt, Human
ucauugaguaaaaacaaaacaaau

SEQ ID NO: 589199 - RNA, 28 nt, Human
ucauugcugaggucccaauguccccauc

SEQ ID NO: 589200 - RNA, 23 nt, Human
ucccaaugggcaguaccuuccuc

SEQ ID NO: 589201 - RNA, 24 nt, Human
ucccagcagcaagcaaccucauag

SEQ ID NO: 589202 - RNA, 21 nt, Human
ucccucagugacugagggcua

SEQ ID NO: 589203 - RNA, 18 nt, Human
ucgcugcugccuccuccu

SEQ ID NO: 589204 - RNA, 18 nt, Human
ucucacaugccacgucuc

SEQ ID NO: 589205 - RNA, 18 nt, Human
ucucauguuaggugucag

SEQ ID NO: 589206 - RNA, 18 nt, Human
ucugaaguggaggugggg

SEQ ID NO: 589207 - RNA, 23 nt, Human
ugaaaagacaccaaauuugugac

SEQ ID NO: 589208 - RNA, 24 nt, Human
ugaaaagacaccaaauuugugacu

SEQ ID NO: 589209 - RNA, 21 nt, Human
ugccaagcagucuucaauccu

SEQ ID NO: 589210 - RNA, 25 nt, Human
ugccaagcagucuucaauccugugg

SEQ ID NO: 589211 - RNA, 21 nt, Human
ugccaccccucccaaucacac

SEQ ID NO: 589212 - RNA, 19 nt, Human
ugccuccuccuucagcagc

SEQ ID NO: 589213 - RNA, 21 nt, Human
ugccuguagagaaaauggccc

SEQ ID NO: 589214 - RNA, 25 nt, Human
ugcuaucaggaaauaaaacuaaaaa

SEQ ID NO: 589215 - RNA, 19 nt, Human
ugcuucuuuccucauuccu

SEQ ID NO: 589216 - RNA, 26 nt, Human
uggcaaacaggagguguucgagggcg

SEQ ID NO: 589217 - RNA, 23 nt, Human
uggcucugccaggcuucccagca

SEQ ID NO: 589218 - RNA, 18 nt, Human
uggggaugggguuggggg

SEQ ID NO: 589219 - RNA, 20 nt, Human
ugggguugggggacagggga

SEQ ID NO: 589220 - RNA, 20 nt, Human
uguagagaaaauggccccca

SEQ ID NO: 589221 - RNA, 23 nt, Human
ugucagaugcccuguagaugcau

SEQ ID NO: 589222 - RNA, 27 nt, Human
ugucauugaguaaaaacaaaacaaaug

SEQ ID NO: 589223 - RNA, 22 nt, Human
ugucucacaugccaagucucau

SEQ ID NO: 589224 - RNA, 19 nt, Human
ugucuggagggaguuaggg

SEQ ID NO: 589225 - RNA, 26 nt, Human
ugugacuuuaccugccuacuagugcc

SEQ ID NO: 589226 - RNA, 18 nt, Human
uguuucuucuggcuccuc

SEQ ID NO: 589227 - RNA, 21 nt, Human
uuagggguuuggaggaaaggg

SEQ ID NO: 589228 - RNA, 21 nt, Human
uucccugggugucuggaggga

SEQ ID NO: 589229 - RNA, 19 nt, Human
uucuauauauauuuuuccu

SEQ ID NO: 589230 - RNA, 18 nt, Human
uuuggaggaaagggaagg

SEQ ID NO: 589231 - RNA, 21 nt, Human
uuuggaggaaagggaaggggg

SEQ ID NO: 589232 - RNA, 23 nt, Human
uuugggaaggaagucuucccguu

SEQ ID NO: 589233 - RNA, 20 nt, Human
agaaccccugcuggcucucc

SEQ ID NO: 589234 - RNA, 20 nt, Human
agaccuccacccaaccacag

SEQ ID NO: 589235 - RNA, 21 nt, Human
agcagagcccuccugaggcuc

SEQ ID NO: 589236 - RNA, 21 nt, Human
cagagcccuccugaggcuccc

SEQ ID NO: 589237 - RNA, 21 nt, Human
cagcacagaugggcagguggg

SEQ ID NO: 589238 - RNA, 21 nt, Human
cagcugggcucccuugagccc

SEQ ID NO: 589239 - RNA, 20 nt, Human
ccagcuccgcacugccugcc

SEQ ID NO: 589240 - RNA, 23 nt, Human
cccacggccagcuccgcacugcc

SEQ ID NO: 589241 - RNA, 22 nt, Human
cccauagccaaguggguggagc

SEQ ID NO: 589242 - RNA, 18 nt, Human
ccccagccucagccugcc

SEQ ID NO: 589243 - RNA, 19 nt, Human
cccuggcucaacuggcucc

SEQ ID NO: 589244 - RNA, 24 nt, Human
cccuugagccccucccccagccuc

SEQ ID NO: 589245 - RNA, 19 nt, Human
ccucagccugccccuuucu

SEQ ID NO: 589246 - RNA, 20 nt, Human
ccuugagccccucccccagc

SEQ ID NO: 589247 - RNA, 23 nt, Human
ccuugagccccucccccagccuc

SEQ ID NO: 589248 - RNA, 23 nt, Human
cgugaaggccaaggcugaggugg

SEQ ID NO: 589249 - RNA, 20 nt, Human
cucaggaacaaguuuauugc

SEQ ID NO: 589250 - RNA, 25 nt, Human
cuccuggaccaaggcccuaacccac

SEQ ID NO: 589251 - RNA, 22 nt, Human
cucuggcccuucuccagaaggg

SEQ ID NO: 589252 - RNA, 22 nt, Human
cugggaggagagccggggaggg

SEQ ID NO: 589253 - RNA, 18 nt, Human
cugggcccucccagcugg

SEQ ID NO: 589254 - RNA, 19 nt, Human
cuggucugagucaugacuu

SEQ ID NO: 589255 - RNA, 18 nt, Human
gaccaaggcccuaaccca

SEQ ID NO: 589256 - RNA, 19 nt, Human
gaccuccacccaaccacag

SEQ ID NO: 589257 - RNA, 21 nt, Human
gagacgccuggauguggcugc

SEQ ID NO: 589258 - RNA, 24 nt, Human
gagccggggagggaggaggauggu

SEQ ID NO: 589259 - RNA, 18 nt, Human
gaggaccugcuggcugca

SEQ ID NO: 589260 - RNA, 18 nt, Human
gaggaugguaggcaggaa

SEQ ID NO: 589261 - RNA, 26 nt, Human
gcacugccugccugggcccucccagc

SEQ ID NO: 589262 - RNA, 24 nt, Human
gcagagcccuccugaggcucccag

SEQ ID NO: 589263 - RNA, 26 nt, Human
gcauaaaaacuacaaaaauaucuggc

SEQ ID NO: 589264 - RNA, 24 nt, Human
gcccacggccagcuccgcacugcc

SEQ ID NO: 589265 - RNA, 22 nt, Human
gccugggcccucccagcugggc

SEQ ID NO: 589266 - RNA, 18 nt, Human
gcugcccuggcucaacug

SEQ ID NO: 589267 - RNA, 20 nt, Human
ggcagguggguugaccuucc

SEQ ID NO: 589268 - RNA, 18 nt, Human
ggcccuucaaggcugaug

SEQ ID NO: 589269 - RNA, 22 nt, Human
ggcucucgagugugggcagcuc

SEQ ID NO: 589270 - RNA, 21 nt, Human
gggagggaggaggaugguagg

SEQ ID NO: 589271 - RNA, 18 nt, Human
ggggagggaggaggaugg

SEQ ID NO: 589272 - RNA, 20 nt, Human
gguggagcugggcuggagug

SEQ ID NO: 589273 - RNA, 19 nt, Human
gugcagacagaccuccacc

SEQ ID NO: 589274 - RNA, 18 nt, Human
guggcgcugaggggguga

SEQ ID NO: 589275 - RNA, 24 nt, Human
uagccaaaggcauaaaaacuacaa

SEQ ID NO: 589276 - RNA, 18 nt, Human
ucaugacuugggcugccc

SEQ ID NO: 589277 - RNA, 19 nt, Human
ucccagugcagacagaccu

SEQ ID NO: 589278 - RNA, 22 nt, Human
ucccagugcagacagaccucca

SEQ ID NO: 589279 - RNA, 26 nt, Human
ucccccagccucagccugccccuuuc

SEQ ID NO: 589280 - RNA, 18 nt, Human
ucccuugagccccucccc

SEQ ID NO: 589281 - RNA, 19 nt, Human
ucuccagaagggaggccca

SEQ ID NO: 589282 - RNA, 25 nt, Human
ucucccauagccaaguggguggagc

SEQ ID NO: 589283 - RNA, 19 nt, Human
ugaaaggguaggcagccca

SEQ ID NO: 589284 - RNA, 22 nt, Human
ugagggggugaggaagugccuu

SEQ ID NO: 589285 - RNA, 19 nt, Human
ugaugcugggaggagagcc

SEQ ID NO: 589286 - RNA, 18 nt, Human
ugccugggcccucccagc

SEQ ID NO: 589287 - RNA, 20 nt, Human
ugccuuggcugcuuccacag

SEQ ID NO: 589288 - RNA, 25 nt, Human
ugcuggcugcauggcuggugugaug

SEQ ID NO: 589289 - RNA, 22 nt, Human
uggaccaaggcccuaacccacc

SEQ ID NO: 589290 - RNA, 21 nt, Human
uggcuccuggaccaaggcccu

SEQ ID NO: 589291 - RNA, 21 nt, Human
uggcugcccuggcucaacugg

SEQ ID NO: 589292 - RNA, 19 nt, Human
uggugugaugcugggagga

SEQ ID NO: 589293 - RNA, 23 nt, Human
uggugugaugcugggaggagagc

SEQ ID NO: 589294 - RNA, 18 nt, Human
uuccggccacuccccaga

SEQ ID NO: 589295 - RNA, 22 nt, Human
uuuuuuuuuuuuuuuucucagg

SEQ ID NO: 589296 - RNA, 20 nt, Human
aauguacaauguguaaaauu

SEQ ID NO: 589297 - RNA, 21 nt, Human
acugcgcggccccggccgggc

SEQ ID NO: 589298 - RNA, 25 nt, Human
acuggagcacaaagcgccgcagccg

SEQ ID NO: 589299 - RNA, 22 nt, Human
auuaaacacagguauaaaucuu

SEQ ID NO: 589300 - RNA, 25 nt, Human
caagccagauugugauuuuaaaaua

SEQ ID NO: 589301 - RNA, 21 nt, Human
ccccgccucagaugcccuaac

SEQ ID NO: 589302 - RNA, 19 nt, Human
cccgccgcuucuccccgcc

SEQ ID NO: 589303 - RNA, 18 nt, Human
cccgggggacgcaacgcc

SEQ ID NO: 589304 - RNA, 27 nt, Human
ccggccgggccagggagcguuaggagc

SEQ ID NO: 589305 - RNA, 21 nt, Human
cgaauaaaccacaaaaguggu

SEQ ID NO: 589306 - RNA, 23 nt, Human
cgccucagaugcccuaacugcgc

SEQ ID NO: 589307 - RNA, 19 nt, Human
cucaaauaucccaaggacc

SEQ ID NO: 589308 - RNA, 23 nt, Human
cugcgcggccccggccgggccag

SEQ ID NO: 589309 - RNA, 22 nt, Human
cuucaagguccaaccauaaauu

SEQ ID NO: 589310 - RNA, 21 nt, Human
gaaguaugccauucaagccag

SEQ ID NO: 589311 - RNA, 21 nt, Human
uaaaauacccaauucauuuuu

SEQ ID NO: 589312 - RNA, 20 nt, Human
uaacuguaaacaaaguagca

SEQ ID NO: 589313 - RNA, 25 nt, Human
uaauuuauacuaaauuccagggaga

SEQ ID NO: 589314 - RNA, 21 nt, Human
ucaaacccuuagacaaacauc

SEQ ID NO: 589315 - RNA, 22 nt, Human
ucuccccgccgcuucuccccgc

SEQ ID NO: 589316 - RNA, 22 nt, Human
ugcaagaucacaauuuaucagu

SEQ ID NO: 589317 - RNA, 22 nt, Human
uggagcacaaagcgccgcagcc

SEQ ID NO: 589318 - RNA, 21 nt, Human
uguaaagaaaacugaaugcau

SEQ ID NO: 589319 - RNA, 20 nt, Human
uguguaaaauuccaauuaaa

SEQ ID NO: 589320 - RNA, 18 nt, Human
uucauuuuuacaacaaau

SEQ ID NO: 589321 - RNA, 18 nt, Human
uuuuuuuuuuuuuuuucg

SEQ ID NO: 589322 - RNA, 21 nt, Human
aaaccaucuucaaaucggcag

SEQ ID NO: 589323 - RNA, 19 nt, Human
aagcagcaccagaccaaca

SEQ ID NO: 589324 - RNA, 21 nt, Human
aagcagcaccagaccaacaga

SEQ ID NO: 589325 - RNA, 19 nt, Human
acaaaugugcacccacaca

SEQ ID NO: 589326 - RNA, 27 nt, Human
acaagugugcacacauacauacgugca

SEQ ID NO: 589327 - RNA, 23 nt, Human
acacacacacacaaaugugcacc

SEQ ID NO: 589328 - RNA, 25 nt, Human
acacacacacacaggcacacacaca

SEQ ID NO: 589329 - RNA, 28 nt, Human
acacacacaggcacacacacacacacaa

SEQ ID NO: 589330 - RNA, 23 nt, Human
acacauacauacgugcacacaca

SEQ ID NO: 589331 - RNA, 25 nt, Human
acacauacauacgugcacacacaca

SEQ ID NO: 589332 - RNA, 24 nt, Human
acagugcugggauuacaggcguga

SEQ ID NO: 589333 - RNA, 19 nt, Human
accccccagcccgggacuu

SEQ ID NO: 589334 - RNA, 23 nt, Human
acgcagccccaggcugcucagag

SEQ ID NO: 589335 - RNA, 27 nt, Human
acgugcacacacacacacaggcacaca

SEQ ID NO: 589336 - RNA, 21 nt, Human
acuggugugagggccguggcu

SEQ ID NO: 589337 - RNA, 18 nt, Human
agagagcgcgcccugccc

SEQ ID NO: 589338 - RNA, 21 nt, Human
agagagcgcgcccugcccaca

SEQ ID NO: 589339 - RNA, 21 nt, Human
agcaugagcacaggggagaga

SEQ ID NO: 589340 - RNA, 23 nt, Human
agccacagagccucggccucagc

SEQ ID NO: 589341 - RNA, 18 nt, Human
agccgagcugcaaaaagu

SEQ ID NO: 589342 - RNA, 23 nt, Human
agcuggagggcaucggaaguggg

SEQ ID NO: 589343 - RNA, 18 nt, Human
aguagagaugggguuuca

SEQ ID NO: 589344 - RNA, 22 nt, Human
aguagagaugggguuucaccau

SEQ ID NO: 589345 - RNA, 23 nt, Human
aguagagaugggguuucaccaug

SEQ ID NO: 589346 - RNA, 19 nt, Human
agucaacuuuuugaugugu

SEQ ID NO: 589347 - RNA, 18 nt, Human
agugcugggauuacaggc

SEQ ID NO: 589348 - RNA, 21 nt, Human
agugcugggauuacaggcgug

SEQ ID NO: 589349 - RNA, 22 nt, Human
agugcugggauuacaggcguga

SEQ ID NO: 589350 - RNA, 29 nt, Human
auacgugcacacacacacacaggcacaca

SEQ ID NO: 589351 - RNA, 19 nt, Human
augaaccagugagcagccc

SEQ ID NO: 589352 - RNA, 19 nt, Human
augggguuucaccaugucg

SEQ ID NO: 589353 - RNA, 20 nt, Human
augggguuucaccaugucgg

SEQ ID NO: 589354 - RNA, 22 nt, Human
augggguuucaccaugucggcc

SEQ ID NO: 589355 - RNA, 18 nt, Human
caagccucugccucggga

SEQ ID NO: 589356 - RNA, 29 nt, Human
caagugugcacacauacauacgugcacac

SEQ ID NO: 589357 - RNA, 21 nt, Human
cacacacaaaugugcacccac

SEQ ID NO: 589358 - RNA, 19 nt, Human
cacagacccagacccagag

SEQ ID NO: 589359 - RNA, 28 nt, Human
cacagacccagacccagagcccgcucac

SEQ ID NO: 589360 - RNA, 21 nt, Human
cacaggaccugguauccggcc

SEQ ID NO: 589361 - RNA, 28 nt, Human
cacaggcacacacacacacacaaaugug

SEQ ID NO: 589362 - RNA, 22 nt, Human
caccaugucggccaggacgguc

SEQ ID NO: 589363 - RNA, 24 nt, Human
caccaugucggccaggacggucuc

SEQ ID NO: 589364 - RNA, 21 nt, Human
caccucacagacccagaccca

SEQ ID NO: 589365 - RNA, 19 nt, Human
cacugcuaccccccagccc

SEQ ID NO: 589366 - RNA, 20 nt, Human
cagagcccgcucaccucugg

SEQ ID NO: 589367 - RNA, 26 nt, Human
cagcaccucacagacccagacccaga

SEQ ID NO: 589368 - RNA, 24 nt, Human
cagcaugagcacaggggagagaag

SEQ ID NO: 589369 - RNA, 21 nt, Human
cagcccagccuuuugccuccc

SEQ ID NO: 589370 - RNA, 19 nt, Human
cagccuuuuucgugccaag

SEQ ID NO: 589371 - RNA, 28 nt, Human
caggcacacacacacacacaaaugugca

SEQ ID NO: 589372 - RNA, 28 nt, Human
caggcacacacacacaggcacacaugca

SEQ ID NO: 589373 - RNA, 24 nt, Human
cagugcugggauuacaggcgugag

SEQ ID NO: 589374 - RNA, 20 nt, Human
caugaaccagugagcagccc

SEQ ID NO: 589375 - RNA, 23 nt, Human
ccacacacacaggcacacacaca

SEQ ID NO: 589376 - RNA, 22 nt, Human
ccacagugcugggauuacaggc

SEQ ID NO: 589377 - RNA, 24 nt, Human
ccacagugcugggauuacaggcgu

SEQ ID NO: 589378 - RNA, 24 nt, Human
ccacccggacggcuccagcgagcc

SEQ ID NO: 589379 - RNA, 27 nt, Human
ccacccgggggacaugggcagggaccu

SEQ ID NO: 589380 - RNA, 23 nt, Human
ccacugcuaccccccagcccggg

SEQ ID NO: 589381 - RNA, 19 nt, Human
ccagaccaacagacacagc

SEQ ID NO: 589382 - RNA, 24 nt, Human
ccagacccagagcccgcucaccuc

SEQ ID NO: 589383 - RNA, 18 nt, Human
ccagagcccgcucaccuc

SEQ ID NO: 589384 - RNA, 24 nt, Human
ccagugagcagccccugccccaga

SEQ ID NO: 589385 - RNA, 24 nt, Human
cccacacacacaggcacacacaca

SEQ ID NO: 589386 - RNA, 21 nt, Human
cccagagcacuguccccucac

SEQ ID NO: 589387 - RNA, 23 nt, Human
cccagccuccacugcuacccccc

SEQ ID NO: 589388 - RNA, 19 nt, Human
ccccccagcccgggacuug

SEQ ID NO: 589389 - RNA, 19 nt, Human
cccccucacgcugugcuuc

SEQ ID NO: 589390 - RNA, 22 nt, Human
ccccucacgcugugcuuccagc

SEQ ID NO: 589391 - RNA, 21 nt, Human
ccucacagacccagacccaga

SEQ ID NO: 589392 - RNA, 21 nt, Human
ccucaugauccucccgccucc

SEQ ID NO: 589393 - RNA, 21 nt, Human
ccucccgccuccgccucccac

SEQ ID NO: 589394 - RNA, 23 nt, Human
ccugcccacaccaccacaggacc

SEQ ID NO: 589395 - RNA, 21 nt, Human
ccuggaaacacugcaugcuga

SEQ ID NO: 589396 - RNA, 21 nt, Human
ccugguauccggccacagcca

SEQ ID NO: 589397 - RNA, 24 nt, Human
cgccuccgccucccacagugcugg

SEQ ID NO: 589398 - RNA, 22 nt, Human
cgcgcccggcccuaaaauguuu

SEQ ID NO: 589399 - RNA, 18 nt, Human
cgggggacaugggcaggg

SEQ ID NO: 589400 - RNA, 23 nt, Human
cucacagacccagacccagagcc

SEQ ID NO: 589401 - RNA, 22 nt, Human
cucagcccagccuuuugccucc

SEQ ID NO: 589402 - RNA, 27 nt, Human
cucaugauccucccgccuccgccuccc

SEQ ID NO: 589403 - RNA, 24 nt, Human
cuccugaccucaugauccucccgc

SEQ ID NO: 589404 - RNA, 22 nt, Human
cucggccucagcccagccuuuu

SEQ ID NO: 589405 - RNA, 23 nt, Human
cugaccucaugauccucccgccu

SEQ ID NO: 589406 - RNA, 19 nt, Human
cuguaaccgucugccucag

SEQ ID NO: 589407 - RNA, 19 nt, Human
cuguuucuguucacacacg

SEQ ID NO: 589408 - RNA, 18 nt, Human
gacacagcguucccaccc

SEQ ID NO: 589409 - RNA, 22 nt, Human
gaccucaugauccucccgccuc

SEQ ID NO: 589410 - RNA, 22 nt, Human
gaccugguauccggccacagcc

SEQ ID NO: 589411 - RNA, 23 nt, Human
gacggucucgaucuccugaccuc

SEQ ID NO: 589412 - RNA, 24 nt, Human
gacuugaaagggcaugagaacugg

SEQ ID NO: 589413 - RNA, 18 nt, Human
gagaugggguuucaccau

SEQ ID NO: 589414 - RNA, 24 nt, Human
gagaugggguuucaccaugucggc

SEQ ID NO: 589415 - RNA, 20 nt, Human
gagcccgcucaccucuggcc

SEQ ID NO: 589416 - RNA, 21 nt, Human
gagccgcugccagcccaucug

SEQ ID NO: 589417 - RNA, 23 nt, Human
gagcgcgcccugcccacaccacc

SEQ ID NO: 589418 - RNA, 18 nt, Human
gauuacaggcgugagcca

SEQ ID NO: 589419 - RNA, 22 nt, Human
gauuacaggcgugagccaccgc

SEQ ID NO: 589420 - RNA, 22 nt, Human
gauuacaggcgugagccaccgc

SEQ ID NO: 589421 - RNA, 27 nt, Human
gcacacacacacacaggcacacacaca

SEQ ID NO: 589422 - RNA, 23 nt, Human
gcacacacacacaggcacacaug

SEQ ID NO: 589423 - RNA, 19 nt, Human
gccacagagccucggccuc

SEQ ID NO: 589424 - RNA, 23 nt, Human
gcccugcccacaccaccacagga

SEQ ID NO: 589425 - RNA, 23 nt, Human
gccuccacugcuaccccccagcc

SEQ ID NO: 589426 - RNA, 25 nt, Human
ggagagaagggucccaaggugugag

SEQ ID NO: 589427 - RNA, 18 nt, Human
ggaugacagaccugaacc

SEQ ID NO: 589428 - RNA, 19 nt, Human
ggccaugaaccagugagca

SEQ ID NO: 589429 - RNA, 21 nt, Human
ggcuguaaccgucugccucag

SEQ ID NO: 589430 - RNA, 24 nt, Human
gggaagaugaggcacagccgagcu

SEQ ID NO: 589431 - RNA, 18 nt, Human
gggacaugggcagggacc

SEQ ID NO: 589432 - RNA, 26 nt, Human
gggcagggaccucucuucagcuuugg

SEQ ID NO: 589433 - RNA, 19 nt, Human
gggcaugagaacugggcag

SEQ ID NO: 589434 - RNA, 22 nt, Human
gggguuucaccaugucggccag

SEQ ID NO: 589435 - RNA, 21 nt, Human
guagagaugggguuucaccau

SEQ ID NO: 589436 - RNA, 23 nt, Human
guagagaugggguuucaccaugu

SEQ ID NO: 589437 - RNA, 22 nt, Human
gucccaaggugugagaaggcca

SEQ ID NO: 589438 - RNA, 19 nt, Human
gugacccugccacaggacu

SEQ ID NO: 589439 - RNA, 25 nt, Human
gugcacccacacacacaggcacaca

SEQ ID NO: 589440 - RNA, 21 nt, Human
gugcuuccagcaugagcacag

SEQ ID NO: 589441 - RNA, 19 nt, Human
uacaacauacaugaaaaug

SEQ ID NO: 589442 - RNA, 23 nt, Human
uacaggcgugagccaccgcgccc

SEQ ID NO: 589443 - RNA, 23 nt, Human
uaccccccagcccgggacuugaa

SEQ ID NO: 589444 - RNA, 22 nt, Human
uagagaugggguuucaccaugu

SEQ ID NO: 589445 - RNA, 21 nt, Human
uagaugacauccuacagcuaa

SEQ ID NO: 589446 - RNA, 18 nt, Human
ucaaggacguucguguuu

SEQ ID NO: 589447 - RNA, 24 nt, Human
ucaccaugucggccaggacggucu

SEQ ID NO: 589448 - RNA, 18 nt, Human
ucagaccgugguguccac

SEQ ID NO: 589449 - RNA, 19 nt, Human
ucagcuuugggagacuugg

SEQ ID NO: 589450 - RNA, 21 nt, Human
uccacaaugaggccuuugaga

SEQ ID NO: 589451 - RNA, 22 nt, Human
uccacaaugaggccuuugagac

SEQ ID NO: 589452 - RNA, 21 nt, Human
uccacagcaccucacagaccc

SEQ ID NO: 589453 - RNA, 21 nt, Human
uccacggcgugaacagaccac

SEQ ID NO: 589454 - RNA, 23 nt, Human
uccacggcgugaacagaccacgu

SEQ ID NO: 589455 - RNA, 21 nt, Human
uccacugcuaccccccagccc

SEQ ID NO: 589456 - RNA, 24 nt, Human
ucccacagugcugggauuacaggc

SEQ ID NO: 589457 - RNA, 18 nt, Human
ucccaguucacucucucu

SEQ ID NO: 589458 - RNA, 21 nt, Human
ucccaugaccuuugcccccuc

SEQ ID NO: 589459 - RNA, 23 nt, Human
ugaaagggcaugagaacugggca

SEQ ID NO: 589460 - RNA, 21 nt, Human
ugaaccagugagcagccccug

SEQ ID NO: 589461 - RNA, 22 nt, Human
ugaccucaugauccucccgccu

SEQ ID NO: 589462 - RNA, 19 nt, Human
ugagcagccccugccccag

SEQ ID NO: 589463 - RNA, 23 nt, Human
ugagcagccccugccccagagca

SEQ ID NO: 589464 - RNA, 21 nt, Human
ugagguacaacauacaugaaa

SEQ ID NO: 589465 - RNA, 22 nt, Human
ugagguacaacauacaugaaaa

SEQ ID NO: 589466 - RNA, 27 nt, Human
ugcacacacacacacaggcacacacac

SEQ ID NO: 589467 - RNA, 28 nt, Human
ugcacacacacacacaggcacacacaca

SEQ ID NO: 589468 - RNA, 26 nt, Human
ugcacacauacauacgugcacacaca

SEQ ID NO: 589469 - RNA, 22 nt, Human
ugccacaggacucccacugugg

SEQ ID NO: 589470 - RNA, 18 nt, Human
ugcccccucacgcugugc

SEQ ID NO: 589471 - RNA, 18 nt, Human
ugcccccucacgcugugc

SEQ ID NO: 589472 - RNA, 23 nt, Human
ugccucgggaaggaagacggcuc

SEQ ID NO: 589473 - RNA, 24 nt, Human
ugcugggauuacaggcgugagcca

SEQ ID NO: 589474 - RNA, 21 nt, Human
uggccggaagacacguggggc

SEQ ID NO: 589475 - RNA, 25 nt, Human
uggccggaagacacguggggcugac

SEQ ID NO: 589476 - RNA, 21 nt, Human
uggcuguaaccgucugccuca

SEQ ID NO: 589477 - RNA, 22 nt, Human
ugggaagaugaggcacagccga

SEQ ID NO: 589478 - RNA, 18 nt, Human
ugggauuacaggcgugag

SEQ ID NO: 589479 - RNA, 19 nt, Human
ugggauuacaggcgugagc

SEQ ID NO: 589480 - RNA, 21 nt, Human
ugggauuacaggcgugagcca

SEQ ID NO: 589481 - RNA, 22 nt, Human
ugggauuacaggcgugagccac

SEQ ID NO: 589482 - RNA, 23 nt, Human
ugggauuacaggcgugagccacc

SEQ ID NO: 589483 - RNA, 24 nt, Human
ugggauuacaggcgugagccaccg

SEQ ID NO: 589484 - RNA, 24 nt, Human
ugggguuucaccaugucggccagg

SEQ ID NO: 589485 - RNA, 18 nt, Human
uguaaccgucugccucag

SEQ ID NO: 589486 - RNA, 23 nt, Human
ugucccugccccaggagcacccc

SEQ ID NO: 589487 - RNA, 20 nt, Human
ugugcacacauacauacgug

SEQ ID NO: 589488 - RNA, 24 nt, Human
ugugcacccacacacacaggcaca

SEQ ID NO: 589489 - RNA, 20 nt, Human
uucacucucucuggcugaga

SEQ ID NO: 589490 - RNA, 19 nt, Human
uuccagcaugagcacaggg

SEQ ID NO: 589491 - RNA, 21 nt, Human
uugcccccucacgcugugcuu

SEQ ID NO: 589492 - RNA, 22 nt, Human
uuucaccaugucggccaggacg

SEQ ID NO: 589493 - RNA, 20 nt, Human
aagauaccacauugaagcag

SEQ ID NO: 589494 - RNA, 18 nt, Human
ccauacaaagauaccaca

SEQ ID NO: 589495 - RNA, 20 nt, Human
ccgcucagagcccucgugcc

SEQ ID NO: 589496 - RNA, 26 nt, Human
cgccgaaccccaggcuccuagaaguc

SEQ ID NO: 589497 - RNA, 21 nt, Human
uuuuuuuuuuuuuuuuuuaca

SEQ ID NO: 589498 - RNA, 29 nt, Human
aaaaacacaaaaggagagagucuaacaca

SEQ ID NO: 589499 - RNA, 19 nt, Human
aaaaaccagcucaacagca

SEQ ID NO: 589500 - RNA, 23 nt, Human
aaacacaaaaggagagagucuaa

SEQ ID NO: 589501 - RNA, 21 nt, Human
aaacagcgccauuuuguucau

SEQ ID NO: 589502 - RNA, 18 nt, Human
aaaugacccuuuuaaagg

SEQ ID NO: 589503 - RNA, 22 nt, Human
aacagacggacuauguuaaaaa

SEQ ID NO: 589504 - RNA, 23 nt, Human
aacucuaugucagacugaaauaa

SEQ ID NO: 589505 - RNA, 19 nt, Human
aagacccuggaagccauag

SEQ ID NO: 589506 - RNA, 22 nt, Human
aagccauagaaguuuagcaaac

SEQ ID NO: 589507 - RNA, 18 nt, Human
aauaucuacccaauucuu

SEQ ID NO: 589508 - RNA, 21 nt, Human
acaccagccgccacggacagc

SEQ ID NO: 589509 - RNA, 18 nt, Human
acagccagacauaaugaa

SEQ ID NO: 589510 - RNA, 20 nt, Human
acauauauaacaaaagugaa

SEQ ID NO: 589511 - RNA, 23 nt, Human
accagcucaacagcaaaacacca

SEQ ID NO: 589512 - RNA, 24 nt, Human
acuacaaucugauugcaguuaacu

SEQ ID NO: 589513 - RNA, 21 nt, Human
agacauaaugaauggcauagc

SEQ ID NO: 589514 - RNA, 22 nt, Human
agcaaacaccuaaaacagaccg

SEQ ID NO: 589515 - RNA, 20 nt, Human
auaaauacaacucacagggc

SEQ ID NO: 589516 - RNA, 25 nt, Human
auuuuguucauuccucccccugccc

SEQ ID NO: 589517 - RNA, 26 nt, Human
caaaacaccaaaugacccuuuuaaag

SEQ ID NO: 589518 - RNA, 18 nt, Human
caacagcaaaacaccaaa

SEQ ID NO: 589519 - RNA, 21 nt, Human
cacccuguuucaugucaagga

SEQ ID NO: 589520 - RNA, 22 nt, Human
cagagaagcugaaaauggguag

SEQ ID NO: 589521 - RNA, 20 nt, Human
cagcaaaacaccaaaugacc

SEQ ID NO: 589522 - RNA, 19 nt, Human
cagcucaacagcaaaacac

SEQ ID NO: 589523 - RNA, 22 nt, Human
cagcucaacagcaaaacaccaa

SEQ ID NO: 589524 - RNA, 20 nt, Human
cauuccucccccugcccacg

SEQ ID NO: 589525 - RNA, 18 nt, Human
ccaacaccagccgccacg

SEQ ID NO: 589526 - RNA, 21 nt, Human
ccaaugccagccaacaccagc

SEQ ID NO: 589527 - RNA, 19 nt, Human
ccacaaaaacuuccuccuc

SEQ ID NO: 589528 - RNA, 20 nt, Human
ccagcccugcagccauugac

SEQ ID NO: 589529 - RNA, 22 nt, Human
ccgccacggacagcuucucuuc

SEQ ID NO: 589530 - RNA, 18 nt, Human
ccucccccugcccacgga

SEQ ID NO: 589531 - RNA, 18 nt, Human
ccucuugacuuugucugc

SEQ ID NO: 589532 - RNA, 21 nt, Human
ccugcagccauugacugccac

SEQ ID NO: 589533 - RNA, 20 nt, Human
cucccccugcccacggacac

SEQ ID NO: 589534 - RNA, 19 nt, Human
cucuauacccagcuaacuc

SEQ ID NO: 589535 - RNA, 21 nt, Human
cuuuucaacauuuucacuugc

SEQ ID NO: 589536 - RNA, 19 nt, Human
gaacaaugccgugcugacu

SEQ ID NO: 589537 - RNA, 24 nt, Human
gagguuugccagcccugaccacag

SEQ ID NO: 589538 - RNA, 18 nt, Human
gagguuugccagcccugc

SEQ ID NO: 589539 - RNA, 25 nt, Human
gcagugccggauacaggauaaauac

SEQ ID NO: 589540 - RNA, 21 nt, Human
ggaaagccugcggagaagccg

SEQ ID NO: 589541 - RNA, 20 nt, Human
ggaagaggaaagccugcgga

SEQ ID NO: 589542 - RNA, 18 nt, Human
ggccacuggggaagagga

SEQ ID NO: 589543 - RNA, 22 nt, Human
guaaacagacggacuauguuaa

SEQ ID NO: 589544 - RNA, 24 nt, Human
guuaaaggaaugcauuguaagaag

SEQ ID NO: 589545 - RNA, 19 nt, Human
uaaaaccaagaguagugcu

SEQ ID NO: 589546 - RNA, 22 nt, Human
uaaagcuauacuugcaccccua

SEQ ID NO: 589547 - RNA, 24 nt, Human
uaaagcuauacuugcaccccuaaa

SEQ ID NO: 589548 - RNA, 25 nt, Human
uaaauacauauauaacaaaagugaa

SEQ ID NO: 589549 - RNA, 22 nt, Human
uagacauucauaggaaauguca

SEQ ID NO: 589550 - RNA, 21 nt, Human
uagcaaacaccuaaaacagac

SEQ ID NO: 589551 - RNA, 21 nt, Human
uagugagaugagguucuucca

SEQ ID NO: 589552 - RNA, 24 nt, Human
ucagcccugggacucgccagugcc

SEQ ID NO: 589553 - RNA, 22 nt, Human
uccuuguaucagaagagaggca

SEQ ID NO: 589554 - RNA, 18 nt, Human
ucuguaucagcccuggga

SEQ ID NO: 589555 - RNA, 20 nt, Human
ugaaaaaaguaacuauagug

SEQ ID NO: 589556 - RNA, 22 nt, Human
ugaaauaaaaccaagaguagug

SEQ ID NO: 589557 - RNA, 24 nt, Human
ugaaauaaaaccaagaguagugcu

SEQ ID NO: 589558 - RNA, 27 nt, Human
ugacucaaaaaccagcucaacagcaag

SEQ ID NO: 589559 - RNA, 18 nt, Human
ugacugccacaucagcag

SEQ ID NO: 589560 - RNA, 21 nt, Human
ugcccacggacacuuccuuug

SEQ ID NO: 589561 - RNA, 19 nt, Human
ugcccugagccuucuuagc

SEQ ID NO: 589562 - RNA, 21 nt, Human
ugcccugagccuucuuagccc

SEQ ID NO: 589563 - RNA, 18 nt, Human
ugccucaguaaacagacg

SEQ ID NO: 589564 - RNA, 19 nt, Human
uguaucagaagagaggcag

SEQ ID NO: 589565 - RNA, 22 nt, Human
ugucaagcauucuaggagucug

SEQ ID NO: 589566 - RNA, 26 nt, Human
ugucacugaaaauaaacaacauagag

SEQ ID NO: 589567 - RNA, 18 nt, Human
uucauuguccacaaaaac

SEQ ID NO: 589568 - RNA, 23 nt, Human
uuuguucauuccucccccugccc

SEQ ID NO: 589569 - RNA, 24 nt, Human
uugauggaauaauaauuuaaugcu

SEQ ID NO: 589570 - RNA, 20 nt, Human
uuuuuuuuuuuuuugaugga

SEQ ID NO: 589571 - RNA, 21 nt, Human
uuuuuuuuuuuuuuuugaugg

SEQ ID NO: 589572 - RNA, 22 nt, Human
aaacaaaaaaagaaggaagaga

SEQ ID NO: 589573 - RNA, 19 nt, Human
aaacaccaagaaccagaca

SEQ ID NO: 589574 - RNA, 21 nt, Human
aaagaaggaaacaaaaaaaaa

SEQ ID NO: 589575 - RNA, 21 nt, Human
aaauagccagugcauaaaaac

SEQ ID NO: 589576 - RNA, 24 nt, Human
aaauagccagugcauaaaaaccuu

SEQ ID NO: 589577 - RNA, 20 nt, Human
aaauagccagugcauaaaac

SEQ ID NO: 589578 - RNA, 21 nt, Human
aacaaaaaaagaaggaagaga

SEQ ID NO: 589579 - RNA, 20 nt, Human
aagaaaguaggaaagaagga

SEQ ID NO: 589580 - RNA, 20 nt, Human
aagaaggaaacaaaaaaaaa

SEQ ID NO: 589581 - RNA, 22 nt, Human
aagaaggaaacaaaaaaaaaaa

SEQ ID NO: 589582 - RNA, 27 nt, Human
aagaaggaaacaaaaaaaaagggaccc

SEQ ID NO: 589583 - RNA, 18 nt, Human
aaggaaacaaaaaaaaaa

SEQ ID NO: 589584 - RNA, 27 nt, Human
aaguaggaaagaaggaaacaaaaaaaa

SEQ ID NO: 589585 - RNA, 18 nt, Human
acaaaaaaaaaaaagaaa

SEQ ID NO: 589586 - RNA, 20 nt, Human
acaaaaaaaaaaaagaaaga

SEQ ID NO: 589587 - RNA, 21 nt, Human
acaaaaaaaaaaaagaaagaa

SEQ ID NO: 589588 - RNA, 20 nt, Human
acaaacaaaaaaagaaggaa

SEQ ID NO: 589589 - RNA, 22 nt, Human
acagaaagggaggauacccaga

SEQ ID NO: 589590 - RNA, 20 nt, Human
acaguaggccucugacauuc

SEQ ID NO: 589591 - RNA, 23 nt, Human
acucaaaccucucuccuuuuauu

SEQ ID NO: 589592 - RNA, 18 nt, Human
agaaaggaaggaaaggaa

SEQ ID NO: 589593 - RNA, 25 nt, Human
agaagaaaaugaauucuuugaagaa

SEQ ID NO: 589594 - RNA, 20 nt, Human
agaaggaagagaaaggaagg

SEQ ID NO: 589595 - RNA, 22 nt, Human
agagaaaggaaggaaaggaagg

SEQ ID NO: 589596 - RNA, 18 nt, Human
agcuuguuggaauccaaa

SEQ ID NO: 589597 - RNA, 23 nt, Human
aggaaagaaggaaacaaaaaaaa

SEQ ID NO: 589598 - RNA, 21 nt, Human
aggaaggagugaaagaaagua

SEQ ID NO: 589599 - RNA, 21 nt, Human
agggaggauacccagaacuca

SEQ ID NO: 589600 - RNA, 21 nt, Human
agugaaagaaaguaggaaaga

SEQ ID NO: 589601 - RNA, 22 nt, Human
auccacaaaauugugaccugau

SEQ ID NO: 589602 - RNA, 24 nt, Human
caaaacccaaaagcaaaaggguca

SEQ ID NO: 589603 - RNA, 25 nt, Human
caaacagucccuguuaugacugcca

SEQ ID NO: 589604 - RNA, 22 nt, Human
caaauagccagugcauaaaaac

SEQ ID NO: 589605 - RNA, 21 nt, Human
caacaaaaucaacccuuggga

SEQ ID NO: 589606 - RNA, 24 nt, Human
caagaaaagaacaauuuacaucca

SEQ ID NO: 589607 - RNA, 19 nt, Human
cacacugagcaaaacccaa

SEQ ID NO: 589608 - RNA, 18 nt, Human
caucuaaaaucagauacu

SEQ ID NO: 589609 - RNA, 20 nt, Human
cauuaccaagaaaagaacaa

SEQ ID NO: 589610 - RNA, 26 nt, Human
cauuuaaaaaaaaaaaaagcagucaa

SEQ ID NO: 589611 - RNA, 21 nt, Human
ccagcauuacuuauugacaag

SEQ ID NO: 589612 - RNA, 24 nt, Human
cgauuguaacccaaauccaaaaaa

SEQ ID NO: 589613 - RNA, 21 nt, Human
cucucuccuuuuauuuauaaa

SEQ ID NO: 589614 - RNA, 19 nt, Human
cugauaaauccaaguugug

SEQ ID NO: 589615 - RNA, 20 nt, Human
cuguauacaaauuguuaaaa

SEQ ID NO: 589616 - RNA, 23 nt, Human
gaucaucuaaaaucagauacuaa

SEQ ID NO: 589617 - RNA, 21 nt, Human
gcaauacugacaaacaguccc

SEQ ID NO: 589618 - RNA, 20 nt, Human
gcuuugucagaaaacauuuu

SEQ ID NO: 589619 - RNA, 24 nt, Human
ggaaagaaggaaacaaaaaaaaaa

SEQ ID NO: 589620 - RNA, 22 nt, Human
gggacaaagccaaagcauggaa

SEQ ID NO: 589621 - RNA, 23 nt, Human
guaaacucacuuuauuuuuaaau

SEQ ID NO: 589622 - RNA, 27 nt, Human
guaggccucugacauucucuaugcugg

SEQ ID NO: 589623 - RNA, 24 nt, Human
uaaaaaacaaacaaacaaacaaaa

SEQ ID NO: 589624 - RNA, 24 nt, Human
uaaauuggggaggcauuuaaaugu

SEQ ID NO: 589625 - RNA, 20 nt, Human
uaacaugauccuguaaguga

SEQ ID NO: 589626 - RNA, 21 nt, Human
uaacauggaagguacaccuuu

SEQ ID NO: 589627 - RNA, 21 nt, Human
uaacuaaauggcaaguaacau

SEQ ID NO: 589628 - RNA, 23 nt, Human
uaaggaacuccaaguccauguca

SEQ ID NO: 589629 - RNA, 19 nt, Human
uaaguaaauugagcggagg

SEQ ID NO: 589630 - RNA, 24 nt, Human
uaauuaaaaaacaaacaaacaaac

SEQ ID NO: 589631 - RNA, 19 nt, Human
uacaauuacacaguaggcc

SEQ ID NO: 589632 - RNA, 19 nt, Human
uacacaaaaaagaagaaaa

SEQ ID NO: 589633 - RNA, 19 nt, Human
uacacaguaggccucugac

SEQ ID NO: 589634 - RNA, 25 nt, Human
uaccaagaaaagaacaauuuacauc

SEQ ID NO: 589635 - RNA, 25 nt, Human
uagagacaccucuagggcuucaaac

SEQ ID NO: 589636 - RNA, 24 nt, Human
uaggaaagaaggaaacaaaaaaaa

SEQ ID NO: 589637 - RNA, 20 nt, Human
uaggagagguccagauugcg

SEQ ID NO: 589638 - RNA, 22 nt, Human
uaguuaccagggacaaagccaa

SEQ ID NO: 589639 - RNA, 25 nt, Human
ucaacauuaccaagaaaagaacaau

SEQ ID NO: 589640 - RNA, 21 nt, Human
ucaacccuugggaaaauugcu

SEQ ID NO: 589641 - RNA, 24 nt, Human
ucccaguaauuaaaaaacaaacaa

SEQ ID NO: 589642 - RNA, 21 nt, Human
ucuuugguuuaaaucuucauu

SEQ ID NO: 589643 - RNA, 25 nt, Human
ugaaagaaaguaggaaagaaggaaa

SEQ ID NO: 589644 - RNA, 21 nt, Human
ugacagcaauacugacaaaca

SEQ ID NO: 589645 - RNA, 25 nt, Human
ugacaguuuccugugagauauuggu

SEQ ID NO: 589646 - RNA, 18 nt, Human
ugagcaaaacccaaaagc

SEQ ID NO: 589647 - RNA, 24 nt, Human
ugauaaauccaaguuguguaagga

SEQ ID NO: 589648 - RNA, 18 nt, Human
ugauacacaaaaaagaag

SEQ ID NO: 589649 - RNA, 25 nt, Human
ugaucaacauuaccaagaaaagaac

SEQ ID NO: 589650 - RNA, 19 nt, Human
ugaugaguuuccgaaggcc

SEQ ID NO: 589651 - RNA, 21 nt, Human
ugcaaaaugaugaguuuccga

SEQ ID NO: 589652 - RNA, 18 nt, Human
ugccagaauuuaaccucu

SEQ ID NO: 589653 - RNA, 18 nt, Human
uggaauugaaguuucauu

SEQ ID NO: 589654 - RNA, 23 nt, Human
uggaauuuugguaaacucacuuu

SEQ ID NO: 589655 - RNA, 21 nt, Human
uggagcgaauccuguuccauu

SEQ ID NO: 589656 - RNA, 19 nt, Human
ugggaaaauugcucuuugg

SEQ ID NO: 589657 - RNA, 23 nt, Human
uguaacccaaauccaaaaaauca

SEQ ID NO: 589658 - RNA, 21 nt, Human
ugucugaagcuuauuguagga

SEQ ID NO: 589659 - RNA, 22 nt, Human
ugugagaucccuguugcaugcu

SEQ ID NO: 589660 - RNA, 22 nt, Human
ugugcagauaaguaauuuuguu

SEQ ID NO: 589661 - RNA, 21 nt, Human
uuaccaagaaaagaacaauua

SEQ ID NO: 589662 - RNA, 24 nt, Human
uucaaacauuuaccucuccuuccc

SEQ ID NO: 589663 - RNA, 24 nt, Human
uucagugcuuugucagaaaacauu

SEQ ID NO: 589664 - RNA, 28 nt, Human
uuccagcaacaaggccuuaggguacccc

SEQ ID NO: 589665 - RNA, 23 nt, Human
uucuuccagcaacaaggccuuag

SEQ ID NO: 589666 - RNA, 18 nt, Human
uugaucuuggaaaacugg

SEQ ID NO: 589667 - RNA, 23 nt, Human
uugaucuuggaaaacugguugug

SEQ ID NO: 589668 - RNA, 23 nt, Human
uuggcuaauggagcgaauccugu

SEQ ID NO: 589669 - RNA, 29 nt, Human
uuguauguguguuuuuaaguccaaccccu

SEQ ID NO: 589670 - RNA, 20 nt, Human
uugucugcucacuaacauga

SEQ ID NO: 589671 - RNA, 28 nt, Human
uugugcuccagguggagcuccggguccg

SEQ ID NO: 589672 - RNA, 21 nt, Human
uuuaaaaaaaaaaaaagcagu

SEQ ID NO: 589673 - RNA, 22 nt, Human
uuuauuauugcuagaucaucca

SEQ ID NO: 589674 - RNA, 20 nt, Human
uuuccugugagauauuggug

SEQ ID NO: 589675 - RNA, 24 nt, Human
aaacuggagugaaaaugauuucca

SEQ ID NO: 589676 - RNA, 18 nt, Human
accuugaggcuuaaagag

SEQ ID NO: 589677 - RNA, 20 nt, Human
agagcaaggaaggaaaaugu

SEQ ID NO: 589678 - RNA, 21 nt, Human
agcauuuuuggaagaaaggca

SEQ ID NO: 589679 - RNA, 19 nt, Human
aggcaccagauaaguccaa

SEQ ID NO: 589680 - RNA, 20 nt, Human
auaaaaugcuaacaaaaaaa

SEQ ID NO: 589681 - RNA, 25 nt, Human
caaugccauaaaaugcuaacaaaaa

SEQ ID NO: 589682 - RNA, 19 nt, Human
ccacacaacgaaggccgcg

SEQ ID NO: 589683 - RNA, 20 nt, Human
ccuuaaagucaguaaauugc

SEQ ID NO: 589684 - RNA, 22 nt, Human
cuguucagccaggagacuaagu

SEQ ID NO: 589685 - RNA, 21 nt, Human
cuugaacaucaaagauguuug

SEQ ID NO: 589686 - RNA, 21 nt, Human
uaaaacagagcccuguaucac

SEQ ID NO: 589687 - RNA, 24 nt, Human
uaaaacagagcccuguaucacaga

SEQ ID NO: 589688 - RNA, 23 nt, Human
uaaauugcauaaaaguacucuga

SEQ ID NO: 589689 - RNA, 21 nt, Human
uaagucucagcaagucagucu

SEQ ID NO: 589690 - RNA, 18 nt, Human
uacuguuuuccuuaaagu

SEQ ID NO: 589691 - RNA, 22 nt, Human
ucaguaaauugcauaaaaguac

SEQ ID NO: 589692 - RNA, 20 nt, Human
uccuuaaagucaguaaauug

SEQ ID NO: 589693 - RNA, 19 nt, Human
ugcagccaggagacaaugc

SEQ ID NO: 589694 - RNA, 18 nt, Human
ugccauaaaaugcuaaca

SEQ ID NO: 589695 - RNA, 20 nt, Human
ugccauaaaaugcuaacaaa

SEQ ID NO: 589696 - RNA, 18 nt, Human
ugucaaaguagaagcugg

SEQ ID NO: 589697 - RNA, 19 nt, Human
aagaccccacccccaauac

SEQ ID NO: 589698 - RNA, 18 nt, Human
aagcacuaaucccauuca

SEQ ID NO: 589699 - RNA, 20 nt, Human
aagcagcagggagucugcgg

SEQ ID NO: 589700 - RNA, 23 nt, Human
aagggcauccacugucaaaaugu

SEQ ID NO: 589701 - RNA, 26 nt, Human
aaucaccucuccaagaccccaccccc

SEQ ID NO: 589702 - RNA, 23 nt, Human
aaucccauucaucagggcuccac

SEQ ID NO: 589703 - RNA, 18 nt, Human
aaucgcuugaaccuggga

SEQ ID NO: 589704 - RNA, 24 nt, Human
aaucgcuugaaccugggaggcaga

SEQ ID NO: 589705 - RNA, 19 nt, Human
acacacggugaguagugac

SEQ ID NO: 589706 - RNA, 18 nt, Human
acaccacuauacuccagc

SEQ ID NO: 589707 - RNA, 22 nt, Human
acaccacuauacuccagccugg

SEQ ID NO: 589708 - RNA, 24 nt, Human
accacuauacuccagccuggguga

SEQ ID NO: 589709 - RNA, 22 nt, Human
accccacccccaauaccauccc

SEQ ID NO: 589710 - RNA, 22 nt, Human
acccucauaaccuaaucaccuc

SEQ ID NO: 589711 - RNA, 20 nt, Human
accuguaauuccagcuacuc

SEQ ID NO: 589712 - RNA, 18 nt, Human
acuauacuccagccuggg

SEQ ID NO: 589713 - RNA, 24 nt, Human
acuauacuccagccugggugacag

SEQ ID NO: 589714 - RNA, 21 nt, Human
acuguugaauuccauuuucua

SEQ ID NO: 589715 - RNA, 19 nt, Human
agaaagccguagccugaaa

SEQ ID NO: 589716 - RNA, 22 nt, Human
agaaucgcuugaaccugggagg

SEQ ID NO: 589717 - RNA, 20 nt, Human
agagguugcagugagccaag

SEQ ID NO: 589718 - RNA, 23 nt, Human
agagguugcagugagccaagauc

SEQ ID NO: 589719 - RNA, 24 nt, Human
agagguugcagugagccaagauca

SEQ ID NO: 589720 - RNA, 26 nt, Human
agccugcagccucauggccacagucu

SEQ ID NO: 589721 - RNA, 24 nt, Human
agccugggugacagagcgagacuc

SEQ ID NO: 589722 - RNA, 18 nt, Human
agcuguguguacaagcag

SEQ ID NO: 589723 - RNA, 22 nt, Human
aggcacucaaagcuuccuguuc

SEQ ID NO: 589724 - RNA, 24 nt, Human
aggcagagguugcagugagccaag

SEQ ID NO: 589725 - RNA, 22 nt, Human
aggcaggagaaucgcuugaacc

SEQ ID NO: 589726 - RNA, 24 nt, Human
aggcaggagaaucgcuugaaccug

SEQ ID NO: 589727 - RNA, 20 nt, Human
aggcugaggcaggagaaucg

SEQ ID NO: 589728 - RNA, 24 nt, Human
aggcugaggcaggagaaucgcuug

SEQ ID NO: 589729 - RNA, 23 nt, Human
agggaugcgaagcagcagggagu

SEQ ID NO: 589730 - RNA, 24 nt, Human
aggggagggaggggaagggacauc

SEQ ID NO: 589731 - RNA, 24 nt, Human
auacuccagccugggugacagagc

SEQ ID NO: 589732 - RNA, 24 nt, Human
aucacaccacuauacuccagccug

SEQ ID NO: 589733 - RNA, 18 nt, Human
caaagcuuccuguucgac

SEQ ID NO: 589734 - RNA, 24 nt, Human
cacaggagggaugcgaagcagcag

SEQ ID NO: 589735 - RNA, 25 nt, Human
caccagccugcagccucauggccac

SEQ ID NO: 589736 - RNA, 21 nt, Human
caccccuaccccuggguguuc

SEQ ID NO: 589737 - RNA, 21 nt, Human
caccucuccaagaccccaccc

SEQ ID NO: 589738 - RNA, 22 nt, Human
caccugccuccugggccccagg

SEQ ID NO: 589739 - RNA, 24 nt, Human
cacuauacuccagccugggugaca

SEQ ID NO: 589740 - RNA, 25 nt, Human
cacuguccagaucuaacuccacacc

SEQ ID NO: 589741 - RNA, 19 nt, Human
cagaccuguaauuccagcu

SEQ ID NO: 589742 - RNA, 28 nt, Human
cagcacccuaaaugacagugcccagggg

SEQ ID NO: 589743 - RNA, 18 nt, Human
cagcccaggucccacaaa

SEQ ID NO: 589744 - RNA, 24 nt, Human
cagcccaggucccacaaaccaucc

SEQ ID NO: 589745 - RNA, 24 nt, Human
cagcuacucgagaggcugaggcag

SEQ ID NO: 589746 - RNA, 19 nt, Human
caggcugcacuuugaaaac

SEQ ID NO: 589747 - RNA, 23 nt, Human
cagggugggggccucagucugcu

SEQ ID NO: 589748 - RNA, 22 nt, Human
cauaaccuaaucaccucuccaa

SEQ ID NO: 589749 - RNA, 24 nt, Human
ccacccucauaaccuaaucaccuc

SEQ ID NO: 589750 - RNA, 20 nt, Human
ccacuauacuccagccuggg

SEQ ID NO: 589751 - RNA, 21 nt, Human
ccacuauacuccagccugggu

SEQ ID NO: 589752 - RNA, 24 nt, Human
ccacuauacuccagccugggugac

SEQ ID NO: 589753 - RNA, 21 nt, Human
ccccaggccaagucaggugug

SEQ ID NO: 589754 - RNA, 24 nt, Human
ccccuccuacugggcucuuucuca

SEQ ID NO: 589755 - RNA, 20 nt, Human
cccgcagccuccggcuagcc

SEQ ID NO: 589756 - RNA, 23 nt, Human
cccuauuagccuccuauaagaaa

SEQ ID NO: 589757 - RNA, 20 nt, Human
cccuuuggggauuagggcuu

SEQ ID NO: 589758 - RNA, 19 nt, Human
ccuacugggcucuuucuca

SEQ ID NO: 589759 - RNA, 25 nt, Human
ccuaggcuuuuucagggugggggag

SEQ ID NO: 589760 - RNA, 19 nt, Human
ccuccuacugggcucuuuc

SEQ ID NO: 589761 - RNA, 23 nt, Human
ccucuccaagaccccacccccaa

SEQ ID NO: 589762 - RNA, 25 nt, Human
ccugggaggcagagguugcagugag

SEQ ID NO: 589763 - RNA, 23 nt, Human
ccugggccccaggccaagucagg

SEQ ID NO: 589764 - RNA, 22 nt, Human
ccugggugacagagcgagacuc

SEQ ID NO: 589765 - RNA, 22 nt, Human
ccuguaauuccagcuacucgag

SEQ ID NO: 589766 - RNA, 25 nt, Human
ccugugcugcaaucugcugucauag

SEQ ID NO: 589767 - RNA, 21 nt, Human
cgacaggccugggucugggac

SEQ ID NO: 589768 - RNA, 22 nt, Human
cggcauggacucucaguucagg

SEQ ID NO: 589769 - RNA, 22 nt, Human
cggucuuccccccgcagccucc

SEQ ID NO: 589770 - RNA, 19 nt, Human
cucaaagcuuccuguucga

SEQ ID NO: 589771 - RNA, 21 nt, Human
cucacuguugcauguuggggc

SEQ ID NO: 589772 - RNA, 20 nt, Human
cuccaagaccccacccccaa

SEQ ID NO: 589773 - RNA, 23 nt, Human
cuccaagaccccacccccaauac

SEQ ID NO: 589774 - RNA, 18 nt, Human
cugaagacugcuguguac

SEQ ID NO: 589775 - RNA, 19 nt, Human
cugaagacugcuguguacc

SEQ ID NO: 589776 - RNA, 19 nt, Human
cugcaccccuaccccuggg

SEQ ID NO: 589777 - RNA, 20 nt, Human
cuggagacacuguagaacac

SEQ ID NO: 589778 - RNA, 24 nt, Human
cuuauggucucacuguugcauguu

SEQ ID NO: 589779 - RNA, 23 nt, Human
cuuggcagcgugauuugcccucu

SEQ ID NO: 589780 - RNA, 18 nt, Human
cuuucuaggucucugaau

SEQ ID NO: 589781 - RNA, 25 nt, Human
cuuuucaggcuccgaagaacucuga

SEQ ID NO: 589782 - RNA, 22 nt, Human
gaaaacacaugcugacagcagc

SEQ ID NO: 589783 - RNA, 22 nt, Human
gaccuguaauuccagcuacucg

SEQ ID NO: 589784 - RNA, 19 nt, Human
gcagcuccagguggcaucc

SEQ ID NO: 589785 - RNA, 22 nt, Human
gcucuuucucaaaccccuuuuc

SEQ ID NO: 589786 - RNA, 20 nt, Human
gcuuuugaugccugccuugg

SEQ ID NO: 589787 - RNA, 22 nt, Human
ggaggugauuuguacagcaccc

SEQ ID NO: 589788 - RNA, 23 nt, Human
ggauuagggcuucaacgugaauu

SEQ ID NO: 589789 - RNA, 18 nt, Human
ggccugcuggguggccag

SEQ ID NO: 589790 - RNA, 23 nt, Human
gggaugcgaagcagcagggaguc

SEQ ID NO: 589791 - RNA, 20 nt, Human
ggggcuggaggggagggccc

SEQ ID NO: 589792 - RNA, 20 nt, Human
gugcagaaggccacuuuggc

SEQ ID NO: 589793 - RNA, 25 nt, Human
uaaaugacagugcccaggaaugucc

SEQ ID NO: 589794 - RNA, 19 nt, Human
uaaccuaaucaccucucca

SEQ ID NO: 589795 - RNA, 19 nt, Human
uacagcacccuaaaugacu

SEQ ID NO: 589796 - RNA, 22 nt, Human
uacuccagccugggugacagag

SEQ ID NO: 589797 - RNA, 24 nt, Human
uacuccagccugggugacagagcg

SEQ ID NO: 589798 - RNA, 19 nt, Human
uauaaagcacuaaucccau

SEQ ID NO: 589799 - RNA, 21 nt, Human
uauagcauauaucacccugaa

SEQ ID NO: 589800 - RNA, 24 nt, Human
ucacugcccacaccugcaccccua

SEQ ID NO: 589801 - RNA, 23 nt, Human
ucagggcuccacccucauaaccu

SEQ ID NO: 589802 - RNA, 20 nt, Human
uccaagaccccacccccaau

SEQ ID NO: 589803 - RNA, 20 nt, Human
uccacugucaaaauguggcc

SEQ ID NO: 589804 - RNA, 23 nt, Human
uccagccugggugacagagcgag

SEQ ID NO: 589805 - RNA, 24 nt, Human
uccagccugggugacagagcgaga

SEQ ID NO: 589806 - RNA, 20 nt, Human
uccagguggcauccagguuu

SEQ ID NO: 589807 - RNA, 19 nt, Human
uccgaagaacucugaggca

SEQ ID NO: 589808 - RNA, 25 nt, Human
uccugccccuccuacugggcucuuu

SEQ ID NO: 589809 - RNA, 21 nt, Human
uccugccugcaguggaggcca

SEQ ID NO: 589810 - RNA, 18 nt, Human
uccuggugagggcucucu

SEQ ID NO: 589811 - RNA, 18 nt, Human
ucgcuugaaccugggagg

SEQ ID NO: 589812 - RNA, 22 nt, Human
ucuacugaguuuauuuucccca

SEQ ID NO: 589813 - RNA, 22 nt, Human
ucucacuguugcauguuggggc

SEQ ID NO: 589814 - RNA, 21 nt, Human
ucuccaagaccccacccccaa

SEQ ID NO: 589815 - RNA, 18 nt, Human
ucugcggucuuccccccg

SEQ ID NO: 589816 - RNA, 23 nt, Human
ucuguggggucagcugucacgcu

SEQ ID NO: 589817 - RNA, 22 nt, Human
ucuuacaguucuggaagcuggg

SEQ ID NO: 589818 - RNA, 20 nt, Human
ucuuacaguucuggaagcuu

SEQ ID NO: 589819 - RNA, 24 nt, Human
ugaaaacacaugcugacagcagcg

SEQ ID NO: 589820 - RNA, 24 nt, Human
ugaaccugggaggcagagguugca

SEQ ID NO: 589821 - RNA, 25 nt, Human
ugaauugggagcauaugaacauuca

SEQ ID NO: 589822 - RNA, 19 nt, Human
ugacaucguggaggaaggc

SEQ ID NO: 589823 - RNA, 25 nt, Human
ugaccacaucuuacacguuuuuagc

SEQ ID NO: 589824 - RNA, 21 nt, Human
ugacuccugcacagggcgcac

SEQ ID NO: 589825 - RNA, 18 nt, Human
ugaggaagacaauggucc

SEQ ID NO: 589826 - RNA, 20 nt, Human
ugaggcaggagaaucgcuug

SEQ ID NO: 589827 - RNA, 24 nt, Human
ugaggcaggagaaucgcuugaacc

SEQ ID NO: 589828 - RNA, 25 nt, Human
ugaggcaggagaaucgcuugaaccu

SEQ ID NO: 589829 - RNA, 21 nt, Human
ugaugucccacugggggcugg

SEQ ID NO: 589830 - RNA, 21 nt, Human
ugauuugcccucugguuccug

SEQ ID NO: 589831 - RNA, 20 nt, Human
ugauuuguacagcacccuaa

SEQ ID NO: 589832 - RNA, 18 nt, Human
ugccgggcugacuccugc

SEQ ID NO: 589833 - RNA, 20 nt, Human
ugccuccugggccccaggcc

SEQ ID NO: 589834 - RNA, 23 nt, Human
uggaagcugggaagucucaaggu

SEQ ID NO: 589835 - RNA, 23 nt, Human
uggaggaaggcacucaaagcuuc

SEQ ID NO: 589836 - RNA, 24 nt, Human
ugggaggcagagguugcagugagc

SEQ ID NO: 589837 - RNA, 20 nt, Human
ugggccccaggccaagucag

SEQ ID NO: 589838 - RNA, 20 nt, Human
ugggcucuuucucaaacccc

SEQ ID NO: 589839 - RNA, 24 nt, Human
ugggcucuuucucaaaccccuuuu

SEQ ID NO: 589840 - RNA, 25 nt, Human
ugggcucuuucucaaaccccuuuuc

SEQ ID NO: 589841 - RNA, 23 nt, Human
ugggggcuggaggggagggcccu

SEQ ID NO: 589842 - RNA, 20 nt, Human
uggggucagcugucacgcuc

SEQ ID NO: 589843 - RNA, 18 nt, Human
uguguacacgauagugug

SEQ ID NO: 589844 - RNA, 20 nt, Human
uguuggcaagaaaaaccacu

SEQ ID NO: 589845 - RNA, 20 nt, Human
uuagggcuucaacgugaauu

SEQ ID NO: 589846 - RNA, 21 nt, Human
uuauuucuuacaguucuggaa

SEQ ID NO: 589847 - RNA, 20 nt, Human
uucacuguccagaucuaacu

SEQ ID NO: 589848 - RNA, 23 nt, Human
uucaggcugcuguaacagaaagc

SEQ ID NO: 589849 - RNA, 24 nt, Human
uugaaccugggaggcagagguugc

SEQ ID NO: 589850 - RNA, 20 nt, Human
uugcagugagccaagaucac

SEQ ID NO: 589851 - RNA, 22 nt, Human
uuggcagcgugauuugcccucu

SEQ ID NO: 589852 - RNA, 24 nt, Human
aaagacauuggcagcaacaaagga

SEQ ID NO: 589853 - RNA, 21 nt, Human
aaauaggcaccuccaaagucu

SEQ ID NO: 589854 - RNA, 18 nt, Human
aagacauuggcagcaaca

SEQ ID NO: 589855 - RNA, 18 nt, Human
aagcauucacccaugacc

SEQ ID NO: 589856 - RNA, 21 nt, Human
aaggacacacaaugacugaaa

SEQ ID NO: 589857 - RNA, 20 nt, Human
acaucugcaaguuaaaauug

SEQ ID NO: 589858 - RNA, 23 nt, Human
accccguggguccccuauucccc

SEQ ID NO: 589859 - RNA, 20 nt, Human
acuccaucuacccagaacaa

SEQ ID NO: 589860 - RNA, 22 nt, Human
agacauuggcagcaacaaagga

SEQ ID NO: 589861 - RNA, 21 nt, Human
auccauccucuuccugcucag

SEQ ID NO: 589862 - RNA, 18 nt, Human
cacacuguacaaacugga

SEQ ID NO: 589863 - RNA, 21 nt, Human
cacagacuugacuaaaaugaa

SEQ ID NO: 589864 - RNA, 23 nt, Human
cacccuggccccauucccaguuc

SEQ ID NO: 589865 - RNA, 21 nt, Human
cacuuacagcagaaagcauuc

SEQ ID NO: 589866 - RNA, 21 nt, Human
cagaaaaaauaggcaccucca

SEQ ID NO: 589867 - RNA, 23 nt, Human
cagaaaaaauaggcaccuccaaa

SEQ ID NO: 589868 - RNA, 24 nt, Human
caucccacuaugcugauuccuacu

SEQ ID NO: 589869 - RNA, 19 nt, Human
caugaaucauuucuccuuc

SEQ ID NO: 589870 - RNA, 21 nt, Human
ccacugaggccaugcugagga

SEQ ID NO: 589871 - RNA, 20 nt, Human
ccagagccacauguucacag

SEQ ID NO: 589872 - RNA, 23 nt, Human
cccgcugagacucccuggaccca

SEQ ID NO: 589873 - RNA, 18 nt, Human
ccgcugagacucccugga

SEQ ID NO: 589874 - RNA, 22 nt, Human
ccucuggaagcuaauauggagc

SEQ ID NO: 589875 - RNA, 19 nt, Human
cuaccuacagaugggcaaa

SEQ ID NO: 589876 - RNA, 26 nt, Human
cuauccagagccacauguucacaguu

SEQ ID NO: 589877 - RNA, 19 nt, Human
cucuaaaagacacuuacag

SEQ ID NO: 589878 - RNA, 21 nt, Human
cucucagugcccugagcgauc

SEQ ID NO: 589879 - RNA, 24 nt, Human
cugauuccuacucuaaaagacacu

SEQ ID NO: 589880 - RNA, 22 nt, Human
cugcugggcaucccacuaugcu

SEQ ID NO: 589881 - RNA, 21 nt, Human
cuuccugcucaguugcucccc

SEQ ID NO: 589882 - RNA, 26 nt, Human
cuugcagugauuuagacacuucuucu

SEQ ID NO: 589883 - RNA, 18 nt, Human
cuuuuccaaaauggccaa

SEQ ID NO: 589884 - RNA, 21 nt, Human
gacagggagagaggggagacu

SEQ ID NO: 589885 - RNA, 22 nt, Human
ggacacacaaugacugaaaaca

SEQ ID NO: 589886 - RNA, 21 nt, Human
gggagacugagcugagaggga

SEQ ID NO: 589887 - RNA, 26 nt, Human
uaaaagacacuuacagcagaaagcau

SEQ ID NO: 589888 - RNA, 22 nt, Human
uagaaguuccccgcugagacuc

SEQ ID NO: 589889 - RNA, 18 nt, Human
ucaacaucugauacaaug

SEQ ID NO: 589890 - RNA, 21 nt, Human
ucacaguucucuagcaagcag

SEQ ID NO: 589891 - RNA, 19 nt, Human
ucccuggacccaugguuug

SEQ ID NO: 589892 - RNA, 18 nt, Human
ucugcaaguuaaaauugc

SEQ ID NO: 589893 - RNA, 24 nt, Human
ugacuaaaaugaauauauuauucu

SEQ ID NO: 589894 - RNA, 22 nt, Human
ugaggccaugcugaggagcugg

SEQ ID NO: 589895 - RNA, 26 nt, Human
ugauccauccucuuccugcucaguug

SEQ ID NO: 589896 - RNA, 23 nt, Human
ugauuccuacucuaaaagacacu

SEQ ID NO: 589897 - RNA, 21 nt, Human
uggagcagcagucacucuauc

SEQ ID NO: 589898 - RNA, 21 nt, Human
ugggagguguggaugcacuga

SEQ ID NO: 589899 - RNA, 18 nt, Human
ugggauggaaugcaggac

SEQ ID NO: 589900 - RNA, 26 nt, Human
ugucuugcuuuuccaaaauggccaau

SEQ ID NO: 589901 - RNA, 22 nt, Human
uuagacacuucuucugaagccu

SEQ ID NO: 589902 - RNA, 22 nt, Human
uuaugaaggaaauauucugucc

SEQ ID NO: 589903 - RNA, 20 nt, Human
uuucugcuggauuuuugugu

SEQ ID NO: 589904 - RNA, 19 nt, Human
aaaaacgguaagaaaucaa

SEQ ID NO: 589905 - RNA, 19 nt, Human
aacacagugaaacccuguc

SEQ ID NO: 589906 - RNA, 20 nt, Human
aacacagugaaacccugucu

SEQ ID NO: 589907 - RNA, 21 nt, Human
aacacagugaaacccugucuc

SEQ ID NO: 589908 - RNA, 20 nt, Human
aaccagaacacgugguuucc

SEQ ID NO: 589909 - RNA, 21 nt, Human
aaccagaacacgugguuucca

SEQ ID NO: 589910 - RNA, 22 nt, Human
aaccagaacacgugguuuccaa

SEQ ID NO: 589911 - RNA, 20 nt, Human
acagagcaagacuccgucuc

SEQ ID NO: 589912 - RNA, 23 nt, Human
acagagcaagacuccgucucaaa

SEQ ID NO: 589913 - RNA, 24 nt, Human
acagagcaagacuccgucucaaaa

SEQ ID NO: 589914 - RNA, 24 nt, Human
acccugucucuacuaaaaauacaa

SEQ ID NO: 589915 - RNA, 24 nt, Human
accgcgccacugcacuccagccug

SEQ ID NO: 589916 - RNA, 19 nt, Human
acgaauacaucuucaucac

SEQ ID NO: 589917 - RNA, 24 nt, Human
acugcacuccagccugggcgacag

SEQ ID NO: 589918 - RNA, 26 nt, Human
acugcacuccagccugggcgacagag

SEQ ID NO: 589919 - RNA, 23 nt, Human
agaaauaggaccuccagaaggaa

SEQ ID NO: 589920 - RNA, 22 nt, Human
agaccgcgccacugcacuccag

SEQ ID NO: 589921 - RNA, 19 nt, Human
agacuuuucuggaagaugg

SEQ ID NO: 589922 - RNA, 22 nt, Human
agaggaggaaaaaauuuaagag

SEQ ID NO: 589923 - RNA, 24 nt, Human
agccugggcgacagagcaagacuc

SEQ ID NO: 589924 - RNA, 20 nt, Human
aggaggggagaggaaggauu

SEQ ID NO: 589925 - RNA, 21 nt, Human
aggcaggagaauggcgugaac

SEQ ID NO: 589926 - RNA, 24 nt, Human
aggcaggagaauggcgugaacccg

SEQ ID NO: 589927 - RNA, 22 nt, Human
aggcagggcgcgguggcucacg

SEQ ID NO: 589928 - RNA, 21 nt, Human
aggccgaggcgggcggaucac

SEQ ID NO: 589929 - RNA, 23 nt, Human
aggccgaggcgggcggaucacaa

SEQ ID NO: 589930 - RNA, 24 nt, Human
aggcggagcuugcagugagccaag

SEQ ID NO: 589931 - RNA, 24 nt, Human
aggcgggcggaucacaaggucagg

SEQ ID NO: 589932 - RNA, 19 nt, Human
aggcugaggcaggagaaug

SEQ ID NO: 589933 - RNA, 21 nt, Human
aguauagaggaagaggaggaa

SEQ ID NO: 589934 - RNA, 24 nt, Human
auaagcaaagccucccaaucccaa

SEQ ID NO: 589935 - RNA, 20 nt, Human
auaauaacaugaggcaaccc

SEQ ID NO: 589936 - RNA, 19 nt, Human
augggaggaggggagagga

SEQ ID NO: 589937 - RNA, 18 nt, Human
caaaacagagccaaaaac

SEQ ID NO: 589938 - RNA, 21 nt, Human
caagacuccgucucaaaaaaa

SEQ ID NO: 589939 - RNA, 18 nt, Human
caaucccaaacaauacga

SEQ ID NO: 589940 - RNA, 20 nt, Human
cacgccuguaaucccagcug

SEQ ID NO: 589941 - RNA, 19 nt, Human
cacugcacuccagccuggg

SEQ ID NO: 589942 - RNA, 20 nt, Human
cacugcacuccagccugggc

SEQ ID NO: 589943 - RNA, 22 nt, Human
cacugcacuccagccugggcga

SEQ ID NO: 589944 - RNA, 23 nt, Human
cacugcacuccagccugggcgac

SEQ ID NO: 589945 - RNA, 24 nt, Human
cacugcacuccagccugggcgaca

SEQ ID NO: 589946 - RNA, 27 nt, Human
cacugcacuccagccugggcgacagag

SEQ ID NO: 589947 - RNA, 22 nt, Human
cagcaaauacaagaccucuuuc

SEQ ID NO: 589948 - RNA, 24 nt, Human
cagcugcucgggaggcugaggcag

SEQ ID NO: 589949 - RNA, 24 nt, Human
cagcuguuagggaggccgaggcgg

SEQ ID NO: 589950 - RNA, 22 nt, Human
cauggaaaccagaacacguggu

SEQ ID NO: 589951 - RNA, 22 nt, Human
ccaaccauacuccacccuccau

SEQ ID NO: 589952 - RNA, 18 nt, Human
ccaagaccgcgccacugc

SEQ ID NO: 589953 - RNA, 24 nt, Human
ccaauaggaaaaaaaaaaaaagaa

SEQ ID NO: 589954 - RNA, 20 nt, Human
ccaaucccaaacaauacgaa

SEQ ID NO: 589955 - RNA, 20 nt, Human
ccacugcacuccagccuggg

SEQ ID NO: 589956 - RNA, 21 nt, Human
ccacugcacuccagccugggc

SEQ ID NO: 589957 - RNA, 21 nt, Human
ccacugcacuccagccugggc

SEQ ID NO: 589958 - RNA, 23 nt, Human
ccacugcacuccagccugggcga

SEQ ID NO: 589959 - RNA, 24 nt, Human
ccacugcacuccagccugggcgac

SEQ ID NO: 589960 - RNA, 22 nt, Human
ccuggcuaacacagugaaaccc

SEQ ID NO: 589961 - RNA, 24 nt, Human
ccuggcuaacacagugaaacccug

SEQ ID NO: 589962 - RNA, 22 nt, Human
ccugggcgacagagcaagacuc

SEQ ID NO: 589963 - RNA, 22 nt, Human
ccuguaaucccagcuguuaggg

SEQ ID NO: 589964 - RNA, 21 nt, Human
ccuguagucccagcugcucgg

SEQ ID NO: 589965 - RNA, 24 nt, Human
cgagaccauccuggcuaacacagu

SEQ ID NO: 589966 - RNA, 23 nt, Human
cgccuguaaucccagcuguuagg

SEQ ID NO: 589967 - RNA, 23 nt, Human
cgccuguagucccagcugcucgg

SEQ ID NO: 589968 - RNA, 24 nt, Human
cgccuguagucccagcugcucggg

SEQ ID NO: 589969 - RNA, 22 nt, Human
cgguaagaaaucaauuaaguau

SEQ ID NO: 589970 - RNA, 18 nt, Human
cucaaaaaaaaaaaaaaa

SEQ ID NO: 589971 - RNA, 20 nt, Human
cucacgccuguaaucccagc

SEQ ID NO: 589972 - RNA, 20 nt, Human
cucacgccuguaaucccagc

SEQ ID NO: 589973 - RNA, 20 nt, Human
cucaucgaaacacucgguga

SEQ ID NO: 589974 - RNA, 22 nt, Human
cuccaaccauacuccacccucc

SEQ ID NO: 589975 - RNA, 19 nt, Human
cuccgucucaaaaaaaaaa

SEQ ID NO: 589976 - RNA, 18 nt, Human
cugaaauugaguaauauc

SEQ ID NO: 589977 - RNA, 18 nt, Human
cuggcuaacacagugaaa

SEQ ID NO: 589978 - RNA, 24 nt, Human
cuggcuaacacagugaaacccugu

SEQ ID NO: 589979 - RNA, 24 nt, Human
gaacacgugguuuccaaacaagaa

SEQ ID NO: 589980 - RNA, 18 nt, Human
gagccaaaaacgguaaga

SEQ ID NO: 589981 - RNA, 18 nt, Human
gagcuugcagugagccaa

SEQ ID NO: 589982 - RNA, 23 nt, Human
gagcuugcagugagccaagaccg

SEQ ID NO: 589983 - RNA, 19 nt, Human
gaggaggggagaggaagga

SEQ ID NO: 589984 - RNA, 24 nt, Human
gaggcgggcggaucacaaggucag

SEQ ID NO: 589985 - RNA, 23 nt, Human
gauaggcaucauggaaaccagaa

SEQ ID NO: 589986 - RNA, 24 nt, Human
gauauagcaaaacagagccaaaaa

SEQ ID NO: 589987 - RNA, 20 nt, Human
gcaaaacagagccaaaaacg

SEQ ID NO: 589988 - RNA, 24 nt, Human
gcacuccagccugggcgacagagc

SEQ ID NO: 589989 - RNA, 20 nt, Human
gccaagaccgcgccacugca

SEQ ID NO: 589990 - RNA, 22 nt, Human
gccacugcacuccagccugggc

SEQ ID NO: 589991 - RNA, 24 nt, Human
gccacugcacuccagccugggcga

SEQ ID NO: 589992 - RNA, 24 nt, Human
gcuaacacagugaaacccugucuc

SEQ ID NO: 589993 - RNA, 22 nt, Human
gcugaggcaggagaauggcgug

SEQ ID NO: 589994 - RNA, 20 nt, Human
ggaaaaaaaaaaaaagaaac

SEQ ID NO: 589995 - RNA, 18 nt, Human
ggagcuugcagugagcca

SEQ ID NO: 589996 - RNA, 20 nt, Human
ggagcuugcagugagccaag

SEQ ID NO: 589997 - RNA, 24 nt, Human
ggaugggaggaggggagaggaagg

SEQ ID NO: 589998 - RNA, 18 nt, Human
ggcagggcgcgguggcuc

SEQ ID NO: 589999 - RNA, 23 nt, Human
ggcgcgguggcucacgccuguaa

SEQ ID NO: 590000 - RNA, 21 nt, Human
ggcggaucacaaggucaggag

SEQ ID NO: 590001 - RNA, 25 nt, Human
ggcuccaaccauacuccacccucca

SEQ ID NO: 590002 - RNA, 23 nt, Human
gggaggccgaggcgggcggauca

SEQ ID NO: 590003 - RNA, 20 nt, Human
gggaugggaggaggggagag

SEQ ID NO: 590004 - RNA, 24 nt, Human
gggaugggaggaggggagaggaag

SEQ ID NO: 590005 - RNA, 24 nt, Human
gggcgagguggcgggcgccuguag

SEQ ID NO: 590006 - RNA, 23 nt, Human
gguggcgggcgccuguaguccca

SEQ ID NO: 590007 - RNA, 23 nt, Human
gguggcucacgccuguaauccca

SEQ ID NO: 590008 - RNA, 24 nt, Human
gguggcucacgccuguaaucccag

SEQ ID NO: 590009 - RNA, 21 nt, Human
gugaaacccugucucuacuaa

SEQ ID NO: 590010 - RNA, 23 nt, Human
guggcgggcgccuguagucccag

SEQ ID NO: 590011 - RNA, 22 nt, Human
uaaaaaaauaagcaaagccucc

SEQ ID NO: 590012 - RNA, 21 nt, Human
uaacacagugaaacccugucu

SEQ ID NO: 590013 - RNA, 22 nt, Human
uaacacagugaaacccugucuc

SEQ ID NO: 590014 - RNA, 24 nt, Human
uaacacagugaaacccugucucua

SEQ ID NO: 590015 - RNA, 23 nt, Human
uacaagaccucuuucuacaaaga

SEQ ID NO: 590016 - RNA, 21 nt, Human
uacagcuuaacccuuuaccuc

SEQ ID NO: 590017 - RNA, 25 nt, Human
uacaucuucaucaccaauucguacu

SEQ ID NO: 590018 - RNA, 22 nt, Human
uacgaauacaucuucaucacca

SEQ ID NO: 590019 - RNA, 19 nt, Human
uagagaaauaggaccucca

SEQ ID NO: 590020 - RNA, 21 nt, Human
uagagaaauaggaccuccaga

SEQ ID NO: 590021 - RNA, 20 nt, Human
uagcaaaacagagccaaaaa

SEQ ID NO: 590022 - RNA, 18 nt, Human
uagcacaaccaacaaauu

SEQ ID NO: 590023 - RNA, 21 nt, Human
uaggaaaaaaaaaaaaagaaa

SEQ ID NO: 590024 - RNA, 22 nt, Human
uaucuauagccagagacggcuu

SEQ ID NO: 590025 - RNA, 18 nt, Human
ucacaaggucaggagauc

SEQ ID NO: 590026 - RNA, 24 nt, Human
ucacaaggucaggagaucgagacc

SEQ ID NO: 590027 - RNA, 22 nt, Human
ucaguccagcagaacguuaaaa

SEQ ID NO: 590028 - RNA, 23 nt, Human
uccagaaggaaaaguaucaagaa

SEQ ID NO: 590029 - RNA, 24 nt, Human
uccagaaggaaaaguaucaagaaa

SEQ ID NO: 590030 - RNA, 24 nt, Human
uccagccugggcgacagagcaaga

SEQ ID NO: 590031 - RNA, 23 nt, Human
uccgucucaaaaaaaaaaaaaaa

SEQ ID NO: 590032 - RNA, 24 nt, Human
uccgucucaaaaaaaaaaaaaaaa

SEQ ID NO: 590033 - RNA, 24 nt, Human
ucgcugauuaggcuccaaccauac

SEQ ID NO: 590034 - RNA, 18 nt, Human
ucucaaaaaaaaaaaaaa

SEQ ID NO: 590035 - RNA, 24 nt, Human
ucucuacuaaaaauacaaaauauu

SEQ ID NO: 590036 - RNA, 24 nt, Human
ugaggcaggagaauggcgugaacc

SEQ ID NO: 590037 - RNA, 25 nt, Human
ugaggcaggagaauggcgugaaccc

SEQ ID NO: 590038 - RNA, 20 nt, Human
ugagggaugggaggagggga

SEQ ID NO: 590039 - RNA, 24 nt, Human
ugagggaugggaggaggggagagg

SEQ ID NO: 590040 - RNA, 21 nt, Human
uggaaaaaagguuaaggcagc

SEQ ID NO: 590041 - RNA, 26 nt, Human
uggaagauguuagagaaauaggaccu

SEQ ID NO: 590042 - RNA, 22 nt, Human
uggauaggcaucauggaaacca

SEQ ID NO: 590043 - RNA, 21 nt, Human
uggcucacgccuguaauccca

SEQ ID NO: 590044 - RNA, 22 nt, Human
uggcucacgccuguaaucccag

SEQ ID NO: 590045 - RNA, 23 nt, Human
uguaaucccagcuguuagggagg

SEQ ID NO: 590046 - RNA, 22 nt, Human
uguuagagaaauaggaccucca

SEQ ID NO: 590047 - RNA, 22 nt, Human
uugcagugagccaagaccgcgc

SEQ ID NO: 590048 - RNA, 24 nt, Human
uuuaagagguggacuggaaaaaag

SEQ ID NO: 590049 - RNA, 23 nt, Human
uuucuggaagauguuagagaaau

SEQ ID NO: 590050 - RNA, 19 nt, Human
aaaaggaagggcauagaaa

SEQ ID NO: 590051 - RNA, 21 nt, Human
aggcugccccuuuggucucca

SEQ ID NO: 590052 - RNA, 23 nt, Human
auuuuaaaaauacauacaucuua

SEQ ID NO: 590053 - RNA, 20 nt, Human
cacuguaaucaaaacaaagc

SEQ ID NO: 590054 - RNA, 20 nt, Human
caucuuacacuguaaucaaa

SEQ ID NO: 590055 - RNA, 19 nt, Human
cuggcucaaggcugccccu

SEQ ID NO: 590056 - RNA, 26 nt, Human
cuguaaucaaaacaaagccggggucc

SEQ ID NO: 590057 - RNA, 23 nt, Human
gaagggcauagaaaggaagaaac

SEQ ID NO: 590058 - RNA, 24 nt, Human
ggaagggcauagaaaggaagaaac

SEQ ID NO: 590059 - RNA, 19 nt, Human
gggaacaaaaggaagggcc

SEQ ID NO: 590060 - RNA, 25 nt, Human
uaaaaauacauacaucuuacacugu

SEQ ID NO: 590061 - RNA, 19 nt, Human
uagaaaggaagaaacucug

SEQ ID NO: 590062 - RNA, 19 nt, Human
ucuguggucuggcucaagg

SEQ ID NO: 590063 - RNA, 20 nt, Human
uuuaaaaauacauacaucuu

SEQ ID NO: 590064 - RNA, 22 nt, Human
aaaaaguugauucaguguuugc

SEQ ID NO: 590065 - RNA, 18 nt, Human
aaagacuuuucugcccuc

SEQ ID NO: 590066 - RNA, 24 nt, Human
aacugcuugaaccugggaggcaga

SEQ ID NO: 590067 - RNA, 24 nt, Human
aagcaacaaaccacaucuguuaga

SEQ ID NO: 590068 - RNA, 18 nt, Human
aagcauccuaaaugaaca

SEQ ID NO: 590069 - RNA, 19 nt, Human
aaguagcugggauuacagg

SEQ ID NO: 590070 - RNA, 24 nt, Human
aaguagcugggauuacaggcacac

SEQ ID NO: 590071 - RNA, 21 nt, Human
acacgccuccuaaacacagga

SEQ ID NO: 590072 - RNA, 21 nt, Human
acagguucucucugugguguc

SEQ ID NO: 590073 - RNA, 19 nt, Human
acccaggcuggagugcagu

SEQ ID NO: 590074 - RNA, 23 nt, Human
acccaggcuggagugcaguggug

SEQ ID NO: 590075 - RNA, 23 nt, Human
acuaaagcaacaaaccacaucug

SEQ ID NO: 590076 - RNA, 19 nt, Human
aggcagagguugcugugag

SEQ ID NO: 590077 - RNA, 22 nt, Human
aggcaggagaacugcuugaacc

SEQ ID NO: 590078 - RNA, 24 nt, Human
aggcaggagaacugcuugaaccug

SEQ ID NO: 590079 - RNA, 24 nt, Human
aggcugaggcaggagaacugcuug

SEQ ID NO: 590080 - RNA, 25 nt, Human
aggcuggagugcaguggugcgaucu

SEQ ID NO: 590081 - RNA, 25 nt, Human
agguggaaacucccuacuacagggc

SEQ ID NO: 590082 - RNA, 21 nt, Human
agugcaguggugcgaucuuag

SEQ ID NO: 590083 - RNA, 23 nt, Human
agugcaguggugcgaucuuagcu

SEQ ID NO: 590084 - RNA, 24 nt, Human
agugcaguggugcgaucuuagcuc

SEQ ID NO: 590085 - RNA, 20 nt, Human
augggguuucaccaugcugg

SEQ ID NO: 590086 - RNA, 22 nt, Human
auucuuuucuacugaccagaga

SEQ ID NO: 590087 - RNA, 21 nt, Human
caacauacauccauaugugca

SEQ ID NO: 590088 - RNA, 23 nt, Human
caaccuccaccucccagguucaa

SEQ ID NO: 590089 - RNA, 22 nt, Human
caacuaaagcaacaaaccacau

SEQ ID NO: 590090 - RNA, 22 nt, Human
caagcaauucuccugccucagc

SEQ ID NO: 590091 - RNA, 28 nt, Human
caagcaauucuccugccucagcuuccca

SEQ ID NO: 590092 - RNA, 20 nt, Human
caaugagcagacuuaacagu

SEQ ID NO: 590093 - RNA, 18 nt, Human
cacagugagacucugucc

SEQ ID NO: 590094 - RNA, 18 nt, Human
caccaugcuggccaggcu

SEQ ID NO: 590095 - RNA, 23 nt, Human
caccaugcuggccaggcugaggc

SEQ ID NO: 590096 - RNA, 21 nt, Human
cacccaggcuggagugcagug

SEQ ID NO: 590097 - RNA, 21 nt, Human
cacgccuccuaaacacaggag

SEQ ID NO: 590098 - RNA, 21 nt, Human
cacugcaaccuccaccuccca

SEQ ID NO: 590099 - RNA, 21 nt, Human
cauggagguagugguggggug

SEQ ID NO: 590100 - RNA, 27 nt, Human
ccaaagacuuuucugcccucauccuaa

SEQ ID NO: 590101 - RNA, 23 nt, Human
ccaaguagcugggauuacaggca

SEQ ID NO: 590102 - RNA, 26 nt, Human
ccaccucccagguucaagcaauucuu

SEQ ID NO: 590103 - RNA, 27 nt, Human
cccaaagacuuuucugcccucauccuu

SEQ ID NO: 590104 - RNA, 23 nt, Human
cccaaguagcugggauuacaggc

SEQ ID NO: 590105 - RNA, 24 nt, Human
cccaaguagcugggauuacaggca

SEQ ID NO: 590106 - RNA, 23 nt, Human
cccagguucaagcaauucuccug

SEQ ID NO: 590107 - RNA, 18 nt, Human
ccccaaagacuuuucugc

SEQ ID NO: 590108 - RNA, 23 nt, Human
ccccaaagacuuuucugcccucu

SEQ ID NO: 590109 - RNA, 19 nt, Human
ccuaaacacaggagugaga

SEQ ID NO: 590110 - RNA, 24 nt, Human
ccucccagguucaagcaauucucc

SEQ ID NO: 590111 - RNA, 21 nt, Human
ccuccuaaacacaggagugag

SEQ ID NO: 590112 - RNA, 24 nt, Human
ccugccucagcuucccaaguagcu

SEQ ID NO: 590113 - RNA, 25 nt, Human
ccugggaggcagagguugcugugag

SEQ ID NO: 590114 - RNA, 24 nt, Human
cgcucugucacccaggcuggagug

SEQ ID NO: 590115 - RNA, 22 nt, Human
cuacagggcucuucauuccaau

SEQ ID NO: 590116 - RNA, 24 nt, Human
cucacugcaaccuccaccucccag

SEQ ID NO: 590117 - RNA, 23 nt, Human
cucagcuucccaaguagcuggga

SEQ ID NO: 590118 - RNA, 24 nt, Human
cucgcucugucacccaggcuggag

SEQ ID NO: 590119 - RNA, 23 nt, Human
cucugucacccaggcuggagugc

SEQ ID NO: 590120 - RNA, 23 nt, Human
cugcaaccuccaccucccagguu

SEQ ID NO: 590121 - RNA, 24 nt, Human
cugcaaccuccaccucccagguuc

SEQ ID NO: 590122 - RNA, 24 nt, Human
cugcuugaaccugggaggcagagg

SEQ ID NO: 590123 - RNA, 23 nt, Human
cuggaagacucauguggccccca

SEQ ID NO: 590124 - RNA, 24 nt, Human
cuuuauaaugguucacaguggcug

SEQ ID NO: 590125 - RNA, 19 nt, Human
cuuuuuuuuugaaauggag

SEQ ID NO: 590126 - RNA, 18 nt, Human
gagaugggguuucaccau

SEQ ID NO: 590127 - RNA, 24 nt, Human
gagaugggguuucaccaugcuggc

SEQ ID NO: 590128 - RNA, 18 nt, Human
gcacaagcuuguuucagu

SEQ ID NO: 590129 - RNA, 24 nt, Human
gccucagcuucccaaguagcuggg

SEQ ID NO: 590130 - RNA, 25 nt, Human
gccuccuaaacacaggagugagagu

SEQ ID NO: 590131 - RNA, 23 nt, Human
ggaaacucccuacuacagggcuc

SEQ ID NO: 590132 - RNA, 21 nt, Human
ggagaucaugccacugcacag

SEQ ID NO: 590133 - RNA, 22 nt, Human
gggguuucaccaugcuggccag

SEQ ID NO: 590134 - RNA, 19 nt, Human
guagagaugggguuucacc

SEQ ID NO: 590135 - RNA, 21 nt, Human
guagagaugggguuucaccau

SEQ ID NO: 590136 - RNA, 22 nt, Human
guagagaugggguuucaccaug

SEQ ID NO: 590137 - RNA, 18 nt, Human
guagcugggauuacaggc

SEQ ID NO: 590138 - RNA, 23 nt, Human
uaaagcaacaaaccacaucuguu

SEQ ID NO: 590139 - RNA, 22 nt, Human
uaaaugaacaaccauggaggua

SEQ ID NO: 590140 - RNA, 24 nt, Human
uaauuuccuguauuuuugguagag

SEQ ID NO: 590141 - RNA, 24 nt, Human
uaguaaaucuucuauuugaugccc

SEQ ID NO: 590142 - RNA, 29 nt, Human
uauuauaaacauuuucaacauggcaauaa

SEQ ID NO: 590143 - RNA, 22 nt, Human
ucacccaggcuggagugcagug

SEQ ID NO: 590144 - RNA, 23 nt, Human
ucacugcaaccuccaccucccag

SEQ ID NO: 590145 - RNA, 24 nt, Human
ucacugcaaccuccaccucccagg

SEQ ID NO: 590146 - RNA, 27 nt, Human
ucacugcaaccuccaccucccagguuc

SEQ ID NO: 590147 - RNA, 21 nt, Human
uccacuuucaacauacaucca

SEQ ID NO: 590148 - RNA, 18 nt, Human
uccaucauccacuuucaa

SEQ ID NO: 590149 - RNA, 24 nt, Human
ucccaaguagcugggauuacaggc

SEQ ID NO: 590150 - RNA, 21 nt, Human
ucccagguucaagcaauucuc

SEQ ID NO: 590151 - RNA, 24 nt, Human
ucccagguucaagcaauucuccug

SEQ ID NO: 590152 - RNA, 21 nt, Human
uccccaaugagcagacuuaac

SEQ ID NO: 590153 - RNA, 24 nt, Human
ucgcucugucacccaggcuggagu

SEQ ID NO: 590154 - RNA, 19 nt, Human
ucucgcucugucacccagg

SEQ ID NO: 590155 - RNA, 22 nt, Human
ucucgcucugucacccaggcug

SEQ ID NO: 590156 - RNA, 23 nt, Human
ucucgcucugucacccaggcugg

SEQ ID NO: 590157 - RNA, 24 nt, Human
ucucgcucugucacccaggcugga

SEQ ID NO: 590158 - RNA, 26 nt, Human
ucucgcucugucacccaggcuggagu

SEQ ID NO: 590159 - RNA, 27 nt, Human
ucucgcucugucacccaggcuggagug

SEQ ID NO: 590160 - RNA, 24 nt, Human
ucugucacccaggcuggagugcag

SEQ ID NO: 590161 - RNA, 22 nt, Human
ucuguccgaaaaaaaaaaaaaa

SEQ ID NO: 590162 - RNA, 23 nt, Human
ucuguccgaaaaaaaaaaaaaag

SEQ ID NO: 590163 - RNA, 20 nt, Human
ucuguggugucacccccaug

SEQ ID NO: 590164 - RNA, 23 nt, Human
ucuguggugucacccccauguuu

SEQ ID NO: 590165 - RNA, 22 nt, Human
ugaaauggagucucgcucuguc

SEQ ID NO: 590166 - RNA, 24 nt, Human
ugaauuagaagcauccuaaaugaa

SEQ ID NO: 590167 - RNA, 24 nt, Human
ugaggcaggagaacugcuugaacc

SEQ ID NO: 590168 - RNA, 24 nt, Human
ugaggcaggagaacugcuugaacc

SEQ ID NO: 590169 - RNA, 23 nt, Human
ugcacagugagacucuguccgaa

SEQ ID NO: 590170 - RNA, 24 nt, Human
ugccucagcuucccaaguagcugg

SEQ ID NO: 590171 - RNA, 23 nt, Human
uggagugcaguggugcgaucuua

SEQ ID NO: 590172 - RNA, 24 nt, Human
uggagugcaguggugcgaucuuag

SEQ ID NO: 590173 - RNA, 19 nt, Human
uggauagcuuaaaggauuc

SEQ ID NO: 590174 - RNA, 22 nt, Human
uggccaggcugaggcaggagaa

SEQ ID NO: 590175 - RNA, 19 nt, Human
ugggauuacaggcacacac

SEQ ID NO: 590176 - RNA, 19 nt, Human
ugggauuacaggcacacac

SEQ ID NO: 590177 - RNA, 21 nt, Human
ugggauuacaggcacacacua

SEQ ID NO: 590178 - RNA, 22 nt, Human
ugggauuacaggcacacacuac

SEQ ID NO: 590179 - RNA, 24 nt, Human
ugggguuucaccaugcuggccagg

SEQ ID NO: 590180 - RNA, 23 nt, Human
ugguagagaugggguuucaccau

SEQ ID NO: 590181 - RNA, 24 nt, Human
ugguagagaugggguuucaccaug

SEQ ID NO: 590182 - RNA, 24 nt, Human
uggugcgaucuuagcucacugcaa

SEQ ID NO: 590183 - RNA, 20 nt, Human
ugugcacauauuuuuacaug

SEQ ID NO: 590184 - RNA, 22 nt, Human
uuagaagcagcccuuuccaucu

SEQ ID NO: 590185 - RNA, 25 nt, Human
uuagcucacugcaaccuccaccucc

SEQ ID NO: 590186 - RNA, 23 nt, Human
uucaacaacuaaagcaacaaacc

SEQ ID NO: 590187 - RNA, 21 nt, Human
uucaagcaauucuccugccuc

SEQ ID NO: 590188 - RNA, 24 nt, Human
uucaagcaauucuccugccucagc

SEQ ID NO: 590189 - RNA, 20 nt, Human
uucacagguucucucugugg

SEQ ID NO: 590190 - RNA, 24 nt, Human
uucacaguggcugaauuagaagca

SEQ ID NO: 590191 - RNA, 21 nt, Human
uuccuguauuuuugguagaga

SEQ ID NO: 590192 - RNA, 24 nt, Human
uugaaccugggaggcagagguugc

SEQ ID NO: 590193 - RNA, 24 nt, Human
uugguagagaugggguuucaccau

SEQ ID NO: 590194 - RNA, 21 nt, Human
uuucaccaugcuggccaggcu

SEQ ID NO: 590195 - RNA, 23 nt, Human
uuuccuguauuuuugguagagau

SEQ ID NO: 590196 - RNA, 24 nt, Human
uuuccuguauuuuugguagagaug

SEQ ID NO: 590197 - RNA, 20 nt, Human
uuuucugcccucauccuaag

SEQ ID NO: 590198 - RNA, 22 nt, Human
uuuuugguagagaugggguuuc

SEQ ID NO: 590199 - RNA, 24 nt, Human
uuuuugguagagaugggguuucac

SEQ ID NO: 590200 - RNA, 19 nt, Human
aaaacugauaaaagcaaca

SEQ ID NO: 590201 - RNA, 21 nt, Human
aaacgcaagaggauggugagg

SEQ ID NO: 590202 - RNA, 21 nt, Human
aaccccacggguccaggcacc

SEQ ID NO: 590203 - RNA, 20 nt, Human
aaccuaguuucccaggccca

SEQ ID NO: 590204 - RNA, 22 nt, Human
aacugauaaaagcaacacaacu

SEQ ID NO: 590205 - RNA, 18 nt, Human
aagcaaggccacgcugug

SEQ ID NO: 590206 - RNA, 25 nt, Human
aagcaccauggcacguccuuugugc

SEQ ID NO: 590207 - RNA, 24 nt, Human
aagccccaaguuuggacacccugc

SEQ ID NO: 590208 - RNA, 21 nt, Human
aagcugaagaggcccccaggg

SEQ ID NO: 590209 - RNA, 23 nt, Human
aaggagccccaugcagccagugc

SEQ ID NO: 590210 - RNA, 18 nt, Human
aaguuuggacacccugcc

SEQ ID NO: 590211 - RNA, 19 nt, Human
acaagcaaggccacgcugu

SEQ ID NO: 590212 - RNA, 23 nt, Human
acacugcaggugccugggaagcc

SEQ ID NO: 590213 - RNA, 21 nt, Human
accaacaccccucccucucaa

SEQ ID NO: 590214 - RNA, 18 nt, Human
acccuggggucccucugc

SEQ ID NO: 590215 - RNA, 19 nt, Human
agagcuggcagggccccuu

SEQ ID NO: 590216 - RNA, 20 nt, Human
agaggauggugagggucccg

SEQ ID NO: 590217 - RNA, 23 nt, Human
agccccagcagggcaggccagga

SEQ ID NO: 590218 - RNA, 19 nt, Human
aggaggggaggggaggggu

SEQ ID NO: 590219 - RNA, 19 nt, Human
agggaaaggauguguggca

SEQ ID NO: 590220 - RNA, 19 nt, Human
aggugccugggaagcccca

SEQ ID NO: 590221 - RNA, 22 nt, Human
aggugcuggugagggaccccag

SEQ ID NO: 590222 - RNA, 21 nt, Human
aggugucagggaggugcuggu

SEQ ID NO: 590223 - RNA, 20 nt, Human
auccccgccgccgccgccgc

SEQ ID NO: 590224 - RNA, 22 nt, Human
augccccucugggagguauguc

SEQ ID NO: 590225 - RNA, 24 nt, Human
caaagcccacccggggcgccuccc

SEQ ID NO: 590226 - RNA, 21 nt, Human
caacaggcuccgccgcggcuc

SEQ ID NO: 590227 - RNA, 24 nt, Human
caaccccacggguccaggcacccu

SEQ ID NO: 590228 - RNA, 23 nt, Human
caaggagccccaugcagccagug

SEQ ID NO: 590229 - RNA, 20 nt, Human
cacagcacugagcaaggccc

SEQ ID NO: 590230 - RNA, 19 nt, Human
caccaacaccccucccucu

SEQ ID NO: 590231 - RNA, 22 nt, Human
caccaacaccccucccucucaa

SEQ ID NO: 590232 - RNA, 23 nt, Human
caccaacaccccucccucucaaa

SEQ ID NO: 590233 - RNA, 19 nt, Human
cacccccaagaggccucca

SEQ ID NO: 590234 - RNA, 27 nt, Human
caccccucccucucaaaugguggcuug

SEQ ID NO: 590235 - RNA, 22 nt, Human
cacccggggcgccucccugccc

SEQ ID NO: 590236 - RNA, 19 nt, Human
cacccuggggucccucugc

SEQ ID NO: 590237 - RNA, 23 nt, Human
cagcagggcaggccaggagggaa

SEQ ID NO: 590238 - RNA, 18 nt, Human
cagcccccuccgcggccc

SEQ ID NO: 590239 - RNA, 27 nt, Human
cagcuccacugaguggccacgagcaac

SEQ ID NO: 590240 - RNA, 20 nt, Human
cagcugcuccuggucuugga

SEQ ID NO: 590241 - RNA, 22 nt, Human
caggcacccucccugcaguccc

SEQ ID NO: 590242 - RNA, 21 nt, Human
cagggaggugcuggugaggga

SEQ ID NO: 590243 - RNA, 20 nt, Human
cagggccccuuccaccucuc

SEQ ID NO: 590244 - RNA, 23 nt, Human
caggggacacccuggggucccuc

SEQ ID NO: 590245 - RNA, 22 nt, Human
cagggugggcucugaggagggg

SEQ ID NO: 590246 - RNA, 20 nt, Human
caguagagccccagcagggc

SEQ ID NO: 590247 - RNA, 23 nt, Human
cauucuuaucuuggagcucaggg

SEQ ID NO: 590248 - RNA, 20 nt, Human
cccaaaggucccacccccaa

SEQ ID NO: 590249 - RNA, 24 nt, Human
cccacccccaagaggccuccagga

SEQ ID NO: 590250 - RNA, 19 nt, Human
cccaggcccaggacaccau

SEQ ID NO: 590251 - RNA, 22 nt, Human
cccaugcagccagugccccaug

SEQ ID NO: 590252 - RNA, 18 nt, Human
ccccaaagcccacccggg

SEQ ID NO: 590253 - RNA, 28 nt, Human
ccccaaagcccacccggggcgccucccu

SEQ ID NO: 590254 - RNA, 21 nt, Human
ccccaagaggccuccaggacc

SEQ ID NO: 590255 - RNA, 19 nt, Human
ccccgccgccgccgccgcc

SEQ ID NO: 590256 - RNA, 25 nt, Human
ccccgccgccgccgccgccucagaa

SEQ ID NO: 590257 - RNA, 27 nt, Human
ccccgccgccgccgccgccucagagac

SEQ ID NO: 590258 - RNA, 19 nt, Human
cccgcaccaaggcaugggg

SEQ ID NO: 590259 - RNA, 18 nt, Human
cccgucggccggcucucc

SEQ ID NO: 590260 - RNA, 21 nt, Human
ccgccgccgccgccgccucag

SEQ ID NO: 590261 - RNA, 19 nt, Human
ccgccgccgccucagagac

SEQ ID NO: 590262 - RNA, 22 nt, Human
ccgccgccucagagaccacucc

SEQ ID NO: 590263 - RNA, 21 nt, Human
ccgccgcggcucccgucggcc

SEQ ID NO: 590264 - RNA, 27 nt, Human
ccgccgcggcucccgucggccggcucu

SEQ ID NO: 590265 - RNA, 21 nt, Human
ccggcagcccgcgcgagcuca

SEQ ID NO: 590266 - RNA, 26 nt, Human
ccucagagaccacucccggcagcccu

SEQ ID NO: 590267 - RNA, 23 nt, Human
ccucccugcaguccccgcggcca

SEQ ID NO: 590268 - RNA, 19 nt, Human
ccuuugcuaauaaggccuc

SEQ ID NO: 590269 - RNA, 19 nt, Human
cgagaggcauuaggauggu

SEQ ID NO: 590270 - RNA, 19 nt, Human
cgccagugccggagacgau

SEQ ID NO: 590271 - RNA, 23 nt, Human
cgccagugccggagacgaucccc

SEQ ID NO: 590272 - RNA, 20 nt, Human
cgcggccaggcuccugcugg

SEQ ID NO: 590273 - RNA, 23 nt, Human
cgcggccaggcuccugcuggguc

SEQ ID NO: 590274 - RNA, 20 nt, Human
cggcuuagcucccgcugugg

SEQ ID NO: 590275 - RNA, 24 nt, Human
cuaaagcucagaacagcccaaggc

SEQ ID NO: 590276 - RNA, 20 nt, Human
cucaaugaagcaaccccacg

SEQ ID NO: 590277 - RNA, 23 nt, Human
cuccccagagcuggcagggcccc

SEQ ID NO: 590278 - RNA, 20 nt, Human
cugaagaggcccccaggggc

SEQ ID NO: 590279 - RNA, 21 nt, Human
cugaaggccgcggucuggcug

SEQ ID NO: 590280 - RNA, 20 nt, Human
cugcaggcccagcuccacug

SEQ ID NO: 590281 - RNA, 21 nt, Human
cugcccaaaggucccaccccc

SEQ ID NO: 590282 - RNA, 18 nt, Human
cugcuccccagagcuggc

SEQ ID NO: 590283 - RNA, 21 nt, Human
cugcugggucuacagggucca

SEQ ID NO: 590284 - RNA, 21 nt, Human
cugcugucuccagcucacagc

SEQ ID NO: 590285 - RNA, 19 nt, Human
cugucuccagcucacagcu

SEQ ID NO: 590286 - RNA, 25 nt, Human
cuuccaccucucggagugcuggccc

SEQ ID NO: 590287 - RNA, 19 nt, Human
cuucccacaaaccacugca

SEQ ID NO: 590288 - RNA, 20 nt, Human
cuucccacaaaccacugcaa

SEQ ID NO: 590289 - RNA, 20 nt, Human
gaaagcaccauggcacgucc

SEQ ID NO: 590290 - RNA, 22 nt, Human
gaacaaauguucagcaguucuc

SEQ ID NO: 590291 - RNA, 18 nt, Human
gacaagcaaggccacgcu

SEQ ID NO: 590292 - RNA, 18 nt, Human
gagcaaggcccugaguag

SEQ ID NO: 590293 - RNA, 18 nt, Human
gaggaggggaggggaggg

SEQ ID NO: 590294 - RNA, 24 nt, Human
gauccccgccgccgccgccgccuc

SEQ ID NO: 590295 - RNA, 19 nt, Human
gcccagggccggcuuagcu

SEQ ID NO: 590296 - RNA, 22 nt, Human
gcccaggugucagggaggugcu

SEQ ID NO: 590297 - RNA, 22 nt, Human
gccccaaagcccacccggggcg

SEQ ID NO: 590298 - RNA, 26 nt, Human
gccccaaagcccacccggggcgccuc

SEQ ID NO: 590299 - RNA, 23 nt, Human
gcccccagugcuguuggcaggug

SEQ ID NO: 590300 - RNA, 22 nt, Human
gcccccuccgcggcccuaaucu

SEQ ID NO: 590301 - RNA, 22 nt, Human
gcgccucccugccccugccugc

SEQ ID NO: 590302 - RNA, 22 nt, Human
gcggccaggcuccugcuggguc

SEQ ID NO: 590303 - RNA, 23 nt, Human
ggaaagcaccauggcacguccuu

SEQ ID NO: 590304 - RNA, 24 nt, Human
ggcucugaggaggggaggggaggg

SEQ ID NO: 590305 - RNA, 21 nt, Human
gggcgccucccugccccugcc

SEQ ID NO: 590306 - RNA, 18 nt, Human
ggggccaaaacgcaagag

SEQ ID NO: 590307 - RNA, 20 nt, Human
gucagugggcaaacccugcc

SEQ ID NO: 590308 - RNA, 22 nt, Human
gugccaugggggucacugcugc

SEQ ID NO: 590309 - RNA, 20 nt, Human
guggcagacaagcaaggcca

SEQ ID NO: 590310 - RNA, 19 nt, Human
guggcagugccgcagcccc

SEQ ID NO: 590311 - RNA, 21 nt, Human
gugucagggaggugcugguga

SEQ ID NO: 590312 - RNA, 18 nt, Human
uaaagcucagaacagccc

SEQ ID NO: 590313 - RNA, 18 nt, Human
uagaaaacugauaaaagc

SEQ ID NO: 590314 - RNA, 25 nt, Human
uaggauggucacugacaggcgccaa

SEQ ID NO: 590315 - RNA, 21 nt, Human
ucagcaguucucucggggcca

SEQ ID NO: 590316 - RNA, 22 nt, Human
ucagggcaccaacaccccuccc

SEQ ID NO: 590317 - RNA, 20 nt, Human
ucaguccugguggcagucca

SEQ ID NO: 590318 - RNA, 19 nt, Human
uccaggcacccucccugca

SEQ ID NO: 590319 - RNA, 23 nt, Human
ucccacccccaagaggccuccag

SEQ ID NO: 590320 - RNA, 18 nt, Human
ucccaggcccaggacacc

SEQ ID NO: 590321 - RNA, 20 nt, Human
uccccgccgccgccgccgcc

SEQ ID NO: 590322 - RNA, 20 nt, Human
uccccgcggccaggcuccug

SEQ ID NO: 590323 - RNA, 21 nt, Human
ucccugcaguccccgcggcca

SEQ ID NO: 590324 - RNA, 27 nt, Human
ucucaaggcucugcaaguguccuucuc

SEQ ID NO: 590325 - RNA, 22 nt, Human
ucucaaugaagcaaccccacgg

SEQ ID NO: 590326 - RNA, 21 nt, Human
ucuccuggggagaagccccca

SEQ ID NO: 590327 - RNA, 23 nt, Human
ucugcaggggacacccugggguc

SEQ ID NO: 590328 - RNA, 24 nt, Human
ucugcaggggacacccuggggucc

SEQ ID NO: 590329 - RNA, 24 nt, Human
ugaagcaaccccacggguccaggc

SEQ ID NO: 590330 - RNA, 21 nt, Human
ugacucaggaggugacagcaa

SEQ ID NO: 590331 - RNA, 23 nt, Human
ugagcaaggcccugaguaggugg

SEQ ID NO: 590332 - RNA, 19 nt, Human
ugagggaccccagugacuc

SEQ ID NO: 590333 - RNA, 19 nt, Human
ugccccugccugcccggcc

SEQ ID NO: 590334 - RNA, 23 nt, Human
ugcgccagugccggagacgaucc

SEQ ID NO: 590335 - RNA, 23 nt, Human
uggcaguccaugccccucuggga

SEQ ID NO: 590336 - RNA, 23 nt, Human
ugggacuuacagcuuuguggaag

SEQ ID NO: 590337 - RNA, 25 nt, Human
ugggaucugcaggggacacccuggg

SEQ ID NO: 590338 - RNA, 18 nt, Human
ugggcaaacccugcccaa

SEQ ID NO: 590339 - RNA, 22 nt, Human
uggggagaagcccccagugcug

SEQ ID NO: 590340 - RNA, 22 nt, Human
ugggucuacaggguccaaggag

SEQ ID NO: 590341 - RNA, 18 nt, Human
uggugagggucccgucac

SEQ ID NO: 590342 - RNA, 20 nt, Human
uggugagggucccgucacug

SEQ ID NO: 590343 - RNA, 20 nt, Human
uggugggaucugcaggggac

SEQ ID NO: 590344 - RNA, 22 nt, Human
ugucacugaggccccccugcag

SEQ ID NO: 590345 - RNA, 25 nt, Human
ugucuuggucaccuuucuggucuca

SEQ ID NO: 590346 - RNA, 22 nt, Human
ugugccaugggggucacugcug

SEQ ID NO: 590347 - RNA, 23 nt, Human
uguggaaggggcccacaaaccuu

SEQ ID NO: 590348 - RNA, 21 nt, Human
uuacagcuuuguggaaggggc

SEQ ID NO: 590349 - RNA, 22 nt, Human
uuggacacccugcccagucccu

SEQ ID NO: 590350 - RNA, 20 nt, Human
aaacccucagugggucaggg

SEQ ID NO: 590351 - RNA, 22 nt, Human
aagaaagaaauuccaguuagga

SEQ ID NO: 590352 - RNA, 21 nt, Human
aagaaccuugauuuaucauug

SEQ ID NO: 590353 - RNA, 25 nt, Human
aagcaauccuccugccucagccucc

SEQ ID NO: 590354 - RNA, 21 nt, Human
acacaacacaccagggaucag

SEQ ID NO: 590355 - RNA, 18 nt, Human
acagcuuacuguaaccuc

SEQ ID NO: 590356 - RNA, 19 nt, Human
acccugugcucaaacugcu

SEQ ID NO: 590357 - RNA, 24 nt, Human
acccugugcucaaacugcuacaaa

SEQ ID NO: 590358 - RNA, 22 nt, Human
acguggcuucagcaauucucaa

SEQ ID NO: 590359 - RNA, 19 nt, Human
acucggucacccaggcugg

SEQ ID NO: 590360 - RNA, 20 nt, Human
acucggucacccaggcugga

SEQ ID NO: 590361 - RNA, 22 nt, Human
acucggucacccaggcuggagg

SEQ ID NO: 590362 - RNA, 20 nt, Human
acugcuacaaaaauaugaga

SEQ ID NO: 590363 - RNA, 24 nt, Human
agcuaggacuacaagcaugugcca

SEQ ID NO: 590364 - RNA, 22 nt, Human
agggaaaaaugagcuaagucug

SEQ ID NO: 590365 - RNA, 21 nt, Human
aggugcuucuacguggcuuca

SEQ ID NO: 590366 - RNA, 22 nt, Human
aggugcuucuacguggcuucag

SEQ ID NO: 590367 - RNA, 23 nt, Human
aguagcuaggacuacaagcaugu

SEQ ID NO: 590368 - RNA, 22 nt, Human
agugggucagggucuucuaaga

SEQ ID NO: 590369 - RNA, 21 nt, Human
auccuccugccucagccuccc

SEQ ID NO: 590370 - RNA, 25 nt, Human
caaacuccuagacucaagcaauccu

SEQ ID NO: 590371 - RNA, 22 nt, Human
caagcaauccuccugccucagc

SEQ ID NO: 590372 - RNA, 27 nt, Human
caagcaauccuccugccucagccuccc

SEQ ID NO: 590373 - RNA, 27 nt, Human
caagcaauccuccugccucagccuccc

SEQ ID NO: 590374 - RNA, 24 nt, Human
cacacaacacaccagggaucagag

SEQ ID NO: 590375 - RNA, 27 nt, Human
cagcaauucucacaacaaacccucagu

SEQ ID NO: 590376 - RNA, 24 nt, Human
cagcuacagcauuucuuacugaac

SEQ ID NO: 590377 - RNA, 24 nt, Human
caguacugaaaguucguuuggaga

SEQ ID NO: 590378 - RNA, 19 nt, Human
ccaaugguugacagcuccc

SEQ ID NO: 590379 - RNA, 20 nt, Human
ccacacuuguuucauuuuua

SEQ ID NO: 590380 - RNA, 19 nt, Human
cccacacaacacaccaggg

SEQ ID NO: 590381 - RNA, 24 nt, Human
cccaccuccaccccaccucaagaa

SEQ ID NO: 590382 - RNA, 27 nt, Human
cccaccuccaccccaccucaagaagaa

SEQ ID NO: 590383 - RNA, 23 nt, Human
ccugccucagccucccaaguagc

SEQ ID NO: 590384 - RNA, 22 nt, Human
cgcuauguugcccaggcugguc

SEQ ID NO: 590385 - RNA, 27 nt, Human
cgcuauguugcccaggcugguccugaa

SEQ ID NO: 590386 - RNA, 20 nt, Human
cguggcuucagcaauucuca

SEQ ID NO: 590387 - RNA, 24 nt, Human
cucaagcaauccuccugccucagc

SEQ ID NO: 590388 - RNA, 23 nt, Human
cugccucagccucccaaguagcu

SEQ ID NO: 590389 - RNA, 21 nt, Human
cuuacuguaaccucaaacucc

SEQ ID NO: 590390 - RNA, 23 nt, Human
cuugcuccccaccuccaccccac

SEQ ID NO: 590391 - RNA, 20 nt, Human
gaacuuccugaccuuuccga

SEQ ID NO: 590392 - RNA, 19 nt, Human
gcugguccugaacuccugg

SEQ ID NO: 590393 - RNA, 23 nt, Human
gcugguccugaacuccuggccuc

SEQ ID NO: 590394 - RNA, 22 nt, Human
ggacuacaagcaugugccacca

SEQ ID NO: 590395 - RNA, 19 nt, Human
ggaucagagccaggucaaa

SEQ ID NO: 590396 - RNA, 18 nt, Human
ggcaagaaagaaauuccg

SEQ ID NO: 590397 - RNA, 24 nt, Human
ggcugguccugaacuccuggccuc

SEQ ID NO: 590398 - RNA, 24 nt, Human
gggggucucgcuauguugcccagg

SEQ ID NO: 590399 - RNA, 20 nt, Human
gugcuucuacguggcuucag

SEQ ID NO: 590400 - RNA, 21 nt, Human
uaaaaagcuauccucagauga

SEQ ID NO: 590401 - RNA, 23 nt, Human
uaaagaggcccacacaacacacc

SEQ ID NO: 590402 - RNA, 21 nt, Human
uaauaaaacccacugaucaaa

SEQ ID NO: 590403 - RNA, 21 nt, Human
uacaagcaugugccaccacac

SEQ ID NO: 590404 - RNA, 21 nt, Human
uacuguaaccucaaacuccua

SEQ ID NO: 590405 - RNA, 21 nt, Human
uaggacuacaagcaugugcca

SEQ ID NO: 590406 - RNA, 24 nt, Human
uaggacuacaagcaugugccacca

SEQ ID NO: 590407 - RNA, 23 nt, Human
uauguugcccaggcugguccuga

SEQ ID NO: 590408 - RNA, 24 nt, Human
uauguugcccaggcugguccugaa

SEQ ID NO: 590409 - RNA, 23 nt, Human
ucacccaggcuggaggccauguc

SEQ ID NO: 590410 - RNA, 20 nt, Human
ucagccucccaaguagcuag

SEQ ID NO: 590411 - RNA, 18 nt, Human
ucaguucuuccauugaug

SEQ ID NO: 590412 - RNA, 21 nt, Human
ucaguucuuccauugauggua

SEQ ID NO: 590413 - RNA, 18 nt, Human
uccaccccaccucaagaa

SEQ ID NO: 590414 - RNA, 20 nt, Human
uccccaccuccaccccaccu

SEQ ID NO: 590415 - RNA, 21 nt, Human
uccccaccuccaccccaccuc

SEQ ID NO: 590416 - RNA, 27 nt, Human
uccuccugccucagccucccaaguagc

SEQ ID NO: 590417 - RNA, 24 nt, Human
ucucacucggucacccaggcugga

SEQ ID NO: 590418 - RNA, 19 nt, Human
ucucgcuauguugcccagg

SEQ ID NO: 590419 - RNA, 23 nt, Human
ucucgcuauguugcccaggcugg

SEQ ID NO: 590420 - RNA, 24 nt, Human
ucucgcuauguugcccaggcuggu

SEQ ID NO: 590421 - RNA, 26 nt, Human
ucucgcuauguugcccaggcuggucc

SEQ ID NO: 590422 - RNA, 27 nt, Human
ucucgcuauguugcccaggcugguccu

SEQ ID NO: 590423 - RNA, 19 nt, Human
ucuugcuccccaccuccac

SEQ ID NO: 590424 - RNA, 19 nt, Human
ugaaagggcaagaaagaaa

SEQ ID NO: 590425 - RNA, 25 nt, Human
ugaaauaauaaaacccacugaucaa

SEQ ID NO: 590426 - RNA, 23 nt, Human
ugaaugacaacagcuacagcauu

SEQ ID NO: 590427 - RNA, 24 nt, Human
ugcccaggcugguccugaacuccu

SEQ ID NO: 590428 - RNA, 23 nt, Human
ugccucagccucccaaguagcua

SEQ ID NO: 590429 - RNA, 24 nt, Human
ugccucagccucccaaguagcuag

SEQ ID NO: 590430 - RNA, 19 nt, Human
ugcuccccaccuccacccc

SEQ ID NO: 590431 - RNA, 20 nt, Human
ugguccugaacuccuggccu

SEQ ID NO: 590432 - RNA, 21 nt, Human
uguccuuggccaaaaguagaa

SEQ ID NO: 590433 - RNA, 19 nt, Human
ugugguuuuacagauuuca

SEQ ID NO: 590434 - RNA, 22 nt, Human
uuaacccugugcucaaacugcu

SEQ ID NO: 590435 - RNA, 23 nt, Human
uuggagaguuguaguccaguuuc

SEQ ID NO: 590436 - RNA, 23 nt, Human
uuuauuuuuuguuuuuauuuuua

SEQ ID NO: 590437 - RNA, 19 nt, Human
uuucugccagagguugcac

SEQ ID NO: 590438 - RNA, 19 nt, Human
uuuuuuuuuuuuaaggacc

SEQ ID NO: 590439 - RNA, 25 nt, Human
uuuuuuuuuuuuuuuuuuuuuaagg

SEQ ID NO: 590440 - RNA, 21 nt, Human
aaacugaggagcagagggcac

SEQ ID NO: 590441 - RNA, 22 nt, Human
aagcauuccauggugucuucau

SEQ ID NO: 590442 - RNA, 26 nt, Human
accccaucugaugacgauucggauug

SEQ ID NO: 590443 - RNA, 19 nt, Human
acuguuuuuuuuuagggug

SEQ ID NO: 590444 - RNA, 23 nt, Human
agagagaagguaauaguuggaaa

SEQ ID NO: 590445 - RNA, 23 nt, Human
agaguauucuaccaccucacgga

SEQ ID NO: 590446 - RNA, 21 nt, Human
agcacugcaagauggucucca

SEQ ID NO: 590447 - RNA, 23 nt, Human
agcagcagcagcagccuaauggg

SEQ ID NO: 590448 - RNA, 18 nt, Human
aggacaguuuuggcugcc

SEQ ID NO: 590449 - RNA, 24 nt, Human
auaguggccucgucauccagcuga

SEQ ID NO: 590450 - RNA, 23 nt, Human
caauaaccagugagaucuccaau

SEQ ID NO: 590451 - RNA, 22 nt, Human
caccccaucugaugacgauucg

SEQ ID NO: 590452 - RNA, 22 nt, Human
cacuggggucauggggucugcc

SEQ ID NO: 590453 - RNA, 27 nt, Human
cagaaucacaucagaguauucuaccaa

SEQ ID NO: 590454 - RNA, 22 nt, Human
cagcacugagaugggcaggcag

SEQ ID NO: 590455 - RNA, 26 nt, Human
cagcagcagcagccuaaugggucucu

SEQ ID NO: 590456 - RNA, 26 nt, Human
cagcagcagccuaaugggucucuggc

SEQ ID NO: 590457 - RNA, 22 nt, Human
cagcagccuaaugggucucugg

SEQ ID NO: 590458 - RNA, 19 nt, Human
cagugagaucuccaaucuu

SEQ ID NO: 590459 - RNA, 20 nt, Human
cauccaggacuuccagaauc

SEQ ID NO: 590460 - RNA, 23 nt, Human
cauugaguuuagcccaccccauc

SEQ ID NO: 590461 - RNA, 21 nt, Human
ccaaucuuauauacaguagcu

SEQ ID NO: 590462 - RNA, 18 nt, Human
ccugcaaaacuucuuccu

SEQ ID NO: 590463 - RNA, 24 nt, Human
ccugcaaaacuucuuccuuacacu

SEQ ID NO: 590464 - RNA, 19 nt, Human
ccuuacacugaaacuccuc

SEQ ID NO: 590465 - RNA, 22 nt, Human
ccuuacacugaaacuccuccug

SEQ ID NO: 590466 - RNA, 20 nt, Human
cggagaauggagcaacuuga

SEQ ID NO: 590467 - RNA, 21 nt, Human
cucacggacuccuuguaauaa

SEQ ID NO: 590468 - RNA, 21 nt, Human
cugcaguacugggcagcaguc

SEQ ID NO: 590469 - RNA, 24 nt, Human
cugcuucucccucaucuccucaac

SEQ ID NO: 590470 - RNA, 22 nt, Human
cugggcagcaguccacugggcc

SEQ ID NO: 590471 - RNA, 26 nt, Human
cugguaaucucccgucccacuggaac

SEQ ID NO: 590472 - RNA, 23 nt, Human
cuugcugcuucucccucaucucc

SEQ ID NO: 590473 - RNA, 20 nt, Human
cuuggaaacuuuaccuggcu

SEQ ID NO: 590474 - RNA, 25 nt, Human
cuuguaauaagccuucauaguggcc

SEQ ID NO: 590475 - RNA, 24 nt, Human
gacuguguaagucucucuucuucc

SEQ ID NO: 590476 - RNA, 26 nt, Human
gagcagagggcacuuuggagguugcu

SEQ ID NO: 590477 - RNA, 23 nt, Human
gaguggguggugguggucuauag

SEQ ID NO: 590478 - RNA, 21 nt, Human
gauacuucuuuuauuucuguu

SEQ ID NO: 590479 - RNA, 19 nt, Human
gcauccaggacuuccagaa

SEQ ID NO: 590480 - RNA, 23 nt, Human
gcuccugggcagcuugcugcuuc

SEQ ID NO: 590481 - RNA, 19 nt, Human
gggcagcuugcugcuucuu

SEQ ID NO: 590482 - RNA, 23 nt, Human
ggguggugguggucuauagaagc

SEQ ID NO: 590483 - RNA, 22 nt, Human
gguugcuuucuucccauuuugu

SEQ ID NO: 590484 - RNA, 20 nt, Human
uaguggccucgucauccagc

SEQ ID NO: 590485 - RNA, 18 nt, Human
uaguuaccaacacugcca

SEQ ID NO: 590486 - RNA, 19 nt, Human
uauuucagccucucgauug

SEQ ID NO: 590487 - RNA, 19 nt, Human
ucccucaucuccucaaccc

SEQ ID NO: 590488 - RNA, 19 nt, Human
ucccucaucuccucaaccc

SEQ ID NO: 590489 - RNA, 21 nt, Human
ucccuggggauuuuaucugca

SEQ ID NO: 590490 - RNA, 24 nt, Human
ucuguuguaaaacagaguaggggu

SEQ ID NO: 590491 - RNA, 23 nt, Human
ugagaucagucaauuaguuacca

SEQ ID NO: 590492 - RNA, 22 nt, Human
ugaggagcagagggcacuuugg

SEQ ID NO: 590493 - RNA, 18 nt, Human
ugaguggguggugguggu

SEQ ID NO: 590494 - RNA, 18 nt, Human
ugcagcacugcaagaugg

SEQ ID NO: 590495 - RNA, 21 nt, Human
uggagugaacaaacugaggag

SEQ ID NO: 590496 - RNA, 18 nt, Human
uggcaucugcuauuucca

SEQ ID NO: 590497 - RNA, 23 nt, Human
uggccaagcauuccauggugucu

SEQ ID NO: 590498 - RNA, 19 nt, Human
ugggaggcaaagacacaua

SEQ ID NO: 590499 - RNA, 20 nt, Human
ugggaggcaaagacacauag

SEQ ID NO: 590500 - RNA, 22 nt, Human
ugggaggcaaagacacauaguu

SEQ ID NO: 590501 - RNA, 23 nt, Human
ugggucucuggcauccaggacuu

SEQ ID NO: 590502 - RNA, 20 nt, Human
ugguaaucucccgucccacu

SEQ ID NO: 590503 - RNA, 19 nt, Human
uguaagucucucuucuucc

SEQ ID NO: 590504 - RNA, 27 nt, Human
ugucaaagaacuuggucauuuccuuaa

SEQ ID NO: 590505 - RNA, 19 nt, Human
ugugagugggugguggugg

SEQ ID NO: 590506 - RNA, 23 nt, Human
uucacugguaaucucccguccca

SEQ ID NO: 590507 - RNA, 18 nt, Human
uugaucuccauuuugagu

SEQ ID NO: 590508 - RNA, 18 nt, Human
uugcuccugggcagcuug

SEQ ID NO: 590509 - RNA, 21 nt, Human
uuggcugccugcuccugacug

SEQ ID NO: 590510 - RNA, 24 nt, Human
uuuaucugcacauuucuguaaauu

SEQ ID NO: 590511 - RNA, 23 nt, Human
aaaauacguuucuuuagugccag

SEQ ID NO: 590512 - RNA, 22 nt, Human
aaacaccagacacauacagaaa

SEQ ID NO: 590513 - RNA, 24 nt, Human
aaacaccagacacauacagaaaca

SEQ ID NO: 590514 - RNA, 18 nt, Human
aaacaccugaagcuguga

SEQ ID NO: 590515 - RNA, 21 nt, Human
aacucccccuucaagaugagc

SEQ ID NO: 590516 - RNA, 21 nt, Human
aacucguaacacaaccucaca

SEQ ID NO: 590517 - RNA, 21 nt, Human
aaucagaguuauccacacuug

SEQ ID NO: 590518 - RNA, 20 nt, Human
acacaaccucacaaaaagcg

SEQ ID NO: 590519 - RNA, 25 nt, Human
acacaaccucacaaaaaggggaacc

SEQ ID NO: 590520 - RNA, 23 nt, Human
acagagccggagccucccacccc

SEQ ID NO: 590521 - RNA, 23 nt, Human
agaaagauuacaugcaacagcca

SEQ ID NO: 590522 - RNA, 19 nt, Human
agcggcagcugacagagcc

SEQ ID NO: 590523 - RNA, 21 nt, Human
auacagaaacaauuaggauuc

SEQ ID NO: 590524 - RNA, 24 nt, Human
aucugcagcgccugcaggagaacu

SEQ ID NO: 590525 - RNA, 21 nt, Human
caaaacaccagacacauacag

SEQ ID NO: 590526 - RNA, 22 nt, Human
caaacaccugaagcugugacuc

SEQ ID NO: 590527 - RNA, 19 nt, Human
caaaugaggaaacugagga

SEQ ID NO: 590528 - RNA, 21 nt, Human
caaccucacaaaaagcggucc

SEQ ID NO: 590529 - RNA, 23 nt, Human
caacucguaacacaaccucacaa

SEQ ID NO: 590530 - RNA, 18 nt, Human
cacuuguagugaaauuca

SEQ ID NO: 590531 - RNA, 24 nt, Human
cagagccggagccucccaccccag

SEQ ID NO: 590532 - RNA, 24 nt, Human
cagcggcagcugacagagccggag

SEQ ID NO: 590533 - RNA, 23 nt, Human
caggagaagaccaagugucagca

SEQ ID NO: 590534 - RNA, 23 nt, Human
cauggucccgagacucacacaaa

SEQ ID NO: 590535 - RNA, 21 nt, Human
cauuucauccucacaccaagc

SEQ ID NO: 590536 - RNA, 18 nt, Human
cccucagauccauaggug

SEQ ID NO: 590537 - RNA, 23 nt, Human
ccuccugaauucagcaaggauug

SEQ ID NO: 590538 - RNA, 21 nt, Human
ccuuaaccuccugaauucagc

SEQ ID NO: 590539 - RNA, 19 nt, Human
cgagggccgaaaugcagca

SEQ ID NO: 590540 - RNA, 23 nt, Human
cgagggccgaaaugcagcagcca

SEQ ID NO: 590541 - RNA, 24 nt, Human
cggagccucccaccccaggauaca

SEQ ID NO: 590542 - RNA, 23 nt, Human
cuccugaauucagcaaggaugua

SEQ ID NO: 590543 - RNA, 21 nt, Human
cugaaaagagauaauguggua

SEQ ID NO: 590544 - RNA, 22 nt, Human
cugcagcgccugcaggagaacu

SEQ ID NO: 590545 - RNA, 24 nt, Human
cuuaagagcugcuccuuuuucccc

SEQ ID NO: 590546 - RNA, 23 nt, Human
cuucacaguggugcaacauaacu

SEQ ID NO: 590547 - RNA, 20 nt, Human
gaaaugcagcagccauacug

SEQ ID NO: 590548 - RNA, 19 nt, Human
gacagagccggagccuccc

SEQ ID NO: 590549 - RNA, 22 nt, Human
gaccagguuccuucaaggaucc

SEQ ID NO: 590550 - RNA, 20 nt, Human
gauccauagguggacugaaa

SEQ ID NO: 590551 - RNA, 24 nt, Human
gcaaaacaccagacacauacagaa

SEQ ID NO: 590552 - RNA, 21 nt, Human
gcaaacaccugaagcugugac

SEQ ID NO: 590553 - RNA, 23 nt, Human
gccgaaaugcagcagccauacug

SEQ ID NO: 590554 - RNA, 18 nt, Human
ggagccaagcuugcaucu

SEQ ID NO: 590555 - RNA, 19 nt, Human
gggaagcgccuuucugagg

SEQ ID NO: 590556 - RNA, 18 nt, Human
ggugucggaagcugaacc

SEQ ID NO: 590557 - RNA, 18 nt, Human
guuucuuuuucaaguuuc

SEQ ID NO: 590558 - RNA, 23 nt, Human
uaacacaaccucacaaaaagcgg

SEQ ID NO: 590559 - RNA, 22 nt, Human
uagaagcaggccccucagaucc

SEQ ID NO: 590560 - RNA, 24 nt, Human
uauacucccccaaagugaaauuuu

SEQ ID NO: 590561 - RNA, 22 nt, Human
uaucucauuucauccucacacc

SEQ ID NO: 590562 - RNA, 20 nt, Human
ucacacaaauguaguaaggu

SEQ ID NO: 590563 - RNA, 23 nt, Human
ucagcacacugucugcugaagug

SEQ ID NO: 590564 - RNA, 24 nt, Human
ucauuucauccucacaccaagccu

SEQ ID NO: 590565 - RNA, 19 nt, Human
uccacacuuguagugaaau

SEQ ID NO: 590566 - RNA, 22 nt, Human
uccacacuuguagugaaauuca

SEQ ID NO: 590567 - RNA, 23 nt, Human
uccccauuuaccaaaugaggaaa

SEQ ID NO: 590568 - RNA, 25 nt, Human
uccuuuuuccccucugaaaagagau

SEQ ID NO: 590569 - RNA, 24 nt, Human
ucgagggccgaaaugcagcagcca

SEQ ID NO: 590570 - RNA, 22 nt, Human
ucucagagaucggcaugguacc

SEQ ID NO: 590571 - RNA, 23 nt, Human
ucuuuuguugaaauucuuuuaau

SEQ ID NO: 590572 - RNA, 23 nt, Human
ugcaaguaacuacuccuuugaaa

SEQ ID NO: 590573 - RNA, 25 nt, Human
ugcauggaucguuuccuuaaccucc

SEQ ID NO: 590574 - RNA, 22 nt, Human
uugagcagaaggaagaacucau

SEQ ID NO: 590575 - RNA, 19 nt, Human
uuuuuuuuuuuuuuuugca

SEQ ID NO: 590576 - RNA, 21 nt, Human
uuuuuuuuuuuuuuuuugcau

SEQ ID NO: 590577 - RNA, 20 nt, Human
uuuuuuuuuuuuuuuuuugg

SEQ ID NO: 590578 - RNA, 22 nt, Human
aaaguuucugugggucaggagu

SEQ ID NO: 590579 - RNA, 22 nt, Human
aagacaaaaacauguagaagga

SEQ ID NO: 590580 - RNA, 22 nt, Human
aaguucuuuuaucagugacuuu

SEQ ID NO: 590581 - RNA, 21 nt, Human
agaggucaguaagacaaaaac

SEQ ID NO: 590582 - RNA, 22 nt, Human
aggcaucuuuucauguuguuuu

SEQ ID NO: 590583 - RNA, 19 nt, Human
aggcguuggcuggggcugg

SEQ ID NO: 590584 - RNA, 24 nt, Human
agugacuuuucccuuccuggcccc

SEQ ID NO: 590585 - RNA, 19 nt, Human
caaaaacauguagaaggag

SEQ ID NO: 590586 - RNA, 22 nt, Human
caaagucagcugauuagaaacc

SEQ ID NO: 590587 - RNA, 20 nt, Human
cacucucuuuuaaaggacua

SEQ ID NO: 590588 - RNA, 24 nt, Human
cauguuguuuucucacaguuuuaa

SEQ ID NO: 590589 - RNA, 23 nt, Human
cccacccacacucaaugggggag

SEQ ID NO: 590590 - RNA, 19 nt, Human
cccaucacuuuugccauau

SEQ ID NO: 590591 - RNA, 20 nt, Human
cugaaaguuucuguggguca

SEQ ID NO: 590592 - RNA, 25 nt, Human
cuggucauagaaaauagaaggcaaa

SEQ ID NO: 590593 - RNA, 18 nt, Human
uaaaaaacaacauggcuu

SEQ ID NO: 590594 - RNA, 20 nt, Human
uaaagguuuuuuuuuuuaaa

SEQ ID NO: 590595 - RNA, 18 nt, Human
uaacauaacauaauaugg

SEQ ID NO: 590596 - RNA, 19 nt, Human
uaacuggcuugauuuggga

SEQ ID NO: 590597 - RNA, 22 nt, Human
uacaaagaaaaaauuauagaac

SEQ ID NO: 590598 - RNA, 23 nt, Human
uaccuuugacagacugugauuuu

SEQ ID NO: 590599 - RNA, 20 nt, Human
uagaaaauagaaggcaaaau

SEQ ID NO: 590600 - RNA, 19 nt, Human
uagaaggagguauacuucu

SEQ ID NO: 590601 - RNA, 20 nt, Human
uagaaggagguauacuucuu

SEQ ID NO: 590602 - RNA, 21 nt, Human
uagcucuuuuucuugacauug

SEQ ID NO: 590603 - RNA, 18 nt, Human
uaggucaggcccacccag

SEQ ID NO: 590604 - RNA, 22 nt, Human
uauaugaacuuaaauggaauaa

SEQ ID NO: 590605 - RNA, 22 nt, Human
uauccuuuuccuauauuacacu

SEQ ID NO: 590606 - RNA, 19 nt, Human
uccucugcucagaguuuca

SEQ ID NO: 590607 - RNA, 25 nt, Human
ucucuuugcacaggaaucucugguc

SEQ ID NO: 590608 - RNA, 19 nt, Human
ugaaaaaaauagauguuug

SEQ ID NO: 590609 - RNA, 19 nt, Human
ugaaaggucauuuuucucc

SEQ ID NO: 590610 - RNA, 19 nt, Human
ugcaagcaaggcguuggcu

SEQ ID NO: 590611 - RNA, 18 nt, Human
uggcuugauuugggaacc

SEQ ID NO: 590612 - RNA, 18 nt, Human
ugggagagaugaucccau

SEQ ID NO: 590613 - RNA, 28 nt, Human
ugggucaggaguccaaacgucggauccg

SEQ ID NO: 590614 - RNA, 19 nt, Human
uuaaaggacaacaauucca

SEQ ID NO: 590615 - RNA, 21 nt, Human
uuaaaggacaacaauuccauu

SEQ ID NO: 590616 - RNA, 21 nt, Human
uuaaaggacuagucugauuag

SEQ ID NO: 590617 - RNA, 24 nt, Human
uuacaugucccacccacacucaau

SEQ ID NO: 590618 - RNA, 22 nt, Human
uucuacagacccagagucaugu

SEQ ID NO: 590619 - RNA, 24 nt, Human
uugaggucuucauugacacucucu

SEQ ID NO: 590620 - RNA, 23 nt, Human
uuuaaaguuuucuuuuaauaccu

SEQ ID NO: 590621 - RNA, 19 nt, Human
uuuacuaagaauccugcca

SEQ ID NO: 590622 - RNA, 21 nt, Human
uuuuuuuuuuuaaaguuuucu

SEQ ID NO: 590623 - RNA, 20 nt, Human
aaagugcugggauuacaggc

SEQ ID NO: 590624 - RNA, 23 nt, Human
aaagugcugggauuacaggcgua

SEQ ID NO: 590625 - RNA, 19 nt, Human
aagugcugggauuacaggc

SEQ ID NO: 590626 - RNA, 19 nt, Human
aagugcugggauuacaggc

SEQ ID NO: 590627 - RNA, 26 nt, Human
aagugcugggauuacaggcguaagcc

SEQ ID NO: 590628 - RNA, 18 nt, Human
acaggcguaagccaccgu

SEQ ID NO: 590629 - RNA, 18 nt, Human
acaggguuucaccauguu

SEQ ID NO: 590630 - RNA, 19 nt, Human
acaggguuucaccauguug

SEQ ID NO: 590631 - RNA, 24 nt, Human
acaggguuucaccauguugcccag

SEQ ID NO: 590632 - RNA, 25 nt, Human
acccgccucggccucccaaagugcu

SEQ ID NO: 590633 - RNA, 24 nt, Human
accguguuggccaggauggucucg

SEQ ID NO: 590634 - RNA, 18 nt, Human
acgggguuucaccguguu

SEQ ID NO: 590635 - RNA, 23 nt, Human
acgggguuucaccguguuggcca

SEQ ID NO: 590636 - RNA, 24 nt, Human
acgggguuucaccguguuggccag

SEQ ID NO: 590637 - RNA, 18 nt, Human
acucugucacccaggcug

SEQ ID NO: 590638 - RNA, 25 nt, Human
acucugucacccaggcugaagugca

SEQ ID NO: 590639 - RNA, 23 nt, Human
agacaggguuucaccauguugcc

SEQ ID NO: 590640 - RNA, 19 nt, Human
agagacgggguuucaccgu

SEQ ID NO: 590641 - RNA, 21 nt, Human
agaggcugcugcagagccacc

SEQ ID NO: 590642 - RNA, 23 nt, Human
aggcguaagccaccgugcccggc

SEQ ID NO: 590643 - RNA, 24 nt, Human
aggcugaagugcaguggugcgauc

SEQ ID NO: 590644 - RNA, 20 nt, Human
agugcaguggugcgaucucg

SEQ ID NO: 590645 - RNA, 23 nt, Human
agugcaguggugcgaucucggcu

SEQ ID NO: 590646 - RNA, 24 nt, Human
agugcaguggugcgaucucggcuc

SEQ ID NO: 590647 - RNA, 18 nt, Human
agugcugggauuacaggc

SEQ ID NO: 590648 - RNA, 24 nt, Human
caaagugcugggauuacaggcgua

SEQ ID NO: 590649 - RNA, 24 nt, Human
cacaggcgcccgccaccacgccca

SEQ ID NO: 590650 - RNA, 23 nt, Human
caccauguugcccagguuguuuc

SEQ ID NO: 590651 - RNA, 23 nt, Human
cacccgccucggccucccaaagu

SEQ ID NO: 590652 - RNA, 19 nt, Human
caccgcaaguuccgccucc

SEQ ID NO: 590653 - RNA, 18 nt, Human
caccguguuggccaggau

SEQ ID NO: 590654 - RNA, 21 nt, Human
caccguguuggccaggauggu

SEQ ID NO: 590655 - RNA, 24 nt, Human
caccguguuggccaggauggucuc

SEQ ID NO: 590656 - RNA, 23 nt, Human
cacucugucacccaggcugaagu

SEQ ID NO: 590657 - RNA, 24 nt, Human
cacucugucacccaggcugaagug

SEQ ID NO: 590658 - RNA, 19 nt, Human
cagccccccgaguaacugg

SEQ ID NO: 590659 - RNA, 21 nt, Human
caggcgcccgccaccacgccc

SEQ ID NO: 590660 - RNA, 24 nt, Human
caggguuucaccauguugcccagg

SEQ ID NO: 590661 - RNA, 22 nt, Human
caugccauucuccugccucagc

SEQ ID NO: 590662 - RNA, 21 nt, Human
cauguugcccagguuguuuca

SEQ ID NO: 590663 - RNA, 22 nt, Human
ccaaagugcugggauuacaggc

SEQ ID NO: 590664 - RNA, 22 nt, Human
ccaaagugcugggauuacaggc

SEQ ID NO: 590665 - RNA, 24 nt, Human
ccaaagugcugggauuacaggcgu

SEQ ID NO: 590666 - RNA, 21 nt, Human
cccgccaccacgcccagcuaa

SEQ ID NO: 590667 - RNA, 20 nt, Human
ccugaccucgugauccaccc

SEQ ID NO: 590668 - RNA, 23 nt, Human
ccugggccucccagagccaagaa

SEQ ID NO: 590669 - RNA, 19 nt, Human
cgccucccggguucaugcc

SEQ ID NO: 590670 - RNA, 24 nt, Human
cgccucggccucccaaagugcugg

SEQ ID NO: 590671 - RNA, 24 nt, Human
cgggguuucaccguguuggccagg

SEQ ID NO: 590672 - RNA, 21 nt, Human
cucccagagccaagaacuagc

SEQ ID NO: 590673 - RNA, 21 nt, Human
cucccggguucaugccauucu

SEQ ID NO: 590674 - RNA, 24 nt, Human
cuccugaccucgugauccacccgc

SEQ ID NO: 590675 - RNA, 22 nt, Human
cuccugccucagccccccgagu

SEQ ID NO: 590676 - RNA, 24 nt, Human
cuccugccucagccccccgaguaa

SEQ ID NO: 590677 - RNA, 22 nt, Human
gaccucgugauccacccgccuc

SEQ ID NO: 590678 - RNA, 22 nt, Human
gaccucgugauccacccgccuc

SEQ ID NO: 590679 - RNA, 24 nt, Human
gaccucgugauccacccgccucgg

SEQ ID NO: 590680 - RNA, 24 nt, Human
gagacgggguuucaccguguuggc

SEQ ID NO: 590681 - RNA, 25 nt, Human
gaguaacugggaccacaggcgcccg

SEQ ID NO: 590682 - RNA, 18 nt, Human
gauuacaggcguaagcca

SEQ ID NO: 590683 - RNA, 21 nt, Human
gauuacaggcguaagccaccg

SEQ ID NO: 590684 - RNA, 24 nt, Human
gauuacaggcguaagccaccgugc

SEQ ID NO: 590685 - RNA, 23 nt, Human
gcccagcuaauuuuuuguauuuu

SEQ ID NO: 590686 - RNA, 25 nt, Human
gccucccggguucaugccauucucc

SEQ ID NO: 590687 - RNA, 24 nt, Human
ggauuacaggcguaagccaccgug

SEQ ID NO: 590688 - RNA, 23 nt, Human
gggguuucaccguguuggccagg

SEQ ID NO: 590689 - RNA, 20 nt, Human
ggucucgaucuccugaccuc

SEQ ID NO: 590690 - RNA, 20 nt, Human
gguggcagaggcugcugcag

SEQ ID NO: 590691 - RNA, 23 nt, Human
guagagacgggguuucaccgugu

SEQ ID NO: 590692 - RNA, 24 nt, Human
gugauccacccgccucggccuccc

SEQ ID NO: 590693 - RNA, 18 nt, Human
guuuuaauccaggcuggu

SEQ ID NO: 590694 - RNA, 22 nt, Human
uaaagacaggguuucaccaugu

SEQ ID NO: 590695 - RNA, 19 nt, Human
uaacugggaccacaggcgc

SEQ ID NO: 590696 - RNA, 24 nt, Human
uaauuuuuuguauuuuuaguagag

SEQ ID NO: 590697 - RNA, 25 nt, Human
uaauuuuuuguauuuuuaguagaga

SEQ ID NO: 590698 - RNA, 23 nt, Human
uacaggcguaagccaccgugccc

SEQ ID NO: 590699 - RNA, 21 nt, Human
uaguagagacgggguuucacc

SEQ ID NO: 590700 - RNA, 24 nt, Human
uaguagagacgggguuucaccgug

SEQ ID NO: 590701 - RNA, 26 nt, Human
uaguagagacgggguuucaccguguu

SEQ ID NO: 590702 - RNA, 26 nt, Human
uaguagagacgggguuucaccguugg

SEQ ID NO: 590703 - RNA, 28 nt, Human
uauuuuauuuuuuguaaagacaggguuu

SEQ ID NO: 590704 - RNA, 24 nt, Human
ucaccgcaaguuccgccucccggg

SEQ ID NO: 590705 - RNA, 24 nt, Human
ucaccguguuggccaggauggucu

SEQ ID NO: 590706 - RNA, 18 nt, Human
ucaugccauucuccugcc

SEQ ID NO: 590707 - RNA, 24 nt, Human
ucccaaagugcugggauuacaggc

SEQ ID NO: 590708 - RNA, 21 nt, Human
ucccagagccaagaacuagca

SEQ ID NO: 590709 - RNA, 21 nt, Human
ucccggguucaugccauucuc

SEQ ID NO: 590710 - RNA, 24 nt, Human
ucccggguucaugccauucuccug

SEQ ID NO: 590711 - RNA, 18 nt, Human
ucggccucccaaagugcu

SEQ ID NO: 590712 - RNA, 19 nt, Human
ucucacucugucacccagg

SEQ ID NO: 590713 - RNA, 24 nt, Human
ucucacucugucacccaggcugaa

SEQ ID NO: 590714 - RNA, 26 nt, Human
ucucacucugucacccaggcugaagu

SEQ ID NO: 590715 - RNA, 27 nt, Human
ucucacucugucacccaggcugaagug

SEQ ID NO: 590716 - RNA, 24 nt, Human
ucugucacccaggcugaagugcag

SEQ ID NO: 590717 - RNA, 24 nt, Human
ugaagugcaguggugcgaucucgg

SEQ ID NO: 590718 - RNA, 18 nt, Human
ugagacagagucucacuc

SEQ ID NO: 590719 - RNA, 22 nt, Human
ugagacagagucucacucuguc

SEQ ID NO: 590720 - RNA, 21 nt, Human
ugccucagccccccgaguaac

SEQ ID NO: 590721 - RNA, 24 nt, Human
ugccucagccccccgaguaacugg

SEQ ID NO: 590722 - RNA, 24 nt, Human
ugcugggauuacaggcguaagcca

SEQ ID NO: 590723 - RNA, 24 nt, Human
uggccaggauggucucgaucuccu

SEQ ID NO: 590724 - RNA, 21 nt, Human
ugggaccacaggcgcccgcca

SEQ ID NO: 590725 - RNA, 24 nt, Human
ugggaccacaggcgcccgccacca

SEQ ID NO: 590726 - RNA, 18 nt, Human
ugggauuacaggcguaag

SEQ ID NO: 590727 - RNA, 21 nt, Human
ugggauuacaggcguaagcca

SEQ ID NO: 590728 - RNA, 22 nt, Human
ugggauuacaggcguaagccac

SEQ ID NO: 590729 - RNA, 23 nt, Human
ugggauuacaggcguaagccacc

SEQ ID NO: 590730 - RNA, 23 nt, Human
ugggauuacaggcguaagccacc

SEQ ID NO: 590731 - RNA, 24 nt, Human
ugggauuacaggcguaagccaccg

SEQ ID NO: 590732 - RNA, 21 nt, Human
ugggccucccagagccaagaa

SEQ ID NO: 590733 - RNA, 21 nt, Human
uguauuuuuaguagagacggg

SEQ ID NO: 590734 - RNA, 18 nt, Human
uuaauccaggcugguuau

SEQ ID NO: 590735 - RNA, 18 nt, Human
uuaguagagacgggguuu

SEQ ID NO: 590736 - RNA, 22 nt, Human
uuaguagagacgggguuucacc

SEQ ID NO: 590737 - RNA, 24 nt, Human
uuaguagagacgggguuucaccgu

SEQ ID NO: 590738 - RNA, 24 nt, Human
uucacauuguuuuaauccaggcug

SEQ ID NO: 590739 - RNA, 19 nt, Human
uucaugccauucuccugcc

SEQ ID NO: 590740 - RNA, 24 nt, Human
uuguaaagacaggguuucaccaug

SEQ ID NO: 590741 - RNA, 23 nt, Human
uuguauuuuuaguagagacgggg

SEQ ID NO: 590742 - RNA, 19 nt, Human
uuucaccauguugcccagg

SEQ ID NO: 590743 - RNA, 19 nt, Human
uuucaccguguuggccagg

SEQ ID NO: 590744 - RNA, 24 nt, Human
uuuuuaguagagacgggguuucac

SEQ ID NO: 590745 - RNA, 21 nt, Human
uuuuuguauuuuuaguagaga

SEQ ID NO: 590746 - RNA, 24 nt, Human
uuuuuuguauuuuuaguagagacg

SEQ ID NO: 590747 - RNA, 23 nt, Human
aaacaaagagaaaaaugcaucca

SEQ ID NO: 590748 - RNA, 24 nt, Human
aaacaaagagaaaaaugcauccaa

SEQ ID NO: 590749 - RNA, 25 nt, Human
aaccuacagaaccuccaccaaaaga

SEQ ID NO: 590750 - RNA, 24 nt, Human
aagagagaagugggucucugagga

SEQ ID NO: 590751 - RNA, 21 nt, Human
aaggaggcauuuaaccaucga

SEQ ID NO: 590752 - RNA, 19 nt, Human
acuuuggaaacaaagagaa

SEQ ID NO: 590753 - RNA, 21 nt, Human
agacaaggcuuccugagugug

SEQ ID NO: 590754 - RNA, 27 nt, Human
agaucacuagaguccaggaguucaaga

SEQ ID NO: 590755 - RNA, 24 nt, Human
agcacuuugggagguugagguggg

SEQ ID NO: 590756 - RNA, 23 nt, Human
agccugggcaacauggcaaagcc

SEQ ID NO: 590757 - RNA, 24 nt, Human
agccugggcaacauggcaaagccu

SEQ ID NO: 590758 - RNA, 23 nt, Human
agcuaggugugguggugugugcc

SEQ ID NO: 590759 - RNA, 21 nt, Human
agcucaugccuguaaucccag

SEQ ID NO: 590760 - RNA, 23 nt, Human
aggaguucaagaccagccugggc

SEQ ID NO: 590761 - RNA, 20 nt, Human
aggaugaggcgggaggauug

SEQ ID NO: 590762 - RNA, 26 nt, Human
aggcauuuaaccaucgaaaguaaaua

SEQ ID NO: 590763 - RNA, 24 nt, Human
aggcgugguagcucaugccuguaa

SEQ ID NO: 590764 - RNA, 21 nt, Human
agguugaggugggcagaucac

SEQ ID NO: 590765 - RNA, 27 nt, Human
aguccaggaguucaagaccagccuggg

SEQ ID NO: 590766 - RNA, 25 nt, Human
augcagaaggaugaggcgggaggau

SEQ ID NO: 590767 - RNA, 19 nt, Human
augccuguaaucccagcac

SEQ ID NO: 590768 - RNA, 22 nt, Human
caacauggcaaagccuugucuc

SEQ ID NO: 590769 - RNA, 22 nt, Human
cacacacaaaaaaauacaaaaa

SEQ ID NO: 590770 - RNA, 24 nt, Human
cagaucacuagaguccaggaguuc

SEQ ID NO: 590771 - RNA, 21 nt, Human
cagcacuuugggagguugagg

SEQ ID NO: 590772 - RNA, 24 nt, Human
cagcacuuugggagguugaggugg

SEQ ID NO: 590773 - RNA, 19 nt, Human
cagcagcugaggccacaac

SEQ ID NO: 590774 - RNA, 26 nt, Human
cagcauaaguaaucccaaaagcaaug

SEQ ID NO: 590775 - RNA, 18 nt, Human
caguauauauacaggaua

SEQ ID NO: 590776 - RNA, 20 nt, Human
caugccuguaaucccagcac

SEQ ID NO: 590777 - RNA, 24 nt, Human
caugccuguaaucccagcacuuug

SEQ ID NO: 590778 - RNA, 28 nt, Human
cauguaagcuucuuucaaggugaagcuu

SEQ ID NO: 590779 - RNA, 22 nt, Human
ccaaaguuuccaaauggagacu

SEQ ID NO: 590780 - RNA, 22 nt, Human
ccagugaaggaagugaauuggg

SEQ ID NO: 590781 - RNA, 19 nt, Human
ccuacagaaccuccaccaa

SEQ ID NO: 590782 - RNA, 23 nt, Human
ccuauacuuuggaaacaaagaga

SEQ ID NO: 590783 - RNA, 21 nt, Human
ccugggcaacauggcaaagcc

SEQ ID NO: 590784 - RNA, 21 nt, Human
ccuuuagucccaguuaugcag

SEQ ID NO: 590785 - RNA, 21 nt, Human
cgcacgcacgcuuuccugccc

SEQ ID NO: 590786 - RNA, 20 nt, Human
cgcccacucucuuagccgca

SEQ ID NO: 590787 - RNA, 19 nt, Human
cgggaggauugauaaacua

SEQ ID NO: 590788 - RNA, 24 nt, Human
cucaugccuguaaucccagcacuu

SEQ ID NO: 590789 - RNA, 21 nt, Human
cuccacacacaaaaaaauaca

SEQ ID NO: 590790 - RNA, 23 nt, Human
cucuggcaacugcagaaaaguuu

SEQ ID NO: 590791 - RNA, 24 nt, Human
gaaccuacagaaccuccaccaaaa

SEQ ID NO: 590792 - RNA, 25 nt, Human
gagacuugacaucaggacagaaacg

SEQ ID NO: 590793 - RNA, 18 nt, Human
gccuugucuccacacaca

SEQ ID NO: 590794 - RNA, 19 nt, Human
gcgcccacucucuuagccg

SEQ ID NO: 590795 - RNA, 20 nt, Human
gcugacuugcccuauauacc

SEQ ID NO: 590796 - RNA, 28 nt, Human
ggaaacaaagagaaaaaugccgguaccc

SEQ ID NO: 590797 - RNA, 18 nt, Human
ggagguugaggugggcag

SEQ ID NO: 590798 - RNA, 22 nt, Human
ggagguugaggugggcagauca

SEQ ID NO: 590799 - RNA, 21 nt, Human
ggauaggcgugguagcucaug

SEQ ID NO: 590800 - RNA, 23 nt, Human
ggccgcgagagcgcccacucucu

SEQ ID NO: 590801 - RNA, 26 nt, Human
gggcagaucacuagaguccaggaguu

SEQ ID NO: 590802 - RNA, 24 nt, Human
gguagcucaugccuguaaucccag

SEQ ID NO: 590803 - RNA, 20 nt, Human
uagacaaggcuuccugagug

SEQ ID NO: 590804 - RNA, 22 nt, Human
uagcucaugccuguaaucccag

SEQ ID NO: 590805 - RNA, 24 nt, Human
uagcucaugccuguaaucccagca

SEQ ID NO: 590806 - RNA, 26 nt, Human
uaugcagaaggaugaggcgggaggau

SEQ ID NO: 590807 - RNA, 27 nt, Human
uaugcagaaggaugaggcgggaggauu

SEQ ID NO: 590808 - RNA, 23 nt, Human
ucacuagaguccaggaguucaag

SEQ ID NO: 590809 - RNA, 26 nt, Human
ucacuagaguccaggaguucaagacc

SEQ ID NO: 590810 - RNA, 27 nt, Human
ucauccagagacaacaaugggguggga

SEQ ID NO: 590811 - RNA, 22 nt, Human
ucaugccuguaaucccagcacu

SEQ ID NO: 590812 - RNA, 20 nt, Human
uccaaauggagacuuagcuc

SEQ ID NO: 590813 - RNA, 19 nt, Human
uccaugguagaaaccugaa

SEQ ID NO: 590814 - RNA, 18 nt, Human
ucccugugggccugucaa

SEQ ID NO: 590815 - RNA, 21 nt, Human
ucucugaggaguaucuggggc

SEQ ID NO: 590816 - RNA, 21 nt, Human
ucucuuagccgcacgcacgcu

SEQ ID NO: 590817 - RNA, 25 nt, Human
ugaagcuuggaagcuguucuccaag

SEQ ID NO: 590818 - RNA, 19 nt, Human
ugagaccaaaguuuccaaa

SEQ ID NO: 590819 - RNA, 18 nt, Human
ugaggugggcagaucacu

SEQ ID NO: 590820 - RNA, 25 nt, Human
ugaggugggcagaucacuagagucc

SEQ ID NO: 590821 - RNA, 26 nt, Human
ugaggugggcagaucacuagagucca

SEQ ID NO: 590822 - RNA, 24 nt, Human
ugaguuccacagcauaaguaaucc

SEQ ID NO: 590823 - RNA, 23 nt, Human
ugccuguaaucccagcacuuugg

SEQ ID NO: 590824 - RNA, 24 nt, Human
ugccuguaaucccagcacuuuggg

SEQ ID NO: 590825 - RNA, 21 nt, Human
uggaaacaaagagaaaaaugc

SEQ ID NO: 590826 - RNA, 24 nt, Human
uggcaaaggaaagcagcaaucauc

SEQ ID NO: 590827 - RNA, 22 nt, Human
uggcuagacuucauccagagac

SEQ ID NO: 590828 - RNA, 20 nt, Human
ugggagguugaggugggcag

SEQ ID NO: 590829 - RNA, 24 nt, Human
ugggagguugaggugggcagauca

SEQ ID NO: 590830 - RNA, 25 nt, Human
uggggugggacccagugaaggaagu

SEQ ID NO: 590831 - RNA, 24 nt, Human
ugguagcucaugccuguaauccca

SEQ ID NO: 590832 - RNA, 24 nt, Human
ugguggugugugccuuuaguccca

SEQ ID NO: 590833 - RNA, 24 nt, Human
uggugugugccuuuagucccaguu

SEQ ID NO: 590834 - RNA, 24 nt, Human
uuagcuaggugugguggugugugc

SEQ ID NO: 590835 - RNA, 20 nt, Human
uuagucccaguuaugcagaa

SEQ ID NO: 590836 - RNA, 23 nt, Human
uuccugaguguguggugcuuucu

SEQ ID NO: 590837 - RNA, 21 nt, Human
uugagaccaaaguuuccaaau

SEQ ID NO: 590838 - RNA, 18 nt, Human
aaacaggguuuugccaug

SEQ ID NO: 590839 - RNA, 19 nt, Human
aacaggguuuugccauguu

SEQ ID NO: 590840 - RNA, 19 nt, Human
acaaucuaccugccuuggc

SEQ ID NO: 590841 - RNA, 22 nt, Human
acaaucuaccugccuuggcuuc

SEQ ID NO: 590842 - RNA, 24 nt, Human
acaaugcagugguuaucuuugacc

SEQ ID NO: 590843 - RNA, 24 nt, Human
acagagucaugaacauaagcucac

SEQ ID NO: 590844 - RNA, 18 nt, Human
acaggguuuugccauguu

SEQ ID NO: 590845 - RNA, 19 nt, Human
acaggguuuugccauguug

SEQ ID NO: 590846 - RNA, 24 nt, Human
acaggguuuugccauguugcccag

SEQ ID NO: 590847 - RNA, 23 nt, Human
acccaggcuggagugcaguggug

SEQ ID NO: 590848 - RNA, 21 nt, Human
accucagccuacugaggagcu

SEQ ID NO: 590849 - RNA, 23 nt, Human
accugccuuggcuucccaaagug

SEQ ID NO: 590850 - RNA, 23 nt, Human
agaaaauuauuauuucuauguua

SEQ ID NO: 590851 - RNA, 22 nt, Human
agaagccacuugacccuccacg

SEQ ID NO: 590852 - RNA, 24 nt, Human
agacccagcuaacuuuguguagaa

SEQ ID NO: 590853 - RNA, 19 nt, Human
agauuacaggcaugcgcca

SEQ ID NO: 590854 - RNA, 22 nt, Human
agcucacugcagccuagaccuc

SEQ ID NO: 590855 - RNA, 25 nt, Human
aggcuggagugcaguggugcaaucu

SEQ ID NO: 590856 - RNA, 21 nt, Human
aguagcugagauuacaggcau

SEQ ID NO: 590857 - RNA, 23 nt, Human
aguagcugagauuacaggcaugc

SEQ ID NO: 590858 - RNA, 21 nt, Human
agugcaguggugcaaucucag

SEQ ID NO: 590859 - RNA, 19 nt, Human
auacagagucaugaacaua

SEQ ID NO: 590860 - RNA, 19 nt, Human
augaacauaagcucacugc

SEQ ID NO: 590861 - RNA, 20 nt, Human
augaacauaagcucacugca

SEQ ID NO: 590862 - RNA, 22 nt, Human
auuauuauuauuauuauuuucu

SEQ ID NO: 590863 - RNA, 24 nt, Human
auugauucuccugccucagccucc

SEQ ID NO: 590864 - RNA, 21 nt, Human
caaacuccugggcuacaaucu

SEQ ID NO: 590865 - RNA, 20 nt, Human
caagugauccucucaccuca

SEQ ID NO: 590866 - RNA, 22 nt, Human
caauugauucuccugccucagc

SEQ ID NO: 590867 - RNA, 24 nt, Human
caccaugccuggcuaauuuuugua

SEQ ID NO: 590868 - RNA, 24 nt, Human
cacccaggcuggagugcaguggug

SEQ ID NO: 590869 - RNA, 24 nt, Human
caccucagccuacugaggagcugg

SEQ ID NO: 590870 - RNA, 19 nt, Human
cacggccgaggacccgcgc

SEQ ID NO: 590871 - RNA, 20 nt, Human
cagccuacugaggagcugga

SEQ ID NO: 590872 - RNA, 24 nt, Human
cagccuagaccuccugggcucaag

SEQ ID NO: 590873 - RNA, 20 nt, Human
cagccuccugaguagcugag

SEQ ID NO: 590874 - RNA, 24 nt, Human
caggguuuugccauguugcccagg

SEQ ID NO: 590875 - RNA, 21 nt, Human
cauccagccuggaauacagag

SEQ ID NO: 590876 - RNA, 23 nt, Human
cauguugcccaggcuguucucaa

SEQ ID NO: 590877 - RNA, 24 nt, Human
cauguugcccaggcuguucucaaa

SEQ ID NO: 590878 - RNA, 18 nt, Human
ccacagaggcaccagacc

SEQ ID NO: 590879 - RNA, 22 nt, Human
cccuccacggccgaggacccgc

SEQ ID NO: 590880 - RNA, 22 nt, Human
ccuagaccuccugggcucaagu

SEQ ID NO: 590881 - RNA, 24 nt, Human
ccuccugggcucaagugauccucu

SEQ ID NO: 590882 - RNA, 24 nt, Human
ccucucaccucagccuacugagga

SEQ ID NO: 590883 - RNA, 19 nt, Human
ccugaguagcugagauuac

SEQ ID NO: 590884 - RNA, 23 nt, Human
ccugaguagcugagauuacaggc

SEQ ID NO: 590885 - RNA, 24 nt, Human
ccugaguagcugagauuacaggca

SEQ ID NO: 590886 - RNA, 23 nt, Human
ccugccucagccuccugaguagc

SEQ ID NO: 590887 - RNA, 22 nt, Human
ccugggcucaagugauccucuc

SEQ ID NO: 590888 - RNA, 22 nt, Human
cgcuccccucccucagcgcuca

SEQ ID NO: 590889 - RNA, 26 nt, Human
cucaagugauccucucaccucagccu

SEQ ID NO: 590890 - RNA, 24 nt, Human
cucacugcagccuagaccuccugg

SEQ ID NO: 590891 - RNA, 18 nt, Human
cuccugggcuacaaucua

SEQ ID NO: 590892 - RNA, 23 nt, Human
cugaguagcugagauuacaggca

SEQ ID NO: 590893 - RNA, 24 nt, Human
cugaguagcugagauuacaggcau

SEQ ID NO: 590894 - RNA, 23 nt, Human
cugcagccuagaccuccugggcu

SEQ ID NO: 590895 - RNA, 23 nt, Human
cugccucagccuccugaguagcu

SEQ ID NO: 590896 - RNA, 24 nt, Human
cuugcucugucacccaggcuggag

SEQ ID NO: 590897 - RNA, 24 nt, Human
cuuuguguagaaacaggguuuugc

SEQ ID NO: 590898 - RNA, 19 nt, Human
gaagaagccacuugacccu

SEQ ID NO: 590899 - RNA, 20 nt, Human
gaagaagccacuugacccuc

SEQ ID NO: 590900 - RNA, 21 nt, Human
gagacaagaucuugcucuauc

SEQ ID NO: 590901 - RNA, 22 nt, Human
gaguagcugagauuacaggcau

SEQ ID NO: 590902 - RNA, 18 nt, Human
gauuacaggcaugcgcca

SEQ ID NO: 590903 - RNA, 24 nt, Human
gauuacaggcaugcgccaccaugc

SEQ ID NO: 590904 - RNA, 22 nt, Human
gccuuggcuucccaaagugcug

SEQ ID NO: 590905 - RNA, 22 nt, Human
gcuacaaucuaccugccuuggc

SEQ ID NO: 590906 - RNA, 18 nt, Human
gcucaagugauccucuca

SEQ ID NO: 590907 - RNA, 25 nt, Human
gcucugucacccaggcuggagugca

SEQ ID NO: 590908 - RNA, 27 nt, Human
gcuggaaccacagaggcaccagaccca

SEQ ID NO: 590909 - RNA, 22 nt, Human
gggcucaagugauccucucacc

SEQ ID NO: 590910 - RNA, 20 nt, Human
guagcugagauuacaggcau

SEQ ID NO: 590911 - RNA, 20 nt, Human
gugcaaucucagcucucagc

SEQ ID NO: 590912 - RNA, 23 nt, Human
uacagagucaugaacauaagcuc

SEQ ID NO: 590913 - RNA, 22 nt, Human
uacaggcaugcgccaccaugcc

SEQ ID NO: 590914 - RNA, 23 nt, Human
uaccugccuuggcuucccaaagu

SEQ ID NO: 590915 - RNA, 21 nt, Human
uagaaaauuauuauuucuaug

SEQ ID NO: 590916 - RNA, 22 nt, Human
uagaaacaggguuuugccaugu

SEQ ID NO: 590917 - RNA, 25 nt, Human
ucaauugauucuccugccucagccu

SEQ ID NO: 590918 - RNA, 24 nt, Human
ucacccaggcuggagugcaguggu

SEQ ID NO: 590919 - RNA, 24 nt, Human
ucacugcagccuagaccuccuggg

SEQ ID NO: 590920 - RNA, 24 nt, Human
uccugaguagcugagauuacaggc

SEQ ID NO: 590921 - RNA, 21 nt, Human
uccugggcucaagugauccuc

SEQ ID NO: 590922 - RNA, 24 nt, Human
uccugggcucaagugauccucuca

SEQ ID NO: 590923 - RNA, 19 nt, Human
ucucagcucaccuccgucu

SEQ ID NO: 590924 - RNA, 24 nt, Human
ucuccugccucagccuccugagua

SEQ ID NO: 590925 - RNA, 24 nt, Human
ucugucacccaggcuggagugcag

SEQ ID NO: 590926 - RNA, 24 nt, Human
ucuugcucuaucauccagccugga

SEQ ID NO: 590927 - RNA, 22 nt, Human
ucuugcucugucacccaggcug

SEQ ID NO: 590928 - RNA, 23 nt, Human
ucuugcucugucacccaggcugg

SEQ ID NO: 590929 - RNA, 24 nt, Human
ucuugcucugucacccaggcugga

SEQ ID NO: 590930 - RNA, 19 nt, Human
ugaacauaagcucacugca

SEQ ID NO: 590931 - RNA, 21 nt, Human
ugagauuacaggcaugcgcca

SEQ ID NO: 590932 - RNA, 22 nt, Human
ugagauuacaggcaugcgccac

SEQ ID NO: 590933 - RNA, 24 nt, Human
ugagauuacaggcaugcgccacca

SEQ ID NO: 590934 - RNA, 20 nt, Human
ugauucuccugccucagccu

SEQ ID NO: 590935 - RNA, 22 nt, Human
ugcaguggugcaaucucagcuc

SEQ ID NO: 590936 - RNA, 24 nt, Human
ugccauguugcccaggcuguucuc

SEQ ID NO: 590937 - RNA, 27 nt, Human
ugccauguugcccaggcuguucucaaa

SEQ ID NO: 590938 - RNA, 24 nt, Human
ugccucagccuccugaguagcuga

SEQ ID NO: 590939 - RNA, 19 nt, Human
ugccuuggcuucccaaagu

SEQ ID NO: 590940 - RNA, 24 nt, Human
ugcucugucacccaggcuggagug

SEQ ID NO: 590941 - RNA, 19 nt, Human
uggaaccacagaggcacca

SEQ ID NO: 590942 - RNA, 18 nt, Human
uggagugcaguggugcaa

SEQ ID NO: 590943 - RNA, 23 nt, Human
uggagugcaguggugcaaucuca

SEQ ID NO: 590944 - RNA, 24 nt, Human
uggagugcaguggugcaaucucag

SEQ ID NO: 590945 - RNA, 19 nt, Human
ugggcucaagugauccucu

SEQ ID NO: 590946 - RNA, 21 nt, Human
uggugcaaucucagcucucag

SEQ ID NO: 590947 - RNA, 22 nt, Human
uguagaaacaggguuuugccau

SEQ ID NO: 590948 - RNA, 23 nt, Human
uguagaaacaggguuuugccaug

SEQ ID NO: 590949 - RNA, 24 nt, Human
uguagaaacaggguuuugccaugu

SEQ ID NO: 590950 - RNA, 23 nt, Human
uuaacaaugcagugguuaucuuu

SEQ ID NO: 590951 - RNA, 23 nt, Human
uucaauugauucuccugccucag

SEQ ID NO: 590952 - RNA, 24 nt, Human
uucuugcucugucacccaggcugg

SEQ ID NO: 590953 - RNA, 24 nt, Human
uugauucuccugccucagccuccu

SEQ ID NO: 590954 - RNA, 24 nt, Human
uugcucugucacccaggcuggagu

SEQ ID NO: 590955 - RNA, 19 nt, Human
uuuugccauguugcccagg

SEQ ID NO: 590956 - RNA, 26 nt, Human
aaaaaaaaaauacaugaguaccagga

SEQ ID NO: 590957 - RNA, 24 nt, Human
aaaaacaaaacaaaacaaaacaaa

SEQ ID NO: 590958 - RNA, 19 nt, Human
aaaaaccagcauuucugca

SEQ ID NO: 590959 - RNA, 20 nt, Human
aaaaacugcaccuucuguca

SEQ ID NO: 590960 - RNA, 18 nt, Human
aaaaauccaggaugaaca

SEQ ID NO: 590961 - RNA, 24 nt, Human
aaaacaaaacaaaaccaaaagaaa

SEQ ID NO: 590962 - RNA, 22 nt, Human
aaaacacccuuguaaaguuuuu

SEQ ID NO: 590963 - RNA, 21 nt, Human
aaaagggauuaaggaacaggg

SEQ ID NO: 590964 - RNA, 20 nt, Human
aaaaugccuacaaugagaug

SEQ ID NO: 590965 - RNA, 22 nt, Human
aaacaaaacaaaacaaaacaaa

SEQ ID NO: 590966 - RNA, 22 nt, Human
aaacaaaacaaaacaaaacaaa

SEQ ID NO: 590967 - RNA, 22 nt, Human
aaacaaaacaaaacaaaaccaa

SEQ ID NO: 590968 - RNA, 23 nt, Human
aaacaaaacaaaacaaaaccaaa

SEQ ID NO: 590969 - RNA, 24 nt, Human
aaacaaaacaaaacaaaaccaaaa

SEQ ID NO: 590970 - RNA, 23 nt, Human
aaacaaacauggcccaguaaaau

SEQ ID NO: 590971 - RNA, 18 nt, Human
aaacaagaaaaaaaacug

SEQ ID NO: 590972 - RNA, 21 nt, Human
aaaugggaagaccauaaaaau

SEQ ID NO: 590973 - RNA, 23 nt, Human
aacaaaacaaaaccaaaagaaaa

SEQ ID NO: 590974 - RNA, 20 nt, Human
aacaaaaccaaaagaaaagu

SEQ ID NO: 590975 - RNA, 19 nt, Human
aagaaaggaaagaaagagg

SEQ ID NO: 590976 - RNA, 21 nt, Human
aagaggcaaaaaccagcacaa

SEQ ID NO: 590977 - RNA, 24 nt, Human
aagaggcaaaaaccagcacaaaug

SEQ ID NO: 590978 - RNA, 26 nt, Human
aagcauuucaguguacaauaguccuu

SEQ ID NO: 590979 - RNA, 21 nt, Human
aauaaaggcuuugcggagaaa

SEQ ID NO: 590980 - RNA, 21 nt, Human
acaaaacaaaacaaaacaaaa

SEQ ID NO: 590981 - RNA, 21 nt, Human
acaaaacaaaacaaaacaaaa

SEQ ID NO: 590982 - RNA, 23 nt, Human
acaaaacaaaacaaaacaaaacc

SEQ ID NO: 590983 - RNA, 22 nt, Human
acaaaacaaaacaaaaccaaaa

SEQ ID NO: 590984 - RNA, 24 nt, Human
acaaaacaaaacaaaaccaaaaga

SEQ ID NO: 590985 - RNA, 18 nt, Human
acaaaaccaaaagaaaag

SEQ ID NO: 590986 - RNA, 24 nt, Human
acaacugugauuauagcaaaguua

SEQ ID NO: 590987 - RNA, 23 nt, Human
acaguagucuuuccuuauguuca

SEQ ID NO: 590988 - RNA, 20 nt, Human
agaaaacaagaaaaaaaacu

SEQ ID NO: 590989 - RNA, 18 nt, Human
agaaaggaaagaaagagg

SEQ ID NO: 590990 - RNA, 19 nt, Human
agaccaaucccuaaaaucc

SEQ ID NO: 590991 - RNA, 24 nt, Human
agcacaaaugggaagaccauaaaa

SEQ ID NO: 590992 - RNA, 24 nt, Human
agugguaagaaaacaagaaaaaaa

SEQ ID NO: 590993 - RNA, 24 nt, Human
auauuacagggucaagaaacaaaa

SEQ ID NO: 590994 - RNA, 21 nt, Human
auuaaggaacagggaggggga

SEQ ID NO: 590995 - RNA, 18 nt, Human
auuauagcaaaguuauug

SEQ ID NO: 590996 - RNA, 18 nt, Human
auuguuuuuaaaaauguu

SEQ ID NO: 590997 - RNA, 24 nt, Human
caaaaacaaaacaaaacaaaacaa

SEQ ID NO: 590998 - RNA, 24 nt, Human
caaaacaaaacaaaacaaaacaaa

SEQ ID NO: 590999 - RNA, 27 nt, Human
caaaacaaaacaaaacaaaacaaaacc

SEQ ID NO: 591000 - RNA, 22 nt, Human
caaaacaaaacaaaacaaaacc

SEQ ID NO: 591001 - RNA, 23 nt, Human
caaaacaaaacaaaacaaaacca

SEQ ID NO: 591002 - RNA, 25 nt, Human
caaaacaaaacaaaacaaaaccaaa

SEQ ID NO: 591003 - RNA, 21 nt, Human
caaaaccaaaagaaaaguccu

SEQ ID NO: 591004 - RNA, 21 nt, Human
caaaagcugcuguccagucau

SEQ ID NO: 591005 - RNA, 22 nt, Human
caacagaagcuaaauacaauug

SEQ ID NO: 591006 - RNA, 24 nt, Human
caagaaaaaaaacugcugcugcau

SEQ ID NO: 591007 - RNA, 21 nt, Human
caauaagacacagcugacacc

SEQ ID NO: 591008 - RNA, 24 nt, Human
caauauuagcagacugucauauua

SEQ ID NO: 591009 - RNA, 24 nt, Human
cacacgcagcagaauacucuuaca

SEQ ID NO: 591010 - RNA, 21 nt, Human
cacuuuuucuuaagacucaag

SEQ ID NO: 591011 - RNA, 22 nt, Human
cagcacaaaugggaagaccaua

SEQ ID NO: 591012 - RNA, 22 nt, Human
cagcacaaaugggaagaccaua

SEQ ID NO: 591013 - RNA, 23 nt, Human
caguaaaauaugaggcaaaaaug

SEQ ID NO: 591014 - RNA, 20 nt, Human
ccaaaaaaaaaaaaaaaaaa

SEQ ID NO: 591015 - RNA, 22 nt, Human
ccaaaaaaaaaaaaaaaaaaaa

SEQ ID NO: 591016 - RNA, 23 nt, Human
ccaaaaaaaaaaaaaaaaaaaaa

SEQ ID NO: 591017 - RNA, 19 nt, Human
ccagcacaaaugggaagac

SEQ ID NO: 591018 - RNA, 21 nt, Human
ccucuaaauacugaugacaga

SEQ ID NO: 591019 - RNA, 21 nt, Human
cucaaguacaacagaaacaag

SEQ ID NO: 591020 - RNA, 21 nt, Human
cugacagugcucuggaacaac

SEQ ID NO: 591021 - RNA, 21 nt, Human
gaacaaguuucaaaaugcaac

SEQ ID NO: 591022 - RNA, 23 nt, Human
gcaaagcuuuucuucauuuaaaa

SEQ ID NO: 591023 - RNA, 22 nt, Human
ggaaaaaaaaaaaauacaugag

SEQ ID NO: 591024 - RNA, 21 nt, Human
ggaaagagaucuggaaaaaaa

SEQ ID NO: 591025 - RNA, 22 nt, Human
gggaaagagaucuggaaaaaaa

SEQ ID NO: 591026 - RNA, 18 nt, Human
ggggaaagagaucuggaa

SEQ ID NO: 591027 - RNA, 21 nt, Human
gguaagaaaacaagaaaaaaa

SEQ ID NO: 591028 - RNA, 22 nt, Human
guaaaaccaaaaacaaaacaaa

SEQ ID NO: 591029 - RNA, 24 nt, Human
guaaaaccaaaaacaaaacaaaac

SEQ ID NO: 591030 - RNA, 27 nt, Human
guaaaguuuuucuuuaggaugguguaa

SEQ ID NO: 591031 - RNA, 23 nt, Human
guacuaaagccuuuggaaauugu

SEQ ID NO: 591032 - RNA, 21 nt, Human
guauaacugcauccacacgca

SEQ ID NO: 591033 - RNA, 22 nt, Human
uaaaaaccagcauuucugcaca

SEQ ID NO: 591034 - RNA, 18 nt, Human
uaaaggcuuugcggagaa

SEQ ID NO: 591035 - RNA, 22 nt, Human
uaagauuccaacuuuauaaccu

SEQ ID NO: 591036 - RNA, 23 nt, Human
uacauucacuucucacccucuaa

SEQ ID NO: 591037 - RNA, 24 nt, Human
uacauucacuucucacccucuaaa

SEQ ID NO: 591038 - RNA, 20 nt, Human
uacuccaaaggaguaggauc

SEQ ID NO: 591039 - RNA, 20 nt, Human
uagcaacuuggggaaagaga

SEQ ID NO: 591040 - RNA, 23 nt, Human
uagcgaaaaucacgacuauaacc

SEQ ID NO: 591041 - RNA, 20 nt, Human
uaggaugguguaaaaaccag

SEQ ID NO: 591042 - RNA, 21 nt, Human
uaguaagauacugaugcagug

SEQ ID NO: 591043 - RNA, 27 nt, Human
uaugcaaagcaucuucuuucacacagu

SEQ ID NO: 591044 - RNA, 23 nt, Human
uauuacagggucaagaaacaaaa

SEQ ID NO: 591045 - RNA, 21 nt, Human
ucauuuaaaaggagaaaaaaa

SEQ ID NO: 591046 - RNA, 25 nt, Human
ucauuuaaaaggagaaaaaaaaaaa

SEQ ID NO: 591047 - RNA, 18 nt, Human
uccaggaugaacaaguuu

SEQ ID NO: 591048 - RNA, 21 nt, Human
ucccuaaaauccauccggagg

SEQ ID NO: 591049 - RNA, 18 nt, Human
ucugaaagaauaaagugg

SEQ ID NO: 591050 - RNA, 23 nt, Human
ucugaaagaauaaagugguaaga

SEQ ID NO: 591051 - RNA, 18 nt, Human
ucugagauaaaaaugauu

SEQ ID NO: 591052 - RNA, 18 nt, Human
ucuguaaaaccaaaaaca

SEQ ID NO: 591053 - RNA, 20 nt, Human
ucugugcaugaguccauuuu

SEQ ID NO: 591054 - RNA, 20 nt, Human
ucuuacaauagcaacuuggg

SEQ ID NO: 591055 - RNA, 19 nt, Human
ucuuuuuuuaaaccaguuc

SEQ ID NO: 591056 - RNA, 21 nt, Human
ucuuuuuuuaaaccaguucug

SEQ ID NO: 591057 - RNA, 19 nt, Human
ugaaaagccuauaaucagg

SEQ ID NO: 591058 - RNA, 18 nt, Human
ugaaagaauaaaguggua

SEQ ID NO: 591059 - RNA, 23 nt, Human
ugcaauaagacacagcugacacc

SEQ ID NO: 591060 - RNA, 28 nt, Human
ugcaauaagacacagcugacaccagacc

SEQ ID NO: 591061 - RNA, 20 nt, Human
ugcagcaaauaugcaaagca

SEQ ID NO: 591062 - RNA, 18 nt, Human
ugcauccacacgcagcag

SEQ ID NO: 591063 - RNA, 21 nt, Human
ugcauccacacgcagcagaau

SEQ ID NO: 591064 - RNA, 18 nt, Human
ugcucuggaacaacugug

SEQ ID NO: 591065 - RNA, 19 nt, Human
uggaaaacacauuuggcuu

SEQ ID NO: 591066 - RNA, 19 nt, Human
ugggaagaccauaaaaaug

SEQ ID NO: 591067 - RNA, 23 nt, Human
uggggucagacgggaaaaaggga

SEQ ID NO: 591068 - RNA, 19 nt, Human
uguaaaaccaaaaacaaaa

SEQ ID NO: 591069 - RNA, 22 nt, Human
ugugcaugaguccauuuucuuu

SEQ ID NO: 591070 - RNA, 28 nt, Human
uucacuggaauuuuuuucuuuguaauaa

SEQ ID NO: 591071 - RNA, 23 nt, Human
uucugcagcuaugcauguauuuc

SEQ ID NO: 591072 - RNA, 24 nt, Human
uucugcagcuaugcauguauuucu

SEQ ID NO: 591073 - RNA, 27 nt, Human
uuguauuuucuuuuuuuaaaccaguuc

SEQ ID NO: 591074 - RNA, 24 nt, Human
uuuaaaaggagaaaaaaaaaaacc

SEQ ID NO: 591075 - RNA, 21 nt, Human
uuuaagauuucuuucccaugg

SEQ ID NO: 591076 - RNA, 23 nt, Human
uuuauaccuguuacauucacuuc

SEQ ID NO: 591077 - RNA, 25 nt, Human
uuucugcagcuaugcauguauuucu

SEQ ID NO: 591078 - RNA, 24 nt, Human
uuuuauagcugcuuuauagcuacu

SEQ ID NO: 591079 - RNA, 20 nt, Human
aaaagauuuagucauaugaa

SEQ ID NO: 591080 - RNA, 20 nt, Human
aacguauuuuuucaaagacc

SEQ ID NO: 591081 - RNA, 20 nt, Human
acgccgcccgcgcccaccca

SEQ ID NO: 591082 - RNA, 19 nt, Human
acgcugagucgcaacccgg

SEQ ID NO: 591083 - RNA, 21 nt, Human
agacgccgcccgcgcccaccc

SEQ ID NO: 591084 - RNA, 21 nt, Human
caagaacgcugagucgcaacc

SEQ ID NO: 591085 - RNA, 22 nt, Human
caaggccagagccccaagcuag

SEQ ID NO: 591086 - RNA, 21 nt, Human
ccaagaacgcugagucgcaac

SEQ ID NO: 591087 - RNA, 26 nt, Human
ccaggcgauagcggcagccccgcacc

SEQ ID NO: 591088 - RNA, 22 nt, Human
ccccaagcuaggccggccccuc

SEQ ID NO: 591089 - RNA, 21 nt, Human
ccccucaacgccccacucccg

SEQ ID NO: 591090 - RNA, 18 nt, Human
cccgcaccgggcucagga

SEQ ID NO: 591091 - RNA, 21 nt, Human
cccucaacgccccacucccgc

SEQ ID NO: 591092 - RNA, 21 nt, Human
ccgcgcugccucccgcccugc

SEQ ID NO: 591093 - RNA, 18 nt, Human
ccucaacgccccacuccc

SEQ ID NO: 591094 - RNA, 22 nt, Human
ccucccgcccugcggcccaagc

SEQ ID NO: 591095 - RNA, 18 nt, Human
ccucgggggaugcccgcc

SEQ ID NO: 591096 - RNA, 20 nt, Human
ccugcggcccaagcaguugg

SEQ ID NO: 591097 - RNA, 22 nt, Human
cggagacgccgcccgcgcccac

SEQ ID NO: 591098 - RNA, 20 nt, Human
cggccaggcgauagcggcag

SEQ ID NO: 591099 - RNA, 23 nt, Human
cggccccucaacgccccacuccc

SEQ ID NO: 591100 - RNA, 20 nt, Human
gcccgcgcccacccaagaac

SEQ ID NO: 591101 - RNA, 20 nt, Human
gcuccggcacccacggccag

SEQ ID NO: 591102 - RNA, 24 nt, Human
gucgcaacccggccgcuccggcac

SEQ ID NO: 591103 - RNA, 18 nt, Human
ucaaaaucacauccaaga

SEQ ID NO: 591104 - RNA, 20 nt, Human
ucccgcccugcggcccaagc

SEQ ID NO: 591105 - RNA, 21 nt, Human
ucccgcccugcggcccaagca

SEQ ID NO: 591106 - RNA, 18 nt, Human
ucggaagacgcaaggcca

SEQ ID NO: 591107 - RNA, 20 nt, Human
ugccucccgcccugcggccc

SEQ ID NO: 591108 - RNA, 23 nt, Human
uucaaaagauuuagucauaugaa

SEQ ID NO: 591109 - RNA, 24 nt, Human
uuuaauugguucauuaaccaaaga

SEQ ID NO: 591110 - RNA, 23 nt, Human
aaaaagauuugugaacuugaaca

SEQ ID NO: 591111 - RNA, 21 nt, Human
aaacugccccccuccccagcc

SEQ ID NO: 591112 - RNA, 22 nt, Human
aaacugccccccuccccagcca

SEQ ID NO: 591113 - RNA, 24 nt, Human
aaagaagaaaaggagaacaaagaa

SEQ ID NO: 591114 - RNA, 22 nt, Human
aaagauuugugaacuugaacaa

SEQ ID NO: 591115 - RNA, 22 nt, Human
aaaggagacaauauguaauaua

SEQ ID NO: 591116 - RNA, 19 nt, Human
aacaaggcaagagauacaa

SEQ ID NO: 591117 - RNA, 24 nt, Human
aacaaggcaagagauacaaucuaa

SEQ ID NO: 591118 - RNA, 18 nt, Human
aacacacucagcuacucu

SEQ ID NO: 591119 - RNA, 19 nt, Human
aaccuccuccuuccuucac

SEQ ID NO: 591120 - RNA, 19 nt, Human
aacuguauguugcccacua

SEQ ID NO: 591121 - RNA, 22 nt, Human
aagaagaaaaggagaacaaaga

SEQ ID NO: 591122 - RNA, 21 nt, Human
aagacauagaauaaacaacaa

SEQ ID NO: 591123 - RNA, 25 nt, Human
aagcagaaaaagaagaaaagggacc

SEQ ID NO: 591124 - RNA, 20 nt, Human
aauuaccuuccaaaggucac

SEQ ID NO: 591125 - RNA, 23 nt, Human
acagagauuguuaacuggauaaa

SEQ ID NO: 591126 - RNA, 21 nt, Human
acagggaaaaacccaugucaa

SEQ ID NO: 591127 - RNA, 22 nt, Human
accuccuccuuccuucacuuga

SEQ ID NO: 591128 - RNA, 19 nt, Human
agaaaaagaagaaaaggag

SEQ ID NO: 591129 - RNA, 22 nt, Human
agaaaacauacuuuggauggga

SEQ ID NO: 591130 - RNA, 19 nt, Human
agaaaucugagucuccauu

SEQ ID NO: 591131 - RNA, 20 nt, Human
agacacauaaucucaucaug

SEQ ID NO: 591132 - RNA, 19 nt, Human
agagauuguuaacuggaua

SEQ ID NO: 591133 - RNA, 23 nt, Human
agagguuaaaaauuacaauuucu

SEQ ID NO: 591134 - RNA, 20 nt, Human
agauuagugaacugaaagac

SEQ ID NO: 591135 - RNA, 21 nt, Human
agccaggaccugauuuucuuc

SEQ ID NO: 591136 - RNA, 21 nt, Human
aggcaagagauacaaucuaaa

SEQ ID NO: 591137 - RNA, 18 nt, Human
aggucuaguguccaguga

SEQ ID NO: 591138 - RNA, 21 nt, Human
aguggaagccucuaaaacugc

SEQ ID NO: 591139 - RNA, 19 nt, Human
auaccccaguaaaaagaca

SEQ ID NO: 591140 - RNA, 21 nt, Human
aucucaucaugaggguuccac

SEQ ID NO: 591141 - RNA, 21 nt, Human
caaaggagacaauauguaaua

SEQ ID NO: 591142 - RNA, 20 nt, Human
caagguguuggcaggucuag

SEQ ID NO: 591143 - RNA, 21 nt, Human
cacuaaacacccacuuuaaau

SEQ ID NO: 591144 - RNA, 18 nt, Human
cagaaaaagaagaaaagg

SEQ ID NO: 591145 - RNA, 30 nt, Human
cagaaaaagaagaaaaggagaacaaagaag

SEQ ID NO: 591146 - RNA, 30 nt, Human
cagcuacucuaagggaaagcagaaaaagag

SEQ ID NO: 591147 - RNA, 18 nt, Human
caggaaauacccaagaac

SEQ ID NO: 591148 - RNA, 21 nt, Human
caggaaccuccuccuuccuuc

SEQ ID NO: 591149 - RNA, 20 nt, Human
cauaagacacauaaucucau

SEQ ID NO: 591150 - RNA, 22 nt, Human
caucauuuucauguacauaugu

SEQ ID NO: 591151 - RNA, 20 nt, Human
cauggcaaagagcagagaaa

SEQ ID NO: 591152 - RNA, 24 nt, Human
ccacuaaacacccacuuuaaauau

SEQ ID NO: 591153 - RNA, 23 nt, Human
ccccaguaaaaagacagagauug

SEQ ID NO: 591154 - RNA, 19 nt, Human
cccggcacuggccuauggc

SEQ ID NO: 591155 - RNA, 22 nt, Human
cccuaaauuuuggcuaagaaau

SEQ ID NO: 591156 - RNA, 22 nt, Human
ccugauuuucuucuggcuacac

SEQ ID NO: 591157 - RNA, 20 nt, Human
ccuggcccuuaaaccccggc

SEQ ID NO: 591158 - RNA, 19 nt, Human
cugaaagacauagcuauga

SEQ ID NO: 591159 - RNA, 18 nt, Human
cugacugccuuaacaaac

SEQ ID NO: 591160 - RNA, 19 nt, Human
cugacugccuuaacaaaca

SEQ ID NO: 591161 - RNA, 21 nt, Human
cugccccccuccccagccaaa

SEQ ID NO: 591162 - RNA, 26 nt, Human
gaaaaagaagaaaaggagaacaaagg

SEQ ID NO: 591163 - RNA, 22 nt, Human
gaacuugaacaaggcaagagau

SEQ ID NO: 591164 - RNA, 21 nt, Human
gaaguuagaaugauaaguuca

SEQ ID NO: 591165 - RNA, 20 nt, Human
gccccccuccccagccaaac

SEQ ID NO: 591166 - RNA, 22 nt, Human
ggaugcuucgucuuugguuucu

SEQ ID NO: 591167 - RNA, 19 nt, Human
gggagggguagugagguuu

SEQ ID NO: 591168 - RNA, 20 nt, Human
gguuucuucuggauccuccc

SEQ ID NO: 591169 - RNA, 23 nt, Human
guaauauaaacacacucagcuac

SEQ ID NO: 591170 - RNA, 18 nt, Human
guuucuucuggauccucc

SEQ ID NO: 591171 - RNA, 25 nt, Human
uaaaaagacagagauuguuaacugg

SEQ ID NO: 591172 - RNA, 24 nt, Human
uaaaaguaaaaccaugauaaauaa

SEQ ID NO: 591173 - RNA, 24 nt, Human
uaaacacccacuuuaaauaugaaa

SEQ ID NO: 591174 - RNA, 26 nt, Human
uaaacuacaaagagaacaaaagcuaa

SEQ ID NO: 591175 - RNA, 20 nt, Human
uaagaaaucugagucuccau

SEQ ID NO: 591176 - RNA, 21 nt, Human
uaagccaacaaaggagacaau

SEQ ID NO: 591177 - RNA, 22 nt, Human
uaagccaacaaaggagacaaua

SEQ ID NO: 591178 - RNA, 18 nt, Human
uaccuuccaaaggucaca

SEQ ID NO: 591179 - RNA, 22 nt, Human
uaggacuucaacauguaaauuu

SEQ ID NO: 591180 - RNA, 22 nt, Human
uagguuaaaaguaaaaccauga

SEQ ID NO: 591181 - RNA, 20 nt, Human
uaguaaaugaaaaacaauau

SEQ ID NO: 591182 - RNA, 23 nt, Human
uauugugggagggguagugaggu

SEQ ID NO: 591183 - RNA, 18 nt, Human
ucaagguguuggcagguc

SEQ ID NO: 591184 - RNA, 18 nt, Human
ucacuugaacucucuugc

SEQ ID NO: 591185 - RNA, 22 nt, Human
ucccugaaugcuuccuuuccug

SEQ ID NO: 591186 - RNA, 18 nt, Human
ucuaaaacugccccccuc

SEQ ID NO: 591187 - RNA, 20 nt, Human
ucuaagggaaagcagaaaaa

SEQ ID NO: 591188 - RNA, 22 nt, Human
ucuagaacuggacucuaaaaca

SEQ ID NO: 591189 - RNA, 26 nt, Human
ucuguuucaggaaauacccaagaacu

SEQ ID NO: 591190 - RNA, 18 nt, Human
ugaaagacauagcuauga

SEQ ID NO: 591191 - RNA, 21 nt, Human
ugaaagacauagcuaugagaa

SEQ ID NO: 591192 - RNA, 21 nt, Human
ugacauccacauccaggaacc

SEQ ID NO: 591193 - RNA, 19 nt, Human
ugagaguccauuuccuggu

SEQ ID NO: 591194 - RNA, 26 nt, Human
uggaaaaaagauuagugaacugaaag

SEQ ID NO: 591195 - RNA, 22 nt, Human
uggcaaagagcagagaaagaga

SEQ ID NO: 591196 - RNA, 18 nt, Human
ugggaugcuucgucuuug

SEQ ID NO: 591197 - RNA, 19 nt, Human
uguacauauguguauacac

SEQ ID NO: 591198 - RNA, 22 nt, Human
uguauacacaaaaagauuugug

SEQ ID NO: 591199 - RNA, 20 nt, Human
ugucaaauuauuagagguua

SEQ ID NO: 591200 - RNA, 20 nt, Human
uucaggaaauacccaagaac

SEQ ID NO: 591201 - RNA, 21 nt, Human
uucuucuggauccucccuaaa

SEQ ID NO: 591202 - RNA, 21 nt, Human
uuuacaguuaauaagccaaca

SEQ ID NO: 591203 - RNA, 22 nt, Human
uuuccuggcccuuaaaccccgg

SEQ ID NO: 591204 - RNA, 23 nt, Human
aaaaaaaaaagaaaaagaaaaag

SEQ ID NO: 591205 - RNA, 21 nt, Human
aaaaagaaaaagaaaaagcau

SEQ ID NO: 591206 - RNA, 23 nt, Human
aaaagaaaaagaaaaagaaaaag

SEQ ID NO: 591207 - RNA, 19 nt, Human
aaaagaaaaagaaaaagca

SEQ ID NO: 591208 - RNA, 19 nt, Human
aacaugguaaaacccuauc

SEQ ID NO: 591209 - RNA, 20 nt, Human
aacaugguaaaacccuaucu

SEQ ID NO: 591210 - RNA, 21 nt, Human
aacaugguaaaacccuaucuc

SEQ ID NO: 591211 - RNA, 20 nt, Human
aacucacuggcagccagugg

SEQ ID NO: 591212 - RNA, 21 nt, Human
aagacuggcagccaaaaggaa

SEQ ID NO: 591213 - RNA, 24 nt, Human
aauugcuugagaugaggaggcgga

SEQ ID NO: 591214 - RNA, 19 nt, Human
acaacagccauauacuccu

SEQ ID NO: 591215 - RNA, 24 nt, Human
acagggcaagacuccgucucaaaa

SEQ ID NO: 591216 - RNA, 23 nt, Human
acccuaucucuacuaaaauacaa

SEQ ID NO: 591217 - RNA, 23 nt, Human
acucugaguggcaaagaaccagg

SEQ ID NO: 591218 - RNA, 18 nt, Human
acugcacugcagccuggg

SEQ ID NO: 591219 - RNA, 19 nt, Human
acugcacugcagccugggc

SEQ ID NO: 591220 - RNA, 20 nt, Human
acugcacugcagccugggcg

SEQ ID NO: 591221 - RNA, 24 nt, Human
acugcacugcagccugggcgacag

SEQ ID NO: 591222 - RNA, 23 nt, Human
acugcagccugggcgacagggca

SEQ ID NO: 591223 - RNA, 21 nt, Human
agaaaaagcauuacuuuaaga

SEQ ID NO: 591224 - RNA, 20 nt, Human
agacacaagagaauaagaug

SEQ ID NO: 591225 - RNA, 19 nt, Human
agacaggagaauugcuuga

SEQ ID NO: 591226 - RNA, 23 nt, Human
agacaggagaauugcuugagaug

SEQ ID NO: 591227 - RNA, 18 nt, Human
agacauuugugcagaaaa

SEQ ID NO: 591228 - RNA, 26 nt, Human
agacggguggaucucuugaggccagg

SEQ ID NO: 591229 - RNA, 23 nt, Human
agccaggugugguggcacaugcc

SEQ ID NO: 591230 - RNA, 24 nt, Human
agccugggcgacagggcaagacuc

SEQ ID NO: 591231 - RNA, 24 nt, Human
agccuggugaacaugguaaaaccc

SEQ ID NO: 591232 - RNA, 18 nt, Human
aggacugaugggcccagg

SEQ ID NO: 591233 - RNA, 18 nt, Human
aggauuucgagacuagcc

SEQ ID NO: 591234 - RNA, 24 nt, Human
aggcggagguugcagugagccgag

SEQ ID NO: 591235 - RNA, 24 nt, Human
aggugugguggcacaugccuguaa

SEQ ID NO: 591236 - RNA, 23 nt, Human
aguggcucacaccuguaauccca

SEQ ID NO: 591237 - RNA, 21 nt, Human
auaaacaccaauaugcccuuc

SEQ ID NO: 591238 - RNA, 23 nt, Human
aucacaguaaaauacaauuugcu

SEQ ID NO: 591239 - RNA, 22 nt, Human
aucccaacacuuugggaggcca

SEQ ID NO: 591240 - RNA, 18 nt, Human
auuagaaacaaucugaca

SEQ ID NO: 591241 - RNA, 22 nt, Human
auugucucuguuuuauacauga

SEQ ID NO: 591242 - RNA, 24 nt, Human
auugugccacugcacugcagccug

SEQ ID NO: 591243 - RNA, 24 nt, Human
caaaaggaaacacugacaagagca

SEQ ID NO: 591244 - RNA, 24 nt, Human
caaaaggaaacacugacaagagca

SEQ ID NO: 591245 - RNA, 19 nt, Human
caaagaaaacaaaaaccac

SEQ ID NO: 591246 - RNA, 24 nt, Human
caacacugaaaacucauuaggaga

SEQ ID NO: 591247 - RNA, 20 nt, Human
caacacuuugggaggccaag

SEQ ID NO: 591248 - RNA, 24 nt, Human
caacacuuugggaggccaagacgg

SEQ ID NO: 591249 - RNA, 26 nt, Human
caagacggguggaucucuugaggcca

SEQ ID NO: 591250 - RNA, 21 nt, Human
caagacuccgucucaaaaaaa

SEQ ID NO: 591251 - RNA, 24 nt, Human
caagagcaugaaaggugcugacug

SEQ ID NO: 591252 - RNA, 19 nt, Human
caagucagaagcagaaaaa

SEQ ID NO: 591253 - RNA, 24 nt, Human
cacaccuguaaucccaacacuuug

SEQ ID NO: 591254 - RNA, 23 nt, Human
caccuguaaucccaacacuuugg

SEQ ID NO: 591255 - RNA, 24 nt, Human
caccuguaaucccaacacuuuggg

SEQ ID NO: 591256 - RNA, 21 nt, Human
cacucuuuacuuagaacucuu

SEQ ID NO: 591257 - RNA, 20 nt, Human
cacugcacugcagccugggc

SEQ ID NO: 591258 - RNA, 23 nt, Human
cacugcacugcagccugggcgac

SEQ ID NO: 591259 - RNA, 24 nt, Human
cacugcacugcagccugggcgaca

SEQ ID NO: 591260 - RNA, 23 nt, Human
cacugcagccugggcgacagggc

SEQ ID NO: 591261 - RNA, 19 nt, Human
cagaaaaagcauuacuugg

SEQ ID NO: 591262 - RNA, 21 nt, Human
ccacaguuacaguuucaggaa

SEQ ID NO: 591263 - RNA, 20 nt, Human
ccacugcacugcagccuggg

SEQ ID NO: 591264 - RNA, 21 nt, Human
ccacugcacugcagccugggc

SEQ ID NO: 591265 - RNA, 24 nt, Human
ccacugcacugcagccugggcgac

SEQ ID NO: 591266 - RNA, 22 nt, Human
ccugggcgacagggcaagacuc

SEQ ID NO: 591267 - RNA, 22 nt, Human
ccuggugaacaugguaaaaccc

SEQ ID NO: 591268 - RNA, 18 nt, Human
ccuguaaucccagcuacu

SEQ ID NO: 591269 - RNA, 21 nt, Human
ccuguaaucccagcuacuggg

SEQ ID NO: 591270 - RNA, 22 nt, Human
ccuguaaucccagcuacugggg

SEQ ID NO: 591271 - RNA, 22 nt, Human
ccuucucuauucuauaucaaaa

SEQ ID NO: 591272 - RNA, 24 nt, Human
cggguggaucucuugaggccagga

SEQ ID NO: 591273 - RNA, 18 nt, Human
cucaaaaaaaaaaaaaag

SEQ ID NO: 591274 - RNA, 25 nt, Human
cucaaaaaaaaaaaaaagaaaaaga

SEQ ID NO: 591275 - RNA, 22 nt, Human
cucacaccuguaaucccaacac

SEQ ID NO: 591276 - RNA, 24 nt, Human
cucacaccuguaaucccaacacuu

SEQ ID NO: 591277 - RNA, 19 nt, Human
cuccgucucaaaaaaaaaa

SEQ ID NO: 591278 - RNA, 18 nt, Human
cugcuucagacuauuuac

SEQ ID NO: 591279 - RNA, 18 nt, Human
gaagcagaaaaauuugag

SEQ ID NO: 591280 - RNA, 27 nt, Human
gacaacacaagaaugagagacaauuaa

SEQ ID NO: 591281 - RNA, 21 nt, Human
gacagggcaagacuccgucuc

SEQ ID NO: 591282 - RNA, 24 nt, Human
gacagggcaagacuccgucucaaa

SEQ ID NO: 591283 - RNA, 23 nt, Human
gagaauugcuugagaugaggagg

SEQ ID NO: 591284 - RNA, 22 nt, Human
gagacugagacaggagaauugc

SEQ ID NO: 591285 - RNA, 23 nt, Human
gagauugugccacugcacugcag

SEQ ID NO: 591286 - RNA, 21 nt, Human
gaggcggagguugcagugagc

SEQ ID NO: 591287 - RNA, 21 nt, Human
gagguugcagugagccgagau

SEQ ID NO: 591288 - RNA, 23 nt, Human
gagguugcagugagccgagauug

SEQ ID NO: 591289 - RNA, 24 nt, Human
gaucucuugaggccaggauuucga

SEQ ID NO: 591290 - RNA, 24 nt, Human
gcacucacuccagcaaacacauug

SEQ ID NO: 591291 - RNA, 24 nt, Human
gccacugcacugcagccugggcga

SEQ ID NO: 591292 - RNA, 20 nt, Human
gcccuucaaaaggaaacacu

SEQ ID NO: 591293 - RNA, 21 nt, Human
gcuagagaaaggcaagcaaau

SEQ ID NO: 591294 - RNA, 22 nt, Human
ggagguugcagugagccgagau

SEQ ID NO: 591295 - RNA, 24 nt, Human
ggagguugcagugagccgagauug

SEQ ID NO: 591296 - RNA, 19 nt, Human
ggcugggugcaguggcuca

SEQ ID NO: 591297 - RNA, 21 nt, Human
ggcugggugcaguggcucaca

SEQ ID NO: 591298 - RNA, 23 nt, Human
ggugcaguggcucacaccuguaa

SEQ ID NO: 591299 - RNA, 22 nt, Human
gguggaucucuugaggccagga

SEQ ID NO: 591300 - RNA, 24 nt, Human
gguggcacaugccuguaaucccag

SEQ ID NO: 591301 - RNA, 20 nt, Human
gucucaaaaaaaaaaaaaag

SEQ ID NO: 591302 - RNA, 18 nt, Human
gugcaguggcucacaccu

SEQ ID NO: 591303 - RNA, 23 nt, Human
gugggacaacacaagaaugagag

SEQ ID NO: 591304 - RNA, 26 nt, Human
gugugcauacauacguguauguacau

SEQ ID NO: 591305 - RNA, 21 nt, Human
uaauccaagacuggcagccaa

SEQ ID NO: 591306 - RNA, 21 nt, Human
uauauagcacacauuuauaug

SEQ ID NO: 591307 - RNA, 20 nt, Human
uauguacacaauaaaaauaa

SEQ ID NO: 591308 - RNA, 26 nt, Human
uauguacacaauaaaaauaauauaug

SEQ ID NO: 591309 - RNA, 21 nt, Human
uauuagaaacaaucugacagc

SEQ ID NO: 591310 - RNA, 25 nt, Human
ucaaaaaaaaaaaaaagaaaaagaa

SEQ ID NO: 591311 - RNA, 22 nt, Human
ucaacugugaguuuuuagcugu

SEQ ID NO: 591312 - RNA, 19 nt, Human
uccaaagaaaacaaaaacc

SEQ ID NO: 591313 - RNA, 22 nt, Human
uccgucucaaaaaaaaaaaaaa

SEQ ID NO: 591314 - RNA, 23 nt, Human
uccgucucaaaaaaaaaaaaaag

SEQ ID NO: 591315 - RNA, 27 nt, Human
uccgucucaaaaaaaaaaaaaagaaaa

SEQ ID NO: 591316 - RNA, 21 nt, Human
uccuugaugcacucacuccag

SEQ ID NO: 591317 - RNA, 21 nt, Human
ucucuacuaaaauacaaaaaa

SEQ ID NO: 591318 - RNA, 23 nt, Human
ucugugugcauuucugugugccc

SEQ ID NO: 591319 - RNA, 24 nt, Human
ugaaagagcuaguauauaaaaaua

SEQ ID NO: 591320 - RNA, 18 nt, Human
ugaaaggugcugacuguu

SEQ ID NO: 591321 - RNA, 20 nt, Human
ugacagcucuugugagcgau

SEQ ID NO: 591322 - RNA, 22 nt, Human
ugagccgagauugugccacugc

SEQ ID NO: 591323 - RNA, 22 nt, Human
ugccuguaaucccagcuacugg

SEQ ID NO: 591324 - RNA, 23 nt, Human
ugccuguaaucccagcuacuggg

SEQ ID NO: 591325 - RNA, 18 nt, Human
ugcuugagaugaggaggc

SEQ ID NO: 591326 - RNA, 23 nt, Human
uggaucucuugaggccaggauuu

SEQ ID NO: 591327 - RNA, 21 nt, Human
uggcacaugccuguaauccca

SEQ ID NO: 591328 - RNA, 18 nt, Human
uggcagccaaaaggaaca

SEQ ID NO: 591329 - RNA, 19 nt, Human
uggcuagagaaaggcaagc

SEQ ID NO: 591330 - RNA, 21 nt, Human
uggcucacaccuguaauccca

SEQ ID NO: 591331 - RNA, 23 nt, Human
ugggaggccaagacggguggauc

SEQ ID NO: 591332 - RNA, 24 nt, Human
ugguggcacaugccuguaauccca

SEQ ID NO: 591333 - RNA, 21 nt, Human
uggugggacaacacaagaaug

SEQ ID NO: 591334 - RNA, 23 nt, Human
uguaacaguguuucaacacaaga

SEQ ID NO: 591335 - RNA, 22 nt, Human
ugugcagaaaaauaacaggaac

SEQ ID NO: 591336 - RNA, 22 nt, Human
ugugcauacauacguguaugua

SEQ ID NO: 591337 - RNA, 22 nt, Human
ugugccacugcacugcagccug

SEQ ID NO: 591338 - RNA, 21 nt, Human
ugugugcauacauacguguau

SEQ ID NO: 591339 - RNA, 25 nt, Human
ugugugcauacauacguguauguac

SEQ ID NO: 591340 - RNA, 25 nt, Human
ugugugcauacauacguguauguag

SEQ ID NO: 591341 - RNA, 22 nt, Human
uguuucaacacaagacauuugu

SEQ ID NO: 591342 - RNA, 22 nt, Human
uuaaaaauauacauauaucaca

SEQ ID NO: 591343 - RNA, 20 nt, Human
uuagugccuguguacucacu

SEQ ID NO: 591344 - RNA, 27 nt, Human
uucaacacugaaaacucauuaggagaa

SEQ ID NO: 591345 - RNA, 21 nt, Human
uucaagucagaagcagaaaaa

SEQ ID NO: 591346 - RNA, 24 nt, Human
uugagaugaggaggcggagguugc

SEQ ID NO: 591347 - RNA, 22 nt, Human
uugcagugagccgagauugugc

SEQ ID NO: 591348 - RNA, 23 nt, Human
uugcagugagccgagauugugcc

SEQ ID NO: 591349 - RNA, 24 nt, Human
uugcuugagaugaggaggcggagg

SEQ ID NO: 591350 - RNA, 19 nt, Human
uuuuuauauuagaaacaau

SEQ ID NO: 591351 - RNA, 26 nt, Human
aaaaacaaacaaacaaaaaacaaaaa

SEQ ID NO: 591352 - RNA, 20 nt, Human
aaacaaaaaacaaaaaaccc

SEQ ID NO: 591353 - RNA, 24 nt, Human
aaacaaaaaacaaaaaacccgugg

SEQ ID NO: 591354 - RNA, 20 nt, Human
aaacaaacaaaaaacaaaaa

SEQ ID NO: 591355 - RNA, 25 nt, Human
aaacaaacaaaaaacaaaaaacccc

SEQ ID NO: 591356 - RNA, 25 nt, Human
aaacaaacaaaaaacaaaaaacccg

SEQ ID NO: 591357 - RNA, 21 nt, Human
aaaccacaagccuuccaacug

SEQ ID NO: 591358 - RNA, 20 nt, Human
aacccguggugccccucccc

SEQ ID NO: 591359 - RNA, 18 nt, Human
aagcuguacccaccagcu

SEQ ID NO: 591360 - RNA, 23 nt, Human
aaggcccacuuccaccaaaaauc

SEQ ID NO: 591361 - RNA, 19 nt, Human
aaggggguggagugacuga

SEQ ID NO: 591362 - RNA, 25 nt, Human
acaaacaaaaaacaaaaaacccgug

SEQ ID NO: 591363 - RNA, 22 nt, Human
acaggcucaggugugcaaaccc

SEQ ID NO: 591364 - RNA, 24 nt, Human
accagccucagggaccuggaaggg

SEQ ID NO: 591365 - RNA, 23 nt, Human
accaggagagcacuccccuccuu

SEQ ID NO: 591366 - RNA, 21 nt, Human
acugcagaaaguacacugugu

SEQ ID NO: 591367 - RNA, 19 nt, Human
agaaccagccucagggacc

SEQ ID NO: 591368 - RNA, 19 nt, Human
agagagcagacacuggguu

SEQ ID NO: 591369 - RNA, 19 nt, Human
agaguuggggugagagagg

SEQ ID NO: 591370 - RNA, 27 nt, Human
agcuguguggccucaagcaaaucacau

SEQ ID NO: 591371 - RNA, 20 nt, Human
agggaaugauagauuggagg

SEQ ID NO: 591372 - RNA, 24 nt, Human
aggggcuugggggagaguuggggu

SEQ ID NO: 591373 - RNA, 22 nt, Human
aggguggacagaggcugagugu

SEQ ID NO: 591374 - RNA, 25 nt, Human
aggugagggcuggaggcagggcugg

SEQ ID NO: 591375 - RNA, 21 nt, Human
agucagaaacugcagaaagua

SEQ ID NO: 591376 - RNA, 20 nt, Human
agugaaagggagaggcugga

SEQ ID NO: 591377 - RNA, 24 nt, Human
agugaaagggagaggcuggagaag

SEQ ID NO: 591378 - RNA, 22 nt, Human
aucugcaccaucugggugcccc

SEQ ID NO: 591379 - RNA, 20 nt, Human
auugaguuaaaugagaaguc

SEQ ID NO: 591380 - RNA, 18 nt, Human
auuggauugguuguaaau

SEQ ID NO: 591381 - RNA, 23 nt, Human
caaaaaacccguggugccccucc

SEQ ID NO: 591382 - RNA, 24 nt, Human
caaaaaccaucuuauaaaaacaaa

SEQ ID NO: 591383 - RNA, 20 nt, Human
caaaaggcuucaaagcacca

SEQ ID NO: 591384 - RNA, 27 nt, Human
caaacaaacaaaaaacaaaaaacccgu

SEQ ID NO: 591385 - RNA, 25 nt, Human
caaauccaaguccaaguccaagucc

SEQ ID NO: 591386 - RNA, 25 nt, Human
caagcucaaauccaaguccaagucc

SEQ ID NO: 591387 - RNA, 25 nt, Human
caaguccaaguccaaguccacgucc

SEQ ID NO: 591388 - RNA, 20 nt, Human
cacacccccaucugccccuu

SEQ ID NO: 591389 - RNA, 23 nt, Human
caccacagacaggcucaggugug

SEQ ID NO: 591390 - RNA, 19 nt, Human
caccaggcagugcguggga

SEQ ID NO: 591391 - RNA, 18 nt, Human
cacuggagucugggcagc

SEQ ID NO: 591392 - RNA, 22 nt, Human
cacuguguucaaggcccacuuc

SEQ ID NO: 591393 - RNA, 20 nt, Human
cagagagcagacacuggguu

SEQ ID NO: 591394 - RNA, 21 nt, Human
cagaugaaaugcugagaccug

SEQ ID NO: 591395 - RNA, 20 nt, Human
cagcccagggcgaggcgccg

SEQ ID NO: 591396 - RNA, 21 nt, Human
cagcccagggcgaggcgccgg

SEQ ID NO: 591397 - RNA, 25 nt, Human
cagcccagggcgaggcgccggggug

SEQ ID NO: 591398 - RNA, 18 nt, Human
caggggugaguggaguug

SEQ ID NO: 591399 - RNA, 23 nt, Human
caguuccuccaugucuccugccc

SEQ ID NO: 591400 - RNA, 21 nt, Human
caucugggugccccccaguuc

SEQ ID NO: 591401 - RNA, 21 nt, Human
ccaccaaaaaucuagcugugu

SEQ ID NO: 591402 - RNA, 22 nt, Human
ccaggcagugcgugggaugcag

SEQ ID NO: 591403 - RNA, 18 nt, Human
ccaguuccuccaugucuc

SEQ ID NO: 591404 - RNA, 21 nt, Human
cccacuuccaccaaaaaucua

SEQ ID NO: 591405 - RNA, 18 nt, Human
cccaucugccccuucaga

SEQ ID NO: 591406 - RNA, 25 nt, Human
cccccaguuccuccaugucuccugc

SEQ ID NO: 591407 - RNA, 19 nt, Human
cccccgccccgccccacuc

SEQ ID NO: 591408 - RNA, 21 nt, Human
ccccgccccgccccacuccuc

SEQ ID NO: 591409 - RNA, 25 nt, Human
ccccgccccgccccacuccuccgaa

SEQ ID NO: 591410 - RNA, 18 nt, Human
cccguggugccccucccc

SEQ ID NO: 591411 - RNA, 18 nt, Human
ccgccccgccccacuccu

SEQ ID NO: 591412 - RNA, 21 nt, Human
ccugagggagcugccccccuc

SEQ ID NO: 591413 - RNA, 19 nt, Human
ccugcccuccuuucuaacc

SEQ ID NO: 591414 - RNA, 21 nt, Human
ccugcgauuagaacccaggaa

SEQ ID NO: 591415 - RNA, 19 nt, Human
ccuggaggagagagcuuga

SEQ ID NO: 591416 - RNA, 23 nt, Human
cgacuacucacacccccaucugc

SEQ ID NO: 591417 - RNA, 25 nt, Human
cgacuccccgacuacucacaccccc

SEQ ID NO: 591418 - RNA, 22 nt, Human
cgccaaggcugagauuaaaaac

SEQ ID NO: 591419 - RNA, 30 nt, Human
cgccaaggcugagauuaaaaacaaacaaag

SEQ ID NO: 591420 - RNA, 23 nt, Human
cuaguucacaguagcuuucccca

SEQ ID NO: 591421 - RNA, 20 nt, Human
cucaaauccaaguccaaguc

SEQ ID NO: 591422 - RNA, 19 nt, Human
cucaccucuacuugccccc

SEQ ID NO: 591423 - RNA, 20 nt, Human
cuccaugucuccugcccucc

SEQ ID NO: 591424 - RNA, 18 nt, Human
cucccccgccccgcccca

SEQ ID NO: 591425 - RNA, 22 nt, Human
cucccccgccccgccccacucc

SEQ ID NO: 591426 - RNA, 18 nt, Human
cuccuccgaaguccgggc

SEQ ID NO: 591427 - RNA, 21 nt, Human
cuccugggccuggcugcuugc

SEQ ID NO: 591428 - RNA, 22 nt, Human
cucucaagcuguacccaccagc

SEQ ID NO: 591429 - RNA, 22 nt, Human
cugcccuccuuucuaacccagg

SEQ ID NO: 591430 - RNA, 22 nt, Human
cugggcuuguuagaggaggcuu

SEQ ID NO: 591431 - RNA, 25 nt, Human
cuguggguggggcugaauuuggggc

SEQ ID NO: 591432 - RNA, 24 nt, Human
gaaaggggcuugggggagaguugg

SEQ ID NO: 591433 - RNA, 18 nt, Human
gaccuggaagggggugga

SEQ ID NO: 591434 - RNA, 21 nt, Human
gacgcgggguugggcacaggc

SEQ ID NO: 591435 - RNA, 21 nt, Human
gacuccccgacuacucacacc

SEQ ID NO: 591436 - RNA, 23 nt, Human
gacuccccgacuacucacacccc

SEQ ID NO: 591437 - RNA, 25 nt, Human
gagccaagcucaaauccaaguccaa

SEQ ID NO: 591438 - RNA, 21 nt, Human
gagcugccccccucucaagcu

SEQ ID NO: 591439 - RNA, 23 nt, Human
gaggcagggcuggccccccaagg

SEQ ID NO: 591440 - RNA, 20 nt, Human
gaugcugggcgaagagugaa

SEQ ID NO: 591441 - RNA, 27 nt, Human
gccaaggcugagauuaaaaacaaacaa

SEQ ID NO: 591442 - RNA, 20 nt, Human
gcccuccuuucuaacccagg

SEQ ID NO: 591443 - RNA, 18 nt, Human
gccggggugggcgcgggg

SEQ ID NO: 591444 - RNA, 21 nt, Human
gcgaggcgccggggugggcgc

SEQ ID NO: 591445 - RNA, 18 nt, Human
gcgccggggugggcgcgg

SEQ ID NO: 591446 - RNA, 20 nt, Human
gcuucauccauccaguuccc

SEQ ID NO: 591447 - RNA, 20 nt, Human
ggacaggggggcaggaugcu

SEQ ID NO: 591448 - RNA, 18 nt, Human
ggagggagguggggaaag

SEQ ID NO: 591449 - RNA, 19 nt, Human
ggccccacuuuccuggagg

SEQ ID NO: 591450 - RNA, 20 nt, Human
ggcuugggggagaguugggg

SEQ ID NO: 591451 - RNA, 25 nt, Human
ggcuugggggagaguuggggugaag

SEQ ID NO: 591452 - RNA, 21 nt, Human
ggguggggcugaauuuggggc

SEQ ID NO: 591453 - RNA, 22 nt, Human
ggguugggcacaggcugcagug

SEQ ID NO: 591454 - RNA, 23 nt, Human
guagggaaugauagauuggaggg

SEQ ID NO: 591455 - RNA, 23 nt, Human
gugacugaguuggggccccacuu

SEQ ID NO: 591456 - RNA, 24 nt, Human
uaagagaggcauuggcaaguggug

SEQ ID NO: 591457 - RNA, 18 nt, Human
uagaaccagccucaggga

SEQ ID NO: 591458 - RNA, 19 nt, Human
uagaacccaggaauccugc

SEQ ID NO: 591459 - RNA, 24 nt, Human
uauaaaaacaaaaggcuucaaagc

SEQ ID NO: 591460 - RNA, 20 nt, Human
uauuuuggccuuagagagua

SEQ ID NO: 591461 - RNA, 18 nt, Human
uccaugucuccugcccuc

SEQ ID NO: 591462 - RNA, 19 nt, Human
ucccaauaagagaacgagg

SEQ ID NO: 591463 - RNA, 21 nt, Human
ucucuguggguggggcugaau

SEQ ID NO: 591464 - RNA, 19 nt, Human
ucugggugccccccaguuc

SEQ ID NO: 591465 - RNA, 23 nt, Human
ugaaaccacaagccuuccaacug

SEQ ID NO: 591466 - RNA, 23 nt, Human
ugaaaugcugagaccugauccuc

SEQ ID NO: 591467 - RNA, 18 nt, Human
ugaagggcaguagcuuag

SEQ ID NO: 591468 - RNA, 26 nt, Human
ugagauuaaaaacaaacaaacaaaaa

SEQ ID NO: 591469 - RNA, 20 nt, Human
ugagggcuggaggcagggcu

SEQ ID NO: 591470 - RNA, 22 nt, Human
ugagggcuggaggcagggcugg

SEQ ID NO: 591471 - RNA, 19 nt, Human
ugagguggauggagccguc

SEQ ID NO: 591472 - RNA, 18 nt, Human
ugaguagaaaggggcuug

SEQ ID NO: 591473 - RNA, 24 nt, Human
ugcagacgcgggguugggcacagg

SEQ ID NO: 591474 - RNA, 23 nt, Human
ugcuugcauuugggauggugggg

SEQ ID NO: 591475 - RNA, 23 nt, Human
ugcuuuaagagaggcauuggcaa

SEQ ID NO: 591476 - RNA, 23 nt, Human
uggaaggggguggagugacugag

SEQ ID NO: 591477 - RNA, 24 nt, Human
uggaaggggguggagugacugagu

SEQ ID NO: 591478 - RNA, 23 nt, Human
uggagaagagaggaaggccccag

SEQ ID NO: 591479 - RNA, 22 nt, Human
uggagggagguggggaaagugu

SEQ ID NO: 591480 - RNA, 20 nt, Human
uggaggugauggggauacag

SEQ ID NO: 591481 - RNA, 20 nt, Human
uggcaagugguggugguggu

SEQ ID NO: 591482 - RNA, 18 nt, Human
uggcccagugaagggcag

SEQ ID NO: 591483 - RNA, 19 nt, Human
uggcccgagcucgcggcag

SEQ ID NO: 591484 - RNA, 22 nt, Human
ugggagcuccaugccugugggg

SEQ ID NO: 591485 - RNA, 23 nt, Human
ugggaugggccugauguccugcu

SEQ ID NO: 591486 - RNA, 18 nt, Human
ugggaugguggggugggg

SEQ ID NO: 591487 - RNA, 21 nt, Human
uggggccccacuuuccuggag

SEQ ID NO: 591488 - RNA, 20 nt, Human
ugggggagaguuggggugag

SEQ ID NO: 591489 - RNA, 23 nt, Human
ugggggccagaggaacuccuggg

SEQ ID NO: 591490 - RNA, 19 nt, Human
uggggugagagaggugagg

SEQ ID NO: 591491 - RNA, 20 nt, Human
uggggugggguugccagccu

SEQ ID NO: 591492 - RNA, 25 nt, Human
ugggguugccagccuugaccacagg

SEQ ID NO: 591493 - RNA, 28 nt, Human
ugggugccccccaguuccuccaugucuc

SEQ ID NO: 591494 - RNA, 18 nt, Human
uggguggggcugaauuug

SEQ ID NO: 591495 - RNA, 18 nt, Human
ugguggagaccacauagg

SEQ ID NO: 591496 - RNA, 18 nt, Human
ugguggugguggugugug

SEQ ID NO: 591497 - RNA, 19 nt, Human
ugguggugugugaauaugg

SEQ ID NO: 591498 - RNA, 19 nt, Human
ugugaauaugguggagacc

SEQ ID NO: 591499 - RNA, 20 nt, Human
uguggaggugauggggauac

SEQ ID NO: 591500 - RNA, 25 nt, Human
ugugggggccagaggaacuccuggg

SEQ ID NO: 591501 - RNA, 22 nt, Human
uuacagucagaaacugcagaaa

SEQ ID NO: 591502 - RNA, 19 nt, Human
uucucuguggguggggcug

SEQ ID NO: 591503 - RNA, 26 nt, Human
uucucuguggguggggcugaauuugg

SEQ ID NO: 591504 - RNA, 24 nt, Human
uuucacagaugaaaugcugagacc

SEQ ID NO: 591505 - RNA, 21 nt, Human
uuuuacagucagaaacugcag

SEQ ID NO: 591506 - RNA, 24 nt, Human
aaagugcugggauuacaggcguga

SEQ ID NO: 591507 - RNA, 21 nt, Human
aaaugauucuccugccucagc

SEQ ID NO: 591508 - RNA, 24 nt, Human
aaauggacuuguaacaucauaaac

SEQ ID NO: 591509 - RNA, 21 nt, Human
aagcagagguucauauuaaga

SEQ ID NO: 591510 - RNA, 19 nt, Human
aagugcugggauuacaggc

SEQ ID NO: 591511 - RNA, 19 nt, Human
aagugcugggauuacaggc

SEQ ID NO: 591512 - RNA, 26 nt, Human
aagugcugggauuacaggcgugagcc

SEQ ID NO: 591513 - RNA, 22 nt, Human
aaucuccacucacugcaaccuc

SEQ ID NO: 591514 - RNA, 21 nt, Human
acaguccaaauugccuggugg

SEQ ID NO: 591515 - RNA, 22 nt, Human
acauguccaagacaguaccaaa

SEQ ID NO: 591516 - RNA, 26 nt, Human
accacauugcugauuuccaaaggucc

SEQ ID NO: 591517 - RNA, 24 nt, Human
accauguuggucaggcuggucuug

SEQ ID NO: 591518 - RNA, 23 nt, Human
accucaaccucccaaagugcugg

SEQ ID NO: 591519 - RNA, 21 nt, Human
acgggguuucaccauguuggu

SEQ ID NO: 591520 - RNA, 23 nt, Human
acgggguuucaccauguugguca

SEQ ID NO: 591521 - RNA, 24 nt, Human
acgggguuucaccauguuggucag

SEQ ID NO: 591522 - RNA, 25 nt, Human
acuccauugaccaggcuggagugca

SEQ ID NO: 591523 - RNA, 24 nt, Human
agaacauguccaagacaguaccaa

SEQ ID NO: 591524 - RNA, 22 nt, Human
agacugaaauucauuaagucug

SEQ ID NO: 591525 - RNA, 25 nt, Human
aggcuggagugcagugguacaaucu

SEQ ID NO: 591526 - RNA, 19 nt, Human
aguagcugggauuacaggc

SEQ ID NO: 591527 - RNA, 19 nt, Human
agugcagugguacaaucuc

SEQ ID NO: 591528 - RNA, 18 nt, Human
agugcugggauuacaggc

SEQ ID NO: 591529 - RNA, 27 nt, Human
aucaucaucaacaucaucauggucuua

SEQ ID NO: 591530 - RNA, 18 nt, Human
augaagacauucuuuccu

SEQ ID NO: 591531 - RNA, 24 nt, Human
augauucuccugccucagccuccc

SEQ ID NO: 591532 - RNA, 18 nt, Human
auucuccugccucagccu

SEQ ID NO: 591533 - RNA, 24 nt, Human
auuuuuguauuuuuaguagagacg

SEQ ID NO: 591534 - RNA, 24 nt, Human
caaagugcugggauuacaggcgug

SEQ ID NO: 591535 - RNA, 24 nt, Human
caaccucagccucccggguugaaa

SEQ ID NO: 591536 - RNA, 23 nt, Human
caagacaguaccaaagacaggau

SEQ ID NO: 591537 - RNA, 26 nt, Human
caaguucaaauccaagcuccaucacc

SEQ ID NO: 591538 - RNA, 24 nt, Human
caccacacccagcuaauuuuugua

SEQ ID NO: 591539 - RNA, 21 nt, Human
caccauguuggucaggcuggu

SEQ ID NO: 591540 - RNA, 23 nt, Human
caccauguuggucaggcuggucu

SEQ ID NO: 591541 - RNA, 24 nt, Human
caccauguuggucaggcuggucuu

SEQ ID NO: 591542 - RNA, 21 nt, Human
cacccaccucaaccucccaaa

SEQ ID NO: 591543 - RNA, 22 nt, Human
cacccaccucaaccucccaaag

SEQ ID NO: 591544 - RNA, 23 nt, Human
cacccaccucaaccucccaaagu

SEQ ID NO: 591545 - RNA, 20 nt, Human
cacugcaaccucagccuccc

SEQ ID NO: 591546 - RNA, 21 nt, Human
cacugcaaccucagccucccg

SEQ ID NO: 591547 - RNA, 23 nt, Human
cacugcaaccucagccucccggg

SEQ ID NO: 591548 - RNA, 22 nt, Human
cagccucccggguugaaaugau

SEQ ID NO: 591549 - RNA, 24 nt, Human
cauguuggucaggcuggucuugaa

SEQ ID NO: 591550 - RNA, 21 nt, Human
cauugaccaggcuggagugca

SEQ ID NO: 591551 - RNA, 25 nt, Human
ccaaagguccucuuaaugucaguac

SEQ ID NO: 591552 - RNA, 22 nt, Human
ccaaagugcugggauuacaggc

SEQ ID NO: 591553 - RNA, 22 nt, Human
ccaaagugcugggauuacaggc

SEQ ID NO: 591554 - RNA, 24 nt, Human
ccaaagugcugggauuacaggcgu

SEQ ID NO: 591555 - RNA, 19 nt, Human
ccaagacaguaccaaagac

SEQ ID NO: 591556 - RNA, 18 nt, Human
ccaagcggggcaguggcc

SEQ ID NO: 591557 - RNA, 20 nt, Human
ccaccacacccagcuaauuu

SEQ ID NO: 591558 - RNA, 26 nt, Human
ccacccaccucaaccucccaaagugc

SEQ ID NO: 591559 - RNA, 18 nt, Human
ccagaugaagaagcagag

SEQ ID NO: 591560 - RNA, 24 nt, Human
cccacucacacaaauggaagaaca

SEQ ID NO: 591561 - RNA, 25 nt, Human
cccacucacacaaauggaagaacaa

SEQ ID NO: 591562 - RNA, 23 nt, Human
cccgaguagcugggauuacaggc

SEQ ID NO: 591563 - RNA, 24 nt, Human
cccgaguagcugggauuacaggcg

SEQ ID NO: 591564 - RNA, 18 nt, Human
cccgccaccagcccggag

SEQ ID NO: 591565 - RNA, 22 nt, Human
ccgaguagcugggauuacaggc

SEQ ID NO: 591566 - RNA, 24 nt, Human
ccgaguagcugggauuacaggcgu

SEQ ID NO: 591567 - RNA, 24 nt, Human
ccucccggguugaaaugauucucc

SEQ ID NO: 591568 - RNA, 22 nt, Human
ccugaccucaugauccacccac

SEQ ID NO: 591569 - RNA, 23 nt, Human
ccugccucagccucccgaguagc

SEQ ID NO: 591570 - RNA, 24 nt, Human
cgggguuucaccauguuggucagg

SEQ ID NO: 591571 - RNA, 20 nt, Human
cguaugccaccacacccagc

SEQ ID NO: 591572 - RNA, 23 nt, Human
cuaauuuuuguauuuuuaguaga

SEQ ID NO: 591573 - RNA, 24 nt, Human
cucacugcaaccucagccucccgg

SEQ ID NO: 591574 - RNA, 24 nt, Human
cucagccucccgaguagcugggau

SEQ ID NO: 591575 - RNA, 18 nt, Human
cuccugaccucaugaucc

SEQ ID NO: 591576 - RNA, 22 nt, Human
cuccugccucagccucccgagu

SEQ ID NO: 591577 - RNA, 23 nt, Human
cugccucagccucccgaguagcu

SEQ ID NO: 591578 - RNA, 18 nt, Human
gacaguaccaaagacagg

SEQ ID NO: 591579 - RNA, 22 nt, Human
gaccucaugauccacccaccuc

SEQ ID NO: 591580 - RNA, 24 nt, Human
gaccucaugauccacccaccucaa

SEQ ID NO: 591581 - RNA, 23 nt, Human
gagacgggguuucaccauguugg

SEQ ID NO: 591582 - RNA, 24 nt, Human
gagacgggguuucaccauguuggu

SEQ ID NO: 591583 - RNA, 26 nt, Human
gaguagcugggauuacaggcguaugc

SEQ ID NO: 591584 - RNA, 19 nt, Human
gauacaguaacccucagca

SEQ ID NO: 591585 - RNA, 18 nt, Human
gauuacaggcguaugcca

SEQ ID NO: 591586 - RNA, 18 nt, Human
gauuacaggcgugagcca

SEQ ID NO: 591587 - RNA, 21 nt, Human
gauuacaggcgugagccacca

SEQ ID NO: 591588 - RNA, 22 nt, Human
gauuacaggcgugagccaccac

SEQ ID NO: 591589 - RNA, 21 nt, Human
gauucuccugccucagccucc

SEQ ID NO: 591590 - RNA, 23 nt, Human
gcuggucuugaacuccugaccuc

SEQ ID NO: 591591 - RNA, 22 nt, Human
ggagucgcacuccauugaccag

SEQ ID NO: 591592 - RNA, 19 nt, Human
ggauuacaggcguaugcca

SEQ ID NO: 591593 - RNA, 19 nt, Human
ggauuacaggcgugagcca

SEQ ID NO: 591594 - RNA, 24 nt, Human
ggcuggucuugaacuccugaccuc

SEQ ID NO: 591595 - RNA, 23 nt, Human
gggguuucaccauguuggucagg

SEQ ID NO: 591596 - RNA, 23 nt, Human
ggguugaaaugauucuccugccu

SEQ ID NO: 591597 - RNA, 19 nt, Human
ggucuugaacuccugaccu

SEQ ID NO: 591598 - RNA, 23 nt, Human
guagagacgggguuucaccaugu

SEQ ID NO: 591599 - RNA, 18 nt, Human
guagcugggauuacaggc

SEQ ID NO: 591600 - RNA, 19 nt, Human
guaugccaccacacccagc

SEQ ID NO: 591601 - RNA, 18 nt, Human
uaacccucagcaagacac

SEQ ID NO: 591602 - RNA, 24 nt, Human
uaauuuuuguauuuuuaguagaga

SEQ ID NO: 591603 - RNA, 24 nt, Human
uacaggcguaugccaccacaccca

SEQ ID NO: 591604 - RNA, 22 nt, Human
uacaggcgugagccaccacgcc

SEQ ID NO: 591605 - RNA, 22 nt, Human
uacaggcgugagccaccacgcc

SEQ ID NO: 591606 - RNA, 23 nt, Human
uacaggcgugagccaccacgccu

SEQ ID NO: 591607 - RNA, 19 nt, Human
uacaguaacccucagcaag

SEQ ID NO: 591608 - RNA, 22 nt, Human
uacaguucucucccaaaaugga

SEQ ID NO: 591609 - RNA, 24 nt, Human
uaccaaagacaggauucaaagaca

SEQ ID NO: 591610 - RNA, 21 nt, Human
uaccagaaucaucaucaacau

SEQ ID NO: 591611 - RNA, 22 nt, Human
uagagacgggguuucaccaugu

SEQ ID NO: 591612 - RNA, 19 nt, Human
uagcaguuaacauugauac

SEQ ID NO: 591613 - RNA, 24 nt, Human
uaguagagacgggguuucaccaug

SEQ ID NO: 591614 - RNA, 26 nt, Human
uaguagagacgggguuucaccauguu

SEQ ID NO: 591615 - RNA, 20 nt, Human
uaucucaaauuacuuaucug

SEQ ID NO: 591616 - RNA, 18 nt, Human
uaugcccauacacaaauu

SEQ ID NO: 591617 - RNA, 21 nt, Human
ucaaauccaagcuccaucacc

SEQ ID NO: 591618 - RNA, 18 nt, Human
ucacugcaaccucagccu

SEQ ID NO: 591619 - RNA, 23 nt, Human
ucacugcaaccucagccucccgg

SEQ ID NO: 591620 - RNA, 24 nt, Human
ucacugcaaccucagccucccggg

SEQ ID NO: 591621 - RNA, 20 nt, Human
ucagccucccgaguagcugg

SEQ ID NO: 591622 - RNA, 18 nt, Human
uccagaugaagaagcaga

SEQ ID NO: 591623 - RNA, 19 nt, Human
uccauugaccaggcuggag

SEQ ID NO: 591624 - RNA, 24 nt, Human
ucccaaagugcugggauuacaggc

SEQ ID NO: 591625 - RNA, 24 nt, Human
ucccgaguagcugggauuacaggc

SEQ ID NO: 591626 - RNA, 24 nt, Human
ucccggguugaaaugauucuccug

SEQ ID NO: 591627 - RNA, 24 nt, Human
ucgcacuccauugaccaggcugga

SEQ ID NO: 591628 - RNA, 21 nt, Human
ucuugaacuccugaccucaug

SEQ ID NO: 591629 - RNA, 18 nt, Human
ugaagaagcagagguuca

SEQ ID NO: 591630 - RNA, 24 nt, Human
ugaccaggcuggagugcaguggua

SEQ ID NO: 591631 - RNA, 24 nt, Human
ugauccacccaccucaaccuccca

SEQ ID NO: 591632 - RNA, 24 nt, Human
ugccucagccucccgaguagcugg

SEQ ID NO: 591633 - RNA, 24 nt, Human
ugcugggauuacaggcgugagcca

SEQ ID NO: 591634 - RNA, 18 nt, Human
uggagugcagugguacaa

SEQ ID NO: 591635 - RNA, 19 nt, Human
uggagugcagugguacaau

SEQ ID NO: 591636 - RNA, 21 nt, Human
ugggauuacaggcguaugcca

SEQ ID NO: 591637 - RNA, 22 nt, Human
ugggauuacaggcguaugccac

SEQ ID NO: 591638 - RNA, 24 nt, Human
ugggauuacaggcguaugccacca

SEQ ID NO: 591639 - RNA, 18 nt, Human
ugggauuacaggcgugag

SEQ ID NO: 591640 - RNA, 19 nt, Human
ugggauuacaggcgugagc

SEQ ID NO: 591641 - RNA, 22 nt, Human
ugggauuacaggcgugagccac

SEQ ID NO: 591642 - RNA, 23 nt, Human
ugggauuacaggcgugagccacc

SEQ ID NO: 591643 - RNA, 24 nt, Human
ugggauuacaggcgugagccacca

SEQ ID NO: 591644 - RNA, 24 nt, Human
ugguacaaucuccacucacugcaa

SEQ ID NO: 591645 - RNA, 24 nt, Human
uggucaggcuggucuugaacuccu

SEQ ID NO: 591646 - RNA, 22 nt, Human
uguaaaauggagauaauaguac

SEQ ID NO: 591647 - RNA, 21 nt, Human
uguauuuuuaguagagacggg

SEQ ID NO: 591648 - RNA, 22 nt, Human
uguucaggcuccacuccuggag

SEQ ID NO: 591649 - RNA, 18 nt, Human
uuaguagagacgggguuu

SEQ ID NO: 591650 - RNA, 22 nt, Human
uuaguagagacgggguuucacc

SEQ ID NO: 591651 - RNA, 24 nt, Human
uuaguagagacgggguuucaccau

SEQ ID NO: 591652 - RNA, 21 nt, Human
uuauguucaggcuccacuccu

SEQ ID NO: 591653 - RNA, 24 nt, Human
uuucaccauguuggucaggcuggu

SEQ ID NO: 591654 - RNA, 24 nt, Human
uuuuuaguagagacgggguuucac

SEQ ID NO: 591655 - RNA, 20 nt, Human
uuuuuguauuuuuaguagag

SEQ ID NO: 591656 - RNA, 21 nt, Human
aaccaugaggagaaaagaguu

SEQ ID NO: 591657 - RNA, 18 nt, Human
accaugaggagaaaagag

SEQ ID NO: 591658 - RNA, 19 nt, Human
acccucauucucauuuucc

SEQ ID NO: 591659 - RNA, 18 nt, Human
agaaccaugaggagaaaa

SEQ ID NO: 591660 - RNA, 21 nt, Human
agguguugaaggauuagaacc

SEQ ID NO: 591661 - RNA, 20 nt, Human
augcaguaggaacaggaguu

SEQ ID NO: 591662 - RNA, 22 nt, Human
cacaauuucuccaggauuaccc

SEQ ID NO: 591663 - RNA, 26 nt, Human
caguaggaacaggaguugcagcaggu

SEQ ID NO: 591664 - RNA, 21 nt, Human
gaaaggucuucauucucuguu

SEQ ID NO: 591665 - RNA, 19 nt, Human
gaugcaguaggaacaggag

SEQ ID NO: 591666 - RNA, 22 nt, Human
gcauguggucggcauggaggua

SEQ ID NO: 591667 - RNA, 20 nt, Human
ggagaaaagaguugacuugc

SEQ ID NO: 591668 - RNA, 22 nt, Human
ggauuacccucauucucauuuu

SEQ ID NO: 591669 - RNA, 21 nt, Human
ggguggaaaauguuugauucu

SEQ ID NO: 591670 - RNA, 18 nt, Human
ugaaggaggugguuugga

SEQ ID NO: 591671 - RNA, 27 nt, Human
ugcaguaggaacaggaguugcagcagg

SEQ ID NO: 591672 - RNA, 20 nt, Human
uggccagcuucacauuuguc

SEQ ID NO: 591673 - RNA, 20 nt, Human
uggcccaagaauucgugcag

SEQ ID NO: 591674 - RNA, 21 nt, Human
uuagaaccaugaggagaaaag

SEQ ID NO: 591675 - RNA, 22 nt, Human
uuaggaguauauggagguggag

SEQ ID NO: 591676 - RNA, 18 nt, Human
uuccuacaggauuaggag

SEQ ID NO: 591677 - RNA, 20 nt, Human
uucucuguuccuacaggauu

SEQ ID NO: 591678 - RNA, 24 nt, Human
uugaaggaggugguuuggauggcc

SEQ ID NO: 591679 - RNA, 19 nt, Human
uugaaggauuagaaccaug

SEQ ID NO: 591680 - RNA, 20 nt, Human
uugcagcagguguugaagga

SEQ ID NO: 591681 - RNA, 18 nt, Human
uugccuucguuaguacau

SEQ ID NO: 591682 - RNA, 19 nt, Human
uuugucagauuguucauug

SEQ ID NO: 591683 - RNA, 22 nt, Human
aaagaaagauaugcuuguggca

SEQ ID NO: 591684 - RNA, 24 nt, Human
aaagugcugggauuacaggcguga

SEQ ID NO: 591685 - RNA, 19 nt, Human
aagcagcugggauuacaga

SEQ ID NO: 591686 - RNA, 26 nt, Human
aagcagcugggauuacagacgccugc

SEQ ID NO: 591687 - RNA, 22 nt, Human
aagccaacccugaugcuccugg

SEQ ID NO: 591688 - RNA, 22 nt, Human
aaguagcagugcugccggggcc

SEQ ID NO: 591689 - RNA, 19 nt, Human
aagugcugggauuacaggc

SEQ ID NO: 591690 - RNA, 19 nt, Human
aagugcugggauuacaggc

SEQ ID NO: 591691 - RNA, 26 nt, Human
aagugcugggauuacaggcgugagcc

SEQ ID NO: 591692 - RNA, 21 nt, Human
acacauacacacauauacaca

SEQ ID NO: 591693 - RNA, 21 nt, Human
acauacacacauauacacaca

SEQ ID NO: 591694 - RNA, 24 nt, Human
acaugcccaggcagaguccaugug

SEQ ID NO: 591695 - RNA, 24 nt, Human
acugccucagccucccaagcagcu

SEQ ID NO: 591696 - RNA, 21 nt, Human
acugugcuuggggaaacucca

SEQ ID NO: 591697 - RNA, 31 nt, Human
acuuaaaauacacauacacacauauacacag

SEQ ID NO: 591698 - RNA, 23 nt, Human
agccggcuccaauggcgccucca

SEQ ID NO: 591699 - RNA, 25 nt, Human
aggcuggagugcaguggcaugaucu

SEQ ID NO: 591700 - RNA, 26 nt, Human
aggguagaccuuuucccuuuagaggu

SEQ ID NO: 591701 - RNA, 22 nt, Human
aguagagaugggguuucaccau

SEQ ID NO: 591702 - RNA, 18 nt, Human
agugcaguggcaugaucu

SEQ ID NO: 591703 - RNA, 18 nt, Human
agugcaguggcaugaucu

SEQ ID NO: 591704 - RNA, 24 nt, Human
agugcaguggcaugaucugugcuc

SEQ ID NO: 591705 - RNA, 23 nt, Human
agugcugccggggccuggcccag

SEQ ID NO: 591706 - RNA, 18 nt, Human
agugcugggauuacaggc

SEQ ID NO: 591707 - RNA, 24 nt, Human
auauacacacacucucacacgcag

SEQ ID NO: 591708 - RNA, 24 nt, Human
augggguuucaccauauuggccag

SEQ ID NO: 591709 - RNA, 18 nt, Human
auuggccaggguggucuc

SEQ ID NO: 591710 - RNA, 24 nt, Human
caaagugcugggauuacaggcgug

SEQ ID NO: 591711 - RNA, 28 nt, Human
caagugauccgcaugccucggacuccca

SEQ ID NO: 591712 - RNA, 22 nt, Human
caagugauucuacugccucagc

SEQ ID NO: 591713 - RNA, 22 nt, Human
cacagccagaauccccaagauc

SEQ ID NO: 591714 - RNA, 18 nt, Human
caccauauuggccagggu

SEQ ID NO: 591715 - RNA, 22 nt, Human
caccauauuggccagggugguc

SEQ ID NO: 591716 - RNA, 24 nt, Human
caccauauuggccaggguggucuc

SEQ ID NO: 591717 - RNA, 19 nt, Human
cagaauccccaagaucaaa

SEQ ID NO: 591718 - RNA, 23 nt, Human
cagacgccugccaccacgcccgg

SEQ ID NO: 591719 - RNA, 21 nt, Human
cagcacccggcagcggcgcug

SEQ ID NO: 591720 - RNA, 23 nt, Human
cagccgggcucgccagccaagcc

SEQ ID NO: 591721 - RNA, 23 nt, Human
cagccucccaagcagcugggauu

SEQ ID NO: 591722 - RNA, 19 nt, Human
caggguagaccuuuucccu

SEQ ID NO: 591723 - RNA, 23 nt, Human
caguuuguucuaauuucucacca

SEQ ID NO: 591724 - RNA, 26 nt, Human
cauccuaacuuacgauucauauucug

SEQ ID NO: 591725 - RNA, 22 nt, Human
caugcucccaagccaacccuga

SEQ ID NO: 591726 - RNA, 22 nt, Human
ccaaagugcugggauuacaggc

SEQ ID NO: 591727 - RNA, 22 nt, Human
ccaaagugcugggauuacaggc

SEQ ID NO: 591728 - RNA, 24 nt, Human
ccaaagugcugggauuacaggcgu

SEQ ID NO: 591729 - RNA, 19 nt, Human
ccacugcgcccagcccaaa

SEQ ID NO: 591730 - RNA, 20 nt, Human
ccacugcgcccagcccaaau

SEQ ID NO: 591731 - RNA, 18 nt, Human
ccaggguucaagugauuc

SEQ ID NO: 591732 - RNA, 23 nt, Human
ccaggguucaagugauucuacug

SEQ ID NO: 591733 - RNA, 25 nt, Human
cccaagaucaaaaaaaaaauuuuug

SEQ ID NO: 591734 - RNA, 19 nt, Human
cccaagcagcugggauuac

SEQ ID NO: 591735 - RNA, 20 nt, Human
ccgcaugccucggacuccca

SEQ ID NO: 591736 - RNA, 26 nt, Human
ccggcagcggcgcuggccccgccuuc

SEQ ID NO: 591737 - RNA, 23 nt, Human
ccgucuccaguuuguucuaauuu

SEQ ID NO: 591738 - RNA, 18 nt, Human
ccugaccucaagugaucc

SEQ ID NO: 591739 - RNA, 19 nt, Human
ccugaccucaagugauccg

SEQ ID NO: 591740 - RNA, 21 nt, Human
ccugauacccagauaugugac

SEQ ID NO: 591741 - RNA, 24 nt, Human
cggcuccaauggcgccuccagcac

SEQ ID NO: 591742 - RNA, 24 nt, Human
cguuuuguugcccaggcuggagug

SEQ ID NO: 591743 - RNA, 21 nt, Human
cucaagugauccgcaugccuc

SEQ ID NO: 591744 - RNA, 19 nt, Human
cuccaggguucaagugauu

SEQ ID NO: 591745 - RNA, 24 nt, Human
cucccaagccaacccugaugcucc

SEQ ID NO: 591746 - RNA, 24 nt, Human
cucguuuuguugcccaggcuggag

SEQ ID NO: 591747 - RNA, 20 nt, Human
cugcaaccgccaccuccagg

SEQ ID NO: 591748 - RNA, 23 nt, Human
cuuuguuguauuuuuaguagaga

SEQ ID NO: 591749 - RNA, 24 nt, Human
gaccucaagugauccgcaugccuc

SEQ ID NO: 591750 - RNA, 23 nt, Human
gagacgaagucucguuuuguugc

SEQ ID NO: 591751 - RNA, 24 nt, Human
gagacgaagucucguuuuguugcc

SEQ ID NO: 591752 - RNA, 23 nt, Human
gagaugggguuucaccauauugg

SEQ ID NO: 591753 - RNA, 24 nt, Human
gagaugggguuucaccauauuggc

SEQ ID NO: 591754 - RNA, 22 nt, Human
gagcucuaugauaauuguguga

SEQ ID NO: 591755 - RNA, 18 nt, Human
gauuacagacgccugcca

SEQ ID NO: 591756 - RNA, 18 nt, Human
gauuacaggcgugagcca

SEQ ID NO: 591757 - RNA, 22 nt, Human
gauuacaggcgugagccacugc

SEQ ID NO: 591758 - RNA, 22 nt, Human
gauuacaggcgugagccacugc

SEQ ID NO: 591759 - RNA, 21 nt, Human
gauucuacugccucagccucc

SEQ ID NO: 591760 - RNA, 22 nt, Human
gcaaccgccaccuccaggguuc

SEQ ID NO: 591761 - RNA, 21 nt, Human
gcagaaacguuuaaguguucu

SEQ ID NO: 591762 - RNA, 24 nt, Human
gccaccuccaggguucaagugauu

SEQ ID NO: 591763 - RNA, 24 nt, Human
gcccaggcuggagugcaguggcau

SEQ ID NO: 591764 - RNA, 18 nt, Human
gcgcccagcccaaauuau

SEQ ID NO: 591765 - RNA, 18 nt, Human
gcucaccucucaugcucc

SEQ ID NO: 591766 - RNA, 24 nt, Human
gcuggagugcaguggcaugaucug

SEQ ID NO: 591767 - RNA, 18 nt, Human
gggguuucaccauauugg

SEQ ID NO: 591768 - RNA, 22 nt, Human
gggguuucaccauauuggccag

SEQ ID NO: 591769 - RNA, 23 nt, Human
gguggucucgaacuccugaccuc

SEQ ID NO: 591770 - RNA, 18 nt, Human
guccaugugucaauggcc

SEQ ID NO: 591771 - RNA, 24 nt, Human
gucucguuuuguugcccaggcugg

SEQ ID NO: 591772 - RNA, 22 nt, Human
gugagccacugcgcccagccca

SEQ ID NO: 591773 - RNA, 24 nt, Human
gugauucuacugccucagccuccc

SEQ ID NO: 591774 - RNA, 24 nt, Human
uaacaauaccuacacauaaaaaca

SEQ ID NO: 591775 - RNA, 20 nt, Human
uaacaugcccaggcagaguc

SEQ ID NO: 591776 - RNA, 24 nt, Human
uaaccuaacaugcccaggcagagu

SEQ ID NO: 591777 - RNA, 23 nt, Human
uacagacgccugccaccacgccc

SEQ ID NO: 591778 - RNA, 19 nt, Human
uacaggcgugagccacugc

SEQ ID NO: 591779 - RNA, 24 nt, Human
uacaggcgugagccacugcgccca

SEQ ID NO: 591780 - RNA, 22 nt, Human
uaccauaauugucgugcaccaa

SEQ ID NO: 591781 - RNA, 30 nt, Human
uagaccaagcaaauguuuuuuuaccauaaa

SEQ ID NO: 591782 - RNA, 19 nt, Human
uaguagagaugggguuuca

SEQ ID NO: 591783 - RNA, 23 nt, Human
uaguagagaugggguuucaccau

SEQ ID NO: 591784 - RNA, 26 nt, Human
uaguagagaugggguuucaccauauu

SEQ ID NO: 591785 - RNA, 24 nt, Human
ucaccauauuggccaggguggucu

SEQ ID NO: 591786 - RNA, 23 nt, Human
ucacugcaaccgccaccuccagg

SEQ ID NO: 591787 - RNA, 24 nt, Human
ucacugcaaccgccaccuccaggg

SEQ ID NO: 591788 - RNA, 27 nt, Human
ucacugcaaccgccaccuccaggguuc

SEQ ID NO: 591789 - RNA, 18 nt, Human
ucagccucccaagcagcu

SEQ ID NO: 591790 - RNA, 20 nt, Human
ucagccucccaagcagcugg

SEQ ID NO: 591791 - RNA, 25 nt, Human
uccaugugaguauuuuaaggcuugg

SEQ ID NO: 591792 - RNA, 24 nt, Human
ucccaaagugcugggauuacaggc

SEQ ID NO: 591793 - RNA, 22 nt, Human
ucgccagccaagccggcuccaa

SEQ ID NO: 591794 - RNA, 19 nt, Human
ucggacucccaaagugcug

SEQ ID NO: 591795 - RNA, 24 nt, Human
ucguuuuguugcccaggcuggagu

SEQ ID NO: 591796 - RNA, 23 nt, Human
ucuaugauaauugugugaaugag

SEQ ID NO: 591797 - RNA, 21 nt, Human
ucuccaguuuguucuaauuuc

SEQ ID NO: 591798 - RNA, 21 nt, Human
ucucgaacuccugaccucaag

SEQ ID NO: 591799 - RNA, 23 nt, Human
ucucguuuuguugcccaggcugg

SEQ ID NO: 591800 - RNA, 24 nt, Human
ucucguuuuguugcccaggcugga

SEQ ID NO: 591801 - RNA, 18 nt, Human
ugaccucaagugauccgc

SEQ ID NO: 591802 - RNA, 24 nt, Human
ugaccucaagugauccgcaugccu

SEQ ID NO: 591803 - RNA, 18 nt, Human
ugaggucaaaccugauac

SEQ ID NO: 591804 - RNA, 22 nt, Human
ugccacugaaggcauauuuugc

SEQ ID NO: 591805 - RNA, 18 nt, Human
ugcccaggcuggagugca

SEQ ID NO: 591806 - RNA, 21 nt, Human
ugcccaggcuggagugcagug

SEQ ID NO: 591807 - RNA, 22 nt, Human
ugcccaggcuggagugcagugg

SEQ ID NO: 591808 - RNA, 24 nt, Human
ugcccaggcuggagugcaguggca

SEQ ID NO: 591809 - RNA, 19 nt, Human
ugccggggccuggcccagg

SEQ ID NO: 591810 - RNA, 24 nt, Human
ugccucagccucccaagcagcugg

SEQ ID NO: 591811 - RNA, 21 nt, Human
ugccucggacucccaaagugc

SEQ ID NO: 591812 - RNA, 24 nt, Human
ugcuccuggcuccaggguagaccu

SEQ ID NO: 591813 - RNA, 24 nt, Human
ugcugggauuacaggcgugagcca

SEQ ID NO: 591814 - RNA, 19 nt, Human
uggagugcaguggcaugau

SEQ ID NO: 591815 - RNA, 21 nt, Human
uggagugcaguggcaugaucu

SEQ ID NO: 591816 - RNA, 22 nt, Human
uggagugcaguggcaugaucug

SEQ ID NO: 591817 - RNA, 24 nt, Human
uggccaggguggucucgaacuccu

SEQ ID NO: 591818 - RNA, 21 nt, Human
ugggauuacagacgccugcca

SEQ ID NO: 591819 - RNA, 22 nt, Human
ugggauuacagacgccugccac

SEQ ID NO: 591820 - RNA, 24 nt, Human
ugggauuacagacgccugccacca

SEQ ID NO: 591821 - RNA, 18 nt, Human
ugggauuacaggcgugag

SEQ ID NO: 591822 - RNA, 19 nt, Human
ugggauuacaggcgugagc

SEQ ID NO: 591823 - RNA, 21 nt, Human
ugggauuacaggcgugagcca

SEQ ID NO: 591824 - RNA, 22 nt, Human
ugggauuacaggcgugagccac

SEQ ID NO: 591825 - RNA, 22 nt, Human
ugggauuacaggcgugagccac

SEQ ID NO: 591826 - RNA, 24 nt, Human
ugggauuacaggcgugagccacug

SEQ ID NO: 591827 - RNA, 26 nt, Human
ugggauuacaggcgugagccacugcg

SEQ ID NO: 591828 - RNA, 24 nt, Human
ugggguuucaccauauuggccagg

SEQ ID NO: 591829 - RNA, 21 nt, Human
uguauuuuuaguagagauggg

SEQ ID NO: 591830 - RNA, 18 nt, Human
uguuacaacuuguauggu

SEQ ID NO: 591831 - RNA, 23 nt, Human
uguuuggaaaaucuaucacagua

SEQ ID NO: 591832 - RNA, 18 nt, Human
uuaguagagaugggguuu

SEQ ID NO: 591833 - RNA, 22 nt, Human
uuaguagagaugggguuucacc

SEQ ID NO: 591834 - RNA, 24 nt, Human
uuaguagagaugggguuucaccau

SEQ ID NO: 591835 - RNA, 23 nt, Human
uucaagugauucuacugccucag

SEQ ID NO: 591836 - RNA, 22 nt, Human
uucacagccagaauccccaaga

SEQ ID NO: 591837 - RNA, 22 nt, Human
uucgcuuuaucaucauaaucac

SEQ ID NO: 591838 - RNA, 24 nt, Human
uugcccaggcuggagugcaguggc

SEQ ID NO: 591839 - RNA, 24 nt, Human
uugcuaaacugcugcuccagguau

SEQ ID NO: 591840 - RNA, 18 nt, Human
uuguauuuuuaguagaga

SEQ ID NO: 591841 - RNA, 23 nt, Human
uuguauuuuuaguagagaugggg

SEQ ID NO: 591842 - RNA, 20 nt, Human
uuuaauaacuaauacaaagg

SEQ ID NO: 591843 - RNA, 19 nt, Human
uuucaccauauuggccagg

SEQ ID NO: 591844 - RNA, 20 nt, Human
uuugcuaaacugcugcucca

SEQ ID NO: 591845 - RNA, 18 nt, Human
uuuguugcccaggcugga

SEQ ID NO: 591846 - RNA, 24 nt, Human
uuuguugcccaggcuggagugcag

SEQ ID NO: 591847 - RNA, 21 nt, Human
uuuguuguauuuuuaguagag

SEQ ID NO: 591848 - RNA, 24 nt, Human
uuuguuguauuuuuaguagagaug

SEQ ID NO: 591849 - RNA, 24 nt, Human
uuuuuaguagagaugggguuucac

SEQ ID NO: 591850 - RNA, 25 nt, Human
aaaaaaaaaucuuuuaauuuuuaua

SEQ ID NO: 591851 - RNA, 20 nt, Human
aaaaaagaggagagcacaaa

SEQ ID NO: 591852 - RNA, 19 nt, Human
aaacaaaaaagaggagagc

SEQ ID NO: 591853 - RNA, 27 nt, Human
aaacaaacaaaaaagaggagagcagcu

SEQ ID NO: 591854 - RNA, 19 nt, Human
aaauaguauuacaguaaca

SEQ ID NO: 591855 - RNA, 23 nt, Human
aacaaaaaagaggagagcacaaa

SEQ ID NO: 591856 - RNA, 26 nt, Human
aacaaacaaauaugaaaaaaaaagua

SEQ ID NO: 591857 - RNA, 19 nt, Human
aacaaggugaaaccucauc

SEQ ID NO: 591858 - RNA, 20 nt, Human
aacaaggugaaaccucaucu

SEQ ID NO: 591859 - RNA, 21 nt, Human
aacaaggugaaaccucaucuc

SEQ ID NO: 591860 - RNA, 18 nt, Human
aagccgaggcggguggau

SEQ ID NO: 591861 - RNA, 24 nt, Human
aauugcuugagccagggagaugga

SEQ ID NO: 591862 - RNA, 24 nt, Human
acagagcaauauuccaucucaaaa

SEQ ID NO: 591863 - RNA, 22 nt, Human
accacuguacuccagccugggc

SEQ ID NO: 591864 - RNA, 23 nt, Human
accacuguacuccagccugggca

SEQ ID NO: 591865 - RNA, 24 nt, Human
accacuguacuccagccugggcaa

SEQ ID NO: 591866 - RNA, 20 nt, Human
accagccugaccaacaaggu

SEQ ID NO: 591867 - RNA, 22 nt, Human
accucaucucuacuaaaaauaa

SEQ ID NO: 591868 - RNA, 21 nt, Human
acgccuauaaucccagcacuu

SEQ ID NO: 591869 - RNA, 21 nt, Human
acuauagucccagcuacuugg

SEQ ID NO: 591870 - RNA, 24 nt, Human
acuguacuccagccugggcaacag

SEQ ID NO: 591871 - RNA, 25 nt, Human
acuguacuccagccugggcaacaga

SEQ ID NO: 591872 - RNA, 19 nt, Human
agauggagguugcagugac

SEQ ID NO: 591873 - RNA, 24 nt, Human
agccugggcaacagagcaauauuc

SEQ ID NO: 591874 - RNA, 21 nt, Human
aggaaaaccauuccguuuuga

SEQ ID NO: 591875 - RNA, 21 nt, Human
aggaaaucagcaaacuaaagc

SEQ ID NO: 591876 - RNA, 20 nt, Human
aggaguuugagaccagccug

SEQ ID NO: 591877 - RNA, 24 nt, Human
aggcaugguggcuuacgccuauaa

SEQ ID NO: 591878 - RNA, 22 nt, Human
aggcggguggauccccugaggu

SEQ ID NO: 591879 - RNA, 26 nt, Human
aggcggguggauccccugaggucagg

SEQ ID NO: 591880 - RNA, 22 nt, Human
agugcaaaacaaacaaaaaaga

SEQ ID NO: 591881 - RNA, 23 nt, Human
auaguauuacaguaacauugcaa

SEQ ID NO: 591882 - RNA, 20 nt, Human
cacagcagguuacuaaaagc

SEQ ID NO: 591883 - RNA, 22 nt, Human
cacagcuccacuuccaucucuu

SEQ ID NO: 591884 - RNA, 19 nt, Human
caccauguaccagaaaaga

SEQ ID NO: 591885 - RNA, 19 nt, Human
cacuguacuccagccuggg

SEQ ID NO: 591886 - RNA, 20 nt, Human
cacuguacuccagccugggc

SEQ ID NO: 591887 - RNA, 21 nt, Human
cacuguacuccagccugggca

SEQ ID NO: 591888 - RNA, 22 nt, Human
cacuguacuccagccugggcaa

SEQ ID NO: 591889 - RNA, 23 nt, Human
cacuguacuccagccugggcaac

SEQ ID NO: 591890 - RNA, 24 nt, Human
cacuguacuccagccugggcaaca

SEQ ID NO: 591891 - RNA, 18 nt, Human
cagaaaagaaugccccuc

SEQ ID NO: 591892 - RNA, 23 nt, Human
cagcaaacuaaagccucaaauca

SEQ ID NO: 591893 - RNA, 24 nt, Human
cagcacuucgggaagccgaggcgg

SEQ ID NO: 591894 - RNA, 21 nt, Human
cagcuccacuuccaucucuuu

SEQ ID NO: 591895 - RNA, 24 nt, Human
cagugaccacuguacuccagccug

SEQ ID NO: 591896 - RNA, 20 nt, Human
ccacuguacuccagccuggg

SEQ ID NO: 591897 - RNA, 21 nt, Human
ccacuguacuccagccugggc

SEQ ID NO: 591898 - RNA, 22 nt, Human
ccacuguacuccagccugggca

SEQ ID NO: 591899 - RNA, 23 nt, Human
ccacuguacuccagccugggcaa

SEQ ID NO: 591900 - RNA, 24 nt, Human
ccacuguacuccagccugggcaac

SEQ ID NO: 591901 - RNA, 23 nt, Human
ccacuuccaucucuucucaggaa

SEQ ID NO: 591902 - RNA, 26 nt, Human
ccauguaccagaaaagaaugccccuc

SEQ ID NO: 591903 - RNA, 24 nt, Human
cccugaggucaggaguuugagacc

SEQ ID NO: 591904 - RNA, 18 nt, Human
ccucagcaacaugggcca

SEQ ID NO: 591905 - RNA, 24 nt, Human
ccugaccaacaaggugaaaccuca

SEQ ID NO: 591906 - RNA, 22 nt, Human
ccugaggucaggaguuugagac

SEQ ID NO: 591907 - RNA, 24 nt, Human
cgaggcggguggauccccugaggu

SEQ ID NO: 591908 - RNA, 23 nt, Human
cgccuauaaucccagcacuucgg

SEQ ID NO: 591909 - RNA, 24 nt, Human
cggguggauccccugaggucagga

SEQ ID NO: 591910 - RNA, 23 nt, Human
cuaaagccucaaaucaaaggugg

SEQ ID NO: 591911 - RNA, 25 nt, Human
cuuacgccuauaaucccagcacuuc

SEQ ID NO: 591912 - RNA, 22 nt, Human
cuuuucauaaaaucuuaguaga

SEQ ID NO: 591913 - RNA, 22 nt, Human
gagaauugcuugagccagggag

SEQ ID NO: 591914 - RNA, 20 nt, Human
gagagcacaaaugaauagcc

SEQ ID NO: 591915 - RNA, 25 nt, Human
gaggcggguggauccccugagguca

SEQ ID NO: 591916 - RNA, 21 nt, Human
gauccccugaggucaggaguu

SEQ ID NO: 591917 - RNA, 24 nt, Human
gauccccugaggucaggaguuuga

SEQ ID NO: 591918 - RNA, 21 nt, Human
gauugacaaagugcaaaacaa

SEQ ID NO: 591919 - RNA, 20 nt, Human
gcaugguggcuuacgccuau

SEQ ID NO: 591920 - RNA, 18 nt, Human
ggaaggacauauuuaaua

SEQ ID NO: 591921 - RNA, 18 nt, Human
ggagguugcagugaccac

SEQ ID NO: 591922 - RNA, 19 nt, Human
ggucaggaguuugagacca

SEQ ID NO: 591923 - RNA, 24 nt, Human
gguggcuuacgccuauaaucccag

SEQ ID NO: 591924 - RNA, 18 nt, Human
guaccagaaaagaaugcc

SEQ ID NO: 591925 - RNA, 24 nt, Human
guacuccagccugggcaacagagc

SEQ ID NO: 591926 - RNA, 18 nt, Human
gucaucuuuucauaaaau

SEQ ID NO: 591927 - RNA, 18 nt, Human
uaacauugcaaacaaaca

SEQ ID NO: 591928 - RNA, 23 nt, Human
uacaaaaugccaaggaaaaccau

SEQ ID NO: 591929 - RNA, 19 nt, Human
uacacagcacacaaauuuu

SEQ ID NO: 591930 - RNA, 18 nt, Human
uacagaugugagagcauu

SEQ ID NO: 591931 - RNA, 18 nt, Human
uaccagaaaagaaugccc

SEQ ID NO: 591932 - RNA, 24 nt, Human
uacgccuauaaucccagcacuucg

SEQ ID NO: 591933 - RNA, 19 nt, Human
uagaaagaaugggaagcca

SEQ ID NO: 591934 - RNA, 22 nt, Human
uagaaagggcucacaaucugag

SEQ ID NO: 591935 - RNA, 27 nt, Human
uaggucuucugauagaagcagcaguuc

SEQ ID NO: 591936 - RNA, 19 nt, Human
uaguagaggugcacuccag

SEQ ID NO: 591937 - RNA, 20 nt, Human
uaguagaggugcacuccagg

SEQ ID NO: 591938 - RNA, 24 nt, Human
uaguagaggugcacuccagggaug

SEQ ID NO: 591939 - RNA, 21 nt, Human
uauugugaugguggccaggaa

SEQ ID NO: 591940 - RNA, 23 nt, Human
uccccugaggucaggaguuugag

SEQ ID NO: 591941 - RNA, 19 nt, Human
ucucuacuaaaaauaaauu

SEQ ID NO: 591942 - RNA, 19 nt, Human
ugaaaccucaucucuacua

SEQ ID NO: 591943 - RNA, 23 nt, Human
ugaauagcccacuuagaagcuga

SEQ ID NO: 591944 - RNA, 22 nt, Human
ugacaaagugcaaaacaaacaa

SEQ ID NO: 591945 - RNA, 23 nt, Human
ugacaaagugcaaaacaaacaaa

SEQ ID NO: 591946 - RNA, 18 nt, Human
ugacauaggagaauugcu

SEQ ID NO: 591947 - RNA, 24 nt, Human
ugacuauagucccagcuacuuggg

SEQ ID NO: 591948 - RNA, 21 nt, Human
ugagaccagccugaccaacaa

SEQ ID NO: 591949 - RNA, 23 nt, Human
ugagaccagccugaccaacaagg

SEQ ID NO: 591950 - RNA, 18 nt, Human
ugaggucaggaguuugag

SEQ ID NO: 591951 - RNA, 20 nt, Human
ugagucucuggagccugaac

SEQ ID NO: 591952 - RNA, 23 nt, Human
ugcaaaacaaacaaaaaagagga

SEQ ID NO: 591953 - RNA, 18 nt, Human
ugcuuauuucugcacucu

SEQ ID NO: 591954 - RNA, 23 nt, Human
uggauccccugaggucaggaguu

SEQ ID NO: 591955 - RNA, 24 nt, Human
uggauccccugaggucaggaguuu

SEQ ID NO: 591956 - RNA, 24 nt, Human
uggcaaauaguauuacaguaacau

SEQ ID NO: 591957 - RNA, 21 nt, Human
uggcuuacgccuauaauccca

SEQ ID NO: 591958 - RNA, 24 nt, Human
uggcuuacgccuauaaucccagca

SEQ ID NO: 591959 - RNA, 25 nt, Human
ugggaagccauuucguuucauaaaa

SEQ ID NO: 591960 - RNA, 24 nt, Human
ugguggcuuacgccuauaauccca

SEQ ID NO: 591961 - RNA, 23 nt, Human
ugucaucuuuucauaaaaucuua

SEQ ID NO: 591962 - RNA, 22 nt, Human
uuaacuuuuaucaugcagccca

SEQ ID NO: 591963 - RNA, 18 nt, Human
uuagccgggcaugguggc

SEQ ID NO: 591964 - RNA, 24 nt, Human
uugcagugaccacuguacuccagc

SEQ ID NO: 591965 - RNA, 24 nt, Human
uugcuugagccagggagauggagg

SEQ ID NO: 591966 - RNA, 23 nt, Human
uugggaggcugacauaggagaau

SEQ ID NO: 591967 - RNA, 23 nt, Human
uuuacaauggcaaauaguauuac

SEQ ID NO: 591968 - RNA, 18 nt, Human
uuuugagucucuggagcc

SEQ ID NO: 591969 - RNA, 19 nt, Human
aaguguugggacuacaggc

SEQ ID NO: 591970 - RNA, 19 nt, Human
aaguguugggacuacaggc

SEQ ID NO: 591971 - RNA, 23 nt, Human
aaguguugggacuacaggcguga

SEQ ID NO: 591972 - RNA, 26 nt, Human
aaguguugggacuacaggcgugagcc

SEQ ID NO: 591973 - RNA, 20 nt, Human
aaucuccgccuccugggcuc

SEQ ID NO: 591974 - RNA, 25 nt, Human
aauuacucaagaccaaaaggcauaa

SEQ ID NO: 591975 - RNA, 24 nt, Human
accagacacaggacacaacaccug

SEQ ID NO: 591976 - RNA, 19 nt, Human
acccaggcuggagugcagu

SEQ ID NO: 591977 - RNA, 23 nt, Human
accccacacauuuuuuguauuuu

SEQ ID NO: 591978 - RNA, 25 nt, Human
acccugggacaccugugguuagcac

SEQ ID NO: 591979 - RNA, 24 nt, Human
acgggaauucgccauguuggccag

SEQ ID NO: 591980 - RNA, 22 nt, Human
acucuugucacccaggcuggag

SEQ ID NO: 591981 - RNA, 24 nt, Human
agacagaggggaaaugaaaacaua

SEQ ID NO: 591982 - RNA, 18 nt, Human
agccuccugaguagcuag

SEQ ID NO: 591983 - RNA, 24 nt, Human
agcgauucuccugccucagccucc

SEQ ID NO: 591984 - RNA, 18 nt, Human
aggaugcuguuaauuacu

SEQ ID NO: 591985 - RNA, 28 nt, Human
aggcauaaaaggagacauauguccaccc

SEQ ID NO: 591986 - RNA, 25 nt, Human
aggcuggagugcagugacacgaucu

SEQ ID NO: 591987 - RNA, 23 nt, Human
aggucuguaguacacccugggga

SEQ ID NO: 591988 - RNA, 24 nt, Human
aggugauccgcccgccucggccuc

SEQ ID NO: 591989 - RNA, 19 nt, Human
aguagcuaggauuacaggc

SEQ ID NO: 591990 - RNA, 18 nt, Human
aguaguugggaagagugg

SEQ ID NO: 591991 - RNA, 20 nt, Human
agugauaaggcaguuuggga

SEQ ID NO: 591992 - RNA, 24 nt, Human
agugcagugacacgaucucggcuc

SEQ ID NO: 591993 - RNA, 22 nt, Human
auuuuuuguauuuuuaguagag

SEQ ID NO: 591994 - RNA, 20 nt, Human
caagcgauucuccugccuca

SEQ ID NO: 591995 - RNA, 22 nt, Human
caagcgauucuccugccucagc

SEQ ID NO: 591996 - RNA, 25 nt, Human
cacaacaccugaggugaaauuucaa

SEQ ID NO: 591997 - RNA, 22 nt, Human
caccaugccuggccccaaccag

SEQ ID NO: 591998 - RNA, 24 nt, Human
cacucuugucacccaggcuggagu

SEQ ID NO: 591999 - RNA, 23 nt, Human
cacugcaaucuccgccuccuggg

SEQ ID NO: 592000 - RNA, 21 nt, Human
cagacacaggacacaacaccu

SEQ ID NO: 592001 - RNA, 19 nt, Human
cagccuccugaguagcuag

SEQ ID NO: 592002 - RNA, 24 nt, Human
cauguuggccaggcuggucuugaa

SEQ ID NO: 592003 - RNA, 19 nt, Human
ccagaacacuucugagcgu

SEQ ID NO: 592004 - RNA, 19 nt, Human
ccauguuggccaggcuggu

SEQ ID NO: 592005 - RNA, 21 nt, Human
ccauguuggccaggcuggucu

SEQ ID NO: 592006 - RNA, 20 nt, Human
cccaguaugcccugccccuu

SEQ ID NO: 592007 - RNA, 24 nt, Human
cccuaaguguugggacuacaggcg

SEQ ID NO: 592008 - RNA, 24 nt, Human
ccgccuccugggcucaagcgauuc

SEQ ID NO: 592009 - RNA, 24 nt, Human
ccuaaguguugggacuacaggcgu

SEQ ID NO: 592010 - RNA, 24 nt, Human
ccuccugggcucaagcgauucucc

SEQ ID NO: 592011 - RNA, 23 nt, Human
ccugaguagcuaggauuacaggc

SEQ ID NO: 592012 - RNA, 24 nt, Human
ccugaguagcuaggauuacaggcu

SEQ ID NO: 592013 - RNA, 22 nt, Human
ccugaucucaggugauccgccc

SEQ ID NO: 592014 - RNA, 23 nt, Human
ccugccucagccuccugaguagc

SEQ ID NO: 592015 - RNA, 24 nt, Human
ccugccucagccuccugaguagcu

SEQ ID NO: 592016 - RNA, 20 nt, Human
ccugggcucaagcgauucuc

SEQ ID NO: 592017 - RNA, 23 nt, Human
ccugggcucaagcgauucuccug

SEQ ID NO: 592018 - RNA, 23 nt, Human
cggaagaguaguugggaagagug

SEQ ID NO: 592019 - RNA, 24 nt, Human
cgggaauucgccauguuggccagg

SEQ ID NO: 592020 - RNA, 24 nt, Human
cucaagcgauucuccugccucagc

SEQ ID NO: 592021 - RNA, 24 nt, Human
cucacugcaaucuccgccuccugg

SEQ ID NO: 592022 - RNA, 24 nt, Human
cuccugaguagcuaggauuacagg

SEQ ID NO: 592023 - RNA, 21 nt, Human
cuccugggcucaagcgauucu

SEQ ID NO: 592024 - RNA, 25 nt, Human
cuccugggcucaagcgauucuccug

SEQ ID NO: 592025 - RNA, 18 nt, Human
cuccugggugcugccucu

SEQ ID NO: 592026 - RNA, 25 nt, Human
cuccugggugcugccucugccuccu

SEQ ID NO: 592027 - RNA, 24 nt, Human
cucuccccaaaucuagcuuccaaa

SEQ ID NO: 592028 - RNA, 20 nt, Human
cugccucugccuccucauau

SEQ ID NO: 592029 - RNA, 18 nt, Human
cugggugcugccucugcc

SEQ ID NO: 592030 - RNA, 24 nt, Human
cuugucacccaggcuggagugcag

SEQ ID NO: 592031 - RNA, 18 nt, Human
gacuacaggcgugagcca

SEQ ID NO: 592032 - RNA, 21 nt, Human
gacuacaggcgugagccacca

SEQ ID NO: 592033 - RNA, 24 nt, Human
gacuacaggcgugagccaccaugc

SEQ ID NO: 592034 - RNA, 22 nt, Human
gagccaccaugccuggccccaa

SEQ ID NO: 592035 - RNA, 26 nt, Human
gaguagcuaggauuacaggcuccugc

SEQ ID NO: 592036 - RNA, 24 nt, Human
gaucucaggugauccgcccgccuc

SEQ ID NO: 592037 - RNA, 24 nt, Human
gccauguuggccaggcuggucuug

SEQ ID NO: 592038 - RNA, 25 nt, Human
gccauguuggccaggcuggucuuga

SEQ ID NO: 592039 - RNA, 24 nt, Human
gcgauucuccugccucagccuccu

SEQ ID NO: 592040 - RNA, 22 nt, Human
ggaauucgccauguuggccagg

SEQ ID NO: 592041 - RNA, 24 nt, Human
ggacuacaggcgugagccaccaug

SEQ ID NO: 592042 - RNA, 22 nt, Human
ggauuacaggcuccugccacca

SEQ ID NO: 592043 - RNA, 21 nt, Human
ggcacagagcacccugggaca

SEQ ID NO: 592044 - RNA, 24 nt, Human
ggcuggucuugaacuccugaucuc

SEQ ID NO: 592045 - RNA, 23 nt, Human
gggaauucgccauguuggccagg

SEQ ID NO: 592046 - RNA, 22 nt, Human
gggcucaagcgauucuccugcc

SEQ ID NO: 592047 - RNA, 19 nt, Human
gguuagcaccauuuaagaa

SEQ ID NO: 592048 - RNA, 24 nt, Human
gugauccgcccgccucggccuccc

SEQ ID NO: 592049 - RNA, 18 nt, Human
guggagcugguggagcug

SEQ ID NO: 592050 - RNA, 22 nt, Human
guggagcugguggagcugucca

SEQ ID NO: 592051 - RNA, 21 nt, Human
uaaaaggagacauauguccac

SEQ ID NO: 592052 - RNA, 23 nt, Human
uacacccuggggaagaaagugau

SEQ ID NO: 592053 - RNA, 22 nt, Human
uacaggcgugagccaccaugcc

SEQ ID NO: 592054 - RNA, 22 nt, Human
uacaggcgugagccaccaugcc

SEQ ID NO: 592055 - RNA, 22 nt, Human
uaggauuacaggcuccugccac

SEQ ID NO: 592056 - RNA, 24 nt, Human
uaggauuacaggcuccugccacca

SEQ ID NO: 592057 - RNA, 25 nt, Human
uaguagagaacgggaauucgccaug

SEQ ID NO: 592058 - RNA, 24 nt, Human
ucacccaggcuggagugcagugac

SEQ ID NO: 592059 - RNA, 23 nt, Human
ucacugcaaucuccgccuccugg

SEQ ID NO: 592060 - RNA, 24 nt, Human
ucacugcaaucuccgccuccuggg

SEQ ID NO: 592061 - RNA, 25 nt, Human
ucacugcaaucuccgccuccugggc

SEQ ID NO: 592062 - RNA, 27 nt, Human
ucacugcaaucuccgccuccugggcuc

SEQ ID NO: 592063 - RNA, 24 nt, Human
ucccuaaguguugggacuacaggc

SEQ ID NO: 592064 - RNA, 19 nt, Human
uccugaguagcuaggauua

SEQ ID NO: 592065 - RNA, 24 nt, Human
uccugaguagcuaggauuacaggc

SEQ ID NO: 592066 - RNA, 21 nt, Human
uccugggcucaagcgauucuc

SEQ ID NO: 592067 - RNA, 24 nt, Human
uccugggcucaagcgauucuccug

SEQ ID NO: 592068 - RNA, 19 nt, Human
uccugggugcugccucugc

SEQ ID NO: 592069 - RNA, 20 nt, Human
uccugguaauugagcuccua

SEQ ID NO: 592070 - RNA, 24 nt, Human
ucgccauguuggccaggcuggucu

SEQ ID NO: 592071 - RNA, 24 nt, Human
ucucacucuugucacccaggcugg

SEQ ID NO: 592072 - RNA, 25 nt, Human
ucucacucuugucacccaggcugga

SEQ ID NO: 592073 - RNA, 19 nt, Human
ucuccgccuccugggcuca

SEQ ID NO: 592074 - RNA, 24 nt, Human
ucuccugccucagccuccugagua

SEQ ID NO: 592075 - RNA, 21 nt, Human
ucugcugaauccuacugucca

SEQ ID NO: 592076 - RNA, 23 nt, Human
ucuugaacuccugaucucaggug

SEQ ID NO: 592077 - RNA, 19 nt, Human
ugacgugaaggcuuucccc

SEQ ID NO: 592078 - RNA, 18 nt, Human
ugaucucaggugauccgc

SEQ ID NO: 592079 - RNA, 24 nt, Human
ugaucucaggugauccgcccgccu

SEQ ID NO: 592080 - RNA, 20 nt, Human
ugcccugccccuugaaaguu

SEQ ID NO: 592081 - RNA, 23 nt, Human
ugccucagccuccugaguagcua

SEQ ID NO: 592082 - RNA, 24 nt, Human
ugccucagccuccugaguagcuag

SEQ ID NO: 592083 - RNA, 21 nt, Human
uggaaggaaagacaucagagc

SEQ ID NO: 592084 - RNA, 21 nt, Human
uggagcugguggagcugucca

SEQ ID NO: 592085 - RNA, 23 nt, Human
uggagugcagugacacgaucucg

SEQ ID NO: 592086 - RNA, 24 nt, Human
uggagugcagugacacgaucucgg

SEQ ID NO: 592087 - RNA, 24 nt, Human
uggccaggcuggucuugaacuccu

SEQ ID NO: 592088 - RNA, 18 nt, Human
ugggacuacaggcgugag

SEQ ID NO: 592089 - RNA, 22 nt, Human
ugggacuacaggcgugagccac

SEQ ID NO: 592090 - RNA, 24 nt, Human
ugggacuacaggcgugagccacca

SEQ ID NO: 592091 - RNA, 25 nt, Human
ugggacuacaggcgugagccaccau

SEQ ID NO: 592092 - RNA, 22 nt, Human
ugggagaaaaaugagguaagcu

SEQ ID NO: 592093 - RNA, 24 nt, Human
ugggcucaagcgauucuccugccu

SEQ ID NO: 592094 - RNA, 25 nt, Human
uuaguagagaacgggaauucgccau

SEQ ID NO: 592095 - RNA, 20 nt, Human
uucgccauguuggccaggcu

SEQ ID NO: 592096 - RNA, 21 nt, Human
uuuuuguauuuuuaguagaga

SEQ ID NO: 592097 - RNA, 18 nt, Human
uuuuuuguauuuuuagua

SEQ ID NO: 592098 - RNA, 24 nt, Human
acugcagacucaaaguggcuacaa

SEQ ID NO: 592099 - RNA, 22 nt, Human
aguggcuacaaaaggaaaagua

SEQ ID NO: 592100 - RNA, 21 nt, Human
caauacccguuuacuaaagac

SEQ ID NO: 592101 - RNA, 21 nt, Human
cuccuaaaccaguucaacuug

SEQ ID NO: 592102 - RNA, 22 nt, Human
gacauuuucagauauuuacaga

SEQ ID NO: 592103 - RNA, 22 nt, Human
uaacucuaggcacuaaucuccu

SEQ ID NO: 592104 - RNA, 26 nt, Human
uaacuugacuuugaaguuuauuauaa

SEQ ID NO: 592105 - RNA, 24 nt, Human
uggcuacaaaaggaaaaguauugu

SEQ ID NO: 592106 - RNA, 23 nt, Human
uuacuaaagacauuuucagauau

SEQ ID NO: 592107 - RNA, 22 nt, Human
aacuccugugggcggcacagcc

SEQ ID NO: 592108 - RNA, 23 nt, Human
aagaauaggaauaagaaaaaugu

SEQ ID NO: 592109 - RNA, 18 nt, Human
agcgaggucacagccugg

SEQ ID NO: 592110 - RNA, 22 nt, Human
aggcagcgaggucacagccugg

SEQ ID NO: 592111 - RNA, 23 nt, Human
aggcagcgaggucacagccuggu

SEQ ID NO: 592112 - RNA, 21 nt, Human
caaggguuggccuggaugugg

SEQ ID NO: 592113 - RNA, 18 nt, Human
cacaccauugaagaggga

SEQ ID NO: 592114 - RNA, 24 nt, Human
caccgcucuccucuccacgucucu

SEQ ID NO: 592115 - RNA, 23 nt, Human
cagaaaauggcccauccaacccc

SEQ ID NO: 592116 - RNA, 19 nt, Human
cauagcuauggcucaagaa

SEQ ID NO: 592117 - RNA, 20 nt, Human
ccaaccccacauccuggccg

SEQ ID NO: 592118 - RNA, 22 nt, Human
ccaaccccacauccuggccggg

SEQ ID NO: 592119 - RNA, 26 nt, Human
ccaaccccacauccuggccgggcgug

SEQ ID NO: 592120 - RNA, 23 nt, Human
ccacaguaugugacaacagaccc

SEQ ID NO: 592121 - RNA, 20 nt, Human
ccacccuggacccccgugcu

SEQ ID NO: 592122 - RNA, 18 nt, Human
ccaggcccugggacgcua

SEQ ID NO: 592123 - RNA, 19 nt, Human
ccaggucccuguggggcga

SEQ ID NO: 592124 - RNA, 19 nt, Human
cccaagagcuaccuggcug

SEQ ID NO: 592125 - RNA, 19 nt, Human
cccaccgcucuccucucca

SEQ ID NO: 592126 - RNA, 23 nt, Human
cccauccaaccccacauccuggc

SEQ ID NO: 592127 - RNA, 25 nt, Human
ccccaagagcuaccuggcugggucu

SEQ ID NO: 592128 - RNA, 26 nt, Human
ccccacauccuggccgggcgugucca

SEQ ID NO: 592129 - RNA, 23 nt, Human
ccccuggcgccugggacaagggu

SEQ ID NO: 592130 - RNA, 27 nt, Human
cccugggacgcuagagaccccaagagc

SEQ ID NO: 592131 - RNA, 20 nt, Human
ccgccgaggggcugggucuu

SEQ ID NO: 592132 - RNA, 19 nt, Human
ccucugggaggaggguggg

SEQ ID NO: 592133 - RNA, 23 nt, Human
ccugggacgcuagagaccccaag

SEQ ID NO: 592134 - RNA, 19 nt, Human
ccugugggcggcacagccc

SEQ ID NO: 592135 - RNA, 27 nt, Human
cggcacagccccaggcugggccucugg

SEQ ID NO: 592136 - RNA, 22 nt, Human
cuggcugggucuauggucaggg

SEQ ID NO: 592137 - RNA, 18 nt, Human
cugugugugccugcaugu

SEQ ID NO: 592138 - RNA, 21 nt, Human
gaacagaaaccaggcccuggg

SEQ ID NO: 592139 - RNA, 22 nt, Human
gaacagaaaccaggcccuggga

SEQ ID NO: 592140 - RNA, 24 nt, Human
gagaucagagccccuggcgccugg

SEQ ID NO: 592141 - RNA, 20 nt, Human
gaggagggugggauggaugg

SEQ ID NO: 592142 - RNA, 21 nt, Human
gagggugggauggaugggaga

SEQ ID NO: 592143 - RNA, 23 nt, Human
gaggguuuggcugccccagacgu

SEQ ID NO: 592144 - RNA, 18 nt, Human
gccccaggcugggccucu

SEQ ID NO: 592145 - RNA, 18 nt, Human
gcugggucuucgccuuua

SEQ ID NO: 592146 - RNA, 20 nt, Human
gcuguguccaucugcaccuc

SEQ ID NO: 592147 - RNA, 19 nt, Human
ggacaaggguuggccugga

SEQ ID NO: 592148 - RNA, 21 nt, Human
ggacaaggguuggccuggaug

SEQ ID NO: 592149 - RNA, 23 nt, Human
ggacgcuagagaccccaagagcu

SEQ ID NO: 592150 - RNA, 23 nt, Human
ggccuugucaaggccucagaggc

SEQ ID NO: 592151 - RNA, 18 nt, Human
ggcggcacagccccaggc

SEQ ID NO: 592152 - RNA, 18 nt, Human
ggcugggucuauggucag

SEQ ID NO: 592153 - RNA, 18 nt, Human
gggaugcguguaggcugu

SEQ ID NO: 592154 - RNA, 19 nt, Human
gggcagggccugggagccg

SEQ ID NO: 592155 - RNA, 20 nt, Human
uaccuggcugggucuauggu

SEQ ID NO: 592156 - RNA, 28 nt, Human
uaggaauaguagaagaauaugccauagc

SEQ ID NO: 592157 - RNA, 22 nt, Human
uauaauaggaauaguagaagaa

SEQ ID NO: 592158 - RNA, 19 nt, Human
ucacagccugguggagggu

SEQ ID NO: 592159 - RNA, 18 nt, Human
ucccaccgcucuccucuc

SEQ ID NO: 592160 - RNA, 22 nt, Human
ucccaccgcucuccucuccacg

SEQ ID NO: 592161 - RNA, 18 nt, Human
ucucuuggcgaugcccag

SEQ ID NO: 592162 - RNA, 21 nt, Human
ucucuuggcgaugcccagcuu

SEQ ID NO: 592163 - RNA, 24 nt, Human
ucucuuggcgaugcccagcuuggg

SEQ ID NO: 592164 - RNA, 20 nt, Human
ugcccagcuugggcugggcg

SEQ ID NO: 592165 - RNA, 19 nt, Human
uggccgggcguguccaggu

SEQ ID NO: 592166 - RNA, 21 nt, Human
uggcgaugcccagcuugggcu

SEQ ID NO: 592167 - RNA, 21 nt, Human
uggcggggguggagaugaggg

SEQ ID NO: 592168 - RNA, 20 nt, Human
ugggaacacaccauugaaga

SEQ ID NO: 592169 - RNA, 18 nt, Human
ugggaggagggugggaug

SEQ ID NO: 592170 - RNA, 19 nt, Human
ugggaggagggugggaugg

SEQ ID NO: 592171 - RNA, 18 nt, Human
ugggauggaugggagauc

SEQ ID NO: 592172 - RNA, 18 nt, Human
ugugcacaggcugugugu

SEQ ID NO: 592173 - RNA, 22 nt, Human
ugugggcggcacagccccaggc

SEQ ID NO: 592174 - RNA, 19 nt, Human
uguggggcgaggguuuggc

SEQ ID NO: 592175 - RNA, 21 nt, Human
ugugugcacaggcugugugug

SEQ ID NO: 592176 - RNA, 29 nt, Human
ugugugccugcaugugugggaugcgugua

SEQ ID NO: 592177 - RNA, 19 nt, Human
ugugugggaugcguguagg

SEQ ID NO: 592178 - RNA, 18 nt, Human
aacccauagccuuggccu

SEQ ID NO: 592179 - RNA, 23 nt, Human
aagaacacuacaaagaguagcuc

SEQ ID NO: 592180 - RNA, 21 nt, Human
aagcaaacuccagacaaugga

SEQ ID NO: 592181 - RNA, 22 nt, Human
aaggcuuuuugucugcagcugc

SEQ ID NO: 592182 - RNA, 19 nt, Human
aagugcccuuauaagagga

SEQ ID NO: 592183 - RNA, 20 nt, Human
acaaagaguagcucucugaa

SEQ ID NO: 592184 - RNA, 22 nt, Human
acaaagaguagcucucugaaca

SEQ ID NO: 592185 - RNA, 23 nt, Human
agaggaggguuuuggcagcugaa

SEQ ID NO: 592186 - RNA, 23 nt, Human
agcugaauucucgguaagaccug

SEQ ID NO: 592187 - RNA, 20 nt, Human
aggcuuuuugucugcagcug

SEQ ID NO: 592188 - RNA, 19 nt, Human
agggguaaggguuuacaga

SEQ ID NO: 592189 - RNA, 21 nt, Human
agguaacccauagccuuggcc

SEQ ID NO: 592190 - RNA, 23 nt, Human
agguaacccauagccuuggccuu

SEQ ID NO: 592191 - RNA, 22 nt, Human
caagcaaacuccagacaaugga

SEQ ID NO: 592192 - RNA, 22 nt, Human
ccaguugucauauaaugaucuc

SEQ ID NO: 592193 - RNA, 20 nt, Human
ccauagccuuggccuuccag

SEQ ID NO: 592194 - RNA, 19 nt, Human
cgguaagaccugcuuuacu

SEQ ID NO: 592195 - RNA, 23 nt, Human
cuuuacucaucaaaguuuagcua

SEQ ID NO: 592196 - RNA, 21 nt, Human
gcuagauuaaaacaagcaaac

SEQ ID NO: 592197 - RNA, 19 nt, Human
ggcuuuuugucugcagcug

SEQ ID NO: 592198 - RNA, 20 nt, Human
gguaaggguuuacagaucag

SEQ ID NO: 592199 - RNA, 23 nt, Human
gugcuaagugcccuuauaagagg

SEQ ID NO: 592200 - RNA, 20 nt, Human
gugugugucuuaaggcuuca

SEQ ID NO: 592201 - RNA, 24 nt, Human
uaacccauagccuuggccuuccag

SEQ ID NO: 592202 - RNA, 25 nt, Human
uagaaaaaacauuuauuauauaugc

SEQ ID NO: 592203 - RNA, 18 nt, Human
uagcucucugaacagcaa

SEQ ID NO: 592204 - RNA, 19 nt, Human
uccagguugaggagggaag

SEQ ID NO: 592205 - RNA, 18 nt, Human
ucuagcuuccuguggcuu

SEQ ID NO: 592206 - RNA, 19 nt, Human
ucucaaucuagcuuccugu

SEQ ID NO: 592207 - RNA, 22 nt, Human
ucucugaacagcaagggguaag

SEQ ID NO: 592208 - RNA, 19 nt, Human
ucugcagcugcuguuuguu

SEQ ID NO: 592209 - RNA, 18 nt, Human
ugaaacuacaaaaaguuc

SEQ ID NO: 592210 - RNA, 19 nt, Human
ugagauacugaguaaagcu

SEQ ID NO: 592211 - RNA, 22 nt, Human
ugcaagaacacuacaaagagua

SEQ ID NO: 592212 - RNA, 22 nt, Human
ugccaaaauuccucaauuugag

SEQ ID NO: 592213 - RNA, 23 nt, Human
ugccaaaauuccucaauuugagg

SEQ ID NO: 592214 - RNA, 20 nt, Human
ugugucuuaaggcuucagaa

SEQ ID NO: 592215 - RNA, 18 nt, Human
uucaaugaaaggggaggg

SEQ ID NO: 592216 - RNA, 28 nt, Human
uucagaaugaaacuacaaaaaguucuga

SEQ ID NO: 592217 - RNA, 22 nt, Human
uugagguaacccauagccuugg

SEQ ID NO: 592218 - RNA, 19 nt, Human
aaaaggucauuuguccaca

SEQ ID NO: 592219 - RNA, 21 nt, Human
aaaccaagaaaacccaaaaga

SEQ ID NO: 592220 - RNA, 19 nt, Human
aaaggccagcggauggccu

SEQ ID NO: 592221 - RNA, 28 nt, Human
aaauccaccuuccuucguaaccaauaaa

SEQ ID NO: 592222 - RNA, 25 nt, Human
aaaucugccucagaccagaggccua

SEQ ID NO: 592223 - RNA, 20 nt, Human
aacauggugaaacccugucu

SEQ ID NO: 592224 - RNA, 21 nt, Human
aacauggugaaacccugucuc

SEQ ID NO: 592225 - RNA, 20 nt, Human
aaccaaggcugacagcaaca

SEQ ID NO: 592226 - RNA, 21 nt, Human
aacccugucucuaccaaaaau

SEQ ID NO: 592227 - RNA, 19 nt, Human
aacggaggagacaagacua

SEQ ID NO: 592228 - RNA, 22 nt, Human
aagcagaaacggaggagacaag

SEQ ID NO: 592229 - RNA, 20 nt, Human
aaggcgccucuacucccgcc

SEQ ID NO: 592230 - RNA, 24 nt, Human
aaucacuugaacccgggaggcgga

SEQ ID NO: 592231 - RNA, 21 nt, Human
acaguccagauccaggagugg

SEQ ID NO: 592232 - RNA, 19 nt, Human
acccaggcuggagugcagu

SEQ ID NO: 592233 - RNA, 18 nt, Human
accccucccuacuuugcu

SEQ ID NO: 592234 - RNA, 24 nt, Human
acccugcuuuuaaaaaaccucgac

SEQ ID NO: 592235 - RNA, 24 nt, Human
acccugucucuaccaaaaauacaa

SEQ ID NO: 592236 - RNA, 18 nt, Human
acgacacuccagccuggg

SEQ ID NO: 592237 - RNA, 24 nt, Human
acgacacuccagccugggcaagag

SEQ ID NO: 592238 - RNA, 21 nt, Human
acgccacgacacuccagccug

SEQ ID NO: 592239 - RNA, 22 nt, Human
acuccagccugggcaagaguga

SEQ ID NO: 592240 - RNA, 18 nt, Human
acucugucacccaggcug

SEQ ID NO: 592241 - RNA, 25 nt, Human
acucugucacccaggcuggagugca

SEQ ID NO: 592242 - RNA, 24 nt, Human
acuugaggucaggaguuugagacc

SEQ ID NO: 592243 - RNA, 22 nt, Human
agaaucacuugaacccgggagg

SEQ ID NO: 592244 - RNA, 18 nt, Human
agcagcugggauuacagg

SEQ ID NO: 592245 - RNA, 24 nt, Human
agccugcagucuucuaggaggcug

SEQ ID NO: 592246 - RNA, 22 nt, Human
agccuggccaacauggugaaac

SEQ ID NO: 592247 - RNA, 24 nt, Human
agccuggccaacauggugaaaccc

SEQ ID NO: 592248 - RNA, 18 nt, Human
agcgucggcgaggcagca

SEQ ID NO: 592249 - RNA, 21 nt, Human
agcuacuggggaagcugaggc

SEQ ID NO: 592250 - RNA, 22 nt, Human
aggaagaaacaguccagaucca

SEQ ID NO: 592251 - RNA, 20 nt, Human
aggaguuugagaccagccug

SEQ ID NO: 592252 - RNA, 18 nt, Human
aggcacgagaaucacuug

SEQ ID NO: 592253 - RNA, 24 nt, Human
aggcacgagaaucacuugaacccg

SEQ ID NO: 592254 - RNA, 21 nt, Human
aggccgaggcggguggaucac

SEQ ID NO: 592255 - RNA, 21 nt, Human
aggcggagguugcagugagcc

SEQ ID NO: 592256 - RNA, 24 nt, Human
aggcggagguugcagugagccgag

SEQ ID NO: 592257 - RNA, 22 nt, Human
aggcggcaaacuaaaaggccaa

SEQ ID NO: 592258 - RNA, 21 nt, Human
aggcggguggaucacuugagg

SEQ ID NO: 592259 - RNA, 23 nt, Human
aggcggguggaucacuugagguc

SEQ ID NO: 592260 - RNA, 26 nt, Human
aggcggguggaucacuugaggucagg

SEQ ID NO: 592261 - RNA, 19 nt, Human
aggcuggagugcaguggca

SEQ ID NO: 592262 - RNA, 21 nt, Human
agugcaguggcacaauuucag

SEQ ID NO: 592263 - RNA, 24 nt, Human
aucacgccacgacacuccagccug

SEQ ID NO: 592264 - RNA, 20 nt, Human
aucacuugaggucaggaguu

SEQ ID NO: 592265 - RNA, 24 nt, Human
aucacuugaggucaggaguuugag

SEQ ID NO: 592266 - RNA, 19 nt, Human
aucccaaaaaaaaaaucug

SEQ ID NO: 592267 - RNA, 21 nt, Human
auuauccugccucagccuccc

SEQ ID NO: 592268 - RNA, 20 nt, Human
caaacuaaaaggccagcgga

SEQ ID NO: 592269 - RNA, 18 nt, Human
caacaggaagaaacaguc

SEQ ID NO: 592270 - RNA, 24 nt, Human
caacauggugaaacccugucucua

SEQ ID NO: 592271 - RNA, 23 nt, Human
caaccuccaccucccaggcccaa

SEQ ID NO: 592272 - RNA, 24 nt, Human
caaccuccaccucccaggcccaag

SEQ ID NO: 592273 - RNA, 24 nt, Human
cacaauuucagcccacugcaaccu

SEQ ID NO: 592274 - RNA, 25 nt, Human
caccuucaauccuagcuacugggga

SEQ ID NO: 592275 - RNA, 23 nt, Human
cacgacacuccagccugggcaag

SEQ ID NO: 592276 - RNA, 24 nt, Human
cacgacacuccagccugggcaaga

SEQ ID NO: 592277 - RNA, 24 nt, Human
cacgccuauaaucccagcacuuug

SEQ ID NO: 592278 - RNA, 21 nt, Human
cacgcgcagccaacccuuggc

SEQ ID NO: 592279 - RNA, 20 nt, Human
cacuccagccugggcaagag

SEQ ID NO: 592280 - RNA, 20 nt, Human
cacuccagccugggcaagag

SEQ ID NO: 592281 - RNA, 22 nt, Human
cacuccagccugggcaagagug

SEQ ID NO: 592282 - RNA, 23 nt, Human
cacucugucacccaggcuggagu

SEQ ID NO: 592283 - RNA, 24 nt, Human
cacucugucacccaggcuggagug

SEQ ID NO: 592284 - RNA, 21 nt, Human
cacugcaaccuccaccuccca

SEQ ID NO: 592285 - RNA, 23 nt, Human
cacuugaggucaggaguuugaga

SEQ ID NO: 592286 - RNA, 22 nt, Human
cagcacuuugagaggccgaggc

SEQ ID NO: 592287 - RNA, 24 nt, Human
cagcacuuugagaggccgaggcgg

SEQ ID NO: 592288 - RNA, 23 nt, Human
cagcccacugcaaccuccaccuc

SEQ ID NO: 592289 - RNA, 23 nt, Human
cagccucccgagcagcugggauu

SEQ ID NO: 592290 - RNA, 18 nt, Human
cagccuuaacaaauagcc

SEQ ID NO: 592291 - RNA, 19 nt, Human
cagggucugcaauguagca

SEQ ID NO: 592292 - RNA, 24 nt, Human
caggugcccaccaccagggaaaac

SEQ ID NO: 592293 - RNA, 19 nt, Human
ccaaaagaauuaaucucau

SEQ ID NO: 592294 - RNA, 19 nt, Human
ccaccucccaggcccaagc

SEQ ID NO: 592295 - RNA, 22 nt, Human
ccacgacacuccagccugggca

SEQ ID NO: 592296 - RNA, 24 nt, Human
ccacgacacuccagccugggcaag

SEQ ID NO: 592297 - RNA, 24 nt, Human
ccacugcaaccuccaccucccagg

SEQ ID NO: 592298 - RNA, 26 nt, Human
ccacugcaaccuccaccucccaggcc

SEQ ID NO: 592299 - RNA, 19 nt, Human
ccagauccaggagugggga

SEQ ID NO: 592300 - RNA, 25 nt, Human
cccaaaaaaaaaaucugccucagac

SEQ ID NO: 592301 - RNA, 24 nt, Human
cccacugcaaccuccaccucccag

SEQ ID NO: 592302 - RNA, 26 nt, Human
ccccaucccaaaaaaaaaaucugccu

SEQ ID NO: 592303 - RNA, 19 nt, Human
cccgagcagcugggauuac

SEQ ID NO: 592304 - RNA, 24 nt, Human
cccgagcagcugggauuacaggug

SEQ ID NO: 592305 - RNA, 21 nt, Human
ccgagcagcugggauuacagg

SEQ ID NO: 592306 - RNA, 23 nt, Human
ccgagcagcugggauuacaggug

SEQ ID NO: 592307 - RNA, 23 nt, Human
ccgccgcacgcgcagccaacccu

SEQ ID NO: 592308 - RNA, 24 nt, Human
ccugccucagccucccgagcagcu

SEQ ID NO: 592309 - RNA, 22 nt, Human
ccuggccaacauggugaaaccc

SEQ ID NO: 592310 - RNA, 24 nt, Human
ccuggccaacauggugaaacccug

SEQ ID NO: 592311 - RNA, 20 nt, Human
ccuuaaaaccaagaaaaccc

SEQ ID NO: 592312 - RNA, 24 nt, Human
cgagaucacgccacgacacuccag

SEQ ID NO: 592313 - RNA, 24 nt, Human
cgagcagcugggauuacaggugcc

SEQ ID NO: 592314 - RNA, 24 nt, Human
cgaggcggguggaucacuugaggu

SEQ ID NO: 592315 - RNA, 24 nt, Human
cgggaggcggagguugcagugagc

SEQ ID NO: 592316 - RNA, 24 nt, Human
cggguggaucacuugaggucagga

SEQ ID NO: 592317 - RNA, 19 nt, Human
cuaauagauucuuccuauu

SEQ ID NO: 592318 - RNA, 20 nt, Human
cuagaaccaaggcugacagc

SEQ ID NO: 592319 - RNA, 22 nt, Human
cucacgccuauaaucccagcac

SEQ ID NO: 592320 - RNA, 24 nt, Human
cucacgccuauaaucccagcacuu

SEQ ID NO: 592321 - RNA, 24 nt, Human
cucacucugucacccaggcuggag

SEQ ID NO: 592322 - RNA, 18 nt, Human
cugcaaccuccaccuccc

SEQ ID NO: 592323 - RNA, 23 nt, Human
cugcaaccuccaccucccaggcc

SEQ ID NO: 592324 - RNA, 19 nt, Human
cugcuuaaaaaaggucauu

SEQ ID NO: 592325 - RNA, 19 nt, Human
cugcuuuuaaaaaaccucg

SEQ ID NO: 592326 - RNA, 24 nt, Human
cuggccaacauggugaaacccugu

SEQ ID NO: 592327 - RNA, 21 nt, Human
cuuaaaaccaagaaaacccaa

SEQ ID NO: 592328 - RNA, 22 nt, Human
gaagaaacaguccagauccagg

SEQ ID NO: 592329 - RNA, 22 nt, Human
gagaugccuuaaaaccaagaaa

SEQ ID NO: 592330 - RNA, 25 nt, Human
gaggcggguggaucacuugagguca

SEQ ID NO: 592331 - RNA, 22 nt, Human
gagguugcagugagccgagauc

SEQ ID NO: 592332 - RNA, 21 nt, Human
gaucacuugaggucaggaguu

SEQ ID NO: 592333 - RNA, 24 nt, Human
gaucacuugaggucaggaguuuga

SEQ ID NO: 592334 - RNA, 20 nt, Human
gcaaccuccaccucccaggc

SEQ ID NO: 592335 - RNA, 18 nt, Human
gcagcugggauuacaggu

SEQ ID NO: 592336 - RNA, 24 nt, Human
gccaacauggugaaacccugucuc

SEQ ID NO: 592337 - RNA, 22 nt, Human
gccacgacacuccagccugggc

SEQ ID NO: 592338 - RNA, 19 nt, Human
gcccaagcaauuauccugc

SEQ ID NO: 592339 - RNA, 24 nt, Human
gccugguuugcugcggcggggaaa

SEQ ID NO: 592340 - RNA, 19 nt, Human
gccuuaacaaauagccugc

SEQ ID NO: 592341 - RNA, 19 nt, Human
gcuggagugcaguggcaca

SEQ ID NO: 592342 - RNA, 18 nt, Human
ggagacaagacuauaaac

SEQ ID NO: 592343 - RNA, 18 nt, Human
ggagguugcagugagccg

SEQ ID NO: 592344 - RNA, 20 nt, Human
ggagguugcagugagccgag

SEQ ID NO: 592345 - RNA, 22 nt, Human
ggagguugcagugagccgagau

SEQ ID NO: 592346 - RNA, 23 nt, Human
ggagguugcagugagccgagauc

SEQ ID NO: 592347 - RNA, 24 nt, Human
ggagguugcagugagccgagauca

SEQ ID NO: 592348 - RNA, 22 nt, Human
ggcggggaaacagucacuuccu

SEQ ID NO: 592349 - RNA, 19 nt, Human
ggcggggugugguggcuca

SEQ ID NO: 592350 - RNA, 22 nt, Human
ggcggggugugguggcucacgg

SEQ ID NO: 592351 - RNA, 24 nt, Human
ggggaagcugaggcacgagaauca

SEQ ID NO: 592352 - RNA, 19 nt, Human
ggucaggaguuugagacca

SEQ ID NO: 592353 - RNA, 24 nt, Human
gguggcucacgccuauaaucccag

SEQ ID NO: 592354 - RNA, 23 nt, Human
ggugugguggcucacgccuauaa

SEQ ID NO: 592355 - RNA, 23 nt, Human
guggcucacgccuauaaucccag

SEQ ID NO: 592356 - RNA, 19 nt, Human
guugcagugagccgagauc

SEQ ID NO: 592357 - RNA, 19 nt, Human
uaaaaaaccucgacuguuu

SEQ ID NO: 592358 - RNA, 19 nt, Human
uaaacuagaaccaaggcug

SEQ ID NO: 592359 - RNA, 19 nt, Human
uaagcagaaacggaggaga

SEQ ID NO: 592360 - RNA, 21 nt, Human
uaccaaaaauacaaaaauuag

SEQ ID NO: 592361 - RNA, 22 nt, Human
uauaaacuagaaccaaggcuga

SEQ ID NO: 592362 - RNA, 23 nt, Human
uauaaacuagaaccaaggcugac

SEQ ID NO: 592363 - RNA, 22 nt, Human
ucacccaggcuggagugcagug

SEQ ID NO: 592364 - RNA, 24 nt, Human
ucacucugucacccaggcuggagu

SEQ ID NO: 592365 - RNA, 24 nt, Human
ucacuugaacccgggaggcggagg

SEQ ID NO: 592366 - RNA, 25 nt, Human
ucagcccacugcaaccuccaccucc

SEQ ID NO: 592367 - RNA, 24 nt, Human
ucagccuuaacaaauagccugcag

SEQ ID NO: 592368 - RNA, 23 nt, Human
ucaucugaugaucacucagucac

SEQ ID NO: 592369 - RNA, 20 nt, Human
uccaccuuccuucguaacca

SEQ ID NO: 592370 - RNA, 21 nt, Human
uccagccugggcaagagugag

SEQ ID NO: 592371 - RNA, 22 nt, Human
uccagccugggcaagagugaga

SEQ ID NO: 592372 - RNA, 22 nt, Human
ucccaaaaaaaaaaucugccuc

SEQ ID NO: 592373 - RNA, 23 nt, Human
ucccgagcagcugggauuacagg

SEQ ID NO: 592374 - RNA, 24 nt, Human
ucccgagcagcugggauuacaggu

SEQ ID NO: 592375 - RNA, 27 nt, Human
ucccuacuuugcugggggaaccuucua

SEQ ID NO: 592376 - RNA, 21 nt, Human
uccuuaacuaccucaagaauc

SEQ ID NO: 592377 - RNA, 20 nt, Human
ucggcgaggcagcaggcucc

SEQ ID NO: 592378 - RNA, 23 nt, Human
ucucacucugucacccaggcugg

SEQ ID NO: 592379 - RNA, 24 nt, Human
ucucacucugucacccaggcugga

SEQ ID NO: 592380 - RNA, 26 nt, Human
ucucacucugucacccaggcuggagu

SEQ ID NO: 592381 - RNA, 24 nt, Human
ucugucacccaggcuggagugcag

SEQ ID NO: 592382 - RNA, 28 nt, Human
ugacagcaacaggaagaaacaguccaga

SEQ ID NO: 592383 - RNA, 23 nt, Human
ugagaccagccuggccaacaugg

SEQ ID NO: 592384 - RNA, 24 nt, Human
ugagaccagccuggccaacauggu

SEQ ID NO: 592385 - RNA, 18 nt, Human
ugagaccccaucccaaaa

SEQ ID NO: 592386 - RNA, 19 nt, Human
ugagaggccgaggcgggug

SEQ ID NO: 592387 - RNA, 24 nt, Human
ugagaggccgaggcggguggauca

SEQ ID NO: 592388 - RNA, 19 nt, Human
ugagccgagaucacgccac

SEQ ID NO: 592389 - RNA, 20 nt, Human
ugaggcacgagaaucacuug

SEQ ID NO: 592390 - RNA, 24 nt, Human
ugaggcacgagaaucacuugaacc

SEQ ID NO: 592391 - RNA, 23 nt, Human
ugaggcggcaaacuaaaaggcca

SEQ ID NO: 592392 - RNA, 18 nt, Human
ugaggucaggaguuugag

SEQ ID NO: 592393 - RNA, 24 nt, Human
ugccucagccucccgagcagcugg

SEQ ID NO: 592394 - RNA, 25 nt, Human
ugccuuaaaaccaagaaaacccaaa

SEQ ID NO: 592395 - RNA, 23 nt, Human
ugcugcggcggggaaacagucac

SEQ ID NO: 592396 - RNA, 18 nt, Human
uggagugcaguggcacaa

SEQ ID NO: 592397 - RNA, 23 nt, Human
uggagugcaguggcacaauuuca

SEQ ID NO: 592398 - RNA, 24 nt, Human
uggagugcaguggcacaauuucag

SEQ ID NO: 592399 - RNA, 23 nt, Human
uggaucacuugaggucaggaguu

SEQ ID NO: 592400 - RNA, 24 nt, Human
uggaucacuugaggucaggaguuu

SEQ ID NO: 592401 - RNA, 26 nt, Human
uggaucacuugaggucaggaguuuga

SEQ ID NO: 592402 - RNA, 20 nt, Human
uggcacaauuucagcccacu

SEQ ID NO: 592403 - RNA, 24 nt, Human
uggcacaauuucagcccacugcaa

SEQ ID NO: 592404 - RNA, 24 nt, Human
uggccaacauggugaaacccuguc

SEQ ID NO: 592405 - RNA, 21 nt, Human
uggcucacgccuauaauccca

SEQ ID NO: 592406 - RNA, 22 nt, Human
uggcucacgccuauaaucccag

SEQ ID NO: 592407 - RNA, 24 nt, Human
uggcucacgccuauaaucccagca

SEQ ID NO: 592408 - RNA, 21 nt, Human
ugggauuacaggugcccacca

SEQ ID NO: 592409 - RNA, 24 nt, Human
ugggauuacaggugcccaccacca

SEQ ID NO: 592410 - RNA, 19 nt, Human
ugggcaagagugagacccc

SEQ ID NO: 592411 - RNA, 24 nt, Human
ugguggcucacgccuauaauccca

SEQ ID NO: 592412 - RNA, 18 nt, Human
uuaaaaccaagaaaaccc

SEQ ID NO: 592413 - RNA, 23 nt, Human
uuaaaaccaagaaaacccaaaag

SEQ ID NO: 592414 - RNA, 19 nt, Human
uuagaaauaucuaaaaauu

SEQ ID NO: 592415 - RNA, 18 nt, Human
uuagccgggcaugguggc

SEQ ID NO: 592416 - RNA, 24 nt, Human
uuccuauucacaaaccaaagauug

SEQ ID NO: 592417 - RNA, 22 nt, Human
uuccuggugcgcaaggcgccuc

SEQ ID NO: 592418 - RNA, 24 nt, Human
uucgagaugccuuaaaaccaagaa

SEQ ID NO: 592419 - RNA, 24 nt, Human
uugaacccgggaggcggagguugc

SEQ ID NO: 592420 - RNA, 18 nt, Human
uugcagugagccgagauc

SEQ ID NO: 592421 - RNA, 20 nt, Human
uugcagugagccgagaucac

SEQ ID NO: 592422 - RNA, 21 nt, Human
uugcagugagccgagaucacg

SEQ ID NO: 592423 - RNA, 19 nt, Human
uuucugguuuuaauccuua

SEQ ID NO: 592424 - RNA, 23 nt, Human
uuuuuuuuuuuugagauggcguc

SEQ ID NO: 592425 - RNA, 26 nt, Human
uuuuuuuuuuuugagauggcgucuca

SEQ ID NO: 592426 - RNA, 18 nt, Human
uuuuuuuuuuuuuuuuug

SEQ ID NO: 592427 - RNA, 19 nt, Human
aaaugccucuugagcagcc

SEQ ID NO: 592428 - RNA, 22 nt, Human
aaccgcuucuccucaaguucca

SEQ ID NO: 592429 - RNA, 26 nt, Human
aacuccacaguuuuccaucucgacac

SEQ ID NO: 592430 - RNA, 22 nt, Human
aagcauuuuuauuguacaucca

SEQ ID NO: 592431 - RNA, 22 nt, Human
aagcugaggacugaucaagcau

SEQ ID NO: 592432 - RNA, 19 nt, Human
aaggcaggauguaaacucu

SEQ ID NO: 592433 - RNA, 20 nt, Human
aagugaccugcaccauaaaa

SEQ ID NO: 592434 - RNA, 23 nt, Human
acaacagagagggcuaauaugaa

SEQ ID NO: 592435 - RNA, 19 nt, Human
acccaagugaccugcacca

SEQ ID NO: 592436 - RNA, 24 nt, Human
acccaagugaccugcaccauaaaa

SEQ ID NO: 592437 - RNA, 21 nt, Human
agacccaagugaccugcacca

SEQ ID NO: 592438 - RNA, 20 nt, Human
agaggacagaaggcaggaug

SEQ ID NO: 592439 - RNA, 22 nt, Human
agaggaccagauuuagcccugu

SEQ ID NO: 592440 - RNA, 21 nt, Human
agauuugaaagccacaaugcc

SEQ ID NO: 592441 - RNA, 26 nt, Human
agccaaggguggccaguucugccgcc

SEQ ID NO: 592442 - RNA, 27 nt, Human
agccaaggguggccaguucugcuccgc

SEQ ID NO: 592443 - RNA, 20 nt, Human
agcccuguucuuuccaucca

SEQ ID NO: 592444 - RNA, 21 nt, Human
agccugaaagaauauagagcu

SEQ ID NO: 592445 - RNA, 22 nt, Human
aggaagaucugacucagaacca

SEQ ID NO: 592446 - RNA, 21 nt, Human
aucucuuuuagcugcaaucaa

SEQ ID NO: 592447 - RNA, 20 nt, Human
auuuccuuccccuccccacc

SEQ ID NO: 592448 - RNA, 19 nt, Human
caacucucugcaaacagca

SEQ ID NO: 592449 - RNA, 24 nt, Human
caaucaaaaugcagcggccaaaac

SEQ ID NO: 592450 - RNA, 18 nt, Human
caccaaggaagaucugac

SEQ ID NO: 592451 - RNA, 22 nt, Human
caccagcaugcauucuuuccag

SEQ ID NO: 592452 - RNA, 21 nt, Human
cagagagggcuaauaugaagc

SEQ ID NO: 592453 - RNA, 21 nt, Human
cagcacucaagaggcagcagg

SEQ ID NO: 592454 - RNA, 19 nt, Human
cagccugaaagaauauaga

SEQ ID NO: 592455 - RNA, 23 nt, Human
cauccuucuuucaaugcuagagg

SEQ ID NO: 592456 - RNA, 18 nt, Human
caucucgacaccagagga

SEQ ID NO: 592457 - RNA, 20 nt, Human
ccacaaugcccauuuucuag

SEQ ID NO: 592458 - RNA, 18 nt, Human
ccagccugcauucagugu

SEQ ID NO: 592459 - RNA, 19 nt, Human
ccaucagucauguuaaaau

SEQ ID NO: 592460 - RNA, 18 nt, Human
ccugaagacccaagugac

SEQ ID NO: 592461 - RNA, 18 nt, Human
ccugccuccuccacgucc

SEQ ID NO: 592462 - RNA, 23 nt, Human
ccuguggaucuagucaccccaga

SEQ ID NO: 592463 - RNA, 22 nt, Human
ccuugauuuggagaauagaaau

SEQ ID NO: 592464 - RNA, 22 nt, Human
cucaagaggcagcagggccacc

SEQ ID NO: 592465 - RNA, 23 nt, Human
cucagccugaaagaauauagagc

SEQ ID NO: 592466 - RNA, 24 nt, Human
cugcaaagcugaggacugaucaag

SEQ ID NO: 592467 - RNA, 24 nt, Human
cuuucaccagguagacauccuucu

SEQ ID NO: 592468 - RNA, 19 nt, Human
gaagaaucucagccugaaa

SEQ ID NO: 592469 - RNA, 20 nt, Human
gaccacagugcuauaucugg

SEQ ID NO: 592470 - RNA, 18 nt, Human
gaggauaaauacagggcu

SEQ ID NO: 592471 - RNA, 19 nt, Human
gauaacuauuuccuucccc

SEQ ID NO: 592472 - RNA, 21 nt, Human
gcaacucucugcaaacagcag

SEQ ID NO: 592473 - RNA, 19 nt, Human
gcauucagugugaacccau

SEQ ID NO: 592474 - RNA, 18 nt, Human
gcccugccugccuccucc

SEQ ID NO: 592475 - RNA, 18 nt, Human
gccugaaagaauauagag

SEQ ID NO: 592476 - RNA, 20 nt, Human
gcucugggugccuggcccug

SEQ ID NO: 592477 - RNA, 20 nt, Human
ggacccugaagacccaagug

SEQ ID NO: 592478 - RNA, 18 nt, Human
ggcacggcucugggugcc

SEQ ID NO: 592479 - RNA, 18 nt, Human
ggccaaaacauauaaaga

SEQ ID NO: 592480 - RNA, 21 nt, Human
ggccagagagaaauauccugu

SEQ ID NO: 592481 - RNA, 21 nt, Human
gugaaaaauguagauuaauga

SEQ ID NO: 592482 - RNA, 24 nt, Human
uaaagaaauaaaguggagaccaca

SEQ ID NO: 592483 - RNA, 25 nt, Human
uagaaauuaauccagcuacacuagc

SEQ ID NO: 592484 - RNA, 22 nt, Human
uagacauccuucuuucaaugcu

SEQ ID NO: 592485 - RNA, 23 nt, Human
uagaggacagugaaaaauguaga

SEQ ID NO: 592486 - RNA, 23 nt, Human
ucaccagguagacauccuucuuu

SEQ ID NO: 592487 - RNA, 30 nt, Human
ucagagccucuucaacuccacaguuuuccu

SEQ ID NO: 592488 - RNA, 19 nt, Human
ucagucauguuaaaauaua

SEQ ID NO: 592489 - RNA, 21 nt, Human
uccagcuacacuagcugaaug

SEQ ID NO: 592490 - RNA, 22 nt, Human
uccccaccuccaacugcaucuc

SEQ ID NO: 592491 - RNA, 23 nt, Human
ucucugcaaacagcagcaggagu

SEQ ID NO: 592492 - RNA, 24 nt, Human
ucucuggaagagucaaccagcuuu

SEQ ID NO: 592493 - RNA, 19 nt, Human
ucugaaaugccucuugagc

SEQ ID NO: 592494 - RNA, 22 nt, Human
ucugaaaugccucuugagcagc

SEQ ID NO: 592495 - RNA, 22 nt, Human
ucuguuaucucuuuuagcugca

SEQ ID NO: 592496 - RNA, 20 nt, Human
ugaaaaauguagauuaauga

SEQ ID NO: 592497 - RNA, 22 nt, Human
ugaaagccacaaugcccauuuu

SEQ ID NO: 592498 - RNA, 18 nt, Human
ugaaaugccucuugagca

SEQ ID NO: 592499 - RNA, 19 nt, Human
ugaauggaaauauuccuua

SEQ ID NO: 592500 - RNA, 19 nt, Human
ugagcagccaaggguggcc

SEQ ID NO: 592501 - RNA, 21 nt, Human
ugagcagccaaggguggccag

SEQ ID NO: 592502 - RNA, 24 nt, Human
ugauaacuauuuccuuccccuccc

SEQ ID NO: 592503 - RNA, 19 nt, Human
ugcugaacacaugcccucg

SEQ ID NO: 592504 - RNA, 20 nt, Human
ugggugccuggcccugccug

SEQ ID NO: 592505 - RNA, 22 nt, Human
uuaacuagcaaauagccauguu

SEQ ID NO: 592506 - RNA, 19 nt, Human
uuagcugcaaucaaaaugc

SEQ ID NO: 592507 - RNA, 22 nt, Human
uucaacuccacaguuuuccauc

SEQ ID NO: 592508 - RNA, 18 nt, Human
uuccuguggaucuaguca

SEQ ID NO: 592509 - RNA, 20 nt, Human
uugauuguccuuucugggca

SEQ ID NO: 592510 - RNA, 20 nt, Human
uuggccucaucaagguguug

SEQ ID NO: 592511 - RNA, 25 nt, Human
uuuuccaucucgacaccagaggacc

SEQ ID NO: 592512 - RNA, 19 nt, Human
uuuugguuccuguggaucu

SEQ ID NO: 592513 - RNA, 19 nt, Human
aaccuccauucuucaucuc

SEQ ID NO: 592514 - RNA, 22 nt, Human
aagaaggcuuuucuuucuggcc

SEQ ID NO: 592515 - RNA, 21 nt, Human
aggaaaaggaacaauaaacac

SEQ ID NO: 592516 - RNA, 19 nt, Human
aguccuggccuagugaaaa

SEQ ID NO: 592517 - RNA, 23 nt, Human
caaccuccauucuucaucucuca

SEQ ID NO: 592518 - RNA, 18 nt, Human
caacuucuaaguuucucu

SEQ ID NO: 592519 - RNA, 19 nt, Human
caauguaguccuggccuag

SEQ ID NO: 592520 - RNA, 22 nt, Human
caauguaguccuggccuaguga

SEQ ID NO: 592521 - RNA, 22 nt, Human
ccagagacugcuuccuuuguag

SEQ ID NO: 592522 - RNA, 23 nt, Human
ccagauaccaaucagggaaugac

SEQ ID NO: 592523 - RNA, 18 nt, Human
ccccauggcccuugcugc

SEQ ID NO: 592524 - RNA, 20 nt, Human
ccccauggcccuugcugcuu

SEQ ID NO: 592525 - RNA, 18 nt, Human
ccucccaguccaggaugu

SEQ ID NO: 592526 - RNA, 24 nt, Human
cuagugaaaaagaaggcuuuucuu

SEQ ID NO: 592527 - RNA, 18 nt, Human
cuggccuccagagacugc

SEQ ID NO: 592528 - RNA, 21 nt, Human
cuugagaacaugugggauuug

SEQ ID NO: 592529 - RNA, 18 nt, Human
gaacaugugggauuuguc

SEQ ID NO: 592530 - RNA, 25 nt, Human
gacuggccaggacuggaacuuaacg

SEQ ID NO: 592531 - RNA, 18 nt, Human
gauuugucuuugagcccc

SEQ ID NO: 592532 - RNA, 20 nt, Human
gccuccagagacugcuuccu

SEQ ID NO: 592533 - RNA, 18 nt, Human
gugguugcaggcugcuug

SEQ ID NO: 592534 - RNA, 21 nt, Human
ucccugagacaguugcuccug

SEQ ID NO: 592535 - RNA, 22 nt, Human
ucucucaauguaguccuggccu

SEQ ID NO: 592536 - RNA, 21 nt, Human
ucugccuccaccucccagucc

SEQ ID NO: 592537 - RNA, 20 nt, Human
ucuuugagccccauuggcuu

SEQ ID NO: 592538 - RNA, 21 nt, Human
ugagaacaugugggauuuguc

SEQ ID NO: 592539 - RNA, 20 nt, Human
ugccuccaccucccaguccg

SEQ ID NO: 592540 - RNA, 22 nt, Human
ugcuuccuuuguaggaaaagga

SEQ ID NO: 592541 - RNA, 21 nt, Human
uggccaggacuggaacuuaac

SEQ ID NO: 592542 - RNA, 20 nt, Human
uggcuugugauguuuuccuc

SEQ ID NO: 592543 - RNA, 25 nt, Human
uguaggaaaaggaacaauaaacacu

SEQ ID NO: 592544 - RNA, 20 nt, Human
ugucugaggugguugcaggc

SEQ ID NO: 592545 - RNA, 22 nt, Human
aacccuuccggggcuuccgcca

SEQ ID NO: 592546 - RNA, 21 nt, Human
accggcaccugucccagcgcg

SEQ ID NO: 592547 - RNA, 24 nt, Human
agccggacucaacccuuccggggc

SEQ ID NO: 592548 - RNA, 18 nt, Human
agcguccccuuccgggug

SEQ ID NO: 592549 - RNA, 19 nt, Human
agcguccccuuccggguga

SEQ ID NO: 592550 - RNA, 19 nt, Human
aucccccucggccgccgcc

SEQ ID NO: 592551 - RNA, 22 nt, Human
caccccgcuccggugucgggag

SEQ ID NO: 592552 - RNA, 18 nt, Human
cagcacaggagcuggcgg

SEQ ID NO: 592553 - RNA, 21 nt, Human
ccccucggccgccgccgccgc

SEQ ID NO: 592554 - RNA, 20 nt, Human
cccgcucgugcucgcggccg

SEQ ID NO: 592555 - RNA, 21 nt, Human
cccggccccagccacgcucgc

SEQ ID NO: 592556 - RNA, 19 nt, Human
ccgccgccgccgccgcaca

SEQ ID NO: 592557 - RNA, 18 nt, Human
ccgccgccgccgccgccg

SEQ ID NO: 592558 - RNA, 23 nt, Human
ccgcuggacgagcgcucucuccg

SEQ ID NO: 592559 - RNA, 19 nt, Human
ccggugucgggaguggugg

SEQ ID NO: 592560 - RNA, 21 nt, Human
cgccguggccgggguggugcu

SEQ ID NO: 592561 - RNA, 24 nt, Human
cgcgaucauccccuuugcguccug

SEQ ID NO: 592562 - RNA, 18 nt, Human
cggagccggacucaaccc

SEQ ID NO: 592563 - RNA, 18 nt, Human
cgggagugguggugacug

SEQ ID NO: 592564 - RNA, 24 nt, Human
cgguggcccucagucuugcuccug

SEQ ID NO: 592565 - RNA, 21 nt, Human
cucccgggccggcucgcagcc

SEQ ID NO: 592566 - RNA, 19 nt, Human
cuccggggcguggcggucc

SEQ ID NO: 592567 - RNA, 21 nt, Human
cucgccggggcuaggcucagc

SEQ ID NO: 592568 - RNA, 20 nt, Human
cugcgcgggggcugcugggg

SEQ ID NO: 592569 - RNA, 19 nt, Human
cugcucucucuggcgggcu

SEQ ID NO: 592570 - RNA, 26 nt, Human
cugucacuguucuccacacugucgug

SEQ ID NO: 592571 - RNA, 22 nt, Human
gccccuacggccccgguugugg

SEQ ID NO: 592572 - RNA, 23 nt, Human
gccguggaagggcuuccaguccc

SEQ ID NO: 592573 - RNA, 23 nt, Human
gcguggggcgcgccugcgcgggg

SEQ ID NO: 592574 - RNA, 24 nt, Human
gcugagccugucgccguggccggg

SEQ ID NO: 592575 - RNA, 21 nt, Human
ggccgggguggugcuccgggg

SEQ ID NO: 592576 - RNA, 23 nt, Human
gggcaggugcggcgccgccggug

SEQ ID NO: 592577 - RNA, 23 nt, Human
ggggugcggggcgagggcguggg

SEQ ID NO: 592578 - RNA, 21 nt, Human
gggugaacaaggaguggcugc

SEQ ID NO: 592579 - RNA, 21 nt, Human
guccuggcggucgcgcucccg

SEQ ID NO: 592580 - RNA, 21 nt, Human
gugcaguucugucgugggaga

SEQ ID NO: 592581 - RNA, 21 nt, Human
gugcggggcgagggcgugggg

SEQ ID NO: 592582 - RNA, 19 nt, Human
gugcucgcggccgccgugg

SEQ ID NO: 592583 - RNA, 24 nt, Human
uccaccccgcuccggugucgggag

SEQ ID NO: 592584 - RNA, 18 nt, Human
uccaucccccucggccgc

SEQ ID NO: 592585 - RNA, 28 nt, Human
ucccccucggccgccgccgccgccgccg

SEQ ID NO: 592586 - RNA, 20 nt, Human
ucccggccccagccacgcuc

SEQ ID NO: 592587 - RNA, 22 nt, Human
ucccgggccggcucgcagcccc

SEQ ID NO: 592588 - RNA, 19 nt, Human
uccuugugcggccgcucgu

SEQ ID NO: 592589 - RNA, 21 nt, Human
ucgcagccccuacggccccgg

SEQ ID NO: 592590 - RNA, 20 nt, Human
ucgcccucgguguaguggug

SEQ ID NO: 592591 - RNA, 22 nt, Human
ucgcuccaucccccucggccgc

SEQ ID NO: 592592 - RNA, 19 nt, Human
ucgggagugguggugacug

SEQ ID NO: 592593 - RNA, 22 nt, Human
ugacccggcucggcgcucgcuc

SEQ ID NO: 592594 - RNA, 18 nt, Human
ugcaccugcccagagagc

SEQ ID NO: 592595 - RNA, 21 nt, Human
uggcgguccuggcggucgcgc

SEQ ID NO: 592596 - RNA, 20 nt, Human
ugggagaagcggucggggug

SEQ ID NO: 592597 - RNA, 22 nt, Human
uggggugaacaaggaguggcug

SEQ ID NO: 592598 - RNA, 18 nt, Human
ugguaguaccggcaccug

SEQ ID NO: 592599 - RNA, 24 nt, Human
ugucgugggagaagcggucggggu

SEQ ID NO: 592600 - RNA, 22 nt, Human
uugcuuuaggcucuucuagagg

SEQ ID NO: 592601 - RNA, 25 nt, Human
aaaccagccagcaauccucccagac

SEQ ID NO: 592602 - RNA, 23 nt, Human
aacaaacagagcaggaagccaga

SEQ ID NO: 592603 - RNA, 26 nt, Human
aacagagcaggaagccagagaucuau

SEQ ID NO: 592604 - RNA, 19 nt, Human
aaccugcccagggcagaug

SEQ ID NO: 592605 - RNA, 19 nt, Human
aacuccucuuccuugcccc

SEQ ID NO: 592606 - RNA, 21 nt, Human
aacuccucuuccuugccccuc

SEQ ID NO: 592607 - RNA, 24 nt, Human
aagacauggaauccaggagaaagg

SEQ ID NO: 592608 - RNA, 19 nt, Human
aagggacaacagaagccug

SEQ ID NO: 592609 - RNA, 20 nt, Human
aaguggcuguuauaggcagg

SEQ ID NO: 592610 - RNA, 19 nt, Human
acagagcaggaagccagag

SEQ ID NO: 592611 - RNA, 22 nt, Human
acaucuggaaagugagaagcca

SEQ ID NO: 592612 - RNA, 20 nt, Human
accagauccccacaucugga

SEQ ID NO: 592613 - RNA, 21 nt, Human
acccugucuguagcaccugga

SEQ ID NO: 592614 - RNA, 26 nt, Human
acugaaauuuaccagauccccacauc

SEQ ID NO: 592615 - RNA, 20 nt, Human
agaaaacaacuggaggacau

SEQ ID NO: 592616 - RNA, 27 nt, Human
agacaagagauggaaagaagggacccc

SEQ ID NO: 592617 - RNA, 19 nt, Human
agacagcauagagcuuugc

SEQ ID NO: 592618 - RNA, 18 nt, Human
agacugaaagaggcagug

SEQ ID NO: 592619 - RNA, 23 nt, Human
agagaggauagacagcauagagc

SEQ ID NO: 592620 - RNA, 19 nt, Human
agaugagcagcaagaccua

SEQ ID NO: 592621 - RNA, 24 nt, Human
agaugagcagcaagaccuagaugg

SEQ ID NO: 592622 - RNA, 21 nt, Human
agcaaagcaacuuuauuccuu

SEQ ID NO: 592623 - RNA, 22 nt, Human
agcuguaggccuguggacugcc

SEQ ID NO: 592624 - RNA, 18 nt, Human
aggccccagugaacuucu

SEQ ID NO: 592625 - RNA, 22 nt, Human
agggacuguguagcauagggcc

SEQ ID NO: 592626 - RNA, 20 nt, Human
agggcccgccucccggugcu

SEQ ID NO: 592627 - RNA, 20 nt, Human
agugaggggugcaacugaag

SEQ ID NO: 592628 - RNA, 28 nt, Human
auacuggaaucuuccugcaaccggaggg

SEQ ID NO: 592629 - RNA, 25 nt, Human
auccaugugccucccaccccccuuc

SEQ ID NO: 592630 - RNA, 19 nt, Human
augggaacagaguccaggu

SEQ ID NO: 592631 - RNA, 19 nt, Human
auucaauucccuucugcaa

SEQ ID NO: 592632 - RNA, 21 nt, Human
caaccagaacaaacagagcag

SEQ ID NO: 592633 - RNA, 23 nt, Human
caacuccucuuccuugccccucc

SEQ ID NO: 592634 - RNA, 22 nt, Human
caacuuggaucauugggcuaaa

SEQ ID NO: 592635 - RNA, 23 nt, Human
caacuuggaucauugggcuaaag

SEQ ID NO: 592636 - RNA, 22 nt, Human
caccccccuucaguuuucuacu

SEQ ID NO: 592637 - RNA, 22 nt, Human
cacccugagcugcucuggcagg

SEQ ID NO: 592638 - RNA, 23 nt, Human
cacccugagcugcucuggcaggg

SEQ ID NO: 592639 - RNA, 18 nt, Human
caccuggauaaagccuuc

SEQ ID NO: 592640 - RNA, 18 nt, Human
cacgcagggcccgccucc

SEQ ID NO: 592641 - RNA, 23 nt, Human
cagcaauccucccagacgguauc

SEQ ID NO: 592642 - RNA, 21 nt, Human
cagcauagagcuuugccagga

SEQ ID NO: 592643 - RNA, 27 nt, Human
caggaaaccagccagcaauccucccag

SEQ ID NO: 592644 - RNA, 20 nt, Human
caguuguugcuugcgggcuu

SEQ ID NO: 592645 - RNA, 18 nt, Human
cauggcugcagcugcucc

SEQ ID NO: 592646 - RNA, 28 nt, Human
caugugccucccaccccccuucaguuuu

SEQ ID NO: 592647 - RNA, 19 nt, Human
ccaaggcucaggaaccugc

SEQ ID NO: 592648 - RNA, 21 nt, Human
ccagaccagguaugaccacug

SEQ ID NO: 592649 - RNA, 19 nt, Human
ccagccagcaauccuccca

SEQ ID NO: 592650 - RNA, 22 nt, Human
ccaggagaaagggacuugcaca

SEQ ID NO: 592651 - RNA, 24 nt, Human
ccagggcaaccagaacaaacagag

SEQ ID NO: 592652 - RNA, 20 nt, Human
ccaugugccucccacccccc

SEQ ID NO: 592653 - RNA, 18 nt, Human
ccccaaggcucaggaacc

SEQ ID NO: 592654 - RNA, 18 nt, Human
ccccacgcagggcccgcc

SEQ ID NO: 592655 - RNA, 20 nt, Human
cccccucugcugucggcucc

SEQ ID NO: 592656 - RNA, 19 nt, Human
ccccucugcugucggcucc

SEQ ID NO: 592657 - RNA, 18 nt, Human
cccucugcugucggcucc

SEQ ID NO: 592658 - RNA, 21 nt, Human
ccgccgcugcucccugacugc

SEQ ID NO: 592659 - RNA, 23 nt, Human
ccgccgcugcucccugacugccc

SEQ ID NO: 592660 - RNA, 18 nt, Human
ccugcugggcucacucca

SEQ ID NO: 592661 - RNA, 22 nt, Human
ccugguguuuccgcaacagccu

SEQ ID NO: 592662 - RNA, 23 nt, Human
ccuugcaacuuucacuuucccug

SEQ ID NO: 592663 - RNA, 23 nt, Human
cgccaggaaguggcuguuauagg

SEQ ID NO: 592664 - RNA, 23 nt, Human
cucacccaucaugauucuccagg

SEQ ID NO: 592665 - RNA, 24 nt, Human
cucagagccuugaaaugggccccu

SEQ ID NO: 592666 - RNA, 18 nt, Human
cucaggaaccugcccagg

SEQ ID NO: 592667 - RNA, 19 nt, Human
cucucagucuugaaaccca

SEQ ID NO: 592668 - RNA, 22 nt, Human
cucuucccuuucuuggugucug

SEQ ID NO: 592669 - RNA, 20 nt, Human
cugcagcugagggacccuga

SEQ ID NO: 592670 - RNA, 23 nt, Human
cugcugggcucacuccauucggu

SEQ ID NO: 592671 - RNA, 19 nt, Human
cuggagcaggucccauggc

SEQ ID NO: 592672 - RNA, 21 nt, Human
cuggagcaggucccauggcug

SEQ ID NO: 592673 - RNA, 19 nt, Human
cuggucccccaaggcucag

SEQ ID NO: 592674 - RNA, 25 nt, Human
cuuguccugcugggucauuuaaaaa

SEQ ID NO: 592675 - RNA, 20 nt, Human
gaaguggcuguuauaggcag

SEQ ID NO: 592676 - RNA, 24 nt, Human
gaaucugauugguuauuaacccug

SEQ ID NO: 592677 - RNA, 19 nt, Human
gaccgccaggaaguggcug

SEQ ID NO: 592678 - RNA, 18 nt, Human
gacuguguagcauagggc

SEQ ID NO: 592679 - RNA, 18 nt, Human
gagagaagagaggauaga

SEQ ID NO: 592680 - RNA, 18 nt, Human
gagaugagcagcaagacc

SEQ ID NO: 592681 - RNA, 24 nt, Human
gcagcugcuccacccugagcugcu

SEQ ID NO: 592682 - RNA, 20 nt, Human
gcauauuagcauucccagaa

SEQ ID NO: 592683 - RNA, 20 nt, Human
gcuuuccaagugguuuucca

SEQ ID NO: 592684 - RNA, 24 nt, Human
ggaacgcucaucucggccaucccc

SEQ ID NO: 592685 - RNA, 24 nt, Human
ggagacaucuauucaauucccuuc

SEQ ID NO: 592686 - RNA, 23 nt, Human
ggaggaagucccggggcaugggc

SEQ ID NO: 592687 - RNA, 22 nt, Human
ggaggugaacaaggugaaaugc

SEQ ID NO: 592688 - RNA, 24 nt, Human
ggaguuaaaagcaacaacagcuuu

SEQ ID NO: 592689 - RNA, 18 nt, Human
ggcagauggagucucacc

SEQ ID NO: 592690 - RNA, 24 nt, Human
ggcaggcucuccuggaugcuugcu

SEQ ID NO: 592691 - RNA, 22 nt, Human
ggcagggucuauacagagugaa

SEQ ID NO: 592692 - RNA, 19 nt, Human
ggccaacuccucuuccuug

SEQ ID NO: 592693 - RNA, 22 nt, Human
gggaaaagugacugucuggaaa

SEQ ID NO: 592694 - RNA, 24 nt, Human
gggacucgggggaccucucuugcc

SEQ ID NO: 592695 - RNA, 20 nt, Human
gggcaaccagaacaaacaga

SEQ ID NO: 592696 - RNA, 21 nt, Human
guggacugccagguaggagga

SEQ ID NO: 592697 - RNA, 18 nt, Human
guguggguucgcugccuc

SEQ ID NO: 592698 - RNA, 21 nt, Human
uaaaagcaacaacagcuuuau

SEQ ID NO: 592699 - RNA, 19 nt, Human
uaaacaccagaugugcgug

SEQ ID NO: 592700 - RNA, 23 nt, Human
uaagaaacauucaagacauggaa

SEQ ID NO: 592701 - RNA, 18 nt, Human
uaaguggcacaaugaccg

SEQ ID NO: 592702 - RNA, 24 nt, Human
uacaaccaagaaaagagggaagca

SEQ ID NO: 592703 - RNA, 18 nt, Human
uaggcagggguuugcaag

SEQ ID NO: 592704 - RNA, 23 nt, Human
uagggccuugccuggagcagguc

SEQ ID NO: 592705 - RNA, 21 nt, Human
uauacuggaaucuuccugcaa

SEQ ID NO: 592706 - RNA, 22 nt, Human
uaucucaggacaacacucccag

SEQ ID NO: 592707 - RNA, 24 nt, Human
ucaguugaugaugauggauuugag

SEQ ID NO: 592708 - RNA, 22 nt, Human
ucccaccccccuucaguuuucu

SEQ ID NO: 592709 - RNA, 20 nt, Human
ucccaguacauucucuaguu

SEQ ID NO: 592710 - RNA, 18 nt, Human
ucccauggacucaccaag

SEQ ID NO: 592711 - RNA, 19 nt, Human
uccccuggaagggcgggua

SEQ ID NO: 592712 - RNA, 22 nt, Human
ucccggugcucuccgcaggcgg

SEQ ID NO: 592713 - RNA, 18 nt, Human
ucccugugggaacgcuca

SEQ ID NO: 592714 - RNA, 19 nt, Human
ucccuguuuucccacaugu

SEQ ID NO: 592715 - RNA, 25 nt, Human
uccgcaggcggcgcccgcccggccc

SEQ ID NO: 592716 - RNA, 23 nt, Human
uccuaaguggcacaaugaccgcc

SEQ ID NO: 592717 - RNA, 18 nt, Human
uccucacccccagggacu

SEQ ID NO: 592718 - RNA, 22 nt, Human
uccucuggaauccucaccccca

SEQ ID NO: 592719 - RNA, 23 nt, Human
uccuggaugcuugcuggggcgug

SEQ ID NO: 592720 - RNA, 24 nt, Human
ucuccaggugaccaccugcugccu

SEQ ID NO: 592721 - RNA, 24 nt, Human
ucuuguaggccccagugaacuucu

SEQ ID NO: 592722 - RNA, 18 nt, Human
ugaaaugcuguaacacug

SEQ ID NO: 592723 - RNA, 23 nt, Human
ugaaauuuaccagauccccacau

SEQ ID NO: 592724 - RNA, 18 nt, Human
ugacaauacuugucucag

SEQ ID NO: 592725 - RNA, 20 nt, Human
ugagaugagcagcaagaccc

SEQ ID NO: 592726 - RNA, 21 nt, Human
ugaggggugcaacugaagguc

SEQ ID NO: 592727 - RNA, 18 nt, Human
ugaggguggaggaagucc

SEQ ID NO: 592728 - RNA, 23 nt, Human
ugccaagcaguuugccccgcucu

SEQ ID NO: 592729 - RNA, 24 nt, Human
ugcccugcugggcucacuccauuc

SEQ ID NO: 592730 - RNA, 18 nt, Human
ugccucccaccccccuuc

SEQ ID NO: 592731 - RNA, 20 nt, Human
ugcgcgcggccccacgcagg

SEQ ID NO: 592732 - RNA, 22 nt, Human
ugcugauggggcugcacaagug

SEQ ID NO: 592733 - RNA, 19 nt, Human
uggaaucuuccugcaagga

SEQ ID NO: 592734 - RNA, 18 nt, Human
uggaggacauccucugcc

SEQ ID NO: 592735 - RNA, 19 nt, Human
uggaguuaaaagcaacaac

SEQ ID NO: 592736 - RNA, 21 nt, Human
uggcagcagugggaaaaccuc

SEQ ID NO: 592737 - RNA, 25 nt, Human
uggcagcagugggaaaaccucagag

SEQ ID NO: 592738 - RNA, 25 nt, Human
uggcagcaucccgcggaugaucagu

SEQ ID NO: 592739 - RNA, 22 nt, Human
uggccaaggccauccggagacu

SEQ ID NO: 592740 - RNA, 20 nt, Human
uggcugcagcugcuccaccc

SEQ ID NO: 592741 - RNA, 20 nt, Human
ugggaaaagugacugucugg

SEQ ID NO: 592742 - RNA, 22 nt, Human
ugggaaaagugacugucuggaa

SEQ ID NO: 592743 - RNA, 19 nt, Human
ugggcugagcagcaggcuu

SEQ ID NO: 592744 - RNA, 26 nt, Human
ugucucugccgccgcugcucccugac

SEQ ID NO: 592745 - RNA, 20 nt, Human
ugucuggaaagcugggguug

SEQ ID NO: 592746 - RNA, 22 nt, Human
ugucuggaaagcugggguugcu

SEQ ID NO: 592747 - RNA, 24 nt, Human
uguuauaggcagggguuugcaagc

SEQ ID NO: 592748 - RNA, 22 nt, Human
uucacuugcauauuagcauucc

SEQ ID NO: 592749 - RNA, 18 nt, Human
uucccugccccuucugug

SEQ ID NO: 592750 - RNA, 21 nt, Human
uuccuuguggcagcaucccgc

SEQ ID NO: 592751 - RNA, 21 nt, Human
uuucagcuucccccucugcug

SEQ ID NO: 592752 - RNA, 21 nt, Human
uuuccagggcaaccagaacaa

SEQ ID NO: 592753 - RNA, 18 nt, Human
uuucucaggaaaccagcc

SEQ ID NO: 592754 - RNA, 20 nt, Human
uuugugcgucuuuucagcuu

SEQ ID NO: 592755 - RNA, 22 nt, Human
aaacaggaacaaagcaaaagua

SEQ ID NO: 592756 - RNA, 19 nt, Human
aacaaagcaaaaguagaca

SEQ ID NO: 592757 - RNA, 25 nt, Human
aagaaacccaugaacaucuguggac

SEQ ID NO: 592758 - RNA, 22 nt, Human
aagaacagacgaaagaauaggc

SEQ ID NO: 592759 - RNA, 20 nt, Human
aagcccagagggaaagaagc

SEQ ID NO: 592760 - RNA, 25 nt, Human
aagcuccuuucuucaccacucuccu

SEQ ID NO: 592761 - RNA, 23 nt, Human
aagcuggaggccaccucuuaggg

SEQ ID NO: 592762 - RNA, 21 nt, Human
aagguccucacagaagggaaa

SEQ ID NO: 592763 - RNA, 22 nt, Human
aaguccagcguucuggaacuag

SEQ ID NO: 592764 - RNA, 27 nt, Human
aaguggucgugaggacuuguuuagagc

SEQ ID NO: 592765 - RNA, 22 nt, Human
aauaacuuuucaggaaaaaaaa

SEQ ID NO: 592766 - RNA, 20 nt, Human
aaugagagaacacaaagaaa

SEQ ID NO: 592767 - RNA, 24 nt, Human
acacuagaagagaugagaaacagg

SEQ ID NO: 592768 - RNA, 21 nt, Human
acccugaaguacagucucaau

SEQ ID NO: 592769 - RNA, 20 nt, Human
acugauggauaaaaguuuca

SEQ ID NO: 592770 - RNA, 24 nt, Human
agaaacagguggucaucagccuuc

SEQ ID NO: 592771 - RNA, 23 nt, Human
agaaacccaugaacaucugugga

SEQ ID NO: 592772 - RNA, 18 nt, Human
agaagcuggaggccaccu

SEQ ID NO: 592773 - RNA, 21 nt, Human
agcaucaacccugaaguacag

SEQ ID NO: 592774 - RNA, 21 nt, Human
aggaaaaagggaagagcagaa

SEQ ID NO: 592775 - RNA, 22 nt, Human
aggaacaaagcaaaaguagaca

SEQ ID NO: 592776 - RNA, 28 nt, Human
aggaauaauggcaacgugaccgguaccc

SEQ ID NO: 592777 - RNA, 23 nt, Human
aggcaggaaaaagggaagagcag

SEQ ID NO: 592778 - RNA, 30 nt, Human
agugcccacuccucacgccaccaaauggcc

SEQ ID NO: 592779 - RNA, 21 nt, Human
aucgaauuggggauucugacu

SEQ ID NO: 592780 - RNA, 22 nt, Human
augcaaguggaggcggcaacuc

SEQ ID NO: 592781 - RNA, 18 nt, Human
auggaaaaugaugcagug

SEQ ID NO: 592782 - RNA, 22 nt, Human
caaagcaaaaguagacaggaac

SEQ ID NO: 592783 - RNA, 22 nt, Human
caagcuccuuucuucaccacuc

SEQ ID NO: 592784 - RNA, 23 nt, Human
caagcuccuuucuucaccacucc

SEQ ID NO: 592785 - RNA, 23 nt, Human
caaugagcaccccauccuugaag

SEQ ID NO: 592786 - RNA, 18 nt, Human
cacaaagaaacccaugaa

SEQ ID NO: 592787 - RNA, 19 nt, Human
cagaagggaaacaggaaca

SEQ ID NO: 592788 - RNA, 20 nt, Human
cagagggaaagaagcguucc

SEQ ID NO: 592789 - RNA, 22 nt, Human
cagcaucaacccugaaguacag

SEQ ID NO: 592790 - RNA, 23 nt, Human
cagcugugagcccagggccaccu

SEQ ID NO: 592791 - RNA, 25 nt, Human
cagcuuugaaaaaaugagagaacac

SEQ ID NO: 592792 - RNA, 26 nt, Human
cauauauauacauacacacacauugg

SEQ ID NO: 592793 - RNA, 28 nt, Human
cauuuuugucuucuguaucagucaggaa

SEQ ID NO: 592794 - RNA, 21 nt, Human
ccacaaugagcaccccauccc

SEQ ID NO: 592795 - RNA, 24 nt, Human
ccaccaaauggccagcaucaaccc

SEQ ID NO: 592796 - RNA, 18 nt, Human
ccagagguguaaggggag

SEQ ID NO: 592797 - RNA, 20 nt, Human
ccaggcaggaaaaagggaag

SEQ ID NO: 592798 - RNA, 21 nt, Human
ccaggcaggaaaaagggaaga

SEQ ID NO: 592799 - RNA, 22 nt, Human
ccaggcaggaaaaagggaagag

SEQ ID NO: 592800 - RNA, 23 nt, Human
cccacuccucacgccaccaaaug

SEQ ID NO: 592801 - RNA, 24 nt, Human
cccagcuuugaaaaaaugagagaa

SEQ ID NO: 592802 - RNA, 21 nt, Human
cccucuuuccccuuccaaugc

SEQ ID NO: 592803 - RNA, 21 nt, Human
ccucugaguuuuaaagaacuc

SEQ ID NO: 592804 - RNA, 24 nt, Human
cguggcauaggaggaagacggcug

SEQ ID NO: 592805 - RNA, 20 nt, Human
cguuccaggcaggaaaaagg

SEQ ID NO: 592806 - RNA, 24 nt, Human
cugcaaggggugggggauggaaaa

SEQ ID NO: 592807 - RNA, 18 nt, Human
cuucagagagcugaaguc

SEQ ID NO: 592808 - RNA, 18 nt, Human
gaaaaaaugagagaacac

SEQ ID NO: 592809 - RNA, 22 nt, Human
gaagguaaaaguggugcuccuc

SEQ ID NO: 592810 - RNA, 23 nt, Human
gagaacacaaagaaacccaugaa

SEQ ID NO: 592811 - RNA, 22 nt, Human
gagcagaagguaaaaguggugc

SEQ ID NO: 592812 - RNA, 18 nt, Human
gaggaaaugaccaagccc

SEQ ID NO: 592813 - RNA, 19 nt, Human
gaggacgaagguggcaggg

SEQ ID NO: 592814 - RNA, 19 nt, Human
gcagcucuacaacauccuu

SEQ ID NO: 592815 - RNA, 18 nt, Human
gcccacuccucacgccac

SEQ ID NO: 592816 - RNA, 18 nt, Human
gcugcaguucuggugaga

SEQ ID NO: 592817 - RNA, 28 nt, Human
ggggagccuaggaccuacucugaaauac

SEQ ID NO: 592818 - RNA, 26 nt, Human
gucaucagccuucagagagcugaagu

SEQ ID NO: 592819 - RNA, 22 nt, Human
guucacguaacaguagugcacc

SEQ ID NO: 592820 - RNA, 18 nt, Human
guucccucuuuccccuuc

SEQ ID NO: 592821 - RNA, 21 nt, Human
uaaugcaaaagcauauauaua

SEQ ID NO: 592822 - RNA, 19 nt, Human
uacaacauccuugcagaac

SEQ ID NO: 592823 - RNA, 18 nt, Human
uacagcuucagaaacagg

SEQ ID NO: 592824 - RNA, 21 nt, Human
uaccauaggaauaauggcaac

SEQ ID NO: 592825 - RNA, 19 nt, Human
uaccguacagcuucagaaa

SEQ ID NO: 592826 - RNA, 23 nt, Human
uacuucauaaagaugagaaaacu

SEQ ID NO: 592827 - RNA, 19 nt, Human
uagaaaagccacaaugagc

SEQ ID NO: 592828 - RNA, 21 nt, Human
uagaaaagccacaaugagcac

SEQ ID NO: 592829 - RNA, 22 nt, Human
uagaaaagccacaaugagcacc

SEQ ID NO: 592830 - RNA, 23 nt, Human
uagaaaagccacaaugagcaccc

SEQ ID NO: 592831 - RNA, 24 nt, Human
uaguuagugcuucugucucauggg

SEQ ID NO: 592832 - RNA, 22 nt, Human
uauauacauacacacacauugu

SEQ ID NO: 592833 - RNA, 25 nt, Human
uauauauacauacacacacauuggc

SEQ ID NO: 592834 - RNA, 20 nt, Human
uaugagaagacacuuguguu

SEQ ID NO: 592835 - RNA, 21 nt, Human
ucagaacugcuagcagagaca

SEQ ID NO: 592836 - RNA, 24 nt, Human
ucagccuucagagagcugaagucu

SEQ ID NO: 592837 - RNA, 19 nt, Human
ucaggagucugugaugcca

SEQ ID NO: 592838 - RNA, 25 nt, Human
ucaugggccacauuuuacugcaagg

SEQ ID NO: 592839 - RNA, 23 nt, Human
uccucacagaagggaaacaggaa

SEQ ID NO: 592840 - RNA, 23 nt, Human
ucucaauguuggugcuugccaag

SEQ ID NO: 592841 - RNA, 20 nt, Human
ucucuucccuucucacacag

SEQ ID NO: 592842 - RNA, 21 nt, Human
ucugggaggaaacauaagaca

SEQ ID NO: 592843 - RNA, 22 nt, Human
ugaaaaaaugagagaacacaaa

SEQ ID NO: 592844 - RNA, 26 nt, Human
ugaaaaaaugagagaacacaaagaaa

SEQ ID NO: 592845 - RNA, 25 nt, Human
ugacauacacuagaagagaugagaa

SEQ ID NO: 592846 - RNA, 19 nt, Human
ugagagaggcugcagaggu

SEQ ID NO: 592847 - RNA, 21 nt, Human
ugagagaggcugcagagguca

SEQ ID NO: 592848 - RNA, 19 nt, Human
ugaggacgaagguggcagg

SEQ ID NO: 592849 - RNA, 20 nt, Human
ugaggaggggaagguccuca

SEQ ID NO: 592850 - RNA, 22 nt, Human
ugauguuggucccaacacccag

SEQ ID NO: 592851 - RNA, 20 nt, Human
ugcccacuccucacgccacc

SEQ ID NO: 592852 - RNA, 24 nt, Human
ugcggaaucaaaauuggcagauga

SEQ ID NO: 592853 - RNA, 20 nt, Human
ugcuugggaggaaaugacca

SEQ ID NO: 592854 - RNA, 18 nt, Human
uggcagaugagagaggcu

SEQ ID NO: 592855 - RNA, 19 nt, Human
uggcuuaaacaaauuaggu

SEQ ID NO: 592856 - RNA, 24 nt, Human
ugggccacauuuuacugcaagggg

SEQ ID NO: 592857 - RNA, 18 nt, Human
uggugagagcacguggca

SEQ ID NO: 592858 - RNA, 20 nt, Human
uuaucuguguauuuacuccc

SEQ ID NO: 592859 - RNA, 18 nt, Human
uucacaguguuucuaaca

SEQ ID NO: 592860 - RNA, 21 nt, Human
uucacaguguuucuaacaauc

SEQ ID NO: 592861 - RNA, 23 nt, Human
uucacaguguuucuaacaaucag

SEQ ID NO: 592862 - RNA, 19 nt, Human
uucccucguucuauggauc

SEQ ID NO: 592863 - RNA, 25 nt, Human
uucccucuuuccccuuccaaugcuu

SEQ ID NO: 592864 - RNA, 18 nt, Human
uugcugcaguucugguga

SEQ ID NO: 592865 - RNA, 22 nt, Human
uuggccuggagaagcaaguuuc

SEQ ID NO: 592866 - RNA, 19 nt, Human
aaaaacccaguucagucac

SEQ ID NO: 592867 - RNA, 24 nt, Human
aaaacccaguucagucacagaaaa

SEQ ID NO: 592868 - RNA, 21 nt, Human
aaaaggaggcaaauauuggua

SEQ ID NO: 592869 - RNA, 20 nt, Human
aagcuaggaugacucuacgg

SEQ ID NO: 592870 - RNA, 18 nt, Human
aagugugaaaauaaaacc

SEQ ID NO: 592871 - RNA, 25 nt, Human
acagagcaagaauccaagugugaaa

SEQ ID NO: 592872 - RNA, 18 nt, Human
agcucucccaaagaagag

SEQ ID NO: 592873 - RNA, 18 nt, Human
aggaagagauaaagggga

SEQ ID NO: 592874 - RNA, 18 nt, Human
aggaagccauggaucuac

SEQ ID NO: 592875 - RNA, 18 nt, Human
aggaggucuugggaaaca

SEQ ID NO: 592876 - RNA, 23 nt, Human
aggcaggagaggaggaaaugagg

SEQ ID NO: 592877 - RNA, 21 nt, Human
aggggcccaaucuagaaauca

SEQ ID NO: 592878 - RNA, 19 nt, Human
aggggucugugcagucugg

SEQ ID NO: 592879 - RNA, 21 nt, Human
auuaggagucuaggcauguca

SEQ ID NO: 592880 - RNA, 26 nt, Human
cacugcugcaucugagccgggugucc

SEQ ID NO: 592881 - RNA, 20 nt, Human
cagccuccgccgccgcugga

SEQ ID NO: 592882 - RNA, 19 nt, Human
cagcucucccaaagaagag

SEQ ID NO: 592883 - RNA, 22 nt, Human
caggacagcgccagccuccgcc

SEQ ID NO: 592884 - RNA, 25 nt, Human
cagguggagagaaucauucucauga

SEQ ID NO: 592885 - RNA, 21 nt, Human
cagucacuuuucucagaccaa

SEQ ID NO: 592886 - RNA, 20 nt, Human
ccagucccaagcguacucca

SEQ ID NO: 592887 - RNA, 22 nt, Human
ccauaccucuuccuuucuggag

SEQ ID NO: 592888 - RNA, 24 nt, Human
cccauaccucuuccuuucuggagc

SEQ ID NO: 592889 - RNA, 20 nt, Human
ccccagucccaagcguacuc

SEQ ID NO: 592890 - RNA, 20 nt, Human
ccgcacagagcccucccucu

SEQ ID NO: 592891 - RNA, 21 nt, Human
ccuggaucauaauuagcugag

SEQ ID NO: 592892 - RNA, 20 nt, Human
ccuuggacagaagaucaguc

SEQ ID NO: 592893 - RNA, 24 nt, Human
cgcacagagcccucccucucagga

SEQ ID NO: 592894 - RNA, 22 nt, Human
cucacucgcagccccaguccca

SEQ ID NO: 592895 - RNA, 23 nt, Human
cucgcagccccagucccaagcgu

SEQ ID NO: 592896 - RNA, 23 nt, Human
cucuccagcacugcugcaucuga

SEQ ID NO: 592897 - RNA, 18 nt, Human
gaaaaggaggcaaauauu

SEQ ID NO: 592898 - RNA, 19 nt, Human
gaauccaagugugaaaaua

SEQ ID NO: 592899 - RNA, 22 nt, Human
gccccagucccaagcguacucc

SEQ ID NO: 592900 - RNA, 19 nt, Human
gccuccgccgccgcuggac

SEQ ID NO: 592901 - RNA, 21 nt, Human
ggaggucuugggaaacacugg

SEQ ID NO: 592902 - RNA, 20 nt, Human
ggccguguguggcauaaugu

SEQ ID NO: 592903 - RNA, 20 nt, Human
uaggcaugucagaaaaaccc

SEQ ID NO: 592904 - RNA, 20 nt, Human
ucagaccaagugagaucuua

SEQ ID NO: 592905 - RNA, 20 nt, Human
uccaagugugaaaauaaaac

SEQ ID NO: 592906 - RNA, 22 nt, Human
ucccaaagaagagcucucucug

SEQ ID NO: 592907 - RNA, 19 nt, Human
ucccuggcagaguuaaaug

SEQ ID NO: 592908 - RNA, 24 nt, Human
ucuccagcacugcugcaucugagc

SEQ ID NO: 592909 - RNA, 23 nt, Human
ugaaaauaaaaccuccaucuaaa

SEQ ID NO: 592910 - RNA, 24 nt, Human
ugaaaauaaaaccuccaucuaaau

SEQ ID NO: 592911 - RNA, 25 nt, Human
ugaaccaaauguccgcuuccgaacc

SEQ ID NO: 592912 - RNA, 21 nt, Human
ugaaggcaccaaggaagaaau

SEQ ID NO: 592913 - RNA, 20 nt, Human
ugacucccauaccucuuccu

SEQ ID NO: 592914 - RNA, 21 nt, Human
ugacucccauaccucuuccuu

SEQ ID NO: 592915 - RNA, 24 nt, Human
ugacucuuccgcacagagcccucc

SEQ ID NO: 592916 - RNA, 23 nt, Human
ugcagucuggugugagugcaucu

SEQ ID NO: 592917 - RNA, 19 nt, Human
uggugugagugcaucucca

SEQ ID NO: 592918 - RNA, 21 nt, Human
ugucagaaaaacccaguucag

SEQ ID NO: 592919 - RNA, 25 nt, Human
uguccagcgccaaguccuggaucau

SEQ ID NO: 592920 - RNA, 23 nt, Human
ugucucaucacccaagcaagguc

SEQ ID NO: 592921 - RNA, 18 nt, Human
ugugaaaauaaaaccucc

SEQ ID NO: 592922 - RNA, 19 nt, Human
ugugaaaauaaaaccucca

SEQ ID NO: 592923 - RNA, 19 nt, Human
uguguggcauaauguggag

SEQ ID NO: 592924 - RNA, 20 nt, Human
uuaaaugcucguucugaacc

SEQ ID NO: 592925 - RNA, 24 nt, Human
uuccgcacagagcccucccucuca

SEQ ID NO: 592926 - RNA, 21 nt, Human
uuuuuuuuuuuuuuuugaagg

SEQ ID NO: 592927 - RNA, 18 nt, Human
uuuuuuuuuuuuuuuuug

SEQ ID NO: 592928 - RNA, 21 nt, Human
aaaagacagcuccgcacuucc

SEQ ID NO: 592929 - RNA, 22 nt, Human
aacaucucuguaacaacagcca

SEQ ID NO: 592930 - RNA, 25 nt, Human
acuuucaacaauaacaauggucuga

SEQ ID NO: 592931 - RNA, 22 nt, Human
agagaacauguuuauuuacauc

SEQ ID NO: 592932 - RNA, 20 nt, Human
agcuccgcacuuccaaucuu

SEQ ID NO: 592933 - RNA, 18 nt, Human
auucuuucaugucguacu

SEQ ID NO: 592934 - RNA, 22 nt, Human
caagcugaaccuauuugacacu

SEQ ID NO: 592935 - RNA, 20 nt, Human
cacaauauaaccagaaggcc

SEQ ID NO: 592936 - RNA, 22 nt, Human
caucacuauuuccuuuuuacaa

SEQ ID NO: 592937 - RNA, 23 nt, Human
caucaugcucaaaagacagcucc

SEQ ID NO: 592938 - RNA, 23 nt, Human
caugcaaaucacuuacuuuucau

SEQ ID NO: 592939 - RNA, 18 nt, Human
ccggucuggccagcucug

SEQ ID NO: 592940 - RNA, 22 nt, Human
ccuaugauuuuuauuuacauga

SEQ ID NO: 592941 - RNA, 19 nt, Human
cguacugagauuucagaua

SEQ ID NO: 592942 - RNA, 20 nt, Human
cucccuauguuguuguguau

SEQ ID NO: 592943 - RNA, 20 nt, Human
cucuguaacaacagccaagg

SEQ ID NO: 592944 - RNA, 22 nt, Human
cugacauucuuucaugucguac

SEQ ID NO: 592945 - RNA, 19 nt, Human
cuggaaguuuuccguauca

SEQ ID NO: 592946 - RNA, 25 nt, Human
cuggaaguuuuccguaucagucaua

SEQ ID NO: 592947 - RNA, 22 nt, Human
cuggugcaucugcucucuuugu

SEQ ID NO: 592948 - RNA, 19 nt, Human
gacccugcaucuuuuccaa

SEQ ID NO: 592949 - RNA, 19 nt, Human
gacuuucaacaauaacaau

SEQ ID NO: 592950 - RNA, 21 nt, Human
gagaaacuauaagacagauuu

SEQ ID NO: 592951 - RNA, 20 nt, Human
uaaaaaauagaaaagguuaa

SEQ ID NO: 592952 - RNA, 21 nt, Human
uaagacagauuuuccuaauau

SEQ ID NO: 592953 - RNA, 23 nt, Human
uacaucacuauuuccuuuuuaca

SEQ ID NO: 592954 - RNA, 21 nt, Human
uagagaaacuauaagacagau

SEQ ID NO: 592955 - RNA, 19 nt, Human
uauaaucaaauccuugcac

SEQ ID NO: 592956 - RNA, 18 nt, Human
uauguuguuguguaugug

SEQ ID NO: 592957 - RNA, 18 nt, Human
ucaaaagacagcuccgca

SEQ ID NO: 592958 - RNA, 28 nt, Human
ucaaaagacagcuccgcaccaccuaggu

SEQ ID NO: 592959 - RNA, 19 nt, Human
ucccuauguuguuguguau

SEQ ID NO: 592960 - RNA, 22 nt, Human
uccuuuuuacaaugccuccacc

SEQ ID NO: 592961 - RNA, 24 nt, Human
ucucuguaacaacagccaagggcc

SEQ ID NO: 592962 - RNA, 18 nt, Human
ucugaaagagacacaugg

SEQ ID NO: 592963 - RNA, 24 nt, Human
ugaauaauaaaauuuuccaggaaa

SEQ ID NO: 592964 - RNA, 22 nt, Human
ugaguuccucugaauaguuggu

SEQ ID NO: 592965 - RNA, 19 nt, Human
ugcucaaaagacagcuccg

SEQ ID NO: 592966 - RNA, 24 nt, Human
uggaucuuuuccgaugaggauuuu

SEQ ID NO: 592967 - RNA, 21 nt, Human
uggcagcaagcugaaccuauu

SEQ ID NO: 592968 - RNA, 18 nt, Human
uuaccauucaucaaauga

SEQ ID NO: 592969 - RNA, 24 nt, Human
uuggaucuuuuccgaugaggauuu

SEQ ID NO: 592970 - RNA, 23 nt, Human
uuuuggcagcaagcugaaccuau

SEQ ID NO: 592971 - RNA, 21 nt, Human
uuuuuuuugaaagagaacaug

SEQ ID NO: 592972 - RNA, 19 nt, Human
uuuuuuuuuuugaaagaga

SEQ ID NO: 592973 - RNA, 27 nt, Human
uuuuuuuuuuuugaaagagaacauguu

SEQ ID NO: 592974 - RNA, 18 nt, Human
uuuuuuuuuuuuuuuuug

SEQ ID NO: 592975 - RNA, 18 nt, Human
aaaaaggcaguucuguuu

SEQ ID NO: 592976 - RNA, 22 nt, Human
aaaacaaaaaaaccccccagaa

SEQ ID NO: 592977 - RNA, 24 nt, Human
aaacaaaaaaaccccccagaaaca

SEQ ID NO: 592978 - RNA, 25 nt, Human
aaacaaaaaaaccccccagaaacaa

SEQ ID NO: 592979 - RNA, 19 nt, Human
aaaccccccagaaacaaca

SEQ ID NO: 592980 - RNA, 22 nt, Human
aaaggacuccaaagccaggaca

SEQ ID NO: 592981 - RNA, 21 nt, Human
aaauagcuuuaaauagauucu

SEQ ID NO: 592982 - RNA, 23 nt, Human
aacaaaaaaaccccccagaaaca

SEQ ID NO: 592983 - RNA, 22 nt, Human
aacaaaaaaauaucagugagaa

SEQ ID NO: 592984 - RNA, 21 nt, Human
aacaaaacaaaaaaacccccc

SEQ ID NO: 592985 - RNA, 26 nt, Human
aacaaaacaaaaaaaccccccagaaa

SEQ ID NO: 592986 - RNA, 30 nt, Human
aacaaaacaaaaaaaccccccagaaacaag

SEQ ID NO: 592987 - RNA, 23 nt, Human
aacaaggaauacauuggacaaaa

SEQ ID NO: 592988 - RNA, 19 nt, Human
aaccuccucuucccugccc

SEQ ID NO: 592989 - RNA, 22 nt, Human
aagccaggacaaccaaagggga

SEQ ID NO: 592990 - RNA, 24 nt, Human
aagugaccagaagaguuagugaac

SEQ ID NO: 592991 - RNA, 24 nt, Human
aaucacuuggacccgggaggcaga

SEQ ID NO: 592992 - RNA, 24 nt, Human
acaaaacaaaaaaaccccccagaa

SEQ ID NO: 592993 - RNA, 25 nt, Human
acaaaacaaaaaaaccccccagaaa

SEQ ID NO: 592994 - RNA, 18 nt, Human
acaaaaccauagaagacu

SEQ ID NO: 592995 - RNA, 22 nt, Human
acaacaaaaaaauaucagugag

SEQ ID NO: 592996 - RNA, 18 nt, Human
acacaccacucagagucc

SEQ ID NO: 592997 - RNA, 19 nt, Human
acaccacucagaguccacc

SEQ ID NO: 592998 - RNA, 24 nt, Human
accaacauggagauacccugucuc

SEQ ID NO: 592999 - RNA, 23 nt, Human
accauagaagacuacaacuuguu

SEQ ID NO: 593000 - RNA, 18 nt, Human
acccacagggggccaggu

SEQ ID NO: 593001 - RNA, 19 nt, Human
acccuggagcucucauagc

SEQ ID NO: 593002 - RNA, 24 nt, Human
acccugucucuaccaaaaauacaa

SEQ ID NO: 593003 - RNA, 22 nt, Human
accuuguugguaaacacccaaa

SEQ ID NO: 593004 - RNA, 26 nt, Human
agaaaaaggcaguucuguuuaaagaa

SEQ ID NO: 593005 - RNA, 18 nt, Human
agacagggaaggagcuga

SEQ ID NO: 593006 - RNA, 18 nt, Human
agaccaacacaauagaaa

SEQ ID NO: 593007 - RNA, 24 nt, Human
agagguugcagugaggugagaucg

SEQ ID NO: 593008 - RNA, 24 nt, Human
agcacuuugggaggccgagguggg

SEQ ID NO: 593009 - RNA, 22 nt, Human
agcagcugcuacuccuggcccc

SEQ ID NO: 593010 - RNA, 23 nt, Human
agcugggugugguggcgcaugcc

SEQ ID NO: 593011 - RNA, 22 nt, Human
aggaagaaaauaugcacucaaa

SEQ ID NO: 593012 - RNA, 19 nt, Human
aggagcugagaguuaaagc

SEQ ID NO: 593013 - RNA, 19 nt, Human
aggcagagguugcagugag

SEQ ID NO: 593014 - RNA, 24 nt, Human
aggcagagguugcagugaggugag

SEQ ID NO: 593015 - RNA, 18 nt, Human
aggcaggagaaucacuug

SEQ ID NO: 593016 - RNA, 24 nt, Human
aggcaggagaaucacuuggacccg

SEQ ID NO: 593017 - RNA, 24 nt, Human
aggcaugguggcucacgccuguaa

SEQ ID NO: 593018 - RNA, 21 nt, Human
aggccgaggugggcggaucac

SEQ ID NO: 593019 - RNA, 24 nt, Human
aggcugaggcaggagaaucacuug

SEQ ID NO: 593020 - RNA, 18 nt, Human
agggauugggggcagggg

SEQ ID NO: 593021 - RNA, 23 nt, Human
agggggccaggucucaaguuucc

SEQ ID NO: 593022 - RNA, 22 nt, Human
aggugggcggaucaccugaggu

SEQ ID NO: 593023 - RNA, 19 nt, Human
aggugguuuuccagccagg

SEQ ID NO: 593024 - RNA, 24 nt, Human
aucaccugccuaagggcgugggcu

SEQ ID NO: 593025 - RNA, 24 nt, Human
aucgcgccauugcacuccagccug

SEQ ID NO: 593026 - RNA, 21 nt, Human
auguuuugaucauuugauguu

SEQ ID NO: 593027 - RNA, 21 nt, Human
auuagcaaauaaauauucuga

SEQ ID NO: 593028 - RNA, 21 nt, Human
auugcacuccagccuggguga

SEQ ID NO: 593029 - RNA, 25 nt, Human
auugcacuccagccugggugacaag

SEQ ID NO: 593030 - RNA, 19 nt, Human
caaaaauacaaaauuagcu

SEQ ID NO: 593031 - RNA, 22 nt, Human
caaaacaaaaaaaccccccaga

SEQ ID NO: 593032 - RNA, 25 nt, Human
caaaacaaaaaaaccccccagaaac

SEQ ID NO: 593033 - RNA, 23 nt, Human
caaaaccauagaagacuacaacu

SEQ ID NO: 593034 - RNA, 19 nt, Human
caaaggacuccaaagccag

SEQ ID NO: 593035 - RNA, 21 nt, Human
caaaggacuccaaagccagga

SEQ ID NO: 593036 - RNA, 24 nt, Human
caaaggacuccaaagccaggacaa

SEQ ID NO: 593037 - RNA, 24 nt, Human
caaaggcauuaaaaacaaaacaaa

SEQ ID NO: 593038 - RNA, 21 nt, Human
caaauauguaaaaucugugug

SEQ ID NO: 593039 - RNA, 23 nt, Human
caacacaauagaaagaguuuaca

SEQ ID NO: 593040 - RNA, 24 nt, Human
caacauggagauacccugucucua

SEQ ID NO: 593041 - RNA, 19 nt, Human
caacugccacaccccaacu

SEQ ID NO: 593042 - RNA, 23 nt, Human
caagugaaaacuagacacacuua

SEQ ID NO: 593043 - RNA, 23 nt, Human
caauuuguuacaaaaccauagaa

SEQ ID NO: 593044 - RNA, 21 nt, Human
caccagugaagccucaguggc

SEQ ID NO: 593045 - RNA, 24 nt, Human
cacgccuguaaucccagcacuuug

SEQ ID NO: 593046 - RNA, 20 nt, Human
cacuacacaccacucagagu

SEQ ID NO: 593047 - RNA, 20 nt, Human
cacuccagccugggugacaa

SEQ ID NO: 593048 - RNA, 24 nt, Human
cacuccagccugggugacaagagc

SEQ ID NO: 593049 - RNA, 21 nt, Human
cagcacuuugggaggccgagg

SEQ ID NO: 593050 - RNA, 24 nt, Human
cagcacuuugggaggccgaggugg

SEQ ID NO: 593051 - RNA, 24 nt, Human
cagcuacuugggaggcugaggcag

SEQ ID NO: 593052 - RNA, 19 nt, Human
cagugggacagaaggggcu

SEQ ID NO: 593053 - RNA, 24 nt, Human
caugccuguaaucccagcuacuug

SEQ ID NO: 593054 - RNA, 19 nt, Human
caugucaccagcuuaggcg

SEQ ID NO: 593055 - RNA, 19 nt, Human
cauugcacuccagccuggg

SEQ ID NO: 593056 - RNA, 21 nt, Human
cauugcacuccagccugggug

SEQ ID NO: 593057 - RNA, 22 nt, Human
cauugcacuccagccuggguga

SEQ ID NO: 593058 - RNA, 24 nt, Human
cauugcacuccagccugggugaca

SEQ ID NO: 593059 - RNA, 25 nt, Human
cauugcacuccagccugggugacaa

SEQ ID NO: 593060 - RNA, 24 nt, Human
ccaguucuuucagauggcaacaaa

SEQ ID NO: 593061 - RNA, 20 nt, Human
ccauugcacuccagccuggg

SEQ ID NO: 593062 - RNA, 21 nt, Human
ccauugcacuccagccugggu

SEQ ID NO: 593063 - RNA, 21 nt, Human
ccauugcacuccagccugggu

SEQ ID NO: 593064 - RNA, 22 nt, Human
ccauugcacuccagccugggug

SEQ ID NO: 593065 - RNA, 24 nt, Human
ccauugcacuccagccugggugac

SEQ ID NO: 593066 - RNA, 21 nt, Human
cccacacaccccgucgagcca

SEQ ID NO: 593067 - RNA, 25 nt, Human
cccacacaccccgucgagccauuuc

SEQ ID NO: 593068 - RNA, 24 nt, Human
cccagaaacaacaacaaaaaaaua

SEQ ID NO: 593069 - RNA, 20 nt, Human
ccccaagaacaugcccuuac

SEQ ID NO: 593070 - RNA, 20 nt, Human
ccccacacaccccgucgagc

SEQ ID NO: 593071 - RNA, 25 nt, Human
ccccccagaaacaacaacaaaaaaa

SEQ ID NO: 593072 - RNA, 22 nt, Human
cccugcccaacugccacacccc

SEQ ID NO: 593073 - RNA, 26 nt, Human
ccuaaaaccacgcaaugcaagcugcu

SEQ ID NO: 593074 - RNA, 22 nt, Human
ccugaccaacauggagauaccc

SEQ ID NO: 593075 - RNA, 22 nt, Human
ccugaggucgggaauccaagac

SEQ ID NO: 593076 - RNA, 22 nt, Human
ccuguaaucccagcacuuuggg

SEQ ID NO: 593077 - RNA, 18 nt, Human
ccuguaaucccagcuacu

SEQ ID NO: 593078 - RNA, 21 nt, Human
ccuguaaucccagcuacuugg

SEQ ID NO: 593079 - RNA, 19 nt, Human
cgacuaguaauuauuuuuu

SEQ ID NO: 593080 - RNA, 21 nt, Human
cgaggugggcggaucaccuga

SEQ ID NO: 593081 - RNA, 24 nt, Human
cgaggugggcggaucaccugaggu

SEQ ID NO: 593082 - RNA, 26 nt, Human
cgccauugcacuccagccugggugac

SEQ ID NO: 593083 - RNA, 23 nt, Human
cgccuguaaucccagcacuuugg

SEQ ID NO: 593084 - RNA, 23 nt, Human
cggaucaccugaggucgggaauc

SEQ ID NO: 593085 - RNA, 24 nt, Human
cggaucaccugaggucgggaaucc

SEQ ID NO: 593086 - RNA, 26 nt, Human
cuagcuagagauaaguaaauuuccuc

SEQ ID NO: 593087 - RNA, 23 nt, Human
cucaagcgagcuuucagacccac

SEQ ID NO: 593088 - RNA, 22 nt, Human
cucacgccuguaaucccagcac

SEQ ID NO: 593089 - RNA, 24 nt, Human
cucacgccuguaaucccagcacuu

SEQ ID NO: 593090 - RNA, 23 nt, Human
cuuaagauaaauauauuagcaaa

SEQ ID NO: 593091 - RNA, 18 nt, Human
cuuggauuaggaggagac

SEQ ID NO: 593092 - RNA, 23 nt, Human
gaauuuaaaagacaaugguuggu

SEQ ID NO: 593093 - RNA, 22 nt, Human
gacccugcuucccuaaaaccac

SEQ ID NO: 593094 - RNA, 23 nt, Human
gagaaucacuuggacccgggagg

SEQ ID NO: 593095 - RNA, 23 nt, Human
gagaucgcgccauugcacuccag

SEQ ID NO: 593096 - RNA, 23 nt, Human
gaggugggcggaucaccugaggu

SEQ ID NO: 593097 - RNA, 18 nt, Human
gaucaccugaggucggga

SEQ ID NO: 593098 - RNA, 24 nt, Human
gaucaccugaggucgggaauccaa

SEQ ID NO: 593099 - RNA, 27 nt, Human
gcauuaaaaacaaaacaaaaaaacccc

SEQ ID NO: 593100 - RNA, 19 nt, Human
gccauugcacuccagccug

SEQ ID NO: 593101 - RNA, 24 nt, Human
gccauugcacuccagccuggguga

SEQ ID NO: 593102 - RNA, 20 nt, Human
gccuguaaucccagcuacuu

SEQ ID NO: 593103 - RNA, 20 nt, Human
gcuaaagaaagccacuuugg

SEQ ID NO: 593104 - RNA, 24 nt, Human
gcugggcaggcaugguggcucacg

SEQ ID NO: 593105 - RNA, 23 nt, Human
gcuuucagacccacugggccagu

SEQ ID NO: 593106 - RNA, 22 nt, Human
ggaucaccugaggucgggaauc

SEQ ID NO: 593107 - RNA, 18 nt, Human
ggauuaggaggagacagg

SEQ ID NO: 593108 - RNA, 23 nt, Human
ggauuaggaggagacagggaagg

SEQ ID NO: 593109 - RNA, 19 nt, Human
ggcaaauguuuugaucauu

SEQ ID NO: 593110 - RNA, 22 nt, Human
ggcauggcgucugagaccugaa

SEQ ID NO: 593111 - RNA, 21 nt, Human
ggcgcaugccuguaaucccag

SEQ ID NO: 593112 - RNA, 18 nt, Human
ggcgucugagaccugaaa

SEQ ID NO: 593113 - RNA, 21 nt, Human
ggcucacgccuguaaucccag

SEQ ID NO: 593114 - RNA, 20 nt, Human
gggaggccgaggugggcgga

SEQ ID NO: 593115 - RNA, 22 nt, Human
gggcugggucacuugacccugc

SEQ ID NO: 593116 - RNA, 20 nt, Human
gggcuguggaucauguacac

SEQ ID NO: 593117 - RNA, 24 nt, Human
gguggcgcaugccuguaaucccag

SEQ ID NO: 593118 - RNA, 24 nt, Human
gguggcucacgccuguaaucccag

SEQ ID NO: 593119 - RNA, 23 nt, Human
ggugugguggcgcaugccuguaa

SEQ ID NO: 593120 - RNA, 19 nt, Human
guccuuguucuccuaccca

SEQ ID NO: 593121 - RNA, 18 nt, Human
gucgagccauuucugcag

SEQ ID NO: 593122 - RNA, 20 nt, Human
gucgggaauccaagaccagc

SEQ ID NO: 593123 - RNA, 21 nt, Human
guggcaaauguuuugaucauu

SEQ ID NO: 593124 - RNA, 18 nt, Human
gugugguggcgcaugccu

SEQ ID NO: 593125 - RNA, 24 nt, Human
uaaaauagugccuuguuagaccaa

SEQ ID NO: 593126 - RNA, 19 nt, Human
uaaagaguagaaaaaggca

SEQ ID NO: 593127 - RNA, 20 nt, Human
uaaagccagcuuacuggggc

SEQ ID NO: 593128 - RNA, 19 nt, Human
uaagaaaaacauucugaua

SEQ ID NO: 593129 - RNA, 23 nt, Human
uaagagugagauucucguucaag

SEQ ID NO: 593130 - RNA, 20 nt, Human
uaagguuuuaaaauugcauu

SEQ ID NO: 593131 - RNA, 20 nt, Human
uaccaaaaauacaaaauuag

SEQ ID NO: 593132 - RNA, 23 nt, Human
uagaccucauuuuaaaagcauua

SEQ ID NO: 593133 - RNA, 23 nt, Human
uagcaaauaaauauucugagaac

SEQ ID NO: 593134 - RNA, 20 nt, Human
uaggaggagacagggaagga

SEQ ID NO: 593135 - RNA, 24 nt, Human
uauuuuuuagaccucauuuuaaaa

SEQ ID NO: 593136 - RNA, 19 nt, Human
ucaguggaaagugagauac

SEQ ID NO: 593137 - RNA, 27 nt, Human
uccaaagccaggacaaccaaaggggac

SEQ ID NO: 593138 - RNA, 21 nt, Human
uccaagaccagccugaccaac

SEQ ID NO: 593139 - RNA, 19 nt, Human
uccagccugggugacaaga

SEQ ID NO: 593140 - RNA, 22 nt, Human
uccauaaaugaaaugugcugcu

SEQ ID NO: 593141 - RNA, 21 nt, Human
uccgaggagcagcccccaagg

SEQ ID NO: 593142 - RNA, 23 nt, Human
ucgcgccauugcacuccagccug

SEQ ID NO: 593143 - RNA, 20 nt, Human
ucuagaacucuucacuguau

SEQ ID NO: 593144 - RNA, 22 nt, Human
ucucaaaaaaaaaaaggcaaug

SEQ ID NO: 593145 - RNA, 19 nt, Human
ucucaguggaaagugagau

SEQ ID NO: 593146 - RNA, 18 nt, Human
ucucauagcagcggcuuu

SEQ ID NO: 593147 - RNA, 24 nt, Human
ucugcagccaguggcagggggccc

SEQ ID NO: 593148 - RNA, 23 nt, Human
ucuucuagcuuuuaaaacauuuu

SEQ ID NO: 593149 - RNA, 18 nt, Human
ucuuucgccaucugcagc

SEQ ID NO: 593150 - RNA, 24 nt, Human
ugaaugaauaaauaaauacaagug

SEQ ID NO: 593151 - RNA, 21 nt, Human
ugacaagagcaaaauuccauc

SEQ ID NO: 593152 - RNA, 24 nt, Human
ugaccaacauggagauacccuguc

SEQ ID NO: 593153 - RNA, 19 nt, Human
ugaccagaagaguuaguga

SEQ ID NO: 593154 - RNA, 25 nt, Human
ugacccugcccaacugccacacccc

SEQ ID NO: 593155 - RNA, 19 nt, Human
ugagaguuaaagccagcuu

SEQ ID NO: 593156 - RNA, 20 nt, Human
ugaggcaggagaaucacuug

SEQ ID NO: 593157 - RNA, 21 nt, Human
ugaggcaggagaaucacuugg

SEQ ID NO: 593158 - RNA, 24 nt, Human
ugaggcaggagaaucacuuggacc

SEQ ID NO: 593159 - RNA, 25 nt, Human
ugaggcaggagaaucacuuggaccc

SEQ ID NO: 593160 - RNA, 22 nt, Human
ugaggugagaucgcgccauugc

SEQ ID NO: 593161 - RNA, 20 nt, Human
ugcaaaggacuccaaagcca

SEQ ID NO: 593162 - RNA, 19 nt, Human
ugcaaauauguaaaaucug

SEQ ID NO: 593163 - RNA, 23 nt, Human
ugcacuccagccugggugacaag

SEQ ID NO: 593164 - RNA, 21 nt, Human
ugccacaccccaacuuagagg

SEQ ID NO: 593165 - RNA, 23 nt, Human
ugcccggagggucagaguucagg

SEQ ID NO: 593166 - RNA, 24 nt, Human
ugccuguaaucccagcuacuuggg

SEQ ID NO: 593167 - RNA, 23 nt, Human
uggaaaaagagcccuuagaccau

SEQ ID NO: 593168 - RNA, 20 nt, Human
uggaccucagccaagaccag

SEQ ID NO: 593169 - RNA, 19 nt, Human
uggcaaauguuuugaucau

SEQ ID NO: 593170 - RNA, 21 nt, Human
uggcgcaugccuguaauccca

SEQ ID NO: 593171 - RNA, 22 nt, Human
uggcgcaugccuguaaucccag

SEQ ID NO: 593172 - RNA, 22 nt, Human
uggcucacgccuguaaucccag

SEQ ID NO: 593173 - RNA, 24 nt, Human
uggcucacgccuguaaucccagca

SEQ ID NO: 593174 - RNA, 19 nt, Human
ugggaggccgaggugggcg

SEQ ID NO: 593175 - RNA, 24 nt, Human
ugggaggccgaggugggcggauca

SEQ ID NO: 593176 - RNA, 19 nt, Human
ugggaggcugaggcaggag

SEQ ID NO: 593177 - RNA, 24 nt, Human
ugggaggcugaggcaggagaauca

SEQ ID NO: 593178 - RNA, 19 nt, Human
ugggcaggcaugguggcuc

SEQ ID NO: 593179 - RNA, 24 nt, Human
ugggcggaucaccugaggucggga

SEQ ID NO: 593180 - RNA, 18 nt, Human
ugggugugguggcgcaug

SEQ ID NO: 593181 - RNA, 24 nt, Human
ugguggcgcaugccuguaauccca

SEQ ID NO: 593182 - RNA, 24 nt, Human
ugguggcucacgccuguaauccca

SEQ ID NO: 593183 - RNA, 25 nt, Human
ugugagcagugggacagaaggggcu

SEQ ID NO: 593184 - RNA, 23 nt, Human
uguuacaaaaccauagaagacua

SEQ ID NO: 593185 - RNA, 21 nt, Human
uguuuaaagaauaauagucuc

SEQ ID NO: 593186 - RNA, 24 nt, Human
uuaaaauugcauuuuuguuucuac

SEQ ID NO: 593187 - RNA, 24 nt, Human
uuaaagccagcuuacuggggcugc

SEQ ID NO: 593188 - RNA, 21 nt, Human
uuagcagcugcuacuccuggc

SEQ ID NO: 593189 - RNA, 18 nt, Human
uuagcugggugugguggc

SEQ ID NO: 593190 - RNA, 20 nt, Human
uuagcugggugugguggcgc

SEQ ID NO: 593191 - RNA, 24 nt, Human
uuagcugggugugguggcgcaugc

SEQ ID NO: 593192 - RNA, 20 nt, Human
uucaagacuggagaacccag

SEQ ID NO: 593193 - RNA, 21 nt, Human
uucauauuaaaagccagaccc

SEQ ID NO: 593194 - RNA, 20 nt, Human
uuccuagcugcugccaucac

SEQ ID NO: 593195 - RNA, 25 nt, Human
uucuccuacccacagggggccagga

SEQ ID NO: 593196 - RNA, 21 nt, Human
uugaagccacauucucuacuc

SEQ ID NO: 593197 - RNA, 23 nt, Human
uugaagccacauucucuacucau

SEQ ID NO: 593198 - RNA, 24 nt, Human
uugacccugcccaacugccacacu

SEQ ID NO: 593199 - RNA, 22 nt, Human
uugcagugaggugagaucgcgc

SEQ ID NO: 593200 - RNA, 25 nt, Human
uugggaggccgaggugggcggauca

SEQ ID NO: 593201 - RNA, 25 nt, Human
uugggaggcugaggcaggagaauca

SEQ ID NO: 593202 - RNA, 24 nt, Human
uuguucaagugaaaacuagacaca

SEQ ID NO: 593203 - RNA, 23 nt, Human
uuucuaccaccuguaagcuacaa

SEQ ID NO: 593204 - RNA, 21 nt, Human
uuugcaaaggacuccaaagcc

SEQ ID NO: 593205 - RNA, 26 nt, Human
uuugcaguucauauuaaaagccagac

SEQ ID NO: 593206 - RNA, 19 nt, Human
aaacaggaaaaucacacac

SEQ ID NO: 593207 - RNA, 20 nt, Human
aaacaggaaaaucacacacg

SEQ ID NO: 593208 - RNA, 21 nt, Human
aaacaguuacaguagaguuca

SEQ ID NO: 593209 - RNA, 19 nt, Human
aaaccccuaacguugccca

SEQ ID NO: 593210 - RNA, 23 nt, Human
aaaccccuaacguugcccacccu

SEQ ID NO: 593211 - RNA, 20 nt, Human
aaaggcaguggccuggcccg

SEQ ID NO: 593212 - RNA, 20 nt, Human
acagggcaaugaacuuggac

SEQ ID NO: 593213 - RNA, 21 nt, Human
acagggcaaugaacuuggaca

SEQ ID NO: 593214 - RNA, 21 nt, Human
acaggggaggggcgggccaga

SEQ ID NO: 593215 - RNA, 27 nt, Human
accccgcuucaguucugccuucuguca

SEQ ID NO: 593216 - RNA, 18 nt, Human
acccugaggcccagccac

SEQ ID NO: 593217 - RNA, 18 nt, Human
accguggcaggcuguggc

SEQ ID NO: 593218 - RNA, 18 nt, Human
accuccagccuccuuccc

SEQ ID NO: 593219 - RNA, 19 nt, Human
agagcggaccuccagccuc

SEQ ID NO: 593220 - RNA, 23 nt, Human
agauacuuagaaaucacacggau

SEQ ID NO: 593221 - RNA, 18 nt, Human
agcaggugcagacgguug

SEQ ID NO: 593222 - RNA, 23 nt, Human
agccacagcaccggacacggccc

SEQ ID NO: 593223 - RNA, 21 nt, Human
agccugggucaaggcggccgg

SEQ ID NO: 593224 - RNA, 23 nt, Human
agcgccgcccucaagggccgccc

SEQ ID NO: 593225 - RNA, 24 nt, Human
agcggaccuccagccuccuucccg

SEQ ID NO: 593226 - RNA, 18 nt, Human
aggaaaaucacacacgua

SEQ ID NO: 593227 - RNA, 22 nt, Human
aggacaaaaggcaguggccugg

SEQ ID NO: 593228 - RNA, 18 nt, Human
aggcaggcgggagaggag

SEQ ID NO: 593229 - RNA, 24 nt, Human
aggggugggggaagagcaggugca

SEQ ID NO: 593230 - RNA, 28 nt, Human
aggugguggcccagccacggcgcucuuc

SEQ ID NO: 593231 - RNA, 21 nt, Human
auaaguaucaugaaccaugcu

SEQ ID NO: 593232 - RNA, 21 nt, Human
augccaagcucacgucuggcu

SEQ ID NO: 593233 - RNA, 21 nt, Human
auggucuugggagugucaaaa

SEQ ID NO: 593234 - RNA, 24 nt, Human
caaagucccacucgugcgcucccc

SEQ ID NO: 593235 - RNA, 26 nt, Human
caacagaaggaccacgauucuaaaug

SEQ ID NO: 593236 - RNA, 21 nt, Human
caacaggugccacugcccccu

SEQ ID NO: 593237 - RNA, 20 nt, Human
caacgcuaagauacuuagaa

SEQ ID NO: 593238 - RNA, 24 nt, Human
caaggcggccggacgucuugacca

SEQ ID NO: 593239 - RNA, 26 nt, Human
cacaacacgccagguggaagaagucu

SEQ ID NO: 593240 - RNA, 21 nt, Human
cacacaacugccuugaugccc

SEQ ID NO: 593241 - RNA, 20 nt, Human
cacacauggcacgugaagau

SEQ ID NO: 593242 - RNA, 19 nt, Human
cacagagcggaccuccagc

SEQ ID NO: 593243 - RNA, 25 nt, Human
caccacugaccuacaguucuaaaau

SEQ ID NO: 593244 - RNA, 25 nt, Human
cacccgcccucaccagggcugcagu

SEQ ID NO: 593245 - RNA, 18 nt, Human
cacgucuggcugcgaccg

SEQ ID NO: 593246 - RNA, 20 nt, Human
cacgucuggcugcgaccgug

SEQ ID NO: 593247 - RNA, 27 nt, Human
cacugaccuacaguucuaaaaucagac

SEQ ID NO: 593248 - RNA, 22 nt, Human
cagaagguccacugguaagcac

SEQ ID NO: 593249 - RNA, 18 nt, Human
cagcaccggacacggccc

SEQ ID NO: 593250 - RNA, 19 nt, Human
cagcaccggacacggcccu

SEQ ID NO: 593251 - RNA, 23 nt, Human
cagccacagcaccggacacggcc

SEQ ID NO: 593252 - RNA, 22 nt, Human
caggaaaaucacacacguagua

SEQ ID NO: 593253 - RNA, 19 nt, Human
caggggccgcuuugcaacu

SEQ ID NO: 593254 - RNA, 24 nt, Human
caggugguggcccagccacggcgc

SEQ ID NO: 593255 - RNA, 20 nt, Human
caguggccguucuccggccc

SEQ ID NO: 593256 - RNA, 22 nt, Human
cagugggcccagugcaaacuuu

SEQ ID NO: 593257 - RNA, 20 nt, Human
cauagaaaccuucagggccg

SEQ ID NO: 593258 - RNA, 21 nt, Human
ccacccugaggcccagccacc

SEQ ID NO: 593259 - RNA, 23 nt, Human
ccaguggccguucuccggccucu

SEQ ID NO: 593260 - RNA, 18 nt, Human
cccacccugaggcccagc

SEQ ID NO: 593261 - RNA, 23 nt, Human
cccagccaccagccacccagggg

SEQ ID NO: 593262 - RNA, 21 nt, Human
ccccagagcccuuggcacaga

SEQ ID NO: 593263 - RNA, 19 nt, Human
cccccugcugggcccuggg

SEQ ID NO: 593264 - RNA, 24 nt, Human
cccccugcugggcccugggccuuc

SEQ ID NO: 593265 - RNA, 18 nt, Human
cccugaggcccagccacc

SEQ ID NO: 593266 - RNA, 22 nt, Human
cccugaggcccagccaccagcc

SEQ ID NO: 593267 - RNA, 21 nt, Human
ccgggaaggaccgcgccggcg

SEQ ID NO: 593268 - RNA, 26 nt, Human
ccuacaguucuaaaaucagacagaca

SEQ ID NO: 593269 - RNA, 19 nt, Human
ccuucagggccggcuccag

SEQ ID NO: 593270 - RNA, 21 nt, Human
cgagauucacagaacauggca

SEQ ID NO: 593271 - RNA, 19 nt, Human
cggauaaugcaaaccgaug

SEQ ID NO: 593272 - RNA, 20 nt, Human
cggcccuggacagcgacggc

SEQ ID NO: 593273 - RNA, 19 nt, Human
cgggagaggaggagcuggg

SEQ ID NO: 593274 - RNA, 19 nt, Human
cgggccagaagguccacug

SEQ ID NO: 593275 - RNA, 25 nt, Human
cggggcccuggaugcccgacaagug

SEQ ID NO: 593276 - RNA, 18 nt, Human
cguccuguacagcuucau

SEQ ID NO: 593277 - RNA, 23 nt, Human
cgucgccaccgccgcugcggcca

SEQ ID NO: 593278 - RNA, 22 nt, Human
cguugcccacccugaggcccag

SEQ ID NO: 593279 - RNA, 22 nt, Human
cucacgucuggcugcgaccgug

SEQ ID NO: 593280 - RNA, 22 nt, Human
cuccccucccacaccaguggcc

SEQ ID NO: 593281 - RNA, 20 nt, Human
cuccggccucuggacucggc

SEQ ID NO: 593282 - RNA, 18 nt, Human
cugcccccugcugggccc

SEQ ID NO: 593283 - RNA, 18 nt, Human
cugcccccugcugggccc

SEQ ID NO: 593284 - RNA, 19 nt, Human
cugccuugaugcccaaagc

SEQ ID NO: 593285 - RNA, 24 nt, Human
cugccuugaugcccaaagccuggg

SEQ ID NO: 593286 - RNA, 20 nt, Human
cuggaugcccgacaagugac

SEQ ID NO: 593287 - RNA, 19 nt, Human
cugggcccugggccuucag

SEQ ID NO: 593288 - RNA, 21 nt, Human
gaacuuggacaagcccuucag

SEQ ID NO: 593289 - RNA, 18 nt, Human
gaagcuaaggcacagcac

SEQ ID NO: 593290 - RNA, 23 nt, Human
gaccucuccccaacagauucagu

SEQ ID NO: 593291 - RNA, 21 nt, Human
gagaggaggagcuggggacac

SEQ ID NO: 593292 - RNA, 25 nt, Human
gcaacagaaggaccacgauucuaaa

SEQ ID NO: 593293 - RNA, 30 nt, Human
gcaacagaaggaccacgauucuaaaugggg

SEQ ID NO: 593294 - RNA, 22 nt, Human
gccaaaccccuaacguugccca

SEQ ID NO: 593295 - RNA, 19 nt, Human
gccccagagcccuuggcac

SEQ ID NO: 593296 - RNA, 23 nt, Human
gcccgacaagugacaggggaggg

SEQ ID NO: 593297 - RNA, 21 nt, Human
gcccuuggcacagagcggacc

SEQ ID NO: 593298 - RNA, 22 nt, Human
gccgguggcggagguauggggg

SEQ ID NO: 593299 - RNA, 20 nt, Human
gccgucgucgccaccgccgc

SEQ ID NO: 593300 - RNA, 24 nt, Human
gcggcuaggcacaggucggggccc

SEQ ID NO: 593301 - RNA, 20 nt, Human
ggagaggaggagcuggggac

SEQ ID NO: 593302 - RNA, 20 nt, Human
ggcagaggauauuggcuaag

SEQ ID NO: 593303 - RNA, 23 nt, Human
ggccggugggugagacacauagg

SEQ ID NO: 593304 - RNA, 23 nt, Human
ggcggccggacgucuugaccacc

SEQ ID NO: 593305 - RNA, 23 nt, Human
ggugggggaagagcaggugcagg

SEQ ID NO: 593306 - RNA, 25 nt, Human
gucccacucgugcgcuccccuccca

SEQ ID NO: 593307 - RNA, 22 nt, Human
gugaccucuccccaacagauuc

SEQ ID NO: 593308 - RNA, 21 nt, Human
uaaaacaggaaaaucacacac

SEQ ID NO: 593309 - RNA, 21 nt, Human
uaacagggcaaugaacuugga

SEQ ID NO: 593310 - RNA, 25 nt, Human
uauaaaauuucccugaauggucuug

SEQ ID NO: 593311 - RNA, 21 nt, Human
ucaacaggugccacugccccc

SEQ ID NO: 593312 - RNA, 20 nt, Human
ucaacgcuaagauacuuaga

SEQ ID NO: 593313 - RNA, 22 nt, Human
ucacagaacauggcaagcccgc

SEQ ID NO: 593314 - RNA, 23 nt, Human
ucccucaaucccauggggcgggc

SEQ ID NO: 593315 - RNA, 18 nt, Human
ucccugaauggucuuggg

SEQ ID NO: 593316 - RNA, 19 nt, Human
uccuacagcuuuacagcca

SEQ ID NO: 593317 - RNA, 20 nt, Human
uccuacagcuuuacagccac

SEQ ID NO: 593318 - RNA, 21 nt, Human
ucgucgccaccgccgcugcgg

SEQ ID NO: 593319 - RNA, 21 nt, Human
ucucccgggaaggaccgcgcc

SEQ ID NO: 593320 - RNA, 21 nt, Human
ugacuauggugaccucucccc

SEQ ID NO: 593321 - RNA, 19 nt, Human
ugagcaacaacgcagccac

SEQ ID NO: 593322 - RNA, 20 nt, Human
ugaggucccacagggguggg

SEQ ID NO: 593323 - RNA, 19 nt, Human
ugagucccggcaccugggg

SEQ ID NO: 593324 - RNA, 21 nt, Human
ugcccaaagccugggcuccua

SEQ ID NO: 593325 - RNA, 19 nt, Human
ugcccgacaagugacaggg

SEQ ID NO: 593326 - RNA, 18 nt, Human
ugccuugaugcccaaagc

SEQ ID NO: 593327 - RNA, 19 nt, Human
ugccuugaugcccaaagcc

SEQ ID NO: 593328 - RNA, 20 nt, Human
ugccuugaugcccaaagccu

SEQ ID NO: 593329 - RNA, 18 nt, Human
uggaagaagucucccggg

SEQ ID NO: 593330 - RNA, 21 nt, Human
uggcaggcuguggcauccccg

SEQ ID NO: 593331 - RNA, 21 nt, Human
uggcucugaagcaagagcagc

SEQ ID NO: 593332 - RNA, 21 nt, Human
uggggaagcuaaggcacagca

SEQ ID NO: 593333 - RNA, 23 nt, Human
uggggcgggcuuucgccaaaccc

SEQ ID NO: 593334 - RNA, 24 nt, Human
ugguaagcaccucggccuuuuccg

SEQ ID NO: 593335 - RNA, 20 nt, Human
uggucuugggagugucaaaa

SEQ ID NO: 593336 - RNA, 19 nt, Human
uuacagccacagcaccgga

SEQ ID NO: 593337 - RNA, 22 nt, Human
uuacagccacagcaccggacac

SEQ ID NO: 593338 - RNA, 19 nt, Human
uucaagaaaacaguuacag

SEQ ID NO: 593339 - RNA, 21 nt, Human
uucauagaaaccuucagggcc

SEQ ID NO: 593340 - RNA, 22 nt, Human
uuccaggccggccggcgcccac

SEQ ID NO: 593341 - RNA, 19 nt, Human
uucccaaacaugaguucau

SEQ ID NO: 593342 - RNA, 18 nt, Human
uugcccagccccuagcag

SEQ ID NO: 593343 - RNA, 23 nt, Human
aaaaaaccaaaacccucccccca

SEQ ID NO: 593344 - RNA, 18 nt, Human
aaaaaccucuuugagucc

SEQ ID NO: 593345 - RNA, 18 nt, Human
aaaaggccaacaugggca

SEQ ID NO: 593346 - RNA, 19 nt, Human
aaauacagucuauaaaccg

SEQ ID NO: 593347 - RNA, 19 nt, Human
aaccaaaacccucccccca

SEQ ID NO: 593348 - RNA, 22 nt, Human
aaccaagaauguacuucagaac

SEQ ID NO: 593349 - RNA, 19 nt, Human
aacccuccccccaccccca

SEQ ID NO: 593350 - RNA, 25 nt, Human
acacacgcaagacagacgauauaac

SEQ ID NO: 593351 - RNA, 23 nt, Human
acacugaugcauccggagucacu

SEQ ID NO: 593352 - RNA, 21 nt, Human
acauacaauuaacagcaucac

SEQ ID NO: 593353 - RNA, 22 nt, Human
accaaaacccuccccccacccc

SEQ ID NO: 593354 - RNA, 25 nt, Human
accaagaauguacuucagaacaagg

SEQ ID NO: 593355 - RNA, 22 nt, Human
accagccagccauccuugucau

SEQ ID NO: 593356 - RNA, 18 nt, Human
acccuccccccaccccca

SEQ ID NO: 593357 - RNA, 22 nt, Human
accggaaggcugaaaaacacca

SEQ ID NO: 593358 - RNA, 19 nt, Human
agaacaaggaucugagagc

SEQ ID NO: 593359 - RNA, 22 nt, Human
agaaguacagauaaccaagaau

SEQ ID NO: 593360 - RNA, 21 nt, Human
agagcaacuuaugguguugcc

SEQ ID NO: 593361 - RNA, 19 nt, Human
caaaacccuccccccaccc

SEQ ID NO: 593362 - RNA, 23 nt, Human
caccagccagccauccuugucau

SEQ ID NO: 593363 - RNA, 18 nt, Human
cacccgaacgcaagaagg

SEQ ID NO: 593364 - RNA, 21 nt, Human
cacugaugcauccggagucac

SEQ ID NO: 593365 - RNA, 18 nt, Human
cacuuuggaaaaaaccaa

SEQ ID NO: 593366 - RNA, 24 nt, Human
cacuuuggaaaaaaccaaaacccu

SEQ ID NO: 593367 - RNA, 22 nt, Human
cagaagaaccgaaugggguggg

SEQ ID NO: 593368 - RNA, 26 nt, Human
caguauggggccugcaggaauccacu

SEQ ID NO: 593369 - RNA, 23 nt, Human
cauacaauuaacagcaucacacc

SEQ ID NO: 593370 - RNA, 24 nt, Human
caucacaccagcuacagaaguaca

SEQ ID NO: 593371 - RNA, 24 nt, Human
ccaaaacccuccccccacccccac

SEQ ID NO: 593372 - RNA, 21 nt, Human
ccaagaauguacuucagaaca

SEQ ID NO: 593373 - RNA, 19 nt, Human
ccaaucuccugauuguucu

SEQ ID NO: 593374 - RNA, 20 nt, Human
ccacaaaaacccaguucuga

SEQ ID NO: 593375 - RNA, 18 nt, Human
ccacccccaccaucauuc

SEQ ID NO: 593376 - RNA, 22 nt, Human
ccacccggccgccgcugugcuc

SEQ ID NO: 593377 - RNA, 20 nt, Human
ccagccccgcuggccccacu

SEQ ID NO: 593378 - RNA, 22 nt, Human
ccccacucacccccgccacccg

SEQ ID NO: 593379 - RNA, 19 nt, Human
ccccgcuggccccacucac

SEQ ID NO: 593380 - RNA, 24 nt, Human
ccccgcuggccccacucacccccg

SEQ ID NO: 593381 - RNA, 21 nt, Human
cccgaacgcaagaaggcagcu

SEQ ID NO: 593382 - RNA, 19 nt, Human
cccgccacccggccgccgc

SEQ ID NO: 593383 - RNA, 24 nt, Human
ccgcugcuguccagccccgcuggc

SEQ ID NO: 593384 - RNA, 22 nt, Human
cgcccggggcccgcugcugucc

SEQ ID NO: 593385 - RNA, 24 nt, Human
cggaaggcugaaaaacaccagcca

SEQ ID NO: 593386 - RNA, 22 nt, Human
cggcggcgcccggggcccgcug

SEQ ID NO: 593387 - RNA, 23 nt, Human
cucacccccgccacccggccgcc

SEQ ID NO: 593388 - RNA, 25 nt, Human
cuccccccacccccaccaucauucu

SEQ ID NO: 593389 - RNA, 22 nt, Human
cugcucugaaccuccacaaaaa

SEQ ID NO: 593390 - RNA, 24 nt, Human
cuugggaaugguuuuuuuuaaaaa

SEQ ID NO: 593391 - RNA, 25 nt, Human
gaaaaaaccaaaacccuccccccac

SEQ ID NO: 593392 - RNA, 22 nt, Human
gaaaaacaccagccagccaucc

SEQ ID NO: 593393 - RNA, 18 nt, Human
gaauccacuagauaaaua

SEQ ID NO: 593394 - RNA, 20 nt, Human
gagugugagauguggcagcu

SEQ ID NO: 593395 - RNA, 24 nt, Human
gccauccuugucauugcuuccaac

SEQ ID NO: 593396 - RNA, 22 nt, Human
gcggcgcccggggcccgcugcu

SEQ ID NO: 593397 - RNA, 19 nt, Human
ggguggguggaagagguuu

SEQ ID NO: 593398 - RNA, 21 nt, Human
gguuuuuuuuaaaaaaugaca

SEQ ID NO: 593399 - RNA, 21 nt, Human
guagagagauaacagaugguc

SEQ ID NO: 593400 - RNA, 19 nt, Human
guccaggcucaguaugggg

SEQ ID NO: 593401 - RNA, 22 nt, Human
guugccugcucugaaccuccac

SEQ ID NO: 593402 - RNA, 20 nt, Human
uaaaaaaugacaagaacuaa

SEQ ID NO: 593403 - RNA, 22 nt, Human
ucacuauguccagucagcucug

SEQ ID NO: 593404 - RNA, 21 nt, Human
ucaggcagaagaaccgaaugg

SEQ ID NO: 593405 - RNA, 25 nt, Human
ucauugcuuccaacugguggacacu

SEQ ID NO: 593406 - RNA, 18 nt, Human
uccacaaaaacccaguuc

SEQ ID NO: 593407 - RNA, 20 nt, Human
ucggcggcggcgaugugcuc

SEQ ID NO: 593408 - RNA, 23 nt, Human
ucggcggcggcgaugugcucggc

SEQ ID NO: 593409 - RNA, 21 nt, Human
ucugaaccuccacaaaaaccc

SEQ ID NO: 593410 - RNA, 21 nt, Human
ucugacacacgcaagacagac

SEQ ID NO: 593411 - RNA, 18 nt, Human
ucugauccuuucacgccc

SEQ ID NO: 593412 - RNA, 19 nt, Human
ugaaaaacaccagccagcc

SEQ ID NO: 593413 - RNA, 21 nt, Human
ugaaccuccacaaaaacccag

SEQ ID NO: 593414 - RNA, 22 nt, Human
ugagauguggcagcucgcuugg

SEQ ID NO: 593415 - RNA, 18 nt, Human
ugcucggcgggcgcgggg

SEQ ID NO: 593416 - RNA, 24 nt, Human
uggaaaaaaccaaaacccuccccc

SEQ ID NO: 593417 - RNA, 26 nt, Human
uggaaaaaaccaaaacccucccccca

SEQ ID NO: 593418 - RNA, 23 nt, Human
uggcacugcuguaaaaggccaac

SEQ ID NO: 593419 - RNA, 19 nt, Human
uggcagcucgcuuggugcc

SEQ ID NO: 593420 - RNA, 18 nt, Human
ugggguggguggaagagg

SEQ ID NO: 593421 - RNA, 18 nt, Human
ugggguggguggaagagg

SEQ ID NO: 593422 - RNA, 21 nt, Human
ugggguggguggaagagguuu

SEQ ID NO: 593423 - RNA, 20 nt, Human
uguaaaaggccaacaugggc

SEQ ID NO: 593424 - RNA, 27 nt, Human
uguccagccccgcuggccccacucacc

SEQ ID NO: 593425 - RNA, 18 nt, Human
uuccacuuuggaaaaaac

SEQ ID NO: 593426 - RNA, 21 nt, Human
uucuucauaaauuugcuucca

SEQ ID NO: 593427 - RNA, 24 nt, Human
uuggaaaaaaccaaaacccucccc

SEQ ID NO: 593428 - RNA, 20 nt, Human
augaugcuguguuccuugau

SEQ ID NO: 593429 - RNA, 20 nt, Human
auggagcuggggggagugcu

SEQ ID NO: 593430 - RNA, 20 nt, Human
auggagcuggggggagugcu

SEQ ID NO: 593431 - RNA, 22 nt, Human
auggagcuggggggagugcuuc

SEQ ID NO: 593432 - RNA, 18 nt, Human
cacuggcggcaaggaggc

SEQ ID NO: 593433 - RNA, 18 nt, Human
cagagaauauacuuggac

SEQ ID NO: 593434 - RNA, 22 nt, Human
ccaagcaacuugagguaaaggc

SEQ ID NO: 593435 - RNA, 23 nt, Human
cccccacacaguguugguuucug

SEQ ID NO: 593436 - RNA, 20 nt, Human
cuguauggcuggaggugucc

SEQ ID NO: 593437 - RNA, 19 nt, Human
gagcuggggggagugcuuc

SEQ ID NO: 593438 - RNA, 22 nt, Human
gcggcaaggaggcggcccgggg

SEQ ID NO: 593439 - RNA, 21 nt, Human
gcggcgcgacgcgacgggcac

SEQ ID NO: 593440 - RNA, 20 nt, Human
ggcggcaaggaggcggcccg

SEQ ID NO: 593441 - RNA, 25 nt, Human
uaaaggcauuaaaaggguuagacua

SEQ ID NO: 593442 - RNA, 24 nt, Human
uacaagaaaugaaaacaagacaau

SEQ ID NO: 593443 - RNA, 19 nt, Human
ucacuggaaacauacguug

SEQ ID NO: 593444 - RNA, 24 nt, Human
uccucucagagaauauacuuggac

SEQ ID NO: 593445 - RNA, 23 nt, Human
ucuguauggcuggagguguccuu

SEQ ID NO: 593446 - RNA, 18 nt, Human
ugaaguaaacaaucuucc

SEQ ID NO: 593447 - RNA, 23 nt, Human
uuccuuguguuaacauaaggauc

SEQ ID NO: 593448 - RNA, 23 nt, Human
uugacuucacuggaaacauacgu

SEQ ID NO: 593449 - RNA, 24 nt, Human
uugaugaaguaaacaaucuuccuu

SEQ ID NO: 593450 - RNA, 22 nt, Human
uuucauauugcauaaugaugcu

SEQ ID NO: 593451 - RNA, 22 nt, Human
aaacaucacaguggcuggaagc

SEQ ID NO: 593452 - RNA, 21 nt, Human
aacacugagacagcaggcauc

SEQ ID NO: 593453 - RNA, 23 nt, Human
aaguacaacacaacucccacuuc

SEQ ID NO: 593454 - RNA, 20 nt, Human
acaacacaacucccacuucc

SEQ ID NO: 593455 - RNA, 18 nt, Human
agacagcaggcaucagag

SEQ ID NO: 593456 - RNA, 23 nt, Human
aggaggacgggguccugucccag

SEQ ID NO: 593457 - RNA, 24 nt, Human
aggaggccccggaggcggcgggac

SEQ ID NO: 593458 - RNA, 26 nt, Human
aggcagaugggucuuaggaagccaga

SEQ ID NO: 593459 - RNA, 21 nt, Human
aggcggcgggaccgcagggcg

SEQ ID NO: 593460 - RNA, 19 nt, Human
cacacagcgaggaggugac

SEQ ID NO: 593461 - RNA, 18 nt, Human
cagaccaaggggccagaa

SEQ ID NO: 593462 - RNA, 18 nt, Human
cagcccagcuacccaagu

SEQ ID NO: 593463 - RNA, 20 nt, Human
ccaaguagaagguggggcgg

SEQ ID NO: 593464 - RNA, 19 nt, Human
ccagcccagcuacccaagu

SEQ ID NO: 593465 - RNA, 23 nt, Human
cccagcgucccagcccagcuacc

SEQ ID NO: 593466 - RNA, 22 nt, Human
ccuggucuuuggggaccuugac

SEQ ID NO: 593467 - RNA, 21 nt, Human
cgccuucagcgcuggcggcgu

SEQ ID NO: 593468 - RNA, 21 nt, Human
cggcagacaccucaaaguucc

SEQ ID NO: 593469 - RNA, 19 nt, Human
cggccuccgggcugcgccu

SEQ ID NO: 593470 - RNA, 21 nt, Human
cugagacagcaggcaucagag

SEQ ID NO: 593471 - RNA, 27 nt, Human
cugggccaccuguucucuauacuucgu

SEQ ID NO: 593472 - RNA, 18 nt, Human
gagaggcagcagugggag

SEQ ID NO: 593473 - RNA, 19 nt, Human
gaggugacagaccaagggg

SEQ ID NO: 593474 - RNA, 25 nt, Human
gaucugggccaccuguucucuauac

SEQ ID NO: 593475 - RNA, 21 nt, Human
ggagaggucauugaggaaugu

SEQ ID NO: 593476 - RNA, 21 nt, Human
ggagcuuucucaagaucacac

SEQ ID NO: 593477 - RNA, 24 nt, Human
ggaggcggcgggaccgcagggcgg

SEQ ID NO: 593478 - RNA, 18 nt, Human
ggaggggaggccguggga

SEQ ID NO: 593479 - RNA, 20 nt, Human
ggaggugacagaccaagggg

SEQ ID NO: 593480 - RNA, 19 nt, Human
ggccagaaguugggucccc

SEQ ID NO: 593481 - RNA, 20 nt, Human
gggccagaaguugggucccc

SEQ ID NO: 593482 - RNA, 19 nt, Human
ggugggugaguggaaggag

SEQ ID NO: 593483 - RNA, 21 nt, Human
guuugcauaauaaccaaacac

SEQ ID NO: 593484 - RNA, 18 nt, Human
uaaccaaacacugagaca

SEQ ID NO: 593485 - RNA, 19 nt, Human
uaaccaaacacugagacag

SEQ ID NO: 593486 - RNA, 22 nt, Human
uacccaaguagaagguggggcg

SEQ ID NO: 593487 - RNA, 23 nt, Human
uauuucaaacaucacaguggcug

SEQ ID NO: 593488 - RNA, 21 nt, Human
ucaaaguuccucugaucccaa

SEQ ID NO: 593489 - RNA, 22 nt, Human
ucacaguggcuggaagcaacag

SEQ ID NO: 593490 - RNA, 21 nt, Human
ucagagugccaugaaguacaa

SEQ ID NO: 593491 - RNA, 19 nt, Human
ucagggagaagagugccag

SEQ ID NO: 593492 - RNA, 19 nt, Human
ucccaggaggccccggagg

SEQ ID NO: 593493 - RNA, 19 nt, Human
ucuauggcugagucuuggg

SEQ ID NO: 593494 - RNA, 22 nt, Human
ucuauggcugagucuugggcag

SEQ ID NO: 593495 - RNA, 22 nt, Human
ucuuaggaagccagaggguugu

SEQ ID NO: 593496 - RNA, 21 nt, Human
ugacagaccaaggggccagaa

SEQ ID NO: 593497 - RNA, 24 nt, Human
ugacagaccaaggggccagaaguu

SEQ ID NO: 593498 - RNA, 27 nt, Human
ugacagcaaggguaaggcaucauucuu

SEQ ID NO: 593499 - RNA, 20 nt, Human
ugagagcugugccuguugag

SEQ ID NO: 593500 - RNA, 27 nt, Human
ugaggcaggggacguguacuguggacu

SEQ ID NO: 593501 - RNA, 21 nt, Human
ugccaugaaguacaacacaac

SEQ ID NO: 593502 - RNA, 19 nt, Human
ugcccaggagaggcagcag

SEQ ID NO: 593503 - RNA, 19 nt, Human
uggcuggaagcaacagggc

SEQ ID NO: 593504 - RNA, 24 nt, Human
ugggagaggucauugaggaauguc

SEQ ID NO: 593505 - RNA, 18 nt, Human
ugggugaguggaaggagc

SEQ ID NO: 593506 - RNA, 23 nt, Human
uugggcagugggugcucugucau

SEQ ID NO: 593507 - RNA, 24 nt, Human
uuggucucagggagaagagugcca

SEQ ID NO: 593508 - RNA, 21 nt, Human
aaaggaagaaggaagccugag

SEQ ID NO: 593509 - RNA, 19 nt, Human
aaccccacuacuuccucca

SEQ ID NO: 593510 - RNA, 19 nt, Human
aagccaguuccagguucaa

SEQ ID NO: 593511 - RNA, 18 nt, Human
aagccugagggcaagggg

SEQ ID NO: 593512 - RNA, 21 nt, Human
aauccuucucccuuaguccac

SEQ ID NO: 593513 - RNA, 22 nt, Human
accaaacaucuagcccuucagc

SEQ ID NO: 593514 - RNA, 26 nt, Human
accaaacaucuagcccuucagcccua

SEQ ID NO: 593515 - RNA, 22 nt, Human
accaaagggaaaggaagaagga

SEQ ID NO: 593516 - RNA, 19 nt, Human
accucugccucaucaacug

SEQ ID NO: 593517 - RNA, 18 nt, Human
acgggccccaccccccau

SEQ ID NO: 593518 - RNA, 20 nt, Human
acuggggcugguagcagagg

SEQ ID NO: 593519 - RNA, 20 nt, Human
agaaaaaacugagcauggug

SEQ ID NO: 593520 - RNA, 20 nt, Human
agaggggggauccucaaacc

SEQ ID NO: 593521 - RNA, 25 nt, Human
agaugggaaggaggaaaccucaggg

SEQ ID NO: 593522 - RNA, 18 nt, Human
agcagaggggggauccuc

SEQ ID NO: 593523 - RNA, 18 nt, Human
aggaagaaggaagccuga

SEQ ID NO: 593524 - RNA, 24 nt, Human
aggaagaaggaagccugagggcaa

SEQ ID NO: 593525 - RNA, 22 nt, Human
aggaagaguagggaaggagagc

SEQ ID NO: 593526 - RNA, 24 nt, Human
agggaaggagagcacucauggaga

SEQ ID NO: 593527 - RNA, 22 nt, Human
agggagcccagugguugcaaug

SEQ ID NO: 593528 - RNA, 18 nt, Human
aguccagaggacugggaa

SEQ ID NO: 593529 - RNA, 20 nt, Human
aguucugaggagggcauggu

SEQ ID NO: 593530 - RNA, 20 nt, Human
caaaguaguagcucagaggc

SEQ ID NO: 593531 - RNA, 19 nt, Human
caacgggccccacccccca

SEQ ID NO: 593532 - RNA, 21 nt, Human
cacaguuucauggucaaagcc

SEQ ID NO: 593533 - RNA, 21 nt, Human
caccacucugcuccugggucc

SEQ ID NO: 593534 - RNA, 22 nt, Human
cacuggagugggaaaaugcugg

SEQ ID NO: 593535 - RNA, 18 nt, Human
cagcucaccuggaacacc

SEQ ID NO: 593536 - RNA, 20 nt, Human
cagcugcugugggggcuggc

SEQ ID NO: 593537 - RNA, 24 nt, Human
caggagaucugcagcugaggccau

SEQ ID NO: 593538 - RNA, 24 nt, Human
cauggggaaggugauacuggggcu

SEQ ID NO: 593539 - RNA, 18 nt, Human
ccaaacaucuagcccuuu

SEQ ID NO: 593540 - RNA, 24 nt, Human
ccacagccacaagagcauggggaa

SEQ ID NO: 593541 - RNA, 19 nt, Human
ccauaccccuuaauccuuc

SEQ ID NO: 593542 - RNA, 26 nt, Human
cccaccccccauuauccggcucccca

SEQ ID NO: 593543 - RNA, 20 nt, Human
ccccaacgggccccaccccc

SEQ ID NO: 593544 - RNA, 21 nt, Human
ccccaacgggccccacccccc

SEQ ID NO: 593545 - RNA, 23 nt, Human
ccccaccccccauuauccggcuc

SEQ ID NO: 593546 - RNA, 21 nt, Human
ccccacuacuuccuccaaagg

SEQ ID NO: 593547 - RNA, 23 nt, Human
ccccccaacgggccccacccccc

SEQ ID NO: 593548 - RNA, 20 nt, Human
ccccuggaggaccuuuggaa

SEQ ID NO: 593549 - RNA, 26 nt, Human
ccccuggaggaccuuuggaaccucug

SEQ ID NO: 593550 - RNA, 20 nt, Human
ccccuguggcagcuccaguu

SEQ ID NO: 593551 - RNA, 21 nt, Human
ccccuguggcagcuccaguuc

SEQ ID NO: 593552 - RNA, 21 nt, Human
cccucagauuccacaugguug

SEQ ID NO: 593553 - RNA, 25 nt, Human
cccuucagcccuacuuucccagccu

SEQ ID NO: 593554 - RNA, 25 nt, Human
ccuccuguuuuccuggcaaccccaa

SEQ ID NO: 593555 - RNA, 21 nt, Human
ccuuaauccuucucccuuagu

SEQ ID NO: 593556 - RNA, 28 nt, Human
cgggccccaccccccauuauccggcucu

SEQ ID NO: 593557 - RNA, 20 nt, Human
cuaaucccaugcaggauuaa

SEQ ID NO: 593558 - RNA, 23 nt, Human
cucaaaccucugccucaucaacu

SEQ ID NO: 593559 - RNA, 21 nt, Human
cucugagguaugcaccgcuuc

SEQ ID NO: 593560 - RNA, 18 nt, Human
cugagaccaaacaucuag

SEQ ID NO: 593561 - RNA, 18 nt, Human
cugaggccaugcucacuu

SEQ ID NO: 593562 - RNA, 22 nt, Human
cugcagcugaggccaugcucac

SEQ ID NO: 593563 - RNA, 19 nt, Human
cugccucaucaacugcccc

SEQ ID NO: 593564 - RNA, 19 nt, Human
cuggaggaccuuuggaacc

SEQ ID NO: 593565 - RNA, 23 nt, Human
cugggaagagccgagguuagccu

SEQ ID NO: 593566 - RNA, 19 nt, Human
cuuccccagcucaccugga

SEQ ID NO: 593567 - RNA, 25 nt, Human
cuuccccagcucaccuggaacaccc

SEQ ID NO: 593568 - RNA, 22 nt, Human
gaaaaaacugagcauggugaga

SEQ ID NO: 593569 - RNA, 19 nt, Human
gaacaggaagaguagggaa

SEQ ID NO: 593570 - RNA, 19 nt, Human
gaaccugcucuagaaggcc

SEQ ID NO: 593571 - RNA, 21 nt, Human
gaaccugcucuagaaggccag

SEQ ID NO: 593572 - RNA, 20 nt, Human
gaaugggugggccccacuuc

SEQ ID NO: 593573 - RNA, 19 nt, Human
gagagaagacagugucaga

SEQ ID NO: 593574 - RNA, 25 nt, Human
gaggaccuuuggaaccucugauagu

SEQ ID NO: 593575 - RNA, 18 nt, Human
gaugcaaaguaguagcuc

SEQ ID NO: 593576 - RNA, 26 nt, Human
gcaaugaaagacuaaaaggucuacac

SEQ ID NO: 593577 - RNA, 19 nt, Human
gccugcuggcugagcuccg

SEQ ID NO: 593578 - RNA, 23 nt, Human
gcucugaagaggggccuagucuu

SEQ ID NO: 593579 - RNA, 23 nt, Human
ggaacaggaagaguagggaagga

SEQ ID NO: 593580 - RNA, 19 nt, Human
ggaaugggugggccccacu

SEQ ID NO: 593581 - RNA, 18 nt, Human
ggaauucagccauacccc

SEQ ID NO: 593582 - RNA, 20 nt, Human
ggccauucacaguuucaugg

SEQ ID NO: 593583 - RNA, 18 nt, Human
gggaaggagagcacucau

SEQ ID NO: 593584 - RNA, 21 nt, Human
gggaaggaggaaaccucaggg

SEQ ID NO: 593585 - RNA, 21 nt, Human
gggauccucaaaccucugccu

SEQ ID NO: 593586 - RNA, 20 nt, Human
ggugauacuggggcugguag

SEQ ID NO: 593587 - RNA, 22 nt, Human
guaccaaauccagcacauccag

SEQ ID NO: 593588 - RNA, 21 nt, Human
guucagaaaaaacugagcaug

SEQ ID NO: 593589 - RNA, 18 nt, Human
guucugaggagggcaugg

SEQ ID NO: 593590 - RNA, 22 nt, Human
uaccauagaacacauccaccuu

SEQ ID NO: 593591 - RNA, 18 nt, Human
uaccucacuaguccaacu

SEQ ID NO: 593592 - RNA, 26 nt, Human
uagaacacauccaccuucuagaaccu

SEQ ID NO: 593593 - RNA, 18 nt, Human
uagcagaggggggauccu

SEQ ID NO: 593594 - RNA, 24 nt, Human
uagcauuccugagauugaugacau

SEQ ID NO: 593595 - RNA, 22 nt, Human
uagggccauucacaguuucaug

SEQ ID NO: 593596 - RNA, 18 nt, Human
uaguuuggccagaaaggg

SEQ ID NO: 593597 - RNA, 20 nt, Human
uauucaguacagaugcaaag

SEQ ID NO: 593598 - RNA, 19 nt, Human
ucagaaaaaacugagcaug

SEQ ID NO: 593599 - RNA, 23 nt, Human
ucccagccuugggaggcucuggg

SEQ ID NO: 593600 - RNA, 22 nt, Human
uccccagccucagaaacuucca

SEQ ID NO: 593601 - RNA, 22 nt, Human
uccuggguccuagagaucaccc

SEQ ID NO: 593602 - RNA, 19 nt, Human
ucucagagcucuggguuca

SEQ ID NO: 593603 - RNA, 23 nt, Human
ucucuaauguucagaccuggcuu

SEQ ID NO: 593604 - RNA, 27 nt, Human
ucugcagcugaggccaugccggggucc

SEQ ID NO: 593605 - RNA, 21 nt, Human
ucugccaugaugccgcugcuc

SEQ ID NO: 593606 - RNA, 22 nt, Human
ugaaagacuaaagcaauaacug

SEQ ID NO: 593607 - RNA, 21 nt, Human
ugaaguuagggccauucacag

SEQ ID NO: 593608 - RNA, 21 nt, Human
ugagggcaaggggugccgggg

SEQ ID NO: 593609 - RNA, 24 nt, Human
ugccaugaugccgcugcuccagga

SEQ ID NO: 593610 - RNA, 18 nt, Human
ugccccuguggcagcucc

SEQ ID NO: 593611 - RNA, 24 nt, Human
ugccuuauuucccuccuguuuucc

SEQ ID NO: 593612 - RNA, 20 nt, Human
ugcuccaggagaucugcagc

SEQ ID NO: 593613 - RNA, 21 nt, Human
ugcuccaggagaucugcagcu

SEQ ID NO: 593614 - RNA, 21 nt, Human
ugcucguuccuccaagagcua

SEQ ID NO: 593615 - RNA, 18 nt, Human
ugcucuagaaggccaggc

SEQ ID NO: 593616 - RNA, 23 nt, Human
uggaaccucugauagucugucau

SEQ ID NO: 593617 - RNA, 22 nt, Human
uggaguucuggccaagucugga

SEQ ID NO: 593618 - RNA, 23 nt, Human
uggaguucuggccaagucuggag

SEQ ID NO: 593619 - RNA, 22 nt, Human
uggcuucacugaggaauaguuc

SEQ ID NO: 593620 - RNA, 19 nt, Human
ugguagcagaggggggauc

SEQ ID NO: 593621 - RNA, 18 nt, Human
uguuuugcucguuccucc

SEQ ID NO: 593622 - RNA, 23 nt, Human
uucccuugaaguuagggccauuc

SEQ ID NO: 593623 - RNA, 22 nt, Human
uugcaaugaaagacuaaagcaa

SEQ ID NO: 593624 - RNA, 18 nt, Human
uugcuaggccugcuggcu

SEQ ID NO: 593625 - RNA, 22 nt, Human
aaaaaaacaaaaaacagggcag

SEQ ID NO: 593626 - RNA, 19 nt, Human
aaacccucaaugaccaaac

SEQ ID NO: 593627 - RNA, 19 nt, Human
aaagaggcccugcagccuu

SEQ ID NO: 593628 - RNA, 18 nt, Human
aacagcacugagcugacc

SEQ ID NO: 593629 - RNA, 20 nt, Human
aacaugggaggauguaaagc

SEQ ID NO: 593630 - RNA, 24 nt, Human
aagaagagagggaggggacccaag

SEQ ID NO: 593631 - RNA, 18 nt, Human
aagagccacaaccugaaa

SEQ ID NO: 593632 - RNA, 21 nt, Human
aagccucccugcccuggcccu

SEQ ID NO: 593633 - RNA, 18 nt, Human
acaaaaaacagggcaggg

SEQ ID NO: 593634 - RNA, 24 nt, Human
acaaacaaacccucaaugaccaaa

SEQ ID NO: 593635 - RNA, 18 nt, Human
acaaaugagagaagcaga

SEQ ID NO: 593636 - RNA, 18 nt, Human
acaaaugagagaagcaga

SEQ ID NO: 593637 - RNA, 21 nt, Human
acacauacuucauccaccuga

SEQ ID NO: 593638 - RNA, 19 nt, Human
accaagaccucccaguccu

SEQ ID NO: 593639 - RNA, 22 nt, Human
accaccaagaccucccaguccu

SEQ ID NO: 593640 - RNA, 26 nt, Human
accagagcacuggaaccauggcacug

SEQ ID NO: 593641 - RNA, 23 nt, Human
accccauaccucccccuuccuaa

SEQ ID NO: 593642 - RNA, 18 nt, Human
acccucuccaaguguuga

SEQ ID NO: 593643 - RNA, 19 nt, Human
acugguucugccuuccucu

SEQ ID NO: 593644 - RNA, 20 nt, Human
acugucucaguccugagcag

SEQ ID NO: 593645 - RNA, 21 nt, Human
agaaaacccucucuucugcca

SEQ ID NO: 593646 - RNA, 24 nt, Human
agacauugaugaaaacacaaacaa

SEQ ID NO: 593647 - RNA, 21 nt, Human
agagagcaggacuggaggguu

SEQ ID NO: 593648 - RNA, 27 nt, Human
agagagggaggggacccaaggcucagg

SEQ ID NO: 593649 - RNA, 22 nt, Human
agagaucuggggagagaugagu

SEQ ID NO: 593650 - RNA, 20 nt, Human
agagggaggggacccaaggc

SEQ ID NO: 593651 - RNA, 23 nt, Human
agagggaggggacccaaggcuca

SEQ ID NO: 593652 - RNA, 20 nt, Human
agaggugacuaaggagccgc

SEQ ID NO: 593653 - RNA, 24 nt, Human
agccagucauggccaaauaaccuc

SEQ ID NO: 593654 - RNA, 22 nt, Human
agccugaacuuggcuuggagac

SEQ ID NO: 593655 - RNA, 21 nt, Human
aggagggaagaagagagggag

SEQ ID NO: 593656 - RNA, 20 nt, Human
aggauuccccgacccagagc

SEQ ID NO: 593657 - RNA, 20 nt, Human
aggcagcuucagaggccugg

SEQ ID NO: 593658 - RNA, 19 nt, Human
aggcagugaggagggguga

SEQ ID NO: 593659 - RNA, 21 nt, Human
aggcuggggaguccaggcggg

SEQ ID NO: 593660 - RNA, 22 nt, Human
aggcuggggaguccaggcgggg

SEQ ID NO: 593661 - RNA, 27 nt, Human
agggaagaagagagggaggggacccaa

SEQ ID NO: 593662 - RNA, 22 nt, Human
agggagcggggaaggagggaag

SEQ ID NO: 593663 - RNA, 19 nt, Human
agggcaggguggggguaga

SEQ ID NO: 593664 - RNA, 18 nt, Human
aggggaacacaggcugga

SEQ ID NO: 593665 - RNA, 22 nt, Human
aggguuccuucugguaccuucu

SEQ ID NO: 593666 - RNA, 21 nt, Human
agugcugguuccuccaaguga

SEQ ID NO: 593667 - RNA, 21 nt, Human
aguggcuguguccugggugac

SEQ ID NO: 593668 - RNA, 24 nt, Human
auguaggcccccaggacugcaggg

SEQ ID NO: 593669 - RNA, 22 nt, Human
auuaggguucuaaaauccugcg

SEQ ID NO: 593670 - RNA, 23 nt, Human
caaacaaacccucagcucccgga

SEQ ID NO: 593671 - RNA, 19 nt, Human
caaaugagagagagagaga

SEQ ID NO: 593672 - RNA, 21 nt, Human
caaccaccaagaccucccagu

SEQ ID NO: 593673 - RNA, 22 nt, Human
caagaucagccagucauggcca

SEQ ID NO: 593674 - RNA, 24 nt, Human
caagcuccuuuccuucccaccuuc

SEQ ID NO: 593675 - RNA, 23 nt, Human
caaggaaggcuuuaucuuccuca

SEQ ID NO: 593676 - RNA, 23 nt, Human
cacaaacaaacccucaaugacca

SEQ ID NO: 593677 - RNA, 24 nt, Human
cacaaacaaacccucaaugaccaa

SEQ ID NO: 593678 - RNA, 27 nt, Human
cacaaacaaacccucaaugaccaaaca

SEQ ID NO: 593679 - RNA, 22 nt, Human
cacaaccugaaauagaugcaga

SEQ ID NO: 593680 - RNA, 21 nt, Human
cacccagucuugggcccaugu

SEQ ID NO: 593681 - RNA, 22 nt, Human
caccucccucuggagauaagcc

SEQ ID NO: 593682 - RNA, 18 nt, Human
cacgcugccucucagcug

SEQ ID NO: 593683 - RNA, 18 nt, Human
cacugagcugaccuuucc

SEQ ID NO: 593684 - RNA, 19 nt, Human
cagacugcccccgcccucc

SEQ ID NO: 593685 - RNA, 21 nt, Human
cagagcacuggaaccauggca

SEQ ID NO: 593686 - RNA, 23 nt, Human
cagccaagauggggcugacuuug

SEQ ID NO: 593687 - RNA, 20 nt, Human
caggcgccugguccgggcuc

SEQ ID NO: 593688 - RNA, 18 nt, Human
cagugugucaagaagggc

SEQ ID NO: 593689 - RNA, 24 nt, Human
cauaacuaacuaaggcagcccaca

SEQ ID NO: 593690 - RNA, 22 nt, Human
cauaagaaaggacacaggugac

SEQ ID NO: 593691 - RNA, 20 nt, Human
ccaaauaaccucauuccuga

SEQ ID NO: 593692 - RNA, 20 nt, Human
ccaccaagaccucccagucc

SEQ ID NO: 593693 - RNA, 23 nt, Human
ccagagaaguaagaguccuagaa

SEQ ID NO: 593694 - RNA, 23 nt, Human
ccagagagcaggacuggaggguu

SEQ ID NO: 593695 - RNA, 20 nt, Human
ccaggacacacgagccccca

SEQ ID NO: 593696 - RNA, 19 nt, Human
ccauguaggcccccaggac

SEQ ID NO: 593697 - RNA, 18 nt, Human
cccaagcucaagguucug

SEQ ID NO: 593698 - RNA, 18 nt, Human
cccauaccucccccuucc

SEQ ID NO: 593699 - RNA, 23 nt, Human
cccauaccucccccuuccuaaca

SEQ ID NO: 593700 - RNA, 18 nt, Human
cccaugcacacgcacaca

SEQ ID NO: 593701 - RNA, 20 nt, Human
cccaugcacacgcacacaca

SEQ ID NO: 593702 - RNA, 19 nt, Human
ccccaaaccccaggccuca

SEQ ID NO: 593703 - RNA, 21 nt, Human
ccccaguucaauucccaagcu

SEQ ID NO: 593704 - RNA, 20 nt, Human
ccccauaccucccccuuccu

SEQ ID NO: 593705 - RNA, 22 nt, Human
ccccauaccucccccuuccuaa

SEQ ID NO: 593706 - RNA, 19 nt, Human
cccccaaaccccaggccuc

SEQ ID NO: 593707 - RNA, 22 nt, Human
ccccgaguggcuguguccuggg

SEQ ID NO: 593708 - RNA, 20 nt, Human
cccuacuccaaggucuucuc

SEQ ID NO: 593709 - RNA, 18 nt, Human
cccucaaugaccaaacaa

SEQ ID NO: 593710 - RNA, 18 nt, Human
cccugaacaucugggccc

SEQ ID NO: 593711 - RNA, 18 nt, Human
ccucccugcccuggcccu

SEQ ID NO: 593712 - RNA, 22 nt, Human
ccuccgaagcccucugcugccc

SEQ ID NO: 593713 - RNA, 23 nt, Human
ccucucugagugaggaacaggga

SEQ ID NO: 593714 - RNA, 24 nt, Human
ccucucuucugccauuuccagaag

SEQ ID NO: 593715 - RNA, 22 nt, Human
ccucuggagauaagccugaccu

SEQ ID NO: 593716 - RNA, 24 nt, Human
ccugcuugcucuccucccuuaagg

SEQ ID NO: 593717 - RNA, 22 nt, Human
ccuggaccagggucuucagagc

SEQ ID NO: 593718 - RNA, 18 nt, Human
cgaguggcuguguccugg

SEQ ID NO: 593719 - RNA, 24 nt, Human
cgcagggaacccacguuggcucca

SEQ ID NO: 593720 - RNA, 20 nt, Human
cuagaaccaagagccacaac

SEQ ID NO: 593721 - RNA, 23 nt, Human
cucacccagucuugggcccaugu

SEQ ID NO: 593722 - RNA, 24 nt, Human
cucaggauuccccgacccagagcc

SEQ ID NO: 593723 - RNA, 22 nt, Human
cucauaacuaacuaaggcagcc

SEQ ID NO: 593724 - RNA, 20 nt, Human
cuccaaguguugaccuugga

SEQ ID NO: 593725 - RNA, 24 nt, Human
cugcacgcugccucucagcugccu

SEQ ID NO: 593726 - RNA, 19 nt, Human
cugcccccucuaguuuuug

SEQ ID NO: 593727 - RNA, 21 nt, Human
cuucccaccuucacaucacug

SEQ ID NO: 593728 - RNA, 22 nt, Human
cuugagacccucuccucccagg

SEQ ID NO: 593729 - RNA, 20 nt, Human
cuuugcccuaagccugaugc

SEQ ID NO: 593730 - RNA, 26 nt, Human
gaaaggacacaggugaccccaguuca

SEQ ID NO: 593731 - RNA, 19 nt, Human
gaacagcacugagcugacc

SEQ ID NO: 593732 - RNA, 21 nt, Human
gaagggcagcaagaucgggag

SEQ ID NO: 593733 - RNA, 20 nt, Human
gaagucaccccauaccuccc

SEQ ID NO: 593734 - RNA, 19 nt, Human
gacaagcaaccuuguauuu

SEQ ID NO: 593735 - RNA, 19 nt, Human
gaccuuggaggcugucucu

SEQ ID NO: 593736 - RNA, 18 nt, Human
gacuaaggagccgcaggg

SEQ ID NO: 593737 - RNA, 19 nt, Human
gacugcccccgcccuccuu

SEQ ID NO: 593738 - RNA, 18 nt, Human
gagacccucuccucccag

SEQ ID NO: 593739 - RNA, 20 nt, Human
gagcccccacccccauucaa

SEQ ID NO: 593740 - RNA, 23 nt, Human
gaucagccagucauggccaaaua

SEQ ID NO: 593741 - RNA, 22 nt, Human
gcacagguguggccagagagca

SEQ ID NO: 593742 - RNA, 20 nt, Human
gcagacugcccccgcccucc

SEQ ID NO: 593743 - RNA, 22 nt, Human
gcccccucuaguuuuugguuug

SEQ ID NO: 593744 - RNA, 19 nt, Human
gcccuuagccagagaagua

SEQ ID NO: 593745 - RNA, 20 nt, Human
gccgugagcauuuuacuccu

SEQ ID NO: 593746 - RNA, 23 nt, Human
gcugucucuucccagcccuuccc

SEQ ID NO: 593747 - RNA, 21 nt, Human
gcuuuacaaagacauugauga

SEQ ID NO: 593748 - RNA, 19 nt, Human
ggaaggagggaagaagaga

SEQ ID NO: 593749 - RNA, 18 nt, Human
ggacacaggugaccccag

SEQ ID NO: 593750 - RNA, 22 nt, Human
ggagggaagaagagagggaggg

SEQ ID NO: 593751 - RNA, 20 nt, Human
ggaucagcuggggcagcggg

SEQ ID NO: 593752 - RNA, 19 nt, Human
ggcaggguggggguagaag

SEQ ID NO: 593753 - RNA, 22 nt, Human
ggccauuuccucaugccuuacc

SEQ ID NO: 593754 - RNA, 19 nt, Human
ggcugcacgcugccucuca

SEQ ID NO: 593755 - RNA, 18 nt, Human
gggaagaagagagggagg

SEQ ID NO: 593756 - RNA, 22 nt, Human
gggaagaagagagggaggggac

SEQ ID NO: 593757 - RNA, 21 nt, Human
gggaaggagggaagaagagag

SEQ ID NO: 593758 - RNA, 21 nt, Human
gggaaggagggaagaagagag

SEQ ID NO: 593759 - RNA, 20 nt, Human
gggagggagguauggggugg

SEQ ID NO: 593760 - RNA, 23 nt, Human
guccccucaguauccucccuaaa

SEQ ID NO: 593761 - RNA, 21 nt, Human
gucucuucccagcccuucccu

SEQ ID NO: 593762 - RNA, 19 nt, Human
gucuuucagaaagaagaug

SEQ ID NO: 593763 - RNA, 18 nt, Human
gugcugguuccuccaagu

SEQ ID NO: 593764 - RNA, 24 nt, Human
guggggaucagcuggggcagcggg

SEQ ID NO: 593765 - RNA, 22 nt, Human
uaccagugcugcugacuuugcc

SEQ ID NO: 593766 - RNA, 22 nt, Human
uaggcccccaggacugcaggga

SEQ ID NO: 593767 - RNA, 18 nt, Human
uaugauggguagucaagg

SEQ ID NO: 593768 - RNA, 19 nt, Human
ucacccagucuugggccca

SEQ ID NO: 593769 - RNA, 18 nt, Human
ucacugaggaugagaaga

SEQ ID NO: 593770 - RNA, 19 nt, Human
uccaaggucuucucagagu

SEQ ID NO: 593771 - RNA, 21 nt, Human
uccaagugaggggaacacagg

SEQ ID NO: 593772 - RNA, 19 nt, Human
uccacgcacacucccaugc

SEQ ID NO: 593773 - RNA, 22 nt, Human
uccacgcacacucccaugcaca

SEQ ID NO: 593774 - RNA, 18 nt, Human
ucccaaugccaagcuccu

SEQ ID NO: 593775 - RNA, 19 nt, Human
ucccaaugccaagcuccuu

SEQ ID NO: 593776 - RNA, 19 nt, Human
ucccaggacacacgagccc

SEQ ID NO: 593777 - RNA, 23 nt, Human
ucccaggacacacgagcccccac

SEQ ID NO: 593778 - RNA, 18 nt, Human
uccccgacccagagcccc

SEQ ID NO: 593779 - RNA, 24 nt, Human
ucccgccggcuccaggcuucgcgg

SEQ ID NO: 593780 - RNA, 19 nt, Human
ucccucuggagauaagccu

SEQ ID NO: 593781 - RNA, 19 nt, Human
ucccucuggagauaagccu

SEQ ID NO: 593782 - RNA, 21 nt, Human
ucccugaacaucugggcccca

SEQ ID NO: 593783 - RNA, 21 nt, Human
ucucagaguggccuggggucc

SEQ ID NO: 593784 - RNA, 20 nt, Human
ucugccaagacucucaccca

SEQ ID NO: 593785 - RNA, 21 nt, Human
ucuugggcccauguaggcccc

SEQ ID NO: 593786 - RNA, 19 nt, Human
ugaaaacacaaacaaaccc

SEQ ID NO: 593787 - RNA, 22 nt, Human
ugaaaacacaaacaaacccuca

SEQ ID NO: 593788 - RNA, 23 nt, Human
ugaaaacacaaacaaacccucaa

SEQ ID NO: 593789 - RNA, 19 nt, Human
ugaaaugagaagucuggcc

SEQ ID NO: 593790 - RNA, 21 nt, Human
ugaccuuuccccccaaacccc

SEQ ID NO: 593791 - RNA, 20 nt, Human
ugacugguucugccuuccuc

SEQ ID NO: 593792 - RNA, 22 nt, Human
ugagaaaacccucucuucugcc

SEQ ID NO: 593793 - RNA, 23 nt, Human
ugagaaaacccucucuucugcca

SEQ ID NO: 593794 - RNA, 19 nt, Human
ugagagagagagagaucac

SEQ ID NO: 593795 - RNA, 23 nt, Human
ugagagagagagagaucacagug

SEQ ID NO: 593796 - RNA, 23 nt, Human
ugaggaggggugaggacaucuaa

SEQ ID NO: 593797 - RNA, 27 nt, Human
ugaggaggggugaggacaucuaaugaa

SEQ ID NO: 593798 - RNA, 18 nt, Human
ugagugaauuaugugagu

SEQ ID NO: 593799 - RNA, 22 nt, Human
ugaugaaaacacaaacaaaccc

SEQ ID NO: 593800 - RNA, 21 nt, Human
ugcaaaggcucugccaagacu

SEQ ID NO: 593801 - RNA, 24 nt, Human
ugccuuaccuguuuuccucccuca

SEQ ID NO: 593802 - RNA, 22 nt, Human
ugcugcugacuuugccccgucc

SEQ ID NO: 593803 - RNA, 22 nt, Human
uggacucuaaguuccaugaauc

SEQ ID NO: 593804 - RNA, 19 nt, Human
uggccaaauaaccucauuc

SEQ ID NO: 593805 - RNA, 20 nt, Human
ugggagagggcgaauccugg

SEQ ID NO: 593806 - RNA, 21 nt, Human
ugggagagggcgaauccugga

SEQ ID NO: 593807 - RNA, 23 nt, Human
ugggagagggcgaauccuggacc

SEQ ID NO: 593808 - RNA, 22 nt, Human
ugguugaagucccaagaagcug

SEQ ID NO: 593809 - RNA, 24 nt, Human
ugguuugauaucagcccuucugca

SEQ ID NO: 593810 - RNA, 23 nt, Human
uguagagaugauaucccagucca

SEQ ID NO: 593811 - RNA, 26 nt, Human
uucacaucacugaggaugagaagagg

SEQ ID NO: 593812 - RNA, 22 nt, Human
uuccagaagcuggggccacacc

SEQ ID NO: 593813 - RNA, 23 nt, Human
uucccaggacacacgagccccca

SEQ ID NO: 593814 - RNA, 22 nt, Human
uuccugaacugguugaaaccag

SEQ ID NO: 593815 - RNA, 24 nt, Human
uuccugcagucuuguagaacugug

SEQ ID NO: 593816 - RNA, 20 nt, Human
uugaaaccaguggguuaacc

SEQ ID NO: 593817 - RNA, 21 nt, Human
uugaaaccaguggguuaaccc

SEQ ID NO: 593818 - RNA, 20 nt, Human
uugggcccauguaggccccc

SEQ ID NO: 593819 - RNA, 21 nt, Human
uuggggaaaaaaaaaacaaaa

SEQ ID NO: 593820 - RNA, 23 nt, Human
uuucagaaagaagaugguugaag

SEQ ID NO: 593821 - RNA, 21 nt, Human
uuuugcugggguuuaaacuuc

SEQ ID NO: 593822 - RNA, 20 nt, Human
uuuuuuuuaaguuugucugg

SEQ ID NO: 593823 - RNA, 21 nt, Human
aagaaagacuaaaauguggua

SEQ ID NO: 593824 - RNA, 25 nt, Human
accacagaagcccccaagugaaccc

SEQ ID NO: 593825 - RNA, 22 nt, Human
agcccccaagugaaccgaauuc

SEQ ID NO: 593826 - RNA, 19 nt, Human
cacagaagcccccaaguga

SEQ ID NO: 593827 - RNA, 23 nt, Human
cacagaagcccccaagugaaccg

SEQ ID NO: 593828 - RNA, 19 nt, Human
cagggcagucucucuggag

SEQ ID NO: 593829 - RNA, 25 nt, Human
cccaggagaaauccauuuugcugcc

SEQ ID NO: 593830 - RNA, 21 nt, Human
ggcgugcagggcagucucucu

SEQ ID NO: 593831 - RNA, 21 nt, Human
uaacuuuguucuccccaggag

SEQ ID NO: 593832 - RNA, 25 nt, Human
uagcacaaucacaguccugucacac

SEQ ID NO: 593833 - RNA, 25 nt, Human
ucagugucccuuaacuuuguucucc

SEQ ID NO: 593834 - RNA, 19 nt, Human
ucuugugcauuuuguacau

SEQ ID NO: 593835 - RNA, 20 nt, Human
ucuugugcauuuuguacauu

SEQ ID NO: 593836 - RNA, 21 nt, Human
ugcugccaaaugugaccagca

SEQ ID NO: 593837 - RNA, 22 nt, Human
uggcccaaggcauggcgugcag

SEQ ID NO: 593838 - RNA, 22 nt, Human
uggcgugcagggcagucucucu

SEQ ID NO: 593839 - RNA, 21 nt, Human
uguccuccacucugucuucau

SEQ ID NO: 593840 - RNA, 23 nt, Human
ugucuucauuuacugcuccagga

SEQ ID NO: 593841 - RNA, 22 nt, Human
uuuguguccuccacucugucuu

SEQ ID NO: 593842 - RNA, 21 nt, Human
aaaaaaaaacccugaauuuac

SEQ ID NO: 593843 - RNA, 22 nt, Human
aaaaaaacaaaaaaaaacccug

SEQ ID NO: 593844 - RNA, 23 nt, Human
aaaaaacaaaaaaaaacccugaa

SEQ ID NO: 593845 - RNA, 26 nt, Human
aaaaaacccugaauuuacagaacuaa

SEQ ID NO: 593846 - RNA, 26 nt, Human
aaaacaaaaaaacaaaaaaaaacccc

SEQ ID NO: 593847 - RNA, 21 nt, Human
aagcauuuuuucggcuuaaaa

SEQ ID NO: 593848 - RNA, 24 nt, Human
aagcuaagcaagggcccagaaauc

SEQ ID NO: 593849 - RNA, 24 nt, Human
acaggcuggacacaguggcucaca

SEQ ID NO: 593850 - RNA, 24 nt, Human
accccgucucuacuaaaacuacaa

SEQ ID NO: 593851 - RNA, 21 nt, Human
accuguaauccaagcacuucg

SEQ ID NO: 593852 - RNA, 21 nt, Human
acucugugacuaagacaauug

SEQ ID NO: 593853 - RNA, 21 nt, Human
acugcuucugcaaacaguuuu

SEQ ID NO: 593854 - RNA, 18 nt, Human
acuguacuccagccuggg

SEQ ID NO: 593855 - RNA, 23 nt, Human
acuguacuccagccugggcgaua

SEQ ID NO: 593856 - RNA, 24 nt, Human
acuguacuccagccugggcgauaa

SEQ ID NO: 593857 - RNA, 24 nt, Human
agacaggaagcaagcuaagcaagg

SEQ ID NO: 593858 - RNA, 20 nt, Human
agaggcagguagaucacuug

SEQ ID NO: 593859 - RNA, 22 nt, Human
agagguugcaguggacugagau

SEQ ID NO: 593860 - RNA, 24 nt, Human
agagguugcaguggacugagauug

SEQ ID NO: 593861 - RNA, 22 nt, Human
agaucacuugaggucaggaguu

SEQ ID NO: 593862 - RNA, 21 nt, Human
agcaagcuaagcaagggccca

SEQ ID NO: 593863 - RNA, 19 nt, Human
agcccgguaaggugaaacc

SEQ ID NO: 593864 - RNA, 24 nt, Human
aggcaggagaacugcuuaaacccg

SEQ ID NO: 593865 - RNA, 26 nt, Human
aggcagguagaucacuugaggucagg

SEQ ID NO: 593866 - RNA, 24 nt, Human
aggcgugguggggcacaccuguaa

SEQ ID NO: 593867 - RNA, 18 nt, Human
aggcugaggcaggagaac

SEQ ID NO: 593868 - RNA, 23 nt, Human
aggcugcaugaagaaaaaaaaaa

SEQ ID NO: 593869 - RNA, 22 nt, Human
agguagaucacuugaggucagg

SEQ ID NO: 593870 - RNA, 24 nt, Human
aguggcucacaccuguaauccaag

SEQ ID NO: 593871 - RNA, 18 nt, Human
auaaaccuacucugugac

SEQ ID NO: 593872 - RNA, 24 nt, Human
aucacuguacuccagccugggcga

SEQ ID NO: 593873 - RNA, 20 nt, Human
aucacuugaggucaggaguu

SEQ ID NO: 593874 - RNA, 24 nt, Human
auugcaucacuguacuccagccug

SEQ ID NO: 593875 - RNA, 24 nt, Human
caaaggcacugauuaaagucaaga

SEQ ID NO: 593876 - RNA, 24 nt, Human
caagggcccagaaaucccaaaggc

SEQ ID NO: 593877 - RNA, 19 nt, Human
cacaccuguaauccaagca

SEQ ID NO: 593878 - RNA, 18 nt, Human
cacaccuguaaucccagc

SEQ ID NO: 593879 - RNA, 22 nt, Human
caccuguaauccaagcacuucg

SEQ ID NO: 593880 - RNA, 21 nt, Human
caccuguaaucccagcuacuc

SEQ ID NO: 593881 - RNA, 24 nt, Human
caccuguaaucccagcuacucagg

SEQ ID NO: 593882 - RNA, 19 nt, Human
cacuguacuccagccuggg

SEQ ID NO: 593883 - RNA, 20 nt, Human
cacuguacuccagccugggc

SEQ ID NO: 593884 - RNA, 20 nt, Human
cacuguacuccagccugggc

SEQ ID NO: 593885 - RNA, 20 nt, Human
cacuguacuccagccugggc

SEQ ID NO: 593886 - RNA, 21 nt, Human
cacuguacuccagccugggcg

SEQ ID NO: 593887 - RNA, 22 nt, Human
cacuguacuccagccugggcga

SEQ ID NO: 593888 - RNA, 22 nt, Human
cacuguacuccagccugggcga

SEQ ID NO: 593889 - RNA, 24 nt, Human
cacuguacuccagccugggcgaua

SEQ ID NO: 593890 - RNA, 21 nt, Human
cacuugaggucaggaguuuua

SEQ ID NO: 593891 - RNA, 27 nt, Human
cagaggcagguagaucacuugagguca

SEQ ID NO: 593892 - RNA, 23 nt, Human
cagagguaauacaaggcuuugcu

SEQ ID NO: 593893 - RNA, 24 nt, Human
cagcuacucaggaggcugaggcag

SEQ ID NO: 593894 - RNA, 24 nt, Human
cagguagaucacuugaggucagga

SEQ ID NO: 593895 - RNA, 20 nt, Human
caucacuguacuccagccug

SEQ ID NO: 593896 - RNA, 24 nt, Human
cauuacaaaaucuuccucuauggg

SEQ ID NO: 593897 - RNA, 23 nt, Human
ccaaauguugauacagaacacuc

SEQ ID NO: 593898 - RNA, 21 nt, Human
ccacacuuggaaccgaugcag

SEQ ID NO: 593899 - RNA, 22 nt, Human
ccagaaaucccaaaggcacuga

SEQ ID NO: 593900 - RNA, 21 nt, Human
ccagcccgguaaggugaaacc

SEQ ID NO: 593901 - RNA, 24 nt, Human
cccaaaacccagcuucugaucuug

SEQ ID NO: 593902 - RNA, 22 nt, Human
cccagauaaaccuacucuguga

SEQ ID NO: 593903 - RNA, 22 nt, Human
ccccaaaacccagcuucugauc

SEQ ID NO: 593904 - RNA, 19 nt, Human
cccgguaaggugaaacccc

SEQ ID NO: 593905 - RNA, 24 nt, Human
ccuguaauccaagcacuucgggag

SEQ ID NO: 593906 - RNA, 21 nt, Human
ccuguaaucccagcuacucag

SEQ ID NO: 593907 - RNA, 21 nt, Human
ccuguacuagaauauauuaag

SEQ ID NO: 593908 - RNA, 24 nt, Human
ccugucuuuaaaaaaaaaaaaaaa

SEQ ID NO: 593909 - RNA, 24 nt, Human
cgggaggcagaggcagguagauca

SEQ ID NO: 593910 - RNA, 22 nt, Human
cgggagggcagagguugcagug

SEQ ID NO: 593911 - RNA, 24 nt, Human
cgguaaggugaaaccccgucucua

SEQ ID NO: 593912 - RNA, 23 nt, Human
cuaaaacuacaaaaauuagcccu

SEQ ID NO: 593913 - RNA, 20 nt, Human
cuaagacaaguguagauauc

SEQ ID NO: 593914 - RNA, 21 nt, Human
cucaaccccaaaacccagcuu

SEQ ID NO: 593915 - RNA, 24 nt, Human
cucacaccuguaauccaagcacuu

SEQ ID NO: 593916 - RNA, 21 nt, Human
cuguaaucccagcuacucagg

SEQ ID NO: 593917 - RNA, 22 nt, Human
cuuaaaacggguacuuguuuuc

SEQ ID NO: 593918 - RNA, 22 nt, Human
cuugacuaaguucauaauuacu

SEQ ID NO: 593919 - RNA, 26 nt, Human
cuuuaaaaaaaaaaaaaaaacuucua

SEQ ID NO: 593920 - RNA, 23 nt, Human
gacacaguggcucacaccuguaa

SEQ ID NO: 593921 - RNA, 21 nt, Human
gagaaaagcaggagagguagc

SEQ ID NO: 593922 - RNA, 20 nt, Human
gauaaagcgagacccugucu

SEQ ID NO: 593923 - RNA, 24 nt, Human
gaucacuugaggucaggaguuuua

SEQ ID NO: 593924 - RNA, 25 nt, Human
gaucacuugaggucaggaguuuuag

SEQ ID NO: 593925 - RNA, 22 nt, Human
gcgauaaagcgagacccugucu

SEQ ID NO: 593926 - RNA, 20 nt, Human
gcuggacacaguggcucaca

SEQ ID NO: 593927 - RNA, 19 nt, Human
ggcagagguugcaguggac

SEQ ID NO: 593928 - RNA, 23 nt, Human
ggcagagguugcaguggacugag

SEQ ID NO: 593929 - RNA, 21 nt, Human
gggcacaccuguaaucccagc

SEQ ID NO: 593930 - RNA, 24 nt, Human
gggcagagguugcaguggacugag

SEQ ID NO: 593931 - RNA, 21 nt, Human
gguaaggugaaaccccgucuc

SEQ ID NO: 593932 - RNA, 24 nt, Human
gguggggcacaccuguaaucccag

SEQ ID NO: 593933 - RNA, 19 nt, Human
gucaguucuucagagccga

SEQ ID NO: 593934 - RNA, 21 nt, Human
guugcaguggacugagauugc

SEQ ID NO: 593935 - RNA, 21 nt, Human
guuuuccggccauaauuauuc

SEQ ID NO: 593936 - RNA, 24 nt, Human
uaaaaaaaacaaaaaaacaaaaaa

SEQ ID NO: 593937 - RNA, 21 nt, Human
uaaaacuacaaaaauuagcca

SEQ ID NO: 593938 - RNA, 24 nt, Human
uaagcaagggcccagaaaucccaa

SEQ ID NO: 593939 - RNA, 20 nt, Human
uacaauaugauugugaauaa

SEQ ID NO: 593940 - RNA, 24 nt, Human
uacuaaaacuacaaaaauuagcca

SEQ ID NO: 593941 - RNA, 22 nt, Human
uacuccagccugggcgauaaag

SEQ ID NO: 593942 - RNA, 24 nt, Human
uacuccagccugggcgauaaagcg

SEQ ID NO: 593943 - RNA, 25 nt, Human
uagaaaggcugcaugaagaaaaaaa

SEQ ID NO: 593944 - RNA, 23 nt, Human
uagaucacuugaggucaggaguu

SEQ ID NO: 593945 - RNA, 24 nt, Human
uagaucacuugaggucaggaguuu

SEQ ID NO: 593946 - RNA, 27 nt, Human
uagaucacuugaggucaggaguuuuag

SEQ ID NO: 593947 - RNA, 22 nt, Human
uaguccaauaaggucuaucugu

SEQ ID NO: 593948 - RNA, 23 nt, Human
uagugucaguucuucagagccga

SEQ ID NO: 593949 - RNA, 21 nt, Human
uauauucacuuaacauauuaa

SEQ ID NO: 593950 - RNA, 26 nt, Human
uauuaaaauuaauauccaucccagau

SEQ ID NO: 593951 - RNA, 27 nt, Human
uauuaaaauuaauauccaucccagaua

SEQ ID NO: 593952 - RNA, 21 nt, Human
uauuugaauucccaucugaau

SEQ ID NO: 593953 - RNA, 23 nt, Human
ucaauucaugaaaaggaaacgcc

SEQ ID NO: 593954 - RNA, 20 nt, Human
ucacuguacuccagccuggg

SEQ ID NO: 593955 - RNA, 21 nt, Human
ucacuguacuccagccugggc

SEQ ID NO: 593956 - RNA, 23 nt, Human
ucacuguacuccagccugggcga

SEQ ID NO: 593957 - RNA, 24 nt, Human
ucacuguacuccagccugggcgau

SEQ ID NO: 593958 - RNA, 19 nt, Human
ucaugaaaaggaaacgccc

SEQ ID NO: 593959 - RNA, 24 nt, Human
uccacagaacugcuucugcaaaca

SEQ ID NO: 593960 - RNA, 19 nt, Human
uccagagaggauucauauu

SEQ ID NO: 593961 - RNA, 24 nt, Human
uccagccugggcgauaaagcgaga

SEQ ID NO: 593962 - RNA, 20 nt, Human
uccuuuagcaggauucccag

SEQ ID NO: 593963 - RNA, 24 nt, Human
ucuaucauuccucugaccugaaac

SEQ ID NO: 593964 - RNA, 21 nt, Human
ucucuacuaaaacuacaaaaa

SEQ ID NO: 593965 - RNA, 20 nt, Human
ucuuuaaaaaaaaaaaaaaa

SEQ ID NO: 593966 - RNA, 24 nt, Human
ugaggcaggagaacugcuuaaacc

SEQ ID NO: 593967 - RNA, 23 nt, Human
ugauugugaauaauggggggagg

SEQ ID NO: 593968 - RNA, 21 nt, Human
ugcaucacuguacuccagccu

SEQ ID NO: 593969 - RNA, 22 nt, Human
ugcaucacuguacuccagccug

SEQ ID NO: 593970 - RNA, 25 nt, Human
uggaaccgaugcagucccauuacca

SEQ ID NO: 593971 - RNA, 18 nt, Human
uggacccucuccagagag

SEQ ID NO: 593972 - RNA, 19 nt, Human
uggcucacaccuguaaucc

SEQ ID NO: 593973 - RNA, 20 nt, Human
uggcucacaccuguaaucca

SEQ ID NO: 593974 - RNA, 19 nt, Human
ugguagaaaggcugcauga

SEQ ID NO: 593975 - RNA, 24 nt, Human
ugguggggcacaccuguaauccca

SEQ ID NO: 593976 - RNA, 23 nt, Human
uguagagcuugcucucacacucu

SEQ ID NO: 593977 - RNA, 20 nt, Human
ugucaguucuucagagccga

SEQ ID NO: 593978 - RNA, 21 nt, Human
uguuguaagaaaaaugacaaa

SEQ ID NO: 593979 - RNA, 22 nt, Human
uuaaaaaaaacaaaaaaacaaa

SEQ ID NO: 593980 - RNA, 21 nt, Human
uuaaacccgggagggcagagg

SEQ ID NO: 593981 - RNA, 20 nt, Human
uucucaaccccaaaacccag

SEQ ID NO: 593982 - RNA, 21 nt, Human
uugcaguggacugagauugca

SEQ ID NO: 593983 - RNA, 24 nt, Human
uuguuguugccaauuguuuuuguu

SEQ ID NO: 593984 - RNA, 23 nt, Human
uuuuccggccauaauuauuccag

SEQ ID NO: 593985 - RNA, 21 nt, Human
aagaggaagagaaaggcccag

SEQ ID NO: 593986 - RNA, 18 nt, Human
acagggcagcaauaauca

SEQ ID NO: 593987 - RNA, 22 nt, Human
acuacagaggaaccagcuaggg

SEQ ID NO: 593988 - RNA, 22 nt, Human
agaaaaacagggcacgagcugg

SEQ ID NO: 593989 - RNA, 18 nt, Human
agacagaugcuggagccc

SEQ ID NO: 593990 - RNA, 19 nt, Human
agaggauggggccuucuac

SEQ ID NO: 593991 - RNA, 18 nt, Human
agcaagacccacagggca

SEQ ID NO: 593992 - RNA, 19 nt, Human
aggaagagaaaggcccaga

SEQ ID NO: 593993 - RNA, 21 nt, Human
aggaugucccagcccuuugaa

SEQ ID NO: 593994 - RNA, 26 nt, Human
aggaugucccagcccuuugaaggguc

SEQ ID NO: 593995 - RNA, 20 nt, Human
agggcaucauuaacuaugga

SEQ ID NO: 593996 - RNA, 18 nt, Human
aggggcugguuggggugg

SEQ ID NO: 593997 - RNA, 22 nt, Human
auuuuuaaaaauuugggaaagu

SEQ ID NO: 593998 - RNA, 20 nt, Human
caaagcagugcuucgagggc

SEQ ID NO: 593999 - RNA, 22 nt, Human
caagagguaugacugccagggc

SEQ ID NO: 594000 - RNA, 23 nt, Human
cacaauaucccuuaugagguagg

SEQ ID NO: 594001 - RNA, 23 nt, Human
caccacacuaugucccccaccaa

SEQ ID NO: 594002 - RNA, 21 nt, Human
cacccacuauguaccaggcac

SEQ ID NO: 594003 - RNA, 18 nt, Human
cacugugaccccguuccu

SEQ ID NO: 594004 - RNA, 22 nt, Human
cagcaauaaucauuuauccuga

SEQ ID NO: 594005 - RNA, 23 nt, Human
caucagaagcuuccccauggcaa

SEQ ID NO: 594006 - RNA, 22 nt, Human
ccaagaggaagagaaaggccca

SEQ ID NO: 594007 - RNA, 19 nt, Human
ccaaggugacccagcuggu

SEQ ID NO: 594008 - RNA, 21 nt, Human
ccagcccuuugaaggguccug

SEQ ID NO: 594009 - RNA, 22 nt, Human
cccaagucccaggaugucccag

SEQ ID NO: 594010 - RNA, 18 nt, Human
cccuugaaaaaacugaag

SEQ ID NO: 594011 - RNA, 20 nt, Human
ccuucuugagccuugguggg

SEQ ID NO: 594012 - RNA, 18 nt, Human
ccuugcugccuccagaag

SEQ ID NO: 594013 - RNA, 21 nt, Human
cuaaagccuucugcagaccca

SEQ ID NO: 594014 - RNA, 21 nt, Human
cuauggcuagaaaaacagggc

SEQ ID NO: 594015 - RNA, 24 nt, Human
cuauguaccaggcacuugggaggu

SEQ ID NO: 594016 - RNA, 18 nt, Human
cugaggccccauucagcg

SEQ ID NO: 594017 - RNA, 18 nt, Human
cugccuccagaagaagcu

SEQ ID NO: 594018 - RNA, 18 nt, Human
cuggacaggaaauggcau

SEQ ID NO: 594019 - RNA, 21 nt, Human
cuucuacucugagucugggag

SEQ ID NO: 594020 - RNA, 24 nt, Human
gagcaccagaccacuggacaagag

SEQ ID NO: 594021 - RNA, 24 nt, Human
gaggagcugugaguaaucuggggg

SEQ ID NO: 594022 - RNA, 21 nt, Human
gaguaaucugggggcuauggc

SEQ ID NO: 594023 - RNA, 19 nt, Human
gagucauacauagcaaucu

SEQ ID NO: 594024 - RNA, 21 nt, Human
gagucugggagaggggcuggu

SEQ ID NO: 594025 - RNA, 18 nt, Human
gauguuucaauaccuucu

SEQ ID NO: 594026 - RNA, 24 nt, Human
gcccuuugaaggguccuggggcuu

SEQ ID NO: 594027 - RNA, 19 nt, Human
ggagaaacagaguggccaa

SEQ ID NO: 594028 - RNA, 18 nt, Human
ggagaggggcugguuggg

SEQ ID NO: 594029 - RNA, 21 nt, Human
ggagaggggcugguuggggug

SEQ ID NO: 594030 - RNA, 22 nt, Human
ggagaucaugcuucuuacccag

SEQ ID NO: 594031 - RNA, 19 nt, Human
ggcaccugcugaggcccca

SEQ ID NO: 594032 - RNA, 18 nt, Human
gggagguauuuucucaca

SEQ ID NO: 594033 - RNA, 21 nt, Human
ggggaaaggcuaauuaccaug

SEQ ID NO: 594034 - RNA, 26 nt, Human
ggggccuucuacucugagucugggag

SEQ ID NO: 594035 - RNA, 18 nt, Human
ggguuuuauuuuuccuug

SEQ ID NO: 594036 - RNA, 19 nt, Human
uaagggacuucccaaaugc

SEQ ID NO: 594037 - RNA, 19 nt, Human
uaaggggccuaaaccauaa

SEQ ID NO: 594038 - RNA, 18 nt, Human
uaccaggcacuugggagg

SEQ ID NO: 594039 - RNA, 19 nt, Human
uaugucccccaccaaggga

SEQ ID NO: 594040 - RNA, 18 nt, Human
ucaauaccuucucucuca

SEQ ID NO: 594041 - RNA, 19 nt, Human
ucccagcaggacuacagag

SEQ ID NO: 594042 - RNA, 25 nt, Human
ucccagcccuuugaaggguccuggg

SEQ ID NO: 594043 - RNA, 19 nt, Human
ucccaggaugucccagccc

SEQ ID NO: 594044 - RNA, 22 nt, Human
uccucugugaaagguaaggggg

SEQ ID NO: 594045 - RNA, 23 nt, Human
uccucugugaaagguaagggggu

SEQ ID NO: 594046 - RNA, 18 nt, Human
uccuugcugccuccagaa

SEQ ID NO: 594047 - RNA, 18 nt, Human
ucucugcuauagccuaaa

SEQ ID NO: 594048 - RNA, 26 nt, Human
ucugcagacccacauuuaaaugagcu

SEQ ID NO: 594049 - RNA, 25 nt, Human
ucugcuauagccuaaaaaccugaac

SEQ ID NO: 594050 - RNA, 21 nt, Human
ucuggacaggaaauggcauga

SEQ ID NO: 594051 - RNA, 21 nt, Human
ugaaagguuccucugugaaag

SEQ ID NO: 594052 - RNA, 23 nt, Human
ugaacugucaccacacuaugucc

SEQ ID NO: 594053 - RNA, 18 nt, Human
ugaauaaauuaacauggg

SEQ ID NO: 594054 - RNA, 18 nt, Human
ugacccagcugguaaugg

SEQ ID NO: 594055 - RNA, 24 nt, Human
ugagacagaugcuggagcccaagu

SEQ ID NO: 594056 - RNA, 21 nt, Human
ugaggagcugugaguaaucug

SEQ ID NO: 594057 - RNA, 22 nt, Human
ugaggagcugugaguaaucugg

SEQ ID NO: 594058 - RNA, 19 nt, Human
ugagucugggagaggggcu

SEQ ID NO: 594059 - RNA, 21 nt, Human
ugagucugggagaggggcugg

SEQ ID NO: 594060 - RNA, 23 nt, Human
uggagcccaagucccaggauguc

SEQ ID NO: 594061 - RNA, 19 nt, Human
uggcaugaggagcugugag

SEQ ID NO: 594062 - RNA, 25 nt, Human
uggccaagguuguagcagcuugggc

SEQ ID NO: 594063 - RNA, 22 nt, Human
uggccugagacagaugcuggag

SEQ ID NO: 594064 - RNA, 18 nt, Human
ugggagaggggcugguug

SEQ ID NO: 594065 - RNA, 24 nt, Human
ugggagaggggcugguuggggugg

SEQ ID NO: 594066 - RNA, 21 nt, Human
uggggccuucuacucugaguc

SEQ ID NO: 594067 - RNA, 24 nt, Human
uggggcuugagaggauggggccuu

SEQ ID NO: 594068 - RNA, 18 nt, Human
ugggguggagaaacagag

SEQ ID NO: 594069 - RNA, 20 nt, Human
ugggguggagaaacagagug

SEQ ID NO: 594070 - RNA, 23 nt, Human
ugggguggagaaacagaguggcc

SEQ ID NO: 594071 - RNA, 22 nt, Human
ugguugggguggcuucggugac

SEQ ID NO: 594072 - RNA, 23 nt, Human
ugucccagcccuuugaagggucc

SEQ ID NO: 594073 - RNA, 19 nt, Human
ugucccccaccaagggaua

SEQ ID NO: 594074 - RNA, 21 nt, Human
uucaguugacccuugaaaaaa

SEQ ID NO: 594075 - RNA, 21 nt, Human
uuccuguacaccaagcucuag

SEQ ID NO: 594076 - RNA, 26 nt, Human
uugacccuugaaaaaacugaauaaau

SEQ ID NO: 594077 - RNA, 27 nt, Human
uugacccuugaaaaaacugaauaaauu

SEQ ID NO: 594078 - RNA, 23 nt, Human
uuguagcagcuugggcaccugcu

SEQ ID NO: 594079 - RNA, 21 nt, Human
uuucucacugucucugcuaua

SEQ ID NO: 594080 - RNA, 27 nt, Human
aaauauauacacauuauguuaaccuuc

SEQ ID NO: 594081 - RNA, 18 nt, Human
aaucacaguuacuuuuuu

SEQ ID NO: 594082 - RNA, 23 nt, Human
acggagcuuagcuguucucaggc

SEQ ID NO: 594083 - RNA, 18 nt, Human
aggaugaaaaaauaaaaa

SEQ ID NO: 594084 - RNA, 21 nt, Human
aggcaucugaaugggggugug

SEQ ID NO: 594085 - RNA, 21 nt, Human
caaagccuacuaaaguccaga

SEQ ID NO: 594086 - RNA, 20 nt, Human
uacaagaaucacaguuacuu

SEQ ID NO: 594087 - RNA, 21 nt, Human
uauggcaauucaccuauaaca

SEQ ID NO: 594088 - RNA, 22 nt, Human
uauggcaauucaccuauaacac

SEQ ID NO: 594089 - RNA, 22 nt, Human
uggcaauucaccuauaacacau

SEQ ID NO: 594090 - RNA, 19 nt, Human
uggggguguggagaagucc

SEQ ID NO: 594091 - RNA, 20 nt, Human
ugucaaaauaaaucagcaca

SEQ ID NO: 594092 - RNA, 19 nt, Human
uucuacaaaaguuuucuca

SEQ ID NO: 594093 - RNA, 19 nt, Human
aaaacaccccucccgccca

SEQ ID NO: 594094 - RNA, 22 nt, Human
aaaccagagcagccucaaaggg

SEQ ID NO: 594095 - RNA, 24 nt, Human
aaagugcugggauuacaggcguga

SEQ ID NO: 594096 - RNA, 25 nt, Human
aaccccaggcacugccauucagccu

SEQ ID NO: 594097 - RNA, 18 nt, Human
aaccccuuugggccugga

SEQ ID NO: 594098 - RNA, 19 nt, Human
aagcaggaagggugacaau

SEQ ID NO: 594099 - RNA, 22 nt, Human
aagcaugccacaagaugcagaa

SEQ ID NO: 594100 - RNA, 18 nt, Human
aagcuggccugccagcag

SEQ ID NO: 594101 - RNA, 24 nt, Human
aaggaggcugguggucaccagggc

SEQ ID NO: 594102 - RNA, 18 nt, Human
aaggggcccaggagcugc

SEQ ID NO: 594103 - RNA, 24 nt, Human
aaguagcugggacuuuaggugugu

SEQ ID NO: 594104 - RNA, 19 nt, Human
aagugcugggauuacaggc

SEQ ID NO: 594105 - RNA, 19 nt, Human
aagugcugggauuacaggc

SEQ ID NO: 594106 - RNA, 26 nt, Human
aagugcugggauuacaggcgugagcc

SEQ ID NO: 594107 - RNA, 18 nt, Human
acaccagaaaagcccagg

SEQ ID NO: 594108 - RNA, 19 nt, Human
acaccccucccgcccaccc

SEQ ID NO: 594109 - RNA, 22 nt, Human
accauggagggugggcagggag

SEQ ID NO: 594110 - RNA, 18 nt, Human
accauguuggccaggcug

SEQ ID NO: 594111 - RNA, 19 nt, Human
acccacaccagaaaagccc

SEQ ID NO: 594112 - RNA, 22 nt, Human
accccucccgcccacccacccc

SEQ ID NO: 594113 - RNA, 20 nt, Human
acccuucccugaacuuuucc

SEQ ID NO: 594114 - RNA, 26 nt, Human
accucacccaaccaaggagaaaauua

SEQ ID NO: 594115 - RNA, 19 nt, Human
acgcgccucugcgccgccu

SEQ ID NO: 594116 - RNA, 22 nt, Human
acucaaccaccaguaccuugcc

SEQ ID NO: 594117 - RNA, 24 nt, Human
acucaaccaccaguaccuugccac

SEQ ID NO: 594118 - RNA, 24 nt, Human
acuccugaccucaacugacccacc

SEQ ID NO: 594119 - RNA, 25 nt, Human
acucugucgcccagccuggagugca

SEQ ID NO: 594120 - RNA, 22 nt, Human
acugaaaugaugccccuacccc

SEQ ID NO: 594121 - RNA, 23 nt, Human
agaaaacaucugauucucacuga

SEQ ID NO: 594122 - RNA, 24 nt, Human
agaagcacagagcuucuccacagg

SEQ ID NO: 594123 - RNA, 18 nt, Human
agaaggggcaggagggca

SEQ ID NO: 594124 - RNA, 25 nt, Human
agagcagaguggggagaagcaccuc

SEQ ID NO: 594125 - RNA, 20 nt, Human
agcaaggucccagagcuugg

SEQ ID NO: 594126 - RNA, 23 nt, Human
agcagaguggggagaagcaccuc

SEQ ID NO: 594127 - RNA, 23 nt, Human
agccucaaccucccaaguagcug

SEQ ID NO: 594128 - RNA, 25 nt, Human
agcugcaagguuccccauggaaccu

SEQ ID NO: 594129 - RNA, 20 nt, Human
agcugccuccucccacaacc

SEQ ID NO: 594130 - RNA, 18 nt, Human
aggcacugcagaucugcc

SEQ ID NO: 594131 - RNA, 25 nt, Human
aggcuggaccugggaguagagagag

SEQ ID NO: 594132 - RNA, 18 nt, Human
agggcccagcccccucuc

SEQ ID NO: 594133 - RNA, 19 nt, Human
aggugugugccaccacacc

SEQ ID NO: 594134 - RNA, 19 nt, Human
agugauggacuacagaugg

SEQ ID NO: 594135 - RNA, 20 nt, Human
agugcaguggcgagaucuug

SEQ ID NO: 594136 - RNA, 23 nt, Human
agugcaguggcgagaucuuggcu

SEQ ID NO: 594137 - RNA, 24 nt, Human
agugcaguggcgagaucuuggcuc

SEQ ID NO: 594138 - RNA, 24 nt, Human
augagauuucaccauguuggccag

SEQ ID NO: 594139 - RNA, 20 nt, Human
augcagaaggggcaggaggg

SEQ ID NO: 594140 - RNA, 19 nt, Human
caaaccagagcagccucaa

SEQ ID NO: 594141 - RNA, 23 nt, Human
caaacccagaaacagaaaacauc

SEQ ID NO: 594142 - RNA, 24 nt, Human
caaagugcugggauuacaggcgug

SEQ ID NO: 594143 - RNA, 18 nt, Human
caaccaccaguaccuugc

SEQ ID NO: 594144 - RNA, 21 nt, Human
cacaagaugcagaaggggcag

SEQ ID NO: 594145 - RNA, 23 nt, Human
cacacagaagaccauggagggug

SEQ ID NO: 594146 - RNA, 21 nt, Human
caccaagaagcacagagcuuc

SEQ ID NO: 594147 - RNA, 22 nt, Human
caccagaaaagcccaggcuaag

SEQ ID NO: 594148 - RNA, 21 nt, Human
caccauguuggccaggcuggu

SEQ ID NO: 594149 - RNA, 24 nt, Human
caccauguuggccaggcuggucuc

SEQ ID NO: 594150 - RNA, 27 nt, Human
caccauguuggccaggcuggucucaaa

SEQ ID NO: 594151 - RNA, 20 nt, Human
cacccaccccaccguacccc

SEQ ID NO: 594152 - RNA, 20 nt, Human
cacccaggggaagcaugcca

SEQ ID NO: 594153 - RNA, 18 nt, Human
caccccucccgcccaccc

SEQ ID NO: 594154 - RNA, 19 nt, Human
caccccucccgcccaccca

SEQ ID NO: 594155 - RNA, 23 nt, Human
caccucaaccccuuugggccugg

SEQ ID NO: 594156 - RNA, 23 nt, Human
caccugccuuggacucccaaagu

SEQ ID NO: 594157 - RNA, 24 nt, Human
caccugccuuggacucccaaagug

SEQ ID NO: 594158 - RNA, 18 nt, Human
cacucugucgcccagccu

SEQ ID NO: 594159 - RNA, 22 nt, Human
cacucugucgcccagccuggag

SEQ ID NO: 594160 - RNA, 21 nt, Human
cacugcaaacucugcuuccca

SEQ ID NO: 594161 - RNA, 24 nt, Human
cagccucaaccucccaaguagcug

SEQ ID NO: 594162 - RNA, 25 nt, Human
cagccucaaccucccaaguagcugg

SEQ ID NO: 594163 - RNA, 19 nt, Human
cagccugggcagccaguga

SEQ ID NO: 594164 - RNA, 19 nt, Human
caggucccagggcccagcc

SEQ ID NO: 594165 - RNA, 22 nt, Human
caggucccagggcccagccccc

SEQ ID NO: 594166 - RNA, 20 nt, Human
caugaaaacaccccucccgc

SEQ ID NO: 594167 - RNA, 24 nt, Human
cauguuggccaggcuggucucaaa

SEQ ID NO: 594168 - RNA, 20 nt, Human
ccaaagugcugggauuacag

SEQ ID NO: 594169 - RNA, 22 nt, Human
ccaaagugcugggauuacaggc

SEQ ID NO: 594170 - RNA, 22 nt, Human
ccaaagugcugggauuacaggc

SEQ ID NO: 594171 - RNA, 24 nt, Human
ccaaagugcugggauuacaggcgu

SEQ ID NO: 594172 - RNA, 27 nt, Human
ccacccaccccaccguaccccacccac

SEQ ID NO: 594173 - RNA, 20 nt, Human
ccacccagggcagcuggcag

SEQ ID NO: 594174 - RNA, 26 nt, Human
ccaccccaccguaccccacccacucc

SEQ ID NO: 594175 - RNA, 28 nt, Human
ccagcagccacacacacacagaagacca

SEQ ID NO: 594176 - RNA, 23 nt, Human
ccagcccccucucuaaagcagga

SEQ ID NO: 594177 - RNA, 21 nt, Human
cccaaacccagaaacagaaaa

SEQ ID NO: 594178 - RNA, 23 nt, Human
cccaagcugggcugcccuugagg

SEQ ID NO: 594179 - RNA, 24 nt, Human
cccacccacucugguuucugaaag

SEQ ID NO: 594180 - RNA, 24 nt, Human
cccaccccaccguaccccacccac

SEQ ID NO: 594181 - RNA, 22 nt, Human
cccagccuggagugcaguggcg

SEQ ID NO: 594182 - RNA, 19 nt, Human
cccaggagcugccuccucc

SEQ ID NO: 594183 - RNA, 20 nt, Human
cccaggagcugccuccuccc

SEQ ID NO: 594184 - RNA, 22 nt, Human
cccaggagcugccuccucccac

SEQ ID NO: 594185 - RNA, 19 nt, Human
cccaggcuaagccccaaga

SEQ ID NO: 594186 - RNA, 20 nt, Human
cccagguucaagugaucuuc

SEQ ID NO: 594187 - RNA, 18 nt, Human
ccccaagcugggcugccc

SEQ ID NO: 594188 - RNA, 24 nt, Human
ccccaccguaccccacccacucug

SEQ ID NO: 594189 - RNA, 20 nt, Human
ccccagggagggggaaugug

SEQ ID NO: 594190 - RNA, 23 nt, Human
ccccagggccuuugcgagucaga

SEQ ID NO: 594191 - RNA, 19 nt, Human
ccccucccugccaacccca

SEQ ID NO: 594192 - RNA, 20 nt, Human
ccccucccugccaaccccag

SEQ ID NO: 594193 - RNA, 22 nt, Human
cccuugaggagcugaguguggc

SEQ ID NO: 594194 - RNA, 18 nt, Human
ccucaucucuccaaaggg

SEQ ID NO: 594195 - RNA, 19 nt, Human
ccucccgcccacccacccc

SEQ ID NO: 594196 - RNA, 20 nt, Human
ccucccgcccacccacccca

SEQ ID NO: 594197 - RNA, 23 nt, Human
ccucugcgccgccuccgcugcuc

SEQ ID NO: 594198 - RNA, 23 nt, Human
ccugaccucaacugacccaccug

SEQ ID NO: 594199 - RNA, 21 nt, Human
ccuucaggucccagggcccag

SEQ ID NO: 594200 - RNA, 19 nt, Human
ccuugcuugugguuuuucu

SEQ ID NO: 594201 - RNA, 23 nt, Human
cucacugcaaacucugcuuccca

SEQ ID NO: 594202 - RNA, 18 nt, Human
cucugcuucugcauucag

SEQ ID NO: 594203 - RNA, 18 nt, Human
cugcuucccagguucaag

SEQ ID NO: 594204 - RNA, 19 nt, Human
cugggacuuuaggugugug

SEQ ID NO: 594205 - RNA, 25 nt, Human
cuguuuuguauuuuuaguacagaug

SEQ ID NO: 594206 - RNA, 23 nt, Human
cuucccagguucaagugaucuuc

SEQ ID NO: 594207 - RNA, 23 nt, Human
cuuuuccgcaguuucagaggaga

SEQ ID NO: 594208 - RNA, 24 nt, Human
gaacuuuuccgcaguuucagagga

SEQ ID NO: 594209 - RNA, 23 nt, Human
gaccauggagggugggcagggag

SEQ ID NO: 594210 - RNA, 22 nt, Human
gacccuucccugaacuuuuccg

SEQ ID NO: 594211 - RNA, 23 nt, Human
gaccucaacugacccaccugccu

SEQ ID NO: 594212 - RNA, 21 nt, Human
gagacuggaagguggaaaggu

SEQ ID NO: 594213 - RNA, 22 nt, Human
gagauuucaccauguuggccag

SEQ ID NO: 594214 - RNA, 19 nt, Human
gagcagaguggggagaagc

SEQ ID NO: 594215 - RNA, 26 nt, Human
gagcagccucaaagggaagggaacgc

SEQ ID NO: 594216 - RNA, 18 nt, Human
gauuacaggcgugagccc

SEQ ID NO: 594217 - RNA, 22 nt, Human
gcaaacucugcuucccagguuc

SEQ ID NO: 594218 - RNA, 26 nt, Human
gcccacccaccccaccguaccccacc

SEQ ID NO: 594219 - RNA, 20 nt, Human
gccccucccugccaacccca

SEQ ID NO: 594220 - RNA, 21 nt, Human
gccgaggguuccccggacccu

SEQ ID NO: 594221 - RNA, 25 nt, Human
gccuggacccacaccagaaaagccc

SEQ ID NO: 594222 - RNA, 22 nt, Human
gcuggccugccagcagccacac

SEQ ID NO: 594223 - RNA, 23 nt, Human
gcuggucucaaacuccugaccuc

SEQ ID NO: 594224 - RNA, 21 nt, Human
ggaaagguauaaaacgugaua

SEQ ID NO: 594225 - RNA, 19 nt, Human
ggacauagcacacugugcc

SEQ ID NO: 594226 - RNA, 23 nt, Human
ggaccuaaaaacccacuagcugc

SEQ ID NO: 594227 - RNA, 23 nt, Human
ggagcaaggucccagagcuuggg

SEQ ID NO: 594228 - RNA, 23 nt, Human
ggaggacacacccaggggaagca

SEQ ID NO: 594229 - RNA, 22 nt, Human
ggcagcuggcagcuuguggggc

SEQ ID NO: 594230 - RNA, 24 nt, Human
ggcuggucucaaacuccugaccuc

SEQ ID NO: 594231 - RNA, 20 nt, Human
gggcagggagacuggaaggu

SEQ ID NO: 594232 - RNA, 24 nt, Human
gggcccaaacccagaaacagaaaa

SEQ ID NO: 594233 - RNA, 22 nt, Human
gggccgaggguuccccggaccc

SEQ ID NO: 594234 - RNA, 19 nt, Human
gggguccagccccagggcc

SEQ ID NO: 594235 - RNA, 24 nt, Human
ggucacugagggcaagcucugugg

SEQ ID NO: 594236 - RNA, 21 nt, Human
gucccagagcuugggaaacca

SEQ ID NO: 594237 - RNA, 22 nt, Human
guccugaauggggccugucugg

SEQ ID NO: 594238 - RNA, 19 nt, Human
guuggagggcaugaugagg

SEQ ID NO: 594239 - RNA, 20 nt, Human
uaaaaacccacuagcugcaa

SEQ ID NO: 594240 - RNA, 22 nt, Human
uaagccccaagauuuuagccag

SEQ ID NO: 594241 - RNA, 24 nt, Human
uaccacaaaggcuccauuccugga

SEQ ID NO: 594242 - RNA, 19 nt, Human
uaccccacccacucugguu

SEQ ID NO: 594243 - RNA, 22 nt, Human
uaccccagggagggggaaugug

SEQ ID NO: 594244 - RNA, 25 nt, Human
uaggugugugccaccacaccuggcu

SEQ ID NO: 594245 - RNA, 24 nt, Human
uaguacagaugagauuucaccaug

SEQ ID NO: 594246 - RNA, 19 nt, Human
ucacaguggcucugcuucu

SEQ ID NO: 594247 - RNA, 19 nt, Human
ucacugcaaacucugcuuc

SEQ ID NO: 594248 - RNA, 24 nt, Human
ucacugcaaacucugcuucccagg

SEQ ID NO: 594249 - RNA, 28 nt, Human
ucacugcaaacucugcuucgggcccucc

SEQ ID NO: 594250 - RNA, 28 nt, Human
ucacugcaaacucugcuucggguccucc

SEQ ID NO: 594251 - RNA, 18 nt, Human
ucagacaaccacagaagc

SEQ ID NO: 594252 - RNA, 18 nt, Human
uccaccacccagggcagc

SEQ ID NO: 594253 - RNA, 19 nt, Human
uccaccacccagggcagcu

SEQ ID NO: 594254 - RNA, 18 nt, Human
uccagccucaaccuccca

SEQ ID NO: 594255 - RNA, 24 nt, Human
uccagccucaaccucccaaguagc

SEQ ID NO: 594256 - RNA, 24 nt, Human
ucccaaagugcugggauuacaggc

SEQ ID NO: 594257 - RNA, 23 nt, Human
ucccaaguagcugggacuuuagg

SEQ ID NO: 594258 - RNA, 21 nt, Human
ucccagagcuugggaaaccaa

SEQ ID NO: 594259 - RNA, 18 nt, Human
ucccagguucaagugauc

SEQ ID NO: 594260 - RNA, 19 nt, Human
ucccugaacuuuuccgcag

SEQ ID NO: 594261 - RNA, 24 nt, Human
ucgcccagccuggagugcaguggc

SEQ ID NO: 594262 - RNA, 18 nt, Human
ucgccggacacuggggga

SEQ ID NO: 594263 - RNA, 19 nt, Human
ucgggguccagccccaggg

SEQ ID NO: 594264 - RNA, 21 nt, Human
ucgucgggguccagccccagg

SEQ ID NO: 594265 - RNA, 24 nt, Human
ucucacucugucgcccagccugga

SEQ ID NO: 594266 - RNA, 23 nt, Human
ucucagacaaccacagaagccaa

SEQ ID NO: 594267 - RNA, 20 nt, Human
ucucaggucauuccccauau

SEQ ID NO: 594268 - RNA, 26 nt, Human
ucugcauucaggggaugccucucaga

SEQ ID NO: 594269 - RNA, 19 nt, Human
ucugcgccgccuccgcugc

SEQ ID NO: 594270 - RNA, 19 nt, Human
ucugcuucccagguucaag

SEQ ID NO: 594271 - RNA, 23 nt, Human
ucugggagcuuugggccgagggu

SEQ ID NO: 594272 - RNA, 19 nt, Human
ucugguuucugaaaggagg

SEQ ID NO: 594273 - RNA, 24 nt, Human
ucugucgcccagccuggagugcag

SEQ ID NO: 594274 - RNA, 20 nt, Human
ugaaaacaccccucccgccc

SEQ ID NO: 594275 - RNA, 24 nt, Human
ugaaaacaccccucccgcccaccc

SEQ ID NO: 594276 - RNA, 21 nt, Human
ugaaaggaggcugguggucac

SEQ ID NO: 594277 - RNA, 22 nt, Human
ugaccucaacugacccaccugc

SEQ ID NO: 594278 - RNA, 21 nt, Human
ugagauuucaccauguuggcc

SEQ ID NO: 594279 - RNA, 24 nt, Human
ugagauuucaccauguuggccagg

SEQ ID NO: 594280 - RNA, 19 nt, Human
ugcccagagccucgucggg

SEQ ID NO: 594281 - RNA, 20 nt, Human
ugcucuggugcccagagccu

SEQ ID NO: 594282 - RNA, 24 nt, Human
ugcugggauuacaggcgugagccc

SEQ ID NO: 594283 - RNA, 20 nt, Human
uggaaaaccucacccaacca

SEQ ID NO: 594284 - RNA, 22 nt, Human
uggaaagguauaaaacgugaua

SEQ ID NO: 594285 - RNA, 27 nt, Human
uggaacaguagacauacaacuugaaua

SEQ ID NO: 594286 - RNA, 21 nt, Human
uggaaccuacuguccugcaug

SEQ ID NO: 594287 - RNA, 18 nt, Human
uggagggcaugaugaggc

SEQ ID NO: 594288 - RNA, 18 nt, Human
uggagggugggcagggag

SEQ ID NO: 594289 - RNA, 23 nt, Human
uggaguccacggacauagcacac

SEQ ID NO: 594290 - RNA, 22 nt, Human
uggaguccucaagauuguggag

SEQ ID NO: 594291 - RNA, 23 nt, Human
uggagugcaguggcgagaucuug

SEQ ID NO: 594292 - RNA, 24 nt, Human
uggagugcaguggcgagaucuugg

SEQ ID NO: 594293 - RNA, 20 nt, Human
uggcaccggcgccgccgcgg

SEQ ID NO: 594294 - RNA, 24 nt, Human
uggccaggcuggucucaaacuccu

SEQ ID NO: 594295 - RNA, 18 nt, Human
ugggauuacaggcgugag

SEQ ID NO: 594296 - RNA, 19 nt, Human
ugggauuacaggcgugagc

SEQ ID NO: 594297 - RNA, 23 nt, Human
ugggauuacaggcgugagcccca

SEQ ID NO: 594298 - RNA, 21 nt, Human
ugggcagggagacuggaaggu

SEQ ID NO: 594299 - RNA, 18 nt, Human
uggggcccaaacccagaa

SEQ ID NO: 594300 - RNA, 23 nt, Human
ugggggacccaguggcucuguug

SEQ ID NO: 594301 - RNA, 26 nt, Human
ugggggacccaguggcucuguugguu

SEQ ID NO: 594302 - RNA, 19 nt, Human
ugguccugacucaaccacc

SEQ ID NO: 594303 - RNA, 18 nt, Human
uguauuuuaacauaugga

SEQ ID NO: 594304 - RNA, 18 nt, Human
uguccugaauggggccug

SEQ ID NO: 594305 - RNA, 19 nt, Human
ugucuggaucacaaaccag

SEQ ID NO: 594306 - RNA, 19 nt, Human
ugucuguuuggucccuagg

SEQ ID NO: 594307 - RNA, 20 nt, Human
uuaggcacugcagaucugcc

SEQ ID NO: 594308 - RNA, 24 nt, Human
uuaguacagaugagauuucaccau

SEQ ID NO: 594309 - RNA, 23 nt, Human
uucacaguggcucugcuucugca

SEQ ID NO: 594310 - RNA, 24 nt, Human
uuccagccucaaccucccaaguag

SEQ ID NO: 594311 - RNA, 19 nt, Human
uuccuggaccuaaaaaccc

SEQ ID NO: 594312 - RNA, 27 nt, Human
uucugcauucaggggaugccucucaga

SEQ ID NO: 594313 - RNA, 19 nt, Human
uuggacucccaaagugcug

SEQ ID NO: 594314 - RNA, 24 nt, Human
uuucaccauguuggccaggcuggu

SEQ ID NO: 594315 - RNA, 19 nt, Human
uuuugcucuggugcccaga

SEQ ID NO: 594316 - RNA, 20 nt, Human
uuuugcucuggugcccagag

SEQ ID NO: 594317 - RNA, 26 nt, Human
uuuugcucuggugcccagagccucgu

SEQ ID NO: 594318 - RNA, 24 nt, Human
uuuuuaguacagaugagauuucac

SEQ ID NO: 594319 - RNA, 21 nt, Human
aaaaaauagaauaucuuuccu

SEQ ID NO: 594320 - RNA, 24 nt, Human
aaacaaucuggucaucuggaaaca

SEQ ID NO: 594321 - RNA, 18 nt, Human
aacagauguguaaacucu

SEQ ID NO: 594322 - RNA, 22 nt, Human
aagaacagcuaaucgacaugac

SEQ ID NO: 594323 - RNA, 24 nt, Human
aagcaggaaaacuaucagaucagg

SEQ ID NO: 594324 - RNA, 19 nt, Human
aaguuccagguucaucaug

SEQ ID NO: 594325 - RNA, 22 nt, Human
acccacagaaagcccaccgcaa

SEQ ID NO: 594326 - RNA, 22 nt, Human
accccguccccucccgccccua

SEQ ID NO: 594327 - RNA, 24 nt, Human
accccguccccucccgccccuacc

SEQ ID NO: 594328 - RNA, 21 nt, Human
acccgccgaggagccgcccaa

SEQ ID NO: 594329 - RNA, 27 nt, Human
accucauguguacuaugaaaguuuuau

SEQ ID NO: 594330 - RNA, 21 nt, Human
acugcauuccccucaugcauu

SEQ ID NO: 594331 - RNA, 24 nt, Human
agaaaaacaaucuggucaucugga

SEQ ID NO: 594332 - RNA, 24 nt, Human
agaaaaacagcaguuaugccugca

SEQ ID NO: 594333 - RNA, 25 nt, Human
agaaaauagacuauuaauugcacaa

SEQ ID NO: 594334 - RNA, 22 nt, Human
augaaaguuuuauuuaugcccc

SEQ ID NO: 594335 - RNA, 25 nt, Human
augugcuggacucugaauucugugg

SEQ ID NO: 594336 - RNA, 19 nt, Human
caaaagagcauauuggagc

SEQ ID NO: 594337 - RNA, 26 nt, Human
caacccaaagcuugacguuaagucaa

SEQ ID NO: 594338 - RNA, 19 nt, Human
cacagcuacaaccuaggga

SEQ ID NO: 594339 - RNA, 22 nt, Human
caccaccgccacccgccgagga

SEQ ID NO: 594340 - RNA, 18 nt, Human
cagaaaaacaaucugguc

SEQ ID NO: 594341 - RNA, 25 nt, Human
cagaauggaccuaacagacaacuga

SEQ ID NO: 594342 - RNA, 19 nt, Human
cagacagaccuucuuaggc

SEQ ID NO: 594343 - RNA, 20 nt, Human
cauacuccucacuguaagaa

SEQ ID NO: 594344 - RNA, 18 nt, Human
ccacagaaagcccaccgc

SEQ ID NO: 594345 - RNA, 22 nt, Human
ccaccccguccccucccgcccc

SEQ ID NO: 594346 - RNA, 24 nt, Human
cccacagaaagcccaccgcaaaug

SEQ ID NO: 594347 - RNA, 23 nt, Human
cccacaucaacccaaagcuugac

SEQ ID NO: 594348 - RNA, 23 nt, Human
cccaccgcaaauguucuguguau

SEQ ID NO: 594349 - RNA, 19 nt, Human
ccccaccccguccccuccc

SEQ ID NO: 594350 - RNA, 21 nt, Human
ccccaccccguccccucccgc

SEQ ID NO: 594351 - RNA, 25 nt, Human
ccccaccccguccccucccgccccu

SEQ ID NO: 594352 - RNA, 24 nt, Human
ccccuaccccagcaaggccggguu

SEQ ID NO: 594353 - RNA, 23 nt, Human
cccggccuggccccgacauuaac

SEQ ID NO: 594354 - RNA, 23 nt, Human
ccgccacccgccgaggagccgcc

SEQ ID NO: 594355 - RNA, 21 nt, Human
ccgccgaggagccgcccaagc

SEQ ID NO: 594356 - RNA, 24 nt, Human
ccgcuacggccaccaccgccaccc

SEQ ID NO: 594357 - RNA, 22 nt, Human
ccuacccacaucaacccaaagc

SEQ ID NO: 594358 - RNA, 23 nt, Human
ccuauaaacauccagacagaccu

SEQ ID NO: 594359 - RNA, 24 nt, Human
ccuauaaacauccagacagaccuu

SEQ ID NO: 594360 - RNA, 23 nt, Human
ccuaucuaccuauauaaaaaaaa

SEQ ID NO: 594361 - RNA, 25 nt, Human
ccucccgccccuaccccagcaaggc

SEQ ID NO: 594362 - RNA, 26 nt, Human
ccucccgccccuaccccagcaaggcc

SEQ ID NO: 594363 - RNA, 23 nt, Human
ccuggccccgacauuaacagggc

SEQ ID NO: 594364 - RNA, 18 nt, Human
cggccaccaccgccaccc

SEQ ID NO: 594365 - RNA, 20 nt, Human
cggccaccaccgccacccgc

SEQ ID NO: 594366 - RNA, 22 nt, Human
cuaacagacaacugaaaguaaa

SEQ ID NO: 594367 - RNA, 21 nt, Human
cuacggccaccaccgccaccc

SEQ ID NO: 594368 - RNA, 18 nt, Human
cucccccggccuggcccc

SEQ ID NO: 594369 - RNA, 18 nt, Human
cugcaguaucucguuagc

SEQ ID NO: 594370 - RNA, 25 nt, Human
cugcaguaucucguuagcaucugac

SEQ ID NO: 594371 - RNA, 23 nt, Human
cugcauuccccucaugcauugcc

SEQ ID NO: 594372 - RNA, 23 nt, Human
gaagggugaauaugcuacacaga

SEQ ID NO: 594373 - RNA, 23 nt, Human
gaggagccgcccaagcccauuug

SEQ ID NO: 594374 - RNA, 24 nt, Human
gcaaauguucuguguaucaaauau

SEQ ID NO: 594375 - RNA, 19 nt, Human
gcacauccuacccacaaca

SEQ ID NO: 594376 - RNA, 21 nt, Human
gcccaccgcaaauguucugug

SEQ ID NO: 594377 - RNA, 21 nt, Human
gccccuaccccagcaaggccg

SEQ ID NO: 594378 - RNA, 20 nt, Human
guauuguuccaggaagcagg

SEQ ID NO: 594379 - RNA, 23 nt, Human
gucuggguacggcuugcuuccug

SEQ ID NO: 594380 - RNA, 26 nt, Human
uaaaaaaaauagaauaucuuuccaga

SEQ ID NO: 594381 - RNA, 24 nt, Human
uaaaaauaugcucauuuucagaaa

SEQ ID NO: 594382 - RNA, 20 nt, Human
uaagcuaaugaccugcauau

SEQ ID NO: 594383 - RNA, 23 nt, Human
uaagucaaaaguaaauuauagua

SEQ ID NO: 594384 - RNA, 24 nt, Human
uaaucgacaugacuaaaaauaugc

SEQ ID NO: 594385 - RNA, 22 nt, Human
uacugaucuggccaaggcacac

SEQ ID NO: 594386 - RNA, 22 nt, Human
uagaagaacagcuaaucgacau

SEQ ID NO: 594387 - RNA, 21 nt, Human
uagaagacauuguaaacccau

SEQ ID NO: 594388 - RNA, 22 nt, Human
uagaagacauuguaaacccauc

SEQ ID NO: 594389 - RNA, 18 nt, Human
uagggcgccauccucccc

SEQ ID NO: 594390 - RNA, 19 nt, Human
uauaaacauccagacagac

SEQ ID NO: 594391 - RNA, 21 nt, Human
uaugccccauuaagucaaaag

SEQ ID NO: 594392 - RNA, 19 nt, Human
uaugcuacacagagcuaug

SEQ ID NO: 594393 - RNA, 24 nt, Human
ucaucuggaaacaaucacagcuac

SEQ ID NO: 594394 - RNA, 20 nt, Human
uccaauguuaacccuagaau

SEQ ID NO: 594395 - RNA, 19 nt, Human
uccccaccccguccccucc

SEQ ID NO: 594396 - RNA, 25 nt, Human
uccccaccccguccccucccgcccc

SEQ ID NO: 594397 - RNA, 23 nt, Human
ucuaguaaacagaauggaccuaa

SEQ ID NO: 594398 - RNA, 20 nt, Human
ucucuugaagugcaagggcu

SEQ ID NO: 594399 - RNA, 22 nt, Human
ucuuaggcagcagaacuggucc

SEQ ID NO: 594400 - RNA, 19 nt, Human
ugaccugcauauuuucaua

SEQ ID NO: 594401 - RNA, 20 nt, Human
ugagcacauccuacccacaa

SEQ ID NO: 594402 - RNA, 18 nt, Human
ugcuacacagagcuauga

SEQ ID NO: 594403 - RNA, 24 nt, Human
ugcuggacucugaauucuguggua

SEQ ID NO: 594404 - RNA, 18 nt, Human
uguauuaagucugaagau

SEQ ID NO: 594405 - RNA, 19 nt, Human
uguguaucaaauauccacc

SEQ ID NO: 594406 - RNA, 21 nt, Human
uguguaucaaauauccaccuc

SEQ ID NO: 594407 - RNA, 22 nt, Human
uucagaaaaacaaucuggucau

SEQ ID NO: 594408 - RNA, 21 nt, Human
uucagaggugcugccuauaaa

SEQ ID NO: 594409 - RNA, 19 nt, Human
uuccagguucaucauguca

SEQ ID NO: 594410 - RNA, 18 nt, Human
aaacugcagagacugaug

SEQ ID NO: 594411 - RNA, 19 nt, Human
aacagcacccccgcauagu

SEQ ID NO: 594412 - RNA, 23 nt, Human
aaggacagagugggugaguaagc

SEQ ID NO: 594413 - RNA, 23 nt, Human
aaggagcaggcaggagccaccag

SEQ ID NO: 594414 - RNA, 21 nt, Human
aaggagcccagggcagcugga

SEQ ID NO: 594415 - RNA, 22 nt, Human
aagggccuuuccacccucucuu

SEQ ID NO: 594416 - RNA, 20 nt, Human
aagugggggauggaggagga

SEQ ID NO: 594417 - RNA, 24 nt, Human
acaaagcaccaggaguuaauacca

SEQ ID NO: 594418 - RNA, 22 nt, Human
accauggggacagauggcaggg

SEQ ID NO: 594419 - RNA, 21 nt, Human
acccagacauggcccuggggc

SEQ ID NO: 594420 - RNA, 21 nt, Human
agaggaagaaaggccacagag

SEQ ID NO: 594421 - RNA, 23 nt, Human
agaggaagaaaggccacagagag

SEQ ID NO: 594422 - RNA, 18 nt, Human
agcccagggcagcuggac

SEQ ID NO: 594423 - RNA, 28 nt, Human
agccuacugcccagaaccccugaaacgg

SEQ ID NO: 594424 - RNA, 24 nt, Human
agcugacagaugggucaggggugg

SEQ ID NO: 594425 - RNA, 18 nt, Human
agggcagcuggaccagua

SEQ ID NO: 594426 - RNA, 19 nt, Human
agugaaggagcaggcagga

SEQ ID NO: 594427 - RNA, 21 nt, Human
agugucccuagcuuaggcagc

SEQ ID NO: 594428 - RNA, 21 nt, Human
auccucggccagugacuagga

SEQ ID NO: 594429 - RNA, 19 nt, Human
cacagagcuguaucaccau

SEQ ID NO: 594430 - RNA, 22 nt, Human
cacugucguccuguucugggaa

SEQ ID NO: 594431 - RNA, 24 nt, Human
cagccggggaugagacacaggcag

SEQ ID NO: 594432 - RNA, 20 nt, Human
caggacaacagcacccccgc

SEQ ID NO: 594433 - RNA, 21 nt, Human
caggacaacagcacccccgca

SEQ ID NO: 594434 - RNA, 23 nt, Human
caggagccaccagguucugaggc

SEQ ID NO: 594435 - RNA, 22 nt, Human
caggagccaccuuugcucuauu

SEQ ID NO: 594436 - RNA, 22 nt, Human
caggcaggacaacagcaccccc

SEQ ID NO: 594437 - RNA, 18 nt, Human
cagggcccaaggcacagg

SEQ ID NO: 594438 - RNA, 25 nt, Human
cagggcccaaggcacaggggaggcu

SEQ ID NO: 594439 - RNA, 21 nt, Human
ccagaacuugaaucacacaga

SEQ ID NO: 594440 - RNA, 21 nt, Human
cccauggcaauggugccuguc

SEQ ID NO: 594441 - RNA, 18 nt, Human
ccccauggcaauggugcc

SEQ ID NO: 594442 - RNA, 22 nt, Human
cccugggaaaaagcugacagau

SEQ ID NO: 594443 - RNA, 22 nt, Human
ccuacugcccagaaccccugaa

SEQ ID NO: 594444 - RNA, 19 nt, Human
ccuccucugucaaugaggg

SEQ ID NO: 594445 - RNA, 23 nt, Human
ccuggcuggcacauguuaguugg

SEQ ID NO: 594446 - RNA, 18 nt, Human
cgccagcaccagcugacc

SEQ ID NO: 594447 - RNA, 24 nt, Human
cuagccuuacaagcucugccagaa

SEQ ID NO: 594448 - RNA, 18 nt, Human
cuauccccacaaacacua

SEQ ID NO: 594449 - RNA, 18 nt, Human
cucccugggaaaaagcug

SEQ ID NO: 594450 - RNA, 23 nt, Human
cugacagaugggucaggggugga

SEQ ID NO: 594451 - RNA, 23 nt, Human
cugcccagaaccccugaaacggg

SEQ ID NO: 594452 - RNA, 19 nt, Human
cuggaagcccuucuuugcc

SEQ ID NO: 594453 - RNA, 20 nt, Human
cuuuccacccucucuucacc

SEQ ID NO: 594454 - RNA, 21 nt, Human
gaaaaggacucugcaggugaa

SEQ ID NO: 594455 - RNA, 20 nt, Human
gacaacagcacccccgcaua

SEQ ID NO: 594456 - RNA, 20 nt, Human
gaccagccccauggcaaugg

SEQ ID NO: 594457 - RNA, 24 nt, Human
gacccuggauggaacugguauggg

SEQ ID NO: 594458 - RNA, 18 nt, Human
gagcaggcaggagccacc

SEQ ID NO: 594459 - RNA, 20 nt, Human
gagcaggcaggagccaccag

SEQ ID NO: 594460 - RNA, 25 nt, Human
gcaaucccuucacauccuccaccau

SEQ ID NO: 594461 - RNA, 21 nt, Human
gcagccggggaugagacacag

SEQ ID NO: 594462 - RNA, 18 nt, Human
gcauggaaucuaucccca

SEQ ID NO: 594463 - RNA, 19 nt, Human
gccauguccugccuuggcc

SEQ ID NO: 594464 - RNA, 19 nt, Human
gcccuggggcugaagggcc

SEQ ID NO: 594465 - RNA, 20 nt, Human
gccucagcucugggggcagg

SEQ ID NO: 594466 - RNA, 22 nt, Human
gcuggaggcuccccauugggcc

SEQ ID NO: 594467 - RNA, 22 nt, Human
gcuuugaauaagaccuccuagg

SEQ ID NO: 594468 - RNA, 23 nt, Human
ggagcccagggcagcuggaccag

SEQ ID NO: 594469 - RNA, 20 nt, Human
ggaguggauggguggcauug

SEQ ID NO: 594470 - RNA, 20 nt, Human
ggcccuggggcugaagggcc

SEQ ID NO: 594471 - RNA, 20 nt, Human
gggaggaagauggggcaagg

SEQ ID NO: 594472 - RNA, 21 nt, Human
gggcaaggaaggaagcacuug

SEQ ID NO: 594473 - RNA, 22 nt, Human
ggggaggcucagaggccuccag

SEQ ID NO: 594474 - RNA, 19 nt, Human
ggugaagugggggauggag

SEQ ID NO: 594475 - RNA, 22 nt, Human
gguggcacucaaggccucuugu

SEQ ID NO: 594476 - RNA, 20 nt, Human
guaacacuuggcaaggagug

SEQ ID NO: 594477 - RNA, 28 nt, Human
guaugggauggggugaagugggggaugg

SEQ ID NO: 594478 - RNA, 20 nt, Human
gugaguaagcagacagggag

SEQ ID NO: 594479 - RNA, 19 nt, Human
gugugcaacaagcacaggg

SEQ ID NO: 594480 - RNA, 22 nt, Human
guucugggaacagcacaagacu

SEQ ID NO: 594481 - RNA, 20 nt, Human
guucuucccuggggguggca

SEQ ID NO: 594482 - RNA, 21 nt, Human
uaaacaagccuugccaggucc

SEQ ID NO: 594483 - RNA, 20 nt, Human
uacugcccagaaccccugaa

SEQ ID NO: 594484 - RNA, 18 nt, Human
uaggucaugaaaaggacu

SEQ ID NO: 594485 - RNA, 25 nt, Human
ucagggguggauugagcuggaaacc

SEQ ID NO: 594486 - RNA, 23 nt, Human
ucccuggggguggcacucaaggc

SEQ ID NO: 594487 - RNA, 22 nt, Human
uccuaggucaugaaaaggacuc

SEQ ID NO: 594488 - RNA, 20 nt, Human
ugaaaaggacucugcaggug

SEQ ID NO: 594489 - RNA, 21 nt, Human
ugaaggggaugguuuuacaaa

SEQ ID NO: 594490 - RNA, 21 nt, Human
ugacucucuggcuuucuccuc

SEQ ID NO: 594491 - RNA, 18 nt, Human
ugaggaaaggacagagug

SEQ ID NO: 594492 - RNA, 18 nt, Human
ugaggccaggcccagccu

SEQ ID NO: 594493 - RNA, 19 nt, Human
ugcagauggccucagcucu

SEQ ID NO: 594494 - RNA, 25 nt, Human
ugccuggcuggcacauguuaguugg

SEQ ID NO: 594495 - RNA, 20 nt, Human
uggcaaggaguggaugggug

SEQ ID NO: 594496 - RNA, 20 nt, Human
uggcacucaaggccucuugu

SEQ ID NO: 594497 - RNA, 20 nt, Human
uggcacucaaggccucuugu

SEQ ID NO: 594498 - RNA, 21 nt, Human
uggcuggaggcuccccauugg

SEQ ID NO: 594499 - RNA, 20 nt, Human
ugggaaaaagcugacagaug

SEQ ID NO: 594500 - RNA, 20 nt, Human
ugggaaaaagcugacagaug

SEQ ID NO: 594501 - RNA, 23 nt, Human
ugggaaaaagcugacagaugggu

SEQ ID NO: 594502 - RNA, 25 nt, Human
ugggaaaaagcugacagauggguca

SEQ ID NO: 594503 - RNA, 18 nt, Human
ugggaaccacccaguggc

SEQ ID NO: 594504 - RNA, 18 nt, Human
ugggaggaagauggggca

SEQ ID NO: 594505 - RNA, 18 nt, Human
ugggauggggugaagugg

SEQ ID NO: 594506 - RNA, 20 nt, Human
ugggauggggugaagugggg

SEQ ID NO: 594507 - RNA, 18 nt, Human
ugggcauggagaacccag

SEQ ID NO: 594508 - RNA, 20 nt, Human
ugggccaugggcaggggcuu

SEQ ID NO: 594509 - RNA, 23 nt, Human
uggggguggcacucaaggccucu

SEQ ID NO: 594510 - RNA, 23 nt, Human
uggggugaagugggggauggagg

SEQ ID NO: 594511 - RNA, 20 nt, Human
ugguaugggauggggugaag

SEQ ID NO: 594512 - RNA, 23 nt, Human
uguggcuucugccuucagccuuc

SEQ ID NO: 594513 - RNA, 24 nt, Human
uuauguucuucccuggggguggca

SEQ ID NO: 594514 - RNA, 25 nt, Human
uucacauccuccaccaucuggguaa

SEQ ID NO: 594515 - RNA, 19 nt, Human
uucccuggggguggcacuc

SEQ ID NO: 594516 - RNA, 23 nt, Human
uucugaggccaggcccagccuac

SEQ ID NO: 594517 - RNA, 18 nt, Human
aaacagucacggacuucc

SEQ ID NO: 594518 - RNA, 19 nt, Human
aaacagucacggacuucca

SEQ ID NO: 594519 - RNA, 24 nt, Human
aagugagcuuccucuucucagcuc

SEQ ID NO: 594520 - RNA, 25 nt, Human
caaauuuuuuucucaggaaagaagc

SEQ ID NO: 594521 - RNA, 20 nt, Human
ccaggaaacagucacggacu

SEQ ID NO: 594522 - RNA, 24 nt, Human
ccaggaaacagucacggacuucca

SEQ ID NO: 594523 - RNA, 22 nt, Human
cccuacgccggaagugagcuuc

SEQ ID NO: 594524 - RNA, 18 nt, Human
ccggaagugagcuuccuc

SEQ ID NO: 594525 - RNA, 20 nt, Human
cucccuacgccggaagugag

SEQ ID NO: 594526 - RNA, 19 nt, Human
ggugcacaggacugggagu

SEQ ID NO: 594527 - RNA, 26 nt, Human
uccgagagcaaugcgaaccucggauu

SEQ ID NO: 594528 - RNA, 22 nt, Human
ugcgaaccucggauuccggagg

SEQ ID NO: 594529 - RNA, 22 nt, Human
ugggaguacuggggaggcagaa

SEQ ID NO: 594530 - RNA, 20 nt, Human
aaacacuaaacaugucaaaa

SEQ ID NO: 594531 - RNA, 19 nt, Human
aaagccaaacuucaggacc

SEQ ID NO: 594532 - RNA, 25 nt, Human
aacacaauaguaacaacuuaaagau

SEQ ID NO: 594533 - RNA, 20 nt, Human
aagcagaaacacuaaacaug

SEQ ID NO: 594534 - RNA, 22 nt, Human
aagcagaaacacuaaacauguc

SEQ ID NO: 594535 - RNA, 23 nt, Human
acacuaaacaugucaaaacaccu

SEQ ID NO: 594536 - RNA, 22 nt, Human
acugugugcuaagugcuuuagg

SEQ ID NO: 594537 - RNA, 25 nt, Human
acuucccaauucaggauaaaagcug

SEQ ID NO: 594538 - RNA, 24 nt, Human
agaaacacuaaacaugucaaaaca

SEQ ID NO: 594539 - RNA, 26 nt, Human
agcagaaacacuaaacaugucaaaac

SEQ ID NO: 594540 - RNA, 18 nt, Human
aucuuuaagggguuuucu

SEQ ID NO: 594541 - RNA, 21 nt, Human
auuacuuuucgucaaaauaac

SEQ ID NO: 594542 - RNA, 26 nt, Human
auugccaucaaaucagaauuuugauu

SEQ ID NO: 594543 - RNA, 23 nt, Human
auuucagguucacagcaaaauug

SEQ ID NO: 594544 - RNA, 23 nt, Human
auuuucucuauuacuuuucguca

SEQ ID NO: 594545 - RNA, 23 nt, Human
cacuguaaagcagaaacacuaaa

SEQ ID NO: 594546 - RNA, 19 nt, Human
cagcacuguaaagcagaaa

SEQ ID NO: 594547 - RNA, 22 nt, Human
cagcacuguaaagcagaaacac

SEQ ID NO: 594548 - RNA, 20 nt, Human
cauucugauacagugcuaaa

SEQ ID NO: 594549 - RNA, 27 nt, Human
ggaauucagcacuguaaagcagaaaca

SEQ ID NO: 594550 - RNA, 20 nt, Human
uaaaagacaaccuaaugaca

SEQ ID NO: 594551 - RNA, 20 nt, Human
uaacacaauaguaacaacuu

SEQ ID NO: 594552 - RNA, 24 nt, Human
uaaccacaaaucugcaaaugacac

SEQ ID NO: 594553 - RNA, 20 nt, Human
uaacugagaagcaaucagua

SEQ ID NO: 594554 - RNA, 18 nt, Human
uaacuuacagguaugaua

SEQ ID NO: 594555 - RNA, 25 nt, Human
uaagaguauuaauuuaaagccaguc

SEQ ID NO: 594556 - RNA, 22 nt, Human
uaguuucuucauucugauacag

SEQ ID NO: 594557 - RNA, 31 nt, Human
uaucccaaauauacacacaauccuauuuauu

SEQ ID NO: 594558 - RNA, 20 nt, Human
ucccaauucaggauaaaagc

SEQ ID NO: 594559 - RNA, 18 nt, Human
ucuagacauaaaauaauu

SEQ ID NO: 594560 - RNA, 19 nt, Human
ugacagaaggaucccgaga

SEQ ID NO: 594561 - RNA, 21 nt, Human
ugcucuaacacuggaugauuc

SEQ ID NO: 594562 - RNA, 22 nt, Human
uuaaaagacaaccuaaugacag

SEQ ID NO: 594563 - RNA, 18 nt, Human
uucauagcuucuaaaaua

SEQ ID NO: 594564 - RNA, 22 nt, Human
uuuucauuuccaugucucuaga

SEQ ID NO: 594565 - RNA, 25 nt, Human
aaauaaaaauaaaaaggcccgaagc

SEQ ID NO: 594566 - RNA, 21 nt, Human
aacacauggcaaacaugauau

SEQ ID NO: 594567 - RNA, 19 nt, Human
aagcgucucugaaacagac

SEQ ID NO: 594568 - RNA, 18 nt, Human
acaguuuuguuucucauu

SEQ ID NO: 594569 - RNA, 20 nt, Human
accuaugaguucuuaagaac

SEQ ID NO: 594570 - RNA, 20 nt, Human
acucuguugcccaggcugga

SEQ ID NO: 594571 - RNA, 25 nt, Human
acucuguugcccaggcuggacuccg

SEQ ID NO: 594572 - RNA, 18 nt, Human
agucaucagaaagucacc

SEQ ID NO: 594573 - RNA, 24 nt, Human
aguuacucuguugcccaggcugga

SEQ ID NO: 594574 - RNA, 22 nt, Human
auucagucaucagaaagucacc

SEQ ID NO: 594575 - RNA, 21 nt, Human
cacaacacauggcaaacauga

SEQ ID NO: 594576 - RNA, 19 nt, Human
caccacaggccagugaggu

SEQ ID NO: 594577 - RNA, 18 nt, Human
cagaaagucaccuaugag

SEQ ID NO: 594578 - RNA, 19 nt, Human
cagaaagucaccuaugagu

SEQ ID NO: 594579 - RNA, 19 nt, Human
cgagcugugugcagucacc

SEQ ID NO: 594580 - RNA, 18 nt, Human
ggcuggacuccgucucaa

SEQ ID NO: 594581 - RNA, 23 nt, Human
guuacucuguugcccaggcugga

SEQ ID NO: 594582 - RNA, 19 nt, Human
uaagaaccacaacacaugg

SEQ ID NO: 594583 - RNA, 22 nt, Human
uaagaaccacaacacauggcaa

SEQ ID NO: 594584 - RNA, 19 nt, Human
uacucuguugcccaggcug

SEQ ID NO: 594585 - RNA, 24 nt, Human
uacucuguugcccaggcuggacuc

SEQ ID NO: 594586 - RNA, 19 nt, Human
ucucaaaaaauaaaaaaua

SEQ ID NO: 594587 - RNA, 24 nt, Human
ucucugaaacagacauucagucau

SEQ ID NO: 594588 - RNA, 23 nt, Human
ucugaaacagacauucagucauc

SEQ ID NO: 594589 - RNA, 18 nt, Human
ucuguugcccaggcugga

SEQ ID NO: 594590 - RNA, 22 nt, Human
uggcaaacaugauaucagaagu

SEQ ID NO: 594591 - RNA, 22 nt, Human
uguauacgccaguuccuucucu

SEQ ID NO: 594592 - RNA, 22 nt, Human
uuacucuguugcccaggcugga

SEQ ID NO: 594593 - RNA, 19 nt, Human
uuauuuauuuauuuauuug

SEQ ID NO: 594594 - RNA, 21 nt, Human
uucagucaucagaaagucacc

SEQ ID NO: 594595 - RNA, 23 nt, Human
uuugagaaggagaguuacucugu

SEQ ID NO: 594596 - RNA, 19 nt, Human
aaaaaaacagaagacacag

SEQ ID NO: 594597 - RNA, 24 nt, Human
aaaaaaacagaagacacaggaaca

SEQ ID NO: 594598 - RNA, 25 nt, Human
aaaacagaagacacaggaacagaag

SEQ ID NO: 594599 - RNA, 23 nt, Human
aaagaagaaaagcugcggcagag

SEQ ID NO: 594600 - RNA, 22 nt, Human
aaagagcuguguaugugaccuc

SEQ ID NO: 594601 - RNA, 23 nt, Human
aaagggggcaggggugcuuccag

SEQ ID NO: 594602 - RNA, 21 nt, Human
aagagcugcugaucacuggcu

SEQ ID NO: 594603 - RNA, 22 nt, Human
aagagcugcugaucacuggcuu

SEQ ID NO: 594604 - RNA, 18 nt, Human
aagaugucaaagcugcga

SEQ ID NO: 594605 - RNA, 23 nt, Human
aagcgacaugaguacaccaagau

SEQ ID NO: 594606 - RNA, 19 nt, Human
aaguugaccugcccagccu

SEQ ID NO: 594607 - RNA, 21 nt, Human
acacaaguugaccugcccagc

SEQ ID NO: 594608 - RNA, 19 nt, Human
accaacugcccuucacaug

SEQ ID NO: 594609 - RNA, 22 nt, Human
acggcauccucccagggugagg

SEQ ID NO: 594610 - RNA, 23 nt, Human
agaaaaaaacagaagacacagga

SEQ ID NO: 594611 - RNA, 19 nt, Human
agaagacacaggaacagaa

SEQ ID NO: 594612 - RNA, 21 nt, Human
agagcuguguaugugaccucc

SEQ ID NO: 594613 - RNA, 23 nt, Human
agaugucaaagcugcgacgggcu

SEQ ID NO: 594614 - RNA, 22 nt, Human
agcaacgauucaccagaaaaaa

SEQ ID NO: 594615 - RNA, 19 nt, Human
aggcagaaaagggcaauaa

SEQ ID NO: 594616 - RNA, 20 nt, Human
aggcgaggccucugcgccuc

SEQ ID NO: 594617 - RNA, 18 nt, Human
agggagccccaagagggc

SEQ ID NO: 594618 - RNA, 20 nt, Human
agggagccccaagagggcau

SEQ ID NO: 594619 - RNA, 22 nt, Human
agggggcaggggugcuuccagg

SEQ ID NO: 594620 - RNA, 22 nt, Human
caacugcccuucacaugaucuc

SEQ ID NO: 594621 - RNA, 24 nt, Human
caccaaguccacagcaagcaacga

SEQ ID NO: 594622 - RNA, 18 nt, Human
caccagaaaaaaacagaa

SEQ ID NO: 594623 - RNA, 22 nt, Human
caccagaaaaaaacagaagaca

SEQ ID NO: 594624 - RNA, 22 nt, Human
caccagaaaaaaacagaagacu

SEQ ID NO: 594625 - RNA, 19 nt, Human
cagaaaagggcaauaaaaa

SEQ ID NO: 594626 - RNA, 27 nt, Human
cagcaagcaacgauucaccagaaaaaa

SEQ ID NO: 594627 - RNA, 18 nt, Human
caggaggccugccugacc

SEQ ID NO: 594628 - RNA, 20 nt, Human
cagggccaguggcgaaacca

SEQ ID NO: 594629 - RNA, 24 nt, Human
cagggccaguggcgaaaccaggag

SEQ ID NO: 594630 - RNA, 22 nt, Human
caggggugcuuccaggucaagc

SEQ ID NO: 594631 - RNA, 21 nt, Human
caggguccccucucagguggg

SEQ ID NO: 594632 - RNA, 21 nt, Human
caucauacuagugucggcccc

SEQ ID NO: 594633 - RNA, 19 nt, Human
ccacacugcguccuucagg

SEQ ID NO: 594634 - RNA, 22 nt, Human
ccaccccgagcucucccaagug

SEQ ID NO: 594635 - RNA, 20 nt, Human
ccagaaaaaaacagaagaca

SEQ ID NO: 594636 - RNA, 29 nt, Human
ccagaaaaaaacagaagacacaggaacaa

SEQ ID NO: 594637 - RNA, 22 nt, Human
cccaccacugcuccuccaaagg

SEQ ID NO: 594638 - RNA, 21 nt, Human
ccccaucugucuugcacuaaa

SEQ ID NO: 594639 - RNA, 25 nt, Human
ccccccggccuaaccugaccggaaa

SEQ ID NO: 594640 - RNA, 18 nt, Human
cccccggccuaaccugac

SEQ ID NO: 594641 - RNA, 18 nt, Human
ccccgguggccgacugug

SEQ ID NO: 594642 - RNA, 26 nt, Human
ccgcacccccccggccuaaccugacc

SEQ ID NO: 594643 - RNA, 22 nt, Human
ccuccaacuacucagagguggg

SEQ ID NO: 594644 - RNA, 19 nt, Human
ccucuacacacacgugcag

SEQ ID NO: 594645 - RNA, 18 nt, Human
ccugaaaagggggcaggg

SEQ ID NO: 594646 - RNA, 19 nt, Human
ccugaaaagggggcagggg

SEQ ID NO: 594647 - RNA, 21 nt, Human
cgccacggcauccucccaggg

SEQ ID NO: 594648 - RNA, 23 nt, Human
cggaaacucgaaaucagucgccc

SEQ ID NO: 594649 - RNA, 20 nt, Human
cggccccugagggcaccccu

SEQ ID NO: 594650 - RNA, 20 nt, Human
cuaaaaggcucaccaagggc

SEQ ID NO: 594651 - RNA, 22 nt, Human
cuaggccaguggcauccacacu

SEQ ID NO: 594652 - RNA, 18 nt, Human
cucagggugccagccggc

SEQ ID NO: 594653 - RNA, 26 nt, Human
cuccaccuccuuccgaccaggaccgc

SEQ ID NO: 594654 - RNA, 20 nt, Human
cuguguaugugaccuccaac

SEQ ID NO: 594655 - RNA, 20 nt, Human
gaaaaaaacagaagacacag

SEQ ID NO: 594656 - RNA, 22 nt, Human
gacaggguccccucucaggugg

SEQ ID NO: 594657 - RNA, 20 nt, Human
gcacugaucuggcuccuggg

SEQ ID NO: 594658 - RNA, 22 nt, Human
gcuuaagugaugaggcauuuuc

SEQ ID NO: 594659 - RNA, 20 nt, Human
ggaaaacagccccaucuggu

SEQ ID NO: 594660 - RNA, 20 nt, Human
ggcaggugaggggcaaaugg

SEQ ID NO: 594661 - RNA, 19 nt, Human
ggcaugaggaaaaagaaga

SEQ ID NO: 594662 - RNA, 24 nt, Human
gggcaggggugcuuccaggucaag

SEQ ID NO: 594663 - RNA, 22 nt, Human
uaaaaaaagagcuguguaugug

SEQ ID NO: 594664 - RNA, 18 nt, Human
uaaaaggcucaccaaggg

SEQ ID NO: 594665 - RNA, 24 nt, Human
uacccccaccacugcuccuccaaa

SEQ ID NO: 594666 - RNA, 22 nt, Human
uccacacugcguccuucaggag

SEQ ID NO: 594667 - RNA, 19 nt, Human
ucccugaaaagggggcagg

SEQ ID NO: 594668 - RNA, 21 nt, Human
ucggccccugagggcaccccu

SEQ ID NO: 594669 - RNA, 20 nt, Human
ucuacccaauuccucccuca

SEQ ID NO: 594670 - RNA, 20 nt, Human
ucucccaaguggcaggaguu

SEQ ID NO: 594671 - RNA, 22 nt, Human
ucugcgccucauucuccaggag

SEQ ID NO: 594672 - RNA, 24 nt, Human
ucugggcagaagcggaugugcugg

SEQ ID NO: 594673 - RNA, 21 nt, Human
ugacccccgacucuccaccuc

SEQ ID NO: 594674 - RNA, 23 nt, Human
ugacccccgacucuccaccuccu

SEQ ID NO: 594675 - RNA, 21 nt, Human
ugaggggcaaaugguaauacu

SEQ ID NO: 594676 - RNA, 25 nt, Human
ugaguacaccaagaugucaaagcug

SEQ ID NO: 594677 - RNA, 19 nt, Human
uggacaggguccccucuca

SEQ ID NO: 594678 - RNA, 20 nt, Human
ugggaggagacgccacggca

SEQ ID NO: 594679 - RNA, 20 nt, Human
ugggaggggguaacacaagg

SEQ ID NO: 594680 - RNA, 24 nt, Human
ugggggaaaacagccccaucuguc

SEQ ID NO: 594681 - RNA, 25 nt, Human
ugguaauacugggaggggguaacac

SEQ ID NO: 594682 - RNA, 21 nt, Human
uucagaggcagaaaagggcaa

SEQ ID NO: 594683 - RNA, 18 nt, Human
uuccuccccucugagucc

SEQ ID NO: 594684 - RNA, 19 nt, Human
uuggagaguuucuacccaa

SEQ ID NO: 594685 - RNA, 21 nt, Human
aaaaacaaugacuauaaaagc

SEQ ID NO: 594686 - RNA, 18 nt, Human
aaaagcuacaggaaaggu

SEQ ID NO: 594687 - RNA, 21 nt, Human
aaaccugggugagggcuggua

SEQ ID NO: 594688 - RNA, 26 nt, Human
aacaaaaaacaauaaauuaaaaguca

SEQ ID NO: 594689 - RNA, 19 nt, Human
aacagaauguuccuggggu

SEQ ID NO: 594690 - RNA, 22 nt, Human
aaccaaggcaauccacucacaa

SEQ ID NO: 594691 - RNA, 21 nt, Human
aaccuaggcacauccuccugu

SEQ ID NO: 594692 - RNA, 24 nt, Human
aaggagcuuuuacccuccaaaucc

SEQ ID NO: 594693 - RNA, 23 nt, Human
aaggcgggcggaucacgagguca

SEQ ID NO: 594694 - RNA, 22 nt, Human
aaggcucuaaguggcccaaagc

SEQ ID NO: 594695 - RNA, 20 nt, Human
aauacaaugaucuacacuuc

SEQ ID NO: 594696 - RNA, 21 nt, Human
aauccccaaacuagaagcaaa

SEQ ID NO: 594697 - RNA, 20 nt, Human
acagagcgagacuccgucuc

SEQ ID NO: 594698 - RNA, 24 nt, Human
acagagcgagacuccgucucaaaa

SEQ ID NO: 594699 - RNA, 24 nt, Human
accaaaaaaaaaacaaugaacugg

SEQ ID NO: 594700 - RNA, 20 nt, Human
accacagugaaaccccgucu

SEQ ID NO: 594701 - RNA, 24 nt, Human
accccgucucuacuaaaaauacaa

SEQ ID NO: 594702 - RNA, 18 nt, Human
acgccacugcacuccagc

SEQ ID NO: 594703 - RNA, 22 nt, Human
acgccacugcacuccagccugg

SEQ ID NO: 594704 - RNA, 24 nt, Human
acuacgccacugcacuccagccug

SEQ ID NO: 594705 - RNA, 28 nt, Human
acuccgucucaaaaaaaaaaaaaaaaaa

SEQ ID NO: 594706 - RNA, 24 nt, Human
acugcacuccagccugggugacag

SEQ ID NO: 594707 - RNA, 26 nt, Human
acugcacuccagccugggugacagag

SEQ ID NO: 594708 - RNA, 19 nt, Human
acugcugagaucuccuuga

SEQ ID NO: 594709 - RNA, 25 nt, Human
agaaaagagaaacacagacacaagg

SEQ ID NO: 594710 - RNA, 23 nt, Human
agaaacacagacacaaggcacgc

SEQ ID NO: 594711 - RNA, 22 nt, Human
agagcuuuuguauuuucccagu

SEQ ID NO: 594712 - RNA, 24 nt, Human
agccugggugacagagcgagacuc

SEQ ID NO: 594713 - RNA, 23 nt, Human
agcgcaauccccaaacuagaagc

SEQ ID NO: 594714 - RNA, 18 nt, Human
agcuuuuguauuuuccca

SEQ ID NO: 594715 - RNA, 21 nt, Human
aggaaauucagucuggucaca

SEQ ID NO: 594716 - RNA, 19 nt, Human
aggcacuuggcccacgcca

SEQ ID NO: 594717 - RNA, 24 nt, Human
aggcaggagaacggcgugaaccca

SEQ ID NO: 594718 - RNA, 22 nt, Human
aggcauguugcaguggucugug

SEQ ID NO: 594719 - RNA, 21 nt, Human
aggccaaggcgggcggaucac

SEQ ID NO: 594720 - RNA, 23 nt, Human
aggccaaggcgggcggaucacga

SEQ ID NO: 594721 - RNA, 24 nt, Human
aggcggagcuugcagugagccgag

SEQ ID NO: 594722 - RNA, 18 nt, Human
aggcgggcggaucacgag

SEQ ID NO: 594723 - RNA, 24 nt, Human
aggcgggcggaucacgaggucagg

SEQ ID NO: 594724 - RNA, 19 nt, Human
aggcugaggcaggagaacg

SEQ ID NO: 594725 - RNA, 20 nt, Human
aguagcagcuuuauucuaaa

SEQ ID NO: 594726 - RNA, 20 nt, Human
aucacgaggucaggagaucc

SEQ ID NO: 594727 - RNA, 22 nt, Human
aucccagcaccuugggaggcca

SEQ ID NO: 594728 - RNA, 20 nt, Human
augacaagaaaagacaugua

SEQ ID NO: 594729 - RNA, 24 nt, Human
caaacuagaagcaaacugcccuua

SEQ ID NO: 594730 - RNA, 22 nt, Human
caauccccaaacuagaagcaaa

SEQ ID NO: 594731 - RNA, 20 nt, Human
cacagacacaaggcacgcca

SEQ ID NO: 594732 - RNA, 18 nt, Human
cacagugaaaccccgucu

SEQ ID NO: 594733 - RNA, 19 nt, Human
cacagugaaaccccgucuc

SEQ ID NO: 594734 - RNA, 18 nt, Human
caccagcauggcuacacc

SEQ ID NO: 594735 - RNA, 24 nt, Human
cacgcuuguaaucccagcaccuug

SEQ ID NO: 594736 - RNA, 22 nt, Human
cacuccagccugggugacagag

SEQ ID NO: 594737 - RNA, 23 nt, Human
cacuccagccugggugacagagc

SEQ ID NO: 594738 - RNA, 24 nt, Human
cacuccagccugggugacagagcg

SEQ ID NO: 594739 - RNA, 19 nt, Human
cacugcacuccagccuggg

SEQ ID NO: 594740 - RNA, 21 nt, Human
cacugcacuccagccugggug

SEQ ID NO: 594741 - RNA, 22 nt, Human
cacugcacuccagccuggguga

SEQ ID NO: 594742 - RNA, 23 nt, Human
cacugcacuccagccugggugac

SEQ ID NO: 594743 - RNA, 24 nt, Human
cacugcacuccagccugggugaca

SEQ ID NO: 594744 - RNA, 25 nt, Human
cacugcacuccagccugggugacag

SEQ ID NO: 594745 - RNA, 22 nt, Human
cagaguugaaacauaaucuguc

SEQ ID NO: 594746 - RNA, 24 nt, Human
cagcaccuugggaggccaaggcgg

SEQ ID NO: 594747 - RNA, 21 nt, Human
cagcccacucauacagcauug

SEQ ID NO: 594748 - RNA, 18 nt, Human
cauagauguacuuugcuc

SEQ ID NO: 594749 - RNA, 20 nt, Human
cauauaaccuaggcacaucc

SEQ ID NO: 594750 - RNA, 20 nt, Human
ccacugcacuccagccuggg

SEQ ID NO: 594751 - RNA, 20 nt, Human
ccacugcacuccagccuggg

SEQ ID NO: 594752 - RNA, 21 nt, Human
ccacugcacuccagccugggu

SEQ ID NO: 594753 - RNA, 21 nt, Human
ccacugcacuccagccugggu

SEQ ID NO: 594754 - RNA, 23 nt, Human
ccacugcacuccagccuggguga

SEQ ID NO: 594755 - RNA, 24 nt, Human
ccacugcacuccagccugggugac

SEQ ID NO: 594756 - RNA, 22 nt, Human
ccaggaggaacaauuccuugcc

SEQ ID NO: 594757 - RNA, 26 nt, Human
cccaaacuagaagcaaacugcccuua

SEQ ID NO: 594758 - RNA, 21 nt, Human
ccuggggucaguuacagugaa

SEQ ID NO: 594759 - RNA, 22 nt, Human
ccugggugacagagcgagacuc

SEQ ID NO: 594760 - RNA, 21 nt, Human
ccuguagucccagcuucucag

SEQ ID NO: 594761 - RNA, 20 nt, Human
ccuucauugggcuagcgcaa

SEQ ID NO: 594762 - RNA, 24 nt, Human
cgagacuacgccacugcacuccag

SEQ ID NO: 594763 - RNA, 24 nt, Human
cgccuguagucccagcuucucaga

SEQ ID NO: 594764 - RNA, 23 nt, Human
cgcuuguaaucccagcaccuugg

SEQ ID NO: 594765 - RNA, 24 nt, Human
cgcuuguaaucccagcaccuuggg

SEQ ID NO: 594766 - RNA, 18 nt, Human
cucaaaaaaaaaaaaaaa

SEQ ID NO: 594767 - RNA, 23 nt, Human
cucacgcuuguaaucccagcacc

SEQ ID NO: 594768 - RNA, 24 nt, Human
cucacgcuuguaaucccagcaccu

SEQ ID NO: 594769 - RNA, 19 nt, Human
cuccgucucaaaaaaaaaa

SEQ ID NO: 594770 - RNA, 20 nt, Human
cucuaaguggcccaaagcuu

SEQ ID NO: 594771 - RNA, 19 nt, Human
cuugcagugagccgagacu

SEQ ID NO: 594772 - RNA, 21 nt, Human
cuugcagugagccgagacuac

SEQ ID NO: 594773 - RNA, 23 nt, Human
gaaaagagaaacacagacacaag

SEQ ID NO: 594774 - RNA, 24 nt, Human
gacagagcgagacuccgucucaaa

SEQ ID NO: 594775 - RNA, 24 nt, Human
gaccacagugaaaccccgucucua

SEQ ID NO: 594776 - RNA, 24 nt, Human
gcacuccagccugggugacagagc

SEQ ID NO: 594777 - RNA, 18 nt, Human
gcagaaugagcugcagag

SEQ ID NO: 594778 - RNA, 22 nt, Human
gcaggagaacggcgugaaccca

SEQ ID NO: 594779 - RNA, 19 nt, Human
gccacugcacuccagccug

SEQ ID NO: 594780 - RNA, 24 nt, Human
gccacugcacuccagccuggguga

SEQ ID NO: 594781 - RNA, 18 nt, Human
ggaaggcauguugcagug

SEQ ID NO: 594782 - RNA, 18 nt, Human
ggagcuugcagugagccg

SEQ ID NO: 594783 - RNA, 20 nt, Human
ggauacagagggccaacugu

SEQ ID NO: 594784 - RNA, 21 nt, Human
ggcggaucacgaggucaggag

SEQ ID NO: 594785 - RNA, 18 nt, Human
ggcgugguggcgggcgcc

SEQ ID NO: 594786 - RNA, 22 nt, Human
ggcgugguggcgggcgccugua

SEQ ID NO: 594787 - RNA, 24 nt, Human
gggugcgguggcucacgcuuguaa

SEQ ID NO: 594788 - RNA, 24 nt, Human
ggucaggagaucgagaccacagug

SEQ ID NO: 594789 - RNA, 24 nt, Human
gguggcgggcgccuguagucccag

SEQ ID NO: 594790 - RNA, 23 nt, Human
gguggcucacgcuuguaauccca

SEQ ID NO: 594791 - RNA, 24 nt, Human
gguggcucacgcuuguaaucccag

SEQ ID NO: 594792 - RNA, 20 nt, Human
guaaaauucauugugacuga

SEQ ID NO: 594793 - RNA, 23 nt, Human
guggcucacgcuuguaaucccag

SEQ ID NO: 594794 - RNA, 20 nt, Human
guucacugcugagaucuccu

SEQ ID NO: 594795 - RNA, 21 nt, Human
uaaaaccugggugagggcugg

SEQ ID NO: 594796 - RNA, 21 nt, Human
uacugaccauauacugagcac

SEQ ID NO: 594797 - RNA, 23 nt, Human
uagaagcaaacugcccuuaauau

SEQ ID NO: 594798 - RNA, 24 nt, Human
uagcagcuuuauucuaaaaggcua

SEQ ID NO: 594799 - RNA, 23 nt, Human
uauaaccuaggcacauccuccug

SEQ ID NO: 594800 - RNA, 27 nt, Human
uauacuguauugguuuuuaaauuugua

SEQ ID NO: 594801 - RNA, 23 nt, Human
uauauaaugauccagcagggaag

SEQ ID NO: 594802 - RNA, 20 nt, Human
uauuuucaaaugaaguggaa

SEQ ID NO: 594803 - RNA, 22 nt, Human
ucaaaaaaaaaaaaaaaaaaaa

SEQ ID NO: 594804 - RNA, 23 nt, Human
ucaaaaaaaaaaaaaaaaaaaaa

SEQ ID NO: 594805 - RNA, 25 nt, Human
ucaaaaaaaaaaaaaaaaaaaaaau

SEQ ID NO: 594806 - RNA, 18 nt, Human
ucacgaggucaggagauc

SEQ ID NO: 594807 - RNA, 24 nt, Human
ucacgaggucaggagaucgagacc

SEQ ID NO: 594808 - RNA, 20 nt, Human
ucaggcacuuggcccacgcc

SEQ ID NO: 594809 - RNA, 25 nt, Human
ucaggccgggugcgguggcucacgc

SEQ ID NO: 594810 - RNA, 19 nt, Human
uccaaaagcuucaucaccu

SEQ ID NO: 594811 - RNA, 21 nt, Human
uccaaacuugguugaauucac

SEQ ID NO: 594812 - RNA, 24 nt, Human
uccagcagggaaggcauguugcag

SEQ ID NO: 594813 - RNA, 23 nt, Human
uccagccugggugacagagcgag

SEQ ID NO: 594814 - RNA, 24 nt, Human
uccagccugggugacagagcgaga

SEQ ID NO: 594815 - RNA, 19 nt, Human
uccguaacugggagaaccc

SEQ ID NO: 594816 - RNA, 25 nt, Human
uccguaacugggagaacccagguug

SEQ ID NO: 594817 - RNA, 23 nt, Human
uccgucucaaaaaaaaaaaaaaa

SEQ ID NO: 594818 - RNA, 25 nt, Human
ucucuacuaaaaauacaaaaaaauu

SEQ ID NO: 594819 - RNA, 23 nt, Human
ugaaaaacaaugacuauaaaagc

SEQ ID NO: 594820 - RNA, 23 nt, Human
ugaauucacagauauagagcuca

SEQ ID NO: 594821 - RNA, 19 nt, Human
ugacugacuuuuggaaggg

SEQ ID NO: 594822 - RNA, 18 nt, Human
ugagaucuccuugauuug

SEQ ID NO: 594823 - RNA, 24 nt, Human
ugaggcaggagaacggcgugaacc

SEQ ID NO: 594824 - RNA, 25 nt, Human
ugaggcaggagaacggcgugaaccc

SEQ ID NO: 594825 - RNA, 19 nt, Human
ugauuggcucguccaauga

SEQ ID NO: 594826 - RNA, 22 nt, Human
ugcauauaaccuaggcacaucc

SEQ ID NO: 594827 - RNA, 21 nt, Human
uggcccacgccaggugcucug

SEQ ID NO: 594828 - RNA, 24 nt, Human
uggcucacgcuuguaaucccagca

SEQ ID NO: 594829 - RNA, 24 nt, Human
ugggaggccaaggcgggcggauca

SEQ ID NO: 594830 - RNA, 25 nt, Human
ugggagugagaugaaaauucaguau

SEQ ID NO: 594831 - RNA, 24 nt, Human
ugguggcgggcgccuguaguccca

SEQ ID NO: 594832 - RNA, 22 nt, Human
uguacuauuuuucucgcacucu

SEQ ID NO: 594833 - RNA, 23 nt, Human
uguauuuucccaguucacugcug

SEQ ID NO: 594834 - RNA, 23 nt, Human
ugugaaggagcuuuuacccucca

SEQ ID NO: 594835 - RNA, 23 nt, Human
ugugacugacuuuuggaaggggu

SEQ ID NO: 594836 - RNA, 18 nt, Human
uuagccgggcgugguggc

SEQ ID NO: 594837 - RNA, 24 nt, Human
uuagccgggcgugguggcgggcgc

SEQ ID NO: 594838 - RNA, 18 nt, Human
uugcagugagccgagacu

SEQ ID NO: 594839 - RNA, 20 nt, Human
uugcagugagccgagacuac

SEQ ID NO: 594840 - RNA, 21 nt, Human
uugcagugagccgagacuacg

SEQ ID NO: 594841 - RNA, 23 nt, Human
uugcuaaaucaucucuagauugc

SEQ ID NO: 594842 - RNA, 21 nt, Human
uuucaggguaaguuuuuauag

SEQ ID NO: 594843 - RNA, 19 nt, Human
uuucaucguuauguauauu

SEQ ID NO: 594844 - RNA, 20 nt, Human
uuuuuuuuuuuuaaggcucu

SEQ ID NO: 594845 - RNA, 23 nt, Human
uuuuuuuuuuuuuuuuuuuaagg

SEQ ID NO: 594846 - RNA, 23 nt, Human
aaaccaguaaaucaauuuguauc

SEQ ID NO: 594847 - RNA, 19 nt, Human
aaagacauagauaaaugcu

SEQ ID NO: 594848 - RNA, 19 nt, Human
aaaucaguacuuaaaacca

SEQ ID NO: 594849 - RNA, 19 nt, Human
aacaaauuucucaacaaua

SEQ ID NO: 594850 - RNA, 20 nt, Human
aacauagcaaaacucugucc

SEQ ID NO: 594851 - RNA, 25 nt, Human
aagccugauguucugaucuacugga

SEQ ID NO: 594852 - RNA, 23 nt, Human
aaucagcaaaauaaaaaccagua

SEQ ID NO: 594853 - RNA, 24 nt, Human
aaucugggcaacauagcaaaacuc

SEQ ID NO: 594854 - RNA, 25 nt, Human
acagcuaauucagaaagggaacaau

SEQ ID NO: 594855 - RNA, 24 nt, Human
accuccacugcucagaaauggccc

SEQ ID NO: 594856 - RNA, 18 nt, Human
acucugucccuacaaaac

SEQ ID NO: 594857 - RNA, 24 nt, Human
acugcacucuagccugggcaacag

SEQ ID NO: 594858 - RNA, 24 nt, Human
acugcacucuagccugggcaacag

SEQ ID NO: 594859 - RNA, 24 nt, Human
agaaauggcccgcgccgcagcucg

SEQ ID NO: 594860 - RNA, 23 nt, Human
agcugggcauggugguacaugcc

SEQ ID NO: 594861 - RNA, 20 nt, Human
aggaguuugagaccaaucug

SEQ ID NO: 594862 - RNA, 19 nt, Human
aggcaggaggaucgcuuga

SEQ ID NO: 594863 - RNA, 23 nt, Human
aggcaggaggaucgcuugagcuc

SEQ ID NO: 594864 - RNA, 24 nt, Human
aggcuaaggcaggaggaucgcuug

SEQ ID NO: 594865 - RNA, 24 nt, Human
aucaugccacugcacucuagccug

SEQ ID NO: 594866 - RNA, 21 nt, Human
aucuauuaccacgaggaacag

SEQ ID NO: 594867 - RNA, 20 nt, Human
augccuauagucccagcaac

SEQ ID NO: 594868 - RNA, 21 nt, Human
auuaaaaaaaaaaaaaaagau

SEQ ID NO: 594869 - RNA, 23 nt, Human
caaagcacuuuaaauuauuuuaa

SEQ ID NO: 594870 - RNA, 21 nt, Human
caacucaagaggcuaaggcag

SEQ ID NO: 594871 - RNA, 24 nt, Human
caauauaaacaaaucuuuugggua

SEQ ID NO: 594872 - RNA, 24 nt, Human
caauauaaucuaugaaauagcauc

SEQ ID NO: 594873 - RNA, 18 nt, Human
caauaugccauuuaaaau

SEQ ID NO: 594874 - RNA, 22 nt, Human
cacagcccacagaccacagccc

SEQ ID NO: 594875 - RNA, 25 nt, Human
cacagcccacagaccacagcccggg

SEQ ID NO: 594876 - RNA, 18 nt, Human
cacaggauuugaugacag

SEQ ID NO: 594877 - RNA, 19 nt, Human
cacugcacucuagccuggg

SEQ ID NO: 594878 - RNA, 21 nt, Human
cacugcacucuagccugggca

SEQ ID NO: 594879 - RNA, 22 nt, Human
cacugcacucuagccugggcaa

SEQ ID NO: 594880 - RNA, 23 nt, Human
cacugcacucuagccugggcaac

SEQ ID NO: 594881 - RNA, 24 nt, Human
cacugcacucuagccugggcaaca

SEQ ID NO: 594882 - RNA, 21 nt, Human
cagcacaggauuugaugacag

SEQ ID NO: 594883 - RNA, 23 nt, Human
caggagugagaggccaggaguuu

SEQ ID NO: 594884 - RNA, 20 nt, Human
ccacugcacucuagccuggg

SEQ ID NO: 594885 - RNA, 20 nt, Human
ccacugcacucuagccuggg

SEQ ID NO: 594886 - RNA, 21 nt, Human
ccacugcacucuagccugggc

SEQ ID NO: 594887 - RNA, 23 nt, Human
ccacugcacucuagccugggcaa

SEQ ID NO: 594888 - RNA, 24 nt, Human
ccacugcacucuagccugggcaac

SEQ ID NO: 594889 - RNA, 30 nt, Human
cccacagcccacagaccacagcccggggcc

SEQ ID NO: 594890 - RNA, 24 nt, Human
cccgcgccgcagcucgucccacag

SEQ ID NO: 594891 - RNA, 25 nt, Human
ccgcggcgcgaucccaguuccuuuu

SEQ ID NO: 594892 - RNA, 22 nt, Human
ccuauagucccagcaacucaag

SEQ ID NO: 594893 - RNA, 23 nt, Human
ccuccaucuaacaguuacuuuua

SEQ ID NO: 594894 - RNA, 24 nt, Human
ccugacauuaaaaaaaaaaaaaaa

SEQ ID NO: 594895 - RNA, 23 nt, Human
cggcaggagugagaggccaggag

SEQ ID NO: 594896 - RNA, 18 nt, Human
cucaagagguugaugcaa

SEQ ID NO: 594897 - RNA, 23 nt, Human
cucgcgcaacaucggucccuggg

SEQ ID NO: 594898 - RNA, 22 nt, Human
cucgucccacagcccacagacc

SEQ ID NO: 594899 - RNA, 19 nt, Human
cugggcaacauagcaaaac

SEQ ID NO: 594900 - RNA, 19 nt, Human
cuugaaaccuccacugcuc

SEQ ID NO: 594901 - RNA, 22 nt, Human
cuugaaaccuccacugcucaga

SEQ ID NO: 594902 - RNA, 19 nt, Human
cuuuuggguacucaacaua

SEQ ID NO: 594903 - RNA, 22 nt, Human
gaaaacacgggcauaagucugg

SEQ ID NO: 594904 - RNA, 18 nt, Human
gaucaugccacugcacuc

SEQ ID NO: 594905 - RNA, 24 nt, Human
gcacucuagccugggcaacagagc

SEQ ID NO: 594906 - RNA, 24 nt, Human
gccacugcacucuagccugggcaa

SEQ ID NO: 594907 - RNA, 21 nt, Human
gcccacagaccacagcccggg

SEQ ID NO: 594908 - RNA, 19 nt, Human
ggcaggagugagaggccag

SEQ ID NO: 594909 - RNA, 19 nt, Human
ggccaggaguuugagacca

SEQ ID NO: 594910 - RNA, 21 nt, Human
gggcgggguaaggggcuucgg

SEQ ID NO: 594911 - RNA, 21 nt, Human
gguacaugccuauagucccag

SEQ ID NO: 594912 - RNA, 22 nt, Human
guggaaaacaaauuucucaaca

SEQ ID NO: 594913 - RNA, 20 nt, Human
uaaacugaaauaagcuauga

SEQ ID NO: 594914 - RNA, 23 nt, Human
uaagacaaaagauuaauaaaaac

SEQ ID NO: 594915 - RNA, 22 nt, Human
uaaggcaggaggaucgcuugag

SEQ ID NO: 594916 - RNA, 21 nt, Human
uaauaguaauuauaaauuagc

SEQ ID NO: 594917 - RNA, 21 nt, Human
uaccuuaaauauaccaaauau

SEQ ID NO: 594918 - RNA, 19 nt, Human
uauaaucuaugaaauagca

SEQ ID NO: 594919 - RNA, 26 nt, Human
uccacauauaacaaacaugauuaaac

SEQ ID NO: 594920 - RNA, 19 nt, Human
ucccugggcagcgcaacug

SEQ ID NO: 594921 - RNA, 22 nt, Human
ucccugggcagcgcaacuguaa

SEQ ID NO: 594922 - RNA, 19 nt, Human
ugaaaacacgggcauaagu

SEQ ID NO: 594923 - RNA, 28 nt, Human
ugaaaacacgggcauaaguuggagaccc

SEQ ID NO: 594924 - RNA, 24 nt, Human
ugaaaauaaaguuuuaaaucauuc

SEQ ID NO: 594925 - RNA, 22 nt, Human
ugacaaguggaaaacaaauuuc

SEQ ID NO: 594926 - RNA, 24 nt, Human
ugguacaugccuauagucccagca

SEQ ID NO: 594927 - RNA, 24 nt, Human
uggugguacaugccuauaguccca

SEQ ID NO: 594928 - RNA, 23 nt, Human
uuaaauauaccaaauauuauaau

SEQ ID NO: 594929 - RNA, 18 nt, Human
uuagcugggcaugguggu

SEQ ID NO: 594930 - RNA, 24 nt, Human
uuagcugggcauggugguacaugc

SEQ ID NO: 594931 - RNA, 18 nt, Human
uuuuaauuuuuuuucccu

SEQ ID NO: 594932 - RNA, 23 nt, Human
uuuuuccuuuuuacacaaaguau

SEQ ID NO: 594933 - RNA, 19 nt, Human
aaaccugaaagcccuggug

SEQ ID NO: 594934 - RNA, 18 nt, Human
aaaguaagucauaauaua

SEQ ID NO: 594935 - RNA, 18 nt, Human
aacaugugcccaaggugg

SEQ ID NO: 594936 - RNA, 24 nt, Human
aagaaaugguaccuggaaccugga

SEQ ID NO: 594937 - RNA, 19 nt, Human
aagaccacaaugcucacca

SEQ ID NO: 594938 - RNA, 23 nt, Human
aagaccccgucucaaaaaaacaa

SEQ ID NO: 594939 - RNA, 21 nt, Human
aagagacaaaauggcagagua

SEQ ID NO: 594940 - RNA, 24 nt, Human
aagcaaaaacggcaacaaccccgg

SEQ ID NO: 594941 - RNA, 21 nt, Human
aagcaacaaaaccugaaagcc

SEQ ID NO: 594942 - RNA, 18 nt, Human
aagccugcccugccaacc

SEQ ID NO: 594943 - RNA, 21 nt, Human
aagccugcccugccaaccccg

SEQ ID NO: 594944 - RNA, 21 nt, Human
aaggccccagaaguacgccaa

SEQ ID NO: 594945 - RNA, 27 nt, Human
acaaaaccugaaagcccuggugcaggc

SEQ ID NO: 594946 - RNA, 19 nt, Human
acaacaagaccccgucuca

SEQ ID NO: 594947 - RNA, 22 nt, Human
acaacucaaaggucggagcagg

SEQ ID NO: 594948 - RNA, 19 nt, Human
acacaacaagaccccgucu

SEQ ID NO: 594949 - RNA, 20 nt, Human
acacaacaagaccccgucuc

SEQ ID NO: 594950 - RNA, 19 nt, Human
acaggggcuggggaaggga

SEQ ID NO: 594951 - RNA, 20 nt, Human
acagugcagcuggggggcag

SEQ ID NO: 594952 - RNA, 20 nt, Human
acccacugcgaaugcucacg

SEQ ID NO: 594953 - RNA, 23 nt, Human
accccgacagaccccagggcuug

SEQ ID NO: 594954 - RNA, 19 nt, Human
accccgucucaaaaaaaca

SEQ ID NO: 594955 - RNA, 18 nt, Human
acgcacuguaccccuggc

SEQ ID NO: 594956 - RNA, 18 nt, Human
acuacacucuaaccuggg

SEQ ID NO: 594957 - RNA, 22 nt, Human
acucaaaggucggagcagggga

SEQ ID NO: 594958 - RNA, 24 nt, Human
agaguucuuuccaucuaccugcuc

SEQ ID NO: 594959 - RNA, 22 nt, Human
agauguacuguucauugcugca

SEQ ID NO: 594960 - RNA, 21 nt, Human
agauucccccucaugcccacc

SEQ ID NO: 594961 - RNA, 18 nt, Human
agcaaaaacggcaacaag

SEQ ID NO: 594962 - RNA, 24 nt, Human
agcagauggggcaagucgcggcgc

SEQ ID NO: 594963 - RNA, 19 nt, Human
agcauguuuucucuuuuac

SEQ ID NO: 594964 - RNA, 18 nt, Human
agccugggcaacauggug

SEQ ID NO: 594965 - RNA, 18 nt, Human
agccugggcaacauggug

SEQ ID NO: 594966 - RNA, 23 nt, Human
agcuggggggcaguaagaaauga

SEQ ID NO: 594967 - RNA, 21 nt, Human
aggaggcggcggcagggcugg

SEQ ID NO: 594968 - RNA, 23 nt, Human
aggaguucaagaccagccugggc

SEQ ID NO: 594969 - RNA, 21 nt, Human
aggcagcccacccuaaggaaa

SEQ ID NO: 594970 - RNA, 23 nt, Human
aggcaggagaucaauuaagcccg

SEQ ID NO: 594971 - RNA, 22 nt, Human
aggcuacaagugaauuuaaaca

SEQ ID NO: 594972 - RNA, 19 nt, Human
aggcucacuguagugagcc

SEQ ID NO: 594973 - RNA, 22 nt, Human
aggcucacuguagugagccgag

SEQ ID NO: 594974 - RNA, 22 nt, Human
aggcugccaugaucagugcccc

SEQ ID NO: 594975 - RNA, 21 nt, Human
agggagaggcaauuucccaau

SEQ ID NO: 594976 - RNA, 18 nt, Human
agggaugcggcucugcgg

SEQ ID NO: 594977 - RNA, 19 nt, Human
agggcaggacuccccagac

SEQ ID NO: 594978 - RNA, 20 nt, Human
agggcucagcuucuccucug

SEQ ID NO: 594979 - RNA, 20 nt, Human
aggggcuggggaagggaugc

SEQ ID NO: 594980 - RNA, 20 nt, Human
aggugugccccuuccaggag

SEQ ID NO: 594981 - RNA, 22 nt, Human
agguuggaaaguaagucauaau

SEQ ID NO: 594982 - RNA, 27 nt, Human
aguccaggaguucaagaccagccuggg

SEQ ID NO: 594983 - RNA, 18 nt, Human
agugcagcuggggggcag

SEQ ID NO: 594984 - RNA, 19 nt, Human
aguguagacgcacuguacc

SEQ ID NO: 594985 - RNA, 21 nt, Human
auaaaacccaucugaugagaa

SEQ ID NO: 594986 - RNA, 18 nt, Human
auaaacuuccacucccgc

SEQ ID NO: 594987 - RNA, 24 nt, Human
auacauacaacuucacaaacccac

SEQ ID NO: 594988 - RNA, 18 nt, Human
aucaguuuaguccuugag

SEQ ID NO: 594989 - RNA, 23 nt, Human
augcugcacuccaccuccacagu

SEQ ID NO: 594990 - RNA, 23 nt, Human
auuaagcccgggaggcugaggcu

SEQ ID NO: 594991 - RNA, 22 nt, Human
auucaggcucugagaagucacc

SEQ ID NO: 594992 - RNA, 19 nt, Human
caaaaacggcaacaaggaa

SEQ ID NO: 594993 - RNA, 26 nt, Human
caaaacagcuuuguagggucauuuca

SEQ ID NO: 594994 - RNA, 21 nt, Human
caacaggccaucccguccccc

SEQ ID NO: 594995 - RNA, 21 nt, Human
caacaggccaucccguccccc

SEQ ID NO: 594996 - RNA, 20 nt, Human
caacuucacaaacccacugc

SEQ ID NO: 594997 - RNA, 21 nt, Human
caagcgcauuaagagacaaaa

SEQ ID NO: 594998 - RNA, 18 nt, Human
caagggcgccugcaggcc

SEQ ID NO: 594999 - RNA, 19 nt, Human
cacaaacccacugcgaaug

SEQ ID NO: 595000 - RNA, 26 nt, Human
cacaacaagaccccgucucaaaaaaa

SEQ ID NO: 595001 - RNA, 25 nt, Human
caccaguccaaggggcugcggucac

SEQ ID NO: 595002 - RNA, 18 nt, Human
caccaugguaacuccaca

SEQ ID NO: 595003 - RNA, 19 nt, Human
caccaugguaacuccacaa

SEQ ID NO: 595004 - RNA, 27 nt, Human
cacuacacucuaaccugggugacacaa

SEQ ID NO: 595005 - RNA, 21 nt, Human
cacuucccucucgcucugcca

SEQ ID NO: 595006 - RNA, 22 nt, Human
cagaccccuuagauaggaauuu

SEQ ID NO: 595007 - RNA, 23 nt, Human
cagcugauuaugccaggugacac

SEQ ID NO: 595008 - RNA, 22 nt, Human
cauacaacuucacaaacccacu

SEQ ID NO: 595009 - RNA, 23 nt, Human
caugaucagugccccgcuccacc

SEQ ID NO: 595010 - RNA, 19 nt, Human
cauggcauccccucgaucc

SEQ ID NO: 595011 - RNA, 19 nt, Human
cauugcguuacaacugccu

SEQ ID NO: 595012 - RNA, 19 nt, Human
ccaagaccacaaugcucac

SEQ ID NO: 595013 - RNA, 23 nt, Human
ccacaagggcgccugcaggcccc

SEQ ID NO: 595014 - RNA, 25 nt, Human
ccaccccccgccaacccucuaucug

SEQ ID NO: 595015 - RNA, 26 nt, Human
ccaccuucauggcauccccucgaucc

SEQ ID NO: 595016 - RNA, 24 nt, Human
ccacuacacucuaaccugggugac

SEQ ID NO: 595017 - RNA, 22 nt, Human
ccaggggagacauucaggcucu

SEQ ID NO: 595018 - RNA, 21 nt, Human
cccacagccuggguguggggc

SEQ ID NO: 595019 - RNA, 22 nt, Human
cccaccuucauccacagaugua

SEQ ID NO: 595020 - RNA, 23 nt, Human
cccccacacaaaacagcuuugua

SEQ ID NO: 595021 - RNA, 26 nt, Human
ccccgccaacccucuaucugcccacc

SEQ ID NO: 595022 - RNA, 21 nt, Human
ccccgcuccaccccccgccaa

SEQ ID NO: 595023 - RNA, 23 nt, Human
ccccgcuccaccccccgccaacc

SEQ ID NO: 595024 - RNA, 19 nt, Human
cccuaacaggaggaccgcu

SEQ ID NO: 595025 - RNA, 22 nt, Human
cccuuggggcuggccacagcag

SEQ ID NO: 595026 - RNA, 21 nt, Human
ccgacacccagucacaugacc

SEQ ID NO: 595027 - RNA, 23 nt, Human
ccuacacaaggcucuucugcacc

SEQ ID NO: 595028 - RNA, 21 nt, Human
ccucagaggcacucccucucc

SEQ ID NO: 595029 - RNA, 18 nt, Human
ccucagucuccuuuuucc

SEQ ID NO: 595030 - RNA, 24 nt, Human
ccucucgcucugccaucccuugau

SEQ ID NO: 595031 - RNA, 20 nt, Human
ccugcaggccccaagaccac

SEQ ID NO: 595032 - RNA, 19 nt, Human
ccugcaggccccaagaccu

SEQ ID NO: 595033 - RNA, 19 nt, Human
ccuggaaccuggagaucag

SEQ ID NO: 595034 - RNA, 19 nt, Human
ccugggcaacaugguggca

SEQ ID NO: 595035 - RNA, 23 nt, Human
ccugggugacacaacaagacccc

SEQ ID NO: 595036 - RNA, 18 nt, Human
ccuguggucccagcuacu

SEQ ID NO: 595037 - RNA, 21 nt, Human
ccuguggucccagcuacuugg

SEQ ID NO: 595038 - RNA, 26 nt, Human
ccuuguccacaggccccaaucagcug

SEQ ID NO: 595039 - RNA, 21 nt, Human
cgacagaccccagggcuuggc

SEQ ID NO: 595040 - RNA, 24 nt, Human
cggacacccacagccuuguccaca

SEQ ID NO: 595041 - RNA, 22 nt, Human
cgggaggcugaggcucacugua

SEQ ID NO: 595042 - RNA, 30 nt, Human
cgugaccuggugucugaauccccagcaccc

SEQ ID NO: 595043 - RNA, 26 nt, Human
cuacacucuaaccugggugacacaac

SEQ ID NO: 595044 - RNA, 21 nt, Human
cucaaauauucgccaccccua

SEQ ID NO: 595045 - RNA, 19 nt, Human
cuccaccccccgccaaccc

SEQ ID NO: 595046 - RNA, 18 nt, Human
cuccucugggacucucuu

SEQ ID NO: 595047 - RNA, 23 nt, Human
cucggaaacuugccucagucucc

SEQ ID NO: 595048 - RNA, 18 nt, Human
cugcacuccaccuccaca

SEQ ID NO: 595049 - RNA, 19 nt, Human
cugcacuucccucucgcuc

SEQ ID NO: 595050 - RNA, 20 nt, Human
cuggcugucuaaaaaugauc

SEQ ID NO: 595051 - RNA, 20 nt, Human
cuggugcaggcuggcaggaa

SEQ ID NO: 595052 - RNA, 22 nt, Human
cuguagugagccgagacggcgc

SEQ ID NO: 595053 - RNA, 23 nt, Human
cuucuccucugggacucucuucu

SEQ ID NO: 595054 - RNA, 21 nt, Human
cuuugauuuuucuuccuugac

SEQ ID NO: 595055 - RNA, 19 nt, Human
gaacaugugcccaaggugg

SEQ ID NO: 595056 - RNA, 20 nt, Human
gaagucuaauagucgcugcc

SEQ ID NO: 595057 - RNA, 18 nt, Human
gacacuuaccauugcguu

SEQ ID NO: 595058 - RNA, 23 nt, Human
gaccccuuagauaggaauuuggg

SEQ ID NO: 595059 - RNA, 23 nt, Human
gaccuggugucugaauccccagc

SEQ ID NO: 595060 - RNA, 24 nt, Human
gagaacaugugcccaagguggucg

SEQ ID NO: 595061 - RNA, 18 nt, Human
gaggaccgcuucagucca

SEQ ID NO: 595062 - RNA, 20 nt, Human
gagggcaccgugcaugcagg

SEQ ID NO: 595063 - RNA, 21 nt, Human
gauucccccucaugcccaccu

SEQ ID NO: 595064 - RNA, 18 nt, Human
gcaaauuuucccccacac

SEQ ID NO: 595065 - RNA, 22 nt, Human
gcaaauuuucccccacacaaaa

SEQ ID NO: 595066 - RNA, 22 nt, Human
gcagacccaugugaauucacca

SEQ ID NO: 595067 - RNA, 21 nt, Human
gcccacccuaaggaaagcauc

SEQ ID NO: 595068 - RNA, 19 nt, Human
gcccaugacacaguccuca

SEQ ID NO: 595069 - RNA, 21 nt, Human
gccuaacacaggggcugggga

SEQ ID NO: 595070 - RNA, 19 nt, Human
gccucacggccuaacacag

SEQ ID NO: 595071 - RNA, 18 nt, Human
gccucagccccuccucca

SEQ ID NO: 595072 - RNA, 24 nt, Human
gcggcggcagggcuggucuucugg

SEQ ID NO: 595073 - RNA, 22 nt, Human
ggaaaggucaagcagaaaugag

SEQ ID NO: 595074 - RNA, 20 nt, Human
ggaggaccgcuucaguccag

SEQ ID NO: 595075 - RNA, 18 nt, Human
ggaggcugaggcucacug

SEQ ID NO: 595076 - RNA, 22 nt, Human
ggaugaugaaaucaccuaacaa

SEQ ID NO: 595077 - RNA, 21 nt, Human
ggcaagucgcggcgccugggg

SEQ ID NO: 595078 - RNA, 21 nt, Human
ggcauccccucgaucccaccu

SEQ ID NO: 595079 - RNA, 18 nt, Human
ggcgccuggggacagagg

SEQ ID NO: 595080 - RNA, 19 nt, Human
ggcuuccaauaaaaucuca

SEQ ID NO: 595081 - RNA, 21 nt, Human
gggagggucuggaagaaaaag

SEQ ID NO: 595082 - RNA, 24 nt, Human
gggcacagugcagcuggggggcag

SEQ ID NO: 595083 - RNA, 23 nt, Human
gggcguccuaccggaaaagggaa

SEQ ID NO: 595084 - RNA, 18 nt, Human
gggcugaggcaggagauc

SEQ ID NO: 595085 - RNA, 20 nt, Human
ggucccagcuacuugggggg

SEQ ID NO: 595086 - RNA, 20 nt, Human
ggugggccuccucugcagca

SEQ ID NO: 595087 - RNA, 24 nt, Human
guaccuggaaccuggagaucaggu

SEQ ID NO: 595088 - RNA, 26 nt, Human
gucucaaaaaaacaaaauaaaaaaag

SEQ ID NO: 595089 - RNA, 18 nt, Human
guggggcaggcugucuca

SEQ ID NO: 595090 - RNA, 22 nt, Human
uaagcaacaaaaccugaaagcc

SEQ ID NO: 595091 - RNA, 23 nt, Human
uaagcaacaaaaccugaaagccc

SEQ ID NO: 595092 - RNA, 18 nt, Human
uaagucauaauauauagg

SEQ ID NO: 595093 - RNA, 25 nt, Human
uacaacuucacaaacccacugcgaa

SEQ ID NO: 595094 - RNA, 23 nt, Human
uaccggaaaagggaagcagccuc

SEQ ID NO: 595095 - RNA, 23 nt, Human
uacuuggggggcugaggcaggag

SEQ ID NO: 595096 - RNA, 22 nt, Human
uagcucaggaggugugccccuu

SEQ ID NO: 595097 - RNA, 21 nt, Human
uaggguuaaauaaaacccauc

SEQ ID NO: 595098 - RNA, 21 nt, Human
uauauaagaccccaagucaaa

SEQ ID NO: 595099 - RNA, 22 nt, Human
uauauaagaccccaagucaaaa

SEQ ID NO: 595100 - RNA, 22 nt, Human
uaugccaggugacacggagggg

SEQ ID NO: 595101 - RNA, 18 nt, Human
ucaaaggucggagcaggg

SEQ ID NO: 595102 - RNA, 22 nt, Human
ucaaauauucgccaccccuaac

SEQ ID NO: 595103 - RNA, 24 nt, Human
ucaaaugcugcacuccaccuccac

SEQ ID NO: 595104 - RNA, 20 nt, Human
ucacggccuaacacaggggc

SEQ ID NO: 595105 - RNA, 19 nt, Human
ucacuguagugagccgaga

SEQ ID NO: 595106 - RNA, 22 nt, Human
ucagccagugagaccuagugcc

SEQ ID NO: 595107 - RNA, 23 nt, Human
ucagccccuccuccaggaagccu

SEQ ID NO: 595108 - RNA, 23 nt, Human
uccaagcaaaaacggcaacaagg

SEQ ID NO: 595109 - RNA, 22 nt, Human
uccaaggaggcaagaguugagg

SEQ ID NO: 595110 - RNA, 20 nt, Human
uccaaggggcugcggucacc

SEQ ID NO: 595111 - RNA, 25 nt, Human
uccaaguguacuuuuucuuuccugc

SEQ ID NO: 595112 - RNA, 22 nt, Human
uccacaauauaguuuccaagca

SEQ ID NO: 595113 - RNA, 19 nt, Human
uccacaggccccaaucagc

SEQ ID NO: 595114 - RNA, 19 nt, Human
uccagaagcaacaggccau

SEQ ID NO: 595115 - RNA, 23 nt, Human
uccaggcuacaagugaauuuaaa

SEQ ID NO: 595116 - RNA, 21 nt, Human
uccccaagggcuguuucuacc

SEQ ID NO: 595117 - RNA, 19 nt, Human
uccggagugcaaggagggc

SEQ ID NO: 595118 - RNA, 23 nt, Human
uccggagugcaaggagggcaccg

SEQ ID NO: 595119 - RNA, 21 nt, Human
uccucaggagguccugagaac

SEQ ID NO: 595120 - RNA, 20 nt, Human
uccugcugcagggagagcuc

SEQ ID NO: 595121 - RNA, 24 nt, Human
uccugcugcagggagagcuccagc

SEQ ID NO: 595122 - RNA, 21 nt, Human
ucucgcucugccaucccuuga

SEQ ID NO: 595123 - RNA, 20 nt, Human
ucugauuugcagggcaggac

SEQ ID NO: 595124 - RNA, 24 nt, Human
ucugcagcagauggggccgggguc

SEQ ID NO: 595125 - RNA, 23 nt, Human
ugaaaagcaguguagacgcacug

SEQ ID NO: 595126 - RNA, 19 nt, Human
ugaauccccagcaccaguc

SEQ ID NO: 595127 - RNA, 19 nt, Human
ugaggugauggucccacag

SEQ ID NO: 595128 - RNA, 27 nt, Human
ugcaugacccuggaugugcuaagcaac

SEQ ID NO: 595129 - RNA, 21 nt, Human
ugccccgcuccaccccccgcc

SEQ ID NO: 595130 - RNA, 24 nt, Human
ugccccgcuccaccccccgccaac

SEQ ID NO: 595131 - RNA, 24 nt, Human
ugccuguggucccagcuacuuggg

SEQ ID NO: 595132 - RNA, 23 nt, Human
ugcugcacuccaccuccacagug

SEQ ID NO: 595133 - RNA, 19 nt, Human
ugcuugggucucuuccaag

SEQ ID NO: 595134 - RNA, 24 nt, Human
uggcacgugccuguggucccagcu

SEQ ID NO: 595135 - RNA, 18 nt, Human
uggcaggaugagagggag

SEQ ID NO: 595136 - RNA, 19 nt, Human
uggcaggaugagagggaga

SEQ ID NO: 595137 - RNA, 21 nt, Human
uggccuaaguguguuguucau

SEQ ID NO: 595138 - RNA, 18 nt, Human
uggggcaagucgcggcgc

SEQ ID NO: 595139 - RNA, 20 nt, Human
uggggcaggcugucucaucc

SEQ ID NO: 595140 - RNA, 23 nt, Human
uggggggcugaggcaggagauca

SEQ ID NO: 595141 - RNA, 21 nt, Human
uggguaagugggcuagagcaa

SEQ ID NO: 595142 - RNA, 19 nt, Human
ugguaccuggaaccuggag

SEQ ID NO: 595143 - RNA, 24 nt, Human
uggucccagcuacuuggggggcug

SEQ ID NO: 595144 - RNA, 24 nt, Human
ugguggcacgugccugugguccca

SEQ ID NO: 595145 - RNA, 24 nt, Human
uguacuguucauugcugcaaggga

SEQ ID NO: 595146 - RNA, 19 nt, Human
uguagacgcacuguacccc

SEQ ID NO: 595147 - RNA, 22 nt, Human
ugucugaauccccagcaccagu

SEQ ID NO: 595148 - RNA, 20 nt, Human
uguggacaggggcacagugc

SEQ ID NO: 595149 - RNA, 21 nt, Human
uuaaaaaagagucaaaaaugu

SEQ ID NO: 595150 - RNA, 21 nt, Human
uuaaacacauuuugagguaaa

SEQ ID NO: 595151 - RNA, 20 nt, Human
uuacagaugcaaauuuuccc

SEQ ID NO: 595152 - RNA, 22 nt, Human
uucacaaacccacugcgaaugc

SEQ ID NO: 595153 - RNA, 22 nt, Human
uucaccacugacaacucaaaua

SEQ ID NO: 595154 - RNA, 21 nt, Human
uucaggcucugagaagucacc

SEQ ID NO: 595155 - RNA, 22 nt, Human
uucaguccaggaguucaagacc

SEQ ID NO: 595156 - RNA, 22 nt, Human
uuccaagcaaaaacggcaacaa

SEQ ID NO: 595157 - RNA, 19 nt, Human
uuccuauucagaucuuuca

SEQ ID NO: 595158 - RNA, 24 nt, Human
uucuuuacagaugcaaauuuuccc

SEQ ID NO: 595159 - RNA, 24 nt, Human
uuggggggcugaggcaggagauca

SEQ ID NO: 595160 - RNA, 21 nt, Human
uuguucauccagccugcagaa

SEQ ID NO: 595161 - RNA, 20 nt, Human
uuuaauaaacuuccacuccc

SEQ ID NO: 595162 - RNA, 18 nt, Human
uuuuauguauuuuaggga

SEQ ID NO: 595163 - RNA, 24 nt, Human
aaaaaaaaguauauguaaacagaa

SEQ ID NO: 595164 - RNA, 20 nt, Human
aaaaacaaauaaaagugccc

SEQ ID NO: 595165 - RNA, 19 nt, Human
aaaaacccacaaauuuccc

SEQ ID NO: 595166 - RNA, 23 nt, Human
aaaaacccacaaauuuccccaac

SEQ ID NO: 595167 - RNA, 19 nt, Human
aaaaaggcagaauuacaau

SEQ ID NO: 595168 - RNA, 24 nt, Human
aaaauacacauucaauauagccaa

SEQ ID NO: 595169 - RNA, 24 nt, Human
aaacagaaaaaaaaaacccucuag

SEQ ID NO: 595170 - RNA, 18 nt, Human
aacacuggccuguggcac

SEQ ID NO: 595171 - RNA, 23 nt, Human
aagaagccauauguuaacuuagg

SEQ ID NO: 595172 - RNA, 19 nt, Human
aaguccugguauagagaag

SEQ ID NO: 595173 - RNA, 26 nt, Human
agaaaaaauucuuccaaaaaggcaga

SEQ ID NO: 595174 - RNA, 22 nt, Human
agccacagaacuauuucaaccu

SEQ ID NO: 595175 - RNA, 22 nt, Human
auacaucuuaauaaaagaacuc

SEQ ID NO: 595176 - RNA, 19 nt, Human
auacugagcuaagaagucc

SEQ ID NO: 595177 - RNA, 23 nt, Human
aucaaugccaagauuuacaaauu

SEQ ID NO: 595178 - RNA, 19 nt, Human
caacagaaaaacuuacauc

SEQ ID NO: 595179 - RNA, 22 nt, Human
caacagaaaaacuuacauccag

SEQ ID NO: 595180 - RNA, 23 nt, Human
caacagaaaaacuuacauccaga

SEQ ID NO: 595181 - RNA, 21 nt, Human
cacaacauucagcuuccuaag

SEQ ID NO: 595182 - RNA, 23 nt, Human
cagagauucuuuucccauuauuu

SEQ ID NO: 595183 - RNA, 18 nt, Human
ccacaacuuucuucuugu

SEQ ID NO: 595184 - RNA, 20 nt, Human
ccacaacuuucuucuuguag

SEQ ID NO: 595185 - RNA, 23 nt, Human
cuuucuggacuaccaaaggaaua

SEQ ID NO: 595186 - RNA, 18 nt, Human
gagaagcagagagaccaa

SEQ ID NO: 595187 - RNA, 23 nt, Human
gauacaucuuaauaaaagaacuc

SEQ ID NO: 595188 - RNA, 19 nt, Human
gaugauguuucuuucugga

SEQ ID NO: 595189 - RNA, 19 nt, Human
gcccaaguuuuaagaagcc

SEQ ID NO: 595190 - RNA, 22 nt, Human
gugaacuuaagaugacuuguuu

SEQ ID NO: 595191 - RNA, 18 nt, Human
uaaacagaaaaaaaaaac

SEQ ID NO: 595192 - RNA, 24 nt, Human
uaaugauaaagccuguccaaguac

SEQ ID NO: 595193 - RNA, 20 nt, Human
uacacauucaauauagccaa

SEQ ID NO: 595194 - RNA, 24 nt, Human
uagagaagcagagagaccaaccua

SEQ ID NO: 595195 - RNA, 23 nt, Human
uaggagaacacucuuuaaugaua

SEQ ID NO: 595196 - RNA, 25 nt, Human
uagugauaacacaacauucagcuuc

SEQ ID NO: 595197 - RNA, 21 nt, Human
uauagagaagcagagagacca

SEQ ID NO: 595198 - RNA, 22 nt, Human
uauauauuucaccaacaacacu

SEQ ID NO: 595199 - RNA, 26 nt, Human
uaucucaacaauacauuuauuacuug

SEQ ID NO: 595200 - RNA, 21 nt, Human
uauguaaacagaaaaaaaaaa

SEQ ID NO: 595201 - RNA, 22 nt, Human
uauguaaacagaaaaaaaaaac

SEQ ID NO: 595202 - RNA, 25 nt, Human
uauuagugauaacacaacauucagc

SEQ ID NO: 595203 - RNA, 18 nt, Human
uauuucaaccuguacccu

SEQ ID NO: 595204 - RNA, 22 nt, Human
uauuucaaccuguacccuuaau

SEQ ID NO: 595205 - RNA, 21 nt, Human
ucacuaaagaaaaauacacau

SEQ ID NO: 595206 - RNA, 21 nt, Human
uccucagugucaauauaucuc

SEQ ID NO: 595207 - RNA, 25 nt, Human
ucucuuucacuucuagcagaagcug

SEQ ID NO: 595208 - RNA, 21 nt, Human
ucuuaggacagccacagaacu

SEQ ID NO: 595209 - RNA, 18 nt, Human
ugaagggagaugauacug

SEQ ID NO: 595210 - RNA, 19 nt, Human
ugccaagauuuacaaauuc

SEQ ID NO: 595211 - RNA, 22 nt, Human
ugcuaaguacugaaauaaaaca

SEQ ID NO: 595212 - RNA, 22 nt, Human
uguaaacagaaaaaaaaaaccc

SEQ ID NO: 595213 - RNA, 24 nt, Human
uguaaacagaaaaaaaaaacccuc

SEQ ID NO: 595214 - RNA, 23 nt, Human
uuccccaacuauagcuuaucugu

SEQ ID NO: 595215 - RNA, 20 nt, Human
uucuaguuuuaaaaagaagc

SEQ ID NO: 595216 - RNA, 20 nt, Human
uuuauaagcuccucaguguc

SEQ ID NO: 595217 - RNA, 23 nt, Human
aaacaggaggaaucggggcaagg

SEQ ID NO: 595218 - RNA, 21 nt, Human
aaauggcugcaggaaagccga

SEQ ID NO: 595219 - RNA, 23 nt, Human
aagcacuggcagaucacgcacuu

SEQ ID NO: 595220 - RNA, 20 nt, Human
aaugccucgucugggauuca

SEQ ID NO: 595221 - RNA, 20 nt, Human
acaggcagaggacguccaca

SEQ ID NO: 595222 - RNA, 20 nt, Human
accccgggaacacccuggcc

SEQ ID NO: 595223 - RNA, 21 nt, Human
acccuggccccuuucccuaac

SEQ ID NO: 595224 - RNA, 19 nt, Human
accgacccaccugcugcgc

SEQ ID NO: 595225 - RNA, 23 nt, Human
acucuacacugcacaaugucaaa

SEQ ID NO: 595226 - RNA, 21 nt, Human
agaaagcacuggcagaucacg

SEQ ID NO: 595227 - RNA, 20 nt, Human
agaggacguccacaaacacc

SEQ ID NO: 595228 - RNA, 21 nt, Human
aggaaacagcuucugcuuuug

SEQ ID NO: 595229 - RNA, 24 nt, Human
agggaugccagacccucggccucc

SEQ ID NO: 595230 - RNA, 23 nt, Human
caacccuggggagcgcaaacagg

SEQ ID NO: 595231 - RNA, 26 nt, Human
cagaacccacagaccugccugcaggg

SEQ ID NO: 595232 - RNA, 22 nt, Human
cagggacaagguggcuccaaag

SEQ ID NO: 595233 - RNA, 25 nt, Human
ccaaaacggcacuggaaaaugugac

SEQ ID NO: 595234 - RNA, 22 nt, Human
ccagacccucggccuccuggac

SEQ ID NO: 595235 - RNA, 20 nt, Human
ccagaugcccagugggcuca

SEQ ID NO: 595236 - RNA, 25 nt, Human
cccaaccccgggaacacccuggccc

SEQ ID NO: 595237 - RNA, 21 nt, Human
cccaaggaguuuagucuccuu

SEQ ID NO: 595238 - RNA, 20 nt, Human
cccacagaccugccugcagg

SEQ ID NO: 595239 - RNA, 21 nt, Human
cccaggggcguggaaaggccc

SEQ ID NO: 595240 - RNA, 23 nt, Human
ccccaaccccgggaacacccugg

SEQ ID NO: 595241 - RNA, 21 nt, Human
cccgcgcugcauccccgggac

SEQ ID NO: 595242 - RNA, 26 nt, Human
cccggccccugccccgcaccgguucc

SEQ ID NO: 595243 - RNA, 23 nt, Human
cccggccccugccccgcacuccc

SEQ ID NO: 595244 - RNA, 21 nt, Human
ccgcgcugcauccccgggacc

SEQ ID NO: 595245 - RNA, 18 nt, Human
ccggccccugccccgcac

SEQ ID NO: 595246 - RNA, 19 nt, Human
ccuccggggggacccggcc

SEQ ID NO: 595247 - RNA, 23 nt, Human
ccuccuggacgcacagcgggggc

SEQ ID NO: 595248 - RNA, 19 nt, Human
ccugcagggccccucaccg

SEQ ID NO: 595249 - RNA, 20 nt, Human
ccuggacgcacagcgggggc

SEQ ID NO: 595250 - RNA, 19 nt, Human
cgaaaaggcuaaacagcug

SEQ ID NO: 595251 - RNA, 22 nt, Human
cggcaaagcggccccuccggaa

SEQ ID NO: 595252 - RNA, 24 nt, Human
cggcaaagcggccccuccggaacg

SEQ ID NO: 595253 - RNA, 22 nt, Human
cgggggcucgcaccccaacccc

SEQ ID NO: 595254 - RNA, 25 nt, Human
cucacaacuucccagcaagaaaugu

SEQ ID NO: 595255 - RNA, 20 nt, Human
cucagacagacagaucuuua

SEQ ID NO: 595256 - RNA, 23 nt, Human
cucgcaccccaaccccgggaaca

SEQ ID NO: 595257 - RNA, 31 nt, Human
cucgcaccccaaccccgggaacacccuggcc

SEQ ID NO: 595258 - RNA, 23 nt, Human
cugugaucucugcgagcuacucc

SEQ ID NO: 595259 - RNA, 25 nt, Human
gaccacuugcuaauugauuucccau

SEQ ID NO: 595260 - RNA, 20 nt, Human
gagcgcuggcccagggugug

SEQ ID NO: 595261 - RNA, 22 nt, Human
gcaaacaggaggaaucggggca

SEQ ID NO: 595262 - RNA, 25 nt, Human
gccggucccagccgcccccucgugc

SEQ ID NO: 595263 - RNA, 21 nt, Human
gcuccaaaggagaggugccaa

SEQ ID NO: 595264 - RNA, 18 nt, Human
ggagcgcaaacaggagga

SEQ ID NO: 595265 - RNA, 19 nt, Human
ggggacccggccccugccc

SEQ ID NO: 595266 - RNA, 23 nt, Human
gggggcucgcaccccaaccccgg

SEQ ID NO: 595267 - RNA, 18 nt, Human
ggucugaaaacccugccu

SEQ ID NO: 595268 - RNA, 18 nt, Human
guaugggugaaaaguuuc

SEQ ID NO: 595269 - RNA, 21 nt, Human
gugacuugaagaaagcacugg

SEQ ID NO: 595270 - RNA, 20 nt, Human
guggaaaggcccaaugccuc

SEQ ID NO: 595271 - RNA, 22 nt, Human
uacauugcaaccaguucucaca

SEQ ID NO: 595272 - RNA, 20 nt, Human
uaccccaggccggucccagc

SEQ ID NO: 595273 - RNA, 24 nt, Human
uacuaaaugggcugggacccacgg

SEQ ID NO: 595274 - RNA, 24 nt, Human
uagccagggacaagguggcuccaa

SEQ ID NO: 595275 - RNA, 23 nt, Human
ucaggagcggauucagggcacag

SEQ ID NO: 595276 - RNA, 22 nt, Human
ucauugcuguguaaugcuggug

SEQ ID NO: 595277 - RNA, 22 nt, Human
ucucagccaccuccggggggac

SEQ ID NO: 595278 - RNA, 20 nt, Human
ugacccccgcgcugcauccc

SEQ ID NO: 595279 - RNA, 24 nt, Human
ugaggcguccucaccgucuacccu

SEQ ID NO: 595280 - RNA, 21 nt, Human
ugcaaccaguucucacauuua

SEQ ID NO: 595281 - RNA, 24 nt, Human
ugcaagcauuucugugaucucugc

SEQ ID NO: 595282 - RNA, 23 nt, Human
uguguuuacagaggugagggcuu

SEQ ID NO: 595283 - RNA, 25 nt, Human
uuagccucaggagcggauucagggc

SEQ ID NO: 595284 - RNA, 19 nt, Human
uucagggcacaggcagagg

SEQ ID NO: 595285 - RNA, 22 nt, Human
uucccguggacccuucucguug

SEQ ID NO: 595286 - RNA, 21 nt, Human
aaaacaaacaaacaaaagagc

SEQ ID NO: 595287 - RNA, 22 nt, Human
aaaacaaacaaacaaaagagca

SEQ ID NO: 595288 - RNA, 23 nt, Human
aaaacaaacaaacaaaagagcac

SEQ ID NO: 595289 - RNA, 18 nt, Human
aaaagagcacagugaacu

SEQ ID NO: 595290 - RNA, 19 nt, Human
aacaaaagagcacagugaa

SEQ ID NO: 595291 - RNA, 22 nt, Human
aacaaaccccuuuuggacagaa

SEQ ID NO: 595292 - RNA, 19 nt, Human
aacauugccucugcugagu

SEQ ID NO: 595293 - RNA, 20 nt, Human
aacucuagaguuuucagaga

SEQ ID NO: 595294 - RNA, 28 nt, Human
aagaggaacaaaccccuuuuggacagaa

SEQ ID NO: 595295 - RNA, 21 nt, Human
aaguugccuaagacacaacuu

SEQ ID NO: 595296 - RNA, 20 nt, Human
acaaacaaaagagcacagug

SEQ ID NO: 595297 - RNA, 22 nt, Human
acaaacaaugcaguaauaaugc

SEQ ID NO: 595298 - RNA, 19 nt, Human
acauaaaauaaaaaaaucu

SEQ ID NO: 595299 - RNA, 19 nt, Human
acauguauugacuaauucc

SEQ ID NO: 595300 - RNA, 20 nt, Human
accaaaacaaacaaacaaaa

SEQ ID NO: 595301 - RNA, 18 nt, Human
acuccagauucaggcaag

SEQ ID NO: 595302 - RNA, 20 nt, Human
agaagcaaauggaagacuug

SEQ ID NO: 595303 - RNA, 24 nt, Human
aggaacaaaccccuuuuggacaga

SEQ ID NO: 595304 - RNA, 19 nt, Human
aggguaauaauaaggcaug

SEQ ID NO: 595305 - RNA, 18 nt, Human
auaaugccucugguuuua

SEQ ID NO: 595306 - RNA, 20 nt, Human
aucacugucguugaaaacuu

SEQ ID NO: 595307 - RNA, 22 nt, Human
caaacaaacaaaagagcacagu

SEQ ID NO: 595308 - RNA, 28 nt, Human
caaacaaacaaaagagcacagugaacuc

SEQ ID NO: 595309 - RNA, 21 nt, Human
cacauaaaacagacuuguaac

SEQ ID NO: 595310 - RNA, 18 nt, Human
cacuggacaucgaaguuc

SEQ ID NO: 595311 - RNA, 18 nt, Human
cagagggcucaaccccac

SEQ ID NO: 595312 - RNA, 24 nt, Human
caugguggccucuuggggucccuu

SEQ ID NO: 595313 - RNA, 21 nt, Human
cauuuuagaauucucaugaaa

SEQ ID NO: 595314 - RNA, 26 nt, Human
ccaaaacaaacaaacaaaagagcaca

SEQ ID NO: 595315 - RNA, 27 nt, Human
ccaaaacaaacaaacaaaagagcacag

SEQ ID NO: 595316 - RNA, 21 nt, Human
ccuaagacacaacuuccuaca

SEQ ID NO: 595317 - RNA, 18 nt, Human
ccucucuuccccuuuucc

SEQ ID NO: 595318 - RNA, 21 nt, Human
cgagauaagagcaugguggcc

SEQ ID NO: 595319 - RNA, 22 nt, Human
cggcccgaggggcgauggacgg

SEQ ID NO: 595320 - RNA, 18 nt, Human
cucaaccccacuccagau

SEQ ID NO: 595321 - RNA, 19 nt, Human
cugcugaguggaauuugca

SEQ ID NO: 595322 - RNA, 19 nt, Human
cuggcuccucaaacagcaa

SEQ ID NO: 595323 - RNA, 21 nt, Human
cugguuuuaguuccucuugga

SEQ ID NO: 595324 - RNA, 18 nt, Human
gacacaacuuccuacaua

SEQ ID NO: 595325 - RNA, 25 nt, Human
gaccguccucuaacugcaccucuau

SEQ ID NO: 595326 - RNA, 19 nt, Human
gaccuuggugacacucagc

SEQ ID NO: 595327 - RNA, 22 nt, Human
gcaacaucaccaaacgugcauu

SEQ ID NO: 595328 - RNA, 19 nt, Human
ggaacaaaccccuuuugga

SEQ ID NO: 595329 - RNA, 19 nt, Human
ggcaaggggaauaggaaag

SEQ ID NO: 595330 - RNA, 22 nt, Human
gguggccucuuggggucccuug

SEQ ID NO: 595331 - RNA, 21 nt, Human
gugaacucaaaucauauucca

SEQ ID NO: 595332 - RNA, 27 nt, Human
uaagaagcaaauggaagacuugcucca

SEQ ID NO: 595333 - RNA, 26 nt, Human
uaagacacaacuuccuacauagagga

SEQ ID NO: 595334 - RNA, 25 nt, Human
uagacagacucccaguaauuaagcc

SEQ ID NO: 595335 - RNA, 21 nt, Human
uagacugugaauauuuacaga

SEQ ID NO: 595336 - RNA, 18 nt, Human
uaguaaucaaaacacaua

SEQ ID NO: 595337 - RNA, 22 nt, Human
uaugaccaaaacaaacaaacaa

SEQ ID NO: 595338 - RNA, 21 nt, Human
uauuggcauccugccauuuca

SEQ ID NO: 595339 - RNA, 18 nt, Human
uauuguccuuuagagcac

SEQ ID NO: 595340 - RNA, 21 nt, Human
ucaaccccacuccagauucag

SEQ ID NO: 595341 - RNA, 21 nt, Human
ucacugucguugaaaacuuuc

SEQ ID NO: 595342 - RNA, 18 nt, Human
uccacauggcuauggagu

SEQ ID NO: 595343 - RNA, 21 nt, Human
uccagauucaggcaaggggaa

SEQ ID NO: 595344 - RNA, 20 nt, Human
ucccaguaauuaagccucca

SEQ ID NO: 595345 - RNA, 20 nt, Human
ucccaguaauuaagccucca

SEQ ID NO: 595346 - RNA, 20 nt, Human
ucccucugguuguugagccu

SEQ ID NO: 595347 - RNA, 21 nt, Human
ucccuugaugggggcuguugg

SEQ ID NO: 595348 - RNA, 18 nt, Human
ugaaauaucucauauugg

SEQ ID NO: 595349 - RNA, 19 nt, Human
ugaccaaaacaaacaaaca

SEQ ID NO: 595350 - RNA, 21 nt, Human
ugagaaaaagauacuaauggg

SEQ ID NO: 595351 - RNA, 18 nt, Human
ugcacuucuaccaucaac

SEQ ID NO: 595352 - RNA, 21 nt, Human
ugcacuucuaccaucaacucc

SEQ ID NO: 595353 - RNA, 26 nt, Human
uggaagacuugcuccaacucuagagu

SEQ ID NO: 595354 - RNA, 18 nt, Human
uggccucuuggggucccu

SEQ ID NO: 595355 - RNA, 19 nt, Human
uuacuccugccauggauca

SEQ ID NO: 595356 - RNA, 21 nt, Human
uuauacaaacaaacuguauuu

SEQ ID NO: 595357 - RNA, 19 nt, Human
uucccagugacaaacaaug

SEQ ID NO: 595358 - RNA, 20 nt, Human
uugcauucguuacuucaaaa

SEQ ID NO: 595359 - RNA, 25 nt, Human
aaaaaaacaaaaaaaaacuauacca

SEQ ID NO: 595360 - RNA, 18 nt, Human
aaaaaaaucaaggcagcu

SEQ ID NO: 595361 - RNA, 21 nt, Human
aaaaaaucaaggcagcuagua

SEQ ID NO: 595362 - RNA, 19 nt, Human
aaaaaaucccccccaccca

SEQ ID NO: 595363 - RNA, 21 nt, Human
aaaaaggaaaauccuugaaga

SEQ ID NO: 595364 - RNA, 20 nt, Human
aaaacaaauguucaaggaaa

SEQ ID NO: 595365 - RNA, 22 nt, Human
aaaaggugacgaguuuuuuaaa

SEQ ID NO: 595366 - RNA, 23 nt, Human
aaaaucccccccacccacaaaaa

SEQ ID NO: 595367 - RNA, 22 nt, Human
aaaaucggcaaagcacaaaaca

SEQ ID NO: 595368 - RNA, 26 nt, Human
aaacaaaaaaaaacuauaccaaccga

SEQ ID NO: 595369 - RNA, 19 nt, Human
aaacacaacugcuacaagg

SEQ ID NO: 595370 - RNA, 25 nt, Human
aaacacaggcuauagcaacuaugaa

SEQ ID NO: 595371 - RNA, 19 nt, Human
aaacagcaaaagaacauga

SEQ ID NO: 595372 - RNA, 21 nt, Human
aaagaauaccauguuaaccac

SEQ ID NO: 595373 - RNA, 21 nt, Human
aaaggcaaaggagacaaccag

SEQ ID NO: 595374 - RNA, 22 nt, Human
aaauccugucucuacuaaaaaa

SEQ ID NO: 595375 - RNA, 22 nt, Human
aacagcgaaacuccgucucaaa

SEQ ID NO: 595376 - RNA, 18 nt, Human
aacccacugagucagacu

SEQ ID NO: 595377 - RNA, 19 nt, Human
aagacccccauggugggaa

SEQ ID NO: 595378 - RNA, 19 nt, Human
aaggcacaaagcucccccg

SEQ ID NO: 595379 - RNA, 18 nt, Human
aauaaggaaugaaaaaau

SEQ ID NO: 595380 - RNA, 23 nt, Human
aaucacaaaacuaaacacaggcu

SEQ ID NO: 595381 - RNA, 24 nt, Human
aaucccuugaacccaggaggcgga

SEQ ID NO: 595382 - RNA, 19 nt, Human
aauccuugaagaaaggcaa

SEQ ID NO: 595383 - RNA, 18 nt, Human
aauuagccaggcauggug

SEQ ID NO: 595384 - RNA, 24 nt, Human
acaaagcucccccgagauacccag

SEQ ID NO: 595385 - RNA, 20 nt, Human
acaacagcgaaacuccgucu

SEQ ID NO: 595386 - RNA, 21 nt, Human
acaacagcgaaacuccgucuc

SEQ ID NO: 595387 - RNA, 22 nt, Human
acagcaaggaggccauccugaa

SEQ ID NO: 595388 - RNA, 22 nt, Human
acaggagaaucccuugaaccca

SEQ ID NO: 595389 - RNA, 24 nt, Human
accaacauggagaaauccugucuc

SEQ ID NO: 595390 - RNA, 20 nt, Human
acccacugagucagacugua

SEQ ID NO: 595391 - RNA, 24 nt, Human
accugaggucaggaguucaagacc

SEQ ID NO: 595392 - RNA, 24 nt, Human
agaaaaaggaaaauccuugaagaa

SEQ ID NO: 595393 - RNA, 23 nt, Human
agacacacacacacaaaaucagg

SEQ ID NO: 595394 - RNA, 23 nt, Human
agacagacgcacagucugucaac

SEQ ID NO: 595395 - RNA, 24 nt, Human
agacagacgcacagucugucaacu

SEQ ID NO: 595396 - RNA, 23 nt, Human
agacagcaaggaggccauccuga

SEQ ID NO: 595397 - RNA, 18 nt, Human
agagcagaguggucacug

SEQ ID NO: 595398 - RNA, 23 nt, Human
agaucaccugaggucaggaguuc

SEQ ID NO: 595399 - RNA, 20 nt, Human
agaugguaacauccagggcc

SEQ ID NO: 595400 - RNA, 24 nt, Human
agaugguaacauccagggccuaaa

SEQ ID NO: 595401 - RNA, 22 nt, Human
agcacaaaacagcaaaagaaca

SEQ ID NO: 595402 - RNA, 24 nt, Human
agcacuuuaggaggccgagguggg

SEQ ID NO: 595403 - RNA, 19 nt, Human
agcaucacaaacuguugga

SEQ ID NO: 595404 - RNA, 23 nt, Human
agccaggcaugguggcgcaugcc

SEQ ID NO: 595405 - RNA, 21 nt, Human
agcucucuccucccccagucc

SEQ ID NO: 595406 - RNA, 24 nt, Human
aggcaugguggcgcaugccuguaa

SEQ ID NO: 595407 - RNA, 23 nt, Human
aggccaauaccaaauaugagaga

SEQ ID NO: 595408 - RNA, 21 nt, Human
aggccgaggugggcagaucac

SEQ ID NO: 595409 - RNA, 19 nt, Human
aggcggagguuguggugag

SEQ ID NO: 595410 - RNA, 22 nt, Human
agggaaaaaacaugauaaagag

SEQ ID NO: 595411 - RNA, 24 nt, Human
agggaaaaaacaugauaaagagga

SEQ ID NO: 595412 - RNA, 23 nt, Human
agggcacgagucuuagauuuuug

SEQ ID NO: 595413 - RNA, 24 nt, Human
aggugcaguggcucaugccuguaa

SEQ ID NO: 595414 - RNA, 22 nt, Human
aggugggcagaucaccugaggu

SEQ ID NO: 595415 - RNA, 26 nt, Human
aggugggcagaucaccugaggucagg

SEQ ID NO: 595416 - RNA, 24 nt, Human
aggugggucuuuugcuugaaccug

SEQ ID NO: 595417 - RNA, 23 nt, Human
aguggcucaugccuguaauccca

SEQ ID NO: 595418 - RNA, 24 nt, Human
aguggcucaugccuguaaucccag

SEQ ID NO: 595419 - RNA, 22 nt, Human
auacugccacuagaauccuaaa

SEQ ID NO: 595420 - RNA, 24 nt, Human
aucaccugaggucaggaguucaag

SEQ ID NO: 595421 - RNA, 18 nt, Human
auccaaaaucggcaaagc

SEQ ID NO: 595422 - RNA, 24 nt, Human
augaaaaaaucccccccacccaca

SEQ ID NO: 595423 - RNA, 19 nt, Human
augccuguaaucccagcac

SEQ ID NO: 595424 - RNA, 22 nt, Human
augcuagcuauuccaacuacau

SEQ ID NO: 595425 - RNA, 24 nt, Human
auugcacuccagccugggcaacaa

SEQ ID NO: 595426 - RNA, 26 nt, Human
auugcacuccagccugggcaacaaca

SEQ ID NO: 595427 - RNA, 23 nt, Human
caaagcacaaaacagcaaaagaa

SEQ ID NO: 595428 - RNA, 23 nt, Human
caaagcacaaaacagcaaaagaa

SEQ ID NO: 595429 - RNA, 21 nt, Human
caaagcucccccgagauaccc

SEQ ID NO: 595430 - RNA, 23 nt, Human
caaagcucccccgagauacccag

SEQ ID NO: 595431 - RNA, 21 nt, Human
caacaacagcgaaacuccguc

SEQ ID NO: 595432 - RNA, 24 nt, Human
caacauggagaaauccugucucua

SEQ ID NO: 595433 - RNA, 26 nt, Human
caacuccuaagacauccauuaagaca

SEQ ID NO: 595434 - RNA, 21 nt, Human
caacugacaccacaauagcac

SEQ ID NO: 595435 - RNA, 21 nt, Human
caagaauacugccacuagaau

SEQ ID NO: 595436 - RNA, 21 nt, Human
caauagcacuagccugcccua

SEQ ID NO: 595437 - RNA, 21 nt, Human
cacaaaaaaaaaucaaggcag

SEQ ID NO: 595438 - RNA, 19 nt, Human
cacaaaacagcaaaagaac

SEQ ID NO: 595439 - RNA, 25 nt, Human
cacaaaacagcaaaagaacaugaaa

SEQ ID NO: 595440 - RNA, 19 nt, Human
cacaaaacuaaacacaggc

SEQ ID NO: 595441 - RNA, 23 nt, Human
cacaaagcucccccgagauaccc

SEQ ID NO: 595442 - RNA, 22 nt, Human
cacacacacacaaaaucaggaa

SEQ ID NO: 595443 - RNA, 21 nt, Human
caccacaauagcacuagccug

SEQ ID NO: 595444 - RNA, 23 nt, Human
caccugaggucaggaguucaaga

SEQ ID NO: 595445 - RNA, 24 nt, Human
cagaucaccugaggucaggaguuc

SEQ ID NO: 595446 - RNA, 27 nt, Human
cagaucaccugaggucaggaguucaag

SEQ ID NO: 595447 - RNA, 24 nt, Human
cagcacuuuaggaggccgaggugg

SEQ ID NO: 595448 - RNA, 24 nt, Human
cagccugaccaacauggagaaauc

SEQ ID NO: 595449 - RNA, 18 nt, Human
cagccugggcaacaacag

SEQ ID NO: 595450 - RNA, 18 nt, Human
cauguuccugucaaccca

SEQ ID NO: 595451 - RNA, 18 nt, Human
cauugcacuccagccugg

SEQ ID NO: 595452 - RNA, 19 nt, Human
cauugcacuccagccuggg

SEQ ID NO: 595453 - RNA, 21 nt, Human
cauugcacuccagccugggca

SEQ ID NO: 595454 - RNA, 24 nt, Human
cauugcacuccagccugggcaaca

SEQ ID NO: 595455 - RNA, 26 nt, Human
cauugcacuccagccugggcaacaac

SEQ ID NO: 595456 - RNA, 23 nt, Human
ccacaaaaaaaaaucaaggcagc

SEQ ID NO: 595457 - RNA, 19 nt, Human
ccacaauagcacuagccug

SEQ ID NO: 595458 - RNA, 19 nt, Human
ccagaaaguagacuuugcc

SEQ ID NO: 595459 - RNA, 22 nt, Human
ccaggaggcggagguuguggug

SEQ ID NO: 595460 - RNA, 20 nt, Human
ccauugcacuccagccuggg

SEQ ID NO: 595461 - RNA, 21 nt, Human
ccauugcacuccagccugggc

SEQ ID NO: 595462 - RNA, 22 nt, Human
ccauugcacuccagccugggca

SEQ ID NO: 595463 - RNA, 23 nt, Human
ccauugcacuccagccugggcaa

SEQ ID NO: 595464 - RNA, 24 nt, Human
ccauugcacuccagccugggcaac

SEQ ID NO: 595465 - RNA, 22 nt, Human
cccacaaaaaaaaaucaaggcu

SEQ ID NO: 595466 - RNA, 23 nt, Human
cccaguaccaucuuuaaggcgaa

SEQ ID NO: 595467 - RNA, 18 nt, Human
ccccacccacaaaaaaaa

SEQ ID NO: 595468 - RNA, 21 nt, Human
ccccacccacaaaaaaaaauc

SEQ ID NO: 595469 - RNA, 24 nt, Human
ccccagaauuuaaaacagcggacc

SEQ ID NO: 595470 - RNA, 25 nt, Human
ccuaaagacaccucuuguuaacuaa

SEQ ID NO: 595471 - RNA, 21 nt, Human
ccuaaagagcagaguggucac

SEQ ID NO: 595472 - RNA, 22 nt, Human
ccugaccaacauggagaaaucc

SEQ ID NO: 595473 - RNA, 24 nt, Human
ccugaccaacauggagaaauccug

SEQ ID NO: 595474 - RNA, 19 nt, Human
ccuguaaucccagcacuuu

SEQ ID NO: 595475 - RNA, 21 nt, Human
ccugucccuucacuccuuggg

SEQ ID NO: 595476 - RNA, 20 nt, Human
cgaggugggcagaucaccug

SEQ ID NO: 595477 - RNA, 24 nt, Human
cgaggugggcagaucaccugaggu

SEQ ID NO: 595478 - RNA, 26 nt, Human
cgaggugggcagaucaccugagguca

SEQ ID NO: 595479 - RNA, 23 nt, Human
cgaugguggcuucgcauguuccu

SEQ ID NO: 595480 - RNA, 22 nt, Human
cgcacagucugucaacuuuggu

SEQ ID NO: 595481 - RNA, 21 nt, Human
cggcaaagcacaaaacagcaa

SEQ ID NO: 595482 - RNA, 23 nt, Human
cggcaaagcacaaaacagcaaaa

SEQ ID NO: 595483 - RNA, 24 nt, Human
cggccaggugcaguggcucaugcc

SEQ ID NO: 595484 - RNA, 21 nt, Human
cuaaacacaggcuauagcaac

SEQ ID NO: 595485 - RNA, 24 nt, Human
cucaugccuguaaucccagcacuu

SEQ ID NO: 595486 - RNA, 21 nt, Human
cuguagggaacuagacuacag

SEQ ID NO: 595487 - RNA, 20 nt, Human
cuuaaaaccccauguacccu

SEQ ID NO: 595488 - RNA, 25 nt, Human
cuuauaauguccuggauugccaacu

SEQ ID NO: 595489 - RNA, 18 nt, Human
gaacagccuucacagaga

SEQ ID NO: 595490 - RNA, 19 nt, Human
gacucugggugggcagcuc

SEQ ID NO: 595491 - RNA, 18 nt, Human
gagcaucacaaacuguug

SEQ ID NO: 595492 - RNA, 20 nt, Human
gaggcggagguuguggugag

SEQ ID NO: 595493 - RNA, 23 nt, Human
gaggugggcagaucaccugaggu

SEQ ID NO: 595494 - RNA, 23 nt, Human
gaggugggucuuuugcuugaacc

SEQ ID NO: 595495 - RNA, 24 nt, Human
gauacgccauugcacuccagccug

SEQ ID NO: 595496 - RNA, 23 nt, Human
gaucaccugaggucaggaguuca

SEQ ID NO: 595497 - RNA, 24 nt, Human
gaucaccugaggucaggaguucaa

SEQ ID NO: 595498 - RNA, 21 nt, Human
gauccaucaaggcacaaagcu

SEQ ID NO: 595499 - RNA, 21 nt, Human
gcaaaugaaacuaaauaucaa

SEQ ID NO: 595500 - RNA, 22 nt, Human
gccauugcacuccagccugggc

SEQ ID NO: 595501 - RNA, 24 nt, Human
gccauugcacuccagccugggcaa

SEQ ID NO: 595502 - RNA, 23 nt, Human
ggaaaagcaaauccuugacugga

SEQ ID NO: 595503 - RNA, 21 nt, Human
ggagaaucccuugaacccagg

SEQ ID NO: 595504 - RNA, 20 nt, Human
ggagaggagaggauuuacua

SEQ ID NO: 595505 - RNA, 23 nt, Human
ggagauacgccauugcacuccag

SEQ ID NO: 595506 - RNA, 22 nt, Human
ggagguuguggugaguggagau

SEQ ID NO: 595507 - RNA, 25 nt, Human
ggagguuguggugaguggagauacg

SEQ ID NO: 595508 - RNA, 21 nt, Human
ggccaggugcaguggcucaug

SEQ ID NO: 595509 - RNA, 19 nt, Human
gggaaaaaacaugauaaag

SEQ ID NO: 595510 - RNA, 26 nt, Human
gggcagaucaccugaggucaggaguu

SEQ ID NO: 595511 - RNA, 21 nt, Human
gguaaagaaucucuuccuuau

SEQ ID NO: 595512 - RNA, 22 nt, Human
ggucccaaagguggauguuugg

SEQ ID NO: 595513 - RNA, 24 nt, Human
gguggcgcaugccuguaaucacag

SEQ ID NO: 595514 - RNA, 24 nt, Human
ggugggcagcucuucaauaaagac

SEQ ID NO: 595515 - RNA, 25 nt, Human
guauauccacgucuaacagguuaca

SEQ ID NO: 595516 - RNA, 21 nt, Human
gucuuuugcuugaaccugggu

SEQ ID NO: 595517 - RNA, 22 nt, Human
gucuuuugcuugaaccugggug

SEQ ID NO: 595518 - RNA, 22 nt, Human
uaaaauccaaaaucggcaaagc

SEQ ID NO: 595519 - RNA, 22 nt, Human
uaaacacaggcuauagcaacua

SEQ ID NO: 595520 - RNA, 24 nt, Human
uaacagguuacaagaauacugcca

SEQ ID NO: 595521 - RNA, 19 nt, Human
uaagacagacgcacagucu

SEQ ID NO: 595522 - RNA, 23 nt, Human
uaagacagacgcacagucuguca

SEQ ID NO: 595523 - RNA, 24 nt, Human
uaagacaggagaaucccuugaacc

SEQ ID NO: 595524 - RNA, 23 nt, Human
uaaguucaauaaggaaugaaaaa

SEQ ID NO: 595525 - RNA, 18 nt, Human
uaauugaaacugacaacg

SEQ ID NO: 595526 - RNA, 24 nt, Human
uacauccacguuagcauccaugug

SEQ ID NO: 595527 - RNA, 23 nt, Human
uaccagaaaguagacuuugccuc

SEQ ID NO: 595528 - RNA, 18 nt, Human
uaccaggagggcacgagu

SEQ ID NO: 595529 - RNA, 19 nt, Human
uagacuacaguucccuacu

SEQ ID NO: 595530 - RNA, 22 nt, Human
uagagaacagcucucuccuccc

SEQ ID NO: 595531 - RNA, 20 nt, Human
uaggaggccgaggugggcag

SEQ ID NO: 595532 - RNA, 24 nt, Human
uaggaggccgaggugggcagauca

SEQ ID NO: 595533 - RNA, 19 nt, Human
uaggcaaaauccugucccu

SEQ ID NO: 595534 - RNA, 19 nt, Human
uauaagauucuuuucuagu

SEQ ID NO: 595535 - RNA, 19 nt, Human
uauaccaaccgaacgcuug

SEQ ID NO: 595536 - RNA, 24 nt, Human
uaugcuauggucccaaagguggau

SEQ ID NO: 595537 - RNA, 20 nt, Human
uauggagaaaaaagagugcc

SEQ ID NO: 595538 - RNA, 18 nt, Human
ucaaaaaaaaagagagaa

SEQ ID NO: 595539 - RNA, 21 nt, Human
ucaacugacaccacaauagca

SEQ ID NO: 595540 - RNA, 18 nt, Human
ucacugggggguaaaaag

SEQ ID NO: 595541 - RNA, 20 nt, Human
ucaggcuccuuacuuguaag

SEQ ID NO: 595542 - RNA, 22 nt, Human
ucauaauugaaacugacaacgc

SEQ ID NO: 595543 - RNA, 22 nt, Human
ucaugccuguaaucccagcacu

SEQ ID NO: 595544 - RNA, 25 nt, Human
uccaaaaucggcaaagcacaaaaca

SEQ ID NO: 595545 - RNA, 26 nt, Human
uccaagcaagacccuggauagggacc

SEQ ID NO: 595546 - RNA, 20 nt, Human
uccguuucuaaaguggggua

SEQ ID NO: 595547 - RNA, 23 nt, Human
uccguuucuaaagugggguagga

SEQ ID NO: 595548 - RNA, 21 nt, Human
uccuugacuggauaaaaacag

SEQ ID NO: 595549 - RNA, 19 nt, Human
ucucacuccaucaaccuaa

SEQ ID NO: 595550 - RNA, 21 nt, Human
ugaaaaaaucccccccaccca

SEQ ID NO: 595551 - RNA, 25 nt, Human
ugaaaaaaucccccccacccacaaa

SEQ ID NO: 595552 - RNA, 18 nt, Human
ugaaaagagaugaaaacu

SEQ ID NO: 595553 - RNA, 21 nt, Human
ugaaacuaaauaucaacugac

SEQ ID NO: 595554 - RNA, 24 nt, Human
ugaaacugacaacgccaguaaauc

SEQ ID NO: 595555 - RNA, 21 nt, Human
ugaacaauagcacaaaugcca

SEQ ID NO: 595556 - RNA, 24 nt, Human
ugaccaacauggagaaauccuguc

SEQ ID NO: 595557 - RNA, 23 nt, Human
ugagguccgaaggaugcugccau

SEQ ID NO: 595558 - RNA, 23 nt, Human
ugaugaaaucacaaaacuaaaca

SEQ ID NO: 595559 - RNA, 20 nt, Human
ugccuaggcaaaauccuguc

SEQ ID NO: 595560 - RNA, 19 nt, Human
ugccucugcagagaggugg

SEQ ID NO: 595561 - RNA, 24 nt, Human
ugccuguaaucacagcuacucagg

SEQ ID NO: 595562 - RNA, 18 nt, Human
ugccuguaaucccagcac

SEQ ID NO: 595563 - RNA, 22 nt, Human
ugccuguaaucccagcacuuua

SEQ ID NO: 595564 - RNA, 24 nt, Human
ugccuguaaucccagcacuuuagg

SEQ ID NO: 595565 - RNA, 19 nt, Human
uggcgcaugccuguaauca

SEQ ID NO: 595566 - RNA, 25 nt, Human
uggcucacagccugguaaagaaucu

SEQ ID NO: 595567 - RNA, 22 nt, Human
uggcucaugccuguaaucccag

SEQ ID NO: 595568 - RNA, 24 nt, Human
uggcucaugccuguaaucccagca

SEQ ID NO: 595569 - RNA, 24 nt, Human
ugggcagaucaccugaggucagga

SEQ ID NO: 595570 - RNA, 22 nt, Human
ugggggguaaaaagaaaaagga

SEQ ID NO: 595571 - RNA, 21 nt, Human
ugggguucagcaaaugaaacu

SEQ ID NO: 595572 - RNA, 18 nt, Human
uggugagguccgaaggau

SEQ ID NO: 595573 - RNA, 21 nt, Human
ugguggcgcaugccuguaauc

SEQ ID NO: 595574 - RNA, 19 nt, Human
uguagggaacuagacuaca

SEQ ID NO: 595575 - RNA, 25 nt, Human
ugucacaacuauauuacauccacug

SEQ ID NO: 595576 - RNA, 22 nt, Human
ugucacugacaaagaacuuuua

SEQ ID NO: 595577 - RNA, 22 nt, Human
uguuccugucaacccacugagu

SEQ ID NO: 595578 - RNA, 18 nt, Human
uuaaugcuggcuuucagg

SEQ ID NO: 595579 - RNA, 21 nt, Human
uuacuuguaaguaaacaaugu

SEQ ID NO: 595580 - RNA, 18 nt, Human
uucaaauaaaaaaguaag

SEQ ID NO: 595581 - RNA, 22 nt, Human
uucaaggaaaagcaaauccuug

SEQ ID NO: 595582 - RNA, 24 nt, Human
uucaaggaaaagcaaauccuugac

SEQ ID NO: 595583 - RNA, 23 nt, Human
uugaacccaggaggcggagguug

SEQ ID NO: 595584 - RNA, 21 nt, Human
uuuaacuaugcuaugguccca

SEQ ID NO: 595585 - RNA, 19 nt, Human
uuuccacacucucccacag

SEQ ID NO: 595586 - RNA, 24 nt, Human
uuuguaaacacuauugugcaaaau

SEQ ID NO: 595587 - RNA, 22 nt, Human
aaaagaaaaaucauccagugca

SEQ ID NO: 595588 - RNA, 19 nt, Human
aaaaguuagaauuaacuua

SEQ ID NO: 595589 - RNA, 19 nt, Human
acagagccgccaggcgacu

SEQ ID NO: 595590 - RNA, 21 nt, Human
acccagcuauccccaaaacag

SEQ ID NO: 595591 - RNA, 18 nt, Human
agcugagaaugggggugg

SEQ ID NO: 595592 - RNA, 23 nt, Human
augugcccaaaaucaagcaaaau

SEQ ID NO: 595593 - RNA, 19 nt, Human
caaaacaguguaguggggc

SEQ ID NO: 595594 - RNA, 22 nt, Human
caaaauaaaaucccaugcuucc

SEQ ID NO: 595595 - RNA, 21 nt, Human
cacgugcuccuuuucugggga

SEQ ID NO: 595596 - RNA, 24 nt, Human
cacuguguucaauuuugaguuucc

SEQ ID NO: 595597 - RNA, 24 nt, Human
cauccagugcacguagaugggcac

SEQ ID NO: 595598 - RNA, 24 nt, Human
caugugcccaaaaucaagcaaaau

SEQ ID NO: 595599 - RNA, 23 nt, Human
ccccaaaacaguguaguggggca

SEQ ID NO: 595600 - RNA, 23 nt, Human
ccgccaggcgacucaauucacgu

SEQ ID NO: 595601 - RNA, 25 nt, Human
cgacuagaggagcggauauggaagc

SEQ ID NO: 595602 - RNA, 23 nt, Human
cggcaaacaguggcucgccagag

SEQ ID NO: 595603 - RNA, 24 nt, Human
cuaaaacugcaaacuaaaaaucug

SEQ ID NO: 595604 - RNA, 24 nt, Human
cuaacuaaaagcagaacucacuua

SEQ ID NO: 595605 - RNA, 19 nt, Human
cuccuuuucuggggaugaa

SEQ ID NO: 595606 - RNA, 19 nt, Human
gaggcgguaccgccgcgaa

SEQ ID NO: 595607 - RNA, 18 nt, Human
ggaggagcugagaauggg

SEQ ID NO: 595608 - RNA, 23 nt, Human
guaguggggcaaaauguucaaaa

SEQ ID NO: 595609 - RNA, 19 nt, Human
guggcuuuaaaaaaaaagu

SEQ ID NO: 595610 - RNA, 20 nt, Human
uaaauguaaauaucuuuaac

SEQ ID NO: 595611 - RNA, 18 nt, Human
uaacuaaaagcagaacuc

SEQ ID NO: 595612 - RNA, 24 nt, Human
uaacuaacuaaaagcagaacucag

SEQ ID NO: 595613 - RNA, 23 nt, Human
uacauuucuucaaauaccauuug

SEQ ID NO: 595614 - RNA, 19 nt, Human
uagaauauaaaagauauua

SEQ ID NO: 595615 - RNA, 24 nt, Human
uagaugggcaccaagaagcuaagc

SEQ ID NO: 595616 - RNA, 24 nt, Human
uagugcaacaaaacauuuccagau

SEQ ID NO: 595617 - RNA, 21 nt, Human
uaucugugacaaugaccaaua

SEQ ID NO: 595618 - RNA, 21 nt, Human
uauggaagcgagcgaaagccg

SEQ ID NO: 595619 - RNA, 24 nt, Human
uauuucaugugcccaaaaucaagc

SEQ ID NO: 595620 - RNA, 19 nt, Human
ucaaaacaaacugaccuga

SEQ ID NO: 595621 - RNA, 21 nt, Human
ucaaaauacaaaggcgugcaa

SEQ ID NO: 595622 - RNA, 27 nt, Human
ucaagaauaaaaguuagaauuaacuua

SEQ ID NO: 595623 - RNA, 24 nt, Human
ucacuguguucaauuuugaguuuc

SEQ ID NO: 595624 - RNA, 27 nt, Human
uccaauauaaauguaaauaucuuuaac

SEQ ID NO: 595625 - RNA, 20 nt, Human
ucccugagcgcguacagagc

SEQ ID NO: 595626 - RNA, 21 nt, Human
ucccugagcgcguacagagcc

SEQ ID NO: 595627 - RNA, 22 nt, Human
ucccugagcgcguacagagccg

SEQ ID NO: 595628 - RNA, 19 nt, Human
uccuaaaacugcaaacuaa

SEQ ID NO: 595629 - RNA, 25 nt, Human
ugaaauaaaauucaagaauaaaagu

SEQ ID NO: 595630 - RNA, 19 nt, Human
ugaccugaaauuuuuagua

SEQ ID NO: 595631 - RNA, 24 nt, Human
ugaccugaaauuuuuaguauuuac

SEQ ID NO: 595632 - RNA, 18 nt, Human
ugaguuuccuaacaucca

SEQ ID NO: 595633 - RNA, 24 nt, Human
ugauauuuaaaacauuuauguggu

SEQ ID NO: 595634 - RNA, 20 nt, Human
ugcccaaaaucaagcaaaau

SEQ ID NO: 595635 - RNA, 31 nt, Human
ugcccaaaaucaagcaaaauaaaaucccauu

SEQ ID NO: 595636 - RNA, 18 nt, Human
ugcccgaucaaacggcaa

SEQ ID NO: 595637 - RNA, 24 nt, Human
uggcucgccagaggacccaaucuu

SEQ ID NO: 595638 - RNA, 21 nt, Human
uuaaauaccaugcaguguacu

SEQ ID NO: 595639 - RNA, 18 nt, Human
uuauauauuuaaccugaa

SEQ ID NO: 595640 - RNA, 19 nt, Human
uucaaaagaaaaaucaucc

SEQ ID NO: 595641 - RNA, 23 nt, Human
uucaaauaccauuuguuucacug

SEQ ID NO: 595642 - RNA, 20 nt, Human
uucacgugcuccuuuucugg

SEQ ID NO: 595643 - RNA, 20 nt, Human
aaaagcacaaaugucaagga

SEQ ID NO: 595644 - RNA, 19 nt, Human
aaaaugaggcccagggaga

SEQ ID NO: 595645 - RNA, 22 nt, Human
aaagacagagauccaggaaagg

SEQ ID NO: 595646 - RNA, 19 nt, Human
aaagugcugggauuaccgg

SEQ ID NO: 595647 - RNA, 24 nt, Human
aaagugcugggauuaccggcguga

SEQ ID NO: 595648 - RNA, 23 nt, Human
aacuuggaaaccaucucuggcag

SEQ ID NO: 595649 - RNA, 24 nt, Human
aagaugcuguacaccugcuacaga

SEQ ID NO: 595650 - RNA, 26 nt, Human
aagugcugggauuaccggcgugagcc

SEQ ID NO: 595651 - RNA, 21 nt, Human
aaucucuuucucccacucaac

SEQ ID NO: 595652 - RNA, 22 nt, Human
acaaagagaggcaaagauacca

SEQ ID NO: 595653 - RNA, 23 nt, Human
acacacacacacacacacacaca

SEQ ID NO: 595654 - RNA, 23 nt, Human
acacacacacacacacacacaca

SEQ ID NO: 595655 - RNA, 23 nt, Human
acacacacacacacacacacaca

SEQ ID NO: 595656 - RNA, 23 nt, Human
acacacacacacacacacacaca

SEQ ID NO: 595657 - RNA, 23 nt, Human
acacacacacacacacacacaca

SEQ ID NO: 595658 - RNA, 23 nt, Human
acacacacacacacacacacaca

SEQ ID NO: 595659 - RNA, 29 nt, Human
acacacacacacacacacacacaggccua

SEQ ID NO: 595660 - RNA, 25 nt, Human
acacacacacacacacacaggccua

SEQ ID NO: 595661 - RNA, 33 nt, Human
acggaagagcacacacacacacacacacacagu

SEQ ID NO: 595662 - RNA, 21 nt, Human
acugcaagcuccgccuuccag

SEQ ID NO: 595663 - RNA, 24 nt, Human
aggaaaugcagagacaaagagagg

SEQ ID NO: 595664 - RNA, 21 nt, Human
aggaauauggguggagaagcc

SEQ ID NO: 595665 - RNA, 18 nt, Human
aggagaagcaacuuuagg

SEQ ID NO: 595666 - RNA, 25 nt, Human
aggcuggagugcaguggcgcaaucu

SEQ ID NO: 595667 - RNA, 19 nt, Human
aguagcugggacuacaggc

SEQ ID NO: 595668 - RNA, 21 nt, Human
agugcaguggcgcaaucucag

SEQ ID NO: 595669 - RNA, 24 nt, Human
agugcaguggcgcaaucucagcuc

SEQ ID NO: 595670 - RNA, 20 nt, Human
aguggaaaugggguuucacc

SEQ ID NO: 595671 - RNA, 19 nt, Human
caaagauaccaaagcagac

SEQ ID NO: 595672 - RNA, 27 nt, Human
caaagugcugggauuaccggcgugagc

SEQ ID NO: 595673 - RNA, 24 nt, Human
caacuccauguggggauaucugac

SEQ ID NO: 595674 - RNA, 21 nt, Human
caagaugcuguacaccugcua

SEQ ID NO: 595675 - RNA, 20 nt, Human
cacacacacacacacacaca

SEQ ID NO: 595676 - RNA, 20 nt, Human
cacacacacacacacacaca

SEQ ID NO: 595677 - RNA, 20 nt, Human
cacacacacacacacacaca

SEQ ID NO: 595678 - RNA, 20 nt, Human
cacacacacacacacacaca

SEQ ID NO: 595679 - RNA, 20 nt, Human
cacacacacacacacacaca

SEQ ID NO: 595680 - RNA, 20 nt, Human
cacacacacacacacacaca

SEQ ID NO: 595681 - RNA, 20 nt, Human
cacacacacacacacacaca

SEQ ID NO: 595682 - RNA, 20 nt, Human
cacacacacacacacacaca

SEQ ID NO: 595683 - RNA, 20 nt, Human
cacacacacacacacacaca

SEQ ID NO: 595684 - RNA, 20 nt, Human
cacacacacacacacacaca

SEQ ID NO: 595685 - RNA, 20 nt, Human
cacacacacacacacacaca

SEQ ID NO: 595686 - RNA, 20 nt, Human
cacacacacacacacacaca

SEQ ID NO: 595687 - RNA, 22 nt, Human
cacacacacacacacacacaca

SEQ ID NO: 595688 - RNA, 22 nt, Human
cacacacacacacacacacaca

SEQ ID NO: 595689 - RNA, 22 nt, Human
cacacacacacacacacacaca

SEQ ID NO: 595690 - RNA, 22 nt, Human
cacacacacacacacacacaca

SEQ ID NO: 595691 - RNA, 26 nt, Human
cacacacacacacacacacacacaca

SEQ ID NO: 595692 - RNA, 26 nt, Human
cacacacacacacacacacacacaca

SEQ ID NO: 595693 - RNA, 26 nt, Human
cacacacacacacacacacacacaca

SEQ ID NO: 595694 - RNA, 26 nt, Human
cacacacacacacacacacacacaca

SEQ ID NO: 595695 - RNA, 26 nt, Human
cacacacacacacacacacacacaca

SEQ ID NO: 595696 - RNA, 26 nt, Human
cacacacacacacacacacacacaca

SEQ ID NO: 595697 - RNA, 26 nt, Human
cacacacacacacacacacacacaca

SEQ ID NO: 595698 - RNA, 26 nt, Human
cacacacacacacacacacacacaca

SEQ ID NO: 595699 - RNA, 31 nt, Human
cacacacacacacacacaggccuagguauag

SEQ ID NO: 595700 - RNA, 31 nt, Human
cacacacacacacacaggccuagguauaugg

SEQ ID NO: 595701 - RNA, 18 nt, Human
caccguguuagccaggau

SEQ ID NO: 595702 - RNA, 24 nt, Human
caccguguuagccaggauggucuc

SEQ ID NO: 595703 - RNA, 22 nt, Human
caugccauucuccugccucagc

SEQ ID NO: 595704 - RNA, 22 nt, Human
ccaaagugcugggauuaccggc

SEQ ID NO: 595705 - RNA, 24 nt, Human
ccaaagugcugggauuaccggcgu

SEQ ID NO: 595706 - RNA, 19 nt, Human
ccagguucaugccauucuc

SEQ ID NO: 595707 - RNA, 22 nt, Human
ccagguucaugccauucuccug

SEQ ID NO: 595708 - RNA, 20 nt, Human
ccaguggucacuucugcucu

SEQ ID NO: 595709 - RNA, 21 nt, Human
cccagggagaaaagcacaaau

SEQ ID NO: 595710 - RNA, 18 nt, Human
cccaguggucacuucugc

SEQ ID NO: 595711 - RNA, 24 nt, Human
cccgaguagcugggacuacaggcg

SEQ ID NO: 595712 - RNA, 25 nt, Human
cccgaguagcugggacuacaggcgc

SEQ ID NO: 595713 - RNA, 23 nt, Human
ccugccucagccucccgaguagc

SEQ ID NO: 595714 - RNA, 20 nt, Human
ccuggcccuucagucuuuuc

SEQ ID NO: 595715 - RNA, 21 nt, Human
ccuuccagguucaugccauuc

SEQ ID NO: 595716 - RNA, 24 nt, Human
ccuuccagguucaugccauucucc

SEQ ID NO: 595717 - RNA, 24 nt, Human
cgcccaggcuggagugcaguggcg

SEQ ID NO: 595718 - RNA, 24 nt, Human
cgccucggccucccaaagugcugg

SEQ ID NO: 595719 - RNA, 21 nt, Human
cgucgcccaggcuggagugca

SEQ ID NO: 595720 - RNA, 21 nt, Human
cucagcccaugcaaacugucc

SEQ ID NO: 595721 - RNA, 24 nt, Human
cucagccucccgaguagcugggac

SEQ ID NO: 595722 - RNA, 20 nt, Human
cuccgucgcccaggcuggag

SEQ ID NO: 595723 - RNA, 24 nt, Human
cuccugaccucgugauccgcccgc

SEQ ID NO: 595724 - RNA, 26 nt, Human
cucuagugaaucucuuucucccacuc

SEQ ID NO: 595725 - RNA, 25 nt, Human
cucuccuugguccugggaccugugc

SEQ ID NO: 595726 - RNA, 24 nt, Human
cugcaagcuccgccuuccagguuc

SEQ ID NO: 595727 - RNA, 23 nt, Human
cugccucagccucccgaguagcu

SEQ ID NO: 595728 - RNA, 30 nt, Human
gaagagcacacacacacacacacacacaca

SEQ ID NO: 595729 - RNA, 22 nt, Human
gaccucgugauccgcccgccuc

SEQ ID NO: 595730 - RNA, 22 nt, Human
gaccucgugauccgcccgccuc

SEQ ID NO: 595731 - RNA, 24 nt, Human
gaccucgugauccgcccgccucgg

SEQ ID NO: 595732 - RNA, 31 nt, Human
gacggaagagcacacacacacacacacacag

SEQ ID NO: 595733 - RNA, 23 nt, Human
gagaaaagcacaaaugucaagga

SEQ ID NO: 595734 - RNA, 20 nt, Human
gagacagagucucgcuccgu

SEQ ID NO: 595735 - RNA, 18 nt, Human
gaggaauauggguggaga

SEQ ID NO: 595736 - RNA, 20 nt, Human
gaguagcugggacuacaggc

SEQ ID NO: 595737 - RNA, 25 nt, Human
gaguagcugggacuacaggcgcucg

SEQ ID NO: 595738 - RNA, 18 nt, Human
gauuaccggcgugagcca

SEQ ID NO: 595739 - RNA, 21 nt, Human
gauuaccggcgugagccaccg

SEQ ID NO: 595740 - RNA, 24 nt, Human
gauuaccggcgugagccaccgugc

SEQ ID NO: 595741 - RNA, 22 nt, Human
gcaagcuccgccuuccagguuc

SEQ ID NO: 595742 - RNA, 23 nt, Human
gcccagcuaauuuuuuguauuuu

SEQ ID NO: 595743 - RNA, 19 nt, Human
gcccaggcuggagugcagu

SEQ ID NO: 595744 - RNA, 20 nt, Human
gcccaggcuggagugcagug

SEQ ID NO: 595745 - RNA, 19 nt, Human
gcccaugcaaacuguccug

SEQ ID NO: 595746 - RNA, 22 nt, Human
gcuccgucgcccaggcuggagu

SEQ ID NO: 595747 - RNA, 25 nt, Human
gcuccgucgcccaggcuggagugca

SEQ ID NO: 595748 - RNA, 27 nt, Human
gcuccgucgcccaggcuggggccgcuc

SEQ ID NO: 595749 - RNA, 19 nt, Human
gcuggagugcaguggcgca

SEQ ID NO: 595750 - RNA, 26 nt, Human
ggaaauaaagacagagauccaggaaa

SEQ ID NO: 595751 - RNA, 20 nt, Human
ggaagagcacacacacacac

SEQ ID NO: 595752 - RNA, 19 nt, Human
ggaaggggacaucaacuug

SEQ ID NO: 595753 - RNA, 24 nt, Human
ggauggucucgaucuccugaccuc

SEQ ID NO: 595754 - RNA, 22 nt, Human
ggcgugagccaccgugcccggc

SEQ ID NO: 595755 - RNA, 21 nt, Human
gggggguggggguggcuuagu

SEQ ID NO: 595756 - RNA, 18 nt, Human
gggguuucaccguguuag

SEQ ID NO: 595757 - RNA, 22 nt, Human
gggguuucaccguguuagccag

SEQ ID NO: 595758 - RNA, 19 nt, Human
gguagagagugaggaggaa

SEQ ID NO: 595759 - RNA, 18 nt, Human
gucaaggaagagagaucu

SEQ ID NO: 595760 - RNA, 21 nt, Human
gucccuuugcugugugccugg

SEQ ID NO: 595761 - RNA, 22 nt, Human
gugagcuucuugccugaagucc

SEQ ID NO: 595762 - RNA, 24 nt, Human
gugauccgcccgccucggccuccc

SEQ ID NO: 595763 - RNA, 19 nt, Human
uaaaaugaggcccagggag

SEQ ID NO: 595764 - RNA, 20 nt, Human
uaauuuuuuguauuuuuagu

SEQ ID NO: 595765 - RNA, 23 nt, Human
uaauuuuuuguauuuuuagugga

SEQ ID NO: 595766 - RNA, 24 nt, Human
uacaggcgcucgccaccacgccca

SEQ ID NO: 595767 - RNA, 24 nt, Human
uaccggcgugagccaccgugcccg

SEQ ID NO: 595768 - RNA, 20 nt, Human
uaggaacuggauguuccacc

SEQ ID NO: 595769 - RNA, 23 nt, Human
uagugaaucucuuucucccacuc

SEQ ID NO: 595770 - RNA, 26 nt, Human
uagugaaucucuuucucccacucaac

SEQ ID NO: 595771 - RNA, 21 nt, Human
uaguggaaaugggguuucacc

SEQ ID NO: 595772 - RNA, 24 nt, Human
uaguggaaaugggguuucaccgug

SEQ ID NO: 595773 - RNA, 26 nt, Human
uaguggaaaugggguuucaccguguu

SEQ ID NO: 595774 - RNA, 24 nt, Human
ucaagcuugggaaagcagaguggg

SEQ ID NO: 595775 - RNA, 24 nt, Human
ucaccguguuagccaggauggucu

SEQ ID NO: 595776 - RNA, 18 nt, Human
ucacugcaagcuccgccu

SEQ ID NO: 595777 - RNA, 18 nt, Human
ucacugcaagcuccgccu

SEQ ID NO: 595778 - RNA, 19 nt, Human
ucacugcaagcuccgccuu

SEQ ID NO: 595779 - RNA, 19 nt, Human
ucacugcaagcuccgccuu

SEQ ID NO: 595780 - RNA, 24 nt, Human
ucacugcaagcuccgccuuccagg

SEQ ID NO: 595781 - RNA, 23 nt, Human
ucagccucccgaguagcugggac

SEQ ID NO: 595782 - RNA, 19 nt, Human
ucagcucacugcaagcucc

SEQ ID NO: 595783 - RNA, 23 nt, Human
ucaguucagucccuuugcugugu

SEQ ID NO: 595784 - RNA, 18 nt, Human
ucaugccauucuccugcc

SEQ ID NO: 595785 - RNA, 18 nt, Human
uccaggaaaggaaaugag

SEQ ID NO: 595786 - RNA, 21 nt, Human
ucccaaagugcugggauuacc

SEQ ID NO: 595787 - RNA, 24 nt, Human
ucccaaagugcugggauuaccggc

SEQ ID NO: 595788 - RNA, 24 nt, Human
ucccgaguagcugggacuacaggc

SEQ ID NO: 595789 - RNA, 24 nt, Human
ucgcccaggcuggagugcaguggc

SEQ ID NO: 595790 - RNA, 18 nt, Human
ucggccucccaaagugcu

SEQ ID NO: 595791 - RNA, 24 nt, Human
ucuccugccucagccucccgagua

SEQ ID NO: 595792 - RNA, 22 nt, Human
ucucgcuccgucgcccaggcug

SEQ ID NO: 595793 - RNA, 23 nt, Human
ucucgcuccgucgcccaggcugg

SEQ ID NO: 595794 - RNA, 24 nt, Human
ucucgcuccgucgcccaggcugga

SEQ ID NO: 595795 - RNA, 26 nt, Human
ucucgcuccgucgcccaggcuggagu

SEQ ID NO: 595796 - RNA, 27 nt, Human
ucucgcuccgucgcccaggcuggagug

SEQ ID NO: 595797 - RNA, 21 nt, Human
ucuggcaggaggcaauuuagc

SEQ ID NO: 595798 - RNA, 21 nt, Human
ugaaauccugagguauagaau

SEQ ID NO: 595799 - RNA, 19 nt, Human
ugagacagagucucgcucc

SEQ ID NO: 595800 - RNA, 22 nt, Human
ugagacagagucucgcuccguc

SEQ ID NO: 595801 - RNA, 25 nt, Human
ugaggaggaaggugggggaagggga

SEQ ID NO: 595802 - RNA, 27 nt, Human
ugcagagacaaagagaggcaaagauac

SEQ ID NO: 595803 - RNA, 23 nt, Human
ugcaguggcgcaaucucagcuca

SEQ ID NO: 595804 - RNA, 24 nt, Human
ugccucagccucccgaguagcugg

SEQ ID NO: 595805 - RNA, 18 nt, Human
ugccugaagucccagugg

SEQ ID NO: 595806 - RNA, 22 nt, Human
ugcugugugccugguggugagc

SEQ ID NO: 595807 - RNA, 18 nt, Human
uggagugcaguggcgcaa

SEQ ID NO: 595808 - RNA, 23 nt, Human
uggagugcaguggcgcaaucuca

SEQ ID NO: 595809 - RNA, 24 nt, Human
uggagugcaguggcgcaaucucag

SEQ ID NO: 595810 - RNA, 24 nt, Human
uggcgcaaucucagcucacugcaa

SEQ ID NO: 595811 - RNA, 21 nt, Human
ugggacuacaggcgcucgcca

SEQ ID NO: 595812 - RNA, 22 nt, Human
ugggacuacaggcgcucgccac

SEQ ID NO: 595813 - RNA, 24 nt, Human
ugggacuacaggcgcucgccacca

SEQ ID NO: 595814 - RNA, 18 nt, Human
ugggauuaccggcgugag

SEQ ID NO: 595815 - RNA, 22 nt, Human
ugggauuaccggcgugagccac

SEQ ID NO: 595816 - RNA, 23 nt, Human
ugggauuaccggcgugagccacc

SEQ ID NO: 595817 - RNA, 23 nt, Human
ugggauuaccggcgugagccacc

SEQ ID NO: 595818 - RNA, 24 nt, Human
ugggauuaccggcgugagccaccg

SEQ ID NO: 595819 - RNA, 21 nt, Human
ugggggguggggguggcuuag

SEQ ID NO: 595820 - RNA, 24 nt, Human
ugggguuucaccguguuagccagg

SEQ ID NO: 595821 - RNA, 21 nt, Human
ugguggugagcuucuugccug

SEQ ID NO: 595822 - RNA, 21 nt, Human
uguauuuuuaguggaaauggg

SEQ ID NO: 595823 - RNA, 19 nt, Human
ugucaaggaagagagaucu

SEQ ID NO: 595824 - RNA, 20 nt, Human
ugucaaggaagagagaucug

SEQ ID NO: 595825 - RNA, 24 nt, Human
uguccuggcccuucagucuuuuca

SEQ ID NO: 595826 - RNA, 18 nt, Human
uuaguggaaaugggguuu

SEQ ID NO: 595827 - RNA, 22 nt, Human
uuaguggaaaugggguuucacc

SEQ ID NO: 595828 - RNA, 24 nt, Human
uuaguggaaaugggguuucaccgu

SEQ ID NO: 595829 - RNA, 19 nt, Human
uucaugccauucuccugcc

SEQ ID NO: 595830 - RNA, 19 nt, Human
uugguccugggaccugugc

SEQ ID NO: 595831 - RNA, 20 nt, Human
uugguccugggaccugugcc

SEQ ID NO: 595832 - RNA, 20 nt, Human
uugguccugggaccugugcc

SEQ ID NO: 595833 - RNA, 23 nt, Human
uuguauuuuuaguggaaaugggg

SEQ ID NO: 595834 - RNA, 19 nt, Human
uuucaccguguuagccagg

SEQ ID NO: 595835 - RNA, 24 nt, Human
uuuuuaguggaaaugggguuucac

SEQ ID NO: 595836 - RNA, 19 nt, Human
uuuuuguauuuuuagugga

SEQ ID NO: 595837 - RNA, 22 nt, Human
aaaaaaaaacaaaaaccaccaa

SEQ ID NO: 595838 - RNA, 23 nt, Human
aaaaaaaaacaaaaaccaccaaa

SEQ ID NO: 595839 - RNA, 24 nt, Human
aaaaaaaaacaaaaaccaccaaaa

SEQ ID NO: 595840 - RNA, 23 nt, Human
aaaaaaaacaaaaaccaccaaaa

SEQ ID NO: 595841 - RNA, 18 nt, Human
aaaacaaaaaccaccaaa

SEQ ID NO: 595842 - RNA, 19 nt, Human
aaaacaaaaaccaccaaaa

SEQ ID NO: 595843 - RNA, 18 nt, Human
aacaaaaaccaccaaaac

SEQ ID NO: 595844 - RNA, 23 nt, Human
aacagaaaaugaaaaaaaaacaa

SEQ ID NO: 595845 - RNA, 20 nt, Human
aagcagcaggaagcagcauu

SEQ ID NO: 595846 - RNA, 19 nt, Human
aagcaggugccuagaagca

SEQ ID NO: 595847 - RNA, 19 nt, Human
aagccagucugcccagccu

SEQ ID NO: 595848 - RNA, 23 nt, Human
aauagcugcauuauuuagauuuu

SEQ ID NO: 595849 - RNA, 21 nt, Human
aauccaacagaaaaugaaaaa

SEQ ID NO: 595850 - RNA, 23 nt, Human
acccugagagagggcaagagagu

SEQ ID NO: 595851 - RNA, 23 nt, Human
agaaaaugaaaaaaaaacaaaaa

SEQ ID NO: 595852 - RNA, 18 nt, Human
agacaagagagaaaaugg

SEQ ID NO: 595853 - RNA, 24 nt, Human
agacaagagagaaaauggcaugag

SEQ ID NO: 595854 - RNA, 25 nt, Human
agacaagagagaaaauggcaugagg

SEQ ID NO: 595855 - RNA, 20 nt, Human
agaguucuuucuauauuccc

SEQ ID NO: 595856 - RNA, 27 nt, Human
aguuccuauuuauucucaaaugcccug

SEQ ID NO: 595857 - RNA, 21 nt, Human
auacugaacaucaugaacucc

SEQ ID NO: 595858 - RNA, 18 nt, Human
aucaugaacuccaaaagc

SEQ ID NO: 595859 - RNA, 22 nt, Human
augucauguccucaacauaaua

SEQ ID NO: 595860 - RNA, 21 nt, Human
auuuccuuuucagcauuuguu

SEQ ID NO: 595861 - RNA, 23 nt, Human
caaacaggcagcugauccaaaau

SEQ ID NO: 595862 - RNA, 26 nt, Human
caacagaaaaugaaaaaaaaacaaaa

SEQ ID NO: 595863 - RNA, 21 nt, Human
caccaaaacuuuuucccccua

SEQ ID NO: 595864 - RNA, 21 nt, Human
caccagagccuggaccaccag

SEQ ID NO: 595865 - RNA, 18 nt, Human
cacccccaucucuagcca

SEQ ID NO: 595866 - RNA, 18 nt, Human
cagagcucugggcuccca

SEQ ID NO: 595867 - RNA, 24 nt, Human
caggugccuagaagcaagcagcag

SEQ ID NO: 595868 - RNA, 20 nt, Human
caguuuauauuuucaaacca

SEQ ID NO: 595869 - RNA, 19 nt, Human
caugagucacauaagugca

SEQ ID NO: 595870 - RNA, 25 nt, Human
ccagaaaccaacuuccuuugaaaca

SEQ ID NO: 595871 - RNA, 25 nt, Human
ccagugguaauagcugcauuauuua

SEQ ID NO: 595872 - RNA, 18 nt, Human
ccaugacacuuaagcauc

SEQ ID NO: 595873 - RNA, 26 nt, Human
ccggucucacccccaucucuagccau

SEQ ID NO: 595874 - RNA, 23 nt, Human
ccucaugguugcaugaggcugcc

SEQ ID NO: 595875 - RNA, 21 nt, Human
cucaaaugcccugacuaaacu

SEQ ID NO: 595876 - RNA, 21 nt, Human
cuccucccagagcucugggcu

SEQ ID NO: 595877 - RNA, 24 nt, Human
cuucaccagagccuggaccaccag

SEQ ID NO: 595878 - RNA, 18 nt, Human
cuuggaccagaaaccaac

SEQ ID NO: 595879 - RNA, 21 nt, Human
gcuugaugacuaaguugguag

SEQ ID NO: 595880 - RNA, 23 nt, Human
gucagguaacaaaagccagucug

SEQ ID NO: 595881 - RNA, 18 nt, Human
guccucaacauaaaguuc

SEQ ID NO: 595882 - RNA, 18 nt, Human
guuuuugcaaacaggcag

SEQ ID NO: 595883 - RNA, 21 nt, Human
uaaaugaagggcuucaccaca

SEQ ID NO: 595884 - RNA, 24 nt, Human
uaaaugacaucaauacucuauaaa

SEQ ID NO: 595885 - RNA, 22 nt, Human
uaagugcauuuaacucagacaa

SEQ ID NO: 595886 - RNA, 18 nt, Human
uaccaagaagcuuguuuu

SEQ ID NO: 595887 - RNA, 19 nt, Human
uagaagcaagcagcaggaa

SEQ ID NO: 595888 - RNA, 22 nt, Human
uaggucaaaacuuggaccagaa

SEQ ID NO: 595889 - RNA, 18 nt, Human
ucaaaccaaugucauguc

SEQ ID NO: 595890 - RNA, 21 nt, Human
ucagaaacauaaaugacauca

SEQ ID NO: 595891 - RNA, 20 nt, Human
ucagguaaaggaaaauugag

SEQ ID NO: 595892 - RNA, 19 nt, Human
uccaacagaaaaugaaaaa

SEQ ID NO: 595893 - RNA, 21 nt, Human
ucccagagcucugggcuccca

SEQ ID NO: 595894 - RNA, 22 nt, Human
ucccagagcucugggcucccag

SEQ ID NO: 595895 - RNA, 23 nt, Human
ucccagagcucugggcucccaga

SEQ ID NO: 595896 - RNA, 22 nt, Human
uccccggucucacccccaucuc

SEQ ID NO: 595897 - RNA, 21 nt, Human
ucccucgucacauacuauccc

SEQ ID NO: 595898 - RNA, 18 nt, Human
uccugggcucagagggcu

SEQ ID NO: 595899 - RNA, 20 nt, Human
ucugggcucccagacugugu

SEQ ID NO: 595900 - RNA, 24 nt, Human
ucuguaagagucuuuuauaccaag

SEQ ID NO: 595901 - RNA, 24 nt, Human
ugaaaaaaaaacaaaaaccaccaa

SEQ ID NO: 595902 - RNA, 28 nt, Human
ugaaaaaaaaacaaaaaccaccaaaacu

SEQ ID NO: 595903 - RNA, 22 nt, Human
ugaaacaccucagaaacauaaa

SEQ ID NO: 595904 - RNA, 19 nt, Human
ugaaugggucccauucuuu

SEQ ID NO: 595905 - RNA, 19 nt, Human
ugacacuuaagcauccaga

SEQ ID NO: 595906 - RNA, 19 nt, Human
ugacuaaacugcucaaaag

SEQ ID NO: 595907 - RNA, 21 nt, Human
ugauuuccaucccuuaucugu

SEQ ID NO: 595908 - RNA, 23 nt, Human
ugcaaacaggcagcugauccaaa

SEQ ID NO: 595909 - RNA, 21 nt, Human
ugcauuuaacucagacaacuu

SEQ ID NO: 595910 - RNA, 20 nt, Human
ugccuagaagcaagcagcag

SEQ ID NO: 595911 - RNA, 22 nt, Human
ugccuagaagcaagcagcagga

SEQ ID NO: 595912 - RNA, 24 nt, Human
ugcuguuaggugaagaacuguuua

SEQ ID NO: 595913 - RNA, 18 nt, Human
ugcuucaggaugcucaga

SEQ ID NO: 595914 - RNA, 18 nt, Human
ugguugcaugaggcugcc

SEQ ID NO: 595915 - RNA, 28 nt, Human
uguaauccaacagaaaaugaaaaaaaaa

SEQ ID NO: 595916 - RNA, 23 nt, Human
uguguugaaacaccucagaaaca

SEQ ID NO: 595917 - RNA, 20 nt, Human
uuagauuuugcuucaggaug

SEQ ID NO: 595918 - RNA, 26 nt, Human
uuaucuguucccugcuuuuguccuuc

SEQ ID NO: 595919 - RNA, 20 nt, Human
uucacagugcuuguaagugc

SEQ ID NO: 595920 - RNA, 19 nt, Human
uuuaggaaaaaaacaagau

SEQ ID NO: 595921 - RNA, 24 nt, Human
uuucuauauucccuucugauuucc

SEQ ID NO: 595922 - RNA, 22 nt, Human
uuuucuguaauccaacagaaaa

SEQ ID NO: 595923 - RNA, 21 nt, Human
uuuugcuucaggaugcucaga

SEQ ID NO: 595924 - RNA, 24 nt, Human
uuuuuggucuucggcagugacauu

SEQ ID NO: 595925 - RNA, 22 nt, Human
uuuuuuuuuuaauguagcaaau

SEQ ID NO: 595926 - RNA, 19 nt, Human
uuuuuuuuuuuuuuuuuaa

SEQ ID NO: 595927 - RNA, 19 nt, Human
aaagugcugggauuacagg

SEQ ID NO: 595928 - RNA, 23 nt, Human
aaagugcugggauuacaggcgug

SEQ ID NO: 595929 - RNA, 27 nt, Human
aagugauccuuucaccucggccuccca

SEQ ID NO: 595930 - RNA, 19 nt, Human
aagugcugggauuacaggc

SEQ ID NO: 595931 - RNA, 19 nt, Human
aagugcugggauuacaggc

SEQ ID NO: 595932 - RNA, 24 nt, Human
aagugcugggauuacaggcgugcc

SEQ ID NO: 595933 - RNA, 21 nt, Human
acgcuggucuccaauuccugg

SEQ ID NO: 595934 - RNA, 21 nt, Human
agagacagggucuugcuuugu

SEQ ID NO: 595935 - RNA, 19 nt, Human
aguagcugggacuacaggc

SEQ ID NO: 595936 - RNA, 23 nt, Human
aguagcugggacuacaggcaugu

SEQ ID NO: 595937 - RNA, 23 nt, Human
agugaucuuccuuccccagccuc

SEQ ID NO: 595938 - RNA, 21 nt, Human
agugcaguggugcaaucauag

SEQ ID NO: 595939 - RNA, 23 nt, Human
agugcaguggugcaaucauagcu

SEQ ID NO: 595940 - RNA, 24 nt, Human
caaagugcugggauuacaggcgug

SEQ ID NO: 595941 - RNA, 27 nt, Human
caagugauccuuucaccucggccuccc

SEQ ID NO: 595942 - RNA, 24 nt, Human
caccucggccucccaaagugcugg

SEQ ID NO: 595943 - RNA, 20 nt, Human
cagccuccugaguagcuggg

SEQ ID NO: 595944 - RNA, 24 nt, Human
cagggucuugcuuuguugcccagg

SEQ ID NO: 595945 - RNA, 21 nt, Human
cauuuuguagagauggagucu

SEQ ID NO: 595946 - RNA, 22 nt, Human
ccaaagugcugggauuacaggc

SEQ ID NO: 595947 - RNA, 22 nt, Human
ccaaagugcugggauuacaggc

SEQ ID NO: 595948 - RNA, 24 nt, Human
ccaaagugcugggauuacaggcgu

SEQ ID NO: 595949 - RNA, 22 nt, Human
ccccagccuccugaguagcugg

SEQ ID NO: 595950 - RNA, 23 nt, Human
ccugaguagcugggacuacaggc

SEQ ID NO: 595951 - RNA, 24 nt, Human
ccugaguagcugggacuacaggca

SEQ ID NO: 595952 - RNA, 22 nt, Human
ccugggcucaagugauccuuuc

SEQ ID NO: 595953 - RNA, 24 nt, Human
cucaagugauccuuucaccucggc

SEQ ID NO: 595954 - RNA, 23 nt, Human
cucauggccuuaagugaucuucc

SEQ ID NO: 595955 - RNA, 25 nt, Human
cucauggccuuaagugaucuuccuu

SEQ ID NO: 595956 - RNA, 24 nt, Human
cugauaaaugcggggguccuucuu

SEQ ID NO: 595957 - RNA, 23 nt, Human
cuuccccagccuccugaguagcu

SEQ ID NO: 595958 - RNA, 21 nt, Human
cuugcuuuguugcccaggcug

SEQ ID NO: 595959 - RNA, 20 nt, Human
cuuuguugcccaggcuggag

SEQ ID NO: 595960 - RNA, 27 nt, Human
gaguagcugggacuacaggcauguguc

SEQ ID NO: 595961 - RNA, 19 nt, Human
gcccaggcuggagugcagu

SEQ ID NO: 595962 - RNA, 21 nt, Human
gccugaggccccugccugcuc

SEQ ID NO: 595963 - RNA, 21 nt, Human
gggcucaagugauccuuucac

SEQ ID NO: 595964 - RNA, 22 nt, Human
gggcucaagugauccuuucacc

SEQ ID NO: 595965 - RNA, 24 nt, Human
gucuugcuuuguugcccaggcugg

SEQ ID NO: 595966 - RNA, 24 nt, Human
gugaucuuccuuccccagccuccu

SEQ ID NO: 595967 - RNA, 24 nt, Human
ucccaaagugcugggauuacaggc

SEQ ID NO: 595968 - RNA, 24 nt, Human
uccugaguagcugggacuacaggc

SEQ ID NO: 595969 - RNA, 20 nt, Human
uccugggcucaagugauccu

SEQ ID NO: 595970 - RNA, 21 nt, Human
uccugggcucaagugauccuu

SEQ ID NO: 595971 - RNA, 18 nt, Human
ucggccucccaaagugcu

SEQ ID NO: 595972 - RNA, 24 nt, Human
ucucgcuaaguugcccacgcuggu

SEQ ID NO: 595973 - RNA, 21 nt, Human
ucucugcagcagauaguacuu

SEQ ID NO: 595974 - RNA, 23 nt, Human
ucuugcuuuguugcccaggcugg

SEQ ID NO: 595975 - RNA, 24 nt, Human
ucuugcuuuguugcccaggcugga

SEQ ID NO: 595976 - RNA, 22 nt, Human
ugcaguggugcaaucauagcuc

SEQ ID NO: 595977 - RNA, 18 nt, Human
ugcccaggcuggagugca

SEQ ID NO: 595978 - RNA, 21 nt, Human
ugcccaggcuggagugcagug

SEQ ID NO: 595979 - RNA, 24 nt, Human
ugcccaggcuggagugcaguggug

SEQ ID NO: 595980 - RNA, 19 nt, Human
ugccuggccacagaugaga

SEQ ID NO: 595981 - RNA, 19 nt, Human
ugcugggauuacaggcgug

SEQ ID NO: 595982 - RNA, 18 nt, Human
uggagugcaguggugcaa

SEQ ID NO: 595983 - RNA, 19 nt, Human
uggagugcaguggugcaau

SEQ ID NO: 595984 - RNA, 21 nt, Human
uggagugcaguggugcaauca

SEQ ID NO: 595985 - RNA, 20 nt, Human
uggccuuaagugaucuuccu

SEQ ID NO: 595986 - RNA, 18 nt, Human
ugggacuacaggcaugug

SEQ ID NO: 595987 - RNA, 22 nt, Human
ugggacuacaggcaugugucac

SEQ ID NO: 595988 - RNA, 24 nt, Human
ugggacuacaggcaugugucacca

SEQ ID NO: 595989 - RNA, 18 nt, Human
ugggauuacaggcgugcc

SEQ ID NO: 595990 - RNA, 18 nt, Human
ugggauuacaggcgugcc

SEQ ID NO: 595991 - RNA, 20 nt, Human
ugggauuacaggcgugccug

SEQ ID NO: 595992 - RNA, 24 nt, Human
ugggauuacaggcgugccuggcca

SEQ ID NO: 595993 - RNA, 25 nt, Human
ugggauuacaggcgugccuggccac

SEQ ID NO: 595994 - RNA, 19 nt, Human
ugggcucaagugauccuuu

SEQ ID NO: 595995 - RNA, 22 nt, Human
ugugggugcgagaccuguccag

SEQ ID NO: 595996 - RNA, 28 nt, Human
uuaagugaucuuccuuccccagccuccu

SEQ ID NO: 595997 - RNA, 23 nt, Human
uuccugggcucaagugauccuuu

SEQ ID NO: 595998 - RNA, 24 nt, Human
uugcccaggcuggagugcaguggu

SEQ ID NO: 595999 - RNA, 24 nt, Human
uugcuuuguugcccaggcuggagu

SEQ ID NO: 596000 - RNA, 22 nt, Human
uuguagagauggagucucgcua

SEQ ID NO: 596001 - RNA, 24 nt, Human
uuuguugcccaggcuggagugcag

SEQ ID NO: 596002 - RNA, 20 nt, Human
ccacagggacaaaggaaggc

SEQ ID NO: 596003 - RNA, 23 nt, Human
ccccagaucggcucgccugacuc

SEQ ID NO: 596004 - RNA, 20 nt, Human
cuccaaauccgccgccacca

SEQ ID NO: 596005 - RNA, 21 nt, Human
cuccaaauccgccgccaccau

SEQ ID NO: 596006 - RNA, 27 nt, Human
ugacuccugguucguagggucccuccu

SEQ ID NO: 596007 - RNA, 22 nt, Human
aaaaaaaaccccaaaaaaccaa

SEQ ID NO: 596008 - RNA, 23 nt, Human
aaaaaaaccccaaaaaaccaaaa

SEQ ID NO: 596009 - RNA, 18 nt, Human
aaaaaaccaaaaaaccaa

SEQ ID NO: 596010 - RNA, 22 nt, Human
aaaaaaccaaaaaaccaaauua

SEQ ID NO: 596011 - RNA, 27 nt, Human
aaaaaccccaaaaaaccaaaaaaccaa

SEQ ID NO: 596012 - RNA, 22 nt, Human
aaaaauaugaacauuugaacaa

SEQ ID NO: 596013 - RNA, 19 nt, Human
aaaaccccaaaaaaccaag

SEQ ID NO: 596014 - RNA, 23 nt, Human
aaacaaauguauuucuuaucccu

SEQ ID NO: 596015 - RNA, 23 nt, Human
aaaccaaaaaaccaaauuaccca

SEQ ID NO: 596016 - RNA, 26 nt, Human
aaacccacaggccaaaccucucuuua

SEQ ID NO: 596017 - RNA, 22 nt, Human
aaccaaaaaaccaaauuacccu

SEQ ID NO: 596018 - RNA, 26 nt, Human
aacccacaggccaaaccucucuuuag

SEQ ID NO: 596019 - RNA, 18 nt, Human
aagaaaaagacccaggaa

SEQ ID NO: 596020 - RNA, 19 nt, Human
aagacaaaaguauccagaa

SEQ ID NO: 596021 - RNA, 21 nt, Human
aagacaaaaguauccagaaga

SEQ ID NO: 596022 - RNA, 23 nt, Human
aagauucuuuauuuaagcagacc

SEQ ID NO: 596023 - RNA, 24 nt, Human
aagcagccauggagaaguuaagug

SEQ ID NO: 596024 - RNA, 21 nt, Human
aagcagcugggcaaacuucug

SEQ ID NO: 596025 - RNA, 23 nt, Human
aagcagcugggcaaacuucuggc

SEQ ID NO: 596026 - RNA, 19 nt, Human
aagcuuccggaggccuccc

SEQ ID NO: 596027 - RNA, 22 nt, Human
aaggaaaggaauauuuuucuca

SEQ ID NO: 596028 - RNA, 24 nt, Human
aaggcuccgucucaaaaaaaaccc

SEQ ID NO: 596029 - RNA, 22 nt, Human
aaucugaacuuacagaaaccaa

SEQ ID NO: 596030 - RNA, 24 nt, Human
aaugcccacuaaauuuugaauagc

SEQ ID NO: 596031 - RNA, 18 nt, Human
aauuagccaggcauggug

SEQ ID NO: 596032 - RNA, 18 nt, Human
acaauggaucuguacaac

SEQ ID NO: 596033 - RNA, 20 nt, Human
acagagcaaggcuccgucuc

SEQ ID NO: 596034 - RNA, 23 nt, Human
acagagcaaggcuccgucucaaa

SEQ ID NO: 596035 - RNA, 24 nt, Human
acagagcaaggcuccgucucaaaa

SEQ ID NO: 596036 - RNA, 23 nt, Human
acauaaaacauacagcagccaca

SEQ ID NO: 596037 - RNA, 19 nt, Human
accacaauggaucuguaca

SEQ ID NO: 596038 - RNA, 26 nt, Human
accacuuaaaaacccacaggccaaac

SEQ ID NO: 596039 - RNA, 18 nt, Human
accccaucucuacuaaaa

SEQ ID NO: 596040 - RNA, 18 nt, Human
acggugaaaccccaucuc

SEQ ID NO: 596041 - RNA, 24 nt, Human
acugcacuccagccugggcgacag

SEQ ID NO: 596042 - RNA, 26 nt, Human
acugcacuccagccugggcgacagag

SEQ ID NO: 596043 - RNA, 18 nt, Human
agaaaccaagcagacgcc

SEQ ID NO: 596044 - RNA, 18 nt, Human
agaaaccaauccaccagg

SEQ ID NO: 596045 - RNA, 21 nt, Human
agaagaaagcagcugggcaaa

SEQ ID NO: 596046 - RNA, 21 nt, Human
agacaguaucuuaaaaguuca

SEQ ID NO: 596047 - RNA, 20 nt, Human
agacccaggaaacugaacga

SEQ ID NO: 596048 - RNA, 24 nt, Human
agcagcugggcaaacuucuggcuc

SEQ ID NO: 596049 - RNA, 24 nt, Human
agccugggcgacagagcaaggcuc

SEQ ID NO: 596050 - RNA, 26 nt, Human
aggaaaggaauauuuuucucaaaugu

SEQ ID NO: 596051 - RNA, 24 nt, Human
aggcaggagaauggcaugaaccca

SEQ ID NO: 596052 - RNA, 27 nt, Human
aggcaggagaauggcaugaacccagga

SEQ ID NO: 596053 - RNA, 21 nt, Human
aggcagggcucuguccaagug

SEQ ID NO: 596054 - RNA, 24 nt, Human
aggcaugguggcgggcgccuguag

SEQ ID NO: 596055 - RNA, 19 nt, Human
aggcugaggcaggagaaug

SEQ ID NO: 596056 - RNA, 18 nt, Human
agggcucuguccaaguga

SEQ ID NO: 596057 - RNA, 21 nt, Human
agguggagguugcauagagcc

SEQ ID NO: 596058 - RNA, 24 nt, Human
agguggagguugcauagagccgag

SEQ ID NO: 596059 - RNA, 20 nt, Human
agguggggccuggugggagg

SEQ ID NO: 596060 - RNA, 21 nt, Human
auacuaagaaaaagaaaacca

SEQ ID NO: 596061 - RNA, 25 nt, Human
auagaacaaaaauaugaacauuuga

SEQ ID NO: 596062 - RNA, 24 nt, Human
aucgcgccacugcacuccagccug

SEQ ID NO: 596063 - RNA, 24 nt, Human
augaacccaggagguggagguugc

SEQ ID NO: 596064 - RNA, 20 nt, Human
auggacacucccauacuaag

SEQ ID NO: 596065 - RNA, 19 nt, Human
auguggucaaaugaaggag

SEQ ID NO: 596066 - RNA, 18 nt, Human
caaaaaaaaccccaaaaa

SEQ ID NO: 596067 - RNA, 21 nt, Human
caaaaaaaaccccaaaaaacc

SEQ ID NO: 596068 - RNA, 25 nt, Human
caaaaaaaaccccaaaaaaccaaaa

SEQ ID NO: 596069 - RNA, 24 nt, Human
caaaaaaccaaaaaaccaaauuac

SEQ ID NO: 596070 - RNA, 24 nt, Human
caacacauaaaacauacagcagcc

SEQ ID NO: 596071 - RNA, 19 nt, Human
caagccccacauuccaggg

SEQ ID NO: 596072 - RNA, 24 nt, Human
caagccccacauuccagggauauc

SEQ ID NO: 596073 - RNA, 23 nt, Human
caauguucaagccccacauucca

SEQ ID NO: 596074 - RNA, 19 nt, Human
caccaggacacccugccaa

SEQ ID NO: 596075 - RNA, 23 nt, Human
cacuccagccugggcgacagagc

SEQ ID NO: 596076 - RNA, 19 nt, Human
cacugcacuccagccuggg

SEQ ID NO: 596077 - RNA, 20 nt, Human
cacugcacuccagccugggc

SEQ ID NO: 596078 - RNA, 20 nt, Human
cacugcacuccagccugggc

SEQ ID NO: 596079 - RNA, 22 nt, Human
cacugcacuccagccugggcga

SEQ ID NO: 596080 - RNA, 24 nt, Human
cacugcacuccagccugggcgaca

SEQ ID NO: 596081 - RNA, 27 nt, Human
cacugcacuccagccugggcgacagag

SEQ ID NO: 596082 - RNA, 24 nt, Human
cagagcccauucgucucacaccau

SEQ ID NO: 596083 - RNA, 24 nt, Human
cagcagccacaaaauaauuagaaa

SEQ ID NO: 596084 - RNA, 24 nt, Human
cagccagauuucuucucaaaucaa

SEQ ID NO: 596085 - RNA, 24 nt, Human
cagcuacucgggaggcugaggcag

SEQ ID NO: 596086 - RNA, 18 nt, Human
caguaccaugcuuccugu

SEQ ID NO: 596087 - RNA, 19 nt, Human
cauacggugaaaccccauc

SEQ ID NO: 596088 - RNA, 20 nt, Human
cauacggugaaaccccaucu

SEQ ID NO: 596089 - RNA, 23 nt, Human
cauacuaagaaaaagaaaaccau

SEQ ID NO: 596090 - RNA, 18 nt, Human
caugggucccucagaauc

SEQ ID NO: 596091 - RNA, 22 nt, Human
caugguggcgggcgccuguagu

SEQ ID NO: 596092 - RNA, 19 nt, Human
caugugaugugccugcucc

SEQ ID NO: 596093 - RNA, 24 nt, Human
ccaagugaacacauugagaaugaa

SEQ ID NO: 596094 - RNA, 23 nt, Human
ccaauacuggagguggggccugg

SEQ ID NO: 596095 - RNA, 23 nt, Human
ccaauccaccaggacacccugcc

SEQ ID NO: 596096 - RNA, 20 nt, Human
ccacugcacuccagccuggg

SEQ ID NO: 596097 - RNA, 20 nt, Human
ccacugcacuccagccuggg

SEQ ID NO: 596098 - RNA, 21 nt, Human
ccacugcacuccagccugggc

SEQ ID NO: 596099 - RNA, 21 nt, Human
ccacugcacuccagccugggc

SEQ ID NO: 596100 - RNA, 23 nt, Human
ccacugcacuccagccugggcga

SEQ ID NO: 596101 - RNA, 24 nt, Human
ccacugcacuccagccugggcgac

SEQ ID NO: 596102 - RNA, 21 nt, Human
ccauucgucucacaccauuuc

SEQ ID NO: 596103 - RNA, 20 nt, Human
ccccaaaaaaccaaaaaacc

SEQ ID NO: 596104 - RNA, 22 nt, Human
ccccaaaaaaccaaaaaaccaa

SEQ ID NO: 596105 - RNA, 24 nt, Human
ccccaaaaaaccaaaaaaccaaau

SEQ ID NO: 596106 - RNA, 22 nt, Human
ccccagaaaccaagcagacgcc

SEQ ID NO: 596107 - RNA, 19 nt, Human
cccugccaacaaaccauuc

SEQ ID NO: 596108 - RNA, 22 nt, Human
ccucaggaucuccugauaccaa

SEQ ID NO: 596109 - RNA, 24 nt, Human
ccuggcucauacggugaaacccca

SEQ ID NO: 596110 - RNA, 22 nt, Human
ccugggcgacagagcaaggcuc

SEQ ID NO: 596111 - RNA, 21 nt, Human
ccuguagucccagcuacucgg

SEQ ID NO: 596112 - RNA, 22 nt, Human
ccuguagucccagcuacucggg

SEQ ID NO: 596113 - RNA, 22 nt, Human
cgagaccauccuggcucauacg

SEQ ID NO: 596114 - RNA, 26 nt, Human
cgccacugcacuccagccugggcgac

SEQ ID NO: 596115 - RNA, 23 nt, Human
cgccuguagucccagcuacucgg

SEQ ID NO: 596116 - RNA, 24 nt, Human
cgccuguagucccagcuacucggg

SEQ ID NO: 596117 - RNA, 23 nt, Human
cuaaaugaaucucuaucaacuaa

SEQ ID NO: 596118 - RNA, 27 nt, Human
cucaagccucaauccaauucauggguc

SEQ ID NO: 596119 - RNA, 25 nt, Human
cucagaaucucaucacucccacuuc

SEQ ID NO: 596120 - RNA, 24 nt, Human
cucaggaucuccugauaccaauuc

SEQ ID NO: 596121 - RNA, 21 nt, Human
cuuccuguaaagccugcagag

SEQ ID NO: 596122 - RNA, 23 nt, Human
cuucuggcuccuaacaggcaauu

SEQ ID NO: 596123 - RNA, 20 nt, Human
cuugccauucauggaagagu

SEQ ID NO: 596124 - RNA, 24 nt, Human
gaaaacuugaaaaauacagaggua

SEQ ID NO: 596125 - RNA, 23 nt, Human
gaccacaauggaucuguacaacc

SEQ ID NO: 596126 - RNA, 23 nt, Human
gagaucgcgccacugcacuccag

SEQ ID NO: 596127 - RNA, 21 nt, Human
gagccgagaucgcgccacugc

SEQ ID NO: 596128 - RNA, 23 nt, Human
gagguugcauagagccgagaucg

SEQ ID NO: 596129 - RNA, 21 nt, Human
gcaaauaggccauguggucaa

SEQ ID NO: 596130 - RNA, 24 nt, Human
gcacuccagccugggcgacagagc

SEQ ID NO: 596131 - RNA, 22 nt, Human
gcaggagaauggcaugaaccca

SEQ ID NO: 596132 - RNA, 23 nt, Human
gcauuuagcauagaacaaaaaua

SEQ ID NO: 596133 - RNA, 22 nt, Human
gccacugcacuccagccugggc

SEQ ID NO: 596134 - RNA, 24 nt, Human
gccacugcacuccagccugggcga

SEQ ID NO: 596135 - RNA, 20 nt, Human
gccgagaucgcgccacugca

SEQ ID NO: 596136 - RNA, 24 nt, Human
ggagguugcauagagccgagaucg

SEQ ID NO: 596137 - RNA, 21 nt, Human
ggcccuuuuaucucagaggug

SEQ ID NO: 596138 - RNA, 21 nt, Human
gggcucccaacacauaaaaca

SEQ ID NO: 596139 - RNA, 20 nt, Human
gguggagguugcauagagcc

SEQ ID NO: 596140 - RNA, 24 nt, Human
gguggcgggcgccuguagucccag

SEQ ID NO: 596141 - RNA, 21 nt, Human
guacaaagauucuuuauuuaa

SEQ ID NO: 596142 - RNA, 25 nt, Human
guccagagcccauucggccuaaugg

SEQ ID NO: 596143 - RNA, 20 nt, Human
gucucacaccauuuccccuc

SEQ ID NO: 596144 - RNA, 19 nt, Human
gucuccugagaguaugagg

SEQ ID NO: 596145 - RNA, 23 nt, Human
gucuuguggaucaugaggucagg

SEQ ID NO: 596146 - RNA, 23 nt, Human
gugaugugccugcuccccugaag

SEQ ID NO: 596147 - RNA, 21 nt, Human
guugcauagagccgagaucgc

SEQ ID NO: 596148 - RNA, 21 nt, Human
uaaaacauacagcagccacaa

SEQ ID NO: 596149 - RNA, 18 nt, Human
uaaauaaacucaugaauu

SEQ ID NO: 596150 - RNA, 27 nt, Human
uaaauaaacucaugaauuucauaugga

SEQ ID NO: 596151 - RNA, 23 nt, Human
uaaccacuuaaaaacccacaggc

SEQ ID NO: 596152 - RNA, 19 nt, Human
uaacuuagaaagaauuacc

SEQ ID NO: 596153 - RNA, 25 nt, Human
uaagaaaaagacccaggaaacugaa

SEQ ID NO: 596154 - RNA, 28 nt, Human
uacagcagccacaaaauaauuagaaaca

SEQ ID NO: 596155 - RNA, 22 nt, Human
uaccagccucaggaucuccuga

SEQ ID NO: 596156 - RNA, 21 nt, Human
uagaacaaaaauaugaacauu

SEQ ID NO: 596157 - RNA, 18 nt, Human
uagaaguauaaaacaaau

SEQ ID NO: 596158 - RNA, 20 nt, Human
uagacauaaauaaacucaug

SEQ ID NO: 596159 - RNA, 20 nt, Human
uagcauagaacaaaaauaug

SEQ ID NO: 596160 - RNA, 22 nt, Human
uauagaaaacuugaaaaauaca

SEQ ID NO: 596161 - RNA, 22 nt, Human
uauccagaagagucuccugaga

SEQ ID NO: 596162 - RNA, 21 nt, Human
uauuucuucuucacgucuucc

SEQ ID NO: 596163 - RNA, 18 nt, Human
ucaugaggucaggagauc

SEQ ID NO: 596164 - RNA, 24 nt, Human
ucaugaggucaggagaucgagacc

SEQ ID NO: 596165 - RNA, 24 nt, Human
uccagccugggcgacagagcaagg

SEQ ID NO: 596166 - RNA, 19 nt, Human
ucccuacaaaaaaaggggc

SEQ ID NO: 596167 - RNA, 22 nt, Human
ucccucaugaauggccugggcc

SEQ ID NO: 596168 - RNA, 23 nt, Human
ucgcgccacugcacuccagccug

SEQ ID NO: 596169 - RNA, 22 nt, Human
ucucuacuaaaaauauaaaaaa

SEQ ID NO: 596170 - RNA, 25 nt, Human
ucuuguggaucaugaggucaggaga

SEQ ID NO: 596171 - RNA, 19 nt, Human
ugaaaccccaucucuacua

SEQ ID NO: 596172 - RNA, 21 nt, Human
ugaaggagugugaccugggac

SEQ ID NO: 596173 - RNA, 21 nt, Human
ugagaguaugagggugaacua

SEQ ID NO: 596174 - RNA, 23 nt, Human
ugaggcaggagaauggcaugaac

SEQ ID NO: 596175 - RNA, 24 nt, Human
ugaggcaggagaauggcaugaacc

SEQ ID NO: 596176 - RNA, 25 nt, Human
ugaggcaggagaauggcaugaaccc

SEQ ID NO: 596177 - RNA, 24 nt, Human
ugccugcucccccuucaccuucug

SEQ ID NO: 596178 - RNA, 23 nt, Human
uggaauauuuaccacuacucccc

SEQ ID NO: 596179 - RNA, 23 nt, Human
uggaucccucaugaauggccugg

SEQ ID NO: 596180 - RNA, 24 nt, Human
uggcaugaacccaggagguggagg

SEQ ID NO: 596181 - RNA, 21 nt, Human
uggcugcacugccagggcagg

SEQ ID NO: 596182 - RNA, 20 nt, Human
uggggccuggugggaggugu

SEQ ID NO: 596183 - RNA, 24 nt, Human
ugguacaaagauucuuuauuuaag

SEQ ID NO: 596184 - RNA, 21 nt, Human
ugguacaggcucagugugaag

SEQ ID NO: 596185 - RNA, 24 nt, Human
ugguggcgggcgccuguaguccca

SEQ ID NO: 596186 - RNA, 18 nt, Human
uggugugugcaugugggu

SEQ ID NO: 596187 - RNA, 21 nt, Human
uguaauccccaauacuggagg

SEQ ID NO: 596188 - RNA, 23 nt, Human
uguauaaaaacuauggugugugc

SEQ ID NO: 596189 - RNA, 19 nt, Human
ugugugcauguggguguau

SEQ ID NO: 596190 - RNA, 19 nt, Human
ugugugcauguggguguau

SEQ ID NO: 596191 - RNA, 22 nt, Human
ugugugcauguggguguaugug

SEQ ID NO: 596192 - RNA, 18 nt, Human
uguucccgcccaaaccuc

SEQ ID NO: 596193 - RNA, 26 nt, Human
uguuuguauaaaaacuauggugugug

SEQ ID NO: 596194 - RNA, 21 nt, Human
uucaaaacaaucagaucuuug

SEQ ID NO: 596195 - RNA, 18 nt, Human
uuccuuauagaaaacuug

SEQ ID NO: 596196 - RNA, 19 nt, Human
uucgucucacaccauuucc

SEQ ID NO: 596197 - RNA, 20 nt, Human
uugccugucucccaggauga

SEQ ID NO: 596198 - RNA, 21 nt, Human
uuguuccugcuuuugucaugu

SEQ ID NO: 596199 - RNA, 20 nt, Human
uuuaugagaaucugaacuua

SEQ ID NO: 596200 - RNA, 20 nt, Human
uuuuccauaaguaccccuug

SEQ ID NO: 596201 - RNA, 18 nt, Human
aaggauggcugugcaugg

SEQ ID NO: 596202 - RNA, 23 nt, Human
accaagacucccaacuaaaucag

SEQ ID NO: 596203 - RNA, 21 nt, Human
acuccaaaaaacuguuugagg

SEQ ID NO: 596204 - RNA, 18 nt, Human
acuccuccuccuccuucc

SEQ ID NO: 596205 - RNA, 23 nt, Human
acuccuccuccuccuuccuauug

SEQ ID NO: 596206 - RNA, 18 nt, Human
agcagaucuacaggcaga

SEQ ID NO: 596207 - RNA, 22 nt, Human
aggaugaauagauucauuauca

SEQ ID NO: 596208 - RNA, 21 nt, Human
auaaaaaucagcacauguuca

SEQ ID NO: 596209 - RNA, 21 nt, Human
auccauaaaauugccucccuc

SEQ ID NO: 596210 - RNA, 18 nt, Human
auccccucucccccacug

SEQ ID NO: 596211 - RNA, 20 nt, Human
caacauggaaaacauaagua

SEQ ID NO: 596212 - RNA, 19 nt, Human
caacuacaggcucugccag

SEQ ID NO: 596213 - RNA, 19 nt, Human
caacuuaccaagacuccca

SEQ ID NO: 596214 - RNA, 20 nt, Human
caagacucccaacuaaauca

SEQ ID NO: 596215 - RNA, 20 nt, Human
cacaaaguccaguagucacu

SEQ ID NO: 596216 - RNA, 19 nt, Human
cacguugcagaaauacuaa

SEQ ID NO: 596217 - RNA, 21 nt, Human
cacucuguccccuuuccaacu

SEQ ID NO: 596218 - RNA, 18 nt, Human
cagaccuauggacaaaua

SEQ ID NO: 596219 - RNA, 18 nt, Human
ccaguagucacucugucc

SEQ ID NO: 596220 - RNA, 25 nt, Human
cccacaacuuaccaagacucccaaa

SEQ ID NO: 596221 - RNA, 21 nt, Human
cccacccgucucagccuugac

SEQ ID NO: 596222 - RNA, 22 nt, Human
ccccacccgucucagccuugac

SEQ ID NO: 596223 - RNA, 22 nt, Human
ccccucucccccacugcuuugu

SEQ ID NO: 596224 - RNA, 18 nt, Human
ccuccuauccccucuccc

SEQ ID NO: 596225 - RNA, 22 nt, Human
cuacuccuccuccuccuuccua

SEQ ID NO: 596226 - RNA, 19 nt, Human
cugugcaugggcccagccc

SEQ ID NO: 596227 - RNA, 23 nt, Human
cuuccuauugcccaccaucuucc

SEQ ID NO: 596228 - RNA, 21 nt, Human
cuuuccaacuacaggcucugc

SEQ ID NO: 596229 - RNA, 27 nt, Human
gaaaacaugcagaggaagccgguaccc

SEQ ID NO: 596230 - RNA, 19 nt, Human
ggacaaauaaacaaacagg

SEQ ID NO: 596231 - RNA, 20 nt, Human
gucucagccuugacugaagu

SEQ ID NO: 596232 - RNA, 23 nt, Human
uaaaaucucaaaagaauacacau

SEQ ID NO: 596233 - RNA, 22 nt, Human
uacuauauagcacaauaaaaau

SEQ ID NO: 596234 - RNA, 24 nt, Human
uagaaaacaugcagaggaagcuca

SEQ ID NO: 596235 - RNA, 19 nt, Human
uagaaugucccucguucag

SEQ ID NO: 596236 - RNA, 22 nt, Human
uagcacaauaaaaaucagcaca

SEQ ID NO: 596237 - RNA, 21 nt, Human
uauaaagcacagaaguauagc

SEQ ID NO: 596238 - RNA, 23 nt, Human
uauauacccccacccgucucagc

SEQ ID NO: 596239 - RNA, 19 nt, Human
uauggacaaauaaacaaac

SEQ ID NO: 596240 - RNA, 19 nt, Human
ucacucuguccccuuuccc

SEQ ID NO: 596241 - RNA, 22 nt, Human
uccaguagucacucuguccccu

SEQ ID NO: 596242 - RNA, 18 nt, Human
uccauaaaauugccuccc

SEQ ID NO: 596243 - RNA, 24 nt, Human
uccuauugcccaccaucuuccucu

SEQ ID NO: 596244 - RNA, 22 nt, Human
uccuccuauccccucuccccca

SEQ ID NO: 596245 - RNA, 24 nt, Human
uccuccuccuccuuccuauugccc

SEQ ID NO: 596246 - RNA, 24 nt, Human
ucuccuggugacagaccuuggucc

SEQ ID NO: 596247 - RNA, 21 nt, Human
ucuucagugauugcccuagaa

SEQ ID NO: 596248 - RNA, 20 nt, Human
ugagagcaggacaagcagug

SEQ ID NO: 596249 - RNA, 21 nt, Human
uggaaacugaucuccugguga

SEQ ID NO: 596250 - RNA, 19 nt, Human
uggagagugggaaaggcag

SEQ ID NO: 596251 - RNA, 21 nt, Human
uggagagugggaaaggcagcu

SEQ ID NO: 596252 - RNA, 19 nt, Human
ugggaaaggcagcuuagca

SEQ ID NO: 596253 - RNA, 22 nt, Human
ugggcccagcccuguggagggu

SEQ ID NO: 596254 - RNA, 25 nt, Human
ugugcaugggcccagcccuguggag

SEQ ID NO: 596255 - RNA, 24 nt, Human
uguuugaggcuuuaugagaacaga

SEQ ID NO: 596256 - RNA, 22 nt, Human
uuccaacuacaggcucugccag

SEQ ID NO: 596257 - RNA, 21 nt, Human
uuggucccuugcccuuauucu

SEQ ID NO: 596258 - RNA, 21 nt, Human
uuuguuucagggcuacuccuc

SEQ ID NO: 596259 - RNA, 24 nt, Human
uuuucacacaaaguccaguaguca

SEQ ID NO: 596260 - RNA, 21 nt, Human
aaaaaaaaaaaaaaaaagucc

SEQ ID NO: 596261 - RNA, 19 nt, Human
aacaugaugaaaccccauc

SEQ ID NO: 596262 - RNA, 20 nt, Human
aacaugaugaaaccccaucu

SEQ ID NO: 596263 - RNA, 21 nt, Human
aacaugaugaaaccccaucuc

SEQ ID NO: 596264 - RNA, 21 nt, Human
aacaugaugaaaccccaucuc

SEQ ID NO: 596265 - RNA, 18 nt, Human
aagcaacccuccaagacu

SEQ ID NO: 596266 - RNA, 23 nt, Human
aagcaacccuccaagacuucucc

SEQ ID NO: 596267 - RNA, 18 nt, Human
aaucgcuugaaccuggga

SEQ ID NO: 596268 - RNA, 24 nt, Human
aaucgcuugaaccugggaggcgga

SEQ ID NO: 596269 - RNA, 20 nt, Human
acaagagcaaaacuccaucu

SEQ ID NO: 596270 - RNA, 24 nt, Human
accccaucucuacuaaaaauacaa

SEQ ID NO: 596271 - RNA, 28 nt, Human
acuccaucucaaaaaaaaaaaaaaaaaa

SEQ ID NO: 596272 - RNA, 22 nt, Human
agaaucgcuugaaccugggagg

SEQ ID NO: 596273 - RNA, 23 nt, Human
agccaggcgugguggcaggugcc

SEQ ID NO: 596274 - RNA, 24 nt, Human
agccuggccaacaugaugaaaccc

SEQ ID NO: 596275 - RNA, 22 nt, Human
aggcaggagaaucgcuugaacc

SEQ ID NO: 596276 - RNA, 24 nt, Human
aggcaggagaaucgcuugaaccug

SEQ ID NO: 596277 - RNA, 24 nt, Human
aggcaugguggcucacgccuguaa

SEQ ID NO: 596278 - RNA, 24 nt, Human
aggcggagguugcggugagccaag

SEQ ID NO: 596279 - RNA, 22 nt, Human
aggcgggcagaucaccugaggu

SEQ ID NO: 596280 - RNA, 26 nt, Human
aggcgggcagaucaccugaggucagg

SEQ ID NO: 596281 - RNA, 24 nt, Human
aggcgugguggcaggugccuguaa

SEQ ID NO: 596282 - RNA, 24 nt, Human
agucugaggcaggagaaucgcuug

SEQ ID NO: 596283 - RNA, 24 nt, Human
aucgcgcuauugcacuccagccug

SEQ ID NO: 596284 - RNA, 25 nt, Human
augguggcucacgccuguaauucca

SEQ ID NO: 596285 - RNA, 18 nt, Human
auugcacuccagccuggg

SEQ ID NO: 596286 - RNA, 20 nt, Human
auugcacuccagccugggca

SEQ ID NO: 596287 - RNA, 23 nt, Human
auugcacuccagccugggcaaca

SEQ ID NO: 596288 - RNA, 24 nt, Human
auugcacuccagccugggcaacaa

SEQ ID NO: 596289 - RNA, 21 nt, Human
caacaagagcaaaacuccauc

SEQ ID NO: 596290 - RNA, 24 nt, Human
caagagcaaaacuccaucucaaaa

SEQ ID NO: 596291 - RNA, 24 nt, Human
caagaucgcgcuauugcacuccag

SEQ ID NO: 596292 - RNA, 25 nt, Human
cacgccuguaauuccagcacuuuug

SEQ ID NO: 596293 - RNA, 24 nt, Human
cacuccagccugggcaacaagagc

SEQ ID NO: 596294 - RNA, 18 nt, Human
cacucuucuuauagucuu

SEQ ID NO: 596295 - RNA, 18 nt, Human
cagaagcaacccuccaag

SEQ ID NO: 596296 - RNA, 27 nt, Human
cagaucaccugaggucaggagcucgag

SEQ ID NO: 596297 - RNA, 24 nt, Human
cagcacuuuuggaggccgaggcgg

SEQ ID NO: 596298 - RNA, 23 nt, Human
cagccuccccucaaauucccucc

SEQ ID NO: 596299 - RNA, 18 nt, Human
cccucaaauucccucccc

SEQ ID NO: 596300 - RNA, 22 nt, Human
ccugaggucaggagcucgagac

SEQ ID NO: 596301 - RNA, 24 nt, Human
ccuggccaacaugaugaaacccca

SEQ ID NO: 596302 - RNA, 19 nt, Human
ccugggaggcggagguugc

SEQ ID NO: 596303 - RNA, 21 nt, Human
ccuguaaucccagcuacuuag

SEQ ID NO: 596304 - RNA, 25 nt, Human
ccuuacuaaaaguacacucuucuua

SEQ ID NO: 596305 - RNA, 21 nt, Human
cgagaccagccuggccaacau

SEQ ID NO: 596306 - RNA, 20 nt, Human
cgaggcgggcagaucaccug

SEQ ID NO: 596307 - RNA, 18 nt, Human
cgccuguaauuccagcac

SEQ ID NO: 596308 - RNA, 21 nt, Human
cgcuugaaccugggaggcgga

SEQ ID NO: 596309 - RNA, 24 nt, Human
cgggcagaucaccugaggucagga

SEQ ID NO: 596310 - RNA, 18 nt, Human
cuacuuaggagucugagg

SEQ ID NO: 596311 - RNA, 20 nt, Human
cuauugcacuccagccuggg

SEQ ID NO: 596312 - RNA, 21 nt, Human
cuauugcacuccagccugggc

SEQ ID NO: 596313 - RNA, 24 nt, Human
cuauugcacuccagccugggcaac

SEQ ID NO: 596314 - RNA, 18 nt, Human
cucaaaaaaaaaaaaaaa

SEQ ID NO: 596315 - RNA, 23 nt, Human
cucaaauucccuccccguccugc

SEQ ID NO: 596316 - RNA, 24 nt, Human
cucacgccuguaauuccagcacuu

SEQ ID NO: 596317 - RNA, 21 nt, Human
cuccaagacuucucccuuacu

SEQ ID NO: 596318 - RNA, 19 nt, Human
cuccaucucaaaaaaaaaa

SEQ ID NO: 596319 - RNA, 24 nt, Human
cugggcaacaagagcaaaacucca

SEQ ID NO: 596320 - RNA, 25 nt, Human
gaggcgggcagaucaccugagguca

SEQ ID NO: 596321 - RNA, 23 nt, Human
gagguugcggugagccaagaucg

SEQ ID NO: 596322 - RNA, 18 nt, Human
gaucaccugaggucagga

SEQ ID NO: 596323 - RNA, 24 nt, Human
gaucaccugaggucaggagcucga

SEQ ID NO: 596324 - RNA, 24 nt, Human
gccaacaugaugaaaccccaucuc

SEQ ID NO: 596325 - RNA, 22 nt, Human
gcuauugcacuccagccugggc

SEQ ID NO: 596326 - RNA, 24 nt, Human
gcuauugcacuccagccugggcaa

SEQ ID NO: 596327 - RNA, 22 nt, Human
ggaggccgaggcgggcagauca

SEQ ID NO: 596328 - RNA, 20 nt, Human
ggagguugcggugagccaag

SEQ ID NO: 596329 - RNA, 24 nt, Human
ggagguugcggugagccaagaucg

SEQ ID NO: 596330 - RNA, 21 nt, Human
ggcaggugccuguaaucccag

SEQ ID NO: 596331 - RNA, 22 nt, Human
ggccaggcaugguggcucacgg

SEQ ID NO: 596332 - RNA, 21 nt, Human
ggcucacgccuguaauuccag

SEQ ID NO: 596333 - RNA, 24 nt, Human
gguggcaggugccuguaaucccag

SEQ ID NO: 596334 - RNA, 24 nt, Human
gguggcucacgccuguaauuccag

SEQ ID NO: 596335 - RNA, 27 nt, Human
guaacacauuaccacauaaacacacua

SEQ ID NO: 596336 - RNA, 21 nt, Human
uaaacacacuaaggcacgccg

SEQ ID NO: 596337 - RNA, 24 nt, Human
uaauguuagaauuucucaacauac

SEQ ID NO: 596338 - RNA, 22 nt, Human
uauugcacuccagccugggcaa

SEQ ID NO: 596339 - RNA, 22 nt, Human
ucaaaaaaaaaaaaaaaaaaaa

SEQ ID NO: 596340 - RNA, 23 nt, Human
ucaaaaaaaaaaaaaaaaaaaaa

SEQ ID NO: 596341 - RNA, 23 nt, Human
ucaaaaaaaaaaaaaaaaaaaaa

SEQ ID NO: 596342 - RNA, 19 nt, Human
ucaccugaggucaggagcu

SEQ ID NO: 596343 - RNA, 22 nt, Human
ucacgccuguaauuccagcacu

SEQ ID NO: 596344 - RNA, 23 nt, Human
uccaucucaaaaaaaaaaaaaaa

SEQ ID NO: 596345 - RNA, 21 nt, Human
ucccuccccguccugcagaag

SEQ ID NO: 596346 - RNA, 24 nt, Human
ucgcuugaaccugggaggcggagg

SEQ ID NO: 596347 - RNA, 22 nt, Human
ucucuacuaaaaauacaaaaaa

SEQ ID NO: 596348 - RNA, 19 nt, Human
ugaaaccccaucucuacua

SEQ ID NO: 596349 - RNA, 24 nt, Human
ugaaccugggaggcggagguugcg

SEQ ID NO: 596350 - RNA, 22 nt, Human
ugagccaagaucgcgcuauugc

SEQ ID NO: 596351 - RNA, 20 nt, Human
ugaggcaggagaaucgcuug

SEQ ID NO: 596352 - RNA, 24 nt, Human
ugaggcaggagaaucgcuugaacc

SEQ ID NO: 596353 - RNA, 25 nt, Human
ugaggcaggagaaucgcuugaaccu

SEQ ID NO: 596354 - RNA, 18 nt, Human
ugcacuccagccugggca

SEQ ID NO: 596355 - RNA, 19 nt, Human
ugcacuccagccugggcaa

SEQ ID NO: 596356 - RNA, 19 nt, Human
ugcacuccagccugggcaa

SEQ ID NO: 596357 - RNA, 20 nt, Human
ugcacuccagccugggcaac

SEQ ID NO: 596358 - RNA, 22 nt, Human
ugcacuccagccugggcaacaa

SEQ ID NO: 596359 - RNA, 24 nt, Human
ugccuguaaucccagcuacuuagg

SEQ ID NO: 596360 - RNA, 22 nt, Human
uggcaggugccuguaaucccag

SEQ ID NO: 596361 - RNA, 22 nt, Human
uggcucacgccuguaauuccag

SEQ ID NO: 596362 - RNA, 24 nt, Human
uggcucacgccuguaauuccagca

SEQ ID NO: 596363 - RNA, 24 nt, Human
ugggaggcggagguugcggugagc

SEQ ID NO: 596364 - RNA, 24 nt, Human
ugguggcaggugccuguaauccca

SEQ ID NO: 596365 - RNA, 23 nt, Human
uguaaucccagcuacuuaggagu

SEQ ID NO: 596366 - RNA, 18 nt, Human
uucucccuuacuaaaagu

SEQ ID NO: 596367 - RNA, 24 nt, Human
uugaaccugggaggcggagguugc

SEQ ID NO: 596368 - RNA, 22 nt, Human
uugcggugagccaagaucgcgc

SEQ ID NO: 596369 - RNA, 18 nt, Human
aaaaaaaaaaaaaaaggc

SEQ ID NO: 596370 - RNA, 21 nt, Human
aaaaaaaggccgggugcggug

SEQ ID NO: 596371 - RNA, 23 nt, Human
aacaaaucacugaagucaagguc

SEQ ID NO: 596372 - RNA, 19 nt, Human
aacaaggcgaaaccccguc

SEQ ID NO: 596373 - RNA, 20 nt, Human
aacaaggcgaaaccccgucu

SEQ ID NO: 596374 - RNA, 21 nt, Human
aacaaggcgaaaccccgucuu

SEQ ID NO: 596375 - RNA, 20 nt, Human
aaccccgucuuuaccaaaaa

SEQ ID NO: 596376 - RNA, 23 nt, Human
aaucgcuugaacccaagaggagg

SEQ ID NO: 596377 - RNA, 20 nt, Human
acaagagcaaaacuccaucu

SEQ ID NO: 596378 - RNA, 20 nt, Human
acaccagaggcugagguggg

SEQ ID NO: 596379 - RNA, 19 nt, Human
acagagaccccgccucaaa

SEQ ID NO: 596380 - RNA, 23 nt, Human
accccgucuuuaccaaaaauaca

SEQ ID NO: 596381 - RNA, 24 nt, Human
acccugucucuacuaaaaauacaa

SEQ ID NO: 596382 - RNA, 18 nt, Human
acgguggaacccugucuc

SEQ ID NO: 596383 - RNA, 24 nt, Human
acugcacuccagccugggugacag

SEQ ID NO: 596384 - RNA, 26 nt, Human
acugcacuccagccugggugacagag

SEQ ID NO: 596385 - RNA, 22 nt, Human
agagauugcagugagccgagau

SEQ ID NO: 596386 - RNA, 24 nt, Human
agagauugcagugagccgagauug

SEQ ID NO: 596387 - RNA, 20 nt, Human
agaggaggagguugugguga

SEQ ID NO: 596388 - RNA, 22 nt, Human
agaggaggagguuguggugagc

SEQ ID NO: 596389 - RNA, 24 nt, Human
agcacuuugggaggccaagauggg

SEQ ID NO: 596390 - RNA, 24 nt, Human
agcacuuugggaggccgagguggg

SEQ ID NO: 596391 - RNA, 19 nt, Human
agcaucuguggucccagcu

SEQ ID NO: 596392 - RNA, 20 nt, Human
agccaggcaugguggagcau

SEQ ID NO: 596393 - RNA, 19 nt, Human
agccgagaucacuucagcc

SEQ ID NO: 596394 - RNA, 23 nt, Human
agccgggcgugguggugcaugcc

SEQ ID NO: 596395 - RNA, 24 nt, Human
agccuggccaauacgguggaaccc

SEQ ID NO: 596396 - RNA, 24 nt, Human
aggaggagguuguggugagccgag

SEQ ID NO: 596397 - RNA, 21 nt, Human
aggcagagauugcagugagcc

SEQ ID NO: 596398 - RNA, 24 nt, Human
aggcagagauugcagugagccgag

SEQ ID NO: 596399 - RNA, 23 nt, Human
aggcaggagaaucgcuugaaccc

SEQ ID NO: 596400 - RNA, 24 nt, Human
aggcaggagaaucgcuugaaccca

SEQ ID NO: 596401 - RNA, 21 nt, Human
aggccgaggugggcagaucau

SEQ ID NO: 596402 - RNA, 22 nt, Human
aggccgggugcgguggcucaug

SEQ ID NO: 596403 - RNA, 20 nt, Human
aggcugaggcaggagaaucg

SEQ ID NO: 596404 - RNA, 24 nt, Human
aggcugaggcaggagaaucgcuug

SEQ ID NO: 596405 - RNA, 24 nt, Human
aggcugaggugggaggauugcuug

SEQ ID NO: 596406 - RNA, 24 nt, Human
aguggcucacgucugugaucccag

SEQ ID NO: 596407 - RNA, 24 nt, Human
aguuacagaccacccugggcaaca

SEQ ID NO: 596408 - RNA, 19 nt, Human
aucaugaggucaggaguuc

SEQ ID NO: 596409 - RNA, 20 nt, Human
aucaugaggucaggaguucc

SEQ ID NO: 596410 - RNA, 19 nt, Human
augccuguaaucucagcac

SEQ ID NO: 596411 - RNA, 24 nt, Human
auggaccggacgcaguggcucacg

SEQ ID NO: 596412 - RNA, 19 nt, Human
augggcggaucaugagguc

SEQ ID NO: 596413 - RNA, 19 nt, Human
auugcagugagccgagauu

SEQ ID NO: 596414 - RNA, 18 nt, Human
caaaacuccaucucaaaa

SEQ ID NO: 596415 - RNA, 25 nt, Human
caaaucacugaagucaaggucuaaa

SEQ ID NO: 596416 - RNA, 21 nt, Human
caacaagagcaaaacuccauc

SEQ ID NO: 596417 - RNA, 24 nt, Human
caacaaggcgaaaccccgucuuua

SEQ ID NO: 596418 - RNA, 21 nt, Human
caagaggaggagguuguggug

SEQ ID NO: 596419 - RNA, 24 nt, Human
caagaugggcggaucaugagguca

SEQ ID NO: 596420 - RNA, 18 nt, Human
cacccugggcaacaaggc

SEQ ID NO: 596421 - RNA, 24 nt, Human
cacgucugugaucccagcacuuug

SEQ ID NO: 596422 - RNA, 18 nt, Human
cacuccagccugggugac

SEQ ID NO: 596423 - RNA, 22 nt, Human
cacuccagccugggugacagag

SEQ ID NO: 596424 - RNA, 19 nt, Human
cacugcacuccagccuggg

SEQ ID NO: 596425 - RNA, 19 nt, Human
cacugcacuccagccuggg

SEQ ID NO: 596426 - RNA, 20 nt, Human
cacugcacuccagccugggu

SEQ ID NO: 596427 - RNA, 22 nt, Human
cacugcacuccagccuggguga

SEQ ID NO: 596428 - RNA, 23 nt, Human
cacugcacuccagccugggugac

SEQ ID NO: 596429 - RNA, 24 nt, Human
cacugcacuccagccugggugaca

SEQ ID NO: 596430 - RNA, 24 nt, Human
cacugcacuccagccugggugaca

SEQ ID NO: 596431 - RNA, 19 nt, Human
cacuucagccugggcaaca

SEQ ID NO: 596432 - RNA, 24 nt, Human
cacuucagccugggcaacaagagc

SEQ ID NO: 596433 - RNA, 20 nt, Human
cagauggaccggacgcagug

SEQ ID NO: 596434 - RNA, 20 nt, Human
cagcacuuugggaggccaag

SEQ ID NO: 596435 - RNA, 28 nt, Human
cagcacuuugggaggccaagaugggcgg

SEQ ID NO: 596436 - RNA, 24 nt, Human
cagcacuuugggaggccgaggugg

SEQ ID NO: 596437 - RNA, 20 nt, Human
caggaguucgagagcagccu

SEQ ID NO: 596438 - RNA, 21 nt, Human
caucuguggucccagcuacac

SEQ ID NO: 596439 - RNA, 20 nt, Human
caugccuguaaucucagcac

SEQ ID NO: 596440 - RNA, 24 nt, Human
caugccuguaaucucagcacuuug

SEQ ID NO: 596441 - RNA, 19 nt, Human
ccccgccucaaaaaaaaaa

SEQ ID NO: 596442 - RNA, 23 nt, Human
cccgccucaaaaaaaaaaaaaaa

SEQ ID NO: 596443 - RNA, 24 nt, Human
ccgucuuuaccaaaaauacagcca

SEQ ID NO: 596444 - RNA, 22 nt, Human
ccuggccaauacgguggaaccc

SEQ ID NO: 596445 - RNA, 24 nt, Human
ccuggccaauacgguggaacccug

SEQ ID NO: 596446 - RNA, 23 nt, Human
ccugggcaacaaggcgaaacccc

SEQ ID NO: 596447 - RNA, 24 nt, Human
ccugggcaacaaggcgaaaccccg

SEQ ID NO: 596448 - RNA, 21 nt, Human
ccuguaaucccaguucuccgg

SEQ ID NO: 596449 - RNA, 22 nt, Human
ccuguaaucucagcacuuuggg

SEQ ID NO: 596450 - RNA, 19 nt, Human
cgaggugggcagaucaucu

SEQ ID NO: 596451 - RNA, 22 nt, Human
cggaucaugaggucaggaguuc

SEQ ID NO: 596452 - RNA, 24 nt, Human
cgucugugaucccagcacuuuggg

SEQ ID NO: 596453 - RNA, 27 nt, Human
cuacaacaaaucacugaagucaagguc

SEQ ID NO: 596454 - RNA, 23 nt, Human
cuacaccagaggcugagguggga

SEQ ID NO: 596455 - RNA, 18 nt, Human
cucaaaaaaaaaaaaaaa

SEQ ID NO: 596456 - RNA, 18 nt, Human
cucaaaaaaauaaaagcc

SEQ ID NO: 596457 - RNA, 24 nt, Human
cucacgucugugaucccagcacuu

SEQ ID NO: 596458 - RNA, 24 nt, Human
cucaugccuguaaucucagcacuu

SEQ ID NO: 596459 - RNA, 24 nt, Human
cuggccaauacgguggaacccugu

SEQ ID NO: 596460 - RNA, 24 nt, Human
cugggcaacaagagcaaaacucca

SEQ ID NO: 596461 - RNA, 23 nt, Human
cuuugggaggccgaggugggcag

SEQ ID NO: 596462 - RNA, 22 nt, Human
gagauugugcacugcacuccag

SEQ ID NO: 596463 - RNA, 21 nt, Human
gaggugggaggauugcuuggg

SEQ ID NO: 596464 - RNA, 25 nt, Human
gaggugggcagaucaucugagcuca

SEQ ID NO: 596465 - RNA, 18 nt, Human
gaucaucugagcucagga

SEQ ID NO: 596466 - RNA, 21 nt, Human
gaucaucugagcucaggaguu

SEQ ID NO: 596467 - RNA, 22 nt, Human
gaucaucugagcucaggaguua

SEQ ID NO: 596468 - RNA, 22 nt, Human
gaucaugaggucaggaguucga

SEQ ID NO: 596469 - RNA, 24 nt, Human
gaucaugaggucaggaguucgaga

SEQ ID NO: 596470 - RNA, 20 nt, Human
gauugcuugggaggcagaga

SEQ ID NO: 596471 - RNA, 24 nt, Human
gauugugcacugcacuccagccug

SEQ ID NO: 596472 - RNA, 21 nt, Human
gcacugcacuccagccugggu

SEQ ID NO: 596473 - RNA, 24 nt, Human
gcacugcacuccagccugggugac

SEQ ID NO: 596474 - RNA, 22 nt, Human
gcaggagaaucgcuugaaccca

SEQ ID NO: 596475 - RNA, 22 nt, Human
gcaugguggagcaucugugguc

SEQ ID NO: 596476 - RNA, 24 nt, Human
gccaauacgguggaacccugucuc

SEQ ID NO: 596477 - RNA, 22 nt, Human
gcucaggaguuacagaccaccc

SEQ ID NO: 596478 - RNA, 24 nt, Human
ggacgcaguggcucacgucuguga

SEQ ID NO: 596479 - RNA, 18 nt, Human
ggaggagguuguggugag

SEQ ID NO: 596480 - RNA, 27 nt, Human
ggaggauugcuugggaggcagagauug

SEQ ID NO: 596481 - RNA, 20 nt, Human
ggagguuguggugagccgag

SEQ ID NO: 596482 - RNA, 22 nt, Human
ggagguuguggugagccgagau

SEQ ID NO: 596483 - RNA, 23 nt, Human
ggagguuguggugagccgagauc

SEQ ID NO: 596484 - RNA, 24 nt, Human
ggagguuguggugagccgagauca

SEQ ID NO: 596485 - RNA, 21 nt, Human
ggaucaugaggucaggaguuc

SEQ ID NO: 596486 - RNA, 21 nt, Human
ggcagaucaucugagcucagg

SEQ ID NO: 596487 - RNA, 25 nt, Human
ggcagaucaucugagcucaggaguu

SEQ ID NO: 596488 - RNA, 23 nt, Human
ggccgggugcgguggcucaugcc

SEQ ID NO: 596489 - RNA, 23 nt, Human
ggcggaucaugaggucaggaguu

SEQ ID NO: 596490 - RNA, 24 nt, Human
gggcgugguggugcaugccuguaa

SEQ ID NO: 596491 - RNA, 24 nt, Human
gggugcgguggcucaugccuguaa

SEQ ID NO: 596492 - RNA, 28 nt, Human
ggugacagagaccccgccucaaaaaaaa

SEQ ID NO: 596493 - RNA, 23 nt, Human
gguggcucaugccuguaaucuca

SEQ ID NO: 596494 - RNA, 24 nt, Human
gguggcucaugccuguaaucucag

SEQ ID NO: 596495 - RNA, 24 nt, Human
gguggugcaugccuguaaucccag

SEQ ID NO: 596496 - RNA, 19 nt, Human
guggagcaucugugguccc

SEQ ID NO: 596497 - RNA, 23 nt, Human
guggugcaugccuguaaucccag

SEQ ID NO: 596498 - RNA, 22 nt, Human
guuacagaccacccugggcaac

SEQ ID NO: 596499 - RNA, 22 nt, Human
uaaaaauacaaaauuagccggg

SEQ ID NO: 596500 - RNA, 23 nt, Human
uaaaaauacaaaauuagccgggc

SEQ ID NO: 596501 - RNA, 21 nt, Human
uacaccagaggcugagguggg

SEQ ID NO: 596502 - RNA, 22 nt, Human
uagagaagcauacaagacuaca

SEQ ID NO: 596503 - RNA, 22 nt, Human
uauagagaagcauacaagacua

SEQ ID NO: 596504 - RNA, 20 nt, Human
ucaaaaaaaaaaaaaaaaaa

SEQ ID NO: 596505 - RNA, 22 nt, Human
ucaaaaaaaaaaaaaaaaaaaa

SEQ ID NO: 596506 - RNA, 23 nt, Human
ucaaaaaaaaaaaaaaaaaaaaa

SEQ ID NO: 596507 - RNA, 22 nt, Human
ucacgucugugaucccagcacu

SEQ ID NO: 596508 - RNA, 24 nt, Human
ucaugaggucaggaguucgagagc

SEQ ID NO: 596509 - RNA, 19 nt, Human
uccagccugggugacagag

SEQ ID NO: 596510 - RNA, 20 nt, Human
uccagccugggugacagaga

SEQ ID NO: 596511 - RNA, 18 nt, Human
ucgagagcagccuggcca

SEQ ID NO: 596512 - RNA, 20 nt, Human
ucucuacuaaaaauacaaaa

SEQ ID NO: 596513 - RNA, 26 nt, Human
ugagaagucagauggaccggacgcag

SEQ ID NO: 596514 - RNA, 21 nt, Human
ugagccgagauugugcacugc

SEQ ID NO: 596515 - RNA, 20 nt, Human
ugaggcaggagaaucgcuug

SEQ ID NO: 596516 - RNA, 24 nt, Human
ugaggcaggagaaucgcuugaacc

SEQ ID NO: 596517 - RNA, 25 nt, Human
ugaggcaggagaaucgcuugaaccc

SEQ ID NO: 596518 - RNA, 20 nt, Human
ugaggugggaggauugcuug

SEQ ID NO: 596519 - RNA, 23 nt, Human
ugaggugggaggauugcuuggga

SEQ ID NO: 596520 - RNA, 26 nt, Human
ugaggugggaggauugcuugggaggc

SEQ ID NO: 596521 - RNA, 22 nt, Human
ugcacugcacuccagccugggu

SEQ ID NO: 596522 - RNA, 23 nt, Human
ugccuguaaucccaguucuccgg

SEQ ID NO: 596523 - RNA, 23 nt, Human
ugccuguaaucucagcacuuugg

SEQ ID NO: 596524 - RNA, 18 nt, Human
uggaacccugucucuacu

SEQ ID NO: 596525 - RNA, 24 nt, Human
uggccaauacgguggaacccuguc

SEQ ID NO: 596526 - RNA, 22 nt, Human
uggcucacgucugugaucccag

SEQ ID NO: 596527 - RNA, 24 nt, Human
uggcucacgucugugaucccagca

SEQ ID NO: 596528 - RNA, 22 nt, Human
uggcucaugccuguaaucucag

SEQ ID NO: 596529 - RNA, 24 nt, Human
uggcucaugccuguaaucucagca

SEQ ID NO: 596530 - RNA, 23 nt, Human
ugggaggcagagauugcaguggc

SEQ ID NO: 596531 - RNA, 24 nt, Human
ugggaggccaagaugggcggauca

SEQ ID NO: 596532 - RNA, 20 nt, Human
ugggaggccgaggugggcag

SEQ ID NO: 596533 - RNA, 24 nt, Human
ugggaggccgaggugggcagauca

SEQ ID NO: 596534 - RNA, 24 nt, Human
ugggcagaucaucugagcucagga

SEQ ID NO: 596535 - RNA, 21 nt, Human
uggugcaugccuguaauccca

SEQ ID NO: 596536 - RNA, 22 nt, Human
uggugcaugccuguaaucccag

SEQ ID NO: 596537 - RNA, 24 nt, Human
ugguggugcaugccuguaauccca

SEQ ID NO: 596538 - RNA, 22 nt, Human
uuagccgggcgugguggugcau

SEQ ID NO: 596539 - RNA, 24 nt, Human
uuagccgggcgugguggugcaugc

SEQ ID NO: 596540 - RNA, 18 nt, Human
uugcagugagccgagauu

SEQ ID NO: 596541 - RNA, 19 nt, Human
uugcagugagccgagauug

SEQ ID NO: 596542 - RNA, 22 nt, Human
uugcagugagccgagauugugc

SEQ ID NO: 596543 - RNA, 25 nt, Human
uugggaggccgaggugggcagauca

SEQ ID NO: 596544 - RNA, 21 nt, Human
uugugcacugcacuccagccu

SEQ ID NO: 596545 - RNA, 18 nt, Human
uuguggugagccgagauc

SEQ ID NO: 596546 - RNA, 19 nt, Human
uuguggugagccgagauca

SEQ ID NO: 596547 - RNA, 20 nt, Human
uuguggugagccgagaucac

SEQ ID NO: 596548 - RNA, 19 nt, Human
aaaaaccuugccacauuca

SEQ ID NO: 596549 - RNA, 19 nt, Human
aaaaaccuugccacauuca

SEQ ID NO: 596550 - RNA, 23 nt, Human
aaacagacugggaaaggugcuca

SEQ ID NO: 596551 - RNA, 24 nt, Human
aaagugcugggauuacagguguga

SEQ ID NO: 596552 - RNA, 19 nt, Human
aacaaaaaacagacuggga

SEQ ID NO: 596553 - RNA, 21 nt, Human
aaccaagcagggaaaauagaa

SEQ ID NO: 596554 - RNA, 21 nt, Human
aagucaacucaaacugaacuc

SEQ ID NO: 596555 - RNA, 30 nt, Human
aagucaacucaaacugaacucaaugcugag

SEQ ID NO: 596556 - RNA, 24 nt, Human
aagugaucuaccugucuuggccuc

SEQ ID NO: 596557 - RNA, 18 nt, Human
aagugcugggauuacagg

SEQ ID NO: 596558 - RNA, 19 nt, Human
aagugcugggauuacaggu

SEQ ID NO: 596559 - RNA, 26 nt, Human
aagugcugggauuacaggugugagcc

SEQ ID NO: 596560 - RNA, 23 nt, Human
aauuuugaacaaaggucuugcca

SEQ ID NO: 596561 - RNA, 21 nt, Human
acauucauuacacuuguaaca

SEQ ID NO: 596562 - RNA, 23 nt, Human
accugucuuggccucccaaagug

SEQ ID NO: 596563 - RNA, 18 nt, Human
acugaggacuuugugaca

SEQ ID NO: 596564 - RNA, 19 nt, Human
agaaauauggguuuuagga

SEQ ID NO: 596565 - RNA, 22 nt, Human
agaaggaaauuuaccucaccaa

SEQ ID NO: 596566 - RNA, 22 nt, Human
agcaaugaacuagcaaaagaaa

SEQ ID NO: 596567 - RNA, 19 nt, Human
agccaccgcaccuggccua

SEQ ID NO: 596568 - RNA, 19 nt, Human
agugccauuuacuucuggc

SEQ ID NO: 596569 - RNA, 20 nt, Human
auauaccacuugaacagaau

SEQ ID NO: 596570 - RNA, 18 nt, Human
auaugacuuuuguaagau

SEQ ID NO: 596571 - RNA, 24 nt, Human
caaagugcugggauuacaggugug

SEQ ID NO: 596572 - RNA, 26 nt, Human
caaccaaaauacuacugugacuaaua

SEQ ID NO: 596573 - RNA, 25 nt, Human
caacucaaacugaacucaaugcuga

SEQ ID NO: 596574 - RNA, 22 nt, Human
caagugaucuaccugucuuggc

SEQ ID NO: 596575 - RNA, 22 nt, Human
caauagaaagaccauugaugaa

SEQ ID NO: 596576 - RNA, 18 nt, Human
caaugguuguagcauuac

SEQ ID NO: 596577 - RNA, 24 nt, Human
cacaauacaauaucagcaccaaaa

SEQ ID NO: 596578 - RNA, 24 nt, Human
cacauucauuacacuuguaacauu

SEQ ID NO: 596579 - RNA, 23 nt, Human
caccaaaaauucguugaauuuuc

SEQ ID NO: 596580 - RNA, 18 nt, Human
cacccgaaugccuuguca

SEQ ID NO: 596581 - RNA, 18 nt, Human
caccuggccuaauccucu

SEQ ID NO: 596582 - RNA, 24 nt, Human
cagacuaaagaucuugccacacau

SEQ ID NO: 596583 - RNA, 21 nt, Human
cagagcaaugaacuagcaaaa

SEQ ID NO: 596584 - RNA, 24 nt, Human
cagugugaauucuaguauguugug

SEQ ID NO: 596585 - RNA, 25 nt, Human
caugaaccugaaauaaaggcuuuga

SEQ ID NO: 596586 - RNA, 21 nt, Human
ccaaagugcugggauuacagg

SEQ ID NO: 596587 - RNA, 21 nt, Human
ccaaagugcugggauuacagg

SEQ ID NO: 596588 - RNA, 24 nt, Human
ccaaagugcugggauuacaggugu

SEQ ID NO: 596589 - RNA, 24 nt, Human
ccacacauaugacuuuuguaagau

SEQ ID NO: 596590 - RNA, 25 nt, Human
ccgcaccuggccuaauccucuuaac

SEQ ID NO: 596591 - RNA, 21 nt, Human
ccugaucucaagugaucuacc

SEQ ID NO: 596592 - RNA, 23 nt, Human
ccugaucucaagugaucuaccug

SEQ ID NO: 596593 - RNA, 23 nt, Human
cucaaaaucagaaaaaguaaaau

SEQ ID NO: 596594 - RNA, 23 nt, Human
cucaagugaucuaccugucuugg

SEQ ID NO: 596595 - RNA, 20 nt, Human
cucuccagugugaauucuag

SEQ ID NO: 596596 - RNA, 18 nt, Human
cugaccacugaaggcucu

SEQ ID NO: 596597 - RNA, 22 nt, Human
cugggaaaggugcucaccucug

SEQ ID NO: 596598 - RNA, 23 nt, Human
cugggaaaggugcucaccucugu

SEQ ID NO: 596599 - RNA, 23 nt, Human
cugucuuggccucccaaagugcu

SEQ ID NO: 596600 - RNA, 20 nt, Human
cuugacugaagaccuugcca

SEQ ID NO: 596601 - RNA, 19 nt, Human
cuugcacgguuucucucca

SEQ ID NO: 596602 - RNA, 19 nt, Human
cuuguaacauuucucucca

SEQ ID NO: 596603 - RNA, 19 nt, Human
cuuguaagguuucucucca

SEQ ID NO: 596604 - RNA, 19 nt, Human
cuuguaagguuucucucca

SEQ ID NO: 596605 - RNA, 22 nt, Human
gaccucagacuaaagaucuugc

SEQ ID NO: 596606 - RNA, 20 nt, Human
gagaaggaaauuuaccucac

SEQ ID NO: 596607 - RNA, 18 nt, Human
gauuacaggugugagcca

SEQ ID NO: 596608 - RNA, 20 nt, Human
gauuacaggugugagccacc

SEQ ID NO: 596609 - RNA, 23 nt, Human
gauuacaggugugagccaccgca

SEQ ID NO: 596610 - RNA, 21 nt, Human
gcaaaagaaaugaaaugccuc

SEQ ID NO: 596611 - RNA, 20 nt, Human
gcaaugaacuagcaaaagaa

SEQ ID NO: 596612 - RNA, 20 nt, Human
ggaaaauagaauccuuuucc

SEQ ID NO: 596613 - RNA, 21 nt, Human
uaaacaaaauagauggagaag

SEQ ID NO: 596614 - RNA, 18 nt, Human
uaaaugauuacauaaccc

SEQ ID NO: 596615 - RNA, 18 nt, Human
uacacuuguaacauuucu

SEQ ID NO: 596616 - RNA, 22 nt, Human
uacaggugugagccaccgcacc

SEQ ID NO: 596617 - RNA, 22 nt, Human
uacaggugugagccaccgcacc

SEQ ID NO: 596618 - RNA, 23 nt, Human
uacaggugugagccaccgcaccu

SEQ ID NO: 596619 - RNA, 23 nt, Human
uaccucaaaaaugaauuuccuga

SEQ ID NO: 596620 - RNA, 23 nt, Human
uaccugucuuggccucccaaagu

SEQ ID NO: 596621 - RNA, 23 nt, Human
uagcaaaagaaaugaaaugccuc

SEQ ID NO: 596622 - RNA, 21 nt, Human
uagccagagcaaugaacuagc

SEQ ID NO: 596623 - RNA, 23 nt, Human
uagccagagcaaugaacuagcaa

SEQ ID NO: 596624 - RNA, 21 nt, Human
uaguaaaguuucccuaugaca

SEQ ID NO: 596625 - RNA, 18 nt, Human
ucaacacaauacccauaa

SEQ ID NO: 596626 - RNA, 25 nt, Human
ucaauuaaaaaccuugccacauuca

SEQ ID NO: 596627 - RNA, 21 nt, Human
ucagcaucugaucaucauaga

SEQ ID NO: 596628 - RNA, 23 nt, Human
ucccaaagugcugggauuacagg

SEQ ID NO: 596629 - RNA, 21 nt, Human
ucccuaugacauggauugcuu

SEQ ID NO: 596630 - RNA, 21 nt, Human
ucuaugguuucucuccaguau

SEQ ID NO: 596631 - RNA, 20 nt, Human
ucuuggccucccaaagugcu

SEQ ID NO: 596632 - RNA, 19 nt, Human
ugaagaaacaaaaaacaga

SEQ ID NO: 596633 - RNA, 21 nt, Human
ugaaugaccuuaugcauuaca

SEQ ID NO: 596634 - RNA, 19 nt, Human
ugaauuuugaacaaagguc

SEQ ID NO: 596635 - RNA, 24 nt, Human
ugacacaaucaucacccuugugag

SEQ ID NO: 596636 - RNA, 19 nt, Human
ugacaugaucuucugugua

SEQ ID NO: 596637 - RNA, 20 nt, Human
ugacauggauugcuugaugg

SEQ ID NO: 596638 - RNA, 21 nt, Human
ugacugaccacugaaggcucu

SEQ ID NO: 596639 - RNA, 18 nt, Human
ugagaaauucauacauug

SEQ ID NO: 596640 - RNA, 18 nt, Human
ugaggcaugaaccugaaa

SEQ ID NO: 596641 - RNA, 22 nt, Human
ugauauaccacuugaacagaau

SEQ ID NO: 596642 - RNA, 24 nt, Human
ugaucucaagugaucuaccugucu

SEQ ID NO: 596643 - RNA, 24 nt, Human
ugcugggauuacaggugugagcca

SEQ ID NO: 596644 - RNA, 18 nt, Human
uggaaaaauuaauacugu

SEQ ID NO: 596645 - RNA, 24 nt, Human
uggccaggcugcucucaaacuccu

SEQ ID NO: 596646 - RNA, 18 nt, Human
uggccucccaaagugcug

SEQ ID NO: 596647 - RNA, 18 nt, Human
ugggauuacaggugugag

SEQ ID NO: 596648 - RNA, 19 nt, Human
ugggauuacaggugugagc

SEQ ID NO: 596649 - RNA, 21 nt, Human
ugggauuacaggugugagcca

SEQ ID NO: 596650 - RNA, 22 nt, Human
ugggauuacaggugugagccac

SEQ ID NO: 596651 - RNA, 23 nt, Human
ugggauuacaggugugagccacc

SEQ ID NO: 596652 - RNA, 24 nt, Human
ugggauuacaggugugagccaccg

SEQ ID NO: 596653 - RNA, 18 nt, Human
uguaagguuuuucuccga

SEQ ID NO: 596654 - RNA, 19 nt, Human
ugucacacucaucacacuu

SEQ ID NO: 596655 - RNA, 22 nt, Human
ugucacauucuucacauuugua

SEQ ID NO: 596656 - RNA, 21 nt, Human
ugugagguuucuuucuuguau

SEQ ID NO: 596657 - RNA, 23 nt, Human
uguguaaugaggcaugaaccuga

SEQ ID NO: 596658 - RNA, 21 nt, Human
uguguagaaaaucacaaagag

SEQ ID NO: 596659 - RNA, 21 nt, Human
uuacugaggacuuugugacaa

SEQ ID NO: 596660 - RNA, 18 nt, Human
uucuccuaugucuuucaa

SEQ ID NO: 596661 - RNA, 19 nt, Human
uuucuuguaugaauucacc

SEQ ID NO: 596662 - RNA, 24 nt, Human
uuugcacaauacaauaucagcacc

SEQ ID NO: 596663 - RNA, 19 nt, Human
uuuguaagguuucucucca

SEQ ID NO: 596664 - RNA, 19 nt, Human
uuuguacgguuucucucca

SEQ ID NO: 596665 - RNA, 24 nt, Human
uuuguugaagaaacaaaaaacaga

SEQ ID NO: 596666 - RNA, 18 nt, Human
aggaagggcuguguacug

SEQ ID NO: 596667 - RNA, 19 nt, Human
auauauauauacauauaua

SEQ ID NO: 596668 - RNA, 19 nt, Human
auauauauauauauauaua

SEQ ID NO: 596669 - RNA, 19 nt, Human
auauauauauauauauaua

SEQ ID NO: 596670 - RNA, 19 nt, Human
auauauauauauauauaua

SEQ ID NO: 596671 - RNA, 19 nt, Human
auauauauauauccauaua

SEQ ID NO: 596672 - RNA, 19 nt, Human
auauauccauauauauaua

SEQ ID NO: 596673 - RNA, 19 nt, Human
auauauccauauauauaug

SEQ ID NO: 596674 - RNA, 25 nt, Human
auauauguauauauacauauaugug

SEQ ID NO: 596675 - RNA, 21 nt, Human
auauauguguauauauaucca

SEQ ID NO: 596676 - RNA, 21 nt, Human
auguauauauacauauaugug

SEQ ID NO: 596677 - RNA, 18 nt, Human
auguguguguauauauau

SEQ ID NO: 596678 - RNA, 20 nt, Human
cauauauauauauauauaua

SEQ ID NO: 596679 - RNA, 18 nt, Human
cauauauauguauauaua

SEQ ID NO: 596680 - RNA, 28 nt, Human
cauauauauguauauauacauauaugug

SEQ ID NO: 596681 - RNA, 19 nt, Human
cccacaugcuaggaagggc

SEQ ID NO: 596682 - RNA, 18 nt, Human
cugcccacaugcuaggaa

SEQ ID NO: 596683 - RNA, 18 nt, Human
gggacuggcuuuccaacu

SEQ ID NO: 596684 - RNA, 19 nt, Human
guguauauauauccauaua

SEQ ID NO: 596685 - RNA, 18 nt, Human
uaagggugccugaacugu

SEQ ID NO: 596686 - RNA, 24 nt, Human
uauacauauauguguguguauaua

SEQ ID NO: 596687 - RNA, 30 nt, Human
uauacauauauguguguguauauauauuac

SEQ ID NO: 596688 - RNA, 26 nt, Human
uauauaauacaugugccauauauaua

SEQ ID NO: 596689 - RNA, 25 nt, Human
uauauacaauuauauaaugcacgua

SEQ ID NO: 596690 - RNA, 20 nt, Human
uauauacauauauauguaua

SEQ ID NO: 596691 - RNA, 24 nt, Human
uauauacauauauauguauauaua

SEQ ID NO: 596692 - RNA, 24 nt, Human
uauauacauauauguguguguaua

SEQ ID NO: 596693 - RNA, 25 nt, Human
uauauacauauauguguguguauaa

SEQ ID NO: 596694 - RNA, 21 nt, Human
uauauauauacauauauaugu

SEQ ID NO: 596695 - RNA, 22 nt, Human
uauauauauacauauauaugua

SEQ ID NO: 596696 - RNA, 22 nt, Human
uauauauauacauauauaugua

SEQ ID NO: 596697 - RNA, 24 nt, Human
uauauauauacauauauauguaua

SEQ ID NO: 596698 - RNA, 20 nt, Human
uauauauauauacauauaua

SEQ ID NO: 596699 - RNA, 21 nt, Human
uauauauauauacauauauau

SEQ ID NO: 596700 - RNA, 22 nt, Human
uauauauauauacauauauaug

SEQ ID NO: 596701 - RNA, 19 nt, Human
uauauauauauauauauau

SEQ ID NO: 596702 - RNA, 19 nt, Human
uauauauauauauauauau

SEQ ID NO: 596703 - RNA, 22 nt, Human
uauauauauauauauauccaua

SEQ ID NO: 596704 - RNA, 30 nt, Human
uauauauauauauauauccauauauauaug

SEQ ID NO: 596705 - RNA, 24 nt, Human
uauauauauauauccauauauaua

SEQ ID NO: 596706 - RNA, 23 nt, Human
uauauauauccauauauauauau

SEQ ID NO: 596707 - RNA, 27 nt, Human
uauauauauccauauauauauauauau

SEQ ID NO: 596708 - RNA, 27 nt, Human
uauauauauccauauauauauauauua

SEQ ID NO: 596709 - RNA, 19 nt, Human
uauauauccauauauauau

SEQ ID NO: 596710 - RNA, 20 nt, Human
uauauauccauauauauaua

SEQ ID NO: 596711 - RNA, 18 nt, Human
uauauauguauauauaca

SEQ ID NO: 596712 - RNA, 19 nt, Human
uauauauguauauauacau

SEQ ID NO: 596713 - RNA, 18 nt, Human
uauauauguguauauaua

SEQ ID NO: 596714 - RNA, 20 nt, Human
uauauccauauauauauaua

SEQ ID NO: 596715 - RNA, 22 nt, Human
uauauccauauauauauauaua

SEQ ID NO: 596716 - RNA, 24 nt, Human
uauauccauauauauauauauaua

SEQ ID NO: 596717 - RNA, 23 nt, Human
uauguauauauacauauaugugu

SEQ ID NO: 596718 - RNA, 24 nt, Human
uauguguauauauauccauauaua

SEQ ID NO: 596719 - RNA, 24 nt, Human
uauguguauauauauccauauaua

SEQ ID NO: 596720 - RNA, 24 nt, Human
uauguguguguauauauaugugua

SEQ ID NO: 596721 - RNA, 25 nt, Human
uauguguguguauauauauguguca

SEQ ID NO: 596722 - RNA, 19 nt, Human
uccauauauauauauauau

SEQ ID NO: 596723 - RNA, 19 nt, Human
uccauauauauauauauau

SEQ ID NO: 596724 - RNA, 30 nt, Human
uccauauauauauauauauauauauccauu

SEQ ID NO: 596725 - RNA, 23 nt, Human
ugcagugcaugacuguauauaua

SEQ ID NO: 596726 - RNA, 25 nt, Human
uggagcaaaagugauugcgguuuuu

SEQ ID NO: 596727 - RNA, 19 nt, Human
uguauauauacauauaugu

SEQ ID NO: 596728 - RNA, 21 nt, Human
uguauauauacauauaugugu

SEQ ID NO: 596729 - RNA, 24 nt, Human
uguauauauacauauaugugugug

SEQ ID NO: 596730 - RNA, 23 nt, Human
uguauauauauccauauauauau

SEQ ID NO: 596731 - RNA, 25 nt, Human
uguauauauauccauauauauauau

SEQ ID NO: 596732 - RNA, 18 nt, Human
uguauauauauguguaua

SEQ ID NO: 596733 - RNA, 20 nt, Human
uguauauauauguguauaua

SEQ ID NO: 596734 - RNA, 22 nt, Human
uguauauauauguguauauaua

SEQ ID NO: 596735 - RNA, 25 nt, Human
ugugccauauauauaauacaugugg

SEQ ID NO: 596736 - RNA, 22 nt, Human
uguguauauauauccauauaua

SEQ ID NO: 596737 - RNA, 24 nt, Human
uguguauauauauccauauauaua

SEQ ID NO: 596738 - RNA, 26 nt, Human
uguguauauauauccauauauauaua

SEQ ID NO: 596739 - RNA, 19 nt, Human
uguguauauauauguguau

SEQ ID NO: 596740 - RNA, 22 nt, Human
uguguauauauauguguauaua

SEQ ID NO: 596741 - RNA, 23 nt, Human
uguguauauauauguguauauau

SEQ ID NO: 596742 - RNA, 19 nt, Human
uguguguauauauaugugu

SEQ ID NO: 596743 - RNA, 23 nt, Human
uguguguguauauauauguguau

SEQ ID NO: 596744 - RNA, 19 nt, Human
uuagaaauuuugguacaag

SEQ ID NO: 596745 - RNA, 19 nt, Human
uugguacaagcugaaaagg

SEQ ID NO: 596746 - RNA, 23 nt, Human
aaauauuuauaauaaccugaaua

SEQ ID NO: 596747 - RNA, 23 nt, Human
acaaaacagccuauaccuaaaau

SEQ ID NO: 596748 - RNA, 24 nt, Human
acaacaaaacagccuauaccuaaa

SEQ ID NO: 596749 - RNA, 20 nt, Human
agccauugugaugaaacuaa

SEQ ID NO: 596750 - RNA, 19 nt, Human
auaaugccaacaacaaaac

SEQ ID NO: 596751 - RNA, 24 nt, Human
auccuaugaucaaacuacauuacu

SEQ ID NO: 596752 - RNA, 22 nt, Human
caacaaaacagccuauaccuaa

SEQ ID NO: 596753 - RNA, 18 nt, Human
cacccuacaguagcucua

SEQ ID NO: 596754 - RNA, 21 nt, Human
gaaugcuuuuguuuuccuucu

SEQ ID NO: 596755 - RNA, 21 nt, Human
ggaaaaaaacugauuauugug

SEQ ID NO: 596756 - RNA, 20 nt, Human
ggaagacuuucuugucuaca

SEQ ID NO: 596757 - RNA, 24 nt, Human
uaaauauuuauaauaaccugaaua

SEQ ID NO: 596758 - RNA, 24 nt, Human
uaagaacugaggcaagucuaacca

SEQ ID NO: 596759 - RNA, 21 nt, Human
uacuuguucuucuacagccua

SEQ ID NO: 596760 - RNA, 21 nt, Human
uauguacaugcagccauugug

SEQ ID NO: 596761 - RNA, 21 nt, Human
ucaaggaagacuuucuugucu

SEQ ID NO: 596762 - RNA, 18 nt, Human
ucccaaaccucucacugc

SEQ ID NO: 596763 - RNA, 21 nt, Human
uccuacugaagaaaccacuuc

SEQ ID NO: 596764 - RNA, 23 nt, Human
ucggaaucaaguuuacucaacaa

SEQ ID NO: 596765 - RNA, 24 nt, Human
ucuacagccuacugucuuuagaca

SEQ ID NO: 596766 - RNA, 18 nt, Human
ucugaugaaaugaaacua

SEQ ID NO: 596767 - RNA, 24 nt, Human
ucuugucuacgguucacccuagcu

SEQ ID NO: 596768 - RNA, 24 nt, Human
ugaaaugaaacuaacuuacacaaa

SEQ ID NO: 596769 - RNA, 25 nt, Human
ugaagccccagaaaguccuacagag

SEQ ID NO: 596770 - RNA, 22 nt, Human
ugcgugccugcgcaucuaugug

SEQ ID NO: 596771 - RNA, 18 nt, Human
ugcuuuuguuuuccuucu

SEQ ID NO: 596772 - RNA, 24 nt, Human
ugguccucuggucacaggacccgu

SEQ ID NO: 596773 - RNA, 18 nt, Human
uuaaaaauuuuagugcag

SEQ ID NO: 596774 - RNA, 20 nt, Human
uuucccuuaaaaauuuuaga

SEQ ID NO: 596775 - RNA, 23 nt, Human
uuuuucacccuacaguagcucua

SEQ ID NO: 596776 - RNA, 23 nt, Human
aaaaaacaaaaucuccacuuaaa

SEQ ID NO: 596777 - RNA, 24 nt, Human
aaaaacccagaaaacauaaggcac

SEQ ID NO: 596778 - RNA, 21 nt, Human
aaaaccaaugagaaaaugucc

SEQ ID NO: 596779 - RNA, 19 nt, Human
aaacagaaaccgacucaag

SEQ ID NO: 596780 - RNA, 24 nt, Human
aaacagaaaccgacucaaggcccg

SEQ ID NO: 596781 - RNA, 21 nt, Human
aaacccagaaaacauaaggca

SEQ ID NO: 596782 - RNA, 22 nt, Human
aaacccauucucccagagccgg

SEQ ID NO: 596783 - RNA, 26 nt, Human
aaagcauauacauuugaaaaaaacaa

SEQ ID NO: 596784 - RNA, 25 nt, Human
aacagaaaccgacucaaggcccgag

SEQ ID NO: 596785 - RNA, 19 nt, Human
aagaacacuugguaaaacc

SEQ ID NO: 596786 - RNA, 27 nt, Human
aagcgcuucuguugagaaaggacaguu

SEQ ID NO: 596787 - RNA, 24 nt, Human
acagcacaaagcugcuccucaugc

SEQ ID NO: 596788 - RNA, 23 nt, Human
acaggauuuucacggcaaaacca

SEQ ID NO: 596789 - RNA, 22 nt, Human
acucacucagucccuggccccu

SEQ ID NO: 596790 - RNA, 22 nt, Human
acuuuuuacccaggggcugagc

SEQ ID NO: 596791 - RNA, 23 nt, Human
agagaaacagaaaccgacucaag

SEQ ID NO: 596792 - RNA, 19 nt, Human
agccagcuggcugagggcc

SEQ ID NO: 596793 - RNA, 21 nt, Human
agccagcuggcugagggcccg

SEQ ID NO: 596794 - RNA, 19 nt, Human
aggaagaaaaacccagaaa

SEQ ID NO: 596795 - RNA, 20 nt, Human
aggaagaaaaacccagaaaa

SEQ ID NO: 596796 - RNA, 20 nt, Human
aggauuuucacggcaaaacc

SEQ ID NO: 596797 - RNA, 20 nt, Human
aggcugcagucucugcgcgc

SEQ ID NO: 596798 - RNA, 22 nt, Human
aggcugcagucucugcgcgcug

SEQ ID NO: 596799 - RNA, 24 nt, Human
aggggaggcuggcuccccgaaaug

SEQ ID NO: 596800 - RNA, 23 nt, Human
caaaauuuccaaagcauauacau

SEQ ID NO: 596801 - RNA, 21 nt, Human
cacggcaaaaccaaugagaaa

SEQ ID NO: 596802 - RNA, 19 nt, Human
cacuugucccucugcugcc

SEQ ID NO: 596803 - RNA, 19 nt, Human
cagagccggucucucccac

SEQ ID NO: 596804 - RNA, 21 nt, Human
cagagccggucucucccacag

SEQ ID NO: 596805 - RNA, 21 nt, Human
caggagccugaagcccaaggg

SEQ ID NO: 596806 - RNA, 20 nt, Human
cagugagcacuuuuuacccu

SEQ ID NO: 596807 - RNA, 18 nt, Human
caguucagccaaacucaa

SEQ ID NO: 596808 - RNA, 21 nt, Human
cccaggggcugagcuuccugg

SEQ ID NO: 596809 - RNA, 20 nt, Human
cccuccagagaaacagaaac

SEQ ID NO: 596810 - RNA, 22 nt, Human
cccucugcucugucccuccaga

SEQ ID NO: 596811 - RNA, 23 nt, Human
ccguggcuguccacgaggucacu

SEQ ID NO: 596812 - RNA, 24 nt, Human
ccugccgugcugccagcucaggag

SEQ ID NO: 596813 - RNA, 18 nt, Human
ccugcgacauggauggag

SEQ ID NO: 596814 - RNA, 18 nt, Human
ccuggccccucugcucug

SEQ ID NO: 596815 - RNA, 20 nt, Human
cgagcagcucaggcgguggc

SEQ ID NO: 596816 - RNA, 18 nt, Human
cggaguguguccacagag

SEQ ID NO: 596817 - RNA, 20 nt, Human
cggcaaaaccaaugagaaaa

SEQ ID NO: 596818 - RNA, 20 nt, Human
cggcaggggacggggauggc

SEQ ID NO: 596819 - RNA, 22 nt, Human
cucccacagcacaaagcugcuc

SEQ ID NO: 596820 - RNA, 24 nt, Human
cugcucugucccuccagagaaaca

SEQ ID NO: 596821 - RNA, 20 nt, Human
cuggccccucugcucugucc

SEQ ID NO: 596822 - RNA, 21 nt, Human
cuggccccucugcucuguccc

SEQ ID NO: 596823 - RNA, 25 nt, Human
cuggccccucugcucugucccucca

SEQ ID NO: 596824 - RNA, 21 nt, Human
cugguuuuuagaaacagaacu

SEQ ID NO: 596825 - RNA, 18 nt, Human
cuuccugggcuccugcga

SEQ ID NO: 596826 - RNA, 23 nt, Human
cuuuguucaucuucuccuguuca

SEQ ID NO: 596827 - RNA, 20 nt, Human
gagaaacagaaaccgacuca

SEQ ID NO: 596828 - RNA, 20 nt, Human
gagaacauuuucuugaaagc

SEQ ID NO: 596829 - RNA, 20 nt, Human
gagcaaauguaaggcugcgu

SEQ ID NO: 596830 - RNA, 19 nt, Human
gaggagcggggcuggggag

SEQ ID NO: 596831 - RNA, 19 nt, Human
gagggcccggagugugucc

SEQ ID NO: 596832 - RNA, 27 nt, Human
gaggggaggcuggcuccccgaaaugug

SEQ ID NO: 596833 - RNA, 18 nt, Human
gaucaccuucacaucacc

SEQ ID NO: 596834 - RNA, 24 nt, Human
gauuuucacggcaaaaccaaugag

SEQ ID NO: 596835 - RNA, 23 nt, Human
gcaaaaccaaugagaaaaugucc

SEQ ID NO: 596836 - RNA, 19 nt, Human
ggaaccggagcggcagggg

SEQ ID NO: 596837 - RNA, 19 nt, Human
ggagcggggcuggggaggg

SEQ ID NO: 596838 - RNA, 20 nt, Human
ggagcucucccugccgugcu

SEQ ID NO: 596839 - RNA, 20 nt, Human
gggaagaggggaggcuggcu

SEQ ID NO: 596840 - RNA, 21 nt, Human
gggaagaggggaggcuggcuc

SEQ ID NO: 596841 - RNA, 21 nt, Human
gggcuggggaggggaagaggg

SEQ ID NO: 596842 - RNA, 21 nt, Human
gugcuucaaagaacacuuggu

SEQ ID NO: 596843 - RNA, 19 nt, Human
uaaaaaaucaaaauuucca

SEQ ID NO: 596844 - RNA, 22 nt, Human
uaaaaaaucaaaauuuccaaag

SEQ ID NO: 596845 - RNA, 25 nt, Human
uaaaacccucuggcuaaaaaaucaa

SEQ ID NO: 596846 - RNA, 20 nt, Human
ucaaaauuuccaaagcauau

SEQ ID NO: 596847 - RNA, 19 nt, Human
ucaccuucacaucacccuc

SEQ ID NO: 596848 - RNA, 20 nt, Human
ucacucagucccuggccccu

SEQ ID NO: 596849 - RNA, 20 nt, Human
ucacugagcggugacuucug

SEQ ID NO: 596850 - RNA, 21 nt, Human
ucacugagcggugacuucuga

SEQ ID NO: 596851 - RNA, 21 nt, Human
ucucccacagcacaaagcugc

SEQ ID NO: 596852 - RNA, 21 nt, Human
ucucccagagccggucucucc

SEQ ID NO: 596853 - RNA, 25 nt, Human
ucucccagagccggucucucccaau

SEQ ID NO: 596854 - RNA, 18 nt, Human
ugaaaaaaacaaaaucuc

SEQ ID NO: 596855 - RNA, 18 nt, Human
ugaaacccauucucccag

SEQ ID NO: 596856 - RNA, 20 nt, Human
ugagaagaauugagacccga

SEQ ID NO: 596857 - RNA, 22 nt, Human
ugagaagaauugagacccgagc

SEQ ID NO: 596858 - RNA, 18 nt, Human
ugaucugagcugcaguga

SEQ ID NO: 596859 - RNA, 19 nt, Human
ugccagggccuuuugagag

SEQ ID NO: 596860 - RNA, 23 nt, Human
uggccccucugcucugucccucc

SEQ ID NO: 596861 - RNA, 20 nt, Human
uggggaggggaagaggggag

SEQ ID NO: 596862 - RNA, 21 nt, Human
uggggaggggaagaggggagg

SEQ ID NO: 596863 - RNA, 23 nt, Human
uggggaggggaagaggggaggcu

SEQ ID NO: 596864 - RNA, 19 nt, Human
uguccacagagggaggagc

SEQ ID NO: 596865 - RNA, 21 nt, Human
ugugaccugaggacugaucug

SEQ ID NO: 596866 - RNA, 22 nt, Human
uucaaagaacacuugguaaaac

SEQ ID NO: 596867 - RNA, 24 nt, Human
uuguugcccgggaucaauugcaaa

SEQ ID NO: 596868 - RNA, 22 nt, Human
uuugaaaaaaacaaaaucucca

SEQ ID NO: 596869 - RNA, 20 nt, Human
acagacagugaaucuugaac

SEQ ID NO: 596870 - RNA, 19 nt, Human
agcuguggauauucuugga

SEQ ID NO: 596871 - RNA, 21 nt, Human
augggucucugauggagauuu

SEQ ID NO: 596872 - RNA, 26 nt, Human
cacaccagaaagcauuacagggacac

SEQ ID NO: 596873 - RNA, 24 nt, Human
caccugaaucugaaaccagugauu

SEQ ID NO: 596874 - RNA, 19 nt, Human
cagcaacugaaacuucauu

SEQ ID NO: 596875 - RNA, 20 nt, Human
caggccuucugugaucuggg

SEQ ID NO: 596876 - RNA, 21 nt, Human
ccagaaagcauuacagggaca

SEQ ID NO: 596877 - RNA, 24 nt, Human
ccucaucacagagcuccuuucuua

SEQ ID NO: 596878 - RNA, 21 nt, Human
ccugaaucugaaaccagugau

SEQ ID NO: 596879 - RNA, 24 nt, Human
cuaaaaaugcugauucaucuugag

SEQ ID NO: 596880 - RNA, 22 nt, Human
cuccuuucuuacccucagcaac

SEQ ID NO: 596881 - RNA, 22 nt, Human
cugaaaccagugauuuucuugu

SEQ ID NO: 596882 - RNA, 18 nt, Human
cugaaucugaaaccagug

SEQ ID NO: 596883 - RNA, 26 nt, Human
gaacaggagguaaaaugaagggaccc

SEQ ID NO: 596884 - RNA, 24 nt, Human
gacacauucacugccuggucaggc

SEQ ID NO: 596885 - RNA, 20 nt, Human
ggcuagaucguuucuucucu

SEQ ID NO: 596886 - RNA, 22 nt, Human
gucaguauuauuuucaaaaggc

SEQ ID NO: 596887 - RNA, 19 nt, Human
uaaaaugaauggugauauc

SEQ ID NO: 596888 - RNA, 22 nt, Human
uaagcuggaaccucaucacaga

SEQ ID NO: 596889 - RNA, 21 nt, Human
uaucaugggucucugauggag

SEQ ID NO: 596890 - RNA, 24 nt, Human
ucaguauuauuuucaaaaggcuuc

SEQ ID NO: 596891 - RNA, 19 nt, Human
uccacuguauuuccagcug

SEQ ID NO: 596892 - RNA, 21 nt, Human
uccacuguauuuccagcuguu

SEQ ID NO: 596893 - RNA, 22 nt, Human
uccagcuguuuuucaauaagca

SEQ ID NO: 596894 - RNA, 23 nt, Human
ucucuaaaaaugcugauucaucu

SEQ ID NO: 596895 - RNA, 26 nt, Human
ucugaaaccagugauuuucuuguuuc

SEQ ID NO: 596896 - RNA, 22 nt, Human
ugaaagaucugaaauagcaggg

SEQ ID NO: 596897 - RNA, 20 nt, Human
ugagccaauguuccaacaga

SEQ ID NO: 596898 - RNA, 18 nt, Human
uggaaccucaucacagag

SEQ ID NO: 596899 - RNA, 20 nt, Human
ugguaaagacacauucacug

SEQ ID NO: 596900 - RNA, 28 nt, Human
uguuucguuuuuuugagccaauguucca

SEQ ID NO: 596901 - RNA, 20 nt, Human
uucagcaacugaaacuucau

SEQ ID NO: 596902 - RNA, 24 nt, Human
uuccugcauuucugaauuugucau

SEQ ID NO: 596903 - RNA, 19 nt, Human
uucuucucugagcugugga

SEQ ID NO: 596904 - RNA, 20 nt, Human
uucuucucugagcuguggau

SEQ ID NO: 596905 - RNA, 22 nt, Human
uugaacucucuaaaaaugcuga

SEQ ID NO: 596906 - RNA, 18 nt, Human
uugcauuguugucucagu

SEQ ID NO: 596907 - RNA, 18 nt, Human
uugcauuguugucucagu

SEQ ID NO: 596908 - RNA, 23 nt, Human
uuuacaucacaccagaaagcauu

SEQ ID NO: 596909 - RNA, 24 nt, Human
uuucuuguuucuuucuccaauggu

SEQ ID NO: 596910 - RNA, 21 nt, Human
uuugucauguugcuuaucuug

SEQ ID NO: 596911 - RNA, 24 nt, Human
aggaggagaaaaguucacuuggaa

SEQ ID NO: 596912 - RNA, 26 nt, Human
aggugugugaggcaguuaacaaagga

SEQ ID NO: 596913 - RNA, 20 nt, Human
augcuggagauccccacagc

SEQ ID NO: 596914 - RNA, 21 nt, Human
cugauaaugcuggagaucccc

SEQ ID NO: 596915 - RNA, 25 nt, Human
guuaacaaaggaggagaaaaguuca

SEQ ID NO: 596916 - RNA, 25 nt, Human
aaaaaaacagcugaucuggacaaaa

SEQ ID NO: 596917 - RNA, 22 nt, Human
aaaaaacagcugaucuggacaa

SEQ ID NO: 596918 - RNA, 21 nt, Human
aaaaauccaaaguuuucuaga

SEQ ID NO: 596919 - RNA, 22 nt, Human
aaacacagcucuucaguucagg

SEQ ID NO: 596920 - RNA, 22 nt, Human
aaacagcugaucuggacaaaag

SEQ ID NO: 596921 - RNA, 25 nt, Human
aaacagcugaucuggacaaaaggca

SEQ ID NO: 596922 - RNA, 19 nt, Human
aaccaggacaccagggucc

SEQ ID NO: 596923 - RNA, 21 nt, Human
aacucccuuccccuugaaauc

SEQ ID NO: 596924 - RNA, 22 nt, Human
aaggacaggucgagucauucug

SEQ ID NO: 596925 - RNA, 19 nt, Human
acaaaaccgccuugccagc

SEQ ID NO: 596926 - RNA, 21 nt, Human
acacugccgucuuccagcccu

SEQ ID NO: 596927 - RNA, 24 nt, Human
acagaagcacucccagcccauuuc

SEQ ID NO: 596928 - RNA, 19 nt, Human
accacggccuccacacacc

SEQ ID NO: 596929 - RNA, 18 nt, Human
acccucaucucccggacc

SEQ ID NO: 596930 - RNA, 23 nt, Human
agacaacucccuuccccuugaaa

SEQ ID NO: 596931 - RNA, 25 nt, Human
agagagcaguuacucaaaaaaaaga

SEQ ID NO: 596932 - RNA, 19 nt, Human
agaggugcaggucaagggg

SEQ ID NO: 596933 - RNA, 23 nt, Human
agauuuuaaaaaaacagcugauc

SEQ ID NO: 596934 - RNA, 23 nt, Human
agcagaagcuacgugaggaaugu

SEQ ID NO: 596935 - RNA, 21 nt, Human
aggaaguggccgugccacuga

SEQ ID NO: 596936 - RNA, 20 nt, Human
aggcucuaacccagcuacag

SEQ ID NO: 596937 - RNA, 20 nt, Human
aggcugggccaggcggcugc

SEQ ID NO: 596938 - RNA, 18 nt, Human
aguauguacaucagcacu

SEQ ID NO: 596939 - RNA, 21 nt, Human
aguuacucaaaaaaaagacac

SEQ ID NO: 596940 - RNA, 20 nt, Human
auccaacccucuccagaaac

SEQ ID NO: 596941 - RNA, 18 nt, Human
caaaaggcagacccaggc

SEQ ID NO: 596942 - RNA, 22 nt, Human
caccugugcccguggaagacgc

SEQ ID NO: 596943 - RNA, 23 nt, Human
caccugugcccguggaagacgcg

SEQ ID NO: 596944 - RNA, 25 nt, Human
cacgggcagaggagaacgucuugug

SEQ ID NO: 596945 - RNA, 19 nt, Human
cacugccgucuuccagccc

SEQ ID NO: 596946 - RNA, 19 nt, Human
cagaaaaacacugaugccu

SEQ ID NO: 596947 - RNA, 23 nt, Human
cagaaacugagcagaacaaaacc

SEQ ID NO: 596948 - RNA, 23 nt, Human
cagaacaaaaccgccuugccagc

SEQ ID NO: 596949 - RNA, 27 nt, Human
cagaaugguccccuaauggucccugaa

SEQ ID NO: 596950 - RNA, 20 nt, Human
cagcaggacagaagcacucc

SEQ ID NO: 596951 - RNA, 24 nt, Human
cauccaacccucuccagaaacuga

SEQ ID NO: 596952 - RNA, 27 nt, Human
cauucccaucucacgcugcuuuagagg

SEQ ID NO: 596953 - RNA, 21 nt, Human
ccacagcugcuggugcugggc

SEQ ID NO: 596954 - RNA, 24 nt, Human
ccacuggcaagaccaugcuuucaa

SEQ ID NO: 596955 - RNA, 23 nt, Human
ccagaaucacacucaggguuuuu

SEQ ID NO: 596956 - RNA, 18 nt, Human
ccagagacacggaacacg

SEQ ID NO: 596957 - RNA, 21 nt, Human
ccccggaaacccucaucuccc

SEQ ID NO: 596958 - RNA, 23 nt, Human
cccggaaacccucaucucccgga

SEQ ID NO: 596959 - RNA, 21 nt, Human
ccuaacgcugggcgcuggucc

SEQ ID NO: 596960 - RNA, 22 nt, Human
cggaaggauucgggccuggaua

SEQ ID NO: 596961 - RNA, 19 nt, Human
cuccacagcugcuggugcu

SEQ ID NO: 596962 - RNA, 18 nt, Human
cuccagggacccaccgcg

SEQ ID NO: 596963 - RNA, 24 nt, Human
cucuccagaaacugagcagaacaa

SEQ ID NO: 596964 - RNA, 21 nt, Human
cucucuggucaggacuccugg

SEQ ID NO: 596965 - RNA, 19 nt, Human
cugggcuuccccugugccc

SEQ ID NO: 596966 - RNA, 19 nt, Human
cugugcccagggucauggg

SEQ ID NO: 596967 - RNA, 22 nt, Human
cuucaagccaggccggcugccc

SEQ ID NO: 596968 - RNA, 22 nt, Human
cuuccagcccuaacgcugggcg

SEQ ID NO: 596969 - RNA, 24 nt, Human
gaccacggccuccacacaccuggu

SEQ ID NO: 596970 - RNA, 21 nt, Human
gaucacuagccccggaaaccc

SEQ ID NO: 596971 - RNA, 21 nt, Human
gcagacccaggcucuaaccca

SEQ ID NO: 596972 - RNA, 24 nt, Human
gcagcggaaggauucgggccugga

SEQ ID NO: 596973 - RNA, 18 nt, Human
gcccagaaucacacucag

SEQ ID NO: 596974 - RNA, 19 nt, Human
gccccggaaacccucaucu

SEQ ID NO: 596975 - RNA, 18 nt, Human
gcgcuggucccucucucc

SEQ ID NO: 596976 - RNA, 25 nt, Human
gcuuggagggcagcggaaggauucg

SEQ ID NO: 596977 - RNA, 21 nt, Human
ggaaaagcauggcagcucaag

SEQ ID NO: 596978 - RNA, 20 nt, Human
ggagacucacgggagaggca

SEQ ID NO: 596979 - RNA, 19 nt, Human
ggaucugaaaagcguaaua

SEQ ID NO: 596980 - RNA, 21 nt, Human
ggcauggaaauugcggcagcu

SEQ ID NO: 596981 - RNA, 20 nt, Human
guccguggcgaugccagccc

SEQ ID NO: 596982 - RNA, 22 nt, Human
uaaaaaaacagcugaucuggac

SEQ ID NO: 596983 - RNA, 21 nt, Human
uaaauguaaacauugaauggc

SEQ ID NO: 596984 - RNA, 24 nt, Human
uagccccggaaacccucaucuccc

SEQ ID NO: 596985 - RNA, 24 nt, Human
ucacagacacacgcagauuggucu

SEQ ID NO: 596986 - RNA, 18 nt, Human
ucacgaucacuagccccg

SEQ ID NO: 596987 - RNA, 20 nt, Human
ucagugcuggccucaagcgg

SEQ ID NO: 596988 - RNA, 18 nt, Human
ucaguucaggaccacagu

SEQ ID NO: 596989 - RNA, 19 nt, Human
ucccucucuccuaagccca

SEQ ID NO: 596990 - RNA, 25 nt, Human
ucccugcagaaauuuuaggggaaga

SEQ ID NO: 596991 - RNA, 20 nt, Human
ucgggccuggauaggggcuu

SEQ ID NO: 596992 - RNA, 23 nt, Human
ucucuggucaggacuccugggac

SEQ ID NO: 596993 - RNA, 18 nt, Human
ugaaguacagggcaccaa

SEQ ID NO: 596994 - RNA, 24 nt, Human
ugaauccagagacacggaacacgg

SEQ ID NO: 596995 - RNA, 20 nt, Human
ugauuugcggaaaaauaucc

SEQ ID NO: 596996 - RNA, 21 nt, Human
ugauuugcggaaaaauauccu

SEQ ID NO: 596997 - RNA, 18 nt, Human
ugccagcccccuucccgc

SEQ ID NO: 596998 - RNA, 20 nt, Human
ugcccagacgagggugagca

SEQ ID NO: 596999 - RNA, 18 nt, Human
ugcccagggucauggcgg

SEQ ID NO: 597000 - RNA, 18 nt, Human
ugcccguggaagacgcgg

SEQ ID NO: 597001 - RNA, 20 nt, Human
ugccuuccuuaucgaucucc

SEQ ID NO: 597002 - RNA, 19 nt, Human
ugcggcagcuggaggccgc

SEQ ID NO: 597003 - RNA, 20 nt, Human
ugcuggugcugggcaggcug

SEQ ID NO: 597004 - RNA, 20 nt, Human
ugggagcagaagcuacguga

SEQ ID NO: 597005 - RNA, 20 nt, Human
ugucaggaaaugagcacuuc

SEQ ID NO: 597006 - RNA, 25 nt, Human
uuagaggucaguucacaccuucugu

SEQ ID NO: 597007 - RNA, 24 nt, Human
uucggucagaaaaacacugaugcc

SEQ ID NO: 597008 - RNA, 22 nt, Human
uucuagaucauucccaucucac

SEQ ID NO: 597009 - RNA, 22 nt, Human
uugcaaauaaaagggaucacga

SEQ ID NO: 597010 - RNA, 27 nt, Human
uuuucuacaagucuuguuuauugaaag

SEQ ID NO: 597011 - RNA, 25 nt, Human
uuuuuuuuuuuuuauuuucuacaag

SEQ ID NO: 597012 - RNA, 19 nt, Human
aaauguccuucuagccauc

SEQ ID NO: 597013 - RNA, 21 nt, Human
aacaaugaccucaucucccuc

SEQ ID NO: 597014 - RNA, 24 nt, Human
aaccacgacacucacucgcgucga

SEQ ID NO: 597015 - RNA, 27 nt, Human
aagaacaggggcagguuccaagaaaaa

SEQ ID NO: 597016 - RNA, 21 nt, Human
aagaagaaaaacccuucccac

SEQ ID NO: 597017 - RNA, 21 nt, Human
aagcccuacuuaaguagggga

SEQ ID NO: 597018 - RNA, 23 nt, Human
acagccgcuccuggcagccagca

SEQ ID NO: 597019 - RNA, 19 nt, Human
acaggcaaggggagacaca

SEQ ID NO: 597020 - RNA, 19 nt, Human
acccugaaccccaaaaccu

SEQ ID NO: 597021 - RNA, 22 nt, Human
acgccugaagacucacagccgc

SEQ ID NO: 597022 - RNA, 21 nt, Human
acggggcgacgaacacauggc

SEQ ID NO: 597023 - RNA, 22 nt, Human
acucuggguccagcaccccaac

SEQ ID NO: 597024 - RNA, 18 nt, Human
agaaaaagaagaaaaacc

SEQ ID NO: 597025 - RNA, 18 nt, Human
agauguggaaacugaggc

SEQ ID NO: 597026 - RNA, 21 nt, Human
agcacccugaaccccaaaacc

SEQ ID NO: 597027 - RNA, 18 nt, Human
agccaggcuggcagacgc

SEQ ID NO: 597028 - RNA, 21 nt, Human
aggaaaagggguaccccaagg

SEQ ID NO: 597029 - RNA, 22 nt, Human
aggagagagugggugagagggg

SEQ ID NO: 597030 - RNA, 22 nt, Human
aggcugaggcauggggggcagu

SEQ ID NO: 597031 - RNA, 18 nt, Human
agggauggucacccccau

SEQ ID NO: 597032 - RNA, 21 nt, Human
agggcugaaguugucccggug

SEQ ID NO: 597033 - RNA, 24 nt, Human
aguggggacugggcagauucuggg

SEQ ID NO: 597034 - RNA, 27 nt, Human
auaaauaacagaaggguuugggaugac

SEQ ID NO: 597035 - RNA, 21 nt, Human
auagaguccacucagggugua

SEQ ID NO: 597036 - RNA, 21 nt, Human
caauggccaauggggucaagc

SEQ ID NO: 597037 - RNA, 21 nt, Human
cacagcacccugaaccccaaa

SEQ ID NO: 597038 - RNA, 22 nt, Human
cacagcccuaauaaauaacaga

SEQ ID NO: 597039 - RNA, 21 nt, Human
caccccaaccacgacacucac

SEQ ID NO: 597040 - RNA, 22 nt, Human
cacgcacacacacgcguggcag

SEQ ID NO: 597041 - RNA, 21 nt, Human
cagaugucuccuaaauguccu

SEQ ID NO: 597042 - RNA, 21 nt, Human
cagcaccccaaccacgacacu

SEQ ID NO: 597043 - RNA, 21 nt, Human
cagcagcagcuuccggccacg

SEQ ID NO: 597044 - RNA, 26 nt, Human
cagcaggggcgugggcagcagcagcu

SEQ ID NO: 597045 - RNA, 27 nt, Human
cagccgcuccuggcagccagcagggcu

SEQ ID NO: 597046 - RNA, 18 nt, Human
cagcuuccggccacgucc

SEQ ID NO: 597047 - RNA, 20 nt, Human
caugcccacccacucuagaa

SEQ ID NO: 597048 - RNA, 24 nt, Human
ccaaccacgacacucacucgcguc

SEQ ID NO: 597049 - RNA, 18 nt, Human
ccaagaaaaagaagaaaa

SEQ ID NO: 597050 - RNA, 23 nt, Human
ccaccacccccgccuggcccccc

SEQ ID NO: 597051 - RNA, 21 nt, Human
ccaugggggagccugcccccc

SEQ ID NO: 597052 - RNA, 18 nt, Human
ccccaaaaccucugaagu

SEQ ID NO: 597053 - RNA, 20 nt, Human
ccccaggcugcauccacgcc

SEQ ID NO: 597054 - RNA, 24 nt, Human
ccccauugacuggaaucaugccca

SEQ ID NO: 597055 - RNA, 18 nt, Human
ccccccacccuacagcug

SEQ ID NO: 597056 - RNA, 22 nt, Human
cccccgccuggccccccagguc

SEQ ID NO: 597057 - RNA, 21 nt, Human
ccccucugcuccacccaugcc

SEQ ID NO: 597058 - RNA, 23 nt, Human
cccucugcuccacccaugccccc

SEQ ID NO: 597059 - RNA, 19 nt, Human
cccugaaccccaaaaccuc

SEQ ID NO: 597060 - RNA, 21 nt, Human
cccugaaccccaaaaccucug

SEQ ID NO: 597061 - RNA, 22 nt, Human
ccgccgccugagcccccgcucc

SEQ ID NO: 597062 - RNA, 20 nt, Human
ccgccugagcccccgcuccg

SEQ ID NO: 597063 - RNA, 18 nt, Human
ccgcuccgccuagacugc

SEQ ID NO: 597064 - RNA, 26 nt, Human
ccucuugcaggaggauuccaagaagu

SEQ ID NO: 597065 - RNA, 23 nt, Human
ccuggccccccagguccagggga

SEQ ID NO: 597066 - RNA, 20 nt, Human
ccuuuugguuaaaauucuga

SEQ ID NO: 597067 - RNA, 18 nt, Human
cgccgccgccugagcccc

SEQ ID NO: 597068 - RNA, 21 nt, Human
cgcgucgaggccgccgccgcc

SEQ ID NO: 597069 - RNA, 28 nt, Human
cgcguggcagggaagaaguggggacugg

SEQ ID NO: 597070 - RNA, 18 nt, Human
cgcuggcagggguagggg

SEQ ID NO: 597071 - RNA, 23 nt, Human
cgggauggacagacggacugcca

SEQ ID NO: 597072 - RNA, 23 nt, Human
cgugggcagcagcagcuuccggc

SEQ ID NO: 597073 - RNA, 22 nt, Human
cucacagccgcuccuggcagcc

SEQ ID NO: 597074 - RNA, 19 nt, Human
cuccacccaugccccccau

SEQ ID NO: 597075 - RNA, 21 nt, Human
cuccacccaugccccccauga

SEQ ID NO: 597076 - RNA, 22 nt, Human
cucugcuccacccaugcccccc

SEQ ID NO: 597077 - RNA, 19 nt, Human
cugaaccccaaaaccucug

SEQ ID NO: 597078 - RNA, 19 nt, Human
cuggccccccagguccagg

SEQ ID NO: 597079 - RNA, 23 nt, Human
cugggggugggcgcuggcagggg

SEQ ID NO: 597080 - RNA, 20 nt, Human
cuucccacagcccuaauaaa

SEQ ID NO: 597081 - RNA, 21 nt, Human
gaaaaacccuucccacagccc

SEQ ID NO: 597082 - RNA, 20 nt, Human
gaaggccaggccugugaaag

SEQ ID NO: 597083 - RNA, 20 nt, Human
gacacagcacccugaacccc

SEQ ID NO: 597084 - RNA, 25 nt, Human
gaccucaucucccuccucuccuuug

SEQ ID NO: 597085 - RNA, 23 nt, Human
gaccugggcacaggcaaggggag

SEQ ID NO: 597086 - RNA, 24 nt, Human
gacugggcagauucugggugggug

SEQ ID NO: 597087 - RNA, 25 nt, Human
gaggcugaggcauggggggcagugu

SEQ ID NO: 597088 - RNA, 18 nt, Human
gaguugcccucuugcagg

SEQ ID NO: 597089 - RNA, 18 nt, Human
gcacacagggaggggcug

SEQ ID NO: 597090 - RNA, 21 nt, Human
gcacacgcacacacacgcgug

SEQ ID NO: 597091 - RNA, 21 nt, Human
gcagcagcagcuuccggccac

SEQ ID NO: 597092 - RNA, 23 nt, Human
gcagguuccaagaaaaagaagaa

SEQ ID NO: 597093 - RNA, 22 nt, Human
gccccccacccuacagcugggc

SEQ ID NO: 597094 - RNA, 19 nt, Human
gcgaggggcccuggcuggg

SEQ ID NO: 597095 - RNA, 20 nt, Human
gcgcaccuuccauuugugcc

SEQ ID NO: 597096 - RNA, 19 nt, Human
gcgcggcgggauggacaga

SEQ ID NO: 597097 - RNA, 21 nt, Human
gcgcuggcagggguaggggca

SEQ ID NO: 597098 - RNA, 23 nt, Human
ggacagacggacugccagccagg

SEQ ID NO: 597099 - RNA, 21 nt, Human
ggacugccagccaggcuggca

SEQ ID NO: 597100 - RNA, 23 nt, Human
ggagacacagcacccugaacccc

SEQ ID NO: 597101 - RNA, 23 nt, Human
ggcagccagcagggcagggaugg

SEQ ID NO: 597102 - RNA, 19 nt, Human
ggcaggcgaggguaggcac

SEQ ID NO: 597103 - RNA, 18 nt, Human
ggcagggguaggggcagg

SEQ ID NO: 597104 - RNA, 21 nt, Human
ggcccuggcugggggugggcg

SEQ ID NO: 597105 - RNA, 18 nt, Human
gggagccugccccccacc

SEQ ID NO: 597106 - RNA, 19 nt, Human
gggcagugugaagaacagg

SEQ ID NO: 597107 - RNA, 21 nt, Human
ggggaggaaggcgaggggccc

SEQ ID NO: 597108 - RNA, 18 nt, Human
ggggugggcgcuggcagg

SEQ ID NO: 597109 - RNA, 19 nt, Human
gggugagagguggagaggc

SEQ ID NO: 597110 - RNA, 20 nt, Human
gggugggcgcuggcaggggu

SEQ ID NO: 597111 - RNA, 20 nt, Human
gguaggggcaggggcaaggg

SEQ ID NO: 597112 - RNA, 20 nt, Human
gucugggucuggcuggcuug

SEQ ID NO: 597113 - RNA, 21 nt, Human
guggcacacgcacacacacgc

SEQ ID NO: 597114 - RNA, 22 nt, Human
uaaaagggcaauaguaggggca

SEQ ID NO: 597115 - RNA, 18 nt, Human
uaccccaaggacccugcc

SEQ ID NO: 597116 - RNA, 19 nt, Human
uccaagaaaaagaagaaaa

SEQ ID NO: 597117 - RNA, 21 nt, Human
uccaagaaaaagaagaaaaac

SEQ ID NO: 597118 - RNA, 23 nt, Human
uccaagaagugaggggaaggcuc

SEQ ID NO: 597119 - RNA, 21 nt, Human
uccaccacccccgccuggccc

SEQ ID NO: 597120 - RNA, 23 nt, Human
ucgcgucgaggccgccgccgccu

SEQ ID NO: 597121 - RNA, 19 nt, Human
ucuacccacugccuuugcc

SEQ ID NO: 597122 - RNA, 24 nt, Human
ucuccuaaauguccuucuagccau

SEQ ID NO: 597123 - RNA, 19 nt, Human
ucuggcuggcuuggggggc

SEQ ID NO: 597124 - RNA, 19 nt, Human
ugaaccccaaaaccucuga

SEQ ID NO: 597125 - RNA, 19 nt, Human
ugacaaacaaugaccucau

SEQ ID NO: 597126 - RNA, 20 nt, Human
ugagagaagacucaaugaca

SEQ ID NO: 597127 - RNA, 19 nt, Human
ugagcccccgcuccgccua

SEQ ID NO: 597128 - RNA, 20 nt, Human
ugaggagggggcaggaaagg

SEQ ID NO: 597129 - RNA, 24 nt, Human
ugcccggggugagggagccccucu

SEQ ID NO: 597130 - RNA, 18 nt, Human
ugcuccacccaugccccc

SEQ ID NO: 597131 - RNA, 21 nt, Human
uggaaacugaggcccaggcag

SEQ ID NO: 597132 - RNA, 22 nt, Human
uggacagacggacugccagcca

SEQ ID NO: 597133 - RNA, 19 nt, Human
uggcaaacagguaagggcu

SEQ ID NO: 597134 - RNA, 18 nt, Human
ugggaugaccugggcaca

SEQ ID NO: 597135 - RNA, 20 nt, Human
ugggcagauucugggugggu

SEQ ID NO: 597136 - RNA, 22 nt, Human
uggggucaagcuuuggcccuua

SEQ ID NO: 597137 - RNA, 22 nt, Human
uguaugaggcugaggcaugggg

SEQ ID NO: 597138 - RNA, 18 nt, Human
uucccccaggcugcaucc

SEQ ID NO: 597139 - RNA, 19 nt, Human
uucuggaaaccaagggcuc

SEQ ID NO: 597140 - RNA, 19 nt, Human
uugacuggaaucaugccca

SEQ ID NO: 597141 - RNA, 18 nt, Human
aaaaacaaguaugaccug

SEQ ID NO: 597142 - RNA, 22 nt, Human
aaaaaggcauuucuaauuggcc

SEQ ID NO: 597143 - RNA, 23 nt, Human
aaaacagcaauaaacacaaaagg

SEQ ID NO: 597144 - RNA, 20 nt, Human
aaaggcacucaauucagagg

SEQ ID NO: 597145 - RNA, 22 nt, Human
aaagugcuacuguuuccaacug

SEQ ID NO: 597146 - RNA, 22 nt, Human
aaagugcuacuguuuccaacug

SEQ ID NO: 597147 - RNA, 18 nt, Human
aaccaggaagaaaguauu

SEQ ID NO: 597148 - RNA, 27 nt, Human
aaccuaauaauaaagguguacagacug

SEQ ID NO: 597149 - RNA, 23 nt, Human
aacuggaaagauauuagacuaaa

SEQ ID NO: 597150 - RNA, 19 nt, Human
aagaaaagaccauguaagg

SEQ ID NO: 597151 - RNA, 18 nt, Human
aagcuaaaaauuaaaucu

SEQ ID NO: 597152 - RNA, 18 nt, Human
aagcuaaaaauuaaaucu

SEQ ID NO: 597153 - RNA, 19 nt, Human
aaggcacucaauucagagg

SEQ ID NO: 597154 - RNA, 22 nt, Human
aauaaacacaaaaggucaacau

SEQ ID NO: 597155 - RNA, 22 nt, Human
aauguucuuacgcauaugcaua

SEQ ID NO: 597156 - RNA, 24 nt, Human
acaaauuauucccauuuuaaaagc

SEQ ID NO: 597157 - RNA, 20 nt, Human
acauaagguagaaacaaagu

SEQ ID NO: 597158 - RNA, 20 nt, Human
acauaagguagaaacaaagu

SEQ ID NO: 597159 - RNA, 23 nt, Human
accuucucacgcgcagccccaac

SEQ ID NO: 597160 - RNA, 22 nt, Human
acggcuccccaggacuucaggg

SEQ ID NO: 597161 - RNA, 23 nt, Human
acuucagggagcccagagaaggg

SEQ ID NO: 597162 - RNA, 19 nt, Human
agaaauuuacagauggaua

SEQ ID NO: 597163 - RNA, 21 nt, Human
aggaagaaaauauuuaaugau

SEQ ID NO: 597164 - RNA, 24 nt, Human
auaaacacaaaaggucaacauaca

SEQ ID NO: 597165 - RNA, 24 nt, Human
auaaacacaaaaggucaacguaua

SEQ ID NO: 597166 - RNA, 22 nt, Human
auugcuaauuggccauccaaau

SEQ ID NO: 597167 - RNA, 23 nt, Human
caaaacucccaacuaaaauuuga

SEQ ID NO: 597168 - RNA, 23 nt, Human
caaagcgcgggacggagggcgca

SEQ ID NO: 597169 - RNA, 19 nt, Human
caacaaagcgcgggacgga

SEQ ID NO: 597170 - RNA, 19 nt, Human
caaguccugagcuuaagua

SEQ ID NO: 597171 - RNA, 23 nt, Human
caauaaacacaaaaggucaacgu

SEQ ID NO: 597172 - RNA, 23 nt, Human
cacaaaaggucaacauacauaaa

SEQ ID NO: 597173 - RNA, 23 nt, Human
cacaaaaggucaacguauauaaa

SEQ ID NO: 597174 - RNA, 20 nt, Human
caccgcagcaccucgccccc

SEQ ID NO: 597175 - RNA, 21 nt, Human
caccgcagcaccucgcccccu

SEQ ID NO: 597176 - RNA, 20 nt, Human
caccuucucacgcgcagccc

SEQ ID NO: 597177 - RNA, 22 nt, Human
cacuguucuuaaacuccuagga

SEQ ID NO: 597178 - RNA, 22 nt, Human
cagcucaaaagagcauugcuaa

SEQ ID NO: 597179 - RNA, 20 nt, Human
cagcuucuauguuagauccu

SEQ ID NO: 597180 - RNA, 18 nt, Human
cagggagcccagaggagg

SEQ ID NO: 597181 - RNA, 20 nt, Human
cauguaagacaagaaauauc

SEQ ID NO: 597182 - RNA, 20 nt, Human
cauuaaccacagaaguacuu

SEQ ID NO: 597183 - RNA, 20 nt, Human
cauuaaccacagaaguacuu

SEQ ID NO: 597184 - RNA, 20 nt, Human
ccaaaaccaggaagaaaaua

SEQ ID NO: 597185 - RNA, 24 nt, Human
ccaccuucucacgcgcagccccaa

SEQ ID NO: 597186 - RNA, 19 nt, Human
cccaggacuucagggagcc

SEQ ID NO: 597187 - RNA, 24 nt, Human
ccccaggacuucagggagcccaga

SEQ ID NO: 597188 - RNA, 19 nt, Human
ccccucgcuuucgcaacaa

SEQ ID NO: 597189 - RNA, 19 nt, Human
cccgagacuucagggagcc

SEQ ID NO: 597190 - RNA, 20 nt, Human
cccgcagcguccggucgcgc

SEQ ID NO: 597191 - RNA, 20 nt, Human
ccgccagccuuccccgagcg

SEQ ID NO: 597192 - RNA, 20 nt, Human
ccgccagccuuccccgagcg

SEQ ID NO: 597193 - RNA, 21 nt, Human
ccgcccgcagcguccggucgc

SEQ ID NO: 597194 - RNA, 22 nt, Human
ccgccgccgccagccuuccccg

SEQ ID NO: 597195 - RNA, 22 nt, Human
ccgccgccgccagccuuccccg

SEQ ID NO: 597196 - RNA, 22 nt, Human
cgcccgcagcguccggucgcgc

SEQ ID NO: 597197 - RNA, 21 nt, Human
cuaaaaggaggaaucauaaug

SEQ ID NO: 597198 - RNA, 22 nt, Human
cucacgcgcagccccaaccguu

SEQ ID NO: 597199 - RNA, 24 nt, Human
gaaagcuuucaauacaccaacuga

SEQ ID NO: 597200 - RNA, 23 nt, Human
gaaggugugaagcuaacuuucau

SEQ ID NO: 597201 - RNA, 22 nt, Human
gagcgcaggugccuacaccgcc

SEQ ID NO: 597202 - RNA, 22 nt, Human
gagcgcaggugccuacaccgcc

SEQ ID NO: 597203 - RNA, 19 nt, Human
gcccagagaagggggucuc

SEQ ID NO: 597204 - RNA, 21 nt, Human
gccgcgcucuagcaccgcagc

SEQ ID NO: 597205 - RNA, 20 nt, Human
ggaaagccaaauuuuaaaaa

SEQ ID NO: 597206 - RNA, 21 nt, Human
ggaaagcuuucaauacaccaa

SEQ ID NO: 597207 - RNA, 20 nt, Human
ggcucuauucaaaacagcaa

SEQ ID NO: 597208 - RNA, 23 nt, Human
gggggucucuggccauggcccgg

SEQ ID NO: 597209 - RNA, 25 nt, Human
guaaagaucagagaauauuaaaaug

SEQ ID NO: 597210 - RNA, 21 nt, Human
guacaguucauaaggccuuug

SEQ ID NO: 597211 - RNA, 25 nt, Human
uaaaaauaaauuuacagauagauaa

SEQ ID NO: 597212 - RNA, 20 nt, Human
uaaaaggaggaaucacaaug

SEQ ID NO: 597213 - RNA, 18 nt, Human
uaaaauccuaggaaagcc

SEQ ID NO: 597214 - RNA, 18 nt, Human
uaaacacaaaaggucaac

SEQ ID NO: 597215 - RNA, 18 nt, Human
uaaacacaaaaggucaac

SEQ ID NO: 597216 - RNA, 22 nt, Human
uaaguaggaaacaaaacuccca

SEQ ID NO: 597217 - RNA, 22 nt, Human
uaaguaggaaacaaaguuccca

SEQ ID NO: 597218 - RNA, 22 nt, Human
uaauaauaaagguguacagacu

SEQ ID NO: 597219 - RNA, 22 nt, Human
uaauaauaaagguguacagacu

SEQ ID NO: 597220 - RNA, 21 nt, Human
uacaguucauaaggccuuugu

SEQ ID NO: 597221 - RNA, 21 nt, Human
uacaguucauaaggccuuugu

SEQ ID NO: 597222 - RNA, 24 nt, Human
uagcaaugacaaugcuuaaguuuu

SEQ ID NO: 597223 - RNA, 23 nt, Human
uaucaaguccugagcuuaaguag

SEQ ID NO: 597224 - RNA, 20 nt, Human
uaucugguacauaaauaacu

SEQ ID NO: 597225 - RNA, 20 nt, Human
uaucugguacauaaauaauu

SEQ ID NO: 597226 - RNA, 18 nt, Human
uauuagacuaaaaggagg

SEQ ID NO: 597227 - RNA, 25 nt, Human
uauucccauuuuaaaagccagaaua

SEQ ID NO: 597228 - RNA, 22 nt, Human
ucaauacaccaacugaaaaagg

SEQ ID NO: 597229 - RNA, 21 nt, Human
ucacucaaagccacucaacuc

SEQ ID NO: 597230 - RNA, 22 nt, Human
uccacuaacauaagguagaaac

SEQ ID NO: 597231 - RNA, 22 nt, Human
uccacuaacauaagguagaaac

SEQ ID NO: 597232 - RNA, 18 nt, Human
ucgcccccucgcuuucgc

SEQ ID NO: 597233 - RNA, 24 nt, Human
ucuccauccucuuccccgcccgca

SEQ ID NO: 597234 - RNA, 23 nt, Human
ugaauuaaaagcaugaguuuaau

SEQ ID NO: 597235 - RNA, 18 nt, Human
ugagguccacuaacauaa

SEQ ID NO: 597236 - RNA, 18 nt, Human
ugagguccacuaacauaa

SEQ ID NO: 597237 - RNA, 19 nt, Human
ugccccagcucaaaagagc

SEQ ID NO: 597238 - RNA, 19 nt, Human
ugccccagcucaaaagagc

SEQ ID NO: 597239 - RNA, 20 nt, Human
ugucaaagaaaagaccaugu

SEQ ID NO: 597240 - RNA, 20 nt, Human
ugucaaagaaaagaccaugu

SEQ ID NO: 597241 - RNA, 24 nt, Human
uuaaaacuauaauaucugguacau

SEQ ID NO: 597242 - RNA, 19 nt, Human
uuaaaugccccagcucaaa

SEQ ID NO: 597243 - RNA, 26 nt, Human
uuagacuaaaaggaggaaucacaaug

SEQ ID NO: 597244 - RNA, 26 nt, Human
uuagacuaaaaggaggaaucauaaug

SEQ ID NO: 597245 - RNA, 23 nt, Human
uucaaaacagcaauaaacacaaa

SEQ ID NO: 597246 - RNA, 23 nt, Human
uucaaaacaguaauaaacacaaa

SEQ ID NO: 597247 - RNA, 19 nt, Human
uucaaagugcuacuguuuc

SEQ ID NO: 597248 - RNA, 19 nt, Human
uucaaagugcuacuguuuc

SEQ ID NO: 597249 - RNA, 21 nt, Human
uucaaagugcuacuguuucca

SEQ ID NO: 597250 - RNA, 21 nt, Human
uucaaagugcuacuguuucca

SEQ ID NO: 597251 - RNA, 25 nt, Human
uucaguuuucuggauuuucugggug

SEQ ID NO: 597252 - RNA, 20 nt, Human
uucauaaggccuuugucauu

SEQ ID NO: 597253 - RNA, 20 nt, Human
uucauaaggccuuugucauu

SEQ ID NO: 597254 - RNA, 18 nt, Human
uuccauuuuuacauuaau

SEQ ID NO: 597255 - RNA, 20 nt, Human
uucuauuagcaugugucacu

SEQ ID NO: 597256 - RNA, 25 nt, Human
uuuucuggauuuucugggugacgau

SEQ ID NO: 597257 - RNA, 22 nt, Human
uuuuuuuuuuuuuuuuauuuuu

SEQ ID NO: 597258 - RNA, 20 nt, Human
accucgggaagcgcuggaaa

SEQ ID NO: 597259 - RNA, 19 nt, Human
acgacacagcggagggggc

SEQ ID NO: 597260 - RNA, 19 nt, Human
agcccagaaguccgaccac

SEQ ID NO: 597261 - RNA, 23 nt, Human
agggggcggggcccgacgcgggg

SEQ ID NO: 597262 - RNA, 19 nt, Human
auggucaccaaagggagua

SEQ ID NO: 597263 - RNA, 22 nt, Human
caccuggggcucugggcuguuc

SEQ ID NO: 597264 - RNA, 19 nt, Human
cacucggcggggaccgccu

SEQ ID NO: 597265 - RNA, 21 nt, Human
cagaaguccgaccacggagcc

SEQ ID NO: 597266 - RNA, 18 nt, Human
cagcggagggggcggggc

SEQ ID NO: 597267 - RNA, 20 nt, Human
cagggcccuccaggugggcc

SEQ ID NO: 597268 - RNA, 25 nt, Human
ccacggagccuucgugccgugcccc

SEQ ID NO: 597269 - RNA, 19 nt, Human
cccccagcgguggugcggc

SEQ ID NO: 597270 - RNA, 18 nt, Human
cccgcccccggcgugcac

SEQ ID NO: 597271 - RNA, 21 nt, Human
ccgccuuuucuccucuaggcu

SEQ ID NO: 597272 - RNA, 22 nt, Human
ccuccaggugggccagggccuu

SEQ ID NO: 597273 - RNA, 22 nt, Human
ccuccgaacagcccagaagucc

SEQ ID NO: 597274 - RNA, 18 nt, Human
ccuccgagucugcgcacu

SEQ ID NO: 597275 - RNA, 20 nt, Human
ccuccgagucugcgcacuuc

SEQ ID NO: 597276 - RNA, 23 nt, Human
ccucuaggcucgcuucgcugccc

SEQ ID NO: 597277 - RNA, 23 nt, Human
cggcacgccccuuccguacagca

SEQ ID NO: 597278 - RNA, 23 nt, Human
cuagaagcucccgacgcggccga

SEQ ID NO: 597279 - RNA, 21 nt, Human
cucaccgcuccuccaugauga

SEQ ID NO: 597280 - RNA, 22 nt, Human
cuucgugccgugccccgccccc

SEQ ID NO: 597281 - RNA, 18 nt, Human
cuuggguccccuucccag

SEQ ID NO: 597282 - RNA, 21 nt, Human
ggcucugggcuguucugcuuc

SEQ ID NO: 597283 - RNA, 19 nt, Human
gggccuccgaacagcccag

SEQ ID NO: 597284 - RNA, 21 nt, Human
gggcggggcccgacgcggggg

SEQ ID NO: 597285 - RNA, 23 nt, Human
ggggcggggcccgacgcgggggc

SEQ ID NO: 597286 - RNA, 20 nt, Human
guuuaaucucaauuccagag

SEQ ID NO: 597287 - RNA, 22 nt, Human
uaggaugcugagcgccaagucc

SEQ ID NO: 597288 - RNA, 19 nt, Human
uaugccuccgagucugcgc

SEQ ID NO: 597289 - RNA, 23 nt, Human
uccagaggucuaggccaggccag

SEQ ID NO: 597290 - RNA, 21 nt, Human
ucggcggggaccgccuuuucu

SEQ ID NO: 597291 - RNA, 20 nt, Human
ucgugccgugccccgccccu

SEQ ID NO: 597292 - RNA, 22 nt, Human
ucucaccgcuccuccaugauga

SEQ ID NO: 597293 - RNA, 21 nt, Human
ucugggcccuacacccagaac

SEQ ID NO: 597294 - RNA, 24 nt, Human
ugaagaauggucaccaaagggagu

SEQ ID NO: 597295 - RNA, 23 nt, Human
ugcucagccuccucccuugccag

SEQ ID NO: 597296 - RNA, 22 nt, Human
uguucugcuucucugggcccua

SEQ ID NO: 597297 - RNA, 24 nt, Human
uucuccucuaggcucgcuucgcug

SEQ ID NO: 597298 - RNA, 19 nt, Human
aaaaaaaaaaaaaaaaaga

SEQ ID NO: 597299 - RNA, 24 nt, Human
aaaaaaaaaaaaaaaagaaaagaa

SEQ ID NO: 597300 - RNA, 25 nt, Human
aaaaaaaaaaaagaaaagaaaagaa

SEQ ID NO: 597301 - RNA, 22 nt, Human
aaaaaagaaacagaucuaagca

SEQ ID NO: 597302 - RNA, 23 nt, Human
aaaaagaaacagaucuaagcaac

SEQ ID NO: 597303 - RNA, 25 nt, Human
aaaaagaaacagaucuaagcaugca

SEQ ID NO: 597304 - RNA, 20 nt, Human
aaaagaaaaagauuugguua

SEQ ID NO: 597305 - RNA, 24 nt, Human
aaacaagacacagagugcacagga

SEQ ID NO: 597306 - RNA, 19 nt, Human
aaaccuggugacccccccc

SEQ ID NO: 597307 - RNA, 20 nt, Human
aaagaucaccuccaggcacc

SEQ ID NO: 597308 - RNA, 22 nt, Human
aacaaagaaacccaaagcacaa

SEQ ID NO: 597309 - RNA, 24 nt, Human
aacaaagaaacccaaagcacaaaa

SEQ ID NO: 597310 - RNA, 20 nt, Human
aacauggugaaacccugucu

SEQ ID NO: 597311 - RNA, 21 nt, Human
aacauggugaaacccugucuc

SEQ ID NO: 597312 - RNA, 20 nt, Human
aacccugcccccccugcucc

SEQ ID NO: 597313 - RNA, 19 nt, Human
aagaaaagaaaagaaaaag

SEQ ID NO: 597314 - RNA, 22 nt, Human
aagaaacagaucuaagcaugca

SEQ ID NO: 597315 - RNA, 23 nt, Human
aaggcacuuucaccuugcauuuu

SEQ ID NO: 597316 - RNA, 23 nt, Human
aauuucuaucccuggacuaucuc

SEQ ID NO: 597317 - RNA, 19 nt, Human
acaaagaaacccaaagcac

SEQ ID NO: 597318 - RNA, 24 nt, Human
acacaacacucauguucuauccaa

SEQ ID NO: 597319 - RNA, 23 nt, Human
acagagcaagacucugucucaaa

SEQ ID NO: 597320 - RNA, 24 nt, Human
acagagcaagacucugucucaaaa

SEQ ID NO: 597321 - RNA, 20 nt, Human
acaggaacccugcccccccu

SEQ ID NO: 597322 - RNA, 23 nt, Human
acaggacagacaagccggcggaa

SEQ ID NO: 597323 - RNA, 18 nt, Human
acauuccuuauucuuauc

SEQ ID NO: 597324 - RNA, 21 nt, Human
accaacagggcagcagccaca

SEQ ID NO: 597325 - RNA, 20 nt, Human
accagaacuuucuacuuccc

SEQ ID NO: 597326 - RNA, 26 nt, Human
acccaaagcacaaaagccagccucug

SEQ ID NO: 597327 - RNA, 19 nt, Human
acccugcccccccugcucc

SEQ ID NO: 597328 - RNA, 21 nt, Human
acccugcccccccugcuccuc

SEQ ID NO: 597329 - RNA, 24 nt, Human
acccugucucuacuaaaaauacaa

SEQ ID NO: 597330 - RNA, 24 nt, Human
accugaggucaggaguucgagacc

SEQ ID NO: 597331 - RNA, 24 nt, Human
accuuucucgcuuuuucagucaac

SEQ ID NO: 597332 - RNA, 28 nt, Human
acucugucucaaaaaaaaaaaaaaaaaa

SEQ ID NO: 597333 - RNA, 24 nt, Human
acugcacuccagccuggccgacag

SEQ ID NO: 597334 - RNA, 26 nt, Human
acugcacuccagccuggccgacagag

SEQ ID NO: 597335 - RNA, 18 nt, Human
agaaaagaaaagaaaaag

SEQ ID NO: 597336 - RNA, 18 nt, Human
agaaaagaaaagaaaaag

SEQ ID NO: 597337 - RNA, 19 nt, Human
agaaaagaaaagaaaaaga

SEQ ID NO: 597338 - RNA, 19 nt, Human
agaacauuugaaugucuga

SEQ ID NO: 597339 - RNA, 21 nt, Human
agaagaagaaagaccugcgca

SEQ ID NO: 597340 - RNA, 20 nt, Human
agagguugcagugagccaag

SEQ ID NO: 597341 - RNA, 23 nt, Human
agagguugcagugagccaagauc

SEQ ID NO: 597342 - RNA, 24 nt, Human
agagguugcagugagccaagauca

SEQ ID NO: 597343 - RNA, 24 nt, Human
agcacuuugggaggcugagguggg

SEQ ID NO: 597344 - RNA, 22 nt, Human
agccugcccaauuuagcuacaa

SEQ ID NO: 597345 - RNA, 22 nt, Human
agccuggccgacagagcaagac

SEQ ID NO: 597346 - RNA, 24 nt, Human
agccuggccgacagagcaagacuc

SEQ ID NO: 597347 - RNA, 23 nt, Human
agccugggcauuggcgcuuucug

SEQ ID NO: 597348 - RNA, 24 nt, Human
agccuguccaacauggugaaaccc

SEQ ID NO: 597349 - RNA, 25 nt, Human
aggaacccugcccccccugcuccuc

SEQ ID NO: 597350 - RNA, 23 nt, Human
aggaguucgagaccagccugucc

SEQ ID NO: 597351 - RNA, 23 nt, Human
aggauuaccugaggucaggaguu

SEQ ID NO: 597352 - RNA, 24 nt, Human
aggauuaccugaggucaggaguuc

SEQ ID NO: 597353 - RNA, 24 nt, Human
aggcagagguugcagugagccaag

SEQ ID NO: 597354 - RNA, 22 nt, Human
aggcaggagaauugcuugagcc

SEQ ID NO: 597355 - RNA, 24 nt, Human
aggcaggagaauugcuugagccug

SEQ ID NO: 597356 - RNA, 24 nt, Human
aggcaugguggcacaugccuguaa

SEQ ID NO: 597357 - RNA, 25 nt, Human
aggcgccagacaggacagacaagcc

SEQ ID NO: 597358 - RNA, 21 nt, Human
aggcugaggcaggagaauugc

SEQ ID NO: 597359 - RNA, 24 nt, Human
aggcugaggcaggagaauugcuug

SEQ ID NO: 597360 - RNA, 24 nt, Human
aggcugaggugggaggauuaccug

SEQ ID NO: 597361 - RNA, 22 nt, Human
aggugggaggauuaccugaggu

SEQ ID NO: 597362 - RNA, 23 nt, Human
aggugggaggauuaccugagguc

SEQ ID NO: 597363 - RNA, 23 nt, Human
auagcaguacagaaaaccaauga

SEQ ID NO: 597364 - RNA, 18 nt, Human
auagcucaccuuucucgc

SEQ ID NO: 597365 - RNA, 24 nt, Human
aucaugccacugcacuccagccug

SEQ ID NO: 597366 - RNA, 22 nt, Human
augccacugcacuccagccugg

SEQ ID NO: 597367 - RNA, 24 nt, Human
auuaccugaggucaggaguucgag

SEQ ID NO: 597368 - RNA, 25 nt, Human
caaaaaaggaaaaucaccaucuucc

SEQ ID NO: 597369 - RNA, 19 nt, Human
caacaaagaaacccaaagc

SEQ ID NO: 597370 - RNA, 21 nt, Human
caacaaagaaacccaaagcac

SEQ ID NO: 597371 - RNA, 22 nt, Human
caacaaagaaacccaaagcaca

SEQ ID NO: 597372 - RNA, 24 nt, Human
caacagggcagcagccacaugcag

SEQ ID NO: 597373 - RNA, 24 nt, Human
caacauggugaaacccugucucua

SEQ ID NO: 597374 - RNA, 24 nt, Human
caagaucaugccacugcacuccag

SEQ ID NO: 597375 - RNA, 23 nt, Human
caagggauuguuuagaaccagca

SEQ ID NO: 597376 - RNA, 24 nt, Human
cacaccuguaaucccagcacuuug

SEQ ID NO: 597377 - RNA, 28 nt, Human
caccccacaggcccuugugaauuuccaa

SEQ ID NO: 597378 - RNA, 19 nt, Human
caccguuaucaaguccagc

SEQ ID NO: 597379 - RNA, 19 nt, Human
caccuggguguaaacagca

SEQ ID NO: 597380 - RNA, 23 nt, Human
caccuguaaucccagcacuuugg

SEQ ID NO: 597381 - RNA, 24 nt, Human
caccuguaaucccagcacuuuggg

SEQ ID NO: 597382 - RNA, 23 nt, Human
cacuccagccuggccgacagagc

SEQ ID NO: 597383 - RNA, 18 nt, Human
cacugcacuccagccugg

SEQ ID NO: 597384 - RNA, 18 nt, Human
cacugcacuccagccugg

SEQ ID NO: 597385 - RNA, 24 nt, Human
cacugcacuccagccuggccgaca

SEQ ID NO: 597386 - RNA, 24 nt, Human
cacugcacuccagccuggccgaca

SEQ ID NO: 597387 - RNA, 24 nt, Human
cagcacuuugggaggcugaggugg

SEQ ID NO: 597388 - RNA, 23 nt, Human
cagccagguaaaauuugucuccc

SEQ ID NO: 597389 - RNA, 24 nt, Human
cagcuacucgggaggcugaggcag

SEQ ID NO: 597390 - RNA, 20 nt, Human
caggcaugguggcacaugcc

SEQ ID NO: 597391 - RNA, 23 nt, Human
cagggcagcagccacaugcagag

SEQ ID NO: 597392 - RNA, 19 nt, Human
cagguccaagggauuguuu

SEQ ID NO: 597393 - RNA, 23 nt, Human
cagugcugcagccacaaugcaga

SEQ ID NO: 597394 - RNA, 20 nt, Human
caugacuacauacacuccuc

SEQ ID NO: 597395 - RNA, 19 nt, Human
caugcagagaaacagacac

SEQ ID NO: 597396 - RNA, 19 nt, Human
cauuagaaaccucaauuua

SEQ ID NO: 597397 - RNA, 24 nt, Human
cauucaaagaucaccuccaggcac

SEQ ID NO: 597398 - RNA, 19 nt, Human
ccaaagcacaaaagccagc

SEQ ID NO: 597399 - RNA, 21 nt, Human
ccaacauggugaaacccuguc

SEQ ID NO: 597400 - RNA, 23 nt, Human
ccaacauggugaaacccugucuc

SEQ ID NO: 597401 - RNA, 19 nt, Human
ccaagcacugaaaacgacu

SEQ ID NO: 597402 - RNA, 22 nt, Human
ccacaacuaagcaugagcgauu

SEQ ID NO: 597403 - RNA, 26 nt, Human
ccacuaaaaagcaaccuuugugccau

SEQ ID NO: 597404 - RNA, 19 nt, Human
ccacugcacuccagccugg

SEQ ID NO: 597405 - RNA, 19 nt, Human
ccacugcacuccagccugg

SEQ ID NO: 597406 - RNA, 20 nt, Human
ccacugcacuccagccuggc

SEQ ID NO: 597407 - RNA, 24 nt, Human
ccacugcacuccagccuggccgac

SEQ ID NO: 597408 - RNA, 22 nt, Human
ccacuggacggcggccuggucu

SEQ ID NO: 597409 - RNA, 21 nt, Human
ccagaacuuucuacuucccaa

SEQ ID NO: 597410 - RNA, 18 nt, Human
ccauaccacaacuaagca

SEQ ID NO: 597411 - RNA, 20 nt, Human
cccaagagccugcccaauuu

SEQ ID NO: 597412 - RNA, 27 nt, Human
cccagugcugcagccacaagguacccc

SEQ ID NO: 597413 - RNA, 20 nt, Human
ccccagugcugcagccacaa

SEQ ID NO: 597414 - RNA, 18 nt, Human
ccccuaaaccuggugacc

SEQ ID NO: 597415 - RNA, 22 nt, Human
ccccuaaaccuggugacccccc

SEQ ID NO: 597416 - RNA, 22 nt, Human
ccccuccuucugcacccguguc

SEQ ID NO: 597417 - RNA, 21 nt, Human
cccgcagcuccagaucagcca

SEQ ID NO: 597418 - RNA, 24 nt, Human
cccugucacccucggcggggucug

SEQ ID NO: 597419 - RNA, 20 nt, Human
ccggaaaggccugggucuua

SEQ ID NO: 597420 - RNA, 22 nt, Human
ccuccaggcaccccacaggccc

SEQ ID NO: 597421 - RNA, 20 nt, Human
ccucccuucucucuuuggcc

SEQ ID NO: 597422 - RNA, 23 nt, Human
ccucggauggaugauccuggucu

SEQ ID NO: 597423 - RNA, 22 nt, Human
ccugaggucaggaguucgagac

SEQ ID NO: 597424 - RNA, 22 nt, Human
ccuggccgacagagcaagacuc

SEQ ID NO: 597425 - RNA, 19 nt, Human
ccuguaaucccagcuacuc

SEQ ID NO: 597426 - RNA, 21 nt, Human
ccuguaaucccagcuacucgg

SEQ ID NO: 597427 - RNA, 24 nt, Human
ccuguccaacauggugaaacccug

SEQ ID NO: 597428 - RNA, 24 nt, Human
ccuugugaauuuccacuaaaaagc

SEQ ID NO: 597429 - RNA, 24 nt, Human
cgagaccagccuguccaacauggu

SEQ ID NO: 597430 - RNA, 21 nt, Human
cggaaucagaccacaccugcu

SEQ ID NO: 597431 - RNA, 21 nt, Human
cgucuuggacucagccccucc

SEQ ID NO: 597432 - RNA, 20 nt, Human
cuacaggaacccugcccccc

SEQ ID NO: 597433 - RNA, 18 nt, Human
cucaaaaaaaaaaaaaaa

SEQ ID NO: 597434 - RNA, 22 nt, Human
cucacaccuguaaucccagcac

SEQ ID NO: 597435 - RNA, 24 nt, Human
cucacaccuguaaucccagcacuu

SEQ ID NO: 597436 - RNA, 18 nt, Human
cucacugucgucauccuc

SEQ ID NO: 597437 - RNA, 22 nt, Human
cuccaggcaccccacaggcccu

SEQ ID NO: 597438 - RNA, 22 nt, Human
cuccccuaaaccuggugacccc

SEQ ID NO: 597439 - RNA, 22 nt, Human
cuccucggauggaugauccugg

SEQ ID NO: 597440 - RNA, 22 nt, Human
cucuacaggaacccugcccccc

SEQ ID NO: 597441 - RNA, 19 nt, Human
cucugucucaaaaaaaaaa

SEQ ID NO: 597442 - RNA, 20 nt, Human
cugagcucgucuuggacuca

SEQ ID NO: 597443 - RNA, 20 nt, Human
cugcuguuucucugugucca

SEQ ID NO: 597444 - RNA, 24 nt, Human
cuguccaacauggugaaacccugu

SEQ ID NO: 597445 - RNA, 19 nt, Human
cuucugguuuucugagcuc

SEQ ID NO: 597446 - RNA, 23 nt, Human
cuugagguaaagaaagauuuggu

SEQ ID NO: 597447 - RNA, 21 nt, Human
cuuguaguccuuuacauuccu

SEQ ID NO: 597448 - RNA, 23 nt, Human
gaaacccaaagcacaaaagccag

SEQ ID NO: 597449 - RNA, 27 nt, Human
gaaacccaaagcacaaaagccagccuc

SEQ ID NO: 597450 - RNA, 19 nt, Human
gaaacccugucucuacuaa

SEQ ID NO: 597451 - RNA, 23 nt, Human
gagaggcagggguuaacaccugg

SEQ ID NO: 597452 - RNA, 23 nt, Human
gaggugggaggauuaccugaggu

SEQ ID NO: 597453 - RNA, 18 nt, Human
gagguugcagugagccaa

SEQ ID NO: 597454 - RNA, 24 nt, Human
gauuaccugaggucaggaguucga

SEQ ID NO: 597455 - RNA, 24 nt, Human
gcacuccagccuggccgacagagc

SEQ ID NO: 597456 - RNA, 18 nt, Human
gcagcuccagaucagcca

SEQ ID NO: 597457 - RNA, 22 nt, Human
gcagcuucaccccggaaaggcc

SEQ ID NO: 597458 - RNA, 24 nt, Human
gcaggcaagcagcaucuucugcug

SEQ ID NO: 597459 - RNA, 20 nt, Human
gccaagaucaugccacugca

SEQ ID NO: 597460 - RNA, 19 nt, Human
gccacaaugcagauggggu

SEQ ID NO: 597461 - RNA, 21 nt, Human
gcggaagacauccauaccaca

SEQ ID NO: 597462 - RNA, 19 nt, Human
gcuacaaaaaaggaaaauc

SEQ ID NO: 597463 - RNA, 22 nt, Human
ggaaaggccugggucuuacuga

SEQ ID NO: 597464 - RNA, 21 nt, Human
ggaacccugcccccccugcuc

SEQ ID NO: 597465 - RNA, 24 nt, Human
ggagaggcagggguuaacaccugg

SEQ ID NO: 597466 - RNA, 23 nt, Human
ggauuaccugaggucaggaguuc

SEQ ID NO: 597467 - RNA, 21 nt, Human
ggcacaugccuguaaucccag

SEQ ID NO: 597468 - RNA, 21 nt, Human
gggcagcagccacaugcagag

SEQ ID NO: 597469 - RNA, 24 nt, Human
gggugugguggcucacaccuguaa

SEQ ID NO: 597470 - RNA, 21 nt, Human
ggucucugcccccagagcucc

SEQ ID NO: 597471 - RNA, 24 nt, Human
gguggcacaugccuguaaucccag

SEQ ID NO: 597472 - RNA, 24 nt, Human
gguggcucacaccuguaaucccag

SEQ ID NO: 597473 - RNA, 23 nt, Human
gguuggccgggugugguggcuca

SEQ ID NO: 597474 - RNA, 19 nt, Human
guaaagaaagauuugguug

SEQ ID NO: 597475 - RNA, 25 nt, Human
gucuaggugaaaaaaaaugaaugga

SEQ ID NO: 597476 - RNA, 18 nt, Human
gugaaaaaaaaugaaugg

SEQ ID NO: 597477 - RNA, 20 nt, Human
gugaggcagagguugcagug

SEQ ID NO: 597478 - RNA, 23 nt, Human
guggcacaugccuguaaucccag

SEQ ID NO: 597479 - RNA, 23 nt, Human
guggcucacaccuguaaucccag

SEQ ID NO: 597480 - RNA, 18 nt, Human
gugugguggcucacaccu

SEQ ID NO: 597481 - RNA, 20 nt, Human
guucacauaaucagcauccu

SEQ ID NO: 597482 - RNA, 19 nt, Human
guucgagaccagccugucc

SEQ ID NO: 597483 - RNA, 24 nt, Human
guuggccgggugugguggcucaca

SEQ ID NO: 597484 - RNA, 21 nt, Human
uaaaaagcaaccuuugugcca

SEQ ID NO: 597485 - RNA, 20 nt, Human
uaaacaagacacagagugcu

SEQ ID NO: 597486 - RNA, 21 nt, Human
uaaguguguacauuagaaacc

SEQ ID NO: 597487 - RNA, 20 nt, Human
uacauuagaaaccucaauuu

SEQ ID NO: 597488 - RNA, 23 nt, Human
uaccugaggucaggaguucgaga

SEQ ID NO: 597489 - RNA, 21 nt, Human
uagaugguuauguuaaauccc

SEQ ID NO: 597490 - RNA, 20 nt, Human
uagcaauguagcaaaggucu

SEQ ID NO: 597491 - RNA, 23 nt, Human
uagcaguacagaaaaccaaugac

SEQ ID NO: 597492 - RNA, 19 nt, Human
uauccaagaaugcuaacac

SEQ ID NO: 597493 - RNA, 21 nt, Human
uaugacugacuguuuucuuaa

SEQ ID NO: 597494 - RNA, 22 nt, Human
ucaaaaaaaaaaaaaaaaaaaa

SEQ ID NO: 597495 - RNA, 23 nt, Human
ucaaaaaaaaaaaaaaaaaaaaa

SEQ ID NO: 597496 - RNA, 19 nt, Human
ucaaaaccuucaccagcaa

SEQ ID NO: 597497 - RNA, 22 nt, Human
ucaaaaccuucaccagcaaaaa

SEQ ID NO: 597498 - RNA, 26 nt, Human
ucacagucuucccagugaucaaaauc

SEQ ID NO: 597499 - RNA, 22 nt, Human
ucagucaacaaagaaacccaaa

SEQ ID NO: 597500 - RNA, 26 nt, Human
ucaucuuuccuuaugucgggacagcc

SEQ ID NO: 597501 - RNA, 23 nt, Human
ucaugccacugcacuccagccug

SEQ ID NO: 597502 - RNA, 20 nt, Human
uccaggcaccccacaggccc

SEQ ID NO: 597503 - RNA, 23 nt, Human
ucccaauagcucaccuuucucgc

SEQ ID NO: 597504 - RNA, 21 nt, Human
uccuacaaaauguuagcuuca

SEQ ID NO: 597505 - RNA, 23 nt, Human
ucgggaggcugaggcaggagaau

SEQ ID NO: 597506 - RNA, 20 nt, Human
ucuaggugaaaaaaaaugaa

SEQ ID NO: 597507 - RNA, 24 nt, Human
ucuauccaaauucuuuuccauucc

SEQ ID NO: 597508 - RNA, 21 nt, Human
ucucuacuaaaaauacaaaaa

SEQ ID NO: 597509 - RNA, 19 nt, Human
ucugaaaaaagaaacagau

SEQ ID NO: 597510 - RNA, 22 nt, Human
ucugcagguccaagggauuguu

SEQ ID NO: 597511 - RNA, 23 nt, Human
ucugucucaaaaaaaaaaaaaaa

SEQ ID NO: 597512 - RNA, 19 nt, Human
ucuucacaagcugguaucu

SEQ ID NO: 597513 - RNA, 24 nt, Human
ucuucacagucuucccagugauca

SEQ ID NO: 597514 - RNA, 18 nt, Human
ucuugagcaggacugguc

SEQ ID NO: 597515 - RNA, 22 nt, Human
ugaaaacgacucuaucccuuaa

SEQ ID NO: 597516 - RNA, 21 nt, Human
ugacuacauacacuccucccc

SEQ ID NO: 597517 - RNA, 18 nt, Human
ugagcaggacuggucccu

SEQ ID NO: 597518 - RNA, 24 nt, Human
ugagccugugaggcagagguugca

SEQ ID NO: 597519 - RNA, 23 nt, Human
ugaggcagagguugcagugagcc

SEQ ID NO: 597520 - RNA, 24 nt, Human
ugaggcaggagaauugcuugagcc

SEQ ID NO: 597521 - RNA, 25 nt, Human
ugaggcaggagaauugcuugagccu

SEQ ID NO: 597522 - RNA, 21 nt, Human
ugagguaaagaaagauuuggu

SEQ ID NO: 597523 - RNA, 22 nt, Human
ugaggugggaggauuaccugag

SEQ ID NO: 597524 - RNA, 23 nt, Human
ugaggugggaggauuaccugagg

SEQ ID NO: 597525 - RNA, 24 nt, Human
ugaggugggaggauuaccugaggu

SEQ ID NO: 597526 - RNA, 26 nt, Human
ugaggugggaggauuaccugagguca

SEQ ID NO: 597527 - RNA, 28 nt, Human
ugaguaggugacaccaugcuguaaugac

SEQ ID NO: 597528 - RNA, 26 nt, Human
ugcaggcaagcagcaucuucugcugg

SEQ ID NO: 597529 - RNA, 24 nt, Human
ugccuguaaucccagcuacucggg

SEQ ID NO: 597530 - RNA, 20 nt, Human
ugcggaagacauccauacca

SEQ ID NO: 597531 - RNA, 18 nt, Human
ugcuugagccugugaggc

SEQ ID NO: 597532 - RNA, 19 nt, Human
uggacguaccuuuucagag

SEQ ID NO: 597533 - RNA, 24 nt, Human
uggaugauccuggucuugagcagg

SEQ ID NO: 597534 - RNA, 21 nt, Human
uggcaauauccauuuuuguuc

SEQ ID NO: 597535 - RNA, 21 nt, Human
uggcacaugccuguaauccca

SEQ ID NO: 597536 - RNA, 19 nt, Human
uggccagagugauuacagg

SEQ ID NO: 597537 - RNA, 19 nt, Human
uggccgggugugguggcuc

SEQ ID NO: 597538 - RNA, 21 nt, Human
uggcucacaccuguaauccca

SEQ ID NO: 597539 - RNA, 22 nt, Human
uggcucacaccuguaaucccag

SEQ ID NO: 597540 - RNA, 24 nt, Human
uggcucacaccuguaaucccagca

SEQ ID NO: 597541 - RNA, 24 nt, Human
uggcucucuacaggaacccugccc

SEQ ID NO: 597542 - RNA, 19 nt, Human
ugggaggcugaggugggag

SEQ ID NO: 597543 - RNA, 22 nt, Human
ugggaggcugaggugggaggau

SEQ ID NO: 597544 - RNA, 25 nt, Human
ugggguggcgaaugucugcagggcu

SEQ ID NO: 597545 - RNA, 20 nt, Human
uggguggaagcuagaagaag

SEQ ID NO: 597546 - RNA, 21 nt, Human
uggucucugcccccagagcuc

SEQ ID NO: 597547 - RNA, 24 nt, Human
ugguggcacaugccuguaauccca

SEQ ID NO: 597548 - RNA, 24 nt, Human
ugguggcucacaccuguaauccca

SEQ ID NO: 597549 - RNA, 26 nt, Human
ugucugaaaaaagaaacagaucuaag

SEQ ID NO: 597550 - RNA, 24 nt, Human
ugugaggcagagguugcagugagc

SEQ ID NO: 597551 - RNA, 23 nt, Human
uguguccacccuccuuugauggu

SEQ ID NO: 597552 - RNA, 18 nt, Human
uguugccccgcagcucca

SEQ ID NO: 597553 - RNA, 20 nt, Human
uguuuagaaccagcagcuuc

SEQ ID NO: 597554 - RNA, 21 nt, Human
uuagaacauuugaaugucuga

SEQ ID NO: 597555 - RNA, 19 nt, Human
uucaacaucuuccagccgc

SEQ ID NO: 597556 - RNA, 25 nt, Human
uucaucacccagaugcaugucugcu

SEQ ID NO: 597557 - RNA, 20 nt, Human
uuccucugucugaguaggug

SEQ ID NO: 597558 - RNA, 23 nt, Human
uugaaugucugaaaaaagaaaca

SEQ ID NO: 597559 - RNA, 18 nt, Human
uugaucuuauuaacuggg

SEQ ID NO: 597560 - RNA, 20 nt, Human
uugcagugagccaagaucau

SEQ ID NO: 597561 - RNA, 18 nt, Human
uugcuugagccugugagg

SEQ ID NO: 597562 - RNA, 22 nt, Human
uuggccgggugugguggcucac

SEQ ID NO: 597563 - RNA, 20 nt, Human
uugggaggcugaggugggag

SEQ ID NO: 597564 - RNA, 23 nt, Human
uuuacauuccuuauucuuaucuu

SEQ ID NO: 597565 - RNA, 22 nt, Human
uuugaaugucugaaaaaagaaa

SEQ ID NO: 597566 - RNA, 23 nt, Human
uuugaaugucugaaaaaagaaac

SEQ ID NO: 597567 - RNA, 22 nt, Human
uuugguuggccggguguggugg

SEQ ID NO: 597568 - RNA, 20 nt, Human
uuuucagaggcggcugugca

SEQ ID NO: 597569 - RNA, 19 nt, Human
aaaaguccuuacugaauau

SEQ ID NO: 597570 - RNA, 20 nt, Human
aaacaggguuacacaggagu

SEQ ID NO: 597571 - RNA, 22 nt, Human
aaaccaguucaacucuaauaua

SEQ ID NO: 597572 - RNA, 23 nt, Human
aaccaacugaugaucccauaaaa

SEQ ID NO: 597573 - RNA, 22 nt, Human
aagguucuuucaagggaacuuu

SEQ ID NO: 597574 - RNA, 23 nt, Human
aaguuucuguggccaaacaucug

SEQ ID NO: 597575 - RNA, 19 nt, Human
aaucauuuuaagaaggcaa

SEQ ID NO: 597576 - RNA, 24 nt, Human
acagcgagccgcggggcgcgggcc

SEQ ID NO: 597577 - RNA, 22 nt, Human
accccaacccacugugaacugg

SEQ ID NO: 597578 - RNA, 19 nt, Human
acugaaugcaccccaaccc

SEQ ID NO: 597579 - RNA, 18 nt, Human
acuuggaaccaacugaug

SEQ ID NO: 597580 - RNA, 24 nt, Human
agaaaauaaaaacuuucuaaaggg

SEQ ID NO: 597581 - RNA, 19 nt, Human
agaaggcaaaguuccaaac

SEQ ID NO: 597582 - RNA, 19 nt, Human
agcugaucuaacauacuug

SEQ ID NO: 597583 - RNA, 24 nt, Human
aggcuguuaacaaauguuaagugg

SEQ ID NO: 597584 - RNA, 20 nt, Human
aguucagcucucucaugucu

SEQ ID NO: 597585 - RNA, 25 nt, Human
aucauauaaacaucagguguuacca

SEQ ID NO: 597586 - RNA, 24 nt, Human
augaucccauaaaaaaugccaaaa

SEQ ID NO: 597587 - RNA, 21 nt, Human
auugcuuuuuaaguuuccuau

SEQ ID NO: 597588 - RNA, 23 nt, Human
caaaagcuccaugaaaucaguaa

SEQ ID NO: 597589 - RNA, 20 nt, Human
caacucuaauauaaacauua

SEQ ID NO: 597590 - RNA, 21 nt, Human
caacugaugaucccauaaaaa

SEQ ID NO: 597591 - RNA, 24 nt, Human
caagggaacuuuucugcaagacca

SEQ ID NO: 597592 - RNA, 25 nt, Human
caauagaaucaaagcaacucaauga

SEQ ID NO: 597593 - RNA, 22 nt, Human
cacagcuuuguagcacagcauu

SEQ ID NO: 597594 - RNA, 22 nt, Human
cacucuauuccgcugccugggc

SEQ ID NO: 597595 - RNA, 22 nt, Human
cacucuauuccgcugccugggc

SEQ ID NO: 597596 - RNA, 20 nt, Human
cagcuuaaaaaguaaugucc

SEQ ID NO: 597597 - RNA, 25 nt, Human
caggcuguuaacaaauguuaagugg

SEQ ID NO: 597598 - RNA, 21 nt, Human
cauuucaacagucuggccuau

SEQ ID NO: 597599 - RNA, 26 nt, Human
ccauaaccaugcuacuacagucuguu

SEQ ID NO: 597600 - RNA, 21 nt, Human
cccaaaagccacauucauucc

SEQ ID NO: 597601 - RNA, 19 nt, Human
cccacgcacagcgagccgc

SEQ ID NO: 597602 - RNA, 18 nt, Human
ccccaaagauggacuacu

SEQ ID NO: 597603 - RNA, 22 nt, Human
cccccaaaagccacauucauuc

SEQ ID NO: 597604 - RNA, 20 nt, Human
ccucccacgcacagcgagcu

SEQ ID NO: 597605 - RNA, 21 nt, Human
cgauccgcgggccgagcgcgg

SEQ ID NO: 597606 - RNA, 21 nt, Human
cgcccagcuccucuucagcgg

SEQ ID NO: 597607 - RNA, 19 nt, Human
cucgcgcccucccacgcac

SEQ ID NO: 597608 - RNA, 19 nt, Human
cucuauuaaaacuaauugg

SEQ ID NO: 597609 - RNA, 24 nt, Human
cucuugcaccaccuccuccacuuc

SEQ ID NO: 597610 - RNA, 18 nt, Human
cugaugaucccauaaaaa

SEQ ID NO: 597611 - RNA, 23 nt, Human
cuggaaaaacagagaacuagaaa

SEQ ID NO: 597612 - RNA, 27 nt, Human
cuuuugcccccaaaagccacauucauu

SEQ ID NO: 597613 - RNA, 22 nt, Human
gaaauccgaagcacgauuccuc

SEQ ID NO: 597614 - RNA, 21 nt, Human
gacccuguuuccuugguuaac

SEQ ID NO: 597615 - RNA, 24 nt, Human
gagcgcggccgggcggccggcgcc

SEQ ID NO: 597616 - RNA, 21 nt, Human
gauaccacugacagcuuaaaa

SEQ ID NO: 597617 - RNA, 19 nt, Human
ggaaagguucuuucaaggg

SEQ ID NO: 597618 - RNA, 19 nt, Human
gggcgcgggccucccgcgc

SEQ ID NO: 597619 - RNA, 23 nt, Human
guugaacaacuaguuauuuuuac

SEQ ID NO: 597620 - RNA, 20 nt, Human
uaaaaguccuuacugaauau

SEQ ID NO: 597621 - RNA, 24 nt, Human
uaaaugaauaucugaauuuuacaa

SEQ ID NO: 597622 - RNA, 22 nt, Human
uaacaaauguuaagugggaaaa

SEQ ID NO: 597623 - RNA, 19 nt, Human
uaagaaggcaaaguuccaa

SEQ ID NO: 597624 - RNA, 23 nt, Human
uagaaucaaagcaacucaaugac

SEQ ID NO: 597625 - RNA, 21 nt, Human
uaggaaaaguugaacaacuag

SEQ ID NO: 597626 - RNA, 21 nt, Human
uaggagaaaauaaagacaaug

SEQ ID NO: 597627 - RNA, 21 nt, Human
uaguuauuuuuacuucaguua

SEQ ID NO: 597628 - RNA, 21 nt, Human
ucccucuugcaccaccuccuc

SEQ ID NO: 597629 - RNA, 21 nt, Human
uccgcgggccgagcgcggccg

SEQ ID NO: 597630 - RNA, 19 nt, Human
uccguguauauauagguga

SEQ ID NO: 597631 - RNA, 20 nt, Human
uccuccacuucaguucagcu

SEQ ID NO: 597632 - RNA, 18 nt, Human
ucgccaggggccggggcc

SEQ ID NO: 597633 - RNA, 18 nt, Human
ugaaaucaguaagguaaa

SEQ ID NO: 597634 - RNA, 24 nt, Human
ugaagccuucauuuuauuucuaaa

SEQ ID NO: 597635 - RNA, 26 nt, Human
ugcagccaagcacugcacucuauucc

SEQ ID NO: 597636 - RNA, 24 nt, Human
ugccaaaaauccaauagaaucaaa

SEQ ID NO: 597637 - RNA, 21 nt, Human
uggaaaaacagagaacuagaa

SEQ ID NO: 597638 - RNA, 23 nt, Human
uggaaaaacagagaacuagaaaa

SEQ ID NO: 597639 - RNA, 23 nt, Human
uggcacaaaaaacacauggugac

SEQ ID NO: 597640 - RNA, 22 nt, Human
ugucuuccaccaagaggacaug

SEQ ID NO: 597641 - RNA, 20 nt, Human
uuacucaugaaaaacagccc

SEQ ID NO: 597642 - RNA, 18 nt, Human
uucagagauagauugucc

SEQ ID NO: 597643 - RNA, 23 nt, Human
uuccaaacaggguuacacaggag

SEQ ID NO: 597644 - RNA, 22 nt, Human
uugcaccaccuccuccacuuca

SEQ ID NO: 597645 - RNA, 22 nt, Human
aaccaauugccuuuaaaaccuu

SEQ ID NO: 597646 - RNA, 22 nt, Human
aacuuucuucacagcugccuca

SEQ ID NO: 597647 - RNA, 21 nt, Human
aaucauggucaaccagauguu

SEQ ID NO: 597648 - RNA, 20 nt, Human
agagucaucagugcccauga

SEQ ID NO: 597649 - RNA, 18 nt, Human
agcugccucauaaaguuu

SEQ ID NO: 597650 - RNA, 21 nt, Human
caaccagauguugcuuuugcc

SEQ ID NO: 597651 - RNA, 21 nt, Human
cugaauugccauuuuauuauu

SEQ ID NO: 597652 - RNA, 23 nt, Human
cugcagugaguugucaucugugg

SEQ ID NO: 597653 - RNA, 23 nt, Human
gauggugucauauucuguugcag

SEQ ID NO: 597654 - RNA, 20 nt, Human
uaacuaacuccggucggugc

SEQ ID NO: 597655 - RNA, 21 nt, Human
uaacuccggucggugcaucuc

SEQ ID NO: 597656 - RNA, 22 nt, Human
ucaaccagauguugcuuuugcc

SEQ ID NO: 597657 - RNA, 20 nt, Human
ucagugccugcagugaguug

SEQ ID NO: 597658 - RNA, 18 nt, Human
uccucacuauugggaacu

SEQ ID NO: 597659 - RNA, 24 nt, Human
ucguuaggguccugcacauggccc

SEQ ID NO: 597660 - RNA, 19 nt, Human
ucucuguaaaccaauugcc

SEQ ID NO: 597661 - RNA, 20 nt, Human
ugugcaagaguaaaggcuuc

SEQ ID NO: 597662 - RNA, 20 nt, Human
uuaaaaccuuagcacaauga

SEQ ID NO: 597663 - RNA, 24 nt, Human
aaaaagaagucauagucaucugaa

SEQ ID NO: 597664 - RNA, 21 nt, Human
aaaaaugaaguccucaccauc

SEQ ID NO: 597665 - RNA, 23 nt, Human
aaacacaaauauccaaugugaac

SEQ ID NO: 597666 - RNA, 25 nt, Human
aaacaggaugcaaaucagaaaacaa

SEQ ID NO: 597667 - RNA, 19 nt, Human
aacaguauucuaaaaaacc

SEQ ID NO: 597668 - RNA, 22 nt, Human
aauacuggagaaugugccaugc

SEQ ID NO: 597669 - RNA, 18 nt, Human
acaaaaccaaggaagaaa

SEQ ID NO: 597670 - RNA, 20 nt, Human
acugcaagguacagcaaaac

SEQ ID NO: 597671 - RNA, 22 nt, Human
acuuuuuuuuuuuuuuuuuuuu

SEQ ID NO: 597672 - RNA, 18 nt, Human
agaugcaacacugcugac

SEQ ID NO: 597673 - RNA, 22 nt, Human
agaugcaacacugcugacacag

SEQ ID NO: 597674 - RNA, 21 nt, Human
agccaagagaacaaaaccaag

SEQ ID NO: 597675 - RNA, 18 nt, Human
agcugacuuaacugcaau

SEQ ID NO: 597676 - RNA, 19 nt, Human
aggaacuuuuuuuuuuuuu

SEQ ID NO: 597677 - RNA, 22 nt, Human
aggaacuuuuuuuuuuuuuuuu

SEQ ID NO: 597678 - RNA, 22 nt, Human
aggaagaaaagauaauuuggga

SEQ ID NO: 597679 - RNA, 21 nt, Human
agucaucugaagucaacacaa

SEQ ID NO: 597680 - RNA, 24 nt, Human
auccacuuuucuacaggaaacaga

SEQ ID NO: 597681 - RNA, 24 nt, Human
aucucauuucucauccuuaagcaa

SEQ ID NO: 597682 - RNA, 23 nt, Human
caaagcugcaaaacacuaaacuu

SEQ ID NO: 597683 - RNA, 21 nt, Human
caaaucagaaaacaauuucac

SEQ ID NO: 597684 - RNA, 24 nt, Human
caaaucagaaaacaauuucacuua

SEQ ID NO: 597685 - RNA, 18 nt, Human
caagagaacaaaaccaag

SEQ ID NO: 597686 - RNA, 18 nt, Human
caagaucagaaaacucac

SEQ ID NO: 597687 - RNA, 24 nt, Human
caagccaagagaacaaaaccaagg

SEQ ID NO: 597688 - RNA, 20 nt, Human
cacuuaagguuugcuuggca

SEQ ID NO: 597689 - RNA, 20 nt, Human
cauaaaguuuucuuggcuca

SEQ ID NO: 597690 - RNA, 25 nt, Human
ccaggaacuuuuuuuuuuuuuuuuu

SEQ ID NO: 597691 - RNA, 25 nt, Human
ccaugagacaagguagcaucuguaa

SEQ ID NO: 597692 - RNA, 23 nt, Human
cccacugggcauucccauaauaa

SEQ ID NO: 597693 - RNA, 21 nt, Human
cccaggaacuuuuuuuuuuuu

SEQ ID NO: 597694 - RNA, 21 nt, Human
ccuacaagugaaaaagguaga

SEQ ID NO: 597695 - RNA, 21 nt, Human
ccugucuuuccuagccuuaac

SEQ ID NO: 597696 - RNA, 23 nt, Human
cuagaaccaauucuugauacuau

SEQ ID NO: 597697 - RNA, 24 nt, Human
cuagccuuaacaaacaaaauucca

SEQ ID NO: 597698 - RNA, 24 nt, Human
cucaaggauuuuucccguaguugc

SEQ ID NO: 597699 - RNA, 19 nt, Human
gaaaaagguagaacucgga

SEQ ID NO: 597700 - RNA, 18 nt, Human
gaacuacugcaggcaagg

SEQ ID NO: 597701 - RNA, 23 nt, Human
gaacucaucaaugacccaccccc

SEQ ID NO: 597702 - RNA, 18 nt, Human
gaacucggaacacugcaa

SEQ ID NO: 597703 - RNA, 18 nt, Human
gaaguauaucucccacug

SEQ ID NO: 597704 - RNA, 19 nt, Human
ggaacuuuuuuuuuuuuuu

SEQ ID NO: 597705 - RNA, 19 nt, Human
ggaacuuuuuuuuuuuuuu

SEQ ID NO: 597706 - RNA, 24 nt, Human
guccuuuucuguucccagcauuuu

SEQ ID NO: 597707 - RNA, 23 nt, Human
uaaagaaugauuauuaaaaguca

SEQ ID NO: 597708 - RNA, 26 nt, Human
uaacaaacaaaauuccauaccauccu

SEQ ID NO: 597709 - RNA, 23 nt, Human
uaacugcaaugacuucuugagga

SEQ ID NO: 597710 - RNA, 21 nt, Human
uaagaacucaucaaugaccca

SEQ ID NO: 597711 - RNA, 19 nt, Human
uaagaacuucuucugggac

SEQ ID NO: 597712 - RNA, 21 nt, Human
uacagcaagaguuuaaaaaag

SEQ ID NO: 597713 - RNA, 27 nt, Human
uagaaacacaaauauccaaugugaaca

SEQ ID NO: 597714 - RNA, 23 nt, Human
uagaauggugagaugagaacauc

SEQ ID NO: 597715 - RNA, 22 nt, Human
uagccuuaacaaacaaaauucc

SEQ ID NO: 597716 - RNA, 21 nt, Human
uauccaaugugaacaucaagc

SEQ ID NO: 597717 - RNA, 23 nt, Human
ucaaaauauauucuuccucucuc

SEQ ID NO: 597718 - RNA, 26 nt, Human
ucaagccaagagaacaaaaccaagga

SEQ ID NO: 597719 - RNA, 19 nt, Human
ucagaugcaacacugcuga

SEQ ID NO: 597720 - RNA, 20 nt, Human
ucagaugcaacacugcugac

SEQ ID NO: 597721 - RNA, 23 nt, Human
ucauaggcuauaggugaccugga

SEQ ID NO: 597722 - RNA, 21 nt, Human
uccacuuuucuacaggaaaca

SEQ ID NO: 597723 - RNA, 19 nt, Human
ucccaagcuaguaagaacu

SEQ ID NO: 597724 - RNA, 24 nt, Human
ucccacugggcauucccauaauaa

SEQ ID NO: 597725 - RNA, 19 nt, Human
ucccugucuuuccuagccu

SEQ ID NO: 597726 - RNA, 21 nt, Human
uccuuuucuguucccagcauu

SEQ ID NO: 597727 - RNA, 21 nt, Human
ucggaacacugcaagguacag

SEQ ID NO: 597728 - RNA, 28 nt, Human
ucucccugucuuuccuagccuuaacaaa

SEQ ID NO: 597729 - RNA, 19 nt, Human
ugaaaaagguagaacucgg

SEQ ID NO: 597730 - RNA, 19 nt, Human
ugacccaccccaucaauga

SEQ ID NO: 597731 - RNA, 24 nt, Human
ugacuucuugaggagugucccucc

SEQ ID NO: 597732 - RNA, 22 nt, Human
ugccgggccacugcugagccuc

SEQ ID NO: 597733 - RNA, 22 nt, Human
ugccuaaacaagaucagaaaac

SEQ ID NO: 597734 - RNA, 18 nt, Human
ugccugccgggccacugc

SEQ ID NO: 597735 - RNA, 24 nt, Human
uggaagcuauagagucugaccagu

SEQ ID NO: 597736 - RNA, 21 nt, Human
uggcucagaugcaacacugcu

SEQ ID NO: 597737 - RNA, 19 nt, Human
ugucucucccugucuuucc

SEQ ID NO: 597738 - RNA, 18 nt, Human
ugugaugacacauuuugg

SEQ ID NO: 597739 - RNA, 18 nt, Human
uguucugagcugacuuaa

SEQ ID NO: 597740 - RNA, 24 nt, Human
uuagaucuuuccuaacaaagaaga

SEQ ID NO: 597741 - RNA, 20 nt, Human
uucccauaauaaagcauccu

SEQ ID NO: 597742 - RNA, 24 nt, Human
uuccuagccuuaacaaacaaaauu

SEQ ID NO: 597743 - RNA, 21 nt, Human
uugucucucccugucuuuccu

SEQ ID NO: 597744 - RNA, 22 nt, Human
uuuaagaacucaucaaugaccc

SEQ ID NO: 597745 - RNA, 19 nt, Human
uuuaguacuuuccgggaaa

SEQ ID NO: 597746 - RNA, 20 nt, Human
aaaaagaagaaggaaaaugg

SEQ ID NO: 597747 - RNA, 19 nt, Human
aaaaggaaggggaguggag

SEQ ID NO: 597748 - RNA, 23 nt, Human
aacaagcaaacacuagccaggua

SEQ ID NO: 597749 - RNA, 26 nt, Human
aacuugcaagauuucaccucuccccu

SEQ ID NO: 597750 - RNA, 21 nt, Human
aagaauacgauagauguccuc

SEQ ID NO: 597751 - RNA, 20 nt, Human
aagagacaggcagcugauga

SEQ ID NO: 597752 - RNA, 22 nt, Human
aagaucacuccagaacaagcaa

SEQ ID NO: 597753 - RNA, 24 nt, Human
aaggguucacugauuggcuucuca

SEQ ID NO: 597754 - RNA, 18 nt, Human
aaucaccugaggucagga

SEQ ID NO: 597755 - RNA, 24 nt, Human
aaucaccugaggucaggaguucga

SEQ ID NO: 597756 - RNA, 20 nt, Human
acaagcagaggaccuagaac

SEQ ID NO: 597757 - RNA, 23 nt, Human
acaggacucaacagccacgcuca

SEQ ID NO: 597758 - RNA, 21 nt, Human
accccuuuuuuccuuacccaa

SEQ ID NO: 597759 - RNA, 24 nt, Human
acccuguauaccuuucccagaaua

SEQ ID NO: 597760 - RNA, 24 nt, Human
accugaggucaggaguucgagacc

SEQ ID NO: 597761 - RNA, 22 nt, Human
acuccagaacaagcaaacacua

SEQ ID NO: 597762 - RNA, 20 nt, Human
acuguguggugggagagggu

SEQ ID NO: 597763 - RNA, 27 nt, Human
agaagaaggaaaauggacuuuaaagag

SEQ ID NO: 597764 - RNA, 22 nt, Human
agaaguguuugguucugcucag

SEQ ID NO: 597765 - RNA, 18 nt, Human
agacaggacucaacagcc

SEQ ID NO: 597766 - RNA, 20 nt, Human
agacaggacucaacagccac

SEQ ID NO: 597767 - RNA, 21 nt, Human
agaguugcucaggcagacagc

SEQ ID NO: 597768 - RNA, 22 nt, Human
agauguccucaaaugggggcuu

SEQ ID NO: 597769 - RNA, 20 nt, Human
agcacuuugggagggugagg

SEQ ID NO: 597770 - RNA, 21 nt, Human
agcauggacaauagccaagaa

SEQ ID NO: 597771 - RNA, 23 nt, Human
aggaguucgagaccagccaggac

SEQ ID NO: 597772 - RNA, 22 nt, Human
aggccggcgaaucaccugaggu

SEQ ID NO: 597773 - RNA, 26 nt, Human
aggccggcgaaucaccugaggucagg

SEQ ID NO: 597774 - RNA, 19 nt, Human
aggcgggugggguauagga

SEQ ID NO: 597775 - RNA, 19 nt, Human
aggcuaaaauggaagggua

SEQ ID NO: 597776 - RNA, 21 nt, Human
agggagcagagucaguuggaa

SEQ ID NO: 597777 - RNA, 21 nt, Human
agggguuuccugugugcucuu

SEQ ID NO: 597778 - RNA, 21 nt, Human
aucaccugaggucaggaguuc

SEQ ID NO: 597779 - RNA, 24 nt, Human
aucaccugaggucaggaguucgag

SEQ ID NO: 597780 - RNA, 24 nt, Human
aucacuccagaacaagcaaacacu

SEQ ID NO: 597781 - RNA, 19 nt, Human
augccuguaaucccagcac

SEQ ID NO: 597782 - RNA, 22 nt, Human
auggccagcaaaccuggccugg

SEQ ID NO: 597783 - RNA, 26 nt, Human
auuuucugucucucccaccccuuuuu

SEQ ID NO: 597784 - RNA, 25 nt, Human
caaaucccagguggagagccaaggg

SEQ ID NO: 597785 - RNA, 23 nt, Human
cacaagcagaggaccuagaacaa

SEQ ID NO: 597786 - RNA, 20 nt, Human
caccaagaaaaggaagggga

SEQ ID NO: 597787 - RNA, 23 nt, Human
caccaagaaaaggaaggggagug

SEQ ID NO: 597788 - RNA, 23 nt, Human
caccccuuuuuuccuuacccaaa

SEQ ID NO: 597789 - RNA, 23 nt, Human
caccucuacuguaccccaaucau

SEQ ID NO: 597790 - RNA, 23 nt, Human
caccugaggucaggaguucgaga

SEQ ID NO: 597791 - RNA, 31 nt, Human
cacuccagaacaagcaaacacuagccagggg

SEQ ID NO: 597792 - RNA, 18 nt, Human
cagaacaagcaaacacua

SEQ ID NO: 597793 - RNA, 22 nt, Human
cagaacaagcaaacacuagcca

SEQ ID NO: 597794 - RNA, 28 nt, Human
cagaagaucacuccagaacaagcaaaca

SEQ ID NO: 597795 - RNA, 25 nt, Human
cagauccaagguagagccaaaucuu

SEQ ID NO: 597796 - RNA, 20 nt, Human
cagcacuuugggagggugag

SEQ ID NO: 597797 - RNA, 21 nt, Human
cagcacuuugggagggugagg

SEQ ID NO: 597798 - RNA, 21 nt, Human
cagcagaugggcaaauuuucu

SEQ ID NO: 597799 - RNA, 21 nt, Human
cagccccucauucccgccuua

SEQ ID NO: 597800 - RNA, 21 nt, Human
caggcagacagcucuucaagg

SEQ ID NO: 597801 - RNA, 20 nt, Human
caucuaagagacaggcagcu

SEQ ID NO: 597802 - RNA, 20 nt, Human
caugccuguaaucccagcac

SEQ ID NO: 597803 - RNA, 24 nt, Human
caugccuguaaucccagcacuuug

SEQ ID NO: 597804 - RNA, 24 nt, Human
cauuauagccgcauaauucaugcc

SEQ ID NO: 597805 - RNA, 23 nt, Human
cauucauuaucaggaaaggaggu

SEQ ID NO: 597806 - RNA, 27 nt, Human
cauuguaaagcuguaaaauguacagca

SEQ ID NO: 597807 - RNA, 24 nt, Human
ccaaaaaaaaaaaaaaaaaaagaa

SEQ ID NO: 597808 - RNA, 22 nt, Human
ccaaacccuauuggugaccaga

SEQ ID NO: 597809 - RNA, 22 nt, Human
ccaaagagagaugccagcccca

SEQ ID NO: 597810 - RNA, 18 nt, Human
ccacuacaucgccuccug

SEQ ID NO: 597811 - RNA, 18 nt, Human
ccagcaaaccuggccugg

SEQ ID NO: 597812 - RNA, 22 nt, Human
ccagguggagagccaaggggga

SEQ ID NO: 597813 - RNA, 22 nt, Human
ccccaaucauauuacggaaagu

SEQ ID NO: 597814 - RNA, 24 nt, Human
ccccuuuuuuccuuacccaaauca

SEQ ID NO: 597815 - RNA, 25 nt, Human
cccucaauccuccucaggagccugu

SEQ ID NO: 597816 - RNA, 24 nt, Human
ccggcgaaucaccugaggucagga

SEQ ID NO: 597817 - RNA, 20 nt, Human
ccgggacagaaaggggaaga

SEQ ID NO: 597818 - RNA, 26 nt, Human
ccuacaggcccuucuguuacccugaa

SEQ ID NO: 597819 - RNA, 21 nt, Human
ccucaaaugggggcuuggcuc

SEQ ID NO: 597820 - RNA, 23 nt, Human
ccucuacuguaccccaaucauau

SEQ ID NO: 597821 - RNA, 22 nt, Human
ccugaggucaggaguucgagac

SEQ ID NO: 597822 - RNA, 19 nt, Human
ccuucuguuacccugaacc

SEQ ID NO: 597823 - RNA, 24 nt, Human
cgaaucaccugaggucaggaguuc

SEQ ID NO: 597824 - RNA, 27 nt, Human
cgaaucaccugaggucaggaguucgag

SEQ ID NO: 597825 - RNA, 25 nt, Human
cucacaagcagaggaccuagaacaa

SEQ ID NO: 597826 - RNA, 24 nt, Human
cucaggccaaagagagaugccagc

SEQ ID NO: 597827 - RNA, 23 nt, Human
cucaugccuguaaucccagcacu

SEQ ID NO: 597828 - RNA, 24 nt, Human
cucaugccuguaaucccagcacuu

SEQ ID NO: 597829 - RNA, 18 nt, Human
cuccagaacaagcaaaca

SEQ ID NO: 597830 - RNA, 22 nt, Human
cugccugccuauuaguuauuua

SEQ ID NO: 597831 - RNA, 23 nt, Human
cugcugggcgacgacgacgaccu

SEQ ID NO: 597832 - RNA, 21 nt, Human
cuucaagggcacuaauccucu

SEQ ID NO: 597833 - RNA, 26 nt, Human
cuugcuacaacuugcaagauuucacc

SEQ ID NO: 597834 - RNA, 20 nt, Human
cuuugggagggugaggccgg

SEQ ID NO: 597835 - RNA, 22 nt, Human
gaacaagcaaacacuagccagg

SEQ ID NO: 597836 - RNA, 23 nt, Human
gaaucaccugaggucaggaguuc

SEQ ID NO: 597837 - RNA, 25 nt, Human
gaaucaccugaggucaggaguucga

SEQ ID NO: 597838 - RNA, 25 nt, Human
gagaacucuucccugaaauucugug

SEQ ID NO: 597839 - RNA, 23 nt, Human
gaggaccuagaacaagcuuugcc

SEQ ID NO: 597840 - RNA, 18 nt, Human
gaggagcagcagaugggc

SEQ ID NO: 597841 - RNA, 19 nt, Human
gaggagcagcagaugggca

SEQ ID NO: 597842 - RNA, 22 nt, Human
gcaaaucccagguggagagcca

SEQ ID NO: 597843 - RNA, 19 nt, Human
gcagagggcagggcaaagu

SEQ ID NO: 597844 - RNA, 20 nt, Human
gccaagggggaggagcagcg

SEQ ID NO: 597845 - RNA, 24 nt, Human
gccccauuaaucaccucuacugua

SEQ ID NO: 597846 - RNA, 19 nt, Human
gcuagggaaacagcuugca

SEQ ID NO: 597847 - RNA, 24 nt, Human
ggaaaggacacagcuuugacccuc

SEQ ID NO: 597848 - RNA, 22 nt, Human
ggaaggggaguggagcccugga

SEQ ID NO: 597849 - RNA, 23 nt, Human
ggacagaaaggggaagaggcggg

SEQ ID NO: 597850 - RNA, 18 nt, Human
ggagcagcagaugggcaa

SEQ ID NO: 597851 - RNA, 19 nt, Human
ggagcugcuagggaaacag

SEQ ID NO: 597852 - RNA, 22 nt, Human
ggcagggagcagagucaguugg

SEQ ID NO: 597853 - RNA, 20 nt, Human
ggcagggcaaaguggcaggu

SEQ ID NO: 597854 - RNA, 21 nt, Human
ggccuacuuagggagccaggu

SEQ ID NO: 597855 - RNA, 19 nt, Human
ggcuuugccaaaggguuca

SEQ ID NO: 597856 - RNA, 20 nt, Human
gggaacaccauucauuaucc

SEQ ID NO: 597857 - RNA, 18 nt, Human
gggaggagcagcagaugg

SEQ ID NO: 597858 - RNA, 20 nt, Human
gggcuuugccaaaggguuca

SEQ ID NO: 597859 - RNA, 19 nt, Human
ggggaagaggcgggugggg

SEQ ID NO: 597860 - RNA, 21 nt, Human
ggggccagucucauuugggag

SEQ ID NO: 597861 - RNA, 19 nt, Human
gguaagggaaaggacacag

SEQ ID NO: 597862 - RNA, 24 nt, Human
gguggcucaugccuguaaucccag

SEQ ID NO: 597863 - RNA, 21 nt, Human
guaaagcuguaaaauguacag

SEQ ID NO: 597864 - RNA, 19 nt, Human
gucuggcaugguggcucau

SEQ ID NO: 597865 - RNA, 21 nt, Human
gugccagguguggaugggggc

SEQ ID NO: 597866 - RNA, 21 nt, Human
gugcugagucuuucagugagc

SEQ ID NO: 597867 - RNA, 19 nt, Human
guggagugggaaucagagu

SEQ ID NO: 597868 - RNA, 19 nt, Human
uaaaauguacagcaccugc

SEQ ID NO: 597869 - RNA, 23 nt, Human
uaacugccugccuauuaguuauu

SEQ ID NO: 597870 - RNA, 19 nt, Human
uacaggggaggccugugcu

SEQ ID NO: 597871 - RNA, 20 nt, Human
uacccugaaccauggagggg

SEQ ID NO: 597872 - RNA, 20 nt, Human
uaucaggaaaggaggugccu

SEQ ID NO: 597873 - RNA, 23 nt, Human
ucacugauuggcuucucaaucgc

SEQ ID NO: 597874 - RNA, 19 nt, Human
ucauuaucaggaaaggagg

SEQ ID NO: 597875 - RNA, 22 nt, Human
uccaaacccuauuggugaccag

SEQ ID NO: 597876 - RNA, 19 nt, Human
uccaggaacccugugccag

SEQ ID NO: 597877 - RNA, 19 nt, Human
ucccugaaauucugugugu

SEQ ID NO: 597878 - RNA, 20 nt, Human
ucuccaaaaaaaaaaaaaaa

SEQ ID NO: 597879 - RNA, 18 nt, Human
ucuugccgccagguaucc

SEQ ID NO: 597880 - RNA, 21 nt, Human
ugaaauagaguugcucaggca

SEQ ID NO: 597881 - RNA, 18 nt, Human
ugaaccauggagggggcc

SEQ ID NO: 597882 - RNA, 20 nt, Human
ugagagaaaccucgaagagu

SEQ ID NO: 597883 - RNA, 19 nt, Human
ugagaugcugucuccaaaa

SEQ ID NO: 597884 - RNA, 21 nt, Human
ugagauggugagggcagggag

SEQ ID NO: 597885 - RNA, 18 nt, Human
ugaggcaaggguugaacc

SEQ ID NO: 597886 - RNA, 20 nt, Human
ugaggccggcgaaucaccug

SEQ ID NO: 597887 - RNA, 26 nt, Human
ugaggccggcgaaucaccugagguca

SEQ ID NO: 597888 - RNA, 20 nt, Human
ugccaagaauaaaucaucua

SEQ ID NO: 597889 - RNA, 20 nt, Human
ugccuccagccccucauucc

SEQ ID NO: 597890 - RNA, 23 nt, Human
ugccuguaaucccagcacuuugg

SEQ ID NO: 597891 - RNA, 24 nt, Human
ugccuguaaucccagcacuuuggg

SEQ ID NO: 597892 - RNA, 19 nt, Human
ugcuagggaaacagcuugc

SEQ ID NO: 597893 - RNA, 28 nt, Human
ugcugucuccaaaaaaaaaaaaaaaaaa

SEQ ID NO: 597894 - RNA, 22 nt, Human
uggaaggcuaaaauggaagggu

SEQ ID NO: 597895 - RNA, 19 nt, Human
uggagcccuggaggcagag

SEQ ID NO: 597896 - RNA, 22 nt, Human
uggagcccuggaggcagagggc

SEQ ID NO: 597897 - RNA, 24 nt, Human
uggcaugguggcucaugccuguaa

SEQ ID NO: 597898 - RNA, 21 nt, Human
uggccagcaaaccuggccugg

SEQ ID NO: 597899 - RNA, 18 nt, Human
uggccccaugcccugcaa

SEQ ID NO: 597900 - RNA, 22 nt, Human
uggccuggggggcuccccagcc

SEQ ID NO: 597901 - RNA, 22 nt, Human
uggcucaugccuguaaucccag

SEQ ID NO: 597902 - RNA, 24 nt, Human
uggcucaugccuguaaucccagca

SEQ ID NO: 597903 - RNA, 21 nt, Human
ugggaaucagaguuugagaug

SEQ ID NO: 597904 - RNA, 20 nt, Human
uggugagggcagggagcaga

SEQ ID NO: 597905 - RNA, 24 nt, Human
ugguggcucaugccuguaauccca

SEQ ID NO: 597906 - RNA, 23 nt, Human
uggugggagaggguagagauuca

SEQ ID NO: 597907 - RNA, 19 nt, Human
ugguucugcucaguccugu

SEQ ID NO: 597908 - RNA, 23 nt, Human
ugucuggcauuuaugcuugauuc

SEQ ID NO: 597909 - RNA, 24 nt, Human
uguggaagcuggguggaaggcuag

SEQ ID NO: 597910 - RNA, 21 nt, Human
uuccuuacccaaauaacugcc

SEQ ID NO: 597911 - RNA, 26 nt, Human
uucugucucucccaccccuuuuuucc

SEQ ID NO: 597912 - RNA, 18 nt, Human
uugccgguguggggcacc

SEQ ID NO: 597913 - RNA, 22 nt, Human
uugcugccuccagccccucauu

SEQ ID NO: 597914 - RNA, 18 nt, Human
uugcuggcugguacuugc

SEQ ID NO: 597915 - RNA, 20 nt, Human
uuggaagaaguguuugguuc

SEQ ID NO: 597916 - RNA, 25 nt, Human
uugggagggugaggccggcgaauca

SEQ ID NO: 597917 - RNA, 18 nt, Human
acauugcaucuacuuuga

SEQ ID NO: 597918 - RNA, 21 nt, Human
acugcauuuuuugccuucccg

SEQ ID NO: 597919 - RNA, 25 nt, Human
agaaagaaacgacguuuaaaccuaa

SEQ ID NO: 597920 - RNA, 18 nt, Human
auggacuuauaggaugca

SEQ ID NO: 597921 - RNA, 18 nt, Human
auuucacccaugaaaaaa

SEQ ID NO: 597922 - RNA, 21 nt, Human
auuugugggaaaauacaacuu

SEQ ID NO: 597923 - RNA, 24 nt, Human
auuuuuugccuucccggaauauuu

SEQ ID NO: 597924 - RNA, 20 nt, Human
caaauacccucaaaauaaac

SEQ ID NO: 597925 - RNA, 21 nt, Human
cacaaaucgucacgaguacac

SEQ ID NO: 597926 - RNA, 23 nt, Human
cacugcauuuuuugccuucccgg

SEQ ID NO: 597927 - RNA, 19 nt, Human
caggcggcugcugguccag

SEQ ID NO: 597928 - RNA, 22 nt, Human
cauuacucuuaguagucauuca

SEQ ID NO: 597929 - RNA, 19 nt, Human
cgcgggagccccggcgacg

SEQ ID NO: 597930 - RNA, 22 nt, Human
cggcugccgagccccgcguccc

SEQ ID NO: 597931 - RNA, 24 nt, Human
cucaaaauagacuucaacgacauu

SEQ ID NO: 597932 - RNA, 21 nt, Human
guugcuguucuuuaauaugac

SEQ ID NO: 597933 - RNA, 21 nt, Human
uaaauaccauguagaaauaaa

SEQ ID NO: 597934 - RNA, 24 nt, Human
uaauaugaccucauucauacuaua

SEQ ID NO: 597935 - RNA, 19 nt, Human
uaggcaagaaggcaggaga

SEQ ID NO: 597936 - RNA, 24 nt, Human
ucacccaugaaaaaauaaauaccu

SEQ ID NO: 597937 - RNA, 22 nt, Human
ucauucaccaugugauaaaauc

SEQ ID NO: 597938 - RNA, 22 nt, Human
ucauuggaauuguuuugguugu

SEQ ID NO: 597939 - RNA, 22 nt, Human
ucuguaacagaagagggaagac

SEQ ID NO: 597940 - RNA, 20 nt, Human
ugcugguccagcucccccgc

SEQ ID NO: 597941 - RNA, 20 nt, Human
ugcuuuauccuuucauguga

SEQ ID NO: 597942 - RNA, 21 nt, Human
uggcaaguagucauucacaau

SEQ ID NO: 597943 - RNA, 25 nt, Human
uguuaugaacaaauacccucaaaau

SEQ ID NO: 597944 - RNA, 24 nt, Human
uucauauauauuuccuaauuuaaa

SEQ ID NO: 597945 - RNA, 18 nt, Human
uucccggaauauuuuccu

SEQ ID NO: 597946 - RNA, 23 nt, Human
uuuaaaccuaacacauucuucau

SEQ ID NO: 597947 - RNA, 20 nt, Human
uuucauuggaauuguuuugg

SEQ ID NO: 597948 - RNA, 22 nt, Human
uuucugaauuugugaacaaaca

SEQ ID NO: 597949 - RNA, 24 nt, Human
aaaaaaaaaaaaaauugcuaagaa

SEQ ID NO: 597950 - RNA, 22 nt, Human
aaaaacauucaguuguauccuc

SEQ ID NO: 597951 - RNA, 21 nt, Human
aaaaacuaaguaugcaacaga

SEQ ID NO: 597952 - RNA, 24 nt, Human
aaaacagcagaacuucaagggagc

SEQ ID NO: 597953 - RNA, 21 nt, Human
aaacaaggugcucagagugua

SEQ ID NO: 597954 - RNA, 24 nt, Human
aaacagcuucuguuuauccucuca

SEQ ID NO: 597955 - RNA, 19 nt, Human
aaagaguauauucuucuuc

SEQ ID NO: 597956 - RNA, 22 nt, Human
aaagcccccucagagaaugccu

SEQ ID NO: 597957 - RNA, 22 nt, Human
aaaggucaccacccccgccccu

SEQ ID NO: 597958 - RNA, 24 nt, Human
aagauggucaugguugacaagcac

SEQ ID NO: 597959 - RNA, 22 nt, Human
aagcuauucacacaaagccagg

SEQ ID NO: 597960 - RNA, 21 nt, Human
aagcuccuaauccagaaucca

SEQ ID NO: 597961 - RNA, 19 nt, Human
aaguaauaauacagcaugu

SEQ ID NO: 597962 - RNA, 21 nt, Human
acaaaaucaccuucagaggaa

SEQ ID NO: 597963 - RNA, 20 nt, Human
acagaacaugagcaaacagc

SEQ ID NO: 597964 - RNA, 20 nt, Human
acagcuucuguuuauccucu

SEQ ID NO: 597965 - RNA, 23 nt, Human
acaggacuaaaaacuaaguaugc

SEQ ID NO: 597966 - RNA, 23 nt, Human
accaaccucagaagacuuaaagg

SEQ ID NO: 597967 - RNA, 22 nt, Human
accacccccgccccuacuaccu

SEQ ID NO: 597968 - RNA, 22 nt, Human
acccccgccccuacuaccuuuc

SEQ ID NO: 597969 - RNA, 20 nt, Human
acugagcgcgcccgccgccc

SEQ ID NO: 597970 - RNA, 19 nt, Human
agcacaaagaaaacauuuu

SEQ ID NO: 597971 - RNA, 22 nt, Human
agccgccgccagacugagcgcg

SEQ ID NO: 597972 - RNA, 23 nt, Human
agcgcuucaaacuuuuuuuggca

SEQ ID NO: 597973 - RNA, 31 nt, Human
aggcagagaagaaacauucuguggauccggg

SEQ ID NO: 597974 - RNA, 24 nt, Human
aguuguauuuggaagcuuuauaag

SEQ ID NO: 597975 - RNA, 28 nt, Human
auaaauccuuaaaaguggaaggggagag

SEQ ID NO: 597976 - RNA, 24 nt, Human
auaagcacaaguccacaucucacc

SEQ ID NO: 597977 - RNA, 18 nt, Human
aucucagcagcauagggg

SEQ ID NO: 597978 - RNA, 19 nt, Human
augaagcacauccuuugcc

SEQ ID NO: 597979 - RNA, 25 nt, Human
auucuguggauccggugcuguuggc

SEQ ID NO: 597980 - RNA, 20 nt, Human
caaaacagcagaacuucaaa

SEQ ID NO: 597981 - RNA, 20 nt, Human
caaaacagcagaacuucaac

SEQ ID NO: 597982 - RNA, 21 nt, Human
caaaacagcagaacuucaacc

SEQ ID NO: 597983 - RNA, 21 nt, Human
caaaguauaaguaccaagaac

SEQ ID NO: 597984 - RNA, 31 nt, Human
caaagugagcaagcuauucacacaaagccaa

SEQ ID NO: 597985 - RNA, 23 nt, Human
caaauuacaaaaucaccuucaga

SEQ ID NO: 597986 - RNA, 28 nt, Human
caagaacaaagaaaguuguaaaaaaugc

SEQ ID NO: 597987 - RNA, 23 nt, Human
cacaaugccauuuaaaccagauu

SEQ ID NO: 597988 - RNA, 18 nt, Human
caccacccccgccccuac

SEQ ID NO: 597989 - RNA, 18 nt, Human
cacccccgccccuacuac

SEQ ID NO: 597990 - RNA, 22 nt, Human
cacuacauguacacuuacaggc

SEQ ID NO: 597991 - RNA, 24 nt, Human
caggacuaaaaacuaaguaugcaa

SEQ ID NO: 597992 - RNA, 23 nt, Human
cauuauauuaaaagccaaaagcc

SEQ ID NO: 597993 - RNA, 19 nt, Human
ccagaauccagggaggaga

SEQ ID NO: 597994 - RNA, 19 nt, Human
ccccucagagaaugccuua

SEQ ID NO: 597995 - RNA, 18 nt, Human
ccccugaccucucaucac

SEQ ID NO: 597996 - RNA, 19 nt, Human
ccgccgccagacugagcgc

SEQ ID NO: 597997 - RNA, 23 nt, Human
ccgccgccagacugagcgcgccc

SEQ ID NO: 597998 - RNA, 26 nt, Human
ccgccgccagacugagcgcgcccgcc

SEQ ID NO: 597999 - RNA, 23 nt, Human
ccucagagaaugccuuauucccc

SEQ ID NO: 598000 - RNA, 22 nt, Human
ccuguuuauaguugacugacag

SEQ ID NO: 598001 - RNA, 19 nt, Human
cgaacaaauacaauccaaa

SEQ ID NO: 598002 - RNA, 19 nt, Human
cgacucccuagucaacacu

SEQ ID NO: 598003 - RNA, 22 nt, Human
cgcuucaaacuuuuuuuggcau

SEQ ID NO: 598004 - RNA, 18 nt, Human
cggcaaaaaaaaaaaaaa

SEQ ID NO: 598005 - RNA, 18 nt, Human
cggcucagcucucagugg

SEQ ID NO: 598006 - RNA, 24 nt, Human
cuacuaagcaauccaggcuuguau

SEQ ID NO: 598007 - RNA, 28 nt, Human
cuagagcccaccauuuugauuguuacac

SEQ ID NO: 598008 - RNA, 24 nt, Human
cuucaaacuuuuuuuggcauaguu

SEQ ID NO: 598009 - RNA, 18 nt, Human
gaaacaccaacucgaagc

SEQ ID NO: 598010 - RNA, 19 nt, Human
gaaggggagagagaaaagg

SEQ ID NO: 598011 - RNA, 24 nt, Human
gagaaugccuuauuccccuacuaa

SEQ ID NO: 598012 - RNA, 21 nt, Human
gcacacucaaagcacacccag

SEQ ID NO: 598013 - RNA, 19 nt, Human
gcuaagaagcuguguaagc

SEQ ID NO: 598014 - RNA, 24 nt, Human
ggaaaauuaccaaccucagaagac

SEQ ID NO: 598015 - RNA, 18 nt, Human
gggacuacagacaugaac

SEQ ID NO: 598016 - RNA, 18 nt, Human
gggacuacagacaugaac

SEQ ID NO: 598017 - RNA, 23 nt, Human
gggacuacagacaugaacuagag

SEQ ID NO: 598018 - RNA, 19 nt, Human
guggauccggugcuguugg

SEQ ID NO: 598019 - RNA, 21 nt, Human
uaaaaaaugcuguguuugcau

SEQ ID NO: 598020 - RNA, 19 nt, Human
uaaaagccaaaagccauaa

SEQ ID NO: 598021 - RNA, 19 nt, Human
uaaauccuuaaaaguggaa

SEQ ID NO: 598022 - RNA, 26 nt, Human
uaacaaaacagcagaacuucaaccuu

SEQ ID NO: 598023 - RNA, 22 nt, Human
uaagcuaaacaaguuuugcuag

SEQ ID NO: 598024 - RNA, 20 nt, Human
uaagugcaaacuugauaacc

SEQ ID NO: 598025 - RNA, 23 nt, Human
uacacuguuuguuagaggaugaa

SEQ ID NO: 598026 - RNA, 22 nt, Human
uacaucccuuugaugcacaguc

SEQ ID NO: 598027 - RNA, 18 nt, Human
uaccaagaacaaagaaag

SEQ ID NO: 598028 - RNA, 25 nt, Human
uaccaagaacaaagaaaguuguaaa

SEQ ID NO: 598029 - RNA, 21 nt, Human
uaccucggaccacaaugccau

SEQ ID NO: 598030 - RNA, 28 nt, Human
uagacagaacaccacaccaaccccgggg

SEQ ID NO: 598031 - RNA, 20 nt, Human
uagagcccaccauuuugauu

SEQ ID NO: 598032 - RNA, 22 nt, Human
uagagcgcuucaaacuuuuuuu

SEQ ID NO: 598033 - RNA, 23 nt, Human
uauccucuagacagaacaccaca

SEQ ID NO: 598034 - RNA, 21 nt, Human
uauccucucagccacaaauuc

SEQ ID NO: 598035 - RNA, 24 nt, Human
ucaaaucaaacccuuucuggggug

SEQ ID NO: 598036 - RNA, 25 nt, Human
ucacaaacacauggauagcuuauca

SEQ ID NO: 598037 - RNA, 21 nt, Human
ucacggcagccgccgccagac

SEQ ID NO: 598038 - RNA, 20 nt, Human
ucagcucugggaguguacac

SEQ ID NO: 598039 - RNA, 21 nt, Human
uccaaaaccauucuagagccc

SEQ ID NO: 598040 - RNA, 20 nt, Human
ucccuggaaaagauucagaa

SEQ ID NO: 598041 - RNA, 24 nt, Human
ucccuggaaaagauucagaagcuc

SEQ ID NO: 598042 - RNA, 18 nt, Human
ucccuuuagccucucccc

SEQ ID NO: 598043 - RNA, 19 nt, Human
ucggcaaaaaaaaaaaaaa

SEQ ID NO: 598044 - RNA, 24 nt, Human
ucggcaaaaaaaaaaaaaauugcu

SEQ ID NO: 598045 - RNA, 20 nt, Human
ucggcuaggcugcgggcggc

SEQ ID NO: 598046 - RNA, 18 nt, Human
ucgguggccgaggaugag

SEQ ID NO: 598047 - RNA, 20 nt, Human
ucuacauguucccauccuca

SEQ ID NO: 598048 - RNA, 20 nt, Human
ucucacucacgugguuucgg

SEQ ID NO: 598049 - RNA, 20 nt, Human
ucucgagcuccaaaaccauu

SEQ ID NO: 598050 - RNA, 18 nt, Human
ucucuuaucuuucuaaaa

SEQ ID NO: 598051 - RNA, 26 nt, Human
ucuguaagucagcaaauuaaaaacau

SEQ ID NO: 598052 - RNA, 22 nt, Human
ucuuaguuuguaacuugucugg

SEQ ID NO: 598053 - RNA, 19 nt, Human
ucuuccuuaacagauuuag

SEQ ID NO: 598054 - RNA, 21 nt, Human
ugaaagaaacaccaacucgaa

SEQ ID NO: 598055 - RNA, 22 nt, Human
ugaaagaaacaccaacucgaag

SEQ ID NO: 598056 - RNA, 24 nt, Human
ugaaagaaacaccaacucgaagca

SEQ ID NO: 598057 - RNA, 18 nt, Human
ugaagcgagaucgaagga

SEQ ID NO: 598058 - RNA, 20 nt, Human
ugaagcgagaucgaaggauu

SEQ ID NO: 598059 - RNA, 19 nt, Human
ugacaguaaguucuauaug

SEQ ID NO: 598060 - RNA, 22 nt, Human
ugacaguaaguucuauauggua

SEQ ID NO: 598061 - RNA, 22 nt, Human
ugaccucucaucacacuuuacu

SEQ ID NO: 598062 - RNA, 20 nt, Human
ugaggcugcacacucaaagc

SEQ ID NO: 598063 - RNA, 21 nt, Human
ugaguaacuggguugugacca

SEQ ID NO: 598064 - RNA, 18 nt, Human
uggaaggggagagagaaa

SEQ ID NO: 598065 - RNA, 19 nt, Human
uggaguuguauuuggaagc

SEQ ID NO: 598066 - RNA, 24 nt, Human
uggaguuguauuuggaagcuuuau

SEQ ID NO: 598067 - RNA, 19 nt, Human
uggcagcccuugcaagucc

SEQ ID NO: 598068 - RNA, 24 nt, Human
ugguggguguggggcacagaacau

SEQ ID NO: 598069 - RNA, 24 nt, Human
uguaucaggcauuauaacaaaaca

SEQ ID NO: 598070 - RNA, 22 nt, Human
ugugacucuucucuuuuacugg

SEQ ID NO: 598071 - RNA, 23 nt, Human
ugugacucuucucuuuuacuggg

SEQ ID NO: 598072 - RNA, 19 nt, Human
uuaaacugcugcuaaaggc

SEQ ID NO: 598073 - RNA, 21 nt, Human
uuagguauauuuuccuauacc

SEQ ID NO: 598074 - RNA, 18 nt, Human
uucacauuuuaugucagu

SEQ ID NO: 598075 - RNA, 20 nt, Human
uucccuuuagccucucccca

SEQ ID NO: 598076 - RNA, 23 nt, Human
uuggcucaucucacucacguggu

SEQ ID NO: 598077 - RNA, 21 nt, Human
uuuacugggauguuccccuga

SEQ ID NO: 598078 - RNA, 19 nt, Human
aagaugcuccuggcccguc

SEQ ID NO: 598079 - RNA, 21 nt, Human
aagccagaggcagcaccagga

SEQ ID NO: 598080 - RNA, 21 nt, Human
accaacagaggcucugcaggc

SEQ ID NO: 598081 - RNA, 22 nt, Human
accuccucugccucuccugcca

SEQ ID NO: 598082 - RNA, 20 nt, Human
acuuggucagugaccaggcc

SEQ ID NO: 598083 - RNA, 26 nt, Human
agcaguccccugggaucccucugcuu

SEQ ID NO: 598084 - RNA, 21 nt, Human
agccagaggcagcaccaggac

SEQ ID NO: 598085 - RNA, 20 nt, Human
aggaaagacaaagccagagg

SEQ ID NO: 598086 - RNA, 22 nt, Human
aggcagcaccaggacauggauc

SEQ ID NO: 598087 - RNA, 22 nt, Human
aggcauccucauccccugaaga

SEQ ID NO: 598088 - RNA, 21 nt, Human
aggggcacagaggggcuugag

SEQ ID NO: 598089 - RNA, 22 nt, Human
agguccucuggcuucacagucu

SEQ ID NO: 598090 - RNA, 18 nt, Human
aucucaagagccuuccuc

SEQ ID NO: 598091 - RNA, 19 nt, Human
aucugaagucuccuggccc

SEQ ID NO: 598092 - RNA, 23 nt, Human
augagcagcaaauaccuccagau

SEQ ID NO: 598093 - RNA, 18 nt, Human
augcugggggggugggga

SEQ ID NO: 598094 - RNA, 24 nt, Human
caacauggacucugcucuuggaug

SEQ ID NO: 598095 - RNA, 19 nt, Human
cacugaggaaagacaaagc

SEQ ID NO: 598096 - RNA, 19 nt, Human
cacuguaugcacaggggau

SEQ ID NO: 598097 - RNA, 25 nt, Human
cagagcaaaggcauugaccuccucu

SEQ ID NO: 598098 - RNA, 23 nt, Human
cagcaccaggacauggaucugaa

SEQ ID NO: 598099 - RNA, 23 nt, Human
cagcagcuccagguccucuggcu

SEQ ID NO: 598100 - RNA, 22 nt, Human
caggaagcccagagcaaaggca

SEQ ID NO: 598101 - RNA, 19 nt, Human
caucucaagagccuuccuc

SEQ ID NO: 598102 - RNA, 22 nt, Human
ccacugaggaaagacaaagcca

SEQ ID NO: 598103 - RNA, 19 nt, Human
ccaggacauggaucugaag

SEQ ID NO: 598104 - RNA, 18 nt, Human
ccagggccugagugaagg

SEQ ID NO: 598105 - RNA, 18 nt, Human
ccagguggggacagggaa

SEQ ID NO: 598106 - RNA, 21 nt, Human
ccaguccugcccacugaggaa

SEQ ID NO: 598107 - RNA, 21 nt, Human
ccaucuuuuucucugccucuu

SEQ ID NO: 598108 - RNA, 22 nt, Human
ccccugaagaugcuccuggccc

SEQ ID NO: 598109 - RNA, 21 nt, Human
ccgccgcaucagcagcuccag

SEQ ID NO: 598110 - RNA, 18 nt, Human
ccggggccuggggccggu

SEQ ID NO: 598111 - RNA, 21 nt, Human
ccucugugugucccucagccu

SEQ ID NO: 598112 - RNA, 22 nt, Human
ccuggggccggugguccggggc

SEQ ID NO: 598113 - RNA, 19 nt, Human
ccuuguggggaucuugccg

SEQ ID NO: 598114 - RNA, 19 nt, Human
cggccagcaugagcagcaa

SEQ ID NO: 598115 - RNA, 23 nt, Human
cuaggggcacagaggggcuugag

SEQ ID NO: 598116 - RNA, 18 nt, Human
cucaagagccuuccucuc

SEQ ID NO: 598117 - RNA, 18 nt, Human
cucagagaaggguaaaga

SEQ ID NO: 598118 - RNA, 20 nt, Human
cuccugccagaaacugggcu

SEQ ID NO: 598119 - RNA, 21 nt, Human
cuccuggcccgucagccucag

SEQ ID NO: 598120 - RNA, 22 nt, Human
cucggccccgggcccuccuaac

SEQ ID NO: 598121 - RNA, 22 nt, Human
cucugcaggcucugaagauaag

SEQ ID NO: 598122 - RNA, 22 nt, Human
cugaccaacagaggcucugcag

SEQ ID NO: 598123 - RNA, 19 nt, Human
cugccgccgcaucagcagc

SEQ ID NO: 598124 - RNA, 18 nt, Human
cuggcuucacagucuugc

SEQ ID NO: 598125 - RNA, 24 nt, Human
cuggggggguggggaggagaccug

SEQ ID NO: 598126 - RNA, 19 nt, Human
cugucaccucugugugucc

SEQ ID NO: 598127 - RNA, 20 nt, Human
cugucaccucuguguguccc

SEQ ID NO: 598128 - RNA, 22 nt, Human
cuucuccaccaucucaagagcc

SEQ ID NO: 598129 - RNA, 22 nt, Human
gagcagcugccgguacuccagg

SEQ ID NO: 598130 - RNA, 19 nt, Human
gaggagaccuggagaaaua

SEQ ID NO: 598131 - RNA, 19 nt, Human
gaugaaggaggcagccaca

SEQ ID NO: 598132 - RNA, 18 nt, Human
gaugaugucgccuggccu

SEQ ID NO: 598133 - RNA, 20 nt, Human
gcagcaccaggcgcuggggc

SEQ ID NO: 598134 - RNA, 20 nt, Human
gcaggccaaggcugcauagc

SEQ ID NO: 598135 - RNA, 23 nt, Human
gccccgggcccuccuaaccgccc

SEQ ID NO: 598136 - RNA, 19 nt, Human
gcccugccagaggcauccu

SEQ ID NO: 598137 - RNA, 19 nt, Human
gcccugccagaggcauccu

SEQ ID NO: 598138 - RNA, 21 nt, Human
gcugcccugccagaggcaucc

SEQ ID NO: 598139 - RNA, 24 nt, Human
ggcacagaggggcuugaggaagga

SEQ ID NO: 598140 - RNA, 19 nt, Human
ggcauugaccuccucugcc

SEQ ID NO: 598141 - RNA, 27 nt, Human
ggcccugccgccgcaucagcagcucca

SEQ ID NO: 598142 - RNA, 19 nt, Human
ggccuggagagacucaggg

SEQ ID NO: 598143 - RNA, 18 nt, Human
ggccuggggccggugguc

SEQ ID NO: 598144 - RNA, 19 nt, Human
gggcacagaggggcuugag

SEQ ID NO: 598145 - RNA, 20 nt, Human
gggcccuccuaaccgcccag

SEQ ID NO: 598146 - RNA, 22 nt, Human
ggggaucuugccggggccuggg

SEQ ID NO: 598147 - RNA, 23 nt, Human
ggggguggggaggagaccuggag

SEQ ID NO: 598148 - RNA, 18 nt, Human
ggugcucaggaagcccag

SEQ ID NO: 598149 - RNA, 21 nt, Human
gugcuggaggccgacucugga

SEQ ID NO: 598150 - RNA, 23 nt, Human
ucaagagccuuccucuccauggg

SEQ ID NO: 598151 - RNA, 18 nt, Human
ucagcagcuccagguccu

SEQ ID NO: 598152 - RNA, 19 nt, Human
ucagcagcuccagguccuc

SEQ ID NO: 598153 - RNA, 24 nt, Human
ucagcaguccccugggaucccucu

SEQ ID NO: 598154 - RNA, 18 nt, Human
ucaguccagccuuguggg

SEQ ID NO: 598155 - RNA, 19 nt, Human
ucccucagccucuucuacc

SEQ ID NO: 598156 - RNA, 20 nt, Human
ucccucugcuucugucaccu

SEQ ID NO: 598157 - RNA, 21 nt, Human
uccggggccuagggggaugcc

SEQ ID NO: 598158 - RNA, 22 nt, Human
uccucuggcuucacagucuugc

SEQ ID NO: 598159 - RNA, 23 nt, Human
uccuguugccuccauuucacuca

SEQ ID NO: 598160 - RNA, 19 nt, Human
uccuugugcuccuguugcc

SEQ ID NO: 598161 - RNA, 21 nt, Human
ucggccccgggcccuccuaac

SEQ ID NO: 598162 - RNA, 22 nt, Human
ucugaagucuccuggcccaaca

SEQ ID NO: 598163 - RNA, 21 nt, Human
ugaaggggagagaauacaggc

SEQ ID NO: 598164 - RNA, 20 nt, Human
ugcagcaccaggcgcugggg

SEQ ID NO: 598165 - RNA, 19 nt, Human
ugcagugagacuuggucag

SEQ ID NO: 598166 - RNA, 21 nt, Human
uggaccagcagacccaguccu

SEQ ID NO: 598167 - RNA, 21 nt, Human
uggcucaguccagccuugugg

SEQ ID NO: 598168 - RNA, 19 nt, Human
ugggcugguuucccagggc

SEQ ID NO: 598169 - RNA, 24 nt, Human
uggggggguggggaggagaccugg

SEQ ID NO: 598170 - RNA, 21 nt, Human
uuucacauaguggcucagucc

SEQ ID NO: 598171 - RNA, 26 nt, Human
aaacacuaaaugccccaggcugagcu

SEQ ID NO: 598172 - RNA, 24 nt, Human
aaacuggcugggugugguggcuca

SEQ ID NO: 598173 - RNA, 20 nt, Human
aaagacaguaaagcagauua

SEQ ID NO: 598174 - RNA, 20 nt, Human
aaagugccagugcaggcagg

SEQ ID NO: 598175 - RNA, 19 nt, Human
aacauggugaaacuccauc

SEQ ID NO: 598176 - RNA, 20 nt, Human
aacauggugaaacuccaucu

SEQ ID NO: 598177 - RNA, 21 nt, Human
aacauggugaaacuccaucuc

SEQ ID NO: 598178 - RNA, 21 nt, Human
aagaaggggaaagcuaacggu

SEQ ID NO: 598179 - RNA, 21 nt, Human
aagccaagcacagccccaggc

SEQ ID NO: 598180 - RNA, 26 nt, Human
aagccaagcacagccccaggcccaaa

SEQ ID NO: 598181 - RNA, 19 nt, Human
aagcuccauugaagugcgg

SEQ ID NO: 598182 - RNA, 20 nt, Human
aagggaggugggggagcugc

SEQ ID NO: 598183 - RNA, 20 nt, Human
aagggaggugggggagcugc

SEQ ID NO: 598184 - RNA, 24 nt, Human
aaucgcuugaacccaggaagcgga

SEQ ID NO: 598185 - RNA, 23 nt, Human
acacagauuucaagccaagcaca

SEQ ID NO: 598186 - RNA, 24 nt, Human
acagagugagacuccgucucagaa

SEQ ID NO: 598187 - RNA, 22 nt, Human
accacaagccaacuccccauaa

SEQ ID NO: 598188 - RNA, 22 nt, Human
acgccacugcauuccagccugg

SEQ ID NO: 598189 - RNA, 24 nt, Human
acgccacugcauuccagccugggc

SEQ ID NO: 598190 - RNA, 24 nt, Human
acuccaucucuacuaaaaauacaa

SEQ ID NO: 598191 - RNA, 24 nt, Human
acugcauuccagccugggcgacag

SEQ ID NO: 598192 - RNA, 26 nt, Human
acugcauuccagccugggcgacagag

SEQ ID NO: 598193 - RNA, 22 nt, Human
agaaucgcuugaacccaggaag

SEQ ID NO: 598194 - RNA, 29 nt, Human
agacaguaaagcagauuagaagggacccc

SEQ ID NO: 598195 - RNA, 23 nt, Human
agaggcagcuguugggaaagccu

SEQ ID NO: 598196 - RNA, 18 nt, Human
agaggcugccagaggagg

SEQ ID NO: 598197 - RNA, 23 nt, Human
agaggcugccagaggaggggggg

SEQ ID NO: 598198 - RNA, 20 nt, Human
agcacagccccaggcccaaa

SEQ ID NO: 598199 - RNA, 24 nt, Human
agcacuuugggaggccaagguggg

SEQ ID NO: 598200 - RNA, 24 nt, Human
agccugggcgacagagugagacuc

SEQ ID NO: 598201 - RNA, 20 nt, Human
agcuccaaauccagcugccu

SEQ ID NO: 598202 - RNA, 19 nt, Human
agcuuguaaccucaagauu

SEQ ID NO: 598203 - RNA, 18 nt, Human
aggaaaaagguacccuau

SEQ ID NO: 598204 - RNA, 20 nt, Human
aggaagcaggauguagcucc

SEQ ID NO: 598205 - RNA, 19 nt, Human
aggagggggggcuaaggga

SEQ ID NO: 598206 - RNA, 23 nt, Human
aggcaggagaaucgcuugaaccc

SEQ ID NO: 598207 - RNA, 24 nt, Human
aggcaggagaaucgcuugaaccca

SEQ ID NO: 598208 - RNA, 21 nt, Human
aggcaggagaggcugccagag

SEQ ID NO: 598209 - RNA, 20 nt, Human
aggccaagguggguggauca

SEQ ID NO: 598210 - RNA, 23 nt, Human
aggcggugacuggacagcagagc

SEQ ID NO: 598211 - RNA, 20 nt, Human
aggcugaggcaggagaaucg

SEQ ID NO: 598212 - RNA, 24 nt, Human
aggcugaggcaggagaaucgcuug

SEQ ID NO: 598213 - RNA, 21 nt, Human
aggggacacagauuucaagcc

SEQ ID NO: 598214 - RNA, 21 nt, Human
aggggguggaacacguggagg

SEQ ID NO: 598215 - RNA, 21 nt, Human
agggugcuggcauuacccuga

SEQ ID NO: 598216 - RNA, 18 nt, Human
agucaauucugaauucag

SEQ ID NO: 598217 - RNA, 22 nt, Human
auagauuccuccccagaggaaa

SEQ ID NO: 598218 - RNA, 24 nt, Human
aucacgccacugcauuccagccug

SEQ ID NO: 598219 - RNA, 21 nt, Human
auggagggcacccuaccccca

SEQ ID NO: 598220 - RNA, 21 nt, Human
caaaguaggcaccuugagggc

SEQ ID NO: 598221 - RNA, 21 nt, Human
caacuccccauaagucaggag

SEQ ID NO: 598222 - RNA, 18 nt, Human
caagccaagcacagcccc

SEQ ID NO: 598223 - RNA, 22 nt, Human
caagccaagcacagccccaggc

SEQ ID NO: 598224 - RNA, 24 nt, Human
caagccaagcacagccccaggccc

SEQ ID NO: 598225 - RNA, 21 nt, Human
caagguggguggaucaugaac

SEQ ID NO: 598226 - RNA, 21 nt, Human
cacacccuaaagacaguaaag

SEQ ID NO: 598227 - RNA, 24 nt, Human
cacagccccaggcccaaaggaagc

SEQ ID NO: 598228 - RNA, 27 nt, Human
cacagccccaggcccaaaggaagcagg

SEQ ID NO: 598229 - RNA, 19 nt, Human
caccagcuccaaauccagc

SEQ ID NO: 598230 - RNA, 22 nt, Human
caccagggaaaacacuaaaugc

SEQ ID NO: 598231 - RNA, 22 nt, Human
caccuggccuguuucagaugga

SEQ ID NO: 598232 - RNA, 24 nt, Human
cacgccuguaaucccagcacuuug

SEQ ID NO: 598233 - RNA, 19 nt, Human
cacugcauuccagccuggg

SEQ ID NO: 598234 - RNA, 22 nt, Human
cacugcauuccagccugggcga

SEQ ID NO: 598235 - RNA, 23 nt, Human
cacugcauuccagccugggcgac

SEQ ID NO: 598236 - RNA, 24 nt, Human
cacugcauuccagccugggcgaca

SEQ ID NO: 598237 - RNA, 18 nt, Human
cagaaaauaggaaaacug

SEQ ID NO: 598238 - RNA, 21 nt, Human
cagcacuuugggaggccaagg

SEQ ID NO: 598239 - RNA, 24 nt, Human
cagcacuuugggaggccaaggugg

SEQ ID NO: 598240 - RNA, 25 nt, Human
cagcccccucuccccucgcuccccc

SEQ ID NO: 598241 - RNA, 20 nt, Human
cagccugggcgacagaguga

SEQ ID NO: 598242 - RNA, 24 nt, Human
cagcuacucgggaggcugaggcag

SEQ ID NO: 598243 - RNA, 19 nt, Human
caguaaagccgagaucacg

SEQ ID NO: 598244 - RNA, 22 nt, Human
cauuccagccugggcgacagag

SEQ ID NO: 598245 - RNA, 24 nt, Human
cauuccagccugggcgacagagug

SEQ ID NO: 598246 - RNA, 26 nt, Human
cauuccuccccaaauaagauuauccc

SEQ ID NO: 598247 - RNA, 24 nt, Human
cauuccuggaggccucuccccacu

SEQ ID NO: 598248 - RNA, 24 nt, Human
ccaagcacagccccaggcccaaag

SEQ ID NO: 598249 - RNA, 19 nt, Human
ccacccauuccuccccaaa

SEQ ID NO: 598250 - RNA, 20 nt, Human
ccacugcauuccagccuggg

SEQ ID NO: 598251 - RNA, 21 nt, Human
ccacugcauuccagccugggc

SEQ ID NO: 598252 - RNA, 21 nt, Human
ccacugcauuccagccugggc

SEQ ID NO: 598253 - RNA, 23 nt, Human
ccacugcauuccagccugggcga

SEQ ID NO: 598254 - RNA, 24 nt, Human
ccacugcauuccagccugggcgac

SEQ ID NO: 598255 - RNA, 20 nt, Human
ccagaagaaggggaaagcua

SEQ ID NO: 598256 - RNA, 22 nt, Human
cccacccauuccuccccaaaua

SEQ ID NO: 598257 - RNA, 21 nt, Human
cccagaaucugagcggacaga

SEQ ID NO: 598258 - RNA, 21 nt, Human
cccaggaaguucucucccucc

SEQ ID NO: 598259 - RNA, 22 nt, Human
ccccacauuccuggaggccucu

SEQ ID NO: 598260 - RNA, 22 nt, Human
ccccucgcucccccuccagccc

SEQ ID NO: 598261 - RNA, 18 nt, Human
cccuaaaucugagccaaa

SEQ ID NO: 598262 - RNA, 21 nt, Human
ccuaaagacaguaaagcagau

SEQ ID NO: 598263 - RNA, 18 nt, Human
ccuccugccccugcugcc

SEQ ID NO: 598264 - RNA, 23 nt, Human
ccuccugccccugcugcccaagc

SEQ ID NO: 598265 - RNA, 22 nt, Human
ccugggcgacagagugagacuc

SEQ ID NO: 598266 - RNA, 20 nt, Human
ccuggguaacauggugaaac

SEQ ID NO: 598267 - RNA, 22 nt, Human
ccuggguaacauggugaaacuc

SEQ ID NO: 598268 - RNA, 24 nt, Human
ccuggguaacauggugaaacucca

SEQ ID NO: 598269 - RNA, 22 nt, Human
ccuguaaucccagcacuuuggg

SEQ ID NO: 598270 - RNA, 21 nt, Human
ccuguagucccagcuacucgg

SEQ ID NO: 598271 - RNA, 22 nt, Human
ccuguagucccagcuacucggg

SEQ ID NO: 598272 - RNA, 23 nt, Human
cgccuguaaucccagcacuuugg

SEQ ID NO: 598273 - RNA, 22 nt, Human
cucacgccuguaaucccagcac

SEQ ID NO: 598274 - RNA, 24 nt, Human
cucacgccuguaaucccagcacuu

SEQ ID NO: 598275 - RNA, 20 nt, Human
cucacugcugaauuccugca

SEQ ID NO: 598276 - RNA, 18 nt, Human
cuccaaauccagcugccu

SEQ ID NO: 598277 - RNA, 23 nt, Human
cuccuguagucccagcuacucgg

SEQ ID NO: 598278 - RNA, 19 nt, Human
cugagcuauccauccagug

SEQ ID NO: 598279 - RNA, 22 nt, Human
cugccccugcugcccaagcucc

SEQ ID NO: 598280 - RNA, 23 nt, Human
cuggcugggugugguggcucacg

SEQ ID NO: 598281 - RNA, 19 nt, Human
cuucaccaagagaacuugg

SEQ ID NO: 598282 - RNA, 19 nt, Human
cuuuaaaaagggaggaucu

SEQ ID NO: 598283 - RNA, 21 nt, Human
gacagagugagacuccgucuc

SEQ ID NO: 598284 - RNA, 24 nt, Human
gacagagugagacuccgucucaga

SEQ ID NO: 598285 - RNA, 22 nt, Human
gacaguaaagcagauuagaaau

SEQ ID NO: 598286 - RNA, 23 nt, Human
gagaucacgccacugcauuccag

SEQ ID NO: 598287 - RNA, 19 nt, Human
gaggcugcaguaaagccga

SEQ ID NO: 598288 - RNA, 19 nt, Human
gcacagccccaggcccaaa

SEQ ID NO: 598289 - RNA, 22 nt, Human
gcaggagaaucgcuugaaccca

SEQ ID NO: 598290 - RNA, 18 nt, Human
gcaguccaggugguccca

SEQ ID NO: 598291 - RNA, 24 nt, Human
gcauuccagccugggcgacagagu

SEQ ID NO: 598292 - RNA, 19 nt, Human
gccaagguggguggaucau

SEQ ID NO: 598293 - RNA, 22 nt, Human
gccacugcauuccagccugggc

SEQ ID NO: 598294 - RNA, 24 nt, Human
gccacugcauuccagccugggcga

SEQ ID NO: 598295 - RNA, 20 nt, Human
gccgagaucacgccacugca

SEQ ID NO: 598296 - RNA, 18 nt, Human
gccuguggccccacccag

SEQ ID NO: 598297 - RNA, 21 nt, Human
gcugggugugguggcucacgc

SEQ ID NO: 598298 - RNA, 18 nt, Human
gcuugccucaccagcucc

SEQ ID NO: 598299 - RNA, 23 nt, Human
ggaauagauuccuccccagagga

SEQ ID NO: 598300 - RNA, 18 nt, Human
ggaggugggggagcugcu

SEQ ID NO: 598301 - RNA, 21 nt, Human
ggauguaaacaacagcagggu

SEQ ID NO: 598302 - RNA, 20 nt, Human
ggcaguccagguggucccag

SEQ ID NO: 598303 - RNA, 21 nt, Human
ggcucacgccuguaaucccag

SEQ ID NO: 598304 - RNA, 19 nt, Human
ggcugggugugguggcuca

SEQ ID NO: 598305 - RNA, 18 nt, Human
ggggagcugcuggaaagg

SEQ ID NO: 598306 - RNA, 22 nt, Human
gggggagcugcuggaaagggaa

SEQ ID NO: 598307 - RNA, 22 nt, Human
gggugcuggcauuacccugagg

SEQ ID NO: 598308 - RNA, 23 nt, Human
gggugcuggcauuacccugaggc

SEQ ID NO: 598309 - RNA, 24 nt, Human
gggugugguggcucacgccuguaa

SEQ ID NO: 598310 - RNA, 24 nt, Human
gguggcucacgccuguaaucccag

SEQ ID NO: 598311 - RNA, 20 nt, Human
gugcauagcugcucaauguu

SEQ ID NO: 598312 - RNA, 18 nt, Human
gugcuggcauuacccuga

SEQ ID NO: 598313 - RNA, 18 nt, Human
guggaggggagcucagca

SEQ ID NO: 598314 - RNA, 22 nt, Human
guguuucucuccaaccucgggg

SEQ ID NO: 598315 - RNA, 23 nt, Human
guuugcucccgccauccugaggg

SEQ ID NO: 598316 - RNA, 22 nt, Human
uaacauggugaaacuccaucuc

SEQ ID NO: 598317 - RNA, 24 nt, Human
uaacauggugaaacuccaucucua

SEQ ID NO: 598318 - RNA, 20 nt, Human
uaagauuaucccuggcuuga

SEQ ID NO: 598319 - RNA, 20 nt, Human
uaagggaggugggggagcug

SEQ ID NO: 598320 - RNA, 27 nt, Human
uacacacccuaaagacaguaaagcaga

SEQ ID NO: 598321 - RNA, 25 nt, Human
uaccagugcuguuugcucccgccau

SEQ ID NO: 598322 - RNA, 20 nt, Human
uacccugaggcuugccucac

SEQ ID NO: 598323 - RNA, 21 nt, Human
uaggaaaacuggcugggugug

SEQ ID NO: 598324 - RNA, 24 nt, Human
uaggaaaacuggcuggguguggug

SEQ ID NO: 598325 - RNA, 23 nt, Human
uauccauccagugaucagaugac

SEQ ID NO: 598326 - RNA, 20 nt, Human
ucaagccaagcacagcccca

SEQ ID NO: 598327 - RNA, 23 nt, Human
ucacgccacugcauuccagccug

SEQ ID NO: 598328 - RNA, 18 nt, Human
ucagaaaaaaaaggaaaa

SEQ ID NO: 598329 - RNA, 23 nt, Human
ucagaaaaaaaaggaaaaaggua

SEQ ID NO: 598330 - RNA, 19 nt, Human
ucagaaaauaggaaaacug

SEQ ID NO: 598331 - RNA, 20 nt, Human
ucagaggcugcucagguagg

SEQ ID NO: 598332 - RNA, 21 nt, Human
ucagaugacccagccugugau

SEQ ID NO: 598333 - RNA, 20 nt, Human
ucagcagaggcaggagaggc

SEQ ID NO: 598334 - RNA, 21 nt, Human
ucaggcagguuggauguaaac

SEQ ID NO: 598335 - RNA, 19 nt, Human
uccagccugggcgacagag

SEQ ID NO: 598336 - RNA, 23 nt, Human
uccagccugggcgacagagugag

SEQ ID NO: 598337 - RNA, 24 nt, Human
uccagccugggcgacagagugaga

SEQ ID NO: 598338 - RNA, 26 nt, Human
uccccaaauaagauuaucccuggcuu

SEQ ID NO: 598339 - RNA, 24 nt, Human
ucgggaggcugaggcaggagaauc

SEQ ID NO: 598340 - RNA, 22 nt, Human
ucucuacuaaaaauacaaaaaa

SEQ ID NO: 598341 - RNA, 25 nt, Human
ugacaggaauagauuccuccccaga

SEQ ID NO: 598342 - RNA, 23 nt, Human
ugacccuccugccccugcugccc

SEQ ID NO: 598343 - RNA, 18 nt, Human
ugacuggacaaagugcca

SEQ ID NO: 598344 - RNA, 19 nt, Human
ugacuggacaaagugccag

SEQ ID NO: 598345 - RNA, 24 nt, Human
ugagaccauccuggguaacauggu

SEQ ID NO: 598346 - RNA, 20 nt, Human
ugagaguugaucuguuuuca

SEQ ID NO: 598347 - RNA, 20 nt, Human
ugaggcaggagaaucgcuug

SEQ ID NO: 598348 - RNA, 24 nt, Human
ugaggcaggagaaucgcuugaacc

SEQ ID NO: 598349 - RNA, 25 nt, Human
ugaggcaggagaaucgcuugaaccc

SEQ ID NO: 598350 - RNA, 21 nt, Human
ugaucagaugacccagccugu

SEQ ID NO: 598351 - RNA, 24 nt, Human
ugcacuuacuccuagaauauacca

SEQ ID NO: 598352 - RNA, 19 nt, Human
ugccaaaacuaaaauucaa

SEQ ID NO: 598353 - RNA, 24 nt, Human
ugccaaaacuaaaauucaaaaggc

SEQ ID NO: 598354 - RNA, 25 nt, Human
ugccaccagcuccaaauccagcugc

SEQ ID NO: 598355 - RNA, 20 nt, Human
ugccagaggagggggggcua

SEQ ID NO: 598356 - RNA, 21 nt, Human
ugcccacccauuccuccccaa

SEQ ID NO: 598357 - RNA, 21 nt, Human
ugcugcccaagcuccauugaa

SEQ ID NO: 598358 - RNA, 21 nt, Human
uggauggcaguccaggugguc

SEQ ID NO: 598359 - RNA, 18 nt, Human
uggccuguuucagaugga

SEQ ID NO: 598360 - RNA, 24 nt, Human
uggcucacgccuguaaucccagca

SEQ ID NO: 598361 - RNA, 23 nt, Human
uggcugggugugguggcucacgc

SEQ ID NO: 598362 - RNA, 23 nt, Human
ugggaggccaagguggguggauc

SEQ ID NO: 598363 - RNA, 24 nt, Human
ugggaggccaagguggguggauca

SEQ ID NO: 598364 - RNA, 24 nt, Human
ugguggcucacgccuguaauccca

SEQ ID NO: 598365 - RNA, 23 nt, Human
uguguuucucuccaaccucgggg

SEQ ID NO: 598366 - RNA, 22 nt, Human
uucauacacacccuaaagacag

SEQ ID NO: 598367 - RNA, 19 nt, Human
uuccuggaggccucucccc

SEQ ID NO: 598368 - RNA, 20 nt, Human
uuccuggaggccucucccca

SEQ ID NO: 598369 - RNA, 18 nt, Human
uugcucccgccauccuga

SEQ ID NO: 598370 - RNA, 18 nt, Human
uuugcucccgccauccug

SEQ ID NO: 598371 - RNA, 24 nt, Human
aaagugcugggauuacaggcauga

SEQ ID NO: 598372 - RNA, 19 nt, Human
aagugcugggauuacaggc

SEQ ID NO: 598373 - RNA, 21 nt, Human
aagugcugggauuacaggcau

SEQ ID NO: 598374 - RNA, 26 nt, Human
aagugcugggauuacaggcaugagcc

SEQ ID NO: 598375 - RNA, 23 nt, Human
aauaaggagacaagaaccaaaaa

SEQ ID NO: 598376 - RNA, 25 nt, Human
aaugaccaaccagauucaauccaua

SEQ ID NO: 598377 - RNA, 19 nt, Human
acagacaggguuucaccau

SEQ ID NO: 598378 - RNA, 18 nt, Human
acaggguuucaccauguu

SEQ ID NO: 598379 - RNA, 23 nt, Human
acaggguuucaccauguuggcca

SEQ ID NO: 598380 - RNA, 24 nt, Human
acaggguuucaccauguuggccag

SEQ ID NO: 598381 - RNA, 21 nt, Human
acaguggagggaucaacugga

SEQ ID NO: 598382 - RNA, 24 nt, Human
accauguuggccaggcuggucuug

SEQ ID NO: 598383 - RNA, 25 nt, Human
acccgccucagccucccaaagugcu

SEQ ID NO: 598384 - RNA, 23 nt, Human
accuuuuuuuuuuuaaacuuuaa

SEQ ID NO: 598385 - RNA, 19 nt, Human
acugcagccuccgccuccu

SEQ ID NO: 598386 - RNA, 29 nt, Human
agacagaaaguagaauauugggggacccc

SEQ ID NO: 598387 - RNA, 22 nt, Human
agacagaaaguagaauauuggu

SEQ ID NO: 598388 - RNA, 23 nt, Human
agcacguucugggauagaggcag

SEQ ID NO: 598389 - RNA, 24 nt, Human
agcgauucuccugccucagccucc

SEQ ID NO: 598390 - RNA, 21 nt, Human
aggccgaaaccugguaacagc

SEQ ID NO: 598391 - RNA, 25 nt, Human
aggcuggagugcaguggcacaaucu

SEQ ID NO: 598392 - RNA, 22 nt, Human
aguacagacaggguuucaccau

SEQ ID NO: 598393 - RNA, 18 nt, Human
aguagcugagauuacagg

SEQ ID NO: 598394 - RNA, 23 nt, Human
agugauccacccgccucagccuc

SEQ ID NO: 598395 - RNA, 21 nt, Human
agugcaguggcacaaucucag

SEQ ID NO: 598396 - RNA, 24 nt, Human
agugcaguggcacaaucucagcuc

SEQ ID NO: 598397 - RNA, 18 nt, Human
agugcugggauuacaggc

SEQ ID NO: 598398 - RNA, 20 nt, Human
auacuuagaauggcacaaaa

SEQ ID NO: 598399 - RNA, 24 nt, Human
caaagugcugggauuacaggcaug

SEQ ID NO: 598400 - RNA, 20 nt, Human
caagcagaagacuaaacacu

SEQ ID NO: 598401 - RNA, 22 nt, Human
caagcgauucuccugccucagc

SEQ ID NO: 598402 - RNA, 22 nt, Human
caauccauaucacugggaaaga

SEQ ID NO: 598403 - RNA, 21 nt, Human
caccauguuggccaggcuggu

SEQ ID NO: 598404 - RNA, 23 nt, Human
caccauguuggccaggcuggucu

SEQ ID NO: 598405 - RNA, 24 nt, Human
caccauguuggccaggcuggucuu

SEQ ID NO: 598406 - RNA, 27 nt, Human
caccauguuggccaggcuggucuugaa

SEQ ID NO: 598407 - RNA, 23 nt, Human
cacccgccucagccucccaaagu

SEQ ID NO: 598408 - RNA, 22 nt, Human
caccuccuccugagacagccug

SEQ ID NO: 598409 - RNA, 23 nt, Human
cacugcagccuccgccuccuggg

SEQ ID NO: 598410 - RNA, 20 nt, Human
cagccuccugaguagcugag

SEQ ID NO: 598411 - RNA, 21 nt, Human
cagcuccgggcuccgcguccc

SEQ ID NO: 598412 - RNA, 24 nt, Human
caggguuucaccauguuggccagg

SEQ ID NO: 598413 - RNA, 20 nt, Human
cagugcaguauacaaccccc

SEQ ID NO: 598414 - RNA, 23 nt, Human
caucuaacuguaaguuuccuaaa

SEQ ID NO: 598415 - RNA, 20 nt, Human
caugcucagcuaacuuuugu

SEQ ID NO: 598416 - RNA, 24 nt, Human
cauguuggccaggcuggucuugaa

SEQ ID NO: 598417 - RNA, 23 nt, Human
ccaaagugcugggauuacaggca

SEQ ID NO: 598418 - RNA, 24 nt, Human
ccaaagugcugggauuacaggcau

SEQ ID NO: 598419 - RNA, 28 nt, Human
ccacaacgcccaaccuuuuuuuuuuuaa

SEQ ID NO: 598420 - RNA, 26 nt, Human
ccacccgccucagccucccaaagugc

SEQ ID NO: 598421 - RNA, 24 nt, Human
cccaaagugcugggauuacaggca

SEQ ID NO: 598422 - RNA, 22 nt, Human
cccaggcuggagugcaguggca

SEQ ID NO: 598423 - RNA, 23 nt, Human
cccccgcaaucgccucgucgccc

SEQ ID NO: 598424 - RNA, 19 nt, Human
cccccugauugccucucuu

SEQ ID NO: 598425 - RNA, 21 nt, Human
ccccuccaaaaaugguaaaga

SEQ ID NO: 598426 - RNA, 22 nt, Human
cccuccaaaaaugguaaagagg

SEQ ID NO: 598427 - RNA, 24 nt, Human
ccgccucagccucccaaagugcug

SEQ ID NO: 598428 - RNA, 24 nt, Human
ccgccuccuggguucaagcgauuc

SEQ ID NO: 598429 - RNA, 23 nt, Human
ccuccaaaaaugguaaagaggaa

SEQ ID NO: 598430 - RNA, 19 nt, Human
ccuccgccuccuggguuca

SEQ ID NO: 598431 - RNA, 24 nt, Human
ccuccuggguucaagcgauucucc

SEQ ID NO: 598432 - RNA, 20 nt, Human
ccugaccuagugauccaccc

SEQ ID NO: 598433 - RNA, 19 nt, Human
ccugaguagcugagauuac

SEQ ID NO: 598434 - RNA, 23 nt, Human
ccugaguagcugagauuacaggc

SEQ ID NO: 598435 - RNA, 24 nt, Human
ccugaguagcugagauuacaggca

SEQ ID NO: 598436 - RNA, 23 nt, Human
ccugccucagccuccugaguagc

SEQ ID NO: 598437 - RNA, 23 nt, Human
ccuggguucaagcgauucuccug

SEQ ID NO: 598438 - RNA, 24 nt, Human
cgccucagccucccaaagugcugg

SEQ ID NO: 598439 - RNA, 21 nt, Human
cuagcucugauucaccuccuc

SEQ ID NO: 598440 - RNA, 27 nt, Human
cuagugauccacccgccucagccuccc

SEQ ID NO: 598441 - RNA, 22 nt, Human
cucaaaaaauauacaagaaagg

SEQ ID NO: 598442 - RNA, 24 nt, Human
cucacugcagccuccgccuccugg

SEQ ID NO: 598443 - RNA, 24 nt, Human
cuccugaccuagugauccacccgc

SEQ ID NO: 598444 - RNA, 21 nt, Human
cuccuggguucaagcgauucu

SEQ ID NO: 598445 - RNA, 18 nt, Human
cugaguagcugagauuac

SEQ ID NO: 598446 - RNA, 23 nt, Human
cugaguagcugagauuacaggca

SEQ ID NO: 598447 - RNA, 23 nt, Human
cugcagccuccgccuccuggguu

SEQ ID NO: 598448 - RNA, 23 nt, Human
cugccucagccuccugaguagcu

SEQ ID NO: 598449 - RNA, 24 nt, Human
cuucuuuuuguuauuacaucuaac

SEQ ID NO: 598450 - RNA, 28 nt, Human
gaaauaaggagacaagaaccaaaaauac

SEQ ID NO: 598451 - RNA, 24 nt, Human
gaccaaccagauucaauccauauc

SEQ ID NO: 598452 - RNA, 22 nt, Human
gaccuagugauccacccgccuc

SEQ ID NO: 598453 - RNA, 24 nt, Human
gaccuagugauccacccgccucag

SEQ ID NO: 598454 - RNA, 21 nt, Human
gagacagccuggacaguggag

SEQ ID NO: 598455 - RNA, 24 nt, Human
gaguagcugagauuacaggcacac

SEQ ID NO: 598456 - RNA, 24 nt, Human
gauuacaggcacacgccaccaugc

SEQ ID NO: 598457 - RNA, 18 nt, Human
gauuacaggcaugagcca

SEQ ID NO: 598458 - RNA, 22 nt, Human
gauuacaggcaugagccacaac

SEQ ID NO: 598459 - RNA, 23 nt, Human
gcacaaaaagugauacgcauaaa

SEQ ID NO: 598460 - RNA, 21 nt, Human
gccucgucgccccagcuccgg

SEQ ID NO: 598461 - RNA, 24 nt, Human
gcgauucuccugccucagccuccu

SEQ ID NO: 598462 - RNA, 19 nt, Human
gcuggagugcaguggcaca

SEQ ID NO: 598463 - RNA, 19 nt, Human
ggauuacaggcaugagcca

SEQ ID NO: 598464 - RNA, 18 nt, Human
ggcuggucuugaacuccu

SEQ ID NO: 598465 - RNA, 21 nt, Human
gggaaagaucaaggaaaaaaa

SEQ ID NO: 598466 - RNA, 22 nt, Human
ggguuucaccauguuggccagg

SEQ ID NO: 598467 - RNA, 19 nt, Human
ggucuugaacuccugaccu

SEQ ID NO: 598468 - RNA, 22 nt, Human
gguuuugaguguagguaucucu

SEQ ID NO: 598469 - RNA, 24 nt, Human
gugauccacccgccucagccuccc

SEQ ID NO: 598470 - RNA, 24 nt, Human
uaacuuuuguauuuuuaguacaga

SEQ ID NO: 598471 - RNA, 22 nt, Human
uacaacccccugauugccucuc

SEQ ID NO: 598472 - RNA, 22 nt, Human
uacagacaggguuucaccaugu

SEQ ID NO: 598473 - RNA, 18 nt, Human
uacaggcacacgccacca

SEQ ID NO: 598474 - RNA, 24 nt, Human
uacaggcaugagccacaacgccca

SEQ ID NO: 598475 - RNA, 21 nt, Human
uagaagggaaccugucaggca

SEQ ID NO: 598476 - RNA, 20 nt, Human
uagguaucucugauuuaaaa

SEQ ID NO: 598477 - RNA, 24 nt, Human
uaguacagacaggguuucaccaug

SEQ ID NO: 598478 - RNA, 22 nt, Human
uauccuuuugccuugucugggu

SEQ ID NO: 598479 - RNA, 20 nt, Human
ucaacuggaaggccgaaacc

SEQ ID NO: 598480 - RNA, 19 nt, Human
ucaagcgauucuccugccu

SEQ ID NO: 598481 - RNA, 23 nt, Human
ucacugcagccuccgccuccugg

SEQ ID NO: 598482 - RNA, 24 nt, Human
ucacugcagccuccgccuccuggg

SEQ ID NO: 598483 - RNA, 25 nt, Human
ucacugcagccuccgccuccugggu

SEQ ID NO: 598484 - RNA, 27 nt, Human
ucacugcagccuccgccuccuggguuc

SEQ ID NO: 598485 - RNA, 23 nt, Human
uccaaaaaugguaaagaggaaau

SEQ ID NO: 598486 - RNA, 21 nt, Human
uccacccgccucagccuccca

SEQ ID NO: 598487 - RNA, 24 nt, Human
ucccaaagugcugggauuacaggc

SEQ ID NO: 598488 - RNA, 23 nt, Human
ucccaggcuggagugcaguggca

SEQ ID NO: 598489 - RNA, 18 nt, Human
ucccuagacugguuugca

SEQ ID NO: 598490 - RNA, 19 nt, Human
ucccuagacugguuugcaa

SEQ ID NO: 598491 - RNA, 24 nt, Human
uccugaguagcugagauuacaggc

SEQ ID NO: 598492 - RNA, 21 nt, Human
uccuggguucaagcgauucuc

SEQ ID NO: 598493 - RNA, 24 nt, Human
uccuggguucaagcgauucuccug

SEQ ID NO: 598494 - RNA, 24 nt, Human
uccuuuugccuugucuggguuuug

SEQ ID NO: 598495 - RNA, 24 nt, Human
ucgaucucaaaaaauauacaagaa

SEQ ID NO: 598496 - RNA, 20 nt, Human
ucgccccagcuccgggcucc

SEQ ID NO: 598497 - RNA, 19 nt, Human
ucucauagacuucccuaga

SEQ ID NO: 598498 - RNA, 24 nt, Human
ucucccaggcuggagugcaguggc

SEQ ID NO: 598499 - RNA, 24 nt, Human
ucuccugccucagccuccugagua

SEQ ID NO: 598500 - RNA, 19 nt, Human
ucucugauuuaaaaguggg

SEQ ID NO: 598501 - RNA, 19 nt, Human
ucugucucccaggcuggag

SEQ ID NO: 598502 - RNA, 24 nt, Human
ucugucucccaggcuggagugcag

SEQ ID NO: 598503 - RNA, 19 nt, Human
ucuugcucugucucccagg

SEQ ID NO: 598504 - RNA, 23 nt, Human
ucuugcucugucucccaggcugg

SEQ ID NO: 598505 - RNA, 24 nt, Human
ucuugcucugucucccaggcugga

SEQ ID NO: 598506 - RNA, 27 nt, Human
ugacagacuagcucugauucaccuccu

SEQ ID NO: 598507 - RNA, 23 nt, Human
ugaccuagugauccacccgccuc

SEQ ID NO: 598508 - RNA, 21 nt, Human
ugagauuacaggcacacgcca

SEQ ID NO: 598509 - RNA, 22 nt, Human
ugagauuacaggcacacgccac

SEQ ID NO: 598510 - RNA, 24 nt, Human
ugagauuacaggcacacgccacca

SEQ ID NO: 598511 - RNA, 25 nt, Human
ugagauuacaggcacacgccaccau

SEQ ID NO: 598512 - RNA, 18 nt, Human
ugauuuaaaagugggaaa

SEQ ID NO: 598513 - RNA, 24 nt, Human
ugccucagccuccugaguagcuga

SEQ ID NO: 598514 - RNA, 24 nt, Human
ugcucugucucccaggcuggagug

SEQ ID NO: 598515 - RNA, 18 nt, Human
uggagugcaguggcacaa

SEQ ID NO: 598516 - RNA, 23 nt, Human
uggagugcaguggcacaaucuca

SEQ ID NO: 598517 - RNA, 24 nt, Human
uggagugcaguggcacaaucucag

SEQ ID NO: 598518 - RNA, 24 nt, Human
uggcacaaucucagcucacugcag

SEQ ID NO: 598519 - RNA, 24 nt, Human
uggccaggcuggucuugaacuccu

SEQ ID NO: 598520 - RNA, 19 nt, Human
ugggaaagaucaaggaaaa

SEQ ID NO: 598521 - RNA, 18 nt, Human
ugggauagaggcagguuc

SEQ ID NO: 598522 - RNA, 18 nt, Human
ugggauuacaggcaugag

SEQ ID NO: 598523 - RNA, 19 nt, Human
ugggauuacaggcaugagc

SEQ ID NO: 598524 - RNA, 21 nt, Human
ugggauuacaggcaugagcca

SEQ ID NO: 598525 - RNA, 22 nt, Human
ugggauuacaggcaugagccac

SEQ ID NO: 598526 - RNA, 22 nt, Human
ugggauuacaggcaugagccac

SEQ ID NO: 598527 - RNA, 23 nt, Human
ugggauuacaggcaugagccaca

SEQ ID NO: 598528 - RNA, 26 nt, Human
ugggauuacaggcaugagccacaacg

SEQ ID NO: 598529 - RNA, 27 nt, Human
ugggauuacaggcaugagccacaacgc

SEQ ID NO: 598530 - RNA, 23 nt, Human
uggguucaagcgauucuccugcc

SEQ ID NO: 598531 - RNA, 24 nt, Human
uggguucaagcgauucuccugccu

SEQ ID NO: 598532 - RNA, 19 nt, Human
ugguaaagaggaaauaagg

SEQ ID NO: 598533 - RNA, 19 nt, Human
ugguaaagaggaaauaagg

SEQ ID NO: 598534 - RNA, 24 nt, Human
uuaaaugcuacuuucucauagacu

SEQ ID NO: 598535 - RNA, 24 nt, Human
uuaguacagacaggguuucaccau

SEQ ID NO: 598536 - RNA, 21 nt, Human
uucaagcgauucuccugccuc

SEQ ID NO: 598537 - RNA, 23 nt, Human
uucaagcgauucuccugccucag

SEQ ID NO: 598538 - RNA, 24 nt, Human
uucaagcgauucuccugccucagc

SEQ ID NO: 598539 - RNA, 22 nt, Human
uuccuuuucuuguaucaacuuc

SEQ ID NO: 598540 - RNA, 18 nt, Human
uugaauuguguggauaga

SEQ ID NO: 598541 - RNA, 19 nt, Human
uugagugucaaaucuccag

SEQ ID NO: 598542 - RNA, 18 nt, Human
uugcucugucucccaggc

SEQ ID NO: 598543 - RNA, 21 nt, Human
uuggucaaauaguuguuagaa

SEQ ID NO: 598544 - RNA, 24 nt, Human
uuucaccauguuggccaggcuggu

SEQ ID NO: 598545 - RNA, 24 nt, Human
uuuuuaguacagacaggguuucac

SEQ ID NO: 598546 - RNA, 18 nt, Human
aagugcucaauuccaaag

SEQ ID NO: 598547 - RNA, 21 nt, Human
auugcacugguaaacaccaca

SEQ ID NO: 598548 - RNA, 22 nt, Human
auuuuuugacuguagauucugg

SEQ ID NO: 598549 - RNA, 25 nt, Human
ccaaagccccacccaucuauugcac

SEQ ID NO: 598550 - RNA, 23 nt, Human
cuuuuugaugccaauuuuuugac

SEQ ID NO: 598551 - RNA, 19 nt, Human
gauaauguggcaaaaagaa

SEQ ID NO: 598552 - RNA, 18 nt, Human
gauucuggcgaagugcuc

SEQ ID NO: 598553 - RNA, 20 nt, Human
uaaacagagauaauguggca

SEQ ID NO: 598554 - RNA, 18 nt, Human
uaaggaaaagaauccacc

SEQ ID NO: 598555 - RNA, 20 nt, Human
uauaaggaaaagaauccacc

SEQ ID NO: 598556 - RNA, 23 nt, Human
ucccaauauuaaacccuugauga

SEQ ID NO: 598557 - RNA, 22 nt, Human
ucccaauauuaaacccuugauu

SEQ ID NO: 598558 - RNA, 26 nt, Human
ugcucaauuccaaagccccacccauc

SEQ ID NO: 598559 - RNA, 18 nt, Human
ugguaaacaccacauuuc

SEQ ID NO: 598560 - RNA, 22 nt, Human
aaacugccuggaaaucuucagc

SEQ ID NO: 598561 - RNA, 18 nt, Human
aagagccagggaucacaa

SEQ ID NO: 598562 - RNA, 21 nt, Human
aagagccagggaucacaaaug

SEQ ID NO: 598563 - RNA, 18 nt, Human
accaggcaauuucuuguu

SEQ ID NO: 598564 - RNA, 21 nt, Human
acugauccucccgaagguggg

SEQ ID NO: 598565 - RNA, 22 nt, Human
agggaucacaaaugacuggguc

SEQ ID NO: 598566 - RNA, 25 nt, Human
auuacaauucacaguaacauacacu

SEQ ID NO: 598567 - RNA, 19 nt, Human
caccaaaccggggacgccg

SEQ ID NO: 598568 - RNA, 20 nt, Human
caccaaaccggggacgccgc

SEQ ID NO: 598569 - RNA, 19 nt, Human
cgacacagauacuggcucc

SEQ ID NO: 598570 - RNA, 23 nt, Human
cucacagauuugaccaggcaauu

SEQ ID NO: 598571 - RNA, 23 nt, Human
cuggugucaguauugaucucuuu

SEQ ID NO: 598572 - RNA, 22 nt, Human
gacugggucagaauuggugcca

SEQ ID NO: 598573 - RNA, 23 nt, Human
gcgggcggcggcgacacagauac

SEQ ID NO: 598574 - RNA, 18 nt, Human
ggcgccgcagcaccaaac

SEQ ID NO: 598575 - RNA, 22 nt, Human
guccucacagauuugaccaggc

SEQ ID NO: 598576 - RNA, 18 nt, Human
uaacauguauacauuugc

SEQ ID NO: 598577 - RNA, 22 nt, Human
ucacagauuugaccaggcaauu

SEQ ID NO: 598578 - RNA, 21 nt, Human
uccacaaaaacugccuggaaa

SEQ ID NO: 598579 - RNA, 23 nt, Human
uccggcgacuccgagccucacag

SEQ ID NO: 598580 - RNA, 18 nt, Human
ugccuggaaaucuucagc

SEQ ID NO: 598581 - RNA, 19 nt, Human
ugcuugauuagagcuggac

SEQ ID NO: 598582 - RNA, 19 nt, Human
ugguacaguauacaccuau

SEQ ID NO: 598583 - RNA, 20 nt, Human
ugguacaguauacaccuaua

SEQ ID NO: 598584 - RNA, 26 nt, Human
uguauacauuugcaguaauuuguaca

SEQ ID NO: 598585 - RNA, 27 nt, Human
aaacauuuugaaaagcaaucuaaauuc

SEQ ID NO: 598586 - RNA, 21 nt, Human
aaacugauaugauggcuggaa

SEQ ID NO: 598587 - RNA, 20 nt, Human
aacaggaugacaguagccuu

SEQ ID NO: 598588 - RNA, 18 nt, Human
aagcauuuccuugagucc

SEQ ID NO: 598589 - RNA, 24 nt, Human
agccaagaagagaaauuauauccc

SEQ ID NO: 598590 - RNA, 20 nt, Human
aguuuagguugggaggucaa

SEQ ID NO: 598591 - RNA, 23 nt, Human
auuccagugggcugcuuucuggu

SEQ ID NO: 598592 - RNA, 18 nt, Human
cagaaaguuuaggugacu

SEQ ID NO: 598593 - RNA, 20 nt, Human
ccagaaaguuuaggugacug

SEQ ID NO: 598594 - RNA, 21 nt, Human
cccacuaagcuccccauucca

SEQ ID NO: 598595 - RNA, 23 nt, Human
ccccaaguugucuguguuccgcc

SEQ ID NO: 598596 - RNA, 21 nt, Human
ccuacugccauacaaccugaa

SEQ ID NO: 598597 - RNA, 25 nt, Human
cgccucaacugcuaacuugccuacu

SEQ ID NO: 598598 - RNA, 21 nt, Human
cuaagcuccccauuccagugg

SEQ ID NO: 598599 - RNA, 23 nt, Human
cuauuuugucuucauggaauaua

SEQ ID NO: 598600 - RNA, 30 nt, Human
cucuccugcaaacaaacuacagauuccauu

SEQ ID NO: 598601 - RNA, 19 nt, Human
cugaacuugauuaauucua

SEQ ID NO: 598602 - RNA, 26 nt, Human
cuugccuaccugauaaaccgacuucg

SEQ ID NO: 598603 - RNA, 18 nt, Human
cuuuagaauuuagaguuu

SEQ ID NO: 598604 - RNA, 24 nt, Human
gaaggacugggagaugggagauug

SEQ ID NO: 598605 - RNA, 18 nt, Human
gaauagaaguucaucuuc

SEQ ID NO: 598606 - RNA, 22 nt, Human
gggaggucaaaaucauaacuuu

SEQ ID NO: 598607 - RNA, 20 nt, Human
ggggaggucauccucugcag

SEQ ID NO: 598608 - RNA, 20 nt, Human
guuuuggacuagacuuccaa

SEQ ID NO: 598609 - RNA, 19 nt, Human
uaaagguaugucuuggaau

SEQ ID NO: 598610 - RNA, 20 nt, Human
uaaauuguauguauuuauug

SEQ ID NO: 598611 - RNA, 27 nt, Human
uacacuaugauuuuuuguugugguuag

SEQ ID NO: 598612 - RNA, 24 nt, Human
uagaguuuagguugggaggucaaa

SEQ ID NO: 598613 - RNA, 19 nt, Human
uagcugucauuuccuccag

SEQ ID NO: 598614 - RNA, 21 nt, Human
uaguuaucagucaccaccaga

SEQ ID NO: 598615 - RNA, 18 nt, Human
uaugucuuguacuaggga

SEQ ID NO: 598616 - RNA, 21 nt, Human
uccuuuuccaugauugggcuu

SEQ ID NO: 598617 - RNA, 23 nt, Human
ucuccugcaaacaaacuacagau

SEQ ID NO: 598618 - RNA, 18 nt, Human
ucugcaguuggggacuga

SEQ ID NO: 598619 - RNA, 23 nt, Human
ucugcaguuggggacugaaggac

SEQ ID NO: 598620 - RNA, 21 nt, Human
ucugguccuuuuccaugauug

SEQ ID NO: 598621 - RNA, 21 nt, Human
ugaaacuuaaagagguaaagg

SEQ ID NO: 598622 - RNA, 21 nt, Human
ugaacugaaguccagaaaguu

SEQ ID NO: 598623 - RNA, 23 nt, Human
ugaauagaaguucaucuucuauu

SEQ ID NO: 598624 - RNA, 23 nt, Human
ugccauacaaccugaacugaagu

SEQ ID NO: 598625 - RNA, 23 nt, Human
uggaguuuucugaacagaaaaau

SEQ ID NO: 598626 - RNA, 19 nt, Human
uggcaaacugauaugaugg

SEQ ID NO: 598627 - RNA, 20 nt, Human
uggccccagaccaacaacag

SEQ ID NO: 598628 - RNA, 19 nt, Human
ugggcugcuuucugguccu

SEQ ID NO: 598629 - RNA, 24 nt, Human
uggggaggucauccucugcaguug

SEQ ID NO: 598630 - RNA, 18 nt, Human
uguacuagggauacaaag

SEQ ID NO: 598631 - RNA, 25 nt, Human
uguauuuauugaccuaauugcuuac

SEQ ID NO: 598632 - RNA, 22 nt, Human
ugucauuuccuccaguguccaa

SEQ ID NO: 598633 - RNA, 21 nt, Human
ugugaccuugcugaacuugau

SEQ ID NO: 598634 - RNA, 22 nt, Human
uguuuuggacuagacuuccaaa

SEQ ID NO: 598635 - RNA, 23 nt, Human
uuccagugggcugcuuucugguc

SEQ ID NO: 598636 - RNA, 23 nt, Human
uucugagauuuuccuguuuugga

SEQ ID NO: 598637 - RNA, 28 nt, Human
uugcugaacuugauuaauucuauuacac

SEQ ID NO: 598638 - RNA, 20 nt, Human
uuuuuggaguuuucugaaca

SEQ ID NO: 598639 - RNA, 19 nt, Human
aagaggcccugcagcuggc

SEQ ID NO: 598640 - RNA, 21 nt, Human
acacagcgacaggucccacaa

SEQ ID NO: 598641 - RNA, 18 nt, Human
aggacacagaaggggagg

SEQ ID NO: 598642 - RNA, 22 nt, Human
aggaccugcgccgucagauccu

SEQ ID NO: 598643 - RNA, 21 nt, Human
aggaccuugauggaggguggg

SEQ ID NO: 598644 - RNA, 18 nt, Human
aggagcaggaggcuuugc

SEQ ID NO: 598645 - RNA, 21 nt, Human
aggaggcuuugcaagguagac

SEQ ID NO: 598646 - RNA, 21 nt, Human
agggagcaggggcugggcugg

SEQ ID NO: 598647 - RNA, 22 nt, Human
agggagcaggggcugggcugga

SEQ ID NO: 598648 - RNA, 26 nt, Human
aggggacugggaaugcagccgccagg

SEQ ID NO: 598649 - RNA, 22 nt, Human
aggggccucugagaugaugggc

SEQ ID NO: 598650 - RNA, 24 nt, Human
aucaguuccccugaggauuuguua

SEQ ID NO: 598651 - RNA, 24 nt, Human
auuaaaauacagaggaugccucug

SEQ ID NO: 598652 - RNA, 22 nt, Human
cagaauccaggucugggguuuc

SEQ ID NO: 598653 - RNA, 20 nt, Human
cagaguucauuaaaauacag

SEQ ID NO: 598654 - RNA, 30 nt, Human
cagauuaaaaugcagaguucauuaaaauag

SEQ ID NO: 598655 - RNA, 21 nt, Human
cagcaagaggcccugcagcug

SEQ ID NO: 598656 - RNA, 19 nt, Human
cagccgccaggaccagcac

SEQ ID NO: 598657 - RNA, 20 nt, Human
cagcuggcuggcuggcugga

SEQ ID NO: 598658 - RNA, 18 nt, Human
caggggcaccugagcucc

SEQ ID NO: 598659 - RNA, 27 nt, Human
caggggccucugagaugaugggcucug

SEQ ID NO: 598660 - RNA, 20 nt, Human
cauuucccaguacugugcuc

SEQ ID NO: 598661 - RNA, 20 nt, Human
ccaucagcucuuaagcagca

SEQ ID NO: 598662 - RNA, 24 nt, Human
cccccacacagcgacaggucccac

SEQ ID NO: 598663 - RNA, 23 nt, Human
cccgcccacugucacagagacca

SEQ ID NO: 598664 - RNA, 25 nt, Human
ccucugagaugaugggcucugguuc

SEQ ID NO: 598665 - RNA, 20 nt, Human
ccugcagcuggcuggcuggc

SEQ ID NO: 598666 - RNA, 18 nt, Human
ccuggggccacguucccc

SEQ ID NO: 598667 - RNA, 20 nt, Human
cgacagcccccacacagcga

SEQ ID NO: 598668 - RNA, 19 nt, Human
cgaccgcccaucaguuccc

SEQ ID NO: 598669 - RNA, 25 nt, Human
cgccaggaccagcacugacagccaa

SEQ ID NO: 598670 - RNA, 26 nt, Human
cggccagagccgaguggcaacggaaa

SEQ ID NO: 598671 - RNA, 20 nt, Human
cggugcagggccccgcccag

SEQ ID NO: 598672 - RNA, 20 nt, Human
cugcagaaugugaccccggc

SEQ ID NO: 598673 - RNA, 19 nt, Human
cugcaggacacagaagggg

SEQ ID NO: 598674 - RNA, 20 nt, Human
cugggcucugaggguccugg

SEQ ID NO: 598675 - RNA, 24 nt, Human
cugguuccuggccuguagcauggg

SEQ ID NO: 598676 - RNA, 22 nt, Human
cuguaugcccauuucccaguac

SEQ ID NO: 598677 - RNA, 23 nt, Human
cuguaugcccauuucccaguacu

SEQ ID NO: 598678 - RNA, 22 nt, Human
cuuugcaagguagacucuacag

SEQ ID NO: 598679 - RNA, 20 nt, Human
gcagcuggcuggcuggcugg

SEQ ID NO: 598680 - RNA, 18 nt, Human
gcaggacacagaagggga

SEQ ID NO: 598681 - RNA, 18 nt, Human
gcccugcagcuggcuggc

SEQ ID NO: 598682 - RNA, 20 nt, Human
ggagauguaaacccuccugc

SEQ ID NO: 598683 - RNA, 18 nt, Human
ggcucugaggguccuggu

SEQ ID NO: 598684 - RNA, 21 nt, Human
ggcugcauccucugcaguugc

SEQ ID NO: 598685 - RNA, 26 nt, Human
ggcugggcuggagucggugcagggcc

SEQ ID NO: 598686 - RNA, 22 nt, Human
gggaaugaacagacaugcugca

SEQ ID NO: 598687 - RNA, 25 nt, Human
gggaggaccugcgccgucagauccu

SEQ ID NO: 598688 - RNA, 20 nt, Human
uaagaagucugggcuaggcu

SEQ ID NO: 598689 - RNA, 24 nt, Human
uaagcagguggcugcauccucugc

SEQ ID NO: 598690 - RNA, 19 nt, Human
uccaggguguggaggaccc

SEQ ID NO: 598691 - RNA, 20 nt, Human
uccaggguguggaggaccca

SEQ ID NO: 598692 - RNA, 18 nt, Human
ucccaauacugugcuccc

SEQ ID NO: 598693 - RNA, 22 nt, Human
uccccgcagagggagcaggggc

SEQ ID NO: 598694 - RNA, 24 nt, Human
uccccugaggauuuguuacguucu

SEQ ID NO: 598695 - RNA, 25 nt, Human
ucugguuccuggccuguagcauggg

SEQ ID NO: 598696 - RNA, 18 nt, Human
ugagcccccauuucccag

SEQ ID NO: 598697 - RNA, 19 nt, Human
ugaugggcucugguuccug

SEQ ID NO: 598698 - RNA, 19 nt, Human
ugcaaggcuggcucuucuu

SEQ ID NO: 598699 - RNA, 20 nt, Human
uggagggugggguuucaggg

SEQ ID NO: 598700 - RNA, 21 nt, Human
uggagggugggguuucagggg

SEQ ID NO: 598701 - RNA, 19 nt, Human
uggcccagcacugccuggg

SEQ ID NO: 598702 - RNA, 20 nt, Human
uggcuggcuggcuggacagc

SEQ ID NO: 598703 - RNA, 18 nt, Human
uggguaggagcaggaggc

SEQ ID NO: 598704 - RNA, 20 nt, Human
ugggugugaugaagaugaug

SEQ ID NO: 598705 - RNA, 19 nt, Human
ugugaugaagaugaugaca

SEQ ID NO: 598706 - RNA, 20 nt, Human
uguggaggacccagugcccg

SEQ ID NO: 598707 - RNA, 22 nt, Human
uucccaguacugugggcuccca

SEQ ID NO: 598708 - RNA, 25 nt, Human
uuucccaguacugugcucacaggug

SEQ ID NO: 598709 - RNA, 23 nt, Human
aaaacacucugaucugaggccaa

SEQ ID NO: 598710 - RNA, 21 nt, Human
aaagaagaggaagagaaagag

SEQ ID NO: 598711 - RNA, 23 nt, Human
aaccugcaacccacaacagccga

SEQ ID NO: 598712 - RNA, 19 nt, Human
aagagagagaaagaagagg

SEQ ID NO: 598713 - RNA, 25 nt, Human
aagcaagagagagagaggagggacc

SEQ ID NO: 598714 - RNA, 22 nt, Human
acaggaagggaagagagaggag

SEQ ID NO: 598715 - RNA, 24 nt, Human
accacaacagcagcacccaaccug

SEQ ID NO: 598716 - RNA, 25 nt, Human
acccaaccugcaacccacaacagcc

SEQ ID NO: 598717 - RNA, 23 nt, Human
acccacugaagcaccccgugucc

SEQ ID NO: 598718 - RNA, 20 nt, Human
acccgggcuguggaaggccc

SEQ ID NO: 598719 - RNA, 21 nt, Human
acuggccaggccaaaaugaaa

SEQ ID NO: 598720 - RNA, 23 nt, Human
agaaagaagaggaagagaaagag

SEQ ID NO: 598721 - RNA, 23 nt, Human
agaaagaaguggagaaaagggac

SEQ ID NO: 598722 - RNA, 24 nt, Human
agacaggaagggaagagagaggag

SEQ ID NO: 598723 - RNA, 26 nt, Human
agacaggaagggaagagaggggaccc

SEQ ID NO: 598724 - RNA, 26 nt, Human
agacaggagagagagaagagggaccc

SEQ ID NO: 598725 - RNA, 26 nt, Human
agacaggaggggaagagaggggaccc

SEQ ID NO: 598726 - RNA, 18 nt, Human
agagacaggaagggaaga

SEQ ID NO: 598727 - RNA, 18 nt, Human
agagacaggaggggaaga

SEQ ID NO: 598728 - RNA, 22 nt, Human
agagacaggagggguagagaga

SEQ ID NO: 598729 - RNA, 18 nt, Human
agagagaaagaagaggaa

SEQ ID NO: 598730 - RNA, 18 nt, Human
agagagagaagaaagcaa

SEQ ID NO: 598731 - RNA, 21 nt, Human
agagagagaggagaggaagag

SEQ ID NO: 598732 - RNA, 21 nt, Human
agagagagaggagaggaagag

SEQ ID NO: 598733 - RNA, 21 nt, Human
agagagagaggagaggaagag

SEQ ID NO: 598734 - RNA, 21 nt, Human
agagagagaggagaggaagag

SEQ ID NO: 598735 - RNA, 18 nt, Human
agagagaggaggggagga

SEQ ID NO: 598736 - RNA, 18 nt, Human
agagagaggaggggagga

SEQ ID NO: 598737 - RNA, 26 nt, Human
agagaggagaggaagagauagaggag

SEQ ID NO: 598738 - RNA, 22 nt, Human
agagauagaggacaggaagaga

SEQ ID NO: 598739 - RNA, 22 nt, Human
agagauagaggaggggaagaga

SEQ ID NO: 598740 - RNA, 18 nt, Human
agaggaagagaaagagag

SEQ ID NO: 598741 - RNA, 18 nt, Human
agaggaagagagacagag

SEQ ID NO: 598742 - RNA, 18 nt, Human
agaggaagagagacagag

SEQ ID NO: 598743 - RNA, 18 nt, Human
agaggaagagagagagga

SEQ ID NO: 598744 - RNA, 18 nt, Human
agaggaagagaggagagg

SEQ ID NO: 598745 - RNA, 21 nt, Human
agaggaagagauagaggaggg

SEQ ID NO: 598746 - RNA, 23 nt, Human
agaggacaggaagagagagagga

SEQ ID NO: 598747 - RNA, 22 nt, Human
agaggagaagagagagaaagaa

SEQ ID NO: 598748 - RNA, 18 nt, Human
agaggagaggaagagaga

SEQ ID NO: 598749 - RNA, 22 nt, Human
agaggaggggaagagauagagg

SEQ ID NO: 598750 - RNA, 18 nt, Human
agaggaggggaggagaga

SEQ ID NO: 598751 - RNA, 27 nt, Human
agaggaggggaggagagacaggagggg

SEQ ID NO: 598752 - RNA, 24 nt, Human
agagggcccuggaggaggaaggcc

SEQ ID NO: 598753 - RNA, 22 nt, Human
agcaagagagagagaggagagg

SEQ ID NO: 598754 - RNA, 21 nt, Human
agccuggucugcagagggccc

SEQ ID NO: 598755 - RNA, 23 nt, Human
aggaagagagagaggagaggaag

SEQ ID NO: 598756 - RNA, 23 nt, Human
aggaagagagagaggagaggaag

SEQ ID NO: 598757 - RNA, 23 nt, Human
aggaagagagagaggagaggaag

SEQ ID NO: 598758 - RNA, 18 nt, Human
aggaagagagagaggagg

SEQ ID NO: 598759 - RNA, 18 nt, Human
aggaagagagagaggagg

SEQ ID NO: 598760 - RNA, 21 nt, Human
aggaagagagaggagaggaag

SEQ ID NO: 598761 - RNA, 21 nt, Human
aggaagagagaggaggggagg

SEQ ID NO: 598762 - RNA, 19 nt, Human
aggaagagaggagaggaag

SEQ ID NO: 598763 - RNA, 18 nt, Human
aggaagagauagaggagg

SEQ ID NO: 598764 - RNA, 25 nt, Human
aggaagggaagagagaggagaggaa

SEQ ID NO: 598765 - RNA, 22 nt, Human
aggagaagagagagaaagaaga

SEQ ID NO: 598766 - RNA, 22 nt, Human
aggaggggaagagauagaggac

SEQ ID NO: 598767 - RNA, 23 nt, Human
aggaggggaggagagacaggagg

SEQ ID NO: 598768 - RNA, 24 nt, Human
aggaggggaggagagacaggaggg

SEQ ID NO: 598769 - RNA, 19 nt, Human
aggccaaaaugaaacaucu

SEQ ID NO: 598770 - RNA, 19 nt, Human
agggcgugaugauuuaaaa

SEQ ID NO: 598771 - RNA, 18 nt, Human
aggggaagagagacagga

SEQ ID NO: 598772 - RNA, 18 nt, Human
aggggaggagagacagga

SEQ ID NO: 598773 - RNA, 18 nt, Human
aggggaggagagacagga

SEQ ID NO: 598774 - RNA, 26 nt, Human
auccaagaccaccagagcaggcccac

SEQ ID NO: 598775 - RNA, 24 nt, Human
caaaauacaaauugcugaaguggg

SEQ ID NO: 598776 - RNA, 25 nt, Human
caaccugcaacccacaacagccgag

SEQ ID NO: 598777 - RNA, 21 nt, Human
caagaccaccagagcaggccc

SEQ ID NO: 598778 - RNA, 24 nt, Human
caccagaaauccagaagacaccuu

SEQ ID NO: 598779 - RNA, 20 nt, Human
caccagagcaggcccaccag

SEQ ID NO: 598780 - RNA, 23 nt, Human
cacugaagcaccccguguccugg

SEQ ID NO: 598781 - RNA, 19 nt, Human
cagaagacaccugaagagg

SEQ ID NO: 598782 - RNA, 18 nt, Human
cagcaaccucaaccggca

SEQ ID NO: 598783 - RNA, 19 nt, Human
cagcacccaaccugcaacc

SEQ ID NO: 598784 - RNA, 23 nt, Human
cagcagcacccaaccugcaaccc

SEQ ID NO: 598785 - RNA, 27 nt, Human
cagcaggcaggaggcagcaggagaacc

SEQ ID NO: 598786 - RNA, 21 nt, Human
cagguuccuccaucucagccu

SEQ ID NO: 598787 - RNA, 24 nt, Human
caugcuucaaggagagagggugac

SEQ ID NO: 598788 - RNA, 22 nt, Human
ccaaccugcaacccacaacagc

SEQ ID NO: 598789 - RNA, 24 nt, Human
ccacguugccccucagaaugccug

SEQ ID NO: 598790 - RNA, 18 nt, Human
ccacugaagcaccccgug

SEQ ID NO: 598791 - RNA, 22 nt, Human
ccacugaagcaccccguguccu

SEQ ID NO: 598792 - RNA, 18 nt, Human
ccagguugaaggcauggc

SEQ ID NO: 598793 - RNA, 26 nt, Human
ccaugcaucccuggcccuuccuccac

SEQ ID NO: 598794 - RNA, 20 nt, Human
cccacugaagcaccccgugu

SEQ ID NO: 598795 - RNA, 19 nt, Human
ccggcacccggaguuccgc

SEQ ID NO: 598796 - RNA, 21 nt, Human
ccguguccuggcucgaccagg

SEQ ID NO: 598797 - RNA, 22 nt, Human
ccuccaucucagccuggucugc

SEQ ID NO: 598798 - RNA, 19 nt, Human
ccuccugccagguugaagg

SEQ ID NO: 598799 - RNA, 25 nt, Human
ccugcagcugcagcaggcaggaggc

SEQ ID NO: 598800 - RNA, 20 nt, Human
ccugcugguacaggagcagg

SEQ ID NO: 598801 - RNA, 19 nt, Human
ccuggcccuuccuccacgu

SEQ ID NO: 598802 - RNA, 27 nt, Human
cuacaguggagauucuggugagugugg

SEQ ID NO: 598803 - RNA, 23 nt, Human
cugccagguugaaggcauggcug

SEQ ID NO: 598804 - RNA, 19 nt, Human
cugugccggaagcgcccuc

SEQ ID NO: 598805 - RNA, 23 nt, Human
gaccacaacagcagcacccaacc

SEQ ID NO: 598806 - RNA, 26 nt, Human
gaccacaacagcagcacccaaccugg

SEQ ID NO: 598807 - RNA, 20 nt, Human
gagaaagaagaggaagagaa

SEQ ID NO: 598808 - RNA, 22 nt, Human
gagaaagaagaggaagagaaag

SEQ ID NO: 598809 - RNA, 19 nt, Human
gagaaagagaggagaagag

SEQ ID NO: 598810 - RNA, 20 nt, Human
gagacaggaagggaagagag

SEQ ID NO: 598811 - RNA, 20 nt, Human
gagagagagagaauaucagc

SEQ ID NO: 598812 - RNA, 23 nt, Human
gagaggaagagagaggagaggaa

SEQ ID NO: 598813 - RNA, 22 nt, Human
gagaggaagagauagaggaggg

SEQ ID NO: 598814 - RNA, 18 nt, Human
gaggacaggaagagagag

SEQ ID NO: 598815 - RNA, 18 nt, Human
gaggagagacaggagggg

SEQ ID NO: 598816 - RNA, 20 nt, Human
gagugggagaaagaagugga

SEQ ID NO: 598817 - RNA, 19 nt, Human
gagugugggugggcucgcc

SEQ ID NO: 598818 - RNA, 19 nt, Human
gaguuccgcugugccggaa

SEQ ID NO: 598819 - RNA, 20 nt, Human
gccacuggccaggccaaaau

SEQ ID NO: 598820 - RNA, 22 nt, Human
gccagugaccccaauauuuucu

SEQ ID NO: 598821 - RNA, 20 nt, Human
gcuuucagccacuggccagg

SEQ ID NO: 598822 - RNA, 19 nt, Human
gcuuugaaguggccccugc

SEQ ID NO: 598823 - RNA, 20 nt, Human
ggaagagauagaggacagga

SEQ ID NO: 598824 - RNA, 19 nt, Human
ggacaggaagagagagagg

SEQ ID NO: 598825 - RNA, 19 nt, Human
ggagaacccgggcugugga

SEQ ID NO: 598826 - RNA, 26 nt, Human
ggagaggaagagagagaggagaggaa

SEQ ID NO: 598827 - RNA, 26 nt, Human
ggagaggaagagagagaggagaggaa

SEQ ID NO: 598828 - RNA, 23 nt, Human
ggagaggaagagagagaggaggg

SEQ ID NO: 598829 - RNA, 29 nt, Human
ggagaggaagagagagaggaggggaggag

SEQ ID NO: 598830 - RNA, 21 nt, Human
ggagaggaagagagaggaggg

SEQ ID NO: 598831 - RNA, 27 nt, Human
ggagaggaagagagaggaggggaggag

SEQ ID NO: 598832 - RNA, 26 nt, Human
ggagaggaagagauagaggaggggaa

SEQ ID NO: 598833 - RNA, 20 nt, Human
ggaggaugaggaguggcuac

SEQ ID NO: 598834 - RNA, 23 nt, Human
ggaggggaggagagacaggaggg

SEQ ID NO: 598835 - RNA, 23 nt, Human
ggaggggaggagagacaggaggg

SEQ ID NO: 598836 - RNA, 21 nt, Human
gggaagagagagaagaggaag

SEQ ID NO: 598837 - RNA, 21 nt, Human
gggaagagagaggagaggaag

SEQ ID NO: 598838 - RNA, 23 nt, Human
gggacuacaguggagauucuggu

SEQ ID NO: 598839 - RNA, 22 nt, Human
gggaggagagacaggaggggua

SEQ ID NO: 598840 - RNA, 21 nt, Human
ggguagagagaggagaggaag

SEQ ID NO: 598841 - RNA, 19 nt, Human
gguacaggagcagggugag

SEQ ID NO: 598842 - RNA, 18 nt, Human
gguagagagaggagagga

SEQ ID NO: 598843 - RNA, 21 nt, Human
guccaucaccagaaauccaga

SEQ ID NO: 598844 - RNA, 24 nt, Human
gucugcagagggcccuggaggagg

SEQ ID NO: 598845 - RNA, 22 nt, Human
uaaauaaaagcaacaugcuuca

SEQ ID NO: 598846 - RNA, 20 nt, Human
ucagccacuggccaggccaa

SEQ ID NO: 598847 - RNA, 22 nt, Human
uccaucaccagaaauccagaag

SEQ ID NO: 598848 - RNA, 25 nt, Human
uccaucaccagaaauccagaagaca

SEQ ID NO: 598849 - RNA, 18 nt, Human
uccccaggcaccuugcug

SEQ ID NO: 598850 - RNA, 19 nt, Human
uccccaggcaccuugcugg

SEQ ID NO: 598851 - RNA, 19 nt, Human
ucucugggaaagcugcugg

SEQ ID NO: 598852 - RNA, 22 nt, Human
ucugaucugaggccaauggcau

SEQ ID NO: 598853 - RNA, 18 nt, Human
ucugcucaagucucccca

SEQ ID NO: 598854 - RNA, 22 nt, Human
ucuguccaucaccagaaaucca

SEQ ID NO: 598855 - RNA, 22 nt, Human
ugaaacaucugcucaagucucc

SEQ ID NO: 598856 - RNA, 19 nt, Human
ugaagaggacugacuguuu

SEQ ID NO: 598857 - RNA, 19 nt, Human
ugaagcaccccguguccug

SEQ ID NO: 598858 - RNA, 21 nt, Human
ugaagcaccccguguccuggc

SEQ ID NO: 598859 - RNA, 19 nt, Human
ugaagugggagaggaagug

SEQ ID NO: 598860 - RNA, 21 nt, Human
ugacagacccacugaagcacc

SEQ ID NO: 598861 - RNA, 19 nt, Human
ugacuguuucuuugccacg

SEQ ID NO: 598862 - RNA, 18 nt, Human
ugaggaguggcuacaccu

SEQ ID NO: 598863 - RNA, 21 nt, Human
ugagugggagaaagaagugga

SEQ ID NO: 598864 - RNA, 19 nt, Human
ugcugaagugggagaggaa

SEQ ID NO: 598865 - RNA, 20 nt, Human
ugcuggaccacaaguuauca

SEQ ID NO: 598866 - RNA, 22 nt, Human
ugcuggggaagccagaggucac

SEQ ID NO: 598867 - RNA, 25 nt, Human
ugcugggggugagugggagaaagaa

SEQ ID NO: 598868 - RNA, 23 nt, Human
uggcaucaaaauacaaauugcug

SEQ ID NO: 598869 - RNA, 20 nt, Human
uggcuacaccuccugccagg

SEQ ID NO: 598870 - RNA, 19 nt, Human
uggcuuugaaguggccccu

SEQ ID NO: 598871 - RNA, 22 nt, Human
ugggaaagcugcuggggaagcc

SEQ ID NO: 598872 - RNA, 23 nt, Human
ugggaaggaccacaacagcagca

SEQ ID NO: 598873 - RNA, 22 nt, Human
ugggagaggaagugaagggcug

SEQ ID NO: 598874 - RNA, 22 nt, Human
ugggaggcuagaagcaucucca

SEQ ID NO: 598875 - RNA, 23 nt, Human
uggggaagccagaggucacagug

SEQ ID NO: 598876 - RNA, 19 nt, Human
uggugagugugggugggcu

SEQ ID NO: 598877 - RNA, 26 nt, Human
uguggaaggccccucugccuucaaag

SEQ ID NO: 598878 - RNA, 27 nt, Human
uguggaaggccccucugccuucaaagg

SEQ ID NO: 598879 - RNA, 23 nt, Human
uuaaaacacucugaucugaggcc

SEQ ID NO: 598880 - RNA, 19 nt, Human
uucuggugagugugggugg

SEQ ID NO: 598881 - RNA, 23 nt, Human
uugaaacuguaaaaagauuucuc

SEQ ID NO: 598882 - RNA, 26 nt, Human
uugaaggcauggcuggggccuccuac

SEQ ID NO: 598883 - RNA, 20 nt, Human
uuggcuuugaaguggccccu

SEQ ID NO: 598884 - RNA, 19 nt, Human
aaaacacaaaagauuucac

SEQ ID NO: 598885 - RNA, 21 nt, Human
aaacaaccucccccagagaau

SEQ ID NO: 598886 - RNA, 23 nt, Human
aaagggagagaaauaaaggaaau

SEQ ID NO: 598887 - RNA, 23 nt, Human
aagaaacaaccucccccagagaa

SEQ ID NO: 598888 - RNA, 19 nt, Human
aagguccuauucugcuccu

SEQ ID NO: 598889 - RNA, 22 nt, Human
aaugaagaguuuggcaauggug

SEQ ID NO: 598890 - RNA, 19 nt, Human
acuagacugcucugaagca

SEQ ID NO: 598891 - RNA, 19 nt, Human
agaaaaacagagaagucag

SEQ ID NO: 598892 - RNA, 23 nt, Human
agacaggaguauaucgggaccua

SEQ ID NO: 598893 - RNA, 21 nt, Human
agagaccccaaagcaacacca

SEQ ID NO: 598894 - RNA, 21 nt, Human
agaggaaggacagaggaagag

SEQ ID NO: 598895 - RNA, 20 nt, Human
agagugaguaggggagaugg

SEQ ID NO: 598896 - RNA, 21 nt, Human
agaugggaaauggcggggggc

SEQ ID NO: 598897 - RNA, 20 nt, Human
agcacacauucagaggguag

SEQ ID NO: 598898 - RNA, 20 nt, Human
agccaucuaaccaagaaguc

SEQ ID NO: 598899 - RNA, 19 nt, Human
aggaaggacagaggaagag

SEQ ID NO: 598900 - RNA, 21 nt, Human
agggauaggguagcuguuagu

SEQ ID NO: 598901 - RNA, 19 nt, Human
aucuuagaaggcucuguuc

SEQ ID NO: 598902 - RNA, 21 nt, Human
caacaccaguuugggguuccc

SEQ ID NO: 598903 - RNA, 20 nt, Human
caccuacacaaaauguggaa

SEQ ID NO: 598904 - RNA, 20 nt, Human
caguggcuucccacucucug

SEQ ID NO: 598905 - RNA, 22 nt, Human
cauauaagguccuauucugcuc

SEQ ID NO: 598906 - RNA, 22 nt, Human
cauggagcagggaaggucgucc

SEQ ID NO: 598907 - RNA, 24 nt, Human
ccacccaucuuauugauccaucuc

SEQ ID NO: 598908 - RNA, 19 nt, Human
ccaucucucugauggauuc

SEQ ID NO: 598909 - RNA, 19 nt, Human
cccacucucugucagacac

SEQ ID NO: 598910 - RNA, 23 nt, Human
cccugcccaccccaggucuccca

SEQ ID NO: 598911 - RNA, 30 nt, Human
cccugcccaccccaggucucccagggcagg

SEQ ID NO: 598912 - RNA, 22 nt, Human
ccugcccaccccaggucuccca

SEQ ID NO: 598913 - RNA, 21 nt, Human
ccuucacugcauuuuuuuccc

SEQ ID NO: 598914 - RNA, 25 nt, Human
ccuuugggaagcugguaagucccug

SEQ ID NO: 598915 - RNA, 21 nt, Human
cgggaccuagcuaccagggag

SEQ ID NO: 598916 - RNA, 21 nt, Human
cuauucugcuccuucacugca

SEQ ID NO: 598917 - RNA, 19 nt, Human
cugacaccuacacaaaaug

SEQ ID NO: 598918 - RNA, 19 nt, Human
cugcuccuucacugcauuu

SEQ ID NO: 598919 - RNA, 19 nt, Human
cugcuccuucacugcauuu

SEQ ID NO: 598920 - RNA, 21 nt, Human
gaaacaaccucccccagagaa

SEQ ID NO: 598921 - RNA, 18 nt, Human
gaaggacagaggaagagu

SEQ ID NO: 598922 - RNA, 18 nt, Human
gaaggauguuauggaugg

SEQ ID NO: 598923 - RNA, 25 nt, Human
gacaccuacacaaaauguggaaaug

SEQ ID NO: 598924 - RNA, 28 nt, Human
gaccccccccaagccacccaucuuauug

SEQ ID NO: 598925 - RNA, 18 nt, Human
gagaaaaacagagaaguc

SEQ ID NO: 598926 - RNA, 19 nt, Human
gagaaaaacagagaaguca

SEQ ID NO: 598927 - RNA, 19 nt, Human
gagaggaaggacagaggaa

SEQ ID NO: 598928 - RNA, 18 nt, Human
gagcuugcucacuagcgg

SEQ ID NO: 598929 - RNA, 18 nt, Human
gaggugaagagaaaggga

SEQ ID NO: 598930 - RNA, 19 nt, Human
gaucugggggaaauggugg

SEQ ID NO: 598931 - RNA, 18 nt, Human
gcccacucccugccugcu

SEQ ID NO: 598932 - RNA, 20 nt, Human
ggaaauggcggggggcgggg

SEQ ID NO: 598933 - RNA, 20 nt, Human
ggaccccccccaagccaccc

SEQ ID NO: 598934 - RNA, 22 nt, Human
ggaccccccccaagccacccau

SEQ ID NO: 598935 - RNA, 23 nt, Human
ggagaugggaaauggcggggggc

SEQ ID NO: 598936 - RNA, 20 nt, Human
ggcaaguguggcaggcagca

SEQ ID NO: 598937 - RNA, 20 nt, Human
ggcauggagcagggaagguc

SEQ ID NO: 598938 - RNA, 20 nt, Human
ggcggggggcgggggagaga

SEQ ID NO: 598939 - RNA, 22 nt, Human
gggaaaguauucagagcccaag

SEQ ID NO: 598940 - RNA, 24 nt, Human
ggggggcgggggagagaaaaacag

SEQ ID NO: 598941 - RNA, 22 nt, Human
ggggugcuuuuguguuaagaaa

SEQ ID NO: 598942 - RNA, 24 nt, Human
ggggugcuuuuguguuaagaaaag

SEQ ID NO: 598943 - RNA, 21 nt, Human
gggguucccugcccaccccag

SEQ ID NO: 598944 - RNA, 25 nt, Human
ggguagcuguuaguaucgacucucc

SEQ ID NO: 598945 - RNA, 18 nt, Human
gggucugagguccucagg

SEQ ID NO: 598946 - RNA, 19 nt, Human
ggugaagagaaagggagag

SEQ ID NO: 598947 - RNA, 18 nt, Human
guccuauucugcuccuuc

SEQ ID NO: 598948 - RNA, 24 nt, Human
gucguccuugcuauggaggaaagg

SEQ ID NO: 598949 - RNA, 18 nt, Human
guuaagaaaagcuacaaa

SEQ ID NO: 598950 - RNA, 22 nt, Human
uaaccaagaagucuggcaacag

SEQ ID NO: 598951 - RNA, 19 nt, Human
uaagaaaagcuacaaagug

SEQ ID NO: 598952 - RNA, 23 nt, Human
uaagaaaagcuacaaaguguuag

SEQ ID NO: 598953 - RNA, 18 nt, Human
uagagaccccaaagcaac

SEQ ID NO: 598954 - RNA, 23 nt, Human
uagagaccccaaagcaacaccag

SEQ ID NO: 598955 - RNA, 20 nt, Human
ucacugcauuuuuuucccag

SEQ ID NO: 598956 - RNA, 18 nt, Human
ucagagcggggaagggag

SEQ ID NO: 598957 - RNA, 24 nt, Human
ucagccaaucuccuuuagagaccc

SEQ ID NO: 598958 - RNA, 19 nt, Human
ucccaaucuuagaaggcuc

SEQ ID NO: 598959 - RNA, 25 nt, Human
ucccccaucucaucucgacaaucuc

SEQ ID NO: 598960 - RNA, 22 nt, Human
ucccugcccaccccaggucucc

SEQ ID NO: 598961 - RNA, 26 nt, Human
uccuugcuauggaggaaaggagagag

SEQ ID NO: 598962 - RNA, 19 nt, Human
ugaguaggggagaugggga

SEQ ID NO: 598963 - RNA, 21 nt, Human
ugaguaggggagauggggaga

SEQ ID NO: 598964 - RNA, 20 nt, Human
ugaucuagcacacauucaga

SEQ ID NO: 598965 - RNA, 29 nt, Human
uggacucuuggcacacaagccaguggcuu

SEQ ID NO: 598966 - RNA, 19 nt, Human
uggaggaaaggagagagga

SEQ ID NO: 598967 - RNA, 25 nt, Human
uggcaauggugaguagaucccuuug

SEQ ID NO: 598968 - RNA, 19 nt, Human
ugggaaaguauucagagcc

SEQ ID NO: 598969 - RNA, 21 nt, Human
ugggaggaagggagaugggaa

SEQ ID NO: 598970 - RNA, 20 nt, Human
ugucuaagaaaguagaagag

SEQ ID NO: 598971 - RNA, 21 nt, Human
uguguuaagaaaagcuacaaa

SEQ ID NO: 598972 - RNA, 22 nt, Human
uguuauggaugggaggaaggga

SEQ ID NO: 598973 - RNA, 23 nt, Human
uguuauggaugggaggaagggag

SEQ ID NO: 598974 - RNA, 23 nt, Human
uuagaaaacacaaaagauuucac

SEQ ID NO: 598975 - RNA, 19 nt, Human
uucaggaccccccccaagc

SEQ ID NO: 598976 - RNA, 18 nt, Human
uugggaaaguauucagag

SEQ ID NO: 598977 - RNA, 24 nt, Human
uuucccagaucacuugcacaaaua

SEQ ID NO: 598978 - RNA, 22 nt, Human
uuugccauuucuaacauccucu

SEQ ID NO: 598979 - RNA, 22 nt, Human
uuuggcaauggugaguagaucc

SEQ ID NO: 598980 - RNA, 28 nt, Human
uuuuuucccagaucacuugcacaaauau

SEQ ID NO: 598981 - RNA, 25 nt, Human
aaagaggcacccagagaagcccccu

SEQ ID NO: 598982 - RNA, 24 nt, Human
aaagugcugggauuacaggcguga

SEQ ID NO: 598983 - RNA, 22 nt, Human
aacagcugagggucuucagugu

SEQ ID NO: 598984 - RNA, 19 nt, Human
aagugcugggauuacaggc

SEQ ID NO: 598985 - RNA, 19 nt, Human
aagugcugggauuacaggc

SEQ ID NO: 598986 - RNA, 26 nt, Human
aagugcugggauuacaggcgugagcc

SEQ ID NO: 598987 - RNA, 18 nt, Human
acaaaagauggccuggag

SEQ ID NO: 598988 - RNA, 21 nt, Human
accaguagggcuaggcuggga

SEQ ID NO: 598989 - RNA, 20 nt, Human
accaucuucccgggagcaag

SEQ ID NO: 598990 - RNA, 24 nt, Human
acgggauuucuccauguuggucag

SEQ ID NO: 598991 - RNA, 21 nt, Human
acugagcccauggagggugcu

SEQ ID NO: 598992 - RNA, 19 nt, Human
agacaaggcccugagcaac

SEQ ID NO: 598993 - RNA, 23 nt, Human
agacauggcagcaaagaggcacc

SEQ ID NO: 598994 - RNA, 22 nt, Human
agagaagcccccggggccuggg

SEQ ID NO: 598995 - RNA, 20 nt, Human
agaggagagacugcagggcc

SEQ ID NO: 598996 - RNA, 19 nt, Human
agccccgggcccccccugc

SEQ ID NO: 598997 - RNA, 23 nt, Human
aggaggagccugucccaggccca

SEQ ID NO: 598998 - RNA, 18 nt, Human
aggcaggagggacugccu

SEQ ID NO: 598999 - RNA, 19 nt, Human
aggcaggagggacugccug

SEQ ID NO: 599000 - RNA, 19 nt, Human
aggcaggagggacugccug

SEQ ID NO: 599001 - RNA, 20 nt, Human
aggcaggagggacugccugg

SEQ ID NO: 599002 - RNA, 22 nt, Human
aggcaggagggacugccuggcu

SEQ ID NO: 599003 - RNA, 23 nt, Human
agggagccccgggcccccccugc

SEQ ID NO: 599004 - RNA, 20 nt, Human
agggugcuguggagcuugcu

SEQ ID NO: 599005 - RNA, 24 nt, Human
aggugauccacccaccucggccuc

SEQ ID NO: 599006 - RNA, 23 nt, Human
aguagcugggauuacaggcaugu

SEQ ID NO: 599007 - RNA, 31 nt, Human
agugcaauugcuauggcgugaucuuggcucc

SEQ ID NO: 599008 - RNA, 18 nt, Human
agugccaugggacuggcu

SEQ ID NO: 599009 - RNA, 18 nt, Human
agugcugggauuacaggc

SEQ ID NO: 599010 - RNA, 23 nt, Human
auggcagcaaagaggcacccaga

SEQ ID NO: 599011 - RNA, 18 nt, Human
augugccaccacgcccag

SEQ ID NO: 599012 - RNA, 24 nt, Human
auucugccaaccuccaagcucacc

SEQ ID NO: 599013 - RNA, 21 nt, Human
caaaauaucugcagggcgcag

SEQ ID NO: 599014 - RNA, 26 nt, Human
caaacuccugacuucaggugauccaa

SEQ ID NO: 599015 - RNA, 21 nt, Human
caaacuggcuccugccgcuga

SEQ ID NO: 599016 - RNA, 24 nt, Human
caaagugcugggauuacaggcgug

SEQ ID NO: 599017 - RNA, 21 nt, Human
caaccccgagcucugccuccu

SEQ ID NO: 599018 - RNA, 23 nt, Human
caaccuccaagcucaccaucagc

SEQ ID NO: 599019 - RNA, 24 nt, Human
caaccuccaagcucaccaucagcc

SEQ ID NO: 599020 - RNA, 25 nt, Human
caaccuccaagcucaccaucagccu

SEQ ID NO: 599021 - RNA, 20 nt, Human
caagaacacagcaaaccaac

SEQ ID NO: 599022 - RNA, 21 nt, Human
cacacagcauguugcugucag

SEQ ID NO: 599023 - RNA, 20 nt, Human
cacagcaaaccaacgcacac

SEQ ID NO: 599024 - RNA, 22 nt, Human
cacccaccucggccucccaaag

SEQ ID NO: 599025 - RNA, 23 nt, Human
cacccaccucggccucccaaagu

SEQ ID NO: 599026 - RNA, 21 nt, Human
caccgcaaccuccgccuccug

SEQ ID NO: 599027 - RNA, 24 nt, Human
caccucggccucccaaagugcugg

SEQ ID NO: 599028 - RNA, 22 nt, Human
cacgguggccuuggaacccgcu

SEQ ID NO: 599029 - RNA, 19 nt, Human
cacgugaagacagcaaagc

SEQ ID NO: 599030 - RNA, 20 nt, Human
cagaaggagcugauggaauu

SEQ ID NO: 599031 - RNA, 24 nt, Human
cagacauuugcagccugcccagua

SEQ ID NO: 599032 - RNA, 21 nt, Human
cagcaaagaggcacccagaga

SEQ ID NO: 599033 - RNA, 19 nt, Human
cagcaaccccgagcucugc

SEQ ID NO: 599034 - RNA, 26 nt, Human
cagccuccugcagccccacuuguuuc

SEQ ID NO: 599035 - RNA, 21 nt, Human
cagcuacuggaccccgacccc

SEQ ID NO: 599036 - RNA, 22 nt, Human
cagggagccccgggcccccccu

SEQ ID NO: 599037 - RNA, 23 nt, Human
cagggccuggcacacacagggcc

SEQ ID NO: 599038 - RNA, 18 nt, Human
caggucugugggggcugg

SEQ ID NO: 599039 - RNA, 20 nt, Human
ccaaagugcugggauuacag

SEQ ID NO: 599040 - RNA, 22 nt, Human
ccaaagugcugggauuacaggc

SEQ ID NO: 599041 - RNA, 22 nt, Human
ccaaagugcugggauuacaggc

SEQ ID NO: 599042 - RNA, 24 nt, Human
ccaaagugcugggauuacaggcgu

SEQ ID NO: 599043 - RNA, 25 nt, Human
ccaaccuccaagcucaccaucagcc

SEQ ID NO: 599044 - RNA, 20 nt, Human
ccaccacgcccagcuaauuu

SEQ ID NO: 599045 - RNA, 24 nt, Human
ccaggccggagugcaauugcuaug

SEQ ID NO: 599046 - RNA, 18 nt, Human
ccauguuggucaggcuag

SEQ ID NO: 599047 - RNA, 18 nt, Human
ccccaucguccccaggca

SEQ ID NO: 599048 - RNA, 18 nt, Human
cccccggggccuggggcu

SEQ ID NO: 599049 - RNA, 20 nt, Human
ccccugcagagguuccugcu

SEQ ID NO: 599050 - RNA, 19 nt, Human
cccgggcccccccugcaga

SEQ ID NO: 599051 - RNA, 21 nt, Human
cccugagcaacaaacuggcuc

SEQ ID NO: 599052 - RNA, 23 nt, Human
ccgaguagcugggauuacaggca

SEQ ID NO: 599053 - RNA, 24 nt, Human
ccgaguagcugggauuacaggcau

SEQ ID NO: 599054 - RNA, 18 nt, Human
ccgcaaccuccgccuccu

SEQ ID NO: 599055 - RNA, 23 nt, Human
ccgcaaccuccgccuccuggguu

SEQ ID NO: 599056 - RNA, 24 nt, Human
ccgcaaccuccgccuccuggguuc

SEQ ID NO: 599057 - RNA, 20 nt, Human
ccgcagcaaccccgagcucu

SEQ ID NO: 599058 - RNA, 22 nt, Human
ccgcagcaaccccgagcucugc

SEQ ID NO: 599059 - RNA, 27 nt, Human
ccgccuccuggguucaagcaauucuuu

SEQ ID NO: 599060 - RNA, 20 nt, Human
ccggagccuggguggagcag

SEQ ID NO: 599061 - RNA, 24 nt, Human
ccuaggacugggacaaaagauggc

SEQ ID NO: 599062 - RNA, 21 nt, Human
ccucacucacggcucccccug

SEQ ID NO: 599063 - RNA, 21 nt, Human
ccuccaggacacgcagcuuca

SEQ ID NO: 599064 - RNA, 19 nt, Human
ccuccgccuccuggguuca

SEQ ID NO: 599065 - RNA, 24 nt, Human
ccuccuggguucaagcaauucucc

SEQ ID NO: 599066 - RNA, 24 nt, Human
ccugacuucaggugauccacccac

SEQ ID NO: 599067 - RNA, 19 nt, Human
ccugcccaguacucuccug

SEQ ID NO: 599068 - RNA, 23 nt, Human
ccuggcuucuggagggagaggag

SEQ ID NO: 599069 - RNA, 23 nt, Human
ccuggguucaagcaauucuccug

SEQ ID NO: 599070 - RNA, 21 nt, Human
ccuguccacccgugugucugu

SEQ ID NO: 599071 - RNA, 21 nt, Human
cgcagccgcaggucugugggg

SEQ ID NO: 599072 - RNA, 21 nt, Human
cgcgaugggagaggcggccua

SEQ ID NO: 599073 - RNA, 29 nt, Human
cggagugcaauugcuauggcgugaucuug

SEQ ID NO: 599074 - RNA, 21 nt, Human
cggcucccccuggccgcugcu

SEQ ID NO: 599075 - RNA, 24 nt, Human
cgggauuucuccauguuggucagg

SEQ ID NO: 599076 - RNA, 23 nt, Human
cgugcagacauggcagcaaagag

SEQ ID NO: 599077 - RNA, 24 nt, Human
cuccauguuggucaggcuagucuc

SEQ ID NO: 599078 - RNA, 24 nt, Human
cuccgaguagcugggauuacaggc

SEQ ID NO: 599079 - RNA, 21 nt, Human
cuccuggguucaagcaauucu

SEQ ID NO: 599080 - RNA, 21 nt, Human
cugcuggauaggaaauugugu

SEQ ID NO: 599081 - RNA, 20 nt, Human
cugcuucuguccugucuuaa

SEQ ID NO: 599082 - RNA, 19 nt, Human
cuggauggauggucccccu

SEQ ID NO: 599083 - RNA, 23 nt, Human
cuggcuucuggagggagaggagg

SEQ ID NO: 599084 - RNA, 21 nt, Human
cugucagggagcacugccggc

SEQ ID NO: 599085 - RNA, 23 nt, Human
cuuuuccacgugaagacagcaaa

SEQ ID NO: 599086 - RNA, 24 nt, Human
gacuucaggugauccacccaccuc

SEQ ID NO: 599087 - RNA, 21 nt, Human
gagacgggauuucuccauguu

SEQ ID NO: 599088 - RNA, 23 nt, Human
gagacgggauuucuccauguugg

SEQ ID NO: 599089 - RNA, 19 nt, Human
gagcaggucacagggaugc

SEQ ID NO: 599090 - RNA, 25 nt, Human
gaguagcugggauuacaggcaugug

SEQ ID NO: 599091 - RNA, 18 nt, Human
gauuacaggcaugugcca

SEQ ID NO: 599092 - RNA, 18 nt, Human
gauuacaggcgugagcca

SEQ ID NO: 599093 - RNA, 22 nt, Human
gauuacaggcgugagccacugc

SEQ ID NO: 599094 - RNA, 22 nt, Human
gauuacaggcgugagccacugc

SEQ ID NO: 599095 - RNA, 20 nt, Human
gcagcaaagaggcacccaga

SEQ ID NO: 599096 - RNA, 25 nt, Human
gcagcaaccccgagcucugccuccu

SEQ ID NO: 599097 - RNA, 19 nt, Human
gcaggucugugggggcugg

SEQ ID NO: 599098 - RNA, 23 nt, Human
gcccagcuaauuuuuuguauuuu

SEQ ID NO: 599099 - RNA, 19 nt, Human
gcccaggccggagugcaau

SEQ ID NO: 599100 - RNA, 25 nt, Human
gccccgggcccccccugcagagguu

SEQ ID NO: 599101 - RNA, 25 nt, Human
gcccugagcaacaaacuggcuccug

SEQ ID NO: 599102 - RNA, 21 nt, Human
gcucuuguugcccaggccgga

SEQ ID NO: 599103 - RNA, 24 nt, Human
ggagcaagacugagcccauggagg

SEQ ID NO: 599104 - RNA, 21 nt, Human
ggagggagaggaggagccugu

SEQ ID NO: 599105 - RNA, 19 nt, Human
ggauuacaggcaugugcca

SEQ ID NO: 599106 - RNA, 21 nt, Human
ggccuuggaacccgcuucagc

SEQ ID NO: 599107 - RNA, 24 nt, Human
ggcgguugugggguucgcuuccag

SEQ ID NO: 599108 - RNA, 21 nt, Human
ggcuucuggagggagaggagg

SEQ ID NO: 599109 - RNA, 22 nt, Human
gggagcaagacugagcccaugg

SEQ ID NO: 599110 - RNA, 19 nt, Human
gggagccccgggccccccc

SEQ ID NO: 599111 - RNA, 23 nt, Human
gggauuucuccauguuggucagg

SEQ ID NO: 599112 - RNA, 19 nt, Human
ggugacagcaaacuaccga

SEQ ID NO: 599113 - RNA, 18 nt, Human
guagcugggauuacaggc

SEQ ID NO: 599114 - RNA, 20 nt, Human
guagcugggauuacaggcau

SEQ ID NO: 599115 - RNA, 24 nt, Human
gugauccacccaccucggccuccc

SEQ ID NO: 599116 - RNA, 20 nt, Human
gugcagacauggcagcaaag

SEQ ID NO: 599117 - RNA, 18 nt, Human
gugggggcuggugucugg

SEQ ID NO: 599118 - RNA, 22 nt, Human
uaaaaagacaaggcccugagca

SEQ ID NO: 599119 - RNA, 19 nt, Human
uaacaagcgugagagcauc

SEQ ID NO: 599120 - RNA, 24 nt, Human
uaauuuuuuguauuuuuaguagag

SEQ ID NO: 599121 - RNA, 25 nt, Human
uaauuuuuuguauuuuuaguagaga

SEQ ID NO: 599122 - RNA, 24 nt, Human
uacaggcaugugccaccacgccca

SEQ ID NO: 599123 - RNA, 22 nt, Human
uacaggcgugagccacugcgcc

SEQ ID NO: 599124 - RNA, 22 nt, Human
uacaggcgugagccacugcgcc

SEQ ID NO: 599125 - RNA, 23 nt, Human
uacaggcgugagccacugcgccu

SEQ ID NO: 599126 - RNA, 23 nt, Human
uacgacacuggcuuuuccacgug

SEQ ID NO: 599127 - RNA, 18 nt, Human
uagaauucugccaaccuc

SEQ ID NO: 599128 - RNA, 19 nt, Human
uagaauucugccaaccucc

SEQ ID NO: 599129 - RNA, 24 nt, Human
uaguagagacgggauuucuccaug

SEQ ID NO: 599130 - RNA, 19 nt, Human
ucaagcaauucuccugccu

SEQ ID NO: 599131 - RNA, 24 nt, Human
ucaccgcaaccuccgccuccuggg

SEQ ID NO: 599132 - RNA, 25 nt, Human
ucaccgcaaccuccgccuccugggu

SEQ ID NO: 599133 - RNA, 27 nt, Human
ucaccgcaaccuccgccuccuggguuc

SEQ ID NO: 599134 - RNA, 21 nt, Human
ucagccuccugcagccccacu

SEQ ID NO: 599135 - RNA, 24 nt, Human
ucagccuccugcagccccacuugu

SEQ ID NO: 599136 - RNA, 24 nt, Human
ucccaaagugcugggauuacaggc

SEQ ID NO: 599137 - RNA, 19 nt, Human
ucccuccuucuggcuggcu

SEQ ID NO: 599138 - RNA, 23 nt, Human
uccgaguagcugggauuacaggc

SEQ ID NO: 599139 - RNA, 24 nt, Human
uccgaguagcugggauuacaggca

SEQ ID NO: 599140 - RNA, 24 nt, Human
uccgccuccuggguucaagcaauu

SEQ ID NO: 599141 - RNA, 25 nt, Human
uccugcagccccacuuguuucuggg

SEQ ID NO: 599142 - RNA, 21 nt, Human
uccuggguucaagcaauucuc

SEQ ID NO: 599143 - RNA, 24 nt, Human
uccuggguucaagcaauucuccug

SEQ ID NO: 599144 - RNA, 18 nt, Human
ucggccucccaaagugcu

SEQ ID NO: 599145 - RNA, 22 nt, Human
ucgguagccuggucugcucucc

SEQ ID NO: 599146 - RNA, 21 nt, Human
ucugccaaccuccaagcucac

SEQ ID NO: 599147 - RNA, 19 nt, Human
ucuucccgggagcaagacu

SEQ ID NO: 599148 - RNA, 23 nt, Human
ugacagcaaacuaccgaacuacu

SEQ ID NO: 599149 - RNA, 21 nt, Human
ugacuucaggugauccaccca

SEQ ID NO: 599150 - RNA, 24 nt, Human
ugacuucaggugauccacccaccu

SEQ ID NO: 599151 - RNA, 25 nt, Human
ugagaaacugaggcaggagggacug

SEQ ID NO: 599152 - RNA, 21 nt, Human
ugagaacacaggagacaaucc

SEQ ID NO: 599153 - RNA, 21 nt, Human
ugaggcaggagggacugccug

SEQ ID NO: 599154 - RNA, 24 nt, Human
ugauccacccaccucggccuccca

SEQ ID NO: 599155 - RNA, 23 nt, Human
ugcccaggccggagugcaauugc

SEQ ID NO: 599156 - RNA, 22 nt, Human
ugcuauggcgugaucuuggcuc

SEQ ID NO: 599157 - RNA, 24 nt, Human
ugcugggauuacaggcgugagcca

SEQ ID NO: 599158 - RNA, 20 nt, Human
ugcuguggagcuugcugcag

SEQ ID NO: 599159 - RNA, 25 nt, Human
uggaccccgaccccaucguccccag

SEQ ID NO: 599160 - RNA, 18 nt, Human
ugggauuacaggcaugug

SEQ ID NO: 599161 - RNA, 21 nt, Human
ugggauuacaggcaugugcca

SEQ ID NO: 599162 - RNA, 22 nt, Human
ugggauuacaggcaugugccac

SEQ ID NO: 599163 - RNA, 24 nt, Human
ugggauuacaggcaugugccacca

SEQ ID NO: 599164 - RNA, 18 nt, Human
ugggauuacaggcgugag

SEQ ID NO: 599165 - RNA, 19 nt, Human
ugggauuacaggcgugagc

SEQ ID NO: 599166 - RNA, 21 nt, Human
ugggauuacaggcgugagcca

SEQ ID NO: 599167 - RNA, 22 nt, Human
ugggauuacaggcgugagccac

SEQ ID NO: 599168 - RNA, 22 nt, Human
ugggauuacaggcgugagccac

SEQ ID NO: 599169 - RNA, 24 nt, Human
ugggauuacaggcgugagccacug

SEQ ID NO: 599170 - RNA, 24 nt, Human
ugggauuacaggcgugagccacug

SEQ ID NO: 599171 - RNA, 22 nt, Human
ugggggcuggugucuggccucc

SEQ ID NO: 599172 - RNA, 21 nt, Human
uggguucaagcaauucuccug

SEQ ID NO: 599173 - RNA, 23 nt, Human
uggguucaagcaauucuccugcc

SEQ ID NO: 599174 - RNA, 24 nt, Human
uggguucaagcaauucuccugccu

SEQ ID NO: 599175 - RNA, 24 nt, Human
uggucaggcuagucucaaacuccu

SEQ ID NO: 599176 - RNA, 19 nt, Human
ugucagggagcacugccgg

SEQ ID NO: 599177 - RNA, 19 nt, Human
uguccugcccgcuccgcag

SEQ ID NO: 599178 - RNA, 23 nt, Human
ugucucauccaccugcugucugc

SEQ ID NO: 599179 - RNA, 19 nt, Human
uguggagcuugcugcaggu

SEQ ID NO: 599180 - RNA, 19 nt, Human
uguggccuaaggcgguugu

SEQ ID NO: 599181 - RNA, 19 nt, Human
ugugggcaacaugcaugug

SEQ ID NO: 599182 - RNA, 21 nt, Human
ugugggguucgcuuccagucu

SEQ ID NO: 599183 - RNA, 20 nt, Human
uguugcccaggccggagugc

SEQ ID NO: 599184 - RNA, 22 nt, Human
uguugcccaggccggagugcaa

SEQ ID NO: 599185 - RNA, 24 nt, Human
uguugcugucagggaacggccucc

SEQ ID NO: 599186 - RNA, 21 nt, Human
uguuuugaaaucaacauagag

SEQ ID NO: 599187 - RNA, 18 nt, Human
uuaguagagacgggauuu

SEQ ID NO: 599188 - RNA, 24 nt, Human
uuaguagagacgggauuucuccau

SEQ ID NO: 599189 - RNA, 21 nt, Human
uucaagcaauucuccugccuc

SEQ ID NO: 599190 - RNA, 27 nt, Human
uucaagcaauucuccugccuccgagua

SEQ ID NO: 599191 - RNA, 18 nt, Human
uuccugcugccggccaga

SEQ ID NO: 599192 - RNA, 21 nt, Human
uugcagccugcccaguacucu

SEQ ID NO: 599193 - RNA, 23 nt, Human
uugcagccugcccaguacucucc

SEQ ID NO: 599194 - RNA, 25 nt, Human
uuuaacacagacauuugcagccugc

SEQ ID NO: 599195 - RNA, 21 nt, Human
uuucuccauguuggucaggcu

SEQ ID NO: 599196 - RNA, 22 nt, Human
uuugcagccugcccaguacucu

SEQ ID NO: 599197 - RNA, 24 nt, Human
uuugcucuuguugcccaggccgga

SEQ ID NO: 599198 - RNA, 20 nt, Human
uuuugcucuuguugcccagg

SEQ ID NO: 599199 - RNA, 23 nt, Human
uuuugcucuuguugcccaggccg

SEQ ID NO: 599200 - RNA, 19 nt, Human
uuuuuaguagagacgggau

SEQ ID NO: 599201 - RNA, 21 nt, Human
uuuuuguauuuuuaguagaga

SEQ ID NO: 599202 - RNA, 24 nt, Human
uuuuuuguauuuuuaguagagacg

SEQ ID NO: 599203 - RNA, 22 nt, Human
aaaaacaucuaaaacugaccug

SEQ ID NO: 599204 - RNA, 20 nt, Human
aacuaggcuugcaaacuaaa

SEQ ID NO: 599205 - RNA, 24 nt, Human
aagaacuaggcuugcaaacuaaaa

SEQ ID NO: 599206 - RNA, 26 nt, Human
aagcagaaaguggauuuccaaucuaa

SEQ ID NO: 599207 - RNA, 26 nt, Human
aaggaucaaaaacaucuaaaacugac

SEQ ID NO: 599208 - RNA, 18 nt, Human
aagucaugaauggguagg

SEQ ID NO: 599209 - RNA, 20 nt, Human
agacacaguaagcagaaagu

SEQ ID NO: 599210 - RNA, 23 nt, Human
aggggucagcaaacuuuucccag

SEQ ID NO: 599211 - RNA, 25 nt, Human
aguuaggauucugcucuccuaauug

SEQ ID NO: 599212 - RNA, 18 nt, Human
auuugguaccuggaccau

SEQ ID NO: 599213 - RNA, 24 nt, Human
caucuaaaacugaccuggaaugaa

SEQ ID NO: 599214 - RNA, 23 nt, Human
cuaaaacagagaaucugacucac

SEQ ID NO: 599215 - RNA, 22 nt, Human
gauucugcucuccuaauuggga

SEQ ID NO: 599216 - RNA, 19 nt, Human
gcaaaaccagccauagaua

SEQ ID NO: 599217 - RNA, 19 nt, Human
guuccaauagaacuuauuu

SEQ ID NO: 599218 - RNA, 21 nt, Human
uaaaacagagaaucugacuca

SEQ ID NO: 599219 - RNA, 21 nt, Human
uaaaauaucaaaggaucaaaa

SEQ ID NO: 599220 - RNA, 21 nt, Human
uaauauaaagcaugagaccua

SEQ ID NO: 599221 - RNA, 21 nt, Human
uaauugggaaaaaauuccaag

SEQ ID NO: 599222 - RNA, 23 nt, Human
uacagaguuucuauugcaacuaa

SEQ ID NO: 599223 - RNA, 24 nt, Human
uaccuggaccauaguuugcugacc

SEQ ID NO: 599224 - RNA, 18 nt, Human
uagcaguuaggauucugc

SEQ ID NO: 599225 - RNA, 23 nt, Human
uagugcaaaaccagccauagaua

SEQ ID NO: 599226 - RNA, 21 nt, Human
uaucuaauauaaagcaugaga

SEQ ID NO: 599227 - RNA, 25 nt, Human
uauguagagaagguugauaaaccuu

SEQ ID NO: 599228 - RNA, 22 nt, Human
ucuaaaacagagaaucugacuc

SEQ ID NO: 599229 - RNA, 21 nt, Human
ugcaaaaccagccauagauaa

SEQ ID NO: 599230 - RNA, 25 nt, Human
ugcaaaaccagccauagauaacacg

SEQ ID NO: 599231 - RNA, 22 nt, Human
ugcaugaauaucacaguggaua

SEQ ID NO: 599232 - RNA, 25 nt, Human
ugugauauaauuuacauacaaaaaa

SEQ ID NO: 599233 - RNA, 20 nt, Human
uuaaugcucggugaauugaa

SEQ ID NO: 599234 - RNA, 24 nt, Human
uugcuucaauaucuaauauaaagc

SEQ ID NO: 599235 - RNA, 23 nt, Human
aaguccuccccggaugcgcuucc

SEQ ID NO: 599236 - RNA, 19 nt, Human
aauaaaagggcagacggga

SEQ ID NO: 599237 - RNA, 22 nt, Human
acaaagucaccccugcaccucu

SEQ ID NO: 599238 - RNA, 23 nt, Human
agacacgcccacgcccuccucug

SEQ ID NO: 599239 - RNA, 23 nt, Human
agagaaaguuuccagaacuugaa

SEQ ID NO: 599240 - RNA, 24 nt, Human
agcgccgaccccacccgcgcacga

SEQ ID NO: 599241 - RNA, 19 nt, Human
agggcccccuccuuuccac

SEQ ID NO: 599242 - RNA, 23 nt, Human
aguggugcugccugcagcuuuaa

SEQ ID NO: 599243 - RNA, 22 nt, Human
auaccagacacgcccacgcccu

SEQ ID NO: 599244 - RNA, 22 nt, Human
caaagucaccccugcaccucuc

SEQ ID NO: 599245 - RNA, 18 nt, Human
caccucucgcucccucca

SEQ ID NO: 599246 - RNA, 19 nt, Human
caccucucgcucccuccac

SEQ ID NO: 599247 - RNA, 20 nt, Human
cacgcccuccucugccccgc

SEQ ID NO: 599248 - RNA, 20 nt, Human
cacugccaccccccucccgc

SEQ ID NO: 599249 - RNA, 22 nt, Human
ccaacaaagucaccccugcacc

SEQ ID NO: 599250 - RNA, 20 nt, Human
ccacacgcgacaagcgccga

SEQ ID NO: 599251 - RNA, 19 nt, Human
ccacugccaccccccuccc

SEQ ID NO: 599252 - RNA, 28 nt, Human
ccagcuaguccugcugccaacaaaguca

SEQ ID NO: 599253 - RNA, 19 nt, Human
ccauaccagacacgcccac

SEQ ID NO: 599254 - RNA, 18 nt, Human
cccacugcgcgccacacg

SEQ ID NO: 599255 - RNA, 20 nt, Human
cccacugcgcgccacacgcg

SEQ ID NO: 599256 - RNA, 21 nt, Human
cccacugcgcgccacacgcgg

SEQ ID NO: 599257 - RNA, 21 nt, Human
cccauaccagacacgcccacg

SEQ ID NO: 599258 - RNA, 21 nt, Human
ccccuccuuuccacugcaucc

SEQ ID NO: 599259 - RNA, 22 nt, Human
ccccugcaccucucgcucccuc

SEQ ID NO: 599260 - RNA, 22 nt, Human
cccgcaaguccuccccggaugc

SEQ ID NO: 599261 - RNA, 26 nt, Human
cccuccacugccaccccccucccgcc

SEQ ID NO: 599262 - RNA, 21 nt, Human
cccuccuuuccacugcauccc

SEQ ID NO: 599263 - RNA, 24 nt, Human
ccgccgcccgccccacugcgcgcc

SEQ ID NO: 599264 - RNA, 19 nt, Human
ccgccucucccgcgccucg

SEQ ID NO: 599265 - RNA, 24 nt, Human
ccucccgccgcccgccccacugcg

SEQ ID NO: 599266 - RNA, 18 nt, Human
ccucucgcucccuccacu

SEQ ID NO: 599267 - RNA, 22 nt, Human
ccucucgcucccuccacugcca

SEQ ID NO: 599268 - RNA, 19 nt, Human
cgacaagcgccgaccccac

SEQ ID NO: 599269 - RNA, 22 nt, Human
cgggcuucucgguguccaccgc

SEQ ID NO: 599270 - RNA, 22 nt, Human
cucccuccacugccaccccccu

SEQ ID NO: 599271 - RNA, 24 nt, Human
cucuggaaaucucaaguggugcug

SEQ ID NO: 599272 - RNA, 25 nt, Human
cucuuuagaaugaacaaaggucugg

SEQ ID NO: 599273 - RNA, 23 nt, Human
cugacaaauaaaagggcagacgg

SEQ ID NO: 599274 - RNA, 18 nt, Human
cugccccgcaaguccucc

SEQ ID NO: 599275 - RNA, 21 nt, Human
cugccccgcaaguccuccccg

SEQ ID NO: 599276 - RNA, 24 nt, Human
cugccugcagcuuuaaaaggcuga

SEQ ID NO: 599277 - RNA, 19 nt, Human
cuggguccucuggaaaucu

SEQ ID NO: 599278 - RNA, 19 nt, Human
cuuccaggucuagcucucc

SEQ ID NO: 599279 - RNA, 20 nt, Human
gaacuugaacagagaccaug

SEQ ID NO: 599280 - RNA, 20 nt, Human
gagggcccccuccuuuccac

SEQ ID NO: 599281 - RNA, 21 nt, Human
gcccucuugcuccuucccucu

SEQ ID NO: 599282 - RNA, 22 nt, Human
uaaaaggcugagcacaaaccca

SEQ ID NO: 599283 - RNA, 22 nt, Human
uaaaagggcagacgggaagacg

SEQ ID NO: 599284 - RNA, 21 nt, Human
uaccagacacgcccacgcccu

SEQ ID NO: 599285 - RNA, 18 nt, Human
uagaaagggcccugggca

SEQ ID NO: 599286 - RNA, 18 nt, Human
uccacugccaccccccuc

SEQ ID NO: 599287 - RNA, 27 nt, Human
uccagaacuugaacagagaggacauac

SEQ ID NO: 599288 - RNA, 19 nt, Human
ucccauaccagacacgcca

SEQ ID NO: 599289 - RNA, 21 nt, Human
ucccuccacugccaccccccu

SEQ ID NO: 599290 - RNA, 24 nt, Human
ucccucgcugacaaauaaaagggc

SEQ ID NO: 599291 - RNA, 24 nt, Human
ucucuuuagaaugaacaaagguug

SEQ ID NO: 599292 - RNA, 24 nt, Human
aaaacaaaaauauaaucacaacua

SEQ ID NO: 599293 - RNA, 23 nt, Human
aaaauaccuccaaacuuaguuau

SEQ ID NO: 599294 - RNA, 21 nt, Human
aaacaaaaauauaaucacaac

SEQ ID NO: 599295 - RNA, 21 nt, Human
aaacaaacuuuagacugcuga

SEQ ID NO: 599296 - RNA, 25 nt, Human
aaacaagaaacaaaaaauuuaucug

SEQ ID NO: 599297 - RNA, 26 nt, Human
aaacaagaaacaaaaaauuuaucuga

SEQ ID NO: 599298 - RNA, 25 nt, Human
aaaccaaaaaaaaucauaaaagcaa

SEQ ID NO: 599299 - RNA, 18 nt, Human
aaagaauccuccaucaca

SEQ ID NO: 599300 - RNA, 23 nt, Human
aaauauauacuuucaaccuaaug

SEQ ID NO: 599301 - RNA, 19 nt, Human
aacaaaacagagagagagc

SEQ ID NO: 599302 - RNA, 26 nt, Human
aacaaaccaaaaaaaaucauaaaagc

SEQ ID NO: 599303 - RNA, 21 nt, Human
aacagaaaugaaaacaacaac

SEQ ID NO: 599304 - RNA, 22 nt, Human
aaccaaaaaaaaucauaaaagc

SEQ ID NO: 599305 - RNA, 22 nt, Human
aaccuaaaaauaaacaagaaac

SEQ ID NO: 599306 - RNA, 23 nt, Human
aagaauccuccaucacaaguuac

SEQ ID NO: 599307 - RNA, 27 nt, Human
aagcaagcaaaugaacaaaagggaccc

SEQ ID NO: 599308 - RNA, 20 nt, Human
aagcaagcaaaugaacaaag

SEQ ID NO: 599309 - RNA, 21 nt, Human
aagguaggggcuuauuucaug

SEQ ID NO: 599310 - RNA, 23 nt, Human
aauccaccugauauuaaaacaaa

SEQ ID NO: 599311 - RNA, 19 nt, Human
acaggaugguuagaaaaaa

SEQ ID NO: 599312 - RNA, 21 nt, Human
accugauauuaaaacaaacca

SEQ ID NO: 599313 - RNA, 18 nt, Human
agagcucagaaucuuaca

SEQ ID NO: 599314 - RNA, 22 nt, Human
agcaaaugaacaaaaaacccua

SEQ ID NO: 599315 - RNA, 19 nt, Human
agccccgacggccgcgggc

SEQ ID NO: 599316 - RNA, 18 nt, Human
agcugucagaugagaagu

SEQ ID NO: 599317 - RNA, 23 nt, Human
agguauaugaaaaagccaaagua

SEQ ID NO: 599318 - RNA, 18 nt, Human
aucucagauacuuucaaa

SEQ ID NO: 599319 - RNA, 20 nt, Human
augaaaacaacaacguagua

SEQ ID NO: 599320 - RNA, 23 nt, Human
augaacaaaaaacccuaguuuug

SEQ ID NO: 599321 - RNA, 23 nt, Human
augaagucuagccaaacuuaaag

SEQ ID NO: 599322 - RNA, 24 nt, Human
auggcuagaacaaaaccggggucc

SEQ ID NO: 599323 - RNA, 23 nt, Human
caaaauaaaucuagauugacuua

SEQ ID NO: 599324 - RNA, 22 nt, Human
cacaacauuuccccuugguucc

SEQ ID NO: 599325 - RNA, 30 nt, Human
caccacuagguauaugaaaaagccaaaguu

SEQ ID NO: 599326 - RNA, 18 nt, Human
cagauacuuucaaaaucu

SEQ ID NO: 599327 - RNA, 24 nt, Human
cauaaaagcaagcaaaugaacaaa

SEQ ID NO: 599328 - RNA, 20 nt, Human
cauguaacagugcuauuaug

SEQ ID NO: 599329 - RNA, 23 nt, Human
ccaaccuuccaagaaaauaaccu

SEQ ID NO: 599330 - RNA, 22 nt, Human
ccccuuucccaccauucugugc

SEQ ID NO: 599331 - RNA, 22 nt, Human
cggcggcgacagcgaaggcgaa

SEQ ID NO: 599332 - RNA, 23 nt, Human
cggcggcggcggcgacagcgaag

SEQ ID NO: 599333 - RNA, 20 nt, Human
cgggcggcggcggcggcgac

SEQ ID NO: 599334 - RNA, 19 nt, Human
cuauggaauauauugaggc

SEQ ID NO: 599335 - RNA, 21 nt, Human
cuuccaaaucuucaagccuag

SEQ ID NO: 599336 - RNA, 22 nt, Human
cuuucaaccuaauggcugccuc

SEQ ID NO: 599337 - RNA, 20 nt, Human
cuuuucagauauguugguug

SEQ ID NO: 599338 - RNA, 22 nt, Human
gaggagugggagaaggcagggg

SEQ ID NO: 599339 - RNA, 24 nt, Human
gccuaucccuguagaagaguguga

SEQ ID NO: 599340 - RNA, 21 nt, Human
ggccgcgggcggcggcggcgg

SEQ ID NO: 599341 - RNA, 23 nt, Human
ggccgcgggcggcggcggcggcg

SEQ ID NO: 599342 - RNA, 18 nt, Human
ggcggcggcggcggcgac

SEQ ID NO: 599343 - RNA, 21 nt, Human
gggcggcggcggcggcgacag

SEQ ID NO: 599344 - RNA, 23 nt, Human
gggcggcggcggcggcgacagcg

SEQ ID NO: 599345 - RNA, 23 nt, Human
guugauuuuauguauauauugcu

SEQ ID NO: 599346 - RNA, 24 nt, Human
uaaaacaaaaauauaaucacaacu

SEQ ID NO: 599347 - RNA, 21 nt, Human
uaaaucugugcucuaacacag

SEQ ID NO: 599348 - RNA, 25 nt, Human
uaacacaggcuuuguaaaaaagaga

SEQ ID NO: 599349 - RNA, 19 nt, Human
uaacauuauuaaugaacca

SEQ ID NO: 599350 - RNA, 26 nt, Human
uaaccaaacaguaagauaccaaagaa

SEQ ID NO: 599351 - RNA, 23 nt, Human
uaacugauaaauuucaaaccaaa

SEQ ID NO: 599352 - RNA, 24 nt, Human
uaaggcaccacuagguauaugaaa

SEQ ID NO: 599353 - RNA, 20 nt, Human
uaaugcaguaugacaauucu

SEQ ID NO: 599354 - RNA, 19 nt, Human
uacuuucuauggaauauau

SEQ ID NO: 599355 - RNA, 20 nt, Human
uagaaaaaagcugcuaacau

SEQ ID NO: 599356 - RNA, 24 nt, Human
uagaacaaaacagagaggggaggc

SEQ ID NO: 599357 - RNA, 24 nt, Human
uagaauuuaaaacaaacuuuagac

SEQ ID NO: 599358 - RNA, 21 nt, Human
uauagagugaaaauaccucca

SEQ ID NO: 599359 - RNA, 22 nt, Human
uaugacaauucuguauaacuga

SEQ ID NO: 599360 - RNA, 23 nt, Human
uauugcuuagaaacaaaaaucca

SEQ ID NO: 599361 - RNA, 23 nt, Human
uccaagaaaauaaccuaaaaaua

SEQ ID NO: 599362 - RNA, 20 nt, Human
ucccccaaaguugauuucuc

SEQ ID NO: 599363 - RNA, 19 nt, Human
ucuaacacaggcuuuguaa

SEQ ID NO: 599364 - RNA, 26 nt, Human
ucucagauagccacaccugauuaaau

SEQ ID NO: 599365 - RNA, 24 nt, Human
ugaaaaagccaaaguauuuccaaa

SEQ ID NO: 599366 - RNA, 22 nt, Human
ugaaaauaccuccaaacuuagu

SEQ ID NO: 599367 - RNA, 19 nt, Human
ugaaauagacaauacuucc

SEQ ID NO: 599368 - RNA, 18 nt, Human
ugcgguauauucagauuu

SEQ ID NO: 599369 - RNA, 24 nt, Human
uggcuagaacaaaacagagagaga

SEQ ID NO: 599370 - RNA, 21 nt, Human
uguuuauuuucaaggguuuua

SEQ ID NO: 599371 - RNA, 21 nt, Human
uuaaaacaaaccaaaaaaaau

SEQ ID NO: 599372 - RNA, 21 nt, Human
uuaaccaaacaguaagauacc

SEQ ID NO: 599373 - RNA, 22 nt, Human
uuacacccauucauaaacacuc

SEQ ID NO: 599374 - RNA, 23 nt, Human
uuagcauuucucagguuucauga

SEQ ID NO: 599375 - RNA, 24 nt, Human
uuaucucacaacauuuccccuugg

SEQ ID NO: 599376 - RNA, 26 nt, Human
uucauguaacagugcuauuaugauaa

SEQ ID NO: 599377 - RNA, 25 nt, Human
uuccaaaucauguguuuuuguuacu

SEQ ID NO: 599378 - RNA, 23 nt, Human
uuccugaauuugcuagauuccua

SEQ ID NO: 599379 - RNA, 24 nt, Human
uugaggcacauagguuacaaguuu

SEQ ID NO: 599380 - RNA, 21 nt, Human
uuuaaaauauauauuugacaa

SEQ ID NO: 599381 - RNA, 26 nt, Human
uuuccauauuucaaagacuguaguug

SEQ ID NO: 599382 - RNA, 22 nt, Human
uuucucaggcaaauucauggcu

SEQ ID NO: 599383 - RNA, 22 nt, Human
uuugcuagauuccuauguacca

SEQ ID NO: 599384 - RNA, 19 nt, Human
uuuuucaacaaaccagaaa

SEQ ID NO: 599385 - RNA, 23 nt, Human
aaaaaaaaaaaaaaaagaaagaa

SEQ ID NO: 599386 - RNA, 19 nt, Human
aaaaaaaaaaaaaauuagc

SEQ ID NO: 599387 - RNA, 19 nt, Human
aaacacaguuccaguaaac

SEQ ID NO: 599388 - RNA, 19 nt, Human
aaaccucugacaacgacag

SEQ ID NO: 599389 - RNA, 22 nt, Human
aaagacugaaaagagcugauaa

SEQ ID NO: 599390 - RNA, 19 nt, Human
aaaucaguucuuagaaggu

SEQ ID NO: 599391 - RNA, 20 nt, Human
aacacagcaaaacucugucu

SEQ ID NO: 599392 - RNA, 21 nt, Human
aacacagcaaaacucugucuc

SEQ ID NO: 599393 - RNA, 18 nt, Human
aagaaagaaaguacgaga

SEQ ID NO: 599394 - RNA, 24 nt, Human
aagcagugguugcagugagccaag

SEQ ID NO: 599395 - RNA, 19 nt, Human
aaucacuugaacccaggaa

SEQ ID NO: 599396 - RNA, 23 nt, Human
aaucacuugaacccaggaagcag

SEQ ID NO: 599397 - RNA, 24 nt, Human
aaucauaugaggccaggaguucaa

SEQ ID NO: 599398 - RNA, 19 nt, Human
aaugacauggcugagaaaa

SEQ ID NO: 599399 - RNA, 28 nt, Human
acagagcaagcgaggcucugucucaaaa

SEQ ID NO: 599400 - RNA, 24 nt, Human
accaacacagcaaaacucugucuc

SEQ ID NO: 599401 - RNA, 23 nt, Human
accaucucauaauuuaaagaaug

SEQ ID NO: 599402 - RNA, 18 nt, Human
acugcacucuagccuggg

SEQ ID NO: 599403 - RNA, 18 nt, Human
acugcacucuagccuggg

SEQ ID NO: 599404 - RNA, 18 nt, Human
acugcacucuagccuggg

SEQ ID NO: 599405 - RNA, 19 nt, Human
acugcacucuagccugggu

SEQ ID NO: 599406 - RNA, 21 nt, Human
acugcacucuagccuggguga

SEQ ID NO: 599407 - RNA, 22 nt, Human
acugcacucuagccugggugac

SEQ ID NO: 599408 - RNA, 23 nt, Human
acugcacucuagccugggugaca

SEQ ID NO: 599409 - RNA, 24 nt, Human
acugcacucuagccugggugacag

SEQ ID NO: 599410 - RNA, 26 nt, Human
acugcacucuagccugggugacagag

SEQ ID NO: 599411 - RNA, 19 nt, Human
agaaagacugaaaagagcu

SEQ ID NO: 599412 - RNA, 19 nt, Human
agacugaaaagagcugaua

SEQ ID NO: 599413 - RNA, 23 nt, Human
agagcaagcgaggcucugucuca

SEQ ID NO: 599414 - RNA, 21 nt, Human
agccgggugugguggcauuug

SEQ ID NO: 599415 - RNA, 23 nt, Human
agccgggugugguggcauuuguc

SEQ ID NO: 599416 - RNA, 28 nt, Human
agccugggugacagagcaagcgaggcuc

SEQ ID NO: 599417 - RNA, 21 nt, Human
agcgaggcucugucucaaaaa

SEQ ID NO: 599418 - RNA, 21 nt, Human
agcucaugucuguacucccag

SEQ ID NO: 599419 - RNA, 20 nt, Human
aggaagacauuuuuaggcgu

SEQ ID NO: 599420 - RNA, 23 nt, Human
aggaggcugaggcaugagaauca

SEQ ID NO: 599421 - RNA, 21 nt, Human
aggcaggaaaacauucucagu

SEQ ID NO: 599422 - RNA, 26 nt, Human
aggcaggugaaucauaugaggccagg

SEQ ID NO: 599423 - RNA, 18 nt, Human
aggcaugagaaucacuug

SEQ ID NO: 599424 - RNA, 24 nt, Human
aggcugaggcaugagaaucacuug

SEQ ID NO: 599425 - RNA, 24 nt, Human
auaugaggccaggaguucaagacc

SEQ ID NO: 599426 - RNA, 24 nt, Human
aucgugcuacugcacucuagccug

SEQ ID NO: 599427 - RNA, 24 nt, Human
auuaauucauucaaucuuuuaagg

SEQ ID NO: 599428 - RNA, 18 nt, Human
caaaauccuauccucuuc

SEQ ID NO: 599429 - RNA, 24 nt, Human
caacacagcaaaacucugucucua

SEQ ID NO: 599430 - RNA, 22 nt, Human
caacccagagaaaguuuauauc

SEQ ID NO: 599431 - RNA, 19 nt, Human
caacugucagucuuaaaaa

SEQ ID NO: 599432 - RNA, 23 nt, Human
caagauaugauuuuuggaugcuu

SEQ ID NO: 599433 - RNA, 24 nt, Human
caagaucgugcuacugcacucuag

SEQ ID NO: 599434 - RNA, 23 nt, Human
cacuccaaucccaaaagagagag

SEQ ID NO: 599435 - RNA, 22 nt, Human
cacucuagccugggugacagag

SEQ ID NO: 599436 - RNA, 19 nt, Human
cacuucaauaggacaaagu

SEQ ID NO: 599437 - RNA, 18 nt, Human
cagaacuuugggaggcag

SEQ ID NO: 599438 - RNA, 19 nt, Human
cagaagaggugaacugaca

SEQ ID NO: 599439 - RNA, 24 nt, Human
cagagcaagcgaggcucugucuca

SEQ ID NO: 599440 - RNA, 24 nt, Human
caggugaaucauaugaggccagga

SEQ ID NO: 599441 - RNA, 22 nt, Human
caguaaacguguaguuacacug

SEQ ID NO: 599442 - RNA, 19 nt, Human
cauucugcuccuuucuuua

SEQ ID NO: 599443 - RNA, 18 nt, Human
ccaaaagagagagaagcc

SEQ ID NO: 599444 - RNA, 22 nt, Human
ccaauuaaaaaaaaaacaguaa

SEQ ID NO: 599445 - RNA, 25 nt, Human
ccacacuccaaucccaaaagagaga

SEQ ID NO: 599446 - RNA, 24 nt, Human
ccagaacacagaaaaaaaaagcca

SEQ ID NO: 599447 - RNA, 19 nt, Human
ccauccauacaaaugaaca

SEQ ID NO: 599448 - RNA, 19 nt, Human
cccaaaagagagagaagcc

SEQ ID NO: 599449 - RNA, 20 nt, Human
ccugaccaacacagcaaaac

SEQ ID NO: 599450 - RNA, 24 nt, Human
ccugaccaacacagcaaaacucug

SEQ ID NO: 599451 - RNA, 18 nt, Human
ccugggugacagagcaag

SEQ ID NO: 599452 - RNA, 23 nt, Human
cgaggcucugucucaaaaaaaaa

SEQ ID NO: 599453 - RNA, 23 nt, Human
cggcaaugccacacuccaauccc

SEQ ID NO: 599454 - RNA, 21 nt, Human
cuacugcacucuagccugggu

SEQ ID NO: 599455 - RNA, 24 nt, Human
cuacugcacucuagccugggugac

SEQ ID NO: 599456 - RNA, 25 nt, Human
cucaaaaaaaaaaaaaaaagaaaga

SEQ ID NO: 599457 - RNA, 19 nt, Human
cucugucucaaaaaaaaaa

SEQ ID NO: 599458 - RNA, 19 nt, Human
cuggguacagauaagaaaa

SEQ ID NO: 599459 - RNA, 20 nt, Human
gaauggggaaugggaggaaa

SEQ ID NO: 599460 - RNA, 28 nt, Human
gacagagcaagcgaggcucugucucaaa

SEQ ID NO: 599461 - RNA, 23 nt, Human
gagaaucacuugaacccaggaag

SEQ ID NO: 599462 - RNA, 25 nt, Human
gaggcaggugaaucauaugaggcca

SEQ ID NO: 599463 - RNA, 20 nt, Human
gagugguucuuuaccuccgc

SEQ ID NO: 599464 - RNA, 24 nt, Human
gcacucuagccugggugacagagc

SEQ ID NO: 599465 - RNA, 22 nt, Human
gcaugagaaucacuugaaccca

SEQ ID NO: 599466 - RNA, 21 nt, Human
gcccagcagccaucuuaggac

SEQ ID NO: 599467 - RNA, 20 nt, Human
gcgaaggaugucuagccugc

SEQ ID NO: 599468 - RNA, 18 nt, Human
gcuacugcacucuagccu

SEQ ID NO: 599469 - RNA, 24 nt, Human
gcuacugcacucuagccuggguga

SEQ ID NO: 599470 - RNA, 21 nt, Human
gcuuguuuuaugauuuuccgg

SEQ ID NO: 599471 - RNA, 23 nt, Human
ggaaaccucugacaacgacagaa

SEQ ID NO: 599472 - RNA, 20 nt, Human
ggaauggggaaugggaggaa

SEQ ID NO: 599473 - RNA, 23 nt, Human
ggaggugccgacacaccuggucu

SEQ ID NO: 599474 - RNA, 21 nt, Human
gguugcagugagccaagaucg

SEQ ID NO: 599475 - RNA, 19 nt, Human
gucucuacuaaaaauacaa

SEQ ID NO: 599476 - RNA, 23 nt, Human
uaaaaacacaguuccaguaaacg

SEQ ID NO: 599477 - RNA, 22 nt, Human
uaacaguaauauaaucaugauu

SEQ ID NO: 599478 - RNA, 18 nt, Human
uacaaaugucuugaagca

SEQ ID NO: 599479 - RNA, 25 nt, Human
uacaagggcagcaugguagcucaug

SEQ ID NO: 599480 - RNA, 20 nt, Human
uacgagaagcucacuggcug

SEQ ID NO: 599481 - RNA, 19 nt, Human
uacucccagaacuuuggga

SEQ ID NO: 599482 - RNA, 21 nt, Human
uacugcacucuagccugggug

SEQ ID NO: 599483 - RNA, 23 nt, Human
uacugcacucuagccugggugac

SEQ ID NO: 599484 - RNA, 24 nt, Human
uacugcacucuagccugggugaca

SEQ ID NO: 599485 - RNA, 19 nt, Human
uagugcuaucaauuuucug

SEQ ID NO: 599486 - RNA, 18 nt, Human
uaucagacagguaggaaa

SEQ ID NO: 599487 - RNA, 19 nt, Human
uaucugaaaauacacaaaa

SEQ ID NO: 599488 - RNA, 23 nt, Human
uauuccagaacacagaaaaaaaa

SEQ ID NO: 599489 - RNA, 22 nt, Human
ucaaaaaaaaaaaaaaaagaaa

SEQ ID NO: 599490 - RNA, 21 nt, Human
ucaaaguuauauuaucuugag

SEQ ID NO: 599491 - RNA, 21 nt, Human
ucaacuaaaugaaagcaagau

SEQ ID NO: 599492 - RNA, 22 nt, Human
uccaacauuuggucuggauacu

SEQ ID NO: 599493 - RNA, 23 nt, Human
uccaaucccaaaagagagagaag

SEQ ID NO: 599494 - RNA, 22 nt, Human
uccagaacacagaaaaaaaaag

SEQ ID NO: 599495 - RNA, 22 nt, Human
uccagaacacagaaaaaaaaag

SEQ ID NO: 599496 - RNA, 27 nt, Human
uccauacaaaugaacaaaaggaguuuc

SEQ ID NO: 599497 - RNA, 25 nt, Human
uccauccauacaaaugaacaaaauc

SEQ ID NO: 599498 - RNA, 21 nt, Human
uccuuaaagaaagacugaaaa

SEQ ID NO: 599499 - RNA, 18 nt, Human
ucuagccugggugacaga

SEQ ID NO: 599500 - RNA, 18 nt, Human
ucucaaaaaaaaaaaaaa

SEQ ID NO: 599501 - RNA, 25 nt, Human
ucucaaaaaaaaaaaaaaaagaaag

SEQ ID NO: 599502 - RNA, 22 nt, Human
ucucuacuaaaaauacaaaaaa

SEQ ID NO: 599503 - RNA, 23 nt, Human
ucugucucaaaaaaaaaaaaaaa

SEQ ID NO: 599504 - RNA, 22 nt, Human
ucuuaggguccaagauugcaag

SEQ ID NO: 599505 - RNA, 22 nt, Human
ugaaaauacacaaaaauuaaca

SEQ ID NO: 599506 - RNA, 19 nt, Human
ugaaaugaauauuguaggu

SEQ ID NO: 599507 - RNA, 24 nt, Human
ugaaucauaugaggccaggaguuc

SEQ ID NO: 599508 - RNA, 19 nt, Human
ugagaaaaauacuuaggaa

SEQ ID NO: 599509 - RNA, 22 nt, Human
ugagccaagaucgugcuacugc

SEQ ID NO: 599510 - RNA, 24 nt, Human
ugaggcaugagaaucacuugaacc

SEQ ID NO: 599511 - RNA, 18 nt, Human
ugagugguucuuuaccuc

SEQ ID NO: 599512 - RNA, 19 nt, Human
ugagugguucuuuaccucc

SEQ ID NO: 599513 - RNA, 19 nt, Human
ugcaacucugaaauaucaa

SEQ ID NO: 599514 - RNA, 22 nt, Human
ugcuggcagucccguuaacugg

SEQ ID NO: 599515 - RNA, 19 nt, Human
ugggaggcagaggcaggug

SEQ ID NO: 599516 - RNA, 24 nt, Human
ugggaggcagaggcaggugaauca

SEQ ID NO: 599517 - RNA, 21 nt, Human
ugggcacugagcagggaggug

SEQ ID NO: 599518 - RNA, 24 nt, Human
ugguagcucaugucuguacuccca

SEQ ID NO: 599519 - RNA, 22 nt, Human
uggucuuguucaccugcuuguu

SEQ ID NO: 599520 - RNA, 24 nt, Human
uguccauaaucccagcuacucagg

SEQ ID NO: 599521 - RNA, 21 nt, Human
ugucuagccugcuggcagucc

SEQ ID NO: 599522 - RNA, 18 nt, Human
uuagccgggugugguggc

SEQ ID NO: 599523 - RNA, 20 nt, Human
uuagccgggugugguggcau

SEQ ID NO: 599524 - RNA, 19 nt, Human
uuccugucagaaccaggaa

SEQ ID NO: 599525 - RNA, 22 nt, Human
uugcagugagccaagaucgugc

SEQ ID NO: 599526 - RNA, 21 nt, Human
uuuccaacauuuggucuggau

SEQ ID NO: 599527 - RNA, 18 nt, Human
aaagaaaucucuucccuu

SEQ ID NO: 599528 - RNA, 23 nt, Human
aaagacacaaaaauacaagcaca

SEQ ID NO: 599529 - RNA, 24 nt, Human
aacaugucuccaaccagauuacua

SEQ ID NO: 599530 - RNA, 23 nt, Human
aaccucagaauaagcaaagacca

SEQ ID NO: 599531 - RNA, 20 nt, Human
aacuaagucaccccccauaa

SEQ ID NO: 599532 - RNA, 23 nt, Human
aagaaagaaagaaagacacaaaa

SEQ ID NO: 599533 - RNA, 21 nt, Human
aagaaagaaagacacaaaaaa

SEQ ID NO: 599534 - RNA, 22 nt, Human
aagaaagacacaaaaauacaag

SEQ ID NO: 599535 - RNA, 18 nt, Human
aagcaaagaccaccaaga

SEQ ID NO: 599536 - RNA, 23 nt, Human
aauaacgggggcuaccaucagaa

SEQ ID NO: 599537 - RNA, 18 nt, Human
aauggaagugggaagaga

SEQ ID NO: 599538 - RNA, 25 nt, Human
acaagcacaacucacauuuucaaau

SEQ ID NO: 599539 - RNA, 22 nt, Human
acacuauccaaugaagaugaaa

SEQ ID NO: 599540 - RNA, 22 nt, Human
acagagacaauguuuagaggaa

SEQ ID NO: 599541 - RNA, 19 nt, Human
accaagauuaucugaccca

SEQ ID NO: 599542 - RNA, 25 nt, Human
accuuauaagccaggcaaaaaaggu

SEQ ID NO: 599543 - RNA, 19 nt, Human
acuaagucaccccccauaa

SEQ ID NO: 599544 - RNA, 23 nt, Human
acugcaguccacauccuucuccu

SEQ ID NO: 599545 - RNA, 20 nt, Human
agaaagaaagaaagacacaa

SEQ ID NO: 599546 - RNA, 25 nt, Human
agaaagaaagacacaaaaauacaag

SEQ ID NO: 599547 - RNA, 20 nt, Human
agaaauuucugggauaguau

SEQ ID NO: 599548 - RNA, 20 nt, Human
agaauaaaugccccagaaag

SEQ ID NO: 599549 - RNA, 23 nt, Human
agaauaagcaaagaccaccaaga

SEQ ID NO: 599550 - RNA, 23 nt, Human
agaauuacaacaugucuccaacc

SEQ ID NO: 599551 - RNA, 24 nt, Human
agaauuacaacaugucuccaacca

SEQ ID NO: 599552 - RNA, 21 nt, Human
agagaacaaauagaaaguuau

SEQ ID NO: 599553 - RNA, 19 nt, Human
agagacaauguuuagagga

SEQ ID NO: 599554 - RNA, 23 nt, Human
agauaacuaagucaccccccaua

SEQ ID NO: 599555 - RNA, 19 nt, Human
agaugcugucuuggagcgg

SEQ ID NO: 599556 - RNA, 21 nt, Human
agccuggucaauguauaacag

SEQ ID NO: 599557 - RNA, 20 nt, Human
aggaggaggggagaagagga

SEQ ID NO: 599558 - RNA, 21 nt, Human
aggcacuaagugcccauuacu

SEQ ID NO: 599559 - RNA, 23 nt, Human
aguaaggaggagaguagaagaga

SEQ ID NO: 599560 - RNA, 21 nt, Human
aguaaugcuaaaauccaaaac

SEQ ID NO: 599561 - RNA, 23 nt, Human
auccuucuccuaucccuuucccu

SEQ ID NO: 599562 - RNA, 21 nt, Human
caaaaauacaagcacaacuca

SEQ ID NO: 599563 - RNA, 21 nt, Human
caaaccucuaccacuacccag

SEQ ID NO: 599564 - RNA, 24 nt, Human
caacucacauuuucaaauaaagga

SEQ ID NO: 599565 - RNA, 23 nt, Human
caagcacaacucacauuuucaaa

SEQ ID NO: 599566 - RNA, 21 nt, Human
cacacacuucucuauaaaagc

SEQ ID NO: 599567 - RNA, 21 nt, Human
cacauccuucuccuaucccuu

SEQ ID NO: 599568 - RNA, 21 nt, Human
caccgcgccgggucccgcguc

SEQ ID NO: 599569 - RNA, 19 nt, Human
cacugcagcacugcagucc

SEQ ID NO: 599570 - RNA, 22 nt, Human
cagccgcuucgccgcucgccug

SEQ ID NO: 599571 - RNA, 18 nt, Human
caggaggaggaggggaga

SEQ ID NO: 599572 - RNA, 28 nt, Human
cauaacaugcaugggauaaauguacaua

SEQ ID NO: 599573 - RNA, 20 nt, Human
ccaagauuaucugacccaau

SEQ ID NO: 599574 - RNA, 19 nt, Human
ccaggcaaaaaagguucaa

SEQ ID NO: 599575 - RNA, 20 nt, Human
ccaggcaaaaaagguucaau

SEQ ID NO: 599576 - RNA, 18 nt, Human
ccgccgccgcccaccgcg

SEQ ID NO: 599577 - RNA, 22 nt, Human
ccgcuucgccgcucgccugaca

SEQ ID NO: 599578 - RNA, 21 nt, Human
ccggcgguggcaccggcgggc

SEQ ID NO: 599579 - RNA, 21 nt, Human
ccuuucgccgccgccgcccac

SEQ ID NO: 599580 - RNA, 24 nt, Human
ccuuucgccgccgccgcccaccgc

SEQ ID NO: 599581 - RNA, 18 nt, Human
cgccgcccuccagccgcu

SEQ ID NO: 599582 - RNA, 18 nt, Human
cgccgccgccgcccaccg

SEQ ID NO: 599583 - RNA, 19 nt, Human
cggcaggaggaggagggga

SEQ ID NO: 599584 - RNA, 21 nt, Human
cuaagucaccccccauaaccu

SEQ ID NO: 599585 - RNA, 24 nt, Human
cucgccgcccuccagccgcuucgg

SEQ ID NO: 599586 - RNA, 18 nt, Human
gaaaggcuccaaggagaa

SEQ ID NO: 599587 - RNA, 19 nt, Human
gaacaaguccugaaggcac

SEQ ID NO: 599588 - RNA, 19 nt, Human
gaacaagugagcugauagg

SEQ ID NO: 599589 - RNA, 19 nt, Human
gaagaugaaaugcuuggga

SEQ ID NO: 599590 - RNA, 18 nt, Human
gagagaaaguauuuguca

SEQ ID NO: 599591 - RNA, 18 nt, Human
gaggagaguagaagagac

SEQ ID NO: 599592 - RNA, 20 nt, Human
gaugagagaacaaauagaaa

SEQ ID NO: 599593 - RNA, 21 nt, Human
gcaagaauggaagugggaaga

SEQ ID NO: 599594 - RNA, 23 nt, Human
gccguccccuuucgccgccgccg

SEQ ID NO: 599595 - RNA, 19 nt, Human
gcggccucggaacaagcac

SEQ ID NO: 599596 - RNA, 22 nt, Human
ggaggaggaggggagaagagga

SEQ ID NO: 599597 - RNA, 25 nt, Human
ggaggaggaggggagaagaggagcg

SEQ ID NO: 599598 - RNA, 20 nt, Human
gggauaguauagaacaaguc

SEQ ID NO: 599599 - RNA, 23 nt, Human
ggggaggaguugccguccccuuu

SEQ ID NO: 599600 - RNA, 20 nt, Human
guaaugcuaaaauccaaaac

SEQ ID NO: 599601 - RNA, 18 nt, Human
guuuaaaaaaagaaagaa

SEQ ID NO: 599602 - RNA, 20 nt, Human
uaaaaaaagaaagaaagaaa

SEQ ID NO: 599603 - RNA, 18 nt, Human
uaaaaacaccagagcagu

SEQ ID NO: 599604 - RNA, 25 nt, Human
uaaaaacaccagagcaguuggagac

SEQ ID NO: 599605 - RNA, 23 nt, Human
uaaaacucaguccagugcuuucu

SEQ ID NO: 599606 - RNA, 19 nt, Human
uaaaauucuggggguaggg

SEQ ID NO: 599607 - RNA, 19 nt, Human
uaacagaaugaacuuccaa

SEQ ID NO: 599608 - RNA, 24 nt, Human
uaacagcaccucuuaauucagggg

SEQ ID NO: 599609 - RNA, 20 nt, Human
uaagcaaagaccaccaagau

SEQ ID NO: 599610 - RNA, 22 nt, Human
uaagcaaagaccaccaagauua

SEQ ID NO: 599611 - RNA, 19 nt, Human
uaagccccugcaaggcuau

SEQ ID NO: 599612 - RNA, 24 nt, Human
uaagucaccccccauaaccuuccc

SEQ ID NO: 599613 - RNA, 22 nt, Human
uaauucagggguauccgucuua

SEQ ID NO: 599614 - RNA, 26 nt, Human
uacaagcacaacucacauuuucaaaa

SEQ ID NO: 599615 - RNA, 18 nt, Human
uacccagccugaagcaaa

SEQ ID NO: 599616 - RNA, 18 nt, Human
uacuauguaacacuaucc

SEQ ID NO: 599617 - RNA, 19 nt, Human
uagaucccaagggagagag

SEQ ID NO: 599618 - RNA, 21 nt, Human
uagcagcugucuuaaaacuca

SEQ ID NO: 599619 - RNA, 25 nt, Human
ucaacaauaugaaaucauucccaag

SEQ ID NO: 599620 - RNA, 18 nt, Human
ucaagcauaguguugagc

SEQ ID NO: 599621 - RNA, 19 nt, Human
ucagaauaagcaaagacca

SEQ ID NO: 599622 - RNA, 19 nt, Human
ucagugugucucaaaguga

SEQ ID NO: 599623 - RNA, 21 nt, Human
ucccaagggagagagacagcu

SEQ ID NO: 599624 - RNA, 19 nt, Human
ucccacgugaacuaggcca

SEQ ID NO: 599625 - RNA, 22 nt, Human
ucccacgugaacuaggccaagu

SEQ ID NO: 599626 - RNA, 20 nt, Human
ucccgcguccucucggccgc

SEQ ID NO: 599627 - RNA, 22 nt, Human
ucccuggccacauggcccaacu

SEQ ID NO: 599628 - RNA, 19 nt, Human
ucgccgccgccgcccaccg

SEQ ID NO: 599629 - RNA, 23 nt, Human
ucuaccacuacccagccugaagc

SEQ ID NO: 599630 - RNA, 26 nt, Human
ucuccuaucccuuucccucugcucaa

SEQ ID NO: 599631 - RNA, 18 nt, Human
ucugucuuugaggcagac

SEQ ID NO: 599632 - RNA, 24 nt, Human
ucuucaaucccaucccacgugaac

SEQ ID NO: 599633 - RNA, 23 nt, Human
ucuuugugugucucucgccgccc

SEQ ID NO: 599634 - RNA, 25 nt, Human
ugaaggcacuaagugcccauuacug

SEQ ID NO: 599635 - RNA, 24 nt, Human
ugaauucuugugguuaaagaguuu

SEQ ID NO: 599636 - RNA, 18 nt, Human
ugacuauguuaguauucc

SEQ ID NO: 599637 - RNA, 18 nt, Human
ugagggaagcaauauggg

SEQ ID NO: 599638 - RNA, 18 nt, Human
ugaguagaaucugggugg

SEQ ID NO: 599639 - RNA, 23 nt, Human
ugcagaggugguuucaugaaggg

SEQ ID NO: 599640 - RNA, 20 nt, Human
ugcaugggauaaauguacau

SEQ ID NO: 599641 - RNA, 21 nt, Human
ugcuuucuucucuacaugaag

SEQ ID NO: 599642 - RNA, 19 nt, Human
uggaagugggaagagagaa

SEQ ID NO: 599643 - RNA, 23 nt, Human
uggcacugcagcacugcagucca

SEQ ID NO: 599644 - RNA, 22 nt, Human
ugggaagagagaaagacuugag

SEQ ID NO: 599645 - RNA, 22 nt, Human
uguaucaccuacccuagaguuu

SEQ ID NO: 599646 - RNA, 22 nt, Human
ugucaagaauaaaugccccaga

SEQ ID NO: 599647 - RNA, 19 nt, Human
ugucuccacuuaacagauc

SEQ ID NO: 599648 - RNA, 21 nt, Human
ugugcaagaauggaaguggga

SEQ ID NO: 599649 - RNA, 23 nt, Human
uguuguguugucuuccucucuuu

SEQ ID NO: 599650 - RNA, 24 nt, Human
uguuuagaggaaaaugggguuuua

SEQ ID NO: 599651 - RNA, 19 nt, Human
uuaaaacucaguccagugc

SEQ ID NO: 599652 - RNA, 20 nt, Human
uuccaaguuaugaaaugauu

SEQ ID NO: 599653 - RNA, 18 nt, Human
uucuucuacagcaacucu

SEQ ID NO: 599654 - RNA, 28 nt, Human
uugaagaaugaguagaaucugggugguc

SEQ ID NO: 599655 - RNA, 24 nt, Human
uugcuaaauaaguagcaauuaugc

SEQ ID NO: 599656 - RNA, 24 nt, Human
uuuaagaccaggacauaauugucc

SEQ ID NO: 599657 - RNA, 25 nt, Human
uuugacuauguuaguauuccaaguu

SEQ ID NO: 599658 - RNA, 21 nt, Human
uuugucaagaauaaaugcccc

SEQ ID NO: 599659 - RNA, 24 nt, Human
uuugucaagaauaaaugccccaga

SEQ ID NO: 599660 - RNA, 18 nt, Human
aaaaagcaaacaaacuua

SEQ ID NO: 599661 - RNA, 18 nt, Human
aaaaucagcugggcgugg

SEQ ID NO: 599662 - RNA, 19 nt, Human
aaacaauugucuuuccucc

SEQ ID NO: 599663 - RNA, 19 nt, Human
aaaggcuuaguccucaaac

SEQ ID NO: 599664 - RNA, 24 nt, Human
aaagugcugggauuacagguguga

SEQ ID NO: 599665 - RNA, 20 nt, Human
aaaguguugggauuacaggc

SEQ ID NO: 599666 - RNA, 22 nt, Human
aaaguguugggauuacaggcgu

SEQ ID NO: 599667 - RNA, 24 nt, Human
aaaguguugggauuacaggcguga

SEQ ID NO: 599668 - RNA, 19 nt, Human
aaauguucuaucaauugca

SEQ ID NO: 599669 - RNA, 26 nt, Human
aagcaaucuuccucuucuuggccucc

SEQ ID NO: 599670 - RNA, 24 nt, Human
aagugaucugcccgccuuggucuc

SEQ ID NO: 599671 - RNA, 18 nt, Human
aagugcugggauuacagg

SEQ ID NO: 599672 - RNA, 19 nt, Human
aagugcugggauuacaggu

SEQ ID NO: 599673 - RNA, 26 nt, Human
aagugcugggauuacaggugugagcc

SEQ ID NO: 599674 - RNA, 21 nt, Human
aaguguugggauuacaggcgu

SEQ ID NO: 599675 - RNA, 26 nt, Human
aaguguugggauuacaggcgugagcc

SEQ ID NO: 599676 - RNA, 19 nt, Human
aaguguugggauugcaggu

SEQ ID NO: 599677 - RNA, 24 nt, Human
aaugaucuaccugucucagccucc

SEQ ID NO: 599678 - RNA, 26 nt, Human
acaagaaaacaauugucuuuccucca

SEQ ID NO: 599679 - RNA, 18 nt, Human
acaggguuucaccauguu

SEQ ID NO: 599680 - RNA, 21 nt, Human
acaggguuucaccauguuggc

SEQ ID NO: 599681 - RNA, 24 nt, Human
acaggguuucaccauguuggccag

SEQ ID NO: 599682 - RNA, 23 nt, Human
accacaccuggcuaguuuuugua

SEQ ID NO: 599683 - RNA, 24 nt, Human
accauguuggccaggauggucucg

SEQ ID NO: 599684 - RNA, 20 nt, Human
acccgccuccaccucccaaa

SEQ ID NO: 599685 - RNA, 18 nt, Human
accuugugauccacccgc

SEQ ID NO: 599686 - RNA, 24 nt, Human
acuccagccuggggguucagguga

SEQ ID NO: 599687 - RNA, 18 nt, Human
acuguacuccagccuggg

SEQ ID NO: 599688 - RNA, 20 nt, Human
acuguacuccagccuggggg

SEQ ID NO: 599689 - RNA, 22 nt, Human
agaaaaaacaaauuugaaugca

SEQ ID NO: 599690 - RNA, 24 nt, Human
agaccagguugguuuugaacuccu

SEQ ID NO: 599691 - RNA, 24 nt, Human
agagugcugggauuacacacauga

SEQ ID NO: 599692 - RNA, 24 nt, Human
agcacuuugggaggcagagguggg

SEQ ID NO: 599693 - RNA, 21 nt, Human
agccuggacaacauggcgaaa

SEQ ID NO: 599694 - RNA, 23 nt, Human
agcugggcguggugguacacacc

SEQ ID NO: 599695 - RNA, 23 nt, Human
aggaguucgagaccagccuggac

SEQ ID NO: 599696 - RNA, 21 nt, Human
aggcacaugaucgcuugaacc

SEQ ID NO: 599697 - RNA, 23 nt, Human
aggcacaugaucgcuugaaccug

SEQ ID NO: 599698 - RNA, 21 nt, Human
aggcagaggugggcagaucau

SEQ ID NO: 599699 - RNA, 19 nt, Human
aggcaggcugccacuggga

SEQ ID NO: 599700 - RNA, 19 nt, Human
aggcauggagaaccacacc

SEQ ID NO: 599701 - RNA, 23 nt, Human
aggcgugagccaccgugccuggc

SEQ ID NO: 599702 - RNA, 25 nt, Human
aggcuggagugcaguggcgugaucu

SEQ ID NO: 599703 - RNA, 23 nt, Human
aggcuuaggcacaugaucgcuug

SEQ ID NO: 599704 - RNA, 19 nt, Human
aggugggcagaucauuagg

SEQ ID NO: 599705 - RNA, 21 nt, Human
aguagccgggauuauaggcau

SEQ ID NO: 599706 - RNA, 22 nt, Human
aguagccgggauuauaggcaug

SEQ ID NO: 599707 - RNA, 19 nt, Human
agugcaguggcgugaucuc

SEQ ID NO: 599708 - RNA, 20 nt, Human
agugcaguggcgugaucucg

SEQ ID NO: 599709 - RNA, 23 nt, Human
agugcaguggcgugaucucggcu

SEQ ID NO: 599710 - RNA, 24 nt, Human
agugcaguggcgugaucucggcuc

SEQ ID NO: 599711 - RNA, 20 nt, Human
agugcugggauuacacacau

SEQ ID NO: 599712 - RNA, 22 nt, Human
agugcugggauuacacacauga

SEQ ID NO: 599713 - RNA, 24 nt, Human
agugcugggauuacacacaugagc

SEQ ID NO: 599714 - RNA, 22 nt, Human
aguugagaugggguuucaccau

SEQ ID NO: 599715 - RNA, 24 nt, Human
auccugccacuguacuccagccug

SEQ ID NO: 599716 - RNA, 24 nt, Human
augaucuaccugucucagccuccc

SEQ ID NO: 599717 - RNA, 18 nt, Human
augcgccaccacgcccag

SEQ ID NO: 599718 - RNA, 19 nt, Human
augggguuucaccauguag

SEQ ID NO: 599719 - RNA, 25 nt, Human
augggguuucaccauguagaccagg

SEQ ID NO: 599720 - RNA, 18 nt, Human
auucuccugccucagccu

SEQ ID NO: 599721 - RNA, 18 nt, Human
auucuccugccucagccu

SEQ ID NO: 599722 - RNA, 22 nt, Human
auuuuuuguauuuuuaguugag

SEQ ID NO: 599723 - RNA, 23 nt, Human
caaagauaaaccugaaaaagcaa

SEQ ID NO: 599724 - RNA, 26 nt, Human
caaagcauaauucacugcaaagauaa

SEQ ID NO: 599725 - RNA, 24 nt, Human
caaagugcugggauuacaggugug

SEQ ID NO: 599726 - RNA, 24 nt, Human
caaaguguugggauugcaggugug

SEQ ID NO: 599727 - RNA, 23 nt, Human
caaccuccaccuccuggguucaa

SEQ ID NO: 599728 - RNA, 22 nt, Human
caagugauucuccugccucagc

SEQ ID NO: 599729 - RNA, 22 nt, Human
caaguuaauuaagaagucaaaa

SEQ ID NO: 599730 - RNA, 19 nt, Human
cacaccugugaucccagcu

SEQ ID NO: 599731 - RNA, 24 nt, Human
caccacgcccagcuaauuuuugua

SEQ ID NO: 599732 - RNA, 21 nt, Human
caccauguagaccagguuggu

SEQ ID NO: 599733 - RNA, 21 nt, Human
caccauguagaccagguuggu

SEQ ID NO: 599734 - RNA, 18 nt, Human
caccauguuggccaggau

SEQ ID NO: 599735 - RNA, 22 nt, Human
caccauguuggccaggaugguc

SEQ ID NO: 599736 - RNA, 24 nt, Human
caccauguuggccaggauggucuc

SEQ ID NO: 599737 - RNA, 18 nt, Human
caccauguuggccuggcu

SEQ ID NO: 599738 - RNA, 24 nt, Human
caccauguuggccuggcuggucuc

SEQ ID NO: 599739 - RNA, 23 nt, Human
cacccgccuccaccucccaaagu

SEQ ID NO: 599740 - RNA, 24 nt, Human
caccugugaucccagcuacucagg

SEQ ID NO: 599741 - RNA, 21 nt, Human
cacugcaaagauaaaccugaa

SEQ ID NO: 599742 - RNA, 21 nt, Human
cacugcaaccuccaccuccug

SEQ ID NO: 599743 - RNA, 23 nt, Human
cacugcaaccuccaccuccuggg

SEQ ID NO: 599744 - RNA, 18 nt, Human
cacuguacuccagccugg

SEQ ID NO: 599745 - RNA, 19 nt, Human
cacuguacuccagccuggg

SEQ ID NO: 599746 - RNA, 19 nt, Human
cacuguacuccagccuggg

SEQ ID NO: 599747 - RNA, 25 nt, Human
cacuguacuccagccuggggguuca

SEQ ID NO: 599748 - RNA, 24 nt, Human
cagagugcugggauuacacacaug

SEQ ID NO: 599749 - RNA, 21 nt, Human
cagcacuuugggaggcagagg

SEQ ID NO: 599750 - RNA, 24 nt, Human
cagcacuuugggaggcagaggugg

SEQ ID NO: 599751 - RNA, 20 nt, Human
caggaggcuuaggcacauga

SEQ ID NO: 599752 - RNA, 24 nt, Human
caggguuucaccauguuggccagg

SEQ ID NO: 599753 - RNA, 22 nt, Human
caggugauucuccugccucagc

SEQ ID NO: 599754 - RNA, 20 nt, Human
caguaagcugagauccugcc

SEQ ID NO: 599755 - RNA, 24 nt, Human
cauauuuuaaacaagaaaacaauu

SEQ ID NO: 599756 - RNA, 24 nt, Human
caugccugugaucccagcacuuug

SEQ ID NO: 599757 - RNA, 21 nt, Human
ccaaagugcugggauuacagg

SEQ ID NO: 599758 - RNA, 21 nt, Human
ccaaagugcugggauuacagg

SEQ ID NO: 599759 - RNA, 24 nt, Human
ccaaagugcugggauuacaggugu

SEQ ID NO: 599760 - RNA, 20 nt, Human
ccaaaguguugggauugcag

SEQ ID NO: 599761 - RNA, 21 nt, Human
ccaaaguguugggauugcagg

SEQ ID NO: 599762 - RNA, 24 nt, Human
ccaaaguguugggauugcaggugu

SEQ ID NO: 599763 - RNA, 20 nt, Human
ccaccacgcccagcuaauuu

SEQ ID NO: 599764 - RNA, 20 nt, Human
ccacccgccuccaccuccca

SEQ ID NO: 599765 - RNA, 21 nt, Human
ccacccgccuccaccucccaa

SEQ ID NO: 599766 - RNA, 24 nt, Human
ccaccuccuggguucaagugauuc

SEQ ID NO: 599767 - RNA, 20 nt, Human
ccacuguacuccagccuggg

SEQ ID NO: 599768 - RNA, 20 nt, Human
ccacuguacuccagccuggg

SEQ ID NO: 599769 - RNA, 22 nt, Human
ccacuguacuccagccuggggg

SEQ ID NO: 599770 - RNA, 22 nt, Human
ccacuguacuccagccuggggg

SEQ ID NO: 599771 - RNA, 23 nt, Human
ccacuguacuccagccugggggu

SEQ ID NO: 599772 - RNA, 19 nt, Human
ccagagugcugggauuaca

SEQ ID NO: 599773 - RNA, 24 nt, Human
ccagagugcugggauuacacacau

SEQ ID NO: 599774 - RNA, 20 nt, Human
ccaggaguucgagaccagcc

SEQ ID NO: 599775 - RNA, 19 nt, Human
cccgaccucaagugaucug

SEQ ID NO: 599776 - RNA, 23 nt, Human
cccgaguagccgggauuauaggc

SEQ ID NO: 599777 - RNA, 24 nt, Human
cccgaguagccgggauuauaggca

SEQ ID NO: 599778 - RNA, 19 nt, Human
cccgccuccaccucccaaa

SEQ ID NO: 599779 - RNA, 22 nt, Human
cccgccuuggucuccuaaagug

SEQ ID NO: 599780 - RNA, 24 nt, Human
cccuaguaguugggacuacaggca

SEQ ID NO: 599781 - RNA, 24 nt, Human
ccgaguagccgggauuauaggcau

SEQ ID NO: 599782 - RNA, 24 nt, Human
ccgccuccaccucccaaagugcug

SEQ ID NO: 599783 - RNA, 24 nt, Human
ccgccuuggucuccuaaaguguug

SEQ ID NO: 599784 - RNA, 23 nt, Human
ccuaaaguguugggauuacaggc

SEQ ID NO: 599785 - RNA, 22 nt, Human
ccuccaccuccuggguucaagu

SEQ ID NO: 599786 - RNA, 21 nt, Human
ccuccuggguucaagugauuc

SEQ ID NO: 599787 - RNA, 24 nt, Human
ccuccuggguucaagugauucucc

SEQ ID NO: 599788 - RNA, 20 nt, Human
ccugaccucaaaugaucuac

SEQ ID NO: 599789 - RNA, 21 nt, Human
ccugaccucaaaugaucuacc

SEQ ID NO: 599790 - RNA, 23 nt, Human
ccugaccucaaaugaucuaccug

SEQ ID NO: 599791 - RNA, 23 nt, Human
ccugccucagccucccgaguagc

SEQ ID NO: 599792 - RNA, 24 nt, Human
ccugccucagccucccuaguaguu

SEQ ID NO: 599793 - RNA, 23 nt, Human
ccuggguucaagugauucuccuc

SEQ ID NO: 599794 - RNA, 23 nt, Human
ccuggguucaagugauucuccug

SEQ ID NO: 599795 - RNA, 21 nt, Human
ccugugaucccagcuacucag

SEQ ID NO: 599796 - RNA, 22 nt, Human
cgaaagucuuuacuaaaaauac

SEQ ID NO: 599797 - RNA, 18 nt, Human
cgaccucaagugaucugc

SEQ ID NO: 599798 - RNA, 24 nt, Human
cgccaggcuggagugcaguggcgu

SEQ ID NO: 599799 - RNA, 23 nt, Human
cgcucugucgccaggcuggagug

SEQ ID NO: 599800 - RNA, 20 nt, Human
cgcugcacagcggcggguca

SEQ ID NO: 599801 - RNA, 24 nt, Human
cgggauuauaggcauggagaacca

SEQ ID NO: 599802 - RNA, 22 nt, Human
cuaaaguguugggauuacaggc

SEQ ID NO: 599803 - RNA, 24 nt, Human
cuaaaguguugggauuacaggcgu

SEQ ID NO: 599804 - RNA, 18 nt, Human
cucaagcaaucuuccucu

SEQ ID NO: 599805 - RNA, 24 nt, Human
cucacugcaaccuccaccuccugg

SEQ ID NO: 599806 - RNA, 26 nt, Human
cucacugcaaccuccaccuccugggu

SEQ ID NO: 599807 - RNA, 24 nt, Human
cucaugccugugaucccagcacuu

SEQ ID NO: 599808 - RNA, 26 nt, Human
cucccgaccucaagugaucugcccgc

SEQ ID NO: 599809 - RNA, 22 nt, Human
cuccugccucagccucccuagu

SEQ ID NO: 599810 - RNA, 20 nt, Human
cuccugggcucaagcaaucu

SEQ ID NO: 599811 - RNA, 23 nt, Human
cuccugggcucaagcaaucuucc

SEQ ID NO: 599812 - RNA, 21 nt, Human
cuccuggguucaagugauucu

SEQ ID NO: 599813 - RNA, 23 nt, Human
cucgcucugucgccaggcuggag

SEQ ID NO: 599814 - RNA, 24 nt, Human
cucuugaccuugugauccacccgc

SEQ ID NO: 599815 - RNA, 23 nt, Human
cugcaaccuccaccuccuggguu

SEQ ID NO: 599816 - RNA, 18 nt, Human
cugcaguaagcugagauc

SEQ ID NO: 599817 - RNA, 22 nt, Human
cugccucagccucccgaguagc

SEQ ID NO: 599818 - RNA, 24 nt, Human
cuggggguucaggugauucuccug

SEQ ID NO: 599819 - RNA, 23 nt, Human
cugucucagccucccagagugcu

SEQ ID NO: 599820 - RNA, 21 nt, Human
cugugaucccagcuacucagg

SEQ ID NO: 599821 - RNA, 19 nt, Human
cuuccucuucuuggccucc

SEQ ID NO: 599822 - RNA, 23 nt, Human
cuuugggaggcagaggugggcag

SEQ ID NO: 599823 - RNA, 22 nt, Human
gaaaaagcaaacaaacuuacaa

SEQ ID NO: 599824 - RNA, 18 nt, Human
gaaguuucaccauguugg

SEQ ID NO: 599825 - RNA, 24 nt, Human
gaccucaaaugaucuaccugucuc

SEQ ID NO: 599826 - RNA, 24 nt, Human
gaccucaagugaucugcccgccuu

SEQ ID NO: 599827 - RNA, 22 nt, Human
gaccuugugauccacccgccuc

SEQ ID NO: 599828 - RNA, 22 nt, Human
gaccuugugauccacccgccuc

SEQ ID NO: 599829 - RNA, 23 nt, Human
gaccuugugauccacccgccucc

SEQ ID NO: 599830 - RNA, 25 nt, Human
gaccuugugauccacccgccuccac

SEQ ID NO: 599831 - RNA, 24 nt, Human
gagagggagucucgcucugucgcc

SEQ ID NO: 599832 - RNA, 18 nt, Human
gagaugggguuucaccau

SEQ ID NO: 599833 - RNA, 20 nt, Human
gagaugggguuucaccaugu

SEQ ID NO: 599834 - RNA, 23 nt, Human
gaggugggcagaucauuaggcca

SEQ ID NO: 599835 - RNA, 24 nt, Human
gaguagccgggauuauaggcaugg

SEQ ID NO: 599836 - RNA, 21 nt, Human
gaucauuaggccaggaguucg

SEQ ID NO: 599837 - RNA, 22 nt, Human
gaucauuaggccaggaguucga

SEQ ID NO: 599838 - RNA, 24 nt, Human
gaucauuaggccaggaguucgaga

SEQ ID NO: 599839 - RNA, 24 nt, Human
gaucgcuugaaccugggagaugga

SEQ ID NO: 599840 - RNA, 18 nt, Human
gauuacacacaugagcca

SEQ ID NO: 599841 - RNA, 22 nt, Human
gauuacacacaugagccacugc

SEQ ID NO: 599842 - RNA, 18 nt, Human
gauuacaggcgugagcca

SEQ ID NO: 599843 - RNA, 21 nt, Human
gauuacaggcgugagccaccg

SEQ ID NO: 599844 - RNA, 24 nt, Human
gauuacaggcgugagccaccgugc

SEQ ID NO: 599845 - RNA, 18 nt, Human
gauuacaggugugagcca

SEQ ID NO: 599846 - RNA, 22 nt, Human
gauuacaggugugagccaccgc

SEQ ID NO: 599847 - RNA, 22 nt, Human
gauuacaggugugagccaccgc

SEQ ID NO: 599848 - RNA, 21 nt, Human
gauucuccugccucagccucc

SEQ ID NO: 599849 - RNA, 22 nt, Human
gcaaccuccaccuccuggguuc

SEQ ID NO: 599850 - RNA, 23 nt, Human
gcagaucauuaggccaggaguuc

SEQ ID NO: 599851 - RNA, 22 nt, Human
gccacuguacuccagccugggg

SEQ ID NO: 599852 - RNA, 22 nt, Human
gcccagcuaauuuuuguauuuu

SEQ ID NO: 599853 - RNA, 23 nt, Human
gcccggcuaauuuuuuguauuuu

SEQ ID NO: 599854 - RNA, 23 nt, Human
gccuccaccucccaaagugcugg

SEQ ID NO: 599855 - RNA, 21 nt, Human
gccuuggucuccuaaaguguu

SEQ ID NO: 599856 - RNA, 21 nt, Human
gcugcaguaagcugagauccu

SEQ ID NO: 599857 - RNA, 19 nt, Human
gcuggagugcaguggcgug

SEQ ID NO: 599858 - RNA, 23 nt, Human
gcuggucucaaacucccgaccuc

SEQ ID NO: 599859 - RNA, 19 nt, Human
ggacuacaggcaugcgcca

SEQ ID NO: 599860 - RNA, 23 nt, Human
ggcagaucauuaggccaggaguu

SEQ ID NO: 599861 - RNA, 21 nt, Human
ggcguggugguacacaccugu

SEQ ID NO: 599862 - RNA, 22 nt, Human
ggcuggagugcaguggcgugau

SEQ ID NO: 599863 - RNA, 23 nt, Human
ggcuggguucgguggcucaugcc

SEQ ID NO: 599864 - RNA, 23 nt, Human
gggauuauaggcauggagaacca

SEQ ID NO: 599865 - RNA, 23 nt, Human
gggguuucaccauguagaccagg

SEQ ID NO: 599866 - RNA, 22 nt, Human
ggguuucaccauguuggccagg

SEQ ID NO: 599867 - RNA, 24 nt, Human
ggugauucuccugccucagccucc

SEQ ID NO: 599868 - RNA, 23 nt, Human
gguggcucaugccugugauccca

SEQ ID NO: 599869 - RNA, 24 nt, Human
gguggcucaugccugugaucccag

SEQ ID NO: 599870 - RNA, 24 nt, Human
ggugguacacaccugugaucccag

SEQ ID NO: 599871 - RNA, 21 nt, Human
gguucgguggcucaugccugu

SEQ ID NO: 599872 - RNA, 24 nt, Human
gguuucaccauguuggccaggaug

SEQ ID NO: 599873 - RNA, 20 nt, Human
gguuuugaacuccugaccuc

SEQ ID NO: 599874 - RNA, 20 nt, Human
guagccgggauuauaggcau

SEQ ID NO: 599875 - RNA, 24 nt, Human
gucucgcucugucgccaggcugga

SEQ ID NO: 599876 - RNA, 24 nt, Human
gugauccacccgccuccaccuccc

SEQ ID NO: 599877 - RNA, 24 nt, Human
gugauucuccugccucagccuccc

SEQ ID NO: 599878 - RNA, 24 nt, Human
gugauucuccugccucagccuccc

SEQ ID NO: 599879 - RNA, 21 nt, Human
gugcgccacuacgcccagcuu

SEQ ID NO: 599880 - RNA, 23 nt, Human
gugguacacaccugugaucccag

SEQ ID NO: 599881 - RNA, 24 nt, Human
guuuuuguauuuuuaguagagaug

SEQ ID NO: 599882 - RNA, 21 nt, Human
guuuuuuucuuuuucuuuuuu

SEQ ID NO: 599883 - RNA, 26 nt, Human
uaaagcaaagcauaauucacugcaaa

SEQ ID NO: 599884 - RNA, 22 nt, Human
uaaauuagagacagggucucaa

SEQ ID NO: 599885 - RNA, 24 nt, Human
uaauagagacaggguuucaccaug

SEQ ID NO: 599886 - RNA, 26 nt, Human
uaauagagacaggguuucaccauguu

SEQ ID NO: 599887 - RNA, 24 nt, Human
uaauuuuuguauuuuuaauagaga

SEQ ID NO: 599888 - RNA, 24 nt, Human
uacaggcaugcgccaccacgccca

SEQ ID NO: 599889 - RNA, 22 nt, Human
uacaggcgugagccaccgugcc

SEQ ID NO: 599890 - RNA, 23 nt, Human
uacaggcgugagccaccgugccu

SEQ ID NO: 599891 - RNA, 23 nt, Human
uacaggugugagccaccgcgccc

SEQ ID NO: 599892 - RNA, 20 nt, Human
uaccugucucagccucccag

SEQ ID NO: 599893 - RNA, 23 nt, Human
uaccugucucagccucccagagu

SEQ ID NO: 599894 - RNA, 21 nt, Human
uacuccagccuggggguucag

SEQ ID NO: 599895 - RNA, 24 nt, Human
uacuccagccuggggguucaggug

SEQ ID NO: 599896 - RNA, 18 nt, Human
uagagacagggucucacu

SEQ ID NO: 599897 - RNA, 21 nt, Human
uagagacaggguuucaccaug

SEQ ID NO: 599898 - RNA, 22 nt, Human
uagagacaggguuucaccaugu

SEQ ID NO: 599899 - RNA, 24 nt, Human
uaguagagaugaaguuucaccaug

SEQ ID NO: 599900 - RNA, 26 nt, Human
uaguagagaugaaguuucaccauguu

SEQ ID NO: 599901 - RNA, 27 nt, Human
uaguaguugggacuacaggcaugcgcc

SEQ ID NO: 599902 - RNA, 24 nt, Human
uaguugagaugggguuucaccaug

SEQ ID NO: 599903 - RNA, 22 nt, Human
ucaaaaaacacgucaaauuuaa

SEQ ID NO: 599904 - RNA, 24 nt, Human
ucaaauuuaagcagaauaaggcug

SEQ ID NO: 599905 - RNA, 19 nt, Human
ucaagugauucuccugccu

SEQ ID NO: 599906 - RNA, 24 nt, Human
ucaccauguuggccaggauggucu

SEQ ID NO: 599907 - RNA, 23 nt, Human
ucacugcaaccuccaccuccugg

SEQ ID NO: 599908 - RNA, 23 nt, Human
ucacugcaaccuccaccuccugg

SEQ ID NO: 599909 - RNA, 24 nt, Human
ucacugcaaccuccaccuccuggg

SEQ ID NO: 599910 - RNA, 26 nt, Human
ucacugcaaccuccaccuccuggguu

SEQ ID NO: 599911 - RNA, 21 nt, Human
ucagccucccgaguagccggg

SEQ ID NO: 599912 - RNA, 18 nt, Human
ucagcugggcgugguggu

SEQ ID NO: 599913 - RNA, 19 nt, Human
ucaggugauucuccugccu

SEQ ID NO: 599914 - RNA, 20 nt, Human
ucaggugauucuccugccuc

SEQ ID NO: 599915 - RNA, 22 nt, Human
ucaugccugugaucccagcacu

SEQ ID NO: 599916 - RNA, 20 nt, Human
ucauuaggccaggaguucga

SEQ ID NO: 599917 - RNA, 24 nt, Human
ucauuaggccaggaguucgagacc

SEQ ID NO: 599918 - RNA, 23 nt, Human
uccacccgccuccaccucccaaa

SEQ ID NO: 599919 - RNA, 23 nt, Human
ucccaaagugcugggauuacagg

SEQ ID NO: 599920 - RNA, 23 nt, Human
ucccaaaguguugggauugcagg

SEQ ID NO: 599921 - RNA, 18 nt, Human
ucccagagugcugggauu

SEQ ID NO: 599922 - RNA, 21 nt, Human
ucccagagugcugggauuaca

SEQ ID NO: 599923 - RNA, 24 nt, Human
ucccgaguagccgggauuauaggc

SEQ ID NO: 599924 - RNA, 22 nt, Human
ucccuaguaguugggacuacag

SEQ ID NO: 599925 - RNA, 24 nt, Human
ucccuaguaguugggacuacaggc

SEQ ID NO: 599926 - RNA, 24 nt, Human
uccuaaaguguugggauuacaggc

SEQ ID NO: 599927 - RNA, 18 nt, Human
uccugaccucaaaugauc

SEQ ID NO: 599928 - RNA, 20 nt, Human
uccugggcucaagcaaucuu

SEQ ID NO: 599929 - RNA, 21 nt, Human
uccuggguucaagugauucuc

SEQ ID NO: 599930 - RNA, 24 nt, Human
uccuggguucaagugauucuccug

SEQ ID NO: 599931 - RNA, 24 nt, Human
ucgccaggcuggagugcaguggcg

SEQ ID NO: 599932 - RNA, 21 nt, Human
ucgcuugaaccugggagaugg

SEQ ID NO: 599933 - RNA, 22 nt, Human
ucuaccugucucagccucccag

SEQ ID NO: 599934 - RNA, 23 nt, Human
ucucaaacuccugggcucaagca

SEQ ID NO: 599935 - RNA, 24 nt, Human
ucuccugccucagccucccgagua

SEQ ID NO: 599936 - RNA, 22 nt, Human
ucucgcucugucgccaggcugg

SEQ ID NO: 599937 - RNA, 23 nt, Human
ucucgcucugucgccaggcugga

SEQ ID NO: 599938 - RNA, 18 nt, Human
ucugucgccaggcuggag

SEQ ID NO: 599939 - RNA, 21 nt, Human
ucugucgccaggcuggagugc

SEQ ID NO: 599940 - RNA, 23 nt, Human
ucugucgccaggcuggagugcag

SEQ ID NO: 599941 - RNA, 20 nt, Human
ucuuccucuucuuggccucc

SEQ ID NO: 599942 - RNA, 22 nt, Human
ucuuuacuaaaaauacaaaaau

SEQ ID NO: 599943 - RNA, 18 nt, Human
ugaaaaagcaaacaaacu

SEQ ID NO: 599944 - RNA, 21 nt, Human
ugaaguuucaccauguuggcc

SEQ ID NO: 599945 - RNA, 22 nt, Human
ugaaugcauuucuaacagcuua

SEQ ID NO: 599946 - RNA, 18 nt, Human
ugaccuugugauccaccc

SEQ ID NO: 599947 - RNA, 22 nt, Human
ugagauccugccacuguacucc

SEQ ID NO: 599948 - RNA, 18 nt, Human
ugaguucuuagaacacag

SEQ ID NO: 599949 - RNA, 19 nt, Human
ugaucccagcuacucagga

SEQ ID NO: 599950 - RNA, 22 nt, Human
ugcaguggcgugaucucggcuc

SEQ ID NO: 599951 - RNA, 24 nt, Human
ugccucagccucccgaguagccgg

SEQ ID NO: 599952 - RNA, 20 nt, Human
ugccucagccucccuaguag

SEQ ID NO: 599953 - RNA, 23 nt, Human
ugccugugaucccagcacuuugg

SEQ ID NO: 599954 - RNA, 24 nt, Human
ugccugugaucccagcacuuuggg

SEQ ID NO: 599955 - RNA, 24 nt, Human
ugcugggauuacacacaugagcca

SEQ ID NO: 599956 - RNA, 24 nt, Human
ugcugggauuacaggugugagcca

SEQ ID NO: 599957 - RNA, 19 nt, Human
uggagugcaguggcgugau

SEQ ID NO: 599958 - RNA, 23 nt, Human
uggagugcaguggcgugaucucg

SEQ ID NO: 599959 - RNA, 24 nt, Human
uggagugcaguggcgugaucucgg

SEQ ID NO: 599960 - RNA, 22 nt, Human
uggccaggauggucucgaucuc

SEQ ID NO: 599961 - RNA, 21 nt, Human
uggccuggcuggucucaaacu

SEQ ID NO: 599962 - RNA, 20 nt, Human
uggcgugaucucggcucacu

SEQ ID NO: 599963 - RNA, 24 nt, Human
uggcucaugccugugaucccagca

SEQ ID NO: 599964 - RNA, 20 nt, Human
ugggaauguuuuuuucuuuu

SEQ ID NO: 599965 - RNA, 21 nt, Human
ugggacuacaggcaugcgcca

SEQ ID NO: 599966 - RNA, 22 nt, Human
ugggacuacaggcaugcgccac

SEQ ID NO: 599967 - RNA, 24 nt, Human
ugggacuacaggcaugcgccacca

SEQ ID NO: 599968 - RNA, 18 nt, Human
ugggaggcagaggugggc

SEQ ID NO: 599969 - RNA, 20 nt, Human
ugggaggcagaggugggcag

SEQ ID NO: 599970 - RNA, 24 nt, Human
ugggaggcagaggugggcagauca

SEQ ID NO: 599971 - RNA, 22 nt, Human
ugggauuacacacaugagccac

SEQ ID NO: 599972 - RNA, 22 nt, Human
ugggauuacacacaugagccac

SEQ ID NO: 599973 - RNA, 24 nt, Human
ugggauuacacacaugagccacug

SEQ ID NO: 599974 - RNA, 26 nt, Human
ugggauuacacacaugagccacugcg

SEQ ID NO: 599975 - RNA, 18 nt, Human
ugggauuacaggcgugag

SEQ ID NO: 599976 - RNA, 21 nt, Human
ugggauuacaggcgugagcca

SEQ ID NO: 599977 - RNA, 22 nt, Human
ugggauuacaggcgugagccac

SEQ ID NO: 599978 - RNA, 23 nt, Human
ugggauuacaggcgugagccacc

SEQ ID NO: 599979 - RNA, 23 nt, Human
ugggauuacaggcgugagccacc

SEQ ID NO: 599980 - RNA, 24 nt, Human
ugggauuacaggcgugagccaccg

SEQ ID NO: 599981 - RNA, 18 nt, Human
ugggauuacaggugugag

SEQ ID NO: 599982 - RNA, 19 nt, Human
ugggauuacaggugugagc

SEQ ID NO: 599983 - RNA, 21 nt, Human
ugggauuacaggugugagcca

SEQ ID NO: 599984 - RNA, 22 nt, Human
ugggauuacaggugugagccac

SEQ ID NO: 599985 - RNA, 23 nt, Human
ugggauuacaggugugagccacc

SEQ ID NO: 599986 - RNA, 24 nt, Human
ugggauuacaggugugagccaccg

SEQ ID NO: 599987 - RNA, 21 nt, Human
ugggauugcaggugugcgcca

SEQ ID NO: 599988 - RNA, 22 nt, Human
ugggcagaucauuaggccagga

SEQ ID NO: 599989 - RNA, 24 nt, Human
ugggguuucaccauguagaccagg

SEQ ID NO: 599990 - RNA, 23 nt, Human
uggguucaagugauucuccugcc

SEQ ID NO: 599991 - RNA, 24 nt, Human
uggguucaagugauucuccugccu

SEQ ID NO: 599992 - RNA, 19 nt, Human
uggucucaaacucccgacc

SEQ ID NO: 599993 - RNA, 23 nt, Human
uggugguacacaccugugauccc

SEQ ID NO: 599994 - RNA, 24 nt, Human
uggugguacacaccugugauccca

SEQ ID NO: 599995 - RNA, 24 nt, Human
ugucucagccucccagagugcugg

SEQ ID NO: 599996 - RNA, 19 nt, Human
ugugcgccacuacgcccag

SEQ ID NO: 599997 - RNA, 21 nt, Human
ugugcgccacuacgcccagcu

SEQ ID NO: 599998 - RNA, 24 nt, Human
uuaauagagacaggguuucaccau

SEQ ID NO: 599999 - RNA, 18 nt, Human
uuaguagagaugaaguuu

SEQ ID NO: 600000 - RNA, 24 nt, Human
uuaguagagaugaaguuucaccau

SEQ ID NO: 600001 - RNA, 18 nt, Human
uuaguugagaugggguuu

SEQ ID NO: 600002 - RNA, 24 nt, Human
uuaguugagaugggguuucaccau

SEQ ID NO: 600003 - RNA, 21 nt, Human
uucaagugauucuccugccuc

SEQ ID NO: 600004 - RNA, 23 nt, Human
uucaagugauucuccugccucag

SEQ ID NO: 600005 - RNA, 24 nt, Human
uucaagugauucuccugccucagc

SEQ ID NO: 600006 - RNA, 23 nt, Human
uucaggugauucuccugccucag

SEQ ID NO: 600007 - RNA, 19 nt, Human
uugggaggcagaggugggc

SEQ ID NO: 600008 - RNA, 21 nt, Human
uugggauugcaggugugcgcc

SEQ ID NO: 600009 - RNA, 23 nt, Human
uuuaaacaagaaaacaauugucu

SEQ ID NO: 600010 - RNA, 19 nt, Human
uuucaccauguuggccagg

SEQ ID NO: 600011 - RNA, 20 nt, Human
uuucaccauguuggccagga

SEQ ID NO: 600012 - RNA, 21 nt, Human
uuucaccauguuggccuggcu

SEQ ID NO: 600013 - RNA, 24 nt, Human
uuuuuaauagagacaggguuucac

SEQ ID NO: 600014 - RNA, 24 nt, Human
uuuuuaguagagaugaaguuucac

SEQ ID NO: 600015 - RNA, 24 nt, Human
uuuuuaguugagaugggguuucac

SEQ ID NO: 600016 - RNA, 20 nt, Human
uuuuuguauuuuuaauagag

SEQ ID NO: 600017 - RNA, 23 nt, Human
uuuuuguauuuuuaauagagaca

SEQ ID NO: 600018 - RNA, 19 nt, Human
uuuuuguauuuuuaguaga

SEQ ID NO: 600019 - RNA, 20 nt, Human
uuuuuguauuuuuaguagag

SEQ ID NO: 600020 - RNA, 21 nt, Human
uuuuuguauuuuuaguagaga

SEQ ID NO: 600021 - RNA, 21 nt, Human
uuuuuguauuuuuaguugaga

SEQ ID NO: 600022 - RNA, 24 nt, Human
uuuuuuguauuuuuaguugagaug

SEQ ID NO: 600023 - RNA, 21 nt, Human
aaaaaagcaguuuaacucaaa

SEQ ID NO: 600024 - RNA, 23 nt, Human
aaaaacccaaaguaccacaaaca

SEQ ID NO: 600025 - RNA, 21 nt, Human
aaaaaggcugcugcauucuuc

SEQ ID NO: 600026 - RNA, 25 nt, Human
aaaaggaaaacaugaauauuucaga

SEQ ID NO: 600027 - RNA, 21 nt, Human
aaacagaucuaccuuguccuu

SEQ ID NO: 600028 - RNA, 22 nt, Human
aaacucauucaucaacugucuu

SEQ ID NO: 600029 - RNA, 21 nt, Human
aaagaaaaacaagaacaagga

SEQ ID NO: 600030 - RNA, 21 nt, Human
aacccuauaaacucauucauc

SEQ ID NO: 600031 - RNA, 24 nt, Human
aagaaagaaaaacaagaacaagga

SEQ ID NO: 600032 - RNA, 23 nt, Human
aagagaaaacaauucaaacauga

SEQ ID NO: 600033 - RNA, 24 nt, Human
aagagaagauauaauuacuuaaaa

SEQ ID NO: 600034 - RNA, 20 nt, Human
aagucuacugcacuuuguac

SEQ ID NO: 600035 - RNA, 23 nt, Human
acaguaauugaauuuuuuguguc

SEQ ID NO: 600036 - RNA, 23 nt, Human
accaaacugccccacccaccagc

SEQ ID NO: 600037 - RNA, 20 nt, Human
acugcacuuuguacuuucac

SEQ ID NO: 600038 - RNA, 25 nt, Human
agaagagaagauauaauuacuuaaa

SEQ ID NO: 600039 - RNA, 22 nt, Human
agaggcagugucaucucagaaa

SEQ ID NO: 600040 - RNA, 22 nt, Human
agagucgagugagggcuugagu

SEQ ID NO: 600041 - RNA, 19 nt, Human
agcaacgaaggccgcgaga

SEQ ID NO: 600042 - RNA, 28 nt, Human
auaaaccaguccucacaguggaggaggu

SEQ ID NO: 600043 - RNA, 20 nt, Human
auagaaauagaggcaguguc

SEQ ID NO: 600044 - RNA, 20 nt, Human
auguaacagcaauguuaaaa

SEQ ID NO: 600045 - RNA, 25 nt, Human
caaaauaaccagcucaacauaggac

SEQ ID NO: 600046 - RNA, 18 nt, Human
caaaguaccacaaacaca

SEQ ID NO: 600047 - RNA, 21 nt, Human
caacagcaggaaaaacaaacc

SEQ ID NO: 600048 - RNA, 24 nt, Human
caacagcaggaaaaacaaaccugc

SEQ ID NO: 600049 - RNA, 24 nt, Human
caaggagggagaaaagcuuuaaaa

SEQ ID NO: 600050 - RNA, 21 nt, Human
caaggauaacaauguuccaac

SEQ ID NO: 600051 - RNA, 24 nt, Human
cacaccucuuuaggucaguuaaag

SEQ ID NO: 600052 - RNA, 23 nt, Human
cacagcccaucuaagcuuccuuu

SEQ ID NO: 600053 - RNA, 20 nt, Human
caccaaguaaacuuagccau

SEQ ID NO: 600054 - RNA, 21 nt, Human
caccagcaagaagagaagaua

SEQ ID NO: 600055 - RNA, 19 nt, Human
cacucaaccccgcaagccg

SEQ ID NO: 600056 - RNA, 25 nt, Human
cagaugucucccaucuuacaaaguu

SEQ ID NO: 600057 - RNA, 24 nt, Human
cagggagcugugcgagcaacgaag

SEQ ID NO: 600058 - RNA, 23 nt, Human
caucuaacuucaacugcaaaacu

SEQ ID NO: 600059 - RNA, 26 nt, Human
cauuuauauaucaaagucuauuuuga

SEQ ID NO: 600060 - RNA, 18 nt, Human
ccacucaaccccgcaagc

SEQ ID NO: 600061 - RNA, 21 nt, Human
ccacucauuagcaaaaaagca

SEQ ID NO: 600062 - RNA, 20 nt, Human
ccccaaaaaaccagcaaggu

SEQ ID NO: 600063 - RNA, 23 nt, Human
cccccaaaaaaccagcaaggucu

SEQ ID NO: 600064 - RNA, 27 nt, Human
cccucccgccgcugccgccagccagac

SEQ ID NO: 600065 - RNA, 21 nt, Human
ccgccgcgcuugugccgccgc

SEQ ID NO: 600066 - RNA, 20 nt, Human
ccggccuccuagccugggca

SEQ ID NO: 600067 - RNA, 21 nt, Human
ccuccaaaaaacugagggagc

SEQ ID NO: 600068 - RNA, 22 nt, Human
ccucccgccgcugccgccagcc

SEQ ID NO: 600069 - RNA, 24 nt, Human
ccucccgccgcugccgccagccag

SEQ ID NO: 600070 - RNA, 22 nt, Human
ccuucaaaccaccucacaaaaa

SEQ ID NO: 600071 - RNA, 21 nt, Human
cuaaaccaaacugccccaccc

SEQ ID NO: 600072 - RNA, 19 nt, Human
cucaagcacucuucucuug

SEQ ID NO: 600073 - RNA, 22 nt, Human
cucaauaucacaggcacugagg

SEQ ID NO: 600074 - RNA, 19 nt, Human
cucaguggccacacuuuua

SEQ ID NO: 600075 - RNA, 21 nt, Human
cugagggagcuuuucuuuucc

SEQ ID NO: 600076 - RNA, 22 nt, Human
cugccccacccaccagcaagaa

SEQ ID NO: 600077 - RNA, 19 nt, Human
cugccgccagccagacccg

SEQ ID NO: 600078 - RNA, 21 nt, Human
cuuaacgcuaaacuuuucuuc

SEQ ID NO: 600079 - RNA, 26 nt, Human
gaagaaagaaaaacaagaacaaggag

SEQ ID NO: 600080 - RNA, 20 nt, Human
gaauacccccaaaaaaccag

SEQ ID NO: 600081 - RNA, 18 nt, Human
gagcugugcgagcaacga

SEQ ID NO: 600082 - RNA, 22 nt, Human
gcagugucaucucagaaaacca

SEQ ID NO: 600083 - RNA, 24 nt, Human
gcccaaauucuaaaaguuaaugcc

SEQ ID NO: 600084 - RNA, 21 nt, Human
gcccuuaggucuccgcacccu

SEQ ID NO: 600085 - RNA, 21 nt, Human
gccggccuccuagccugggca

SEQ ID NO: 600086 - RNA, 23 nt, Human
ggaggaaucaaugggccucucuu

SEQ ID NO: 600087 - RNA, 19 nt, Human
gggagaaaagcuuuaaaag

SEQ ID NO: 600088 - RNA, 20 nt, Human
ggucucucggcucccucccg

SEQ ID NO: 600089 - RNA, 22 nt, Human
ggucucucggcucccucccgcc

SEQ ID NO: 600090 - RNA, 22 nt, Human
ggugggggaggaaucaaugggc

SEQ ID NO: 600091 - RNA, 18 nt, Human
gucuucuuuuucuguauu

SEQ ID NO: 600092 - RNA, 21 nt, Human
uaaaacucucagagaaaagga

SEQ ID NO: 600093 - RNA, 22 nt, Human
uaaaaucaaaugcucaguggcc

SEQ ID NO: 600094 - RNA, 21 nt, Human
uaaagguggagugaaggcaau

SEQ ID NO: 600095 - RNA, 23 nt, Human
uaaaugcaacuaacauaguguaa

SEQ ID NO: 600096 - RNA, 22 nt, Human
uaacaaucaacagcaggaaaaa

SEQ ID NO: 600097 - RNA, 23 nt, Human
uaacacuaaaccaaacugcccca

SEQ ID NO: 600098 - RNA, 25 nt, Human
uaacagcaauguuaaaauugacaag

SEQ ID NO: 600099 - RNA, 23 nt, Human
uaaccagcucaacauaggacauu

SEQ ID NO: 600100 - RNA, 21 nt, Human
uaacucaaauacuuagaccaa

SEQ ID NO: 600101 - RNA, 22 nt, Human
uaacucaaauacuuagaccaaa

SEQ ID NO: 600102 - RNA, 19 nt, Human
uaaucuggacaaacuauau

SEQ ID NO: 600103 - RNA, 18 nt, Human
uacaaggauaacaauguu

SEQ ID NO: 600104 - RNA, 23 nt, Human
uacaaggauaacaauguuccaac

SEQ ID NO: 600105 - RNA, 24 nt, Human
uaccuuguccuuccuucaaaccac

SEQ ID NO: 600106 - RNA, 28 nt, Human
uaccuuguccuuccuucaaaccaccuca

SEQ ID NO: 600107 - RNA, 19 nt, Human
uacugcugcugcuucuuuu

SEQ ID NO: 600108 - RNA, 27 nt, Human
uagaccaaaguauaacacuaaaccaaa

SEQ ID NO: 600109 - RNA, 24 nt, Human
uagcaaaaaagcaguuuaacucaa

SEQ ID NO: 600110 - RNA, 25 nt, Human
uagcaaaaaagcaguuuaacucaaa

SEQ ID NO: 600111 - RNA, 28 nt, Human
uagcaaaaaagcaguuuaacucaaauac

SEQ ID NO: 600112 - RNA, 20 nt, Human
uaggucuccgcacccuuagc

SEQ ID NO: 600113 - RNA, 19 nt, Human
uaguggagaugggacuaca

SEQ ID NO: 600114 - RNA, 21 nt, Human
uaucaaaauaaccagcucaac

SEQ ID NO: 600115 - RNA, 22 nt, Human
uaucaaaauaaccagcucaaca

SEQ ID NO: 600116 - RNA, 22 nt, Human
uaugaaugaaacuuccuuuuaa

SEQ ID NO: 600117 - RNA, 21 nt, Human
uauuuggaaaugagacuuuau

SEQ ID NO: 600118 - RNA, 19 nt, Human
ucaugaggcagcuauuagg

SEQ ID NO: 600119 - RNA, 22 nt, Human
uccaacagaugugcaauagcac

SEQ ID NO: 600120 - RNA, 23 nt, Human
uccaggugaaaugguuauagaaa

SEQ ID NO: 600121 - RNA, 20 nt, Human
ucccaaaguguuuaaaaacc

SEQ ID NO: 600122 - RNA, 25 nt, Human
ucccgccgccgcgcuugugccgccg

SEQ ID NO: 600123 - RNA, 23 nt, Human
ucccgccgcugccgccagccaga

SEQ ID NO: 600124 - RNA, 21 nt, Human
ucuaaauaguggagaugggac

SEQ ID NO: 600125 - RNA, 20 nt, Human
ucucccgccgccgcgcuugu

SEQ ID NO: 600126 - RNA, 19 nt, Human
ucuccuccuccuccauaag

SEQ ID NO: 600127 - RNA, 25 nt, Human
ucugagaacauuucuaaauagugga

SEQ ID NO: 600128 - RNA, 26 nt, Human
ucuuccacauucuccuccuccuccaa

SEQ ID NO: 600129 - RNA, 24 nt, Human
ugacaaguuuaauucuuaacugcc

SEQ ID NO: 600130 - RNA, 18 nt, Human
ugacagaaagcucaagcc

SEQ ID NO: 600131 - RNA, 21 nt, Human
ugaguaaacugcuuuagauau

SEQ ID NO: 600132 - RNA, 23 nt, Human
ugcccagcuuuuuaccucuucca

SEQ ID NO: 600133 - RNA, 20 nt, Human
uggaaaugagacuuuauacc

SEQ ID NO: 600134 - RNA, 24 nt, Human
uggacaaacuauauauugcauaga

SEQ ID NO: 600135 - RNA, 22 nt, Human
uggggugggggaggaaucaaug

SEQ ID NO: 600136 - RNA, 20 nt, Human
uguaacucaagcacucuucu

SEQ ID NO: 600137 - RNA, 19 nt, Human
ugucaaagccacuccgugu

SEQ ID NO: 600138 - RNA, 18 nt, Human
uguccaagagaaaacacc

SEQ ID NO: 600139 - RNA, 21 nt, Human
uguuggggugggggaggaauc

SEQ ID NO: 600140 - RNA, 20 nt, Human
uuaaaaaaaauuaaucucac

SEQ ID NO: 600141 - RNA, 24 nt, Human
uucaaaccaccucacaaaaauaag

SEQ ID NO: 600142 - RNA, 25 nt, Human
uuccuccuuaaauaacauguacuug

SEQ ID NO: 600143 - RNA, 18 nt, Human
uucucuuuuuggaggacu

SEQ ID NO: 600144 - RNA, 23 nt, Human
uucucuuuuuggaggacuuuuca

SEQ ID NO: 600145 - RNA, 22 nt, Human
uuguacuuucacauucucaaau

SEQ ID NO: 600146 - RNA, 20 nt, Human
uuuuccaguuaacagaauug

SEQ ID NO: 600147 - RNA, 20 nt, Human
uuuuguaggcucugcccuuc

SEQ ID NO: 600148 - RNA, 22 nt, Human
uuuuuaccucuuccacauucuc

SEQ ID NO: 600149 - RNA, 18 nt, Human
aaaacuuagagcacucac

SEQ ID NO: 600150 - RNA, 19 nt, Human
aaacguaccaccugauuac

SEQ ID NO: 600151 - RNA, 20 nt, Human
aacugauugacuuuagugau

SEQ ID NO: 600152 - RNA, 19 nt, Human
aagcagcauaaagcauaac

SEQ ID NO: 600153 - RNA, 24 nt, Human
acuuuagugaugugccuugaaagu

SEQ ID NO: 600154 - RNA, 23 nt, Human
auugauaccacccucucaagcau

SEQ ID NO: 600155 - RNA, 18 nt, Human
auuuggggaauaaaugug

SEQ ID NO: 600156 - RNA, 23 nt, Human
caacgcucagaaaccguccgagg

SEQ ID NO: 600157 - RNA, 19 nt, Human
cacuugcuccuuggauagc

SEQ ID NO: 600158 - RNA, 20 nt, Human
cauaacugauugacuuuagg

SEQ ID NO: 600159 - RNA, 19 nt, Human
ccccaaauggcacuguggu

SEQ ID NO: 600160 - RNA, 18 nt, Human
ccgcuccugccuugcacg

SEQ ID NO: 600161 - RNA, 19 nt, Human
cgcccgugauaagguuuua

SEQ ID NO: 600162 - RNA, 21 nt, Human
cgcgugccaaacaccaacgcu

SEQ ID NO: 600163 - RNA, 24 nt, Human
cgcuccugccuugcacguuagaga

SEQ ID NO: 600164 - RNA, 21 nt, Human
cuaauauguauuucuuuuccc

SEQ ID NO: 600165 - RNA, 26 nt, Human
cuccuguguuagggagaggcaggaau

SEQ ID NO: 600166 - RNA, 19 nt, Human
cugggccgccgcuccugcc

SEQ ID NO: 600167 - RNA, 21 nt, Human
cugggggcggacaucucccuu

SEQ ID NO: 600168 - RNA, 20 nt, Human
cuuucuggguauucugaaua

SEQ ID NO: 600169 - RNA, 23 nt, Human
cuuuuuuuuuuuuuuuuuucaag

SEQ ID NO: 600170 - RNA, 20 nt, Human
ggucauucuuucauggacau

SEQ ID NO: 600171 - RNA, 20 nt, Human
guauuuggggaauaaaugug

SEQ ID NO: 600172 - RNA, 22 nt, Human
uaacuaaugugguuuuaguggc

SEQ ID NO: 600173 - RNA, 21 nt, Human
uacuuuggagaaaaaaaaauc

SEQ ID NO: 600174 - RNA, 21 nt, Human
uaugaugcauugaggaugaca

SEQ ID NO: 600175 - RNA, 21 nt, Human
uaugauuaagcagcauaaagc

SEQ ID NO: 600176 - RNA, 18 nt, Human
uauuacauuuuauuuuuc

SEQ ID NO: 600177 - RNA, 24 nt, Human
uauuauguuuuccuuauauggugu

SEQ ID NO: 600178 - RNA, 21 nt, Human
ugaauuagaaagauucagaua

SEQ ID NO: 600179 - RNA, 24 nt, Human
ugacacauagucacuacacaccuu

SEQ ID NO: 600180 - RNA, 23 nt, Human
ugacauaacugauugacuuuagu

SEQ ID NO: 600181 - RNA, 23 nt, Human
ugagauuauuauagaagaguguc

SEQ ID NO: 600182 - RNA, 23 nt, Human
ugauaguaauggugucuauggca

SEQ ID NO: 600183 - RNA, 25 nt, Human
ugauaguaauggugucuauggcauu

SEQ ID NO: 600184 - RNA, 18 nt, Human
ugauugacuuuagugaug

SEQ ID NO: 600185 - RNA, 19 nt, Human
uggagaaaaaaaaaucugc

SEQ ID NO: 600186 - RNA, 21 nt, Human
uggccuuuuuuuuuuuuuuuu

SEQ ID NO: 600187 - RNA, 21 nt, Human
ugggagaaaggcucagugaag

SEQ ID NO: 600188 - RNA, 27 nt, Human
ugggggcggacaucucccuugugaccc

SEQ ID NO: 600189 - RNA, 20 nt, Human
uguuuuuaagagccacugau

SEQ ID NO: 600190 - RNA, 18 nt, Human
uguuuuuuugcucuucuc

SEQ ID NO: 600191 - RNA, 23 nt, Human
uuauauggugucagcuaauaagu

SEQ ID NO: 600192 - RNA, 20 nt, Human
uucauggacaucuguugccc

SEQ ID NO: 600193 - RNA, 23 nt, Human
uugauaccacccucucaagcaua

SEQ ID NO: 600194 - RNA, 19 nt, Human
uuucauggacaucuguugc

SEQ ID NO: 600195 - RNA, 23 nt, Human
uuuuuuuuuuuucaaguugcuca

SEQ ID NO: 600196 - RNA, 21 nt, Human
aaaaagaauuugaggccacuu

SEQ ID NO: 600197 - RNA, 23 nt, Human
aaacaaacaaaaauuuuuaaaca

SEQ ID NO: 600198 - RNA, 19 nt, Human
aacagagugagacuccguc

SEQ ID NO: 600199 - RNA, 21 nt, Human
aacagagugagacuccgucuu

SEQ ID NO: 600200 - RNA, 21 nt, Human
aacauggugaaacucuugucu

SEQ ID NO: 600201 - RNA, 22 nt, Human
aacauggugaaacucuugucuc

SEQ ID NO: 600202 - RNA, 20 nt, Human
aaugacaagacaaacuggga

SEQ ID NO: 600203 - RNA, 22 nt, Human
aaugcagcccuuaaacacaccu

SEQ ID NO: 600204 - RNA, 22 nt, Human
acagagugagacuccgucuuug

SEQ ID NO: 600205 - RNA, 20 nt, Human
acauggugaaacucuugucu

SEQ ID NO: 600206 - RNA, 19 nt, Human
accaauuccggacacacau

SEQ ID NO: 600207 - RNA, 20 nt, Human
accugagaauaguuaggaaa

SEQ ID NO: 600208 - RNA, 24 nt, Human
acuccagccugggcaacagaguga

SEQ ID NO: 600209 - RNA, 19 nt, Human
acucuggaggcugaggcag

SEQ ID NO: 600210 - RNA, 24 nt, Human
acugcacuccagccugggcaacag

SEQ ID NO: 600211 - RNA, 24 nt, Human
acugcacuccagccugggcaacag

SEQ ID NO: 600212 - RNA, 24 nt, Human
acuugaggucaggaguucaagacc

SEQ ID NO: 600213 - RNA, 22 nt, Human
agagguugcagugagccgagau

SEQ ID NO: 600214 - RNA, 24 nt, Human
agagguugcagugagccgagauug

SEQ ID NO: 600215 - RNA, 20 nt, Human
agcacuuugggaggcugagg

SEQ ID NO: 600216 - RNA, 19 nt, Human
agcauguucucugcaccuc

SEQ ID NO: 600217 - RNA, 22 nt, Human
agccuggccaacauggugaaac

SEQ ID NO: 600218 - RNA, 24 nt, Human
agccuggccaacauggugaaacuc

SEQ ID NO: 600219 - RNA, 24 nt, Human
agccugggcaacagagugagacuc

SEQ ID NO: 600220 - RNA, 22 nt, Human
agcucugagccuccugaaugac

SEQ ID NO: 600221 - RNA, 20 nt, Human
aggaaaauuuuuuucuucuc

SEQ ID NO: 600222 - RNA, 22 nt, Human
aggcaaaacaucacuaaccuaa

SEQ ID NO: 600223 - RNA, 24 nt, Human
aggcaggaaaaccgcuugaaucca

SEQ ID NO: 600224 - RNA, 25 nt, Human
aggcaguggaucacuugaggucagg

SEQ ID NO: 600225 - RNA, 24 nt, Human
aggcgcaguggcucacgccuauaa

SEQ ID NO: 600226 - RNA, 24 nt, Human
aggcugaggcaggaaaaccgcuug

SEQ ID NO: 600227 - RNA, 23 nt, Human
aggcugaggcaguggaucacuug

SEQ ID NO: 600228 - RNA, 21 nt, Human
agguagagguugcagugagcc

SEQ ID NO: 600229 - RNA, 24 nt, Human
agguagagguugcagugagccgag

SEQ ID NO: 600230 - RNA, 24 nt, Human
aguggcucacgccuauaaucccag

SEQ ID NO: 600231 - RNA, 18 nt, Human
aguuaaaagaacagguga

SEQ ID NO: 600232 - RNA, 24 nt, Human
aucacuugaggucaggaguucaag

SEQ ID NO: 600233 - RNA, 24 nt, Human
auccaggagguagagguugcagug

SEQ ID NO: 600234 - RNA, 19 nt, Human
auccuuggcaacauuccag

SEQ ID NO: 600235 - RNA, 19 nt, Human
augcagcccuuaaacacac

SEQ ID NO: 600236 - RNA, 23 nt, Human
auggaaugcagcccuuaaacaca

SEQ ID NO: 600237 - RNA, 24 nt, Human
auugugccacugcacuccagccug

SEQ ID NO: 600238 - RNA, 19 nt, Human
caaaacaucacuaaccuaa

SEQ ID NO: 600239 - RNA, 22 nt, Human
caaaacaucacuaaccuaauca

SEQ ID NO: 600240 - RNA, 25 nt, Human
caacauggugaaacucuugucucua

SEQ ID NO: 600241 - RNA, 24 nt, Human
caagaccagccuggccaacauggu

SEQ ID NO: 600242 - RNA, 20 nt, Human
cacaggaugacacacagcag

SEQ ID NO: 600243 - RNA, 24 nt, Human
cacgccuauaaucccagcacuuug

SEQ ID NO: 600244 - RNA, 22 nt, Human
cacuccagccugggcaacagag

SEQ ID NO: 600245 - RNA, 22 nt, Human
cacuccagccugggcaacagag

SEQ ID NO: 600246 - RNA, 24 nt, Human
cacuccagccugggcaacagagug

SEQ ID NO: 600247 - RNA, 18 nt, Human
cacugcacuccagccugg

SEQ ID NO: 600248 - RNA, 19 nt, Human
cacugcacuccagccuggg

SEQ ID NO: 600249 - RNA, 21 nt, Human
cacugcacuccagccugggca

SEQ ID NO: 600250 - RNA, 23 nt, Human
cacugcacuccagccugggcaac

SEQ ID NO: 600251 - RNA, 24 nt, Human
cacugcacuccagccugggcaaca

SEQ ID NO: 600252 - RNA, 23 nt, Human
cacuugaggucaggaguucaaga

SEQ ID NO: 600253 - RNA, 23 nt, Human
cagcaauacuuuaggaauaauga

SEQ ID NO: 600254 - RNA, 24 nt, Human
cagcacuuugggaggcugaggcag

SEQ ID NO: 600255 - RNA, 18 nt, Human
cagcuaaugauaucgaag

SEQ ID NO: 600256 - RNA, 21 nt, Human
cagugagaccaagaacccacc

SEQ ID NO: 600257 - RNA, 23 nt, Human
caguggaucacuugaggucagga

SEQ ID NO: 600258 - RNA, 18 nt, Human
cauucacacacgguccgc

SEQ ID NO: 600259 - RNA, 21 nt, Human
ccaauuccggacacacauagc

SEQ ID NO: 600260 - RNA, 20 nt, Human
ccacugcacuccagccuggg

SEQ ID NO: 600261 - RNA, 21 nt, Human
ccacugcacuccagccugggc

SEQ ID NO: 600262 - RNA, 23 nt, Human
ccacugcacuccagccugggcaa

SEQ ID NO: 600263 - RNA, 24 nt, Human
ccacugcacuccagccugggcaac

SEQ ID NO: 600264 - RNA, 22 nt, Human
ccuauaaucccagcacuuuggg

SEQ ID NO: 600265 - RNA, 21 nt, Human
ccuccaaauuuucuuggcuau

SEQ ID NO: 600266 - RNA, 19 nt, Human
ccucucucucuccaaaggu

SEQ ID NO: 600267 - RNA, 20 nt, Human
ccuggccaacauggugaaac

SEQ ID NO: 600268 - RNA, 25 nt, Human
ccuggccaacauggugaaacucuug

SEQ ID NO: 600269 - RNA, 22 nt, Human
ccugggcaacagagugagacuc

SEQ ID NO: 600270 - RNA, 19 nt, Human
ccuguaaucccuguuacuc

SEQ ID NO: 600271 - RNA, 19 nt, Human
ccugugagcugaaagaagg

SEQ ID NO: 600272 - RNA, 20 nt, Human
ccuuggcaacauuccagaag

SEQ ID NO: 600273 - RNA, 22 nt, Human
cgaaaaacagcuaaugauaucg

SEQ ID NO: 600274 - RNA, 23 nt, Human
cgccuauaaucccagcacuuugg

SEQ ID NO: 600275 - RNA, 22 nt, Human
cucacgccuauaaucccagcac

SEQ ID NO: 600276 - RNA, 24 nt, Human
cucacgccuauaaucccagcacuu

SEQ ID NO: 600277 - RNA, 26 nt, Human
cuccaaagguuaaccaugaucaugaa

SEQ ID NO: 600278 - RNA, 19 nt, Human
cuccaaauuuucuuggcua

SEQ ID NO: 600279 - RNA, 18 nt, Human
cuccguacgugugugugc

SEQ ID NO: 600280 - RNA, 24 nt, Human
cugaggcaguggaucacuugaggu

SEQ ID NO: 600281 - RNA, 22 nt, Human
cugcaggagcacuucaaacaca

SEQ ID NO: 600282 - RNA, 22 nt, Human
cuggcuccuucauccuggucuc

SEQ ID NO: 600283 - RNA, 21 nt, Human
gaaaaucuucuuugcuuggcu

SEQ ID NO: 600284 - RNA, 19 nt, Human
gaauucuccagaaauucuc

SEQ ID NO: 600285 - RNA, 20 nt, Human
gacaauguucaagaaaugcc

SEQ ID NO: 600286 - RNA, 23 nt, Human
gagauugugccacugcacuccag

SEQ ID NO: 600287 - RNA, 21 nt, Human
gagguagagguugcagugagc

SEQ ID NO: 600288 - RNA, 21 nt, Human
gaucacuugaggucaggaguu

SEQ ID NO: 600289 - RNA, 23 nt, Human
gaucacuugaggucaggaguuca

SEQ ID NO: 600290 - RNA, 24 nt, Human
gaucacuugaggucaggaguucaa

SEQ ID NO: 600291 - RNA, 23 nt, Human
gcacuccagccugggcaacagag

SEQ ID NO: 600292 - RNA, 22 nt, Human
gcagcugaauucuccagaaauu

SEQ ID NO: 600293 - RNA, 23 nt, Human
gcaguggaucacuugaggucaac

SEQ ID NO: 600294 - RNA, 25 nt, Human
gccaacauggugaaacucuugucuc

SEQ ID NO: 600295 - RNA, 22 nt, Human
gccacugcacuccagccugggc

SEQ ID NO: 600296 - RNA, 24 nt, Human
gccacugcacuccagccugggcaa

SEQ ID NO: 600297 - RNA, 22 nt, Human
ggaguaugccuguaaucccugu

SEQ ID NO: 600298 - RNA, 20 nt, Human
ggaguuguaacaagaaccag

SEQ ID NO: 600299 - RNA, 23 nt, Human
ggcaagguggaguaugccuguaa

SEQ ID NO: 600300 - RNA, 23 nt, Human
ggugaaacucuugucuccggcuc

SEQ ID NO: 600301 - RNA, 21 nt, Human
ggugaugaggggaaacggaga

SEQ ID NO: 600302 - RNA, 19 nt, Human
gucucuacuaaaaauacaa

SEQ ID NO: 600303 - RNA, 20 nt, Human
guggaguaugccuguaaucc

SEQ ID NO: 600304 - RNA, 24 nt, Human
guugcagugagccgagauugugcc

SEQ ID NO: 600305 - RNA, 23 nt, Human
uaaaaauacaaaaucagcagggc

SEQ ID NO: 600306 - RNA, 22 nt, Human
uaaagcacauagcaaaaauccc

SEQ ID NO: 600307 - RNA, 23 nt, Human
uaaagcacauagcaaaaaucccu

SEQ ID NO: 600308 - RNA, 24 nt, Human
uaagaagaggcagcacgagugggc

SEQ ID NO: 600309 - RNA, 20 nt, Human
uacaaaaucagcagggcaag

SEQ ID NO: 600310 - RNA, 21 nt, Human
uagauucugagggcucacaga

SEQ ID NO: 600311 - RNA, 23 nt, Human
uagcugcaggagcacuucaaaca

SEQ ID NO: 600312 - RNA, 24 nt, Human
uagcugcaggagcacuucaaacac

SEQ ID NO: 600313 - RNA, 27 nt, Human
uauaaaaggaggcauacuaauuuuaag

SEQ ID NO: 600314 - RNA, 18 nt, Human
uaucgaagaaaaguaggc

SEQ ID NO: 600315 - RNA, 25 nt, Human
uaugccuguaaucccuguuacucug

SEQ ID NO: 600316 - RNA, 20 nt, Human
uccacgcacucauucagcca

SEQ ID NO: 600317 - RNA, 23 nt, Human
uccagccugggcaacagagugag

SEQ ID NO: 600318 - RNA, 24 nt, Human
uccagccugggcaacagagugaga

SEQ ID NO: 600319 - RNA, 19 nt, Human
uccuuggcaacauuccaga

SEQ ID NO: 600320 - RNA, 24 nt, Human
ucgaaaaacagcuaaugauaucga

SEQ ID NO: 600321 - RNA, 18 nt, Human
ucuaccaaaaagaauuug

SEQ ID NO: 600322 - RNA, 19 nt, Human
ucuccucucucucuccaaa

SEQ ID NO: 600323 - RNA, 19 nt, Human
ucucuacuaaaaauacaaa

SEQ ID NO: 600324 - RNA, 23 nt, Human
ucucugaagagcaaauucaguuu

SEQ ID NO: 600325 - RNA, 18 nt, Human
ucucuggaucucaguucu

SEQ ID NO: 600326 - RNA, 18 nt, Human
ugacaagacaaacuggga

SEQ ID NO: 600327 - RNA, 21 nt, Human
ugacaagacaaacugggaagu

SEQ ID NO: 600328 - RNA, 18 nt, Human
ugagaccaagaacccacc

SEQ ID NO: 600329 - RNA, 19 nt, Human
ugagaccaagaacccacca

SEQ ID NO: 600330 - RNA, 22 nt, Human
ugagccgagauugugccacugc

SEQ ID NO: 600331 - RNA, 25 nt, Human
ugaggcaggaaaaccgcuugaaucc

SEQ ID NO: 600332 - RNA, 23 nt, Human
ugaggcaguggaucacuugaggu

SEQ ID NO: 600333 - RNA, 25 nt, Human
ugaggcaguggaucacuugagguca

SEQ ID NO: 600334 - RNA, 21 nt, Human
ugagggcucacagagcaggca

SEQ ID NO: 600335 - RNA, 21 nt, Human
ugauagcugcaggagcacuuc

SEQ ID NO: 600336 - RNA, 25 nt, Human
ugcauucuaaugcuccuggcuaacc

SEQ ID NO: 600337 - RNA, 21 nt, Human
ugccacagaagcauaaaaaau

SEQ ID NO: 600338 - RNA, 23 nt, Human
ugccacagaagcauaaaaaaucc

SEQ ID NO: 600339 - RNA, 24 nt, Human
ugccacugcacuccagccugggca

SEQ ID NO: 600340 - RNA, 24 nt, Human
ugccuguaaucccuguuacucugg

SEQ ID NO: 600341 - RNA, 24 nt, Human
uggagucagugagaccaagaaccc

SEQ ID NO: 600342 - RNA, 24 nt, Human
uggaucacuugaggucaggaguuc

SEQ ID NO: 600343 - RNA, 27 nt, Human
uggaucacuugaggucaggaguucaag

SEQ ID NO: 600344 - RNA, 25 nt, Human
uggccaacauggugaaacucuuguc

SEQ ID NO: 600345 - RNA, 24 nt, Human
uggccaggcgcaguggcucacgcc

SEQ ID NO: 600346 - RNA, 21 nt, Human
uggcucacgccuauaauccca

SEQ ID NO: 600347 - RNA, 22 nt, Human
uggcucacgccuauaaucccag

SEQ ID NO: 600348 - RNA, 24 nt, Human
uggcucacgccuauaaucccagca

SEQ ID NO: 600349 - RNA, 20 nt, Human
uggcuccuucauccuggucu

SEQ ID NO: 600350 - RNA, 19 nt, Human
ugggaagugacaaaguucu

SEQ ID NO: 600351 - RNA, 23 nt, Human
ugggaggcugaggcaguggauca

SEQ ID NO: 600352 - RNA, 24 nt, Human
uuacaauuucccuucuaccaaaaa

SEQ ID NO: 600353 - RNA, 18 nt, Human
uucuccguacgugugugu

SEQ ID NO: 600354 - RNA, 23 nt, Human
uucuuggcuauuaccaguaguuc

SEQ ID NO: 600355 - RNA, 25 nt, Human
uugaaagugaaaaauucuguuucag

SEQ ID NO: 600356 - RNA, 18 nt, Human
uugcagugagccgagauu

SEQ ID NO: 600357 - RNA, 19 nt, Human
uugcagugagccgagauug

SEQ ID NO: 600358 - RNA, 22 nt, Human
uugcagugagccgagauugugc

SEQ ID NO: 600359 - RNA, 24 nt, Human
uugggaggcugaggcaguggauca

SEQ ID NO: 600360 - RNA, 19 nt, Human
uugugcacacacuucuuca

SEQ ID NO: 600361 - RNA, 24 nt, Human
uugugcacacacuucuucaaauuc

SEQ ID NO: 600362 - RNA, 23 nt, Human
uugugccacugcacuccagccug

SEQ ID NO: 600363 - RNA, 24 nt, Human
uuuggccaggcgcaguggcucacg

SEQ ID NO: 600364 - RNA, 19 nt, Human
uuuuuuuuuauggcauagu

SEQ ID NO: 600365 - RNA, 23 nt, Human
aaacaggaaagaauaucuuccac

SEQ ID NO: 600366 - RNA, 19 nt, Human
aaggaucacuggaaguauu

SEQ ID NO: 600367 - RNA, 23 nt, Human
aaggcaacauuucaucaacgaaa

SEQ ID NO: 600368 - RNA, 20 nt, Human
acaggaaagaauaucuucca

SEQ ID NO: 600369 - RNA, 19 nt, Human
acccggcacuuaaaaaacc

SEQ ID NO: 600370 - RNA, 23 nt, Human
accuuggcaaccguggcccaauc

SEQ ID NO: 600371 - RNA, 25 nt, Human
agacagauaaguggaaaaauacgaa

SEQ ID NO: 600372 - RNA, 21 nt, Human
agagguccaaaauucacccgg

SEQ ID NO: 600373 - RNA, 18 nt, Human
agcguggaguggggagag

SEQ ID NO: 600374 - RNA, 23 nt, Human
agcuuuuaagcucuucuaaacag

SEQ ID NO: 600375 - RNA, 20 nt, Human
aggaagcaaaaaggcaccug

SEQ ID NO: 600376 - RNA, 23 nt, Human
aggcagaacugugccaugugugg

SEQ ID NO: 600377 - RNA, 27 nt, Human
aggcaggauguaguacagaagggaccc

SEQ ID NO: 600378 - RNA, 20 nt, Human
aggcggcaggucacaggcaa

SEQ ID NO: 600379 - RNA, 25 nt, Human
aggcggcaggucacaggcagaacug

SEQ ID NO: 600380 - RNA, 20 nt, Human
aggucacaggcagaacugug

SEQ ID NO: 600381 - RNA, 21 nt, Human
auucugaucaggugaacuggu

SEQ ID NO: 600382 - RNA, 19 nt, Human
caagacagauaaguggaaa

SEQ ID NO: 600383 - RNA, 21 nt, Human
caccucugcuguuccugggag

SEQ ID NO: 600384 - RNA, 22 nt, Human
cacuuaaaaaaccaaucacaga

SEQ ID NO: 600385 - RNA, 19 nt, Human
cagaagguuaagagcacac

SEQ ID NO: 600386 - RNA, 20 nt, Human
cagcacucagaagguuaaga

SEQ ID NO: 600387 - RNA, 24 nt, Human
cagcacucagaagguuaagagcac

SEQ ID NO: 600388 - RNA, 22 nt, Human
cagccagggugguccaccuccu

SEQ ID NO: 600389 - RNA, 19 nt, Human
cagccgccgucgcuccgga

SEQ ID NO: 600390 - RNA, 24 nt, Human
caggaggaaacagcuuuccuuucu

SEQ ID NO: 600391 - RNA, 22 nt, Human
caucucagucucaaaaccugaa

SEQ ID NO: 600392 - RNA, 24 nt, Human
ccaaauaaccaacuguacuuuuuu

SEQ ID NO: 600393 - RNA, 23 nt, Human
ccagggcccggucggcucccuuc

SEQ ID NO: 600394 - RNA, 27 nt, Human
ccagucucuucccugcaguuggugucc

SEQ ID NO: 600395 - RNA, 20 nt, Human
cccggucggcucccuucgcc

SEQ ID NO: 600396 - RNA, 21 nt, Human
ccgcugaucauucuuaguuau

SEQ ID NO: 600397 - RNA, 20 nt, Human
ccugcaguuagaacgugaag

SEQ ID NO: 600398 - RNA, 24 nt, Human
ccugcccgcucagggcaccaggag

SEQ ID NO: 600399 - RNA, 24 nt, Human
cucagaagguuaagagcacacaaa

SEQ ID NO: 600400 - RNA, 19 nt, Human
cuccacagcccugcacagu

SEQ ID NO: 600401 - RNA, 18 nt, Human
cucucuucugggaaacag

SEQ ID NO: 600402 - RNA, 22 nt, Human
cugccgccggugcgcgaggucc

SEQ ID NO: 600403 - RNA, 23 nt, Human
cuggaaguauuaugaccccccuc

SEQ ID NO: 600404 - RNA, 25 nt, Human
cuuuacgcuaguaaccagucucuuc

SEQ ID NO: 600405 - RNA, 24 nt, Human
gaaugauuuccaagggaaccucau

SEQ ID NO: 600406 - RNA, 25 nt, Human
gacuuuuauuucucucuucugggaa

SEQ ID NO: 600407 - RNA, 22 nt, Human
gagaguagggaggugcagggga

SEQ ID NO: 600408 - RNA, 21 nt, Human
gaggugcaggggauggguagg

SEQ ID NO: 600409 - RNA, 21 nt, Human
gaguggggagagaaugacggc

SEQ ID NO: 600410 - RNA, 23 nt, Human
gcgccuggcuccagcugcagccg

SEQ ID NO: 600411 - RNA, 18 nt, Human
gcugguccuucuuucacg

SEQ ID NO: 600412 - RNA, 20 nt, Human
ggaaagaauaucuuccacug

SEQ ID NO: 600413 - RNA, 18 nt, Human
ggaaaugcuauggacgcc

SEQ ID NO: 600414 - RNA, 19 nt, Human
ggaaccucauguucuuucc

SEQ ID NO: 600415 - RNA, 22 nt, Human
ggaauagaaaaauuggaaagga

SEQ ID NO: 600416 - RNA, 19 nt, Human
ggacgggcgagcgccuggc

SEQ ID NO: 600417 - RNA, 20 nt, Human
ggagaguagggaggugcagg

SEQ ID NO: 600418 - RNA, 21 nt, Human
gggaaaugcuauggacgccuc

SEQ ID NO: 600419 - RNA, 18 nt, Human
gguucaggucucucagag

SEQ ID NO: 600420 - RNA, 19 nt, Human
guggucugccucguccaca

SEQ ID NO: 600421 - RNA, 18 nt, Human
uaaagaacaaacacugca

SEQ ID NO: 600422 - RNA, 21 nt, Human
uaauaaagaacaaacacugca

SEQ ID NO: 600423 - RNA, 21 nt, Human
uagcagcacucagaagguuaa

SEQ ID NO: 600424 - RNA, 24 nt, Human
uaguaaccagucucuucccugcag

SEQ ID NO: 600425 - RNA, 22 nt, Human
uauuucucucuucugggaaaca

SEQ ID NO: 600426 - RNA, 25 nt, Human
ucaaaaccugaauuccaguaaagcu

SEQ ID NO: 600427 - RNA, 20 nt, Human
ucaaaaggcaggauguagua

SEQ ID NO: 600428 - RNA, 22 nt, Human
ucacagcccaacaguguuuucc

SEQ ID NO: 600429 - RNA, 19 nt, Human
ucacguuguggucugccuc

SEQ ID NO: 600430 - RNA, 22 nt, Human
ucagaagguuaagagcacacaa

SEQ ID NO: 600431 - RNA, 20 nt, Human
ucagccagggugguccaccu

SEQ ID NO: 600432 - RNA, 21 nt, Human
uccaaaauucacccggcacuu

SEQ ID NO: 600433 - RNA, 18 nt, Human
uccacaggucugggcuag

SEQ ID NO: 600434 - RNA, 19 nt, Human
uccacaggucugggcuagc

SEQ ID NO: 600435 - RNA, 26 nt, Human
uccaccgacaaauauuuugcuaaauu

SEQ ID NO: 600436 - RNA, 27 nt, Human
uccaccgacaaauauuuugcuaaauua

SEQ ID NO: 600437 - RNA, 19 nt, Human
ucucucaggagucacugcu

SEQ ID NO: 600438 - RNA, 22 nt, Human
ugacaagacagauaaguggaaa

SEQ ID NO: 600439 - RNA, 22 nt, Human
ugauaaaacuauuuauuaggga

SEQ ID NO: 600440 - RNA, 18 nt, Human
ugcauaaaaacuugcugc

SEQ ID NO: 600441 - RNA, 20 nt, Human
ugccguaacauaacguggca

SEQ ID NO: 600442 - RNA, 20 nt, Human
ugccucguccacaggucugg

SEQ ID NO: 600443 - RNA, 22 nt, Human
ugcuauggacgccucggcaggg

SEQ ID NO: 600444 - RNA, 21 nt, Human
uggaaaggaugaaagaaggaa

SEQ ID NO: 600445 - RNA, 22 nt, Human
uggaacuuuucagggagagauc

SEQ ID NO: 600446 - RNA, 18 nt, Human
uggaauagaaaaauugga

SEQ ID NO: 600447 - RNA, 21 nt, Human
uggaauagaaaaauuggaaag

SEQ ID NO: 600448 - RNA, 25 nt, Human
uggaauagaaaaauuggaaaggaug

SEQ ID NO: 600449 - RNA, 19 nt, Human
uggcagaggaguggggagc

SEQ ID NO: 600450 - RNA, 21 nt, Human
uggcccaaucacaggggcaga

SEQ ID NO: 600451 - RNA, 21 nt, Human
ugggguuuuaccuccagccca

SEQ ID NO: 600452 - RNA, 23 nt, Human
uuaaaaaaccaaucacagagaag

SEQ ID NO: 600453 - RNA, 21 nt, Human
uuaaaaggaucacuggaaguu

SEQ ID NO: 600454 - RNA, 19 nt, Human
uuccaaagggugaggugga

SEQ ID NO: 600455 - RNA, 23 nt, Human
uuccuuucuuccaaagggugagg

SEQ ID NO: 600456 - RNA, 23 nt, Human
uugcauaaaaacuugcugcacau

SEQ ID NO: 600457 - RNA, 20 nt, Human
aaaaagguucucaacacuuu

SEQ ID NO: 600458 - RNA, 25 nt, Human
aacuauuaaaaguuacaacagaacu

SEQ ID NO: 600459 - RNA, 27 nt, Human
aacuuauucgcuucuuuucuucacuuu

SEQ ID NO: 600460 - RNA, 20 nt, Human
aagaaccuugugaaacaaac

SEQ ID NO: 600461 - RNA, 19 nt, Human
aaguaacucuagagccaga

SEQ ID NO: 600462 - RNA, 22 nt, Human
aagugugcugcuacacuaaacu

SEQ ID NO: 600463 - RNA, 20 nt, Human
acccaacugauucacccauc

SEQ ID NO: 600464 - RNA, 21 nt, Human
accucauggccaagguuucau

SEQ ID NO: 600465 - RNA, 19 nt, Human
agagccagacaccacagag

SEQ ID NO: 600466 - RNA, 21 nt, Human
auggaaacauuaauacccaca

SEQ ID NO: 600467 - RNA, 18 nt, Human
caacaaugucuuccccac

SEQ ID NO: 600468 - RNA, 21 nt, Human
cacaacucggucuaagaaccu

SEQ ID NO: 600469 - RNA, 21 nt, Human
cacuaccacacagcugcaaac

SEQ ID NO: 600470 - RNA, 20 nt, Human
cagaacucucaagcaaguca

SEQ ID NO: 600471 - RNA, 24 nt, Human
cagccuucaaaauggaggcugaaa

SEQ ID NO: 600472 - RNA, 24 nt, Human
caggauacacagaugcacuuaaug

SEQ ID NO: 600473 - RNA, 19 nt, Human
ccuugcuuucuuuuuuuuc

SEQ ID NO: 600474 - RNA, 22 nt, Human
cugaaaaugcuugguaaaaaga

SEQ ID NO: 600475 - RNA, 22 nt, Human
cugcaaauuaaaccacuaccac

SEQ ID NO: 600476 - RNA, 22 nt, Human
gagccagacaccacagagcuaa

SEQ ID NO: 600477 - RNA, 19 nt, Human
gaucuuuucucuucuuuuu

SEQ ID NO: 600478 - RNA, 20 nt, Human
gcuugguaaaaagaaguaac

SEQ ID NO: 600479 - RNA, 25 nt, Human
guuacaacagaacuauuuaaacauc

SEQ ID NO: 600480 - RNA, 19 nt, Human
uaaaaagaaaagucugacu

SEQ ID NO: 600481 - RNA, 26 nt, Human
uaaacugaaaaucgguucucauuuua

SEQ ID NO: 600482 - RNA, 24 nt, Human
uaagaaccuugugaaacaaaccuc

SEQ ID NO: 600483 - RNA, 19 nt, Human
uaaggcugcaaauuaaacc

SEQ ID NO: 600484 - RNA, 22 nt, Human
ucaaaauggaggcugaaaaugc

SEQ ID NO: 600485 - RNA, 18 nt, Human
ucagaaaugcaaugaaca

SEQ ID NO: 600486 - RNA, 21 nt, Human
ucagagguccucuucauaagu

SEQ ID NO: 600487 - RNA, 24 nt, Human
ucaucuuuaccuucuauuuucuua

SEQ ID NO: 600488 - RNA, 21 nt, Human
ucccagagauggaauuuaucc

SEQ ID NO: 600489 - RNA, 23 nt, Human
ucguauuuuuuuuaucuccagaa

SEQ ID NO: 600490 - RNA, 24 nt, Human
ucuagaaccuggguuuuuuuccac

SEQ ID NO: 600491 - RNA, 23 nt, Human
ucuuuucucuucuuuuuugacag

SEQ ID NO: 600492 - RNA, 22 nt, Human
ugacagaacucucaagcaaguc

SEQ ID NO: 600493 - RNA, 25 nt, Human
ugcuccauuaucauucuucucaucu

SEQ ID NO: 600494 - RNA, 20 nt, Human
ugucuugcuacuucuaucaa

SEQ ID NO: 600495 - RNA, 20 nt, Human
uuaauacccacacaauuccc

SEQ ID NO: 600496 - RNA, 18 nt, Human
uuagacagcuaagacuuc

SEQ ID NO: 600497 - RNA, 25 nt, Human
uucaaaauggaggcugaaaaugcuc

SEQ ID NO: 600498 - RNA, 21 nt, Human
uugacagaggcuugugucuug

SEQ ID NO: 600499 - RNA, 22 nt, Human
uuuacaaaacccaacugauuca

SEQ ID NO: 600500 - RNA, 20 nt, Human
aaaaaguccuggucuuuagg

SEQ ID NO: 600501 - RNA, 19 nt, Human
aagccugcuucugaggccc

SEQ ID NO: 600502 - RNA, 21 nt, Human
acgcgcugaacggcugggagc

SEQ ID NO: 600503 - RNA, 21 nt, Human
agaacaccuuggucucugggu

SEQ ID NO: 600504 - RNA, 19 nt, Human
agacugaaaugccagugga

SEQ ID NO: 600505 - RNA, 23 nt, Human
aguguacuuucugauauuuuggu

SEQ ID NO: 600506 - RNA, 24 nt, Human
auccugguccugggauuugggagg

SEQ ID NO: 600507 - RNA, 26 nt, Human
ccaauggcacuccaggaguauuuccu

SEQ ID NO: 600508 - RNA, 21 nt, Human
ccaguggagcuuggaauucag

SEQ ID NO: 600509 - RNA, 18 nt, Human
ccccgaggccugcuccgg

SEQ ID NO: 600510 - RNA, 21 nt, Human
ccugguccugggauuugggag

SEQ ID NO: 600511 - RNA, 18 nt, Human
cucaauauccaugaaaag

SEQ ID NO: 600512 - RNA, 21 nt, Human
cuccggcugagauggcacugg

SEQ ID NO: 600513 - RNA, 21 nt, Human
cucucccuuucucaucuguca

SEQ ID NO: 600514 - RNA, 24 nt, Human
cuuuuugccuuuguuguucuuuaa

SEQ ID NO: 600515 - RNA, 18 nt, Human
guacuuucugauauuuug

SEQ ID NO: 600516 - RNA, 21 nt, Human
guggagcuuggaauucagugc

SEQ ID NO: 600517 - RNA, 18 nt, Human
uaaaaaguccuggucuuu

SEQ ID NO: 600518 - RNA, 22 nt, Human
uaaccgccucaaguaaaccgcc

SEQ ID NO: 600519 - RNA, 18 nt, Human
uacugcuuuugacgcucu

SEQ ID NO: 600520 - RNA, 22 nt, Human
uaggggagucuugguccuggau

SEQ ID NO: 600521 - RNA, 21 nt, Human
ucagguacugcuuuugacgcu

SEQ ID NO: 600522 - RNA, 24 nt, Human
ucagugcucaauccugauugauac

SEQ ID NO: 600523 - RNA, 21 nt, Human
uccuuagguagaaaauucugg

SEQ ID NO: 600524 - RNA, 21 nt, Human
uccuuagguagaaaauucugg

SEQ ID NO: 600525 - RNA, 26 nt, Human
ucucccauuucucaaaagaugagggu

SEQ ID NO: 600526 - RNA, 21 nt, Human
ucucuagacaaaaaauucugg

SEQ ID NO: 600527 - RNA, 24 nt, Human
ucucuagacaaaaaauucuggucc

SEQ ID NO: 600528 - RNA, 21 nt, Human
ucucuagauaaaaaauucugg

SEQ ID NO: 600529 - RNA, 24 nt, Human
ucucuagauaaaaaauucuggucc

SEQ ID NO: 600530 - RNA, 24 nt, Human
ucucuagauaaaaaguccuggucu

SEQ ID NO: 600531 - RNA, 21 nt, Human
ucucuaggggagucuuggucc

SEQ ID NO: 600532 - RNA, 25 nt, Human
ucucucacucuuucuucucucauaa

SEQ ID NO: 600533 - RNA, 21 nt, Human
ucucucauaaaagaugcaggu

SEQ ID NO: 600534 - RNA, 21 nt, Human
ucucuggguagaaaaucccgg

SEQ ID NO: 600535 - RNA, 24 nt, Human
ucucuggguagaaaaucccggucc

SEQ ID NO: 600536 - RNA, 21 nt, Human
ucucuggguagaaaauccugg

SEQ ID NO: 600537 - RNA, 21 nt, Human
ucucuggguagaaaauccugg

SEQ ID NO: 600538 - RNA, 24 nt, Human
ucucuggguagaaaauccuggucc

SEQ ID NO: 600539 - RNA, 24 nt, Human
ucucuggguagaaaauccuggucc

SEQ ID NO: 600540 - RNA, 22 nt, Human
ucugaggccccgaggccugcuc

SEQ ID NO: 600541 - RNA, 19 nt, Human
ucuugguccugacauuugg

SEQ ID NO: 600542 - RNA, 21 nt, Human
ucuuuagguagaaaauccugg

SEQ ID NO: 600543 - RNA, 24 nt, Human
ucuuuagguagaaaauccuggucu

SEQ ID NO: 600544 - RNA, 19 nt, Human
ucuuucuuaucuucuucuc

SEQ ID NO: 600545 - RNA, 21 nt, Human
ucuuugggaagaacaccuugg

SEQ ID NO: 600546 - RNA, 22 nt, Human
ucuuuuguucuuuuugccuuug

SEQ ID NO: 600547 - RNA, 21 nt, Human
ugagauggcacuggccaggaa

SEQ ID NO: 600548 - RNA, 28 nt, Human
ugcuccgucccgcccauccguagccuua

SEQ ID NO: 600549 - RNA, 23 nt, Human
uugggaagaacaccuuggucucu

SEQ ID NO: 600550 - RNA, 23 nt, Human
uuggggagaacaugcuggucucu

SEQ ID NO: 600551 - RNA, 23 nt, Human
uuggggagaacaugcuggucucu

SEQ ID NO: 600552 - RNA, 23 nt, Human
uuggggagaacaugcuggucucu

SEQ ID NO: 600553 - RNA, 22 nt, Human
aaccacuuaaggaaaugacauc

SEQ ID NO: 600554 - RNA, 22 nt, Human
acccugaaaguaacaagcaaau

SEQ ID NO: 600555 - RNA, 21 nt, Human
caacaacaacuuauguaggua

SEQ ID NO: 600556 - RNA, 20 nt, Human
caacgaaagacuaguagguu

SEQ ID NO: 600557 - RNA, 20 nt, Human
caagaacauugugcuacgug

SEQ ID NO: 600558 - RNA, 25 nt, Human
caggagaggguacccacacgcaaca

SEQ ID NO: 600559 - RNA, 20 nt, Human
cauaaaccaauuuuuuuucc

SEQ ID NO: 600560 - RNA, 24 nt, Human
cauauuacaaauugcaaugaaaau

SEQ ID NO: 600561 - RNA, 21 nt, Human
cccugaaaguaacaagcaaau

SEQ ID NO: 600562 - RNA, 24 nt, Human
ccuacccacuaacuacucccuuuc

SEQ ID NO: 600563 - RNA, 28 nt, Human
cgcaacagcagcauagcccguuuuuuuu

SEQ ID NO: 600564 - RNA, 21 nt, Human
cucgauuuuacugaagaggaa

SEQ ID NO: 600565 - RNA, 23 nt, Human
cuuaaagucaguuucuaagaacc

SEQ ID NO: 600566 - RNA, 20 nt, Human
gcgaagacaaugaaccccgg

SEQ ID NO: 600567 - RNA, 19 nt, Human
ggaacagauauuugagaac

SEQ ID NO: 600568 - RNA, 20 nt, Human
ggacucaaacagauccugug

SEQ ID NO: 600569 - RNA, 19 nt, Human
uaagaaccuuucgauggcc

SEQ ID NO: 600570 - RNA, 18 nt, Human
uaagcucuugccuaccca

SEQ ID NO: 600571 - RNA, 25 nt, Human
uacaauugagugcuuacuauguguc

SEQ ID NO: 600572 - RNA, 19 nt, Human
uacccacacgcaacagcag

SEQ ID NO: 600573 - RNA, 20 nt, Human
ucaaaaucuaagcucuugcc

SEQ ID NO: 600574 - RNA, 24 nt, Human
ucaagaacauugugcuacguguca

SEQ ID NO: 600575 - RNA, 22 nt, Human
ugaaccccggggagcucugccc

SEQ ID NO: 600576 - RNA, 24 nt, Human
ugaaccccggggagcucugcccaa

SEQ ID NO: 600577 - RNA, 23 nt, Human
ugucuugcaccucugaauauuua

SEQ ID NO: 600578 - RNA, 27 nt, Human
uugccuacccacuaacuacucccuuuc

SEQ ID NO: 600579 - RNA, 19 nt, Human
aaacaaagggcugcaugug

SEQ ID NO: 600580 - RNA, 20 nt, Human
acaggaaguuuugucuugga

SEQ ID NO: 600581 - RNA, 19 nt, Human
aggcccgagaggaaagcga

SEQ ID NO: 600582 - RNA, 23 nt, Human
aggcggcgugcuuccccgcuccg

SEQ ID NO: 600583 - RNA, 18 nt, Human
aguguccggccccugcga

SEQ ID NO: 600584 - RNA, 24 nt, Human
cacccaccuccccccguccuucca

SEQ ID NO: 600585 - RNA, 19 nt, Human
caccgcgcagcggccgggg

SEQ ID NO: 600586 - RNA, 24 nt, Human
ccacccaccuccccccguccuucc

SEQ ID NO: 600587 - RNA, 21 nt, Human
ccccccguccuuccacauaca

SEQ ID NO: 600588 - RNA, 22 nt, Human
ccccucguggggaaacuuuggc

SEQ ID NO: 600589 - RNA, 21 nt, Human
cccggcgcuucagcccuggcc

SEQ ID NO: 600590 - RNA, 21 nt, Human
cccggcuggacagaaaacaaa

SEQ ID NO: 600591 - RNA, 19 nt, Human
ccgccgcaguguucucucg

SEQ ID NO: 600592 - RNA, 20 nt, Human
ccggagcgcacgcggcgugg

SEQ ID NO: 600593 - RNA, 20 nt, Human
ccggccccugcgaaacgcuc

SEQ ID NO: 600594 - RNA, 20 nt, Human
ccggggucggugcguccgcg

SEQ ID NO: 600595 - RNA, 20 nt, Human
ccguugugaaaccucguggu

SEQ ID NO: 600596 - RNA, 21 nt, Human
cggaaaggagcccggcggccg

SEQ ID NO: 600597 - RNA, 25 nt, Human
cggggucggugcguccgcgugggcg

SEQ ID NO: 600598 - RNA, 23 nt, Human
cgugaucuucagaccccagguuc

SEQ ID NO: 600599 - RNA, 24 nt, Human
cuccacccaccuccccccguccuu

SEQ ID NO: 600600 - RNA, 21 nt, Human
cucggggcggggaagugagug

SEQ ID NO: 600601 - RNA, 21 nt, Human
cuuggcccggacugcucggcc

SEQ ID NO: 600602 - RNA, 19 nt, Human
gaaacgcuccgacaucccu

SEQ ID NO: 600603 - RNA, 20 nt, Human
gaaacgcuccgacaucccug

SEQ ID NO: 600604 - RNA, 20 nt, Human
gaccccagguucuuugguac

SEQ ID NO: 600605 - RNA, 24 nt, Human
gagcuggcggccgagggucuuuaa

SEQ ID NO: 600606 - RNA, 24 nt, Human
gcccccucguggggaaacuuuggc

SEQ ID NO: 600607 - RNA, 20 nt, Human
gccgcaguguucucucgcgg

SEQ ID NO: 600608 - RNA, 20 nt, Human
gcgaaacgcuccgacauccc

SEQ ID NO: 600609 - RNA, 20 nt, Human
gcgcuucagcccuggcgucg

SEQ ID NO: 600610 - RNA, 22 nt, Human
gcguagggccgugcaggucgga

SEQ ID NO: 600611 - RNA, 25 nt, Human
gcgugcgggcgggcgaccgagggag

SEQ ID NO: 600612 - RNA, 20 nt, Human
gcgugggcgcgaggcgcggg

SEQ ID NO: 600613 - RNA, 20 nt, Human
ggagggaugcggaugcgaca

SEQ ID NO: 600614 - RNA, 21 nt, Human
gggaagugaguggagccuggg

SEQ ID NO: 600615 - RNA, 21 nt, Human
gggcauaauugaggagucgcc

SEQ ID NO: 600616 - RNA, 20 nt, Human
gggcgcgggguccggacccc

SEQ ID NO: 600617 - RNA, 18 nt, Human
ggucggggggccaggcuc

SEQ ID NO: 600618 - RNA, 20 nt, Human
guauuugaggcaaaccgaaa

SEQ ID NO: 600619 - RNA, 18 nt, Human
guccgcgugggcgcgagg

SEQ ID NO: 600620 - RNA, 19 nt, Human
gugcugggcucugccggag

SEQ ID NO: 600621 - RNA, 26 nt, Human
ucagcccccucguggggaaacuuugg

SEQ ID NO: 600622 - RNA, 19 nt, Human
uccuuccacauacacacag

SEQ ID NO: 600623 - RNA, 24 nt, Human
ucgccggaguugagggauccacgu

SEQ ID NO: 600624 - RNA, 23 nt, Human
ucgggcgccguugugaaaccucg

SEQ ID NO: 600625 - RNA, 21 nt, Human
ucucucgcggaaaggagcccg

SEQ ID NO: 600626 - RNA, 23 nt, Human
ucucucgcggaaaggagcccggc

SEQ ID NO: 600627 - RNA, 20 nt, Human
ucuucagaccccagguucuu

SEQ ID NO: 600628 - RNA, 23 nt, Human
ugaggagucgccggaguugaggg

SEQ ID NO: 600629 - RNA, 20 nt, Human
uggagccugggcauaauuga

SEQ ID NO: 600630 - RNA, 22 nt, Human
ugggcguagggccgugcagguc

SEQ ID NO: 600631 - RNA, 22 nt, Human
uggugcguagggaggcggcgug

SEQ ID NO: 600632 - RNA, 19 nt, Human
uucucguggcccgggagcc

SEQ ID NO: 600633 - RNA, 24 nt, Human
uugaaggugacaaugacuuuucuc

SEQ ID NO: 600634 - RNA, 18 nt, Human
aaaaaagaaacuaacaga

SEQ ID NO: 600635 - RNA, 19 nt, Human
aaaauaucacaugcacccc

SEQ ID NO: 600636 - RNA, 25 nt, Human
aaagauuuuuuuuuuuccuauuaga

SEQ ID NO: 600637 - RNA, 21 nt, Human
aacuaugacauuauuggagca

SEQ ID NO: 600638 - RNA, 18 nt, Human
aauagcuuuuucagauga

SEQ ID NO: 600639 - RNA, 22 nt, Human
acaaaaaagaaacuaacagaaa

SEQ ID NO: 600640 - RNA, 24 nt, Human
acaauaccaaaaacuaaucagguc

SEQ ID NO: 600641 - RNA, 22 nt, Human
acugguucuuagucaauucuca

SEQ ID NO: 600642 - RNA, 19 nt, Human
agcacaauaccaaaaacua

SEQ ID NO: 600643 - RNA, 24 nt, Human
aggaggaggcaagauagaggguuu

SEQ ID NO: 600644 - RNA, 23 nt, Human
auacaaaaaagaaacuaacagaa

SEQ ID NO: 600645 - RNA, 20 nt, Human
auaucaaaauaucacaugca

SEQ ID NO: 600646 - RNA, 18 nt, Human
auauuuggaaaaagaggg

SEQ ID NO: 600647 - RNA, 24 nt, Human
auccauuccuguuucuuccuccaa

SEQ ID NO: 600648 - RNA, 19 nt, Human
augcaaacuuggcuugaaa

SEQ ID NO: 600649 - RNA, 20 nt, Human
auuuuuuuuuuuccuauuag

SEQ ID NO: 600650 - RNA, 21 nt, Human
caacaauggauaaauagcuag

SEQ ID NO: 600651 - RNA, 27 nt, Human
caauuaaaugacaauuaacaauaaugu

SEQ ID NO: 600652 - RNA, 19 nt, Human
caauuugguaaggagagua

SEQ ID NO: 600653 - RNA, 23 nt, Human
cacaauaccaaaaacuaaucagg

SEQ ID NO: 600654 - RNA, 28 nt, Human
cacaauaccaaaaacuaaucaggucucu

SEQ ID NO: 600655 - RNA, 25 nt, Human
cagggcagaagacagaagaucuccu

SEQ ID NO: 600656 - RNA, 24 nt, Human
ccuauaaagcuauuuucuaaaaca

SEQ ID NO: 600657 - RNA, 19 nt, Human
ccuccaugaaacuuugcuu

SEQ ID NO: 600658 - RNA, 24 nt, Human
cggcaguaggaaacacacagguuu

SEQ ID NO: 600659 - RNA, 21 nt, Human
cuccuaggcuaaacccugcau

SEQ ID NO: 600660 - RNA, 19 nt, Human
cuucacacagguagauauu

SEQ ID NO: 600661 - RNA, 20 nt, Human
cuuccuccaaggcuucaggc

SEQ ID NO: 600662 - RNA, 18 nt, Human
gaacuggaaaggcugaca

SEQ ID NO: 600663 - RNA, 18 nt, Human
gcccugaagucuccuuuu

SEQ ID NO: 600664 - RNA, 22 nt, Human
gggcagaagacagaagaucucc

SEQ ID NO: 600665 - RNA, 19 nt, Human
gucucuguaccaugguucu

SEQ ID NO: 600666 - RNA, 20 nt, Human
uaagaugagccuucuagagg

SEQ ID NO: 600667 - RNA, 29 nt, Human
uacaaaaaagaaacuaacagaaaacaauu

SEQ ID NO: 600668 - RNA, 25 nt, Human
uaccauaccugcuucugcauucaac

SEQ ID NO: 600669 - RNA, 24 nt, Human
uauaaagcuauuuucuaaaacaau

SEQ ID NO: 600670 - RNA, 25 nt, Human
uauacaaaaaagaaacuaacagaaa

SEQ ID NO: 600671 - RNA, 23 nt, Human
uaucccaauuacccugauuugau

SEQ ID NO: 600672 - RNA, 25 nt, Human
uaugcacauaucaaaauaucacaug

SEQ ID NO: 600673 - RNA, 23 nt, Human
uauuuaauagcuuuuucagauga

SEQ ID NO: 600674 - RNA, 21 nt, Human
ucaaaauaucacaugcacccc

SEQ ID NO: 600675 - RNA, 20 nt, Human
ucacuccuaggcuaaacccu

SEQ ID NO: 600676 - RNA, 21 nt, Human
uccauuccuguuucuuccucc

SEQ ID NO: 600677 - RNA, 24 nt, Human
ucuuacaaauuuaagaugagccuu

SEQ ID NO: 600678 - RNA, 22 nt, Human
ugaaagguacuuaucauuuuaa

SEQ ID NO: 600679 - RNA, 21 nt, Human
ugaaaguagguuaugcaaacu

SEQ ID NO: 600680 - RNA, 22 nt, Human
ugaauguuuccaacacaaauaa

SEQ ID NO: 600681 - RNA, 21 nt, Human
ugccuaaugaugcaucaaaua

SEQ ID NO: 600682 - RNA, 19 nt, Human
ugcuacacauuguaugcac

SEQ ID NO: 600683 - RNA, 19 nt, Human
ugcuucugucccuuaaacc

SEQ ID NO: 600684 - RNA, 18 nt, Human
uggaacuggaaaggcuga

SEQ ID NO: 600685 - RNA, 18 nt, Human
uggcuaauccagguaaua

SEQ ID NO: 600686 - RNA, 19 nt, Human
uguacaacuaucauguauc

SEQ ID NO: 600687 - RNA, 25 nt, Human
uguaugcacauaucaaaauaucaca

SEQ ID NO: 600688 - RNA, 22 nt, Human
uguuucuuccuccaaggcuuca

SEQ ID NO: 600689 - RNA, 19 nt, Human
uucacaacagcuaagauau

SEQ ID NO: 600690 - RNA, 19 nt, Human
uucacauugcuucuuucau

SEQ ID NO: 600691 - RNA, 24 nt, Human
uucauugcuucugucccuuaaacc

SEQ ID NO: 600692 - RNA, 24 nt, Human
uuccuccaaggcuucaggcuacag

SEQ ID NO: 600693 - RNA, 21 nt, Human
uuccugcccaaagcauccauu

SEQ ID NO: 600694 - RNA, 18 nt, Human
uugauauaaguauccaac

SEQ ID NO: 600695 - RNA, 19 nt, Human
uugaucugcccuccuacau

SEQ ID NO: 600696 - RNA, 18 nt, Human
uuuuuuuuuuuuuuuuug

SEQ ID NO: 600697 - RNA, 20 nt, Human
aagccgcuuucugcucugcc

SEQ ID NO: 600698 - RNA, 21 nt, Human
aaggaugggagcccuggggca

SEQ ID NO: 600699 - RNA, 23 nt, Human
acacagaaaccgagcagagacaa

SEQ ID NO: 600700 - RNA, 18 nt, Human
accaccuuucucugcucc

SEQ ID NO: 600701 - RNA, 22 nt, Human
accagugcccuggacauggccc

SEQ ID NO: 600702 - RNA, 20 nt, Human
accauaacccaucaacccug

SEQ ID NO: 600703 - RNA, 21 nt, Human
accauguuacagggaucaugc

SEQ ID NO: 600704 - RNA, 19 nt, Human
accucacccgccuuccuga

SEQ ID NO: 600705 - RNA, 21 nt, Human
agacaagugacuucaggucug

SEQ ID NO: 600706 - RNA, 19 nt, Human
agacacagaaggcuucgug

SEQ ID NO: 600707 - RNA, 19 nt, Human
agacagagaugcucacgac

SEQ ID NO: 600708 - RNA, 21 nt, Human
agagcagcagcaggccgagca

SEQ ID NO: 600709 - RNA, 21 nt, Human
agagggcccuggaggagggcc

SEQ ID NO: 600710 - RNA, 21 nt, Human
agcaggaggucggccugggug

SEQ ID NO: 600711 - RNA, 19 nt, Human
agccugggcaccguguccu

SEQ ID NO: 600712 - RNA, 24 nt, Human
aggaggcuggugggcccagcuggg

SEQ ID NO: 600713 - RNA, 18 nt, Human
aggcaggcacugcaggga

SEQ ID NO: 600714 - RNA, 19 nt, Human
aggcuggagugcaguggca

SEQ ID NO: 600715 - RNA, 24 nt, Human
agggccgguauggggggcccgggg

SEQ ID NO: 600716 - RNA, 19 nt, Human
aggugguguuggucacguc

SEQ ID NO: 600717 - RNA, 23 nt, Human
agugcaguggcaccaucacggcu

SEQ ID NO: 600718 - RNA, 20 nt, Human
aucgagcugucccgacaugu

SEQ ID NO: 600719 - RNA, 21 nt, Human
caaccaggcuccacugagggc

SEQ ID NO: 600720 - RNA, 19 nt, Human
caaccccagagggcccugg

SEQ ID NO: 600721 - RNA, 20 nt, Human
cacagaaaccgagcagagac

SEQ ID NO: 600722 - RNA, 18 nt, Human
cacagugccagguccaac

SEQ ID NO: 600723 - RNA, 21 nt, Human
caccaccuuucucugcuccca

SEQ ID NO: 600724 - RNA, 21 nt, Human
caccacuccaggcuguccccc

SEQ ID NO: 600725 - RNA, 22 nt, Human
caccacuccaggcugucccccu

SEQ ID NO: 600726 - RNA, 21 nt, Human
caccccaaccccagagggccc

SEQ ID NO: 600727 - RNA, 26 nt, Human
caccccaaccccagagggccggcgcc

SEQ ID NO: 600728 - RNA, 24 nt, Human
cacgcagggcggcauccggguucu

SEQ ID NO: 600729 - RNA, 19 nt, Human
cagaaaccgagcagagaca

SEQ ID NO: 600730 - RNA, 23 nt, Human
cagagacaaagccgcuuucugcu

SEQ ID NO: 600731 - RNA, 22 nt, Human
cagaggguugcagccugggcac

SEQ ID NO: 600732 - RNA, 18 nt, Human
cagcaccccaaccccaga

SEQ ID NO: 600733 - RNA, 21 nt, Human
cagcaccccaaccccagaggg

SEQ ID NO: 600734 - RNA, 23 nt, Human
cagccuccaccucccagacucaa

SEQ ID NO: 600735 - RNA, 24 nt, Human
cagccuccaccucccagacucaag

SEQ ID NO: 600736 - RNA, 18 nt, Human
cagcgcacgcagggcggc

SEQ ID NO: 600737 - RNA, 23 nt, Human
cagggacagcucacggggaagaa

SEQ ID NO: 600738 - RNA, 22 nt, Human
cagggccaggcuugagcccagg

SEQ ID NO: 600739 - RNA, 20 nt, Human
caucugggggcugucugccc

SEQ ID NO: 600740 - RNA, 20 nt, Human
ccacugccagggcagcugcc

SEQ ID NO: 600741 - RNA, 22 nt, Human
ccagcgaggccgugcgcagccu

SEQ ID NO: 600742 - RNA, 21 nt, Human
ccagcugggacuccugaccau

SEQ ID NO: 600743 - RNA, 24 nt, Human
ccagugugcugcgggccagggcca

SEQ ID NO: 600744 - RNA, 23 nt, Human
cccagggccgagacacagaaggc

SEQ ID NO: 600745 - RNA, 21 nt, Human
cccaugacgacagccagcgag

SEQ ID NO: 600746 - RNA, 19 nt, Human
ccccaaccccagagggccc

SEQ ID NO: 600747 - RNA, 23 nt, Human
cccguaagcauccacgcgcaucu

SEQ ID NO: 600748 - RNA, 24 nt, Human
cccguaagcauccacgcgcaucug

SEQ ID NO: 600749 - RNA, 23 nt, Human
cccuaacuggacccagacccucc

SEQ ID NO: 600750 - RNA, 18 nt, Human
cccucagucccugagagc

SEQ ID NO: 600751 - RNA, 20 nt, Human
cccucagucccugagagccc

SEQ ID NO: 600752 - RNA, 19 nt, Human
ccucccagacucaagggau

SEQ ID NO: 600753 - RNA, 19 nt, Human
ccugcaauucuaagcccuc

SEQ ID NO: 600754 - RNA, 22 nt, Human
ccuggacagcaggccagggccu

SEQ ID NO: 600755 - RNA, 18 nt, Human
ccugggcuggccccagag

SEQ ID NO: 600756 - RNA, 19 nt, Human
cgcagaugggagugccucc

SEQ ID NO: 600757 - RNA, 19 nt, Human
cgcagccuggagauguggc

SEQ ID NO: 600758 - RNA, 18 nt, Human
cuaggguggaggggggca

SEQ ID NO: 600759 - RNA, 18 nt, Human
cucaccacuccaggcugu

SEQ ID NO: 600760 - RNA, 24 nt, Human
cucacugcagccuccaccucccag

SEQ ID NO: 600761 - RNA, 22 nt, Human
cuccaugucccuaacuggaccc

SEQ ID NO: 600762 - RNA, 20 nt, Human
cugcacccugaagauggcca

SEQ ID NO: 600763 - RNA, 24 nt, Human
cugcagccuccaccucccagacuc

SEQ ID NO: 600764 - RNA, 19 nt, Human
cugccacccaggcuggagu

SEQ ID NO: 600765 - RNA, 18 nt, Human
cuggugggcccagcuggg

SEQ ID NO: 600766 - RNA, 19 nt, Human
cuugcaacucacaguggaa

SEQ ID NO: 600767 - RNA, 22 nt, Human
cuuucugcucugcccuugggaa

SEQ ID NO: 600768 - RNA, 18 nt, Human
gaagcagacagguccaga

SEQ ID NO: 600769 - RNA, 21 nt, Human
gaaggaugggagcccuggggc

SEQ ID NO: 600770 - RNA, 23 nt, Human
gacacagaaaccgagcagagaca

SEQ ID NO: 600771 - RNA, 22 nt, Human
gaccagugcccuggacauggcc

SEQ ID NO: 600772 - RNA, 23 nt, Human
gacucaagggauacuccugcuuc

SEQ ID NO: 600773 - RNA, 19 nt, Human
gagccuggacagcaggccg

SEQ ID NO: 600774 - RNA, 18 nt, Human
gagggcucgccacagugc

SEQ ID NO: 600775 - RNA, 19 nt, Human
gagggggccacccuagacc

SEQ ID NO: 600776 - RNA, 18 nt, Human
gagucuguuuccccgugc

SEQ ID NO: 600777 - RNA, 23 nt, Human
gcagaaggaugggagcccugggg

SEQ ID NO: 600778 - RNA, 21 nt, Human
gcagagcagcagcaggccgag

SEQ ID NO: 600779 - RNA, 19 nt, Human
gcagauccacagcgaccau

SEQ ID NO: 600780 - RNA, 21 nt, Human
gcagauccacagcgaccauga

SEQ ID NO: 600781 - RNA, 18 nt, Human
gcauccggguucuggucg

SEQ ID NO: 600782 - RNA, 21 nt, Human
gccacccuagaccaaagcugg

SEQ ID NO: 600783 - RNA, 23 nt, Human
gcgcagaugggagugccucccac

SEQ ID NO: 600784 - RNA, 21 nt, Human
gcggcauccggguucuggucg

SEQ ID NO: 600785 - RNA, 21 nt, Human
gcucccaagaccaucuuacaa

SEQ ID NO: 600786 - RNA, 25 nt, Human
gcucugccacccaggcuggagugca

SEQ ID NO: 600787 - RNA, 19 nt, Human
gcugcacccugaagauggc

SEQ ID NO: 600788 - RNA, 20 nt, Human
gcuggagugcaguggcacca

SEQ ID NO: 600789 - RNA, 22 nt, Human
ggaccggcucagcuccgagggu

SEQ ID NO: 600790 - RNA, 24 nt, Human
ggcaccaaccuugcagggcuucag

SEQ ID NO: 600791 - RNA, 19 nt, Human
ggcauccggguucuggucg

SEQ ID NO: 600792 - RNA, 22 nt, Human
ggcauccggguucuggucgugg

SEQ ID NO: 600793 - RNA, 20 nt, Human
ggcaugucugauaccaacca

SEQ ID NO: 600794 - RNA, 24 nt, Human
ggccagggccaggcuugagcccag

SEQ ID NO: 600795 - RNA, 22 nt, Human
ggcccagggccgagacacagaa

SEQ ID NO: 600796 - RNA, 24 nt, Human
ggcucugccacccaggcuggagug

SEQ ID NO: 600797 - RNA, 19 nt, Human
ggcugucugcccagggccc

SEQ ID NO: 600798 - RNA, 20 nt, Human
gggcccagcugggacuccug

SEQ ID NO: 600799 - RNA, 22 nt, Human
ggggagcuggagccuggacagc

SEQ ID NO: 600800 - RNA, 20 nt, Human
ggguggccucugugggaccc

SEQ ID NO: 600801 - RNA, 23 nt, Human
gguauggggggcccggggaggcc

SEQ ID NO: 600802 - RNA, 18 nt, Human
gguccagagagggugagc

SEQ ID NO: 600803 - RNA, 23 nt, Human
gucacguccacgcuccugcucau

SEQ ID NO: 600804 - RNA, 23 nt, Human
gucugagucuguuuccccgugcu

SEQ ID NO: 600805 - RNA, 25 nt, Human
gugcagaaggaugggagcccugggg

SEQ ID NO: 600806 - RNA, 18 nt, Human
guggaaggcaggcacugc

SEQ ID NO: 600807 - RNA, 19 nt, Human
guggaaggcaggcacugca

SEQ ID NO: 600808 - RNA, 21 nt, Human
gugggggguggggacacagaa

SEQ ID NO: 600809 - RNA, 21 nt, Human
ucacccaugccuccauguccc

SEQ ID NO: 600810 - RNA, 20 nt, Human
ucacugagggcauggcaugu

SEQ ID NO: 600811 - RNA, 18 nt, Human
ucacugcagccuccaccu

SEQ ID NO: 600812 - RNA, 19 nt, Human
ucacugcagccuccaccuc

SEQ ID NO: 600813 - RNA, 23 nt, Human
ucacugcagccuccaccucccag

SEQ ID NO: 600814 - RNA, 24 nt, Human
ucacugcagccuccaccucccaga

SEQ ID NO: 600815 - RNA, 23 nt, Human
ucagucucacaccaaccucaccc

SEQ ID NO: 600816 - RNA, 19 nt, Human
uccacgcuccugcucaucu

SEQ ID NO: 600817 - RNA, 24 nt, Human
ucccaaguagcuggaaacauaggu

SEQ ID NO: 600818 - RNA, 18 nt, Human
ucccugggcuggccccag

SEQ ID NO: 600819 - RNA, 18 nt, Human
uccggguucuggucgugg

SEQ ID NO: 600820 - RNA, 23 nt, Human
uccuaggguggaggggggcaccc

SEQ ID NO: 600821 - RNA, 21 nt, Human
uccugcucaucucucggucca

SEQ ID NO: 600822 - RNA, 19 nt, Human
uccugcuuccgccucccaa

SEQ ID NO: 600823 - RNA, 21 nt, Human
ucgccacagugccagguccaa

SEQ ID NO: 600824 - RNA, 21 nt, Human
ucgugggggguggggacacag

SEQ ID NO: 600825 - RNA, 18 nt, Human
ucuagcaggaggucggcc

SEQ ID NO: 600826 - RNA, 18 nt, Human
ucucacaccaaccucacc

SEQ ID NO: 600827 - RNA, 21 nt, Human
ucucacaccaaccucacccgc

SEQ ID NO: 600828 - RNA, 19 nt, Human
ucugaggugucacugaggg

SEQ ID NO: 600829 - RNA, 24 nt, Human
ucugccacccaggcuggagugcag

SEQ ID NO: 600830 - RNA, 23 nt, Human
ucuggcucugccacccaggcugg

SEQ ID NO: 600831 - RNA, 24 nt, Human
ucuggcucugccacccaggcugga

SEQ ID NO: 600832 - RNA, 19 nt, Human
ucugugaccagugcccugg

SEQ ID NO: 600833 - RNA, 20 nt, Human
ucugugaccagugcccugga

SEQ ID NO: 600834 - RNA, 19 nt, Human
ugaaaugcccagcuugcaa

SEQ ID NO: 600835 - RNA, 22 nt, Human
ugaaaugcccagcuugcaacuc

SEQ ID NO: 600836 - RNA, 20 nt, Human
ugagagcccagggugcuggc

SEQ ID NO: 600837 - RNA, 22 nt, Human
ugagcaggaaggugguguuggu

SEQ ID NO: 600838 - RNA, 26 nt, Human
ugagcccaggcaaggcugaggaccgg

SEQ ID NO: 600839 - RNA, 19 nt, Human
ugaggaccggcucagcucc

SEQ ID NO: 600840 - RNA, 19 nt, Human
ugauaccaaccaggcucca

SEQ ID NO: 600841 - RNA, 22 nt, Human
ugcagaaggaugggagcccugg

SEQ ID NO: 600842 - RNA, 20 nt, Human
ugcccucagucccugagagc

SEQ ID NO: 600843 - RNA, 22 nt, Human
ugcccucagucccugagagccc

SEQ ID NO: 600844 - RNA, 21 nt, Human
ugcccuggacauggcccggag

SEQ ID NO: 600845 - RNA, 19 nt, Human
ugccuggcucgcccugcaa

SEQ ID NO: 600846 - RNA, 24 nt, Human
ugcuggcugcacccugaagauggc

SEQ ID NO: 600847 - RNA, 21 nt, Human
ugcugggccaggcaaggaccc

SEQ ID NO: 600848 - RNA, 18 nt, Human
uggacagcaggccagggc

SEQ ID NO: 600849 - RNA, 22 nt, Human
uggagauagauggaggcggcca

SEQ ID NO: 600850 - RNA, 23 nt, Human
uggaggagggccgguaugggggg

SEQ ID NO: 600851 - RNA, 21 nt, Human
uggagugcaguggcaccauca

SEQ ID NO: 600852 - RNA, 24 nt, Human
uggagugcaguggcaccaucacgg

SEQ ID NO: 600853 - RNA, 21 nt, Human
uggcugcacccugaagauggc

SEQ ID NO: 600854 - RNA, 22 nt, Human
ugggcaggggagcuggagccug

SEQ ID NO: 600855 - RNA, 22 nt, Human
ugggcgcagauccacagcgacc

SEQ ID NO: 600856 - RNA, 21 nt, Human
ugggggguggggacacagaaa

SEQ ID NO: 600857 - RNA, 23 nt, Human
ugggggugcagagcagcagcagg

SEQ ID NO: 600858 - RNA, 22 nt, Human
ugggguggccucugugggaccu

SEQ ID NO: 600859 - RNA, 23 nt, Human
ugggguggccucugugggaccuc

SEQ ID NO: 600860 - RNA, 20 nt, Human
uggguucaaacguggcucug

SEQ ID NO: 600861 - RNA, 23 nt, Human
uucuagcaggaggucggccuggg

SEQ ID NO: 600862 - RNA, 24 nt, Human
aaauuggaccaaaaauguggaguu

SEQ ID NO: 600863 - RNA, 18 nt, Human
aagaguuagccaagagaa

SEQ ID NO: 600864 - RNA, 19 nt, Human
aagcaggcgggcgggcgga

SEQ ID NO: 600865 - RNA, 20 nt, Human
accccugcgggagcuggagg

SEQ ID NO: 600866 - RNA, 24 nt, Human
acucaggguuuguauaaccacguc

SEQ ID NO: 600867 - RNA, 19 nt, Human
aggcaggguuaggaaagcc

SEQ ID NO: 600868 - RNA, 23 nt, Human
aggcgggcgggcggagaaaggag

SEQ ID NO: 600869 - RNA, 18 nt, Human
aucuaaaagacuguagaa

SEQ ID NO: 600870 - RNA, 26 nt, Human
augcagcuucaagaguuagccaagag

SEQ ID NO: 600871 - RNA, 18 nt, Human
auuggagagugagugagg

SEQ ID NO: 600872 - RNA, 21 nt, Human
cacggguuuucuucucggccc

SEQ ID NO: 600873 - RNA, 18 nt, Human
cagauaauggacuaaguc

SEQ ID NO: 600874 - RNA, 20 nt, Human
cagcggcggcggcgcgcggg

SEQ ID NO: 600875 - RNA, 23 nt, Human
cagcuccgacucccugacgccag

SEQ ID NO: 600876 - RNA, 21 nt, Human
ccaauucuggguacguacaac

SEQ ID NO: 600877 - RNA, 22 nt, Human
cccagcaagccucuuugggguc

SEQ ID NO: 600878 - RNA, 24 nt, Human
ccccgcgccguccuccggccccgg

SEQ ID NO: 600879 - RNA, 18 nt, Human
ccgcuccaccgggacuaa

SEQ ID NO: 600880 - RNA, 22 nt, Human
ccggccccggccgcgcugcgcu

SEQ ID NO: 600881 - RNA, 19 nt, Human
cgcaccgagauccccucua

SEQ ID NO: 600882 - RNA, 22 nt, Human
cgccagcgcgaccagaucaauc

SEQ ID NO: 600883 - RNA, 24 nt, Human
cgccccgggccccuccacaucccg

SEQ ID NO: 600884 - RNA, 25 nt, Human
cgccguccuccggccccggccgcgc

SEQ ID NO: 600885 - RNA, 23 nt, Human
cggccccagcaagccucuuuggg

SEQ ID NO: 600886 - RNA, 23 nt, Human
cgggcggagaaaggagaggccga

SEQ ID NO: 600887 - RNA, 24 nt, Human
cggggcgaccccugcgggagcugg

SEQ ID NO: 600888 - RNA, 21 nt, Human
cuaaguccgcuccaccgggac

SEQ ID NO: 600889 - RNA, 18 nt, Human
cugggcagcuccgacucc

SEQ ID NO: 600890 - RNA, 22 nt, Human
cuucaagaguuagccaagagaa

SEQ ID NO: 600891 - RNA, 23 nt, Human
gagaaaaguugacucuugcaaga

SEQ ID NO: 600892 - RNA, 24 nt, Human
gagcgggcgggcaggcaggcgagu

SEQ ID NO: 600893 - RNA, 19 nt, Human
gagcgggucucgcgggcgg

SEQ ID NO: 600894 - RNA, 27 nt, Human
gagcgggugagcgugugagcgggcggg

SEQ ID NO: 600895 - RNA, 21 nt, Human
gcaacgaaagauagacauaaa

SEQ ID NO: 600896 - RNA, 20 nt, Human
gccccggccgcgcugcgcuc

SEQ ID NO: 600897 - RNA, 18 nt, Human
gccccgggccccuccaca

SEQ ID NO: 600898 - RNA, 22 nt, Human
gccccgggccccuccacauccc

SEQ ID NO: 600899 - RNA, 26 nt, Human
gccccgggccccuccacaucccgcac

SEQ ID NO: 600900 - RNA, 23 nt, Human
gcgcggcagcggcggcggcgcgc

SEQ ID NO: 600901 - RNA, 20 nt, Human
gcgugugagcgggcgggcag

SEQ ID NO: 600902 - RNA, 21 nt, Human
gcuccggccgcucccccgcgc

SEQ ID NO: 600903 - RNA, 18 nt, Human
gcucuccaaggcgccugg

SEQ ID NO: 600904 - RNA, 19 nt, Human
ggcaggcaggcgagugcgc

SEQ ID NO: 600905 - RNA, 21 nt, Human
gggccccuccacaucccgcac

SEQ ID NO: 600906 - RNA, 18 nt, Human
gggcguggggcugccggu

SEQ ID NO: 600907 - RNA, 25 nt, Human
ggggaccccggcgccccgggccccu

SEQ ID NO: 600908 - RNA, 24 nt, Human
uaaaagggcgcgucucgaaaggua

SEQ ID NO: 600909 - RNA, 23 nt, Human
uaggaaagccugaacgccgccac

SEQ ID NO: 600910 - RNA, 18 nt, Human
uauuggagagugagugag

SEQ ID NO: 600911 - RNA, 24 nt, Human
uccacaucccgcacggguuuucuu

SEQ ID NO: 600912 - RNA, 18 nt, Human
uccaggaagaaacggggc

SEQ ID NO: 600913 - RNA, 19 nt, Human
uccgcuccaccgggacuaa

SEQ ID NO: 600914 - RNA, 22 nt, Human
ucgcaccgagauccccucuaau

SEQ ID NO: 600915 - RNA, 20 nt, Human
ucgcgccggcggggcgaccc

SEQ ID NO: 600916 - RNA, 23 nt, Human
ucuccaggaagaaacggggcgug

SEQ ID NO: 600917 - RNA, 18 nt, Human
ugagugaggggcaacgaa

SEQ ID NO: 600918 - RNA, 18 nt, Human
ugcaagaagauauuuuca

SEQ ID NO: 600919 - RNA, 19 nt, Human
uggcaugccauuauuugga

SEQ ID NO: 600920 - RNA, 20 nt, Human
ugucuuuucuccaggaagaa

SEQ ID NO: 600921 - RNA, 19 nt, Human
uucgcaccgagauccccuc

SEQ ID NO: 600922 - RNA, 25 nt, Human
aaacaugguuagagcaccugugugc

SEQ ID NO: 600923 - RNA, 22 nt, Human
aaagauggugguugugagggua

SEQ ID NO: 600924 - RNA, 20 nt, Human
aagacuguaagaagguagcu

SEQ ID NO: 600925 - RNA, 21 nt, Human
aagcaagcaggcaguccucca

SEQ ID NO: 600926 - RNA, 24 nt, Human
aagcaagcaggcaguccuccaggg

SEQ ID NO: 600927 - RNA, 19 nt, Human
aagcaggcaguccuccagg

SEQ ID NO: 600928 - RNA, 18 nt, Human
aagcuguuuaagcugugg

SEQ ID NO: 600929 - RNA, 21 nt, Human
aagcuguuuaagcuguggccc

SEQ ID NO: 600930 - RNA, 18 nt, Human
accaacgaaaccacaaaa

SEQ ID NO: 600931 - RNA, 21 nt, Human
accccacaaaaaaaaggguga

SEQ ID NO: 600932 - RNA, 25 nt, Human
acgaaaccacaaaaaaggugguacc

SEQ ID NO: 600933 - RNA, 18 nt, Human
agaaacagagggaagacc

SEQ ID NO: 600934 - RNA, 20 nt, Human
agaaacagagggaagacuga

SEQ ID NO: 600935 - RNA, 22 nt, Human
agaaagcaagcaggcaguccuc

SEQ ID NO: 600936 - RNA, 20 nt, Human
agaaaguagaaagaucacug

SEQ ID NO: 600937 - RNA, 23 nt, Human
agaauagaaagguaugaaaaaga

SEQ ID NO: 600938 - RNA, 23 nt, Human
agagaaacagagggaagacugag

SEQ ID NO: 600939 - RNA, 20 nt, Human
agagaagaaacugacuaacg

SEQ ID NO: 600940 - RNA, 23 nt, Human
agagcaccugugugcaagauagu

SEQ ID NO: 600941 - RNA, 22 nt, Human
agagcauauaagagaagaaacu

SEQ ID NO: 600942 - RNA, 23 nt, Human
agagcauauaagagaagaaacug

SEQ ID NO: 600943 - RNA, 21 nt, Human
agcuguggcccugagcugaag

SEQ ID NO: 600944 - RNA, 18 nt, Human
agggaaggcacucugcag

SEQ ID NO: 600945 - RNA, 21 nt, Human
auccuuuuccuuaccaaaaag

SEQ ID NO: 600946 - RNA, 23 nt, Human
aucuuccuuaucuuucucuguag

SEQ ID NO: 600947 - RNA, 20 nt, Human
augggcuagaaucucuaaac

SEQ ID NO: 600948 - RNA, 19 nt, Human
caagcaggcaguccuccag

SEQ ID NO: 600949 - RNA, 20 nt, Human
cacagcauuuuauucaaguu

SEQ ID NO: 600950 - RNA, 21 nt, Human
caccagagaaacagagggaag

SEQ ID NO: 600951 - RNA, 18 nt, Human
caccuccucuaccccaca

SEQ ID NO: 600952 - RNA, 25 nt, Human
cacuguaccacagaagggaaaugag

SEQ ID NO: 600953 - RNA, 24 nt, Human
cacuuccggcugcagcaucaggga

SEQ ID NO: 600954 - RNA, 19 nt, Human
cagagcuggaaagacacac

SEQ ID NO: 600955 - RNA, 18 nt, Human
cagagucauucugccucc

SEQ ID NO: 600956 - RNA, 19 nt, Human
cagcgugccucuaugccug

SEQ ID NO: 600957 - RNA, 22 nt, Human
cauauaagagaagaaacugacu

SEQ ID NO: 600958 - RNA, 21 nt, Human
caucagaaggcgggagcaagg

SEQ ID NO: 600959 - RNA, 20 nt, Human
caucagggaaggcacucugc

SEQ ID NO: 600960 - RNA, 24 nt, Human
ccaaaaaggaacuucuuaaucacc

SEQ ID NO: 600961 - RNA, 20 nt, Human
cccaugggcuagaaucucua

SEQ ID NO: 600962 - RNA, 21 nt, Human
ccugcacacugcagagcacag

SEQ ID NO: 600963 - RNA, 27 nt, Human
cgaggguaccaacacagccaaagacug

SEQ ID NO: 600964 - RNA, 18 nt, Human
cuagccagauaacccaug

SEQ ID NO: 600965 - RNA, 20 nt, Human
cucaccaacgaaaccacaag

SEQ ID NO: 600966 - RNA, 19 nt, Human
cucugcagucuccccucca

SEQ ID NO: 600967 - RNA, 22 nt, Human
cugcagucuccccuccagguuc

SEQ ID NO: 600968 - RNA, 21 nt, Human
gaaaguagaaagaucacugag

SEQ ID NO: 600969 - RNA, 21 nt, Human
gaaaugagggcuagugucccc

SEQ ID NO: 600970 - RNA, 19 nt, Human
gcacacugcagagcacagu

SEQ ID NO: 600971 - RNA, 18 nt, Human
gcagaaauuuaucucuac

SEQ ID NO: 600972 - RNA, 19 nt, Human
gcuccuaguggugacagag

SEQ ID NO: 600973 - RNA, 18 nt, Human
gcuuuacuugggggcucc

SEQ ID NO: 600974 - RNA, 22 nt, Human
ggagggaaggaucacuuccggc

SEQ ID NO: 600975 - RNA, 18 nt, Human
ggcccugagcugaaggag

SEQ ID NO: 600976 - RNA, 22 nt, Human
guuuugaauaaaucagagcugg

SEQ ID NO: 600977 - RNA, 23 nt, Human
uagaaaguagaaagaucacugag

SEQ ID NO: 600978 - RNA, 20 nt, Human
uagccagauaacccaugggc

SEQ ID NO: 600979 - RNA, 23 nt, Human
uagcucagagcacacgaggguac

SEQ ID NO: 600980 - RNA, 23 nt, Human
uagugcagcaagguggaaagagc

SEQ ID NO: 600981 - RNA, 18 nt, Human
ucaaagguagacuugggc

SEQ ID NO: 600982 - RNA, 26 nt, Human
ucaauaaacaugguuagagcaccugu

SEQ ID NO: 600983 - RNA, 21 nt, Human
ucacugaguaaauuacugcac

SEQ ID NO: 600984 - RNA, 19 nt, Human
ucagagcacacgaggguac

SEQ ID NO: 600985 - RNA, 19 nt, Human
ucauucugccuccccagcc

SEQ ID NO: 600986 - RNA, 18 nt, Human
ucccaggggccaggugga

SEQ ID NO: 600987 - RNA, 21 nt, Human
ucuagaaaguagaaagaucac

SEQ ID NO: 600988 - RNA, 23 nt, Human
ucugcagucuccccuccagguuc

SEQ ID NO: 600989 - RNA, 25 nt, Human
ucugcagucuccccuccagguucuc

SEQ ID NO: 600990 - RNA, 19 nt, Human
ucuuaaguaacaacugguc

SEQ ID NO: 600991 - RNA, 19 nt, Human
ugaauaaaucagagcugga

SEQ ID NO: 600992 - RNA, 18 nt, Human
ugacuaacgagggggucu

SEQ ID NO: 600993 - RNA, 22 nt, Human
ugagaaauggaaguuugagagg

SEQ ID NO: 600994 - RNA, 22 nt, Human
ugauaaugaacaagugaaagug

SEQ ID NO: 600995 - RNA, 20 nt, Human
ugcaccuccucuaccccaca

SEQ ID NO: 600996 - RNA, 22 nt, Human
uggaaagacacacuuuuggaga

SEQ ID NO: 600997 - RNA, 20 nt, Human
uggaaagagcuuuggaaagg

SEQ ID NO: 600998 - RNA, 21 nt, Human
uggaaagagcuuuggaaagga

SEQ ID NO: 600999 - RNA, 23 nt, Human
uggcccugagcugaaggagcaau

SEQ ID NO: 601000 - RNA, 20 nt, Human
ugguuugaauuuccaugaug

SEQ ID NO: 601001 - RNA, 21 nt, Human
uguuugcagaaauuuaucucu

SEQ ID NO: 601002 - RNA, 25 nt, Human
uuccaugaugccuaacucuaugguu

SEQ ID NO: 601003 - RNA, 19 nt, Human
uuucaggguugugcuuuac

SEQ ID NO: 601004 - RNA, 22 nt, Human
uuucucaccaacgaaaccacaa

SEQ ID NO: 601005 - RNA, 22 nt, Human
uuuggaaaggagaggaaagaug

SEQ ID NO: 601006 - RNA, 22 nt, Human
aaacugaggcagggcaaguggu

SEQ ID NO: 601007 - RNA, 30 nt, Human
aaaugaccaggaagguaagucccugaagcc

SEQ ID NO: 601008 - RNA, 19 nt, Human
aagcaaggaggggagcuga

SEQ ID NO: 601009 - RNA, 19 nt, Human
aagcaaggaggggagcuga

SEQ ID NO: 601010 - RNA, 20 nt, Human
aaguagguggcaaguaacau

SEQ ID NO: 601011 - RNA, 18 nt, Human
accaggaagguaaguccc

SEQ ID NO: 601012 - RNA, 19 nt, Human
accccauccaccaccagau

SEQ ID NO: 601013 - RNA, 23 nt, Human
acuggagacuggaggcugagaag

SEQ ID NO: 601014 - RNA, 18 nt, Human
agauggaggacucgaggc

SEQ ID NO: 601015 - RNA, 23 nt, Human
agauggaggacucgaggccuggg

SEQ ID NO: 601016 - RNA, 21 nt, Human
agcccgaggcacagcagcggg

SEQ ID NO: 601017 - RNA, 18 nt, Human
agcgucgaugugguuccc

SEQ ID NO: 601018 - RNA, 21 nt, Human
aggaacaccccauccaccacc

SEQ ID NO: 601019 - RNA, 21 nt, Human
aggaggcagaggaaggcggga

SEQ ID NO: 601020 - RNA, 19 nt, Human
aggcgggcugcagaugggg

SEQ ID NO: 601021 - RNA, 21 nt, Human
agggaggcucagacuggaggc

SEQ ID NO: 601022 - RNA, 26 nt, Human
agguggcaaguaacaucaccuggggg

SEQ ID NO: 601023 - RNA, 20 nt, Human
aguccgcgcucaggaggcag

SEQ ID NO: 601024 - RNA, 23 nt, Human
augcggggggaggugaaggaguc

SEQ ID NO: 601025 - RNA, 20 nt, Human
cacacccagaaaaaucaagu

SEQ ID NO: 601026 - RNA, 24 nt, Human
caccccauucucucccacacccag

SEQ ID NO: 601027 - RNA, 22 nt, Human
cacccuauucuuccuacagggc

SEQ ID NO: 601028 - RNA, 21 nt, Human
cagcccgaggcacagcagcgg

SEQ ID NO: 601029 - RNA, 22 nt, Human
cagcgcgggccaugcacggcuc

SEQ ID NO: 601030 - RNA, 18 nt, Human
ccagcagcccgaggcaca

SEQ ID NO: 601031 - RNA, 19 nt, Human
ccaggcggcucaggaugcg

SEQ ID NO: 601032 - RNA, 19 nt, Human
cccaccccauucucuccca

SEQ ID NO: 601033 - RNA, 30 nt, Human
cccaccccauucucucccacacccagaaag

SEQ ID NO: 601034 - RNA, 20 nt, Human
cccauacacuuccuccgcca

SEQ ID NO: 601035 - RNA, 20 nt, Human
cccauccaccaccagauaca

SEQ ID NO: 601036 - RNA, 22 nt, Human
ccccauacacuuccuccgccaa

SEQ ID NO: 601037 - RNA, 23 nt, Human
ccccauccaccaccagauacaga

SEQ ID NO: 601038 - RNA, 21 nt, Human
ccccauucucucccacaccca

SEQ ID NO: 601039 - RNA, 24 nt, Human
ccgcgcucaggaggcagaggaagg

SEQ ID NO: 601040 - RNA, 22 nt, Human
ccucggggcugcagcagggaga

SEQ ID NO: 601041 - RNA, 21 nt, Human
cgacccggcucccaucccgcc

SEQ ID NO: 601042 - RNA, 24 nt, Human
cgccucggccuccagcaaagacag

SEQ ID NO: 601043 - RNA, 27 nt, Human
cgccucggccuccagcaaagacagcuc

SEQ ID NO: 601044 - RNA, 30 nt, Human
cgccucggccuccagcaaagacagcuccaa

SEQ ID NO: 601045 - RNA, 25 nt, Human
cggcaaggcuggcccccuggcgcug

SEQ ID NO: 601046 - RNA, 19 nt, Human
cggcgcgacccggcgcggg

SEQ ID NO: 601047 - RNA, 21 nt, Human
cggcucccaucccgccgccuc

SEQ ID NO: 601048 - RNA, 19 nt, Human
cugaagcugcggugacccc

SEQ ID NO: 601049 - RNA, 22 nt, Human
gacgcucggcgcgcagcagcuc

SEQ ID NO: 601050 - RNA, 20 nt, Human
gagcaccggggagaggugga

SEQ ID NO: 601051 - RNA, 23 nt, Human
gaggguuuuguuuuuuguuguug

SEQ ID NO: 601052 - RNA, 21 nt, Human
gcaaguaacaucaccuggggg

SEQ ID NO: 601053 - RNA, 18 nt, Human
gcccugccaccugguagc

SEQ ID NO: 601054 - RNA, 18 nt, Human
ggagaugacccauccuug

SEQ ID NO: 601055 - RNA, 18 nt, Human
ggccgggguggugcagcc

SEQ ID NO: 601056 - RNA, 21 nt, Human
ggccuccagcaaagacagcuc

SEQ ID NO: 601057 - RNA, 20 nt, Human
gggaggguuuuguuuuuugu

SEQ ID NO: 601058 - RNA, 18 nt, Human
ggggagagguggacaccc

SEQ ID NO: 601059 - RNA, 20 nt, Human
gguuuuguuuuuuguuguug

SEQ ID NO: 601060 - RNA, 25 nt, Human
guucucagcccuggaaggcaauagg

SEQ ID NO: 601061 - RNA, 20 nt, Human
uaagagaccccagaucugga

SEQ ID NO: 601062 - RNA, 19 nt, Human
uaagucccugaagcugcgg

SEQ ID NO: 601063 - RNA, 21 nt, Human
ucagaacacucgaggaagcaa

SEQ ID NO: 601064 - RNA, 20 nt, Human
ucaggaggcagaggaaggcg

SEQ ID NO: 601065 - RNA, 21 nt, Human
uccaccaccagauacagagau

SEQ ID NO: 601066 - RNA, 25 nt, Human
ucccgccgccucggccuccagcaaa

SEQ ID NO: 601067 - RNA, 23 nt, Human
uccgcccgugagaaggagucccc

SEQ ID NO: 601068 - RNA, 21 nt, Human
uccgcgcucaggaggcagagg

SEQ ID NO: 601069 - RNA, 27 nt, Human
ucuaugcugggugcacaggcugaggga

SEQ ID NO: 601070 - RNA, 18 nt, Human
ucucagcccuggaaggca

SEQ ID NO: 601071 - RNA, 18 nt, Human
ugagaagaagcgucgaug

SEQ ID NO: 601072 - RNA, 19 nt, Human
ugagggaaaccaugguucg

SEQ ID NO: 601073 - RNA, 18 nt, Human
ugcacaggcugagggaaa

SEQ ID NO: 601074 - RNA, 18 nt, Human
uggaggcggcggagcagg

SEQ ID NO: 601075 - RNA, 22 nt, Human
uggcaaguaacaucaccugggg

SEQ ID NO: 601076 - RNA, 24 nt, Human
ugggaggguuuuguuuuuuguugu

SEQ ID NO: 601077 - RNA, 18 nt, Human
ugggggaugcggggggag

SEQ ID NO: 601078 - RNA, 24 nt, Human
uuuuuuguuguugauuuuuuugug

SEQ ID NO: 601079 - RNA, 19 nt, Human
aaaaagucaguaagacaaa

SEQ ID NO: 601080 - RNA, 23 nt, Human
aagaaaagacaaugccugugcca

SEQ ID NO: 601081 - RNA, 26 nt, Human
agauaccaaaagaauaugcucagcaa

SEQ ID NO: 601082 - RNA, 18 nt, Human
aggcugccucugggagcg

SEQ ID NO: 601083 - RNA, 22 nt, Human
agucaguaagacaaacaaguua

SEQ ID NO: 601084 - RNA, 30 nt, Human
cauggcccugaaaaagucaguaagacaaag

SEQ ID NO: 601085 - RNA, 22 nt, Human
ccuuaagauucugagucuugaa

SEQ ID NO: 601086 - RNA, 21 nt, Human
cugcugcccgcagaccacucg

SEQ ID NO: 601087 - RNA, 20 nt, Human
gaaaaacgacagccagcuua

SEQ ID NO: 601088 - RNA, 18 nt, Human
gcuagcugaacuguauaa

SEQ ID NO: 601089 - RNA, 24 nt, Human
uacuuuacuuuuuuuuccuuaaga

SEQ ID NO: 601090 - RNA, 23 nt, Human
uccacagaggccaggagaaaaac

SEQ ID NO: 601091 - RNA, 21 nt, Human
ucccgcccaguccgagcugga

SEQ ID NO: 601092 - RNA, 21 nt, Human
uccgagcuggaauuccaaggc

SEQ ID NO: 601093 - RNA, 20 nt, Human
ugacuagaaacuccaagagc

SEQ ID NO: 601094 - RNA, 23 nt, Human
ugacuagaaacuccaagagcggg

SEQ ID NO: 601095 - RNA, 18 nt, Human
ugagcaaggacaauucca

SEQ ID NO: 601096 - RNA, 19 nt, Human
uggaauuccaaggcugccu

SEQ ID NO: 601097 - RNA, 19 nt, Human
uggcagcaugugagcaagg

SEQ ID NO: 601098 - RNA, 24 nt, Human
ugucggcgaccugggccgccugcg

SEQ ID NO: 601099 - RNA, 22 nt, Human
uugaugcaauggaucaaaauca

SEQ ID NO: 601100 - RNA, 24 nt, Human
uuuugcuauuguuauaauuuugau

SEQ ID NO: 601101 - RNA, 22 nt, Human
aaauagcuguuaacuaaaaucu

SEQ ID NO: 601102 - RNA, 21 nt, Human
acuaaaaucucccacugcuca

SEQ ID NO: 601103 - RNA, 18 nt, Human
agcacagaaccugaaugc

SEQ ID NO: 601104 - RNA, 18 nt, Human
aggcaaagggguccuacu

SEQ ID NO: 601105 - RNA, 19 nt, Human
auggcacagcagaagcuua

SEQ ID NO: 601106 - RNA, 24 nt, Human
cacugcucagacuacuuucugccc

SEQ ID NO: 601107 - RNA, 22 nt, Human
cagacuacuuucugcccuaaug

SEQ ID NO: 601108 - RNA, 18 nt, Human
cagcagggcaguuaacuc

SEQ ID NO: 601109 - RNA, 21 nt, Human
cccacugguaccccuuuuaga

SEQ ID NO: 601110 - RNA, 23 nt, Human
ccgauaugcuugauaugcuuuuc

SEQ ID NO: 601111 - RNA, 23 nt, Human
ccuuccacauguuaagcuaggaa

SEQ ID NO: 601112 - RNA, 26 nt, Human
cuguaaguggaaaagacucacucccc

SEQ ID NO: 601113 - RNA, 19 nt, Human
ggaaaccuaacaggauguc

SEQ ID NO: 601114 - RNA, 24 nt, Human
ggccauuacuauccagucuguauu

SEQ ID NO: 601115 - RNA, 20 nt, Human
gguccuacuguaaguggaaa

SEQ ID NO: 601116 - RNA, 21 nt, Human
uaacucuggacucagagcccu

SEQ ID NO: 601117 - RNA, 19 nt, Human
uacaagggacccacuggua

SEQ ID NO: 601118 - RNA, 20 nt, Human
uacugcuaaugaaaugggaa

SEQ ID NO: 601119 - RNA, 22 nt, Human
uauuguuucuuggccccacugc

SEQ ID NO: 601120 - RNA, 24 nt, Human
ucauauauauuguuucuuggcccc

SEQ ID NO: 601121 - RNA, 20 nt, Human
uccacauguuaagcuaggaa

SEQ ID NO: 601122 - RNA, 18 nt, Human
uccuagaggcaggcagcc

SEQ ID NO: 601123 - RNA, 18 nt, Human
uccuagaggcaggcagcc

SEQ ID NO: 601124 - RNA, 21 nt, Human
uccugggccaagaagcuaaag

SEQ ID NO: 601125 - RNA, 21 nt, Human
ugaggcaaagggguccuacug

SEQ ID NO: 601126 - RNA, 23 nt, Human
ugauaugcuuuuccuuccacaug

SEQ ID NO: 601127 - RNA, 21 nt, Human
ugccaggaaaaauuccugggc

SEQ ID NO: 601128 - RNA, 23 nt, Human
uuccugggccaagaagcuaaagc

SEQ ID NO: 601129 - RNA, 20 nt, Human
uuucacuguggugggauggu

SEQ ID NO: 601130 - RNA, 25 nt, Human
uuuuuuuuucuuucaaacuguaggg

SEQ ID NO: 601131 - RNA, 22 nt, Human
aaaaauaguuauugauucacac

SEQ ID NO: 601132 - RNA, 21 nt, Human
aaaaaucaacagaauuggcca

SEQ ID NO: 601133 - RNA, 20 nt, Human
aaaaguaaaccaccaaagac

SEQ ID NO: 601134 - RNA, 24 nt, Human
aaaaugcugggauuacaggcauga

SEQ ID NO: 601135 - RNA, 19 nt, Human
aaagaccaauacuucucuc

SEQ ID NO: 601136 - RNA, 26 nt, Human
aaaugcugggauuacaggcaugagcc

SEQ ID NO: 601137 - RNA, 24 nt, Human
aacacaaaugcggcugcugacacc

SEQ ID NO: 601138 - RNA, 19 nt, Human
aacauggugaaaccccauc

SEQ ID NO: 601139 - RNA, 20 nt, Human
aacauggugaaaccccaucu

SEQ ID NO: 601140 - RNA, 21 nt, Human
aacauggugaaaccccaucuc

SEQ ID NO: 601141 - RNA, 22 nt, Human
aacauggugaaaccccaucucg

SEQ ID NO: 601142 - RNA, 21 nt, Human
acagcccugcacauaucagaa

SEQ ID NO: 601143 - RNA, 21 nt, Human
acccgucucggccucccaaaa

SEQ ID NO: 601144 - RNA, 25 nt, Human
acccgucucggccucccaaaaugcu

SEQ ID NO: 601145 - RNA, 21 nt, Human
accggggucuggagacuggag

SEQ ID NO: 601146 - RNA, 18 nt, Human
acgggguuucaucguguu

SEQ ID NO: 601147 - RNA, 19 nt, Human
acgggguuucaucguguua

SEQ ID NO: 601148 - RNA, 20 nt, Human
acgggguuucaucguguuag

SEQ ID NO: 601149 - RNA, 24 nt, Human
acgggguuucaucguguuagccag

SEQ ID NO: 601150 - RNA, 19 nt, Human
agaaaaagaaugggcaaau

SEQ ID NO: 601151 - RNA, 24 nt, Human
agagcagcaaaacaaguuagagga

SEQ ID NO: 601152 - RNA, 18 nt, Human
agcaaaacaaguuagagg

SEQ ID NO: 601153 - RNA, 19 nt, Human
agcccugcacauaucagaa

SEQ ID NO: 601154 - RNA, 19 nt, Human
agcguccccacagauguuc

SEQ ID NO: 601155 - RNA, 23 nt, Human
aggaauccgagaccaaucuggcc

SEQ ID NO: 601156 - RNA, 24 nt, Human
aggcacagugguucaugccuguaa

SEQ ID NO: 601157 - RNA, 18 nt, Human
aguagagacgggguuuca

SEQ ID NO: 601158 - RNA, 19 nt, Human
aguggugaauaucaggaaa

SEQ ID NO: 601159 - RNA, 23 nt, Human
agugguucaugccuguaauccca

SEQ ID NO: 601160 - RNA, 24 nt, Human
agugguucaugccuguaaucccag

SEQ ID NO: 601161 - RNA, 26 nt, Human
auacuucucucuccuuucaauacuaa

SEQ ID NO: 601162 - RNA, 18 nt, Human
auaucagaagcgucccca

SEQ ID NO: 601163 - RNA, 27 nt, Human
augauuuuuaaaacugaauaggcaaag

SEQ ID NO: 601164 - RNA, 19 nt, Human
augccuguaaucccagcac

SEQ ID NO: 601165 - RNA, 21 nt, Human
auggcucagagcagcaaaaca

SEQ ID NO: 601166 - RNA, 24 nt, Human
caaaaugcugggauuacaggcaug

SEQ ID NO: 601167 - RNA, 21 nt, Human
caacagcaagggcauagagag

SEQ ID NO: 601168 - RNA, 23 nt, Human
caacagcaagggcauagagagga

SEQ ID NO: 601169 - RNA, 18 nt, Human
caacauggugaaacccca

SEQ ID NO: 601170 - RNA, 25 nt, Human
caagggcauagagaggagaccuuga

SEQ ID NO: 601171 - RNA, 19 nt, Human
caauacuucucucuccuuu

SEQ ID NO: 601172 - RNA, 20 nt, Human
caccaaagaccaauacuucu

SEQ ID NO: 601173 - RNA, 19 nt, Human
caccccagaaaagcuggug

SEQ ID NO: 601174 - RNA, 23 nt, Human
cacccgucucggccucccaaaau

SEQ ID NO: 601175 - RNA, 18 nt, Human
cacucgaaaaaucaacag

SEQ ID NO: 601176 - RNA, 20 nt, Human
cacucggugggagguggcca

SEQ ID NO: 601177 - RNA, 26 nt, Human
cacuuucuccuccucuucguccucca

SEQ ID NO: 601178 - RNA, 20 nt, Human
cacuuugggucacuugaggu

SEQ ID NO: 601179 - RNA, 19 nt, Human
cagagcagcaaaacaaguu

SEQ ID NO: 601180 - RNA, 19 nt, Human
caucguguuagccaggaug

SEQ ID NO: 601181 - RNA, 24 nt, Human
caucguguuagccaggauggucuc

SEQ ID NO: 601182 - RNA, 20 nt, Human
caugccuguaaucccagcac

SEQ ID NO: 601183 - RNA, 24 nt, Human
caugccuguaaucccagcacuuug

SEQ ID NO: 601184 - RNA, 19 nt, Human
cauguucauccaccccaga

SEQ ID NO: 601185 - RNA, 23 nt, Human
ccaaaaugcugggauuacaggca

SEQ ID NO: 601186 - RNA, 24 nt, Human
ccaaaaugcugggauuacaggcau

SEQ ID NO: 601187 - RNA, 19 nt, Human
ccacuuucuccuccucuuc

SEQ ID NO: 601188 - RNA, 20 nt, Human
ccagcacuuugggucacuug

SEQ ID NO: 601189 - RNA, 24 nt, Human
cccaaaaugcugggauuacaggca

SEQ ID NO: 601190 - RNA, 19 nt, Human
cccgcgcuccagugauggg

SEQ ID NO: 601191 - RNA, 20 nt, Human
ccugaccucgugauccaccc

SEQ ID NO: 601192 - RNA, 23 nt, Human
ccugcacauaucagaagcguccc

SEQ ID NO: 601193 - RNA, 24 nt, Human
cgagaccaaucuggccaacauggu

SEQ ID NO: 601194 - RNA, 19 nt, Human
cgccacucggugggaggug

SEQ ID NO: 601195 - RNA, 23 nt, Human
cgccccgccuccgaggccugagc

SEQ ID NO: 601196 - RNA, 24 nt, Human
cuccugaccucgugauccacccgu

SEQ ID NO: 601197 - RNA, 18 nt, Human
cugacgcugcaaacaaca

SEQ ID NO: 601198 - RNA, 19 nt, Human
cugacgcugcaaacaacag

SEQ ID NO: 601199 - RNA, 19 nt, Human
cugagccacuuucuccucc

SEQ ID NO: 601200 - RNA, 21 nt, Human
cuggccaacauggugaaaccc

SEQ ID NO: 601201 - RNA, 23 nt, Human
cuggccaacauggugaaacccca

SEQ ID NO: 601202 - RNA, 22 nt, Human
gaccucgugauccacccgucuc

SEQ ID NO: 601203 - RNA, 22 nt, Human
gaccucgugauccacccgucuc

SEQ ID NO: 601204 - RNA, 24 nt, Human
gaccucgugauccacccgucucgg

SEQ ID NO: 601205 - RNA, 23 nt, Human
gagcagcaaaacaaguuagagga

SEQ ID NO: 601206 - RNA, 18 nt, Human
gauuacaggcaugagcca

SEQ ID NO: 601207 - RNA, 21 nt, Human
gauuacaggcaugagccacca

SEQ ID NO: 601208 - RNA, 24 nt, Human
gauuacaggcaugagccaccauac

SEQ ID NO: 601209 - RNA, 24 nt, Human
gcaaagccuuacucuaacugauca

SEQ ID NO: 601210 - RNA, 24 nt, Human
gccaacauggugaaaccccaucuc

SEQ ID NO: 601211 - RNA, 24 nt, Human
ggauggucucgaucuccugaccuc

SEQ ID NO: 601212 - RNA, 19 nt, Human
ggauuacaggcaugagcca

SEQ ID NO: 601213 - RNA, 18 nt, Human
gggcagcagcaguucguu

SEQ ID NO: 601214 - RNA, 23 nt, Human
gggguuucaucguguuagccagg

SEQ ID NO: 601215 - RNA, 22 nt, Human
ggguuucaucguguuagccagg

SEQ ID NO: 601216 - RNA, 18 nt, Human
ggucacuugaggucagga

SEQ ID NO: 601217 - RNA, 24 nt, Human
guccccacagauguucuaaacaca

SEQ ID NO: 601218 - RNA, 24 nt, Human
gugauccacccgucucggccuccc

SEQ ID NO: 601219 - RNA, 18 nt, Human
guucguacugggcgaccc

SEQ ID NO: 601220 - RNA, 22 nt, Human
uaaaaaguaaaccaccaaagac

SEQ ID NO: 601221 - RNA, 20 nt, Human
uaaaauuaaugaaauaaugu

SEQ ID NO: 601222 - RNA, 23 nt, Human
uaaaccaccaaagaccaauacuu

SEQ ID NO: 601223 - RNA, 23 nt, Human
uaacugaucaaaugaccaaucag

SEQ ID NO: 601224 - RNA, 23 nt, Human
uacaggcaugagccaccauaccc

SEQ ID NO: 601225 - RNA, 20 nt, Human
uagcagugucugaauccagu

SEQ ID NO: 601226 - RNA, 19 nt, Human
uaguagagacgggguuuca

SEQ ID NO: 601227 - RNA, 24 nt, Human
uaguagagacgggguuucaucgug

SEQ ID NO: 601228 - RNA, 19 nt, Human
ucaacagaauuggccaggc

SEQ ID NO: 601229 - RNA, 19 nt, Human
ucaacagaauuggccaggc

SEQ ID NO: 601230 - RNA, 23 nt, Human
ucaacagcccugcacauaucaga

SEQ ID NO: 601231 - RNA, 24 nt, Human
ucacacuuuccaaaauuuuuaaaa

SEQ ID NO: 601232 - RNA, 22 nt, Human
ucacuugaggucaggaauccga

SEQ ID NO: 601233 - RNA, 24 nt, Human
ucagagcagcaaaacaaguuagag

SEQ ID NO: 601234 - RNA, 23 nt, Human
ucagcuccuuucuguuagcccuc

SEQ ID NO: 601235 - RNA, 24 nt, Human
ucaucguguuagccaggauggucu

SEQ ID NO: 601236 - RNA, 23 nt, Human
ucaugccuguaaucccagcacuu

SEQ ID NO: 601237 - RNA, 24 nt, Human
ucccaaaaugcugggauuacaggc

SEQ ID NO: 601238 - RNA, 19 nt, Human
ucgccccgccuccgaggcc

SEQ ID NO: 601239 - RNA, 22 nt, Human
ucggugcauguucauccacccc

SEQ ID NO: 601240 - RNA, 23 nt, Human
ucuccuccucuucguccuccaag

SEQ ID NO: 601241 - RNA, 20 nt, Human
ucucggccucccaaaaugcu

SEQ ID NO: 601242 - RNA, 23 nt, Human
ucuggccaacauggugaaacccc

SEQ ID NO: 601243 - RNA, 20 nt, Human
ugaaaugcacugcagagaaa

SEQ ID NO: 601244 - RNA, 21 nt, Human
ugaaaugcacugcagagaaaa

SEQ ID NO: 601245 - RNA, 23 nt, Human
ugaccucgugauccacccgucuc

SEQ ID NO: 601246 - RNA, 19 nt, Human
ugcaaacaacagcaagggc

SEQ ID NO: 601247 - RNA, 23 nt, Human
ugccuguaaucccagcacuuugg

SEQ ID NO: 601248 - RNA, 23 nt, Human
ugccuguaaucccagcacuuugg

SEQ ID NO: 601249 - RNA, 24 nt, Human
ugccuguaaucccagcacuuuggg

SEQ ID NO: 601250 - RNA, 24 nt, Human
uggccaacauggugaaaccccauc

SEQ ID NO: 601251 - RNA, 24 nt, Human
uggccaggcacagugguucaugcc

SEQ ID NO: 601252 - RNA, 18 nt, Human
ugggauuacaggcaugag

SEQ ID NO: 601253 - RNA, 22 nt, Human
ugggauuacaggcaugagccac

SEQ ID NO: 601254 - RNA, 23 nt, Human
ugggauuacaggcaugagccacc

SEQ ID NO: 601255 - RNA, 24 nt, Human
ugggauuacaggcaugagccacca

SEQ ID NO: 601256 - RNA, 25 nt, Human
ugggauuacaggcaugagccaccau

SEQ ID NO: 601257 - RNA, 23 nt, Human
ugggucacuugaggucaggaauc

SEQ ID NO: 601258 - RNA, 24 nt, Human
ugggucacuugaggucaggaaucc

SEQ ID NO: 601259 - RNA, 22 nt, Human
ugguucaugccuguaaucccag

SEQ ID NO: 601260 - RNA, 24 nt, Human
ugguucaugccuguaaucccagca

SEQ ID NO: 601261 - RNA, 21 nt, Human
uuaaaaauacaaaaucauagu

SEQ ID NO: 601262 - RNA, 18 nt, Human
uuaguagagacgggguuu

SEQ ID NO: 601263 - RNA, 20 nt, Human
uuaguagagacgggguuuca

SEQ ID NO: 601264 - RNA, 24 nt, Human
uuaguagagacgggguuucaucgu

SEQ ID NO: 601265 - RNA, 23 nt, Human
uucaugccuguaaucccagcacu

SEQ ID NO: 601266 - RNA, 18 nt, Human
uucguccuccaagaucgc

SEQ ID NO: 601267 - RNA, 18 nt, Human
uucuccuccucuucgucc

SEQ ID NO: 601268 - RNA, 19 nt, Human
uuucaucguguuagccagg

SEQ ID NO: 601269 - RNA, 21 nt, Human
uuuccaaaauuuuuaaaaagu

SEQ ID NO: 601270 - RNA, 18 nt, Human
uuucuaugugggcagccu

SEQ ID NO: 601271 - RNA, 19 nt, Human
uuucuccuccucuucgucc

SEQ ID NO: 601272 - RNA, 23 nt, Human
uuuuaguagagacgggguuucau

SEQ ID NO: 601273 - RNA, 22 nt, Human
aacaacuuucucacacuagcuc

SEQ ID NO: 601274 - RNA, 18 nt, Human
aacacaccccucccgcua

SEQ ID NO: 601275 - RNA, 20 nt, Human
aacugcuucucuaccaagaa

SEQ ID NO: 601276 - RNA, 18 nt, Human
aaggcaaaggagaagcag

SEQ ID NO: 601277 - RNA, 18 nt, Human
aaguggcccauacgauga

SEQ ID NO: 601278 - RNA, 18 nt, Human
aaucauggcaaaaggcaa

SEQ ID NO: 601279 - RNA, 18 nt, Human
acugaaacucaucugugg

SEQ ID NO: 601280 - RNA, 23 nt, Human
acuguaacccauccugacacacu

SEQ ID NO: 601281 - RNA, 20 nt, Human
agcaggcaccuuugucagau

SEQ ID NO: 601282 - RNA, 20 nt, Human
agggucuagggaugccuuag

SEQ ID NO: 601283 - RNA, 22 nt, Human
aucuguggugacaugcacaucu

SEQ ID NO: 601284 - RNA, 19 nt, Human
augaacacaccccucccgc

SEQ ID NO: 601285 - RNA, 23 nt, Human
augcugucuucccugucucagcu

SEQ ID NO: 601286 - RNA, 29 nt, Human
auggcaaaaggcaaaggagaagggacccc

SEQ ID NO: 601287 - RNA, 19 nt, Human
caaaaggcaaaggagaagc

SEQ ID NO: 601288 - RNA, 25 nt, Human
caaaaggcaaaggagaagcaggcac

SEQ ID NO: 601289 - RNA, 22 nt, Human
cagcuguacagccggcucugcc

SEQ ID NO: 601290 - RNA, 19 nt, Human
caguagcaccuuggcuaga

SEQ ID NO: 601291 - RNA, 19 nt, Human
ccccaugaacacaccccuc

SEQ ID NO: 601292 - RNA, 21 nt, Human
ccccaugaacacaccccuccc

SEQ ID NO: 601293 - RNA, 23 nt, Human
ccccaugaacacaccccucccgc

SEQ ID NO: 601294 - RNA, 25 nt, Human
ccuuccauaguugggaccaaaagcc

SEQ ID NO: 601295 - RNA, 23 nt, Human
cuagacccaucuguauaccaugc

SEQ ID NO: 601296 - RNA, 21 nt, Human
cucuaccaagaaauacuggag

SEQ ID NO: 601297 - RNA, 18 nt, Human
cugaaguaugagggaagu

SEQ ID NO: 601298 - RNA, 24 nt, Human
cugcaagauggauagcucugacuc

SEQ ID NO: 601299 - RNA, 20 nt, Human
cugcccugccuuucggguca

SEQ ID NO: 601300 - RNA, 18 nt, Human
cugugccuucccugucug

SEQ ID NO: 601301 - RNA, 18 nt, Human
gaaguggguggaugggca

SEQ ID NO: 601302 - RNA, 23 nt, Human
gaaguggguggaugggcagaaag

SEQ ID NO: 601303 - RNA, 20 nt, Human
gcucugacucucucuuucuc

SEQ ID NO: 601304 - RNA, 19 nt, Human
gcugaaguaugagggaagu

SEQ ID NO: 601305 - RNA, 24 nt, Human
gggaaguggguggaugggcagaaa

SEQ ID NO: 601306 - RNA, 21 nt, Human
gguuuuauucagcagcagcuc

SEQ ID NO: 601307 - RNA, 22 nt, Human
uaagggacuuggcauacuuugc

SEQ ID NO: 601308 - RNA, 18 nt, Human
uaaguggcccauacgaug

SEQ ID NO: 601309 - RNA, 27 nt, Human
uaaucagaaauaaauauuuauguacag

SEQ ID NO: 601310 - RNA, 18 nt, Human
uacuguuuucccaguuga

SEQ ID NO: 601311 - RNA, 27 nt, Human
uacuuugcugcuccaaguaggcacccc

SEQ ID NO: 601312 - RNA, 22 nt, Human
uagggucuagggaugccuuagg

SEQ ID NO: 601313 - RNA, 19 nt, Human
uauguccuagcucccuccu

SEQ ID NO: 601314 - RNA, 18 nt, Human
uccacauagcugaggaga

SEQ ID NO: 601315 - RNA, 21 nt, Human
uccauaguugggaccaaaagc

SEQ ID NO: 601316 - RNA, 18 nt, Human
ucccacauacagcuguac

SEQ ID NO: 601317 - RNA, 22 nt, Human
ucgaggcagcaguagcaccuug

SEQ ID NO: 601318 - RNA, 20 nt, Human
ugaagaaauaucugagacug

SEQ ID NO: 601319 - RNA, 22 nt, Human
ugaagaaauaucugagacuggg

SEQ ID NO: 601320 - RNA, 23 nt, Human
ugaaguaugagggaagugggugg

SEQ ID NO: 601321 - RNA, 19 nt, Human
ugcaacaacagucgaggca

SEQ ID NO: 601322 - RNA, 19 nt, Human
ugcccugccuuucggguca

SEQ ID NO: 601323 - RNA, 18 nt, Human
ugccuuaggccccacagu

SEQ ID NO: 601324 - RNA, 24 nt, Human
uguauaccaugcccuauuaggaau

SEQ ID NO: 601325 - RNA, 21 nt, Human
ugucugugccuucccugucug

SEQ ID NO: 601326 - RNA, 23 nt, Human
uguuacuaacugcuucucuacca

SEQ ID NO: 601327 - RNA, 23 nt, Human
aaacugcucuaaacacuccccca

SEQ ID NO: 601328 - RNA, 19 nt, Human
aacaaggaagacagggucu

SEQ ID NO: 601329 - RNA, 24 nt, Human
aaggguuucacuauacugcccagg

SEQ ID NO: 601330 - RNA, 25 nt, Human
acuauacugcccaggcuaaacuuga

SEQ ID NO: 601331 - RNA, 24 nt, Human
agccuccugaauagcugggaguag

SEQ ID NO: 601332 - RNA, 23 nt, Human
aguagcugggacuacagggaugu

SEQ ID NO: 601333 - RNA, 27 nt, Human
auagcugggaguagcugggacuacagg

SEQ ID NO: 601334 - RNA, 22 nt, Human
augaaucucuguauugucagaa

SEQ ID NO: 601335 - RNA, 27 nt, Human
cacuauacugcccaggcuaaacuugaa

SEQ ID NO: 601336 - RNA, 22 nt, Human
cagccuccugaauagcugggag

SEQ ID NO: 601337 - RNA, 23 nt, Human
ccagacacuuaauuaaugcugau

SEQ ID NO: 601338 - RNA, 23 nt, Human
ccgccucagccuccugaauagcu

SEQ ID NO: 601339 - RNA, 21 nt, Human
ccugaauagcugggaguagcu

SEQ ID NO: 601340 - RNA, 22 nt, Human
ccugacuggcagaguacccaga

SEQ ID NO: 601341 - RNA, 22 nt, Human
ccugccgccucagccuccugaa

SEQ ID NO: 601342 - RNA, 24 nt, Human
ccugccgccucagccuccugaaua

SEQ ID NO: 601343 - RNA, 18 nt, Human
ccuggcaaguccuuuacc

SEQ ID NO: 601344 - RNA, 23 nt, Human
ccuggcaaguccuuuaccucccc

SEQ ID NO: 601345 - RNA, 20 nt, Human
ccuuggcaugugcucagucc

SEQ ID NO: 601346 - RNA, 19 nt, Human
ccuugguucaagugauccu

SEQ ID NO: 601347 - RNA, 20 nt, Human
ccuugguucaagugauccug

SEQ ID NO: 601348 - RNA, 24 nt, Human
cgccucagccuccugaauagcugg

SEQ ID NO: 601349 - RNA, 20 nt, Human
cuaaccaaauaaugccaccc

SEQ ID NO: 601350 - RNA, 25 nt, Human
cuccugaauagcugggaguagcugg

SEQ ID NO: 601351 - RNA, 22 nt, Human
gaauucuccuugaucacuucuc

SEQ ID NO: 601352 - RNA, 24 nt, Human
gacuacagggauguguuaucaugc

SEQ ID NO: 601353 - RNA, 20 nt, Human
gaguagcugggacuacaggg

SEQ ID NO: 601354 - RNA, 20 nt, Human
gaucuugugauccucucucu

SEQ ID NO: 601355 - RNA, 24 nt, Human
ggacuacagggauguguuaucaug

SEQ ID NO: 601356 - RNA, 19 nt, Human
guagcugggacuacaggga

SEQ ID NO: 601357 - RNA, 24 nt, Human
gugauccugccgccucagccuccu

SEQ ID NO: 601358 - RNA, 18 nt, Human
uaaaagggugccuuggca

SEQ ID NO: 601359 - RNA, 19 nt, Human
uaccuccccguaggccugg

SEQ ID NO: 601360 - RNA, 24 nt, Human
uauacugcccaggcuaaacuugaa

SEQ ID NO: 601361 - RNA, 19 nt, Human
uauaguggugaacaaggaa

SEQ ID NO: 601362 - RNA, 20 nt, Human
uauaguggugaacaaggaag

SEQ ID NO: 601363 - RNA, 22 nt, Human
uaucaugcccagugaaagcccu

SEQ ID NO: 601364 - RNA, 18 nt, Human
ucaagugauccugccgcc

SEQ ID NO: 601365 - RNA, 22 nt, Human
ucacuauacugcccaggcuaaa

SEQ ID NO: 601366 - RNA, 19 nt, Human
uccauaaaagggugccuug

SEQ ID NO: 601367 - RNA, 18 nt, Human
uccuugguucaagugauc

SEQ ID NO: 601368 - RNA, 21 nt, Human
uccuugguucaagugauccug

SEQ ID NO: 601369 - RNA, 24 nt, Human
ugcaagccuuaggaucugaaacuu

SEQ ID NO: 601370 - RNA, 20 nt, Human
ugcccaggcuaaacuugaac

SEQ ID NO: 601371 - RNA, 24 nt, Human
ugcccaggcuaaacuugaacuccu

SEQ ID NO: 601372 - RNA, 20 nt, Human
ugccuuggcaugugcucagu

SEQ ID NO: 601373 - RNA, 18 nt, Human
ugcuacaagcucuguuuu

SEQ ID NO: 601374 - RNA, 18 nt, Human
ugggacuacagggaugug

SEQ ID NO: 601375 - RNA, 22 nt, Human
ugggacuacagggauguguuau

SEQ ID NO: 601376 - RNA, 26 nt, Human
ugguacagguugaauauccauaaaag

SEQ ID NO: 601377 - RNA, 23 nt, Human
ugguucaagugauccugccgccu

SEQ ID NO: 601378 - RNA, 18 nt, Human
uguuuuugagaaaggguu

SEQ ID NO: 601379 - RNA, 23 nt, Human
uucaagugauccugccgccucag

SEQ ID NO: 601380 - RNA, 24 nt, Human
uucaucuuguguaacucuuuuaag

SEQ ID NO: 601381 - RNA, 26 nt, Human
uucaucuuguguaacucuuuuaagua

SEQ ID NO: 601382 - RNA, 19 nt, Human
uuggcaugugcucaguccu

SEQ ID NO: 601383 - RNA, 24 nt, Human
uugugugaucuugugauccucucu

SEQ ID NO: 601384 - RNA, 24 nt, Human
uuuaagcaaagaagaaauuggugu

SEQ ID NO: 601385 - RNA, 24 nt, Human
uuucacuauacugcccaggcuaaa

SEQ ID NO: 601386 - RNA, 22 nt, Human
uuucaguagcccuuuauuuguu

SEQ ID NO: 601387 - RNA, 21 nt, Human
aaacaagauaggaguacucag

SEQ ID NO: 601388 - RNA, 24 nt, Human
aacugguccgggccuccuggccuc

SEQ ID NO: 601389 - RNA, 21 nt, Human
aagcaggggugggaaaauucg

SEQ ID NO: 601390 - RNA, 23 nt, Human
aagcaggggugggaaaauucggg

SEQ ID NO: 601391 - RNA, 22 nt, Human
accucaaggcaguguggugggg

SEQ ID NO: 601392 - RNA, 22 nt, Human
acugcgcucaucccccuccccc

SEQ ID NO: 601393 - RNA, 22 nt, Human
agagacuggggaaggcaggggc

SEQ ID NO: 601394 - RNA, 23 nt, Human
agcaaacugcgcucaucccccuc

SEQ ID NO: 601395 - RNA, 19 nt, Human
aggacaccuggguccucuc

SEQ ID NO: 601396 - RNA, 21 nt, Human
aggccccagcccaagucccaa

SEQ ID NO: 601397 - RNA, 21 nt, Human
aggggaggaggugcgaaggca

SEQ ID NO: 601398 - RNA, 19 nt, Human
aggugcgaaggcaaacacu

SEQ ID NO: 601399 - RNA, 20 nt, Human
caaccuccucggggagaagc

SEQ ID NO: 601400 - RNA, 22 nt, Human
caagucccaacuugcucaagag

SEQ ID NO: 601401 - RNA, 19 nt, Human
cacaacugcagccucccag

SEQ ID NO: 601402 - RNA, 19 nt, Human
cacugcuaggacaccuggg

SEQ ID NO: 601403 - RNA, 24 nt, Human
ccaggccccagcccaagucccaac

SEQ ID NO: 601404 - RNA, 23 nt, Human
ccccagcccaagucccaacuugc

SEQ ID NO: 601405 - RNA, 21 nt, Human
cccccgagucacggccaaccc

SEQ ID NO: 601406 - RNA, 18 nt, Human
cccccggggccugcucac

SEQ ID NO: 601407 - RNA, 20 nt, Human
cccccggggccugcucacuc

SEQ ID NO: 601408 - RNA, 20 nt, Human
ccccgagucacggccaaccc

SEQ ID NO: 601409 - RNA, 22 nt, Human
ccccggggccugcucacuccuc

SEQ ID NO: 601410 - RNA, 19 nt, Human
ccgcccccgagucacggcc

SEQ ID NO: 601411 - RNA, 24 nt, Human
ccgcccccgagucacggccaaccc

SEQ ID NO: 601412 - RNA, 22 nt, Human
ccucccagccaaucauucuucc

SEQ ID NO: 601413 - RNA, 22 nt, Human
ccucccccggggccugcucacu

SEQ ID NO: 601414 - RNA, 23 nt, Human
ccuccucggggagaagcaggggu

SEQ ID NO: 601415 - RNA, 21 nt, Human
ccucggggagaagcaggggug

SEQ ID NO: 601416 - RNA, 23 nt, Human
ccucggggagaagcagggguggg

SEQ ID NO: 601417 - RNA, 21 nt, Human
ccuggccgccugcaccuuggc

SEQ ID NO: 601418 - RNA, 24 nt, Human
ccuggccucccucccgcggccucc

SEQ ID NO: 601419 - RNA, 21 nt, Human
cgagggccucagugccagaug

SEQ ID NO: 601420 - RNA, 18 nt, Human
cggcaggggaggaaagcg

SEQ ID NO: 601421 - RNA, 21 nt, Human
cggcaggggaggaaagcgagc

SEQ ID NO: 601422 - RNA, 23 nt, Human
cucccacccuggccgccugcacc

SEQ ID NO: 601423 - RNA, 20 nt, Human
cucccgaacagguggagaaa

SEQ ID NO: 601424 - RNA, 25 nt, Human
cuccucggggagaagcagggguggg

SEQ ID NO: 601425 - RNA, 19 nt, Human
gacuggggaaggcaggggc

SEQ ID NO: 601426 - RNA, 18 nt, Human
gagcccuggggcccuacu

SEQ ID NO: 601427 - RNA, 18 nt, Human
gauucacuucccagaggg

SEQ ID NO: 601428 - RNA, 24 nt, Human
gcucaagagcucaaccuccucggg

SEQ ID NO: 601429 - RNA, 18 nt, Human
ggagccuggggugguugc

SEQ ID NO: 601430 - RNA, 21 nt, Human
ggagggggccggcaggggagg

SEQ ID NO: 601431 - RNA, 23 nt, Human
gggcggagggggccggcagggga

SEQ ID NO: 601432 - RNA, 22 nt, Human
ggggaggaggugcgaaggcaaa

SEQ ID NO: 601433 - RNA, 24 nt, Human
gggggcggagggggccggcagggg

SEQ ID NO: 601434 - RNA, 20 nt, Human
ggucagaaguugugguugag

SEQ ID NO: 601435 - RNA, 23 nt, Human
ggucuuauuugccccccgcgcug

SEQ ID NO: 601436 - RNA, 19 nt, Human
gugaagcugcagggagggg

SEQ ID NO: 601437 - RNA, 21 nt, Human
uaccacaacugcagccuccca

SEQ ID NO: 601438 - RNA, 23 nt, Human
uaccacaacugcagccucccagg

SEQ ID NO: 601439 - RNA, 20 nt, Human
ucagggucgccagguggcga

SEQ ID NO: 601440 - RNA, 22 nt, Human
ucauucuuccaggccccagccc

SEQ ID NO: 601441 - RNA, 18 nt, Human
ucccaggggagccugggg

SEQ ID NO: 601442 - RNA, 18 nt, Human
ucccugugaagcugcagg

SEQ ID NO: 601443 - RNA, 24 nt, Human
ucgccaccaccccgcggcuuccua

SEQ ID NO: 601444 - RNA, 21 nt, Human
ucgccagguggcgaggcaggu

SEQ ID NO: 601445 - RNA, 19 nt, Human
ugcagccucccaggggagc

SEQ ID NO: 601446 - RNA, 26 nt, Human
uggcugcagagaccccuccacugaca

SEQ ID NO: 601447 - RNA, 19 nt, Human
ugugugggggcggaggggg

SEQ ID NO: 601448 - RNA, 21 nt, Human
ugugugggggcggagggggcc

SEQ ID NO: 601449 - RNA, 23 nt, Human
uuaggugcacaucuccaacuccc

SEQ ID NO: 601450 - RNA, 21 nt, Human
uucuaaacccuaggaaggcuc

SEQ ID NO: 601451 - RNA, 19 nt, Human
aaggaacugacccgagagc

SEQ ID NO: 601452 - RNA, 22 nt, Human
agauuacaggugugagccacug

SEQ ID NO: 601453 - RNA, 19 nt, Human
agcccgagucaaaccgcac

SEQ ID NO: 601454 - RNA, 24 nt, Human
aggccaggacggauugacaggaga

SEQ ID NO: 601455 - RNA, 19 nt, Human
aggucacagaaggaacuga

SEQ ID NO: 601456 - RNA, 20 nt, Human
cacgccuggaaucccagccg

SEQ ID NO: 601457 - RNA, 21 nt, Human
cacgccuggaaucccagccgu

SEQ ID NO: 601458 - RNA, 19 nt, Human
caggagacgccugggccac

SEQ ID NO: 601459 - RNA, 18 nt, Human
ccccuggaugcccacagg

SEQ ID NO: 601460 - RNA, 20 nt, Human
ccccuggaugcccacaggcu

SEQ ID NO: 601461 - RNA, 22 nt, Human
ccuggaaucccagccgucuggg

SEQ ID NO: 601462 - RNA, 22 nt, Human
cgucacagggcggccuuagguu

SEQ ID NO: 601463 - RNA, 22 nt, Human
cgugacaucacuaaccagcucc

SEQ ID NO: 601464 - RNA, 19 nt, Human
cucacgccuggaaucccag

SEQ ID NO: 601465 - RNA, 18 nt, Human
gauuacaggugugagcca

SEQ ID NO: 601466 - RNA, 19 nt, Human
gauuacaggugugagccac

SEQ ID NO: 601467 - RNA, 23 nt, Human
ggaggcugagauuacagguguga

SEQ ID NO: 601468 - RNA, 21 nt, Human
gggaacagccgagaucagccg

SEQ ID NO: 601469 - RNA, 21 nt, Human
gggaggggaguggagaugggg

SEQ ID NO: 601470 - RNA, 19 nt, Human
gggcgugacaucacuaacc

SEQ ID NO: 601471 - RNA, 19 nt, Human
ggggaguggagauggggaa

SEQ ID NO: 601472 - RNA, 22 nt, Human
ggugccgaggucacagaaggaa

SEQ ID NO: 601473 - RNA, 19 nt, Human
guccccagcguuuucucag

SEQ ID NO: 601474 - RNA, 19 nt, Human
uacaggugugagccacugu

SEQ ID NO: 601475 - RNA, 24 nt, Human
uacaggugugagccacugucccca

SEQ ID NO: 601476 - RNA, 21 nt, Human
ucagcccgagucaaaccgcac

SEQ ID NO: 601477 - RNA, 23 nt, Human
uccccagcguuuucucagcccga

SEQ ID NO: 601478 - RNA, 19 nt, Human
ugaaguuaucaucagugca

SEQ ID NO: 601479 - RNA, 20 nt, Human
ugacccgagagccgucacag

SEQ ID NO: 601480 - RNA, 21 nt, Human
ugagauuacaggugugagcca

SEQ ID NO: 601481 - RNA, 22 nt, Human
ugagauuacaggugugagccac

SEQ ID NO: 601482 - RNA, 22 nt, Human
ugagauuacaggugugagccac

SEQ ID NO: 601483 - RNA, 22 nt, Human
ugagauuacaggugugagccac

SEQ ID NO: 601484 - RNA, 24 nt, Human
ugagauuacaggugugagccacug

SEQ ID NO: 601485 - RNA, 21 nt, Human
uggcagcugcugaggccagga

SEQ ID NO: 601486 - RNA, 21 nt, Human
ugugagccacuguccccagcg

SEQ ID NO: 601487 - RNA, 18 nt, Human
uuuuuuuuuuuuuuuuug

SEQ ID NO: 601488 - RNA, 22 nt, Human
aaacugaaccucuauccuguaa

SEQ ID NO: 601489 - RNA, 19 nt, Human
aaauuaauaggaugaauga

SEQ ID NO: 601490 - RNA, 22 nt, Human
aaauuccagagguaucuaaacu

SEQ ID NO: 601491 - RNA, 23 nt, Human
aacccuguuuuucccccacagua

SEQ ID NO: 601492 - RNA, 22 nt, Human
aagaaaaacaaaaagaacuuua

SEQ ID NO: 601493 - RNA, 21 nt, Human
acauacacccccuauuauaug

SEQ ID NO: 601494 - RNA, 19 nt, Human
acccuguuuuucccccaca

SEQ ID NO: 601495 - RNA, 21 nt, Human
acuaaacuguuagacugagau

SEQ ID NO: 601496 - RNA, 18 nt, Human
acugcaagaaaaagaagc

SEQ ID NO: 601497 - RNA, 22 nt, Human
agaugcuaaagccccaacaacu

SEQ ID NO: 601498 - RNA, 23 nt, Human
agccccuucuaaaaagcucccau

SEQ ID NO: 601499 - RNA, 23 nt, Human
aggcucauuuucccaaaucaaaa

SEQ ID NO: 601500 - RNA, 26 nt, Human
aguugauacuacucagagcaagauag

SEQ ID NO: 601501 - RNA, 20 nt, Human
aguugauuguagcacaacug

SEQ ID NO: 601502 - RNA, 21 nt, Human
aguuuaaacaaaauucacaca

SEQ ID NO: 601503 - RNA, 24 nt, Human
auggcugguaccuccuccaaacac

SEQ ID NO: 601504 - RNA, 22 nt, Human
caaagcacuggaguucgguuug

SEQ ID NO: 601505 - RNA, 23 nt, Human
caacaucacuccauuuuuuccac

SEQ ID NO: 601506 - RNA, 20 nt, Human
caaguaaaccugaaagaaaa

SEQ ID NO: 601507 - RNA, 24 nt, Human
caccuccuuuuuccucguugucuu

SEQ ID NO: 601508 - RNA, 21 nt, Human
caccuguguauuucacagaag

SEQ ID NO: 601509 - RNA, 20 nt, Human
cagaaucaaccccguaacaa

SEQ ID NO: 601510 - RNA, 21 nt, Human
cagcaggauaaaaaacguaaa

SEQ ID NO: 601511 - RNA, 23 nt, Human
cagcaggauaaaaaacguaaaac

SEQ ID NO: 601512 - RNA, 24 nt, Human
cagcaggauaaaaaacguaaaaca

SEQ ID NO: 601513 - RNA, 22 nt, Human
cagcauauuacauugccucugg

SEQ ID NO: 601514 - RNA, 20 nt, Human
cauguuccacaaaaagguca

SEQ ID NO: 601515 - RNA, 24 nt, Human
ccaacaacucuuugugcucaguga

SEQ ID NO: 601516 - RNA, 26 nt, Human
ccacucaauuuuagcagcuuuaauuu

SEQ ID NO: 601517 - RNA, 21 nt, Human
ccccuucuaaaaagcucccau

SEQ ID NO: 601518 - RNA, 23 nt, Human
cccuacccggacaccuccuuuuu

SEQ ID NO: 601519 - RNA, 19 nt, Human
cccuucuaaaaagcuccca

SEQ ID NO: 601520 - RNA, 18 nt, Human
ccgaccgccgccgcugcc

SEQ ID NO: 601521 - RNA, 19 nt, Human
ccgaccgccgccgcugccg

SEQ ID NO: 601522 - RNA, 19 nt, Human
ccgaccgccgccgcugccg

SEQ ID NO: 601523 - RNA, 19 nt, Human
ccgccgccaccaccaggcc

SEQ ID NO: 601524 - RNA, 23 nt, Human
ccgccgccaccaccaggccucgg

SEQ ID NO: 601525 - RNA, 23 nt, Human
ccgccgccaccaccaggccucgg

SEQ ID NO: 601526 - RNA, 18 nt, Human
ccgccgccgcugccguuc

SEQ ID NO: 601527 - RNA, 20 nt, Human
ccgccgccgcugccguuccg

SEQ ID NO: 601528 - RNA, 22 nt, Human
ccgcugccguuccguagcugcu

SEQ ID NO: 601529 - RNA, 26 nt, Human
ccuauggucagaaucaaccccguaac

SEQ ID NO: 601530 - RNA, 20 nt, Human
ccuccuuuuuccucguuguc

SEQ ID NO: 601531 - RNA, 23 nt, Human
ccucgggugucgccgcguugccc

SEQ ID NO: 601532 - RNA, 18 nt, Human
ccugccaccagccuugcc

SEQ ID NO: 601533 - RNA, 24 nt, Human
ccugccaccagccuugcccucaau

SEQ ID NO: 601534 - RNA, 18 nt, Human
cgaccgccgccgcugccg

SEQ ID NO: 601535 - RNA, 23 nt, Human
cgcguugcccuacccggacaccu

SEQ ID NO: 601536 - RNA, 23 nt, Human
cuacucagagcaagauaguacag

SEQ ID NO: 601537 - RNA, 22 nt, Human
cucccaucugcacuagccuuac

SEQ ID NO: 601538 - RNA, 23 nt, Human
cugcaagaaaaagaagcuggucu

SEQ ID NO: 601539 - RNA, 18 nt, Human
cuuauuugcucagaucuu

SEQ ID NO: 601540 - RNA, 20 nt, Human
gaguucgguuuguacuucuc

SEQ ID NO: 601541 - RNA, 25 nt, Human
gcucccgccaccacccggcucgguc

SEQ ID NO: 601542 - RNA, 19 nt, Human
ggacuaguguucuuuccca

SEQ ID NO: 601543 - RNA, 19 nt, Human
gugaauuuuggaaacacaa

SEQ ID NO: 601544 - RNA, 23 nt, Human
uaacaaguuuggccaaacaaugc

SEQ ID NO: 601545 - RNA, 22 nt, Human
uaauaaaacauaacaaagcacu

SEQ ID NO: 601546 - RNA, 24 nt, Human
uagcagcuuuaauuuuuuaagaaa

SEQ ID NO: 601547 - RNA, 20 nt, Human
uagugauucacauugcauac

SEQ ID NO: 601548 - RNA, 21 nt, Human
uaugcugucugagauauagua

SEQ ID NO: 601549 - RNA, 25 nt, Human
uauuacauugccucuggcuugcacc

SEQ ID NO: 601550 - RNA, 18 nt, Human
uauuugaaggcaagaaca

SEQ ID NO: 601551 - RNA, 22 nt, Human
uauuugaaggcaagaacauuua

SEQ ID NO: 601552 - RNA, 23 nt, Human
ucaagagacccuuucuucucaaa

SEQ ID NO: 601553 - RNA, 19 nt, Human
ucccaacaauaagaacuuc

SEQ ID NO: 601554 - RNA, 23 nt, Human
ucccugacaccagcacuuagccc

SEQ ID NO: 601555 - RNA, 18 nt, Human
uccggcugcucccgcugc

SEQ ID NO: 601556 - RNA, 22 nt, Human
ucuuuuuuccuuucucacuuaa

SEQ ID NO: 601557 - RNA, 23 nt, Human
ugaaagguuugcauuguuguuuu

SEQ ID NO: 601558 - RNA, 21 nt, Human
ugaauauucauucuaagacaa

SEQ ID NO: 601559 - RNA, 22 nt, Human
ugacaagaguagcuuaggacgc

SEQ ID NO: 601560 - RNA, 23 nt, Human
ugagaauauuaagccugaggcua

SEQ ID NO: 601561 - RNA, 21 nt, Human
ugcaagaaaaagaagcugguc

SEQ ID NO: 601562 - RNA, 19 nt, Human
ugccucuggcuugcaccuc

SEQ ID NO: 601563 - RNA, 26 nt, Human
ugcuucagccuugaauaucucgaucc

SEQ ID NO: 601564 - RNA, 23 nt, Human
ugcuuuguuagcuguaacagccu

SEQ ID NO: 601565 - RNA, 23 nt, Human
uggaaacacaagcguauugaaca

SEQ ID NO: 601566 - RNA, 26 nt, Human
ugguagucaggaguucugggaugacu

SEQ ID NO: 601567 - RNA, 26 nt, Human
uguaacugcaagaaaaagaagcuggu

SEQ ID NO: 601568 - RNA, 18 nt, Human
ugucuuuuuuccuuucuc

SEQ ID NO: 601569 - RNA, 20 nt, Human
ugugcucagugaaagaaucc

SEQ ID NO: 601570 - RNA, 27 nt, Human
uguuguagguuucucugggggugaccc

SEQ ID NO: 601571 - RNA, 20 nt, Human
uguuguuuuaguucuucaag

SEQ ID NO: 601572 - RNA, 20 nt, Human
uuagccccuucuaaaaagcu

SEQ ID NO: 601573 - RNA, 20 nt, Human
uucaaguuuuaguuaaaauu

SEQ ID NO: 601574 - RNA, 24 nt, Human
uucacacauacacccccuauuaua

SEQ ID NO: 601575 - RNA, 18 nt, Human
uucacagaagcccaacac

SEQ ID NO: 601576 - RNA, 18 nt, Human
uuccuuuuuucacucuug

SEQ ID NO: 601577 - RNA, 22 nt, Human
uucucuguaaauagugauucac

SEQ ID NO: 601578 - RNA, 23 nt, Human
uuuuuguuuuuuugccaucuguu

SEQ ID NO: 601579 - RNA, 22 nt, Human
aaaccaucaccugguuugcauu

SEQ ID NO: 601580 - RNA, 23 nt, Human
aacucguuuuuuccugaaacuuu

SEQ ID NO: 601581 - RNA, 22 nt, Human
aagcaucucagaaaguggaccc

SEQ ID NO: 601582 - RNA, 18 nt, Human
aaguauaaacucuauucc

SEQ ID NO: 601583 - RNA, 18 nt, Human
aaguaucugggacuacag

SEQ ID NO: 601584 - RNA, 24 nt, Human
aaguaucugggacuacaggcaugu

SEQ ID NO: 601585 - RNA, 19 nt, Human
aagugcugggauuaacagg

SEQ ID NO: 601586 - RNA, 21 nt, Human
aagugcugggauuaacaggug

SEQ ID NO: 601587 - RNA, 24 nt, Human
aagugcugggauuaacagguguga

SEQ ID NO: 601588 - RNA, 24 nt, Human
accauguugcccaggcuggucucg

SEQ ID NO: 601589 - RNA, 25 nt, Human
accauguugcccaggcuggucucga

SEQ ID NO: 601590 - RNA, 22 nt, Human
acccuugaccuccugggcucaa

SEQ ID NO: 601591 - RNA, 23 nt, Human
acuacauaugaaugaggcuacag

SEQ ID NO: 601592 - RNA, 23 nt, Human
agacauuaauccaauuugaauaa

SEQ ID NO: 601593 - RNA, 18 nt, Human
agauucauuuucuugagu

SEQ ID NO: 601594 - RNA, 18 nt, Human
aggcauugaaaccaucac

SEQ ID NO: 601595 - RNA, 19 nt, Human
aggcauugaaaccaucacc

SEQ ID NO: 601596 - RNA, 19 nt, Human
aggcuggagugcaguggca

SEQ ID NO: 601597 - RNA, 22 nt, Human
aggguuucaccauguugcccag

SEQ ID NO: 601598 - RNA, 23 nt, Human
aggguuucaccauguugcccagg

SEQ ID NO: 601599 - RNA, 23 nt, Human
agugcaguggcaugaccucggcu

SEQ ID NO: 601600 - RNA, 24 nt, Human
agugcaguggcaugaccucggcuc

SEQ ID NO: 601601 - RNA, 18 nt, Human
auaggguuucaccauguu

SEQ ID NO: 601602 - RNA, 19 nt, Human
auaggguuucaccauguug

SEQ ID NO: 601603 - RNA, 24 nt, Human
augaaggcuugcuaugcauaaaua

SEQ ID NO: 601604 - RNA, 25 nt, Human
caacaaacaguuauugagcaccugc

SEQ ID NO: 601605 - RNA, 25 nt, Human
caagcgauucucccaucccagccca

SEQ ID NO: 601606 - RNA, 24 nt, Human
caccauguugcccaggcuggucuc

SEQ ID NO: 601607 - RNA, 27 nt, Human
caccauguugcccaggcuggucucgaa

SEQ ID NO: 601608 - RNA, 19 nt, Human
cacuguacccuugaccucc

SEQ ID NO: 601609 - RNA, 24 nt, Human
cagggucuugcucuguugcccagg

SEQ ID NO: 601610 - RNA, 20 nt, Human
caguggcaugaccucggcca

SEQ ID NO: 601611 - RNA, 21 nt, Human
caguggcaugaccucggcuca

SEQ ID NO: 601612 - RNA, 23 nt, Human
cauguugcccaggcuggucucga

SEQ ID NO: 601613 - RNA, 24 nt, Human
cauguugcccaggcuggucucgaa

SEQ ID NO: 601614 - RNA, 19 nt, Human
cauugcacccagccuguua

SEQ ID NO: 601615 - RNA, 21 nt, Human
ccaggccaggcuggagugcag

SEQ ID NO: 601616 - RNA, 22 nt, Human
ccaggcuggagugcaguggcau

SEQ ID NO: 601617 - RNA, 18 nt, Human
ccauugcacccagccugu

SEQ ID NO: 601618 - RNA, 24 nt, Human
cccaaguaucugggacuacaggca

SEQ ID NO: 601619 - RNA, 20 nt, Human
cccaucccagcccacuccca

SEQ ID NO: 601620 - RNA, 19 nt, Human
ccccaccgcccgcuagccc

SEQ ID NO: 601621 - RNA, 19 nt, Human
cccccaccgcccgcuagcc

SEQ ID NO: 601622 - RNA, 22 nt, Human
cccccaccgcccgcuagcccgc

SEQ ID NO: 601623 - RNA, 25 nt, Human
ccgaagugcugggauuaacaggugu

SEQ ID NO: 601624 - RNA, 24 nt, Human
ccuccugggcucaagcgauucucc

SEQ ID NO: 601625 - RNA, 20 nt, Human
ccugggcucaagcgauucuc

SEQ ID NO: 601626 - RNA, 19 nt, Human
ccuugaccuccugggcuca

SEQ ID NO: 601627 - RNA, 25 nt, Human
cgaagugcugggauuaacaggugug

SEQ ID NO: 601628 - RNA, 21 nt, Human
cggagauaggguuucaccaug

SEQ ID NO: 601629 - RNA, 25 nt, Human
cucaagcgauucucccaucccagcc

SEQ ID NO: 601630 - RNA, 24 nt, Human
cucacuguacccuugaccuccugg

SEQ ID NO: 601631 - RNA, 21 nt, Human
cuccugggcucaagcgauucu

SEQ ID NO: 601632 - RNA, 25 nt, Human
cuccugggcucaagcgauucuccca

SEQ ID NO: 601633 - RNA, 23 nt, Human
cucuguugcccaggccaggcugg

SEQ ID NO: 601634 - RNA, 21 nt, Human
cugcuggcgcccccaccgccc

SEQ ID NO: 601635 - RNA, 21 nt, Human
cuguugcccaggccaggcugg

SEQ ID NO: 601636 - RNA, 22 nt, Human
gaagcuguuuguauauuuucag

SEQ ID NO: 601637 - RNA, 24 nt, Human
gaagugcugggauuaacaggugug

SEQ ID NO: 601638 - RNA, 25 nt, Human
gaagugcugggauuaacagguguga

SEQ ID NO: 601639 - RNA, 20 nt, Human
gagacagggucuugcucugu

SEQ ID NO: 601640 - RNA, 20 nt, Human
gauuugagggggagaugaau

SEQ ID NO: 601641 - RNA, 20 nt, Human
gcaucucagaaaguggaccc

SEQ ID NO: 601642 - RNA, 20 nt, Human
gcucaagcgauucucccauc

SEQ ID NO: 601643 - RNA, 19 nt, Human
gcuggagugcaguggcaug

SEQ ID NO: 601644 - RNA, 18 nt, Human
gcuggcgcccccaccgcc

SEQ ID NO: 601645 - RNA, 19 nt, Human
ggacuacaggcaugugcca

SEQ ID NO: 601646 - RNA, 21 nt, Human
ggguuucaccauguugcccag

SEQ ID NO: 601647 - RNA, 22 nt, Human
ggguuucaccauguugcccagg

SEQ ID NO: 601648 - RNA, 22 nt, Human
guacccuugaccuccugggcuc

SEQ ID NO: 601649 - RNA, 21 nt, Human
gugugugugugugugugaagc

SEQ ID NO: 601650 - RNA, 21 nt, Human
gugugugugugugugugugug

SEQ ID NO: 601651 - RNA, 21 nt, Human
gugugugugugugugugugug

SEQ ID NO: 601652 - RNA, 23 nt, Human
uaacaggugugagccauugcacu

SEQ ID NO: 601653 - RNA, 19 nt, Human
uaaguauaaacucuauucc

SEQ ID NO: 601654 - RNA, 19 nt, Human
uaccgcagccauugaugau

SEQ ID NO: 601655 - RNA, 21 nt, Human
uacuuuggagauucauuuucu

SEQ ID NO: 601656 - RNA, 24 nt, Human
uaggguuucaccauguugcccagg

SEQ ID NO: 601657 - RNA, 22 nt, Human
uauuuuaucuucugaugcuuuc

SEQ ID NO: 601658 - RNA, 18 nt, Human
ucaaauaaacucacacag

SEQ ID NO: 601659 - RNA, 19 nt, Human
ucaaauaaacucacacaga

SEQ ID NO: 601660 - RNA, 21 nt, Human
ucaccauguugcccaggcugg

SEQ ID NO: 601661 - RNA, 24 nt, Human
ucacggagauaggguuucaccaug

SEQ ID NO: 601662 - RNA, 23 nt, Human
ucacuguacccuugaccuccugg

SEQ ID NO: 601663 - RNA, 24 nt, Human
ucacuguacccuugaccuccuggg

SEQ ID NO: 601664 - RNA, 25 nt, Human
ucacuuccguucaugaaggcuugcu

SEQ ID NO: 601665 - RNA, 22 nt, Human
ucagaaaguggacccagaaauc

SEQ ID NO: 601666 - RNA, 24 nt, Human
ucccaaguaucugggacuacaggc

SEQ ID NO: 601667 - RNA, 18 nt, Human
ucccgaagugcugggauu

SEQ ID NO: 601668 - RNA, 19 nt, Human
ucccgaagugcugggauua

SEQ ID NO: 601669 - RNA, 24 nt, Human
ucccgaagugcugggauuaacagg

SEQ ID NO: 601670 - RNA, 22 nt, Human
uccuacuaggcuaccgcagcca

SEQ ID NO: 601671 - RNA, 21 nt, Human
uccugggcucaagcgauucuc

SEQ ID NO: 601672 - RNA, 23 nt, Human
uccugggcucaagcgauucuccc

SEQ ID NO: 601673 - RNA, 21 nt, Human
ucucgaacucuugggcccaag

SEQ ID NO: 601674 - RNA, 21 nt, Human
ucugccauuaguauuuauucu

SEQ ID NO: 601675 - RNA, 21 nt, Human
ucugggacuacaggcaugugc

SEQ ID NO: 601676 - RNA, 29 nt, Human
ucuguugcccaggccaggcuggagugcag

SEQ ID NO: 601677 - RNA, 19 nt, Human
ucuugcucuguugcccagg

SEQ ID NO: 601678 - RNA, 23 nt, Human
ucuugcucuguugcccaggccag

SEQ ID NO: 601679 - RNA, 24 nt, Human
ucuugcucuguugcccaggccagg

SEQ ID NO: 601680 - RNA, 27 nt, Human
ucuugcucuguugcccaggccaggcug

SEQ ID NO: 601681 - RNA, 18 nt, Human
ugaaaugcaacaaacagu

SEQ ID NO: 601682 - RNA, 22 nt, Human
ugagacagggucuugcucuguu

SEQ ID NO: 601683 - RNA, 22 nt, Human
ugcaacaaacaguuauugagca

SEQ ID NO: 601684 - RNA, 20 nt, Human
ugcaguggcaugaccucggc

SEQ ID NO: 601685 - RNA, 24 nt, Human
ugcccaggcuggucucgaacucuu

SEQ ID NO: 601686 - RNA, 26 nt, Human
ugcucuguugcccaggccaggcugga

SEQ ID NO: 601687 - RNA, 22 nt, Human
uggaauggagaguuucaaacag

SEQ ID NO: 601688 - RNA, 23 nt, Human
uggagugcaguggcaugaccucg

SEQ ID NO: 601689 - RNA, 24 nt, Human
uggagugcaguggcaugaccucgg

SEQ ID NO: 601690 - RNA, 18 nt, Human
ugggacuacaggcaugug

SEQ ID NO: 601691 - RNA, 21 nt, Human
ugggacuacaggcaugugcca

SEQ ID NO: 601692 - RNA, 22 nt, Human
ugggacuacaggcaugugccac

SEQ ID NO: 601693 - RNA, 24 nt, Human
ugggacuacaggcaugugccacca

SEQ ID NO: 601694 - RNA, 20 nt, Human
ugggauuaacaggugugagc

SEQ ID NO: 601695 - RNA, 22 nt, Human
ugggauuaacaggugugagcca

SEQ ID NO: 601696 - RNA, 23 nt, Human
ugggauuaacaggugugagccau

SEQ ID NO: 601697 - RNA, 25 nt, Human
ugggauuaacaggugugagccauug

SEQ ID NO: 601698 - RNA, 23 nt, Human
ugggcuccagacuucacuguccu

SEQ ID NO: 601699 - RNA, 20 nt, Human
ugguuuuagaaagcaucuca

SEQ ID NO: 601700 - RNA, 24 nt, Human
ugugccaccacucuuggcuaauuu

SEQ ID NO: 601701 - RNA, 22 nt, Human
ugugugugugugugugaagcug

SEQ ID NO: 601702 - RNA, 18 nt, Human
ugugugugugugugugug

SEQ ID NO: 601703 - RNA, 18 nt, Human
ugugugugugugugugug

SEQ ID NO: 601704 - RNA, 18 nt, Human
ugugugugugugugugug

SEQ ID NO: 601705 - RNA, 18 nt, Human
ugugugugugugugugug

SEQ ID NO: 601706 - RNA, 18 nt, Human
ugugugugugugugugug

SEQ ID NO: 601707 - RNA, 18 nt, Human
ugugugugugugugugug

SEQ ID NO: 601708 - RNA, 18 nt, Human
ugugugugugugugugug

SEQ ID NO: 601709 - RNA, 18 nt, Human
ugugugugugugugugug

SEQ ID NO: 601710 - RNA, 18 nt, Human
ugugugugugugugugug

SEQ ID NO: 601711 - RNA, 18 nt, Human
ugugugugugugugugug

SEQ ID NO: 601712 - RNA, 18 nt, Human
ugugugugugugugugug

SEQ ID NO: 601713 - RNA, 21 nt, Human
ugugugugugugugugugugu

SEQ ID NO: 601714 - RNA, 21 nt, Human
ugugugugugugugugugugu

SEQ ID NO: 601715 - RNA, 21 nt, Human
ugugugugugugugugugugu

SEQ ID NO: 601716 - RNA, 21 nt, Human
ugugugugugugugugugugu

SEQ ID NO: 601717 - RNA, 21 nt, Human
ugugugugugugugugugugu

SEQ ID NO: 601718 - RNA, 21 nt, Human
ugugugugugugugugugugu

SEQ ID NO: 601719 - RNA, 21 nt, Human
ugugugugugugugugugugu

SEQ ID NO: 601720 - RNA, 21 nt, Human
ugugugugugugugugugugu

SEQ ID NO: 601721 - RNA, 21 nt, Human
ugugugugugugugugugugu

SEQ ID NO: 601722 - RNA, 21 nt, Human
ugugugugugugugugugugu

SEQ ID NO: 601723 - RNA, 21 nt, Human
ugugugugugugugugugugu

SEQ ID NO: 601724 - RNA, 21 nt, Human
ugugugugugugugugugugu

SEQ ID NO: 601725 - RNA, 21 nt, Human
ugugugugugugugugugugu

SEQ ID NO: 601726 - RNA, 21 nt, Human
ugugugugugugugugugugu

SEQ ID NO: 601727 - RNA, 21 nt, Human
ugugugugugugugugugugu

SEQ ID NO: 601728 - RNA, 21 nt, Human
ugugugugugugugugugugu

SEQ ID NO: 601729 - RNA, 21 nt, Human
ugugugugugugugugugugu

SEQ ID NO: 601730 - RNA, 21 nt, Human
ugugugugugugugugugugu

SEQ ID NO: 601731 - RNA, 21 nt, Human
ugugugugugugugugugugu

SEQ ID NO: 601732 - RNA, 22 nt, Human
ugugugugugugugugugugug

SEQ ID NO: 601733 - RNA, 22 nt, Human
ugugugugugugugugugugug

SEQ ID NO: 601734 - RNA, 22 nt, Human
ugugugugugugugugugugug

SEQ ID NO: 601735 - RNA, 22 nt, Human
ugugugugugugugugugugug

SEQ ID NO: 601736 - RNA, 22 nt, Human
ugugugugugugugugugugug

SEQ ID NO: 601737 - RNA, 22 nt, Human
ugugugugugugugugugugug

SEQ ID NO: 601738 - RNA, 22 nt, Human
ugugugugugugugugugugug

SEQ ID NO: 601739 - RNA, 23 nt, Human
uguugcccaggccaggcuggagu

SEQ ID NO: 601740 - RNA, 18 nt, Human
uucaaaggauguaaaaaa

SEQ ID NO: 601741 - RNA, 26 nt, Human
uuccuuugugugugugugugugugug

SEQ ID NO: 601742 - RNA, 19 nt, Human
uucuuugaagauacuuugg

SEQ ID NO: 601743 - RNA, 18 nt, Human
uuggccucccgaagugcu

SEQ ID NO: 601744 - RNA, 21 nt, Human
uugguuuuagaaagcaucuca

SEQ ID NO: 601745 - RNA, 22 nt, Human
uuucaccauguugcccaggcug

SEQ ID NO: 601746 - RNA, 24 nt, Human
uuucaccauguugcccaggcuggu

SEQ ID NO: 601747 - RNA, 24 nt, Human
uuugugugugugugugugugugug

SEQ ID NO: 601748 - RNA, 23 nt, Human
uuuugaagcacucccuucaaagg

SEQ ID NO: 601749 - RNA, 23 nt, Human
acucccaaaggauguuuucagaa

SEQ ID NO: 601750 - RNA, 19 nt, Human
auugaaucaguauuuugcu

SEQ ID NO: 601751 - RNA, 22 nt, Human
caucacacacccacuuuuucca

SEQ ID NO: 601752 - RNA, 21 nt, Human
ccacgacauucgucuuguuuu

SEQ ID NO: 601753 - RNA, 20 nt, Human
cucauguaacucuuccucac

SEQ ID NO: 601754 - RNA, 20 nt, Human
gaauugaggcagagagaaau

SEQ ID NO: 601755 - RNA, 20 nt, Human
gauacaucacacacccacuu

SEQ ID NO: 601756 - RNA, 18 nt, Human
ucucugcagaauuuguca

SEQ ID NO: 601757 - RNA, 19 nt, Human
ucuucagacacuggggcuc

SEQ ID NO: 601758 - RNA, 29 nt, Human
ugacuuugguuuuuaaaacuaaugaguuu

SEQ ID NO: 601759 - RNA, 24 nt, Human
ugaggcagagagaaaugaaguccu

SEQ ID NO: 601760 - RNA, 27 nt, Human
ugauauguuuaucauaauugauuugaa

SEQ ID NO: 601761 - RNA, 22 nt, Human
uucucauguaacucuuccucac

SEQ ID NO: 601762 - RNA, 19 nt, Human
uucuuugcccuuuacaguu

SEQ ID NO: 601763 - RNA, 26 nt, Human
uuugaaauacucccaaaggauguuuu

SEQ ID NO: 601764 - RNA, 21 nt, Human
aaaacaagaaaaaaaaaaagc

SEQ ID NO: 601765 - RNA, 23 nt, Human
aaacaagaaaaaaaaaaagccca

SEQ ID NO: 601766 - RNA, 18 nt, Human
aaaccagaagaccgagug

SEQ ID NO: 601767 - RNA, 21 nt, Human
aacaaaagguaaauuucaagg

SEQ ID NO: 601768 - RNA, 22 nt, Human
aacaucuauccauucuuguuuc

SEQ ID NO: 601769 - RNA, 23 nt, Human
aagucaauuugcuucuaaaccag

SEQ ID NO: 601770 - RNA, 27 nt, Human
aauaaaaacaagaaaaaaaaaaagccc

SEQ ID NO: 601771 - RNA, 18 nt, Human
aauggcaaagcauaauua

SEQ ID NO: 601772 - RNA, 21 nt, Human
accagaagaccgagugugucu

SEQ ID NO: 601773 - RNA, 22 nt, Human
agaagaaaguccagacuucuaa

SEQ ID NO: 601774 - RNA, 19 nt, Human
agacuucuaacauauucac

SEQ ID NO: 601775 - RNA, 18 nt, Human
aggaagcaggaagacuuu

SEQ ID NO: 601776 - RNA, 22 nt, Human
aggagcuuucaaccugaaauac

SEQ ID NO: 601777 - RNA, 18 nt, Human
auuacguguauggcauca

SEQ ID NO: 601778 - RNA, 26 nt, Human
auuccccuuauguuuaaccucuuuca

SEQ ID NO: 601779 - RNA, 25 nt, Human
caaaacccagcaguaauaggagcuu

SEQ ID NO: 601780 - RNA, 21 nt, Human
caagccaacccagaagguacc

SEQ ID NO: 601781 - RNA, 19 nt, Human
cauucuuguuucgguggaa

SEQ ID NO: 601782 - RNA, 23 nt, Human
ccaaauaaaaacaagaaaaaaaa

SEQ ID NO: 601783 - RNA, 26 nt, Human
ccaaauaaaaacaagaaaaaaaaaaa

SEQ ID NO: 601784 - RNA, 18 nt, Human
ccaacccagaagguaccu

SEQ ID NO: 601785 - RNA, 25 nt, Human
ccagcaguaauaggagcuuucaacc

SEQ ID NO: 601786 - RNA, 23 nt, Human
cccacauucaagaagcaagagag

SEQ ID NO: 601787 - RNA, 22 nt, Human
cccagcaguaauaggagcuuuc

SEQ ID NO: 601788 - RNA, 19 nt, Human
cccauaaacaccuuccuuu

SEQ ID NO: 601789 - RNA, 21 nt, Human
cccauaaacaccuuccuuugg

SEQ ID NO: 601790 - RNA, 21 nt, Human
cccccacauucaagaagcaag

SEQ ID NO: 601791 - RNA, 22 nt, Human
cccccacauucaagaagcaaga

SEQ ID NO: 601792 - RNA, 24 nt, Human
ccuccaaaacccagcaguaauagg

SEQ ID NO: 601793 - RNA, 24 nt, Human
cuugaaacccuauaugacuccagg

SEQ ID NO: 601794 - RNA, 20 nt, Human
gaacgaaauagcaggagugu

SEQ ID NO: 601795 - RNA, 19 nt, Human
gacccaagccaacccagaa

SEQ ID NO: 601796 - RNA, 18 nt, Human
gauuugggugccuuccuu

SEQ ID NO: 601797 - RNA, 23 nt, Human
gcaagugaauggaucauauuugc

SEQ ID NO: 601798 - RNA, 25 nt, Human
gggcaagugaauggaucauauuugc

SEQ ID NO: 601799 - RNA, 19 nt, Human
gucaauuugcuucuaaacc

SEQ ID NO: 601800 - RNA, 18 nt, Human
uaacaaaagguaaauuuc

SEQ ID NO: 601801 - RNA, 20 nt, Human
uaacccuccuaauggagaag

SEQ ID NO: 601802 - RNA, 20 nt, Human
uccauucuuguuucggugga

SEQ ID NO: 601803 - RNA, 21 nt, Human
ucccaaauaaaaacaagaaaa

SEQ ID NO: 601804 - RNA, 19 nt, Human
uccccccauaaacaccuuc

SEQ ID NO: 601805 - RNA, 21 nt, Human
ucuaaaccagaagaccgagug

SEQ ID NO: 601806 - RNA, 19 nt, Human
ucuaacauauucacucaca

SEQ ID NO: 601807 - RNA, 20 nt, Human
ugauuuauagacuauccgua

SEQ ID NO: 601808 - RNA, 21 nt, Human
ugccacaggauaaaguaacaa

SEQ ID NO: 601809 - RNA, 26 nt, Human
ugggugccuuccuuuuuuaagguuuu

SEQ ID NO: 601810 - RNA, 26 nt, Human
ugucccaaauaaaaacaagaaaaaaa

SEQ ID NO: 601811 - RNA, 21 nt, Human
uuccaugaucucuuccugcag

SEQ ID NO: 601812 - RNA, 24 nt, Human
uuccaugaucucuuccugcagguu

SEQ ID NO: 601813 - RNA, 19 nt, Human
uuccuuugggagauuuggg

SEQ ID NO: 601814 - RNA, 18 nt, Human
uugggagauuugggugcc

SEQ ID NO: 601815 - RNA, 19 nt, Human
uuuacgaaaaucuucagcc

SEQ ID NO: 601816 - RNA, 20 nt, Human
uuuacgaaaaucuucagcca

SEQ ID NO: 601817 - RNA, 25 nt, Human
uuugcuagaagucccuuucccccca

SEQ ID NO: 601818 - RNA, 21 nt, Human
uuuuuaagguuuuaaaaacua

SEQ ID NO: 601819 - RNA, 20 nt, Human
aaacaaaccagugcagagaa

SEQ ID NO: 601820 - RNA, 21 nt, Human
aacuuauugcuggaagaaguc

SEQ ID NO: 601821 - RNA, 23 nt, Human
aaucuuucuguaguuguugauuu

SEQ ID NO: 601822 - RNA, 19 nt, Human
auaauucuccuggaggucu

SEQ ID NO: 601823 - RNA, 25 nt, Human
auacuagagucacuuaaucuguaca

SEQ ID NO: 601824 - RNA, 21 nt, Human
caagcgcucuagaaugugaug

SEQ ID NO: 601825 - RNA, 19 nt, Human
ccaagauagugauuuuuuu

SEQ ID NO: 601826 - RNA, 23 nt, Human
cuagcaaagugguuuauucuuuc

SEQ ID NO: 601827 - RNA, 18 nt, Human
cugucuuuucacucucuc

SEQ ID NO: 601828 - RNA, 18 nt, Human
cuuucuguaguuguugau

SEQ ID NO: 601829 - RNA, 20 nt, Human
gaaugugaugagaccucagu

SEQ ID NO: 601830 - RNA, 18 nt, Human
uaaguaguuaaucuaugg

SEQ ID NO: 601831 - RNA, 18 nt, Human
ucaguuccuccucuucca

SEQ ID NO: 601832 - RNA, 19 nt, Human
ucuguacaagaauaccugu

SEQ ID NO: 601833 - RNA, 22 nt, Human
ucuguacaagaauaccugugau

SEQ ID NO: 601834 - RNA, 19 nt, Human
uguaaguaguuaaucuaug

SEQ ID NO: 601835 - RNA, 18 nt, Human
uuccaagauagugauuuu

SEQ ID NO: 601836 - RNA, 19 nt, Human
aaagugcugggauuucagg

SEQ ID NO: 601837 - RNA, 24 nt, Human
aaagugcugggauuucagguguga

SEQ ID NO: 601838 - RNA, 22 nt, Human
aagacagcagcagccacaagcg

SEQ ID NO: 601839 - RNA, 18 nt, Human
aagugcugggauuucagg

SEQ ID NO: 601840 - RNA, 20 nt, Human
aaugaucuuccugccucggc

SEQ ID NO: 601841 - RNA, 23 nt, Human
acaggaguuaagacagcagcagc

SEQ ID NO: 601842 - RNA, 18 nt, Human
acucugugacccaggaug

SEQ ID NO: 601843 - RNA, 23 nt, Human
agccacaagcgcacuuuuaaaca

SEQ ID NO: 601844 - RNA, 18 nt, Human
aguagcugggauuacagg

SEQ ID NO: 601845 - RNA, 24 nt, Human
auagcucacugcaaccuugauuuc

SEQ ID NO: 601846 - RNA, 18 nt, Human
aucauagcucacugcaac

SEQ ID NO: 601847 - RNA, 24 nt, Human
caaagugcugggauuucaggugug

SEQ ID NO: 601848 - RNA, 23 nt, Human
caaccuugauuucccaagcucaa

SEQ ID NO: 601849 - RNA, 22 nt, Human
caaguaaucguccugccucagc

SEQ ID NO: 601850 - RNA, 21 nt, Human
caccaccaggccugacucuuu

SEQ ID NO: 601851 - RNA, 20 nt, Human
cagcagcagccacaagcgca

SEQ ID NO: 601852 - RNA, 23 nt, Human
cagccaguggcugugaugcagcc

SEQ ID NO: 601853 - RNA, 23 nt, Human
cauguuguccagacugguuucaa

SEQ ID NO: 601854 - RNA, 24 nt, Human
cauguuguccagacugguuucaaa

SEQ ID NO: 601855 - RNA, 21 nt, Human
ccaaagugcugggauuucagg

SEQ ID NO: 601856 - RNA, 24 nt, Human
ccaaagugcugggauuucaggugu

SEQ ID NO: 601857 - RNA, 18 nt, Human
ccacaagcgcacuuuuaa

SEQ ID NO: 601858 - RNA, 23 nt, Human
ccacaagcgcacuuuuaaacacg

SEQ ID NO: 601859 - RNA, 23 nt, Human
ccaguggcugugaugcagccaaa

SEQ ID NO: 601860 - RNA, 23 nt, Human
ccauccccggaccuuuucuuuuc

SEQ ID NO: 601861 - RNA, 19 nt, Human
cccaggauggaguguggcc

SEQ ID NO: 601862 - RNA, 23 nt, Human
cccgaguagcugggauuacaggc

SEQ ID NO: 601863 - RNA, 24 nt, Human
cccgaguagcugggauuacaggcg

SEQ ID NO: 601864 - RNA, 22 nt, Human
ccgaguagcugggauuacaggc

SEQ ID NO: 601865 - RNA, 22 nt, Human
ccgguagagauggggucucccc

SEQ ID NO: 601866 - RNA, 23 nt, Human
ccugccucagccucccgaguagc

SEQ ID NO: 601867 - RNA, 24 nt, Human
ccugccucagccucccgaguagcu

SEQ ID NO: 601868 - RNA, 24 nt, Human
ccugccucggccucccaaagugcu

SEQ ID NO: 601869 - RNA, 24 nt, Human
cgguagagauggggucuccccaug

SEQ ID NO: 601870 - RNA, 24 nt, Human
cguccugccucagccucccgagua

SEQ ID NO: 601871 - RNA, 24 nt, Human
cucagccucccgaguagcugggau

SEQ ID NO: 601872 - RNA, 21 nt, Human
cucugugacccaggauggagu

SEQ ID NO: 601873 - RNA, 26 nt, Human
cucuuuuuuuuuuccuccgguagaga

SEQ ID NO: 601874 - RNA, 23 nt, Human
cugcaaccuugauuucccaagcu

SEQ ID NO: 601875 - RNA, 22 nt, Human
cugggauuucaggugugagcca

SEQ ID NO: 601876 - RNA, 23 nt, Human
gagauggggucuccccauguugu

SEQ ID NO: 601877 - RNA, 25 nt, Human
gaguagcugggauuacaggcgcaca

SEQ ID NO: 601878 - RNA, 18 nt, Human
gauuucaggugugagcca

SEQ ID NO: 601879 - RNA, 21 nt, Human
gauuucaggugugagccacca

SEQ ID NO: 601880 - RNA, 19 nt, Human
gcucaaguaaucguccugc

SEQ ID NO: 601881 - RNA, 24 nt, Human
guaaucguccugccucagccuccc

SEQ ID NO: 601882 - RNA, 18 nt, Human
gugcugggauuucaggug

SEQ ID NO: 601883 - RNA, 22 nt, Human
uaagacagcagcagccacaagc

SEQ ID NO: 601884 - RNA, 21 nt, Human
uaccugugcuaaagcaaggcu

SEQ ID NO: 601885 - RNA, 21 nt, Human
uacuuuuuugagacaaggucu

SEQ ID NO: 601886 - RNA, 20 nt, Human
uagcucacugcaaccuugau

SEQ ID NO: 601887 - RNA, 24 nt, Human
uagcucacugcaaccuugauuucc

SEQ ID NO: 601888 - RNA, 27 nt, Human
ucaaugaucuuccugccucggccuccc

SEQ ID NO: 601889 - RNA, 24 nt, Human
ucacugcaaccuugauuucccaag

SEQ ID NO: 601890 - RNA, 28 nt, Human
ucacugcaaccuugauuucgggcccucc

SEQ ID NO: 601891 - RNA, 28 nt, Human
ucacugcaaccuugauuucggguccucc

SEQ ID NO: 601892 - RNA, 20 nt, Human
ucagccucccgaguagcugg

SEQ ID NO: 601893 - RNA, 23 nt, Human
ucccaaagugcugggauuucagg

SEQ ID NO: 601894 - RNA, 24 nt, Human
ucccgaguagcugggauuacaggc

SEQ ID NO: 601895 - RNA, 18 nt, Human
ucggccucccaaagugcu

SEQ ID NO: 601896 - RNA, 20 nt, Human
ucucacucugugacccagga

SEQ ID NO: 601897 - RNA, 24 nt, Human
ucucacucugugacccaggaugga

SEQ ID NO: 601898 - RNA, 27 nt, Human
ugacucuuuuuuuuuuccuccgguaga

SEQ ID NO: 601899 - RNA, 24 nt, Human
ugccucagccucccgaguagcugg

SEQ ID NO: 601900 - RNA, 21 nt, Human
ugccucggccucccaaagugc

SEQ ID NO: 601901 - RNA, 24 nt, Human
ugccucggccucccaaagugcugg

SEQ ID NO: 601902 - RNA, 20 nt, Human
uggcuucuggcuucauaccu

SEQ ID NO: 601903 - RNA, 21 nt, Human
ugggauuacaggcgcacacca

SEQ ID NO: 601904 - RNA, 22 nt, Human
ugggauuacaggcgcacaccac

SEQ ID NO: 601905 - RNA, 24 nt, Human
ugggauuacaggcgcacaccacca

SEQ ID NO: 601906 - RNA, 18 nt, Human
ugggauuucaggugugag

SEQ ID NO: 601907 - RNA, 24 nt, Human
ugggauuucaggugugagccacca

SEQ ID NO: 601908 - RNA, 18 nt, Human
uguccgccaagcacagga

SEQ ID NO: 601909 - RNA, 21 nt, Human
uguuacuuuuuugagacaagg

SEQ ID NO: 601910 - RNA, 19 nt, Human
uucaggugugagccaccau

SEQ ID NO: 601911 - RNA, 22 nt, Human
uuucaaacuccugagcucaaug

SEQ ID NO: 601912 - RNA, 23 nt, Human
uuuuuuuuuuccuccgguagaga

SEQ ID NO: 601913 - RNA, 22 nt, Human
aaaaaaaaaaaaaaaaacaaag

SEQ ID NO: 601914 - RNA, 26 nt, Human
aaaaaaaaaaaaaaaaacaaaguguu

SEQ ID NO: 601915 - RNA, 23 nt, Human
aaaaaaaaaaaaaacaaaguguu

SEQ ID NO: 601916 - RNA, 21 nt, Human
aaaacccuucauccuuugagg

SEQ ID NO: 601917 - RNA, 22 nt, Human
aaguuucugguaagaacaguuc

SEQ ID NO: 601918 - RNA, 25 nt, Human
acagagcaaggaagucugcugaaac

SEQ ID NO: 601919 - RNA, 27 nt, Human
acaguguuggagaggauuuuucagcac

SEQ ID NO: 601920 - RNA, 23 nt, Human
accacagucgcguuucuccgauc

SEQ ID NO: 601921 - RNA, 21 nt, Human
acccaucuucugcuucagcca

SEQ ID NO: 601922 - RNA, 19 nt, Human
acccugcuauucccagccc

SEQ ID NO: 601923 - RNA, 22 nt, Human
acucuuugugaucauuccuccu

SEQ ID NO: 601924 - RNA, 24 nt, Human
agagggggaaaacacaccacuuuu

SEQ ID NO: 601925 - RNA, 19 nt, Human
agagguggggugucaggag

SEQ ID NO: 601926 - RNA, 20 nt, Human
agauccucagaaaucaagag

SEQ ID NO: 601927 - RNA, 21 nt, Human
agcagagaaguuucugguaag

SEQ ID NO: 601928 - RNA, 21 nt, Human
aggugcuuggcugaaucaacg

SEQ ID NO: 601929 - RNA, 23 nt, Human
aucuccauccacaguguuggaga

SEQ ID NO: 601930 - RNA, 21 nt, Human
caaaaaggagcaauccuccug

SEQ ID NO: 601931 - RNA, 26 nt, Human
cacagagcaaggaagucugcugaaac

SEQ ID NO: 601932 - RNA, 24 nt, Human
cagccaguagagguucuaaaacuu

SEQ ID NO: 601933 - RNA, 22 nt, Human
cagccgcuacauaucucuccca

SEQ ID NO: 601934 - RNA, 23 nt, Human
cagggucagccgcuacauaucuc

SEQ ID NO: 601935 - RNA, 22 nt, Human
cauccagaggggaccuccugga

SEQ ID NO: 601936 - RNA, 22 nt, Human
caugcuauuugaaucagaauca

SEQ ID NO: 601937 - RNA, 20 nt, Human
cauggaucaugcuauuugaa

SEQ ID NO: 601938 - RNA, 18 nt, Human
caugucaaccuuuuugca

SEQ ID NO: 601939 - RNA, 25 nt, Human
ccaauuaaaaaaaaaaaaaaaaaaa

SEQ ID NO: 601940 - RNA, 27 nt, Human
ccaauuaaaaaaaaaaaaaaaaaaaca

SEQ ID NO: 601941 - RNA, 29 nt, Human
ccacucuccuucuucucuucuggggagaa

SEQ ID NO: 601942 - RNA, 20 nt, Human
ccagugguuuccgggguccu

SEQ ID NO: 601943 - RNA, 22 nt, Human
ccgcuacauaucucucccaacc

SEQ ID NO: 601944 - RNA, 18 nt, Human
ccugcagacgcucuccuu

SEQ ID NO: 601945 - RNA, 23 nt, Human
ccugcagacgcucuccuuuccag

SEQ ID NO: 601946 - RNA, 23 nt, Human
cuaguucacugacacaucuccca

SEQ ID NO: 601947 - RNA, 21 nt, Human
cuccauacauuuggccaaaaa

SEQ ID NO: 601948 - RNA, 24 nt, Human
cucugugaccuucuuuaacuggcu

SEQ ID NO: 601949 - RNA, 20 nt, Human
cugagauccucagaaaucaa

SEQ ID NO: 601950 - RNA, 21 nt, Human
cugguaagaacaguucaucuc

SEQ ID NO: 601951 - RNA, 21 nt, Human
cuucagggguugcccaccucu

SEQ ID NO: 601952 - RNA, 18 nt, Human
cuugucuccaaagagggg

SEQ ID NO: 601953 - RNA, 24 nt, Human
cuuugaaauccaauuaaaaaaaaa

SEQ ID NO: 601954 - RNA, 20 nt, Human
cuuuuugcaguuucacaaac

SEQ ID NO: 601955 - RNA, 21 nt, Human
gaaaacacaccacuuuuauuu

SEQ ID NO: 601956 - RNA, 24 nt, Human
gcccacugucccugcagacgcucu

SEQ ID NO: 601957 - RNA, 19 nt, Human
ggagagguggggugucagg

SEQ ID NO: 601958 - RNA, 19 nt, Human
gugucaggagcagagaagu

SEQ ID NO: 601959 - RNA, 18 nt, Human
uccaaagagggggaaaac

SEQ ID NO: 601960 - RNA, 22 nt, Human
uccaggcggccuccagugguuu

SEQ ID NO: 601961 - RNA, 22 nt, Human
uccauccacaguguuggagagg

SEQ ID NO: 601962 - RNA, 23 nt, Human
ucccauccuaacuuuggcuuuaa

SEQ ID NO: 601963 - RNA, 19 nt, Human
ucccugcagacgcucuccu

SEQ ID NO: 601964 - RNA, 18 nt, Human
uccuggcuagaaaagggg

SEQ ID NO: 601965 - RNA, 20 nt, Human
ucuuuccuuuugcaaaggaa

SEQ ID NO: 601966 - RNA, 18 nt, Human
ucuuugugaucauuccuc

SEQ ID NO: 601967 - RNA, 24 nt, Human
ugaaacuucugagauccucagaaa

SEQ ID NO: 601968 - RNA, 21 nt, Human
ugcaguuucacaaacagguua

SEQ ID NO: 601969 - RNA, 19 nt, Human
ugcuugguaacagacacau

SEQ ID NO: 601970 - RNA, 20 nt, Human
uggcaucagccaguagaggu

SEQ ID NO: 601971 - RNA, 24 nt, Human
ugucaggagcagagaaguuucugg

SEQ ID NO: 601972 - RNA, 20 nt, Human
ugugaucauuccuccucugu

SEQ ID NO: 601973 - RNA, 20 nt, Human
ugugaucauuccuccucugu

SEQ ID NO: 601974 - RNA, 22 nt, Human
uucacugacacaucucccauaa

SEQ ID NO: 601975 - RNA, 19 nt, Human
uucccagcccucaugcuau

SEQ ID NO: 601976 - RNA, 19 nt, Human
uuuuucagcaccauuccga

SEQ ID NO: 601977 - RNA, 20 nt, Human
aaagaagaaggggcugagag

SEQ ID NO: 601978 - RNA, 20 nt, Human
aagaaggggcugagagccac

SEQ ID NO: 601979 - RNA, 20 nt, Human
aaguuaacaguguugacuau

SEQ ID NO: 601980 - RNA, 25 nt, Human
accaagccugucaagccagguuggg

SEQ ID NO: 601981 - RNA, 19 nt, Human
agaagaaagcuggcuuaca

SEQ ID NO: 601982 - RNA, 22 nt, Human
aggaaagaagaaggggcugaga

SEQ ID NO: 601983 - RNA, 20 nt, Human
aggcaggaaagaagaagggg

SEQ ID NO: 601984 - RNA, 24 nt, Human
aggcaggaaagaagaaggggcuga

SEQ ID NO: 601985 - RNA, 21 nt, Human
auagaagaaagcuggcuuaca

SEQ ID NO: 601986 - RNA, 18 nt, Human
auguaauaacagaucuuc

SEQ ID NO: 601987 - RNA, 26 nt, Human
caauugccagucuugacuccuucuuu

SEQ ID NO: 601988 - RNA, 21 nt, Human
cguaccggaagugcuggugcc

SEQ ID NO: 601989 - RNA, 18 nt, Human
gaaggggcaacuccggaa

SEQ ID NO: 601990 - RNA, 18 nt, Human
gaccaagccugucaagcc

SEQ ID NO: 601991 - RNA, 19 nt, Human
gcaacuccggaaacagcag

SEQ ID NO: 601992 - RNA, 23 nt, Human
gcaacuccggaaacagcagcugc

SEQ ID NO: 601993 - RNA, 21 nt, Human
gcagcagcgaguuuuccguac

SEQ ID NO: 601994 - RNA, 22 nt, Human
ggaaagaagaaggggcugagag

SEQ ID NO: 601995 - RNA, 22 nt, Human
gguaaaauaggauaaucuuuaa

SEQ ID NO: 601996 - RNA, 22 nt, Human
guaauggucucuuagaguuucu

SEQ ID NO: 601997 - RNA, 18 nt, Human
uaaagaaaaagguguuua

SEQ ID NO: 601998 - RNA, 19 nt, Human
uaaguaaaugaccaaguau

SEQ ID NO: 601999 - RNA, 18 nt, Human
uaaguaaauugucaaagg

SEQ ID NO: 602000 - RNA, 19 nt, Human
uagaaaaaugaacucuucu

SEQ ID NO: 602001 - RNA, 26 nt, Human
uaucagauucucuuuucugucaguuu

SEQ ID NO: 602002 - RNA, 26 nt, Human
ugaggcaggaaagaagaaggggcuga

SEQ ID NO: 602003 - RNA, 20 nt, Human
uguaauuugguaaguaaaug

SEQ ID NO: 602004 - RNA, 23 nt, Human
uguaauuugguaaguaaaugacc

SEQ ID NO: 602005 - RNA, 23 nt, Human
ugucaaaggauccagguugacaa

SEQ ID NO: 602006 - RNA, 21 nt, Human
uuaaacauaucauaaacacug

SEQ ID NO: 602007 - RNA, 20 nt, Human
uugcagagaccaagccuguc

SEQ ID NO: 602008 - RNA, 22 nt, Human
uuggggcagcagcgaguuuucc

SEQ ID NO: 602009 - RNA, 22 nt, Human
uuuguaauuugguaaguaaaug

SEQ ID NO: 602010 - RNA, 23 nt, Human
aaaaugauaaauaaaccgaggca

SEQ ID NO: 602011 - RNA, 19 nt, Human
aaagaaacaguccaggagg

SEQ ID NO: 602012 - RNA, 23 nt, Human
aaauccauuuuuggaggagccaa

SEQ ID NO: 602013 - RNA, 18 nt, Human
aaccaugaaacuguauuc

SEQ ID NO: 602014 - RNA, 21 nt, Human
acacugcuguguccugugaaa

SEQ ID NO: 602015 - RNA, 21 nt, Human
accagguacuaugucugcagg

SEQ ID NO: 602016 - RNA, 18 nt, Human
acuuaaaauuagagaggg

SEQ ID NO: 602017 - RNA, 27 nt, Human
agacgucaaggucacucuguuugaacc

SEQ ID NO: 602018 - RNA, 18 nt, Human
agagagggaaaccccaga

SEQ ID NO: 602019 - RNA, 22 nt, Human
agagauaaccucuuugaccuuc

SEQ ID NO: 602020 - RNA, 19 nt, Human
aggagccaaacaggcucaa

SEQ ID NO: 602021 - RNA, 21 nt, Human
auaaccucuuugaccuucagc

SEQ ID NO: 602022 - RNA, 18 nt, Human
auagcaauaaaaugaugu

SEQ ID NO: 602023 - RNA, 24 nt, Human
caaauccauuuuuggaggagccaa

SEQ ID NO: 602024 - RNA, 20 nt, Human
caggacuacuuguuuuccuu

SEQ ID NO: 602025 - RNA, 22 nt, Human
caggauucaguaaacaacaaua

SEQ ID NO: 602026 - RNA, 21 nt, Human
cagggcuuuugaaauuaaaga

SEQ ID NO: 602027 - RNA, 19 nt, Human
ccagaaugacaccagccac

SEQ ID NO: 602028 - RNA, 21 nt, Human
ccagucagacccagaaugaca

SEQ ID NO: 602029 - RNA, 22 nt, Human
ccccagagaccugaguggcacu

SEQ ID NO: 602030 - RNA, 24 nt, Human
ccucuuugaccuucagcaauuuua

SEQ ID NO: 602031 - RNA, 21 nt, Human
cugaguaucauaaaaaguaaa

SEQ ID NO: 602032 - RNA, 21 nt, Human
cuuucuagguuuugccgaaua

SEQ ID NO: 602033 - RNA, 21 nt, Human
gaaagaauuaaaaaccaugaa

SEQ ID NO: 602034 - RNA, 18 nt, Human
ggaggagccaaacaggcu

SEQ ID NO: 602035 - RNA, 21 nt, Human
gggaaaccccagagaccugag

SEQ ID NO: 602036 - RNA, 22 nt, Human
ggucacucuguuugaacccaaa

SEQ ID NO: 602037 - RNA, 26 nt, Human
gucaaggucacucuguuugaaccaag

SEQ ID NO: 602038 - RNA, 26 nt, Human
uaaaaaaaaaucugacauuucccuua

SEQ ID NO: 602039 - RNA, 22 nt, Human
uaaaauuagagagggaaacccc

SEQ ID NO: 602040 - RNA, 21 nt, Human
uacucauguucauguuaucac

SEQ ID NO: 602041 - RNA, 26 nt, Human
uagcaauaaaaugauguccguaaauc

SEQ ID NO: 602042 - RNA, 23 nt, Human
ucacgucuacaaauagcaauaaa

SEQ ID NO: 602043 - RNA, 24 nt, Human
ucagacccagaaugacaccagcca

SEQ ID NO: 602044 - RNA, 22 nt, Human
ucuacacugcuguguccuguga

SEQ ID NO: 602045 - RNA, 23 nt, Human
ugaauaggaacgccugaguggcc

SEQ ID NO: 602046 - RNA, 25 nt, Human
ugcccauccacugaaggcccacaua

SEQ ID NO: 602047 - RNA, 20 nt, Human
uggaggagccaaacaggcuc

SEQ ID NO: 602048 - RNA, 20 nt, Human
uggcaaacaggacuacuugu

SEQ ID NO: 602049 - RNA, 24 nt, Human
ugugaaaugaaccuaauuuuccga

SEQ ID NO: 602050 - RNA, 18 nt, Human
uuaaaaauuuuuccucau

SEQ ID NO: 602051 - RNA, 27 nt, Human
uuaaaaguucuucauccuaauuucuga

SEQ ID NO: 602052 - RNA, 18 nt, Human
uuaauuuacuugggguuu

SEQ ID NO: 602053 - RNA, 18 nt, Human
uucauuuuauuuuuccuu

SEQ ID NO: 602054 - RNA, 18 nt, Human
uuccuggaaaguccuguc

SEQ ID NO: 602055 - RNA, 22 nt, Human
uugaccuucagcaauuuuaaaa

SEQ ID NO: 602056 - RNA, 18 nt, Human
uuggaggagccaaacagg

SEQ ID NO: 602057 - RNA, 23 nt, Human
uuucacaccaggauucaguaaac

SEQ ID NO: 602058 - RNA, 20 nt, Human
aacuaccuucuaaggaaaac

SEQ ID NO: 602059 - RNA, 18 nt, Human
acccuuuuaaauguacuc

SEQ ID NO: 602060 - RNA, 19 nt, Human
accuacccuuggaaacagc

SEQ ID NO: 602061 - RNA, 23 nt, Human
acuuuauuagcuuagucuccacc

SEQ ID NO: 602062 - RNA, 19 nt, Human
ccaaccacaccgcagccgu

SEQ ID NO: 602063 - RNA, 20 nt, Human
gaagccguuaaauuugugcu

SEQ ID NO: 602064 - RNA, 18 nt, Human
uaaauaagaaugacauuu

SEQ ID NO: 602065 - RNA, 19 nt, Human
uaaauaagaaugacauuuu

SEQ ID NO: 602066 - RNA, 18 nt, Human
uuuacuguaguaaccuac

SEQ ID NO: 602067 - RNA, 22 nt, Human
aaaaaaacccauaaagcucaaa

SEQ ID NO: 602068 - RNA, 18 nt, Human
aaaaagcagcagacaccu

SEQ ID NO: 602069 - RNA, 18 nt, Human
aaaaccacaaccucccaa

SEQ ID NO: 602070 - RNA, 19 nt, Human
aaaccacaaccucccaaca

SEQ ID NO: 602071 - RNA, 22 nt, Human
aaacccaccacccacaccccag

SEQ ID NO: 602072 - RNA, 20 nt, Human
aaacucauaggggucguggg

SEQ ID NO: 602073 - RNA, 24 nt, Human
aacaacuucccaacacacaagcca

SEQ ID NO: 602074 - RNA, 24 nt, Human
aacaacuucccaacacaugagcca

SEQ ID NO: 602075 - RNA, 20 nt, Human
aacagaaucccucugcacag

SEQ ID NO: 602076 - RNA, 20 nt, Human
aacauuucuucucugcuuca

SEQ ID NO: 602077 - RNA, 23 nt, Human
aaccccccaacacgcaagccaca

SEQ ID NO: 602078 - RNA, 22 nt, Human
aacuccugcaggcucagcgcac

SEQ ID NO: 602079 - RNA, 21 nt, Human
aacuucccagcaggcacaggc

SEQ ID NO: 602080 - RNA, 21 nt, Human
aagaaauggacgacggaacaa

SEQ ID NO: 602081 - RNA, 24 nt, Human
aagaacuacagugcaagccacgua

SEQ ID NO: 602082 - RNA, 23 nt, Human
aagccacauaaacaacuucccaa

SEQ ID NO: 602083 - RNA, 23 nt, Human
aagccacauaaacaacuucccaa

SEQ ID NO: 602084 - RNA, 23 nt, Human
aaggaaaugaggucagugaccac

SEQ ID NO: 602085 - RNA, 24 nt, Human
aagggcacccccacagcaggaguc

SEQ ID NO: 602086 - RNA, 20 nt, Human
acaagccacgcagaccacaa

SEQ ID NO: 602087 - RNA, 20 nt, Human
acaagccacgcagaccacaa

SEQ ID NO: 602088 - RNA, 21 nt, Human
acacaagccacgcagaccaca

SEQ ID NO: 602089 - RNA, 21 nt, Human
acacaagccacgcagaccaca

SEQ ID NO: 602090 - RNA, 21 nt, Human
acacagaccacaaccccccaa

SEQ ID NO: 602091 - RNA, 21 nt, Human
acacagacugcaaccucccaa

SEQ ID NO: 602092 - RNA, 19 nt, Human
acacaggugccaacagaau

SEQ ID NO: 602093 - RNA, 18 nt, Human
acaggcaucucccagcuc

SEQ ID NO: 602094 - RNA, 20 nt, Human
acaguaucugucugucuggu

SEQ ID NO: 602095 - RNA, 23 nt, Human
acagugcaagccacguagaccac

SEQ ID NO: 602096 - RNA, 22 nt, Human
accacaaccucccaacacacaa

SEQ ID NO: 602097 - RNA, 21 nt, Human
accacccacaccccaguucug

SEQ ID NO: 602098 - RNA, 23 nt, Human
accacccacaccccaguucugug

SEQ ID NO: 602099 - RNA, 19 nt, Human
accucgcaacacgcaagcc

SEQ ID NO: 602100 - RNA, 21 nt, Human
acgcagaccacaaccucccaa

SEQ ID NO: 602101 - RNA, 21 nt, Human
acgcagaccacgaccucccaa

SEQ ID NO: 602102 - RNA, 21 nt, Human
acggggcuguguacagagacu

SEQ ID NO: 602103 - RNA, 21 nt, Human
acggggcuguguacagagacu

SEQ ID NO: 602104 - RNA, 18 nt, Human
agaacaaacgccagaggg

SEQ ID NO: 602105 - RNA, 18 nt, Human
agacaagaaauggacgac

SEQ ID NO: 602106 - RNA, 21 nt, Human
agacaagaaauggacgacgga

SEQ ID NO: 602107 - RNA, 21 nt, Human
agacaauucauuaccuccccg

SEQ ID NO: 602108 - RNA, 23 nt, Human
agacacacacaacaggcaucucc

SEQ ID NO: 602109 - RNA, 19 nt, Human
agaccacaaccccccaaca

SEQ ID NO: 602110 - RNA, 18 nt, Human
agaccacaaccuccagca

SEQ ID NO: 602111 - RNA, 19 nt, Human
agaccacaaccucccaaca

SEQ ID NO: 602112 - RNA, 19 nt, Human
agaccacaaccucccaaca

SEQ ID NO: 602113 - RNA, 19 nt, Human
agacugcaaccucccaaca

SEQ ID NO: 602114 - RNA, 24 nt, Human
agagggcuucacccagaacccagg

SEQ ID NO: 602115 - RNA, 21 nt, Human
agcacacaagccacauaaaca

SEQ ID NO: 602116 - RNA, 21 nt, Human
agcacacaagccacauaaaca

SEQ ID NO: 602117 - RNA, 23 nt, Human
agccaagcagacaaccgcccaac

SEQ ID NO: 602118 - RNA, 21 nt, Human
agccacgcagaccacgaccuc

SEQ ID NO: 602119 - RNA, 18 nt, Human
agccacgcagaccgcaac

SEQ ID NO: 602120 - RNA, 18 nt, Human
agccacguagaccacaac

SEQ ID NO: 602121 - RNA, 21 nt, Human
agccacguagaccacaaccuc

SEQ ID NO: 602122 - RNA, 19 nt, Human
agcccagcguggugaagcc

SEQ ID NO: 602123 - RNA, 22 nt, Human
agcgaccccaggacaguggggc

SEQ ID NO: 602124 - RNA, 20 nt, Human
aggaggauccaggaagagga

SEQ ID NO: 602125 - RNA, 18 nt, Human
aggccacaaccuccagca

SEQ ID NO: 602126 - RNA, 23 nt, Human
agggcagccaccuggccugagaa

SEQ ID NO: 602127 - RNA, 21 nt, Human
agggccccacgcugaccucug

SEQ ID NO: 602128 - RNA, 18 nt, Human
agggcuggagccacacgu

SEQ ID NO: 602129 - RNA, 21 nt, Human
agugaccacguggccuccacg

SEQ ID NO: 602130 - RNA, 24 nt, Human
auacagaccacugcaacuucccaa

SEQ ID NO: 602131 - RNA, 23 nt, Human
augaaacaccagcggcagcccug

SEQ ID NO: 602132 - RNA, 19 nt, Human
augacaaaaacucuacacg

SEQ ID NO: 602133 - RNA, 20 nt, Human
auguggcaauuccagggcug

SEQ ID NO: 602134 - RNA, 21 nt, Human
caaaaaccacaaccucccaac

SEQ ID NO: 602135 - RNA, 27 nt, Human
caaaaagcagcagacaccucugaaaug

SEQ ID NO: 602136 - RNA, 24 nt, Human
caaaagaacuacagugcaagccac

SEQ ID NO: 602137 - RNA, 24 nt, Human
caacaagcagggcuuaaugggggu

SEQ ID NO: 602138 - RNA, 21 nt, Human
caacaccagcacccccacugg

SEQ ID NO: 602139 - RNA, 22 nt, Human
caacacccagugacagagacac

SEQ ID NO: 602140 - RNA, 22 nt, Human
caagcagacaaccgcccaacac

SEQ ID NO: 602141 - RNA, 22 nt, Human
caagcagacaacugcccaacac

SEQ ID NO: 602142 - RNA, 26 nt, Human
caagccacaaaaaccacaaccuccca

SEQ ID NO: 602143 - RNA, 21 nt, Human
caagccacgcagaccacaacc

SEQ ID NO: 602144 - RNA, 21 nt, Human
caagccacgcagaccacaacu

SEQ ID NO: 602145 - RNA, 21 nt, Human
caagccacguagaccacaacc

SEQ ID NO: 602146 - RNA, 24 nt, Human
cacaaacuaugacaggaacacacu

SEQ ID NO: 602147 - RNA, 18 nt, Human
cacacaagccacauaaac

SEQ ID NO: 602148 - RNA, 20 nt, Human
cacacgugaugcucggacac

SEQ ID NO: 602149 - RNA, 23 nt, Human
cacagacaauucauuaccucccc

SEQ ID NO: 602150 - RNA, 19 nt, Human
cacagaccacaacccccca

SEQ ID NO: 602151 - RNA, 20 nt, Human
cacagaccacaaccccccaa

SEQ ID NO: 602152 - RNA, 19 nt, Human
cacagagcacugcaacuuc

SEQ ID NO: 602153 - RNA, 19 nt, Human
cacagcaggagucauaaaa

SEQ ID NO: 602154 - RNA, 18 nt, Human
caccacccacaccccagu

SEQ ID NO: 602155 - RNA, 21 nt, Human
cacgcaagccacaaaaaccac

SEQ ID NO: 602156 - RNA, 22 nt, Human
cacgcaagccacaaaaaccaca

SEQ ID NO: 602157 - RNA, 27 nt, Human
cacgcaagccacacagagcacugcaac

SEQ ID NO: 602158 - RNA, 22 nt, Human
cacgcagaccacaaccucccaa

SEQ ID NO: 602159 - RNA, 22 nt, Human
cacgcagaccacaaccucccaa

SEQ ID NO: 602160 - RNA, 24 nt, Human
cacgcagcucugcagccuggccac

SEQ ID NO: 602161 - RNA, 22 nt, Human
cacgcuguagagcaggcucccg

SEQ ID NO: 602162 - RNA, 21 nt, Human
cagaacccagguccuggcuuc

SEQ ID NO: 602163 - RNA, 22 nt, Human
cagacuugggguucaaggggga

SEQ ID NO: 602164 - RNA, 20 nt, Human
cagagcaaggcuguccaaaa

SEQ ID NO: 602165 - RNA, 26 nt, Human
cagcacaaaugaaaugaagaccaaca

SEQ ID NO: 602166 - RNA, 24 nt, Human
cagcagacaccucugaaaugcccc

SEQ ID NO: 602167 - RNA, 20 nt, Human
cagcaggucagcauggcacu

SEQ ID NO: 602168 - RNA, 18 nt, Human
cagccuggcccugugcuc

SEQ ID NO: 602169 - RNA, 19 nt, Human
cagcgcacacugcacgccu

SEQ ID NO: 602170 - RNA, 23 nt, Human
cagcgcagcacaaaugaaaugaa

SEQ ID NO: 602171 - RNA, 23 nt, Human
cagcgguuggcugggcuccagug

SEQ ID NO: 602172 - RNA, 19 nt, Human
cagcguccggcucggccgu

SEQ ID NO: 602173 - RNA, 22 nt, Human
caggacaguggggcagacagag

SEQ ID NO: 602174 - RNA, 20 nt, Human
caggagccacgugaacacag

SEQ ID NO: 602175 - RNA, 21 nt, Human
caggaucaaaguccuugucug

SEQ ID NO: 602176 - RNA, 21 nt, Human
caggcaaaaagcagcagacac

SEQ ID NO: 602177 - RNA, 24 nt, Human
caucaaggaaaugaggucagugac

SEQ ID NO: 602178 - RNA, 21 nt, Human
cauuuaaaaacccaccaccca

SEQ ID NO: 602179 - RNA, 18 nt, Human
ccaacacaugagccaagc

SEQ ID NO: 602180 - RNA, 19 nt, Human
ccaacaccagcacccccac

SEQ ID NO: 602181 - RNA, 18 nt, Human
ccaacacgugagccaagc

SEQ ID NO: 602182 - RNA, 23 nt, Human
ccaaccuuggcuucaucuggagg

SEQ ID NO: 602183 - RNA, 20 nt, Human
ccacaaaaaccacaaccucc

SEQ ID NO: 602184 - RNA, 21 nt, Human
ccacagcaggagucauaaaaa

SEQ ID NO: 602185 - RNA, 24 nt, Human
ccaccacaaagaccaucuguggca

SEQ ID NO: 602186 - RNA, 22 nt, Human
ccaccaccacaaagaccaucug

SEQ ID NO: 602187 - RNA, 27 nt, Human
ccagaacccagguccuggcuucuacac

SEQ ID NO: 602188 - RNA, 22 nt, Human
ccagcacacaagccacauaaac

SEQ ID NO: 602189 - RNA, 24 nt, Human
ccagcacccccacuggaauaacaa

SEQ ID NO: 602190 - RNA, 24 nt, Human
ccagccuggcccugugcuccccaa

SEQ ID NO: 602191 - RNA, 19 nt, Human
ccagcggcagcccugccag

SEQ ID NO: 602192 - RNA, 22 nt, Human
ccagcuccuucuucaccuuccc

SEQ ID NO: 602193 - RNA, 21 nt, Human
ccaggaagaggaggcacuggu

SEQ ID NO: 602194 - RNA, 19 nt, Human
ccauggccugccugggaga

SEQ ID NO: 602195 - RNA, 24 nt, Human
cccaacacacaagccacgcagacc

SEQ ID NO: 602196 - RNA, 24 nt, Human
cccaacacacaagccacgcagacc

SEQ ID NO: 602197 - RNA, 25 nt, Human
cccaaccuuggcuucaucuggaggc

SEQ ID NO: 602198 - RNA, 18 nt, Human
cccaccaccacaaagacc

SEQ ID NO: 602199 - RNA, 18 nt, Human
cccaccacccacacccca

SEQ ID NO: 602200 - RNA, 23 nt, Human
cccagccuggcccugugccgguu

SEQ ID NO: 602201 - RNA, 20 nt, Human
ccccauggcccugcuauagg

SEQ ID NO: 602202 - RNA, 21 nt, Human
cccccaacacgcaagccacaa

SEQ ID NO: 602203 - RNA, 24 nt, Human
cccccaacacgcaagccacaaaaa

SEQ ID NO: 602204 - RNA, 20 nt, Human
ccgccgcgcuccgccugugc

SEQ ID NO: 602205 - RNA, 22 nt, Human
ccgccgcgcuccgccugugcuu

SEQ ID NO: 602206 - RNA, 23 nt, Human
ccuaggguguccccaaccuuggc

SEQ ID NO: 602207 - RNA, 22 nt, Human
ccuccccgcggcugcuucccgc

SEQ ID NO: 602208 - RNA, 22 nt, Human
ccugacggcaggcggcuccagc

SEQ ID NO: 602209 - RNA, 25 nt, Human
ccuuacaucaacaauauguggugau

SEQ ID NO: 602210 - RNA, 22 nt, Human
ccuuaugugugucugauccgga

SEQ ID NO: 602211 - RNA, 21 nt, Human
cgaagauuaggagacaagucc

SEQ ID NO: 602212 - RNA, 23 nt, Human
cgagaacugggaauauaaagaua

SEQ ID NO: 602213 - RNA, 24 nt, Human
cgagggaacuggaaguuuccgugu

SEQ ID NO: 602214 - RNA, 21 nt, Human
cggcagcccugccagaggcac

SEQ ID NO: 602215 - RNA, 22 nt, Human
cggcaggcggcuccagcccuca

SEQ ID NO: 602216 - RNA, 21 nt, Human
cggccgagagccgccgcgcuc

SEQ ID NO: 602217 - RNA, 21 nt, Human
cgggcaggcagaacacacucc

SEQ ID NO: 602218 - RNA, 25 nt, Human
cucagccuuggcucccaccaagcuc

SEQ ID NO: 602219 - RNA, 22 nt, Human
cuccagcacacaagccacauaa

SEQ ID NO: 602220 - RNA, 22 nt, Human
cuccagcacacaagccacauaa

SEQ ID NO: 602221 - RNA, 21 nt, Human
cuccucaccccagccuggccc

SEQ ID NO: 602222 - RNA, 20 nt, Human
cuccucaggguucacggggc

SEQ ID NO: 602223 - RNA, 20 nt, Human
cuccucaggguucacggggc

SEQ ID NO: 602224 - RNA, 23 nt, Human
cuccucaggguucguggggcuug

SEQ ID NO: 602225 - RNA, 18 nt, Human
cugaaacaaaaaccuuca

SEQ ID NO: 602226 - RNA, 19 nt, Human
cugaccucuggaucccggu

SEQ ID NO: 602227 - RNA, 20 nt, Human
cuggucccucucggaggcgu

SEQ ID NO: 602228 - RNA, 24 nt, Human
cuucacccagaacccagguccugg

SEQ ID NO: 602229 - RNA, 21 nt, Human
cuucccagguggugcuggucc

SEQ ID NO: 602230 - RNA, 20 nt, Human
cuugaggucccuuaaaauuc

SEQ ID NO: 602231 - RNA, 19 nt, Human
cuugggguucaagggggaa

SEQ ID NO: 602232 - RNA, 23 nt, Human
gaaacaaaaaccuucacccacga

SEQ ID NO: 602233 - RNA, 19 nt, Human
gaaaggagagcguggucag

SEQ ID NO: 602234 - RNA, 22 nt, Human
gaacaaacgccagagggccccu

SEQ ID NO: 602235 - RNA, 24 nt, Human
gaacaaacgccagagggccccuca

SEQ ID NO: 602236 - RNA, 20 nt, Human
gaacaaacgcucuggacaua

SEQ ID NO: 602237 - RNA, 21 nt, Human
gaagcccagcguggugaagcc

SEQ ID NO: 602238 - RNA, 19 nt, Human
gacacgauggccacacgcc

SEQ ID NO: 602239 - RNA, 18 nt, Human
gaccaucuguggcaggag

SEQ ID NO: 602240 - RNA, 19 nt, Human
gacucaccggcaacagcag

SEQ ID NO: 602241 - RNA, 18 nt, Human
gagcaggcucccgucccc

SEQ ID NO: 602242 - RNA, 20 nt, Human
gaggcguuggacagggagcu

SEQ ID NO: 602243 - RNA, 22 nt, Human
gcaagccacaaaaaccacaacc

SEQ ID NO: 602244 - RNA, 24 nt, Human
gcacccccacagcaggagucauaa

SEQ ID NO: 602245 - RNA, 21 nt, Human
gcacugcaacuucccagcagg

SEQ ID NO: 602246 - RNA, 19 nt, Human
gcagaccacaaccucccaa

SEQ ID NO: 602247 - RNA, 19 nt, Human
gcagaccacaacuucccaa

SEQ ID NO: 602248 - RNA, 19 nt, Human
gcagaccacaacuucccaa

SEQ ID NO: 602249 - RNA, 22 nt, Human
gccaagcagacaacugcccaac

SEQ ID NO: 602250 - RNA, 20 nt, Human
gccacacagacugcaaccuc

SEQ ID NO: 602251 - RNA, 23 nt, Human
gcugaaacaaaaaccuucaccca

SEQ ID NO: 602252 - RNA, 19 nt, Human
gcuucccagguggugcugg

SEQ ID NO: 602253 - RNA, 18 nt, Human
ggacagggagcugagguu

SEQ ID NO: 602254 - RNA, 21 nt, Human
ggacagggagcugagguugga

SEQ ID NO: 602255 - RNA, 20 nt, Human
ggcaggcagaacacacuccu

SEQ ID NO: 602256 - RNA, 20 nt, Human
ggccccaccaccacaaagac

SEQ ID NO: 602257 - RNA, 25 nt, Human
ggcccugggggagaggcggaagguc

SEQ ID NO: 602258 - RNA, 18 nt, Human
ggcuuggagacucugcug

SEQ ID NO: 602259 - RNA, 21 nt, Human
gggcaggcagaacacacuccu

SEQ ID NO: 602260 - RNA, 21 nt, Human
gguguccccaaccuuggcuuc

SEQ ID NO: 602261 - RNA, 22 nt, Human
guaaacacaggugccaacagaa

SEQ ID NO: 602262 - RNA, 21 nt, Human
guagagcaggcucccgucccc

SEQ ID NO: 602263 - RNA, 21 nt, Human
gucuccuccucaucagcgucc

SEQ ID NO: 602264 - RNA, 23 nt, Human
guggugcagacacacacaacagg

SEQ ID NO: 602265 - RNA, 24 nt, Human
uaaaaacccaccacccacacccca

SEQ ID NO: 602266 - RNA, 19 nt, Human
uacagaaugaggccagaca

SEQ ID NO: 602267 - RNA, 23 nt, Human
uacagaccacugcaacuucccaa

SEQ ID NO: 602268 - RNA, 22 nt, Human
uagaaagggcacccccacagca

SEQ ID NO: 602269 - RNA, 20 nt, Human
uaggacuucaucgacaugaa

SEQ ID NO: 602270 - RNA, 20 nt, Human
uaggguguccccaaccuugg

SEQ ID NO: 602271 - RNA, 21 nt, Human
uaggguguccccaaccuuggc

SEQ ID NO: 602272 - RNA, 24 nt, Human
ucaaauggcugucgucagggucca

SEQ ID NO: 602273 - RNA, 22 nt, Human
ucaacacccagugacagagaca

SEQ ID NO: 602274 - RNA, 19 nt, Human
ucaccggcaacagcagagc

SEQ ID NO: 602275 - RNA, 23 nt, Human
ucagagcccacaggauggccagg

SEQ ID NO: 602276 - RNA, 22 nt, Human
uccacgaugcaugaaacaccag

SEQ ID NO: 602277 - RNA, 28 nt, Human
uccagggcugaaacacagaccggggucc

SEQ ID NO: 602278 - RNA, 19 nt, Human
uccaucaaggaaaugaggu

SEQ ID NO: 602279 - RNA, 19 nt, Human
ucccaacacaugagccaag

SEQ ID NO: 602280 - RNA, 18 nt, Human
ucccaccaagcucagccg

SEQ ID NO: 602281 - RNA, 20 nt, Human
uccccaaccuuggcuucauc

SEQ ID NO: 602282 - RNA, 18 nt, Human
uccccauggcccugcuau

SEQ ID NO: 602283 - RNA, 25 nt, Human
uccuaggguguccccaaccuuggcu

SEQ ID NO: 602284 - RNA, 22 nt, Human
uccuggcuucuacacaaggcuc

SEQ ID NO: 602285 - RNA, 21 nt, Human
ucuacacgugcaaaauaaaac

SEQ ID NO: 602286 - RNA, 21 nt, Human
ucucccagcucuaucugcaga

SEQ ID NO: 602287 - RNA, 22 nt, Human
ucucgucuuugaagcccagcgu

SEQ ID NO: 602288 - RNA, 24 nt, Human
ucucucgucuuugaagcccagcgu

SEQ ID NO: 602289 - RNA, 21 nt, Human
ucugaaaugcccccacuucag

SEQ ID NO: 602290 - RNA, 19 nt, Human
ucugcagagggcuucaccc

SEQ ID NO: 602291 - RNA, 21 nt, Human
ucugcagccuggccacacacc

SEQ ID NO: 602292 - RNA, 19 nt, Human
ucuggaaggaagcacugcc

SEQ ID NO: 602293 - RNA, 19 nt, Human
ucugucccucaggaggggc

SEQ ID NO: 602294 - RNA, 22 nt, Human
ucuguguacaggccaucaggag

SEQ ID NO: 602295 - RNA, 21 nt, Human
ucuuaggcuccccauggcccu

SEQ ID NO: 602296 - RNA, 22 nt, Human
ugaaacacagacugcagagcaa

SEQ ID NO: 602297 - RNA, 25 nt, Human
ugaaacaccagcggcagcccugcca

SEQ ID NO: 602298 - RNA, 24 nt, Human
ugaaacaccagcggcagcuggagc

SEQ ID NO: 602299 - RNA, 21 nt, Human
ugaaagcacauuuguccaaga

SEQ ID NO: 602300 - RNA, 24 nt, Human
ugaaagcacauuuguccaagaaca

SEQ ID NO: 602301 - RNA, 21 nt, Human
ugaaaugaaaccugcaaggau

SEQ ID NO: 602302 - RNA, 21 nt, Human
ugacaaaaacucuacacgugc

SEQ ID NO: 602303 - RNA, 22 nt, Human
ugacacgauggccacacgcccu

SEQ ID NO: 602304 - RNA, 23 nt, Human
ugacacgauggccauauggccuu

SEQ ID NO: 602305 - RNA, 19 nt, Human
ugaccacgcuguagagcag

SEQ ID NO: 602306 - RNA, 31 nt, Human
ugaccacgcuguagagcaggcucccgucccc

SEQ ID NO: 602307 - RNA, 22 nt, Human
ugaccucuggaucccgguggcu

SEQ ID NO: 602308 - RNA, 21 nt, Human
ugagccacacagaccacaacc

SEQ ID NO: 602309 - RNA, 21 nt, Human
ugagccacgcaggccacaacc

SEQ ID NO: 602310 - RNA, 25 nt, Human
ugaggucagugaccacguggccucc

SEQ ID NO: 602311 - RNA, 25 nt, Human
ugaggucagugaccacguggccucc

SEQ ID NO: 602312 - RNA, 20 nt, Human
ugcacaguguccauguaugu

SEQ ID NO: 602313 - RNA, 18 nt, Human
ugcagcagggccuccauc

SEQ ID NO: 602314 - RNA, 20 nt, Human
ugccaaggagaaccucuuag

SEQ ID NO: 602315 - RNA, 25 nt, Human
ugccaaggagaaccucuuaggcucc

SEQ ID NO: 602316 - RNA, 22 nt, Human
ugccagaaaggagagcgugguc

SEQ ID NO: 602317 - RNA, 18 nt, Human
ugccagaggcaccuggac

SEQ ID NO: 602318 - RNA, 21 nt, Human
uggagaauguggcaauuccag

SEQ ID NO: 602319 - RNA, 20 nt, Human
uggccccugcgaggccccuu

SEQ ID NO: 602320 - RNA, 20 nt, Human
uggggcuuggagacucugcu

SEQ ID NO: 602321 - RNA, 18 nt, Human
ugggggcagcuccccacc

SEQ ID NO: 602322 - RNA, 21 nt, Human
uggugaucacuuagcaauguu

SEQ ID NO: 602323 - RNA, 24 nt, Human
uggugugugcagacuugggguuca

SEQ ID NO: 602324 - RNA, 19 nt, Human
ugugcuccccaauggcccc

SEQ ID NO: 602325 - RNA, 19 nt, Human
uguggcaauuccagggcug

SEQ ID NO: 602326 - RNA, 22 nt, Human
ugugggggcagcuccccaccgc

SEQ ID NO: 602327 - RNA, 21 nt, Human
uguggugcagacacacacaac

SEQ ID NO: 602328 - RNA, 18 nt, Human
uguuuucagcucauacca

SEQ ID NO: 602329 - RNA, 22 nt, Human
uuagccugcagcagggccucca

SEQ ID NO: 602330 - RNA, 22 nt, Human
uucaugggaacauuucuucucu

SEQ ID NO: 602331 - RNA, 23 nt, Human
uucauuaccuccccgcggcugcu

SEQ ID NO: 602332 - RNA, 24 nt, Human
uugaagacuuaauaugaaaaaaac

SEQ ID NO: 602333 - RNA, 23 nt, Human
uuggcugggcuccagugcaaggg

SEQ ID NO: 602334 - RNA, 24 nt, Human
aaagugaacaaacuaaagucagaa

SEQ ID NO: 602335 - RNA, 24 nt, Human
aaauaucaaaagucccagggaacc

SEQ ID NO: 602336 - RNA, 21 nt, Human
aagaagaaaauacacuguuua

SEQ ID NO: 602337 - RNA, 27 nt, Human
aagaagaaaauacacuguuuaucuggg

SEQ ID NO: 602338 - RNA, 24 nt, Human
aaguaacugggauuacaggugugu

SEQ ID NO: 602339 - RNA, 26 nt, Human
aaguaacugggauuacaggugugugc

SEQ ID NO: 602340 - RNA, 18 nt, Human
aagugcugggauuacagg

SEQ ID NO: 602341 - RNA, 18 nt, Human
aagugcugggauuacagg

SEQ ID NO: 602342 - RNA, 19 nt, Human
aagugcugggauuacaggu

SEQ ID NO: 602343 - RNA, 23 nt, Human
aagugcugggauuacagguguga

SEQ ID NO: 602344 - RNA, 26 nt, Human
aagugcugggauuacaggugugagcc

SEQ ID NO: 602345 - RNA, 20 nt, Human
acuaaagucagaagcaggug

SEQ ID NO: 602346 - RNA, 18 nt, Human
acugaaagagcagccaaa

SEQ ID NO: 602347 - RNA, 22 nt, Human
acugcaaccuccgccucccggg

SEQ ID NO: 602348 - RNA, 24 nt, Human
agaaaguggcaaacuacuggaaaa

SEQ ID NO: 602349 - RNA, 18 nt, Human
agccacugugcccagccc

SEQ ID NO: 602350 - RNA, 24 nt, Human
agcgauucuugugccucagccucc

SEQ ID NO: 602351 - RNA, 20 nt, Human
agugcugggauuacaggugu

SEQ ID NO: 602352 - RNA, 24 nt, Human
auccuaagccauacggcaggcccu

SEQ ID NO: 602353 - RNA, 23 nt, Human
aucugcccaccucagcuucccca

SEQ ID NO: 602354 - RNA, 18 nt, Human
augggguuucgccauguu

SEQ ID NO: 602355 - RNA, 24 nt, Human
augggguuucgccauguugaccag

SEQ ID NO: 602356 - RNA, 24 nt, Human
auuuuuguauuuuuaguagagaug

SEQ ID NO: 602357 - RNA, 26 nt, Human
caaaaaaaaaaaaaagaagaaaauac

SEQ ID NO: 602358 - RNA, 27 nt, Human
caagcgauucuugugccucagccuccc

SEQ ID NO: 602359 - RNA, 24 nt, Human
caccacgcccagcuaauuuuugua

SEQ ID NO: 602360 - RNA, 24 nt, Human
caccucagcuuccccaagugcugg

SEQ ID NO: 602361 - RNA, 20 nt, Human
cacugugcccagcccaaagu

SEQ ID NO: 602362 - RNA, 24 nt, Human
cagagucucccucuguugcccagg

SEQ ID NO: 602363 - RNA, 18 nt, Human
cagcagggcgaucuuggc

SEQ ID NO: 602364 - RNA, 24 nt, Human
cauguugaccaggcuggucuagaa

SEQ ID NO: 602365 - RNA, 20 nt, Human
cauuauuguaaugcagaaca

SEQ ID NO: 602366 - RNA, 23 nt, Human
ccaaaaaaaaaaaaaagaagaaa

SEQ ID NO: 602367 - RNA, 24 nt, Human
ccaaaaaaaaaaaaaagaagaaaa

SEQ ID NO: 602368 - RNA, 21 nt, Human
ccaaguaacugggauuacagg

SEQ ID NO: 602369 - RNA, 24 nt, Human
ccaaguaacugggauuacaggugu

SEQ ID NO: 602370 - RNA, 20 nt, Human
ccaagugcugggauuacagg

SEQ ID NO: 602371 - RNA, 20 nt, Human
ccaagugcugggauuacagg

SEQ ID NO: 602372 - RNA, 24 nt, Human
ccaagugcugggauuacaggugug

SEQ ID NO: 602373 - RNA, 20 nt, Human
ccaccacgcccagcuaauuu

SEQ ID NO: 602374 - RNA, 19 nt, Human
ccacugugcccagcccaaa

SEQ ID NO: 602375 - RNA, 19 nt, Human
ccacugugcccagcccaaa

SEQ ID NO: 602376 - RNA, 20 nt, Human
ccauguugaccaggcugguc

SEQ ID NO: 602377 - RNA, 19 nt, Human
cccaaguaacugggauuac

SEQ ID NO: 602378 - RNA, 22 nt, Human
cccaaguaacugggauuacagg

SEQ ID NO: 602379 - RNA, 21 nt, Human
cccaagugcugggauuacagg

SEQ ID NO: 602380 - RNA, 24 nt, Human
cccaagugcugggauuacaggugu

SEQ ID NO: 602381 - RNA, 18 nt, Human
cccaggcuggagugcagc

SEQ ID NO: 602382 - RNA, 22 nt, Human
ccccaagugcugggauuacagg

SEQ ID NO: 602383 - RNA, 20 nt, Human
cccggguucaagcgauucuu

SEQ ID NO: 602384 - RNA, 24 nt, Human
cccucuguugcccaggcuggagug

SEQ ID NO: 602385 - RNA, 24 nt, Human
ccgccucccggguucaagcgauuc

SEQ ID NO: 602386 - RNA, 22 nt, Human
ccucccggguucaagcgauucu

SEQ ID NO: 602387 - RNA, 20 nt, Human
cgauucuugugccucagccu

SEQ ID NO: 602388 - RNA, 22 nt, Human
cgccauguugaccaggcugguc

SEQ ID NO: 602389 - RNA, 27 nt, Human
cgccauguugaccaggcuggucuagaa

SEQ ID NO: 602390 - RNA, 23 nt, Human
cuagaacuccugaccucaacuga

SEQ ID NO: 602391 - RNA, 22 nt, Human
cuagccucauuauggcaaugaa

SEQ ID NO: 602392 - RNA, 20 nt, Human
cucaccaaaaaaaaaaaaaa

SEQ ID NO: 602393 - RNA, 24 nt, Human
cucccucuguugcccaggcuggag

SEQ ID NO: 602394 - RNA, 23 nt, Human
cucuguugcccaggcuggagugc

SEQ ID NO: 602395 - RNA, 21 nt, Human
cugaauuuaauaacuuaagug

SEQ ID NO: 602396 - RNA, 23 nt, Human
cugcaaccuccgccucccggguu

SEQ ID NO: 602397 - RNA, 24 nt, Human
cugcaaccuccgccucccggguuc

SEQ ID NO: 602398 - RNA, 24 nt, Human
cugcccaccucagcuuccccaagu

SEQ ID NO: 602399 - RNA, 18 nt, Human
cuggaaaaguagcuuaaa

SEQ ID NO: 602400 - RNA, 23 nt, Human
cuugugccucagccucccaagua

SEQ ID NO: 602401 - RNA, 24 nt, Human
gaccucaacugaucugcccaccuc

SEQ ID NO: 602402 - RNA, 20 nt, Human
gagacagagucucccucugu

SEQ ID NO: 602403 - RNA, 18 nt, Human
gagaugggguuucgccau

SEQ ID NO: 602404 - RNA, 20 nt, Human
gagaugggguuucgccaugu

SEQ ID NO: 602405 - RNA, 18 nt, Human
gaugacaucccauuauug

SEQ ID NO: 602406 - RNA, 20 nt, Human
gaugcauagugcuggagaca

SEQ ID NO: 602407 - RNA, 18 nt, Human
gauuacaggugugagcca

SEQ ID NO: 602408 - RNA, 21 nt, Human
gauuacaggugugagccacug

SEQ ID NO: 602409 - RNA, 24 nt, Human
gauuacaggugugagccacugugc

SEQ ID NO: 602410 - RNA, 18 nt, Human
gauuacaggugugugcca

SEQ ID NO: 602411 - RNA, 19 nt, Human
gcagaacaugauaaugucc

SEQ ID NO: 602412 - RNA, 22 nt, Human
gcccagcuaauuuuuguauuuu

SEQ ID NO: 602413 - RNA, 24 nt, Human
gcgauucuugugccucagccuccc

SEQ ID NO: 602414 - RNA, 23 nt, Human
gcuggucuagaacuccugaccuc

SEQ ID NO: 602415 - RNA, 21 nt, Human
gcuuaaagcucuggaccacuc

SEQ ID NO: 602416 - RNA, 22 nt, Human
ggagacagagucucccucuguu

SEQ ID NO: 602417 - RNA, 24 nt, Human
ggcuggucuagaacuccugaccuc

SEQ ID NO: 602418 - RNA, 19 nt, Human
gggagcuagccucauuaug

SEQ ID NO: 602419 - RNA, 22 nt, Human
gggguuucgccauguugaccag

SEQ ID NO: 602420 - RNA, 23 nt, Human
guagagaugggguuucgccaugu

SEQ ID NO: 602421 - RNA, 22 nt, Human
gugagccacugugcccagccca

SEQ ID NO: 602422 - RNA, 22 nt, Human
gugccucagccucccaaguaac

SEQ ID NO: 602423 - RNA, 23 nt, Human
uaaaagugaacaaacuaaaguca

SEQ ID NO: 602424 - RNA, 18 nt, Human
uaacugcaaccuccgccu

SEQ ID NO: 602425 - RNA, 21 nt, Human
uaacugcaaccuccgccuccc

SEQ ID NO: 602426 - RNA, 24 nt, Human
uaacugcaaccuccgccucccggg

SEQ ID NO: 602427 - RNA, 19 nt, Human
uaaguuacaaauagucuga

SEQ ID NO: 602428 - RNA, 24 nt, Human
uaauuuuuguauuuuuaguagaga

SEQ ID NO: 602429 - RNA, 23 nt, Human
uacaggugugagccacugugccc

SEQ ID NO: 602430 - RNA, 24 nt, Human
uacaggugugagccacugugccca

SEQ ID NO: 602431 - RNA, 24 nt, Human
uacaggugugugccaccacgccca

SEQ ID NO: 602432 - RNA, 22 nt, Human
uagagaugggguuucgccaugu

SEQ ID NO: 602433 - RNA, 23 nt, Human
uagcaucacugaaagagcagcca

SEQ ID NO: 602434 - RNA, 19 nt, Human
uagccucauuauggcaauu

SEQ ID NO: 602435 - RNA, 24 nt, Human
uaguagagaugggguuucgccaug

SEQ ID NO: 602436 - RNA, 21 nt, Human
ucaccaaaaaaaaaaaaaaga

SEQ ID NO: 602437 - RNA, 26 nt, Human
ucaccaaaaaaaaaaaaaagaagaaa

SEQ ID NO: 602438 - RNA, 23 nt, Human
ucccaaguaacugggauuacagg

SEQ ID NO: 602439 - RNA, 24 nt, Human
ucccaaguaacugggauuacaggu

SEQ ID NO: 602440 - RNA, 23 nt, Human
uccccaagugcugggauuacagg

SEQ ID NO: 602441 - RNA, 20 nt, Human
ucccggguucaagcgauucu

SEQ ID NO: 602442 - RNA, 20 nt, Human
ucccggguucaagcgauucu

SEQ ID NO: 602443 - RNA, 22 nt, Human
ucccggguucaagcgauucuug

SEQ ID NO: 602444 - RNA, 20 nt, Human
ucccucuguugcccaggcug

SEQ ID NO: 602445 - RNA, 24 nt, Human
ucccucuguugcccaggcuggagu

SEQ ID NO: 602446 - RNA, 22 nt, Human
ucgccauguugaccaggcuggu

SEQ ID NO: 602447 - RNA, 23 nt, Human
ucucccucuguugcccaggcugg

SEQ ID NO: 602448 - RNA, 24 nt, Human
ucucccucuguugcccaggcugga

SEQ ID NO: 602449 - RNA, 22 nt, Human
ucugcccaccucagcuucccca

SEQ ID NO: 602450 - RNA, 31 nt, Human
ucuggaccacucaccaaaaaaaaaaaaaagg

SEQ ID NO: 602451 - RNA, 18 nt, Human
ucuguugcccaggcugga

SEQ ID NO: 602452 - RNA, 24 nt, Human
ucuguugcccaggcuggagugcag

SEQ ID NO: 602453 - RNA, 22 nt, Human
ugaaaacaugucaugaaaauac

SEQ ID NO: 602454 - RNA, 21 nt, Human
ugaacaaacuaaagucagaag

SEQ ID NO: 602455 - RNA, 24 nt, Human
ugaccaggcuggucuagaacuccu

SEQ ID NO: 602456 - RNA, 18 nt, Human
ugaccucaacugaucugc

SEQ ID NO: 602457 - RNA, 22 nt, Human
ugaccucaacugaucugcccac

SEQ ID NO: 602458 - RNA, 23 nt, Human
ugaucugcccaccucagcuuccc

SEQ ID NO: 602459 - RNA, 24 nt, Human
ugaucugcccaccucagcuucccc

SEQ ID NO: 602460 - RNA, 18 nt, Human
ugcccaggcuggagugca

SEQ ID NO: 602461 - RNA, 19 nt, Human
ugcccaggcuggagugcag

SEQ ID NO: 602462 - RNA, 25 nt, Human
ugcccaggcuggagugcagcagggc

SEQ ID NO: 602463 - RNA, 25 nt, Human
ugcccaggcuggagugcagcagggc

SEQ ID NO: 602464 - RNA, 24 nt, Human
ugccucagccucccaaguaacugg

SEQ ID NO: 602465 - RNA, 24 nt, Human
ugcugggauuacaggugugagcca

SEQ ID NO: 602466 - RNA, 24 nt, Human
uggagugcagcagggcgaucuugg

SEQ ID NO: 602467 - RNA, 18 nt, Human
ugggauuacaggugugag

SEQ ID NO: 602468 - RNA, 21 nt, Human
ugggauuacaggugugagcca

SEQ ID NO: 602469 - RNA, 22 nt, Human
ugggauuacaggugugagccac

SEQ ID NO: 602470 - RNA, 22 nt, Human
ugggauuacaggugugagccac

SEQ ID NO: 602471 - RNA, 22 nt, Human
ugggauuacaggugugagccac

SEQ ID NO: 602472 - RNA, 24 nt, Human
ugggauuacaggugugagccacug

SEQ ID NO: 602473 - RNA, 19 nt, Human
ugggauuacaggugugugc

SEQ ID NO: 602474 - RNA, 21 nt, Human
ugggauuacaggugugugcca

SEQ ID NO: 602475 - RNA, 22 nt, Human
ugggauuacaggugugugccac

SEQ ID NO: 602476 - RNA, 24 nt, Human
ugggauuacaggugugugccacca

SEQ ID NO: 602477 - RNA, 24 nt, Human
ugggguuucgccauguugaccagg

SEQ ID NO: 602478 - RNA, 23 nt, Human
ugugauaugguuaauauaauaca

SEQ ID NO: 602479 - RNA, 19 nt, Human
ugugugccaccacgcccag

SEQ ID NO: 602480 - RNA, 21 nt, Human
ugugugccaccacgcccagcu

SEQ ID NO: 602481 - RNA, 18 nt, Human
uuaguagagaugggguuu

SEQ ID NO: 602482 - RNA, 22 nt, Human
uuaguagagaugggguuucgcc

SEQ ID NO: 602483 - RNA, 24 nt, Human
uuaguagagaugggguuucgccau

SEQ ID NO: 602484 - RNA, 23 nt, Human
uucaagcgauucuugugccucag

SEQ ID NO: 602485 - RNA, 18 nt, Human
uucacuaacaguuuuugu

SEQ ID NO: 602486 - RNA, 19 nt, Human
uucacuaacaguuuuuguu

SEQ ID NO: 602487 - RNA, 31 nt, Human
uugacacacaauuagcaucacugaaagaggg

SEQ ID NO: 602488 - RNA, 18 nt, Human
uugcccaggcuggagugc

SEQ ID NO: 602489 - RNA, 23 nt, Human
uuguauuuuuaguagagaugggg

SEQ ID NO: 602490 - RNA, 23 nt, Human
uuucgccauguugaccaggcugu

SEQ ID NO: 602491 - RNA, 22 nt, Human
uuuuuaguagagaugggguuuc

SEQ ID NO: 602492 - RNA, 23 nt, Human
uuuuuaguagagaugggguuucg

SEQ ID NO: 602493 - RNA, 20 nt, Human
uuuuuguauuuuuaguagag

SEQ ID NO: 602494 - RNA, 22 nt, Human
uuuuuguuuuuguuuuuggaga

SEQ ID NO: 602495 - RNA, 18 nt, Human
aaaaauaaccuccucccu

SEQ ID NO: 602496 - RNA, 23 nt, Human
aaaacacaaaaauaaccuccucc

SEQ ID NO: 602497 - RNA, 24 nt, Human
aaaaccaaccaaccaaccaacccc

SEQ ID NO: 602498 - RNA, 22 nt, Human
aaaaccacaaaugacaccuuuc

SEQ ID NO: 602499 - RNA, 26 nt, Human
aaacaaaaccaaaaacaaaaccaacc

SEQ ID NO: 602500 - RNA, 19 nt, Human
aaacaaaaccaaccaacca

SEQ ID NO: 602501 - RNA, 27 nt, Human
aaacaagaaacauacuacucaaaagaa

SEQ ID NO: 602502 - RNA, 21 nt, Human
aaacaauguauauccaaccga

SEQ ID NO: 602503 - RNA, 24 nt, Human
aaacaauguauauccaaccgagau

SEQ ID NO: 602504 - RNA, 18 nt, Human
aaagaacaaagucuuuuc

SEQ ID NO: 602505 - RNA, 23 nt, Human
aaagacucccaaauaaaaaugaa

SEQ ID NO: 602506 - RNA, 23 nt, Human
aaaggaaguagaccaaggagacu

SEQ ID NO: 602507 - RNA, 23 nt, Human
aaauagucgaugugaacugcuua

SEQ ID NO: 602508 - RNA, 22 nt, Human
aacaaaaccaaaaacaaaacca

SEQ ID NO: 602509 - RNA, 23 nt, Human
aacaaaaccaaccaaccaaccaa

SEQ ID NO: 602510 - RNA, 22 nt, Human
aaccaaccaaccaaccaacccc

SEQ ID NO: 602511 - RNA, 18 nt, Human
aaccaaccaaccaacccc

SEQ ID NO: 602512 - RNA, 22 nt, Human
aaccaaccaaccccaaaacaca

SEQ ID NO: 602513 - RNA, 23 nt, Human
aaccacaaaucaauacaaaucca

SEQ ID NO: 602514 - RNA, 23 nt, Human
aagaaacauacuacucaaaagaa

SEQ ID NO: 602515 - RNA, 20 nt, Human
aagcaaauguggcacgugau

SEQ ID NO: 602516 - RNA, 18 nt, Human
aagcuaugauguuuuagg

SEQ ID NO: 602517 - RNA, 23 nt, Human
acaaaaauaaccuccucccuaac

SEQ ID NO: 602518 - RNA, 27 nt, Human
acaaaaccaaaaacaaaaccaaccaac

SEQ ID NO: 602519 - RNA, 21 nt, Human
acaaaaccaaccaaccaacca

SEQ ID NO: 602520 - RNA, 21 nt, Human
acaaaaccacaaaugacaccu

SEQ ID NO: 602521 - RNA, 23 nt, Human
accaaccaaccaaccaaccccaa

SEQ ID NO: 602522 - RNA, 24 nt, Human
accaaccaaccaaccccaaaacac

SEQ ID NO: 602523 - RNA, 22 nt, Human
accacaaaucaauacaaaucca

SEQ ID NO: 602524 - RNA, 18 nt, Human
accuaucuucacccccuc

SEQ ID NO: 602525 - RNA, 22 nt, Human
acgaagaacaggaacaugcaaa

SEQ ID NO: 602526 - RNA, 20 nt, Human
agaccaaggagacugaaggu

SEQ ID NO: 602527 - RNA, 20 nt, Human
aggacaaaaccacaaaugac

SEQ ID NO: 602528 - RNA, 22 nt, Human
aggcacaaaggaaguagaccaa

SEQ ID NO: 602529 - RNA, 22 nt, Human
auaaaaccuaaaaaaagaaagu

SEQ ID NO: 602530 - RNA, 21 nt, Human
auuucauuaguuacuggacaa

SEQ ID NO: 602531 - RNA, 23 nt, Human
auuucauuaguuacuggacaaaa

SEQ ID NO: 602532 - RNA, 24 nt, Human
caaaaccaaccaaccaaccaaccc

SEQ ID NO: 602533 - RNA, 21 nt, Human
caaaacuggacaaaacacaau

SEQ ID NO: 602534 - RNA, 21 nt, Human
caaaagaaaacuccccuggaa

SEQ ID NO: 602535 - RNA, 27 nt, Human
caaaaugaacaauaaguauucugggua

SEQ ID NO: 602536 - RNA, 23 nt, Human
caaaugucuucauauagaaaaug

SEQ ID NO: 602537 - RNA, 21 nt, Human
caacacucuucacagaaaagu

SEQ ID NO: 602538 - RNA, 20 nt, Human
caaccaaccaaccccaaaac

SEQ ID NO: 602539 - RNA, 25 nt, Human
caaccaaccccaaaacacaaaaaua

SEQ ID NO: 602540 - RNA, 27 nt, Human
caaccaaccccaaaacacaaaaauaac

SEQ ID NO: 602541 - RNA, 25 nt, Human
caagaaacauacuacucaaaagaaa

SEQ ID NO: 602542 - RNA, 24 nt, Human
caagcaaauguggcacgugauggg

SEQ ID NO: 602543 - RNA, 19 nt, Human
caaugcuaaaaaaugcaaa

SEQ ID NO: 602544 - RNA, 21 nt, Human
caaugcuaaaaaaugcaaaca

SEQ ID NO: 602545 - RNA, 24 nt, Human
cacaaaaauaaccuccucccuaac

SEQ ID NO: 602546 - RNA, 20 nt, Human
cacaaaacuggacaaaacac

SEQ ID NO: 602547 - RNA, 18 nt, Human
cacauacacacacacgca

SEQ ID NO: 602548 - RNA, 24 nt, Human
cacccugggaaaagcuuaaacuca

SEQ ID NO: 602549 - RNA, 21 nt, Human
cagcaagcaaaaaugcuacca

SEQ ID NO: 602550 - RNA, 21 nt, Human
caguaaaaaaacaaaaccaaa

SEQ ID NO: 602551 - RNA, 31 nt, Human
caguaaaaaaacaaaaccaaaaacaaaaccu

SEQ ID NO: 602552 - RNA, 25 nt, Human
caucacuaaacauaaauaaaaaggg

SEQ ID NO: 602553 - RNA, 23 nt, Human
cauuuuuauuccucuuuucaggc

SEQ ID NO: 602554 - RNA, 26 nt, Human
ccaaaacacaaaaauaaccuccuccc

SEQ ID NO: 602555 - RNA, 23 nt, Human
ccaagcaaauguggcacgugaug

SEQ ID NO: 602556 - RNA, 23 nt, Human
ccacaaaucaauacaaauccaac

SEQ ID NO: 602557 - RNA, 21 nt, Human
cccaagugcuccaugccuucu

SEQ ID NO: 602558 - RNA, 19 nt, Human
cccugggaaaagcuuaaac

SEQ ID NO: 602559 - RNA, 19 nt, Human
ccuaccgcuacucuucgcc

SEQ ID NO: 602560 - RNA, 18 nt, Human
ccuguuacaucuggaaca

SEQ ID NO: 602561 - RNA, 19 nt, Human
cgaagaacaggaacaugca

SEQ ID NO: 602562 - RNA, 25 nt, Human
cguucagaaucccgccaacacggaa

SEQ ID NO: 602563 - RNA, 22 nt, Human
cuaaaaaaugcaaacauauaca

SEQ ID NO: 602564 - RNA, 22 nt, Human
cuaaauuucugauuuuacacac

SEQ ID NO: 602565 - RNA, 20 nt, Human
cucccaaauaaaaaugaaaa

SEQ ID NO: 602566 - RNA, 19 nt, Human
cucccuaacuucucugguc

SEQ ID NO: 602567 - RNA, 24 nt, Human
cuuaaacaaagaugacccaaaucu

SEQ ID NO: 602568 - RNA, 24 nt, Human
gaaaagaacaaagucuuuucaaaa

SEQ ID NO: 602569 - RNA, 24 nt, Human
gaacaggaacaugcaaacaagaaa

SEQ ID NO: 602570 - RNA, 26 nt, Human
gaacuuuuaugaggaaaaaagguaac

SEQ ID NO: 602571 - RNA, 24 nt, Human
gagaaaauguaagcuaccuaacau

SEQ ID NO: 602572 - RNA, 22 nt, Human
gagugcuauuucuccaucaugg

SEQ ID NO: 602573 - RNA, 22 nt, Human
gaugggcuggcacuggaaaggc

SEQ ID NO: 602574 - RNA, 22 nt, Human
gcacuggaaaggcugcucugga

SEQ ID NO: 602575 - RNA, 23 nt, Human
uaaaaaaugcaaacauauacaua

SEQ ID NO: 602576 - RNA, 23 nt, Human
uaacaacuuuucuauuucucuca

SEQ ID NO: 602577 - RNA, 19 nt, Human
uaacauaaaacaaaugucu

SEQ ID NO: 602578 - RNA, 19 nt, Human
uaacauaaaacaaaugucu

SEQ ID NO: 602579 - RNA, 21 nt, Human
uaaccuccucccuaacuucuc

SEQ ID NO: 602580 - RNA, 28 nt, Human
uacacacacacgcagaggagaaaaugua

SEQ ID NO: 602581 - RNA, 23 nt, Human
uacacacauacacacacacgcag

SEQ ID NO: 602582 - RNA, 22 nt, Human
uacguuuagaacaauacacuuu

SEQ ID NO: 602583 - RNA, 21 nt, Human
uaggccaucacuaaacauaaa

SEQ ID NO: 602584 - RNA, 27 nt, Human
ucaauacaaauccaacaaaauacaugg

SEQ ID NO: 602585 - RNA, 21 nt, Human
ucccaaauaaaaaugaaaaga

SEQ ID NO: 602586 - RNA, 23 nt, Human
ucuuaccuaucuucacccccuca

SEQ ID NO: 602587 - RNA, 21 nt, Human
ugacaggcugacguaccuucc

SEQ ID NO: 602588 - RNA, 23 nt, Human
ugcaagcuggacacuggcuauua

SEQ ID NO: 602589 - RNA, 24 nt, Human
ugcauaugacaggcugacguaccu

SEQ ID NO: 602590 - RNA, 20 nt, Human
ugcccugggaaaacucuguc

SEQ ID NO: 602591 - RNA, 22 nt, Human
uggacaaaacacaaugcuaaaa

SEQ ID NO: 602592 - RNA, 23 nt, Human
uggacaaaacacaaugcuaaaaa

SEQ ID NO: 602593 - RNA, 23 nt, Human
uggcacgugaugggcagagugag

SEQ ID NO: 602594 - RNA, 21 nt, Human
ugggaaaagcuuaaacucaag

SEQ ID NO: 602595 - RNA, 23 nt, Human
ugggaaaagcuuaaacucaagug

SEQ ID NO: 602596 - RNA, 18 nt, Human
ugggcagagugagcgaca

SEQ ID NO: 602597 - RNA, 23 nt, Human
ugucugaaacaagcagcuugggg

SEQ ID NO: 602598 - RNA, 21 nt, Human
uuuagguuccucuaaacccaa

SEQ ID NO: 602599 - RNA, 21 nt, Human
uuuugcuuaugacauucuuua

SEQ ID NO: 602600 - RNA, 24 nt, Human
uuuuuuuuuuuuuuuugcuuauga

SEQ ID NO: 602601 - RNA, 18 nt, Human
aaaaaagccaccaugccc

SEQ ID NO: 602602 - RNA, 24 nt, Human
aaaagucaaauuccauuuccuuua

SEQ ID NO: 602603 - RNA, 21 nt, Human
aaacagaaacuugaagccaaa

SEQ ID NO: 602604 - RNA, 21 nt, Human
aaacucugucucuacaaaaag

SEQ ID NO: 602605 - RNA, 23 nt, Human
aaacuguagaaucucaagcacaa

SEQ ID NO: 602606 - RNA, 26 nt, Human
aaaggcaccaauaacaguuggagacc

SEQ ID NO: 602607 - RNA, 18 nt, Human
aaagugcugggauuacaa

SEQ ID NO: 602608 - RNA, 24 nt, Human
aaagugcugggauuacaagcauga

SEQ ID NO: 602609 - RNA, 24 nt, Human
aaagugcugggauuacaggcguga

SEQ ID NO: 602610 - RNA, 20 nt, Human
aacaaaaaugacuuugaaau

SEQ ID NO: 602611 - RNA, 27 nt, Human
aaccaucccaacugcaaaggcacucaa

SEQ ID NO: 602612 - RNA, 18 nt, Human
aacuuuuaaaagaauucu

SEQ ID NO: 602613 - RNA, 18 nt, Human
aagaauucucuauuuugu

SEQ ID NO: 602614 - RNA, 25 nt, Human
aagcaauccuccugcuucagcuucc

SEQ ID NO: 602615 - RNA, 18 nt, Human
aaggcauuuuauacagaa

SEQ ID NO: 602616 - RNA, 23 nt, Human
aaggguucgugcaaacuuuacca

SEQ ID NO: 602617 - RNA, 24 nt, Human
aagugaucugcccgccucggccuc

SEQ ID NO: 602618 - RNA, 19 nt, Human
aagugcugggauuacaagc

SEQ ID NO: 602619 - RNA, 21 nt, Human
aagugcugggauuacaagcau

SEQ ID NO: 602620 - RNA, 19 nt, Human
aagugcugggauuacaggc

SEQ ID NO: 602621 - RNA, 19 nt, Human
aagugcugggauuacaggc

SEQ ID NO: 602622 - RNA, 18 nt, Human
acagagugaaacucuguc

SEQ ID NO: 602623 - RNA, 19 nt, Human
acagagugaaacucugucu

SEQ ID NO: 602624 - RNA, 20 nt, Human
acagagugaaacucugucuc

SEQ ID NO: 602625 - RNA, 26 nt, Human
acagagugaaacucugucucuacaaa

SEQ ID NO: 602626 - RNA, 19 nt, Human
acaggcaagagccacuacg

SEQ ID NO: 602627 - RNA, 19 nt, Human
acaggguuucaccauuugg

SEQ ID NO: 602628 - RNA, 20 nt, Human
accacaaccuccaccuccca

SEQ ID NO: 602629 - RNA, 22 nt, Human
accauuugggccaggcuggucu

SEQ ID NO: 602630 - RNA, 24 nt, Human
acccaggcuggagugcaguggcau

SEQ ID NO: 602631 - RNA, 23 nt, Human
accucggccucccaaagugcugg

SEQ ID NO: 602632 - RNA, 24 nt, Human
accuugugauccacccaccucggc

SEQ ID NO: 602633 - RNA, 18 nt, Human
acgggguuucaccacguu

SEQ ID NO: 602634 - RNA, 20 nt, Human
acgggguuucaccacguugg

SEQ ID NO: 602635 - RNA, 24 nt, Human
acgggguuucaccacguuggccag

SEQ ID NO: 602636 - RNA, 25 nt, Human
acuauguugcccaggcuagucuuga

SEQ ID NO: 602637 - RNA, 24 nt, Human
acuccagcuugggcgacagaguga

SEQ ID NO: 602638 - RNA, 18 nt, Human
acuccguuguccaggcug

SEQ ID NO: 602639 - RNA, 19 nt, Human
acuccguuguccaggcugg

SEQ ID NO: 602640 - RNA, 22 nt, Human
acuccguuguccaggcuggagu

SEQ ID NO: 602641 - RNA, 25 nt, Human
acuccguuguccaggcuggagugca

SEQ ID NO: 602642 - RNA, 18 nt, Human
acucugucacccaggcug

SEQ ID NO: 602643 - RNA, 25 nt, Human
acucugucacccaggcuggagugca

SEQ ID NO: 602644 - RNA, 24 nt, Human
acugcacuccagcuugggcgacag

SEQ ID NO: 602645 - RNA, 26 nt, Human
acugcacuccagcuugggcgacagag

SEQ ID NO: 602646 - RNA, 19 nt, Human
agaaaaaauuauuuugugg

SEQ ID NO: 602647 - RNA, 24 nt, Human
agaaaggcauuuuauacagaagca

SEQ ID NO: 602648 - RNA, 24 nt, Human
agaaugcugggauuacaggcaaga

SEQ ID NO: 602649 - RNA, 21 nt, Human
agacaaaaaccuagcauuagc

SEQ ID NO: 602650 - RNA, 24 nt, Human
agaggcugcagugagguaugauug

SEQ ID NO: 602651 - RNA, 23 nt, Human
agagguggacucccgaaggguag

SEQ ID NO: 602652 - RNA, 18 nt, Human
agccaaauaagaugacug

SEQ ID NO: 602653 - RNA, 19 nt, Human
agccuguaguuccagcuac

SEQ ID NO: 602654 - RNA, 24 nt, Human
agcuugggcgacagagugaaacuc

SEQ ID NO: 602655 - RNA, 21 nt, Human
aggaaccaucccaacugcaaa

SEQ ID NO: 602656 - RNA, 26 nt, Human
aggaggcuccggcgagcggcggcucc

SEQ ID NO: 602657 - RNA, 18 nt, Human
aggcaccaauaacaguua

SEQ ID NO: 602658 - RNA, 19 nt, Human
aggcuggagugcaguggca

SEQ ID NO: 602659 - RNA, 25 nt, Human
aggcuggagugcaguggcacgaucu

SEQ ID NO: 602660 - RNA, 22 nt, Human
agggaggguaagauauuccaaa

SEQ ID NO: 602661 - RNA, 22 nt, Human
aguagagacaggguuucaccau

SEQ ID NO: 602662 - RNA, 19 nt, Human
aguagcugggacuauaggc

SEQ ID NO: 602663 - RNA, 18 nt, Human
aguagcugggauuacagg

SEQ ID NO: 602664 - RNA, 24 nt, Human
agugauucucgugccucagccucc

SEQ ID NO: 602665 - RNA, 21 nt, Human
agugcaguggcacgaucuuag

SEQ ID NO: 602666 - RNA, 23 nt, Human
agugcaguggcacgaucuuagcu

SEQ ID NO: 602667 - RNA, 24 nt, Human
agugcaguggcacgaucuuagcuc

SEQ ID NO: 602668 - RNA, 20 nt, Human
agugcaguggcaugauauug

SEQ ID NO: 602669 - RNA, 23 nt, Human
agugcaguggcaugauauuggcu

SEQ ID NO: 602670 - RNA, 24 nt, Human
agugcaguggcaugauauuggcuc

SEQ ID NO: 602671 - RNA, 24 nt, Human
agugcugggauuacaagcaugagc

SEQ ID NO: 602672 - RNA, 18 nt, Human
agugcugggauuacaggc

SEQ ID NO: 602673 - RNA, 19 nt, Human
aguucaaacacugaaagau

SEQ ID NO: 602674 - RNA, 22 nt, Human
auggaggacaagcuucugcuca

SEQ ID NO: 602675 - RNA, 21 nt, Human
auuggaagggacucugagauc

SEQ ID NO: 602676 - RNA, 20 nt, Human
auuguauuuuaauugagagg

SEQ ID NO: 602677 - RNA, 24 nt, Human
auugugccacugcacuccagcuug

SEQ ID NO: 602678 - RNA, 18 nt, Human
auuuccuuaauguugcuu

SEQ ID NO: 602679 - RNA, 24 nt, Human
auuuuuguauauuuaguagagaca

SEQ ID NO: 602680 - RNA, 23 nt, Human
caaccuccaccucccagguucaa

SEQ ID NO: 602681 - RNA, 20 nt, Human
caaccuccacuuccuggguu

SEQ ID NO: 602682 - RNA, 22 nt, Human
caagcaauccuccugcuucagc

SEQ ID NO: 602683 - RNA, 22 nt, Human
caagcgauucuccugccucagc

SEQ ID NO: 602684 - RNA, 22 nt, Human
caagugauucucgugccucagc

SEQ ID NO: 602685 - RNA, 28 nt, Human
caagugauucucgugccucagccucccg

SEQ ID NO: 602686 - RNA, 20 nt, Human
caaugauaaaggaagagacc

SEQ ID NO: 602687 - RNA, 21 nt, Human
caccacaaccuccaccuccca

SEQ ID NO: 602688 - RNA, 21 nt, Human
caccacaaccuccaccuccca

SEQ ID NO: 602689 - RNA, 24 nt, Human
caccacacccagcuaauuuuugua

SEQ ID NO: 602690 - RNA, 22 nt, Human
caccacguuggccagggugguc

SEQ ID NO: 602691 - RNA, 24 nt, Human
caccacguuggccaggguggucuc

SEQ ID NO: 602692 - RNA, 24 nt, Human
caccaugcccagcuaguuuuugua

SEQ ID NO: 602693 - RNA, 24 nt, Human
caccauuugggccaggcuggucuu

SEQ ID NO: 602694 - RNA, 22 nt, Human
cacccaccucggccucccaaag

SEQ ID NO: 602695 - RNA, 23 nt, Human
cacccaccucggccucccaaagu

SEQ ID NO: 602696 - RNA, 20 nt, Human
cacuauguugcccaggcuag

SEQ ID NO: 602697 - RNA, 22 nt, Human
cacuauguugcccaggcuaguc

SEQ ID NO: 602698 - RNA, 24 nt, Human
cacuauguugcccaggcuagucuu

SEQ ID NO: 602699 - RNA, 22 nt, Human
cacuccagcuugggcgacagag

SEQ ID NO: 602700 - RNA, 22 nt, Human
cacuccagcuugggcgacagag

SEQ ID NO: 602701 - RNA, 24 nt, Human
cacuccagcuugggcgacagagug

SEQ ID NO: 602702 - RNA, 24 nt, Human
cacuccguuguccaggcuggagug

SEQ ID NO: 602703 - RNA, 23 nt, Human
cacugcaaccuccacuuccuggg

SEQ ID NO: 602704 - RNA, 19 nt, Human
cacugcacuccagcuuggg

SEQ ID NO: 602705 - RNA, 20 nt, Human
cacugcacuccagcuugggc

SEQ ID NO: 602706 - RNA, 20 nt, Human
cacugcacuccagcuugggc

SEQ ID NO: 602707 - RNA, 22 nt, Human
cacugcacuccagcuugggcga

SEQ ID NO: 602708 - RNA, 24 nt, Human
cacugcacuccagcuugggcgaca

SEQ ID NO: 602709 - RNA, 20 nt, Human
cagccuccugaguagcuggg

SEQ ID NO: 602710 - RNA, 18 nt, Human
caggcuagucuugaacuu

SEQ ID NO: 602711 - RNA, 18 nt, Human
caggguuucaccauuugg

SEQ ID NO: 602712 - RNA, 21 nt, Human
caggugcccgccaccacaccc

SEQ ID NO: 602713 - RNA, 22 nt, Human
cagugagauggggacacuuucu

SEQ ID NO: 602714 - RNA, 18 nt, Human
cagugucagaaaucaggu

SEQ ID NO: 602715 - RNA, 18 nt, Human
cauuugggccaggcuggu

SEQ ID NO: 602716 - RNA, 19 nt, Human
ccaaagugcugggauuaca

SEQ ID NO: 602717 - RNA, 24 nt, Human
ccaaagugcugggauuacaagcau

SEQ ID NO: 602718 - RNA, 22 nt, Human
ccaaagugcugggauuacaggc

SEQ ID NO: 602719 - RNA, 22 nt, Human
ccaaagugcugggauuacaggc

SEQ ID NO: 602720 - RNA, 24 nt, Human
ccaaagugcugggauuacaggcgu

SEQ ID NO: 602721 - RNA, 19 nt, Human
ccaaauggaccaaucacaa

SEQ ID NO: 602722 - RNA, 20 nt, Human
ccaaauggaccaaucacaaa

SEQ ID NO: 602723 - RNA, 23 nt, Human
ccacaaccuccaccucccagguu

SEQ ID NO: 602724 - RNA, 24 nt, Human
ccacaaccuccaccucccagguuc

SEQ ID NO: 602725 - RNA, 20 nt, Human
ccacugcacuccagcuuggg

SEQ ID NO: 602726 - RNA, 20 nt, Human
ccacugcacuccagcuuggg

SEQ ID NO: 602727 - RNA, 21 nt, Human
ccacugcacuccagcuugggc

SEQ ID NO: 602728 - RNA, 21 nt, Human
ccacugcacuccagcuugggc

SEQ ID NO: 602729 - RNA, 23 nt, Human
ccacugcacuccagcuugggcga

SEQ ID NO: 602730 - RNA, 24 nt, Human
ccacugcacuccagcuugggcgac

SEQ ID NO: 602731 - RNA, 23 nt, Human
ccagaaugcugggauuacaggca

SEQ ID NO: 602732 - RNA, 19 nt, Human
ccagauucaggaccuuaca

SEQ ID NO: 602733 - RNA, 24 nt, Human
ccaggcuagucuugaacuucuggg

SEQ ID NO: 602734 - RNA, 24 nt, Human
cccagaaugcugggauuacaggca

SEQ ID NO: 602735 - RNA, 24 nt, Human
cccaggcugagccggcgcggaggc

SEQ ID NO: 602736 - RNA, 20 nt, Human
cccagguucaagcgauucuc

SEQ ID NO: 602737 - RNA, 23 nt, Human
cccagguucaagcgauucuccug

SEQ ID NO: 602738 - RNA, 22 nt, Human
cccaugcagcuuuauucaccuc

SEQ ID NO: 602739 - RNA, 19 nt, Human
cccgaguagcugggacuau

SEQ ID NO: 602740 - RNA, 24 nt, Human
cccgaguagcugggacuauaggcg

SEQ ID NO: 602741 - RNA, 21 nt, Human
cccgccaccacacccagcuaa

SEQ ID NO: 602742 - RNA, 24 nt, Human
ccgagucucacuauguugcccagg

SEQ ID NO: 602743 - RNA, 19 nt, Human
ccgcgcccggccuauuaug

SEQ ID NO: 602744 - RNA, 22 nt, Human
ccuccacuuccuggguucaagu

SEQ ID NO: 602745 - RNA, 24 nt, Human
ccucccagguucaagcgauucucc

SEQ ID NO: 602746 - RNA, 22 nt, Human
ccugaccuugugauccacccac

SEQ ID NO: 602747 - RNA, 22 nt, Human
ccugaguagcugggauuacagg

SEQ ID NO: 602748 - RNA, 23 nt, Human
ccugaguagcugggauuacaggu

SEQ ID NO: 602749 - RNA, 24 nt, Human
ccugaguagcugggauuacaggug

SEQ ID NO: 602750 - RNA, 22 nt, Human
ccugaucucaagugaucugccc

SEQ ID NO: 602751 - RNA, 20 nt, Human
ccuggguucaagugauucuc

SEQ ID NO: 602752 - RNA, 22 nt, Human
ccuguaagggcaacuuccuaaa

SEQ ID NO: 602753 - RNA, 21 nt, Human
ccuguaguuccagcuacucca

SEQ ID NO: 602754 - RNA, 22 nt, Human
ccuguaguuccagcuacuccag

SEQ ID NO: 602755 - RNA, 19 nt, Human
ccugucucauuuuaaaacc

SEQ ID NO: 602756 - RNA, 24 nt, Human
cgacagagugaaacucugucucua

SEQ ID NO: 602757 - RNA, 21 nt, Human
cguuguccaggcuggagugca

SEQ ID NO: 602758 - RNA, 20 nt, Human
cucaaaggcaccaauaacag

SEQ ID NO: 602759 - RNA, 24 nt, Human
cucaagcaauccuccugcuucagc

SEQ ID NO: 602760 - RNA, 18 nt, Human
cucaagugaucugcccgc

SEQ ID NO: 602761 - RNA, 21 nt, Human
cucaagugaucugcccgccuc

SEQ ID NO: 602762 - RNA, 24 nt, Human
cucaccacaaccuccaccucccag

SEQ ID NO: 602763 - RNA, 24 nt, Human
cucacugcaaccuccacuuccugg

SEQ ID NO: 602764 - RNA, 24 nt, Human
cucagccucccgaguagcugggac

SEQ ID NO: 602765 - RNA, 24 nt, Human
cucagccuccugaguagcugggau

SEQ ID NO: 602766 - RNA, 25 nt, Human
cucauaauuccaauacauacaucca

SEQ ID NO: 602767 - RNA, 19 nt, Human
cucauuaugcccuagaaca

SEQ ID NO: 602768 - RNA, 18 nt, Human
cuccugaccuugugaucc

SEQ ID NO: 602769 - RNA, 22 nt, Human
cuccugccucagccuccugagu

SEQ ID NO: 602770 - RNA, 19 nt, Human
cucugagaucagaaaaguc

SEQ ID NO: 602771 - RNA, 21 nt, Human
cugaguagcugggauuacagg

SEQ ID NO: 602772 - RNA, 21 nt, Human
cugcccgccucggccucccag

SEQ ID NO: 602773 - RNA, 23 nt, Human
cugccucagccuccugaguagcu

SEQ ID NO: 602774 - RNA, 20 nt, Human
cugggcucaagcaauccucc

SEQ ID NO: 602775 - RNA, 22 nt, Human
cugucaaaaauaugugcuguua

SEQ ID NO: 602776 - RNA, 18 nt, Human
cugucacccaggcuggag

SEQ ID NO: 602777 - RNA, 24 nt, Human
cugucucuauuccacugaacaaaa

SEQ ID NO: 602778 - RNA, 21 nt, Human
cuguuuucuguacacuuuuag

SEQ ID NO: 602779 - RNA, 21 nt, Human
cuuacucugucacccaggcug

SEQ ID NO: 602780 - RNA, 21 nt, Human
cuuccuggguucaagugauuc

SEQ ID NO: 602781 - RNA, 25 nt, Human
cuucugggcucaagcaauccuccug

SEQ ID NO: 602782 - RNA, 20 nt, Human
cuugaacuucugggcucaag

SEQ ID NO: 602783 - RNA, 25 nt, Human
cuuggcccaggccucggccucuuuc

SEQ ID NO: 602784 - RNA, 24 nt, Human
gaacuucugggcucaagcaauccu

SEQ ID NO: 602785 - RNA, 21 nt, Human
gaagagacccuucuugacuca

SEQ ID NO: 602786 - RNA, 21 nt, Human
gacagagugaaacucugucuc

SEQ ID NO: 602787 - RNA, 22 nt, Human
gaccuugugauccacccaccuc

SEQ ID NO: 602788 - RNA, 22 nt, Human
gaccuugugauccacccaccuc

SEQ ID NO: 602789 - RNA, 24 nt, Human
gaccuugugauccacccaccucgg

SEQ ID NO: 602790 - RNA, 24 nt, Human
gagacgggguuucaccacguuggc

SEQ ID NO: 602791 - RNA, 20 nt, Human
gaggcuccggcgagcggcgg

SEQ ID NO: 602792 - RNA, 18 nt, Human
gauuacaagcaugagcca

SEQ ID NO: 602793 - RNA, 22 nt, Human
gauuacaagcaugagccacugc

SEQ ID NO: 602794 - RNA, 23 nt, Human
gauuacaagcaugagccacugca

SEQ ID NO: 602795 - RNA, 18 nt, Human
gauuacaggcaagagcca

SEQ ID NO: 602796 - RNA, 19 nt, Human
gauuacaggcaagagccac

SEQ ID NO: 602797 - RNA, 18 nt, Human
gauuacaggcgugagcca

SEQ ID NO: 602798 - RNA, 22 nt, Human
gauuacaggcgugagccaccgc

SEQ ID NO: 602799 - RNA, 22 nt, Human
gauuacaggcgugagccaccgc

SEQ ID NO: 602800 - RNA, 18 nt, Human
gauuacaggugcccgcca

SEQ ID NO: 602801 - RNA, 21 nt, Human
gauucuccugccucagccucc

SEQ ID NO: 602802 - RNA, 21 nt, Human
gauugugccacugcacuccag

SEQ ID NO: 602803 - RNA, 21 nt, Human
gcaaaaaagccaccaugccca

SEQ ID NO: 602804 - RNA, 22 nt, Human
gcaaccuccacuuccuggguuc

SEQ ID NO: 602805 - RNA, 24 nt, Human
gcacuccagcuugggcgacagagu

SEQ ID NO: 602806 - RNA, 22 nt, Human
gccacugcacuccagcuugggc

SEQ ID NO: 602807 - RNA, 24 nt, Human
gccacugcacuccagcuugggcga

SEQ ID NO: 602808 - RNA, 23 nt, Human
gccucggccucccagaaugcugg

SEQ ID NO: 602809 - RNA, 23 nt, Human
gcgacagagugaaacucugucuc

SEQ ID NO: 602810 - RNA, 23 nt, Human
gcgauucuccugccucagccucc

SEQ ID NO: 602811 - RNA, 19 nt, Human
gcuggagugcaguggcacg

SEQ ID NO: 602812 - RNA, 24 nt, Human
gcuucagcuucccaaagugcuggg

SEQ ID NO: 602813 - RNA, 22 nt, Human
ggauuacaagcaugagccacug

SEQ ID NO: 602814 - RNA, 19 nt, Human
ggauuacaggcaagagcca

SEQ ID NO: 602815 - RNA, 23 nt, Human
ggccaggcuggucuugaacuccu

SEQ ID NO: 602816 - RNA, 19 nt, Human
ggcucaagcaauccuccug

SEQ ID NO: 602817 - RNA, 23 nt, Human
ggcuggucuugaacuccugaccu

SEQ ID NO: 602818 - RNA, 19 nt, Human
gggcucaagcaauccuccu

SEQ ID NO: 602819 - RNA, 20 nt, Human
gggcucaagcaauccuccug

SEQ ID NO: 602820 - RNA, 23 nt, Human
ggggagaaaacagauuaacacaa

SEQ ID NO: 602821 - RNA, 23 nt, Human
gggguuucaccacguuggccagg

SEQ ID NO: 602822 - RNA, 22 nt, Human
ggguuucaccacguuggccagg

SEQ ID NO: 602823 - RNA, 20 nt, Human
ggucuugaacuccugaccuu

SEQ ID NO: 602824 - RNA, 23 nt, Human
gguggucucgaacuccugaucuc

SEQ ID NO: 602825 - RNA, 18 nt, Human
guagagaccgagucucac

SEQ ID NO: 602826 - RNA, 22 nt, Human
guagagaccgagucucacuaug

SEQ ID NO: 602827 - RNA, 24 nt, Human
gugauccacccaccucggccuccc

SEQ ID NO: 602828 - RNA, 24 nt, Human
gugaucugcccgccucggccuccc

SEQ ID NO: 602829 - RNA, 24 nt, Human
gugauucucgugccucagccuccc

SEQ ID NO: 602830 - RNA, 22 nt, Human
gugccucagccucccgaguagc

SEQ ID NO: 602831 - RNA, 18 nt, Human
guuggccaggguggucuc

SEQ ID NO: 602832 - RNA, 18 nt, Human
guuguccaggcuggagug

SEQ ID NO: 602833 - RNA, 24 nt, Human
guuuuuguauuuuuaguagagacg

SEQ ID NO: 602834 - RNA, 23 nt, Human
uaaaaagucaaauuccauuuccu

SEQ ID NO: 602835 - RNA, 23 nt, Human
uaaaacagaaacuugaagccaaa

SEQ ID NO: 602836 - RNA, 24 nt, Human
uaaaacagaaacuugaagccaaac

SEQ ID NO: 602837 - RNA, 24 nt, Human
uaaaacuugauuauguagaaguuu

SEQ ID NO: 602838 - RNA, 22 nt, Human
uaaaucucuguugaaaacacug

SEQ ID NO: 602839 - RNA, 21 nt, Human
uaaaugaaaauuaaguuucuu

SEQ ID NO: 602840 - RNA, 23 nt, Human
uaacuaauaucaguagccaugga

SEQ ID NO: 602841 - RNA, 22 nt, Human
uaagaucacauaagcccaagag

SEQ ID NO: 602842 - RNA, 21 nt, Human
uaagugauucuuuacuauacu

SEQ ID NO: 602843 - RNA, 22 nt, Human
uaauuuguaaagacaaaaaccu

SEQ ID NO: 602844 - RNA, 24 nt, Human
uaauuuuuguauauuuaguagaga

SEQ ID NO: 602845 - RNA, 22 nt, Human
uacaacugaagcagugucagaa

SEQ ID NO: 602846 - RNA, 24 nt, Human
uacaagcaugagccacugcaucca

SEQ ID NO: 602847 - RNA, 24 nt, Human
uacaggcaagagccacuacgccca

SEQ ID NO: 602848 - RNA, 23 nt, Human
uacaggcgugagccaccgcgccc

SEQ ID NO: 602849 - RNA, 24 nt, Human
uacaggugcccgccaccacaccca

SEQ ID NO: 602850 - RNA, 27 nt, Human
uaccauaaaacuguagaaucucaagca

SEQ ID NO: 602851 - RNA, 18 nt, Human
uacuccagaggcugaggg

SEQ ID NO: 602852 - RNA, 24 nt, Human
uacucugucacccaggcuggagug

SEQ ID NO: 602853 - RNA, 21 nt, Human
uagaaacccccaaaacaucag

SEQ ID NO: 602854 - RNA, 22 nt, Human
uagaaacccccaaaacaucagg

SEQ ID NO: 602855 - RNA, 23 nt, Human
uagaacaucauuauacucuaaaa

SEQ ID NO: 602856 - RNA, 18 nt, Human
uagaaucucaagcacaag

SEQ ID NO: 602857 - RNA, 24 nt, Human
uagaaucucaagcacaaguaaguu

SEQ ID NO: 602858 - RNA, 20 nt, Human
uagagacaggguuucaccau

SEQ ID NO: 602859 - RNA, 22 nt, Human
uagagacgggguuucaccacgu

SEQ ID NO: 602860 - RNA, 19 nt, Human
uaguagagacaggguuuca

SEQ ID NO: 602861 - RNA, 24 nt, Human
uaguagagacgggguuucaccacg

SEQ ID NO: 602862 - RNA, 24 nt, Human
uagucuugaacuucugggcucaag

SEQ ID NO: 602863 - RNA, 18 nt, Human
uagugccacuauaaggca

SEQ ID NO: 602864 - RNA, 24 nt, Human
uaguuuuuguauuuuuaguagaga

SEQ ID NO: 602865 - RNA, 24 nt, Human
uauaaaacagaaacuugaagccaa

SEQ ID NO: 602866 - RNA, 20 nt, Human
uauaccaugaaaccaauucc

SEQ ID NO: 602867 - RNA, 21 nt, Human
uaucacgaaagcaaauuccca

SEQ ID NO: 602868 - RNA, 22 nt, Human
uauggcaaaauuuacugguguc

SEQ ID NO: 602869 - RNA, 20 nt, Human
uauguugcccaggcuagucu

SEQ ID NO: 602870 - RNA, 23 nt, Human
uauguugcccaggcuagucuuga

SEQ ID NO: 602871 - RNA, 24 nt, Human
uauguugcccaggcuagucuugaa

SEQ ID NO: 602872 - RNA, 24 nt, Human
uauuuaguagagacaggguuucac

SEQ ID NO: 602873 - RNA, 18 nt, Human
uauuuuauacuguggugc

SEQ ID NO: 602874 - RNA, 22 nt, Human
ucacauaagcccaagaggcugc

SEQ ID NO: 602875 - RNA, 24 nt, Human
ucaccacaaccuccaccucccagg

SEQ ID NO: 602876 - RNA, 27 nt, Human
ucaccacaaccuccaccucccagguuc

SEQ ID NO: 602877 - RNA, 24 nt, Human
ucaccacguuggccaggguggucu

SEQ ID NO: 602878 - RNA, 22 nt, Human
ucacccaggcuggagugcagug

SEQ ID NO: 602879 - RNA, 24 nt, Human
ucacugcaaccuccacuuccuggg

SEQ ID NO: 602880 - RNA, 25 nt, Human
ucacugcaaccuccacuuccugggu

SEQ ID NO: 602881 - RNA, 26 nt, Human
ucacugcaaccuccacuuccuggguu

SEQ ID NO: 602882 - RNA, 19 nt, Human
ucagaaaagucuggccuaa

SEQ ID NO: 602883 - RNA, 23 nt, Human
ucagccucccgaguagcugggac

SEQ ID NO: 602884 - RNA, 20 nt, Human
ucagccuccugaguagcugg

SEQ ID NO: 602885 - RNA, 20 nt, Human
uccacuguauuuuagccaga

SEQ ID NO: 602886 - RNA, 18 nt, Human
uccagcuugggcgacaga

SEQ ID NO: 602887 - RNA, 22 nt, Human
uccagcuugggcgacagaguga

SEQ ID NO: 602888 - RNA, 18 nt, Human
ucccaaagugcugggauu

SEQ ID NO: 602889 - RNA, 24 nt, Human
ucccaaagugcugggauuacaagc

SEQ ID NO: 602890 - RNA, 24 nt, Human
ucccaaagugcugggauuacaggc

SEQ ID NO: 602891 - RNA, 24 nt, Human
ucccagaaugcugggauuacaggc

SEQ ID NO: 602892 - RNA, 21 nt, Human
ucccagguucaagcgauucuc

SEQ ID NO: 602893 - RNA, 24 nt, Human
ucccagguucaagcgauucuccug

SEQ ID NO: 602894 - RNA, 26 nt, Human
ucccgaaggguagccugaccauuggg

SEQ ID NO: 602895 - RNA, 24 nt, Human
ucccgaguagcugggacuauaggc

SEQ ID NO: 602896 - RNA, 24 nt, Human
uccugaguagcugggauuacaggu

SEQ ID NO: 602897 - RNA, 20 nt, Human
uccuggguucaagugauucu

SEQ ID NO: 602898 - RNA, 21 nt, Human
uccuggguucaagugauucuc

SEQ ID NO: 602899 - RNA, 24 nt, Human
uccuggguucaagugauucucgug

SEQ ID NO: 602900 - RNA, 22 nt, Human
uccuuuagauuuccuuaauguu

SEQ ID NO: 602901 - RNA, 18 nt, Human
ucgaaaaaggaaaaaaaa

SEQ ID NO: 602902 - RNA, 18 nt, Human
ucggccucccaaagugcu

SEQ ID NO: 602903 - RNA, 18 nt, Human
ucggccucccagaaugcu

SEQ ID NO: 602904 - RNA, 19 nt, Human
ucuauacgcaauuuuagga

SEQ ID NO: 602905 - RNA, 19 nt, Human
ucucacuauguugcccagg

SEQ ID NO: 602906 - RNA, 26 nt, Human
ucucacuauguugcccaggcuagucu

SEQ ID NO: 602907 - RNA, 27 nt, Human
ucucacuauguugcccaggcuagucuu

SEQ ID NO: 602908 - RNA, 22 nt, Human
ucucacuccguuguccaggcug

SEQ ID NO: 602909 - RNA, 23 nt, Human
ucucacuccguuguccaggcugg

SEQ ID NO: 602910 - RNA, 24 nt, Human
ucucacuccguuguccaggcugga

SEQ ID NO: 602911 - RNA, 21 nt, Human
ucucgaacuccugaucucaag

SEQ ID NO: 602912 - RNA, 19 nt, Human
ucucgcucuguuucccagg

SEQ ID NO: 602913 - RNA, 22 nt, Human
ucucgcucuguuucccaggugc

SEQ ID NO: 602914 - RNA, 23 nt, Human
ucucgcucuguuucccaggugcc

SEQ ID NO: 602915 - RNA, 23 nt, Human
ucucguuuucugaacuuugucuu

SEQ ID NO: 602916 - RNA, 20 nt, Human
ucucuacaaaaagaaaaaaa

SEQ ID NO: 602917 - RNA, 22 nt, Human
ucugcccgccucggccucccag

SEQ ID NO: 602918 - RNA, 24 nt, Human
ucugucacccaggcuggagugcag

SEQ ID NO: 602919 - RNA, 23 nt, Human
ucuguugucuuaaugauaccaau

SEQ ID NO: 602920 - RNA, 23 nt, Human
ucuuacucugucacccaggcugg

SEQ ID NO: 602921 - RNA, 24 nt, Human
ucuuacucugucacccaggcugga

SEQ ID NO: 602922 - RNA, 19 nt, Human
ucuugaacuccugaccuug

SEQ ID NO: 602923 - RNA, 23 nt, Human
ucuugaacuucugggcucaagca

SEQ ID NO: 602924 - RNA, 25 nt, Human
ucuuucauuuuuggcagugagaugg

SEQ ID NO: 602925 - RNA, 20 nt, Human
ugaaaacacuggccaucuau

SEQ ID NO: 602926 - RNA, 20 nt, Human
ugaaggaacuccaaaaaaaa

SEQ ID NO: 602927 - RNA, 19 nt, Human
ugacaagaagcaauauuua

SEQ ID NO: 602928 - RNA, 24 nt, Human
ugacuugcuaucucucaagugcua

SEQ ID NO: 602929 - RNA, 19 nt, Human
ugagacggagucuuacucu

SEQ ID NO: 602930 - RNA, 18 nt, Human
ugaucucaagugaucugc

SEQ ID NO: 602931 - RNA, 24 nt, Human
ugaucucaagugaucugcccgccu

SEQ ID NO: 602932 - RNA, 24 nt, Human
ugcacugcgaguagaaucauuaca

SEQ ID NO: 602933 - RNA, 22 nt, Human
ugcccaggcuagucuugaacuu

SEQ ID NO: 602934 - RNA, 24 nt, Human
ugcccaggcuagucuugaacuucu

SEQ ID NO: 602935 - RNA, 28 nt, Human
ugcccaggcuagucuugaacuucugggc

SEQ ID NO: 602936 - RNA, 22 nt, Human
ugccucagccucccgaguagcu

SEQ ID NO: 602937 - RNA, 24 nt, Human
ugccucagccucccgaguagcugg

SEQ ID NO: 602938 - RNA, 24 nt, Human
ugccucagccuccugaguagcugg

SEQ ID NO: 602939 - RNA, 27 nt, Human
ugcugggauuacaagcaugagccacug

SEQ ID NO: 602940 - RNA, 22 nt, Human
ugcugggauuacaggcaagagc

SEQ ID NO: 602941 - RNA, 24 nt, Human
ugcugggauuacaggcgugagcca

SEQ ID NO: 602942 - RNA, 24 nt, Human
ugcuucagcuucccaaagugcugg

SEQ ID NO: 602943 - RNA, 23 nt, Human
uggagugcaguggcacgaucuua

SEQ ID NO: 602944 - RNA, 24 nt, Human
uggagugcaguggcacgaucuuag

SEQ ID NO: 602945 - RNA, 23 nt, Human
uggagugcaguggcaugauauug

SEQ ID NO: 602946 - RNA, 24 nt, Human
uggagugcaguggcaugauauugg

SEQ ID NO: 602947 - RNA, 18 nt, Human
uggcaaaauuuacuggug

SEQ ID NO: 602948 - RNA, 24 nt, Human
uggcacgaucuuagcucacugcaa

SEQ ID NO: 602949 - RNA, 21 nt, Human
uggcagugagauggggacacu

SEQ ID NO: 602950 - RNA, 21 nt, Human
uggcagugagauggggacacu

SEQ ID NO: 602951 - RNA, 24 nt, Human
uggcaugauauuggcucaccacaa

SEQ ID NO: 602952 - RNA, 24 nt, Human
uggccaggguggucucgaacuccu

SEQ ID NO: 602953 - RNA, 18 nt, Human
ugggacuauaggcgugca

SEQ ID NO: 602954 - RNA, 21 nt, Human
ugggauuacaagcaugagcca

SEQ ID NO: 602955 - RNA, 22 nt, Human
ugggauuacaagcaugagccac

SEQ ID NO: 602956 - RNA, 22 nt, Human
ugggauuacaagcaugagccac

SEQ ID NO: 602957 - RNA, 24 nt, Human
ugggauuacaagcaugagccacug

SEQ ID NO: 602958 - RNA, 26 nt, Human
ugggauuacaagcaugagccacugca

SEQ ID NO: 602959 - RNA, 22 nt, Human
ugggauuacaggcaagagccac

SEQ ID NO: 602960 - RNA, 22 nt, Human
ugggauuacaggcaagagccac

SEQ ID NO: 602961 - RNA, 23 nt, Human
ugggauuacaggcaagagccacu

SEQ ID NO: 602962 - RNA, 24 nt, Human
ugggauuacaggcaagagccacua

SEQ ID NO: 602963 - RNA, 24 nt, Human
ugggauuacaggcaagagccacua

SEQ ID NO: 602964 - RNA, 19 nt, Human
ugggauuacaggcgugagc

SEQ ID NO: 602965 - RNA, 21 nt, Human
ugggauuacaggcgugagcca

SEQ ID NO: 602966 - RNA, 22 nt, Human
ugggauuacaggcgugagccac

SEQ ID NO: 602967 - RNA, 23 nt, Human
ugggauuacaggcgugagccacc

SEQ ID NO: 602968 - RNA, 24 nt, Human
ugggauuacaggcgugagccaccg

SEQ ID NO: 602969 - RNA, 21 nt, Human
ugggauuacaggugcccgcca

SEQ ID NO: 602970 - RNA, 22 nt, Human
ugggauuacaggugcccgccac

SEQ ID NO: 602971 - RNA, 24 nt, Human
ugggauuacaggugcccgccacca

SEQ ID NO: 602972 - RNA, 19 nt, Human
ugggauuguagauugaccu

SEQ ID NO: 602973 - RNA, 24 nt, Human
ugggcucaagcaauccuccugcuu

SEQ ID NO: 602974 - RNA, 22 nt, Human
ugggggucugauaugcuuuuua

SEQ ID NO: 602975 - RNA, 23 nt, Human
uggguucaagugauucucgugcc

SEQ ID NO: 602976 - RNA, 24 nt, Human
ugguagagaccgagucucacuaug

SEQ ID NO: 602977 - RNA, 21 nt, Human
uguagaaguuugcaaaugaaa

SEQ ID NO: 602978 - RNA, 21 nt, Human
uguauuuuuaguagagacggg

SEQ ID NO: 602979 - RNA, 21 nt, Human
ugucauagaaacccccaaaac

SEQ ID NO: 602980 - RNA, 20 nt, Human
uguccaggcuggagugcagu

SEQ ID NO: 602981 - RNA, 21 nt, Human
uguccaggcuggagugcagug

SEQ ID NO: 602982 - RNA, 22 nt, Human
uguccaggcuggagugcagugg

SEQ ID NO: 602983 - RNA, 24 nt, Human
uguccaggcuggagugcaguggca

SEQ ID NO: 602984 - RNA, 20 nt, Human
uguguaaucuacuuaaggug

SEQ ID NO: 602985 - RNA, 24 nt, Human
uguugcugucucuauuccacugaa

SEQ ID NO: 602986 - RNA, 23 nt, Human
uuaauuuuuuuuuuccccagagu

SEQ ID NO: 602987 - RNA, 24 nt, Human
uuacucugucacccaggcuggagu

SEQ ID NO: 602988 - RNA, 24 nt, Human
uuaguagagacaggguuucaccau

SEQ ID NO: 602989 - RNA, 18 nt, Human
uuaguagagacgggguuu

SEQ ID NO: 602990 - RNA, 22 nt, Human
uuaguagagacgggguuucacc

SEQ ID NO: 602991 - RNA, 24 nt, Human
uuaguagagacgggguuucaccac

SEQ ID NO: 602992 - RNA, 25 nt, Human
uuaguagagacgggguuucaccacg

SEQ ID NO: 602993 - RNA, 21 nt, Human
uucaagcgauucuccugccuc

SEQ ID NO: 602994 - RNA, 23 nt, Human
uucaagcgauucuccugccucag

SEQ ID NO: 602995 - RNA, 24 nt, Human
uucaagcgauucuccugccucagc

SEQ ID NO: 602996 - RNA, 23 nt, Human
uucaagugauucucgugccucag

SEQ ID NO: 602997 - RNA, 23 nt, Human
uucuagguauaaauauggaggac

SEQ ID NO: 602998 - RNA, 19 nt, Human
uucugcucaccgccucaag

SEQ ID NO: 602999 - RNA, 24 nt, Human
uugauuggaagggacucugagauc

SEQ ID NO: 603000 - RNA, 19 nt, Human
uuggcccaggccucggccu

SEQ ID NO: 603001 - RNA, 24 nt, Human
uuguccaggcuggagugcaguggc

SEQ ID NO: 603002 - RNA, 23 nt, Human
uugugccacugcacuccagcuug

SEQ ID NO: 603003 - RNA, 18 nt, Human
uuuagccauuucugaaaa

SEQ ID NO: 603004 - RNA, 19 nt, Human
uuucaccacguuggccagg

SEQ ID NO: 603005 - RNA, 22 nt, Human
uuugggccaggcuggucuugaa

SEQ ID NO: 603006 - RNA, 24 nt, Human
uuuuuaguagagacgggguuucac

SEQ ID NO: 603007 - RNA, 20 nt, Human
uuuuuguauauuuaguagag

SEQ ID NO: 603008 - RNA, 20 nt, Human
uuuuuguauuuuuaguagag

SEQ ID NO: 603009 - RNA, 21 nt, Human
uuuuuguauuuuuaguagaga

SEQ ID NO: 603010 - RNA, 19 nt, Human
uuuuuugguagagaccgag

SEQ ID NO: 603011 - RNA, 20 nt, Human
aggaagcccccgaugggggc

SEQ ID NO: 603012 - RNA, 19 nt, Human
aggcaaaaggagguacagg

SEQ ID NO: 603013 - RNA, 19 nt, Human
aggcaaaaggagguacagg

SEQ ID NO: 603014 - RNA, 18 nt, Human
cagagcaguccgccggcc

SEQ ID NO: 603015 - RNA, 22 nt, Human
cagcuucugccagccuccacug

SEQ ID NO: 603016 - RNA, 20 nt, Human
cccguggcugcgcagcucgg

SEQ ID NO: 603017 - RNA, 21 nt, Human
ccucuucagagcaguccgccg

SEQ ID NO: 603018 - RNA, 20 nt, Human
ccugacaccuucuccccacu

SEQ ID NO: 603019 - RNA, 21 nt, Human
cucagcuucugccagccucca

SEQ ID NO: 603020 - RNA, 18 nt, Human
cugacaccuucuccccac

SEQ ID NO: 603021 - RNA, 25 nt, Human
cuuagcuucugucucuggcuuuggc

SEQ ID NO: 603022 - RNA, 21 nt, Human
gacaccuucuccccacuggcu

SEQ ID NO: 603023 - RNA, 21 nt, Human
gagcagagccaggcaaaagga

SEQ ID NO: 603024 - RNA, 18 nt, Human
gagggguagggaucugga

SEQ ID NO: 603025 - RNA, 18 nt, Human
ggaaagggcuucuccccc

SEQ ID NO: 603026 - RNA, 20 nt, Human
gucacgucucagcuucugcc

SEQ ID NO: 603027 - RNA, 21 nt, Human
uaaugaguguuacuccuagac

SEQ ID NO: 603028 - RNA, 19 nt, Human
uagcuucugucucuggcuu

SEQ ID NO: 603029 - RNA, 18 nt, Human
uccccacuggcuuccucu

SEQ ID NO: 603030 - RNA, 21 nt, Human
ucccggaguguggugcugggg

SEQ ID NO: 603031 - RNA, 24 nt, Human
uccuagacagucacgucucagcuu

SEQ ID NO: 603032 - RNA, 20 nt, Human
ucucuggcuuuggcuucacc

SEQ ID NO: 603033 - RNA, 21 nt, Human
ucugccuuagcuucugucucu

SEQ ID NO: 603034 - RNA, 26 nt, Human
ucugccuuagcuucugucucuggcuu

SEQ ID NO: 603035 - RNA, 24 nt, Human
ugccuuagcuucugucucuggcuu

SEQ ID NO: 603036 - RNA, 18 nt, Human
uggccgcggagccugaca

SEQ ID NO: 603037 - RNA, 20 nt, Human
ugggggcugggcucccggag

SEQ ID NO: 603038 - RNA, 21 nt, Human
ugucccagcucucuuagcugg

SEQ ID NO: 603039 - RNA, 23 nt, Human
ugucccagcucucuuagcuggcc

SEQ ID NO: 603040 - RNA, 27 nt, Human
aaacaaauaauauuaacaaccccagag

SEQ ID NO: 603041 - RNA, 21 nt, Human
aaacaugccagaaaaggauuc

SEQ ID NO: 603042 - RNA, 27 nt, Human
aaagaaaaaaaucaaauacucuuaagc

SEQ ID NO: 603043 - RNA, 22 nt, Human
aaauauaucacccuucaaugca

SEQ ID NO: 603044 - RNA, 19 nt, Human
aagacugaaaaauaucgug

SEQ ID NO: 603045 - RNA, 19 nt, Human
aaggucugaaaacuaaguc

SEQ ID NO: 603046 - RNA, 22 nt, Human
aaguaaaggcuccaagucuuaa

SEQ ID NO: 603047 - RNA, 18 nt, Human
acaaccccagagugaacu

SEQ ID NO: 603048 - RNA, 22 nt, Human
accuacagcuacucuguaauga

SEQ ID NO: 603049 - RNA, 20 nt, Human
agaaaaagaaaaaaaucaaa

SEQ ID NO: 603050 - RNA, 20 nt, Human
agccccggaaccucucuucu

SEQ ID NO: 603051 - RNA, 25 nt, Human
aggaaaaaucaaauccaaaguacua

SEQ ID NO: 603052 - RNA, 20 nt, Human
aggucugaaaacuaagucua

SEQ ID NO: 603053 - RNA, 26 nt, Human
augaaacaaauaauauuaacaacccc

SEQ ID NO: 603054 - RNA, 21 nt, Human
caagucuuaaguauccaauuu

SEQ ID NO: 603055 - RNA, 22 nt, Human
caaguguaguaaaaacgaaaac

SEQ ID NO: 603056 - RNA, 20 nt, Human
caaugcauauacaauaguua

SEQ ID NO: 603057 - RNA, 21 nt, Human
cagcccagccccggaaccucu

SEQ ID NO: 603058 - RNA, 19 nt, Human
ccagcccagccccggaacc

SEQ ID NO: 603059 - RNA, 22 nt, Human
cccagccccggaaccucucuuc

SEQ ID NO: 603060 - RNA, 24 nt, Human
cuaccuacagcuacucuguaauga

SEQ ID NO: 603061 - RNA, 23 nt, Human
gaaaaaaccuguaucagcucaaa

SEQ ID NO: 603062 - RNA, 20 nt, Human
gccccggaaccucucuucca

SEQ ID NO: 603063 - RNA, 26 nt, Human
gccccggaaccucucuuccagugcuu

SEQ ID NO: 603064 - RNA, 25 nt, Human
uaaacacauauacaauacaaacuaa

SEQ ID NO: 603065 - RNA, 22 nt, Human
uaacaaccccagagugaacuaa

SEQ ID NO: 603066 - RNA, 23 nt, Human
uaacucaguguacaguacuggau

SEQ ID NO: 603067 - RNA, 19 nt, Human
uaagacugaaaaauaucgu

SEQ ID NO: 603068 - RNA, 25 nt, Human
uaagucuaucagagagaauugcaau

SEQ ID NO: 603069 - RNA, 28 nt, Human
uaguaaaaacgaaaacugaggucaguac

SEQ ID NO: 603070 - RNA, 20 nt, Human
uauaucacccuucaaugcau

SEQ ID NO: 603071 - RNA, 23 nt, Human
uccauggagagccucauuauuuc

SEQ ID NO: 603072 - RNA, 20 nt, Human
ucccucaaaggacauuaaau

SEQ ID NO: 603073 - RNA, 22 nt, Human
ucucacacaagcaauacaaaau

SEQ ID NO: 603074 - RNA, 22 nt, Human
ugaaaaauaucgugagcaaaaa

SEQ ID NO: 603075 - RNA, 19 nt, Human
ugccaaauaucacaucuua

SEQ ID NO: 603076 - RNA, 26 nt, Human
ugcuugaauuuccgccgguacagcgu

SEQ ID NO: 603077 - RNA, 21 nt, Human
uguauuagaaauccucaagca

SEQ ID NO: 603078 - RNA, 26 nt, Human
uguucauccuuccauggagagccuca

SEQ ID NO: 603079 - RNA, 21 nt, Human
uuauaaauauuuuuggguuuu

SEQ ID NO: 603080 - RNA, 19 nt, Human
aaacgccgacccacccccc

SEQ ID NO: 603081 - RNA, 19 nt, Human
aacggagcccucaccugcc

SEQ ID NO: 603082 - RNA, 18 nt, Human
aagcagaaugggaacccg

SEQ ID NO: 603083 - RNA, 19 nt, Human
aaggcacccugcccuggag

SEQ ID NO: 603084 - RNA, 18 nt, Human
acagacagcugaacuggg

SEQ ID NO: 603085 - RNA, 19 nt, Human
acccagaagcuggcacacc

SEQ ID NO: 603086 - RNA, 26 nt, Human
agccaguaaccgguggugugggcaca

SEQ ID NO: 603087 - RNA, 20 nt, Human
agcugcucccuccccucccc

SEQ ID NO: 603088 - RNA, 19 nt, Human
aggacggggagaggaaggg

SEQ ID NO: 603089 - RNA, 21 nt, Human
aggaggaggagggagcggggc

SEQ ID NO: 603090 - RNA, 22 nt, Human
aggaggaggagggagcggggcc

SEQ ID NO: 603091 - RNA, 21 nt, Human
agggacucggagccccaaggc

SEQ ID NO: 603092 - RNA, 21 nt, Human
aguggcagaagcagaauggga

SEQ ID NO: 603093 - RNA, 24 nt, Human
caacggagcccucaccugccugcc

SEQ ID NO: 603094 - RNA, 18 nt, Human
cacacagcuggaaguggc

SEQ ID NO: 603095 - RNA, 20 nt, Human
cacacugugguacuguggga

SEQ ID NO: 603096 - RNA, 19 nt, Human
cacccccacacugggccca

SEQ ID NO: 603097 - RNA, 20 nt, Human
cagaaugggaacccgggcag

SEQ ID NO: 603098 - RNA, 19 nt, Human
cagaccaaggcaacggagc

SEQ ID NO: 603099 - RNA, 24 nt, Human
cagcagcccuggcagcagccucug

SEQ ID NO: 603100 - RNA, 18 nt, Human
caggacggggagaggaag

SEQ ID NO: 603101 - RNA, 21 nt, Human
cauggccaaguccuguguucc

SEQ ID NO: 603102 - RNA, 19 nt, Human
cauucaccccccugccauc

SEQ ID NO: 603103 - RNA, 19 nt, Human
ccagacccugcuucugaca

SEQ ID NO: 603104 - RNA, 24 nt, Human
ccauagaaugacccagaagcuggc

SEQ ID NO: 603105 - RNA, 19 nt, Human
cccacacagggacaggaga

SEQ ID NO: 603106 - RNA, 21 nt, Human
cccaccacugacuccagggga

SEQ ID NO: 603107 - RNA, 21 nt, Human
cccagaccaaggcaacggagc

SEQ ID NO: 603108 - RNA, 18 nt, Human
cccauagaaugacccaga

SEQ ID NO: 603109 - RNA, 19 nt, Human
ccccacacugggcccaagc

SEQ ID NO: 603110 - RNA, 19 nt, Human
ccccacacugggcccaagc

SEQ ID NO: 603111 - RNA, 22 nt, Human
ccccugcuucccugacuccccu

SEQ ID NO: 603112 - RNA, 21 nt, Human
cccgaguccacugggggguga

SEQ ID NO: 603113 - RNA, 18 nt, Human
cccgccgucugcccggag

SEQ ID NO: 603114 - RNA, 26 nt, Human
ccggcggccuccucguuccgccuccc

SEQ ID NO: 603115 - RNA, 18 nt, Human
ccucaccugccugccacc

SEQ ID NO: 603116 - RNA, 22 nt, Human
ccugaacuaaggcagcaucuuu

SEQ ID NO: 603117 - RNA, 18 nt, Human
ccuggcccugccauucac

SEQ ID NO: 603118 - RNA, 23 nt, Human
cgaaggcaccaaaaggugaaggc

SEQ ID NO: 603119 - RNA, 23 nt, Human
cguuccgccucccaguuuuccca

SEQ ID NO: 603120 - RNA, 23 nt, Human
cuacuggaaggcacccugcccug

SEQ ID NO: 603121 - RNA, 19 nt, Human
cuccucucuggcccccuca

SEQ ID NO: 603122 - RNA, 20 nt, Human
cucgcugaagccccauucca

SEQ ID NO: 603123 - RNA, 22 nt, Human
cugcggagaaagaugcuccugg

SEQ ID NO: 603124 - RNA, 24 nt, Human
cuggaggcuucccuuggcuacugg

SEQ ID NO: 603125 - RNA, 18 nt, Human
cuggcccccucauccagg

SEQ ID NO: 603126 - RNA, 20 nt, Human
cugggcccacacagggacag

SEQ ID NO: 603127 - RNA, 23 nt, Human
cuuggcgcuaacacagccucggc

SEQ ID NO: 603128 - RNA, 24 nt, Human
gaagccccauuccagacccugcuu

SEQ ID NO: 603129 - RNA, 21 nt, Human
gaaugacccagaagcuggcac

SEQ ID NO: 603130 - RNA, 22 nt, Human
gacucggagccccaaggccuuu

SEQ ID NO: 603131 - RNA, 19 nt, Human
gagccaguaaccgguggug

SEQ ID NO: 603132 - RNA, 23 nt, Human
gcauuugacucccaaaacagcuc

SEQ ID NO: 603133 - RNA, 22 nt, Human
gcuaacacagccucggcugcgc

SEQ ID NO: 603134 - RNA, 19 nt, Human
gcucccuccccuccccugc

SEQ ID NO: 603135 - RNA, 18 nt, Human
gcugaacugggucgugcc

SEQ ID NO: 603136 - RNA, 19 nt, Human
ggaagcuucccaccacuga

SEQ ID NO: 603137 - RNA, 18 nt, Human
ggaaggaggaggagggag

SEQ ID NO: 603138 - RNA, 19 nt, Human
ggaggagggagcggggcag

SEQ ID NO: 603139 - RNA, 21 nt, Human
ggcagccugguuccuggcccu

SEQ ID NO: 603140 - RNA, 18 nt, Human
ggcugcggggauuuuauu

SEQ ID NO: 603141 - RNA, 26 nt, Human
gggaacccgggcagccugguuccugg

SEQ ID NO: 603142 - RNA, 18 nt, Human
gggaaggaggaggaggga

SEQ ID NO: 603143 - RNA, 20 nt, Human
gggagaggaagggacucgga

SEQ ID NO: 603144 - RNA, 20 nt, Human
gggcccacacagggacagga

SEQ ID NO: 603145 - RNA, 19 nt, Human
ggugcuaaaugaggaaacg

SEQ ID NO: 603146 - RNA, 22 nt, Human
gugaugccugcugcugaggguu

SEQ ID NO: 603147 - RNA, 24 nt, Human
uagaagaugcuacugguggcccac

SEQ ID NO: 603148 - RNA, 22 nt, Human
ucacuccucucuggcccccuca

SEQ ID NO: 603149 - RNA, 21 nt, Human
uccagagguugcugaggacuc

SEQ ID NO: 603150 - RNA, 18 nt, Human
uccaggggaaggaggagg

SEQ ID NO: 603151 - RNA, 19 nt, Human
ucccaccacugacuccagg

SEQ ID NO: 603152 - RNA, 18 nt, Human
ucccacuacgaggcaggg

SEQ ID NO: 603153 - RNA, 24 nt, Human
uccccuccccugcuucccugacuc

SEQ ID NO: 603154 - RNA, 20 nt, Human
uccuuggcgcuaacacagcc

SEQ ID NO: 603155 - RNA, 24 nt, Human
ucucgccaggaaacggucugcgga

SEQ ID NO: 603156 - RNA, 24 nt, Human
ucucuggaggcuucccuuggcuac

SEQ ID NO: 603157 - RNA, 22 nt, Human
ucugaagccacuuccuugccca

SEQ ID NO: 603158 - RNA, 21 nt, Human
ucuggcccccucauccaggag

SEQ ID NO: 603159 - RNA, 24 nt, Human
ucugugcucucuggaggcuucccu

SEQ ID NO: 603160 - RNA, 21 nt, Human
ugccuggagcucuccgugggg

SEQ ID NO: 603161 - RNA, 23 nt, Human
ugccuggagcucuccguggggcc

SEQ ID NO: 603162 - RNA, 19 nt, Human
uggaaggcacccugcccug

SEQ ID NO: 603163 - RNA, 20 nt, Human
uggcagcagccucugcuaac

SEQ ID NO: 603164 - RNA, 24 nt, Human
ugggaacccgggcagccugguucc

SEQ ID NO: 603165 - RNA, 20 nt, Human
ugggccggguugggaccggc

SEQ ID NO: 603166 - RNA, 19 nt, Human
uggggccagcugaggcugg

SEQ ID NO: 603167 - RNA, 23 nt, Human
uguuccagagguugcugaggacu

SEQ ID NO: 603168 - RNA, 21 nt, Human
uuauucacuccucucuggccc

SEQ ID NO: 603169 - RNA, 18 nt, Human
uucccaccacugacucca

SEQ ID NO: 603170 - RNA, 19 nt, Human
uugcugaggacucuccugg

SEQ ID NO: 603171 - RNA, 19 nt, Human
aaacgcgggcuccuccugg

SEQ ID NO: 603172 - RNA, 24 nt, Human
aaagugcugggaugacagguguga

SEQ ID NO: 603173 - RNA, 18 nt, Human
aacucacaggcucuccuu

SEQ ID NO: 603174 - RNA, 26 nt, Human
acacaagaccuuccccagucaucucu

SEQ ID NO: 603175 - RNA, 23 nt, Human
acaggugugagccaccgcaccca

SEQ ID NO: 603176 - RNA, 19 nt, Human
acucucuuugcccccuucu

SEQ ID NO: 603177 - RNA, 23 nt, Human
acucugggugccagcaucuggag

SEQ ID NO: 603178 - RNA, 18 nt, Human
acucugucauccaggcug

SEQ ID NO: 603179 - RNA, 24 nt, Human
acucugucauccaggcuggagggc

SEQ ID NO: 603180 - RNA, 21 nt, Human
agaccaaggaacagagaccug

SEQ ID NO: 603181 - RNA, 21 nt, Human
agagaagaagccggcaaugua

SEQ ID NO: 603182 - RNA, 21 nt, Human
agaggugcagccggggcugcc

SEQ ID NO: 603183 - RNA, 18 nt, Human
aggccucaagcgcuucuc

SEQ ID NO: 603184 - RNA, 22 nt, Human
aggcuuggaagccaccccagcc

SEQ ID NO: 603185 - RNA, 18 nt, Human
aucucacucugucaucca

SEQ ID NO: 603186 - RNA, 24 nt, Human
caaagugcugggaugacaggugug

SEQ ID NO: 603187 - RNA, 22 nt, Human
caagcgcuucuccugccuuggc

SEQ ID NO: 603188 - RNA, 21 nt, Human
cacaccucuccacacugccca

SEQ ID NO: 603189 - RNA, 19 nt, Human
caccaaagcucauugcagc

SEQ ID NO: 603190 - RNA, 21 nt, Human
caccgcacccagccagagggc

SEQ ID NO: 603191 - RNA, 20 nt, Human
cacuccugcccucccagagg

SEQ ID NO: 603192 - RNA, 22 nt, Human
cacucugucauccaggcuggag

SEQ ID NO: 603193 - RNA, 24 nt, Human
cacucugucauccaggcuggaggg

SEQ ID NO: 603194 - RNA, 22 nt, Human
cagaagccccuuccuugggucu

SEQ ID NO: 603195 - RNA, 23 nt, Human
cagagcccuccacuccugggucu

SEQ ID NO: 603196 - RNA, 19 nt, Human
caguggugccaccaaagcu

SEQ ID NO: 603197 - RNA, 21 nt, Human
ccaaagugcugggaugacagg

SEQ ID NO: 603198 - RNA, 24 nt, Human
ccaaagugcugggaugacaggugu

SEQ ID NO: 603199 - RNA, 22 nt, Human
ccacacugcccagugaagacca

SEQ ID NO: 603200 - RNA, 21 nt, Human
ccaccaagccugacucucuuu

SEQ ID NO: 603201 - RNA, 23 nt, Human
ccaccaagccugacucucuuugc

SEQ ID NO: 603202 - RNA, 20 nt, Human
ccaccagaagccccuuccuu

SEQ ID NO: 603203 - RNA, 22 nt, Human
ccacugaggaugcgccagacac

SEQ ID NO: 603204 - RNA, 26 nt, Human
ccagaagccccuuccuugggucuucc

SEQ ID NO: 603205 - RNA, 23 nt, Human
ccagaggugccuagaaaguagag

SEQ ID NO: 603206 - RNA, 21 nt, Human
ccucaagcgcuucuccugccu

SEQ ID NO: 603207 - RNA, 21 nt, Human
ccucaugccccagccacaggc

SEQ ID NO: 603208 - RNA, 24 nt, Human
ccucucauucugaagagccgggaa

SEQ ID NO: 603209 - RNA, 26 nt, Human
ccugcccucccagaggugccuagaaa

SEQ ID NO: 603210 - RNA, 21 nt, Human
ccugggucuggcaggccaccc

SEQ ID NO: 603211 - RNA, 19 nt, Human
cgcgggcuccuccuggcca

SEQ ID NO: 603212 - RNA, 22 nt, Human
cgcgggcuccuccuggccacac

SEQ ID NO: 603213 - RNA, 18 nt, Human
cggcccaggacgaggaaa

SEQ ID NO: 603214 - RNA, 23 nt, Human
cgugcaccaccacacccagcuaa

SEQ ID NO: 603215 - RNA, 20 nt, Human
cucacagagcccuccacucc

SEQ ID NO: 603216 - RNA, 24 nt, Human
cucacucugucauccaggcuggag

SEQ ID NO: 603217 - RNA, 24 nt, Human
cucucuguccuacuugccucccgg

SEQ ID NO: 603218 - RNA, 21 nt, Human
cugaagagccgggaaguccau

SEQ ID NO: 603219 - RNA, 23 nt, Human
cugccuuggccucccaaagugcu

SEQ ID NO: 603220 - RNA, 21 nt, Human
cugcuggagagugguuggacc

SEQ ID NO: 603221 - RNA, 22 nt, Human
cuucucaccccuuuccaugucc

SEQ ID NO: 603222 - RNA, 20 nt, Human
cuugccucccggcuuucucu

SEQ ID NO: 603223 - RNA, 23 nt, Human
gaagccaccccagccaccaagcc

SEQ ID NO: 603224 - RNA, 21 nt, Human
gaccugcgcagggcucacccc

SEQ ID NO: 603225 - RNA, 21 nt, Human
gaggcuuggaagccaccccag

SEQ ID NO: 603226 - RNA, 18 nt, Human
gaugacaggugugagcca

SEQ ID NO: 603227 - RNA, 22 nt, Human
gccuuggccucccaaagugcug

SEQ ID NO: 603228 - RNA, 18 nt, Human
gcgugcaccaccacaccc

SEQ ID NO: 603229 - RNA, 18 nt, Human
gcuucuccugccuuggcc

SEQ ID NO: 603230 - RNA, 20 nt, Human
gcuucuccugccuuggccuc

SEQ ID NO: 603231 - RNA, 24 nt, Human
ggaacagagaccugcgcagggcuc

SEQ ID NO: 603232 - RNA, 24 nt, Human
ggcuggucuugaacuccaggccuc

SEQ ID NO: 603233 - RNA, 24 nt, Human
gggaaggagaggugcagccggggc

SEQ ID NO: 603234 - RNA, 19 nt, Human
gggaugacaggugugagcc

SEQ ID NO: 603235 - RNA, 24 nt, Human
gggcccucacagagcccuccacuc

SEQ ID NO: 603236 - RNA, 21 nt, Human
gguugucaucugcucccacuc

SEQ ID NO: 603237 - RNA, 23 nt, Human
gugguuggacccuguguuucugg

SEQ ID NO: 603238 - RNA, 24 nt, Human
uaaauugcacaggcuggucuugaa

SEQ ID NO: 603239 - RNA, 22 nt, Human
uaauuuugguauuuuuuggugg

SEQ ID NO: 603240 - RNA, 25 nt, Human
uaauuuugguauuuuuugguggaga

SEQ ID NO: 603241 - RNA, 19 nt, Human
uagacccuggucuggacaa

SEQ ID NO: 603242 - RNA, 22 nt, Human
uaggugggacuacaugcgugca

SEQ ID NO: 603243 - RNA, 19 nt, Human
ucacagagcccuccacucc

SEQ ID NO: 603244 - RNA, 24 nt, Human
ucacaggcucuccuuccucagccu

SEQ ID NO: 603245 - RNA, 21 nt, Human
ucagugagggcuuguuuccug

SEQ ID NO: 603246 - RNA, 22 nt, Human
uccacugaggaugcgccagaca

SEQ ID NO: 603247 - RNA, 23 nt, Human
ucccaaagugcugggaugacagg

SEQ ID NO: 603248 - RNA, 23 nt, Human
uccccagucaucucucuguccua

SEQ ID NO: 603249 - RNA, 22 nt, Human
ucccgggcccucacagagcccu

SEQ ID NO: 603250 - RNA, 23 nt, Human
ucccuguccugaguccgaauucc

SEQ ID NO: 603251 - RNA, 19 nt, Human
uccuccuggccacaccucu

SEQ ID NO: 603252 - RNA, 24 nt, Human
uccugaguccgaauucccgggccc

SEQ ID NO: 603253 - RNA, 22 nt, Human
ucuaaaaugguugucaucugcu

SEQ ID NO: 603254 - RNA, 21 nt, Human
ucucaccccuuuccauguccc

SEQ ID NO: 603255 - RNA, 23 nt, Human
ucucacucugucauccaggcugg

SEQ ID NO: 603256 - RNA, 24 nt, Human
ucucacucugucauccaggcugga

SEQ ID NO: 603257 - RNA, 23 nt, Human
ucucucuguccuacuugccuccc

SEQ ID NO: 603258 - RNA, 24 nt, Human
ucugaagagccgggaaguccaucu

SEQ ID NO: 603259 - RNA, 23 nt, Human
ugcagccggggcugccucaugcc

SEQ ID NO: 603260 - RNA, 18 nt, Human
ugccagaguagacccugg

SEQ ID NO: 603261 - RNA, 18 nt, Human
ugccagcaucuggaguug

SEQ ID NO: 603262 - RNA, 21 nt, Human
ugccucccggcuuucucuucc

SEQ ID NO: 603263 - RNA, 21 nt, Human
ugcgugcaccaccacacccag

SEQ ID NO: 603264 - RNA, 22 nt, Human
ugcucccacuccugcccuccca

SEQ ID NO: 603265 - RNA, 18 nt, Human
ugcugggaugacaggugu

SEQ ID NO: 603266 - RNA, 24 nt, Human
ugggacuacaugcgugcaccacca

SEQ ID NO: 603267 - RNA, 22 nt, Human
ugggaugacaggugugagccac

SEQ ID NO: 603268 - RNA, 23 nt, Human
ugggaugacaggugugagccacc

SEQ ID NO: 603269 - RNA, 24 nt, Human
ugggaugacaggugugagccaccg

SEQ ID NO: 603270 - RNA, 22 nt, Human
uucccgggcccucacagagccc

SEQ ID NO: 603271 - RNA, 20 nt, Human
uuccucagccuccugaguag

SEQ ID NO: 603272 - RNA, 20 nt, Human
uuccuugggucuuccagaca

SEQ ID NO: 603273 - RNA, 22 nt, Human
uuccuugggucuuccagacaca

SEQ ID NO: 603274 - RNA, 21 nt, Human
uucucaccccuuuccaugucc

SEQ ID NO: 603275 - RNA, 23 nt, Human
uuggaagccaccccagccaccaa

SEQ ID NO: 603276 - RNA, 18 nt, Human
uuggccucccaaagugcu

SEQ ID NO: 603277 - RNA, 21 nt, Human
uuugaacacuggagaagugag

SEQ ID NO: 603278 - RNA, 19 nt, Human
uuuuugguggagaugggau

SEQ ID NO: 603279 - RNA, 18 nt, Human
uuuuuugguggagauggg

SEQ ID NO: 603280 - RNA, 24 nt, Human
aaaaaagaaucuucuguaaguaaa

SEQ ID NO: 603281 - RNA, 21 nt, Human
aaaccaaaccaaaaaggagga

SEQ ID NO: 603282 - RNA, 20 nt, Human
aaagugagagcagcuacaga

SEQ ID NO: 603283 - RNA, 21 nt, Human
aagaauuuguagcuggaaaca

SEQ ID NO: 603284 - RNA, 19 nt, Human
aagacaucugaaugugaug

SEQ ID NO: 603285 - RNA, 21 nt, Human
aagagcaacuuguaggcucua

SEQ ID NO: 603286 - RNA, 22 nt, Human
aaguaaacugguaguuuucuua

SEQ ID NO: 603287 - RNA, 25 nt, Human
acaaaaauuaaccgcuuguauuuca

SEQ ID NO: 603288 - RNA, 21 nt, Human
acaaagugagagcagcuacag

SEQ ID NO: 603289 - RNA, 22 nt, Human
acaaagugagagcagcuacaga

SEQ ID NO: 603290 - RNA, 20 nt, Human
acuuguuuccuauccucuga

SEQ ID NO: 603291 - RNA, 21 nt, Human
agaaaagacaaagugagagca

SEQ ID NO: 603292 - RNA, 21 nt, Human
agaaggcaaaccauuuaaaca

SEQ ID NO: 603293 - RNA, 23 nt, Human
agaauacauuacauguauaccag

SEQ ID NO: 603294 - RNA, 19 nt, Human
agcaaugugggcuuuuccc

SEQ ID NO: 603295 - RNA, 23 nt, Human
aggcaaaccauuuaaacaaugaa

SEQ ID NO: 603296 - RNA, 22 nt, Human
agggaggcggcacgccuugggg

SEQ ID NO: 603297 - RNA, 21 nt, Human
aguaagcauuugacucccuac

SEQ ID NO: 603298 - RNA, 23 nt, Human
aguuagugauaauugguaguaug

SEQ ID NO: 603299 - RNA, 18 nt, Human
augaaaccuacuguuugg

SEQ ID NO: 603300 - RNA, 18 nt, Human
auguaacuuggguucucu

SEQ ID NO: 603301 - RNA, 21 nt, Human
caaaccaaaaaggaggagagc

SEQ ID NO: 603302 - RNA, 19 nt, Human
caauaccuacauaaagaau

SEQ ID NO: 603303 - RNA, 21 nt, Human
cacuaacaaggaucagaaaaa

SEQ ID NO: 603304 - RNA, 19 nt, Human
cacuguucauuaagaaaac

SEQ ID NO: 603305 - RNA, 24 nt, Human
cauaagcaaacauuccugaaagug

SEQ ID NO: 603306 - RNA, 20 nt, Human
ccaaaaccaaaccaaaaagg

SEQ ID NO: 603307 - RNA, 21 nt, Human
ccaauguauccgcaacuccua

SEQ ID NO: 603308 - RNA, 25 nt, Human
ccaguauauccaauguauccgcaac

SEQ ID NO: 603309 - RNA, 24 nt, Human
ccagugucggcguaaacuuucucc

SEQ ID NO: 603310 - RNA, 22 nt, Human
ccauacgcgcuaauacaggcca

SEQ ID NO: 603311 - RNA, 18 nt, Human
ccugaccaacgcauggaa

SEQ ID NO: 603312 - RNA, 23 nt, Human
ccugcgacugagaacagggaggc

SEQ ID NO: 603313 - RNA, 24 nt, Human
cgacugagaacagggaggcggcac

SEQ ID NO: 603314 - RNA, 25 nt, Human
cgagggcccgaggccauacgcgcua

SEQ ID NO: 603315 - RNA, 21 nt, Human
cuaagagaaagaguuugcagu

SEQ ID NO: 603316 - RNA, 19 nt, Human
cugaauacuuaaaauagac

SEQ ID NO: 603317 - RNA, 28 nt, Human
gaaaagacaaagugagagcagcuacaga

SEQ ID NO: 603318 - RNA, 23 nt, Human
gaagaauuuguagcuggaaacac

SEQ ID NO: 603319 - RNA, 18 nt, Human
gagaacagggaggcggcc

SEQ ID NO: 603320 - RNA, 19 nt, Human
gaggagagcagacaaggcu

SEQ ID NO: 603321 - RNA, 19 nt, Human
gaggagagcagacaaggcu

SEQ ID NO: 603322 - RNA, 20 nt, Human
gaggagagcagacaaggcuu

SEQ ID NO: 603323 - RNA, 24 nt, Human
gagucaguuccaaaaccaaaccaa

SEQ ID NO: 603324 - RNA, 18 nt, Human
gcugcccucuuucuuuuc

SEQ ID NO: 603325 - RNA, 23 nt, Human
ggagucaguuccaaaaccaaacc

SEQ ID NO: 603326 - RNA, 21 nt, Human
gggaggcggcacgccuugggg

SEQ ID NO: 603327 - RNA, 19 nt, Human
gggaucaaaaucuuuucug

SEQ ID NO: 603328 - RNA, 23 nt, Human
uaacaauaccuacauaaagaaua

SEQ ID NO: 603329 - RNA, 22 nt, Human
uaagcauuugacucccuacaua

SEQ ID NO: 603330 - RNA, 18 nt, Human
uaauaagucacaaccaag

SEQ ID NO: 603331 - RNA, 23 nt, Human
uaauaagucacaaccaagacauc

SEQ ID NO: 603332 - RNA, 23 nt, Human
uacagcauacaaaaaauggcaag

SEQ ID NO: 603333 - RNA, 24 nt, Human
uaccagaagagaaauacuuguuuc

SEQ ID NO: 603334 - RNA, 22 nt, Human
uaccaguguuuucagggccccc

SEQ ID NO: 603335 - RNA, 21 nt, Human
uacuguuuggaaaaaagaauc

SEQ ID NO: 603336 - RNA, 19 nt, Human
uacuuguuuccuauccucu

SEQ ID NO: 603337 - RNA, 18 nt, Human
uagaaaaugguggaggca

SEQ ID NO: 603338 - RNA, 19 nt, Human
uagugauaauugguaguau

SEQ ID NO: 603339 - RNA, 18 nt, Human
uauucaaaacacagaaau

SEQ ID NO: 603340 - RNA, 22 nt, Human
uauuuuaggcugcccucuuucu

SEQ ID NO: 603341 - RNA, 20 nt, Human
ucaaaacacagaaauaauca

SEQ ID NO: 603342 - RNA, 18 nt, Human
uccaaaaccaaaccaaaa

SEQ ID NO: 603343 - RNA, 20 nt, Human
uccacaaauaaaaauacagc

SEQ ID NO: 603344 - RNA, 26 nt, Human
uccacaaauaaaaauacagcauacaa

SEQ ID NO: 603345 - RNA, 21 nt, Human
ucccaacgccuuauauauacc

SEQ ID NO: 603346 - RNA, 19 nt, Human
ucccucacguuacaaaaau

SEQ ID NO: 603347 - RNA, 22 nt, Human
ucgccaccaacgcgcucuccca

SEQ ID NO: 603348 - RNA, 19 nt, Human
ucuaaaauguaacuugggu

SEQ ID NO: 603349 - RNA, 23 nt, Human
ucugaccuucaguagaaaaaaaa

SEQ ID NO: 603350 - RNA, 20 nt, Human
ucuuucuuuucuaagagaaa

SEQ ID NO: 603351 - RNA, 18 nt, Human
ugacucggccgucgccac

SEQ ID NO: 603352 - RNA, 23 nt, Human
ugagagcagcuacagaaguagca

SEQ ID NO: 603353 - RNA, 20 nt, Human
ugagaguacuuuucaaaaag

SEQ ID NO: 603354 - RNA, 23 nt, Human
ugagaguacuuuucaaaaaggaa

SEQ ID NO: 603355 - RNA, 22 nt, Human
ugcaguguuauuuuuaacgucu

SEQ ID NO: 603356 - RNA, 22 nt, Human
ugccacacugguaauaagucac

SEQ ID NO: 603357 - RNA, 22 nt, Human
ugccuaacuaaaauugccaaua

SEQ ID NO: 603358 - RNA, 24 nt, Human
ugccuaacuaaaauugccaauaug

SEQ ID NO: 603359 - RNA, 19 nt, Human
uggaaaggaauaagaagug

SEQ ID NO: 603360 - RNA, 21 nt, Human
uuaccaguguuuucagggccc

SEQ ID NO: 603361 - RNA, 22 nt, Human
uuaggcugcccucuuucuuuuc

SEQ ID NO: 603362 - RNA, 21 nt, Human
uuggaaaaaagaaucuucugu

SEQ ID NO: 603363 - RNA, 19 nt, Human
uuuccuauccucugaccuu

SEQ ID NO: 603364 - RNA, 23 nt, Human
uuucuaagagaaagaguuugcag

SEQ ID NO: 603365 - RNA, 21 nt, Human
uuugcaguucuucaaaugguc

SEQ ID NO: 603366 - RNA, 18 nt, Human
uuuguagcuggaaacacu

SEQ ID NO: 603367 - RNA, 18 nt, Human
uuuuuuuuuuuuuuuuug

SEQ ID NO: 603368 - RNA, 25 nt, Human
uuuuuuuuuuuuuuuuuugauuuuu

SEQ ID NO: 603369 - RNA, 18 nt, Human
aaauguggcugggugaag

SEQ ID NO: 603370 - RNA, 20 nt, Human
aacauagugagaugccaucu

SEQ ID NO: 603371 - RNA, 23 nt, Human
aaguggcucacaccuggaauccc

SEQ ID NO: 603372 - RNA, 25 nt, Human
accugagccccgggagauggaggcc

SEQ ID NO: 603373 - RNA, 30 nt, Human
accuggaaucccagcacuuuaggaggccaa

SEQ ID NO: 603374 - RNA, 23 nt, Human
acugcacucaagccugauuuugc

SEQ ID NO: 603375 - RNA, 24 nt, Human
acuuuaggaggccaaggagagagg

SEQ ID NO: 603376 - RNA, 22 nt, Human
agauggaggcugcagugagcca

SEQ ID NO: 603377 - RNA, 21 nt, Human
agccugggcaacauagugaga

SEQ ID NO: 603378 - RNA, 22 nt, Human
agccugggcaacauagugagau

SEQ ID NO: 603379 - RNA, 23 nt, Human
aggaucacuugaggucaggaguu

SEQ ID NO: 603380 - RNA, 24 nt, Human
aggaucacuugaggucaggaguuc

SEQ ID NO: 603381 - RNA, 18 nt, Human
aggugggaaaaucaccug

SEQ ID NO: 603382 - RNA, 24 nt, Human
aguggcucacaccuggaaucccag

SEQ ID NO: 603383 - RNA, 24 nt, Human
aucacuugaggucaggaguucaag

SEQ ID NO: 603384 - RNA, 23 nt, Human
auguggcugggugaaguggcuca

SEQ ID NO: 603385 - RNA, 24 nt, Human
auugcgccacugcacucaagccug

SEQ ID NO: 603386 - RNA, 25 nt, Human
caagauggauaaauguggcugggug

SEQ ID NO: 603387 - RNA, 19 nt, Human
cacaccuggaaucccagca

SEQ ID NO: 603388 - RNA, 18 nt, Human
caccaaaaaacaaagcaa

SEQ ID NO: 603389 - RNA, 19 nt, Human
caccaaaaaacaaagcaau

SEQ ID NO: 603390 - RNA, 20 nt, Human
caccaaaaaacaaagcaaua

SEQ ID NO: 603391 - RNA, 18 nt, Human
cacugcacucaagccuga

SEQ ID NO: 603392 - RNA, 23 nt, Human
cacuugaggucaggaguucaaga

SEQ ID NO: 603393 - RNA, 20 nt, Human
cagcacuuuaggaggccaag

SEQ ID NO: 603394 - RNA, 21 nt, Human
cagcacuuuaggaggccaagg

SEQ ID NO: 603395 - RNA, 21 nt, Human
cagugagccacgauugcgcca

SEQ ID NO: 603396 - RNA, 20 nt, Human
ccaagugaacuccacagccc

SEQ ID NO: 603397 - RNA, 18 nt, Human
ccacugcacucaagccug

SEQ ID NO: 603398 - RNA, 19 nt, Human
ccacugcacucaagccuga

SEQ ID NO: 603399 - RNA, 20 nt, Human
ccacugcacucaagccugau

SEQ ID NO: 603400 - RNA, 20 nt, Human
ccacuucugggcccuccccc

SEQ ID NO: 603401 - RNA, 19 nt, Human
cccagaaccugcacuuucc

SEQ ID NO: 603402 - RNA, 24 nt, Human
cccccagccuccaagccggccuac

SEQ ID NO: 603403 - RNA, 24 nt, Human
cucacaccuggaaucccagcacuu

SEQ ID NO: 603404 - RNA, 22 nt, Human
cugcagugagccacgauugcgc

SEQ ID NO: 603405 - RNA, 18 nt, Human
cuguagucccagcuacuc

SEQ ID NO: 603406 - RNA, 20 nt, Human
cuguagucccagcuacucgg

SEQ ID NO: 603407 - RNA, 21 nt, Human
cuguagucccagcuacucggg

SEQ ID NO: 603408 - RNA, 18 nt, Human
gaaguggcucacaccugg

SEQ ID NO: 603409 - RNA, 19 nt, Human
gacuucccagaaccugcac

SEQ ID NO: 603410 - RNA, 28 nt, Human
gagcugccacuccucccaagugaacucc

SEQ ID NO: 603411 - RNA, 23 nt, Human
gaggcugcagugagccacgauug

SEQ ID NO: 603412 - RNA, 23 nt, Human
gaucacuugaggucaggaguuca

SEQ ID NO: 603413 - RNA, 24 nt, Human
gaucacuugaggucaggaguucaa

SEQ ID NO: 603414 - RNA, 18 nt, Human
ggaaucccagcacuuuag

SEQ ID NO: 603415 - RNA, 21 nt, Human
ggagagaggaucacuugaggu

SEQ ID NO: 603416 - RNA, 22 nt, Human
ggaggcugcagugagccacgau

SEQ ID NO: 603417 - RNA, 24 nt, Human
ggaggcugcagugagccacgauug

SEQ ID NO: 603418 - RNA, 23 nt, Human
ggaucacuugaggucaggaguuc

SEQ ID NO: 603419 - RNA, 24 nt, Human
gggaaagcugaggugggaaaauca

SEQ ID NO: 603420 - RNA, 19 nt, Human
gggcccucccccagccucc

SEQ ID NO: 603421 - RNA, 24 nt, Human
gggugaaguggcucacaccuggaa

SEQ ID NO: 603422 - RNA, 20 nt, Human
ggugaaguggcucacaccug

SEQ ID NO: 603423 - RNA, 23 nt, Human
gugauucuuugaaaugcaccaaa

SEQ ID NO: 603424 - RNA, 25 nt, Human
uauuccacuucugggcccuccccca

SEQ ID NO: 603425 - RNA, 18 nt, Human
ucagugauucuuugaaau

SEQ ID NO: 603426 - RNA, 23 nt, Human
uccacuucugggcccucccccag

SEQ ID NO: 603427 - RNA, 18 nt, Human
ucccccagccuccaagcc

SEQ ID NO: 603428 - RNA, 19 nt, Human
ucccccagccuccaagccg

SEQ ID NO: 603429 - RNA, 22 nt, Human
uccucccaagugaacuccacag

SEQ ID NO: 603430 - RNA, 24 nt, Human
ucucuguagucccagcuacucggg

SEQ ID NO: 603431 - RNA, 19 nt, Human
ucugggcccucccccagcc

SEQ ID NO: 603432 - RNA, 21 nt, Human
ucugggcccucccccagccuc

SEQ ID NO: 603433 - RNA, 24 nt, Human
ugaaaugcaccaaaaaacaaagca

SEQ ID NO: 603434 - RNA, 25 nt, Human
ugaaguggcucacaccuggaauccc

SEQ ID NO: 603435 - RNA, 19 nt, Human
ugagaugccaucucuguag

SEQ ID NO: 603436 - RNA, 20 nt, Human
ugaggugggaaaaucaccug

SEQ ID NO: 603437 - RNA, 22 nt, Human
ugcagugagccacgauugcgcc

SEQ ID NO: 603438 - RNA, 24 nt, Human
uggcucacaccuggaaucccagca

SEQ ID NO: 603439 - RNA, 22 nt, Human
ugggaaaaucaccugagccccg

SEQ ID NO: 603440 - RNA, 19 nt, Human
ugggcccucccccagccuc

SEQ ID NO: 603441 - RNA, 22 nt, Human
ugggcccucccccagccuccaa

SEQ ID NO: 603442 - RNA, 21 nt, Human
uuugaaaugcaccaaaaaaca

SEQ ID NO: 603443 - RNA, 27 nt, Human
aaucauuccauuuucgucuccuccccu

SEQ ID NO: 603444 - RNA, 27 nt, Human
accuccuccauccccgacuccaaagac

SEQ ID NO: 603445 - RNA, 24 nt, Human
agacugucaaaaauugccagcgcu

SEQ ID NO: 603446 - RNA, 21 nt, Human
aggggcagaaccuccuccauc

SEQ ID NO: 603447 - RNA, 18 nt, Human
agguauuaaaaauagcau

SEQ ID NO: 603448 - RNA, 19 nt, Human
agucaguuuccgcuccugg

SEQ ID NO: 603449 - RNA, 22 nt, Human
caccuuugggacaugggggaug

SEQ ID NO: 603450 - RNA, 20 nt, Human
caggauggaccacuuuucuu

SEQ ID NO: 603451 - RNA, 21 nt, Human
ccucugguuguauuccaccuu

SEQ ID NO: 603452 - RNA, 24 nt, Human
cuaaagccuuggauuuucuucugg

SEQ ID NO: 603453 - RNA, 21 nt, Human
cuccuccauccccgacuccaa

SEQ ID NO: 603454 - RNA, 19 nt, Human
cugguuaccaaaagaguca

SEQ ID NO: 603455 - RNA, 19 nt, Human
cuuuauuggaaaaccccaa

SEQ ID NO: 603456 - RNA, 22 nt, Human
uauaacaccucacaggggcaga

SEQ ID NO: 603457 - RNA, 21 nt, Human
ucaaagucacaaauaaaugca

SEQ ID NO: 603458 - RNA, 22 nt, Human
ucaaagucacaaauaaaugcag

SEQ ID NO: 603459 - RNA, 24 nt, Human
ucagaggcuucauaucccugcugg

SEQ ID NO: 603460 - RNA, 19 nt, Human
uccccgacuccaaagacuc

SEQ ID NO: 603461 - RNA, 19 nt, Human
uccuagguuuuuguaggcu

SEQ ID NO: 603462 - RNA, 23 nt, Human
ucuucugggcaguuccuaaaggc

SEQ ID NO: 603463 - RNA, 19 nt, Human
ugaaaaaucagcaauccag

SEQ ID NO: 603464 - RNA, 19 nt, Human
uggcaggagagauuucuaa

SEQ ID NO: 603465 - RNA, 26 nt, Human
uggcauggaagaaaucauuccauuuu

SEQ ID NO: 603466 - RNA, 23 nt, Human
uggcuaaagccuuggauuuucuu

SEQ ID NO: 603467 - RNA, 22 nt, Human
ugucugguuaccaaaagaguca

SEQ ID NO: 603468 - RNA, 21 nt, Human
uuucuuagcaacaguuucuaa

SEQ ID NO: 603469 - RNA, 22 nt, Human
uuugauggucauguauaacacc

SEQ ID NO: 603470 - RNA, 24 nt, Human
aaaaaaaucaacaaccuaaaaagu

SEQ ID NO: 603471 - RNA, 22 nt, Human
aaaguccaauggucaucuaaaa

SEQ ID NO: 603472 - RNA, 21 nt, Human
aacaguaacacaugauuuaga

SEQ ID NO: 603473 - RNA, 20 nt, Human
aaccucugccuccccgguuc

SEQ ID NO: 603474 - RNA, 19 nt, Human
acaaauggucucagauaca

SEQ ID NO: 603475 - RNA, 24 nt, Human
acaagauaaaaucagaucucuuca

SEQ ID NO: 603476 - RNA, 19 nt, Human
acagacacaaaccauuaca

SEQ ID NO: 603477 - RNA, 24 nt, Human
accuuacggccugcaaagccuaaa

SEQ ID NO: 603478 - RNA, 23 nt, Human
acuacccccuuuguucuaagcaa

SEQ ID NO: 603479 - RNA, 25 nt, Human
acucugucgcucaggcuagagugca

SEQ ID NO: 603480 - RNA, 19 nt, Human
agcuaggaaaaaacuggag

SEQ ID NO: 603481 - RNA, 18 nt, Human
agcuuuuauuuaacagcc

SEQ ID NO: 603482 - RNA, 24 nt, Human
agugcaguagcaugaucucggcuu

SEQ ID NO: 603483 - RNA, 18 nt, Human
aguucuaagaaacaacuc

SEQ ID NO: 603484 - RNA, 20 nt, Human
auacugaaacuuuuuguuac

SEQ ID NO: 603485 - RNA, 21 nt, Human
auacuguguugacaaauauca

SEQ ID NO: 603486 - RNA, 20 nt, Human
augagaaaaaaacccagggg

SEQ ID NO: 603487 - RNA, 23 nt, Human
auuugugacagaaaccuuacggc

SEQ ID NO: 603488 - RNA, 20 nt, Human
caacuauacccugcaggcca

SEQ ID NO: 603489 - RNA, 21 nt, Human
caagauaaaaucagaucucuu

SEQ ID NO: 603490 - RNA, 20 nt, Human
caagugauucuccugccuca

SEQ ID NO: 603491 - RNA, 22 nt, Human
caagugauucuccugccucagc

SEQ ID NO: 603492 - RNA, 24 nt, Human
cacucugucgcucaggcuagagug

SEQ ID NO: 603493 - RNA, 19 nt, Human
cagccuaagcuuuuguuuu

SEQ ID NO: 603494 - RNA, 19 nt, Human
caucuaaaaugaaaugaaa

SEQ ID NO: 603495 - RNA, 22 nt, Human
cauuaaugcugcaaaguuguuu

SEQ ID NO: 603496 - RNA, 21 nt, Human
cauuuuacaggaaagaaaauu

SEQ ID NO: 603497 - RNA, 23 nt, Human
ccaauucugauguguucaguagc

SEQ ID NO: 603498 - RNA, 23 nt, Human
ccccgguucaagugauucuccuc

SEQ ID NO: 603499 - RNA, 23 nt, Human
ccccgguucaagugauucuccug

SEQ ID NO: 603500 - RNA, 23 nt, Human
ccgaauagcuaggaaaaaacugg

SEQ ID NO: 603501 - RNA, 28 nt, Human
ccuacuggcugcucuugaaagguuuucc

SEQ ID NO: 603502 - RNA, 24 nt, Human
ccuccccgguucaagugauucucc

SEQ ID NO: 603503 - RNA, 23 nt, Human
cgguucaagugauucuccugccu

SEQ ID NO: 603504 - RNA, 20 nt, Human
cguuguugacgucaucauuu

SEQ ID NO: 603505 - RNA, 24 nt, Human
cuagagugcaguagcaugaucucg

SEQ ID NO: 603506 - RNA, 22 nt, Human
cuagauugaggucagccaacua

SEQ ID NO: 603507 - RNA, 18 nt, Human
cuccccgguucaagugau

SEQ ID NO: 603508 - RNA, 23 nt, Human
cuccugccucagcuucccgaguc

SEQ ID NO: 603509 - RNA, 24 nt, Human
cugcaaccucugccuccccgguuc

SEQ ID NO: 603510 - RNA, 19 nt, Human
cugccucagcuucccgagu

SEQ ID NO: 603511 - RNA, 23 nt, Human
cugccuccccgguucaagugauu

SEQ ID NO: 603512 - RNA, 20 nt, Human
cuuuuuuuuuugagacagag

SEQ ID NO: 603513 - RNA, 24 nt, Human
gagaacaaaguccaauggucaucu

SEQ ID NO: 603514 - RNA, 19 nt, Human
gagcaguucugugaaacua

SEQ ID NO: 603515 - RNA, 21 nt, Human
gauucuccugccucagcuucc

SEQ ID NO: 603516 - RNA, 23 nt, Human
gccucagcuucccgaguccaacu

SEQ ID NO: 603517 - RNA, 21 nt, Human
gguucaagugauucuccugcc

SEQ ID NO: 603518 - RNA, 24 nt, Human
gugauucuccugccucagcuuccc

SEQ ID NO: 603519 - RNA, 19 nt, Human
uaacugcaaccucugccuc

SEQ ID NO: 603520 - RNA, 21 nt, Human
uaacugcaaccucugccuccc

SEQ ID NO: 603521 - RNA, 24 nt, Human
uaacugcaaccucugccuccccgg

SEQ ID NO: 603522 - RNA, 18 nt, Human
uaagaaacaacucuaucu

SEQ ID NO: 603523 - RNA, 24 nt, Human
uaauagguguagaaaauauacaca

SEQ ID NO: 603524 - RNA, 25 nt, Human
uacaaauacagacacaaaccauuac

SEQ ID NO: 603525 - RNA, 21 nt, Human
uacucaauuuugaggugcaaa

SEQ ID NO: 603526 - RNA, 19 nt, Human
uagaaaauauacacauguu

SEQ ID NO: 603527 - RNA, 24 nt, Human
uagagugcaguagcaugaucucgg

SEQ ID NO: 603528 - RNA, 25 nt, Human
uauggcaauaaauaaugaugcauug

SEQ ID NO: 603529 - RNA, 19 nt, Human
ucaacaaccuaaaaaguaa

SEQ ID NO: 603530 - RNA, 19 nt, Human
ucaagugauucuccugccu

SEQ ID NO: 603531 - RNA, 21 nt, Human
uccccgguucaagugauucuc

SEQ ID NO: 603532 - RNA, 24 nt, Human
uccccgguucaagugauucuccug

SEQ ID NO: 603533 - RNA, 18 nt, Human
ucgcucaggcuagagugc

SEQ ID NO: 603534 - RNA, 18 nt, Human
ucucacucugucgcucag

SEQ ID NO: 603535 - RNA, 19 nt, Human
ucucacucugucgcucagg

SEQ ID NO: 603536 - RNA, 24 nt, Human
ucucacucugucgcucaggcuaga

SEQ ID NO: 603537 - RNA, 24 nt, Human
ucugucgcucaggcuagagugcag

SEQ ID NO: 603538 - RNA, 26 nt, Human
ucuuuuuuuuuugagacagagucuca

SEQ ID NO: 603539 - RNA, 19 nt, Human
ugaaaagccuaacauugga

SEQ ID NO: 603540 - RNA, 19 nt, Human
ugacagaaaccuuacggcc

SEQ ID NO: 603541 - RNA, 20 nt, Human
ugacagaaaccuuacggccu

SEQ ID NO: 603542 - RNA, 18 nt, Human
ugagacagagucucacuc

SEQ ID NO: 603543 - RNA, 22 nt, Human
ugagacagagucucacucuguc

SEQ ID NO: 603544 - RNA, 22 nt, Human
ugaggucagccaacuauacccc

SEQ ID NO: 603545 - RNA, 20 nt, Human
ugauucuccugccucagcuu

SEQ ID NO: 603546 - RNA, 21 nt, Human
ugcaguagcaugaucucggcu

SEQ ID NO: 603547 - RNA, 22 nt, Human
ugccuccccgguucaagugauu

SEQ ID NO: 603548 - RNA, 23 nt, Human
ugcugacucguguucuagauaac

SEQ ID NO: 603549 - RNA, 24 nt, Human
ugggauauuggugaauaaaguagg

SEQ ID NO: 603550 - RNA, 20 nt, Human
ugguuaaagagaucuccagg

SEQ ID NO: 603551 - RNA, 20 nt, Human
ugugacagaaaccuuacggc

SEQ ID NO: 603552 - RNA, 22 nt, Human
uguuacauuaaugcugcaaagu

SEQ ID NO: 603553 - RNA, 22 nt, Human
uuacaaagguaacaaaaagagc

SEQ ID NO: 603554 - RNA, 19 nt, Human
uucaaaacaaauauuuaau

SEQ ID NO: 603555 - RNA, 25 nt, Human
uucaaaacaaauauuuaauauuuua

SEQ ID NO: 603556 - RNA, 21 nt, Human
uucaagugauucuccugccuc

SEQ ID NO: 603557 - RNA, 23 nt, Human
uucaagugauucuccugccucag

SEQ ID NO: 603558 - RNA, 24 nt, Human
uucaagugauucuccugccucagc

SEQ ID NO: 603559 - RNA, 19 nt, Human
uucuaagaaacaacucuau

SEQ ID NO: 603560 - RNA, 21 nt, Human
uuuagggggauucacuuccau

SEQ ID NO: 603561 - RNA, 24 nt, Human
aaaaagacagacauaucuacacaa

SEQ ID NO: 603562 - RNA, 24 nt, Human
aaaaagacagacauaucuacacaa

SEQ ID NO: 603563 - RNA, 20 nt, Human
aaaagacagacauaucuaca

SEQ ID NO: 603564 - RNA, 18 nt, Human
aaacagauguuagaaacu

SEQ ID NO: 603565 - RNA, 22 nt, Human
aaccccaauaacucacaaguau

SEQ ID NO: 603566 - RNA, 22 nt, Human
aacccuuuuacucauugguauc

SEQ ID NO: 603567 - RNA, 22 nt, Human
aagacccaccauuacccaggaa

SEQ ID NO: 603568 - RNA, 21 nt, Human
aagcagagaggagugcagaga

SEQ ID NO: 603569 - RNA, 20 nt, Human
aaggagcagaccucuguccu

SEQ ID NO: 603570 - RNA, 22 nt, Human
aaugcuaaggggccaggagaaa

SEQ ID NO: 603571 - RNA, 18 nt, Human
aaugggcauuuucucuga

SEQ ID NO: 603572 - RNA, 24 nt, Human
acagagucagagugaacaggaaga

SEQ ID NO: 603573 - RNA, 23 nt, Human
acgcggggacgcgggacgggacg

SEQ ID NO: 603574 - RNA, 18 nt, Human
acuugggaacgucagcgg

SEQ ID NO: 603575 - RNA, 19 nt, Human
agacagacauaucuacaca

SEQ ID NO: 603576 - RNA, 18 nt, Human
agacccaccauuacccag

SEQ ID NO: 603577 - RNA, 18 nt, Human
agaggagcagaggcagga

SEQ ID NO: 603578 - RNA, 19 nt, Human
agagucagagugaacagga

SEQ ID NO: 603579 - RNA, 19 nt, Human
agaguggggaaaaggcuga

SEQ ID NO: 603580 - RNA, 18 nt, Human
agaugcuggcucagggag

SEQ ID NO: 603581 - RNA, 25 nt, Human
aggaacccuuuuacucauugguauc

SEQ ID NO: 603582 - RNA, 18 nt, Human
aggagcagaggcaggaga

SEQ ID NO: 603583 - RNA, 27 nt, Human
aggcaggagacagagguggggggaccc

SEQ ID NO: 603584 - RNA, 20 nt, Human
aggcaucuggcccaccccag

SEQ ID NO: 603585 - RNA, 19 nt, Human
auggccaugacuuugggga

SEQ ID NO: 603586 - RNA, 23 nt, Human
auguguguuacugugguggcaug

SEQ ID NO: 603587 - RNA, 21 nt, Human
caaaagagaauaaauaugaca

SEQ ID NO: 603588 - RNA, 23 nt, Human
caaggugaagagggagggacugg

SEQ ID NO: 603589 - RNA, 19 nt, Human
caggaaggagcagaccucu

SEQ ID NO: 603590 - RNA, 19 nt, Human
caggagacagaggugggca

SEQ ID NO: 603591 - RNA, 22 nt, Human
cccaccccaggacccuccugga

SEQ ID NO: 603592 - RNA, 21 nt, Human
ccccuaguauuugugagcaac

SEQ ID NO: 603593 - RNA, 21 nt, Human
cccugaaacagauguuagaaa

SEQ ID NO: 603594 - RNA, 20 nt, Human
cccuggaucugucacuuggg

SEQ ID NO: 603595 - RNA, 21 nt, Human
ccuaccaaagaugagaacagg

SEQ ID NO: 603596 - RNA, 19 nt, Human
cuggcagaauccuaccaaa

SEQ ID NO: 603597 - RNA, 24 nt, Human
cuggcccaccccaggacccuccug

SEQ ID NO: 603598 - RNA, 22 nt, Human
cuggcgggcggcgcgcuccucg

SEQ ID NO: 603599 - RNA, 21 nt, Human
gaacagaagaugcaaaagcaa

SEQ ID NO: 603600 - RNA, 21 nt, Human
gaagaguggacgggcaguggu

SEQ ID NO: 603601 - RNA, 22 nt, Human
gaagaugccuagucaucucuuc

SEQ ID NO: 603602 - RNA, 23 nt, Human
gaaugcuaaggggccaggagaaa

SEQ ID NO: 603603 - RNA, 21 nt, Human
gacagcagugaugaagaugcc

SEQ ID NO: 603604 - RNA, 21 nt, Human
gacuacucuuugauggggaau

SEQ ID NO: 603605 - RNA, 18 nt, Human
gaguggggaaaaggcuga

SEQ ID NO: 603606 - RNA, 19 nt, Human
ggaaaaggcugagcuggga

SEQ ID NO: 603607 - RNA, 20 nt, Human
ggaaugguaaagggacaagg

SEQ ID NO: 603608 - RNA, 18 nt, Human
ggacgcagggagcuggcg

SEQ ID NO: 603609 - RNA, 24 nt, Human
ggagacagaggugggcaggcaucu

SEQ ID NO: 603610 - RNA, 19 nt, Human
ggcaggagacagagguggg

SEQ ID NO: 603611 - RNA, 26 nt, Human
ggcggcgcgcuccucgcaggcucgag

SEQ ID NO: 603612 - RNA, 21 nt, Human
ggcgggcggcgcgcuccucgc

SEQ ID NO: 603613 - RNA, 21 nt, Human
gggaaugguaaagggacaagg

SEQ ID NO: 603614 - RNA, 18 nt, Human
gggcagagggcaagguca

SEQ ID NO: 603615 - RNA, 20 nt, Human
gggcagagggcaaggucagc

SEQ ID NO: 603616 - RNA, 24 nt, Human
gugaagcagagaggagugcagaga

SEQ ID NO: 603617 - RNA, 18 nt, Human
gugguccacccagccucc

SEQ ID NO: 603618 - RNA, 24 nt, Human
guuccuccuguugaagaguggacg

SEQ ID NO: 603619 - RNA, 20 nt, Human
uacaguauuuaagagugggg

SEQ ID NO: 603620 - RNA, 20 nt, Human
uacagugaaguaguacagua

SEQ ID NO: 603621 - RNA, 23 nt, Human
uaccaaagaugagaacagggaag

SEQ ID NO: 603622 - RNA, 21 nt, Human
ucuacagcuggauacccugaa

SEQ ID NO: 603623 - RNA, 23 nt, Human
ucuacagcuggauacccugaaac

SEQ ID NO: 603624 - RNA, 19 nt, Human
ucuguccuuucucuaaugu

SEQ ID NO: 603625 - RNA, 24 nt, Human
ugaagaugccuagucaucucuucu

SEQ ID NO: 603626 - RNA, 19 nt, Human
ugagaacagggaaguugaa

SEQ ID NO: 603627 - RNA, 22 nt, Human
ugagaacagggaaguugaaugu

SEQ ID NO: 603628 - RNA, 24 nt, Human
ugagaacagggaaguugaauguga

SEQ ID NO: 603629 - RNA, 19 nt, Human
ugaggacccaaaaagacag

SEQ ID NO: 603630 - RNA, 20 nt, Human
ugaggacccaaaaagacaga

SEQ ID NO: 603631 - RNA, 22 nt, Human
ugccuagucaucucuucucggg

SEQ ID NO: 603632 - RNA, 20 nt, Human
uggaggggcuuggacacugg

SEQ ID NO: 603633 - RNA, 19 nt, Human
uggaucugucacuugggaa

SEQ ID NO: 603634 - RNA, 21 nt, Human
uggcaggaaggagcagaccuc

SEQ ID NO: 603635 - RNA, 19 nt, Human
uggcaugcuguuccuccug

SEQ ID NO: 603636 - RNA, 30 nt, Human
uggcaugcuguuccuccuguugaagagugg

SEQ ID NO: 603637 - RNA, 23 nt, Human
uggcucagggaggggaccgacag

SEQ ID NO: 603638 - RNA, 21 nt, Human
ugggaggaaugaaggcuggca

SEQ ID NO: 603639 - RNA, 19 nt, Human
ugggcagagggcaagguca

SEQ ID NO: 603640 - RNA, 22 nt, Human
ugggggauaagaacaucuacag

SEQ ID NO: 603641 - RNA, 19 nt, Human
ugugaagcagagaggagug

SEQ ID NO: 603642 - RNA, 18 nt, Human
uuaagacccaccauuacc

SEQ ID NO: 603643 - RNA, 22 nt, Human
uucucugaggacccaaaaagac

SEQ ID NO: 603644 - RNA, 23 nt, Human
uugaagaguggacgggcaguggu

SEQ ID NO: 603645 - RNA, 22 nt, Human
aaaaacaauagaaauguuuggc

SEQ ID NO: 603646 - RNA, 25 nt, Human
aaacagaaagaaaucacaaaagcaa

SEQ ID NO: 603647 - RNA, 22 nt, Human
aaaugaacuuacugcaaguagc

SEQ ID NO: 603648 - RNA, 18 nt, Human
aacagaaagaaaucacaa

SEQ ID NO: 603649 - RNA, 19 nt, Human
aaguaugccugguuaagau

SEQ ID NO: 603650 - RNA, 18 nt, Human
aagugcugggauuacagg

SEQ ID NO: 603651 - RNA, 18 nt, Human
aagugcugggauuacagg

SEQ ID NO: 603652 - RNA, 19 nt, Human
aagugcugggauuacaggu

SEQ ID NO: 603653 - RNA, 22 nt, Human
aagugcugggauuacaggugug

SEQ ID NO: 603654 - RNA, 23 nt, Human
aagugcugggauuacagguguga

SEQ ID NO: 603655 - RNA, 26 nt, Human
aagugcugggauuacaggugugagcc

SEQ ID NO: 603656 - RNA, 18 nt, Human
aauaauggguaagaaaga

SEQ ID NO: 603657 - RNA, 22 nt, Human
aaucacaaaagcaauuaagaga

SEQ ID NO: 603658 - RNA, 20 nt, Human
acaaaauauuccuagacgag

SEQ ID NO: 603659 - RNA, 23 nt, Human
acaacugaauugagcuagcugaa

SEQ ID NO: 603660 - RNA, 19 nt, Human
acaguaagugguuguauga

SEQ ID NO: 603661 - RNA, 22 nt, Human
accgccgacguacucucccccu

SEQ ID NO: 603662 - RNA, 21 nt, Human
acuggccuaucccaaauacac

SEQ ID NO: 603663 - RNA, 20 nt, Human
acuguauucaaaaugauaga

SEQ ID NO: 603664 - RNA, 27 nt, Human
agaaacagaaagaaaucaccgguaccc

SEQ ID NO: 603665 - RNA, 22 nt, Human
agaaagaauaccucaacaacug

SEQ ID NO: 603666 - RNA, 26 nt, Human
agagcaccgccgacguacucuccccc

SEQ ID NO: 603667 - RNA, 19 nt, Human
aggcuuguacuguauucaa

SEQ ID NO: 603668 - RNA, 23 nt, Human
aggugcuggaaagcgagugcgcc

SEQ ID NO: 603669 - RNA, 22 nt, Human
aggugugagccacugugccugg

SEQ ID NO: 603670 - RNA, 24 nt, Human
auaguggugcugucacagaaggac

SEQ ID NO: 603671 - RNA, 20 nt, Human
auaucugauccccaaauagc

SEQ ID NO: 603672 - RNA, 24 nt, Human
auaugauagacauacauguauaua

SEQ ID NO: 603673 - RNA, 19 nt, Human
auuuuacaggucuuugugg

SEQ ID NO: 603674 - RNA, 18 nt, Human
caaaauauuccuagacga

SEQ ID NO: 603675 - RNA, 26 nt, Human
caaagcccgagagcaccgccgacgua

SEQ ID NO: 603676 - RNA, 19 nt, Human
caaguagcucaacauagua

SEQ ID NO: 603677 - RNA, 22 nt, Human
caauagaauggaauuaaaacug

SEQ ID NO: 603678 - RNA, 25 nt, Human
cacaaaagcaauuaagagagcucaa

SEQ ID NO: 603679 - RNA, 18 nt, Human
cacugugccuggucucac

SEQ ID NO: 603680 - RNA, 21 nt, Human
cagaaagaaaucacaaaagca

SEQ ID NO: 603681 - RNA, 24 nt, Human
cagaaggacaaaauauuccuagac

SEQ ID NO: 603682 - RNA, 22 nt, Human
caguucugaguuccacuggccu

SEQ ID NO: 603683 - RNA, 26 nt, Human
cauacaaggauccugcauaucucaag

SEQ ID NO: 603684 - RNA, 22 nt, Human
cauuuuauuuuuuaauagacau

SEQ ID NO: 603685 - RNA, 20 nt, Human
ccauauuuugaaaauaaggc

SEQ ID NO: 603686 - RNA, 21 nt, Human
ccaucagccaaauaaaaaaau

SEQ ID NO: 603687 - RNA, 24 nt, Human
cccuccaugcuaccgccgccucag

SEQ ID NO: 603688 - RNA, 22 nt, Human
ccuaagugcugggauuacaggu

SEQ ID NO: 603689 - RNA, 23 nt, Human
ccuaagugcugggauuacaggug

SEQ ID NO: 603690 - RNA, 24 nt, Human
ccuaagugcugggauuacaggugu

SEQ ID NO: 603691 - RNA, 22 nt, Human
ccucaggcuacacaagaggacu

SEQ ID NO: 603692 - RNA, 20 nt, Human
cuaagugcugggauuacagg

SEQ ID NO: 603693 - RNA, 25 nt, Human
cuccaugcuaccgccgccucaggcu

SEQ ID NO: 603694 - RNA, 20 nt, Human
gaagaaacagaaagaaauca

SEQ ID NO: 603695 - RNA, 19 nt, Human
gacauacauguauauaugu

SEQ ID NO: 603696 - RNA, 22 nt, Human
gagaugauuuacaccuaauaga

SEQ ID NO: 603697 - RNA, 20 nt, Human
gagcacaaagcccgagagca

SEQ ID NO: 603698 - RNA, 18 nt, Human
gauuacaggugugagcca

SEQ ID NO: 603699 - RNA, 21 nt, Human
gauuacaggugugagccacug

SEQ ID NO: 603700 - RNA, 24 nt, Human
gauuacaggugugagccacugugc

SEQ ID NO: 603701 - RNA, 18 nt, Human
gcaaguacaaauguagga

SEQ ID NO: 603702 - RNA, 24 nt, Human
uaaaaacaaaugaacuuacugcaa

SEQ ID NO: 603703 - RNA, 24 nt, Human
uaaacaacuucaacaucauccauu

SEQ ID NO: 603704 - RNA, 26 nt, Human
uaaauucuaucacguuaccacuaaua

SEQ ID NO: 603705 - RNA, 24 nt, Human
uaacuccuagcuucaaucaauccu

SEQ ID NO: 603706 - RNA, 19 nt, Human
uaagagagcucaaauaaug

SEQ ID NO: 603707 - RNA, 24 nt, Human
uaagugcugggauuacagguguga

SEQ ID NO: 603708 - RNA, 19 nt, Human
uaagugguuguaugaugcc

SEQ ID NO: 603709 - RNA, 21 nt, Human
uaauagacauugaauaugaua

SEQ ID NO: 603710 - RNA, 22 nt, Human
uacaggugugagccacugugcc

SEQ ID NO: 603711 - RNA, 22 nt, Human
uacaggugugagccacugugcc

SEQ ID NO: 603712 - RNA, 23 nt, Human
uacaggugugagccacugugccu

SEQ ID NO: 603713 - RNA, 19 nt, Human
uacauugggauggauagug

SEQ ID NO: 603714 - RNA, 23 nt, Human
uacauugggauggauaguggugc

SEQ ID NO: 603715 - RNA, 20 nt, Human
uaccaauguccauuaagcag

SEQ ID NO: 603716 - RNA, 18 nt, Human
uaccacauucuaaaaagc

SEQ ID NO: 603717 - RNA, 19 nt, Human
uacguugcccaggcugguc

SEQ ID NO: 603718 - RNA, 21 nt, Human
uacguugcccaggcuggucuc

SEQ ID NO: 603719 - RNA, 24 nt, Human
uacguugcccaggcuggucucuaa

SEQ ID NO: 603720 - RNA, 27 nt, Human
uacguugcccaggcuggucucuaacuc

SEQ ID NO: 603721 - RNA, 19 nt, Human
uagcauggaauauauuucu

SEQ ID NO: 603722 - RNA, 24 nt, Human
uauaaacaacuucaacaucaucca

SEQ ID NO: 603723 - RNA, 24 nt, Human
uaucuguguauuacugcaaacagg

SEQ ID NO: 603724 - RNA, 20 nt, Human
uaugaugccaauacugacuc

SEQ ID NO: 603725 - RNA, 21 nt, Human
ucacagaaggacaaaauauuc

SEQ ID NO: 603726 - RNA, 19 nt, Human
ucccaaauacacuggauua

SEQ ID NO: 603727 - RNA, 26 nt, Human
uccccaaauagcucauacaauaaucc

SEQ ID NO: 603728 - RNA, 20 nt, Human
uccccaagaagaaaaccuuc

SEQ ID NO: 603729 - RNA, 23 nt, Human
ucccuaagugcugggauuacagg

SEQ ID NO: 603730 - RNA, 21 nt, Human
uccugcauaucucaaggaccc

SEQ ID NO: 603731 - RNA, 19 nt, Human
ucuaaagaaugugucugug

SEQ ID NO: 603732 - RNA, 21 nt, Human
ugcaaacaggugaacauagua

SEQ ID NO: 603733 - RNA, 24 nt, Human
ugcccaggcuggucucuaacuccu

SEQ ID NO: 603734 - RNA, 24 nt, Human
ugcugggauuacaggugugagcca

SEQ ID NO: 603735 - RNA, 19 nt, Human
ugggaagaaacagaaagaa

SEQ ID NO: 603736 - RNA, 18 nt, Human
ugggauuacaggugugag

SEQ ID NO: 603737 - RNA, 21 nt, Human
ugggauuacaggugugagcca

SEQ ID NO: 603738 - RNA, 22 nt, Human
ugggauuacaggugugagccac

SEQ ID NO: 603739 - RNA, 22 nt, Human
ugggauuacaggugugagccac

SEQ ID NO: 603740 - RNA, 22 nt, Human
ugggauuacaggugugagccac

SEQ ID NO: 603741 - RNA, 24 nt, Human
ugggauuacaggugugagccacug

SEQ ID NO: 603742 - RNA, 21 nt, Human
uguaagccuuccccucaacaa

SEQ ID NO: 603743 - RNA, 24 nt, Human
ugucacagaaggacaaaauauucc

SEQ ID NO: 603744 - RNA, 26 nt, Human
uguccgaguccguguugaggugcugg

SEQ ID NO: 603745 - RNA, 20 nt, Human
ugucuguguaagccuucccc

SEQ ID NO: 603746 - RNA, 20 nt, Human
uuaacacucaucacauuuua

SEQ ID NO: 603747 - RNA, 24 nt, Human
uuacaggguuuaugccaguuacau

SEQ ID NO: 603748 - RNA, 23 nt, Human
uuacaguaagugguuguaugaug

SEQ ID NO: 603749 - RNA, 19 nt, Human
uuccccaagaagaaaaccu

SEQ ID NO: 603750 - RNA, 19 nt, Human
uugaggagugagguaaaga

SEQ ID NO: 603751 - RNA, 21 nt, Human
uugaggugcuggaaagcgagu

SEQ ID NO: 603752 - RNA, 22 nt, Human
uugugaaguaaaugcacuaaga

SEQ ID NO: 603753 - RNA, 22 nt, Human
aacuccgccaaggccagaauaa

SEQ ID NO: 603754 - RNA, 24 nt, Human
accgcaaccaccaagcuggacccg

SEQ ID NO: 603755 - RNA, 19 nt, Human
acuaccgcaaccaccaagc

SEQ ID NO: 603756 - RNA, 22 nt, Human
agccuggcaaccagcggaggcc

SEQ ID NO: 603757 - RNA, 23 nt, Human
auagccucuuuccgagauucccu

SEQ ID NO: 603758 - RNA, 22 nt, Human
caaccaccaagcuggacccggc

SEQ ID NO: 603759 - RNA, 18 nt, Human
cacuaccgcaaccaccaa

SEQ ID NO: 603760 - RNA, 21 nt, Human
cagaauaagaucccggaugcc

SEQ ID NO: 603761 - RNA, 23 nt, Human
caucaaagauuccuucugcauuc

SEQ ID NO: 603762 - RNA, 22 nt, Human
ccaaauggucccgagcaagcca

SEQ ID NO: 603763 - RNA, 21 nt, Human
ccaaggccagaauaagauccc

SEQ ID NO: 603764 - RNA, 19 nt, Human
ccaccucuagaccaagccu

SEQ ID NO: 603765 - RNA, 20 nt, Human
ccccaacuccgccaaggcca

SEQ ID NO: 603766 - RNA, 22 nt, Human
ccccaacuccgccaaggccaga

SEQ ID NO: 603767 - RNA, 20 nt, Human
cccggccgcgggcccugacc

SEQ ID NO: 603768 - RNA, 19 nt, Human
ccucucacuaccgcaacca

SEQ ID NO: 603769 - RNA, 18 nt, Human
cggacucuggguccagcc

SEQ ID NO: 603770 - RNA, 23 nt, Human
cucuugaaagaaauucauucuuu

SEQ ID NO: 603771 - RNA, 23 nt, Human
cuggcaaccagcggaggccucuc

SEQ ID NO: 603772 - RNA, 21 nt, Human
cuuuaaaaacaacauucgauc

SEQ ID NO: 603773 - RNA, 21 nt, Human
gaucuuucugcauuuccuuaa

SEQ ID NO: 603774 - RNA, 20 nt, Human
gguguucaggaugaugagaa

SEQ ID NO: 603775 - RNA, 23 nt, Human
gucccgagcaagccaaagcggca

SEQ ID NO: 603776 - RNA, 21 nt, Human
uaauucuuuuaauuuauucug

SEQ ID NO: 603777 - RNA, 24 nt, Human
uaccgcaaccaccaagcuggaccc

SEQ ID NO: 603778 - RNA, 25 nt, Human
uaccgcaaccaccaagcuggacccg

SEQ ID NO: 603779 - RNA, 27 nt, Human
uaccgcaaccaccaagcuggacccggc

SEQ ID NO: 603780 - RNA, 22 nt, Human
ucaggaucuuucugcauuuccu

SEQ ID NO: 603781 - RNA, 20 nt, Human
ucccagagcucgguguucag

SEQ ID NO: 603782 - RNA, 20 nt, Human
ucccggaugccaggagagcc

SEQ ID NO: 603783 - RNA, 23 nt, Human
uccgccaaggccagaauaagauc

SEQ ID NO: 603784 - RNA, 19 nt, Human
uccuugagaaauguuuuca

SEQ ID NO: 603785 - RNA, 21 nt, Human
ucuagaccaagccuggcaacc

SEQ ID NO: 603786 - RNA, 23 nt, Human
ucuccgccggagucccagagcuc

SEQ ID NO: 603787 - RNA, 18 nt, Human
ugaaagaaauucauucuu

SEQ ID NO: 603788 - RNA, 25 nt, Human
ugaauucuuucacugugcuccaccu

SEQ ID NO: 603789 - RNA, 19 nt, Human
ugggcuuucaaaugcagac

SEQ ID NO: 603790 - RNA, 19 nt, Human
uguuucuccuccuuuaaca

SEQ ID NO: 603791 - RNA, 22 nt, Human
uuauagccucuuuccgagauuc

SEQ ID NO: 603792 - RNA, 27 nt, Human
uucuaaaucucuuucuuuuucaauuuu

SEQ ID NO: 603793 - RNA, 21 nt, Human
uugauugugcuucacucauau

SEQ ID NO: 603794 - RNA, 27 nt, Human
aaaaacauguuacccaauuuaaccuuc

SEQ ID NO: 603795 - RNA, 24 nt, Human
aaaaagaggaaagcuguauaaaaa

SEQ ID NO: 603796 - RNA, 22 nt, Human
aaaagaaaaaccaaacaaaaaa

SEQ ID NO: 603797 - RNA, 18 nt, Human
aaacuacuauucaccuca

SEQ ID NO: 603798 - RNA, 24 nt, Human
aaagugcugcgauuacaggcauga

SEQ ID NO: 603799 - RNA, 23 nt, Human
aacaaaaaaauuagcaacacaaa

SEQ ID NO: 603800 - RNA, 24 nt, Human
aagaagcauauuaagaaaacaagc

SEQ ID NO: 603801 - RNA, 25 nt, Human
aagccuauaauuacccaaaucaaaa

SEQ ID NO: 603802 - RNA, 19 nt, Human
aaguagcugggacuacagg

SEQ ID NO: 603803 - RNA, 20 nt, Human
aaguagcugggacuacaggc

SEQ ID NO: 603804 - RNA, 25 nt, Human
aaguagcugggacuacaggcgcccg

SEQ ID NO: 603805 - RNA, 24 nt, Human
aagugauccacccgccucggccuc

SEQ ID NO: 603806 - RNA, 22 nt, Human
aauaagaguagaaaaaucacaa

SEQ ID NO: 603807 - RNA, 18 nt, Human
aaugcagaaaaugaaaaa

SEQ ID NO: 603808 - RNA, 21 nt, Human
acaagccuauaauuacccaaa

SEQ ID NO: 603809 - RNA, 27 nt, Human
acauagcacacuuaauaaaaugucucc

SEQ ID NO: 603810 - RNA, 25 nt, Human
acccgccucggccucccaaagugcu

SEQ ID NO: 603811 - RNA, 23 nt, Human
accucagccucccaaguaccugg

SEQ ID NO: 603812 - RNA, 20 nt, Human
acugcaagcuccgccucccg

SEQ ID NO: 603813 - RNA, 24 nt, Human
acuugugcuuauagagaaaacaaa

SEQ ID NO: 603814 - RNA, 20 nt, Human
agaaaacuguuguaugagga

SEQ ID NO: 603815 - RNA, 22 nt, Human
agaaauuaugaaaagacaaagc

SEQ ID NO: 603816 - RNA, 20 nt, Human
agagaaaacaaacaaaaaaa

SEQ ID NO: 603817 - RNA, 22 nt, Human
agcaauuucaaauauaacccaa

SEQ ID NO: 603818 - RNA, 22 nt, Human
agccgcauugcccucaggccuc

SEQ ID NO: 603819 - RNA, 22 nt, Human
agcuaaaagaaaaaccaaacaa

SEQ ID NO: 603820 - RNA, 18 nt, Human
aggcacaugccaccacac

SEQ ID NO: 603821 - RNA, 18 nt, Human
aggccucgagucccccac

SEQ ID NO: 603822 - RNA, 25 nt, Human
aggcuggagugcaguggcgggaucu

SEQ ID NO: 603823 - RNA, 22 nt, Human
aguagagaugagguuucaccau

SEQ ID NO: 603824 - RNA, 20 nt, Human
agugcaguggcgggaucucg

SEQ ID NO: 603825 - RNA, 23 nt, Human
agugcaguggcgggaucucggcu

SEQ ID NO: 603826 - RNA, 24 nt, Human
agugcaguggcgggaucucggcuc

SEQ ID NO: 603827 - RNA, 24 nt, Human
augagguuucaccauguuggccag

SEQ ID NO: 603828 - RNA, 21 nt, Human
auuaagaaaacaagccuauaa

SEQ ID NO: 603829 - RNA, 23 nt, Human
caaacaaaaaaauuagcaacaca

SEQ ID NO: 603830 - RNA, 24 nt, Human
caaagugcugcgauuacaggcaug

SEQ ID NO: 603831 - RNA, 18 nt, Human
caauccauuaauccuccc

SEQ ID NO: 603832 - RNA, 18 nt, Human
caccauguuggccaggau

SEQ ID NO: 603833 - RNA, 22 nt, Human
caccauguuggccaggaugguc

SEQ ID NO: 603834 - RNA, 24 nt, Human
caccauguuggccaggauggucuc

SEQ ID NO: 603835 - RNA, 23 nt, Human
cacccgccucggccucccaaagu

SEQ ID NO: 603836 - RNA, 22 nt, Human
cacgccauucuccugccucagc

SEQ ID NO: 603837 - RNA, 20 nt, Human
cagaaaaugaaaaacauguu

SEQ ID NO: 603838 - RNA, 24 nt, Human
caggccucgagucccccacuagcu

SEQ ID NO: 603839 - RNA, 21 nt, Human
caggcgcccgccacuacgccc

SEQ ID NO: 603840 - RNA, 25 nt, Human
cauauuaagaaaacaagccuauaau

SEQ ID NO: 603841 - RNA, 24 nt, Human
caugccaccacacuuggcuaauuu

SEQ ID NO: 603842 - RNA, 24 nt, Human
ccaaagugcugcgauuacaggcau

SEQ ID NO: 603843 - RNA, 27 nt, Human
ccauuaauccucccaccucagccuccc

SEQ ID NO: 603844 - RNA, 23 nt, Human
cccaaguagcugggacuacaggc

SEQ ID NO: 603845 - RNA, 24 nt, Human
cccaaguagcugggacuacaggcg

SEQ ID NO: 603846 - RNA, 20 nt, Human
cccaccucagccucccaagu

SEQ ID NO: 603847 - RNA, 22 nt, Human
ccccacuagcuccuuccgucca

SEQ ID NO: 603848 - RNA, 24 nt, Human
cccucaggccucgagucccccacu

SEQ ID NO: 603849 - RNA, 21 nt, Human
ccucgagucccccacuagcuc

SEQ ID NO: 603850 - RNA, 23 nt, Human
ccugccucagccucccaaguagc

SEQ ID NO: 603851 - RNA, 24 nt, Human
ccugccucagccucccaaguagcu

SEQ ID NO: 603852 - RNA, 19 nt, Human
cgauuacaggcaugagcca

SEQ ID NO: 603853 - RNA, 24 nt, Human
cgcccaggcuggagugcaguggcg

SEQ ID NO: 603854 - RNA, 19 nt, Human
cgccucccggguucacgcc

SEQ ID NO: 603855 - RNA, 25 nt, Human
cgccucggccucccaaagugcugcg

SEQ ID NO: 603856 - RNA, 22 nt, Human
cgcggagggacgaucggggccg

SEQ ID NO: 603857 - RNA, 24 nt, Human
cgcucugucgcccaggcuggagug

SEQ ID NO: 603858 - RNA, 19 nt, Human
cguccaggcacgggcuccg

SEQ ID NO: 603859 - RNA, 21 nt, Human
cucaagugauccacccgccuc

SEQ ID NO: 603860 - RNA, 24 nt, Human
cucagccucccaaguagcugggac

SEQ ID NO: 603861 - RNA, 21 nt, Human
cucccggguucacgccauucu

SEQ ID NO: 603862 - RNA, 25 nt, Human
cuccugccucagccucccaaguagc

SEQ ID NO: 603863 - RNA, 24 nt, Human
cucgcucugucgcccaggcuggag

SEQ ID NO: 603864 - RNA, 21 nt, Human
cugaucucaagugauccaccc

SEQ ID NO: 603865 - RNA, 21 nt, Human
gagacggagucucgcucuguc

SEQ ID NO: 603866 - RNA, 18 nt, Human
gagguuucaccauguugg

SEQ ID NO: 603867 - RNA, 22 nt, Human
gagguuucaccauguuggccag

SEQ ID NO: 603868 - RNA, 19 nt, Human
gaguaaauaagugcucuuc

SEQ ID NO: 603869 - RNA, 20 nt, Human
gagucccccacuagcuccuu

SEQ ID NO: 603870 - RNA, 18 nt, Human
gauuacaggcaugagcca

SEQ ID NO: 603871 - RNA, 22 nt, Human
gauuacaggcaugagccaccac

SEQ ID NO: 603872 - RNA, 19 nt, Human
gcccaggcuggagugcagu

SEQ ID NO: 603873 - RNA, 20 nt, Human
gcccaggcuggagugcagug

SEQ ID NO: 603874 - RNA, 23 nt, Human
gcccggcuaauuuuuuguauuuu

SEQ ID NO: 603875 - RNA, 25 nt, Human
gccucccggguucacgccauucucc

SEQ ID NO: 603876 - RNA, 20 nt, Human
gccucgagucccccacuagc

SEQ ID NO: 603877 - RNA, 23 nt, Human
gcuaaaagaaaaaccaaacaaaa

SEQ ID NO: 603878 - RNA, 25 nt, Human
gcucugucgcccaggcuggagugca

SEQ ID NO: 603879 - RNA, 23 nt, Human
gggcuccggcgcuagagcaguuu

SEQ ID NO: 603880 - RNA, 18 nt, Human
gguaacgggagcggcgga

SEQ ID NO: 603881 - RNA, 24 nt, Human
gguuucaccauguuggccaggaug

SEQ ID NO: 603882 - RNA, 24 nt, Human
gugauccacccgccucggccuccc

SEQ ID NO: 603883 - RNA, 19 nt, Human
uaaaagaaaaaccaaacaa

SEQ ID NO: 603884 - RNA, 20 nt, Human
uaaaagaaaaaccaaacaaa

SEQ ID NO: 603885 - RNA, 24 nt, Human
uaaaagaaaaaccaaacaaaaaac

SEQ ID NO: 603886 - RNA, 20 nt, Human
uaaaaugucuccugagauga

SEQ ID NO: 603887 - RNA, 22 nt, Human
uaaaaugucuccugagaugaaa

SEQ ID NO: 603888 - RNA, 21 nt, Human
uaacaaaccugaugaaaaaga

SEQ ID NO: 603889 - RNA, 24 nt, Human
uaauuacccaaaucaaaauuuagc

SEQ ID NO: 603890 - RNA, 24 nt, Human
uaauuuuuuguauuuuuaguagag

SEQ ID NO: 603891 - RNA, 25 nt, Human
uaauuuuuuguauuuuuaguagaga

SEQ ID NO: 603892 - RNA, 23 nt, Human
uacaauuauaaaacauagcacac

SEQ ID NO: 603893 - RNA, 22 nt, Human
uacaggcaugagccaccacgcc

SEQ ID NO: 603894 - RNA, 22 nt, Human
uagagaugagguuucaccaugu

SEQ ID NO: 603895 - RNA, 24 nt, Human
uaguagagaugagguuucaccaug

SEQ ID NO: 603896 - RNA, 26 nt, Human
uaguagagaugagguuucaccauguu

SEQ ID NO: 603897 - RNA, 18 nt, Human
uauuaagaaaacaagccu

SEQ ID NO: 603898 - RNA, 24 nt, Human
ucaccauguuggccaggauggucu

SEQ ID NO: 603899 - RNA, 18 nt, Human
ucacugcaagcuccgccu

SEQ ID NO: 603900 - RNA, 19 nt, Human
ucacugcaagcuccgccuc

SEQ ID NO: 603901 - RNA, 24 nt, Human
ucacugcaagcuccgccucccggg

SEQ ID NO: 603902 - RNA, 20 nt, Human
ucacuuccaaaaauuaaagu

SEQ ID NO: 603903 - RNA, 18 nt, Human
ucagccucccaaguagcu

SEQ ID NO: 603904 - RNA, 20 nt, Human
ucagccucccaaguagcugg

SEQ ID NO: 603905 - RNA, 18 nt, Human
ucagcuaaaagaaaaacc

SEQ ID NO: 603906 - RNA, 24 nt, Human
ucagcuaaaagaaaaaccaaacaa

SEQ ID NO: 603907 - RNA, 24 nt, Human
ucccaaagugcugcgauuacaggc

SEQ ID NO: 603908 - RNA, 24 nt, Human
ucccaaguagcugggacuacaggc

SEQ ID NO: 603909 - RNA, 21 nt, Human
ucccggguucacgccauucuc

SEQ ID NO: 603910 - RNA, 24 nt, Human
ucccggguucacgccauucuccug

SEQ ID NO: 603911 - RNA, 26 nt, Human
uccucccaccucagccucccaaguac

SEQ ID NO: 603912 - RNA, 24 nt, Human
ucgcccaggcuggagugcaguggc

SEQ ID NO: 603913 - RNA, 24 nt, Human
ucgcucugucgcccaggcuggagu

SEQ ID NO: 603914 - RNA, 18 nt, Human
ucggccucccaaagugcu

SEQ ID NO: 603915 - RNA, 19 nt, Human
ucucgcucugucgcccagg

SEQ ID NO: 603916 - RNA, 22 nt, Human
ucucgcucugucgcccaggcug

SEQ ID NO: 603917 - RNA, 23 nt, Human
ucucgcucugucgcccaggcugg

SEQ ID NO: 603918 - RNA, 24 nt, Human
ucucgcucugucgcccaggcugga

SEQ ID NO: 603919 - RNA, 26 nt, Human
ucucgcucugucgcccaggcuggagu

SEQ ID NO: 603920 - RNA, 27 nt, Human
ucucgcucugucgcccaggcuggagug

SEQ ID NO: 603921 - RNA, 24 nt, Human
ucugucgcccaggcuggagugcag

SEQ ID NO: 603922 - RNA, 22 nt, Human
ucuuuaacuccauuuuuaucca

SEQ ID NO: 603923 - RNA, 22 nt, Human
ugaaaaagaggaaagcuguaua

SEQ ID NO: 603924 - RNA, 24 nt, Human
ugaaaaagaggaaagcuguauaaa

SEQ ID NO: 603925 - RNA, 24 nt, Human
ugaagagacaggcuaaguaaguaa

SEQ ID NO: 603926 - RNA, 24 nt, Human
ugagguuucaccauguuggccagg

SEQ ID NO: 603927 - RNA, 24 nt, Human
ugaucucaagugauccacccgccu

SEQ ID NO: 603928 - RNA, 22 nt, Human
ugcaguggcgggaucucggcuc

SEQ ID NO: 603929 - RNA, 20 nt, Human
ugcccucaggccucgagucc

SEQ ID NO: 603930 - RNA, 24 nt, Human
ugccucagccucccaaguagcugg

SEQ ID NO: 603931 - RNA, 22 nt, Human
ugcgauuacaggcaugagccac

SEQ ID NO: 603932 - RNA, 23 nt, Human
ugcgauuacaggcaugagccacc

SEQ ID NO: 603933 - RNA, 24 nt, Human
ugcgauuacaggcaugagccacca

SEQ ID NO: 603934 - RNA, 23 nt, Human
uggagugcaguggcgggaucucg

SEQ ID NO: 603935 - RNA, 24 nt, Human
uggagugcaguggcgggaucucgg

SEQ ID NO: 603936 - RNA, 24 nt, Human
uggccaggauggucucaaacuucu

SEQ ID NO: 603937 - RNA, 21 nt, Human
ugggaccauaggcacaugcca

SEQ ID NO: 603938 - RNA, 24 nt, Human
ugggaccauaggcacaugccacca

SEQ ID NO: 603939 - RNA, 21 nt, Human
ugggacuacaggcgcccgcca

SEQ ID NO: 603940 - RNA, 22 nt, Human
ugggacuacaggcgcccgccac

SEQ ID NO: 603941 - RNA, 22 nt, Human
ugggacuacaggcgcccgccac

SEQ ID NO: 603942 - RNA, 24 nt, Human
ugggacuacaggcgcccgccacua

SEQ ID NO: 603943 - RNA, 20 nt, Human
uguauaaaaacucaguauca

SEQ ID NO: 603944 - RNA, 18 nt, Human
uuaguagagaugagguuu

SEQ ID NO: 603945 - RNA, 22 nt, Human
uuaguagagaugagguuucacc

SEQ ID NO: 603946 - RNA, 24 nt, Human
uuaguagagaugagguuucaccau

SEQ ID NO: 603947 - RNA, 24 nt, Human
uuccaaaaauuaaaguccggcagg

SEQ ID NO: 603948 - RNA, 19 nt, Human
uuucaccauguuggccagg

SEQ ID NO: 603949 - RNA, 20 nt, Human
uuucaccauguuggccagga

SEQ ID NO: 603950 - RNA, 24 nt, Human
uuuuuaguagagaugagguuucac

SEQ ID NO: 603951 - RNA, 21 nt, Human
uuuuuguauuuuuaguagaga

SEQ ID NO: 603952 - RNA, 24 nt, Human
uuuuuuguauuuuuaguagagaug

SEQ ID NO: 603953 - RNA, 20 nt, Human
aaagaagcccaggcaccccc

SEQ ID NO: 603954 - RNA, 24 nt, Human
aaagugcaguuugggaacugggag

SEQ ID NO: 603955 - RNA, 24 nt, Human
aagaacagaggaaagagaagccaa

SEQ ID NO: 603956 - RNA, 18 nt, Human
aagagccuggcuuccacc

SEQ ID NO: 603957 - RNA, 19 nt, Human
aaggucccacagggaucag

SEQ ID NO: 603958 - RNA, 19 nt, Human
aagugcaguuugggaacug

SEQ ID NO: 603959 - RNA, 20 nt, Human
acaggaccuugaugacaggg

SEQ ID NO: 603960 - RNA, 18 nt, Human
acaugccgggagcgcccc

SEQ ID NO: 603961 - RNA, 18 nt, Human
acgcugcgguacagggac

SEQ ID NO: 603962 - RNA, 18 nt, Human
acuggucccuagaccgca

SEQ ID NO: 603963 - RNA, 18 nt, Human
agaaaaucuuccauuccc

SEQ ID NO: 603964 - RNA, 18 nt, Human
agacccccaucccugcug

SEQ ID NO: 603965 - RNA, 26 nt, Human
agaggaaagagaagccaagcaaagag

SEQ ID NO: 603966 - RNA, 21 nt, Human
agcaagggugguucucaucaa

SEQ ID NO: 603967 - RNA, 23 nt, Human
aggaaagagaagccaagcaaaga

SEQ ID NO: 603968 - RNA, 19 nt, Human
aggggaaguugaagugggg

SEQ ID NO: 603969 - RNA, 20 nt, Human
augccgggagcgccccacgc

SEQ ID NO: 603970 - RNA, 19 nt, Human
caagguaggaacugccucu

SEQ ID NO: 603971 - RNA, 22 nt, Human
cacagccucgguaguauuuauu

SEQ ID NO: 603972 - RNA, 24 nt, Human
caccagcgcuucagaauuccucaa

SEQ ID NO: 603973 - RNA, 19 nt, Human
cacugcagagaagcagagu

SEQ ID NO: 603974 - RNA, 26 nt, Human
cagcacccuacagcuguuagaccccc

SEQ ID NO: 603975 - RNA, 19 nt, Human
cagcuuugaauagcgcccc

SEQ ID NO: 603976 - RNA, 20 nt, Human
caggaccuugaugacagggu

SEQ ID NO: 603977 - RNA, 22 nt, Human
ccaccgcgcucccggcgcggcc

SEQ ID NO: 603978 - RNA, 23 nt, Human
ccaccgcgcucccggcgcggccu

SEQ ID NO: 603979 - RNA, 22 nt, Human
ccccacgccuagccccaccgcg

SEQ ID NO: 603980 - RNA, 19 nt, Human
ccccaggggacagucccac

SEQ ID NO: 603981 - RNA, 24 nt, Human
ccccccaggggacagucccacccc

SEQ ID NO: 603982 - RNA, 19 nt, Human
cccuacagcuguuagaccc

SEQ ID NO: 603983 - RNA, 23 nt, Human
ccuagccccaccgcgcucccggc

SEQ ID NO: 603984 - RNA, 21 nt, Human
ccugcccccuuaggagcccac

SEQ ID NO: 603985 - RNA, 24 nt, Human
cgaggucaagugcugucuucggau

SEQ ID NO: 603986 - RNA, 27 nt, Human
cgccaaagaagcccaggcaccccccag

SEQ ID NO: 603987 - RNA, 22 nt, Human
cgccugcccccuuaggagccca

SEQ ID NO: 603988 - RNA, 23 nt, Human
cgccugcccccuuaggagcccac

SEQ ID NO: 603989 - RNA, 24 nt, Human
cgcuucagaauuccucaagcaagg

SEQ ID NO: 603990 - RNA, 18 nt, Human
cugcccccuuaggagccc

SEQ ID NO: 603991 - RNA, 22 nt, Human
cuuccgaucuaaaagugagagg

SEQ ID NO: 603992 - RNA, 21 nt, Human
cuucggauggcguccacucac

SEQ ID NO: 603993 - RNA, 22 nt, Human
gaaagagaagccaagcaaagag

SEQ ID NO: 603994 - RNA, 21 nt, Human
gaagcccaggcaccccccagg

SEQ ID NO: 603995 - RNA, 18 nt, Human
gagcugcugcagcguggc

SEQ ID NO: 603996 - RNA, 20 nt, Human
gagggaaccgcagagaggug

SEQ ID NO: 603997 - RNA, 22 nt, Human
gcagccagggcuggacgggaga

SEQ ID NO: 603998 - RNA, 18 nt, Human
gccccuccugggccucag

SEQ ID NO: 603999 - RNA, 20 nt, Human
gccuagccccaccgcgcucc

SEQ ID NO: 604000 - RNA, 20 nt, Human
gcuaccaaccuggagugaag

SEQ ID NO: 604001 - RNA, 23 nt, Human
ggaaagagaagccaagcaaagag

SEQ ID NO: 604002 - RNA, 25 nt, Human
ggaaggggugcggccauccucccgg

SEQ ID NO: 604003 - RNA, 21 nt, Human
ggacgggagaccacguuuggg

SEQ ID NO: 604004 - RNA, 18 nt, Human
ggcagcauggauugauau

SEQ ID NO: 604005 - RNA, 23 nt, Human
ggcugcagccagggcuggacggg

SEQ ID NO: 604006 - RNA, 23 nt, Human
gggaaccgcagagaggugugagc

SEQ ID NO: 604007 - RNA, 19 nt, Human
guccacucacacgccugcc

SEQ ID NO: 604008 - RNA, 22 nt, Human
gucuucgaggggaaguugaagu

SEQ ID NO: 604009 - RNA, 22 nt, Human
gugaacagaucacugcuuccaa

SEQ ID NO: 604010 - RNA, 23 nt, Human
gugaacagaucacugcuuccaaa

SEQ ID NO: 604011 - RNA, 22 nt, Human
gugaagcgcuucccaaaacuaa

SEQ ID NO: 604012 - RNA, 22 nt, Human
uaaccucagcaggcaaagcaau

SEQ ID NO: 604013 - RNA, 19 nt, Human
uagcgagaggcaagugugu

SEQ ID NO: 604014 - RNA, 20 nt, Human
ucaaugaguuucuccucuuc

SEQ ID NO: 604015 - RNA, 22 nt, Human
ucacacgccugcccccuuagga

SEQ ID NO: 604016 - RNA, 21 nt, Human
ucacggaggggaaggugcgcc

SEQ ID NO: 604017 - RNA, 26 nt, Human
ucacuggucccuagaccgcaccuucu

SEQ ID NO: 604018 - RNA, 22 nt, Human
uccaaaaauagagaagcagagu

SEQ ID NO: 604019 - RNA, 22 nt, Human
ucccugcugucaaaggucccac

SEQ ID NO: 604020 - RNA, 24 nt, Human
ucccugcugucaaaggucccacag

SEQ ID NO: 604021 - RNA, 19 nt, Human
ucccugugcugcucaggcc

SEQ ID NO: 604022 - RNA, 22 nt, Human
ucuccaaagaagcuaccaaccu

SEQ ID NO: 604023 - RNA, 23 nt, Human
ugaacagaucacugcuuccaaaa

SEQ ID NO: 604024 - RNA, 24 nt, Human
ugaggaggacgcuguagcgagagg

SEQ ID NO: 604025 - RNA, 18 nt, Human
ugccgggagcgccccacg

SEQ ID NO: 604026 - RNA, 20 nt, Human
ugcuggaguggcagcacccu

SEQ ID NO: 604027 - RNA, 25 nt, Human
uggcagcacccuacagcuguuagac

SEQ ID NO: 604028 - RNA, 19 nt, Human
ugggaacugggaggcugca

SEQ ID NO: 604029 - RNA, 21 nt, Human
ugggaggcugcagccagggcu

SEQ ID NO: 604030 - RNA, 20 nt, Human
ugggccucagcaaacugcag

SEQ ID NO: 604031 - RNA, 18 nt, Human
ugggugaucagcaggaag

SEQ ID NO: 604032 - RNA, 22 nt, Human
uuccgaucuaaaagugagaggg

SEQ ID NO: 604033 - RNA, 19 nt, Human
aaaaaaaaaguuguccaaa

SEQ ID NO: 604034 - RNA, 21 nt, Human
aaacuagaaggagcuaccugg

SEQ ID NO: 604035 - RNA, 19 nt, Human
aaaugaccuaaaacuaaag

SEQ ID NO: 604036 - RNA, 19 nt, Human
aagggaagcugguuaccaa

SEQ ID NO: 604037 - RNA, 24 nt, Human
acgaguauuuaaagaaaaagcuag

SEQ ID NO: 604038 - RNA, 26 nt, Human
auaaagcagaaaaugcaggaagaggc

SEQ ID NO: 604039 - RNA, 22 nt, Human
auuauuuugaaguuuuucauca

SEQ ID NO: 604040 - RNA, 19 nt, Human
cacucugccuagcacuuac

SEQ ID NO: 604041 - RNA, 22 nt, Human
cacuggcacaaacucacaaaga

SEQ ID NO: 604042 - RNA, 22 nt, Human
cccaaaaaaaauauaacuaucc

SEQ ID NO: 604043 - RNA, 23 nt, Human
ccuaaaaauauauaauuuaaaau

SEQ ID NO: 604044 - RNA, 22 nt, Human
cuaauauaugucuccuucaucu

SEQ ID NO: 604045 - RNA, 18 nt, Human
cugcuaaguuggucaaaa

SEQ ID NO: 604046 - RNA, 21 nt, Human
cuggacuugcuguuaucagaa

SEQ ID NO: 604047 - RNA, 21 nt, Human
cuggcacaaacucacaaagag

SEQ ID NO: 604048 - RNA, 20 nt, Human
cugggaaacaaaguucaucc

SEQ ID NO: 604049 - RNA, 23 nt, Human
uaaagcuacaagguaaaggcaca

SEQ ID NO: 604050 - RNA, 25 nt, Human
uaaauaaagcagaaaaugcaggaaa

SEQ ID NO: 604051 - RNA, 21 nt, Human
uagaaagugcaccuguaagaa

SEQ ID NO: 604052 - RNA, 22 nt, Human
uagaaagugcaccuguaagaaa

SEQ ID NO: 604053 - RNA, 20 nt, Human
uccaaauauuucaacuuuuu

SEQ ID NO: 604054 - RNA, 22 nt, Human
uccaacuucaaugucguagaac

SEQ ID NO: 604055 - RNA, 18 nt, Human
uccuuuagcuaguuugau

SEQ ID NO: 604056 - RNA, 22 nt, Human
ugauguaugguaaauggcuagg

SEQ ID NO: 604057 - RNA, 18 nt, Human
uggaaugcuauccuuaaa

SEQ ID NO: 604058 - RNA, 21 nt, Human
uggcagaacgcuauucaaagu

SEQ ID NO: 604059 - RNA, 24 nt, Human
uguaaaaacugcuuuugucugcua

SEQ ID NO: 604060 - RNA, 21 nt, Human
ugucguagaacccaaaaaaaa

SEQ ID NO: 604061 - RNA, 23 nt, Human
uguuaucagaaugcuuuuucacu

SEQ ID NO: 604062 - RNA, 18 nt, Human
uuagggucauguguuagg

SEQ ID NO: 604063 - RNA, 23 nt, Human
uuccccuauacuaggauucagca

SEQ ID NO: 604064 - RNA, 21 nt, Human
uuucaucacuuaacaauuucu

SEQ ID NO: 604065 - RNA, 21 nt, Human
aaaaagaaacagccacaggua

SEQ ID NO: 604066 - RNA, 24 nt, Human
aaaaauaaaaagaaacagccacag

SEQ ID NO: 604067 - RNA, 26 nt, Human
aaaaauaaagaaaaaaauaccacgac

SEQ ID NO: 604068 - RNA, 25 nt, Human
aaagaaacagccacagguaauuuag

SEQ ID NO: 604069 - RNA, 19 nt, Human
aaauaaaaagaaacagccc

SEQ ID NO: 604070 - RNA, 23 nt, Human
aacauaccuaaaauucaaaauca

SEQ ID NO: 604071 - RNA, 23 nt, Human
aagcaucccuaauuguggaagga

SEQ ID NO: 604072 - RNA, 26 nt, Human
aaguagucaaaaaaauaaaaagaaac

SEQ ID NO: 604073 - RNA, 23 nt, Human
caaacauuuaaaaauaaagaaaa

SEQ ID NO: 604074 - RNA, 22 nt, Human
cacagcuaaauacucaucuaac

SEQ ID NO: 604075 - RNA, 20 nt, Human
cauauaagaccccaaauaaa

SEQ ID NO: 604076 - RNA, 22 nt, Human
cauauaagcaaaacuaaauuuc

SEQ ID NO: 604077 - RNA, 25 nt, Human
ccaugaauucauaagacaguaacac

SEQ ID NO: 604078 - RNA, 18 nt, Human
cccgacuccugcggccgu

SEQ ID NO: 604079 - RNA, 24 nt, Human
ccgaagcccgacuccugcggccgu

SEQ ID NO: 604080 - RNA, 22 nt, Human
ccugcggccgugggcggcaggc

SEQ ID NO: 604081 - RNA, 26 nt, Human
cggaggaaaguccgcugucucugguu

SEQ ID NO: 604082 - RNA, 19 nt, Human
cucugcugcaaccaucgga

SEQ ID NO: 604083 - RNA, 20 nt, Human
gcauuuuauuauuucugauu

SEQ ID NO: 604084 - RNA, 18 nt, Human
ggaaggaugguaauuuau

SEQ ID NO: 604085 - RNA, 21 nt, Human
uaaaaauugccuuaaauuaau

SEQ ID NO: 604086 - RNA, 21 nt, Human
uaagaccccaaauaaauuuua

SEQ ID NO: 604087 - RNA, 20 nt, Human
uaagagaaacaugcuucguc

SEQ ID NO: 604088 - RNA, 21 nt, Human
uagucaaaaaaauaaaaagaa

SEQ ID NO: 604089 - RNA, 25 nt, Human
uauaaaaguagucaaaaaaauaaaa

SEQ ID NO: 604090 - RNA, 19 nt, Human
ugauggggggauaaaagca

SEQ ID NO: 604091 - RNA, 20 nt, Human
ugcgaccgaagcccgacucc

SEQ ID NO: 604092 - RNA, 22 nt, Human
ugcggccgugggcggcaggcac

SEQ ID NO: 604093 - RNA, 20 nt, Human
uggaauguaaaugaaaacuu

SEQ ID NO: 604094 - RNA, 21 nt, Human
ugucucuggugcgaccgaagc

SEQ ID NO: 604095 - RNA, 22 nt, Human
uuaacuaggaaauuugcauuua

SEQ ID NO: 604096 - RNA, 22 nt, Human
uuagauuaauuauaacaacaac

SEQ ID NO: 604097 - RNA, 19 nt, Human
uucaaaaucaaguuaaaua

SEQ ID NO: 604098 - RNA, 20 nt, Human
uugguaucaaacaacugcaa

SEQ ID NO: 604099 - RNA, 18 nt, Human
uuuuuuuuuuuuuuuuug

SEQ ID NO: 604100 - RNA, 24 nt, Human
aaagugcugggauuacagguguga

SEQ ID NO: 604101 - RNA, 18 nt, Human
aagugcugggauuacagg

SEQ ID NO: 604102 - RNA, 19 nt, Human
aagugcugggauuacaggu

SEQ ID NO: 604103 - RNA, 26 nt, Human
aagugcugggauuacaggugugagcc

SEQ ID NO: 604104 - RNA, 20 nt, Human
aauucacccgucucagccuc

SEQ ID NO: 604105 - RNA, 24 nt, Human
aauuuuguauuuuuaguagagaca

SEQ ID NO: 604106 - RNA, 24 nt, Human
acaggauuucaccauguuggucag

SEQ ID NO: 604107 - RNA, 24 nt, Human
accauguuggucaggcuggucucg

SEQ ID NO: 604108 - RNA, 25 nt, Human
acccgucucagccucccaaagugcu

SEQ ID NO: 604109 - RNA, 24 nt, Human
acucuuguugcccaggcuggagug

SEQ ID NO: 604110 - RNA, 23 nt, Human
acuuguugaaggcuuugccauau

SEQ ID NO: 604111 - RNA, 23 nt, Human
aggauuucaccauguuggucagg

SEQ ID NO: 604112 - RNA, 21 nt, Human
aguagcugggauuacaggcau

SEQ ID NO: 604113 - RNA, 23 nt, Human
aguagcugggauuacaggcaugc

SEQ ID NO: 604114 - RNA, 21 nt, Human
agugcaauggcgcgaucucag

SEQ ID NO: 604115 - RNA, 23 nt, Human
augcaccacuacgcauggcuaau

SEQ ID NO: 604116 - RNA, 24 nt, Human
caaagugcugggauuacaggugug

SEQ ID NO: 604117 - RNA, 21 nt, Human
caaccucugccucccggguuc

SEQ ID NO: 604118 - RNA, 22 nt, Human
caagcaauucuccugccucagc

SEQ ID NO: 604119 - RNA, 21 nt, Human
cacagagcgcugaagacgaga

SEQ ID NO: 604120 - RNA, 21 nt, Human
cacauucuucacauuuguaga

SEQ ID NO: 604121 - RNA, 21 nt, Human
caccauguuggucaggcuggu

SEQ ID NO: 604122 - RNA, 24 nt, Human
caccauguuggucaggcuggucuc

SEQ ID NO: 604123 - RNA, 23 nt, Human
cacccgucucagccucccaaagu

SEQ ID NO: 604124 - RNA, 19 nt, Human
caccgcacccagccagaau

SEQ ID NO: 604125 - RNA, 24 nt, Human
cacucuuguugcccaggcuggagu

SEQ ID NO: 604126 - RNA, 23 nt, Human
cacuucaaccucugccucccggg

SEQ ID NO: 604127 - RNA, 20 nt, Human
cagcgagggacaaaggcccc

SEQ ID NO: 604128 - RNA, 24 nt, Human
caggauuucaccauguuggucagg

SEQ ID NO: 604129 - RNA, 21 nt, Human
caggccacagcgagggacaaa

SEQ ID NO: 604130 - RNA, 20 nt, Human
caguaugaauuaucuuaugu

SEQ ID NO: 604131 - RNA, 21 nt, Human
ccaaagugcugggauuacagg

SEQ ID NO: 604132 - RNA, 21 nt, Human
ccaaagugcugggauuacagg

SEQ ID NO: 604133 - RNA, 24 nt, Human
ccaaagugcugggauuacaggugu

SEQ ID NO: 604134 - RNA, 21 nt, Human
ccaauaccugcaggucacagg

SEQ ID NO: 604135 - RNA, 23 nt, Human
ccacauucuucacauuuguagaa

SEQ ID NO: 604136 - RNA, 23 nt, Human
ccacucuuguugcccaggcugga

SEQ ID NO: 604137 - RNA, 23 nt, Human
cccgaguagcugggauuacaggc

SEQ ID NO: 604138 - RNA, 24 nt, Human
cccgaguagcugggauuacaggca

SEQ ID NO: 604139 - RNA, 23 nt, Human
cccggguucaagcaauucuccug

SEQ ID NO: 604140 - RNA, 23 nt, Human
ccgaguagcugggauuacaggca

SEQ ID NO: 604141 - RNA, 24 nt, Human
ccgaguagcugggauuacaggcau

SEQ ID NO: 604142 - RNA, 24 nt, Human
ccgucucagccucccaaagugcug

SEQ ID NO: 604143 - RNA, 24 nt, Human
ccucccggguucaagcaauucucc

SEQ ID NO: 604144 - RNA, 23 nt, Human
ccugccucagccucccgaguagc

SEQ ID NO: 604145 - RNA, 24 nt, Human
ccugccucagccucccgaguagcu

SEQ ID NO: 604146 - RNA, 24 nt, Human
cgucucagccucccaaagugcugg

SEQ ID NO: 604147 - RNA, 24 nt, Human
cuaauuuuguauuuuuaguagaga

SEQ ID NO: 604148 - RNA, 24 nt, Human
cucacuucaaccucugccucccgg

SEQ ID NO: 604149 - RNA, 24 nt, Human
cucagccucccgaguagcugggau

SEQ ID NO: 604150 - RNA, 25 nt, Human
cucccaaccucauguaauucacccg

SEQ ID NO: 604151 - RNA, 18 nt, Human
cucuuguugcccaggcug

SEQ ID NO: 604152 - RNA, 21 nt, Human
cugcaggucacagggccacag

SEQ ID NO: 604153 - RNA, 23 nt, Human
cuucaaccucugccucccggguu

SEQ ID NO: 604154 - RNA, 24 nt, Human
cuuguugcccaggcuggagugcaa

SEQ ID NO: 604155 - RNA, 26 nt, Human
gagccuggaccucuaggagcagagga

SEQ ID NO: 604156 - RNA, 19 nt, Human
gagcgcugaagacgagacc

SEQ ID NO: 604157 - RNA, 20 nt, Human
gagcgcugaagacgagaccu

SEQ ID NO: 604158 - RNA, 18 nt, Human
gagcucaggccacagcga

SEQ ID NO: 604159 - RNA, 22 nt, Human
gagcucaggccacagcgaggga

SEQ ID NO: 604160 - RNA, 19 nt, Human
gaggaccaauuaaagccuu

SEQ ID NO: 604161 - RNA, 18 nt, Human
gauuacaggugugagcca

SEQ ID NO: 604162 - RNA, 22 nt, Human
gauuacaggugugagccaccgc

SEQ ID NO: 604163 - RNA, 23 nt, Human
gauuacaggugugagccaccgca

SEQ ID NO: 604164 - RNA, 19 nt, Human
gccacagcgagggacaaag

SEQ ID NO: 604165 - RNA, 24 nt, Human
gccacucuuguugcccaggcugga

SEQ ID NO: 604166 - RNA, 19 nt, Human
gcccaggcuggagugcaau

SEQ ID NO: 604167 - RNA, 19 nt, Human
gcuggagugcaauggcgcg

SEQ ID NO: 604168 - RNA, 23 nt, Human
gcuggucucgaacucccaaccuc

SEQ ID NO: 604169 - RNA, 23 nt, Human
ggggaccgguuaaaggcuuugcc

SEQ ID NO: 604170 - RNA, 24 nt, Human
guaauucacccgucucagccuccc

SEQ ID NO: 604171 - RNA, 23 nt, Human
guagaauuucucuccaguaugaa

SEQ ID NO: 604172 - RNA, 20 nt, Human
guagcugggauuacaggcau

SEQ ID NO: 604173 - RNA, 24 nt, Human
uaaguuuuggggaccgguuaaagg

SEQ ID NO: 604174 - RNA, 25 nt, Human
uacaggcaugcaccacuacgcaugg

SEQ ID NO: 604175 - RNA, 24 nt, Human
uacaggugugagccaccgcaccca

SEQ ID NO: 604176 - RNA, 20 nt, Human
uaccugcaggucacagggcc

SEQ ID NO: 604177 - RNA, 21 nt, Human
uaccuuauguuuaguaagagu

SEQ ID NO: 604178 - RNA, 22 nt, Human
uagagacaggauuucaccaugu

SEQ ID NO: 604179 - RNA, 25 nt, Human
uagagacaggauuucaccauguugg

SEQ ID NO: 604180 - RNA, 21 nt, Human
uaggagcagaggacacagagc

SEQ ID NO: 604181 - RNA, 18 nt, Human
uaguaagaguugaagacu

SEQ ID NO: 604182 - RNA, 24 nt, Human
uaguagagacaggauuucaccaug

SEQ ID NO: 604183 - RNA, 26 nt, Human
uaguagagacaggauuucaccauguu

SEQ ID NO: 604184 - RNA, 21 nt, Human
uaucuuaugucugguaagaau

SEQ ID NO: 604185 - RNA, 19 nt, Human
uaugugcaguaagguuuga

SEQ ID NO: 604186 - RNA, 18 nt, Human
ucacuucaaccucugccu

SEQ ID NO: 604187 - RNA, 24 nt, Human
ucacuucaaccucugccucccggg

SEQ ID NO: 604188 - RNA, 20 nt, Human
ucagccucccgaguagcugg

SEQ ID NO: 604189 - RNA, 23 nt, Human
ucccaaagugcugggauuacagg

SEQ ID NO: 604190 - RNA, 26 nt, Human
ucccaaccucauguaauucacccguc

SEQ ID NO: 604191 - RNA, 18 nt, Human
ucccaauaccugcagguc

SEQ ID NO: 604192 - RNA, 24 nt, Human
ucccgaguagcugggauuacaggc

SEQ ID NO: 604193 - RNA, 21 nt, Human
ucccggguucaagcaauucuc

SEQ ID NO: 604194 - RNA, 24 nt, Human
ucccggguucaagcaauucuccug

SEQ ID NO: 604195 - RNA, 18 nt, Human
ucuccaauaugaguuauc

SEQ ID NO: 604196 - RNA, 24 nt, Human
ucuccugccucagccucccgagua

SEQ ID NO: 604197 - RNA, 20 nt, Human
ucucuccaguaugaauuauc

SEQ ID NO: 604198 - RNA, 20 nt, Human
ucucuccaguaugaauuauc

SEQ ID NO: 604199 - RNA, 24 nt, Human
ucugccucccggguucaagcaauu

SEQ ID NO: 604200 - RNA, 22 nt, Human
ucuuguugcccaggcuggagug

SEQ ID NO: 604201 - RNA, 21 nt, Human
ucuuuuauguuuaguaagggu

SEQ ID NO: 604202 - RNA, 24 nt, Human
ugaagacgagaccuggagcucagg

SEQ ID NO: 604203 - RNA, 20 nt, Human
ugagauggagugccacucuu

SEQ ID NO: 604204 - RNA, 23 nt, Human
ugagauggagugccacucuuguu

SEQ ID NO: 604205 - RNA, 22 nt, Human
ugccacauucuucacauuugua

SEQ ID NO: 604206 - RNA, 22 nt, Human
ugccacauucuucacauuugua

SEQ ID NO: 604207 - RNA, 24 nt, Human
ugccacucuuguugcccaggcugg

SEQ ID NO: 604208 - RNA, 22 nt, Human
ugccauauucuucacacucaua

SEQ ID NO: 604209 - RNA, 18 nt, Human
ugcccaggcuggagugca

SEQ ID NO: 604210 - RNA, 21 nt, Human
ugcccaggcuggagugcaaug

SEQ ID NO: 604211 - RNA, 21 nt, Human
ugcccaggcuggagugcaaug

SEQ ID NO: 604212 - RNA, 24 nt, Human
ugcccaggcuggagugcaauggcg

SEQ ID NO: 604213 - RNA, 24 nt, Human
ugccucagccucccgaguagcugg

SEQ ID NO: 604214 - RNA, 24 nt, Human
ugcugggauuacaggugugagcca

SEQ ID NO: 604215 - RNA, 23 nt, Human
uggagugcaauggcgcgaucuca

SEQ ID NO: 604216 - RNA, 24 nt, Human
uggagugcaauggcgcgaucucag

SEQ ID NO: 604217 - RNA, 24 nt, Human
uggcgcgaucucagcucacuucaa

SEQ ID NO: 604218 - RNA, 21 nt, Human
ugggauuacaggcaugcacca

SEQ ID NO: 604219 - RNA, 24 nt, Human
ugggauuacaggcaugcaccacua

SEQ ID NO: 604220 - RNA, 24 nt, Human
ugggauuacaggcaugcaccacua

SEQ ID NO: 604221 - RNA, 18 nt, Human
ugggauuacaggugugag

SEQ ID NO: 604222 - RNA, 19 nt, Human
ugggauuacaggugugagc

SEQ ID NO: 604223 - RNA, 21 nt, Human
ugggauuacaggugugagcca

SEQ ID NO: 604224 - RNA, 22 nt, Human
ugggauuacaggugugagccac

SEQ ID NO: 604225 - RNA, 23 nt, Human
ugggauuacaggugugagccacc

SEQ ID NO: 604226 - RNA, 24 nt, Human
ugggauuacaggugugagccaccg

SEQ ID NO: 604227 - RNA, 23 nt, Human
uggucaggcuggucucgaacucc

SEQ ID NO: 604228 - RNA, 22 nt, Human
uguaagauguaucuccaauaug

SEQ ID NO: 604229 - RNA, 25 nt, Human
uguaagauguaucuccaauaugagg

SEQ ID NO: 604230 - RNA, 19 nt, Human
uguaggguuucucuccaga

SEQ ID NO: 604231 - RNA, 23 nt, Human
uguaggguuucucuccaguauga

SEQ ID NO: 604232 - RNA, 23 nt, Human
uguaggguuucucuccaguauga

SEQ ID NO: 604233 - RNA, 23 nt, Human
uguaggguuucucuccaguauga

SEQ ID NO: 604234 - RNA, 23 nt, Human
uguaggguuucucuccaguauga

SEQ ID NO: 604235 - RNA, 20 nt, Human
uguugcccaggcuggagugc

SEQ ID NO: 604236 - RNA, 19 nt, Human
uguuuaguaagguaugaga

SEQ ID NO: 604237 - RNA, 18 nt, Human
uuacuuuguucaauaagg

SEQ ID NO: 604238 - RNA, 24 nt, Human
uuaguagagacaggauuucaccau

SEQ ID NO: 604239 - RNA, 23 nt, Human
uuaucuuauguuuaguaagguuu

SEQ ID NO: 604240 - RNA, 21 nt, Human
uucaagcaauucuccugccuc

SEQ ID NO: 604241 - RNA, 24 nt, Human
uucaagcaauucuccugccucagc

SEQ ID NO: 604242 - RNA, 19 nt, Human
uucuuauguuuaguaagaa

SEQ ID NO: 604243 - RNA, 23 nt, Human
uugaagacuggcuaaaggcuuua

SEQ ID NO: 604244 - RNA, 18 nt, Human
uugcccaggcuggagugc

SEQ ID NO: 604245 - RNA, 24 nt, Human
uuucaccauguuggucaggcuggu

SEQ ID NO: 604246 - RNA, 23 nt, Human
uuugaggacucauuaaaagcuuu

SEQ ID NO: 604247 - RNA, 19 nt, Human
uuuguaagguuucucucca

SEQ ID NO: 604248 - RNA, 19 nt, Human
uuuguaggguuucucucca

SEQ ID NO: 604249 - RNA, 19 nt, Human
uuuguaggguuucucucca

SEQ ID NO: 604250 - RNA, 19 nt, Human
uuuguaggguuucucucca

SEQ ID NO: 604251 - RNA, 19 nt, Human
uuuguaggguuucucucca

SEQ ID NO: 604252 - RNA, 19 nt, Human
uuuuguauuuuuaguagag

SEQ ID NO: 604253 - RNA, 20 nt, Human
uuuuguauuuuuaguagaga

SEQ ID NO: 604254 - RNA, 18 nt, Human
agcagcagccuccugggg

SEQ ID NO: 604255 - RNA, 19 nt, Human
aggagggcaggacaauuuc

SEQ ID NO: 604256 - RNA, 22 nt, Human
cacacugucuccucuucuuugu

SEQ ID NO: 604257 - RNA, 22 nt, Human
cagcagccuccuggggugacug

SEQ ID NO: 604258 - RNA, 22 nt, Human
ccacacugucuccucuucuuug

SEQ ID NO: 604259 - RNA, 23 nt, Human
gggugacacacauucauuaaggu

SEQ ID NO: 604260 - RNA, 24 nt, Human
uaaugaugugguuuugaaauguga

SEQ ID NO: 604261 - RNA, 20 nt, Human
uagcagcagccuccuggggu

SEQ ID NO: 604262 - RNA, 21 nt, Human
ucauagcagcagccuccuggg

SEQ ID NO: 604263 - RNA, 18 nt, Human
ucgaaagggguaaccaca

SEQ ID NO: 604264 - RNA, 20 nt, Human
ugcauuuuuuccagcagcuu

SEQ ID NO: 604265 - RNA, 20 nt, Human
ugugguuuugaaaugugaug

SEQ ID NO: 604266 - RNA, 23 nt, Human
aagcagaacggagggaagcagag

SEQ ID NO: 604267 - RNA, 23 nt, Human
aagcagaacggagggaagcagag

SEQ ID NO: 604268 - RNA, 18 nt, Human
aagcugccaaccccucug

SEQ ID NO: 604269 - RNA, 21 nt, Human
acagcacucucaggguucccc

SEQ ID NO: 604270 - RNA, 20 nt, Human
acucagaggaagcagggcca

SEQ ID NO: 604271 - RNA, 20 nt, Human
acuugggcuccauuuucccu

SEQ ID NO: 604272 - RNA, 21 nt, Human
agaacggagggaagcagagga

SEQ ID NO: 604273 - RNA, 18 nt, Human
agacaggaaaaaugaggc

SEQ ID NO: 604274 - RNA, 19 nt, Human
agacaggaaaaaugaggcc

SEQ ID NO: 604275 - RNA, 22 nt, Human
agacaggaaaaaugaggccaag

SEQ ID NO: 604276 - RNA, 23 nt, Human
agacaggaaaaaugaggccaagg

SEQ ID NO: 604277 - RNA, 18 nt, Human
agacuuggagcccaggug

SEQ ID NO: 604278 - RNA, 19 nt, Human
agcaaaggacaccuguccc

SEQ ID NO: 604279 - RNA, 24 nt, Human
agcacucucaggguuccccugccu

SEQ ID NO: 604280 - RNA, 20 nt, Human
agcagccccagucagggcag

SEQ ID NO: 604281 - RNA, 25 nt, Human
agccagugcucuggacaauagaggc

SEQ ID NO: 604282 - RNA, 19 nt, Human
agccgucaauucuucagcc

SEQ ID NO: 604283 - RNA, 20 nt, Human
aggcagacgggagcugaggu

SEQ ID NO: 604284 - RNA, 19 nt, Human
aggcagcagugagagcgug

SEQ ID NO: 604285 - RNA, 22 nt, Human
aggcagcagugagagcgugggc

SEQ ID NO: 604286 - RNA, 24 nt, Human
aggcagcggccagcaggaggcagc

SEQ ID NO: 604287 - RNA, 19 nt, Human
agguggguuaaguucucuc

SEQ ID NO: 604288 - RNA, 25 nt, Human
agugguacuggugccagcucuuggg

SEQ ID NO: 604289 - RNA, 22 nt, Human
agugguauccuggucccugucc

SEQ ID NO: 604290 - RNA, 23 nt, Human
cacacagugacagagugguaucc

SEQ ID NO: 604291 - RNA, 21 nt, Human
caccaagagcccuggggucug

SEQ ID NO: 604292 - RNA, 25 nt, Human
caccccaggguauggacuuccugga

SEQ ID NO: 604293 - RNA, 20 nt, Human
caccccuccucuaacccccu

SEQ ID NO: 604294 - RNA, 18 nt, Human
cagaagccacuggucaca

SEQ ID NO: 604295 - RNA, 19 nt, Human
cagcccagaggcucuuagc

SEQ ID NO: 604296 - RNA, 22 nt, Human
cagcccagaggcucuuagcugc

SEQ ID NO: 604297 - RNA, 19 nt, Human
cagccuccauacagagcca

SEQ ID NO: 604298 - RNA, 24 nt, Human
cagccucuggguuugggaaguccu

SEQ ID NO: 604299 - RNA, 24 nt, Human
caggaaaaaugaggccaaggguua

SEQ ID NO: 604300 - RNA, 23 nt, Human
caggagggaggagcagccccagu

SEQ ID NO: 604301 - RNA, 20 nt, Human
caggauuacucccugccucu

SEQ ID NO: 604302 - RNA, 22 nt, Human
cagggccauccagaggcccagc

SEQ ID NO: 604303 - RNA, 22 nt, Human
caggguauggacuuccuggagg

SEQ ID NO: 604304 - RNA, 20 nt, Human
cagucagggcagggccaucc

SEQ ID NO: 604305 - RNA, 21 nt, Human
cagugcucuggacaauagagg

SEQ ID NO: 604306 - RNA, 19 nt, Human
cauugcuggacgccaagcc

SEQ ID NO: 604307 - RNA, 21 nt, Human
cauuguacaaugcuaauguua

SEQ ID NO: 604308 - RNA, 20 nt, Human
ccaaguccagccucugcacu

SEQ ID NO: 604309 - RNA, 20 nt, Human
ccagccucugcacuucaguc

SEQ ID NO: 604310 - RNA, 18 nt, Human
ccaggacaggagggagga

SEQ ID NO: 604311 - RNA, 21 nt, Human
ccaggacaggagggaggagca

SEQ ID NO: 604312 - RNA, 25 nt, Human
cccaaucuucaccccuccucuaacc

SEQ ID NO: 604313 - RNA, 25 nt, Human
ccccucuguggguccccagcuuuua

SEQ ID NO: 604314 - RNA, 20 nt, Human
cccugcagcccagaggcucu

SEQ ID NO: 604315 - RNA, 23 nt, Human
cccugccucuuccacucucccca

SEQ ID NO: 604316 - RNA, 24 nt, Human
cccuggggucugcagcuccgagcc

SEQ ID NO: 604317 - RNA, 18 nt, Human
ccuaguauacaacaggau

SEQ ID NO: 604318 - RNA, 21 nt, Human
ccuccaggccguggucaguuc

SEQ ID NO: 604319 - RNA, 21 nt, Human
ccucugcacuucagucuuggg

SEQ ID NO: 604320 - RNA, 19 nt, Human
ccucuggcuguccaccagg

SEQ ID NO: 604321 - RNA, 19 nt, Human
ccugccucuuccacucucc

SEQ ID NO: 604322 - RNA, 19 nt, Human
ccugccucuuccacucucc

SEQ ID NO: 604323 - RNA, 24 nt, Human
ccugugugugugugugugugugug

SEQ ID NO: 604324 - RNA, 22 nt, Human
cucccugccucuuccacucucc

SEQ ID NO: 604325 - RNA, 22 nt, Human
cuccuccaggaugggacaucac

SEQ ID NO: 604326 - RNA, 24 nt, Human
cucuauugcccucuccuggacaua

SEQ ID NO: 604327 - RNA, 22 nt, Human
cucuccccacauccauccugaa

SEQ ID NO: 604328 - RNA, 18 nt, Human
cugagccauggucucccc

SEQ ID NO: 604329 - RNA, 18 nt, Human
cugagcccugagucagug

SEQ ID NO: 604330 - RNA, 19 nt, Human
cugaggcagacgggagcug

SEQ ID NO: 604331 - RNA, 18 nt, Human
cugcacuucagucuuggg

SEQ ID NO: 604332 - RNA, 24 nt, Human
cuggguccccugugggaacucaga

SEQ ID NO: 604333 - RNA, 23 nt, Human
cuuccacucuccccacauccauc

SEQ ID NO: 604334 - RNA, 26 nt, Human
gacaccugugugugugugugugugug

SEQ ID NO: 604335 - RNA, 19 nt, Human
gacuucuucccuagggcuc

SEQ ID NO: 604336 - RNA, 23 nt, Human
gagcagccuccauacagagccaa

SEQ ID NO: 604337 - RNA, 19 nt, Human
gagcccuggggucugcagc

SEQ ID NO: 604338 - RNA, 19 nt, Human
gcagcuccgagcagaagcc

SEQ ID NO: 604339 - RNA, 23 nt, Human
gcccgauucuuucuucccuaacc

SEQ ID NO: 604340 - RNA, 27 nt, Human
gccucuggguuugggaaguccugggug

SEQ ID NO: 604341 - RNA, 22 nt, Human
gcggggucccaggacaggaggg

SEQ ID NO: 604342 - RNA, 28 nt, Human
gcugaagcagaacggagggaagcagagg

SEQ ID NO: 604343 - RNA, 23 nt, Human
gcugccuggucacagcuuucuaa

SEQ ID NO: 604344 - RNA, 19 nt, Human
ggaagcagaggacacagcg

SEQ ID NO: 604345 - RNA, 21 nt, Human
ggacacagcggcccugguggg

SEQ ID NO: 604346 - RNA, 18 nt, Human
ggccguggucaguuccaa

SEQ ID NO: 604347 - RNA, 20 nt, Human
ggggagggcagcucagccca

SEQ ID NO: 604348 - RNA, 18 nt, Human
gggucccuggccagaggc

SEQ ID NO: 604349 - RNA, 22 nt, Human
gguguagaagcugggggagaga

SEQ ID NO: 604350 - RNA, 23 nt, Human
guccuggcugugucacucucuug

SEQ ID NO: 604351 - RNA, 21 nt, Human
gugugugugugugugugugug

SEQ ID NO: 604352 - RNA, 24 nt, Human
guuccaaguuacugucuucacugu

SEQ ID NO: 604353 - RNA, 18 nt, Human
uacaccgucaugauaggg

SEQ ID NO: 604354 - RNA, 22 nt, Human
uacuuuaucuugaaaacaaucu

SEQ ID NO: 604355 - RNA, 23 nt, Human
uagacaccugugugugugugugu

SEQ ID NO: 604356 - RNA, 21 nt, Human
uaggaauuauuguccucuuuc

SEQ ID NO: 604357 - RNA, 21 nt, Human
uaggggaagcugaagcagaac

SEQ ID NO: 604358 - RNA, 18 nt, Human
uauuccagucacuccagg

SEQ ID NO: 604359 - RNA, 22 nt, Human
ucaaugcacaguugucacauuu

SEQ ID NO: 604360 - RNA, 22 nt, Human
ucacugccucuggcauucguga

SEQ ID NO: 604361 - RNA, 20 nt, Human
uccacccuuccucugagcca

SEQ ID NO: 604362 - RNA, 20 nt, Human
uccagagccgucaauucuuc

SEQ ID NO: 604363 - RNA, 18 nt, Human
uccaggcugcauucucca

SEQ ID NO: 604364 - RNA, 21 nt, Human
uccccaccagugucugugggg

SEQ ID NO: 604365 - RNA, 23 nt, Human
ucccccaggauuacucccugccu

SEQ ID NO: 604366 - RNA, 18 nt, Human
ucccccagguggguuaag

SEQ ID NO: 604367 - RNA, 25 nt, Human
ucccccagguggguuaaguucucuc

SEQ ID NO: 604368 - RNA, 18 nt, Human
ucccccugccugggccag

SEQ ID NO: 604369 - RNA, 24 nt, Human
uccccugccuccaccaagagcccu

SEQ ID NO: 604370 - RNA, 20 nt, Human
ucccuagggcuccuccuccu

SEQ ID NO: 604371 - RNA, 20 nt, Human
ucccugacuucuucccuagg

SEQ ID NO: 604372 - RNA, 26 nt, Human
ucccugccucuuccacucuccccaca

SEQ ID NO: 604373 - RNA, 26 nt, Human
ucccugcugucccccaggauuacucc

SEQ ID NO: 604374 - RNA, 23 nt, Human
ucccuggccagaggcuacuuggg

SEQ ID NO: 604375 - RNA, 22 nt, Human
uccucgggacauugggucccug

SEQ ID NO: 604376 - RNA, 18 nt, Human
ucucuguaaacagcacuc

SEQ ID NO: 604377 - RNA, 24 nt, Human
ucugcagcuccgagcagaagccac

SEQ ID NO: 604378 - RNA, 19 nt, Human
ucuucagccucagucuucc

SEQ ID NO: 604379 - RNA, 22 nt, Human
ucuuucuucccuaaccuuaggg

SEQ ID NO: 604380 - RNA, 20 nt, Human
ugaaaacaaucuugagaagu

SEQ ID NO: 604381 - RNA, 23 nt, Human
ugacuucuucccuagggcuccuc

SEQ ID NO: 604382 - RNA, 19 nt, Human
ugagcagccuccauacaga

SEQ ID NO: 604383 - RNA, 25 nt, Human
ugaggcagacgggagcugagguucu

SEQ ID NO: 604384 - RNA, 19 nt, Human
ugccuccucccugcugucc

SEQ ID NO: 604385 - RNA, 27 nt, Human
ugccucuggcauucgugagcccgauuc

SEQ ID NO: 604386 - RNA, 22 nt, Human
ugcuagacagagaugggugugu

SEQ ID NO: 604387 - RNA, 20 nt, Human
ugcuccacccuuccucugag

SEQ ID NO: 604388 - RNA, 24 nt, Human
uggaacgucccugacccaggguuc

SEQ ID NO: 604389 - RNA, 24 nt, Human
uggaacgucccugacccaggguuu

SEQ ID NO: 604390 - RNA, 23 nt, Human
uggagcccagguguagaagcugg

SEQ ID NO: 604391 - RNA, 20 nt, Human
uggccagaggcuacuugggc

SEQ ID NO: 604392 - RNA, 20 nt, Human
ugggaaguccugggugaguc

SEQ ID NO: 604393 - RNA, 18 nt, Human
ugggagaggcugacccug

SEQ ID NO: 604394 - RNA, 20 nt, Human
ugggagaggcugacccugca

SEQ ID NO: 604395 - RNA, 18 nt, Human
ugggcuguggggcugcuu

SEQ ID NO: 604396 - RNA, 30 nt, Human
uggggagggcagcucagcccaguaggguuu

SEQ ID NO: 604397 - RNA, 19 nt, Human
ugggugugugugcgugucu

SEQ ID NO: 604398 - RNA, 20 nt, Human
ugggugugugugcgugucug

SEQ ID NO: 604399 - RNA, 24 nt, Human
ugggugugugugcgugucugucug

SEQ ID NO: 604400 - RNA, 20 nt, Human
ugguauccuggucccugucc

SEQ ID NO: 604401 - RNA, 24 nt, Human
uggucccugucccugacuucuucc

SEQ ID NO: 604402 - RNA, 19 nt, Human
uggugccagcucuugggga

SEQ ID NO: 604403 - RNA, 19 nt, Human
uguggggugagcagccucc

SEQ ID NO: 604404 - RNA, 24 nt, Human
ugugucuucucucucuauccugag

SEQ ID NO: 604405 - RNA, 19 nt, Human
uguguguguguguguguag

SEQ ID NO: 604406 - RNA, 18 nt, Human
ugugugugugugugugug

SEQ ID NO: 604407 - RNA, 18 nt, Human
ugugugugugugugugug

SEQ ID NO: 604408 - RNA, 18 nt, Human
ugugugugugugugugug

SEQ ID NO: 604409 - RNA, 18 nt, Human
ugugugugugugugugug

SEQ ID NO: 604410 - RNA, 18 nt, Human
ugugugugugugugugug

SEQ ID NO: 604411 - RNA, 18 nt, Human
ugugugugugugugugug

SEQ ID NO: 604412 - RNA, 18 nt, Human
ugugugugugugugugug

SEQ ID NO: 604413 - RNA, 18 nt, Human
ugugugugugugugugug

SEQ ID NO: 604414 - RNA, 18 nt, Human
ugugugugugugugugug

SEQ ID NO: 604415 - RNA, 18 nt, Human
ugugugugugugugugug

SEQ ID NO: 604416 - RNA, 18 nt, Human
ugugugugugugugugug

SEQ ID NO: 604417 - RNA, 18 nt, Human
ugugugugugugugugug

SEQ ID NO: 604418 - RNA, 18 nt, Human
ugugugugugugugugug

SEQ ID NO: 604419 - RNA, 18 nt, Human
ugugugugugugugugug

SEQ ID NO: 604420 - RNA, 18 nt, Human
ugugugugugugugugug

SEQ ID NO: 604421 - RNA, 18 nt, Human
ugugugugugugugugug

SEQ ID NO: 604422 - RNA, 18 nt, Human
ugugugugugugugugug

SEQ ID NO: 604423 - RNA, 18 nt, Human
ugugugugugugugugug

SEQ ID NO: 604424 - RNA, 18 nt, Human
ugugugugugugugugug

SEQ ID NO: 604425 - RNA, 21 nt, Human
ugugugugugugugugugugu

SEQ ID NO: 604426 - RNA, 21 nt, Human
ugugugugugugugugugugu

SEQ ID NO: 604427 - RNA, 21 nt, Human
ugugugugugugugugugugu

SEQ ID NO: 604428 - RNA, 21 nt, Human
ugugugugugugugugugugu

SEQ ID NO: 604429 - RNA, 21 nt, Human
ugugugugugugugugugugu

SEQ ID NO: 604430 - RNA, 21 nt, Human
ugugugugugugugugugugu

SEQ ID NO: 604431 - RNA, 21 nt, Human
ugugugugugugugugugugu

SEQ ID NO: 604432 - RNA, 21 nt, Human
ugugugugugugugugugugu

SEQ ID NO: 604433 - RNA, 21 nt, Human
ugugugugugugugugugugu

SEQ ID NO: 604434 - RNA, 21 nt, Human
ugugugugugugugugugugu

SEQ ID NO: 604435 - RNA, 21 nt, Human
ugugugugugugugugugugu

SEQ ID NO: 604436 - RNA, 21 nt, Human
ugugugugugugugugugugu

SEQ ID NO: 604437 - RNA, 21 nt, Human
ugugugugugugugugugugu

SEQ ID NO: 604438 - RNA, 21 nt, Human
ugugugugugugugugugugu

SEQ ID NO: 604439 - RNA, 21 nt, Human
ugugugugugugugugugugu

SEQ ID NO: 604440 - RNA, 21 nt, Human
ugugugugugugugugugugu

SEQ ID NO: 604441 - RNA, 21 nt, Human
ugugugugugugugugugugu

SEQ ID NO: 604442 - RNA, 21 nt, Human
ugugugugugugugugugugu

SEQ ID NO: 604443 - RNA, 21 nt, Human
ugugugugugugugugugugu

SEQ ID NO: 604444 - RNA, 21 nt, Human
ugugugugugugugugugugu

SEQ ID NO: 604445 - RNA, 21 nt, Human
ugugugugugugugugugugu

SEQ ID NO: 604446 - RNA, 21 nt, Human
ugugugugugugugugugugu

SEQ ID NO: 604447 - RNA, 21 nt, Human
ugugugugugugugugugugu

SEQ ID NO: 604448 - RNA, 21 nt, Human
ugugugugugugugugugugu

SEQ ID NO: 604449 - RNA, 21 nt, Human
ugugugugugugugugugugu

SEQ ID NO: 604450 - RNA, 21 nt, Human
ugugugugugugugugugugu

SEQ ID NO: 604451 - RNA, 21 nt, Human
ugugugugugugugugugugu

SEQ ID NO: 604452 - RNA, 21 nt, Human
ugugugugugugugugugugu

SEQ ID NO: 604453 - RNA, 21 nt, Human
ugugugugugugugugugugu

SEQ ID NO: 604454 - RNA, 21 nt, Human
ugugugugugugugugugugu

SEQ ID NO: 604455 - RNA, 21 nt, Human
ugugugugugugugugugugu

SEQ ID NO: 604456 - RNA, 21 nt, Human
ugugugugugugugugugugu

SEQ ID NO: 604457 - RNA, 21 nt, Human
ugugugugugugugugugugu

SEQ ID NO: 604458 - RNA, 21 nt, Human
ugugugugugugugugugugu

SEQ ID NO: 604459 - RNA, 22 nt, Human
ugugugugugugugugugugua

SEQ ID NO: 604460 - RNA, 22 nt, Human
ugugugugugugugugugugug

SEQ ID NO: 604461 - RNA, 22 nt, Human
ugugugugugugugugugugug

SEQ ID NO: 604462 - RNA, 22 nt, Human
ugugugugugugugugugugug

SEQ ID NO: 604463 - RNA, 22 nt, Human
ugugugugugugugugugugug

SEQ ID NO: 604464 - RNA, 22 nt, Human
ugugugugugugugugugugug

SEQ ID NO: 604465 - RNA, 22 nt, Human
ugugugugugugugugugugug

SEQ ID NO: 604466 - RNA, 22 nt, Human
ugugugugugugugugugugug

SEQ ID NO: 604467 - RNA, 22 nt, Human
ugugugugugugugugugugug

SEQ ID NO: 604468 - RNA, 22 nt, Human
ugugugugugugugugugugug

SEQ ID NO: 604469 - RNA, 22 nt, Human
ugugugugugugugugugugug

SEQ ID NO: 604470 - RNA, 22 nt, Human
ugugugugugugugugugugug

SEQ ID NO: 604471 - RNA, 22 nt, Human
ugugugugugugugugugugug

SEQ ID NO: 604472 - RNA, 22 nt, Human
ugugugugugugugugugugug

SEQ ID NO: 604473 - RNA, 22 nt, Human
ugugugugugugugugugugug

SEQ ID NO: 604474 - RNA, 22 nt, Human
ugugugugugugugugugugug

SEQ ID NO: 604475 - RNA, 23 nt, Human
ugugugugugugugugugugugu

SEQ ID NO: 604476 - RNA, 24 nt, Human
uuagugacuugcugagggucacac

SEQ ID NO: 604477 - RNA, 19 nt, Human
uucacaagacaggaaaaau

SEQ ID NO: 604478 - RNA, 18 nt, Human
uugagaaguaggaauuau

SEQ ID NO: 604479 - RNA, 22 nt, Human
uuuagucacuguuuccucuccu

SEQ ID NO: 604480 - RNA, 21 nt, Human
uuugcucugggccccucccca

SEQ ID NO: 604481 - RNA, 19 nt, Human
aaauaaagcacaauauuca

SEQ ID NO: 604482 - RNA, 25 nt, Human
aaguaggaacagacauccaaaacaa

SEQ ID NO: 604483 - RNA, 23 nt, Human
acaggcacaucugggcugacagg

SEQ ID NO: 604484 - RNA, 18 nt, Human
accugguuuccccaaugg

SEQ ID NO: 604485 - RNA, 19 nt, Human
agacauccaaaacaacuga

SEQ ID NO: 604486 - RNA, 22 nt, Human
agggauggggcagugcucuguc

SEQ ID NO: 604487 - RNA, 22 nt, Human
aggggaucaucaguacauggug

SEQ ID NO: 604488 - RNA, 22 nt, Human
aguacaccugcuaaauaaagca

SEQ ID NO: 604489 - RNA, 25 nt, Human
aucugggcugaggucacagagggau

SEQ ID NO: 604490 - RNA, 21 nt, Human
auggggcagugcucugucagu

SEQ ID NO: 604491 - RNA, 22 nt, Human
auucugggaaacuucucagucu

SEQ ID NO: 604492 - RNA, 19 nt, Human
caaggaggggaucaucagu

SEQ ID NO: 604493 - RNA, 18 nt, Human
caaucaccugguuucccc

SEQ ID NO: 604494 - RNA, 18 nt, Human
cacgcgugucagcaaggc

SEQ ID NO: 604495 - RNA, 18 nt, Human
cacugcugaagcccccgg

SEQ ID NO: 604496 - RNA, 28 nt, Human
cagaaagagacuuuuucuaauacagcag

SEQ ID NO: 604497 - RNA, 19 nt, Human
caggcaaucaccugguuuc

SEQ ID NO: 604498 - RNA, 21 nt, Human
cccaugcuggauacugguaga

SEQ ID NO: 604499 - RNA, 18 nt, Human
ccccccugccuccauucu

SEQ ID NO: 604500 - RNA, 19 nt, Human
cccccugccuccauucugg

SEQ ID NO: 604501 - RNA, 23 nt, Human
cgcuggguugggggcgcugccuc

SEQ ID NO: 604502 - RNA, 22 nt, Human
cuccauguacuucccacugcuu

SEQ ID NO: 604503 - RNA, 24 nt, Human
cuccuuggacucuccagggugcua

SEQ ID NO: 604504 - RNA, 20 nt, Human
cucuguggucgggaaggcuc

SEQ ID NO: 604505 - RNA, 23 nt, Human
cucuguggucgggaaggcuccac

SEQ ID NO: 604506 - RNA, 18 nt, Human
cuugucucacggacaguu

SEQ ID NO: 604507 - RNA, 23 nt, Human
gaacagacauccaaaacaacuga

SEQ ID NO: 604508 - RNA, 18 nt, Human
gaagagcgugggggaggc

SEQ ID NO: 604509 - RNA, 19 nt, Human
gacagguuggccggacucu

SEQ ID NO: 604510 - RNA, 20 nt, Human
gagagcuccauguacuuccc

SEQ ID NO: 604511 - RNA, 24 nt, Human
gaguacaccugcuaaauaaagcac

SEQ ID NO: 604512 - RNA, 21 nt, Human
gcacugcugaagcccccggga

SEQ ID NO: 604513 - RNA, 23 nt, Human
gcagcgccugggccagggggccc

SEQ ID NO: 604514 - RNA, 21 nt, Human
gcgccugggccagggggcccc

SEQ ID NO: 604515 - RNA, 21 nt, Human
gcgcuggguugggggcgcugc

SEQ ID NO: 604516 - RNA, 21 nt, Human
gcugccuccuuggacucucca

SEQ ID NO: 604517 - RNA, 20 nt, Human
ggaacggaguaagaauuuca

SEQ ID NO: 604518 - RNA, 18 nt, Human
ggcagagcccaggcugca

SEQ ID NO: 604519 - RNA, 20 nt, Human
ggcccgugguggagcagcag

SEQ ID NO: 604520 - RNA, 24 nt, Human
ggccugggcuuuguuugcauucug

SEQ ID NO: 604521 - RNA, 24 nt, Human
gggauaaaggcuugaccggaaaga

SEQ ID NO: 604522 - RNA, 18 nt, Human
gggauggggcagugcucu

SEQ ID NO: 604523 - RNA, 20 nt, Human
uacugguagaugacuggggc

SEQ ID NO: 604524 - RNA, 23 nt, Human
uacugguagaugacuggggcggg

SEQ ID NO: 604525 - RNA, 20 nt, Human
uaggaacagacauccaaaac

SEQ ID NO: 604526 - RNA, 20 nt, Human
ucacaucuaaguacaggccc

SEQ ID NO: 604527 - RNA, 18 nt, Human
ucaguggcccaucugcug

SEQ ID NO: 604528 - RNA, 22 nt, Human
ucccugucaguaaaauggggau

SEQ ID NO: 604529 - RNA, 21 nt, Human
ucuaaguacaggccccaugcu

SEQ ID NO: 604530 - RNA, 20 nt, Human
ucuguaacuuuggggguaag

SEQ ID NO: 604531 - RNA, 18 nt, Human
ucuuggucagaaaugaag

SEQ ID NO: 604532 - RNA, 21 nt, Human
ugacuugaaggugccagaugg

SEQ ID NO: 604533 - RNA, 22 nt, Human
ugccuccuuggacucuccaggg

SEQ ID NO: 604534 - RNA, 25 nt, Human
uggaacggaguaagaauuucaggca

SEQ ID NO: 604535 - RNA, 18 nt, Human
uggccggacucuccagga

SEQ ID NO: 604536 - RNA, 21 nt, Human
uggcucuguggucgggaaggc

SEQ ID NO: 604537 - RNA, 22 nt, Human
uggcugggacagguuggccgga

SEQ ID NO: 604538 - RNA, 23 nt, Human
uggugaagagcgugggggaggcg

SEQ ID NO: 604539 - RNA, 19 nt, Human
uguaaaaagccccugggua

SEQ ID NO: 604540 - RNA, 26 nt, Human
uguaacuaggaucuguaacuuugggg

SEQ ID NO: 604541 - RNA, 20 nt, Human
ugugucauagggcaggaaaa

SEQ ID NO: 604542 - RNA, 19 nt, Human
uuacuuaaguugagccuca

SEQ ID NO: 604543 - RNA, 26 nt, Human
uuaguggggcgcuggguugggggcgc

SEQ ID NO: 604544 - RNA, 21 nt, Human
uucccugucaguaaaaugggg

SEQ ID NO: 604545 - RNA, 23 nt, Human
uugaugauggagcguccagaacg

SEQ ID NO: 604546 - RNA, 22 nt, Human
uuggaacggaguaagaauuuca

SEQ ID NO: 604547 - RNA, 20 nt, Human
uuucaggggccugggcuuug

SEQ ID NO: 604548 - RNA, 21 nt, Human
uuucaggggccugggcuuugu

SEQ ID NO: 604549 - RNA, 21 nt, Human
aaauaaaauacaaaaccaagg

SEQ ID NO: 604550 - RNA, 21 nt, Human
aagcagcugagggcuggucau

SEQ ID NO: 604551 - RNA, 24 nt, Human
aaggucauugauauccacagccac

SEQ ID NO: 604552 - RNA, 18 nt, Human
acccagugguguaggcac

SEQ ID NO: 604553 - RNA, 22 nt, Human
agaaagccuguucccgaaguga

SEQ ID NO: 604554 - RNA, 19 nt, Human
agacacaugcucuccgugu

SEQ ID NO: 604555 - RNA, 19 nt, Human
agccagcccuuacccuccc

SEQ ID NO: 604556 - RNA, 20 nt, Human
aggagacacugcccacaacc

SEQ ID NO: 604557 - RNA, 19 nt, Human
aguagagggagaaagaugg

SEQ ID NO: 604558 - RNA, 21 nt, Human
auacagcucaucgaucuugcu

SEQ ID NO: 604559 - RNA, 18 nt, Human
cacagccacaaccugggg

SEQ ID NO: 604560 - RNA, 22 nt, Human
cacagccacaaccuggggcagg

SEQ ID NO: 604561 - RNA, 23 nt, Human
caggagacacugcccacaaccac

SEQ ID NO: 604562 - RNA, 22 nt, Human
cauacugaucgccuacacacag

SEQ ID NO: 604563 - RNA, 24 nt, Human
caucccggagacgccgcuggacac

SEQ ID NO: 604564 - RNA, 20 nt, Human
cauugcuaggaaucuguggg

SEQ ID NO: 604565 - RNA, 23 nt, Human
ccacaaccuggggcagggcggca

SEQ ID NO: 604566 - RNA, 22 nt, Human
cccacaaccacaugguuggcca

SEQ ID NO: 604567 - RNA, 21 nt, Human
cccacaccugcuuuccacuac

SEQ ID NO: 604568 - RNA, 18 nt, Human
ccccguaguuuccagcgc

SEQ ID NO: 604569 - RNA, 24 nt, Human
cccguaguuuccagcgcugacgcc

SEQ ID NO: 604570 - RNA, 23 nt, Human
ccggugggcucuggcuauaggug

SEQ ID NO: 604571 - RNA, 22 nt, Human
ccuacacacagccuggcgaagc

SEQ ID NO: 604572 - RNA, 23 nt, Human
ccuggugagcccugaaagugggg

SEQ ID NO: 604573 - RNA, 21 nt, Human
cggagaugaaacucgcccagc

SEQ ID NO: 604574 - RNA, 21 nt, Human
cggcaggguggccaagcccca

SEQ ID NO: 604575 - RNA, 19 nt, Human
cucacaggagacacugccc

SEQ ID NO: 604576 - RNA, 20 nt, Human
cuugcuggcauggaacucca

SEQ ID NO: 604577 - RNA, 24 nt, Human
gccuggugagcccugaaagugggg

SEQ ID NO: 604578 - RNA, 20 nt, Human
gcgcuuggugacuguggagg

SEQ ID NO: 604579 - RNA, 23 nt, Human
ggcuggucauccuugucgaaggg

SEQ ID NO: 604580 - RNA, 20 nt, Human
gggcagcggcaggguggcca

SEQ ID NO: 604581 - RNA, 25 nt, Human
uacccucaauucggccccguaguuu

SEQ ID NO: 604582 - RNA, 24 nt, Human
uauccacagccacaaccuggggca

SEQ ID NO: 604583 - RNA, 21 nt, Human
uccacagccacaaccuggggc

SEQ ID NO: 604584 - RNA, 19 nt, Human
uccaggcugagcuugaugg

SEQ ID NO: 604585 - RNA, 23 nt, Human
uccaugugacuuccaggcugagc

SEQ ID NO: 604586 - RNA, 27 nt, Human
uccuuggucucacaggagacacuuuac

SEQ ID NO: 604587 - RNA, 21 nt, Human
ugacagaagaagcagcugagg

SEQ ID NO: 604588 - RNA, 24 nt, Human
ugacagaagaagcagcugagggcu

SEQ ID NO: 604589 - RNA, 19 nt, Human
ugagcccugaaaguggggg

SEQ ID NO: 604590 - RNA, 18 nt, Human
ugaguagagggagaaaga

SEQ ID NO: 604591 - RNA, 21 nt, Human
ugccaggcugucccgggccuc

SEQ ID NO: 604592 - RNA, 22 nt, Human
ugcugagccgaggcugggaggc

SEQ ID NO: 604593 - RNA, 22 nt, Human
uggagccagcccuuacccuccc

SEQ ID NO: 604594 - RNA, 20 nt, Human
uggcauggaacuccagucgu

SEQ ID NO: 604595 - RNA, 19 nt, Human
uggcugggcagcggcaggg

SEQ ID NO: 604596 - RNA, 22 nt, Human
ugggggagggguaucuggagcc

SEQ ID NO: 604597 - RNA, 20 nt, Human
uggugacuguggaggccuug

SEQ ID NO: 604598 - RNA, 21 nt, Human
uguaaauaaaauacaaaacca

SEQ ID NO: 604599 - RNA, 19 nt, Human
ugucccgggccucucggcu

SEQ ID NO: 604600 - RNA, 21 nt, Human
uguccggugggcucuggcuau

SEQ ID NO: 604601 - RNA, 21 nt, Human
ugugggggagggguaucugga

SEQ ID NO: 604602 - RNA, 22 nt, Human
ugugggggagggguaucuggag

SEQ ID NO: 604603 - RNA, 18 nt, Human
uuguaggcaccaucccgg

SEQ ID NO: 604604 - RNA, 24 nt, Human
aaaaagaucucgaauacccaugcu

SEQ ID NO: 604605 - RNA, 22 nt, Human
aaaaaggacuccauccucugga

SEQ ID NO: 604606 - RNA, 18 nt, Human
aaaaggccuugcugugag

SEQ ID NO: 604607 - RNA, 20 nt, Human
aaacaaacaaaaaggacucc

SEQ ID NO: 604608 - RNA, 23 nt, Human
aaacaggcacaucuucaugaaca

SEQ ID NO: 604609 - RNA, 18 nt, Human
aaagagcauauuuuagga

SEQ ID NO: 604610 - RNA, 24 nt, Human
aaagugcugggauuacaggcguga

SEQ ID NO: 604611 - RNA, 24 nt, Human
aaagugcugggauuauaggcauga

SEQ ID NO: 604612 - RNA, 22 nt, Human
aaauccauuucccuauggcaca

SEQ ID NO: 604613 - RNA, 18 nt, Human
aacaaauuaacccaaaac

SEQ ID NO: 604614 - RNA, 19 nt, Human
aacauagugaaaccccauc

SEQ ID NO: 604615 - RNA, 20 nt, Human
aacauagugaaaccccaucu

SEQ ID NO: 604616 - RNA, 21 nt, Human
aacauagugaaaccccaucuc

SEQ ID NO: 604617 - RNA, 21 nt, Human
aacauagugaaaccccaucuc

SEQ ID NO: 604618 - RNA, 24 nt, Human
aaccuuguguaugucuccuuugca

SEQ ID NO: 604619 - RNA, 26 nt, Human
aagaccacaagcaugagucagagcca

SEQ ID NO: 604620 - RNA, 24 nt, Human
aagcaauccucuggccuuggccuc

SEQ ID NO: 604621 - RNA, 25 nt, Human
aagcaauccucuggccuuggccucc

SEQ ID NO: 604622 - RNA, 18 nt, Human
aagccacgacagcaacaa

SEQ ID NO: 604623 - RNA, 19 nt, Human
aaguaguugggacuacaag

SEQ ID NO: 604624 - RNA, 18 nt, Human
aaguaucugggacuacag

SEQ ID NO: 604625 - RNA, 24 nt, Human
aagugauccacuuggcucggccuc

SEQ ID NO: 604626 - RNA, 19 nt, Human
aagugcugggauuacaggc

SEQ ID NO: 604627 - RNA, 19 nt, Human
aagugcugggauuacaggc

SEQ ID NO: 604628 - RNA, 19 nt, Human
aagugcugggauuauaggc

SEQ ID NO: 604629 - RNA, 21 nt, Human
aagugcugggauuauaggcau

SEQ ID NO: 604630 - RNA, 27 nt, Human
acaccauagcagguauacaaaaaaugg

SEQ ID NO: 604631 - RNA, 22 nt, Human
acagugccgggagcuaccacgc

SEQ ID NO: 604632 - RNA, 23 nt, Human
acauuaugacucccagaugggaa

SEQ ID NO: 604633 - RNA, 19 nt, Human
acccaggcuggagugcaau

SEQ ID NO: 604634 - RNA, 20 nt, Human
accuugccucuggucucagc

SEQ ID NO: 604635 - RNA, 18 nt, Human
acgggguuucgcuauguu

SEQ ID NO: 604636 - RNA, 23 nt, Human
acgggguuucgcuauguuggcca

SEQ ID NO: 604637 - RNA, 24 nt, Human
acgggguuucgcuauguuggccag

SEQ ID NO: 604638 - RNA, 20 nt, Human
acuagggucagcuuugcuga

SEQ ID NO: 604639 - RNA, 20 nt, Human
acuccauccucuggaaagca

SEQ ID NO: 604640 - RNA, 20 nt, Human
acugcagccucaaacaggau

SEQ ID NO: 604641 - RNA, 23 nt, Human
acuuuucuuccuggcauuuagca

SEQ ID NO: 604642 - RNA, 19 nt, Human
agaaacacauuuuugggcu

SEQ ID NO: 604643 - RNA, 23 nt, Human
agacaaagaugaauaaaggggac

SEQ ID NO: 604644 - RNA, 23 nt, Human
agacagggucucgcuauguugcc

SEQ ID NO: 604645 - RNA, 23 nt, Human
agaccacaagcaugagucagagc

SEQ ID NO: 604646 - RNA, 19 nt, Human
agaggcagaggacacaggu

SEQ ID NO: 604647 - RNA, 21 nt, Human
agcaaggaggugacagcagcc

SEQ ID NO: 604648 - RNA, 20 nt, Human
agcauauaggagccuggccu

SEQ ID NO: 604649 - RNA, 27 nt, Human
agccacgacagcaacaacuuggaaucc

SEQ ID NO: 604650 - RNA, 21 nt, Human
agccauguagugagaauauag

SEQ ID NO: 604651 - RNA, 22 nt, Human
agccuaggcaacauagugaaac

SEQ ID NO: 604652 - RNA, 23 nt, Human
aggaaggaauuucauuuggcuca

SEQ ID NO: 604653 - RNA, 18 nt, Human
aggcaggaggauggcucg

SEQ ID NO: 604654 - RNA, 19 nt, Human
aggcaugagccaccguacc

SEQ ID NO: 604655 - RNA, 19 nt, Human
aggcugcugcaauacagaa

SEQ ID NO: 604656 - RNA, 26 nt, Human
aggcugcugcaauacagaauuucuuu

SEQ ID NO: 604657 - RNA, 20 nt, Human
agggcacugaacuuugccuc

SEQ ID NO: 604658 - RNA, 19 nt, Human
aggggugugggguuggcag

SEQ ID NO: 604659 - RNA, 21 nt, Human
agggucauggaauugagacag

SEQ ID NO: 604660 - RNA, 22 nt, Human
agguccuuucugaccauccuau

SEQ ID NO: 604661 - RNA, 23 nt, Human
agguggccggcacagccacauug

SEQ ID NO: 604662 - RNA, 19 nt, Human
aguagcugggauuacaggc

SEQ ID NO: 604663 - RNA, 25 nt, Human
agugagggucauggaauugagacag

SEQ ID NO: 604664 - RNA, 23 nt, Human
agugcaauggcacaaucacagcu

SEQ ID NO: 604665 - RNA, 20 nt, Human
agugcaguggcacaaucucg

SEQ ID NO: 604666 - RNA, 24 nt, Human
agugcaguggcacaaucucggcuc

SEQ ID NO: 604667 - RNA, 20 nt, Human
agugcaguggcgcgaucucg

SEQ ID NO: 604668 - RNA, 24 nt, Human
agugcaguggcgcgaucucgacuc

SEQ ID NO: 604669 - RNA, 20 nt, Human
agugguguucaaaaccucug

SEQ ID NO: 604670 - RNA, 18 nt, Human
auaaaacaaaaaacaggc

SEQ ID NO: 604671 - RNA, 19 nt, Human
aucacagcucacuggagcc

SEQ ID NO: 604672 - RNA, 23 nt, Human
aucgcuacccucccugcacccaa

SEQ ID NO: 604673 - RNA, 24 nt, Human
augaucuacccaccuuggccuccc

SEQ ID NO: 604674 - RNA, 19 nt, Human
auuacaggcgcaugccacu

SEQ ID NO: 604675 - RNA, 21 nt, Human
auucuccugccucagccuccc

SEQ ID NO: 604676 - RNA, 18 nt, Human
auucuccuggcucagccu

SEQ ID NO: 604677 - RNA, 21 nt, Human
caaaacaaacaaaaaggacuc

SEQ ID NO: 604678 - RNA, 26 nt, Human
caaaacaaacaaaaaggacuccaacu

SEQ ID NO: 604679 - RNA, 21 nt, Human
caaaauaucccaggcccagag

SEQ ID NO: 604680 - RNA, 19 nt, Human
caaagagcauauuuuagga

SEQ ID NO: 604681 - RNA, 21 nt, Human
caaagaucuucccugcucccc

SEQ ID NO: 604682 - RNA, 22 nt, Human
caacaacuuggaaucccccagg

SEQ ID NO: 604683 - RNA, 24 nt, Human
caacaagaccacaagcaugaguca

SEQ ID NO: 604684 - RNA, 21 nt, Human
caacacuuugggaggcccagg

SEQ ID NO: 604685 - RNA, 24 nt, Human
caacacuuugggaggcccaggcag

SEQ ID NO: 604686 - RNA, 24 nt, Human
caaccuccaccucccaggcucaag

SEQ ID NO: 604687 - RNA, 22 nt, Human
caacucauguacgugacugaua

SEQ ID NO: 604688 - RNA, 22 nt, Human
caagaggucugucucacuuccu

SEQ ID NO: 604689 - RNA, 22 nt, Human
caagcaauucuccugccucagc

SEQ ID NO: 604690 - RNA, 19 nt, Human
caaggaggugacagcagcc

SEQ ID NO: 604691 - RNA, 26 nt, Human
caaggcacacaaaaagccuagcaaaa

SEQ ID NO: 604692 - RNA, 22 nt, Human
caagugauucuccuggcucagc

SEQ ID NO: 604693 - RNA, 23 nt, Human
caaucugucauuuccaacacccu

SEQ ID NO: 604694 - RNA, 22 nt, Human
cacaagcaugagucagagccaa

SEQ ID NO: 604695 - RNA, 21 nt, Human
cacaaucacagcucacuggag

SEQ ID NO: 604696 - RNA, 21 nt, Human
cacaggugccaacacaccugg

SEQ ID NO: 604697 - RNA, 23 nt, Human
cacauuuuugggcugccucauga

SEQ ID NO: 604698 - RNA, 21 nt, Human
caccaugcuggccaggcuggu

SEQ ID NO: 604699 - RNA, 22 nt, Human
caccaugcuggccaggcugguc

SEQ ID NO: 604700 - RNA, 27 nt, Human
caccaugcuggccaggcuggucuagaa

SEQ ID NO: 604701 - RNA, 18 nt, Human
cacccccaggaccaaauc

SEQ ID NO: 604702 - RNA, 18 nt, Human
cacccugccuuccuugcu

SEQ ID NO: 604703 - RNA, 24 nt, Human
caccucagccucccaaguaguugg

SEQ ID NO: 604704 - RNA, 20 nt, Human
caccucucucuucccucccc

SEQ ID NO: 604705 - RNA, 23 nt, Human
caccugcuauuuccucuuuccca

SEQ ID NO: 604706 - RNA, 21 nt, Human
cacgacagcaacaacuuggaa

SEQ ID NO: 604707 - RNA, 24 nt, Human
cacgccuguaaucccaacacuuug

SEQ ID NO: 604708 - RNA, 21 nt, Human
cacgcugucuuuuauggggcc

SEQ ID NO: 604709 - RNA, 21 nt, Human
cacucugucgcccagacugcu

SEQ ID NO: 604710 - RNA, 27 nt, Human
cacucugucgcccagacugcuggagug

SEQ ID NO: 604711 - RNA, 24 nt, Human
cacuggcaaccuccaccucccagg

SEQ ID NO: 604712 - RNA, 21 nt, Human
cagaauccuccaagaacucug

SEQ ID NO: 604713 - RNA, 18 nt, Human
caggaagcugagaguggc

SEQ ID NO: 604714 - RNA, 20 nt, Human
caggaccaaauccauuuccc

SEQ ID NO: 604715 - RNA, 19 nt, Human
cagggccaggccacccagc

SEQ ID NO: 604716 - RNA, 24 nt, Human
cagggucucgcuauguugccuagg

SEQ ID NO: 604717 - RNA, 19 nt, Human
cagguucaagugauucucc

SEQ ID NO: 604718 - RNA, 21 nt, Human
cagguucaagugauucuccug

SEQ ID NO: 604719 - RNA, 18 nt, Human
cagugccgggagcuacca

SEQ ID NO: 604720 - RNA, 26 nt, Human
caucuccuuucaaccucaagacagcc

SEQ ID NO: 604721 - RNA, 24 nt, Human
caugcuggccaggcuggucuagaa

SEQ ID NO: 604722 - RNA, 22 nt, Human
ccaaagugcugggauuacaggc

SEQ ID NO: 604723 - RNA, 22 nt, Human
ccaaagugcugggauuacaggc

SEQ ID NO: 604724 - RNA, 24 nt, Human
ccaaagugcugggauuacaggcgu

SEQ ID NO: 604725 - RNA, 24 nt, Human
ccaaagugcugggauuauaggcau

SEQ ID NO: 604726 - RNA, 18 nt, Human
ccacacugcagccucaaa

SEQ ID NO: 604727 - RNA, 19 nt, Human
ccacacugcagccucaaac

SEQ ID NO: 604728 - RNA, 21 nt, Human
ccacauuucugaaccuuucca

SEQ ID NO: 604729 - RNA, 18 nt, Human
ccacccccaggaccaaau

SEQ ID NO: 604730 - RNA, 19 nt, Human
ccaccuugccccucccgag

SEQ ID NO: 604731 - RNA, 22 nt, Human
ccacgacagcaacaacuuggaa

SEQ ID NO: 604732 - RNA, 21 nt, Human
ccacgcccagccagcaauaca

SEQ ID NO: 604733 - RNA, 20 nt, Human
ccacgcccagccagcaauag

SEQ ID NO: 604734 - RNA, 18 nt, Human
ccacugguggccuuacag

SEQ ID NO: 604735 - RNA, 18 nt, Human
ccauacucacacaaaaaa

SEQ ID NO: 604736 - RNA, 23 nt, Human
cccaaguaguugggacuacaagu

SEQ ID NO: 604737 - RNA, 24 nt, Human
cccaaguaguugggacuacaagug

SEQ ID NO: 604738 - RNA, 24 nt, Human
cccaaguaucugggacuacaggca

SEQ ID NO: 604739 - RNA, 23 nt, Human
cccacagugccgggagcuaccac

SEQ ID NO: 604740 - RNA, 20 nt, Human
cccaccucagccucccaagu

SEQ ID NO: 604741 - RNA, 21 nt, Human
cccagagaguuuuauagcuga

SEQ ID NO: 604742 - RNA, 21 nt, Human
cccaggcucaagcaauucucc

SEQ ID NO: 604743 - RNA, 21 nt, Human
ccccccgccaccccacaccuc

SEQ ID NO: 604744 - RNA, 19 nt, Human
cccccgccaccccacaccu

SEQ ID NO: 604745 - RNA, 21 nt, Human
ccccuggauuagcuacugcuc

SEQ ID NO: 604746 - RNA, 22 nt, Human
ccccuuacuaaaccugcucuau

SEQ ID NO: 604747 - RNA, 23 nt, Human
ccccuuacuaaaccugcucuauc

SEQ ID NO: 604748 - RNA, 23 nt, Human
cccgaguagcugggauuacaggc

SEQ ID NO: 604749 - RNA, 24 nt, Human
cccgaguagcugggauuacaggcg

SEQ ID NO: 604750 - RNA, 18 nt, Human
cccuaucagccuucaaac

SEQ ID NO: 604751 - RNA, 21 nt, Human
cccuuacuaaaccugcucuau

SEQ ID NO: 604752 - RNA, 22 nt, Human
ccgaguagcugggauuacaggc

SEQ ID NO: 604753 - RNA, 22 nt, Human
ccgccccccgccaccccacacc

SEQ ID NO: 604754 - RNA, 21 nt, Human
ccuauccaagcucccgccccc

SEQ ID NO: 604755 - RNA, 23 nt, Human
ccuccagaaaugcccuucuccac

SEQ ID NO: 604756 - RNA, 24 nt, Human
ccucccaggcucaagcaauucucc

SEQ ID NO: 604757 - RNA, 24 nt, Human
ccucucagguucaagugauucucc

SEQ ID NO: 604758 - RNA, 20 nt, Human
ccucuggucucagcccucug

SEQ ID NO: 604759 - RNA, 24 nt, Human
ccugaccucaaaugaucuacccac

SEQ ID NO: 604760 - RNA, 23 nt, Human
ccugaccucaagugauccacuug

SEQ ID NO: 604761 - RNA, 24 nt, Human
ccugaccucaagugauccacuugg

SEQ ID NO: 604762 - RNA, 24 nt, Human
ccugcagccaguucauuagguggc

SEQ ID NO: 604763 - RNA, 24 nt, Human
ccugccucagccucccgaguagcu

SEQ ID NO: 604764 - RNA, 24 nt, Human
cgccuguaaucccaacacuuuggg

SEQ ID NO: 604765 - RNA, 21 nt, Human
cgcuacccucccugcacccaa

SEQ ID NO: 604766 - RNA, 19 nt, Human
cgcuauguuggccaggcuc

SEQ ID NO: 604767 - RNA, 24 nt, Human
cgcucugucacccaggcuggagug

SEQ ID NO: 604768 - RNA, 24 nt, Human
cgggguuucgcuauguuggccagg

SEQ ID NO: 604769 - RNA, 22 nt, Human
cuaacccuugauguagaccauc

SEQ ID NO: 604770 - RNA, 24 nt, Human
cucaaaugaucuacccaccuuggc

SEQ ID NO: 604771 - RNA, 24 nt, Human
cucaagcaauucuccugccucagc

SEQ ID NO: 604772 - RNA, 22 nt, Human
cucacgccuguaaucccaacac

SEQ ID NO: 604773 - RNA, 24 nt, Human
cucacgccuguaaucccaacacuu

SEQ ID NO: 604774 - RNA, 23 nt, Human
cucacugaaaccuccaccucuca

SEQ ID NO: 604775 - RNA, 24 nt, Human
cucacuggcaaccuccaccuccca

SEQ ID NO: 604776 - RNA, 23 nt, Human
cucagaauccuccaagaacuccu

SEQ ID NO: 604777 - RNA, 24 nt, Human
cucagccucccaaguaguugggac

SEQ ID NO: 604778 - RNA, 24 nt, Human
cucagccucccgaguagcugggau

SEQ ID NO: 604779 - RNA, 24 nt, Human
cucaggcaauccucccaccucagc

SEQ ID NO: 604780 - RNA, 19 nt, Human
cucccauacucacacaaaa

SEQ ID NO: 604781 - RNA, 20 nt, Human
cucccgccccccgccacccc

SEQ ID NO: 604782 - RNA, 24 nt, Human
cuccuuucaaccucaagacagccc

SEQ ID NO: 604783 - RNA, 24 nt, Human
cucgcucugucacccaggcuggag

SEQ ID NO: 604784 - RNA, 19 nt, Human
cucucagguucaagugauu

SEQ ID NO: 604785 - RNA, 22 nt, Human
cucuggucucagcccucugucc

SEQ ID NO: 604786 - RNA, 24 nt, Human
cugaaaccuccaccucucagguuc

SEQ ID NO: 604787 - RNA, 20 nt, Human
cugaaccuuuccagagagcu

SEQ ID NO: 604788 - RNA, 21 nt, Human
cugcguacccgcacugaccug

SEQ ID NO: 604789 - RNA, 21 nt, Human
cuugccaggacacuucaaccu

SEQ ID NO: 604790 - RNA, 20 nt, Human
cuuggcucggccucccaaag

SEQ ID NO: 604791 - RNA, 21 nt, Human
cuuugcaccugcuauuuccuc

SEQ ID NO: 604792 - RNA, 26 nt, Human
gaaaagacaaagcaagauuaaacaaa

SEQ ID NO: 604793 - RNA, 24 nt, Human
gaaagcagguaagaccuggauucu

SEQ ID NO: 604794 - RNA, 20 nt, Human
gaacagaaauaaguuaaaau

SEQ ID NO: 604795 - RNA, 21 nt, Human
gaacagaauuuuuccucccau

SEQ ID NO: 604796 - RNA, 23 nt, Human
gaccucaaaugaucuacccaccu

SEQ ID NO: 604797 - RNA, 24 nt, Human
gaccucaagugauccacuuggcuc

SEQ ID NO: 604798 - RNA, 24 nt, Human
gagacgggguuucgcuauguuggc

SEQ ID NO: 604799 - RNA, 21 nt, Human
gagcaaggaggugacagcagc

SEQ ID NO: 604800 - RNA, 23 nt, Human
gaggggugugggguuggcaggag

SEQ ID NO: 604801 - RNA, 22 nt, Human
gauauuuuggaagaggcaauga

SEQ ID NO: 604802 - RNA, 18 nt, Human
gauuacaggcgcaugcca

SEQ ID NO: 604803 - RNA, 18 nt, Human
gauuacaggcgugagcca

SEQ ID NO: 604804 - RNA, 21 nt, Human
gauuacaggcgugagccacca

SEQ ID NO: 604805 - RNA, 22 nt, Human
gauuacaggcgugagccaccac

SEQ ID NO: 604806 - RNA, 21 nt, Human
gauuauaggcaugagccaccg

SEQ ID NO: 604807 - RNA, 24 nt, Human
gauuauaggcaugagccaccguac

SEQ ID NO: 604808 - RNA, 21 nt, Human
gauucuccuggcucagccucc

SEQ ID NO: 604809 - RNA, 23 nt, Human
gcaauccucccaccucagccucc

SEQ ID NO: 604810 - RNA, 21 nt, Human
gcacagccacauuguggucuu

SEQ ID NO: 604811 - RNA, 18 nt, Human
gcaccaccaucccugggc

SEQ ID NO: 604812 - RNA, 20 nt, Human
gccccccgccaccccacacc

SEQ ID NO: 604813 - RNA, 21 nt, Human
gcuauguugccuaggcugggc

SEQ ID NO: 604814 - RNA, 20 nt, Human
gcucugggucacucaaggcu

SEQ ID NO: 604815 - RNA, 19 nt, Human
gcuggagugcaauggcaca

SEQ ID NO: 604816 - RNA, 19 nt, Human
gcuggagugcaguggcaca

SEQ ID NO: 604817 - RNA, 19 nt, Human
gcuggagugcaguggcgcg

SEQ ID NO: 604818 - RNA, 20 nt, Human
gcuucauccccaacuaucac

SEQ ID NO: 604819 - RNA, 21 nt, Human
ggacacaggugaagaaggcgu

SEQ ID NO: 604820 - RNA, 19 nt, Human
ggauuacaggcgugagcca

SEQ ID NO: 604821 - RNA, 20 nt, Human
ggcucacgccuguaauccca

SEQ ID NO: 604822 - RNA, 24 nt, Human
ggcuggucuagaacuccugaccuc

SEQ ID NO: 604823 - RNA, 23 nt, Human
gggaagaagaacugauuaagucc

SEQ ID NO: 604824 - RNA, 19 nt, Human
gggagauggaucccagugg

SEQ ID NO: 604825 - RNA, 28 nt, Human
gggcugcagucaucugaagguuuggcug

SEQ ID NO: 604826 - RNA, 23 nt, Human
gggguuucgcuauguuggccagg

SEQ ID NO: 604827 - RNA, 23 nt, Human
gggugggggugcugagugagggu

SEQ ID NO: 604828 - RNA, 20 nt, Human
gggugugggguuggcaggag

SEQ ID NO: 604829 - RNA, 26 nt, Human
ggucuuugcaccugcuauuuccucuu

SEQ ID NO: 604830 - RNA, 18 nt, Human
guagagacagggucucgc

SEQ ID NO: 604831 - RNA, 23 nt, Human
guagagacgggguuucgcuaugu

SEQ ID NO: 604832 - RNA, 18 nt, Human
guagcugggauuacaggc

SEQ ID NO: 604833 - RNA, 20 nt, Human
guccauaaaucuaauuucuc

SEQ ID NO: 604834 - RNA, 24 nt, Human
gugauccacuuggcucggccuccc

SEQ ID NO: 604835 - RNA, 24 nt, Human
gugauucuccuggcucagccuccc

SEQ ID NO: 604836 - RNA, 19 nt, Human
guguagaaacacauuuuug

SEQ ID NO: 604837 - RNA, 22 nt, Human
guguggggcuuuugagaauugg

SEQ ID NO: 604838 - RNA, 18 nt, Human
uaaacaaauacuuaacug

SEQ ID NO: 604839 - RNA, 20 nt, Human
uaauuuguauccccagugcc

SEQ ID NO: 604840 - RNA, 24 nt, Human
uacaggcgugagccaccacgccca

SEQ ID NO: 604841 - RNA, 18 nt, Human
uaccaaagcugccuuguc

SEQ ID NO: 604842 - RNA, 18 nt, Human
uaccagggccaggccacc

SEQ ID NO: 604843 - RNA, 22 nt, Human
uaccagggccaggccacccagc

SEQ ID NO: 604844 - RNA, 22 nt, Human
uacccaccuuggccucccaaag

SEQ ID NO: 604845 - RNA, 22 nt, Human
uagaacaacaccuggcacauga

SEQ ID NO: 604846 - RNA, 22 nt, Human
uagagacagggucucgcuaugu

SEQ ID NO: 604847 - RNA, 22 nt, Human
uagagacagggucucgcucugu

SEQ ID NO: 604848 - RNA, 22 nt, Human
uagagacgggguuucgcuaugu

SEQ ID NO: 604849 - RNA, 18 nt, Human
uagaggaaugaacaaggc

SEQ ID NO: 604850 - RNA, 18 nt, Human
uagcaccaccaaagagca

SEQ ID NO: 604851 - RNA, 20 nt, Human
uaggcaacauagugaaaccc

SEQ ID NO: 604852 - RNA, 24 nt, Human
uagguuuucaccaugcuggccagg

SEQ ID NO: 604853 - RNA, 18 nt, Human
uaguagagacgggguuuc

SEQ ID NO: 604854 - RNA, 24 nt, Human
uaguagagacgggguuucgcuaug

SEQ ID NO: 604855 - RNA, 24 nt, Human
uaguagagauagguuuucaccaug

SEQ ID NO: 604856 - RNA, 19 nt, Human
uaucuacagcuguauaaca

SEQ ID NO: 604857 - RNA, 22 nt, Human
uaugagaccagccuaggcaaca

SEQ ID NO: 604858 - RNA, 22 nt, Human
uaugagaccagccuaggcaaca

SEQ ID NO: 604859 - RNA, 18 nt, Human
uauguugccuaggcuggg

SEQ ID NO: 604860 - RNA, 22 nt, Human
uauguugccuaggcugggcuca

SEQ ID NO: 604861 - RNA, 24 nt, Human
uauguugccuaggcugggcucaaa

SEQ ID NO: 604862 - RNA, 21 nt, Human
uauuccuccucugcacaggcc

SEQ ID NO: 604863 - RNA, 23 nt, Human
ucaaccucaagacagcccuugaa

SEQ ID NO: 604864 - RNA, 23 nt, Human
ucacccagagcauauaggagccu

SEQ ID NO: 604865 - RNA, 18 nt, Human
ucacccaggcuggagugc

SEQ ID NO: 604866 - RNA, 24 nt, Human
ucacugaaaccuccaccucucagg

SEQ ID NO: 604867 - RNA, 22 nt, Human
ucacuggagccucaaacuccug

SEQ ID NO: 604868 - RNA, 24 nt, Human
ucacuggagccucaaacuccuggg

SEQ ID NO: 604869 - RNA, 24 nt, Human
ucacuggcaaccuccaccucccag

SEQ ID NO: 604870 - RNA, 21 nt, Human
ucagaggcagaggacacaggu

SEQ ID NO: 604871 - RNA, 20 nt, Human
ucagccucccgaguagcugg

SEQ ID NO: 604872 - RNA, 24 nt, Human
ucagccuucaaacucaggucaaaa

SEQ ID NO: 604873 - RNA, 21 nt, Human
ucaguaugggaagggacuuca

SEQ ID NO: 604874 - RNA, 19 nt, Human
uccagagagcuugaguguc

SEQ ID NO: 604875 - RNA, 24 nt, Human
ucccaaagugcugggauuacaggc

SEQ ID NO: 604876 - RNA, 24 nt, Human
ucccaaagugcugggauuauaggc

SEQ ID NO: 604877 - RNA, 18 nt, Human
ucccaaguaguugggacu

SEQ ID NO: 604878 - RNA, 24 nt, Human
ucccaaguaucugggacuacaggc

SEQ ID NO: 604879 - RNA, 18 nt, Human
ucccaggcccagagaguu

SEQ ID NO: 604880 - RNA, 21 nt, Human
ucccaggcucaagcaauucuc

SEQ ID NO: 604881 - RNA, 24 nt, Human
ucccaggcucaagcaauucuccug

SEQ ID NO: 604882 - RNA, 25 nt, Human
uccccgcaaaauaucccaggcccag

SEQ ID NO: 604883 - RNA, 24 nt, Human
ucccgaguagcugggauuacaggc

SEQ ID NO: 604884 - RNA, 21 nt, Human
ucccuauggcacaaaggcaga

SEQ ID NO: 604885 - RNA, 24 nt, Human
ucccugcuccccgcaaaauauccc

SEQ ID NO: 604886 - RNA, 21 nt, Human
uccuccaagaacucuguucac

SEQ ID NO: 604887 - RNA, 19 nt, Human
uccucuggccuuggccucc

SEQ ID NO: 604888 - RNA, 18 nt, Human
uccugaccucaaaugauc

SEQ ID NO: 604889 - RNA, 18 nt, Human
uccugggcucaggcaauc

SEQ ID NO: 604890 - RNA, 22 nt, Human
uccugggcucaggcaauccucc

SEQ ID NO: 604891 - RNA, 24 nt, Human
uccugggcucaggcaauccuccca

SEQ ID NO: 604892 - RNA, 23 nt, Human
ucgaauacccaugcuucaucccc

SEQ ID NO: 604893 - RNA, 24 nt, Human
ucgcucugucacccaggcuggagu

SEQ ID NO: 604894 - RNA, 26 nt, Human
ucucacucugucgcccagacugcugg

SEQ ID NO: 604895 - RNA, 27 nt, Human
ucucacucugucgcccagacugcugga

SEQ ID NO: 604896 - RNA, 22 nt, Human
ucucaggggucuuuaaagcuga

SEQ ID NO: 604897 - RNA, 21 nt, Human
ucucagguucaagugauucuc

SEQ ID NO: 604898 - RNA, 24 nt, Human
ucucagguucaagugauucuccug

SEQ ID NO: 604899 - RNA, 20 nt, Human
ucucccuccuuuucacucua

SEQ ID NO: 604900 - RNA, 23 nt, Human
ucucgcuauguugccuaggcugg

SEQ ID NO: 604901 - RNA, 24 nt, Human
ucucgcuauguugccuaggcuggg

SEQ ID NO: 604902 - RNA, 19 nt, Human
ucucgcucugucacccagg

SEQ ID NO: 604903 - RNA, 23 nt, Human
ucucgcucugucacccaggcugg

SEQ ID NO: 604904 - RNA, 24 nt, Human
ucucgcucugucacccaggcugga

SEQ ID NO: 604905 - RNA, 26 nt, Human
ucucgcucugucacccaggcuggagu

SEQ ID NO: 604906 - RNA, 27 nt, Human
ucucgcucugucacccaggcuggagug

SEQ ID NO: 604907 - RNA, 19 nt, Human
ucucuuguucuguuccaac

SEQ ID NO: 604908 - RNA, 23 nt, Human
ucugccacccagcuggagugcag

SEQ ID NO: 604909 - RNA, 24 nt, Human
ucugucacccaggcuggagugcaa

SEQ ID NO: 604910 - RNA, 27 nt, Human
ucugucgcccagacugcuggagugcag

SEQ ID NO: 604911 - RNA, 23 nt, Human
ucuuguccagccuccuuggggca

SEQ ID NO: 604912 - RNA, 21 nt, Human
ugaaaagacaaagcaagauua

SEQ ID NO: 604913 - RNA, 20 nt, Human
ugaaauuaggcaacaggggc

SEQ ID NO: 604914 - RNA, 21 nt, Human
ugaccagggcugcagucaucu

SEQ ID NO: 604915 - RNA, 27 nt, Human
ugaccauccuauccaagcucccgcccc

SEQ ID NO: 604916 - RNA, 20 nt, Human
ugaccucaagugauccacuu

SEQ ID NO: 604917 - RNA, 19 nt, Human
ugacucaguggagccgcag

SEQ ID NO: 604918 - RNA, 19 nt, Human
ugacugugucuuucucccu

SEQ ID NO: 604919 - RNA, 24 nt, Human
ugagaccagccuaggcaacauagu

SEQ ID NO: 604920 - RNA, 18 nt, Human
ugagugagggucauggaa

SEQ ID NO: 604921 - RNA, 21 nt, Human
ugagugagggucauggaauug

SEQ ID NO: 604922 - RNA, 21 nt, Human
ugcacaggccugggguggggg

SEQ ID NO: 604923 - RNA, 22 nt, Human
ugcaguggcacaaucucggcuc

SEQ ID NO: 604924 - RNA, 24 nt, Human
ugccucagccucccgaguagcugg

SEQ ID NO: 604925 - RNA, 20 nt, Human
ugccuccagaaaugcccuuc

SEQ ID NO: 604926 - RNA, 19 nt, Human
ugccuugucucgcaggaaa

SEQ ID NO: 604927 - RNA, 25 nt, Human
ugcgcagccccgaacccacccucaa

SEQ ID NO: 604928 - RNA, 18 nt, Human
ugcugccuccagaaaugc

SEQ ID NO: 604929 - RNA, 24 nt, Human
ugcugggauuacaggcgugagcca

SEQ ID NO: 604930 - RNA, 19 nt, Human
uggaaucccccagggaacc

SEQ ID NO: 604931 - RNA, 20 nt, Human
uggaggggugugggguuggc

SEQ ID NO: 604932 - RNA, 19 nt, Human
uggaguauuauucuuggag

SEQ ID NO: 604933 - RNA, 19 nt, Human
uggagugcaauggcacaau

SEQ ID NO: 604934 - RNA, 21 nt, Human
uggagugcaauggcacaauca

SEQ ID NO: 604935 - RNA, 23 nt, Human
uggagugcaguggcacaaucucg

SEQ ID NO: 604936 - RNA, 24 nt, Human
uggagugcaguggcacaaucucgg

SEQ ID NO: 604937 - RNA, 23 nt, Human
uggagugcaguggcgcgaucucg

SEQ ID NO: 604938 - RNA, 18 nt, Human
uggcaaccuccaccuccc

SEQ ID NO: 604939 - RNA, 24 nt, Human
uggcaaccuccaccucccaggcuc

SEQ ID NO: 604940 - RNA, 20 nt, Human
uggcacaaucacagcucacu

SEQ ID NO: 604941 - RNA, 20 nt, Human
uggcacaaucacagcucacu

SEQ ID NO: 604942 - RNA, 22 nt, Human
uggcacaaucucggcucacuga

SEQ ID NO: 604943 - RNA, 20 nt, Human
uggccaggcuccugaccucu

SEQ ID NO: 604944 - RNA, 24 nt, Human
uggccaggcuggucuagaacuccu

SEQ ID NO: 604945 - RNA, 24 nt, Human
uggcucagccucccaaguaucugg

SEQ ID NO: 604946 - RNA, 22 nt, Human
uggcugaguguuucagggucuu

SEQ ID NO: 604947 - RNA, 23 nt, Human
ugggaagggacuucacaggggua

SEQ ID NO: 604948 - RNA, 24 nt, Human
ugggaagggacuucacagggguau

SEQ ID NO: 604949 - RNA, 24 nt, Human
ugggacuacaagugugcaccacca

SEQ ID NO: 604950 - RNA, 23 nt, Human
ugggacuacaggcacaggugcca

SEQ ID NO: 604951 - RNA, 21 nt, Human
ugggagauggaucccaguggu

SEQ ID NO: 604952 - RNA, 21 nt, Human
ugggauuacaggcgcaugcca

SEQ ID NO: 604953 - RNA, 22 nt, Human
ugggauuacaggcgcaugccac

SEQ ID NO: 604954 - RNA, 22 nt, Human
ugggauuacaggcgcaugccac

SEQ ID NO: 604955 - RNA, 24 nt, Human
ugggauuacaggcgcaugccacua

SEQ ID NO: 604956 - RNA, 18 nt, Human
ugggauuacaggcgugag

SEQ ID NO: 604957 - RNA, 19 nt, Human
ugggauuacaggcgugagc

SEQ ID NO: 604958 - RNA, 22 nt, Human
ugggauuacaggcgugagccac

SEQ ID NO: 604959 - RNA, 23 nt, Human
ugggauuacaggcgugagccacc

SEQ ID NO: 604960 - RNA, 24 nt, Human
ugggauuacaggcgugagccacca

SEQ ID NO: 604961 - RNA, 22 nt, Human
ugggauuauaggcaugagccac

SEQ ID NO: 604962 - RNA, 23 nt, Human
ugggauuauaggcaugagccacc

SEQ ID NO: 604963 - RNA, 23 nt, Human
ugggauuauaggcaugagccacc

SEQ ID NO: 604964 - RNA, 24 nt, Human
ugggauuauaggcaugagccaccg

SEQ ID NO: 604965 - RNA, 18 nt, Human
uggggugggggugcugag

SEQ ID NO: 604966 - RNA, 19 nt, Human
uggugaaagaagaaaaagc

SEQ ID NO: 604967 - RNA, 24 nt, Human
uguagagacagggucucgcuaugu

SEQ ID NO: 604968 - RNA, 20 nt, Human
ugucacccaggcuggagugc

SEQ ID NO: 604969 - RNA, 25 nt, Human
ugucauucucaccaccacugacagg

SEQ ID NO: 604970 - RNA, 18 nt, Human
uguggaucaggaagcugg

SEQ ID NO: 604971 - RNA, 18 nt, Human
uuaguagagacgggguuu

SEQ ID NO: 604972 - RNA, 19 nt, Human
uuaguagagacgggguuuc

SEQ ID NO: 604973 - RNA, 19 nt, Human
uuaguagagacgggguuuc

SEQ ID NO: 604974 - RNA, 24 nt, Human
uuaguagagacgggguuucgcuau

SEQ ID NO: 604975 - RNA, 24 nt, Human
uuaguagagauagguuuucaccau

SEQ ID NO: 604976 - RNA, 20 nt, Human
uucaaaacaaacaaaaagga

SEQ ID NO: 604977 - RNA, 23 nt, Human
uucaaaacaaacaaaaaggacuc

SEQ ID NO: 604978 - RNA, 19 nt, Human
uucaagugauucuccuggc

SEQ ID NO: 604979 - RNA, 23 nt, Human
uucaagugauucuccuggcucag

SEQ ID NO: 604980 - RNA, 22 nt, Human
uucagccacucacacgguuacc

SEQ ID NO: 604981 - RNA, 21 nt, Human
uucaugcugcuucuguggauc

SEQ ID NO: 604982 - RNA, 21 nt, Human
uucuccaccuugccucugguc

SEQ ID NO: 604983 - RNA, 18 nt, Human
uuggccucccaaagugcu

SEQ ID NO: 604984 - RNA, 24 nt, Human
uuggcucggccucccaaagugcug

SEQ ID NO: 604985 - RNA, 21 nt, Human
uugguggugagccauguagug

SEQ ID NO: 604986 - RNA, 19 nt, Human
uuuauagucacucagaggc

SEQ ID NO: 604987 - RNA, 24 nt, Human
uuuauagucacucagaggcagagg

SEQ ID NO: 604988 - RNA, 19 nt, Human
uuucaaaacaaacaaaaag

SEQ ID NO: 604989 - RNA, 21 nt, Human
uuucaccaugcuggccaggcu

SEQ ID NO: 604990 - RNA, 24 nt, Human
uuucgcuauguuggccaggcuccu

SEQ ID NO: 604991 - RNA, 18 nt, Human
uuuguagagacagggucu

SEQ ID NO: 604992 - RNA, 23 nt, Human
uuuucaccaugcuggccaggcug

SEQ ID NO: 604993 - RNA, 22 nt, Human
uuuuuaguagagacgggguuuc

SEQ ID NO: 604994 - RNA, 24 nt, Human
uuuuuaguagagauagguuuucac

SEQ ID NO: 604995 - RNA, 21 nt, Human
uuuuuguauuuuuaguagaga

SEQ ID NO: 604996 - RNA, 24 nt, Human
uuuuuuaguagagacgggguuucg

SEQ ID NO: 604997 - RNA, 23 nt, Human
uuuuuuguagagacagggucucg

SEQ ID NO: 604998 - RNA, 24 nt, Human
uuuuuuguauuuuuaguagagaua

SEQ ID NO: 604999 - RNA, 22 nt, Human
uuuuuuguauuuuuaguagagg

SEQ ID NO: 605000 - RNA, 24 nt, Human
uuuuuuuuguauuuuuaguagaga

SEQ ID NO: 605001 - RNA, 22 nt, Human
aaaaaaaaaaaaaaaaaaagaa

SEQ ID NO: 605002 - RNA, 24 nt, Human
aaaaaaaaaaaaaaaagaaaagaa

SEQ ID NO: 605003 - RNA, 22 nt, Human
aaaaagcuagugcuucagccca

SEQ ID NO: 605004 - RNA, 19 nt, Human
aaaccaauuccaagaugac

SEQ ID NO: 605005 - RNA, 20 nt, Human
aaacccccugcagaggcucu

SEQ ID NO: 605006 - RNA, 25 nt, Human
aaaggugggcaauaaauaggaaucc

SEQ ID NO: 605007 - RNA, 20 nt, Human
aacaugcccacauaccacag

SEQ ID NO: 605008 - RNA, 23 nt, Human
aacaugcccacauaccacaggua

SEQ ID NO: 605009 - RNA, 22 nt, Human
aagaagggaugggaauuuuuua

SEQ ID NO: 605010 - RNA, 21 nt, Human
aagaggcuggagagagagggg

SEQ ID NO: 605011 - RNA, 20 nt, Human
acaaacaguuucauaaagag

SEQ ID NO: 605012 - RNA, 20 nt, Human
acgagcccccagguaugccc

SEQ ID NO: 605013 - RNA, 25 nt, Human
acgcaaaccccuaaaccuguccccu

SEQ ID NO: 605014 - RNA, 23 nt, Human
acgcagcauccaggagucgaaac

SEQ ID NO: 605015 - RNA, 21 nt, Human
acuggagcacagcuggaucca

SEQ ID NO: 605016 - RNA, 23 nt, Human
acuggccucauaucccuuguggc

SEQ ID NO: 605017 - RNA, 21 nt, Human
agaaaagaaaaaaaugcucau

SEQ ID NO: 605018 - RNA, 18 nt, Human
agaaagcucaggccaugc

SEQ ID NO: 605019 - RNA, 24 nt, Human
agacagcgcaaagggaaagucagg

SEQ ID NO: 605020 - RNA, 21 nt, Human
agagaacaguggcccaugaug

SEQ ID NO: 605021 - RNA, 22 nt, Human
agagagggguagguugccugug

SEQ ID NO: 605022 - RNA, 19 nt, Human
agagcugagcuguucacag

SEQ ID NO: 605023 - RNA, 19 nt, Human
agaggcucuccagaaagcu

SEQ ID NO: 605024 - RNA, 24 nt, Human
agaggcuggagagagagggguagg

SEQ ID NO: 605025 - RNA, 22 nt, Human
agagggggcuuccucuggggac

SEQ ID NO: 605026 - RNA, 24 nt, Human
agaugggucuccagguucuggggc

SEQ ID NO: 605027 - RNA, 19 nt, Human
agcaagacagccuucccca

SEQ ID NO: 605028 - RNA, 24 nt, Human
agccagguaucuuggcacauucuu

SEQ ID NO: 605029 - RNA, 22 nt, Human
agcuaacauacacagcggacac

SEQ ID NO: 605030 - RNA, 20 nt, Human
agcuaccaaaaagcuagugc

SEQ ID NO: 605031 - RNA, 25 nt, Human
agcuucucucucccaguuucccucc

SEQ ID NO: 605032 - RNA, 19 nt, Human
aggaagccccagucugccg

SEQ ID NO: 605033 - RNA, 18 nt, Human
aggaagcccuuagagagc

SEQ ID NO: 605034 - RNA, 20 nt, Human
agucagaguggaggaggagg

SEQ ID NO: 605035 - RNA, 20 nt, Human
aucccaaaggcccucuaccu

SEQ ID NO: 605036 - RNA, 22 nt, Human
caaaccccuaaaccuguccccu

SEQ ID NO: 605037 - RNA, 24 nt, Human
caaaccccuaaaccuguccccuca

SEQ ID NO: 605038 - RNA, 18 nt, Human
caaagagaacaguggccc

SEQ ID NO: 605039 - RNA, 18 nt, Human
caaagcggaugccaaacc

SEQ ID NO: 605040 - RNA, 21 nt, Human
caaccucaaggagaaacagcu

SEQ ID NO: 605041 - RNA, 23 nt, Human
caaccucaaggagaaacagcuga

SEQ ID NO: 605042 - RNA, 21 nt, Human
caagcacaccgacuguggggc

SEQ ID NO: 605043 - RNA, 18 nt, Human
cacaaacccucuauuucu

SEQ ID NO: 605044 - RNA, 23 nt, Human
cacccucugguggcacuggccuc

SEQ ID NO: 605045 - RNA, 19 nt, Human
caccuuaacaucccaaagg

SEQ ID NO: 605046 - RNA, 22 nt, Human
cacuugcugggaacccuggagg

SEQ ID NO: 605047 - RNA, 23 nt, Human
cagacccagccacagggcccuga

SEQ ID NO: 605048 - RNA, 24 nt, Human
cagaggcaaaaacccccauuaaaa

SEQ ID NO: 605049 - RNA, 21 nt, Human
cagcaaggugccccgucacug

SEQ ID NO: 605050 - RNA, 22 nt, Human
cagcgcaaagggaaagucaggc

SEQ ID NO: 605051 - RNA, 19 nt, Human
cagcuggauccacgaugca

SEQ ID NO: 605052 - RNA, 21 nt, Human
cagggacagaugaggugggag

SEQ ID NO: 605053 - RNA, 21 nt, Human
cagguaucuuggcacauucuu

SEQ ID NO: 605054 - RNA, 23 nt, Human
cagguucuggggcuggggcuucu

SEQ ID NO: 605055 - RNA, 19 nt, Human
cauccugcucugcaucuca

SEQ ID NO: 605056 - RNA, 21 nt, Human
caucuggagcuagcagugacc

SEQ ID NO: 605057 - RNA, 18 nt, Human
cauuucacauguccauga

SEQ ID NO: 605058 - RNA, 19 nt, Human
ccaaagcggaugccaaacc

SEQ ID NO: 605059 - RNA, 19 nt, Human
cccacgagacagcgcaaag

SEQ ID NO: 605060 - RNA, 18 nt, Human
cccaggaggaagccccag

SEQ ID NO: 605061 - RNA, 21 nt, Human
ccccuaaaccuguccccucaa

SEQ ID NO: 605062 - RNA, 22 nt, Human
ccccuaaaccuguccccucaaa

SEQ ID NO: 605063 - RNA, 26 nt, Human
cccgcagccaaagcuggagaaggagc

SEQ ID NO: 605064 - RNA, 24 nt, Human
cccucaaagagaacaguggcccau

SEQ ID NO: 605065 - RNA, 22 nt, Human
ccgaacuucuaaacaaacacuc

SEQ ID NO: 605066 - RNA, 26 nt, Human
ccgcaaccucaaggagaagggaacgc

SEQ ID NO: 605067 - RNA, 21 nt, Human
ccuaacccuaggagcauggga

SEQ ID NO: 605068 - RNA, 22 nt, Human
ccuauaacuacugcacccagac

SEQ ID NO: 605069 - RNA, 19 nt, Human
ccuaucucuuuggaguguu

SEQ ID NO: 605070 - RNA, 19 nt, Human
ccuaugccccaguccgagu

SEQ ID NO: 605071 - RNA, 23 nt, Human
ccugcagaggcucuccagaaagc

SEQ ID NO: 605072 - RNA, 18 nt, Human
ccuguccccucaaagaga

SEQ ID NO: 605073 - RNA, 19 nt, Human
cgaacgcaaaccccuaaac

SEQ ID NO: 605074 - RNA, 24 nt, Human
cgggagauauagauauggaggggu

SEQ ID NO: 605075 - RNA, 23 nt, Human
cguguuuguaaacugggaggcac

SEQ ID NO: 605076 - RNA, 21 nt, Human
cucggagaucuucuuggccac

SEQ ID NO: 605077 - RNA, 19 nt, Human
cucugcagcagacccagcc

SEQ ID NO: 605078 - RNA, 22 nt, Human
cuggcgggccuggaccugggcu

SEQ ID NO: 605079 - RNA, 19 nt, Human
cuuuaagaaagggccguuc

SEQ ID NO: 605080 - RNA, 27 nt, Human
gaacgcaaaccccuaaaccuguccccu

SEQ ID NO: 605081 - RNA, 24 nt, Human
gaaggagagucaugcccauggaga

SEQ ID NO: 605082 - RNA, 18 nt, Human
gaauccaacaggccuaag

SEQ ID NO: 605083 - RNA, 22 nt, Human
gaccugggcuccaggaaaaggu

SEQ ID NO: 605084 - RNA, 20 nt, Human
gacuggagcacagcuggauc

SEQ ID NO: 605085 - RNA, 21 nt, Human
gagaaggagcuggggucucag

SEQ ID NO: 605086 - RNA, 23 nt, Human
gagacagcgcaaagggaaaguca

SEQ ID NO: 605087 - RNA, 18 nt, Human
gaggggaauggaucggaa

SEQ ID NO: 605088 - RNA, 24 nt, Human
gcaaaacacaucauugugagauaa

SEQ ID NO: 605089 - RNA, 28 nt, Human
gcaaaccccuaaaccuguccccucaaag

SEQ ID NO: 605090 - RNA, 23 nt, Human
gcccacauaccacagguaaaaua

SEQ ID NO: 605091 - RNA, 22 nt, Human
gcccauggagaaggagaggggg

SEQ ID NO: 605092 - RNA, 23 nt, Human
gcugcucggagaucuucuuggcc

SEQ ID NO: 605093 - RNA, 22 nt, Human
gcuucugucucucucagggagg

SEQ ID NO: 605094 - RNA, 22 nt, Human
ggaccugggcuccaggaaaagg

SEQ ID NO: 605095 - RNA, 24 nt, Human
ggacuuaggaaacaugcacagcag

SEQ ID NO: 605096 - RNA, 22 nt, Human
ggaggggugagaaagaagggau

SEQ ID NO: 605097 - RNA, 22 nt, Human
ggcaccacccucugguggcacu

SEQ ID NO: 605098 - RNA, 18 nt, Human
ggccaguggcaguaaaca

SEQ ID NO: 605099 - RNA, 22 nt, Human
ggccaguggcaguaaacaugcc

SEQ ID NO: 605100 - RNA, 22 nt, Human
ggcuggagagagagggguaggu

SEQ ID NO: 605101 - RNA, 19 nt, Human
gggaauggaucggaaggga

SEQ ID NO: 605102 - RNA, 21 nt, Human
gggacaaaaaagaagaggcgg

SEQ ID NO: 605103 - RNA, 19 nt, Human
gggacagaugaggugggag

SEQ ID NO: 605104 - RNA, 24 nt, Human
gggcagggacaugccuuacucuuu

SEQ ID NO: 605105 - RNA, 24 nt, Human
ggggaauggaucggaagggaugug

SEQ ID NO: 605106 - RNA, 18 nt, Human
gucuuuuuccuacucugg

SEQ ID NO: 605107 - RNA, 19 nt, Human
guggggccugucccuugcc

SEQ ID NO: 605108 - RNA, 22 nt, Human
guguuuguaaacugggaggcac

SEQ ID NO: 605109 - RNA, 24 nt, Human
uaaagaggcuggagagagaggggu

SEQ ID NO: 605110 - RNA, 18 nt, Human
uaaggcaccuuccugagg

SEQ ID NO: 605111 - RNA, 19 nt, Human
uaagggacaaaaaagaaga

SEQ ID NO: 605112 - RNA, 23 nt, Human
uacccccuuuccaucugguggcc

SEQ ID NO: 605113 - RNA, 19 nt, Human
uacugcacccagacguagc

SEQ ID NO: 605114 - RNA, 22 nt, Human
uagcaagacagccuuccccaga

SEQ ID NO: 605115 - RNA, 26 nt, Human
uagcaagacagccuuccccagagcaa

SEQ ID NO: 605116 - RNA, 19 nt, Human
uaugaggaaaaagucuugu

SEQ ID NO: 605117 - RNA, 22 nt, Human
ucaaagagaacaguggcccaug

SEQ ID NO: 605118 - RNA, 23 nt, Human
ucaauucaauuccuccgcaaccu

SEQ ID NO: 605119 - RNA, 23 nt, Human
ucacugcugcucggagaucuucu

SEQ ID NO: 605120 - RNA, 19 nt, Human
ucagcccacaagggcgaac

SEQ ID NO: 605121 - RNA, 21 nt, Human
uccaagaugacaucugacugc

SEQ ID NO: 605122 - RNA, 18 nt, Human
uccagguucuggggcugg

SEQ ID NO: 605123 - RNA, 21 nt, Human
uccagguucuggggcuggggc

SEQ ID NO: 605124 - RNA, 19 nt, Human
ucccacgagacagcgcaaa

SEQ ID NO: 605125 - RNA, 26 nt, Human
ucccagggcauguagcaggagacccc

SEQ ID NO: 605126 - RNA, 22 nt, Human
uccccaagcugcugguccgggg

SEQ ID NO: 605127 - RNA, 19 nt, Human
uccugcucugcaucucagg

SEQ ID NO: 605128 - RNA, 19 nt, Human
ucuccagaaagcucaggcc

SEQ ID NO: 605129 - RNA, 18 nt, Human
ucuccaggucugugucuc

SEQ ID NO: 605130 - RNA, 22 nt, Human
ucuccugauagccaaggagcuc

SEQ ID NO: 605131 - RNA, 19 nt, Human
ucugccuuagggcaggacu

SEQ ID NO: 605132 - RNA, 21 nt, Human
ucuugaacaggcacagaggca

SEQ ID NO: 605133 - RNA, 21 nt, Human
ucuuuuagaaaccaauuccaa

SEQ ID NO: 605134 - RNA, 30 nt, Human
ugaacaggcacagaggcaaaaacccccauu

SEQ ID NO: 605135 - RNA, 21 nt, Human
ugaagggggaacgcuggacgg

SEQ ID NO: 605136 - RNA, 21 nt, Human
ugaccagaaagugggcaucca

SEQ ID NO: 605137 - RNA, 19 nt, Human
ugagaugggggagaugggu

SEQ ID NO: 605138 - RNA, 22 nt, Human
ugagcuagaagcagacccucca

SEQ ID NO: 605139 - RNA, 24 nt, Human
ugaggcaaacaauacccccuuucc

SEQ ID NO: 605140 - RNA, 24 nt, Human
ugaggcugguuucacaggagccag

SEQ ID NO: 605141 - RNA, 23 nt, Human
ugaggugggagcgcaggaagccc

SEQ ID NO: 605142 - RNA, 18 nt, Human
ugaguguuucucuugaag

SEQ ID NO: 605143 - RNA, 22 nt, Human
ugcccacauaccacagguaaaa

SEQ ID NO: 605144 - RNA, 21 nt, Human
ugcccagaggacacacagcaa

SEQ ID NO: 605145 - RNA, 19 nt, Human
ugccccacuccccagcacg

SEQ ID NO: 605146 - RNA, 18 nt, Human
uggaggaggaggggacag

SEQ ID NO: 605147 - RNA, 18 nt, Human
uggaggggugagaaagaa

SEQ ID NO: 605148 - RNA, 23 nt, Human
uggaggguccccaagcugcuggu

SEQ ID NO: 605149 - RNA, 21 nt, Human
uggcccaggaggaagccccag

SEQ ID NO: 605150 - RNA, 18 nt, Human
ugguccggggcguggcag

SEQ ID NO: 605151 - RNA, 22 nt, Human
ugguggccucgaaggagaguca

SEQ ID NO: 605152 - RNA, 23 nt, Human
uguaacagcaguugugagauggg

SEQ ID NO: 605153 - RNA, 23 nt, Human
uguagcaggagaccacagcuucu

SEQ ID NO: 605154 - RNA, 19 nt, Human
uguccaggauucuccugau

SEQ ID NO: 605155 - RNA, 21 nt, Human
uguccaggauucuccugauag

SEQ ID NO: 605156 - RNA, 19 nt, Human
ugucccuugccccacuccc

SEQ ID NO: 605157 - RNA, 33 nt, Human
uucagacuuuguuaaaaaaaaaaaaaaaaaaaa

SEQ ID NO: 605158 - RNA, 18 nt, Human
uucaucuucugccuuagg

SEQ ID NO: 605159 - RNA, 22 nt, Human
uucgggaugaguguuucucuug

SEQ ID NO: 605160 - RNA, 21 nt, Human
uucuccugauagccaaggagc

SEQ ID NO: 605161 - RNA, 24 nt, Human
uucuuucucacucacuuccuuaaa

SEQ ID NO: 605162 - RNA, 22 nt, Human
uuguacauauaucaaucucccu

SEQ ID NO: 605163 - RNA, 24 nt, Human
uuuagcaagacagccuuccccaga

SEQ ID NO: 605164 - RNA, 22 nt, Human
uuuguccaucucagaacagagc

SEQ ID NO: 605165 - RNA, 20 nt, Human
uuuucucuuccagcucccag

SEQ ID NO: 605166 - RNA, 21 nt, Human
aaacauaaaacaaaccugcgu

SEQ ID NO: 605167 - RNA, 21 nt, Human
aaacgagacacaauuacagaa

SEQ ID NO: 605168 - RNA, 23 nt, Human
aaccucagagcccauguuucacc

SEQ ID NO: 605169 - RNA, 20 nt, Human
aauguccuucugggcucucc

SEQ ID NO: 605170 - RNA, 21 nt, Human
acuggccuugcccucuuuucc

SEQ ID NO: 605171 - RNA, 20 nt, Human
agauuccaggacccaggaaa

SEQ ID NO: 605172 - RNA, 23 nt, Human
agcaggggucccggcuccugcgc

SEQ ID NO: 605173 - RNA, 23 nt, Human
agccuggcucucccccuggccuc

SEQ ID NO: 605174 - RNA, 21 nt, Human
aggacacagguucaguccugc

SEQ ID NO: 605175 - RNA, 21 nt, Human
aggcagguagguuauccuuga

SEQ ID NO: 605176 - RNA, 22 nt, Human
agguagccaaccucagagccca

SEQ ID NO: 605177 - RNA, 22 nt, Human
agugugcuccuuccugggcagc

SEQ ID NO: 605178 - RNA, 22 nt, Human
aucagugacagcggcuaagguu

SEQ ID NO: 605179 - RNA, 18 nt, Human
augcagcagcaggggcuc

SEQ ID NO: 605180 - RNA, 21 nt, Human
auggugacuagaaggugguag

SEQ ID NO: 605181 - RNA, 23 nt, Human
caccccuggccuggagugugcuc

SEQ ID NO: 605182 - RNA, 18 nt, Human
cagcagcaggggcucggc

SEQ ID NO: 605183 - RNA, 19 nt, Human
caggacacagguucagucc

SEQ ID NO: 605184 - RNA, 19 nt, Human
cauaaaacaaaccugcgug

SEQ ID NO: 605185 - RNA, 21 nt, Human
caugcagcagcaggggcucgg

SEQ ID NO: 605186 - RNA, 20 nt, Human
ccacugggcagugaaggcuc

SEQ ID NO: 605187 - RNA, 22 nt, Human
ccagcaggugcacagcgcggcc

SEQ ID NO: 605188 - RNA, 20 nt, Human
ccagggcugccacugggcag

SEQ ID NO: 605189 - RNA, 19 nt, Human
ccccagggcugccacuggg

SEQ ID NO: 605190 - RNA, 23 nt, Human
ccccugccugugugacccacccg

SEQ ID NO: 605191 - RNA, 23 nt, Human
cccgugccucucuucagcuggga

SEQ ID NO: 605192 - RNA, 20 nt, Human
cccugaggagccagaggcua

SEQ ID NO: 605193 - RNA, 18 nt, Human
ccugcucugugccugucc

SEQ ID NO: 605194 - RNA, 24 nt, Human
ccugugaccugggcaaugcccagc

SEQ ID NO: 605195 - RNA, 20 nt, Human
ccuucugggcucuccccacc

SEQ ID NO: 605196 - RNA, 23 nt, Human
cuacggacucucuccugugaccu

SEQ ID NO: 605197 - RNA, 21 nt, Human
cucagagcccauguuucaccc

SEQ ID NO: 605198 - RNA, 24 nt, Human
cucguugcguuugguccgaccacu

SEQ ID NO: 605199 - RNA, 18 nt, Human
cucuccccaccuuccucu

SEQ ID NO: 605200 - RNA, 21 nt, Human
cugccaugcaccccuggccug

SEQ ID NO: 605201 - RNA, 18 nt, Human
cugcucugugccugucca

SEQ ID NO: 605202 - RNA, 21 nt, Human
cuggccuugcccucuuuucca

SEQ ID NO: 605203 - RNA, 21 nt, Human
gaaggcucuucaggacacagg

SEQ ID NO: 605204 - RNA, 20 nt, Human
gaagugggggauccuggcca

SEQ ID NO: 605205 - RNA, 19 nt, Human
gaggagccagaggcuagca

SEQ ID NO: 605206 - RNA, 19 nt, Human
gcagccccugcucugugcc

SEQ ID NO: 605207 - RNA, 18 nt, Human
gcccauguuucaccccug

SEQ ID NO: 605208 - RNA, 21 nt, Human
gccuggagugugcuccuuccu

SEQ ID NO: 605209 - RNA, 22 nt, Human
gccuggagugugcuccuuccug

SEQ ID NO: 605210 - RNA, 18 nt, Human
gccuugcccucuuuucca

SEQ ID NO: 605211 - RNA, 18 nt, Human
gcucugugccuguccagu

SEQ ID NO: 605212 - RNA, 22 nt, Human
gcucugugccuguccagugcug

SEQ ID NO: 605213 - RNA, 19 nt, Human
ggcucuccccaccuuccuc

SEQ ID NO: 605214 - RNA, 20 nt, Human
gggauccuggccaagucacc

SEQ ID NO: 605215 - RNA, 25 nt, Human
gggcugccacugggcagugaaggcu

SEQ ID NO: 605216 - RNA, 24 nt, Human
gguaggagggaggcuucuaggagc

SEQ ID NO: 605217 - RNA, 19 nt, Human
uagauuccaggacccagga

SEQ ID NO: 605218 - RNA, 22 nt, Human
uagccaaccucagagcccaugu

SEQ ID NO: 605219 - RNA, 19 nt, Human
ucacuugggagccugcucc

SEQ ID NO: 605220 - RNA, 23 nt, Human
ucacuugggagccugcuccuggg

SEQ ID NO: 605221 - RNA, 24 nt, Human
ucacuugggagccugcuccugggu

SEQ ID NO: 605222 - RNA, 20 nt, Human
ucagagcccauguuucaccc

SEQ ID NO: 605223 - RNA, 24 nt, Human
ucagagcccauguuucaccccugc

SEQ ID NO: 605224 - RNA, 19 nt, Human
ucccccuggccucaaaucc

SEQ ID NO: 605225 - RNA, 20 nt, Human
ucccccuggccucaaauccc

SEQ ID NO: 605226 - RNA, 24 nt, Human
ucccggcuccugcgcaggucucua

SEQ ID NO: 605227 - RNA, 28 nt, Human
ucggcagugaggacuggccuugcccucu

SEQ ID NO: 605228 - RNA, 19 nt, Human
ucucugcaggcagguaggu

SEQ ID NO: 605229 - RNA, 25 nt, Human
ucugcaauguccuucugggcucucc

SEQ ID NO: 605230 - RNA, 22 nt, Human
ugacagaaagcucccacugcuc

SEQ ID NO: 605231 - RNA, 18 nt, Human
ugagagucauuacuucug

SEQ ID NO: 605232 - RNA, 21 nt, Human
ugccagaguccccaugcaggc

SEQ ID NO: 605233 - RNA, 23 nt, Human
ugccaugcaccccuggccuggag

SEQ ID NO: 605234 - RNA, 22 nt, Human
ugggcacagcgaagugggggau

SEQ ID NO: 605235 - RNA, 24 nt, Human
ugggcacagcgaagugggggaucc

SEQ ID NO: 605236 - RNA, 18 nt, Human
ugggcagccccugcucug

SEQ ID NO: 605237 - RNA, 21 nt, Human
uggggaaaaucuuaauggcca

SEQ ID NO: 605238 - RNA, 25 nt, Human
uucucugcaggcagguagguuaucc

SEQ ID NO: 605239 - RNA, 24 nt, Human
agacagaagcccagucgguaaaca

SEQ ID NO: 605240 - RNA, 22 nt, Human
caucgcaaaguauccuaccugu

SEQ ID NO: 605241 - RNA, 19 nt, Human
cucuuaagacagaagccca

SEQ ID NO: 605242 - RNA, 18 nt, Human
gcccagucgguaaacagu

SEQ ID NO: 605243 - RNA, 24 nt, Human
uaagacagaagcccagucgguaaa

SEQ ID NO: 605244 - RNA, 21 nt, Human
uuuucuuggcucuuaagacag

SEQ ID NO: 605245 - RNA, 20 nt, Human
aaaauauuccaugauguccc

SEQ ID NO: 605246 - RNA, 22 nt, Human
aagcggguaccgucccuuccau

SEQ ID NO: 605247 - RNA, 19 nt, Human
accucuacccuggcuuccc

SEQ ID NO: 605248 - RNA, 20 nt, Human
agagccagggggcccggcaa

SEQ ID NO: 605249 - RNA, 24 nt, Human
aggcagaggcagagaaugccagaa

SEQ ID NO: 605250 - RNA, 21 nt, Human
agggggcuggaaagggggccc

SEQ ID NO: 605251 - RNA, 18 nt, Human
caagaauaugaggcagag

SEQ ID NO: 605252 - RNA, 23 nt, Human
cacagauuaggaguggacguucu

SEQ ID NO: 605253 - RNA, 19 nt, Human
cacugcauacagagaaggu

SEQ ID NO: 605254 - RNA, 19 nt, Human
cagaagcggguaccguccc

SEQ ID NO: 605255 - RNA, 22 nt, Human
cagagcaguaaucagagcagag

SEQ ID NO: 605256 - RNA, 19 nt, Human
cagcagccgaaggacucau

SEQ ID NO: 605257 - RNA, 22 nt, Human
caggaagguccaggagguggca

SEQ ID NO: 605258 - RNA, 21 nt, Human
caggagguggcagaagcgggu

SEQ ID NO: 605259 - RNA, 20 nt, Human
caggcucauggacuagugcu

SEQ ID NO: 605260 - RNA, 23 nt, Human
caguagacagcaagauuucccag

SEQ ID NO: 605261 - RNA, 21 nt, Human
cauaacccaggugcaccaacc

SEQ ID NO: 605262 - RNA, 22 nt, Human
ccagaagagagccagggggccc

SEQ ID NO: 605263 - RNA, 18 nt, Human
ccagggagaggaaaaccg

SEQ ID NO: 605264 - RNA, 25 nt, Human
cccacagaagcacugcauacagaga

SEQ ID NO: 605265 - RNA, 21 nt, Human
cccaccucuacccuggcuucc

SEQ ID NO: 605266 - RNA, 23 nt, Human
cccaccucuacccuggcuuccca

SEQ ID NO: 605267 - RNA, 23 nt, Human
cccugcagcaagcccaccuggcc

SEQ ID NO: 605268 - RNA, 22 nt, Human
ccucuacccuggcuucccagac

SEQ ID NO: 605269 - RNA, 21 nt, Human
ccugcagcaagcccaccuggc

SEQ ID NO: 605270 - RNA, 21 nt, Human
cuaacaagaauaugaggcaga

SEQ ID NO: 605271 - RNA, 19 nt, Human
cucccacagaagcacugca

SEQ ID NO: 605272 - RNA, 22 nt, Human
cuuaccauaacccaggugcacc

SEQ ID NO: 605273 - RNA, 19 nt, Human
gaagagagccagggggccc

SEQ ID NO: 605274 - RNA, 22 nt, Human
gagaaugccagaagagagccag

SEQ ID NO: 605275 - RNA, 24 nt, Human
gcaccagcaaucugggauaugguc

SEQ ID NO: 605276 - RNA, 22 nt, Human
gcagaggcagagaaugccagaa

SEQ ID NO: 605277 - RNA, 19 nt, Human
gccuaacaagaauaugagg

SEQ ID NO: 605278 - RNA, 21 nt, Human
gccuugggaacacucgggcug

SEQ ID NO: 605279 - RNA, 19 nt, Human
ggaaaaccgcccugcccca

SEQ ID NO: 605280 - RNA, 29 nt, Human
guagaggugggcugcguagggcgagcacc

SEQ ID NO: 605281 - RNA, 26 nt, Human
uaacaagaauaugaggcagaggcaga

SEQ ID NO: 605282 - RNA, 20 nt, Human
uaacccaggugcaccagcaa

SEQ ID NO: 605283 - RNA, 22 nt, Human
uaccauaacccaggugcaccag

SEQ ID NO: 605284 - RNA, 23 nt, Human
uaccauaacccaggugcaccagc

SEQ ID NO: 605285 - RNA, 20 nt, Human
uacccuggcuucccagacuu

SEQ ID NO: 605286 - RNA, 18 nt, Human
uagggaagcaauaguccu

SEQ ID NO: 605287 - RNA, 23 nt, Human
ucagagcaaaacucaaggugcag

SEQ ID NO: 605288 - RNA, 20 nt, Human
ucagcauuuuggccuuggga

SEQ ID NO: 605289 - RNA, 24 nt, Human
ucaggaagguccaggagguggcag

SEQ ID NO: 605290 - RNA, 22 nt, Human
ucaguagacagcaagauuuccc

SEQ ID NO: 605291 - RNA, 18 nt, Human
ucauuggucagcagggaa

SEQ ID NO: 605292 - RNA, 25 nt, Human
ucccugcagcaagcccaccuggccu

SEQ ID NO: 605293 - RNA, 19 nt, Human
ugagguggcucuccucucu

SEQ ID NO: 605294 - RNA, 21 nt, Human
ugagugacaguuagaauggaa

SEQ ID NO: 605295 - RNA, 19 nt, Human
uuuuuugugauuccaagca

SEQ ID NO: 605296 - RNA, 21 nt, Human
uuuuuugugauuccaagcagg

SEQ ID NO: 605297 - RNA, 23 nt, Human
aaaaacugaauuggaggguuuuu

SEQ ID NO: 605298 - RNA, 20 nt, Human
aaagaggcaccucccgcuuu

SEQ ID NO: 605299 - RNA, 19 nt, Human
aagccagcucugcgugcug

SEQ ID NO: 605300 - RNA, 23 nt, Human
aaucacauuuuucuuuuuuacau

SEQ ID NO: 605301 - RNA, 22 nt, Human
agaagcaccuuuuaauauucau

SEQ ID NO: 605302 - RNA, 23 nt, Human
agaguaagccagaacauucacug

SEQ ID NO: 605303 - RNA, 19 nt, Human
auuuauaaaagaucuucug

SEQ ID NO: 605304 - RNA, 18 nt, Human
cagaggugggcagugcug

SEQ ID NO: 605305 - RNA, 22 nt, Human
ccgagcacuucuaucagaagcc

SEQ ID NO: 605306 - RNA, 20 nt, Human
ccgguggcuggcggugcucu

SEQ ID NO: 605307 - RNA, 19 nt, Human
ccuuaugccuuggacucug

SEQ ID NO: 605308 - RNA, 19 nt, Human
ccuuaugguucauaugagu

SEQ ID NO: 605309 - RNA, 23 nt, Human
cuuaugguucauaugaguuuauu

SEQ ID NO: 605310 - RNA, 21 nt, Human
gagaagcagcagcugcauuug

SEQ ID NO: 605311 - RNA, 20 nt, Human
gagcagaggugggcagugcu

SEQ ID NO: 605312 - RNA, 18 nt, Human
gcaguaccuguucucacg

SEQ ID NO: 605313 - RNA, 21 nt, Human
gcuuugcuuucuuucccgagc

SEQ ID NO: 605314 - RNA, 26 nt, Human
guuguaauggugagauauuuauaagg

SEQ ID NO: 605315 - RNA, 20 nt, Human
uaccuucaccaguaaugcac

SEQ ID NO: 605316 - RNA, 19 nt, Human
uaucagaagccagcucugc

SEQ ID NO: 605317 - RNA, 22 nt, Human
uccagguggcgugaucacuguc

SEQ ID NO: 605318 - RNA, 23 nt, Human
ucuggcuguccagguggcgugau

SEQ ID NO: 605319 - RNA, 19 nt, Human
ucugugaacacacguguga

SEQ ID NO: 605320 - RNA, 23 nt, Human
ugaacacacgugugaacccggcg

SEQ ID NO: 605321 - RNA, 22 nt, Human
ugccaguucagagguguuguag

SEQ ID NO: 605322 - RNA, 24 nt, Human
ugccgguggcuggcggugcucagg

SEQ ID NO: 605323 - RNA, 21 nt, Human
ugccuuggacucuggcugucc

SEQ ID NO: 605324 - RNA, 23 nt, Human
uggaaaauuagcaacauacacau

SEQ ID NO: 605325 - RNA, 22 nt, Human
uggcacuuuaauguuaguacug

SEQ ID NO: 605326 - RNA, 19 nt, Human
uggcgugaucacugucgac

SEQ ID NO: 605327 - RNA, 21 nt, Human
uggcuguccagguggcgugau

SEQ ID NO: 605328 - RNA, 23 nt, Human
ugggagcagaggugggcagugcu

SEQ ID NO: 605329 - RNA, 25 nt, Human
ugggagcagaggugggcagugcugg

SEQ ID NO: 605330 - RNA, 20 nt, Human
ugggauguggccggucuugg

SEQ ID NO: 605331 - RNA, 24 nt, Human
ugucauuuacaucaaauaugcagc

SEQ ID NO: 605332 - RNA, 18 nt, Human
uguggccggucuuggugc

SEQ ID NO: 605333 - RNA, 23 nt, Human
uguggccguagcucugugaacac

SEQ ID NO: 605334 - RNA, 24 nt, Human
uuauaaaaacugaauuggaggguu

SEQ ID NO: 605335 - RNA, 26 nt, Human
uuguuuguuuguuuguuuguuuuuuu

SEQ ID NO: 605336 - RNA, 18 nt, Human
aaacgaucaguauccccc

SEQ ID NO: 605337 - RNA, 23 nt, Human
aagaagccuccucuggugguuga

SEQ ID NO: 605338 - RNA, 22 nt, Human
acaagacaccaaguccggucac

SEQ ID NO: 605339 - RNA, 23 nt, Human
acacagguaaacaggcuccuuca

SEQ ID NO: 605340 - RNA, 24 nt, Human
acaccaaguccggucaccauggaa

SEQ ID NO: 605341 - RNA, 20 nt, Human
accauggaaaagaauuaaac

SEQ ID NO: 605342 - RNA, 25 nt, Human
accauggaaaagaauuaaaccuaga

SEQ ID NO: 605343 - RNA, 21 nt, Human
accccgccuagcccaaggccg

SEQ ID NO: 605344 - RNA, 18 nt, Human
agaaacagaagaaauagg

SEQ ID NO: 605345 - RNA, 25 nt, Human
agaaacagaagaaauaggggaccgg

SEQ ID NO: 605346 - RNA, 22 nt, Human
agaauucuuccuuuauuuacuc

SEQ ID NO: 605347 - RNA, 22 nt, Human
agaggggccgccggugcccaga

SEQ ID NO: 605348 - RNA, 25 nt, Human
aggaaaaagaaaaaagaaaccucau

SEQ ID NO: 605349 - RNA, 24 nt, Human
aggggaccccgccuagcccaaggc

SEQ ID NO: 605350 - RNA, 18 nt, Human
agugagaaacagaagaaa

SEQ ID NO: 605351 - RNA, 21 nt, Human
aucugcacucagacgcucccc

SEQ ID NO: 605352 - RNA, 18 nt, Human
caagaaagaagccuccuc

SEQ ID NO: 605353 - RNA, 22 nt, Human
cacagguaaacaggcuccuuca

SEQ ID NO: 605354 - RNA, 26 nt, Human
caccauggaaaagaauuaaaccuaga

SEQ ID NO: 605355 - RNA, 24 nt, Human
caggaaagaauuuaaaaauccauc

SEQ ID NO: 605356 - RNA, 20 nt, Human
caggcacagaaacuggcaga

SEQ ID NO: 605357 - RNA, 18 nt, Human
caguagagcgaagcugug

SEQ ID NO: 605358 - RNA, 19 nt, Human
caucagaaaggaacuguuu

SEQ ID NO: 605359 - RNA, 20 nt, Human
caugaucugcacucagacgc

SEQ ID NO: 605360 - RNA, 18 nt, Human
ccaaaauuaaaaaaagga

SEQ ID NO: 605361 - RNA, 19 nt, Human
ccaaacgaucaguaucccc

SEQ ID NO: 605362 - RNA, 22 nt, Human
ccacuucguaaccaggcuacaa

SEQ ID NO: 605363 - RNA, 27 nt, Human
cccaaaauuaaaaaaaggaaaaagaaa

SEQ ID NO: 605364 - RNA, 27 nt, Human
cccacaguucaggccaaaccggggucc

SEQ ID NO: 605365 - RNA, 22 nt, Human
ccgaagaaacaccaucacagga

SEQ ID NO: 605366 - RNA, 24 nt, Human
ccucaugaucugcacucagacgcu

SEQ ID NO: 605367 - RNA, 21 nt, Human
ccugccgagcaguagagcgaa

SEQ ID NO: 605368 - RNA, 22 nt, Human
ccuucauaacaacacugugcau

SEQ ID NO: 605369 - RNA, 20 nt, Human
cggaauugacaaauaaagcc

SEQ ID NO: 605370 - RNA, 22 nt, Human
cguaaccaggcuacaagacacc

SEQ ID NO: 605371 - RNA, 24 nt, Human
cguaaccaggcuacaagacaccaa

SEQ ID NO: 605372 - RNA, 25 nt, Human
cuacaagacaccaaguccggucacc

SEQ ID NO: 605373 - RNA, 26 nt, Human
cucauucauuuccaaaaaucaagauc

SEQ ID NO: 605374 - RNA, 24 nt, Human
cugugggcuggagcacgcugagga

SEQ ID NO: 605375 - RNA, 21 nt, Human
cuucagugagaaacagaagaa

SEQ ID NO: 605376 - RNA, 21 nt, Human
cuugguggaaaacagugggug

SEQ ID NO: 605377 - RNA, 21 nt, Human
gaagcugugggcuggagcaac

SEQ ID NO: 605378 - RNA, 21 nt, Human
gaauggugccagauuuugaac

SEQ ID NO: 605379 - RNA, 19 nt, Human
gauuacacguuccugucuc

SEQ ID NO: 605380 - RNA, 18 nt, Human
gcagccccagccagaucc

SEQ ID NO: 605381 - RNA, 18 nt, Human
gcgaagcugugggcugga

SEQ ID NO: 605382 - RNA, 26 nt, Human
ggaaauuuaaauuuuuccacuuucag

SEQ ID NO: 605383 - RNA, 23 nt, Human
ggaggacuuggcuuaaccuugag

SEQ ID NO: 605384 - RNA, 20 nt, Human
ggauuacacguuccugucuc

SEQ ID NO: 605385 - RNA, 21 nt, Human
guaaccaggcuacaagacacc

SEQ ID NO: 605386 - RNA, 22 nt, Human
uaagaaauguuuauuguucaag

SEQ ID NO: 605387 - RNA, 21 nt, Human
uaccccaaaauuaaaaaaagg

SEQ ID NO: 605388 - RNA, 22 nt, Human
uaggacuucagugagaaacaga

SEQ ID NO: 605389 - RNA, 24 nt, Human
ucaacgucccacuucguaaccagg

SEQ ID NO: 605390 - RNA, 20 nt, Human
ucaccaaggucaagggcugu

SEQ ID NO: 605391 - RNA, 18 nt, Human
ucaggccaaacaucauaa

SEQ ID NO: 605392 - RNA, 18 nt, Human
ucagugagaaacagaaga

SEQ ID NO: 605393 - RNA, 21 nt, Human
uccaacccccuuuccucuugu

SEQ ID NO: 605394 - RNA, 21 nt, Human
uccacggcagagaaaugcuaa

SEQ ID NO: 605395 - RNA, 19 nt, Human
uccacuuucaguuugaaua

SEQ ID NO: 605396 - RNA, 20 nt, Human
uccauuugguauuuuccacu

SEQ ID NO: 605397 - RNA, 24 nt, Human
ucccacuucguaaccaggcuacaa

SEQ ID NO: 605398 - RNA, 18 nt, Human
ucccagcugguccaugca

SEQ ID NO: 605399 - RNA, 23 nt, Human
ucguaugugaaucugugaauccu

SEQ ID NO: 605400 - RNA, 19 nt, Human
ucucugcaggcacagaaac

SEQ ID NO: 605401 - RNA, 24 nt, Human
ucucugcaggcacagaaacuggca

SEQ ID NO: 605402 - RNA, 26 nt, Human
ucugcaggcacagaaacuggcagacc

SEQ ID NO: 605403 - RNA, 21 nt, Human
ugacugagucuuggcucagca

SEQ ID NO: 605404 - RNA, 22 nt, Human
ugauaagcaauucuccacggca

SEQ ID NO: 605405 - RNA, 23 nt, Human
ugcccagaggccagcugcccugc

SEQ ID NO: 605406 - RNA, 22 nt, Human
uggagaacggagaaaacgacug

SEQ ID NO: 605407 - RNA, 25 nt, Human
ugguggaaaacaguggguguccaga

SEQ ID NO: 605408 - RNA, 22 nt, Human
uuaaccuugagaaacuguucuu

SEQ ID NO: 605409 - RNA, 23 nt, Human
uuaaccuugagaaacuguucuuu

SEQ ID NO: 605410 - RNA, 21 nt, Human
uucagugagaaacagaagaaa

SEQ ID NO: 605411 - RNA, 22 nt, Human
uucauuguucagaugguaaacc

SEQ ID NO: 605412 - RNA, 18 nt, Human
uucugugcaugucacccu

SEQ ID NO: 605413 - RNA, 19 nt, Human
uugauaagcaauucuccac

SEQ ID NO: 605414 - RNA, 19 nt, Human
aaaaacagcuggaaagagc

SEQ ID NO: 605415 - RNA, 19 nt, Human
aaaagcucaagucacugcc

SEQ ID NO: 605416 - RNA, 19 nt, Human
aaaagcucaagucacugcc

SEQ ID NO: 605417 - RNA, 23 nt, Human
aaagaacgacgagggcuggcaga

SEQ ID NO: 605418 - RNA, 20 nt, Human
aaagagacaacguagacuga

SEQ ID NO: 605419 - RNA, 19 nt, Human
aaagugcugggauuacagg

SEQ ID NO: 605420 - RNA, 19 nt, Human
aaagugcugggauuacagg

SEQ ID NO: 605421 - RNA, 23 nt, Human
aaagugcugggauuacaggugua

SEQ ID NO: 605422 - RNA, 18 nt, Human
aacaugcuccugugguuu

SEQ ID NO: 605423 - RNA, 21 nt, Human
aacuucacgaaggcuagaacc

SEQ ID NO: 605424 - RNA, 22 nt, Human
aagaacaccucauuguuggucc

SEQ ID NO: 605425 - RNA, 22 nt, Human
aagcaaggaccacucuggggag

SEQ ID NO: 605426 - RNA, 20 nt, Human
aagggaugaacacggggggg

SEQ ID NO: 605427 - RNA, 18 nt, Human
aagugcugggauuacagg

SEQ ID NO: 605428 - RNA, 19 nt, Human
aagugcugggauuacaggu

SEQ ID NO: 605429 - RNA, 26 nt, Human
aagugcugggauuacagguguaagcc

SEQ ID NO: 605430 - RNA, 26 nt, Human
aaugaggaggcagccacuguggagga

SEQ ID NO: 605431 - RNA, 19 nt, Human
acacacuugccggcaggga

SEQ ID NO: 605432 - RNA, 22 nt, Human
acacccagaucuuacacccagu

SEQ ID NO: 605433 - RNA, 18 nt, Human
acagguguaagccaccgc

SEQ ID NO: 605434 - RNA, 21 nt, Human
accaagauaggaaaaucaaug

SEQ ID NO: 605435 - RNA, 18 nt, Human
accacaaccuccaccucc

SEQ ID NO: 605436 - RNA, 23 nt, Human
accacgccuggcuaauuuuugua

SEQ ID NO: 605437 - RNA, 20 nt, Human
accaggaaagaggaaaggcc

SEQ ID NO: 605438 - RNA, 27 nt, Human
acucugucgccuaggcuggagugcaau

SEQ ID NO: 605439 - RNA, 28 nt, Human
agacaaaucucuuccuaaacaugcuccu

SEQ ID NO: 605440 - RNA, 20 nt, Human
agacugaacucaccuuacaa

SEQ ID NO: 605441 - RNA, 23 nt, Human
agagaagcaaucauccccauggc

SEQ ID NO: 605442 - RNA, 23 nt, Human
agagacaaaucucuuccuaaaca

SEQ ID NO: 605443 - RNA, 19 nt, Human
agagcauugugacuugaaa

SEQ ID NO: 605444 - RNA, 23 nt, Human
agaggcagucuuccucccagagu

SEQ ID NO: 605445 - RNA, 22 nt, Human
agaggcauuucugcugcagccu

SEQ ID NO: 605446 - RNA, 24 nt, Human
agcagaaccucuggcuuucuucua

SEQ ID NO: 605447 - RNA, 18 nt, Human
agcagaugcugaggucag

SEQ ID NO: 605448 - RNA, 18 nt, Human
aggaaagaggaaaggccu

SEQ ID NO: 605449 - RNA, 21 nt, Human
aggagugcaggcagaggggcc

SEQ ID NO: 605450 - RNA, 23 nt, Human
aggauuuggcuuuuuuucccugg

SEQ ID NO: 605451 - RNA, 25 nt, Human
aggcagaggcagacuuaaggucgac

SEQ ID NO: 605452 - RNA, 22 nt, Human
aggcagaggcagacuuauucca

SEQ ID NO: 605453 - RNA, 22 nt, Human
aggcagaggggccugcugcugg

SEQ ID NO: 605454 - RNA, 21 nt, Human
agggaccaacagaccuccacg

SEQ ID NO: 605455 - RNA, 22 nt, Human
agggaggcggcaacggcggugg

SEQ ID NO: 605456 - RNA, 22 nt, Human
aggggcaagccugaggagugca

SEQ ID NO: 605457 - RNA, 21 nt, Human
aggucucagauagugccucuc

SEQ ID NO: 605458 - RNA, 22 nt, Human
aguagagaugggcuuuugccau

SEQ ID NO: 605459 - RNA, 18 nt, Human
aguagcugggauuacagg

SEQ ID NO: 605460 - RNA, 21 nt, Human
agugcaauggcgugaucucag

SEQ ID NO: 605461 - RNA, 24 nt, Human
agugcaauggcgugaucucagcuc

SEQ ID NO: 605462 - RNA, 20 nt, Human
aguuaacuacaugaggaacg

SEQ ID NO: 605463 - RNA, 19 nt, Human
augauucuuaggaguccac

SEQ ID NO: 605464 - RNA, 24 nt, Human
augggcuuuugccauguugaccag

SEQ ID NO: 605465 - RNA, 25 nt, Human
auuuuuguauuuuuuaguagagaug

SEQ ID NO: 605466 - RNA, 21 nt, Human
caaaagcucaagucacugcca

SEQ ID NO: 605467 - RNA, 23 nt, Human
caaaccccagacccaggacucca

SEQ ID NO: 605468 - RNA, 24 nt, Human
caaaccccagacccaggacuccag

SEQ ID NO: 605469 - RNA, 24 nt, Human
caaagugcugggauuacaggugua

SEQ ID NO: 605470 - RNA, 23 nt, Human
caaccuccaccuccuggguucaa

SEQ ID NO: 605471 - RNA, 22 nt, Human
caagcgagucuccugccucagc

SEQ ID NO: 605472 - RNA, 24 nt, Human
cacaaccacgccuggcuaauuuuu

SEQ ID NO: 605473 - RNA, 21 nt, Human
caccacaaccuccaccuccug

SEQ ID NO: 605474 - RNA, 21 nt, Human
cacggcaguggcacuagugcc

SEQ ID NO: 605475 - RNA, 22 nt, Human
cacucugucgccuaggcuggag

SEQ ID NO: 605476 - RNA, 22 nt, Human
cacugaggcagcgaggggcaag

SEQ ID NO: 605477 - RNA, 20 nt, Human
cacugccaugagaccaggag

SEQ ID NO: 605478 - RNA, 22 nt, Human
cagaccuccacgagaacaacuu

SEQ ID NO: 605479 - RNA, 23 nt, Human
cagcagaggggccaggcugggug

SEQ ID NO: 605480 - RNA, 23 nt, Human
caggaauccaggugagaagcaag

SEQ ID NO: 605481 - RNA, 26 nt, Human
caggagccagcagggugaggcagagg

SEQ ID NO: 605482 - RNA, 18 nt, Human
caggggaggggagguugc

SEQ ID NO: 605483 - RNA, 22 nt, Human
caggugacccgccugccucagc

SEQ ID NO: 605484 - RNA, 22 nt, Human
caguguguuccucuuuggggac

SEQ ID NO: 605485 - RNA, 23 nt, Human
caugauucuuaggaguccaccaa

SEQ ID NO: 605486 - RNA, 24 nt, Human
cauguugaccaggcuggucuugaa

SEQ ID NO: 605487 - RNA, 21 nt, Human
ccaaagugcugggauuacagg

SEQ ID NO: 605488 - RNA, 21 nt, Human
ccaaagugcugggauuacagg

SEQ ID NO: 605489 - RNA, 24 nt, Human
ccaaagugcugggauuacaggugu

SEQ ID NO: 605490 - RNA, 18 nt, Human
ccacaaccuccaccuccu

SEQ ID NO: 605491 - RNA, 21 nt, Human
ccacaaccuccaccuccuggg

SEQ ID NO: 605492 - RNA, 23 nt, Human
ccacaaccuccaccuccuggguu

SEQ ID NO: 605493 - RNA, 24 nt, Human
ccacaaccuccaccuccuggguuc

SEQ ID NO: 605494 - RNA, 22 nt, Human
ccacacacuugccggcagggag

SEQ ID NO: 605495 - RNA, 20 nt, Human
ccaccaggagccagcagggu

SEQ ID NO: 605496 - RNA, 19 nt, Human
ccauguugaccaggcuggu

SEQ ID NO: 605497 - RNA, 21 nt, Human
ccauguugaccaggcuggucu

SEQ ID NO: 605498 - RNA, 21 nt, Human
cccacagcagagcucagggau

SEQ ID NO: 605499 - RNA, 21 nt, Human
cccaggagccaaaugaggagg

SEQ ID NO: 605500 - RNA, 24 nt, Human
ccccaccuacucuucccucucccu

SEQ ID NO: 605501 - RNA, 24 nt, Human
ccccagacccaggacuccagaacu

SEQ ID NO: 605502 - RNA, 26 nt, Human
ccccuccagcaaugucaacucugccu

SEQ ID NO: 605503 - RNA, 25 nt, Human
ccccugcuccagccuguugccacag

SEQ ID NO: 605504 - RNA, 23 nt, Human
cccgaguagcugggauuacaggc

SEQ ID NO: 605505 - RNA, 20 nt, Human
cccggccccaccuacucuuc

SEQ ID NO: 605506 - RNA, 18 nt, Human
cccucucccuuucauucc

SEQ ID NO: 605507 - RNA, 24 nt, Human
cccucucccuuucauucccuucua

SEQ ID NO: 605508 - RNA, 21 nt, Human
ccgcccucuacacccagaucu

SEQ ID NO: 605509 - RNA, 26 nt, Human
ccgccugccucagccucccaaagugc

SEQ ID NO: 605510 - RNA, 19 nt, Human
ccggccccaccuacucuuc

SEQ ID NO: 605511 - RNA, 23 nt, Human
ccuagagaagcaaucauccccau

SEQ ID NO: 605512 - RNA, 22 nt, Human
ccuagucccgaccuccugagga

SEQ ID NO: 605513 - RNA, 19 nt, Human
ccuccaccuccuggguuca

SEQ ID NO: 605514 - RNA, 19 nt, Human
ccucucccacccuaguccc

SEQ ID NO: 605515 - RNA, 18 nt, Human
ccugaccucaggugaccc

SEQ ID NO: 605516 - RNA, 21 nt, Human
ccugaccucaggugacccgcc

SEQ ID NO: 605517 - RNA, 23 nt, Human
ccugaccucaggugacccgccug

SEQ ID NO: 605518 - RNA, 23 nt, Human
ccugccucagccucccgaguagc

SEQ ID NO: 605519 - RNA, 21 nt, Human
ccugggaugaaacccaccagg

SEQ ID NO: 605520 - RNA, 23 nt, Human
ccuggguucaagcgagucucccc

SEQ ID NO: 605521 - RNA, 23 nt, Human
ccuggguucaagcgagucuccug

SEQ ID NO: 605522 - RNA, 21 nt, Human
ccuucaggacauggccugcag

SEQ ID NO: 605523 - RNA, 18 nt, Human
ccuucuagcacucugguc

SEQ ID NO: 605524 - RNA, 21 nt, Human
cgaggggcaagccugaggagu

SEQ ID NO: 605525 - RNA, 22 nt, Human
cggcagggaggcggcaacggcc

SEQ ID NO: 605526 - RNA, 21 nt, Human
cggugaacagugagaccagga

SEQ ID NO: 605527 - RNA, 27 nt, Human
cucaccacaaccuccaccuccuggguu

SEQ ID NO: 605528 - RNA, 24 nt, Human
cucacucugucgccuaggcuggag

SEQ ID NO: 605529 - RNA, 24 nt, Human
cucagccucccgaguagcugggau

SEQ ID NO: 605530 - RNA, 19 nt, Human
cuccagccuguugccacag

SEQ ID NO: 605531 - RNA, 18 nt, Human
cuccccaggguucugugc

SEQ ID NO: 605532 - RNA, 26 nt, Human
cuccugaccucaggugacccgccugc

SEQ ID NO: 605533 - RNA, 21 nt, Human
cuccugugguuucaugauucu

SEQ ID NO: 605534 - RNA, 23 nt, Human
cucugucgccuaggcuggagugc

SEQ ID NO: 605535 - RNA, 22 nt, Human
cugaagccgcccucuacaccca

SEQ ID NO: 605536 - RNA, 27 nt, Human
cugcccaucaagagcagcgcaaagugc

SEQ ID NO: 605537 - RNA, 23 nt, Human
cugccucagccucccaaagugcu

SEQ ID NO: 605538 - RNA, 23 nt, Human
cugccucagccucccgaguagcu

SEQ ID NO: 605539 - RNA, 25 nt, Human
cugcuccagccuguugccacagggu

SEQ ID NO: 605540 - RNA, 21 nt, Human
cugcugcccaucaagagcagc

SEQ ID NO: 605541 - RNA, 22 nt, Human
cuggcacgugcagggcugggga

SEQ ID NO: 605542 - RNA, 21 nt, Human
cuguguacacaggcuccugca

SEQ ID NO: 605543 - RNA, 19 nt, Human
gacaccagagagaaaagca

SEQ ID NO: 605544 - RNA, 21 nt, Human
gaccaacagaccuccacgaga

SEQ ID NO: 605545 - RNA, 24 nt, Human
gaccucaggugacccgccugccuc

SEQ ID NO: 605546 - RNA, 21 nt, Human
gacgagggcuggcagacaaga

SEQ ID NO: 605547 - RNA, 19 nt, Human
gagaggaggagcagcugau

SEQ ID NO: 605548 - RNA, 19 nt, Human
gaggggcaagccugaggag

SEQ ID NO: 605549 - RNA, 23 nt, Human
gaguagcugggauuacaggccac

SEQ ID NO: 605550 - RNA, 21 nt, Human
gagugcaauggcgugaucuca

SEQ ID NO: 605551 - RNA, 18 nt, Human
gauuacagguguaagcca

SEQ ID NO: 605552 - RNA, 23 nt, Human
gauuacagguguaagccaccgca

SEQ ID NO: 605553 - RNA, 19 nt, Human
gcaaaccccagacccagga

SEQ ID NO: 605554 - RNA, 20 nt, Human
gcaaggcccucucuaaggag

SEQ ID NO: 605555 - RNA, 20 nt, Human
gccauguugaccaggcuggu

SEQ ID NO: 605556 - RNA, 25 nt, Human
gccccaccuacucuucccucucccu

SEQ ID NO: 605557 - RNA, 22 nt, Human
gcccuguguacacaggcuccug

SEQ ID NO: 605558 - RNA, 20 nt, Human
gccuaggcuggagugcaaug

SEQ ID NO: 605559 - RNA, 20 nt, Human
gccuaggcuggagugcaaug

SEQ ID NO: 605560 - RNA, 24 nt, Human
gccuaggcuggagugcaauggcgu

SEQ ID NO: 605561 - RNA, 21 nt, Human
gccucagccucccaaagugcu

SEQ ID NO: 605562 - RNA, 24 nt, Human
gcgagucuccugccucagccuccc

SEQ ID NO: 605563 - RNA, 20 nt, Human
gcgguggcugcaacagcggc

SEQ ID NO: 605564 - RNA, 23 nt, Human
gcuggucuugaacuccugaccuc

SEQ ID NO: 605565 - RNA, 22 nt, Human
ggauuacagguguaagccaccg

SEQ ID NO: 605566 - RNA, 21 nt, Human
ggcagacaagaacaagcagaa

SEQ ID NO: 605567 - RNA, 20 nt, Human
ggcggcaacggcgguggcug

SEQ ID NO: 605568 - RNA, 22 nt, Human
ggcuggagugcaauggcgugau

SEQ ID NO: 605569 - RNA, 24 nt, Human
ggcuggucuugaacuccugaccuc

SEQ ID NO: 605570 - RNA, 18 nt, Human
gggaaguggagaaagaug

SEQ ID NO: 605571 - RNA, 22 nt, Human
gggcuggggaggccacagcucc

SEQ ID NO: 605572 - RNA, 22 nt, Human
gggcuuuugccauguugaccag

SEQ ID NO: 605573 - RNA, 22 nt, Human
ggguagaggugagaggcagggg

SEQ ID NO: 605574 - RNA, 19 nt, Human
ggucuugaacuccugaccu

SEQ ID NO: 605575 - RNA, 24 nt, Human
ggugaacagugagaccaggaaaga

SEQ ID NO: 605576 - RNA, 23 nt, Human
guagagaugggcuuuugccaugu

SEQ ID NO: 605577 - RNA, 18 nt, Human
guagcugggauuacaggc

SEQ ID NO: 605578 - RNA, 19 nt, Human
guccccuugagugagaggu

SEQ ID NO: 605579 - RNA, 24 nt, Human
gugacccgccugccucagccuccc

SEQ ID NO: 605580 - RNA, 24 nt, Human
guggcugcaacagcggcggcagca

SEQ ID NO: 605581 - RNA, 18 nt, Human
uaaacauuccauuugucc

SEQ ID NO: 605582 - RNA, 24 nt, Human
uaaagcugcaaggcccucucuaag

SEQ ID NO: 605583 - RNA, 19 nt, Human
uaacagcaauuccaacugc

SEQ ID NO: 605584 - RNA, 25 nt, Human
uaauuuuuguauuuuuuaguagaga

SEQ ID NO: 605585 - RNA, 24 nt, Human
uacagguguaagccaccgcacuca

SEQ ID NO: 605586 - RNA, 22 nt, Human
uagagaugggcuuuugccaugu

SEQ ID NO: 605587 - RNA, 24 nt, Human
uaguagagaugggcuuuugccaug

SEQ ID NO: 605588 - RNA, 24 nt, Human
ucaccacaaccuccaccuccuggg

SEQ ID NO: 605589 - RNA, 27 nt, Human
ucaccacaaccuccaccuccuggguuc

SEQ ID NO: 605590 - RNA, 24 nt, Human
ucacucugucgccuaggcuggagu

SEQ ID NO: 605591 - RNA, 19 nt, Human
ucacugaggcagcgagggg

SEQ ID NO: 605592 - RNA, 23 nt, Human
ucagagggaccaacagaccucca

SEQ ID NO: 605593 - RNA, 20 nt, Human
ucagccucccgaguagcugg

SEQ ID NO: 605594 - RNA, 21 nt, Human
ucaugauucuuaggaguccac

SEQ ID NO: 605595 - RNA, 18 nt, Human
uccacacacuugccggca

SEQ ID NO: 605596 - RNA, 23 nt, Human
ucccaaagugcugggauuacagg

SEQ ID NO: 605597 - RNA, 24 nt, Human
ucccaacaugagcccacuccauga

SEQ ID NO: 605598 - RNA, 24 nt, Human
ucccagagucagcuggucccaaca

SEQ ID NO: 605599 - RNA, 24 nt, Human
uccccacagcagagcucagggaua

SEQ ID NO: 605600 - RNA, 20 nt, Human
uccccaggguucugugcucc

SEQ ID NO: 605601 - RNA, 23 nt, Human
uccccauggcgggucccaagaac

SEQ ID NO: 605602 - RNA, 24 nt, Human
ucccgaguagcugggauuacaggc

SEQ ID NO: 605603 - RNA, 23 nt, Human
uccuaggagaggaggagcagcug

SEQ ID NO: 605604 - RNA, 18 nt, Human
uccuaugagagaagagga

SEQ ID NO: 605605 - RNA, 21 nt, Human
uccuggguucaagcgagucuc

SEQ ID NO: 605606 - RNA, 24 nt, Human
uccuggguucaagcgagucuccug

SEQ ID NO: 605607 - RNA, 18 nt, Human
ucgccuaggcuggagugc

SEQ ID NO: 605608 - RNA, 20 nt, Human
ucuagcacucuggucuccua

SEQ ID NO: 605609 - RNA, 23 nt, Human
ucucacucugucgccuaggcugg

SEQ ID NO: 605610 - RNA, 24 nt, Human
ucucacucugucgccuaggcugga

SEQ ID NO: 605611 - RNA, 23 nt, Human
ucucagauagugccucucccacc

SEQ ID NO: 605612 - RNA, 24 nt, Human
ucuccugccucagccucccgagua

SEQ ID NO: 605613 - RNA, 21 nt, Human
ucucuaaggaguucccagucc

SEQ ID NO: 605614 - RNA, 21 nt, Human
ucucugaagagggaggguggc

SEQ ID NO: 605615 - RNA, 19 nt, Human
ucugaagagggaggguggc

SEQ ID NO: 605616 - RNA, 19 nt, Human
ucugaggacacccggugaa

SEQ ID NO: 605617 - RNA, 24 nt, Human
ucugucgccuaggcuggagugcaa

SEQ ID NO: 605618 - RNA, 23 nt, Human
ucuugaacuccugaccucaggug

SEQ ID NO: 605619 - RNA, 24 nt, Human
ugaccaggcuggucuugaacuccu

SEQ ID NO: 605620 - RNA, 18 nt, Human
ugacccgccugccucagc

SEQ ID NO: 605621 - RNA, 18 nt, Human
ugaccucaggugacccgc

SEQ ID NO: 605622 - RNA, 24 nt, Human
ugagacuaagaacagagguauuug

SEQ ID NO: 605623 - RNA, 20 nt, Human
ugagagaagaggaaggcuuu

SEQ ID NO: 605624 - RNA, 19 nt, Human
ugagcagaugcugagguca

SEQ ID NO: 605625 - RNA, 23 nt, Human
ugaggcagcgaggggcaagccug

SEQ ID NO: 605626 - RNA, 22 nt, Human
ugauaccacuucuccccagggu

SEQ ID NO: 605627 - RNA, 24 nt, Human
ugccauguugaccaggcuggucuu

SEQ ID NO: 605628 - RNA, 27 nt, Human
ugccauguugaccaggcuggucuugaa

SEQ ID NO: 605629 - RNA, 24 nt, Human
ugccucagccucccaaagugcugg

SEQ ID NO: 605630 - RNA, 24 nt, Human
ugccucagccucccgaguagcugg

SEQ ID NO: 605631 - RNA, 19 nt, Human
ugccugggaugaaacccac

SEQ ID NO: 605632 - RNA, 26 nt, Human
ugccugggaugaaacccaccaggagc

SEQ ID NO: 605633 - RNA, 24 nt, Human
ugcuccagccuguugccacagggu

SEQ ID NO: 605634 - RNA, 25 nt, Human
ugcuccagccuguugccacagggug

SEQ ID NO: 605635 - RNA, 24 nt, Human
ugcugggauuacagguguaagcca

SEQ ID NO: 605636 - RNA, 21 nt, Human
uggaaagagacaacguagacu

SEQ ID NO: 605637 - RNA, 24 nt, Human
uggaaaugaaugggcucaagacca

SEQ ID NO: 605638 - RNA, 24 nt, Human
uggacauaaacauuccauuugucc

SEQ ID NO: 605639 - RNA, 19 nt, Human
uggagugcaauggcgugau

SEQ ID NO: 605640 - RNA, 24 nt, Human
uggagugcaauggcgugaucucag

SEQ ID NO: 605641 - RNA, 22 nt, Human
uggcaccaagcacccauugacc

SEQ ID NO: 605642 - RNA, 19 nt, Human
uggcacgugcagggcuggg

SEQ ID NO: 605643 - RNA, 19 nt, Human
uggcccggcugggccacgg

SEQ ID NO: 605644 - RNA, 24 nt, Human
uggcgugaucucagcucaccacaa

SEQ ID NO: 605645 - RNA, 18 nt, Human
uggcugcaacagcggcgg

SEQ ID NO: 605646 - RNA, 19 nt, Human
uggcuguggggaggugugc

SEQ ID NO: 605647 - RNA, 23 nt, Human
uggcuuuuuuucccuggaagagg

SEQ ID NO: 605648 - RNA, 21 nt, Human
ugggauuacaggccacaacca

SEQ ID NO: 605649 - RNA, 22 nt, Human
ugggauuacaggccacaaccac

SEQ ID NO: 605650 - RNA, 18 nt, Human
ugggauuacagguguaag

SEQ ID NO: 605651 - RNA, 19 nt, Human
ugggauuacagguguaagc

SEQ ID NO: 605652 - RNA, 21 nt, Human
ugggauuacagguguaagcca

SEQ ID NO: 605653 - RNA, 22 nt, Human
ugggauuacagguguaagccac

SEQ ID NO: 605654 - RNA, 23 nt, Human
ugggauuacagguguaagccacc

SEQ ID NO: 605655 - RNA, 24 nt, Human
ugggauuacagguguaagccaccg

SEQ ID NO: 605656 - RNA, 23 nt, Human
ugggcagagggugggaugugagc

SEQ ID NO: 605657 - RNA, 23 nt, Human
ugggccacggcaguggcacuagu

SEQ ID NO: 605658 - RNA, 24 nt, Human
ugggcuuuugccauguugaccagg

SEQ ID NO: 605659 - RNA, 19 nt, Human
uggggaccagcaaacccca

SEQ ID NO: 605660 - RNA, 22 nt, Human
uuaacagcaauuccaacugcgc

SEQ ID NO: 605661 - RNA, 18 nt, Human
uuaguagagaugggcuuu

SEQ ID NO: 605662 - RNA, 24 nt, Human
uuaguagagaugggcuuuugccau

SEQ ID NO: 605663 - RNA, 19 nt, Human
uugaaaguggcucugagag

SEQ ID NO: 605664 - RNA, 21 nt, Human
uuggggaccagcaaaccccag

SEQ ID NO: 605665 - RNA, 23 nt, Human
uuucugcugcagccugagcuaug

SEQ ID NO: 605666 - RNA, 24 nt, Human
uuugggguagaggugagaggcagg

SEQ ID NO: 605667 - RNA, 23 nt, Human
uuuugccauguugaccaggcugg

SEQ ID NO: 605668 - RNA, 24 nt, Human
uuuuuaguagagaugggcuuuugc

SEQ ID NO: 605669 - RNA, 21 nt, Human
uuuuuguauuuuuuaguagag

SEQ ID NO: 605670 - RNA, 21 nt, Human
uuuuuuaguagagaugggcuu

SEQ ID NO: 605671 - RNA, 20 nt, Human
accacagccacccucuucuc

SEQ ID NO: 605672 - RNA, 21 nt, Human
accuggccacuugucaggagc

SEQ ID NO: 605673 - RNA, 22 nt, Human
agaggcaggggcacagaggcag

SEQ ID NO: 605674 - RNA, 22 nt, Human
agcacgcccaccacagccaccc

SEQ ID NO: 605675 - RNA, 24 nt, Human
agcaguaggagacccucaugcagg

SEQ ID NO: 605676 - RNA, 22 nt, Human
aggcaggaaaggauggccagag

SEQ ID NO: 605677 - RNA, 22 nt, Human
aggcaggggagggagcuuacgg

SEQ ID NO: 605678 - RNA, 22 nt, Human
aggcugcagggcaggcuccagc

SEQ ID NO: 605679 - RNA, 24 nt, Human
agggagggagccgcaguccucagg

SEQ ID NO: 605680 - RNA, 18 nt, Human
aguccucaggggaaggga

SEQ ID NO: 605681 - RNA, 19 nt, Human
auggagcgugcugcugucc

SEQ ID NO: 605682 - RNA, 20 nt, Human
caaaggcccuagaacccuuc

SEQ ID NO: 605683 - RNA, 23 nt, Human
caccccaccuaccacugcccacc

SEQ ID NO: 605684 - RNA, 22 nt, Human
caccccagcacugccgcagacc

SEQ ID NO: 605685 - RNA, 22 nt, Human
cacccucccagaccucaagcca

SEQ ID NO: 605686 - RNA, 21 nt, Human
cacccucuucuccaggcugca

SEQ ID NO: 605687 - RNA, 21 nt, Human
cacugcagcaaggggcagagc

SEQ ID NO: 605688 - RNA, 18 nt, Human
cagcaaggugggcucacu

SEQ ID NO: 605689 - RNA, 23 nt, Human
cagcgugggacuggaggcccagg

SEQ ID NO: 605690 - RNA, 22 nt, Human
caggcuccagcuccccaugggg

SEQ ID NO: 605691 - RNA, 19 nt, Human
cagggagauggcacagcag

SEQ ID NO: 605692 - RNA, 20 nt, Human
cagggcaggcuccagcuccc

SEQ ID NO: 605693 - RNA, 18 nt, Human
cagggccccuggcuuuac

SEQ ID NO: 605694 - RNA, 25 nt, Human
ccaaaggcaagcuccagcuccagac

SEQ ID NO: 605695 - RNA, 22 nt, Human
ccacccaaaggcccuagaaccc

SEQ ID NO: 605696 - RNA, 22 nt, Human
ccacugcccaccuggugccacc

SEQ ID NO: 605697 - RNA, 24 nt, Human
ccacugcccaccuggugccacccc

SEQ ID NO: 605698 - RNA, 18 nt, Human
ccagcuccagaccaggca

SEQ ID NO: 605699 - RNA, 23 nt, Human
ccaggcauugggccagccgugcc

SEQ ID NO: 605700 - RNA, 18 nt, Human
ccaggggucugcaugugu

SEQ ID NO: 605701 - RNA, 21 nt, Human
ccaugcgggcaaaugaccaag

SEQ ID NO: 605702 - RNA, 20 nt, Human
cccaccacagccacccucuu

SEQ ID NO: 605703 - RNA, 18 nt, Human
cccagagccaccuggcca

SEQ ID NO: 605704 - RNA, 20 nt, Human
ccccagcacugccgcagacc

SEQ ID NO: 605705 - RNA, 20 nt, Human
ccccaucaggccagggcccc

SEQ ID NO: 605706 - RNA, 19 nt, Human
ccccugaccuaggcacggg

SEQ ID NO: 605707 - RNA, 23 nt, Human
cccgggcccuccccacccaaagg

SEQ ID NO: 605708 - RNA, 19 nt, Human
cccucagaaccaauguugc

SEQ ID NO: 605709 - RNA, 27 nt, Human
cccucccagaccucaagccaccccacc

SEQ ID NO: 605710 - RNA, 19 nt, Human
cccugaguccuggcuuucc

SEQ ID NO: 605711 - RNA, 21 nt, Human
cccugaguccuggcuuuccug

SEQ ID NO: 605712 - RNA, 27 nt, Human
ccuagaacccuagccuucaauccuggg

SEQ ID NO: 605713 - RNA, 22 nt, Human
ccucagaaccaauguugcagca

SEQ ID NO: 605714 - RNA, 19 nt, Human
ccuccccacccaaaggccc

SEQ ID NO: 605715 - RNA, 27 nt, Human
ccuccccacccaaaggcccuagaaccc

SEQ ID NO: 605716 - RNA, 24 nt, Human
ccucuucuccaggcugcagggcag

SEQ ID NO: 605717 - RNA, 18 nt, Human
ccuggcccagcagcuccu

SEQ ID NO: 605718 - RNA, 18 nt, Human
cgggcccuccccacccaa

SEQ ID NO: 605719 - RNA, 24 nt, Human
cggggcaggagggcccagagccac

SEQ ID NO: 605720 - RNA, 24 nt, Human
cucccaaguccugcccccugcauu

SEQ ID NO: 605721 - RNA, 18 nt, Human
cuccccaugggggcccca

SEQ ID NO: 605722 - RNA, 21 nt, Human
cucccccgccugcuggaaccu

SEQ ID NO: 605723 - RNA, 19 nt, Human
cuccuuaggcugacccuga

SEQ ID NO: 605724 - RNA, 20 nt, Human
cugcagcaguuggggccagc

SEQ ID NO: 605725 - RNA, 19 nt, Human
cugcauguguccuggcugg

SEQ ID NO: 605726 - RNA, 19 nt, Human
cugcucacuggggagggag

SEQ ID NO: 605727 - RNA, 19 nt, Human
cuuggaccaagcagucaac

SEQ ID NO: 605728 - RNA, 18 nt, Human
gacagguggaggggccaa

SEQ ID NO: 605729 - RNA, 18 nt, Human
gaccucaagccaccccac

SEQ ID NO: 605730 - RNA, 18 nt, Human
gagacccucaugcaggag

SEQ ID NO: 605731 - RNA, 23 nt, Human
gagaggcaggggcacagaggcag
